United States Patent 8,673,560 (METHODS AND COMPOSITIONS FOR MULTIPLEX PCR) - sequence listing, part 2

SEQ ID NO: 29501 - DNA, 20 bp, Artificial Sequence
  Synthetic
gctgagcaguctggaugagg

SEQ ID NO: 29502 - DNA, 23 bp, Artificial Sequence
  Synthetic
gtcttttccuctgactgtgcuct

SEQ ID NO: 29503 - DNA, 27 bp, Artificial Sequence
  Synthetic
cagtgtatauaggagagtgtgtgctug

SEQ ID NO: 29504 - DNA, 20 bp, Artificial Sequence
  Synthetic
gggcuagagaugacccacat

SEQ ID NO: 29505 - DNA, 19 bp, Artificial Sequence
  Synthetic
aggtguccagctgcgatug

SEQ ID NO: 29506 - DNA, 21 bp, Artificial Sequence
  Synthetic
cacttacaccaccugcctcut

SEQ ID NO: 29507 - DNA, 20 bp, Artificial Sequence
  Synthetic
tggcuagaggccactcaugt

SEQ ID NO: 29508 - DNA, 22 bp, Artificial Sequence
  Synthetic
cauctacatccugagggacgac

SEQ ID NO: 29509 - DNA, 20 bp, Artificial Sequence
  Synthetic
ctttgcacaaugccctguct

SEQ ID NO: 29510 - DNA, 22 bp, Artificial Sequence
  Synthetic
gggtugttgaacttuggaggct

SEQ ID NO: 29511 - DNA, 21 bp, Artificial Sequence
  Synthetic
cacguccaggacgttgtagut

SEQ ID NO: 29512 - DNA, 18 bp, Artificial Sequence
  Synthetic
ggccugagacgtcagcut

SEQ ID NO: 29513 - DNA, 19 bp, Artificial Sequence
  Synthetic
gcccagugaagggccugag

SEQ ID NO: 29514 - DNA, 20 bp, Artificial Sequence
  Synthetic
ctggaagggcaccugtcuac

SEQ ID NO: 29515 - DNA, 19 bp, Artificial Sequence
  Synthetic
gcccctugtgatgccugac

SEQ ID NO: 29516 - DNA, 21 bp, Artificial Sequence
  Synthetic
tcagatgtccgugtaccccut

SEQ ID NO: 29517 - DNA, 20 bp, Artificial Sequence
  Synthetic
ctttttgcaccauccgcugt

SEQ ID NO: 29518 - DNA, 17 bp, Artificial Sequence
  Synthetic
ggcauggcccugagcat

SEQ ID NO: 29519 - DNA, 19 bp, Artificial Sequence
  Synthetic
ggcccttcuggtcttccuc

SEQ ID NO: 29520 - DNA, 21 bp, Artificial Sequence
  Synthetic
ccctggagaucacagagcugt

SEQ ID NO: 29521 - DNA, 24 bp, Artificial Sequence
  Synthetic
tgaaggtagaggucagatgcugaa

SEQ ID NO: 29522 - DNA, 22 bp, Artificial Sequence
  Synthetic
tggctacaaautggacugcaac

SEQ ID NO: 29523 - DNA, 25 bp, Artificial Sequence
  Synthetic
caaagattgatgugcccttcctuac

SEQ ID NO: 29524 - DNA, 24 bp, Artificial Sequence
  Synthetic
cgacagtgccuaagacagaaatuc

SEQ ID NO: 29525 - DNA, 28 bp, Artificial Sequence
  Synthetic
gctgatcaacaaaugaaaagacaccuac

SEQ ID NO: 29526 - DNA, 27 bp, Artificial Sequence
  Synthetic
tgcacttaaaugcagattatttuggag

SEQ ID NO: 29527 - DNA, 27 bp, Artificial Sequence
  Synthetic
caccaaggaguctagtgatctacauga

SEQ ID NO: 29528 - DNA, 24 bp, Artificial Sequence
  Synthetic
gactattctcuccttcccgcttut

SEQ ID NO: 29529 - DNA, 23 bp, Artificial Sequence
  Synthetic
caccugtaaatactugccacagc

SEQ ID NO: 29530 - DNA, 19 bp, Artificial Sequence
  Synthetic
ccctguggacggtgactug

SEQ ID NO: 29531 - DNA, 22 bp, Artificial Sequence
  Synthetic
caucctcagaaaugcagcaagg

SEQ ID NO: 29532 - DNA, 25 bp, Artificial Sequence
  Synthetic
gtcttucaggagtcguaagaaagca

SEQ ID NO: 29533 - DNA, 26 bp, Artificial Sequence
  Synthetic
acctugaacacgagaaatgaugaaca

SEQ ID NO: 29534 - DNA, 27 bp, Artificial Sequence
  Synthetic
tgaaaattgucacgaaacaatgagcut

SEQ ID NO: 29535 - DNA, 20 bp, Artificial Sequence
  Synthetic
cagtgcccugagcaauagca

SEQ ID NO: 29536 - DNA, 26 bp, Artificial Sequence
  Synthetic
ctgtacctgtucacattcagacucaa

SEQ ID NO: 29537 - DNA, 22 bp, Artificial Sequence
  Synthetic
ctcccttcuttgtctcaugggt

SEQ ID NO: 29538 - DNA, 25 bp, Artificial Sequence
  Synthetic
gctacctagaautgaacacgucaga

SEQ ID NO: 29539 - DNA, 29 bp, Artificial Sequence
  Synthetic
cagcggtugacatctaatattugacaaaa

SEQ ID NO: 29540 - DNA, 21 bp, Artificial Sequence
  Synthetic
gcagacgucgttacaatcgug

SEQ ID NO: 29541 - DNA, 24 bp, Artificial Sequence
  Synthetic
ccattattgtuccctgatcugcaa

SEQ ID NO: 29542 - DNA, 21 bp, Artificial Sequence
  Synthetic
attcagatgguccggcaagut

SEQ ID NO: 29543 - DNA, 28 bp, Artificial Sequence
  Synthetic
cctcactagccutgtcaaaaatgaaaut

SEQ ID NO: 29544 - DNA, 22 bp, Artificial Sequence
  Synthetic
aaatgugctacacuggacacca

SEQ ID NO: 29545 - DNA, 21 bp, Artificial Sequence
  Synthetic
ggcaaagaaccacucaccugt

SEQ ID NO: 29546 - DNA, 27 bp, Artificial Sequence
  Synthetic
tggtatatcttguccagcaaccattut

SEQ ID NO: 29547 - DNA, 25 bp, Artificial Sequence
  Synthetic
ggcatttacgaaucacttctucagg

SEQ ID NO: 29548 - DNA, 29 bp, Artificial Sequence
  Synthetic
caagatggttgaaucccaagatguaaaaa

SEQ ID NO: 29549 - DNA, 28 bp, Artificial Sequence
  Synthetic
agttcccagcutgtatcctaauaagagt

SEQ ID NO: 29550 - DNA, 20 bp, Artificial Sequence
  Synthetic
gccaagaagugccccttcuc

SEQ ID NO: 29551 - DNA, 17 bp, Artificial Sequence
  Synthetic
cggcgcgugctguagat

SEQ ID NO: 29552 - DNA, 21 bp, Artificial Sequence
  Synthetic
tctggagugtaggauggcact

SEQ ID NO: 29553 - DNA, 22 bp, Artificial Sequence
  Synthetic
ccttcctcugcctatctgucca

SEQ ID NO: 29554 - DNA, 20 bp, Artificial Sequence
  Synthetic
cagggtcugaagccacucaa

SEQ ID NO: 29555 - DNA, 18 bp, Artificial Sequence
  Synthetic
gaaaccugggcgugacct

SEQ ID NO: 29556 - DNA, 19 bp, Artificial Sequence
  Synthetic
cucagcccuacaccatcuc

SEQ ID NO: 29557 - DNA, 19 bp, Artificial Sequence
  Synthetic
gtcctagtgugggctgcuc

SEQ ID NO: 29558 - DNA, 17 bp, Artificial Sequence
  Synthetic
ccgtggcugaccacugt

SEQ ID NO: 29559 - DNA, 18 bp, Artificial Sequence
  Synthetic
tggguctgcucacaggga

SEQ ID NO: 29560 - DNA, 22 bp, Artificial Sequence
  Synthetic
gggagctguagcttccauaagg

SEQ ID NO: 29561 - DNA, 18 bp, Artificial Sequence
  Synthetic
tggcaggugggctacuca

SEQ ID NO: 29562 - DNA, 22 bp, Artificial Sequence
  Synthetic
agatgctcacagucccccauat

SEQ ID NO: 29563 - DNA, 22 bp, Artificial Sequence
  Synthetic
aagggagaaacucactggctug

SEQ ID NO: 29564 - DNA, 19 bp, Artificial Sequence
  Synthetic
caggguggccacucacaat

SEQ ID NO: 29565 - DNA, 21 bp, Artificial Sequence
  Synthetic
cuccactaugggcaggagaga

SEQ ID NO: 29566 - DNA, 21 bp, Artificial Sequence
  Synthetic
ccaggtgugaactggtgtcug

SEQ ID NO: 29567 - DNA, 22 bp, Artificial Sequence
  Synthetic
caatggcccautctgacaucat

SEQ ID NO: 29568 - DNA, 18 bp, Artificial Sequence
  Synthetic
tcccutctcuggccccaa

SEQ ID NO: 29569 - DNA, 18 bp, Artificial Sequence
  Synthetic
gcagggcugggtgatgug

SEQ ID NO: 29570 - DNA, 17 bp, Artificial Sequence
  Synthetic
cugaccgugcccaggag

SEQ ID NO: 29571 - DNA, 17 bp, Artificial Sequence
  Synthetic
tgcugagcccccaagug

SEQ ID NO: 29572 - DNA, 31 bp, Artificial Sequence
  Synthetic
gaaccuttaatagaaatuggacagcaagaaa

SEQ ID NO: 29573 - DNA, 21 bp, Artificial Sequence
  Synthetic
agtccaagcuaggccctttug

SEQ ID NO: 29574 - DNA, 21 bp, Artificial Sequence
  Synthetic
cuaaaggcacugagcacttuc

SEQ ID NO: 29575 - DNA, 22 bp, Artificial Sequence
  Synthetic
ggcactgacuctctctgccuat

SEQ ID NO: 29576 - DNA, 21 bp, Artificial Sequence
  Synthetic
ccaccagacutagggcctcua

SEQ ID NO: 29577 - DNA, 23 bp, Artificial Sequence
  Synthetic
agttcgauaagccagagaagcug

SEQ ID NO: 29578 - DNA, 18 bp, Artificial Sequence
  Synthetic
tguccctcugcaccccat

SEQ ID NO: 29579 - DNA, 17 bp, Artificial Sequence
  Synthetic
gctgtugcccccactug

SEQ ID NO: 29580 - DNA, 23 bp, Artificial Sequence
  Synthetic
ccatcctuacagggtcctugagt

SEQ ID NO: 29581 - DNA, 19 bp, Artificial Sequence
  Synthetic
gggctttcugtgccactuc

SEQ ID NO: 29582 - DNA, 20 bp, Artificial Sequence
  Synthetic
tcatctgguggctgtgggua

SEQ ID NO: 29583 - DNA, 20 bp, Artificial Sequence
  Synthetic
cggtgccugcttctctctut

SEQ ID NO: 29584 - DNA, 22 bp, Artificial Sequence
  Synthetic
cacactccuccttggactctuc

SEQ ID NO: 29585 - DNA, 22 bp, Artificial Sequence
  Synthetic
tggtggcugaggacagaacuaa

SEQ ID NO: 29586 - DNA, 21 bp, Artificial Sequence
  Synthetic
cctaucagaggccaggguaga

SEQ ID NO: 29587 - DNA, 23 bp, Artificial Sequence
  Synthetic
gagctatguggaccaacactgut

SEQ ID NO: 29588 - DNA, 24 bp, Artificial Sequence
  Synthetic
gtacaccaaacugcacatugcaaa

SEQ ID NO: 29589 - DNA, 23 bp, Artificial Sequence
  Synthetic
cctatgtcacaccugtgttccuc

SEQ ID NO: 29590 - DNA, 20 bp, Artificial Sequence
  Synthetic
ggtccgaggugtctcuggaa

SEQ ID NO: 29591 - DNA, 25 bp, Artificial Sequence
  Synthetic
caaatgaguaactcttcctcuggct

SEQ ID NO: 29592 - DNA, 21 bp, Artificial Sequence
  Synthetic
cagtctctuggccacctucag

SEQ ID NO: 29593 - DNA, 23 bp, Artificial Sequence
  Synthetic
ccaaatcacuctctgcctgugaa

SEQ ID NO: 29594 - DNA, 21 bp, Artificial Sequence
  Synthetic
cugugagaagaucagcaacga

SEQ ID NO: 29595 - DNA, 21 bp, Artificial Sequence
  Synthetic
cugattcacccucagagggat

SEQ ID NO: 29596 - DNA, 23 bp, Artificial Sequence
  Synthetic
ttctagcagaaccuttgcaucca

SEQ ID NO: 29597 - DNA, 21 bp, Artificial Sequence
  Synthetic
cgtttgtugctgccttuccag

SEQ ID NO: 29598 - DNA, 20 bp, Artificial Sequence
  Synthetic
cccaagggaacutgcacuca

SEQ ID NO: 29599 - DNA, 23 bp, Artificial Sequence
  Synthetic
gtgttccucctctttggugacag

SEQ ID NO: 29600 - DNA, 20 bp, Artificial Sequence
  Synthetic
agacagtucctccccuccac

SEQ ID NO: 29601 - DNA, 23 bp, Artificial Sequence
  Synthetic
tcugagaacaagccccugagaat

SEQ ID NO: 29602 - DNA, 21 bp, Artificial Sequence
  Synthetic
cctaccccutccctttgtuga

SEQ ID NO: 29603 - DNA, 22 bp, Artificial Sequence
  Synthetic
tgttggtcugtcccatttgugt

SEQ ID NO: 29604 - DNA, 25 bp, Artificial Sequence
  Synthetic
ctctatgttatucagtgggacaugg

SEQ ID NO: 29605 - DNA, 19 bp, Artificial Sequence
  Synthetic
cggugggacacgcctaaug

SEQ ID NO: 29606 - DNA, 22 bp, Artificial Sequence
  Synthetic
gutttgggcctuagaggaccat

SEQ ID NO: 29607 - DNA, 18 bp, Artificial Sequence
  Synthetic
cctctccccucccctcug

SEQ ID NO: 29608 - DNA, 21 bp, Artificial Sequence
  Synthetic
ccuacccccaagagauggaga

SEQ ID NO: 29609 - DNA, 21 bp, Artificial Sequence
  Synthetic
gtcacgcucctcccacuaaac

SEQ ID NO: 29610 - DNA, 21 bp, Artificial Sequence
  Synthetic
gaagatgttcucccaggcgua

SEQ ID NO: 29611 - DNA, 20 bp, Artificial Sequence
  Synthetic
cagaagccuctcccctcuga

SEQ ID NO: 29612 - DNA, 22 bp, Artificial Sequence
  Synthetic
cttccccucagcccatctagua

SEQ ID NO: 29613 - DNA, 27 bp, Artificial Sequence
  Synthetic
gaatgtgaaacacuctgctctcattuc

SEQ ID NO: 29614 - DNA, 24 bp, Artificial Sequence
  Synthetic
caagtacctguattgctcctcuca

SEQ ID NO: 29615 - DNA, 23 bp, Artificial Sequence
  Synthetic
attttgcuggcaatgacagucac

SEQ ID NO: 29616 - DNA, 21 bp, Artificial Sequence
  Synthetic
gaagacgucgttctcctuccc

SEQ ID NO: 29617 - DNA, 21 bp, Artificial Sequence
  Synthetic
gaattagcccucaggcacuct

SEQ ID NO: 29618 - DNA, 20 bp, Artificial Sequence
  Synthetic
catccaccaguaggtgccut

SEQ ID NO: 29619 - DNA, 22 bp, Artificial Sequence
  Synthetic
ggtagggaguggtgagaagtug

SEQ ID NO: 29620 - DNA, 20 bp, Artificial Sequence
  Synthetic
gauggcgtgguccaagaact

SEQ ID NO: 29621 - DNA, 21 bp, Artificial Sequence
  Synthetic
cacatgaugcacacacgtcuc

SEQ ID NO: 29622 - DNA, 23 bp, Artificial Sequence
  Synthetic
cactttccugagtccucagacag

SEQ ID NO: 29623 - DNA, 20 bp, Artificial Sequence
  Synthetic
accctcutcctccuccaagt

SEQ ID NO: 29624 - DNA, 24 bp, Artificial Sequence
  Synthetic
ggtgatgaagaguaggaagacgug

SEQ ID NO: 29625 - DNA, 17 bp, Artificial Sequence
  Synthetic
atgccccuggccttcug

SEQ ID NO: 29626 - DNA, 20 bp, Artificial Sequence
  Synthetic
ccgaggcuttgtgtucacga

SEQ ID NO: 29627 - DNA, 20 bp, Artificial Sequence
  Synthetic
agagtggguactccccctug

SEQ ID NO: 29628 - DNA, 22 bp, Artificial Sequence
  Synthetic
ctggagaaagguggctgagaut

SEQ ID NO: 29629 - DNA, 21 bp, Artificial Sequence
  Synthetic
tgcaccauccaactgagtgug

SEQ ID NO: 29630 - DNA, 21 bp, Artificial Sequence
  Synthetic
cactccaaguggtcacctgut

SEQ ID NO: 29631 - DNA, 24 bp, Artificial Sequence
  Synthetic
tccctaaggccugttttcctcuaa

SEQ ID NO: 29632 - DNA, 21 bp, Artificial Sequence
  Synthetic
gcccagaaugcaccactauca

SEQ ID NO: 29633 - DNA, 22 bp, Artificial Sequence
  Synthetic
ttggatuccgaccattcauccc

SEQ ID NO: 29634 - DNA, 23 bp, Artificial Sequence
  Synthetic
tggtcugctcctcuagagacaac

SEQ ID NO: 29635 - DNA, 26 bp, Artificial Sequence
  Synthetic
tgggtccctgutaaactaactcctua

SEQ ID NO: 29636 - DNA, 20 bp, Artificial Sequence
  Synthetic
cagtccuccactggatugcc

SEQ ID NO: 29637 - DNA, 22 bp, Artificial Sequence
  Synthetic
cttcccttauctggccatguga

SEQ ID NO: 29638 - DNA, 27 bp, Artificial Sequence
  Synthetic
ggatagtagaacaugtccaaagggaug

SEQ ID NO: 29639 - DNA, 28 bp, Artificial Sequence
  Synthetic
ctctaagcagagugacaatuacagaact

SEQ ID NO: 29640 - DNA, 20 bp, Artificial Sequence
  Synthetic
attgtgucccagggttgcut

SEQ ID NO: 29641 - DNA, 30 bp, Artificial Sequence
  Synthetic
tgtcatataaacaaugccacatctacucag

SEQ ID NO: 29642 - DNA, 19 bp, Artificial Sequence
  Synthetic
ctgaagcugggtgtcugca

SEQ ID NO: 29643 - DNA, 23 bp, Artificial Sequence
  Synthetic
ttcaccagctucctcctctttuc

SEQ ID NO: 29644 - DNA, 22 bp, Artificial Sequence
  Synthetic
gcacacugatgttcaugcacag

SEQ ID NO: 29645 - DNA, 29 bp, Artificial Sequence
  Synthetic
ccaacttttcuccaaatcaagaatucaca

SEQ ID NO: 29646 - DNA, 21 bp, Artificial Sequence
  Synthetic
ggagtgtguggcagagaucaa

SEQ ID NO: 29647 - DNA, 20 bp, Artificial Sequence
  Synthetic
ctggactgcugtggtctguc

SEQ ID NO: 29648 - DNA, 21 bp, Artificial Sequence
  Synthetic
gggaucacagtcugacccaat

SEQ ID NO: 29649 - DNA, 22 bp, Artificial Sequence
  Synthetic
ctgaaucccgagcacacattuc

SEQ ID NO: 29650 - DNA, 21 bp, Artificial Sequence
  Synthetic
gggugcatctcuagagcaagc

SEQ ID NO: 29651 - DNA, 23 bp, Artificial Sequence
  Synthetic
gttcctcaaacguctctcgcuaa

SEQ ID NO: 29652 - DNA, 19 bp, Artificial Sequence
  Synthetic
ctcccccggacuctgttug

SEQ ID NO: 29653 - DNA, 20 bp, Artificial Sequence
  Synthetic
catcaccgaccuctcctgug

SEQ ID NO: 29654 - DNA, 23 bp, Artificial Sequence
  Synthetic
gagcucctctgtcucagaacaac

SEQ ID NO: 29655 - DNA, 27 bp, Artificial Sequence
  Synthetic
gagctgtgattcugctattggatttuc

SEQ ID NO: 29656 - DNA, 21 bp, Artificial Sequence
  Synthetic
ggaattcucgggccactttuc

SEQ ID NO: 29657 - DNA, 19 bp, Artificial Sequence
  Synthetic
acgacucagcacctucgac

SEQ ID NO: 29658 - DNA, 28 bp, Artificial Sequence
  Synthetic
gctgcaaatauagggaagtaagtucaca

SEQ ID NO: 29659 - DNA, 27 bp, Artificial Sequence
  Synthetic
gcaatttcttttuccttgtggtcugat

SEQ ID NO: 29660 - DNA, 27 bp, Artificial Sequence
  Synthetic
ccagcuaacctggatauggacaaaaat

SEQ ID NO: 29661 - DNA, 26 bp, Artificial Sequence
  Synthetic
gtgtgtaggaaccuagttgtgtuagt

SEQ ID NO: 29662 - DNA, 18 bp, Artificial Sequence
  Synthetic
gtggccccaaggutguga

SEQ ID NO: 29663 - DNA, 19 bp, Artificial Sequence
  Synthetic
gccaggcuggtcucaaaca

SEQ ID NO: 29664 - DNA, 23 bp, Artificial Sequence
  Synthetic
gctgagucagaattgcttgaucc

SEQ ID NO: 29665 - DNA, 28 bp, Artificial Sequence
  Synthetic
accacatagtatguccctttaaagcaut

SEQ ID NO: 29666 - DNA, 24 bp, Artificial Sequence
  Synthetic
ctaggtuaacaaggccaaacucca

SEQ ID NO: 29667 - DNA, 28 bp, Artificial Sequence
  Synthetic
gaaggcccauttgtaagaatgtugaaaa

SEQ ID NO: 29668 - DNA, 31 bp, Artificial Sequence
  Synthetic
gaaggcatatattuggtgagaacattguaat

SEQ ID NO: 29669 - DNA, 23 bp, Artificial Sequence
  Synthetic
tgtaaagcgcaggauggagatut

SEQ ID NO: 29670 - DNA, 22 bp, Artificial Sequence
  Synthetic
tcagtuccaacccaaatgccut

SEQ ID NO: 29671 - DNA, 21 bp, Artificial Sequence
  Synthetic
caagtgctaguccactggcut

SEQ ID NO: 29672 - DNA, 20 bp, Artificial Sequence
  Synthetic
gccaccgcuatcacctucag

SEQ ID NO: 29673 - DNA, 25 bp, Artificial Sequence
  Synthetic
cutcaatggctauagagagaaccca

SEQ ID NO: 29674 - DNA, 20 bp, Artificial Sequence
  Synthetic
ggaaagagutgcugcaccag

SEQ ID NO: 29675 - DNA, 19 bp, Artificial Sequence
  Synthetic
cacatccaucggcgcttug

SEQ ID NO: 29676 - DNA, 27 bp, Artificial Sequence
  Synthetic
gatatcgugccttctgtauacaaaggt

SEQ ID NO: 29677 - DNA, 28 bp, Artificial Sequence
  Synthetic
gtctcaatacuggccaagattacaguaa

SEQ ID NO: 29678 - DNA, 25 bp, Artificial Sequence
  Synthetic
cttctagugaagagagatcgccuct

SEQ ID NO: 29679 - DNA, 21 bp, Artificial Sequence
  Synthetic
aggtttgccuctctccucaca

SEQ ID NO: 29680 - DNA, 26 bp, Artificial Sequence
  Synthetic
cggagcaaacagguttaaagacatug

SEQ ID NO: 29681 - DNA, 22 bp, Artificial Sequence
  Synthetic
gctaacctgucccacctgatut

SEQ ID NO: 29682 - DNA, 24 bp, Artificial Sequence
  Synthetic
gctctttguactgaagatguggca

SEQ ID NO: 29683 - DNA, 24 bp, Artificial Sequence
  Synthetic
ccaacggagaagautcagaugagg

SEQ ID NO: 29684 - DNA, 21 bp, Artificial Sequence
  Synthetic
tggatggcugcttgggtttua

SEQ ID NO: 29685 - DNA, 28 bp, Artificial Sequence
  Synthetic
gacactaccattuggtttgattttggut

SEQ ID NO: 29686 - DNA, 22 bp, Artificial Sequence
  Synthetic
actcccgcutatactgggcuat

SEQ ID NO: 29687 - DNA, 30 bp, Artificial Sequence
  Synthetic
tattaataatgtggutttctgtccactucc

SEQ ID NO: 29688 - DNA, 25 bp, Artificial Sequence
  Synthetic
cagtaagaaaugaagagagggcgut

SEQ ID NO: 29689 - DNA, 22 bp, Artificial Sequence
  Synthetic
cctctcctcuccctttccucag

SEQ ID NO: 29690 - DNA, 25 bp, Artificial Sequence
  Synthetic
ggcctgtgagucaactaaaaguagg

SEQ ID NO: 29691 - DNA, 17 bp, Artificial Sequence
  Synthetic
tccagcuggcgcttuga

SEQ ID NO: 29692 - DNA, 30 bp, Artificial Sequence
  Synthetic
agaacttttacacuagtcttttccaauccc

SEQ ID NO: 29693 - DNA, 25 bp, Artificial Sequence
  Synthetic
aggctagaccutctctgtccattua

SEQ ID NO: 29694 - DNA, 22 bp, Artificial Sequence
  Synthetic
cttgaaccaugttugcccaaga

SEQ ID NO: 29695 - DNA, 24 bp, Artificial Sequence
  Synthetic
cttaaagccucccttcctctuact

SEQ ID NO: 29696 - DNA, 23 bp, Artificial Sequence
  Synthetic
agagagatucttcccauccacca

SEQ ID NO: 29697 - DNA, 25 bp, Artificial Sequence
  Synthetic
actccccaccucttcttcttttcua

SEQ ID NO: 29698 - DNA, 17 bp, Artificial Sequence
  Synthetic
caaguccgccggcucat

SEQ ID NO: 29699 - DNA, 22 bp, Artificial Sequence
  Synthetic
cagctgtctucggttctctcug

SEQ ID NO: 29700 - DNA, 18 bp, Artificial Sequence
  Synthetic
cgcuccccggcctactua

SEQ ID NO: 29701 - DNA, 18 bp, Artificial Sequence
  Synthetic
tgagcgccutcactgucc

SEQ ID NO: 29702 - DNA, 17 bp, Artificial Sequence
  Synthetic
ttcaggucccgcacguc

SEQ ID NO: 29703 - DNA, 17 bp, Artificial Sequence
  Synthetic
ggctuccacgtgtgucc

SEQ ID NO: 29704 - DNA, 22 bp, Artificial Sequence
  Synthetic
cccctacagccucccattuact

SEQ ID NO: 29705 - DNA, 23 bp, Artificial Sequence
  Synthetic
cagaugggcaatagctuccagaa

SEQ ID NO: 29706 - DNA, 21 bp, Artificial Sequence
  Synthetic
agagtcaacacuccctgctug

SEQ ID NO: 29707 - DNA, 24 bp, Artificial Sequence
  Synthetic
ccgaguagaaacacagatgtguct

SEQ ID NO: 29708 - DNA, 20 bp, Artificial Sequence
  Synthetic
agccccuggttggaagaaug

SEQ ID NO: 29709 - DNA, 18 bp, Artificial Sequence
  Synthetic
gagatgccuccccuccct

SEQ ID NO: 29710 - DNA, 18 bp, Artificial Sequence
  Synthetic
gtgagcugtgggtugggt

SEQ ID NO: 29711 - DNA, 22 bp, Artificial Sequence
  Synthetic
cattcaggcacutaccagguga

SEQ ID NO: 29712 - DNA, 23 bp, Artificial Sequence
  Synthetic
cctgagacaucagtccacuggat

SEQ ID NO: 29713 - DNA, 25 bp, Artificial Sequence
  Synthetic
cttagcuacccactctauacccaca

SEQ ID NO: 29714 - DNA, 20 bp, Artificial Sequence
  Synthetic
caggcccugccatattgugt

SEQ ID NO: 29715 - DNA, 26 bp, Artificial Sequence
  Synthetic
aatccuggagattcctaucagaggag

SEQ ID NO: 29716 - DNA, 21 bp, Artificial Sequence
  Synthetic
atgtgagugtctagcauggct

SEQ ID NO: 29717 - DNA, 24 bp, Artificial Sequence
  Synthetic
ctgattcaggagcugagtcaugaa

SEQ ID NO: 29718 - DNA, 21 bp, Artificial Sequence
  Synthetic
ccttcccucggatctgttugg

SEQ ID NO: 29719 - DNA, 21 bp, Artificial Sequence
  Synthetic
ggacgagcaacgutacucaag

SEQ ID NO: 29720 - DNA, 22 bp, Artificial Sequence
  Synthetic
ccttgactgugaggttgaccug

SEQ ID NO: 29721 - DNA, 22 bp, Artificial Sequence
  Synthetic
tctgacutggatcucaccccaa

SEQ ID NO: 29722 - DNA, 23 bp, Artificial Sequence
  Synthetic
ctggtuccacacacccatctuat

SEQ ID NO: 29723 - DNA, 26 bp, Artificial Sequence
  Synthetic
ctctgaactacautgtgtcttcugca

SEQ ID NO: 29724 - DNA, 18 bp, Artificial Sequence
  Synthetic
gacccacccuacccugga

SEQ ID NO: 29725 - DNA, 17 bp, Artificial Sequence
  Synthetic
gggtgtguggcccagug

SEQ ID NO: 29726 - DNA, 21 bp, Artificial Sequence
  Synthetic
gtccaagcccuaaagccucat

SEQ ID NO: 29727 - DNA, 25 bp, Artificial Sequence
  Synthetic
cttcaaauaccggtucaagaaggac

SEQ ID NO: 29728 - DNA, 19 bp, Artificial Sequence
  Synthetic
gcaagtgcugtggcctcut

SEQ ID NO: 29729 - DNA, 19 bp, Artificial Sequence
  Synthetic
agccaacccucatgcucac

SEQ ID NO: 29730 - DNA, 20 bp, Artificial Sequence
  Synthetic
gccacaccgagucagagaua

SEQ ID NO: 29731 - DNA, 20 bp, Artificial Sequence
  Synthetic
tggaacuggctgaccaugac

SEQ ID NO: 29732 - DNA, 19 bp, Artificial Sequence
  Synthetic
cctctccuctcccctcuga

SEQ ID NO: 29733 - DNA, 18 bp, Artificial Sequence
  Synthetic
ccuagacugcgggacaca

SEQ ID NO: 29734 - DNA, 20 bp, Artificial Sequence
  Synthetic
cagtgttgugctcaggguca

SEQ ID NO: 29735 - DNA, 23 bp, Artificial Sequence
  Synthetic
ctaatcccttuccagtcccucac

SEQ ID NO: 29736 - DNA, 19 bp, Artificial Sequence
  Synthetic
ccccagucgagacccugaa

SEQ ID NO: 29737 - DNA, 24 bp, Artificial Sequence
  Synthetic
ggcaagtcugtgaatacucagagg

SEQ ID NO: 29738 - DNA, 19 bp, Artificial Sequence
  Synthetic
tgccttcuagggctcucca

SEQ ID NO: 29739 - DNA, 17 bp, Artificial Sequence
  Synthetic
ctgtcgccccugcctut

SEQ ID NO: 29740 - DNA, 20 bp, Artificial Sequence
  Synthetic
ttttgagaccugcccuggac

SEQ ID NO: 29741 - DNA, 20 bp, Artificial Sequence
  Synthetic
cacgacucccatctgauccc

SEQ ID NO: 29742 - DNA, 19 bp, Artificial Sequence
  Synthetic
cttgttgcuggcgctgaug

SEQ ID NO: 29743 - DNA, 25 bp, Artificial Sequence
  Synthetic
tgctagcacaguatttacugagagg

SEQ ID NO: 29744 - DNA, 19 bp, Artificial Sequence
  Synthetic
aaggcctuggctatgguga

SEQ ID NO: 29745 - DNA, 18 bp, Artificial Sequence
  Synthetic
aguggacagggcccttug

SEQ ID NO: 29746 - DNA, 20 bp, Artificial Sequence
  Synthetic
cagtagagcuccgtctccuc

SEQ ID NO: 29747 - DNA, 21 bp, Artificial Sequence
  Synthetic
gagcctaccugcactgactut

SEQ ID NO: 29748 - DNA, 21 bp, Artificial Sequence
  Synthetic
gaaagagccggcuaaccuact

SEQ ID NO: 29749 - DNA, 20 bp, Artificial Sequence
  Synthetic
ctgattccaucccccaccug

SEQ ID NO: 29750 - DNA, 23 bp, Artificial Sequence
  Synthetic
ccaugggctgattuggaagaagg

SEQ ID NO: 29751 - DNA, 23 bp, Artificial Sequence
  Synthetic
tgucaacaactauggcaaaggct

SEQ ID NO: 29752 - DNA, 24 bp, Artificial Sequence
  Synthetic
ctaaaaggagggcugaatgaggua

SEQ ID NO: 29753 - DNA, 20 bp, Artificial Sequence
  Synthetic
cuggagagctucgagaaggc

SEQ ID NO: 29754 - DNA, 21 bp, Artificial Sequence
  Synthetic
ccaaggcaggucttgcaguag

SEQ ID NO: 29755 - DNA, 20 bp, Artificial Sequence
  Synthetic
gtccaaggcucagaguccag

SEQ ID NO: 29756 - DNA, 21 bp, Artificial Sequence
  Synthetic
cctttguccacacctgcaaug

SEQ ID NO: 29757 - DNA, 20 bp, Artificial Sequence
  Synthetic
tgattccugccccatgagug

SEQ ID NO: 29758 - DNA, 17 bp, Artificial Sequence
  Synthetic
ccatcucctcgcugcgt

SEQ ID NO: 29759 - DNA, 19 bp, Artificial Sequence
  Synthetic
gcagctccucgtgatccuc

SEQ ID NO: 29760 - DNA, 18 bp, Artificial Sequence
  Synthetic
cucatccgcuacgccaac

SEQ ID NO: 29761 - DNA, 20 bp, Artificial Sequence
  Synthetic
ggactttggcuccacccauc

SEQ ID NO: 29762 - DNA, 22 bp, Artificial Sequence
  Synthetic
cctaccacacaacaugttcugg

SEQ ID NO: 29763 - DNA, 23 bp, Artificial Sequence
  Synthetic
cccaaggcutctctttguaggaa

SEQ ID NO: 29764 - DNA, 23 bp, Artificial Sequence
  Synthetic
ctgatttcagggutcccaccuag

SEQ ID NO: 29765 - DNA, 23 bp, Artificial Sequence
  Synthetic
aagaagaacugcaggaacgugaa

SEQ ID NO: 29766 - DNA, 22 bp, Artificial Sequence
  Synthetic
tgtggaaauagcagcagcugag

SEQ ID NO: 29767 - DNA, 22 bp, Artificial Sequence
  Synthetic
gggaagguccatggtatggtut

SEQ ID NO: 29768 - DNA, 22 bp, Artificial Sequence
  Synthetic
cctgttggcugtggatgagaug

SEQ ID NO: 29769 - DNA, 26 bp, Artificial Sequence
  Synthetic
agtgctatuctaagttccuaggcaga

SEQ ID NO: 29770 - DNA, 21 bp, Artificial Sequence
  Synthetic
ctgcagucccatgaucaccat

SEQ ID NO: 29771 - DNA, 23 bp, Artificial Sequence
  Synthetic
gtagtagccuggcctctgauaca

SEQ ID NO: 29772 - DNA, 23 bp, Artificial Sequence
  Synthetic
gucacaggcauagacaccaaaga

SEQ ID NO: 29773 - DNA, 24 bp, Artificial Sequence
  Synthetic
tggttggtgautgttccaaaggut

SEQ ID NO: 29774 - DNA, 21 bp, Artificial Sequence
  Synthetic
cttcccttgcuctgagccuac

SEQ ID NO: 29775 - DNA, 21 bp, Artificial Sequence
  Synthetic
cagcautctggucagcacaac

SEQ ID NO: 29776 - DNA, 22 bp, Artificial Sequence
  Synthetic
tctcaacctutgccctccuact

SEQ ID NO: 29777 - DNA, 22 bp, Artificial Sequence
  Synthetic
gatcagtgucctgctggtguac

SEQ ID NO: 29778 - DNA, 20 bp, Artificial Sequence
  Synthetic
cagtgcuggacacucggaat

SEQ ID NO: 29779 - DNA, 22 bp, Artificial Sequence
  Synthetic
cctgctgccuggaatcttcuaa

SEQ ID NO: 29780 - DNA, 21 bp, Artificial Sequence
  Synthetic
cagcaggauggccatguagat

SEQ ID NO: 29781 - DNA, 19 bp, Artificial Sequence
  Synthetic
gcccaaggucatcgagugc

SEQ ID NO: 29782 - DNA, 23 bp, Artificial Sequence
  Synthetic
cgcttcugcaaggagaaagctua

SEQ ID NO: 29783 - DNA, 25 bp, Artificial Sequence
  Synthetic
ctggtaccugaagaccattgacauc

SEQ ID NO: 29784 - DNA, 25 bp, Artificial Sequence
  Synthetic
attaaggtcaugggaatacgctcug

SEQ ID NO: 29785 - DNA, 26 bp, Artificial Sequence
  Synthetic
tttgacttcaagcugttcttcaaugg

SEQ ID NO: 29786 - DNA, 23 bp, Artificial Sequence
  Synthetic
gggtgaaguttgcactttcuaca

SEQ ID NO: 29787 - DNA, 23 bp, Artificial Sequence
  Synthetic
ccaccatcaucttcgacaacugg

SEQ ID NO: 29788 - DNA, 22 bp, Artificial Sequence
  Synthetic
ccccugagagaaagggaugaga

SEQ ID NO: 29789 - DNA, 21 bp, Artificial Sequence
  Synthetic
caggctgcutgtgtgttucag

SEQ ID NO: 29790 - DNA, 23 bp, Artificial Sequence
  Synthetic
ctgtactggucacaagccaugat

SEQ ID NO: 29791 - DNA, 22 bp, Artificial Sequence
  Synthetic
tcucccauacagagcctctuag

SEQ ID NO: 29792 - DNA, 23 bp, Artificial Sequence
  Synthetic
ccagaagcaugacatggtctcuc

SEQ ID NO: 29793 - DNA, 21 bp, Artificial Sequence
  Synthetic
gtgtcccacggguaagcauat

SEQ ID NO: 29794 - DNA, 17 bp, Artificial Sequence
  Synthetic
ccugaagugcgcagcct

SEQ ID NO: 29795 - DNA, 17 bp, Artificial Sequence
  Synthetic
ggcggcacucacguaga

SEQ ID NO: 29796 - DNA, 20 bp, Artificial Sequence
  Synthetic
cagagcacauccgccaguat

SEQ ID NO: 29797 - DNA, 21 bp, Artificial Sequence
  Synthetic
tggagcuctaggtccuaagcc

SEQ ID NO: 29798 - DNA, 21 bp, Artificial Sequence
  Synthetic
gctttgccagugacacccuac

SEQ ID NO: 29799 - DNA, 21 bp, Artificial Sequence
  Synthetic
tgggtctautcctgcauccct

SEQ ID NO: 29800 - DNA, 20 bp, Artificial Sequence
  Synthetic
gggtacacugacgtcctcut

SEQ ID NO: 29801 - DNA, 22 bp, Artificial Sequence
  Synthetic
ctcaccctcauactgcaggtug

SEQ ID NO: 29802 - DNA, 22 bp, Artificial Sequence
  Synthetic
agtggcagccuagtcctctuag

SEQ ID NO: 29803 - DNA, 23 bp, Artificial Sequence
  Synthetic
cctucagagggauagaagtcaug

SEQ ID NO: 29804 - DNA, 19 bp, Artificial Sequence
  Synthetic
gtgccaguggctgaucact

SEQ ID NO: 29805 - DNA, 23 bp, Artificial Sequence
  Synthetic
ggaaggaaautcccaugagcaga

SEQ ID NO: 29806 - DNA, 25 bp, Artificial Sequence
  Synthetic
aatatgaccuggagagcattgacug

SEQ ID NO: 29807 - DNA, 28 bp, Artificial Sequence
  Synthetic
tcattagtccuattttgcagaugaggaa

SEQ ID NO: 29808 - DNA, 22 bp, Artificial Sequence
  Synthetic
acaagcucaacgccaacuacat

SEQ ID NO: 29809 - DNA, 24 bp, Artificial Sequence
  Synthetic
ggatatcttautcctgggcuggag

SEQ ID NO: 29810 - DNA, 17 bp, Artificial Sequence
  Synthetic
gcacagccccucccauc

SEQ ID NO: 29811 - DNA, 18 bp, Artificial Sequence
  Synthetic
ctccacgucacccuagcc

SEQ ID NO: 29812 - DNA, 24 bp, Artificial Sequence
  Synthetic
ggaatgauggagaccatccgaauc

SEQ ID NO: 29813 - DNA, 22 bp, Artificial Sequence
  Synthetic
cgcccauggtcctgauaagaaa

SEQ ID NO: 29814 - DNA, 21 bp, Artificial Sequence
  Synthetic
ggtggtccuagaggagaccut

SEQ ID NO: 29815 - DNA, 22 bp, Artificial Sequence
  Synthetic
acaccacacguacacctgtaug

SEQ ID NO: 29816 - DNA, 20 bp, Artificial Sequence
  Synthetic
ggtcaguctggaaugggaca

SEQ ID NO: 29817 - DNA, 19 bp, Artificial Sequence
  Synthetic
gcctugcgcaccagauagg

SEQ ID NO: 29818 - DNA, 22 bp, Artificial Sequence
  Synthetic
ggaatcccugcaacaacagcua

SEQ ID NO: 29819 - DNA, 21 bp, Artificial Sequence
  Synthetic
gccagcaaguggacaccuaag

SEQ ID NO: 29820 - DNA, 21 bp, Artificial Sequence
  Synthetic
ctccuggagcagauggaaagg

SEQ ID NO: 29821 - DNA, 20 bp, Artificial Sequence
  Synthetic
aggaucaacacaagcggugt

SEQ ID NO: 29822 - DNA, 29 bp, Artificial Sequence
  Synthetic
gacctctctgaguataaatttgccaagut

SEQ ID NO: 29823 - DNA, 20 bp, Artificial Sequence
  Synthetic
caccacccucatcacuacgg

SEQ ID NO: 29824 - DNA, 23 bp, Artificial Sequence
  Synthetic
ccatgagugatggcagugagaag

SEQ ID NO: 29825 - DNA, 26 bp, Artificial Sequence
  Synthetic
tataggaucctttttcugcagaggag

SEQ ID NO: 29826 - DNA, 22 bp, Artificial Sequence
  Synthetic
gggaacaccccuaacttuacct

SEQ ID NO: 29827 - DNA, 23 bp, Artificial Sequence
  Synthetic
acucagccaucaaaagacttuca

SEQ ID NO: 29828 - DNA, 18 bp, Artificial Sequence
  Synthetic
gggtgautcccccuccct

SEQ ID NO: 29829 - DNA, 20 bp, Artificial Sequence
  Synthetic
cctagcuccccttcccacuc

SEQ ID NO: 29830 - DNA, 19 bp, Artificial Sequence
  Synthetic
actuccaggccaccaaguc

SEQ ID NO: 29831 - DNA, 23 bp, Artificial Sequence
  Synthetic
accttgucaaacagggcaatgua

SEQ ID NO: 29832 - DNA, 23 bp, Artificial Sequence
  Synthetic
tccgttttcugtctgaacugacc

SEQ ID NO: 29833 - DNA, 23 bp, Artificial Sequence
  Synthetic
gtgaagaccucttugcggaagaa

SEQ ID NO: 29834 - DNA, 18 bp, Artificial Sequence
  Synthetic
ctgggccaaugcaugacc

SEQ ID NO: 29835 - DNA, 22 bp, Artificial Sequence
  Synthetic
ggactcctcucagcccttcuac

SEQ ID NO: 29836 - DNA, 20 bp, Artificial Sequence
  Synthetic
ctctcagugccttggtcucg

SEQ ID NO: 29837 - DNA, 22 bp, Artificial Sequence
  Synthetic
ctctgtcugtctgcatcuccat

SEQ ID NO: 29838 - DNA, 20 bp, Artificial Sequence
  Synthetic
ctgttcuccgtgttggucct

SEQ ID NO: 29839 - DNA, 19 bp, Artificial Sequence
  Synthetic
cagugccaggcagtccaua

SEQ ID NO: 29840 - DNA, 22 bp, Artificial Sequence
  Synthetic
ctcatcaucctggaccaugaca

SEQ ID NO: 29841 - DNA, 23 bp, Artificial Sequence
  Synthetic
cctattguacagctgugggaagt

SEQ ID NO: 29842 - DNA, 18 bp, Artificial Sequence
  Synthetic
ttgctgacgguccctgug

SEQ ID NO: 29843 - DNA, 18 bp, Artificial Sequence
  Synthetic
gcccaguggcacggauat

SEQ ID NO: 29844 - DNA, 19 bp, Artificial Sequence
  Synthetic
aggtccugtgacucccgat

SEQ ID NO: 29845 - DNA, 21 bp, Artificial Sequence
  Synthetic
gtaccucagggctttcuggag

SEQ ID NO: 29846 - DNA, 20 bp, Artificial Sequence
  Synthetic
gggttgtcugcctccaagug

SEQ ID NO: 29847 - DNA, 20 bp, Artificial Sequence
  Synthetic
gggcacugcagaccuagaag

SEQ ID NO: 29848 - DNA, 23 bp, Artificial Sequence
  Synthetic
ccaaggactuctgccagaacauc

SEQ ID NO: 29849 - DNA, 21 bp, Artificial Sequence
  Synthetic
cccagtucctctctctuccgt

SEQ ID NO: 29850 - DNA, 19 bp, Artificial Sequence
  Synthetic
ggacgugagcactcctcug

SEQ ID NO: 29851 - DNA, 21 bp, Artificial Sequence
  Synthetic
ggccaaaguacagcaacgcua

SEQ ID NO: 29852 - DNA, 20 bp, Artificial Sequence
  Synthetic
ggactcugagctctgagcug

SEQ ID NO: 29853 - DNA, 21 bp, Artificial Sequence
  Synthetic
ctctgagaagcccauggtgua

SEQ ID NO: 29854 - DNA, 19 bp, Artificial Sequence
  Synthetic
gccttctgugagggcaugt

SEQ ID NO: 29855 - DNA, 19 bp, Artificial Sequence
  Synthetic
cacuaggcccagcaggaug

SEQ ID NO: 29856 - DNA, 21 bp, Artificial Sequence
  Synthetic
cucacagccaugagcaaacag

SEQ ID NO: 29857 - DNA, 20 bp, Artificial Sequence
  Synthetic
catcccagagagaugccuca

SEQ ID NO: 29858 - DNA, 18 bp, Artificial Sequence
  Synthetic
cacgtguccccggtacuc

SEQ ID NO: 29859 - DNA, 21 bp, Artificial Sequence
  Synthetic
ccgttcugaccaauagacgac

SEQ ID NO: 29860 - DNA, 23 bp, Artificial Sequence
  Synthetic
ggaaatuccagtccctucaggat

SEQ ID NO: 29861 - DNA, 25 bp, Artificial Sequence
  Synthetic
cttccactccuttccagaaaacuca

SEQ ID NO: 29862 - DNA, 24 bp, Artificial Sequence
  Synthetic
actgcacuctctaagguaacaaca

SEQ ID NO: 29863 - DNA, 27 bp, Artificial Sequence
  Synthetic
gcaccacactcucctatctttactuac

SEQ ID NO: 29864 - DNA, 28 bp, Artificial Sequence
  Synthetic
gaggtgatcugaacttaaatctctuccc

SEQ ID NO: 29865 - DNA, 22 bp, Artificial Sequence
  Synthetic
acactaggcagucactgtucct

SEQ ID NO: 29866 - DNA, 22 bp, Artificial Sequence
  Synthetic
cgacacugtggtcctuagcaac

SEQ ID NO: 29867 - DNA, 24 bp, Artificial Sequence
  Synthetic
guaaggcagaaaggagaugcagat

SEQ ID NO: 29868 - DNA, 21 bp, Artificial Sequence
  Synthetic
aggcctgaugtcctaggaugt

SEQ ID NO: 29869 - DNA, 23 bp, Artificial Sequence
  Synthetic
agaaatcttcccugccaccttuc

SEQ ID NO: 29870 - DNA, 22 bp, Artificial Sequence
  Synthetic
ctgtgcaucccaggtttcuagg

SEQ ID NO: 29871 - DNA, 25 bp, Artificial Sequence
  Synthetic
tgggatttggugagaacaagagaut

SEQ ID NO: 29872 - DNA, 20 bp, Artificial Sequence
  Synthetic
ggcagcutaacgaugcccat

SEQ ID NO: 29873 - DNA, 23 bp, Artificial Sequence
  Synthetic
tcuaaagagaugaagcccccaca

SEQ ID NO: 29874 - DNA, 20 bp, Artificial Sequence
  Synthetic
ctucggcaggagggatugag

SEQ ID NO: 29875 - DNA, 18 bp, Artificial Sequence
  Synthetic
cagccccuccaccucaga

SEQ ID NO: 29876 - DNA, 23 bp, Artificial Sequence
  Synthetic
tcccaagccuatgggttcattuc

SEQ ID NO: 29877 - DNA, 23 bp, Artificial Sequence
  Synthetic
cctggctacauggaaaacgauct

SEQ ID NO: 29878 - DNA, 24 bp, Artificial Sequence
  Synthetic
ctggagatgcugtggatgtaacuc

SEQ ID NO: 29879 - DNA, 31 bp, Artificial Sequence
  Synthetic
gagaccagaaaaaucgtaatcacactauaac

SEQ ID NO: 29880 - DNA, 21 bp, Artificial Sequence
  Synthetic
gggagggugatggcagacuaa

SEQ ID NO: 29881 - DNA, 25 bp, Artificial Sequence
  Synthetic
caagautcttgcctuccaaaaccag

SEQ ID NO: 29882 - DNA, 24 bp, Artificial Sequence
  Synthetic
gttggtggtggutagtgggtatut

SEQ ID NO: 29883 - DNA, 21 bp, Artificial Sequence
  Synthetic
ggtgtctgcucctgcactauc

SEQ ID NO: 29884 - DNA, 22 bp, Artificial Sequence
  Synthetic
cacctctcaguccatctcucac

SEQ ID NO: 29885 - DNA, 27 bp, Artificial Sequence
  Synthetic
cagaaatgagacuatggagtcacucac

SEQ ID NO: 29886 - DNA, 23 bp, Artificial Sequence
  Synthetic
gcatttcaaagcutggctuggat

SEQ ID NO: 29887 - DNA, 22 bp, Artificial Sequence
  Synthetic
cagtctcguagggttucacagg

SEQ ID NO: 29888 - DNA, 26 bp, Artificial Sequence
  Synthetic
gggatgggaauagagacattcatcua

SEQ ID NO: 29889 - DNA, 22 bp, Artificial Sequence
  Synthetic
ccccacucaggtugaaaaggac

SEQ ID NO: 29890 - DNA, 22 bp, Artificial Sequence
  Synthetic
ccatccgttcugcatccctauc

SEQ ID NO: 29891 - DNA, 29 bp, Artificial Sequence
  Synthetic
cagggagaaaaagcucattcattcattuc

SEQ ID NO: 29892 - DNA, 21 bp, Artificial Sequence
  Synthetic
gtgccatgucggagaacauct

SEQ ID NO: 29893 - DNA, 23 bp, Artificial Sequence
  Synthetic
ggagagggaaucacauccaaagc

SEQ ID NO: 29894 - DNA, 33 bp, Artificial Sequence
  Synthetic
aattaccacttguactagtatgcctuaagaaaa

SEQ ID NO: 29895 - DNA, 22 bp, Artificial Sequence
  Synthetic
cctgtacacaugaagccaucgt

SEQ ID NO: 29896 - DNA, 31 bp, Artificial Sequence
  Synthetic
tcctagtatagcauaattgagagaaaaacug

SEQ ID NO: 29897 - DNA, 28 bp, Artificial Sequence
  Synthetic
ccutctagaacaguagacacaaaacagg

SEQ ID NO: 29898 - DNA, 23 bp, Artificial Sequence
  Synthetic
tgcatggcautagcaaagacuca

SEQ ID NO: 29899 - DNA, 22 bp, Artificial Sequence
  Synthetic
gaguacagtgcaaugagggacc

SEQ ID NO: 29900 - DNA, 28 bp, Artificial Sequence
  Synthetic
gtacucatgaaaatggucagagaaacct

SEQ ID NO: 29901 - DNA, 22 bp, Artificial Sequence
  Synthetic
aacttgtgguagttggagcugg

SEQ ID NO: 29902 - DNA, 19 bp, Artificial Sequence
  Synthetic
ccggtauctactgguggca

SEQ ID NO: 29903 - DNA, 24 bp, Artificial Sequence
  Synthetic
gcctaccacucccttaaagacuga

SEQ ID NO: 29904 - DNA, 23 bp, Artificial Sequence
  Synthetic
cgatttctucccagggtcaaguc

SEQ ID NO: 29905 - DNA, 29 bp, Artificial Sequence
  Synthetic
cctgatctcagaaugtccttttctttuca

SEQ ID NO: 29906 - DNA, 21 bp, Artificial Sequence
  Synthetic
tgtttagaaggucgcgugcat

SEQ ID NO: 29907 - DNA, 29 bp, Artificial Sequence
  Synthetic
ttgggatcttgggautaagaaacaatcut

SEQ ID NO: 29908 - DNA, 24 bp, Artificial Sequence
  Synthetic
gatggctguctttttcacactugg

SEQ ID NO: 29909 - DNA, 28 bp, Artificial Sequence
  Synthetic
tcttcatcaaccuctggtaatcuacaga

SEQ ID NO: 29910 - DNA, 27 bp, Artificial Sequence
  Synthetic
tgccgatatauaccaagtactuagaca

SEQ ID NO: 29911 - DNA, 25 bp, Artificial Sequence
  Synthetic
ccggaauatccagacugacaacaac

SEQ ID NO: 29912 - DNA, 29 bp, Artificial Sequence
  Synthetic
cugaagcatcttaguaagacaaaacagga

SEQ ID NO: 29913 - DNA, 28 bp, Artificial Sequence
  Synthetic
gttggatacacagccuagacttacttut

SEQ ID NO: 29914 - DNA, 19 bp, Artificial Sequence
  Synthetic
cugggatuacaggcgcaga

SEQ ID NO: 29915 - DNA, 27 bp, Artificial Sequence
  Synthetic
cctatgcttccuctttcctttguacag

SEQ ID NO: 29916 - DNA, 20 bp, Artificial Sequence
  Synthetic
cagccgagguaccccattua

SEQ ID NO: 29917 - DNA, 26 bp, Artificial Sequence
  Synthetic
gtattacatugaatgccttgaugcca

SEQ ID NO: 29918 - DNA, 22 bp, Artificial Sequence
  Synthetic
ggcaaugactgaacugcagagt

SEQ ID NO: 29919 - DNA, 20 bp, Artificial Sequence
  Synthetic
cagaacagggcutccagguc

SEQ ID NO: 29920 - DNA, 21 bp, Artificial Sequence
  Synthetic
tgccgtcagguagttctccut

SEQ ID NO: 29921 - DNA, 21 bp, Artificial Sequence
  Synthetic
cctagugccaccgagataugc

SEQ ID NO: 29922 - DNA, 29 bp, Artificial Sequence
  Synthetic
atggtagtaatcugatcactagggtuaca

SEQ ID NO: 29923 - DNA, 25 bp, Artificial Sequence
  Synthetic
ttgcttgatugcaggaaatctucac

SEQ ID NO: 29924 - DNA, 18 bp, Artificial Sequence
  Synthetic
gggctccacucaccgtug

SEQ ID NO: 29925 - DNA, 19 bp, Artificial Sequence
  Synthetic
ccccagcugagtacggcua

SEQ ID NO: 29926 - DNA, 23 bp, Artificial Sequence
  Synthetic
cggattgtgtugtttctgggtuc

SEQ ID NO: 29927 - DNA, 22 bp, Artificial Sequence
  Synthetic
aactggguagcaaggcatcuac

SEQ ID NO: 29928 - DNA, 22 bp, Artificial Sequence
  Synthetic
gtccagauaggcaatgctgtuc

SEQ ID NO: 29929 - DNA, 23 bp, Artificial Sequence
  Synthetic
ccttgaaccaugaactctuggca

SEQ ID NO: 29930 - DNA, 23 bp, Artificial Sequence
  Synthetic
gttcttctugggaacgtttgcug

SEQ ID NO: 29931 - DNA, 24 bp, Artificial Sequence
  Synthetic
gtctctcaagcutttgtgtctgug

SEQ ID NO: 29932 - DNA, 22 bp, Artificial Sequence
  Synthetic
ttgttgagggacutgagtgugg

SEQ ID NO: 29933 - DNA, 23 bp, Artificial Sequence
  Synthetic
acaatcctggcugatctctcugt

SEQ ID NO: 29934 - DNA, 21 bp, Artificial Sequence
  Synthetic
cccctccaucttccaacucca

SEQ ID NO: 29935 - DNA, 20 bp, Artificial Sequence
  Synthetic
gggcugggacataaagcugt

SEQ ID NO: 29936 - DNA, 21 bp, Artificial Sequence
  Synthetic
ctcagugcaggacactuggat

SEQ ID NO: 29937 - DNA, 21 bp, Artificial Sequence
  Synthetic
cgcagtcuctggacuaaggag

SEQ ID NO: 29938 - DNA, 21 bp, Artificial Sequence
  Synthetic
gagacttgutccaaccugcca

SEQ ID NO: 29939 - DNA, 25 bp, Artificial Sequence
  Synthetic
gtgcattctugtttcactttgucca

SEQ ID NO: 29940 - DNA, 21 bp, Artificial Sequence
  Synthetic
gctgagggagguagaagccut

SEQ ID NO: 29941 - DNA, 23 bp, Artificial Sequence
  Synthetic
ccactgtcagutctcatctccug

SEQ ID NO: 29942 - DNA, 22 bp, Artificial Sequence
  Synthetic
ctcaugccaggagcatcactua

SEQ ID NO: 29943 - DNA, 22 bp, Artificial Sequence
  Synthetic
tttccauaccaggctcugagac

SEQ ID NO: 29944 - DNA, 23 bp, Artificial Sequence
  Synthetic
gcccttcctugagggaacaatuc

SEQ ID NO: 29945 - DNA, 24 bp, Artificial Sequence
  Synthetic
acctgcttccuccttcccattaua

SEQ ID NO: 29946 - DNA, 18 bp, Artificial Sequence
  Synthetic
catgagggccugcacuga

SEQ ID NO: 29947 - DNA, 21 bp, Artificial Sequence
  Synthetic
caccttctuaccccagctcut

SEQ ID NO: 29948 - DNA, 21 bp, Artificial Sequence
  Synthetic
ggatcctaaugcccagcaguc

SEQ ID NO: 29949 - DNA, 19 bp, Artificial Sequence
  Synthetic
actgggcuttcccuagcac

SEQ ID NO: 29950 - DNA, 24 bp, Artificial Sequence
  Synthetic
acttctgttcutcattcctccuga

SEQ ID NO: 29951 - DNA, 24 bp, Artificial Sequence
  Synthetic
ggttgatcacutcttggtgtcuct

SEQ ID NO: 29952 - DNA, 19 bp, Artificial Sequence
  Synthetic
cccuccaccgatagugcct

SEQ ID NO: 29953 - DNA, 23 bp, Artificial Sequence
  Synthetic
ggctcagcucaccttttctttuc

SEQ ID NO: 29954 - DNA, 17 bp, Artificial Sequence
  Synthetic
gaggccgutcccctguc

SEQ ID NO: 29955 - DNA, 19 bp, Artificial Sequence
  Synthetic
cccaaaccauccgccucat

SEQ ID NO: 29956 - DNA, 22 bp, Artificial Sequence
  Synthetic
cctcccuaacccaaactccauc

SEQ ID NO: 29957 - DNA, 22 bp, Artificial Sequence
  Synthetic
ccaccctcutctctctccugaa

SEQ ID NO: 29958 - DNA, 21 bp, Artificial Sequence
  Synthetic
cccuacaaggguacacaggga

SEQ ID NO: 29959 - DNA, 21 bp, Artificial Sequence
  Synthetic
ggttggtgggutagtgggaug

SEQ ID NO: 29960 - DNA, 21 bp, Artificial Sequence
  Synthetic
ccugtgcctcauagaacagca

SEQ ID NO: 29961 - DNA, 21 bp, Artificial Sequence
  Synthetic
cauccgagggcatctugaaca

SEQ ID NO: 29962 - DNA, 21 bp, Artificial Sequence
  Synthetic
ccugtgggcaugagaagaagg

SEQ ID NO: 29963 - DNA, 29 bp, Artificial Sequence
  Synthetic
ggttcattctutgctgcttattugacaat

SEQ ID NO: 29964 - DNA, 21 bp, Artificial Sequence
  Synthetic
gagcaaugagcaagggtuacg

SEQ ID NO: 29965 - DNA, 23 bp, Artificial Sequence
  Synthetic
gaactggcautcacctctctuct

SEQ ID NO: 29966 - DNA, 21 bp, Artificial Sequence
  Synthetic
gggttgtutcgagggucaaga

SEQ ID NO: 29967 - DNA, 22 bp, Artificial Sequence
  Synthetic
caactcatgcutaggctgucct

SEQ ID NO: 29968 - DNA, 21 bp, Artificial Sequence
  Synthetic
gctagtuccactgagcuccac

SEQ ID NO: 29969 - DNA, 28 bp, Artificial Sequence
  Synthetic
cccagaagtcugattgaacattttcuct

SEQ ID NO: 29970 - DNA, 25 bp, Artificial Sequence
  Synthetic
atctcagaagugacctcatugaact

SEQ ID NO: 29971 - DNA, 25 bp, Artificial Sequence
  Synthetic
tgggatatctcuctctctccctuca

SEQ ID NO: 29972 - DNA, 21 bp, Artificial Sequence
  Synthetic
gctgcggucctagtggtcuat

SEQ ID NO: 29973 - DNA, 29 bp, Artificial Sequence
  Synthetic
tgttttagcagttuatagggattgaccug

SEQ ID NO: 29974 - DNA, 27 bp, Artificial Sequence
  Synthetic
ctaagcaautatctguaaagcagaggt

SEQ ID NO: 29975 - DNA, 25 bp, Artificial Sequence
  Synthetic
ctcctaacgtugttgggtttcttug

SEQ ID NO: 29976 - DNA, 22 bp, Artificial Sequence
  Synthetic
tggctgcuctttaagaggugac

SEQ ID NO: 29977 - DNA, 27 bp, Artificial Sequence
  Synthetic
gtcatcttaccaugttcttcacctuca

SEQ ID NO: 29978 - DNA, 23 bp, Artificial Sequence
  Synthetic
gccccacaggauggtaagtuaga

SEQ ID NO: 29979 - DNA, 24 bp, Artificial Sequence
  Synthetic
cttagtgggcutactcggctuaat

SEQ ID NO: 29980 - DNA, 21 bp, Artificial Sequence
  Synthetic
agcatctaugggagcgtgtut

SEQ ID NO: 29981 - DNA, 23 bp, Artificial Sequence
  Synthetic
cctctgcgacgacauaatctgug

SEQ ID NO: 29982 - DNA, 17 bp, Artificial Sequence
  Synthetic
cuccagagcuggagcgg

SEQ ID NO: 29983 - DNA, 18 bp, Artificial Sequence
  Synthetic
ccgcggugagccatgaut

SEQ ID NO: 29984 - DNA, 18 bp, Artificial Sequence
  Synthetic
gggcuctccugggaacca

SEQ ID NO: 29985 - DNA, 19 bp, Artificial Sequence
  Synthetic
tccucccggaagagctuca

SEQ ID NO: 29986 - DNA, 22 bp, Artificial Sequence
  Synthetic
gctggagtaguagcttccacug

SEQ ID NO: 29987 - DNA, 21 bp, Artificial Sequence
  Synthetic
gcuccaacaccagcagaucaa

SEQ ID NO: 29988 - DNA, 27 bp, Artificial Sequence
  Synthetic
agtcactgatcucatgtatgtgtgtug

SEQ ID NO: 29989 - DNA, 21 bp, Artificial Sequence
  Synthetic
gagctcaugaacaccaagcug

SEQ ID NO: 29990 - DNA, 25 bp, Artificial Sequence
  Synthetic
gtttcttttagaacucaggccccut

SEQ ID NO: 29991 - DNA, 24 bp, Artificial Sequence
  Synthetic
cagaatcttucctctttccuggct

SEQ ID NO: 29992 - DNA, 28 bp, Artificial Sequence
  Synthetic
tgtcagttccautcaaatctttcacuca

SEQ ID NO: 29993 - DNA, 22 bp, Artificial Sequence
  Synthetic
agtgccaaucatccctgttucc

SEQ ID NO: 29994 - DNA, 23 bp, Artificial Sequence
  Synthetic
cccaaaggaaggcauggtaguag

SEQ ID NO: 29995 - DNA, 20 bp, Artificial Sequence
  Synthetic
gagccgttgutcgagcagua

SEQ ID NO: 29996 - DNA, 27 bp, Artificial Sequence
  Synthetic
gccaaaacatcutccttctttctcuct

SEQ ID NO: 29997 - DNA, 22 bp, Artificial Sequence
  Synthetic
ctccuggaggtauccaagaggt

SEQ ID NO: 29998 - DNA, 21 bp, Artificial Sequence
  Synthetic
gcaccaccuccaaagccauag

SEQ ID NO: 29999 - DNA, 17 bp, Artificial Sequence
  Synthetic
ggctucggcagggucag

SEQ ID NO: 30000 - DNA, 20 bp, Artificial Sequence
  Synthetic
cacacutgacuggcgagaca

SEQ ID NO: 30001 - DNA, 22 bp, Artificial Sequence
  Synthetic
tgcccagcccacutaatcatuc

SEQ ID NO: 30002 - DNA, 21 bp, Artificial Sequence
  Synthetic
gagttgcgccgutttccuaac

SEQ ID NO: 30003 - DNA, 23 bp, Artificial Sequence
  Synthetic
ggcctccacuatgtttcgaauga

SEQ ID NO: 30004 - DNA, 26 bp, Artificial Sequence
  Synthetic
attgacgtaaacaugtaaggtgcuct

SEQ ID NO: 30005 - DNA, 27 bp, Artificial Sequence
  Synthetic
gattcctgacuactttgctgtgaatug

SEQ ID NO: 30006 - DNA, 24 bp, Artificial Sequence
  Synthetic
acatcagtttgugagaggatggug

SEQ ID NO: 30007 - DNA, 28 bp, Artificial Sequence
  Synthetic
tggcacagauacacttaacatgcaauat

SEQ ID NO: 30008 - DNA, 29 bp, Artificial Sequence
  Synthetic
gctgaggtagauggttttcaaaugaagat

SEQ ID NO: 30009 - DNA, 27 bp, Artificial Sequence
  Synthetic
tggaaatgatuaaggtcatatggcuct

SEQ ID NO: 30010 - DNA, 26 bp, Artificial Sequence
  Synthetic
catatgcaugtatacacucacccaca

SEQ ID NO: 30011 - DNA, 22 bp, Artificial Sequence
  Synthetic
gctcagacagugaaggctgtuc

SEQ ID NO: 30012 - DNA, 28 bp, Artificial Sequence
  Synthetic
ggtctgttccauacagaaataagcuact

SEQ ID NO: 30013 - DNA, 26 bp, Artificial Sequence
  Synthetic
atuatgggagaagaagaaaucgctut

SEQ ID NO: 30014 - DNA, 30 bp, Artificial Sequence
  Synthetic
ttctgttgtacauaaaagtaacccatucca

SEQ ID NO: 30015 - DNA, 27 bp, Artificial Sequence
  Synthetic
cagtcattactuacaatgcgcauaaca

SEQ ID NO: 30016 - DNA, 28 bp, Artificial Sequence
  Synthetic
gacaccagatugatctgtatcaactuca

SEQ ID NO: 30017 - DNA, 28 bp, Artificial Sequence
  Synthetic
catctctgcaaaugttagatacgguaca

SEQ ID NO: 30018 - DNA, 30 bp, Artificial Sequence
  Synthetic
cgatgtgaauccaaacttgctattuagaat

SEQ ID NO: 30019 - DNA, 28 bp, Artificial Sequence
  Synthetic
gtaacaaaguacacttgtgcacuaaaca

SEQ ID NO: 30020 - DNA, 28 bp, Artificial Sequence
  Synthetic
actgttctcttttuctttccctgtgaut

SEQ ID NO: 30021 - DNA, 24 bp, Artificial Sequence
  Synthetic
gattgcagaggutgacttttccug

SEQ ID NO: 30022 - DNA, 25 bp, Artificial Sequence
  Synthetic
tttagcatgcugtgagttcaucaga

SEQ ID NO: 30023 - DNA, 26 bp, Artificial Sequence
  Synthetic
gcttcccgaaguttaagagacaugat

SEQ ID NO: 30024 - DNA, 26 bp, Artificial Sequence
  Synthetic
cctccactgutatctgcatttugaac

SEQ ID NO: 30025 - DNA, 25 bp, Artificial Sequence
  Synthetic
ttgaaggtgccuatagtgacaaucc

SEQ ID NO: 30026 - DNA, 27 bp, Artificial Sequence
  Synthetic
aaaagccatucaaaactctctcuacct

SEQ ID NO: 30027 - DNA, 28 bp, Artificial Sequence
  Synthetic
gtggaggaauaaacagtgtctcttacug

SEQ ID NO: 30028 - DNA, 30 bp, Artificial Sequence
  Synthetic
tgtttggttaaguctatagcacatgtucaa

SEQ ID NO: 30029 - DNA, 22 bp, Artificial Sequence
  Synthetic
cccaggutcctggatuaaggat

SEQ ID NO: 30030 - DNA, 25 bp, Artificial Sequence
  Synthetic
atgtctggccugatatttgacuaca

SEQ ID NO: 30031 - DNA, 27 bp, Artificial Sequence
  Synthetic
ggctgtcccagaaguttatttaccuaa

SEQ ID NO: 30032 - DNA, 28 bp, Artificial Sequence
  Synthetic
ggaatgaaattauggaaatccctguacc

SEQ ID NO: 30033 - DNA, 21 bp, Artificial Sequence
  Synthetic
ctaucgagaggcaugcaccat

SEQ ID NO: 30034 - DNA, 22 bp, Artificial Sequence
  Synthetic
ggctguaaaagcttctgugcat

SEQ ID NO: 30035 - DNA, 29 bp, Artificial Sequence
  Synthetic
tcagtcttttcatgugtaatcctcttgut

SEQ ID NO: 30036 - DNA, 21 bp, Artificial Sequence
  Synthetic
acataccaaguagccccucca

SEQ ID NO: 30037 - DNA, 29 bp, Artificial Sequence
  Synthetic
gctgctttaatagcuctcagaatgtttuc

SEQ ID NO: 30038 - DNA, 25 bp, Artificial Sequence
  Synthetic
caacatugaaaatgtcacuggcaga

SEQ ID NO: 30039 - DNA, 27 bp, Artificial Sequence
  Synthetic
agtatgacaagcutctcattgctgaut

SEQ ID NO: 30040 - DNA, 23 bp, Artificial Sequence
  Synthetic
atgctcataugtgagatgugcca

SEQ ID NO: 30041 - DNA, 23 bp, Artificial Sequence
  Synthetic
ggaggatttgutggtttgcccua

SEQ ID NO: 30042 - DNA, 17 bp, Artificial Sequence
  Synthetic
ggcagugcagggucgag

SEQ ID NO: 30043 - DNA, 21 bp, Artificial Sequence
  Synthetic
gtgatgctgutcaagctccug

SEQ ID NO: 30044 - DNA, 28 bp, Artificial Sequence
  Synthetic
tgctcttgagtaugtactcatatccugt

SEQ ID NO: 30045 - DNA, 26 bp, Artificial Sequence
  Synthetic
gcagtgcccuccagaaaataaaguaa

SEQ ID NO: 30046 - DNA, 22 bp, Artificial Sequence
  Synthetic
ctauggcgatgguagggaaaga

SEQ ID NO: 30047 - DNA, 23 bp, Artificial Sequence
  Synthetic
cttcactcaagccugtggtttug

SEQ ID NO: 30048 - DNA, 28 bp, Artificial Sequence
  Synthetic
gaaagcacaauaatggttttctguaccc

SEQ ID NO: 30049 - DNA, 25 bp, Artificial Sequence
  Synthetic
gctctcagautgactttccatucca

SEQ ID NO: 30050 - DNA, 22 bp, Artificial Sequence
  Synthetic
cctgggcucaactcattugaga

SEQ ID NO: 30051 - DNA, 22 bp, Artificial Sequence
  Synthetic
gagtcuggcttggctuaaacct

SEQ ID NO: 30052 - DNA, 25 bp, Artificial Sequence
  Synthetic
tttcatacttgccuccacatactug

SEQ ID NO: 30053 - DNA, 30 bp, Artificial Sequence
  Synthetic
gagtacaatcacauttttccacttctugaa

SEQ ID NO: 30054 - DNA, 24 bp, Artificial Sequence
  Synthetic
tcatgctgguattttccatccuca

SEQ ID NO: 30055 - DNA, 26 bp, Artificial Sequence
  Synthetic
gccttgaaaaaucaggtgtctcttut

SEQ ID NO: 30056 - DNA, 28 bp, Artificial Sequence
  Synthetic
tgctgttattttaugaagacagtgugga

SEQ ID NO: 30057 - DNA, 23 bp, Artificial Sequence
  Synthetic
atttggauaaacgtagccugcct

SEQ ID NO: 30058 - DNA, 27 bp, Artificial Sequence
  Synthetic
agaaaagaacauggaagtttgcuacga

SEQ ID NO: 30059 - DNA, 29 bp, Artificial Sequence
  Synthetic
ggaatgaattgcuaaactgtggaaaaugt

SEQ ID NO: 30060 - DNA, 19 bp, Artificial Sequence
  Synthetic
gtttuccaggaccgcagug

SEQ ID NO: 30061 - DNA, 18 bp, Artificial Sequence
  Synthetic
ccucctgcgucaggacaa

SEQ ID NO: 30062 - DNA, 23 bp, Artificial Sequence
  Synthetic
ccaagctcccacuttctgtgaut

SEQ ID NO: 30063 - DNA, 26 bp, Artificial Sequence
  Synthetic
caaaccattctguttgcttctctcuc

SEQ ID NO: 30064 - DNA, 20 bp, Artificial Sequence
  Synthetic
cccatctccgucctcctcuc

SEQ ID NO: 30065 - DNA, 23 bp, Artificial Sequence
  Synthetic
ggcaatguccctttctccttuca

SEQ ID NO: 30066 - DNA, 21 bp, Artificial Sequence
  Synthetic
ggatcccagauggtgacccua

SEQ ID NO: 30067 - DNA, 28 bp, Artificial Sequence
  Synthetic
acatagatcttgacugtcactttctguc

SEQ ID NO: 30068 - DNA, 23 bp, Artificial Sequence
  Synthetic
tgcgtgagagcutcacattcaut

SEQ ID NO: 30069 - DNA, 29 bp, Artificial Sequence
  Synthetic
cagaatcttaattugggtggctaaacaut

SEQ ID NO: 30070 - DNA, 19 bp, Artificial Sequence
  Synthetic
aggtgtucgagttgcccut

SEQ ID NO: 30071 - DNA, 18 bp, Artificial Sequence
  Synthetic
tcaggucccgucaagcag

SEQ ID NO: 30072 - DNA, 22 bp, Artificial Sequence
  Synthetic
tgcctctacucggtccaaguat

SEQ ID NO: 30073 - DNA, 24 bp, Artificial Sequence
  Synthetic
cuttttacaguacaagcccaccac

SEQ ID NO: 30074 - DNA, 20 bp, Artificial Sequence
  Synthetic
gtgcgagcagaaugcttugg

SEQ ID NO: 30075 - DNA, 24 bp, Artificial Sequence
  Synthetic
ccaaugatgctaaugacgacacag

SEQ ID NO: 30076 - DNA, 22 bp, Artificial Sequence
  Synthetic
ggagagccuctagctgctuact

SEQ ID NO: 30077 - DNA, 23 bp, Artificial Sequence
  Synthetic
acagaauagttucccagcagcac

SEQ ID NO: 30078 - DNA, 28 bp, Artificial Sequence
  Synthetic
tcagatactaggauaaagaagccacucc

SEQ ID NO: 30079 - DNA, 28 bp, Artificial Sequence
  Synthetic
gtgtacatgcucctttttctttcactut

SEQ ID NO: 30080 - DNA, 23 bp, Artificial Sequence
  Synthetic
gaagagucacacacacuggaaga

SEQ ID NO: 30081 - DNA, 31 bp, Artificial Sequence
  Synthetic
ctctatttgcagtgutaatgtgctttcttua

SEQ ID NO: 30082 - DNA, 23 bp, Artificial Sequence
  Synthetic
catattgcguggagtaagcuggt

SEQ ID NO: 30083 - DNA, 23 bp, Artificial Sequence
  Synthetic
cagggucaaatcatucagagcct

SEQ ID NO: 30084 - DNA, 26 bp, Artificial Sequence
  Synthetic
gcttggtgucagatacaaacaatugg

SEQ ID NO: 30085 - DNA, 26 bp, Artificial Sequence
  Synthetic
attgttgtttttguagccaaagccut

SEQ ID NO: 30086 - DNA, 24 bp, Artificial Sequence
  Synthetic
aagtccagauggattctucacagt

SEQ ID NO: 30087 - DNA, 27 bp, Artificial Sequence
  Synthetic
aauacttaguaacacggaguacaagag

SEQ ID NO: 30088 - DNA, 28 bp, Artificial Sequence
  Synthetic
ctgctgctatuttcaatgaaagaaucct

SEQ ID NO: 30089 - DNA, 23 bp, Artificial Sequence
  Synthetic
gtagctugtgctcauggcaaaaa

SEQ ID NO: 30090 - DNA, 28 bp, Artificial Sequence
  Synthetic
tgggcatgaaautagacatacttctucc

SEQ ID NO: 30091 - DNA, 28 bp, Artificial Sequence
  Synthetic
attgttttcuagctaaagatuccaggct

SEQ ID NO: 30092 - DNA, 21 bp, Artificial Sequence
  Synthetic
gcatggcaacagcutcagtug

SEQ ID NO: 30093 - DNA, 29 bp, Artificial Sequence
  Synthetic
cctgaagcctcutttaggaagtaacatut

SEQ ID NO: 30094 - DNA, 22 bp, Artificial Sequence
  Synthetic
ctaggccacuggatauggaacc

SEQ ID NO: 30095 - DNA, 25 bp, Artificial Sequence
  Synthetic
tgtgtgtgaaugggtgtattuagca

SEQ ID NO: 30096 - DNA, 21 bp, Artificial Sequence
  Synthetic
gcuggagaaccaugagcagag

SEQ ID NO: 30097 - DNA, 28 bp, Artificial Sequence
  Synthetic
tccttcatatcatutgttctgtcaggug

SEQ ID NO: 30098 - DNA, 23 bp, Artificial Sequence
  Synthetic
gtgaattctguctcccactuccc

SEQ ID NO: 30099 - DNA, 24 bp, Artificial Sequence
  Synthetic
tttgtaacaagcautcccttcugt

SEQ ID NO: 30100 - DNA, 22 bp, Artificial Sequence
  Synthetic
tcatcatttuccagggccacuc

SEQ ID NO: 30101 - DNA, 28 bp, Artificial Sequence
  Synthetic
acataaactguggctttaaaggacucat

SEQ ID NO: 30102 - DNA, 26 bp, Artificial Sequence
  Synthetic
caggatgtcatacugaccagagtcua

SEQ ID NO: 30103 - DNA, 27 bp, Artificial Sequence
  Synthetic
acttucaaccaaaaccattcttugcag

SEQ ID NO: 30104 - DNA, 29 bp, Artificial Sequence
  Synthetic
cacaacaaaguctgaacattugaacaaaa

SEQ ID NO: 30105 - DNA, 27 bp, Artificial Sequence
  Synthetic
ggtaccttgaugagctaaagaatucct

SEQ ID NO: 30106 - DNA, 29 bp, Artificial Sequence
  Synthetic
catggaautactttattcuacccccaagg

SEQ ID NO: 30107 - DNA, 28 bp, Artificial Sequence
  Synthetic
ccaagcatttuagatgaggaagatucag

SEQ ID NO: 30108 - DNA, 17 bp, Artificial Sequence
  Synthetic
cgggctugcggacatug

SEQ ID NO: 30109 - DNA, 18 bp, Artificial Sequence
  Synthetic
cgttccggcguctcctug

SEQ ID NO: 30110 - DNA, 17 bp, Artificial Sequence
  Synthetic
gccgtugccgttgcuac

SEQ ID NO: 30111 - DNA, 17 bp, Artificial Sequence
  Synthetic
ccgagtcucgccgctuc

SEQ ID NO: 30112 - DNA, 24 bp, Artificial Sequence
  Synthetic
gtcttagcugtgttgttguggaaa

SEQ ID NO: 30113 - DNA, 28 bp, Artificial Sequence
  Synthetic
aggatcctctcutttcattccaactuac

SEQ ID NO: 30114 - DNA, 26 bp, Artificial Sequence
  Synthetic
cacatcaagatucagaacactgguga

SEQ ID NO: 30115 - DNA, 29 bp, Artificial Sequence
  Synthetic
gcagactttguggtcactaaaatgtuact

SEQ ID NO: 30116 - DNA, 29 bp, Artificial Sequence
  Synthetic
ctctcugggaaagaaguagagaaattaut

SEQ ID NO: 30117 - DNA, 25 bp, Artificial Sequence
  Synthetic
catctugccagacccattttucaac

SEQ ID NO: 30118 - DNA, 31 bp, Artificial Sequence
  Synthetic
ttctttattttacaucaactgctgtacucga

SEQ ID NO: 30119 - DNA, 25 bp, Artificial Sequence
  Synthetic
caagagcaacutctcctccacuaaa

SEQ ID NO: 30120 - DNA, 24 bp, Artificial Sequence
  Synthetic
aatgaacaaaacutggacuaggct

SEQ ID NO: 30121 - DNA, 28 bp, Artificial Sequence
  Synthetic
agaaaacactgugaaaagcaaagctuac

SEQ ID NO: 30122 - DNA, 22 bp, Artificial Sequence
  Synthetic
tgaatgactuttggcggauggt

SEQ ID NO: 30123 - DNA, 33 bp, Artificial Sequence
  Synthetic
aattcatttatucaattcctaaacauggccaat

SEQ ID NO: 30124 - DNA, 27 bp, Artificial Sequence
  Synthetic
ctcttcctcuccattggattuaggaaa

SEQ ID NO: 30125 - DNA, 23 bp, Artificial Sequence
  Synthetic
atgatgctcucctgcttatggug

SEQ ID NO: 30126 - DNA, 30 bp, Artificial Sequence
  Synthetic
acattgtttctgtugatattaatggctugg

SEQ ID NO: 30127 - DNA, 28 bp, Artificial Sequence
  Synthetic
cgtgagcacttuccttccataaacuaaa

SEQ ID NO: 30128 - DNA, 26 bp, Artificial Sequence
  Synthetic
ccccttaaaauaaccattgtcccuca

SEQ ID NO: 30129 - DNA, 31 bp, Artificial Sequence; identical to SEQ ID NO: 21019
  Synthetic

SEQ ID NO: 30130 - DNA, 30 bp, Artificial Sequence
  Synthetic
aattgtggttucaagctactgattagauca

SEQ ID NO: 30131 - DNA, 20 bp, Artificial Sequence
  Synthetic
gccagaguggagcgacaaua

SEQ ID NO: 30132 - DNA, 17 bp, Artificial Sequence
  Synthetic
gccacggagguctggug

SEQ ID NO: 30133 - DNA, 18 bp, Artificial Sequence
  Synthetic
cugcaacacguggccaag

SEQ ID NO: 30134 - DNA, 25 bp, Artificial Sequence
  Synthetic
gaatcttcttcacugggtgatguct

SEQ ID NO: 30135 - DNA, 27 bp, Artificial Sequence
  Synthetic
ctcaggacttautcttcagtacttugg

SEQ ID NO: 30136 - DNA, 19 bp, Artificial Sequence
  Synthetic
gggcagugggtatgggtug

SEQ ID NO: 30137 - DNA, 24 bp, Artificial Sequence
  Synthetic
actgataggcgutatctcccauct

SEQ ID NO: 30138 - DNA, 22 bp, Artificial Sequence
  Synthetic
gccatucagaggagcaaagtuc

SEQ ID NO: 30139 - DNA, 29 bp, Artificial Sequence
  Synthetic
cggatgaaaauaatggatttggcucaaaa

SEQ ID NO: 30140 - DNA, 19 bp, Artificial Sequence
  Synthetic
ggaauccaggccacgguac

SEQ ID NO: 30141 - DNA, 20 bp, Artificial Sequence
  Synthetic
tgagccaggccuctaguaca

SEQ ID NO: 30142 - DNA, 23 bp, Artificial Sequence
  Synthetic
cttcttctctuccaagccaccut

SEQ ID NO: 30143 - DNA, 21 bp, Artificial Sequence
  Synthetic
cactacugccagggcttgtua

SEQ ID NO: 30144 - DNA, 22 bp, Artificial Sequence
  Synthetic
caactgggcaaugcgtuaaact

SEQ ID NO: 30145 - DNA, 22 bp, Artificial Sequence
  Synthetic
caacactguggactgctttgug

SEQ ID NO: 30146 - DNA, 23 bp, Artificial Sequence
  Synthetic
ggaagaagaugctgcttgtguag

SEQ ID NO: 30147 - DNA, 21 bp, Artificial Sequence
  Synthetic
catctcccacauccggctaug

SEQ ID NO: 30148 - DNA, 26 bp, Artificial Sequence
  Synthetic
cauaatgcgaaaaaugaagaggacgg

SEQ ID NO: 30149 - DNA, 25 bp, Artificial Sequence
  Synthetic
tgtcctagctagugattcctgtgut

SEQ ID NO: 30150 - DNA, 25 bp, Artificial Sequence
  Synthetic
ctcttgutttcagagauggaccaca

SEQ ID NO: 30151 - DNA, 24 bp, Artificial Sequence
  Synthetic
gcaatcacagguttcccaagcuaa

SEQ ID NO: 30152 - DNA, 21 bp, Artificial Sequence
  Synthetic
acttucagcagcagguagcac

SEQ ID NO: 30153 - DNA, 29 bp, Artificial Sequence
  Synthetic
ctttgaagcagccuttatgtatgtgttut

SEQ ID NO: 30154 - DNA, 21 bp, Artificial Sequence
  Synthetic
gaacttgcgaguggtttcgug

SEQ ID NO: 30155 - DNA, 23 bp, Artificial Sequence
  Synthetic
ttttccgagucatgatcctcgug

SEQ ID NO: 30156 - DNA, 27 bp, Artificial Sequence
  Synthetic
actaatataugcaaactgcucacagca

SEQ ID NO: 30157 - DNA, 28 bp, Artificial Sequence
  Synthetic
ctgagtgtuaggaaggaaaagaaguaca

SEQ ID NO: 30158 - DNA, 20 bp, Artificial Sequence
  Synthetic
cctggtugcaggtcccuaac

SEQ ID NO: 30159 - DNA, 28 bp, Artificial Sequence
  Synthetic
agcgtggacgacaguaattaaaaguaat

SEQ ID NO: 30160 - DNA, 29 bp, Artificial Sequence
  Synthetic
gatagatttatgcuctctggacaagaugt

SEQ ID NO: 30161 - DNA, 23 bp, Artificial Sequence
  Synthetic
cgaagucgaaagaaactgtccuc

SEQ ID NO: 30162 - DNA, 19 bp, Artificial Sequence
  Synthetic
ggagaagccacgugctcua

SEQ ID NO: 30163 - DNA, 18 bp, Artificial Sequence
  Synthetic
cgacgcaguggaaaugcc

SEQ ID NO: 30164 - DNA, 22 bp, Artificial Sequence
  Synthetic
cagcccttcaugttccagttuc

SEQ ID NO: 30165 - DNA, 29 bp, Artificial Sequence
  Synthetic
acaacatgggauaaatgagaagaacucac

SEQ ID NO: 30166 - DNA, 25 bp, Artificial Sequence
  Synthetic
tttcagcagugtcataagtauggct

SEQ ID NO: 30167 - DNA, 22 bp, Artificial Sequence
  Synthetic
gcatggagugccacactctuac

SEQ ID NO: 30168 - DNA, 23 bp, Artificial Sequence
  Synthetic
gaccatucccagaggtacttucc

SEQ ID NO: 30169 - DNA, 29 bp, Artificial Sequence
  Synthetic
ccctgaagttgaaaugtagatggtatcut

SEQ ID NO: 30170 - DNA, 22 bp, Artificial Sequence
  Synthetic
gggtatccauctgagagctugc

SEQ ID NO: 30171 - DNA, 23 bp, Artificial Sequence
  Synthetic
atgccacattugagagagctcut

SEQ ID NO: 30172 - DNA, 28 bp, Artificial Sequence
  Synthetic
caccaacatacutcagaagcauaaacag

SEQ ID NO: 30173 - DNA, 28 bp, Artificial Sequence
  Synthetic
ctgcagaguggactagtttgttuaaaga

SEQ ID NO: 30174 - DNA, 26 bp, Artificial Sequence
  Synthetic
ctttggtttuaggccactgagauaga

SEQ ID NO: 30175 - DNA, 25 bp, Artificial Sequence
  Synthetic
aggagaacaaaggacuaagactugc

SEQ ID NO: 30176 - DNA, 21 bp, Artificial Sequence
  Synthetic
ctgctgcaucagggugagaat

SEQ ID NO: 30177 - DNA, 28 bp, Artificial Sequence
  Synthetic
ttgaaggtagtguaagaaaagcgaauct

SEQ ID NO: 30178 - DNA, 23 bp, Artificial Sequence
  Synthetic
ccatctgtatuccccctgcttuc

SEQ ID NO: 30179 - DNA, 22 bp, Artificial Sequence
  Synthetic
agatgccucggcacatctttut

SEQ ID NO: 30180 - DNA, 22 bp, Artificial Sequence
  Synthetic
tcatuccagccaguaacaaccc

SEQ ID NO: 30181 - DNA, 27 bp, Artificial Sequence
  Synthetic
tgaagatgtaauaacctcgaacuccca

SEQ ID NO: 30182 - DNA, 25 bp, Artificial Sequence
  Synthetic
ggattggaaguttccctacauaccc

SEQ ID NO: 30183 - DNA, 25 bp, Artificial Sequence
  Synthetic
ccataggatuggcagagatctgcua

SEQ ID NO: 30184 - DNA, 21 bp, Artificial Sequence
  Synthetic
cattgaagcuggccagtaucg

SEQ ID NO: 30185 - DNA, 27 bp, Artificial Sequence
  Synthetic
cccacaatttagugcttcagagtttut

SEQ ID NO: 30186 - DNA, 26 bp, Artificial Sequence
  Synthetic
gagtggaagutctcagagacuaacag

SEQ ID NO: 30187 - DNA, 23 bp, Artificial Sequence
  Synthetic
gccucccaaagtgcuaggaaaaa

SEQ ID NO: 30188 - DNA, 28 bp, Artificial Sequence
  Synthetic
ctagagagtaccguaatgggttaatugg

SEQ ID NO: 30189 - DNA, 30 bp, Artificial Sequence
  Synthetic
atacacctgtuttatgttctcaucagacat

SEQ ID NO: 30190 - DNA, 22 bp, Artificial Sequence
  Synthetic
gggctcacacugcaacagtaua

SEQ ID NO: 30191 - DNA, 26 bp, Artificial Sequence
  Synthetic
atcaguacaaaaccaaacucaaacut

SEQ ID NO: 30192 - DNA, 25 bp, Artificial Sequence
  Synthetic
cattcatttagcauccccaguacct

SEQ ID NO: 30193 - DNA, 30 bp, Artificial Sequence
  Synthetic
tcatgaaaacaaatcutcagtcatctccut

SEQ ID NO: 30194 - DNA, 22 bp, Artificial Sequence
  Synthetic
gcaggcagcutgactaaugagt

SEQ ID NO: 30195 - DNA, 17 bp, Artificial Sequence
  Synthetic
ggccgtucccgtagucc

SEQ ID NO: 30196 - DNA, 23 bp, Artificial Sequence
  Synthetic
cctccatacccuccccacttaua

SEQ ID NO: 30197 - DNA, 24 bp, Artificial Sequence
  Synthetic
gtatctaaccccacautccccauc

SEQ ID NO: 30198 - DNA, 21 bp, Artificial Sequence
  Synthetic
tuggtgtatgauggcccagac

SEQ ID NO: 30199 - DNA, 24 bp, Artificial Sequence
  Synthetic
cacagtatgguaacacggtugact

SEQ ID NO: 30200 - DNA, 25 bp, Artificial Sequence
  Synthetic
tauaactgcattguagcccaaaacg

SEQ ID NO: 30201 - DNA, 26 bp, Artificial Sequence
  Synthetic
ctagaacagcaauggacataggctua

SEQ ID NO: 30202 - DNA, 26 bp, Artificial Sequence
  Synthetic
gggcttgtacugaactatctagugat

SEQ ID NO: 30203 - DNA, 30 bp, Artificial Sequence
  Synthetic
tttttccatcaaggucatcttctgttttuc

SEQ ID NO: 30204 - DNA, 21 bp, Artificial Sequence
  Synthetic
cctacugccctgauccaggat

SEQ ID NO: 30205 - DNA, 23 bp, Artificial Sequence
  Synthetic
ggatttguccccacacacttcuc

SEQ ID NO: 30206 - DNA, 28 bp, Artificial Sequence
  Synthetic
attggttctcacaaauagtaggtgtgut

SEQ ID NO: 30207 - DNA, 24 bp, Artificial Sequence
  Synthetic
aaaatgauggaggagggaaaggug

SEQ ID NO: 30208 - DNA, 20 bp, Artificial Sequence
  Synthetic
agcttcugcagctgcttcut

SEQ ID NO: 30209 - DNA, 21 bp, Artificial Sequence
  Synthetic
ccatgttccutgccacctcuc

SEQ ID NO: 30210 - DNA, 23 bp, Artificial Sequence
  Synthetic
cttttctagaugtcctgggcuct

SEQ ID NO: 30211 - DNA, 21 bp, Artificial Sequence
  Synthetic
gaaggagaacaucgccaucgt

SEQ ID NO: 30212 - DNA, 17 bp, Artificial Sequence
  Synthetic
ggaggccaguccccuga

SEQ ID NO: 30213 - DNA, 18 bp, Artificial Sequence
  Synthetic
ggtggacucgcugcagac

SEQ ID NO: 30214 - DNA, 20 bp, Artificial Sequence
  Synthetic
gugagggagaagugggagac

SEQ ID NO: 30215 - DNA, 24 bp, Artificial Sequence
  Synthetic
gggaacauaggctttgagcttuct

SEQ ID NO: 30216 - DNA, 21 bp, Artificial Sequence
  Synthetic
cctccaaggaggutgccttug

SEQ ID NO: 30217 - DNA, 22 bp, Artificial Sequence
  Synthetic
gcaccggcuacagaatgagaua

SEQ ID NO: 30218 - DNA, 20 bp, Artificial Sequence
  Synthetic
gccccutcctctcugagagt

SEQ ID NO: 30219 - DNA, 18 bp, Artificial Sequence
  Synthetic
gcatgacugcgaccugct

SEQ ID NO: 30220 - DNA, 21 bp, Artificial Sequence
  Synthetic
gctccattuctggcacugaga

SEQ ID NO: 30221 - DNA, 20 bp, Artificial Sequence
  Synthetic
cacaagccccucattucacc

SEQ ID NO: 30222 - DNA, 25 bp, Artificial Sequence
  Synthetic
agaatgagaaugacaagggagaugg

SEQ ID NO: 30223 - DNA, 17 bp, Artificial Sequence
  Synthetic
aaccugcagcgggugaa

SEQ ID NO: 30224 - DNA, 19 bp, Artificial Sequence
  Synthetic
cucccgagacaggtcugag

SEQ ID NO: 30225 - DNA, 24 bp, Artificial Sequence
  Synthetic
ggaacctaagtucctggtagctut

SEQ ID NO: 30226 - DNA, 21 bp, Artificial Sequence
  Synthetic
caggccagacaccuccatuag

SEQ ID NO: 30227 - DNA, 27 bp, Artificial Sequence
  Synthetic
ctttgcttautttcttcccuccaacag

SEQ ID NO: 30228 - DNA, 23 bp, Artificial Sequence
  Synthetic
gggcctctugtagagctttctuc

SEQ ID NO: 30229 - DNA, 23 bp, Artificial Sequence
  Synthetic
ccagactagagugttgtccuggt

SEQ ID NO: 30230 - DNA, 21 bp, Artificial Sequence
  Synthetic
ttcttgagcuctgagcacucg

SEQ ID NO: 30231 - DNA, 25 bp, Artificial Sequence
  Synthetic
ccctagguctcctctcttuaaccat

SEQ ID NO: 30232 - DNA, 22 bp, Artificial Sequence
  Synthetic
ggacttcuccagcgtctcttug

SEQ ID NO: 30233 - DNA, 23 bp, Artificial Sequence
  Synthetic
tcucttttatagugccccaccct

SEQ ID NO: 30234 - DNA, 22 bp, Artificial Sequence
  Synthetic
tcctctcugctccacucaacat

SEQ ID NO: 30235 - DNA, 22 bp, Artificial Sequence
  Synthetic
catgggtgacuctggacactuc

SEQ ID NO: 30236 - DNA, 24 bp, Artificial Sequence
  Synthetic
gtcagcctuagggtaaagtggaug

SEQ ID NO: 30237 - DNA, 22 bp, Artificial Sequence
  Synthetic
cctaacuccccaccttcatcug

SEQ ID NO: 30238 - DNA, 22 bp, Artificial Sequence
  Synthetic
ctggcccuttgtgtctucagaa

SEQ ID NO: 30239 - DNA, 21 bp, Artificial Sequence
  Synthetic
cttctcccugatccacuacgc

SEQ ID NO: 30240 - DNA, 19 bp, Artificial Sequence
  Synthetic
gcauaggtggugaggccaa

SEQ ID NO: 30241 - DNA, 17 bp, Artificial Sequence
  Synthetic
ctcccaccccucaugcc

SEQ ID NO: 30242 - DNA, 24 bp, Artificial Sequence
  Synthetic
acatcttctcauacactgcctugg

SEQ ID NO: 30243 - DNA, 24 bp, Artificial Sequence
  Synthetic
agtgctcactuatcctttcccuct

SEQ ID NO: 30244 - DNA, 19 bp, Artificial Sequence
  Synthetic
cactcacaucgguggccat

SEQ ID NO: 30245 - DNA, 22 bp, Artificial Sequence
  Synthetic
ctcccttucccaactctaccug

SEQ ID NO: 30246 - DNA, 24 bp, Artificial Sequence
  Synthetic
aaaacaggagauggcaggaaugat

SEQ ID NO: 30247 - DNA, 23 bp, Artificial Sequence
  Synthetic
caggatttcacuctgtcctuccc

SEQ ID NO: 30248 - DNA, 18 bp, Artificial Sequence
  Synthetic
ggtaacucgggucagcct

SEQ ID NO: 30249 - DNA, 25 bp, Artificial Sequence
  Synthetic
cctgagttttgautggtctctgugg

SEQ ID NO: 30250 - DNA, 17 bp, Artificial Sequence
  Synthetic
tgggugggtgtcuggga

SEQ ID NO: 30251 - DNA, 19 bp, Artificial Sequence
  Synthetic
gccttguctcctgcuccag

SEQ ID NO: 30252 - DNA, 23 bp, Artificial Sequence
  Synthetic
cctctgcaucttcttucccagac

SEQ ID NO: 30253 - DNA, 21 bp, Artificial Sequence
  Synthetic
gcccttugacattcgcacuga

SEQ ID NO: 30254 - DNA, 22 bp, Artificial Sequence
  Synthetic
ctcagggcagugaagaagaguc

SEQ ID NO: 30255 - DNA, 27 bp, Artificial Sequence
  Synthetic
gactgattggacuttgtttccttucaa

SEQ ID NO: 30256 - DNA, 19 bp, Artificial Sequence
  Synthetic
gggacgagcuctcctaugc

SEQ ID NO: 30257 - DNA, 25 bp, Artificial Sequence
  Synthetic
ccttctatgacugtgccatctucac

SEQ ID NO: 30258 - DNA, 20 bp, Artificial Sequence
  Synthetic
cttctgcagcugcttctugc

SEQ ID NO: 30259 - DNA, 22 bp, Artificial Sequence
  Synthetic
tgugaggactugaccagaccat

SEQ ID NO: 30260 - DNA, 23 bp, Artificial Sequence
  Synthetic
gagcaggaaaagcautgagcauc

SEQ ID NO: 30261 - DNA, 18 bp, Artificial Sequence
  Synthetic
gagcuggaggagtugcgt

SEQ ID NO: 30262 - DNA, 19 bp, Artificial Sequence
  Synthetic
cagtccccuctgggugagt

SEQ ID NO: 30263 - DNA, 18 bp, Artificial Sequence
  Synthetic
ggactcgcugcagaccuc

SEQ ID NO: 30264 - DNA, 20 bp, Artificial Sequence
  Synthetic
gaccaaaagccuggagcuca

SEQ ID NO: 30265 - DNA, 22 bp, Artificial Sequence
  Synthetic
cctcaaccgagutaccgtgtuc

SEQ ID NO: 30266 - DNA, 20 bp, Artificial Sequence
  Synthetic
gctctggccuctcacugaac

SEQ ID NO: 30267 - DNA, 22 bp, Artificial Sequence
  Synthetic
gcaccggcuacagaatgagauc

SEQ ID NO: 30268 - DNA, 20 bp, Artificial Sequence
  Synthetic
tagctaagcaucgcctgugt

SEQ ID NO: 30269 - DNA, 20 bp, Artificial Sequence
  Synthetic
tccttuccaaggccaacucg

SEQ ID NO: 30270 - DNA, 23 bp, Artificial Sequence
  Synthetic
gctgggaagggaagugattugat

SEQ ID NO: 30271 - DNA, 24 bp, Artificial Sequence
  Synthetic
agtgctgatcuagaatggtgctuc

SEQ ID NO: 30272 - DNA, 21 bp, Artificial Sequence
  Synthetic
gggaagugggaaaaugaacca

SEQ ID NO: 30273 - DNA, 17 bp, Artificial Sequence
  Synthetic
agcugggcgagcagauc

SEQ ID NO: 30274 - DNA, 19 bp, Artificial Sequence
  Synthetic
cucccgagacaggtcugag

SEQ ID NO: 30275 - DNA, 22 bp, Artificial Sequence
  Synthetic
aactgacutgctgtuccagaga

SEQ ID NO: 30276 - DNA, 23 bp, Artificial Sequence
  Synthetic
gggtctgcutgtactgttauggg

SEQ ID NO: 30277 - DNA, 21 bp, Artificial Sequence
  Synthetic
cctggcuccttctctcuacca

SEQ ID NO: 30278 - DNA, 23 bp, Artificial Sequence
  Synthetic
gcctctugcagagctttcttcuc

SEQ ID NO: 30279 - DNA, 20 bp, Artificial Sequence
  Synthetic
agcagcauggacctugacat

SEQ ID NO: 30280 - DNA, 24 bp, Artificial Sequence
  Synthetic
ctcagcattcauctcctcctcauc

SEQ ID NO: 30281 - DNA, 26 bp, Artificial Sequence
  Synthetic
gagttacccucctatttgagtgaugt

SEQ ID NO: 30282 - DNA, 22 bp, Artificial Sequence
  Synthetic
gtgtgaacucctccttcaugga

SEQ ID NO: 30283 - DNA, 22 bp, Artificial Sequence
  Synthetic
caaggttucaggacctcaggua

SEQ ID NO: 30284 - DNA, 24 bp, Artificial Sequence
  Synthetic
caggaaaagcaucagaggagucaa

SEQ ID NO: 30285 - DNA, 22 bp, Artificial Sequence
  Synthetic
catgggtgacuctggacactuc

SEQ ID NO: 30286 - DNA, 22 bp, Artificial Sequence
  Synthetic
gtggtgguaggtagggagaugt

SEQ ID NO: 30287 - DNA, 26 bp, Artificial Sequence
  Synthetic
tttctcuattgcattttuggccacag

SEQ ID NO: 30288 - DNA, 22 bp, Artificial Sequence
  Synthetic
cagaatcccugctcctctguac

SEQ ID NO: 30289 - DNA, 23 bp, Artificial Sequence
  Synthetic
cccacttcuccctgatccacuat

SEQ ID NO: 30290 - DNA, 24 bp, Artificial Sequence
  Synthetic
gagaautcaggtgguaaggccaaa

SEQ ID NO: 30291 - DNA, 17 bp, Artificial Sequence
  Synthetic
gcucccacccctcaugc

SEQ ID NO: 30292 - DNA, 26 bp, Artificial Sequence
  Synthetic
gttgggaagagugaacttgaaaacuc

SEQ ID NO: 30293 - DNA, 23 bp, Artificial Sequence
  Synthetic
ttgctactugccttttcctucca

SEQ ID NO: 30294 - DNA, 21 bp, Artificial Sequence
  Synthetic
gatggcgccugtcagcttaua

SEQ ID NO: 30295 - DNA, 27 bp, Artificial Sequence
  Synthetic
cagggatuaaggagacaagttttcuct

SEQ ID NO: 30296 - DNA, 21 bp, Artificial Sequence
  Synthetic
ccaggtugccatggagauagt

SEQ ID NO: 30297 - DNA, 29 bp, Artificial Sequence
  Synthetic
ccctaacttttctutctctccttcttcuc

SEQ ID NO: 30298 - DNA, 23 bp, Artificial Sequence
  Synthetic
gggaaggcucatatcugagacca

SEQ ID NO: 30299 - DNA, 20 bp, Artificial Sequence
  Synthetic
gucctguaccgcagaaaggg

SEQ ID NO: 30300 - DNA, 21 bp, Artificial Sequence
  Synthetic
ggctgggaucagggagatuct

SEQ ID NO: 30301 - DNA, 17 bp, Artificial Sequence
  Synthetic
acugggauaggccggga

SEQ ID NO: 30302 - DNA, 25 bp, Artificial Sequence
  Synthetic
ccuagacacaaauagaagacacuct

SEQ ID NO: 30303 - DNA, 23 bp, Artificial Sequence
  Synthetic
gttcgacaaaaucgaggacaugg

SEQ ID NO: 30304 - DNA, 21 bp, Artificial Sequence
  Synthetic
ctctctguccacccaggtgua

SEQ ID NO: 30305 - DNA, 25 bp, Artificial Sequence
  Synthetic
tttgaccucaagaaggatgtctucg

SEQ ID NO: 30306 - DNA, 26 bp, Artificial Sequence
  Synthetic
tggagagaagaggagautaagctuga

SEQ ID NO: 30307 - DNA, 19 bp, Artificial Sequence
  Synthetic
ccagtcuggtggactuggg

SEQ ID NO: 30308 - DNA, 24 bp, Artificial Sequence
  Synthetic
gggagagaauagtttgagctccug

SEQ ID NO: 30309 - DNA, 28 bp, Artificial Sequence
  Synthetic
ccatatggtgtugtcctctatttctuag

SEQ ID NO: 30310 - DNA, 19 bp, Artificial Sequence
  Synthetic
ggacaccccucgacttcuc

SEQ ID NO: 30311 - DNA, 22 bp, Artificial Sequence
  Synthetic
tccgtgagcuctacaagaucct

SEQ ID NO: 30312 - DNA, 19 bp, Artificial Sequence
  Synthetic
cttgcucctgcguaaagcc

SEQ ID NO: 30313 - DNA, 18 bp, Artificial Sequence
  Synthetic
cccctacucctccgccut

SEQ ID NO: 30314 - DNA, 22 bp, Artificial Sequence
  Synthetic
gcagcuacagaagtuggaacga

SEQ ID NO: 30315 - DNA, 24 bp, Artificial Sequence
  Synthetic
tctcttcttucagcagcugagaac

SEQ ID NO: 30316 - DNA, 27 bp, Artificial Sequence
  Synthetic
agcctaggataugaacatactgctcut

SEQ ID NO: 30317 - DNA, 21 bp, Artificial Sequence
  Synthetic
acctacccaucaggaccucac

SEQ ID NO: 30318 - DNA, 24 bp, Artificial Sequence
  Synthetic
gtgagctaacacugaagtcctcut

SEQ ID NO: 30319 - DNA, 22 bp, Artificial Sequence
  Synthetic
gaatctugccaatgtggugagc

SEQ ID NO: 30320 - DNA, 24 bp, Artificial Sequence
  Synthetic
ccctgatctaautgtgccctctut

SEQ ID NO: 30321 - DNA, 22 bp, Artificial Sequence
  Synthetic
cacacaccugaagtactugcca

SEQ ID NO: 30322 - DNA, 26 bp, Artificial Sequence
  Synthetic
ggaccataaagauttccagactgcua

SEQ ID NO: 30323 - DNA, 22 bp, Artificial Sequence
  Synthetic
tggattgggccugataaagcug

SEQ ID NO: 30324 - DNA, 30 bp, Artificial Sequence
  Synthetic
aattgtagtgcacaaagutctgtttttcut

SEQ ID NO: 30325 - DNA, 22 bp, Artificial Sequence
  Synthetic
agtgaauccagtcuggcaaagg

SEQ ID NO: 30326 - DNA, 24 bp, Artificial Sequence
  Synthetic
guggagcaagaugaggaagaagat

SEQ ID NO: 30327 - DNA, 31 bp, Artificial Sequence
  Synthetic
cacactggcuttgagaataauaaaacaaaac

SEQ ID NO: 30328 - DNA, 25 bp, Artificial Sequence
  Synthetic
gtacttttuaagggttgugggacct

SEQ ID NO: 30329 - DNA, 29 bp, Artificial Sequence
  Synthetic
agcacaaagguagttaattcugaaagaca

SEQ ID NO: 30330 - DNA, 26 bp, Artificial Sequence
  Synthetic
ctacattactgtugcactcctgauct

SEQ ID NO: 30331 - DNA, 28 bp, Artificial Sequence
  Synthetic
gtgacaaacaaatuatcagtcttgggut

SEQ ID NO: 30332 - DNA, 23 bp, Artificial Sequence
  Synthetic
tgtgtggagaaaugatggctugt

SEQ ID NO: 30333 - DNA, 30 bp, Artificial Sequence
  Synthetic
gcttataacagugaccctgaaaaaucaaga

SEQ ID NO: 30334 - DNA, 29 bp, Artificial Sequence
  Synthetic
gaattgtgaaaucatagcaaagagugacc

SEQ ID NO: 30335 - DNA, 28 bp, Artificial Sequence
  Synthetic
ttgacattaagagcuctgacacattcut

SEQ ID NO: 30336 - DNA, 29 bp, Artificial Sequence
  Synthetic
ccttttatggaccaautagcattccauca

SEQ ID NO: 30337 - DNA, 24 bp, Artificial Sequence
  Synthetic
tctauaggcacctcctuccaaagt

SEQ ID NO: 30338 - DNA, 22 bp, Artificial Sequence
  Synthetic
tgggtgggautcaccactttuc

SEQ ID NO: 30339 - DNA, 24 bp, Artificial Sequence
  Synthetic
ttacaacgtguctctgcttctcuc

SEQ ID NO: 30340 - DNA, 21 bp, Artificial Sequence
  Synthetic
ttcttggucaccctcaggtug

SEQ ID NO: 30341 - DNA, 28 bp, Artificial Sequence
  Synthetic
ctatgatgaagcguttaggcatgttuaa

SEQ ID NO: 30342 - DNA, 21 bp, Artificial Sequence
  Synthetic
caggctggutgagcaacctua

SEQ ID NO: 30343 - DNA, 27 bp, Artificial Sequence
  Synthetic
gctagtggauaagtttttggaggaugt

SEQ ID NO: 30344 - DNA, 22 bp, Artificial Sequence
  Synthetic
gaaattcaggcccuccaggaut

SEQ ID NO: 30345 - DNA, 23 bp, Artificial Sequence
  Synthetic
catcccaccaugatcaggaucac

SEQ ID NO: 30346 - DNA, 29 bp, Artificial Sequence
  Synthetic
gtgtgtctttccutcaagatgtaaatguc

SEQ ID NO: 30347 - DNA, 23 bp, Artificial Sequence
  Synthetic
caacatagugagacccccacaua

SEQ ID NO: 30348 - DNA, 24 bp, Artificial Sequence
  Synthetic
agctttttctuccaaagccactug

SEQ ID NO: 30349 - DNA, 24 bp, Artificial Sequence
  Synthetic
tgtgaagttgcucgaatgtctuct

SEQ ID NO: 30350 - DNA, 31 bp, Artificial Sequence
  Synthetic
tgtctatctactgutattcttacctggucat

SEQ ID NO: 30351 - DNA, 23 bp, Artificial Sequence
  Synthetic
cacaccttguaatcacccctuga

SEQ ID NO: 30352 - DNA, 24 bp, Artificial Sequence
  Synthetic
tgtggaggaaggauacauttccua

SEQ ID NO: 30353 - DNA, 27 bp, Artificial Sequence
  Synthetic
cacctcacatuctaaagtgttgctuac

SEQ ID NO: 30354 - DNA, 23 bp, Artificial Sequence
  Synthetic
ttgagatcagggaugctccuagt

SEQ ID NO: 30355 - DNA, 23 bp, Artificial Sequence
  Synthetic
aaaagctctaugctgccctucat

SEQ ID NO: 30356 - DNA, 28 bp, Artificial Sequence
  Synthetic
aaatgaactagtaugaactttgccucca

SEQ ID NO: 30357 - DNA, 24 bp, Artificial Sequence
  Synthetic
gacutcatgaggtuaacccaggag

SEQ ID NO: 30358 - DNA, 24 bp, Artificial Sequence
  Synthetic
agcagctgcaacuctttgtattuc

SEQ ID NO: 30359 - DNA, 22 bp, Artificial Sequence
  Synthetic
ccttacccutctgggtctucct

SEQ ID NO: 30360 - DNA, 21 bp, Artificial Sequence
  Synthetic
ctgtgaatgcgugcttcctut

SEQ ID NO: 30361 - DNA, 20 bp, Artificial Sequence
  Synthetic
gagccaaucaggacugcaca

SEQ ID NO: 30362 - DNA, 22 bp, Artificial Sequence
  Synthetic
aggactucttcctguacaacgc

SEQ ID NO: 30363 - DNA, 23 bp, Artificial Sequence
  Synthetic
ggccatgugagctttuagaaaca

SEQ ID NO: 30364 - DNA, 24 bp, Artificial Sequence
  Synthetic
aagcuaaagaccaggauacaggga

SEQ ID NO: 30365 - DNA, 28 bp, Artificial Sequence
  Synthetic
cacatacauatgcatgaguacacacact

SEQ ID NO: 30366 - DNA, 22 bp, Artificial Sequence
  Synthetic
tgacccctgugaaccagtttuc

SEQ ID NO: 30367 - DNA, 31 bp, Artificial Sequence
  Synthetic
agtgacctcuaccaaacaataatgaaauaat

SEQ ID NO: 30368 - DNA, 24 bp, Artificial Sequence
  Synthetic
aaacgugagttgcucaaaccaaat

SEQ ID NO: 30369 - DNA, 20 bp, Artificial Sequence
  Synthetic
caccctguatgttgcctugg

SEQ ID NO: 30370 - DNA, 25 bp, Artificial Sequence
  Synthetic
gggttgattuggagattcagtgugt

SEQ ID NO: 30371 - DNA, 21 bp, Artificial Sequence
  Synthetic
gtagcctagucccctcccaut

SEQ ID NO: 30372 - DNA, 24 bp, Artificial Sequence
  Synthetic
aagutacagtaguagaggcggagt

SEQ ID NO: 30373 - DNA, 26 bp, Artificial Sequence
  Synthetic
tccacctugagttttaatgtguaggg

SEQ ID NO: 30374 - DNA, 20 bp, Artificial Sequence
  Synthetic
gcagcucaccatgtaugcct

SEQ ID NO: 30375 - DNA, 25 bp, Artificial Sequence
  Synthetic
cattgcttuactaaagggucaggct

SEQ ID NO: 30376 - DNA, 18 bp, Artificial Sequence
  Synthetic
ccaccauggacgccauca

SEQ ID NO: 30377 - DNA, 17 bp, Artificial Sequence
  Synthetic
gtgccaggcucgagucc

SEQ ID NO: 30378 - DNA, 19 bp, Artificial Sequence
  Synthetic
ccagcucgaggaggacauc

SEQ ID NO: 30379 - DNA, 27 bp, Artificial Sequence
  Synthetic
gagaaagagaaagagutagccatucgt

SEQ ID NO: 30380 - DNA, 21 bp, Artificial Sequence
  Synthetic
gcaccgaagaugaacuggaca

SEQ ID NO: 30381 - DNA, 25 bp, Artificial Sequence
  Synthetic
ggtaaacttccutcattgctcucca

SEQ ID NO: 30382 - DNA, 17 bp, Artificial Sequence
  Synthetic
gggaguagctcgcugga

SEQ ID NO: 30383 - DNA, 17 bp, Artificial Sequence
  Synthetic
gggaggaugcgcctcug

SEQ ID NO: 30384 - DNA, 25 bp, Artificial Sequence
  Synthetic
cttgggttttcutgcttgtcttuct

SEQ ID NO: 30385 - DNA, 25 bp, Artificial Sequence
  Synthetic
gaatcaagacugtacattgcuccct

SEQ ID NO: 30386 - DNA, 23 bp, Artificial Sequence
  Synthetic
gggtgtcutatgtatgaaugcgt

SEQ ID NO: 30387 - DNA, 23 bp, Artificial Sequence
  Synthetic
ccuaaaaaccauacgagccauca

SEQ ID NO: 30388 - DNA, 23 bp, Artificial Sequence
  Synthetic
ccttaacauctgttggcugagct

SEQ ID NO: 30389 - DNA, 27 bp, Artificial Sequence
  Synthetic
tggcttcauccacaactctcatatuac

SEQ ID NO: 30390 - DNA, 22 bp, Artificial Sequence
  Synthetic
cctcacucaccctccatttcut

SEQ ID NO: 30391 - DNA, 25 bp, Artificial Sequence
  Synthetic
gaaggcatgguggtgagtttatuac

SEQ ID NO: 30392 - DNA, 28 bp, Artificial Sequence
  Synthetic
tgaggtctctutgtgttctctatuaact

SEQ ID NO: 30393 - DNA, 24 bp, Artificial Sequence
  Synthetic
gcctagaatucagcccaagtttut

SEQ ID NO: 30394 - DNA, 24 bp, Artificial Sequence
  Synthetic
tgtgattgatguttgcctgccuaa

SEQ ID NO: 30395 - DNA, 23 bp, Artificial Sequence
  Synthetic
gcagcuaaggaggttttcacaug

SEQ ID NO: 30396 - DNA, 18 bp, Artificial Sequence
  Synthetic
gcugccccgggagaaauc

SEQ ID NO: 30397 - DNA, 20 bp, Artificial Sequence
  Synthetic
gctgttgguctggtcuccat

SEQ ID NO: 30398 - DNA, 20 bp, Artificial Sequence
  Synthetic
ccugaggacugggaaaggga

SEQ ID NO: 30399 - DNA, 20 bp, Artificial Sequence
  Synthetic
acgcucctctugaagaagcc

SEQ ID NO: 30400 - DNA, 21 bp, Artificial Sequence
  Synthetic
ggctugggcaaaaatguccaa

SEQ ID NO: 30401 - DNA, 21 bp, Artificial Sequence
  Synthetic
ctgcccattucttgtcaccuc

SEQ ID NO: 30402 - DNA, 18 bp, Artificial Sequence
  Synthetic
cagguccaccuggacagc

SEQ ID NO: 30403 - DNA, 19 bp, Artificial Sequence
  Synthetic
tcagctgcuctcccacuca

SEQ ID NO: 30404 - DNA, 22 bp, Artificial Sequence
  Synthetic
gagttccccucctctccauact

SEQ ID NO: 30405 - DNA, 19 bp, Artificial Sequence
  Synthetic
ccctgtcuggttgacucga

SEQ ID NO: 30406 - DNA, 18 bp, Artificial Sequence
  Synthetic
cauggagacgcgtgucct

SEQ ID NO: 30407 - DNA, 22 bp, Artificial Sequence
  Synthetic
ctacacacauctgcacacaugg

SEQ ID NO: 30408 - DNA, 19 bp, Artificial Sequence
  Synthetic
cccaagugatgcugagcca

SEQ ID NO: 30409 - DNA, 17 bp, Artificial Sequence
  Synthetic
acugtgccugggacacc

SEQ ID NO: 30410 - DNA, 23 bp, Artificial Sequence
  Synthetic
gcaagaccauagggaatacucca

SEQ ID NO: 30411 - DNA, 27 bp, Artificial Sequence
  Synthetic
gggctattatgaauaaagctgctauga

SEQ ID NO: 30412 - DNA, 22 bp, Artificial Sequence
  Synthetic
cactaccautcaccuacagcca

SEQ ID NO: 30413 - DNA, 24 bp, Artificial Sequence
  Synthetic
gagagactgutgactggtgugaaa

SEQ ID NO: 30414 - DNA, 25 bp, Artificial Sequence
  Synthetic
caaacgttcauaggcaaatgucagg

SEQ ID NO: 30415 - DNA, 22 bp, Artificial Sequence
  Synthetic
agggtgccuagacaagagguag

SEQ ID NO: 30416 - DNA, 21 bp, Artificial Sequence
  Synthetic
cagccucctttggtuagcaag

SEQ ID NO: 30417 - DNA, 22 bp, Artificial Sequence
  Synthetic
tggcgagaggauattccaguga

SEQ ID NO: 30418 - DNA, 23 bp, Artificial Sequence
  Synthetic
tccaaaccaggaggaucagtcuc

SEQ ID NO: 30419 - DNA, 25 bp, Artificial Sequence
  Synthetic
cttactagacacucctctcctcucc

SEQ ID NO: 30420 - DNA, 22 bp, Artificial Sequence
  Synthetic
cccctcgggugctaacttcuat

SEQ ID NO: 30421 - DNA, 27 bp, Artificial Sequence
  Synthetic
cctatgagttcaugagcacattctuct

SEQ ID NO: 30422 - DNA, 23 bp, Artificial Sequence
  Synthetic
gaagcttcacuctgagcauaaca

SEQ ID NO: 30423 - DNA, 22 bp, Artificial Sequence
  Synthetic
aagtgtgaaccugaagggtguc

SEQ ID NO: 30424 - DNA, 22 bp, Artificial Sequence
  Synthetic
cgttgcuccatcacccuagaac

SEQ ID NO: 30425 - DNA, 27 bp, Artificial Sequence
  Synthetic
gcttccttugaaactgacatgtucaat

SEQ ID NO: 30426 - DNA, 24 bp, Artificial Sequence
  Synthetic
accttcccacaucatcctttcuct

SEQ ID NO: 30427 - DNA, 31 bp, Artificial Sequence
  Synthetic
aatctgagaauagaaaaccttaaccaacuaa

SEQ ID NO: 30428 - DNA, 18 bp, Artificial Sequence
  Synthetic
cgggacaaguccgacuca

SEQ ID NO: 30429 - DNA, 20 bp, Artificial Sequence
  Synthetic
gaccagcgcuacgtccttua

SEQ ID NO: 30430 - DNA, 20 bp, Artificial Sequence
  Synthetic
ccaaagccuggagcttguca

SEQ ID NO: 30431 - DNA, 17 bp, Artificial Sequence
  Synthetic
ggcacaauccgcugcac

SEQ ID NO: 30432 - DNA, 22 bp, Artificial Sequence
  Synthetic
cuccacgggagcaaauacagag

SEQ ID NO: 30433 - DNA, 26 bp, Artificial Sequence
  Synthetic
cactctcctttugaccttagcatuaa

SEQ ID NO: 30434 - DNA, 27 bp, Artificial Sequence
  Synthetic
ggatgaaaagucaaaactgaccaguct

SEQ ID NO: 30435 - DNA, 26 bp, Artificial Sequence
  Synthetic
gctgtttgaagaguttgccatagaug

SEQ ID NO: 30436 - DNA, 21 bp, Artificial Sequence
  Synthetic
ccatgcuccaaagguagcaag

SEQ ID NO: 30437 - DNA, 23 bp, Artificial Sequence
  Synthetic
aaagacaaagtcugccctctgut

SEQ ID NO: 30438 - DNA, 26 bp, Artificial Sequence
  Synthetic
ggcaggagauagaacagatggtagua

SEQ ID NO: 30439 - DNA, 21 bp, Artificial Sequence
  Synthetic
tcaacuacggccgcatctaug

SEQ ID NO: 30440 - DNA, 23 bp, Artificial Sequence
  Synthetic
gcccaatgtucatcagaactguc

SEQ ID NO: 30441 - DNA, 22 bp, Artificial Sequence
  Synthetic
tgggtauctcactctucccaca

SEQ ID NO: 30442 - DNA, 22 bp, Artificial Sequence
  Synthetic
gggaaggaaaugggtctuagca

SEQ ID NO: 30443 - DNA, 23 bp, Artificial Sequence
  Synthetic
gatagattcugcttcccauggct

SEQ ID NO: 30444 - DNA, 22 bp, Artificial Sequence
  Synthetic
agtctcaggugtgtcactcuga

SEQ ID NO: 30445 - DNA, 22 bp, Artificial Sequence
  Synthetic
cagggccugatataggtgtgug

SEQ ID NO: 30446 - DNA, 20 bp, Artificial Sequence
  Synthetic
ctccccaaagcucaggtuca

SEQ ID NO: 30447 - DNA, 22 bp, Artificial Sequence
  Synthetic
cagagtgggcauctggtaauca

SEQ ID NO: 30448 - DNA, 21 bp, Artificial Sequence
  Synthetic
tgacgcuctgagtagugcaga

SEQ ID NO: 30449 - DNA, 25 bp, Artificial Sequence
  Synthetic
gacattgugagagagagaacctucc

SEQ ID NO: 30450 - DNA, 21 bp, Artificial Sequence
  Synthetic
cctucccagagauaaccccua

SEQ ID NO: 30451 - DNA, 20 bp, Artificial Sequence
  Synthetic
ccctaguggactggctcugt

SEQ ID NO: 30452 - DNA, 25 bp, Artificial Sequence
  Synthetic
atccatcaacgacutcttcatcucc

SEQ ID NO: 30453 - DNA, 22 bp, Artificial Sequence
  Synthetic
cttgcuaaaccagcucagggat

SEQ ID NO: 30454 - DNA, 17 bp, Artificial Sequence
  Synthetic
tgugccacagcccaugt

SEQ ID NO: 30455 - DNA, 19 bp, Artificial Sequence
  Synthetic
gtccctugctctggtuccc

SEQ ID NO: 30456 - DNA, 22 bp, Artificial Sequence
  Synthetic
caggaaaggaguacctccccua

SEQ ID NO: 30457 - DNA, 20 bp, Artificial Sequence
  Synthetic
cctggagguccctactggug

SEQ ID NO: 30458 - DNA, 19 bp, Artificial Sequence
  Synthetic
cagcccguaacaggaccuc

SEQ ID NO: 30459 - DNA, 17 bp, Artificial Sequence
  Synthetic
ccgtacccguggccauc

SEQ ID NO: 30460 - DNA, 19 bp, Artificial Sequence
  Synthetic
gtagggcaggcuctgctuc

SEQ ID NO: 30461 - DNA, 20 bp, Artificial Sequence
  Synthetic
ggcugcacgagcaaatctuc

SEQ ID NO: 30462 - DNA, 17 bp, Artificial Sequence
  Synthetic
ggccaccutccuccaga

SEQ ID NO: 30463 - DNA, 21 bp, Artificial Sequence
  Synthetic
caggcatggucaaacccatut

SEQ ID NO: 30464 - DNA, 20 bp, Artificial Sequence
  Synthetic
caccccucactctgcttcuc

SEQ ID NO: 30465 - DNA, 18 bp, Artificial Sequence
  Synthetic
gguccacccgaagctugt

SEQ ID NO: 30466 - DNA, 18 bp, Artificial Sequence
  Synthetic
agaggaucacgcgggtug

SEQ ID NO: 30467 - DNA, 21 bp, Artificial Sequence
  Synthetic
guatttggaggucagcacggt

SEQ ID NO: 30468 - DNA, 22 bp, Artificial Sequence
  Synthetic
gtgttgctcagaugtccccaut

SEQ ID NO: 30469 - DNA, 23 bp, Artificial Sequence
  Synthetic
aaagacacagguagctcacucac

SEQ ID NO: 30470 - DNA, 21 bp, Artificial Sequence
  Synthetic
agggttctuggagagcacauc

SEQ ID NO: 30471 - DNA, 18 bp, Artificial Sequence
  Synthetic
ctgacgucacccauccca

SEQ ID NO: 30472 - DNA, 23 bp, Artificial Sequence
  Synthetic
ggaggtgagugggagatguagat

SEQ ID NO: 30473 - DNA, 31 bp, Artificial Sequence
  Synthetic
accattatuagaacaggauctcaattcttut

SEQ ID NO: 30474 - DNA, 19 bp, Artificial Sequence
  Synthetic
cctgggtgucctctccugt

SEQ ID NO: 30475 - DNA, 24 bp, Artificial Sequence
  Synthetic
aacctuccagagcagttucagaaa

SEQ ID NO: 30476 - DNA, 18 bp, Artificial Sequence
  Synthetic
agggcccugctcacatuc

SEQ ID NO: 30477 - DNA, 17 bp, Artificial Sequence
  Synthetic
tgccagcucacugcaca

SEQ ID NO: 30478 - DNA, 23 bp, Artificial Sequence
  Synthetic
tgtcctatgagaucgtcctgucc

SEQ ID NO: 30479 - DNA, 22 bp, Artificial Sequence
  Synthetic
cccaagguaccatcttcugagt

SEQ ID NO: 30480 - DNA, 21 bp, Artificial Sequence
  Synthetic
cgtccaugacctgtugaccac

SEQ ID NO: 30481 - DNA, 21 bp, Artificial Sequence
  Synthetic
ctcagaaagcugcactucacc

SEQ ID NO: 30482 - DNA, 17 bp, Artificial Sequence
  Synthetic
gcagacgggcuggtgug

SEQ ID NO: 30483 - DNA, 21 bp, Artificial Sequence
  Synthetic
ccacggagaaauagcccugag

SEQ ID NO: 30484 - DNA, 23 bp, Artificial Sequence
  Synthetic
gtaagtccuggccttctctucaa

SEQ ID NO: 30485 - DNA, 21 bp, Artificial Sequence
  Synthetic
gacuccaacacaacgcagaug

SEQ ID NO: 30486 - DNA, 22 bp, Artificial Sequence
  Synthetic
ctctggcttucaccatcctcut

SEQ ID NO: 30487 - DNA, 23 bp, Artificial Sequence
  Synthetic
acatcccucagacaugcaaacag

SEQ ID NO: 30488 - DNA, 18 bp, Artificial Sequence
  Synthetic
gaaggcccugtccugacg

SEQ ID NO: 30489 - DNA, 20 bp, Artificial Sequence
  Synthetic
cagaggcucgcagtctttug

SEQ ID NO: 30490 - DNA, 20 bp, Artificial Sequence
  Synthetic
ctgaggtgucctgtctccug

SEQ ID NO: 30491 - DNA, 20 bp, Artificial Sequence
  Synthetic
gctgagatgugcgtgagcut

SEQ ID NO: 30492 - DNA, 21 bp, Artificial Sequence
  Synthetic
cctgaccacccuctccatuac

SEQ ID NO: 30493 - DNA, 18 bp, Artificial Sequence
  Synthetic
tttcugccgcaaggccua

SEQ ID NO: 30494 - DNA, 18 bp, Artificial Sequence
  Synthetic
ccatugccaccccucact

SEQ ID NO: 30495 - DNA, 19 bp, Artificial Sequence
  Synthetic
ccacagccccaugtcctuc

SEQ ID NO: 30496 - DNA, 21 bp, Artificial Sequence
  Synthetic
ctttggcccutggtgauaggt

SEQ ID NO: 30497 - DNA, 22 bp, Artificial Sequence
  Synthetic
atcatguccagacaggttuccg

SEQ ID NO: 30498 - DNA, 22 bp, Artificial Sequence
  Synthetic
gtttcacgcuccctgtcttcua

SEQ ID NO: 30499 - DNA, 21 bp, Artificial Sequence
  Synthetic
gaggaaaggaaggugcaguca

SEQ ID NO: 30500 - DNA, 20 bp, Artificial Sequence
  Synthetic
gaggctgguggttttgcauc

SEQ ID NO: 30501 - DNA, 21 bp, Artificial Sequence
  Synthetic
gucttctccugcacaggaacc

SEQ ID NO: 30502 - DNA, 19 bp, Artificial Sequence
  Synthetic
guactggccucaggccaaa

SEQ ID NO: 30503 - DNA, 22 bp, Artificial Sequence
  Synthetic
caccgacagugacttguacagg

SEQ ID NO: 30504 - DNA, 21 bp, Artificial Sequence
  Synthetic
tctctgcucgacctgtgtgua

SEQ ID NO: 30505 - DNA, 21 bp, Artificial Sequence
  Synthetic
cagcacctaugaggcagagug

SEQ ID NO: 30506 - DNA, 21 bp, Artificial Sequence
  Synthetic
ggttctctutgggatggucct

SEQ ID NO: 30507 - DNA, 20 bp, Artificial Sequence
  Synthetic
agaggagcuggacttgcuca

SEQ ID NO: 30508 - DNA, 19 bp, Artificial Sequence
  Synthetic
gaggtuaaggcccggucac

SEQ ID NO: 30509 - DNA, 23 bp, Artificial Sequence
  Synthetic
tttaaggcguccctctctacuct

SEQ ID NO: 30510 - DNA, 19 bp, Artificial Sequence
  Synthetic
gatggccaggcuctgtgut

SEQ ID NO: 30511 - DNA, 18 bp, Artificial Sequence
  Synthetic
acacagcuccagcggaug

SEQ ID NO: 30512 - DNA, 17 bp, Artificial Sequence
  Synthetic
gtgaugccacccugcct

SEQ ID NO: 30513 - DNA, 18 bp, Artificial Sequence
  Synthetic
ccucaccacacacgucca

SEQ ID NO: 30514 - DNA, 21 bp, Artificial Sequence
  Synthetic
ccagagccccuggagtaauca

SEQ ID NO: 30515 - DNA, 23 bp, Artificial Sequence
  Synthetic
accggagucattgtagacaaugg

SEQ ID NO: 30516 - DNA, 19 bp, Artificial Sequence
  Synthetic
caguagccgagaucagcct

SEQ ID NO: 30517 - DNA, 17 bp, Artificial Sequence
  Synthetic
ctctuggcgccacacug

SEQ ID NO: 30518 - DNA, 19 bp, Artificial Sequence
  Synthetic
ccugcacgcaaatgugagt

SEQ ID NO: 30519 - DNA, 21 bp, Artificial Sequence
  Synthetic
gagggagccccauattcccua

SEQ ID NO: 30520 - DNA, 19 bp, Artificial Sequence
  Synthetic
tcctcgguggaggactuca

SEQ ID NO: 30521 - DNA, 21 bp, Artificial Sequence
  Synthetic
gtgtaccacutctgugggcat

SEQ ID NO: 30522 - DNA, 23 bp, Artificial Sequence
  Synthetic
cttgtaaggugcggcuagaaact

SEQ ID NO: 30523 - DNA, 20 bp, Artificial Sequence
  Synthetic
cctacccugggtggtcgaua

SEQ ID NO: 30524 - DNA, 27 bp, Artificial Sequence
  Synthetic
tcaaggaguaaaaacacaggtttugat

SEQ ID NO: 30525 - DNA, 28 bp, Artificial Sequence
  Synthetic
tcttcctagaggcautcattgtgaaaug

SEQ ID NO: 30526 - DNA, 27 bp, Artificial Sequence
  Synthetic
tttaggctguttatctatgtugcccaa

SEQ ID NO: 30527 - DNA, 28 bp, Artificial Sequence
  Synthetic
cagccatucaccaaagatattucagaaa

SEQ ID NO: 30528 - DNA, 28 bp, Artificial Sequence
  Synthetic
tttttcagtgacauatcattagccccut

SEQ ID NO: 30529 - DNA, 26 bp, Artificial Sequence
  Synthetic
aggtgcacaaacacutctctactuac

SEQ ID NO: 30530 - DNA, 24 bp, Artificial Sequence
  Synthetic
gatctgtgaacugctgttctccua

SEQ ID NO: 30531 - DNA, 24 bp, Artificial Sequence
  Synthetic
gggccattcutgacaagagtttuc

SEQ ID NO: 30532 - DNA, 24 bp, Artificial Sequence
  Synthetic
ggtgcaaaacugtagaaagtugct

SEQ ID NO: 30533 - DNA, 27 bp, Artificial Sequence
  Synthetic
tcccaaccaugaagatttctttgcuaa

SEQ ID NO: 30534 - DNA, 21 bp, Artificial Sequence
  Synthetic
tgcttttcuctggccugagag

SEQ ID NO: 30535 - DNA, 20 bp, Artificial Sequence
  Synthetic
cagggucaagcagcucaaga

SEQ ID NO: 30536 - DNA, 24 bp, Artificial Sequence
  Synthetic
ggaagaggtuccctgacttcacua

SEQ ID NO: 30537 - DNA, 20 bp, Artificial Sequence
  Synthetic
ggagcaagcuccacgagaug

SEQ ID NO: 30538 - DNA, 17 bp, Artificial Sequence
  Synthetic
ggcccucacctgctgug

SEQ ID NO: 30539 - DNA, 19 bp, Artificial Sequence
  Synthetic
cccugaggcatgacuccaa

SEQ ID NO: 30540 - DNA, 21 bp, Artificial Sequence
  Synthetic
catctgaggcuctccuagcaa

SEQ ID NO: 30541 - DNA, 23 bp, Artificial Sequence
  Synthetic
cttgtcctcccugttgactcaug

SEQ ID NO: 30542 - DNA, 23 bp, Artificial Sequence
  Synthetic
cgaagttuccacaccaaccauga

SEQ ID NO: 30543 - DNA, 19 bp, Artificial Sequence
  Synthetic
caacaugcaggcgcucaag

SEQ ID NO: 30544 - DNA, 21 bp, Artificial Sequence
  Synthetic
cctcgcauggactggtgaaua

SEQ ID NO: 30545 - DNA, 23 bp, Artificial Sequence
  Synthetic
cctuggaagucaaagaggaacuc

SEQ ID NO: 30546 - DNA, 19 bp, Artificial Sequence
  Synthetic
gagccacgcgucatacuct

SEQ ID NO: 30547 - DNA, 22 bp, Artificial Sequence
  Synthetic
cggccgcutatgataaacugga

SEQ ID NO: 30548 - DNA, 23 bp, Artificial Sequence
  Synthetic
agagaagtugagaggacccauga

SEQ ID NO: 30549 - DNA, 22 bp, Artificial Sequence
  Synthetic
acctcttugcatccctttugca

SEQ ID NO: 30550 - DNA, 19 bp, Artificial Sequence
  Synthetic
ctccuccccacagaacugg

SEQ ID NO: 30551 - DNA, 26 bp, Artificial Sequence
  Synthetic
aggtggaacauaagaagaagaagcug

SEQ ID NO: 30552 - DNA, 25 bp, Artificial Sequence
  Synthetic
ctgctgatgucactcttatgtguca

SEQ ID NO: 30553 - DNA, 22 bp, Artificial Sequence
  Synthetic
actgccatucactgtgttccuc

SEQ ID NO: 30554 - DNA, 21 bp, Artificial Sequence
  Synthetic
ctcctggagguctgagatgug

SEQ ID NO: 30555 - DNA, 25 bp, Artificial Sequence
  Synthetic
cauaactgtctggucccagaaaagt

SEQ ID NO: 30556 - DNA, 28 bp, Artificial Sequence
  Synthetic
caacagagcaagaccucatctcuaaaaa

SEQ ID NO: 30557 - DNA, 23 bp, Artificial Sequence
  Synthetic
ggaacgaaaacucctugaggaga

SEQ ID NO: 30558 - DNA, 23 bp, Artificial Sequence
  Synthetic
ctgtggtgagggucaagtgatut

SEQ ID NO: 30559 - DNA, 22 bp, Artificial Sequence
  Synthetic
gtatgcagaggcugaggagaug

SEQ ID NO: 30560 - DNA, 21 bp, Artificial Sequence
  Synthetic
cccagccaugcatccauacag

SEQ ID NO: 30561 - DNA, 21 bp, Artificial Sequence
  Synthetic
aatgatgggcuaaccgtgugt

SEQ ID NO: 30562 - DNA, 25 bp, Artificial Sequence
  Synthetic
tgtgattcgcguttgaggtatuagg

SEQ ID NO: 30563 - DNA, 24 bp, Artificial Sequence
  Synthetic
ctcttccttuccttcctttugcag

SEQ ID NO: 30564 - DNA, 20 bp, Artificial Sequence
  Synthetic
gggtaccuccagcatccaut

SEQ ID NO: 30565 - DNA, 20 bp, Artificial Sequence
  Synthetic
gggatccacugccctcttug

SEQ ID NO: 30566 - DNA, 20 bp, Artificial Sequence
  Synthetic
cgtagcguggtcatcagcut

SEQ ID NO: 30567 - DNA, 22 bp, Artificial Sequence
  Synthetic
gctgagccuctggcctattuag

SEQ ID NO: 30568 - DNA, 21 bp, Artificial Sequence
  Synthetic
tgccactcucagactgtcuct

SEQ ID NO: 30569 - DNA, 20 bp, Artificial Sequence
  Synthetic
gaaugctggtuccccaaagc

SEQ ID NO: 30570 - DNA, 21 bp, Artificial Sequence
  Synthetic
acacacgtguacaaggtguga

SEQ ID NO: 30571 - DNA, 24 bp, Artificial Sequence
  Synthetic
gctctucaaccacaccatgtucat

SEQ ID NO: 30572 - DNA, 23 bp, Artificial Sequence
  Synthetic
gccatctacaugcctttcuccaa

SEQ ID NO: 30573 - DNA, 22 bp, Artificial Sequence
  Synthetic
gcaacataugagcgcctttucc

SEQ ID NO: 30574 - DNA, 24 bp, Artificial Sequence
  Synthetic
gggtgcatggauggataagtgaua

SEQ ID NO: 30575 - DNA, 26 bp, Artificial Sequence
  Synthetic
tcacgatgttucttttctccauccag

SEQ ID NO: 30576 - DNA, 25 bp, Artificial Sequence
  Synthetic
tcttaacaggutccactggtaucca

SEQ ID NO: 30577 - DNA, 24 bp, Artificial Sequence
  Synthetic
tgacctgtctucctctccttcuag

SEQ ID NO: 30578 - DNA, 23 bp, Artificial Sequence
  Synthetic
ctggaaagauagaggtggctcut

SEQ ID NO: 30579 - DNA, 23 bp, Artificial Sequence
  Synthetic
cctgaactgugttttcctgtugg

SEQ ID NO: 30580 - DNA, 22 bp, Artificial Sequence
  Synthetic
ggugcaagaggatcaugcagat

SEQ ID NO: 30581 - DNA, 25 bp, Artificial Sequence
  Synthetic
catatattcuccagcccctgatguc

SEQ ID NO: 30582 - DNA, 25 bp, Artificial Sequence
  Synthetic
ctgcactcauggatcttttcttuca

SEQ ID NO: 30583 - DNA, 28 bp, Artificial Sequence
  Synthetic
cccttagcucagagctcattttaatuca

SEQ ID NO: 30584 - DNA, 21 bp, Artificial Sequence
  Synthetic
gcccutgtacatgucgacgat

SEQ ID NO: 30585 - DNA, 30 bp, Artificial Sequence
  Synthetic
ccatctctaacaugagaatattgagtgcut

SEQ ID NO: 30586 - DNA, 24 bp, Artificial Sequence
  Synthetic
ttctggaugtcatcttucccaacc

SEQ ID NO: 30587 - DNA, 26 bp, Artificial Sequence
  Synthetic
tgagaagtucctctttguggacaaaa

SEQ ID NO: 30588 - DNA, 17 bp, Artificial Sequence
  Synthetic
ggacggucagagcugca

SEQ ID NO: 30589 - DNA, 21 bp, Artificial Sequence
  Synthetic
ggugaagaugccggaggaaag

SEQ ID NO: 30590 - DNA, 17 bp, Artificial Sequence
  Synthetic
cggccccucctcctcuc

SEQ ID NO: 30591 - DNA, 20 bp, Artificial Sequence
  Synthetic
agagtcugtgccucacgagt

SEQ ID NO: 30592 - DNA, 20 bp, Artificial Sequence
  Synthetic
agcaagttugccgcctttug

SEQ ID NO: 30593 - DNA, 20 bp, Artificial Sequence
  Synthetic
ggcugcagaagcgagtctut

SEQ ID NO: 30594 - DNA, 25 bp, Artificial Sequence
  Synthetic
aggtccttcutatccaggaugaaga

SEQ ID NO: 30595 - DNA, 22 bp, Artificial Sequence
  Synthetic
tgtcctccacacaugggaaaug

SEQ ID NO: 30596 - DNA, 22 bp, Artificial Sequence
  Synthetic
cctccagcucagttcctugaaa

SEQ ID NO: 30597 - DNA, 27 bp, Artificial Sequence
  Synthetic
ctctaaaaagtucctttcccttccuca

SEQ ID NO: 30598 - DNA, 19 bp, Artificial Sequence
  Synthetic
ccagggcgugaccatctua

SEQ ID NO: 30599 - DNA, 22 bp, Artificial Sequence
  Synthetic
cttcctugacctcccauaaccc

SEQ ID NO: 30600 - DNA, 26 bp, Artificial Sequence
  Synthetic
agctggaagacaauttcaaagagugt

SEQ ID NO: 30601 - DNA, 24 bp, Artificial Sequence
  Synthetic
tttgcacaacaugcatctaucaga

SEQ ID NO: 30602 - DNA, 23 bp, Artificial Sequence
  Synthetic
gtgttgtgtguttgtgagtguca

SEQ ID NO: 30603 - DNA, 20 bp, Artificial Sequence
  Synthetic
gggagcagcaugctaccuat

SEQ ID NO: 30604 - DNA, 23 bp, Artificial Sequence
  Synthetic
cagaaaccacauctcaugaacgc

SEQ ID NO: 30605 - DNA, 27 bp, Artificial Sequence
  Synthetic
ttcaccatcaucattccctttcttuca

SEQ ID NO: 30606 - DNA, 24 bp, Artificial Sequence
  Synthetic
caggaagtagaugaggtcgcauag

SEQ ID NO: 30607 - DNA, 22 bp, Artificial Sequence
  Synthetic
gatccaactggugaagagccut

SEQ ID NO: 30608 - DNA, 22 bp, Artificial Sequence
  Synthetic
gccatgagtugacagggaacut

SEQ ID NO: 30609 - DNA, 23 bp, Artificial Sequence
  Synthetic
caaauagcgccatcaucaacgac

SEQ ID NO: 30610 - DNA, 24 bp, Artificial Sequence
  Synthetic
ttgcgguagaaggttcuaaaagca

SEQ ID NO: 30611 - DNA, 23 bp, Artificial Sequence
  Synthetic
cttccacauctgtgtcttugcag

SEQ ID NO: 30612 - DNA, 21 bp, Artificial Sequence
  Synthetic
cucagacattctugcgcaacc

SEQ ID NO: 30613 - DNA, 26 bp, Artificial Sequence
  Synthetic
ttcactttattcuctgcagaagcugt

SEQ ID NO: 30614 - DNA, 23 bp, Artificial Sequence
  Synthetic
aaaacuccccctguaagcaaagt

SEQ ID NO: 30615 - DNA, 24 bp, Artificial Sequence
  Synthetic
ccctaacccaguccttttatccuc

SEQ ID NO: 30616 - DNA, 29 bp, Artificial Sequence
  Synthetic
actaatcttttagggucttctcagacucc

SEQ ID NO: 30617 - DNA, 24 bp, Artificial Sequence
  Synthetic
ccataaatggcucttcctgtgtuc

SEQ ID NO: 30618 - DNA, 22 bp, Artificial Sequence
  Synthetic
catgtgtccauctgagctcucc

SEQ ID NO: 30619 - DNA, 25 bp, Artificial Sequence
  Synthetic
cttaccttccccautcattcacuca

SEQ ID NO: 30620 - DNA, 22 bp, Artificial Sequence
  Synthetic
ccatccucctcctuacccaagt

SEQ ID NO: 30621 - DNA, 23 bp, Artificial Sequence
  Synthetic
cctcagttuacccatgaccctuc

SEQ ID NO: 30622 - DNA, 18 bp, Artificial Sequence
  Synthetic
ggcccagutgatcccuga

SEQ ID NO: 30623 - DNA, 19 bp, Artificial Sequence
  Synthetic
cgcacagagcutgctaugg

SEQ ID NO: 30624 - DNA, 21 bp, Artificial Sequence
  Synthetic
cacccugaggtgguaacagac

SEQ ID NO: 30625 - DNA, 25 bp, Artificial Sequence
  Synthetic
ctgccttuctgtattttcugaccct

SEQ ID NO: 30626 - DNA, 20 bp, Artificial Sequence
  Synthetic
ccctagcugggagggtagut

SEQ ID NO: 30627 - DNA, 30 bp, Artificial Sequence
  Synthetic
cctagatctgaaggaugagagattctttuc

SEQ ID NO: 30628 - DNA, 24 bp, Artificial Sequence
  Synthetic
ccttttctgcugtagaaaguccct

SEQ ID NO: 30629 - DNA, 21 bp, Artificial Sequence
  Synthetic
guggaaccagagucagagaug

SEQ ID NO: 30630 - DNA, 19 bp, Artificial Sequence
  Synthetic
gttcggtgucgccgaagua

SEQ ID NO: 30631 - DNA, 17 bp, Artificial Sequence
  Synthetic
guggucacccgcagact

SEQ ID NO: 30632 - DNA, 30 bp, Artificial Sequence
  Synthetic
ggcatatatcttgauctctacagaccugat

SEQ ID NO: 30633 - DNA, 25 bp, Artificial Sequence
  Synthetic
acccattaucaccactctgtttcug

SEQ ID NO: 30634 - DNA, 26 bp, Artificial Sequence
  Synthetic
acagaatgacuaaaagttcccugcaa

SEQ ID NO: 30635 - DNA, 25 bp, Artificial Sequence
  Synthetic
agcacttcctcucttaggtcctuac

SEQ ID NO: 30636 - DNA, 20 bp, Artificial Sequence
  Synthetic
guctctggcugcagagcaat

SEQ ID NO: 30637 - DNA, 24 bp, Artificial Sequence
  Synthetic
aggugatggacatauggcaaacag

SEQ ID NO: 30638 - DNA, 28 bp, Artificial Sequence
  Synthetic
cgcatctttcaguaatcattttggtuct

SEQ ID NO: 30639 - DNA, 23 bp, Artificial Sequence
  Synthetic
tcgtacagugactgtccttcugt

SEQ ID NO: 30640 - DNA, 25 bp, Artificial Sequence
  Synthetic
tcagacagtguatgtttggagtuca

SEQ ID NO: 30641 - DNA, 20 bp, Artificial Sequence
  Synthetic
cugcttgatcauggccaagg

SEQ ID NO: 30642 - DNA, 21 bp, Artificial Sequence
  Synthetic
ccaggacacucccacatucac

SEQ ID NO: 30643 - DNA, 24 bp, Artificial Sequence
  Synthetic
tggccucaaagctttcctuaacaa

SEQ ID NO: 30644 - DNA, 22 bp, Artificial Sequence
  Synthetic
aagagaggauggagguccagag

SEQ ID NO: 30645 - DNA, 20 bp, Artificial Sequence
  Synthetic
cttcacaggcggugacagua

SEQ ID NO: 30646 - DNA, 20 bp, Artificial Sequence
  Synthetic
tgccugccgtgtgtuaaact

SEQ ID NO: 30647 - DNA, 26 bp, Artificial Sequence
  Synthetic
ctcctttgtcuccagtctaatggtut

SEQ ID NO: 30648 - DNA, 20 bp, Artificial Sequence
  Synthetic
tcagaacgutgacagugcgt

SEQ ID NO: 30649 - DNA, 26 bp, Artificial Sequence
  Synthetic
gcctgtgggaaaauggtttctaauga

SEQ ID NO: 30650 - DNA, 26 bp, Artificial Sequence
  Synthetic
gtgccctucacagacatcttuaaaaa

SEQ ID NO: 30651 - DNA, 17 bp, Artificial Sequence
  Synthetic
cggccccacgcuctuac

SEQ ID NO: 30652 - DNA, 21 bp, Artificial Sequence
  Synthetic
aggaataaucgcccccgatug

SEQ ID NO: 30653 - DNA, 17 bp, Artificial Sequence
  Synthetic
cugcccccacuggacat

SEQ ID NO: 30654 - DNA, 18 bp, Artificial Sequence
  Synthetic
gcgaauacaccggcucgt

SEQ ID NO: 30655 - DNA, 22 bp, Artificial Sequence
  Synthetic
ctccaggucccttcgtattugg

SEQ ID NO: 30656 - DNA, 19 bp, Artificial Sequence
  Synthetic
ctgctucaaccctguccgt

SEQ ID NO: 30657 - DNA, 20 bp, Artificial Sequence
  Synthetic
gggagttgauggacgtccuc

SEQ ID NO: 30658 - DNA, 22 bp, Artificial Sequence
  Synthetic
cagtgacuccgagatccucaag

SEQ ID NO: 30659 - DNA, 21 bp, Artificial Sequence
  Synthetic
ctgatgguggagtggatgucg

SEQ ID NO: 30660 - DNA, 18 bp, Artificial Sequence
  Synthetic
ctcggacgggcucaagua

SEQ ID NO: 30661 - DNA, 20 bp, Artificial Sequence
  Synthetic
ccaccttcucgcggatctug

SEQ ID NO: 30662 - DNA, 19 bp, Artificial Sequence
  Synthetic
ccucaacccagaccccugt

SEQ ID NO: 30663 - DNA, 20 bp, Artificial Sequence
  Synthetic
cccacgaugccagtaucagg

SEQ ID NO: 30664 - DNA, 19 bp, Artificial Sequence
  Synthetic
gacatcgaggugctgucca

SEQ ID NO: 30665 - DNA, 18 bp, Artificial Sequence
  Synthetic
cucctcguccaccgacac

SEQ ID NO: 30666 - DNA, 18 bp, Artificial Sequence
  Synthetic
ggcctgcucgtggaugac

SEQ ID NO: 30667 - DNA, 23 bp, Artificial Sequence
  Synthetic
catccucagcaagggtttcauct

SEQ ID NO: 30668 - DNA, 19 bp, Artificial Sequence
  Synthetic
gcagagacugcgguccaag

SEQ ID NO: 30669 - DNA, 22 bp, Artificial Sequence
  Synthetic
ccattctccucgtcggactcua

SEQ ID NO: 30670 - DNA, 22 bp, Artificial Sequence
  Synthetic
gggtctgcuagcttggugaaaa

SEQ ID NO: 30671 - DNA, 28 bp, Artificial Sequence
  Synthetic
gcgacatctcaucagatgaaaaagtuaa

SEQ ID NO: 30672 - DNA, 19 bp, Artificial Sequence
  Synthetic
ggcttucaggccaacaugg

SEQ ID NO: 30673 - DNA, 17 bp, Artificial Sequence
  Synthetic
cagagcucggccuccag

SEQ ID NO: 30674 - DNA, 30 bp, Artificial Sequence
  Synthetic
tgttttgcttuggttatttaggaguacact

SEQ ID NO: 30675 - DNA, 28 bp, Artificial Sequence
  Synthetic
gctactgacugaagaacatcagaugaat

SEQ ID NO: 30676 - DNA, 20 bp, Artificial Sequence
  Synthetic
gaggcagcauttccuggaac

SEQ ID NO: 30677 - DNA, 19 bp, Artificial Sequence
  Synthetic
ccacagccucactcucaca

SEQ ID NO: 30678 - DNA, 22 bp, Artificial Sequence
  Synthetic
ccagcaguggttctgattugga

SEQ ID NO: 30679 - DNA, 29 bp, Artificial Sequence
  Synthetic
gttcagagagcuctgatttacagaactua

SEQ ID NO: 30680 - DNA, 24 bp, Artificial Sequence
  Synthetic
acggaauccccaagtagttagugt

SEQ ID NO: 30681 - DNA, 21 bp, Artificial Sequence
  Synthetic
aatgaccuccacgaactcugg

SEQ ID NO: 30682 - DNA, 26 bp, Artificial Sequence
  Synthetic
gttgtccttggugtagaactttguct

SEQ ID NO: 30683 - DNA, 24 bp, Artificial Sequence
  Synthetic
gatctcatcgaugtagacgaugca

SEQ ID NO: 30684 - DNA, 22 bp, Artificial Sequence
  Synthetic
caaggtcttcgucctgtgaguc

SEQ ID NO: 30685 - DNA, 24 bp, Artificial Sequence
  Synthetic
cuatcttcagugcaaaaggcaacc

SEQ ID NO: 30686 - DNA, 21 bp, Artificial Sequence
  Synthetic
tctgttgtgucaggaccccua

SEQ ID NO: 30687 - DNA, 19 bp, Artificial Sequence
  Synthetic
gctgggaucctggctcuga

SEQ ID NO: 30688 - DNA, 23 bp, Artificial Sequence
  Synthetic
tcctctuaagccctgauagcaga

SEQ ID NO: 30689 - DNA, 21 bp, Artificial Sequence
  Synthetic
ggtucaagccctgcuaaggag

SEQ ID NO: 30690 - DNA, 21 bp, Artificial Sequence
  Synthetic
cctgggtcaucttgacctugt

SEQ ID NO: 30691 - DNA, 21 bp, Artificial Sequence
  Synthetic
ggaaaagcgcuctgaaaccuc

SEQ ID NO: 30692 - DNA, 22 bp, Artificial Sequence
  Synthetic
catcgccuactccatggugaag

SEQ ID NO: 30693 - DNA, 20 bp, Artificial Sequence
  Synthetic
acccutgtgtgguagaccca

SEQ ID NO: 30694 - DNA, 22 bp, Artificial Sequence
  Synthetic
caccuccccaggacauagagat

SEQ ID NO: 30695 - DNA, 22 bp, Artificial Sequence
  Synthetic
caagtcctguttctccctcugg

SEQ ID NO: 30696 - DNA, 18 bp, Artificial Sequence
  Synthetic
gccgactuggcccaagua

SEQ ID NO: 30697 - DNA, 21 bp, Artificial Sequence
  Synthetic
cucacaaacacaggacuccgt

SEQ ID NO: 30698 - DNA, 23 bp, Artificial Sequence
  Synthetic
caagagcuccatgttatgctugt

SEQ ID NO: 30699 - DNA, 20 bp, Artificial Sequence
  Synthetic
ctgaggaccugctcctcuct

SEQ ID NO: 30700 - DNA, 22 bp, Artificial Sequence
  Synthetic
ccggaacautcttuggcagaag

SEQ ID NO: 30701 - DNA, 23 bp, Artificial Sequence
  Synthetic
ctgtggacaugtacttgaagcug

SEQ ID NO: 30702 - DNA, 21 bp, Artificial Sequence
  Synthetic
cacagacaacccutcccauct

SEQ ID NO: 30703 - DNA, 20 bp, Artificial Sequence
  Synthetic
agccactucttggtgtugca

SEQ ID NO: 30704 - DNA, 21 bp, Artificial Sequence
  Synthetic
agaggacaccutggctgguaa

SEQ ID NO: 30705 - DNA, 29 bp, Artificial Sequence
  Synthetic
gaggaatgtgucagccttatttagaauga

SEQ ID NO: 30706 - DNA, 23 bp, Artificial Sequence
  Synthetic
cagggtgttuaggagatgaccut

SEQ ID NO: 30707 - DNA, 20 bp, Artificial Sequence
  Synthetic
atctgtgtgcuggtgctcuc

SEQ ID NO: 30708 - DNA, 23 bp, Artificial Sequence
  Synthetic
cccacaacuagtagagugaagga

SEQ ID NO: 30709 - DNA, 22 bp, Artificial Sequence
  Synthetic
cctgcctugaactctttugcag

SEQ ID NO: 30710 - DNA, 19 bp, Artificial Sequence
  Synthetic
cctgcccagguggtaguag

SEQ ID NO: 30711 - DNA, 22 bp, Artificial Sequence
  Synthetic
tgtgccagcauactgctcttut

SEQ ID NO: 30712 - DNA, 24 bp, Artificial Sequence
  Synthetic
cccuccagagaaccctaauacagt

SEQ ID NO: 30713 - DNA, 28 bp, Artificial Sequence
  Synthetic
agaattgatagcagugtttgctgttcua

SEQ ID NO: 30714 - DNA, 19 bp, Artificial Sequence
  Synthetic
gaacggucacctacgugct

SEQ ID NO: 30715 - DNA, 20 bp, Artificial Sequence
  Synthetic
gcaccutccttcugcagact

SEQ ID NO: 30716 - DNA, 20 bp, Artificial Sequence
  Synthetic
ggtccgaaagcugcguaaac

SEQ ID NO: 30717 - DNA, 29 bp, Artificial Sequence
  Synthetic
ttttcagattttguacagcagcaattuct

SEQ ID NO: 30718 - DNA, 23 bp, Artificial Sequence
  Synthetic
tggtatgtcugcatgtctgtcuc

SEQ ID NO: 30719 - DNA, 19 bp, Artificial Sequence
  Synthetic
gatgtgggucctccugcac

SEQ ID NO: 30720 - DNA, 23 bp, Artificial Sequence
  Synthetic
ggaatttuccagggcacugaaga

SEQ ID NO: 30721 - DNA, 26 bp, Artificial Sequence
  Synthetic
tgaatggctaguactgatggttucac

SEQ ID NO: 30722 - DNA, 25 bp, Artificial Sequence
  Synthetic
gtctaatgccuctgcctaauggaaa

SEQ ID NO: 30723 - DNA, 24 bp, Artificial Sequence
  Synthetic
ccctaacuagtttcttcctucgca

SEQ ID NO: 30724 - DNA, 22 bp, Artificial Sequence
  Synthetic
ggtguagcacaacagacacuca

SEQ ID NO: 30725 - DNA, 30 bp, Artificial Sequence; identical to SEQ ID NO: 15103
  Synthetic

SEQ ID NO: 30726 - DNA, 24 bp, Artificial Sequence
  Synthetic
tgagagacugacaaggaaagucct

SEQ ID NO: 30727 - DNA, 21 bp, Artificial Sequence
  Synthetic
ggtcaccguctgtgggaatug

SEQ ID NO: 30728 - DNA, 22 bp, Artificial Sequence
  Synthetic
ctgggaaggcugaaaaacucaa

SEQ ID NO: 30729 - DNA, 25 bp, Artificial Sequence
  Synthetic
gttctcattcugtgtcttcccugaa

SEQ ID NO: 30730 - DNA, 22 bp, Artificial Sequence
  Synthetic
accagaaaucatggatguggca

SEQ ID NO: 30731 - DNA, 22 bp, Artificial Sequence
  Synthetic
tcutctcuccacacaggacact

SEQ ID NO: 30732 - DNA, 22 bp, Artificial Sequence
  Synthetic
cccuacacacactctugaccag

SEQ ID NO: 30733 - DNA, 24 bp, Artificial Sequence
  Synthetic
tgaagggagcggaugcttttatut

SEQ ID NO: 30734 - DNA, 20 bp, Artificial Sequence
  Synthetic
ggcatcuccagtcagcgtua

SEQ ID NO: 30735 - DNA, 20 bp, Artificial Sequence
  Synthetic
ctctttcugctgcatuggca

SEQ ID NO: 30736 - DNA, 22 bp, Artificial Sequence
  Synthetic
tgctgaagcuctggaagtgtut

SEQ ID NO: 30737 - DNA, 25 bp, Artificial Sequence
  Synthetic
gtgtgctgacauctgttttctgtuc

SEQ ID NO: 30738 - DNA, 26 bp, Artificial Sequence
  Synthetic
aaacagcacguttcaauagagagaca

SEQ ID NO: 30739 - DNA, 29 bp, Artificial Sequence
  Synthetic
agaccatgatguccataaataacttuggt

SEQ ID NO: 30740 - DNA, 27 bp, Artificial Sequence
  Synthetic
actagacugcaaaaacagtaacacuga

SEQ ID NO: 30741 - DNA, 29 bp, Artificial Sequence
  Synthetic
aggaaaatgcautcataaaggacucagaa

SEQ ID NO: 30742 - DNA, 22 bp, Artificial Sequence
  Synthetic
ggcaggttucctcatcttugct

SEQ ID NO: 30743 - DNA, 30 bp, Artificial Sequence
  Synthetic
tcatgtgtuaagagaaagctatggtttugt

SEQ ID NO: 30744 - DNA, 21 bp, Artificial Sequence
  Synthetic
gcctcgggugttttctuagga

SEQ ID NO: 30745 - DNA, 21 bp, Artificial Sequence
  Synthetic
tcgaaccgacutctctccgua

SEQ ID NO: 30746 - DNA, 21 bp, Artificial Sequence
  Synthetic
ttccuggacaggactauggct

SEQ ID NO: 30747 - DNA, 19 bp, Artificial Sequence
  Synthetic
ggtuccggttctuggcgat

SEQ ID NO: 30748 - DNA, 19 bp, Artificial Sequence
  Synthetic
tgcagcagcuggacaaugt

SEQ ID NO: 30749 - DNA, 21 bp, Artificial Sequence
  Synthetic
guagtaggcgaugaagagcgt

SEQ ID NO: 30750 - DNA, 21 bp, Artificial Sequence
  Synthetic
accagggcuttggcctuaaag

SEQ ID NO: 30751 - DNA, 21 bp, Artificial Sequence
  Synthetic
gctguggaaggcgtagaugag

SEQ ID NO: 30752 - DNA, 20 bp, Artificial Sequence
  Synthetic
gacccugggcagttcctuac

SEQ ID NO: 30753 - DNA, 20 bp, Artificial Sequence
  Synthetic
cacaaccuccccatgtccuc

SEQ ID NO: 30754 - DNA, 20 bp, Artificial Sequence
  Synthetic
atctttgcugccagctcuca

SEQ ID NO: 30755 - DNA, 20 bp, Artificial Sequence
  Synthetic
tcagccccauaccacuaggg

SEQ ID NO: 30756 - DNA, 21 bp, Artificial Sequence
  Synthetic
gggaaacggucaggcauacag

SEQ ID NO: 30757 - DNA, 21 bp, Artificial Sequence
  Synthetic
caggagcccugttaacatugg

SEQ ID NO: 30758 - DNA, 24 bp, Artificial Sequence
  Synthetic
ctctcatagtgugaaggcagguag

SEQ ID NO: 30759 - DNA, 22 bp, Artificial Sequence
  Synthetic
gctcctugggaggaagtauggt

SEQ ID NO: 30760 - DNA, 21 bp, Artificial Sequence
  Synthetic
ccauccacagacaggaaucgc

SEQ ID NO: 30761 - DNA, 21 bp, Artificial Sequence
  Synthetic
ttggttccugacccctttguc

SEQ ID NO: 30762 - DNA, 22 bp, Artificial Sequence
  Synthetic
cccuaaaaacaggcagggagug

SEQ ID NO: 30763 - DNA, 21 bp, Artificial Sequence
  Synthetic
acagacucgcactgucaacaa

SEQ ID NO: 30764 - DNA, 22 bp, Artificial Sequence
  Synthetic
gcctggccutcttgagaaacut

SEQ ID NO: 30765 - DNA, 23 bp, Artificial Sequence
  Synthetic
acgaagaauggatcaaggucgag

SEQ ID NO: 30766 - DNA, 25 bp, Artificial Sequence
  Synthetic
cgatcttctctucccgaggttcaua

SEQ ID NO: 30767 - DNA, 28 bp, Artificial Sequence
  Synthetic
tttctcatcttggacutgatcttgtcut

SEQ ID NO: 30768 - DNA, 27 bp, Artificial Sequence
  Synthetic
guaaatattaccaaguccaccccaaga

SEQ ID NO: 30769 - DNA, 20 bp, Artificial Sequence
  Synthetic
ctaacgaaugccgtccucct

SEQ ID NO: 30770 - DNA, 23 bp, Artificial Sequence
  Synthetic
tggttggagaagagcucaccaua

SEQ ID NO: 30771 - DNA, 28 bp, Artificial Sequence
  Synthetic
acttttctugacccttttatccucacag

SEQ ID NO: 30772 - DNA, 24 bp, Artificial Sequence
  Synthetic
tcaatgtcgugggaatcatagucc

SEQ ID NO: 30773 - DNA, 25 bp, Artificial Sequence
  Synthetic
ggatggtttugggatttaagtggut

SEQ ID NO: 30774 - DNA, 26 bp, Artificial Sequence
  Synthetic
acttauaggagguaaagagcaggaua

SEQ ID NO: 30775 - DNA, 31 bp, Artificial Sequence
  Synthetic
ttaattgggcttccutaacaagtcttaauct

SEQ ID NO: 30776 - DNA, 23 bp, Artificial Sequence
  Synthetic
gcaagaagcagcaacugtcttua

SEQ ID NO: 30777 - DNA, 24 bp, Artificial Sequence
  Synthetic
ggatatcaccucacctgcttcuct

SEQ ID NO: 30778 - DNA, 25 bp, Artificial Sequence
  Synthetic
ggatagccauggattttcctgacuc

SEQ ID NO: 30779 - DNA, 29 bp, Artificial Sequence
  Synthetic
gagatcacgtttugacttgaatctttcut

SEQ ID NO: 30780 - DNA, 23 bp, Artificial Sequence
  Synthetic
gaatcaaugaactcgctcuccca

SEQ ID NO: 30781 - DNA, 28 bp, Artificial Sequence
  Synthetic
aacgtatttcuaaaccctattgcucagg

SEQ ID NO: 30782 - DNA, 21 bp, Artificial Sequence
  Synthetic
ccgacttggcaucttggagut

SEQ ID NO: 30783 - DNA, 28 bp, Artificial Sequence
  Synthetic
cccctggctcauctgtaatttactttut

SEQ ID NO: 30784 - DNA, 22 bp, Artificial Sequence
  Synthetic
ccacucaagtcttuccacccaa

SEQ ID NO: 30785 - DNA, 22 bp, Artificial Sequence
  Synthetic
caguaaggacaaucccaaccug

SEQ ID NO: 30786 - DNA, 21 bp, Artificial Sequence
  Synthetic
cctctcugggcccttagctua

SEQ ID NO: 30787 - DNA, 22 bp, Artificial Sequence
  Synthetic
gcagtgtaccuggtctggtgua

SEQ ID NO: 30788 - DNA, 21 bp, Artificial Sequence
  Synthetic
ccggugcaatcccaauacaag

SEQ ID NO: 30789 - DNA, 29 bp, Artificial Sequence
  Synthetic
gagaacaaaagaggutaactcuggagaat

SEQ ID NO: 30790 - DNA, 22 bp, Artificial Sequence
  Synthetic
gcctgtugagcagagtcaaguc

SEQ ID NO: 30791 - DNA, 29 bp, Artificial Sequence
  Synthetic
tggttatggaagguaatgatagttccugt

SEQ ID NO: 30792 - DNA, 21 bp, Artificial Sequence
  Synthetic
gcttgucggcttcauaccaca

SEQ ID NO: 30793 - DNA, 23 bp, Artificial Sequence
  Synthetic
ggtagcagtugcctttggttcua

SEQ ID NO: 30794 - DNA, 23 bp, Artificial Sequence
  Synthetic
cctucccaguaggaacctatcua

SEQ ID NO: 30795 - DNA, 26 bp, Artificial Sequence
  Synthetic
aggctaatttcaugtccacctuacag

SEQ ID NO: 30796 - DNA, 21 bp, Artificial Sequence
  Synthetic
aggcggcccagautcttttua

SEQ ID NO: 30797 - DNA, 27 bp, Artificial Sequence
  Synthetic
gcttgattgtgcuttttggactttuag

SEQ ID NO: 30798 - DNA, 22 bp, Artificial Sequence
  Synthetic
cttgttctgcutgatccccuca

SEQ ID NO: 30799 - DNA, 25 bp, Artificial Sequence
  Synthetic
ggaatcttccutgtaatcccctugg

SEQ ID NO: 30800 - DNA, 30 bp, Artificial Sequence
  Synthetic
aaaaagaaagtcaguaaagtcaaggtcuca

SEQ ID NO: 30801 - DNA, 23 bp, Artificial Sequence
  Synthetic
ctggtttaagcuccaggtcugat

SEQ ID NO: 30802 - DNA, 22 bp, Artificial Sequence
  Synthetic
cgatacugcacgtgactaucca

SEQ ID NO: 30803 - DNA, 22 bp, Artificial Sequence
  Synthetic
cggacagtugttttcctcuggt

SEQ ID NO: 30804 - DNA, 25 bp, Artificial Sequence
  Synthetic
gcttgaggtugaagttgtaguccag

SEQ ID NO: 30805 - DNA, 24 bp, Artificial Sequence
  Synthetic
tgactcttacuctccatgtuccca

SEQ ID NO: 30806 - DNA, 22 bp, Artificial Sequence
  Synthetic
aaaaggctacaugcccaccuag

SEQ ID NO: 30807 - DNA, 24 bp, Artificial Sequence
  Synthetic
tgaaggacacaccccuctauacag

SEQ ID NO: 30808 - DNA, 20 bp, Artificial Sequence
  Synthetic
ccctccaccugagcgttuag

SEQ ID NO: 30809 - DNA, 28 bp, Artificial Sequence
  Synthetic
ctttggctgacucttcctttcatttuag

SEQ ID NO: 30810 - DNA, 30 bp, Artificial Sequence
  Synthetic
tcaggactttaaggaucaagattacgttuc

SEQ ID NO: 30811 - DNA, 25 bp, Artificial Sequence
  Synthetic
gacttggtggaugacaactactuct

SEQ ID NO: 30812 - DNA, 24 bp, Artificial Sequence
  Synthetic
gtaagcagcuagacaaacccauac

SEQ ID NO: 30813 - DNA, 24 bp, Artificial Sequence
  Synthetic
ccttggactaugctgacaacaucc

SEQ ID NO: 30814 - DNA, 23 bp, Artificial Sequence
  Synthetic
ccacccaccauatttcagcctut

SEQ ID NO: 30815 - DNA, 25 bp, Artificial Sequence
  Synthetic
agccttctcuttttctaatgugcca

SEQ ID NO: 30816 - DNA, 22 bp, Artificial Sequence
  Synthetic
cggaacttccugttggtcaugt

SEQ ID NO: 30817 - DNA, 23 bp, Artificial Sequence
  Synthetic
ggcctttaaacugaggtgcctut

SEQ ID NO: 30818 - DNA, 28 bp, Artificial Sequence
  Synthetic
tctctttctcctuaggtggaatgaauct

SEQ ID NO: 30819 - DNA, 20 bp, Artificial Sequence
  Synthetic
cgutgtctcugggacagcac

SEQ ID NO: 30820 - DNA, 30 bp, Artificial Sequence
  Synthetic
tttctttcagaaaucgagctatagcagaut

SEQ ID NO: 30821 - DNA, 27 bp, Artificial Sequence
  Synthetic
acaaatgacaaaautgtgcgtaacugt

SEQ ID NO: 30822 - DNA, 30 bp, Artificial Sequence
  Synthetic
tcctacatacauagttgcaaaauaaaggca

SEQ ID NO: 30823 - DNA, 25 bp, Artificial Sequence
  Synthetic
ccattctttugggtctcgtttcuga

SEQ ID NO: 30824 - DNA, 28 bp, Artificial Sequence
  Synthetic
gttggtgtuaaccaattttctgtucact

SEQ ID NO: 30825 - DNA, 27 bp, Artificial Sequence
  Synthetic
gttaaagcactaucctctacccctuac

SEQ ID NO: 30826 - DNA, 24 bp, Artificial Sequence
  Synthetic
tggtaccautctcttcaucccagt

SEQ ID NO: 30827 - DNA, 23 bp, Artificial Sequence
  Synthetic
ggtcatuggaacagctggctauc

SEQ ID NO: 30828 - DNA, 25 bp, Artificial Sequence
  Synthetic
tccataccuaacttcttgtguggga

SEQ ID NO: 30829 - DNA, 29 bp, Artificial Sequence
  Synthetic
cagtgaagaugcaaaagaaatgguaagat

SEQ ID NO: 30830 - DNA, 26 bp, Artificial Sequence
  Synthetic
ctcactatgtttgutgtccaggctua

SEQ ID NO: 30831 - DNA, 24 bp, Artificial Sequence
  Synthetic
caucagagtgcauccagaggaaaa

SEQ ID NO: 30832 - DNA, 22 bp, Artificial Sequence
  Synthetic
cctttatgagccauccatgcuc

SEQ ID NO: 30833 - DNA, 28 bp, Artificial Sequence
  Synthetic
ctctttacaaagutgacgtgtcattuct

SEQ ID NO: 30834 - DNA, 23 bp, Artificial Sequence
  Synthetic
gcttgagagtugaaggccagaug

SEQ ID NO: 30835 - DNA, 28 bp, Artificial Sequence
  Synthetic
ctacccatccgutaagattggttactua

SEQ ID NO: 30836 - DNA, 20 bp, Artificial Sequence
  Synthetic
cacgtgggaguctcctucag

SEQ ID NO: 30837 - DNA, 20 bp, Artificial Sequence
  Synthetic
gagagagccugcacauacgg

SEQ ID NO: 30838 - DNA, 21 bp, Artificial Sequence
  Synthetic
cctacatcaagguacggccut

SEQ ID NO: 30839 - DNA, 22 bp, Artificial Sequence
  Synthetic
tgaugatcagcgugaggacaac

SEQ ID NO: 30840 - DNA, 20 bp, Artificial Sequence
  Synthetic
cctctcuaagcccgcccuat

SEQ ID NO: 30841 - DNA, 27 bp, Artificial Sequence
  Synthetic
gatguaggagaaguagaagagaaacug

SEQ ID NO: 30842 - DNA, 17 bp, Artificial Sequence
  Synthetic
cgcccuccgtctgtcug

SEQ ID NO: 30843 - DNA, 17 bp, Artificial Sequence
  Synthetic
cuggaaggucccgggaa

SEQ ID NO: 30844 - DNA, 26 bp, Artificial Sequence
  Synthetic
ttcttcatccagcacutctgtttgua

SEQ ID NO: 30845 - DNA, 21 bp, Artificial Sequence
  Synthetic
aggctattgaauggcctcugg

SEQ ID NO: 30846 - DNA, 26 bp, Artificial Sequence
  Synthetic
atctcttttcuttaaggctucaggca

SEQ ID NO: 30847 - DNA, 21 bp, Artificial Sequence
  Synthetic
ggctgcutgatctcugggaat

SEQ ID NO: 30848 - DNA, 21 bp, Artificial Sequence
  Synthetic
gggaaatugaagtcggugcga

SEQ ID NO: 30849 - DNA, 22 bp, Artificial Sequence
  Synthetic
cagctgccuctttactgacugt

SEQ ID NO: 30850 - DNA, 18 bp, Artificial Sequence
  Synthetic
ggugggcctuaggagcct

SEQ ID NO: 30851 - DNA, 19 bp, Artificial Sequence
  Synthetic
gtcggugggcttattgcuc

SEQ ID NO: 30852 - DNA, 19 bp, Artificial Sequence
  Synthetic
gcagcuccaggagaaccug

SEQ ID NO: 30853 - DNA, 24 bp, Artificial Sequence
  Synthetic
cattgtcaugaattgcgtcaucgt

SEQ ID NO: 30854 - DNA, 18 bp, Artificial Sequence
  Synthetic
cccutcacacuggccaca

SEQ ID NO: 30855 - DNA, 19 bp, Artificial Sequence
  Synthetic
tcactggcuctcccuccag

SEQ ID NO: 30856 - DNA, 21 bp, Artificial Sequence
  Synthetic
acacagggcacgaugatgtua

SEQ ID NO: 30857 - DNA, 19 bp, Artificial Sequence
  Synthetic
ctcugacagccagcugacc

SEQ ID NO: 30858 - DNA, 20 bp, Artificial Sequence
  Synthetic
cctcggaguagctctuccca

SEQ ID NO: 30859 - DNA, 21 bp, Artificial Sequence
  Synthetic
tgtgcaaaaagcucggttucc

SEQ ID NO: 30860 - DNA, 22 bp, Artificial Sequence
  Synthetic
ctggacaagaccucacaccaut

SEQ ID NO: 30861 - DNA, 21 bp, Artificial Sequence
  Synthetic
agccaaaaaucccacttcugg

SEQ ID NO: 30862 - DNA, 24 bp, Artificial Sequence
  Synthetic
ctgtgtctaaguctccatctuggt

SEQ ID NO: 30863 - DNA, 24 bp, Artificial Sequence
  Synthetic
cagagcucagaataacccugagaa

SEQ ID NO: 30864 - DNA, 18 bp, Artificial Sequence
  Synthetic
ggcacugaacccccacuc

SEQ ID NO: 30865 - DNA, 18 bp, Artificial Sequence
  Synthetic
ggcugcggtgactuacct

SEQ ID NO: 30866 - DNA, 21 bp, Artificial Sequence
  Synthetic
cccaaccagagcccugaaaut

SEQ ID NO: 30867 - DNA, 25 bp, Artificial Sequence
  Synthetic
cagctctgatuatcccttccctuac

SEQ ID NO: 30868 - DNA, 23 bp, Artificial Sequence
  Synthetic
ggtgtttggagaugttaagcuca

SEQ ID NO: 30869 - DNA, 22 bp, Artificial Sequence
  Synthetic
gcatactgggaugtggcgauag

SEQ ID NO: 30870 - DNA, 24 bp, Artificial Sequence
  Synthetic
gggacttugaagctcaucagaact

SEQ ID NO: 30871 - DNA, 21 bp, Artificial Sequence
  Synthetic
ggagaaaugggaggcaggtug

SEQ ID NO: 30872 - DNA, 22 bp, Artificial Sequence
  Synthetic
tgacaaccugtugaacacacct

SEQ ID NO: 30873 - DNA, 21 bp, Artificial Sequence
  Synthetic
gcacccguactccaucaaaga

SEQ ID NO: 30874 - DNA, 21 bp, Artificial Sequence
  Synthetic
ccuagggagacugcagaacca

SEQ ID NO: 30875 - DNA, 21 bp, Artificial Sequence
  Synthetic
cugacccgacugggaagaaag

SEQ ID NO: 30876 - DNA, 20 bp, Artificial Sequence
  Synthetic
agtccagtutgggtgcucag

SEQ ID NO: 30877 - DNA, 21 bp, Artificial Sequence
  Synthetic
tctgcagaagaccgucctgua

SEQ ID NO: 30878 - DNA, 20 bp, Artificial Sequence
  Synthetic
gacagtgagucctgacugct

SEQ ID NO: 30879 - DNA, 25 bp, Artificial Sequence
  Synthetic
gaatgactggutagttgccauacac

SEQ ID NO: 30880 - DNA, 21 bp, Artificial Sequence
  Synthetic
cgcactguccccatctctuaa

SEQ ID NO: 30881 - DNA, 24 bp, Artificial Sequence
  Synthetic
cggaatggtguagagctcactuac

SEQ ID NO: 30882 - DNA, 20 bp, Artificial Sequence
  Synthetic
ccagccgguccagauttaut

SEQ ID NO: 30883 - DNA, 17 bp, Artificial Sequence
  Synthetic
gcagccccgagucucac

SEQ ID NO: 30884 - DNA, 20 bp, Artificial Sequence
  Synthetic
ccagcaacaggugcacatuc

SEQ ID NO: 30885 - DNA, 21 bp, Artificial Sequence
  Synthetic
gagaataagugcagcccuggt

SEQ ID NO: 30886 - DNA, 24 bp, Artificial Sequence
  Synthetic
ccctcatttcuctccaccctacut

SEQ ID NO: 30887 - DNA, 28 bp, Artificial Sequence
  Synthetic
cttactgggcuggatattcaaggaaaut

SEQ ID NO: 30888 - DNA, 21 bp, Artificial Sequence
  Synthetic
ggcctgauccctgatgagauc

SEQ ID NO: 30889 - DNA, 26 bp, Artificial Sequence
  Synthetic
gatgtcuaaggaaagggaggattugt

SEQ ID NO: 30890 - DNA, 22 bp, Artificial Sequence
  Synthetic
acuaaccaggacagctcucaca

SEQ ID NO: 30891 - DNA, 23 bp, Artificial Sequence
  Synthetic
agaagagtgaugaggatgcaugg

SEQ ID NO: 30892 - DNA, 24 bp, Artificial Sequence
  Synthetic
aatctgtcttugaatggccuggaa

SEQ ID NO: 30893 - DNA, 31 bp, Artificial Sequence
  Synthetic
acatgaggtactugataataatgggtacuga

SEQ ID NO: 30894 - DNA, 22 bp, Artificial Sequence
  Synthetic
cccaccaauacgcctcttcuac

SEQ ID NO: 30895 - DNA, 19 bp, Artificial Sequence
  Synthetic
gtggguaacgggcgtaguc

SEQ ID NO: 30896 - DNA, 23 bp, Artificial Sequence
  Synthetic
ccagagcucaggaagtttcctut

SEQ ID NO: 30897 - DNA, 21 bp, Artificial Sequence
  Synthetic
ggtctcaacccuccagtctuc

SEQ ID NO: 30898 - DNA, 17 bp, Artificial Sequence
  Synthetic
cccaucctccuccccac

SEQ ID NO: 30899 - DNA, 21 bp, Artificial Sequence
  Synthetic
gtucaagacagaagggccuga

SEQ ID NO: 30900 - DNA, 32 bp, Artificial Sequence
  Synthetic
atgatgttccttagautaggtgtattaaaucc

SEQ ID NO: 30901 - DNA, 28 bp, Artificial Sequence
  Synthetic
guagctaactaactucagaacaccaact

SEQ ID NO: 30902 - DNA, 25 bp, Artificial Sequence
  Synthetic
aaagtgaatcugaggcataacugca

SEQ ID NO: 30903 - DNA, 26 bp, Artificial Sequence
  Synthetic
cttgcttctcutttcctatccugagt

SEQ ID NO: 30904 - DNA, 21 bp, Artificial Sequence
  Synthetic
accuggagggccacugacaac

SEQ ID NO: 30905 - DNA, 29 bp, Artificial Sequence
  Synthetic
gcctctgattccucactgattgctctuag

SEQ ID NO: 30906 - DNA, 22 bp, Artificial Sequence
  Synthetic
gcctcacaaccuccgtcatgug

SEQ ID NO: 30907 - DNA, 29 bp, Artificial Sequence
  Synthetic
tctgtctccttccucttcctacagtacuc

SEQ ID NO: 30908 - DNA, 21 bp, Artificial Sequence
  Synthetic
ctcauggaagccagccccuca

SEQ ID NO: 30909 - DNA, 21 bp, Artificial Sequence
  Synthetic
ctgcaccagcagcuccuacac

SEQ ID NO: 30910 - DNA, 23 bp, Artificial Sequence
  Synthetic
ccttgtcctuaccagaacgtugt

SEQ ID NO: 30911 - DNA, 26 bp, Artificial Sequence
  Synthetic
tttcagacctauggaaactgtgagug

SEQ ID NO: 30912 - DNA, 17 bp, Artificial Sequence
  Synthetic
ctcgtggguccggugaa

SEQ ID NO: 30913 - DNA, 17 bp, Artificial Sequence
  Synthetic
gccuccacccacagguc

SEQ ID NO: 30914 - DNA, 20 bp, Artificial Sequence
  Synthetic
ggtcacagguaggctcccut

SEQ ID NO: 30915 - DNA, 20 bp, Artificial Sequence
  Synthetic
gacaaggcguagtggaucgt

SEQ ID NO: 30916 - DNA, 21 bp, Artificial Sequence
  Synthetic
ctctgagccccuactctccut

SEQ ID NO: 30917 - DNA, 17 bp, Artificial Sequence
  Synthetic
gccgcguccgtgtcuag

SEQ ID NO: 30918 - DNA, 20 bp, Artificial Sequence
  Synthetic
ctggcaucgctcctcaguat

SEQ ID NO: 30919 - DNA, 23 bp, Artificial Sequence
  Synthetic
catttcuggcacaagctcactuc

SEQ ID NO: 30920 - DNA, 23 bp, Artificial Sequence
  Synthetic
gacctctugcattgacctcuacc

SEQ ID NO: 30921 - DNA, 24 bp, Artificial Sequence
  Synthetic
atgactacaugtcctccugagagt

SEQ ID NO: 30922 - DNA, 22 bp, Artificial Sequence
  Synthetic
tgggcagaaaaugcaagucaac

SEQ ID NO: 30923 - DNA, 23 bp, Artificial Sequence
  Synthetic
acttgaacauccagtccagctut

SEQ ID NO: 30924 - DNA, 21 bp, Artificial Sequence
  Synthetic
gctgccucttacccuacccat

SEQ ID NO: 30925 - DNA, 19 bp, Artificial Sequence
  Synthetic
gtggaucctcgtcugcaca

SEQ ID NO: 30926 - DNA, 24 bp, Artificial Sequence
  Synthetic
gtctttagctuggccatcatcaug

SEQ ID NO: 30927 - DNA, 22 bp, Artificial Sequence
  Synthetic
actgggcuttgcttuagaggaa

SEQ ID NO: 30928 - DNA, 21 bp, Artificial Sequence
  Synthetic
cccaggtcutcagcagcttua

SEQ ID NO: 30929 - DNA, 17 bp, Artificial Sequence
  Synthetic
cutcccacuggcaccca

SEQ ID NO: 30930 - DNA, 21 bp, Artificial Sequence
  Synthetic
agtgagcccautgaggttgug

SEQ ID NO: 30931 - DNA, 21 bp, Artificial Sequence
  Synthetic
ttgattgggcagguaggcuag

SEQ ID NO: 30932 - DNA, 22 bp, Artificial Sequence
  Synthetic
catgtcacuggacatccucagt

SEQ ID NO: 30933 - DNA, 23 bp, Artificial Sequence
  Synthetic
tgagtugcctcctcuacaggaaa

SEQ ID NO: 30934 - DNA, 18 bp, Artificial Sequence
  Synthetic
gccacagcutaccgcauc

SEQ ID NO: 30935 - DNA, 21 bp, Artificial Sequence
  Synthetic
cagaagggugagctgaggtut

SEQ ID NO: 30936 - DNA, 19 bp, Artificial Sequence
  Synthetic
ccccatuccccttcccuga

SEQ ID NO: 30937 - DNA, 18 bp, Artificial Sequence
  Synthetic
gcttgggugggacgtuct

SEQ ID NO: 30938 - DNA, 23 bp, Artificial Sequence
  Synthetic
ttcgagaaaggugtggttuccat

SEQ ID NO: 30939 - DNA, 21 bp, Artificial Sequence
  Synthetic
cctcauagctcggguaaggct

SEQ ID NO: 30940 - DNA, 18 bp, Artificial Sequence
  Synthetic
ggcttuccctggcuacgg

SEQ ID NO: 30941 - DNA, 22 bp, Artificial Sequence
  Synthetic
ggcactgcugtctttttcauca

SEQ ID NO: 30942 - DNA, 19 bp, Artificial Sequence
  Synthetic
cgacattgccucccctcug

SEQ ID NO: 30943 - DNA, 24 bp, Artificial Sequence
  Synthetic
actggtaggcaugaagattcugga

SEQ ID NO: 30944 - DNA, 25 bp, Artificial Sequence
  Synthetic
ggaaaccctccautaccaaaaccuc

SEQ ID NO: 30945 - DNA, 23 bp, Artificial Sequence
  Synthetic
gaaagttcuccaggtttggcauc

SEQ ID NO: 30946 - DNA, 20 bp, Artificial Sequence
  Synthetic
aacugcaagcccctucagaa

SEQ ID NO: 30947 - DNA, 18 bp, Artificial Sequence
  Synthetic
gagtagccgcuccctucg

SEQ ID NO: 30948 - DNA, 21 bp, Artificial Sequence
  Synthetic
agcutcctctacugcaaccag

SEQ ID NO: 30949 - DNA, 22 bp, Artificial Sequence
  Synthetic
cgaactuggagaagctgucgag

SEQ ID NO: 30950 - DNA, 19 bp, Artificial Sequence
  Synthetic
ccgacaaagcutgggcuga

SEQ ID NO: 30951 - DNA, 21 bp, Artificial Sequence
  Synthetic
ccacggaaggguctucaaaca

SEQ ID NO: 30952 - DNA, 21 bp, Artificial Sequence
  Synthetic
accccacuacagcagctttug

SEQ ID NO: 30953 - DNA, 21 bp, Artificial Sequence
  Synthetic
ctttgctgaugccatcugagg

SEQ ID NO: 30954 - DNA, 21 bp, Artificial Sequence
  Synthetic
gactucaagcaggaggaggug

SEQ ID NO: 30955 - DNA, 21 bp, Artificial Sequence
  Synthetic
aggagcucacauagggaggag

SEQ ID NO: 30956 - DNA, 18 bp, Artificial Sequence
  Synthetic
catcctgcugggcccuac

SEQ ID NO: 30957 - DNA, 19 bp, Artificial Sequence
  Synthetic
ggctccguaagctttugcc

SEQ ID NO: 30958 - DNA, 21 bp, Artificial Sequence
  Synthetic
cctcttgcuccctgaatccug

SEQ ID NO: 30959 - DNA, 18 bp, Artificial Sequence
  Synthetic
ccgctugcccgactugaa

SEQ ID NO: 30960 - DNA, 20 bp, Artificial Sequence
  Synthetic
tccucgacaacagccactug

SEQ ID NO: 30961 - DNA, 19 bp, Artificial Sequence
  Synthetic
caggttccgcutcttggug

SEQ ID NO: 30962 - DNA, 23 bp, Artificial Sequence
  Synthetic
ggaugtcttcucccaagaaagcc

SEQ ID NO: 30963 - DNA, 23 bp, Artificial Sequence
  Synthetic
cgctttacaugcgaacttctuga

SEQ ID NO: 30964 - DNA, 23 bp, Artificial Sequence
  Synthetic
gtggaagaaggccuggtaaaugt

SEQ ID NO: 30965 - DNA, 22 bp, Artificial Sequence
  Synthetic
ctttccggcucctcttctuagg

SEQ ID NO: 30966 - DNA, 21 bp, Artificial Sequence
  Synthetic
ccagugaggacaactctggug

SEQ ID NO: 30967 - DNA, 17 bp, Artificial Sequence
  Synthetic
ctgtcgucgtcgctugg

SEQ ID NO: 30968 - DNA, 18 bp, Artificial Sequence
  Synthetic
ttcgugcggguggagaag

SEQ ID NO: 30969 - DNA, 17 bp, Artificial Sequence
  Synthetic
gccuccagggagtgugg

SEQ ID NO: 30970 - DNA, 22 bp, Artificial Sequence
  Synthetic
gtacctctugccttgtttgcug

SEQ ID NO: 30971 - DNA, 19 bp, Artificial Sequence
  Synthetic
ctgcacacucgggacctut

SEQ ID NO: 30972 - DNA, 18 bp, Artificial Sequence
  Synthetic
gtgauggccgggaggaug

SEQ ID NO: 30973 - DNA, 17 bp, Artificial Sequence
  Synthetic
gctgggcuggcctctua

SEQ ID NO: 30974 - DNA, 20 bp, Artificial Sequence
  Synthetic
ccucctggcugcagacaaaa

SEQ ID NO: 30975 - DNA, 19 bp, Artificial Sequence
  Synthetic
ctcctcucccgctugacac

SEQ ID NO: 30976 - DNA, 19 bp, Artificial Sequence
  Synthetic
ttttgcagaggcugccgua

SEQ ID NO: 30977 - DNA, 18 bp, Artificial Sequence
  Synthetic
gcuccggaacgggtttuc

SEQ ID NO: 30978 - DNA, 22 bp, Artificial Sequence
  Synthetic
gggatctuccagtgggatcugt

SEQ ID NO: 30979 - DNA, 22 bp, Artificial Sequence
  Synthetic
cacctctgguaacgtcctctuc

SEQ ID NO: 30980 - DNA, 26 bp, Artificial Sequence
  Synthetic
ggcugtgaaaauagaaaaggacagga

SEQ ID NO: 30981 - DNA, 17 bp, Artificial Sequence
  Synthetic
ctccgcugcgagaugga

SEQ ID NO: 30982 - DNA, 21 bp, Artificial Sequence
  Synthetic
cacccttccuggcactatucc

SEQ ID NO: 30983 - DNA, 23 bp, Artificial Sequence
  Synthetic
ccttctggugtgaatggcatuct

SEQ ID NO: 30984 - DNA, 22 bp, Artificial Sequence
  Synthetic
ggtcacgcauctcgtucagaat

SEQ ID NO: 30985 - DNA, 23 bp, Artificial Sequence
  Synthetic
ggcagtautcaggccuaaggaac

SEQ ID NO: 30986 - DNA, 23 bp, Artificial Sequence
  Synthetic
ctcgtggtucttcttcagguagg

SEQ ID NO: 30987 - DNA, 24 bp, Artificial Sequence
  Synthetic
tgtgatcaggaugggtgtctcaua

SEQ ID NO: 30988 - DNA, 22 bp, Artificial Sequence
  Synthetic
gaaggagcuagctggaatggug

SEQ ID NO: 30989 - DNA, 21 bp, Artificial Sequence
  Synthetic
gtgagaaggugaccaugcaga

SEQ ID NO: 30990 - DNA, 18 bp, Artificial Sequence
  Synthetic
gcugaagccaccgccaua

SEQ ID NO: 30991 - DNA, 18 bp, Artificial Sequence
  Synthetic
gcaccaugaccaccugca

SEQ ID NO: 30992 - DNA, 23 bp, Artificial Sequence
  Synthetic
gcagattuccaagggagactuca

SEQ ID NO: 30993 - DNA, 19 bp, Artificial Sequence
  Synthetic
gaucccccacagccacuac

SEQ ID NO: 30994 - DNA, 22 bp, Artificial Sequence
  Synthetic
tgtgccaagaacugtgctacuc

SEQ ID NO: 30995 - DNA, 25 bp, Artificial Sequence
  Synthetic
acactttgaaugctctttcctucct

SEQ ID NO: 30996 - DNA, 21 bp, Artificial Sequence
  Synthetic
caatcugaggaacccccaucg

SEQ ID NO: 30997 - DNA, 25 bp, Artificial Sequence
  Synthetic
cctctctctucctctcttctuccag

SEQ ID NO: 30998 - DNA, 24 bp, Artificial Sequence
  Synthetic
ttgttaaggaaaguggtgcatuga

SEQ ID NO: 30999 - DNA, 33 bp, Artificial Sequence
  Synthetic
gtatgtaacctgtcutttctatgatctcttuag

SEQ ID NO: 31000 - DNA, 22 bp, Artificial Sequence
  Synthetic
gcctcgccucatgtggtttuat

SEQ ID NO: 31001 - DNA, 29 bp, Artificial Sequence
  Synthetic
gtgctagagguaactcatgataauggaat

SEQ ID NO: 31002 - DNA, 22 bp, Artificial Sequence
  Synthetic
ctgggcagautctgcaacttuc

SEQ ID NO: 31003 - DNA, 30 bp, Artificial Sequence; identical to SEQ ID NO: 4777
  Synthetic

SEQ ID NO: 31004 - DNA, 22 bp, Artificial Sequence
  Synthetic
tgttgcucctccacaucaacaa

SEQ ID NO: 31005 - DNA, 22 bp, Artificial Sequence
  Synthetic
cacaattgguggcgatggttut

SEQ ID NO: 31006 - DNA, 29 bp, Artificial Sequence
  Synthetic
caaacacagctautaaaaagtcattccuc

SEQ ID NO: 31007 - DNA, 28 bp, Artificial Sequence
  Synthetic
ttcccttgatguctacaatttcacctut

SEQ ID NO: 31008 - DNA, 24 bp, Artificial Sequence
  Synthetic
caaagagaugatgucagcaaacct

SEQ ID NO: 31009 - DNA, 32 bp, Artificial Sequence
  Synthetic
gcttttacatcugaacctctgtttttgttaut

SEQ ID NO: 31010 - DNA, 23 bp, Artificial Sequence
  Synthetic
ccaaucaagaaaggatccugggt

SEQ ID NO: 31011 - DNA, 19 bp, Artificial Sequence
  Synthetic
catagcaccgutgcuaccg

SEQ ID NO: 31012 - DNA, 22 bp, Artificial Sequence
  Synthetic
cttcgguaacccugagccaaat

SEQ ID NO: 31013 - DNA, 25 bp, Artificial Sequence
  Synthetic
cctatgggaaguagtcatgcatcuc

SEQ ID NO: 31014 - DNA, 25 bp, Artificial Sequence
  Synthetic
gttgcaaaaccccuaatcuaagcat

SEQ ID NO: 31015 - DNA, 27 bp, Artificial Sequence
  Synthetic
ggaaatgagaacautccaagtacagug

SEQ ID NO: 31016 - DNA, 28 bp, Artificial Sequence
  Synthetic
cgatatgggtttugtaaaagtccatgut

SEQ ID NO: 31017 - DNA, 29 bp, Artificial Sequence
  Synthetic
ggaaagaatgaguctaatatcaagccugt

SEQ ID NO: 31018 - DNA, 22 bp, Artificial Sequence
  Synthetic
gcaaatgacuggcgcttugaaa

SEQ ID NO: 31019 - DNA, 30 bp, Artificial Sequence
  Synthetic
caaaaacagaaccaaauaaatgtgtgaguc

SEQ ID NO: 31020 - DNA, 25 bp, Artificial Sequence
  Synthetic
tgcaaaacccuttctccactuaaca

SEQ ID NO: 31021 - DNA, 26 bp, Artificial Sequence
  Synthetic
agacaaguaaaagacaugacagcgat

SEQ ID NO: 31022 - DNA, 28 bp, Artificial Sequence
  Synthetic
tcactgcuagaacaactatcaattugca

SEQ ID NO: 31023 - DNA, 28 bp, Artificial Sequence
  Synthetic
ctcgaaaaagaauctgcttucaaaacga

SEQ ID NO: 31024 - DNA, 22 bp, Artificial Sequence
  Synthetic
accattctgcuccgtttggtua

SEQ ID NO: 31025 - DNA, 32 bp, Artificial Sequence; identical to SEQ ID NO: 9083
  Synthetic

SEQ ID NO: 31026 - DNA, 28 bp, Artificial Sequence
  Synthetic
tggccagtaaguctattttctcugaaga

SEQ ID NO: 31027 - DNA, 31 bp, Artificial Sequence; identical to SEQ ID NO: 6943
  Synthetic

SEQ ID NO: 31028 - DNA, 27 bp, Artificial Sequence
  Synthetic
ccgcctatcautacatgtttcctuact

SEQ ID NO: 31029 - DNA, 27 bp, Artificial Sequence
  Synthetic
gcatccagaaaaguatcagggtagtuc

SEQ ID NO: 31030 - DNA, 24 bp, Artificial Sequence
  Synthetic
ttgtaaaggucccaaatggtctuc

SEQ ID NO: 31031 - DNA, 29 bp, Artificial Sequence
  Synthetic
gtttcttatuaggactctgtctttuccct

SEQ ID NO: 31032 - DNA, 32 bp, Artificial Sequence
  Synthetic
acaaatacaaattaugaccaagattttuggca

SEQ ID NO: 31033 - DNA, 28 bp, Artificial Sequence
  Synthetic
tgcttgactgtuctttaccatactgtut

SEQ ID NO: 31034 - DNA, 23 bp, Artificial Sequence
  Synthetic
tctguagaagtctttuggcacgg

SEQ ID NO: 31035 - DNA, 28 bp, Artificial Sequence
  Synthetic
caacaaagagcauacatagggtttcuct

SEQ ID NO: 31036 - DNA, 28 bp, Artificial Sequence
  Synthetic
atttctacttttucctactgtggtugct

SEQ ID NO: 31037 - DNA, 30 bp, Artificial Sequence
  Synthetic
ggctatttgcctuttgagtattctttcuac

SEQ ID NO: 31038 - DNA, 27 bp, Artificial Sequence
  Synthetic
ggtcaattcugttcatttgcauaggag

SEQ ID NO: 31039 - DNA, 31 bp, Artificial Sequence
  Synthetic
tgttaaagttcatuggaacagaaagaaaugg

SEQ ID NO: 31040 - DNA, 22 bp, Artificial Sequence
  Synthetic
tctgatccucctgtgtgtguga

SEQ ID NO: 31041 - DNA, 19 bp, Artificial Sequence
  Synthetic
tctccatutcggctugcgt

SEQ ID NO: 31042 - DNA, 22 bp, Artificial Sequence
  Synthetic
ccaucaacatcgucaccaccaa

SEQ ID NO: 31043 - DNA, 20 bp, Artificial Sequence
  Synthetic
gccccatccuctcagtccut

SEQ ID NO: 31044 - DNA, 21 bp, Artificial Sequence
  Synthetic
ccauaccaggccaaacagtug

SEQ ID NO: 31045 - DNA, 22 bp, Artificial Sequence
  Synthetic
gacctaugaagggcctggacua

SEQ ID NO: 31046 - DNA, 19 bp, Artificial Sequence
  Synthetic
cccccagaucgggagaaug

SEQ ID NO: 31047 - DNA, 21 bp, Artificial Sequence
  Synthetic
cccutcctttgugggaggaat

SEQ ID NO: 31048 - DNA, 21 bp, Artificial Sequence
  Synthetic
ctgaggcacuacttccgcuac

SEQ ID NO: 31049 - DNA, 22 bp, Artificial Sequence
  Synthetic
ctgtatccugagggacctcuga

SEQ ID NO: 31050 - DNA, 19 bp, Artificial Sequence
  Synthetic
gcgcacggugataaagucc

SEQ ID NO: 31051 - DNA, 27 bp, Artificial Sequence
  Synthetic
attttaatcaugcctaaagucccacct

SEQ ID NO: 31052 - DNA, 23 bp, Artificial Sequence
  Synthetic
cgtatgaatcucctggaccccut

SEQ ID NO: 31053 - DNA, 21 bp, Artificial Sequence
  Synthetic
cgctctccutcttcagaucgg

SEQ ID NO: 31054 - DNA, 19 bp, Artificial Sequence
  Synthetic
gucaacggcuccagcaaga

SEQ ID NO: 31055 - DNA, 19 bp, Artificial Sequence
  Synthetic
ggcaaaucagcccugacca

SEQ ID NO: 31056 - DNA, 21 bp, Artificial Sequence
  Synthetic
ccacccggautacaaguacca

SEQ ID NO: 31057 - DNA, 20 bp, Artificial Sequence
  Synthetic
cgggacggagauagcttguc

SEQ ID NO: 31058 - DNA, 21 bp, Artificial Sequence
  Synthetic
agcgacgucatctccaacauc

SEQ ID NO: 31059 - DNA, 19 bp, Artificial Sequence
  Synthetic
tgcutggacauccacacgt

SEQ ID NO: 31060 - DNA, 20 bp, Artificial Sequence
  Synthetic
caucaagacggagcagcuga

SEQ ID NO: 31061 - DNA, 23 bp, Artificial Sequence
  Synthetic
tgtaggugaaggtggaguagagg

SEQ ID NO: 31062 - DNA, 20 bp, Artificial Sequence
  Synthetic
acacagcucactcgacctug

SEQ ID NO: 31063 - DNA, 25 bp, Artificial Sequence
  Synthetic
ggataggtcaugtttgtgtctugga

SEQ ID NO: 31064 - DNA, 21 bp, Artificial Sequence
  Synthetic
gtgggaaagugcttgccttug

SEQ ID NO: 31065 - DNA, 26 bp, Artificial Sequence
  Synthetic
ccctagattcatutccaccagctaut

SEQ ID NO: 31066 - DNA, 20 bp, Artificial Sequence
  Synthetic
cctccggagugaccctcuag

SEQ ID NO: 31067 - DNA, 23 bp, Artificial Sequence
  Synthetic
catcggacauggagtuggagaag

SEQ ID NO: 31068 - DNA, 22 bp, Artificial Sequence
  Synthetic
gctcagctaucccctctctguc

SEQ ID NO: 31069 - DNA, 27 bp, Artificial Sequence
  Synthetic
attutaagttgtgggugaaagaggagt

SEQ ID NO: 31070 - DNA, 19 bp, Artificial Sequence
  Synthetic
ccuacacgacgccgtgaug

SEQ ID NO: 31071 - DNA, 20 bp, Artificial Sequence
  Synthetic
tcatcgtugcggctcaugat

SEQ ID NO: 31072 - DNA, 23 bp, Artificial Sequence
  Synthetic
tcatggagaugcttagccugaga

SEQ ID NO: 31073 - DNA, 23 bp, Artificial Sequence
  Synthetic
atttcuccaccgtgauccaagac

SEQ ID NO: 31074 - DNA, 17 bp, Artificial Sequence
  Synthetic
gggccutcaggcaucga

SEQ ID NO: 31075 - DNA, 19 bp, Artificial Sequence
  Synthetic
ctugaggccgucggagaag

SEQ ID NO: 31076 - DNA, 21 bp, Artificial Sequence
  Synthetic
cccaccauggtctctctcaut

SEQ ID NO: 31077 - DNA, 19 bp, Artificial Sequence
  Synthetic
ggugtacaaggugcaccca

SEQ ID NO: 31078 - DNA, 19 bp, Artificial Sequence
  Synthetic
ccgcuacgagggtcagtuc

SEQ ID NO: 31079 - DNA, 20 bp, Artificial Sequence
  Synthetic
ccaagtcuggctcucccaac

SEQ ID NO: 31080 - DNA, 21 bp, Artificial Sequence
  Synthetic
ccctcuccagagagaacccua

SEQ ID NO: 31081 - DNA, 22 bp, Artificial Sequence
  Synthetic
acctcgtaggucttagccucac

SEQ ID NO: 31082 - DNA, 17 bp, Artificial Sequence
  Synthetic
gggtgcccugctgacug

SEQ ID NO: 31083 - DNA, 17 bp, Artificial Sequence
  Synthetic
ccuccccaccgagcuct

SEQ ID NO: 31084 - DNA, 20 bp, Artificial Sequence
  Synthetic
ggtcccaccugaagaggtug

SEQ ID NO: 31085 - DNA, 22 bp, Artificial Sequence
  Synthetic
catgttgtuggtgacctuccag

SEQ ID NO: 31086 - DNA, 20 bp, Artificial Sequence
  Synthetic
cccctgaucctagcatggut

SEQ ID NO: 31087 - DNA, 21 bp, Artificial Sequence
  Synthetic
ggcctagtucctgggtcctua

SEQ ID NO: 31088 - DNA, 22 bp, Artificial Sequence
  Synthetic
gcctccactucagggctatcua

SEQ ID NO: 31089 - DNA, 23 bp, Artificial Sequence
  Synthetic
ctatgggauggagatggaguagg

SEQ ID NO: 31090 - DNA, 23 bp, Artificial Sequence
  Synthetic
tgaagctuacagagaagcaggug

SEQ ID NO: 31091 - DNA, 19 bp, Artificial Sequence
  Synthetic
gggtucggaggtggucaga

SEQ ID NO: 31092 - DNA, 22 bp, Artificial Sequence
  Synthetic
ctttatccggccugaggaugac

SEQ ID NO: 31093 - DNA, 22 bp, Artificial Sequence
  Synthetic
gccaggucgcaattccactuaa

SEQ ID NO: 31094 - DNA, 21 bp, Artificial Sequence
  Synthetic
tggtctcugcagtgtccauga

SEQ ID NO: 31095 - DNA, 21 bp, Artificial Sequence
  Synthetic
gggagucaacttctugcagct

SEQ ID NO: 31096 - DNA, 18 bp, Artificial Sequence
  Synthetic
ccccaaccugacccgtua

SEQ ID NO: 31097 - DNA, 19 bp, Artificial Sequence
  Synthetic
cacctgucgtgacccucag

SEQ ID NO: 31098 - DNA, 25 bp, Artificial Sequence
  Synthetic
gtaaagtacuggattcagggugact

SEQ ID NO: 31099 - DNA, 21 bp, Artificial Sequence
  Synthetic
ggacaaauggacagacauggc

SEQ ID NO: 31100 - DNA, 21 bp, Artificial Sequence
  Synthetic
tgaccctcugaagcactcuct

SEQ ID NO: 31101 - DNA, 17 bp, Artificial Sequence
  Synthetic
cccugcccaccacucac

SEQ ID NO: 31102 - DNA, 23 bp, Artificial Sequence
  Synthetic
atcatcccugacatccctaucgt

SEQ ID NO: 31103 - DNA, 22 bp, Artificial Sequence
  Synthetic
gacucactctguacccaagacc

SEQ ID NO: 31104 - DNA, 20 bp, Artificial Sequence
  Synthetic
gggugaccaggaatgugcag

SEQ ID NO: 31105 - DNA, 19 bp, Artificial Sequence
  Synthetic
ctcaggugggtgccauagg

SEQ ID NO: 31106 - DNA, 24 bp, Artificial Sequence
  Synthetic
cctgctcctcucactcttgtttug

SEQ ID NO: 31107 - DNA, 20 bp, Artificial Sequence
  Synthetic
ggatggccaccccugtacua

SEQ ID NO: 31108 - DNA, 22 bp, Artificial Sequence
  Synthetic
cccacatcuctcagagugagct

SEQ ID NO: 31109 - DNA, 21 bp, Artificial Sequence
  Synthetic
gttccugacacagctgaggua

SEQ ID NO: 31110 - DNA, 19 bp, Artificial Sequence
  Synthetic
tggtgguggaagaccucct

SEQ ID NO: 31111 - DNA, 22 bp, Artificial Sequence
  Synthetic
aguagaggaagagcaucagcct

SEQ ID NO: 31112 - DNA, 17 bp, Artificial Sequence
  Synthetic
cugagcccagacucgct

SEQ ID NO: 31113 - DNA, 20 bp, Artificial Sequence
  Synthetic
gagcagggaagaugcctuca

SEQ ID NO: 31114 - DNA, 20 bp, Artificial Sequence
  Synthetic
ccaccctcugactggccuat

SEQ ID NO: 31115 - DNA, 18 bp, Artificial Sequence
  Synthetic
gagagccgggauccccua

SEQ ID NO: 31116 - DNA, 21 bp, Artificial Sequence
  Synthetic
ctuagcacccacauggaccaa

SEQ ID NO: 31117 - DNA, 21 bp, Artificial Sequence
  Synthetic
aauaggttugggcccacagag

SEQ ID NO: 31118 - DNA, 21 bp, Artificial Sequence
  Synthetic
gcctcuactcccauagcccaa

SEQ ID NO: 31119 - DNA, 19 bp, Artificial Sequence
  Synthetic
gcccagacucctgcctuac

SEQ ID NO: 31120 - DNA, 18 bp, Artificial Sequence
  Synthetic
ctctgcgugcguggagat

SEQ ID NO: 31121 - DNA, 18 bp, Artificial Sequence
  Synthetic
ccuggcgacuccaagacc

SEQ ID NO: 31122 - DNA, 29 bp, Artificial Sequence
  Synthetic
aaaacctcacaaggucctttatacttugt

SEQ ID NO: 31123 - DNA, 22 bp, Artificial Sequence
  Synthetic
ccataggacacagccucctcut

SEQ ID NO: 31124 - DNA, 20 bp, Artificial Sequence
  Synthetic
ccuggagaggaggcauacga

SEQ ID NO: 31125 - DNA, 24 bp, Artificial Sequence
  Synthetic
aaaacagaagucagggctacucac

SEQ ID NO: 31126 - DNA, 21 bp, Artificial Sequence
  Synthetic
tcaatggtgucgctgtctcuc

SEQ ID NO: 31127 - DNA, 22 bp, Artificial Sequence
  Synthetic
aaaccugggaaggcttcctuac

SEQ ID NO: 31128 - DNA, 21 bp, Artificial Sequence
  Synthetic
acctccaagagcuggtgtgua

SEQ ID NO: 31129 - DNA, 20 bp, Artificial Sequence
  Synthetic
cggtcgugactcttcuccag

SEQ ID NO: 31130 - DNA, 25 bp, Artificial Sequence
  Synthetic
ccactcactcuctctctctttcucc

SEQ ID NO: 31131 - DNA, 29 bp, Artificial Sequence
  Synthetic
attaaacatgtgucgagtttgcagaauac

SEQ ID NO: 31132 - DNA, 20 bp, Artificial Sequence
  Synthetic
gaggctcuggtgttctuggg

SEQ ID NO: 31133 - DNA, 18 bp, Artificial Sequence
  Synthetic
cacatccucgctgccugt

SEQ ID NO: 31134 - DNA, 21 bp, Artificial Sequence
  Synthetic
acggcgagautgaggcctaua

SEQ ID NO: 31135 - DNA, 20 bp, Artificial Sequence
  Synthetic
ctgagggcaucctctgtguc

SEQ ID NO: 31136 - DNA, 19 bp, Artificial Sequence
  Synthetic
caccctguggctccttguc

SEQ ID NO: 31137 - DNA, 26 bp, Artificial Sequence
  Synthetic
tggttgaagtatutggtggtcttgut

SEQ ID NO: 31138 - DNA, 27 bp, Artificial Sequence
  Synthetic
gggcaatatucacaggtatttctttuc

SEQ ID NO: 31139 - DNA, 22 bp, Artificial Sequence
  Synthetic
gcttcctcucgatcaggaucgt

SEQ ID NO: 31140 - DNA, 27 bp, Artificial Sequence
  Synthetic
ccagccctaautttgctttttgaugaa

SEQ ID NO: 31141 - DNA, 22 bp, Artificial Sequence
  Synthetic
cctgtgtcaccutgaccatcuc

SEQ ID NO: 31142 - DNA, 24 bp, Artificial Sequence
  Synthetic
ggtctctcccugagtctctgttut

SEQ ID NO: 31143 - DNA, 21 bp, Artificial Sequence
  Synthetic
ttctctgucacccggttgtuc

SEQ ID NO: 31144 - DNA, 18 bp, Artificial Sequence
  Synthetic
cctcggugccgggauaga

SEQ ID NO: 31145 - DNA, 20 bp, Artificial Sequence
  Synthetic
gaccttcaugacccacgugt

SEQ ID NO: 31146 - DNA, 18 bp, Artificial Sequence
  Synthetic
cccctcugtcctgtcucc

SEQ ID NO: 31147 - DNA, 19 bp, Artificial Sequence
  Synthetic
cctttccgcugctcccuac

SEQ ID NO: 31148 - DNA, 25 bp, Artificial Sequence
  Synthetic
catttcctggaauctgagtttgugg

SEQ ID NO: 31149 - DNA, 20 bp, Artificial Sequence
  Synthetic
gatgagagccagucgctugt

SEQ ID NO: 31150 - DNA, 21 bp, Artificial Sequence
  Synthetic
cagatgaucgccaacaagcuc

SEQ ID NO: 31151 - DNA, 26 bp, Artificial Sequence
  Synthetic
ctggtttatuaaattgctgaguggct

SEQ ID NO: 31152 - DNA, 21 bp, Artificial Sequence
  Synthetic
gatggctuctcatcgtcugct

SEQ ID NO: 31153 - DNA, 26 bp, Artificial Sequence
  Synthetic
ccctagtaauaaaagctggtuggcaa

SEQ ID NO: 31154 - DNA, 22 bp, Artificial Sequence
  Synthetic
gggtgtatuactttgccaugcc

SEQ ID NO: 31155 - DNA, 24 bp, Artificial Sequence
  Synthetic
accctcgaagguctgtatacucac

SEQ ID NO: 31156 - DNA, 22 bp, Artificial Sequence
  Synthetic
tcgtcaccaaucccaaggaaug

SEQ ID NO: 31157 - DNA, 27 bp, Artificial Sequence
  Synthetic
caagttaaaguggaatgaaaagugcct

SEQ ID NO: 31158 - DNA, 17 bp, Artificial Sequence
  Synthetic
tgtccgcgauggaggug

SEQ ID NO: 31159 - DNA, 18 bp, Artificial Sequence
  Synthetic
ggaggcuacacgggacug

SEQ ID NO: 31160 - DNA, 26 bp, Artificial Sequence
  Synthetic
gggctcttttgauaaaccaagagaut

SEQ ID NO: 31161 - DNA, 22 bp, Artificial Sequence
  Synthetic
agcgatctcacucttccggaua

SEQ ID NO: 31162 - DNA, 28 bp, Artificial Sequence
  Synthetic
tgtttctcgaugaaatggagtttuacct

SEQ ID NO: 31163 - DNA, 21 bp, Artificial Sequence
  Synthetic
ccgtagatgcugactgcacuc

SEQ ID NO: 31164 - DNA, 25 bp, Artificial Sequence
  Synthetic
aaaacattcaaggcutcaccatgug

SEQ ID NO: 31165 - DNA, 24 bp, Artificial Sequence
  Synthetic
gaaatgaacagcgagguctttgug

SEQ ID NO: 31166 - DNA, 26 bp, Artificial Sequence
  Synthetic
tgatgaucgagaagatgtcuggaagt

SEQ ID NO: 31167 - DNA, 30 bp, Artificial Sequence
  Synthetic
atcttgaauttatagcagucaaaacagaga

SEQ ID NO: 31168 - DNA, 17 bp, Artificial Sequence
  Synthetic
ccugcacgggagcugaa

SEQ ID NO: 31169 - DNA, 25 bp, Artificial Sequence
  Synthetic
tggataagucaaagtccaggucagt

SEQ ID NO: 31170 - DNA, 19 bp, Artificial Sequence
  Synthetic
ccuctgauggcgaaagcga

SEQ ID NO: 31171 - DNA, 19 bp, Artificial Sequence
  Synthetic
cagctcaggcuccttgucc

SEQ ID NO: 31172 - DNA, 19 bp, Artificial Sequence
  Synthetic
ggugagtcccuggaccaga

SEQ ID NO: 31173 - DNA, 19 bp, Artificial Sequence
  Synthetic
ggcacgaucttgcggaugt

SEQ ID NO: 31174 - DNA, 17 bp, Artificial Sequence
  Synthetic
gcccugagcctccagug

SEQ ID NO: 31175 - DNA, 18 bp, Artificial Sequence
  Synthetic
ccugagcgggaagagcug

SEQ ID NO: 31176 - DNA, 21 bp, Artificial Sequence
  Synthetic
gctggacagcugttggtucat

SEQ ID NO: 31177 - DNA, 22 bp, Artificial Sequence
  Synthetic
tggagtcguagatccgaaccuc

SEQ ID NO: 31178 - DNA, 21 bp, Artificial Sequence
  Synthetic
agtcugattcggugcggaaaa

SEQ ID NO: 31179 - DNA, 21 bp, Artificial Sequence
  Synthetic
tgggctgucgctttcttcuag

SEQ ID NO: 31180 - DNA, 19 bp, Artificial Sequence
  Synthetic
gaaggagguctgtcgcuga

SEQ ID NO: 31181 - DNA, 18 bp, Artificial Sequence
  Synthetic
cucagaccccgcacucac

SEQ ID NO: 31182 - DNA, 21 bp, Artificial Sequence
  Synthetic
ggagcucaacgacctcatgug

SEQ ID NO: 31183 - DNA, 29 bp, Artificial Sequence
  Synthetic
ctgtcacttacaaaaguagacattccugt

SEQ ID NO: 31184 - DNA, 19 bp, Artificial Sequence
  Synthetic
gccugagaaccggaugagg

SEQ ID NO: 31185 - DNA, 19 bp, Artificial Sequence
  Synthetic
gaaggcgucctgcagttug

SEQ ID NO: 31186 - DNA, 27 bp, Artificial Sequence
  Synthetic
gctctttctcautttcagcatctcuct

SEQ ID NO: 31187 - DNA, 21 bp, Artificial Sequence
  Synthetic
accagaaacggucagtgaugg

SEQ ID NO: 31188 - DNA, 20 bp, Artificial Sequence
  Synthetic
gcctccagacaucgaguacc

SEQ ID NO: 31189 - DNA, 22 bp, Artificial Sequence
  Synthetic
ccagugactuggaaccaaggat

SEQ ID NO: 31190 - DNA, 19 bp, Artificial Sequence
  Synthetic
cacctagcuttgccccuga

SEQ ID NO: 31191 - DNA, 21 bp, Artificial Sequence
  Synthetic
cacactacgugcaaaccctug

SEQ ID NO: 31192 - DNA, 23 bp, Artificial Sequence
  Synthetic
gccctacguagcaaacuacagag

SEQ ID NO: 31193 - DNA, 22 bp, Artificial Sequence
  Synthetic
atgagtggacgagugatgagug

SEQ ID NO: 31194 - DNA, 21 bp, Artificial Sequence
  Synthetic
aggagatcagguggacacuct

SEQ ID NO: 31195 - DNA, 23 bp, Artificial Sequence
  Synthetic
gtaggagctugagaccttatugc

SEQ ID NO: 31196 - DNA, 25 bp, Artificial Sequence
  Synthetic
atgaaattgcugaccatgctttgut

SEQ ID NO: 31197 - DNA, 19 bp, Artificial Sequence
  Synthetic
ccugccgagggagcaauac

SEQ ID NO: 31198 - DNA, 22 bp, Artificial Sequence
  Synthetic
ctccgcattutctacctgtgug

SEQ ID NO: 31199 - DNA, 27 bp, Artificial Sequence
  Synthetic
cccaauaaagaagauaaaaggccagua

SEQ ID NO: 31200 - DNA, 21 bp, Artificial Sequence
  Synthetic
cattcgccucttccccttcut

SEQ ID NO: 31201 - DNA, 23 bp, Artificial Sequence
  Synthetic
cttagctgtcacutagcgtccuc

SEQ ID NO: 31202 - DNA, 21 bp, Artificial Sequence
  Synthetic
catcctgagutgtcacgugga

SEQ ID NO: 31203 - DNA, 22 bp, Artificial Sequence
  Synthetic
tgaatgaggccautggtctuca

SEQ ID NO: 31204 - DNA, 19 bp, Artificial Sequence
  Synthetic
cacagucaccccucagcac

SEQ ID NO: 31205 - DNA, 28 bp, Artificial Sequence
  Synthetic
tccttctcatttutagttctccacucac

SEQ ID NO: 31206 - DNA, 22 bp, Artificial Sequence
  Synthetic
catgtaccaugcccucaaggag

SEQ ID NO: 31207 - DNA, 20 bp, Artificial Sequence
  Synthetic
gggctgtgucctgtttccug

SEQ ID NO: 31208 - DNA, 17 bp, Artificial Sequence
  Synthetic
gcgcccccaaucccauc

SEQ ID NO: 31209 - DNA, 17 bp, Artificial Sequence
  Synthetic
gcagcugggcacguagt

SEQ ID NO: 31210 - DNA, 19 bp, Artificial Sequence
  Synthetic
agccatcccugctcgacua

SEQ ID NO: 31211 - DNA, 17 bp, Artificial Sequence
  Synthetic
gcuccagggccccttug

SEQ ID NO: 31212 - DNA, 28 bp, Artificial Sequence
  Synthetic
gaaattgatugaagtaatgttcgugcct

SEQ ID NO: 31213 - DNA, 21 bp, Artificial Sequence
  Synthetic
gacttcgugatccatcugcct

SEQ ID NO: 31214 - DNA, 23 bp, Artificial Sequence
  Synthetic
cctaggugacagaaugagaccct

SEQ ID NO: 31215 - DNA, 24 bp, Artificial Sequence
  Synthetic
accgactattugacgcagtaugac

SEQ ID NO: 31216 - DNA, 22 bp, Artificial Sequence
  Synthetic
ggcatcccuggcatcauacaaa

SEQ ID NO: 31217 - DNA, 31 bp, Artificial Sequence
  Synthetic
agcatctgactgautttactttttcctuaca

SEQ ID NO: 31218 - DNA, 21 bp, Artificial Sequence
  Synthetic
gggacgttuccttcttgagug

SEQ ID NO: 31219 - DNA, 28 bp, Artificial Sequence
  Synthetic
gatttaattgtuacgcttttcccccuaa

SEQ ID NO: 31220 - DNA, 27 bp, Artificial Sequence
  Synthetic
accttcactacautagcaaagtctuag

SEQ ID NO: 31221 - DNA, 28 bp, Artificial Sequence
  Synthetic
ctacattaaggtcuttcctgcagacaut

SEQ ID NO: 31222 - DNA, 23 bp, Artificial Sequence
  Synthetic
gggaataaaagcgutttggcugt

SEQ ID NO: 31223 - DNA, 25 bp, Artificial Sequence
  Synthetic
ctctaaccggugttatttcccctuc

SEQ ID NO: 31224 - DNA, 20 bp, Artificial Sequence
  Synthetic
cgtgtacucctcgcagtucc

SEQ ID NO: 31225 - DNA, 21 bp, Artificial Sequence
  Synthetic
ccccuaacccagagauacgca

SEQ ID NO: 31226 - DNA, 22 bp, Artificial Sequence
  Synthetic
gggtcttcugacccctcactua

SEQ ID NO: 31227 - DNA, 18 bp, Artificial Sequence
  Synthetic
caccgugcccuaaacgac

SEQ ID NO: 31228 - DNA, 22 bp, Artificial Sequence
  Synthetic
ctgacctcccuctacaacccua

SEQ ID NO: 31229 - DNA, 22 bp, Artificial Sequence
  Synthetic
agaccttcuaccccctgaaucc

SEQ ID NO: 31230 - DNA, 20 bp, Artificial Sequence
  Synthetic
cccctgcaaucgtctcugac

SEQ ID NO: 31231 - DNA, 24 bp, Artificial Sequence
  Synthetic
agggcaacatuaagggtctgttut

SEQ ID NO: 31232 - DNA, 26 bp, Artificial Sequence
  Synthetic
ccuatgagtaggatuagggaccagat

SEQ ID NO: 31233 - DNA, 22 bp, Artificial Sequence
  Synthetic
caagacctuttctgtccuccca

SEQ ID NO: 31234 - DNA, 19 bp, Artificial Sequence
  Synthetic
agaggaggcugacctgugt

SEQ ID NO: 31235 - DNA, 22 bp, Artificial Sequence
  Synthetic
cctgaguagctgggatuacacc

SEQ ID NO: 31236 - DNA, 19 bp, Artificial Sequence
  Synthetic
gtgacgtugcggcagtuag

SEQ ID NO: 31237 - DNA, 24 bp, Artificial Sequence
  Synthetic
ctcgaagtagaugatgaggtccug

SEQ ID NO: 31238 - DNA, 22 bp, Artificial Sequence
  Synthetic
tgggtcucctattgtgaugcct

SEQ ID NO: 31239 - DNA, 19 bp, Artificial Sequence
  Synthetic
tcaggacugggaccccuac

SEQ ID NO: 31240 - DNA, 20 bp, Artificial Sequence
  Synthetic
ggccgctucacctctcatuc

SEQ ID NO: 31241 - DNA, 21 bp, Artificial Sequence
  Synthetic
gaggccagcautcagagtuca

SEQ ID NO: 31242 - DNA, 19 bp, Artificial Sequence
  Synthetic
cuctctggctucccaccac

SEQ ID NO: 31243 - DNA, 18 bp, Artificial Sequence
  Synthetic
gggtguagccctcgguga

SEQ ID NO: 31244 - DNA, 22 bp, Artificial Sequence
  Synthetic
atctccacaggagccuccaaua

SEQ ID NO: 31245 - DNA, 21 bp, Artificial Sequence
  Synthetic
ttgaugcggaaggagauggac

SEQ ID NO: 31246 - DNA, 22 bp, Artificial Sequence
  Synthetic
ccattgaucccaggactgctuc

SEQ ID NO: 31247 - DNA, 25 bp, Artificial Sequence
  Synthetic
cgatactccutgatgggtucaagat

SEQ ID NO: 31248 - DNA, 22 bp, Artificial Sequence
  Synthetic
ggtcatgauggaggaggguaga

SEQ ID NO: 31249 - DNA, 19 bp, Artificial Sequence
  Synthetic
ccuggcaccgcaagtcuag

SEQ ID NO: 31250 - DNA, 18 bp, Artificial Sequence
  Synthetic
gtgaccugtcgccuccac

SEQ ID NO: 31251 - DNA, 20 bp, Artificial Sequence
  Synthetic
ccagccctuagcacagcauc

SEQ ID NO: 31252 - DNA, 19 bp, Artificial Sequence
  Synthetic
gacactgguggaccgtcug

SEQ ID NO: 31253 - DNA, 21 bp, Artificial Sequence
  Synthetic
ggctcgatgutgtagccguag

SEQ ID NO: 31254 - DNA, 22 bp, Artificial Sequence
  Synthetic
cccaaagccugtcttcuaccaa

SEQ ID NO: 31255 - DNA, 24 bp, Artificial Sequence
  Synthetic
tgactgctucaaactcgaaguacc

SEQ ID NO: 31256 - DNA, 26 bp, Artificial Sequence
  Synthetic
ctgtcttcatauatctctcccuccct

SEQ ID NO: 31257 - DNA, 26 bp, Artificial Sequence
  Synthetic
gggtgaagataauggtgttctctgug

SEQ ID NO: 31258 - DNA, 22 bp, Artificial Sequence
  Synthetic
ccaactctcccauccctaccuc

SEQ ID NO: 31259 - DNA, 21 bp, Artificial Sequence
  Synthetic
gttgauggcaaatggcucgaa

SEQ ID NO: 31260 - DNA, 21 bp, Artificial Sequence
  Synthetic
tgugaccaggtguaggaccaa

SEQ ID NO: 31261 - DNA, 20 bp, Artificial Sequence
  Synthetic
cggaagtgcuggtggaacug

SEQ ID NO: 31262 - DNA, 22 bp, Artificial Sequence
  Synthetic
cgaccctgacuacgaaaaccug

SEQ ID NO: 31263 - DNA, 18 bp, Artificial Sequence
  Synthetic
gcccccaauccccacuct

SEQ ID NO: 31264 - DNA, 21 bp, Artificial Sequence
  Synthetic
ctgaccacuagttccccucct

SEQ ID NO: 31265 - DNA, 17 bp, Artificial Sequence
  Synthetic
cctgcaccucccaccuc

SEQ ID NO: 31266 - DNA, 21 bp, Artificial Sequence
  Synthetic
gaccuacaaatuggccccaga

SEQ ID NO: 31267 - DNA, 21 bp, Artificial Sequence
  Synthetic
ccattagugcccccatcacug

SEQ ID NO: 31268 - DNA, 20 bp, Artificial Sequence
  Synthetic
ctgatgccagugtccuggag

SEQ ID NO: 31269 - DNA, 18 bp, Artificial Sequence
  Synthetic
ctgcccaccccugcauag

SEQ ID NO: 31270 - DNA, 19 bp, Artificial Sequence
  Synthetic
tctgugcagccacguagac

SEQ ID NO: 31271 - DNA, 23 bp, Artificial Sequence
  Synthetic
gtgaccatttuctgtgctcctuc

SEQ ID NO: 31272 - DNA, 17 bp, Artificial Sequence
  Synthetic
gcctcagcccugccauc

SEQ ID NO: 31273 - DNA, 25 bp, Artificial Sequence
  Synthetic
gcatgtatcuctggagtttugggaa

SEQ ID NO: 31274 - DNA, 24 bp, Artificial Sequence
  Synthetic
gugaagaggaagaugaggaggaga

SEQ ID NO: 31275 - DNA, 21 bp, Artificial Sequence
  Synthetic
cagcccaccugtaactucaca

SEQ ID NO: 31276 - DNA, 20 bp, Artificial Sequence
  Synthetic
agcgctatguggacaagcuc

SEQ ID NO: 31277 - DNA, 23 bp, Artificial Sequence
  Synthetic
tttagaggtugagggtccucagt

SEQ ID NO: 31278 - DNA, 28 bp, Artificial Sequence
  Synthetic
gcatgcacauatgcacaaataaaugagt

SEQ ID NO: 31279 - DNA, 26 bp, Artificial Sequence
  Synthetic
ggtttctctuccttcttctucaccag

SEQ ID NO: 31280 - DNA, 20 bp, Artificial Sequence
  Synthetic
gctccaagccutgcattguc

SEQ ID NO: 31281 - DNA, 20 bp, Artificial Sequence
  Synthetic
aggctcauggtgtctuccac

SEQ ID NO: 31282 - DNA, 18 bp, Artificial Sequence
  Synthetic
gctgucacagtgguggct

SEQ ID NO: 31283 - DNA, 17 bp, Artificial Sequence
  Synthetic
ccugagcuccccagcac

SEQ ID NO: 31284 - DNA, 22 bp, Artificial Sequence
  Synthetic
gagacaagcaggagugagaugt

SEQ ID NO: 31285 - DNA, 23 bp, Artificial Sequence
  Synthetic
tgagtttggaaucagcaggtguc

SEQ ID NO: 31286 - DNA, 21 bp, Artificial Sequence
  Synthetic
aggtctcugatggtggcucat

SEQ ID NO: 31287 - DNA, 19 bp, Artificial Sequence
  Synthetic
gatggccucttcgauggca

SEQ ID NO: 31288 - DNA, 18 bp, Artificial Sequence
  Synthetic
ccggcccccucctcaaua

SEQ ID NO: 31289 - DNA, 18 bp, Artificial Sequence
  Synthetic
cctggcucagggtcucac

SEQ ID NO: 31290 - DNA, 21 bp, Artificial Sequence
  Synthetic
ggauggaactuggcgaaggag

SEQ ID NO: 31291 - DNA, 22 bp, Artificial Sequence
  Synthetic
gcaagaagucctggttcucgat

SEQ ID NO: 31292 - DNA, 21 bp, Artificial Sequence
  Synthetic
cutggatccttuggccacagt

SEQ ID NO: 31293 - DNA, 21 bp, Artificial Sequence
  Synthetic
gcagcauagagtccaccauga

SEQ ID NO: 31294 - DNA, 24 bp, Artificial Sequence
  Synthetic
gggattctacaucttgtgcatugt

SEQ ID NO: 31295 - DNA, 20 bp, Artificial Sequence
  Synthetic
acaaaugagccccgcaguag

SEQ ID NO: 31296 - DNA, 19 bp, Artificial Sequence
  Synthetic
cctgctucacccggtttuc

SEQ ID NO: 31297 - DNA, 24 bp, Artificial Sequence
  Synthetic
tgaaatcttccuctctgtcuccca

SEQ ID NO: 31298 - DNA, 20 bp, Artificial Sequence
  Synthetic
cccccaggautctctgucct

SEQ ID NO: 31299 - DNA, 24 bp, Artificial Sequence
  Synthetic
ggtttcatttugaccctcaaugct

SEQ ID NO: 31300 - DNA, 21 bp, Artificial Sequence
  Synthetic
gagtcccugaaggccatgaut

SEQ ID NO: 31301 - DNA, 21 bp, Artificial Sequence
  Synthetic
gccaugccccttgttcuagac

SEQ ID NO: 31302 - DNA, 22 bp, Artificial Sequence
  Synthetic
ggctggcaucctctgaatcuag

SEQ ID NO: 31303 - DNA, 23 bp, Artificial Sequence
  Synthetic
caugaaggcaaucagcaaaacca

SEQ ID NO: 31304 - DNA, 23 bp, Artificial Sequence
  Synthetic
ggctgatccutctctccacauct

SEQ ID NO: 31305 - DNA, 22 bp, Artificial Sequence
  Synthetic
aacaggtgucctaggtgaguct

SEQ ID NO: 31306 - DNA, 21 bp, Artificial Sequence
  Synthetic
cacccctcautggacccttua

SEQ ID NO: 31307 - DNA, 24 bp, Artificial Sequence
  Synthetic
ggattacaaucctgtgaggucagg

SEQ ID NO: 31308 - DNA, 22 bp, Artificial Sequence
  Synthetic
actgtccuctgtcctctuagcc

SEQ ID NO: 31309 - DNA, 22 bp, Artificial Sequence
  Synthetic
gaacatcagcuctggaaucgga

SEQ ID NO: 31310 - DNA, 18 bp, Artificial Sequence
  Synthetic
cgugggccagaaccucac

SEQ ID NO: 31311 - DNA, 22 bp, Artificial Sequence
  Synthetic
atucaaacacucagggactcuc

SEQ ID NO: 31312 - DNA, 20 bp, Artificial Sequence
  Synthetic
gacacguggcagcuaaacac

SEQ ID NO: 31313 - DNA, 21 bp, Artificial Sequence
  Synthetic
ggagauttggacucccagcac

SEQ ID NO: 31314 - DNA, 21 bp, Artificial Sequence
  Synthetic
ctacacagagaugccgcaugt

SEQ ID NO: 31315 - DNA, 24 bp, Artificial Sequence
  Synthetic
gautctcaggatatuccccagcag

SEQ ID NO: 31316 - DNA, 22 bp, Artificial Sequence
  Synthetic
tgctaggtuggagatgctgtut

SEQ ID NO: 31317 - DNA, 22 bp, Artificial Sequence
  Synthetic
cccgatagtugggatgaagugg

SEQ ID NO: 31318 - DNA, 21 bp, Artificial Sequence
  Synthetic
ggacgagtuctctgtgctcug

SEQ ID NO: 31319 - DNA, 24 bp, Artificial Sequence
  Synthetic
gaagaagttuctagccagucagga

SEQ ID NO: 31320 - DNA, 19 bp, Artificial Sequence
  Synthetic
cctguccggtcugcaacac

SEQ ID NO: 31321 - DNA, 21 bp, Artificial Sequence
  Synthetic
ggccagguaggaagtccuaga

SEQ ID NO: 31322 - DNA, 21 bp, Artificial Sequence
  Synthetic
tgaagaagaugctgcccaucg

SEQ ID NO: 31323 - DNA, 22 bp, Artificial Sequence
  Synthetic
tggcattguggttgttcccuaa

SEQ ID NO: 31324 - DNA, 23 bp, Artificial Sequence
  Synthetic
acccautgagtccucccaaaaac

SEQ ID NO: 31325 - DNA, 21 bp, Artificial Sequence
  Synthetic
ggactcugcgcacgatttuct

SEQ ID NO: 31326 - DNA, 21 bp, Artificial Sequence
  Synthetic
gggatgtgacugtcctgcuat

SEQ ID NO: 31327 - DNA, 23 bp, Artificial Sequence
  Synthetic
cctccattcuccagactcuccag

SEQ ID NO: 31328 - DNA, 21 bp, Artificial Sequence
  Synthetic
gggactcuagaaaccctcucc

SEQ ID NO: 31329 - DNA, 20 bp, Artificial Sequence
  Synthetic
gcccuggcaagagtctucac

SEQ ID NO: 31330 - DNA, 22 bp, Artificial Sequence
  Synthetic
tgcagugcttguccacaaaaag

SEQ ID NO: 31331 - DNA, 24 bp, Artificial Sequence
  Synthetic
tgctgaatgaaugggagatgacug

SEQ ID NO: 31332 - DNA, 21 bp, Artificial Sequence
  Synthetic
ggaacacacugcctuccaact

SEQ ID NO: 31333 - DNA, 24 bp, Artificial Sequence
  Synthetic
cttgccttctuctgaagtccctut

SEQ ID NO: 31334 - DNA, 22 bp, Artificial Sequence
  Synthetic
aggcttcaucacatacccccua

SEQ ID NO: 31335 - DNA, 25 bp, Artificial Sequence
  Synthetic
ggaaucccaaaggaagatgtcucag

SEQ ID NO: 31336 - DNA, 19 bp, Artificial Sequence
  Synthetic
gtgtctuggcgcatcugac

SEQ ID NO: 31337 - DNA, 25 bp, Artificial Sequence
  Synthetic
ctaattcagucaacccttccguacc

SEQ ID NO: 31338 - DNA, 21 bp, Artificial Sequence
  Synthetic
gagacggtucaggtgtgacut

SEQ ID NO: 31339 - DNA, 23 bp, Artificial Sequence
  Synthetic
gacatggcuttggagaagtucct

SEQ ID NO: 31340 - DNA, 21 bp, Artificial Sequence
  Synthetic
catcgtgauccctgatcccut

SEQ ID NO: 31341 - DNA, 22 bp, Artificial Sequence
  Synthetic
cctgagcgagcutcatcaucat

SEQ ID NO: 31342 - DNA, 19 bp, Artificial Sequence
  Synthetic
gtttaggcccugctgggua

SEQ ID NO: 31343 - DNA, 23 bp, Artificial Sequence
  Synthetic
ctttactgtuccctcacccucac

SEQ ID NO: 31344 - DNA, 25 bp, Artificial Sequence
  Synthetic
catccaatguggagatgatccucaa

SEQ ID NO: 31345 - DNA, 21 bp, Artificial Sequence
  Synthetic
gcagagatguctcttgccuga

SEQ ID NO: 31346 - DNA, 18 bp, Artificial Sequence
  Synthetic
cgacaucggctucaacgt

SEQ ID NO: 31347 - DNA, 21 bp, Artificial Sequence
  Synthetic
ctcgaaguagatgcgcucgat

SEQ ID NO: 31348 - DNA, 23 bp, Artificial Sequence
  Synthetic
gacaccaucttcgagaugcagat

SEQ ID NO: 31349 - DNA, 17 bp, Artificial Sequence
  Synthetic
caggcugcggtagcuga

SEQ ID NO: 31350 - DNA, 17 bp, Artificial Sequence
  Synthetic
ggtggccgugaccgaug

SEQ ID NO: 31351 - DNA, 23 bp, Artificial Sequence
  Synthetic
tccaaucccccatcttuccaaaa

SEQ ID NO: 31352 - DNA, 21 bp, Artificial Sequence
  Synthetic
ctcctgaccuctctctgucct

SEQ ID NO: 31353 - DNA, 21 bp, Artificial Sequence
  Synthetic
gtgacctggcuggatcctuac

SEQ ID NO: 31354 - DNA, 23 bp, Artificial Sequence
  Synthetic
cacagaugaatctctguccccat

SEQ ID NO: 31355 - DNA, 23 bp, Artificial Sequence
  Synthetic
ctgtgctttccuccaggaaguag

SEQ ID NO: 31356 - DNA, 21 bp, Artificial Sequence
  Synthetic
cctttggccucctcccacuat

SEQ ID NO: 31357 - DNA, 19 bp, Artificial Sequence
  Synthetic
gccuggactggguggaaac

SEQ ID NO: 31358 - DNA, 22 bp, Artificial Sequence
  Synthetic
gtctacacagccugatgctcuc

SEQ ID NO: 31359 - DNA, 22 bp, Artificial Sequence
  Synthetic
cttgagtgucagactccaguca

SEQ ID NO: 31360 - DNA, 20 bp, Artificial Sequence
  Synthetic
gcacagcugactctcgagug

SEQ ID NO: 31361 - DNA, 20 bp, Artificial Sequence
  Synthetic
cauggcgatguccaggagat

SEQ ID NO: 31362 - DNA, 17 bp, Artificial Sequence
  Synthetic
gctgaccuggccccauc

SEQ ID NO: 31363 - DNA, 20 bp, Artificial Sequence
  Synthetic
ggaagggucccagagtgcua

SEQ ID NO: 31364 - DNA, 21 bp, Artificial Sequence
  Synthetic
ttcacatguacgtgggtgucc

SEQ ID NO: 31365 - DNA, 23 bp, Artificial Sequence
  Synthetic
ctgcattctuagccatggagcua

SEQ ID NO: 31366 - DNA, 22 bp, Artificial Sequence
  Synthetic
gcctccacuctgatgtctctug

SEQ ID NO: 31367 - DNA, 22 bp, Artificial Sequence
  Synthetic
aaagctaaguaccccactgcug

SEQ ID NO: 31368 - DNA, 28 bp, Artificial Sequence
  Synthetic
aacagagcaacacccugtctaaaaauat

SEQ ID NO: 31369 - DNA, 23 bp, Artificial Sequence
  Synthetic
ctaagctggucctcatactgcut

SEQ ID NO: 31370 - DNA, 20 bp, Artificial Sequence
  Synthetic
cagccccgaauctagccuac

SEQ ID NO: 31371 - DNA, 27 bp, Artificial Sequence
  Synthetic
gaagatagccuttacatccctaauccc

SEQ ID NO: 31372 - DNA, 24 bp, Artificial Sequence
  Synthetic
cgtcatctcuggaatccccatcua

SEQ ID NO: 31373 - DNA, 21 bp, Artificial Sequence
  Synthetic
gguggaggcacagauagacgt

SEQ ID NO: 31374 - DNA, 17 bp, Artificial Sequence
  Synthetic
ccggucccctcuacacc

SEQ ID NO: 31375 - DNA, 28 bp, Artificial Sequence
  Synthetic
tcctggaagaacacucagaaaaacuaaa

SEQ ID NO: 31376 - DNA, 25 bp, Artificial Sequence
  Synthetic
tcatgtgagugtgaatgagtgugag

SEQ ID NO: 31377 - DNA, 24 bp, Artificial Sequence
  Synthetic
attgtuccggcagaagaagaugat

SEQ ID NO: 31378 - DNA, 21 bp, Artificial Sequence
  Synthetic
ctgacctgccutctctgtguc

SEQ ID NO: 31379 - DNA, 20 bp, Artificial Sequence
  Synthetic
gaagatgcuacggtggcugt

SEQ ID NO: 31380 - DNA, 20 bp, Artificial Sequence
  Synthetic
tgacgacagutcagcguacc

SEQ ID NO: 31381 - DNA, 22 bp, Artificial Sequence
  Synthetic
tcggtgtuccacaaatcctucc

SEQ ID NO: 31382 - DNA, 24 bp, Artificial Sequence
  Synthetic
acccactggaucacttcgauaagt

SEQ ID NO: 31383 - DNA, 18 bp, Artificial Sequence
  Synthetic
gcaacugctgcagaugct

SEQ ID NO: 31384 - DNA, 22 bp, Artificial Sequence
  Synthetic
gggcacagcauagttgtgtuga

SEQ ID NO: 31385 - DNA, 23 bp, Artificial Sequence
  Synthetic
ctcuccagucaaagacctaagut

SEQ ID NO: 31386 - DNA, 21 bp, Artificial Sequence
  Synthetic
ggutggctccaugaccaagat

SEQ ID NO: 31387 - DNA, 23 bp, Artificial Sequence
  Synthetic
tcaaggcuactccatcaaugcag

SEQ ID NO: 31388 - DNA, 20 bp, Artificial Sequence
  Synthetic
tgutacaaagugccccagca

SEQ ID NO: 31389 - DNA, 19 bp, Artificial Sequence
  Synthetic
aaggcggagautgcaguga

SEQ ID NO: 31390 - DNA, 20 bp, Artificial Sequence
  Synthetic
cccggagucgaagacagtuc

SEQ ID NO: 31391 - DNA, 19 bp, Artificial Sequence
  Synthetic
gtgttgaccucgccctcuc

SEQ ID NO: 31392 - DNA, 22 bp, Artificial Sequence
  Synthetic
agggugagccctatatcuggac

SEQ ID NO: 31393 - DNA, 24 bp, Artificial Sequence
  Synthetic
ctatgcctcuttcttctcctucca

SEQ ID NO: 31394 - DNA, 18 bp, Artificial Sequence
  Synthetic
gggagguaaggacgguga

SEQ ID NO: 31395 - DNA, 18 bp, Artificial Sequence
  Synthetic
ccuggaggaggaggugct

SEQ ID NO: 31396 - DNA, 24 bp, Artificial Sequence
  Synthetic
cctcacctttuctctcccaatugt

SEQ ID NO: 31397 - DNA, 24 bp, Artificial Sequence
  Synthetic
ccagagaaucagcattctgtcucc

SEQ ID NO: 31398 - DNA, 23 bp, Artificial Sequence
  Synthetic
gtgatucaggacccuagaaggua

SEQ ID NO: 31399 - DNA, 23 bp, Artificial Sequence
  Synthetic
ctttacaccggauttcgaaggug

SEQ ID NO: 31400 - DNA, 19 bp, Artificial Sequence
  Synthetic
gcagagagaggugctccug

SEQ ID NO: 31401 - DNA, 21 bp, Artificial Sequence
  Synthetic
cgctgggugtattcgcctaug

SEQ ID NO: 31402 - DNA, 23 bp, Artificial Sequence
  Synthetic
ctctttucccctccaaauccagt

SEQ ID NO: 31403 - DNA, 25 bp, Artificial Sequence
  Synthetic
ggttcatttaucccacccttctcut

SEQ ID NO: 31404 - DNA, 21 bp, Artificial Sequence
  Synthetic
cacccccaaucctagagctuc

SEQ ID NO: 31405 - DNA, 17 bp, Artificial Sequence
  Synthetic
ggtgcccugcaggtguc

SEQ ID NO: 31406 - DNA, 25 bp, Artificial Sequence
  Synthetic
gttctaaggcucggtcattcaucaa

SEQ ID NO: 31407 - DNA, 22 bp, Artificial Sequence
  Synthetic
catcgtggugaggctuaaggag

SEQ ID NO: 31408 - DNA, 22 bp, Artificial Sequence
  Synthetic
tctcagctucaccctaggacug

SEQ ID NO: 31409 - DNA, 22 bp, Artificial Sequence
  Synthetic
tgtccttcugcagactccgtua

SEQ ID NO: 31410 - DNA, 21 bp, Artificial Sequence
  Synthetic
cgtcaccccauggtgaguaac

SEQ ID NO: 31411 - DNA, 23 bp, Artificial Sequence
  Synthetic
gugccaagagaaaugactguact

SEQ ID NO: 31412 - DNA, 22 bp, Artificial Sequence
  Synthetic
cactgttugccaagacccagua

SEQ ID NO: 31413 - DNA, 23 bp, Artificial Sequence
  Synthetic
cctcctcccaucactctttgtuc

SEQ ID NO: 31414 - DNA, 21 bp, Artificial Sequence
  Synthetic
caagacccuccacagatgugt

SEQ ID NO: 31415 - DNA, 20 bp, Artificial Sequence
  Synthetic
gggcgtaggucatggcauag

SEQ ID NO: 31416 - DNA, 22 bp, Artificial Sequence
  Synthetic
tccctaucaggccagagctaug

SEQ ID NO: 31417 - DNA, 22 bp, Artificial Sequence
  Synthetic
cgatggagagagauggagacug

SEQ ID NO: 31418 - DNA, 22 bp, Artificial Sequence
  Synthetic
caagttttuagggaacgcugct

SEQ ID NO: 31419 - DNA, 22 bp, Artificial Sequence
  Synthetic
catagctuggcgatggtctuga

SEQ ID NO: 31420 - DNA, 23 bp, Artificial Sequence
  Synthetic
gggtgauacaggcttcttttuga

SEQ ID NO: 31421 - DNA, 24 bp, Artificial Sequence
  Synthetic
cugagaaggagatauacccagcca

SEQ ID NO: 31422 - DNA, 21 bp, Artificial Sequence
  Synthetic
gacaacctccugtcccgttua

SEQ ID NO: 31423 - DNA, 20 bp, Artificial Sequence
  Synthetic
ccatcgtcuccagacccuga

SEQ ID NO: 31424 - DNA, 18 bp, Artificial Sequence
  Synthetic
ctgucggaggaggagcug

SEQ ID NO: 31425 - DNA, 21 bp, Artificial Sequence
  Synthetic
caaggucacagtgucagcaga

SEQ ID NO: 31426 - DNA, 23 bp, Artificial Sequence
  Synthetic
gttgctttgcugttacctctguc

SEQ ID NO: 31427 - DNA, 20 bp, Artificial Sequence
  Synthetic
cctcaccuttccctccucac

SEQ ID NO: 31428 - DNA, 17 bp, Artificial Sequence
  Synthetic
gggtccgguaggcaugg

SEQ ID NO: 31429 - DNA, 17 bp, Artificial Sequence
  Synthetic
ggcgctcugggagtcug

SEQ ID NO: 31430 - DNA, 18 bp, Artificial Sequence
  Synthetic
gatcgcagccuccctguc

SEQ ID NO: 31431 - DNA, 21 bp, Artificial Sequence
  Synthetic
ctcatccuggccttctucaca

SEQ ID NO: 31432 - DNA, 21 bp, Artificial Sequence
  Synthetic
agaguggccttatguccacct

SEQ ID NO: 31433 - DNA, 22 bp, Artificial Sequence
  Synthetic
aagacctgcuctagcccauact

SEQ ID NO: 31434 - DNA, 22 bp, Artificial Sequence
  Synthetic
cgcggtcugctatacgatguac

SEQ ID NO: 31435 - DNA, 24 bp, Artificial Sequence
  Synthetic
guagaagaggacgacauggacaaa

SEQ ID NO: 31436 - DNA, 22 bp, Artificial Sequence
  Synthetic
gttggccccaugtttctcaaug

SEQ ID NO: 31437 - DNA, 25 bp, Artificial Sequence
  Synthetic
gttaattggtttugtgcctgcctua

SEQ ID NO: 31438 - DNA, 20 bp, Artificial Sequence
  Synthetic
cgaacugccttgccaucgaa

SEQ ID NO: 31439 - DNA, 27 bp, Artificial Sequence
  Synthetic
caatcttacacgugtgtgggttttuaa

SEQ ID NO: 31440 - DNA, 23 bp, Artificial Sequence
  Synthetic
gatgtucgcacagttatccuggt

SEQ ID NO: 31441 - DNA, 24 bp, Artificial Sequence
  Synthetic
ctaagctgccagcutctgttttuc

SEQ ID NO: 31442 - DNA, 28 bp, Artificial Sequence
  Synthetic
gtggcttattugtgaaaagtcaaauggt

SEQ ID NO: 31443 - DNA, 26 bp, Artificial Sequence
  Synthetic
ccctaaactugaactccatttcucct

SEQ ID NO: 31444 - DNA, 23 bp, Artificial Sequence
  Synthetic
acacacacacacgauagtggaug

SEQ ID NO: 31445 - DNA, 29 bp, Artificial Sequence
  Synthetic
ttgggtattaggaaaauaagtggtggtut

SEQ ID NO: 31446 - DNA, 26 bp, Artificial Sequence
  Synthetic
gaaccagguccagagaaauatcauaa

SEQ ID NO: 31447 - DNA, 21 bp, Artificial Sequence
  Synthetic
ggtggcaccugctatgaugag

SEQ ID NO: 31448 - DNA, 21 bp, Artificial Sequence
  Synthetic
ggaagggucccagagauagca

SEQ ID NO: 31449 - DNA, 25 bp, Artificial Sequence
  Synthetic
ccgattgtcucccctttgattcuag

SEQ ID NO: 31450 - DNA, 22 bp, Artificial Sequence
  Synthetic
attcccggaugagggagtctua

SEQ ID NO: 31451 - DNA, 27 bp, Artificial Sequence
  Synthetic
tgatctgaucccaagcctatcttcuag

SEQ ID NO: 31452 - DNA, 21 bp, Artificial Sequence
  Synthetic
cttggccauctgaggtttugc

SEQ ID NO: 31453 - DNA, 24 bp, Artificial Sequence
  Synthetic
tctctctccccutctcctcttcua

SEQ ID NO: 31454 - DNA, 21 bp, Artificial Sequence
  Synthetic
gcaagtcggcuacccaagtut

SEQ ID NO: 31455 - DNA, 24 bp, Artificial Sequence
  Synthetic
atttctcatgcucatccccatcuc

SEQ ID NO: 31456 - DNA, 22 bp, Artificial Sequence
  Synthetic
tcacacuggacaagcctaggua

SEQ ID NO: 31457 - DNA, 21 bp, Artificial Sequence
  Synthetic
gactgccaucctggttttugc

SEQ ID NO: 31458 - DNA, 21 bp, Artificial Sequence
  Synthetic
accctggguctcatcccuaag

SEQ ID NO: 31459 - DNA, 27 bp, Artificial Sequence
  Synthetic
tctcttaacgtucaaaaggctaaccug

SEQ ID NO: 31460 - DNA, 25 bp, Artificial Sequence
  Synthetic
gggtgauaaatggacacuaaaagca

SEQ ID NO: 31461 - DNA, 21 bp, Artificial Sequence
  Synthetic
agtatcagauccgcgugacct

SEQ ID NO: 31462 - DNA, 28 bp, Artificial Sequence
  Synthetic
aaatgctaagtacuaaggagacagaucc

SEQ ID NO: 31463 - DNA, 28 bp, Artificial Sequence
  Synthetic
gaccctgtttcugaattgctaaattgut

SEQ ID NO: 31464 - DNA, 23 bp, Artificial Sequence
  Synthetic
acugatactcctugaggcacact

SEQ ID NO: 31465 - DNA, 28 bp, Artificial Sequence
  Synthetic
tctatacucgaagaaaacagctttcucc

SEQ ID NO: 31466 - DNA, 18 bp, Artificial Sequence
  Synthetic
ctccuaccttggcucgca

SEQ ID NO: 31467 - DNA, 17 bp, Artificial Sequence
  Synthetic
gcuccaaucggcggagt

SEQ ID NO: 31468 - DNA, 22 bp, Artificial Sequence
  Synthetic
ggaaaggaggguggatccugat

SEQ ID NO: 31469 - DNA, 20 bp, Artificial Sequence
  Synthetic
ggcctuggctgctagtugag

SEQ ID NO: 31470 - DNA, 21 bp, Artificial Sequence
  Synthetic
ccugagaccagcgucaagaag

SEQ ID NO: 31471 - DNA, 22 bp, Artificial Sequence
  Synthetic
aatuaagcaggaccccuaggga

SEQ ID NO: 31472 - DNA, 22 bp, Artificial Sequence
  Synthetic
ggcatcagagcucaccttugaa

SEQ ID NO: 31473 - DNA, 19 bp, Artificial Sequence
  Synthetic
gccccaccucggatttcuc

SEQ ID NO: 31474 - DNA, 19 bp, Artificial Sequence
  Synthetic
cactgaccaugagggcugt

SEQ ID NO: 31475 - DNA, 23 bp, Artificial Sequence
  Synthetic
cggtgtacuctctgtccaugagt

SEQ ID NO: 31476 - DNA, 20 bp, Artificial Sequence
  Synthetic
ctgttcaagggugcggguat

SEQ ID NO: 31477 - DNA, 20 bp, Artificial Sequence
  Synthetic
ccactactucgggcacucac

SEQ ID NO: 31478 - DNA, 21 bp, Artificial Sequence
  Synthetic
ggacuaccatcugaccgaggt

SEQ ID NO: 31479 - DNA, 21 bp, Artificial Sequence
  Synthetic
ctggugacagcactgatcuca

SEQ ID NO: 31480 - DNA, 22 bp, Artificial Sequence
  Synthetic
gcaagacaagccuctgagtugg

SEQ ID NO: 31481 - DNA, 25 bp, Artificial Sequence
  Synthetic
gtctgtcttaucggagatttgguca

SEQ ID NO: 31482 - DNA, 22 bp, Artificial Sequence
  Synthetic
cctaccccuctgaaggtgacuc

SEQ ID NO: 31483 - DNA, 24 bp, Artificial Sequence
  Synthetic
ggcctcaaagguctcttcaucaaa

SEQ ID NO: 31484 - DNA, 19 bp, Artificial Sequence
  Synthetic
agguagagaggccagcuga

SEQ ID NO: 31485 - DNA, 19 bp, Artificial Sequence
  Synthetic
caccctgaauccagcggua

SEQ ID NO: 31486 - DNA, 22 bp, Artificial Sequence
  Synthetic
aaccgctucaagaagaucagca

SEQ ID NO: 31487 - DNA, 18 bp, Artificial Sequence
  Synthetic
gaagcggucactgcaugg

SEQ ID NO: 31488 - DNA, 22 bp, Artificial Sequence
  Synthetic
cttcctgaccccuctgtgatuc

SEQ ID NO: 31489 - DNA, 22 bp, Artificial Sequence
  Synthetic
agtcccaucagcatcctctuca

SEQ ID NO: 31490 - DNA, 24 bp, Artificial Sequence
  Synthetic
ctcatacacggucttatcgtccug

SEQ ID NO: 31491 - DNA, 23 bp, Artificial Sequence
  Synthetic
catcuggaagctctuccgaaact

SEQ ID NO: 31492 - DNA, 19 bp, Artificial Sequence
  Synthetic
cgtguccgagggcttctuc

SEQ ID NO: 31493 - DNA, 18 bp, Artificial Sequence
  Synthetic
cgcagccucgaagugact

SEQ ID NO: 31494 - DNA, 19 bp, Artificial Sequence
  Synthetic
gucctguacagcgagagca

SEQ ID NO: 31495 - DNA, 19 bp, Artificial Sequence
  Synthetic
cuacagcccggactgugac

SEQ ID NO: 31496 - DNA, 22 bp, Artificial Sequence
  Synthetic
gttcatcctucttgggctgugt

SEQ ID NO: 31497 - DNA, 23 bp, Artificial Sequence
  Synthetic
gaattcatcugcactgtgtuggg

SEQ ID NO: 31498 - DNA, 24 bp, Artificial Sequence
  Synthetic
caacttttugcaaagcagcauagc

SEQ ID NO: 31499 - DNA, 24 bp, Artificial Sequence
  Synthetic
gaaaacaagatugcggtcagcuaa

SEQ ID NO: 31500 - DNA, 22 bp, Artificial Sequence
  Synthetic
gagccauccatctuggagacag

SEQ ID NO: 31501 - DNA, 23 bp, Artificial Sequence
  Synthetic
guacggauggaaaaagagtcuca

SEQ ID NO: 31502 - DNA, 24 bp, Artificial Sequence
  Synthetic
ggaatggaaggauggaagaacuca

SEQ ID NO: 31503 - DNA, 22 bp, Artificial Sequence
  Synthetic
aagaacttcucgtctgcuagcg

SEQ ID NO: 31504 - DNA, 23 bp, Artificial Sequence
  Synthetic
cacaaatgugccaggaactucaa

SEQ ID NO: 31505 - DNA, 31 bp, Artificial Sequence
  Synthetic
aactagcaggcagutatttttaaagatcuct

SEQ ID NO: 31506 - DNA, 23 bp, Artificial Sequence
  Synthetic
gatgcttucggcttgactatugg

SEQ ID NO: 31507 - DNA, 22 bp, Artificial Sequence
  Synthetic
cttagaugccccagggaaagug

SEQ ID NO: 31508 - DNA, 24 bp, Artificial Sequence
  Synthetic
acttcctcuacatcgatgcttucg

SEQ ID NO: 31509 - DNA, 22 bp, Artificial Sequence
  Synthetic
agttcactaaugccgtgaugct

SEQ ID NO: 31510 - DNA, 20 bp, Artificial Sequence
  Synthetic
ggtgtgggugcgataaugca

SEQ ID NO: 31511 - DNA, 23 bp, Artificial Sequence
  Synthetic
gggugggaccaaactataatucc

SEQ ID NO: 31512 - DNA, 21 bp, Artificial Sequence
  Synthetic
agcccuacagaggtggtuaca

SEQ ID NO: 31513 - DNA, 20 bp, Artificial Sequence
  Synthetic
tgctctguctgtggtcaucg

SEQ ID NO: 31514 - DNA, 23 bp, Artificial Sequence
  Synthetic
cttcccctuccctttcttggaug

SEQ ID NO: 31515 - DNA, 22 bp, Artificial Sequence
  Synthetic
tgcctugaaacaagccaagcua

SEQ ID NO: 31516 - DNA, 20 bp, Artificial Sequence
  Synthetic
atgtucacctggaugcggat

SEQ ID NO: 31517 - DNA, 24 bp, Artificial Sequence
  Synthetic
ccccaggacauaagctattuagcc

SEQ ID NO: 31518 - DNA, 20 bp, Artificial Sequence
  Synthetic
gccattcuccctgugacagt

SEQ ID NO: 31519 - DNA, 21 bp, Artificial Sequence
  Synthetic
cgtctgugagaaatgctgugc

SEQ ID NO: 31520 - DNA, 18 bp, Artificial Sequence
  Synthetic
cgtacguccgggaagcuc

SEQ ID NO: 31521 - DNA, 20 bp, Artificial Sequence
  Synthetic
gcaaataacugcggctcucc

SEQ ID NO: 31522 - DNA, 19 bp, Artificial Sequence
  Synthetic
gggttuccgttgcagucct

SEQ ID NO: 31523 - DNA, 19 bp, Artificial Sequence
  Synthetic
cccgctccuagcaaaggug

SEQ ID NO: 31524 - DNA, 23 bp, Artificial Sequence
  Synthetic
agcactttcuccatgggaagtut

SEQ ID NO: 31525 - DNA, 29 bp, Artificial Sequence
  Synthetic
tcgccattatuacaagagttaagcatcut

SEQ ID NO: 31526 - DNA, 22 bp, Artificial Sequence
  Synthetic
tgggtattgtugggaggaggua

SEQ ID NO: 31527 - DNA, 24 bp, Artificial Sequence
  Synthetic
caagggaatguttattgggcgauc

SEQ ID NO: 31528 - DNA, 25 bp, Artificial Sequence
  Synthetic
cgttttcctaaccutgttcgccuat

SEQ ID NO: 31529 - DNA, 29 bp, Artificial Sequence
  Synthetic
gtacaggatgacauagtagaagttcucag

SEQ ID NO: 31530 - DNA, 22 bp, Artificial Sequence
  Synthetic
ccaatgaccccuaccaccagua

SEQ ID NO: 31531 - DNA, 23 bp, Artificial Sequence
  Synthetic
catctcttcaugtctggacguca

SEQ ID NO: 31532 - DNA, 29 bp, Artificial Sequence
  Synthetic
catttcaatcucagtgatttatgctugct

SEQ ID NO: 31533 - DNA, 28 bp, Artificial Sequence
  Synthetic
gtcacacacaaaugatgtttcaugagaa

SEQ ID NO: 31534 - DNA, 23 bp, Artificial Sequence
  Synthetic
ggatgtguccagtttuagccagt

SEQ ID NO: 31535 - DNA, 20 bp, Artificial Sequence
  Synthetic
agcacucgaacgacccatuc

SEQ ID NO: 31536 - DNA, 20 bp, Artificial Sequence
  Synthetic
ccaccctgcugaactgtcuc

SEQ ID NO: 31537 - DNA, 21 bp, Artificial Sequence
  Synthetic
acgtgtgggutttggccaaua

SEQ ID NO: 31538 - DNA, 17 bp, Artificial Sequence
  Synthetic
gcuacgccggcttcuga

SEQ ID NO: 31539 - DNA, 20 bp, Artificial Sequence
  Synthetic
gggactauccctggcucaca

SEQ ID NO: 31540 - DNA, 21 bp, Artificial Sequence
  Synthetic
cttctggagggugctgtucaa

SEQ ID NO: 31541 - DNA, 21 bp, Artificial Sequence
  Synthetic
cctcaaacaccacuccggtuc

SEQ ID NO: 31542 - DNA, 19 bp, Artificial Sequence
  Synthetic
cgtccccaaggcuttggua

SEQ ID NO: 31543 - DNA, 19 bp, Artificial Sequence
  Synthetic
aagacuggagacccuggct

SEQ ID NO: 31544 - DNA, 20 bp, Artificial Sequence
  Synthetic
ctgcctgcutctggcauaga

SEQ ID NO: 31545 - DNA, 17 bp, Artificial Sequence
  Synthetic
cccgccacagcgucuac

SEQ ID NO: 31546 - DNA, 18 bp, Artificial Sequence
  Synthetic
cattgcugacgccccuct

SEQ ID NO: 31547 - DNA, 20 bp, Artificial Sequence
  Synthetic
tccctgagugcccagguaaa

SEQ ID NO: 31548 - DNA, 17 bp, Artificial Sequence
  Synthetic
cctgccguggtgggtua

SEQ ID NO: 31549 - DNA, 23 bp, Artificial Sequence
  Synthetic
caggtaccacutcctccagaauc

SEQ ID NO: 31550 - DNA, 18 bp, Artificial Sequence
  Synthetic
cgcugaggucgggagaga

SEQ ID NO: 31551 - DNA, 21 bp, Artificial Sequence
  Synthetic
cctgaaatuctgcccugacca

SEQ ID NO: 31552 - DNA, 19 bp, Artificial Sequence
  Synthetic
tctgcaugggcgtctctug

SEQ ID NO: 31553 - DNA, 19 bp, Artificial Sequence
  Synthetic
gcttcccutcagggucagt

SEQ ID NO: 31554 - DNA, 18 bp, Artificial Sequence
  Synthetic
agggucccagcagucact

SEQ ID NO: 31555 - DNA, 19 bp, Artificial Sequence
  Synthetic
ccggcaggugcttguagac

SEQ ID NO: 31556 - DNA, 17 bp, Artificial Sequence
  Synthetic
cgcugttgccucccaca

SEQ ID NO: 31557 - DNA, 17 bp, Artificial Sequence
  Synthetic
ccgaccacgcucacuca

SEQ ID NO: 31558 - DNA, 22 bp, Artificial Sequence
  Synthetic
gttgggcugacctcttctctut

SEQ ID NO: 31559 - DNA, 21 bp, Artificial Sequence
  Synthetic
ctgagttuccacggcucaaga

SEQ ID NO: 31560 - DNA, 20 bp, Artificial Sequence
  Synthetic
gggacaugcagctctgauga

SEQ ID NO: 31561 - DNA, 25 bp, Artificial Sequence
  Synthetic
ggtttaattuccaggcacatgaugg

SEQ ID NO: 31562 - DNA, 21 bp, Artificial Sequence
  Synthetic
gtgcctguaatcccagcuaca

SEQ ID NO: 31563 - DNA, 22 bp, Artificial Sequence
  Synthetic
gtggtggcaauggttacaugag

SEQ ID NO: 31564 - DNA, 20 bp, Artificial Sequence
  Synthetic
cttggacccggacucgtuat

SEQ ID NO: 31565 - DNA, 19 bp, Artificial Sequence
  Synthetic
ggaaguccaggugcaccac

SEQ ID NO: 31566 - DNA, 27 bp, Artificial Sequence
  Synthetic
ggaaccacttcuaactgaaattggtut

SEQ ID NO: 31567 - DNA, 27 bp, Artificial Sequence
  Synthetic
gatctgatgagucagcaaagaagacut

SEQ ID NO: 31568 - DNA, 21 bp, Artificial Sequence
  Synthetic
gagcctuggcagaattucacg

SEQ ID NO: 31569 - DNA, 23 bp, Artificial Sequence
  Synthetic
tttacagaggucgcagagggaua

SEQ ID NO: 31570 - DNA, 20 bp, Artificial Sequence
  Synthetic
ggtgggacgutcactguagt

SEQ ID NO: 31571 - DNA, 20 bp, Artificial Sequence
  Synthetic
gctctgtcgcuctgcttcug

SEQ ID NO: 31572 - DNA, 18 bp, Artificial Sequence
  Synthetic
gtcccccaacucccctut

SEQ ID NO: 31573 - DNA, 18 bp, Artificial Sequence
  Synthetic
tcaugcgggaagcgaugg

SEQ ID NO: 31574 - DNA, 23 bp, Artificial Sequence
  Synthetic
tgtccttccccautggtttgtua

SEQ ID NO: 31575 - DNA, 24 bp, Artificial Sequence
  Synthetic
cagtttcaucgagttcuagcccaa

SEQ ID NO: 31576 - DNA, 22 bp, Artificial Sequence
  Synthetic
cacctcacutccacucacagag

SEQ ID NO: 31577 - DNA, 28 bp, Artificial Sequence
  Synthetic
ccaaatuaacgcucaggaaaaatacaut

SEQ ID NO: 31578 - DNA, 30 bp, Artificial Sequence
  Synthetic
gcaaacaataccaaauttacttcatgtgua

SEQ ID NO: 31579 - DNA, 26 bp, Artificial Sequence
  Synthetic
agcccauaaaggaatguaaaccaaca

SEQ ID NO: 31580 - DNA, 23 bp, Artificial Sequence
  Synthetic
ggcgcttacaguagctgttctua

SEQ ID NO: 31581 - DNA, 23 bp, Artificial Sequence
  Synthetic
ccatctgcaguacacacatgucc

SEQ ID NO: 31582 - DNA, 26 bp, Artificial Sequence
  Synthetic
cagtaggcagugaagtaaatttgugg

SEQ ID NO: 31583 - DNA, 28 bp, Artificial Sequence
  Synthetic
acagtgacaucatcagtuaaaacaaggt

SEQ ID NO: 31584 - DNA, 22 bp, Artificial Sequence
  Synthetic
aacagcacaugatcccactuca

SEQ ID NO: 31585 - DNA, 20 bp, Artificial Sequence
  Synthetic
cgaatcgcugtggcctugat

SEQ ID NO: 31586 - DNA, 23 bp, Artificial Sequence
  Synthetic
ccctcttctgugaagctgacauc

SEQ ID NO: 31587 - DNA, 26 bp, Artificial Sequence
  Synthetic
aggaaagagaacaucaccaggacuaa

SEQ ID NO: 31588 - DNA, 22 bp, Artificial Sequence
  Synthetic
tgatgcatgauaccctctugcc

SEQ ID NO: 31589 - DNA, 28 bp, Artificial Sequence
  Synthetic
tccugatcagcaaaauacaagaaagaga

SEQ ID NO: 31590 - DNA, 21 bp, Artificial Sequence
  Synthetic
cuggtttagccucaagcccaa

SEQ ID NO: 31591 - DNA, 21 bp, Artificial Sequence
  Synthetic
cagggtgggugcctactttua

SEQ ID NO: 31592 - DNA, 23 bp, Artificial Sequence
  Synthetic
gtggccttcuttgaagagctcua

SEQ ID NO: 31593 - DNA, 26 bp, Artificial Sequence
  Synthetic
gagagaaatctcuacagggtcguagt

SEQ ID NO: 31594 - DNA, 21 bp, Artificial Sequence
  Synthetic
cttgagcagcugaagctgtut

SEQ ID NO: 31595 - DNA, 17 bp, Artificial Sequence
  Synthetic
ctcctcucgccctugcc

SEQ ID NO: 31596 - DNA, 20 bp, Artificial Sequence
  Synthetic
gccaaggauctgggaucagg

SEQ ID NO: 31597 - DNA, 21 bp, Artificial Sequence
  Synthetic
ccttgauggcgaactgaguga

SEQ ID NO: 31598 - DNA, 17 bp, Artificial Sequence
  Synthetic
gctgcccugctggcaua

SEQ ID NO: 31599 - DNA, 22 bp, Artificial Sequence
  Synthetic
cccagtgcuaactccagtctut

SEQ ID NO: 31600 - DNA, 17 bp, Artificial Sequence
  Synthetic
gccuccacggacaggut

SEQ ID NO: 31601 - DNA, 17 bp, Artificial Sequence
  Synthetic
cccutgatgcucccgca

SEQ ID NO: 31602 - DNA, 18 bp, Artificial Sequence
  Synthetic
caccccaaggugccacut

SEQ ID NO: 31603 - DNA, 21 bp, Artificial Sequence
  Synthetic
cuctctcuagggaaggccaca

SEQ ID NO: 31604 - DNA, 20 bp, Artificial Sequence
  Synthetic
ggtccaggutgggagtggua

SEQ ID NO: 31605 - DNA, 20 bp, Artificial Sequence
  Synthetic
cccuccctctctugggacag

SEQ ID NO: 31606 - DNA, 28 bp, Artificial Sequence
  Synthetic
aagaattgttgaguctgaggaatauggg

SEQ ID NO: 31607 - DNA, 27 bp, Artificial Sequence
  Synthetic
ctgaatactgagcautttctgaagcug

SEQ ID NO: 31608 - DNA, 21 bp, Artificial Sequence
  Synthetic
ccacccacutgagacacctuc

SEQ ID NO: 31609 - DNA, 23 bp, Artificial Sequence
  Synthetic
tgactgccaugtgtctttctguc

SEQ ID NO: 31610 - DNA, 20 bp, Artificial Sequence
  Synthetic
cttctggucacgcaugcaac

SEQ ID NO: 31611 - DNA, 28 bp, Artificial Sequence
  Synthetic
ccatacatagtuccttctgttctucaca

SEQ ID NO: 31612 - DNA, 25 bp, Artificial Sequence
  Synthetic
ttcccugcaagacaacacattauga

SEQ ID NO: 31613 - DNA, 21 bp, Artificial Sequence
  Synthetic
gctgttgtgcutgtccccuag

SEQ ID NO: 31614 - DNA, 25 bp, Artificial Sequence
  Synthetic
gtgagaaccugcatttcuaacagac

SEQ ID NO: 31615 - DNA, 24 bp, Artificial Sequence
  Synthetic
ttttgttgacagcguctcggauat

SEQ ID NO: 31616 - DNA, 17 bp, Artificial Sequence
  Synthetic
gcaccagucgggtcuca

SEQ ID NO: 31617 - DNA, 17 bp, Artificial Sequence
  Synthetic
ctgggccutcugcagct

SEQ ID NO: 31618 - DNA, 25 bp, Artificial Sequence
  Synthetic
aaattatcuacccagcactgcagut

SEQ ID NO: 31619 - DNA, 17 bp, Artificial Sequence
  Synthetic
gtccgcautgccauccg

SEQ ID NO: 31620 - DNA, 23 bp, Artificial Sequence
  Synthetic
cgagctgaagutggtttgggaua

SEQ ID NO: 31621 - DNA, 26 bp, Artificial Sequence
  Synthetic
atcaaagtgattucagggatccucac

SEQ ID NO: 31622 - DNA, 21 bp, Artificial Sequence
  Synthetic
acgctgguagagaggcctaut

SEQ ID NO: 31623 - DNA, 24 bp, Artificial Sequence
  Synthetic
ccatatcacaagccuctgggttuc

SEQ ID NO: 31624 - DNA, 24 bp, Artificial Sequence
  Synthetic
autcagctgagugggaaaaaggaa

SEQ ID NO: 31625 - DNA, 22 bp, Artificial Sequence
  Synthetic
gcctttgaccgugacttttcug

SEQ ID NO: 31626 - DNA, 27 bp, Artificial Sequence
  Synthetic
tgcaatgaatgucaatggttgaauagc

SEQ ID NO: 31627 - DNA, 21 bp, Artificial Sequence
  Synthetic
gaggccagggcucaactuaat

SEQ ID NO: 31628 - DNA, 25 bp, Artificial Sequence
  Synthetic
gcgggaaucaggagttguaaaacat

SEQ ID NO: 31629 - DNA, 28 bp, Artificial Sequence
  Synthetic
ctatctgcaccutttgtaaagtctguct

SEQ ID NO: 31630 - DNA, 22 bp, Artificial Sequence
  Synthetic
cctgaucccagcaaatcugagt

SEQ ID NO: 31631 - DNA, 31 bp, Artificial Sequence
  Synthetic
tgtaatcatggcccuttaatatctgtttuct

SEQ ID NO: 31632 - DNA, 22 bp, Artificial Sequence
  Synthetic
cgaaguttgacugccaaccact

SEQ ID NO: 31633 - DNA, 27 bp, Artificial Sequence
  Synthetic
gggtcaaaatttaugagtcctgagugt

SEQ ID NO: 31634 - DNA, 27 bp, Artificial Sequence
  Synthetic
ctgtttattgtggucttccaggattug

SEQ ID NO: 31635 - DNA, 27 bp, Artificial Sequence
  Synthetic
tttttgatgccaauaggaatcugcaag

SEQ ID NO: 31636 - DNA, 23 bp, Artificial Sequence
  Synthetic
ctcccctcttucctcactctcua

SEQ ID NO: 31637 - DNA, 24 bp, Artificial Sequence
  Synthetic
ccuaacccccaaagcaaaauaagg

SEQ ID NO: 31638 - DNA, 31 bp, Artificial Sequence
  Synthetic
aggttagctttccutggttagttattucaat

SEQ ID NO: 31639 - DNA, 27 bp, Artificial Sequence
  Synthetic
tgtataacataacugtgtggtgggtut

SEQ ID NO: 31640 - DNA, 24 bp, Artificial Sequence
  Synthetic
actactcacguttccatgttgucc

SEQ ID NO: 31641 - DNA, 24 bp, Artificial Sequence
  Synthetic
cagaagacuggagtggtcatuagt

SEQ ID NO: 31642 - DNA, 21 bp, Artificial Sequence
  Synthetic
cagcaacuggcacaggagaua

SEQ ID NO: 31643 - DNA, 23 bp, Artificial Sequence
  Synthetic
ctagacuggatgagacuggaacc

SEQ ID NO: 31644 - DNA, 28 bp, Artificial Sequence
  Synthetic
acugaagagctaataugagaaaacgaag

SEQ ID NO: 31645 - DNA, 28 bp, Artificial Sequence
  Synthetic
gcatgautctatccaaatuccaagacag

SEQ ID NO: 31646 - DNA, 26 bp, Artificial Sequence
  Synthetic
aatctgctgucaaataagaacaguct

SEQ ID NO: 31647 - DNA, 29 bp, Artificial Sequence
  Synthetic
ggtcagtaattgutttctgctttgatuct

SEQ ID NO: 31648 - DNA, 23 bp, Artificial Sequence
  Synthetic
acgttgaccaaautgttgtgcuc

SEQ ID NO: 31649 - DNA, 28 bp, Artificial Sequence
  Synthetic
ggacacugaaaggaaggttttautctut

SEQ ID NO: 31650 - DNA, 26 bp, Artificial Sequence
  Synthetic
gtcacctgucatttaactuggaggaa

SEQ ID NO: 31651 - DNA, 30 bp, Artificial Sequence
  Synthetic
aaagcaaaaatcaugttgttgttattgtug

SEQ ID NO: 31652 - DNA, 22 bp, Artificial Sequence
  Synthetic
gccaggcuaatgtcgcatttua

SEQ ID NO: 31653 - DNA, 27 bp, Artificial Sequence
  Synthetic
gaatttgacctccutgcctttctttut

SEQ ID NO: 31654 - DNA, 27 bp, Artificial Sequence
  Synthetic
aaaggacaacaaugtttacaatgugct

SEQ ID NO: 31655 - DNA, 27 bp, Artificial Sequence
  Synthetic
ccaatttgcutttgactatugcacaca

SEQ ID NO: 31656 - DNA, 21 bp, Artificial Sequence
  Synthetic
cctcttgaagutcccggaguc

SEQ ID NO: 31657 - DNA, 28 bp, Artificial Sequence
  Synthetic
gcctaaaacctugtcatattgccaatut

SEQ ID NO: 31658 - DNA, 24 bp, Artificial Sequence
  Synthetic
ctatgtgcutaacatgugcaaggc

SEQ ID NO: 31659 - DNA, 22 bp, Artificial Sequence
  Synthetic
acatggtacgcugctgttctut

SEQ ID NO: 31660 - DNA, 29 bp, Artificial Sequence
  Synthetic
aggaccttgguaagagttatgauaagagg

SEQ ID NO: 31661 - DNA, 27 bp, Artificial Sequence
  Synthetic
tgtaagcaaagutggcatttuaaagca

SEQ ID NO: 31662 - DNA, 23 bp, Artificial Sequence
  Synthetic
ccttggagtcutctaggagccut

SEQ ID NO: 31663 - DNA, 25 bp, Artificial Sequence
  Synthetic
catctgaacauttggtccttugcag

SEQ ID NO: 31664 - DNA, 26 bp, Artificial Sequence
  Synthetic
ctccaagaggcautgatattctcugt

SEQ ID NO: 31665 - DNA, 29 bp, Artificial Sequence
  Synthetic
gctgtttacgaaguattttaagacacucc

SEQ ID NO: 31666 - DNA, 26 bp, Artificial Sequence
  Synthetic
tccagccattgugttgaatccttuaa

SEQ ID NO: 31667 - DNA, 28 bp, Artificial Sequence
  Synthetic
atgtgagataacguttggaagttacaut

SEQ ID NO: 31668 - DNA, 23 bp, Artificial Sequence
  Synthetic
taagaactggugggaaatgguct

SEQ ID NO: 31669 - DNA, 20 bp, Artificial Sequence
  Synthetic
gcagattucaaccgggctug

SEQ ID NO: 31670 - DNA, 23 bp, Artificial Sequence
  Synthetic
gccaaagagaaugggatccagua

SEQ ID NO: 31671 - DNA, 30 bp, Artificial Sequence
  Synthetic
ttcaccaaatggautaagatgttcaugaat

SEQ ID NO: 31672 - DNA, 29 bp, Artificial Sequence
  Synthetic
ccaaatgagaaaautcagtgatatugcca

SEQ ID NO: 31673 - DNA, 28 bp, Artificial Sequence
  Synthetic
tgaagacctugaagagcagttaaaucat

SEQ ID NO: 31674 - DNA, 25 bp, Artificial Sequence
  Synthetic
gcaacattuaacacatgugacggaa

SEQ ID NO: 31675 - DNA, 24 bp, Artificial Sequence
  Synthetic
acgttgttgcauttgtctgttuca

SEQ ID NO: 31676 - DNA, 28 bp, Artificial Sequence
  Synthetic
ttttcttttagtugctgctctttuccag

SEQ ID NO: 31677 - DNA, 28 bp, Artificial Sequence
  Synthetic
gtgtcccagttugcattaacaaatagut

SEQ ID NO: 31678 - DNA, 21 bp, Artificial Sequence
  Synthetic
cgcagautcaggctucccaat

SEQ ID NO: 31679 - DNA, 30 bp, Artificial Sequence
  Synthetic
gcttcatttttgttutgcctttttggtauc

SEQ ID NO: 31680 - DNA, 29 bp, Artificial Sequence
  Synthetic
ccatggaggguactgaaataaattcuaca

SEQ ID NO: 31681 - DNA, 27 bp, Artificial Sequence
  Synthetic
aggtcggatugacattattcauagcaa

SEQ ID NO: 31682 - DNA, 27 bp, Artificial Sequence
  Synthetic
agtcaattgttcuggcactatgaauga

SEQ ID NO: 31683 - DNA, 26 bp, Artificial Sequence
  Synthetic
ctcacaagcccuattagaaguggaac

SEQ ID NO: 31684 - DNA, 23 bp, Artificial Sequence
  Synthetic
gttgcaaacacauacgtgggtut

SEQ ID NO: 31685 - DNA, 20 bp, Artificial Sequence
  Synthetic
gaatgcagugcguaggcaag

SEQ ID NO: 31686 - DNA, 21 bp, Artificial Sequence
  Synthetic
cctttcatcuctgggcucagg

SEQ ID NO: 31687 - DNA, 26 bp, Artificial Sequence
  Synthetic
gcagccagaagugcactatacataua

SEQ ID NO: 31688 - DNA, 23 bp, Artificial Sequence
  Synthetic
cctccagtggutcaagcaattut

SEQ ID NO: 31689 - DNA, 28 bp, Artificial Sequence
  Synthetic
gattagttuagcaauaggaggttgaaua

SEQ ID NO: 31690 - DNA, 28 bp, Artificial Sequence
  Synthetic
aggacaaagatgautgaagtaactggug

SEQ ID NO: 31691 - DNA, 28 bp, Artificial Sequence
  Synthetic
tgccatggtaugtctctgtacaatuaag

SEQ ID NO: 31692 - DNA, 27 bp, Artificial Sequence
  Synthetic
gaggtgacagcuatccagttactatuc

SEQ ID NO: 31693 - DNA, 24 bp, Artificial Sequence
  Synthetic
aaggtcaaugctctcctttucaca

SEQ ID NO: 31694 - DNA, 28 bp, Artificial Sequence
  Synthetic
aggcaactucagaatccaaattacuagg

SEQ ID NO: 31695 - DNA, 28 bp, Artificial Sequence
  Synthetic
cutttcagguaacagaaagaaagcaaca

SEQ ID NO: 31696 - DNA, 20 bp, Artificial Sequence
  Synthetic
ccugcgtattugccaccaga

SEQ ID NO: 31697 - DNA, 25 bp, Artificial Sequence
  Synthetic
agtgccttttuacactgtcctuaca

SEQ ID NO: 31698 - DNA, 29 bp, Artificial Sequence
  Synthetic
aagttagaaacacugcaacattttgtuga

SEQ ID NO: 31699 - DNA, 24 bp, Artificial Sequence
  Synthetic
acttaauccaggagtcccucacat

SEQ ID NO: 31700 - DNA, 28 bp, Artificial Sequence
  Synthetic
tgatagcttttcugtaatcctgcugaac

SEQ ID NO: 31701 - DNA, 29 bp, Artificial Sequence
  Synthetic
cgtgatattgugattgattttcaugcaga

SEQ ID NO: 31702 - DNA, 26 bp, Artificial Sequence
  Synthetic
gctcattttatcugagaggcctguat

SEQ ID NO: 31703 - DNA, 22 bp, Artificial Sequence
  Synthetic
gautcgcatatuggcacagacc

SEQ ID NO: 31704 - DNA, 29 bp, Artificial Sequence
  Synthetic
ggatttgtctuctatttggtactugacct

SEQ ID NO: 31705 - DNA, 26 bp, Artificial Sequence
  Synthetic
ttctttcttaggaaguttgggcaugt

SEQ ID NO: 31706 - DNA, 22 bp, Artificial Sequence
  Synthetic
gtggagcutgagctaugacact

SEQ ID NO: 31707 - DNA, 29 bp, Artificial Sequence
  Synthetic
aactgggatgtugtgagaaagaaattaua

SEQ ID NO: 31708 - DNA, 31 bp, Artificial Sequence
  Synthetic
actgctttctgtaautcatctggagtttuat

SEQ ID NO: 31709 - DNA, 28 bp, Artificial Sequence
  Synthetic
tgtttgtttgtttugtggaaggtctaug

SEQ ID NO: 31710 - DNA, 29 bp, Artificial Sequence
  Synthetic
tgagtgttaagttcuttgagttctgtcuc

SEQ ID NO: 31711 - DNA, 27 bp, Artificial Sequence
  Synthetic
gccatcagucccaattttacatttuct

SEQ ID NO: 31712 - DNA, 25 bp, Artificial Sequence
  Synthetic
ctgaaggucaaatgcttatguacct

SEQ ID NO: 31713 - DNA, 22 bp, Artificial Sequence
  Synthetic
aaatugagggacgcuggaagaa

SEQ ID NO: 31714 - DNA, 24 bp, Artificial Sequence
  Synthetic
gtgaatgcttgauaagcgtgctut

SEQ ID NO: 31715 - DNA, 22 bp, Artificial Sequence
  Synthetic
cgctaucaggagaccatgagug

SEQ ID NO: 31716 - DNA, 23 bp, Artificial Sequence
  Synthetic
agtaccutctggattuccccaca

SEQ ID NO: 31717 - DNA, 26 bp, Artificial Sequence
  Synthetic
aattcaaagcauagcccugaaagaga

SEQ ID NO: 31718 - DNA, 28 bp, Artificial Sequence
  Synthetic
cctattgatuatgctccaaauggaagga

SEQ ID NO: 31719 - DNA, 30 bp, Artificial Sequence
  Synthetic
tcatcgcttuctataatcagcuacaacaat

SEQ ID NO: 31720 - DNA, 28 bp, Artificial Sequence
  Synthetic
acaagtgctugtctgatataatucagct

SEQ ID NO: 31721 - DNA, 27 bp, Artificial Sequence
  Synthetic
tgaattactcauctttgctctcaugct

SEQ ID NO: 31722 - DNA, 22 bp, Artificial Sequence
  Synthetic
gcugaagugaaaacaccaccaa

SEQ ID NO: 31723 - DNA, 23 bp, Artificial Sequence
  Synthetic
aagggaacagaucctgguaaagc

SEQ ID NO: 31724 - DNA, 27 bp, Artificial Sequence
  Synthetic
aatctggttgctucttttgtagggtua

SEQ ID NO: 31725 - DNA, 25 bp, Artificial Sequence
  Synthetic
gaauaagtcagugacccagaagacg

SEQ ID NO: 31726 - DNA, 30 bp, Artificial Sequence
  Synthetic
actgggtttttauaagaccattgaaagcua

SEQ ID NO: 31727 - DNA, 28 bp, Artificial Sequence
  Synthetic
aattctttaatgtcutgcagtgccttut

SEQ ID NO: 31728 - DNA, 26 bp, Artificial Sequence
  Synthetic
ctgacctuaagttgttctuccaaagc

SEQ ID NO: 31729 - DNA, 28 bp, Artificial Sequence
  Synthetic
gagagcaaatcauttcaacacacatgua

SEQ ID NO: 31730 - DNA, 27 bp, Artificial Sequence
  Synthetic
acaaactgagaaucgtaactuaaccat

SEQ ID NO: 31731 - DNA, 29 bp, Artificial Sequence
  Synthetic
tgaagtacaagagcagaugaatctccuaa

SEQ ID NO: 31732 - DNA, 25 bp, Artificial Sequence
  Synthetic
tgaggaaaaaggaugacttgccaut

SEQ ID NO: 31733 - DNA, 29 bp, Artificial Sequence
  Synthetic
cagctttagaagaaguattatcgtggcut

SEQ ID NO: 31734 - DNA, 25 bp, Artificial Sequence
  Synthetic
cttggaagcagutctctggtttgua

SEQ ID NO: 31735 - DNA, 24 bp, Artificial Sequence
  Synthetic
tggtttttcccccucctctctauc

SEQ ID NO: 31736 - DNA, 28 bp, Artificial Sequence
  Synthetic
ctgttgagaatagugcatttgatgaugt

SEQ ID NO: 31737 - DNA, 30 bp, Artificial Sequence
  Synthetic
ccaaaaattgatgugtagtgttaatgugct

SEQ ID NO: 31738 - DNA, 24 bp, Artificial Sequence
  Synthetic
aaagtaggacaugatcuggaacca

SEQ ID NO: 31739 - DNA, 30 bp, Artificial Sequence
  Synthetic
acaatcaactcguaattatccacaggtuaa

SEQ ID NO: 31740 - DNA, 24 bp, Artificial Sequence
  Synthetic
ccucacaacaaaagucccaattua

SEQ ID NO: 31741 - DNA, 23 bp, Artificial Sequence
  Synthetic
cagccuccgcagaatttgaaaug

SEQ ID NO: 31742 - DNA, 29 bp, Artificial Sequence
  Synthetic
caatctacctaautagtgagcttgucaca

SEQ ID NO: 31743 - DNA, 28 bp, Artificial Sequence
  Synthetic
cctacuggagcaataaagttugaagaac

SEQ ID NO: 31744 - DNA, 27 bp, Artificial Sequence
  Synthetic
tcatggccagcutctaattgtattugt

SEQ ID NO: 31745 - DNA, 24 bp, Artificial Sequence
  Synthetic
gggagctgutggaattcaaauaga

SEQ ID NO: 31746 - DNA, 31 bp, Artificial Sequence
  Synthetic
gtcctttacacaatuaaaagaagatgctgut

SEQ ID NO: 31747 - DNA, 28 bp, Artificial Sequence
  Synthetic
gaaagaggcctuactgcagaatatagut

SEQ ID NO: 31748 - DNA, 21 bp, Artificial Sequence
  Synthetic
ggccgtgaccutctcactcua

SEQ ID NO: 31749 - DNA, 23 bp, Artificial Sequence
  Synthetic
ttctttgggaaggcugccttuaa

SEQ ID NO: 31750 - DNA, 28 bp, Artificial Sequence
  Synthetic
attttgactttucagttgagatgaugcc

SEQ ID NO: 31751 - DNA, 28 bp, Artificial Sequence
  Synthetic
ttcugaaatcagcttuggagagaagaaa

SEQ ID NO: 31752 - DNA, 24 bp, Artificial Sequence
  Synthetic
gatttggacacccuggcuaaagaa

SEQ ID NO: 31753 - DNA, 26 bp, Artificial Sequence
  Synthetic
actgtttcacutaaagcaagucagga

SEQ ID NO: 31754 - DNA, 25 bp, Artificial Sequence
  Synthetic
ggaaggagacgcgauatugaaaaga

SEQ ID NO: 31755 - DNA, 28 bp, Artificial Sequence
  Synthetic
tgggacaguaaaaggcaataatagctut

SEQ ID NO: 31756 - DNA, 27 bp, Artificial Sequence
  Synthetic
ctgaagaaaacaaauatgacugccaca

SEQ ID NO: 31757 - DNA, 26 bp, Artificial Sequence
  Synthetic
tcctccattccutgtttcttgctuac

SEQ ID NO: 31758 - DNA, 22 bp, Artificial Sequence
  Synthetic
cctcagcuccagaagccuaaat

SEQ ID NO: 31759 - DNA, 26 bp, Artificial Sequence
  Synthetic
caaagttaagcacguattacagugca

SEQ ID NO: 31760 - DNA, 22 bp, Artificial Sequence
  Synthetic
tctaggaagugcctgagcuagt

SEQ ID NO: 31761 - DNA, 21 bp, Artificial Sequence
  Synthetic
ggcggcuacacgactttcaut

SEQ ID NO: 31762 - DNA, 22 bp, Artificial Sequence
  Synthetic
cgguagcaggacaacagttuct

SEQ ID NO: 31763 - DNA, 24 bp, Artificial Sequence
  Synthetic
gctaatgtgcacutgcaatctcug

SEQ ID NO: 31764 - DNA, 30 bp, Artificial Sequence
  Synthetic
tttggatgttttcaauggtactatccugaa

SEQ ID NO: 31765 - DNA, 26 bp, Artificial Sequence
  Synthetic
ttgagctctucggtagtaggtauagg

SEQ ID NO: 31766 - DNA, 28 bp, Artificial Sequence
  Synthetic
gctgttgutgcattttauacagagaaat

SEQ ID NO: 31767 - DNA, 24 bp, Artificial Sequence
  Synthetic
gaaaaaccctutgagcatccucag

SEQ ID NO: 31768 - DNA, 25 bp, Artificial Sequence
  Synthetic
caaagaagatgcuggagattctuca

SEQ ID NO: 31769 - DNA, 28 bp, Artificial Sequence
  Synthetic
ttggtcccatugaatatctcgttuacaa

SEQ ID NO: 31770 - DNA, 26 bp, Artificial Sequence
  Synthetic
gctttggcattcugaagtacttggua

SEQ ID NO: 31771 - DNA, 30 bp, Artificial Sequence
  Synthetic
caaattcuatattcacaagtugggaaaggc

SEQ ID NO: 31772 - DNA, 23 bp, Artificial Sequence
  Synthetic
ggttcttcugtcagaggatuggg

SEQ ID NO: 31773 - DNA, 21 bp, Artificial Sequence
  Synthetic
cagccagacuacagugaacga

SEQ ID NO: 31774 - DNA, 22 bp, Artificial Sequence
  Synthetic
caggcagtuggcagttgauaga

SEQ ID NO: 31775 - DNA, 26 bp, Artificial Sequence
  Synthetic
gacaacugggagaagggtgauaaaaa

SEQ ID NO: 31776 - DNA, 20 bp, Artificial Sequence
  Synthetic
gtgttgggcucatggatugg

SEQ ID NO: 31777 - DNA, 24 bp, Artificial Sequence
  Synthetic
tttccctcaucctctttctccuca

SEQ ID NO: 31778 - DNA, 22 bp, Artificial Sequence
  Synthetic
tcttttctgcccaugtacccut

SEQ ID NO: 31779 - DNA, 26 bp, Artificial Sequence
  Synthetic
aaaaaggagauccacctcuaccaaac

SEQ ID NO: 31780 - DNA, 22 bp, Artificial Sequence
  Synthetic
gatccaacccaccucttctuca

SEQ ID NO: 31781 - DNA, 25 bp, Artificial Sequence
  Synthetic
tgccttcatttuctccccaatcuag

SEQ ID NO: 31782 - DNA, 17 bp, Artificial Sequence
  Synthetic
cgatggtucccggcgua

SEQ ID NO: 31783 - DNA, 21 bp, Artificial Sequence
  Synthetic
cguagctcaagaucccgaagg

SEQ ID NO: 31784 - DNA, 22 bp, Artificial Sequence
  Synthetic
aaacaacuaaacgccgcttucc

SEQ ID NO: 31785 - DNA, 22 bp, Artificial Sequence
  Synthetic
tcttccagccutttcctucagc

SEQ ID NO: 31786 - DNA, 23 bp, Artificial Sequence
  Synthetic
ggataacttcuggctggtgacug

SEQ ID NO: 31787 - DNA, 22 bp, Artificial Sequence
  Synthetic
gagctgacacccaugtagctua

SEQ ID NO: 31788 - DNA, 23 bp, Artificial Sequence
  Synthetic
gcacccagccaguagaaggauat

SEQ ID NO: 31789 - DNA, 23 bp, Artificial Sequence
  Synthetic
cggattgccaccuctacatcaug

SEQ ID NO: 31790 - DNA, 21 bp, Artificial Sequence
  Synthetic
gccccagtugtggttctctuc

SEQ ID NO: 31791 - DNA, 25 bp, Artificial Sequence
  Synthetic
ccagtaccaaaautccaagcctuac

SEQ ID NO: 31792 - DNA, 22 bp, Artificial Sequence
  Synthetic
gatggtgugagcagtcacucat

SEQ ID NO: 31793 - DNA, 24 bp, Artificial Sequence
  Synthetic
gctatctcucaatgcttcctuggg

SEQ ID NO: 31794 - DNA, 23 bp, Artificial Sequence
  Synthetic
ggctctggccutttatatgccut

SEQ ID NO: 31795 - DNA, 28 bp, Artificial Sequence
  Synthetic
ctatccccatccuttcctcaaacataut

SEQ ID NO: 31796 - DNA, 23 bp, Artificial Sequence
  Synthetic
ccctacctuactcctccttcuct

SEQ ID NO: 31797 - DNA, 27 bp, Artificial Sequence
  Synthetic
cttgttctcttauctctgccctcuaac

SEQ ID NO: 31798 - DNA, 29 bp, Artificial Sequence
  Synthetic
tgatcactcttatuattgccttaggtgug

SEQ ID NO: 31799 - DNA, 25 bp, Artificial Sequence
  Synthetic
tgtgggagaaaacaucatgucgaat

SEQ ID NO: 31800 - DNA, 23 bp, Artificial Sequence
  Synthetic
caatctggucttctctcuccact

SEQ ID NO: 31801 - DNA, 22 bp, Artificial Sequence
  Synthetic
gccacgcucaggattgaactua

SEQ ID NO: 31802 - DNA, 23 bp, Artificial Sequence
  Synthetic
cagatgucgagaaggaggugaag

SEQ ID NO: 31803 - DNA, 22 bp, Artificial Sequence
  Synthetic
cacatccucagaacagcuccaa

SEQ ID NO: 31804 - DNA, 22 bp, Artificial Sequence
  Synthetic
agtcatgucccaatgtcctguc

SEQ ID NO: 31805 - DNA, 24 bp, Artificial Sequence
  Synthetic
aatatguacagggaggtgcuaggt

SEQ ID NO: 31806 - DNA, 21 bp, Artificial Sequence
  Synthetic
tctcacucccactgccctuat

SEQ ID NO: 31807 - DNA, 23 bp, Artificial Sequence
  Synthetic
ctatatggcaugaactccugcct

SEQ ID NO: 31808 - DNA, 23 bp, Artificial Sequence
  Synthetic
ccagaggcutgaatctgttugga

SEQ ID NO: 31809 - DNA, 24 bp, Artificial Sequence
  Synthetic
ccccttacctuccacctctctuac

SEQ ID NO: 31810 - DNA, 25 bp, Artificial Sequence
  Synthetic
ctaggcaagagucttagugagaacc

SEQ ID NO: 31811 - DNA, 21 bp, Artificial Sequence
  Synthetic
ggttgtaguacctcccgggua

SEQ ID NO: 31812 - DNA, 22 bp, Artificial Sequence
  Synthetic
ctccacacugagtcatggtguc

SEQ ID NO: 31813 - DNA, 27 bp, Artificial Sequence
  Synthetic
tccagtgtgtautgaaatttgagguct

SEQ ID NO: 31814 - DNA, 22 bp, Artificial Sequence
  Synthetic
ctgcctccguggattctactut

SEQ ID NO: 31815 - DNA, 23 bp, Artificial Sequence
  Synthetic
cuatacacacttcuggcaccact

SEQ ID NO: 31816 - DNA, 30 bp, Artificial Sequence
  Synthetic
actatacattgtgutccttaacaacuccag

SEQ ID NO: 31817 - DNA, 22 bp, Artificial Sequence
  Synthetic
tcattguccagcagtcgatgug

SEQ ID NO: 31818 - DNA, 24 bp, Artificial Sequence
  Synthetic
gtgattcaatgutgcaggagauca

SEQ ID NO: 31819 - DNA, 21 bp, Artificial Sequence
  Synthetic
acacatggagcugaacgugag

SEQ ID NO: 31820 - DNA, 22 bp, Artificial Sequence
  Synthetic
ccctgtgucctctgtctgtuct

SEQ ID NO: 31821 - DNA, 23 bp, Artificial Sequence
  Synthetic
caatcttgguccactcccuaagc

SEQ ID NO: 31822 - DNA, 25 bp, Artificial Sequence
  Synthetic
ctgataaacatautggctgctgugg

SEQ ID NO: 31823 - DNA, 21 bp, Artificial Sequence
  Synthetic
ttttgcacuccgcattuccag

SEQ ID NO: 31824 - DNA, 29 bp, Artificial Sequence
  Synthetic
atcttcacctctutcttctttggtttuct

SEQ ID NO: 31825 - DNA, 23 bp, Artificial Sequence
  Synthetic
gattccaguaaccgcaaacctug

SEQ ID NO: 31826 - DNA, 25 bp, Artificial Sequence
  Synthetic
ctacaaatgctugcagtcttctgut

SEQ ID NO: 31827 - DNA, 20 bp, Artificial Sequence
  Synthetic
tgugtgguagagcagcaacc

SEQ ID NO: 31828 - DNA, 21 bp, Artificial Sequence
  Synthetic
cctgctccuaccctgcuagag

SEQ ID NO: 31829 - DNA, 22 bp, Artificial Sequence
  Synthetic
cgtcatgaagugagaggctgug

SEQ ID NO: 31830 - DNA, 23 bp, Artificial Sequence
  Synthetic
tgaggagcuatggatgucaagga

SEQ ID NO: 31831 - DNA, 22 bp, Artificial Sequence
  Synthetic
tgccgguacacagaggtctuat

SEQ ID NO: 31832 - DNA, 22 bp, Artificial Sequence
  Synthetic
cacutgggatctucacaaggac

SEQ ID NO: 31833 - DNA, 23 bp, Artificial Sequence
  Synthetic
agtctcacaaucccaggctctua

SEQ ID NO: 31834 - DNA, 25 bp, Artificial Sequence
  Synthetic
cacccttcuaccaatcctactctug

SEQ ID NO: 31835 - DNA, 25 bp, Artificial Sequence
  Synthetic
caaatgctcccutatacctcugcat

SEQ ID NO: 31836 - DNA, 29 bp, Artificial Sequence
  Synthetic
catgataagtaccaugactccaatgagug

SEQ ID NO: 31837 - DNA, 23 bp, Artificial Sequence
  Synthetic
ccagatgaaaucccagtgcctua

SEQ ID NO: 31838 - DNA, 23 bp, Artificial Sequence
  Synthetic
ggatugggaaaggaggtugaaga

SEQ ID NO: 31839 - DNA, 23 bp, Artificial Sequence
  Synthetic
ccgcccccuaaatttattccaug

SEQ ID NO: 31840 - DNA, 26 bp, Artificial Sequence
  Synthetic
agtaccaacatauttggacgctacug

SEQ ID NO: 31841 - DNA, 21 bp, Artificial Sequence
  Synthetic
caacagcucaatgccucacat

SEQ ID NO: 31842 - DNA, 22 bp, Artificial Sequence
  Synthetic
ccaucatgucagacacggacag

SEQ ID NO: 31843 - DNA, 21 bp, Artificial Sequence
  Synthetic
gcacctccutcctctgctuag

SEQ ID NO: 31844 - DNA, 24 bp, Artificial Sequence
  Synthetic
tgggaattauctgagggagugagg

SEQ ID NO: 31845 - DNA, 26 bp, Artificial Sequence
  Synthetic
gttcaagccaauacaccaaagaauca

SEQ ID NO: 31846 - DNA, 22 bp, Artificial Sequence
  Synthetic
tggcatugagccatgtgtauag

SEQ ID NO: 31847 - DNA, 24 bp, Artificial Sequence
  Synthetic
agtcagaggaacuactgaagucca

SEQ ID NO: 31848 - DNA, 23 bp, Artificial Sequence
  Synthetic
gctgctgtttucccatctgacut

SEQ ID NO: 31849 - DNA, 23 bp, Artificial Sequence
  Synthetic
gattctacugagcactccaccuc

SEQ ID NO: 31850 - DNA, 24 bp, Artificial Sequence
  Synthetic
tttctctaagutcccctccugact

SEQ ID NO: 31851 - DNA, 31 bp, Artificial Sequence
  Synthetic
ctcttggtttgguatctgtcactttatcuat

SEQ ID NO: 31852 - DNA, 28 bp, Artificial Sequence
  Synthetic
ctttaatguggaatttggaguggaaacc

SEQ ID NO: 31853 - DNA, 23 bp, Artificial Sequence
  Synthetic
gatatcaucctcccaaugcagct

SEQ ID NO: 31854 - DNA, 30 bp, Artificial Sequence
  Synthetic
acatgagtaacuctttttatcttugccaga

SEQ ID NO: 31855 - DNA, 28 bp, Artificial Sequence
  Synthetic
gtccatataccagaucctcattgucaat

SEQ ID NO: 31856 - DNA, 24 bp, Artificial Sequence
  Synthetic
aggaaaggugaatctucagggaga

SEQ ID NO: 31857 - DNA, 28 bp, Artificial Sequence
  Synthetic
cuttctttgttcttcuaaacaccaagcc

SEQ ID NO: 31858 - DNA, 21 bp, Artificial Sequence
  Synthetic
ggagaaccccauggctttgut

SEQ ID NO: 31859 - DNA, 21 bp, Artificial Sequence
  Synthetic
tggaacugccggagtttgaug

SEQ ID NO: 31860 - DNA, 27 bp, Artificial Sequence
  Synthetic
tgtttttggtgugtttgtctcagatug

SEQ ID NO: 31861 - DNA, 23 bp, Artificial Sequence
  Synthetic
agatcaccauctttgcctgugag

SEQ ID NO: 31862 - DNA, 27 bp, Artificial Sequence
  Synthetic
ctaaataactgggucttctgtgtucct

SEQ ID NO: 31863 - DNA, 31 bp, Artificial Sequence
  Synthetic
actggttcctcatutatcaatttccttagut

SEQ ID NO: 31864 - DNA, 31 bp, Artificial Sequence
  Synthetic
ctttttcgtgcuccaatttatcttcauaaga

SEQ ID NO: 31865 - DNA, 21 bp, Artificial Sequence
  Synthetic
acaacccaaucccctcccuat

SEQ ID NO: 31866 - DNA, 26 bp, Artificial Sequence
  Synthetic
ttgctgtcaataaauatcagggccut

SEQ ID NO: 31867 - DNA, 24 bp, Artificial Sequence
  Synthetic
tggtgtcuaagaggaaggtgtuca

SEQ ID NO: 31868 - DNA, 23 bp, Artificial Sequence
  Synthetic
caagtgtctgcuagaggtgacug

SEQ ID NO: 31869 - DNA, 28 bp, Artificial Sequence
  Synthetic
gcatctaagtcautctgctacctuaact

SEQ ID NO: 31870 - DNA, 25 bp, Artificial Sequence
  Synthetic
tttgtgtgtggcuatttgtctcgua

SEQ ID NO: 31871 - DNA, 23 bp, Artificial Sequence
  Synthetic
cctctttguaacgctcttgaugc

SEQ ID NO: 31872 - DNA, 28 bp, Artificial Sequence
  Synthetic
gtatgcctttutaaggttgattucccaa

SEQ ID NO: 31873 - DNA, 28 bp, Artificial Sequence
  Synthetic
catgttctcaaugttctttcccattuct

SEQ ID NO: 31874 - DNA, 25 bp, Artificial Sequence
  Synthetic
gtggcatgtugaactttgatagcuc

SEQ ID NO: 31875 - DNA, 23 bp, Artificial Sequence
  Synthetic
cagtggcagaagagutaaggcua

SEQ ID NO: 31876 - DNA, 23 bp, Artificial Sequence
  Synthetic
tttttcttccuctgctgcucaca

SEQ ID NO: 31877 - DNA, 29 bp, Artificial Sequence
  Synthetic
cgttagctgtaaucacaccacattauact

SEQ ID NO: 31878 - DNA, 25 bp, Artificial Sequence
  Synthetic
gactaacaaattcugccccctcuat

SEQ ID NO: 31879 - DNA, 24 bp, Artificial Sequence
  Synthetic
cacttcctgccuggtatctctuac

SEQ ID NO: 31880 - DNA, 25 bp, Artificial Sequence
  Synthetic
tttttggtcugaggaagcattcuga

SEQ ID NO: 31881 - DNA, 29 bp, Artificial Sequence
  Synthetic
gccttgacauccctactatagatauccaa

SEQ ID NO: 31882 - DNA, 26 bp, Artificial Sequence
  Synthetic
cagtcaaugcaaaggttguaaaggac

SEQ ID NO: 31883 - DNA, 27 bp, Artificial Sequence
  Synthetic
tgcaatcacggaacauttgattctuac

SEQ ID NO: 31884 - DNA, 24 bp, Artificial Sequence
  Synthetic
cccggcaaautgtccttaacttut

SEQ ID NO: 31885 - DNA, 25 bp, Artificial Sequence
  Synthetic
agtattuggcacagagacagctuac

SEQ ID NO: 31886 - DNA, 23 bp, Artificial Sequence
  Synthetic
gaccatacguaaggtgagugagt

SEQ ID NO: 31887 - DNA, 31 bp, Artificial Sequence
  Synthetic
gacggattcauggaaagaaaataaugagaaa

SEQ ID NO: 31888 - DNA, 32 bp, Artificial Sequence
  Synthetic
ataagctccatgaagauagatatttttgtcut

SEQ ID NO: 31889 - DNA, 24 bp, Artificial Sequence
  Synthetic
ccaggcttuctaattctgctucct

SEQ ID NO: 31890 - DNA, 28 bp, Artificial Sequence
  Synthetic
tccctttcctagauagaagctaagtugt

SEQ ID NO: 31891 - DNA, 31 bp, Artificial Sequence
  Synthetic
gcaggcacaauaacaatcttauaaagagaaa

SEQ ID NO: 31892 - DNA, 26 bp, Artificial Sequence
  Synthetic
agatgtgugagagttactagttuggg

SEQ ID NO: 31893 - DNA, 28 bp, Artificial Sequence
  Synthetic
gacatcatgctutcttcattttccaugt

SEQ ID NO: 31894 - DNA, 23 bp, Artificial Sequence
  Synthetic
gatccttuggtggcacugagaat

SEQ ID NO: 31895 - DNA, 20 bp, Artificial Sequence
  Synthetic
tggaccuggcttaguacgct

SEQ ID NO: 31896 - DNA, 26 bp, Artificial Sequence
  Synthetic
caataatttctuggcctttgcucaga

SEQ ID NO: 31897 - DNA, 28 bp, Artificial Sequence
  Synthetic
tctagatgtcauggatgaagaatccuga

SEQ ID NO: 31898 - DNA, 22 bp, Artificial Sequence
  Synthetic
tgtgcagcuatcagtcttuggt

SEQ ID NO: 31899 - DNA, 22 bp, Artificial Sequence
  Synthetic
gtgagacugctgaacacatugc

SEQ ID NO: 31900 - DNA, 22 bp, Artificial Sequence
  Synthetic
tctctgtggaggutgcaaagug

SEQ ID NO: 31901 - DNA, 22 bp, Artificial Sequence
  Synthetic
gcaacaagucctgaatccctug

SEQ ID NO: 31902 - DNA, 30 bp, Artificial Sequence
  Synthetic
accatgtatgatauatcttccactgcuact

SEQ ID NO: 31903 - DNA, 24 bp, Artificial Sequence
  Synthetic
tcatcactgaguacatggccaaug

SEQ ID NO: 31904 - DNA, 28 bp, Artificial Sequence
  Synthetic
cctctcttacugtaagtcatcttuaagc

SEQ ID NO: 31905 - DNA, 23 bp, Artificial Sequence
  Synthetic
acgtggccaucaagatgaucaaa

SEQ ID NO: 31906 - DNA, 22 bp, Artificial Sequence
  Synthetic
gcagaacagugtaccucaagga

SEQ ID NO: 31907 - DNA, 24 bp, Artificial Sequence
  Synthetic
gcatgaccuctctctctgttucag

SEQ ID NO: 31908 - DNA, 21 bp, Artificial Sequence
  Synthetic
ggcacagcaucaaggagcuat

SEQ ID NO: 31909 - DNA, 26 bp, Artificial Sequence
  Synthetic
agacagcttcuttttcgttgttucag

SEQ ID NO: 31910 - DNA, 23 bp, Artificial Sequence
  Synthetic
gagagagagagutcctccuggaa

SEQ ID NO: 31911 - DNA, 24 bp, Artificial Sequence
  Synthetic
gtgggcataugaatctgtctccug

SEQ ID NO: 31912 - DNA, 30 bp, Artificial Sequence
  Synthetic
gctttccuccaagataaaatattcaucacc

SEQ ID NO: 31913 - DNA, 27 bp, Artificial Sequence
  Synthetic
aaaccctcctaccutttctcctaacua

SEQ ID NO: 31914 - DNA, 21 bp, Artificial Sequence
  Synthetic
acagacccutgggagagugat

SEQ ID NO: 31915 - DNA, 26 bp, Artificial Sequence
  Synthetic
tgatctctctcutctttcctgcuaca

SEQ ID NO: 31916 - DNA, 21 bp, Artificial Sequence
  Synthetic
cccaccaccccutctaatugt

SEQ ID NO: 31917 - DNA, 28 bp, Artificial Sequence
  Synthetic
agcaatgcaucaaccaataaccatttut

SEQ ID NO: 31918 - DNA, 22 bp, Artificial Sequence
  Synthetic
ccccucctccuaccaacgaaaa

SEQ ID NO: 31919 - DNA, 25 bp, Artificial Sequence
  Synthetic
ctaaactucaagaagcgcctgttuc

SEQ ID NO: 31920 - DNA, 27 bp, Artificial Sequence
  Synthetic
gccttgagcutttaaagtgaauggaga

SEQ ID NO: 31921 - DNA, 23 bp, Artificial Sequence
  Synthetic
tgtaatccugcctgcttcaucac

SEQ ID NO: 31922 - DNA, 26 bp, Artificial Sequence
  Synthetic
gauagtaacaucaagagcaagggaaa

SEQ ID NO: 31923 - DNA, 25 bp, Artificial Sequence
  Synthetic
caaagctcuccttcaggauaaggac

SEQ ID NO: 31924 - DNA, 23 bp, Artificial Sequence
  Synthetic
tcctcccaggaacuttacctgua

SEQ ID NO: 31925 - DNA, 26 bp, Artificial Sequence
  Synthetic
tcttggacuggacatctttuaaccag

SEQ ID NO: 31926 - DNA, 25 bp, Artificial Sequence
  Synthetic
tttgaaggagaccutggtttcctut

SEQ ID NO: 31927 - DNA, 23 bp, Artificial Sequence
  Synthetic
ccccagcuggaaattcatttcut

SEQ ID NO: 31928 - DNA, 22 bp, Artificial Sequence
  Synthetic
agcagatcuactccccagucag

SEQ ID NO: 31929 - DNA, 26 bp, Artificial Sequence
  Synthetic
tgtgcttctacaauggtgactcttut

SEQ ID NO: 31930 - DNA, 21 bp, Artificial Sequence
  Synthetic
gggagccauccaacagtcauc

SEQ ID NO: 31931 - DNA, 28 bp, Artificial Sequence
  Synthetic
gcctaataaaugggaggtacctaagugt

SEQ ID NO: 31932 - DNA, 20 bp, Artificial Sequence
  Synthetic
cgcagcccagaugtagtuct

SEQ ID NO: 31933 - DNA, 21 bp, Artificial Sequence
  Synthetic
gagggugattggtuagcggaa

SEQ ID NO: 31934 - DNA, 25 bp, Artificial Sequence
  Synthetic
cttggatttguactctggactcuga

SEQ ID NO: 31935 - DNA, 25 bp, Artificial Sequence
  Synthetic
aaacuaaagcagacatuccagagct

SEQ ID NO: 31936 - DNA, 24 bp, Artificial Sequence
  Synthetic
gtcctccauaaatgaagucagcgt

SEQ ID NO: 31937 - DNA, 26 bp, Artificial Sequence
  Synthetic
tctactaagctguctgtgtcctttug

SEQ ID NO: 31938 - DNA, 21 bp, Artificial Sequence
  Synthetic
tggaggaagaguccgucaaca

SEQ ID NO: 31939 - DNA, 22 bp, Artificial Sequence
  Synthetic
cccactctuttgagcaagucct

SEQ ID NO: 31940 - DNA, 22 bp, Artificial Sequence
  Synthetic
gggctttcauattggcagaugt

SEQ ID NO: 31941 - DNA, 31 bp, Artificial Sequence
  Synthetic
cagtgtcagtgugtattagtttggtuagaat

SEQ ID NO: 31942 - DNA, 24 bp, Artificial Sequence
  Synthetic
gtgtaaatguaacgcactcccuga

SEQ ID NO: 31943 - DNA, 23 bp, Artificial Sequence
  Synthetic
acugtagcttcuaccgaaccaga

SEQ ID NO: 31944 - DNA, 24 bp, Artificial Sequence
  Synthetic
gggttgggaguaagagauagagag

SEQ ID NO: 31945 - DNA, 23 bp, Artificial Sequence
  Synthetic
actgttagtcaugtgggcatgug

SEQ ID NO: 31946 - DNA, 25 bp, Artificial Sequence
  Synthetic
gaagcagtcuttgcatttcaguaca

SEQ ID NO: 31947 - DNA, 26 bp, Artificial Sequence
  Synthetic
ccccagcttauttcttatgaatgucg

SEQ ID NO: 31948 - DNA, 20 bp, Artificial Sequence
  Synthetic
gcugttccucaaacgacacg

SEQ ID NO: 31949 - DNA, 19 bp, Artificial Sequence
  Synthetic
cccttctcuccggcggaua

SEQ ID NO: 31950 - DNA, 30 bp, Artificial Sequence
  Synthetic
acagactagatttguataacaggacaguga

SEQ ID NO: 31951 - DNA, 28 bp, Artificial Sequence
  Synthetic
aaagctagtaccutgaacacatcugaag

SEQ ID NO: 31952 - DNA, 24 bp, Artificial Sequence
  Synthetic
gatctggaccutcttctgtuaacc

SEQ ID NO: 31953 - DNA, 26 bp, Artificial Sequence
  Synthetic
ggaacttcaaacagugttcctcauca

SEQ ID NO: 31954 - DNA, 26 bp, Artificial Sequence
  Synthetic
ccctgcauataaggaatgtugaaaga

SEQ ID NO: 31955 - DNA, 28 bp, Artificial Sequence
  Synthetic
caacaaggaaaucaggaacuttttagua

SEQ ID NO: 31956 - DNA, 29 bp, Artificial Sequence
  Synthetic
tcagtgaataaaaugtaagtcccatguga

SEQ ID NO: 31957 - DNA, 24 bp, Artificial Sequence
  Synthetic
tgccaggauatgtttgaugagacc

SEQ ID NO: 31958 - DNA, 25 bp, Artificial Sequence
  Synthetic
tgaacauacctttgtauggaagcga

SEQ ID NO: 31959 - DNA, 26 bp, Artificial Sequence
  Synthetic
ccaaaaggaaautccagaagtgtuct

SEQ ID NO: 31960 - DNA, 25 bp, Artificial Sequence
  Synthetic
attaaccutttgtaacuccccggaa

SEQ ID NO: 31961 - DNA, 29 bp, Artificial Sequence
  Synthetic
caagcaactgaacuttacatgaacaugaa

SEQ ID NO: 31962 - DNA, 27 bp, Artificial Sequence
  Synthetic
ctgugagatttgtattucacaacacca

SEQ ID NO: 31963 - DNA, 25 bp, Artificial Sequence
  Synthetic
ggctacaggugagttaaccactuac

SEQ ID NO: 31964 - DNA, 31 bp, Artificial Sequence
  Synthetic
aagatagtgttatccugcttatttgatgcut

SEQ ID NO: 31965 - DNA, 25 bp, Artificial Sequence
  Synthetic
gatcaagcctuaaccttctctguga

SEQ ID NO: 31966 - DNA, 26 bp, Artificial Sequence
  Synthetic
accgaautcttuggagaggaacaaat

SEQ ID NO: 31967 - DNA, 29 bp, Artificial Sequence
  Synthetic
gctgaattactgauctgttctgagtcuaa

SEQ ID NO: 31968 - DNA, 24 bp, Artificial Sequence
  Synthetic
gatgcatgttugtgtctgtctgut

SEQ ID NO: 31969 - DNA, 27 bp, Artificial Sequence
  Synthetic
cagagacaatgguaaagggaaaacuca

SEQ ID NO: 31970 - DNA, 24 bp, Artificial Sequence
  Synthetic
tcagcaaagacuctgtaaccaucc

SEQ ID NO: 31971 - DNA, 27 bp, Artificial Sequence
  Synthetic
aggtttatgtctugggacagttctuac

SEQ ID NO: 31972 - DNA, 22 bp, Artificial Sequence
  Synthetic
gcttcctgcugctcttctgauc

SEQ ID NO: 31973 - DNA, 23 bp, Artificial Sequence
  Synthetic
gcttctuaagctttggucgcaaa

SEQ ID NO: 31974 - DNA, 26 bp, Artificial Sequence
  Synthetic
cagcagctguaagttcctcttactut

SEQ ID NO: 31975 - DNA, 22 bp, Artificial Sequence
  Synthetic
cgtgttgcaugaagcactctua

SEQ ID NO: 31976 - DNA, 21 bp, Artificial Sequence
  Synthetic
gctugggagcgaagaagacua

SEQ ID NO: 31977 - DNA, 29 bp, Artificial Sequence
  Synthetic
ctttggctuggcaatataagtcuaaaagt

SEQ ID NO: 31978 - DNA, 24 bp, Artificial Sequence
  Synthetic
gutccctttaucgaggaagaccac

SEQ ID NO: 31979 - DNA, 24 bp, Artificial Sequence
  Synthetic
aggacaacgagauaagcaccttuc

SEQ ID NO: 31980 - DNA, 23 bp, Artificial Sequence
  Synthetic
cctcctcctcuctctcggttaut

SEQ ID NO: 31981 - DNA, 28 bp, Artificial Sequence
  Synthetic
tgacaaacctttuctttaccttcaccut

SEQ ID NO: 31982 - DNA, 21 bp, Artificial Sequence
  Synthetic
ccagcaaagggugtcgtttuc

SEQ ID NO: 31983 - DNA, 27 bp, Artificial Sequence
  Synthetic
gcctttctgucatgctgauaaggaaat

SEQ ID NO: 31984 - DNA, 28 bp, Artificial Sequence
  Synthetic
gctggataagguttcttcatgttcuaca

SEQ ID NO: 31985 - DNA, 25 bp, Artificial Sequence
  Synthetic
gggaagaaatugaagtgccttucag

SEQ ID NO: 31986 - DNA, 25 bp, Artificial Sequence
  Synthetic
acaagttctucaagggacagaaugt

SEQ ID NO: 31987 - DNA, 26 bp, Artificial Sequence
  Synthetic
aggctctgaaucttggaattgaagug

SEQ ID NO: 31988 - DNA, 22 bp, Artificial Sequence
  Synthetic
cctgggttcautagctggguat

SEQ ID NO: 31989 - DNA, 23 bp, Artificial Sequence
  Synthetic
gutcaagaacaacuacccaagcc

SEQ ID NO: 31990 - DNA, 26 bp, Artificial Sequence
  Synthetic
gcagcacauctaaaataauccccaga

SEQ ID NO: 31991 - DNA, 28 bp, Artificial Sequence
  Synthetic
ctgcttactgaaacaugaaaaccttgut

SEQ ID NO: 31992 - DNA, 19 bp, Artificial Sequence
  Synthetic
ctgucccgggaaguccaag

SEQ ID NO: 31993 - DNA, 22 bp, Artificial Sequence
  Synthetic
ggtagcugcgaggaaactttug

SEQ ID NO: 31994 - DNA, 25 bp, Artificial Sequence
  Synthetic
ctagtggctugtattcctagtugct

SEQ ID NO: 31995 - DNA, 26 bp, Artificial Sequence
  Synthetic
caaatcttatgucagcaggtcctuac

SEQ ID NO: 31996 - DNA, 27 bp, Artificial Sequence
  Synthetic
ggtaaaatcacuctgaaagcatauggt

SEQ ID NO: 31997 - DNA, 28 bp, Artificial Sequence
  Synthetic
ccataggaatttuctcctctacttgucg

SEQ ID NO: 31998 - DNA, 28 bp, Artificial Sequence
  Synthetic
aggtaagtgaaucttctcccttaatuga

SEQ ID NO: 31999 - DNA, 24 bp, Artificial Sequence
  Synthetic
gctgaggagagcacuggaattuac

SEQ ID NO: 32000 - DNA, 25 bp, Artificial Sequence
  Synthetic
tccagagaugaggtcaagcaauact

SEQ ID NO: 32001 - DNA, 28 bp, Artificial Sequence
  Synthetic
caagagaaacgutaattgcagtacucac

SEQ ID NO: 32002 - DNA, 26 bp, Artificial Sequence
  Synthetic
gtcggtatgagugggaaacgaaauaa

SEQ ID NO: 32003 - DNA, 27 bp, Artificial Sequence
  Synthetic
catatguaagctaagtguccagcacat

SEQ ID NO: 32004 - DNA, 27 bp, Artificial Sequence
  Synthetic
gccgaactttucttcttagacatucat

SEQ ID NO: 32005 - DNA, 33 bp, Artificial Sequence
  Synthetic
aaggaatttaaaaataugtccattccacuaaac

SEQ ID NO: 32006 - DNA, 19 bp, Artificial Sequence
  Synthetic
tgacatccutggccaugct

SEQ ID NO: 32007 - DNA, 32 bp, Artificial Sequence
  Synthetic
acaactagttttaaaaucctgaatggtaguga

SEQ ID NO: 32008 - DNA, 25 bp, Artificial Sequence
  Synthetic
agtttcagucccagtttttcaugct

SEQ ID NO: 32009 - DNA, 28 bp, Artificial Sequence
  Synthetic
gactacatacattutggcaagcctaaug

SEQ ID NO: 32010 - DNA, 31 bp, Artificial Sequence
  Synthetic
ccccttctatacuaaagaaatcaatcgagut

SEQ ID NO: 32011 - DNA, 27 bp, Artificial Sequence
  Synthetic
acattatcuaaggcaagcagtugacat

SEQ ID NO: 32012 - DNA, 22 bp, Artificial Sequence
  Synthetic
cccatgugcaaactcacttcug

SEQ ID NO: 32013 - DNA, 22 bp, Artificial Sequence
  Synthetic
tcctttcttcugattgccgugt

SEQ ID NO: 32014 - DNA, 21 bp, Artificial Sequence
  Synthetic
ctcctgtccuggactccacua

SEQ ID NO: 32015 - DNA, 20 bp, Artificial Sequence
  Synthetic
cgacagccuggccgattaug

SEQ ID NO: 32016 - DNA, 17 bp, Artificial Sequence
  Synthetic
gugaaggccagggugga

SEQ ID NO: 32017 - DNA, 20 bp, Artificial Sequence
  Synthetic
cgctgtugagacagagugct

SEQ ID NO: 32018 - DNA, 18 bp, Artificial Sequence
  Synthetic
caugcttcccuggcaggt

SEQ ID NO: 32019 - DNA, 17 bp, Artificial Sequence
  Synthetic
accctcuctcccuggca

SEQ ID NO: 32020 - DNA, 20 bp, Artificial Sequence
  Synthetic
ctccctgtuggcaggtcaut

SEQ ID NO: 32021 - DNA, 18 bp, Artificial Sequence
  Synthetic
gccaaccccugtctgucc

SEQ ID NO: 32022 - DNA, 20 bp, Artificial Sequence
  Synthetic
cagaaccgaguggcagguag

SEQ ID NO: 32023 - DNA, 21 bp, Artificial Sequence
  Synthetic
agtgtcatccucagtggctug

SEQ ID NO: 32024 - DNA, 21 bp, Artificial Sequence
  Synthetic
cctcaccaucctgtcgcttua

SEQ ID NO: 32025 - DNA, 25 bp, Artificial Sequence
  Synthetic
ctctatccaagucactggtggttuc

SEQ ID NO: 32026 - DNA, 23 bp, Artificial Sequence
  Synthetic
gcctggacuttgatctcauaggg

SEQ ID NO: 32027 - DNA, 23 bp, Artificial Sequence
  Synthetic
gccaaagaaugctggtgttctug

SEQ ID NO: 32028 - DNA, 21 bp, Artificial Sequence
  Synthetic
ctctcuaagccctccctucac

SEQ ID NO: 32029 - DNA, 20 bp, Artificial Sequence
  Synthetic
ctgtcgcccuatgtccacua

SEQ ID NO: 32030 - DNA, 21 bp, Artificial Sequence
  Synthetic
gcactgagcucaagcctctua

SEQ ID NO: 32031 - DNA, 21 bp, Artificial Sequence
  Synthetic
gtaagucctaggguggaagcc

SEQ ID NO: 32032 - DNA, 20 bp, Artificial Sequence
  Synthetic
ccccttucaccgtcactguc

SEQ ID NO: 32033 - DNA, 22 bp, Artificial Sequence
  Synthetic
gaggacaacagagugactuccc

SEQ ID NO: 32034 - DNA, 20 bp, Artificial Sequence
  Synthetic
agtagcguccggtgtcatug

SEQ ID NO: 32035 - DNA, 20 bp, Artificial Sequence
  Synthetic
ctggtaguggtgagtgucgt

SEQ ID NO: 32036 - DNA, 21 bp, Artificial Sequence
  Synthetic
gcagggacagacugggagtua

SEQ ID NO: 32037 - DNA, 17 bp, Artificial Sequence
  Synthetic
ccaccugctgcaugcac

SEQ ID NO: 32038 - DNA, 21 bp, Artificial Sequence
  Synthetic
ccatgacagugggcaucacag

SEQ ID NO: 32039 - DNA, 23 bp, Artificial Sequence
  Synthetic
gucaccuaccagaaccacaacaa

SEQ ID NO: 32040 - DNA, 18 bp, Artificial Sequence
  Synthetic
aucaccccagcccccuat

SEQ ID NO: 32041 - DNA, 19 bp, Artificial Sequence
  Synthetic
cacccacuttctccuggca

SEQ ID NO: 32042 - DNA, 19 bp, Artificial Sequence
  Synthetic
gaagtcaugaccccgucca

SEQ ID NO: 32043 - DNA, 19 bp, Artificial Sequence
  Synthetic
gagtgucagcccgtctguc

SEQ ID NO: 32044 - DNA, 22 bp, Artificial Sequence
  Synthetic
acctcugagcaaagttgctgut

SEQ ID NO: 32045 - DNA, 19 bp, Artificial Sequence
  Synthetic
cttgcaccugtcccuccag

SEQ ID NO: 32046 - DNA, 22 bp, Artificial Sequence
  Synthetic
ctgactgugcttgtcgguaaga

SEQ ID NO: 32047 - DNA, 22 bp, Artificial Sequence
  Synthetic
cgtgaccgagagagutagcuga

SEQ ID NO: 32048 - DNA, 22 bp, Artificial Sequence
  Synthetic
ctgagtctuagctggctcctug

SEQ ID NO: 32049 - DNA, 20 bp, Artificial Sequence
  Synthetic
caccacucagaguccccaaa

SEQ ID NO: 32050 - DNA, 24 bp, Artificial Sequence
  Synthetic
cttacaggtcutcagtccttuccc

SEQ ID NO: 32051 - DNA, 22 bp, Artificial Sequence
  Synthetic
gaaagccgugaaggagtctuct

SEQ ID NO: 32052 - DNA, 21 bp, Artificial Sequence
  Synthetic
cgtttctugggaatggccuga

SEQ ID NO: 32053 - DNA, 21 bp, Artificial Sequence
  Synthetic
agagggugtgcaggugaaaag

SEQ ID NO: 32054 - DNA, 21 bp, Artificial Sequence
  Synthetic
ccctcucccagttaccgugaa

SEQ ID NO: 32055 - DNA, 22 bp, Artificial Sequence
  Synthetic
tgtcuttctgtttguccccaca

SEQ ID NO: 32056 - DNA, 18 bp, Artificial Sequence
  Synthetic
tccccggucacggaugat

SEQ ID NO: 32057 - DNA, 27 bp, Artificial Sequence
  Synthetic
aacccctcaaguttaaaaaggugaaga

SEQ ID NO: 32058 - DNA, 24 bp, Artificial Sequence
  Synthetic
gauggccaaaucaggacatauact

SEQ ID NO: 32059 - DNA, 22 bp, Artificial Sequence
  Synthetic
aaaaaggtcgugcagctcaaug

SEQ ID NO: 32060 - DNA, 19 bp, Artificial Sequence
  Synthetic
gcaaaucgcatugcgcaga

SEQ ID NO: 32061 - DNA, 17 bp, Artificial Sequence
  Synthetic
ccutccgcauccgccat

SEQ ID NO: 32062 - DNA, 25 bp, Artificial Sequence
  Synthetic
aaaatccatttccuacctgcccuaa

SEQ ID NO: 32063 - DNA, 30 bp, Artificial Sequence
  Synthetic
tcaaagtgaagucaaacacattactacuca

SEQ ID NO: 32064 - DNA, 22 bp, Artificial Sequence
  Synthetic
gtttgtgggccacauagtggua

SEQ ID NO: 32065 - DNA, 24 bp, Artificial Sequence
  Synthetic
agaaagtaaguttgcacagugcct

SEQ ID NO: 32066 - DNA, 24 bp, Artificial Sequence
  Synthetic
atcccaaggugactggttgttuaa

SEQ ID NO: 32067 - DNA, 31 bp, Artificial Sequence
  Synthetic
tcttaaugaagaaatagttuccagcagacaa

SEQ ID NO: 32068 - DNA, 22 bp, Artificial Sequence
  Synthetic
ggaccagugactgcacatguac

SEQ ID NO: 32069 - DNA, 21 bp, Artificial Sequence
  Synthetic
ccacucacaggcctaaugact

SEQ ID NO: 32070 - DNA, 28 bp, Artificial Sequence
  Synthetic
ctgatgggcugagatacaaataaacuga

SEQ ID NO: 32071 - DNA, 30 bp, Artificial Sequence
  Synthetic
ccaaatataaactccuaacccggaactuac

SEQ ID NO: 32072 - DNA, 27 bp, Artificial Sequence
  Synthetic
gggctcatcaautatcaattcttucac

SEQ ID NO: 32073 - DNA, 21 bp, Artificial Sequence
  Synthetic
acgcaacccaguaccactuac

SEQ ID NO: 32074 - DNA, 23 bp, Artificial Sequence
  Synthetic
tttgatgguggctttagactugc

SEQ ID NO: 32075 - DNA, 23 bp, Artificial Sequence
  Synthetic
acautccaaacugaggacagcat

SEQ ID NO: 32076 - DNA, 23 bp, Artificial Sequence
  Synthetic
gcttgcttgacugtggaccttua

SEQ ID NO: 32077 - DNA, 22 bp, Artificial Sequence
  Synthetic
agcttcaaguggccttcacuac

SEQ ID NO: 32078 - DNA, 28 bp, Artificial Sequence
  Synthetic
aagagttaagutaaattggaugcaccct

SEQ ID NO: 32079 - DNA, 20 bp, Artificial Sequence
  Synthetic
aggcacaggaccuctacuga

SEQ ID NO: 32080 - DNA, 22 bp, Artificial Sequence
  Synthetic
gaagguagcgagtcaguaacgg

SEQ ID NO: 32081 - DNA, 28 bp, Artificial Sequence
  Synthetic
gactacuggaaacaactagaagugagaa

SEQ ID NO: 32082 - DNA, 29 bp, Artificial Sequence
  Synthetic
ctgctctgagucagttaaacagtaaauct

SEQ ID NO: 32083 - DNA, 27 bp, Artificial Sequence
  Synthetic
gcatgtccttgugataaccttctttut

SEQ ID NO: 32084 - DNA, 22 bp, Artificial Sequence
  Synthetic
catgttcagauggagaggcugt

SEQ ID NO: 32085 - DNA, 17 bp, Artificial Sequence
  Synthetic
ctgccccutgcccugat

SEQ ID NO: 32086 - DNA, 24 bp, Artificial Sequence
  Synthetic
gccacttctucccatcaagacuat

SEQ ID NO: 32087 - DNA, 30 bp, Artificial Sequence
  Synthetic
agtttcaggagguagcacatacattuaaaa

SEQ ID NO: 32088 - DNA, 26 bp, Artificial Sequence
  Synthetic
agaagcatggagauggattcattauc

SEQ ID NO: 32089 - DNA, 23 bp, Artificial Sequence
  Synthetic
tgtgtuccacccgtttcattuca

SEQ ID NO: 32090 - DNA, 25 bp, Artificial Sequence
  Synthetic
tctgctttgaucactgattgtgtuc

SEQ ID NO: 32091 - DNA, 28 bp, Artificial Sequence
  Synthetic
gcagcaatgaaaacauccattctatuca

SEQ ID NO: 32092 - DNA, 30 bp, Artificial Sequence
  Synthetic
aataaatacaatgtucaagtccctggauca

SEQ ID NO: 32093 - DNA, 26 bp, Artificial Sequence
  Synthetic
accaaaagcuggtacttcacugaaaa

SEQ ID NO: 32094 - DNA, 27 bp, Artificial Sequence
  Synthetic
aagcttcttatugcacgtaggauaaat

SEQ ID NO: 32095 - DNA, 30 bp, Artificial Sequence
  Synthetic
gtcaagcctaaugaaaccaaaacttactut

SEQ ID NO: 32096 - DNA, 29 bp, Artificial Sequence
  Synthetic
ccaaaagtgggaauacattatagucagca

SEQ ID NO: 32097 - DNA, 24 bp, Artificial Sequence
  Synthetic
gctcctttacucagcccttauacc

SEQ ID NO: 32098 - DNA, 25 bp, Artificial Sequence
  Synthetic
gagcagagcaaaggaauaaccaaug

SEQ ID NO: 32099 - DNA, 30 bp, Artificial Sequence
  Synthetic
gtcagatcaagaggaaautgactatgauga

SEQ ID NO: 32100 - DNA, 24 bp, Artificial Sequence
  Synthetic
ttcgggcttautttgtccctcaut

SEQ ID NO: 32101 - DNA, 23 bp, Artificial Sequence
  Synthetic
agaguagcaacagaaagctcugc

SEQ ID NO: 32102 - DNA, 28 bp, Artificial Sequence
  Synthetic
agggaatagguccttctgataaatguga

SEQ ID NO: 32103 - DNA, 27 bp, Artificial Sequence
  Synthetic
cagucatttctuacaaggagccaaaaa

SEQ ID NO: 32104 - DNA, 28 bp, Artificial Sequence
  Synthetic
cctttgcaatggguaatggagatctaut

SEQ ID NO: 32105 - DNA, 26 bp, Artificial Sequence
  Synthetic
ggataattguggatgacaccucaacc

SEQ ID NO: 32106 - DNA, 30 bp, Artificial Sequence
  Synthetic
gcatatttctcuacaatttgcttggttuga

SEQ ID NO: 32107 - DNA, 28 bp, Artificial Sequence
  Synthetic
gactggcacuaagaatttcaugaagaac

SEQ ID NO: 32108 - DNA, 26 bp, Artificial Sequence
  Synthetic
gtaagaaatagguttctgctgctugg

SEQ ID NO: 32109 - DNA, 25 bp, Artificial Sequence
  Synthetic
agaaucagcaaggtggauacaaagg

SEQ ID NO: 32110 - DNA, 27 bp, Artificial Sequence
  Synthetic
gatttagccucaaagctgtagcattut

SEQ ID NO: 32111 - DNA, 31 bp, Artificial Sequence
  Synthetic
acaaacaaaactuccaataattcagcaacua

SEQ ID NO: 32112 - DNA, 27 bp, Artificial Sequence
  Synthetic
accactctctgutgacgatacatttut

SEQ ID NO: 32113 - DNA, 29 bp, Artificial Sequence
  Synthetic
cagcaggtactgauaatacaagttcctua

SEQ ID NO: 32114 - DNA, 29 bp, Artificial Sequence
  Synthetic
tctcatttaatctuaattggaggccugac

SEQ ID NO: 32115 - DNA, 27 bp, Artificial Sequence
  Synthetic
ctcctctagtgauttgttgatgctcut

SEQ ID NO: 32116 - DNA, 23 bp, Artificial Sequence
  Synthetic
gggtgucttgaattcugggagaa

SEQ ID NO: 32117 - DNA, 29 bp, Artificial Sequence
  Synthetic
gagtaaccagagucttattcttcctcauc

SEQ ID NO: 32118 - DNA, 24 bp, Artificial Sequence
  Synthetic
agacagtttcucctgagaauggga

SEQ ID NO: 32119 - DNA, 26 bp, Artificial Sequence
  Synthetic
atctctttuccccattgttttugcag

SEQ ID NO: 32120 - DNA, 28 bp, Artificial Sequence
  Synthetic
tcttttacugacctatatugcaaaccat

SEQ ID NO: 32121 - DNA, 24 bp, Artificial Sequence
  Synthetic
gatctagctucaggactcatuggc

SEQ ID NO: 32122 - DNA, 22 bp, Artificial Sequence
  Synthetic
agcuggagaaaggaccaacaua

SEQ ID NO: 32123 - DNA, 26 bp, Artificial Sequence
  Synthetic
cagaccatauaacatctacccucacg

SEQ ID NO: 32124 - DNA, 23 bp, Artificial Sequence
  Synthetic
tccatuggagacaaggctgaaut

SEQ ID NO: 32125 - DNA, 25 bp, Artificial Sequence
  Synthetic
ctcgtgaagcuattcagcatgaauc

SEQ ID NO: 32126 - DNA, 25 bp, Artificial Sequence
  Synthetic
ctaacctuaaacatggctucaggat

SEQ ID NO: 32127 - DNA, 25 bp, Artificial Sequence
  Synthetic
ctttatccaaautcgctcagtugcc

SEQ ID NO: 32128 - DNA, 26 bp, Artificial Sequence
  Synthetic
ccttcagcaacacacuatattccugt

SEQ ID NO: 32129 - DNA, 26 bp, Artificial Sequence
  Synthetic
ctttccttacugctcaaacactctug

SEQ ID NO: 32130 - DNA, 22 bp, Artificial Sequence
  Synthetic
ccgagcugtttgtgaacugaag

SEQ ID NO: 32131 - DNA, 27 bp, Artificial Sequence
  Synthetic
actctatcttugccttctctctcauca

SEQ ID NO: 32132 - DNA, 23 bp, Artificial Sequence
  Synthetic
tcaggugaaggaacacaaaugct

SEQ ID NO: 32133 - DNA, 29 bp, Artificial Sequence
  Synthetic
gtgccttacctacucatatctttctcaug

SEQ ID NO: 32134 - DNA, 22 bp, Artificial Sequence
  Synthetic
guaacgccaccatuacaaagca

SEQ ID NO: 32135 - DNA, 23 bp, Artificial Sequence
  Synthetic
tggcggacauctcattctuacag

SEQ ID NO: 32136 - DNA, 24 bp, Artificial Sequence
  Synthetic
aagcagactuacatccccacaauc

SEQ ID NO: 32137 - DNA, 29 bp, Artificial Sequence
  Synthetic
ccagttgaacauttgtagcaataagucat

SEQ ID NO: 32138 - DNA, 20 bp, Artificial Sequence
  Synthetic
cccagucccctacaucgaca

SEQ ID NO: 32139 - DNA, 19 bp, Artificial Sequence
  Synthetic
ctcccagccguatgcugag

SEQ ID NO: 32140 - DNA, 22 bp, Artificial Sequence
  Synthetic
tctcugtggagcugggaaaaac

SEQ ID NO: 32141 - DNA, 20 bp, Artificial Sequence
  Synthetic
cagccctguggaacctguac

SEQ ID NO: 32142 - DNA, 24 bp, Artificial Sequence
  Synthetic
cgtcttctaacccucctcctctuc

SEQ ID NO: 32143 - DNA, 22 bp, Artificial Sequence
  Synthetic
aaccagugaaagggtgcugaat

SEQ ID NO: 32144 - DNA, 22 bp, Artificial Sequence
  Synthetic
ggaacgtctgugcctgtgaaut

SEQ ID NO: 32145 - DNA, 21 bp, Artificial Sequence
  Synthetic
gacaagagugaagggcacaug

SEQ ID NO: 32146 - DNA, 22 bp, Artificial Sequence
  Synthetic
tcctcccctucttctccctcua

SEQ ID NO: 32147 - DNA, 19 bp, Artificial Sequence
  Synthetic
agtggtaggugaccgugga

SEQ ID NO: 32148 - DNA, 24 bp, Artificial Sequence
  Synthetic
aggatgaggaggaugatgatguga

SEQ ID NO: 32149 - DNA, 22 bp, Artificial Sequence
  Synthetic
gcacactagaugccatccucag

SEQ ID NO: 32150 - DNA, 17 bp, Artificial Sequence
  Synthetic
cccgucgcgaagttucc

SEQ ID NO: 32151 - DNA, 19 bp, Artificial Sequence
  Synthetic
cccatucaggtcgtuccca

SEQ ID NO: 32152 - DNA, 23 bp, Artificial Sequence
  Synthetic
ggccagcccuggaaaaatattuc

SEQ ID NO: 32153 - DNA, 19 bp, Artificial Sequence
  Synthetic
ggaagcccugacccaccua

SEQ ID NO: 32154 - DNA, 21 bp, Artificial Sequence
  Synthetic
ggagctccugaagaagtuccg

SEQ ID NO: 32155 - DNA, 21 bp, Artificial Sequence
  Synthetic
acacccagautgcacgucaaa

SEQ ID NO: 32156 - DNA, 21 bp, Artificial Sequence
  Synthetic
ccccacacugggtgagatgua

SEQ ID NO: 32157 - DNA, 23 bp, Artificial Sequence
  Synthetic
cttcctaucacccctcugaggat

SEQ ID NO: 32158 - DNA, 19 bp, Artificial Sequence
  Synthetic
cutctctgugaccccacgt

SEQ ID NO: 32159 - DNA, 21 bp, Artificial Sequence
  Synthetic
aatcacccauctcgccatcuc

SEQ ID NO: 32160 - DNA, 20 bp, Artificial Sequence
  Synthetic
cagugacaggaggtgcuaca

SEQ ID NO: 32161 - DNA, 20 bp, Artificial Sequence
  Synthetic
agtactguggcccacaacuc

SEQ ID NO: 32162 - DNA, 20 bp, Artificial Sequence
  Synthetic
tcctactgaggugctcccut

SEQ ID NO: 32163 - DNA, 22 bp, Artificial Sequence
  Synthetic
gcagaagccagaugaaggtguc

SEQ ID NO: 32164 - DNA, 18 bp, Artificial Sequence
  Synthetic
gaggaggcugcactgtug

SEQ ID NO: 32165 - DNA, 17 bp, Artificial Sequence
  Synthetic
tgtgcaggugggtggug

SEQ ID NO: 32166 - DNA, 20 bp, Artificial Sequence
  Synthetic
agccaatggugaggacccua

SEQ ID NO: 32167 - DNA, 21 bp, Artificial Sequence
  Synthetic
ggcaagcaguttcccttcugt

SEQ ID NO: 32168 - DNA, 23 bp, Artificial Sequence
  Synthetic
ggccatccuagaattctgccuaa

SEQ ID NO: 32169 - DNA, 18 bp, Artificial Sequence
  Synthetic
cccgcaucctggctaugc

SEQ ID NO: 32170 - DNA, 21 bp, Artificial Sequence
  Synthetic
ggccactgaugctttctguct

SEQ ID NO: 32171 - DNA, 20 bp, Artificial Sequence
  Synthetic
ggcctggccaautagggauc

SEQ ID NO: 32172 - DNA, 24 bp, Artificial Sequence
  Synthetic
ccccatautcttgattcuccccaa

SEQ ID NO: 32173 - DNA, 28 bp, Artificial Sequence
  Synthetic
agccatgtguctcttatttttctugact

SEQ ID NO: 32174 - DNA, 21 bp, Artificial Sequence
  Synthetic
tccagactugggactguggaa

SEQ ID NO: 32175 - DNA, 20 bp, Artificial Sequence
  Synthetic
gtgggtgccucaaggactua

SEQ ID NO: 32176 - DNA, 21 bp, Artificial Sequence
  Synthetic
caaugggaagagcaccgugat

SEQ ID NO: 32177 - DNA, 21 bp, Artificial Sequence
  Synthetic
cgtgucacaacggaggactug

SEQ ID NO: 32178 - DNA, 20 bp, Artificial Sequence
  Synthetic
ctcacaagucccaggtcugt

SEQ ID NO: 32179 - DNA, 19 bp, Artificial Sequence
  Synthetic
gcugggagctugggagaag

SEQ ID NO: 32180 - DNA, 21 bp, Artificial Sequence
  Synthetic
ccaccuacactcactcuggac

SEQ ID NO: 32181 - DNA, 28 bp, Artificial Sequence
  Synthetic
gaaaaggaggacauctgttctcatcaut

SEQ ID NO: 32182 - DNA, 22 bp, Artificial Sequence
  Synthetic
ctggcagugaaaaccagaguct

SEQ ID NO: 32183 - DNA, 25 bp, Artificial Sequence
  Synthetic
acctatctgcagucttggactctua

SEQ ID NO: 32184 - DNA, 22 bp, Artificial Sequence
  Synthetic
tgagaggaaggaugtgccauct

SEQ ID NO: 32185 - DNA, 21 bp, Artificial Sequence
  Synthetic
acctgttgcuccatgacucac

SEQ ID NO: 32186 - DNA, 21 bp, Artificial Sequence
  Synthetic
tgguagagccctgtcuccaag

SEQ ID NO: 32187 - DNA, 23 bp, Artificial Sequence
  Synthetic
acacagctugtcacagttuaggt

SEQ ID NO: 32188 - DNA, 21 bp, Artificial Sequence
  Synthetic
agactcaauacgtcccccuca

SEQ ID NO: 32189 - DNA, 20 bp, Artificial Sequence
  Synthetic
cttcccgagcagaacugguc

SEQ ID NO: 32190 - DNA, 21 bp, Artificial Sequence
  Synthetic
gggctctauggcctcctcuac

SEQ ID NO: 32191 - DNA, 22 bp, Artificial Sequence
  Synthetic
ctgacccugcctaaaggaaguc

SEQ ID NO: 32192 - DNA, 21 bp, Artificial Sequence
  Synthetic
tgtcaagcguccttaggaugg

SEQ ID NO: 32193 - DNA, 20 bp, Artificial Sequence
  Synthetic
ggagcccacauggcactuag

SEQ ID NO: 32194 - DNA, 17 bp, Artificial Sequence
  Synthetic
ctgctgcugcgctucac

SEQ ID NO: 32195 - DNA, 17 bp, Artificial Sequence
  Synthetic
gaacugccgcugcaacc

SEQ ID NO: 32196 - DNA, 24 bp, Artificial Sequence
  Synthetic
cacggtgcautcttttctcaucac

SEQ ID NO: 32197 - DNA, 22 bp, Artificial Sequence
  Synthetic
ctctttgucacctccaggtuct

SEQ ID NO: 32198 - DNA, 21 bp, Artificial Sequence
  Synthetic
tuacaggcagggctuacaagg

SEQ ID NO: 32199 - DNA, 24 bp, Artificial Sequence
  Synthetic
gaagttgcuctcaaagaaguccca

SEQ ID NO: 32200 - DNA, 21 bp, Artificial Sequence
  Synthetic
ctggtcgacuaccctgatgug

SEQ ID NO: 32201 - DNA, 23 bp, Artificial Sequence
  Synthetic
gttcuccaaaaccccctgaucaa

SEQ ID NO: 32202 - DNA, 24 bp, Artificial Sequence
  Synthetic
ggaggagaaauggtcactttgcut

SEQ ID NO: 32203 - DNA, 21 bp, Artificial Sequence
  Synthetic
catgacacacucgggacucac

SEQ ID NO: 32204 - DNA, 22 bp, Artificial Sequence
  Synthetic
ccatcgccuatgaaatctucgg

SEQ ID NO: 32205 - DNA, 23 bp, Artificial Sequence
  Synthetic
gagaacagagguttcuacccaca

SEQ ID NO: 32206 - DNA, 25 bp, Artificial Sequence
  Synthetic
gggtgaacauattctagcccugaag

SEQ ID NO: 32207 - DNA, 20 bp, Artificial Sequence
  Synthetic
ctccaugcagggacaucaca

SEQ ID NO: 32208 - DNA, 20 bp, Artificial Sequence
  Synthetic
acccacgucgattgcatcuc

SEQ ID NO: 32209 - DNA, 20 bp, Artificial Sequence
  Synthetic
cacctgtguccccaagcaua

SEQ ID NO: 32210 - DNA, 20 bp, Artificial Sequence
  Synthetic
aagcaggcugatuggagagg

SEQ ID NO: 32211 - DNA, 28 bp, Artificial Sequence
  Synthetic
ctggatactggauatacagaccugaact

SEQ ID NO: 32212 - DNA, 21 bp, Artificial Sequence
  Synthetic
ggacaccccgauctgtggaua

SEQ ID NO: 32213 - DNA, 20 bp, Artificial Sequence
  Synthetic
catgagcuggtaggcgaugt

SEQ ID NO: 32214 - DNA, 21 bp, Artificial Sequence
  Synthetic
cagaagtgauggctcctguct

SEQ ID NO: 32215 - DNA, 19 bp, Artificial Sequence
  Synthetic
ccaucacaggccacctcug

SEQ ID NO: 32216 - DNA, 19 bp, Artificial Sequence
  Synthetic
ggucacagcctcucagcat

SEQ ID NO: 32217 - DNA, 18 bp, Artificial Sequence
  Synthetic
ccagggccgugttuccag

SEQ ID NO: 32218 - DNA, 21 bp, Artificial Sequence
  Synthetic
cctccucggaagacactcuga

SEQ ID NO: 32219 - DNA, 21 bp, Artificial Sequence
  Synthetic
ccagguggguagacaggagac

SEQ ID NO: 32220 - DNA, 20 bp, Artificial Sequence
  Synthetic
ggctcucagcaggtgttucc

SEQ ID NO: 32221 - DNA, 18 bp, Artificial Sequence
  Synthetic
aggctgcauacgccauca

SEQ ID NO: 32222 - DNA, 19 bp, Artificial Sequence
  Synthetic
tttgccaaaugcgcctcuc

SEQ ID NO: 32223 - DNA, 22 bp, Artificial Sequence
  Synthetic
ggauggcgacggauaaaggaaa

SEQ ID NO: 32224 - DNA, 22 bp, Artificial Sequence
  Synthetic
catggagauggtgttcugggaa

SEQ ID NO: 32225 - DNA, 27 bp, Artificial Sequence
  Synthetic
gtgctgatcaauatcactccatuaggg

SEQ ID NO: 32226 - DNA, 29 bp, Artificial Sequence
  Synthetic
ctttgaagatcugtctgtaatgtgugagt

SEQ ID NO: 32227 - DNA, 28 bp, Artificial Sequence
  Synthetic
accacttcactugagataaatcagctut

SEQ ID NO: 32228 - DNA, 30 bp, Artificial Sequence
  Synthetic
aaagtcacctattcautcatacgatggtut

SEQ ID NO: 32229 - DNA, 23 bp, Artificial Sequence
  Synthetic
agtcaaagtccutctgctcaucc

SEQ ID NO: 32230 - DNA, 21 bp, Artificial Sequence
  Synthetic
agctcatcutcgtcacaugcc

SEQ ID NO: 32231 - DNA, 23 bp, Artificial Sequence
  Synthetic
agcagguagaggaagaggaacuc

SEQ ID NO: 32232 - DNA, 19 bp, Artificial Sequence
  Synthetic
gccgtcugcatcgtacuca

SEQ ID NO: 32233 - DNA, 20 bp, Artificial Sequence
  Synthetic
ggtcaggutgggtgcugaag

SEQ ID NO: 32234 - DNA, 21 bp, Artificial Sequence
  Synthetic
gagtgaccccacuctgagtuc

SEQ ID NO: 32235 - DNA, 24 bp, Artificial Sequence
  Synthetic
ttgcaggcagcguagatagtuaat

SEQ ID NO: 32236 - DNA, 23 bp, Artificial Sequence
  Synthetic
gtaagagaggugagaagtgcucc

SEQ ID NO: 32237 - DNA, 24 bp, Artificial Sequence
  Synthetic
tgggtatcuccagaacctctaguc

SEQ ID NO: 32238 - DNA, 21 bp, Artificial Sequence
  Synthetic
catcttccuccccacaacugt

SEQ ID NO: 32239 - DNA, 22 bp, Artificial Sequence
  Synthetic
agggcttaccuttccctaccut

SEQ ID NO: 32240 - DNA, 27 bp, Artificial Sequence
  Synthetic
agctctattgugaactatacgggttuc

SEQ ID NO: 32241 - DNA, 30 bp, Artificial Sequence
  Synthetic
acgtacttaccautttactccaaaactuca

SEQ ID NO: 32242 - DNA, 22 bp, Artificial Sequence
  Synthetic
cggccagcagcccuatttuaat

SEQ ID NO: 32243 - DNA, 25 bp, Artificial Sequence
  Synthetic
gatggtaaugaccttaggtgtugct

SEQ ID NO: 32244 - DNA, 24 bp, Artificial Sequence
  Synthetic
cacaaggaacuactgctggaauca

SEQ ID NO: 32245 - DNA, 27 bp, Artificial Sequence
  Synthetic
gagtggatattugtcatctaccacugt

SEQ ID NO: 32246 - DNA, 28 bp, Artificial Sequence
  Synthetic
gataggugacaatcttgaatuggaggag

SEQ ID NO: 32247 - DNA, 26 bp, Artificial Sequence
  Synthetic
cacttgcuaaggatcctaaatugcag

SEQ ID NO: 32248 - DNA, 28 bp, Artificial Sequence
  Synthetic
aaacacaaggcaaagcautttaacagua

SEQ ID NO: 32249 - DNA, 27 bp, Artificial Sequence
  Synthetic
tttccatcattgugttttgttggcuag

SEQ ID NO: 32250 - DNA, 17 bp, Artificial Sequence
  Synthetic
ggcggguccagatgcug

SEQ ID NO: 32251 - DNA, 17 bp, Artificial Sequence
  Synthetic
tgcgcaggutgcgauct

SEQ ID NO: 32252 - DNA, 17 bp, Artificial Sequence
  Synthetic
agctaguggcgcucacg

SEQ ID NO: 32253 - DNA, 17 bp, Artificial Sequence
  Synthetic
ccgcuccagcacgtugt

SEQ ID NO: 32254 - DNA, 22 bp, Artificial Sequence
  Synthetic
ggagacugaggaccagaacuca

SEQ ID NO: 32255 - DNA, 24 bp, Artificial Sequence
  Synthetic
cucattaccgaugacacagaaggg

SEQ ID NO: 32256 - DNA, 20 bp, Artificial Sequence
  Synthetic
gtaggcuggctgtgatcucg

SEQ ID NO: 32257 - DNA, 20 bp, Artificial Sequence
  Synthetic
ctatgcgcguagaccacuga

SEQ ID NO: 32258 - DNA, 18 bp, Artificial Sequence
  Synthetic
ctutcccgtguggaagcc

SEQ ID NO: 32259 - DNA, 20 bp, Artificial Sequence
  Synthetic
ccuacaaagacccucacgca

SEQ ID NO: 32260 - DNA, 20 bp, Artificial Sequence
  Synthetic
gacaccctugcagcctctua

SEQ ID NO: 32261 - DNA, 21 bp, Artificial Sequence
  Synthetic
cttctucccgggcatcttgua

SEQ ID NO: 32262 - DNA, 21 bp, Artificial Sequence
  Synthetic
gcaggaccuggcaagatcuga

SEQ ID NO: 32263 - DNA, 17 bp, Artificial Sequence
  Synthetic
ggtgcuccgtcggguac

SEQ ID NO: 32264 - DNA, 21 bp, Artificial Sequence
  Synthetic
gctctggcuaacttggctcuc

SEQ ID NO: 32265 - DNA, 21 bp, Artificial Sequence
  Synthetic
gctccagcucttttgcaccut

SEQ ID NO: 32266 - DNA, 25 bp, Artificial Sequence
  Synthetic
cctattggacacuctactggtggut

SEQ ID NO: 32267 - DNA, 20 bp, Artificial Sequence
  Synthetic
gcctcaggccucagtctuac

SEQ ID NO: 32268 - DNA, 23 bp, Artificial Sequence
  Synthetic
ggaaatucaaggagacacugcga

SEQ ID NO: 32269 - DNA, 22 bp, Artificial Sequence
  Synthetic
ggttggccucagacttcatuca

SEQ ID NO: 32270 - DNA, 17 bp, Artificial Sequence
  Synthetic
ccacuccaccggcuagg

SEQ ID NO: 32271 - DNA, 18 bp, Artificial Sequence
  Synthetic
gucgaacagcggcactug

SEQ ID NO: 32272 - DNA, 19 bp, Artificial Sequence
  Synthetic
tcggucagcaccaacaugg

SEQ ID NO: 32273 - DNA, 19 bp, Artificial Sequence
  Synthetic
catcucacgctccugaggt

SEQ ID NO: 32274 - DNA, 22 bp, Artificial Sequence
  Synthetic
ctugagacttcatuccccagca

SEQ ID NO: 32275 - DNA, 23 bp, Artificial Sequence
  Synthetic
cagtugcaacgaagccaatcaua

SEQ ID NO: 32276 - DNA, 21 bp, Artificial Sequence
  Synthetic
ccucaagcccttctugcagag

SEQ ID NO: 32277 - DNA, 20 bp, Artificial Sequence
  Synthetic
tgaagtggcucctagcccua

SEQ ID NO: 32278 - DNA, 21 bp, Artificial Sequence
  Synthetic
acaggccuagcttgcaaugat

SEQ ID NO: 32279 - DNA, 24 bp, Artificial Sequence
  Synthetic
cgatacggucagctcttgtaggua

SEQ ID NO: 32280 - DNA, 22 bp, Artificial Sequence
  Synthetic
agaaggccuacttctccacucc

SEQ ID NO: 32281 - DNA, 23 bp, Artificial Sequence
  Synthetic
ccaccauaaatcaggguccacat

SEQ ID NO: 32282 - DNA, 23 bp, Artificial Sequence
  Synthetic
aggaattgcutgctcaacucagt

SEQ ID NO: 32283 - DNA, 24 bp, Artificial Sequence
  Synthetic
ggctgaaguggagattaacauccc

SEQ ID NO: 32284 - DNA, 26 bp, Artificial Sequence
  Synthetic
caaccttacucctttccuaacgaact

SEQ ID NO: 32285 - DNA, 30 bp, Artificial Sequence
  Synthetic
tgcttgatugatttttctttcucacaaaca

SEQ ID NO: 32286 - DNA, 28 bp, Artificial Sequence
  Synthetic
gagcacatgctuaggaaaactcttaauc

SEQ ID NO: 32287 - DNA, 27 bp, Artificial Sequence
  Synthetic
actgaggtttcugttatcttctcucct

SEQ ID NO: 32288 - DNA, 28 bp, Artificial Sequence
  Synthetic
gttttagatgtgautcagattgagugca

SEQ ID NO: 32289 - DNA, 26 bp, Artificial Sequence
  Synthetic
ctttcaaccucttccatcacaucaac

SEQ ID NO: 32290 - DNA, 29 bp, Artificial Sequence
  Synthetic
acacatcttctucagaatcacaaactuga

SEQ ID NO: 32291 - DNA, 24 bp, Artificial Sequence
  Synthetic
caagcccauttgtgtttcugaaca

SEQ ID NO: 32292 - DNA, 30 bp, Artificial Sequence
  Synthetic
agacacttatttucagaagaggacagatug

SEQ ID NO: 32293 - DNA, 26 bp, Artificial Sequence
  Synthetic
ctcaacuggaggacattcacttuact

SEQ ID NO: 32294 - DNA, 26 bp, Artificial Sequence
  Synthetic
tcagtccaguaattttcaagccauga

SEQ ID NO: 32295 - DNA, 27 bp, Artificial Sequence
  Synthetic
tcttccctatguttcaatgtcctucag

SEQ ID NO: 32296 - DNA, 23 bp, Artificial Sequence
  Synthetic
cacugagagaugccaaggaauag

SEQ ID NO: 32297 - DNA, 28 bp, Artificial Sequence
  Synthetic
cttcttccttatucttccaccattucag

SEQ ID NO: 32298 - DNA, 21 bp, Artificial Sequence
  Synthetic
cagaagugcatgggacugaca

SEQ ID NO: 32299 - DNA, 21 bp, Artificial Sequence
  Synthetic
ctagcagctutggcctccaua

SEQ ID NO: 32300 - DNA, 25 bp, Artificial Sequence
  Synthetic
aagtcagttucggtttccttcugaa

SEQ ID NO: 32301 - DNA, 23 bp, Artificial Sequence
  Synthetic
gagtccatgugatctcctuccac

SEQ ID NO: 32302 - DNA, 22 bp, Artificial Sequence
  Synthetic
gggaatgttaugcctccctcut

SEQ ID NO: 32303 - DNA, 22 bp, Artificial Sequence
  Synthetic
ggagaggcacuacaacatgcuc

SEQ ID NO: 32304 - DNA, 22 bp, Artificial Sequence
  Synthetic
gcaggacucttccaagtgucaa

SEQ ID NO: 32305 - DNA, 21 bp, Artificial Sequence
  Synthetic
ggaatccuctcctgcucacct

SEQ ID NO: 32306 - DNA, 21 bp, Artificial Sequence
  Synthetic
aagagacccagcacutggtut

SEQ ID NO: 32307 - DNA, 26 bp, Artificial Sequence
  Synthetic
ctccaaatggcauttctttctctucc

SEQ ID NO: 32308 - DNA, 22 bp, Artificial Sequence
  Synthetic
gggtctgaugatcaccctucct

SEQ ID NO: 32309 - DNA, 24 bp, Artificial Sequence
  Synthetic
aggctagctcugtgttttctccua

SEQ ID NO: 32310 - DNA, 24 bp, Artificial Sequence
  Synthetic
ctaaccagcaccuccaaactcaua

SEQ ID NO: 32311 - DNA, 21 bp, Artificial Sequence
  Synthetic
ggtcccauggaaaggacagug

SEQ ID NO: 32312 - DNA, 20 bp, Artificial Sequence
  Synthetic
cggtaacccucccagcttug

SEQ ID NO: 32313 - DNA, 24 bp, Artificial Sequence
  Synthetic
cgtttccaacagucctacttcuct

SEQ ID NO: 32314 - DNA, 25 bp, Artificial Sequence
  Synthetic
ttatgcucacccggttattcucaaa

SEQ ID NO: 32315 - DNA, 26 bp, Artificial Sequence
  Synthetic
cactctgagutgtctcattucacaca

SEQ ID NO: 32316 - DNA, 21 bp, Artificial Sequence
  Synthetic
cctcttgguctggtcctucag

SEQ ID NO: 32317 - DNA, 22 bp, Artificial Sequence
  Synthetic
tgaacaaauccaagcaccucca

SEQ ID NO: 32318 - DNA, 24 bp, Artificial Sequence
  Synthetic
ggtatgtgaagugtgaggcactua

SEQ ID NO: 32319 - DNA, 21 bp, Artificial Sequence
  Synthetic
caaggagcagcucucagagat

SEQ ID NO: 32320 - DNA, 23 bp, Artificial Sequence
  Synthetic
gggtttgguagctggaagacaut

SEQ ID NO: 32321 - DNA, 28 bp, Artificial Sequence
  Synthetic
gaggcctcuaaagaaatacctgattucc

SEQ ID NO: 32322 - DNA, 28 bp, Artificial Sequence
  Synthetic
gcaagtcaaaaaucctactcaaatcucc

SEQ ID NO: 32323 - DNA, 23 bp, Artificial Sequence
  Synthetic
tggtctgaggauttcctgttucc

SEQ ID NO: 32324 - DNA, 27 bp, Artificial Sequence
  Synthetic
tuaatatcttcuacagggagccaggat

SEQ ID NO: 32325 - DNA, 27 bp, Artificial Sequence
  Synthetic
gaagacaacaagcaguttcacaaacua

SEQ ID NO: 32326 - DNA, 21 bp, Artificial Sequence
  Synthetic
ggatggugaagggttgaccug

SEQ ID NO: 32327 - DNA, 28 bp, Artificial Sequence
  Synthetic
agcaactttgaggcugattatggaauat

SEQ ID NO: 32328 - DNA, 20 bp, Artificial Sequence
  Synthetic
gcccttcuaagcagcatgug

SEQ ID NO: 32329 - DNA, 26 bp, Artificial Sequence
  Synthetic
tttattccacguctattcucccacag

SEQ ID NO: 32330 - DNA, 17 bp, Artificial Sequence
  Synthetic
gcccuctgggugagcag

SEQ ID NO: 32331 - DNA, 28 bp, Artificial Sequence
  Synthetic
cattagagauccagaccttataggcaut

SEQ ID NO: 32332 - DNA, 23 bp, Artificial Sequence
  Synthetic
actugacagaaaccagcuggaat

SEQ ID NO: 32333 - DNA, 28 bp, Artificial Sequence
  Synthetic
ggtcaagaacutatcttccttctuccaa

SEQ ID NO: 32334 - DNA, 22 bp, Artificial Sequence
  Synthetic
ctgcagaaguacccagtgtuct

SEQ ID NO: 32335 - DNA, 23 bp, Artificial Sequence
  Synthetic
tcagtcatcccauccatctgtug

SEQ ID NO: 32336 - DNA, 20 bp, Artificial Sequence
  Synthetic
tcatctugcgcaccaaggut

SEQ ID NO: 32337 - DNA, 23 bp, Artificial Sequence
  Synthetic
gtacacccuttaccaacaaugcc

SEQ ID NO: 32338 - DNA, 20 bp, Artificial Sequence
  Synthetic
ggagccauggatttgccauc

SEQ ID NO: 32339 - DNA, 21 bp, Artificial Sequence
  Synthetic
agccactgcutttctcgtugt

SEQ ID NO: 32340 - DNA, 22 bp, Artificial Sequence
  Synthetic
gaaagaguagacagccgcugat

SEQ ID NO: 32341 - DNA, 24 bp, Artificial Sequence
  Synthetic
gtctgaacaucaccttcuacgaga

SEQ ID NO: 32342 - DNA, 25 bp, Artificial Sequence
  Synthetic
agagagtcagtutcctaggcttcut

SEQ ID NO: 32343 - DNA, 21 bp, Artificial Sequence
  Synthetic
actggctuctgattggugcag

SEQ ID NO: 32344 - DNA, 23 bp, Artificial Sequence
  Synthetic
ccagtaggatutgctggtggaut

SEQ ID NO: 32345 - DNA, 22 bp, Artificial Sequence
  Synthetic
cttgatgcugctgtctauggct

SEQ ID NO: 32346 - DNA, 23 bp, Artificial Sequence
  Synthetic
ccctuccaaggaaacgtgttgua

SEQ ID NO: 32347 - DNA, 23 bp, Artificial Sequence
  Synthetic
gttcttgttggcuttctccacug

SEQ ID NO: 32348 - DNA, 22 bp, Artificial Sequence
  Synthetic
agctagatgucacgctctccut

SEQ ID NO: 32349 - DNA, 24 bp, Artificial Sequence
  Synthetic
caatgcagtgauttggtgtaccug

SEQ ID NO: 32350 - DNA, 19 bp, Artificial Sequence
  Synthetic
ggaggaggaucgcgaacut

SEQ ID NO: 32351 - DNA, 23 bp, Artificial Sequence
  Synthetic
ctttgtcccuctgtgtcttcuca

SEQ ID NO: 32352 - DNA, 20 bp, Artificial Sequence
  Synthetic
agagctgguccagggauaca

SEQ ID NO: 32353 - DNA, 24 bp, Artificial Sequence
  Synthetic
tcctcctcacacuctctcaactut

SEQ ID NO: 32354 - DNA, 21 bp, Artificial Sequence
  Synthetic
gagggtgcgaucagtgatgut

SEQ ID NO: 32355 - DNA, 27 bp, Artificial Sequence
  Synthetic
gcagtgacugtatttcttctucccaag

SEQ ID NO: 32356 - DNA, 24 bp, Artificial Sequence
  Synthetic
cccccttacuctgatcatgtucat

SEQ ID NO: 32357 - DNA, 25 bp, Artificial Sequence
  Synthetic
ctgttcgtgtcuctgtcttgatcuc

SEQ ID NO: 32358 - DNA, 22 bp, Artificial Sequence
  Synthetic
cuaaggccacucagcaagacaa

SEQ ID NO: 32359 - DNA, 25 bp, Artificial Sequence
  Synthetic
ctctcctucaactggtaugaagaca

SEQ ID NO: 32360 - DNA, 25 bp, Artificial Sequence
  Synthetic
caggctacucacctcttgaattcut

SEQ ID NO: 32361 - DNA, 27 bp, Artificial Sequence
  Synthetic
tgttttactgucaattacagctuccca

SEQ ID NO: 32362 - DNA, 21 bp, Artificial Sequence
  Synthetic
gccuggagctttugcaaggat

SEQ ID NO: 32363 - DNA, 26 bp, Artificial Sequence
  Synthetic
cctacagtggauagaagacactcugt

SEQ ID NO: 32364 - DNA, 20 bp, Artificial Sequence
  Synthetic
ctttctcaggcugggtgcut

SEQ ID NO: 32365 - DNA, 28 bp, Artificial Sequence
  Synthetic
ttcaacacccugttctttctcttatuca

SEQ ID NO: 32366 - DNA, 21 bp, Artificial Sequence
  Synthetic
ccggagggugtccatgaatug

SEQ ID NO: 32367 - DNA, 24 bp, Artificial Sequence
  Synthetic
ctgggugacagagcgagauaaaaa

SEQ ID NO: 32368 - DNA, 22 bp, Artificial Sequence
  Synthetic
cacucccacccuaagatcttuc

SEQ ID NO: 32369 - DNA, 26 bp, Artificial Sequence
  Synthetic
agcaccacugaactttctctctttut

SEQ ID NO: 32370 - DNA, 23 bp, Artificial Sequence
  Synthetic
guccagttctuccagagcaaaag

SEQ ID NO: 32371 - DNA, 29 bp, Artificial Sequence
  Synthetic
ccccaacuaagggcttatgtgtaatuaaa

SEQ ID NO: 32372 - DNA, 32 bp, Artificial Sequence
  Synthetic
aatatgaatatggaucacatctcuaccagagt

SEQ ID NO: 32373 - DNA, 26 bp, Artificial Sequence
  Synthetic
ccaacaaggacagutgauacaaaaca

SEQ ID NO: 32374 - DNA, 27 bp, Artificial Sequence
  Synthetic
aaaagctctatctuccctagtgtggua

SEQ ID NO: 32375 - DNA, 22 bp, Artificial Sequence
  Synthetic
gagtacagugccaugagagacc

SEQ ID NO: 32376 - DNA, 27 bp, Artificial Sequence
  Synthetic
cagaatatggguaaagatgauccgaca

SEQ ID NO: 32377 - DNA, 24 bp, Artificial Sequence
  Synthetic
accctgautactggttuccaacag

SEQ ID NO: 32378 - DNA, 22 bp, Artificial Sequence
  Synthetic
ctgucaaagagggagutggaug

SEQ ID NO: 32379 - DNA, 22 bp, Artificial Sequence
  Synthetic
ccctuccccacacagttcaaug

SEQ ID NO: 32380 - DNA, 26 bp, Artificial Sequence
  Synthetic
ggagggauacagcttttctttcauct

SEQ ID NO: 32381 - DNA, 26 bp, Artificial Sequence
  Synthetic
tttgcttccaguccctaatcacuaac

SEQ ID NO: 32382 - DNA, 24 bp, Artificial Sequence
  Synthetic
tgtgtgtttguctgcctgtctuaa

SEQ ID NO: 32383 - DNA, 22 bp, Artificial Sequence
  Synthetic
gctttcctugccttctcaaugg

SEQ ID NO: 32384 - DNA, 25 bp, Artificial Sequence
  Synthetic
gcttgccutaatgttccauacagga

SEQ ID NO: 32385 - DNA, 22 bp, Artificial Sequence
  Synthetic
gutccctctucacagcacgaat

SEQ ID NO: 32386 - DNA, 27 bp, Artificial Sequence
  Synthetic
acacattctgutttctatgacuccaat

SEQ ID NO: 32387 - DNA, 23 bp, Artificial Sequence
  Synthetic
gtcccaccacucaattucaggaa

SEQ ID NO: 32388 - DNA, 26 bp, Artificial Sequence
  Synthetic
tctcttagaaucatctcuacccgcat

SEQ ID NO: 32389 - DNA, 25 bp, Artificial Sequence
  Synthetic
ctgctcuagagacttgatucaggaa

SEQ ID NO: 32390 - DNA, 28 bp, Artificial Sequence
  Synthetic
gcacagaaggaacuacaagaaaaaguca

SEQ ID NO: 32391 - DNA, 28 bp, Artificial Sequence
  Synthetic
aggattaaagacauaaacttgccacuct

SEQ ID NO: 32392 - DNA, 22 bp, Artificial Sequence
  Synthetic
agccctgccuctgatctucaat

SEQ ID NO: 32393 - DNA, 20 bp, Artificial Sequence
  Synthetic
ggcccaguatggacaccuac

SEQ ID NO: 32394 - DNA, 26 bp, Artificial Sequence
  Synthetic
ggttctttcuaccccatcatctucca

SEQ ID NO: 32395 - DNA, 22 bp, Artificial Sequence
  Synthetic
ccccctuaatcccctcuaaccc

SEQ ID NO: 32396 - DNA, 33 bp, Artificial Sequence
  Synthetic
tttattatatatcucttttctaggguacagcca

SEQ ID NO: 32397 - DNA, 21 bp, Artificial Sequence
  Synthetic
agtgtucagccccatgcttut

SEQ ID NO: 32398 - DNA, 20 bp, Artificial Sequence
  Synthetic
acgtcgcugtaagcucacac

SEQ ID NO: 32399 - DNA, 24 bp, Artificial Sequence
  Synthetic
caatctcaccuggctactccatuc

SEQ ID NO: 32400 - DNA, 20 bp, Artificial Sequence
  Synthetic
tctucagcccactucccaga

SEQ ID NO: 32401 - DNA, 25 bp, Artificial Sequence
  Synthetic
tgggtgacttcutagatgagggtut

SEQ ID NO: 32402 - DNA, 25 bp, Artificial Sequence
  Synthetic
ggtgatgtcuacaatgatgggacug

SEQ ID NO: 32403 - DNA, 24 bp, Artificial Sequence
  Synthetic
atgtgaccctuacctacactcuct

SEQ ID NO: 32404 - DNA, 21 bp, Artificial Sequence
  Synthetic
cacactctgcucccagaacut

SEQ ID NO: 32405 - DNA, 22 bp, Artificial Sequence
  Synthetic
gtccaggaucagttgctctucc

SEQ ID NO: 32406 - DNA, 20 bp, Artificial Sequence
  Synthetic
cctaggucacgggcaaugaa

SEQ ID NO: 32407 - DNA, 18 bp, Artificial Sequence
  Synthetic
cacccagcuggtctgguc

SEQ ID NO: 32408 - DNA, 21 bp, Artificial Sequence
  Synthetic
tgagtgaccccutcccatuca

SEQ ID NO: 32409 - DNA, 20 bp, Artificial Sequence
  Synthetic
ggaggcuaatggcugaaccg

SEQ ID NO: 32410 - DNA, 29 bp, Artificial Sequence
  Synthetic
aaaaacgaaaagtutcaatggctctaugt

SEQ ID NO: 32411 - DNA, 25 bp, Artificial Sequence
  Synthetic
gatacccttatuccctgtggatguc

SEQ ID NO: 32412 - DNA, 20 bp, Artificial Sequence
  Synthetic
ccatacucagctccauccgt

SEQ ID NO: 32413 - DNA, 23 bp, Artificial Sequence
  Synthetic
cctagcagaugtgtccattcucc

SEQ ID NO: 32414 - DNA, 21 bp, Artificial Sequence
  Synthetic
tgctgatugggagctctcuct

SEQ ID NO: 32415 - DNA, 23 bp, Artificial Sequence
  Synthetic
gctcctagucatcacaugaccca

SEQ ID NO: 32416 - DNA, 22 bp, Artificial Sequence
  Synthetic
ccaccaagucctcatcactcuc

SEQ ID NO: 32417 - DNA, 24 bp, Artificial Sequence
  Synthetic
cactctttauccctggactccuca

SEQ ID NO: 32418 - DNA, 22 bp, Artificial Sequence
  Synthetic
ggtccagcaauttgagucaggt

SEQ ID NO: 32419 - DNA, 24 bp, Artificial Sequence
  Synthetic
gtagatgugagaagggatgctugg

SEQ ID NO: 32420 - DNA, 22 bp, Artificial Sequence
  Synthetic
tccaccccaucagttctctcut

SEQ ID NO: 32421 - DNA, 23 bp, Artificial Sequence
  Synthetic
aattagcaaggucaccaggacuc

SEQ ID NO: 32422 - DNA, 17 bp, Artificial Sequence
  Synthetic
cccctgacucccccugt

SEQ ID NO: 32423 - DNA, 17 bp, Artificial Sequence
  Synthetic
catgguccagcccugct

SEQ ID NO: 32424 - DNA, 22 bp, Artificial Sequence
  Synthetic
gatctgccuccctcctccttua

SEQ ID NO: 32425 - DNA, 24 bp, Artificial Sequence
  Synthetic
gatgtcccggaacuctttacucac

SEQ ID NO: 32426 - DNA, 21 bp, Artificial Sequence
  Synthetic
ggctcccugacaatctccauc

SEQ ID NO: 32427 - DNA, 20 bp, Artificial Sequence
  Synthetic
catccaggacuggcacucac

SEQ ID NO: 32428 - DNA, 23 bp, Artificial Sequence
  Synthetic
tctcctgtcuccatccttcacut

SEQ ID NO: 32429 - DNA, 24 bp, Artificial Sequence
  Synthetic
attgtagacaguggaagaggctuc

SEQ ID NO: 32430 - DNA, 25 bp, Artificial Sequence
  Synthetic
tgagaatggctuttcataccctgug

SEQ ID NO: 32431 - DNA, 23 bp, Artificial Sequence
  Synthetic
ctccugaaagcacuaaggcaaag

SEQ ID NO: 32432 - DNA, 23 bp, Artificial Sequence
  Synthetic
cgtuaagcagagaguaacaccuc

SEQ ID NO: 32433 - DNA, 21 bp, Artificial Sequence
  Synthetic
gtgctgcugtcatcctaguca

SEQ ID NO: 32434 - DNA, 24 bp, Artificial Sequence
  Synthetic
tcagagaggaaaacgugttgtgut

SEQ ID NO: 32435 - DNA, 27 bp, Artificial Sequence
  Synthetic
gatggatctucacgtctgtccuaaaaa

SEQ ID NO: 32436 - DNA, 24 bp, Artificial Sequence
  Synthetic
cacctagguctagcagtatugcat

SEQ ID NO: 32437 - DNA, 27 bp, Artificial Sequence
  Synthetic
caguttgaaaaataucaggagcagcac

SEQ ID NO: 32438 - DNA, 30 bp, Artificial Sequence
  Synthetic
ggaaaaugaagagaaaaagcagaaauggaa

SEQ ID NO: 32439 - DNA, 25 bp, Artificial Sequence
  Synthetic
tgctcacctcutacttgtcctauct

SEQ ID NO: 32440 - DNA, 29 bp, Artificial Sequence
  Synthetic
atcatgattgcuatcaacttcacuaagaa

SEQ ID NO: 32441 - DNA, 22 bp, Artificial Sequence
  Synthetic
aaggagutggcugaggaagaac

SEQ ID NO: 32442 - DNA, 20 bp, Artificial Sequence
  Synthetic
acattccccuctggcccaua

SEQ ID NO: 32443 - DNA, 25 bp, Artificial Sequence
  Synthetic
cacaccatguctcttgtctcugaag

SEQ ID NO: 32444 - DNA, 18 bp, Artificial Sequence
  Synthetic
gggtggcgaucacttguc

SEQ ID NO: 32445 - DNA, 25 bp, Artificial Sequence
  Synthetic
gggagtcucgcaaggataagaaaua

SEQ ID NO: 32446 - DNA, 20 bp, Artificial Sequence
  Synthetic
gggcttgacugttcccaucc

SEQ ID NO: 32447 - DNA, 25 bp, Artificial Sequence
  Synthetic
caaacgtacagcaguctctcttcut

SEQ ID NO: 32448 - DNA, 22 bp, Artificial Sequence
  Synthetic
cctctucccccaacctaucagt

SEQ ID NO: 32449 - DNA, 22 bp, Artificial Sequence
  Synthetic
ctacagtgacaauggcacgtuc

SEQ ID NO: 32450 - DNA, 22 bp, Artificial Sequence
  Synthetic
gttauccaaccccaggatuccc

SEQ ID NO: 32451 - DNA, 23 bp, Artificial Sequence
  Synthetic
atctgatuccccactttgtgcut

SEQ ID NO: 32452 - DNA, 28 bp, Artificial Sequence
  Synthetic
ttcagcaatgttgutactggaaatgtuc

SEQ ID NO: 32453 - DNA, 28 bp, Artificial Sequence
  Synthetic
cctgtctatuacaacaacatgctacuca

SEQ ID NO: 32454 - DNA, 29 bp, Artificial Sequence
  Synthetic
gcatttacaaaucagtcttttccaacuct

SEQ ID NO: 32455 - DNA, 28 bp, Artificial Sequence
  Synthetic
gacttcttcagcautatgacaagagcua

SEQ ID NO: 32456 - DNA, 31 bp, Artificial Sequence
  Synthetic
cagtgtaaauaaacatcctgatttugcaact

SEQ ID NO: 32457 - DNA, 23 bp, Artificial Sequence
  Synthetic
gtcagttatguggctagcagcut

SEQ ID NO: 32458 - DNA, 22 bp, Artificial Sequence
  Synthetic
ggtgcucaccagaatauccact

SEQ ID NO: 32459 - DNA, 28 bp, Artificial Sequence
  Synthetic
gtaaattgttcutgaggaaggtuccaaa

SEQ ID NO: 32460 - DNA, 30 bp, Artificial Sequence
  Synthetic
atatggaccaauaaaacaagagggaaauat

SEQ ID NO: 32461 - DNA, 22 bp, Artificial Sequence
  Synthetic
ccctcaaauatggtcccaucct

SEQ ID NO: 32462 - DNA, 28 bp, Artificial Sequence
  Synthetic
aggagtattucctcctctactugagaag

SEQ ID NO: 32463 - DNA, 26 bp, Artificial Sequence
  Synthetic
tccaaagttatugtcactggcatuca

SEQ ID NO: 32464 - DNA, 25 bp, Artificial Sequence
  Synthetic
ctcacugatataaagtugcgagcca

SEQ ID NO: 32465 - DNA, 24 bp, Artificial Sequence
  Synthetic
gccaaaauaaacttccauggccaa

SEQ ID NO: 32466 - DNA, 21 bp, Artificial Sequence
  Synthetic
tcgtugaaacccaugcagaca

SEQ ID NO: 32467 - DNA, 30 bp, Artificial Sequence
  Synthetic
gtctgggtatugtcagtaacttucagaaat

SEQ ID NO: 32468 - DNA, 23 bp, Artificial Sequence
  Synthetic
ctctcugagacagacagggauca

SEQ ID NO: 32469 - DNA, 26 bp, Artificial Sequence
  Synthetic
gccagaaauaaaccaggaaaaaugcc

SEQ ID NO: 32470 - DNA, 24 bp, Artificial Sequence
  Synthetic
tgutcttgtucagacacagccaat

SEQ ID NO: 32471 - DNA, 23 bp, Artificial Sequence
  Synthetic
aaataccuccatgtuggcaggag

SEQ ID NO: 32472 - DNA, 25 bp, Artificial Sequence
  Synthetic
aggatggaatugatggttactccug

SEQ ID NO: 32473 - DNA, 26 bp, Artificial Sequence
  Synthetic
gctaactacaccauctgtgatucaga

SEQ ID NO: 32474 - DNA, 22 bp, Artificial Sequence
  Synthetic
tgttggucccagccttgttuaa

SEQ ID NO: 32475 - DNA, 20 bp, Artificial Sequence
  Synthetic
cuaagccaaucacccaacgc

SEQ ID NO: 32476 - DNA, 29 bp, Artificial Sequence
  Synthetic
ttactttccagauatagctgtaacugcac

SEQ ID NO: 32477 - DNA, 26 bp, Artificial Sequence
  Synthetic
attggtggaagguattttgtcacuca

SEQ ID NO: 32478 - DNA, 22 bp, Artificial Sequence
  Synthetic
gcaataguaacccctgccaguc

SEQ ID NO: 32479 - DNA, 28 bp, Artificial Sequence
  Synthetic
agaaagtcaagtcauatcccatctccut

SEQ ID NO: 32480 - DNA, 25 bp, Artificial Sequence
  Synthetic
aatgaatgttcutcaaaccctugcc

SEQ ID NO: 32481 - DNA, 26 bp, Artificial Sequence
  Synthetic
aagtgagggaugcatgttccattaut

SEQ ID NO: 32482 - DNA, 22 bp, Artificial Sequence
  Synthetic
ggtcaaaaguggctcagugaca

SEQ ID NO: 32483 - DNA, 23 bp, Artificial Sequence
  Synthetic
ctggtgtugtgggaaaugaacag

SEQ ID NO: 32484 - DNA, 20 bp, Artificial Sequence
  Synthetic
gcaucgcgaaagctccuact

SEQ ID NO: 32485 - DNA, 23 bp, Artificial Sequence
  Synthetic
atgaugagccagaugagatgtuc

SEQ ID NO: 32486 - DNA, 29 bp, Artificial Sequence
  Synthetic
ttttctcctccucctctattttgacatug

SEQ ID NO: 32487 - DNA, 27 bp, Artificial Sequence
  Synthetic
ccagacacggauatattgataagugct

SEQ ID NO: 32488 - DNA, 28 bp, Artificial Sequence
  Synthetic
ctgtatcagtcutcacaaaaccuaggat

SEQ ID NO: 32489 - DNA, 31 bp, Artificial Sequence
  Synthetic
gaaagaattccagautttggttgtttaguct

SEQ ID NO: 32490 - DNA, 25 bp, Artificial Sequence
  Synthetic
aaacagatatguggtttcaccguca

SEQ ID NO: 32491 - DNA, 22 bp, Artificial Sequence
  Synthetic
tgaatccacaccacugaaccuc

SEQ ID NO: 32492 - DNA, 29 bp, Artificial Sequence
  Synthetic
tcaccttctctcautaggtattgcaaaug

SEQ ID NO: 32493 - DNA, 23 bp, Artificial Sequence
  Synthetic
gctgttgccacuttgcaatugaa

SEQ ID NO: 32494 - DNA, 24 bp, Artificial Sequence
  Synthetic
gcaaauggaaguggacaacgaaac

SEQ ID NO: 32495 - DNA, 30 bp, Artificial Sequence
  Synthetic
agtaagagagataaaugcctccgatttcua

SEQ ID NO: 32496 - DNA, 21 bp, Artificial Sequence
  Synthetic
cccugtttgcauggaggaaac

SEQ ID NO: 32497 - DNA, 28 bp, Artificial Sequence
  Synthetic
ttgtctatauccacttcacagtucacac

SEQ ID NO: 32498 - DNA, 28 bp, Artificial Sequence
  Synthetic
cttgaatgagaugaacaagaugaacagc

SEQ ID NO: 32499 - DNA, 25 bp, Artificial Sequence
  Synthetic
tcttccagaaggcuctaatgugact

SEQ ID NO: 32500 - DNA, 23 bp, Artificial Sequence
  Synthetic
cttgctctggutggtcttcatuc

SEQ ID NO: 32501 - DNA, 21 bp, Artificial Sequence
  Synthetic
acaauggccagcaagaggauc

SEQ ID NO: 32502 - DNA, 21 bp, Artificial Sequence
  Synthetic
ccctgcaauggagagacugat

SEQ ID NO: 32503 - DNA, 19 bp, Artificial Sequence
  Synthetic
acaauggtgucgagcggaa

SEQ ID NO: 32504 - DNA, 21 bp, Artificial Sequence
  Synthetic
ggattccuccccaguggagaa

SEQ ID NO: 32505 - DNA, 22 bp, Artificial Sequence
  Synthetic
cctaaaguacagccuggaccac

SEQ ID NO: 32506 - DNA, 23 bp, Artificial Sequence
  Synthetic
cacttgcagguggcataguagag

SEQ ID NO: 32507 - DNA, 21 bp, Artificial Sequence
  Synthetic
cctcctgcugctgttccatut

SEQ ID NO: 32508 - DNA, 22 bp, Artificial Sequence
  Synthetic
cattgagcuaactccgcctuct

SEQ ID NO: 32509 - DNA, 23 bp, Artificial Sequence
  Synthetic
ccagatcuccctcttuccacaaa

SEQ ID NO: 32510 - DNA, 23 bp, Artificial Sequence
  Synthetic
tgtaccactcuccaccatgguaa

SEQ ID NO: 32511 - DNA, 19 bp, Artificial Sequence
  Synthetic
gctccccaacguggactug

SEQ ID NO: 32512 - DNA, 22 bp, Artificial Sequence
  Synthetic
gctgaugcactgaacaugggaa

SEQ ID NO: 32513 - DNA, 20 bp, Artificial Sequence
  Synthetic
atuagggcagucgaggaauc

SEQ ID NO: 32514 - DNA, 20 bp, Artificial Sequence
  Synthetic
tcctgtcugcctcctccuac

SEQ ID NO: 32515 - DNA, 22 bp, Artificial Sequence
  Synthetic
agatggctugcaccccaatauc

SEQ ID NO: 32516 - DNA, 20 bp, Artificial Sequence
  Synthetic
gtcccugagctgguccaaaa

SEQ ID NO: 32517 - DNA, 17 bp, Artificial Sequence
  Synthetic
ccacccccuctcccucc

SEQ ID NO: 32518 - DNA, 23 bp, Artificial Sequence
  Synthetic
gaagcttcugtcaagactcucca

SEQ ID NO: 32519 - DNA, 23 bp, Artificial Sequence
  Synthetic
agtgtaagcucctctcccttcuc

SEQ ID NO: 32520 - DNA, 19 bp, Artificial Sequence
  Synthetic
ctgcugagaactgcucgga

SEQ ID NO: 32521 - DNA, 21 bp, Artificial Sequence
  Synthetic
cacccttgcutccagaccuat

SEQ ID NO: 32522 - DNA, 18 bp, Artificial Sequence
  Synthetic
gcctgaugccttgucgca

SEQ ID NO: 32523 - DNA, 23 bp, Artificial Sequence
  Synthetic
tgtagaaagagccucaggucaga

SEQ ID NO: 32524 - DNA, 20 bp, Artificial Sequence
  Synthetic
cggaccacccucacttcgua

SEQ ID NO: 32525 - DNA, 18 bp, Artificial Sequence
  Synthetic
ggacaugccgtgugacga

SEQ ID NO: 32526 - DNA, 20 bp, Artificial Sequence
  Synthetic
gggcauaccccctctgtcua

SEQ ID NO: 32527 - DNA, 20 bp, Artificial Sequence
  Synthetic
ggagagcgcugtgacctaug

SEQ ID NO: 32528 - DNA, 21 bp, Artificial Sequence
  Synthetic
agccaagutttcatgcuccct

SEQ ID NO: 32529 - DNA, 20 bp, Artificial Sequence
  Synthetic
aagaactgugagcggtguca

SEQ ID NO: 32530 - DNA, 19 bp, Artificial Sequence
  Synthetic
cacucgacccagacccuac

SEQ ID NO: 32531 - DNA, 26 bp, Artificial Sequence
  Synthetic
gcccttcttugttgattactccugat

SEQ ID NO: 32532 - DNA, 19 bp, Artificial Sequence
  Synthetic
agcauggccgugacagaag

SEQ ID NO: 32533 - DNA, 28 bp, Artificial Sequence
  Synthetic
catatgaaggagacuctatgtgcctcua

SEQ ID NO: 32534 - DNA, 23 bp, Artificial Sequence
  Synthetic
gaacagtgggacaucagggatut

SEQ ID NO: 32535 - DNA, 20 bp, Artificial Sequence
  Synthetic
gatugagcgctccucagact

SEQ ID NO: 32536 - DNA, 22 bp, Artificial Sequence
  Synthetic
gagagacaaggacacugtgcuc

SEQ ID NO: 32537 - DNA, 23 bp, Artificial Sequence
  Synthetic
tggacagtcuctggatgacagut

SEQ ID NO: 32538 - DNA, 20 bp, Artificial Sequence
  Synthetic
ttccuccagtccugggaagt

SEQ ID NO: 32539 - DNA, 21 bp, Artificial Sequence
  Synthetic
tggactgcuccatcacacauc

SEQ ID NO: 32540 - DNA, 22 bp, Artificial Sequence
  Synthetic
gaccuttccuaggacacagcaa

SEQ ID NO: 32541 - DNA, 22 bp, Artificial Sequence
  Synthetic
tcacaugccactugagacaagg

SEQ ID NO: 32542 - DNA, 20 bp, Artificial Sequence
  Synthetic
gcucaaccccggatcugaac

SEQ ID NO: 32543 - DNA, 25 bp, Artificial Sequence
  Synthetic
gtatgttaccugtctttaccugcct

SEQ ID NO: 32544 - DNA, 31 bp, Artificial Sequence
  Synthetic
atutcttagacctctatuaggaaggaacact

SEQ ID NO: 32545 - DNA, 23 bp, Artificial Sequence
  Synthetic
tgacuaaggaacgcaccacatuc

SEQ ID NO: 32546 - DNA, 21 bp, Artificial Sequence
  Synthetic
ggcagcatucggtgaaguaca

SEQ ID NO: 32547 - DNA, 24 bp, Artificial Sequence
  Synthetic
ccagcucatggacatucaagacaa

SEQ ID NO: 32548 - DNA, 24 bp, Artificial Sequence
  Synthetic
tccttgtuaccatggctaugacac

SEQ ID NO: 32549 - DNA, 22 bp, Artificial Sequence
  Synthetic
tggccatttutctgtcccugat

SEQ ID NO: 32550 - DNA, 29 bp, Artificial Sequence
  Synthetic
aacatatgtgtgtutcttgaggaagauga

SEQ ID NO: 32551 - DNA, 28 bp, Artificial Sequence
  Synthetic
ccctatttguaggtgttgaaugaacaag

SEQ ID NO: 32552 - DNA, 19 bp, Artificial Sequence
  Synthetic
ccctccgucggtuaacacg

SEQ ID NO: 32553 - DNA, 23 bp, Artificial Sequence
  Synthetic
cctgcactccutcaaagaggtua

SEQ ID NO: 32554 - DNA, 20 bp, Artificial Sequence
  Synthetic
gatccacucggaagccguac

SEQ ID NO: 32555 - DNA, 27 bp, Artificial Sequence
  Synthetic
gtcttgactcuacgtatccattcucat

SEQ ID NO: 32556 - DNA, 22 bp, Artificial Sequence
  Synthetic
gtgcaggccuctactccaauag

SEQ ID NO: 32557 - DNA, 25 bp, Artificial Sequence
  Synthetic
tttgtaggaggugggatcttggaua

SEQ ID NO: 32558 - DNA, 22 bp, Artificial Sequence
  Synthetic
actgatgtugaccactgctugg

SEQ ID NO: 32559 - DNA, 28 bp, Artificial Sequence
  Synthetic
cttgcttttgacagucttgttgattuct

SEQ ID NO: 32560 - DNA, 26 bp, Artificial Sequence
  Synthetic
agcttccgtuatagattaggacugga

SEQ ID NO: 32561 - DNA, 25 bp, Artificial Sequence
  Synthetic
aagtgacuggacattcauacagacc

SEQ ID NO: 32562 - DNA, 23 bp, Artificial Sequence
  Synthetic
ccaagggcucaggcaauagaaag

SEQ ID NO: 32563 - DNA, 30 bp, Artificial Sequence
  Synthetic
cagtgagaacaaauggtgatatcatcaaut

SEQ ID NO: 32564 - DNA, 22 bp, Artificial Sequence
  Synthetic
gactcaaaauaccccctuggct

SEQ ID NO: 32565 - DNA, 22 bp, Artificial Sequence
  Synthetic
ccuggaaaccuccaagaaaccc

SEQ ID NO: 32566 - DNA, 20 bp, Artificial Sequence
  Synthetic
cctccatucgtgcaggcuac

SEQ ID NO: 32567 - DNA, 23 bp, Artificial Sequence
  Synthetic
agaagtcagcccuccagatctut

SEQ ID NO: 32568 - DNA, 28 bp, Artificial Sequence
  Synthetic
aaagtcacaggaucaaagcuaaaaggat

SEQ ID NO: 32569 - DNA, 23 bp, Artificial Sequence
  Synthetic
aattcagcugggcatacctguag

SEQ ID NO: 32570 - DNA, 21 bp, Artificial Sequence
  Synthetic
ccccaagcutttcccucgaag

SEQ ID NO: 32571 - DNA, 22 bp, Artificial Sequence
  Synthetic
ctctctacacacugacccugga

SEQ ID NO: 32572 - DNA, 24 bp, Artificial Sequence
  Synthetic
ggcatgucagggctcatctattua

SEQ ID NO: 32573 - DNA, 25 bp, Artificial Sequence
  Synthetic
gcaggagaaautttaagccctugga

SEQ ID NO: 32574 - DNA, 28 bp, Artificial Sequence
  Synthetic
gcatgtctgtuacttttctaaaggguct

SEQ ID NO: 32575 - DNA, 22 bp, Artificial Sequence
  Synthetic
acacaaacuctggaagcuccac

SEQ ID NO: 32576 - DNA, 21 bp, Artificial Sequence
  Synthetic
gtgttggagcaguacgcatuc

SEQ ID NO: 32577 - DNA, 25 bp, Artificial Sequence
  Synthetic
tttcaaggaagutgtggagtuagca

SEQ ID NO: 32578 - DNA, 28 bp, Artificial Sequence
  Synthetic
tcaccattttgacaugcttgtatcctua

SEQ ID NO: 32579 - DNA, 31 bp, Artificial Sequence
  Synthetic
tgtttttaatgttcuctctctctctctcuct

SEQ ID NO: 32580 - DNA, 27 bp, Artificial Sequence
  Synthetic
atttcttctggtgutgacataggtgut

SEQ ID NO: 32581 - DNA, 30 bp, Artificial Sequence
  Synthetic
tcacaaatttaggacuaagcaattgauaca

SEQ ID NO: 32582 - DNA, 26 bp, Artificial Sequence
  Synthetic
ggaaaagcaaguttccattacgacuc

SEQ ID NO: 32583 - DNA, 25 bp, Artificial Sequence
  Synthetic
gggatggugtgacttttgauacact

SEQ ID NO: 32584 - DNA, 26 bp, Artificial Sequence
  Synthetic
gugacctcatataucaaacacacacc

SEQ ID NO: 32585 - DNA, 22 bp, Artificial Sequence
  Synthetic
agagtaccagaucaggcaggut

SEQ ID NO: 32586 - DNA, 22 bp, Artificial Sequence
  Synthetic
ctgaaccccutttcccagagut

SEQ ID NO: 32587 - DNA, 28 bp, Artificial Sequence
  Synthetic
tcaaatgcagtcauttttctgcttctut

SEQ ID NO: 32588 - DNA, 28 bp, Artificial Sequence
  Synthetic
ttcaagattgtctautttggtccacgua

SEQ ID NO: 32589 - DNA, 27 bp, Artificial Sequence
  Synthetic
tttttctcttuccagatgtgaaccuca

SEQ ID NO: 32590 - DNA, 27 bp, Artificial Sequence
  Synthetic
aacacatttctucaattgatgcctucc

SEQ ID NO: 32591 - DNA, 28 bp, Artificial Sequence
  Synthetic
cacaaaagccuaccctatgtatgtcuaa

SEQ ID NO: 32592 - DNA, 23 bp, Artificial Sequence
  Synthetic
tggcaccgggucattcttttuaa

SEQ ID NO: 32593 - DNA, 27 bp, Artificial Sequence
  Synthetic
actttatagcagccucagttttctucc

SEQ ID NO: 32594 - DNA, 23 bp, Artificial Sequence
  Synthetic
cacagcaaauctggtttccugag

SEQ ID NO: 32595 - DNA, 23 bp, Artificial Sequence
  Synthetic
aatcagttgggauctgcaagaug

SEQ ID NO: 32596 - DNA, 30 bp, Artificial Sequence
  Synthetic
acatcatggtgugagaagctaataattuca

SEQ ID NO: 32597 - DNA, 28 bp, Artificial Sequence
  Synthetic
gtatccatgcgcuaaaactcaaaagtua

SEQ ID NO: 32598 - DNA, 27 bp, Artificial Sequence
  Synthetic
cattaaatgagautgtcatggcugaga

SEQ ID NO: 32599 - DNA, 24 bp, Artificial Sequence
  Synthetic
cccaaautaccactguggaagaca

SEQ ID NO: 32600 - DNA, 22 bp, Artificial Sequence
  Synthetic
cacttgaagacauagccuggca

SEQ ID NO: 32601 - DNA, 25 bp, Artificial Sequence
  Synthetic
gtgtcatcuggacatctcctucaaa

SEQ ID NO: 32602 - DNA, 30 bp, Artificial Sequence
  Synthetic
gaaattttataauggagggatgactgauct

SEQ ID NO: 32603 - DNA, 28 bp, Artificial Sequence
  Synthetic
aagccaaacacagaguattggatcttua

SEQ ID NO: 32604 - DNA, 31 bp, Artificial Sequence
  Synthetic
gggaggttcataguaaagaaagaatatgcut

SEQ ID NO: 32605 - DNA, 22 bp, Artificial Sequence
  Synthetic
tgtgacaacgutagctggtcut

SEQ ID NO: 32606 - DNA, 27 bp, Artificial Sequence
  Synthetic
actttgaacuattcaacaugcccagaa

SEQ ID NO: 32607 - DNA, 27 bp, Artificial Sequence
  Synthetic
gatgttcctgcutgtcttttgcttuag

SEQ ID NO: 32608 - DNA, 25 bp, Artificial Sequence
  Synthetic
acttagtggaaucacagacaauggg

SEQ ID NO: 32609 - DNA, 21 bp, Artificial Sequence
  Synthetic
gcctgacccucacatcactut

SEQ ID NO: 32610 - DNA, 24 bp, Artificial Sequence
  Synthetic
tcaacacagagucaatccagggua

SEQ ID NO: 32611 - DNA, 27 bp, Artificial Sequence
  Synthetic
gctcttagcccauggacaaaataugaa

SEQ ID NO: 32612 - DNA, 25 bp, Artificial Sequence
  Synthetic
gggtugccaagatataaucacagat

SEQ ID NO: 32613 - DNA, 25 bp, Artificial Sequence
  Synthetic
ctggaaaugtcactaatugcacagt

SEQ ID NO: 32614 - DNA, 27 bp, Artificial Sequence
  Synthetic
cctatgtagaagacauttggctgtgua

SEQ ID NO: 32615 - DNA, 29 bp, Artificial Sequence
  Synthetic
tttcccatacaggutattttccaatccut

SEQ ID NO: 32616 - DNA, 28 bp, Artificial Sequence
  Synthetic
agatagccaacauttgcatagactuacc

SEQ ID NO: 32617 - DNA, 23 bp, Artificial Sequence
  Synthetic
gucatguacaguggagaagagac

SEQ ID NO: 32618 - DNA, 30 bp, Artificial Sequence
  Synthetic
caaattacctggguctacatagaatauccc

SEQ ID NO: 32619 - DNA, 24 bp, Artificial Sequence
  Synthetic
actcacagguggaaaatcgaacuc

SEQ ID NO: 32620 - DNA, 21 bp, Artificial Sequence
  Synthetic
tgagucaccgccacttactuc

SEQ ID NO: 32621 - DNA, 23 bp, Artificial Sequence
  Synthetic
ctatcgtgctuacggatttgcuc

SEQ ID NO: 32622 - DNA, 25 bp, Artificial Sequence
  Synthetic
attaagcaccacauataagcugcca

SEQ ID NO: 32623 - DNA, 21 bp, Artificial Sequence
  Synthetic
cugacgaggacauacccgaag

SEQ ID NO: 32624 - DNA, 23 bp, Artificial Sequence
  Synthetic
gggagaagaaguggaaggaaugg

SEQ ID NO: 32625 - DNA, 29 bp, Artificial Sequence
  Synthetic
gtgggattcuggaacgctatgtattauat

SEQ ID NO: 32626 - DNA, 25 bp, Artificial Sequence
  Synthetic
ccagcatgugagagagacaacatut

SEQ ID NO: 32627 - DNA, 29 bp, Artificial Sequence
  Synthetic
gctgagtaaattcutgtttctccctaucc

SEQ ID NO: 32628 - DNA, 24 bp, Artificial Sequence
  Synthetic
gcctcccauccatgtauaaacagt

SEQ ID NO: 32629 - DNA, 27 bp, Artificial Sequence
  Synthetic
tccatgatttatuggtttgggtcugaa

SEQ ID NO: 32630 - DNA, 29 bp, Artificial Sequence
  Synthetic
tgcaaacaaaaaggaagutaataggguct

SEQ ID NO: 32631 - DNA, 28 bp, Artificial Sequence
  Synthetic
ctgttgtcagaggugtaattgagaagua

SEQ ID NO: 32632 - DNA, 24 bp, Artificial Sequence
  Synthetic
gtgtgtgugcacatatgcattuga

SEQ ID NO: 32633 - DNA, 28 bp, Artificial Sequence
  Synthetic
gccagccccucattaatctatatgagua

SEQ ID NO: 32634 - DNA, 23 bp, Artificial Sequence
  Synthetic
atccagautgactcugacagcac

SEQ ID NO: 32635 - DNA, 25 bp, Artificial Sequence
  Synthetic
ctgcagaggacaaaaaugattggua

SEQ ID NO: 32636 - DNA, 21 bp, Artificial Sequence
  Synthetic
actccgaugcatgcttcauca

SEQ ID NO: 32637 - DNA, 30 bp, Artificial Sequence
  Synthetic
ccttctgcagccuttttatatacctactut

SEQ ID NO: 32638 - DNA, 30 bp, Artificial Sequence
  Synthetic
caatccatttaatuggtcagttctgaacut

SEQ ID NO: 32639 - DNA, 28 bp, Artificial Sequence
  Synthetic
tcctagagttucttagcaccctuacaat

SEQ ID NO: 32640 - DNA, 21 bp, Artificial Sequence
  Synthetic
cctcccagcugttauacacgt

SEQ ID NO: 32641 - DNA, 28 bp, Artificial Sequence
  Synthetic
gcctatttcuttgactttaauggcacat

SEQ ID NO: 32642 - DNA, 27 bp, Artificial Sequence
  Synthetic
acagaaaagtauggcaacaccaacaua

SEQ ID NO: 32643 - DNA, 30 bp, Artificial Sequence
  Synthetic
agtaactacaacuaatgatcauggcaaaca

SEQ ID NO: 32644 - DNA, 23 bp, Artificial Sequence
  Synthetic
tttacctcaguaccaggcaccua

SEQ ID NO: 32645 - DNA, 25 bp, Artificial Sequence
  Synthetic
tttgctgaucacacttgtctuacca

SEQ ID NO: 32646 - DNA, 27 bp, Artificial Sequence
  Synthetic
cttcgtgtcucctaaataaagcaaugt

SEQ ID NO: 32647 - DNA, 29 bp, Artificial Sequence
  Synthetic
cctatatatcagcuggaaaggagagaguc

SEQ ID NO: 32648 - DNA, 29 bp, Artificial Sequence
  Synthetic
tcatatccatuaaaacttgcttaccugct

SEQ ID NO: 32649 - DNA, 23 bp, Artificial Sequence
  Synthetic
aagctgtugcacactgctaaauc

SEQ ID NO: 32650 - DNA, 22 bp, Artificial Sequence
  Synthetic
tgtccaaaugaagcccuaagcc

SEQ ID NO: 32651 - DNA, 23 bp, Artificial Sequence
  Synthetic
tcaauatctccugggagaagcca

SEQ ID NO: 32652 - DNA, 28 bp, Artificial Sequence
  Synthetic
aatttgaggaaacauttgcatucagagg

SEQ ID NO: 32653 - DNA, 28 bp, Artificial Sequence
  Synthetic
gtagaatcggccaaugaaaatgcatuaa

SEQ ID NO: 32654 - DNA, 22 bp, Artificial Sequence
  Synthetic
gggaatcucagccttggatuct

SEQ ID NO: 32655 - DNA, 23 bp, Artificial Sequence
  Synthetic
cagctaccauctggaatctggut

SEQ ID NO: 32656 - DNA, 28 bp, Artificial Sequence
  Synthetic
acagagtcugagccaataggaatgauat

SEQ ID NO: 32657 - DNA, 29 bp, Artificial Sequence
  Synthetic
ttcaccaacttgugaaatgtaactttgut

SEQ ID NO: 32658 - DNA, 27 bp, Artificial Sequence
  Synthetic
ccatccctgaguaaactgtaaguaagc

SEQ ID NO: 32659 - DNA, 28 bp, Artificial Sequence
  Synthetic
tgctggatatctuacttcagtttgctut

SEQ ID NO: 32660 - DNA, 21 bp, Artificial Sequence
  Synthetic
cacugggaacacaagcaucac

SEQ ID NO: 32661 - DNA, 30 bp, Artificial Sequence
  Synthetic
tcttactctacaaugctattggtaggtgua

SEQ ID NO: 32662 - DNA, 22 bp, Artificial Sequence
  Synthetic
acacacugaccagtcaggcuat

SEQ ID NO: 32663 - DNA, 29 bp, Artificial Sequence
  Synthetic
cttggtagagtatuctgtttttctgtgua

SEQ ID NO: 32664 - DNA, 23 bp, Artificial Sequence
  Synthetic
ggtcaaatugtacctgugaggct

SEQ ID NO: 32665 - DNA, 22 bp, Artificial Sequence
  Synthetic
catcugcaagcccaatgtugaa

SEQ ID NO: 32666 - DNA, 25 bp, Artificial Sequence
  Synthetic
cactgaagtccuttggcttctttut

SEQ ID NO: 32667 - DNA, 27 bp, Artificial Sequence
  Synthetic
gaatgaaatcautttcccatccucacc

SEQ ID NO: 32668 - DNA, 22 bp, Artificial Sequence
  Synthetic
agccatcaggauccaactctug

SEQ ID NO: 32669 - DNA, 31 bp, Artificial Sequence
  Synthetic
cctgtcttgtaccuaatgagcaaattatcua

SEQ ID NO: 32670 - DNA, 25 bp, Artificial Sequence
  Synthetic
tgcautgtagauagaagcacacagg

SEQ ID NO: 32671 - DNA, 28 bp, Artificial Sequence
  Synthetic
tcaattguaaaccttgtcaaugcaacag

SEQ ID NO: 32672 - DNA, 26 bp, Artificial Sequence
  Synthetic
aatgtaaagctugaaatctggctugc

SEQ ID NO: 32673 - DNA, 24 bp, Artificial Sequence
  Synthetic
gagttcguaaaagccacgcaaaua

SEQ ID NO: 32674 - DNA, 21 bp, Artificial Sequence
  Synthetic
gaagtcuccaccagccuagag

SEQ ID NO: 32675 - DNA, 24 bp, Artificial Sequence
  Synthetic
aggaattgtggugcttttggaaug

SEQ ID NO: 32676 - DNA, 24 bp, Artificial Sequence
  Synthetic
gacatgaagtutgtgggcattugt

SEQ ID NO: 32677 - DNA, 27 bp, Artificial Sequence
  Synthetic
gataatagagtgucacggttgaaucct

SEQ ID NO: 32678 - DNA, 27 bp, Artificial Sequence
  Synthetic
agtgaattcagcauttatccttucggt

SEQ ID NO: 32679 - DNA, 29 bp, Artificial Sequence
  Synthetic
ggtattgcttgguaaacagagacttctua

SEQ ID NO: 32680 - DNA, 26 bp, Artificial Sequence
  Synthetic
atttctucacaagaattcuccccagt

SEQ ID NO: 32681 - DNA, 24 bp, Artificial Sequence
  Synthetic
tctcttttccggutgcttccuaag

SEQ ID NO: 32682 - DNA, 22 bp, Artificial Sequence
  Synthetic
ctatgggcgutaggaugcagat

SEQ ID NO: 32683 - DNA, 22 bp, Artificial Sequence
  Synthetic
gaaaguttccatcgugccaacc

SEQ ID NO: 32684 - DNA, 24 bp, Artificial Sequence
  Synthetic
ccaatgaaagaacugggcaatuca

SEQ ID NO: 32685 - DNA, 25 bp, Artificial Sequence
  Synthetic
gataccagcagcuactcatgtctuc

SEQ ID NO: 32686 - DNA, 22 bp, Artificial Sequence
  Synthetic
ctcugacagugaggaagaagug

SEQ ID NO: 32687 - DNA, 23 bp, Artificial Sequence
  Synthetic
gcatcagggaaugaatgtcuggt

SEQ ID NO: 32688 - DNA, 22 bp, Artificial Sequence
  Synthetic
agagcugaccctcaaauacgga

SEQ ID NO: 32689 - DNA, 22 bp, Artificial Sequence
  Synthetic
cagguacagugaccaacacagg

SEQ ID NO: 32690 - DNA, 20 bp, Artificial Sequence
  Synthetic
tcctcaacuccgtgcugaac

SEQ ID NO: 32691 - DNA, 24 bp, Artificial Sequence
  Synthetic
gtgtttttcuaaaggcggctgtut

SEQ ID NO: 32692 - DNA, 21 bp, Artificial Sequence
  Synthetic
ggttgggacugaatggtggua

SEQ ID NO: 32693 - DNA, 23 bp, Artificial Sequence
  Synthetic
gcactgaucatgatgagguaggc

SEQ ID NO: 32694 - DNA, 24 bp, Artificial Sequence
  Synthetic
tgacaaggaugtctctgtctucct

SEQ ID NO: 32695 - DNA, 21 bp, Artificial Sequence
  Synthetic
cccagucaactcugaaagcca

SEQ ID NO: 32696 - DNA, 21 bp, Artificial Sequence
  Synthetic
agctttgtuccctgguaacac

SEQ ID NO: 32697 - DNA, 21 bp, Artificial Sequence
  Synthetic
cgtgtgaacaugggcacctua

SEQ ID NO: 32698 - DNA, 21 bp, Artificial Sequence
  Synthetic
gtccucgaacaagctcctgug

SEQ ID NO: 32699 - DNA, 21 bp, Artificial Sequence
  Synthetic
aaagaugagcccgaacgugat

SEQ ID NO: 32700 - DNA, 17 bp, Artificial Sequence
  Synthetic
gtggacggcucggtgut

SEQ ID NO: 32701 - DNA, 22 bp, Artificial Sequence
  Synthetic
gcctgaagaaucccacacucac

SEQ ID NO: 32702 - DNA, 21 bp, Artificial Sequence
  Synthetic
cccccaccuattctuccaagg

SEQ ID NO: 32703 - DNA, 24 bp, Artificial Sequence
  Synthetic
gcttgcugaacaaatctacugggt

SEQ ID NO: 32704 - DNA, 24 bp, Artificial Sequence
  Synthetic
ggatgctaccutttcagctgtcua

SEQ ID NO: 32705 - DNA, 22 bp, Artificial Sequence
  Synthetic
gcccagaggucttcattcucag

SEQ ID NO: 32706 - DNA, 24 bp, Artificial Sequence
  Synthetic
caaauttatgcagttugcaagcca

SEQ ID NO: 32707 - DNA, 25 bp, Artificial Sequence
  Synthetic
tcttcagauacggcagcaaaaucat

SEQ ID NO: 32708 - DNA, 27 bp, Artificial Sequence
  Synthetic
ccattactatuctgttggaccuccaaa

SEQ ID NO: 32709 - DNA, 25 bp, Artificial Sequence
  Synthetic
gttgctgctuggaaactttactuga

SEQ ID NO: 32710 - DNA, 25 bp, Artificial Sequence
  Synthetic
cautgggaaagauggagaaaagcaa

SEQ ID NO: 32711 - DNA, 23 bp, Artificial Sequence
  Synthetic
aaaugtaaccaggucaccagacc

SEQ ID NO: 32712 - DNA, 20 bp, Artificial Sequence
  Synthetic
gaccttuccgagccctctut

SEQ ID NO: 32713 - DNA, 20 bp, Artificial Sequence
  Synthetic
tctaggtgcuctccagggut

SEQ ID NO: 32714 - DNA, 17 bp, Artificial Sequence
  Synthetic
cccagccaugctgugct

SEQ ID NO: 32715 - DNA, 18 bp, Artificial Sequence
  Synthetic
gctucagacccgccagug

SEQ ID NO: 32716 - DNA, 22 bp, Artificial Sequence
  Synthetic
cgaaggugaaccagacacaguc

SEQ ID NO: 32717 - DNA, 25 bp, Artificial Sequence
  Synthetic
gtatactccacaaucctaccugcac

SEQ ID NO: 32718 - DNA, 20 bp, Artificial Sequence
  Synthetic
gguggagggaugccagaaac

SEQ ID NO: 32719 - DNA, 17 bp, Artificial Sequence
  Synthetic
ggccaacgugggcuacc

SEQ ID NO: 32720 - DNA, 23 bp, Artificial Sequence
  Synthetic
ctcattagggcccuctcctctua

SEQ ID NO: 32721 - DNA, 23 bp, Artificial Sequence
  Synthetic
gcacttcgcuttcttttgauccc

SEQ ID NO: 32722 - DNA, 22 bp, Artificial Sequence
  Synthetic
tggtgagatgguccctgagaut

SEQ ID NO: 32723 - DNA, 21 bp, Artificial Sequence
  Synthetic
gctgttucccttgtggauccg

SEQ ID NO: 32724 - DNA, 21 bp, Artificial Sequence
  Synthetic
agggaucagcaggcactgaua

SEQ ID NO: 32725 - DNA, 21 bp, Artificial Sequence
  Synthetic
cgtgtgcacugacacctaugt

SEQ ID NO: 32726 - DNA, 26 bp, Artificial Sequence
  Synthetic
tgcaccacacuttatttaacgcttug

SEQ ID NO: 32727 - DNA, 22 bp, Artificial Sequence
  Synthetic
gacagugaggaccccaaaugag

SEQ ID NO: 32728 - DNA, 24 bp, Artificial Sequence
  Synthetic
aaggaaaguaaaaccctgtgcuca

SEQ ID NO: 32729 - DNA, 18 bp, Artificial Sequence
  Synthetic
cctccugcagaccuccca

SEQ ID NO: 32730 - DNA, 20 bp, Artificial Sequence
  Synthetic
cagagtccccauggagctug

SEQ ID NO: 32731 - DNA, 20 bp, Artificial Sequence
  Synthetic
tgggatacuggcaggaugct

SEQ ID NO: 32732 - DNA, 22 bp, Artificial Sequence
  Synthetic
tgcagttccuttcctgtgtuca

SEQ ID NO: 32733 - DNA, 30 bp, Artificial Sequence
  Synthetic
tctcaaaactagaagugtaagctggauaga

SEQ ID NO: 32734 - DNA, 18 bp, Artificial Sequence
  Synthetic
ggtgggcucaggtuggaa

SEQ ID NO: 32735 - DNA, 17 bp, Artificial Sequence
  Synthetic
ggcuccagccggctuac

SEQ ID NO: 32736 - DNA, 23 bp, Artificial Sequence
  Synthetic
cctctggtcuactctctgctcuc

SEQ ID NO: 32737 - DNA, 20 bp, Artificial Sequence
  Synthetic
ctcaccgucaaagacugcac

SEQ ID NO: 32738 - DNA, 20 bp, Artificial Sequence
  Synthetic
gcactctuagcaccccaucc

SEQ ID NO: 32739 - DNA, 23 bp, Artificial Sequence
  Synthetic
gctttgggcaagutttcacucac

SEQ ID NO: 32740 - DNA, 20 bp, Artificial Sequence
  Synthetic
gctgugagaaccuggcacat

SEQ ID NO: 32741 - DNA, 21 bp, Artificial Sequence
  Synthetic
gatttggcucaggtgaugggt

SEQ ID NO: 32742 - DNA, 19 bp, Artificial Sequence
  Synthetic
gaccaccacccuctgtuca

SEQ ID NO: 32743 - DNA, 29 bp, Artificial Sequence
  Synthetic
ggaaaaatacgaucatgactugggaaaaa

SEQ ID NO: 32744 - DNA, 20 bp, Artificial Sequence
  Synthetic
ttgcugaaaccgtgaguacc

SEQ ID NO: 32745 - DNA, 22 bp, Artificial Sequence
  Synthetic
ccttggguagcttgatctugcc

SEQ ID NO: 32746 - DNA, 21 bp, Artificial Sequence
  Synthetic
ctccaggagguggtagaugga

SEQ ID NO: 32747 - DNA, 22 bp, Artificial Sequence
  Synthetic
ccaaatgtcuagaccccaccug

SEQ ID NO: 32748 - DNA, 19 bp, Artificial Sequence
  Synthetic
gggaacugccaagcaauga

SEQ ID NO: 32749 - DNA, 18 bp, Artificial Sequence
  Synthetic
gugaccacaggccucact

SEQ ID NO: 32750 - DNA, 22 bp, Artificial Sequence
  Synthetic
gggatctaacuctctgggcuag

SEQ ID NO: 32751 - DNA, 23 bp, Artificial Sequence
  Synthetic
acacaccctuatcaccccauaga

SEQ ID NO: 32752 - DNA, 22 bp, Artificial Sequence
  Synthetic
cacauggctcuggagaagacat

SEQ ID NO: 32753 - DNA, 21 bp, Artificial Sequence
  Synthetic
cgccaaagauctcgatcucgt

SEQ ID NO: 32754 - DNA, 23 bp, Artificial Sequence
  Synthetic
ctgggtaagggaugctgattcut

SEQ ID NO: 32755 - DNA, 24 bp, Artificial Sequence
  Synthetic
gatctggatauagaccagccucac

SEQ ID NO: 32756 - DNA, 18 bp, Artificial Sequence
  Synthetic
cgcctagugcgcctugat

SEQ ID NO: 32757 - DNA, 21 bp, Artificial Sequence
  Synthetic
ctggctucaccttccctcuac

SEQ ID NO: 32758 - DNA, 24 bp, Artificial Sequence
  Synthetic
cactctcctcautctgtgtgctua

SEQ ID NO: 32759 - DNA, 21 bp, Artificial Sequence
  Synthetic
ggtgcagaugtcaaagtuggg

SEQ ID NO: 32760 - DNA, 19 bp, Artificial Sequence
  Synthetic
ggatucaggccagtgcgut

SEQ ID NO: 32761 - DNA, 22 bp, Artificial Sequence
  Synthetic
ccatcatcuccccttccccuac

SEQ ID NO: 32762 - DNA, 21 bp, Artificial Sequence
  Synthetic
gtcagagagcgcuacctctug

SEQ ID NO: 32763 - DNA, 29 bp, Artificial Sequence
  Synthetic
ggagcccacaaauaagtaaacagtacaua

SEQ ID NO: 32764 - DNA, 25 bp, Artificial Sequence
  Synthetic
cttgtttccttucctttgctgtugt

SEQ ID NO: 32765 - DNA, 24 bp, Artificial Sequence
  Synthetic
gttagggacgucttcgaggattua

SEQ ID NO: 32766 - DNA, 20 bp, Artificial Sequence
  Synthetic
caggagtgcutggtccguat

SEQ ID NO: 32767 - DNA, 24 bp, Artificial Sequence
  Synthetic
ctactaugaactcccugaggcaga

SEQ ID NO: 32768 - DNA, 23 bp, Artificial Sequence
  Synthetic
ggtagtttcgagcucttgtccug

SEQ ID NO: 32769 - DNA, 22 bp, Artificial Sequence
  Synthetic
gtctcaccgaucttttcgucct

SEQ ID NO: 32770 - DNA, 24 bp, Artificial Sequence
  Synthetic
gagtgtcctugaagcatctcauct

SEQ ID NO: 32771 - DNA, 20 bp, Artificial Sequence
  Synthetic
cgagagcccaccauggttug

SEQ ID NO: 32772 - DNA, 20 bp, Artificial Sequence
  Synthetic
ctgttcugtgcccucagcat

SEQ ID NO: 32773 - DNA, 18 bp, Artificial Sequence
  Synthetic
cctgtggcugggcaaguc

SEQ ID NO: 32774 - DNA, 29 bp, Artificial Sequence
  Synthetic
actgtgttggaaaucttaatgagaacuat

SEQ ID NO: 32775 - DNA, 21 bp, Artificial Sequence
  Synthetic
gggaaucggaaggacacugac

SEQ ID NO: 32776 - DNA, 24 bp, Artificial Sequence
  Synthetic
ttggccaaaaacuacctctctgut

SEQ ID NO: 32777 - DNA, 22 bp, Artificial Sequence
  Synthetic
gggcuggaggaagtagactuac

SEQ ID NO: 32778 - DNA, 20 bp, Artificial Sequence
  Synthetic
cagttgaccuccgggatcuc

SEQ ID NO: 32779 - DNA, 21 bp, Artificial Sequence
  Synthetic
cucccccatuagacccagagt

SEQ ID NO: 32780 - DNA, 19 bp, Artificial Sequence
  Synthetic
ctggugaagccctucagct

SEQ ID NO: 32781 - DNA, 23 bp, Artificial Sequence
  Synthetic
gggagaaggaaaugatggaagug

SEQ ID NO: 32782 - DNA, 24 bp, Artificial Sequence
  Synthetic
acccaaaaguaaatgccucaggac

SEQ ID NO: 32783 - DNA, 25 bp, Artificial Sequence
  Synthetic
atcttgatttcugcctgctcttuct

SEQ ID NO: 32784 - DNA, 21 bp, Artificial Sequence
  Synthetic
cccttguaccaagcaccuagc

SEQ ID NO: 32785 - DNA, 23 bp, Artificial Sequence
  Synthetic
tgttgggcacagcauaatagugt

SEQ ID NO: 32786 - DNA, 20 bp, Artificial Sequence
  Synthetic
acctgacccuctaggcugac

SEQ ID NO: 32787 - DNA, 22 bp, Artificial Sequence
  Synthetic
cgtggaugtccttuccagcaat

SEQ ID NO: 32788 - DNA, 24 bp, Artificial Sequence
  Synthetic
gttggagcugagatgttuagagca

SEQ ID NO: 32789 - DNA, 28 bp, Artificial Sequence
  Synthetic
caccagctatttutcttccactttguag

SEQ ID NO: 32790 - DNA, 22 bp, Artificial Sequence
  Synthetic
gctccugacccgtguaaaaagg

SEQ ID NO: 32791 - DNA, 21 bp, Artificial Sequence
  Synthetic
cacttgucagagctgguggag

SEQ ID NO: 32792 - DNA, 22 bp, Artificial Sequence
  Synthetic
ccucaagaagaugcccagcaaa

SEQ ID NO: 32793 - DNA, 21 bp, Artificial Sequence
  Synthetic
gcugagatcgucaccaagacc

SEQ ID NO: 32794 - DNA, 27 bp, Artificial Sequence
  Synthetic
attaaagaatccautctgaggcuacgg

SEQ ID NO: 32795 - DNA, 22 bp, Artificial Sequence
  Synthetic
cgtgttgagguggcttttccut

SEQ ID NO: 32796 - DNA, 20 bp, Artificial Sequence
  Synthetic
cccttgctaugctcccctuc

SEQ ID NO: 32797 - DNA, 21 bp, Artificial Sequence
  Synthetic
actacuctgagcugagccagt

SEQ ID NO: 32798 - DNA, 22 bp, Artificial Sequence
  Synthetic
agacaaugacaggcttctuggg

SEQ ID NO: 32799 - DNA, 24 bp, Artificial Sequence
  Synthetic
gggtgtcacauagatcctgaguga

SEQ ID NO: 32800 - DNA, 20 bp, Artificial Sequence
  Synthetic
gagtgccacaaugcgaaugg

SEQ ID NO: 32801 - DNA, 22 bp, Artificial Sequence
  Synthetic
tgaggtcattutgaggctgtug

SEQ ID NO: 32802 - DNA, 24 bp, Artificial Sequence
  Synthetic
ggaaagtatgucccacttcucagg

SEQ ID NO: 32803 - DNA, 23 bp, Artificial Sequence
  Synthetic
tttggcatcucaggttttccuca

SEQ ID NO: 32804 - DNA, 24 bp, Artificial Sequence
  Synthetic
ccagaggagggauggaaacactua

SEQ ID NO: 32805 - DNA, 29 bp, Artificial Sequence
  Synthetic
cttatatcctucctgtttcttttcuggca

SEQ ID NO: 32806 - DNA, 23 bp, Artificial Sequence
  Synthetic
aatgtaatgaggugctcgtccug

SEQ ID NO: 32807 - DNA, 24 bp, Artificial Sequence
  Synthetic
cactcagtcuacgttgacucacat

SEQ ID NO: 32808 - DNA, 24 bp, Artificial Sequence
  Synthetic
ggccuaggaacaggaagacuacat

SEQ ID NO: 32809 - DNA, 22 bp, Artificial Sequence
  Synthetic
gctttgccuccttcctggauag

SEQ ID NO: 32810 - DNA, 22 bp, Artificial Sequence
  Synthetic
acagcacacagggautgaacug

SEQ ID NO: 32811 - DNA, 23 bp, Artificial Sequence
  Synthetic
gactgttcagugattggtcucct

SEQ ID NO: 32812 - DNA, 20 bp, Artificial Sequence
  Synthetic
gccccaucatgctgcauagg

SEQ ID NO: 32813 - DNA, 25 bp, Artificial Sequence
  Synthetic
gcactggatugagtctaccttcuct

SEQ ID NO: 32814 - DNA, 23 bp, Artificial Sequence
  Synthetic
gggatctcccutgaggtcaucat

SEQ ID NO: 32815 - DNA, 24 bp, Artificial Sequence
  Synthetic
caattcaugggagcctgtcattug

SEQ ID NO: 32816 - DNA, 23 bp, Artificial Sequence
  Synthetic
caggtaguactgtagcuccccat

SEQ ID NO: 32817 - DNA, 28 bp, Artificial Sequence
  Synthetic
gcagatcagagguctagttctgtaaugt

SEQ ID NO: 32818 - DNA, 23 bp, Artificial Sequence
  Synthetic
agcaaacauggcacaaactugac

SEQ ID NO: 32819 - DNA, 22 bp, Artificial Sequence
  Synthetic
cctcatccccggutctttgtuc

SEQ ID NO: 32820 - DNA, 29 bp, Artificial Sequence
  Synthetic
caatcttccccaautattggtgaaucaaa

SEQ ID NO: 32821 - DNA, 28 bp, Artificial Sequence
  Synthetic
gcctcatttgtcuaactgttgaactuct

SEQ ID NO: 32822 - DNA, 22 bp, Artificial Sequence
  Synthetic
gtcaacacguagaaagguggct

SEQ ID NO: 32823 - DNA, 26 bp, Artificial Sequence
  Synthetic
ggtaatttctgucctccaattccgua

SEQ ID NO: 32824 - DNA, 22 bp, Artificial Sequence
  Synthetic
ccaguatcctcugcaggaaagt

SEQ ID NO: 32825 - DNA, 22 bp, Artificial Sequence
  Synthetic
gtgaauaggcgttctcauccct

SEQ ID NO: 32826 - DNA, 27 bp, Artificial Sequence
  Synthetic
tgaaacaaggcuacattttggtcaaug

SEQ ID NO: 32827 - DNA, 24 bp, Artificial Sequence
  Synthetic
cactttauggccaataaacgcugt

SEQ ID NO: 32828 - DNA, 22 bp, Artificial Sequence
  Synthetic
gccgagcaagugagtttuccat

SEQ ID NO: 32829 - DNA, 30 bp, Artificial Sequence
  Synthetic
ggacaagaaccuatgatactgatgaatugt

SEQ ID NO: 32830 - DNA, 24 bp, Artificial Sequence
  Synthetic
aaaagaaacaagcacutaggcugt

SEQ ID NO: 32831 - DNA, 24 bp, Artificial Sequence
  Synthetic
ttaatggtggugttacctgctcuc

SEQ ID NO: 32832 - DNA, 24 bp, Artificial Sequence
  Synthetic
aaaaugcatcaataucccgagggt

SEQ ID NO: 32833 - DNA, 25 bp, Artificial Sequence
  Synthetic
gtgggctauggattgtcaaguagaa

SEQ ID NO: 32834 - DNA, 27 bp, Artificial Sequence
  Synthetic
ctagagagcutgtttacacuagaaggg

SEQ ID NO: 32835 - DNA, 28 bp, Artificial Sequence
  Synthetic
gccctctttttcuaatccttcattgtut

SEQ ID NO: 32836 - DNA, 21 bp, Artificial Sequence
  Synthetic
ccaggtucactagcacauggt

SEQ ID NO: 32837 - DNA, 29 bp, Artificial Sequence
  Synthetic
cgttctcaatatuggttggttgtttctug

SEQ ID NO: 32838 - DNA, 21 bp, Artificial Sequence
  Synthetic
acctcatagguctcccgaguc

SEQ ID NO: 32839 - DNA, 27 bp, Artificial Sequence
  Synthetic
gttctgccautcaatatcacatugcat

SEQ ID NO: 32840 - DNA, 22 bp, Artificial Sequence
  Synthetic
cgttgagccutgtctcccauac

SEQ ID NO: 32841 - DNA, 22 bp, Artificial Sequence
  Synthetic
cctgctcaugtcaaagctucaa

SEQ ID NO: 32842 - DNA, 17 bp, Artificial Sequence
  Synthetic
gcttggcuccgccacuc

SEQ ID NO: 32843 - DNA, 18 bp, Artificial Sequence
  Synthetic
gggcgcacucacctcuac

SEQ ID NO: 32844 - DNA, 22 bp, Artificial Sequence
  Synthetic
agtgctctcucttcttggccua

SEQ ID NO: 32845 - DNA, 21 bp, Artificial Sequence
  Synthetic
ggataacagcggugtgtgguc

SEQ ID NO: 32846 - DNA, 21 bp, Artificial Sequence
  Synthetic
tgtcgaaucaaagccccuacc

SEQ ID NO: 32847 - DNA, 22 bp, Artificial Sequence
  Synthetic
gtaatugcatgatgugccccaa

SEQ ID NO: 32848 - DNA, 28 bp, Artificial Sequence
  Synthetic
ctatcacagcauatgacaaagaagtuga

SEQ ID NO: 32849 - DNA, 22 bp, Artificial Sequence
  Synthetic
ggactctgguctgtggactuac

SEQ ID NO: 32850 - DNA, 26 bp, Artificial Sequence
  Synthetic
cauagaattgtagugaacagcagcct

SEQ ID NO: 32851 - DNA, 20 bp, Artificial Sequence
  Synthetic
gagcctagccutgctgctua

SEQ ID NO: 32852 - DNA, 24 bp, Artificial Sequence
  Synthetic
cctgacatucccaccaccttacua

SEQ ID NO: 32853 - DNA, 25 bp, Artificial Sequence
  Synthetic
ttcattcaugcaggaaacaccaaug

SEQ ID NO: 32854 - DNA, 22 bp, Artificial Sequence
  Synthetic
tctgtgtgugctttgtggtuct

SEQ ID NO: 32855 - DNA, 26 bp, Artificial Sequence
  Synthetic
tcgtgctcttcuagggtttagactua

SEQ ID NO: 32856 - DNA, 24 bp, Artificial Sequence
  Synthetic
tcaaacccaugactggtctatugg

SEQ ID NO: 32857 - DNA, 26 bp, Artificial Sequence
  Synthetic
gcaaacattttuagctgggagactua

SEQ ID NO: 32858 - DNA, 28 bp, Artificial Sequence
  Synthetic
attatcaagugaaagaaaacacgcugac

SEQ ID NO: 32859 - DNA, 28 bp, Artificial Sequence
  Synthetic
aaactgctacctucttatcccacattut

SEQ ID NO: 32860 - DNA, 24 bp, Artificial Sequence
  Synthetic
ttcctgaccugggtttuagagaac

SEQ ID NO: 32861 - DNA, 23 bp, Artificial Sequence
  Synthetic
actcctgcauttctcggaaguac

SEQ ID NO: 32862 - DNA, 23 bp, Artificial Sequence
  Synthetic
ggcagaaacugcttgcaagttut

SEQ ID NO: 32863 - DNA, 21 bp, Artificial Sequence
  Synthetic
ccaaacccutccaggauagcc

SEQ ID NO: 32864 - DNA, 22 bp, Artificial Sequence
  Synthetic
gctttguggaaaggcttgcauc

SEQ ID NO: 32865 - DNA, 23 bp, Artificial Sequence
  Synthetic
caugcagagtauggaagggagac

SEQ ID NO: 32866 - DNA, 28 bp, Artificial Sequence
  Synthetic
caagcagacgutatttacgtcaauacac

SEQ ID NO: 32867 - DNA, 24 bp, Artificial Sequence
  Synthetic
agtcagatcutcccattccucact

SEQ ID NO: 32868 - DNA, 24 bp, Artificial Sequence
  Synthetic
cgatgaacutttgtttgcugacga

SEQ ID NO: 32869 - DNA, 28 bp, Artificial Sequence
  Synthetic
gacagcttactuaacaacattcatcugg

SEQ ID NO: 32870 - DNA, 23 bp, Artificial Sequence
  Synthetic
gctaagcucagctcattttcugc

SEQ ID NO: 32871 - DNA, 23 bp, Artificial Sequence
  Synthetic
aaaccacctuagggagactcugt

SEQ ID NO: 32872 - DNA, 21 bp, Artificial Sequence
  Synthetic
cctcgauggcactttucacct

SEQ ID NO: 32873 - DNA, 29 bp, Artificial Sequence
  Synthetic
ggacaataattcucatgcatggatttcut

SEQ ID NO: 32874 - DNA, 24 bp, Artificial Sequence
  Synthetic
tgtgttgaugacgatgacagugat

SEQ ID NO: 32875 - DNA, 25 bp, Artificial Sequence
  Synthetic
ccagatggguagttgtgggatttut

SEQ ID NO: 32876 - DNA, 25 bp, Artificial Sequence
  Synthetic
gatgacgtugacgatgaaguagagg

SEQ ID NO: 32877 - DNA, 25 bp, Artificial Sequence
  Synthetic
ttccaaaccucacttcctttcucag

SEQ ID NO: 32878 - DNA, 23 bp, Artificial Sequence
  Synthetic
gctgcagutctgttcaucaaagg

SEQ ID NO: 32879 - DNA, 27 bp, Artificial Sequence
  Synthetic
gccattttccucttttatcccaatugt

SEQ ID NO: 32880 - DNA, 29 bp, Artificial Sequence
  Synthetic
ccagatcttttcugaaggaatgtgaatut

SEQ ID NO: 32881 - DNA, 26 bp, Artificial Sequence
  Synthetic
gtcaatactgaautcccatgcacauc

SEQ ID NO: 32882 - DNA, 29 bp, Artificial Sequence
  Synthetic
ttggtatatatcccugttacccatatuga

SEQ ID NO: 32883 - DNA, 26 bp, Artificial Sequence
  Synthetic
ctctctcccccauaaaaatgatccut

SEQ ID NO: 32884 - DNA, 22 bp, Artificial Sequence
  Synthetic
cctccagcacuttagccucaaa

SEQ ID NO: 32885 - DNA, 23 bp, Artificial Sequence
  Synthetic
acaauagctctagugagccgact

SEQ ID NO: 32886 - DNA, 29 bp, Artificial Sequence
  Synthetic
agtcagatccaaautcattccctaaacuc

SEQ ID NO: 32887 - DNA, 22 bp, Artificial Sequence
  Synthetic
gtgagccuaccccagaaguaac

SEQ ID NO: 32888 - DNA, 27 bp, Artificial Sequence
  Synthetic
ctaaagacuacaccatgttactuggct

SEQ ID NO: 32889 - DNA, 27 bp, Artificial Sequence
  Synthetic
catgacugagatgaaattugcaagcat

SEQ ID NO: 32890 - DNA, 26 bp, Artificial Sequence
  Synthetic
aaggcttctuagagttttctgtgcut

SEQ ID NO: 32891 - DNA, 26 bp, Artificial Sequence
  Synthetic
cgacaguggaaagtacacaatuaagg

SEQ ID NO: 32892 - DNA, 28 bp, Artificial Sequence
  Synthetic
agaaatgttgaagutcttcagatgugga

SEQ ID NO: 32893 - DNA, 28 bp, Artificial Sequence
  Synthetic
cttcatcucacagcctagatcucaaaat

SEQ ID NO: 32894 - DNA, 23 bp, Artificial Sequence
  Synthetic
ccttcatctcugtgactggctug

SEQ ID NO: 32895 - DNA, 28 bp, Artificial Sequence
  Synthetic
tcagaactcatgcugagattaaagcaut

SEQ ID NO: 32896 - DNA, 23 bp, Artificial Sequence
  Synthetic
gaagcttccuctttgagggcuaa

SEQ ID NO: 32897 - DNA, 30 bp, Artificial Sequence
  Synthetic
gggtctctttcuaattaagtttgcctuaca

SEQ ID NO: 32898 - DNA, 30 bp, Artificial Sequence
  Synthetic
aaagagacattuaagaactggttaccttuc

SEQ ID NO: 32899 - DNA, 25 bp, Artificial Sequence
  Synthetic
aaccaaaagcucctgaaccaattuc

SEQ ID NO: 32900 - DNA, 29 bp, Artificial Sequence
  Synthetic
gccccataaatugtaagttggtttuagac

SEQ ID NO: 32901 - DNA, 24 bp, Artificial Sequence
  Synthetic
cctgtgtggutgaaagcagtguat

SEQ ID NO: 32902 - DNA, 24 bp, Artificial Sequence
  Synthetic
gggtgagaaggutctggagattuc

SEQ ID NO: 32903 - DNA, 23 bp, Artificial Sequence
  Synthetic
gagatctctucagtccaggctuc

SEQ ID NO: 32904 - DNA, 20 bp, Artificial Sequence
  Synthetic
cctcguagacggtcauggac

SEQ ID NO: 32905 - DNA, 24 bp, Artificial Sequence
  Synthetic
atctgagauggaagcttcgtctuc

SEQ ID NO: 32906 - DNA, 22 bp, Artificial Sequence
  Synthetic
cgttgcatagucagaagctucg

SEQ ID NO: 32907 - DNA, 22 bp, Artificial Sequence
  Synthetic
ccatguggccaaaatacacgut

SEQ ID NO: 32908 - DNA, 28 bp, Artificial Sequence
  Synthetic
ctttcatggacucataccuggaaaagat

SEQ ID NO: 32909 - DNA, 23 bp, Artificial Sequence
  Synthetic
cgctccctguctccaacttauat

SEQ ID NO: 32910 - DNA, 24 bp, Artificial Sequence
  Synthetic
ctttgacaugaagtcaagtucgct

SEQ ID NO: 32911 - DNA, 28 bp, Artificial Sequence
  Synthetic
ggaggaaauaagaaaagacutcagguat

SEQ ID NO: 32912 - DNA, 29 bp, Artificial Sequence
  Synthetic
ctctcttcctcugttcttttcattgcuaa

SEQ ID NO: 32913 - DNA, 24 bp, Artificial Sequence
  Synthetic
ggcgtatucctaaactgucccaag

SEQ ID NO: 32914 - DNA, 23 bp, Artificial Sequence
  Synthetic
gggtcgttuctgtacaactcugt

SEQ ID NO: 32915 - DNA, 30 bp, Artificial Sequence
  Synthetic
gggaatucagacttgagauagaagaaaaga

SEQ ID NO: 32916 - DNA, 26 bp, Artificial Sequence
  Synthetic
agaatttcagccautctgagggttut

SEQ ID NO: 32917 - DNA, 24 bp, Artificial Sequence
  Synthetic
ggcttggautattatgctcugcac

SEQ ID NO: 32918 - DNA, 23 bp, Artificial Sequence
  Synthetic
gccagtaaccutttgaacauggg

SEQ ID NO: 32919 - DNA, 24 bp, Artificial Sequence
  Synthetic
aggtcagaaaaucaaaccagguga

SEQ ID NO: 32920 - DNA, 23 bp, Artificial Sequence
  Synthetic
tcattgtgtcugttctgcgctua

SEQ ID NO: 32921 - DNA, 27 bp, Artificial Sequence
  Synthetic
gagaacagugagaaatacgaaaucacc

SEQ ID NO: 32922 - DNA, 26 bp, Artificial Sequence
  Synthetic
caatggaugccactttaacttuagca

SEQ ID NO: 32923 - DNA, 22 bp, Artificial Sequence
  Synthetic
gaaatctcgcaugacagcaucg

SEQ ID NO: 32924 - DNA, 21 bp, Artificial Sequence
  Synthetic
agccaggaaugggttgauacc

SEQ ID NO: 32925 - DNA, 30 bp, Artificial Sequence
  Synthetic
aaaccagaagaagcuctaccattaaaauca

SEQ ID NO: 32926 - DNA, 30 bp, Artificial Sequence
  Synthetic
ctctttcattaagutcaaaagcacttgugt

SEQ ID NO: 32927 - DNA, 27 bp, Artificial Sequence
  Synthetic
ctcaaagaagacauacatggccaaaut

SEQ ID NO: 32928 - DNA, 25 bp, Artificial Sequence
  Synthetic
gatgctttagucatggagactuccc

SEQ ID NO: 32929 - DNA, 22 bp, Artificial Sequence
  Synthetic
gaaagatggcuccgtguaggac

SEQ ID NO: 32930 - DNA, 21 bp, Artificial Sequence
  Synthetic
ggucaggaacaucagccacat

SEQ ID NO: 32931 - DNA, 23 bp, Artificial Sequence
  Synthetic
ccuggcagaaaggauaagatcuc

SEQ ID NO: 32932 - DNA, 25 bp, Artificial Sequence
  Synthetic
ctccacccccaagutaataacucat

SEQ ID NO: 32933 - DNA, 29 bp, Artificial Sequence
  Synthetic
ggcaaagaaatcautgcagatggatuaaa

SEQ ID NO: 32934 - DNA, 23 bp, Artificial Sequence
  Synthetic
ttcctcttuaaagtgtggugcct

SEQ ID NO: 32935 - DNA, 29 bp, Artificial Sequence
  Synthetic
cgtgagaagaaguagaauaaatggattuc

SEQ ID NO: 32936 - DNA, 28 bp, Artificial Sequence
  Synthetic
tgcaaagauggaactttaccauaggaag

SEQ ID NO: 32937 - DNA, 22 bp, Artificial Sequence
  Synthetic
ggtgtctucagccatctcagug

SEQ ID NO: 32938 - DNA, 27 bp, Artificial Sequence
  Synthetic
gggaaaatacaautgtggtggtttuca

SEQ ID NO: 32939 - DNA, 25 bp, Artificial Sequence
  Synthetic
cgtaagactcaugctgggaaauaca

SEQ ID NO: 32940 - DNA, 21 bp, Artificial Sequence
  Synthetic
ccauggaaccaagtcauggca

SEQ ID NO: 32941 - DNA, 26 bp, Artificial Sequence
  Synthetic
ccaatgaggutggagaaguagaaacc

SEQ ID NO: 32942 - DNA, 23 bp, Artificial Sequence
  Synthetic
ttccggcttugtatgagctctut

SEQ ID NO: 32943 - DNA, 31 bp, Artificial Sequence
  Synthetic
cctgatauacaaggauaaaggattacagaut

SEQ ID NO: 32944 - DNA, 27 bp, Artificial Sequence
  Synthetic
gtgaattgcttguccttaatacgtucc

SEQ ID NO: 32945 - DNA, 28 bp, Artificial Sequence
  Synthetic
ccagtaaagcugactcccttttcatuat

SEQ ID NO: 32946 - DNA, 23 bp, Artificial Sequence
  Synthetic
ttgtggtggugatctgagtctug

SEQ ID NO: 32947 - DNA, 28 bp, Artificial Sequence
  Synthetic
gggactgtattcuaatacatgtgtgcut

SEQ ID NO: 32948 - DNA, 26 bp, Artificial Sequence
  Synthetic
tgctgaaacacggaaauggtattcua

SEQ ID NO: 32949 - DNA, 23 bp, Artificial Sequence
  Synthetic
agaagggccacuggaatatgaug

SEQ ID NO: 32950 - DNA, 25 bp, Artificial Sequence
  Synthetic
cagtgtgtguttcagatgtugcaat

SEQ ID NO: 32951 - DNA, 22 bp, Artificial Sequence
  Synthetic
cttagtcccccuaccccaaaug

SEQ ID NO: 32952 - DNA, 23 bp, Artificial Sequence
  Synthetic
ctctcgaatcutggttggagugg

SEQ ID NO: 32953 - DNA, 29 bp, Artificial Sequence
  Synthetic
caactttgcagcaacuttaaccagtauat

SEQ ID NO: 32954 - DNA, 20 bp, Artificial Sequence
  Synthetic
ggagcgguaccgtgtcatug

SEQ ID NO: 32955 - DNA, 23 bp, Artificial Sequence
  Synthetic
tcgtgttaaccuctgtcttgcug

SEQ ID NO: 32956 - DNA, 22 bp, Artificial Sequence
  Synthetic
gatgagcgucacgttgttcuac

SEQ ID NO: 32957 - DNA, 30 bp, Artificial Sequence
  Synthetic
gttcagtcacccaautttgatttgaaguaa

SEQ ID NO: 32958 - DNA, 26 bp, Artificial Sequence
  Synthetic
gtggtttcacggauggttaattuagc

SEQ ID NO: 32959 - DNA, 26 bp, Artificial Sequence
  Synthetic
aatgcctgattuctttcccatagugt

SEQ ID NO: 32960 - DNA, 25 bp, Artificial Sequence
  Synthetic
gtgctctaggacugtgggtttuaag

SEQ ID NO: 32961 - DNA, 23 bp, Artificial Sequence
  Synthetic
gcatuggagaaccttgugaaaca

SEQ ID NO: 32962 - DNA, 27 bp, Artificial Sequence
  Synthetic
tctcaacgaugtaattgttgacuggag

SEQ ID NO: 32963 - DNA, 27 bp, Artificial Sequence
  Synthetic
tgatcacctctcuagaaaggaactaug

SEQ ID NO: 32964 - DNA, 22 bp, Artificial Sequence
  Synthetic
tgagtagctcucagtggtguca

SEQ ID NO: 32965 - DNA, 26 bp, Artificial Sequence
  Synthetic
tttcttctcacaccugtccatgaaut

SEQ ID NO: 32966 - DNA, 23 bp, Artificial Sequence
  Synthetic
gcaattgatucgctgtatucgct

SEQ ID NO: 32967 - DNA, 28 bp, Artificial Sequence
  Synthetic
ggtactgacatugtaggatatgttcugg

SEQ ID NO: 32968 - DNA, 30 bp, Artificial Sequence
  Synthetic
agagattgtgtgutggaaaattatctguca

SEQ ID NO: 32969 - DNA, 24 bp, Artificial Sequence
  Synthetic
atggagggtugtgattaccagtuc

SEQ ID NO: 32970 - DNA, 26 bp, Artificial Sequence
  Synthetic
tgatttcatugccaccatcagatuca

SEQ ID NO: 32971 - DNA, 23 bp, Artificial Sequence
  Synthetic
gaagggagaaggguagucttauc

SEQ ID NO: 32972 - DNA, 23 bp, Artificial Sequence
  Synthetic
gttcttgaugagcctgguaacga

SEQ ID NO: 32973 - DNA, 24 bp, Artificial Sequence
  Synthetic
ggcttgtcautacacctgttucag

SEQ ID NO: 32974 - DNA, 21 bp, Artificial Sequence
  Synthetic
cagttgcucgtttgccaguat

SEQ ID NO: 32975 - DNA, 29 bp, Artificial Sequence
  Synthetic
ttcattcatatcugttttgcctacugaca

SEQ ID NO: 32976 - DNA, 25 bp, Artificial Sequence
  Synthetic
gctaacacacggaacucataagugt

SEQ ID NO: 32977 - DNA, 28 bp, Artificial Sequence
  Synthetic
agatcaacagtaucactgatttggtcug

SEQ ID NO: 32978 - DNA, 28 bp, Artificial Sequence
  Synthetic
agttctgaactgauattccagtcctuct

SEQ ID NO: 32979 - DNA, 19 bp, Artificial Sequence
  Synthetic
gcgctccuaccagaccuga

SEQ ID NO: 32980 - DNA, 22 bp, Artificial Sequence
  Synthetic
ctggaatugacaagcugccaag

SEQ ID NO: 32981 - DNA, 25 bp, Artificial Sequence
  Synthetic
ccctggaaaauacagctggtgtuaa

SEQ ID NO: 32982 - DNA, 22 bp, Artificial Sequence
  Synthetic
caggacgaccacugattgguac

SEQ ID NO: 32983 - DNA, 26 bp, Artificial Sequence
  Synthetic
gtagagcgtcutgttgagaaaacuga

SEQ ID NO: 32984 - DNA, 23 bp, Artificial Sequence
  Synthetic
tggtcaggtutaagccaagcuaa

SEQ ID NO: 32985 - DNA, 24 bp, Artificial Sequence
  Synthetic
ggcaggttaucagtgaaaaaugca

SEQ ID NO: 32986 - DNA, 22 bp, Artificial Sequence
  Synthetic
gcctggagugtctagcacttuc

SEQ ID NO: 32987 - DNA, 24 bp, Artificial Sequence
  Synthetic
gcaaaccagacuctaacctuagcc

SEQ ID NO: 32988 - DNA, 26 bp, Artificial Sequence
  Synthetic
acaacatgaguctgtttgaagttugc

SEQ ID NO: 32989 - DNA, 22 bp, Artificial Sequence
  Synthetic
acutaggagacuggcacaaggt

SEQ ID NO: 32990 - DNA, 22 bp, Artificial Sequence
  Synthetic
ggttgacgggcuctctacatut

SEQ ID NO: 32991 - DNA, 29 bp, Artificial Sequence
  Synthetic
ggcagtgaaatucaacagtatatcctuga

SEQ ID NO: 32992 - DNA, 26 bp, Artificial Sequence
  Synthetic
acataguaccgcttaguaaaaacgca

SEQ ID NO: 32993 - DNA, 27 bp, Artificial Sequence
  Synthetic
cuacatcatugaaaaaugggaaaccag

SEQ ID NO: 32994 - DNA, 28 bp, Artificial Sequence
  Synthetic
ctagagttagtutctttttccttgucca

SEQ ID NO: 32995 - DNA, 25 bp, Artificial Sequence
  Synthetic
ttggauccaccagcctatttgtuag

SEQ ID NO: 32996 - DNA, 26 bp, Artificial Sequence
  Synthetic
tggtcttcctugtaccaaagcttuaa

SEQ ID NO: 32997 - DNA, 27 bp, Artificial Sequence
  Synthetic
ccttgtgatauggcactacugaaaaat

SEQ ID NO: 32998 - DNA, 23 bp, Artificial Sequence
  Synthetic
tgacgtcaguaaagttgcatcuc

SEQ ID NO: 32999 - DNA, 28 bp, Artificial Sequence
  Synthetic
gacctggttacaaaugtaatgatgcaut

SEQ ID NO: 33000 - DNA, 27 bp, Artificial Sequence
  Synthetic
tcagcatauacacggaattggtaaucc

SEQ ID NO: 33001 - DNA, 24 bp, Artificial Sequence
  Synthetic
cccccaggaaagucagutatauac

SEQ ID NO: 33002 - DNA, 22 bp, Artificial Sequence
  Synthetic
gtcgttcuggcaacactugaac

SEQ ID NO: 33003 - DNA, 27 bp, Artificial Sequence
  Synthetic
gataatgcagtgugtagaattgcaguc

SEQ ID NO: 33004 - DNA, 23 bp, Artificial Sequence
  Synthetic
ctgatggauggtttgggtttucc

SEQ ID NO: 33005 - DNA, 22 bp, Artificial Sequence
  Synthetic
agtcagucctggagtucagagt

SEQ ID NO: 33006 - DNA, 22 bp, Artificial Sequence
  Synthetic
gtccagcugaggatgacagaug

SEQ ID NO: 33007 - DNA, 23 bp, Artificial Sequence
  Synthetic
ccaagagaacauggtctgtcgug

SEQ ID NO: 33008 - DNA, 22 bp, Artificial Sequence
  Synthetic
agctggtgugtcaagcacttua

SEQ ID NO: 33009 - DNA, 28 bp, Artificial Sequence
  Synthetic
ctgtcacauggagaaaagaugagaagaa

SEQ ID NO: 33010 - DNA, 28 bp, Artificial Sequence
  Synthetic
aaaaagagtgatutcctggaagtaugct

SEQ ID NO: 33011 - DNA, 26 bp, Artificial Sequence
  Synthetic
caacctgaaaccuggagtcaatuact

SEQ ID NO: 33012 - DNA, 24 bp, Artificial Sequence
  Synthetic
ccatcauagacaggcttacuccag

SEQ ID NO: 33013 - DNA, 22 bp, Artificial Sequence
  Synthetic
gcagcatctucacctgtgtcut

SEQ ID NO: 33014 - DNA, 24 bp, Artificial Sequence
  Synthetic
tttttgtctggugtcacggauagt

SEQ ID NO: 33015 - DNA, 28 bp, Artificial Sequence
  Synthetic
ttgtaccttgtttucccttcctttcuaa

SEQ ID NO: 33016 - DNA, 27 bp, Artificial Sequence
  Synthetic
aattttggtggtugtaatgatgcacuc

SEQ ID NO: 33017 - DNA, 27 bp, Artificial Sequence
  Synthetic
acatcgtgttttgucctttcactgaua

SEQ ID NO: 33018 - DNA, 23 bp, Artificial Sequence
  Synthetic
agcccatggcautccttagttut

SEQ ID NO: 33019 - DNA, 23 bp, Artificial Sequence
  Synthetic
caggtacauctgtgaagcucaga

SEQ ID NO: 33020 - DNA, 25 bp, Artificial Sequence
  Synthetic
aaccaggaaaagguatgcggaaaua

SEQ ID NO: 33021 - DNA, 27 bp, Artificial Sequence
  Synthetic
agcttcaccaaugttactgaaacucaa

SEQ ID NO: 33022 - DNA, 23 bp, Artificial Sequence
  Synthetic
gagaagcagautagcggcactua

SEQ ID NO: 33023 - DNA, 30 bp, Artificial Sequence
  Synthetic
gacttatttatgaautcagggtgtaugcag

SEQ ID NO: 33024 - DNA, 26 bp, Artificial Sequence
  Synthetic
actgtttcugtctttcattuccaggt

SEQ ID NO: 33025 - DNA, 28 bp, Artificial Sequence
  Synthetic
ccaacttttcaaagauccaggttttcut

SEQ ID NO: 33026 - DNA, 23 bp, Artificial Sequence
  Synthetic
ttttctgcctugatgcggaatug

SEQ ID NO: 33027 - DNA, 30 bp, Artificial Sequence
  Synthetic
caactggcccugttgttattagtgatauaa

SEQ ID NO: 33028 - DNA, 27 bp, Artificial Sequence
  Synthetic
caggttctcagcaguaatttcggtaut

SEQ ID NO: 33029 - DNA, 31 bp, Artificial Sequence
  Synthetic
cactutctatactcattttucagaaccacct

SEQ ID NO: 33030 - DNA, 22 bp, Artificial Sequence
  Synthetic
gccacugcacattuaacccagt

SEQ ID NO: 33031 - DNA, 28 bp, Artificial Sequence
  Synthetic
gaagagtgcacauttaaaagtgctguaa

SEQ ID NO: 33032 - DNA, 21 bp, Artificial Sequence
  Synthetic
ggagaggcggutacagttgut

SEQ ID NO: 33033 - DNA, 24 bp, Artificial Sequence
  Synthetic
aatgttttgagugctgcttcacug

SEQ ID NO: 33034 - DNA, 23 bp, Artificial Sequence
  Synthetic
ggcttacuccacaagacatuggg

SEQ ID NO: 33035 - DNA, 27 bp, Artificial Sequence
  Synthetic
acaacaggagcugaatatgtttucaga

SEQ ID NO: 33036 - DNA, 21 bp, Artificial Sequence
  Synthetic
cggctuaacccaggcaauagt

SEQ ID NO: 33037 - DNA, 28 bp, Artificial Sequence
  Synthetic
gacttcgggaaggaugtgaatatgaaua

SEQ ID NO: 33038 - DNA, 26 bp, Artificial Sequence
  Synthetic
ttgaccagcaaagugtcatagatuct

SEQ ID NO: 33039 - DNA, 27 bp, Artificial Sequence
  Synthetic
gcatggacaataugtgaaggagagtua

SEQ ID NO: 33040 - DNA, 23 bp, Artificial Sequence
  Synthetic
tggtggaccaggcutatcaagua

SEQ ID NO: 33041 - DNA, 22 bp, Artificial Sequence
  Synthetic
cgacctcugccagtaattucct

SEQ ID NO: 33042 - DNA, 22 bp, Artificial Sequence
  Synthetic
cagtggatucagatggcucact

SEQ ID NO: 33043 - DNA, 27 bp, Artificial Sequence
  Synthetic
agtgtcacutaaatggtcuaaaccaca

SEQ ID NO: 33044 - DNA, 28 bp, Artificial Sequence
  Synthetic
acacgatactcauacatcagtcctucat

SEQ ID NO: 33045 - DNA, 23 bp, Artificial Sequence
  Synthetic
cctggtacucctaaagttgugca

SEQ ID NO: 33046 - DNA, 23 bp, Artificial Sequence
  Synthetic
gatgttctugcaactgcttguga

SEQ ID NO: 33047 - DNA, 31 bp, Artificial Sequence
  Synthetic
tgctggatccauaacagttcctattactaua

SEQ ID NO: 33048 - DNA, 28 bp, Artificial Sequence
  Synthetic
tctagttgtcuctttaagagtcugacca

SEQ ID NO: 33049 - DNA, 23 bp, Artificial Sequence
  Synthetic
gtcttcaggguagctgcagtuaa

SEQ ID NO: 33050 - DNA, 26 bp, Artificial Sequence
  Synthetic
acttttcactcccuttagtctgcaut

SEQ ID NO: 33051 - DNA, 22 bp, Artificial Sequence
  Synthetic
ctacttccgagucttggctucc

SEQ ID NO: 33052 - DNA, 22 bp, Artificial Sequence
  Synthetic
aataaguggtggtucccaggac

SEQ ID NO: 33053 - DNA, 27 bp, Artificial Sequence
  Synthetic
cagctcattuacaatgttggtgatuga

SEQ ID NO: 33054 - DNA, 23 bp, Artificial Sequence
  Synthetic
cagaacgaccaccuttcugagat

SEQ ID NO: 33055 - DNA, 26 bp, Artificial Sequence
  Synthetic
caacaggatuacaaggaaagcagtuc

SEQ ID NO: 33056 - DNA, 24 bp, Artificial Sequence
  Synthetic
ggagacagaagauctggaagtguc

SEQ ID NO: 33057 - DNA, 24 bp, Artificial Sequence
  Synthetic
gauggaccaagugcaacaagaaaa

SEQ ID NO: 33058 - DNA, 22 bp, Artificial Sequence
  Synthetic
gaggaccuggtggcttauaagg

SEQ ID NO: 33059 - DNA, 21 bp, Artificial Sequence
  Synthetic
gactctctuggacccaggtut

SEQ ID NO: 33060 - DNA, 22 bp, Artificial Sequence
  Synthetic
cctggcctgucaagtaccttua

SEQ ID NO: 33061 - DNA, 29 bp, Artificial Sequence
  Synthetic
ctgatgttgtutggtcaaaagauggaaaa

SEQ ID NO: 33062 - DNA, 24 bp, Artificial Sequence
  Synthetic
ggcaccacuactatcagatggtuc

SEQ ID NO: 33063 - DNA, 23 bp, Artificial Sequence
  Synthetic
actgaaauggaagaaaccugcct

SEQ ID NO: 33064 - DNA, 26 bp, Artificial Sequence
  Synthetic
ccaaugccaacaatatttucagcaga

SEQ ID NO: 33065 - DNA, 24 bp, Artificial Sequence
  Synthetic
gtgaatgauggaggcaccaaaaut

SEQ ID NO: 33066 - DNA, 23 bp, Artificial Sequence
  Synthetic
gggcacttttuccatacctgtut

SEQ ID NO: 33067 - DNA, 26 bp, Artificial Sequence
  Synthetic
tgcagacttugtagtcatatctuggg

SEQ ID NO: 33068 - DNA, 30 bp, Artificial Sequence
  Synthetic
gtcatctttgtuaccttctttaatgugcaa

SEQ ID NO: 33069 - DNA, 28 bp, Artificial Sequence
  Synthetic
acacatataguatccaagcuggagaaga

SEQ ID NO: 33070 - DNA, 29 bp, Artificial Sequence
  Synthetic
attataagcctugacacggaactgataut

SEQ ID NO: 33071 - DNA, 22 bp, Artificial Sequence
  Synthetic
ctuccccaucaggaaaggtuac

SEQ ID NO: 33072 - DNA, 28 bp, Artificial Sequence
  Synthetic
aacttgttttgcugcatttactacucac

SEQ ID NO: 33073 - DNA, 24 bp, Artificial Sequence
  Synthetic
ggaaaacagcaguggatcaaaguc

SEQ ID NO: 33074 - DNA, 24 bp, Artificial Sequence
  Synthetic
gttggacgaccuttgaatggaaug

SEQ ID NO: 33075 - DNA, 30 bp, Artificial Sequence
  Synthetic
tcaaaactcacugaacaccaagagtauaaa

SEQ ID NO: 33076 - DNA, 21 bp, Artificial Sequence
  Synthetic
gttuaccccaggcaagtguga

SEQ ID NO: 33077 - DNA, 23 bp, Artificial Sequence
  Synthetic
gccgcatuacagatttgcgtcua

SEQ ID NO: 33078 - DNA, 28 bp, Artificial Sequence
  Synthetic
gcaatatttgtgacutccaagcttttug

SEQ ID NO: 33079 - DNA, 21 bp, Artificial Sequence
  Synthetic
gagaaaccagucgactugcct

SEQ ID NO: 33080 - DNA, 28 bp, Artificial Sequence
  Synthetic
tggaggtcctgguctatctaatacttut

SEQ ID NO: 33081 - DNA, 30 bp, Artificial Sequence
  Synthetic
gtggttaagaggagauaaggaaatugaaga

SEQ ID NO: 33082 - DNA, 26 bp, Artificial Sequence
  Synthetic
ttggatccautgaaattctugggagt

SEQ ID NO: 33083 - DNA, 25 bp, Artificial Sequence
  Synthetic
gtagagaaacgugatttgcctgaug

SEQ ID NO: 33084 - DNA, 22 bp, Artificial Sequence
  Synthetic
tcacagggauctctggcuacat

SEQ ID NO: 33085 - DNA, 27 bp, Artificial Sequence
  Synthetic
gutaccaccuggagagaaaagaaagaa

SEQ ID NO: 33086 - DNA, 23 bp, Artificial Sequence
  Synthetic
ggcctggtuctttgtagggauat

SEQ ID NO: 33087 - DNA, 22 bp, Artificial Sequence
  Synthetic
caaccaccacaguatgggaugt

SEQ ID NO: 33088 - DNA, 29 bp, Artificial Sequence
  Synthetic
ccttttggaggaucaggtttatcuagagt

SEQ ID NO: 33089 - DNA, 20 bp, Artificial Sequence
  Synthetic
cuggacgtccuaagccaacc

SEQ ID NO: 33090 - DNA, 27 bp, Artificial Sequence
  Synthetic
aggatcacttcuccccttttcattuac

SEQ ID NO: 33091 - DNA, 23 bp, Artificial Sequence
  Synthetic
gtcaccagaaacagugtctcuct

SEQ ID NO: 33092 - DNA, 24 bp, Artificial Sequence
  Synthetic
ttggagcugatcgatttuccaaga

SEQ ID NO: 33093 - DNA, 26 bp, Artificial Sequence
  Synthetic
tttgttactgugagagttcuggacac

SEQ ID NO: 33094 - DNA, 23 bp, Artificial Sequence
  Synthetic
ctcggattucaccatccacctut

SEQ ID NO: 33095 - DNA, 30 bp, Artificial Sequence
  Synthetic
gctattaauaaagctggagtuggagaacat

SEQ ID NO: 33096 - DNA, 27 bp, Artificial Sequence
  Synthetic
caccaacacucacatcacattttucaa

SEQ ID NO: 33097 - DNA, 24 bp, Artificial Sequence
  Synthetic
gttcagagttuctgctgagaaugc

SEQ ID NO: 33098 - DNA, 23 bp, Artificial Sequence
  Synthetic
cagatgctgguctttcccauaca

SEQ ID NO: 33099 - DNA, 23 bp, Artificial Sequence
  Synthetic
tctcagcugcaaggttacuaagc

SEQ ID NO: 33100 - DNA, 25 bp, Artificial Sequence
  Synthetic
tgtgcattttuctgctgtaacucct

SEQ ID NO: 33101 - DNA, 27 bp, Artificial Sequence
  Synthetic
cacagcucgattagaaauaaagagcac

SEQ ID NO: 33102 - DNA, 23 bp, Artificial Sequence
  Synthetic
tcgtggtggauctacctcatcuc

SEQ ID NO: 33103 - DNA, 27 bp, Artificial Sequence
  Synthetic
tggaagcaagaucactggttatatugt

SEQ ID NO: 33104 - DNA, 22 bp, Artificial Sequence
  Synthetic
ggtcacgagccacauaacatuc

SEQ ID NO: 33105 - DNA, 23 bp, Artificial Sequence
  Synthetic
gccaatcagugatggaggaagua

SEQ ID NO: 33106 - DNA, 25 bp, Artificial Sequence
  Synthetic
tcccatatcugttttcagcugcaat

SEQ ID NO: 33107 - DNA, 26 bp, Artificial Sequence
  Synthetic
ccagttaaaauggatgaagugacagc

SEQ ID NO: 33108 - DNA, 24 bp, Artificial Sequence
  Synthetic
aggcgtcctutattgtcagtagug

SEQ ID NO: 33109 - DNA, 20 bp, Artificial Sequence
  Synthetic
actgagtgugccagtgaucg

SEQ ID NO: 33110 - DNA, 24 bp, Artificial Sequence
  Synthetic
ttggtctgcauctccacaatguag

SEQ ID NO: 33111 - DNA, 28 bp, Artificial Sequence
  Synthetic
cttcaagaaggcugtagctactattuca

SEQ ID NO: 33112 - DNA, 22 bp, Artificial Sequence
  Synthetic
gtcccaugtgagtgugacagat

SEQ ID NO: 33113 - DNA, 24 bp, Artificial Sequence
  Synthetic
agcatcgaauccacaagctctuac

SEQ ID NO: 33114 - DNA, 23 bp, Artificial Sequence
  Synthetic
agutcaatttcuggaggcagcat

SEQ ID NO: 33115 - DNA, 26 bp, Artificial Sequence
  Synthetic
atcactgggtauatggttgagatugc

SEQ ID NO: 33116 - DNA, 24 bp, Artificial Sequence
  Synthetic
agccttgtaaaauggactgguagg

SEQ ID NO: 33117 - DNA, 25 bp, Artificial Sequence
  Synthetic
gattctgatgguggaagtgaaauca

SEQ ID NO: 33118 - DNA, 28 bp, Artificial Sequence
  Synthetic
ccactccatatutatttacagccaugac

SEQ ID NO: 33119 - DNA, 28 bp, Artificial Sequence
  Synthetic
actgaagtgacaucagaaaagtgtguac

SEQ ID NO: 33120 - DNA, 22 bp, Artificial Sequence
  Synthetic
agtcgcugtaagggtauaggca

SEQ ID NO: 33121 - DNA, 29 bp, Artificial Sequence
  Synthetic
cggttatatuaaaagcaggtgaagcatuc

SEQ ID NO: 33122 - DNA, 24 bp, Artificial Sequence
  Synthetic
cgatcacacggaautcataugcag

SEQ ID NO: 33123 - DNA, 26 bp, Artificial Sequence
  Synthetic
cacctggaaaaccaguacctcuaaat

SEQ ID NO: 33124 - DNA, 27 bp, Artificial Sequence
  Synthetic
cacttgatttgaaaaugttgcctggua

SEQ ID NO: 33125 - DNA, 22 bp, Artificial Sequence
  Synthetic
catcagcaugcatagtugccaa

SEQ ID NO: 33126 - DNA, 21 bp, Artificial Sequence
  Synthetic
cagtctgccgcauttccacua

SEQ ID NO: 33127 - DNA, 27 bp, Artificial Sequence
  Synthetic
cctatccatuaacagcaaggaacatug

SEQ ID NO: 33128 - DNA, 22 bp, Artificial Sequence
  Synthetic
cgaccgagcacuggaattucaa

SEQ ID NO: 33129 - DNA, 25 bp, Artificial Sequence
  Synthetic
cgtgaaagggutagaatgtgttgug

SEQ ID NO: 33130 - DNA, 22 bp, Artificial Sequence
  Synthetic
atgttaaggcugtctgguggag

SEQ ID NO: 33131 - DNA, 26 bp, Artificial Sequence
  Synthetic
aatcttatuccacagccaccacuaag

SEQ ID NO: 33132 - DNA, 20 bp, Artificial Sequence
  Synthetic
gcgtguccaagactcugacg

SEQ ID NO: 33133 - DNA, 28 bp, Artificial Sequence
  Synthetic
tggaccaaagauaacatcaaccugaaaa

SEQ ID NO: 33134 - DNA, 21 bp, Artificial Sequence
  Synthetic
gccatcucccgttctacgaut

SEQ ID NO: 33135 - DNA, 23 bp, Artificial Sequence
  Synthetic
ggtggactugaaatcactggcua

SEQ ID NO: 33136 - DNA, 30 bp, Artificial Sequence
  Synthetic
aagtatatatucagagtttggctttugggt

SEQ ID NO: 33137 - DNA, 22 bp, Artificial Sequence
  Synthetic
cgaattccgugtcagugcagaa

SEQ ID NO: 33138 - DNA, 24 bp, Artificial Sequence
  Synthetic
catcgcaggcutttcttttctcuc

SEQ ID NO: 33139 - DNA, 29 bp, Artificial Sequence
  Synthetic
agggaattgacauggaaacatttauagca

SEQ ID NO: 33140 - DNA, 24 bp, Artificial Sequence
  Synthetic
ccacatgccugcaagactgaauat

SEQ ID NO: 33141 - DNA, 23 bp, Artificial Sequence
  Synthetic
cgaaggtggaacaugtgaaggua

SEQ ID NO: 33142 - DNA, 30 bp, Artificial Sequence
  Synthetic
gtgatatctgauggtctaatgtctttucct

SEQ ID NO: 33143 - DNA, 28 bp, Artificial Sequence
  Synthetic
agcctccttccutttctgattaaaaugt

SEQ ID NO: 33144 - DNA, 25 bp, Artificial Sequence
  Synthetic
caaggucagttacaguaaaggcaca

SEQ ID NO: 33145 - DNA, 27 bp, Artificial Sequence
  Synthetic
ctggtatttgttugactggttttgcut

SEQ ID NO: 33146 - DNA, 21 bp, Artificial Sequence
  Synthetic
cttgcccacaccugctaaaut

SEQ ID NO: 33147 - DNA, 27 bp, Artificial Sequence
  Synthetic
cttgatacatcccugggtcttttguag

SEQ ID NO: 33148 - DNA, 30 bp, Artificial Sequence
  Synthetic
atttataauaagaagcctccucaaaaccgt

SEQ ID NO: 33149 - DNA, 28 bp, Artificial Sequence
  Synthetic
gaaaaccaccttuagagtaaccagacut

SEQ ID NO: 33150 - DNA, 23 bp, Artificial Sequence
  Synthetic
ggcttctgcugtgacttcaucaa

SEQ ID NO: 33151 - DNA, 26 bp, Artificial Sequence
  Synthetic
gaagatcctcuagcaactgacacuag

SEQ ID NO: 33152 - DNA, 24 bp, Artificial Sequence
  Synthetic
agataagcuagtgagugggacaca

SEQ ID NO: 33153 - DNA, 29 bp, Artificial Sequence
  Synthetic
caacgagttaugaaatccttaagccuaca

SEQ ID NO: 33154 - DNA, 27 bp, Artificial Sequence
  Synthetic
gcaaaggagaaaugataagtguaagcc

SEQ ID NO: 33155 - DNA, 28 bp, Artificial Sequence
  Synthetic
tccaaaacaagcutcagagtagctaaut

SEQ ID NO: 33156 - DNA, 28 bp, Artificial Sequence
  Synthetic
tgaaatagactuaccaagcacttucaca

SEQ ID NO: 33157 - DNA, 28 bp, Artificial Sequence
  Synthetic
ccacctccaaagautacttggtcuaaac

SEQ ID NO: 33158 - DNA, 23 bp, Artificial Sequence
  Synthetic
gccttatgtacuccccctgguaa

SEQ ID NO: 33159 - DNA, 20 bp, Artificial Sequence
  Synthetic
gctgacuccgataacugggt

SEQ ID NO: 33160 - DNA, 24 bp, Artificial Sequence
  Synthetic
ttcatgaaaacutccttccugggt

SEQ ID NO: 33161 - DNA, 28 bp, Artificial Sequence
  Synthetic
gaacatuaaaagcaacaggtctucaaga

SEQ ID NO: 33162 - DNA, 23 bp, Artificial Sequence
  Synthetic
cttccagcugactgtcatgugat

SEQ ID NO: 33163 - DNA, 27 bp, Artificial Sequence
  Synthetic
caaaaacccatauggtaggaacattuc

SEQ ID NO: 33164 - DNA, 21 bp, Artificial Sequence
  Synthetic
gcagagactugagcccagtug

SEQ ID NO: 33165 - DNA, 26 bp, Artificial Sequence
  Synthetic
aggtctccagaccuctactctauact

SEQ ID NO: 33166 - DNA, 27 bp, Artificial Sequence
  Synthetic
gcagtaatggtauagtctcctgagucc

SEQ ID NO: 33167 - DNA, 26 bp, Artificial Sequence
  Synthetic
tgcttggatgcuactgtttttgguaa

SEQ ID NO: 33168 - DNA, 27 bp, Artificial Sequence
  Synthetic
tgaccatcatgaaugctgttacatcut

SEQ ID NO: 33169 - DNA, 22 bp, Artificial Sequence
  Synthetic
ggtgataaaugggtacggugca

SEQ ID NO: 33170 - DNA, 27 bp, Artificial Sequence
  Synthetic
cttagacuccgagatttaaatgugcct

SEQ ID NO: 33171 - DNA, 24 bp, Artificial Sequence
  Synthetic
tgatactcttguccggtcaacuga

SEQ ID NO: 33172 - DNA, 28 bp, Artificial Sequence
  Synthetic
gaagacaaggaagaugtcagtttcuaca

SEQ ID NO: 33173 - DNA, 23 bp, Artificial Sequence
  Synthetic
cggctcuagcttcagucacaaaa

SEQ ID NO: 33174 - DNA, 29 bp, Artificial Sequence
  Synthetic
tttctgagcttcauatttagatggccaut

SEQ ID NO: 33175 - DNA, 22 bp, Artificial Sequence
  Synthetic
atgaagutgtcacauccagcca

SEQ ID NO: 33176 - DNA, 27 bp, Artificial Sequence
  Synthetic
aatttctagagcuagattccucaggga

SEQ ID NO: 33177 - DNA, 27 bp, Artificial Sequence
  Synthetic
tggccuaaaggaaggaaagaaauacaa

SEQ ID NO: 33178 - DNA, 23 bp, Artificial Sequence
  Synthetic
gccatcgautttagcaccuccat

SEQ ID NO: 33179 - DNA, 30 bp, Artificial Sequence
  Synthetic
acattggagcaaauccatactaaaactcut

SEQ ID NO: 33180 - DNA, 28 bp, Artificial Sequence
  Synthetic
catggaagctugttttcttaacttcugg

SEQ ID NO: 33181 - DNA, 28 bp, Artificial Sequence
  Synthetic
gatgctgaggagacaugtatatctgaut

SEQ ID NO: 33182 - DNA, 22 bp, Artificial Sequence
  Synthetic
ggccatagugtcaaccagauca

SEQ ID NO: 33183 - DNA, 31 bp, Artificial Sequence
  Synthetic
cccacattctgaaaaaucaattaatgaccut

SEQ ID NO: 33184 - DNA, 23 bp, Artificial Sequence
  Synthetic
attacaccguttccagcctucat

SEQ ID NO: 33185 - DNA, 23 bp, Artificial Sequence
  Synthetic
tttacttucagagccacctgguc

SEQ ID NO: 33186 - DNA, 23 bp, Artificial Sequence
  Synthetic
tcautttctgcctugacacggaa

SEQ ID NO: 33187 - DNA, 26 bp, Artificial Sequence
  Synthetic
gtaagcaaagaagagaugactguggt

SEQ ID NO: 33188 - DNA, 23 bp, Artificial Sequence
  Synthetic
ggaggcccugtgcctattttaut

SEQ ID NO: 33189 - DNA, 25 bp, Artificial Sequence
  Synthetic
ttgttgatgtguccagtgataggug

SEQ ID NO: 33190 - DNA, 23 bp, Artificial Sequence
  Synthetic
ccatcactucgctttgcttuagt

SEQ ID NO: 33191 - DNA, 31 bp, Artificial Sequence
  Synthetic
agacttacaaaaaccaguacttgatcugaaa

SEQ ID NO: 33192 - DNA, 28 bp, Artificial Sequence
  Synthetic
ccatgtagtgaguttctttaatgctucc

SEQ ID NO: 33193 - DNA, 29 bp, Artificial Sequence
  Synthetic
aaacaaaaactcccautctggctatuaac

SEQ ID NO: 33194 - DNA, 23 bp, Artificial Sequence
  Synthetic
cctttctggtutggtttgcgaua

SEQ ID NO: 33195 - DNA, 27 bp, Artificial Sequence
  Synthetic
tgatcatggcaaguatatcatcucagc

SEQ ID NO: 33196 - DNA, 23 bp, Artificial Sequence
  Synthetic
gactcgagcuagaatgcggauag

SEQ ID NO: 33197 - DNA, 23 bp, Artificial Sequence
  Synthetic
attaggcaaugtgccttuagggt

SEQ ID NO: 33198 - DNA, 23 bp, Artificial Sequence
  Synthetic
agctgtttctcugctcttgtcut

SEQ ID NO: 33199 - DNA, 24 bp, Artificial Sequence
  Synthetic
ggtcaacaaaacaccuatcgcuga

SEQ ID NO: 33200 - DNA, 25 bp, Artificial Sequence
  Synthetic
ggagacggaggacuaaatttaugct

SEQ ID NO: 33201 - DNA, 31 bp, Artificial Sequence
  Synthetic
ggaagccctgugataaattatattgtugaga

SEQ ID NO: 33202 - DNA, 25 bp, Artificial Sequence
  Synthetic
gcccaggaacaucaagaacaguaag

SEQ ID NO: 33203 - DNA, 25 bp, Artificial Sequence
  Synthetic
ctgctattauaagaggtgtgccugt

SEQ ID NO: 33204 - DNA, 27 bp, Artificial Sequence
  Synthetic
gaggcacugaaaagtaaacaugaaaaa

SEQ ID NO: 33205 - DNA, 25 bp, Artificial Sequence
  Synthetic
aaagctgaaaacautgtgggtctug

SEQ ID NO: 33206 - DNA, 30 bp, Artificial Sequence
  Synthetic
gggatctttucaaagaagaagttatgauga

SEQ ID NO: 33207 - DNA, 24 bp, Artificial Sequence
  Synthetic
tcacttcgcuaagcatctgaauga

SEQ ID NO: 33208 - DNA, 25 bp, Artificial Sequence
  Synthetic
agacagttttugaaccagctggaut

SEQ ID NO: 33209 - DNA, 26 bp, Artificial Sequence
  Synthetic
aagacttagugccatcaucaaaggag

SEQ ID NO: 33210 - DNA, 31 bp, Artificial Sequence
  Synthetic
catacaatcagacauctattttcctugcaaa

SEQ ID NO: 33211 - DNA, 25 bp, Artificial Sequence
  Synthetic
ccctgagtcaugtcctgaaacuaaa

SEQ ID NO: 33212 - DNA, 26 bp, Artificial Sequence
  Synthetic
ccaattggatcuttagcaaagacugg

SEQ ID NO: 33213 - DNA, 28 bp, Artificial Sequence
  Synthetic
cacaaacuacatccuggaaaagagagaa

SEQ ID NO: 33214 - DNA, 23 bp, Artificial Sequence
  Synthetic
aggaaccccugtaacaaatgtug

SEQ ID NO: 33215 - DNA, 28 bp, Artificial Sequence
  Synthetic
cggatacatgcugaaaatctgtauggaa

SEQ ID NO: 33216 - DNA, 27 bp, Artificial Sequence
  Synthetic
gtctttacccacutccttcttcucaat

SEQ ID NO: 33217 - DNA, 28 bp, Artificial Sequence
  Synthetic
ggcaataacatttugtgccatgatttut

SEQ ID NO: 33218 - DNA, 25 bp, Artificial Sequence
  Synthetic
gttcuccacaaccauacagtattug

SEQ ID NO: 33219 - DNA, 20 bp, Artificial Sequence
  Synthetic
cctcacuggccgttacucag

SEQ ID NO: 33220 - DNA, 30 bp, Artificial Sequence
  Synthetic
acaaatctacaaaugtgcaagttucagaag

SEQ ID NO: 33221 - DNA, 28 bp, Artificial Sequence
  Synthetic
ggactgagaagutccacaaagtuacaaa

SEQ ID NO: 33222 - DNA, 28 bp, Artificial Sequence
  Synthetic
cttaggaggatuccaagtcaaagtuaca

SEQ ID NO: 33223 - DNA, 31 bp, Artificial Sequence
  Synthetic
tgcaatctucagaaaaggaatattcacuaca

SEQ ID NO: 33224 - DNA, 21 bp, Artificial Sequence
  Synthetic
gcggtcagautcacgctttuc

SEQ ID NO: 33225 - DNA, 30 bp, Artificial Sequence
  Synthetic
aaggcaaacagcutgaattattttcttcut

SEQ ID NO: 33226 - DNA, 21 bp, Artificial Sequence
  Synthetic
ggtggcutcttgagguaaggt

SEQ ID NO: 33227 - DNA, 31 bp, Artificial Sequence
  Synthetic
ttccttatgccaucagtatttatgttucaga

SEQ ID NO: 33228 - DNA, 26 bp, Artificial Sequence
  Synthetic
cagcaatgttgacugctctaactcua

SEQ ID NO: 33229 - DNA, 26 bp, Artificial Sequence
  Synthetic
tggtgatgctutaggaagccatuaaa

SEQ ID NO: 33230 - DNA, 22 bp, Artificial Sequence
  Synthetic
gcugcaaagagccagtauacgt

SEQ ID NO: 33231 - DNA, 27 bp, Artificial Sequence
  Synthetic
ggtcttattgaaggutccgactaucaa

SEQ ID NO: 33232 - DNA, 23 bp, Artificial Sequence
  Synthetic
agagccuccatcatattcuggct

SEQ ID NO: 33233 - DNA, 28 bp, Artificial Sequence
  Synthetic
agaaacctcutctgtaaguaggagaaca

SEQ ID NO: 33234 - DNA, 24 bp, Artificial Sequence
  Synthetic
cttaggttcacuggagacauggac

SEQ ID NO: 33235 - DNA, 28 bp, Artificial Sequence
  Synthetic
catctgagtgauaaagggttccttctut

SEQ ID NO: 33236 - DNA, 28 bp, Artificial Sequence
  Synthetic
aagtatcatcuaccaccagtttgtugac

SEQ ID NO: 33237 - DNA, 28 bp, Artificial Sequence
  Synthetic
tgctttttgctccuaatgacaactttut

SEQ ID NO: 33238 - DNA, 28 bp, Artificial Sequence
  Synthetic
actaggtctucaacagtaaattgcagut

SEQ ID NO: 33239 - DNA, 26 bp, Artificial Sequence
  Synthetic
tttttacagatccucctgatccucct

SEQ ID NO: 33240 - DNA, 26 bp, Artificial Sequence
  Synthetic
caggcttttccaucaatagtcctcut

SEQ ID NO: 33241 - DNA, 30 bp, Artificial Sequence
  Synthetic
cgttgcttatautgtgatttacauccaaca

SEQ ID NO: 33242 - DNA, 27 bp, Artificial Sequence
  Synthetic
ctccagctguacaaagaaaataguagt

SEQ ID NO: 33243 - DNA, 29 bp, Artificial Sequence
  Synthetic
gcaatgaagguaggaaaataaccattcuc

SEQ ID NO: 33244 - DNA, 26 bp, Artificial Sequence
  Synthetic
tactagtaccutgaatatcaguggca

SEQ ID NO: 33245 - DNA, 28 bp, Artificial Sequence
  Synthetic
agcccaaucaaaggatacattguagaaa

SEQ ID NO: 33246 - DNA, 21 bp, Artificial Sequence
  Synthetic
guccccagaaauggaagcaua

SEQ ID NO: 33247 - DNA, 23 bp, Artificial Sequence
  Synthetic
ggaagtcctuattggtcacgugt

SEQ ID NO: 33248 - DNA, 28 bp, Artificial Sequence
  Synthetic
ggcgataaggaucttgaatgactactut

SEQ ID NO: 33249 - DNA, 28 bp, Artificial Sequence
  Synthetic
agtcatcccucccaaaataagttgaaut

SEQ ID NO: 33250 - DNA, 23 bp, Artificial Sequence
  Synthetic
tcctacttgcaucacgtttguca

SEQ ID NO: 33251 - DNA, 31 bp, Artificial Sequence
  Synthetic
cttctcaatattcuctgttgattccttucca

SEQ ID NO: 33252 - DNA, 21 bp, Artificial Sequence
  Synthetic
ggaccgctutgggaatgcuaa

SEQ ID NO: 33253 - DNA, 25 bp, Artificial Sequence
  Synthetic
acuatcaaagtuaaggcaggagagc

SEQ ID NO: 33254 - DNA, 27 bp, Artificial Sequence
  Synthetic
caacttatgggauaaaggcacactgua

SEQ ID NO: 33255 - DNA, 27 bp, Artificial Sequence
  Synthetic
ctttgaaagagtuaacaagcgactcug

SEQ ID NO: 33256 - DNA, 24 bp, Artificial Sequence
  Synthetic
attttgagacugttgggagttuga

SEQ ID NO: 33257 - DNA, 27 bp, Artificial Sequence
  Synthetic
gagggacaagaauataagttccgtgut

SEQ ID NO: 33258 - DNA, 28 bp, Artificial Sequence
  Synthetic
gataaagcctgutatttcacttccucca

SEQ ID NO: 33259 - DNA, 28 bp, Artificial Sequence
  Synthetic
cacaggatttucccaagtgatactauct

SEQ ID NO: 33260 - DNA, 30 bp, Artificial Sequence
  Synthetic
gtgcatccttgauaattagttcagattugg

SEQ ID NO: 33261 - DNA, 27 bp, Artificial Sequence
  Synthetic
ctaatgcaugactgttctcttucaaca

SEQ ID NO: 33262 - DNA, 20 bp, Artificial Sequence
  Synthetic
atugacagcacucacccgaa

SEQ ID NO: 33263 - DNA, 24 bp, Artificial Sequence
  Synthetic
caagagtcacugacacaagctcua

SEQ ID NO: 33264 - DNA, 27 bp, Artificial Sequence
  Synthetic
gacataggugagtccttctaauaagcc

SEQ ID NO: 33265 - DNA, 21 bp, Artificial Sequence
  Synthetic
gaccacctgaugcaccagaua

SEQ ID NO: 33266 - DNA, 27 bp, Artificial Sequence
  Synthetic
tgcaatgtcuaagtgttgaagugacaa

SEQ ID NO: 33267 - DNA, 28 bp, Artificial Sequence
  Synthetic
ccttcccacacaaauttttgattacugt

SEQ ID NO: 33268 - DNA, 23 bp, Artificial Sequence
  Synthetic
gaggcaggacaaauggttctuct

SEQ ID NO: 33269 - DNA, 25 bp, Artificial Sequence
  Synthetic
aggtgatgaaauagcacttgaugca

SEQ ID NO: 33270 - DNA, 22 bp, Artificial Sequence
  Synthetic
gggaaaguggcaactccaugaa

SEQ ID NO: 33271 - DNA, 25 bp, Artificial Sequence
  Synthetic
gaagaaagguggaagagatgcaaug

SEQ ID NO: 33272 - DNA, 22 bp, Artificial Sequence
  Synthetic
gccatagugcatccatguccaa

SEQ ID NO: 33273 - DNA, 21 bp, Artificial Sequence
  Synthetic
cautatgtccuggagcgcaga

SEQ ID NO: 33274 - DNA, 26 bp, Artificial Sequence
  Synthetic
tcctctacatgugaagaatgtcuggt

SEQ ID NO: 33275 - DNA, 29 bp, Artificial Sequence
  Synthetic
ggcaaagaagtuaaagcaagtgatagaut

SEQ ID NO: 33276 - DNA, 27 bp, Artificial Sequence
  Synthetic
cagagtatgucaaaatgcaatgcauga

SEQ ID NO: 33277 - DNA, 28 bp, Artificial Sequence
  Synthetic
ttgttccugacaaagaatatgtccugag

SEQ ID NO: 33278 - DNA, 26 bp, Artificial Sequence
  Synthetic
actggacacauttcaacatggtaucc

SEQ ID NO: 33279 - DNA, 28 bp, Artificial Sequence
  Synthetic
gaagatccaacaaguaagtagtgcugat

SEQ ID NO: 33280 - DNA, 27 bp, Artificial Sequence
  Synthetic
aaaaacacagutaagaattugcagcca

SEQ ID NO: 33281 - DNA, 29 bp, Artificial Sequence
  Synthetic
cctttcctctggutttcctaatcattgut

SEQ ID NO: 33282 - DNA, 21 bp, Artificial Sequence
  Synthetic
ccactgttugccagcctttuc

SEQ ID NO: 33283 - DNA, 22 bp, Artificial Sequence
  Synthetic
gcctgcactutcagactgacua

SEQ ID NO: 33284 - DNA, 24 bp, Artificial Sequence
  Synthetic
agccttatucacagctctaacucg

SEQ ID NO: 33285 - DNA, 22 bp, Artificial Sequence
  Synthetic
ccagaacaugatggaggugcaa

SEQ ID NO: 33286 - DNA, 30 bp, Artificial Sequence
  Synthetic
cattgtttaggttugtcaaaaaggagtuca

SEQ ID NO: 33287 - DNA, 28 bp, Artificial Sequence
  Synthetic
atgatgatacacaugcactttgttccua

SEQ ID NO: 33288 - DNA, 22 bp, Artificial Sequence
  Synthetic
ccatcaucatctggcucacacc

SEQ ID NO: 33289 - DNA, 28 bp, Artificial Sequence
  Synthetic
aaggatgcttatgucaaacttgcattut

SEQ ID NO: 33290 - DNA, 25 bp, Artificial Sequence
  Synthetic
gggattaattuggtggcctugaagt

SEQ ID NO: 33291 - DNA, 25 bp, Artificial Sequence
  Synthetic
ttctgcatcugtaatgccauacaca

SEQ ID NO: 33292 - DNA, 30 bp, Artificial Sequence
  Synthetic
cattttcaatgguaattcttttgtccugct

SEQ ID NO: 33293 - DNA, 27 bp, Artificial Sequence
  Synthetic
cctctgacctuaaatctgcttgaacut

SEQ ID NO: 33294 - DNA, 24 bp, Artificial Sequence
  Synthetic
ccaacaaagcccautttagugact

SEQ ID NO: 33295 - DNA, 26 bp, Artificial Sequence
  Synthetic
catgggauccacctaaaaatgauggt

SEQ ID NO: 33296 - DNA, 22 bp, Artificial Sequence
  Synthetic
gcctugccccataactucaact

SEQ ID NO: 33297 - DNA, 31 bp, Artificial Sequence
  Synthetic
cctgatcttgtucaaggaaaagagtactuat

SEQ ID NO: 33298 - DNA, 25 bp, Artificial Sequence
  Synthetic
ttcccctactcucatttttggcaut

SEQ ID NO: 33299 - DNA, 23 bp, Artificial Sequence
  Synthetic
cagtgactcgugagtgcatttut

SEQ ID NO: 33300 - DNA, 24 bp, Artificial Sequence
  Synthetic
gagaaatgacaagutcggcauagg

SEQ ID NO: 33301 - DNA, 30 bp, Artificial Sequence
  Synthetic
actgcaaactcautaacttttcttcttugt

SEQ ID NO: 33302 - DNA, 27 bp, Artificial Sequence
  Synthetic
cacatacagtuatgtccatgauccaca

SEQ ID NO: 33303 - DNA, 27 bp, Artificial Sequence
  Synthetic
ctgaaagauggaggaagcccaatatua

SEQ ID NO: 33304 - DNA, 28 bp, Artificial Sequence
  Synthetic
ggcctaatatcuggatttcatgcaguaa

SEQ ID NO: 33305 - DNA, 23 bp, Artificial Sequence
  Synthetic
ggatacugccatgactgugagag

SEQ ID NO: 33306 - DNA, 28 bp, Artificial Sequence
  Synthetic
ccacagaagaagaaaauatgagttuggg

SEQ ID NO: 33307 - DNA, 25 bp, Artificial Sequence
  Synthetic
gttgagtacctautccgtgtgagug

SEQ ID NO: 33308 - DNA, 29 bp, Artificial Sequence
  Synthetic
tctttctcttaaugtcacgtcttucaaca

SEQ ID NO: 33309 - DNA, 28 bp, Artificial Sequence
  Synthetic
cacaattuaaaagcaagauagcacacua

SEQ ID NO: 33310 - DNA, 26 bp, Artificial Sequence
  Synthetic
cctttgtctccuttcttggcttcuaa

SEQ ID NO: 33311 - DNA, 28 bp, Artificial Sequence
  Synthetic
agcgttcacatgutatctttctcacuag

SEQ ID NO: 33312 - DNA, 27 bp, Artificial Sequence
  Synthetic
ccttcactcaucatctggtgtttauca

SEQ ID NO: 33313 - DNA, 29 bp, Artificial Sequence
  Synthetic
ttctttccagaaautcctgttgagaucat

SEQ ID NO: 33314 - DNA, 27 bp, Artificial Sequence
  Synthetic
aggagacattggautatcagttagcut

SEQ ID NO: 33315 - DNA, 24 bp, Artificial Sequence
  Synthetic
cacttggaagaucagacagucact

SEQ ID NO: 33316 - DNA, 22 bp, Artificial Sequence
  Synthetic
catcugggaagccacagtctut

SEQ ID NO: 33317 - DNA, 27 bp, Artificial Sequence
  Synthetic
tuttctccttuacaacagaggaagacc

SEQ ID NO: 33318 - DNA, 27 bp, Artificial Sequence
  Synthetic
ctgcactttuaacattttcacctcugt

SEQ ID NO: 33319 - DNA, 28 bp, Artificial Sequence
  Synthetic
caaagccaaauggttcagaaaugaagaa

SEQ ID NO: 33320 - DNA, 29 bp, Artificial Sequence
  Synthetic
catctttcacaacuaggaccctcttttua

SEQ ID NO: 33321 - DNA, 28 bp, Artificial Sequence
  Synthetic
caaagccucaaaaccttgaaatactuga

SEQ ID NO: 33322 - DNA, 26 bp, Artificial Sequence
  Synthetic
ttcctgtttcaaugatctcctcaucc

SEQ ID NO: 33323 - DNA, 28 bp, Artificial Sequence
  Synthetic
ccagcttaacucaatgtggtttttgtut

SEQ ID NO: 33324 - DNA, 30 bp, Artificial Sequence
  Synthetic
ccttacttcacaggaauattcagcttcauc

SEQ ID NO: 33325 - DNA, 24 bp, Artificial Sequence
  Synthetic
cttaaggacaccugtgugaaggaa

SEQ ID NO: 33326 - DNA, 28 bp, Artificial Sequence
  Synthetic
aagtgttgtgtugttttgttgttguagt

SEQ ID NO: 33327 - DNA, 27 bp, Artificial Sequence
  Synthetic
aagaagtatgaaautgttgctgauggc

SEQ ID NO: 33328 - DNA, 24 bp, Artificial Sequence
  Synthetic
attgttcaugagcctctgcctuat

SEQ ID NO: 33329 - DNA, 30 bp, Artificial Sequence
  Synthetic
cacccatatactagautgctgtttcatgua

SEQ ID NO: 33330 - DNA, 30 bp, Artificial Sequence
  Synthetic
ctttcacctgutcttttctaatucacacag

SEQ ID NO: 33331 - DNA, 22 bp, Artificial Sequence
  Synthetic
atgctggcccutcacttttcua

SEQ ID NO: 33332 - DNA, 26 bp, Artificial Sequence
  Synthetic
gctttctttaggautagcatgcgtut

SEQ ID NO: 33333 - DNA, 29 bp, Artificial Sequence
  Synthetic
aaagcttttcacutatactttactugcag

SEQ ID NO: 33334 - DNA, 27 bp, Artificial Sequence
  Synthetic
gaatgtgatcgaaugagttttccctuc

SEQ ID NO: 33335 - DNA, 24 bp, Artificial Sequence
  Synthetic
ttcctcaccccuctcaaagatgua

SEQ ID NO: 33336 - DNA, 29 bp, Artificial Sequence
  Synthetic
tcctttataagcucaaatctgtcaucacc

SEQ ID NO: 33337 - DNA, 25 bp, Artificial Sequence
  Synthetic
cttcatccacugtccacttcttuca

SEQ ID NO: 33338 - DNA, 23 bp, Artificial Sequence
  Synthetic
accaagcaaccccuctcctauat

SEQ ID NO: 33339 - DNA, 30 bp, Artificial Sequence
  Synthetic
cagtcatgcuaacaaaactgtatcattuca

SEQ ID NO: 33340 - DNA, 24 bp, Artificial Sequence
  Synthetic
gcctttatcttuaaggtccgccut

SEQ ID NO: 33341 - DNA, 26 bp, Artificial Sequence
  Synthetic
gcuaaatgtctttuacagaggccgat

SEQ ID NO: 33342 - DNA, 30 bp, Artificial Sequence
  Synthetic
caatgtcacttctutcatttccaatttgug

SEQ ID NO: 33343 - DNA, 27 bp, Artificial Sequence
  Synthetic
tctgaggcattauctatgcttgcatut

SEQ ID NO: 33344 - DNA, 31 bp, Artificial Sequence
  Synthetic
agcgatgatatcaaauttgtcagatgactua

SEQ ID NO: 33345 - DNA, 27 bp, Artificial Sequence
  Synthetic
tcaactttattucacttccctgugcat

SEQ ID NO: 33346 - DNA, 23 bp, Artificial Sequence
  Synthetic
attgcatuaagggcctgguagag

SEQ ID NO: 33347 - DNA, 30 bp, Artificial Sequence
  Synthetic
tgtatctgaaacacutctcctauagggaat

SEQ ID NO: 33348 - DNA, 25 bp, Artificial Sequence
  Synthetic
tcagtttccatugtccaggaatguc

SEQ ID NO: 33349 - DNA, 24 bp, Artificial Sequence
  Synthetic
caaagcatcgutgggttgtcuaaa

SEQ ID NO: 33350 - DNA, 29 bp, Artificial Sequence
  Synthetic
agcaatatcttcuggcatagcattctuaa

SEQ ID NO: 33351 - DNA, 25 bp, Artificial Sequence
  Synthetic
gaagtcattagagautggctgguga

SEQ ID NO: 33352 - DNA, 22 bp, Artificial Sequence
  Synthetic
aatcttgccauccttccuccag

SEQ ID NO: 33353 - DNA, 27 bp, Artificial Sequence
  Synthetic
agtagcaactugcattgtagtttuaca

SEQ ID NO: 33354 - DNA, 23 bp, Artificial Sequence
  Synthetic
gtgtatucaccagcaucggaaag

SEQ ID NO: 33355 - DNA, 31 bp, Artificial Sequence
  Synthetic
tgaaagaaaucaaagacatcatctugacaga

SEQ ID NO: 33356 - DNA, 26 bp, Artificial Sequence
  Synthetic
ttcccctugaatatgaacttuggaaa

SEQ ID NO: 33357 - DNA, 28 bp, Artificial Sequence
  Synthetic
ctcaccctccauggtttactatuaaaca

SEQ ID NO: 33358 - DNA, 29 bp, Artificial Sequence
  Synthetic
tgtgtgtgaauacagaaagaatatgcugt

SEQ ID NO: 33359 - DNA, 28 bp, Artificial Sequence
  Synthetic
tccaagatacgugggcttaattttagut

SEQ ID NO: 33360 - DNA, 27 bp, Artificial Sequence
  Synthetic
tgtaccttttgtuggttcaggaatcut

SEQ ID NO: 33361 - DNA, 33 bp, Artificial Sequence
  Synthetic
gaaaaataaattgatatutcagatgaggtgcut

SEQ ID NO: 33362 - DNA, 24 bp, Artificial Sequence
  Synthetic
acttaacgcugacagaatggtuga

SEQ ID NO: 33363 - DNA, 30 bp, Artificial Sequence
  Synthetic
agagacatttttctugttgaaattccgtut

SEQ ID NO: 33364 - DNA, 27 bp, Artificial Sequence
  Synthetic
ctggatagaaguttgaagcaggcuaat

SEQ ID NO: 33365 - DNA, 32 bp, Artificial Sequence
  Synthetic
atccacatgcuaacatatacatatacuaacac

SEQ ID NO: 33366 - DNA, 20 bp, Artificial Sequence
  Synthetic
tgtaccugctggagguggaa

SEQ ID NO: 33367 - DNA, 30 bp, Artificial Sequence
  Synthetic
atcgtgtttagugtttgtccatctuagaat

SEQ ID NO: 33368 - DNA, 26 bp, Artificial Sequence
  Synthetic
aggtgacttautagacaagggugagt

SEQ ID NO: 33369 - DNA, 29 bp, Artificial Sequence
  Synthetic
gtgatgaatgttuactggtgattgttuct

SEQ ID NO: 33370 - DNA, 29 bp, Artificial Sequence
  Synthetic
tgaaaugtgaaaatcaugaagcagaacag

SEQ ID NO: 33371 - DNA, 28 bp, Artificial Sequence
  Synthetic
gcttttgtcttguttctcaatcttcgut

SEQ ID NO: 33372 - DNA, 19 bp, Artificial Sequence
  Synthetic
gggaggacuttccggttug

SEQ ID NO: 33373 - DNA, 20 bp, Artificial Sequence
  Synthetic
agugccacccacaaaaggua

SEQ ID NO: 33374 - DNA, 28 bp, Artificial Sequence
  Synthetic
gatcatcugaagcctaaaatcagugaca

SEQ ID NO: 33375 - DNA, 29 bp, Artificial Sequence
  Synthetic
ttgagtttaagcgucagaagatctatcuc

SEQ ID NO: 33376 - DNA, 22 bp, Artificial Sequence
  Synthetic
catagccaucttgtggcatuga

SEQ ID NO: 33377 - DNA, 29 bp, Artificial Sequence
  Synthetic
gtgccuaagaaaattgtgguagaagaaaa

SEQ ID NO: 33378 - DNA, 25 bp, Artificial Sequence
  Synthetic
gacatcaaguggaatgcaaactugt

SEQ ID NO: 33379 - DNA, 28 bp, Artificial Sequence
  Synthetic
agtgctccaaaauacttcaagagtucat

SEQ ID NO: 33380 - DNA, 25 bp, Artificial Sequence
  Synthetic
cttccactucttcagccucaaaaac

SEQ ID NO: 33381 - DNA, 26 bp, Artificial Sequence
  Synthetic
agaaatuccggaagaagaagagtucc

SEQ ID NO: 33382 - DNA, 28 bp, Artificial Sequence
  Synthetic
caucaaaaacaaucaagacacagagaca

SEQ ID NO: 33383 - DNA, 29 bp, Artificial Sequence
  Synthetic
ttgaacattcucagctaacuaaaacacct

SEQ ID NO: 33384 - DNA, 25 bp, Artificial Sequence
  Synthetic
tcctctatgcuaggtggttcttcug

SEQ ID NO: 33385 - DNA, 21 bp, Artificial Sequence
  Synthetic
acaagcgtutcgaaggcugag

SEQ ID NO: 33386 - DNA, 24 bp, Artificial Sequence
  Synthetic
actggagaugaacaaaaggauggg

SEQ ID NO: 33387 - DNA, 26 bp, Artificial Sequence
  Synthetic
aggaagttccucccgaagaagaauat

SEQ ID NO: 33388 - DNA, 26 bp, Artificial Sequence
  Synthetic
agaacttccucttcctcagguagaac

SEQ ID NO: 33389 - DNA, 28 bp, Artificial Sequence
  Synthetic
cctttcataagcutcttcattgttguga

SEQ ID NO: 33390 - DNA, 24 bp, Artificial Sequence
  Synthetic
tgcaacatugcaagttcatguacc

SEQ ID NO: 33391 - DNA, 21 bp, Artificial Sequence
  Synthetic
ggccttacautgccagcctua

SEQ ID NO: 33392 - DNA, 23 bp, Artificial Sequence
  Synthetic
gugacacauacacaaggtttuga

SEQ ID NO: 33393 - DNA, 29 bp, Artificial Sequence
  Synthetic
ttctttcctgcaaaauttccaacattcut

SEQ ID NO: 33394 - DNA, 26 bp, Artificial Sequence
  Synthetic
ttcccacaaaagaaguttucacacac

SEQ ID NO: 33395 - DNA, 25 bp, Artificial Sequence
  Synthetic
tgggtggccutttactgacaauaaa

SEQ ID NO: 33396 - DNA, 24 bp, Artificial Sequence
  Synthetic
acucagcaaaaauacagaccauca

SEQ ID NO: 33397 - DNA, 28 bp, Artificial Sequence
  Synthetic
ctagcctugagaaacctgtttcaattut

SEQ ID NO: 33398 - DNA, 25 bp, Artificial Sequence
  Synthetic
tgagtgtgcacauatttagtguggt

SEQ ID NO: 33399 - DNA, 28 bp, Artificial Sequence
  Synthetic
gcttatacccuagaagaagaagctgtut

SEQ ID NO: 33400 - DNA, 29 bp, Artificial Sequence
  Synthetic
agtataggagucagattgggaacuagaag

SEQ ID NO: 33401 - DNA, 28 bp, Artificial Sequence
  Synthetic
acacacatttucagaatcttgcaatuca

SEQ ID NO: 33402 - DNA, 23 bp, Artificial Sequence
  Synthetic
cagcccccauaaccagtgtatut

SEQ ID NO: 33403 - DNA, 30 bp, Artificial Sequence
  Synthetic
cgtccactttgatauaactccctaatccua

SEQ ID NO: 33404 - DNA, 27 bp, Artificial Sequence
  Synthetic
ggcacacttatuttctggttaatgtut

SEQ ID NO: 33405 - DNA, 29 bp, Artificial Sequence
  Synthetic
acctaatcttuctaaagttccugaagcac

SEQ ID NO: 33406 - DNA, 29 bp, Artificial Sequence
  Synthetic
ggtctguagacaatttgugaaagaaaaca

SEQ ID NO: 33407 - DNA, 28 bp, Artificial Sequence
  Synthetic
cagcaggctgaauttaaatgaaacctua

SEQ ID NO: 33408 - DNA, 28 bp, Artificial Sequence
  Synthetic
cagaccagauggaaaaagcaagaattua

SEQ ID NO: 33409 - DNA, 24 bp, Artificial Sequence
  Synthetic
actgggctucaatgagatcacaut

SEQ ID NO: 33410 - DNA, 26 bp, Artificial Sequence
  Synthetic
gacatgcaautaaagaggctugaagg

SEQ ID NO: 33411 - DNA, 24 bp, Artificial Sequence
  Synthetic
tccacccguctgctttctuaaaaa

SEQ ID NO: 33412 - DNA, 28 bp, Artificial Sequence
  Synthetic
agacaaaggcagcauagtacataugaag

SEQ ID NO: 33413 - DNA, 30 bp, Artificial Sequence
  Synthetic
tctcagaaggtgacuagaatattccacaut

SEQ ID NO: 33414 - DNA, 28 bp, Artificial Sequence
  Synthetic
tcgtttcagatutgtgagttactuagca

SEQ ID NO: 33415 - DNA, 29 bp, Artificial Sequence
  Synthetic
gtacctgaagttucaaagaagattgtucc

SEQ ID NO: 33416 - DNA, 22 bp, Artificial Sequence
  Synthetic
gtgcctatuggattgaacugct

SEQ ID NO: 33417 - DNA, 29 bp, Artificial Sequence
  Synthetic
agcatcccttcutattcctgtgttttuat

SEQ ID NO: 33418 - DNA, 22 bp, Artificial Sequence
  Synthetic
tccccttcgucatagccttcut

SEQ ID NO: 33419 - DNA, 26 bp, Artificial Sequence
  Synthetic
cacaaggagaagagagucttcatuga

SEQ ID NO: 33420 - DNA, 29 bp, Artificial Sequence
  Synthetic
agaatagtuagcagaagtgcaaatcucag

SEQ ID NO: 33421 - DNA, 28 bp, Artificial Sequence
  Synthetic
caaacaactaacaaugatgtggaggaut

SEQ ID NO: 33422 - DNA, 22 bp, Artificial Sequence
  Synthetic
tcutgaccacuagagggccaat

SEQ ID NO: 33423 - DNA, 21 bp, Artificial Sequence
  Synthetic
tcctgtggtugctcctccuat

SEQ ID NO: 33424 - DNA, 20 bp, Artificial Sequence
  Synthetic
tgcagtttggucgctgguat

SEQ ID NO: 33425 - DNA, 29 bp, Artificial Sequence
  Synthetic
ctctatgcttatuacatgtcccttuccag

SEQ ID NO: 33426 - DNA, 26 bp, Artificial Sequence
  Synthetic
agaatggtatagguaggctacgtgut

SEQ ID NO: 33427 - DNA, 30 bp, Artificial Sequence
  Synthetic
gcaacataucagaaaacaaaagttggauga

SEQ ID NO: 33428 - DNA, 21 bp, Artificial Sequence
  Synthetic
cggccatcautcctgaagtug

SEQ ID NO: 33429 - DNA, 30 bp, Artificial Sequence
  Synthetic
aatctaacttugaaccctctttgtactuaa

SEQ ID NO: 33430 - DNA, 22 bp, Artificial Sequence
  Synthetic
ctggtcttcugctcgaacauct

SEQ ID NO: 33431 - DNA, 26 bp, Artificial Sequence
  Synthetic
aaaatgcgtgutgtatcacaugaaca

SEQ ID NO: 33432 - DNA, 28 bp, Artificial Sequence
  Synthetic
cggtcaccaucaatgcttatttcaaaut

SEQ ID NO: 33433 - DNA, 31 bp, Artificial Sequence
  Synthetic
agggaaggaguaacaaatgtgttttaatuct

SEQ ID NO: 33434 - DNA, 28 bp, Artificial Sequence
  Synthetic
tgacgtcatauaactataggattcuggt

SEQ ID NO: 33435 - DNA, 23 bp, Artificial Sequence
  Synthetic
cactgactuccgaggtcttctuc

SEQ ID NO: 33436 - DNA, 21 bp, Artificial Sequence
  Synthetic
gtggaugcggaacccactuat

SEQ ID NO: 33437 - DNA, 27 bp, Artificial Sequence
  Synthetic
acaaaaactgautctgggttauaccga

SEQ ID NO: 33438 - DNA, 24 bp, Artificial Sequence
  Synthetic
agtgcacttacuttctacgacuct

SEQ ID NO: 33439 - DNA, 28 bp, Artificial Sequence
  Synthetic
caacctccuaaggcttatttuacaaagg

SEQ ID NO: 33440 - DNA, 22 bp, Artificial Sequence
  Synthetic
actagcaaagcugaagcugcat

SEQ ID NO: 33441 - DNA, 30 bp, Artificial Sequence
  Synthetic
gcctttatgttccucatgaaaataccttut

SEQ ID NO: 33442 - DNA, 23 bp, Artificial Sequence
  Synthetic
gcatcatuggacactttgcaugt

SEQ ID NO: 33443 - DNA, 23 bp, Artificial Sequence
  Synthetic
ctttcaaactugagggacgtgug

SEQ ID NO: 33444 - DNA, 24 bp, Artificial Sequence
  Synthetic
tcauaaaaacgacacctucaggct

SEQ ID NO: 33445 - DNA, 22 bp, Artificial Sequence
  Synthetic
gaaguggcggaaaguaccagat

SEQ ID NO: 33446 - DNA, 24 bp, Artificial Sequence
  Synthetic
tctggaccaugtcagtttacugaa

SEQ ID NO: 33447 - DNA, 29 bp, Artificial Sequence
  Synthetic
catttttagacaauacagccacacucaat

SEQ ID NO: 33448 - DNA, 24 bp, Artificial Sequence
  Synthetic
aggccuccccagacattttaaauc

SEQ ID NO: 33449 - DNA, 24 bp, Artificial Sequence
  Synthetic
acccacuacgacttacaaaaugca

SEQ ID NO: 33450 - DNA, 23 bp, Artificial Sequence
  Synthetic
ggttcugcagccaagagagauaa

SEQ ID NO: 33451 - DNA, 25 bp, Artificial Sequence
  Synthetic
tgcaggacaauacaactgctacaut

SEQ ID NO: 33452 - DNA, 25 bp, Artificial Sequence
  Synthetic
ccatttttcutccagguaaccgaaa

SEQ ID NO: 33453 - DNA, 29 bp, Artificial Sequence
  Synthetic
tgtcagactgcucttctagatttauacga

SEQ ID NO: 33454 - DNA, 22 bp, Artificial Sequence
  Synthetic
ctccaaagacacgutgcatcug

SEQ ID NO: 33455 - DNA, 31 bp, Artificial Sequence
  Synthetic
aaccttttctgataugtgcttttgtgttuag

SEQ ID NO: 33456 - DNA, 24 bp, Artificial Sequence
  Synthetic
auttccttcauggaaccaggagac

SEQ ID NO: 33457 - DNA, 28 bp, Artificial Sequence
  Synthetic
tccatcaaaaagacagutctctctucaa

SEQ ID NO: 33458 - DNA, 30 bp, Artificial Sequence
  Synthetic
gtatttgttgtcacutgttagctctttucc

SEQ ID NO: 33459 - DNA, 28 bp, Artificial Sequence
  Synthetic
cacactcaccaggauctgtattttctut

SEQ ID NO: 33460 - DNA, 30 bp, Artificial Sequence
  Synthetic
aaatccatatgtugtcactttctcuaacga

SEQ ID NO: 33461 - DNA, 24 bp, Artificial Sequence
  Synthetic
ccaggcttucctcctttttcauca

SEQ ID NO: 33462 - DNA, 25 bp, Artificial Sequence
  Synthetic
aggatguggatactggtuaggaagt

SEQ ID NO: 33463 - DNA, 29 bp, Artificial Sequence
  Synthetic
acttacagaatacauccgtattttcctut

SEQ ID NO: 33464 - DNA, 24 bp, Artificial Sequence
  Synthetic
accgagucaacgaatgacattcug

SEQ ID NO: 33465 - DNA, 26 bp, Artificial Sequence
  Synthetic
ctgtgtttttccucttggttccauag

SEQ ID NO: 33466 - DNA, 25 bp, Artificial Sequence
  Synthetic
gagaactgucagagtggcagtatut

SEQ ID NO: 33467 - DNA, 27 bp, Artificial Sequence
  Synthetic
caccatgttggucttcattctttucag

SEQ ID NO: 33468 - DNA, 31 bp, Artificial Sequence
  Synthetic
tctgcaaatuagcatcatcttucaaaagaac

SEQ ID NO: 33469 - DNA, 26 bp, Artificial Sequence
  Synthetic
gtggatgcctuctcacctgtaaauaa

SEQ ID NO: 33470 - DNA, 27 bp, Artificial Sequence
  Synthetic
aggaagcaacgutatttttgaatugca

SEQ ID NO: 33471 - DNA, 26 bp, Artificial Sequence
  Synthetic
gctgactaccaucctttgtaccauag

SEQ ID NO: 33472 - DNA, 28 bp, Artificial Sequence
  Synthetic
gctctcaagaauttccagtatgguagat

SEQ ID NO: 33473 - DNA, 30 bp, Artificial Sequence
  Synthetic
caagaattttacccacaugttttctcctua

SEQ ID NO: 33474 - DNA, 22 bp, Artificial Sequence
  Synthetic
tctaatggcugcaccucaaaca

SEQ ID NO: 33475 - DNA, 23 bp, Artificial Sequence
  Synthetic
cccttccgccutgcaatatcuag

SEQ ID NO: 33476 - DNA, 26 bp, Artificial Sequence
  Synthetic
ctccaacaagcucagattcaaaguac

SEQ ID NO: 33477 - DNA, 23 bp, Artificial Sequence
  Synthetic
gcaaaactacccutccccacaua

SEQ ID NO: 33478 - DNA, 28 bp, Artificial Sequence
  Synthetic
atgaatgtaatgugatgtttgctgtcug

SEQ ID NO: 33479 - DNA, 29 bp, Artificial Sequence
  Synthetic
cactcttgagttugaaaggttactttgut

SEQ ID NO: 33480 - DNA, 28 bp, Artificial Sequence
  Synthetic
gaaatcctggtautttcactctctcuga

SEQ ID NO: 33481 - DNA, 25 bp, Artificial Sequence
  Synthetic
gtgtggccaugattctcacatttut

SEQ ID NO: 33482 - DNA, 28 bp, Artificial Sequence
  Synthetic
tcattagtagcuttgcagtgatatuccc

SEQ ID NO: 33483 - DNA, 23 bp, Artificial Sequence
  Synthetic
gccttctccaguaggagctctua

SEQ ID NO: 33484 - DNA, 24 bp, Artificial Sequence
  Synthetic
cuaagagcccaaaucagaggagaa

SEQ ID NO: 33485 - DNA, 30 bp, Artificial Sequence
  Synthetic
tgaaagttggaaauacaacatgtcatucat

SEQ ID NO: 33486 - DNA, 31 bp, Artificial Sequence
  Synthetic
gtaaggaacaaauattgtcaaaagtcaugga

SEQ ID NO: 33487 - DNA, 28 bp, Artificial Sequence
  Synthetic
ctggaggaaacuatacaatcacatgugt

SEQ ID NO: 33488 - DNA, 25 bp, Artificial Sequence
  Synthetic
ccacagttugcaaagaaaaagagug

SEQ ID NO: 33489 - DNA, 21 bp, Artificial Sequence
  Synthetic
cccatccaagugtgctgguat

SEQ ID NO: 33490 - DNA, 31 bp, Artificial Sequence
  Synthetic
cttaaggtgttaggagaugaaatgagaagut

SEQ ID NO: 33491 - DNA, 26 bp, Artificial Sequence
  Synthetic
aacatcaaugacagtggagaguacac

SEQ ID NO: 33492 - DNA, 26 bp, Artificial Sequence
  Synthetic
ggccgtaattuggtatctcctttgua

SEQ ID NO: 33493 - DNA, 31 bp, Artificial Sequence
  Synthetic
tcatttgcattctuctaacatgtagcauagt

SEQ ID NO: 33494 - DNA, 23 bp, Artificial Sequence
  Synthetic
acatcccttccugcctcatttuc

SEQ ID NO: 33495 - DNA, 26 bp, Artificial Sequence
  Synthetic
acctacacuggaacacttccaattuc

SEQ ID NO: 33496 - DNA, 29 bp, Artificial Sequence
  Synthetic
cagtuaaacacaagaaaaauacaaggaug

SEQ ID NO: 33497 - DNA, 24 bp, Artificial Sequence
  Synthetic
ggagaccggugcaacatctattut

SEQ ID NO: 33498 - DNA, 25 bp, Artificial Sequence
  Synthetic
tgtcaacatagaugtgcaccugaag

SEQ ID NO: 33499 - DNA, 30 bp, Artificial Sequence
  Synthetic
gcaaaguaccaaaccauattttcagauaat

SEQ ID NO: 33500 - DNA, 28 bp, Artificial Sequence
  Synthetic
ttgtaaaaggaauttgcauaagcaacca

SEQ ID NO: 33501 - DNA, 22 bp, Artificial Sequence
  Synthetic
caaggauggaaagctgtugacc

SEQ ID NO: 33502 - DNA, 22 bp, Artificial Sequence
  Synthetic
cagcattuggcaccagtttcua

SEQ ID NO: 33503 - DNA, 25 bp, Artificial Sequence
  Synthetic
guccagtggctuaaagagaaggaag

SEQ ID NO: 33504 - DNA, 21 bp, Artificial Sequence
  Synthetic
gtccagatcaugcgagaguga

SEQ ID NO: 33505 - DNA, 30 bp, Artificial Sequence
  Synthetic
gcaagaaauacaagattgcauccaaaaact

SEQ ID NO: 33506 - DNA, 27 bp, Artificial Sequence
  Synthetic
gggagaagguggttttcatttaaugag

SEQ ID NO: 33507 - DNA, 28 bp, Artificial Sequence
  Synthetic
gccagtgataaguacagaatgacttuca

SEQ ID NO: 33508 - DNA, 30 bp, Artificial Sequence
  Synthetic
agacautgtaactgaauacagagaaccaaa

SEQ ID NO: 33509 - DNA, 28 bp, Artificial Sequence
  Synthetic
ggaacttgtcucaggtcctaaatgttuc

SEQ ID NO: 33510 - DNA, 30 bp, Artificial Sequence
  Synthetic
atttuagctctaaaggauacaaaggcaaga

SEQ ID NO: 33511 - DNA, 22 bp, Artificial Sequence
  Synthetic
cagacttgugtgccaugagaga

SEQ ID NO: 33512 - DNA, 24 bp, Artificial Sequence
  Synthetic
caaugcaaacagcaaaacacaucc

SEQ ID NO: 33513 - DNA, 22 bp, Artificial Sequence
  Synthetic
gacagcggucagtacacttuca

SEQ ID NO: 33514 - DNA, 24 bp, Artificial Sequence
  Synthetic
gccatttcacuttgagttctggug

SEQ ID NO: 33515 - DNA, 27 bp, Artificial Sequence
  Synthetic
gtctauagcgacagtttcatuagcaga

SEQ ID NO: 33516 - DNA, 28 bp, Artificial Sequence
  Synthetic
tgtccattauccacacttctgattugaa

SEQ ID NO: 33517 - DNA, 30 bp, Artificial Sequence
  Synthetic
tcacacuctcttatttaaucacagaaccac

SEQ ID NO: 33518 - DNA, 24 bp, Artificial Sequence
  Synthetic
tgctgcttcgaauttccctgtuat

SEQ ID NO: 33519 - DNA, 30 bp, Artificial Sequence
  Synthetic
agtaagctactgucttccttttgaatctut

SEQ ID NO: 33520 - DNA, 24 bp, Artificial Sequence
  Synthetic
ccatcaaugaaggaaatgccaugt

SEQ ID NO: 33521 - DNA, 25 bp, Artificial Sequence
  Synthetic
gttttgcccagugacctgttttuaa

SEQ ID NO: 33522 - DNA, 23 bp, Artificial Sequence
  Synthetic
gaggtgtcauccttccaaacuga

SEQ ID NO: 33523 - DNA, 23 bp, Artificial Sequence
  Synthetic
tctttcaccucagaaccccctua

SEQ ID NO: 33524 - DNA, 29 bp, Artificial Sequence
  Synthetic
ggcagtattgucatgaaaagagaattugt

SEQ ID NO: 33525 - DNA, 25 bp, Artificial Sequence
  Synthetic
ctccttcatucaccaaaaagcugaa

SEQ ID NO: 33526 - DNA, 23 bp, Artificial Sequence
  Synthetic
gggtcagttcutggccatcttua

SEQ ID NO: 33527 - DNA, 25 bp, Artificial Sequence
  Synthetic
ggtaaugcacaacccacatctaucc

SEQ ID NO: 33528 - DNA, 24 bp, Artificial Sequence
  Synthetic
tcttcagtgauttcatcgctguct

SEQ ID NO: 33529 - DNA, 28 bp, Artificial Sequence
  Synthetic
ctggcttttcugaagagtcaattcttut

SEQ ID NO: 33530 - DNA, 24 bp, Artificial Sequence
  Synthetic
ggctaaccagaugatcctgaauga

SEQ ID NO: 33531 - DNA, 22 bp, Artificial Sequence
  Synthetic
cccctccucccttaaugcaaat

SEQ ID NO: 33532 - DNA, 27 bp, Artificial Sequence
  Synthetic
cagtagacuccacaaaagacattcugt

SEQ ID NO: 33533 - DNA, 31 bp, Artificial Sequence
  Synthetic
ctcacatttcttaauaacttccttcctucca

SEQ ID NO: 33534 - DNA, 27 bp, Artificial Sequence
  Synthetic
agcttctttgguaatatagcagctucc

SEQ ID NO: 33535 - DNA, 28 bp, Artificial Sequence
  Synthetic
tcccttagaucaaccctcttaactctut

SEQ ID NO: 33536 - DNA, 22 bp, Artificial Sequence
  Synthetic
gtgcctuccacaaatgctaucc

SEQ ID NO: 33537 - DNA, 21 bp, Artificial Sequence
  Synthetic
cucccttcttgugcaacacac

SEQ ID NO: 33538 - DNA, 28 bp, Artificial Sequence
  Synthetic
agctgggcaacautgtttttaaaactua

SEQ ID NO: 33539 - DNA, 25 bp, Artificial Sequence
  Synthetic
cctaacaagcauttagggtgcuaac

SEQ ID NO: 33540 - DNA, 24 bp, Artificial Sequence
  Synthetic
gcaacaccatuggaaaagctcaut

SEQ ID NO: 33541 - DNA, 30 bp, Artificial Sequence
  Synthetic
gtgttgaaagtgtutgggaattgatatgut

SEQ ID NO: 33542 - DNA, 22 bp, Artificial Sequence
  Synthetic
gccacactugccgacttcatua

SEQ ID NO: 33543 - DNA, 22 bp, Artificial Sequence
  Synthetic
cttcagugtgaagtcucaggca

SEQ ID NO: 33544 - DNA, 25 bp, Artificial Sequence
  Synthetic
ctacaaaagcaugaaagcattgugt

SEQ ID NO: 33545 - DNA, 28 bp, Artificial Sequence
  Synthetic
gtaaaagtugaagacagtgggagtuact

SEQ ID NO: 33546 - DNA, 26 bp, Artificial Sequence
  Synthetic
agtttttctacugaggattcctugca

SEQ ID NO: 33547 - DNA, 27 bp, Artificial Sequence
  Synthetic
ccccagggaaagautataagatctgut

SEQ ID NO: 33548 - DNA, 29 bp, Artificial Sequence
  Synthetic
ggctctaattcttuaatgaaatgtggcut

SEQ ID NO: 33549 - DNA, 26 bp, Artificial Sequence
  Synthetic
gggactcctgugatagaaaccattug

SEQ ID NO: 33550 - DNA, 25 bp, Artificial Sequence
  Synthetic
ccagttgguaatacaagcattuccc

SEQ ID NO: 33551 - DNA, 27 bp, Artificial Sequence
  Synthetic
tcgatctucaaagtatatcuccagcct

SEQ ID NO: 33552 - DNA, 23 bp, Artificial Sequence
  Synthetic
tctggaaguggcagataagugaa

SEQ ID NO: 33553 - DNA, 27 bp, Artificial Sequence
  Synthetic
tcgacaaagtaaauaccgaagaccauc

SEQ ID NO: 33554 - DNA, 26 bp, Artificial Sequence
  Synthetic
ttcctcagaaacagugtccacuaaag

SEQ ID NO: 33555 - DNA, 26 bp, Artificial Sequence
  Synthetic
ggttaaatatttggaugccacaccug

SEQ ID NO: 33556 - DNA, 22 bp, Artificial Sequence
  Synthetic
acttgtttuggctccttgcuga

SEQ ID NO: 33557 - DNA, 22 bp, Artificial Sequence
  Synthetic
ggtcgaggcugtaaacaucacc

SEQ ID NO: 33558 - DNA, 24 bp, Artificial Sequence
  Synthetic
ccttagaaagaagguccctuccct

SEQ ID NO: 33559 - DNA, 22 bp, Artificial Sequence
  Synthetic
acuggaaaaugcagggcaagat

SEQ ID NO: 33560 - DNA, 21 bp, Artificial Sequence
  Synthetic
gtcccucagctaagctcugac

SEQ ID NO: 33561 - DNA, 29 bp, Artificial Sequence
  Synthetic
aactttattagcugaacctgaagggaaut

SEQ ID NO: 33562 - DNA, 24 bp, Artificial Sequence
  Synthetic
ctttggagaaggutttcugggact

SEQ ID NO: 33563 - DNA, 28 bp, Artificial Sequence
  Synthetic
agaaaaccagcaacuatcttaugagcat

SEQ ID NO: 33564 - DNA, 22 bp, Artificial Sequence
  Synthetic
tggaaaatccucaggagccuct

SEQ ID NO: 33565 - DNA, 28 bp, Artificial Sequence
  Synthetic
ctttgcaccagugtttattacactauca

SEQ ID NO: 33566 - DNA, 21 bp, Artificial Sequence
  Synthetic
ccucccagctttuccagagat

SEQ ID NO: 33567 - DNA, 29 bp, Artificial Sequence
  Synthetic
ctattaacccctuctgctgactacaaaut

SEQ ID NO: 33568 - DNA, 24 bp, Artificial Sequence
  Synthetic
gtgccttccutttcggaaucaaat

SEQ ID NO: 33569 - DNA, 26 bp, Artificial Sequence
  Synthetic
gccatcaacuggtgtctaattcttug

SEQ ID NO: 33570 - DNA, 28 bp, Artificial Sequence
  Synthetic
attttaagtuaaggtgagtgcugcaaag

SEQ ID NO: 33571 - DNA, 30 bp, Artificial Sequence
  Synthetic
caaagauggaaaattaguccaaggaagaag

SEQ ID NO: 33572 - DNA, 24 bp, Artificial Sequence
  Synthetic
ccttccaccaccugaaatucaaaa

SEQ ID NO: 33573 - DNA, 22 bp, Artificial Sequence
  Synthetic
agtgcaacauacaggugcagag

SEQ ID NO: 33574 - DNA, 26 bp, Artificial Sequence
  Synthetic
gggatccctaugactgaacattugaa

SEQ ID NO: 33575 - DNA, 27 bp, Artificial Sequence
  Synthetic
gttcccgaattuactcctgaccauaaa

SEQ ID NO: 33576 - DNA, 26 bp, Artificial Sequence
  Synthetic
gacaatttctugaggagaaggtgtuc

SEQ ID NO: 33577 - DNA, 28 bp, Artificial Sequence
  Synthetic
agagtacatgtgucatgctgtaaacauc

SEQ ID NO: 33578 - DNA, 26 bp, Artificial Sequence
  Synthetic
auttcgataccattucacaccaggaa

SEQ ID NO: 33579 - DNA, 27 bp, Artificial Sequence
  Synthetic
caaatgagcatutctacacaccuacag

SEQ ID NO: 33580 - DNA, 24 bp, Artificial Sequence
  Synthetic
gggtgtggaauatcgctcuagagt

SEQ ID NO: 33581 - DNA, 27 bp, Artificial Sequence
  Synthetic
gttgctgaaagauattcaacacctucc

SEQ ID NO: 33582 - DNA, 28 bp, Artificial Sequence
  Synthetic
gggacttuggagattcaaaatatucaac

SEQ ID NO: 33583 - DNA, 29 bp, Artificial Sequence
  Synthetic
tggaagaagtaacuttcaacactgtguat

SEQ ID NO: 33584 - DNA, 24 bp, Artificial Sequence
  Synthetic
acgcttuccagcagcaagtaaaua

SEQ ID NO: 33585 - DNA, 31 bp, Artificial Sequence
  Synthetic
agaatccaggugaacaaataaguacaaacat

SEQ ID NO: 33586 - DNA, 25 bp, Artificial Sequence
  Synthetic
gtggcatctguatattcctgtgucc

SEQ ID NO: 33587 - DNA, 22 bp, Artificial Sequence
  Synthetic
gtgccctacutccaacctcauc

SEQ ID NO: 33588 - DNA, 29 bp, Artificial Sequence
  Synthetic
ctgtacatgucggacttctttttcuaaag

SEQ ID NO: 33589 - DNA, 27 bp, Artificial Sequence
  Synthetic
aaacuagggaacaguaggaaatacaut

SEQ ID NO: 33590 - DNA, 29 bp, Artificial Sequence
  Synthetic
ctggttgaccacuatctaattctuggaat

SEQ ID NO: 33591 - DNA, 26 bp, Artificial Sequence
  Synthetic
agctgctttccuctcaaactcauaaa

SEQ ID NO: 33592 - DNA, 30 bp, Artificial Sequence
  Synthetic
gcttgatcttgautctctttgctttaauga

SEQ ID NO: 33593 - DNA, 27 bp, Artificial Sequence
  Synthetic
gccattgtataugaagaatccctuggt

SEQ ID NO: 33594 - DNA, 25 bp, Artificial Sequence
  Synthetic
cactttgggcacautcttgtacaut

SEQ ID NO: 33595 - DNA, 27 bp, Artificial Sequence
  Synthetic
ttcaagaaccauaaaaaucagcaagcc

SEQ ID NO: 33596 - DNA, 28 bp, Artificial Sequence
  Synthetic
gtctcaaggcttugaaaatagtccctua

SEQ ID NO: 33597 - DNA, 27 bp, Artificial Sequence
  Synthetic
ggcagttgaaagugtttcagatcuaac

SEQ ID NO: 33598 - DNA, 25 bp, Artificial Sequence
  Synthetic
tggttctgcuttaaaaggacuccat

SEQ ID NO: 33599 - DNA, 25 bp, Artificial Sequence
  Synthetic
gaacctaaagcaaugcctcaagauc

SEQ ID NO: 33600 - DNA, 28 bp, Artificial Sequence
  Synthetic
ggaactggugggttagttttuaacaaat

SEQ ID NO: 33601 - DNA, 29 bp, Artificial Sequence
  Synthetic
tggaacaguaaaaacaaccagtatgctua

SEQ ID NO: 33602 - DNA, 23 bp, Artificial Sequence
  Synthetic
gtgggatuggcatgtcattgtua

SEQ ID NO: 33603 - DNA, 28 bp, Artificial Sequence
  Synthetic
tctctgcttcuacacgaattgatgaaut

SEQ ID NO: 33604 - DNA, 28 bp, Artificial Sequence
  Synthetic
tgtggtgtaatagcutgagacacattut

SEQ ID NO: 33605 - DNA, 27 bp, Artificial Sequence
  Synthetic
tccagacugaaataagaaugagccaag

SEQ ID NO: 33606 - DNA, 31 bp, Artificial Sequence
  Synthetic
actctcagctgaaugatctaccttataacut

SEQ ID NO: 33607 - DNA, 22 bp, Artificial Sequence
  Synthetic
ccuggacaaggagaucaaagug

SEQ ID NO: 33608 - DNA, 28 bp, Artificial Sequence
  Synthetic
cattcccttttgutccacatcttgttut

SEQ ID NO: 33609 - DNA, 30 bp, Artificial Sequence
  Synthetic
tgttatucaaaaagggcaagaugagaaaua

SEQ ID NO: 33610 - DNA, 28 bp, Artificial Sequence
  Synthetic
gaatctctgtctuggacccttttaauct

SEQ ID NO: 33611 - DNA, 28 bp, Artificial Sequence
  Synthetic
agccttctttuacccagaaacttacaut

SEQ ID NO: 33612 - DNA, 22 bp, Artificial Sequence
  Synthetic
aagctgcauaaagcgaugagga

SEQ ID NO: 33613 - DNA, 24 bp, Artificial Sequence
  Synthetic
cacgaaggugcaaagauagaggaa

SEQ ID NO: 33614 - DNA, 23 bp, Artificial Sequence
  Synthetic
ccgtggacuctttagcacatucc

SEQ ID NO: 33615 - DNA, 23 bp, Artificial Sequence
  Synthetic
agtggcagautcctcttucacaa

SEQ ID NO: 33616 - DNA, 26 bp, Artificial Sequence
  Synthetic
cacaguatgcaauaaaacaaacagca

SEQ ID NO: 33617 - DNA, 27 bp, Artificial Sequence
  Synthetic
gcttatagtugatgcttacucagagca

SEQ ID NO: 33618 - DNA, 24 bp, Artificial Sequence
  Synthetic
ccattggauttctggctugggaat

SEQ ID NO: 33619 - DNA, 30 bp, Artificial Sequence
  Synthetic
gcaaggtaagacautaaaaattggtaugct

SEQ ID NO: 33620 - DNA, 23 bp, Artificial Sequence
  Synthetic
cttggccuacagcattacuagca

SEQ ID NO: 33621 - DNA, 28 bp, Artificial Sequence
  Synthetic
tgaagtatctcutttcttttgtgucgca

SEQ ID NO: 33622 - DNA, 25 bp, Artificial Sequence
  Synthetic
ggaaaggacaaaagccugcttctua

SEQ ID NO: 33623 - DNA, 27 bp, Artificial Sequence
  Synthetic
ttcaagtgcaaauttcttcatgauggg

SEQ ID NO: 33624 - DNA, 27 bp, Artificial Sequence
  Synthetic
ggaggattauttctgatggauccacaa

SEQ ID NO: 33625 - DNA, 29 bp, Artificial Sequence
  Synthetic
acgacacaaauatgtaguggaaagaagaa

SEQ ID NO: 33626 - DNA, 27 bp, Artificial Sequence
  Synthetic
ggatggtggutagaaaatguaaaaggg

SEQ ID NO: 33627 - DNA, 24 bp, Artificial Sequence
  Synthetic
cgtgtcaacugcaaaactcttugt

SEQ ID NO: 33628 - DNA, 25 bp, Artificial Sequence
  Synthetic
gtttaccguatggtgatucagagga

SEQ ID NO: 33629 - DNA, 26 bp, Artificial Sequence
  Synthetic
tttctacatgcuattttccagcucgt

SEQ ID NO: 33630 - DNA, 30 bp, Artificial Sequence
  Synthetic
gatttgattuccacaccattcttuaaccat

SEQ ID NO: 33631 - DNA, 26 bp, Artificial Sequence
  Synthetic
ttacgtaaagtcuccttgggtgttut

SEQ ID NO: 33632 - DNA, 23 bp, Artificial Sequence
  Synthetic
ttggtcatugccacagacaaaug

SEQ ID NO: 33633 - DNA, 24 bp, Artificial Sequence
  Synthetic
caaaactgccucttttgagtguga

SEQ ID NO: 33634 - DNA, 23 bp, Artificial Sequence
  Synthetic
gggttcatuaaggaaagggcugt

SEQ ID NO: 33635 - DNA, 25 bp, Artificial Sequence
  Synthetic
acaaacacagacuggtcucagaaag

SEQ ID NO: 33636 - DNA, 26 bp, Artificial Sequence
  Synthetic
ggagcaatucagtgatagggtuaact

SEQ ID NO: 33637 - DNA, 22 bp, Artificial Sequence
  Synthetic
ggagttgtgcuggaatccaaug

SEQ ID NO: 33638 - DNA, 28 bp, Artificial Sequence
  Synthetic
tttatggtauccaaaatggccataucgt

SEQ ID NO: 33639 - DNA, 25 bp, Artificial Sequence
  Synthetic
atggccauaaaaggagacutaucat

SEQ ID NO: 33640 - DNA, 29 bp, Artificial Sequence
  Synthetic
ggttaataaauataccaaccugccacagt

SEQ ID NO: 33641 - DNA, 28 bp, Artificial Sequence
  Synthetic
ggaattgatgucctgtggaatttuaagg

SEQ ID NO: 33642 - DNA, 28 bp, Artificial Sequence
  Synthetic
tctcttggtuattgttacacugggaaag

SEQ ID NO: 33643 - DNA, 25 bp, Artificial Sequence
  Synthetic
gtacaggccautgtgaaaggtacua

SEQ ID NO: 33644 - DNA, 27 bp, Artificial Sequence
  Synthetic
acacacacaagaugaatgaattttgut

SEQ ID NO: 33645 - DNA, 27 bp, Artificial Sequence
  Synthetic
gacatgacuaaggaagatgcuggaaat

SEQ ID NO: 33646 - DNA, 22 bp, Artificial Sequence
  Synthetic
cgtctttcauccagacgcctuc

SEQ ID NO: 33647 - DNA, 27 bp, Artificial Sequence
  Synthetic
ctgcagtgagcaucattatggtttaut

SEQ ID NO: 33648 - DNA, 23 bp, Artificial Sequence
  Synthetic
acgtccacgacgagaugtaatug

SEQ ID NO: 33649 - DNA, 29 bp, Artificial Sequence
  Synthetic
ctaagtctagaugcatacctcuccaaaaa

SEQ ID NO: 33650 - DNA, 25 bp, Artificial Sequence
  Synthetic
tcaauggtcagtauggagaggaagt

SEQ ID NO: 33651 - DNA, 26 bp, Artificial Sequence
  Synthetic
ctttttcccccaccuttttcttguag

SEQ ID NO: 33652 - DNA, 20 bp, Artificial Sequence
  Synthetic
tcttcgggccaguaccagua

SEQ ID NO: 33653 - DNA, 28 bp, Artificial Sequence
  Synthetic
aaggcaaaaucacgattccaactttuaa

SEQ ID NO: 33654 - DNA, 25 bp, Artificial Sequence
  Synthetic
ggtaatggctucataatagcccuct

SEQ ID NO: 33655 - DNA, 22 bp, Artificial Sequence
  Synthetic
aaggccugagtttcacguacat

SEQ ID NO: 33656 - DNA, 22 bp, Artificial Sequence
  Synthetic
tccacgatguccaggtaaugga

SEQ ID NO: 33657 - DNA, 24 bp, Artificial Sequence
  Synthetic
aggtgcacutacaggtguaacaac

SEQ ID NO: 33658 - DNA, 26 bp, Artificial Sequence
  Synthetic
ccatatttgtuagtggctcugcaagt

SEQ ID NO: 33659 - DNA, 24 bp, Artificial Sequence
  Synthetic
tccttaagacutaagcgcttuggg

SEQ ID NO: 33660 - DNA, 22 bp, Artificial Sequence
  Synthetic
tctatatgucccccgtgggaug

SEQ ID NO: 33661 - DNA, 27 bp, Artificial Sequence
  Synthetic
attgattattcccucccccaactttut

SEQ ID NO: 33662 - DNA, 24 bp, Artificial Sequence
  Synthetic
tcaaccatacaaugtcagggtugg

SEQ ID NO: 33663 - DNA, 26 bp, Artificial Sequence
  Synthetic
caggtatttcagccutactccctcua

SEQ ID NO: 33664 - DNA, 28 bp, Artificial Sequence
  Synthetic
ggcagggacaauaattagtgattgagua

SEQ ID NO: 33665 - DNA, 29 bp, Artificial Sequence
  Synthetic
tgcucatgaatcauaaaaacacaaaaaca

SEQ ID NO: 33666 - DNA, 28 bp, Artificial Sequence
  Synthetic
gaaacaggtttuaacacaaagactggut

SEQ ID NO: 33667 - DNA, 24 bp, Artificial Sequence
  Synthetic
gcctcacgaaaguattgtgtguct

SEQ ID NO: 33668 - DNA, 23 bp, Artificial Sequence
  Synthetic
ggaatgtaagucggagcuccaag

SEQ ID NO: 33669 - DNA, 22 bp, Artificial Sequence
  Synthetic
caagcgcaucaaacauggagaa

SEQ ID NO: 33670 - DNA, 27 bp, Artificial Sequence
  Synthetic
ccaatttguatctttactguggcaagg

SEQ ID NO: 33671 - DNA, 25 bp, Artificial Sequence
  Synthetic
atggagaagaaaagauggcagtuga

SEQ ID NO: 33672 - DNA, 21 bp, Artificial Sequence
  Synthetic
tcuaaccccgagctcaucact

SEQ ID NO: 33673 - DNA, 29 bp, Artificial Sequence
  Synthetic
cacctggatttguatactctgagtaugaa

SEQ ID NO: 33674 - DNA, 23 bp, Artificial Sequence
  Synthetic
gcacauagaaactggagtugcac

SEQ ID NO: 33675 - DNA, 28 bp, Artificial Sequence
  Synthetic
cccacagaagagutgttgataactgaut

SEQ ID NO: 33676 - DNA, 23 bp, Artificial Sequence
  Synthetic
ccagtttcuggaccactggttut

SEQ ID NO: 33677 - DNA, 23 bp, Artificial Sequence
  Synthetic
ccagtautggcaaatugcaaccc

SEQ ID NO: 33678 - DNA, 23 bp, Artificial Sequence
  Synthetic
aagtgatggcaugtgcatuagga

SEQ ID NO: 33679 - DNA, 22 bp, Artificial Sequence
  Synthetic
gacagugacatgguacagggaa

SEQ ID NO: 33680 - DNA, 25 bp, Artificial Sequence
  Synthetic
gagaaactgauctttgcaaacgugt

SEQ ID NO: 33681 - DNA, 29 bp, Artificial Sequence
  Synthetic
tgcatgagcuaagagtttatgagattucc

SEQ ID NO: 33682 - DNA, 22 bp, Artificial Sequence
  Synthetic
aacgccagcutcactcttguaa

SEQ ID NO: 33683 - DNA, 30 bp, Artificial Sequence
  Synthetic
tgactttattttcugactctgtttccaugt

SEQ ID NO: 33684 - DNA, 24 bp, Artificial Sequence
  Synthetic
tgaggctugctttaccaugaacaa

SEQ ID NO: 33685 - DNA, 27 bp, Artificial Sequence
  Synthetic
cactttggaguacggatauaaggaacg

SEQ ID NO: 33686 - DNA, 23 bp, Artificial Sequence
  Synthetic
gggauttcacactuggaacaaca

SEQ ID NO: 33687 - DNA, 31 bp, Artificial Sequence
  Synthetic
aagccctgttcaacutaaatcttgatttuac

SEQ ID NO: 33688 - DNA, 22 bp, Artificial Sequence
  Synthetic
agtgacuttcacatuggcagga

SEQ ID NO: 33689 - DNA, 29 bp, Artificial Sequence
  Synthetic
gtcttcccatugcttttgtatctttugaa

SEQ ID NO: 33690 - DNA, 31 bp, Artificial Sequence
  Synthetic
gcttcttgagttacutgtttctgtttctuag

SEQ ID NO: 33691 - DNA, 28 bp, Artificial Sequence
  Synthetic
accatattattucattgggcaucaggaa

SEQ ID NO: 33692 - DNA, 23 bp, Artificial Sequence
  Synthetic
ctcagtggauggtggttgagtua

SEQ ID NO: 33693 - DNA, 22 bp, Artificial Sequence
  Synthetic
gttgttgcugccgttgataugg

SEQ ID NO: 33694 - DNA, 31 bp, Artificial Sequence
  Synthetic
tgaaauaaggaaaaauaaaaccattcugaca

SEQ ID NO: 33695 - DNA, 23 bp, Artificial Sequence
  Synthetic
gaggcugagaugagagagacaac

SEQ ID NO: 33696 - DNA, 24 bp, Artificial Sequence
  Synthetic
ggacaagggaauctttctcgttuc

SEQ ID NO: 33697 - DNA, 22 bp, Artificial Sequence
  Synthetic
aagucaagauccccaacaccac

SEQ ID NO: 33698 - DNA, 26 bp, Artificial Sequence
  Synthetic
aagatuaaaacaaagcccacgtugag

SEQ ID NO: 33699 - DNA, 24 bp, Artificial Sequence
  Synthetic
acattcauctttccctucccacag

SEQ ID NO: 33700 - DNA, 24 bp, Artificial Sequence
  Synthetic
gtagaggucgccttcttgugaaat

SEQ ID NO: 33701 - DNA, 27 bp, Artificial Sequence
  Synthetic
tctcactcttgacuttgttctcttguc

SEQ ID NO: 33702 - DNA, 22 bp, Artificial Sequence
  Synthetic
agatccatuggtggcttucagg

SEQ ID NO: 33703 - DNA, 27 bp, Artificial Sequence
  Synthetic
tgcccattcaaacauaaaggtgaatug

SEQ ID NO: 33704 - DNA, 24 bp, Artificial Sequence
  Synthetic
gtgccatgtucctcaagagaauct

SEQ ID NO: 33705 - DNA, 29 bp, Artificial Sequence
  Synthetic
gaagcatggaagaaaugattccaaaguaa

SEQ ID NO: 33706 - DNA, 22 bp, Artificial Sequence
  Synthetic
accaactgccugctttgauagt

SEQ ID NO: 33707 - DNA, 30 bp, Artificial Sequence
  Synthetic
cttcagaaaattgtutcccttggaatguag

SEQ ID NO: 33708 - DNA, 24 bp, Artificial Sequence
  Synthetic
ccttcttaugaggcaggatucgat

SEQ ID NO: 33709 - DNA, 27 bp, Artificial Sequence
  Synthetic
gaagtatggcucttataatugcccgaa

SEQ ID NO: 33710 - DNA, 28 bp, Artificial Sequence
  Synthetic
acagtctaaagguaatgaaagtgatugg

SEQ ID NO: 33711 - DNA, 31 bp, Artificial Sequence
  Synthetic
cgcgttatctgttutatgtctttgttttgut

SEQ ID NO: 33712 - DNA, 28 bp, Artificial Sequence
  Synthetic
aaatgatatttcacagucttctgcccua

SEQ ID NO: 33713 - DNA, 27 bp, Artificial Sequence
  Synthetic
aaaaatatcgauggatgtccccuaacc

SEQ ID NO: 33714 - DNA, 25 bp, Artificial Sequence
  Synthetic
agagggagaagggucagtttaauga

SEQ ID NO: 33715 - DNA, 29 bp, Artificial Sequence
  Synthetic
tgccttctttgcutgatttgtattttuct

SEQ ID NO: 33716 - DNA, 30 bp, Artificial Sequence
  Synthetic
ccaaatatguagctaaaactagugaaggca

SEQ ID NO: 33717 - DNA, 26 bp, Artificial Sequence
  Synthetic
gtcactttgtguatgtgtgtgtgtut

SEQ ID NO: 33718 - DNA, 22 bp, Artificial Sequence
  Synthetic
cctgcaagcutcaacagaggut

SEQ ID NO: 33719 - DNA, 27 bp, Artificial Sequence
  Synthetic
acagacttgugtgtcatttuaaaggga

SEQ ID NO: 33720 - DNA, 29 bp, Artificial Sequence
  Synthetic
ttttgttccttuttcaagcagaugaagag

SEQ ID NO: 33721 - DNA, 28 bp, Artificial Sequence
  Synthetic
tgttcctctctaugaaacacaatggtut

SEQ ID NO: 33722 - DNA, 19 bp, Artificial Sequence
  Synthetic
cagcaccacgucacaacug

SEQ ID NO: 33723 - DNA, 17 bp, Artificial Sequence
  Synthetic
gccaugcccuggaggag

SEQ ID NO: 33724 - DNA, 31 bp, Artificial Sequence
  Synthetic
tctattatatttuagaacagtctgctugccc

SEQ ID NO: 33725 - DNA, 25 bp, Artificial Sequence
  Synthetic
agaagaggaagaccuggagcaauaa

SEQ ID NO: 33726 - DNA, 30 bp, Artificial Sequence
  Synthetic
tttttgtttucagaguagattcttcatauc

SEQ ID NO: 33727 - DNA, 22 bp, Artificial Sequence
  Synthetic
tgacugtgaattgucccagcat

SEQ ID NO: 33728 - DNA, 26 bp, Artificial Sequence
  Synthetic
tttatctccctuccaggagaaatugc

SEQ ID NO: 33729 - DNA, 26 bp, Artificial Sequence
  Synthetic
actagaccauatgaagagctuggaca

SEQ ID NO: 33730 - DNA, 31 bp, Artificial Sequence
  Synthetic
ggaattgaatatutggttctggtauacagca

SEQ ID NO: 33731 - DNA, 22 bp, Artificial Sequence
  Synthetic
cuccaagcactguacaccaaag

SEQ ID NO: 33732 - DNA, 32 bp, Artificial Sequence
  Synthetic
agaaggattcacutgtataaaatauccaccag

SEQ ID NO: 33733 - DNA, 21 bp, Artificial Sequence
  Synthetic
cgugcaagauggaggaagcaa

SEQ ID NO: 33734 - DNA, 29 bp, Artificial Sequence
  Synthetic
gggattgacauatgttttagaugagaaga

SEQ ID NO: 33735 - DNA, 27 bp, Artificial Sequence
  Synthetic
gcttttgagagaacucattacccugac

SEQ ID NO: 33736 - DNA, 22 bp, Artificial Sequence
  Synthetic
cacaggtuaaacccccucacat

SEQ ID NO: 33737 - DNA, 23 bp, Artificial Sequence
  Synthetic
agcutttatgcccucaggaaagg

SEQ ID NO: 33738 - DNA, 26 bp, Artificial Sequence
  Synthetic
gcacaatucacagttctagaauccca

SEQ ID NO: 33739 - DNA, 17 bp, Artificial Sequence
  Synthetic
gagggcaucggcuagct

SEQ ID NO: 33740 - DNA, 21 bp, Artificial Sequence
  Synthetic
gctgtgttuggccttcttcuc

SEQ ID NO: 33741 - DNA, 20 bp, Artificial Sequence
  Synthetic
acagcccugcttgtcucaac

SEQ ID NO: 33742 - DNA, 20 bp, Artificial Sequence
  Synthetic
atuggagagucccagatguc

SEQ ID NO: 33743 - DNA, 20 bp, Artificial Sequence
  Synthetic
gcgtcuccaagatcctgugc

SEQ ID NO: 33744 - DNA, 18 bp, Artificial Sequence
  Synthetic
cgctgaggcccuccctua

SEQ ID NO: 33745 - DNA, 18 bp, Artificial Sequence
  Synthetic
gtucccgagggtcauccg

SEQ ID NO: 33746 - DNA, 30 bp, Artificial Sequence
  Synthetic
aaagaataaagauggagggtgtgataaucc

SEQ ID NO: 33747 - DNA, 22 bp, Artificial Sequence
  Synthetic
cggtttcuggactcttcctuga

SEQ ID NO: 33748 - DNA, 27 bp, Artificial Sequence
  Synthetic
caaaaaggaaguaggaaaugctcttua

SEQ ID NO: 33749 - DNA, 22 bp, Artificial Sequence
  Synthetic
tgatgacagcugtgctaacguc

SEQ ID NO: 33750 - DNA, 23 bp, Artificial Sequence
  Synthetic
tgaaggctcccuttggtacatug

SEQ ID NO: 33751 - DNA, 22 bp, Artificial Sequence
  Synthetic
caccttgtguccaacctcucag

SEQ ID NO: 33752 - DNA, 24 bp, Artificial Sequence
  Synthetic
ttagagtcattugcttccccaucc

SEQ ID NO: 33753 - DNA, 29 bp, Artificial Sequence
  Synthetic
tctgtccuccaagaataaatcucaagaga

SEQ ID NO: 33754 - DNA, 23 bp, Artificial Sequence
  Synthetic
gctccacttcuccttcaaggaut

SEQ ID NO: 33755 - DNA, 27 bp, Artificial Sequence
  Synthetic
gatccaagaaugggctttttctuacag

SEQ ID NO: 33756 - DNA, 17 bp, Artificial Sequence
  Synthetic
ggguggagctuccagca

SEQ ID NO: 33757 - DNA, 28 bp, Artificial Sequence
  Synthetic
gcttgaagattgtuaacctatgaggcut

SEQ ID NO: 33758 - DNA, 24 bp, Artificial Sequence
  Synthetic
cctcagtguaagacagctcugaat

SEQ ID NO: 33759 - DNA, 22 bp, Artificial Sequence
  Synthetic
ttctccauggtgttucccaagg

SEQ ID NO: 33760 - DNA, 27 bp, Artificial Sequence
  Synthetic
agaataaaattcaacccuccacagcut

SEQ ID NO: 33761 - DNA, 29 bp, Artificial Sequence
  Synthetic
acaagattgggagaucaatgtttguaact

SEQ ID NO: 33762 - DNA, 21 bp, Artificial Sequence
  Synthetic
agcccccuctctagaagaucc

SEQ ID NO: 33763 - DNA, 25 bp, Artificial Sequence
  Synthetic
tgcttgctgutcctgagatcuaaaa

SEQ ID NO: 33764 - DNA, 27 bp, Artificial Sequence
  Synthetic
gacaataaaagucaagatgctgggaut

SEQ ID NO: 33765 - DNA, 22 bp, Artificial Sequence
  Synthetic
gagtcagugagcctggaacauc

SEQ ID NO: 33766 - DNA, 23 bp, Artificial Sequence
  Synthetic
gggatuaacgtgcatatuccaca

SEQ ID NO: 33767 - DNA, 28 bp, Artificial Sequence
  Synthetic
tggtgacatugttcagtcaaatuaacct

SEQ ID NO: 33768 - DNA, 17 bp, Artificial Sequence
  Synthetic
gctgggcugccauggaa

SEQ ID NO: 33769 - DNA, 23 bp, Artificial Sequence
  Synthetic
gcccagccuttgcttctatttut

SEQ ID NO: 33770 - DNA, 21 bp, Artificial Sequence
  Synthetic
gctcaucccaacctcatgguc

SEQ ID NO: 33771 - DNA, 21 bp, Artificial Sequence
  Synthetic
gctccttgutgtagccctuct

SEQ ID NO: 33772 - DNA, 24 bp, Artificial Sequence
  Synthetic
agagagagagagagugggtgaaug

SEQ ID NO: 33773 - DNA, 19 bp, Artificial Sequence
  Synthetic
ccctcggccutccaaagug

SEQ ID NO: 33774 - DNA, 21 bp, Artificial Sequence
  Synthetic
tcaccctgccucctttcctua

SEQ ID NO: 33775 - DNA, 19 bp, Artificial Sequence
  Synthetic
guggcagccaguacacgaa

SEQ ID NO: 33776 - DNA, 21 bp, Artificial Sequence
  Synthetic
gagtgtcacuctctgcccaut

SEQ ID NO: 33777 - DNA, 20 bp, Artificial Sequence
  Synthetic
tgugtgtgtcugagggacct

SEQ ID NO: 33778 - DNA, 19 bp, Artificial Sequence
  Synthetic
ccgcaagccccucttcuac

SEQ ID NO: 33779 - DNA, 19 bp, Artificial Sequence
  Synthetic
ggcucccaggaggaaguga

SEQ ID NO: 33780 - DNA, 20 bp, Artificial Sequence
  Synthetic
gctccaagcugagtgttugc

SEQ ID NO: 33781 - DNA, 24 bp, Artificial Sequence
  Synthetic
ccaggattacaguggtgagcttut

SEQ ID NO: 33782 - DNA, 20 bp, Artificial Sequence
  Synthetic
gccgaggaguacttccugct

SEQ ID NO: 33783 - DNA, 17 bp, Artificial Sequence
  Synthetic
gggccagagugggtgug

SEQ ID NO: 33784 - DNA, 18 bp, Artificial Sequence
  Synthetic
tctcugccccuacccaca

SEQ ID NO: 33785 - DNA, 18 bp, Artificial Sequence
  Synthetic
tcucctggcuccccaaca

SEQ ID NO: 33786 - DNA, 22 bp, Artificial Sequence
  Synthetic
ccuatttagcuggcagggacat

SEQ ID NO: 33787 - DNA, 21 bp, Artificial Sequence
  Synthetic
aggtcaatcuccttgcagugg

SEQ ID NO: 33788 - DNA, 19 bp, Artificial Sequence
  Synthetic
tcugacacaugcacgcaca

SEQ ID NO: 33789 - DNA, 23 bp, Artificial Sequence
  Synthetic
cagtactuggagacagugaaggt

SEQ ID NO: 33790 - DNA, 21 bp, Artificial Sequence
  Synthetic
gcatctccutctgccacauct

SEQ ID NO: 33791 - DNA, 20 bp, Artificial Sequence
  Synthetic
cccaccuggctttagaccuc

SEQ ID NO: 33792 - DNA, 19 bp, Artificial Sequence
  Synthetic
cgtuacaacggccuacggt

SEQ ID NO: 33793 - DNA, 17 bp, Artificial Sequence
  Synthetic
ccagttcuccgcccucc

SEQ ID NO: 33794 - DNA, 22 bp, Artificial Sequence
  Synthetic
gtcatcttcugcaatcgcaguc

SEQ ID NO: 33795 - DNA, 20 bp, Artificial Sequence
  Synthetic
gcttcagaccgugctaucgt

SEQ ID NO: 33796 - DNA, 22 bp, Artificial Sequence
  Synthetic
ccctagtcugccactgaggaut

SEQ ID NO: 33797 - DNA, 25 bp, Artificial Sequence
  Synthetic
acagaaatctucaatctcccauccg

SEQ ID NO: 33798 - DNA, 19 bp, Artificial Sequence
  Synthetic
accagcacugcaaauggct

SEQ ID NO: 33799 - DNA, 19 bp, Artificial Sequence
  Synthetic
cgaggcugcctgtcttcua

SEQ ID NO: 33800 - DNA, 26 bp, Artificial Sequence
  Synthetic
cccaccttauattgccatcttuacga

SEQ ID NO: 33801 - DNA, 25 bp, Artificial Sequence
  Synthetic
agctcagctgutttctttccctuag

SEQ ID NO: 33802 - DNA, 27 bp, Artificial Sequence
  Synthetic
acgctttaagtutgcacataaatcucc

SEQ ID NO: 33803 - DNA, 26 bp, Artificial Sequence
  Synthetic
aaaccagaguccttaacaagcatuga

SEQ ID NO: 33804 - DNA, 26 bp, Artificial Sequence
  Synthetic
gaatcgcttaauggactagaaggcut

SEQ ID NO: 33805 - DNA, 23 bp, Artificial Sequence
  Synthetic
atguccaggagaccaagttucag

SEQ ID NO: 33806 - DNA, 21 bp, Artificial Sequence
  Synthetic
cggcacaguccactaactcua

SEQ ID NO: 33807 - DNA, 24 bp, Artificial Sequence
  Synthetic
gcactgacugccaactaatttugc

SEQ ID NO: 33808 - DNA, 30 bp, Artificial Sequence
  Synthetic
tctaatttccaacgagguttttcttacuga

SEQ ID NO: 33809 - DNA, 28 bp, Artificial Sequence
  Synthetic
tgtggcttctguttgtcttgtctatuaa

SEQ ID NO: 33810 - DNA, 27 bp, Artificial Sequence
  Synthetic
accccattaautgactgacatuaccac

SEQ ID NO: 33811 - DNA, 28 bp, Artificial Sequence
  Synthetic
ccaatcatggaautttctttctccucct

SEQ ID NO: 33812 - DNA, 27 bp, Artificial Sequence
  Synthetic
tcctcatcccuatcttccttggauaaa

SEQ ID NO: 33813 - DNA, 30 bp, Artificial Sequence
  Synthetic
gcataatttacaccugtgttcttgttguag

SEQ ID NO: 33814 - DNA, 31 bp, Artificial Sequence
  Synthetic
caaacatagctatutgaagctagaagaucct

SEQ ID NO: 33815 - DNA, 22 bp, Artificial Sequence
  Synthetic
gttggtccuaaaggtggtccut

SEQ ID NO: 33816 - DNA, 22 bp, Artificial Sequence
  Synthetic
gctgauagccaaactgcugaac

SEQ ID NO: 33817 - DNA, 32 bp, Artificial Sequence
  Synthetic
tgggttgaatacutttgttctagagtuacaat

SEQ ID NO: 33818 - DNA, 18 bp, Artificial Sequence
  Synthetic
ccagcuggagcgtttucg

SEQ ID NO: 33819 - DNA, 18 bp, Artificial Sequence
  Synthetic
cccuccccaaguccaact

SEQ ID NO: 33820 - DNA, 21 bp, Artificial Sequence
  Synthetic
ctgaccaucacgaggcugaat

SEQ ID NO: 33821 - DNA, 25 bp, Artificial Sequence
  Synthetic
tgtatgagagaaacucaggtuccga

SEQ ID NO: 33822 - DNA, 24 bp, Artificial Sequence
  Synthetic
tgggatuacaggcaaaaaccucat

SEQ ID NO: 33823 - DNA, 20 bp, Artificial Sequence
  Synthetic
ggtagcggucaacaagggut

SEQ ID NO: 33824 - DNA, 23 bp, Artificial Sequence
  Synthetic
cctcagagacuacaaggugaagc

SEQ ID NO: 33825 - DNA, 25 bp, Artificial Sequence
  Synthetic
ggtgactttugggattttccatguc

SEQ ID NO: 33826 - DNA, 22 bp, Artificial Sequence
  Synthetic
gaaggatgcucaggaaguccac

SEQ ID NO: 33827 - DNA, 22 bp, Artificial Sequence
  Synthetic
tgtgugaagcccaucaaagacc

SEQ ID NO: 33828 - DNA, 29 bp, Artificial Sequence
  Synthetic
ggcaacttcaguacttcctatatcttucc

SEQ ID NO: 33829 - DNA, 22 bp, Artificial Sequence
  Synthetic
agtgcaaggcugtcaacaugat

SEQ ID NO: 33830 - DNA, 18 bp, Artificial Sequence
  Synthetic
acatcuggcccgcacauc

SEQ ID NO: 33831 - DNA, 17 bp, Artificial Sequence
  Synthetic
ggcgauacgcguccaca

SEQ ID NO: 33832 - DNA, 28 bp, Artificial Sequence
  Synthetic
tcaaaacagttucactttcctgtcauct

SEQ ID NO: 33833 - DNA, 29 bp, Artificial Sequence
  Synthetic
agtgagggagcaugactaaaaauagaaaa

SEQ ID NO: 33834 - DNA, 25 bp, Artificial Sequence
  Synthetic
cagtcaagttuccacaactgtguaa

SEQ ID NO: 33835 - DNA, 29 bp, Artificial Sequence
  Synthetic
acactgactgtgugtactatgagaauaca

SEQ ID NO: 33836 - DNA, 21 bp, Artificial Sequence
  Synthetic
caagctccccuaccatgacut

SEQ ID NO: 33837 - DNA, 27 bp, Artificial Sequence
  Synthetic
ccacaccctuaagagaagaaaacucac

SEQ ID NO: 33838 - DNA, 23 bp, Artificial Sequence
  Synthetic
ctgggagtugccatatctgucat

SEQ ID NO: 33839 - DNA, 21 bp, Artificial Sequence
  Synthetic
gutgatgttgtuggcacacgt

SEQ ID NO: 33840 - DNA, 24 bp, Artificial Sequence
  Synthetic
cagaacactucagagcagttugag

SEQ ID NO: 33841 - DNA, 22 bp, Artificial Sequence
  Synthetic
gtactcctguaggttgccctug

SEQ ID NO: 33842 - DNA, 24 bp, Artificial Sequence
  Synthetic
gacctcaagagcuccaatatccuc

SEQ ID NO: 33843 - DNA, 25 bp, Artificial Sequence
  Synthetic
ggagatatggaucaagagguagggt

SEQ ID NO: 33844 - DNA, 24 bp, Artificial Sequence
  Synthetic
catctcaccaugctcatttcctut

SEQ ID NO: 33845 - DNA, 27 bp, Artificial Sequence
  Synthetic
tgacctttguaaacactcactcctuac

SEQ ID NO: 33846 - DNA, 21 bp, Artificial Sequence
  Synthetic
gacggcuccctaaacacuacc

SEQ ID NO: 33847 - DNA, 26 bp, Artificial Sequence
  Synthetic
tgacaatgucaaaggcatagaaugct

SEQ ID NO: 33848 - DNA, 24 bp, Artificial Sequence
  Synthetic
catctagacgtutccttggctcut

SEQ ID NO: 33849 - DNA, 21 bp, Artificial Sequence
  Synthetic
cccgttaagucgtagccctua

SEQ ID NO: 33850 - DNA, 32 bp, Artificial Sequence
  Synthetic
ttttggtatcuaacagaaagaagatutggaua

SEQ ID NO: 33851 - DNA, 24 bp, Artificial Sequence
  Synthetic
cagacaaugtcaucacaggaggat

SEQ ID NO: 33852 - DNA, 32 bp, Artificial Sequence
  Synthetic
taatagagaactgauagaaattggatgugagg

SEQ ID NO: 33853 - DNA, 21 bp, Artificial Sequence
  Synthetic
ctgtgggugtttcctgugagt

SEQ ID NO: 33854 - DNA, 22 bp, Artificial Sequence
  Synthetic
gctttttcuccccctcccacua

SEQ ID NO: 33855 - DNA, 19 bp, Artificial Sequence
  Synthetic
ggaugagaagcgcccugac

SEQ ID NO: 33856 - DNA, 23 bp, Artificial Sequence
  Synthetic
ccaccagauggttcgtacagaut

SEQ ID NO: 33857 - DNA, 23 bp, Artificial Sequence
  Synthetic
ctgattttuggcagccactucag

SEQ ID NO: 33858 - DNA, 26 bp, Artificial Sequence
  Synthetic
atgatctgcacutccttttcttcaut

SEQ ID NO: 33859 - DNA, 21 bp, Artificial Sequence
  Synthetic
gcagtugaggccctatgcauc

SEQ ID NO: 33860 - DNA, 28 bp, Artificial Sequence
  Synthetic
gttgtatctcaagcaugaattcagctut

SEQ ID NO: 33861 - DNA, 28 bp, Artificial Sequence
  Synthetic
gagctactatttucagaaacgatcagut

SEQ ID NO: 33862 - DNA, 29 bp, Artificial Sequence
  Synthetic
ctatgacagcatuatttcttgttccctug

SEQ ID NO: 33863 - DNA, 28 bp, Artificial Sequence
  Synthetic
aaatgcttagtauctgcttgatcacuga

SEQ ID NO: 33864 - DNA, 22 bp, Artificial Sequence
  Synthetic
gacaccagugtatgttgggaug

SEQ ID NO: 33865 - DNA, 26 bp, Artificial Sequence
  Synthetic
ctgcaggatatutccatcttctguga

SEQ ID NO: 33866 - DNA, 21 bp, Artificial Sequence
  Synthetic
caggtctauctgaggccucca

SEQ ID NO: 33867 - DNA, 19 bp, Artificial Sequence
  Synthetic
ccgtgaguccatcgtguga

SEQ ID NO: 33868 - DNA, 20 bp, Artificial Sequence
  Synthetic
acctggaggutatcgcuggt

SEQ ID NO: 33869 - DNA, 22 bp, Artificial Sequence
  Synthetic
tctttgaagcaugcctcctucc

SEQ ID NO: 33870 - DNA, 22 bp, Artificial Sequence
  Synthetic
gacccutttggugaaggcaaag

SEQ ID NO: 33871 - DNA, 29 bp, Artificial Sequence
  Synthetic
tcgatatgtuctatgagatcugggagaaa

SEQ ID NO: 33872 - DNA, 26 bp, Artificial Sequence
  Synthetic
gatgaggaaggagaugatgatguagg

SEQ ID NO: 33873 - DNA, 21 bp, Artificial Sequence
  Synthetic
tggcaucgacgacatgtucaa

SEQ ID NO: 33874 - DNA, 21 bp, Artificial Sequence
  Synthetic
tctccguccagctgacttgua

SEQ ID NO: 33875 - DNA, 25 bp, Artificial Sequence
  Synthetic
gtcctgagaaaaucaacatctuggc

SEQ ID NO: 33876 - DNA, 20 bp, Artificial Sequence
  Synthetic
gactgugaagcggctcugat

SEQ ID NO: 33877 - DNA, 21 bp, Artificial Sequence
  Synthetic
gttggugccttctcttugcac

SEQ ID NO: 33878 - DNA, 23 bp, Artificial Sequence
  Synthetic
ggctttcagaugcagacacugat

SEQ ID NO: 33879 - DNA, 29 bp, Artificial Sequence
  Synthetic
agcgaggtacagaautaaatgattgtcut

SEQ ID NO: 33880 - DNA, 24 bp, Artificial Sequence
  Synthetic
gctcttgttgtucacgatggtgua

SEQ ID NO: 33881 - DNA, 22 bp, Artificial Sequence
  Synthetic
gaactgagccacutctctgucc

SEQ ID NO: 33882 - DNA, 17 bp, Artificial Sequence
  Synthetic
cutcgggugcccacact

SEQ ID NO: 33883 - DNA, 19 bp, Artificial Sequence
  Synthetic
ttgtcuggccttgtcugca

SEQ ID NO: 33884 - DNA, 22 bp, Artificial Sequence
  Synthetic
tgaatgtcucgaaccagctgug

SEQ ID NO: 33885 - DNA, 27 bp, Artificial Sequence
  Synthetic
ctttctcucagtcatctctucaaccat

SEQ ID NO: 33886 - DNA, 22 bp, Artificial Sequence
  Synthetic
tcagggacaaaggcaugcatua

SEQ ID NO: 33887 - DNA, 21 bp, Artificial Sequence
  Synthetic
ggtgtgtggacucagctcaua

SEQ ID NO: 33888 - DNA, 25 bp, Artificial Sequence
  Synthetic
ctgttctccucatcttcttctuggt

SEQ ID NO: 33889 - DNA, 19 bp, Artificial Sequence
  Synthetic
gcatugccaccccctacuc

SEQ ID NO: 33890 - DNA, 24 bp, Artificial Sequence
  Synthetic
gaggttgttcauctctctgtccuc

SEQ ID NO: 33891 - DNA, 24 bp, Artificial Sequence
  Synthetic
cctcagttuccccatcauagaact

SEQ ID NO: 33892 - DNA, 20 bp, Artificial Sequence
  Synthetic
gcauaatgacugccccgaca

SEQ ID NO: 33893 - DNA, 23 bp, Artificial Sequence
  Synthetic
ccatcatcgugttcatcttugct

SEQ ID NO: 33894 - DNA, 24 bp, Artificial Sequence
  Synthetic
cagatcaaaguagggaugaccaag

SEQ ID NO: 33895 - DNA, 23 bp, Artificial Sequence
  Synthetic
tggaacatcutcgacagcaucat

SEQ ID NO: 33896 - DNA, 22 bp, Artificial Sequence
  Synthetic
gcaggaucccttcttcctuacc

SEQ ID NO: 33897 - DNA, 24 bp, Artificial Sequence
  Synthetic
ctcaccatcacuatgtgcatcgua

SEQ ID NO: 33898 - DNA, 24 bp, Artificial Sequence
  Synthetic
gctgggauaaagatgaggguacct

SEQ ID NO: 33899 - DNA, 22 bp, Artificial Sequence
  Synthetic
cgcaaatcucctgattgcacuc

SEQ ID NO: 33900 - DNA, 23 bp, Artificial Sequence
  Synthetic
ccagtaaugagaccaccccatug

SEQ ID NO: 33901 - DNA, 23 bp, Artificial Sequence
  Synthetic
cctgggttcugaagcagatttug

SEQ ID NO: 33902 - DNA, 22 bp, Artificial Sequence
  Synthetic
gctagaaccacagcugggatua

SEQ ID NO: 33903 - DNA, 22 bp, Artificial Sequence
  Synthetic
cgtccgttccuccactctttuc

SEQ ID NO: 33904 - DNA, 22 bp, Artificial Sequence
  Synthetic
caggtucaccagguagaaggac

SEQ ID NO: 33905 - DNA, 22 bp, Artificial Sequence
  Synthetic
gctattugaaccccuggcacaa

SEQ ID NO: 33906 - DNA, 29 bp, Artificial Sequence
  Synthetic
ggtcagggcauaaatagaaaatacaguca

SEQ ID NO: 33907 - DNA, 26 bp, Artificial Sequence
  Synthetic
tcaccagcaugatgtttctctuacag

SEQ ID NO: 33908 - DNA, 20 bp, Artificial Sequence
  Synthetic
cgttgagcgcugtgaagtug

SEQ ID NO: 33909 - DNA, 19 bp, Artificial Sequence
  Synthetic
gtgaccccgugcttgtuct

SEQ ID NO: 33910 - DNA, 22 bp, Artificial Sequence
  Synthetic
accaauaggagacacacaguca

SEQ ID NO: 33911 - DNA, 25 bp, Artificial Sequence
  Synthetic
ccaataactguggtttgattcugca

SEQ ID NO: 33912 - DNA, 20 bp, Artificial Sequence
  Synthetic
caggagccauggcauggaat

SEQ ID NO: 33913 - DNA, 20 bp, Artificial Sequence
  Synthetic
gctgcucagctttcctugac

SEQ ID NO: 33914 - DNA, 19 bp, Artificial Sequence
  Synthetic
tggaggugggtggtaguca

SEQ ID NO: 33915 - DNA, 18 bp, Artificial Sequence
  Synthetic
ccaucgagaagcgcaugg

SEQ ID NO: 33916 - DNA, 20 bp, Artificial Sequence
  Synthetic
ggcagcaggaugtcaaguga

SEQ ID NO: 33917 - DNA, 20 bp, Artificial Sequence
  Synthetic
cttccccaugttgcacucct

SEQ ID NO: 33918 - DNA, 23 bp, Artificial Sequence
  Synthetic
ctccattucaccaatgggucaca

SEQ ID NO: 33919 - DNA, 24 bp, Artificial Sequence
  Synthetic
cuccagcacattuccaagaacaag

SEQ ID NO: 33920 - DNA, 23 bp, Artificial Sequence
  Synthetic
tctccccgguactaacactaugg

SEQ ID NO: 33921 - DNA, 19 bp, Artificial Sequence
  Synthetic
ggagtguctgtggcucact

SEQ ID NO: 33922 - DNA, 22 bp, Artificial Sequence
  Synthetic
ccactctgggauccactcacut

SEQ ID NO: 33923 - DNA, 23 bp, Artificial Sequence
  Synthetic
ctctgtactuacagcccccaaug

SEQ ID NO: 33924 - DNA, 18 bp, Artificial Sequence
  Synthetic
guggcaggagccacaaug

SEQ ID NO: 33925 - DNA, 19 bp, Artificial Sequence
  Synthetic
aggtacugcccaggacuga

SEQ ID NO: 33926 - DNA, 18 bp, Artificial Sequence
  Synthetic
gauccaggcaggcucagt

SEQ ID NO: 33927 - DNA, 19 bp, Artificial Sequence
  Synthetic
gtaccaucgggctgugaca

SEQ ID NO: 33928 - DNA, 23 bp, Artificial Sequence
  Synthetic
gtgggaaucagagagggtugaaa

SEQ ID NO: 33929 - DNA, 27 bp, Artificial Sequence
  Synthetic
ggatgatgaguactctgaatacuccga

SEQ ID NO: 33930 - DNA, 20 bp, Artificial Sequence
  Synthetic
ccugcattcauggacaccca

SEQ ID NO: 33931 - DNA, 20 bp, Artificial Sequence
  Synthetic
gctgcccauggtgactucag

SEQ ID NO: 33932 - DNA, 22 bp, Artificial Sequence
  Synthetic
cttcttgacugcttgccctgua

SEQ ID NO: 33933 - DNA, 24 bp, Artificial Sequence
  Synthetic
ctttatggtcccugtggtcttcug

SEQ ID NO: 33934 - DNA, 22 bp, Artificial Sequence
  Synthetic
tcugaccucagggacaacagaa

SEQ ID NO: 33935 - DNA, 21 bp, Artificial Sequence
  Synthetic
ccaacctgccugactctgauc

SEQ ID NO: 33936 - DNA, 28 bp, Artificial Sequence
  Synthetic
ggagatauaggacagagtcagtaaucag

SEQ ID NO: 33937 - DNA, 23 bp, Artificial Sequence
  Synthetic
ctctcatgcutcttctgtuccca

SEQ ID NO: 33938 - DNA, 18 bp, Artificial Sequence
  Synthetic
cccccucattcugagcgt

SEQ ID NO: 33939 - DNA, 24 bp, Artificial Sequence
  Synthetic
gauggagagaagggagauaaggua

SEQ ID NO: 33940 - DNA, 25 bp, Artificial Sequence
  Synthetic
gggtcactauaaggtcaaaagcuac

SEQ ID NO: 33941 - DNA, 20 bp, Artificial Sequence
  Synthetic
gcauctgaguggccacacat

SEQ ID NO: 33942 - DNA, 21 bp, Artificial Sequence
  Synthetic
ccctcacagaugctguggaac

SEQ ID NO: 33943 - DNA, 23 bp, Artificial Sequence
  Synthetic
ccgugacttctuacccaaaccaa

SEQ ID NO: 33944 - DNA, 21 bp, Artificial Sequence
  Synthetic
caggcaggaaucagaggaguc

SEQ ID NO: 33945 - DNA, 29 bp, Artificial Sequence
  Synthetic
gggtgagtggaucttgtatgatatuagaa

SEQ ID NO: 33946 - DNA, 22 bp, Artificial Sequence
  Synthetic
ggactgaagucacagcactguc

SEQ ID NO: 33947 - DNA, 22 bp, Artificial Sequence
  Synthetic
gtcttacuccacagccgaacuc

SEQ ID NO: 33948 - DNA, 20 bp, Artificial Sequence
  Synthetic
ggtcaugggaggtcagugga

SEQ ID NO: 33949 - DNA, 21 bp, Artificial Sequence
  Synthetic
ctcgugaggacttaggauggg

SEQ ID NO: 33950 - DNA, 22 bp, Artificial Sequence
  Synthetic
ggattcaccaugcccctacaug

SEQ ID NO: 33951 - DNA, 22 bp, Artificial Sequence
  Synthetic
cattgaccatuccctcccttug

SEQ ID NO: 33952 - DNA, 23 bp, Artificial Sequence
  Synthetic
ggucacccttugaggaaaagagg

SEQ ID NO: 33953 - DNA, 24 bp, Artificial Sequence
  Synthetic
ctgaactctgugctcatgttccua

SEQ ID NO: 33954 - DNA, 22 bp, Artificial Sequence
  Synthetic
gagccttctcugctcagtaguc

SEQ ID NO: 33955 - DNA, 23 bp, Artificial Sequence
  Synthetic
gcauatttaagctcuggccccat

SEQ ID NO: 33956 - DNA, 22 bp, Artificial Sequence
  Synthetic
gagaggtcagugggattcctug

SEQ ID NO: 33957 - DNA, 22 bp, Artificial Sequence
  Synthetic
acccacaagccugttuccaaat

SEQ ID NO: 33958 - DNA, 20 bp, Artificial Sequence
  Synthetic
tgctgccccacucctcauat

SEQ ID NO: 33959 - DNA, 21 bp, Artificial Sequence
  Synthetic
ctgacagagcucttccctcuc

SEQ ID NO: 33960 - DNA, 23 bp, Artificial Sequence
  Synthetic
ggatgucagggtgacaauggaca

SEQ ID NO: 33961 - DNA, 24 bp, Artificial Sequence
  Synthetic
cacaggutagggtcauagggagat

SEQ ID NO: 33962 - DNA, 18 bp, Artificial Sequence
  Synthetic
gaggtuggcgcacacuac

SEQ ID NO: 33963 - DNA, 23 bp, Artificial Sequence
  Synthetic
gccttctcugtgttaatcccuga

SEQ ID NO: 33964 - DNA, 22 bp, Artificial Sequence
  Synthetic
accaaggaaacugaggcaguac

SEQ ID NO: 33965 - DNA, 25 bp, Artificial Sequence
  Synthetic
guatggaaatugacccccaaggaaa

SEQ ID NO: 33966 - DNA, 21 bp, Artificial Sequence
  Synthetic
gcataugcacaccacctcuag

SEQ ID NO: 33967 - DNA, 24 bp, Artificial Sequence
  Synthetic
gctaaggtcagugtgtggaaucag

SEQ ID NO: 33968 - DNA, 22 bp, Artificial Sequence
  Synthetic
gggttauggcacacacuaccat

SEQ ID NO: 33969 - DNA, 23 bp, Artificial Sequence
  Synthetic
ccaccccatuttcttgtttccug

SEQ ID NO: 33970 - DNA, 22 bp, Artificial Sequence
  Synthetic
ctgaaatgcaaauagcggguga

SEQ ID NO: 33971 - DNA, 21 bp, Artificial Sequence
  Synthetic
gagccuggaaagcctggtaut

SEQ ID NO: 33972 - DNA, 18 bp, Artificial Sequence
  Synthetic
cagccccuatgcctgugg

SEQ ID NO: 33973 - DNA, 20 bp, Artificial Sequence
  Synthetic
gggtgugaaggtgcttucct

SEQ ID NO: 33974 - DNA, 24 bp, Artificial Sequence
  Synthetic
gagagaugaagacaaactgcuagg

SEQ ID NO: 33975 - DNA, 20 bp, Artificial Sequence
  Synthetic
ccaaggtgagugcggatgut

SEQ ID NO: 33976 - DNA, 22 bp, Artificial Sequence
  Synthetic
ggagggutgcccatugaaacat

SEQ ID NO: 33977 - DNA, 23 bp, Artificial Sequence
  Synthetic
ccactctttuctgaggtcucagg

SEQ ID NO: 33978 - DNA, 24 bp, Artificial Sequence
  Synthetic
gcctgaatcucctttctctcccua

SEQ ID NO: 33979 - DNA, 22 bp, Artificial Sequence
  Synthetic
gccagacaccagugaatgttug

SEQ ID NO: 33980 - DNA, 22 bp, Artificial Sequence
  Synthetic
ctgtgggaacagaucactggut

SEQ ID NO: 33981 - DNA, 29 bp, Artificial Sequence
  Synthetic
cagaggcccuataaatctuaacaaagact

SEQ ID NO: 33982 - DNA, 22 bp, Artificial Sequence
  Synthetic
ggtctagggucctcatgugaag

SEQ ID NO: 33983 - DNA, 26 bp, Artificial Sequence
  Synthetic
gcctctuaccactctatttuccacag

SEQ ID NO: 33984 - DNA, 22 bp, Artificial Sequence
  Synthetic
ctggagggaauagggucagaua

SEQ ID NO: 33985 - DNA, 23 bp, Artificial Sequence
  Synthetic
ggaaagggugagtgtgattgguc

SEQ ID NO: 33986 - DNA, 21 bp, Artificial Sequence
  Synthetic
cttgcugaggaacagcctuga

SEQ ID NO: 33987 - DNA, 22 bp, Artificial Sequence
  Synthetic
ccccttgtugagccattctuct

SEQ ID NO: 33988 - DNA, 21 bp, Artificial Sequence
  Synthetic
ctccagaccccutgtgugaag

SEQ ID NO: 33989 - DNA, 23 bp, Artificial Sequence
  Synthetic
aaggcuaccaacattcccaugag

SEQ ID NO: 33990 - DNA, 23 bp, Artificial Sequence
  Synthetic
cctcagcctutcctatcacctuc

SEQ ID NO: 33991 - DNA, 24 bp, Artificial Sequence
  Synthetic
tccctgagugagttagatccugac

SEQ ID NO: 33992 - DNA, 21 bp, Artificial Sequence
  Synthetic
ggtuccaagaacccccaugat

SEQ ID NO: 33993 - DNA, 22 bp, Artificial Sequence
  Synthetic
cttgagaacugcttgctucgag

SEQ ID NO: 33994 - DNA, 21 bp, Artificial Sequence
  Synthetic
caggactuagtcaggguccca

SEQ ID NO: 33995 - DNA, 24 bp, Artificial Sequence
  Synthetic
ggtgaaggttgucttcctgactuc

SEQ ID NO: 33996 - DNA, 23 bp, Artificial Sequence
  Synthetic
ccaagtcccauagataggcccua

SEQ ID NO: 33997 - DNA, 26 bp, Artificial Sequence
  Synthetic
acctccatuccaatgaagacttugat

SEQ ID NO: 33998 - DNA, 22 bp, Artificial Sequence
  Synthetic
gagucaccuaggagcccaaaat

SEQ ID NO: 33999 - DNA, 22 bp, Artificial Sequence
  Synthetic
caggagugggacttttgtgugt

SEQ ID NO: 34000 - DNA, 22 bp, Artificial Sequence
  Synthetic
gucaagggcaagaagucagaac

SEQ ID NO: 34001 - DNA, 23 bp, Artificial Sequence
  Synthetic
ctggagagaagguaagugcaacc

SEQ ID NO: 34002 - DNA, 23 bp, Artificial Sequence
  Synthetic
ctggagggaacucttatctccut

SEQ ID NO: 34003 - DNA, 26 bp, Artificial Sequence
  Synthetic
caaatctcugaacccccaaattcauc

SEQ ID NO: 34004 - DNA, 21 bp, Artificial Sequence
  Synthetic
accccagaacugggacaucat

SEQ ID NO: 34005 - DNA, 18 bp, Artificial Sequence
  Synthetic
gggtgtggguctctccug

SEQ ID NO: 34006 - DNA, 22 bp, Artificial Sequence
  Synthetic
gaacagcaggucagggaaugaa

SEQ ID NO: 34007 - DNA, 24 bp, Artificial Sequence
  Synthetic
cctcatcacucctggtatcttugg

SEQ ID NO: 34008 - DNA, 24 bp, Artificial Sequence
  Synthetic
gagacaaaguataaggugcaaccc

SEQ ID NO: 34009 - DNA, 22 bp, Artificial Sequence
  Synthetic
cccactgcuctctgtcctuaca

SEQ ID NO: 34010 - DNA, 23 bp, Artificial Sequence
  Synthetic
gaagaacccugggaagacactua

SEQ ID NO: 34011 - DNA, 22 bp, Artificial Sequence
  Synthetic
ctaaaggugagcaagccttguc

SEQ ID NO: 34012 - DNA, 22 bp, Artificial Sequence
  Synthetic
tcccgatgautctaactcugct

SEQ ID NO: 34013 - DNA, 25 bp, Artificial Sequence
  Synthetic
cccacctaacugctatcttcttuca

SEQ ID NO: 34014 - DNA, 23 bp, Artificial Sequence
  Synthetic
ggaaagacaugtcagatgugggt

SEQ ID NO: 34015 - DNA, 25 bp, Artificial Sequence
  Synthetic
gggactggguggtagaatauaaggg

SEQ ID NO: 34016 - DNA, 24 bp, Artificial Sequence
  Synthetic
aagaaggtcuggacagagtccaua

SEQ ID NO: 34017 - DNA, 22 bp, Artificial Sequence
  Synthetic
ccaggcttcuggtaaggaguag

SEQ ID NO: 34018 - DNA, 20 bp, Artificial Sequence
  Synthetic
caccaagcucccagtggaua

SEQ ID NO: 34019 - DNA, 21 bp, Artificial Sequence
  Synthetic
caggctcugtgtttcctucca

SEQ ID NO: 34020 - DNA, 22 bp, Artificial Sequence
  Synthetic
ccttcccacuacgcccactaua

SEQ ID NO: 34021 - DNA, 27 bp, Artificial Sequence
  Synthetic
ctttttaatcaagutctgtctccugca

SEQ ID NO: 34022 - DNA, 19 bp, Artificial Sequence
  Synthetic
ccaaggugaggcaggctua

SEQ ID NO: 34023 - DNA, 23 bp, Artificial Sequence
  Synthetic
tgtcactaucccacatgctctug

SEQ ID NO: 34024 - DNA, 24 bp, Artificial Sequence
  Synthetic
actaccaatccuggtcctttcucc

SEQ ID NO: 34025 - DNA, 22 bp, Artificial Sequence
  Synthetic
acucccaggaaauacagacuct

SEQ ID NO: 34026 - DNA, 20 bp, Artificial Sequence
  Synthetic
gtgatccguagaacgucgct

SEQ ID NO: 34027 - DNA, 24 bp, Artificial Sequence
  Synthetic
acactaaccucacactgacttuca

SEQ ID NO: 34028 - DNA, 20 bp, Artificial Sequence
  Synthetic
ccaccuggacccccaauaaa

SEQ ID NO: 34029 - DNA, 20 bp, Artificial Sequence
  Synthetic
ttccagcagacuccccatug

SEQ ID NO: 34030 - DNA, 21 bp, Artificial Sequence
  Synthetic
gcacccauaccctcattgguc

SEQ ID NO: 34031 - DNA, 27 bp, Artificial Sequence
  Synthetic
acttctgacttcugtctgtaactccua

SEQ ID NO: 34032 - DNA, 21 bp, Artificial Sequence
  Synthetic
aggtacacucagaccccucag

SEQ ID NO: 34033 - DNA, 22 bp, Artificial Sequence
  Synthetic
tctatgcugtgctcuccaacag

SEQ ID NO: 34034 - DNA, 22 bp, Artificial Sequence
  Synthetic
caagccugcaagauaacagggt

SEQ ID NO: 34035 - DNA, 19 bp, Artificial Sequence
  Synthetic
gaggccacugacaucccat

SEQ ID NO: 34036 - DNA, 22 bp, Artificial Sequence
  Synthetic
gccttgcagacucaggactcua

SEQ ID NO: 34037 - DNA, 21 bp, Artificial Sequence
  Synthetic
tgaatcccuggtgggactcuc

SEQ ID NO: 34038 - DNA, 24 bp, Artificial Sequence
  Synthetic
cagggcaagaggucactttatcut

SEQ ID NO: 34039 - DNA, 25 bp, Artificial Sequence
  Synthetic
caatcctugagagtacaguggacag

SEQ ID NO: 34040 - DNA, 21 bp, Artificial Sequence
  Synthetic
gtctaggucaggguacaccgt

SEQ ID NO: 34041 - DNA, 21 bp, Artificial Sequence
  Synthetic
gtcctgaugggtcgtcactuc

SEQ ID NO: 34042 - DNA, 21 bp, Artificial Sequence
  Synthetic
ggttccccuggacacttcaut

SEQ ID NO: 34043 - DNA, 23 bp, Artificial Sequence
  Synthetic
ccatccgugagcttagcuacaag

SEQ ID NO: 34044 - DNA, 19 bp, Artificial Sequence
  Synthetic
gggttuccagggtctccuc

SEQ ID NO: 34045 - DNA, 24 bp, Artificial Sequence
  Synthetic
gttcttactggauggctcctcauc

SEQ ID NO: 34046 - DNA, 19 bp, Artificial Sequence
  Synthetic
ggaugaaggccgaguggag

SEQ ID NO: 34047 - DNA, 21 bp, Artificial Sequence
  Synthetic
gctgacggcutttactgccua

SEQ ID NO: 34048 - DNA, 22 bp, Artificial Sequence
  Synthetic
gcaaaacuccuggaagggacag

SEQ ID NO: 34049 - DNA, 23 bp, Artificial Sequence
  Synthetic
aagaatguggcgatgggttaugt

SEQ ID NO: 34050 - DNA, 22 bp, Artificial Sequence
  Synthetic
ccugggaagagauaagggttuc

SEQ ID NO: 34051 - DNA, 26 bp, Artificial Sequence
  Synthetic
gcttatgtcucatgtgtcattcucca

SEQ ID NO: 34052 - DNA, 25 bp, Artificial Sequence
  Synthetic
acaggtgtagugtgttcatcaaugt

SEQ ID NO: 34053 - DNA, 22 bp, Artificial Sequence
  Synthetic
tgccctcuggtgtttcauacag

SEQ ID NO: 34054 - DNA, 21 bp, Artificial Sequence
  Synthetic
aagcagucaaugaagccagga

SEQ ID NO: 34055 - DNA, 28 bp, Artificial Sequence
  Synthetic
cagatgctcttgugtttctgtctttuag

SEQ ID NO: 34056 - DNA, 20 bp, Artificial Sequence
  Synthetic
cccatttgcuggctcaugac

SEQ ID NO: 34057 - DNA, 23 bp, Artificial Sequence
  Synthetic
gcctgaggcuttcaatctctucc

SEQ ID NO: 34058 - DNA, 18 bp, Artificial Sequence
  Synthetic
gtgcaggugcgagucagt

SEQ ID NO: 34059 - DNA, 18 bp, Artificial Sequence
  Synthetic
ggcccuggtggcacuaag

SEQ ID NO: 34060 - DNA, 22 bp, Artificial Sequence
  Synthetic
cagagccagauagcagacctug

SEQ ID NO: 34061 - DNA, 22 bp, Artificial Sequence
  Synthetic
gagttcaugaagggtguggagt

SEQ ID NO: 34062 - DNA, 19 bp, Artificial Sequence
  Synthetic
gcauggaggcaggagauca

SEQ ID NO: 34063 - DNA, 18 bp, Artificial Sequence
  Synthetic
ccacagcccuacccugag

SEQ ID NO: 34064 - DNA, 22 bp, Artificial Sequence
  Synthetic
ggctcggauaggctaaatugct

SEQ ID NO: 34065 - DNA, 20 bp, Artificial Sequence
  Synthetic
gggcaaggugatgaggaugc

SEQ ID NO: 34066 - DNA, 20 bp, Artificial Sequence
  Synthetic
accaagccuctggtctcugg

SEQ ID NO: 34067 - DNA, 22 bp, Artificial Sequence
  Synthetic
tcagcagcagcuataccugagt

SEQ ID NO: 34068 - DNA, 21 bp, Artificial Sequence
  Synthetic
cctttucccggagctctucaa

SEQ ID NO: 34069 - DNA, 22 bp, Artificial Sequence
  Synthetic
tggtaaugagcaaagccgtcuc

SEQ ID NO: 34070 - DNA, 26 bp, Artificial Sequence
  Synthetic
atgcagaaagucaacttauggaagga

SEQ ID NO: 34071 - DNA, 28 bp, Artificial Sequence
  Synthetic
ccatcacttttccauggattatcactug

SEQ ID NO: 34072 - DNA, 24 bp, Artificial Sequence
  Synthetic
tggttctgtaauaggcctcaccut

SEQ ID NO: 34073 - DNA, 25 bp, Artificial Sequence
  Synthetic
catacaattucaggcaaggccauac

SEQ ID NO: 34074 - DNA, 24 bp, Artificial Sequence
  Synthetic
ccugaagaagaaggaggttuaugt

SEQ ID NO: 34075 - DNA, 28 bp, Artificial Sequence
  Synthetic
ctgaggatacutaaaggtacugaaaggt

SEQ ID NO: 34076 - DNA, 29 bp, Artificial Sequence
  Synthetic
cttccaacaauaggattcagcauagagaa

SEQ ID NO: 34077 - DNA, 24 bp, Artificial Sequence
  Synthetic
gggtaggaagaaugaccagguaga

SEQ ID NO: 34078 - DNA, 24 bp, Artificial Sequence
  Synthetic
cttaggtuaggaaatgcccaugga

SEQ ID NO: 34079 - DNA, 28 bp, Artificial Sequence
  Synthetic
agatacagacugaaagacacacacauac

SEQ ID NO: 34080 - DNA, 25 bp, Artificial Sequence
  Synthetic
tgtaaaagtgtcucagttgctgugt

SEQ ID NO: 34081 - DNA, 27 bp, Artificial Sequence
  Synthetic
gcttataugccaccatgtttgaucact

SEQ ID NO: 34082 - DNA, 22 bp, Artificial Sequence
  Synthetic
tgggccacauagcaagatccua

SEQ ID NO: 34083 - DNA, 29 bp, Artificial Sequence
  Synthetic
tgctgaggttuccaactattatctttuca

SEQ ID NO: 34084 - DNA, 28 bp, Artificial Sequence
  Synthetic
cttgcatttatggacuctgaccttttua

SEQ ID NO: 34085 - DNA, 28 bp, Artificial Sequence
  Synthetic
gggatgagatggcutataactgacttut

SEQ ID NO: 34086 - DNA, 25 bp, Artificial Sequence
  Synthetic
caaccaucaaucagaaaaaggaggg

SEQ ID NO: 34087 - DNA, 26 bp, Artificial Sequence
  Synthetic
agcaagacaagugaagtcaactgtua

SEQ ID NO: 34088 - DNA, 29 bp, Artificial Sequence
  Synthetic
ttcttctaacaacautctgacacctuacc

SEQ ID NO: 34089 - DNA, 21 bp, Artificial Sequence
  Synthetic
tgcuacaactguggcaaacca

SEQ ID NO: 34090 - DNA, 21 bp, Artificial Sequence
  Synthetic
gcatgtgcucacctcuccaag

SEQ ID NO: 34091 - DNA, 24 bp, Artificial Sequence
  Synthetic
ctggtctgacuagccgaattctut

SEQ ID NO: 34092 - DNA, 18 bp, Artificial Sequence
  Synthetic
cctcugccacggcttcuc

SEQ ID NO: 34093 - DNA, 28 bp, Artificial Sequence
  Synthetic
aaaagaactttcaguggtttaatgcugt

SEQ ID NO: 34094 - DNA, 22 bp, Artificial Sequence
  Synthetic
cttctacgugcccttcuccaat

SEQ ID NO: 34095 - DNA, 20 bp, Artificial Sequence
  Synthetic
cggctaggutgagcaggaug

SEQ ID NO: 34096 - DNA, 23 bp, Artificial Sequence
  Synthetic
cctagctacccuctccctgtcua

SEQ ID NO: 34097 - DNA, 21 bp, Artificial Sequence
  Synthetic
cccatgauggcatggttcucc

SEQ ID NO: 34098 - DNA, 21 bp, Artificial Sequence
  Synthetic
ctgtucccaagtcccucacag

SEQ ID NO: 34099 - DNA, 28 bp, Artificial Sequence
  Synthetic
tgcccauagcagaaaaagatgataauca

SEQ ID NO: 34100 - DNA, 19 bp, Artificial Sequence
  Synthetic
ctggaggagccauggtcug

SEQ ID NO: 34101 - DNA, 22 bp, Artificial Sequence
  Synthetic
gaagaugggaccgaagtuggag

SEQ ID NO: 34102 - DNA, 20 bp, Artificial Sequence
  Synthetic
gggcgaaccucactaacgug

SEQ ID NO: 34103 - DNA, 23 bp, Artificial Sequence
  Synthetic
acagagtccuaggcaggtctuag

SEQ ID NO: 34104 - DNA, 27 bp, Artificial Sequence
  Synthetic
aaatcttcctctuttaactagctgcug

SEQ ID NO: 34105 - DNA, 24 bp, Artificial Sequence
  Synthetic
cctggttguactgtagcttgtugt

SEQ ID NO: 34106 - DNA, 22 bp, Artificial Sequence
  Synthetic
cgggttucacatttctcctucc

SEQ ID NO: 34107 - DNA, 24 bp, Artificial Sequence
  Synthetic
tcaaaaacaaaugtccccggauct

SEQ ID NO: 34108 - DNA, 26 bp, Artificial Sequence
  Synthetic
tcctaactcugaacacagcttttuga

SEQ ID NO: 34109 - DNA, 27 bp, Artificial Sequence
  Synthetic
gttttgtttgaaagaucggtggaacut

SEQ ID NO: 34110 - DNA, 23 bp, Artificial Sequence
  Synthetic
tctgaacagcutcaagagggtuc

SEQ ID NO: 34111 - DNA, 21 bp, Artificial Sequence
  Synthetic
acctctuggccttctcucaca

SEQ ID NO: 34112 - DNA, 23 bp, Artificial Sequence
  Synthetic
gcacaggaggacauaaacugagg

SEQ ID NO: 34113 - DNA, 17 bp, Artificial Sequence
  Synthetic
cgcgccucgatctcuga

SEQ ID NO: 34114 - DNA, 17 bp, Artificial Sequence
  Synthetic
gtgcagauggtgugcgt

SEQ ID NO: 34115 - DNA, 17 bp, Artificial Sequence
  Synthetic
gccgcugtggucaaggg

SEQ ID NO: 34116 - DNA, 20 bp, Artificial Sequence
  Synthetic
gccacgagutgtugaggaag

SEQ ID NO: 34117 - DNA, 19 bp, Artificial Sequence
  Synthetic
cggccugcgaagacatgut

SEQ ID NO: 34118 - DNA, 20 bp, Artificial Sequence
  Synthetic
aacgggaacutcgcgaugat

SEQ ID NO: 34119 - DNA, 17 bp, Artificial Sequence
  Synthetic
cugcuggccccagagac

SEQ ID NO: 34120 - DNA, 18 bp, Artificial Sequence
  Synthetic
guccgctuacggccaagt

SEQ ID NO: 34121 - DNA, 18 bp, Artificial Sequence
  Synthetic
ccggagccccuctctgut

SEQ ID NO: 34122 - DNA, 24 bp, Artificial Sequence
  Synthetic
ggaaacttgtguggcttggtttua

SEQ ID NO: 34123 - DNA, 25 bp, Artificial Sequence
  Synthetic
ttttcttgccaautttaagcucgca

SEQ ID NO: 34124 - DNA, 30 bp, Artificial Sequence
  Synthetic
tccaactatatcagcutgtattcctctuct

SEQ ID NO: 34125 - DNA, 27 bp, Artificial Sequence
  Synthetic
cgtccattttgcuaaaaaccatacuca

SEQ ID NO: 34126 - DNA, 18 bp, Artificial Sequence
  Synthetic
tguccgcccctcuaacga

SEQ ID NO: 34127 - DNA, 17 bp, Artificial Sequence
  Synthetic
gcugctccguccccaag

SEQ ID NO: 34128 - DNA, 21 bp, Artificial Sequence
  Synthetic
ccactgtcugggtcaaggaug

SEQ ID NO: 34129 - DNA, 21 bp, Artificial Sequence
  Synthetic
actcggcucctttctguagct

SEQ ID NO: 34130 - DNA, 17 bp, Artificial Sequence
  Synthetic
cctctgcucccacucgg

SEQ ID NO: 34131 - DNA, 17 bp, Artificial Sequence
  Synthetic
cgcccaccutgaugcct

SEQ ID NO: 34132 - DNA, 20 bp, Artificial Sequence
  Synthetic
gtggagccuggtcauggaaa

SEQ ID NO: 34133 - DNA, 18 bp, Artificial Sequence
  Synthetic
ggcagaugacgcucaggg

SEQ ID NO: 34134 - DNA, 21 bp, Artificial Sequence
  Synthetic
actgcaaggugtacagugacg

SEQ ID NO: 34135 - DNA, 22 bp, Artificial Sequence
  Synthetic
ctagacccaaauccucacgcaa

SEQ ID NO: 34136 - DNA, 18 bp, Artificial Sequence
  Synthetic
ctcgccuatcgctcugct

SEQ ID NO: 34137 - DNA, 17 bp, Artificial Sequence
  Synthetic
gcgucccccagacagug

SEQ ID NO: 34138 - DNA, 22 bp, Artificial Sequence
  Synthetic
gtatgcaggcaucctcagcuac

SEQ ID NO: 34139 - DNA, 26 bp, Artificial Sequence
  Synthetic
agctcagaaccuggtatctacttuct

SEQ ID NO: 34140 - DNA, 18 bp, Artificial Sequence
  Synthetic
gctgagagugggcgagut

SEQ ID NO: 34141 - DNA, 17 bp, Artificial Sequence
  Synthetic
ccagcccugctcugcac

SEQ ID NO: 34142 - DNA, 17 bp, Artificial Sequence
  Synthetic
cggtaggugcgguagcg

SEQ ID NO: 34143 - DNA, 20 bp, Artificial Sequence
  Synthetic
cttgaaggugagctgcucct

SEQ ID NO: 34144 - DNA, 20 bp, Artificial Sequence
  Synthetic
ggagagguggagaggctuca

SEQ ID NO: 34145 - DNA, 19 bp, Artificial Sequence
  Synthetic
cgtccuactggcaugaccc

SEQ ID NO: 34146 - DNA, 20 bp, Artificial Sequence
  Synthetic
ggtgtctgucctgggaguct

SEQ ID NO: 34147 - DNA, 18 bp, Artificial Sequence
  Synthetic
gccagggaugccacucac

SEQ ID NO: 34148 - DNA, 19 bp, Artificial Sequence
  Synthetic
ctgcccgcagguacaugat

SEQ ID NO: 34149 - DNA, 19 bp, Artificial Sequence
  Synthetic
cccacaccucagcactcug

SEQ ID NO: 34150 - DNA, 18 bp, Artificial Sequence
  Synthetic
gggacgacuccgtgttug

SEQ ID NO: 34151 - DNA, 23 bp, Artificial Sequence
  Synthetic
cacacagaccaaagcuctgtgua

SEQ ID NO: 34152 - DNA, 26 bp, Artificial Sequence
  Synthetic
atctgtcagcagauctcaagaaacug

SEQ ID NO: 34153 - DNA, 23 bp, Artificial Sequence
  Synthetic
gggagccatutcctatctcatug

SEQ ID NO: 34154 - DNA, 30 bp, Artificial Sequence
  Synthetic
cgtaatcucaccagcttataaatguaacac

SEQ ID NO: 34155 - DNA, 26 bp, Artificial Sequence
  Synthetic
caccctttaatcugttgttgctctut

SEQ ID NO: 34156 - DNA, 24 bp, Artificial Sequence
  Synthetic
cactcaugaacaagcaccaaacug

SEQ ID NO: 34157 - DNA, 28 bp, Artificial Sequence
  Synthetic
ccccgaaagttcucattcaaagtgtaut

SEQ ID NO: 34158 - DNA, 23 bp, Artificial Sequence
  Synthetic
aggcctttuaagagcaccttucc

SEQ ID NO: 34159 - DNA, 31 bp, Artificial Sequence
  Synthetic
ggtcctttaaggtugtttgtacacataatut

SEQ ID NO: 34160 - DNA, 27 bp, Artificial Sequence
  Synthetic
gaggccauaactcttgtagaaucaact

SEQ ID NO: 34161 - DNA, 30 bp, Artificial Sequence
  Synthetic
gccattcgatugcaaactatttagacttut

SEQ ID NO: 34162 - DNA, 24 bp, Artificial Sequence
  Synthetic
agggagaaauggcataaagcacut

SEQ ID NO: 34163 - DNA, 22 bp, Artificial Sequence
  Synthetic
tcacgccucctaaagttccuct

SEQ ID NO: 34164 - DNA, 28 bp, Artificial Sequence
  Synthetic
ggaaatggtcaaugtagttgagaaaguc

SEQ ID NO: 34165 - DNA, 27 bp, Artificial Sequence
  Synthetic
aaataattaccugcagctcatctccuc

SEQ ID NO: 34166 - DNA, 24 bp, Artificial Sequence
  Synthetic
gaccguaagaattaacuggcaggt

SEQ ID NO: 34167 - DNA, 22 bp, Artificial Sequence
  Synthetic
tttctgttgcutccgtcgttug

SEQ ID NO: 34168 - DNA, 21 bp, Artificial Sequence
  Synthetic
caguccgggaacagatuccac

SEQ ID NO: 34169 - DNA, 28 bp, Artificial Sequence
  Synthetic
acaaagaagauaagagcaccauacaaua

SEQ ID NO: 34170 - DNA, 28 bp, Artificial Sequence
  Synthetic
gaagauaaagggaggaacaguttttaug

SEQ ID NO: 34171 - DNA, 22 bp, Artificial Sequence
  Synthetic
gcttgtuggagaccaccttcug

SEQ ID NO: 34172 - DNA, 21 bp, Artificial Sequence
  Synthetic
ctggucaatcaccuggacgag

SEQ ID NO: 34173 - DNA, 22 bp, Artificial Sequence
  Synthetic
cccctgggagucacacatcaua

SEQ ID NO: 34174 - DNA, 22 bp, Artificial Sequence
  Synthetic
tcttcctatggauggctggcua

SEQ ID NO: 34175 - DNA, 24 bp, Artificial Sequence
  Synthetic
ctgaactgccugagaagatucaga

SEQ ID NO: 34176 - DNA, 28 bp, Artificial Sequence
  Synthetic
cctttcttuaaaaacaagcagccacuaa

SEQ ID NO: 34177 - DNA, 27 bp, Artificial Sequence
  Synthetic
ctagctcttgucgaagatttgagtuct

SEQ ID NO: 34178 - DNA, 33 bp, Artificial Sequence
  Synthetic
ttgtgttcttttuaacaggaagtactuaaacaa

SEQ ID NO: 34179 - DNA, 25 bp, Artificial Sequence
  Synthetic
cgagagaagcugtacttggatcuac

SEQ ID NO: 34180 - DNA, 22 bp, Artificial Sequence
  Synthetic
cttauggaagucgggaaggauc

SEQ ID NO: 34181 - DNA, 26 bp, Artificial Sequence
  Synthetic
aacaauaaactggaguacacaaggca

SEQ ID NO: 34182 - DNA, 32 bp, Artificial Sequence
  Synthetic
gtggttttagtttuccttacaaacagatauga

SEQ ID NO: 34183 - DNA, 30 bp, Artificial Sequence
  Synthetic
cctaatagctctucgctgttttatcactua

SEQ ID NO: 34184 - DNA, 26 bp, Artificial Sequence
  Synthetic
gaaagcctacaccauttttgcatgua

SEQ ID NO: 34185 - DNA, 29 bp, Artificial Sequence
  Synthetic
agaaccatctugcttcatacttttcugat

SEQ ID NO: 34186 - DNA, 30 bp, Artificial Sequence
  Synthetic
agtaaatatcccautcatcacttaatuggt

SEQ ID NO: 34187 - DNA, 24 bp, Artificial Sequence
  Synthetic
gggagcuagacatagcuagcaaag

SEQ ID NO: 34188 - DNA, 22 bp, Artificial Sequence
  Synthetic
tgcagcacuccacaacatcaut

SEQ ID NO: 34189 - DNA, 30 bp, Artificial Sequence
  Synthetic
gcactacgatguacactatagagaacauac

SEQ ID NO: 34190 - DNA, 26 bp, Artificial Sequence
  Synthetic
gattttattttucagtgccagcucct

SEQ ID NO: 34191 - DNA, 31 bp, Artificial Sequence
  Synthetic
ccatgatttaaaaauccaccagtaattguct

SEQ ID NO: 34192 - DNA, 28 bp, Artificial Sequence
  Synthetic
cagaattatugcaagtggactgugaaat

SEQ ID NO: 34193 - DNA, 32 bp, Artificial Sequence
  Synthetic
taactcataccugagctatcttaagaaauaca

SEQ ID NO: 34194 - DNA, 27 bp, Artificial Sequence
  Synthetic
tgattaatttgcaggutattgcgagug

SEQ ID NO: 34195 - DNA, 29 bp, Artificial Sequence
  Synthetic
caggtaagaaautaggaaatctcauggct

SEQ ID NO: 34196 - DNA, 22 bp, Artificial Sequence
  Synthetic
gctgtagauggtgcactugcat

SEQ ID NO: 34197 - DNA, 32 bp, Artificial Sequence
  Synthetic
tgcttacaattagguctttttgagagtaugaa

SEQ ID NO: 34198 - DNA, 26 bp, Artificial Sequence
  Synthetic
tctcagcaagaaauccuaaagaccag

SEQ ID NO: 34199 - DNA, 28 bp, Artificial Sequence
  Synthetic
cttctagggctutttgtttcctaacaug

SEQ ID NO: 34200 - DNA, 28 bp, Artificial Sequence
  Synthetic
ccaatcgacaugatgataataggucaga

SEQ ID NO: 34201 - DNA, 23 bp, Artificial Sequence
  Synthetic
ctgcaaaccucgcttugaagaag

SEQ ID NO: 34202 - DNA, 21 bp, Artificial Sequence
  Synthetic
gaagaagctcugctgcccaua

SEQ ID NO: 34203 - DNA, 31 bp, Artificial Sequence
  Synthetic
ctgcaaaactuactttcatcatctucagaat

SEQ ID NO: 34204 - DNA, 22 bp, Artificial Sequence
  Synthetic
ctggaaggcaaagucctucaca

SEQ ID NO: 34205 - DNA, 24 bp, Artificial Sequence
  Synthetic
cgatttgttuctgaaccatuggct

SEQ ID NO: 34206 - DNA, 33 bp, Artificial Sequence
  Synthetic
gaagaagaagagagaucaacaaautatagcaua

SEQ ID NO: 34207 - DNA, 23 bp, Artificial Sequence
  Synthetic
gcctctuggcattagaugaaggt

SEQ ID NO: 34208 - DNA, 32 bp, Artificial Sequence
  Synthetic
agaagatactccaauatgtttttcaagatgua

SEQ ID NO: 34209 - DNA, 23 bp, Artificial Sequence
  Synthetic
gatttggttcuagggtgctguga

SEQ ID NO: 34210 - DNA, 22 bp, Artificial Sequence
  Synthetic
acuatgtucaggagaccccact

SEQ ID NO: 34211 - DNA, 23 bp, Artificial Sequence
  Synthetic
gcttggttugagctgttugagga

SEQ ID NO: 34212 - DNA, 25 bp, Artificial Sequence
  Synthetic
cacggaaagtacuccagatggatut

SEQ ID NO: 34213 - DNA, 32 bp, Artificial Sequence
  Synthetic
ctgaatcatctaauaggtccttttcagaauca

SEQ ID NO: 34214 - DNA, 21 bp, Artificial Sequence
  Synthetic
attaccuccacctguggcaag

SEQ ID NO: 34215 - DNA, 23 bp, Artificial Sequence
  Synthetic
tctaactcctuctccagcagcua

SEQ ID NO: 34216 - DNA, 29 bp, Artificial Sequence
  Synthetic
gatgacaauaaaguagaggaaggtgauat

SEQ ID NO: 34217 - DNA, 30 bp, Artificial Sequence
  Synthetic
cacgtgtcctatautcagtattttgtggua

SEQ ID NO: 34218 - DNA, 25 bp, Artificial Sequence
  Synthetic
caaggtctucaatgataagcuccca

SEQ ID NO: 34219 - DNA, 27 bp, Artificial Sequence
  Synthetic
cctctgatuccttattttctttugcct

SEQ ID NO: 34220 - DNA, 26 bp, Artificial Sequence
  Synthetic
agtcauccaaagacauaccagacaga

SEQ ID NO: 34221 - DNA, 24 bp, Artificial Sequence
  Synthetic
tgatttaggagcauagcctgaugc

SEQ ID NO: 34222 - DNA, 28 bp, Artificial Sequence
  Synthetic
ccttcaagacucaagggtgataaugaaa

SEQ ID NO: 34223 - DNA, 27 bp, Artificial Sequence
  Synthetic
ttactatggaatutgcaccttccugaa

SEQ ID NO: 34224 - DNA, 28 bp, Artificial Sequence
  Synthetic
acctgaucaagaagaaaaacccttuaca

SEQ ID NO: 34225 - DNA, 24 bp, Artificial Sequence
  Synthetic
cctcgagagautgaaggcatgtut

SEQ ID NO: 34226 - DNA, 22 bp, Artificial Sequence
  Synthetic
gccuccaaaagccctagugaag

SEQ ID NO: 34227 - DNA, 23 bp, Artificial Sequence
  Synthetic
gttucggucaggagactgtauag

SEQ ID NO: 34228 - DNA, 22 bp, Artificial Sequence
  Synthetic
cagguagacagaugagccaaca

SEQ ID NO: 34229 - DNA, 30 bp, Artificial Sequence
  Synthetic
gcgtactaatacagguctttctgatctauc

SEQ ID NO: 34230 - DNA, 25 bp, Artificial Sequence
  Synthetic
gcacaaacuccagttttaagtccut

SEQ ID NO: 34231 - DNA, 24 bp, Artificial Sequence
  Synthetic
gtttccaggtucctgacctatuga

SEQ ID NO: 34232 - DNA, 28 bp, Artificial Sequence
  Synthetic
aaacatgugaactctattucaggaacca

SEQ ID NO: 34233 - DNA, 26 bp, Artificial Sequence
  Synthetic
ctcacccaaacaucctctgtttuaga

SEQ ID NO: 34234 - DNA, 30 bp, Artificial Sequence; identical to SEQ ID NO: 5832
  Synthetic

SEQ ID NO: 34235 - DNA, 23 bp, Artificial Sequence
  Synthetic
tttgcttgagcugctagaacuga

SEQ ID NO: 34236 - DNA, 19 bp, Artificial Sequence
  Synthetic
cagcucggccatcucagat

SEQ ID NO: 34237 - DNA, 33 bp, Artificial Sequence
  Synthetic
catagaattttcttaguttcattcttcctcuct

SEQ ID NO: 34238 - DNA, 27 bp, Artificial Sequence
  Synthetic
cctgtctauacaagtcatgagttuggg

SEQ ID NO: 34239 - DNA, 23 bp, Artificial Sequence
  Synthetic
agcttatuccaagctgagtugct

SEQ ID NO: 34240 - DNA, 27 bp, Artificial Sequence
  Synthetic
gccaataccaauagaattgttagguga

SEQ ID NO: 34241 - DNA, 27 bp, Artificial Sequence
  Synthetic
ttaaatcccauaggcaatagctuggaa

SEQ ID NO: 34242 - DNA, 23 bp, Artificial Sequence
  Synthetic
gcagagcccucagcaaatacuac

SEQ ID NO: 34243 - DNA, 27 bp, Artificial Sequence
  Synthetic
cagaaatgucccagaactuaaagcaat

SEQ ID NO: 34244 - DNA, 30 bp, Artificial Sequence
  Synthetic
ttcattttctaatuccatcctcttgtucca

SEQ ID NO: 34245 - DNA, 23 bp, Artificial Sequence
  Synthetic
tctgactccucttctggcttcut

SEQ ID NO: 34246 - DNA, 21 bp, Artificial Sequence
  Synthetic
agagcaagcugccctttctut

SEQ ID NO: 34247 - DNA, 21 bp, Artificial Sequence
  Synthetic
tgctctctgagucctcctcug

SEQ ID NO: 34248 - DNA, 21 bp, Artificial Sequence
  Synthetic
cttctgtacguggtgtccugt

SEQ ID NO: 34249 - DNA, 17 bp, Artificial Sequence
  Synthetic
gctgcuctgcgagucct

SEQ ID NO: 34250 - DNA, 22 bp, Artificial Sequence
  Synthetic
tcccctcaucctgtttcucact

SEQ ID NO: 34251 - DNA, 21 bp, Artificial Sequence
  Synthetic
gcttcttgagucctcctccug

SEQ ID NO: 34252 - DNA, 24 bp, Artificial Sequence
  Synthetic
ctcactcacautctccttcuggac

SEQ ID NO: 34253 - DNA, 23 bp, Artificial Sequence
  Synthetic
tctgatgacucctcactacugct

SEQ ID NO: 34254 - DNA, 23 bp, Artificial Sequence
  Synthetic
tcacacugggactctgtcuacaa

SEQ ID NO: 34255 - DNA, 20 bp, Artificial Sequence
  Synthetic
tgctctccgagutgtccaug

SEQ ID NO: 34256 - DNA, 23 bp, Artificial Sequence
  Synthetic
gaaccttcuccagcctttcttug

SEQ ID NO: 34257 - DNA, 23 bp, Artificial Sequence
  Synthetic
gaagaatcctcugctggtctcug

SEQ ID NO: 34258 - DNA, 22 bp, Artificial Sequence
  Synthetic
actccuggagacacctctctuc

SEQ ID NO: 34259 - DNA, 23 bp, Artificial Sequence
  Synthetic
tcctcactgcuctcagagtctuc

SEQ ID NO: 34260 - DNA, 25 bp, Artificial Sequence
  Synthetic
ccctccttaautcccttttcuccac

SEQ ID NO: 34261 - DNA, 22 bp, Artificial Sequence
  Synthetic
agtgactggucctcctctcuac

SEQ ID NO: 34262 - DNA, 23 bp, Artificial Sequence
  Synthetic
ccctacatgggaugtaacaccut

SEQ ID NO: 34263 - DNA, 21 bp, Artificial Sequence
  Synthetic
ctgtctucccaggaggtgtug

SEQ ID NO: 34264 - DNA, 24 bp, Artificial Sequence
  Synthetic
gttgaagcaguttccccaaatuct

SEQ ID NO: 34265 - DNA, 22 bp, Artificial Sequence
  Synthetic
gcagtggagcacaugaagguat

SEQ ID NO: 34266 - DNA, 21 bp, Artificial Sequence
  Synthetic
gtggacccuttgccttguaaa

SEQ ID NO: 34267 - DNA, 18 bp, Artificial Sequence
  Synthetic
gggcttgugcgggtguag

SEQ ID NO: 34268 - DNA, 20 bp, Artificial Sequence
  Synthetic
ccccatcucgctccattuca

SEQ ID NO: 34269 - DNA, 26 bp, Artificial Sequence
  Synthetic
cacatgtggguaagtatggaaguagg

SEQ ID NO: 34270 - DNA, 22 bp, Artificial Sequence
  Synthetic
gaccaggtcutacttgcccuaa

SEQ ID NO: 34271 - DNA, 21 bp, Artificial Sequence
  Synthetic
tgaagaactgucgctgctguc

SEQ ID NO: 34272 - DNA, 22 bp, Artificial Sequence
  Synthetic
gggcuaccaacaggatactgug

SEQ ID NO: 34273 - DNA, 21 bp, Artificial Sequence
  Synthetic
cctgagggaucggguagacag

SEQ ID NO: 34274 - DNA, 23 bp, Artificial Sequence
  Synthetic
tgaccccacautctctctccaua

SEQ ID NO: 34275 - DNA, 24 bp, Artificial Sequence
  Synthetic
cttctttcuttcctgtuccagcag

SEQ ID NO: 34276 - DNA, 24 bp, Artificial Sequence
  Synthetic
ctctgttuccccagaaaagaccuc

SEQ ID NO: 34277 - DNA, 23 bp, Artificial Sequence
  Synthetic
tgctttgauctccacctucaacc

SEQ ID NO: 34278 - DNA, 24 bp, Artificial Sequence
  Synthetic
ggaattcacuagtccucaggaggt

SEQ ID NO: 34279 - DNA, 24 bp, Artificial Sequence
  Synthetic
accctgaatgcucaggaatgatug

SEQ ID NO: 34280 - DNA, 27 bp, Artificial Sequence
  Synthetic
ttttctcttctcucagcggtttaaugt

SEQ ID NO: 34281 - DNA, 29 bp, Artificial Sequence
  Synthetic
aguattaaaatcaugaggagcaggacaaa

SEQ ID NO: 34282 - DNA, 26 bp, Artificial Sequence
  Synthetic
acagcctgaggugttttgaaatttug

SEQ ID NO: 34283 - DNA, 24 bp, Artificial Sequence
  Synthetic
aataatgccuccttctcucagcag

SEQ ID NO: 34284 - DNA, 28 bp, Artificial Sequence
  Synthetic
actaatggtgtttuctctctctctcuct

SEQ ID NO: 34285 - DNA, 31 bp, Artificial Sequence
  Synthetic
gcatcaaacaagutaaatgattcaagttucc

SEQ ID NO: 34286 - DNA, 27 bp, Artificial Sequence
  Synthetic
ggatctttatugacgatcttgggtgut

SEQ ID NO: 34287 - DNA, 23 bp, Artificial Sequence
  Synthetic
gtcaaccagtuatgggaagggut

SEQ ID NO: 34288 - DNA, 28 bp, Artificial Sequence
  Synthetic
gaattgaacatucacttgctgtttcuga

SEQ ID NO: 34289 - DNA, 24 bp, Artificial Sequence
  Synthetic
ctgccugagacaggaataatcucc

SEQ ID NO: 34290 - DNA, 27 bp, Artificial Sequence
  Synthetic
ctcagattaatugctgtgctttuggat

SEQ ID NO: 34291 - DNA, 23 bp, Artificial Sequence
  Synthetic
gcattttgggaugttccacugac

SEQ ID NO: 34292 - DNA, 21 bp, Artificial Sequence
  Synthetic
autcaagagcucagacgccaa

SEQ ID NO: 34293 - DNA, 27 bp, Artificial Sequence
  Synthetic
gttctggguccatttcagaatcuacat

SEQ ID NO: 34294 - DNA, 21 bp, Artificial Sequence
  Synthetic
gagtagacacggugcagucaa

SEQ ID NO: 34295 - DNA, 31 bp, Artificial Sequence
  Synthetic
ctggaatctggaucatcctgaaaagauaaat

SEQ ID NO: 34296 - DNA, 28 bp, Artificial Sequence
  Synthetic
ttgattcttattgaugccccatgtttug

SEQ ID NO: 34297 - DNA, 30 bp, Artificial Sequence
  Synthetic
tgcctttaacatguataatcactgcaagua

SEQ ID NO: 34298 - DNA, 22 bp, Artificial Sequence
  Synthetic
gctggaaaagcaaucgtcaugt

SEQ ID NO: 34299 - DNA, 30 bp, Artificial Sequence
  Synthetic
tctgtctcgaaaauaaataagaggccatut

SEQ ID NO: 34300 - DNA, 25 bp, Artificial Sequence
  Synthetic
gcagaacaguatgatgtucccaagg

SEQ ID NO: 34301 - DNA, 27 bp, Artificial Sequence
  Synthetic
agaatgttcagaaucaaaagccaguga

SEQ ID NO: 34302 - DNA, 23 bp, Artificial Sequence
  Synthetic
gattccagagaaccutggccuaa

SEQ ID NO: 34303 - DNA, 25 bp, Artificial Sequence
  Synthetic
gcaagcccaauaaagagtcaccaut

SEQ ID NO: 34304 - DNA, 28 bp, Artificial Sequence
  Synthetic
cgaagtgatuccattagtatctguacca

SEQ ID NO: 34305 - DNA, 27 bp, Artificial Sequence
  Synthetic
actaatgagaggcutctgttttgctut

SEQ ID NO: 34306 - DNA, 25 bp, Artificial Sequence
  Synthetic
tgctctctcuccaaaattcaaccug

SEQ ID NO: 34307 - DNA, 24 bp, Artificial Sequence
  Synthetic
ggagagccuttggtaucagaagag

SEQ ID NO: 34308 - DNA, 27 bp, Artificial Sequence
  Synthetic
ctcttacagatccutaggtgaggaugt

SEQ ID NO: 34309 - DNA, 21 bp, Artificial Sequence
  Synthetic
caggacuccgguaagagacca

SEQ ID NO: 34310 - DNA, 23 bp, Artificial Sequence
  Synthetic
attatctggcgagutgtctgcut

SEQ ID NO: 34311 - DNA, 21 bp, Artificial Sequence
  Synthetic
cagttttcutttgcgcucggt

SEQ ID NO: 34312 - DNA, 27 bp, Artificial Sequence
  Synthetic
gaagatggtgaccauttttctgatgug

SEQ ID NO: 34313 - DNA, 21 bp, Artificial Sequence
  Synthetic
tgttcatgcgcutacgaggut

SEQ ID NO: 34314 - DNA, 24 bp, Artificial Sequence
  Synthetic
caagcatactugaggaaccacuga

SEQ ID NO: 34315 - DNA, 29 bp, Artificial Sequence
  Synthetic
gacaatgtttaucagcactttctccaaut

SEQ ID NO: 34316 - DNA, 25 bp, Artificial Sequence
  Synthetic
attacaacaatuttggcctguggac

SEQ ID NO: 34317 - DNA, 21 bp, Artificial Sequence
  Synthetic
aaaacggagccucccttucaa

SEQ ID NO: 34318 - DNA, 28 bp, Artificial Sequence
  Synthetic
tgtgcccagtutctaaatcatctaaugt

SEQ ID NO: 34319 - DNA, 32 bp, Artificial Sequence
  Synthetic
aaaaauaacataccttttuagaaaggccaagg

SEQ ID NO: 34320 - DNA, 30 bp, Artificial Sequence
  Synthetic
ggataagagatttuggacatgtgtgtuagt

SEQ ID NO: 34321 - DNA, 28 bp, Artificial Sequence
  Synthetic
gaaggtgaaaagaucaggaactgaguaa

SEQ ID NO: 34322 - DNA, 26 bp, Artificial Sequence
  Synthetic
ctttaacccacugacactggtttuac

SEQ ID NO: 34323 - DNA, 28 bp, Artificial Sequence
  Synthetic
gaggaagaccgutcgatatctacttuac

SEQ ID NO: 34324 - DNA, 21 bp, Artificial Sequence
  Synthetic
gccttcuacccttgtguggaa

SEQ ID NO: 34325 - DNA, 28 bp, Artificial Sequence
  Synthetic
gaggttttacaautagactgguccacat

SEQ ID NO: 34326 - DNA, 22 bp, Artificial Sequence
  Synthetic
gctgggucaaagatcctugcat

SEQ ID NO: 34327 - DNA, 31 bp, Artificial Sequence
  Synthetic
ccagtggcaataugatgaaaagtattttugt

SEQ ID NO: 34328 - DNA, 26 bp, Artificial Sequence
  Synthetic
cagacagacatugctaatccttacut

SEQ ID NO: 34329 - DNA, 28 bp, Artificial Sequence
  Synthetic
ctcccacatcaugtctcatcttaucaat

SEQ ID NO: 34330 - DNA, 31 bp, Artificial Sequence
  Synthetic
aataagtaatuccacccagagatttugaagt

SEQ ID NO: 34331 - DNA, 25 bp, Artificial Sequence
  Synthetic
gagccagctautccatttctctuct

SEQ ID NO: 34332 - DNA, 23 bp, Artificial Sequence
  Synthetic
ctgtgggauagactctgaaugca

SEQ ID NO: 34333 - DNA, 25 bp, Artificial Sequence
  Synthetic
aagcaacugcaaagaggagaaagua

SEQ ID NO: 34334 - DNA, 22 bp, Artificial Sequence
  Synthetic
gcagaggtcucaggaagtcuga

SEQ ID NO: 34335 - DNA, 25 bp, Artificial Sequence
  Synthetic
tcagctgcagaaucctgaaatgaut

SEQ ID NO: 34336 - DNA, 25 bp, Artificial Sequence
  Synthetic
gaatgaggcucagagagggtagtua

SEQ ID NO: 34337 - DNA, 26 bp, Artificial Sequence
  Synthetic
tccccacaacuaaaacactcatctuc

SEQ ID NO: 34338 - DNA, 22 bp, Artificial Sequence
  Synthetic
tcatccacaccutcggactgua

SEQ ID NO: 34339 - DNA, 25 bp, Artificial Sequence
  Synthetic
ggaaatgaaaagcaucccttcucga

SEQ ID NO: 34340 - DNA, 22 bp, Artificial Sequence
  Synthetic
agagcaaucaacaggaauggct

SEQ ID NO: 34341 - DNA, 23 bp, Artificial Sequence
  Synthetic
ggaaaccaaggautgggattugg

SEQ ID NO: 34342 - DNA, 22 bp, Artificial Sequence
  Synthetic
caaccacuggaaagacctcugg

SEQ ID NO: 34343 - DNA, 21 bp, Artificial Sequence
  Synthetic
tttctcaggaggugggaguct

SEQ ID NO: 34344 - DNA, 21 bp, Artificial Sequence
  Synthetic
gcttcaccucatcaggucaca

SEQ ID NO: 34345 - DNA, 22 bp, Artificial Sequence
  Synthetic
gcaggaggcugagaaagaaguc

SEQ ID NO: 34346 - DNA, 20 bp, Artificial Sequence
  Synthetic
ccagcaacuacctgcactug

SEQ ID NO: 34347 - DNA, 22 bp, Artificial Sequence
  Synthetic
cagtgtctguccagccactaug

SEQ ID NO: 34348 - DNA, 22 bp, Artificial Sequence
  Synthetic
cttccagucacaagtgugcaga

SEQ ID NO: 34349 - DNA, 20 bp, Artificial Sequence
  Synthetic
acaaccauaagcccccacug

SEQ ID NO: 34350 - DNA, 17 bp, Artificial Sequence
  Synthetic
cgaccucgcgagcctuc

SEQ ID NO: 34351 - DNA, 17 bp, Artificial Sequence
  Synthetic
gacucggcgcggaucat

SEQ ID NO: 34352 - DNA, 22 bp, Artificial Sequence
  Synthetic
agtggttttgucccgttttugc

SEQ ID NO: 34353 - DNA, 23 bp, Artificial Sequence
  Synthetic
cgaugggaauagggaaagctuac

SEQ ID NO: 34354 - DNA, 22 bp, Artificial Sequence
  Synthetic
ttgcccagaacgggutttcaua

SEQ ID NO: 34355 - DNA, 24 bp, Artificial Sequence
  Synthetic
tggtgacatguttggtgaacucat

SEQ ID NO: 34356 - DNA, 23 bp, Artificial Sequence
  Synthetic
gcgtaagugaaacaggugcaaag

SEQ ID NO: 34357 - DNA, 30 bp, Artificial Sequence
  Synthetic
tgaagacuctaaaaugaaacacagacaagt

SEQ ID NO: 34358 - DNA, 20 bp, Artificial Sequence
  Synthetic
ctgccttugaacctcctgug

SEQ ID NO: 34359 - DNA, 22 bp, Artificial Sequence
  Synthetic
aacaggcucaagacaagcauct

SEQ ID NO: 34360 - DNA, 28 bp, Artificial Sequence
  Synthetic
ctcaataagcugaaacaagaaagugacc

SEQ ID NO: 34361 - DNA, 25 bp, Artificial Sequence
  Synthetic
tggcacggcuttaagtcatauaaga

SEQ ID NO: 34362 - DNA, 23 bp, Artificial Sequence
  Synthetic
cgcagtggagutggattctucag

SEQ ID NO: 34363 - DNA, 31 bp, Artificial Sequence
  Synthetic
tgcaacattttgaagautattttcagtgcut

SEQ ID NO: 34364 - DNA, 28 bp, Artificial Sequence
  Synthetic
gtagctacattaaugcaggttgaaaauc

SEQ ID NO: 34365 - DNA, 25 bp, Artificial Sequence
  Synthetic
ggtttattgcutctgtagtcugggt

SEQ ID NO: 34366 - DNA, 29 bp, Artificial Sequence
  Synthetic
acacauacttatgaauaaagccaaaccct

SEQ ID NO: 34367 - DNA, 24 bp, Artificial Sequence
  Synthetic
gctttgggaacutggatgactuac

SEQ ID NO: 34368 - DNA, 22 bp, Artificial Sequence
  Synthetic
cccatctagugggtggcattut

SEQ ID NO: 34369 - DNA, 30 bp, Artificial Sequence
  Synthetic
ggctatttctgaugaactcttggtaatgua

SEQ ID NO: 34370 - DNA, 22 bp, Artificial Sequence
  Synthetic
aggcctagcaccutgataccua

SEQ ID NO: 34371 - DNA, 23 bp, Artificial Sequence
  Synthetic
cgaatcttcugcagctccaucag

SEQ ID NO: 34372 - DNA, 31 bp, Artificial Sequence
  Synthetic
tgtgtctatgtguattaaaacagcatatugt

SEQ ID NO: 34373 - DNA, 25 bp, Artificial Sequence
  Synthetic
cctctgaagtuggcaagcatatcut

SEQ ID NO: 34374 - DNA, 30 bp, Artificial Sequence
  Synthetic
ggcaaatctucacagactaattatgucact

SEQ ID NO: 34375 - DNA, 25 bp, Artificial Sequence
  Synthetic
ggccactgtuataagctttcaagut

SEQ ID NO: 34376 - DNA, 27 bp, Artificial Sequence
  Synthetic
actaugaagacagaacuacagaaagcc

SEQ ID NO: 34377 - DNA, 28 bp, Artificial Sequence
  Synthetic
caagtgacautatcttgugaacaaccaa

SEQ ID NO: 34378 - DNA, 23 bp, Artificial Sequence
  Synthetic
actatcaggcuttctgcaagugg

SEQ ID NO: 34379 - DNA, 28 bp, Artificial Sequence
  Synthetic
ccagaggaaaacaugaatuacacccaat

SEQ ID NO: 34380 - DNA, 27 bp, Artificial Sequence
  Synthetic
gaaatatcuggcaaacgagacaaauca

SEQ ID NO: 34381 - DNA, 29 bp, Artificial Sequence
  Synthetic
gctatcctcaggaagugtatacgcttuac

SEQ ID NO: 34382 - DNA, 24 bp, Artificial Sequence
  Synthetic
ctttccutccttttcuccaaggct

SEQ ID NO: 34383 - DNA, 27 bp, Artificial Sequence
  Synthetic
ccaggatgtguccaaatccatgttaua

SEQ ID NO: 34384 - DNA, 24 bp, Artificial Sequence
  Synthetic
gcagaaauaccaggcagagtgtuc

SEQ ID NO: 34385 - DNA, 31 bp, Artificial Sequence
  Synthetic
cttccacagatttucttcttctcttttcauc

SEQ ID NO: 34386 - DNA, 25 bp, Artificial Sequence
  Synthetic
ggagaaggaguacgagatugaaagg

SEQ ID NO: 34387 - DNA, 30 bp, Artificial Sequence
  Synthetic
tctatcaagcuggtttctaagattttugga

SEQ ID NO: 34388 - DNA, 26 bp, Artificial Sequence
  Synthetic
gcuctgagataaugcagaagaagcag

SEQ ID NO: 34389 - DNA, 23 bp, Artificial Sequence
  Synthetic
ctcctccugaaactcagcttuga

SEQ ID NO: 34390 - DNA, 24 bp, Artificial Sequence
  Synthetic
tttgagaccgagaucaacaucacc

SEQ ID NO: 34391 - DNA, 21 bp, Artificial Sequence
  Synthetic
agtggccutttgctgtuggat

SEQ ID NO: 34392 - DNA, 30 bp, Artificial Sequence
  Synthetic
aaaaccatccaggauaaaaacaaggagaua

SEQ ID NO: 34393 - DNA, 23 bp, Artificial Sequence
  Synthetic
cagttcttgcucctgaacctuca

SEQ ID NO: 34394 - DNA, 20 bp, Artificial Sequence
  Synthetic
gaggagcugaatcggcugaa

SEQ ID NO: 34395 - DNA, 23 bp, Artificial Sequence
  Synthetic
gaggtcatccucactcctctuct

SEQ ID NO: 34396 - DNA, 24 bp, Artificial Sequence
  Synthetic
tcacttgaggaaugagcattucca

SEQ ID NO: 34397 - DNA, 22 bp, Artificial Sequence
  Synthetic
ggctcctuagttccaagauggt

SEQ ID NO: 34398 - DNA, 27 bp, Artificial Sequence
  Synthetic
catttcttucttcttcaatuccaggca

SEQ ID NO: 34399 - DNA, 25 bp, Artificial Sequence
  Synthetic
gaatttgctguttctcacacuccag

SEQ ID NO: 34400 - DNA, 25 bp, Artificial Sequence
  Synthetic
gtctuaggagtgagaucgaaagact

SEQ ID NO: 34401 - DNA, 21 bp, Artificial Sequence
  Synthetic
cccaucaaacaccagctugga

SEQ ID NO: 34402 - DNA, 25 bp, Artificial Sequence
  Synthetic
gaagaagtcaguggaagaagtugct

SEQ ID NO: 34403 - DNA, 21 bp, Artificial Sequence
  Synthetic
tcagcttcucattccgauggg

SEQ ID NO: 34404 - DNA, 28 bp, Artificial Sequence
  Synthetic
agtatctgttucagaagccaucaagaaa

SEQ ID NO: 34405 - DNA, 24 bp, Artificial Sequence
  Synthetic
ttttggugactggauccacaaagt

SEQ ID NO: 34406 - DNA, 23 bp, Artificial Sequence
  Synthetic
tgaccgtcacugagctaguagat

SEQ ID NO: 34407 - DNA, 21 bp, Artificial Sequence
  Synthetic
actccagagcaguaccagguc

SEQ ID NO: 34408 - DNA, 25 bp, Artificial Sequence
  Synthetic
agctgtcacugggtataatgaucct

SEQ ID NO: 34409 - DNA, 30 bp, Artificial Sequence
  Synthetic
ccctcttatatgcuatgtcaactgguaaac

SEQ ID NO: 34410 - DNA, 22 bp, Artificial Sequence
  Synthetic
gatgaggaaauagggcuctguc

SEQ ID NO: 34411 - DNA, 28 bp, Artificial Sequence
  Synthetic
gatggttatttcutcccattcacatucc

SEQ ID NO: 34412 - DNA, 22 bp, Artificial Sequence
  Synthetic
ctcagccucactcaatttgcug

SEQ ID NO: 34413 - DNA, 24 bp, Artificial Sequence
  Synthetic
aggttttcugtgtcaaagauggct

SEQ ID NO: 34414 - DNA, 21 bp, Artificial Sequence
  Synthetic
gtcactucaggacgcagtcuc

SEQ ID NO: 34415 - DNA, 20 bp, Artificial Sequence
  Synthetic
acutccgggucaacaagacc

SEQ ID NO: 34416 - DNA, 22 bp, Artificial Sequence
  Synthetic
ccagcagcuatgccaaaaucct

SEQ ID NO: 34417 - DNA, 22 bp, Artificial Sequence
  Synthetic
cggagccgaagacaugttguaa

SEQ ID NO: 34418 - DNA, 20 bp, Artificial Sequence
  Synthetic
ccgctcacugacagacacuc

SEQ ID NO: 34419 - DNA, 22 bp, Artificial Sequence
  Synthetic
gccggtctaaugtaggcaagua

SEQ ID NO: 34420 - DNA, 23 bp, Artificial Sequence
  Synthetic
caggcaaucccattttctcugga

SEQ ID NO: 34421 - DNA, 22 bp, Artificial Sequence
  Synthetic
cgcttacccucaagaaccugaa

SEQ ID NO: 34422 - DNA, 23 bp, Artificial Sequence
  Synthetic
acccttaaucctgcctcauagaa

SEQ ID NO: 34423 - DNA, 26 bp, Artificial Sequence
  Synthetic
gtagagaggatugaagacagccauag

SEQ ID NO: 34424 - DNA, 21 bp, Artificial Sequence
  Synthetic
caccttcttuagctccccgut

SEQ ID NO: 34425 - DNA, 19 bp, Artificial Sequence
  Synthetic
ctcacacgutcgucaccac

SEQ ID NO: 34426 - DNA, 21 bp, Artificial Sequence
  Synthetic
gtaggtgatugcttgctgcug

SEQ ID NO: 34427 - DNA, 22 bp, Artificial Sequence
  Synthetic
cccutctacccucaacgacaaa

SEQ ID NO: 34428 - DNA, 18 bp, Artificial Sequence
  Synthetic
gtgccuggactcguacgg

SEQ ID NO: 34429 - DNA, 20 bp, Artificial Sequence
  Synthetic
cgucatgcaauacgccgact

SEQ ID NO: 34430 - DNA, 19 bp, Artificial Sequence
  Synthetic
cggugttcugcggagaact

SEQ ID NO: 34431 - DNA, 19 bp, Artificial Sequence
  Synthetic
gccaacaugggcagtcuga

SEQ ID NO: 34432 - DNA, 22 bp, Artificial Sequence
  Synthetic
gctggcauaggttccactguat

SEQ ID NO: 34433 - DNA, 28 bp, Artificial Sequence
  Synthetic
gcttggttuacaacagggaataggttua

SEQ ID NO: 34434 - DNA, 17 bp, Artificial Sequence
  Synthetic
ccacccgguggttgucg

SEQ ID NO: 34435 - DNA, 25 bp, Artificial Sequence
  Synthetic
ctaaaaucagagccauccagacagt

SEQ ID NO: 34436 - DNA, 25 bp, Artificial Sequence
  Synthetic
gcctatactucaccatggagactuc

SEQ ID NO: 34437 - DNA, 28 bp, Artificial Sequence
  Synthetic
aacaagtgattugatgatgtgttuacct

SEQ ID NO: 34438 - DNA, 25 bp, Artificial Sequence
  Synthetic
gtgaagtgaugcccgatgacattua

SEQ ID NO: 34439 - DNA, 29 bp, Artificial Sequence
  Synthetic
ggcattttcattcugacttggtatttugt

SEQ ID NO: 34440 - DNA, 27 bp, Artificial Sequence
  Synthetic
tgaatgagtgaaugtgtgaatggauga

SEQ ID NO: 34441 - DNA, 26 bp, Artificial Sequence
  Synthetic
agtcctcaactucttccgtttctaug

SEQ ID NO: 34442 - DNA, 27 bp, Artificial Sequence
  Synthetic
ttctgctguaggagagagagaacuaaa

SEQ ID NO: 34443 - DNA, 22 bp, Artificial Sequence
  Synthetic
cugcaaaagcaucaggaggaga

SEQ ID NO: 34444 - DNA, 22 bp, Artificial Sequence
  Synthetic
ctccccucctactacacauggt

SEQ ID NO: 34445 - DNA, 23 bp, Artificial Sequence
  Synthetic
cagccacatcuggcttgaaatuc

SEQ ID NO: 34446 - DNA, 23 bp, Artificial Sequence
  Synthetic
gcttccugagatcatttggucct

SEQ ID NO: 34447 - DNA, 21 bp, Artificial Sequence
  Synthetic
ggttctgcugctctccaaucc

SEQ ID NO: 34448 - DNA, 21 bp, Artificial Sequence
  Synthetic
gtcttccuggcaaggguaaac

SEQ ID NO: 34449 - DNA, 23 bp, Artificial Sequence
  Synthetic
gctgcttatccutcagccactuc

SEQ ID NO: 34450 - DNA, 23 bp, Artificial Sequence
  Synthetic
gcagtgagaugaggatctgcuct

SEQ ID NO: 34451 - DNA, 23 bp, Artificial Sequence
  Synthetic
agacttcccccutgttcctacuc

SEQ ID NO: 34452 - DNA, 22 bp, Artificial Sequence
  Synthetic
acgtcttagcugaacgtgagug

SEQ ID NO: 34453 - DNA, 18 bp, Artificial Sequence
  Synthetic
gaucaccggcaugcagga

SEQ ID NO: 34454 - DNA, 24 bp, Artificial Sequence
  Synthetic
gaauggacaggaucagacagagac

SEQ ID NO: 34455 - DNA, 23 bp, Artificial Sequence
  Synthetic
catcctgcucacactttctucct

SEQ ID NO: 34456 - DNA, 19 bp, Artificial Sequence
  Synthetic
ggguaggagacgtccuggt

SEQ ID NO: 34457 - DNA, 20 bp, Artificial Sequence
  Synthetic
gctgtccuggtgccguagat

SEQ ID NO: 34458 - DNA, 21 bp, Artificial Sequence
  Synthetic
ggagatgttugtgcacccuga

SEQ ID NO: 34459 - DNA, 22 bp, Artificial Sequence
  Synthetic
atgcaggaagaugaggccauac

SEQ ID NO: 34460 - DNA, 22 bp, Artificial Sequence
  Synthetic
gcaagagacaaggutggtguga

SEQ ID NO: 34461 - DNA, 27 bp, Artificial Sequence
  Synthetic
tccatgaccugatttattccttgucag

SEQ ID NO: 34462 - DNA, 22 bp, Artificial Sequence
  Synthetic
tgcttgtuaggctggtagtucc

SEQ ID NO: 34463 - DNA, 21 bp, Artificial Sequence
  Synthetic
aaccagccacuacccttccua

SEQ ID NO: 34464 - DNA, 19 bp, Artificial Sequence
  Synthetic
cacttgggucccacaggut

SEQ ID NO: 34465 - DNA, 24 bp, Artificial Sequence
  Synthetic
cccacctcucccttaagagaauga

SEQ ID NO: 34466 - DNA, 19 bp, Artificial Sequence
  Synthetic
gaggagcauccccacacug

SEQ ID NO: 34467 - DNA, 24 bp, Artificial Sequence
  Synthetic
aggacacatuccttgtgtgtgtut

SEQ ID NO: 34468 - DNA, 19 bp, Artificial Sequence
  Synthetic
cccatcccaccugccatug

SEQ ID NO: 34469 - DNA, 23 bp, Artificial Sequence
  Synthetic
ttggcuggaggataaacacucag

SEQ ID NO: 34470 - DNA, 20 bp, Artificial Sequence
  Synthetic
ccggcutcccaauacccaag

SEQ ID NO: 34471 - DNA, 24 bp, Artificial Sequence
  Synthetic
tgtgacccugactcttattcucca

SEQ ID NO: 34472 - DNA, 21 bp, Artificial Sequence
  Synthetic
tgcagaggagutccagcucaa

SEQ ID NO: 34473 - DNA, 28 bp, Artificial Sequence
  Synthetic
gaaggagaggagguttttgactctaauc

SEQ ID NO: 34474 - DNA, 21 bp, Artificial Sequence
  Synthetic
ttggccccugagacgatacua

SEQ ID NO: 34475 - DNA, 25 bp, Artificial Sequence
  Synthetic
ctcatctguggtgtatctgttuccc

SEQ ID NO: 34476 - DNA, 21 bp, Artificial Sequence
  Synthetic
ggcaaaacaucaccccaucct

SEQ ID NO: 34477 - DNA, 23 bp, Artificial Sequence
  Synthetic
cctgtgtccutgtctctgcttuc

SEQ ID NO: 34478 - DNA, 25 bp, Artificial Sequence
  Synthetic
gguaagagaagagagucagagacac

SEQ ID NO: 34479 - DNA, 28 bp, Artificial Sequence
  Synthetic
ttctctaatatctugtctgccttcucct

SEQ ID NO: 34480 - DNA, 23 bp, Artificial Sequence
  Synthetic
caccccacaggaaacutgtcaua

SEQ ID NO: 34481 - DNA, 23 bp, Artificial Sequence
  Synthetic
ggtctgaccauctgctttcucag

SEQ ID NO: 34482 - DNA, 21 bp, Artificial Sequence
  Synthetic
actcaggaugcttggtgctug

SEQ ID NO: 34483 - DNA, 24 bp, Artificial Sequence
  Synthetic
gtttaattugggagcatggctgug

SEQ ID NO: 34484 - DNA, 22 bp, Artificial Sequence
  Synthetic
ggcagacagacuaatgcuaggg

SEQ ID NO: 34485 - DNA, 22 bp, Artificial Sequence
  Synthetic
gatccttccucctgggaatcug

SEQ ID NO: 34486 - DNA, 22 bp, Artificial Sequence
  Synthetic
caggtgaacuctcagcuggaaa

SEQ ID NO: 34487 - DNA, 20 bp, Artificial Sequence
  Synthetic
gaagctgagutcccccacuc

SEQ ID NO: 34488 - DNA, 20 bp, Artificial Sequence
  Synthetic
aagagctgcuttccagcugt

SEQ ID NO: 34489 - DNA, 24 bp, Artificial Sequence
  Synthetic
tgacaactccucttccctctguag

SEQ ID NO: 34490 - DNA, 23 bp, Artificial Sequence
  Synthetic
agagagaacautacccaggguga

SEQ ID NO: 34491 - DNA, 29 bp, Artificial Sequence
  Synthetic
ctgaaccctaccuttcataacttcucaat

SEQ ID NO: 34492 - DNA, 21 bp, Artificial Sequence
  Synthetic
tcaactgacuggctgactuca

SEQ ID NO: 34493 - DNA, 21 bp, Artificial Sequence
  Synthetic
ctgtccutccctcucacacag

SEQ ID NO: 34494 - DNA, 23 bp, Artificial Sequence
  Synthetic
gaaggcagugaagagaggagaug

SEQ ID NO: 34495 - DNA, 23 bp, Artificial Sequence
  Synthetic
tcttaggagcutggtcctuccaa

SEQ ID NO: 34496 - DNA, 27 bp, Artificial Sequence
  Synthetic
agagccauatgaataaugagacaaggg

SEQ ID NO: 34497 - DNA, 23 bp, Artificial Sequence
  Synthetic
gggccacuggtcacattttcuat

SEQ ID NO: 34498 - DNA, 26 bp, Artificial Sequence
  Synthetic
acagacaaaaucccagcagacattua

SEQ ID NO: 34499 - DNA, 24 bp, Artificial Sequence
  Synthetic
ccttgttgcucatgctttgaaucc

SEQ ID NO: 34500 - DNA, 22 bp, Artificial Sequence
  Synthetic
ggtgggauctcctatccaucac

SEQ ID NO: 34501 - DNA, 20 bp, Artificial Sequence
  Synthetic
tggagguctgaccgucacac

SEQ ID NO: 34502 - DNA, 24 bp, Artificial Sequence
  Synthetic
agacggcaugaatggataaaacug

SEQ ID NO: 34503 - DNA, 25 bp, Artificial Sequence
  Synthetic
ggtaagtguagtggcaaatguaggg

SEQ ID NO: 34504 - DNA, 22 bp, Artificial Sequence
  Synthetic
ctcccttcccuacctatccuca

SEQ ID NO: 34505 - DNA, 19 bp, Artificial Sequence
  Synthetic
acagggucgtgtccucact

SEQ ID NO: 34506 - DNA, 22 bp, Artificial Sequence
  Synthetic
ccugggagaauaagggaagugt

SEQ ID NO: 34507 - DNA, 21 bp, Artificial Sequence
  Synthetic
ccctcccuatgcctccuaacc

SEQ ID NO: 34508 - DNA, 25 bp, Artificial Sequence
  Synthetic
caaaagaagccccuttccagaacua

SEQ ID NO: 34509 - DNA, 23 bp, Artificial Sequence
  Synthetic
gaagggtgaauttggagagugct

SEQ ID NO: 34510 - DNA, 23 bp, Artificial Sequence
  Synthetic
tcctccauatctttccugcccat

SEQ ID NO: 34511 - DNA, 24 bp, Artificial Sequence
  Synthetic
tcttttgcatuctcttcccacucc

SEQ ID NO: 34512 - DNA, 23 bp, Artificial Sequence
  Synthetic
gaaggctcagaugagcacauaga

SEQ ID NO: 34513 - DNA, 24 bp, Artificial Sequence
  Synthetic
ggcaguggaaauaggagaagcaag

SEQ ID NO: 34514 - DNA, 26 bp, Artificial Sequence
  Synthetic
gaucgaaaccaauaagaagcaatuct

SEQ ID NO: 34515 - DNA, 22 bp, Artificial Sequence
  Synthetic
gggcccuacgattacacctaug

SEQ ID NO: 34516 - DNA, 21 bp, Artificial Sequence
  Synthetic
atcaagacgucatgggcugag

SEQ ID NO: 34517 - DNA, 23 bp, Artificial Sequence
  Synthetic
actcttctccutctctcctuggg

SEQ ID NO: 34518 - DNA, 22 bp, Artificial Sequence
  Synthetic
ggacacagtuccaggaagacug

SEQ ID NO: 34519 - DNA, 22 bp, Artificial Sequence
  Synthetic
cccaggcauctctcctcctuag

SEQ ID NO: 34520 - DNA, 22 bp, Artificial Sequence
  Synthetic
ggttcctgautttgtggccugt

SEQ ID NO: 34521 - DNA, 24 bp, Artificial Sequence
  Synthetic
cgctccatcuctctcatgtcttug

SEQ ID NO: 34522 - DNA, 26 bp, Artificial Sequence
  Synthetic
gtctcaaggguttcacagttuagagt

SEQ ID NO: 34523 - DNA, 22 bp, Artificial Sequence
  Synthetic
cgcutcctgtaugaagaccaga

SEQ ID NO: 34524 - DNA, 19 bp, Artificial Sequence
  Synthetic
gccuaccccaccatgucac

SEQ ID NO: 34525 - DNA, 24 bp, Artificial Sequence
  Synthetic
tcctgataaucatggactcuccca

SEQ ID NO: 34526 - DNA, 18 bp, Artificial Sequence
  Synthetic
cucttaccugcccagcct

SEQ ID NO: 34527 - DNA, 17 bp, Artificial Sequence
  Synthetic
ccgcagccuctgaccuc

SEQ ID NO: 34528 - DNA, 25 bp, Artificial Sequence
  Synthetic
gacccacccauactatatgacaucc

SEQ ID NO: 34529 - DNA, 26 bp, Artificial Sequence
  Synthetic
cagtgagttgucttcccttgttcuat

SEQ ID NO: 34530 - DNA, 22 bp, Artificial Sequence
  Synthetic
gctgaagggauttgtgugggaa

SEQ ID NO: 34531 - DNA, 28 bp, Artificial Sequence
  Synthetic
gccttaacaguagttttctgcctuacag

SEQ ID NO: 34532 - DNA, 26 bp, Artificial Sequence
  Synthetic
gaccctaaactuaaattccaccguca

SEQ ID NO: 34533 - DNA, 20 bp, Artificial Sequence
  Synthetic
tgugaagaagcugggcaagg

SEQ ID NO: 34534 - DNA, 21 bp, Artificial Sequence
  Synthetic
ggaggctcuccttaccctcua

SEQ ID NO: 34535 - DNA, 23 bp, Artificial Sequence
  Synthetic
cacacuacagtuacgaccaccag

SEQ ID NO: 34536 - DNA, 23 bp, Artificial Sequence
  Synthetic
tgagcctcagugtccccaataua

SEQ ID NO: 34537 - DNA, 25 bp, Artificial Sequence
  Synthetic
caggtgtttcaugaagaagaccauc

SEQ ID NO: 34538 - DNA, 27 bp, Artificial Sequence
  Synthetic
ggaagaggaugatgtugaagagaacac

SEQ ID NO: 34539 - DNA, 29 bp, Artificial Sequence
  Synthetic
cgatgtgatgaauaattctgagagccaut

SEQ ID NO: 34540 - DNA, 24 bp, Artificial Sequence
  Synthetic
ggtcaaactugactttcaguagcg

SEQ ID NO: 34541 - DNA, 19 bp, Artificial Sequence
  Synthetic
ccugccaccactacugcat

SEQ ID NO: 34542 - DNA, 22 bp, Artificial Sequence
  Synthetic
gctcacgtcucttatgctggut

SEQ ID NO: 34543 - DNA, 19 bp, Artificial Sequence
  Synthetic
ccccttucaattgcugcga

SEQ ID NO: 34544 - DNA, 20 bp, Artificial Sequence
  Synthetic
gctcctcucctgtctccuca

SEQ ID NO: 34545 - DNA, 23 bp, Artificial Sequence
  Synthetic
actgtgctugggaaaagauaccc

SEQ ID NO: 34546 - DNA, 22 bp, Artificial Sequence
  Synthetic
cctcacctccugcctgtctuat

SEQ ID NO: 34547 - DNA, 24 bp, Artificial Sequence
  Synthetic
gctcccautctatagcaugaaggg

SEQ ID NO: 34548 - DNA, 30 bp, Artificial Sequence
  Synthetic
atgtatgagacauttttcagtctguaagca

SEQ ID NO: 34549 - DNA, 26 bp, Artificial Sequence
  Synthetic
attcaguacacccggaaactatucag

SEQ ID NO: 34550 - DNA, 23 bp, Artificial Sequence
  Synthetic
catagcagcagcagcugatttug

SEQ ID NO: 34551 - DNA, 25 bp, Artificial Sequence
  Synthetic
agttgatgaauggagtguccagaag

SEQ ID NO: 34552 - DNA, 22 bp, Artificial Sequence
  Synthetic
tcatctccacccuccaagctua

SEQ ID NO: 34553 - DNA, 26 bp, Artificial Sequence
  Synthetic
tggtcccacutacaacugaacaaaaa

SEQ ID NO: 34554 - DNA, 29 bp, Artificial Sequence
  Synthetic
agtagcuattcccactauaagggagaaag

SEQ ID NO: 34555 - DNA, 28 bp, Artificial Sequence
  Synthetic
aggcagaaacucaagatggttatgtuag

SEQ ID NO: 34556 - DNA, 24 bp, Artificial Sequence
  Synthetic
tgctatgaatucctaatggcugca

SEQ ID NO: 34557 - DNA, 25 bp, Artificial Sequence
  Synthetic
ctccctcctccuattcccatttcua

SEQ ID NO: 34558 - DNA, 23 bp, Artificial Sequence
  Synthetic
ccatcugaaggctggacuaggat

SEQ ID NO: 34559 - DNA, 29 bp, Artificial Sequence
  Synthetic
tttcactgguaataatggattguggaaaa

SEQ ID NO: 34560 - DNA, 26 bp, Artificial Sequence
  Synthetic
tcagaacattctcuagtaccccaguc

SEQ ID NO: 34561 - DNA, 21 bp, Artificial Sequence
  Synthetic
gttggtcaacguaggcctcuc

SEQ ID NO: 34562 - DNA, 27 bp, Artificial Sequence
  Synthetic
tggttttggccaauctgtaagaagtua

SEQ ID NO: 34563 - DNA, 27 bp, Artificial Sequence
  Synthetic
tcagcttcctuattgctgaatgaauct

SEQ ID NO: 34564 - DNA, 26 bp, Artificial Sequence
  Synthetic
caaaacttgaggaguttgatccauga

SEQ ID NO: 34565 - DNA, 22 bp, Artificial Sequence
  Synthetic
ttcttgauagcgctgaugccat

SEQ ID NO: 34566 - DNA, 25 bp, Artificial Sequence
  Synthetic
tctttgatctguaccatcctcucca

SEQ ID NO: 34567 - DNA, 27 bp, Artificial Sequence
  Synthetic
gagcaggcttugaagatttcagaauag

SEQ ID NO: 34568 - DNA, 22 bp, Artificial Sequence
  Synthetic
cctcuaccacaggcattgcaut

SEQ ID NO: 34569 - DNA, 26 bp, Artificial Sequence
  Synthetic
gagttgcttuttgactgtctucacag

SEQ ID NO: 34570 - DNA, 22 bp, Artificial Sequence
  Synthetic
gtcctctcugctgttatugggt

SEQ ID NO: 34571 - DNA, 29 bp, Artificial Sequence
  Synthetic
cgatatttgtggcuggtggtttataugat

SEQ ID NO: 34572 - DNA, 21 bp, Artificial Sequence
  Synthetic
cugaggtgaauacaggccaca

SEQ ID NO: 34573 - DNA, 25 bp, Artificial Sequence
  Synthetic
ctgcuccacaaaattccgucaaaaa

SEQ ID NO: 34574 - DNA, 25 bp, Artificial Sequence
  Synthetic
catggcaccauagtcaaagttctug

SEQ ID NO: 34575 - DNA, 20 bp, Artificial Sequence
  Synthetic
catcaaccuccauggcaacg

SEQ ID NO: 34576 - DNA, 22 bp, Artificial Sequence
  Synthetic
ccagctgugccaaacacaauat

SEQ ID NO: 34577 - DNA, 29 bp, Artificial Sequence
  Synthetic
gaaagtacctgaugacatgcatttgttua

SEQ ID NO: 34578 - DNA, 23 bp, Artificial Sequence
  Synthetic
acaaacagtcuccccctacauga

SEQ ID NO: 34579 - DNA, 29 bp, Artificial Sequence
  Synthetic
ccagctagtgatutttgaaacaggtttut

SEQ ID NO: 34580 - DNA, 30 bp, Artificial Sequence
  Synthetic
cauattgtaacaaaatcucaagcagaagca

SEQ ID NO: 34581 - DNA, 27 bp, Artificial Sequence
  Synthetic
tggctttcattccuctgaaggatttut

SEQ ID NO: 34582 - DNA, 21 bp, Artificial Sequence
  Synthetic
caacatgcucgcaatcctugt

SEQ ID NO: 34583 - DNA, 31 bp, Artificial Sequence
  Synthetic
tgacatatcugagcaatttctttttctucca

SEQ ID NO: 34584 - DNA, 23 bp, Artificial Sequence
  Synthetic
cttcttcaacaccutgccatgut

SEQ ID NO: 34585 - DNA, 24 bp, Artificial Sequence
  Synthetic
ttcttugggaggtgaaaauaccac

SEQ ID NO: 34586 - DNA, 24 bp, Artificial Sequence
  Synthetic
tgtctggaatugaagggtgatugg

SEQ ID NO: 34587 - DNA, 24 bp, Artificial Sequence
  Synthetic
cgagtgggtcugtcttttccatut

SEQ ID NO: 34588 - DNA, 21 bp, Artificial Sequence
  Synthetic
aacgagauaacctgctccuct

SEQ ID NO: 34589 - DNA, 29 bp, Artificial Sequence
  Synthetic
aacaaccactgucaattatgtacgtgaua

SEQ ID NO: 34590 - DNA, 22 bp, Artificial Sequence
  Synthetic
cutctataagccucgacagcca

SEQ ID NO: 34591 - DNA, 23 bp, Artificial Sequence
  Synthetic
tggaaacccuttcagcttctugt

SEQ ID NO: 34592 - DNA, 27 bp, Artificial Sequence
  Synthetic
tgggccttattuatcatctgttctguc

SEQ ID NO: 34593 - DNA, 29 bp, Artificial Sequence
  Synthetic
atgtgtccagtuttcttattttgcttuca

SEQ ID NO: 34594 - DNA, 24 bp, Artificial Sequence
  Synthetic
tgctgugagaaaacaagugacagt

SEQ ID NO: 34595 - DNA, 30 bp, Artificial Sequence
  Synthetic
ctgtttcacttttuaggtatggtctcttug

SEQ ID NO: 34596 - DNA, 25 bp, Artificial Sequence
  Synthetic
acacccctgautgagaaagaactut

SEQ ID NO: 34597 - DNA, 27 bp, Artificial Sequence
  Synthetic
gatcccctggauttgttgaaacatuag

SEQ ID NO: 34598 - DNA, 24 bp, Artificial Sequence
  Synthetic
tgtgtccuacacaagaaugcagaa

SEQ ID NO: 34599 - DNA, 28 bp, Artificial Sequence
  Synthetic
tcaacagaatcucaggagccatatcuaa

SEQ ID NO: 34600 - DNA, 22 bp, Artificial Sequence
  Synthetic
cagatgcttauggaaggctugc

SEQ ID NO: 34601 - DNA, 26 bp, Artificial Sequence
  Synthetic
ggagatttgtcuggaagcatgttcua

SEQ ID NO: 34602 - DNA, 26 bp, Artificial Sequence
  Synthetic
tgaaagaccccaauacaaatguccag

SEQ ID NO: 34603 - DNA, 22 bp, Artificial Sequence
  Synthetic
gttaaaggugccaaaccgaugg

SEQ ID NO: 34604 - DNA, 24 bp, Artificial Sequence
  Synthetic
ggcucagcaactatagucaaggac

SEQ ID NO: 34605 - DNA, 23 bp, Artificial Sequence
  Synthetic
cctactcaacucccttcttuccc

SEQ ID NO: 34606 - DNA, 26 bp, Artificial Sequence
  Synthetic
ctggaacttauccagaaagttuccct

SEQ ID NO: 34607 - DNA, 22 bp, Artificial Sequence
  Synthetic
gacaacgucacagtggagaaug

SEQ ID NO: 34608 - DNA, 24 bp, Artificial Sequence
  Synthetic
tatcgctgccauttggactaaaut

SEQ ID NO: 34609 - DNA, 20 bp, Artificial Sequence
  Synthetic
ggagtgugagacgcccaauc

SEQ ID NO: 34610 - DNA, 21 bp, Artificial Sequence
  Synthetic
ccagccuacactctctgaugg

SEQ ID NO: 34611 - DNA, 24 bp, Artificial Sequence
  Synthetic
catttgcgaggaaagutcccaaug

SEQ ID NO: 34612 - DNA, 28 bp, Artificial Sequence
  Synthetic
agtagtcaguacagcattaaucacaaaa

SEQ ID NO: 34613 - DNA, 25 bp, Artificial Sequence
  Synthetic
ggattttcuccagggaatgtcucag

SEQ ID NO: 34614 - DNA, 25 bp, Artificial Sequence
  Synthetic
gtgtgctgtcutatttgcttgacut

SEQ ID NO: 34615 - DNA, 25 bp, Artificial Sequence
  Synthetic
aggagcugcaaacattgacatttut

SEQ ID NO: 34616 - DNA, 27 bp, Artificial Sequence
  Synthetic
actcctatgtgauaccaaagtccauct

SEQ ID NO: 34617 - DNA, 30 bp, Artificial Sequence
  Synthetic
ccccaagtguttcattattttccuaagaat

SEQ ID NO: 34618 - DNA, 24 bp, Artificial Sequence
  Synthetic
acacaacguggcttgcatuaaaaa

SEQ ID NO: 34619 - DNA, 21 bp, Artificial Sequence
  Synthetic
agtcctggucaatgggcuaac

SEQ ID NO: 34620 - DNA, 26 bp, Artificial Sequence
  Synthetic
ccuccttctagagtuaagaagcaacc

SEQ ID NO: 34621 - DNA, 20 bp, Artificial Sequence
  Synthetic
caacgugagcctgtcuggat

SEQ ID NO: 34622 - DNA, 21 bp, Artificial Sequence
  Synthetic
tttctcctugcatggcaguga

SEQ ID NO: 34623 - DNA, 25 bp, Artificial Sequence
  Synthetic
cctgtgacautgtgaactuaacgga

SEQ ID NO: 34624 - DNA, 23 bp, Artificial Sequence
  Synthetic
ctctctgaccucactggcaaaut

SEQ ID NO: 34625 - DNA, 31 bp, Artificial Sequence
  Synthetic
gttatttcctaaacauctgcctatcttcugt

SEQ ID NO: 34626 - DNA, 21 bp, Artificial Sequence
  Synthetic
gacgtggacutccacauccaa

SEQ ID NO: 34627 - DNA, 28 bp, Artificial Sequence
  Synthetic
gtgacugtgaatttaauccaaaaagaca

SEQ ID NO: 34628 - DNA, 31 bp, Artificial Sequence
  Synthetic
gtcacaauaactggattuaaggaagagacat

SEQ ID NO: 34629 - DNA, 27 bp, Artificial Sequence
  Synthetic
gagttctcttcccutaagtcagtccua

SEQ ID NO: 34630 - DNA, 22 bp, Artificial Sequence
  Synthetic
ctgtgagacccuccccagatua

SEQ ID NO: 34631 - DNA, 30 bp, Artificial Sequence
  Synthetic
gtgaacaaaacgagutgcaaagttatttuc

SEQ ID NO: 34632 - DNA, 24 bp, Artificial Sequence
  Synthetic
tggcctcuaacaaaatcacugcaa

SEQ ID NO: 34633 - DNA, 31 bp, Artificial Sequence
  Synthetic
cctggtagataugaaatgcataaaauggaaa

SEQ ID NO: 34634 - DNA, 22 bp, Artificial Sequence
  Synthetic
gcagcaaauccatgccacuaga

SEQ ID NO: 34635 - DNA, 23 bp, Artificial Sequence
  Synthetic
ccgatgactucacatccagguac

SEQ ID NO: 34636 - DNA, 22 bp, Artificial Sequence
  Synthetic
tgttccctugggaatgtgagug

SEQ ID NO: 34637 - DNA, 22 bp, Artificial Sequence
  Synthetic
ctttguttctgacgugccacag

SEQ ID NO: 34638 - DNA, 23 bp, Artificial Sequence
  Synthetic
cagtaaccccuagcaggaaagut

SEQ ID NO: 34639 - DNA, 23 bp, Artificial Sequence
  Synthetic
ccagtgcuggttcatcagaucaa

SEQ ID NO: 34640 - DNA, 23 bp, Artificial Sequence
  Synthetic
ggtaactguccccaaaacaguga

SEQ ID NO: 34641 - DNA, 28 bp, Artificial Sequence
  Synthetic
aactgaaggactuatttggtgtccauag

SEQ ID NO: 34642 - DNA, 28 bp, Artificial Sequence
  Synthetic
gatgaaaaagacaaucagaaugaagcca

SEQ ID NO: 34643 - DNA, 28 bp, Artificial Sequence
  Synthetic
gggtggtcttuatgctcatgatauaaat

SEQ ID NO: 34644 - DNA, 21 bp, Artificial Sequence
  Synthetic
gctccaugggacuggaaagag

SEQ ID NO: 34645 - DNA, 22 bp, Artificial Sequence
  Synthetic
tggagccaugtactaccuggaa

SEQ ID NO: 34646 - DNA, 24 bp, Artificial Sequence
  Synthetic
guatgggacuggcaacagagaaaa

SEQ ID NO: 34647 - DNA, 31 bp, Artificial Sequence
  Synthetic
ctcttgcttgacuctatgttctacttuacag

SEQ ID NO: 34648 - DNA, 21 bp, Artificial Sequence
  Synthetic
ctcgccagcccaucatgatua

SEQ ID NO: 34649 - DNA, 31 bp, Artificial Sequence
  Synthetic
acctacacauacacacauacataaatttcut

SEQ ID NO: 34650 - DNA, 27 bp, Artificial Sequence
  Synthetic
gttaatggucatcaagaaauggccaaa

SEQ ID NO: 34651 - DNA, 30 bp, Artificial Sequence
  Synthetic
gcaatcccagutgatattttcatucaaaac

SEQ ID NO: 34652 - DNA, 25 bp, Artificial Sequence
  Synthetic
tcctcaugagaaccaatctugcaat

SEQ ID NO: 34653 - DNA, 31 bp, Artificial Sequence
  Synthetic
tcattcttacctcaguttgtcttttcctuag

SEQ ID NO: 34654 - DNA, 28 bp, Artificial Sequence
  Synthetic
cacttacctatcaaugtactcagcauca

SEQ ID NO: 34655 - DNA, 31 bp, Artificial Sequence
  Synthetic
ttgccauattgagtatauacaaccaaaaaga

SEQ ID NO: 34656 - DNA, 21 bp, Artificial Sequence
  Synthetic
cagacacgcuggctcattuac

SEQ ID NO: 34657 - DNA, 27 bp, Artificial Sequence
  Synthetic
cataaggattuccactttctgtccuca

SEQ ID NO: 34658 - DNA, 28 bp, Artificial Sequence
  Synthetic
ccugtcctuagaaaaggaagaaaaucaa

SEQ ID NO: 34659 - DNA, 25 bp, Artificial Sequence
  Synthetic
ggtagtggttugaatctgacctuca

SEQ ID NO: 34660 - DNA, 26 bp, Artificial Sequence
  Synthetic
tcaatactcaucagagagaucagcca

SEQ ID NO: 34661 - DNA, 27 bp, Artificial Sequence
  Synthetic
ctcatctcctuaatttcccaggttuca

SEQ ID NO: 34662 - DNA, 24 bp, Artificial Sequence
  Synthetic
gcccctttcauccagaacatttut

SEQ ID NO: 34663 - DNA, 20 bp, Artificial Sequence
  Synthetic
caagggcucagacgacucag

SEQ ID NO: 34664 - DNA, 21 bp, Artificial Sequence
  Synthetic
caggaccacgagugtgatucc

SEQ ID NO: 34665 - DNA, 26 bp, Artificial Sequence
  Synthetic
gtcttcctccugaaaaacgtcaaauc

SEQ ID NO: 34666 - DNA, 27 bp, Artificial Sequence
  Synthetic
gcttcttcaaaugctcttgacatguat

SEQ ID NO: 34667 - DNA, 30 bp, Artificial Sequence
  Synthetic
caactcattctcautttgtagtgcaucaaa

SEQ ID NO: 34668 - DNA, 28 bp, Artificial Sequence
  Synthetic
agtgguggagaaagtagaataucgagat

SEQ ID NO: 34669 - DNA, 23 bp, Artificial Sequence
  Synthetic
ggattgggugggtatcaguaagc

SEQ ID NO: 34670 - DNA, 25 bp, Artificial Sequence
  Synthetic
gatgtagcugaagagagggacaaug

SEQ ID NO: 34671 - DNA, 30 bp, Artificial Sequence
  Synthetic
caataacaatttgugcaggtataactggug

SEQ ID NO: 34672 - DNA, 21 bp, Artificial Sequence
  Synthetic
ggaacccacgucagtcctcua

SEQ ID NO: 34673 - DNA, 25 bp, Artificial Sequence
  Synthetic
agattgagaagugcaaagctccuac

SEQ ID NO: 34674 - DNA, 30 bp, Artificial Sequence
  Synthetic
gcttacacaguagattcttgtctagtuagg

SEQ ID NO: 34675 - DNA, 27 bp, Artificial Sequence
  Synthetic
aaatggctttguaagtggtcagauact

SEQ ID NO: 34676 - DNA, 23 bp, Artificial Sequence
  Synthetic
gaauaccccaguggaccagaaat

SEQ ID NO: 34677 - DNA, 28 bp, Artificial Sequence
  Synthetic
cagtgtcacauaaaaccaggctaattut

SEQ ID NO: 34678 - DNA, 17 bp, Artificial Sequence
  Synthetic
ggaggtgucctcgcuca

SEQ ID NO: 34679 - DNA, 20 bp, Artificial Sequence
  Synthetic
gcctcctccucgttctccuc

SEQ ID NO: 34680 - DNA, 22 bp, Artificial Sequence
  Synthetic
ggtucacggaggagaaauggag

SEQ ID NO: 34681 - DNA, 22 bp, Artificial Sequence
  Synthetic
tgtctccccugggtagtttugt

SEQ ID NO: 34682 - DNA, 28 bp, Artificial Sequence
  Synthetic
ccaagagaugcaaaccataaacttgtut

SEQ ID NO: 34683 - DNA, 28 bp, Artificial Sequence
  Synthetic
tcaaatgtcauggagataagugaaagct

SEQ ID NO: 34684 - DNA, 31 bp, Artificial Sequence
  Synthetic
ggtcctgttttacutcacaagatatggaaua

SEQ ID NO: 34685 - DNA, 22 bp, Artificial Sequence
  Synthetic
ctggccuggctctctacttuaa

SEQ ID NO: 34686 - DNA, 29 bp, Artificial Sequence
  Synthetic
gttattgaatggucacatcaaauccaaga

SEQ ID NO: 34687 - DNA, 28 bp, Artificial Sequence
  Synthetic
cagctcaggacacuttgctaatttaaut

SEQ ID NO: 34688 - DNA, 24 bp, Artificial Sequence
  Synthetic
ccatgttgtttuacgtggctcuct

SEQ ID NO: 34689 - DNA, 30 bp, Artificial Sequence
  Synthetic
acagatggtatgaaauaatggagcgatuaa

SEQ ID NO: 34690 - DNA, 27 bp, Artificial Sequence
  Synthetic
tgattcttugaaacagagacggtuaca

SEQ ID NO: 34691 - DNA, 28 bp, Artificial Sequence
  Synthetic
cttcccataaaguagcttgccaatttut

SEQ ID NO: 34692 - DNA, 25 bp, Artificial Sequence
  Synthetic
tgctcaatgtaguggaaaggtctut

SEQ ID NO: 34693 - DNA, 31 bp, Artificial Sequence
  Synthetic
ggtcataagtgcuctgtttaaaaagttuaca

SEQ ID NO: 34694 - DNA, 23 bp, Artificial Sequence
  Synthetic
gcgagugagagagagcuaaagua

SEQ ID NO: 34695 - DNA, 25 bp, Artificial Sequence
  Synthetic
aataattgucccaagccttctguca

SEQ ID NO: 34696 - DNA, 26 bp, Artificial Sequence
  Synthetic
actcatagtgcutaatgttgcctuca

SEQ ID NO: 34697 - DNA, 25 bp, Artificial Sequence
  Synthetic
gtgtccaaccutatccaccactuac

SEQ ID NO: 34698 - DNA, 32 bp, Artificial Sequence
  Synthetic
atacgtataaaccaguagaaaaaccttatucc

SEQ ID NO: 34699 - DNA, 28 bp, Artificial Sequence
  Synthetic
gaccatttauggcactgaattuaaccaa

SEQ ID NO: 34700 - DNA, 29 bp, Artificial Sequence
  Synthetic
gctaacatattuggcactttttgtttugg

SEQ ID NO: 34701 - DNA, 19 bp, Artificial Sequence
  Synthetic
gccatgucagccacgtugt

SEQ ID NO: 34702 - DNA, 21 bp, Artificial Sequence
  Synthetic
ggtgauccagcagaccaugag

SEQ ID NO: 34703 - DNA, 29 bp, Artificial Sequence
  Synthetic
agatttttgctctuctctgaactcaauga

SEQ ID NO: 34704 - DNA, 27 bp, Artificial Sequence
  Synthetic
tccctctctggauacctggaaaattua

SEQ ID NO: 34705 - DNA, 27 bp, Artificial Sequence
  Synthetic
cctctctgtcuagggaaggttuaaaca

SEQ ID NO: 34706 - DNA, 26 bp, Artificial Sequence
  Synthetic
actctcccttugaagaattacctugg

SEQ ID NO: 34707 - DNA, 25 bp, Artificial Sequence
  Synthetic
gtctccagggugtttctgaaatcua

SEQ ID NO: 34708 - DNA, 28 bp, Artificial Sequence
  Synthetic
gcaaggaaaacccutagcatttaatgua

SEQ ID NO: 34709 - DNA, 23 bp, Artificial Sequence
  Synthetic
aaaggcttcaugtccacctugaa

SEQ ID NO: 34710 - DNA, 32 bp, Artificial Sequence
  Synthetic
aagattcaatcagaagucttatactgcuaaat

SEQ ID NO: 34711 - DNA, 24 bp, Artificial Sequence
  Synthetic
tgcaccaugatgtcaacuaaacca

SEQ ID NO: 34712 - DNA, 26 bp, Artificial Sequence
  Synthetic
tgaagtaattucgcatttgtgcctut

SEQ ID NO: 34713 - DNA, 28 bp, Artificial Sequence
  Synthetic
acaaaaacttgguaactagcttacguca

SEQ ID NO: 34714 - DNA, 27 bp, Artificial Sequence
  Synthetic
gttcagagagagautcagacactaugc

SEQ ID NO: 34715 - DNA, 27 bp, Artificial Sequence
  Synthetic
gcaaaacaaagacaaaaugtggcagua

SEQ ID NO: 34716 - DNA, 26 bp, Artificial Sequence
  Synthetic
gaagaagaaaugttgcagaugcaaga

SEQ ID NO: 34717 - DNA, 30 bp, Artificial Sequence
  Synthetic
tccacaaactgcauatgtaaaagaacuact

SEQ ID NO: 34718 - DNA, 28 bp, Artificial Sequence
  Synthetic
ccaggagtugggaaatatatgucaaagg

SEQ ID NO: 34719 - DNA, 22 bp, Artificial Sequence
  Synthetic
gtaactctgugatggcccucag

SEQ ID NO: 34720 - DNA, 26 bp, Artificial Sequence
  Synthetic
aggcaaaaggaaccgutcatataugt

SEQ ID NO: 34721 - DNA, 28 bp, Artificial Sequence
  Synthetic
aaaattagccaaguagaaaugacccagt

SEQ ID NO: 34722 - DNA, 26 bp, Artificial Sequence
  Synthetic
cagagtagatauagtgcctcccucat

SEQ ID NO: 34723 - DNA, 31 bp, Artificial Sequence
  Synthetic
tgaagatgaccaaguctgctatgtttaatut

SEQ ID NO: 34724 - DNA, 21 bp, Artificial Sequence
  Synthetic
tctaatauccacggccccgua

SEQ ID NO: 34725 - DNA, 29 bp, Artificial Sequence
  Synthetic
ggttgcaccuccataacacagtatuaaat

SEQ ID NO: 34726 - DNA, 28 bp, Artificial Sequence
  Synthetic
cataacgttucatgacttcatauggcat

SEQ ID NO: 34727 - DNA, 22 bp, Artificial Sequence
  Synthetic
ctgtacatuccaactgcccugt

SEQ ID NO: 34728 - DNA, 22 bp, Artificial Sequence
  Synthetic
ccttagagccaguaggaggaug

SEQ ID NO: 34729 - DNA, 27 bp, Artificial Sequence
  Synthetic
aatcaaaaatccacagutccctaggut

SEQ ID NO: 34730 - DNA, 31 bp, Artificial Sequence
  Synthetic
gctcttaaattctguatttgtaacccttcuc

SEQ ID NO: 34731 - DNA, 20 bp, Artificial Sequence
  Synthetic
agtttugccaccacgtcuct

SEQ ID NO: 34732 - DNA, 21 bp, Artificial Sequence
  Synthetic
ccagtgtccugcgtatgauga

SEQ ID NO: 34733 - DNA, 29 bp, Artificial Sequence
  Synthetic
ctatctggacggaaacuttgaattgtuac

SEQ ID NO: 34734 - DNA, 27 bp, Artificial Sequence
  Synthetic
gcgtaaaaaccccutctgttaaatuct

SEQ ID NO: 34735 - DNA, 20 bp, Artificial Sequence
  Synthetic
gatagccugcatgccacuca

SEQ ID NO: 34736 - DNA, 28 bp, Artificial Sequence
  Synthetic
tcagcaatttguacttatcaccttguca

SEQ ID NO: 34737 - DNA, 28 bp, Artificial Sequence
  Synthetic
caagaaaacguaacaaatgatcccucac

SEQ ID NO: 34738 - DNA, 26 bp, Artificial Sequence
  Synthetic
ggtgtttgtuagaccttgtatuggct

SEQ ID NO: 34739 - DNA, 23 bp, Artificial Sequence
  Synthetic
catctgtucaaagtgcagctucc

SEQ ID NO: 34740 - DNA, 23 bp, Artificial Sequence
  Synthetic
ggcutgggtguaaggaaagaaga

SEQ ID NO: 34741 - DNA, 27 bp, Artificial Sequence
  Synthetic
gacaacaaatgtuctttccatagcugt

SEQ ID NO: 34742 - DNA, 23 bp, Artificial Sequence
  Synthetic
gaaacagaagccgguttggaaug

SEQ ID NO: 34743 - DNA, 24 bp, Artificial Sequence
  Synthetic
gcttgtacugaaaaacggcttuct

SEQ ID NO: 34744 - DNA, 24 bp, Artificial Sequence
  Synthetic
acacagcctgugatacttctggua

SEQ ID NO: 34745 - DNA, 26 bp, Artificial Sequence
  Synthetic
cgctcctuaagtgatgtatcucaaac

SEQ ID NO: 34746 - DNA, 24 bp, Artificial Sequence
  Synthetic
tctgctttucaagcctagtgtuca

SEQ ID NO: 34747 - DNA, 25 bp, Artificial Sequence
  Synthetic
tuaaatggcguaaccgaagacaaac

SEQ ID NO: 34748 - DNA, 24 bp, Artificial Sequence
  Synthetic
cttgctgacucctgaaaatguacc

SEQ ID NO: 34749 - DNA, 22 bp, Artificial Sequence
  Synthetic
gttttaaccuccccaugaccct

SEQ ID NO: 34750 - DNA, 23 bp, Artificial Sequence
  Synthetic
gtgguggcagaaagagaugaaag

SEQ ID NO: 34751 - DNA, 30 bp, Artificial Sequence
  Synthetic
ctaatacaattgctaugttccacacaccua

SEQ ID NO: 34752 - DNA, 30 bp, Artificial Sequence
  Synthetic
aaggaaaacctcuaatgctagtaggaaaug

SEQ ID NO: 34753 - DNA, 28 bp, Artificial Sequence
  Synthetic
ccttgatgatttutgatcccttgttuct

SEQ ID NO: 34754 - DNA, 28 bp, Artificial Sequence
  Synthetic
ggtcataactatggucctggaggaaaua

SEQ ID NO: 34755 - DNA, 29 bp, Artificial Sequence
  Synthetic
gatttugggagagagtaaacuacagagac

SEQ ID NO: 34756 - DNA, 22 bp, Artificial Sequence
  Synthetic
cctggauacagggaggagugaa

SEQ ID NO: 34757 - DNA, 26 bp, Artificial Sequence
  Synthetic
tgctgttggaaauggaagcuaaagat

SEQ ID NO: 34758 - DNA, 28 bp, Artificial Sequence
  Synthetic
gcctctgaautaaaggtatttuccccat

SEQ ID NO: 34759 - DNA, 25 bp, Artificial Sequence
  Synthetic
tgacctctgacautcatacgctuac

SEQ ID NO: 34760 - DNA, 23 bp, Artificial Sequence
  Synthetic
ccctcattuattgccacttugct

SEQ ID NO: 34761 - DNA, 27 bp, Artificial Sequence
  Synthetic
gaaaagcatcgugactagttaacucac

SEQ ID NO: 34762 - DNA, 21 bp, Artificial Sequence
  Synthetic
caacgccgcaucagcatttua

SEQ ID NO: 34763 - DNA, 29 bp, Artificial Sequence
  Synthetic
ggaagatcttucaagaaatgtgttggtut

SEQ ID NO: 34764 - DNA, 29 bp, Artificial Sequence
  Synthetic
gcgatgaagatguggacaagataattuct

SEQ ID NO: 34765 - DNA, 28 bp, Artificial Sequence
  Synthetic
gcaatagcaggutttaactaacaugcaa

SEQ ID NO: 34766 - DNA, 29 bp, Artificial Sequence
  Synthetic
ttgagaggattucacatgaactgtaaugt

SEQ ID NO: 34767 - DNA, 28 bp, Artificial Sequence
  Synthetic
gcttcttctucaacaggttctuaaacag

SEQ ID NO: 34768 - DNA, 23 bp, Artificial Sequence
  Synthetic
atttgttgugaacaaggccagug

SEQ ID NO: 34769 - DNA, 26 bp, Artificial Sequence
  Synthetic
gctccgcacuctaaatgttggaatua

SEQ ID NO: 34770 - DNA, 22 bp, Artificial Sequence
  Synthetic
tccagactuccgctaatccugt

SEQ ID NO: 34771 - DNA, 22 bp, Artificial Sequence
  Synthetic
aggautttcatctugccaggct

SEQ ID NO: 34772 - DNA, 30 bp, Artificial Sequence
  Synthetic
gcaagcautaattaactaugacaaagagca

SEQ ID NO: 34773 - DNA, 25 bp, Artificial Sequence
  Synthetic
ccctttguggagaacatctguaaac

SEQ ID NO: 34774 - DNA, 27 bp, Artificial Sequence
  Synthetic
ggtttgtccauttaccttacaguaaca

SEQ ID NO: 34775 - DNA, 23 bp, Artificial Sequence
  Synthetic
ttctugacaccggactttcucag

SEQ ID NO: 34776 - DNA, 21 bp, Artificial Sequence
  Synthetic
tggaaggacguaaacctugcc

SEQ ID NO: 34777 - DNA, 25 bp, Artificial Sequence
  Synthetic
aagaacatcuccacagagtgtctuc

SEQ ID NO: 34778 - DNA, 25 bp, Artificial Sequence
  Synthetic
acctagggtuactttctcatgacut

SEQ ID NO: 34779 - DNA, 21 bp, Artificial Sequence
  Synthetic
gttatuccaggcggcaatugt

SEQ ID NO: 34780 - DNA, 28 bp, Artificial Sequence
  Synthetic
ccactgaatttuaaggtttttgaaugcc

SEQ ID NO: 34781 - DNA, 25 bp, Artificial Sequence
  Synthetic
gctgctgcugaaaatcattuagcaa

SEQ ID NO: 34782 - DNA, 31 bp, Artificial Sequence
  Synthetic
atgtgaatttaacaagaacuttcgccttauc

SEQ ID NO: 34783 - DNA, 25 bp, Artificial Sequence
  Synthetic
actaagtgtuggtggtgacguaaac

SEQ ID NO: 34784 - DNA, 22 bp, Artificial Sequence
  Synthetic
agggaagcuttctggaugacac

SEQ ID NO: 34785 - DNA, 28 bp, Artificial Sequence
  Synthetic
gtcctcttagaggaautaccaagtcuga

SEQ ID NO: 34786 - DNA, 29 bp, Artificial Sequence
  Synthetic
ggtgatugaagccaaagaaaaugaaagaa

SEQ ID NO: 34787 - DNA, 28 bp, Artificial Sequence
  Synthetic
ccaatgtuccagaaacaaattgaacucc

SEQ ID NO: 34788 - DNA, 21 bp, Artificial Sequence
  Synthetic
catgcagggacgcauctcuat

SEQ ID NO: 34789 - DNA, 21 bp, Artificial Sequence
  Synthetic
agaggcatcugcctttggtuc

SEQ ID NO: 34790 - DNA, 28 bp, Artificial Sequence
  Synthetic
agatagacccucttgaattggattucct

SEQ ID NO: 34791 - DNA, 29 bp, Artificial Sequence
  Synthetic
tttacatttcaacacuggagagagcuaat

SEQ ID NO: 34792 - DNA, 31 bp, Artificial Sequence
  Synthetic
gtgtucagaaaaagaaaaautaccucaagaa

SEQ ID NO: 34793 - DNA, 27 bp, Artificial Sequence
  Synthetic
cagatcctccuaactcttcagacuaca

SEQ ID NO: 34794 - DNA, 22 bp, Artificial Sequence
  Synthetic
gugcgaagtatguggagaggac

SEQ ID NO: 34795 - DNA, 29 bp, Artificial Sequence
  Synthetic
aaaagaaactaagaucactgtgaacugaa

SEQ ID NO: 34796 - DNA, 25 bp, Artificial Sequence
  Synthetic
agtaataugcctcacctucacagga

SEQ ID NO: 34797 - DNA, 22 bp, Artificial Sequence
  Synthetic
tcatctggugtaggugcagact

SEQ ID NO: 34798 - DNA, 23 bp, Artificial Sequence
  Synthetic
gacccttgcucttggaaaccaua

SEQ ID NO: 34799 - DNA, 22 bp, Artificial Sequence
  Synthetic
aaaaggauagcttcggcuccag

SEQ ID NO: 34800 - DNA, 20 bp, Artificial Sequence
  Synthetic
cgtgctacuggttggcuact

SEQ ID NO: 34801 - DNA, 29 bp, Artificial Sequence
  Synthetic
ttcaugaattcttctaaauacacccgaca

SEQ ID NO: 34802 - DNA, 23 bp, Artificial Sequence
  Synthetic
cctccacccaaaugctgaaauag

SEQ ID NO: 34803 - DNA, 30 bp, Artificial Sequence
  Synthetic
cctagguaaaaacttattgattugcacaat

SEQ ID NO: 34804 - DNA, 26 bp, Artificial Sequence
  Synthetic
gcttccaagaaugtgagaggaugaat

SEQ ID NO: 34805 - DNA, 22 bp, Artificial Sequence
  Synthetic
gataatgccaautccccctugc

SEQ ID NO: 34806 - DNA, 24 bp, Artificial Sequence
  Synthetic
aacagcaaguttttcttccuccct

SEQ ID NO: 34807 - DNA, 22 bp, Artificial Sequence
  Synthetic
gtaaacaaagcagggcutcugg

SEQ ID NO: 34808 - DNA, 28 bp, Artificial Sequence
  Synthetic
aaccagaatgtugaatgtttattgcauc

SEQ ID NO: 34809 - DNA, 24 bp, Artificial Sequence
  Synthetic
ctgtttggtutcttgtctguccac

SEQ ID NO: 34810 - DNA, 19 bp, Artificial Sequence
  Synthetic
gctggaguggctctgctuc

SEQ ID NO: 34811 - DNA, 18 bp, Artificial Sequence
  Synthetic
acagucgtgugccaccac

SEQ ID NO: 34812 - DNA, 17 bp, Artificial Sequence
  Synthetic
ggcgugaaccgagcuga

SEQ ID NO: 34813 - DNA, 17 bp, Artificial Sequence
  Synthetic
gtcguccgtcacuccca

SEQ ID NO: 34814 - DNA, 23 bp, Artificial Sequence
  Synthetic
gtattgccaagcuaggctaguga

SEQ ID NO: 34815 - DNA, 31 bp, Artificial Sequence
  Synthetic
ggcatgttttaccutaagatacttacttgug

SEQ ID NO: 34816 - DNA, 25 bp, Artificial Sequence
  Synthetic
gggctatuaggatacatuccacagt

SEQ ID NO: 34817 - DNA, 28 bp, Artificial Sequence
  Synthetic
aatcaacacacatuttcttcacaggtuc

SEQ ID NO: 34818 - DNA, 28 bp, Artificial Sequence
  Synthetic
actcaactaattutcctgaagtcaugct

SEQ ID NO: 34819 - DNA, 31 bp, Artificial Sequence
  Synthetic
gttttgtaaactucagtaaagtgctgaugaa

SEQ ID NO: 34820 - DNA, 23 bp, Artificial Sequence
  Synthetic
ctccttatgaggutctctcccut

SEQ ID NO: 34821 - DNA, 28 bp, Artificial Sequence
  Synthetic
cctgacttuagcaaggatatcaaccaua

SEQ ID NO: 34822 - DNA, 22 bp, Artificial Sequence
  Synthetic
ctgaagttcutgaagcgtugcc

SEQ ID NO: 34823 - DNA, 29 bp, Artificial Sequence
  Synthetic
agugattucaaagacaauaacaaaaacca

SEQ ID NO: 34824 - DNA, 24 bp, Artificial Sequence
  Synthetic
catgcgtgttutgggacaatguag

SEQ ID NO: 34825 - DNA, 30 bp, Artificial Sequence
  Synthetic
ccccaaaccaaaauacttaagaagtcctua

SEQ ID NO: 34826 - DNA, 23 bp, Artificial Sequence
  Synthetic
gtggaagccaauggcctaatcua

SEQ ID NO: 34827 - DNA, 28 bp, Artificial Sequence
  Synthetic
gtcttttgacatcucctacagagctuat

SEQ ID NO: 34828 - DNA, 30 bp, Artificial Sequence
  Synthetic
ttgttcatgtttuattcttttgaagguggt

SEQ ID NO: 34829 - DNA, 27 bp, Artificial Sequence
  Synthetic
caacccatttguctgtttcggtatuat

SEQ ID NO: 34830 - DNA, 26 bp, Artificial Sequence
  Synthetic
gcaaatgaagagacccutgaaacaug

SEQ ID NO: 34831 - DNA, 21 bp, Artificial Sequence
  Synthetic
tcttggttttguggccagcua

SEQ ID NO: 34832 - DNA, 25 bp, Artificial Sequence
  Synthetic
tttgcaaatuggttgtgacugagat

SEQ ID NO: 34833 - DNA, 27 bp, Artificial Sequence
  Synthetic
agaactctcaauctgccaacatctuac

SEQ ID NO: 34834 - DNA, 29 bp, Artificial Sequence
  Synthetic
tttttaaaccctaugcagacacatugaac

SEQ ID NO: 34835 - DNA, 23 bp, Artificial Sequence
  Synthetic
acagttccatugctgctggauac

SEQ ID NO: 34836 - DNA, 27 bp, Artificial Sequence
  Synthetic
agagaguaggtttctatcucaggcaaa

SEQ ID NO: 34837 - DNA, 23 bp, Artificial Sequence
  Synthetic
auctttagctgugagaccagcac

SEQ ID NO: 34838 - DNA, 30 bp, Artificial Sequence
  Synthetic
tgggaagattcauatgagaattgattgugt

SEQ ID NO: 34839 - DNA, 22 bp, Artificial Sequence
  Synthetic
agacgacaauggtgagcaaucc

SEQ ID NO: 34840 - DNA, 30 bp, Artificial Sequence
  Synthetic
gttagaaagtucagcattatttggtugaca

SEQ ID NO: 34841 - DNA, 25 bp, Artificial Sequence
  Synthetic
agtacuaagaggaacaccacacuca

SEQ ID NO: 34842 - DNA, 29 bp, Artificial Sequence
  Synthetic
cttaatgtactucctgaaatacucagcga

SEQ ID NO: 34843 - DNA, 28 bp, Artificial Sequence
  Synthetic
ctgagatggataucataaggctgttgut

SEQ ID NO: 34844 - DNA, 30 bp, Artificial Sequence
  Synthetic
tttaacaatcatcacauggaaaaccatucc

SEQ ID NO: 34845 - DNA, 28 bp, Artificial Sequence
  Synthetic
ggcaggaagcauataagaaccaaatcut

SEQ ID NO: 34846 - DNA, 21 bp, Artificial Sequence
  Synthetic
acaccagaaugatgggctcut

SEQ ID NO: 34847 - DNA, 27 bp, Artificial Sequence
  Synthetic
cagcaaatgtcucacaaaggtactuac

SEQ ID NO: 34848 - DNA, 23 bp, Artificial Sequence
  Synthetic
gccttuccagataacagtugcca

SEQ ID NO: 34849 - DNA, 28 bp, Artificial Sequence
  Synthetic
ctgctctcaucagggaaaggaaataaut

SEQ ID NO: 34850 - DNA, 27 bp, Artificial Sequence
  Synthetic
gcttttgagccugatgaggatatugaa

SEQ ID NO: 34851 - DNA, 31 bp, Artificial Sequence
  Synthetic
tccaaaugtataatucagaaaaccagaacct

SEQ ID NO: 34852 - DNA, 27 bp, Artificial Sequence
  Synthetic
tcctaggaacuaacaaaacattgtguc

SEQ ID NO: 34853 - DNA, 25 bp, Artificial Sequence
  Synthetic
aaccttgacccucttgagattucac

SEQ ID NO: 34854 - DNA, 28 bp, Artificial Sequence
  Synthetic
tgggttgaugctattctatttcuaccct

SEQ ID NO: 34855 - DNA, 28 bp, Artificial Sequence
  Synthetic
atgttccctgacagutcttaatcagaua

SEQ ID NO: 34856 - DNA, 22 bp, Artificial Sequence
  Synthetic
gctatgcguacacttgcaucct

SEQ ID NO: 34857 - DNA, 27 bp, Artificial Sequence
  Synthetic
cgtctgaataautctagccatttugcc

SEQ ID NO: 34858 - DNA, 22 bp, Artificial Sequence
  Synthetic
tggagaacccguagtgcaaauc

SEQ ID NO: 34859 - DNA, 21 bp, Artificial Sequence
  Synthetic
gtccacacacccacucttgut

SEQ ID NO: 34860 - DNA, 22 bp, Artificial Sequence
  Synthetic
atggaccuaggaggaagguagg

SEQ ID NO: 34861 - DNA, 23 bp, Artificial Sequence
  Synthetic
ccaggacaaaggauccatucaga

SEQ ID NO: 34862 - DNA, 20 bp, Artificial Sequence
  Synthetic
ctgaagggutgtgggcugat

SEQ ID NO: 34863 - DNA, 23 bp, Artificial Sequence
  Synthetic
cactaatcccutgcccactguag

SEQ ID NO: 34864 - DNA, 22 bp, Artificial Sequence
  Synthetic
gccuggcagagagagtactuga

SEQ ID NO: 34865 - DNA, 23 bp, Artificial Sequence
  Synthetic
gcatcccaucctcacattgtucc

SEQ ID NO: 34866 - DNA, 22 bp, Artificial Sequence
  Synthetic
aggtgaaccugggtcctcauaa

SEQ ID NO: 34867 - DNA, 23 bp, Artificial Sequence
  Synthetic
agaagaaccgagacuaccctcug

SEQ ID NO: 34868 - DNA, 22 bp, Artificial Sequence
  Synthetic
agtctggtugctgggauaacct

SEQ ID NO: 34869 - DNA, 21 bp, Artificial Sequence
  Synthetic
ccaaccugcaggcaaatgtuc

SEQ ID NO: 34870 - DNA, 24 bp, Artificial Sequence
  Synthetic
tctcagcaagaaagucgatgtcuc

SEQ ID NO: 34871 - DNA, 22 bp, Artificial Sequence
  Synthetic
cctggctttcutccagccttut

SEQ ID NO: 34872 - DNA, 21 bp, Artificial Sequence
  Synthetic
ccaccatggucagttcctgug

SEQ ID NO: 34873 - DNA, 25 bp, Artificial Sequence
  Synthetic
tgataaactcttuacgtgggctgug

SEQ ID NO: 34874 - DNA, 17 bp, Artificial Sequence
  Synthetic
tggaugcgcgcaccuag

SEQ ID NO: 34875 - DNA, 17 bp, Artificial Sequence
  Synthetic
cggcgucagcaguagca

SEQ ID NO: 34876 - DNA, 29 bp, Artificial Sequence
  Synthetic
ctgaagatagttcuaggaggaaacagcua

SEQ ID NO: 34877 - DNA, 28 bp, Artificial Sequence
  Synthetic
acaggtcguaaaaaccttccctaaaauc

SEQ ID NO: 34878 - DNA, 17 bp, Artificial Sequence
  Synthetic
agtgaguggccccucca

SEQ ID NO: 34879 - DNA, 18 bp, Artificial Sequence
  Synthetic
cccagucgacucccggat

SEQ ID NO: 34880 - DNA, 22 bp, Artificial Sequence
  Synthetic
gaatatggagcaaucccgguca

SEQ ID NO: 34881 - DNA, 23 bp, Artificial Sequence
  Synthetic
ccctctccccutagagcacttua

SEQ ID NO: 34882 - DNA, 27 bp, Artificial Sequence
  Synthetic
tctctctctctcuctctctgtctcuac

SEQ ID NO: 34883 - DNA, 18 bp, Artificial Sequence
  Synthetic
gagccaucagcaguccca

SEQ ID NO: 34884 - DNA, 21 bp, Artificial Sequence
  Synthetic
gctcagccaugttctgccuaa

SEQ ID NO: 34885 - DNA, 21 bp, Artificial Sequence
  Synthetic
gagtctgguggcaagttcuca

SEQ ID NO: 34886 - DNA, 22 bp, Artificial Sequence
  Synthetic
cacagugcctggaguaaggaat

SEQ ID NO: 34887 - DNA, 24 bp, Artificial Sequence
  Synthetic
agctcatttcacugtctcaaccut

SEQ ID NO: 34888 - DNA, 20 bp, Artificial Sequence
  Synthetic
cccccaaccacacutctgug

SEQ ID NO: 34889 - DNA, 24 bp, Artificial Sequence
  Synthetic
caccccatucccagcttttctaut

SEQ ID NO: 34890 - DNA, 26 bp, Artificial Sequence
  Synthetic
ctgcagtagtuatgtccaagagauga

SEQ ID NO: 34891 - DNA, 28 bp, Artificial Sequence
  Synthetic
actctuggagaaaucagaaagtaaaugg

SEQ ID NO: 34892 - DNA, 21 bp, Artificial Sequence
  Synthetic
ctggagaauccacccuttcug

SEQ ID NO: 34893 - DNA, 23 bp, Artificial Sequence
  Synthetic
gatggaggttuagggtgttgcua

SEQ ID NO: 34894 - DNA, 27 bp, Artificial Sequence
  Synthetic
tttgttcttaaugcccaaggagagaut

SEQ ID NO: 34895 - DNA, 23 bp, Artificial Sequence
  Synthetic
cagggaagugggaatgtttcuca

SEQ ID NO: 34896 - DNA, 22 bp, Artificial Sequence
  Synthetic
acagctgugatttgctucgaat

SEQ ID NO: 34897 - DNA, 27 bp, Artificial Sequence
  Synthetic
cagatctgaacuaattccgtctagugc

SEQ ID NO: 34898 - DNA, 21 bp, Artificial Sequence
  Synthetic
gcctctccugttccttcucag

SEQ ID NO: 34899 - DNA, 18 bp, Artificial Sequence
  Synthetic
gcgcctucccgtcguaag

SEQ ID NO: 34900 - DNA, 22 bp, Artificial Sequence
  Synthetic
gctcccaggcugagacttctua

SEQ ID NO: 34901 - DNA, 23 bp, Artificial Sequence
  Synthetic
aggucctagugaccagagagaac

SEQ ID NO: 34902 - DNA, 22 bp, Artificial Sequence
  Synthetic
cagggagggauggctattgtut

SEQ ID NO: 34903 - DNA, 23 bp, Artificial Sequence
  Synthetic
tgauagaacaauccaccccaggt

SEQ ID NO: 34904 - DNA, 22 bp, Artificial Sequence
  Synthetic
tgcacaaggugagtctttugct

SEQ ID NO: 34905 - DNA, 25 bp, Artificial Sequence
  Synthetic
ctcaaatgggacacaucgtgatuac

SEQ ID NO: 34906 - DNA, 20 bp, Artificial Sequence
  Synthetic
agctuccggaacacgactuc

SEQ ID NO: 34907 - DNA, 19 bp, Artificial Sequence
  Synthetic
ggactcuccaccagcucca

SEQ ID NO: 34908 - DNA, 21 bp, Artificial Sequence
  Synthetic
agaaggacaggugtgagctug

SEQ ID NO: 34909 - DNA, 24 bp, Artificial Sequence
  Synthetic
gggacatuacaggaggccaaauag

SEQ ID NO: 34910 - DNA, 19 bp, Artificial Sequence
  Synthetic
ggaggcutggguagcacac

SEQ ID NO: 34911 - DNA, 21 bp, Artificial Sequence
  Synthetic
ttgagccucactgtccatguc

SEQ ID NO: 34912 - DNA, 17 bp, Artificial Sequence
  Synthetic
ctcacgccccacuccuc

SEQ ID NO: 34913 - DNA, 18 bp, Artificial Sequence
  Synthetic
accccuggcctcuggaaa

SEQ ID NO: 34914 - DNA, 22 bp, Artificial Sequence
  Synthetic
gcgacaaacacucacctctgua

SEQ ID NO: 34915 - DNA, 28 bp, Artificial Sequence
  Synthetic
tctaactgttctutctctattgccaugc

SEQ ID NO: 34916 - DNA, 19 bp, Artificial Sequence
  Synthetic
gctggcccutggtgacaua

SEQ ID NO: 34917 - DNA, 19 bp, Artificial Sequence
  Synthetic
gcuggaagcaggtgtugct

SEQ ID NO: 34918 - DNA, 18 bp, Artificial Sequence
  Synthetic
ctgagccacugggtcugt

SEQ ID NO: 34919 - DNA, 17 bp, Artificial Sequence
  Synthetic
tgcugtggcugcaggag

SEQ ID NO: 34920 - DNA, 18 bp, Artificial Sequence
  Synthetic
ctggtccccuggctccua

SEQ ID NO: 34921 - DNA, 21 bp, Artificial Sequence
  Synthetic
ccaccatcutcctcccugaca

SEQ ID NO: 34922 - DNA, 19 bp, Artificial Sequence
  Synthetic
acgauacccaaccggugac

SEQ ID NO: 34923 - DNA, 22 bp, Artificial Sequence
  Synthetic
gtctacacucaccaccaaccuc

SEQ ID NO: 34924 - DNA, 17 bp, Artificial Sequence
  Synthetic
ccccagccccuctccua

SEQ ID NO: 34925 - DNA, 20 bp, Artificial Sequence
  Synthetic
gttctcuccgtggucagcag

SEQ ID NO: 34926 - DNA, 20 bp, Artificial Sequence
  Synthetic
aaaccacugagcaggtgcut

SEQ ID NO: 34927 - DNA, 18 bp, Artificial Sequence
  Synthetic
cucagcaagugcggaggt

SEQ ID NO: 34928 - DNA, 22 bp, Artificial Sequence
  Synthetic
gtggtccacucataaagccuac

SEQ ID NO: 34929 - DNA, 21 bp, Artificial Sequence
  Synthetic
ctttuccaggcacugcagaac

SEQ ID NO: 34930 - DNA, 21 bp, Artificial Sequence
  Synthetic
cattcaaacugctccgagugc

SEQ ID NO: 34931 - DNA, 22 bp, Artificial Sequence
  Synthetic
atccuacccacccacuaaaggt

SEQ ID NO: 34932 - DNA, 23 bp, Artificial Sequence
  Synthetic
cgtugccaagagtaugaacaagg

SEQ ID NO: 34933 - DNA, 24 bp, Artificial Sequence
  Synthetic
ggttgtttggcutaaactctggug

SEQ ID NO: 34934 - DNA, 24 bp, Artificial Sequence
  Synthetic
gctgcctuctcttttcaucacagt

SEQ ID NO: 34935 - DNA, 21 bp, Artificial Sequence
  Synthetic
cttgccacccuacctagtguc

SEQ ID NO: 34936 - DNA, 21 bp, Artificial Sequence
  Synthetic
ccacagggucactctugagat

SEQ ID NO: 34937 - DNA, 17 bp, Artificial Sequence
  Synthetic
gcttcccccuggctucc

SEQ ID NO: 34938 - DNA, 20 bp, Artificial Sequence
  Synthetic
gtctcacgaugccgttcuct

SEQ ID NO: 34939 - DNA, 22 bp, Artificial Sequence
  Synthetic
tgtaaggtgcutgggacatgug

SEQ ID NO: 34940 - DNA, 18 bp, Artificial Sequence
  Synthetic
cgtgtggguggcagucag

SEQ ID NO: 34941 - DNA, 19 bp, Artificial Sequence
  Synthetic
cttcctcucgcccaucaca

SEQ ID NO: 34942 - DNA, 20 bp, Artificial Sequence
  Synthetic
ccgacatcucctcgggctua

SEQ ID NO: 34943 - DNA, 21 bp, Artificial Sequence
  Synthetic
ctctaacacccugtggctcuc

SEQ ID NO: 34944 - DNA, 22 bp, Artificial Sequence
  Synthetic
ccactcctugcttctcagauga

SEQ ID NO: 34945 - DNA, 21 bp, Artificial Sequence
  Synthetic
cagtgcauacaccgagaccug

SEQ ID NO: 34946 - DNA, 23 bp, Artificial Sequence
  Synthetic
acgccaccacaagaugataaguc

SEQ ID NO: 34947 - DNA, 22 bp, Artificial Sequence
  Synthetic
ggctggaauactgcuacaaccc

SEQ ID NO: 34948 - DNA, 22 bp, Artificial Sequence
  Synthetic
ggactgauaccccagcucagat

SEQ ID NO: 34949 - DNA, 30 bp, Artificial Sequence
  Synthetic
caagtaaatgagtcucaacgtgttcttuaa

SEQ ID NO: 34950 - DNA, 23 bp, Artificial Sequence
  Synthetic
agaauagcaagcaaggaaugcct

SEQ ID NO: 34951 - DNA, 20 bp, Artificial Sequence
  Synthetic
gctctagggugaccccacuc

SEQ ID NO: 34952 - DNA, 23 bp, Artificial Sequence
  Synthetic
ggctgtggaagucactcttctug

SEQ ID NO: 34953 - DNA, 21 bp, Artificial Sequence
  Synthetic
ctaacacccugttcgcacuga

SEQ ID NO: 34954 - DNA, 25 bp, Artificial Sequence
  Synthetic
tggcatttgtutttccaactctucg

SEQ ID NO: 34955 - DNA, 19 bp, Artificial Sequence
  Synthetic
tgggtggugctggtctgua

SEQ ID NO: 34956 - DNA, 23 bp, Artificial Sequence
  Synthetic
atccctacugagatggagtgugt

SEQ ID NO: 34957 - DNA, 21 bp, Artificial Sequence
  Synthetic
gcacaucgaggtgaaugggag

SEQ ID NO: 34958 - DNA, 22 bp, Artificial Sequence
  Synthetic
cctggctctucccactaaacuc

SEQ ID NO: 34959 - DNA, 24 bp, Artificial Sequence
  Synthetic
tctggacccucaatgtatccctut

SEQ ID NO: 34960 - DNA, 23 bp, Artificial Sequence
  Synthetic
cctcutaaacccaaugcccagac

SEQ ID NO: 34961 - DNA, 22 bp, Artificial Sequence
  Synthetic
aactgcacuagccttggugaaa

SEQ ID NO: 34962 - DNA, 21 bp, Artificial Sequence
  Synthetic
gttgatgctcugcacatcguc

SEQ ID NO: 34963 - DNA, 23 bp, Artificial Sequence
  Synthetic
agcgtaatuccctttgtctcucc

SEQ ID NO: 34964 - DNA, 19 bp, Artificial Sequence
  Synthetic
cctagcggugcagagtgug

SEQ ID NO: 34965 - DNA, 21 bp, Artificial Sequence
  Synthetic
ctttccccucccctaccuaga

SEQ ID NO: 34966 - DNA, 26 bp, Artificial Sequence
  Synthetic
gatacccctuctactggttttuccat

SEQ ID NO: 34967 - DNA, 24 bp, Artificial Sequence
  Synthetic
agttauccagcagagcaucaaagg

SEQ ID NO: 34968 - DNA, 22 bp, Artificial Sequence
  Synthetic
gcgagtccuacctatgtuccca

SEQ ID NO: 34969 - DNA, 21 bp, Artificial Sequence
  Synthetic
gacccucctgcucagaagaac

SEQ ID NO: 34970 - DNA, 23 bp, Artificial Sequence
  Synthetic
caagccuaggaggttgttgatut

SEQ ID NO: 34971 - DNA, 28 bp, Artificial Sequence
  Synthetic
atctaguaggaagcaaguattttuggat

SEQ ID NO: 34972 - DNA, 24 bp, Artificial Sequence
  Synthetic
tgctgcctcutcctttggatatut

SEQ ID NO: 34973 - DNA, 29 bp, Artificial Sequence
  Synthetic
gccaagtactttucaggaacaaaagaaua

SEQ ID NO: 34974 - DNA, 25 bp, Artificial Sequence
  Synthetic
ggcactaugacagttgagaugaaag

SEQ ID NO: 34975 - DNA, 26 bp, Artificial Sequence
  Synthetic
gagaatgaacaugctgcaagcttuaa

SEQ ID NO: 34976 - DNA, 23 bp, Artificial Sequence
  Synthetic
gctagtugggagaatgctacugt

SEQ ID NO: 34977 - DNA, 29 bp, Artificial Sequence
  Synthetic
ccctttcttcacuatatgaaaactgucca

SEQ ID NO: 34978 - DNA, 30 bp, Artificial Sequence
  Synthetic
gatcaaauggaggagtcatcatuagaaaga

SEQ ID NO: 34979 - DNA, 27 bp, Artificial Sequence
  Synthetic
tgataccagtuttgttgtccaauacca

SEQ ID NO: 34980 - DNA, 27 bp, Artificial Sequence
  Synthetic
caaaaatatttcugaggctccagctuc

SEQ ID NO: 34981 - DNA, 22 bp, Artificial Sequence
  Synthetic
gttgcaagcugtccatctugat

SEQ ID NO: 34982 - DNA, 28 bp, Artificial Sequence
  Synthetic
ggaagaccuccagaaaagtgatactgua

SEQ ID NO: 34983 - DNA, 30 bp, Artificial Sequence
  Synthetic
aacactttatctctutgaccgatttctcut

SEQ ID NO: 34984 - DNA, 31 bp, Artificial Sequence
  Synthetic
tgaaagcaagugctattttaaguaaacaaca

SEQ ID NO: 34985 - DNA, 27 bp, Artificial Sequence
  Synthetic
gctacaattuaccacactcgtttcaut

SEQ ID NO: 34986 - DNA, 28 bp, Artificial Sequence
  Synthetic
ccggttugacaggagataatutatguaa

SEQ ID NO: 34987 - DNA, 31 bp, Artificial Sequence
  Synthetic
cctgattttucagcagutatatgactttuag

SEQ ID NO: 34988 - DNA, 23 bp, Artificial Sequence
  Synthetic
ctcttaccagucctgatgctuca

SEQ ID NO: 34989 - DNA, 27 bp, Artificial Sequence
  Synthetic
agcatcaactugacagaagctatucat

SEQ ID NO: 34990 - DNA, 22 bp, Artificial Sequence
  Synthetic
caagccactutggactcaguga

SEQ ID NO: 34991 - DNA, 26 bp, Artificial Sequence
  Synthetic
gccttattuacagtgcacatcucaca

SEQ ID NO: 34992 - DNA, 28 bp, Artificial Sequence
  Synthetic
gatactgtgtttuctgataaggcttgug

SEQ ID NO: 34993 - DNA, 30 bp, Artificial Sequence
  Synthetic
attcagggtctgucaaaatatttagatcut

SEQ ID NO: 34994 - DNA, 31 bp, Artificial Sequence
  Synthetic
cctaagugaaaaagaaguagaacttgauaag

SEQ ID NO: 34995 - DNA, 27 bp, Artificial Sequence
  Synthetic
tttctttcacttgaugtcatgctgtug

SEQ ID NO: 34996 - DNA, 28 bp, Artificial Sequence
  Synthetic
caacaccaccauctttagatttttgcua

SEQ ID NO: 34997 - DNA, 26 bp, Artificial Sequence
  Synthetic
actggatgtttuatatggctgcucac

SEQ ID NO: 34998 - DNA, 22 bp, Artificial Sequence
  Synthetic
cgcaaatcucaggtttgtccut

SEQ ID NO: 34999 - DNA, 29 bp, Artificial Sequence
  Synthetic
gcactaacatcacacutatcttgtcttuc

SEQ ID NO: 35000 - DNA, 26 bp, Artificial Sequence
  Synthetic
tcacagacauagaggaaggagtacug

SEQ ID NO: 35001 - DNA, 23 bp, Artificial Sequence
  Synthetic
cagttccucgagttcugaagagg

SEQ ID NO: 35002 - DNA, 25 bp, Artificial Sequence
  Synthetic
tgaaacctgugccaaggaaagaaua

SEQ ID NO: 35003 - DNA, 29 bp, Artificial Sequence
  Synthetic
ccacaaagagcauacagtttauccaaaga

SEQ ID NO: 35004 - DNA, 30 bp, Artificial Sequence
  Synthetic
acacccauatttactucagacagacaaaaa

SEQ ID NO: 35005 - DNA, 26 bp, Artificial Sequence
  Synthetic
attaccutcttcctcuaaccccaaga

SEQ ID NO: 35006 - DNA, 28 bp, Artificial Sequence
  Synthetic
gggtaatguggattcaaauacacaagac

SEQ ID NO: 35007 - DNA, 26 bp, Artificial Sequence
  Synthetic
tttaaggagguctcaactuggcaaat

SEQ ID NO: 35008 - DNA, 28 bp, Artificial Sequence
  Synthetic
tcutgaaagcaguagagaacaagaagat

SEQ ID NO: 35009 - DNA, 26 bp, Artificial Sequence
  Synthetic
tgaaagucaaactggttauccaaggg

SEQ ID NO: 35010 - DNA, 22 bp, Artificial Sequence
  Synthetic
caccucagtgaagugaagcaca

SEQ ID NO: 35011 - DNA, 26 bp, Artificial Sequence
  Synthetic
gcatttgcugacccataggattuact

SEQ ID NO: 35012 - DNA, 27 bp, Artificial Sequence
  Synthetic
aaacaaagcugacacattttgaucact

SEQ ID NO: 35013 - DNA, 20 bp, Artificial Sequence
  Synthetic
cacaaaggautgcccaugcc

SEQ ID NO: 35014 - DNA, 22 bp, Artificial Sequence
  Synthetic
gcagcagaugggcagctataug

SEQ ID NO: 35015 - DNA, 20 bp, Artificial Sequence
  Synthetic
cgagugacgcaaggaaggug

SEQ ID NO: 35016 - DNA, 21 bp, Artificial Sequence
  Synthetic
gtuaggccgcaaaccctuaac

SEQ ID NO: 35017 - DNA, 23 bp, Artificial Sequence
  Synthetic
ccttgaccacugtttgaugggaa

SEQ ID NO: 35018 - DNA, 23 bp, Artificial Sequence
  Synthetic
catgtcacccaugaaagcaauga

SEQ ID NO: 35019 - DNA, 24 bp, Artificial Sequence
  Synthetic
gcctataaauggacgagactgcug

SEQ ID NO: 35020 - DNA, 22 bp, Artificial Sequence
  Synthetic
cgacugataccuggccaacaac

SEQ ID NO: 35021 - DNA, 21 bp, Artificial Sequence
  Synthetic
gtaggctcugtgtcccctuac

SEQ ID NO: 35022 - DNA, 23 bp, Artificial Sequence
  Synthetic
ccggatatgacucaggttagugg

SEQ ID NO: 35023 - DNA, 23 bp, Artificial Sequence
  Synthetic
ttttcttctugggacccauccag

SEQ ID NO: 35024 - DNA, 22 bp, Artificial Sequence
  Synthetic
cgaaagccccuaagatucccaa

SEQ ID NO: 35025 - DNA, 22 bp, Artificial Sequence
  Synthetic
cacccctcauttcataggcugt

SEQ ID NO: 35026 - DNA, 26 bp, Artificial Sequence
  Synthetic
gctcggccacauttttctttttaauc

SEQ ID NO: 35027 - DNA, 28 bp, Artificial Sequence
  Synthetic
ccataaatcccacagauctggtacuaac

SEQ ID NO: 35028 - DNA, 27 bp, Artificial Sequence
  Synthetic
tttcagtcctautttgtgctcataugg

SEQ ID NO: 35029 - DNA, 30 bp, Artificial Sequence
  Synthetic
cccccatuaaaaacagaatcacaattuact

SEQ ID NO: 35030 - DNA, 29 bp, Artificial Sequence
  Synthetic
tgtatgtggtcaaaugaatccaattcuga

SEQ ID NO: 35031 - DNA, 26 bp, Artificial Sequence
  Synthetic
gctcccuggacattagtttcucaaac

SEQ ID NO: 35032 - DNA, 25 bp, Artificial Sequence
  Synthetic
gacagcagtgugtcatatccauact

SEQ ID NO: 35033 - DNA, 21 bp, Artificial Sequence
  Synthetic
aggttcggaautcccttuccc

SEQ ID NO: 35034 - DNA, 26 bp, Artificial Sequence
  Synthetic
tcagagttgutcttatagggucgagt

SEQ ID NO: 35035 - DNA, 24 bp, Artificial Sequence
  Synthetic
tgcaatcaccaauatggtcacuga

SEQ ID NO: 35036 - DNA, 27 bp, Artificial Sequence
  Synthetic
acttgcaagcaaaucatgacactagua

SEQ ID NO: 35037 - DNA, 29 bp, Artificial Sequence
  Synthetic
cttctgaatgttugttagctcaactucaa

SEQ ID NO: 35038 - DNA, 26 bp, Artificial Sequence
  Synthetic
cagtattcacgutatgctgtccaauc

SEQ ID NO: 35039 - DNA, 24 bp, Artificial Sequence
  Synthetic
gtagtctuccagtatguccaagca

SEQ ID NO: 35040 - DNA, 25 bp, Artificial Sequence
  Synthetic
aaaaggagcaaguatgttgtcgcua

SEQ ID NO: 35041 - DNA, 27 bp, Artificial Sequence
  Synthetic
guacacaggaggaaaauaaacctauca

SEQ ID NO: 35042 - DNA, 24 bp, Artificial Sequence
  Synthetic
ataccaucacattggaaugagggt

SEQ ID NO: 35043 - DNA, 28 bp, Artificial Sequence
  Synthetic
tgtcgaacattuccctttcataggaaut

SEQ ID NO: 35044 - DNA, 28 bp, Artificial Sequence
  Synthetic
actctctttgagaaaaaugcagcattug

SEQ ID NO: 35045 - DNA, 27 bp, Artificial Sequence
  Synthetic
cttcacagaatutagacccttcaucct

SEQ ID NO: 35046 - DNA, 28 bp, Artificial Sequence
  Synthetic
ataaacaaaagcugctttacattcugct

SEQ ID NO: 35047 - DNA, 25 bp, Artificial Sequence
  Synthetic
gtgttcgaaugggacttcttacuca

SEQ ID NO: 35048 - DNA, 23 bp, Artificial Sequence
  Synthetic
gctcuacagtgcagugaaggaag

SEQ ID NO: 35049 - DNA, 28 bp, Artificial Sequence
  Synthetic
ccagttgggaautctaactactgtuaca

SEQ ID NO: 35050 - DNA, 23 bp, Artificial Sequence
  Synthetic
gccaactcacugagcaagatgua

SEQ ID NO: 35051 - DNA, 22 bp, Artificial Sequence
  Synthetic
caaacagcauggtggagaccua

SEQ ID NO: 35052 - DNA, 24 bp, Artificial Sequence
  Synthetic
gattctaggttugtcagctccugt

SEQ ID NO: 35053 - DNA, 25 bp, Artificial Sequence
  Synthetic
aaaagggaatuaagctctccagguc

SEQ ID NO: 35054 - DNA, 21 bp, Artificial Sequence
  Synthetic
ggagagagggcaugtgagcua

SEQ ID NO: 35055 - DNA, 30 bp, Artificial Sequence
  Synthetic
gagatgtatucaaacagaaacgtcactuac

SEQ ID NO: 35056 - DNA, 25 bp, Artificial Sequence
  Synthetic
aaagtagcacugggcagattatuac

SEQ ID NO: 35057 - DNA, 31 bp, Artificial Sequence
  Synthetic
ggagctataaaagccaauatactcaagtuca

SEQ ID NO: 35058 - DNA, 30 bp, Artificial Sequence
  Synthetic
actgtcatttgaaucttaatgagtcaucct

SEQ ID NO: 35059 - DNA, 22 bp, Artificial Sequence
  Synthetic
cagacgtguagtcagggtugaa

SEQ ID NO: 35060 - DNA, 27 bp, Artificial Sequence
  Synthetic
tcttttcctgaaguatgatgcaagcua

SEQ ID NO: 35061 - DNA, 31 bp, Artificial Sequence
  Synthetic
ctgaagtatttcuccaaactctcatcagaut

SEQ ID NO: 35062 - DNA, 27 bp, Artificial Sequence
  Synthetic
aaagtgtacaatguagaatgccctuga

SEQ ID NO: 35063 - DNA, 21 bp, Artificial Sequence
  Synthetic
gcagagctuaagcctctcucc

SEQ ID NO: 35064 - DNA, 26 bp, Artificial Sequence
  Synthetic
cctcaatgacccugagttatcctuct

SEQ ID NO: 35065 - DNA, 22 bp, Artificial Sequence
  Synthetic
gttttcaggcucctccacttug

SEQ ID NO: 35066 - DNA, 24 bp, Artificial Sequence
  Synthetic
gcagacacugggtccaaatctaut

SEQ ID NO: 35067 - DNA, 24 bp, Artificial Sequence
  Synthetic
agtactcgugaaaaagagcaggug

SEQ ID NO: 35068 - DNA, 26 bp, Artificial Sequence
  Synthetic
gagatgaaacccgagauggattcuac

SEQ ID NO: 35069 - DNA, 27 bp, Artificial Sequence
  Synthetic
tcaagcuagaaagatttcctcuaccct

SEQ ID NO: 35070 - DNA, 23 bp, Artificial Sequence
  Synthetic
aagcagtgtugaaaggcaaaugg

SEQ ID NO: 35071 - DNA, 25 bp, Artificial Sequence
  Synthetic
cucccttttaagcugcagaaacaag

SEQ ID NO: 35072 - DNA, 21 bp, Artificial Sequence
  Synthetic
ccagctucgagagtcucaggt

SEQ ID NO: 35073 - DNA, 27 bp, Artificial Sequence
  Synthetic
agttccatttgagucttaaaggcauca

SEQ ID NO: 35074 - DNA, 29 bp, Artificial Sequence
  Synthetic
atccattctaggauagcgttttctugaaa

SEQ ID NO: 35075 - DNA, 25 bp, Artificial Sequence
  Synthetic
agcctagtcccaucttcaagatuga

SEQ ID NO: 35076 - DNA, 26 bp, Artificial Sequence
  Synthetic
atgatctgacagutctctttggcaut

SEQ ID NO: 35077 - DNA, 31 bp, Artificial Sequence
  Synthetic
ctttcttctccugtcaaagtgtttataucca

SEQ ID NO: 35078 - DNA, 29 bp, Artificial Sequence
  Synthetic
gggaagactgugtttttaatcatttguca

SEQ ID NO: 35079 - DNA, 28 bp, Artificial Sequence
  Synthetic
ggccaacagaaaauaagaaagacuaagg

SEQ ID NO: 35080 - DNA, 21 bp, Artificial Sequence
  Synthetic
atgttugaccgccttcucact

SEQ ID NO: 35081 - DNA, 22 bp, Artificial Sequence
  Synthetic
tctggagatuctgaaggcucgt

SEQ ID NO: 35082 - DNA, 19 bp, Artificial Sequence
  Synthetic
ttgggcgggcugttgaaua

SEQ ID NO: 35083 - DNA, 21 bp, Artificial Sequence
  Synthetic
gatccatucgcagagucagca

SEQ ID NO: 35084 - DNA, 23 bp, Artificial Sequence
  Synthetic
acccatccaugtttctaccucca

SEQ ID NO: 35085 - DNA, 22 bp, Artificial Sequence
  Synthetic
ctgcagtctuatccaggctcuc

SEQ ID NO: 35086 - DNA, 32 bp, Artificial Sequence
  Synthetic
actaatattaagaattuaaacacggtgcatut

SEQ ID NO: 35087 - DNA, 22 bp, Artificial Sequence
  Synthetic
gtggcacagaaguacacaguct

SEQ ID NO: 35088 - DNA, 21 bp, Artificial Sequence
  Synthetic
cctatggtgugaggcatggug

SEQ ID NO: 35089 - DNA, 28 bp, Artificial Sequence
  Synthetic
ttggcttugaatacatgaauagggaact

SEQ ID NO: 35090 - DNA, 28 bp, Artificial Sequence
  Synthetic
caaaagtccaaucacaaaatucacacac

SEQ ID NO: 35091 - DNA, 28 bp, Artificial Sequence
  Synthetic
agataucagccauccagtaaaaaucaaa

SEQ ID NO: 35092 - DNA, 20 bp, Artificial Sequence
  Synthetic
cgagcuaacagcccaggtut

SEQ ID NO: 35093 - DNA, 27 bp, Artificial Sequence
  Synthetic
ttttccuagagacctucagagaagaca

SEQ ID NO: 35094 - DNA, 28 bp, Artificial Sequence
  Synthetic
gacaatcctuccattgaagaaguaggaa

SEQ ID NO: 35095 - DNA, 27 bp, Artificial Sequence
  Synthetic
attattcacctugctccaaggatauct

SEQ ID NO: 35096 - DNA, 23 bp, Artificial Sequence
  Synthetic
ttgtgacaagaagucccacguag

SEQ ID NO: 35097 - DNA, 22 bp, Artificial Sequence
  Synthetic
ggtgttgcaacutgttccctug

SEQ ID NO: 35098 - DNA, 28 bp, Artificial Sequence
  Synthetic
tttgttgtattgaagutttggcaacuga

SEQ ID NO: 35099 - DNA, 28 bp, Artificial Sequence
  Synthetic
ggaagattttcauttggaaacctgtuct

SEQ ID NO: 35100 - DNA, 25 bp, Artificial Sequence
  Synthetic
gggtgcguagataataaacaaucca

SEQ ID NO: 35101 - DNA, 24 bp, Artificial Sequence
  Synthetic
gttctttcucttgcttgugcacag

SEQ ID NO: 35102 - DNA, 29 bp, Artificial Sequence
  Synthetic
ctctttagtacautcgtaaaggcuacagt

SEQ ID NO: 35103 - DNA, 23 bp, Artificial Sequence
  Synthetic
ctttgaccgugccttcttgttut

SEQ ID NO: 35104 - DNA, 24 bp, Artificial Sequence
  Synthetic
ccattuagaccaaaggtucccaag

SEQ ID NO: 35105 - DNA, 29 bp, Artificial Sequence
  Synthetic
atctctttaaggaugaattctgagccaut

SEQ ID NO: 35106 - DNA, 30 bp, Artificial Sequence
  Synthetic
tctagtaaactttcutgttgacatttcuga

SEQ ID NO: 35107 - DNA, 27 bp, Artificial Sequence
  Synthetic
tggcaggaagaaguatctcgtatcaua

SEQ ID NO: 35108 - DNA, 22 bp, Artificial Sequence
  Synthetic
ggcattcuagtccatgcugcaa

SEQ ID NO: 35109 - DNA, 30 bp, Artificial Sequence
  Synthetic
tggatttcgtuaggactgaatttttcguaa

SEQ ID NO: 35110 - DNA, 21 bp, Artificial Sequence
  Synthetic
ccccagaauatggcaggugac

SEQ ID NO: 35111 - DNA, 24 bp, Artificial Sequence
  Synthetic
cauaaagctucagacccacgacat

SEQ ID NO: 35112 - DNA, 24 bp, Artificial Sequence
  Synthetic
aaacagcagutatcuggcaagagt

SEQ ID NO: 35113 - DNA, 25 bp, Artificial Sequence
  Synthetic
accttattttucttccagctugcct

SEQ ID NO: 35114 - DNA, 25 bp, Artificial Sequence
  Synthetic
ttcttgcatgauggatgtgaaacug

SEQ ID NO: 35115 - DNA, 29 bp, Artificial Sequence
  Synthetic
acattaaagaggaggutctgatcacaaug

SEQ ID NO: 35116 - DNA, 21 bp, Artificial Sequence
  Synthetic
tgggtgggucataaggtguga

SEQ ID NO: 35117 - DNA, 30 bp, Artificial Sequence
  Synthetic
acaggaattcgaggauttcagtattttcut

SEQ ID NO: 35118 - DNA, 30 bp, Artificial Sequence
  Synthetic
aaagctaagactguggtgatattcatucaa

SEQ ID NO: 35119 - DNA, 25 bp, Artificial Sequence
  Synthetic
cacttttcctguttctagcctguga

SEQ ID NO: 35120 - DNA, 24 bp, Artificial Sequence
  Synthetic
gctacttcauaaactaggccugca

SEQ ID NO: 35121 - DNA, 28 bp, Artificial Sequence
  Synthetic
tgccttgaagugagtaggaattuaacaa

SEQ ID NO: 35122 - DNA, 28 bp, Artificial Sequence
  Synthetic
actatctctcucatttttgcttgauggg

SEQ ID NO: 35123 - DNA, 23 bp, Artificial Sequence
  Synthetic
gcaaatgtugccaacagcttuct

SEQ ID NO: 35124 - DNA, 25 bp, Artificial Sequence
  Synthetic
gaccaaugaccatactgaugaagga

SEQ ID NO: 35125 - DNA, 29 bp, Artificial Sequence
  Synthetic
ctttgtttcccautgtgaatatgacucag

SEQ ID NO: 35126 - DNA, 32 bp, Artificial Sequence
  Synthetic
attacttactagaagutgttttccatctucat

SEQ ID NO: 35127 - DNA, 25 bp, Artificial Sequence
  Synthetic
cctggcatccugccttatctttuaa

SEQ ID NO: 35128 - DNA, 28 bp, Artificial Sequence
  Synthetic
tccttaacctuacagagtttcatggtuc

SEQ ID NO: 35129 - DNA, 28 bp, Artificial Sequence
  Synthetic
agtttattcctgcugtgttcaggtuaaa

SEQ ID NO: 35130 - DNA, 23 bp, Artificial Sequence
  Synthetic
gttctcggcuagaaaguccaaca

SEQ ID NO: 35131 - DNA, 25 bp, Artificial Sequence
  Synthetic
gtgtacacaugtgcttcctuaaaca

SEQ ID NO: 35132 - DNA, 22 bp, Artificial Sequence
  Synthetic
tgcaucgttugagaacggaaca

SEQ ID NO: 35133 - DNA, 29 bp, Artificial Sequence
  Synthetic
gcgtggcattutaattactagaaagugat

SEQ ID NO: 35134 - DNA, 25 bp, Artificial Sequence
  Synthetic
ctcagtgaagautctgttgcagcua

SEQ ID NO: 35135 - DNA, 22 bp, Artificial Sequence
  Synthetic
ggagttugagcgggtgactuac

SEQ ID NO: 35136 - DNA, 22 bp, Artificial Sequence
  Synthetic
gcggcagaauttgagagatugt

SEQ ID NO: 35137 - DNA, 29 bp, Artificial Sequence
  Synthetic
gggtgacttgauggagtcattaatcttua

SEQ ID NO: 35138 - DNA, 18 bp, Artificial Sequence
  Synthetic
cctccctgugctctgcut

SEQ ID NO: 35139 - DNA, 20 bp, Artificial Sequence
  Synthetic
ctcccagucctccttuccag

SEQ ID NO: 35140 - DNA, 18 bp, Artificial Sequence
  Synthetic
caacgaguccacgtcguc

SEQ ID NO: 35141 - DNA, 19 bp, Artificial Sequence
  Synthetic
gcagtccucctcguccaca

SEQ ID NO: 35142 - DNA, 19 bp, Artificial Sequence
  Synthetic
acgagagugagcgggacua

SEQ ID NO: 35143 - DNA, 19 bp, Artificial Sequence
  Synthetic
ggccagguggacagaagug

SEQ ID NO: 35144 - DNA, 23 bp, Artificial Sequence
  Synthetic
cctcatccuccattcccatucac

SEQ ID NO: 35145 - DNA, 25 bp, Artificial Sequence
  Synthetic
gaaaggacacuagctcctagaucct

SEQ ID NO: 35146 - DNA, 23 bp, Artificial Sequence
  Synthetic
catttguggagcacttgauccct

SEQ ID NO: 35147 - DNA, 22 bp, Artificial Sequence
  Synthetic
ggtagaugagctccucagcaga

SEQ ID NO: 35148 - DNA, 21 bp, Artificial Sequence
  Synthetic
tggaagcuaagggtccgtcut

SEQ ID NO: 35149 - DNA, 18 bp, Artificial Sequence
  Synthetic
ggagcugttcccgugcag

SEQ ID NO: 35150 - DNA, 21 bp, Artificial Sequence
  Synthetic
ggtgggacugtgctttcugac

SEQ ID NO: 35151 - DNA, 26 bp, Artificial Sequence
  Synthetic
cacagtgagaaugaaattagggcuct

SEQ ID NO: 35152 - DNA, 20 bp, Artificial Sequence
  Synthetic
cagtgcugtgacuggacact

SEQ ID NO: 35153 - DNA, 22 bp, Artificial Sequence
  Synthetic
tggatcuaagccacaugacgac

SEQ ID NO: 35154 - DNA, 23 bp, Artificial Sequence
  Synthetic
cugatatgtggugaagccagact

SEQ ID NO: 35155 - DNA, 17 bp, Artificial Sequence
  Synthetic
agugctgggugcagacg

SEQ ID NO: 35156 - DNA, 19 bp, Artificial Sequence
  Synthetic
ccacccgcuttctgtcuct

SEQ ID NO: 35157 - DNA, 17 bp, Artificial Sequence
  Synthetic
ccugccccauccagagg

SEQ ID NO: 35158 - DNA, 23 bp, Artificial Sequence
  Synthetic
catctgctcuccctagacagcua

SEQ ID NO: 35159 - DNA, 22 bp, Artificial Sequence
  Synthetic
ggtcctggcugttgtaagacuc

SEQ ID NO: 35160 - DNA, 19 bp, Artificial Sequence
  Synthetic
tgtggacccccutgacuga

SEQ ID NO: 35161 - DNA, 19 bp, Artificial Sequence
  Synthetic
gacagugagcggcacugat

SEQ ID NO: 35162 - DNA, 23 bp, Artificial Sequence
  Synthetic
ccttaacuaacacgggctctcut

SEQ ID NO: 35163 - DNA, 20 bp, Artificial Sequence
  Synthetic
cctcagcuagccctccucat

SEQ ID NO: 35164 - DNA, 21 bp, Artificial Sequence
  Synthetic
ctacatcgcaguctcctucgt

SEQ ID NO: 35165 - DNA, 19 bp, Artificial Sequence
  Synthetic
agccccagccauaaaggug

SEQ ID NO: 35166 - DNA, 24 bp, Artificial Sequence
  Synthetic
ctctcgaugcaactctatcgucac

SEQ ID NO: 35167 - DNA, 28 bp, Artificial Sequence
  Synthetic
ccgcaaatcccacuagctaaatatcuaa

SEQ ID NO: 35168 - DNA, 22 bp, Artificial Sequence
  Synthetic
cactgaauagggctttggccut

SEQ ID NO: 35169 - DNA, 21 bp, Artificial Sequence
  Synthetic
caattggtggugtggccaauc

SEQ ID NO: 35170 - DNA, 23 bp, Artificial Sequence
  Synthetic
gttcctccucagcctctttctut

SEQ ID NO: 35171 - DNA, 22 bp, Artificial Sequence
  Synthetic
gccttccaguttggacctccua

SEQ ID NO: 35172 - DNA, 20 bp, Artificial Sequence
  Synthetic
cctgcuccaccgaggtctua

SEQ ID NO: 35173 - DNA, 22 bp, Artificial Sequence
  Synthetic
cautccccaaacugccaaacag

SEQ ID NO: 35174 - DNA, 22 bp, Artificial Sequence
  Synthetic
tctttagccaguggcttggtut

SEQ ID NO: 35175 - DNA, 25 bp, Artificial Sequence
  Synthetic
cagataccagaaucagaggacucac

SEQ ID NO: 35176 - DNA, 22 bp, Artificial Sequence
  Synthetic
cctcttgcucctctgcttaguc

SEQ ID NO: 35177 - DNA, 23 bp, Artificial Sequence
  Synthetic
gaatgcctccucctcatttcuca

SEQ ID NO: 35178 - DNA, 24 bp, Artificial Sequence
  Synthetic
ggacatgcutctcttaactuccct

SEQ ID NO: 35179 - DNA, 27 bp, Artificial Sequence
  Synthetic
aggaaagtccugatttctttagctugg

SEQ ID NO: 35180 - DNA, 23 bp, Artificial Sequence
  Synthetic
ccagtgcttcuccctcaactaug

SEQ ID NO: 35181 - DNA, 23 bp, Artificial Sequence
  Synthetic
ccttgaggugaggaactttgcut

SEQ ID NO: 35182 - DNA, 20 bp, Artificial Sequence
  Synthetic
cccttcagauggccctggua

SEQ ID NO: 35183 - DNA, 21 bp, Artificial Sequence
  Synthetic
ccaggucagacgctcauagac

SEQ ID NO: 35184 - DNA, 20 bp, Artificial Sequence
  Synthetic
agtggcaucttgcuccacac

SEQ ID NO: 35185 - DNA, 20 bp, Artificial Sequence
  Synthetic
acccuggagccctaacctut

SEQ ID NO: 35186 - DNA, 18 bp, Artificial Sequence
  Synthetic
ccugcagcccagcagaua

SEQ ID NO: 35187 - DNA, 20 bp, Artificial Sequence
  Synthetic
ggtaugagccagctctucca

SEQ ID NO: 35188 - DNA, 18 bp, Artificial Sequence
  Synthetic
cttctuccgccagucggt

SEQ ID NO: 35189 - DNA, 18 bp, Artificial Sequence
  Synthetic
gtcctccgcucggctuag

SEQ ID NO: 35190 - DNA, 22 bp, Artificial Sequence
  Synthetic
atgaagccaccaugcctacaut

SEQ ID NO: 35191 - DNA, 22 bp, Artificial Sequence
  Synthetic
ggcccacuaagatgggcattut

SEQ ID NO: 35192 - DNA, 23 bp, Artificial Sequence
  Synthetic
tgatgctggccucatatgttugt

SEQ ID NO: 35193 - DNA, 27 bp, Artificial Sequence
  Synthetic
acutacttcttcauaacgaggaacagc

SEQ ID NO: 35194 - DNA, 21 bp, Artificial Sequence
  Synthetic
gtcgaugtgtgguagccagag

SEQ ID NO: 35195 - DNA, 20 bp, Artificial Sequence
  Synthetic
gatggugcagcaggttccua

SEQ ID NO: 35196 - DNA, 24 bp, Artificial Sequence
  Synthetic
gagttcagatuagcccatggauca

SEQ ID NO: 35197 - DNA, 22 bp, Artificial Sequence
  Synthetic
gccguagaagggatugacaagc

SEQ ID NO: 35198 - DNA, 23 bp, Artificial Sequence
  Synthetic
ctcacuaacaaagcaggcttugg

SEQ ID NO: 35199 - DNA, 26 bp, Artificial Sequence
  Synthetic
gccaaccaucttgtctaactucagat

SEQ ID NO: 35200 - DNA, 20 bp, Artificial Sequence
  Synthetic
ctcctccuctgctcauggag

SEQ ID NO: 35201 - DNA, 22 bp, Artificial Sequence
  Synthetic
aggactgcagacugaactcuca

SEQ ID NO: 35202 - DNA, 22 bp, Artificial Sequence
  Synthetic
acgtctggagauaggaggcuat

SEQ ID NO: 35203 - DNA, 22 bp, Artificial Sequence
  Synthetic
ctagctaggugtcctgtuccac

SEQ ID NO: 35204 - DNA, 21 bp, Artificial Sequence
  Synthetic
ccatctccugaccctcctcuc

SEQ ID NO: 35205 - DNA, 17 bp, Artificial Sequence
  Synthetic
actgcucccccgacuca

SEQ ID NO: 35206 - DNA, 20 bp, Artificial Sequence
  Synthetic
cctugagccagggctguaag

SEQ ID NO: 35207 - DNA, 17 bp, Artificial Sequence
  Synthetic
cuccugcccaccagagg

SEQ ID NO: 35208 - DNA, 19 bp, Artificial Sequence
  Synthetic
ggtcaguccttccgacuct

SEQ ID NO: 35209 - DNA, 18 bp, Artificial Sequence
  Synthetic
gctccgagccaugcaucc

SEQ ID NO: 35210 - DNA, 21 bp, Artificial Sequence
  Synthetic
gcagatcttccucccctccuc

SEQ ID NO: 35211 - DNA, 23 bp, Artificial Sequence
  Synthetic
accaaatgugaagacgugggaat

SEQ ID NO: 35212 - DNA, 18 bp, Artificial Sequence
  Synthetic
cccagcaugaccccugaa

SEQ ID NO: 35213 - DNA, 19 bp, Artificial Sequence
  Synthetic
tgggtccuggaggtcucac

SEQ ID NO: 35214 - DNA, 20 bp, Artificial Sequence
  Synthetic
gcguccacgagcagaacuac

SEQ ID NO: 35215 - DNA, 21 bp, Artificial Sequence
  Synthetic
tgtgggaagutggcatctguc

SEQ ID NO: 35216 - DNA, 22 bp, Artificial Sequence
  Synthetic
ccctcagcugtgagtgtatuga

SEQ ID NO: 35217 - DNA, 24 bp, Artificial Sequence
  Synthetic
accctgtatguccttgtgacuact

SEQ ID NO: 35218 - DNA, 24 bp, Artificial Sequence
  Synthetic
gagggagutgaagaugacaaggaa

SEQ ID NO: 35219 - DNA, 30 bp, Artificial Sequence
  Synthetic
caggagugggaaaagautaaatattcauac

SEQ ID NO: 35220 - DNA, 31 bp, Artificial Sequence
  Synthetic
gttcatgtatcaaucagatgtgaattcucaa

SEQ ID NO: 35221 - DNA, 25 bp, Artificial Sequence
  Synthetic
auccttucacagaauacacaacaga

SEQ ID NO: 35222 - DNA, 20 bp, Artificial Sequence
  Synthetic
gtatacguggtggcugcaga

SEQ ID NO: 35223 - DNA, 19 bp, Artificial Sequence
  Synthetic
cgugcaggaugaccagcag

SEQ ID NO: 35224 - DNA, 24 bp, Artificial Sequence
  Synthetic
agcctcatctucaagctcatcaut

SEQ ID NO: 35225 - DNA, 21 bp, Artificial Sequence
  Synthetic
tgagguagcagagcucacaga

SEQ ID NO: 35226 - DNA, 23 bp, Artificial Sequence
  Synthetic
auccagacccaggcaauaacaag

SEQ ID NO: 35227 - DNA, 27 bp, Artificial Sequence
  Synthetic
gccaaaacgaaagutgcataactuagt

SEQ ID NO: 35228 - DNA, 25 bp, Artificial Sequence
  Synthetic
aggacauagacttugaaacaagcga

SEQ ID NO: 35229 - DNA, 22 bp, Artificial Sequence
  Synthetic
catcacttttugtgtggccucc

SEQ ID NO: 35230 - DNA, 22 bp, Artificial Sequence
  Synthetic
gtctggagggcugagaaugaac

SEQ ID NO: 35231 - DNA, 22 bp, Artificial Sequence
  Synthetic
gatgttctaucagcgcauccac

SEQ ID NO: 35232 - DNA, 24 bp, Artificial Sequence
  Synthetic
ccatatgguaacagaagauggcaa

SEQ ID NO: 35233 - DNA, 24 bp, Artificial Sequence
  Synthetic
cccacatcauaccattcctuggat

SEQ ID NO: 35234 - DNA, 21 bp, Artificial Sequence
  Synthetic
guaaaggaaagggcuccagca

SEQ ID NO: 35235 - DNA, 26 bp, Artificial Sequence
  Synthetic
gctgtgtgtcauatctgagcttctut

SEQ ID NO: 35236 - DNA, 23 bp, Artificial Sequence
  Synthetic
ccaggacaguttggguaaacagt

SEQ ID NO: 35237 - DNA, 28 bp, Artificial Sequence
  Synthetic
cctgtagcttgaucacctcattctttut

SEQ ID NO: 35238 - DNA, 25 bp, Artificial Sequence
  Synthetic
ggctgatgucttgtgcaaatauagt

SEQ ID NO: 35239 - DNA, 26 bp, Artificial Sequence
  Synthetic
tcggagcuaaaactcccttttatucc

SEQ ID NO: 35240 - DNA, 25 bp, Artificial Sequence
  Synthetic
agaatcccauagcattgtagcctug

SEQ ID NO: 35241 - DNA, 26 bp, Artificial Sequence
  Synthetic
agaagatgucagtggttgtttucagt

SEQ ID NO: 35242 - DNA, 21 bp, Artificial Sequence
  Synthetic
cctcuacacccgcatttugca

SEQ ID NO: 35243 - DNA, 22 bp, Artificial Sequence
  Synthetic
ggucatgugacacagcgaagat

SEQ ID NO: 35244 - DNA, 17 bp, Artificial Sequence
  Synthetic
gtccgagccaugcguct

SEQ ID NO: 35245 - DNA, 17 bp, Artificial Sequence
  Synthetic
ccctgutcgctcugcac

SEQ ID NO: 35246 - DNA, 23 bp, Artificial Sequence
  Synthetic
taatgttctccuctcttggcuct

SEQ ID NO: 35247 - DNA, 19 bp, Artificial Sequence
  Synthetic
ccggacucccagcactuac

SEQ ID NO: 35248 - DNA, 20 bp, Artificial Sequence
  Synthetic
gagtacatcguccgggtcug

SEQ ID NO: 35249 - DNA, 21 bp, Artificial Sequence
  Synthetic
tcagagtcgggautgggagua

SEQ ID NO: 35250 - DNA, 18 bp, Artificial Sequence
  Synthetic
gcagatccugcgcauggt

SEQ ID NO: 35251 - DNA, 19 bp, Artificial Sequence
  Synthetic
agacagccccuctgaccuc

SEQ ID NO: 35252 - DNA, 20 bp, Artificial Sequence
  Synthetic
gtgaccagucctgcctguaa

SEQ ID NO: 35253 - DNA, 20 bp, Artificial Sequence
  Synthetic
tccccaggcaaaugtgugac

SEQ ID NO: 35254 - DNA, 19 bp, Artificial Sequence
  Synthetic
gggacugagaggccucact

SEQ ID NO: 35255 - DNA, 22 bp, Artificial Sequence
  Synthetic
cacttgtccucaaagggcatug

SEQ ID NO: 35256 - DNA, 21 bp, Artificial Sequence
  Synthetic
tcttgttugagcacgugcaac

SEQ ID NO: 35257 - DNA, 25 bp, Artificial Sequence
  Synthetic
gtcugagagaggaugaagacagaga

SEQ ID NO: 35258 - DNA, 21 bp, Artificial Sequence
  Synthetic
gcatcuggcaccuccaacaat

SEQ ID NO: 35259 - DNA, 18 bp, Artificial Sequence
  Synthetic
gccctcgaucggacucag

SEQ ID NO: 35260 - DNA, 23 bp, Artificial Sequence
  Synthetic
gggauagcaaagagauggagagg

SEQ ID NO: 35261 - DNA, 22 bp, Artificial Sequence
  Synthetic
gcctgctgaguactgctcaaug

SEQ ID NO: 35262 - DNA, 23 bp, Artificial Sequence
  Synthetic
cctctgatggutcccttacccut

SEQ ID NO: 35263 - DNA, 21 bp, Artificial Sequence
  Synthetic
gcttcttgguatggccagcuc

SEQ ID NO: 35264 - DNA, 19 bp, Artificial Sequence
  Synthetic
gcttctautcgcgcugcct

SEQ ID NO: 35265 - DNA, 21 bp, Artificial Sequence
  Synthetic
gcctcugagaagtcccucagt

SEQ ID NO: 35266 - DNA, 24 bp, Artificial Sequence
  Synthetic
tgtcuccaaggaggaaaugaacua

SEQ ID NO: 35267 - DNA, 22 bp, Artificial Sequence
  Synthetic
gtgtcctcgaucttctgctuca

SEQ ID NO: 35268 - DNA, 21 bp, Artificial Sequence
  Synthetic
aggcctgaaggutaaggtgug

SEQ ID NO: 35269 - DNA, 20 bp, Artificial Sequence
  Synthetic
tcagtcagcautcggaggug

SEQ ID NO: 35270 - DNA, 22 bp, Artificial Sequence
  Synthetic
cataacucccctcatgcugaca

SEQ ID NO: 35271 - DNA, 27 bp, Artificial Sequence
  Synthetic
agcctctattuacattttccctcucac

SEQ ID NO: 35272 - DNA, 23 bp, Artificial Sequence
  Synthetic
acccagaaaaccucatgactgug

SEQ ID NO: 35273 - DNA, 20 bp, Artificial Sequence
  Synthetic
cccaauagggccaatcgtug

SEQ ID NO: 35274 - DNA, 17 bp, Artificial Sequence
  Synthetic
gcatccccuggccctug

SEQ ID NO: 35275 - DNA, 24 bp, Artificial Sequence
  Synthetic
aaactcattugaaggcagauggga

SEQ ID NO: 35276 - DNA, 24 bp, Artificial Sequence
  Synthetic
ttgaacaguccatgaaaggugaca

SEQ ID NO: 35277 - DNA, 31 bp, Artificial Sequence
  Synthetic
cttgggctttuaaaaactcaatattgccuaa

SEQ ID NO: 35278 - DNA, 28 bp, Artificial Sequence
  Synthetic
tgtgagaaagaaaaaucaaucaagcaat

SEQ ID NO: 35279 - DNA, 27 bp, Artificial Sequence
  Synthetic
ttcctaagcatgugctctatttcguag

SEQ ID NO: 35280 - DNA, 25 bp, Artificial Sequence
  Synthetic
ggaggacaatucctgagagagauga

SEQ ID NO: 35281 - DNA, 30 bp, Artificial Sequence
  Synthetic
cctgtgctcatguttgactttttattttug

SEQ ID NO: 35282 - DNA, 28 bp, Artificial Sequence
  Synthetic
caatcagaaacccautgtcttcauaggt

SEQ ID NO: 35283 - DNA, 30 bp, Artificial Sequence
  Synthetic
caagtttgtgattcugaagaagatgtgtut

SEQ ID NO: 35284 - DNA, 27 bp, Artificial Sequence
  Synthetic
gtgatcaggatuggtatcaaagguagg

SEQ ID NO: 35285 - DNA, 27 bp, Artificial Sequence
  Synthetic
ctcttccaaagccutttaaaaccacut

SEQ ID NO: 35286 - DNA, 30 bp, Artificial Sequence
  Synthetic
aaattctaaattccugaacatcaccuagca

SEQ ID NO: 35287 - DNA, 28 bp, Artificial Sequence
  Synthetic
catggcttgaaaautactggacugaaaa

SEQ ID NO: 35288 - DNA, 21 bp, Artificial Sequence
  Synthetic
ccaagcuaggccctacttuga

SEQ ID NO: 35289 - DNA, 24 bp, Artificial Sequence
  Synthetic
aatgttctgtcuccccttcaucac

SEQ ID NO: 35290 - DNA, 25 bp, Artificial Sequence
  Synthetic
caggtcattaaucaatgccttcuct

SEQ ID NO: 35291 - DNA, 28 bp, Artificial Sequence
  Synthetic
ccaaagccataacuccttttaagggaut

SEQ ID NO: 35292 - DNA, 24 bp, Artificial Sequence
  Synthetic
cagatcugcttgaaaugagagcaa

SEQ ID NO: 35293 - DNA, 23 bp, Artificial Sequence
  Synthetic
gcagcgaatucagaaagagguct

SEQ ID NO: 35294 - DNA, 21 bp, Artificial Sequence
  Synthetic
gggctctcugtaggaggcaua

SEQ ID NO: 35295 - DNA, 26 bp, Artificial Sequence
  Synthetic
cctaatctcgcucttctcttaccuct

SEQ ID NO: 35296 - DNA, 21 bp, Artificial Sequence
  Synthetic
ggaggaggagaccuggaacug

SEQ ID NO: 35297 - DNA, 23 bp, Artificial Sequence
  Synthetic
ctuaggcccaaccacuaacagag

SEQ ID NO: 35298 - DNA, 20 bp, Artificial Sequence
  Synthetic
ccagcccugggaatctctug

SEQ ID NO: 35299 - DNA, 21 bp, Artificial Sequence
  Synthetic
ctgtcagcucatccuccacag

SEQ ID NO: 35300 - DNA, 24 bp, Artificial Sequence
  Synthetic
gtggccauaacaaaacautttuca

SEQ ID NO: 35301 - DNA, 28 bp, Artificial Sequence
  Synthetic
tccactcctugaaggatactcagtaaut

SEQ ID NO: 35302 - DNA, 27 bp, Artificial Sequence
  Synthetic
gtgacttgcatuatggcattatgtucc

SEQ ID NO: 35303 - DNA, 23 bp, Artificial Sequence
  Synthetic
tctcagttcucagtccggttuct

SEQ ID NO: 35304 - DNA, 24 bp, Artificial Sequence
  Synthetic
tgggtataagguccagttcuggat

SEQ ID NO: 35305 - DNA, 26 bp, Artificial Sequence
  Synthetic
tgaagtggacucaattcctgttgaug

SEQ ID NO: 35306 - DNA, 22 bp, Artificial Sequence
  Synthetic
ggaggaagaaaguggcacucat

SEQ ID NO: 35307 - DNA, 29 bp, Artificial Sequence
  Synthetic
gcagtgctattaccutcatcttggaatua

SEQ ID NO: 35308 - DNA, 22 bp, Artificial Sequence
  Synthetic
cccaggutttctgucaggagat

SEQ ID NO: 35309 - DNA, 22 bp, Artificial Sequence
  Synthetic
tgctctccucttctcttuccga

SEQ ID NO: 35310 - DNA, 21 bp, Artificial Sequence
  Synthetic
gggctcacuccactgauaaac

SEQ ID NO: 35311 - DNA, 23 bp, Artificial Sequence
  Synthetic
tccttctgcucttccctctucat

SEQ ID NO: 35312 - DNA, 21 bp, Artificial Sequence
  Synthetic
gctgtgguggcttacactgua

SEQ ID NO: 35313 - DNA, 21 bp, Artificial Sequence
  Synthetic
ctcagaugtcctcuccaccct

SEQ ID NO: 35314 - DNA, 29 bp, Artificial Sequence
  Synthetic
ggtcaagtacctuaatgttgtcttcagut

SEQ ID NO: 35315 - DNA, 26 bp, Artificial Sequence
  Synthetic
gggtatguaaacagactggagattug

SEQ ID NO: 35316 - DNA, 22 bp, Artificial Sequence
  Synthetic
gtgtcttgugacttccugagca

SEQ ID NO: 35317 - DNA, 28 bp, Artificial Sequence
  Synthetic
tgctgtacttguggtattcattgcatua

SEQ ID NO: 35318 - DNA, 27 bp, Artificial Sequence
  Synthetic
ctgccagttugaaatgttagtttguga

SEQ ID NO: 35319 - DNA, 23 bp, Artificial Sequence
  Synthetic
tgtuccagaagcagaaauggaca

SEQ ID NO: 35320 - DNA, 20 bp, Artificial Sequence
  Synthetic
caacgccugccatctugaac

SEQ ID NO: 35321 - DNA, 25 bp, Artificial Sequence
  Synthetic
ccagtcacatguctcactctgtcua

SEQ ID NO: 35322 - DNA, 23 bp, Artificial Sequence
  Synthetic
cagcuaaacaccgaccgacaaua

SEQ ID NO: 35323 - DNA, 21 bp, Artificial Sequence
  Synthetic
ccaggacuccaatgtctgcuc

SEQ ID NO: 35324 - DNA, 21 bp, Artificial Sequence
  Synthetic
ccagccccutagacttucgag

SEQ ID NO: 35325 - DNA, 27 bp, Artificial Sequence
  Synthetic
caacaaaacagagcutgggttagatut

SEQ ID NO: 35326 - DNA, 28 bp, Artificial Sequence
  Synthetic
gcatatgctctgugcttgaagttctuat

SEQ ID NO: 35327 - DNA, 23 bp, Artificial Sequence
  Synthetic
acagagcuggcatcagtctttut

SEQ ID NO: 35328 - DNA, 24 bp, Artificial Sequence
  Synthetic
aaatcttcugcaaatggucccaga

SEQ ID NO: 35329 - DNA, 21 bp, Artificial Sequence
  Synthetic
ctttggcacaggcutgtacut

SEQ ID NO: 35330 - DNA, 21 bp, Artificial Sequence
  Synthetic
gagacugagcagcagctgtua

SEQ ID NO: 35331 - DNA, 24 bp, Artificial Sequence
  Synthetic
cttaactctcccguccttcttgug

SEQ ID NO: 35332 - DNA, 21 bp, Artificial Sequence
  Synthetic
tgggctcuagagaagtgugct

SEQ ID NO: 35333 - DNA, 19 bp, Artificial Sequence
  Synthetic
cactgacgccugtgttcug

SEQ ID NO: 35334 - DNA, 20 bp, Artificial Sequence
  Synthetic
caggaaugcggtgatcuggt

SEQ ID NO: 35335 - DNA, 27 bp, Artificial Sequence
  Synthetic
gggccatgtaautaggcattatgttua

SEQ ID NO: 35336 - DNA, 21 bp, Artificial Sequence
  Synthetic
cguttacauagagggccacct

SEQ ID NO: 35337 - DNA, 25 bp, Artificial Sequence
  Synthetic
gtaaggtaggauagggagactccut

SEQ ID NO: 35338 - DNA, 23 bp, Artificial Sequence
  Synthetic
ctgatcaagguaccaagcgagua

SEQ ID NO: 35339 - DNA, 22 bp, Artificial Sequence
  Synthetic
gctctttttcugtgccctcucc

SEQ ID NO: 35340 - DNA, 21 bp, Artificial Sequence
  Synthetic
cagaaagcacagcaugauggt

SEQ ID NO: 35341 - DNA, 22 bp, Artificial Sequence
  Synthetic
gcacatggagugtgcguagaaa

SEQ ID NO: 35342 - DNA, 22 bp, Artificial Sequence
  Synthetic
gauggagaagctguccaggaac

SEQ ID NO: 35343 - DNA, 27 bp, Artificial Sequence
  Synthetic
gcactctactatuctgcttctctccut

SEQ ID NO: 35344 - DNA, 27 bp, Artificial Sequence
  Synthetic
tgatttatgaguccagtctcaauccct

SEQ ID NO: 35345 - DNA, 21 bp, Artificial Sequence
  Synthetic
ccggaguggtattcccugaca

SEQ ID NO: 35346 - DNA, 25 bp, Artificial Sequence
  Synthetic
gggatgtagggautcttgtttctuc

SEQ ID NO: 35347 - DNA, 25 bp, Artificial Sequence
  Synthetic
caacttcgacuggagggacatatut

SEQ ID NO: 35348 - DNA, 23 bp, Artificial Sequence
  Synthetic
gggcctgcutgttgtatttugat

SEQ ID NO: 35349 - DNA, 25 bp, Artificial Sequence
  Synthetic
guacttcttugacaacagcacacag

SEQ ID NO: 35350 - DNA, 20 bp, Artificial Sequence
  Synthetic
gggagguccaggguacacaa

SEQ ID NO: 35351 - DNA, 26 bp, Artificial Sequence
  Synthetic
tctgtaaaatcugtcccttgtcucct

SEQ ID NO: 35352 - DNA, 27 bp, Artificial Sequence
  Synthetic
caatcccuagaaaggccutatagtuat

SEQ ID NO: 35353 - DNA, 22 bp, Artificial Sequence
  Synthetic
ctgaagacttugccttgcccua

SEQ ID NO: 35354 - DNA, 28 bp, Artificial Sequence
  Synthetic
cctcttgaatucttggtgacataucaga

SEQ ID NO: 35355 - DNA, 30 bp, Artificial Sequence
  Synthetic
aaattgttttactgucaattacagctuccc

SEQ ID NO: 35356 - DNA, 23 bp, Artificial Sequence
  Synthetic
agagcttgaagaaguccacgtug

SEQ ID NO: 35357 - DNA, 21 bp, Artificial Sequence
  Synthetic
ccacagggcaguttctagugt

SEQ ID NO: 35358 - DNA, 21 bp, Artificial Sequence
  Synthetic
ccttcctgccuccgctaguat

SEQ ID NO: 35359 - DNA, 22 bp, Artificial Sequence
  Synthetic
gacagagcuacacatcttgucc

SEQ ID NO: 35360 - DNA, 22 bp, Artificial Sequence
  Synthetic
tgcatgguagggatcucaacac

SEQ ID NO: 35361 - DNA, 27 bp, Artificial Sequence
  Synthetic
ccgtcttgtccucattttctgtttuaa

SEQ ID NO: 35362 - DNA, 22 bp, Artificial Sequence
  Synthetic
ccccacactuccaacctgttua

SEQ ID NO: 35363 - DNA, 22 bp, Artificial Sequence
  Synthetic
gggcttcgugagacagauacag

SEQ ID NO: 35364 - DNA, 29 bp, Artificial Sequence
  Synthetic
tgtaattaugccaagaaaucatatgcuca

SEQ ID NO: 35365 - DNA, 29 bp, Artificial Sequence
  Synthetic
tgcaagagagcutataatttggattgugt

SEQ ID NO: 35366 - DNA, 21 bp, Artificial Sequence
  Synthetic
cgtaactcutggccagtucgt

SEQ ID NO: 35367 - DNA, 29 bp, Artificial Sequence
  Synthetic
ctgtacccagccuaatcttgtttttctua

SEQ ID NO: 35368 - DNA, 22 bp, Artificial Sequence
  Synthetic
ccttcgccugtcctcatgtaut

SEQ ID NO: 35369 - DNA, 32 bp, Artificial Sequence
  Synthetic
cctgtggttttuaataaaaattgaactuccct

SEQ ID NO: 35370 - DNA, 31 bp, Artificial Sequence
  Synthetic
tttttaggtgtaguattgagtcctgttugag

SEQ ID NO: 35371 - DNA, 27 bp, Artificial Sequence
  Synthetic
cttcactgtctuctctatccatggtut

SEQ ID NO: 35372 - DNA, 26 bp, Artificial Sequence
  Synthetic
gactgtguactcttaccttuccaacc

SEQ ID NO: 35373 - DNA, 28 bp, Artificial Sequence
  Synthetic
gtcctgagcucattagacagtaaatugt

SEQ ID NO: 35374 - DNA, 25 bp, Artificial Sequence
  Synthetic
tgaaugggagaaguaagaaggagaa

SEQ ID NO: 35375 - DNA, 27 bp, Artificial Sequence
  Synthetic
tgtgccaaagautattctgtucagagt

SEQ ID NO: 35376 - DNA, 23 bp, Artificial Sequence
  Synthetic
ggctgccacuttcatgaatgaug

SEQ ID NO: 35377 - DNA, 28 bp, Artificial Sequence
  Synthetic
aggtatttatugcttctcaaactucaga

SEQ ID NO: 35378 - DNA, 23 bp, Artificial Sequence
  Synthetic
gcaugcctactcugaaagccaat

SEQ ID NO: 35379 - DNA, 23 bp, Artificial Sequence
  Synthetic
ctaagccagauacctttguccgt

SEQ ID NO: 35380 - DNA, 28 bp, Artificial Sequence
  Synthetic
cctaagaaggagcuaaaggaaggagaua

SEQ ID NO: 35381 - DNA, 30 bp, Artificial Sequence
  Synthetic
tgagtcttaaacucagctgattaaaaacug

SEQ ID NO: 35382 - DNA, 29 bp, Artificial Sequence
  Synthetic
ctttggtatacuaatatctctgccugaca

SEQ ID NO: 35383 - DNA, 22 bp, Artificial Sequence
  Synthetic
ccactgagaaaugcaccttugg

SEQ ID NO: 35384 - DNA, 21 bp, Artificial Sequence
  Synthetic
ccagcuggagaagtgactuca

SEQ ID NO: 35385 - DNA, 21 bp, Artificial Sequence
  Synthetic
gaggttuccacccaaucccat

SEQ ID NO: 35386 - DNA, 22 bp, Artificial Sequence
  Synthetic
aggcagcugctgatgcuaaaat

SEQ ID NO: 35387 - DNA, 25 bp, Artificial Sequence
  Synthetic
tctccctcaaguttttcagacucac

SEQ ID NO: 35388 - DNA, 33 bp, Artificial Sequence
  Synthetic
atattatttgtttagaaccugaatctcaaguct

SEQ ID NO: 35389 - DNA, 28 bp, Artificial Sequence
  Synthetic
caggagttggcuaaagttttacaatgut

SEQ ID NO: 35390 - DNA, 22 bp, Artificial Sequence
  Synthetic
ctacagagaacauggctcguga

SEQ ID NO: 35391 - DNA, 19 bp, Artificial Sequence
  Synthetic
aggcaagggcutgcaguag

SEQ ID NO: 35392 - DNA, 21 bp, Artificial Sequence
  Synthetic
ctgctgugccctctttaguca

SEQ ID NO: 35393 - DNA, 19 bp, Artificial Sequence
  Synthetic
tcagcttcucctcccugct

SEQ ID NO: 35394 - DNA, 21 bp, Artificial Sequence
  Synthetic
tccctcguggtgtagagugat

SEQ ID NO: 35395 - DNA, 20 bp, Artificial Sequence
  Synthetic
tgggtgcguaactttgucga

SEQ ID NO: 35396 - DNA, 27 bp, Artificial Sequence
  Synthetic
gcttctgtcaguctttggtgaaacuag

SEQ ID NO: 35397 - DNA, 21 bp, Artificial Sequence
  Synthetic
caccatgcuctttgccucaga

SEQ ID NO: 35398 - DNA, 27 bp, Artificial Sequence
  Synthetic
catagttggguagagaaatcgctcuaa

SEQ ID NO: 35399 - DNA, 20 bp, Artificial Sequence
  Synthetic
ccccugaacaucagcgagac

SEQ ID NO: 35400 - DNA, 24 bp, Artificial Sequence
  Synthetic
ggacacagaucagcatggcuaaat

SEQ ID NO: 35401 - DNA, 21 bp, Artificial Sequence
  Synthetic
catcacccacutggcucaaga

SEQ ID NO: 35402 - DNA, 22 bp, Artificial Sequence
  Synthetic
agtttcucaacccccagacauc

SEQ ID NO: 35403 - DNA, 26 bp, Artificial Sequence
  Synthetic
gaatcggatauaacatcatccgggua

SEQ ID NO: 35404 - DNA, 22 bp, Artificial Sequence
  Synthetic
guatcaguacccagcgggaaac

SEQ ID NO: 35405 - DNA, 23 bp, Artificial Sequence
  Synthetic
cttcagccgcuatgagaguacac

SEQ ID NO: 35406 - DNA, 24 bp, Artificial Sequence
  Synthetic
actggaaggcuaccaaaggacuat

SEQ ID NO: 35407 - DNA, 21 bp, Artificial Sequence
  Synthetic
tgcccaggagaguagtugagg

SEQ ID NO: 35408 - DNA, 20 bp, Artificial Sequence
  Synthetic
actgcucacccagaaagugc

SEQ ID NO: 35409 - DNA, 21 bp, Artificial Sequence
  Synthetic
ttcctgctgucggacactuac

SEQ ID NO: 35410 - DNA, 23 bp, Artificial Sequence
  Synthetic
gctggutatttcacaucagagca

SEQ ID NO: 35411 - DNA, 23 bp, Artificial Sequence
  Synthetic
gctctctacccacuctaccccua

SEQ ID NO: 35412 - DNA, 24 bp, Artificial Sequence
  Synthetic
cctctatgtcccuttcccttccut

SEQ ID NO: 35413 - DNA, 25 bp, Artificial Sequence
  Synthetic
atgaagugggaaacctgatacucac

SEQ ID NO: 35414 - DNA, 21 bp, Artificial Sequence
  Synthetic
ctcagtcccuaagcccatcug

SEQ ID NO: 35415 - DNA, 25 bp, Artificial Sequence
  Synthetic
ctccctattggutctcctccagtua

SEQ ID NO: 35416 - DNA, 22 bp, Artificial Sequence
  Synthetic
gaccacagacaaugttcccuct

SEQ ID NO: 35417 - DNA, 24 bp, Artificial Sequence
  Synthetic
gtatgtgtagacugtgctcagugt

SEQ ID NO: 35418 - DNA, 22 bp, Artificial Sequence
  Synthetic
agttgggaagggauctguggat

SEQ ID NO: 35419 - DNA, 21 bp, Artificial Sequence
  Synthetic
ccacuggaaggccatttgaug

SEQ ID NO: 35420 - DNA, 22 bp, Artificial Sequence
  Synthetic
cctacctucttccctacugcac

SEQ ID NO: 35421 - DNA, 21 bp, Artificial Sequence
  Synthetic
cctggugagtggtccuacact

SEQ ID NO: 35422 - DNA, 26 bp, Artificial Sequence
  Synthetic
ttggcctcttautattggagtcaugg

SEQ ID NO: 35423 - DNA, 21 bp, Artificial Sequence
  Synthetic
gctguccacccaguaggagat

SEQ ID NO: 35424 - DNA, 23 bp, Artificial Sequence
  Synthetic
cactttgtcacugtcactgucct

SEQ ID NO: 35425 - DNA, 21 bp, Artificial Sequence
  Synthetic
cctgcattccutgggagacug

SEQ ID NO: 35426 - DNA, 23 bp, Artificial Sequence
  Synthetic
acagaaauggcctgugaaacaga

SEQ ID NO: 35427 - DNA, 24 bp, Artificial Sequence
  Synthetic
ggtgaacagugtctgatcatguga

SEQ ID NO: 35428 - DNA, 24 bp, Artificial Sequence
  Synthetic
gccacaatttucaccttaggugga

SEQ ID NO: 35429 - DNA, 28 bp, Artificial Sequence
  Synthetic
tgggcttttctcuatttcatgttccaut

SEQ ID NO: 35430 - DNA, 24 bp, Artificial Sequence
  Synthetic
ctcacatautttgcacaugacgct

SEQ ID NO: 35431 - DNA, 28 bp, Artificial Sequence
  Synthetic
aatcacattgtuctgattacccauccat

SEQ ID NO: 35432 - DNA, 26 bp, Artificial Sequence
  Synthetic
acagactugggatgatacucaaagca

SEQ ID NO: 35433 - DNA, 22 bp, Artificial Sequence
  Synthetic
aaactccuaaatgacgcuggct

SEQ ID NO: 35434 - DNA, 23 bp, Artificial Sequence
  Synthetic
ctctgagagcutttggaacugct

SEQ ID NO: 35435 - DNA, 21 bp, Artificial Sequence
  Synthetic
gccaggugcagtgtagtccua

SEQ ID NO: 35436 - DNA, 20 bp, Artificial Sequence
  Synthetic
cagaaugggtccucacacgt

SEQ ID NO: 35437 - DNA, 21 bp, Artificial Sequence
  Synthetic
autggtuacccgaggcagaag

SEQ ID NO: 35438 - DNA, 23 bp, Artificial Sequence
  Synthetic
atctcgaugaccatcaccttugg

SEQ ID NO: 35439 - DNA, 19 bp, Artificial Sequence
  Synthetic
cagtcgcucggtgacugat

SEQ ID NO: 35440 - DNA, 20 bp, Artificial Sequence
  Synthetic
ggaguagtcuccgcccagat

SEQ ID NO: 35441 - DNA, 22 bp, Artificial Sequence
  Synthetic
acttctttucccacccctccua

SEQ ID NO: 35442 - DNA, 23 bp, Artificial Sequence
  Synthetic
ggaggguttttgacgucacaagt

SEQ ID NO: 35443 - DNA, 24 bp, Artificial Sequence
  Synthetic
catgcttccccucattcctcauag

SEQ ID NO: 35444 - DNA, 22 bp, Artificial Sequence
  Synthetic
gattgcugagagacaccugagt

SEQ ID NO: 35445 - DNA, 24 bp, Artificial Sequence
  Synthetic
gggatttuaagcaggtuccaggaa

SEQ ID NO: 35446 - DNA, 27 bp, Artificial Sequence
  Synthetic
aagggatgacugtaattactuggaacc

SEQ ID NO: 35447 - DNA, 25 bp, Artificial Sequence
  Synthetic
ctgggaaacacaucatctcttugga

SEQ ID NO: 35448 - DNA, 30 bp, Artificial Sequence
  Synthetic
ttttcatactgtatcugccaaaaccattug

SEQ ID NO: 35449 - DNA, 22 bp, Artificial Sequence
  Synthetic
agcaucaaagacagccgatuct

SEQ ID NO: 35450 - DNA, 26 bp, Artificial Sequence
  Synthetic
tgactcaaacugccatgtatttcuca

SEQ ID NO: 35451 - DNA, 20 bp, Artificial Sequence
  Synthetic
acgagagucacccgaguacc

SEQ ID NO: 35452 - DNA, 19 bp, Artificial Sequence
  Synthetic
catgctgcucgtcacucga

SEQ ID NO: 35453 - DNA, 23 bp, Artificial Sequence
  Synthetic
cuaaaagccaguaggcataucac

SEQ ID NO: 35454 - DNA, 21 bp, Artificial Sequence
  Synthetic
cagagaccucggccattttug

SEQ ID NO: 35455 - DNA, 23 bp, Artificial Sequence
  Synthetic
aagccaatcacugctatggtuga

SEQ ID NO: 35456 - DNA, 22 bp, Artificial Sequence
  Synthetic
gggaaaatuacaggctggucct

SEQ ID NO: 35457 - DNA, 29 bp, Artificial Sequence
  Synthetic
cagttccaagcautcataaattctcacut

SEQ ID NO: 35458 - DNA, 23 bp, Artificial Sequence
  Synthetic
ggctgttuctcacagaucccaaa

SEQ ID NO: 35459 - DNA, 22 bp, Artificial Sequence
  Synthetic
aagcaaggcutctgaagtcucc

SEQ ID NO: 35460 - DNA, 28 bp, Artificial Sequence
  Synthetic
aagcacaaacugcattttgaatcuaagt

SEQ ID NO: 35461 - DNA, 30 bp, Artificial Sequence
  Synthetic
tgaggtagaagaugagaaggtagttaaugt

SEQ ID NO: 35462 - DNA, 20 bp, Artificial Sequence
  Synthetic
gtugaggcagcacaaagguc

SEQ ID NO: 35463 - DNA, 27 bp, Artificial Sequence
  Synthetic
catgttgtcacaguctttgtccaaaut

SEQ ID NO: 35464 - DNA, 22 bp, Artificial Sequence
  Synthetic
ccattggutcctguggcaagaa

SEQ ID NO: 35465 - DNA, 24 bp, Artificial Sequence
  Synthetic
ccutgatatccugggacacagaag

SEQ ID NO: 35466 - DNA, 24 bp, Artificial Sequence
  Synthetic
tttgacaagugctctgguaaacaa

SEQ ID NO: 35467 - DNA, 22 bp, Artificial Sequence
  Synthetic
gcatccugacaagtugcaccat

SEQ ID NO: 35468 - DNA, 21 bp, Artificial Sequence
  Synthetic
gccatgggucttgggttgaua

SEQ ID NO: 35469 - DNA, 23 bp, Artificial Sequence
  Synthetic
ccaacaaagaggcaucaagguct

SEQ ID NO: 35470 - DNA, 23 bp, Artificial Sequence
  Synthetic
gccagtauagcagtcaaccucct

SEQ ID NO: 35471 - DNA, 21 bp, Artificial Sequence
  Synthetic
agctccacacautccccatug

SEQ ID NO: 35472 - DNA, 28 bp, Artificial Sequence
  Synthetic
tcatgcactuctgcaagattauacaagt

SEQ ID NO: 35473 - DNA, 26 bp, Artificial Sequence
  Synthetic
caagttctcacaaguaccaccattut

SEQ ID NO: 35474 - DNA, 23 bp, Artificial Sequence
  Synthetic
gctgtacccaucagcaatgtcua

SEQ ID NO: 35475 - DNA, 25 bp, Artificial Sequence
  Synthetic
ctatgttacaaacugagccctuggt

SEQ ID NO: 35476 - DNA, 26 bp, Artificial Sequence
  Synthetic
aggtcaataatcagucaaaggtgcut

SEQ ID NO: 35477 - DNA, 29 bp, Artificial Sequence
  Synthetic
gcacatattgatugatcactttcaagugg

SEQ ID NO: 35478 - DNA, 27 bp, Artificial Sequence
  Synthetic
aattgattggaaucacattacccugga

SEQ ID NO: 35479 - DNA, 24 bp, Artificial Sequence
  Synthetic
ccatagcacucagctttctcucac

SEQ ID NO: 35480 - DNA, 26 bp, Artificial Sequence
  Synthetic
caggcttacutctagcttuggaaaac

SEQ ID NO: 35481 - DNA, 28 bp, Artificial Sequence
  Synthetic
tcgattttccacguagaagcagaaauaa

SEQ ID NO: 35482 - DNA, 26 bp, Artificial Sequence
  Synthetic
aatggtggattcutcaaaggctguat

SEQ ID NO: 35483 - DNA, 30 bp, Artificial Sequence
  Synthetic
acctagtttgtaugagtaatcattacctug

SEQ ID NO: 35484 - DNA, 21 bp, Artificial Sequence
  Synthetic
ctcacaagugggaaagccugt

SEQ ID NO: 35485 - DNA, 29 bp, Artificial Sequence
  Synthetic
aactggctttguctatactctttttcugt

SEQ ID NO: 35486 - DNA, 25 bp, Artificial Sequence
  Synthetic
gcaugcagaaaaagaguctgaatut

SEQ ID NO: 35487 - DNA, 23 bp, Artificial Sequence
  Synthetic
caautgtgctggucacaaaaggt

SEQ ID NO: 35488 - DNA, 23 bp, Artificial Sequence
  Synthetic
cctgcaagggugtctaaguacaa

SEQ ID NO: 35489 - DNA, 30 bp, Artificial Sequence
  Synthetic
gcaatgataagagcuatagatgtctucaca

SEQ ID NO: 35490 - DNA, 22 bp, Artificial Sequence
  Synthetic
acatgtgagccuggatacacug

SEQ ID NO: 35491 - DNA, 26 bp, Artificial Sequence
  Synthetic
accaagcttcauatggactttaugct

SEQ ID NO: 35492 - DNA, 28 bp, Artificial Sequence
  Synthetic
actttttcttcccauttcacaaccaaug

SEQ ID NO: 35493 - DNA, 25 bp, Artificial Sequence
  Synthetic
gagacauaaaaggagaggctgctua

SEQ ID NO: 35494 - DNA, 22 bp, Artificial Sequence
  Synthetic
cagtgactgucgccttgtuact

SEQ ID NO: 35495 - DNA, 22 bp, Artificial Sequence
  Synthetic
cgaagggacacaaugctccuaa

SEQ ID NO: 35496 - DNA, 23 bp, Artificial Sequence
  Synthetic
gcttgaauagaggaguccccaca

SEQ ID NO: 35497 - DNA, 20 bp, Artificial Sequence
  Synthetic
gcagtaucccccgccttuag

SEQ ID NO: 35498 - DNA, 27 bp, Artificial Sequence
  Synthetic
gctcaggguaatcttactagcuacaca

SEQ ID NO: 35499 - DNA, 20 bp, Artificial Sequence
  Synthetic
tccgugaccacatcaauggg

SEQ ID NO: 35500 - DNA, 22 bp, Artificial Sequence
  Synthetic
tgaatgcccaauagtccaugcc

SEQ ID NO: 35501 - DNA, 28 bp, Artificial Sequence
  Synthetic
tgacaatgacacugagactattcuacct

SEQ ID NO: 35502 - DNA, 21 bp, Artificial Sequence
  Synthetic
ggaggaagccauaatgccuca

SEQ ID NO: 35503 - DNA, 25 bp, Artificial Sequence
  Synthetic
acacattgatucactgttcacucat

SEQ ID NO: 35504 - DNA, 20 bp, Artificial Sequence
  Synthetic
gcaatgtccugcttggtcug

SEQ ID NO: 35505 - DNA, 21 bp, Artificial Sequence
  Synthetic
aggttagugggctccuacagt

SEQ ID NO: 35506 - DNA, 23 bp, Artificial Sequence
  Synthetic
ggcactggautgaatctgugagg

SEQ ID NO: 35507 - DNA, 22 bp, Artificial Sequence
  Synthetic
ccacatgtaagcugggttggut

SEQ ID NO: 35508 - DNA, 20 bp, Artificial Sequence
  Synthetic
gacauagcucaccagggcat

SEQ ID NO: 35509 - DNA, 23 bp, Artificial Sequence
  Synthetic
tcatggagatguctggctgttuc

SEQ ID NO: 35510 - DNA, 23 bp, Artificial Sequence
  Synthetic
cgagaagcaugaggaauggagat

SEQ ID NO: 35511 - DNA, 20 bp, Artificial Sequence
  Synthetic
gutgtccctuccgagagacc

SEQ ID NO: 35512 - DNA, 26 bp, Artificial Sequence
  Synthetic
agcactgtgaaaaugcctttaaacug

SEQ ID NO: 35513 - DNA, 28 bp, Artificial Sequence
  Synthetic
ctagaugcaaagagtaagatugagcaga

SEQ ID NO: 35514 - DNA, 21 bp, Artificial Sequence
  Synthetic
ggcatugcggagtcuaccaaa

SEQ ID NO: 35515 - DNA, 23 bp, Artificial Sequence
  Synthetic
cctagcctgugactgtgattucc

SEQ ID NO: 35516 - DNA, 18 bp, Artificial Sequence
  Synthetic
cgucccccaggcttugag

SEQ ID NO: 35517 - DNA, 23 bp, Artificial Sequence
  Synthetic
aatctaggacacagucccugaca

SEQ ID NO: 35518 - DNA, 19 bp, Artificial Sequence
  Synthetic
attugggacccaccacgut

SEQ ID NO: 35519 - DNA, 21 bp, Artificial Sequence
  Synthetic
gccaugtcatcugcagggaag

SEQ ID NO: 35520 - DNA, 21 bp, Artificial Sequence
  Synthetic
gtaggugagtccagugaagcc

SEQ ID NO: 35521 - DNA, 21 bp, Artificial Sequence
  Synthetic
gctcctggaauctgctcugaa

SEQ ID NO: 35522 - DNA, 20 bp, Artificial Sequence
  Synthetic
cggtuccggaaatagugcag

SEQ ID NO: 35523 - DNA, 22 bp, Artificial Sequence
  Synthetic
caaaggtgugggtcagatguca

SEQ ID NO: 35524 - DNA, 25 bp, Artificial Sequence
  Synthetic
cttagatttagugcccttcctgcut

SEQ ID NO: 35525 - DNA, 22 bp, Artificial Sequence
  Synthetic
ctactatgctgugtcccagcuc

SEQ ID NO: 35526 - DNA, 21 bp, Artificial Sequence
  Synthetic
ggcaaguagggcaaguaucaa

SEQ ID NO: 35527 - DNA, 24 bp, Artificial Sequence
  Synthetic
cttctctttcccutccctctguag

SEQ ID NO: 35528 - DNA, 19 bp, Artificial Sequence
  Synthetic
acucgccaggtctuaccga

SEQ ID NO: 35529 - DNA, 21 bp, Artificial Sequence
  Synthetic
tgtggtaugccaggaggttug

SEQ ID NO: 35530 - DNA, 21 bp, Artificial Sequence
  Synthetic
cctgtggaggcugtacagtut

SEQ ID NO: 35531 - DNA, 23 bp, Artificial Sequence
  Synthetic
tgagtgtctgcuatctccctcuc

SEQ ID NO: 35532 - DNA, 22 bp, Artificial Sequence
  Synthetic
actgaagggacuacaggugaca

SEQ ID NO: 35533 - DNA, 22 bp, Artificial Sequence
  Synthetic
gcactgttguacccagttugct

SEQ ID NO: 35534 - DNA, 24 bp, Artificial Sequence
  Synthetic
ttggaaaatgcuggagctcuagac

SEQ ID NO: 35535 - DNA, 23 bp, Artificial Sequence
  Synthetic
actaggtctuggccctttcuaca

SEQ ID NO: 35536 - DNA, 22 bp, Artificial Sequence
  Synthetic
accaggcagguaaagacaggua

SEQ ID NO: 35537 - DNA, 20 bp, Artificial Sequence
  Synthetic
cagtgacgacagaugggugt

SEQ ID NO: 35538 - DNA, 22 bp, Artificial Sequence
  Synthetic
tgcattccagggutacgtctuc

SEQ ID NO: 35539 - DNA, 30 bp, Artificial Sequence
  Synthetic
ttgatagcaagtaugtagccaatgatgaut

SEQ ID NO: 35540 - DNA, 26 bp, Artificial Sequence
  Synthetic
acagtgagttguccatcaagacttuc

SEQ ID NO: 35541 - DNA, 27 bp, Artificial Sequence
  Synthetic
gaaatacucacagcaacttccttcuca

SEQ ID NO: 35542 - DNA, 27 bp, Artificial Sequence
  Synthetic
ggctctttguggatttttctttguagt

SEQ ID NO: 35543 - DNA, 28 bp, Artificial Sequence
  Synthetic
ccagagaugacaaaaatgctttcugaaa

SEQ ID NO: 35544 - DNA, 25 bp, Artificial Sequence
  Synthetic
tctgctggucagctttcagattuag

SEQ ID NO: 35545 - DNA, 21 bp, Artificial Sequence
  Synthetic
gaacggccaacugaaggagua

SEQ ID NO: 35546 - DNA, 26 bp, Artificial Sequence
  Synthetic
gtttttaaaaguggcttctccgagut

SEQ ID NO: 35547 - DNA, 23 bp, Artificial Sequence
  Synthetic
ccacatacaagcugagagtggug

SEQ ID NO: 35548 - DNA, 22 bp, Artificial Sequence
  Synthetic
catccttcugcctgacccatua

SEQ ID NO: 35549 - DNA, 24 bp, Artificial Sequence
  Synthetic
gccttcaagccutcactaacuact

SEQ ID NO: 35550 - DNA, 29 bp, Artificial Sequence
  Synthetic
tgatttttaaaagucaaccagtccuggat

SEQ ID NO: 35551 - DNA, 25 bp, Artificial Sequence
  Synthetic
ccacgttccaugtgatctcttcuac

SEQ ID NO: 35552 - DNA, 27 bp, Artificial Sequence
  Synthetic
tctttaagtgccutttcaaattgugca

SEQ ID NO: 35553 - DNA, 27 bp, Artificial Sequence
  Synthetic
aatagcaacucagcctagaaaauccaa

SEQ ID NO: 35554 - DNA, 24 bp, Artificial Sequence
  Synthetic
gttgcaucaaaggtgcaatcucag

SEQ ID NO: 35555 - DNA, 28 bp, Artificial Sequence
  Synthetic
cctggtgtttuaaagattcttcccauga

SEQ ID NO: 35556 - DNA, 27 bp, Artificial Sequence
  Synthetic
caaatagttcacggaugaagaggguat

SEQ ID NO: 35557 - DNA, 22 bp, Artificial Sequence
  Synthetic
cuacacagtaacugccagcaac

SEQ ID NO: 35558 - DNA, 27 bp, Artificial Sequence
  Synthetic
agttcataacttcugatctggccatut

SEQ ID NO: 35559 - DNA, 28 bp, Artificial Sequence
  Synthetic
gccttactctcaguataacttctcccut

SEQ ID NO: 35560 - DNA, 26 bp, Artificial Sequence
  Synthetic
catacattcattugagtggcacugac

SEQ ID NO: 35561 - DNA, 25 bp, Artificial Sequence
  Synthetic
aggcttcaaaggaaugaaatgcuct

SEQ ID NO: 35562 - DNA, 24 bp, Artificial Sequence
  Synthetic
aatgtccucaccacatuccaagag

SEQ ID NO: 35563 - DNA, 23 bp, Artificial Sequence
  Synthetic
cgctatgaagugattcgcagaug

SEQ ID NO: 35564 - DNA, 21 bp, Artificial Sequence
  Synthetic
ggcutcatctguccacagagg

SEQ ID NO: 35565 - DNA, 28 bp, Artificial Sequence
  Synthetic
ctacacaaagaaautgtatgcugcaagt

SEQ ID NO: 35566 - DNA, 27 bp, Artificial Sequence
  Synthetic
gggaagattcuaaggtttgaaucagag

SEQ ID NO: 35567 - DNA, 28 bp, Artificial Sequence
  Synthetic
ggttcagagaaugactttccagcaauat

SEQ ID NO: 35568 - DNA, 24 bp, Artificial Sequence
  Synthetic
cccaaggagcuggaaaatctugag

SEQ ID NO: 35569 - DNA, 21 bp, Artificial Sequence
  Synthetic
gcctgctuggtttccttucag

SEQ ID NO: 35570 - DNA, 31 bp, Artificial Sequence
  Synthetic
gtctttatattuggactgagaatgtatucct

SEQ ID NO: 35571 - DNA, 24 bp, Artificial Sequence
  Synthetic
ggtcatcatcaauccacccttcug

SEQ ID NO: 35572 - DNA, 29 bp, Artificial Sequence
  Synthetic
tccuttaaaatgttuacacacacacacac

SEQ ID NO: 35573 - DNA, 28 bp, Artificial Sequence
  Synthetic
gcagtgctagugatgattacattgtuca

SEQ ID NO: 35574 - DNA, 29 bp, Artificial Sequence
  Synthetic
aacaatttaacaacuttcagtgggacaug

SEQ ID NO: 35575 - DNA, 27 bp, Artificial Sequence
  Synthetic
caatggcctcguttctcaatatcaaut

SEQ ID NO: 35576 - DNA, 28 bp, Artificial Sequence
  Synthetic
gttatgaaggaguttacagatuccacct

SEQ ID NO: 35577 - DNA, 29 bp, Artificial Sequence
  Synthetic
tgcactttatttcutgcttgctttttcua

SEQ ID NO: 35578 - DNA, 22 bp, Artificial Sequence
  Synthetic
cagtgtggaugagaccttuccc

SEQ ID NO: 35579 - DNA, 26 bp, Artificial Sequence
  Synthetic
attgctgcttaautcctacgtctuca

SEQ ID NO: 35580 - DNA, 27 bp, Artificial Sequence
  Synthetic
ggttagatgcauagggcaattaaaugt

SEQ ID NO: 35581 - DNA, 22 bp, Artificial Sequence
  Synthetic
gatgtgccucaaggagtgaguc

SEQ ID NO: 35582 - DNA, 26 bp, Artificial Sequence
  Synthetic
agtttaaggagagutgatgucagagt

SEQ ID NO: 35583 - DNA, 26 bp, Artificial Sequence
  Synthetic
gataagaggguctcacaatuccacag

SEQ ID NO: 35584 - DNA, 22 bp, Artificial Sequence
  Synthetic
cgccuccgagagcttttctauc

SEQ ID NO: 35585 - DNA, 25 bp, Artificial Sequence
  Synthetic
tccagtggagaguctaaagcacaua

SEQ ID NO: 35586 - DNA, 26 bp, Artificial Sequence
  Synthetic
tctagggcaaauttctcactctcuct

SEQ ID NO: 35587 - DNA, 20 bp, Artificial Sequence
  Synthetic
tgtggcagaaugccgtacuc

SEQ ID NO: 35588 - DNA, 26 bp, Artificial Sequence
  Synthetic
cccatagtttutgagtacaccuggaa

SEQ ID NO: 35589 - DNA, 27 bp, Artificial Sequence
  Synthetic
ttcaaacttucaggtttgttguaacgg

SEQ ID NO: 35590 - DNA, 22 bp, Artificial Sequence
  Synthetic
gctcatcacuctgatccugcac

SEQ ID NO: 35591 - DNA, 28 bp, Artificial Sequence
  Synthetic
tgccacttttuacttaagactgauagca

SEQ ID NO: 35592 - DNA, 25 bp, Artificial Sequence
  Synthetic
gtgggtgtuggtatatcactuggag

SEQ ID NO: 35593 - DNA, 27 bp, Artificial Sequence
  Synthetic
ggaaggtgggautcagactattgtuag

SEQ ID NO: 35594 - DNA, 23 bp, Artificial Sequence
  Synthetic
actcagugacaacaccattuggg

SEQ ID NO: 35595 - DNA, 28 bp, Artificial Sequence
  Synthetic
gcatttagctuaacatgtgcttttucag

SEQ ID NO: 35596 - DNA, 24 bp, Artificial Sequence
  Synthetic
tguggactccatugaagacagaga

SEQ ID NO: 35597 - DNA, 26 bp, Artificial Sequence
  Synthetic
ccatgtccugcatttattgtugacag

SEQ ID NO: 35598 - DNA, 22 bp, Artificial Sequence
  Synthetic
tgagattggcucctctctcugg

SEQ ID NO: 35599 - DNA, 28 bp, Artificial Sequence
  Synthetic
ggaaggaaaucctgtattttgugaagaa

SEQ ID NO: 35600 - DNA, 26 bp, Artificial Sequence
  Synthetic
ggaataaaagccuccttcattuccct

SEQ ID NO: 35601 - DNA, 22 bp, Artificial Sequence
  Synthetic
cccaccguacctcagaatgtug

SEQ ID NO: 35602 - DNA, 21 bp, Artificial Sequence
  Synthetic
actgcggaagucacattggut

SEQ ID NO: 35603 - DNA, 21 bp, Artificial Sequence
  Synthetic
ggcctcgugaacttcaatugc

SEQ ID NO: 35604 - DNA, 23 bp, Artificial Sequence
  Synthetic
agagtgctcaucagtacccgaua

SEQ ID NO: 35605 - DNA, 25 bp, Artificial Sequence
  Synthetic
cagagctgutctctgatacuccaac

SEQ ID NO: 35606 - DNA, 24 bp, Artificial Sequence
  Synthetic
gcagtgtaugggtgtaaatgcauc

SEQ ID NO: 35607 - DNA, 25 bp, Artificial Sequence
  Synthetic
ccaagaggtcugactttctggatut

SEQ ID NO: 35608 - DNA, 27 bp, Artificial Sequence
  Synthetic
tgtataacccagcugatagaauggaca

SEQ ID NO: 35609 - DNA, 28 bp, Artificial Sequence
  Synthetic
ctgctctaatucatctgtgttttucgac

SEQ ID NO: 35610 - DNA, 28 bp, Artificial Sequence
  Synthetic
aggcattgcaatugttataggatcagut

SEQ ID NO: 35611 - DNA, 30 bp, Artificial Sequence
  Synthetic
cagtaggtaataacuacacccttctgaaug

SEQ ID NO: 35612 - DNA, 22 bp, Artificial Sequence
  Synthetic
gaguccatuagggcgaaaaggt

SEQ ID NO: 35613 - DNA, 29 bp, Artificial Sequence
  Synthetic
tttactucacaguaaaaagagattcttug

SEQ ID NO: 35614 - DNA, 27 bp, Artificial Sequence
  Synthetic
ggactcugaaggaatgtaaacuccaag

SEQ ID NO: 35615 - DNA, 28 bp, Artificial Sequence
  Synthetic
cttgctttctuaagaccttctttgcuat

SEQ ID NO: 35616 - DNA, 23 bp, Artificial Sequence
  Synthetic
ggtgaataugagtgggcttuggg

SEQ ID NO: 35617 - DNA, 28 bp, Artificial Sequence
  Synthetic
ttcctcaatgtucatgaaaactttuggg

SEQ ID NO: 35618 - DNA, 30 bp, Artificial Sequence
  Synthetic
catatgatccuggaaaagttctgtactgut

SEQ ID NO: 35619 - DNA, 28 bp, Artificial Sequence
  Synthetic
aaaaagtgucacaaatccaagtucaaat

SEQ ID NO: 35620 - DNA, 23 bp, Artificial Sequence
  Synthetic
tgcagatauggaacccctggaua

SEQ ID NO: 35621 - DNA, 30 bp, Artificial Sequence
  Synthetic
ccaaaaaggcaaauggtattataacucagt

SEQ ID NO: 35622 - DNA, 27 bp, Artificial Sequence
  Synthetic
ttcatgacugaaatgtggaagucaaga

SEQ ID NO: 35623 - DNA, 23 bp, Artificial Sequence
  Synthetic
gtaaacacgcaacccuctttugt

SEQ ID NO: 35624 - DNA, 27 bp, Artificial Sequence
  Synthetic
ctgtcctcactauaggctttcagaaug

SEQ ID NO: 35625 - DNA, 28 bp, Artificial Sequence
  Synthetic
agaactgccattutccctattttctcut

SEQ ID NO: 35626 - DNA, 25 bp, Artificial Sequence
  Synthetic
tttagaggaccuccacattaccugt

SEQ ID NO: 35627 - DNA, 23 bp, Artificial Sequence
  Synthetic
cgttaactuggcatctgtgucca

SEQ ID NO: 35628 - DNA, 27 bp, Artificial Sequence
  Synthetic
autgctatctctugaaacacagaacca

SEQ ID NO: 35629 - DNA, 27 bp, Artificial Sequence
  Synthetic
ctttcataucagcaagtgtgaauggac

SEQ ID NO: 35630 - DNA, 28 bp, Artificial Sequence
  Synthetic
taaagaaaccccaautaagtgtaaugcc

SEQ ID NO: 35631 - DNA, 28 bp, Artificial Sequence
  Synthetic
tggtggaatgaacuttgagatttcctut

SEQ ID NO: 35632 - DNA, 27 bp, Artificial Sequence
  Synthetic
gaggucaagttaaucaaacaggagaga

SEQ ID NO: 35633 - DNA, 25 bp, Artificial Sequence
  Synthetic
tggcagagtuctgaagaacaaauca

SEQ ID NO: 35634 - DNA, 31 bp, Artificial Sequence
  Synthetic
aaacaggttctautctaagtttggaugacaa

SEQ ID NO: 35635 - DNA, 28 bp, Artificial Sequence
  Synthetic
aaggtgtatttcucatctcctcttcuct

SEQ ID NO: 35636 - DNA, 25 bp, Artificial Sequence
  Synthetic
caaaagccugatgcctaauagcaat

SEQ ID NO: 35637 - DNA, 33 bp, Artificial Sequence
  Synthetic
ttgtaaattggtttauaacaaatatgtgtgugt

SEQ ID NO: 35638 - DNA, 28 bp, Artificial Sequence
  Synthetic
tttttcctttcctucacttacctgacut

SEQ ID NO: 35639 - DNA, 26 bp, Artificial Sequence
  Synthetic
acagacttcacuggtaagtgtgttug

SEQ ID NO: 35640 - DNA, 23 bp, Artificial Sequence
  Synthetic
tggtcaucagagctgguagagat

SEQ ID NO: 35641 - DNA, 29 bp, Artificial Sequence
  Synthetic
tgtcuagagacagaaaucaaattctugaa

SEQ ID NO: 35642 - DNA, 31 bp, Artificial Sequence
  Synthetic
ccaactgaatugcagagagtaataguaaact

SEQ ID NO: 35643 - DNA, 24 bp, Artificial Sequence
  Synthetic
ccctctguctgaattcauggaact

SEQ ID NO: 35644 - DNA, 29 bp, Artificial Sequence
  Synthetic
catattgatgtcauaccccacaactttuc

SEQ ID NO: 35645 - DNA, 25 bp, Artificial Sequence
  Synthetic
gggacgacautcattgttttgaugt

SEQ ID NO: 35646 - DNA, 24 bp, Artificial Sequence
  Synthetic
tggttgtcatugtttgaggaggut

SEQ ID NO: 35647 - DNA, 29 bp, Artificial Sequence
  Synthetic
gtctgatgagtuacgtaggttcactatut

SEQ ID NO: 35648 - DNA, 28 bp, Artificial Sequence
  Synthetic
gtacagaaaaaucgtacttggcaaaugg

SEQ ID NO: 35649 - DNA, 22 bp, Artificial Sequence
  Synthetic
gtcccagagggaaacutgacut

SEQ ID NO: 35650 - DNA, 26 bp, Artificial Sequence
  Synthetic
gaaaccacaacagcauttatccucaa

SEQ ID NO: 35651 - DNA, 22 bp, Artificial Sequence
  Synthetic
ctgattctccaaaugcccacug

SEQ ID NO: 35652 - DNA, 24 bp, Artificial Sequence
  Synthetic
agcctttctgaugggttctaaaug

SEQ ID NO: 35653 - DNA, 27 bp, Artificial Sequence
  Synthetic
gtaaacaattugtcactggcucaaagt

SEQ ID NO: 35654 - DNA, 24 bp, Artificial Sequence
  Synthetic
gaagttatugctttgcaacugcca

SEQ ID NO: 35655 - DNA, 26 bp, Artificial Sequence
  Synthetic
aactggtgcagutaatcacatctgua

SEQ ID NO: 35656 - DNA, 26 bp, Artificial Sequence
  Synthetic
aggaatgtcatugtgcactgaaaaug

SEQ ID NO: 35657 - DNA, 23 bp, Artificial Sequence
  Synthetic
aggtcttcgcugtaatcagtgug

SEQ ID NO: 35658 - DNA, 25 bp, Artificial Sequence
  Synthetic
cctccaaacauttattgcactguct

SEQ ID NO: 35659 - DNA, 24 bp, Artificial Sequence
  Synthetic
caaattctgcaaucctcactcugg

SEQ ID NO: 35660 - DNA, 27 bp, Artificial Sequence
  Synthetic
tccagatggtaauagagatgtgacugt

SEQ ID NO: 35661 - DNA, 27 bp, Artificial Sequence
  Synthetic
cagtgccagaauggattctacaatcua

SEQ ID NO: 35662 - DNA, 26 bp, Artificial Sequence
  Synthetic
acatccaaauaagtttcuggcagaca

SEQ ID NO: 35663 - DNA, 23 bp, Artificial Sequence
  Synthetic
tgcataaccuttccctgaugcag

SEQ ID NO: 35664 - DNA, 24 bp, Artificial Sequence
  Synthetic
ttgtaatggcagcutttggaaugg

SEQ ID NO: 35665 - DNA, 30 bp, Artificial Sequence
  Synthetic
tctggtgaaaggccuaacatatcaauaaaa

SEQ ID NO: 35666 - DNA, 25 bp, Artificial Sequence
  Synthetic
agtacugcccatgaaaaugaaacct

SEQ ID NO: 35667 - DNA, 29 bp, Artificial Sequence
  Synthetic
tctcaacatttugatttctgtttugccaa

SEQ ID NO: 35668 - DNA, 26 bp, Artificial Sequence
  Synthetic
gaaagctgaagacagutgacagaauc

SEQ ID NO: 35669 - DNA, 28 bp, Artificial Sequence
  Synthetic
atcatucagttctttaguccacaaccaa

SEQ ID NO: 35670 - DNA, 23 bp, Artificial Sequence
  Synthetic
acaaaagagagaggaugggctuc

SEQ ID NO: 35671 - DNA, 24 bp, Artificial Sequence
  Synthetic
gtccttacaguctccctctugact

SEQ ID NO: 35672 - DNA, 26 bp, Artificial Sequence
  Synthetic
atactgctgcagautttgtgaguaga

SEQ ID NO: 35673 - DNA, 29 bp, Artificial Sequence
  Synthetic
ggtttgcaaccuccaataaaagtaaugac

SEQ ID NO: 35674 - DNA, 28 bp, Artificial Sequence
  Synthetic
aatgatcttcacuactactggtttuggg

SEQ ID NO: 35675 - DNA, 23 bp, Artificial Sequence
  Synthetic
ctgcaucacaccagacaagaaug

SEQ ID NO: 35676 - DNA, 22 bp, Artificial Sequence
  Synthetic
ctgggaguccacatactgctug

SEQ ID NO: 35677 - DNA, 27 bp, Artificial Sequence
  Synthetic
tgctttaucaggaggagaatgutttut

SEQ ID NO: 35678 - DNA, 20 bp, Artificial Sequence
  Synthetic
tgtgtccaaguctccagguc

SEQ ID NO: 35679 - DNA, 21 bp, Artificial Sequence
  Synthetic
cattagggacguccgctcauc

SEQ ID NO: 35680 - DNA, 22 bp, Artificial Sequence
  Synthetic
ctggtuccaaaaatccgugcat

SEQ ID NO: 35681 - DNA, 22 bp, Artificial Sequence
  Synthetic
aaacagcatgaucacgtgctuc

SEQ ID NO: 35682 - DNA, 22 bp, Artificial Sequence
  Synthetic
ccctagcagguccagaaucact

SEQ ID NO: 35683 - DNA, 23 bp, Artificial Sequence
  Synthetic
cgatgacgcugatcatgaugagg

SEQ ID NO: 35684 - DNA, 22 bp, Artificial Sequence
  Synthetic
gaagagcatucaggcttgggua

SEQ ID NO: 35685 - DNA, 21 bp, Artificial Sequence
  Synthetic
ggaccctgcugcttatctguc

SEQ ID NO: 35686 - DNA, 20 bp, Artificial Sequence
  Synthetic
atggtgugcatccacuggaa

SEQ ID NO: 35687 - DNA, 19 bp, Artificial Sequence
  Synthetic
gatttggcccuggacaucg

SEQ ID NO: 35688 - DNA, 21 bp, Artificial Sequence
  Synthetic
ccgcctgagaugtgaacctut

SEQ ID NO: 35689 - DNA, 22 bp, Artificial Sequence
  Synthetic
gaacucatgcctcucagggaag

SEQ ID NO: 35690 - DNA, 17 bp, Artificial Sequence
  Synthetic
gagcagcugggcctuct

SEQ ID NO: 35691 - DNA, 18 bp, Artificial Sequence
  Synthetic
gcauccccagccacucac

SEQ ID NO: 35692 - DNA, 22 bp, Artificial Sequence
  Synthetic
ctgcutgctgtgtucaagaagg

SEQ ID NO: 35693 - DNA, 24 bp, Artificial Sequence
  Synthetic
ccaatgaaaatuccctgcagctug

SEQ ID NO: 35694 - DNA, 27 bp, Artificial Sequence
  Synthetic
atttgtcauagcaccaggtatauagga

SEQ ID NO: 35695 - DNA, 23 bp, Artificial Sequence
  Synthetic
ctacttcctguctgctgtgaugg

SEQ ID NO: 35696 - DNA, 22 bp, Artificial Sequence
  Synthetic
gcctccgugtagatgatctucc

SEQ ID NO: 35697 - DNA, 26 bp, Artificial Sequence
  Synthetic
catccaatacagcccugaaactgtua

SEQ ID NO: 35698 - DNA, 25 bp, Artificial Sequence
  Synthetic
cggaugttaggttuaagaagaggct

SEQ ID NO: 35699 - DNA, 27 bp, Artificial Sequence
  Synthetic
gaacctgttcccutacagttctctuac

SEQ ID NO: 35700 - DNA, 23 bp, Artificial Sequence
  Synthetic
ccaugtagtugccagagcagaat

SEQ ID NO: 35701 - DNA, 30 bp, Artificial Sequence
  Synthetic
agttaactaacaaugaacaagatccttugt

SEQ ID NO: 35702 - DNA, 25 bp, Artificial Sequence
  Synthetic
aagaaaagguaggaaaacgguggaa

SEQ ID NO: 35703 - DNA, 29 bp, Artificial Sequence
  Synthetic
gcaggcaaacaugaaagatatcaaagauc

SEQ ID NO: 35704 - DNA, 17 bp, Artificial Sequence
  Synthetic
cccagccuagcccacug

SEQ ID NO: 35705 - DNA, 22 bp, Artificial Sequence
  Synthetic
agaggaugaagacccucagcat

SEQ ID NO: 35706 - DNA, 18 bp, Artificial Sequence
  Synthetic
cctcucccaggcatuggt

SEQ ID NO: 35707 - DNA, 19 bp, Artificial Sequence
  Synthetic
cggtcctucttcgcacugg

SEQ ID NO: 35708 - DNA, 23 bp, Artificial Sequence
  Synthetic
tctcagaagcugagcctaacuca

SEQ ID NO: 35709 - DNA, 21 bp, Artificial Sequence
  Synthetic
ccctaacutgtcccugcagac

SEQ ID NO: 35710 - DNA, 21 bp, Artificial Sequence
  Synthetic
cagggtgccutaggctagtut

SEQ ID NO: 35711 - DNA, 22 bp, Artificial Sequence
  Synthetic
caatgcctuggaccttaaccug

SEQ ID NO: 35712 - DNA, 23 bp, Artificial Sequence
  Synthetic
gtgcagtaggutggtttcctuca

SEQ ID NO: 35713 - DNA, 23 bp, Artificial Sequence
  Synthetic
agctagugagacagtuacaggga

SEQ ID NO: 35714 - DNA, 24 bp, Artificial Sequence
  Synthetic
caaggaaacuaccttcacgtccuc

SEQ ID NO: 35715 - DNA, 21 bp, Artificial Sequence
  Synthetic
cttccccugaagcuggacaaa

SEQ ID NO: 35716 - DNA, 23 bp, Artificial Sequence
  Synthetic
catcaagccugtggtcaaggtua

SEQ ID NO: 35717 - DNA, 28 bp, Artificial Sequence
  Synthetic
ccatacgtaaacacucttgaatgaatug

SEQ ID NO: 35718 - DNA, 24 bp, Artificial Sequence
  Synthetic
aagtgtuggcagttattgttuggg

SEQ ID NO: 35719 - DNA, 29 bp, Artificial Sequence
  Synthetic
agtgagaacugactgctttcauagaaaat

SEQ ID NO: 35720 - DNA, 23 bp, Artificial Sequence
  Synthetic
gggtcttcugattctgggaucac

SEQ ID NO: 35721 - DNA, 24 bp, Artificial Sequence
  Synthetic
gaagacccagggaaaugtacucac

SEQ ID NO: 35722 - DNA, 23 bp, Artificial Sequence
  Synthetic
gggacagucagggtttuagagga

SEQ ID NO: 35723 - DNA, 20 bp, Artificial Sequence
  Synthetic
gaaaguccccucccgagaga

SEQ ID NO: 35724 - DNA, 21 bp, Artificial Sequence
  Synthetic
catccugccagtaucccagac

SEQ ID NO: 35725 - DNA, 26 bp, Artificial Sequence
  Synthetic
ccctaaagacuccaagacucagaact

SEQ ID NO: 35726 - DNA, 22 bp, Artificial Sequence
  Synthetic
ccatccacagccugttcatgua

SEQ ID NO: 35727 - DNA, 23 bp, Artificial Sequence
  Synthetic
cucaggcaaaucaaaaaccccat

SEQ ID NO: 35728 - DNA, 20 bp, Artificial Sequence
  Synthetic
gctccttgugacctgaccuc

SEQ ID NO: 35729 - DNA, 20 bp, Artificial Sequence
  Synthetic
caugacaccucaaggccagt

SEQ ID NO: 35730 - DNA, 22 bp, Artificial Sequence
  Synthetic
gggaacaagutcgacaugacct

SEQ ID NO: 35731 - DNA, 22 bp, Artificial Sequence
  Synthetic
gagtagactcuggcagcttucc

SEQ ID NO: 35732 - DNA, 17 bp, Artificial Sequence
  Synthetic
accctcugccctguggt

SEQ ID NO: 35733 - DNA, 20 bp, Artificial Sequence
  Synthetic
cagtugagccaggagaggug

SEQ ID NO: 35734 - DNA, 21 bp, Artificial Sequence
  Synthetic
ggaccaguacctguaccagct

SEQ ID NO: 35735 - DNA, 21 bp, Artificial Sequence
  Synthetic
ttgtcccugccagttctgaug

SEQ ID NO: 35736 - DNA, 22 bp, Artificial Sequence
  Synthetic
gactgtggguttctgtcctuct

SEQ ID NO: 35737 - DNA, 20 bp, Artificial Sequence
  Synthetic
caaggcagcuccaggtagug

SEQ ID NO: 35738 - DNA, 22 bp, Artificial Sequence
  Synthetic
accccaagutttctgacgucac

SEQ ID NO: 35739 - DNA, 21 bp, Artificial Sequence
  Synthetic
caaaaggagggugcaguccat

SEQ ID NO: 35740 - DNA, 23 bp, Artificial Sequence
  Synthetic
ctgtctgtcucctctcattgcut

SEQ ID NO: 35741 - DNA, 20 bp, Artificial Sequence
  Synthetic
cautcagtcguccccaccag

SEQ ID NO: 35742 - DNA, 21 bp, Artificial Sequence
  Synthetic
tctgagtcugccccttctcut

SEQ ID NO: 35743 - DNA, 20 bp, Artificial Sequence
  Synthetic
gacaagugcagccccacaua

SEQ ID NO: 35744 - DNA, 22 bp, Artificial Sequence
  Synthetic
ctcactcuggcacctctgttut

SEQ ID NO: 35745 - DNA, 24 bp, Artificial Sequence
  Synthetic
gatgtctccautcccagatcucag

SEQ ID NO: 35746 - DNA, 20 bp, Artificial Sequence
  Synthetic
ggaccagacgcucatctuct

SEQ ID NO: 35747 - DNA, 20 bp, Artificial Sequence
  Synthetic
agaccccaccuttgcacaug

SEQ ID NO: 35748 - DNA, 22 bp, Artificial Sequence
  Synthetic
atggactguctgatcacugaca

SEQ ID NO: 35749 - DNA, 26 bp, Artificial Sequence
  Synthetic
gcaatcagttugaagaaggaaagguc

SEQ ID NO: 35750 - DNA, 27 bp, Artificial Sequence
  Synthetic
cacttggcattuctttctgtcctauct

SEQ ID NO: 35751 - DNA, 17 bp, Artificial Sequence
  Synthetic
ggacggcucaccucgat

SEQ ID NO: 35752 - DNA, 21 bp, Artificial Sequence
  Synthetic
gcagtccugtgtcaucaggaa

SEQ ID NO: 35753 - DNA, 19 bp, Artificial Sequence
  Synthetic
aucccgcagggaatuggag

SEQ ID NO: 35754 - DNA, 22 bp, Artificial Sequence
  Synthetic
gtcttgtctuggtcccttggut

SEQ ID NO: 35755 - DNA, 20 bp, Artificial Sequence
  Synthetic
ctggaggaugcccatccuac

SEQ ID NO: 35756 - DNA, 23 bp, Artificial Sequence
  Synthetic
gggtttccaacuctgaagaaugc

SEQ ID NO: 35757 - DNA, 23 bp, Artificial Sequence
  Synthetic
gtcagacugaagagaggcctuac

SEQ ID NO: 35758 - DNA, 26 bp, Artificial Sequence
  Synthetic
cacagccaaaccauatcaacaaugat

SEQ ID NO: 35759 - DNA, 22 bp, Artificial Sequence
  Synthetic
gccaaatgcucggacaatguag

SEQ ID NO: 35760 - DNA, 22 bp, Artificial Sequence
  Synthetic
ggcactcaugaagccucaaaga

SEQ ID NO: 35761 - DNA, 23 bp, Artificial Sequence
  Synthetic
agacccaagaugccccaattuac

SEQ ID NO: 35762 - DNA, 26 bp, Artificial Sequence
  Synthetic
tctctatgactaugacctcctcucca

SEQ ID NO: 35763 - DNA, 23 bp, Artificial Sequence
  Synthetic
ggugtgttgucagagaagacagg

SEQ ID NO: 35764 - DNA, 20 bp, Artificial Sequence
  Synthetic
ctgggcagccccautatcuc

SEQ ID NO: 35765 - DNA, 20 bp, Artificial Sequence
  Synthetic
cccaagggucaaggtccuac

SEQ ID NO: 35766 - DNA, 28 bp, Artificial Sequence
  Synthetic
tctaggtggatuagagtgataccttucc

SEQ ID NO: 35767 - DNA, 19 bp, Artificial Sequence
  Synthetic
ttcccutcccugagccaga

SEQ ID NO: 35768 - DNA, 22 bp, Artificial Sequence
  Synthetic
aagggaacacugcctctctcua

SEQ ID NO: 35769 - DNA, 24 bp, Artificial Sequence
  Synthetic
tgggattcuagcaatagcgctuac

SEQ ID NO: 35770 - DNA, 22 bp, Artificial Sequence
  Synthetic
ccctaaccaagugctctctguc

SEQ ID NO: 35771 - DNA, 21 bp, Artificial Sequence
  Synthetic
ctcctggacugtggcctauac

SEQ ID NO: 35772 - DNA, 20 bp, Artificial Sequence
  Synthetic
gatcaccaugggtccctguc

SEQ ID NO: 35773 - DNA, 21 bp, Artificial Sequence
  Synthetic
acaatcaggccuaggagguct

SEQ ID NO: 35774 - DNA, 24 bp, Artificial Sequence
  Synthetic
atttatgcutgacccaugacacct

SEQ ID NO: 35775 - DNA, 26 bp, Artificial Sequence
  Synthetic
ctgagacagacagugattcagatuga

SEQ ID NO: 35776 - DNA, 25 bp, Artificial Sequence
  Synthetic
gaaagaguaggcagaaaucaagaug

SEQ ID NO: 35777 - DNA, 27 bp, Artificial Sequence
  Synthetic
gctgaaattctuggttttggatcacug

SEQ ID NO: 35778 - DNA, 23 bp, Artificial Sequence
  Synthetic
acuattatgctgugcccaacagg

SEQ ID NO: 35779 - DNA, 26 bp, Artificial Sequence
  Synthetic
ctttcctgacguctgaatactcacug

SEQ ID NO: 35780 - DNA, 21 bp, Artificial Sequence
  Synthetic
ccatcugggccagttccauag

SEQ ID NO: 35781 - DNA, 23 bp, Artificial Sequence
  Synthetic
ccttaguaaggtagagtgugggt

SEQ ID NO: 35782 - DNA, 22 bp, Artificial Sequence
  Synthetic
ccgaguttgttgtucccaggat

SEQ ID NO: 35783 - DNA, 27 bp, Artificial Sequence
  Synthetic
gcttctctcacauttcctttttctguc

SEQ ID NO: 35784 - DNA, 21 bp, Artificial Sequence
  Synthetic
atctcgtccucgatgctgaug

SEQ ID NO: 35785 - DNA, 21 bp, Artificial Sequence
  Synthetic
acacgtgaucctttggtggut

SEQ ID NO: 35786 - DNA, 23 bp, Artificial Sequence
  Synthetic
acagcatccugcttgttcucaat

SEQ ID NO: 35787 - DNA, 30 bp, Artificial Sequence
  Synthetic
tgaccgtgttgucactaattctttatuact

SEQ ID NO: 35788 - DNA, 26 bp, Artificial Sequence
  Synthetic
tcattttaggaaggagguctgtgcua

SEQ ID NO: 35789 - DNA, 22 bp, Artificial Sequence
  Synthetic
catgaggcagugagcctactuc

SEQ ID NO: 35790 - DNA, 20 bp, Artificial Sequence
  Synthetic
gggcuaaccccaccctcaua

SEQ ID NO: 35791 - DNA, 21 bp, Artificial Sequence
  Synthetic
catgctaucaccaagcacucg

SEQ ID NO: 35792 - DNA, 22 bp, Artificial Sequence
  Synthetic
gacctgggucactcaggatcua

SEQ ID NO: 35793 - DNA, 23 bp, Artificial Sequence
  Synthetic
gctacatcucctcccagatugag

SEQ ID NO: 35794 - DNA, 22 bp, Artificial Sequence
  Synthetic
ccgtccucagacccaaacatua

SEQ ID NO: 35795 - DNA, 25 bp, Artificial Sequence
  Synthetic
gcaaagggaacautatcaucagcac

SEQ ID NO: 35796 - DNA, 27 bp, Artificial Sequence
  Synthetic
gaaatgcttctugggaaattcacauga

SEQ ID NO: 35797 - DNA, 24 bp, Artificial Sequence
  Synthetic
ctgcttcttuctgttggttuccag

SEQ ID NO: 35798 - DNA, 22 bp, Artificial Sequence
  Synthetic
cgggacaaagugcaagacatuc

SEQ ID NO: 35799 - DNA, 26 bp, Artificial Sequence
  Synthetic
agtattttctccucaaggccaaguac

SEQ ID NO: 35800 - DNA, 21 bp, Artificial Sequence
  Synthetic
gactgagcaccuccaauccag

SEQ ID NO: 35801 - DNA, 26 bp, Artificial Sequence
  Synthetic
gcctcagtacuctcatttccttguag

SEQ ID NO: 35802 - DNA, 21 bp, Artificial Sequence
  Synthetic
ctgaggcuttcccaucagacc

SEQ ID NO: 35803 - DNA, 22 bp, Artificial Sequence
  Synthetic
acagtgggaaugctgcttctut

SEQ ID NO: 35804 - DNA, 25 bp, Artificial Sequence
  Synthetic
ggaaaccacacaugaacccaaatuc

SEQ ID NO: 35805 - DNA, 22 bp, Artificial Sequence
  Synthetic
cccttgaccutttcctcctugt

SEQ ID NO: 35806 - DNA, 22 bp, Artificial Sequence
  Synthetic
ccaacaacutttgcugagacct

SEQ ID NO: 35807 - DNA, 22 bp, Artificial Sequence
  Synthetic
ccaaccctcuatggcatctcuc

SEQ ID NO: 35808 - DNA, 22 bp, Artificial Sequence
  Synthetic
gcaugaagcacaacaagcaguc

SEQ ID NO: 35809 - DNA, 25 bp, Artificial Sequence
  Synthetic
ggtgaaggcauactcatcacatcuc

SEQ ID NO: 35810 - DNA, 22 bp, Artificial Sequence
  Synthetic
ctttccagcauccctgcattuc

SEQ ID NO: 35811 - DNA, 26 bp, Artificial Sequence
  Synthetic
cctcattacctugttttgcctctgua

SEQ ID NO: 35812 - DNA, 22 bp, Artificial Sequence
  Synthetic
gctgccagguaggaaugagaga

SEQ ID NO: 35813 - DNA, 23 bp, Artificial Sequence
  Synthetic
tctcgtgacugtagcaaactgug

SEQ ID NO: 35814 - DNA, 24 bp, Artificial Sequence
  Synthetic
cttcuaaaacccaacccaguagca

SEQ ID NO: 35815 - DNA, 24 bp, Artificial Sequence
  Synthetic
cacccuacccaactatgaagaugt

SEQ ID NO: 35816 - DNA, 26 bp, Artificial Sequence
  Synthetic
gactctatatuctacgactgcuccca

SEQ ID NO: 35817 - DNA, 24 bp, Artificial Sequence
  Synthetic
cctgatguagttttccucccacag

SEQ ID NO: 35818 - DNA, 24 bp, Artificial Sequence
  Synthetic
caacggaaacuccacaccatatuc

SEQ ID NO: 35819 - DNA, 31 bp, Artificial Sequence
  Synthetic
acatgatattgauggcacttcttttcttcua

SEQ ID NO: 35820 - DNA, 22 bp, Artificial Sequence
  Synthetic
ggaaggatccaucaggaagcug

SEQ ID NO: 35821 - DNA, 24 bp, Artificial Sequence
  Synthetic
tgatggauggaaaactcactugct

SEQ ID NO: 35822 - DNA, 21 bp, Artificial Sequence
  Synthetic
cugcaatcttcuagccaccgt

SEQ ID NO: 35823 - DNA, 25 bp, Artificial Sequence
  Synthetic
cctttgttccutttgttgtggguag

SEQ ID NO: 35824 - DNA, 23 bp, Artificial Sequence
  Synthetic
ccaaagccauctgccacttcaua

SEQ ID NO: 35825 - DNA, 26 bp, Artificial Sequence
  Synthetic
gatgagtuccaagaagaaggattugc

SEQ ID NO: 35826 - DNA, 27 bp, Artificial Sequence
  Synthetic
ctcaataaatguaacaggaccuaggca

SEQ ID NO: 35827 - DNA, 22 bp, Artificial Sequence
  Synthetic
tccagatcauggttgagtuggg

SEQ ID NO: 35828 - DNA, 28 bp, Artificial Sequence
  Synthetic
gaatgatgcuagaagatgcatgttuagg

SEQ ID NO: 35829 - DNA, 25 bp, Artificial Sequence
  Synthetic
ctgggucaaacagatgauaccagat

SEQ ID NO: 35830 - DNA, 29 bp, Artificial Sequence
  Synthetic
aaaaagatactuagcacttcgaagatucc

SEQ ID NO: 35831 - DNA, 28 bp, Artificial Sequence
  Synthetic
gcatcatcuacaagcccaaaacuaaaga

SEQ ID NO: 35832 - DNA, 23 bp, Artificial Sequence
  Synthetic
actgatctuacaccaagcatucc

SEQ ID NO: 35833 - DNA, 20 bp, Artificial Sequence
  Synthetic
gagaggtgcugtcccttgut

SEQ ID NO: 35834 - DNA, 21 bp, Artificial Sequence
  Synthetic
actcctgagccuggaatccut

SEQ ID NO: 35835 - DNA, 22 bp, Artificial Sequence
  Synthetic
cgtttctttuccttccccagug

SEQ ID NO: 35836 - DNA, 19 bp, Artificial Sequence
  Synthetic
gttcgggacguccatcugt

SEQ ID NO: 35837 - DNA, 17 bp, Artificial Sequence
  Synthetic
gaggccccugcttccuc

SEQ ID NO: 35838 - DNA, 22 bp, Artificial Sequence
  Synthetic
ctatucccgggacctttuccag

SEQ ID NO: 35839 - DNA, 24 bp, Artificial Sequence
  Synthetic
caacugtgtgttugaaggcaagag

SEQ ID NO: 35840 - DNA, 23 bp, Artificial Sequence
  Synthetic
cttgguggaaagaugggaaggaa

SEQ ID NO: 35841 - DNA, 27 bp, Artificial Sequence
  Synthetic
ggctacagaaugatactctgtcucaat

SEQ ID NO: 35842 - DNA, 31 bp, Artificial Sequence
  Synthetic
atctgaaacattcutttgtgtaacgtttuct

SEQ ID NO: 35843 - DNA, 19 bp, Artificial Sequence
  Synthetic
gcccacagcucggactuac

SEQ ID NO: 35844 - DNA, 28 bp, Artificial Sequence
  Synthetic
ggtattaatgcauttgtttggtagcugt

SEQ ID NO: 35845 - DNA, 23 bp, Artificial Sequence
  Synthetic
tccctctucaccctggaacttua

SEQ ID NO: 35846 - DNA, 22 bp, Artificial Sequence
  Synthetic
tgcaagcccuggctaatuacag

SEQ ID NO: 35847 - DNA, 24 bp, Artificial Sequence
  Synthetic
gcaaagttucaactctcagucagg

SEQ ID NO: 35848 - DNA, 23 bp, Artificial Sequence
  Synthetic
gcccagaccucagtgttttcaut

SEQ ID NO: 35849 - DNA, 23 bp, Artificial Sequence
  Synthetic
cccttacugggtatagctcucac

SEQ ID NO: 35850 - DNA, 22 bp, Artificial Sequence
  Synthetic
gccccaguagccctgttttuat

SEQ ID NO: 35851 - DNA, 30 bp, Artificial Sequence
  Synthetic
ctgtctattgauccttctttgttcucaact

SEQ ID NO: 35852 - DNA, 24 bp, Artificial Sequence
  Synthetic
ctcucataccacaugaaaccagca

SEQ ID NO: 35853 - DNA, 27 bp, Artificial Sequence
  Synthetic
cctagaagaaugggattcatcacugat

SEQ ID NO: 35854 - DNA, 24 bp, Artificial Sequence
  Synthetic
gggcttttcuggtcacaguaacaa

SEQ ID NO: 35855 - DNA, 24 bp, Artificial Sequence
  Synthetic
cacataagcccugagaagtgtuca

SEQ ID NO: 35856 - DNA, 20 bp, Artificial Sequence
  Synthetic
ctgacgcugctgaagacgua

SEQ ID NO: 35857 - DNA, 25 bp, Artificial Sequence
  Synthetic
cccctgaaucaaagctgtgtacaua

SEQ ID NO: 35858 - DNA, 23 bp, Artificial Sequence
  Synthetic
caaaggcauggatugcacaaaga

SEQ ID NO: 35859 - DNA, 20 bp, Artificial Sequence
  Synthetic
cucagagctcuccagcaact

SEQ ID NO: 35860 - DNA, 24 bp, Artificial Sequence
  Synthetic
catgaaggacgguacatccugaat

SEQ ID NO: 35861 - DNA, 22 bp, Artificial Sequence
  Synthetic
ggacttcugagccttcugagga

SEQ ID NO: 35862 - DNA, 26 bp, Artificial Sequence
  Synthetic
cagcagaacuaaagggagaagcaaua

SEQ ID NO: 35863 - DNA, 29 bp, Artificial Sequence
  Synthetic
gactcattgaatuaaatcagcaaggauga

SEQ ID NO: 35864 - DNA, 23 bp, Artificial Sequence
  Synthetic
ctgttgtaugccacctacttgut

SEQ ID NO: 35865 - DNA, 22 bp, Artificial Sequence
  Synthetic
cactcucccctgaucaaacacc

SEQ ID NO: 35866 - DNA, 29 bp, Artificial Sequence
  Synthetic
ctaaatagccccaaguattagcuagaaac

SEQ ID NO: 35867 - DNA, 23 bp, Artificial Sequence
  Synthetic
tgttcgtcatugcctccatcauc

SEQ ID NO: 35868 - DNA, 24 bp, Artificial Sequence
  Synthetic
tctgcctgtutgttagcacaugat

SEQ ID NO: 35869 - DNA, 21 bp, Artificial Sequence
  Synthetic
cacctaccacutcgtcaugca

SEQ ID NO: 35870 - DNA, 27 bp, Artificial Sequence
  Synthetic
tctaactggtacugagagcctatgaut

SEQ ID NO: 35871 - DNA, 23 bp, Artificial Sequence
  Synthetic
tgagatcatcgucacccacttuc

SEQ ID NO: 35872 - DNA, 20 bp, Artificial Sequence
  Synthetic
cagtggugagaagcatuccg

SEQ ID NO: 35873 - DNA, 23 bp, Artificial Sequence
  Synthetic
agatgactauggcggtgugaaaa

SEQ ID NO: 35874 - DNA, 21 bp, Artificial Sequence
  Synthetic
cgacgtgcucacactgttuca

SEQ ID NO: 35875 - DNA, 26 bp, Artificial Sequence
  Synthetic
cactaggtcttuctccttttctgugg

SEQ ID NO: 35876 - DNA, 18 bp, Artificial Sequence
  Synthetic
gcccccagugctcttguc

SEQ ID NO: 35877 - DNA, 22 bp, Artificial Sequence
  Synthetic
gttggtgtcauctgctgtcuca

SEQ ID NO: 35878 - DNA, 26 bp, Artificial Sequence
  Synthetic
acagttcagaaagautagtccgtgug

SEQ ID NO: 35879 - DNA, 27 bp, Artificial Sequence
  Synthetic
gaaacaagauggtggactttauaccct

SEQ ID NO: 35880 - DNA, 24 bp, Artificial Sequence
  Synthetic
auttttctuccaccacaggaccat

SEQ ID NO: 35881 - DNA, 30 bp, Artificial Sequence
  Synthetic
gtacacacaattcaguagaaagcaaatcut

SEQ ID NO: 35882 - DNA, 20 bp, Artificial Sequence
  Synthetic
aggacaugcttugggcagac

SEQ ID NO: 35883 - DNA, 23 bp, Artificial Sequence
  Synthetic
actgtgtauctgctatgcuccac

SEQ ID NO: 35884 - DNA, 21 bp, Artificial Sequence
  Synthetic
acuggccacggaaattttugg

SEQ ID NO: 35885 - DNA, 28 bp, Artificial Sequence
  Synthetic
tccacatcugaagaacttcaacattuct

SEQ ID NO: 35886 - DNA, 30 bp, Artificial Sequence
  Synthetic
tcacaagtaaagagaacautttgtcctuca

SEQ ID NO: 35887 - DNA, 23 bp, Artificial Sequence
  Synthetic
gcgaucagaccctaaccaucaag

SEQ ID NO: 35888 - DNA, 27 bp, Artificial Sequence
  Synthetic
ccttcgtttaugctcatctgaguagaa

SEQ ID NO: 35889 - DNA, 28 bp, Artificial Sequence
  Synthetic
gatgucagaggcaaaatcucaagaaaag

SEQ ID NO: 35890 - DNA, 25 bp, Artificial Sequence
  Synthetic
gtggguaaaaacaaaagccaaccua

SEQ ID NO: 35891 - DNA, 26 bp, Artificial Sequence
  Synthetic
caaatcauttgcattcuacaggccat

SEQ ID NO: 35892 - DNA, 27 bp, Artificial Sequence
  Synthetic
tgtatccugcaacccagtaacaatuac

SEQ ID NO: 35893 - DNA, 24 bp, Artificial Sequence
  Synthetic
tgagatttcuggtgaagguggaac

SEQ ID NO: 35894 - DNA, 22 bp, Artificial Sequence
  Synthetic
caggtgaccucttttgccctua

SEQ ID NO: 35895 - DNA, 25 bp, Artificial Sequence
  Synthetic
aagcagutaagtcuccaaaacgagt

SEQ ID NO: 35896 - DNA, 21 bp, Artificial Sequence
  Synthetic
ccacgctguaattgcccucat

SEQ ID NO: 35897 - DNA, 25 bp, Artificial Sequence
  Synthetic
tttggcagcaagaautcuaacaaag

SEQ ID NO: 35898 - DNA, 25 bp, Artificial Sequence
  Synthetic
catctgtgatutcacttcccugaca

SEQ ID NO: 35899 - DNA, 21 bp, Artificial Sequence
  Synthetic
ctgtgugcaccaacuacaagg

SEQ ID NO: 35900 - DNA, 31 bp, Artificial Sequence
  Synthetic
gcagttggctuagactgaacatttaaaauaa

SEQ ID NO: 35901 - DNA, 27 bp, Artificial Sequence
  Synthetic
agatttgagagguctgcaagattugat

SEQ ID NO: 35902 - DNA, 23 bp, Artificial Sequence
  Synthetic
cagacacuggcctcattaacuca

SEQ ID NO: 35903 - DNA, 25 bp, Artificial Sequence
  Synthetic
cacccagcauctctcagaauacaaa

SEQ ID NO: 35904 - DNA, 24 bp, Artificial Sequence
  Synthetic
cttcgttgggaugtgataggtuga

SEQ ID NO: 35905 - DNA, 27 bp, Artificial Sequence
  Synthetic
gaattactccuccccattgatgacuac

SEQ ID NO: 35906 - DNA, 25 bp, Artificial Sequence
  Synthetic
gctggtcucactatctcaagaucat

SEQ ID NO: 35907 - DNA, 25 bp, Artificial Sequence
  Synthetic
cagtatgaaaugcctgggaaactug

SEQ ID NO: 35908 - DNA, 22 bp, Artificial Sequence
  Synthetic
atccggagutttctctccucct

SEQ ID NO: 35909 - DNA, 25 bp, Artificial Sequence
  Synthetic
gcgacacguacaaaaacaaatugac

SEQ ID NO: 35910 - DNA, 22 bp, Artificial Sequence
  Synthetic
cttcaggcaaagugtcccugat

SEQ ID NO: 35911 - DNA, 27 bp, Artificial Sequence
  Synthetic
ccacctccaacagauagtacctuaaga

SEQ ID NO: 35912 - DNA, 29 bp, Artificial Sequence
  Synthetic
ctgactcaaatgugtacttcttgtcatug

SEQ ID NO: 35913 - DNA, 25 bp, Artificial Sequence
  Synthetic
actgccguagaaccaugaagaaaat

SEQ ID NO: 35914 - DNA, 21 bp, Artificial Sequence
  Synthetic
gatggccacuccatcttcgua

SEQ ID NO: 35915 - DNA, 23 bp, Artificial Sequence
  Synthetic
cgatcucagaagggagtgagugt

SEQ ID NO: 35916 - DNA, 24 bp, Artificial Sequence
  Synthetic
ctatcttcugcttcaaccaugggt

SEQ ID NO: 35917 - DNA, 27 bp, Artificial Sequence
  Synthetic
ggaacactgguatatgtgctatugagt

SEQ ID NO: 35918 - DNA, 23 bp, Artificial Sequence
  Synthetic
ctgacgggcutgaccaaattcua

SEQ ID NO: 35919 - DNA, 26 bp, Artificial Sequence
  Synthetic
aggacttgacauatttgagcgcatua

SEQ ID NO: 35920 - DNA, 26 bp, Artificial Sequence
  Synthetic
cctgatcaguccctttgacttuaaca

SEQ ID NO: 35921 - DNA, 30 bp, Artificial Sequence
  Synthetic
tgaactatgaugaagaggtagaugaaacca

SEQ ID NO: 35922 - DNA, 27 bp, Artificial Sequence
  Synthetic
aagttgatcacgguataacgtgttuct

SEQ ID NO: 35923 - DNA, 27 bp, Artificial Sequence
  Synthetic
gaattgaucagaagacagttgaacugg

SEQ ID NO: 35924 - DNA, 26 bp, Artificial Sequence
  Synthetic
acttggtaguggccattattgucaat

SEQ ID NO: 35925 - DNA, 29 bp, Artificial Sequence
  Synthetic
cacttaaacacauactgttagatgtugct

SEQ ID NO: 35926 - DNA, 31 bp, Artificial Sequence
  Synthetic
gtagccaccctuaaattcttgaatcctauat

SEQ ID NO: 35927 - DNA, 25 bp, Artificial Sequence
  Synthetic
actcccaaatcugatgtcccaatuc

SEQ ID NO: 35928 - DNA, 28 bp, Artificial Sequence
  Synthetic
agtttctcgaauttcttctgttgucaca

SEQ ID NO: 35929 - DNA, 30 bp, Artificial Sequence
  Synthetic
cctgtttcatctcaugactcaaatctttut

SEQ ID NO: 35930 - DNA, 26 bp, Artificial Sequence
  Synthetic
gtgaggttcacaautctacaggtugt

SEQ ID NO: 35931 - DNA, 25 bp, Artificial Sequence
  Synthetic
ccacaautgtatttucccccaacag

SEQ ID NO: 35932 - DNA, 24 bp, Artificial Sequence
  Synthetic
caaaaacattgcugagctggacut

SEQ ID NO: 35933 - DNA, 26 bp, Artificial Sequence
  Synthetic
gttatgtacatuggtcgtccaguacc

SEQ ID NO: 35934 - DNA, 23 bp, Artificial Sequence
  Synthetic
gctugcaggagaagcttacuact

SEQ ID NO: 35935 - DNA, 29 bp, Artificial Sequence
  Synthetic
ttcctgacatuaaatggtacagattuggt

SEQ ID NO: 35936 - DNA, 28 bp, Artificial Sequence
  Synthetic
gggaattagccutaacttgtttagttug

SEQ ID NO: 35937 - DNA, 24 bp, Artificial Sequence
  Synthetic
cagtgccuggaagaagagcaauaa

SEQ ID NO: 35938 - DNA, 24 bp, Artificial Sequence
  Synthetic
gaccaaacauggcttgcttcttua

SEQ ID NO: 35939 - DNA, 22 bp, Artificial Sequence
  Synthetic
ctgacaagugggucagacacaa

SEQ ID NO: 35940 - DNA, 28 bp, Artificial Sequence
  Synthetic
cagtcccaaguattataagccaaugact

SEQ ID NO: 35941 - DNA, 25 bp, Artificial Sequence
  Synthetic
gtggtaaaaggccucaaagagaaug

SEQ ID NO: 35942 - DNA, 20 bp, Artificial Sequence
  Synthetic
cacagagcggacutggaugt

SEQ ID NO: 35943 - DNA, 25 bp, Artificial Sequence
  Synthetic
ccaggatattaguaagcgtgccaug

SEQ ID NO: 35944 - DNA, 28 bp, Artificial Sequence
  Synthetic
gggactaagaaauaagtctatggcaaut

SEQ ID NO: 35945 - DNA, 26 bp, Artificial Sequence
  Synthetic
tcaacatgaauggaccaagtguaaca

SEQ ID NO: 35946 - DNA, 31 bp, Artificial Sequence
  Synthetic
tcaatttgactgauacaaaatgtcctuacca

SEQ ID NO: 35947 - DNA, 26 bp, Artificial Sequence
  Synthetic
ggtccgtguaaataaagtacctguga

SEQ ID NO: 35948 - DNA, 20 bp, Artificial Sequence
  Synthetic
tggaagggccugtggactua

SEQ ID NO: 35949 - DNA, 22 bp, Artificial Sequence
  Synthetic
tgctccacugagtggttatgug

SEQ ID NO: 35950 - DNA, 28 bp, Artificial Sequence
  Synthetic
acttcaaatcaaaautgggtgacugaac

SEQ ID NO: 35951 - DNA, 28 bp, Artificial Sequence
  Synthetic
tgtcacagttgaaacucacactaaagua

SEQ ID NO: 35952 - DNA, 26 bp, Artificial Sequence
  Synthetic
gctatttggtacauacctctgagguc

SEQ ID NO: 35953 - DNA, 25 bp, Artificial Sequence
  Synthetic
cagagagauggatgaaggttgucac

SEQ ID NO: 35954 - DNA, 22 bp, Artificial Sequence
  Synthetic
ctgagaccaguactgcaucaga

SEQ ID NO: 35955 - DNA, 22 bp, Artificial Sequence
  Synthetic
attcccacgautgatgguggag

SEQ ID NO: 35956 - DNA, 27 bp, Artificial Sequence
  Synthetic
agaggtgatcaaucataggtcaagcua

SEQ ID NO: 35957 - DNA, 20 bp, Artificial Sequence
  Synthetic
ctugcaagccgggcaatuat

SEQ ID NO: 35958 - DNA, 30 bp, Artificial Sequence
  Synthetic
caagatctggtauttctggaaagttaauga

SEQ ID NO: 35959 - DNA, 21 bp, Artificial Sequence
  Synthetic
gccgtgaacgugaagggtaug

SEQ ID NO: 35960 - DNA, 25 bp, Artificial Sequence
  Synthetic
tgatcagtgtccutctcttgcatut

SEQ ID NO: 35961 - DNA, 31 bp, Artificial Sequence
  Synthetic
ccttatttgcctaauatctgcatctcactut

SEQ ID NO: 35962 - DNA, 22 bp, Artificial Sequence
  Synthetic
actgtuaccagctgcatucact

SEQ ID NO: 35963 - DNA, 27 bp, Artificial Sequence
  Synthetic
gcataucatcattcaguggacaaaacc

SEQ ID NO: 35964 - DNA, 23 bp, Artificial Sequence
  Synthetic
tgataagacugcccttctcccut

SEQ ID NO: 35965 - DNA, 23 bp, Artificial Sequence
  Synthetic
cgaatgcccaacccuatcctaug

SEQ ID NO: 35966 - DNA, 24 bp, Artificial Sequence
  Synthetic
tgcccacacuggaaaatgctauat

SEQ ID NO: 35967 - DNA, 26 bp, Artificial Sequence
  Synthetic
tctctgugaaaaagtctcttugcagt

SEQ ID NO: 35968 - DNA, 22 bp, Artificial Sequence
  Synthetic
gagcugtcaguaggcaaaacag

SEQ ID NO: 35969 - DNA, 22 bp, Artificial Sequence
  Synthetic
gtgacugctctcagugaaggag

SEQ ID NO: 35970 - DNA, 22 bp, Artificial Sequence
  Synthetic
caaccttgcugcctccatcaua

SEQ ID NO: 35971 - DNA, 28 bp, Artificial Sequence
  Synthetic
gttggtatguatcacaattuaagggcat

SEQ ID NO: 35972 - DNA, 30 bp, Artificial Sequence
  Synthetic
tttttcttaccaaauggatgttcagcaaut

SEQ ID NO: 35973 - DNA, 21 bp, Artificial Sequence
  Synthetic
agcgtgaaucggguacaacag

SEQ ID NO: 35974 - DNA, 23 bp, Artificial Sequence
  Synthetic
ccacaactgugacgctaaatgut

SEQ ID NO: 35975 - DNA, 23 bp, Artificial Sequence
  Synthetic
caggaagcccauttaccatugac

SEQ ID NO: 35976 - DNA, 24 bp, Artificial Sequence
  Synthetic
ttggcctucacacggaattcauat

SEQ ID NO: 35977 - DNA, 23 bp, Artificial Sequence
  Synthetic
atactagcaaaucctccgcaguc

SEQ ID NO: 35978 - DNA, 25 bp, Artificial Sequence
  Synthetic
tcattgaccutgaagatcugacgag

SEQ ID NO: 35979 - DNA, 26 bp, Artificial Sequence
  Synthetic
ggtagtaagucaatcacatucaccgt

SEQ ID NO: 35980 - DNA, 24 bp, Artificial Sequence
  Synthetic
ctgutgtatggataucagcccgaa

SEQ ID NO: 35981 - DNA, 29 bp, Artificial Sequence
  Synthetic
ggttaacagcucctgagttagacauagat

SEQ ID NO: 35982 - DNA, 23 bp, Artificial Sequence
  Synthetic
ttttcacacaugcctctgcatuc

SEQ ID NO: 35983 - DNA, 24 bp, Artificial Sequence
  Synthetic
gcaagtggcauctcaagactcaut

SEQ ID NO: 35984 - DNA, 28 bp, Artificial Sequence
  Synthetic
ccatcttgtgcutttcttttctcttcut

SEQ ID NO: 35985 - DNA, 27 bp, Artificial Sequence
  Synthetic
caagcaaatgcauctaattgattuggg

SEQ ID NO: 35986 - DNA, 22 bp, Artificial Sequence
  Synthetic
caattagugcccaggcaaguct

SEQ ID NO: 35987 - DNA, 29 bp, Artificial Sequence
  Synthetic
agacatgccuagttgtattttaauggaca

SEQ ID NO: 35988 - DNA, 21 bp, Artificial Sequence
  Synthetic
cgatggucccgagtagcauct

SEQ ID NO: 35989 - DNA, 28 bp, Artificial Sequence
  Synthetic
attattaaguccggagagagcctuagaa

SEQ ID NO: 35990 - DNA, 28 bp, Artificial Sequence
  Synthetic
aaatgtgaatgcucttagtctcatugga

SEQ ID NO: 35991 - DNA, 20 bp, Artificial Sequence
  Synthetic
caaggaaaugaacgcugggt

SEQ ID NO: 35992 - DNA, 28 bp, Artificial Sequence
  Synthetic
augtaagaaggtgaugcagagaagaaaa

SEQ ID NO: 35993 - DNA, 22 bp, Artificial Sequence
  Synthetic
ccactggacuggtagaagguct

SEQ ID NO: 35994 - DNA, 24 bp, Artificial Sequence
  Synthetic
tgacatgccaucagaagtcacaut

SEQ ID NO: 35995 - DNA, 26 bp, Artificial Sequence
  Synthetic
ttcacaaactaacuggaagatggugt

SEQ ID NO: 35996 - DNA, 23 bp, Artificial Sequence
  Synthetic
ccaagggugatgactgtaauggg

SEQ ID NO: 35997 - DNA, 28 bp, Artificial Sequence
  Synthetic
cacaatgtgcaccutgaattaccttaua

SEQ ID NO: 35998 - DNA, 26 bp, Artificial Sequence
  Synthetic
tcagtccuttctcattttuggcaaac

SEQ ID NO: 35999 - DNA, 29 bp, Artificial Sequence
  Synthetic
tgatctcucaatgaaagacucaacaaaga

SEQ ID NO: 36000 - DNA, 25 bp, Artificial Sequence
  Synthetic
aggatgtgcuagaacatttgtguga

SEQ ID NO: 36001 - DNA, 26 bp, Artificial Sequence
  Synthetic
gaacctaagtcutcaactgtgagugt

SEQ ID NO: 36002 - DNA, 22 bp, Artificial Sequence
  Synthetic
gtatcuggcatcacugccaaga

SEQ ID NO: 36003 - DNA, 28 bp, Artificial Sequence
  Synthetic
agcatactuccaggaaatcactctttut

SEQ ID NO: 36004 - DNA, 23 bp, Artificial Sequence
  Synthetic
guttacagcagauacccggaagt

SEQ ID NO: 36005 - DNA, 23 bp, Artificial Sequence
  Synthetic
caaccaagtcauccatcacccut

SEQ ID NO: 36006 - DNA, 22 bp, Artificial Sequence
  Synthetic
caggtgaagaugctgcagguat

SEQ ID NO: 36007 - DNA, 31 bp, Artificial Sequence
  Synthetic
gagcctaggauggtttaaagtacuaaaagag

SEQ ID NO: 36008 - DNA, 23 bp, Artificial Sequence
  Synthetic
aagcataugcacaggttagcgua

SEQ ID NO: 36009 - DNA, 26 bp, Artificial Sequence
  Synthetic
ggtctatggugtctgaacattuggaa

SEQ ID NO: 36010 - DNA, 26 bp, Artificial Sequence
  Synthetic
ggacaaaacacgaugttagtactuct

SEQ ID NO: 36011 - DNA, 28 bp, Artificial Sequence
  Synthetic
atcgccttaataguggatgctatgaaut

SEQ ID NO: 36012 - DNA, 23 bp, Artificial Sequence
  Synthetic
cactcaataguaggcgcaggtut

SEQ ID NO: 36013 - DNA, 29 bp, Artificial Sequence
  Synthetic
ccttactttaaggutggtgcaactattut

SEQ ID NO: 36014 - DNA, 24 bp, Artificial Sequence
  Synthetic
ctgagucaagccagagatgaugaa

SEQ ID NO: 36015 - DNA, 28 bp, Artificial Sequence
  Synthetic
cgctaatcugcttctcttatuaccacag

SEQ ID NO: 36016 - DNA, 24 bp, Artificial Sequence
  Synthetic
gttttccaacuccagcagcattut

SEQ ID NO: 36017 - DNA, 21 bp, Artificial Sequence
  Synthetic
gcagtgcagucgtaggctauc

SEQ ID NO: 36018 - DNA, 25 bp, Artificial Sequence
  Synthetic
aggugttgcuacaaaagagagaaat

SEQ ID NO: 36019 - DNA, 27 bp, Artificial Sequence
  Synthetic
atgaaacugaccacaggagaagaauac

SEQ ID NO: 36020 - DNA, 26 bp, Artificial Sequence
  Synthetic
ccatttgagagucacactttctucag

SEQ ID NO: 36021 - DNA, 24 bp, Artificial Sequence
  Synthetic
cccctuaaggcaaccatgagatut

SEQ ID NO: 36022 - DNA, 29 bp, Artificial Sequence
  Synthetic
cacaaaattagacauacctagttgcucct

SEQ ID NO: 36023 - DNA, 28 bp, Artificial Sequence
  Synthetic
gutgaagcacuagaaaaaggacagaaaa

SEQ ID NO: 36024 - DNA, 30 bp, Artificial Sequence
  Synthetic
tcacactattcuagcaaaattaacguggat

SEQ ID NO: 36025 - DNA, 22 bp, Artificial Sequence
  Synthetic
gcaagaaagcaugggtctcugt

SEQ ID NO: 36026 - DNA, 28 bp, Artificial Sequence
  Synthetic
gggtatcuaaaactttgacaacuaaggt

SEQ ID NO: 36027 - DNA, 21 bp, Artificial Sequence
  Synthetic
ccttuccgaggaagaccagua

SEQ ID NO: 36028 - DNA, 30 bp, Artificial Sequence
  Synthetic
actagcaccaaccutattgacagatttuac

SEQ ID NO: 36029 - DNA, 25 bp, Artificial Sequence
  Synthetic
tgtggacucaggcaagacaactaua

SEQ ID NO: 36030 - DNA, 24 bp, Artificial Sequence
  Synthetic
gcagcautttctgcauaaacacga

SEQ ID NO: 36031 - DNA, 28 bp, Artificial Sequence
  Synthetic
cgtctttggaaautacttctgugaccaa

SEQ ID NO: 36032 - DNA, 28 bp, Artificial Sequence
  Synthetic
acttggttacttuacaggatgtcatcug

SEQ ID NO: 36033 - DNA, 22 bp, Artificial Sequence
  Synthetic
tctguggccgttaatugcaaag

SEQ ID NO: 36034 - DNA, 31 bp, Artificial Sequence
  Synthetic
cttgctctttctucaatttctataccaucct

SEQ ID NO: 36035 - DNA, 22 bp, Artificial Sequence
  Synthetic
aaggaatgcugctgactcagut

SEQ ID NO: 36036 - DNA, 26 bp, Artificial Sequence
  Synthetic
ctgtgatcttagcuccaccatcauaa

SEQ ID NO: 36037 - DNA, 22 bp, Artificial Sequence
  Synthetic
caaatgaaaguctccggcctug

SEQ ID NO: 36038 - DNA, 23 bp, Artificial Sequence
  Synthetic
caagcatgguagattttguggca

SEQ ID NO: 36039 - DNA, 25 bp, Artificial Sequence
  Synthetic
cacctctacaacauggcacatagut

SEQ ID NO: 36040 - DNA, 22 bp, Artificial Sequence
  Synthetic
gtccuggtctgucaaggacaat

SEQ ID NO: 36041 - DNA, 26 bp, Artificial Sequence
  Synthetic
caagcuactgtgaacuggagaaaaga

SEQ ID NO: 36042 - DNA, 26 bp, Artificial Sequence
  Synthetic
ttgtcttggaucacttcttcccttut

SEQ ID NO: 36043 - DNA, 27 bp, Artificial Sequence
  Synthetic
cagcaaaattacuggttatgtggtuga

SEQ ID NO: 36044 - DNA, 25 bp, Artificial Sequence
  Synthetic
ctggcaaaccaaucccatattcaut

SEQ ID NO: 36045 - DNA, 25 bp, Artificial Sequence
  Synthetic
aagtgaagaaagacucagtgacgut

SEQ ID NO: 36046 - DNA, 27 bp, Artificial Sequence
  Synthetic
cgaccactgucaaatctggtaacatua

SEQ ID NO: 36047 - DNA, 25 bp, Artificial Sequence
  Synthetic
ccaccagaaauagaactcgatgcug

SEQ ID NO: 36048 - DNA, 26 bp, Artificial Sequence
  Synthetic
gtgttttcttuaagcttggtcacugt

SEQ ID NO: 36049 - DNA, 22 bp, Artificial Sequence
  Synthetic
cccaagcaauccaaaagugacg

SEQ ID NO: 36050 - DNA, 21 bp, Artificial Sequence
  Synthetic
tgagccgcagauccgttaaug

SEQ ID NO: 36051 - DNA, 20 bp, Artificial Sequence
  Synthetic
ggcctgtuacggcctguaat

SEQ ID NO: 36052 - DNA, 23 bp, Artificial Sequence
  Synthetic
gttaagggccugtacctcagtug

SEQ ID NO: 36053 - DNA, 27 bp, Artificial Sequence
  Synthetic
gtggtacaaaguctatacccatcacug

SEQ ID NO: 36054 - DNA, 27 bp, Artificial Sequence
  Synthetic
cattctagcagcugtttcttcaagtuc

SEQ ID NO: 36055 - DNA, 26 bp, Artificial Sequence
  Synthetic
caagaaatgcagcuggaaacttuagt

SEQ ID NO: 36056 - DNA, 26 bp, Artificial Sequence
  Synthetic
acctgttatttugctaccaccaucat

SEQ ID NO: 36057 - DNA, 25 bp, Artificial Sequence
  Synthetic
gggccttgaguatgagttcaaagut

SEQ ID NO: 36058 - DNA, 27 bp, Artificial Sequence
  Synthetic
ttctttctgutcaagatgguagccaat

SEQ ID NO: 36059 - DNA, 28 bp, Artificial Sequence
  Synthetic
cggagtaccaguttagaatttttgcuga

SEQ ID NO: 36060 - DNA, 22 bp, Artificial Sequence
  Synthetic
ccaccagtauaggctggaggut

SEQ ID NO: 36061 - DNA, 27 bp, Artificial Sequence
  Synthetic
gctacctcaacugttttgcacatuaaa

SEQ ID NO: 36062 - DNA, 31 bp, Artificial Sequence
  Synthetic
ggtcggcctauaactggaatttctatttuaa

SEQ ID NO: 36063 - DNA, 26 bp, Artificial Sequence
  Synthetic
tgttactgguttgagttcuggacaag

SEQ ID NO: 36064 - DNA, 21 bp, Artificial Sequence
  Synthetic
gtcugggacacatcagugagt

SEQ ID NO: 36065 - DNA, 26 bp, Artificial Sequence
  Synthetic
agtcaaucagaaaagcguatgcuaat

SEQ ID NO: 36066 - DNA, 28 bp, Artificial Sequence
  Synthetic
gtcaagaacuttcacagtuacaaaagca

SEQ ID NO: 36067 - DNA, 22 bp, Artificial Sequence
  Synthetic
ctggtggauctgccagaatuca

SEQ ID NO: 36068 - DNA, 21 bp, Artificial Sequence
  Synthetic
gttgagggcacagacucguat

SEQ ID NO: 36069 - DNA, 30 bp, Artificial Sequence
  Synthetic
cacacattguagacaccactaaaaatucaa

SEQ ID NO: 36070 - DNA, 28 bp, Artificial Sequence
  Synthetic
catgatcttctgutaatcctgtcacuct

SEQ ID NO: 36071 - DNA, 25 bp, Artificial Sequence
  Synthetic
aaaaatccattugtgcttccuggac

SEQ ID NO: 36072 - DNA, 24 bp, Artificial Sequence
  Synthetic
caacttcugaagcaacaacagucc

SEQ ID NO: 36073 - DNA, 28 bp, Artificial Sequence
  Synthetic
caggttctaagucattcccagtaaaugt

SEQ ID NO: 36074 - DNA, 30 bp, Artificial Sequence
  Synthetic
tctgtgttctutatttcacatcuagcagat

SEQ ID NO: 36075 - DNA, 25 bp, Artificial Sequence
  Synthetic
caataacugccaaggatgaggtuga

SEQ ID NO: 36076 - DNA, 21 bp, Artificial Sequence
  Synthetic
agcuagctttcauccaacgac

SEQ ID NO: 36077 - DNA, 25 bp, Artificial Sequence
  Synthetic
aaagcaagcaagaautctgaaugct

SEQ ID NO: 36078 - DNA, 27 bp, Artificial Sequence
  Synthetic
tgttgacctttguccacaaaatacugt

SEQ ID NO: 36079 - DNA, 27 bp, Artificial Sequence
  Synthetic
cttagagtctgauccaattgtagcuca

SEQ ID NO: 36080 - DNA, 27 bp, Artificial Sequence
  Synthetic
gtagttcuagcaacaguagcagaaaca

SEQ ID NO: 36081 - DNA, 26 bp, Artificial Sequence
  Synthetic
agaagacagcauccatcgaaattgua

SEQ ID NO: 36082 - DNA, 26 bp, Artificial Sequence
  Synthetic
gggagaccauctttagtccagguaat

SEQ ID NO: 36083 - DNA, 29 bp, Artificial Sequence
  Synthetic
gggaagaatatcuttttagagttgtugct

SEQ ID NO: 36084 - DNA, 26 bp, Artificial Sequence
  Synthetic
catcatgttcaggutttgtccaacuc

SEQ ID NO: 36085 - DNA, 28 bp, Artificial Sequence
  Synthetic
tgctgttguaactaactgccauaagaat

SEQ ID NO: 36086 - DNA, 25 bp, Artificial Sequence
  Synthetic
actttcaggtuaacaggtggactug

SEQ ID NO: 36087 - DNA, 25 bp, Artificial Sequence
  Synthetic
cgtccuacaccagaagttaaauggg

SEQ ID NO: 36088 - DNA, 25 bp, Artificial Sequence
  Synthetic
actataatagguccagggacgucag

SEQ ID NO: 36089 - DNA, 27 bp, Artificial Sequence
  Synthetic
gtggctgtgaaautcaaggatacatug

SEQ ID NO: 36090 - DNA, 22 bp, Artificial Sequence
  Synthetic
gcttggutcactaaguccagca

SEQ ID NO: 36091 - DNA, 25 bp, Artificial Sequence
  Synthetic
cagtgaccaaggacucaatgatugt

SEQ ID NO: 36092 - DNA, 29 bp, Artificial Sequence
  Synthetic
acggaaagtauattcattgcctucaagaa

SEQ ID NO: 36093 - DNA, 25 bp, Artificial Sequence
  Synthetic
cacctgaaggaccugttgttatcuc

SEQ ID NO: 36094 - DNA, 20 bp, Artificial Sequence
  Synthetic
tgagactgguggcaaagucg

SEQ ID NO: 36095 - DNA, 24 bp, Artificial Sequence
  Synthetic
aaagcacaggagcaauaacagcua

SEQ ID NO: 36096 - DNA, 25 bp, Artificial Sequence
  Synthetic
gccctcagguaattctttcttcuca

SEQ ID NO: 36097 - DNA, 24 bp, Artificial Sequence
  Synthetic
attggcaagccgaguaaagtauca

SEQ ID NO: 36098 - DNA, 26 bp, Artificial Sequence
  Synthetic
cttgcgttcuagatgatagccaauga

SEQ ID NO: 36099 - DNA, 30 bp, Artificial Sequence
  Synthetic
ctgaagactggaugtgaatatcagttuaga

SEQ ID NO: 36100 - DNA, 26 bp, Artificial Sequence
  Synthetic
ggcccuaggaaagaguaatactauca

SEQ ID NO: 36101 - DNA, 31 bp, Artificial Sequence
  Synthetic
agagtaaaugcagagaguacagaaaataaut

SEQ ID NO: 36102 - DNA, 24 bp, Artificial Sequence
  Synthetic
ctggtggaaugacaagatcttugg

SEQ ID NO: 36103 - DNA, 21 bp, Artificial Sequence
  Synthetic
atggaggcagccgaautcuag

SEQ ID NO: 36104 - DNA, 25 bp, Artificial Sequence
  Synthetic
ccauattcattttcugcgagaaccc

SEQ ID NO: 36105 - DNA, 29 bp, Artificial Sequence
  Synthetic
gatctgaagguaaaagaggtcacuaagac

SEQ ID NO: 36106 - DNA, 27 bp, Artificial Sequence
  Synthetic
gtttacauttccaacaauaagcagggt

SEQ ID NO: 36107 - DNA, 23 bp, Artificial Sequence
  Synthetic
gaacuccaaaggcugaagacaga

SEQ ID NO: 36108 - DNA, 24 bp, Artificial Sequence
  Synthetic
aatctgccatucatcttcctcugg

SEQ ID NO: 36109 - DNA, 22 bp, Artificial Sequence
  Synthetic
tgcuggaattagugcaccaagt

SEQ ID NO: 36110 - DNA, 25 bp, Artificial Sequence
  Synthetic
tcacgccgtuccacaatataatuga

SEQ ID NO: 36111 - DNA, 29 bp, Artificial Sequence
  Synthetic
tcttgaaaggcaaugaatacatatuccgt

SEQ ID NO: 36112 - DNA, 22 bp, Artificial Sequence
  Synthetic
tccaguggagggaaccatgaua

SEQ ID NO: 36113 - DNA, 28 bp, Artificial Sequence
  Synthetic
acaaagatucaacaagaagggatagugg

SEQ ID NO: 36114 - DNA, 23 bp, Artificial Sequence
  Synthetic
cctgaaacaucagcttccaguct

SEQ ID NO: 36115 - DNA, 24 bp, Artificial Sequence
  Synthetic
cagtcagtggccuaacagaagaug

SEQ ID NO: 36116 - DNA, 26 bp, Artificial Sequence
  Synthetic
ggcttagcccauttaagtgttacugt

SEQ ID NO: 36117 - DNA, 23 bp, Artificial Sequence
  Synthetic
gcagactgugagcaaagcttuag

SEQ ID NO: 36118 - DNA, 26 bp, Artificial Sequence
  Synthetic
gaggtccaggaaccutaaatggauag

SEQ ID NO: 36119 - DNA, 26 bp, Artificial Sequence
  Synthetic
tggtggtguaccaataagcaactaug

SEQ ID NO: 36120 - DNA, 24 bp, Artificial Sequence
  Synthetic
tgatgacaucaccaacctctccua

SEQ ID NO: 36121 - DNA, 24 bp, Artificial Sequence
  Synthetic
ccaaagcuggtgacaacaucaaag

SEQ ID NO: 36122 - DNA, 30 bp, Artificial Sequence
  Synthetic
ggtatattcctcuccttcagttagatucct

SEQ ID NO: 36123 - DNA, 23 bp, Artificial Sequence
  Synthetic
cguaaaagcctcugaagcaccat

SEQ ID NO: 36124 - DNA, 28 bp, Artificial Sequence
  Synthetic
cggtaactttauatgtgcatttauggca

SEQ ID NO: 36125 - DNA, 24 bp, Artificial Sequence
  Synthetic
tgggaagaaaaguggctttgugaa

SEQ ID NO: 36126 - DNA, 23 bp, Artificial Sequence
  Synthetic
cgtattttcaaugttggcucggt

SEQ ID NO: 36127 - DNA, 21 bp, Artificial Sequence
  Synthetic
cagcggtgautccagatgtug

SEQ ID NO: 36128 - DNA, 24 bp, Artificial Sequence
  Synthetic
cctacuttttgatgcuccacgaca

SEQ ID NO: 36129 - DNA, 28 bp, Artificial Sequence
  Synthetic
cgttcattccagagugccaatatttuat

SEQ ID NO: 36130 - DNA, 22 bp, Artificial Sequence
  Synthetic
gtggaccaatucctgctctgut

SEQ ID NO: 36131 - DNA, 30 bp, Artificial Sequence
  Synthetic
cagcgaaatuacaggatatcatguagaaag

SEQ ID NO: 36132 - DNA, 31 bp, Artificial Sequence
  Synthetic
ttcctaaactctgcuataaatgtttccaugt

SEQ ID NO: 36133 - DNA, 25 bp, Artificial Sequence
  Synthetic
cttttgtggacaguggtttcugaag

SEQ ID NO: 36134 - DNA, 22 bp, Artificial Sequence
  Synthetic
gaccagguacatcaaggacugt

SEQ ID NO: 36135 - DNA, 23 bp, Artificial Sequence
  Synthetic
ccaaaaucaagttgguccaaggc

SEQ ID NO: 36136 - DNA, 30 bp, Artificial Sequence
  Synthetic
acattttaaucagaaaaggaaggaggutua

SEQ ID NO: 36137 - DNA, 24 bp, Artificial Sequence
  Synthetic
gccaaccaugttaatgucccagaa

SEQ ID NO: 36138 - DNA, 27 bp, Artificial Sequence
  Synthetic
tccaggaggauctaaaacauaaaagca

SEQ ID NO: 36139 - DNA, 30 bp, Artificial Sequence
  Synthetic
cttgaatatgaatuccgagttatggcaauc

SEQ ID NO: 36140 - DNA, 27 bp, Artificial Sequence
  Synthetic
actgttcucagggaaatatttgugagg

SEQ ID NO: 36141 - DNA, 24 bp, Artificial Sequence
  Synthetic
acggtttugaggaggcttcttaut

SEQ ID NO: 36142 - DNA, 26 bp, Artificial Sequence
  Synthetic
ctgaaggtatatuccatgccctcaug

SEQ ID NO: 36143 - DNA, 23 bp, Artificial Sequence
  Synthetic
catccccacuggaccaaucaaat

SEQ ID NO: 36144 - DNA, 22 bp, Artificial Sequence
  Synthetic
cgcagaugactcaacacugact

SEQ ID NO: 36145 - DNA, 30 bp, Artificial Sequence
  Synthetic
cgcctggcctuaaaaataacagtaattuat

SEQ ID NO: 36146 - DNA, 27 bp, Artificial Sequence
  Synthetic
ccttcagtcaaaucttttgcagaguac

SEQ ID NO: 36147 - DNA, 28 bp, Artificial Sequence
  Synthetic
gcttacacttatcauttctcctttgcut

SEQ ID NO: 36148 - DNA, 25 bp, Artificial Sequence
  Synthetic
aagaagtaggautttccctccucca

SEQ ID NO: 36149 - DNA, 19 bp, Artificial Sequence
  Synthetic
agauactccugggccacct

SEQ ID NO: 36150 - DNA, 28 bp, Artificial Sequence
  Synthetic
gtccaatcctguctcttagattgacaut

SEQ ID NO: 36151 - DNA, 21 bp, Artificial Sequence
  Synthetic
aaggccaguccctggaaauac

SEQ ID NO: 36152 - DNA, 24 bp, Artificial Sequence
  Synthetic
agattctgtgguaagttgcaccuc

SEQ ID NO: 36153 - DNA, 27 bp, Artificial Sequence
  Synthetic
catuaaacacucaggaaggaagtttuc

SEQ ID NO: 36154 - DNA, 23 bp, Artificial Sequence
  Synthetic
cacggaacucatattcgguacct

SEQ ID NO: 36155 - DNA, 29 bp, Artificial Sequence
  Synthetic
atcctcctgutattagcaacauaaccaaa

SEQ ID NO: 36156 - DNA, 25 bp, Artificial Sequence
  Synthetic
aatgaaaaaccaucgggaaaugtuc

SEQ ID NO: 36157 - DNA, 24 bp, Artificial Sequence
  Synthetic
ttgutgacaaacgugaaacaagca

SEQ ID NO: 36158 - DNA, 29 bp, Artificial Sequence
  Synthetic
gtcttctcccacautattctgtaaaucct

SEQ ID NO: 36159 - DNA, 21 bp, Artificial Sequence
  Synthetic
gcuattcagcgugaaccggaa

SEQ ID NO: 36160 - DNA, 21 bp, Artificial Sequence
  Synthetic
caagaaacugttggcaucggt

SEQ ID NO: 36161 - DNA, 28 bp, Artificial Sequence
  Synthetic
agaagcagcataugaatttcccactaut

SEQ ID NO: 36162 - DNA, 22 bp, Artificial Sequence
  Synthetic
ggaatctggugaggtgcaguat

SEQ ID NO: 36163 - DNA, 31 bp, Artificial Sequence
  Synthetic
gataaatggtgagugtacctctttttgttut

SEQ ID NO: 36164 - DNA, 23 bp, Artificial Sequence
  Synthetic
cuacaaggccaguacaaggauat

SEQ ID NO: 36165 - DNA, 26 bp, Artificial Sequence
  Synthetic
gacatcttccutgtcttcatcuccag

SEQ ID NO: 36166 - DNA, 21 bp, Artificial Sequence
  Synthetic
cuttccaacccugcaggaagt

SEQ ID NO: 36167 - DNA, 29 bp, Artificial Sequence
  Synthetic
tcttacatttcttucctcttggttcaugt

SEQ ID NO: 36168 - DNA, 22 bp, Artificial Sequence
  Synthetic
gagctgtcugctttatgcacug

SEQ ID NO: 36169 - DNA, 24 bp, Artificial Sequence
  Synthetic
ccaccagaagaaacutauccacct

SEQ ID NO: 36170 - DNA, 24 bp, Artificial Sequence
  Synthetic
gcatttcuggccgctactcuaaat

SEQ ID NO: 36171 - DNA, 20 bp, Artificial Sequence
  Synthetic
ctggttaccucccctacgug

SEQ ID NO: 36172 - DNA, 30 bp, Artificial Sequence
  Synthetic
agtatcttgaccutgctaaaauaggagact

SEQ ID NO: 36173 - DNA, 21 bp, Artificial Sequence
  Synthetic
aagacatggucgaccgtuacc

SEQ ID NO: 36174 - DNA, 22 bp, Artificial Sequence
  Synthetic
acatgtctccucagcatcccua

SEQ ID NO: 36175 - DNA, 28 bp, Artificial Sequence
  Synthetic
tugataatgtggucagaaaaggacaagt

SEQ ID NO: 36176 - DNA, 26 bp, Artificial Sequence
  Synthetic
gaatgaaucacatgcuaagggaagga

SEQ ID NO: 36177 - DNA, 24 bp, Artificial Sequence
  Synthetic
caaaaatagcagaugcgtctccug

SEQ ID NO: 36178 - DNA, 29 bp, Artificial Sequence
  Synthetic
cgaatacttcugtgcttgagatuaagagt

SEQ ID NO: 36179 - DNA, 25 bp, Artificial Sequence
  Synthetic
tctccucccagaccatgaataucag

SEQ ID NO: 36180 - DNA, 26 bp, Artificial Sequence
  Synthetic
caccatcatautcaggtggatuccaa

SEQ ID NO: 36181 - DNA, 29 bp, Artificial Sequence
  Synthetic
atgaatatatttucagagtccgugcagaa

SEQ ID NO: 36182 - DNA, 21 bp, Artificial Sequence
  Synthetic
ggtggaucccagcaaacagua

SEQ ID NO: 36183 - DNA, 28 bp, Artificial Sequence
  Synthetic
ccgtgctgatucatctaaattttctcut

SEQ ID NO: 36184 - DNA, 25 bp, Artificial Sequence
  Synthetic
ctttgacagtuaggaccccactuaa

SEQ ID NO: 36185 - DNA, 25 bp, Artificial Sequence
  Synthetic
cgatgacugggaaagagtgcauaaa

SEQ ID NO: 36186 - DNA, 22 bp, Artificial Sequence
  Synthetic
gctcaccuggtctgtcaauagg

SEQ ID NO: 36187 - DNA, 31 bp, Artificial Sequence
  Synthetic
tggctcagaaauaacaaacttcataguagaa

SEQ ID NO: 36188 - DNA, 22 bp, Artificial Sequence
  Synthetic
ggcatgtccacugctgttctua

SEQ ID NO: 36189 - DNA, 25 bp, Artificial Sequence
  Synthetic
gttattaccgugagaguaggccaaa

SEQ ID NO: 36190 - DNA, 28 bp, Artificial Sequence
  Synthetic
gtactcattuccttcaattaguccaggt

SEQ ID NO: 36191 - DNA, 28 bp, Artificial Sequence
  Synthetic
cctggaccaccuattaatcctaaacuga

SEQ ID NO: 36192 - DNA, 23 bp, Artificial Sequence
  Synthetic
gtccagucactctgaactucagg

SEQ ID NO: 36193 - DNA, 23 bp, Artificial Sequence
  Synthetic
tgactccacaccuactgttgcua

SEQ ID NO: 36194 - DNA, 26 bp, Artificial Sequence
  Synthetic
ccacgtgtcttuccttgtatcttgut

SEQ ID NO: 36195 - DNA, 24 bp, Artificial Sequence
  Synthetic
ggtagcaaaacaguagccguacat

SEQ ID NO: 36196 - DNA, 22 bp, Artificial Sequence
  Synthetic
ggttgtccacuttgcaguagga

SEQ ID NO: 36197 - DNA, 30 bp, Artificial Sequence
  Synthetic
aaactaggtaattttuggactagcagtaut

SEQ ID NO: 36198 - DNA, 23 bp, Artificial Sequence
  Synthetic
cctgggtgccutcttcttgauat

SEQ ID NO: 36199 - DNA, 29 bp, Artificial Sequence
  Synthetic
cgtaagttgcuttctctgaauacaaaact

SEQ ID NO: 36200 - DNA, 20 bp, Artificial Sequence
  Synthetic
ggaagagguactggtugcct

SEQ ID NO: 36201 - DNA, 25 bp, Artificial Sequence
  Synthetic
cuttttagataaaccugggccacct

SEQ ID NO: 36202 - DNA, 24 bp, Artificial Sequence
  Synthetic
tccaagttacutttgggaauggca

SEQ ID NO: 36203 - DNA, 29 bp, Artificial Sequence
  Synthetic
gtttgcaaggaaaauagatgtctgatugt

SEQ ID NO: 36204 - DNA, 23 bp, Artificial Sequence
  Synthetic
tcccgaagaccggugactttaua

SEQ ID NO: 36205 - DNA, 23 bp, Artificial Sequence
  Synthetic
ttagctaaaccaaguccaccugt

SEQ ID NO: 36206 - DNA, 30 bp, Artificial Sequence
  Synthetic
gtgtatggatgaauaggatctttgguaact

SEQ ID NO: 36207 - DNA, 22 bp, Artificial Sequence
  Synthetic
tgatgcaccugatcagccaaut

SEQ ID NO: 36208 - DNA, 26 bp, Artificial Sequence
  Synthetic
tgaatcagauaccagaggaucactua

SEQ ID NO: 36209 - DNA, 31 bp, Artificial Sequence
  Synthetic
tgatggaggcaguaaaatcaccaattataut

SEQ ID NO: 36210 - DNA, 26 bp, Artificial Sequence
  Synthetic
tggcacaaaaugttattgccattuct

SEQ ID NO: 36211 - DNA, 24 bp, Artificial Sequence
  Synthetic
agatcaaggccaaacgutcagaut

SEQ ID NO: 36212 - DNA, 24 bp, Artificial Sequence
  Synthetic
tgaaccaggaaaccutaggcttug

SEQ ID NO: 36213 - DNA, 30 bp, Artificial Sequence
  Synthetic
acttctgaaactugcacatttgtagattug

SEQ ID NO: 36214 - DNA, 27 bp, Artificial Sequence
  Synthetic
cagtgtattttcugctaagcaagtugt

SEQ ID NO: 36215 - DNA, 31 bp, Artificial Sequence
  Synthetic
aagacctggaagucaaagaagttacuaaaaa

SEQ ID NO: 36216 - DNA, 22 bp, Artificial Sequence
  Synthetic
ggctctcugataacaagugcct

SEQ ID NO: 36217 - DNA, 27 bp, Artificial Sequence
  Synthetic
ggctctccaaucaccaattatgtcaut

SEQ ID NO: 36218 - DNA, 28 bp, Artificial Sequence
  Synthetic
gaatgttgguttaaaaagtugcacagac

SEQ ID NO: 36219 - DNA, 25 bp, Artificial Sequence
  Synthetic
cgtcaccuggaacatgaaugaaaga

SEQ ID NO: 36220 - DNA, 24 bp, Artificial Sequence
  Synthetic
tcaggtgaaacuggaagcaatuga

SEQ ID NO: 36221 - DNA, 30 bp, Artificial Sequence
  Synthetic
aggattaaaggaaggaguautctacaaaut

SEQ ID NO: 36222 - DNA, 26 bp, Artificial Sequence
  Synthetic
attcatagtgcauttccttagugcca

SEQ ID NO: 36223 - DNA, 25 bp, Artificial Sequence
  Synthetic
actaacgtauactggctcttugcag

SEQ ID NO: 36224 - DNA, 24 bp, Artificial Sequence
  Synthetic
agcautgattgcatauacccggaa

SEQ ID NO: 36225 - DNA, 23 bp, Artificial Sequence
  Synthetic
ctccatgacugtcaacugggaag

SEQ ID NO: 36226 - DNA, 27 bp, Artificial Sequence
  Synthetic
tggctttgtaugtgaaaatgttcucct

SEQ ID NO: 36227 - DNA, 26 bp, Artificial Sequence
  Synthetic
aaagagaagcuaacaggaagacaugg

SEQ ID NO: 36228 - DNA, 29 bp, Artificial Sequence
  Synthetic
caagtaatttuaaccaaaccatgcaguct

SEQ ID NO: 36229 - DNA, 25 bp, Artificial Sequence
  Synthetic
agaaccugttctctaugacacccat

SEQ ID NO: 36230 - DNA, 28 bp, Artificial Sequence
  Synthetic
gaactatuattgaacaccuaggaaggca

SEQ ID NO: 36231 - DNA, 23 bp, Artificial Sequence
  Synthetic
gtgcaauaagcgtgatguggaag

SEQ ID NO: 36232 - DNA, 23 bp, Artificial Sequence
  Synthetic
gcttacataucggatctcuggca

SEQ ID NO: 36233 - DNA, 28 bp, Artificial Sequence
  Synthetic
agacaggaucaaaggctatgttatugag

SEQ ID NO: 36234 - DNA, 30 bp, Artificial Sequence
  Synthetic
gatgtaaatcacaauataagcaacgtucct

SEQ ID NO: 36235 - DNA, 21 bp, Artificial Sequence
  Synthetic
gtacagcuggagactgcugaa

SEQ ID NO: 36236 - DNA, 28 bp, Artificial Sequence
  Synthetic
tccatcctatuagaaaaggagacaguca

SEQ ID NO: 36237 - DNA, 22 bp, Artificial Sequence
  Synthetic
gattccugctgtcaucaaggga

SEQ ID NO: 36238 - DNA, 25 bp, Artificial Sequence
  Synthetic
cagtcagtaguaccttcttctugca

SEQ ID NO: 36239 - DNA, 25 bp, Artificial Sequence
  Synthetic
cagcacttcaucagcttcaaaauct

SEQ ID NO: 36240 - DNA, 22 bp, Artificial Sequence
  Synthetic
tttggttattggugctcggcua

SEQ ID NO: 36241 - DNA, 27 bp, Artificial Sequence
  Synthetic
ggaatcagtgaugagtgcaaaucagat

SEQ ID NO: 36242 - DNA, 31 bp, Artificial Sequence
  Synthetic
aggttauattaaaatggcaucaaaccagagt

SEQ ID NO: 36243 - DNA, 27 bp, Artificial Sequence
  Synthetic
tggcagtgaaaucacccattatgtuat

SEQ ID NO: 36244 - DNA, 23 bp, Artificial Sequence
  Synthetic
cggtcuggaaaggaaucaacaga

SEQ ID NO: 36245 - DNA, 22 bp, Artificial Sequence
  Synthetic
ccgaagugaggcaaaaacugag

SEQ ID NO: 36246 - DNA, 22 bp, Artificial Sequence
  Synthetic
cattggaaggccugtcacauct

SEQ ID NO: 36247 - DNA, 30 bp, Artificial Sequence
  Synthetic
tttaatgcatttuacagtgtgcctttaucc

SEQ ID NO: 36248 - DNA, 28 bp, Artificial Sequence
  Synthetic
caagatttucaaccagaaaagatguggt

SEQ ID NO: 36249 - DNA, 24 bp, Artificial Sequence
  Synthetic
tcattttcactugcctctggcuaa

SEQ ID NO: 36250 - DNA, 23 bp, Artificial Sequence
  Synthetic
cagccaaacutgttctuggcaat

SEQ ID NO: 36251 - DNA, 27 bp, Artificial Sequence
  Synthetic
acttaactggtcugatccagaagauga

SEQ ID NO: 36252 - DNA, 28 bp, Artificial Sequence
  Synthetic
gatagtatcactugggaaaatcctguga

SEQ ID NO: 36253 - DNA, 25 bp, Artificial Sequence
  Synthetic
cgtgttgtaauagacaacgtuggaa

SEQ ID NO: 36254 - DNA, 25 bp, Artificial Sequence
  Synthetic
tctgtugaaagagaacagtcaugca

SEQ ID NO: 36255 - DNA, 23 bp, Artificial Sequence
  Synthetic
ccgagagggugctgatuacaaac

SEQ ID NO: 36256 - DNA, 26 bp, Artificial Sequence
  Synthetic
gggttcccatuctagttcaatagtug

SEQ ID NO: 36257 - DNA, 30 bp, Artificial Sequence
  Synthetic
aatctguaagtagttcctuaagaagaaggt

SEQ ID NO: 36258 - DNA, 27 bp, Artificial Sequence
  Synthetic
ccaaaguacatgguaaaaaggcaaact

SEQ ID NO: 36259 - DNA, 24 bp, Artificial Sequence
  Synthetic
caaaacccgacucagaatggatug

SEQ ID NO: 36260 - DNA, 30 bp, Artificial Sequence
  Synthetic
tccattggaaagugtagttttaatgacuca

SEQ ID NO: 36261 - DNA, 24 bp, Artificial Sequence
  Synthetic
gagaaggaagggugaagtucaaga

SEQ ID NO: 36262 - DNA, 26 bp, Artificial Sequence
  Synthetic
gttgggtaaggugatccagaaauact

SEQ ID NO: 36263 - DNA, 24 bp, Artificial Sequence
  Synthetic
gagttgccacuttcccatttugaa

SEQ ID NO: 36264 - DNA, 22 bp, Artificial Sequence
  Synthetic
gtcaggattgguaccaggtgut

SEQ ID NO: 36265 - DNA, 30 bp, Artificial Sequence
  Synthetic
agaaggtggtttucctgatactaacattut

SEQ ID NO: 36266 - DNA, 27 bp, Artificial Sequence
  Synthetic
tggtatatatgttcucctcccagctuc

SEQ ID NO: 36267 - DNA, 28 bp, Artificial Sequence
  Synthetic
ccccactuagagacaagtgcattatuaa

SEQ ID NO: 36268 - DNA, 28 bp, Artificial Sequence
  Synthetic
tgcagagatgtgaucattcttcattgut

SEQ ID NO: 36269 - DNA, 29 bp, Artificial Sequence
  Synthetic
tgcattgcatttugacatactctgtttut

SEQ ID NO: 36270 - DNA, 24 bp, Artificial Sequence
  Synthetic
ccaatagcautgactgctcucact

SEQ ID NO: 36271 - DNA, 29 bp, Artificial Sequence
  Synthetic
cagagaaaaatgguggaagtcctatcaua

SEQ ID NO: 36272 - DNA, 22 bp, Artificial Sequence
  Synthetic
gugagggaggaccugagaaaag

SEQ ID NO: 36273 - DNA, 24 bp, Artificial Sequence
  Synthetic
gaaggaacagagguccagttucag

SEQ ID NO: 36274 - DNA, 28 bp, Artificial Sequence
  Synthetic
tgtcacaaagatuaagtgcaagagcaua

SEQ ID NO: 36275 - DNA, 24 bp, Artificial Sequence
  Synthetic
attguggaaaagagagacgucagg

SEQ ID NO: 36276 - DNA, 23 bp, Artificial Sequence
  Synthetic
tctcauatcgtagcucacaggca

SEQ ID NO: 36277 - DNA, 27 bp, Artificial Sequence
  Synthetic
ctcatggaaggauaggaauactcatuc

SEQ ID NO: 36278 - DNA, 30 bp, Artificial Sequence
  Synthetic
tcagcatttcaaugacataagactcaauct

SEQ ID NO: 36279 - DNA, 28 bp, Artificial Sequence
  Synthetic
tcatatgaactccuttttgacaaaccua

SEQ ID NO: 36280 - DNA, 25 bp, Artificial Sequence
  Synthetic
actgctgtcutaacatcttgauggg

SEQ ID NO: 36281 - DNA, 24 bp, Artificial Sequence
  Synthetic
ctaaagacgcagugactcucacat

SEQ ID NO: 36282 - DNA, 29 bp, Artificial Sequence
  Synthetic
aaatatgacaccaaaaugcaagttugaca

SEQ ID NO: 36283 - DNA, 23 bp, Artificial Sequence
  Synthetic
ctcatccaccgucaaggauacaa

SEQ ID NO: 36284 - DNA, 29 bp, Artificial Sequence
  Synthetic
tccccttttaaaaugagaaccttcctuac

SEQ ID NO: 36285 - DNA, 27 bp, Artificial Sequence
  Synthetic
cttggacaaaggcugatatgattcuga

SEQ ID NO: 36286 - DNA, 24 bp, Artificial Sequence
  Synthetic
agcagatttaaggucagaggccua

SEQ ID NO: 36287 - DNA, 29 bp, Artificial Sequence
  Synthetic
tcgacatcacaguaaaacatcctattcug

SEQ ID NO: 36288 - DNA, 29 bp, Artificial Sequence
  Synthetic
tcaactatataucctttgatgcgugaacc

SEQ ID NO: 36289 - DNA, 24 bp, Artificial Sequence
  Synthetic
tggcaatgugaagagaactgcaua

SEQ ID NO: 36290 - DNA, 28 bp, Artificial Sequence
  Synthetic
ccacatttgtuacgagcacaaacttuaa

SEQ ID NO: 36291 - DNA, 26 bp, Artificial Sequence
  Synthetic
ccctggtcauggtaaaaatctttugg

SEQ ID NO: 36292 - DNA, 22 bp, Artificial Sequence
  Synthetic
aaatgcacucacgagtcacugt

SEQ ID NO: 36293 - DNA, 24 bp, Artificial Sequence
  Synthetic
gggtgaaaaugaagaccttgtcug

SEQ ID NO: 36294 - DNA, 22 bp, Artificial Sequence
  Synthetic
cctgtugccccaaagtagcuat

SEQ ID NO: 36295 - DNA, 29 bp, Artificial Sequence
  Synthetic
tggatcatggacauaactgtatgtgttut

SEQ ID NO: 36296 - DNA, 26 bp, Artificial Sequence
  Synthetic
tcttcgcaucgctcaattatauagcc

SEQ ID NO: 36297 - DNA, 27 bp, Artificial Sequence
  Synthetic
actaacgtaaatgguatgctccaacuc

SEQ ID NO: 36298 - DNA, 22 bp, Artificial Sequence
  Synthetic
acagtugcagacaggtctucag

SEQ ID NO: 36299 - DNA, 30 bp, Artificial Sequence
  Synthetic
tcatattttcttcutctgtggtgaaaucca

SEQ ID NO: 36300 - DNA, 22 bp, Artificial Sequence
  Synthetic
ccagtgccaacuctgtttctug

SEQ ID NO: 36301 - DNA, 26 bp, Artificial Sequence
  Synthetic
ggtggaagcaaaaucataggtuacgt

SEQ ID NO: 36302 - DNA, 25 bp, Artificial Sequence
  Synthetic
tgctgtctugcttttaaattgugct

SEQ ID NO: 36303 - DNA, 26 bp, Artificial Sequence
  Synthetic
cggctgaacaaacutctttcagaaut

SEQ ID NO: 36304 - DNA, 31 bp, Artificial Sequence
  Synthetic
ctgaaatctaaacuctgtgatatuggaagga

SEQ ID NO: 36305 - DNA, 28 bp, Artificial Sequence
  Synthetic
tccaatggcuaagaaataacatggtugt

SEQ ID NO: 36306 - DNA, 32 bp, Artificial Sequence
  Synthetic
cttaatatgtaccutccacaaaaagtcuagca

SEQ ID NO: 36307 - DNA, 27 bp, Artificial Sequence
  Synthetic
tgcaagctaacugataatccaatguct

SEQ ID NO: 36308 - DNA, 22 bp, Artificial Sequence
  Synthetic
agaagacagcgucatcgaacuc

SEQ ID NO: 36309 - DNA, 30 bp, Artificial Sequence
  Synthetic
gttgataaguacaaguacatgttaaccaut

SEQ ID NO: 36310 - DNA, 26 bp, Artificial Sequence
  Synthetic
aggtctucctctgttguaaaggagaa

SEQ ID NO: 36311 - DNA, 28 bp, Artificial Sequence
  Synthetic
gccaactataatgugtctttgaccaauc

SEQ ID NO: 36312 - DNA, 27 bp, Artificial Sequence
  Synthetic
acccuaaaagcaagaacaaactuacca

SEQ ID NO: 36313 - DNA, 31 bp, Artificial Sequence
  Synthetic
ggatgataagacacutgaatctggagauaaa

SEQ ID NO: 36314 - DNA, 31 bp, Artificial Sequence
  Synthetic
cactgtagtttucataccatgtacttugact

SEQ ID NO: 36315 - DNA, 25 bp, Artificial Sequence
  Synthetic
gcgcagaagugatttggtauaaagg

SEQ ID NO: 36316 - DNA, 27 bp, Artificial Sequence
  Synthetic
caaaaaccacautgagttaagcuggaa

SEQ ID NO: 36317 - DNA, 29 bp, Artificial Sequence
  Synthetic
ttcttgtcaucaacaaatgtctacuggat

SEQ ID NO: 36318 - DNA, 28 bp, Artificial Sequence
  Synthetic
tgacagtacaagaugacaggtauacagt

SEQ ID NO: 36319 - DNA, 30 bp, Artificial Sequence
  Synthetic
atgtcagagtaaatutccagaaacctcaut

SEQ ID NO: 36320 - DNA, 29 bp, Artificial Sequence
  Synthetic
cagtcatgtauaacaagttttcugaccct

SEQ ID NO: 36321 - DNA, 28 bp, Artificial Sequence
  Synthetic
gagtaccttggcuaatgagtatgatuct

SEQ ID NO: 36322 - DNA, 23 bp, Artificial Sequence
  Synthetic
aagtgaagguggaagaacuccag

SEQ ID NO: 36323 - DNA, 23 bp, Artificial Sequence
  Synthetic
aaagctgttucttccctcucgaa

SEQ ID NO: 36324 - DNA, 22 bp, Artificial Sequence
  Synthetic
cuagaaaagugaagggccagca

SEQ ID NO: 36325 - DNA, 24 bp, Artificial Sequence
  Synthetic
gctgttatuaaggcagauggcaag

SEQ ID NO: 36326 - DNA, 29 bp, Artificial Sequence
  Synthetic
aaauttaaaaagcactuaccaagcacagt

SEQ ID NO: 36327 - DNA, 21 bp, Artificial Sequence
  Synthetic
ttcaagaaugaccagcgccua

SEQ ID NO: 36328 - DNA, 29 bp, Artificial Sequence
  Synthetic
actatttacctucaatgatcagttugcca

SEQ ID NO: 36329 - DNA, 25 bp, Artificial Sequence
  Synthetic
gcuaaaaggaacccaggaaaucaca

SEQ ID NO: 36330 - DNA, 22 bp, Artificial Sequence
  Synthetic
gggtgtaucaggaagtctugca

SEQ ID NO: 36331 - DNA, 24 bp, Artificial Sequence
  Synthetic
ccttcuaaccctcacuccaaacag

SEQ ID NO: 36332 - DNA, 29 bp, Artificial Sequence
  Synthetic
ttttattagucgagctgaaatgauacagt

SEQ ID NO: 36333 - DNA, 23 bp, Artificial Sequence
  Synthetic
tgcgccgcaucttaaaaaucaaa

SEQ ID NO: 36334 - DNA, 22 bp, Artificial Sequence
  Synthetic
ccccacucccatgatucagaaa

SEQ ID NO: 36335 - DNA, 23 bp, Artificial Sequence
  Synthetic
tcauctcttcugagggcaagact

SEQ ID NO: 36336 - DNA, 25 bp, Artificial Sequence
  Synthetic
tgggatgucacagatctcatuagct

SEQ ID NO: 36337 - DNA, 27 bp, Artificial Sequence
  Synthetic
agaggcaaaugttatatgguccaaagg

SEQ ID NO: 36338 - DNA, 29 bp, Artificial Sequence
  Synthetic
aaaatcagacatuaagaatgaggctttuc

SEQ ID NO: 36339 - DNA, 22 bp, Artificial Sequence
  Synthetic
gcacaaagucaaacuggaccaa

SEQ ID NO: 36340 - DNA, 29 bp, Artificial Sequence
  Synthetic
ctccattattatuaaagcaacccgaauct

SEQ ID NO: 36341 - DNA, 24 bp, Artificial Sequence
  Synthetic
tttgaugcagaaatcucagaggca

SEQ ID NO: 36342 - DNA, 25 bp, Artificial Sequence
  Synthetic
ccaacgatgcuttgcttttatgugt

SEQ ID NO: 36343 - DNA, 29 bp, Artificial Sequence
  Synthetic
gagagatggaaaucatctgtaccucaaaa

SEQ ID NO: 36344 - DNA, 27 bp, Artificial Sequence
  Synthetic
gaacgaaatcucccaggaaagtacuaa

SEQ ID NO: 36345 - DNA, 24 bp, Artificial Sequence
  Synthetic
gagttaaacaaagagcgugacgug

SEQ ID NO: 36346 - DNA, 26 bp, Artificial Sequence
  Synthetic
caatgcaagtugctactaaggttugt

SEQ ID NO: 36347 - DNA, 26 bp, Artificial Sequence
  Synthetic
gaaagctgcacaucattgatgtucaa

SEQ ID NO: 36348 - DNA, 23 bp, Artificial Sequence
  Synthetic
cugaagagucaacgaactcugat

SEQ ID NO: 36349 - DNA, 29 bp, Artificial Sequence
  Synthetic
tcctaaggagaugccaaatcaacttttua

SEQ ID NO: 36350 - DNA, 27 bp, Artificial Sequence
  Synthetic
gcagcauaaacagggcttgaatttuaa

SEQ ID NO: 36351 - DNA, 28 bp, Artificial Sequence
  Synthetic
cactaatgcaauggacttctctcuacag

SEQ ID NO: 36352 - DNA, 28 bp, Artificial Sequence
  Synthetic
ttaaggtcatgugttcaaatcttgaugt

SEQ ID NO: 36353 - DNA, 25 bp, Artificial Sequence
  Synthetic
caaaacctgutgaagaggtugaagt

SEQ ID NO: 36354 - DNA, 27 bp, Artificial Sequence
  Synthetic
acaaattgtcacugagattcctaccug

SEQ ID NO: 36355 - DNA, 29 bp, Artificial Sequence
  Synthetic
ttgcatttgtcaagcutattcaacatcut

SEQ ID NO: 36356 - DNA, 23 bp, Artificial Sequence
  Synthetic
cagaacautcgauggaggcagaa

SEQ ID NO: 36357 - DNA, 29 bp, Artificial Sequence
  Synthetic
ggagtagaaagutaatcacttgctucaga

SEQ ID NO: 36358 - DNA, 27 bp, Artificial Sequence
  Synthetic
caacacaacacacaauaagaagagugt

SEQ ID NO: 36359 - DNA, 31 bp, Artificial Sequence
  Synthetic
agaaattcctatuattcaagtgccugaagag

SEQ ID NO: 36360 - DNA, 31 bp, Artificial Sequence
  Synthetic
acaaagcttaaatuagaaatagtcgcaagug

SEQ ID NO: 36361 - DNA, 28 bp, Artificial Sequence
  Synthetic
gcaaaatgtgaagucgatgtggtauaaa

SEQ ID NO: 36362 - DNA, 28 bp, Artificial Sequence
  Synthetic
caatcaccaguaaacattcatcacatut

SEQ ID NO: 36363 - DNA, 31 bp, Artificial Sequence
  Synthetic
tcattgaaaccaugagcttaaacaactacua

SEQ ID NO: 36364 - DNA, 24 bp, Artificial Sequence
  Synthetic
aaaagcucagagcacccagaatua

SEQ ID NO: 36365 - DNA, 25 bp, Artificial Sequence
  Synthetic
tgagctcatguctttaaagtgtucg

SEQ ID NO: 36366 - DNA, 27 bp, Artificial Sequence
  Synthetic
caaacaataucaaacacagcaccauga

SEQ ID NO: 36367 - DNA, 26 bp, Artificial Sequence
  Synthetic
gatcaaacucttctgctcuggaaagt

SEQ ID NO: 36368 - DNA, 22 bp, Artificial Sequence
  Synthetic
gagaucggcggacacttctaug

SEQ ID NO: 36369 - DNA, 31 bp, Artificial Sequence
  Synthetic
catccatcatuttcaccttttcuaaacacaa

SEQ ID NO: 36370 - DNA, 26 bp, Artificial Sequence
  Synthetic
gaaaagccagtuacctttagttggug

SEQ ID NO: 36371 - DNA, 24 bp, Artificial Sequence
  Synthetic
attgttgctgugttctgttctgug

SEQ ID NO: 36372 - DNA, 26 bp, Artificial Sequence
  Synthetic
gggtttctaaucttccaaacugaaca

SEQ ID NO: 36373 - DNA, 30 bp, Artificial Sequence
  Synthetic
gttgaagaagaauacagagutgaaaaagut

SEQ ID NO: 36374 - DNA, 25 bp, Artificial Sequence
  Synthetic
tgcatgcaacaauacacgaaaaucc

SEQ ID NO: 36375 - DNA, 24 bp, Artificial Sequence
  Synthetic
ctatgaaagcutgctcucgacagt

SEQ ID NO: 36376 - DNA, 29 bp, Artificial Sequence
  Synthetic
cgatataagaaaagcauactggtgaauct

SEQ ID NO: 36377 - DNA, 24 bp, Artificial Sequence
  Synthetic
gagccugaagaagagcctattuca

SEQ ID NO: 36378 - DNA, 28 bp, Artificial Sequence
  Synthetic
cttttauaggagaaggaaggaaauggca

SEQ ID NO: 36379 - DNA, 25 bp, Artificial Sequence
  Synthetic
tgttaacacautggtctttcugggt

SEQ ID NO: 36380 - DNA, 26 bp, Artificial Sequence
  Synthetic
caggtacaaautcttcttccucaggt

SEQ ID NO: 36381 - DNA, 28 bp, Artificial Sequence
  Synthetic
aagaagaaautgttccugaagaggaagt

SEQ ID NO: 36382 - DNA, 24 bp, Artificial Sequence
  Synthetic
cuaaagagttgcaucccaaagagt

SEQ ID NO: 36383 - DNA, 21 bp, Artificial Sequence
  Synthetic
gaagugcccaagaaacctgug

SEQ ID NO: 36384 - DNA, 24 bp, Artificial Sequence
  Synthetic
gaaagatcugctatggcucaccaa

SEQ ID NO: 36385 - DNA, 30 bp, Artificial Sequence
  Synthetic
agctgtgttttauatggatgtgttgtuact

SEQ ID NO: 36386 - DNA, 22 bp, Artificial Sequence
  Synthetic
ccttugcaggaggcatcatcua

SEQ ID NO: 36387 - DNA, 31 bp, Artificial Sequence
  Synthetic
gtcattggcaaaugtccaacttaaagauaat

SEQ ID NO: 36388 - DNA, 27 bp, Artificial Sequence
  Synthetic
agaaaagaucacaaucgaggaaggaaa

SEQ ID NO: 36389 - DNA, 28 bp, Artificial Sequence
  Synthetic
gttcttgtccugattcttacattucagt

SEQ ID NO: 36390 - DNA, 26 bp, Artificial Sequence
  Synthetic
acagacauggaggaaacaaagatcuc

SEQ ID NO: 36391 - DNA, 32 bp, Artificial Sequence
  Synthetic
aagtctaacatgaaauaccttgtatgtactut

SEQ ID NO: 36392 - DNA, 27 bp, Artificial Sequence
  Synthetic
cctcatattcttcutcccgttgtacug

SEQ ID NO: 36393 - DNA, 31 bp, Artificial Sequence
  Synthetic
cgcaaaagaataaaaucaaagcacattgtua

SEQ ID NO: 36394 - DNA, 26 bp, Artificial Sequence
  Synthetic
agtcagtataccuttagctggtggut

SEQ ID NO: 36395 - DNA, 26 bp, Artificial Sequence
  Synthetic
gctactactttauggctgccttttug

SEQ ID NO: 36396 - DNA, 26 bp, Artificial Sequence
  Synthetic
acccaccaacauataaacagtaugac

SEQ ID NO: 36397 - DNA, 30 bp, Artificial Sequence
  Synthetic
tgtttgatggtatugcctggtatctttuaa

SEQ ID NO: 36398 - DNA, 28 bp, Artificial Sequence
  Synthetic
cataagacagutatgcaaatgugaaggt

SEQ ID NO: 36399 - DNA, 31 bp, Artificial Sequence
  Synthetic
tuttataatcttttcaagugacagagaggca

SEQ ID NO: 36400 - DNA, 25 bp, Artificial Sequence
  Synthetic
cttugaggaaauacacacaaacuca

SEQ ID NO: 36401 - DNA, 28 bp, Artificial Sequence
  Synthetic
ctcttccccaaautctagaaagugagaa

SEQ ID NO: 36402 - DNA, 23 bp, Artificial Sequence
  Synthetic
agaaatacacccacagugcacuc

SEQ ID NO: 36403 - DNA, 27 bp, Artificial Sequence
  Synthetic
tgctcatttauttggccttttugacaa

SEQ ID NO: 36404 - DNA, 22 bp, Artificial Sequence
  Synthetic
gctttacgucgaaagccacugt

SEQ ID NO: 36405 - DNA, 28 bp, Artificial Sequence
  Synthetic
gcatgtgccuatgttctttcauaaaagt

SEQ ID NO: 36406 - DNA, 26 bp, Artificial Sequence
  Synthetic
acaacaagagggauaaaaatcugcct

SEQ ID NO: 36407 - DNA, 29 bp, Artificial Sequence
  Synthetic
ccatgtgtttgauctgatgtcttgtacua

SEQ ID NO: 36408 - DNA, 22 bp, Artificial Sequence
  Synthetic
cttgtgtacaugggtgcuagga

SEQ ID NO: 36409 - DNA, 31 bp, Artificial Sequence
  Synthetic
acatauauacagagagagagagauagagaga

SEQ ID NO: 36410 - DNA, 28 bp, Artificial Sequence
  Synthetic
atttcacataaacugcaaatcaggtuca

SEQ ID NO: 36411 - DNA, 27 bp, Artificial Sequence
  Synthetic
aagaagggcaagaauactaugaaaggg

SEQ ID NO: 36412 - DNA, 27 bp, Artificial Sequence
  Synthetic
agttcgtcauaaggttctucgaaagat

SEQ ID NO: 36413 - DNA, 29 bp, Artificial Sequence
  Synthetic
tttagtgaagcagutggatggatagaaut

SEQ ID NO: 36414 - DNA, 22 bp, Artificial Sequence
  Synthetic
cttccttcacccuccactgtut

SEQ ID NO: 36415 - DNA, 30 bp, Artificial Sequence
  Synthetic
cctgaaagcautttagttactuacaccaga

SEQ ID NO: 36416 - DNA, 24 bp, Artificial Sequence
  Synthetic
acgttttgguggtggtttctttuc

SEQ ID NO: 36417 - DNA, 29 bp, Artificial Sequence
  Synthetic
tgaagtactgaaagaaaugcatgagacut

SEQ ID NO: 36418 - DNA, 32 bp, Artificial Sequence
  Synthetic
agatatcttatacatuttagtttggcttcugt

SEQ ID NO: 36419 - DNA, 25 bp, Artificial Sequence
  Synthetic
acgtagccuacctataccattcuga

SEQ ID NO: 36420 - DNA, 25 bp, Artificial Sequence
  Synthetic
gatagaatgagagcaugagcgcaua

SEQ ID NO: 36421 - DNA, 25 bp, Artificial Sequence
  Synthetic
cagaacugacagagagccagaaaua

SEQ ID NO: 36422 - DNA, 24 bp, Artificial Sequence
  Synthetic
cactttggtgugtgtctacaggua

SEQ ID NO: 36423 - DNA, 27 bp, Artificial Sequence
  Synthetic
acacaaagtccauaaattgaccatugc

SEQ ID NO: 36424 - DNA, 23 bp, Artificial Sequence
  Synthetic
acgcagatgugctcaacaguaat

SEQ ID NO: 36425 - DNA, 26 bp, Artificial Sequence
  Synthetic
aactgaaaaacuggaacccagtgaua

SEQ ID NO: 36426 - DNA, 26 bp, Artificial Sequence
  Synthetic
ctttttacctcugtctgtgacaguct

SEQ ID NO: 36427 - DNA, 28 bp, Artificial Sequence
  Synthetic
gctgaatatagucatgcgtcctcuaaat

SEQ ID NO: 36428 - DNA, 24 bp, Artificial Sequence
  Synthetic
tttgcttgagcagutcaaatgcut

SEQ ID NO: 36429 - DNA, 29 bp, Artificial Sequence
  Synthetic
agtagaagacaggugttttatccttacut

SEQ ID NO: 36430 - DNA, 22 bp, Artificial Sequence
  Synthetic
caugttcgttaaaugccacgca

SEQ ID NO: 36431 - DNA, 28 bp, Artificial Sequence
  Synthetic
tttcattattccutagaaaccacugcga

SEQ ID NO: 36432 - DNA, 22 bp, Artificial Sequence
  Synthetic
tgctggctugagctgcataaua

SEQ ID NO: 36433 - DNA, 24 bp, Artificial Sequence
  Synthetic
cagggaaauaaagcctucagacag

SEQ ID NO: 36434 - DNA, 30 bp, Artificial Sequence
  Synthetic
tggtcaagatatcauaagaaatgctcaugg

SEQ ID NO: 36435 - DNA, 21 bp, Artificial Sequence
  Synthetic
catgaacgacgcuggtttgua

SEQ ID NO: 36436 - DNA, 27 bp, Artificial Sequence
  Synthetic
ttttgtaucaggcaacagutataggut

SEQ ID NO: 36437 - DNA, 30 bp, Artificial Sequence
  Synthetic
agcttcatattaguaatctgcttctagcut

SEQ ID NO: 36438 - DNA, 23 bp, Artificial Sequence
  Synthetic
gggcgctgutttccagataacua

SEQ ID NO: 36439 - DNA, 29 bp, Artificial Sequence
  Synthetic
ctgaaaccttgtcuttctgctctactaut

SEQ ID NO: 36440 - DNA, 25 bp, Artificial Sequence
  Synthetic
caaggcuccggtcagtttuaaaaat

SEQ ID NO: 36441 - DNA, 26 bp, Artificial Sequence
  Synthetic
tctgttccuacagagcaaaaactucc

SEQ ID NO: 36442 - DNA, 29 bp, Artificial Sequence
  Synthetic
tgaaaaccagtguagcaacattattccua

SEQ ID NO: 36443 - DNA, 24 bp, Artificial Sequence
  Synthetic
gcatgtctccutcatgactgatug

SEQ ID NO: 36444 - DNA, 26 bp, Artificial Sequence
  Synthetic
caggaatctttuccagaggcatttuc

SEQ ID NO: 36445 - DNA, 22 bp, Artificial Sequence
  Synthetic
acattcacuggaactccuccca

SEQ ID NO: 36446 - DNA, 29 bp, Artificial Sequence
  Synthetic
tcgtataaatcuagaagagcagtcugaca

SEQ ID NO: 36447 - DNA, 23 bp, Artificial Sequence
  Synthetic
agcagtgaacuagtaccagguga

SEQ ID NO: 36448 - DNA, 29 bp, Artificial Sequence
  Synthetic
tttactgttttguaaactgacctcucaca

SEQ ID NO: 36449 - DNA, 23 bp, Artificial Sequence
  Synthetic
tctatgggucacctccaatcuct

SEQ ID NO: 36450 - DNA, 26 bp, Artificial Sequence
  Synthetic
tgaugaaggaaaaguccaagaaauca

SEQ ID NO: 36451 - DNA, 29 bp, Artificial Sequence
  Synthetic
ctgaactcaguactaagtggttuaaggat

SEQ ID NO: 36452 - DNA, 22 bp, Artificial Sequence
  Synthetic
tggtgagtgugtgccttgtauc

SEQ ID NO: 36453 - DNA, 26 bp, Artificial Sequence
  Synthetic
ggtguggttcaaagauaagggagaaa

SEQ ID NO: 36454 - DNA, 27 bp, Artificial Sequence
  Synthetic
gggcaacagaguattacaatuagaagg

SEQ ID NO: 36455 - DNA, 28 bp, Artificial Sequence
  Synthetic
ggcaagaaguacaagataatgtcugaga

SEQ ID NO: 36456 - DNA, 27 bp, Artificial Sequence
  Synthetic
gaggacaatuaaagaggaggctaaugt

SEQ ID NO: 36457 - DNA, 30 bp, Artificial Sequence
  Synthetic
cgagactgaaatucaagagagcagtaaaut

SEQ ID NO: 36458 - DNA, 22 bp, Artificial Sequence
  Synthetic
agcacacccacccucctataut

SEQ ID NO: 36459 - DNA, 26 bp, Artificial Sequence
  Synthetic
ggcaactacaagaugactttgguaga

SEQ ID NO: 36460 - DNA, 24 bp, Artificial Sequence
  Synthetic
gcagtgaagcugctttacaaugaa

SEQ ID NO: 36461 - DNA, 23 bp, Artificial Sequence
  Synthetic
aagtgtctuggtacaaggauggg

SEQ ID NO: 36462 - DNA, 28 bp, Artificial Sequence
  Synthetic
gaaaatgaatctgutcacacacacuagg

SEQ ID NO: 36463 - DNA, 26 bp, Artificial Sequence
  Synthetic
gctacgatcagcucctgcatauaaaa

SEQ ID NO: 36464 - DNA, 22 bp, Artificial Sequence
  Synthetic
agcaagtcagucatgccatgua

SEQ ID NO: 36465 - DNA, 31 bp, Artificial Sequence
  Synthetic
ctgagagaugcagtattactaugacagaaaa

SEQ ID NO: 36466 - DNA, 27 bp, Artificial Sequence
  Synthetic
ggttctauaaggagaaaacatgugggt

SEQ ID NO: 36467 - DNA, 26 bp, Artificial Sequence
  Synthetic
ggaagatttugtcacagaacuggagt

SEQ ID NO: 36468 - DNA, 24 bp, Artificial Sequence
  Synthetic
cacgtccacaugaaagaggtgtua

SEQ ID NO: 36469 - DNA, 22 bp, Artificial Sequence
  Synthetic
tccagctttucggaaaacguct

SEQ ID NO: 36470 - DNA, 21 bp, Artificial Sequence
  Synthetic
ccctccacccccuggaaauat

SEQ ID NO: 36471 - DNA, 28 bp, Artificial Sequence
  Synthetic
tggttcaaagauggaagagaattgtcug

SEQ ID NO: 36472 - DNA, 21 bp, Artificial Sequence
  Synthetic
tctctggcugtgctttgcuac

SEQ ID NO: 36473 - DNA, 25 bp, Artificial Sequence
  Synthetic
tggctgaaagauagaggtgaaguca

SEQ ID NO: 36474 - DNA, 25 bp, Artificial Sequence
  Synthetic
aaaaaugtgagaatcauggccacac

SEQ ID NO: 36475 - DNA, 25 bp, Artificial Sequence
  Synthetic
ccttaatctugaagcctccgatguc

SEQ ID NO: 36476 - DNA, 26 bp, Artificial Sequence
  Synthetic
acattggagaaucacatcagaaccut

SEQ ID NO: 36477 - DNA, 28 bp, Artificial Sequence
  Synthetic
tcatatgaucacaccagtcactctucaa

SEQ ID NO: 36478 - DNA, 26 bp, Artificial Sequence
  Synthetic
tgatcgtaagcaaugccacagaatua

SEQ ID NO: 36479 - DNA, 28 bp, Artificial Sequence
  Synthetic
ccttactgacugttttgtttggttuact

SEQ ID NO: 36480 - DNA, 27 bp, Artificial Sequence
  Synthetic
agaattctcaaaugaggagtgttuccc

SEQ ID NO: 36481 - DNA, 24 bp, Artificial Sequence
  Synthetic
cattgccttucttctcatccucca

SEQ ID NO: 36482 - DNA, 29 bp, Artificial Sequence
  Synthetic
tcatcgtctctuaaaagtactccatcuct

SEQ ID NO: 36483 - DNA, 28 bp, Artificial Sequence
  Synthetic
gaacttctcauttcatctccuaacacct

SEQ ID NO: 36484 - DNA, 29 bp, Artificial Sequence
  Synthetic
cagttcctatacuattttctgcttugcat

SEQ ID NO: 36485 - DNA, 24 bp, Artificial Sequence
  Synthetic
ctgggacaccagaaautacagugt

SEQ ID NO: 36486 - DNA, 22 bp, Artificial Sequence
  Synthetic
gaaaggcucacagtuagcaact

SEQ ID NO: 36487 - DNA, 21 bp, Artificial Sequence
  Synthetic
gggcagtatucctgcgagaut

SEQ ID NO: 36488 - DNA, 28 bp, Artificial Sequence
  Synthetic
gttaaaaccaucctttttccaagugaca

SEQ ID NO: 36489 - DNA, 28 bp, Artificial Sequence
  Synthetic
ccttgtgttttucttgtgtttaacugct

SEQ ID NO: 36490 - DNA, 22 bp, Artificial Sequence
  Synthetic
ccagttcugccacagtgtctuc

SEQ ID NO: 36491 - DNA, 31 bp, Artificial Sequence
  Synthetic
gcttacaggatcutttaattgttctccaugt

SEQ ID NO: 36492 - DNA, 24 bp, Artificial Sequence
  Synthetic
agaattcaacugcaatgugcagac

SEQ ID NO: 36493 - DNA, 25 bp, Artificial Sequence
  Synthetic
tgagtctcutacctttccucacaca

SEQ ID NO: 36494 - DNA, 25 bp, Artificial Sequence
  Synthetic
agctaaatttgugtttttggcugct

SEQ ID NO: 36495 - DNA, 28 bp, Artificial Sequence
  Synthetic
agactttgacagauggatatcacgttut

SEQ ID NO: 36496 - DNA, 31 bp, Artificial Sequence
  Synthetic
atcctgatgtttucactttctctaatcacut

SEQ ID NO: 36497 - DNA, 28 bp, Artificial Sequence
  Synthetic
acaatttccatccaucttttcctgtuca

SEQ ID NO: 36498 - DNA, 28 bp, Artificial Sequence
  Synthetic
acattgagaatgugaatacttgtgugga

SEQ ID NO: 36499 - DNA, 28 bp, Artificial Sequence
  Synthetic
agtagcccaatucatgagaaattctugt

SEQ ID NO: 36500 - DNA, 21 bp, Artificial Sequence
  Synthetic
gtatgacggccacugagucaa

SEQ ID NO: 36501 - DNA, 29 bp, Artificial Sequence
  Synthetic
tgatactctcctcuttcctgactcttuag

SEQ ID NO: 36502 - DNA, 20 bp, Artificial Sequence
  Synthetic
gucgaccctuccaagccaat

SEQ ID NO: 36503 - DNA, 31 bp, Artificial Sequence
  Synthetic
tgtcacaataatucaactgcaagcaattuaa

SEQ ID NO: 36504 - DNA, 29 bp, Artificial Sequence
  Synthetic
tccagautattaactuccagagacacaga

SEQ ID NO: 36505 - DNA, 23 bp, Artificial Sequence
  Synthetic
gttttgcugtttgcatuggacag

SEQ ID NO: 36506 - DNA, 23 bp, Artificial Sequence
  Synthetic
gcttccgaagucatttuccacct

SEQ ID NO: 36507 - DNA, 23 bp, Artificial Sequence
  Synthetic
catgacctuggaatgtgttgugg

SEQ ID NO: 36508 - DNA, 27 bp, Artificial Sequence
  Synthetic
ctgctaatgaaacugtcgctauagact

SEQ ID NO: 36509 - DNA, 29 bp, Artificial Sequence
  Synthetic
tgtctatatttcatutgtggacagtgugg

SEQ ID NO: 36510 - DNA, 31 bp, Artificial Sequence
  Synthetic
cagaatttttatttgauaggctgcttctugt

SEQ ID NO: 36511 - DNA, 24 bp, Artificial Sequence
  Synthetic
cgtttgaagucacttggcugaaga

SEQ ID NO: 36512 - DNA, 23 bp, Artificial Sequence
  Synthetic
cucaagggaagaucccaaactua

SEQ ID NO: 36513 - DNA, 26 bp, Artificial Sequence
  Synthetic
gggaatgaaauaacagccatucagaa

SEQ ID NO: 36514 - DNA, 29 bp, Artificial Sequence
  Synthetic
caagaaaatcuagacaagcaagaaaguga

SEQ ID NO: 36515 - DNA, 25 bp, Artificial Sequence
  Synthetic
aacaaagagutacacucaggagcag

SEQ ID NO: 36516 - DNA, 31 bp, Artificial Sequence
  Synthetic
cttgataaguggaaataaaattugccaacct

SEQ ID NO: 36517 - DNA, 22 bp, Artificial Sequence
  Synthetic
cccataagcauccagtggtuca

SEQ ID NO: 36518 - DNA, 24 bp, Artificial Sequence
  Synthetic
cccaaucctctctguagaagaaca

SEQ ID NO: 36519 - DNA, 27 bp, Artificial Sequence
  Synthetic
gactaaggagatuacagccaaatggut

SEQ ID NO: 36520 - DNA, 21 bp, Artificial Sequence
  Synthetic
ccaaggcaaacgutcugaacc

SEQ ID NO: 36521 - DNA, 24 bp, Artificial Sequence
  Synthetic
gccaattacggugacttggcuaaa

SEQ ID NO: 36522 - DNA, 22 bp, Artificial Sequence
  Synthetic
cttcagaaaagccagucccuca

SEQ ID NO: 36523 - DNA, 28 bp, Artificial Sequence
  Synthetic
ctgcgaagtgguagaaagtataagacut

SEQ ID NO: 36524 - DNA, 22 bp, Artificial Sequence
  Synthetic
ggccauaacttuggcaacacaa

SEQ ID NO: 36525 - DNA, 29 bp, Artificial Sequence
  Synthetic
tgauagagaaatuaaggagagcagcaaac

SEQ ID NO: 36526 - DNA, 26 bp, Artificial Sequence
  Synthetic
acaaggtuagcacaaagatgucaaga

SEQ ID NO: 36527 - DNA, 22 bp, Artificial Sequence
  Synthetic
caacaaagagcuggtttcuggt

SEQ ID NO: 36528 - DNA, 24 bp, Artificial Sequence
  Synthetic
gataaaaugcaaagtcuccagcca

SEQ ID NO: 36529 - DNA, 28 bp, Artificial Sequence
  Synthetic
aaagaaatagcugcttctgacagauaca

SEQ ID NO: 36530 - DNA, 26 bp, Artificial Sequence
  Synthetic
gttgggttucaaatgcatatguagca

SEQ ID NO: 36531 - DNA, 23 bp, Artificial Sequence
  Synthetic
gtacaaagaugggagaccctugg

SEQ ID NO: 36532 - DNA, 29 bp, Artificial Sequence
  Synthetic
gcaatttgagguttaaatgttccuacaca

SEQ ID NO: 36533 - DNA, 27 bp, Artificial Sequence
  Synthetic
ggtcaucagagaagacggaaaaaucaa

SEQ ID NO: 36534 - DNA, 28 bp, Artificial Sequence
  Synthetic
gataggauaagagaagaaaguaccagut

SEQ ID NO: 36535 - DNA, 27 bp, Artificial Sequence
  Synthetic
tgttggtgaataugaatgtgttgtugc

SEQ ID NO: 36536 - DNA, 26 bp, Artificial Sequence
  Synthetic
gaaccagcuaatttcaaatgguccag

SEQ ID NO: 36537 - DNA, 25 bp, Artificial Sequence
  Synthetic
ggtttgtttacugagtttccaucca

SEQ ID NO: 36538 - DNA, 22 bp, Artificial Sequence
  Synthetic
ggatcacaggugagccttucag

SEQ ID NO: 36539 - DNA, 24 bp, Artificial Sequence
  Synthetic
ttatgtgtgtugggtctctttgut

SEQ ID NO: 36540 - DNA, 30 bp, Artificial Sequence
  Synthetic
ccaaaggaatcucaagtgttgctatttuat

SEQ ID NO: 36541 - DNA, 25 bp, Artificial Sequence
  Synthetic
gccaagcagagutgatcatcatuga

SEQ ID NO: 36542 - DNA, 22 bp, Artificial Sequence
  Synthetic
agagtgcagcaccauctttcug

SEQ ID NO: 36543 - DNA, 29 bp, Artificial Sequence
  Synthetic
gacttaactcaucttttctctgtctugga

SEQ ID NO: 36544 - DNA, 22 bp, Artificial Sequence
  Synthetic
cacctgggutctcaggattuca

SEQ ID NO: 36545 - DNA, 26 bp, Artificial Sequence
  Synthetic
ttaatggactcuacttcccttugcag

SEQ ID NO: 36546 - DNA, 23 bp, Artificial Sequence
  Synthetic
ggcctcacagacauactctccut

SEQ ID NO: 36547 - DNA, 23 bp, Artificial Sequence
  Synthetic
ggatggccccaugatacauacac

SEQ ID NO: 36548 - DNA, 22 bp, Artificial Sequence
  Synthetic
gctgaagcaaccccuttaguga

SEQ ID NO: 36549 - DNA, 24 bp, Artificial Sequence
  Synthetic
cctaacagcugagggtccuagaat

SEQ ID NO: 36550 - DNA, 22 bp, Artificial Sequence
  Synthetic
acatgatgtguctgggctctug

SEQ ID NO: 36551 - DNA, 25 bp, Artificial Sequence
  Synthetic
ggcaataaagaaagugcaggaggua

SEQ ID NO: 36552 - DNA, 22 bp, Artificial Sequence
  Synthetic
cutcctcaattcugaccgcaga

SEQ ID NO: 36553 - DNA, 21 bp, Artificial Sequence
  Synthetic
cacaaagugcgctcatctuga

SEQ ID NO: 36554 - DNA, 26 bp, Artificial Sequence
  Synthetic
tggaggttcuattgaagactguggat

SEQ ID NO: 36555 - DNA, 24 bp, Artificial Sequence
  Synthetic
ccaacctacagcugcagattguac

SEQ ID NO: 36556 - DNA, 26 bp, Artificial Sequence
  Synthetic
ctgctcaatucattggcttuagcaat

SEQ ID NO: 36557 - DNA, 21 bp, Artificial Sequence
  Synthetic
cugcaaagcaaaguccacacc

SEQ ID NO: 36558 - DNA, 25 bp, Artificial Sequence
  Synthetic
gttccagagccautagggttaugaa

SEQ ID NO: 36559 - DNA, 23 bp, Artificial Sequence
  Synthetic
gaaacagaaucagcaguggcaaa

SEQ ID NO: 36560 - DNA, 25 bp, Artificial Sequence
  Synthetic
gctatgaucatcaccgucaaaaaca

SEQ ID NO: 36561 - DNA, 27 bp, Artificial Sequence
  Synthetic
gtctgaatcuccagtttacccaacuaa

SEQ ID NO: 36562 - DNA, 24 bp, Artificial Sequence
  Synthetic
gggtcuccaaggtaatgaatucaa

SEQ ID NO: 36563 - DNA, 25 bp, Artificial Sequence
  Synthetic
caaacaaaucaggaatggcugagag

SEQ ID NO: 36564 - DNA, 22 bp, Artificial Sequence
  Synthetic
gccacttucctcaacagugaac

SEQ ID NO: 36565 - DNA, 28 bp, Artificial Sequence
  Synthetic
tcttaaagagcaacuacacagacagtut

SEQ ID NO: 36566 - DNA, 26 bp, Artificial Sequence
  Synthetic
agatagcctcucctacacaatucaca

SEQ ID NO: 36567 - DNA, 31 bp, Artificial Sequence
  Synthetic
ttttaaaattccagaaaautcagatgctgua

SEQ ID NO: 36568 - DNA, 30 bp, Artificial Sequence
  Synthetic
tggaagaacatcuagactcacaatcauact

SEQ ID NO: 36569 - DNA, 25 bp, Artificial Sequence
  Synthetic
gattuggaacacaccacatcaucaa

SEQ ID NO: 36570 - DNA, 23 bp, Artificial Sequence
  Synthetic
gcaaagctctutgcttccccuat

SEQ ID NO: 36571 - DNA, 26 bp, Artificial Sequence
  Synthetic
cattgttgaagutgaaggtctuccag

SEQ ID NO: 36572 - DNA, 28 bp, Artificial Sequence
  Synthetic
catatttcataagcugaacccctctcut

SEQ ID NO: 36573 - DNA, 23 bp, Artificial Sequence
  Synthetic
actcuggagagatacuccacacc

SEQ ID NO: 36574 - DNA, 27 bp, Artificial Sequence
  Synthetic
ggagtatctttcucctacctcacctuc

SEQ ID NO: 36575 - DNA, 27 bp, Artificial Sequence
  Synthetic
gatcagttttauaccccaccatcauct

SEQ ID NO: 36576 - DNA, 31 bp, Artificial Sequence
  Synthetic
ctagtgattcctguttctggttgtagtatuc

SEQ ID NO: 36577 - DNA, 25 bp, Artificial Sequence
  Synthetic
agaatcugagacctcccuaacacaa

SEQ ID NO: 36578 - DNA, 25 bp, Artificial Sequence
  Synthetic
acatttttcttcuccagaggcauga

SEQ ID NO: 36579 - DNA, 22 bp, Artificial Sequence
  Synthetic
gcattuccaaagcaggatggug

SEQ ID NO: 36580 - DNA, 28 bp, Artificial Sequence
  Synthetic
aggacaacttttcucagaaagatcagut

SEQ ID NO: 36581 - DNA, 28 bp, Artificial Sequence
  Synthetic
gagctttcaaauagaactatgguggaga

SEQ ID NO: 36582 - DNA, 27 bp, Artificial Sequence
  Synthetic
tgtaacgttucagggctaggaatttut

SEQ ID NO: 36583 - DNA, 28 bp, Artificial Sequence
  Synthetic
cacactcaaauaaaacacacagatguga

SEQ ID NO: 36584 - DNA, 24 bp, Artificial Sequence
  Synthetic
ttccctttctugtgcgtcaaatuc

SEQ ID NO: 36585 - DNA, 29 bp, Artificial Sequence
  Synthetic
ctcaaaagaagatugatgacaaagcctut

SEQ ID NO: 36586 - DNA, 24 bp, Artificial Sequence
  Synthetic
ctttttccccggguagtgtatcuc

SEQ ID NO: 36587 - DNA, 29 bp, Artificial Sequence
  Synthetic
ttggaaaacutggtagaucagaaaaggaa

SEQ ID NO: 36588 - DNA, 26 bp, Artificial Sequence
  Synthetic
gacattgtatgaautcagccctgaug

SEQ ID NO: 36589 - DNA, 31 bp, Artificial Sequence
  Synthetic
actccctggacaaaugtaaaagaatatucag

SEQ ID NO: 36590 - DNA, 25 bp, Artificial Sequence
  Synthetic
ttctctataagugacaggcuccact

SEQ ID NO: 36591 - DNA, 25 bp, Artificial Sequence
  Synthetic
cagccagtugtaacatggttucaaa

SEQ ID NO: 36592 - DNA, 30 bp, Artificial Sequence
  Synthetic
caaatctgtgtttuggtgattgagtaacut

SEQ ID NO: 36593 - DNA, 24 bp, Artificial Sequence
  Synthetic
gtcaagagggucaaacaaauctuc

SEQ ID NO: 36594 - DNA, 29 bp, Artificial Sequence
  Synthetic
gacatcatgttttugttttgctttcacut

SEQ ID NO: 36595 - DNA, 28 bp, Artificial Sequence
  Synthetic
gatatcctcaaccuatagtgacgtggua

SEQ ID NO: 36596 - DNA, 27 bp, Artificial Sequence
  Synthetic
atgttttcttccutctgttcggtttug

SEQ ID NO: 36597 - DNA, 27 bp, Artificial Sequence
  Synthetic
agaaggaggaaguatatgagactccug

SEQ ID NO: 36598 - DNA, 25 bp, Artificial Sequence
  Synthetic
ggtagactttccuttaccagtgcut

SEQ ID NO: 36599 - DNA, 29 bp, Artificial Sequence
  Synthetic
ctctagagaggacaugaaaatcagatcua

SEQ ID NO: 36600 - DNA, 22 bp, Artificial Sequence
  Synthetic
cctccctuaaacgttgcaacut

SEQ ID NO: 36601 - DNA, 25 bp, Artificial Sequence
  Synthetic
ggtttactggcuctcccttuaacaa

SEQ ID NO: 36602 - DNA, 29 bp, Artificial Sequence
  Synthetic
tccgttctgcucttttcagaaattcuaaa

SEQ ID NO: 36603 - DNA, 27 bp, Artificial Sequence
  Synthetic
atttacaccatcacucttccagctuag

SEQ ID NO: 36604 - DNA, 28 bp, Artificial Sequence
  Synthetic
aaccggttcacccuctaaaacatattua

SEQ ID NO: 36605 - DNA, 25 bp, Artificial Sequence
  Synthetic
gggaauctgaacatucagaaaggga

SEQ ID NO: 36606 - DNA, 26 bp, Artificial Sequence
  Synthetic
ttttgtgattguttcagtctcucgga

SEQ ID NO: 36607 - DNA, 27 bp, Artificial Sequence
  Synthetic
aattgcagaaagcacugagctatcuaa

SEQ ID NO: 36608 - DNA, 27 bp, Artificial Sequence
  Synthetic
ccttttgagatautttgctctccucct

SEQ ID NO: 36609 - DNA, 29 bp, Artificial Sequence
  Synthetic
gggcaagugacaaaguttagatcttaaua

SEQ ID NO: 36610 - DNA, 24 bp, Artificial Sequence
  Synthetic
actattggcugctttgcaagagua

SEQ ID NO: 36611 - DNA, 22 bp, Artificial Sequence
  Synthetic
gatttcaugcgagggtttcugg

SEQ ID NO: 36612 - DNA, 29 bp, Artificial Sequence
  Synthetic
ggaacaacaatgauttacatgaactctug

SEQ ID NO: 36613 - DNA, 27 bp, Artificial Sequence
  Synthetic
agaagatgaaggaacutacacgttugt

SEQ ID NO: 36614 - DNA, 29 bp, Artificial Sequence
  Synthetic
tttgtaagtatuggcaatgacacctttug

SEQ ID NO: 36615 - DNA, 28 bp, Artificial Sequence
  Synthetic
tgtgaggtctcuatggtgacttaaucat

SEQ ID NO: 36616 - DNA, 28 bp, Artificial Sequence
  Synthetic
cttcaatuagcaaaagugtgtattctug

SEQ ID NO: 36617 - DNA, 27 bp, Artificial Sequence
  Synthetic
atgggctattugtcaacatttacucct

SEQ ID NO: 36618 - DNA, 25 bp, Artificial Sequence
  Synthetic
gtctcagagauaaacattcggugga

SEQ ID NO: 36619 - DNA, 28 bp, Artificial Sequence
  Synthetic
gagcttcaagttuttgttgttgttgtug

SEQ ID NO: 36620 - DNA, 22 bp, Artificial Sequence
  Synthetic
gatgcgaacauctctgcctuct

SEQ ID NO: 36621 - DNA, 28 bp, Artificial Sequence
  Synthetic
ggtaaactcgaauttccatttcauccat

SEQ ID NO: 36622 - DNA, 28 bp, Artificial Sequence
  Synthetic
tgaaaccataccutccacataaagtgug

SEQ ID NO: 36623 - DNA, 28 bp, Artificial Sequence
  Synthetic
cagtgaactaugaaggcatctctuacaa

SEQ ID NO: 36624 - DNA, 22 bp, Artificial Sequence
  Synthetic
agtggucagcaaagtguaggat

SEQ ID NO: 36625 - DNA, 22 bp, Artificial Sequence
  Synthetic
acagaggacucggcagaauaca

SEQ ID NO: 36626 - DNA, 21 bp, Artificial Sequence
  Synthetic
gggacautgaagugggacacc

SEQ ID NO: 36627 - DNA, 28 bp, Artificial Sequence
  Synthetic
tgaaccccatguatctatttgtttggut

SEQ ID NO: 36628 - DNA, 22 bp, Artificial Sequence
  Synthetic
cagcatcagcutgtggacttuc

SEQ ID NO: 36629 - DNA, 28 bp, Artificial Sequence
  Synthetic
tcactgaattgcuccaattttcctctua

SEQ ID NO: 36630 - DNA, 30 bp, Artificial Sequence
  Synthetic
ttgttccttugacagagataguatacttut

SEQ ID NO: 36631 - DNA, 28 bp, Artificial Sequence
  Synthetic
ggacttcttttccutgatgatgtcauct

SEQ ID NO: 36632 - DNA, 23 bp, Artificial Sequence
  Synthetic
tgtcauctaatttgguggcagca

SEQ ID NO: 36633 - DNA, 29 bp, Artificial Sequence
  Synthetic
actcatactguacatctcttgtuccaaag

SEQ ID NO: 36634 - DNA, 26 bp, Artificial Sequence
  Synthetic
tttagaactgggcutgatttcctugt

SEQ ID NO: 36635 - DNA, 29 bp, Artificial Sequence
  Synthetic
tttcccagtguaacaataaccaagagaut

SEQ ID NO: 36636 - DNA, 24 bp, Artificial Sequence
  Synthetic
ttcggttaatgacuagtcgctgut

SEQ ID NO: 36637 - DNA, 29 bp, Artificial Sequence
  Synthetic
attcatcttgtgugtgtatgatttugcag

SEQ ID NO: 36638 - DNA, 22 bp, Artificial Sequence
  Synthetic
gggctggaauggtgaaagagua

SEQ ID NO: 36639 - DNA, 28 bp, Artificial Sequence
  Synthetic
tgaagttaaagtcuccttggaaagtgug

SEQ ID NO: 36640 - DNA, 21 bp, Artificial Sequence
  Synthetic
gcugacaggaaugggaggact

SEQ ID NO: 36641 - DNA, 29 bp, Artificial Sequence
  Synthetic
tgtggagcttaaauccaatggcaaataua

SEQ ID NO: 36642 - DNA, 27 bp, Artificial Sequence
  Synthetic
ctaattttaccacaugctaagggugac

SEQ ID NO: 36643 - DNA, 24 bp, Artificial Sequence
  Synthetic
ggatgcactcugacagaaaggtuc

SEQ ID NO: 36644 - DNA, 27 bp, Artificial Sequence
  Synthetic
aatacaaagacagguccaucaaaggaa

SEQ ID NO: 36645 - DNA, 21 bp, Artificial Sequence
  Synthetic
attgaacgguctgaccggauc

SEQ ID NO: 36646 - DNA, 28 bp, Artificial Sequence
  Synthetic
actaggactuagttcaatcttgucaggt

SEQ ID NO: 36647 - DNA, 24 bp, Artificial Sequence
  Synthetic
caguaaatucaagcgcagaacaga

SEQ ID NO: 36648 - DNA, 25 bp, Artificial Sequence
  Synthetic
cttcaaactgaagcuttcctggtuc

SEQ ID NO: 36649 - DNA, 25 bp, Artificial Sequence
  Synthetic
aggttcagagtucgctatgatggua

SEQ ID NO: 36650 - DNA, 26 bp, Artificial Sequence
  Synthetic
ctggcttttgcutttctttctgauct

SEQ ID NO: 36651 - DNA, 30 bp, Artificial Sequence
  Synthetic
gttgcatattcuagagacagtggtatcaut

SEQ ID NO: 36652 - DNA, 23 bp, Artificial Sequence
  Synthetic
gtgttagccugcattcaaagugg

SEQ ID NO: 36653 - DNA, 24 bp, Artificial Sequence
  Synthetic
gccugagccagagagaaagtuaat

SEQ ID NO: 36654 - DNA, 28 bp, Artificial Sequence
  Synthetic
atcaatatagtgguatagcttcccuggt

SEQ ID NO: 36655 - DNA, 26 bp, Artificial Sequence
  Synthetic
acttgaaaugaaagtcagagcuacgg

SEQ ID NO: 36656 - DNA, 28 bp, Artificial Sequence
  Synthetic
gctgaaataccugtttataacccaagug

SEQ ID NO: 36657 - DNA, 31 bp, Artificial Sequence
  Synthetic
agcaaattgtcaaugactatacccauaaagt

SEQ ID NO: 36658 - DNA, 29 bp, Artificial Sequence
  Synthetic
gattcatgagcaaaaacutatcacgctua

SEQ ID NO: 36659 - DNA, 28 bp, Artificial Sequence
  Synthetic
acagatgagucacaacttgagagacuat

SEQ ID NO: 36660 - DNA, 27 bp, Artificial Sequence
  Synthetic
ttagcccucgattttcttctuacacaa

SEQ ID NO: 36661 - DNA, 23 bp, Artificial Sequence
  Synthetic
gaaattgtatguggagcctgcug

SEQ ID NO: 36662 - DNA, 29 bp, Artificial Sequence
  Synthetic
ccatcttgtagaaaguccatttggtauct

SEQ ID NO: 36663 - DNA, 26 bp, Artificial Sequence
  Synthetic
aacatttatcauagctcctugccaca

SEQ ID NO: 36664 - DNA, 29 bp, Artificial Sequence
  Synthetic
ctgattcaacagcutcagattcagaaaug

SEQ ID NO: 36665 - DNA, 27 bp, Artificial Sequence
  Synthetic
aacagtctagcucagatacatctccut

SEQ ID NO: 36666 - DNA, 28 bp, Artificial Sequence
  Synthetic
actacagtatctutggccattttctucc

SEQ ID NO: 36667 - DNA, 26 bp, Artificial Sequence
  Synthetic
tuactgatgaagucccagcaagaaat

SEQ ID NO: 36668 - DNA, 25 bp, Artificial Sequence
  Synthetic
gggtgaguaaattctactcuaggct

SEQ ID NO: 36669 - DNA, 22 bp, Artificial Sequence
  Synthetic
ctgccgcgccutactttatuac

SEQ ID NO: 36670 - DNA, 22 bp, Artificial Sequence
  Synthetic
ccctcatatuagcttccgggut

SEQ ID NO: 36671 - DNA, 27 bp, Artificial Sequence
  Synthetic
gggtcactaaacauctcatctcaauga

SEQ ID NO: 36672 - DNA, 27 bp, Artificial Sequence
  Synthetic
gtcaatggaactutcgatttggtaguc

SEQ ID NO: 36673 - DNA, 28 bp, Artificial Sequence
  Synthetic
gcagttgaaaugcataagttcaaacuct

SEQ ID NO: 36674 - DNA, 21 bp, Artificial Sequence
  Synthetic
gcaagacuccactggctacut

SEQ ID NO: 36675 - DNA, 21 bp, Artificial Sequence
  Synthetic
ccttcgcugacacaccagaua

SEQ ID NO: 36676 - DNA, 24 bp, Artificial Sequence
  Synthetic
cagagatgctcugtttcacaggut

SEQ ID NO: 36677 - DNA, 28 bp, Artificial Sequence
  Synthetic
ggtatcacugagtttcatttcaaugcag

SEQ ID NO: 36678 - DNA, 20 bp, Artificial Sequence
  Synthetic
ctaccttugcggcggaaaug

SEQ ID NO: 36679 - DNA, 31 bp, Artificial Sequence
  Synthetic
ccagcctgatcucgatattcctatgtatuaa

SEQ ID NO: 36680 - DNA, 25 bp, Artificial Sequence
  Synthetic
tcaccttcucctgagttattugcac

SEQ ID NO: 36681 - DNA, 28 bp, Artificial Sequence
  Synthetic
cctcctttctttutgacttacgtttcut

SEQ ID NO: 36682 - DNA, 27 bp, Artificial Sequence
  Synthetic
aagacttctccauttaagggtttugac

SEQ ID NO: 36683 - DNA, 30 bp, Artificial Sequence
  Synthetic
gctaaagucaaagaacaagaaacuagaaut

SEQ ID NO: 36684 - DNA, 27 bp, Artificial Sequence
  Synthetic
tgattatctgtgutgacccctguaaga

SEQ ID NO: 36685 - DNA, 29 bp, Artificial Sequence
  Synthetic
gtgttttctucctttctctaugaaaagca

SEQ ID NO: 36686 - DNA, 24 bp, Artificial Sequence
  Synthetic
ctgatcactggutctctcactcug

SEQ ID NO: 36687 - DNA, 24 bp, Artificial Sequence
  Synthetic
gtattttgcuctaggtggcucagt

SEQ ID NO: 36688 - DNA, 24 bp, Artificial Sequence
  Synthetic
ctgatctgaguagaggttgucagc

SEQ ID NO: 36689 - DNA, 24 bp, Artificial Sequence
  Synthetic
tcttgacctcugccttttggttut

SEQ ID NO: 36690 - DNA, 21 bp, Artificial Sequence
  Synthetic
gtgcttuggcagcaauagacg

SEQ ID NO: 36691 - DNA, 26 bp, Artificial Sequence
  Synthetic
ctcaacgtgggcuttgttttaatcut

SEQ ID NO: 36692 - DNA, 23 bp, Artificial Sequence
  Synthetic
ctuggccccattuagacacaaac

SEQ ID NO: 36693 - DNA, 22 bp, Artificial Sequence
  Synthetic
ccagagcucccttgattuccaa

SEQ ID NO: 36694 - DNA, 22 bp, Artificial Sequence
  Synthetic
gcatctaccuctgcccauagct

SEQ ID NO: 36695 - DNA, 26 bp, Artificial Sequence
  Synthetic
actaaagccaacaguggacgatatuc

SEQ ID NO: 36696 - DNA, 22 bp, Artificial Sequence
  Synthetic
tcaagtccugcagcaacgtuaa

SEQ ID NO: 36697 - DNA, 26 bp, Artificial Sequence
  Synthetic
ccttagcugggacaccctaatttaut

SEQ ID NO: 36698 - DNA, 24 bp, Artificial Sequence
  Synthetic
aggtttaaagcauggccacattuc

SEQ ID NO: 36699 - DNA, 25 bp, Artificial Sequence
  Synthetic
tttgtatttggcautggcattgugt

SEQ ID NO: 36700 - DNA, 26 bp, Artificial Sequence
  Synthetic
tgatgcaacutccattaagucaccat

SEQ ID NO: 36701 - DNA, 28 bp, Artificial Sequence
  Synthetic
gcgttagtagcuagagataaaccaagua

SEQ ID NO: 36702 - DNA, 25 bp, Artificial Sequence
  Synthetic
ccaacagttaautggatacccugga

SEQ ID NO: 36703 - DNA, 28 bp, Artificial Sequence
  Synthetic
gtgagggaaaauaaccaatcacttucat

SEQ ID NO: 36704 - DNA, 29 bp, Artificial Sequence
  Synthetic
cattgagttttuacctacctttctugcac

SEQ ID NO: 36705 - DNA, 26 bp, Artificial Sequence
  Synthetic
ggcactggcaaaacutaagtaaguct

SEQ ID NO: 36706 - DNA, 25 bp, Artificial Sequence
  Synthetic
gaacctgccutttcttaaagtcuga

SEQ ID NO: 36707 - DNA, 26 bp, Artificial Sequence
  Synthetic
gtgcatgttutaaaattgcttuggca

SEQ ID NO: 36708 - DNA, 26 bp, Artificial Sequence
  Synthetic
ttacacatcaguccaacacttuagca

SEQ ID NO: 36709 - DNA, 29 bp, Artificial Sequence
  Synthetic
aatttaggtaugttattcacagugggcat

SEQ ID NO: 36710 - DNA, 27 bp, Artificial Sequence
  Synthetic
ttacaagtagttucccaagtttgcaut

SEQ ID NO: 36711 - DNA, 28 bp, Artificial Sequence
  Synthetic
gctacccaggtutattatgagaaggtug

SEQ ID NO: 36712 - DNA, 28 bp, Artificial Sequence
  Synthetic
ggctgattaaaattucccatgaggagua

SEQ ID NO: 36713 - DNA, 30 bp, Artificial Sequence
  Synthetic
cagagaagtgguactttattaggtaucaca

SEQ ID NO: 36714 - DNA, 20 bp, Artificial Sequence
  Synthetic
agcaaaagcucgtgggtgua

SEQ ID NO: 36715 - DNA, 20 bp, Artificial Sequence
  Synthetic
aucttcgagaucgggaggga

SEQ ID NO: 36716 - DNA, 17 bp, Artificial Sequence
  Synthetic
gcacucacccggtucct

SEQ ID NO: 36717 - DNA, 17 bp, Artificial Sequence
  Synthetic
gccagggugctggacug

SEQ ID NO: 36718 - DNA, 28 bp, Artificial Sequence
  Synthetic
ccattgcctuaaaatgttgcatttguct

SEQ ID NO: 36719 - DNA, 21 bp, Artificial Sequence
  Synthetic
gtttctggtcutcgcagccua

SEQ ID NO: 36720 - DNA, 26 bp, Artificial Sequence
  Synthetic
cacgtcucaacaattaauaaccgcaa

SEQ ID NO: 36721 - DNA, 27 bp, Artificial Sequence
  Synthetic
ggacaaaguaagccttggacttttuag

SEQ ID NO: 36722 - DNA, 23 bp, Artificial Sequence
  Synthetic
gtaggacugagatgtuggcagac

SEQ ID NO: 36723 - DNA, 25 bp, Artificial Sequence
  Synthetic
attttaacctcutcccaatcuggct

SEQ ID NO: 36724 - DNA, 22 bp, Artificial Sequence
  Synthetic
gctgtctgggutggaaggaauc

SEQ ID NO: 36725 - DNA, 22 bp, Artificial Sequence
  Synthetic
ggtggcugatgaactttugcac

SEQ ID NO: 36726 - DNA, 24 bp, Artificial Sequence
  Synthetic
ggttgaaagccaucagttgatugg

SEQ ID NO: 36727 - DNA, 28 bp, Artificial Sequence
  Synthetic
tttcagtaagaagccuctaatctgttut

SEQ ID NO: 36728 - DNA, 25 bp, Artificial Sequence
  Synthetic
gggccagtucctccctagtauaaat

SEQ ID NO: 36729 - DNA, 33 bp, Artificial Sequence
  Synthetic
cattttatgatgtttugttcttctgtgctttua

SEQ ID NO: 36730 - DNA, 25 bp, Artificial Sequence
  Synthetic
cuctctcctttaaugcgaggaaact

SEQ ID NO: 36731 - DNA, 22 bp, Artificial Sequence
  Synthetic
tcttaaccacuttcagccccug

SEQ ID NO: 36732 - DNA, 20 bp, Artificial Sequence
  Synthetic
ctgccgucagatcaccaaug

SEQ ID NO: 36733 - DNA, 25 bp, Artificial Sequence
  Synthetic
agtaaatucgggaaaggugaagagg

SEQ ID NO: 36734 - DNA, 22 bp, Artificial Sequence
  Synthetic
gggagaggutaatgggccuagt

SEQ ID NO: 36735 - DNA, 21 bp, Artificial Sequence
  Synthetic
tgcccgccugttctctuaaag

SEQ ID NO: 36736 - DNA, 22 bp, Artificial Sequence
  Synthetic
gtatggagccaguctcctggua

SEQ ID NO: 36737 - DNA, 24 bp, Artificial Sequence
  Synthetic
gcttctcuttttcacctucccaca

SEQ ID NO: 36738 - DNA, 18 bp, Artificial Sequence
  Synthetic
caucatccugggcacagc

SEQ ID NO: 36739 - DNA, 18 bp, Artificial Sequence
  Synthetic
tttcccgggutccagcuc

SEQ ID NO: 36740 - DNA, 26 bp, Artificial Sequence
  Synthetic
ggatgcutcagtcttuacagaacagg

SEQ ID NO: 36741 - DNA, 26 bp, Artificial Sequence
  Synthetic
agtgatttgauggctgtaatcctuca

SEQ ID NO: 36742 - DNA, 21 bp, Artificial Sequence
  Synthetic
ccagaucagcccccaaattuc

SEQ ID NO: 36743 - DNA, 28 bp, Artificial Sequence
  Synthetic
ctgtttctaagcugcatttcacttucaa

SEQ ID NO: 36744 - DNA, 20 bp, Artificial Sequence
  Synthetic
gccctttccauctggaggug

SEQ ID NO: 36745 - DNA, 19 bp, Artificial Sequence
  Synthetic
ctagcggugcccacgtuat

SEQ ID NO: 36746 - DNA, 30 bp, Artificial Sequence
  Synthetic
gagagggtaguagaaattcacttgctatut

SEQ ID NO: 36747 - DNA, 25 bp, Artificial Sequence
  Synthetic
tggguacagacattcacuaggaagt

SEQ ID NO: 36748 - DNA, 25 bp, Artificial Sequence
  Synthetic
cctgatcaatuacacacacggguat

SEQ ID NO: 36749 - DNA, 30 bp, Artificial Sequence
  Synthetic
agactgaauaacacaaaactgttctctuct

SEQ ID NO: 36750 - DNA, 29 bp, Artificial Sequence
  Synthetic
ttcaaatagcagatuccatcattagccut

SEQ ID NO: 36751 - DNA, 26 bp, Artificial Sequence
  Synthetic
gggagcucactaaactatucacaagt

SEQ ID NO: 36752 - DNA, 22 bp, Artificial Sequence
  Synthetic
ggcagattccaucatcagccut

SEQ ID NO: 36753 - DNA, 29 bp, Artificial Sequence
  Synthetic
gctcacugaagacccuaatttaaactaut

SEQ ID NO: 36754 - DNA, 21 bp, Artificial Sequence
  Synthetic
gtggtcacauagtggtgcuct

SEQ ID NO: 36755 - DNA, 27 bp, Artificial Sequence
  Synthetic
ctggatctgagcuctgaaatgactuat

SEQ ID NO: 36756 - DNA, 21 bp, Artificial Sequence
  Synthetic
cccaccauagcctcttggtug

SEQ ID NO: 36757 - DNA, 29 bp, Artificial Sequence
  Synthetic
agtccctgcaauctgtaataatttcctut

SEQ ID NO: 36758 - DNA, 22 bp, Artificial Sequence
  Synthetic
tcaggatctcaucgctttgcug

SEQ ID NO: 36759 - DNA, 22 bp, Artificial Sequence
  Synthetic
agggtactgaugtgtgtcccut

SEQ ID NO: 36760 - DNA, 25 bp, Artificial Sequence
  Synthetic
gcttctgtaaaucgtcaccagatug

SEQ ID NO: 36761 - DNA, 28 bp, Artificial Sequence
  Synthetic
ccatttttauaggaatctcuggaagcct

SEQ ID NO: 36762 - DNA, 21 bp, Artificial Sequence
  Synthetic
cctcatuccacagccctguag

SEQ ID NO: 36763 - DNA, 21 bp, Artificial Sequence
  Synthetic
gggaguggagtgagugaggag

SEQ ID NO: 36764 - DNA, 21 bp, Artificial Sequence
  Synthetic
tgauccggcacctgttucaag

SEQ ID NO: 36765 - DNA, 22 bp, Artificial Sequence
  Synthetic
ctaucctggtacuggaaagcca

SEQ ID NO: 36766 - DNA, 20 bp, Artificial Sequence
  Synthetic
gcactggugacatgccttug

SEQ ID NO: 36767 - DNA, 20 bp, Artificial Sequence
  Synthetic
actcacgacuggcagagtug

SEQ ID NO: 36768 - DNA, 21 bp, Artificial Sequence
  Synthetic
cgtgcttguctaccacuacgg

SEQ ID NO: 36769 - DNA, 21 bp, Artificial Sequence
  Synthetic
gggtgctucagtcaccttcut

SEQ ID NO: 36770 - DNA, 21 bp, Artificial Sequence
  Synthetic
cctggccugaccctaagaugt

SEQ ID NO: 36771 - DNA, 21 bp, Artificial Sequence
  Synthetic
gggcaccaggaugttgaugat

SEQ ID NO: 36772 - DNA, 22 bp, Artificial Sequence
  Synthetic
cccaaggucacagctaagtcug

SEQ ID NO: 36773 - DNA, 20 bp, Artificial Sequence
  Synthetic
gggcaaacacucagctugga

SEQ ID NO: 36774 - DNA, 20 bp, Artificial Sequence
  Synthetic
cctttcttguggcccctuga

SEQ ID NO: 36775 - DNA, 21 bp, Artificial Sequence
  Synthetic
tctcgaacaugaggtcacugc

SEQ ID NO: 36776 - DNA, 22 bp, Artificial Sequence
  Synthetic
tggtcttggutttcagcccauc

SEQ ID NO: 36777 - DNA, 21 bp, Artificial Sequence
  Synthetic
ggcaatccugtggtccctuac

SEQ ID NO: 36778 - DNA, 21 bp, Artificial Sequence
  Synthetic
gcaggacaagcgcutcatcua

SEQ ID NO: 36779 - DNA, 21 bp, Artificial Sequence
  Synthetic
gatgtccacccucagaccauc

SEQ ID NO: 36780 - DNA, 22 bp, Artificial Sequence
  Synthetic
aggcccagaucgtcaaggauat

SEQ ID NO: 36781 - DNA, 22 bp, Artificial Sequence
  Synthetic
ggaaacugtgtcugcagcagat

SEQ ID NO: 36782 - DNA, 21 bp, Artificial Sequence
  Synthetic
cgtguggaaggtgagcuacac

SEQ ID NO: 36783 - DNA, 26 bp, Artificial Sequence
  Synthetic
tggatctcgaucaggtagctctuaat

SEQ ID NO: 36784 - DNA, 17 bp, Artificial Sequence
  Synthetic
aagguggtgcugcggaa

SEQ ID NO: 36785 - DNA, 20 bp, Artificial Sequence
  Synthetic
cgaagggccautgtgctuct

SEQ ID NO: 36786 - DNA, 17 bp, Artificial Sequence
  Synthetic
gtgguctggaucgcgga

SEQ ID NO: 36787 - DNA, 18 bp, Artificial Sequence
  Synthetic
cggccuccatctccucct

SEQ ID NO: 36788 - DNA, 22 bp, Artificial Sequence
  Synthetic
cggtguggctcttuaacaacct

SEQ ID NO: 36789 - DNA, 28 bp, Artificial Sequence
  Synthetic
cctgtactuaccacaacaaccttatcut

SEQ ID NO: 36790 - DNA, 19 bp, Artificial Sequence
  Synthetic
ggagcgcautgcacaucaa

SEQ ID NO: 36791 - DNA, 25 bp, Artificial Sequence
  Synthetic
gatgttugcccctaaacaucacaat

SEQ ID NO: 36792 - DNA, 23 bp, Artificial Sequence
  Synthetic
cctgaagacaggugcaaagucaa

SEQ ID NO: 36793 - DNA, 24 bp, Artificial Sequence
  Synthetic
cagggtacaucctgtgtcttugag

SEQ ID NO: 36794 - DNA, 20 bp, Artificial Sequence
  Synthetic
ccacgagtugggtccttucg

SEQ ID NO: 36795 - DNA, 28 bp, Artificial Sequence
  Synthetic
ggtgataaaugcacttttgtcatauggt

SEQ ID NO: 36796 - DNA, 22 bp, Artificial Sequence
  Synthetic
caccgagagccacutgtgauag

SEQ ID NO: 36797 - DNA, 31 bp, Artificial Sequence
  Synthetic
tctactcatgccccucaaacttattttuaat

SEQ ID NO: 36798 - DNA, 24 bp, Artificial Sequence
  Synthetic
ggcaatgucaattagcuggaacat

SEQ ID NO: 36799 - DNA, 22 bp, Artificial Sequence
  Synthetic
gtagacctcccugagcacttuc

SEQ ID NO: 36800 - DNA, 21 bp, Artificial Sequence
  Synthetic
acaccaaagcccugcagtuag

SEQ ID NO: 36801 - DNA, 32 bp, Artificial Sequence
  Synthetic
ccctcattaucaaaagattattaccatugcat

SEQ ID NO: 36802 - DNA, 27 bp, Artificial Sequence
  Synthetic
cacacaaggauaagccaacagaagaua

SEQ ID NO: 36803 - DNA, 24 bp, Artificial Sequence
  Synthetic
cctcccucagagaaaauctttugt

SEQ ID NO: 36804 - DNA, 22 bp, Artificial Sequence
  Synthetic
ggagggaaugcgaagaaacuct

SEQ ID NO: 36805 - DNA, 25 bp, Artificial Sequence
  Synthetic
cctaaaaaccaguctttccctgcut

SEQ ID NO: 36806 - DNA, 23 bp, Artificial Sequence
  Synthetic
cccucaacaugccagaaagagaa

SEQ ID NO: 36807 - DNA, 33 bp, Artificial Sequence
  Synthetic
tggtagctgttgutatttctattgaacttugat

SEQ ID NO: 36808 - DNA, 32 bp, Artificial Sequence
  Synthetic
tgaatattttgcctguctttaagttgaacaug

SEQ ID NO: 36809 - DNA, 24 bp, Artificial Sequence
  Synthetic
tccagctgcauctctcctacaaua

SEQ ID NO: 36810 - DNA, 20 bp, Artificial Sequence
  Synthetic
agaactgcgcuctcttcucg

SEQ ID NO: 36811 - DNA, 20 bp, Artificial Sequence
  Synthetic
cccctccguacctgctctua

SEQ ID NO: 36812 - DNA, 30 bp, Artificial Sequence
  Synthetic
aataaatcacagcugcaaacgttaaatuct

SEQ ID NO: 36813 - DNA, 22 bp, Artificial Sequence
  Synthetic
tcauacacggcagccacauaat

SEQ ID NO: 36814 - DNA, 23 bp, Artificial Sequence
  Synthetic
cggttcttccugccatctgauaa

SEQ ID NO: 36815 - DNA, 24 bp, Artificial Sequence
  Synthetic
acugaggaaaaagguaggaaucac

SEQ ID NO: 36816 - DNA, 26 bp, Artificial Sequence
  Synthetic
acaaatgtcgugttcagcaataaugg

SEQ ID NO: 36817 - DNA, 21 bp, Artificial Sequence
  Synthetic
aggcagutggguacacaacat

SEQ ID NO: 36818 - DNA, 23 bp, Artificial Sequence
  Synthetic
ctctggaguccttttgguaccat

SEQ ID NO: 36819 - DNA, 21 bp, Artificial Sequence
  Synthetic
ggagcatucacgttccactug

SEQ ID NO: 36820 - DNA, 24 bp, Artificial Sequence
  Synthetic
accttauccaaagagctgtaugcc

SEQ ID NO: 36821 - DNA, 24 bp, Artificial Sequence
  Synthetic
gtcatcccugaggucagaaacaaa

SEQ ID NO: 36822 - DNA, 21 bp, Artificial Sequence
  Synthetic
gcgcttgtaugagagggacua

SEQ ID NO: 36823 - DNA, 28 bp, Artificial Sequence
  Synthetic
aatgtctcgaugattgaggttuaagagg

SEQ ID NO: 36824 - DNA, 17 bp, Artificial Sequence
  Synthetic
tcuggcccgcacatcug

SEQ ID NO: 36825 - DNA, 17 bp, Artificial Sequence
  Synthetic
tgaacgugcggugggat

SEQ ID NO: 36826 - DNA, 31 bp, Artificial Sequence
  Synthetic
ttcatttgaaatugcataacatctucaggaa

SEQ ID NO: 36827 - DNA, 27 bp, Artificial Sequence
  Synthetic
caggtggaaaauctcacaucacaaaat

SEQ ID NO: 36828 - DNA, 24 bp, Artificial Sequence
  Synthetic
cctttctgtcuggaggccatatua

SEQ ID NO: 36829 - DNA, 24 bp, Artificial Sequence
  Synthetic
ggagaagcagcaucttccagaaua

SEQ ID NO: 36830 - DNA, 23 bp, Artificial Sequence
  Synthetic
catgaacccacutcctgacagua

SEQ ID NO: 36831 - DNA, 23 bp, Artificial Sequence
  Synthetic
cgcggtagcaguagaagatgaug

SEQ ID NO: 36832 - DNA, 21 bp, Artificial Sequence
  Synthetic
ggaagaugaccgctcugacat

SEQ ID NO: 36833 - DNA, 23 bp, Artificial Sequence
  Synthetic
ggaaagatctugactgccacugt

SEQ ID NO: 36834 - DNA, 23 bp, Artificial Sequence
  Synthetic
ggaaacaauactggctgaucacc

SEQ ID NO: 36835 - DNA, 22 bp, Artificial Sequence
  Synthetic
agcaggtuaggtcgttctucac

SEQ ID NO: 36836 - DNA, 28 bp, Artificial Sequence
  Synthetic
ttgtgaaaauaaaaaggcagctggaaut

SEQ ID NO: 36837 - DNA, 22 bp, Artificial Sequence
  Synthetic
aatgatgctgguccacaccuac

SEQ ID NO: 36838 - DNA, 22 bp, Artificial Sequence
  Synthetic
atggtgcccuttggatctctut

SEQ ID NO: 36839 - DNA, 21 bp, Artificial Sequence
  Synthetic
ccugcccuagaagagctatut

SEQ ID NO: 36840 - DNA, 17 bp, Artificial Sequence
  Synthetic
gggcuggatggcguaag

SEQ ID NO: 36841 - DNA, 19 bp, Artificial Sequence
  Synthetic
cggtucaccactgtcucgt

SEQ ID NO: 36842 - DNA, 32 bp, Artificial Sequence
  Synthetic
gagtagttgcagacugataaattattttcugt

SEQ ID NO: 36843 - DNA, 24 bp, Artificial Sequence
  Synthetic
gcacaaacaucctgctacttugag

SEQ ID NO: 36844 - DNA, 26 bp, Artificial Sequence
  Synthetic
ccccttgggautagtatctatctcuc

SEQ ID NO: 36845 - DNA, 26 bp, Artificial Sequence
  Synthetic
agcttcaacaauttactctcccaugt

SEQ ID NO: 36846 - DNA, 21 bp, Artificial Sequence
  Synthetic
ctcaccccucaggacagttut

SEQ ID NO: 36847 - DNA, 25 bp, Artificial Sequence
  Synthetic
ggttgaggaguttggtgctacatua

SEQ ID NO: 36848 - DNA, 28 bp, Artificial Sequence
  Synthetic
ttaatacagacttugctaccaggactug

SEQ ID NO: 36849 - DNA, 20 bp, Artificial Sequence
  Synthetic
tttgcucagaggcugcagaa

SEQ ID NO: 36850 - DNA, 25 bp, Artificial Sequence
  Synthetic
gcaagatgaggagaugcttgaacuc

SEQ ID NO: 36851 - DNA, 24 bp, Artificial Sequence
  Synthetic
acagaataaaggagguaggctgua

SEQ ID NO: 36852 - DNA, 27 bp, Artificial Sequence
  Synthetic
gggttgguaggattctattactuacct

SEQ ID NO: 36853 - DNA, 26 bp, Artificial Sequence
  Synthetic
gcttgttcacacacucagctgattua

SEQ ID NO: 36854 - DNA, 25 bp, Artificial Sequence
  Synthetic
gttaaagcttgcuccttcatgtuct

SEQ ID NO: 36855 - DNA, 27 bp, Artificial Sequence
  Synthetic
acagaagtauaagaatggctgucacac

SEQ ID NO: 36856 - DNA, 26 bp, Artificial Sequence
  Synthetic
ggtattgaatttcuttggaccaggug

SEQ ID NO: 36857 - DNA, 27 bp, Artificial Sequence
  Synthetic
aaagattgtaugaggtcctgtccuagt

SEQ ID NO: 36858 - DNA, 25 bp, Artificial Sequence
  Synthetic
tcacacattcugcctcctaaacaut

SEQ ID NO: 36859 - DNA, 28 bp, Artificial Sequence
  Synthetic
cagaaggcaaguataagtcttaagugct

SEQ ID NO: 36860 - DNA, 24 bp, Artificial Sequence
  Synthetic
gaaaaaggcugcttttcagtgugt

SEQ ID NO: 36861 - DNA, 24 bp, Artificial Sequence
  Synthetic
caccctcctaugacagtgtcacua

SEQ ID NO: 36862 - DNA, 20 bp, Artificial Sequence
  Synthetic
gauaaccauggccgacacct

SEQ ID NO: 36863 - DNA, 22 bp, Artificial Sequence
  Synthetic
cgcatccatugcatggacatuc

SEQ ID NO: 36864 - DNA, 27 bp, Artificial Sequence
  Synthetic
gacaggaccgaauactcaataaacuga

SEQ ID NO: 36865 - DNA, 21 bp, Artificial Sequence
  Synthetic
gtgggcaucctcttctucacc

SEQ ID NO: 36866 - DNA, 20 bp, Artificial Sequence
  Synthetic
ctgtuggcgaaggtcuggaa

SEQ ID NO: 36867 - DNA, 20 bp, Artificial Sequence
  Synthetic
gcatccucagactgauccga

SEQ ID NO: 36868 - DNA, 23 bp, Artificial Sequence
  Synthetic
ccacaaagagcaggutgatctug

SEQ ID NO: 36869 - DNA, 25 bp, Artificial Sequence
  Synthetic
actttccattugcctctccttucag

SEQ ID NO: 36870 - DNA, 17 bp, Artificial Sequence
  Synthetic
ccctcaauccccuggca

SEQ ID NO: 36871 - DNA, 23 bp, Artificial Sequence
  Synthetic
tctccctgtgugatttctcccut

SEQ ID NO: 36872 - DNA, 21 bp, Artificial Sequence
  Synthetic
gaagucccttctcuccaggac

SEQ ID NO: 36873 - DNA, 22 bp, Artificial Sequence
  Synthetic
agagggagacutgccttugaac

SEQ ID NO: 36874 - DNA, 20 bp, Artificial Sequence
  Synthetic
gaaggcagccaccuctctua

SEQ ID NO: 36875 - DNA, 23 bp, Artificial Sequence
  Synthetic
atcctccccauttctacttugcc

SEQ ID NO: 36876 - DNA, 23 bp, Artificial Sequence
  Synthetic
ccagtttcugacctgacttucca

SEQ ID NO: 36877 - DNA, 21 bp, Artificial Sequence
  Synthetic
caagaccugctaccacaucgt

SEQ ID NO: 36878 - DNA, 20 bp, Artificial Sequence
  Synthetic
tctggguggaactgaggcua

SEQ ID NO: 36879 - DNA, 21 bp, Artificial Sequence
  Synthetic
ctacucagcccacacucacac

SEQ ID NO: 36880 - DNA, 21 bp, Artificial Sequence
  Synthetic
gggaagcugcttugagagagg

SEQ ID NO: 36881 - DNA, 20 bp, Artificial Sequence
  Synthetic
ggccgagucagacacagaug

SEQ ID NO: 36882 - DNA, 19 bp, Artificial Sequence
  Synthetic
gcaccttcuccgtctcugg

SEQ ID NO: 36883 - DNA, 19 bp, Artificial Sequence
  Synthetic
caaccucacagccccugat

SEQ ID NO: 36884 - DNA, 28 bp, Artificial Sequence
  Synthetic
ggtagatggatugatagaagggtaagua

SEQ ID NO: 36885 - DNA, 22 bp, Artificial Sequence
  Synthetic
tctguggagagtggaucgagac

SEQ ID NO: 36886 - DNA, 21 bp, Artificial Sequence
  Synthetic
gttctugccaaagagcugcat

SEQ ID NO: 36887 - DNA, 20 bp, Artificial Sequence
  Synthetic
ccagagcccutcacaagguc

SEQ ID NO: 36888 - DNA, 22 bp, Artificial Sequence
  Synthetic
gctccaugaggctaaggaugac

SEQ ID NO: 36889 - DNA, 20 bp, Artificial Sequence
  Synthetic
ggccagggaguctttccauc

SEQ ID NO: 36890 - DNA, 21 bp, Artificial Sequence
  Synthetic
cgccaugaagagtgtgtugag

SEQ ID NO: 36891 - DNA, 27 bp, Artificial Sequence
  Synthetic
acagaatcaaacuaactcattggcugt

SEQ ID NO: 36892 - DNA, 23 bp, Artificial Sequence
  Synthetic
cgtgtatutttggactuggcact

SEQ ID NO: 36893 - DNA, 24 bp, Artificial Sequence
  Synthetic
caaaaagaacagcacugtggacug

SEQ ID NO: 36894 - DNA, 23 bp, Artificial Sequence
  Synthetic
cgctgtgcugttttcatcatcug

SEQ ID NO: 36895 - DNA, 21 bp, Artificial Sequence
  Synthetic
aagagcacaugtcatggucgt

SEQ ID NO: 36896 - DNA, 22 bp, Artificial Sequence
  Synthetic
cctacagtcaggugagggctua

SEQ ID NO: 36897 - DNA, 26 bp, Artificial Sequence
  Synthetic
tcttcttcatgcutgtcatcttccug

SEQ ID NO: 36898 - DNA, 20 bp, Artificial Sequence
  Synthetic
acttgugtagccuggaccct

SEQ ID NO: 36899 - DNA, 22 bp, Artificial Sequence
  Synthetic
aacaaagtcuctgtgtguggct

SEQ ID NO: 36900 - DNA, 22 bp, Artificial Sequence
  Synthetic
ggtctgctgguctcacaaaguc

SEQ ID NO: 36901 - DNA, 22 bp, Artificial Sequence
  Synthetic
cagctcttcaugggcaaccuaa

SEQ ID NO: 36902 - DNA, 21 bp, Artificial Sequence
  Synthetic
ggcatatcccuctagcctugg

SEQ ID NO: 36903 - DNA, 26 bp, Artificial Sequence
  Synthetic
gttgtcattgtcucgtgtgtgaatut

SEQ ID NO: 36904 - DNA, 23 bp, Artificial Sequence
  Synthetic
aggcauagcacagcauagcaaat

SEQ ID NO: 36905 - DNA, 21 bp, Artificial Sequence
  Synthetic
gctcaggccucccuaagaaac

SEQ ID NO: 36906 - DNA, 24 bp, Artificial Sequence
  Synthetic
ggtacucagcaggtattaacugca

SEQ ID NO: 36907 - DNA, 22 bp, Artificial Sequence
  Synthetic
agggcctaaugctactgtcugt

SEQ ID NO: 36908 - DNA, 20 bp, Artificial Sequence
  Synthetic
gctctccugcaaggtggtug

SEQ ID NO: 36909 - DNA, 22 bp, Artificial Sequence
  Synthetic
tctctguccctgggcauagaat

SEQ ID NO: 36910 - DNA, 18 bp, Artificial Sequence
  Synthetic
agcacuccccucccagaa

SEQ ID NO: 36911 - DNA, 23 bp, Artificial Sequence
  Synthetic
ccatcuagagggattcagugggt

SEQ ID NO: 36912 - DNA, 21 bp, Artificial Sequence
  Synthetic
gtcctcataggugcctgtguc

SEQ ID NO: 36913 - DNA, 24 bp, Artificial Sequence
  Synthetic
ggatagcucctcattaucaggcat

SEQ ID NO: 36914 - DNA, 18 bp, Artificial Sequence
  Synthetic
gtcagccuaccccacucc

SEQ ID NO: 36915 - DNA, 20 bp, Artificial Sequence
  Synthetic
ggtguggccccacctttuaa

SEQ ID NO: 36916 - DNA, 22 bp, Artificial Sequence
  Synthetic
cttcttgggcuctggcttttug

SEQ ID NO: 36917 - DNA, 23 bp, Artificial Sequence
  Synthetic
aatagccccuaagcctagccaua

SEQ ID NO: 36918 - DNA, 22 bp, Artificial Sequence
  Synthetic
actgaaauaacggacgugcaca

SEQ ID NO: 36919 - DNA, 20 bp, Artificial Sequence
  Synthetic
agatggcugacgaccgttuc

SEQ ID NO: 36920 - DNA, 23 bp, Artificial Sequence
  Synthetic
accauagacaaaagggugacagg

SEQ ID NO: 36921 - DNA, 22 bp, Artificial Sequence
  Synthetic
ctgaccttucaaccctctcuga

SEQ ID NO: 36922 - DNA, 24 bp, Artificial Sequence
  Synthetic
catcactaucccaaggagctucag

SEQ ID NO: 36923 - DNA, 22 bp, Artificial Sequence
  Synthetic
tgtgcacacaguggaaaucagt

SEQ ID NO: 36924 - DNA, 20 bp, Artificial Sequence
  Synthetic
ccugagaggaccccagtuga

SEQ ID NO: 36925 - DNA, 23 bp, Artificial Sequence
  Synthetic
tgtctctccaucttcccatccut

SEQ ID NO: 36926 - DNA, 18 bp, Artificial Sequence
  Synthetic
tgctgggugagggaggua

SEQ ID NO: 36927 - DNA, 20 bp, Artificial Sequence
  Synthetic
cctgaggucagaggucacag

SEQ ID NO: 36928 - DNA, 22 bp, Artificial Sequence
  Synthetic
ggcaggcuggaagatggttaug

SEQ ID NO: 36929 - DNA, 29 bp, Artificial Sequence
  Synthetic
cctctgattacugactctgtcctatauct

SEQ ID NO: 36930 - DNA, 21 bp, Artificial Sequence
  Synthetic
ccactguccacagaccctgua

SEQ ID NO: 36931 - DNA, 23 bp, Artificial Sequence
  Synthetic
cacaaaggagagauggtgagugt

SEQ ID NO: 36932 - DNA, 22 bp, Artificial Sequence
  Synthetic
cccagugccctaatatcugacc

SEQ ID NO: 36933 - DNA, 24 bp, Artificial Sequence
  Synthetic
gattctcttuggtccctcacugac

SEQ ID NO: 36934 - DNA, 23 bp, Artificial Sequence
  Synthetic
cactuaagaggauccccaggaua

SEQ ID NO: 36935 - DNA, 22 bp, Artificial Sequence
  Synthetic
cctgatcuggtcctgacugaat

SEQ ID NO: 36936 - DNA, 23 bp, Artificial Sequence
  Synthetic
tctgggaguttgagctcucagat

SEQ ID NO: 36937 - DNA, 21 bp, Artificial Sequence
  Synthetic
tcccgacucctctgattccug

SEQ ID NO: 36938 - DNA, 19 bp, Artificial Sequence
  Synthetic
gccccgcaccugaattcua

SEQ ID NO: 36939 - DNA, 22 bp, Artificial Sequence
  Synthetic
ctttgtctgguccccactgtut

SEQ ID NO: 36940 - DNA, 22 bp, Artificial Sequence
  Synthetic
caccctggauggtgacatuagg

SEQ ID NO: 36941 - DNA, 21 bp, Artificial Sequence
  Synthetic
ccactgatucccctcacugat

SEQ ID NO: 36942 - DNA, 21 bp, Artificial Sequence
  Synthetic
ccccaucctaagtccucacga

SEQ ID NO: 36943 - DNA, 21 bp, Artificial Sequence
  Synthetic
gggttcccaagucactctcug

SEQ ID NO: 36944 - DNA, 22 bp, Artificial Sequence
  Synthetic
cctcccaggacuctcaucagaa

SEQ ID NO: 36945 - DNA, 23 bp, Artificial Sequence
  Synthetic
tccgatgccucttttccucaaag

SEQ ID NO: 36946 - DNA, 20 bp, Artificial Sequence
  Synthetic
cccaagaguggccccttaug

SEQ ID NO: 36947 - DNA, 22 bp, Artificial Sequence
  Synthetic
gccugactacugagcagagaag

SEQ ID NO: 36948 - DNA, 24 bp, Artificial Sequence
  Synthetic
gtcatgagggugggtaaactaugg

SEQ ID NO: 36949 - DNA, 21 bp, Artificial Sequence
  Synthetic
caaggaaucccactgaccuct

SEQ ID NO: 36950 - DNA, 22 bp, Artificial Sequence
  Synthetic
catggcattuggaaacaggcut

SEQ ID NO: 36951 - DNA, 22 bp, Artificial Sequence
  Synthetic
gggcctgaaauatgaggagugg

SEQ ID NO: 36952 - DNA, 21 bp, Artificial Sequence
  Synthetic
ccugagagggaagagctcugt

SEQ ID NO: 36953 - DNA, 23 bp, Artificial Sequence
  Synthetic
gttctctcatgucgtcctgtguc

SEQ ID NO: 36954 - DNA, 23 bp, Artificial Sequence
  Synthetic
cccuggaggaagagaaagtucag

SEQ ID NO: 36955 - DNA, 24 bp, Artificial Sequence
  Synthetic
gtcatctccugcaatgaggaugag

SEQ ID NO: 36956 - DNA, 20 bp, Artificial Sequence
  Synthetic
cagagaaggccuggctcauc

SEQ ID NO: 36957 - DNA, 22 bp, Artificial Sequence
  Synthetic
gtgaccaguactgcctcagtut

SEQ ID NO: 36958 - DNA, 25 bp, Artificial Sequence
  Synthetic
caatacatgugagagccaccttcut

SEQ ID NO: 36959 - DNA, 23 bp, Artificial Sequence
  Synthetic
cacactagagguggtgtgcauat

SEQ ID NO: 36960 - DNA, 23 bp, Artificial Sequence
  Synthetic
gggatgagaugtcaagtcagucc

SEQ ID NO: 36961 - DNA, 26 bp, Artificial Sequence
  Synthetic
cctataacccuctgtgatccugagat

SEQ ID NO: 36962 - DNA, 20 bp, Artificial Sequence
  Synthetic
catcuctgcccugcaggaaa

SEQ ID NO: 36963 - DNA, 18 bp, Artificial Sequence
  Synthetic
cuggccaggagagugagg

SEQ ID NO: 36964 - DNA, 22 bp, Artificial Sequence
  Synthetic
cugcaggaguggaagagagaat

SEQ ID NO: 36965 - DNA, 20 bp, Artificial Sequence
  Synthetic
gacctctugctgtcccucag

SEQ ID NO: 36966 - DNA, 22 bp, Artificial Sequence
  Synthetic
acagaacctauggagcctcaug

SEQ ID NO: 36967 - DNA, 26 bp, Artificial Sequence
  Synthetic
gttcctagcaguttgtcttcatcuct

SEQ ID NO: 36968 - DNA, 21 bp, Artificial Sequence
  Synthetic
cacggucacccugaaaacaag

SEQ ID NO: 36969 - DNA, 22 bp, Artificial Sequence
  Synthetic
gccatgaugtttcaaugggcaa

SEQ ID NO: 36970 - DNA, 23 bp, Artificial Sequence
  Synthetic
acccugagaccucagaaaagagt

SEQ ID NO: 36971 - DNA, 21 bp, Artificial Sequence
  Synthetic
gaaggtaaagucccccaccug

SEQ ID NO: 36972 - DNA, 21 bp, Artificial Sequence
  Synthetic
gtctacacgugtgcctcaugt

SEQ ID NO: 36973 - DNA, 23 bp, Artificial Sequence
  Synthetic
acatccaaccagugatctgtucc

SEQ ID NO: 36974 - DNA, 23 bp, Artificial Sequence
  Synthetic
actctctcggaugctgtgacuat

SEQ ID NO: 36975 - DNA, 23 bp, Artificial Sequence
  Synthetic
ccttaggcucacagggacuagag

SEQ ID NO: 36976 - DNA, 22 bp, Artificial Sequence
  Synthetic
ccggtcacccugtggaaaauag

SEQ ID NO: 36977 - DNA, 26 bp, Artificial Sequence
  Synthetic
ccatcttacccucacctcttatcuga

SEQ ID NO: 36978 - DNA, 21 bp, Artificial Sequence
  Synthetic
cgaaacccutcaatgcccuga

SEQ ID NO: 36979 - DNA, 22 bp, Artificial Sequence
  Synthetic
ctcagcaagcutatctcugcca

SEQ ID NO: 36980 - DNA, 21 bp, Artificial Sequence
  Synthetic
gggaagugggagttaguggaa

SEQ ID NO: 36981 - DNA, 20 bp, Artificial Sequence
  Synthetic
gggaccugagggctcctaut

SEQ ID NO: 36982 - DNA, 23 bp, Artificial Sequence
  Synthetic
gagggtttagcautacagggtug

SEQ ID NO: 36983 - DNA, 26 bp, Artificial Sequence
  Synthetic
caaaatatugggagggtctgtcucag

SEQ ID NO: 36984 - DNA, 21 bp, Artificial Sequence
  Synthetic
gcagggaguggatggaugaac

SEQ ID NO: 36985 - DNA, 20 bp, Artificial Sequence
  Synthetic
tcatggcggguaagggagua

SEQ ID NO: 36986 - DNA, 22 bp, Artificial Sequence
  Synthetic
ctcgaagcaagcagutcucaag

SEQ ID NO: 36987 - DNA, 22 bp, Artificial Sequence
  Synthetic
ccgggugaatcaatgugggaat

SEQ ID NO: 36988 - DNA, 23 bp, Artificial Sequence
  Synthetic
gccctguggatggaaggauaaga

SEQ ID NO: 36989 - DNA, 22 bp, Artificial Sequence
  Synthetic
agggcctauctatgggactugg

SEQ ID NO: 36990 - DNA, 22 bp, Artificial Sequence
  Synthetic
ctgtggaaucacagcccagaua

SEQ ID NO: 36991 - DNA, 22 bp, Artificial Sequence
  Synthetic
gattttgggcucctaggugact

SEQ ID NO: 36992 - DNA, 22 bp, Artificial Sequence
  Synthetic
ggccccugaatguagagaaagt

SEQ ID NO: 36993 - DNA, 23 bp, Artificial Sequence
  Synthetic
tctagcccugtctgtccataucc

SEQ ID NO: 36994 - DNA, 25 bp, Artificial Sequence
  Synthetic
aaaagaagaggucagagctgagtug

SEQ ID NO: 36995 - DNA, 21 bp, Artificial Sequence
  Synthetic
gagttugggaccccttgtcug

SEQ ID NO: 36996 - DNA, 23 bp, Artificial Sequence
  Synthetic
ggagcaguggttgatgatugagg

SEQ ID NO: 36997 - DNA, 24 bp, Artificial Sequence
  Synthetic
ctgacttgaugatgtcccagtuct

SEQ ID NO: 36998 - DNA, 25 bp, Artificial Sequence
  Synthetic
aataugagccaagaactaugaagcc

SEQ ID NO: 36999 - DNA, 22 bp, Artificial Sequence
  Synthetic
attcccctgutcattcccugac

SEQ ID NO: 37000 - DNA, 21 bp, Artificial Sequence
  Synthetic
ggucacaagggccagaguaac

SEQ ID NO: 37001 - DNA, 26 bp, Artificial Sequence
  Synthetic
caccttatacttugtctcctccauca

SEQ ID NO: 37002 - DNA, 18 bp, Artificial Sequence
  Synthetic
ctgcacaggguctggugt

SEQ ID NO: 37003 - DNA, 20 bp, Artificial Sequence
  Synthetic
cagtgcccacgutgacatuc

SEQ ID NO: 37004 - DNA, 20 bp, Artificial Sequence
  Synthetic
ggagagcccugcaaauggag

SEQ ID NO: 37005 - DNA, 21 bp, Artificial Sequence
  Synthetic
cccttcctgucctgacctcut

SEQ ID NO: 37006 - DNA, 22 bp, Artificial Sequence
  Synthetic
ggcccuaggaagggtaaucagt

SEQ ID NO: 37007 - DNA, 22 bp, Artificial Sequence
  Synthetic
ccctcaucgagaggugaacaga

SEQ ID NO: 37008 - DNA, 25 bp, Artificial Sequence
  Synthetic
gaacccucagaccccutatattcua

SEQ ID NO: 37009 - DNA, 25 bp, Artificial Sequence
  Synthetic
cttaatgtggugatgttgggaaugg

SEQ ID NO: 37010 - DNA, 22 bp, Artificial Sequence
  Synthetic
ttccccaucagcctactcctua

SEQ ID NO: 37011 - DNA, 24 bp, Artificial Sequence
  Synthetic
gttctgacaugtccttcctuccag

SEQ ID NO: 37012 - DNA, 22 bp, Artificial Sequence
  Synthetic
gccucagggagaggtagaauct

SEQ ID NO: 37013 - DNA, 25 bp, Artificial Sequence
  Synthetic
tcagtaacttgutccccttccuaca

SEQ ID NO: 37014 - DNA, 27 bp, Artificial Sequence
  Synthetic
acttgatuaaaaagctgtcuccacaga

SEQ ID NO: 37015 - DNA, 25 bp, Artificial Sequence
  Synthetic
cctcgatcttucattcctcctucag

SEQ ID NO: 37016 - DNA, 22 bp, Artificial Sequence
  Synthetic
cccaatgguccctaacttccuc

SEQ ID NO: 37017 - DNA, 23 bp, Artificial Sequence
  Synthetic
ccctgattccugagctttctcuc

SEQ ID NO: 37018 - DNA, 21 bp, Artificial Sequence
  Synthetic
actcgcacugagtagcugact

SEQ ID NO: 37019 - DNA, 21 bp, Artificial Sequence
  Synthetic
gtgaaggtauggctcccugac

SEQ ID NO: 37020 - DNA, 20 bp, Artificial Sequence
  Synthetic
gctaatgcggugtggcuagt

SEQ ID NO: 37021 - DNA, 21 bp, Artificial Sequence
  Synthetic
cagagttugctagcccuggag

SEQ ID NO: 37022 - DNA, 21 bp, Artificial Sequence
  Synthetic
gggtcugaaagagcaauggag

SEQ ID NO: 37023 - DNA, 21 bp, Artificial Sequence
  Synthetic
catgccagcauttccctcuga

SEQ ID NO: 37024 - DNA, 21 bp, Artificial Sequence
  Synthetic
cacaagccucctgcagtacuc

SEQ ID NO: 37025 - DNA, 24 bp, Artificial Sequence
  Synthetic
ccacctacccugacttctctctua

SEQ ID NO: 37026 - DNA, 18 bp, Artificial Sequence
  Synthetic
cgacaccucccccacuca

SEQ ID NO: 37027 - DNA, 23 bp, Artificial Sequence
  Synthetic
ggtctgacccugttatctugcag

SEQ ID NO: 37028 - DNA, 21 bp, Artificial Sequence
  Synthetic
tgaagaaagugcccagcctuc

SEQ ID NO: 37029 - DNA, 22 bp, Artificial Sequence
  Synthetic
ctgtagagucctgagtcugcaa

SEQ ID NO: 37030 - DNA, 20 bp, Artificial Sequence
  Synthetic
ggtcagaggcuggcagaaut

SEQ ID NO: 37031 - DNA, 24 bp, Artificial Sequence
  Synthetic
ctgggcaagauaaagtgacctcut

SEQ ID NO: 37032 - DNA, 21 bp, Artificial Sequence
  Synthetic
ggacctugtagccagucacag

SEQ ID NO: 37033 - DNA, 24 bp, Artificial Sequence
  Synthetic
tgattccatccuatgtgctccuga

SEQ ID NO: 37034 - DNA, 20 bp, Artificial Sequence
  Synthetic
tcactcctgcucggtcctua

SEQ ID NO: 37035 - DNA, 23 bp, Artificial Sequence
  Synthetic
gatgaccccaaaugaagtgucca

SEQ ID NO: 37036 - DNA, 22 bp, Artificial Sequence
  Synthetic
tggtcagccacauggagaatug

SEQ ID NO: 37037 - DNA, 22 bp, Artificial Sequence
  Synthetic
gatacccguaaccctcacccua

SEQ ID NO: 37038 - DNA, 19 bp, Artificial Sequence
  Synthetic
ggaccucgcggaaatugct

SEQ ID NO: 37039 - DNA, 20 bp, Artificial Sequence
  Synthetic
accatcccaagucccaguga

SEQ ID NO: 37040 - DNA, 23 bp, Artificial Sequence
  Synthetic
tcagtgggaucatggacugaaac

SEQ ID NO: 37041 - DNA, 19 bp, Artificial Sequence
  Synthetic
gggccacaccaccuatucc

SEQ ID NO: 37042 - DNA, 21 bp, Artificial Sequence
  Synthetic
tgtcccuggacgactgtacuc

SEQ ID NO: 37043 - DNA, 20 bp, Artificial Sequence
  Synthetic
ggtgctgaugcgtggctuat

SEQ ID NO: 37044 - DNA, 20 bp, Artificial Sequence
  Synthetic
cctgaccuccaggacccuat

SEQ ID NO: 37045 - DNA, 21 bp, Artificial Sequence
  Synthetic
gcctctgccugtatgggaaug

SEQ ID NO: 37046 - DNA, 21 bp, Artificial Sequence
  Synthetic
ccccacaccacutctugacac

SEQ ID NO: 37047 - DNA, 21 bp, Artificial Sequence
  Synthetic
ggatgcugggacctggauact

SEQ ID NO: 37048 - DNA, 27 bp, Artificial Sequence
  Synthetic
acaaggauactgctctaugaacaagga

SEQ ID NO: 37049 - DNA, 22 bp, Artificial Sequence
  Synthetic
aaaacgctccacuttggtccua

SEQ ID NO: 37050 - DNA, 23 bp, Artificial Sequence
  Synthetic
ggaccacuguaaacagggaggaa

SEQ ID NO: 37051 - DNA, 19 bp, Artificial Sequence
  Synthetic
gcaguaccgggacagucac

SEQ ID NO: 37052 - DNA, 19 bp, Artificial Sequence
  Synthetic
ccacccuccaagaucagca

SEQ ID NO: 37053 - DNA, 17 bp, Artificial Sequence
  Synthetic
cgccgtcugcactcgut

SEQ ID NO: 37054 - DNA, 20 bp, Artificial Sequence
  Synthetic
ccaggacucagctggagtug

SEQ ID NO: 37055 - DNA, 22 bp, Artificial Sequence
  Synthetic
ccgcatcgacuatgatgguaag

SEQ ID NO: 37056 - DNA, 22 bp, Artificial Sequence
  Synthetic
aatctgagacugccctcctgua

SEQ ID NO: 37057 - DNA, 20 bp, Artificial Sequence
  Synthetic
ctacccuggcctctguaacg

SEQ ID NO: 37058 - DNA, 22 bp, Artificial Sequence
  Synthetic
tccacctcaucgatcatcucct

SEQ ID NO: 37059 - DNA, 20 bp, Artificial Sequence
  Synthetic
ctgctgagcccugactacug

SEQ ID NO: 37060 - DNA, 19 bp, Artificial Sequence
  Synthetic
gctacuaaccccgcacuct

SEQ ID NO: 37061 - DNA, 20 bp, Artificial Sequence
  Synthetic
gcuggaggatacuacacgca

SEQ ID NO: 37062 - DNA, 21 bp, Artificial Sequence
  Synthetic
tgccggtttucccaacttcua

SEQ ID NO: 37063 - DNA, 20 bp, Artificial Sequence
  Synthetic
aaccggcgutgaggagauac

SEQ ID NO: 37064 - DNA, 27 bp, Artificial Sequence
  Synthetic
gctcttcuaaattgtgtgucccaaaat

SEQ ID NO: 37065 - DNA, 33 bp, Artificial Sequence
  Synthetic
tttagaacttatgttutaaaaacgacaactuct

SEQ ID NO: 37066 - DNA, 24 bp, Artificial Sequence
  Synthetic
ccataactuaaggtgccttugggt

SEQ ID NO: 37067 - DNA, 26 bp, Artificial Sequence
  Synthetic
cacuattatcuagcccaaggcacaaa

SEQ ID NO: 37068 - DNA, 29 bp, Artificial Sequence
  Synthetic
cttgaggaaaacucatctctggtaatugt

SEQ ID NO: 37069 - DNA, 28 bp, Artificial Sequence
  Synthetic
gggataaagtggautacctggatgatut

SEQ ID NO: 37070 - DNA, 28 bp, Artificial Sequence
  Synthetic
ggcacatgtugaatattgcataugaagg

SEQ ID NO: 37071 - DNA, 28 bp, Artificial Sequence
  Synthetic
aaccatctagutaagcaacatucacaga

SEQ ID NO: 37072 - DNA, 27 bp, Artificial Sequence
  Synthetic
caaaatgaccuaaaaagctggaagugt

SEQ ID NO: 37073 - DNA, 28 bp, Artificial Sequence
  Synthetic
gccagggtttauctttgatgttctcuaa

SEQ ID NO: 37074 - DNA, 28 bp, Artificial Sequence
  Synthetic
tcaatttcaatgcutaaccagtttugct

SEQ ID NO: 37075 - DNA, 28 bp, Artificial Sequence
  Synthetic
gctgaagacacacaguattttgtaaugt

SEQ ID NO: 37076 - DNA, 25 bp, Artificial Sequence
  Synthetic
tcagatcagauccagactgugaaga

SEQ ID NO: 37077 - DNA, 28 bp, Artificial Sequence
  Synthetic
ccaaattagcauacctgaagtcctaugt

SEQ ID NO: 37078 - DNA, 27 bp, Artificial Sequence
  Synthetic
cagttataagccauctcatcccaucat

SEQ ID NO: 37079 - DNA, 19 bp, Artificial Sequence
  Synthetic
caaagcgcacuagtuggca

SEQ ID NO: 37080 - DNA, 21 bp, Artificial Sequence
  Synthetic
aattgtgcautcccgugcaag

SEQ ID NO: 37081 - DNA, 24 bp, Artificial Sequence
  Synthetic
tctgaggcccautgtgaaaactut

SEQ ID NO: 37082 - DNA, 18 bp, Artificial Sequence
  Synthetic
gcatggucgcagucacga

SEQ ID NO: 37083 - DNA, 28 bp, Artificial Sequence
  Synthetic
aaaggttttatagucttggcctgttuct

SEQ ID NO: 37084 - DNA, 29 bp, Artificial Sequence
  Synthetic
gaccagtcttgauactaacaaatacugaa

SEQ ID NO: 37085 - DNA, 17 bp, Artificial Sequence
  Synthetic
ggccguggtcguggaat

SEQ ID NO: 37086 - DNA, 24 bp, Artificial Sequence
  Synthetic
gggaggtcacuttataagggtcug

SEQ ID NO: 37087 - DNA, 24 bp, Artificial Sequence
  Synthetic
caggtagtacugtgggtacucgaa

SEQ ID NO: 37088 - DNA, 18 bp, Artificial Sequence
  Synthetic
gcgcacgccuctcaacua

SEQ ID NO: 37089 - DNA, 19 bp, Artificial Sequence
  Synthetic
tctcccagaccccuccaug

SEQ ID NO: 37090 - DNA, 22 bp, Artificial Sequence
  Synthetic
tgtaagcccaugagcaactucc

SEQ ID NO: 37091 - DNA, 23 bp, Artificial Sequence
  Synthetic
gaaccagacacuactgggttuga

SEQ ID NO: 37092 - DNA, 21 bp, Artificial Sequence
  Synthetic
ttcgtgguccacttcaccauc

SEQ ID NO: 37093 - DNA, 19 bp, Artificial Sequence
  Synthetic
gtccagaccauggctccuc

SEQ ID NO: 37094 - DNA, 24 bp, Artificial Sequence
  Synthetic
gcautctacatctucacccaccag

SEQ ID NO: 37095 - DNA, 21 bp, Artificial Sequence
  Synthetic
ggaagtagcutgtcctuggca

SEQ ID NO: 37096 - DNA, 19 bp, Artificial Sequence
  Synthetic
cuaccgtguccaagacgga

SEQ ID NO: 37097 - DNA, 18 bp, Artificial Sequence
  Synthetic
tcucaggctgucccaggt

SEQ ID NO: 37098 - DNA, 28 bp, Artificial Sequence
  Synthetic
cacaacaaaagtgcuctagttctctcua

SEQ ID NO: 37099 - DNA, 27 bp, Artificial Sequence
  Synthetic
ttttgtttttcaaaccucctgcttcuc

SEQ ID NO: 37100 - DNA, 20 bp, Artificial Sequence
  Synthetic
cctccaggacutgcaucgaa

SEQ ID NO: 37101 - DNA, 26 bp, Artificial Sequence
  Synthetic
agatttgcgtuagagtttttgtuggg

SEQ ID NO: 37102 - DNA, 20 bp, Artificial Sequence
  Synthetic
cggtugcccggtgaatttut

SEQ ID NO: 37103 - DNA, 21 bp, Artificial Sequence
  Synthetic
cggcctguactcggttuacac

SEQ ID NO: 37104 - DNA, 19 bp, Artificial Sequence
  Synthetic
cgcgtcuagccatggacug

SEQ ID NO: 37105 - DNA, 23 bp, Artificial Sequence
  Synthetic
ctttctacugggctcgtctctut

SEQ ID NO: 37106 - DNA, 18 bp, Artificial Sequence
  Synthetic
ctgcaucctcgcauccgt

SEQ ID NO: 37107 - DNA, 18 bp, Artificial Sequence
  Synthetic
gcctgcagutcgcttgug

SEQ ID NO: 37108 - DNA, 17 bp, Artificial Sequence
  Synthetic
gtguacggcccguacga

SEQ ID NO: 37109 - DNA, 19 bp, Artificial Sequence
  Synthetic
ccccaaguacctgcaguct

SEQ ID NO: 37110 - DNA, 19 bp, Artificial Sequence
  Synthetic
gccggtagutgcccttcuc

SEQ ID NO: 37111 - DNA, 20 bp, Artificial Sequence
  Synthetic
ctgtccggcauctaccagua

SEQ ID NO: 37112 - DNA, 18 bp, Artificial Sequence
  Synthetic
ggctccutgactgugcga

SEQ ID NO: 37113 - DNA, 22 bp, Artificial Sequence
  Synthetic
ccgcagtcuccagaagttugag

SEQ ID NO: 37114 - DNA, 19 bp, Artificial Sequence
  Synthetic
ggagtggagcucagccuct

SEQ ID NO: 37115 - DNA, 18 bp, Artificial Sequence
  Synthetic
ggucgtgctucgggaaac

SEQ ID NO: 37116 - DNA, 31 bp, Artificial Sequence
  Synthetic
agcttatgtttcaugttgtgtatcttttgug

SEQ ID NO: 37117 - DNA, 28 bp, Artificial Sequence
  Synthetic
cccaaaaccuaccagtgtcataaactua

SEQ ID NO: 37118 - DNA, 28 bp, Artificial Sequence
  Synthetic
tggtagccttucagagatttatccguat

SEQ ID NO: 37119 - DNA, 31 bp, Artificial Sequence
  Synthetic
acctctatcatttuaagcatgtagcaaauca

SEQ ID NO: 37120 - DNA, 21 bp, Artificial Sequence
  Synthetic
cctcatggutgcccatctucc

SEQ ID NO: 37121 - DNA, 19 bp, Artificial Sequence
  Synthetic
gtcctcgugggaggcatuc

SEQ ID NO: 37122 - DNA, 19 bp, Artificial Sequence
  Synthetic
cattggtugcggccatcuc

SEQ ID NO: 37123 - DNA, 19 bp, Artificial Sequence
  Synthetic
gggccutagtcccucagct

SEQ ID NO: 37124 - DNA, 21 bp, Artificial Sequence
  Synthetic
gcattggaggcaucaaggugg

SEQ ID NO: 37125 - DNA, 20 bp, Artificial Sequence
  Synthetic
aacutgttcuccacgacgca

SEQ ID NO: 37126 - DNA, 17 bp, Artificial Sequence
  Synthetic
gccccugagcgtcauct

SEQ ID NO: 37127 - DNA, 20 bp, Artificial Sequence
  Synthetic
attcaccuccacgtgctuga

SEQ ID NO: 37128 - DNA, 19 bp, Artificial Sequence
  Synthetic
ctgagccggguctcttguc

SEQ ID NO: 37129 - DNA, 21 bp, Artificial Sequence
  Synthetic
ggcaugggacagagtcgtuac

SEQ ID NO: 37130 - DNA, 22 bp, Artificial Sequence
  Synthetic
ggccucaacgcccatgtcttug

SEQ ID NO: 37131 - DNA, 21 bp, Artificial Sequence
  Synthetic
gcgggagaucttgugcacggt

SEQ ID NO: 37132 - DNA, 18 bp, Artificial Sequence
  Synthetic
tgtaccuccacgcccugt

SEQ ID NO: 37133 - DNA, 17 bp, Artificial Sequence
  Synthetic
gcccucagcaccacuga

SEQ ID NO: 37134 - DNA, 22 bp, Artificial Sequence
  Synthetic
ccgtgaagaugctgaaagguga

SEQ ID NO: 37135 - DNA, 17 bp, Artificial Sequence
  Synthetic
gccgcuaccgcaccuac

SEQ ID NO: 37136 - DNA, 21 bp, Artificial Sequence
  Synthetic
ctactcctucgacaccugcaa

SEQ ID NO: 37137 - DNA, 20 bp, Artificial Sequence
  Synthetic
gctgaagccuctccaccuct

SEQ ID NO: 37138 - DNA, 18 bp, Artificial Sequence
  Synthetic
tcaugccaguaggacgcc

SEQ ID NO: 37139 - DNA, 17 bp, Artificial Sequence
  Synthetic
tccuggctcugcccagt

SEQ ID NO: 37140 - DNA, 21 bp, Artificial Sequence
  Synthetic
ccttcaggcugttcccgaaua

SEQ ID NO: 37141 - DNA, 18 bp, Artificial Sequence
  Synthetic
gcacucacgtcgguggac

SEQ ID NO: 37142 - DNA, 18 bp, Artificial Sequence
  Synthetic
agagguggctgugcgaag

SEQ ID NO: 37143 - DNA, 17 bp, Artificial Sequence
  Synthetic
cccutcacguccgcgag

SEQ ID NO: 37144 - DNA, 26 bp, Artificial Sequence
  Synthetic
accatgtatucacttcagugaaaggg

SEQ ID NO: 37145 - DNA, 24 bp, Artificial Sequence
  Synthetic
caagactacgaaccugaagccuaa

SEQ ID NO: 37146 - DNA, 28 bp, Artificial Sequence
  Synthetic
gagagcaaatgatuctcactaagcacua

SEQ ID NO: 37147 - DNA, 30 bp, Artificial Sequence
  Synthetic
cttcatcatgttcuttttgtgcttctuact

SEQ ID NO: 37148 - DNA, 23 bp, Artificial Sequence
  Synthetic
ggaaucttgaatacugggccaca

SEQ ID NO: 37149 - DNA, 25 bp, Artificial Sequence
  Synthetic
cagcaattuaaggctagctugagac

SEQ ID NO: 37150 - DNA, 26 bp, Artificial Sequence
  Synthetic
tatcgaactggcuaacatgttttuct

SEQ ID NO: 37151 - DNA, 29 bp, Artificial Sequence
  Synthetic
acttgagtgaaagaugaagtggtaacauc

SEQ ID NO: 37152 - DNA, 24 bp, Artificial Sequence
  Synthetic
ctgctgucagatggctuaaagaga

SEQ ID NO: 37153 - DNA, 23 bp, Artificial Sequence
  Synthetic
gctaactcctutttcctgctgug

SEQ ID NO: 37154 - DNA, 31 bp, Artificial Sequence
  Synthetic
ctgatcgtagtuctgatttcatttgttucat

SEQ ID NO: 37155 - DNA, 23 bp, Artificial Sequence
  Synthetic
ccccagaccuctgcaatugaaaa

SEQ ID NO: 37156 - DNA, 24 bp, Artificial Sequence
  Synthetic
gcatacaucaggccatctccuact

SEQ ID NO: 37157 - DNA, 30 bp, Artificial Sequence
  Synthetic
tttagcaaatauctgctgaaugaacaaaaa

SEQ ID NO: 37158 - DNA, 31 bp, Artificial Sequence
  Synthetic
tgttggttgtcatuaaatgtttctgatcuct

SEQ ID NO: 37159 - DNA, 28 bp, Artificial Sequence
  Synthetic
gaaagatacagaaugcaagcaagctuac

SEQ ID NO: 37160 - DNA, 27 bp, Artificial Sequence
  Synthetic
tgaaagattuccaggacctaatgctug

SEQ ID NO: 37161 - DNA, 26 bp, Artificial Sequence
  Synthetic
cccaaugagaaccttttgtuccagaa

SEQ ID NO: 37162 - DNA, 18 bp, Artificial Sequence
  Synthetic
cccggcgagcutaactug

SEQ ID NO: 37163 - DNA, 21 bp, Artificial Sequence
  Synthetic
ctcgguggaaagagctggtut

SEQ ID NO: 37164 - DNA, 19 bp, Artificial Sequence
  Synthetic
gcccugacagacgacaugg

SEQ ID NO: 37165 - DNA, 22 bp, Artificial Sequence
  Synthetic
tgagcagugcctttttcuggag

SEQ ID NO: 37166 - DNA, 27 bp, Artificial Sequence
  Synthetic
gtttagccaccuttcctaatttuccaa

SEQ ID NO: 37167 - DNA, 24 bp, Artificial Sequence
  Synthetic
acagaauacacacactgacauggg

SEQ ID NO: 37168 - DNA, 22 bp, Artificial Sequence
  Synthetic
caagtugaggcactgaagaugg

SEQ ID NO: 37169 - DNA, 31 bp, Artificial Sequence
  Synthetic
cctcaagttuacaagagggaatautgaauaa

SEQ ID NO: 37170 - DNA, 32 bp, Artificial Sequence
  Synthetic
aagaatattttagacugcttaaagcaattgut

SEQ ID NO: 37171 - DNA, 23 bp, Artificial Sequence
  Synthetic
cactcuccagaacggcttgauac

SEQ ID NO: 37172 - DNA, 27 bp, Artificial Sequence
  Synthetic
tgatgtaagtatugctcttctgcaguc

SEQ ID NO: 37173 - DNA, 31 bp, Artificial Sequence
  Synthetic
agtttcaaataagtugtactgccaagtuact

SEQ ID NO: 37174 - DNA, 28 bp, Artificial Sequence
  Synthetic
gagcttttaaguggtagccatagtauga

SEQ ID NO: 37175 - DNA, 33 bp, Artificial Sequence
  Synthetic
aauaactacctatttttauacccacaaacaaga

SEQ ID NO: 37176 - DNA, 30 bp, Artificial Sequence
  Synthetic
gtttatcatacagacacutcatttggagua

SEQ ID NO: 37177 - DNA, 27 bp, Artificial Sequence
  Synthetic
gtgaccaggguttgtaatcttctgtua

SEQ ID NO: 37178 - DNA, 27 bp, Artificial Sequence
  Synthetic
ctcatgauaaggatgatatgucgcgaa

SEQ ID NO: 37179 - DNA, 22 bp, Artificial Sequence
  Synthetic
tcttgtcaucaggctgtgagug

SEQ ID NO: 37180 - DNA, 28 bp, Artificial Sequence
  Synthetic
agggttatattagugatccctgcataut

SEQ ID NO: 37181 - DNA, 31 bp, Artificial Sequence
  Synthetic
catgtctatgctcutcatcaaatgaaagtut

SEQ ID NO: 37182 - DNA, 26 bp, Artificial Sequence
  Synthetic
agttaccaactuggtaccagtttgut

SEQ ID NO: 37183 - DNA, 30 bp, Artificial Sequence
  Synthetic
attccagcatatcgucttagtgtaatacug

SEQ ID NO: 37184 - DNA, 28 bp, Artificial Sequence
  Synthetic
agcttggctucaagttgtctttttaaug

SEQ ID NO: 37185 - DNA, 23 bp, Artificial Sequence
  Synthetic
agattgcacaacugccctcuaag

SEQ ID NO: 37186 - DNA, 33 bp, Artificial Sequence
  Synthetic
gtaacatagaagtuaatgagagacaaatuccaa

SEQ ID NO: 37187 - DNA, 25 bp, Artificial Sequence
  Synthetic
cgguaagtaagagugccaaccaaaa

SEQ ID NO: 37188 - DNA, 26 bp, Artificial Sequence
  Synthetic
tgttactgcauacacattgtgaccut

SEQ ID NO: 37189 - DNA, 22 bp, Artificial Sequence
  Synthetic
cccccatgucccataatgctuc

SEQ ID NO: 37190 - DNA, 21 bp, Artificial Sequence
  Synthetic
ggctcaagcutgccatctcut

SEQ ID NO: 37191 - DNA, 29 bp, Artificial Sequence
  Synthetic
ggacagtcatgtugccagtattaaaatug

SEQ ID NO: 37192 - DNA, 24 bp, Artificial Sequence
  Synthetic
auccagcaacagaaaauccaggaa

SEQ ID NO: 37193 - DNA, 32 bp, Artificial Sequence
  Synthetic
cgacttagtgaaatugtaagtgtttgaatgug

SEQ ID NO: 37194 - DNA, 26 bp, Artificial Sequence
  Synthetic
tcaaatgaaacccucgattgaaucct

SEQ ID NO: 37195 - DNA, 23 bp, Artificial Sequence
  Synthetic
tgggtctugcccatctttcatuc

SEQ ID NO: 37196 - DNA, 22 bp, Artificial Sequence
  Synthetic
gtttctccauacaggucacggg

SEQ ID NO: 37197 - DNA, 28 bp, Artificial Sequence
  Synthetic
tgatccacaugacgtttctcttcatuat

SEQ ID NO: 37198 - DNA, 23 bp, Artificial Sequence
  Synthetic
tcaagcagugagaatacguccac

SEQ ID NO: 37199 - DNA, 30 bp, Artificial Sequence
  Synthetic
atcttcagctgaugacaaagatgataauga

SEQ ID NO: 37200 - DNA, 22 bp, Artificial Sequence
  Synthetic
aagatcctgugagcgaagtucc

SEQ ID NO: 37201 - DNA, 28 bp, Artificial Sequence
  Synthetic
gaactgacagaaguacatctgcuaaaca

SEQ ID NO: 37202 - DNA, 23 bp, Artificial Sequence
  Synthetic
cagaaguaaaacaccuccaccac

SEQ ID NO: 37203 - DNA, 21 bp, Artificial Sequence
  Synthetic
gcacucaggctggaugaacaa

SEQ ID NO: 37204 - DNA, 30 bp, Artificial Sequence
  Synthetic
gccuaaagaatcaaaugaaaaccaagagaa

SEQ ID NO: 37205 - DNA, 22 bp, Artificial Sequence
  Synthetic
tttguacacaggcagctgacut

SEQ ID NO: 37206 - DNA, 24 bp, Artificial Sequence
  Synthetic
caatcgaaucccctccaaaugagt

SEQ ID NO: 37207 - DNA, 28 bp, Artificial Sequence
  Synthetic
catagcagaautaatgcattcugcaaga

SEQ ID NO: 37208 - DNA, 28 bp, Artificial Sequence
  Synthetic
aagaaaccaactucaccagtaaaaccua

SEQ ID NO: 37209 - DNA, 32 bp, Artificial Sequence
  Synthetic
gcaaaacttcctcugactctatcttcattaut

SEQ ID NO: 37210 - DNA, 26 bp, Artificial Sequence
  Synthetic
ttccagggaaaaggcugaatuaagaa

SEQ ID NO: 37211 - DNA, 21 bp, Artificial Sequence
  Synthetic
cttttcaucagttgcugcccc

SEQ ID NO: 37212 - DNA, 24 bp, Artificial Sequence
  Synthetic
cagggagaaccaaguaaaccucaa

SEQ ID NO: 37213 - DNA, 25 bp, Artificial Sequence
  Synthetic
ccacccatattuctgggactatgut

SEQ ID NO: 37214 - DNA, 31 bp, Artificial Sequence
  Synthetic
cctgattcagaaaautttgattggaaagcua

SEQ ID NO: 37215 - DNA, 29 bp, Artificial Sequence
  Synthetic
ggttttagaattcgugggcctttatuact

SEQ ID NO: 37216 - DNA, 22 bp, Artificial Sequence
  Synthetic
aaaugaaacagcccctucaagc

SEQ ID NO: 37217 - DNA, 21 bp, Artificial Sequence
  Synthetic
gagaagtgguggctgttugac

SEQ ID NO: 37218 - DNA, 23 bp, Artificial Sequence
  Synthetic
tgcccagcaaccautaaguagac

SEQ ID NO: 37219 - DNA, 28 bp, Artificial Sequence
  Synthetic
ggataaacctgtutgtttggtaaggtuc

SEQ ID NO: 37220 - DNA, 30 bp, Artificial Sequence
  Synthetic
tcttcaactaaaucaagtggaagtgaauct

SEQ ID NO: 37221 - DNA, 26 bp, Artificial Sequence
  Synthetic
tgtggauagagacataucaggaaggg

SEQ ID NO: 37222 - DNA, 28 bp, Artificial Sequence
  Synthetic
cattctgaaaguccttctagactuccaa

SEQ ID NO: 37223 - DNA, 28 bp, Artificial Sequence
  Synthetic
gcggatacttggutttctttactttgut

SEQ ID NO: 37224 - DNA, 27 bp, Artificial Sequence
  Synthetic
ctaatttatcaaauggcacctgctgut

SEQ ID NO: 37225 - DNA, 21 bp, Artificial Sequence
  Synthetic
gcatgggaacacugccatuac

SEQ ID NO: 37226 - DNA, 25 bp, Artificial Sequence
  Synthetic
agttctataguggaacguaccccat

SEQ ID NO: 37227 - DNA, 27 bp, Artificial Sequence
  Synthetic
ctttgtgttgtuattcactggagtugg

SEQ ID NO: 37228 - DNA, 26 bp, Artificial Sequence
  Synthetic
gggtcttacctugtgacatctgttua

SEQ ID NO: 37229 - DNA, 22 bp, Artificial Sequence
  Synthetic
ctaaccaucaagagtgccuccc

SEQ ID NO: 37230 - DNA, 23 bp, Artificial Sequence
  Synthetic
gttgttctgucacccagttggua

SEQ ID NO: 37231 - DNA, 27 bp, Artificial Sequence
  Synthetic
tcaatattccauagcctgtucccaaag

SEQ ID NO: 37232 - DNA, 22 bp, Artificial Sequence
  Synthetic
aagtggccugtgctcttagtuc

SEQ ID NO: 37233 - DNA, 23 bp, Artificial Sequence
  Synthetic
cctccucagtttcugagaccaac

SEQ ID NO: 37234 - DNA, 23 bp, Artificial Sequence
  Synthetic
ctttgatgagcagcuggtttgug

SEQ ID NO: 37235 - DNA, 22 bp, Artificial Sequence
  Synthetic
tcctagggaugggtggcaatua

SEQ ID NO: 37236 - DNA, 21 bp, Artificial Sequence
  Synthetic
atgugacaccccaggucaaag

SEQ ID NO: 37237 - DNA, 20 bp, Artificial Sequence
  Synthetic
cagaggugctcauggcagag

SEQ ID NO: 37238 - DNA, 19 bp, Artificial Sequence
  Synthetic
guagccucccagaccaagg

SEQ ID NO: 37239 - DNA, 22 bp, Artificial Sequence
  Synthetic
cagagugggagaacaagtccug

SEQ ID NO: 37240 - DNA, 17 bp, Artificial Sequence
  Synthetic
ggccugcagtugccaag

SEQ ID NO: 37241 - DNA, 20 bp, Artificial Sequence
  Synthetic
tguggagacaggagcuggat

SEQ ID NO: 37242 - DNA, 20 bp, Artificial Sequence
  Synthetic
cuaggaaaacagggccugca

SEQ ID NO: 37243 - DNA, 28 bp, Artificial Sequence
  Synthetic
tctaggtucagagaggaaaagucaaaac

SEQ ID NO: 37244 - DNA, 17 bp, Artificial Sequence
  Synthetic
ccugcaacccccucagc

SEQ ID NO: 37245 - DNA, 24 bp, Artificial Sequence
  Synthetic
agattgtagacagagucccagugt

SEQ ID NO: 37246 - DNA, 21 bp, Artificial Sequence
  Synthetic
gtccaggucaaggcugaaaag

SEQ ID NO: 37247 - DNA, 20 bp, Artificial Sequence
  Synthetic
aaaacccaugctctgccuga

SEQ ID NO: 37248 - DNA, 21 bp, Artificial Sequence
  Synthetic
gacttcuccagcaggctcauc

SEQ ID NO: 37249 - DNA, 21 bp, Artificial Sequence
  Synthetic
aggaguccaaaggaccacgua

SEQ ID NO: 37250 - DNA, 22 bp, Artificial Sequence
  Synthetic
ccaggugaaagcugaaaagcag

SEQ ID NO: 37251 - DNA, 21 bp, Artificial Sequence
  Synthetic
caacacuagcccccagucaag

SEQ ID NO: 37252 - DNA, 25 bp, Artificial Sequence
  Synthetic
ctccaatacuattatcccccugcaa

SEQ ID NO: 37253 - DNA, 19 bp, Artificial Sequence
  Synthetic
tccattcccucccccucac

SEQ ID NO: 37254 - DNA, 20 bp, Artificial Sequence
  Synthetic
accagaucagagctgcctug

SEQ ID NO: 37255 - DNA, 22 bp, Artificial Sequence
  Synthetic
ccgttcugaggagtgagtgtug

SEQ ID NO: 37256 - DNA, 25 bp, Artificial Sequence
  Synthetic
tctgttuaggaucaggagtcttcut

SEQ ID NO: 37257 - DNA, 21 bp, Artificial Sequence
  Synthetic
cagggtucacacagaagctug

SEQ ID NO: 37258 - DNA, 23 bp, Artificial Sequence
  Synthetic
tgtcgacccuaatcgtaguccag

SEQ ID NO: 37259 - DNA, 20 bp, Artificial Sequence
  Synthetic
ctcccaccacugcauaaggg

SEQ ID NO: 37260 - DNA, 21 bp, Artificial Sequence
  Synthetic
gcaucccaaggacttgugagt

SEQ ID NO: 37261 - DNA, 18 bp, Artificial Sequence
  Synthetic
gcacctuctacgcuccgt

SEQ ID NO: 37262 - DNA, 23 bp, Artificial Sequence
  Synthetic
ctgagagcucagatgacagugag

SEQ ID NO: 37263 - DNA, 24 bp, Artificial Sequence
  Synthetic
tgagtctgagauatggagcugagg

SEQ ID NO: 37264 - DNA, 21 bp, Artificial Sequence
  Synthetic
gcctcttucacaatgggctuc

SEQ ID NO: 37265 - DNA, 23 bp, Artificial Sequence
  Synthetic
ccctccugcagaccttaactuac

SEQ ID NO: 37266 - DNA, 21 bp, Artificial Sequence
  Synthetic
tcagtggugaaggtccugact

SEQ ID NO: 37267 - DNA, 20 bp, Artificial Sequence
  Synthetic
gctttccccutggaagucgt

SEQ ID NO: 37268 - DNA, 20 bp, Artificial Sequence
  Synthetic
cctgtgcaccucccaacaut

SEQ ID NO: 37269 - DNA, 22 bp, Artificial Sequence
  Synthetic
ggtctgttutctggccugagac

SEQ ID NO: 37270 - DNA, 24 bp, Artificial Sequence
  Synthetic
cattttguaagaatggcatugcct

SEQ ID NO: 37271 - DNA, 20 bp, Artificial Sequence
  Synthetic
gcttcgcucccgggaatuac

SEQ ID NO: 37272 - DNA, 22 bp, Artificial Sequence
  Synthetic
gcggaaacgaugcctgtattuc

SEQ ID NO: 37273 - DNA, 24 bp, Artificial Sequence
  Synthetic
tccacattccutcatcatctugcc

SEQ ID NO: 37274 - DNA, 22 bp, Artificial Sequence
  Synthetic
gctaaagccauttcagccccut

SEQ ID NO: 37275 - DNA, 27 bp, Artificial Sequence
  Synthetic
gcactgttaagutctcccttttctuac

SEQ ID NO: 37276 - DNA, 23 bp, Artificial Sequence
  Synthetic
taatggatucgctgcattuagct

SEQ ID NO: 37277 - DNA, 28 bp, Artificial Sequence
  Synthetic
tcaatgcaaaccaaagucagaagttuac

SEQ ID NO: 37278 - DNA, 26 bp, Artificial Sequence
  Synthetic
gaaggacagaagutcaaagagcuaca

SEQ ID NO: 37279 - DNA, 30 bp, Artificial Sequence
  Synthetic
taattctgtactuggaatacatgccatuat

SEQ ID NO: 37280 - DNA, 17 bp, Artificial Sequence
  Synthetic
ctgcgtcugcgccaaug

SEQ ID NO: 37281 - DNA, 21 bp, Artificial Sequence
  Synthetic
acgcacacacacguacacaua

SEQ ID NO: 37282 - DNA, 25 bp, Artificial Sequence
  Synthetic
tgggtgtacuatgcagttaucgact

SEQ ID NO: 37283 - DNA, 23 bp, Artificial Sequence
  Synthetic
aggacucaaggaagugcaaacaa

SEQ ID NO: 37284 - DNA, 26 bp, Artificial Sequence
  Synthetic
gaattttacttgugtggacgaugcag

SEQ ID NO: 37285 - DNA, 22 bp, Artificial Sequence
  Synthetic
agctaauggcaagaauggcgat

SEQ ID NO: 37286 - DNA, 28 bp, Artificial Sequence
  Synthetic
cccttttcacuaggagacacaaacatua

SEQ ID NO: 37287 - DNA, 23 bp, Artificial Sequence
  Synthetic
aagtttccctutaagtggccugt

SEQ ID NO: 37288 - DNA, 21 bp, Artificial Sequence
  Synthetic
cttcttuggcggcaatgaugt

SEQ ID NO: 37289 - DNA, 25 bp, Artificial Sequence
  Synthetic
tcttcgaattgaugtctgcctucaa

SEQ ID NO: 37290 - DNA, 26 bp, Artificial Sequence
  Synthetic
agcttctgattucatctccctttucc

SEQ ID NO: 37291 - DNA, 27 bp, Artificial Sequence
  Synthetic
caggaatacautttcggttcttugacc

SEQ ID NO: 37292 - DNA, 25 bp, Artificial Sequence
  Synthetic
cctgttgctuaatggctgttugaaa

SEQ ID NO: 37293 - DNA, 30 bp, Artificial Sequence
  Synthetic
gcgtatcagatauatccccagagauaaagt

SEQ ID NO: 37294 - DNA, 28 bp, Artificial Sequence
  Synthetic
cactgcaaagaaagaauttgagactuca

SEQ ID NO: 37295 - DNA, 24 bp, Artificial Sequence
  Synthetic
ggtcacugcttccatcaucagaag

SEQ ID NO: 37296 - DNA, 21 bp, Artificial Sequence
  Synthetic
gctgccacaaacacuagggua

SEQ ID NO: 37297 - DNA, 26 bp, Artificial Sequence
  Synthetic
gagttctcacuggatatgcttgauga

SEQ ID NO: 37298 - DNA, 23 bp, Artificial Sequence
  Synthetic
gaggagtgcaguttgaaatgcug

SEQ ID NO: 37299 - DNA, 23 bp, Artificial Sequence
  Synthetic
ggctttgaugttccagagucact

SEQ ID NO: 37300 - DNA, 22 bp, Artificial Sequence
  Synthetic
gcggttgaugactgcucaaaac

SEQ ID NO: 37301 - DNA, 21 bp, Artificial Sequence
  Synthetic
tgtcggacaguaagccaggua

SEQ ID NO: 37302 - DNA, 25 bp, Artificial Sequence
  Synthetic
cacagtgaaccguaaagcctuaaag

SEQ ID NO: 37303 - DNA, 28 bp, Artificial Sequence
  Synthetic
cagattgcttaaccutgctatcgaaaug

SEQ ID NO: 37304 - DNA, 22 bp, Artificial Sequence
  Synthetic
cgttuaaaccaaaggcgcacua

SEQ ID NO: 37305 - DNA, 23 bp, Artificial Sequence
  Synthetic
gcagtcagcaugattttgctcug

SEQ ID NO: 37306 - DNA, 26 bp, Artificial Sequence
  Synthetic
ggtctcauaaaaacagtgggtttucc

SEQ ID NO: 37307 - DNA, 25 bp, Artificial Sequence
  Synthetic
ggaccagugaaagtttgctgaaaut

SEQ ID NO: 37308 - DNA, 24 bp, Artificial Sequence
  Synthetic
attucaaccaaagaagagccucca

SEQ ID NO: 37309 - DNA, 23 bp, Artificial Sequence
  Synthetic
cugctcaaatacugagaccccaa

SEQ ID NO: 37310 - DNA, 23 bp, Artificial Sequence
  Synthetic
tcaatatccauggcagcugacaa

SEQ ID NO: 37311 - DNA, 28 bp, Artificial Sequence
  Synthetic
gcacttcaaacutactactgcatuacgt

SEQ ID NO: 37312 - DNA, 24 bp, Artificial Sequence
  Synthetic
gggtcaaauggaagagacaucaat

SEQ ID NO: 37313 - DNA, 25 bp, Artificial Sequence
  Synthetic
cacaagugggcaaacatttctcuac

SEQ ID NO: 37314 - DNA, 30 bp, Artificial Sequence
  Synthetic
tgaacttttcaccuaatggtttagcattug

SEQ ID NO: 37315 - DNA, 26 bp, Artificial Sequence
  Synthetic
ctggacacacucttcatgguaaaact

SEQ ID NO: 37316 - DNA, 31 bp, Artificial Sequence
  Synthetic
agtgctaacaaauagacttgaataacucaca

SEQ ID NO: 37317 - DNA, 27 bp, Artificial Sequence
  Synthetic
ggtaaagtgatuagggcagatgauact

SEQ ID NO: 37318 - DNA, 24 bp, Artificial Sequence
  Synthetic
cttgcagtcutgtgatctgaaugc

SEQ ID NO: 37319 - DNA, 27 bp, Artificial Sequence
  Synthetic
gagatgagtgcuattcttcaggctuac

SEQ ID NO: 37320 - DNA, 21 bp, Artificial Sequence
  Synthetic
cctcgagcugttcctuccaac

SEQ ID NO: 37321 - DNA, 25 bp, Artificial Sequence
  Synthetic
gtcugtgtttgccugagaaacaaaa

SEQ ID NO: 37322 - DNA, 25 bp, Artificial Sequence
  Synthetic
gtttgccttttucaggacgtgaaut

SEQ ID NO: 37323 - DNA, 20 bp, Artificial Sequence
  Synthetic
tcatagagcagcaugcggut

SEQ ID NO: 37324 - DNA, 26 bp, Artificial Sequence
  Synthetic
tgtatacattuggataccagtgucct

SEQ ID NO: 37325 - DNA, 27 bp, Artificial Sequence
  Synthetic
cagtgaaaacagcauttcccattacut

SEQ ID NO: 37326 - DNA, 24 bp, Artificial Sequence
  Synthetic
ctgttctctugggagttggtaucc

SEQ ID NO: 37327 - DNA, 22 bp, Artificial Sequence
  Synthetic
agcagaaguctagaaggguggt

SEQ ID NO: 37328 - DNA, 22 bp, Artificial Sequence
  Synthetic
gggugaaaucacaaaggagcga

SEQ ID NO: 37329 - DNA, 24 bp, Artificial Sequence
  Synthetic
gaacgaguagcggtacaaauggat

SEQ ID NO: 37330 - DNA, 22 bp, Artificial Sequence
  Synthetic
ccagcuccttttguaagcagca

SEQ ID NO: 37331 - DNA, 25 bp, Artificial Sequence
  Synthetic
tttatctgacatuttgggtgccuga

SEQ ID NO: 37332 - DNA, 25 bp, Artificial Sequence
  Synthetic
cccagccuttagataaggucagaga

SEQ ID NO: 37333 - DNA, 23 bp, Artificial Sequence
  Synthetic
ggatttauccagccttgggucag

SEQ ID NO: 37334 - DNA, 21 bp, Artificial Sequence
  Synthetic
gacaaaccccaugcctcttug

SEQ ID NO: 37335 - DNA, 22 bp, Artificial Sequence
  Synthetic
ggcatcttcucatcagcctgug

SEQ ID NO: 37336 - DNA, 24 bp, Artificial Sequence
  Synthetic
gcaagcugttaaatcacucaccca

SEQ ID NO: 37337 - DNA, 25 bp, Artificial Sequence
  Synthetic
gagacctaaaagautgcccactcut

SEQ ID NO: 37338 - DNA, 21 bp, Artificial Sequence
  Synthetic
cccugggaaaagcctcaucac

SEQ ID NO: 37339 - DNA, 30 bp, Artificial Sequence
  Synthetic
gacattgattgguactacttctgttcugat

SEQ ID NO: 37340 - DNA, 19 bp, Artificial Sequence
  Synthetic
cccgcggaucaacactcug

SEQ ID NO: 37341 - DNA, 17 bp, Artificial Sequence
  Synthetic
ggacgguccctcccugt

SEQ ID NO: 37342 - DNA, 29 bp, Artificial Sequence
  Synthetic
aaggttttcttccuggtagtatgtgttut

SEQ ID NO: 37343 - DNA, 23 bp, Artificial Sequence
  Synthetic
cgatccatgcuctgtggacaaua

SEQ ID NO: 37344 - DNA, 22 bp, Artificial Sequence
  Synthetic
gaggctacacutgtcagagugg

SEQ ID NO: 37345 - DNA, 26 bp, Artificial Sequence
  Synthetic
tgaggtcuagaagactctttgucaca

SEQ ID NO: 37346 - DNA, 24 bp, Artificial Sequence
  Synthetic
ctgaggccaguatcugaagaaaag

SEQ ID NO: 37347 - DNA, 29 bp, Artificial Sequence
  Synthetic
tcgatgcactugagaaataaatcagctua

SEQ ID NO: 37348 - DNA, 25 bp, Artificial Sequence
  Synthetic
gggtgauggaagtttaatgaugact

SEQ ID NO: 37349 - DNA, 25 bp, Artificial Sequence
  Synthetic
gcctaccucaattttgtcugaagct

SEQ ID NO: 37350 - DNA, 24 bp, Artificial Sequence
  Synthetic
aaactgctuactagctttcaugca

SEQ ID NO: 37351 - DNA, 25 bp, Artificial Sequence
  Synthetic
gatgaacatcaaugcacttggugat

SEQ ID NO: 37352 - DNA, 30 bp, Artificial Sequence
  Synthetic
gacaatcctugaaacagaactactagauga

SEQ ID NO: 37353 - DNA, 22 bp, Artificial Sequence
  Synthetic
ggttctggguctgagacgauac

SEQ ID NO: 37354 - DNA, 23 bp, Artificial Sequence
  Synthetic
gattgtacagcugaagcctcgua

SEQ ID NO: 37355 - DNA, 31 bp, Artificial Sequence
  Synthetic
actctagattaaaugttgctttcttgaugga

SEQ ID NO: 37356 - DNA, 22 bp, Artificial Sequence
  Synthetic
agcctggcuctagcatgtttuc

SEQ ID NO: 37357 - DNA, 22 bp, Artificial Sequence
  Synthetic
cctaagtggcccugaggacaua

SEQ ID NO: 37358 - DNA, 21 bp, Artificial Sequence
  Synthetic
agacgauagccgacctugagt

SEQ ID NO: 37359 - DNA, 27 bp, Artificial Sequence
  Synthetic
tgauacaaagagaaagatgucccaagc

SEQ ID NO: 37360 - DNA, 28 bp, Artificial Sequence
  Synthetic
agaaaaugacaaguaagaaacatggaug

SEQ ID NO: 37361 - DNA, 25 bp, Artificial Sequence
  Synthetic
ccaggcaaaauactagcagauacct

SEQ ID NO: 37362 - DNA, 22 bp, Artificial Sequence
  Synthetic
gctgaggttcucaaccagctua

SEQ ID NO: 37363 - DNA, 27 bp, Artificial Sequence
  Synthetic
aaaugaagauccagaaaaagaagctug

SEQ ID NO: 37364 - DNA, 22 bp, Artificial Sequence
  Synthetic
ccgcccaatutggtgacttgua

SEQ ID NO: 37365 - DNA, 23 bp, Artificial Sequence
  Synthetic
gaagtctgagaguggatctgcug

SEQ ID NO: 37366 - DNA, 30 bp, Artificial Sequence
  Synthetic
cttgggtatataucaagtgaatttcugggt

SEQ ID NO: 37367 - DNA, 21 bp, Artificial Sequence
  Synthetic
gcggcguttagcatcauagag

SEQ ID NO: 37368 - DNA, 29 bp, Artificial Sequence
  Synthetic
agggtacaaauaacagtggtaaaagagug

SEQ ID NO: 37369 - DNA, 26 bp, Artificial Sequence
  Synthetic
cttaattgaatuggcgcaaagtucag

SEQ ID NO: 37370 - DNA, 28 bp, Artificial Sequence
  Synthetic
tgatttaaaactguggaactgtagcugt

SEQ ID NO: 37371 - DNA, 27 bp, Artificial Sequence
  Synthetic
gggcaggtttuaagagatatgtgauga

SEQ ID NO: 37372 - DNA, 26 bp, Artificial Sequence
  Synthetic
gggaaaagtacugcttctttctugga

SEQ ID NO: 37373 - DNA, 21 bp, Artificial Sequence
  Synthetic
gcaagctucgctttgaacugg

SEQ ID NO: 37374 - DNA, 25 bp, Artificial Sequence
  Synthetic
cacccgacugacttatgagatugaa

SEQ ID NO: 37375 - DNA, 23 bp, Artificial Sequence
  Synthetic
tcttcctgcaguagaacccucaa

SEQ ID NO: 37376 - DNA, 28 bp, Artificial Sequence
  Synthetic
ggagatatccaugcaaaaagaggaugat

SEQ ID NO: 37377 - DNA, 25 bp, Artificial Sequence
  Synthetic
cctgcttcagutctatctccagaug

SEQ ID NO: 37378 - DNA, 28 bp, Artificial Sequence
  Synthetic
tcaggacaaaaauaaggagaucgagaga

SEQ ID NO: 37379 - DNA, 23 bp, Artificial Sequence
  Synthetic
gtatcctctuccttctgcauggt

SEQ ID NO: 37380 - DNA, 22 bp, Artificial Sequence
  Synthetic
tcucaggaggguggaagaagac

SEQ ID NO: 37381 - DNA, 30 bp, Artificial Sequence
  Synthetic
ttctttgtcgaucagttgttttaaccttuc

SEQ ID NO: 37382 - DNA, 24 bp, Artificial Sequence
  Synthetic
gugcgacggagacaauaaacaaac

SEQ ID NO: 37383 - DNA, 22 bp, Artificial Sequence
  Synthetic
cctctugcaggagtcttcugac

SEQ ID NO: 37384 - DNA, 22 bp, Artificial Sequence
  Synthetic
ctggagcaggcauccattgtua

SEQ ID NO: 37385 - DNA, 27 bp, Artificial Sequence
  Synthetic
cttctgcttttaucttctatcgcctuc

SEQ ID NO: 37386 - DNA, 24 bp, Artificial Sequence
  Synthetic
gaagcggacagugataaaaaugca

SEQ ID NO: 37387 - DNA, 28 bp, Artificial Sequence
  Synthetic
agtgaagctgugatcaagtatttgugaa

SEQ ID NO: 37388 - DNA, 26 bp, Artificial Sequence
  Synthetic
tgcaaaaucaactcuagaggcagaaa

SEQ ID NO: 37389 - DNA, 27 bp, Artificial Sequence
  Synthetic
tcttcaattctcutgatctctgctugg

SEQ ID NO: 37390 - DNA, 20 bp, Artificial Sequence
  Synthetic
tgtgaguggaccgtugacac

SEQ ID NO: 37391 - DNA, 23 bp, Artificial Sequence
  Synthetic
cgaaggaauggctggattucaga

SEQ ID NO: 37392 - DNA, 26 bp, Artificial Sequence
  Synthetic
ggcagctacagguggtataattgauc

SEQ ID NO: 37393 - DNA, 28 bp, Artificial Sequence
  Synthetic
gcattccggttuctctatcaatcaaaut

SEQ ID NO: 37394 - DNA, 26 bp, Artificial Sequence
  Synthetic
gaatgauccccgagatagucagaaaa

SEQ ID NO: 37395 - DNA, 24 bp, Artificial Sequence
  Synthetic
agtggacgguctcaatauaccaga

SEQ ID NO: 37396 - DNA, 23 bp, Artificial Sequence
  Synthetic
ggccatgaaaautggcttagucc

SEQ ID NO: 37397 - DNA, 28 bp, Artificial Sequence
  Synthetic
ggaacaaagagaugatgtttcctgttuc

SEQ ID NO: 37398 - DNA, 22 bp, Artificial Sequence
  Synthetic
atugauccaaaggagagccauc

SEQ ID NO: 37399 - DNA, 28 bp, Artificial Sequence
  Synthetic
tguttcttcttttcttucagaggcagaa

SEQ ID NO: 37400 - DNA, 23 bp, Artificial Sequence
  Synthetic
acctucaaagaactgtgugagca

SEQ ID NO: 37401 - DNA, 26 bp, Artificial Sequence
  Synthetic
gacaccattttucaaggagatcaugt

SEQ ID NO: 37402 - DNA, 21 bp, Artificial Sequence
  Synthetic
tggaagaaucgagccccatug

SEQ ID NO: 37403 - DNA, 23 bp, Artificial Sequence
  Synthetic
catgucttggtcaaucacaccct

SEQ ID NO: 37404 - DNA, 22 bp, Artificial Sequence
  Synthetic
tcctggagutccagtaccucac

SEQ ID NO: 37405 - DNA, 28 bp, Artificial Sequence
  Synthetic
gagcgatttauggcatccttataggaua

SEQ ID NO: 37406 - DNA, 28 bp, Artificial Sequence
  Synthetic
catttagcagtagutctattgggcacua

SEQ ID NO: 37407 - DNA, 29 bp, Artificial Sequence
  Synthetic
augagctaagaagauaaaaagccagaaca

SEQ ID NO: 37408 - DNA, 31 bp, Artificial Sequence
  Synthetic
cctacagtacaguaatctggatacaaaugat

SEQ ID NO: 37409 - DNA, 24 bp, Artificial Sequence
  Synthetic
cgcaaacuggagaagucagaagac

SEQ ID NO: 37410 - DNA, 22 bp, Artificial Sequence
  Synthetic
gcccttttuaacagagccgtuc

SEQ ID NO: 37411 - DNA, 25 bp, Artificial Sequence
  Synthetic
atttgttccctuccttcttcctcuc

SEQ ID NO: 37412 - DNA, 19 bp, Artificial Sequence
  Synthetic
gacggcgaacugtaucacg

SEQ ID NO: 37413 - DNA, 23 bp, Artificial Sequence
  Synthetic
tgaaaggcuccatcatccagtug

SEQ ID NO: 37414 - DNA, 21 bp, Artificial Sequence
  Synthetic
aagttcucgctctugggaagg

SEQ ID NO: 37415 - DNA, 20 bp, Artificial Sequence
  Synthetic
ccctgtcaucggctaccuga

SEQ ID NO: 37416 - DNA, 21 bp, Artificial Sequence
  Synthetic
cutccctaaaugcaggccact

SEQ ID NO: 37417 - DNA, 19 bp, Artificial Sequence
  Synthetic
cggcaagucggttccucac

SEQ ID NO: 37418 - DNA, 21 bp, Artificial Sequence
  Synthetic
gctgctcucagctttctuggt

SEQ ID NO: 37419 - DNA, 23 bp, Artificial Sequence
  Synthetic
agaaccaguacgtccacattucc

SEQ ID NO: 37420 - DNA, 17 bp, Artificial Sequence
  Synthetic
cttgtgucccggcguct

SEQ ID NO: 37421 - DNA, 20 bp, Artificial Sequence
  Synthetic
cagttcatugggtccuccca

SEQ ID NO: 37422 - DNA, 21 bp, Artificial Sequence
  Synthetic
ccctguggacaatgctttgug

SEQ ID NO: 37423 - DNA, 20 bp, Artificial Sequence
  Synthetic
gaatgccugccucccaagaa

SEQ ID NO: 37424 - DNA, 26 bp, Artificial Sequence
  Synthetic
agccactacacauattgttcttggut

SEQ ID NO: 37425 - DNA, 28 bp, Artificial Sequence
  Synthetic
acutctctgugaaaggaagaaagaauac

SEQ ID NO: 37426 - DNA, 26 bp, Artificial Sequence
  Synthetic
gaaagatucaaaggatcacucaccct

SEQ ID NO: 37427 - DNA, 32 bp, Artificial Sequence
  Synthetic
ttggactgattuagagaatggagttattaaut

SEQ ID NO: 37428 - DNA, 25 bp, Artificial Sequence
  Synthetic
attttccaggucaggactttaucct

SEQ ID NO: 37429 - DNA, 23 bp, Artificial Sequence
  Synthetic
tttggatttccuctcctgcacuc

SEQ ID NO: 37430 - DNA, 23 bp, Artificial Sequence
  Synthetic
gguagagggagagaaacaauguc

SEQ ID NO: 37431 - DNA, 24 bp, Artificial Sequence
  Synthetic
aggaggaggagagaguagaguaua

SEQ ID NO: 37432 - DNA, 18 bp, Artificial Sequence
  Synthetic
ggagccauccccgttucc

SEQ ID NO: 37433 - DNA, 25 bp, Artificial Sequence
  Synthetic
caagugcaaagaaaaagcuagttuc

SEQ ID NO: 37434 - DNA, 22 bp, Artificial Sequence
  Synthetic
cgaactccaugggtttccagua

SEQ ID NO: 37435 - DNA, 24 bp, Artificial Sequence
  Synthetic
gaaaagctcugacaaccucaggaa

SEQ ID NO: 37436 - DNA, 22 bp, Artificial Sequence
  Synthetic
ccttgaatuctgcccugacaca

SEQ ID NO: 37437 - DNA, 24 bp, Artificial Sequence
  Synthetic
tccactcugccactagagtauagg

SEQ ID NO: 37438 - DNA, 22 bp, Artificial Sequence
  Synthetic
acuacccccagaacaucaccat

SEQ ID NO: 37439 - DNA, 23 bp, Artificial Sequence
  Synthetic
cctggctcucatcagtcacauac

SEQ ID NO: 37440 - DNA, 26 bp, Artificial Sequence
  Synthetic
ctaaattgagaugggtgaaugaggaa

SEQ ID NO: 37441 - DNA, 24 bp, Artificial Sequence
  Synthetic
ctagtuttgtctcctucccacagt

SEQ ID NO: 37442 - DNA, 18 bp, Artificial Sequence
  Synthetic
gagccccagaugccacuc

SEQ ID NO: 37443 - DNA, 21 bp, Artificial Sequence
  Synthetic
gcctgtcugcttcatgggaua

SEQ ID NO: 37444 - DNA, 21 bp, Artificial Sequence
  Synthetic
cctccagccugagtcugagat

SEQ ID NO: 37445 - DNA, 19 bp, Artificial Sequence
  Synthetic
gtgtgguccagctcaccut

SEQ ID NO: 37446 - DNA, 24 bp, Artificial Sequence
  Synthetic
gucaccaaaauccagaaaccacua

SEQ ID NO: 37447 - DNA, 19 bp, Artificial Sequence
  Synthetic
ccuctcccucacccaacag

SEQ ID NO: 37448 - DNA, 22 bp, Artificial Sequence
  Synthetic
tcgagugagccaaagatcucct

SEQ ID NO: 37449 - DNA, 23 bp, Artificial Sequence
  Synthetic
cctcacaccaaccutgtctctug

SEQ ID NO: 37450 - DNA, 22 bp, Artificial Sequence
  Synthetic
gggagtcuatttgtccuggaga

SEQ ID NO: 37451 - DNA, 20 bp, Artificial Sequence
  Synthetic
cctgtggacutgggacctug

SEQ ID NO: 37452 - DNA, 21 bp, Artificial Sequence
  Synthetic
tgagtcccaacuccaacucca

SEQ ID NO: 37453 - DNA, 21 bp, Artificial Sequence
  Synthetic
cattctctugactgccugcac

SEQ ID NO: 37454 - DNA, 18 bp, Artificial Sequence
  Synthetic
cuccccaacagccuccac

SEQ ID NO: 37455 - DNA, 18 bp, Artificial Sequence
  Synthetic
gggatgcucctccugacc

SEQ ID NO: 37456 - DNA, 20 bp, Artificial Sequence
  Synthetic
catcuggagacggaggcauc

SEQ ID NO: 37457 - DNA, 25 bp, Artificial Sequence
  Synthetic
tgtaugtgtgtgtcuaggacaggaa

SEQ ID NO: 37458 - DNA, 22 bp, Artificial Sequence
  Synthetic
gggtaaagaggaugaggctugg

SEQ ID NO: 37459 - DNA, 25 bp, Artificial Sequence
  Synthetic
ggtattgacagutttggaggtgaug

SEQ ID NO: 37460 - DNA, 23 bp, Artificial Sequence
  Synthetic
acccatatucccaggtctgucat

SEQ ID NO: 37461 - DNA, 21 bp, Artificial Sequence
  Synthetic
ttcaagattcccugggccauc

SEQ ID NO: 37462 - DNA, 25 bp, Artificial Sequence
  Synthetic
ccacatctcautctcttttgtcucc

SEQ ID NO: 37463 - DNA, 23 bp, Artificial Sequence
  Synthetic
cacctccaucctaagcaaugaca

SEQ ID NO: 37464 - DNA, 18 bp, Artificial Sequence
  Synthetic
gccagggagutggcagug

SEQ ID NO: 37465 - DNA, 24 bp, Artificial Sequence
  Synthetic
ctgggcccaugttttgtatactug

SEQ ID NO: 37466 - DNA, 17 bp, Artificial Sequence
  Synthetic
ccctgcucccacuccca

SEQ ID NO: 37467 - DNA, 25 bp, Artificial Sequence
  Synthetic
gtctctgacuctcttctctuaccca

SEQ ID NO: 37468 - DNA, 23 bp, Artificial Sequence
  Synthetic
gtcagccauctcatcuggaaaga

SEQ ID NO: 37469 - DNA, 21 bp, Artificial Sequence
  Synthetic
gccatgacuccttcctccugt

SEQ ID NO: 37470 - DNA, 21 bp, Artificial Sequence
  Synthetic
agccccuggtggtaucagaat

SEQ ID NO: 37471 - DNA, 26 bp, Artificial Sequence
  Synthetic
atcttccccaaaugtctggttcauag

SEQ ID NO: 37472 - DNA, 23 bp, Artificial Sequence
  Synthetic
ccctcaaatcuccaactaccugt

SEQ ID NO: 37473 - DNA, 25 bp, Artificial Sequence
  Synthetic
caggaactctcuctgcttttgtcua

SEQ ID NO: 37474 - DNA, 21 bp, Artificial Sequence
  Synthetic
cctgagaauggguagccagga

SEQ ID NO: 37475 - DNA, 21 bp, Artificial Sequence
  Synthetic
gtaagtugaccccgagctcug

SEQ ID NO: 37476 - DNA, 21 bp, Artificial Sequence
  Synthetic
gggaactcagcutccttccug

SEQ ID NO: 37477 - DNA, 23 bp, Artificial Sequence
  Synthetic
cttcccacuccttgactctgtut

SEQ ID NO: 37478 - DNA, 23 bp, Artificial Sequence
  Synthetic
ccuauagagggaagaggagtugt

SEQ ID NO: 37479 - DNA, 23 bp, Artificial Sequence
  Synthetic
ctcacccugggtaatgttctcuc

SEQ ID NO: 37480 - DNA, 23 bp, Artificial Sequence
  Synthetic
cctgcatcugtgctttcuggaat

SEQ ID NO: 37481 - DNA, 23 bp, Artificial Sequence
  Synthetic
cctcctctcacucctaactgcut

SEQ ID NO: 37482 - DNA, 23 bp, Artificial Sequence
  Synthetic
ggaguctggagacucaggagaat

SEQ ID NO: 37483 - DNA, 24 bp, Artificial Sequence
  Synthetic
gccctctcaccuctatctttcuca

SEQ ID NO: 37484 - DNA, 22 bp, Artificial Sequence
  Synthetic
gttggaaggaucaagcuccuaa

SEQ ID NO: 37485 - DNA, 23 bp, Artificial Sequence
  Synthetic
gaggccccuttataaatgccuct

SEQ ID NO: 37486 - DNA, 21 bp, Artificial Sequence
  Synthetic
cctttcagugcaagggucact

SEQ ID NO: 37487 - DNA, 22 bp, Artificial Sequence
  Synthetic
tgctgggautttgtctgtgucc

SEQ ID NO: 37488 - DNA, 27 bp, Artificial Sequence
  Synthetic
ctgaaacccttaauttcctgtatccut

SEQ ID NO: 37489 - DNA, 22 bp, Artificial Sequence
  Synthetic
gtgcctggucacctgtttcuag

SEQ ID NO: 37490 - DNA, 22 bp, Artificial Sequence
  Synthetic
gaaggcagcuagaaagguggag

SEQ ID NO: 37491 - DNA, 28 bp, Artificial Sequence
  Synthetic
actaaagggacacagutttatccatuca

SEQ ID NO: 37492 - DNA, 23 bp, Artificial Sequence
  Synthetic
ggtaaagctgcugtgccttcuag

SEQ ID NO: 37493 - DNA, 26 bp, Artificial Sequence
  Synthetic
cagtgaaagtaauggatgggcuaagt

SEQ ID NO: 37494 - DNA, 23 bp, Artificial Sequence
  Synthetic
ggaagccuggagaactaggucat

SEQ ID NO: 37495 - DNA, 24 bp, Artificial Sequence
  Synthetic
cttgttctgacacutcccttgtuc

SEQ ID NO: 37496 - DNA, 22 bp, Artificial Sequence
  Synthetic
gagacugagctggugaacagat

SEQ ID NO: 37497 - DNA, 23 bp, Artificial Sequence
  Synthetic
ggtguggatagttcuggaaaggg

SEQ ID NO: 37498 - DNA, 18 bp, Artificial Sequence
  Synthetic
cctgccgcacacucacuc

SEQ ID NO: 37499 - DNA, 22 bp, Artificial Sequence
  Synthetic
ggaccttcuctccttgaccuca

SEQ ID NO: 37500 - DNA, 24 bp, Artificial Sequence
  Synthetic
acaagccaccuaacaggaaatuac

SEQ ID NO: 37501 - DNA, 24 bp, Artificial Sequence
  Synthetic
tgacccctacucttttgttccuca

SEQ ID NO: 37502 - DNA, 24 bp, Artificial Sequence
  Synthetic
ggutaaaaaucagaggcgacagga

SEQ ID NO: 37503 - DNA, 22 bp, Artificial Sequence
  Synthetic
ggctacatgugtgtctcctuca

SEQ ID NO: 37504 - DNA, 24 bp, Artificial Sequence
  Synthetic
cctcacgauaatcatccccauagc

SEQ ID NO: 37505 - DNA, 22 bp, Artificial Sequence
  Synthetic
cagccctaacauccccatcuac

SEQ ID NO: 37506 - DNA, 24 bp, Artificial Sequence
  Synthetic
gaaggtgtccuaggagatgatugc

SEQ ID NO: 37507 - DNA, 22 bp, Artificial Sequence
  Synthetic
tcaccccacaccutccaatuac

SEQ ID NO: 37508 - DNA, 31 bp, Artificial Sequence
  Synthetic
tgaaaataaaaaggcugatgaatgaggacua

SEQ ID NO: 37509 - DNA, 22 bp, Artificial Sequence
  Synthetic
cagcagcaaccaucaagactuc

SEQ ID NO: 37510 - DNA, 22 bp, Artificial Sequence
  Synthetic
cagaagtcaaucctgcctcuga

SEQ ID NO: 37511 - DNA, 25 bp, Artificial Sequence
  Synthetic
ttcacttgaaccucttccaccatut

SEQ ID NO: 37512 - DNA, 20 bp, Artificial Sequence
  Synthetic
cctcggaagacuggcugaga

SEQ ID NO: 37513 - DNA, 24 bp, Artificial Sequence
  Synthetic
actctgtgtguatctctctcggut

SEQ ID NO: 37514 - DNA, 22 bp, Artificial Sequence
  Synthetic
ccaggcaucaggactcctctua

SEQ ID NO: 37515 - DNA, 23 bp, Artificial Sequence
  Synthetic
tcatagtctgcuccctgtctuct

SEQ ID NO: 37516 - DNA, 21 bp, Artificial Sequence
  Synthetic
gcctgtacugccccattuaca

SEQ ID NO: 37517 - DNA, 26 bp, Artificial Sequence
  Synthetic
gctgatgtgaugtgctttctctuaca

SEQ ID NO: 37518 - DNA, 22 bp, Artificial Sequence
  Synthetic
ccagcugtgagaauccagacat

SEQ ID NO: 37519 - DNA, 29 bp, Artificial Sequence
  Synthetic
gtgttcacagtguggtttgatttacauag

SEQ ID NO: 37520 - DNA, 22 bp, Artificial Sequence
  Synthetic
gggaggaagauccatcccauct

SEQ ID NO: 37521 - DNA, 23 bp, Artificial Sequence
  Synthetic
ttgacaatcguctccttctugca

SEQ ID NO: 37522 - DNA, 18 bp, Artificial Sequence
  Synthetic
tcggctuccacctggtug

SEQ ID NO: 37523 - DNA, 20 bp, Artificial Sequence
  Synthetic
gcgattcucccagatugcct

SEQ ID NO: 37524 - DNA, 19 bp, Artificial Sequence
  Synthetic
acaggtugagctccuccgt

SEQ ID NO: 37525 - DNA, 22 bp, Artificial Sequence
  Synthetic
cccatcuccagctgtctgttuc

SEQ ID NO: 37526 - DNA, 22 bp, Artificial Sequence
  Synthetic
tgaactcgauctgcagcatguc

SEQ ID NO: 37527 - DNA, 21 bp, Artificial Sequence
  Synthetic
tgaagccguacctggctauct

SEQ ID NO: 37528 - DNA, 23 bp, Artificial Sequence
  Synthetic
cccuatcaatgagtugggcacaa

SEQ ID NO: 37529 - DNA, 21 bp, Artificial Sequence
  Synthetic
gactacactuggcaagcaugg

SEQ ID NO: 37530 - DNA, 20 bp, Artificial Sequence
  Synthetic
tggaaccuagcgtccagcua

SEQ ID NO: 37531 - DNA, 19 bp, Artificial Sequence
  Synthetic
catagcgguagtcgcgcut

SEQ ID NO: 37532 - DNA, 23 bp, Artificial Sequence
  Synthetic
gggtgatgugaatattgtuggca

SEQ ID NO: 37533 - DNA, 22 bp, Artificial Sequence
  Synthetic
ctctctttuaggccctccucct

SEQ ID NO: 37534 - DNA, 21 bp, Artificial Sequence
  Synthetic
gggtttugggctaaccaucat

SEQ ID NO: 37535 - DNA, 24 bp, Artificial Sequence
  Synthetic
tggcctccagguaatggactatua

SEQ ID NO: 37536 - DNA, 22 bp, Artificial Sequence
  Synthetic
tggcgagaagaacauggactug

SEQ ID NO: 37537 - DNA, 22 bp, Artificial Sequence
  Synthetic
gtgggccuttcagaatcuggaa

SEQ ID NO: 37538 - DNA, 22 bp, Artificial Sequence
  Synthetic
aacttcccugatcacagtugct

SEQ ID NO: 37539 - DNA, 23 bp, Artificial Sequence
  Synthetic
caagagcagutgctcagauacca

SEQ ID NO: 37540 - DNA, 22 bp, Artificial Sequence
  Synthetic
gacaatguggcggctaacttuc

SEQ ID NO: 37541 - DNA, 30 bp, Artificial Sequence
  Synthetic
gtcagaaatgcuaagtatgcaaaatgtgua

SEQ ID NO: 37542 - DNA, 26 bp, Artificial Sequence
  Synthetic
acttctgctuttgcttctttuaagcc

SEQ ID NO: 37543 - DNA, 20 bp, Artificial Sequence
  Synthetic
aucttctttuccccgccaca

SEQ ID NO: 37544 - DNA, 24 bp, Artificial Sequence
  Synthetic
cagttugacccagagaucaagact

SEQ ID NO: 37545 - DNA, 25 bp, Artificial Sequence
  Synthetic
tcctttattguccaaatgtcugcct

SEQ ID NO: 37546 - DNA, 27 bp, Artificial Sequence
  Synthetic
cacactctaaaagauaggctgaaugct

SEQ ID NO: 37547 - DNA, 29 bp, Artificial Sequence
  Synthetic
ttgatatatatucggccctatgcacttuc

SEQ ID NO: 37548 - DNA, 29 bp, Artificial Sequence
  Synthetic
tcagtgtaaguagattgacattugcaaca

SEQ ID NO: 37549 - DNA, 23 bp, Artificial Sequence
  Synthetic
catcgagucatcactgcucaaca

SEQ ID NO: 37550 - DNA, 26 bp, Artificial Sequence
  Synthetic
gccctatgugagttcatttccaucat

SEQ ID NO: 37551 - DNA, 31 bp, Artificial Sequence
  Synthetic
gctgggaaataguaatactcgaaagacuaac

SEQ ID NO: 37552 - DNA, 27 bp, Artificial Sequence
  Synthetic
catgaugttgaaatagtuggcaccaat

SEQ ID NO: 37553 - DNA, 22 bp, Artificial Sequence
  Synthetic
aggcaaaucaccaaagtcugct

SEQ ID NO: 37554 - DNA, 28 bp, Artificial Sequence
  Synthetic
aactggatauaacttctgaatugcccaa

SEQ ID NO: 37555 - DNA, 29 bp, Artificial Sequence
  Synthetic
tgatggcaagagugatggattacaaauaa

SEQ ID NO: 37556 - DNA, 29 bp, Artificial Sequence
  Synthetic
cctcattaatcttucaaagttcagctucc

SEQ ID NO: 37557 - DNA, 23 bp, Artificial Sequence
  Synthetic
tttggaugcaatguggaaagcat

SEQ ID NO: 37558 - DNA, 26 bp, Artificial Sequence
  Synthetic
gtttaggguttgaagaatugccaagt

SEQ ID NO: 37559 - DNA, 27 bp, Artificial Sequence
  Synthetic
caaatgcagagaacaguggaattaugc

SEQ ID NO: 37560 - DNA, 24 bp, Artificial Sequence
  Synthetic
tgcatggaugtatgaaauggcact

SEQ ID NO: 37561 - DNA, 25 bp, Artificial Sequence
  Synthetic
ccaagaggaggucgaattggtatuc

SEQ ID NO: 37562 - DNA, 25 bp, Artificial Sequence
  Synthetic
tgaattccuaagcacaatcugcact

SEQ ID NO: 37563 - DNA, 23 bp, Artificial Sequence
  Synthetic
agaatctctggcutcttggctut

SEQ ID NO: 37564 - DNA, 22 bp, Artificial Sequence
  Synthetic
agtctcuctgatccugccacaa

SEQ ID NO: 37565 - DNA, 28 bp, Artificial Sequence
  Synthetic
gccagtcauggagtacttttaaaugaca

SEQ ID NO: 37566 - DNA, 27 bp, Artificial Sequence
  Synthetic
gaaaattctcacagutgggatttcugg

SEQ ID NO: 37567 - DNA, 28 bp, Artificial Sequence
  Synthetic
ccgaaatatacaaautcagcctgacgua

SEQ ID NO: 37568 - DNA, 25 bp, Artificial Sequence
  Synthetic
ggtcttccuagctcattcactuacc

SEQ ID NO: 37569 - DNA, 25 bp, Artificial Sequence
  Synthetic
ccaatgccautgttatgctgtuaca

SEQ ID NO: 37570 - DNA, 28 bp, Artificial Sequence
  Synthetic
guatttctctaucagacacaagcacaca

SEQ ID NO: 37571 - DNA, 28 bp, Artificial Sequence
  Synthetic
atccctuagaaaaggaacaaaagctuct

SEQ ID NO: 37572 - DNA, 28 bp, Artificial Sequence
  Synthetic
ttccaaactcuttactgtgttguacaat

SEQ ID NO: 37573 - DNA, 26 bp, Artificial Sequence
  Synthetic
cctgaatcagcuttaaaatgguccct

SEQ ID NO: 37574 - DNA, 26 bp, Artificial Sequence
  Synthetic
acctgcctguttattaacagtaugac

SEQ ID NO: 37575 - DNA, 25 bp, Artificial Sequence
  Synthetic
atgcaagttguggcttttggtatut

SEQ ID NO: 37576 - DNA, 22 bp, Artificial Sequence
  Synthetic
ggttcugacctggtgauggaag

SEQ ID NO: 37577 - DNA, 29 bp, Artificial Sequence
  Synthetic
ggttccttactaaaugagcactattgugt

SEQ ID NO: 37578 - DNA, 21 bp, Artificial Sequence
  Synthetic
agccacgagggutagacaaug

SEQ ID NO: 37579 - DNA, 31 bp, Artificial Sequence
  Synthetic
aggaatgtattggautcagaatgagcaaaua

SEQ ID NO: 37580 - DNA, 23 bp, Artificial Sequence
  Synthetic
cgaccaaagcutgaatugaccaa

SEQ ID NO: 37581 - DNA, 30 bp, Artificial Sequence
  Synthetic
gccattgtgtaauaatctttctgtttucca

SEQ ID NO: 37582 - DNA, 24 bp, Artificial Sequence
  Synthetic
ggcccagcacaugtaattttgtug

SEQ ID NO: 37583 - DNA, 29 bp, Artificial Sequence
  Synthetic
gacctttgctguaacatgctgtatttuat

SEQ ID NO: 37584 - DNA, 30 bp, Artificial Sequence
  Synthetic
tgtgaaatcauaagacagccaaaacauaga

SEQ ID NO: 37585 - DNA, 28 bp, Artificial Sequence
  Synthetic
tctttcttuccagcaaccttatcauaca

SEQ ID NO: 37586 - DNA, 27 bp, Artificial Sequence
  Synthetic
aaacttaagagaccuaacatttugcca

SEQ ID NO: 37587 - DNA, 27 bp, Artificial Sequence
  Synthetic
agcatctctugttttcctaagugacat

SEQ ID NO: 37588 - DNA, 27 bp, Artificial Sequence
  Synthetic
ccctcaaaucccacatatcatctauca

SEQ ID NO: 37589 - DNA, 22 bp, Artificial Sequence
  Synthetic
ggagtgcaguttcaagtctugg

SEQ ID NO: 37590 - DNA, 27 bp, Artificial Sequence
  Synthetic
gcucattagacttuccaacaaaacact

SEQ ID NO: 37591 - DNA, 29 bp, Artificial Sequence
  Synthetic
gatgtcctcagtuctatcatcctctttut

SEQ ID NO: 37592 - DNA, 25 bp, Artificial Sequence
  Synthetic
acagtttccacagugacaatctcut

SEQ ID NO: 37593 - DNA, 22 bp, Artificial Sequence
  Synthetic
acttttccucgggctgcttuag

SEQ ID NO: 37594 - DNA, 22 bp, Artificial Sequence
  Synthetic
cagccaggaacutgactccaua

SEQ ID NO: 37595 - DNA, 28 bp, Artificial Sequence
  Synthetic
gactgacaatttuccctttgtccatuag

SEQ ID NO: 37596 - DNA, 27 bp, Artificial Sequence
  Synthetic
cagtaagttgaggaugcttgtgtuagt

SEQ ID NO: 37597 - DNA, 22 bp, Artificial Sequence
  Synthetic
ccaacccagcuctctgtttucc

SEQ ID NO: 37598 - DNA, 26 bp, Artificial Sequence
  Synthetic
ctcagtaatcutgacggtaatuggct

SEQ ID NO: 37599 - DNA, 28 bp, Artificial Sequence
  Synthetic
catutcattaagattgaugacaccccat

SEQ ID NO: 37600 - DNA, 22 bp, Artificial Sequence
  Synthetic
ccaaugatcuggcacaaagagg

SEQ ID NO: 37601 - DNA, 26 bp, Artificial Sequence
  Synthetic
tggttctttccuaatggtgactgtut

SEQ ID NO: 37602 - DNA, 22 bp, Artificial Sequence
  Synthetic
ctgtagcatuagccaggacucg

SEQ ID NO: 37603 - DNA, 25 bp, Artificial Sequence
  Synthetic
agaatgggtagugaggaagcaaaug

SEQ ID NO: 37604 - DNA, 22 bp, Artificial Sequence
  Synthetic
ccacacagggugacattccuat

SEQ ID NO: 37605 - DNA, 22 bp, Artificial Sequence
  Synthetic
ctgttgcccuggaaauagaggt

SEQ ID NO: 37606 - DNA, 22 bp, Artificial Sequence
  Synthetic
ggcttccaccaugtaagcugaa

SEQ ID NO: 37607 - DNA, 27 bp, Artificial Sequence
  Synthetic
gatgatcaactuccttgcaatguaact

SEQ ID NO: 37608 - DNA, 20 bp, Artificial Sequence
  Synthetic
caattccccugacacucgct

SEQ ID NO: 37609 - DNA, 23 bp, Artificial Sequence
  Synthetic
gtgggaccauacttactgugagg

SEQ ID NO: 37610 - DNA, 22 bp, Artificial Sequence
  Synthetic
ccagactgugaagagggaugga

SEQ ID NO: 37611 - DNA, 25 bp, Artificial Sequence
  Synthetic
ggaaaggctucaccttcatgtauga

SEQ ID NO: 37612 - DNA, 21 bp, Artificial Sequence
  Synthetic
agggttucacaccagatgcuc

SEQ ID NO: 37613 - DNA, 24 bp, Artificial Sequence
  Synthetic
ccctaccutccacttaatugacct

SEQ ID NO: 37614 - DNA, 24 bp, Artificial Sequence
  Synthetic
cctagctgaaugctagaccaucaa

SEQ ID NO: 37615 - DNA, 23 bp, Artificial Sequence
  Synthetic
cgaggcugatgaactauacggat

SEQ ID NO: 37616 - DNA, 24 bp, Artificial Sequence
  Synthetic
tttcagaggacautgattgcccut

SEQ ID NO: 37617 - DNA, 25 bp, Artificial Sequence
  Synthetic
gactattcugcagttctucccagag

SEQ ID NO: 37618 - DNA, 27 bp, Artificial Sequence
  Synthetic
gttatattaacaguggtcacucaccca

SEQ ID NO: 37619 - DNA, 28 bp, Artificial Sequence
  Synthetic
ggtgatcccatutgaatatgctgtttut

SEQ ID NO: 37620 - DNA, 25 bp, Artificial Sequence
  Synthetic
gacagactacautggtctggttuga

SEQ ID NO: 37621 - DNA, 28 bp, Artificial Sequence
  Synthetic
aggaacatttgaugatagtgagagguct

SEQ ID NO: 37622 - DNA, 27 bp, Artificial Sequence
  Synthetic
catgttacaaaucagtgaggagugagt

SEQ ID NO: 37623 - DNA, 30 bp, Artificial Sequence
  Synthetic
acagaatttaccagaaaugtaaccatcuca

SEQ ID NO: 37624 - DNA, 23 bp, Artificial Sequence
  Synthetic
acagtgaagucactggcatugag

SEQ ID NO: 37625 - DNA, 26 bp, Artificial Sequence
  Synthetic
tccttgaggaugaaactctguaaggt

SEQ ID NO: 37626 - DNA, 22 bp, Artificial Sequence
  Synthetic
ctcaaggucaacaagcautcut

SEQ ID NO: 37627 - DNA, 30 bp, Artificial Sequence
  Synthetic
acttgatagtaatuggatcactggtctcua

SEQ ID NO: 37628 - DNA, 20 bp, Artificial Sequence
  Synthetic
cauagaacaggcccgtcucc

SEQ ID NO: 37629 - DNA, 22 bp, Artificial Sequence
  Synthetic
ggtugggaacaagggctcuaac

SEQ ID NO: 37630 - DNA, 25 bp, Artificial Sequence
  Synthetic
agagagcaauaccaataccuaccca

SEQ ID NO: 37631 - DNA, 29 bp, Artificial Sequence
  Synthetic
gcctttctatttuatctgaactgcaucca

SEQ ID NO: 37632 - DNA, 22 bp, Artificial Sequence
  Synthetic
cauaaagaccauccccagtuct

SEQ ID NO: 37633 - DNA, 29 bp, Artificial Sequence
  Synthetic
ccatcatttagtcutgtctgtcttgacut

SEQ ID NO: 37634 - DNA, 21 bp, Artificial Sequence
  Synthetic
gggctatcccaugatgctcug

SEQ ID NO: 37635 - DNA, 27 bp, Artificial Sequence
  Synthetic
cacttagtgtutgagaaagagaugcct

SEQ ID NO: 37636 - DNA, 25 bp, Artificial Sequence
  Synthetic
cctaggtuagcaaaggtgctttuga

SEQ ID NO: 37637 - DNA, 29 bp, Artificial Sequence
  Synthetic
cctgtaatgtttaugcgatctacatguct

SEQ ID NO: 37638 - DNA, 22 bp, Artificial Sequence
  Synthetic
catcccucatgccauacagaca

SEQ ID NO: 37639 - DNA, 30 bp, Artificial Sequence
  Synthetic
actcttgcagaaauattatctgtgttucca

SEQ ID NO: 37640 - DNA, 29 bp, Artificial Sequence
  Synthetic
agaaagtaagcaagaugagagagauaggt

SEQ ID NO: 37641 - DNA, 22 bp, Artificial Sequence
  Synthetic
cccagaagacucgtgcagatuc

SEQ ID NO: 37642 - DNA, 27 bp, Artificial Sequence
  Synthetic
gagaaagagagagaaugtgtgtgtgut

SEQ ID NO: 37643 - DNA, 30 bp, Artificial Sequence
  Synthetic
ggagtattgcacaautatctcttgtcttut

SEQ ID NO: 37644 - DNA, 24 bp, Artificial Sequence
  Synthetic
tcccactcauaaaaaccacucacc

SEQ ID NO: 37645 - DNA, 29 bp, Artificial Sequence
  Synthetic
acatgctcactugtggtactattttcuaa

SEQ ID NO: 37646 - DNA, 24 bp, Artificial Sequence
  Synthetic
agcaaaaatcccucatcctgtcug

SEQ ID NO: 37647 - DNA, 27 bp, Artificial Sequence
  Synthetic
gcctgagatttcuttcccttgtgtuag

SEQ ID NO: 37648 - DNA, 30 bp, Artificial Sequence
  Synthetic
tctcaaggtaaccuattgtgttcttaccua

SEQ ID NO: 37649 - DNA, 27 bp, Artificial Sequence
  Synthetic
tgctccaaucaaaactgaaaatgctut

SEQ ID NO: 37650 - DNA, 22 bp, Artificial Sequence
  Synthetic
gcggugagtttttcugagagga

SEQ ID NO: 37651 - DNA, 26 bp, Artificial Sequence
  Synthetic
tcttggttttcuttttcttgctucgg

SEQ ID NO: 37652 - DNA, 20 bp, Artificial Sequence
  Synthetic
tcuagagccaagacgccuct

SEQ ID NO: 37653 - DNA, 22 bp, Artificial Sequence
  Synthetic
aggataaggugtcccagctuca

SEQ ID NO: 37654 - DNA, 24 bp, Artificial Sequence
  Synthetic
acaacgcuaaacagaaagagcuga

SEQ ID NO: 37655 - DNA, 27 bp, Artificial Sequence
  Synthetic
cctcttgcttugccaaacatttatcut

SEQ ID NO: 37656 - DNA, 27 bp, Artificial Sequence
  Synthetic
caagatgtgaagauggcacatttuagt

SEQ ID NO: 37657 - DNA, 22 bp, Artificial Sequence
  Synthetic
ccacagccautcgtcccaaaua

SEQ ID NO: 37658 - DNA, 22 bp, Artificial Sequence
  Synthetic
gcatattucttgcccucaagca

SEQ ID NO: 37659 - DNA, 27 bp, Artificial Sequence
  Synthetic
cctcatcttcaugagcttcactttcuc

SEQ ID NO: 37660 - DNA, 24 bp, Artificial Sequence
  Synthetic
caggaagaccaugggtgaagtuac

SEQ ID NO: 37661 - DNA, 28 bp, Artificial Sequence
  Synthetic
cttcctctucaccaaactgataaaaucc

SEQ ID NO: 37662 - DNA, 27 bp, Artificial Sequence
  Synthetic
ggtccccatuagactactaaatctugc

SEQ ID NO: 37663 - DNA, 28 bp, Artificial Sequence
  Synthetic
tgtttgtgtgtcugtgtgtgataauagt

SEQ ID NO: 37664 - DNA, 28 bp, Artificial Sequence
  Synthetic
acagaagggtcaguttttctgagaaaut

SEQ ID NO: 37665 - DNA, 27 bp, Artificial Sequence
  Synthetic
tccacactaggaucatccatttctgua

SEQ ID NO: 37666 - DNA, 28 bp, Artificial Sequence
  Synthetic
tgaggaagaugaagatgaggaagaugat

SEQ ID NO: 37667 - DNA, 29 bp, Artificial Sequence
  Synthetic
gcttgatttucaagattgagatttugcag

SEQ ID NO: 37668 - DNA, 19 bp, Artificial Sequence
  Synthetic
cgaccctucgcctaaccuc

SEQ ID NO: 37669 - DNA, 24 bp, Artificial Sequence
  Synthetic
ggttgtccucgctttccaaauact

SEQ ID NO: 37670 - DNA, 27 bp, Artificial Sequence
  Synthetic
gtttcttctgcuagcaatacagcuaca

SEQ ID NO: 37671 - DNA, 29 bp, Artificial Sequence
  Synthetic
gaaaagtcattuactccaatgcttucagt

SEQ ID NO: 37672 - DNA, 25 bp, Artificial Sequence
  Synthetic
tggacagtttugttgccaatttugt

SEQ ID NO: 37673 - DNA, 28 bp, Artificial Sequence
  Synthetic
agttcttctagacautttgccccuaaaa

SEQ ID NO: 37674 - DNA, 33 bp, Artificial Sequence
  Synthetic
ggatgcctaaaauaactattaaagtctatguct

SEQ ID NO: 37675 - DNA, 28 bp, Artificial Sequence
  Synthetic
acgctgcacugaatctctttctataaut

SEQ ID NO: 37676 - DNA, 24 bp, Artificial Sequence
  Synthetic
tttaacttagcutcaggcaccugt

SEQ ID NO: 37677 - DNA, 22 bp, Artificial Sequence
  Synthetic
ggguaaataucaaggccgagca

SEQ ID NO: 37678 - DNA, 22 bp, Artificial Sequence
  Synthetic
ggaatucccacagacacgcaua

SEQ ID NO: 37679 - DNA, 27 bp, Artificial Sequence
  Synthetic
cctaccucacagcaacaattcttatug

SEQ ID NO: 37680 - DNA, 29 bp, Artificial Sequence
  Synthetic
gtggctgttaacaucttaaagacttucaa

SEQ ID NO: 37681 - DNA, 22 bp, Artificial Sequence
  Synthetic
gcttttugcacccacctucaac

SEQ ID NO: 37682 - DNA, 28 bp, Artificial Sequence
  Synthetic
cgagatgagugaagaacttatggaacuc

SEQ ID NO: 37683 - DNA, 27 bp, Artificial Sequence
  Synthetic
gatggtccctatuatcactgtgaccua

SEQ ID NO: 37684 - DNA, 27 bp, Artificial Sequence
  Synthetic
ggcatttaaguccaaaactctggaaut

SEQ ID NO: 37685 - DNA, 27 bp, Artificial Sequence
  Synthetic
attcaccccttucatttaacagccuat

SEQ ID NO: 37686 - DNA, 23 bp, Artificial Sequence
  Synthetic
ttgcutacagggtuggaaaccat

SEQ ID NO: 37687 - DNA, 28 bp, Artificial Sequence
  Synthetic
ttgccatgaccuaagcttaactactuac

SEQ ID NO: 37688 - DNA, 29 bp, Artificial Sequence
  Synthetic
caatcctgaucacgctttagtttaucaaa

SEQ ID NO: 37689 - DNA, 26 bp, Artificial Sequence
  Synthetic
cctaccttugggtcaaaatugacaca

SEQ ID NO: 37690 - DNA, 21 bp, Artificial Sequence
  Synthetic
gctatugacgagcagcugaca

SEQ ID NO: 37691 - DNA, 20 bp, Artificial Sequence
  Synthetic
gtgctctcucctgggaggua

SEQ ID NO: 37692 - DNA, 30 bp, Artificial Sequence
  Synthetic
caatgcagtctcutcttttacaaactatut

SEQ ID NO: 37693 - DNA, 27 bp, Artificial Sequence
  Synthetic
accacaatgucgtcaatgaattcuaca

SEQ ID NO: 37694 - DNA, 24 bp, Artificial Sequence
  Synthetic
tgatcttgtugcctcctgagatug

SEQ ID NO: 37695 - DNA, 28 bp, Artificial Sequence
  Synthetic
ccatacucagccacaatttgttttugaa

SEQ ID NO: 37696 - DNA, 26 bp, Artificial Sequence
  Synthetic
agtggtgaatgucatcaacaaaguct

SEQ ID NO: 37697 - DNA, 30 bp, Artificial Sequence
  Synthetic
cactacattaaatgcuaagggttttcctug

SEQ ID NO: 37698 - DNA, 29 bp, Artificial Sequence
  Synthetic
ttgaggacttuagagtgtttgatagtugg

SEQ ID NO: 37699 - DNA, 28 bp, Artificial Sequence
  Synthetic
catgaaactggcaacautaatacgctua

SEQ ID NO: 37700 - DNA, 23 bp, Artificial Sequence
  Synthetic
acagatuccggactucagagaga

SEQ ID NO: 37701 - DNA, 31 bp, Artificial Sequence
  Synthetic
tggtaattatgattatutcacctctgcacut

SEQ ID NO: 37702 - DNA, 31 bp, Artificial Sequence
  Synthetic
gctagtuaccaagtttttgtttuaagaaagg

SEQ ID NO: 37703 - DNA, 26 bp, Artificial Sequence
  Synthetic
cgctgtgtauggattttctgcatuaa

SEQ ID NO: 37704 - DNA, 30 bp, Artificial Sequence
  Synthetic
aaaatcaaagatugaaatgtcgagauaacc

SEQ ID NO: 37705 - DNA, 26 bp, Artificial Sequence
  Synthetic
gagccactucaaaaagacgaguagat

SEQ ID NO: 37706 - DNA, 30 bp, Artificial Sequence
  Synthetic
agtttatatatttugctgcagagactugct

SEQ ID NO: 37707 - DNA, 28 bp, Artificial Sequence
  Synthetic
gtggtgcugagaaagataaattgttgua

SEQ ID NO: 37708 - DNA, 23 bp, Artificial Sequence
  Synthetic
cacagutaaggacaugacagcct

SEQ ID NO: 37709 - DNA, 25 bp, Artificial Sequence
  Synthetic
cacttcauctcagatgaugcaaacc

SEQ ID NO: 37710 - DNA, 22 bp, Artificial Sequence
  Synthetic
gaaatcagucagaccugggcaa

SEQ ID NO: 37711 - DNA, 29 bp, Artificial Sequence
  Synthetic
tgtaaacatacaucaaaacatcacauggt

SEQ ID NO: 37712 - DNA, 24 bp, Artificial Sequence
  Synthetic
gagcaagugttaagcuggcaaaat

SEQ ID NO: 37713 - DNA, 24 bp, Artificial Sequence
  Synthetic
gcatacagccugtcttugacaaac

SEQ ID NO: 37714 - DNA, 27 bp, Artificial Sequence
  Synthetic
ccgaagutttaatgacugaagggacaa

SEQ ID NO: 37715 - DNA, 31 bp, Artificial Sequence
  Synthetic
cagctaacacaguataatacgagacttucaa

SEQ ID NO: 37716 - DNA, 25 bp, Artificial Sequence
  Synthetic
gaagacaaucaggatgtttcugcac

SEQ ID NO: 37717 - DNA, 27 bp, Artificial Sequence
  Synthetic
ttgcttgttgaacucaaccttcuaaga

SEQ ID NO: 37718 - DNA, 21 bp, Artificial Sequence
  Synthetic
ccauagtggccuacgaggaaa

SEQ ID NO: 37719 - DNA, 31 bp, Artificial Sequence
  Synthetic
cttgaagttccuttatgtctcaaaaucacaa

SEQ ID NO: 37720 - DNA, 25 bp, Artificial Sequence
  Synthetic
ctggagauagacagaagaucaugac

SEQ ID NO: 37721 - DNA, 27 bp, Artificial Sequence
  Synthetic
aaacaacgacttucttggaactacuct

SEQ ID NO: 37722 - DNA, 28 bp, Artificial Sequence
  Synthetic
gactgtgatguttgtgttttctatugct

SEQ ID NO: 37723 - DNA, 30 bp, Artificial Sequence
  Synthetic
ctaacttactttguagtccatttgctcuga

SEQ ID NO: 37724 - DNA, 23 bp, Artificial Sequence
  Synthetic
gcattttgcaguggtttgcatut

SEQ ID NO: 37725 - DNA, 25 bp, Artificial Sequence
  Synthetic
gctaagccacaaagcauaacactug

SEQ ID NO: 37726 - DNA, 31 bp, Artificial Sequence
  Synthetic
gaactccttctuaaaaactttcagctctuac

SEQ ID NO: 37727 - DNA, 28 bp, Artificial Sequence
  Synthetic
gccagctacucactcaacaaaatcauat

SEQ ID NO: 37728 - DNA, 22 bp, Artificial Sequence
  Synthetic
tgacgacaucccagtgtttcug

SEQ ID NO: 37729 - DNA, 29 bp, Artificial Sequence
  Synthetic
caattagccacaautatttccacugacaa

SEQ ID NO: 37730 - DNA, 31 bp, Artificial Sequence
  Synthetic
ggaacatataatgaauacggaaaactctuca

SEQ ID NO: 37731 - DNA, 26 bp, Artificial Sequence
  Synthetic
tgttgtcacagcuttagggttuaagt

SEQ ID NO: 37732 - DNA, 26 bp, Artificial Sequence
  Synthetic
aggtctcttcucatccattcuacgag

SEQ ID NO: 37733 - DNA, 29 bp, Artificial Sequence
  Synthetic
gaatcgaactctuaatacactcaggaugt

SEQ ID NO: 37734 - DNA, 22 bp, Artificial Sequence
  Synthetic
tcactccctucatgaggctuct

SEQ ID NO: 37735 - DNA, 25 bp, Artificial Sequence
  Synthetic
ctgtgcaacaacaugaatgtgctua

SEQ ID NO: 37736 - DNA, 28 bp, Artificial Sequence
  Synthetic
atgtactctcutaaggataaaguggagt

SEQ ID NO: 37737 - DNA, 27 bp, Artificial Sequence
  Synthetic
tcataaacttcutttgggctgucagaa

SEQ ID NO: 37738 - DNA, 28 bp, Artificial Sequence
  Synthetic
aggtttctaccccuatgatattgtuact

SEQ ID NO: 37739 - DNA, 21 bp, Artificial Sequence
  Synthetic
cctgcgacggaaauttcacug

SEQ ID NO: 37740 - DNA, 24 bp, Artificial Sequence
  Synthetic
acgcactcuctctctctttcugat

SEQ ID NO: 37741 - DNA, 24 bp, Artificial Sequence
  Synthetic
caaagactgttuttcccactccug

SEQ ID NO: 37742 - DNA, 24 bp, Artificial Sequence
  Synthetic
guggatgaaaucgacagaagaagt

SEQ ID NO: 37743 - DNA, 31 bp, Artificial Sequence
  Synthetic
gcatgttcatgucgtcgataaaataaaucaa

SEQ ID NO: 37744 - DNA, 24 bp, Artificial Sequence
  Synthetic
taaggagguaatctgcgaugaaga

SEQ ID NO: 37745 - DNA, 26 bp, Artificial Sequence
  Synthetic
tttgagagcaguattcaacacccuac

SEQ ID NO: 37746 - DNA, 24 bp, Artificial Sequence
  Synthetic
gcacuaaacaccatctauggccaa

SEQ ID NO: 37747 - DNA, 25 bp, Artificial Sequence
  Synthetic
ggcataacauagagcagtcaaggua

SEQ ID NO: 37748 - DNA, 21 bp, Artificial Sequence
  Synthetic
gtgtgggtcugcaagctttuc

SEQ ID NO: 37749 - DNA, 25 bp, Artificial Sequence
  Synthetic
tgtaatgtggguccttccctctauc

SEQ ID NO: 37750 - DNA, 20 bp, Artificial Sequence
  Synthetic
gccataaugggcgcttccut

SEQ ID NO: 37751 - DNA, 21 bp, Artificial Sequence
  Synthetic
gaagggucagaagaacugcct

SEQ ID NO: 37752 - DNA, 28 bp, Artificial Sequence
  Synthetic
gctgaactttgucttgtaaaacattuca

SEQ ID NO: 37753 - DNA, 28 bp, Artificial Sequence
  Synthetic
ccagagcaugaacttcattatgaatucc

SEQ ID NO: 37754 - DNA, 20 bp, Artificial Sequence
  Synthetic
tcattcaucacccgcctgut

SEQ ID NO: 37755 - DNA, 18 bp, Artificial Sequence
  Synthetic
caggcugacacggcauac

SEQ ID NO: 37756 - DNA, 26 bp, Artificial Sequence
  Synthetic
ccaccccaaagagutttcuagaacaa

SEQ ID NO: 37757 - DNA, 30 bp, Artificial Sequence
  Synthetic
agaaatggatutagtagtgctucaaaagga

SEQ ID NO: 37758 - DNA, 27 bp, Artificial Sequence
  Synthetic
catctgagtcaaccuccatttttctut

SEQ ID NO: 37759 - DNA, 30 bp, Artificial Sequence
  Synthetic
gaggaaacucagggaucaataaattatcut

SEQ ID NO: 37760 - DNA, 27 bp, Artificial Sequence
  Synthetic
ttttgtaatgtgagucctaaaagcuga

SEQ ID NO: 37761 - DNA, 27 bp, Artificial Sequence
  Synthetic
accacttttagacagutctctggaaug

SEQ ID NO: 37762 - DNA, 26 bp, Artificial Sequence
  Synthetic
tgtaaagcauccatcctatcugggat

SEQ ID NO: 37763 - DNA, 27 bp, Artificial Sequence
  Synthetic
ccttttcaatgucatagtttgcacuca

SEQ ID NO: 37764 - DNA, 24 bp, Artificial Sequence
  Synthetic
cggcutcattugaaaaagcaacag

SEQ ID NO: 37765 - DNA, 24 bp, Artificial Sequence
  Synthetic
aaaatccccacaagcugatcugaa

SEQ ID NO: 37766 - DNA, 28 bp, Artificial Sequence
  Synthetic
aatccattaagucctttgaagcucaaga

SEQ ID NO: 37767 - DNA, 25 bp, Artificial Sequence
  Synthetic
gctgacaagguaaggaactgaacut

SEQ ID NO: 37768 - DNA, 25 bp, Artificial Sequence
  Synthetic
gatatccatgutgacggatgaugct

SEQ ID NO: 37769 - DNA, 26 bp, Artificial Sequence
  Synthetic
agccagtctcutcaaacttcacauac

SEQ ID NO: 37770 - DNA, 26 bp, Artificial Sequence
  Synthetic
tggccaagguccattataagaauaca

SEQ ID NO: 37771 - DNA, 26 bp, Artificial Sequence
  Synthetic
tgaggattugccaattttgtgugaag

SEQ ID NO: 37772 - DNA, 26 bp, Artificial Sequence
  Synthetic
gtacttaaccaccauttcccacacut

SEQ ID NO: 37773 - DNA, 24 bp, Artificial Sequence
  Synthetic
gcctccaatcuctctaccagttug

SEQ ID NO: 37774 - DNA, 29 bp, Artificial Sequence
  Synthetic
ctcataatttttcauttcaggtacgucct

SEQ ID NO: 37775 - DNA, 21 bp, Artificial Sequence
  Synthetic
cttgctgccacuggtctguaa

SEQ ID NO: 37776 - DNA, 24 bp, Artificial Sequence
  Synthetic
aaccttaaactgutgccctgtgua

SEQ ID NO: 37777 - DNA, 22 bp, Artificial Sequence
  Synthetic
catgggtgaugctctccaucag

SEQ ID NO: 37778 - DNA, 22 bp, Artificial Sequence
  Synthetic
ttctgcctacucagtcatguct

SEQ ID NO: 37779 - DNA, 24 bp, Artificial Sequence
  Synthetic
gtgtgtucaactgtgaaucgaagc

SEQ ID NO: 37780 - DNA, 27 bp, Artificial Sequence
  Synthetic
actgtaaagtaucgttcacaccatucc

SEQ ID NO: 37781 - DNA, 31 bp, Artificial Sequence
  Synthetic
tcagcttctgtautaaacttttcttctucca

SEQ ID NO: 37782 - DNA, 22 bp, Artificial Sequence
  Synthetic
tacttctatcgugtgcctgugt

SEQ ID NO: 37783 - DNA, 29 bp, Artificial Sequence
  Synthetic
cttcgaatgcttuaactaagtccaatcug

SEQ ID NO: 37784 - DNA, 22 bp, Artificial Sequence
  Synthetic
acagaatuccaggctcctcuca

SEQ ID NO: 37785 - DNA, 28 bp, Artificial Sequence
  Synthetic
agtgtcttcccugaaacttaatacucac

SEQ ID NO: 37786 - DNA, 26 bp, Artificial Sequence
  Synthetic
agattacagggutttcatgagtgcug

SEQ ID NO: 37787 - DNA, 22 bp, Artificial Sequence
  Synthetic
gacttcatugtctgccuagcct

SEQ ID NO: 37788 - DNA, 25 bp, Artificial Sequence
  Synthetic
gagcaggagtutaaaagcatcctut

SEQ ID NO: 37789 - DNA, 23 bp, Artificial Sequence
  Synthetic
gcccaaagacugacagctttgua

SEQ ID NO: 37790 - DNA, 25 bp, Artificial Sequence
  Synthetic
ttgaggaagugaaaatggatgccua

SEQ ID NO: 37791 - DNA, 24 bp, Artificial Sequence
  Synthetic
tgttggatgucactgtcaggaaut

SEQ ID NO: 37792 - DNA, 28 bp, Artificial Sequence
  Synthetic
caccaugacgaaaactgaaauagaaagg

SEQ ID NO: 37793 - DNA, 31 bp, Artificial Sequence
  Synthetic
caagtgatatacguatttcccgaaugagaat

SEQ ID NO: 37794 - DNA, 25 bp, Artificial Sequence
  Synthetic
attggaagauattcactgtguggct

SEQ ID NO: 37795 - DNA, 26 bp, Artificial Sequence
  Synthetic
cautattcagaacacuaacccagcac

SEQ ID NO: 37796 - DNA, 22 bp, Artificial Sequence
  Synthetic
cgggaaccutacaugcaacact

SEQ ID NO: 37797 - DNA, 20 bp, Artificial Sequence
  Synthetic
ggttccccacutacccctug

SEQ ID NO: 37798 - DNA, 24 bp, Artificial Sequence
  Synthetic
ctatgccggucatcttugcaaaag

SEQ ID NO: 37799 - DNA, 23 bp, Artificial Sequence
  Synthetic
gccagtgtuaccttacgcttcua

SEQ ID NO: 37800 - DNA, 17 bp, Artificial Sequence
  Synthetic
cgcccggccutgtctut

SEQ ID NO: 37801 - DNA, 22 bp, Artificial Sequence
  Synthetic
tcttcttgcugctcttcuccac

SEQ ID NO: 37802 - DNA, 22 bp, Artificial Sequence
  Synthetic
accccatcuaataagggccuca

SEQ ID NO: 37803 - DNA, 28 bp, Artificial Sequence
  Synthetic
cccacgttcuattctttgttatauccca

SEQ ID NO: 37804 - DNA, 21 bp, Artificial Sequence
  Synthetic
ccgtggutcctcagucaaact

SEQ ID NO: 37805 - DNA, 31 bp, Artificial Sequence
  Synthetic
ccatggtagauaccaacattacttctcuaaa

SEQ ID NO: 37806 - DNA, 26 bp, Artificial Sequence
  Synthetic
tggatguagcaaaccaauatcagaut

SEQ ID NO: 37807 - DNA, 29 bp, Artificial Sequence
  Synthetic
gttaaatgcggauacttaaaatcagccut

SEQ ID NO: 37808 - DNA, 28 bp, Artificial Sequence
  Synthetic
gaattgaaagcaacugcagatgacttua

SEQ ID NO: 37809 - DNA, 28 bp, Artificial Sequence
  Synthetic
gtgtccaaacaugagtttuaagaaacca

SEQ ID NO: 37810 - DNA, 22 bp, Artificial Sequence
  Synthetic
atgaacctaaucgccagccaut

SEQ ID NO: 37811 - DNA, 27 bp, Artificial Sequence
  Synthetic
gagaaactggcuacatgatcaggtuat

SEQ ID NO: 37812 - DNA, 30 bp, Artificial Sequence
  Synthetic
tttttgactgtatcuttgcattgtccttut

SEQ ID NO: 37813 - DNA, 24 bp, Artificial Sequence
  Synthetic
gctgagagccucccaaaatgtaua

SEQ ID NO: 37814 - DNA, 28 bp, Artificial Sequence
  Synthetic
aagatctacagucagttcttuccaaacc

SEQ ID NO: 37815 - DNA, 25 bp, Artificial Sequence
  Synthetic
guttcctaaactuccaccacaaaca

SEQ ID NO: 37816 - DNA, 28 bp, Artificial Sequence
  Synthetic
tcutttacttcctguaaacaagcacact

SEQ ID NO: 37817 - DNA, 28 bp, Artificial Sequence
  Synthetic
gaaagtggaacagugaattaacaucaca

SEQ ID NO: 37818 - DNA, 25 bp, Artificial Sequence
  Synthetic
ggtcgatuaggacacattcucgaat

SEQ ID NO: 37819 - DNA, 25 bp, Artificial Sequence
  Synthetic
tctctgatgaguctgaagtccacuc

SEQ ID NO: 37820 - DNA, 18 bp, Artificial Sequence
  Synthetic
ctcctcgcugtcctcugg

SEQ ID NO: 37821 - DNA, 19 bp, Artificial Sequence
  Synthetic
ctccgcutctctcuacgca

SEQ ID NO: 37822 - DNA, 27 bp, Artificial Sequence
  Synthetic
tgaatgtaatcacuttgcatgtgctut

SEQ ID NO: 37823 - DNA, 28 bp, Artificial Sequence
  Synthetic
caccaaccuaatagaggtataaugcact

SEQ ID NO: 37824 - DNA, 24 bp, Artificial Sequence
  Synthetic
aatggtgggauctgttgttcugag

SEQ ID NO: 37825 - DNA, 28 bp, Artificial Sequence
  Synthetic
ttcautacctgtataatuccaaccagca

SEQ ID NO: 37826 - DNA, 21 bp, Artificial Sequence
  Synthetic
ttggcagaucctttggtuggt

SEQ ID NO: 37827 - DNA, 22 bp, Artificial Sequence
  Synthetic
ggcccagacucagagaaugaat

SEQ ID NO: 37828 - DNA, 24 bp, Artificial Sequence
  Synthetic
accaatctugctgatttcacugct

SEQ ID NO: 37829 - DNA, 28 bp, Artificial Sequence
  Synthetic
ttgtttgucaaccaaataatgcugaact

SEQ ID NO: 37830 - DNA, 22 bp, Artificial Sequence
  Synthetic
tggtggucaaatctucacagca

SEQ ID NO: 37831 - DNA, 26 bp, Artificial Sequence
  Synthetic
ccuataaaaccagtucagcaaaaggg

SEQ ID NO: 37832 - DNA, 22 bp, Artificial Sequence
  Synthetic
gtctgugaacaggctgtcucat

SEQ ID NO: 37833 - DNA, 25 bp, Artificial Sequence
  Synthetic
ggtaugcagagaaguagggttauac

SEQ ID NO: 37834 - DNA, 28 bp, Artificial Sequence
  Synthetic
aggtagttatcacaugatggtaccugat

SEQ ID NO: 37835 - DNA, 27 bp, Artificial Sequence
  Synthetic
aggaaatctgggutttacgttacucac

SEQ ID NO: 37836 - DNA, 29 bp, Artificial Sequence
  Synthetic
tgaggctugaaattatttaaucccagaca

SEQ ID NO: 37837 - DNA, 28 bp, Artificial Sequence
  Synthetic
ggaccccaguaaatacttgtagaaugaa

SEQ ID NO: 37838 - DNA, 22 bp, Artificial Sequence
  Synthetic
taccaaggaacagugtguaggt

SEQ ID NO: 37839 - DNA, 26 bp, Artificial Sequence
  Synthetic
gttgggatatcaagutcctccagauc

SEQ ID NO: 37840 - DNA, 28 bp, Artificial Sequence
  Synthetic
tgaaagtaataaugtttctccugagcaa

SEQ ID NO: 37841 - DNA, 30 bp, Artificial Sequence
  Synthetic
cgggaaagtctuacaggtagatatguagat

SEQ ID NO: 37842 - DNA, 28 bp, Artificial Sequence
  Synthetic
gacggtccatgaugctatactctatcua

SEQ ID NO: 37843 - DNA, 30 bp, Artificial Sequence
  Synthetic
cttaaaattcaacagcuagactagactugt

SEQ ID NO: 37844 - DNA, 28 bp, Artificial Sequence
  Synthetic
aatgcagactuaaggagaattcagtugt

SEQ ID NO: 37845 - DNA, 30 bp, Artificial Sequence
  Synthetic
tcttagtgcttcuctttcaatggcttaaua

SEQ ID NO: 37846 - DNA, 19 bp, Artificial Sequence
  Synthetic
cgggagcagucctgacuct

SEQ ID NO: 37847 - DNA, 22 bp, Artificial Sequence
  Synthetic
acagtuacgaaaagcggctgua

SEQ ID NO: 37848 - DNA, 22 bp, Artificial Sequence
  Synthetic
aacctcagcutgaccucagaac

SEQ ID NO: 37849 - DNA, 22 bp, Artificial Sequence
  Synthetic
ctgatctgcuccacctacctuc

SEQ ID NO: 37850 - DNA, 21 bp, Artificial Sequence
  Synthetic
cuatgagguagggcacgaact

SEQ ID NO: 37851 - DNA, 24 bp, Artificial Sequence
  Synthetic
ggtatcccguttttgccctuaaga

SEQ ID NO: 37852 - DNA, 20 bp, Artificial Sequence
  Synthetic
cccaauccccagcacatuct

SEQ ID NO: 37853 - DNA, 21 bp, Artificial Sequence
  Synthetic
gactcttcuctgccttgugca

SEQ ID NO: 37854 - DNA, 22 bp, Artificial Sequence
  Synthetic
ccaggagccauaccatcaccua

SEQ ID NO: 37855 - DNA, 22 bp, Artificial Sequence
  Synthetic
gctcttccgucctttcucacag

SEQ ID NO: 37856 - DNA, 22 bp, Artificial Sequence
  Synthetic
ctgcttcugggaatcctuggag

SEQ ID NO: 37857 - DNA, 25 bp, Artificial Sequence
  Synthetic
ccactttcatcutcaccctccuaaa

SEQ ID NO: 37858 - DNA, 20 bp, Artificial Sequence
  Synthetic
cagcgtgagggucctctcua

SEQ ID NO: 37859 - DNA, 20 bp, Artificial Sequence
  Synthetic
gcatggctuctctggcaucc

SEQ ID NO: 37860 - DNA, 20 bp, Artificial Sequence
  Synthetic
cagggagugtagcagugcag

SEQ ID NO: 37861 - DNA, 24 bp, Artificial Sequence
  Synthetic
gaccacactucccttctacaucag

SEQ ID NO: 37862 - DNA, 23 bp, Artificial Sequence
  Synthetic
aaagtctcuccatctctccaugc

SEQ ID NO: 37863 - DNA, 26 bp, Artificial Sequence
  Synthetic
tccccactaauaacactcacttcuct

SEQ ID NO: 37864 - DNA, 21 bp, Artificial Sequence
  Synthetic
cgtctucggagagacctugag

SEQ ID NO: 37865 - DNA, 22 bp, Artificial Sequence
  Synthetic
gacttggctuacccctcctuag

SEQ ID NO: 37866 - DNA, 17 bp, Artificial Sequence
  Synthetic
ctcgtgucccgggtgut

SEQ ID NO: 37867 - DNA, 17 bp, Artificial Sequence
  Synthetic
cctccucgggacucgac

SEQ ID NO: 37868 - DNA, 25 bp, Artificial Sequence
  Synthetic
tctataaauagctggaggugggcat

SEQ ID NO: 37869 - DNA, 26 bp, Artificial Sequence
  Synthetic
gttcaaagggcauatactggtacugg

SEQ ID NO: 37870 - DNA, 23 bp, Artificial Sequence
  Synthetic
tgtctgcuggcctctgtctatua

SEQ ID NO: 37871 - DNA, 27 bp, Artificial Sequence
  Synthetic
atttctttattccucagtccccaucac

SEQ ID NO: 37872 - DNA, 21 bp, Artificial Sequence
  Synthetic
acgggatctutctggtgctuc

SEQ ID NO: 37873 - DNA, 21 bp, Artificial Sequence
  Synthetic
acacccugcttaacatucgct

SEQ ID NO: 37874 - DNA, 25 bp, Artificial Sequence
  Synthetic
ggacattcatcucccttttcaccut

SEQ ID NO: 37875 - DNA, 21 bp, Artificial Sequence
  Synthetic
ccagctcuggcttcagtcaug

SEQ ID NO: 37876 - DNA, 23 bp, Artificial Sequence
  Synthetic
cctctctuccacctgtttctcug

SEQ ID NO: 37877 - DNA, 29 bp, Artificial Sequence
  Synthetic
gcacttgtggauactgattaaaactgtut

SEQ ID NO: 37878 - DNA, 22 bp, Artificial Sequence
  Synthetic
tgaaaacugcccacctctgtut

SEQ ID NO: 37879 - DNA, 23 bp, Artificial Sequence
  Synthetic
caatcuacagcctcacuccacac

SEQ ID NO: 37880 - DNA, 24 bp, Artificial Sequence
  Synthetic
gactacgguggacuaaaggaaact

SEQ ID NO: 37881 - DNA, 24 bp, Artificial Sequence
  Synthetic
gtgctgtttccuctttaccatgug

SEQ ID NO: 37882 - DNA, 23 bp, Artificial Sequence
  Synthetic
tgcagaaaggaggauagugggaa

SEQ ID NO: 37883 - DNA, 25 bp, Artificial Sequence
  Synthetic
ctagatugcaactctcagucagacc

SEQ ID NO: 37884 - DNA, 25 bp, Artificial Sequence
  Synthetic
tcatgtctctcautccgtgttatuc

SEQ ID NO: 37885 - DNA, 23 bp, Artificial Sequence
  Synthetic
gatgtgagcaauctgacccgtua

SEQ ID NO: 37886 - DNA, 22 bp, Artificial Sequence
  Synthetic
caccatgcttuctccctccaua

SEQ ID NO: 37887 - DNA, 24 bp, Artificial Sequence
  Synthetic
actagctcuggagtcgacttctuc

SEQ ID NO: 37888 - DNA, 18 bp, Artificial Sequence
  Synthetic
gauggcgcggaagttguc

SEQ ID NO: 37889 - DNA, 22 bp, Artificial Sequence
  Synthetic
cgcttttcccuttgctccugat

SEQ ID NO: 37890 - DNA, 23 bp, Artificial Sequence
  Synthetic
cagctcttuggaggcaaatgtua

SEQ ID NO: 37891 - DNA, 24 bp, Artificial Sequence
  Synthetic
gtatccccaaacacauctcctcuc

SEQ ID NO: 37892 - DNA, 24 bp, Artificial Sequence
  Synthetic
ggtgaaaggaggcuctgtgattut

SEQ ID NO: 37893 - DNA, 22 bp, Artificial Sequence
  Synthetic
ccugagcagucagcaaaagact

SEQ ID NO: 37894 - DNA, 27 bp, Artificial Sequence
  Synthetic
ttcctttcattguacctgttctttuct

SEQ ID NO: 37895 - DNA, 20 bp, Artificial Sequence
  Synthetic
ccccgguactctttcgagut

SEQ ID NO: 37896 - DNA, 20 bp, Artificial Sequence
  Synthetic
gcaagguagagggcgagtug

SEQ ID NO: 37897 - DNA, 21 bp, Artificial Sequence
  Synthetic
cccacacaagutcacccucag

SEQ ID NO: 37898 - DNA, 20 bp, Artificial Sequence
  Synthetic
cgaucccagacaccuagcat

SEQ ID NO: 37899 - DNA, 27 bp, Artificial Sequence
  Synthetic
ctggccagaguattccttttaaguagg

SEQ ID NO: 37900 - DNA, 17 bp, Artificial Sequence
  Synthetic
tgccugcggccttgaut

SEQ ID NO: 37901 - DNA, 19 bp, Artificial Sequence
  Synthetic
gcagctgcuacctggaugc

SEQ ID NO: 37902 - DNA, 20 bp, Artificial Sequence
  Synthetic
tgggacuggacgagcttcua

SEQ ID NO: 37903 - DNA, 20 bp, Artificial Sequence
  Synthetic
ctgagcgcuctttcctccuc

SEQ ID NO: 37904 - DNA, 21 bp, Artificial Sequence
  Synthetic
gcagacaggcaugggaguaga

SEQ ID NO: 37905 - DNA, 19 bp, Artificial Sequence
  Synthetic
catgacccccuacccugac

SEQ ID NO: 37906 - DNA, 18 bp, Artificial Sequence
  Synthetic
cagctcccuctccccugt

SEQ ID NO: 37907 - DNA, 19 bp, Artificial Sequence
  Synthetic
ccuccttccttucccacca

SEQ ID NO: 37908 - DNA, 19 bp, Artificial Sequence
  Synthetic
cuggaagagguggaagcca

SEQ ID NO: 37909 - DNA, 19 bp, Artificial Sequence
  Synthetic
cuctgcaggaugaccgcat

SEQ ID NO: 37910 - DNA, 22 bp, Artificial Sequence
  Synthetic
tgctaaaguccccggagactuc

SEQ ID NO: 37911 - DNA, 21 bp, Artificial Sequence
  Synthetic
gggtgguggatgggttuaaca

SEQ ID NO: 37912 - DNA, 21 bp, Artificial Sequence
  Synthetic
ggacaaucagacgggaagcug

SEQ ID NO: 37913 - DNA, 26 bp, Artificial Sequence
  Synthetic
ctgtgatuaccttgatttcuggacct

SEQ ID NO: 37914 - DNA, 21 bp, Artificial Sequence
  Synthetic
ccttagguctaggagcuggca

SEQ ID NO: 37915 - DNA, 17 bp, Artificial Sequence
  Synthetic
ccugacagccggcucag

SEQ ID NO: 37916 - DNA, 18 bp, Artificial Sequence
  Synthetic
cccucccagaggcgauct

SEQ ID NO: 37917 - DNA, 19 bp, Artificial Sequence
  Synthetic
gctctcccugcaaaacugg

SEQ ID NO: 37918 - DNA, 18 bp, Artificial Sequence
  Synthetic
cgatgtgucccgcaccuc

SEQ ID NO: 37919 - DNA, 22 bp, Artificial Sequence
  Synthetic
ccaagcugaagaagacauggct

SEQ ID NO: 37920 - DNA, 19 bp, Artificial Sequence
  Synthetic
ctccuggcactucccacaa

SEQ ID NO: 37921 - DNA, 19 bp, Artificial Sequence
  Synthetic
cagacacugtgcccuggac

SEQ ID NO: 37922 - DNA, 21 bp, Artificial Sequence
  Synthetic
catccctcuggtgcagugaag

SEQ ID NO: 37923 - DNA, 22 bp, Artificial Sequence
  Synthetic
cttgtcagutctgcccauccat

SEQ ID NO: 37924 - DNA, 21 bp, Artificial Sequence
  Synthetic
gccagtcacauggatgctcug

SEQ ID NO: 37925 - DNA, 20 bp, Artificial Sequence
  Synthetic
ccctgaugcctgagcauagt

SEQ ID NO: 37926 - DNA, 21 bp, Artificial Sequence
  Synthetic
cacaagugggagcatgtccut

SEQ ID NO: 37927 - DNA, 19 bp, Artificial Sequence
  Synthetic
ggagaguacgcccagctuc

SEQ ID NO: 37928 - DNA, 18 bp, Artificial Sequence
  Synthetic
tcucaccagcagguggag

SEQ ID NO: 37929 - DNA, 19 bp, Artificial Sequence
  Synthetic
tgccaauggcggacucaaa

SEQ ID NO: 37930 - DNA, 17 bp, Artificial Sequence
  Synthetic
ccctgcucagggaggug

SEQ ID NO: 37931 - DNA, 21 bp, Artificial Sequence
  Synthetic
cgtcccugaccttacagucct

SEQ ID NO: 37932 - DNA, 22 bp, Artificial Sequence
  Synthetic
agaaagaggacucctcagucca

SEQ ID NO: 37933 - DNA, 19 bp, Artificial Sequence
  Synthetic
tcccctgugctgcttucag

SEQ ID NO: 37934 - DNA, 26 bp, Artificial Sequence
  Synthetic
agtctgctatcutcatcacattgucc

SEQ ID NO: 37935 - DNA, 24 bp, Artificial Sequence
  Synthetic
gttctaugagacaagtcggcuagt

SEQ ID NO: 37936 - DNA, 19 bp, Artificial Sequence
  Synthetic
ctcctcugggttgtggcug

SEQ ID NO: 37937 - DNA, 23 bp, Artificial Sequence
  Synthetic
tuctttgaggugaagccaaacct

SEQ ID NO: 37938 - DNA, 21 bp, Artificial Sequence
  Synthetic
ctgttugcttggaaugggaca

SEQ ID NO: 37939 - DNA, 24 bp, Artificial Sequence
  Synthetic
ccaacttaugccactctctgttuc

SEQ ID NO: 37940 - DNA, 27 bp, Artificial Sequence
  Synthetic
ccaaagctauaaattagggacaaugga

SEQ ID NO: 37941 - DNA, 27 bp, Artificial Sequence
  Synthetic
catcgtctacaagaugaagagtgguac

SEQ ID NO: 37942 - DNA, 24 bp, Artificial Sequence
  Synthetic
gcaggacaucgagaggagaagtua

SEQ ID NO: 37943 - DNA, 26 bp, Artificial Sequence
  Synthetic
cattttgcttccgutgtctcttcuag

SEQ ID NO: 37944 - DNA, 24 bp, Artificial Sequence
  Synthetic
agtgacgttgcuctcaaagctuat

SEQ ID NO: 37945 - DNA, 22 bp, Artificial Sequence
  Synthetic
ccgaatgggaucattccucacg

SEQ ID NO: 37946 - DNA, 21 bp, Artificial Sequence
  Synthetic
caggttgtcugggccaatcut

SEQ ID NO: 37947 - DNA, 22 bp, Artificial Sequence
  Synthetic
cctctttagccauggcaagguc

SEQ ID NO: 37948 - DNA, 22 bp, Artificial Sequence
  Synthetic
cuaactttcgcaugcacacaca

SEQ ID NO: 37949 - DNA, 21 bp, Artificial Sequence
  Synthetic
cctgtctcucttggcttuccc

SEQ ID NO: 37950 - DNA, 18 bp, Artificial Sequence
  Synthetic
gcagggcutggcuaccaa

SEQ ID NO: 37951 - DNA, 17 bp, Artificial Sequence
  Synthetic
ctgcagcutcgctgucg

SEQ ID NO: 37952 - DNA, 23 bp, Artificial Sequence
  Synthetic
ccacatcaccugcaaccatauca

SEQ ID NO: 37953 - DNA, 23 bp, Artificial Sequence
  Synthetic
acctctaacugcagaacugggat

SEQ ID NO: 37954 - DNA, 24 bp, Artificial Sequence
  Synthetic
gaatatcctggaugtctgcagcua

SEQ ID NO: 37955 - DNA, 26 bp, Artificial Sequence
  Synthetic
gaccttcagaagacguaggatgaaug

SEQ ID NO: 37956 - DNA, 22 bp, Artificial Sequence
  Synthetic
gtcaacccucgctccttuaagt

SEQ ID NO: 37957 - DNA, 21 bp, Artificial Sequence
  Synthetic
ctttguccaggtcuacaggct

SEQ ID NO: 37958 - DNA, 22 bp, Artificial Sequence
  Synthetic
gcctagtggucttcaggaaugg

SEQ ID NO: 37959 - DNA, 28 bp, Artificial Sequence
  Synthetic
attcataucccacacgaatccaatuagt

SEQ ID NO: 37960 - DNA, 28 bp, Artificial Sequence
  Synthetic
ggagccattuaaaccaggaaattaugac

SEQ ID NO: 37961 - DNA, 21 bp, Artificial Sequence
  Synthetic
catggatttugccgtcctuga

SEQ ID NO: 37962 - DNA, 28 bp, Artificial Sequence
  Synthetic
ggtcccagattuattctgtttcttcuga

SEQ ID NO: 37963 - DNA, 30 bp, Artificial Sequence
  Synthetic
tggtttcttccucttttattctgaaucgaa

SEQ ID NO: 37964 - DNA, 26 bp, Artificial Sequence
  Synthetic
gaagaacagaaagucgatcatcuggt

SEQ ID NO: 37965 - DNA, 24 bp, Artificial Sequence
  Synthetic
gttccctggaugatatctgtgucc

SEQ ID NO: 37966 - DNA, 30 bp, Artificial Sequence
  Synthetic
atctgaaactgaggutcaagagaaaaugat

SEQ ID NO: 37967 - DNA, 28 bp, Artificial Sequence
  Synthetic
cttgacttaagcagacugttttccttut

SEQ ID NO: 37968 - DNA, 26 bp, Artificial Sequence
  Synthetic
tgtggaggaagaugtagttgattgug

SEQ ID NO: 37969 - DNA, 23 bp, Artificial Sequence
  Synthetic
cagtgacaguagaggatgctuct

SEQ ID NO: 37970 - DNA, 24 bp, Artificial Sequence
  Synthetic
gacagcaagcaauaaatuccaggt

SEQ ID NO: 37971 - DNA, 29 bp, Artificial Sequence
  Synthetic
cgtggaatugagattactttuggaacaaa

SEQ ID NO: 37972 - DNA, 29 bp, Artificial Sequence
  Synthetic
guatttaacatcctugagcaaaaacccaa

SEQ ID NO: 37973 - DNA, 22 bp, Artificial Sequence
  Synthetic
agaatttgcccuggttguagca

SEQ ID NO: 37974 - DNA, 29 bp, Artificial Sequence
  Synthetic
agcctataaaaucagctccagtatguaga

SEQ ID NO: 37975 - DNA, 28 bp, Artificial Sequence
  Synthetic
accagtgtcatuggcaataaaagactua

SEQ ID NO: 37976 - DNA, 31 bp, Artificial Sequence
  Synthetic
ctgtactttgucacagtcagctattaaugat

SEQ ID NO: 37977 - DNA, 23 bp, Artificial Sequence
  Synthetic
caggaacugaagcttgcaatugg

SEQ ID NO: 37978 - DNA, 25 bp, Artificial Sequence
  Synthetic
cttggugctaaaccuaaagggaagt

SEQ ID NO: 37979 - DNA, 30 bp, Artificial Sequence
  Synthetic
agatctattggaaccaugtcttgttcttuc

SEQ ID NO: 37980 - DNA, 23 bp, Artificial Sequence
  Synthetic
ttttggaagugacttgctcucca

SEQ ID NO: 37981 - DNA, 27 bp, Artificial Sequence
  Synthetic
ccctcatagguatggttctcctttuga

SEQ ID NO: 37982 - DNA, 28 bp, Artificial Sequence
  Synthetic
ctgaagagtuagaaagaggtgaugacat

SEQ ID NO: 37983 - DNA, 31 bp, Artificial Sequence
  Synthetic
tcatcctgaaactuccttagtgaacaattut

SEQ ID NO: 37984 - DNA, 25 bp, Artificial Sequence
  Synthetic
ggagagcaagccacugaagaatuaa

SEQ ID NO: 37985 - DNA, 31 bp, Artificial Sequence
  Synthetic
ggtctccttttcacuattttgcttagaauca

SEQ ID NO: 37986 - DNA, 21 bp, Artificial Sequence
  Synthetic
actatcggccugacagugaca

SEQ ID NO: 37987 - DNA, 29 bp, Artificial Sequence
  Synthetic
cctggaacacugaaattccacagaatuat

SEQ ID NO: 37988 - DNA, 25 bp, Artificial Sequence
  Synthetic
atctatgtugcaggaatuccaggag

SEQ ID NO: 37989 - DNA, 24 bp, Artificial Sequence
  Synthetic
cagaagccauttgcctttgucaat

SEQ ID NO: 37990 - DNA, 21 bp, Artificial Sequence
  Synthetic
gcccaacgauggatgaacuct

SEQ ID NO: 37991 - DNA, 26 bp, Artificial Sequence
  Synthetic
cccttctccuctgtatgatgattugc

SEQ ID NO: 37992 - DNA, 23 bp, Artificial Sequence
  Synthetic
atggtacacutcaggaagcugac

SEQ ID NO: 37993 - DNA, 27 bp, Artificial Sequence
  Synthetic
gctttattgtuctcttcccugaacaca

SEQ ID NO: 37994 - DNA, 29 bp, Artificial Sequence
  Synthetic
cacatttgacutgatggguaaaagaagaa

SEQ ID NO: 37995 - DNA, 24 bp, Artificial Sequence
  Synthetic
gatttcatttguctgaccgcugag

SEQ ID NO: 37996 - DNA, 24 bp, Artificial Sequence
  Synthetic
cttggtcaagcutgcctctuagat

SEQ ID NO: 37997 - DNA, 31 bp, Artificial Sequence
  Synthetic
gacaaagaatgagugtgctgatattgaaaut

SEQ ID NO: 37998 - DNA, 19 bp, Artificial Sequence
  Synthetic
caccccaaacuccctucca

SEQ ID NO: 37999 - DNA, 23 bp, Artificial Sequence
  Synthetic
ctcatcatucctggatcugccat

SEQ ID NO: 38000 - DNA, 24 bp, Artificial Sequence
  Synthetic
agaatgtggtuacccggaaaaucc

SEQ ID NO: 38001 - DNA, 30 bp, Artificial Sequence
  Synthetic
gatgcatcttttgutgttcatactgatuat

SEQ ID NO: 38002 - DNA, 21 bp, Artificial Sequence
  Synthetic
gtctacccuggcaugcagaat

SEQ ID NO: 38003 - DNA, 21 bp, Artificial Sequence
  Synthetic
tgcauggaaaaauccccacgt

SEQ ID NO: 38004 - DNA, 23 bp, Artificial Sequence
  Synthetic
tccttttatugccaccucaggac

SEQ ID NO: 38005 - DNA, 22 bp, Artificial Sequence
  Synthetic
actgtctggcuccgagaacuaa

SEQ ID NO: 38006 - DNA, 23 bp, Artificial Sequence
  Synthetic
caagauaccccaatgctguagga

SEQ ID NO: 38007 - DNA, 21 bp, Artificial Sequence
  Synthetic
gaggagtgccugctggatuac

SEQ ID NO: 38008 - DNA, 22 bp, Artificial Sequence
  Synthetic
gaataugggccccagaaacaug

SEQ ID NO: 38009 - DNA, 23 bp, Artificial Sequence
  Synthetic
aaaagauggctgtugaccaggat

SEQ ID NO: 38010 - DNA, 26 bp, Artificial Sequence
  Synthetic
agtttcagaaacaucagccacuaact

SEQ ID NO: 38011 - DNA, 22 bp, Artificial Sequence
  Synthetic
cttcacuagctgagcatucggt

SEQ ID NO: 38012 - DNA, 30 bp, Artificial Sequence
  Synthetic
gggtagauaaccaagaactaaauaggaact

SEQ ID NO: 38013 - DNA, 25 bp, Artificial Sequence
  Synthetic
tggcagttttugctttcttttccut

SEQ ID NO: 38014 - DNA, 28 bp, Artificial Sequence
  Synthetic
gagacaugcagaaacacattaaaaguga

SEQ ID NO: 38015 - DNA, 29 bp, Artificial Sequence
  Synthetic
aaggctcgggaaucacaataattgtatua

SEQ ID NO: 38016 - DNA, 26 bp, Artificial Sequence
  Synthetic
gggaatgattucttgctcttauagct

SEQ ID NO: 38017 - DNA, 26 bp, Artificial Sequence
  Synthetic
cctcacagattutaatggctccaaug

SEQ ID NO: 38018 - DNA, 26 bp, Artificial Sequence
  Synthetic
ttgctgugacccaaaatattatugct

SEQ ID NO: 38019 - DNA, 29 bp, Artificial Sequence
  Synthetic
cctgaatcaccacuttgtaatacaaauga

SEQ ID NO: 38020 - DNA, 26 bp, Artificial Sequence
  Synthetic
tgutcacttccttaugaagacagcac

SEQ ID NO: 38021 - DNA, 23 bp, Artificial Sequence
  Synthetic
gttucccaaagaucacaccacua

SEQ ID NO: 38022 - DNA, 22 bp, Artificial Sequence
  Synthetic
ccautgtccacaauccccaact

SEQ ID NO: 38023 - DNA, 29 bp, Artificial Sequence
  Synthetic
gcacagaguaagtacaaagaauacaacct

SEQ ID NO: 38024 - DNA, 23 bp, Artificial Sequence
  Synthetic
agtggctttccutgtgttaccuc

SEQ ID NO: 38025 - DNA, 29 bp, Artificial Sequence
  Synthetic
gccatttcatgggcuaatcttcaatttua

SEQ ID NO: 38026 - DNA, 26 bp, Artificial Sequence
  Synthetic
ctuggcccucaaagaagaaactatua

SEQ ID NO: 38027 - DNA, 21 bp, Artificial Sequence
  Synthetic
cutaagcaagtucgcgagcag

SEQ ID NO: 38028 - DNA, 24 bp, Artificial Sequence
  Synthetic
cagggugcttatctttucccagat

SEQ ID NO: 38029 - DNA, 25 bp, Artificial Sequence
  Synthetic
tagccccuttatcatagatuccact

SEQ ID NO: 38030 - DNA, 25 bp, Artificial Sequence
  Synthetic
tcgacagattcuccaaacctgatuc

SEQ ID NO: 38031 - DNA, 28 bp, Artificial Sequence
  Synthetic
ctttttaaaggcaucaggactttctugt

SEQ ID NO: 38032 - DNA, 29 bp, Artificial Sequence
  Synthetic
ctgtgaaaatcuacaggctgatuacaaga

SEQ ID NO: 38033 - DNA, 28 bp, Artificial Sequence
  Synthetic
aggtcgaaaaataaucaaaggctgagua

SEQ ID NO: 38034 - DNA, 23 bp, Artificial Sequence
  Synthetic
ctatggugcactcatggaugagg

SEQ ID NO: 38035 - DNA, 26 bp, Artificial Sequence
  Synthetic
tctgtcatgctuctatggaaaaccug

SEQ ID NO: 38036 - DNA, 22 bp, Artificial Sequence
  Synthetic
atgggagggugagtaagaaguc

SEQ ID NO: 38037 - DNA, 24 bp, Artificial Sequence
  Synthetic
agtctgagaacuccatcagcucat

SEQ ID NO: 38038 - DNA, 21 bp, Artificial Sequence
  Synthetic
gattucccaacgctgguacct

SEQ ID NO: 38039 - DNA, 23 bp, Artificial Sequence
  Synthetic
aggatggttcugcagatggttuc

SEQ ID NO: 38040 - DNA, 23 bp, Artificial Sequence
  Synthetic
atatttcccugcctcgtgcatua

SEQ ID NO: 38041 - DNA, 22 bp, Artificial Sequence
  Synthetic
tcttgtagcugtcctccuggaa

SEQ ID NO: 38042 - DNA, 22 bp, Artificial Sequence
  Synthetic
ttggcaggaugatggaugaaca

SEQ ID NO: 38043 - DNA, 24 bp, Artificial Sequence
  Synthetic
gaacaaatgugagctcgcacuaac

SEQ ID NO: 38044 - DNA, 22 bp, Artificial Sequence
  Synthetic
gtgtgttttcugtgcacggaug

SEQ ID NO: 38045 - DNA, 28 bp, Artificial Sequence
  Synthetic
cctgccaatagaugtgaaactgacauaa

SEQ ID NO: 38046 - DNA, 25 bp, Artificial Sequence
  Synthetic
ctgtttctugctttgcttucaagga

SEQ ID NO: 38047 - DNA, 21 bp, Artificial Sequence
  Synthetic
cacugctgtcaugaagcagga

SEQ ID NO: 38048 - DNA, 22 bp, Artificial Sequence
  Synthetic
gccaacttuactggccuaacac

SEQ ID NO: 38049 - DNA, 24 bp, Artificial Sequence
  Synthetic
gagtggaaaccutgaagaaacuca

SEQ ID NO: 38050 - DNA, 23 bp, Artificial Sequence
  Synthetic
gaaccaattuagagccttugcca

SEQ ID NO: 38051 - DNA, 28 bp, Artificial Sequence
  Synthetic
gaattcaagggcautctacattguacac

SEQ ID NO: 38052 - DNA, 22 bp, Artificial Sequence
  Synthetic
cattgagcugctacggaagauc

SEQ ID NO: 38053 - DNA, 27 bp, Artificial Sequence
  Synthetic
tttgagcaaaguttttatgtgcaucca

SEQ ID NO: 38054 - DNA, 23 bp, Artificial Sequence
  Synthetic
gaugagagggtacuggaacaagc

SEQ ID NO: 38055 - DNA, 23 bp, Artificial Sequence
  Synthetic
tcctctucggaacctttctcuga

SEQ ID NO: 38056 - DNA, 25 bp, Artificial Sequence
  Synthetic
cttcagtttcccugatactgtggut

SEQ ID NO: 38057 - DNA, 23 bp, Artificial Sequence
  Synthetic
gctactgaaggauctccgtccuc

SEQ ID NO: 38058 - DNA, 29 bp, Artificial Sequence
  Synthetic
cattttatgctcutttgcatcttgaugga

SEQ ID NO: 38059 - DNA, 22 bp, Artificial Sequence
  Synthetic
acatcuggcgcctatttacugg

SEQ ID NO: 38060 - DNA, 22 bp, Artificial Sequence
  Synthetic
ccagcccauatagcagtacugt

SEQ ID NO: 38061 - DNA, 29 bp, Artificial Sequence
  Synthetic
caactttttctugtccattttcugagacc

SEQ ID NO: 38062 - DNA, 24 bp, Artificial Sequence
  Synthetic
gcctaatgtcucaacaccagtguc

SEQ ID NO: 38063 - DNA, 20 bp, Artificial Sequence
  Synthetic
aggcaagcuccccaactuac

SEQ ID NO: 38064 - DNA, 21 bp, Artificial Sequence
  Synthetic
cagacacacggauccctgtua

SEQ ID NO: 38065 - DNA, 27 bp, Artificial Sequence
  Synthetic
attccttccaacuctaaactcugcaat

SEQ ID NO: 38066 - DNA, 29 bp, Artificial Sequence
  Synthetic
gaaacgacatagaugtcgaaaccctaaua

SEQ ID NO: 38067 - DNA, 27 bp, Artificial Sequence
  Synthetic
gcagacaggautcttttcccctauaga

SEQ ID NO: 38068 - DNA, 22 bp, Artificial Sequence
  Synthetic
atttccauttggaauggcaggt

SEQ ID NO: 38069 - DNA, 23 bp, Artificial Sequence
  Synthetic
acttttgggccutcttcctctuc

SEQ ID NO: 38070 - DNA, 21 bp, Artificial Sequence
  Synthetic
ctgtttgcuggaatggaccug

SEQ ID NO: 38071 - DNA, 20 bp, Artificial Sequence
  Synthetic
aguagcagcugacagagggt

SEQ ID NO: 38072 - DNA, 22 bp, Artificial Sequence
  Synthetic
aaaagcacagaugctgttucgg

SEQ ID NO: 38073 - DNA, 22 bp, Artificial Sequence
  Synthetic
gcattctgaagucctgccaaug

SEQ ID NO: 38074 - DNA, 24 bp, Artificial Sequence
  Synthetic
gaagagcuagactcacttgauggg

SEQ ID NO: 38075 - DNA, 25 bp, Artificial Sequence
  Synthetic
accaagataccutttgacacaccug

SEQ ID NO: 38076 - DNA, 27 bp, Artificial Sequence
  Synthetic
gcatttacttcugacatctcgatucct

SEQ ID NO: 38077 - DNA, 20 bp, Artificial Sequence
  Synthetic
gcgctctaugtggagagugg

SEQ ID NO: 38078 - DNA, 24 bp, Artificial Sequence
  Synthetic
cagaaatucagcaaaaccaugcca

SEQ ID NO: 38079 - DNA, 23 bp, Artificial Sequence
  Synthetic
gcatcattugggaaagucaagca

SEQ ID NO: 38080 - DNA, 28 bp, Artificial Sequence
  Synthetic
ccaattguacaaacaguataccagatut

SEQ ID NO: 38081 - DNA, 27 bp, Artificial Sequence
  Synthetic
cagtttactcagugctttcatggatut

SEQ ID NO: 38082 - DNA, 25 bp, Artificial Sequence
  Synthetic
ttactcagaacguctgatgttuccc

SEQ ID NO: 38083 - DNA, 26 bp, Artificial Sequence
  Synthetic
ttgatgagtucagaacagtgctguaa

SEQ ID NO: 38084 - DNA, 22 bp, Artificial Sequence
  Synthetic
gaacgaccuattgggctucact

SEQ ID NO: 38085 - DNA, 29 bp, Artificial Sequence
  Synthetic
gtgcaaagcagutaattgatctaaacugt

SEQ ID NO: 38086 - DNA, 25 bp, Artificial Sequence
  Synthetic
atctcatauccgacataggcatuct

SEQ ID NO: 38087 - DNA, 29 bp, Artificial Sequence
  Synthetic
cgcttaccctatuttccaattgtaaacut

SEQ ID NO: 38088 - DNA, 24 bp, Artificial Sequence
  Synthetic
aatctgttaccugggccaaauacc

SEQ ID NO: 38089 - DNA, 29 bp, Artificial Sequence
  Synthetic
aatgtttatcuccagggtttttcttccut

SEQ ID NO: 38090 - DNA, 28 bp, Artificial Sequence
  Synthetic
atgtaagtattgacugtacaccctcuct

SEQ ID NO: 38091 - DNA, 29 bp, Artificial Sequence
  Synthetic
gacactgtagccuttacgaatgtacuaaa

SEQ ID NO: 38092 - DNA, 26 bp, Artificial Sequence
  Synthetic
catggaagaaaggutaagtgagtuca

SEQ ID NO: 38093 - DNA, 24 bp, Artificial Sequence
  Synthetic
ccucttctcagaaauccagaccac

SEQ ID NO: 38094 - DNA, 23 bp, Artificial Sequence
  Synthetic
cagatgagacugcctgcagtaut

SEQ ID NO: 38095 - DNA, 29 bp, Artificial Sequence
  Synthetic
ggttttgttttcuagattcaagatuggca

SEQ ID NO: 38096 - DNA, 24 bp, Artificial Sequence
  Synthetic
acactcttgcuccacgttgtaaut

SEQ ID NO: 38097 - DNA, 27 bp, Artificial Sequence
  Synthetic
cagtgtaagagcuttatgtttccccut

SEQ ID NO: 38098 - DNA, 24 bp, Artificial Sequence
  Synthetic
tcactcccttutgcacacatgaua

SEQ ID NO: 38099 - DNA, 31 bp, Artificial Sequence
  Synthetic
caggactatuagacagtgatttttcauacct

SEQ ID NO: 38100 - DNA, 20 bp, Artificial Sequence
  Synthetic
ggcggguaggcacttcaaua

SEQ ID NO: 38101 - DNA, 28 bp, Artificial Sequence
  Synthetic
ccccctatauagacaaattaggcaucct

SEQ ID NO: 38102 - DNA, 26 bp, Artificial Sequence
  Synthetic
cctaaaaggauaaaatcctgggcuga

SEQ ID NO: 38103 - DNA, 28 bp, Artificial Sequence
  Synthetic
cctaggaacatcutcttaccgtttctut

SEQ ID NO: 38104 - DNA, 22 bp, Artificial Sequence
  Synthetic
aagaaagguccccaacgatcug

SEQ ID NO: 38105 - DNA, 31 bp, Artificial Sequence
  Synthetic
caccatagagtccautcaggatttttaaaut

SEQ ID NO: 38106 - DNA, 23 bp, Artificial Sequence
  Synthetic
cacacatuccaaacacaccagua

SEQ ID NO: 38107 - DNA, 31 bp, Artificial Sequence
  Synthetic
ctgcctagtcuggatttttctcttaaguaaa

SEQ ID NO: 38108 - DNA, 25 bp, Artificial Sequence
  Synthetic
gagtaatauaaacggccacccctut

SEQ ID NO: 38109 - DNA, 27 bp, Artificial Sequence
  Synthetic
tcaaguttcttatttgucaaggcaagc

SEQ ID NO: 38110 - DNA, 28 bp, Artificial Sequence
  Synthetic
attatttacaacautacaacctgugggt

SEQ ID NO: 38111 - DNA, 23 bp, Artificial Sequence
  Synthetic
ctttgagccutccatcctucaca

SEQ ID NO: 38112 - DNA, 25 bp, Artificial Sequence
  Synthetic
tacuctttugggaaagaaggaagga

SEQ ID NO: 38113 - DNA, 22 bp, Artificial Sequence
  Synthetic
ccagagagugcctaucaacgaa

SEQ ID NO: 38114 - DNA, 25 bp, Artificial Sequence
  Synthetic
ttcttggatuactgctgtucacagt

SEQ ID NO: 38115 - DNA, 27 bp, Artificial Sequence
  Synthetic
ttggcttttgucctcttctcttctuag

SEQ ID NO: 38116 - DNA, 23 bp, Artificial Sequence
  Synthetic
tgtgtcctttuccctctccacua

SEQ ID NO: 38117 - DNA, 26 bp, Artificial Sequence
  Synthetic
tttttctcaggguccagaattauggg

SEQ ID NO: 38118 - DNA, 27 bp, Artificial Sequence
  Synthetic
ccatatttctgtugatcagctctguct

SEQ ID NO: 38119 - DNA, 21 bp, Artificial Sequence
  Synthetic
agtguccaggcacagaguagt

SEQ ID NO: 38120 - DNA, 22 bp, Artificial Sequence
  Synthetic
accaaagcaaauccgtctucca

SEQ ID NO: 38121 - DNA, 25 bp, Artificial Sequence
  Synthetic
tgaacaaaagagggcgucttctuag

SEQ ID NO: 38122 - DNA, 26 bp, Artificial Sequence
  Synthetic
catatggttuctgtaatcaugaggct

SEQ ID NO: 38123 - DNA, 21 bp, Artificial Sequence
  Synthetic
gtattgctcugacccctccuc

SEQ ID NO: 38124 - DNA, 22 bp, Artificial Sequence
  Synthetic
cccagatcaguttactgtggug

SEQ ID NO: 38125 - DNA, 22 bp, Artificial Sequence
  Synthetic
tgggcugaaacaactttccuga

SEQ ID NO: 38126 - DNA, 25 bp, Artificial Sequence
  Synthetic
gttttuaagccaagaagtcugcagt

SEQ ID NO: 38127 - DNA, 22 bp, Artificial Sequence
  Synthetic
ctaaagcggaaugaggaugcct

SEQ ID NO: 38128 - DNA, 25 bp, Artificial Sequence
  Synthetic
gagtagtctatutagggccacucct

SEQ ID NO: 38129 - DNA, 25 bp, Artificial Sequence
  Synthetic
ccaagctctugacttttgctttugg

SEQ ID NO: 38130 - DNA, 23 bp, Artificial Sequence
  Synthetic
cctcucccatctgcuaaggagaa

SEQ ID NO: 38131 - DNA, 27 bp, Artificial Sequence
  Synthetic
gatgattttgcuctttctttgctucct

SEQ ID NO: 38132 - DNA, 28 bp, Artificial Sequence
  Synthetic
gttgttctaagccuttaagttttguggt

SEQ ID NO: 38133 - DNA, 24 bp, Artificial Sequence
  Synthetic
gctcaaggataucagcagctttuc

SEQ ID NO: 38134 - DNA, 25 bp, Artificial Sequence
  Synthetic
cagaatcacagucccagtagattuc

SEQ ID NO: 38135 - DNA, 29 bp, Artificial Sequence
  Synthetic
ggagggttgautgatggactauagaaaat

SEQ ID NO: 38136 - DNA, 21 bp, Artificial Sequence
  Synthetic
agcactcugcctaactcccua

SEQ ID NO: 38137 - DNA, 27 bp, Artificial Sequence
  Synthetic
cctatcatctcugtgtttctcctucag

SEQ ID NO: 38138 - DNA, 27 bp, Artificial Sequence
  Synthetic
ctgaaaatttgacutactgtgccaucc

SEQ ID NO: 38139 - DNA, 28 bp, Artificial Sequence
  Synthetic
tgaggagcagguttctatatgagagtut

SEQ ID NO: 38140 - DNA, 24 bp, Artificial Sequence
  Synthetic
tcaggagguggtgaataaaugaac

SEQ ID NO: 38141 - DNA, 27 bp, Artificial Sequence
  Synthetic
ctaactggatgccutattcttggtgua

SEQ ID NO: 38142 - DNA, 23 bp, Artificial Sequence
  Synthetic
tgtcuaccccaaattcuccaggt

SEQ ID NO: 38143 - DNA, 22 bp, Artificial Sequence
  Synthetic
tctgcccgucttcctgtagtua

SEQ ID NO: 38144 - DNA, 26 bp, Artificial Sequence
  Synthetic
agattcaccuccaatcagttuggaag

SEQ ID NO: 38145 - DNA, 26 bp, Artificial Sequence
  Synthetic
tcacgttggaaugtgctttttcttut

SEQ ID NO: 38146 - DNA, 27 bp, Artificial Sequence
  Synthetic
ggaggauggagagaattatgcaaauca

SEQ ID NO: 38147 - DNA, 30 bp, Artificial Sequence; identical to SEQ ID NO: 25913
  Synthetic

SEQ ID NO: 38148 - DNA, 19 bp, Artificial Sequence
  Synthetic
gcagcagagcucaggguag

SEQ ID NO: 38149 - DNA, 17 bp, Artificial Sequence
  Synthetic
cgacgacutcgcucgga

SEQ ID NO: 38150 - DNA, 22 bp, Artificial Sequence
  Synthetic
gcatatcuttgagggugggaca

SEQ ID NO: 38151 - DNA, 28 bp, Artificial Sequence
  Synthetic
tgtcttggtagagacugtgatatgtcut

SEQ ID NO: 38152 - DNA, 22 bp, Artificial Sequence
  Synthetic
gggctggutctccaaaucagaa

SEQ ID NO: 38153 - DNA, 26 bp, Artificial Sequence
  Synthetic
caatagaagcugaatttggtgtgcug

SEQ ID NO: 38154 - DNA, 26 bp, Artificial Sequence
  Synthetic
cagaatccttaucactgtcactguca

SEQ ID NO: 38155 - DNA, 23 bp, Artificial Sequence
  Synthetic
ctttucagacagccgatcaucag

SEQ ID NO: 38156 - DNA, 25 bp, Artificial Sequence
  Synthetic
tgccgtgttutgtattttcgttucc

SEQ ID NO: 38157 - DNA, 29 bp, Artificial Sequence
  Synthetic
ccagagctcatuattctagacagtctuca

SEQ ID NO: 38158 - DNA, 23 bp, Artificial Sequence
  Synthetic
cgatctctatutctgctccguga

SEQ ID NO: 38159 - DNA, 28 bp, Artificial Sequence
  Synthetic
gaaagcatcaugggaagaaaagaaugaa

SEQ ID NO: 38160 - DNA, 25 bp, Artificial Sequence
  Synthetic
ttcaggtttcugggagatgacaaug

SEQ ID NO: 38161 - DNA, 30 bp, Artificial Sequence; identical to SEQ ID NO: 25927
  Synthetic

SEQ ID NO: 38162 - DNA, 21 bp, Artificial Sequence
  Synthetic
tgtatcugagacgtggcucct

SEQ ID NO: 38163 - DNA, 23 bp, Artificial Sequence
  Synthetic
aaggcagccautctgattctuca

SEQ ID NO: 38164 - DNA, 27 bp, Artificial Sequence
  Synthetic
tcttaaaucagacacaaatgccugact

SEQ ID NO: 38165 - DNA, 29 bp, Artificial Sequence
  Synthetic
gtgctcgagtuagaaatattgaagauggt

SEQ ID NO: 38166 - DNA, 28 bp, Artificial Sequence
  Synthetic
gaggaatttcaacauctctaggtctugt

SEQ ID NO: 38167 - DNA, 27 bp, Artificial Sequence
  Synthetic
cagaagatgacutcaaggagtatgucc

SEQ ID NO: 38168 - DNA, 28 bp, Artificial Sequence
  Synthetic
gcagcgatcuaagtaagacacattauca

SEQ ID NO: 38169 - DNA, 31 bp, Artificial Sequence; identical to SEQ ID NO: 25935
  Synthetic

SEQ ID NO: 38170 - DNA, 17 bp, Artificial Sequence
  Synthetic
ggauccgcgaaggcgua

SEQ ID NO: 38171 - DNA, 21 bp, Artificial Sequence
  Synthetic
gaaggcgggugttgtgtttug

SEQ ID NO: 38172 - DNA, 20 bp, Artificial Sequence
  Synthetic
cagcccagucagtcagucac

SEQ ID NO: 38173 - DNA, 19 bp, Artificial Sequence
  Synthetic
agutaccgttugcccggaa

SEQ ID NO: 38174 - DNA, 24 bp, Artificial Sequence
  Synthetic
agagagctcugaggactgatctug

SEQ ID NO: 38175 - DNA, 20 bp, Artificial Sequence
  Synthetic
tgcagggcuctacaggctua

SEQ ID NO: 38176 - DNA, 21 bp, Artificial Sequence
  Synthetic
caggtaaccuggctccaacug

SEQ ID NO: 38177 - DNA, 27 bp, Artificial Sequence
  Synthetic
caactctgguttgaaagttguaagagg

SEQ ID NO: 38178 - DNA, 25 bp, Artificial Sequence
  Synthetic
aguaacatttctgttuccacagggt

SEQ ID NO: 38179 - DNA, 25 bp, Artificial Sequence
  Synthetic
cattaatccugttcccatguccaca

SEQ ID NO: 38180 - DNA, 22 bp, Artificial Sequence
  Synthetic
gcctatttgcugaccacacucc

SEQ ID NO: 38181 - DNA, 23 bp, Artificial Sequence
  Synthetic
aggatcctacutgggagacugac

SEQ ID NO: 38182 - DNA, 26 bp, Artificial Sequence
  Synthetic
gataactguaaaagggctctctcucc

SEQ ID NO: 38183 - DNA, 22 bp, Artificial Sequence
  Synthetic
gccagactgutctgagtccuga

SEQ ID NO: 38184 - DNA, 24 bp, Artificial Sequence
  Synthetic
cttcctgaggutcattaccaccug

SEQ ID NO: 38185 - DNA, 28 bp, Artificial Sequence
  Synthetic
aaggttcacacucctctgatatuagagt

SEQ ID NO: 38186 - DNA, 23 bp, Artificial Sequence
  Synthetic
cagctcaagcucttcaaaacgug

SEQ ID NO: 38187 - DNA, 22 bp, Artificial Sequence
  Synthetic
cctattgugggtggugaacact

SEQ ID NO: 38188 - DNA, 25 bp, Artificial Sequence
  Synthetic
atcttcatgugaccccttagttugg

SEQ ID NO: 38189 - DNA, 26 bp, Artificial Sequence
  Synthetic
tctctaggccucagtttcccttttua

SEQ ID NO: 38190 - DNA, 21 bp, Artificial Sequence
  Synthetic
tgggcugggacacatuaaagg

SEQ ID NO: 38191 - DNA, 25 bp, Artificial Sequence
  Synthetic
aaattgattcctcutcacccctgut

SEQ ID NO: 38192 - DNA, 22 bp, Artificial Sequence
  Synthetic
cttttcuggcatctucccacag

SEQ ID NO: 38193 - DNA, 23 bp, Artificial Sequence
  Synthetic
tcatgccttucaagacactgcut

SEQ ID NO: 38194 - DNA, 23 bp, Artificial Sequence
  Synthetic
tcattcaucccccaagucacaag

SEQ ID NO: 38195 - DNA, 21 bp, Artificial Sequence
  Synthetic
cctagccucaccccttcatug

SEQ ID NO: 38196 - DNA, 21 bp, Artificial Sequence
  Synthetic
ccacatctucacctggcagut

SEQ ID NO: 38197 - DNA, 22 bp, Artificial Sequence
  Synthetic
ccgtgtccucctatcccttuag

SEQ ID NO: 38198 - DNA, 24 bp, Artificial Sequence
  Synthetic
agtctggaggaccacutaaaggua

SEQ ID NO: 38199 - DNA, 23 bp, Artificial Sequence
  Synthetic
gcttctggutgtccttcttuccc

SEQ ID NO: 38200 - DNA, 20 bp, Artificial Sequence
  Synthetic
caagacggucagcacucaac

SEQ ID NO: 38201 - DNA, 23 bp, Artificial Sequence
  Synthetic
gatggaggaugaggtgctactuc

SEQ ID NO: 38202 - DNA, 23 bp, Artificial Sequence
  Synthetic
ccctgccccgaguaattataucg

SEQ ID NO: 38203 - DNA, 20 bp, Artificial Sequence
  Synthetic
tgacaaccccuccctcaugt

SEQ ID NO: 38204 - DNA, 18 bp, Artificial Sequence
  Synthetic
cccacagagguggtcugg

SEQ ID NO: 38205 - DNA, 19 bp, Artificial Sequence
  Synthetic
cgtcccauctgtccuggaa

SEQ ID NO: 38206 - DNA, 23 bp, Artificial Sequence
  Synthetic
ccatgtctgtucctggaggtcua

SEQ ID NO: 38207 - DNA, 25 bp, Artificial Sequence
  Synthetic
ggccagtcacuatatccacattguc

SEQ ID NO: 38208 - DNA, 22 bp, Artificial Sequence
  Synthetic
ggctgggccauatgatatcuga

SEQ ID NO: 38209 - DNA, 25 bp, Artificial Sequence
  Synthetic
gactgcttttccutctcactctgut

SEQ ID NO: 38210 - DNA, 21 bp, Artificial Sequence
  Synthetic
cguatgcttcaaugcacccat

SEQ ID NO: 38211 - DNA, 23 bp, Artificial Sequence
  Synthetic
gcacccucagtgatttctauccc

SEQ ID NO: 38212 - DNA, 23 bp, Artificial Sequence
  Synthetic
cacagttgccaucattgtcuacc

SEQ ID NO: 38213 - DNA, 28 bp, Artificial Sequence
  Synthetic
ctcatcagcatuatttccttgtgttugt

SEQ ID NO: 38214 - DNA, 28 bp, Artificial Sequence
  Synthetic
gcttccacacacauctgtaggatuaaat

SEQ ID NO: 38215 - DNA, 29 bp, Artificial Sequence
  Synthetic
tcctatagcagugtctaatttgtcaugaa

SEQ ID NO: 38216 - DNA, 30 bp, Artificial Sequence; identical to SEQ ID NO: 25982
  Synthetic

SEQ ID NO: 38217 - DNA, 27 bp, Artificial Sequence
  Synthetic
ccacttaacatguatggcagaagcaua

SEQ ID NO: 38218 - DNA, 28 bp, Artificial Sequence
  Synthetic
actcacgtatguataaagcctagucagt

SEQ ID NO: 38219 - DNA, 25 bp, Artificial Sequence
  Synthetic
tgaccagttuatacagttggtugcc

SEQ ID NO: 38220 - DNA, 24 bp, Artificial Sequence
  Synthetic
gatgagcaagauaggaaggcagut

SEQ ID NO: 38221 - DNA, 30 bp, Artificial Sequence; identical to SEQ ID NO: 25987
  Synthetic

SEQ ID NO: 38222 - DNA, 26 bp, Artificial Sequence
  Synthetic
tctgacaaaaacagccautagacuga

SEQ ID NO: 38223 - DNA, 28 bp, Artificial Sequence
  Synthetic
tctatcagacaugccataacaaaacugg

SEQ ID NO: 38224 - DNA, 22 bp, Artificial Sequence
  Synthetic
ggcatcaaaccugtctccauga

SEQ ID NO: 38225 - DNA, 29 bp, Artificial Sequence
  Synthetic
gttcttatatctttauttctccccggcut

SEQ ID NO: 38226 - DNA, 28 bp, Artificial Sequence
  Synthetic
caagtaccacaacaucaagtucaaagaa

SEQ ID NO: 38227 - DNA, 30 bp, Artificial Sequence; identical to SEQ ID NO: 25993
  Synthetic

SEQ ID NO: 38228 - DNA, 25 bp, Artificial Sequence
  Synthetic
ctctgcagauaaccataggttucca

SEQ ID NO: 38229 - DNA, 22 bp, Artificial Sequence
  Synthetic
cctacttucgagctactgucca

SEQ ID NO: 38230 - DNA, 19 bp, Artificial Sequence
  Synthetic
tggtgccacucaagctucc

SEQ ID NO: 38231 - DNA, 21 bp, Artificial Sequence
  Synthetic
ctccaacacauccauggcaga

SEQ ID NO: 38232 - DNA, 21 bp, Artificial Sequence
  Synthetic
catctgcautgggatcugcac

SEQ ID NO: 38233 - DNA, 21 bp, Artificial Sequence
  Synthetic
ccagugagcaatgugagcaac

SEQ ID NO: 38234 - DNA, 21 bp, Artificial Sequence
  Synthetic
gaactcgtuccagcacucgat

SEQ ID NO: 38235 - DNA, 23 bp, Artificial Sequence
  Synthetic
ccatcatguacggcaagttcucc

SEQ ID NO: 38236 - DNA, 19 bp, Artificial Sequence
  Synthetic
gccagguccttgugaacca

SEQ ID NO: 38237 - DNA, 21 bp, Artificial Sequence
  Synthetic
ccccugagcatgatctucagc

SEQ ID NO: 38238 - DNA, 24 bp, Artificial Sequence
  Synthetic
gctttgtcctucagcgttttgaug

SEQ ID NO: 38239 - DNA, 21 bp, Artificial Sequence
  Synthetic
cggtgacagugatgttucacg

SEQ ID NO: 38240 - DNA, 21 bp, Artificial Sequence
  Synthetic
ccutctgcttatuccggcaca

SEQ ID NO: 38241 - DNA, 29 bp, Artificial Sequence
  Synthetic
ggttgguagagaacttagaguagaaaagg

SEQ ID NO: 38242 - DNA, 17 bp, Artificial Sequence
  Synthetic
gggtuccggcaguaggc

SEQ ID NO: 38243 - DNA, 24 bp, Artificial Sequence
  Synthetic
gtgtaggcagaauggttttgtugt

SEQ ID NO: 38244 - DNA, 19 bp, Artificial Sequence
  Synthetic
gggcgauggtgtactccug

SEQ ID NO: 38245 - DNA, 17 bp, Artificial Sequence
  Synthetic
cccgcuaacgcgaguct

SEQ ID NO: 38246 - DNA, 22 bp, Artificial Sequence
  Synthetic
aaagacatgagcuggcaggaut

SEQ ID NO: 38247 - DNA, 31 bp, Artificial Sequence; identical to SEQ ID NO: 26013
  Synthetic

SEQ ID NO: 38248 - DNA, 22 bp, Artificial Sequence
  Synthetic
ggattcgcagucgtgaaccaua

SEQ ID NO: 38249 - DNA, 22 bp, Artificial Sequence
  Synthetic
tcttttgugaccgctctcctug

SEQ ID NO: 38250 - DNA, 18 bp, Artificial Sequence
  Synthetic
caagcgagccgugagcua

SEQ ID NO: 38251 - DNA, 19 bp, Artificial Sequence
  Synthetic
cgaagctcugagggctucc

SEQ ID NO: 38252 - DNA, 22 bp, Artificial Sequence
  Synthetic
aggagaacctugtcctcctcut

SEQ ID NO: 38253 - DNA, 19 bp, Artificial Sequence
  Synthetic
actgaccacggccugttug

SEQ ID NO: 38254 - DNA, 20 bp, Artificial Sequence
  Synthetic
gaagccgucacagtggugat

SEQ ID NO: 38255 - DNA, 22 bp, Artificial Sequence
  Synthetic
gcgcagagacgcutttgaaaut

SEQ ID NO: 38256 - DNA, 24 bp, Artificial Sequence
  Synthetic
cgtctgggaacuatactccgaguc

SEQ ID NO: 38257 - DNA, 20 bp, Artificial Sequence
  Synthetic
agtguggccagcagguaaat

SEQ ID NO: 38258 - DNA, 22 bp, Artificial Sequence
  Synthetic
ccggcccaaucacaatgattuc

SEQ ID NO: 38259 - DNA, 25 bp, Artificial Sequence
  Synthetic
gatcttgugaacatcctcatugcac

SEQ ID NO: 38260 - DNA, 21 bp, Artificial Sequence
  Synthetic
cagaagcgaucaggaugacca

SEQ ID NO: 38261 - DNA, 23 bp, Artificial Sequence
  Synthetic
tgatcugaaccgaggacacctua

SEQ ID NO: 38262 - DNA, 21 bp, Artificial Sequence
  Synthetic
cccaggcucgtatagttgcug

SEQ ID NO: 38263 - DNA, 27 bp, Artificial Sequence
  Synthetic
agtcagtaagcuttcatgcaaagtuct

SEQ ID NO: 38264 - DNA, 19 bp, Artificial Sequence
  Synthetic
tgacccaagccgucaggua

SEQ ID NO: 38265 - DNA, 21 bp, Artificial Sequence
  Synthetic
tgtaatgctgugcgaagcuca

SEQ ID NO: 38266 - DNA, 23 bp, Artificial Sequence
  Synthetic
acaaaggaaccugttgaagcuga

SEQ ID NO: 38267 - DNA, 28 bp, Artificial Sequence
  Synthetic
aacaugtatatagucacccagaaagcag

SEQ ID NO: 38268 - DNA, 26 bp, Artificial Sequence
  Synthetic
aagtagaagcaauctgatgaacucca

SEQ ID NO: 38269 - DNA, 19 bp, Artificial Sequence
  Synthetic
tgctcucccagttcuccga

SEQ ID NO: 38270 - DNA, 20 bp, Artificial Sequence
  Synthetic
tgtagtacacgugcgtgugg

SEQ ID NO: 38271 - DNA, 22 bp, Artificial Sequence
  Synthetic
tgcaacatgtutcccctcctut

SEQ ID NO: 38272 - DNA, 22 bp, Artificial Sequence
  Synthetic
ggaucaccacagccttcaucac

SEQ ID NO: 38273 - DNA, 20 bp, Artificial Sequence
  Synthetic
catgtccagugcagctcuca

SEQ ID NO: 38274 - DNA, 22 bp, Artificial Sequence
  Synthetic
cauttgucaacggacagcagat

SEQ ID NO: 38275 - DNA, 20 bp, Artificial Sequence
  Synthetic
tgttctgugcccccattgut

SEQ ID NO: 38276 - DNA, 20 bp, Artificial Sequence
  Synthetic
gccgatucgaaggtgggtut

SEQ ID NO: 38277 - DNA, 22 bp, Artificial Sequence
  Synthetic
actgatgatgugccttccctug

SEQ ID NO: 38278 - DNA, 22 bp, Artificial Sequence
  Synthetic
gtgttttgcuctccaccctuct

SEQ ID NO: 38279 - DNA, 25 bp, Artificial Sequence
  Synthetic
gaaatgctgaauaaggctgaggtug

SEQ ID NO: 38280 - DNA, 27 bp, Artificial Sequence
  Synthetic
tgutcaaaactgaaauggaacaaacaa

SEQ ID NO: 38281 - DNA, 27 bp, Artificial Sequence
  Synthetic
catggcctcutctttttaacttugaca

SEQ ID NO: 38282 - DNA, 20 bp, Artificial Sequence
  Synthetic
cgccttaccugctgctcaut

SEQ ID NO: 38283 - DNA, 24 bp, Artificial Sequence
  Synthetic
agaccccuaaagaagaaggtgcua

SEQ ID NO: 38284 - DNA, 19 bp, Artificial Sequence
  Synthetic
tcuaucaaccgcgaggagg

SEQ ID NO: 38285 - DNA, 20 bp, Artificial Sequence
  Synthetic
tcgcggugggatuaaaagca

SEQ ID NO: 38286 - DNA, 23 bp, Artificial Sequence
  Synthetic
aagugggaggagagagtcugaaa

SEQ ID NO: 38287 - DNA, 17 bp, Artificial Sequence
  Synthetic
catggccucggctggua

SEQ ID NO: 38288 - DNA, 28 bp, Artificial Sequence
  Synthetic
ctttttcttctccuccgttttcttctuc

SEQ ID NO: 38289 - DNA, 23 bp, Artificial Sequence
  Synthetic
gagggccauggaactgcttaaua

SEQ ID NO: 38290 - DNA, 31 bp, Artificial Sequence; identical to SEQ ID NO: 26056
  Synthetic

SEQ ID NO: 38291 - DNA, 24 bp, Artificial Sequence
  Synthetic
gaucaacagaagaacccaguggaa

SEQ ID NO: 38292 - DNA, 28 bp, Artificial Sequence
  Synthetic
tccaatctctccutatactgctgatcut

SEQ ID NO: 38293 - DNA, 29 bp, Artificial Sequence
  Synthetic
tttgctgatacaguctattttctccucag

SEQ ID NO: 38294 - DNA, 28 bp, Artificial Sequence
  Synthetic
tgtactgcctautcactattgtttgugg

SEQ ID NO: 38295 - DNA, 28 bp, Artificial Sequence
  Synthetic
gctactcaggaggcutaaaaatatcugt

SEQ ID NO: 38296 - DNA, 21 bp, Artificial Sequence
  Synthetic
ggcggaucaccaagcaatcua

SEQ ID NO: 38297 - DNA, 28 bp, Artificial Sequence
  Synthetic
caaactatttuccattctgcatcuccag

SEQ ID NO: 38298 - DNA, 24 bp, Artificial Sequence
  Synthetic
tcaugaaccucagaagacaagaga

SEQ ID NO: 38299 - DNA, 24 bp, Artificial Sequence
  Synthetic
gtcttcttccugttcccttgucag

SEQ ID NO: 38300 - DNA, 27 bp, Artificial Sequence
  Synthetic
aatgattgtactuacctgccagagtuc

SEQ ID NO: 38301 - DNA, 22 bp, Artificial Sequence
  Synthetic
cctgaugcaggagcacatguat

SEQ ID NO: 38302 - DNA, 23 bp, Artificial Sequence
  Synthetic
tttgaagccaaggauggtgtuat

SEQ ID NO: 38303 - DNA, 26 bp, Artificial Sequence
  Synthetic
gtctttgtgugaatctttttccugca

SEQ ID NO: 38304 - DNA, 24 bp, Artificial Sequence
  Synthetic
ttaaatctguggtgtggcaaugac

SEQ ID NO: 38305 - DNA, 29 bp, Artificial Sequence
  Synthetic
cattctggtgtucttcacttattaccuca

SEQ ID NO: 38306 - DNA, 33 bp, Artificial Sequence; identical to SEQ ID NO: 26072
  Synthetic

SEQ ID NO: 38307 - DNA, 26 bp, Artificial Sequence
  Synthetic
ggtaggtgtutcttggaaatguggaa

SEQ ID NO: 38308 - DNA, 32 bp, Artificial Sequence; identical to SEQ ID NO: 26074
  Synthetic

SEQ ID NO: 38309 - DNA, 28 bp, Artificial Sequence
  Synthetic
gttaggtaaaatggugtatcctggcuat

SEQ ID NO: 38310 - DNA, 29 bp, Artificial Sequence
  Synthetic
tcaaaaagucatcaagacuccaaaagaca

SEQ ID NO: 38311 - DNA, 26 bp, Artificial Sequence
  Synthetic
ctccgagtaauctagctagcttucac

SEQ ID NO: 38312 - DNA, 22 bp, Artificial Sequence
  Synthetic
caaagcccacgcuctttcuact

SEQ ID NO: 38313 - DNA, 28 bp, Artificial Sequence
  Synthetic
tttgtgaactagauctgtgaatctugca

SEQ ID NO: 38314 - DNA, 28 bp, Artificial Sequence
  Synthetic
tcaaccttgaucaatagaagucaaaagt

SEQ ID NO: 38315 - DNA, 24 bp, Artificial Sequence
  Synthetic
ggtctgtcatucaccatttgacug

SEQ ID NO: 38316 - DNA, 21 bp, Artificial Sequence
  Synthetic
atttaggacugcatgcuggct

SEQ ID NO: 38317 - DNA, 29 bp, Artificial Sequence
  Synthetic
accatccccttaguattaggtgaaatcut

SEQ ID NO: 38318 - DNA, 24 bp, Artificial Sequence
  Synthetic
tuactggcatcuagaacagcaagg

SEQ ID NO: 38319 - DNA, 29 bp, Artificial Sequence
  Synthetic
tccctaggtctaaucctcttctttcttut

SEQ ID NO: 38320 - DNA, 20 bp, Artificial Sequence
  Synthetic
gtcagucgtccagugccaat

SEQ ID NO: 38321 - DNA, 25 bp, Artificial Sequence
  Synthetic
gccttctttucattttccctugcag

SEQ ID NO: 38322 - DNA, 29 bp, Artificial Sequence
  Synthetic
aaattccctctauagctatggaaagucct

SEQ ID NO: 38323 - DNA, 28 bp, Artificial Sequence
  Synthetic
tcgatattgtaacacuctgagtttgcut

SEQ ID NO: 38324 - DNA, 30 bp, Artificial Sequence; identical to SEQ ID NO: 26090
  Synthetic

SEQ ID NO: 38325 - DNA, 25 bp, Artificial Sequence
  Synthetic
ctgaggcttguttgattctgggaua

SEQ ID NO: 38326 - DNA, 24 bp, Artificial Sequence
  Synthetic
tgacauggctattagugcacaagg

SEQ ID NO: 38327 - DNA, 29 bp, Artificial Sequence
  Synthetic
aggtacttaggaauggcaaatttgtuaca

SEQ ID NO: 38328 - DNA, 22 bp, Artificial Sequence
  Synthetic
ccctcacuggagtcttccacut

SEQ ID NO: 38329 - DNA, 29 bp, Artificial Sequence
  Synthetic
ggttaatttgctugtgtttactttgguga

SEQ ID NO: 38330 - DNA, 21 bp, Artificial Sequence
  Synthetic
actgaggatuccctggaccut

SEQ ID NO: 38331 - DNA, 28 bp, Artificial Sequence
  Synthetic
tcttcacccccugaatcatttcattuaa

SEQ ID NO: 38332 - DNA, 19 bp, Artificial Sequence
  Synthetic
ctgctcaguctctccugct

SEQ ID NO: 38333 - DNA, 17 bp, Artificial Sequence
  Synthetic
gccaggacccugaccuc

SEQ ID NO: 38334 - DNA, 22 bp, Artificial Sequence
  Synthetic
cctactgtgaccucagccacua

SEQ ID NO: 38335 - DNA, 21 bp, Artificial Sequence
  Synthetic
gccagggaguaaaccuggaag

SEQ ID NO: 38336 - DNA, 21 bp, Artificial Sequence
  Synthetic
ccggtttugggtatggguact

SEQ ID NO: 38337 - DNA, 19 bp, Artificial Sequence
  Synthetic
gtggcccuacctacccaug

SEQ ID NO: 38338 - DNA, 19 bp, Artificial Sequence
  Synthetic
caggtgggutagcacguga

SEQ ID NO: 38339 - DNA, 22 bp, Artificial Sequence
  Synthetic
gttggcttaguctccccatcug

SEQ ID NO: 38340 - DNA, 21 bp, Artificial Sequence
  Synthetic
gggaggaaccagaugtccaug

SEQ ID NO: 38341 - DNA, 17 bp, Artificial Sequence
  Synthetic
ctggccugcctctgcua

SEQ ID NO: 38342 - DNA, 20 bp, Artificial Sequence
  Synthetic
gccacaaugctggcatugag

SEQ ID NO: 38343 - DNA, 20 bp, Artificial Sequence
  Synthetic
gtggcacagacugtguccat

SEQ ID NO: 38344 - DNA, 17 bp, Artificial Sequence
  Synthetic
ccauacccggccgagug

SEQ ID NO: 38345 - DNA, 17 bp, Artificial Sequence
  Synthetic
aggtgcgcgugtctcug

SEQ ID NO: 38346 - DNA, 20 bp, Artificial Sequence
  Synthetic
gggtuggagggaacacacuc

SEQ ID NO: 38347 - DNA, 22 bp, Artificial Sequence
  Synthetic
tctgactggacugtgtgtguct

SEQ ID NO: 38348 - DNA, 17 bp, Artificial Sequence
  Synthetic
gggcgugagcucaggat

SEQ ID NO: 38349 - DNA, 17 bp, Artificial Sequence
  Synthetic
gcccugccacuggacac

SEQ ID NO: 38350 - DNA, 23 bp, Artificial Sequence
  Synthetic
tcagccactcugcttacaatguc

SEQ ID NO: 38351 - DNA, 23 bp, Artificial Sequence
  Synthetic
gtggaugaacagcaccttgttuc

SEQ ID NO: 38352 - DNA, 21 bp, Artificial Sequence
  Synthetic
catcatgucctagcccugacc

SEQ ID NO: 38353 - DNA, 27 bp, Artificial Sequence
  Synthetic
gtgttcgctttutccccttttaatuca

SEQ ID NO: 38354 - DNA, 19 bp, Artificial Sequence
  Synthetic
ctgtucagaccacccucgt

SEQ ID NO: 38355 - DNA, 24 bp, Artificial Sequence
  Synthetic
actcctgatuggctttgtcttucc

SEQ ID NO: 38356 - DNA, 21 bp, Artificial Sequence
  Synthetic
tgtctcagggucactcaggut

SEQ ID NO: 38357 - DNA, 17 bp, Artificial Sequence
  Synthetic
ccaggucgctcccucac

SEQ ID NO: 38358 - DNA, 23 bp, Artificial Sequence
  Synthetic
ctgtccttgccuacttcttccut

SEQ ID NO: 38359 - DNA, 21 bp, Artificial Sequence
  Synthetic
aggagguagcggtcctcauac

SEQ ID NO: 38360 - DNA, 20 bp, Artificial Sequence
  Synthetic
ctccugacagccctctgtuc

SEQ ID NO: 38361 - DNA, 21 bp, Artificial Sequence
  Synthetic
gatgctagugctccctgcuaa

SEQ ID NO: 38362 - DNA, 21 bp, Artificial Sequence
  Synthetic
cacctgugctgtctcttucct

SEQ ID NO: 38363 - DNA, 19 bp, Artificial Sequence
  Synthetic
aggaccaaggaugggugga

SEQ ID NO: 38364 - DNA, 21 bp, Artificial Sequence
  Synthetic
ggtguccagggactggtaugt

SEQ ID NO: 38365 - DNA, 20 bp, Artificial Sequence
  Synthetic
ccttcgagucccaacaggug

SEQ ID NO: 38366 - DNA, 20 bp, Artificial Sequence
  Synthetic
ggtgggtgacuctgagccut

SEQ ID NO: 38367 - DNA, 20 bp, Artificial Sequence
  Synthetic
cagggatcuctgggttugct

SEQ ID NO: 38368 - DNA, 22 bp, Artificial Sequence
  Synthetic
gcctccctaguggtatcctgut

SEQ ID NO: 38369 - DNA, 24 bp, Artificial Sequence
  Synthetic
ctcctcattguagagagacagugg

SEQ ID NO: 38370 - DNA, 22 bp, Artificial Sequence
  Synthetic
gctgagcugacaagcttcuact

SEQ ID NO: 38371 - DNA, 21 bp, Artificial Sequence
  Synthetic
cctttacaccuggaggctcug

SEQ ID NO: 38372 - DNA, 21 bp, Artificial Sequence
  Synthetic
gggaaggucaagaggcattuc

SEQ ID NO: 38373 - DNA, 27 bp, Artificial Sequence
  Synthetic
aatgagactcaucatgaacacagcuaa

SEQ ID NO: 38374 - DNA, 23 bp, Artificial Sequence
  Synthetic
caagtcttugcccagttctguct

SEQ ID NO: 38375 - DNA, 19 bp, Artificial Sequence
  Synthetic
cattcagcagucgguggga

SEQ ID NO: 38376 - DNA, 20 bp, Artificial Sequence
  Synthetic
ggtcttgguctcaccgtugt

SEQ ID NO: 38377 - DNA, 25 bp, Artificial Sequence
  Synthetic
cagtgtgagugagtgtcagtguaat

SEQ ID NO: 38378 - DNA, 21 bp, Artificial Sequence
  Synthetic
cctgcagcugtcctcugaaag

SEQ ID NO: 38379 - DNA, 24 bp, Artificial Sequence
  Synthetic
gcutgataccucccaaaaacggat

SEQ ID NO: 38380 - DNA, 23 bp, Artificial Sequence
  Synthetic
ggagacatacugtctgggtcuga

SEQ ID NO: 38381 - DNA, 28 bp, Artificial Sequence
  Synthetic
tcggatttttcacuttgctcatgtttut

SEQ ID NO: 38382 - DNA, 21 bp, Artificial Sequence
  Synthetic
agcugaacaagucaaggacac

SEQ ID NO: 38383 - DNA, 26 bp, Artificial Sequence
  Synthetic
gaacaagctagauacaatcagcucca

SEQ ID NO: 38384 - DNA, 22 bp, Artificial Sequence
  Synthetic
caaaaagcaagcuccacctguc

SEQ ID NO: 38385 - DNA, 22 bp, Artificial Sequence
  Synthetic
ccctcccuctgctttacaauca

SEQ ID NO: 38386 - DNA, 26 bp, Artificial Sequence
  Synthetic
gtgggagtgugaagaatgattctugt

SEQ ID NO: 38387 - DNA, 25 bp, Artificial Sequence
  Synthetic
acugaggagctgtuaaagaaagcaa

SEQ ID NO: 38388 - DNA, 23 bp, Artificial Sequence
  Synthetic
ggactgggagugaagatacuggt

SEQ ID NO: 38389 - DNA, 22 bp, Artificial Sequence
  Synthetic
agacagtcucccaggttcucag

SEQ ID NO: 38390 - DNA, 23 bp, Artificial Sequence
  Synthetic
cctgtgagcaauggcacaaaauc

SEQ ID NO: 38391 - DNA, 28 bp, Artificial Sequence
  Synthetic
tgacttcagttguctttgtttctctuca

SEQ ID NO: 38392 - DNA, 22 bp, Artificial Sequence
  Synthetic
gcttctcaaagugaggctugca

SEQ ID NO: 38393 - DNA, 27 bp, Artificial Sequence
  Synthetic
gtgttcatatatgutctgcccttguct

SEQ ID NO: 38394 - DNA, 27 bp, Artificial Sequence
  Synthetic
tttcccaaccacauactaaatcugacc

SEQ ID NO: 38395 - DNA, 26 bp, Artificial Sequence
  Synthetic
cccctgtgttcutctcttccatttua

SEQ ID NO: 38396 - DNA, 27 bp, Artificial Sequence
  Synthetic
gctgagatttggugagacacagaauag

SEQ ID NO: 38397 - DNA, 29 bp, Artificial Sequence
  Synthetic
gcactgagtugacactctgaagtattuaa

SEQ ID NO: 38398 - DNA, 30 bp, Artificial Sequence; identical to SEQ ID NO: 26164
  Synthetic

SEQ ID NO: 38399 - DNA, 25 bp, Artificial Sequence
  Synthetic
ctcttctcaacgggutccttttcua

SEQ ID NO: 38400 - DNA, 30 bp, Artificial Sequence; identical to SEQ ID NO: 26166
  Synthetic

SEQ ID NO: 38401 - DNA, 27 bp, Artificial Sequence
  Synthetic
gactgccctugttcttttacatttuca

SEQ ID NO: 38402 - DNA, 24 bp, Artificial Sequence
  Synthetic
tgtatcagcaggautctaguggct

SEQ ID NO: 38403 - DNA, 20 bp, Artificial Sequence
  Synthetic
gcctucgagcgagagaaugg

SEQ ID NO: 38404 - DNA, 17 bp, Artificial Sequence
  Synthetic
ccagtguccgtcgcguc

SEQ ID NO: 38405 - DNA, 20 bp, Artificial Sequence
  Synthetic
ggcagaacucaccttugcct

SEQ ID NO: 38406 - DNA, 20 bp, Artificial Sequence
  Synthetic
cagcatctcuacggcacgua

SEQ ID NO: 38407 - DNA, 21 bp, Artificial Sequence
  Synthetic
ccatgccaagcutcagtguca

SEQ ID NO: 38408 - DNA, 21 bp, Artificial Sequence
  Synthetic
cuctgctucccagagacaagg

SEQ ID NO: 38409 - DNA, 26 bp, Artificial Sequence
  Synthetic
tgaagaataaaccagauggcttgugt

SEQ ID NO: 38410 - DNA, 19 bp, Artificial Sequence
  Synthetic
ggtggtgauggtgccctuc

SEQ ID NO: 38411 - DNA, 18 bp, Artificial Sequence
  Synthetic
acacggtugggtggcuac

SEQ ID NO: 38412 - DNA, 21 bp, Artificial Sequence
  Synthetic
cagacgtgguacctgcaucag

SEQ ID NO: 38413 - DNA, 21 bp, Artificial Sequence
  Synthetic
atgaagagugagcaccucaut

SEQ ID NO: 38414 - DNA, 23 bp, Artificial Sequence
  Synthetic
ggtcaaugactcagactuccagg

SEQ ID NO: 38415 - DNA, 23 bp, Artificial Sequence
  Synthetic
ccuttcaatctuccccagacagg

SEQ ID NO: 38416 - DNA, 23 bp, Artificial Sequence
  Synthetic
ccugtttgtgaaugacaccaagg

SEQ ID NO: 38417 - DNA, 22 bp, Artificial Sequence
  Synthetic
tgcagctguactgcttttcuca

SEQ ID NO: 38418 - DNA, 20 bp, Artificial Sequence
  Synthetic
gcaggauctgccuaggaggt

SEQ ID NO: 38419 - DNA, 22 bp, Artificial Sequence
  Synthetic
atgccctgautaaaccctgcut

SEQ ID NO: 38420 - DNA, 19 bp, Artificial Sequence
  Synthetic
cagagcauacgcagccugt

SEQ ID NO: 38421 - DNA, 20 bp, Artificial Sequence
  Synthetic
cctccggaaggucatcucag

SEQ ID NO: 38422 - DNA, 20 bp, Artificial Sequence
  Synthetic
ttcctccccugtcatccuca

SEQ ID NO: 38423 - DNA, 17 bp, Artificial Sequence
  Synthetic
cctgtgccuggcaggua

SEQ ID NO: 38424 - DNA, 20 bp, Artificial Sequence
  Synthetic
ctccuggaagacccaagcug

SEQ ID NO: 38425 - DNA, 21 bp, Artificial Sequence
  Synthetic
aatgagatgaggucgcccaug

SEQ ID NO: 38426 - DNA, 22 bp, Artificial Sequence
  Synthetic
catggccugacgactcgtgcua

SEQ ID NO: 38427 - DNA, 21 bp, Artificial Sequence
  Synthetic
catggugcacctgggauccct

SEQ ID NO: 38428 - DNA, 22 bp, Artificial Sequence
  Synthetic
cactggtccuttcactctcugc

SEQ ID NO: 38429 - DNA, 21 bp, Artificial Sequence
  Synthetic
agggaaugcacacagatgucc

SEQ ID NO: 38430 - DNA, 26 bp, Artificial Sequence
  Synthetic
ctgagttguatctagttguggcacat

SEQ ID NO: 38431 - DNA, 29 bp, Artificial Sequence
  Synthetic
aaatgcatgggaaautctaccatagagut

SEQ ID NO: 38432 - DNA, 26 bp, Artificial Sequence
  Synthetic
gttcttcagugcagaacaaatgauct

SEQ ID NO: 38433 - DNA, 29 bp, Artificial Sequence
  Synthetic
gagtccattaccuttcacaaagaaatgut

SEQ ID NO: 38434 - DNA, 20 bp, Artificial Sequence
  Synthetic
gcaccccaaggcuggaauaa

SEQ ID NO: 38435 - DNA, 21 bp, Artificial Sequence
  Synthetic
cctcttctucgctgtccucag

SEQ ID NO: 38436 - DNA, 17 bp, Artificial Sequence
  Synthetic
gaagugcggccagctug

SEQ ID NO: 38437 - DNA, 17 bp, Artificial Sequence
  Synthetic
ctctccucggctcugct

SEQ ID NO: 38438 - DNA, 21 bp, Artificial Sequence
  Synthetic
gagggtttgugacaggccuat

SEQ ID NO: 38439 - DNA, 22 bp, Artificial Sequence
  Synthetic
gagagggcuccaaaagtcacuc

SEQ ID NO: 38440 - DNA, 19 bp, Artificial Sequence
  Synthetic
tgcaugcgacacttggugt

SEQ ID NO: 38441 - DNA, 24 bp, Artificial Sequence
  Synthetic
ccctcttctaugggttccttguct

SEQ ID NO: 38442 - DNA, 18 bp, Artificial Sequence
  Synthetic
ccugggaggaagggcuca

SEQ ID NO: 38443 - DNA, 24 bp, Artificial Sequence
  Synthetic
acagagcuggaaaaagacaagguc

SEQ ID NO: 38444 - DNA, 22 bp, Artificial Sequence
  Synthetic
gccccttugcatgaagcaauac

SEQ ID NO: 38445 - DNA, 23 bp, Artificial Sequence
  Synthetic
cggagaagguaatggacgugaac

SEQ ID NO: 38446 - DNA, 23 bp, Artificial Sequence
  Synthetic
gggatctgutcactcagtugaga

SEQ ID NO: 38447 - DNA, 22 bp, Artificial Sequence
  Synthetic
catgagaugggcatggagaugt

SEQ ID NO: 38448 - DNA, 21 bp, Artificial Sequence
  Synthetic
cactcccuctttcctgtugca

SEQ ID NO: 38449 - DNA, 24 bp, Artificial Sequence
  Synthetic
gttaagacgcuttccagacugaca

SEQ ID NO: 38450 - DNA, 22 bp, Artificial Sequence
  Synthetic
cuaggacacagaucaggctcua

SEQ ID NO: 38451 - DNA, 30 bp, Artificial Sequence; identical to SEQ ID NO: 26217
  Synthetic

SEQ ID NO: 38452 - DNA, 23 bp, Artificial Sequence
  Synthetic
accatgtgccautcatcctucat

SEQ ID NO: 38453 - DNA, 20 bp, Artificial Sequence
  Synthetic
gcagccucactggtttccug

SEQ ID NO: 38454 - DNA, 22 bp, Artificial Sequence
  Synthetic
gcccacttcucatctcctgtuc

SEQ ID NO: 38455 - DNA, 22 bp, Artificial Sequence
  Synthetic
acactactcutgggcgauagct

SEQ ID NO: 38456 - DNA, 22 bp, Artificial Sequence
  Synthetic
agccagagaccauccttttcug

SEQ ID NO: 38457 - DNA, 23 bp, Artificial Sequence
  Synthetic
cctcgtggcuttttcctttgtug

SEQ ID NO: 38458 - DNA, 31 bp, Artificial Sequence; identical to SEQ ID NO: 26224
  Synthetic

SEQ ID NO: 38459 - DNA, 28 bp, Artificial Sequence
  Synthetic
cctccatataccaaugacaaaactguga

SEQ ID NO: 38460 - DNA, 28 bp, Artificial Sequence
  Synthetic
tgatgttcttacugtcaatcatggacuc

SEQ ID NO: 38461 - DNA, 26 bp, Artificial Sequence
  Synthetic
cacatgaggagaaugtacctcugaac

SEQ ID NO: 38462 - DNA, 27 bp, Artificial Sequence
  Synthetic
gccgttgatatuactgtggatacuagg

SEQ ID NO: 38463 - DNA, 28 bp, Artificial Sequence
  Synthetic
gttttggattucacaggcaatgtaauca

SEQ ID NO: 38464 - DNA, 21 bp, Artificial Sequence
  Synthetic
gtacctgauagccccauggac

SEQ ID NO: 38465 - DNA, 29 bp, Artificial Sequence
  Synthetic
aagaaccuaagauggaagaagaagaacac

SEQ ID NO: 38466 - DNA, 25 bp, Artificial Sequence
  Synthetic
gactctgtggautccgattcttcug

SEQ ID NO: 38467 - DNA, 23 bp, Artificial Sequence
  Synthetic
gaaacucactcuggaccaagagg

SEQ ID NO: 38468 - DNA, 24 bp, Artificial Sequence
  Synthetic
gggaatattcuggctctctuccat

SEQ ID NO: 38469 - DNA, 27 bp, Artificial Sequence
  Synthetic
gctgacactucaattgcatttucacaa

SEQ ID NO: 38470 - DNA, 23 bp, Artificial Sequence
  Synthetic
cctcaccauattcctcctgucca

SEQ ID NO: 38471 - DNA, 22 bp, Artificial Sequence
  Synthetic
tcgautgaauggcggaagaaaa

SEQ ID NO: 38472 - DNA, 30 bp, Artificial Sequence; identical to SEQ ID NO: 26238
  Synthetic

SEQ ID NO: 38473 - DNA, 27 bp, Artificial Sequence
  Synthetic
gtgccctucagaagtaacaaataugga

SEQ ID NO: 38474 - DNA, 23 bp, Artificial Sequence
  Synthetic
ctgaggaugccttttggttcuct

SEQ ID NO: 38475 - DNA, 23 bp, Artificial Sequence
  Synthetic
caccaccuccttctattcctugc

SEQ ID NO: 38476 - DNA, 25 bp, Artificial Sequence
  Synthetic
gacgtugaaacggaaaguggaaaaa

SEQ ID NO: 38477 - DNA, 24 bp, Artificial Sequence
  Synthetic
aattttgcccauccaccaaacauc

SEQ ID NO: 38478 - DNA, 30 bp, Artificial Sequence; identical to SEQ ID NO: 26244
  Synthetic

SEQ ID NO: 38479 - DNA, 27 bp, Artificial Sequence
  Synthetic
gtacaaacaaaagagguagcagcaauc

SEQ ID NO: 38480 - DNA, 24 bp, Artificial Sequence
  Synthetic
agcctctgaaucttttctctuggg

SEQ ID NO: 38481 - DNA, 25 bp, Artificial Sequence
  Synthetic
gtagacggaucactuaagagcaaca

SEQ ID NO: 38482 - DNA, 30 bp, Artificial Sequence; identical to SEQ ID NO: 26248
  Synthetic

SEQ ID NO: 38483 - DNA, 28 bp, Artificial Sequence
  Synthetic
cttgctttaguaggttagtgttgttugg

SEQ ID NO: 38484 - DNA, 24 bp, Artificial Sequence
  Synthetic
gcaccaucaatatttuacaacgca

SEQ ID NO: 38485 - DNA, 28 bp, Artificial Sequence
  Synthetic
accagcatuaaaaagagaggagaaaguc

SEQ ID NO: 38486 - DNA, 28 bp, Artificial Sequence
  Synthetic
aagtacttatagccucaagtcagaauca

SEQ ID NO: 38487 - DNA, 28 bp, Artificial Sequence
  Synthetic
ttccctagaagautacaccaaatgugac

SEQ ID NO: 38488 - DNA, 30 bp, Artificial Sequence; identical to SEQ ID NO: 26254
  Synthetic

SEQ ID NO: 38489 - DNA, 21 bp, Artificial Sequence
  Synthetic
ctttcagguctccgtggucaa

SEQ ID NO: 38490 - DNA, 28 bp, Artificial Sequence
  Synthetic
cttgaaacttgaaguaggatctccucat

SEQ ID NO: 38491 - DNA, 31 bp, Artificial Sequence; identical to SEQ ID NO: 26257
  Synthetic

SEQ ID NO: 38492 - DNA, 31 bp, Artificial Sequence; identical to SEQ ID NO: 26258
  Synthetic

SEQ ID NO: 38493 - DNA, 26 bp, Artificial Sequence
  Synthetic
tgtgaatggaccuctggattaugaga

SEQ ID NO: 38494 - DNA, 28 bp, Artificial Sequence
  Synthetic
ctaagtttacuggttgatggugagaaca

SEQ ID NO: 38495 - DNA, 29 bp, Artificial Sequence
  Synthetic
aatacatcatcutctctaaaccugcagac

SEQ ID NO: 38496 - DNA, 26 bp, Artificial Sequence
  Synthetic
aaaaatgtgcugtcatctgtuaagcc

SEQ ID NO: 38497 - DNA, 26 bp, Artificial Sequence
  Synthetic
ctgccaguatttttgaaguggaagaa

SEQ ID NO: 38498 - DNA, 31 bp, Artificial Sequence; identical to SEQ ID NO: 26264
  Synthetic

SEQ ID NO: 38499 - DNA, 28 bp, Artificial Sequence
  Synthetic
cctaacctggtutcaactgaagtacuaa

SEQ ID NO: 38500 - DNA, 23 bp, Artificial Sequence
  Synthetic
ttcttggtcuggaaatgccucat

SEQ ID NO: 38501 - DNA, 31 bp, Artificial Sequence; identical to SEQ ID NO: 26267
  Synthetic

SEQ ID NO: 38502 - DNA, 23 bp, Artificial Sequence
  Synthetic
ccagcuggcaaattctctucaac

SEQ ID NO: 38503 - DNA, 27 bp, Artificial Sequence
  Synthetic
acagagaagucagggactactaugaac

SEQ ID NO: 38504 - DNA, 30 bp, Artificial Sequence; identical to SEQ ID NO: 26270
  Synthetic

SEQ ID NO: 38505 - DNA, 28 bp, Artificial Sequence
  Synthetic
agtgttugatccttatcugccaagaaat

SEQ ID NO: 38506 - DNA, 21 bp, Artificial Sequence
  Synthetic
cctucacagggagcatacuca

SEQ ID NO: 38507 - DNA, 31 bp, Artificial Sequence; identical to SEQ ID NO: 26273
  Synthetic

SEQ ID NO: 38508 - DNA, 30 bp, Artificial Sequence; identical to SEQ ID NO: 26274
  Synthetic

SEQ ID NO: 38509 - DNA, 28 bp, Artificial Sequence
  Synthetic
cgtaaccatctucttttcctctcttuct

SEQ ID NO: 38510 - DNA, 21 bp, Artificial Sequence
  Synthetic
gcgatggtgauaagccctgut

SEQ ID NO: 38511 - DNA, 24 bp, Artificial Sequence
  Synthetic
gacatgguggtgaaaagtugagac

SEQ ID NO: 38512 - DNA, 21 bp, Artificial Sequence
  Synthetic
agggaaggtuggcgtgttauc

SEQ ID NO: 38513 - DNA, 30 bp, Artificial Sequence; identical to SEQ ID NO: 26279
  Synthetic

SEQ ID NO: 38514 - DNA, 30 bp, Artificial Sequence; identical to SEQ ID NO: 26280
  Synthetic

SEQ ID NO: 38515 - DNA, 27 bp, Artificial Sequence
  Synthetic
gtgcggttgugatcatttacattuaca

SEQ ID NO: 38516 - DNA, 22 bp, Artificial Sequence
  Synthetic
agactgtccgaaauggttgcuc

SEQ ID NO: 38517 - DNA, 26 bp, Artificial Sequence
  Synthetic
gtgaaacuccaaaaagauagcacgac

SEQ ID NO: 38518 - DNA, 24 bp, Artificial Sequence
  Synthetic
tttactggcuccaggagacuaagt

SEQ ID NO: 38519 - DNA, 23 bp, Artificial Sequence
  Synthetic
gctttgttccucagctgaugaag

SEQ ID NO: 38520 - DNA, 31 bp, Artificial Sequence; identical to SEQ ID NO: 26286
  Synthetic

SEQ ID NO: 38521 - DNA, 25 bp, Artificial Sequence
  Synthetic
tccaatgtttctuccttgtgtccut

SEQ ID NO: 38522 - DNA, 23 bp, Artificial Sequence
  Synthetic
gcacagagcuctccaagagtauc

SEQ ID NO: 38523 - DNA, 29 bp, Artificial Sequence
  Synthetic
cccctaatgttgacuggaaatatagtgut

SEQ ID NO: 38524 - DNA, 27 bp, Artificial Sequence
  Synthetic
aggtatttacauaccggatcatcugga

SEQ ID NO: 38525 - DNA, 26 bp, Artificial Sequence
  Synthetic
atttctggtgugcagttgataaaaug

SEQ ID NO: 38526 - DNA, 29 bp, Artificial Sequence
  Synthetic
cttcatggtagauaatagtgcccacttut

SEQ ID NO: 38527 - DNA, 27 bp, Artificial Sequence
  Synthetic
gaaaaatgtacugaatgaacgagugct

SEQ ID NO: 38528 - DNA, 31 bp, Artificial Sequence; identical to SEQ ID NO: 26294
  Synthetic

SEQ ID NO: 38529 - DNA, 20 bp, Artificial Sequence
  Synthetic
gccgcgguttaagagcauga

SEQ ID NO: 38530 - DNA, 22 bp, Artificial Sequence
  Synthetic
caggaagctuctcaccctctuc

SEQ ID NO: 38531 - DNA, 22 bp, Artificial Sequence
  Synthetic
gucccagagcacaaagaugaac

SEQ ID NO: 38532 - DNA, 20 bp, Artificial Sequence
  Synthetic
tctgctctcucccttggcua

SEQ ID NO: 38533 - DNA, 21 bp, Artificial Sequence
  Synthetic
ctguccccaggagagaatugg

SEQ ID NO: 38534 - DNA, 22 bp, Artificial Sequence
  Synthetic
tcacaggattuctggaccccua

SEQ ID NO: 38535 - DNA, 24 bp, Artificial Sequence
  Synthetic
ggtctctgauaccctcaaggguaa

SEQ ID NO: 38536 - DNA, 22 bp, Artificial Sequence
  Synthetic
cccaattcutcgccatugacag

SEQ ID NO: 38537 - DNA, 23 bp, Artificial Sequence
  Synthetic
ctgggtcaaugtcccatuggaat

SEQ ID NO: 38538 - DNA, 24 bp, Artificial Sequence
  Synthetic
caaactcaaguccctcctctctuc

SEQ ID NO: 38539 - DNA, 21 bp, Artificial Sequence
  Synthetic
tcagagccugagatgccuact

SEQ ID NO: 38540 - DNA, 22 bp, Artificial Sequence
  Synthetic
gggtgactgauctctgtccaua

SEQ ID NO: 38541 - DNA, 22 bp, Artificial Sequence
  Synthetic
ccaccuggatgaagaguggaag

SEQ ID NO: 38542 - DNA, 22 bp, Artificial Sequence
  Synthetic
ccttcctgacuggcttcttcug

SEQ ID NO: 38543 - DNA, 22 bp, Artificial Sequence
  Synthetic
ccactccaaaaugccagugagt

SEQ ID NO: 38544 - DNA, 25 bp, Artificial Sequence
  Synthetic
ctatgccaaggugaagatcactcuc

SEQ ID NO: 38545 - DNA, 21 bp, Artificial Sequence
  Synthetic
ccttccctgautgctgagguc

SEQ ID NO: 38546 - DNA, 22 bp, Artificial Sequence
  Synthetic
gcctggcaguaatgacttctug

SEQ ID NO: 38547 - DNA, 26 bp, Artificial Sequence
  Synthetic
gaaaagttcccagauctcatgaguct

SEQ ID NO: 38548 - DNA, 21 bp, Artificial Sequence
  Synthetic
ccgggucaggatcaatgtgut

SEQ ID NO: 38549 - DNA, 27 bp, Artificial Sequence
  Synthetic
gtacagggagaaggcuaagataaaugg

SEQ ID NO: 38550 - DNA, 24 bp, Artificial Sequence
  Synthetic
ctcaagtctgcutacagagggauc

SEQ ID NO: 38551 - DNA, 23 bp, Artificial Sequence
  Synthetic
agcactcaccaucccttacacua

SEQ ID NO: 38552 - DNA, 20 bp, Artificial Sequence
  Synthetic
cccacctutttcccccugaa

SEQ ID NO: 38553 - DNA, 20 bp, Artificial Sequence
  Synthetic
gtggaggaccaggguactug

SEQ ID NO: 38554 - DNA, 18 bp, Artificial Sequence
  Synthetic
aagatugcccgugggcat

SEQ ID NO: 38555 - DNA, 19 bp, Artificial Sequence
  Synthetic
ctgctcugccaccaccuac

SEQ ID NO: 38556 - DNA, 19 bp, Artificial Sequence
  Synthetic
gcacccuggtguacagcat

SEQ ID NO: 38557 - DNA, 18 bp, Artificial Sequence
  Synthetic
cccgcagccuaaggtgug

SEQ ID NO: 38558 - DNA, 22 bp, Artificial Sequence
  Synthetic
gagaagcauccatcccagtguc

SEQ ID NO: 38559 - DNA, 18 bp, Artificial Sequence
  Synthetic
cagcuggtacuccgcgat

SEQ ID NO: 38560 - DNA, 23 bp, Artificial Sequence
  Synthetic
attcattcccuacttggtcuggt

SEQ ID NO: 38561 - DNA, 19 bp, Artificial Sequence
  Synthetic
tcgttguccgtgcagtuca

SEQ ID NO: 38562 - DNA, 19 bp, Artificial Sequence
  Synthetic
ccagcucaggagcagaguc

SEQ ID NO: 38563 - DNA, 18 bp, Artificial Sequence
  Synthetic
gtgcgggacuggtgcaua

SEQ ID NO: 38564 - DNA, 24 bp, Artificial Sequence
  Synthetic
actgtccuggatgtgaaugacaac

SEQ ID NO: 38565 - DNA, 19 bp, Artificial Sequence
  Synthetic
ctctggugccacugagcat

SEQ ID NO: 38566 - DNA, 18 bp, Artificial Sequence
  Synthetic
gggtcugtcccuccacac

SEQ ID NO: 38567 - DNA, 18 bp, Artificial Sequence
  Synthetic
ccgtccugaggucagcac

SEQ ID NO: 38568 - DNA, 22 bp, Artificial Sequence
  Synthetic
ccccacucagttctatcuggga

SEQ ID NO: 38569 - DNA, 24 bp, Artificial Sequence
  Synthetic
cgacacatucatcatgtagcuggt

SEQ ID NO: 38570 - DNA, 22 bp, Artificial Sequence
  Synthetic
ggcactggguactgagattgug

SEQ ID NO: 38571 - DNA, 28 bp, Artificial Sequence
  Synthetic
gacattttaugacaaagaggagagugct

SEQ ID NO: 38572 - DNA, 22 bp, Artificial Sequence
  Synthetic
ctgtaggtcuctgaccacgtuc

SEQ ID NO: 38573 - DNA, 21 bp, Artificial Sequence
  Synthetic
ggtggatccuggctgttucac

SEQ ID NO: 38574 - DNA, 21 bp, Artificial Sequence
  Synthetic
gctttagcccugactccagut

SEQ ID NO: 38575 - DNA, 22 bp, Artificial Sequence
  Synthetic
cccccgtaugtccagctataug

SEQ ID NO: 38576 - DNA, 19 bp, Artificial Sequence
  Synthetic
ccgcaucagcggtgagauc

SEQ ID NO: 38577 - DNA, 25 bp, Artificial Sequence
  Synthetic
ggaattccatuctcacccatctugt

SEQ ID NO: 38578 - DNA, 20 bp, Artificial Sequence
  Synthetic
ccaacggcacagucaccuat

SEQ ID NO: 38579 - DNA, 21 bp, Artificial Sequence
  Synthetic
agactgcauctttgctccauc

SEQ ID NO: 38580 - DNA, 26 bp, Artificial Sequence
  Synthetic
gaggcagaatuatcaggtccattuca

SEQ ID NO: 38581 - DNA, 23 bp, Artificial Sequence
  Synthetic
cagtgactucaaatggtcccuca

SEQ ID NO: 38582 - DNA, 21 bp, Artificial Sequence
  Synthetic
gagugaggcttgcuagaggaa

SEQ ID NO: 38583 - DNA, 22 bp, Artificial Sequence
  Synthetic
ggttguagaaggcgatggtcuc

SEQ ID NO: 38584 - DNA, 19 bp, Artificial Sequence
  Synthetic
cgaacctccucctcggtug

SEQ ID NO: 38585 - DNA, 19 bp, Artificial Sequence
  Synthetic
agggctgtuctcgctgaug

SEQ ID NO: 38586 - DNA, 25 bp, Artificial Sequence
  Synthetic
aaguagaaaguagggaaaaggtcuc

SEQ ID NO: 38587 - DNA, 20 bp, Artificial Sequence
  Synthetic
tctctctccaugcgcctcua

SEQ ID NO: 38588 - DNA, 18 bp, Artificial Sequence
  Synthetic
gggctgggutggtctugt

SEQ ID NO: 38589 - DNA, 20 bp, Artificial Sequence
  Synthetic
ccagaaucaggctgggagug

SEQ ID NO: 38590 - DNA, 24 bp, Artificial Sequence
  Synthetic
ctcatcaccaucctggaugacaat

SEQ ID NO: 38591 - DNA, 20 bp, Artificial Sequence
  Synthetic
gcaaacuccgtguccaacct

SEQ ID NO: 38592 - DNA, 21 bp, Artificial Sequence
  Synthetic
tgttggtaaugccaccaucga

SEQ ID NO: 38593 - DNA, 22 bp, Artificial Sequence
  Synthetic
tggtcaauggccgtgatatugg

SEQ ID NO: 38594 - DNA, 22 bp, Artificial Sequence
  Synthetic
ccugggaagggcagatttuagg

SEQ ID NO: 38595 - DNA, 23 bp, Artificial Sequence
  Synthetic
caatgagagaugtcugcagggaa

SEQ ID NO: 38596 - DNA, 22 bp, Artificial Sequence
  Synthetic
gccctttgggaucacctacuac

SEQ ID NO: 38597 - DNA, 26 bp, Artificial Sequence
  Synthetic
cctcctcugacagatttctaaccuac

SEQ ID NO: 38598 - DNA, 20 bp, Artificial Sequence
  Synthetic
ggactgaccutggcctacuc

SEQ ID NO: 38599 - DNA, 23 bp, Artificial Sequence
  Synthetic
gtccttcccacutccaaatucca

SEQ ID NO: 38600 - DNA, 21 bp, Artificial Sequence
  Synthetic
cctttggccutgacctccauc

SEQ ID NO: 38601 - DNA, 21 bp, Artificial Sequence
  Synthetic
tguccaaggaaggccacauac

SEQ ID NO: 38602 - DNA, 21 bp, Artificial Sequence
  Synthetic
cgagaagutcagtcugaccgt

SEQ ID NO: 38603 - DNA, 23 bp, Artificial Sequence
  Synthetic
gccacagcuggaagaaggaaaua

SEQ ID NO: 38604 - DNA, 25 bp, Artificial Sequence
  Synthetic
agttcttcatcaucgacccaaucag

SEQ ID NO: 38605 - DNA, 21 bp, Artificial Sequence
  Synthetic
agttccccuagggacttucca

SEQ ID NO: 38606 - DNA, 20 bp, Artificial Sequence
  Synthetic
ggccccaugtgatgacaucc

SEQ ID NO: 38607 - DNA, 23 bp, Artificial Sequence
  Synthetic
gtaatcagggcacuagctctguc

SEQ ID NO: 38608 - DNA, 20 bp, Artificial Sequence
  Synthetic
ttcatcgucaaggccuccag

SEQ ID NO: 38609 - DNA, 19 bp, Artificial Sequence
  Synthetic
gcagguggtgtaaguggca

SEQ ID NO: 38610 - DNA, 21 bp, Artificial Sequence
  Synthetic
gcactgagtcuctgagccgua

SEQ ID NO: 38611 - DNA, 26 bp, Artificial Sequence
  Synthetic
gggatctcgutaatgacgatctugac

SEQ ID NO: 38612 - DNA, 21 bp, Artificial Sequence
  Synthetic
cctaaaagaggccugcccauc

SEQ ID NO: 38613 - DNA, 21 bp, Artificial Sequence
  Synthetic
acaggcugacaguccaaacac

SEQ ID NO: 38614 - DNA, 23 bp, Artificial Sequence
  Synthetic
aaggagcagcuacggaatcttut

SEQ ID NO: 38615 - DNA, 20 bp, Artificial Sequence
  Synthetic
aggacgatgaucgccatcug

SEQ ID NO: 38616 - DNA, 18 bp, Artificial Sequence
  Synthetic
gcaccccaucctcccuca

SEQ ID NO: 38617 - DNA, 18 bp, Artificial Sequence
  Synthetic
ctgggagacugcagcuct

SEQ ID NO: 38618 - DNA, 21 bp, Artificial Sequence
  Synthetic
gctccagcuaacatccccuct

SEQ ID NO: 38619 - DNA, 23 bp, Artificial Sequence
  Synthetic
tctctaccacccugtgttctcug

SEQ ID NO: 38620 - DNA, 21 bp, Artificial Sequence
  Synthetic
gcggcucaaaaagctcttugc

SEQ ID NO: 38621 - DNA, 25 bp, Artificial Sequence
  Synthetic
agagcuccagagacauagagaagga

SEQ ID NO: 38622 - DNA, 17 bp, Artificial Sequence
  Synthetic
cuggccaccgaccucaa

SEQ ID NO: 38623 - DNA, 22 bp, Artificial Sequence
  Synthetic
cacaaggctuccctgtctaguc

SEQ ID NO: 38624 - DNA, 19 bp, Artificial Sequence
  Synthetic
ggccguaggcagccuaaat

SEQ ID NO: 38625 - DNA, 18 bp, Artificial Sequence
  Synthetic
cucggauacgcggcagat

SEQ ID NO: 38626 - DNA, 23 bp, Artificial Sequence
  Synthetic
aaatgguaaggaagggcacauca

SEQ ID NO: 38627 - DNA, 28 bp, Artificial Sequence
  Synthetic
gtcttgtacatuttggctagttttuccc

SEQ ID NO: 38628 - DNA, 28 bp, Artificial Sequence
  Synthetic
ccagagtggugggtaatgattttaaugt

SEQ ID NO: 38629 - DNA, 30 bp, Artificial Sequence; identical to SEQ ID NO: 26395
  Synthetic

SEQ ID NO: 38630 - DNA, 30 bp, Artificial Sequence; identical to SEQ ID NO: 26396
  Synthetic

SEQ ID NO: 38631 - DNA, 25 bp, Artificial Sequence
  Synthetic
agtcccaggaaacugcaaatacaut

SEQ ID NO: 38632 - DNA, 20 bp, Artificial Sequence
  Synthetic
cgtguggacatguggcagat

SEQ ID NO: 38633 - DNA, 20 bp, Artificial Sequence
  Synthetic
gcttcuggcaaguggaggac

SEQ ID NO: 38634 - DNA, 20 bp, Artificial Sequence
  Synthetic
ctctctgguctgggccacua

SEQ ID NO: 38635 - DNA, 20 bp, Artificial Sequence
  Synthetic
gggagguctttggcattugg

SEQ ID NO: 38636 - DNA, 29 bp, Artificial Sequence
  Synthetic
tgaacaatgccucagctatacattuacat

SEQ ID NO: 38637 - DNA, 25 bp, Artificial Sequence
  Synthetic
ggcctaactautcaaacagggauga

SEQ ID NO: 38638 - DNA, 23 bp, Artificial Sequence
  Synthetic
actgggaugaaatcagacuccga

SEQ ID NO: 38639 - DNA, 26 bp, Artificial Sequence
  Synthetic
tcctaactctuaagaagggctgcaua

SEQ ID NO: 38640 - DNA, 28 bp, Artificial Sequence
  Synthetic
actcttcutttaggattcuccaaaagcc

SEQ ID NO: 38641 - DNA, 27 bp, Artificial Sequence
  Synthetic
tcaattctagguagcctggttactgua

SEQ ID NO: 38642 - DNA, 29 bp, Artificial Sequence
  Synthetic
tttctgagggaaggauaatggtauagaga

SEQ ID NO: 38643 - DNA, 28 bp, Artificial Sequence
  Synthetic
ggaataaatgcutcatcctgtuccaaat

SEQ ID NO: 38644 - DNA, 24 bp, Artificial Sequence
  Synthetic
tgggtacaccaugctttttgauga

SEQ ID NO: 38645 - DNA, 26 bp, Artificial Sequence
  Synthetic
catacttctccauatcggccttuacc

SEQ ID NO: 38646 - DNA, 26 bp, Artificial Sequence
  Synthetic
aatgagcattactuctccctagccua

SEQ ID NO: 38647 - DNA, 26 bp, Artificial Sequence
  Synthetic
gcagctgaauaagccaattuaagcag

SEQ ID NO: 38648 - DNA, 23 bp, Artificial Sequence
  Synthetic
tcaacttggaccutggctttcut

SEQ ID NO: 38649 - DNA, 24 bp, Artificial Sequence
  Synthetic
cagaaacuactcaaacucccacct

SEQ ID NO: 38650 - DNA, 24 bp, Artificial Sequence
  Synthetic
agtccccugaagaagtgattcgua

SEQ ID NO: 38651 - DNA, 27 bp, Artificial Sequence
  Synthetic
ctagagtttcucctccgatggttuaac

SEQ ID NO: 38652 - DNA, 17 bp, Artificial Sequence
  Synthetic
gcaggcccucctcgtua

SEQ ID NO: 38653 - DNA, 17 bp, Artificial Sequence
  Synthetic
cgaugggcgcguagagc

SEQ ID NO: 38654 - DNA, 17 bp, Artificial Sequence
  Synthetic
cuagacccgcgcgtcuc

SEQ ID NO: 38655 - DNA, 20 bp, Artificial Sequence
  Synthetic
ctcucaggaagcacctucgt

SEQ ID NO: 38656 - DNA, 18 bp, Artificial Sequence
  Synthetic
ccacuccccaggtgcauc

SEQ ID NO: 38657 - DNA, 19 bp, Artificial Sequence
  Synthetic
catgacauccagccaugcc

SEQ ID NO: 38658 - DNA, 18 bp, Artificial Sequence
  Synthetic
ggctguggcgaucacgaa

SEQ ID NO: 38659 - DNA, 21 bp, Artificial Sequence
  Synthetic
gcatcugagcaaggtggaugg

SEQ ID NO: 38660 - DNA, 22 bp, Artificial Sequence
  Synthetic
acactgtgtgutttctggccua

SEQ ID NO: 38661 - DNA, 22 bp, Artificial Sequence
  Synthetic
tgcctggaaguttccgactuac

SEQ ID NO: 38662 - DNA, 19 bp, Artificial Sequence
  Synthetic
gaccgguaaccacgtccug

SEQ ID NO: 38663 - DNA, 28 bp, Artificial Sequence
  Synthetic
acaataacagugaccaaaatgacaguga

SEQ ID NO: 38664 - DNA, 21 bp, Artificial Sequence
  Synthetic
cgatguccaggaaccgcuaat

SEQ ID NO: 38665 - DNA, 22 bp, Artificial Sequence
  Synthetic
catagccgucgacagagaagug

SEQ ID NO: 38666 - DNA, 19 bp, Artificial Sequence
  Synthetic
ggaggccuaacgtgctguc

SEQ ID NO: 38667 - DNA, 20 bp, Artificial Sequence
  Synthetic
gactcctugagctccagucc

SEQ ID NO: 38668 - DNA, 21 bp, Artificial Sequence
  Synthetic
gaggagaagugatgcgtguct

SEQ ID NO: 38669 - DNA, 17 bp, Artificial Sequence
  Synthetic
gcaccgcugatcaugca

SEQ ID NO: 38670 - DNA, 20 bp, Artificial Sequence
  Synthetic
cagcactuggccctgattug

SEQ ID NO: 38671 - DNA, 19 bp, Artificial Sequence
  Synthetic
cctgcaggagcutcacgut

SEQ ID NO: 38672 - DNA, 22 bp, Artificial Sequence
  Synthetic
actcaucaccgacatgctucac

SEQ ID NO: 38673 - DNA, 20 bp, Artificial Sequence
  Synthetic
cctccucaggacccctcauc

SEQ ID NO: 38674 - DNA, 23 bp, Artificial Sequence
  Synthetic
tttaaatgcacugaccucccaca

SEQ ID NO: 38675 - DNA, 22 bp, Artificial Sequence
  Synthetic
cctggcccacaaguatcacuaa

SEQ ID NO: 38676 - DNA, 25 bp, Artificial Sequence
  Synthetic
tgtaccctgtuacttatcccctucc

SEQ ID NO: 38677 - DNA, 22 bp, Artificial Sequence
  Synthetic
ctaaggugaaggctcauggcaa

SEQ ID NO: 38678 - DNA, 24 bp, Artificial Sequence
  Synthetic
acatgcccaguttctattggtcuc

SEQ ID NO: 38679 - DNA, 23 bp, Artificial Sequence
  Synthetic
cauaaaagucagggcagagccat

SEQ ID NO: 38680 - DNA, 18 bp, Artificial Sequence
  Synthetic
gucugcacggacgaagga

SEQ ID NO: 38681 - DNA, 17 bp, Artificial Sequence
  Synthetic
cccugcccagcaucgag

SEQ ID NO: 38682 - DNA, 21 bp, Artificial Sequence
  Synthetic
cctagcaucccacuaaaccct

SEQ ID NO: 38683 - DNA, 18 bp, Artificial Sequence
  Synthetic
catcuccccgggctgtut

SEQ ID NO: 38684 - DNA, 17 bp, Artificial Sequence
  Synthetic
cggatggugccgcugaa

SEQ ID NO: 38685 - DNA, 19 bp, Artificial Sequence
  Synthetic
ctcacugggacccaugcag

SEQ ID NO: 38686 - DNA, 18 bp, Artificial Sequence
  Synthetic
cgcctgucctgcagcaut

SEQ ID NO: 38687 - DNA, 20 bp, Artificial Sequence
  Synthetic
ggauactagctguggcccat

SEQ ID NO: 38688 - DNA, 18 bp, Artificial Sequence
  Synthetic
gggagtgcuggtgtcuga

SEQ ID NO: 38689 - DNA, 20 bp, Artificial Sequence
  Synthetic
ctgtggcuctaaccccugag

SEQ ID NO: 38690 - DNA, 21 bp, Artificial Sequence
  Synthetic
cccctgtuccactcctaccut

SEQ ID NO: 38691 - DNA, 25 bp, Artificial Sequence
  Synthetic
ctcttaactgutccactctgtuccc

SEQ ID NO: 38692 - DNA, 22 bp, Artificial Sequence
  Synthetic
tggatgaaguagcacacgaugg

SEQ ID NO: 38693 - DNA, 26 bp, Artificial Sequence
  Synthetic
agcactcuaaacacagtcaauaccaa

SEQ ID NO: 38694 - DNA, 25 bp, Artificial Sequence
  Synthetic
ctaaggcucagagaacagtgactug

SEQ ID NO: 38695 - DNA, 20 bp, Artificial Sequence
  Synthetic
cacgtcugtcactguggagt

SEQ ID NO: 38696 - DNA, 19 bp, Artificial Sequence
  Synthetic
cacucccaacctcugccat

SEQ ID NO: 38697 - DNA, 17 bp, Artificial Sequence
  Synthetic
cgagccugcgccaagua

SEQ ID NO: 38698 - DNA, 21 bp, Artificial Sequence
  Synthetic
tctctguggctgaucagacct

SEQ ID NO: 38699 - DNA, 28 bp, Artificial Sequence
  Synthetic
ccaccaaccatauatcctgaagacatug

SEQ ID NO: 38700 - DNA, 19 bp, Artificial Sequence
  Synthetic
ctgcccccuatagccugac

SEQ ID NO: 38701 - DNA, 23 bp, Artificial Sequence
  Synthetic
tccctacccuctactctctucct

SEQ ID NO: 38702 - DNA, 21 bp, Artificial Sequence
  Synthetic
ccccucagaggctgctacuaa

SEQ ID NO: 38703 - DNA, 20 bp, Artificial Sequence
  Synthetic
ccaactcugaccaggcugac

SEQ ID NO: 38704 - DNA, 19 bp, Artificial Sequence
  Synthetic
cacccuggagggagtugac

SEQ ID NO: 38705 - DNA, 23 bp, Artificial Sequence
  Synthetic
gagagctcaguatgcctttccuc

SEQ ID NO: 38706 - DNA, 24 bp, Artificial Sequence
  Synthetic
tgaggaggauggtuaaaaggagat

SEQ ID NO: 38707 - DNA, 22 bp, Artificial Sequence
  Synthetic
gggtaatggutgttcagacucc

SEQ ID NO: 38708 - DNA, 19 bp, Artificial Sequence
  Synthetic
cctctgggagutggtgcug

SEQ ID NO: 38709 - DNA, 20 bp, Artificial Sequence
  Synthetic
agtgggucctcaccuccaaa

SEQ ID NO: 38710 - DNA, 18 bp, Artificial Sequence
  Synthetic
agcctugaggcugacaca

SEQ ID NO: 38711 - DNA, 20 bp, Artificial Sequence
  Synthetic
tcacttgugcctctguccac

SEQ ID NO: 38712 - DNA, 19 bp, Artificial Sequence
  Synthetic
tccutgcatguacgcagca

SEQ ID NO: 38713 - DNA, 23 bp, Artificial Sequence
  Synthetic
agtattccaaugagcggcugaag

SEQ ID NO: 38714 - DNA, 20 bp, Artificial Sequence
  Synthetic
acacacaccuttgggcacuc

SEQ ID NO: 38715 - DNA, 20 bp, Artificial Sequence
  Synthetic
agggcaaccaucaggucaaa

SEQ ID NO: 38716 - DNA, 32 bp, Artificial Sequence; identical to SEQ ID NO: 26482
  Synthetic

SEQ ID NO: 38717 - DNA, 26 bp, Artificial Sequence
  Synthetic
catttctgcaagcaucctactatgug

SEQ ID NO: 38718 - DNA, 27 bp, Artificial Sequence
  Synthetic
tctcagaaacaacugaaaaccatcuag

SEQ ID NO: 38719 - DNA, 21 bp, Artificial Sequence
  Synthetic
actgtgcauctttgggaucgt

SEQ ID NO: 38720 - DNA, 23 bp, Artificial Sequence
  Synthetic
ctctcugtgacccuaaaccagaa

SEQ ID NO: 38721 - DNA, 21 bp, Artificial Sequence
  Synthetic
ccttcgugaatctgctgucca

SEQ ID NO: 38722 - DNA, 17 bp, Artificial Sequence
  Synthetic
ggccagagccuctgcut

SEQ ID NO: 38723 - DNA, 25 bp, Artificial Sequence
  Synthetic
atcaccaagaccaucaagtttguca

SEQ ID NO: 38724 - DNA, 21 bp, Artificial Sequence
  Synthetic
ctccctccuacacctcaccua

SEQ ID NO: 38725 - DNA, 23 bp, Artificial Sequence
  Synthetic
tcctgtcugtttctctcucccat

SEQ ID NO: 38726 - DNA, 18 bp, Artificial Sequence
  Synthetic
gcctccucctcccuccct

SEQ ID NO: 38727 - DNA, 20 bp, Artificial Sequence
  Synthetic
tcaacaacggcugctttgug

SEQ ID NO: 38728 - DNA, 17 bp, Artificial Sequence
  Synthetic
aagaguggcccgagcug

SEQ ID NO: 38729 - DNA, 25 bp, Artificial Sequence
  Synthetic
ggacctucttctgaaguccaaaagg

SEQ ID NO: 38730 - DNA, 18 bp, Artificial Sequence
  Synthetic
agcagauggccacugcaa

SEQ ID NO: 38731 - DNA, 24 bp, Artificial Sequence
  Synthetic
gttttgtgttucttgctctgcuct

SEQ ID NO: 38732 - DNA, 23 bp, Artificial Sequence
  Synthetic
tgaggcaucctattgugagacct

SEQ ID NO: 38733 - DNA, 21 bp, Artificial Sequence
  Synthetic
gttggccaaucagcctcauct

SEQ ID NO: 38734 - DNA, 22 bp, Artificial Sequence
  Synthetic
cccaggagugaccttgagagua

SEQ ID NO: 38735 - DNA, 25 bp, Artificial Sequence
  Synthetic
ctcaaagctucccactgtcttttuc

SEQ ID NO: 38736 - DNA, 25 bp, Artificial Sequence
  Synthetic
aggtacucccagagagaaagaagug

SEQ ID NO: 38737 - DNA, 29 bp, Artificial Sequence
  Synthetic
ctattggtaacauccaatgtggaacttut

SEQ ID NO: 38738 - DNA, 22 bp, Artificial Sequence
  Synthetic
ggacaugggaaacagcagtuct

SEQ ID NO: 38739 - DNA, 22 bp, Artificial Sequence
  Synthetic
gaagaagcacugagcaaccauc

SEQ ID NO: 38740 - DNA, 20 bp, Artificial Sequence
  Synthetic
ctgcacccauggagaggaug

SEQ ID NO: 38741 - DNA, 19 bp, Artificial Sequence
  Synthetic
acaccacugaccuggacga

SEQ ID NO: 38742 - DNA, 22 bp, Artificial Sequence
  Synthetic
agcaggaggguctatguggaaa

SEQ ID NO: 38743 - DNA, 23 bp, Artificial Sequence
  Synthetic
ttcaaatgugccctttgtccuct

SEQ ID NO: 38744 - DNA, 26 bp, Artificial Sequence
  Synthetic
tcacaccauttagtgttgauaggaca

SEQ ID NO: 38745 - DNA, 26 bp, Artificial Sequence
  Synthetic
gctgaactgtguctcatcattttgut

SEQ ID NO: 38746 - DNA, 23 bp, Artificial Sequence
  Synthetic
gggccagcauttctgactagtuc

SEQ ID NO: 38747 - DNA, 23 bp, Artificial Sequence
  Synthetic
gttcugactccaguaacaggcat

SEQ ID NO: 38748 - DNA, 17 bp, Artificial Sequence
  Synthetic
ggctggcugcacucact

SEQ ID NO: 38749 - DNA, 20 bp, Artificial Sequence
  Synthetic
gggcctcutttctcccauga

SEQ ID NO: 38750 - DNA, 20 bp, Artificial Sequence
  Synthetic
guggagaugacaagggccaa

SEQ ID NO: 38751 - DNA, 19 bp, Artificial Sequence
  Synthetic
ctgtccugcagaugagcga

SEQ ID NO: 38752 - DNA, 21 bp, Artificial Sequence
  Synthetic
gcaaggttucctcggaagugg

SEQ ID NO: 38753 - DNA, 28 bp, Artificial Sequence
  Synthetic
cgtgattctgcutctatctctcttucag

SEQ ID NO: 38754 - DNA, 20 bp, Artificial Sequence
  Synthetic
cctcccaccgucatggagua

SEQ ID NO: 38755 - DNA, 21 bp, Artificial Sequence
  Synthetic
ctgcctcuctctgtggucaag

SEQ ID NO: 38756 - DNA, 18 bp, Artificial Sequence
  Synthetic
cgcccagggugatctcuc

SEQ ID NO: 38757 - DNA, 19 bp, Artificial Sequence
  Synthetic
gcatucccggcatcuccac

SEQ ID NO: 38758 - DNA, 17 bp, Artificial Sequence
  Synthetic
ggtguccacccccuacc

SEQ ID NO: 38759 - DNA, 18 bp, Artificial Sequence
  Synthetic
cggctcuttccagcucct

SEQ ID NO: 38760 - DNA, 28 bp, Artificial Sequence
  Synthetic
tgtaaatcatagugtgagatacagcugc

SEQ ID NO: 38761 - DNA, 26 bp, Artificial Sequence
  Synthetic
acaacccagugaagagttctaccaua

SEQ ID NO: 38762 - DNA, 28 bp, Artificial Sequence
  Synthetic
caagatggccutcatggatuagaaaaag

SEQ ID NO: 38763 - DNA, 26 bp, Artificial Sequence
  Synthetic
aatttctcautctgtgguacaaccca

SEQ ID NO: 38764 - DNA, 20 bp, Artificial Sequence
  Synthetic
gctguggaacacccagguaa

SEQ ID NO: 38765 - DNA, 28 bp, Artificial Sequence
  Synthetic
agcttctgccgutaactaggttaauaaa

SEQ ID NO: 38766 - DNA, 20 bp, Artificial Sequence
  Synthetic
ggacggaucacaaggucagg

SEQ ID NO: 38767 - DNA, 21 bp, Artificial Sequence
  Synthetic
tgtgatcacugctcagugcaa

SEQ ID NO: 38768 - DNA, 24 bp, Artificial Sequence
  Synthetic
tgctttaaacauttgtctgugcgt

SEQ ID NO: 38769 - DNA, 24 bp, Artificial Sequence
  Synthetic
ggtttgaaaagcugttggcctauc

SEQ ID NO: 38770 - DNA, 28 bp, Artificial Sequence
  Synthetic
gctgctttttctutaaacggtacacaua

SEQ ID NO: 38771 - DNA, 22 bp, Artificial Sequence
  Synthetic
ctggcatguagtgtcacggaut

SEQ ID NO: 38772 - DNA, 24 bp, Artificial Sequence
  Synthetic
cagatgcuaagaccaggtactuca

SEQ ID NO: 38773 - DNA, 24 bp, Artificial Sequence
  Synthetic
aacgtttgcacuatgacctucaga

SEQ ID NO: 38774 - DNA, 22 bp, Artificial Sequence
  Synthetic
gcagcaaagacutccgaatucc

SEQ ID NO: 38775 - DNA, 21 bp, Artificial Sequence
  Synthetic
cgcttgccucagaacaactuc

SEQ ID NO: 38776 - DNA, 24 bp, Artificial Sequence
  Synthetic
catcagagagucctcctggagaut

SEQ ID NO: 38777 - DNA, 20 bp, Artificial Sequence
  Synthetic
gggaugcagctcgtuaccac

SEQ ID NO: 38778 - DNA, 18 bp, Artificial Sequence
  Synthetic
cuccagagccgugcgaat

SEQ ID NO: 38779 - DNA, 19 bp, Artificial Sequence
  Synthetic
gagagucgccgtcuccaag

SEQ ID NO: 38780 - DNA, 31 bp, Artificial Sequence; identical to SEQ ID NO: 26546
  Synthetic

SEQ ID NO: 38781 - DNA, 28 bp, Artificial Sequence
  Synthetic
ccatgtctgttuctcaaagggaatauct

SEQ ID NO: 38782 - DNA, 21 bp, Artificial Sequence
  Synthetic
cctgagccacucctcactuct

SEQ ID NO: 38783 - DNA, 26 bp, Artificial Sequence
  Synthetic
ctctgactacugtcatttctctugcc

SEQ ID NO: 38784 - DNA, 24 bp, Artificial Sequence
  Synthetic
agtactctguacaagcacctcugt

SEQ ID NO: 38785 - DNA, 30 bp, Artificial Sequence; identical to SEQ ID NO: 26551
  Synthetic

SEQ ID NO: 38786 - DNA, 21 bp, Artificial Sequence
  Synthetic
tcagctgaagucgcattugag

SEQ ID NO: 38787 - DNA, 26 bp, Artificial Sequence
  Synthetic
gctcttggaguttaagacuacaccag

SEQ ID NO: 38788 - DNA, 24 bp, Artificial Sequence
  Synthetic
acacagacuaagagacaguggaga

SEQ ID NO: 38789 - DNA, 24 bp, Artificial Sequence
  Synthetic
gcgacuccagaagttguaagcaaa

SEQ ID NO: 38790 - DNA, 25 bp, Artificial Sequence
  Synthetic
gggaaguggacagaaaaccacatua

SEQ ID NO: 38791 - DNA, 29 bp, Artificial Sequence
  Synthetic
gctctctacaguaagttctcataccatug

SEQ ID NO: 38792 - DNA, 17 bp, Artificial Sequence
  Synthetic
cgtcgcgaguccctgug

SEQ ID NO: 38793 - DNA, 29 bp, Artificial Sequence
  Synthetic
ccgaggattaacucctattttcttgcuaa

SEQ ID NO: 38794 - DNA, 24 bp, Artificial Sequence
  Synthetic
acttgaaagcagutcacacacugt

SEQ ID NO: 38795 - DNA, 24 bp, Artificial Sequence
  Synthetic
tgtctctttgutgcaagtgtcuct

SEQ ID NO: 38796 - DNA, 29 bp, Artificial Sequence
  Synthetic
aacaacaaagagaaucatgaaaucaaccc

SEQ ID NO: 38797 - DNA, 25 bp, Artificial Sequence
  Synthetic
gcctttaaugagatcccctttucca

SEQ ID NO: 38798 - DNA, 22 bp, Artificial Sequence
  Synthetic
agggccaaagaguccatcagua

SEQ ID NO: 38799 - DNA, 24 bp, Artificial Sequence
  Synthetic
actgagcctutttcccttcttugt

SEQ ID NO: 38800 - DNA, 27 bp, Artificial Sequence
  Synthetic
agttctaagcaccuttgaaatggtuca

SEQ ID NO: 38801 - DNA, 27 bp, Artificial Sequence
  Synthetic
ccattgctttugaagaaacagttgugt

SEQ ID NO: 38802 - DNA, 21 bp, Artificial Sequence
  Synthetic
gggagaaggacuccactuggt

SEQ ID NO: 38803 - DNA, 21 bp, Artificial Sequence
  Synthetic
cgctgacacugtgcttctcuc

SEQ ID NO: 38804 - DNA, 20 bp, Artificial Sequence
  Synthetic
agugaacuggccggaaaagt

SEQ ID NO: 38805 - DNA, 19 bp, Artificial Sequence
  Synthetic
cttcggctuacgggtcgut

SEQ ID NO: 38806 - DNA, 17 bp, Artificial Sequence
  Synthetic
gcugctguaggcaccca

SEQ ID NO: 38807 - DNA, 17 bp, Artificial Sequence
  Synthetic
gtccgcucccccactuc

SEQ ID NO: 38808 - DNA, 18 bp, Artificial Sequence
  Synthetic
cgctctucccatcuccca

SEQ ID NO: 38809 - DNA, 18 bp, Artificial Sequence
  Synthetic
ccgctuccgcatgtucag

SEQ ID NO: 38810 - DNA, 20 bp, Artificial Sequence
  Synthetic
ccagcgccuaaagttcccua

SEQ ID NO: 38811 - DNA, 22 bp, Artificial Sequence
  Synthetic
gtaccaagucctgucaccaaca

SEQ ID NO: 38812 - DNA, 17 bp, Artificial Sequence
  Synthetic
cccagacccugggcuca

SEQ ID NO: 38813 - DNA, 18 bp, Artificial Sequence
  Synthetic
tgacccccugctcacugt

SEQ ID NO: 38814 - DNA, 22 bp, Artificial Sequence
  Synthetic
tgtcctccaugttctcaaugcg

SEQ ID NO: 38815 - DNA, 24 bp, Artificial Sequence
  Synthetic
caggttcagggutaagctttucct

SEQ ID NO: 38816 - DNA, 19 bp, Artificial Sequence
  Synthetic
gtcaauggcgggtcttgug

SEQ ID NO: 38817 - DNA, 23 bp, Artificial Sequence
  Synthetic
cacacaucgatactggugaagga

SEQ ID NO: 38818 - DNA, 21 bp, Artificial Sequence
  Synthetic
tcaatggcaaggugagcaugt

SEQ ID NO: 38819 - DNA, 20 bp, Artificial Sequence
  Synthetic
gctcagaccccuctcugacc

SEQ ID NO: 38820 - DNA, 19 bp, Artificial Sequence
  Synthetic
cgtagacgcgcauctcgua

SEQ ID NO: 38821 - DNA, 21 bp, Artificial Sequence
  Synthetic
aaacagauccgagggaaggug

SEQ ID NO: 38822 - DNA, 21 bp, Artificial Sequence
  Synthetic
cgtgatguttgtcgaguggct

SEQ ID NO: 38823 - DNA, 21 bp, Artificial Sequence
  Synthetic
ggaagaugagggcgtcuacac

SEQ ID NO: 38824 - DNA, 19 bp, Artificial Sequence
  Synthetic
tcggcaccacguagguaga

SEQ ID NO: 38825 - DNA, 20 bp, Artificial Sequence
  Synthetic
gtcagctccuctgctcccua

SEQ ID NO: 38826 - DNA, 24 bp, Artificial Sequence
  Synthetic
ttttgatcctugctcttccctcug

SEQ ID NO: 38827 - DNA, 18 bp, Artificial Sequence
  Synthetic
ctccaggguagggugggt

SEQ ID NO: 38828 - DNA, 17 bp, Artificial Sequence
  Synthetic
catccaccugcccugca

SEQ ID NO: 38829 - DNA, 18 bp, Artificial Sequence
  Synthetic
acacccucccgagcucaa

SEQ ID NO: 38830 - DNA, 24 bp, Artificial Sequence
  Synthetic
gttgatgatcagguggtgtctcug

SEQ ID NO: 38831 - DNA, 25 bp, Artificial Sequence
  Synthetic
gcaagtcaaauggtgagtuccagaa

SEQ ID NO: 38832 - DNA, 19 bp, Artificial Sequence
  Synthetic
catctccuccccaggtucc

SEQ ID NO: 38833 - DNA, 18 bp, Artificial Sequence
  Synthetic
ggtguccgcagcttucct

SEQ ID NO: 38834 - DNA, 24 bp, Artificial Sequence
  Synthetic
cattcttgagccauttgaccucag

SEQ ID NO: 38835 - DNA, 19 bp, Artificial Sequence
  Synthetic
ccacagccacaguagctug

SEQ ID NO: 38836 - DNA, 20 bp, Artificial Sequence
  Synthetic
ggctccuggcagaatuaggg

SEQ ID NO: 38837 - DNA, 21 bp, Artificial Sequence
  Synthetic
aggaaguaaaggcccaugggt

SEQ ID NO: 38838 - DNA, 19 bp, Artificial Sequence
  Synthetic
gaacugccacccaggacuc

SEQ ID NO: 38839 - DNA, 21 bp, Artificial Sequence
  Synthetic
ggctagtguccctttcuccct

SEQ ID NO: 38840 - DNA, 21 bp, Artificial Sequence
  Synthetic
acgaggcaucctccttagugt

SEQ ID NO: 38841 - DNA, 19 bp, Artificial Sequence
  Synthetic
cguccctccaugcacacag

SEQ ID NO: 38842 - DNA, 18 bp, Artificial Sequence
  Synthetic
cccctucccaccccaaug

SEQ ID NO: 38843 - DNA, 30 bp, Artificial Sequence; identical to SEQ ID NO: 26609
  Synthetic

SEQ ID NO: 38844 - DNA, 20 bp, Artificial Sequence
  Synthetic
caaaccucagggaaggcuga

SEQ ID NO: 38845 - DNA, 18 bp, Artificial Sequence
  Synthetic
cgggcaggagugaaggug

SEQ ID NO: 38846 - DNA, 20 bp, Artificial Sequence
  Synthetic
tcctcgucaacccccucaag

SEQ ID NO: 38847 - DNA, 25 bp, Artificial Sequence
  Synthetic
cccauatatagugggaaggacagga

SEQ ID NO: 38848 - DNA, 21 bp, Artificial Sequence
  Synthetic
ccuagagugccccgaagagat

SEQ ID NO: 38849 - DNA, 20 bp, Artificial Sequence
  Synthetic
cacgtugtgaggtuccacga

SEQ ID NO: 38850 - DNA, 21 bp, Artificial Sequence
  Synthetic
ctcatgacgugagtaggcuca

SEQ ID NO: 38851 - DNA, 20 bp, Artificial Sequence
  Synthetic
ctggcctaugctcacctucc

SEQ ID NO: 38852 - DNA, 22 bp, Artificial Sequence
  Synthetic
gggatggaaucaggctgtauca

SEQ ID NO: 38853 - DNA, 19 bp, Artificial Sequence
  Synthetic
ggtgguggcagaggaguag

SEQ ID NO: 38854 - DNA, 20 bp, Artificial Sequence
  Synthetic
ctcauggcccggtactucag

SEQ ID NO: 38855 - DNA, 20 bp, Artificial Sequence
  Synthetic
cctgccccuacctgctgtua

SEQ ID NO: 38856 - DNA, 23 bp, Artificial Sequence
  Synthetic
gtcatcattgutgtgggcauagc

SEQ ID NO: 38857 - DNA, 23 bp, Artificial Sequence
  Synthetic
tgcgagttucacaagaccatcuc

SEQ ID NO: 38858 - DNA, 18 bp, Artificial Sequence
  Synthetic
cagccugacccucgaacg

SEQ ID NO: 38859 - DNA, 22 bp, Artificial Sequence
  Synthetic
tguaccaguccaaccagacaga

SEQ ID NO: 38860 - DNA, 21 bp, Artificial Sequence
  Synthetic
ccaatcggugtccctctcuac

SEQ ID NO: 38861 - DNA, 18 bp, Artificial Sequence
  Synthetic
cagcccugccagcttuac

SEQ ID NO: 38862 - DNA, 17 bp, Artificial Sequence
  Synthetic
cctccugcccaggctuc

SEQ ID NO: 38863 - DNA, 17 bp, Artificial Sequence
  Synthetic
cugcgcaggaugagcac

SEQ ID NO: 38864 - DNA, 22 bp, Artificial Sequence
  Synthetic
caaaggagtgcugaggttccua

SEQ ID NO: 38865 - DNA, 22 bp, Artificial Sequence
  Synthetic
cautgacaggtuggcaaaccac

SEQ ID NO: 38866 - DNA, 21 bp, Artificial Sequence
  Synthetic
gcccuggtaccuggagaagag

SEQ ID NO: 38867 - DNA, 24 bp, Artificial Sequence
  Synthetic
ttctagccucagttucccaaaagg

SEQ ID NO: 38868 - DNA, 20 bp, Artificial Sequence
  Synthetic
catgagcuggacctcgtugt

SEQ ID NO: 38869 - DNA, 22 bp, Artificial Sequence
  Synthetic
gagacctucctttccugacact

SEQ ID NO: 38870 - DNA, 23 bp, Artificial Sequence
  Synthetic
gagagggagagautccuccaagt

SEQ ID NO: 38871 - DNA, 24 bp, Artificial Sequence
  Synthetic
ctcgggcttautccagtacatguc

SEQ ID NO: 38872 - DNA, 21 bp, Artificial Sequence
  Synthetic
aagtaaggccaggugttgguc

SEQ ID NO: 38873 - DNA, 25 bp, Artificial Sequence
  Synthetic
ccacagtagttuggtccttgagtut

SEQ ID NO: 38874 - DNA, 20 bp, Artificial Sequence
  Synthetic
tgtggacgccutcaagtcug

SEQ ID NO: 38875 - DNA, 27 bp, Artificial Sequence
  Synthetic
ccagaactcacaguctttaagctttug

SEQ ID NO: 38876 - DNA, 24 bp, Artificial Sequence
  Synthetic
agatccccgaaaaucaccucaaag

SEQ ID NO: 38877 - DNA, 23 bp, Artificial Sequence
  Synthetic
cccuaggaaattguggaggaagg

SEQ ID NO: 38878 - DNA, 21 bp, Artificial Sequence
  Synthetic
gggaccaggugaaggaagaug

SEQ ID NO: 38879 - DNA, 18 bp, Artificial Sequence
  Synthetic
cctgccacccuttccugt

SEQ ID NO: 38880 - DNA, 24 bp, Artificial Sequence
  Synthetic
ctcactagggaugaagcacatucc

SEQ ID NO: 38881 - DNA, 30 bp, Artificial Sequence; identical to SEQ ID NO: 26647
  Synthetic

SEQ ID NO: 38882 - DNA, 19 bp, Artificial Sequence
  Synthetic
cccacagggcutctcccua

SEQ ID NO: 38883 - DNA, 22 bp, Artificial Sequence
  Synthetic
cctgctgcccuacttctacauc

SEQ ID NO: 38884 - DNA, 18 bp, Artificial Sequence
  Synthetic
cccaucggcggatgtgua

SEQ ID NO: 38885 - DNA, 17 bp, Artificial Sequence
  Synthetic
accgctugacccctucc

SEQ ID NO: 38886 - DNA, 19 bp, Artificial Sequence
  Synthetic
gguaccacccgaagtgguc

SEQ ID NO: 38887 - DNA, 20 bp, Artificial Sequence
  Synthetic
gcatctgcguggagtgugat

SEQ ID NO: 38888 - DNA, 21 bp, Artificial Sequence
  Synthetic
gacaggtugatgaggguccag

SEQ ID NO: 38889 - DNA, 21 bp, Artificial Sequence
  Synthetic
ctgggcuctcgctaaguaagg

SEQ ID NO: 38890 - DNA, 20 bp, Artificial Sequence
  Synthetic
agacggcauagccaaggaug

SEQ ID NO: 38891 - DNA, 22 bp, Artificial Sequence
  Synthetic
ggaaagcgccutcatttcugaa

SEQ ID NO: 38892 - DNA, 19 bp, Artificial Sequence
  Synthetic
ccaccugctgtgucccaac

SEQ ID NO: 38893 - DNA, 23 bp, Artificial Sequence
  Synthetic
cccccttcaucgtctactactuc

SEQ ID NO: 38894 - DNA, 24 bp, Artificial Sequence
  Synthetic
gtccttcattccuttgggtccaua

SEQ ID NO: 38895 - DNA, 25 bp, Artificial Sequence
  Synthetic
gtaagcaaggutctctttctugcag

SEQ ID NO: 38896 - DNA, 22 bp, Artificial Sequence
  Synthetic
ctgagactcuctctcgcccaua

SEQ ID NO: 38897 - DNA, 24 bp, Artificial Sequence
  Synthetic
ctttcgatcauctccctgcaucaa

SEQ ID NO: 38898 - DNA, 23 bp, Artificial Sequence
  Synthetic
agagcccaagagcuttcuagagt

SEQ ID NO: 38899 - DNA, 24 bp, Artificial Sequence
  Synthetic
catctccccaaucttcttgtuggt

SEQ ID NO: 38900 - DNA, 20 bp, Artificial Sequence
  Synthetic
cctgggcugagttccagtug

SEQ ID NO: 38901 - DNA, 20 bp, Artificial Sequence
  Synthetic
ccctcggaacuctggtccua

SEQ ID NO: 38902 - DNA, 20 bp, Artificial Sequence
  Synthetic
gcactgugcccacatttuca

SEQ ID NO: 38903 - DNA, 21 bp, Artificial Sequence
  Synthetic
ccctacaaucctagggugggt

SEQ ID NO: 38904 - DNA, 23 bp, Artificial Sequence
  Synthetic
caugttcacugacaccgagaact

SEQ ID NO: 38905 - DNA, 23 bp, Artificial Sequence
  Synthetic
gtgcuaggacagaaactgagcug

SEQ ID NO: 38906 - DNA, 17 bp, Artificial Sequence
  Synthetic
gcaggcuggcaggugag

SEQ ID NO: 38907 - DNA, 22 bp, Artificial Sequence
  Synthetic
caucaagagcccaactucccaa

SEQ ID NO: 38908 - DNA, 21 bp, Artificial Sequence
  Synthetic
gggccugaacaacaccctuac

SEQ ID NO: 38909 - DNA, 22 bp, Artificial Sequence
  Synthetic
ttgtcagugaactcgatgugca

SEQ ID NO: 38910 - DNA, 17 bp, Artificial Sequence
  Synthetic
aggagagggugggcuca

SEQ ID NO: 38911 - DNA, 23 bp, Artificial Sequence
  Synthetic
gggtctcauagtagacgaugcct

SEQ ID NO: 38912 - DNA, 21 bp, Artificial Sequence
  Synthetic
gagaggugactgctgttugct

SEQ ID NO: 38913 - DNA, 21 bp, Artificial Sequence
  Synthetic
ctcagcugaagctgtuggaca

SEQ ID NO: 38914 - DNA, 21 bp, Artificial Sequence
  Synthetic
gcctttgtcugggttggucaa

SEQ ID NO: 38915 - DNA, 22 bp, Artificial Sequence
  Synthetic
ctctacgaagcugtagcggaug

SEQ ID NO: 38916 - DNA, 22 bp, Artificial Sequence
  Synthetic
gctgtccatucccttgtgtucc

SEQ ID NO: 38917 - DNA, 23 bp, Artificial Sequence
  Synthetic
cagcccacaucatgggaattuac

SEQ ID NO: 38918 - DNA, 21 bp, Artificial Sequence
  Synthetic
ctgaucccaaacccacctgua

SEQ ID NO: 38919 - DNA, 20 bp, Artificial Sequence
  Synthetic
cagcaaggcugggtucaaag

SEQ ID NO: 38920 - DNA, 20 bp, Artificial Sequence
  Synthetic
agcgcaucatccagtuccag

SEQ ID NO: 38921 - DNA, 20 bp, Artificial Sequence
  Synthetic
ctgagggugatgcauggaca

SEQ ID NO: 38922 - DNA, 23 bp, Artificial Sequence
  Synthetic
gtgtcttctgugtcaccccaaut

SEQ ID NO: 38923 - DNA, 24 bp, Artificial Sequence
  Synthetic
cttgtccaccaugtctgagtgaut

SEQ ID NO: 38924 - DNA, 22 bp, Artificial Sequence
  Synthetic
agggcataccucttgtctccut

SEQ ID NO: 38925 - DNA, 22 bp, Artificial Sequence
  Synthetic
ggtagagcaguggctgttugag

SEQ ID NO: 38926 - DNA, 22 bp, Artificial Sequence
  Synthetic
gccaggtcautttgacagctut

SEQ ID NO: 38927 - DNA, 27 bp, Artificial Sequence
  Synthetic
ctcataaaucttggtcaucacagggat

SEQ ID NO: 38928 - DNA, 19 bp, Artificial Sequence
  Synthetic
ccccgcaaagucttgcugt

SEQ ID NO: 38929 - DNA, 18 bp, Artificial Sequence
  Synthetic
ccuaggccaccuaaggca

SEQ ID NO: 38930 - DNA, 18 bp, Artificial Sequence
  Synthetic
ccagcacuccggtcagug

SEQ ID NO: 38931 - DNA, 22 bp, Artificial Sequence
  Synthetic
tccaagggaugcctgtttuagg

SEQ ID NO: 38932 - DNA, 18 bp, Artificial Sequence
  Synthetic
cctcagcggguactcugg

SEQ ID NO: 38933 - DNA, 20 bp, Artificial Sequence
  Synthetic
catutacacacgugcgcaca

SEQ ID NO: 38934 - DNA, 22 bp, Artificial Sequence
  Synthetic
autcatggaugggaccaccaag

SEQ ID NO: 38935 - DNA, 20 bp, Artificial Sequence
  Synthetic
tgaauagccccggcaaguag

SEQ ID NO: 38936 - DNA, 19 bp, Artificial Sequence
  Synthetic
tctcccagugcgagcagua

SEQ ID NO: 38937 - DNA, 21 bp, Artificial Sequence
  Synthetic
cggaagatuccctcccacuca

SEQ ID NO: 38938 - DNA, 25 bp, Artificial Sequence
  Synthetic
gcagctgattuttagagcaaacuca

SEQ ID NO: 38939 - DNA, 20 bp, Artificial Sequence
  Synthetic
gcuacagagcaagggacugg

SEQ ID NO: 38940 - DNA, 21 bp, Artificial Sequence
  Synthetic
gggcatgacugactcaacugg

SEQ ID NO: 38941 - DNA, 22 bp, Artificial Sequence
  Synthetic
gtattcgucccccttgatggug

SEQ ID NO: 38942 - DNA, 25 bp, Artificial Sequence
  Synthetic
gcagacatgagugataacaccucag

SEQ ID NO: 38943 - DNA, 21 bp, Artificial Sequence
  Synthetic
gtcctctcautgatgccgtug

SEQ ID NO: 38944 - DNA, 20 bp, Artificial Sequence
  Synthetic
gccacagguagagagcugac

SEQ ID NO: 38945 - DNA, 19 bp, Artificial Sequence
  Synthetic
cctgtggcucccatcctuc

SEQ ID NO: 38946 - DNA, 21 bp, Artificial Sequence
  Synthetic
tctatucggcacaagccctuc

SEQ ID NO: 38947 - DNA, 19 bp, Artificial Sequence
  Synthetic
gtgaggtcugcccctcauc

SEQ ID NO: 38948 - DNA, 21 bp, Artificial Sequence
  Synthetic
ctttucccacccagcaacauc

SEQ ID NO: 38949 - DNA, 22 bp, Artificial Sequence
  Synthetic
aactgctatguggtcctcaucc

SEQ ID NO: 38950 - DNA, 21 bp, Artificial Sequence
  Synthetic
gggctcaguataggaggcaua

SEQ ID NO: 38951 - DNA, 23 bp, Artificial Sequence
  Synthetic
gaatcccuctgaggactugagga

SEQ ID NO: 38952 - DNA, 20 bp, Artificial Sequence
  Synthetic
agacaggccutaggugggaa

SEQ ID NO: 38953 - DNA, 20 bp, Artificial Sequence
  Synthetic
gccucagatgaucccaggac

SEQ ID NO: 38954 - DNA, 21 bp, Artificial Sequence
  Synthetic
tgtgaccugctctgtctcuga

SEQ ID NO: 38955 - DNA, 17 bp, Artificial Sequence
  Synthetic
gaugcccaccccaugct

SEQ ID NO: 38956 - DNA, 22 bp, Artificial Sequence
  Synthetic
ggctucattcctguccccaaat

SEQ ID NO: 38957 - DNA, 22 bp, Artificial Sequence
  Synthetic
guctgtggtucaggcagagaag

SEQ ID NO: 38958 - DNA, 21 bp, Artificial Sequence
  Synthetic
attcctgggagcugtgctaug

SEQ ID NO: 38959 - DNA, 20 bp, Artificial Sequence
  Synthetic
ctccccgugactgttcacut

SEQ ID NO: 38960 - DNA, 19 bp, Artificial Sequence
  Synthetic
gutccaatucccgcccaga

SEQ ID NO: 38961 - DNA, 20 bp, Artificial Sequence
  Synthetic
gcautgccgtuaccagacat

SEQ ID NO: 38962 - DNA, 23 bp, Artificial Sequence
  Synthetic
aagutcctttctuccaagccagt

SEQ ID NO: 38963 - DNA, 27 bp, Artificial Sequence
  Synthetic
atcataactgttcugacaaacctccuc

SEQ ID NO: 38964 - DNA, 23 bp, Artificial Sequence
  Synthetic
ggattatgugcctctguccccat

SEQ ID NO: 38965 - DNA, 25 bp, Artificial Sequence
  Synthetic
gaauccctucagggaaggaaagaag

SEQ ID NO: 38966 - DNA, 22 bp, Artificial Sequence
  Synthetic
ctaggcuccaccactgaaguag

SEQ ID NO: 38967 - DNA, 23 bp, Artificial Sequence
  Synthetic
gccccttacutgcaagactctua

SEQ ID NO: 38968 - DNA, 23 bp, Artificial Sequence
  Synthetic
gaaaggaacagugactgccuagt

SEQ ID NO: 38969 - DNA, 23 bp, Artificial Sequence
  Synthetic
gtcactctuccaaaaggauccgt

SEQ ID NO: 38970 - DNA, 24 bp, Artificial Sequence
  Synthetic
tacccaggcuttctagatgauagg

SEQ ID NO: 38971 - DNA, 23 bp, Artificial Sequence
  Synthetic
gggaaggcauatgtcaccatgug

SEQ ID NO: 38972 - DNA, 23 bp, Artificial Sequence
  Synthetic
cccacagtugccttttcagugat

SEQ ID NO: 38973 - DNA, 23 bp, Artificial Sequence
  Synthetic
agaaatgccacagucctccttuc

SEQ ID NO: 38974 - DNA, 23 bp, Artificial Sequence
  Synthetic
cttgttcucaccaaaucccacct

SEQ ID NO: 38975 - DNA, 20 bp, Artificial Sequence
  Synthetic
tgugccccacaaaccagtua

SEQ ID NO: 38976 - DNA, 23 bp, Artificial Sequence
  Synthetic
gcttggguacctcagtuccaaac

SEQ ID NO: 38977 - DNA, 22 bp, Artificial Sequence
  Synthetic
caagaacacucactgccucaga

SEQ ID NO: 38978 - DNA, 22 bp, Artificial Sequence
  Synthetic
ctcagatgccuatgggctucat

SEQ ID NO: 38979 - DNA, 28 bp, Artificial Sequence
  Synthetic
guaaaaacacagugggcaagagaaaaat

SEQ ID NO: 38980 - DNA, 25 bp, Artificial Sequence
  Synthetic
aagtaacagagugttttcacgugga

SEQ ID NO: 38981 - DNA, 27 bp, Artificial Sequence
  Synthetic
gggaccagucagtctcattataaucct

SEQ ID NO: 38982 - DNA, 22 bp, Artificial Sequence
  Synthetic
gtggcuaagagggtcagtugaa

SEQ ID NO: 38983 - DNA, 27 bp, Artificial Sequence
  Synthetic
gattcggaaagagguatctgaacucac

SEQ ID NO: 38984 - DNA, 21 bp, Artificial Sequence
  Synthetic
ggtgaguacagggtcctctug

SEQ ID NO: 38985 - DNA, 24 bp, Artificial Sequence
  Synthetic
ggactggaaagugacaatgtccua

SEQ ID NO: 38986 - DNA, 22 bp, Artificial Sequence
  Synthetic
gggtggtcaugatggatcucct

SEQ ID NO: 38987 - DNA, 28 bp, Artificial Sequence
  Synthetic
aagttctggaaccugaaaaacuaagagt

SEQ ID NO: 38988 - DNA, 22 bp, Artificial Sequence
  Synthetic
cttgagagcgagauggtgagug

SEQ ID NO: 38989 - DNA, 22 bp, Artificial Sequence
  Synthetic
ctcacccacaccuttcagtgua

SEQ ID NO: 38990 - DNA, 21 bp, Artificial Sequence
  Synthetic
tgtgagctucaccaacgaguc

SEQ ID NO: 38991 - DNA, 22 bp, Artificial Sequence
  Synthetic
gtcaccctccuactgggactua

SEQ ID NO: 38992 - DNA, 21 bp, Artificial Sequence
  Synthetic
attgacccugatgtgcagugt

SEQ ID NO: 38993 - DNA, 23 bp, Artificial Sequence
  Synthetic
cttcccaacaaauggctctucaa

SEQ ID NO: 38994 - DNA, 21 bp, Artificial Sequence
  Synthetic
tgacuaaccagccctagctut

SEQ ID NO: 38995 - DNA, 24 bp, Artificial Sequence
  Synthetic
cuaacatagacaaugccaaacgca

SEQ ID NO: 38996 - DNA, 29 bp, Artificial Sequence
  Synthetic
catttaagguaaaagctaacagtcugcat

SEQ ID NO: 38997 - DNA, 30 bp, Artificial Sequence; identical to SEQ ID NO: 26763
  Synthetic

SEQ ID NO: 38998 - DNA, 26 bp, Artificial Sequence
  Synthetic
gttgccaccutgttaccttuaaaaga

SEQ ID NO: 38999 - DNA, 32 bp, Artificial Sequence; identical to SEQ ID NO: 26765
  Synthetic

SEQ ID NO: 39000 - DNA, 29 bp, Artificial Sequence
  Synthetic
aattccataactucttgctaagtccugag

SEQ ID NO: 39001 - DNA, 29 bp, Artificial Sequence
  Synthetic
ttgtggacaggutttgaaagatatttgug

SEQ ID NO: 39002 - DNA, 21 bp, Artificial Sequence
  Synthetic
cctccccagucctcatguact

SEQ ID NO: 39003 - DNA, 32 bp, Artificial Sequence; identical to SEQ ID NO: 26769
  Synthetic

SEQ ID NO: 39004 - DNA, 23 bp, Artificial Sequence
  Synthetic
gctgtatcgucaaggcactctug

SEQ ID NO: 39005 - DNA, 28 bp, Artificial Sequence
  Synthetic
tgagtttgtatuaaaaggtactggugga

SEQ ID NO: 39006 - DNA, 26 bp, Artificial Sequence
  Synthetic
cagccgagaauactttgtcatttucc

SEQ ID NO: 39007 - DNA, 24 bp, Artificial Sequence
  Synthetic
cttgacutgacccugggaagaaat

SEQ ID NO: 39008 - DNA, 21 bp, Artificial Sequence
  Synthetic
gtcaugaccgcacatucacaa

SEQ ID NO: 39009 - DNA, 30 bp, Artificial Sequence; identical to SEQ ID NO: 26775
  Synthetic

SEQ ID NO: 39010 - DNA, 22 bp, Artificial Sequence
  Synthetic
catctttgugaacgggagguga

SEQ ID NO: 39011 - DNA, 23 bp, Artificial Sequence
  Synthetic
gaaagatgcugcatgttggugac

SEQ ID NO: 39012 - DNA, 27 bp, Artificial Sequence
  Synthetic
aaaagtaggaaaucaggcccaatacuc

SEQ ID NO: 39013 - DNA, 23 bp, Artificial Sequence
  Synthetic
tggattccttutgtgtgtgguca

SEQ ID NO: 39014 - DNA, 26 bp, Artificial Sequence
  Synthetic
cgactgccaaaacauccaatacttut

SEQ ID NO: 39015 - DNA, 30 bp, Artificial Sequence; identical to SEQ ID NO: 26781
  Synthetic

SEQ ID NO: 39016 - DNA, 20 bp, Artificial Sequence
  Synthetic
ggcaggguacaggtagcaut

SEQ ID NO: 39017 - DNA, 29 bp, Artificial Sequence
  Synthetic
gttttcatggtaacuctgtgcttttcuag

SEQ ID NO: 39018 - DNA, 24 bp, Artificial Sequence
  Synthetic
aucaatcatttgcuccaggaaact

SEQ ID NO: 39019 - DNA, 23 bp, Artificial Sequence
  Synthetic
caacaaatuggaggtggcugaac

SEQ ID NO: 39020 - DNA, 27 bp, Artificial Sequence
  Synthetic
agtgtgcaaagucaccataauagaagt

SEQ ID NO: 39021 - DNA, 24 bp, Artificial Sequence
  Synthetic
ctgaatctgugcctgtttgtcuag

SEQ ID NO: 39022 - DNA, 20 bp, Artificial Sequence
  Synthetic
gctguggaaggagctcugat

SEQ ID NO: 39023 - DNA, 20 bp, Artificial Sequence
  Synthetic
cagcauggctctgtuagcga

SEQ ID NO: 39024 - DNA, 20 bp, Artificial Sequence
  Synthetic
aatcgctgugcgtgtaguga

SEQ ID NO: 39025 - DNA, 31 bp, Artificial Sequence; identical to SEQ ID NO: 26791
  Synthetic

SEQ ID NO: 39026 - DNA, 19 bp, Artificial Sequence
  Synthetic
gcgggauaggaggagguga

SEQ ID NO: 39027 - DNA, 18 bp, Artificial Sequence
  Synthetic
cuccgaggccaagcugaa

SEQ ID NO: 39028 - DNA, 27 bp, Artificial Sequence
  Synthetic
gaacaccgagautttattttgcaguct

SEQ ID NO: 39029 - DNA, 20 bp, Artificial Sequence
  Synthetic
ggccgguctgcttcttguaa

SEQ ID NO: 39030 - DNA, 21 bp, Artificial Sequence
  Synthetic
cacaggcagcucttctctcug

SEQ ID NO: 39031 - DNA, 23 bp, Artificial Sequence
  Synthetic
cagaacaucacctaccacugcaa

SEQ ID NO: 39032 - DNA, 23 bp, Artificial Sequence
  Synthetic
tgcuaaaagctuccagggagaaa

SEQ ID NO: 39033 - DNA, 22 bp, Artificial Sequence
  Synthetic
gagacttgcguctaccccaauc

SEQ ID NO: 39034 - DNA, 20 bp, Artificial Sequence
  Synthetic
catctccucccttgctgcua

SEQ ID NO: 39035 - DNA, 19 bp, Artificial Sequence
  Synthetic
ggccugagacagcaugacg

SEQ ID NO: 39036 - DNA, 24 bp, Artificial Sequence
  Synthetic
ccuaaaagaggcccugagcaaaaa

SEQ ID NO: 39037 - DNA, 22 bp, Artificial Sequence
  Synthetic
tcctcacgaccuctctctctug

SEQ ID NO: 39038 - DNA, 20 bp, Artificial Sequence
  Synthetic
gctcaagugggctctgtgug

SEQ ID NO: 39039 - DNA, 24 bp, Artificial Sequence
  Synthetic
gactcaatcggugtctgtcttgut

SEQ ID NO: 39040 - DNA, 23 bp, Artificial Sequence
  Synthetic
cttaguccagagacugcggaaac

SEQ ID NO: 39041 - DNA, 23 bp, Artificial Sequence
  Synthetic
attcttcuctgagccugagacct

SEQ ID NO: 39042 - DNA, 20 bp, Artificial Sequence
  Synthetic
tgggactugtccttgcugac

SEQ ID NO: 39043 - DNA, 24 bp, Artificial Sequence
  Synthetic
cactcatcauccttgtctctgucc

SEQ ID NO: 39044 - DNA, 19 bp, Artificial Sequence
  Synthetic
gggcctggugagggactua

SEQ ID NO: 39045 - DNA, 24 bp, Artificial Sequence
  Synthetic
acttcccgcautttctccttcuag

SEQ ID NO: 39046 - DNA, 17 bp, Artificial Sequence
  Synthetic
cgccaugggagcctcug

SEQ ID NO: 39047 - DNA, 18 bp, Artificial Sequence
  Synthetic
cgucttcctugggccact

SEQ ID NO: 39048 - DNA, 22 bp, Artificial Sequence
  Synthetic
catccattuccctcccugacaa

SEQ ID NO: 39049 - DNA, 20 bp, Artificial Sequence
  Synthetic
catgcccccutctcucacag

SEQ ID NO: 39050 - DNA, 19 bp, Artificial Sequence
  Synthetic
ccgccttuggcaggagaua

SEQ ID NO: 39051 - DNA, 18 bp, Artificial Sequence
  Synthetic
cgcaccaaggutggctug

SEQ ID NO: 39052 - DNA, 22 bp, Artificial Sequence
  Synthetic
ccauaagggaauggaagcgauc

SEQ ID NO: 39053 - DNA, 24 bp, Artificial Sequence
  Synthetic
tgtccacuacagactccctctuac

SEQ ID NO: 39054 - DNA, 22 bp, Artificial Sequence
  Synthetic
cttgccucctaggcaucagaaa

SEQ ID NO: 39055 - DNA, 23 bp, Artificial Sequence
  Synthetic
ctttgggtcugccctatactgug

SEQ ID NO: 39056 - DNA, 20 bp, Artificial Sequence
  Synthetic
ggaggcugggcaggtactua

SEQ ID NO: 39057 - DNA, 20 bp, Artificial Sequence
  Synthetic
cuggaaactcugggccagaa

SEQ ID NO: 39058 - DNA, 23 bp, Artificial Sequence
  Synthetic
ccctggtuaaactctacucagga

SEQ ID NO: 39059 - DNA, 26 bp, Artificial Sequence
  Synthetic
tctgagaatggugttctgtcttucag

SEQ ID NO: 39060 - DNA, 22 bp, Artificial Sequence
  Synthetic
gcaacagcagcuctgctactua

SEQ ID NO: 39061 - DNA, 22 bp, Artificial Sequence
  Synthetic
atcgctgaggucacatggtauc

SEQ ID NO: 39062 - DNA, 21 bp, Artificial Sequence
  Synthetic
ggatggagccuccacatucac

SEQ ID NO: 39063 - DNA, 26 bp, Artificial Sequence
  Synthetic
tgaaggctcacuctgtttctctttut

SEQ ID NO: 39064 - DNA, 22 bp, Artificial Sequence
  Synthetic
gggtttgacuccagagatguca

SEQ ID NO: 39065 - DNA, 21 bp, Artificial Sequence
  Synthetic
gacuttgcuaccccaggagag

SEQ ID NO: 39066 - DNA, 24 bp, Artificial Sequence
  Synthetic
ccacaactgucagagcaaaguaca

SEQ ID NO: 39067 - DNA, 26 bp, Artificial Sequence
  Synthetic
cttcatttcatccuccctgtctctuc

SEQ ID NO: 39068 - DNA, 21 bp, Artificial Sequence
  Synthetic
tgctgtggutgcacccaauac

SEQ ID NO: 39069 - DNA, 23 bp, Artificial Sequence
  Synthetic
catggtcacutccttcttgcuca

SEQ ID NO: 39070 - DNA, 26 bp, Artificial Sequence
  Synthetic
acaacacagaauatgaacttugcaca

SEQ ID NO: 39071 - DNA, 22 bp, Artificial Sequence
  Synthetic
cttttggcgucttcccuaggag

SEQ ID NO: 39072 - DNA, 22 bp, Artificial Sequence
  Synthetic
ttcugggaaacccaagtuggaa

SEQ ID NO: 39073 - DNA, 22 bp, Artificial Sequence
  Synthetic
acaccuccactttggatugcag

SEQ ID NO: 39074 - DNA, 23 bp, Artificial Sequence
  Synthetic
cagctccucatttgtctacucgt

SEQ ID NO: 39075 - DNA, 27 bp, Artificial Sequence
  Synthetic
ggcttccaaaacuacaatgtcaaagut

SEQ ID NO: 39076 - DNA, 23 bp, Artificial Sequence
  Synthetic
aatgaggauaccaggtcaauccc

SEQ ID NO: 39077 - DNA, 27 bp, Artificial Sequence
  Synthetic
tgtagtaaaccccucattttctgtucc

SEQ ID NO: 39078 - DNA, 23 bp, Artificial Sequence
  Synthetic
caggtaagugcaagcagcaatut

SEQ ID NO: 39079 - DNA, 28 bp, Artificial Sequence
  Synthetic
attgatgccuttttctctttaugccaag

SEQ ID NO: 39080 - DNA, 25 bp, Artificial Sequence
  Synthetic
tgaagaacauggtaagaugacagca

SEQ ID NO: 39081 - DNA, 25 bp, Artificial Sequence
  Synthetic
gctctcctcuaacttaccatccugt

SEQ ID NO: 39082 - DNA, 27 bp, Artificial Sequence
  Synthetic
acagactggatuaacatagcattgcut

SEQ ID NO: 39083 - DNA, 31 bp, Artificial Sequence; identical to SEQ ID NO: 26849
  Synthetic

SEQ ID NO: 39084 - DNA, 22 bp, Artificial Sequence
  Synthetic
ctgaggcaguctttcacgtcut

SEQ ID NO: 39085 - DNA, 25 bp, Artificial Sequence
  Synthetic
actgcaacctcuctctttttctcuc

SEQ ID NO: 39086 - DNA, 17 bp, Artificial Sequence
  Synthetic
cuggcccugacaccgaa

SEQ ID NO: 39087 - DNA, 17 bp, Artificial Sequence
  Synthetic
gcttcccccucctgcuc

SEQ ID NO: 39088 - DNA, 22 bp, Artificial Sequence
  Synthetic
cttgcagcaggutcttagcuct

SEQ ID NO: 39089 - DNA, 19 bp, Artificial Sequence
  Synthetic
ggaggtctugccggaggua

SEQ ID NO: 39090 - DNA, 27 bp, Artificial Sequence
  Synthetic
ggaaaaguttggatcuagaaacagcag

SEQ ID NO: 39091 - DNA, 27 bp, Artificial Sequence
  Synthetic
tgggagctgtuaacccttaattcaaut

SEQ ID NO: 39092 - DNA, 20 bp, Artificial Sequence
  Synthetic
gtaaguggcgatcuccacgt

SEQ ID NO: 39093 - DNA, 23 bp, Artificial Sequence
  Synthetic
accccactcucctcctttctauc

SEQ ID NO: 39094 - DNA, 23 bp, Artificial Sequence
  Synthetic
cctcacucaggagacagtcauca

SEQ ID NO: 39095 - DNA, 23 bp, Artificial Sequence
  Synthetic
aaccagaugaccgactccaaauc

SEQ ID NO: 39096 - DNA, 21 bp, Artificial Sequence
  Synthetic
gatgautggcacugcacacac

SEQ ID NO: 39097 - DNA, 23 bp, Artificial Sequence
  Synthetic
ctgacaaacacutcccatcccut

SEQ ID NO: 39098 - DNA, 21 bp, Artificial Sequence
  Synthetic
ctgcctccugaggttgtugat

SEQ ID NO: 39099 - DNA, 23 bp, Artificial Sequence
  Synthetic
cttuagagggauggaaagaggug

SEQ ID NO: 39100 - DNA, 22 bp, Artificial Sequence
  Synthetic
tcaggagacuctggtugacagt

SEQ ID NO: 39101 - DNA, 20 bp, Artificial Sequence
  Synthetic
gcactagtgguggcagctuc

SEQ ID NO: 39102 - DNA, 21 bp, Artificial Sequence
  Synthetic
cauagccacccacuccacaag

SEQ ID NO: 39103 - DNA, 21 bp, Artificial Sequence
  Synthetic
cucttgcuccaccaggaacaa

SEQ ID NO: 39104 - DNA, 28 bp, Artificial Sequence
  Synthetic
ccatggauaaataaacacuaggaacgca

SEQ ID NO: 39105 - DNA, 21 bp, Artificial Sequence
  Synthetic
cucaccaugcaagaagacuca

SEQ ID NO: 39106 - DNA, 26 bp, Artificial Sequence
  Synthetic
caaggacaaggccautaagaaatucg

SEQ ID NO: 39107 - DNA, 23 bp, Artificial Sequence
  Synthetic
ccugagaggcuccaaagaacaga

SEQ ID NO: 39108 - DNA, 27 bp, Artificial Sequence
  Synthetic
tgaagctacatuactgtgtgagttgug

SEQ ID NO: 39109 - DNA, 26 bp, Artificial Sequence
  Synthetic
accctccaggaugaaatttuaaccat

SEQ ID NO: 39110 - DNA, 24 bp, Artificial Sequence
  Synthetic
gctcaacacacaagutttcagugg

SEQ ID NO: 39111 - DNA, 28 bp, Artificial Sequence
  Synthetic
agctagtcccaaucgaatcagagtauag

SEQ ID NO: 39112 - DNA, 33 bp, Artificial Sequence; identical to SEQ ID NO: 26878
  Synthetic

SEQ ID NO: 39113 - DNA, 27 bp, Artificial Sequence
  Synthetic
agggcttaucgagacaaattgaagtut

SEQ ID NO: 39114 - DNA, 25 bp, Artificial Sequence
  Synthetic
ggaacatggautcatagaaguccct

SEQ ID NO: 39115 - DNA, 27 bp, Artificial Sequence
  Synthetic
ggaatccacauccttgttttgtuaggt

SEQ ID NO: 39116 - DNA, 26 bp, Artificial Sequence
  Synthetic
aaaagccagaccuttgtgattacuct

SEQ ID NO: 39117 - DNA, 29 bp, Artificial Sequence
  Synthetic
tcagctctgatgugatatctgatctacut

SEQ ID NO: 39118 - DNA, 23 bp, Artificial Sequence
  Synthetic
actgcgccugaccagaatuaaat

SEQ ID NO: 39119 - DNA, 29 bp, Artificial Sequence
  Synthetic
cagccactgaauatatctcaagtcttuga

SEQ ID NO: 39120 - DNA, 28 bp, Artificial Sequence
  Synthetic
gcacatttcaaguagccttagttcugaa

SEQ ID NO: 39121 - DNA, 27 bp, Artificial Sequence
  Synthetic
acatttgcagatuccctcagatatgua

SEQ ID NO: 39122 - DNA, 23 bp, Artificial Sequence
  Synthetic
gcatgagaaagaaugaggcugga

SEQ ID NO: 39123 - DNA, 27 bp, Artificial Sequence
  Synthetic
cuggaaagccagaugacaaaagaaaag

SEQ ID NO: 39124 - DNA, 27 bp, Artificial Sequence
  Synthetic
catgaccattcacutttacactcacug

SEQ ID NO: 39125 - DNA, 23 bp, Artificial Sequence
  Synthetic
aagtcagcctugctgagatcaut

SEQ ID NO: 39126 - DNA, 23 bp, Artificial Sequence
  Synthetic
ctgggctcuccttgttgagtuaa

SEQ ID NO: 39127 - DNA, 29 bp, Artificial Sequence
  Synthetic
ctcacgttucaaaatacaaacgaugaaga

SEQ ID NO: 39128 - DNA, 28 bp, Artificial Sequence
  Synthetic
gttggcaauagaagcatgtcgaattaut

SEQ ID NO: 39129 - DNA, 26 bp, Artificial Sequence
  Synthetic
gaaaacagaggaaaaaugcccagtua

SEQ ID NO: 39130 - DNA, 24 bp, Artificial Sequence
  Synthetic
caggaattcgcacauccctgatua

SEQ ID NO: 39131 - DNA, 28 bp, Artificial Sequence
  Synthetic
gtaattacagcaagaauccctcttctuc

SEQ ID NO: 39132 - DNA, 25 bp, Artificial Sequence
  Synthetic
atcccaaucgcaggctgaattatua

SEQ ID NO: 39133 - DNA, 31 bp, Artificial Sequence; identical to SEQ ID NO: 26899
  Synthetic

SEQ ID NO: 39134 - DNA, 26 bp, Artificial Sequence
  Synthetic
atccttcccaaacaugacatcaucat

SEQ ID NO: 39135 - DNA, 27 bp, Artificial Sequence
  Synthetic
caaacagctcucattcactctctttut

SEQ ID NO: 39136 - DNA, 26 bp, Artificial Sequence
  Synthetic
ggtgacaaugaaaatatuccgaaccc

SEQ ID NO: 39137 - DNA, 27 bp, Artificial Sequence
  Synthetic
ggauaaagaggaggagguatgactuaa

SEQ ID NO: 39138 - DNA, 22 bp, Artificial Sequence
  Synthetic
gagaatgugccaggctaatugc

SEQ ID NO: 39139 - DNA, 24 bp, Artificial Sequence
  Synthetic
ccagcctcaugatgtggaaaauga

SEQ ID NO: 39140 - DNA, 30 bp, Artificial Sequence; identical to SEQ ID NO: 26906
  Synthetic

SEQ ID NO: 39141 - DNA, 28 bp, Artificial Sequence
  Synthetic
cctgccatcuctttatccttctttucat

SEQ ID NO: 39142 - DNA, 23 bp, Artificial Sequence
  Synthetic
aaacacaaaaucctgtguaccca

SEQ ID NO: 39143 - DNA, 28 bp, Artificial Sequence
  Synthetic
gggaggtataguagcccatatgtatgua

SEQ ID NO: 39144 - DNA, 26 bp, Artificial Sequence
  Synthetic
taactcagaaagaucccutaaacugt

SEQ ID NO: 39145 - DNA, 26 bp, Artificial Sequence
  Synthetic
agtctttgaugcgaagaaaacgttuc

SEQ ID NO: 39146 - DNA, 23 bp, Artificial Sequence
  Synthetic
caggcagguataggtctgtcuct

SEQ ID NO: 39147 - DNA, 17 bp, Artificial Sequence
  Synthetic
cgccggagcugcaauga

SEQ ID NO: 39148 - DNA, 22 bp, Artificial Sequence
  Synthetic
cacagcugacagaccacatuct

SEQ ID NO: 39149 - DNA, 23 bp, Artificial Sequence
  Synthetic
ccaagaagcccacutatccccua

SEQ ID NO: 39150 - DNA, 21 bp, Artificial Sequence
  Synthetic
agagctaguggctcaccttug

SEQ ID NO: 39151 - DNA, 28 bp, Artificial Sequence
  Synthetic
gggaatactgaucctgatttaacaguga

SEQ ID NO: 39152 - DNA, 26 bp, Artificial Sequence
  Synthetic
ggagtaggaaaguttcaaagaccuga

SEQ ID NO: 39153 - DNA, 28 bp, Artificial Sequence
  Synthetic
ccaatuacaggaauagaacaggttcuat

SEQ ID NO: 39154 - DNA, 22 bp, Artificial Sequence
  Synthetic
ggaaaagauggcgctcattgug

SEQ ID NO: 39155 - DNA, 29 bp, Artificial Sequence
  Synthetic
gtgatgagcttugagttttctttcttcut

SEQ ID NO: 39156 - DNA, 27 bp, Artificial Sequence
  Synthetic
gttatcttcauggaagccacagtacut

SEQ ID NO: 39157 - DNA, 28 bp, Artificial Sequence
  Synthetic
agacacctatttugtgcctgtattcuag

SEQ ID NO: 39158 - DNA, 25 bp, Artificial Sequence
  Synthetic
agtgaacaaguacattgcuccaagt

SEQ ID NO: 39159 - DNA, 22 bp, Artificial Sequence
  Synthetic
gtactcaggacgutgccttcuc

SEQ ID NO: 39160 - DNA, 26 bp, Artificial Sequence
  Synthetic
aagatcttgaugatgtttgucagagc

SEQ ID NO: 39161 - DNA, 24 bp, Artificial Sequence
  Synthetic
ttcctgttcuggttctgcatctut

SEQ ID NO: 39162 - DNA, 21 bp, Artificial Sequence
  Synthetic
ccagcagtcutcggatctcut

SEQ ID NO: 39163 - DNA, 24 bp, Artificial Sequence
  Synthetic
ctaaaaagucagagaccucacucc

SEQ ID NO: 39164 - DNA, 20 bp, Artificial Sequence
  Synthetic
cagggucagggacagaaucc

SEQ ID NO: 39165 - DNA, 20 bp, Artificial Sequence
  Synthetic
ccgagtcugagggactcuga

SEQ ID NO: 39166 - DNA, 21 bp, Artificial Sequence
  Synthetic
gctgctacutcccacagauga

SEQ ID NO: 39167 - DNA, 22 bp, Artificial Sequence
  Synthetic
tgttgagccccauaatgucacg

SEQ ID NO: 39168 - DNA, 22 bp, Artificial Sequence
  Synthetic
cccatgtgugtctgtcacugaa

SEQ ID NO: 39169 - DNA, 20 bp, Artificial Sequence
  Synthetic
cctcatggcagutccctcug

SEQ ID NO: 39170 - DNA, 22 bp, Artificial Sequence
  Synthetic
gccccaggugacacaaagagua

SEQ ID NO: 39171 - DNA, 30 bp, Artificial Sequence; identical to SEQ ID NO: 26937
  Synthetic

SEQ ID NO: 39172 - DNA, 24 bp, Artificial Sequence
  Synthetic
aagtggcugcaaagaattuggaag

SEQ ID NO: 39173 - DNA, 28 bp, Artificial Sequence
  Synthetic
cccactcaccagauactgatgtttatut

SEQ ID NO: 39174 - DNA, 18 bp, Artificial Sequence
  Synthetic
cgtctuccacgcccugag

SEQ ID NO: 39175 - DNA, 17 bp, Artificial Sequence
  Synthetic
gccagcugtggguggag

SEQ ID NO: 39176 - DNA, 24 bp, Artificial Sequence
  Synthetic
gguagaagcaguagaagggaggag

SEQ ID NO: 39177 - DNA, 23 bp, Artificial Sequence
  Synthetic
agcuagcacgaggatagttuaca

SEQ ID NO: 39178 - DNA, 22 bp, Artificial Sequence
  Synthetic
aatgggctguagtgcacttuga

SEQ ID NO: 39179 - DNA, 23 bp, Artificial Sequence
  Synthetic
cccagugaaaggaacacagtuga

SEQ ID NO: 39180 - DNA, 25 bp, Artificial Sequence
  Synthetic
ggatggatcguaaagacagtctgut

SEQ ID NO: 39181 - DNA, 23 bp, Artificial Sequence
  Synthetic
aattctttccugtcgcttugcag

SEQ ID NO: 39182 - DNA, 30 bp, Artificial Sequence; identical to SEQ ID NO: 26948
  Synthetic

SEQ ID NO: 39183 - DNA, 27 bp, Artificial Sequence
  Synthetic
gaaaatgcacaccucaaaaggctaaut

SEQ ID NO: 39184 - DNA, 22 bp, Artificial Sequence
  Synthetic
agagttaggccutaccagccut

SEQ ID NO: 39185 - DNA, 22 bp, Artificial Sequence
  Synthetic
cagcatcaucagagtgccauga

SEQ ID NO: 39186 - DNA, 24 bp, Artificial Sequence
  Synthetic
gttactcaatucatgcagcaugca

SEQ ID NO: 39187 - DNA, 23 bp, Artificial Sequence
  Synthetic
ttctcatgccuagctctcuagca

SEQ ID NO: 39188 - DNA, 26 bp, Artificial Sequence
  Synthetic
actaaaacaaaautcagauggcaggt

SEQ ID NO: 39189 - DNA, 28 bp, Artificial Sequence
  Synthetic
gtccatgtagattucactggcctttaua

SEQ ID NO: 39190 - DNA, 21 bp, Artificial Sequence
  Synthetic
gctggaaguctgaacccctug

SEQ ID NO: 39191 - DNA, 28 bp, Artificial Sequence
  Synthetic
gatcaaagacaaaautgaaccaagugct

SEQ ID NO: 39192 - DNA, 28 bp, Artificial Sequence
  Synthetic
atgtttctgactguatacataacgcaut

SEQ ID NO: 39193 - DNA, 33 bp, Artificial Sequence; identical to SEQ ID NO: 26959
  Synthetic

SEQ ID NO: 39194 - DNA, 29 bp, Artificial Sequence
  Synthetic
cctctaacatucaatttcacagcugagat

SEQ ID NO: 39195 - DNA, 25 bp, Artificial Sequence
  Synthetic
gcttctccccaagcuggtattatuc

SEQ ID NO: 39196 - DNA, 22 bp, Artificial Sequence
  Synthetic
agagttgtagcucagccctcut

SEQ ID NO: 39197 - DNA, 24 bp, Artificial Sequence
  Synthetic
gaaatcacagaguttctgcuggga

SEQ ID NO: 39198 - DNA, 29 bp, Artificial Sequence
  Synthetic
gacaaacaaaaacaugaacaaattguggt

SEQ ID NO: 39199 - DNA, 21 bp, Artificial Sequence
  Synthetic
ctaccagucaggtcccaacuc

SEQ ID NO: 39200 - DNA, 25 bp, Artificial Sequence
  Synthetic
acaagtctggucaaaatactugcct

SEQ ID NO: 39201 - DNA, 28 bp, Artificial Sequence
  Synthetic
ctcctggacaaagaaauagagaagucat

SEQ ID NO: 39202 - DNA, 24 bp, Artificial Sequence
  Synthetic
acacagaccutgagttgtgtaucc

SEQ ID NO: 39203 - DNA, 22 bp, Artificial Sequence
  Synthetic
tcaagtgcccaguacaaagcuc

SEQ ID NO: 39204 - DNA, 28 bp, Artificial Sequence
  Synthetic
aagctgatgaaaaucaaagacaaaugca

SEQ ID NO: 39205 - DNA, 28 bp, Artificial Sequence
  Synthetic
tgaaugaaagggaauaactacttugaca

SEQ ID NO: 39206 - DNA, 29 bp, Artificial Sequence
  Synthetic
gtaagatcactgugaaaatctttgctuga

SEQ ID NO: 39207 - DNA, 28 bp, Artificial Sequence
  Synthetic
ccgaaacgugaagaaataatggagagua

SEQ ID NO: 39208 - DNA, 30 bp, Artificial Sequence; identical to SEQ ID NO: 26974
  Synthetic

SEQ ID NO: 39209 - DNA, 26 bp, Artificial Sequence
  Synthetic
gtgaccggguagtatactgtttctut

SEQ ID NO: 39210 - DNA, 24 bp, Artificial Sequence
  Synthetic
ggcatttgguctgtggtuagagat

SEQ ID NO: 39211 - DNA, 32 bp, Artificial Sequence; identical to SEQ ID NO: 26977
  Synthetic

SEQ ID NO: 39212 - DNA, 17 bp, Artificial Sequence
  Synthetic
ccauacaccggcucgca

SEQ ID NO: 39213 - DNA, 17 bp, Artificial Sequence
  Synthetic
ggcggcuccttggtcuc

SEQ ID NO: 39214 - DNA, 17 bp, Artificial Sequence
  Synthetic
gggcagcugcacaguct

SEQ ID NO: 39215 - DNA, 17 bp, Artificial Sequence
  Synthetic
cucctcaccuccgcgat

SEQ ID NO: 39216 - DNA, 25 bp, Artificial Sequence
  Synthetic
tcaacacutaggtaaaauccgacgt

SEQ ID NO: 39217 - DNA, 25 bp, Artificial Sequence
  Synthetic
ctcccctccauacaggtcataguaa

SEQ ID NO: 39218 - DNA, 25 bp, Artificial Sequence
  Synthetic
aattgtgttuaggagagctgacugt

SEQ ID NO: 39219 - DNA, 31 bp, Artificial Sequence; identical to SEQ ID NO: 26985
  Synthetic

SEQ ID NO: 39220 - DNA, 23 bp, Artificial Sequence
  Synthetic
gcagtgaacaugagagtgctuga

SEQ ID NO: 39221 - DNA, 25 bp, Artificial Sequence
  Synthetic
ggagaaagctugagctttccaauct

SEQ ID NO: 39222 - DNA, 28 bp, Artificial Sequence
  Synthetic
ttccttaaagaaguaatgctgauccagg

SEQ ID NO: 39223 - DNA, 26 bp, Artificial Sequence
  Synthetic
caagagugactattacugagcggaat

SEQ ID NO: 39224 - DNA, 30 bp, Artificial Sequence; identical to SEQ ID NO: 26990
  Synthetic

SEQ ID NO: 39225 - DNA, 23 bp, Artificial Sequence
  Synthetic
tcacucgggagttttctuggaac

SEQ ID NO: 39226 - DNA, 28 bp, Artificial Sequence
  Synthetic
tttaggctttuatttcagagtucacaga

SEQ ID NO: 39227 - DNA, 27 bp, Artificial Sequence
  Synthetic
cagttcccaaaguctctagaauacgac

SEQ ID NO: 39228 - DNA, 21 bp, Artificial Sequence
  Synthetic
ggcaauaccacttucggacct

SEQ ID NO: 39229 - DNA, 26 bp, Artificial Sequence
  Synthetic
gttaaagagcuaggagtgggtaggua

SEQ ID NO: 39230 - DNA, 31 bp, Artificial Sequence; identical to SEQ ID NO: 26996
  Synthetic

SEQ ID NO: 39231 - DNA, 22 bp, Artificial Sequence
  Synthetic
agagaatgagaauccgcaugcc

SEQ ID NO: 39232 - DNA, 24 bp, Artificial Sequence
  Synthetic
tcatgtaagcutaaacagcguggt

SEQ ID NO: 39233 - DNA, 30 bp, Artificial Sequence; identical to SEQ ID NO: 26999
  Synthetic

SEQ ID NO: 39234 - DNA, 22 bp, Artificial Sequence
  Synthetic
tgtgaagcaggccucacttuag

SEQ ID NO: 39235 - DNA, 21 bp, Artificial Sequence
  Synthetic
ctgggagagggaaugtuccag

SEQ ID NO: 39236 - DNA, 20 bp, Artificial Sequence
  Synthetic
cagcugctguaggaaggcat

SEQ ID NO: 39237 - DNA, 25 bp, Artificial Sequence
  Synthetic
catccctauaagaagccctacaugg

SEQ ID NO: 39238 - DNA, 23 bp, Artificial Sequence
  Synthetic
aatgaatactccucacccccuca

SEQ ID NO: 39239 - DNA, 23 bp, Artificial Sequence
  Synthetic
accagtgugagaatggtgttucc

SEQ ID NO: 39240 - DNA, 23 bp, Artificial Sequence
  Synthetic
tgctggctuacctgggtaattug

SEQ ID NO: 39241 - DNA, 27 bp, Artificial Sequence
  Synthetic
cttgttctctcutcctctttcctucag

SEQ ID NO: 39242 - DNA, 22 bp, Artificial Sequence
  Synthetic
cgtgagugcagaacgctgtaut

SEQ ID NO: 39243 - DNA, 25 bp, Artificial Sequence
  Synthetic
gcagggutttatcuggagacaaagg

SEQ ID NO: 39244 - DNA, 30 bp, Artificial Sequence; identical to SEQ ID NO: 27010
  Synthetic

SEQ ID NO: 39245 - DNA, 21 bp, Artificial Sequence
  Synthetic
ccctccguccctctctctuag

SEQ ID NO: 39246 - DNA, 19 bp, Artificial Sequence
  Synthetic
gaagcgcgagguctcctua

SEQ ID NO: 39247 - DNA, 20 bp, Artificial Sequence
  Synthetic
cccctgcutcttgtccucag

SEQ ID NO: 39248 - DNA, 19 bp, Artificial Sequence
  Synthetic
gcagagcuccattguggca

SEQ ID NO: 39249 - DNA, 32 bp, Artificial Sequence; identical to SEQ ID NO: 27015
  Synthetic

SEQ ID NO: 39250 - DNA, 22 bp, Artificial Sequence
  Synthetic
ctgtgaagacagucttcuccgt

SEQ ID NO: 39251 - DNA, 24 bp, Artificial Sequence
  Synthetic
gaggagaucaaaacccagaagguc

SEQ ID NO: 39252 - DNA, 20 bp, Artificial Sequence
  Synthetic
cguggacacgaagaucagct

SEQ ID NO: 39253 - DNA, 22 bp, Artificial Sequence
  Synthetic
agcattggaaagauctggcuca

SEQ ID NO: 39254 - DNA, 17 bp, Artificial Sequence
  Synthetic
gctccuaggcgggucct

SEQ ID NO: 39255 - DNA, 19 bp, Artificial Sequence
  Synthetic
cccagucuccgagggaaga

SEQ ID NO: 39256 - DNA, 26 bp, Artificial Sequence
  Synthetic
gacgcagcuacattttacctugaaat

SEQ ID NO: 39257 - DNA, 21 bp, Artificial Sequence
  Synthetic
gctgcttaacguggcagagut

SEQ ID NO: 39258 - DNA, 24 bp, Artificial Sequence
  Synthetic
ggtgguacccattguaaaggaagt

SEQ ID NO: 39259 - DNA, 22 bp, Artificial Sequence
  Synthetic
ccatgcatguggcctacuacag

SEQ ID NO: 39260 - DNA, 21 bp, Artificial Sequence
  Synthetic
cgaagtccucttgctcgucac

SEQ ID NO: 39261 - DNA, 22 bp, Artificial Sequence
  Synthetic
tcccaaggccucttccacuaat

SEQ ID NO: 39262 - DNA, 23 bp, Artificial Sequence
  Synthetic
gcatgaagagggcguacaagtua

SEQ ID NO: 39263 - DNA, 30 bp, Artificial Sequence; identical to SEQ ID NO: 27029
  Synthetic

SEQ ID NO: 39264 - DNA, 26 bp, Artificial Sequence
  Synthetic
tacacgttucagaagacatccuaaag

SEQ ID NO: 39265 - DNA, 23 bp, Artificial Sequence
  Synthetic
tccatccucaggcgtagaagtua

SEQ ID NO: 39266 - DNA, 21 bp, Artificial Sequence
  Synthetic
aggaugaaccgggaggaatug

SEQ ID NO: 39267 - DNA, 21 bp, Artificial Sequence
  Synthetic
agcaaggcuccgtcucaaaaa

SEQ ID NO: 39268 - DNA, 19 bp, Artificial Sequence
  Synthetic
cagaugcaccgacugcaag

SEQ ID NO: 39269 - DNA, 22 bp, Artificial Sequence
  Synthetic
ttcccagtgucttagccctgua

SEQ ID NO: 39270 - DNA, 30 bp, Artificial Sequence; identical to SEQ ID NO: 27036
  Synthetic

SEQ ID NO: 39271 - DNA, 22 bp, Artificial Sequence
  Synthetic
gcatgcauagaccaatgggtut

SEQ ID NO: 39272 - DNA, 25 bp, Artificial Sequence
  Synthetic
gagacaagagggagguattctuact

SEQ ID NO: 39273 - DNA, 21 bp, Artificial Sequence
  Synthetic
cagctgaugatggcaacucac

SEQ ID NO: 39274 - DNA, 17 bp, Artificial Sequence
  Synthetic
ccctcccugccauggac

SEQ ID NO: 39275 - DNA, 21 bp, Artificial Sequence
  Synthetic
gggacccaaaugtggtacuca

SEQ ID NO: 39276 - DNA, 30 bp, Artificial Sequence; identical to SEQ ID NO: 27042
  Synthetic

SEQ ID NO: 39277 - DNA, 24 bp, Artificial Sequence
  Synthetic
tgcatttuggaggagctctactuc

SEQ ID NO: 39278 - DNA, 30 bp, Artificial Sequence; identical to SEQ ID NO: 27044
  Synthetic

SEQ ID NO: 39279 - DNA, 23 bp, Artificial Sequence
  Synthetic
ccccttccugtaccatcttucct

SEQ ID NO: 39280 - DNA, 22 bp, Artificial Sequence
  Synthetic
tccacccucctctacccuaaga

SEQ ID NO: 39281 - DNA, 24 bp, Artificial Sequence
  Synthetic
ctggtggaugtgcagtucaaaaag

SEQ ID NO: 39282 - DNA, 23 bp, Artificial Sequence
  Synthetic
acctcccaguatgtgauggagac

SEQ ID NO: 39283 - DNA, 24 bp, Artificial Sequence
  Synthetic
gaaattctgcautggtgctuagga

SEQ ID NO: 39284 - DNA, 24 bp, Artificial Sequence
  Synthetic
cccttttccucaatccaugaccaa

SEQ ID NO: 39285 - DNA, 25 bp, Artificial Sequence
  Synthetic
gaatcgagccuggtctctaaaguag

SEQ ID NO: 39286 - DNA, 25 bp, Artificial Sequence
  Synthetic
gggaaggaaguagataaggtgcuga

SEQ ID NO: 39287 - DNA, 22 bp, Artificial Sequence
  Synthetic
ctggttucaggaagctcucagg

SEQ ID NO: 39288 - DNA, 28 bp, Artificial Sequence
  Synthetic
gagagaaatgaaguctaacactagtucc

SEQ ID NO: 39289 - DNA, 26 bp, Artificial Sequence
  Synthetic
ccccaugaggaggttttctctuagat

SEQ ID NO: 39290 - DNA, 30 bp, Artificial Sequence; identical to SEQ ID NO: 27056
  Synthetic

SEQ ID NO: 39291 - DNA, 26 bp, Artificial Sequence
  Synthetic
cctcttccucgtgctgattttuaaag

SEQ ID NO: 39292 - DNA, 21 bp, Artificial Sequence
  Synthetic
gtgaccagacaguggatugga

SEQ ID NO: 39293 - DNA, 29 bp, Artificial Sequence
  Synthetic
cgtatgcaatgatuactccagtgtactua

SEQ ID NO: 39294 - DNA, 22 bp, Artificial Sequence
  Synthetic
cttcuacccagaggcagaagug

SEQ ID NO: 39295 - DNA, 23 bp, Artificial Sequence
  Synthetic
atcagacttccucaccccaguaa

SEQ ID NO: 39296 - DNA, 28 bp, Artificial Sequence
  Synthetic
aagcattaagaguatcaacagtgcugaa

SEQ ID NO: 39297 - DNA, 23 bp, Artificial Sequence
  Synthetic
tgactcacugtctagctctugct

SEQ ID NO: 39298 - DNA, 24 bp, Artificial Sequence
  Synthetic
gctgctgtccuccatgctattuac

SEQ ID NO: 39299 - DNA, 30 bp, Artificial Sequence; identical to SEQ ID NO: 27065
  Synthetic

SEQ ID NO: 39300 - DNA, 17 bp, Artificial Sequence
  Synthetic
agtcugagcggcgaugg

SEQ ID NO: 39301 - DNA, 17 bp, Artificial Sequence
  Synthetic
cuccagcagcagcucct

SEQ ID NO: 39302 - DNA, 22 bp, Artificial Sequence
  Synthetic
tggtgguggaagtgcaacauat

SEQ ID NO: 39303 - DNA, 31 bp, Artificial Sequence; identical to SEQ ID NO: 27069
  Synthetic

SEQ ID NO: 39304 - DNA, 22 bp, Artificial Sequence
  Synthetic
gctcactttcauggctgtggut

SEQ ID NO: 39305 - DNA, 27 bp, Artificial Sequence
  Synthetic
tgttaacaccaaauaacttactgcuca

SEQ ID NO: 39306 - DNA, 25 bp, Artificial Sequence
  Synthetic
gtgtataaactcuccaggttgccut

SEQ ID NO: 39307 - DNA, 21 bp, Artificial Sequence
  Synthetic
ggagcagcccauctatccuga

SEQ ID NO: 39308 - DNA, 25 bp, Artificial Sequence
  Synthetic
cgacatcatgguattccccttacua

SEQ ID NO: 39309 - DNA, 18 bp, Artificial Sequence
  Synthetic
tgggcctucccctacucc

SEQ ID NO: 39310 - DNA, 24 bp, Artificial Sequence
  Synthetic
aatgtggaagugactagugaagcc

SEQ ID NO: 39311 - DNA, 23 bp, Artificial Sequence
  Synthetic
catagcccauctccagctcatuc

SEQ ID NO: 39312 - DNA, 24 bp, Artificial Sequence
  Synthetic
ggccagagaagaaacutccacauc

SEQ ID NO: 39313 - DNA, 18 bp, Artificial Sequence
  Synthetic
cgagcagaucgcccucaa

SEQ ID NO: 39314 - DNA, 23 bp, Artificial Sequence
  Synthetic
aaggccttguttctgtcttuagg

SEQ ID NO: 39315 - DNA, 30 bp, Artificial Sequence; identical to SEQ ID NO: 27081
  Synthetic

SEQ ID NO: 39316 - DNA, 21 bp, Artificial Sequence
  Synthetic
gctggtcucaatcagctccug

SEQ ID NO: 39317 - DNA, 21 bp, Artificial Sequence
  Synthetic
ctcacacccacuctcctgaug

SEQ ID NO: 39318 - DNA, 19 bp, Artificial Sequence
  Synthetic
gtguctctgcauccaggga

SEQ ID NO: 39319 - DNA, 18 bp, Artificial Sequence
  Synthetic
ctctcaacccugcccugt

SEQ ID NO: 39320 - DNA, 21 bp, Artificial Sequence
  Synthetic
actcatctcuggcctctugga

SEQ ID NO: 39321 - DNA, 20 bp, Artificial Sequence
  Synthetic
ggctgaagagugagcctugt

SEQ ID NO: 39322 - DNA, 22 bp, Artificial Sequence
  Synthetic
ctctacguccaccatcaagucc

SEQ ID NO: 39323 - DNA, 22 bp, Artificial Sequence
  Synthetic
cagtgtugcccagtagagucac

SEQ ID NO: 39324 - DNA, 21 bp, Artificial Sequence
  Synthetic
tgtctcctccucgtactgcuc

SEQ ID NO: 39325 - DNA, 22 bp, Artificial Sequence
  Synthetic
gctgggctuggttgaagtacua

SEQ ID NO: 39326 - DNA, 23 bp, Artificial Sequence
  Synthetic
ggccattucacaagtcatgucct

SEQ ID NO: 39327 - DNA, 22 bp, Artificial Sequence
  Synthetic
ccttcctgucttgcttccugaa

SEQ ID NO: 39328 - DNA, 17 bp, Artificial Sequence
  Synthetic
cguggcctccuccaggt

SEQ ID NO: 39329 - DNA, 20 bp, Artificial Sequence
  Synthetic
cuttgtgtcugacccaggca

SEQ ID NO: 39330 - DNA, 22 bp, Artificial Sequence
  Synthetic
gcctcagtuacctcagggcuat

SEQ ID NO: 39331 - DNA, 22 bp, Artificial Sequence
  Synthetic
gaaggaaggcuacctgtcacuc

SEQ ID NO: 39332 - DNA, 23 bp, Artificial Sequence
  Synthetic
cattggtgtugcctgcaaaauct

SEQ ID NO: 39333 - DNA, 21 bp, Artificial Sequence
  Synthetic
caucgctaagcugaccaagga

SEQ ID NO: 39334 - DNA, 23 bp, Artificial Sequence
  Synthetic
aggaccaggauaacacuctaguc

SEQ ID NO: 39335 - DNA, 23 bp, Artificial Sequence
  Synthetic
tggaggaugaggaggagaugaac

SEQ ID NO: 39336 - DNA, 21 bp, Artificial Sequence
  Synthetic
cctggttgugagatgggcuat

SEQ ID NO: 39337 - DNA, 22 bp, Artificial Sequence
  Synthetic
ccaccaugaaggaagagtucgg

SEQ ID NO: 39338 - DNA, 20 bp, Artificial Sequence
  Synthetic
ttgacatugcggatcugcct

SEQ ID NO: 39339 - DNA, 21 bp, Artificial Sequence
  Synthetic
gcctgttgcauctacccctug

SEQ ID NO: 39340 - DNA, 22 bp, Artificial Sequence
  Synthetic
ctcccccugttctatgagcuct

SEQ ID NO: 39341 - DNA, 23 bp, Artificial Sequence
  Synthetic
actttacccuaaggctgacccut

SEQ ID NO: 39342 - DNA, 24 bp, Artificial Sequence
  Synthetic
tttcctcaucaaactcaagcauca

SEQ ID NO: 39343 - DNA, 29 bp, Artificial Sequence
  Synthetic
tgttgattatttcucctctcgctgttuag

SEQ ID NO: 39344 - DNA, 22 bp, Artificial Sequence
  Synthetic
ccaggaugttgtaguccacagt

SEQ ID NO: 39345 - DNA, 24 bp, Artificial Sequence
  Synthetic
tgattctctcuttgcctctucacc

SEQ ID NO: 39346 - DNA, 23 bp, Artificial Sequence
  Synthetic
ctcagcaaauggctgttgaaugt

SEQ ID NO: 39347 - DNA, 22 bp, Artificial Sequence
  Synthetic
gcagcaggugtactactccauc

SEQ ID NO: 39348 - DNA, 18 bp, Artificial Sequence
  Synthetic
gtcagcaccucaggccut

SEQ ID NO: 39349 - DNA, 22 bp, Artificial Sequence
  Synthetic
ctctttgtcuctcgctctgucc

SEQ ID NO: 39350 - DNA, 18 bp, Artificial Sequence
  Synthetic
tgcaugcaggagtcgtug

SEQ ID NO: 39351 - DNA, 25 bp, Artificial Sequence
  Synthetic
ctctactcuctttccttccucacct

SEQ ID NO: 39352 - DNA, 26 bp, Artificial Sequence
  Synthetic
aagccagauacagtacaatcaacugg

SEQ ID NO: 39353 - DNA, 24 bp, Artificial Sequence
  Synthetic
catgcagttcugctcctttcauag

SEQ ID NO: 39354 - DNA, 20 bp, Artificial Sequence
  Synthetic
tgcaaucccagcctuaaacc

SEQ ID NO: 39355 - DNA, 19 bp, Artificial Sequence
  Synthetic
cagatccucagcccugacc

SEQ ID NO: 39356 - DNA, 21 bp, Artificial Sequence
  Synthetic
cctggctuatttaggccucca

SEQ ID NO: 39357 - DNA, 18 bp, Artificial Sequence
  Synthetic
cttaugcgcccccuccag

SEQ ID NO: 39358 - DNA, 24 bp, Artificial Sequence
  Synthetic
tggcttugacaaactcttcctugt

SEQ ID NO: 39359 - DNA, 22 bp, Artificial Sequence
  Synthetic
gggctcccucaggagtaacaua

SEQ ID NO: 39360 - DNA, 20 bp, Artificial Sequence
  Synthetic
agggtgcuctgtctggguat

SEQ ID NO: 39361 - DNA, 19 bp, Artificial Sequence
  Synthetic
tcaccucatgcucccacct

SEQ ID NO: 39362 - DNA, 22 bp, Artificial Sequence
  Synthetic
cattctccucagctggttguca

SEQ ID NO: 39363 - DNA, 19 bp, Artificial Sequence
  Synthetic
cgagcagaucgcccucaag

SEQ ID NO: 39364 - DNA, 21 bp, Artificial Sequence
  Synthetic
cggagagacacuggtcuggat

SEQ ID NO: 39365 - DNA, 23 bp, Artificial Sequence
  Synthetic
gatgctcaaugcttttcctgcuc

SEQ ID NO: 39366 - DNA, 22 bp, Artificial Sequence
  Synthetic
acccgcucactagtctcaauca

SEQ ID NO: 39367 - DNA, 21 bp, Artificial Sequence
  Synthetic
ctcatgcccacuctcctgauc

SEQ ID NO: 39368 - DNA, 18 bp, Artificial Sequence
  Synthetic
gcgtguctctgcguccag

SEQ ID NO: 39369 - DNA, 17 bp, Artificial Sequence
  Synthetic
ccctgugccctgacugt

SEQ ID NO: 39370 - DNA, 17 bp, Artificial Sequence
  Synthetic
ccuccccagcctctugg

SEQ ID NO: 39371 - DNA, 20 bp, Artificial Sequence
  Synthetic
ggctgaagagugagcctugt

SEQ ID NO: 39372 - DNA, 22 bp, Artificial Sequence
  Synthetic
ctacgtccaccaucaagtccuc

SEQ ID NO: 39373 - DNA, 22 bp, Artificial Sequence
  Synthetic
gtttcctcutgtccccauccac

SEQ ID NO: 39374 - DNA, 23 bp, Artificial Sequence
  Synthetic
gtctcatactuggtcctccacug

SEQ ID NO: 39375 - DNA, 25 bp, Artificial Sequence
  Synthetic
gggttgcttuatggagaaagcugaa

SEQ ID NO: 39376 - DNA, 20 bp, Artificial Sequence
  Synthetic
gagacugtggugggaaccat

SEQ ID NO: 39377 - DNA, 28 bp, Artificial Sequence
  Synthetic
catcatataactcuccttcccttcucag

SEQ ID NO: 39378 - DNA, 17 bp, Artificial Sequence
  Synthetic
cguggcctccuccaggt

SEQ ID NO: 39379 - DNA, 18 bp, Artificial Sequence
  Synthetic
tcugaccaggcacgcauc

SEQ ID NO: 39380 - DNA, 23 bp, Artificial Sequence
  Synthetic
ccugtaatgctgugaacaggaca

SEQ ID NO: 39381 - DNA, 22 bp, Artificial Sequence
  Synthetic
ccttaccucaccatccctccut

SEQ ID NO: 39382 - DNA, 23 bp, Artificial Sequence
  Synthetic
gggcacagauagacatggcauat

SEQ ID NO: 39383 - DNA, 22 bp, Artificial Sequence
  Synthetic
gatcatugccaagcugaccaag

SEQ ID NO: 39384 - DNA, 25 bp, Artificial Sequence
  Synthetic
agtatggtcugagagtcctgaugag

SEQ ID NO: 39385 - DNA, 24 bp, Artificial Sequence
  Synthetic
caaggugaaggagaugaacgagag

SEQ ID NO: 39386 - DNA, 21 bp, Artificial Sequence
  Synthetic
ggguggaagagccaacaguag

SEQ ID NO: 39387 - DNA, 25 bp, Artificial Sequence
  Synthetic
gcugaagagugcagaaagagagaag

SEQ ID NO: 39388 - DNA, 22 bp, Artificial Sequence
  Synthetic
cgggaaaccucctcttgagauc

SEQ ID NO: 39389 - DNA, 22 bp, Artificial Sequence
  Synthetic
cccaccatcuctttccctcgua

SEQ ID NO: 39390 - DNA, 22 bp, Artificial Sequence
  Synthetic
ctcccccugttctatgagcuct

SEQ ID NO: 39391 - DNA, 25 bp, Artificial Sequence
  Synthetic
acagactccucctacttccttctug

SEQ ID NO: 39392 - DNA, 17 bp, Artificial Sequence
  Synthetic
gggctgugtcccacuca

SEQ ID NO: 39393 - DNA, 25 bp, Artificial Sequence
  Synthetic
caaaugccagcaaggatguaaagag

SEQ ID NO: 39394 - DNA, 24 bp, Artificial Sequence
  Synthetic
ccaatgatgtugtagtccacgaug

SEQ ID NO: 39395 - DNA, 22 bp, Artificial Sequence
  Synthetic
cactcagtgaugctctctccug

SEQ ID NO: 39396 - DNA, 22 bp, Artificial Sequence
  Synthetic
gggagcgagugagtgattgtuc

SEQ ID NO: 39397 - DNA, 23 bp, Artificial Sequence
  Synthetic
aatatgggtcuctcctccaccut

SEQ ID NO: 39398 - DNA, 21 bp, Artificial Sequence
  Synthetic
gagaugactgcugagcagaca

SEQ ID NO: 39399 - DNA, 27 bp, Artificial Sequence
  Synthetic
cttcactucagaggagaaaaacuccat

SEQ ID NO: 39400 - DNA, 22 bp, Artificial Sequence
  Synthetic
gcgtctuagctctgctttugga

SEQ ID NO: 39401 - DNA, 22 bp, Artificial Sequence
  Synthetic
gtgtcccacccuaaccatgtut

SEQ ID NO: 39402 - DNA, 24 bp, Artificial Sequence
  Synthetic
agagagagaggucaagaccagaug

SEQ ID NO: 39403 - DNA, 22 bp, Artificial Sequence
  Synthetic
agauatgagcctucccccaact

SEQ ID NO: 39404 - DNA, 21 bp, Artificial Sequence
  Synthetic
caggugagagctcttcuccct

SEQ ID NO: 39405 - DNA, 22 bp, Artificial Sequence
  Synthetic
ccaauaagcccctgtctucaca

SEQ ID NO: 39406 - DNA, 23 bp, Artificial Sequence
  Synthetic
cctatcccagutccctucaggaa

SEQ ID NO: 39407 - DNA, 25 bp, Artificial Sequence
  Synthetic
gcaagtcacugctccttttctaucc

SEQ ID NO: 39408 - DNA, 23 bp, Artificial Sequence
  Synthetic
cgatcctugaggttguagagcac

SEQ ID NO: 39409 - DNA, 23 bp, Artificial Sequence
  Synthetic
ctcttgagcacuattgccctguc

SEQ ID NO: 39410 - DNA, 23 bp, Artificial Sequence
  Synthetic
aaactccugtttgtcaucaggca

SEQ ID NO: 39411 - DNA, 21 bp, Artificial Sequence
  Synthetic
aagggaagaaugggcagaugg

SEQ ID NO: 39412 - DNA, 20 bp, Artificial Sequence
  Synthetic
ctgcuccaggaatccctucg

SEQ ID NO: 39413 - DNA, 20 bp, Artificial Sequence
  Synthetic
ccttctgcugcagggcaaua

SEQ ID NO: 39414 - DNA, 17 bp, Artificial Sequence
  Synthetic
ccuagggucgcccgagt

SEQ ID NO: 39415 - DNA, 22 bp, Artificial Sequence
  Synthetic
ggagaccagcuactgctucaag

SEQ ID NO: 39416 - DNA, 19 bp, Artificial Sequence
  Synthetic
cgagaacuggtggctcucc

SEQ ID NO: 39417 - DNA, 18 bp, Artificial Sequence
  Synthetic
tcgatgcugccgtcgtut

SEQ ID NO: 39418 - DNA, 17 bp, Artificial Sequence
  Synthetic
cccagcaggcugtgcuc

SEQ ID NO: 39419 - DNA, 18 bp, Artificial Sequence
  Synthetic
gucccaaggugaccagca

SEQ ID NO: 39420 - DNA, 28 bp, Artificial Sequence
  Synthetic
tttttaacgtatcutagtgtgagcucgt

SEQ ID NO: 39421 - DNA, 23 bp, Artificial Sequence
  Synthetic
gcatggcccuttggagacuaaag

SEQ ID NO: 39422 - DNA, 23 bp, Artificial Sequence
  Synthetic
gggactccutgctaaccauagga

SEQ ID NO: 39423 - DNA, 30 bp, Artificial Sequence; identical to SEQ ID NO: 27189
  Synthetic

SEQ ID NO: 39424 - DNA, 21 bp, Artificial Sequence
  Synthetic
ggtggtuaatgtgtccucggt

SEQ ID NO: 39425 - DNA, 21 bp, Artificial Sequence
  Synthetic
ccaagttgcugtggacctcua

SEQ ID NO: 39426 - DNA, 23 bp, Artificial Sequence
  Synthetic
ctcttcuccccctttgucaagac

SEQ ID NO: 39427 - DNA, 22 bp, Artificial Sequence
  Synthetic
atcaggcacaaacucagctuct

SEQ ID NO: 39428 - DNA, 23 bp, Artificial Sequence
  Synthetic
cttctaggaauccggtgggagua

SEQ ID NO: 39429 - DNA, 20 bp, Artificial Sequence
  Synthetic
aggtguccacaactcaugcc

SEQ ID NO: 39430 - DNA, 24 bp, Artificial Sequence
  Synthetic
gttgttaaucccaggtcuaaccgt

SEQ ID NO: 39431 - DNA, 24 bp, Artificial Sequence
  Synthetic
gccatatttcaaugtcagctccuc

SEQ ID NO: 39432 - DNA, 24 bp, Artificial Sequence
  Synthetic
ggtaatgtggutggtgatcuccat

SEQ ID NO: 39433 - DNA, 24 bp, Artificial Sequence
  Synthetic
caaagatctgugtctcatgcucac

SEQ ID NO: 39434 - DNA, 30 bp, Artificial Sequence; identical to SEQ ID NO: 27200
  Synthetic

SEQ ID NO: 39435 - DNA, 23 bp, Artificial Sequence
  Synthetic
catucccaccacaccaaaatucc

SEQ ID NO: 39436 - DNA, 26 bp, Artificial Sequence
  Synthetic
cctaccacccauttacaagttuagcc

SEQ ID NO: 39437 - DNA, 27 bp, Artificial Sequence
  Synthetic
tgcttcagtuccgataaattcuacact

SEQ ID NO: 39438 - DNA, 26 bp, Artificial Sequence
  Synthetic
gagctgtaactuccactttctctuga

SEQ ID NO: 39439 - DNA, 28 bp, Artificial Sequence
  Synthetic
actttgcaacauagagaaatgcacauac

SEQ ID NO: 39440 - DNA, 24 bp, Artificial Sequence
  Synthetic
tgtgaatgtgugtctttcccauct

SEQ ID NO: 39441 - DNA, 30 bp, Artificial Sequence; identical to SEQ ID NO: 27207
  Synthetic

SEQ ID NO: 39442 - DNA, 22 bp, Artificial Sequence
  Synthetic
ccgaagacagcacugttaccug

SEQ ID NO: 39443 - DNA, 21 bp, Artificial Sequence
  Synthetic
ccaagtcucccctcttcaugg

SEQ ID NO: 39444 - DNA, 22 bp, Artificial Sequence
  Synthetic
cctacagauaccagggugcaac

SEQ ID NO: 39445 - DNA, 25 bp, Artificial Sequence
  Synthetic
gccttgaauttcttttcugcacgac

SEQ ID NO: 39446 - DNA, 23 bp, Artificial Sequence
  Synthetic
acagcttctuacagtgctggaug

SEQ ID NO: 39447 - DNA, 24 bp, Artificial Sequence
  Synthetic
gctacactcutccaaacctucact

SEQ ID NO: 39448 - DNA, 27 bp, Artificial Sequence
  Synthetic
aaggcttctgaguggtacaacttttua

SEQ ID NO: 39449 - DNA, 21 bp, Artificial Sequence
  Synthetic
caaggcugacactcacgauga

SEQ ID NO: 39450 - DNA, 22 bp, Artificial Sequence
  Synthetic
gggtgatcutgttgaaggtugg

SEQ ID NO: 39451 - DNA, 24 bp, Artificial Sequence
  Synthetic
ctgatcacugggagtcatcatgug

SEQ ID NO: 39452 - DNA, 22 bp, Artificial Sequence
  Synthetic
tgagttggccuacaggtatugt

SEQ ID NO: 39453 - DNA, 30 bp, Artificial Sequence; identical to SEQ ID NO: 27219
  Synthetic

SEQ ID NO: 39454 - DNA, 21 bp, Artificial Sequence
  Synthetic
gcttcagaaucacagcucggt

SEQ ID NO: 39455 - DNA, 20 bp, Artificial Sequence
  Synthetic
acagaugcgctaaugacggt

SEQ ID NO: 39456 - DNA, 28 bp, Artificial Sequence
  Synthetic
cgcaattttccuattatcggagugaaag

SEQ ID NO: 39457 - DNA, 20 bp, Artificial Sequence
  Synthetic
gagugagaggactccuccgt

SEQ ID NO: 39458 - DNA, 20 bp, Artificial Sequence
  Synthetic
gcaggagugctcacgatcug

SEQ ID NO: 39459 - DNA, 27 bp, Artificial Sequence
  Synthetic
gccctcttaacuacactctcatuacct

SEQ ID NO: 39460 - DNA, 25 bp, Artificial Sequence
  Synthetic
cacagcauccaagaggtaaagtuct

SEQ ID NO: 39461 - DNA, 27 bp, Artificial Sequence
  Synthetic
ggctttcttcaugatcttgtacatguc

SEQ ID NO: 39462 - DNA, 21 bp, Artificial Sequence
  Synthetic
cccctgugttgttcccuacat

SEQ ID NO: 39463 - DNA, 26 bp, Artificial Sequence
  Synthetic
gtcagttctgauaatcggaggtguac

SEQ ID NO: 39464 - DNA, 25 bp, Artificial Sequence
  Synthetic
agacagaagautcccttuccagaga

SEQ ID NO: 39465 - DNA, 21 bp, Artificial Sequence
  Synthetic
tctcauggctcagtucccaac

SEQ ID NO: 39466 - DNA, 20 bp, Artificial Sequence
  Synthetic
cctgctcccauatggctcuc

SEQ ID NO: 39467 - DNA, 20 bp, Artificial Sequence
  Synthetic
cccaucaagagcatcuccca

SEQ ID NO: 39468 - DNA, 20 bp, Artificial Sequence
  Synthetic
gagtugggaagggaccctug

SEQ ID NO: 39469 - DNA, 25 bp, Artificial Sequence
  Synthetic
catgttgatguaggttttgctccug

SEQ ID NO: 39470 - DNA, 21 bp, Artificial Sequence
  Synthetic
gcttgcttcuggtgacacuga

SEQ ID NO: 39471 - DNA, 20 bp, Artificial Sequence
  Synthetic
cattctccccugcaccauct

SEQ ID NO: 39472 - DNA, 23 bp, Artificial Sequence
  Synthetic
tgtgcctgtucagactgtaaucc

SEQ ID NO: 39473 - DNA, 20 bp, Artificial Sequence
  Synthetic
gcauaggaagcccctguagc

SEQ ID NO: 39474 - DNA, 22 bp, Artificial Sequence
  Synthetic
acacagccagguggaatttgut

SEQ ID NO: 39475 - DNA, 23 bp, Artificial Sequence
  Synthetic
cccatttgguttgagcaacucac

SEQ ID NO: 39476 - DNA, 22 bp, Artificial Sequence
  Synthetic
ctccuagaccctcccuccaaat

SEQ ID NO: 39477 - DNA, 23 bp, Artificial Sequence
  Synthetic
tgactcccacgcutcattttcuc

SEQ ID NO: 39478 - DNA, 22 bp, Artificial Sequence
  Synthetic
ctccacguccacctctaacaug

SEQ ID NO: 39479 - DNA, 25 bp, Artificial Sequence
  Synthetic
agattatcaggugagatgcctgtug

SEQ ID NO: 39480 - DNA, 21 bp, Artificial Sequence
  Synthetic
ctttcctcutgccccguaaga

SEQ ID NO: 39481 - DNA, 26 bp, Artificial Sequence
  Synthetic
gtgaaactgaaaucctgagtgaucct

SEQ ID NO: 39482 - DNA, 24 bp, Artificial Sequence
  Synthetic
agtattggcugtcttgaggaaugc

SEQ ID NO: 39483 - DNA, 24 bp, Artificial Sequence
  Synthetic
gcttcagcauctgcatcttctuct

SEQ ID NO: 39484 - DNA, 17 bp, Artificial Sequence
  Synthetic
cgacgcccgugtgtugt

SEQ ID NO: 39485 - DNA, 18 bp, Artificial Sequence
  Synthetic
gctgtccuccgccttgug

SEQ ID NO: 39486 - DNA, 21 bp, Artificial Sequence
  Synthetic
ccctgtccutctggttctgug

SEQ ID NO: 39487 - DNA, 25 bp, Artificial Sequence
  Synthetic
gcatcttugagagcctcagagtaut

SEQ ID NO: 39488 - DNA, 17 bp, Artificial Sequence
  Synthetic
gcgactuccggacugct

SEQ ID NO: 39489 - DNA, 19 bp, Artificial Sequence
  Synthetic
caggcuccggatcttccug

SEQ ID NO: 39490 - DNA, 22 bp, Artificial Sequence
  Synthetic
agccattucctgaagcuaccac

SEQ ID NO: 39491 - DNA, 22 bp, Artificial Sequence
  Synthetic
agatggctgaugaggcattcuc

SEQ ID NO: 39492 - DNA, 21 bp, Artificial Sequence
  Synthetic
gggcctgaugggatctgauct

SEQ ID NO: 39493 - DNA, 24 bp, Artificial Sequence
  Synthetic
tcatgctgttuagtcactgctcug

SEQ ID NO: 39494 - DNA, 24 bp, Artificial Sequence
  Synthetic
ccatccctcucctttttctcucct

SEQ ID NO: 39495 - DNA, 24 bp, Artificial Sequence
  Synthetic
cagctctuaaaagatgccttuccc

SEQ ID NO: 39496 - DNA, 27 bp, Artificial Sequence
  Synthetic
tataggtgatgugcttcattttcaucc

SEQ ID NO: 39497 - DNA, 22 bp, Artificial Sequence
  Synthetic
tgccaggutggtatucaaccat

SEQ ID NO: 39498 - DNA, 23 bp, Artificial Sequence
  Synthetic
tcccaccuttttatctucacgca

SEQ ID NO: 39499 - DNA, 28 bp, Artificial Sequence
  Synthetic
gtttatttgacacugaaacgaagagcut

SEQ ID NO: 39500 - DNA, 22 bp, Artificial Sequence
  Synthetic
actaaagcuggccctgaaugag

SEQ ID NO: 39501 - DNA, 31 bp, Artificial Sequence; identical to SEQ ID NO: 27267
  Synthetic

SEQ ID NO: 39502 - DNA, 29 bp, Artificial Sequence
  Synthetic
ctggatcagacuttactggagtuaaacaa

SEQ ID NO: 39503 - DNA, 18 bp, Artificial Sequence
  Synthetic
accaggaucgcccugaca

SEQ ID NO: 39504 - DNA, 22 bp, Artificial Sequence
  Synthetic
aggutcatggacugaggcaaag

SEQ ID NO: 39505 - DNA, 22 bp, Artificial Sequence
  Synthetic
cctaccuccaggagaagccaua

SEQ ID NO: 39506 - DNA, 22 bp, Artificial Sequence
  Synthetic
cgggaagcacuatggcatcuat

SEQ ID NO: 39507 - DNA, 21 bp, Artificial Sequence
  Synthetic
ggctuggacattttugcccaa

SEQ ID NO: 39508 - DNA, 20 bp, Artificial Sequence
  Synthetic
gaugaaccaggacggugagg

SEQ ID NO: 39509 - DNA, 21 bp, Artificial Sequence
  Synthetic
ggactcagugttggacuccat

SEQ ID NO: 39510 - DNA, 21 bp, Artificial Sequence
  Synthetic
cgagaagcaggcgcuaagauc

SEQ ID NO: 39511 - DNA, 22 bp, Artificial Sequence
  Synthetic
cacttgacggccaugaagagua

SEQ ID NO: 39512 - DNA, 22 bp, Artificial Sequence
  Synthetic
aagctgtgugtctgccauaaca

SEQ ID NO: 39513 - DNA, 23 bp, Artificial Sequence
  Synthetic
ccggaaccgagagauagttucct

SEQ ID NO: 39514 - DNA, 21 bp, Artificial Sequence
  Synthetic
gccagcctuataacagccgua

SEQ ID NO: 39515 - DNA, 24 bp, Artificial Sequence
  Synthetic
gttagaggucagggacagaugagt

SEQ ID NO: 39516 - DNA, 21 bp, Artificial Sequence
  Synthetic
gactagtgcucagaagcuggt

SEQ ID NO: 39517 - DNA, 27 bp, Artificial Sequence
  Synthetic
gaacataucacaaaggagcttcuccat

SEQ ID NO: 39518 - DNA, 28 bp, Artificial Sequence
  Synthetic
aatgccacatuactctttattgaaugcg

SEQ ID NO: 39519 - DNA, 23 bp, Artificial Sequence
  Synthetic
ttctgugagcaggagttugaaca

SEQ ID NO: 39520 - DNA, 31 bp, Artificial Sequence; identical to SEQ ID NO: 27286
  Synthetic

SEQ ID NO: 39521 - DNA, 23 bp, Artificial Sequence
  Synthetic
tggagcaacaagutgacatcuga

SEQ ID NO: 39522 - DNA, 22 bp, Artificial Sequence
  Synthetic
gaagggtacuagtccagaggug

SEQ ID NO: 39523 - DNA, 24 bp, Artificial Sequence
  Synthetic
ctgttgttgcutgttttcccucag

SEQ ID NO: 39524 - DNA, 25 bp, Artificial Sequence
  Synthetic
gaccagtuccagctccttcatauag

SEQ ID NO: 39525 - DNA, 23 bp, Artificial Sequence
  Synthetic
gcacataccugttgtcccatgut

SEQ ID NO: 39526 - DNA, 21 bp, Artificial Sequence
  Synthetic
gcctgacucggtauggaaagg

SEQ ID NO: 39527 - DNA, 24 bp, Artificial Sequence
  Synthetic
gcattaggcuttcaggatgtugaa

SEQ ID NO: 39528 - DNA, 23 bp, Artificial Sequence
  Synthetic
tgggaagacagagcugacttcua

SEQ ID NO: 39529 - DNA, 21 bp, Artificial Sequence
  Synthetic
cttacgtguaggactgugcgt

SEQ ID NO: 39530 - DNA, 22 bp, Artificial Sequence
  Synthetic
actggcuggttaggaugagaga

SEQ ID NO: 39531 - DNA, 25 bp, Artificial Sequence
  Synthetic
tcacagtgugcactttaaccuacag

SEQ ID NO: 39532 - DNA, 27 bp, Artificial Sequence
  Synthetic
ccaggatccuaaggcaaaacaagatut

SEQ ID NO: 39533 - DNA, 28 bp, Artificial Sequence
  Synthetic
tttactctgccuctctacatcttccuag

SEQ ID NO: 39534 - DNA, 22 bp, Artificial Sequence
  Synthetic
ggccatccagagutacagctuc

SEQ ID NO: 39535 - DNA, 23 bp, Artificial Sequence
  Synthetic
accaagctuaccctgtcttccua

SEQ ID NO: 39536 - DNA, 27 bp, Artificial Sequence
  Synthetic
ctgacatcgtacuggaattgaaagtug

SEQ ID NO: 39537 - DNA, 19 bp, Artificial Sequence
  Synthetic
ccugaccagggtcucacgt

SEQ ID NO: 39538 - DNA, 20 bp, Artificial Sequence
  Synthetic
ccacaccgaugttggcauct

SEQ ID NO: 39539 - DNA, 19 bp, Artificial Sequence
  Synthetic
gaagccagccuggaccaua

SEQ ID NO: 39540 - DNA, 28 bp, Artificial Sequence
  Synthetic
ctcagatccuatgtgtaaugaggaacaa

SEQ ID NO: 39541 - DNA, 26 bp, Artificial Sequence
  Synthetic
gtgagagtagautgggtctcttucag

SEQ ID NO: 39542 - DNA, 21 bp, Artificial Sequence
  Synthetic
acctcgtcauggatgctgaug

SEQ ID NO: 39543 - DNA, 22 bp, Artificial Sequence
  Synthetic
ggccagagugaagcttctctug

SEQ ID NO: 39544 - DNA, 22 bp, Artificial Sequence
  Synthetic
caaagcauccaagctcttcugg

SEQ ID NO: 39545 - DNA, 24 bp, Artificial Sequence
  Synthetic
cgtggaatgauggtgataacacug

SEQ ID NO: 39546 - DNA, 23 bp, Artificial Sequence
  Synthetic
catuagtaagcgcucagcaaagg

SEQ ID NO: 39547 - DNA, 22 bp, Artificial Sequence
  Synthetic
gcagaatgtucctgagctgcut

SEQ ID NO: 39548 - DNA, 23 bp, Artificial Sequence
  Synthetic
ccucagagcccagtttcuacaga

SEQ ID NO: 39549 - DNA, 23 bp, Artificial Sequence
  Synthetic
cctgcuaagacccatttcctucc

SEQ ID NO: 39550 - DNA, 20 bp, Artificial Sequence
  Synthetic
ggaaaggcaucccaggacuc

SEQ ID NO: 39551 - DNA, 21 bp, Artificial Sequence
  Synthetic
ctgcttccuttgctctgucca

SEQ ID NO: 39552 - DNA, 22 bp, Artificial Sequence
  Synthetic
gaactctggcugggaagaacua

SEQ ID NO: 39553 - DNA, 22 bp, Artificial Sequence
  Synthetic
ctactttgguccttggacugct

SEQ ID NO: 39554 - DNA, 22 bp, Artificial Sequence
  Synthetic
acccaaacuctttccacuagcc

SEQ ID NO: 39555 - DNA, 21 bp, Artificial Sequence
  Synthetic
gcacttaccugggatggctuc

SEQ ID NO: 39556 - DNA, 22 bp, Artificial Sequence
  Synthetic
tcctgagaauggagcaagggua

SEQ ID NO: 39557 - DNA, 24 bp, Artificial Sequence
  Synthetic
cttctcctgcucctgattgtctuc

SEQ ID NO: 39558 - DNA, 22 bp, Artificial Sequence
  Synthetic
ctaaggcuaagccgaaggcuag

SEQ ID NO: 39559 - DNA, 21 bp, Artificial Sequence
  Synthetic
caaccagaacugggagcgtua

SEQ ID NO: 39560 - DNA, 20 bp, Artificial Sequence
  Synthetic
agcgccaccugattacagug

SEQ ID NO: 39561 - DNA, 20 bp, Artificial Sequence
  Synthetic
gtggtgguaatgggauggct

SEQ ID NO: 39562 - DNA, 17 bp, Artificial Sequence
  Synthetic
caccggcagugtgcuct

SEQ ID NO: 39563 - DNA, 22 bp, Artificial Sequence
  Synthetic
ccttttctccucctcctccuca

SEQ ID NO: 39564 - DNA, 21 bp, Artificial Sequence
  Synthetic
cactaactgcucctgccaguc

SEQ ID NO: 39565 - DNA, 26 bp, Artificial Sequence
  Synthetic
tggttgttguggagtggaagttuaat

SEQ ID NO: 39566 - DNA, 19 bp, Artificial Sequence
  Synthetic
cagaccuccacgucgaaca

SEQ ID NO: 39567 - DNA, 20 bp, Artificial Sequence
  Synthetic
acaaccuggaccagcactuc

SEQ ID NO: 39568 - DNA, 18 bp, Artificial Sequence
  Synthetic
gcatcucccctcctugcc

SEQ ID NO: 39569 - DNA, 17 bp, Artificial Sequence
  Synthetic
tgggtcuccagcuccgt

SEQ ID NO: 39570 - DNA, 17 bp, Artificial Sequence
  Synthetic
gggccggcacucttcug

SEQ ID NO: 39571 - DNA, 17 bp, Artificial Sequence
  Synthetic
ttgaggguggcctgugg

SEQ ID NO: 39572 - DNA, 18 bp, Artificial Sequence
  Synthetic
guggacgacaugcccaac

SEQ ID NO: 39573 - DNA, 18 bp, Artificial Sequence
  Synthetic
gcuacaccucccgcaacc

SEQ ID NO: 39574 - DNA, 21 bp, Artificial Sequence
  Synthetic
tggacaagtucctggcttcug

SEQ ID NO: 39575 - DNA, 21 bp, Artificial Sequence
  Synthetic
ctccattgutggcacatuccg

SEQ ID NO: 39576 - DNA, 22 bp, Artificial Sequence
  Synthetic
ctggaaaaugcagtgggaguct

SEQ ID NO: 39577 - DNA, 29 bp, Artificial Sequence
  Synthetic
ctctctagtagcucaactggataaaccua

SEQ ID NO: 39578 - DNA, 25 bp, Artificial Sequence
  Synthetic
gctgatcctguggcttttgtcttua

SEQ ID NO: 39579 - DNA, 21 bp, Artificial Sequence
  Synthetic
cgucaaggucagagaaaccuc

SEQ ID NO: 39580 - DNA, 22 bp, Artificial Sequence
  Synthetic
ccatgcgugttattgacgucat

SEQ ID NO: 39581 - DNA, 20 bp, Artificial Sequence
  Synthetic
cucccagaaaccagggugaa

SEQ ID NO: 39582 - DNA, 20 bp, Artificial Sequence
  Synthetic
cccugacacgcattgtguct

SEQ ID NO: 39583 - DNA, 22 bp, Artificial Sequence
  Synthetic
aggactctcuaagccagtgugt

SEQ ID NO: 39584 - DNA, 19 bp, Artificial Sequence
  Synthetic
ctcaggcgugctactcucg

SEQ ID NO: 39585 - DNA, 26 bp, Artificial Sequence
  Synthetic
ctatacttcttgaugagcctggugat

SEQ ID NO: 39586 - DNA, 19 bp, Artificial Sequence
  Synthetic
ccatgcggugggtgtguag

SEQ ID NO: 39587 - DNA, 19 bp, Artificial Sequence
  Synthetic
gagacccguggaactcgut

SEQ ID NO: 39588 - DNA, 21 bp, Artificial Sequence
  Synthetic
caacaccggcucttctttuga

SEQ ID NO: 39589 - DNA, 20 bp, Artificial Sequence
  Synthetic
ctcaucgggcatccugagac

SEQ ID NO: 39590 - DNA, 18 bp, Artificial Sequence
  Synthetic
cgagatguggccctcgut

SEQ ID NO: 39591 - DNA, 18 bp, Artificial Sequence
  Synthetic
cggguacaacggctcuca

SEQ ID NO: 39592 - DNA, 17 bp, Artificial Sequence
  Synthetic
ggtgagcugcgtccuct

SEQ ID NO: 39593 - DNA, 20 bp, Artificial Sequence
  Synthetic
gctuccaggaaccacaccug

SEQ ID NO: 39594 - DNA, 22 bp, Artificial Sequence
  Synthetic
ctcagctgcutctcttgctuct

SEQ ID NO: 39595 - DNA, 18 bp, Artificial Sequence
  Synthetic
caacgugggacggauggt

SEQ ID NO: 39596 - DNA, 22 bp, Artificial Sequence
  Synthetic
ggagaggttucatgcctggaut

SEQ ID NO: 39597 - DNA, 21 bp, Artificial Sequence
  Synthetic
tgtcctgcuctgacctccuac

SEQ ID NO: 39598 - DNA, 24 bp, Artificial Sequence
  Synthetic
agatgccugacatcatcaucaagg

SEQ ID NO: 39599 - DNA, 20 bp, Artificial Sequence
  Synthetic
ggtuccccaaggagtccuga

SEQ ID NO: 39600 - DNA, 18 bp, Artificial Sequence
  Synthetic
cctgagcgccucggttut

SEQ ID NO: 39601 - DNA, 21 bp, Artificial Sequence
  Synthetic
cuaccgagagauacagcctuc

SEQ ID NO: 39602 - DNA, 19 bp, Artificial Sequence
  Synthetic
cccctccacuggcttgtuc

SEQ ID NO: 39603 - DNA, 17 bp, Artificial Sequence
  Synthetic
cccgacagucccgcuac

SEQ ID NO: 39604 - DNA, 23 bp, Artificial Sequence
  Synthetic
gatagccugaaaaaccuccacct

SEQ ID NO: 39605 - DNA, 22 bp, Artificial Sequence
  Synthetic
cuagaagacagggagcgugaaa

SEQ ID NO: 39606 - DNA, 19 bp, Artificial Sequence
  Synthetic
ctaaguccaccctgugcgt

SEQ ID NO: 39607 - DNA, 20 bp, Artificial Sequence
  Synthetic
cttccugaacacugggacca

SEQ ID NO: 39608 - DNA, 20 bp, Artificial Sequence
  Synthetic
cgaaaccugagaaggccuca

SEQ ID NO: 39609 - DNA, 24 bp, Artificial Sequence
  Synthetic
caaataucccaagagggucaaguc

SEQ ID NO: 39610 - DNA, 20 bp, Artificial Sequence
  Synthetic
gagctgtcuaacgcccucat

SEQ ID NO: 39611 - DNA, 18 bp, Artificial Sequence
  Synthetic
ggagccacautgccguca

SEQ ID NO: 39612 - DNA, 20 bp, Artificial Sequence
  Synthetic
ggtcaggagaaggcuggtuc

SEQ ID NO: 39613 - DNA, 19 bp, Artificial Sequence
  Synthetic
ggctcugagccacacucac

SEQ ID NO: 39614 - DNA, 21 bp, Artificial Sequence
  Synthetic
tctgtggaccuctcctuccag

SEQ ID NO: 39615 - DNA, 18 bp, Artificial Sequence
  Synthetic
agcacttuccccguccag

SEQ ID NO: 39616 - DNA, 22 bp, Artificial Sequence
  Synthetic
cgaggtuacaccatcuccgact

SEQ ID NO: 39617 - DNA, 19 bp, Artificial Sequence
  Synthetic
caagugaggcaccaggtuc

SEQ ID NO: 39618 - DNA, 18 bp, Artificial Sequence
  Synthetic
cctaagcuccctguggca

SEQ ID NO: 39619 - DNA, 18 bp, Artificial Sequence
  Synthetic
gccctguccaggcaccua

SEQ ID NO: 39620 - DNA, 21 bp, Artificial Sequence
  Synthetic
gctcatcgagcugaaggacug

SEQ ID NO: 39621 - DNA, 20 bp, Artificial Sequence
  Synthetic
ggtagcaggacuggauggga

SEQ ID NO: 39622 - DNA, 20 bp, Artificial Sequence
  Synthetic
ccugggcaacgactttgugt

SEQ ID NO: 39623 - DNA, 19 bp, Artificial Sequence
  Synthetic
cctcgugaccgaagcucag

SEQ ID NO: 39624 - DNA, 19 bp, Artificial Sequence
  Synthetic
ggcgugaccaccaagtcuc

SEQ ID NO: 39625 - DNA, 21 bp, Artificial Sequence
  Synthetic
tgagctcacuatcagguggca

SEQ ID NO: 39626 - DNA, 20 bp, Artificial Sequence
  Synthetic
ctcccagacutacugcccaa

SEQ ID NO: 39627 - DNA, 18 bp, Artificial Sequence
  Synthetic
ccggccucacacaaacuc

SEQ ID NO: 39628 - DNA, 20 bp, Artificial Sequence
  Synthetic
ggagttgcgguccaggaauc

SEQ ID NO: 39629 - DNA, 19 bp, Artificial Sequence
  Synthetic
cauccacgucgaagaggca

SEQ ID NO: 39630 - DNA, 28 bp, Artificial Sequence
  Synthetic
tgtacttgtgtuacccttagagtttugg

SEQ ID NO: 39631 - DNA, 28 bp, Artificial Sequence
  Synthetic
accagatgtaatuagcaacccatcatut

SEQ ID NO: 39632 - DNA, 22 bp, Artificial Sequence
  Synthetic
ctgaagacccugggtttgcuat

SEQ ID NO: 39633 - DNA, 23 bp, Artificial Sequence
  Synthetic
gtgacgccuctttgtuaaaagca

SEQ ID NO: 39634 - DNA, 24 bp, Artificial Sequence
  Synthetic
gataatccuacctttguggccagt

SEQ ID NO: 39635 - DNA, 29 bp, Artificial Sequence
  Synthetic
caagttuggaacacaggcaatatauacaa

SEQ ID NO: 39636 - DNA, 22 bp, Artificial Sequence
  Synthetic
gggagcctucatctgtactucg

SEQ ID NO: 39637 - DNA, 20 bp, Artificial Sequence
  Synthetic
aatgccctaugctggctugt

SEQ ID NO: 39638 - DNA, 17 bp, Artificial Sequence
  Synthetic
cgtugcccaggcuggag

SEQ ID NO: 39639 - DNA, 23 bp, Artificial Sequence
  Synthetic
aatggaaucaaggccagugaaua

SEQ ID NO: 39640 - DNA, 24 bp, Artificial Sequence
  Synthetic
gcatugggcagaaaagaaauggat

SEQ ID NO: 39641 - DNA, 27 bp, Artificial Sequence
  Synthetic
gaatatactuaaccgggctccttctug

SEQ ID NO: 39642 - DNA, 18 bp, Artificial Sequence
  Synthetic
ctgcggtuggcgttgaug

SEQ ID NO: 39643 - DNA, 22 bp, Artificial Sequence
  Synthetic
cgagcaguacaaggagcaggua

SEQ ID NO: 39644 - DNA, 23 bp, Artificial Sequence
  Synthetic
ggtggactugaacttggactuga

SEQ ID NO: 39645 - DNA, 20 bp, Artificial Sequence
  Synthetic
ggtctcagugcgctctctug

SEQ ID NO: 39646 - DNA, 25 bp, Artificial Sequence
  Synthetic
ccctcttccuccattcagtttccua

SEQ ID NO: 39647 - DNA, 22 bp, Artificial Sequence
  Synthetic
gagttgtcaggguggactctug

SEQ ID NO: 39648 - DNA, 20 bp, Artificial Sequence
  Synthetic
catgccccaagcucctagug

SEQ ID NO: 39649 - DNA, 22 bp, Artificial Sequence
  Synthetic
ggcagcacacauctctatucct

SEQ ID NO: 39650 - DNA, 23 bp, Artificial Sequence
  Synthetic
gcttggagauccctttcgaacug

SEQ ID NO: 39651 - DNA, 26 bp, Artificial Sequence
  Synthetic
ttcatgaagtugagcctcatagaaug

SEQ ID NO: 39652 - DNA, 23 bp, Artificial Sequence
  Synthetic
cggctttgagcautttgttgguc

SEQ ID NO: 39653 - DNA, 22 bp, Artificial Sequence
  Synthetic
agaagtcaccuctgggtctugt

SEQ ID NO: 39654 - DNA, 23 bp, Artificial Sequence
  Synthetic
gctgaagccugttcttggtctut

SEQ ID NO: 39655 - DNA, 20 bp, Artificial Sequence
  Synthetic
cctcucaccctacccuggac

SEQ ID NO: 39656 - DNA, 22 bp, Artificial Sequence
  Synthetic
ctccugcaaaagggaugcaaag

SEQ ID NO: 39657 - DNA, 21 bp, Artificial Sequence
  Synthetic
ccagtctctuggcaccctuag

SEQ ID NO: 39658 - DNA, 19 bp, Artificial Sequence
  Synthetic
ccatcgcugcactuggact

SEQ ID NO: 39659 - DNA, 21 bp, Artificial Sequence
  Synthetic
tgttatcccucccctctgcut

SEQ ID NO: 39660 - DNA, 22 bp, Artificial Sequence
  Synthetic
ggatagcaggauggtgggatug

SEQ ID NO: 39661 - DNA, 25 bp, Artificial Sequence
  Synthetic
agaagaacaaugcccugaagaagat

SEQ ID NO: 39662 - DNA, 18 bp, Artificial Sequence
  Synthetic
cagcaaaugcccctugcc

SEQ ID NO: 39663 - DNA, 23 bp, Artificial Sequence
  Synthetic
tcctgaagagcaccutggtttut

SEQ ID NO: 39664 - DNA, 21 bp, Artificial Sequence
  Synthetic
gtgctcggautataggcguga

SEQ ID NO: 39665 - DNA, 26 bp, Artificial Sequence
  Synthetic
gtuactcttttcccuccacaacaaag

SEQ ID NO: 39666 - DNA, 24 bp, Artificial Sequence
  Synthetic
ctccatctcaugcagtatctccuc

SEQ ID NO: 39667 - DNA, 22 bp, Artificial Sequence
  Synthetic
gtacctguatggatgcauggct

SEQ ID NO: 39668 - DNA, 23 bp, Artificial Sequence
  Synthetic
caaatgtgaaggcuccagaguga

SEQ ID NO: 39669 - DNA, 19 bp, Artificial Sequence
  Synthetic
agggtguggcttcaugacc

SEQ ID NO: 39670 - DNA, 22 bp, Artificial Sequence
  Synthetic
gccagtgaugacatggguaaga

SEQ ID NO: 39671 - DNA, 24 bp, Artificial Sequence
  Synthetic
ggtgacttcugctctgtgttucaa

SEQ ID NO: 39672 - DNA, 18 bp, Artificial Sequence
  Synthetic
ggacagcccuggcttcug

SEQ ID NO: 39673 - DNA, 20 bp, Artificial Sequence
  Synthetic
gauggccaagaugacggaga

SEQ ID NO: 39674 - DNA, 24 bp, Artificial Sequence
  Synthetic
tgttcaatuctccagcucaaagca

SEQ ID NO: 39675 - DNA, 27 bp, Artificial Sequence
  Synthetic
gccttggtttcuaagtttctagttucc

SEQ ID NO: 39676 - DNA, 21 bp, Artificial Sequence
  Synthetic
ctccacgaaagacutguccgt

SEQ ID NO: 39677 - DNA, 22 bp, Artificial Sequence
  Synthetic
ggatgcccaugcgttgtgtaua

SEQ ID NO: 39678 - DNA, 21 bp, Artificial Sequence
  Synthetic
gatgaagtuccactcgaugcc

SEQ ID NO: 39679 - DNA, 24 bp, Artificial Sequence
  Synthetic
ggctccttgucttctgacttcaua

SEQ ID NO: 39680 - DNA, 21 bp, Artificial Sequence
  Synthetic
tttgtucacgcgggtgaguat

SEQ ID NO: 39681 - DNA, 23 bp, Artificial Sequence
  Synthetic
gcacccggucaagaauaaaaauc

SEQ ID NO: 39682 - DNA, 21 bp, Artificial Sequence
  Synthetic
ccaaccccaaagucattgguc

SEQ ID NO: 39683 - DNA, 23 bp, Artificial Sequence
  Synthetic
agtggcttuaggctccaaaacuc

SEQ ID NO: 39684 - DNA, 26 bp, Artificial Sequence
  Synthetic
caggatcugagactgttttaauagcc

SEQ ID NO: 39685 - DNA, 23 bp, Artificial Sequence
  Synthetic
gaatcccuaactcccuccaaacc

SEQ ID NO: 39686 - DNA, 24 bp, Artificial Sequence
  Synthetic
caggagaugacaccaaagctttuc

SEQ ID NO: 39687 - DNA, 30 bp, Artificial Sequence; identical to SEQ ID NO: 27453
  Synthetic

SEQ ID NO: 39688 - DNA, 24 bp, Artificial Sequence
  Synthetic
cctgagttcutgcaatgatgtuct

SEQ ID NO: 39689 - DNA, 26 bp, Artificial Sequence
  Synthetic
catagatgatgtucccgtgtcttuca

SEQ ID NO: 39690 - DNA, 22 bp, Artificial Sequence
  Synthetic
aaacuccacattccuggcaaga

SEQ ID NO: 39691 - DNA, 21 bp, Artificial Sequence
  Synthetic
ctgcccauctacucggagaag

SEQ ID NO: 39692 - DNA, 26 bp, Artificial Sequence
  Synthetic
tcccaacacatutctaatgcctacut

SEQ ID NO: 39693 - DNA, 22 bp, Artificial Sequence
  Synthetic
tggagaauggcaagaaggucac

SEQ ID NO: 39694 - DNA, 21 bp, Artificial Sequence
  Synthetic
ccacugggctgttgaugaagt

SEQ ID NO: 39695 - DNA, 21 bp, Artificial Sequence
  Synthetic
tctgcagaccgagutccuaga

SEQ ID NO: 39696 - DNA, 20 bp, Artificial Sequence
  Synthetic
ccttacuccgccttctccuc

SEQ ID NO: 39697 - DNA, 18 bp, Artificial Sequence
  Synthetic
cuccaccgagctcuccac

SEQ ID NO: 39698 - DNA, 25 bp, Artificial Sequence
  Synthetic
cctaaaacuaaatgtguggcccact

SEQ ID NO: 39699 - DNA, 22 bp, Artificial Sequence
  Synthetic
cgctaugacaggaaagaugggt

SEQ ID NO: 39700 - DNA, 30 bp, Artificial Sequence; identical to SEQ ID NO: 27466
  Synthetic

SEQ ID NO: 39701 - DNA, 17 bp, Artificial Sequence
  Synthetic
guggcgcacgggttuac

SEQ ID NO: 39702 - DNA, 19 bp, Artificial Sequence
  Synthetic
cacttuaccccagcugcgt

SEQ ID NO: 39703 - DNA, 26 bp, Artificial Sequence
  Synthetic
agagggacttgucacttctttgttuc

SEQ ID NO: 39704 - DNA, 21 bp, Artificial Sequence
  Synthetic
gugagggcacuaaaaggtgua

SEQ ID NO: 39705 - DNA, 21 bp, Artificial Sequence
  Synthetic
ttggccgguatgtatgtcugg

SEQ ID NO: 39706 - DNA, 22 bp, Artificial Sequence
  Synthetic
gcacagagggugacatttcugg

SEQ ID NO: 39707 - DNA, 21 bp, Artificial Sequence
  Synthetic
gaagacccucatcaccaucgg

SEQ ID NO: 39708 - DNA, 20 bp, Artificial Sequence
  Synthetic
ggagtcuctgtgcugcgaat

SEQ ID NO: 39709 - DNA, 20 bp, Artificial Sequence
  Synthetic
gtgttcaugcgctgtgtucc

SEQ ID NO: 39710 - DNA, 20 bp, Artificial Sequence
  Synthetic
acacgaagaugccagtgucg

SEQ ID NO: 39711 - DNA, 22 bp, Artificial Sequence
  Synthetic
caccctggagucatccgtttua

SEQ ID NO: 39712 - DNA, 17 bp, Artificial Sequence
  Synthetic
tcagugcccuggaggct

SEQ ID NO: 39713 - DNA, 22 bp, Artificial Sequence
  Synthetic
ccactggcugctgatggatuac

SEQ ID NO: 39714 - DNA, 24 bp, Artificial Sequence
  Synthetic
tctcctgcuctctcatctuacaca

SEQ ID NO: 39715 - DNA, 22 bp, Artificial Sequence
  Synthetic
ggtcaccaaugtcaucccacag

SEQ ID NO: 39716 - DNA, 22 bp, Artificial Sequence
  Synthetic
gctcctugaagagctucaccag

SEQ ID NO: 39717 - DNA, 21 bp, Artificial Sequence
  Synthetic
tgucagaaggugggacacaga

SEQ ID NO: 39718 - DNA, 26 bp, Artificial Sequence
  Synthetic
aaaguccaagagaagcauaaaaggua

SEQ ID NO: 39719 - DNA, 24 bp, Artificial Sequence
  Synthetic
tctctctcugactttctcctcucc

SEQ ID NO: 39720 - DNA, 22 bp, Artificial Sequence
  Synthetic
ctcctttucagcctcctctuca

SEQ ID NO: 39721 - DNA, 23 bp, Artificial Sequence
  Synthetic
gatcuaacaggagctgcugagac

SEQ ID NO: 39722 - DNA, 22 bp, Artificial Sequence
  Synthetic
gtucccagacaggugagcaaat

SEQ ID NO: 39723 - DNA, 24 bp, Artificial Sequence
  Synthetic
aatagaggcaggagguagacucag

SEQ ID NO: 39724 - DNA, 19 bp, Artificial Sequence
  Synthetic
tgutctggtcugggaggct

SEQ ID NO: 39725 - DNA, 19 bp, Artificial Sequence
  Synthetic
gggagcuggaggtctcuga

SEQ ID NO: 39726 - DNA, 22 bp, Artificial Sequence
  Synthetic
cccacauacagucagacccaag

SEQ ID NO: 39727 - DNA, 22 bp, Artificial Sequence
  Synthetic
ggtcaaggucacgtgcuagaag

SEQ ID NO: 39728 - DNA, 17 bp, Artificial Sequence
  Synthetic
ggcgcugcatugagggt

SEQ ID NO: 39729 - DNA, 19 bp, Artificial Sequence
  Synthetic
tgcttuccccgctgctuag

SEQ ID NO: 39730 - DNA, 24 bp, Artificial Sequence
  Synthetic
catatactcaacuccctgcctcuc

SEQ ID NO: 39731 - DNA, 17 bp, Artificial Sequence
  Synthetic
cccgaggugggctgtua

SEQ ID NO: 39732 - DNA, 18 bp, Artificial Sequence
  Synthetic
ccuccagccccagcagua

SEQ ID NO: 39733 - DNA, 20 bp, Artificial Sequence
  Synthetic
tcgagggccucattgagcua

SEQ ID NO: 39734 - DNA, 17 bp, Artificial Sequence
  Synthetic
cagcctcgugggctcug

SEQ ID NO: 39735 - DNA, 26 bp, Artificial Sequence
  Synthetic
tcacctaggacutacatgatcctgut

SEQ ID NO: 39736 - DNA, 21 bp, Artificial Sequence
  Synthetic
gattcggutctggtuccacct

SEQ ID NO: 39737 - DNA, 26 bp, Artificial Sequence
  Synthetic
tgtacaactcauaagagtggcccaua

SEQ ID NO: 39738 - DNA, 19 bp, Artificial Sequence
  Synthetic
ggtgcagcagagcuggaut

SEQ ID NO: 39739 - DNA, 17 bp, Artificial Sequence
  Synthetic
gcgccuagccgtgtcug

SEQ ID NO: 39740 - DNA, 26 bp, Artificial Sequence
  Synthetic
gaaatatgtgugggttcttcugacac

SEQ ID NO: 39741 - DNA, 23 bp, Artificial Sequence
  Synthetic
ggtgatuacgccatctacctuac

SEQ ID NO: 39742 - DNA, 21 bp, Artificial Sequence
  Synthetic
gccctgggaguaggagctuaa

SEQ ID NO: 39743 - DNA, 27 bp, Artificial Sequence
  Synthetic
ctccaggtttucgattttctgtatucc

SEQ ID NO: 39744 - DNA, 25 bp, Artificial Sequence
  Synthetic
tttgacttctgcugaccttacctuc

SEQ ID NO: 39745 - DNA, 28 bp, Artificial Sequence
  Synthetic
ggtgctttttcgutgtttttgttttugt

SEQ ID NO: 39746 - DNA, 26 bp, Artificial Sequence
  Synthetic
cccggttaucagacagattcctaaut

SEQ ID NO: 39747 - DNA, 28 bp, Artificial Sequence
  Synthetic
aatgtgatcagaaggcutttctcttcut

SEQ ID NO: 39748 - DNA, 26 bp, Artificial Sequence
  Synthetic
gaagaagaucacagacagcatugaag

SEQ ID NO: 39749 - DNA, 25 bp, Artificial Sequence
  Synthetic
ttgcctaatcucaaaggaactcugg

SEQ ID NO: 39750 - DNA, 25 bp, Artificial Sequence
  Synthetic
gaaacaaggcagaagauggagcuat

SEQ ID NO: 39751 - DNA, 20 bp, Artificial Sequence
  Synthetic
tgacgacaguagcaggguct

SEQ ID NO: 39752 - DNA, 22 bp, Artificial Sequence
  Synthetic
gauggagaucaagagccagagg

SEQ ID NO: 39753 - DNA, 20 bp, Artificial Sequence
  Synthetic
tgtgtgttuctccgcucaca

SEQ ID NO: 39754 - DNA, 26 bp, Artificial Sequence
  Synthetic
tgauggaacgagaauggaagattuag

SEQ ID NO: 39755 - DNA, 33 bp, Artificial Sequence; identical to SEQ ID NO: 27521
  Synthetic

SEQ ID NO: 39756 - DNA, 27 bp, Artificial Sequence
  Synthetic
agaatatgtgcuttccgaagatugagg

SEQ ID NO: 39757 - DNA, 24 bp, Artificial Sequence
  Synthetic
tggtgtctugttttcggattucca

SEQ ID NO: 39758 - DNA, 20 bp, Artificial Sequence
  Synthetic
acaggucacccttcctucca

SEQ ID NO: 39759 - DNA, 23 bp, Artificial Sequence
  Synthetic
gggaaaacuatgatgcttucggt

SEQ ID NO: 39760 - DNA, 22 bp, Artificial Sequence
  Synthetic
gggatcuggaaccgagtuacat

SEQ ID NO: 39761 - DNA, 18 bp, Artificial Sequence
  Synthetic
gccctgguacgtgtugcc

SEQ ID NO: 39762 - DNA, 19 bp, Artificial Sequence
  Synthetic
cgaguggacgcacggatuc

SEQ ID NO: 39763 - DNA, 20 bp, Artificial Sequence
  Synthetic
ggaggacgcagcucaactuc

SEQ ID NO: 39764 - DNA, 18 bp, Artificial Sequence
  Synthetic
ggcagagcgucccgtaug

SEQ ID NO: 39765 - DNA, 21 bp, Artificial Sequence
  Synthetic
aaacagccccutcttctugct

SEQ ID NO: 39766 - DNA, 17 bp, Artificial Sequence
  Synthetic
gagcaccgucagcucca

SEQ ID NO: 39767 - DNA, 17 bp, Artificial Sequence
  Synthetic
cggttgcuggcccacuc

SEQ ID NO: 39768 - DNA, 23 bp, Artificial Sequence
  Synthetic
gcaaguacaagcagaacatccuc

SEQ ID NO: 39769 - DNA, 22 bp, Artificial Sequence
  Synthetic
ctgaacagacugggcucacaaa

SEQ ID NO: 39770 - DNA, 17 bp, Artificial Sequence
  Synthetic
cggccucgctguggaat

SEQ ID NO: 39771 - DNA, 18 bp, Artificial Sequence
  Synthetic
tcaggucggagggagugg

SEQ ID NO: 39772 - DNA, 19 bp, Artificial Sequence
  Synthetic
acaaggucgcccacttcuc

SEQ ID NO: 39773 - DNA, 17 bp, Artificial Sequence
  Synthetic
gaaccucgggugcggaa

SEQ ID NO: 39774 - DNA, 21 bp, Artificial Sequence
  Synthetic
gaagcugagcaacuaccggat

SEQ ID NO: 39775 - DNA, 23 bp, Artificial Sequence
  Synthetic
gcctgaagtuctccttgttcugg

SEQ ID NO: 39776 - DNA, 21 bp, Artificial Sequence
  Synthetic
gcgttgggacutgaccttcuc

SEQ ID NO: 39777 - DNA, 21 bp, Artificial Sequence
  Synthetic
gcuggaaacccucaggaaaca

SEQ ID NO: 39778 - DNA, 23 bp, Artificial Sequence
  Synthetic
catcggagucgccattctgttua

SEQ ID NO: 39779 - DNA, 22 bp, Artificial Sequence
  Synthetic
aggcaaacugtgagtgauaccc

SEQ ID NO: 39780 - DNA, 26 bp, Artificial Sequence
  Synthetic
acgatttttaguctgcattgcttugg

SEQ ID NO: 39781 - DNA, 29 bp, Artificial Sequence
  Synthetic
gctcagctgctuctttaaacagatacaua

SEQ ID NO: 39782 - DNA, 25 bp, Artificial Sequence
  Synthetic
gtgtctgttgcucatgtgtttgtut

SEQ ID NO: 39783 - DNA, 21 bp, Artificial Sequence
  Synthetic
cagcatctcguggacaaaguc

SEQ ID NO: 39784 - DNA, 20 bp, Artificial Sequence
  Synthetic
gtagggtugctcgtctgucc

SEQ ID NO: 39785 - DNA, 29 bp, Artificial Sequence
  Synthetic
gttcaagcaucaacaaatacauccaacat

SEQ ID NO: 39786 - DNA, 17 bp, Artificial Sequence
  Synthetic
ctggcaucgtgctgcug

SEQ ID NO: 39787 - DNA, 19 bp, Artificial Sequence
  Synthetic
cctctgcucacaccuccct

SEQ ID NO: 39788 - DNA, 18 bp, Artificial Sequence
  Synthetic
ctgugggaagacgcugct

SEQ ID NO: 39789 - DNA, 19 bp, Artificial Sequence
  Synthetic
acccgtguccctttcaguc

SEQ ID NO: 39790 - DNA, 21 bp, Artificial Sequence
  Synthetic
gtgcggagccucttuaaggaa

SEQ ID NO: 39791 - DNA, 24 bp, Artificial Sequence
  Synthetic
caacctgtuctgaaagacaucgga

SEQ ID NO: 39792 - DNA, 19 bp, Artificial Sequence
  Synthetic
agggtcatucgctctgcug

SEQ ID NO: 39793 - DNA, 22 bp, Artificial Sequence
  Synthetic
ggctctgcauaaagggactugt

SEQ ID NO: 39794 - DNA, 23 bp, Artificial Sequence
  Synthetic
ctgtggcaguaactaggctugag

SEQ ID NO: 39795 - DNA, 19 bp, Artificial Sequence
  Synthetic
gctgcgggutgagaacgua

SEQ ID NO: 39796 - DNA, 21 bp, Artificial Sequence
  Synthetic
ccaactcauaccccggcatuc

SEQ ID NO: 39797 - DNA, 20 bp, Artificial Sequence
  Synthetic
ccccagucagcuacagacac

SEQ ID NO: 39798 - DNA, 18 bp, Artificial Sequence
  Synthetic
ggtggtgcugcctcagug

SEQ ID NO: 39799 - DNA, 19 bp, Artificial Sequence
  Synthetic
caggtgccaucccaaacug

SEQ ID NO: 39800 - DNA, 21 bp, Artificial Sequence
  Synthetic
tgacacagtuccctccacuca

SEQ ID NO: 39801 - DNA, 24 bp, Artificial Sequence
  Synthetic
gccutggaaatactucacgagagg

SEQ ID NO: 39802 - DNA, 22 bp, Artificial Sequence
  Synthetic
cccaugggccgaagaaaaugat

SEQ ID NO: 39803 - DNA, 22 bp, Artificial Sequence
  Synthetic
ctcagcugaaaagcaacucagg

SEQ ID NO: 39804 - DNA, 19 bp, Artificial Sequence
  Synthetic
ttccuctgctcugggacca

SEQ ID NO: 39805 - DNA, 21 bp, Artificial Sequence
  Synthetic
cccaggagccucatctctuct

SEQ ID NO: 39806 - DNA, 22 bp, Artificial Sequence
  Synthetic
aggcagcugtcaattctcaugt

SEQ ID NO: 39807 - DNA, 24 bp, Artificial Sequence
  Synthetic
cctgtgagttugcctgttttcuct

SEQ ID NO: 39808 - DNA, 23 bp, Artificial Sequence
  Synthetic
aggtgaaacugtgcttgtauccc

SEQ ID NO: 39809 - DNA, 22 bp, Artificial Sequence
  Synthetic
gctccacagaugagcagtaucc

SEQ ID NO: 39810 - DNA, 22 bp, Artificial Sequence
  Synthetic
ctcaaggagggcucgttctuaa

SEQ ID NO: 39811 - DNA, 21 bp, Artificial Sequence
  Synthetic
ttggtctccugcggttuacag

SEQ ID NO: 39812 - DNA, 27 bp, Artificial Sequence
  Synthetic
gattgaaaccaagcutgcgagaaaaua

SEQ ID NO: 39813 - DNA, 20 bp, Artificial Sequence
  Synthetic
tgcaaugaccccgttctcuc

SEQ ID NO: 39814 - DNA, 21 bp, Artificial Sequence
  Synthetic
ctgtggaguctcccactcauc

SEQ ID NO: 39815 - DNA, 24 bp, Artificial Sequence
  Synthetic
ttcactctacuagttgtgggucct

SEQ ID NO: 39816 - DNA, 20 bp, Artificial Sequence
  Synthetic
acugacagaucggacggaca

SEQ ID NO: 39817 - DNA, 23 bp, Artificial Sequence
  Synthetic
ccaccaauacagccccttcttuc

SEQ ID NO: 39818 - DNA, 24 bp, Artificial Sequence
  Synthetic
ccgcgccuggcaataaatatctua

SEQ ID NO: 39819 - DNA, 28 bp, Artificial Sequence
  Synthetic
ggcgatacugaggaggattttattguat

SEQ ID NO: 39820 - DNA, 21 bp, Artificial Sequence
  Synthetic
ggccaggguagctctttucaa

SEQ ID NO: 39821 - DNA, 26 bp, Artificial Sequence
  Synthetic
tttataaacctgucggtggattgugt

SEQ ID NO: 39822 - DNA, 23 bp, Artificial Sequence
  Synthetic
ggutctgtgtguccagagagaga

SEQ ID NO: 39823 - DNA, 22 bp, Artificial Sequence
  Synthetic
ggtctgttuccacctgagcaut

SEQ ID NO: 39824 - DNA, 23 bp, Artificial Sequence
  Synthetic
gctgcacaaaguatctcgugact

SEQ ID NO: 39825 - DNA, 28 bp, Artificial Sequence
  Synthetic
cggaatgcacuaaattcagttttaugaa

SEQ ID NO: 39826 - DNA, 21 bp, Artificial Sequence
  Synthetic
aatccctcgucctacagguca

SEQ ID NO: 39827 - DNA, 24 bp, Artificial Sequence
  Synthetic
cctggaaaautccagctuggaaga

SEQ ID NO: 39828 - DNA, 20 bp, Artificial Sequence
  Synthetic
agacgagcucatgaguccct

SEQ ID NO: 39829 - DNA, 23 bp, Artificial Sequence
  Synthetic
cgctcatgagaacugtgtctcug

SEQ ID NO: 39830 - DNA, 22 bp, Artificial Sequence
  Synthetic
gcacacaugagacacagcauga

SEQ ID NO: 39831 - DNA, 26 bp, Artificial Sequence
  Synthetic
atctggtttcutccttcttcucacag

SEQ ID NO: 39832 - DNA, 30 bp, Artificial Sequence; identical to SEQ ID NO: 27598
  Synthetic

SEQ ID NO: 39833 - DNA, 24 bp, Artificial Sequence
  Synthetic
tgtgaccagutgtguagaaagcaa

SEQ ID NO: 39834 - DNA, 23 bp, Artificial Sequence
  Synthetic
catcagagcagaguctgcacaua

SEQ ID NO: 39835 - DNA, 26 bp, Artificial Sequence
  Synthetic
ttctttttccttucctccctgtaugg

SEQ ID NO: 39836 - DNA, 26 bp, Artificial Sequence
  Synthetic
tcuatagaaacctucagggaagacac

SEQ ID NO: 39837 - DNA, 22 bp, Artificial Sequence
  Synthetic
tgcgctcugctatctatccuca

SEQ ID NO: 39838 - DNA, 22 bp, Artificial Sequence
  Synthetic
ggccttcugggaagatcaggua

SEQ ID NO: 39839 - DNA, 27 bp, Artificial Sequence
  Synthetic
gctgtgactaugtcatggttctuaact

SEQ ID NO: 39840 - DNA, 23 bp, Artificial Sequence
  Synthetic
gcaggcagcaugacaagtacuag

SEQ ID NO: 39841 - DNA, 28 bp, Artificial Sequence
  Synthetic
tgatctctgacutgaagtttttgtcugt

SEQ ID NO: 39842 - DNA, 21 bp, Artificial Sequence
  Synthetic
gggacaaacautggugcagga

SEQ ID NO: 39843 - DNA, 29 bp, Artificial Sequence
  Synthetic
tgtctgccaaatuaaagagccaagataut

SEQ ID NO: 39844 - DNA, 26 bp, Artificial Sequence
  Synthetic
cagaggagaaauacctcaaauggaaa

SEQ ID NO: 39845 - DNA, 30 bp, Artificial Sequence; identical to SEQ ID NO: 27611
  Synthetic

SEQ ID NO: 39846 - DNA, 25 bp, Artificial Sequence
  Synthetic
ctugagaguagaaggcattaucaca

SEQ ID NO: 39847 - DNA, 24 bp, Artificial Sequence
  Synthetic
gggatttagtugagccttacguct

SEQ ID NO: 39848 - DNA, 23 bp, Artificial Sequence
  Synthetic
agatcaacagaacautgccugga

SEQ ID NO: 39849 - DNA, 29 bp, Artificial Sequence
  Synthetic
ggttgggaaaauaggacatagctttagua

SEQ ID NO: 39850 - DNA, 28 bp, Artificial Sequence
  Synthetic
tgaactagaatgautagcataggccuca

SEQ ID NO: 39851 - DNA, 23 bp, Artificial Sequence
  Synthetic
cctcccaaaguactgggatuaca

SEQ ID NO: 39852 - DNA, 17 bp, Artificial Sequence
  Synthetic
gccatgccugggcugac

SEQ ID NO: 39853 - DNA, 20 bp, Artificial Sequence
  Synthetic
cttctcugggatcccugcac

SEQ ID NO: 39854 - DNA, 20 bp, Artificial Sequence
  Synthetic
ggugagcttgguggagaacg

SEQ ID NO: 39855 - DNA, 21 bp, Artificial Sequence
  Synthetic
ctgcaggugatcacgtcaaug

SEQ ID NO: 39856 - DNA, 19 bp, Artificial Sequence
  Synthetic
tggccagugtcgtctucag

SEQ ID NO: 39857 - DNA, 20 bp, Artificial Sequence
  Synthetic
caggatggugagggugacag

SEQ ID NO: 39858 - DNA, 24 bp, Artificial Sequence
  Synthetic
cctcatcatcugcaatgccaucat

SEQ ID NO: 39859 - DNA, 27 bp, Artificial Sequence
  Synthetic
catttaguccatcctcttugacaaacg

SEQ ID NO: 39860 - DNA, 20 bp, Artificial Sequence
  Synthetic
ctccaggcaggacutcucac

SEQ ID NO: 39861 - DNA, 20 bp, Artificial Sequence
  Synthetic
cttcacaucccagcugacga

SEQ ID NO: 39862 - DNA, 23 bp, Artificial Sequence
  Synthetic
ctccugcaaaaggaggtgaaauc

SEQ ID NO: 39863 - DNA, 22 bp, Artificial Sequence
  Synthetic
ctggtcacugagtcaggcatut

SEQ ID NO: 39864 - DNA, 20 bp, Artificial Sequence
  Synthetic
acaaaccagccccugaacuc

SEQ ID NO: 39865 - DNA, 17 bp, Artificial Sequence
  Synthetic
cugcggaucgggaggac

SEQ ID NO: 39866 - DNA, 22 bp, Artificial Sequence
  Synthetic
tccctactgcuatccccacauc

SEQ ID NO: 39867 - DNA, 21 bp, Artificial Sequence
  Synthetic
ctgtacacugacggccuacaa

SEQ ID NO: 39868 - DNA, 21 bp, Artificial Sequence
  Synthetic
ccccaccauacttccucccaa

SEQ ID NO: 39869 - DNA, 28 bp, Artificial Sequence
  Synthetic
attcagctctguactcctctttaccuat

SEQ ID NO: 39870 - DNA, 26 bp, Artificial Sequence
  Synthetic
gtctgagtttuaggcacaaaaugagt

SEQ ID NO: 39871 - DNA, 23 bp, Artificial Sequence
  Synthetic
tgacactcccugcctgttttuag

SEQ ID NO: 39872 - DNA, 22 bp, Artificial Sequence
  Synthetic
gaggtgaugatctcaucgccat

SEQ ID NO: 39873 - DNA, 26 bp, Artificial Sequence
  Synthetic
gggauccttgtaatauaacccacacc

SEQ ID NO: 39874 - DNA, 23 bp, Artificial Sequence
  Synthetic
aagatcagauccttgagcugcac

SEQ ID NO: 39875 - DNA, 24 bp, Artificial Sequence
  Synthetic
accccactcutccaaatctttucc

SEQ ID NO: 39876 - DNA, 23 bp, Artificial Sequence
  Synthetic
gatgagaaacagccugaagguct

SEQ ID NO: 39877 - DNA, 27 bp, Artificial Sequence
  Synthetic
ttgatctgggaggguagagactaaaut

SEQ ID NO: 39878 - DNA, 21 bp, Artificial Sequence
  Synthetic
gccttctucccagcatgtgua

SEQ ID NO: 39879 - DNA, 27 bp, Artificial Sequence
  Synthetic
actgagccutatttgtcttcucagaac

SEQ ID NO: 39880 - DNA, 22 bp, Artificial Sequence
  Synthetic
gcctggccugaaaatacauggt

SEQ ID NO: 39881 - DNA, 26 bp, Artificial Sequence
  Synthetic
ccacccagaaauactggattgacauc

SEQ ID NO: 39882 - DNA, 24 bp, Artificial Sequence
  Synthetic
ggcagacaggacaautccuaaagt

SEQ ID NO: 39883 - DNA, 28 bp, Artificial Sequence
  Synthetic
catataagaugaactcttcctgugcaga

SEQ ID NO: 39884 - DNA, 19 bp, Artificial Sequence
  Synthetic
cctcucccctcgatuccag

SEQ ID NO: 39885 - DNA, 28 bp, Artificial Sequence
  Synthetic
ctcttgatctcuaatgtcacattgucgt

SEQ ID NO: 39886 - DNA, 22 bp, Artificial Sequence
  Synthetic
ggttgtgacagguccctcuaag

SEQ ID NO: 39887 - DNA, 19 bp, Artificial Sequence
  Synthetic
tgcctgccutgccatcuag

SEQ ID NO: 39888 - DNA, 21 bp, Artificial Sequence
  Synthetic
cctgaacuccacacggtucaa

SEQ ID NO: 39889 - DNA, 22 bp, Artificial Sequence
  Synthetic
cttguaccgctacauacagcca

SEQ ID NO: 39890 - DNA, 23 bp, Artificial Sequence
  Synthetic
ggcctgagcaauagggttuagaa

SEQ ID NO: 39891 - DNA, 25 bp, Artificial Sequence
  Synthetic
ccagacacgtaucaagattggacuc

SEQ ID NO: 39892 - DNA, 23 bp, Artificial Sequence
  Synthetic
ggugtgaaaugagcagaggacag

SEQ ID NO: 39893 - DNA, 28 bp, Artificial Sequence
  Synthetic
gacatgttaaccutgactttgtggttua

SEQ ID NO: 39894 - DNA, 22 bp, Artificial Sequence
  Synthetic
cgaagccacacaugtugaacag

SEQ ID NO: 39895 - DNA, 26 bp, Artificial Sequence
  Synthetic
tttgaagggaagutcctuccaagaaa

SEQ ID NO: 39896 - DNA, 21 bp, Artificial Sequence
  Synthetic
agtacccugcaaggcuaggaa

SEQ ID NO: 39897 - DNA, 26 bp, Artificial Sequence
  Synthetic
agtattatggccuggtgatggattug

SEQ ID NO: 39898 - DNA, 23 bp, Artificial Sequence
  Synthetic
gacaagcacuccacacacaatuc

SEQ ID NO: 39899 - DNA, 28 bp, Artificial Sequence
  Synthetic
ccgctttgagaagaugtatgagaagauc

SEQ ID NO: 39900 - DNA, 26 bp, Artificial Sequence
  Synthetic
catcaagagaguaaaccaatcaugct

SEQ ID NO: 39901 - DNA, 22 bp, Artificial Sequence
  Synthetic
gatgcttaccuggaccaguacc

SEQ ID NO: 39902 - DNA, 22 bp, Artificial Sequence
  Synthetic
gguagaaccaaaggcaacugct

SEQ ID NO: 39903 - DNA, 22 bp, Artificial Sequence
  Synthetic
cacccttcccautgcttttguc

SEQ ID NO: 39904 - DNA, 25 bp, Artificial Sequence
  Synthetic
cagaacaaggutcagtcacaacuct

SEQ ID NO: 39905 - DNA, 22 bp, Artificial Sequence
  Synthetic
ccactguggacaagactgttug

SEQ ID NO: 39906 - DNA, 21 bp, Artificial Sequence
  Synthetic
ggagccagauagcccccuaat

SEQ ID NO: 39907 - DNA, 24 bp, Artificial Sequence
  Synthetic
gcatgatatuctggacatgaugcc

SEQ ID NO: 39908 - DNA, 22 bp, Artificial Sequence
  Synthetic
gggcagguactttugaagcaat

SEQ ID NO: 39909 - DNA, 29 bp, Artificial Sequence
  Synthetic
gtattcttaacttcugcttgggatcguag

SEQ ID NO: 39910 - DNA, 23 bp, Artificial Sequence
  Synthetic
cccatcagaccuggagctuaaac

SEQ ID NO: 39911 - DNA, 23 bp, Artificial Sequence
  Synthetic
cgggaagttcugcgtttgacuaa

SEQ ID NO: 39912 - DNA, 23 bp, Artificial Sequence
  Synthetic
gagcaauggacccaactgatgua

SEQ ID NO: 39913 - DNA, 23 bp, Artificial Sequence
  Synthetic
gcaaaaaccucaactaccugcac

SEQ ID NO: 39914 - DNA, 23 bp, Artificial Sequence
  Synthetic
gaggtgggaacauggagaguaag

SEQ ID NO: 39915 - DNA, 24 bp, Artificial Sequence
  Synthetic
ccaaactctggugggcttatttut

SEQ ID NO: 39916 - DNA, 22 bp, Artificial Sequence
  Synthetic
gcaatgccautggctgtatugt

SEQ ID NO: 39917 - DNA, 27 bp, Artificial Sequence
  Synthetic
ctcatcttaaguctgtgcctagtucag

SEQ ID NO: 39918 - DNA, 22 bp, Artificial Sequence
  Synthetic
ccaaccuaaacagcagcctuct

SEQ ID NO: 39919 - DNA, 28 bp, Artificial Sequence
  Synthetic
gtctgcttattctugatgttgtacccua

SEQ ID NO: 39920 - DNA, 22 bp, Artificial Sequence
  Synthetic
aaggccutcaaaucaaacaggt

SEQ ID NO: 39921 - DNA, 25 bp, Artificial Sequence
  Synthetic
tttgtctagcugcttacttgaggug

SEQ ID NO: 39922 - DNA, 21 bp, Artificial Sequence
  Synthetic
cctccaguggctcaacatcua

SEQ ID NO: 39923 - DNA, 25 bp, Artificial Sequence
  Synthetic
tgggtagaaauggttgtgtgatguc

SEQ ID NO: 39924 - DNA, 22 bp, Artificial Sequence
  Synthetic
ccaccaagaugagctgucaaag

SEQ ID NO: 39925 - DNA, 24 bp, Artificial Sequence
  Synthetic
ggaagatcautcgagaccauggag

SEQ ID NO: 39926 - DNA, 17 bp, Artificial Sequence
  Synthetic
gccgcuccacactcucg

SEQ ID NO: 39927 - DNA, 20 bp, Artificial Sequence
  Synthetic
cctttctgcugcgcttctug

SEQ ID NO: 39928 - DNA, 31 bp, Artificial Sequence; identical to SEQ ID NO: 27694
  Synthetic

SEQ ID NO: 39929 - DNA, 23 bp, Artificial Sequence
  Synthetic
agaagagaccucccaaagctgua

SEQ ID NO: 39930 - DNA, 28 bp, Artificial Sequence
  Synthetic
ctttgtctugaggatcatagtuaagcca

SEQ ID NO: 39931 - DNA, 32 bp, Artificial Sequence; identical to SEQ ID NO: 27697
  Synthetic

SEQ ID NO: 39932 - DNA, 24 bp, Artificial Sequence
  Synthetic
aatttacgtcagguggacctctug

SEQ ID NO: 39933 - DNA, 23 bp, Artificial Sequence
  Synthetic
gcctcccgutaagtctgctttua

SEQ ID NO: 39934 - DNA, 27 bp, Artificial Sequence
  Synthetic
catggtaaaaucccatggtcaatugat

SEQ ID NO: 39935 - DNA, 28 bp, Artificial Sequence
  Synthetic
gctgatgccttutcaactaaacttacut

SEQ ID NO: 39936 - DNA, 22 bp, Artificial Sequence
  Synthetic
ggccaaaucaagatggcacuct

SEQ ID NO: 39937 - DNA, 30 bp, Artificial Sequence; identical to SEQ ID NO: 27703
  Synthetic

SEQ ID NO: 39938 - DNA, 28 bp, Artificial Sequence
  Synthetic
tgtttttaaggugggtcatgataacugg

SEQ ID NO: 39939 - DNA, 28 bp, Artificial Sequence
  Synthetic
cactccaaaauctaatgtucagagacct

SEQ ID NO: 39940 - DNA, 27 bp, Artificial Sequence
  Synthetic
cagcgtagaucaaacagtaaaagtgug

SEQ ID NO: 39941 - DNA, 29 bp, Artificial Sequence
  Synthetic
agtatacaatttggautcaccatgcauga

SEQ ID NO: 39942 - DNA, 21 bp, Artificial Sequence
  Synthetic
gacccagugcctcatgtcaut

SEQ ID NO: 39943 - DNA, 24 bp, Artificial Sequence
  Synthetic
ctgaaatcugaacagacugagcca

SEQ ID NO: 39944 - DNA, 23 bp, Artificial Sequence
  Synthetic
gcatcggatugaacctcagtcut

SEQ ID NO: 39945 - DNA, 20 bp, Artificial Sequence
  Synthetic
tcugaaggagacucccacgt

SEQ ID NO: 39946 - DNA, 17 bp, Artificial Sequence
  Synthetic
ccccugccctgtctugt

SEQ ID NO: 39947 - DNA, 21 bp, Artificial Sequence
  Synthetic
ccatgugggcagagatguagg

SEQ ID NO: 39948 - DNA, 23 bp, Artificial Sequence
  Synthetic
tcaaauaccccaacggagugaac

SEQ ID NO: 39949 - DNA, 21 bp, Artificial Sequence
  Synthetic
ctctgccgugtcttctgucaa

SEQ ID NO: 39950 - DNA, 22 bp, Artificial Sequence
  Synthetic
tcgcatttgucaccatgaucgt

SEQ ID NO: 39951 - DNA, 20 bp, Artificial Sequence
  Synthetic
gccatguagctctcaccuct

SEQ ID NO: 39952 - DNA, 23 bp, Artificial Sequence
  Synthetic
ccaaccuaacaccagcttctguc

SEQ ID NO: 39953 - DNA, 23 bp, Artificial Sequence
  Synthetic
ggtgctagtucagctggtcauac

SEQ ID NO: 39954 - DNA, 18 bp, Artificial Sequence
  Synthetic
ggagaccacuctgcucct

SEQ ID NO: 39955 - DNA, 18 bp, Artificial Sequence
  Synthetic
cttcggcugcaagctugg

SEQ ID NO: 39956 - DNA, 23 bp, Artificial Sequence
  Synthetic
gagcctatgugaaccctttccuc

SEQ ID NO: 39957 - DNA, 19 bp, Artificial Sequence
  Synthetic
cgccgtguatccagcctua

SEQ ID NO: 39958 - DNA, 21 bp, Artificial Sequence
  Synthetic
gtcaguaaagaggcagcugca

SEQ ID NO: 39959 - DNA, 18 bp, Artificial Sequence
  Synthetic
cccaccccggugtttucc

SEQ ID NO: 39960 - DNA, 24 bp, Artificial Sequence
  Synthetic
tggctttttcaguatcagctccuc

SEQ ID NO: 39961 - DNA, 20 bp, Artificial Sequence
  Synthetic
gggcttcguactaaccucgt

SEQ ID NO: 39962 - DNA, 17 bp, Artificial Sequence
  Synthetic
gtccgcugggacacgut

SEQ ID NO: 39963 - DNA, 20 bp, Artificial Sequence
  Synthetic
guaccaggagaagucgtgut

SEQ ID NO: 39964 - DNA, 18 bp, Artificial Sequence
  Synthetic
cuggagggagagccagug

SEQ ID NO: 39965 - DNA, 21 bp, Artificial Sequence
  Synthetic
gaagccgcucttctacgucat

SEQ ID NO: 39966 - DNA, 23 bp, Artificial Sequence
  Synthetic
cgtcuagaagcgggtttttcuga

SEQ ID NO: 39967 - DNA, 20 bp, Artificial Sequence
  Synthetic
cgctagaucccagctuccag

SEQ ID NO: 39968 - DNA, 20 bp, Artificial Sequence
  Synthetic
ggtcugcaccctcucagagt

SEQ ID NO: 39969 - DNA, 19 bp, Artificial Sequence
  Synthetic
ttccaucccccacccctua

SEQ ID NO: 39970 - DNA, 22 bp, Artificial Sequence
  Synthetic
ccagaagugggatttttggcut

SEQ ID NO: 39971 - DNA, 23 bp, Artificial Sequence
  Synthetic
gccaatgacccutccttctugac

SEQ ID NO: 39972 - DNA, 17 bp, Artificial Sequence
  Synthetic
gccagagcugggucaga

SEQ ID NO: 39973 - DNA, 22 bp, Artificial Sequence
  Synthetic
guccctcttgucacacacagac

SEQ ID NO: 39974 - DNA, 21 bp, Artificial Sequence
  Synthetic
ggaagtcccutccctgaacut

SEQ ID NO: 39975 - DNA, 22 bp, Artificial Sequence
  Synthetic
ggcaaattucagggctctggut

SEQ ID NO: 39976 - DNA, 17 bp, Artificial Sequence
  Synthetic
gggccaggguggttucc

SEQ ID NO: 39977 - DNA, 21 bp, Artificial Sequence
  Synthetic
aagccccgagucattcctuac

SEQ ID NO: 39978 - DNA, 21 bp, Artificial Sequence
  Synthetic
gccagugacaaccccagatuc

SEQ ID NO: 39979 - DNA, 20 bp, Artificial Sequence
  Synthetic
gctctccuagggttgccuca

SEQ ID NO: 39980 - DNA, 20 bp, Artificial Sequence
  Synthetic
ccacgcccugaataucccat

SEQ ID NO: 39981 - DNA, 21 bp, Artificial Sequence
  Synthetic
cccccaacccaaautcacuca

SEQ ID NO: 39982 - DNA, 22 bp, Artificial Sequence
  Synthetic
gctucaaacacagcagaggugt

SEQ ID NO: 39983 - DNA, 26 bp, Artificial Sequence
  Synthetic
agtgagacttcugtttgggttaccua

SEQ ID NO: 39984 - DNA, 22 bp, Artificial Sequence
  Synthetic
gccaagtcugacaaagccctut

SEQ ID NO: 39985 - DNA, 20 bp, Artificial Sequence
  Synthetic
cugagcacccaaacuggact

SEQ ID NO: 39986 - DNA, 21 bp, Artificial Sequence
  Synthetic
cacatcucagcacgggcauat

SEQ ID NO: 39987 - DNA, 21 bp, Artificial Sequence
  Synthetic
cagcagucaggactcactguc

SEQ ID NO: 39988 - DNA, 20 bp, Artificial Sequence
  Synthetic
caggguggtgtauggcaact

SEQ ID NO: 39989 - DNA, 18 bp, Artificial Sequence
  Synthetic
cggctgcaguccctgaug

SEQ ID NO: 39990 - DNA, 23 bp, Artificial Sequence
  Synthetic
ccctttcctcuccttgagacuaa

SEQ ID NO: 39991 - DNA, 17 bp, Artificial Sequence
  Synthetic
ctgcggcucaggcatuc

SEQ ID NO: 39992 - DNA, 18 bp, Artificial Sequence
  Synthetic
gctgccaagcucagguga

SEQ ID NO: 39993 - DNA, 17 bp, Artificial Sequence
  Synthetic
gcccuggccgggaguat

SEQ ID NO: 39994 - DNA, 18 bp, Artificial Sequence
  Synthetic
gcaccagggcugcactua

SEQ ID NO: 39995 - DNA, 17 bp, Artificial Sequence
  Synthetic
gctggccugaccuccac

SEQ ID NO: 39996 - DNA, 23 bp, Artificial Sequence
  Synthetic
ggcttccuttggaaaucccaagt

SEQ ID NO: 39997 - DNA, 21 bp, Artificial Sequence
  Synthetic
cgggcttuggaagttctccua

SEQ ID NO: 39998 - DNA, 22 bp, Artificial Sequence
  Synthetic
gttctcuggcagctctagugac

SEQ ID NO: 39999 - DNA, 25 bp, Artificial Sequence
  Synthetic
aatgatagagcccauggatguagga

SEQ ID NO: 40000 - DNA, 22 bp, Artificial Sequence
  Synthetic
tctacctggucaacgtcatugc

SEQ ID NO: 40001 - DNA, 22 bp, Artificial Sequence
  Synthetic
tgaugctttggatuggcaggaa

SEQ ID NO: 40002 - DNA, 25 bp, Artificial Sequence
  Synthetic
tgacaaagtaccugagacctcacua

SEQ ID NO: 40003 - DNA, 25 bp, Artificial Sequence
  Synthetic
ggttggaggaggagauctttctuac

SEQ ID NO: 40004 - DNA, 20 bp, Artificial Sequence
  Synthetic
actggctguctttgcgttug

SEQ ID NO: 40005 - DNA, 19 bp, Artificial Sequence
  Synthetic
tccacccccgutggacaua

SEQ ID NO: 40006 - DNA, 20 bp, Artificial Sequence
  Synthetic
cccuccagacccctttccut

SEQ ID NO: 40007 - DNA, 28 bp, Artificial Sequence
  Synthetic
cccaaagaguaaatcagatgatacugca

SEQ ID NO: 40008 - DNA, 26 bp, Artificial Sequence
  Synthetic
caagaagtggagaaugtcagtcugag

SEQ ID NO: 40009 - DNA, 25 bp, Artificial Sequence
  Synthetic
cttcaaagcautggucagggaaaag

SEQ ID NO: 40010 - DNA, 22 bp, Artificial Sequence
  Synthetic
caaatgccccaautgcagguaa

SEQ ID NO: 40011 - DNA, 24 bp, Artificial Sequence
  Synthetic
cacctttcctugcctctttccuag

SEQ ID NO: 40012 - DNA, 21 bp, Artificial Sequence
  Synthetic
cagtgtgcaggguggcaagug

SEQ ID NO: 40013 - DNA, 26 bp, Artificial Sequence
  Synthetic
gcctcatctugggcctgtgttatcuc

SEQ ID NO: 40014 - DNA, 21 bp, Artificial Sequence
  Synthetic
gggccagaccuaagagcaauc

SEQ ID NO: 40015 - DNA, 22 bp, Artificial Sequence
  Synthetic
catggccauctacaagcaguca

SEQ ID NO: 40016 - DNA, 20 bp, Artificial Sequence
  Synthetic
acaucttgtugagggcaggg

SEQ ID NO: 40017 - DNA, 20 bp, Artificial Sequence
  Synthetic
tccugaggtguagacgccaa

SEQ ID NO: 40018 - DNA, 22 bp, Artificial Sequence
  Synthetic
cugggaagggauagaagaugac

SEQ ID NO: 40019 - DNA, 24 bp, Artificial Sequence
  Synthetic
tgactgctctuttcacccatcuac

SEQ ID NO: 40020 - DNA, 24 bp, Artificial Sequence
  Synthetic
aaagtcagucccatggaatttucg

SEQ ID NO: 40021 - DNA, 23 bp, Artificial Sequence
  Synthetic
ctggatccccacutttcctctug

SEQ ID NO: 40022 - DNA, 17 bp, Artificial Sequence
  Synthetic
ctgctucgcgcatucgg

SEQ ID NO: 40023 - DNA, 17 bp, Artificial Sequence
  Synthetic
ctccucgcacccugcaa

SEQ ID NO: 40024 - DNA, 19 bp, Artificial Sequence
  Synthetic
ggtcttccugccctucgac

SEQ ID NO: 40025 - DNA, 17 bp, Artificial Sequence
  Synthetic
cucccgggaccgtcuac

SEQ ID NO: 40026 - DNA, 17 bp, Artificial Sequence
  Synthetic
agcccccautcgtgcug

SEQ ID NO: 40027 - DNA, 21 bp, Artificial Sequence
  Synthetic
tccatggcgautgtctcagug

SEQ ID NO: 40028 - DNA, 23 bp, Artificial Sequence
  Synthetic
ctggtctctuctgacggaactug

SEQ ID NO: 40029 - DNA, 27 bp, Artificial Sequence
  Synthetic
ccaaattuacggaaagaagacaacugg

SEQ ID NO: 40030 - DNA, 23 bp, Artificial Sequence
  Synthetic
ctccccaucgtgggatttuaaga

SEQ ID NO: 40031 - DNA, 22 bp, Artificial Sequence
  Synthetic
ctgagaccuacctctguaccca

SEQ ID NO: 40032 - DNA, 22 bp, Artificial Sequence
  Synthetic
accucctcgcucagagagaaat

SEQ ID NO: 40033 - DNA, 24 bp, Artificial Sequence
  Synthetic
cccttggaaugggtaggguaagag

SEQ ID NO: 40034 - DNA, 20 bp, Artificial Sequence
  Synthetic
tggtgagggugggagtctut

SEQ ID NO: 40035 - DNA, 21 bp, Artificial Sequence
  Synthetic
actgcggcacacuacttctug

SEQ ID NO: 40036 - DNA, 19 bp, Artificial Sequence
  Synthetic
ggucagaggcagccttugt

SEQ ID NO: 40037 - DNA, 17 bp, Artificial Sequence
  Synthetic
ccacucccagccccuga

SEQ ID NO: 40038 - DNA, 19 bp, Artificial Sequence
  Synthetic
tcactgccugccatcccua

SEQ ID NO: 40039 - DNA, 23 bp, Artificial Sequence
  Synthetic
gtgtagagaucgttgagcagguc

SEQ ID NO: 40040 - DNA, 20 bp, Artificial Sequence
  Synthetic
acaagaggcaaucgctucgt

SEQ ID NO: 40041 - DNA, 20 bp, Artificial Sequence
  Synthetic
gggaaccucaggcatauggc

SEQ ID NO: 40042 - DNA, 23 bp, Artificial Sequence
  Synthetic
gtggagauaatgggugcgaagat

SEQ ID NO: 40043 - DNA, 20 bp, Artificial Sequence
  Synthetic
gtcttguccccgtcacacuc

SEQ ID NO: 40044 - DNA, 18 bp, Artificial Sequence
  Synthetic
tcaccccaguccgccuaa

SEQ ID NO: 40045 - DNA, 17 bp, Artificial Sequence
  Synthetic
ccacgucatcgcugcct

SEQ ID NO: 40046 - DNA, 20 bp, Artificial Sequence
  Synthetic
ggaaguggcccgtctgaauc

SEQ ID NO: 40047 - DNA, 23 bp, Artificial Sequence
  Synthetic
ctgctgguagttctgttgttugc

SEQ ID NO: 40048 - DNA, 24 bp, Artificial Sequence
  Synthetic
gcucgccaaggactattauaaccc

SEQ ID NO: 40049 - DNA, 20 bp, Artificial Sequence
  Synthetic
aggctctccucaccagcaua

SEQ ID NO: 40050 - DNA, 23 bp, Artificial Sequence
  Synthetic
ggtggccaaguatgaugagaact

SEQ ID NO: 40051 - DNA, 23 bp, Artificial Sequence
  Synthetic
ggaatgcugaggaaagtggguac

SEQ ID NO: 40052 - DNA, 18 bp, Artificial Sequence
  Synthetic
caugacaggccgcugact

SEQ ID NO: 40053 - DNA, 21 bp, Artificial Sequence
  Synthetic
cccgtagugctgatactuggc

SEQ ID NO: 40054 - DNA, 21 bp, Artificial Sequence
  Synthetic
cutcctacagtuccacaccgt

SEQ ID NO: 40055 - DNA, 21 bp, Artificial Sequence
  Synthetic
caggttcucagggagcttguc

SEQ ID NO: 40056 - DNA, 20 bp, Artificial Sequence
  Synthetic
gcauaaaagccagcacugca

SEQ ID NO: 40057 - DNA, 20 bp, Artificial Sequence
  Synthetic
ggcctucgagttgctgtuga

SEQ ID NO: 40058 - DNA, 19 bp, Artificial Sequence
  Synthetic
agagccuacacggcaguct

SEQ ID NO: 40059 - DNA, 20 bp, Artificial Sequence
  Synthetic
guggttcuccagcgagaagg

SEQ ID NO: 40060 - DNA, 20 bp, Artificial Sequence
  Synthetic
gcaaugccaaggactucagc

SEQ ID NO: 40061 - DNA, 20 bp, Artificial Sequence
  Synthetic
ggutgtguccgggaaacagt

SEQ ID NO: 40062 - DNA, 18 bp, Artificial Sequence
  Synthetic
gctuaccaagggccugga

SEQ ID NO: 40063 - DNA, 19 bp, Artificial Sequence
  Synthetic
cacctgccucctcctucac

SEQ ID NO: 40064 - DNA, 21 bp, Artificial Sequence
  Synthetic
cctggaagcugaggaggagua

SEQ ID NO: 40065 - DNA, 20 bp, Artificial Sequence
  Synthetic
ctctggaccuttgacucggt

SEQ ID NO: 40066 - DNA, 22 bp, Artificial Sequence
  Synthetic
caucgcaaagaaagaguctgug

SEQ ID NO: 40067 - DNA, 24 bp, Artificial Sequence
  Synthetic
gtgagagaacgaguacacatccug

SEQ ID NO: 40068 - DNA, 18 bp, Artificial Sequence
  Synthetic
cccgaugggcuccaagac

SEQ ID NO: 40069 - DNA, 20 bp, Artificial Sequence
  Synthetic
ggctgcuggagacctugaat

SEQ ID NO: 40070 - DNA, 22 bp, Artificial Sequence
  Synthetic
tcaaaaggaagucggcctucat

SEQ ID NO: 40071 - DNA, 18 bp, Artificial Sequence
  Synthetic
attgccctuggtgggcut

SEQ ID NO: 40072 - DNA, 22 bp, Artificial Sequence
  Synthetic
ccatcgugcagaagatcaccuc

SEQ ID NO: 40073 - DNA, 21 bp, Artificial Sequence
  Synthetic
cauaacggaucagccccagaa

SEQ ID NO: 40074 - DNA, 21 bp, Artificial Sequence
  Synthetic
caaaaccgaggccutcacauc

SEQ ID NO: 40075 - DNA, 21 bp, Artificial Sequence
  Synthetic
tctttggctucttgcctccuc

SEQ ID NO: 40076 - DNA, 22 bp, Artificial Sequence
  Synthetic
acaccaccucttcaccctguaa

SEQ ID NO: 40077 - DNA, 21 bp, Artificial Sequence
  Synthetic
cagtgcauatggtggugaacg

SEQ ID NO: 40078 - DNA, 21 bp, Artificial Sequence
  Synthetic
cctcgttcuccttggaugcag

SEQ ID NO: 40079 - DNA, 21 bp, Artificial Sequence
  Synthetic
cttgaagtuggccgggtttug

SEQ ID NO: 40080 - DNA, 20 bp, Artificial Sequence
  Synthetic
tgccgctugagagaacacuc

SEQ ID NO: 40081 - DNA, 21 bp, Artificial Sequence
  Synthetic
actcatgttugcgaccctugt

SEQ ID NO: 40082 - DNA, 20 bp, Artificial Sequence
  Synthetic
ggccuaccagcctguaaagc

SEQ ID NO: 40083 - DNA, 20 bp, Artificial Sequence
  Synthetic
gctccaaugccctcctgtuc

SEQ ID NO: 40084 - DNA, 18 bp, Artificial Sequence
  Synthetic
agtccgaggucgtcggua

SEQ ID NO: 40085 - DNA, 21 bp, Artificial Sequence
  Synthetic
gatcaaggaucggctcuggac

SEQ ID NO: 40086 - DNA, 23 bp, Artificial Sequence
  Synthetic
cccacucctaacaaugaccagag

SEQ ID NO: 40087 - DNA, 21 bp, Artificial Sequence
  Synthetic
gtcctucgcaccaagaacuga

SEQ ID NO: 40088 - DNA, 18 bp, Artificial Sequence
  Synthetic
cggagccccuagccaaug

SEQ ID NO: 40089 - DNA, 25 bp, Artificial Sequence
  Synthetic
cccaccatguatctaatgatccugt

SEQ ID NO: 40090 - DNA, 20 bp, Artificial Sequence
  Synthetic
gucttcacguccagcaggat

SEQ ID NO: 40091 - DNA, 20 bp, Artificial Sequence
  Synthetic
acggccacacucactaaucg

SEQ ID NO: 40092 - DNA, 22 bp, Artificial Sequence
  Synthetic
gaaugccatucacaccagaagg

SEQ ID NO: 40093 - DNA, 21 bp, Artificial Sequence
  Synthetic
gtcaaugtggagauggacgct

SEQ ID NO: 40094 - DNA, 25 bp, Artificial Sequence
  Synthetic
cctccctgcauttcttttaagcuga

SEQ ID NO: 40095 - DNA, 20 bp, Artificial Sequence
  Synthetic
gtggaagccgacaucaaugg

SEQ ID NO: 40096 - DNA, 21 bp, Artificial Sequence
  Synthetic
ggatgttcuggcccaccatut

SEQ ID NO: 40097 - DNA, 25 bp, Artificial Sequence
  Synthetic
atgaagcaagagcutaatguaggct

SEQ ID NO: 40098 - DNA, 18 bp, Artificial Sequence
  Synthetic
ccaggcggucatugaggt

SEQ ID NO: 40099 - DNA, 20 bp, Artificial Sequence
  Synthetic
gtctcatccucccgcttcuc

SEQ ID NO: 40100 - DNA, 20 bp, Artificial Sequence
  Synthetic
cccttcauggagcuggagga

SEQ ID NO: 40101 - DNA, 20 bp, Artificial Sequence
  Synthetic
gggaauggaaagugccagac

SEQ ID NO: 40102 - DNA, 24 bp, Artificial Sequence
  Synthetic
ccactttguaagctcattctuggg

SEQ ID NO: 40103 - DNA, 27 bp, Artificial Sequence
  Synthetic
tgaattgacacuaatctctgcttgugt

SEQ ID NO: 40104 - DNA, 22 bp, Artificial Sequence
  Synthetic
gcatccauagggacugacaggt

SEQ ID NO: 40105 - DNA, 26 bp, Artificial Sequence
  Synthetic
gcctgggttaaguatgcagattacug

SEQ ID NO: 40106 - DNA, 22 bp, Artificial Sequence
  Synthetic
gucttacaaaaugaagcggccc

SEQ ID NO: 40107 - DNA, 24 bp, Artificial Sequence
  Synthetic
ttatcctgaugggttgtgttuggt

SEQ ID NO: 40108 - DNA, 23 bp, Artificial Sequence
  Synthetic
agacucagcaucagcaaaaacct

SEQ ID NO: 40109 - DNA, 32 bp, Artificial Sequence; identical to SEQ ID NO: 27875
  Synthetic

SEQ ID NO: 40110 - DNA, 31 bp, Artificial Sequence; identical to SEQ ID NO: 27876
  Synthetic

SEQ ID NO: 40111 - DNA, 24 bp, Artificial Sequence
  Synthetic
ctctgcatugaaagttccccaaut

SEQ ID NO: 40112 - DNA, 31 bp, Artificial Sequence; identical to SEQ ID NO: 27878
  Synthetic

SEQ ID NO: 40113 - DNA, 25 bp, Artificial Sequence
  Synthetic
ccatcucaagaggagctcatuaagg

SEQ ID NO: 40114 - DNA, 29 bp, Artificial Sequence
  Synthetic
gtcagataccacagcauctttacatugat

SEQ ID NO: 40115 - DNA, 30 bp, Artificial Sequence; identical to SEQ ID NO: 27881
  Synthetic

SEQ ID NO: 40116 - DNA, 27 bp, Artificial Sequence
  Synthetic
agatatcagtguttggccaacaauaca

SEQ ID NO: 40117 - DNA, 27 bp, Artificial Sequence
  Synthetic
tcttggtgccauttatcgttttugaag

SEQ ID NO: 40118 - DNA, 26 bp, Artificial Sequence
  Synthetic
gcaaacacaaaaaccuggttccaaua

SEQ ID NO: 40119 - DNA, 29 bp, Artificial Sequence
  Synthetic
aattggaagacutgactgcaaauacaaac

SEQ ID NO: 40120 - DNA, 25 bp, Artificial Sequence
  Synthetic
tccuctgtgttctuagacagacact

SEQ ID NO: 40121 - DNA, 22 bp, Artificial Sequence
  Synthetic
cctagcccuttcacccauacac

SEQ ID NO: 40122 - DNA, 24 bp, Artificial Sequence
  Synthetic
caucaggtgtcucagaacaaacct

SEQ ID NO: 40123 - DNA, 22 bp, Artificial Sequence
  Synthetic
cagagggccaaaautgaaugct

SEQ ID NO: 40124 - DNA, 30 bp, Artificial Sequence; identical to SEQ ID NO: 27890
  Synthetic

SEQ ID NO: 40125 - DNA, 28 bp, Artificial Sequence
  Synthetic
aacgaaactggacucattactccaaaua

SEQ ID NO: 40126 - DNA, 25 bp, Artificial Sequence
  Synthetic
gcctgcagugatattaactgtcugt

SEQ ID NO: 40127 - DNA, 28 bp, Artificial Sequence
  Synthetic
gctcagtattugcagaatacatucaagg

SEQ ID NO: 40128 - DNA, 22 bp, Artificial Sequence
  Synthetic
gggttutcaaatgcugcacact

SEQ ID NO: 40129 - DNA, 22 bp, Artificial Sequence
  Synthetic
gcugaagaccccaaagatcuca

SEQ ID NO: 40130 - DNA, 26 bp, Artificial Sequence
  Synthetic
tttgttaacutcagctcugggaaagt

SEQ ID NO: 40131 - DNA, 30 bp, Artificial Sequence; identical to SEQ ID NO: 27897
  Synthetic

SEQ ID NO: 40132 - DNA, 28 bp, Artificial Sequence
  Synthetic
cttatactgctgcutataggttcagcut

SEQ ID NO: 40133 - DNA, 29 bp, Artificial Sequence
  Synthetic
aagactccugaaatgataaaucagggaac

SEQ ID NO: 40134 - DNA, 25 bp, Artificial Sequence
  Synthetic
gtggctcaguaacaaatgctccuat

SEQ ID NO: 40135 - DNA, 31 bp, Artificial Sequence; identical to SEQ ID NO: 27901
  Synthetic

SEQ ID NO: 40136 - DNA, 28 bp, Artificial Sequence
  Synthetic
ttcatcacttcuggaaaaccactcatua

SEQ ID NO: 40137 - DNA, 22 bp, Artificial Sequence
  Synthetic
ccaacauaacagatgggcugga

SEQ ID NO: 40138 - DNA, 23 bp, Artificial Sequence
  Synthetic
gctccacaugcaagttugaaaca

SEQ ID NO: 40139 - DNA, 27 bp, Artificial Sequence
  Synthetic
ccacctccaaggugtatgaagtatgua

SEQ ID NO: 40140 - DNA, 28 bp, Artificial Sequence
  Synthetic
aggaaaauaccagcttcauagacaaagg

SEQ ID NO: 40141 - DNA, 32 bp, Artificial Sequence; identical to SEQ ID NO: 27907
  Synthetic

SEQ ID NO: 40142 - DNA, 19 bp, Artificial Sequence
  Synthetic
gcutctagccugggccaca

SEQ ID NO: 40143 - DNA, 28 bp, Artificial Sequence
  Synthetic
ctatcatccaaaguatgggcuacagaaa

SEQ ID NO: 40144 - DNA, 27 bp, Artificial Sequence
  Synthetic
taaaaggtcttaucaccacgtcauaga

SEQ ID NO: 40145 - DNA, 30 bp, Artificial Sequence; identical to SEQ ID NO: 27911
  Synthetic

SEQ ID NO: 40146 - DNA, 27 bp, Artificial Sequence
  Synthetic
aagttaggtgtutcctgggttaugaag

SEQ ID NO: 40147 - DNA, 32 bp, Artificial Sequence; identical to SEQ ID NO: 27913
  Synthetic

SEQ ID NO: 40148 - DNA, 17 bp, Artificial Sequence
  Synthetic
gtcgcggcuccgctaua

SEQ ID NO: 40149 - DNA, 17 bp, Artificial Sequence
  Synthetic
cgggagcucaccugcac

SEQ ID NO: 40150 - DNA, 21 bp, Artificial Sequence
  Synthetic
actcucagcccaccttctcuc

SEQ ID NO: 40151 - DNA, 20 bp, Artificial Sequence
  Synthetic
ttggacaguccacgttugct

SEQ ID NO: 40152 - DNA, 21 bp, Artificial Sequence
  Synthetic
ggcaggagacaaugtcccauc

SEQ ID NO: 40153 - DNA, 23 bp, Artificial Sequence
  Synthetic
cutatatggcaagucggaccagt

SEQ ID NO: 40154 - DNA, 21 bp, Artificial Sequence
  Synthetic
gggtaguccaggcccttcaua

SEQ ID NO: 40155 - DNA, 28 bp, Artificial Sequence
  Synthetic
tctctgaatccuaagaagaagctcucag

SEQ ID NO: 40156 - DNA, 20 bp, Artificial Sequence
  Synthetic
ccttcucccaccctcacuga

SEQ ID NO: 40157 - DNA, 22 bp, Artificial Sequence
  Synthetic
acaguccagacgaccttcucat

SEQ ID NO: 40158 - DNA, 19 bp, Artificial Sequence
  Synthetic
ctgcugagccccatcacut

SEQ ID NO: 40159 - DNA, 20 bp, Artificial Sequence
  Synthetic
gtgagccaucaucgcaggaa

SEQ ID NO: 40160 - DNA, 17 bp, Artificial Sequence
  Synthetic
ccccgcgccutccuaag

SEQ ID NO: 40161 - DNA, 21 bp, Artificial Sequence
  Synthetic
tgctcgtcggucatcttcaug

SEQ ID NO: 40162 - DNA, 19 bp, Artificial Sequence
  Synthetic
caagttccccgugtgcauc

SEQ ID NO: 40163 - DNA, 18 bp, Artificial Sequence
  Synthetic
gtactgguccgcgagcut

SEQ ID NO: 40164 - DNA, 20 bp, Artificial Sequence
  Synthetic
gaccugacagttuggcggat

SEQ ID NO: 40165 - DNA, 20 bp, Artificial Sequence
  Synthetic
cccgttctucaccgactucc

SEQ ID NO: 40166 - DNA, 28 bp, Artificial Sequence
  Synthetic
ttttctcgtgcutgttcttttattgucc

SEQ ID NO: 40167 - DNA, 23 bp, Artificial Sequence
  Synthetic
aactcgttgacaucgaaggtcuc

SEQ ID NO: 40168 - DNA, 18 bp, Artificial Sequence
  Synthetic
gcuacggcaucagcagca

SEQ ID NO: 40169 - DNA, 17 bp, Artificial Sequence
  Synthetic
ctcagcguggucagcgt

SEQ ID NO: 40170 - DNA, 20 bp, Artificial Sequence
  Synthetic
tccagcucctacuacagcca

SEQ ID NO: 40171 - DNA, 18 bp, Artificial Sequence
  Synthetic
gccatctucgccctucgt

SEQ ID NO: 40172 - DNA, 21 bp, Artificial Sequence
  Synthetic
gtggaggccucatgtgucaat

SEQ ID NO: 40173 - DNA, 24 bp, Artificial Sequence
  Synthetic
gtttaggugagacaccgtgagauc

SEQ ID NO: 40174 - DNA, 19 bp, Artificial Sequence
  Synthetic
ccagugaccccctgtccut

SEQ ID NO: 40175 - DNA, 23 bp, Artificial Sequence
  Synthetic
ccataaauagccaggcugagcat

SEQ ID NO: 40176 - DNA, 22 bp, Artificial Sequence
  Synthetic
tggacctguacatcctcaugga

SEQ ID NO: 40177 - DNA, 18 bp, Artificial Sequence
  Synthetic
ggtgcagcugtccugagt

SEQ ID NO: 40178 - DNA, 20 bp, Artificial Sequence
  Synthetic
gacactcuctctcccuccca

SEQ ID NO: 40179 - DNA, 17 bp, Artificial Sequence
  Synthetic
gcuggcagcaccctucc

SEQ ID NO: 40180 - DNA, 22 bp, Artificial Sequence
  Synthetic
ccttccacuatgaggctgaugg

SEQ ID NO: 40181 - DNA, 24 bp, Artificial Sequence
  Synthetic
agtagttggugacagcaaagaugg

SEQ ID NO: 40182 - DNA, 22 bp, Artificial Sequence
  Synthetic
ccacagagcacugatcaaccuc

SEQ ID NO: 40183 - DNA, 25 bp, Artificial Sequence
  Synthetic
tgttttaaacgautccactcggugt

SEQ ID NO: 40184 - DNA, 23 bp, Artificial Sequence
  Synthetic
gaagggcaacauccatcugaaac

SEQ ID NO: 40185 - DNA, 22 bp, Artificial Sequence
  Synthetic
gcacaggagucctgcttcatuc

SEQ ID NO: 40186 - DNA, 22 bp, Artificial Sequence
  Synthetic
ggaatgaccagutcctcctuca

SEQ ID NO: 40187 - DNA, 23 bp, Artificial Sequence
  Synthetic
cactggaagutgtcatacucgca

SEQ ID NO: 40188 - DNA, 23 bp, Artificial Sequence
  Synthetic
cctggacuacaggcacagatgua

SEQ ID NO: 40189 - DNA, 23 bp, Artificial Sequence
  Synthetic
ccatagggutctctcuggagagg

SEQ ID NO: 40190 - DNA, 19 bp, Artificial Sequence
  Synthetic
cccaacacagugcctguct

SEQ ID NO: 40191 - DNA, 19 bp, Artificial Sequence
  Synthetic
ccuaggctcucagcaaccc

SEQ ID NO: 40192 - DNA, 19 bp, Artificial Sequence
  Synthetic
cccctcutgaccatuggca

SEQ ID NO: 40193 - DNA, 23 bp, Artificial Sequence
  Synthetic
gcucagagaaagagcagucagag

SEQ ID NO: 40194 - DNA, 17 bp, Artificial Sequence
  Synthetic
cucaagggccgugacgt

SEQ ID NO: 40195 - DNA, 22 bp, Artificial Sequence
  Synthetic
cagagaagaggcaugctgugat

SEQ ID NO: 40196 - DNA, 17 bp, Artificial Sequence
  Synthetic
ccuaggcccagccucac

SEQ ID NO: 40197 - DNA, 19 bp, Artificial Sequence
  Synthetic
cctgaaguggaggccugat

SEQ ID NO: 40198 - DNA, 19 bp, Artificial Sequence
  Synthetic
ctgaaccutccacccucga

SEQ ID NO: 40199 - DNA, 22 bp, Artificial Sequence
  Synthetic
ggtctgcagugagggtgtagua

SEQ ID NO: 40200 - DNA, 19 bp, Artificial Sequence
  Synthetic
acctcugaccaccuccgaa

SEQ ID NO: 40201 - DNA, 26 bp, Artificial Sequence
  Synthetic
tccttgatgauggtgatgttuaccag

SEQ ID NO: 40202 - DNA, 21 bp, Artificial Sequence
  Synthetic
cccagcacacuctgacaaaug

SEQ ID NO: 40203 - DNA, 17 bp, Artificial Sequence
  Synthetic
cacccucgaccctgugg

SEQ ID NO: 40204 - DNA, 21 bp, Artificial Sequence
  Synthetic
tggaaagagcugcaggugaag

SEQ ID NO: 40205 - DNA, 22 bp, Artificial Sequence
  Synthetic
gtcttccctcucctcctgctua

SEQ ID NO: 40206 - DNA, 23 bp, Artificial Sequence
  Synthetic
tctgugcaaagaggacaguaagg

SEQ ID NO: 40207 - DNA, 23 bp, Artificial Sequence
  Synthetic
caatacggguacaggttggugag

SEQ ID NO: 40208 - DNA, 22 bp, Artificial Sequence
  Synthetic
cactgacagcacucttcctgua

SEQ ID NO: 40209 - DNA, 23 bp, Artificial Sequence
  Synthetic
gcaggaaagaaggauctggtuct

SEQ ID NO: 40210 - DNA, 20 bp, Artificial Sequence
  Synthetic
gcccatguccagtgaguggt

SEQ ID NO: 40211 - DNA, 25 bp, Artificial Sequence
  Synthetic
gtacataaggaagcugtcgtagucc

SEQ ID NO: 40212 - DNA, 17 bp, Artificial Sequence
  Synthetic
ggctgcggcuggaagut

SEQ ID NO: 40213 - DNA, 17 bp, Artificial Sequence
  Synthetic
gcgggugagcctgucac

SEQ ID NO: 40214 - DNA, 19 bp, Artificial Sequence
  Synthetic
gaugaccacgaccagugct

SEQ ID NO: 40215 - DNA, 20 bp, Artificial Sequence
  Synthetic
ggttggcugaggtcacucac

SEQ ID NO: 40216 - DNA, 21 bp, Artificial Sequence
  Synthetic
tgactcccacugagacccuag

SEQ ID NO: 40217 - DNA, 22 bp, Artificial Sequence
  Synthetic
cagctggtacuccacactguag

SEQ ID NO: 40218 - DNA, 22 bp, Artificial Sequence
  Synthetic
actaggtcucgatggcagctua

SEQ ID NO: 40219 - DNA, 21 bp, Artificial Sequence
  Synthetic
cggaacacguaggagtggtug

SEQ ID NO: 40220 - DNA, 22 bp, Artificial Sequence
  Synthetic
acaggctgaugctcttcctcua

SEQ ID NO: 40221 - DNA, 22 bp, Artificial Sequence
  Synthetic
ccatctcacaggucaccaggua

SEQ ID NO: 40222 - DNA, 20 bp, Artificial Sequence
  Synthetic
gcagacgcugaaggcatcut

SEQ ID NO: 40223 - DNA, 21 bp, Artificial Sequence
  Synthetic
gggugaaggaaaggacaggug

SEQ ID NO: 40224 - DNA, 22 bp, Artificial Sequence
  Synthetic
caagccaggucatctaaugcct

SEQ ID NO: 40225 - DNA, 22 bp, Artificial Sequence
  Synthetic
tgcggucaagttuggaagaact

SEQ ID NO: 40226 - DNA, 21 bp, Artificial Sequence
  Synthetic
ccucctaatccauccccagca

SEQ ID NO: 40227 - DNA, 21 bp, Artificial Sequence
  Synthetic
atagcccggucagtttcucac

SEQ ID NO: 40228 - DNA, 23 bp, Artificial Sequence
  Synthetic
gagagucagaaacaugggaaggt

SEQ ID NO: 40229 - DNA, 20 bp, Artificial Sequence
  Synthetic
ggacttgccugttgctucct

SEQ ID NO: 40230 - DNA, 30 bp, Artificial Sequence; identical to SEQ ID NO: 27996
  Synthetic

SEQ ID NO: 40231 - DNA, 23 bp, Artificial Sequence
  Synthetic
cggaataacugcccauagggaat

SEQ ID NO: 40232 - DNA, 21 bp, Artificial Sequence
  Synthetic
cggaagcugcaatugaagagg

SEQ ID NO: 40233 - DNA, 19 bp, Artificial Sequence
  Synthetic
agccuccccgctaacacua

SEQ ID NO: 40234 - DNA, 22 bp, Artificial Sequence
  Synthetic
tcagtggcaautaagccctgut

SEQ ID NO: 40235 - DNA, 18 bp, Artificial Sequence
  Synthetic
tgtgcagguggctcaucg

SEQ ID NO: 40236 - DNA, 23 bp, Artificial Sequence
  Synthetic
gcaggaggguaaccagaaaggua

SEQ ID NO: 40237 - DNA, 21 bp, Artificial Sequence
  Synthetic
guagccacaaccuggaccaaa

SEQ ID NO: 40238 - DNA, 20 bp, Artificial Sequence
  Synthetic
cacctgguacaccugcagaa

SEQ ID NO: 40239 - DNA, 21 bp, Artificial Sequence
  Synthetic
ctggccauggtacauggagac

SEQ ID NO: 40240 - DNA, 21 bp, Artificial Sequence
  Synthetic
gggctgctuctcatcctgtut

SEQ ID NO: 40241 - DNA, 20 bp, Artificial Sequence
  Synthetic
gagggucgaacacugagagc

SEQ ID NO: 40242 - DNA, 20 bp, Artificial Sequence
  Synthetic
gccttagugagctcccucgt

SEQ ID NO: 40243 - DNA, 29 bp, Artificial Sequence
  Synthetic
cttttcttcctccutcatgatggattuct

SEQ ID NO: 40244 - DNA, 24 bp, Artificial Sequence
  Synthetic
gcagagccagutcaataccuacag

SEQ ID NO: 40245 - DNA, 26 bp, Artificial Sequence
  Synthetic
gagtaucatttgttccuggagacaag

SEQ ID NO: 40246 - DNA, 19 bp, Artificial Sequence
  Synthetic
gaagacggaugctgccauc

SEQ ID NO: 40247 - DNA, 19 bp, Artificial Sequence
  Synthetic
ggacggcutgccctcauat

SEQ ID NO: 40248 - DNA, 22 bp, Artificial Sequence
  Synthetic
agucaacgagctcaucaccaac

SEQ ID NO: 40249 - DNA, 23 bp, Artificial Sequence
  Synthetic
cttccaggagutcatgtcugacc

SEQ ID NO: 40250 - DNA, 19 bp, Artificial Sequence
  Synthetic
ctgaucgacgagcacgaug

SEQ ID NO: 40251 - DNA, 20 bp, Artificial Sequence
  Synthetic
gagctcguctcagcaucact

SEQ ID NO: 40252 - DNA, 24 bp, Artificial Sequence
  Synthetic
gatgaataaaaaccggugcagcuc

SEQ ID NO: 40253 - DNA, 23 bp, Artificial Sequence
  Synthetic
gggtgtggaaautacatccuggt

SEQ ID NO: 40254 - DNA, 24 bp, Artificial Sequence
  Synthetic
tttcttacacugcctctccuacct

SEQ ID NO: 40255 - DNA, 18 bp, Artificial Sequence
  Synthetic
ccttggtguggccagguc

SEQ ID NO: 40256 - DNA, 22 bp, Artificial Sequence
  Synthetic
ccagcatggucctgtgattcuc

SEQ ID NO: 40257 - DNA, 21 bp, Artificial Sequence
  Synthetic
gacctccugggacacgttuac

SEQ ID NO: 40258 - DNA, 20 bp, Artificial Sequence
  Synthetic
tccaagcaguccctagugct

SEQ ID NO: 40259 - DNA, 24 bp, Artificial Sequence
  Synthetic
aacacaattccggauctcttccug

SEQ ID NO: 40260 - DNA, 31 bp, Artificial Sequence; identical to SEQ ID NO: 28026
  Synthetic

SEQ ID NO: 40261 - DNA, 21 bp, Artificial Sequence
  Synthetic
ggccagccucagacacaaaua

SEQ ID NO: 40262 - DNA, 30 bp, Artificial Sequence; identical to SEQ ID NO: 28028
  Synthetic

SEQ ID NO: 40263 - DNA, 22 bp, Artificial Sequence
  Synthetic
ggagggttcuttggcaactuac

SEQ ID NO: 40264 - DNA, 23 bp, Artificial Sequence
  Synthetic
ggtggtcagucatgtgtgtcauc

SEQ ID NO: 40265 - DNA, 21 bp, Artificial Sequence
  Synthetic
aggtccacuggaggagaaguc

SEQ ID NO: 40266 - DNA, 20 bp, Artificial Sequence
  Synthetic
gccgguaccgagaggaacua

SEQ ID NO: 40267 - DNA, 18 bp, Artificial Sequence
  Synthetic
cacccuccacuccagcag

SEQ ID NO: 40268 - DNA, 19 bp, Artificial Sequence
  Synthetic
ggcctcucagtcccgtgua

SEQ ID NO: 40269 - DNA, 18 bp, Artificial Sequence
  Synthetic
gggtccuccaggauccct

SEQ ID NO: 40270 - DNA, 21 bp, Artificial Sequence
  Synthetic
actcagcugaaagcccugaac

SEQ ID NO: 40271 - DNA, 18 bp, Artificial Sequence
  Synthetic
ccacacguccgtgctuct

SEQ ID NO: 40272 - DNA, 22 bp, Artificial Sequence
  Synthetic
ccttttcucccgactgttgcua

SEQ ID NO: 40273 - DNA, 20 bp, Artificial Sequence
  Synthetic
actgtucacacggcctctuc

SEQ ID NO: 40274 - DNA, 26 bp, Artificial Sequence
  Synthetic
cttaaactgtuacgcttggcaagaug

SEQ ID NO: 40275 - DNA, 31 bp, Artificial Sequence; identical to SEQ ID NO: 28041
  Synthetic

SEQ ID NO: 40276 - DNA, 25 bp, Artificial Sequence
  Synthetic
attgcgguaacttttcctttugcat

SEQ ID NO: 40277 - DNA, 20 bp, Artificial Sequence
  Synthetic
gccagatguccctctcguct

SEQ ID NO: 40278 - DNA, 17 bp, Artificial Sequence
  Synthetic
gaucctgugcgcagggt

SEQ ID NO: 40279 - DNA, 18 bp, Artificial Sequence
  Synthetic
tctgccggccuctttucc

SEQ ID NO: 40280 - DNA, 17 bp, Artificial Sequence
  Synthetic
ccugcagcaccgaguct

SEQ ID NO: 40281 - DNA, 19 bp, Artificial Sequence
  Synthetic
tcctccucctcctccaugc

SEQ ID NO: 40282 - DNA, 28 bp, Artificial Sequence
  Synthetic
tgtacacactgacuactatgccaaguat

SEQ ID NO: 40283 - DNA, 19 bp, Artificial Sequence
  Synthetic
cccgcgucttctctaucgg

SEQ ID NO: 40284 - DNA, 19 bp, Artificial Sequence
  Synthetic
cacgtggucaacccugact

SEQ ID NO: 40285 - DNA, 21 bp, Artificial Sequence
  Synthetic
gtgcaugaaccaacagctguc

SEQ ID NO: 40286 - DNA, 19 bp, Artificial Sequence
  Synthetic
gatgccggutctucccaag

SEQ ID NO: 40287 - DNA, 22 bp, Artificial Sequence
  Synthetic
gcaagctugaagagccctcaut

SEQ ID NO: 40288 - DNA, 19 bp, Artificial Sequence
  Synthetic
ggtgaagagcugccugacg

SEQ ID NO: 40289 - DNA, 19 bp, Artificial Sequence
  Synthetic
aggugcacagcucagcaat

SEQ ID NO: 40290 - DNA, 21 bp, Artificial Sequence
  Synthetic
cgttugccacaagcatcucac

SEQ ID NO: 40291 - DNA, 19 bp, Artificial Sequence
  Synthetic
gtcggucaggcttcagucc

SEQ ID NO: 40292 - DNA, 17 bp, Artificial Sequence
  Synthetic
gtcgggugtcgccugag

SEQ ID NO: 40293 - DNA, 18 bp, Artificial Sequence
  Synthetic
tcttccaucccgcggtug

SEQ ID NO: 40294 - DNA, 24 bp, Artificial Sequence
  Synthetic
cccaaatugcaagacagagtugct

SEQ ID NO: 40295 - DNA, 21 bp, Artificial Sequence
  Synthetic
cacatccacutcctgcugaac

SEQ ID NO: 40296 - DNA, 21 bp, Artificial Sequence
  Synthetic
gcgcaggaacuttggtaguca

SEQ ID NO: 40297 - DNA, 23 bp, Artificial Sequence
  Synthetic
ctgcaggaucatgtccttgauct

SEQ ID NO: 40298 - DNA, 21 bp, Artificial Sequence
  Synthetic
cagctgaugctctttccuggt

SEQ ID NO: 40299 - DNA, 24 bp, Artificial Sequence
  Synthetic
gtaatgauaaggaccccacccauc

SEQ ID NO: 40300 - DNA, 20 bp, Artificial Sequence
  Synthetic
tgtctgccacuccctgguat

SEQ ID NO: 40301 - DNA, 23 bp, Artificial Sequence
  Synthetic
ggccgaaagutcttgtactccuc

SEQ ID NO: 40302 - DNA, 25 bp, Artificial Sequence
  Synthetic
ggtaaaagaacaguaaacccuggct

SEQ ID NO: 40303 - DNA, 22 bp, Artificial Sequence
  Synthetic
gtggaagaugcgattgatucgg

SEQ ID NO: 40304 - DNA, 21 bp, Artificial Sequence
  Synthetic
ggagagaacgutccccagaug

SEQ ID NO: 40305 - DNA, 22 bp, Artificial Sequence
  Synthetic
gtgactctccucgtggaactug

SEQ ID NO: 40306 - DNA, 21 bp, Artificial Sequence
  Synthetic
cactgtcccugggtgtcttuc

SEQ ID NO: 40307 - DNA, 25 bp, Artificial Sequence
  Synthetic
gcggagaugagaacaaaacctgtua

SEQ ID NO: 40308 - DNA, 22 bp, Artificial Sequence
  Synthetic
ttggccttguactcacagugac

SEQ ID NO: 40309 - DNA, 24 bp, Artificial Sequence
  Synthetic
tccttggatcugagagtgaggaut

SEQ ID NO: 40310 - DNA, 18 bp, Artificial Sequence
  Synthetic
ctaagcugcgcgcttucc

SEQ ID NO: 40311 - DNA, 21 bp, Artificial Sequence
  Synthetic
agtgacugagttcugcccaga

SEQ ID NO: 40312 - DNA, 18 bp, Artificial Sequence
  Synthetic
gacccauggcagggucaa

SEQ ID NO: 40313 - DNA, 19 bp, Artificial Sequence
  Synthetic
ctgcttccuctcccaggug

SEQ ID NO: 40314 - DNA, 21 bp, Artificial Sequence
  Synthetic
gggtgauacacaagccugacc

SEQ ID NO: 40315 - DNA, 21 bp, Artificial Sequence
  Synthetic
ggtgctgaugtcaccgaugat

SEQ ID NO: 40316 - DNA, 24 bp, Artificial Sequence
  Synthetic
ggctcctacuccatctgtatcugt

SEQ ID NO: 40317 - DNA, 20 bp, Artificial Sequence
  Synthetic
ggucactgtuggcaaacacg

SEQ ID NO: 40318 - DNA, 21 bp, Artificial Sequence
  Synthetic
ccccuccccacctgtcttuat

SEQ ID NO: 40319 - DNA, 19 bp, Artificial Sequence
  Synthetic
ccccagaccacugaagcuc

SEQ ID NO: 40320 - DNA, 24 bp, Artificial Sequence
  Synthetic
ccagaagcaugaaacactgtucaa

SEQ ID NO: 40321 - DNA, 24 bp, Artificial Sequence
  Synthetic
gagctgctgucgggaaaaatuaac

SEQ ID NO: 40322 - DNA, 26 bp, Artificial Sequence
  Synthetic
gatgtaggaagagutaatcacgugct

SEQ ID NO: 40323 - DNA, 28 bp, Artificial Sequence
  Synthetic
ctgagcutcatgtattuccaaaggaaaa

SEQ ID NO: 40324 - DNA, 26 bp, Artificial Sequence
  Synthetic
gcaccaatgutctcaaattcugagag

SEQ ID NO: 40325 - DNA, 23 bp, Artificial Sequence
  Synthetic
ggtgtguggcctctttgtaugat

SEQ ID NO: 40326 - DNA, 21 bp, Artificial Sequence
  Synthetic
ccatgcagcaautgtccagua

SEQ ID NO: 40327 - DNA, 27 bp, Artificial Sequence
  Synthetic
gcatagaguacgactggaactuaacat

SEQ ID NO: 40328 - DNA, 27 bp, Artificial Sequence
  Synthetic
catccctggcucagttaagtatttuat

SEQ ID NO: 40329 - DNA, 29 bp, Artificial Sequence
  Synthetic
ggaaagaaatugagagcagctaatcttut

SEQ ID NO: 40330 - DNA, 26 bp, Artificial Sequence
  Synthetic
gattttccatucaggttcttctgguc

SEQ ID NO: 40331 - DNA, 28 bp, Artificial Sequence
  Synthetic
cgtcattcctgauccttcatgagtauat

SEQ ID NO: 40332 - DNA, 18 bp, Artificial Sequence
  Synthetic
cutacaccuccgccacca

SEQ ID NO: 40333 - DNA, 24 bp, Artificial Sequence
  Synthetic
agttgtgacgggagutgtagttuc

SEQ ID NO: 40334 - DNA, 19 bp, Artificial Sequence
  Synthetic
ggcctguggtctgcaguat

SEQ ID NO: 40335 - DNA, 19 bp, Artificial Sequence
  Synthetic
cctcuccctccugcacaga

SEQ ID NO: 40336 - DNA, 23 bp, Artificial Sequence
  Synthetic
gggatctgugcttattctgtucc

SEQ ID NO: 40337 - DNA, 25 bp, Artificial Sequence
  Synthetic
gatactagggtugtagagggagguc

SEQ ID NO: 40338 - DNA, 20 bp, Artificial Sequence
  Synthetic
ccattccauccccacccaua

SEQ ID NO: 40339 - DNA, 22 bp, Artificial Sequence
  Synthetic
gcaaacccauggtgagaagaug

SEQ ID NO: 40340 - DNA, 21 bp, Artificial Sequence
  Synthetic
agcctcccautgaccaactuc

SEQ ID NO: 40341 - DNA, 24 bp, Artificial Sequence
  Synthetic
cctaatccuactcataggguccca

SEQ ID NO: 40342 - DNA, 19 bp, Artificial Sequence
  Synthetic
tctgacuccccttggcuct

SEQ ID NO: 40343 - DNA, 17 bp, Artificial Sequence
  Synthetic
gggcutcaggugaggga

SEQ ID NO: 40344 - DNA, 20 bp, Artificial Sequence
  Synthetic
cagaccuctgtcuccccact

SEQ ID NO: 40345 - DNA, 24 bp, Artificial Sequence
  Synthetic
tgaaagaggccaagugtatggaug

SEQ ID NO: 40346 - DNA, 18 bp, Artificial Sequence
  Synthetic
ggagccuggacagctuca

SEQ ID NO: 40347 - DNA, 17 bp, Artificial Sequence
  Synthetic
ccucgccacgtccucac

SEQ ID NO: 40348 - DNA, 21 bp, Artificial Sequence
  Synthetic
ccccagauccccagtcctaut

SEQ ID NO: 40349 - DNA, 21 bp, Artificial Sequence
  Synthetic
cccagaaugagaggugaagcg

SEQ ID NO: 40350 - DNA, 21 bp, Artificial Sequence
  Synthetic
ctggtgccuacacacccttua

SEQ ID NO: 40351 - DNA, 23 bp, Artificial Sequence
  Synthetic
gagggtugagaggttctgagtuc

SEQ ID NO: 40352 - DNA, 23 bp, Artificial Sequence
  Synthetic
gactccattuctgacagcucagg

SEQ ID NO: 40353 - DNA, 27 bp, Artificial Sequence
  Synthetic
tgtatggtcagagacutagaaatgcug

SEQ ID NO: 40354 - DNA, 20 bp, Artificial Sequence
  Synthetic
ccccugaagacgtgaucagc

SEQ ID NO: 40355 - DNA, 20 bp, Artificial Sequence
  Synthetic
ggaagcugtctcaggucagt

SEQ ID NO: 40356 - DNA, 21 bp, Artificial Sequence
  Synthetic
gctatgcuccatgccaugagg

SEQ ID NO: 40357 - DNA, 21 bp, Artificial Sequence
  Synthetic
cucgccagaaaaccttugcag

SEQ ID NO: 40358 - DNA, 20 bp, Artificial Sequence
  Synthetic
catggagtugaccctgggut

SEQ ID NO: 40359 - DNA, 24 bp, Artificial Sequence
  Synthetic
ctctctctcaguctctacctccug

SEQ ID NO: 40360 - DNA, 22 bp, Artificial Sequence
  Synthetic
tcagcagucagggatcccauat

SEQ ID NO: 40361 - DNA, 21 bp, Artificial Sequence
  Synthetic
acacgttgugcccattttcug

SEQ ID NO: 40362 - DNA, 19 bp, Artificial Sequence
  Synthetic
ctaccgccugctggaugaa

SEQ ID NO: 40363 - DNA, 21 bp, Artificial Sequence
  Synthetic
gggcugagtcaggucagagat

SEQ ID NO: 40364 - DNA, 24 bp, Artificial Sequence
  Synthetic
cgggcagagaaaucctatacagug

SEQ ID NO: 40365 - DNA, 22 bp, Artificial Sequence
  Synthetic
agaguagacaagctgugggaga

SEQ ID NO: 40366 - DNA, 21 bp, Artificial Sequence
  Synthetic
cgttggcugtatgaucgacct

SEQ ID NO: 40367 - DNA, 22 bp, Artificial Sequence
  Synthetic
ggaggtagggaugggagagtug

SEQ ID NO: 40368 - DNA, 23 bp, Artificial Sequence
  Synthetic
tctgaggttcuttgccatctgug

SEQ ID NO: 40369 - DNA, 27 bp, Artificial Sequence
  Synthetic
aaagagaaacucaaagaagagcacugt

SEQ ID NO: 40370 - DNA, 22 bp, Artificial Sequence
  Synthetic
cctggtggagaugcttttccug

SEQ ID NO: 40371 - DNA, 21 bp, Artificial Sequence
  Synthetic
cagtccctuctttgccgtuct

SEQ ID NO: 40372 - DNA, 21 bp, Artificial Sequence
  Synthetic
ggcatgaauattgcgguggga

SEQ ID NO: 40373 - DNA, 24 bp, Artificial Sequence
  Synthetic
aaaattgagggutactgguccaca

SEQ ID NO: 40374 - DNA, 20 bp, Artificial Sequence
  Synthetic
gcagtgaccgcutctgtcuc

SEQ ID NO: 40375 - DNA, 21 bp, Artificial Sequence
  Synthetic
ctaaattgcugtggccuggac

SEQ ID NO: 40376 - DNA, 20 bp, Artificial Sequence
  Synthetic
gggcaauccaagaggtcucc

SEQ ID NO: 40377 - DNA, 19 bp, Artificial Sequence
  Synthetic
ccaccugcaggaagtggut

SEQ ID NO: 40378 - DNA, 20 bp, Artificial Sequence
  Synthetic
tggaggaagagaugguggct

SEQ ID NO: 40379 - DNA, 18 bp, Artificial Sequence
  Synthetic
gtgcagcagcugagctug

SEQ ID NO: 40380 - DNA, 20 bp, Artificial Sequence
  Synthetic
catcacgcucttccctccug

SEQ ID NO: 40381 - DNA, 20 bp, Artificial Sequence
  Synthetic
cagcatccucagtgcctugt

SEQ ID NO: 40382 - DNA, 23 bp, Artificial Sequence
  Synthetic
acagugaagaaccgagacttugt

SEQ ID NO: 40383 - DNA, 24 bp, Artificial Sequence
  Synthetic
cctcatcttccutttcctgtgcug

SEQ ID NO: 40384 - DNA, 25 bp, Artificial Sequence
  Synthetic
gaagttucaaggaagtcctgauggt

SEQ ID NO: 40385 - DNA, 23 bp, Artificial Sequence
  Synthetic
gcttttaugaggaggccauagcg

SEQ ID NO: 40386 - DNA, 24 bp, Artificial Sequence
  Synthetic
tctctgatcucagagttcctgcut

SEQ ID NO: 40387 - DNA, 24 bp, Artificial Sequence
  Synthetic
gtctcgagagaaagutagcauggg

SEQ ID NO: 40388 - DNA, 23 bp, Artificial Sequence
  Synthetic
cctcaugagcctgtuggagaaag

SEQ ID NO: 40389 - DNA, 22 bp, Artificial Sequence
  Synthetic
atctgtcctcaugccctcttug

SEQ ID NO: 40390 - DNA, 21 bp, Artificial Sequence
  Synthetic
gtacaccatcucaccgtccuc

SEQ ID NO: 40391 - DNA, 27 bp, Artificial Sequence
  Synthetic
agggaatgttatugtatcctgagggua

SEQ ID NO: 40392 - DNA, 17 bp, Artificial Sequence
  Synthetic
ctgaccacccugccugt

SEQ ID NO: 40393 - DNA, 18 bp, Artificial Sequence
  Synthetic
gtgccaggagugggtuct

SEQ ID NO: 40394 - DNA, 21 bp, Artificial Sequence
  Synthetic
atgggtcuggtctctgacuga

SEQ ID NO: 40395 - DNA, 23 bp, Artificial Sequence
  Synthetic
gtgaccagugactccatactucc

SEQ ID NO: 40396 - DNA, 20 bp, Artificial Sequence
  Synthetic
aggagaacgccaaugtggug

SEQ ID NO: 40397 - DNA, 20 bp, Artificial Sequence
  Synthetic
cgggtugccctatugaggag

SEQ ID NO: 40398 - DNA, 20 bp, Artificial Sequence
  Synthetic
gcagagcagucactgagugg

SEQ ID NO: 40399 - DNA, 21 bp, Artificial Sequence
  Synthetic
gcatcactccutcgccaagut

SEQ ID NO: 40400 - DNA, 23 bp, Artificial Sequence
  Synthetic
ccaaagatgucagcatcctucgt

SEQ ID NO: 40401 - DNA, 20 bp, Artificial Sequence
  Synthetic
ctgctcuaccgtgacccauc

SEQ ID NO: 40402 - DNA, 17 bp, Artificial Sequence
  Synthetic
gtgugcgccgctcttug

SEQ ID NO: 40403 - DNA, 17 bp, Artificial Sequence
  Synthetic
ccugccccacccugaag

SEQ ID NO: 40404 - DNA, 22 bp, Artificial Sequence
  Synthetic
atttgtgtguccccctcttgut

SEQ ID NO: 40405 - DNA, 22 bp, Artificial Sequence
  Synthetic
cctccacauaggccatttuggg

SEQ ID NO: 40406 - DNA, 24 bp, Artificial Sequence
  Synthetic
cugggagauagagaggaagattuc

SEQ ID NO: 40407 - DNA, 24 bp, Artificial Sequence
  Synthetic
tgaggguttcttggauaggaggac

SEQ ID NO: 40408 - DNA, 22 bp, Artificial Sequence
  Synthetic
ctagccacauggtcagggttut

SEQ ID NO: 40409 - DNA, 23 bp, Artificial Sequence
  Synthetic
gccttctcuatcgtccatuccca

SEQ ID NO: 40410 - DNA, 20 bp, Artificial Sequence
  Synthetic
cctcccatcutccccttguc

SEQ ID NO: 40411 - DNA, 21 bp, Artificial Sequence
  Synthetic
ggctagautcagaggaugcca

SEQ ID NO: 40412 - DNA, 20 bp, Artificial Sequence
  Synthetic
ccagagcccugatttcuggt

SEQ ID NO: 40413 - DNA, 19 bp, Artificial Sequence
  Synthetic
ctttgccgggugtgttcug

SEQ ID NO: 40414 - DNA, 22 bp, Artificial Sequence
  Synthetic
cagcauccttcccaucagaaca

SEQ ID NO: 40415 - DNA, 23 bp, Artificial Sequence
  Synthetic
gggagauaaagggtccaaugagg

SEQ ID NO: 40416 - DNA, 23 bp, Artificial Sequence
  Synthetic
tctctgtcccugtctcctcuaat

SEQ ID NO: 40417 - DNA, 22 bp, Artificial Sequence
  Synthetic
ctgggagcuatttctucagggt

SEQ ID NO: 40418 - DNA, 23 bp, Artificial Sequence
  Synthetic
gtctcctagacuctccgatucca

SEQ ID NO: 40419 - DNA, 20 bp, Artificial Sequence
  Synthetic
gcagugccacagtggtguag

SEQ ID NO: 40420 - DNA, 22 bp, Artificial Sequence
  Synthetic
cactgcaugggcctattugaga

SEQ ID NO: 40421 - DNA, 20 bp, Artificial Sequence
  Synthetic
cgatggcuccctctcctuac

SEQ ID NO: 40422 - DNA, 21 bp, Artificial Sequence
  Synthetic
ggtgauggcttgacatuccct

SEQ ID NO: 40423 - DNA, 19 bp, Artificial Sequence
  Synthetic
gggcagcgugatctcgaug

SEQ ID NO: 40424 - DNA, 21 bp, Artificial Sequence
  Synthetic
cacctcugaccacctcaacuc

SEQ ID NO: 40425 - DNA, 21 bp, Artificial Sequence
  Synthetic
cccttucagaccatcugccaa

SEQ ID NO: 40426 - DNA, 19 bp, Artificial Sequence
  Synthetic
tgtucgcacagcccatugt

SEQ ID NO: 40427 - DNA, 20 bp, Artificial Sequence
  Synthetic
ggatacagggcguagagguc

SEQ ID NO: 40428 - DNA, 21 bp, Artificial Sequence
  Synthetic
ccccauctcctccuccaagat

SEQ ID NO: 40429 - DNA, 18 bp, Artificial Sequence
  Synthetic
cggctccuctggttgugg

SEQ ID NO: 40430 - DNA, 19 bp, Artificial Sequence
  Synthetic
gctgaggcaugggatuggg

SEQ ID NO: 40431 - DNA, 20 bp, Artificial Sequence
  Synthetic
tgggcgcacacauatucagg

SEQ ID NO: 40432 - DNA, 21 bp, Artificial Sequence
  Synthetic
gccuggaaggaaagggttgug

SEQ ID NO: 40433 - DNA, 22 bp, Artificial Sequence
  Synthetic
tgcutcttttgctugcagagga

SEQ ID NO: 40434 - DNA, 19 bp, Artificial Sequence
  Synthetic
gctggcagauggctctgua

SEQ ID NO: 40435 - DNA, 20 bp, Artificial Sequence
  Synthetic
ccacccacaucctugaagcc

SEQ ID NO: 40436 - DNA, 17 bp, Artificial Sequence
  Synthetic
gcaugggaggucgggaa

SEQ ID NO: 40437 - DNA, 18 bp, Artificial Sequence
  Synthetic
cccagcccuatccagcuc

SEQ ID NO: 40438 - DNA, 22 bp, Artificial Sequence
  Synthetic
acccugcccagaagctcttaua

SEQ ID NO: 40439 - DNA, 22 bp, Artificial Sequence
  Synthetic
ctttttguggacaagcacugca

SEQ ID NO: 40440 - DNA, 22 bp, Artificial Sequence
  Synthetic
gggcagaagugagaatgugagg

SEQ ID NO: 40441 - DNA, 22 bp, Artificial Sequence
  Synthetic
aagagtccagugcacatgugag

SEQ ID NO: 40442 - DNA, 23 bp, Artificial Sequence
  Synthetic
gguaacagagguaaagggactuc

SEQ ID NO: 40443 - DNA, 23 bp, Artificial Sequence
  Synthetic
agaagagguccactcgaaccuac

SEQ ID NO: 40444 - DNA, 22 bp, Artificial Sequence
  Synthetic
ctgtcccugactgtcattgugt

SEQ ID NO: 40445 - DNA, 20 bp, Artificial Sequence
  Synthetic
cccagatccucagccccuag

SEQ ID NO: 40446 - DNA, 23 bp, Artificial Sequence
  Synthetic
actgttcauctccccuagcacat

SEQ ID NO: 40447 - DNA, 20 bp, Artificial Sequence
  Synthetic
ccaagucacaccugaaccgt

SEQ ID NO: 40448 - DNA, 23 bp, Artificial Sequence
  Synthetic
gcaaggaugtcatugaagagcag

SEQ ID NO: 40449 - DNA, 21 bp, Artificial Sequence
  Synthetic
ggaauccccgagaagggauca

SEQ ID NO: 40450 - DNA, 17 bp, Artificial Sequence
  Synthetic
ggcgcacagucgccuat

SEQ ID NO: 40451 - DNA, 20 bp, Artificial Sequence
  Synthetic
ggagcacucgggugacaaac

SEQ ID NO: 40452 - DNA, 20 bp, Artificial Sequence
  Synthetic
cucctgggcuggaaagagag

SEQ ID NO: 40453 - DNA, 26 bp, Artificial Sequence
  Synthetic
ttgagttucaggaacatgucgaagaa

SEQ ID NO: 40454 - DNA, 22 bp, Artificial Sequence
  Synthetic
agagaatugaggctcuccaggt

SEQ ID NO: 40455 - DNA, 19 bp, Artificial Sequence
  Synthetic
cacatgcuccgacaggtug

SEQ ID NO: 40456 - DNA, 17 bp, Artificial Sequence
  Synthetic
cgcggugaccccttgua

SEQ ID NO: 40457 - DNA, 18 bp, Artificial Sequence
  Synthetic
ctcgggcuccgagatcug

SEQ ID NO: 40458 - DNA, 17 bp, Artificial Sequence
  Synthetic
ctgcgaggccucagcua

SEQ ID NO: 40459 - DNA, 17 bp, Artificial Sequence
  Synthetic
gagctcggucaccguca

SEQ ID NO: 40460 - DNA, 27 bp, Artificial Sequence
  Synthetic
gggaaauaagagagaaaggagaugaga

SEQ ID NO: 40461 - DNA, 21 bp, Artificial Sequence
  Synthetic
cuactcuaggagggaggcagt

SEQ ID NO: 40462 - DNA, 22 bp, Artificial Sequence
  Synthetic
ctgatctgugagcgctttcuct

SEQ ID NO: 40463 - DNA, 25 bp, Artificial Sequence
  Synthetic
ggaggaacccugaaattctgauagg

SEQ ID NO: 40464 - DNA, 24 bp, Artificial Sequence
  Synthetic
cgatgaggaugagaacatggtgua

SEQ ID NO: 40465 - DNA, 19 bp, Artificial Sequence
  Synthetic
ccagccaauaagccctugc

SEQ ID NO: 40466 - DNA, 24 bp, Artificial Sequence
  Synthetic
gaaaaacaguggagttucagccaa

SEQ ID NO: 40467 - DNA, 18 bp, Artificial Sequence
  Synthetic
gcctgtgauggcctggug

SEQ ID NO: 40468 - DNA, 22 bp, Artificial Sequence
  Synthetic
ggtgactggaguctgacacuca

SEQ ID NO: 40469 - DNA, 20 bp, Artificial Sequence
  Synthetic
gacgtugggaaccctccuaa

SEQ ID NO: 40470 - DNA, 27 bp, Artificial Sequence
  Synthetic
ggacacuacaacaacttcttcttugct

SEQ ID NO: 40471 - DNA, 22 bp, Artificial Sequence
  Synthetic
cttatccctucaccacccacug

SEQ ID NO: 40472 - DNA, 22 bp, Artificial Sequence
  Synthetic
catgtctucagccctgcctauc

SEQ ID NO: 40473 - DNA, 23 bp, Artificial Sequence
  Synthetic
ctgtagagcucgtattcgucacc

SEQ ID NO: 40474 - DNA, 21 bp, Artificial Sequence
  Synthetic
gtctgaaccaggucagagguc

SEQ ID NO: 40475 - DNA, 22 bp, Artificial Sequence
  Synthetic
ctgtgaguggcaagagacauca

SEQ ID NO: 40476 - DNA, 29 bp, Artificial Sequence
  Synthetic
gcaacatagcaagacutcctctctacuat

SEQ ID NO: 40477 - DNA, 22 bp, Artificial Sequence
  Synthetic
cccactgucctcccatuaacac

SEQ ID NO: 40478 - DNA, 21 bp, Artificial Sequence
  Synthetic
ccagcuggtgattgttuccgt

SEQ ID NO: 40479 - DNA, 23 bp, Artificial Sequence
  Synthetic
ccactccuccaaaattucagcag

SEQ ID NO: 40480 - DNA, 21 bp, Artificial Sequence
  Synthetic
ggtggtctccuctgctctcut

SEQ ID NO: 40481 - DNA, 20 bp, Artificial Sequence
  Synthetic
ggttgatgauctggcctugc

SEQ ID NO: 40482 - DNA, 21 bp, Artificial Sequence
  Synthetic
tctcctctcuggtcccaacug

SEQ ID NO: 40483 - DNA, 21 bp, Artificial Sequence
  Synthetic
ccttuggcccaaacacaggua

SEQ ID NO: 40484 - DNA, 20 bp, Artificial Sequence
  Synthetic
gtactgcccacucggcuaac

SEQ ID NO: 40485 - DNA, 20 bp, Artificial Sequence
  Synthetic
caagguacagggcatgcauc

SEQ ID NO: 40486 - DNA, 19 bp, Artificial Sequence
  Synthetic
ttcgcugccacactugagt

SEQ ID NO: 40487 - DNA, 20 bp, Artificial Sequence
  Synthetic
gcaggaagguggcaggatug

SEQ ID NO: 40488 - DNA, 23 bp, Artificial Sequence
  Synthetic
ccactccuccttccctagtucat

SEQ ID NO: 40489 - DNA, 28 bp, Artificial Sequence
  Synthetic
cctgtttatcccaguaattgacctcauc

SEQ ID NO: 40490 - DNA, 17 bp, Artificial Sequence
  Synthetic
gcccacugccccatguc

SEQ ID NO: 40491 - DNA, 18 bp, Artificial Sequence
  Synthetic
gtgggcugagcaggtcuc

SEQ ID NO: 40492 - DNA, 20 bp, Artificial Sequence
  Synthetic
gcuggagcgaaaggatuggg

SEQ ID NO: 40493 - DNA, 21 bp, Artificial Sequence
  Synthetic
ccacccgutttgaaccucagt

SEQ ID NO: 40494 - DNA, 27 bp, Artificial Sequence
  Synthetic
acagtgagaautagctgttuacacaca

SEQ ID NO: 40495 - DNA, 22 bp, Artificial Sequence
  Synthetic
gtttctctgacgucccccauag

SEQ ID NO: 40496 - DNA, 21 bp, Artificial Sequence
  Synthetic
cttctugagaagcctggcuca

SEQ ID NO: 40497 - DNA, 24 bp, Artificial Sequence
  Synthetic
tgacgaaguatgggcttuggaaat

SEQ ID NO: 40498 - DNA, 19 bp, Artificial Sequence
  Synthetic
ccggcuacaaggaccctuc

SEQ ID NO: 40499 - DNA, 17 bp, Artificial Sequence
  Synthetic
gcgctcccugaacccua

SEQ ID NO: 40500 - DNA, 19 bp, Artificial Sequence
  Synthetic
ccgcaaaugcgcagcuaag

SEQ ID NO: 40501 - DNA, 21 bp, Artificial Sequence
  Synthetic
acctgtcccutctctcuccag

SEQ ID NO: 40502 - DNA, 22 bp, Artificial Sequence
  Synthetic
cttccctccuccaggtgtcuat

SEQ ID NO: 40503 - DNA, 20 bp, Artificial Sequence
  Synthetic
cggacucaccgtcctuacct

SEQ ID NO: 40504 - DNA, 18 bp, Artificial Sequence
  Synthetic
tggttguccgtgcggaug

SEQ ID NO: 40505 - DNA, 21 bp, Artificial Sequence
  Synthetic
gautcctagccuggaaccagt

SEQ ID NO: 40506 - DNA, 24 bp, Artificial Sequence
  Synthetic
caagactgatccugcaactccaut

SEQ ID NO: 40507 - DNA, 21 bp, Artificial Sequence
  Synthetic
ctcacatcugtgtgtctugcg

SEQ ID NO: 40508 - DNA, 22 bp, Artificial Sequence
  Synthetic
caccaagucgaagttgcatgug

SEQ ID NO: 40509 - DNA, 21 bp, Artificial Sequence
  Synthetic
agacttcatucagcggtugct

SEQ ID NO: 40510 - DNA, 22 bp, Artificial Sequence
  Synthetic
ggcgtcugcccatagaacatut

SEQ ID NO: 40511 - DNA, 21 bp, Artificial Sequence
  Synthetic
gctctgcuccttttgguccag

SEQ ID NO: 40512 - DNA, 22 bp, Artificial Sequence
  Synthetic
ccagggaacaagcutgctaucc

SEQ ID NO: 40513 - DNA, 21 bp, Artificial Sequence
  Synthetic
cuaccaaccacccaugacgaa

SEQ ID NO: 40514 - DNA, 18 bp, Artificial Sequence
  Synthetic
tcaccucgcccctctuca

SEQ ID NO: 40515 - DNA, 17 bp, Artificial Sequence
  Synthetic
gugcagaagcgggugga

SEQ ID NO: 40516 - DNA, 22 bp, Artificial Sequence
  Synthetic
tcagaatcucgaagtcguccct

SEQ ID NO: 40517 - DNA, 25 bp, Artificial Sequence
  Synthetic
agaacctuacacggtgtttatgugg

SEQ ID NO: 40518 - DNA, 17 bp, Artificial Sequence
  Synthetic
cccgaggguaggcacuc

SEQ ID NO: 40519 - DNA, 17 bp, Artificial Sequence
  Synthetic
gccatggugctgccugt

SEQ ID NO: 40520 - DNA, 22 bp, Artificial Sequence
  Synthetic
atggcaaccaggauggaatuct

SEQ ID NO: 40521 - DNA, 20 bp, Artificial Sequence
  Synthetic
ctcacgggcauagacgtcug

SEQ ID NO: 40522 - DNA, 20 bp, Artificial Sequence
  Synthetic
acccccauctccgctctuat

SEQ ID NO: 40523 - DNA, 23 bp, Artificial Sequence
  Synthetic
gtaggaauctgagaugcccagag

SEQ ID NO: 40524 - DNA, 20 bp, Artificial Sequence
  Synthetic
cagagucccctttgccugag

SEQ ID NO: 40525 - DNA, 21 bp, Artificial Sequence
  Synthetic
gcaccaugggagaaagguagg

SEQ ID NO: 40526 - DNA, 25 bp, Artificial Sequence
  Synthetic
gtgcctggaaguttcagatcttgua

SEQ ID NO: 40527 - DNA, 19 bp, Artificial Sequence
  Synthetic
cugtgagctgucccaggag

SEQ ID NO: 40528 - DNA, 23 bp, Artificial Sequence
  Synthetic
gaggagacacagcuggatcttuc

SEQ ID NO: 40529 - DNA, 22 bp, Artificial Sequence
  Synthetic
gacagtcagaauccagcacuct

SEQ ID NO: 40530 - DNA, 25 bp, Artificial Sequence
  Synthetic
gggtagggauttagatacucacacc

SEQ ID NO: 40531 - DNA, 18 bp, Artificial Sequence
  Synthetic
gcgugagggacgucacac

SEQ ID NO: 40532 - DNA, 23 bp, Artificial Sequence
  Synthetic
cagtgtcccuaagaagagaccug

SEQ ID NO: 40533 - DNA, 20 bp, Artificial Sequence
  Synthetic
cctcccucgaagcggacaua

SEQ ID NO: 40534 - DNA, 18 bp, Artificial Sequence
  Synthetic
cttccuccctcccuccca

SEQ ID NO: 40535 - DNA, 18 bp, Artificial Sequence
  Synthetic
catgacgcagugggcuca

SEQ ID NO: 40536 - DNA, 17 bp, Artificial Sequence
  Synthetic
agcagcugcaggaccuc

SEQ ID NO: 40537 - DNA, 19 bp, Artificial Sequence
  Synthetic
gcttcucccctccaugacc

SEQ ID NO: 40538 - DNA, 17 bp, Artificial Sequence
  Synthetic
gggccuggtcgcugaac

SEQ ID NO: 40539 - DNA, 18 bp, Artificial Sequence
  Synthetic
cctggguctggcccauac

SEQ ID NO: 40540 - DNA, 24 bp, Artificial Sequence
  Synthetic
cttctcctcaccuaacccatcauc

SEQ ID NO: 40541 - DNA, 21 bp, Artificial Sequence
  Synthetic
cttggacacacgcagucatuc

SEQ ID NO: 40542 - DNA, 18 bp, Artificial Sequence
  Synthetic
gcugtgagaugcggcact

SEQ ID NO: 40543 - DNA, 22 bp, Artificial Sequence
  Synthetic
cccagagcutaaaccgaaugga

SEQ ID NO: 40544 - DNA, 23 bp, Artificial Sequence
  Synthetic
gggcttcucttctctgtcuacca

SEQ ID NO: 40545 - DNA, 23 bp, Artificial Sequence
  Synthetic
cagcugaaccagaucaaaaaccc

SEQ ID NO: 40546 - DNA, 28 bp, Artificial Sequence
  Synthetic
tctactatcaucacacaaactaguccca

SEQ ID NO: 40547 - DNA, 28 bp, Artificial Sequence
  Synthetic
ctctcaagtcugacaattgttttuccag

SEQ ID NO: 40548 - DNA, 25 bp, Artificial Sequence
  Synthetic
ctagggagaaguagatcctagcuca

SEQ ID NO: 40549 - DNA, 24 bp, Artificial Sequence
  Synthetic
caaagtgcaccuctgactcctaut

SEQ ID NO: 40550 - DNA, 24 bp, Artificial Sequence
  Synthetic
agaaaaacagaagcuggcagctua

SEQ ID NO: 40551 - DNA, 22 bp, Artificial Sequence
  Synthetic
aataaactgcucacccgtcucc

SEQ ID NO: 40552 - DNA, 24 bp, Artificial Sequence
  Synthetic
aagggaatgguggctttgttttua

SEQ ID NO: 40553 - DNA, 25 bp, Artificial Sequence
  Synthetic
accaaggtgguctttgctttctuag

SEQ ID NO: 40554 - DNA, 23 bp, Artificial Sequence
  Synthetic
ctgcttcuggtttccatugcaag

SEQ ID NO: 40555 - DNA, 26 bp, Artificial Sequence
  Synthetic
tggtcgtgtcugctcttcttttauag

SEQ ID NO: 40556 - DNA, 24 bp, Artificial Sequence
  Synthetic
gacacatgcacutaaaagcauccc

SEQ ID NO: 40557 - DNA, 22 bp, Artificial Sequence
  Synthetic
gtaagtgguagttggcctugga

SEQ ID NO: 40558 - DNA, 21 bp, Artificial Sequence
  Synthetic
gttgaagugggatcccuccaa

SEQ ID NO: 40559 - DNA, 25 bp, Artificial Sequence
  Synthetic
gcttcacaaguccttcagttcttut

SEQ ID NO: 40560 - DNA, 19 bp, Artificial Sequence
  Synthetic
gtcuggagacagccagguc

SEQ ID NO: 40561 - DNA, 25 bp, Artificial Sequence
  Synthetic
ccccttttcgcugttcctgatatut

SEQ ID NO: 40562 - DNA, 27 bp, Artificial Sequence
  Synthetic
auttttaaatcucacagggacagagct

SEQ ID NO: 40563 - DNA, 24 bp, Artificial Sequence
  Synthetic
cctgagcugagaaggctttucaat

SEQ ID NO: 40564 - DNA, 21 bp, Artificial Sequence
  Synthetic
ccacacgcucgtcttctguaa

SEQ ID NO: 40565 - DNA, 23 bp, Artificial Sequence
  Synthetic
cccctccutttcttgtugaccag

SEQ ID NO: 40566 - DNA, 29 bp, Artificial Sequence
  Synthetic
agctgaguacagaaaaatuagacaaaggg

SEQ ID NO: 40567 - DNA, 27 bp, Artificial Sequence
  Synthetic
ctcttagtgacuccaggatcttttugg

SEQ ID NO: 40568 - DNA, 29 bp, Artificial Sequence
  Synthetic
aaaagaggcauagtcacaataaagucagt

SEQ ID NO: 40569 - DNA, 22 bp, Artificial Sequence
  Synthetic
tgacacgcccutctctgtttut

SEQ ID NO: 40570 - DNA, 26 bp, Artificial Sequence
  Synthetic
gccaaagccauagtagtagtcaucac

SEQ ID NO: 40571 - DNA, 30 bp, Artificial Sequence; identical to SEQ ID NO: 28337
  Synthetic

SEQ ID NO: 40572 - DNA, 21 bp, Artificial Sequence
  Synthetic
cctcctucccgagtagucact

SEQ ID NO: 40573 - DNA, 24 bp, Artificial Sequence
  Synthetic
cgacgagtgugacacatactucaa

SEQ ID NO: 40574 - DNA, 20 bp, Artificial Sequence
  Synthetic
ggagaagggcucctacctug

SEQ ID NO: 40575 - DNA, 25 bp, Artificial Sequence
  Synthetic
ctccaaucggcggagtatatuagag

SEQ ID NO: 40576 - DNA, 22 bp, Artificial Sequence
  Synthetic
gaaatuggacagccugacacac

SEQ ID NO: 40577 - DNA, 21 bp, Artificial Sequence
  Synthetic
agaacucccacugaggaacct

SEQ ID NO: 40578 - DNA, 19 bp, Artificial Sequence
  Synthetic
gauggtacccuggcccaac

SEQ ID NO: 40579 - DNA, 18 bp, Artificial Sequence
  Synthetic
cctgaggcuccctgcuca

SEQ ID NO: 40580 - DNA, 22 bp, Artificial Sequence
  Synthetic
gggttggautagctcugcagat

SEQ ID NO: 40581 - DNA, 24 bp, Artificial Sequence
  Synthetic
tgttctttccutcttctgcctugg

SEQ ID NO: 40582 - DNA, 22 bp, Artificial Sequence
  Synthetic
ggattgagtuccaggctgtucc

SEQ ID NO: 40583 - DNA, 25 bp, Artificial Sequence
  Synthetic
agttcagaccuccgaatagguagac

SEQ ID NO: 40584 - DNA, 22 bp, Artificial Sequence
  Synthetic
cccctcacutacagcctctuct

SEQ ID NO: 40585 - DNA, 19 bp, Artificial Sequence
  Synthetic
ggtgcccacuccaaggauc

SEQ ID NO: 40586 - DNA, 22 bp, Artificial Sequence
  Synthetic
ggagtagtgagugcccgaagua

SEQ ID NO: 40587 - DNA, 22 bp, Artificial Sequence
  Synthetic
cagauctgccugacaaacacca

SEQ ID NO: 40588 - DNA, 18 bp, Artificial Sequence
  Synthetic
gggagggugagctgguca

SEQ ID NO: 40589 - DNA, 19 bp, Artificial Sequence
  Synthetic
tgtccccugccaacucaga

SEQ ID NO: 40590 - DNA, 23 bp, Artificial Sequence
  Synthetic
ctgtcaccugaggtggtgaatua

SEQ ID NO: 40591 - DNA, 21 bp, Artificial Sequence
  Synthetic
gugggaccacctuaccaagac

SEQ ID NO: 40592 - DNA, 25 bp, Artificial Sequence
  Synthetic
ccctaaacaacgutctatcuggcaa

SEQ ID NO: 40593 - DNA, 21 bp, Artificial Sequence
  Synthetic
gccagcacucagacacacuaa

SEQ ID NO: 40594 - DNA, 21 bp, Artificial Sequence
  Synthetic
ttgactgggacuccctctcut

SEQ ID NO: 40595 - DNA, 20 bp, Artificial Sequence
  Synthetic
tgccttttcuggccttcugg

SEQ ID NO: 40596 - DNA, 18 bp, Artificial Sequence
  Synthetic
gggccttuagcccaaguc

SEQ ID NO: 40597 - DNA, 18 bp, Artificial Sequence
  Synthetic
gtcgtguggctgcaggua

SEQ ID NO: 40598 - DNA, 22 bp, Artificial Sequence
  Synthetic
cagtggaaagccucgtacucaa

SEQ ID NO: 40599 - DNA, 22 bp, Artificial Sequence
  Synthetic
aatgagatuaaggcccgctcug

SEQ ID NO: 40600 - DNA, 20 bp, Artificial Sequence
  Synthetic
cagcugggccgagttctuaa

SEQ ID NO: 40601 - DNA, 17 bp, Artificial Sequence
  Synthetic
gagcugcggatctugcg

SEQ ID NO: 40602 - DNA, 21 bp, Artificial Sequence
  Synthetic
gcttugaaagcccctccatuc

SEQ ID NO: 40603 - DNA, 20 bp, Artificial Sequence
  Synthetic
caucacaccccacgaguaca

SEQ ID NO: 40604 - DNA, 20 bp, Artificial Sequence
  Synthetic
cgggaagcugtcctttuggg

SEQ ID NO: 40605 - DNA, 18 bp, Artificial Sequence
  Synthetic
gggccaccaaugccaaug

SEQ ID NO: 40606 - DNA, 20 bp, Artificial Sequence
  Synthetic
cctctgcuttggccaaucct

SEQ ID NO: 40607 - DNA, 24 bp, Artificial Sequence
  Synthetic
cgctgttctcuttggtgtcatuca

SEQ ID NO: 40608 - DNA, 27 bp, Artificial Sequence
  Synthetic
tctagagatttcacugtgtctgcatug

SEQ ID NO: 40609 - DNA, 21 bp, Artificial Sequence
  Synthetic
ggccaccuccgttgtgaauaa

SEQ ID NO: 40610 - DNA, 24 bp, Artificial Sequence
  Synthetic
gccaggattuccttgggaaagaut

SEQ ID NO: 40611 - DNA, 26 bp, Artificial Sequence
  Synthetic
atccataugcagattgattctuggct

SEQ ID NO: 40612 - DNA, 20 bp, Artificial Sequence
  Synthetic
gtccgcucgtggatcugaag

SEQ ID NO: 40613 - DNA, 19 bp, Artificial Sequence
  Synthetic
ccgccgaccuatgucaagg

SEQ ID NO: 40614 - DNA, 22 bp, Artificial Sequence
  Synthetic
tgcttcaagucatactcuccgt

SEQ ID NO: 40615 - DNA, 25 bp, Artificial Sequence
  Synthetic
gatatccuggaaaccacatcctucc

SEQ ID NO: 40616 - DNA, 21 bp, Artificial Sequence
  Synthetic
tctccacggaaccgutttcuc

SEQ ID NO: 40617 - DNA, 24 bp, Artificial Sequence
  Synthetic
cgctatcugccatgatgatgucat

SEQ ID NO: 40618 - DNA, 24 bp, Artificial Sequence
  Synthetic
catgtgcauccgaatatgttgcug

SEQ ID NO: 40619 - DNA, 22 bp, Artificial Sequence
  Synthetic
tcttaagcugtcagagcuccct

SEQ ID NO: 40620 - DNA, 19 bp, Artificial Sequence
  Synthetic
cuccctuggaagccaccag

SEQ ID NO: 40621 - DNA, 28 bp, Artificial Sequence
  Synthetic
ccatagaugaaccgagtctttcttuaga

SEQ ID NO: 40622 - DNA, 19 bp, Artificial Sequence
  Synthetic
gttgcccutggtggugaag

SEQ ID NO: 40623 - DNA, 18 bp, Artificial Sequence
  Synthetic
ccactguggcgcuagaca

SEQ ID NO: 40624 - DNA, 18 bp, Artificial Sequence
  Synthetic
agggatgutggcgugagg

SEQ ID NO: 40625 - DNA, 18 bp, Artificial Sequence
  Synthetic
gcagauccagcucaccga

SEQ ID NO: 40626 - DNA, 24 bp, Artificial Sequence
  Synthetic
gtcacattagugttggccacttug

SEQ ID NO: 40627 - DNA, 19 bp, Artificial Sequence
  Synthetic
caccagucccggcaguaag

SEQ ID NO: 40628 - DNA, 25 bp, Artificial Sequence
  Synthetic
gaactcagagaugctgaagaacucc

SEQ ID NO: 40629 - DNA, 26 bp, Artificial Sequence
  Synthetic
catcttttactugggcagagtcctua

SEQ ID NO: 40630 - DNA, 21 bp, Artificial Sequence
  Synthetic
gtcctccuccgagttgatgug

SEQ ID NO: 40631 - DNA, 23 bp, Artificial Sequence
  Synthetic
tcagggcucatgataaaucgcaa

SEQ ID NO: 40632 - DNA, 17 bp, Artificial Sequence
  Synthetic
cgugcgaggcgatuggt

SEQ ID NO: 40633 - DNA, 23 bp, Artificial Sequence
  Synthetic
gaaattgatgaugccctgcacug

SEQ ID NO: 40634 - DNA, 24 bp, Artificial Sequence
  Synthetic
ggctgctttutacttcactgugag

SEQ ID NO: 40635 - DNA, 22 bp, Artificial Sequence
  Synthetic
gaacaaguatgggucaccagca

SEQ ID NO: 40636 - DNA, 27 bp, Artificial Sequence
  Synthetic
gccctaatccauctgatgcttttucat

SEQ ID NO: 40637 - DNA, 29 bp, Artificial Sequence
  Synthetic
gcgactaacaaucaaagtgaaaagauaca

SEQ ID NO: 40638 - DNA, 23 bp, Artificial Sequence
  Synthetic
cgtttggctugtggtgtaatugg

SEQ ID NO: 40639 - DNA, 29 bp, Artificial Sequence
  Synthetic
cagtttctcacuacaggtacttuaaagca

SEQ ID NO: 40640 - DNA, 21 bp, Artificial Sequence
  Synthetic
cccuccaagccaaagttgaug

SEQ ID NO: 40641 - DNA, 24 bp, Artificial Sequence
  Synthetic
ttttcctgccagucctctacaaug

SEQ ID NO: 40642 - DNA, 23 bp, Artificial Sequence
  Synthetic
gagaaagguaccaagcuaacauc

SEQ ID NO: 40643 - DNA, 26 bp, Artificial Sequence
  Synthetic
cttcagcacaaaauattgcuccaaca

SEQ ID NO: 40644 - DNA, 26 bp, Artificial Sequence
  Synthetic
ggaaccacugacagtctaucacaaaa

SEQ ID NO: 40645 - DNA, 21 bp, Artificial Sequence
  Synthetic
cttccugagacgaagcctucc

SEQ ID NO: 40646 - DNA, 22 bp, Artificial Sequence
  Synthetic
catcggacucgatgtagacgut

SEQ ID NO: 40647 - DNA, 20 bp, Artificial Sequence
  Synthetic
gccctttcugaccaagcugt

SEQ ID NO: 40648 - DNA, 19 bp, Artificial Sequence
  Synthetic
gagcggccuttgctcttug

SEQ ID NO: 40649 - DNA, 17 bp, Artificial Sequence
  Synthetic
ccucagaagccggcgua

SEQ ID NO: 40650 - DNA, 21 bp, Artificial Sequence
  Synthetic
ggagcuccaccctctagucat

SEQ ID NO: 40651 - DNA, 22 bp, Artificial Sequence
  Synthetic
catagcgcuccaggttgtaguc

SEQ ID NO: 40652 - DNA, 20 bp, Artificial Sequence
  Synthetic
ccacccuaccccuggagaaa

SEQ ID NO: 40653 - DNA, 20 bp, Artificial Sequence
  Synthetic
tctgaggccutcctctuggt

SEQ ID NO: 40654 - DNA, 17 bp, Artificial Sequence
  Synthetic
cccagcucccccatuca

SEQ ID NO: 40655 - DNA, 18 bp, Artificial Sequence
  Synthetic
tctgaccccugaccccut

SEQ ID NO: 40656 - DNA, 17 bp, Artificial Sequence
  Synthetic
ggaccagccggcaucuc

SEQ ID NO: 40657 - DNA, 21 bp, Artificial Sequence
  Synthetic
cagggaaggucaggtgctuac

SEQ ID NO: 40658 - DNA, 24 bp, Artificial Sequence
  Synthetic
aagtgaggtctuctcaggctctua

SEQ ID NO: 40659 - DNA, 21 bp, Artificial Sequence
  Synthetic
gtgccaaguggtcaagatcug

SEQ ID NO: 40660 - DNA, 18 bp, Artificial Sequence
  Synthetic
gaggtcautgccgugcag

SEQ ID NO: 40661 - DNA, 20 bp, Artificial Sequence
  Synthetic
ccggaacuguacaccaacca

SEQ ID NO: 40662 - DNA, 23 bp, Artificial Sequence
  Synthetic
tgtctgtuggagaccagauggat

SEQ ID NO: 40663 - DNA, 22 bp, Artificial Sequence
  Synthetic
cgtccucattcttcuggcacag

SEQ ID NO: 40664 - DNA, 19 bp, Artificial Sequence
  Synthetic
gatctgucacccgctguct

SEQ ID NO: 40665 - DNA, 18 bp, Artificial Sequence
  Synthetic
cguggccatguggacagg

SEQ ID NO: 40666 - DNA, 19 bp, Artificial Sequence
  Synthetic
cggcauggacacgactcut

SEQ ID NO: 40667 - DNA, 20 bp, Artificial Sequence
  Synthetic
tgaattcauccgccccguag

SEQ ID NO: 40668 - DNA, 17 bp, Artificial Sequence
  Synthetic
gcuggcagcccctcauc

SEQ ID NO: 40669 - DNA, 19 bp, Artificial Sequence
  Synthetic
agaugtgcucccccaacac

SEQ ID NO: 40670 - DNA, 23 bp, Artificial Sequence
  Synthetic
acttagagggaaggutggauggt

SEQ ID NO: 40671 - DNA, 21 bp, Artificial Sequence
  Synthetic
aggtgtccutctcagcacuct

SEQ ID NO: 40672 - DNA, 24 bp, Artificial Sequence
  Synthetic
gctgtaaacagcuctgtgtttcug

SEQ ID NO: 40673 - DNA, 24 bp, Artificial Sequence
  Synthetic
ctcccgagutcaagtgattcucat

SEQ ID NO: 40674 - DNA, 25 bp, Artificial Sequence
  Synthetic
cttttcagtucagtggcatucacat

SEQ ID NO: 40675 - DNA, 29 bp, Artificial Sequence
  Synthetic
ggagaagtcauagagacagaaaguagagt

SEQ ID NO: 40676 - DNA, 17 bp, Artificial Sequence
  Synthetic
gctuccccagccuccag

SEQ ID NO: 40677 - DNA, 22 bp, Artificial Sequence
  Synthetic
cagaggucgaagaatcgctcut

SEQ ID NO: 40678 - DNA, 19 bp, Artificial Sequence
  Synthetic
cguggaccttcuggaggag

SEQ ID NO: 40679 - DNA, 19 bp, Artificial Sequence
  Synthetic
ccttgugggcaatcuggga

SEQ ID NO: 40680 - DNA, 26 bp, Artificial Sequence
  Synthetic
gaaatgaaccaaucattgagcacuga

SEQ ID NO: 40681 - DNA, 20 bp, Artificial Sequence
  Synthetic
tcctcagccuccgauaagca

SEQ ID NO: 40682 - DNA, 20 bp, Artificial Sequence
  Synthetic
gtcagggaagcugatuccca

SEQ ID NO: 40683 - DNA, 21 bp, Artificial Sequence
  Synthetic
gggagagtcuccacctctuac

SEQ ID NO: 40684 - DNA, 18 bp, Artificial Sequence
  Synthetic
gctccgcauccgtgacug

SEQ ID NO: 40685 - DNA, 18 bp, Artificial Sequence
  Synthetic
cctgctggucctgcttug

SEQ ID NO: 40686 - DNA, 19 bp, Artificial Sequence
  Synthetic
gggcuaaagggcucagagt

SEQ ID NO: 40687 - DNA, 19 bp, Artificial Sequence
  Synthetic
cgagctuccacctcgacug

SEQ ID NO: 40688 - DNA, 21 bp, Artificial Sequence
  Synthetic
gcacaggaggaagugccaaua

SEQ ID NO: 40689 - DNA, 21 bp, Artificial Sequence
  Synthetic
tcctgggcaagutctcucaga

SEQ ID NO: 40690 - DNA, 25 bp, Artificial Sequence
  Synthetic
tttagaatctcaaucgcctgctcuc

SEQ ID NO: 40691 - DNA, 29 bp, Artificial Sequence
  Synthetic
agctttctttuagaccacatatctgcuat

SEQ ID NO: 40692 - DNA, 22 bp, Artificial Sequence
  Synthetic
cgctcuccacccatctcactua

SEQ ID NO: 40693 - DNA, 25 bp, Artificial Sequence
  Synthetic
gtctacuacacaaggagcucagaga

SEQ ID NO: 40694 - DNA, 22 bp, Artificial Sequence
  Synthetic
gctgtcggacugaaactgtgut

SEQ ID NO: 40695 - DNA, 32 bp, Artificial Sequence; identical to SEQ ID NO: 28461
  Synthetic

SEQ ID NO: 40696 - DNA, 24 bp, Artificial Sequence
  Synthetic
gccctgtgautcaatgactgttut

SEQ ID NO: 40697 - DNA, 21 bp, Artificial Sequence
  Synthetic
gccaaggaaguccccaaguag

SEQ ID NO: 40698 - DNA, 20 bp, Artificial Sequence
  Synthetic
cagaggcugagcaggaaaug

SEQ ID NO: 40699 - DNA, 17 bp, Artificial Sequence
  Synthetic
agcctccucgccaguct

SEQ ID NO: 40700 - DNA, 23 bp, Artificial Sequence
  Synthetic
gcttgtaugacccaagctccuaa

SEQ ID NO: 40701 - DNA, 24 bp, Artificial Sequence
  Synthetic
ccccaatcacucagtctagtucac

SEQ ID NO: 40702 - DNA, 25 bp, Artificial Sequence
  Synthetic
tggcattgttgauatcacaggguat

SEQ ID NO: 40703 - DNA, 22 bp, Artificial Sequence
  Synthetic
gcacgggutagtaucacagagg

SEQ ID NO: 40704 - DNA, 24 bp, Artificial Sequence
  Synthetic
ctctcagctucttctctgcttuct

SEQ ID NO: 40705 - DNA, 26 bp, Artificial Sequence
  Synthetic
ctccctatggauggctctcttgauat

SEQ ID NO: 40706 - DNA, 20 bp, Artificial Sequence
  Synthetic
ccagugaggagccaucacat

SEQ ID NO: 40707 - DNA, 18 bp, Artificial Sequence
  Synthetic
ccccagaggugcugcaag

SEQ ID NO: 40708 - DNA, 19 bp, Artificial Sequence
  Synthetic
gggtuaccctgggugaaga

SEQ ID NO: 40709 - DNA, 20 bp, Artificial Sequence
  Synthetic
aggtatgugcagtgctuggg

SEQ ID NO: 40710 - DNA, 18 bp, Artificial Sequence
  Synthetic
ttcgccaucaaggtuggg

SEQ ID NO: 40711 - DNA, 19 bp, Artificial Sequence
  Synthetic
ctgtggcuccatggcucat

SEQ ID NO: 40712 - DNA, 20 bp, Artificial Sequence
  Synthetic
gggtugggccaagatcacut

SEQ ID NO: 40713 - DNA, 19 bp, Artificial Sequence
  Synthetic
ggtccccaucccactgtug

SEQ ID NO: 40714 - DNA, 17 bp, Artificial Sequence
  Synthetic
tugggaggugggagggt

SEQ ID NO: 40715 - DNA, 21 bp, Artificial Sequence
  Synthetic
cgaggctaccucacaggaaug

SEQ ID NO: 40716 - DNA, 21 bp, Artificial Sequence
  Synthetic
tccatugggaggaaagggaug

SEQ ID NO: 40717 - DNA, 18 bp, Artificial Sequence
  Synthetic
ccgacgaccucggctaug

SEQ ID NO: 40718 - DNA, 20 bp, Artificial Sequence
  Synthetic
gggctcutccattcucacac

SEQ ID NO: 40719 - DNA, 22 bp, Artificial Sequence
  Synthetic
cccaacccauggagacctauga

SEQ ID NO: 40720 - DNA, 22 bp, Artificial Sequence
  Synthetic
cccgggacaaagaaucctcuaa

SEQ ID NO: 40721 - DNA, 21 bp, Artificial Sequence
  Synthetic
actgaugccccaugaaaaccc

SEQ ID NO: 40722 - DNA, 25 bp, Artificial Sequence
  Synthetic
gtgagaccutgtctcugaagcaaat

SEQ ID NO: 40723 - DNA, 25 bp, Artificial Sequence
  Synthetic
cctgctgccautttctttcuaacag

SEQ ID NO: 40724 - DNA, 24 bp, Artificial Sequence
  Synthetic
agaatuccaggacaacatgtguca

SEQ ID NO: 40725 - DNA, 27 bp, Artificial Sequence
  Synthetic
agaatgacttuggttttcctctcucag

SEQ ID NO: 40726 - DNA, 23 bp, Artificial Sequence
  Synthetic
tgtctgcaacacugcaaaauact

SEQ ID NO: 40727 - DNA, 23 bp, Artificial Sequence
  Synthetic
gacattttgaugcaggctctucc

SEQ ID NO: 40728 - DNA, 18 bp, Artificial Sequence
  Synthetic
gtggacucaccgcacucc

SEQ ID NO: 40729 - DNA, 26 bp, Artificial Sequence
  Synthetic
atttttccaaaguaagaagucagcut

SEQ ID NO: 40730 - DNA, 17 bp, Artificial Sequence
  Synthetic
cggcuggaagcucagca

SEQ ID NO: 40731 - DNA, 18 bp, Artificial Sequence
  Synthetic
accgagccuggctcuact

SEQ ID NO: 40732 - DNA, 20 bp, Artificial Sequence
  Synthetic
catcaggcacacutgcugac

SEQ ID NO: 40733 - DNA, 22 bp, Artificial Sequence
  Synthetic
gcuccagaaaggaauccttcut

SEQ ID NO: 40734 - DNA, 23 bp, Artificial Sequence
  Synthetic
gtcatccacucatcgatgucaca

SEQ ID NO: 40735 - DNA, 22 bp, Artificial Sequence
  Synthetic
gctttutgcagacaugcacagg

SEQ ID NO: 40736 - DNA, 23 bp, Artificial Sequence
  Synthetic
aagaauaccagcccacatacugc

SEQ ID NO: 40737 - DNA, 24 bp, Artificial Sequence
  Synthetic
tgttatttcagucacctggtgcut

SEQ ID NO: 40738 - DNA, 31 bp, Artificial Sequence; identical to SEQ ID NO: 28504
  Synthetic

SEQ ID NO: 40739 - DNA, 27 bp, Artificial Sequence
  Synthetic
gtgatgctgtuggatttctctttcaut

SEQ ID NO: 40740 - DNA, 29 bp, Artificial Sequence
  Synthetic
tttgtacaatugcatagacgtguaaaacc

SEQ ID NO: 40741 - DNA, 28 bp, Artificial Sequence
  Synthetic
catgacagaugaagaaggagcagaauaa

SEQ ID NO: 40742 - DNA, 22 bp, Artificial Sequence
  Synthetic
gcgugcacacacacaattctua

SEQ ID NO: 40743 - DNA, 25 bp, Artificial Sequence
  Synthetic
ttccctttctgauatctctgccuct

SEQ ID NO: 40744 - DNA, 24 bp, Artificial Sequence
  Synthetic
ccaagatgagucaaacactuacgg

SEQ ID NO: 40745 - DNA, 25 bp, Artificial Sequence
  Synthetic
tcctctcctuctacctctcuacaga

SEQ ID NO: 40746 - DNA, 27 bp, Artificial Sequence
  Synthetic
gaattgatgctugttgcacctauaaaa

SEQ ID NO: 40747 - DNA, 21 bp, Artificial Sequence
  Synthetic
caagcuactgcgucaacacaa

SEQ ID NO: 40748 - DNA, 30 bp, Artificial Sequence; identical to SEQ ID NO: 28514
  Synthetic

SEQ ID NO: 40749 - DNA, 22 bp, Artificial Sequence
  Synthetic
cctgcccagaucttgattucct

SEQ ID NO: 40750 - DNA, 28 bp, Artificial Sequence
  Synthetic
tgctaattcctauatcctgtgctaucct

SEQ ID NO: 40751 - DNA, 31 bp, Artificial Sequence; identical to SEQ ID NO: 28517
  Synthetic

SEQ ID NO: 40752 - DNA, 23 bp, Artificial Sequence
  Synthetic
agaaattgucaagtgacguggga

SEQ ID NO: 40753 - DNA, 22 bp, Artificial Sequence
  Synthetic
gccagugcagactgtctuagag

SEQ ID NO: 40754 - DNA, 24 bp, Artificial Sequence
  Synthetic
caggtgaacuaactctcacgucag

SEQ ID NO: 40755 - DNA, 27 bp, Artificial Sequence
  Synthetic
gtgttcttugggaatttgatucgaaga

SEQ ID NO: 40756 - DNA, 23 bp, Artificial Sequence
  Synthetic
gttacattuggcctgatgctugg

SEQ ID NO: 40757 - DNA, 26 bp, Artificial Sequence
  Synthetic
gaactgatauacacctccttugccat

SEQ ID NO: 40758 - DNA, 22 bp, Artificial Sequence
  Synthetic
caaaggaugcaactucacccaa

SEQ ID NO: 40759 - DNA, 25 bp, Artificial Sequence
  Synthetic
ggaattgagtuggatgtcaggtuct

SEQ ID NO: 40760 - DNA, 23 bp, Artificial Sequence
  Synthetic
agggccctgutgtaatgctaaut

SEQ ID NO: 40761 - DNA, 23 bp, Artificial Sequence
  Synthetic
ctatttaugaccgccuggagcaa

SEQ ID NO: 40762 - DNA, 29 bp, Artificial Sequence
  Synthetic
ctgtttctccccuctctaagtaaaaaugt

SEQ ID NO: 40763 - DNA, 27 bp, Artificial Sequence
  Synthetic
tgggttgtcugttatttctgauggaat

SEQ ID NO: 40764 - DNA, 20 bp, Artificial Sequence
  Synthetic
gttttgaccgccucagctug

SEQ ID NO: 40765 - DNA, 21 bp, Artificial Sequence
  Synthetic
gtgctttcagcugtgagctug

SEQ ID NO: 40766 - DNA, 31 bp, Artificial Sequence; identical to SEQ ID NO: 28532
  Synthetic

SEQ ID NO: 40767 - DNA, 28 bp, Artificial Sequence
  Synthetic
gtcttggagacucaaagtatcttaucag

SEQ ID NO: 40768 - DNA, 21 bp, Artificial Sequence
  Synthetic
gggcccugaagcaaagaagua

SEQ ID NO: 40769 - DNA, 29 bp, Artificial Sequence
  Synthetic
gcagagaaaaauagatgagaccctugaaa

SEQ ID NO: 40770 - DNA, 21 bp, Artificial Sequence
  Synthetic
ctccgucaccactgatcctuc

SEQ ID NO: 40771 - DNA, 29 bp, Artificial Sequence
  Synthetic
gccaaataagcacutcttttcatctcaut

SEQ ID NO: 40772 - DNA, 24 bp, Artificial Sequence
  Synthetic
ggcctttttgcuccacatctttuc

SEQ ID NO: 40773 - DNA, 25 bp, Artificial Sequence
  Synthetic
catattcttctucctgctgtccugt

SEQ ID NO: 40774 - DNA, 23 bp, Artificial Sequence
  Synthetic
actattttgutttgtcccuggct

SEQ ID NO: 40775 - DNA, 21 bp, Artificial Sequence
  Synthetic
acaggaugctacccguaagga

SEQ ID NO: 40776 - DNA, 26 bp, Artificial Sequence
  Synthetic
caguttagctggatuggaaaaacaaa

SEQ ID NO: 40777 - DNA, 29 bp, Artificial Sequence
  Synthetic
cagatgataucagaaaaguccacatgaua

SEQ ID NO: 40778 - DNA, 30 bp, Artificial Sequence; identical to SEQ ID NO: 28544
  Synthetic

SEQ ID NO: 40779 - DNA, 24 bp, Artificial Sequence
  Synthetic
cggaggcaacagutgaatgaaaug

SEQ ID NO: 40780 - DNA, 29 bp, Artificial Sequence
  Synthetic
ttttattgaaactugtcatgcatctugct

SEQ ID NO: 40781 - DNA, 27 bp, Artificial Sequence
  Synthetic
gctgaagaacccugatactaagggaua

SEQ ID NO: 40782 - DNA, 22 bp, Artificial Sequence
  Synthetic
aagccagucggtaagttctguc

SEQ ID NO: 40783 - DNA, 29 bp, Artificial Sequence
  Synthetic
gaaattggctctutagcttgtgtttcuaa

SEQ ID NO: 40784 - DNA, 28 bp, Artificial Sequence
  Synthetic
tgattataaataguccacgtcaauggca

SEQ ID NO: 40785 - DNA, 26 bp, Artificial Sequence
  Synthetic
atctgcactauatgggttctttuccc

SEQ ID NO: 40786 - DNA, 26 bp, Artificial Sequence
  Synthetic
cuaataggagauaaccacagcagcag

SEQ ID NO: 40787 - DNA, 29 bp, Artificial Sequence
  Synthetic
tggcttatgcctugagaattatttaccut

SEQ ID NO: 40788 - DNA, 26 bp, Artificial Sequence
  Synthetic
aauaacctaaugggcagaaaaccaat

SEQ ID NO: 40789 - DNA, 29 bp, Artificial Sequence
  Synthetic
agataacattgcuagtatcccactugaac

SEQ ID NO: 40790 - DNA, 24 bp, Artificial Sequence
  Synthetic
gcctttcacccugcttataatcuc

SEQ ID NO: 40791 - DNA, 28 bp, Artificial Sequence
  Synthetic
aaacagaugccagtattcuacaggaaaa

SEQ ID NO: 40792 - DNA, 30 bp, Artificial Sequence; identical to SEQ ID NO: 28558
  Synthetic

SEQ ID NO: 40793 - DNA, 21 bp, Artificial Sequence
  Synthetic
tgcttttaccugcaggcgaut

SEQ ID NO: 40794 - DNA, 22 bp, Artificial Sequence
  Synthetic
actttgcaaugctgctgtctuc

SEQ ID NO: 40795 - DNA, 23 bp, Artificial Sequence
  Synthetic
caccatttgcuacctttgggaut

SEQ ID NO: 40796 - DNA, 23 bp, Artificial Sequence
  Synthetic
gaggtcaggagcautgagaagut

SEQ ID NO: 40797 - DNA, 28 bp, Artificial Sequence
  Synthetic
ggaggtttcacugttaggaagcuaaaaa

SEQ ID NO: 40798 - DNA, 22 bp, Artificial Sequence
  Synthetic
cttgctgagcuggatctgagut

SEQ ID NO: 40799 - DNA, 26 bp, Artificial Sequence
  Synthetic
gacaacagccuttgaaatttugagag

SEQ ID NO: 40800 - DNA, 27 bp, Artificial Sequence
  Synthetic
aatatgtgctcugaaaattcagtugga

SEQ ID NO: 40801 - DNA, 30 bp, Artificial Sequence; identical to SEQ ID NO: 28567
  Synthetic

SEQ ID NO: 40802 - DNA, 25 bp, Artificial Sequence
  Synthetic
tttccacctuggagtagatctucct

SEQ ID NO: 40803 - DNA, 26 bp, Artificial Sequence
  Synthetic
caagtcctauctcttgctcauggaat

SEQ ID NO: 40804 - DNA, 27 bp, Artificial Sequence
  Synthetic
tcaaacacagaautgttactggucact

SEQ ID NO: 40805 - DNA, 27 bp, Artificial Sequence
  Synthetic
gttggtggaagauaaactcagtctuct

SEQ ID NO: 40806 - DNA, 31 bp, Artificial Sequence; identical to SEQ ID NO: 28572
  Synthetic

SEQ ID NO: 40807 - DNA, 27 bp, Artificial Sequence
  Synthetic
gtaagaugcgaaaggaaatgaatguct

SEQ ID NO: 40808 - DNA, 27 bp, Artificial Sequence
  Synthetic
tgcccgtugctttacaatttauaagga

SEQ ID NO: 40809 - DNA, 31 bp, Artificial Sequence; identical to SEQ ID NO: 28575
  Synthetic

SEQ ID NO: 40810 - DNA, 27 bp, Artificial Sequence
  Synthetic
ccaatcttgccaauaatcaagttgucc

SEQ ID NO: 40811 - DNA, 27 bp, Artificial Sequence
  Synthetic
ctgactaauaatgctatccucccaaca

SEQ ID NO: 40812 - DNA, 25 bp, Artificial Sequence
  Synthetic
caatataagcugccaactgcttguc

SEQ ID NO: 40813 - DNA, 27 bp, Artificial Sequence
  Synthetic
ttgttcagcaggautacagaaaagcua

SEQ ID NO: 40814 - DNA, 28 bp, Artificial Sequence
  Synthetic
agcaaacaaaactauaggatcagggauc

SEQ ID NO: 40815 - DNA, 28 bp, Artificial Sequence
  Synthetic
tgaccctattcuaagcaaaccaaatcuc

SEQ ID NO: 40816 - DNA, 22 bp, Artificial Sequence
  Synthetic
ccatgacuccgccatctgtuag

SEQ ID NO: 40817 - DNA, 26 bp, Artificial Sequence
  Synthetic
tcagaagatacugagcatttgcugat

SEQ ID NO: 40818 - DNA, 26 bp, Artificial Sequence
  Synthetic
catgttctuaaccactatgccucaca

SEQ ID NO: 40819 - DNA, 31 bp, Artificial Sequence; identical to SEQ ID NO: 28585
  Synthetic

SEQ ID NO: 40820 - DNA, 26 bp, Artificial Sequence
  Synthetic
aggaaagagcagacugtatacaacut

SEQ ID NO: 40821 - DNA, 31 bp, Artificial Sequence; identical to SEQ ID NO: 28587
  Synthetic

SEQ ID NO: 40822 - DNA, 25 bp, Artificial Sequence
  Synthetic
aggaacaaagccutaaccaaaagua

SEQ ID NO: 40823 - DNA, 22 bp, Artificial Sequence
  Synthetic
gccagagttugcttcgagacut

SEQ ID NO: 40824 - DNA, 22 bp, Artificial Sequence
  Synthetic
caaaauccaccccagctguaaa

SEQ ID NO: 40825 - DNA, 23 bp, Artificial Sequence
  Synthetic
tgccttauaacgggtctcgttuc

SEQ ID NO: 40826 - DNA, 23 bp, Artificial Sequence
  Synthetic
ctuttgacaatgcucaaccagct

SEQ ID NO: 40827 - DNA, 25 bp, Artificial Sequence
  Synthetic
aggcttuacaaagttctcugcaaga

SEQ ID NO: 40828 - DNA, 26 bp, Artificial Sequence
  Synthetic
ggtatggagaguttggtttctgacug

SEQ ID NO: 40829 - DNA, 28 bp, Artificial Sequence
  Synthetic
agtttgctgacaauttaggaaaacaugg

SEQ ID NO: 40830 - DNA, 21 bp, Artificial Sequence
  Synthetic
ggaacatggguccttgtccut

SEQ ID NO: 40831 - DNA, 30 bp, Artificial Sequence; identical to SEQ ID NO: 28597
  Synthetic

SEQ ID NO: 40832 - DNA, 22 bp, Artificial Sequence
  Synthetic
gcagtagtugtcatctgcucca

SEQ ID NO: 40833 - DNA, 27 bp, Artificial Sequence
  Synthetic
agatcatttcttucagtctgtgggtuc

SEQ ID NO: 40834 - DNA, 27 bp, Artificial Sequence
  Synthetic
guagaatcacagauaacaaagcacgga

SEQ ID NO: 40835 - DNA, 25 bp, Artificial Sequence
  Synthetic
tttgctgtctuaggttggatgtuga

SEQ ID NO: 40836 - DNA, 22 bp, Artificial Sequence
  Synthetic
ggtggaagutcctctugagcat

SEQ ID NO: 40837 - DNA, 26 bp, Artificial Sequence
  Synthetic
tgaagtctttcuagcaatgtcugacc

SEQ ID NO: 40838 - DNA, 23 bp, Artificial Sequence
  Synthetic
gcaaagttauccagccatgctuc

SEQ ID NO: 40839 - DNA, 25 bp, Artificial Sequence
  Synthetic
caacccaggcutattctgtgatcut

SEQ ID NO: 40840 - DNA, 28 bp, Artificial Sequence
  Synthetic
tttaaagccagtugtgtgaatcttgtuc

SEQ ID NO: 40841 - DNA, 28 bp, Artificial Sequence
  Synthetic
catgtgugagaaactagctguaaaagac

SEQ ID NO: 40842 - DNA, 28 bp, Artificial Sequence
  Synthetic
tttctaguagaaagcacgcaacauaaga

SEQ ID NO: 40843 - DNA, 27 bp, Artificial Sequence
  Synthetic
tgctttcaaagaggucataataggcut

SEQ ID NO: 40844 - DNA, 23 bp, Artificial Sequence
  Synthetic
cctgaggcautcccatctugaat

SEQ ID NO: 40845 - DNA, 30 bp, Artificial Sequence; identical to SEQ ID NO: 28611
  Synthetic

SEQ ID NO: 40846 - DNA, 22 bp, Artificial Sequence
  Synthetic
gcaaugtgtccucagcagaaag

SEQ ID NO: 40847 - DNA, 29 bp, Artificial Sequence
  Synthetic
gcaaagacautaattgtguaacacccaat

SEQ ID NO: 40848 - DNA, 30 bp, Artificial Sequence; identical to SEQ ID NO: 28614
  Synthetic

SEQ ID NO: 40849 - DNA, 25 bp, Artificial Sequence
  Synthetic
ctcttccaagutttgccucaacaag

SEQ ID NO: 40850 - DNA, 25 bp, Artificial Sequence
  Synthetic
agcagtgguagtccagaaattuacc

SEQ ID NO: 40851 - DNA, 30 bp, Artificial Sequence; identical to SEQ ID NO: 28617
  Synthetic

SEQ ID NO: 40852 - DNA, 23 bp, Artificial Sequence
  Synthetic
agctggtggugaagttgatuaca

SEQ ID NO: 40853 - DNA, 29 bp, Artificial Sequence
  Synthetic
cttgctcaaggaaugcattttcttaugaa

SEQ ID NO: 40854 - DNA, 25 bp, Artificial Sequence
  Synthetic
tttactcaccagaugagaccucaga

SEQ ID NO: 40855 - DNA, 25 bp, Artificial Sequence
  Synthetic
aaacaggugcaaaaagattgtgugt

SEQ ID NO: 40856 - DNA, 23 bp, Artificial Sequence
  Synthetic
cuctacttctucccaccaaagca

SEQ ID NO: 40857 - DNA, 22 bp, Artificial Sequence
  Synthetic
ggatcactcacuttcccccuac

SEQ ID NO: 40858 - DNA, 17 bp, Artificial Sequence
  Synthetic
cacccugccctgcagua

SEQ ID NO: 40859 - DNA, 28 bp, Artificial Sequence
  Synthetic
tgcattgttuaacaggatcctcagatua

SEQ ID NO: 40860 - DNA, 27 bp, Artificial Sequence
  Synthetic
caatgaatcaccauagtacatggguct

SEQ ID NO: 40861 - DNA, 28 bp, Artificial Sequence
  Synthetic
tcagatctgctgauagccatagcataua

SEQ ID NO: 40862 - DNA, 26 bp, Artificial Sequence
  Synthetic
guatttgcctttatugcaagggaagt

SEQ ID NO: 40863 - DNA, 23 bp, Artificial Sequence
  Synthetic
gttgcuagaggcagacaaauccc

SEQ ID NO: 40864 - DNA, 30 bp, Artificial Sequence; identical to SEQ ID NO: 28630
  Synthetic

SEQ ID NO: 40865 - DNA, 22 bp, Artificial Sequence
  Synthetic
gtgaggtaaucagccaggauct

SEQ ID NO: 40866 - DNA, 22 bp, Artificial Sequence
  Synthetic
gcgaattuacgcctggattuca

SEQ ID NO: 40867 - DNA, 28 bp, Artificial Sequence
  Synthetic
attgcatcugaggatgattuaagagagg

SEQ ID NO: 40868 - DNA, 24 bp, Artificial Sequence
  Synthetic
ttgcctttuactgtcccaugaagt

SEQ ID NO: 40869 - DNA, 26 bp, Artificial Sequence
  Synthetic
aaccttcagagaggcaucaatttgua

SEQ ID NO: 40870 - DNA, 22 bp, Artificial Sequence
  Synthetic
aaccctgcaaagcugaaaccua

SEQ ID NO: 40871 - DNA, 31 bp, Artificial Sequence; identical to SEQ ID NO: 28637
  Synthetic

SEQ ID NO: 40872 - DNA, 17 bp, Artificial Sequence
  Synthetic
gccuggcgggcaaacua

SEQ ID NO: 40873 - DNA, 22 bp, Artificial Sequence
  Synthetic
ccguctctuggagaagaagcag

SEQ ID NO: 40874 - DNA, 24 bp, Artificial Sequence
  Synthetic
atttcagcacuaagaactgugcct

SEQ ID NO: 40875 - DNA, 29 bp, Artificial Sequence
  Synthetic
agatgttacagttcucacagtcttgaaug

SEQ ID NO: 40876 - DNA, 22 bp, Artificial Sequence
  Synthetic
gcagcgtguttttccggaatug

SEQ ID NO: 40877 - DNA, 25 bp, Artificial Sequence
  Synthetic
ctgcatcttugaactggaaagcuaa

SEQ ID NO: 40878 - DNA, 24 bp, Artificial Sequence
  Synthetic
gatgctgtggutcaggactatgut

SEQ ID NO: 40879 - DNA, 31 bp, Artificial Sequence; identical to SEQ ID NO: 28645
  Synthetic

SEQ ID NO: 40880 - DNA, 26 bp, Artificial Sequence
  Synthetic
tcagacaaaggaagugtccaugaaag

SEQ ID NO: 40881 - DNA, 28 bp, Artificial Sequence
  Synthetic
aggcaatguaaaacaaatgtuaaaggca

SEQ ID NO: 40882 - DNA, 26 bp, Artificial Sequence
  Synthetic
cctgttattgccutggagtttaaugg

SEQ ID NO: 40883 - DNA, 30 bp, Artificial Sequence; identical to SEQ ID NO: 28649
  Synthetic

SEQ ID NO: 40884 - DNA, 23 bp, Artificial Sequence
  Synthetic
gggcaaaaggguaattcucaagt

SEQ ID NO: 40885 - DNA, 24 bp, Artificial Sequence
  Synthetic
gttacacccuaaagccugaaacct

SEQ ID NO: 40886 - DNA, 22 bp, Artificial Sequence
  Synthetic
gaauctcacugacgaggcagag

SEQ ID NO: 40887 - DNA, 25 bp, Artificial Sequence
  Synthetic
gcagacatcaugagtactccttugg

SEQ ID NO: 40888 - DNA, 23 bp, Artificial Sequence
  Synthetic
actccuaaagacccugcaaaacc

SEQ ID NO: 40889 - DNA, 30 bp, Artificial Sequence; identical to SEQ ID NO: 28655
  Synthetic

SEQ ID NO: 40890 - DNA, 26 bp, Artificial Sequence
  Synthetic
ggttgaatcctutagccctacttuct

SEQ ID NO: 40891 - DNA, 25 bp, Artificial Sequence
  Synthetic
gaccacataugcacacatatcucca

SEQ ID NO: 40892 - DNA, 23 bp, Artificial Sequence
  Synthetic
ggucctggagcugaacaacaaat

SEQ ID NO: 40893 - DNA, 25 bp, Artificial Sequence
  Synthetic
ctggatatcugcagtacccagatug

SEQ ID NO: 40894 - DNA, 20 bp, Artificial Sequence
  Synthetic
gatctctguacggcccctuc

SEQ ID NO: 40895 - DNA, 24 bp, Artificial Sequence
  Synthetic
gttccugacacagacagacuacac

SEQ ID NO: 40896 - DNA, 18 bp, Artificial Sequence
  Synthetic
cuacgggcugggcaagat

SEQ ID NO: 40897 - DNA, 19 bp, Artificial Sequence
  Synthetic
ccatucccagccgtcagug

SEQ ID NO: 40898 - DNA, 21 bp, Artificial Sequence
  Synthetic
tcccacccugaggtacactut

SEQ ID NO: 40899 - DNA, 22 bp, Artificial Sequence
  Synthetic
tgttaatggcacuctgggaucg

SEQ ID NO: 40900 - DNA, 28 bp, Artificial Sequence
  Synthetic
aatagagaccucactatttgcaatgucc

SEQ ID NO: 40901 - DNA, 25 bp, Artificial Sequence
  Synthetic
agtacacctggugttaggagtuact

SEQ ID NO: 40902 - DNA, 20 bp, Artificial Sequence
  Synthetic
gctgtggutccacgauaggg

SEQ ID NO: 40903 - DNA, 23 bp, Artificial Sequence
  Synthetic
gcagattcugttctctacuggca

SEQ ID NO: 40904 - DNA, 27 bp, Artificial Sequence
  Synthetic
gggagtcuaagaagaattugaggaaga

SEQ ID NO: 40905 - DNA, 29 bp, Artificial Sequence
  Synthetic
gcttgttgacugagcagatataacaugag

SEQ ID NO: 40906 - DNA, 23 bp, Artificial Sequence
  Synthetic
gggtaaccauggtgaatgagtug

SEQ ID NO: 40907 - DNA, 24 bp, Artificial Sequence
  Synthetic
gtaccaggcuagtggtcagacaua

SEQ ID NO: 40908 - DNA, 26 bp, Artificial Sequence
  Synthetic
atgtagatcuaagagccagaaugcac

SEQ ID NO: 40909 - DNA, 25 bp, Artificial Sequence
  Synthetic
tccttctatuccccttttcgctuac

SEQ ID NO: 40910 - DNA, 23 bp, Artificial Sequence
  Synthetic
ggcctacacautgaggagugaag

SEQ ID NO: 40911 - DNA, 25 bp, Artificial Sequence
  Synthetic
cagaggtaacuagagagtgguaggg

SEQ ID NO: 40912 - DNA, 26 bp, Artificial Sequence
  Synthetic
acttagtactgcugttctgtgaacug

SEQ ID NO: 40913 - DNA, 27 bp, Artificial Sequence
  Synthetic
gaagaaacgauctagugcaaggaaaag

SEQ ID NO: 40914 - DNA, 23 bp, Artificial Sequence
  Synthetic
ccttggaucttcccattaugcct

SEQ ID NO: 40915 - DNA, 23 bp, Artificial Sequence
  Synthetic
tcccttcaaucttctcctugggt

SEQ ID NO: 40916 - DNA, 21 bp, Artificial Sequence
  Synthetic
agatcggugctggagtcugat

SEQ ID NO: 40917 - DNA, 23 bp, Artificial Sequence
  Synthetic
ctgttuaaggagccucaaaccca

SEQ ID NO: 40918 - DNA, 21 bp, Artificial Sequence
  Synthetic
actggtcccuttcaactgucc

SEQ ID NO: 40919 - DNA, 25 bp, Artificial Sequence
  Synthetic
cuagcagggagaagauagggaagaa

SEQ ID NO: 40920 - DNA, 22 bp, Artificial Sequence
  Synthetic
ttgcatttcucacccccgttua

SEQ ID NO: 40921 - DNA, 25 bp, Artificial Sequence
  Synthetic
tcagttatuccgaagctctgctuac

SEQ ID NO: 40922 - DNA, 24 bp, Artificial Sequence
  Synthetic
gcaggcctucttcaacactacuat

SEQ ID NO: 40923 - DNA, 21 bp, Artificial Sequence
  Synthetic
caaagctguagcggtuagcag

SEQ ID NO: 40924 - DNA, 23 bp, Artificial Sequence
  Synthetic
aggtttttccugagggcattugt

SEQ ID NO: 40925 - DNA, 20 bp, Artificial Sequence
  Synthetic
gtcacugccccacuagcaaa

SEQ ID NO: 40926 - DNA, 25 bp, Artificial Sequence
  Synthetic
gcacacacauaaacccacauacagt

SEQ ID NO: 40927 - DNA, 23 bp, Artificial Sequence
  Synthetic
ctggttcagaucagggtcactua

SEQ ID NO: 40928 - DNA, 20 bp, Artificial Sequence
  Synthetic
cctatcucccacccgugaac

SEQ ID NO: 40929 - DNA, 22 bp, Artificial Sequence
  Synthetic
gtgggaggaaggugaaacugac

SEQ ID NO: 40930 - DNA, 23 bp, Artificial Sequence
  Synthetic
cctcatgcagcucatttgctauc

SEQ ID NO: 40931 - DNA, 29 bp, Artificial Sequence
  Synthetic
tccttttctcaaggutcctattgtttcuc

SEQ ID NO: 40932 - DNA, 24 bp, Artificial Sequence
  Synthetic
ctcctaccauctgctttcctucac

SEQ ID NO: 40933 - DNA, 25 bp, Artificial Sequence
  Synthetic
tgggtccuaacatgtttctauccga

SEQ ID NO: 40934 - DNA, 30 bp, Artificial Sequence; identical to SEQ ID NO: 28700
  Synthetic

SEQ ID NO: 40935 - DNA, 23 bp, Artificial Sequence
  Synthetic
agtaacccctuaggtgcatccut

SEQ ID NO: 40936 - DNA, 26 bp, Artificial Sequence
  Synthetic
ctcagattggaacuaagctttccuga

SEQ ID NO: 40937 - DNA, 22 bp, Artificial Sequence
  Synthetic
cttggguatgaaacugcaggga

SEQ ID NO: 40938 - DNA, 26 bp, Artificial Sequence
  Synthetic
tgtatctctgaacucttgtcccauct

SEQ ID NO: 40939 - DNA, 20 bp, Artificial Sequence
  Synthetic
gggcagacaauggaacaugc

SEQ ID NO: 40940 - DNA, 21 bp, Artificial Sequence
  Synthetic
gtttggaacaguccgagugga

SEQ ID NO: 40941 - DNA, 22 bp, Artificial Sequence
  Synthetic
gctcuggagcctttttcucagg

SEQ ID NO: 40942 - DNA, 22 bp, Artificial Sequence
  Synthetic
ctacaacccacucaccctctuc

SEQ ID NO: 40943 - DNA, 22 bp, Artificial Sequence
  Synthetic
gtaggtcccuccagcattccua

SEQ ID NO: 40944 - DNA, 24 bp, Artificial Sequence
  Synthetic
tcatgggttuagaaccctcctcut

SEQ ID NO: 40945 - DNA, 23 bp, Artificial Sequence
  Synthetic
gtgaagaucccaagtgtctccuc

SEQ ID NO: 40946 - DNA, 21 bp, Artificial Sequence
  Synthetic
aagctgctcugcatactcucg

SEQ ID NO: 40947 - DNA, 20 bp, Artificial Sequence
  Synthetic
caggtggcggguaggatcua

SEQ ID NO: 40948 - DNA, 22 bp, Artificial Sequence
  Synthetic
cctgcuaacgtttcttucaggt

SEQ ID NO: 40949 - DNA, 21 bp, Artificial Sequence
  Synthetic
gtaggauggctgtugaacgga

SEQ ID NO: 40950 - DNA, 22 bp, Artificial Sequence
  Synthetic
cagcccttuagttctgaggcut

SEQ ID NO: 40951 - DNA, 20 bp, Artificial Sequence
  Synthetic
ggctgtaguccagcagcuac

SEQ ID NO: 40952 - DNA, 22 bp, Artificial Sequence
  Synthetic
attccatccccutccctcgaua

SEQ ID NO: 40953 - DNA, 25 bp, Artificial Sequence
  Synthetic
ggautgggaatuaagaggaaagggt

SEQ ID NO: 40954 - DNA, 23 bp, Artificial Sequence
  Synthetic
cctttccccuctgttttgagcut

SEQ ID NO: 40955 - DNA, 20 bp, Artificial Sequence
  Synthetic
cctccagcggaaucttcguc

SEQ ID NO: 40956 - DNA, 23 bp, Artificial Sequence
  Synthetic
gtgggagucgtaggtttagtugt

SEQ ID NO: 40957 - DNA, 26 bp, Artificial Sequence
  Synthetic
gtacatacauagtaggtggcuagcct

SEQ ID NO: 40958 - DNA, 22 bp, Artificial Sequence
  Synthetic
tgaguggcaaggaagctuaagg

SEQ ID NO: 40959 - DNA, 27 bp, Artificial Sequence
  Synthetic
ctcctcagacaaaaguagacaatcuct

SEQ ID NO: 40960 - DNA, 23 bp, Artificial Sequence
  Synthetic
ttccuctttggccucagagaaag

SEQ ID NO: 40961 - DNA, 24 bp, Artificial Sequence
  Synthetic
gcaatcugagcattcuccacagaa

SEQ ID NO: 40962 - DNA, 24 bp, Artificial Sequence
  Synthetic
ctgauacaggaagagcagauccag

SEQ ID NO: 40963 - DNA, 26 bp, Artificial Sequence
  Synthetic
tgttcctctcauaggccttaatcuca

SEQ ID NO: 40964 - DNA, 27 bp, Artificial Sequence
  Synthetic
tccaaatttucccaatcaacuggagat

SEQ ID NO: 40965 - DNA, 26 bp, Artificial Sequence
  Synthetic
ctttcttacauaccagtgttgcucac

SEQ ID NO: 40966 - DNA, 25 bp, Artificial Sequence
  Synthetic
tgatgaaaacutcctgatggugaca

SEQ ID NO: 40967 - DNA, 25 bp, Artificial Sequence
  Synthetic
gagcccacttauggtgactaagaut

SEQ ID NO: 40968 - DNA, 25 bp, Artificial Sequence
  Synthetic
caaaccttgguactccattttuccc

SEQ ID NO: 40969 - DNA, 28 bp, Artificial Sequence
  Synthetic
ccgttgacatuaacagcaagtttucaaa

SEQ ID NO: 40970 - DNA, 22 bp, Artificial Sequence
  Synthetic
gggcutggtgttuagaagaaca

SEQ ID NO: 40971 - DNA, 27 bp, Artificial Sequence
  Synthetic
gutctcctctaucacagaaaagacact

SEQ ID NO: 40972 - DNA, 22 bp, Artificial Sequence
  Synthetic
ggaatuacggcagcccttctut

SEQ ID NO: 40973 - DNA, 30 bp, Artificial Sequence; identical to SEQ ID NO: 28739
  Synthetic

SEQ ID NO: 40974 - DNA, 24 bp, Artificial Sequence
  Synthetic
ttcaggtgguggagagatgtttut

SEQ ID NO: 40975 - DNA, 28 bp, Artificial Sequence
  Synthetic
tggaagcauaagcagaattatgtauggg

SEQ ID NO: 40976 - DNA, 26 bp, Artificial Sequence
  Synthetic
ttaagauggagagcaataagctuggt

SEQ ID NO: 40977 - DNA, 27 bp, Artificial Sequence
  Synthetic
gaatgatcaagaaaucagtttcuggca

SEQ ID NO: 40978 - DNA, 29 bp, Artificial Sequence
  Synthetic
tgccaaataaaauacacttggtttgtugg

SEQ ID NO: 40979 - DNA, 27 bp, Artificial Sequence
  Synthetic
aggcagacaaauaactagucacaacag

SEQ ID NO: 40980 - DNA, 22 bp, Artificial Sequence
  Synthetic
cccactgcccugagaatcttut

SEQ ID NO: 40981 - DNA, 30 bp, Artificial Sequence; identical to SEQ ID NO: 28747
  Synthetic

SEQ ID NO: 40982 - DNA, 27 bp, Artificial Sequence
  Synthetic
ttaaggtagcagaaugacttagaugcc

SEQ ID NO: 40983 - DNA, 28 bp, Artificial Sequence
  Synthetic
actctaaatttuccacttccacacucac

SEQ ID NO: 40984 - DNA, 23 bp, Artificial Sequence
  Synthetic
ggatcaaggutttctgtggcuga

SEQ ID NO: 40985 - DNA, 29 bp, Artificial Sequence
  Synthetic
gtcaaacttttaggugacctcctcttuat

SEQ ID NO: 40986 - DNA, 25 bp, Artificial Sequence
  Synthetic
gctcagcugaagatagtgacttuga

SEQ ID NO: 40987 - DNA, 23 bp, Artificial Sequence
  Synthetic
tgcagttacguaggctcctttut

SEQ ID NO: 40988 - DNA, 21 bp, Artificial Sequence
  Synthetic
tgatgacacagcutccgugac

SEQ ID NO: 40989 - DNA, 24 bp, Artificial Sequence
  Synthetic
agagcaagacuctgtccucaaaga

SEQ ID NO: 40990 - DNA, 28 bp, Artificial Sequence
  Synthetic
ctgcatatacugagggatgactttatut

SEQ ID NO: 40991 - DNA, 23 bp, Artificial Sequence
  Synthetic
gaaggtggcgcauttgtttgaua

SEQ ID NO: 40992 - DNA, 23 bp, Artificial Sequence
  Synthetic
tcccccugggaactagaaauagg

SEQ ID NO: 40993 - DNA, 24 bp, Artificial Sequence
  Synthetic
agaaggaagcaaugcacatacuca

SEQ ID NO: 40994 - DNA, 24 bp, Artificial Sequence
  Synthetic
agtgttgauagccaggtagauagg

SEQ ID NO: 40995 - DNA, 26 bp, Artificial Sequence
  Synthetic
attggccgagugatgattttgtagua

SEQ ID NO: 40996 - DNA, 28 bp, Artificial Sequence
  Synthetic
tgcattaaaaggauaaagaagtgtuggc

SEQ ID NO: 40997 - DNA, 26 bp, Artificial Sequence
  Synthetic
ttccactgccuttctctcattcuaac

SEQ ID NO: 40998 - DNA, 27 bp, Artificial Sequence
  Synthetic
gaatatttguaacccaacaaagguggt

SEQ ID NO: 40999 - DNA, 28 bp, Artificial Sequence
  Synthetic
cacacacagucacttgatuacaaaaagg

SEQ ID NO: 41000 - DNA, 27 bp, Artificial Sequence
  Synthetic
ttttctagguctaggataaugggacac

SEQ ID NO: 41001 - DNA, 24 bp, Artificial Sequence
  Synthetic
aggacctccauctttaccaccuac

SEQ ID NO: 41002 - DNA, 24 bp, Artificial Sequence
  Synthetic
gtactgcuaaagaagcagcttugg

SEQ ID NO: 41003 - DNA, 28 bp, Artificial Sequence
  Synthetic
agagaagaauggtatctcaguaaacgga

SEQ ID NO: 41004 - DNA, 28 bp, Artificial Sequence
  Synthetic
cttatgtggtcagutgataggacttuga

SEQ ID NO: 41005 - DNA, 22 bp, Artificial Sequence
  Synthetic
agaagcaatggutgaggccuac

SEQ ID NO: 41006 - DNA, 23 bp, Artificial Sequence
  Synthetic
gctucaggagaacacaaggaugg

SEQ ID NO: 41007 - DNA, 21 bp, Artificial Sequence
  Synthetic
gttgggccccucaacatcaua

SEQ ID NO: 41008 - DNA, 22 bp, Artificial Sequence
  Synthetic
catcggtggguatgaggtauca

SEQ ID NO: 41009 - DNA, 22 bp, Artificial Sequence
  Synthetic
cccaaaggaagccucattcauc

SEQ ID NO: 41010 - DNA, 27 bp, Artificial Sequence
  Synthetic
agaaguagaaccaagaagcttatuggc

SEQ ID NO: 41011 - DNA, 26 bp, Artificial Sequence
  Synthetic
aacatttgctgcutactcattgcaut

SEQ ID NO: 41012 - DNA, 21 bp, Artificial Sequence
  Synthetic
ctgtagagacguaggcctugg

SEQ ID NO: 41013 - DNA, 22 bp, Artificial Sequence
  Synthetic
ggaagacuaggacccctgcuat

SEQ ID NO: 41014 - DNA, 30 bp, Artificial Sequence; identical to SEQ ID NO: 28780
  Synthetic

SEQ ID NO: 41015 - DNA, 23 bp, Artificial Sequence
  Synthetic
tcactggtcuctgtttgcacuac

SEQ ID NO: 41016 - DNA, 23 bp, Artificial Sequence
  Synthetic
atctcccucaggtagtucaggag

SEQ ID NO: 41017 - DNA, 23 bp, Artificial Sequence
  Synthetic
ccccagccccuttattgctatua

SEQ ID NO: 41018 - DNA, 25 bp, Artificial Sequence
  Synthetic
attcatcttcagacauggagcctuc

SEQ ID NO: 41019 - DNA, 28 bp, Artificial Sequence
  Synthetic
ccaaagaaucacaccaagactttatugt

SEQ ID NO: 41020 - DNA, 24 bp, Artificial Sequence
  Synthetic
cctcttatcaccutgtcctgcaut

SEQ ID NO: 41021 - DNA, 27 bp, Artificial Sequence
  Synthetic
gttactgacuaagcatccacttctuca

SEQ ID NO: 41022 - DNA, 21 bp, Artificial Sequence
  Synthetic
cagaacaggcccucagtucaa

SEQ ID NO: 41023 - DNA, 24 bp, Artificial Sequence
  Synthetic
ctccaauctgcttaugaccaggag

SEQ ID NO: 41024 - DNA, 22 bp, Artificial Sequence
  Synthetic
gaggatgcugatcacgggaaut

SEQ ID NO: 41025 - DNA, 23 bp, Artificial Sequence
  Synthetic
caaatgauctacagcugcggaag

SEQ ID NO: 41026 - DNA, 22 bp, Artificial Sequence
  Synthetic
actgccaagucccagggtaaut

SEQ ID NO: 41027 - DNA, 23 bp, Artificial Sequence
  Synthetic
atcactggcutcttgtttugcag

SEQ ID NO: 41028 - DNA, 28 bp, Artificial Sequence
  Synthetic
ctcgtttctctcutccttctttccttut

SEQ ID NO: 41029 - DNA, 23 bp, Artificial Sequence
  Synthetic
aagtcugtgttttcaucgaccca

SEQ ID NO: 41030 - DNA, 22 bp, Artificial Sequence
  Synthetic
gttgcacagcaucaccagtcua

SEQ ID NO: 41031 - DNA, 30 bp, Artificial Sequence; identical to SEQ ID NO: 28797
  Synthetic

SEQ ID NO: 41032 - DNA, 21 bp, Artificial Sequence
  Synthetic
agagtttgugcacggucaaga

SEQ ID NO: 41033 - DNA, 28 bp, Artificial Sequence
  Synthetic
ggtccucaggaactttcattaucaacag

SEQ ID NO: 41034 - DNA, 22 bp, Artificial Sequence
  Synthetic
gcutcctttucacagggaggag

SEQ ID NO: 41035 - DNA, 23 bp, Artificial Sequence
  Synthetic
ctaagcaaccacacuttctuggt

SEQ ID NO: 41036 - DNA, 23 bp, Artificial Sequence
  Synthetic
gggtcctgautgatggcaatuac

SEQ ID NO: 41037 - DNA, 29 bp, Artificial Sequence
  Synthetic
agaatgtttcctccuctcttgtttgaaut

SEQ ID NO: 41038 - DNA, 25 bp, Artificial Sequence
  Synthetic
gtccagcaacaucaacaattctcuc

SEQ ID NO: 41039 - DNA, 28 bp, Artificial Sequence
  Synthetic
cctcctttaaacugttttcatcucacaa

SEQ ID NO: 41040 - DNA, 31 bp, Artificial Sequence; identical to SEQ ID NO: 28806
  Synthetic

SEQ ID NO: 41041 - DNA, 22 bp, Artificial Sequence
  Synthetic
gacattgaugcccagaccttug

SEQ ID NO: 41042 - DNA, 22 bp, Artificial Sequence
  Synthetic
ggccaugagggctgtttcuaaa

SEQ ID NO: 41043 - DNA, 24 bp, Artificial Sequence
  Synthetic
gcaggttatgaguacctctgcaut

SEQ ID NO: 41044 - DNA, 24 bp, Artificial Sequence
  Synthetic
gggaagggaguacccaatatcuga

SEQ ID NO: 41045 - DNA, 21 bp, Artificial Sequence
  Synthetic
tgacaaugcagcugaggaacc

SEQ ID NO: 41046 - DNA, 18 bp, Artificial Sequence
  Synthetic
guggatcaguggcccaga

SEQ ID NO: 41047 - DNA, 23 bp, Artificial Sequence
  Synthetic
actcgcttggugattccatguaa

SEQ ID NO: 41048 - DNA, 27 bp, Artificial Sequence
  Synthetic
cttaatgtgcugttgagttagaaugga

SEQ ID NO: 41049 - DNA, 24 bp, Artificial Sequence
  Synthetic
tccttttctctugctttgggcuag

SEQ ID NO: 41050 - DNA, 25 bp, Artificial Sequence
  Synthetic
tcatgcauagatgtttuccacacca

SEQ ID NO: 41051 - DNA, 27 bp, Artificial Sequence
  Synthetic
caatcagtgttuctgctttctccauag

SEQ ID NO: 41052 - DNA, 27 bp, Artificial Sequence
  Synthetic
agtttgatggctuctgtgatatcagug

SEQ ID NO: 41053 - DNA, 24 bp, Artificial Sequence
  Synthetic
cccaactgguctgtcaacguaaaa

SEQ ID NO: 41054 - DNA, 27 bp, Artificial Sequence
  Synthetic
tcaaagcaaccgaagaaugtaaccaua

SEQ ID NO: 41055 - DNA, 25 bp, Artificial Sequence
  Synthetic
atctctgtcugacaacatcaaccug

SEQ ID NO: 41056 - DNA, 22 bp, Artificial Sequence
  Synthetic
cattacucagtgccugcaaggt

SEQ ID NO: 41057 - DNA, 25 bp, Artificial Sequence
  Synthetic
ccctttttgttuttgcctctctuca

SEQ ID NO: 41058 - DNA, 27 bp, Artificial Sequence
  Synthetic
acattaaaacuggcatctgtttccuca

SEQ ID NO: 41059 - DNA, 25 bp, Artificial Sequence
  Synthetic
gaaaacacucccccttcatagucat

SEQ ID NO: 41060 - DNA, 21 bp, Artificial Sequence
  Synthetic
gggtcagautctcagcuccca

SEQ ID NO: 41061 - DNA, 17 bp, Artificial Sequence
  Synthetic
ctcuccggcggauacgg

SEQ ID NO: 41062 - DNA, 22 bp, Artificial Sequence
  Synthetic
tccgaaggagacccutgacuag

SEQ ID NO: 41063 - DNA, 21 bp, Artificial Sequence
  Synthetic
tggcutcaguaggaggacagt

SEQ ID NO: 41064 - DNA, 29 bp, Artificial Sequence
  Synthetic
tgactgagagaagcagutatttagtuagg

SEQ ID NO: 41065 - DNA, 28 bp, Artificial Sequence
  Synthetic
cccaaaaggugtcttaaatgtagugagt

SEQ ID NO: 41066 - DNA, 20 bp, Artificial Sequence
  Synthetic
gagagcgccgcuttgaaauc

SEQ ID NO: 41067 - DNA, 22 bp, Artificial Sequence
  Synthetic
aggtautttgccaauggccact

SEQ ID NO: 41068 - DNA, 23 bp, Artificial Sequence
  Synthetic
tcaaagcccugttaccctggaua

SEQ ID NO: 41069 - DNA, 28 bp, Artificial Sequence
  Synthetic
ggcaaatatgtttucacatgggactuac

SEQ ID NO: 41070 - DNA, 27 bp, Artificial Sequence
  Synthetic
agctctttguaccaaatacccaatcug

SEQ ID NO: 41071 - DNA, 27 bp, Artificial Sequence
  Synthetic
atgtcttaaataucaacaggccacugt

SEQ ID NO: 41072 - DNA, 22 bp, Artificial Sequence
  Synthetic
ggacaggagguagccagagaua

SEQ ID NO: 41073 - DNA, 30 bp, Artificial Sequence; identical to SEQ ID NO: 28839
  Synthetic

SEQ ID NO: 41074 - DNA, 25 bp, Artificial Sequence
  Synthetic
tggtgagtuactttggaaaugagct

SEQ ID NO: 41075 - DNA, 25 bp, Artificial Sequence
  Synthetic
agatgggaautgacaaugcaaaagg

SEQ ID NO: 41076 - DNA, 31 bp, Artificial Sequence; identical to SEQ ID NO: 28842
  Synthetic

SEQ ID NO: 41077 - DNA, 28 bp, Artificial Sequence
  Synthetic
cctcccataacuctaacaatctcatcuc

SEQ ID NO: 41078 - DNA, 25 bp, Artificial Sequence
  Synthetic
tgtaacaagagagccuaacccugat

SEQ ID NO: 41079 - DNA, 30 bp, Artificial Sequence; identical to SEQ ID NO: 28845
  Synthetic

SEQ ID NO: 41080 - DNA, 24 bp, Artificial Sequence
  Synthetic
tctccaagggagaugagcuagaag

SEQ ID NO: 41081 - DNA, 28 bp, Artificial Sequence
  Synthetic
gcagtagauagggagaucatgtatttut

SEQ ID NO: 41082 - DNA, 28 bp, Artificial Sequence
  Synthetic
ttttagaggacacutttctgttggtuct

SEQ ID NO: 41083 - DNA, 28 bp, Artificial Sequence
  Synthetic
tcttcaatcttatcutctcccgagtuca

SEQ ID NO: 41084 - DNA, 26 bp, Artificial Sequence
  Synthetic
ccaaagtctttatuctgagaccccut

SEQ ID NO: 41085 - DNA, 27 bp, Artificial Sequence
  Synthetic
ttgtagggaagguctactctcactuac

SEQ ID NO: 41086 - DNA, 23 bp, Artificial Sequence
  Synthetic
tggagctccuttcccttgactua

SEQ ID NO: 41087 - DNA, 22 bp, Artificial Sequence
  Synthetic
cacauccccaggtcaguagaac

SEQ ID NO: 41088 - DNA, 23 bp, Artificial Sequence
  Synthetic
gccctgaggutttgcttaggtua

SEQ ID NO: 41089 - DNA, 31 bp, Artificial Sequence; identical to SEQ ID NO: 28855
  Synthetic

SEQ ID NO: 41090 - DNA, 27 bp, Artificial Sequence
  Synthetic
gctaccacuaaaatgtatcttccucca

SEQ ID NO: 41091 - DNA, 21 bp, Artificial Sequence
  Synthetic
gcttcttcutcctggugcact

SEQ ID NO: 41092 - DNA, 28 bp, Artificial Sequence
  Synthetic
ccatttttagautacatttgggucagca

SEQ ID NO: 41093 - DNA, 26 bp, Artificial Sequence
  Synthetic
atgcattccuggttgttttcttucag

SEQ ID NO: 41094 - DNA, 27 bp, Artificial Sequence
  Synthetic
tggtgcaautaatggagauagaagaca

SEQ ID NO: 41095 - DNA, 23 bp, Artificial Sequence
  Synthetic
ctatagtgctutgcctggcuaca

SEQ ID NO: 41096 - DNA, 28 bp, Artificial Sequence
  Synthetic
aagtttcactctaguggtttttgaccut

SEQ ID NO: 41097 - DNA, 29 bp, Artificial Sequence
  Synthetic
cgccaatatagauctgcttattatccuga

SEQ ID NO: 41098 - DNA, 22 bp, Artificial Sequence
  Synthetic
cucaccccaauaaggcccaaat

SEQ ID NO: 41099 - DNA, 27 bp, Artificial Sequence
  Synthetic
tggagatugacaagtacuggagagaat

SEQ ID NO: 41100 - DNA, 26 bp, Artificial Sequence
  Synthetic
aacttcaggugatcagttgtgtugat

SEQ ID NO: 41101 - DNA, 22 bp, Artificial Sequence
  Synthetic
gacagcctguttccagtcauct

SEQ ID NO: 41102 - DNA, 24 bp, Artificial Sequence
  Synthetic
caaactcaaaagcutgtggaguca

SEQ ID NO: 41103 - DNA, 28 bp, Artificial Sequence
  Synthetic
gtctcaaattcatuttcacactggatut

SEQ ID NO: 41104 - DNA, 17 bp, Artificial Sequence
  Synthetic
ctagcgcgcucagggua

SEQ ID NO: 41105 - DNA, 17 bp, Artificial Sequence
  Synthetic
ggtggcgaugctgcuca

SEQ ID NO: 41106 - DNA, 23 bp, Artificial Sequence
  Synthetic
ccgtttgctcucagttgccauat

SEQ ID NO: 41107 - DNA, 31 bp, Artificial Sequence; identical to SEQ ID NO: 28873
  Synthetic

SEQ ID NO: 41108 - DNA, 24 bp, Artificial Sequence
  Synthetic
gtgccattugttgtgtatctuggt

SEQ ID NO: 41109 - DNA, 31 bp, Artificial Sequence; identical to SEQ ID NO: 28875
  Synthetic

SEQ ID NO: 41110 - DNA, 31 bp, Artificial Sequence; identical to SEQ ID NO: 28876
  Synthetic

SEQ ID NO: 41111 - DNA, 24 bp, Artificial Sequence
  Synthetic
tcattcaacacuaacgtgcctugt

SEQ ID NO: 41112 - DNA, 29 bp, Artificial Sequence
  Synthetic
actataataguagactgttcctucacgct

SEQ ID NO: 41113 - DNA, 28 bp, Artificial Sequence
  Synthetic
gttcatcacauaccagacaatagcauct

SEQ ID NO: 41114 - DNA, 25 bp, Artificial Sequence
  Synthetic
acttcttgauaaccgtcagtgctut

SEQ ID NO: 41115 - DNA, 31 bp, Artificial Sequence; identical to SEQ ID NO: 28881
  Synthetic

SEQ ID NO: 41116 - DNA, 33 bp, Artificial Sequence; identical to SEQ ID NO: 28882
  Synthetic

SEQ ID NO: 41117 - DNA, 28 bp, Artificial Sequence
  Synthetic
aactggacaaccaaugagattcttcuac

SEQ ID NO: 41118 - DNA, 27 bp, Artificial Sequence
  Synthetic
actccctacugactcacgtattttuct

SEQ ID NO: 41119 - DNA, 29 bp, Artificial Sequence
  Synthetic
caatgctcctauagaagctatccaacauc

SEQ ID NO: 41120 - DNA, 25 bp, Artificial Sequence
  Synthetic
gaaggcacatugctgaattgtatug

SEQ ID NO: 41121 - DNA, 27 bp, Artificial Sequence
  Synthetic
tgagttgaatguattttcatcccucat

SEQ ID NO: 41122 - DNA, 26 bp, Artificial Sequence
  Synthetic
atttgatgcugaactgtattgcuaca

SEQ ID NO: 41123 - DNA, 25 bp, Artificial Sequence
  Synthetic
gacgcatacuggcaactggatauaa

SEQ ID NO: 41124 - DNA, 26 bp, Artificial Sequence
  Synthetic
agtgtaactcaaguctctggttcuct

SEQ ID NO: 41125 - DNA, 19 bp, Artificial Sequence
  Synthetic
gagctcuaatgcggugcca

SEQ ID NO: 41126 - DNA, 19 bp, Artificial Sequence
  Synthetic
gggagatcugcccaagcug

SEQ ID NO: 41127 - DNA, 17 bp, Artificial Sequence
  Synthetic
ctgccguggcccuagaa

SEQ ID NO: 41128 - DNA, 24 bp, Artificial Sequence
  Synthetic
aaccatccucgttgaacugaacat

SEQ ID NO: 41129 - DNA, 19 bp, Artificial Sequence
  Synthetic
ctcggcagugctctcacuc

SEQ ID NO: 41130 - DNA, 17 bp, Artificial Sequence
  Synthetic
gcgaggugctcctcuct

SEQ ID NO: 41131 - DNA, 18 bp, Artificial Sequence
  Synthetic
gctggtguctcacccuca

SEQ ID NO: 41132 - DNA, 18 bp, Artificial Sequence
  Synthetic
ggcccccuttcacgctua

SEQ ID NO: 41133 - DNA, 19 bp, Artificial Sequence
  Synthetic
ccacacuctcctcgtuccc

SEQ ID NO: 41134 - DNA, 18 bp, Artificial Sequence
  Synthetic
ccccuccacctccctucc

SEQ ID NO: 41135 - DNA, 18 bp, Artificial Sequence
  Synthetic
cctgccacucggttcugt

SEQ ID NO: 41136 - DNA, 22 bp, Artificial Sequence
  Synthetic
ccaggtgguaggagctauaggg

SEQ ID NO: 41137 - DNA, 22 bp, Artificial Sequence
  Synthetic
ttgagaggaggguccccatuaa

SEQ ID NO: 41138 - DNA, 21 bp, Artificial Sequence
  Synthetic
caatgcugagaggtguggaca

SEQ ID NO: 41139 - DNA, 19 bp, Artificial Sequence
  Synthetic
ccaacacguccacctucgt

SEQ ID NO: 41140 - DNA, 22 bp, Artificial Sequence
  Synthetic
catcagccccutcctttgcaua

SEQ ID NO: 41141 - DNA, 30 bp, Artificial Sequence; identical to SEQ ID NO: 28907
  Synthetic

SEQ ID NO: 41142 - DNA, 26 bp, Artificial Sequence
  Synthetic
tgtttatggcaguaaccctaaaggug

SEQ ID NO: 41143 - DNA, 25 bp, Artificial Sequence
  Synthetic
tcactccattgucggttcatttcut

SEQ ID NO: 41144 - DNA, 19 bp, Artificial Sequence
  Synthetic
ccttctggaguggaggcut

SEQ ID NO: 41145 - DNA, 17 bp, Artificial Sequence
  Synthetic
gctccuccgcagguact

SEQ ID NO: 41146 - DNA, 22 bp, Artificial Sequence
  Synthetic
agtcactcugttgtccuccaga

SEQ ID NO: 41147 - DNA, 21 bp, Artificial Sequence
  Synthetic
acgaacgctucttcccctaug

SEQ ID NO: 41148 - DNA, 20 bp, Artificial Sequence
  Synthetic
ggacacgacacucaccacua

SEQ ID NO: 41149 - DNA, 20 bp, Artificial Sequence
  Synthetic
ctgtctccugaggctgtucc

SEQ ID NO: 41150 - DNA, 20 bp, Artificial Sequence
  Synthetic
cctcacccucctcttccuct

SEQ ID NO: 41151 - DNA, 18 bp, Artificial Sequence
  Synthetic
gctcuccccttccuccca

SEQ ID NO: 41152 - DNA, 18 bp, Artificial Sequence
  Synthetic
gcagcgguactcgccauc

SEQ ID NO: 41153 - DNA, 22 bp, Artificial Sequence
  Synthetic
ggtgattggccutgtccttuct

SEQ ID NO: 41154 - DNA, 20 bp, Artificial Sequence
  Synthetic
agagagugcagagcctcuga

SEQ ID NO: 41155 - DNA, 20 bp, Artificial Sequence
  Synthetic
gtcatgactucggcctccut

SEQ ID NO: 41156 - DNA, 21 bp, Artificial Sequence
  Synthetic
cccacaaucccacacgaacuc

SEQ ID NO: 41157 - DNA, 19 bp, Artificial Sequence
  Synthetic
cutcaccaucacgggcaac

SEQ ID NO: 41158 - DNA, 21 bp, Artificial Sequence
  Synthetic
gggcttcugggcttagaagut

SEQ ID NO: 41159 - DNA, 21 bp, Artificial Sequence
  Synthetic
gctctcuccaccctgtctuca

SEQ ID NO: 41160 - DNA, 19 bp, Artificial Sequence
  Synthetic
tgcaatccgcuccgtguaa

SEQ ID NO: 41161 - DNA, 20 bp, Artificial Sequence
  Synthetic
cagaggaggcucacuggaga

SEQ ID NO: 41162 - DNA, 17 bp, Artificial Sequence
  Synthetic
gggctcagguggaggug

SEQ ID NO: 41163 - DNA, 19 bp, Artificial Sequence
  Synthetic
tccacccucggugagaaga

SEQ ID NO: 41164 - DNA, 20 bp, Artificial Sequence
  Synthetic
gtctccugcacagaucggat

SEQ ID NO: 41165 - DNA, 22 bp, Artificial Sequence
  Synthetic
cacccaggucatggtgaucaaa

SEQ ID NO: 41166 - DNA, 21 bp, Artificial Sequence
  Synthetic
cccaggacutttcuccaggac

SEQ ID NO: 41167 - DNA, 25 bp, Artificial Sequence
  Synthetic
atccctggacccuaatgatttugac

SEQ ID NO: 41168 - DNA, 22 bp, Artificial Sequence
  Synthetic
cctgcccugtagagauaggagt

SEQ ID NO: 41169 - DNA, 22 bp, Artificial Sequence
  Synthetic
cagagacaucagaagggucagg

SEQ ID NO: 41170 - DNA, 29 bp, Artificial Sequence
  Synthetic
cttgccctcttuctcttctttcttatcut

SEQ ID NO: 41171 - DNA, 26 bp, Artificial Sequence
  Synthetic
ctggcatgtuctctgtgatactuaca

SEQ ID NO: 41172 - DNA, 17 bp, Artificial Sequence
  Synthetic
gcggucccacucacagt

SEQ ID NO: 41173 - DNA, 17 bp, Artificial Sequence
  Synthetic
cgctcccucctcucgga

SEQ ID NO: 41174 - DNA, 18 bp, Artificial Sequence
  Synthetic
ggtgggugggtccuagca

SEQ ID NO: 41175 - DNA, 17 bp, Artificial Sequence
  Synthetic
cgggccccgauaccauc

SEQ ID NO: 41176 - DNA, 27 bp, Artificial Sequence
  Synthetic
ccttgttttcugtttaaaaggcauaca

SEQ ID NO: 41177 - DNA, 28 bp, Artificial Sequence
  Synthetic
catctgatgcacgautttaaccacauac

SEQ ID NO: 41178 - DNA, 25 bp, Artificial Sequence
  Synthetic
tcagatttgutgtttcacuggagca

SEQ ID NO: 41179 - DNA, 20 bp, Artificial Sequence
  Synthetic
ggcucgttctaugcacacga

SEQ ID NO: 41180 - DNA, 22 bp, Artificial Sequence
  Synthetic
ctgtgcaaaaugggagtgacug

SEQ ID NO: 41181 - DNA, 24 bp, Artificial Sequence
  Synthetic
gtcctcccuacaattgcagactua

SEQ ID NO: 41182 - DNA, 26 bp, Artificial Sequence
  Synthetic
ggataactgcauttctcaaccaguga

SEQ ID NO: 41183 - DNA, 25 bp, Artificial Sequence
  Synthetic
aaacttcuagccccgtaacacauac

SEQ ID NO: 41184 - DNA, 22 bp, Artificial Sequence
  Synthetic
cccttacactuggtgccatcuc

SEQ ID NO: 41185 - DNA, 29 bp, Artificial Sequence
  Synthetic
atacacctagtaugtaaccacaaacatut

SEQ ID NO: 41186 - DNA, 24 bp, Artificial Sequence
  Synthetic
accagggaggaaccutgttctaut

SEQ ID NO: 41187 - DNA, 21 bp, Artificial Sequence
  Synthetic
tctgaaacaucctgcccucac

SEQ ID NO: 41188 - DNA, 25 bp, Artificial Sequence
  Synthetic
actcactgaaccuttcttgtccaut

SEQ ID NO: 41189 - DNA, 22 bp, Artificial Sequence
  Synthetic
ggaaccugaacgtgttuccaca

SEQ ID NO: 41190 - DNA, 27 bp, Artificial Sequence
  Synthetic
agcaaaagagguagaattggtttcuga

SEQ ID NO: 41191 - DNA, 25 bp, Artificial Sequence
  Synthetic
ccacccauatcctuaaaacaggaca

SEQ ID NO: 41192 - DNA, 26 bp, Artificial Sequence
  Synthetic
gattuagcacaaagguagaaggcaag

SEQ ID NO: 41193 - DNA, 22 bp, Artificial Sequence
  Synthetic
tgtggugaactctcuagaccca

SEQ ID NO: 41194 - DNA, 24 bp, Artificial Sequence
  Synthetic
ctttcttuccaaggagaccagcut

SEQ ID NO: 41195 - DNA, 24 bp, Artificial Sequence
  Synthetic
ctagtccaacuctattgcccucag

SEQ ID NO: 41196 - DNA, 21 bp, Artificial Sequence
  Synthetic
agtcacccuacccatggtuga

SEQ ID NO: 41197 - DNA, 30 bp, Artificial Sequence; identical to SEQ ID NO: 28963
  Synthetic

SEQ ID NO: 41198 - DNA, 27 bp, Artificial Sequence
  Synthetic
aattaagtttguggaagctaagagugt

SEQ ID NO: 41199 - DNA, 29 bp, Artificial Sequence
  Synthetic
cctctacatctcucagtttatcatcaugt

SEQ ID NO: 41200 - DNA, 27 bp, Artificial Sequence
  Synthetic
ttcatagaaucctttgagctugcaaga

SEQ ID NO: 41201 - DNA, 29 bp, Artificial Sequence
  Synthetic
actaacccagcugaatttaatctctgtut

SEQ ID NO: 41202 - DNA, 22 bp, Artificial Sequence
  Synthetic
gctgagtagguagggaaccuct

SEQ ID NO: 41203 - DNA, 28 bp, Artificial Sequence
  Synthetic
gcataaaccaatguatctcatgctcaut

SEQ ID NO: 41204 - DNA, 24 bp, Artificial Sequence
  Synthetic
acagtgaacacaugtccacugaaa

SEQ ID NO: 41205 - DNA, 26 bp, Artificial Sequence
  Synthetic
ggtggaguggagagaaagaaactuat

SEQ ID NO: 41206 - DNA, 23 bp, Artificial Sequence
  Synthetic
gagccctgcaguttctttccaua

SEQ ID NO: 41207 - DNA, 24 bp, Artificial Sequence
  Synthetic
aggattgatgucttccctcccuag

SEQ ID NO: 41208 - DNA, 24 bp, Artificial Sequence
  Synthetic
tgccatatgaugttgcacttucca

SEQ ID NO: 41209 - DNA, 31 bp, Artificial Sequence; identical to SEQ ID NO: 28975
  Synthetic

SEQ ID NO: 41210 - DNA, 27 bp, Artificial Sequence
  Synthetic
gtcccaaatgutcatttagttcuccac

SEQ ID NO: 41211 - DNA, 24 bp, Artificial Sequence
  Synthetic
gatgtgaggcauttctacccacut

SEQ ID NO: 41212 - DNA, 31 bp, Artificial Sequence; identical to SEQ ID NO: 28978
  Synthetic

SEQ ID NO: 41213 - DNA, 27 bp, Artificial Sequence
  Synthetic
gaaagcaatcaugcaatagcagcaaua

SEQ ID NO: 41214 - DNA, 23 bp, Artificial Sequence
  Synthetic
ccaatagctuggagggagtctut

SEQ ID NO: 41215 - DNA, 26 bp, Artificial Sequence
  Synthetic
ggcaaagutgaattgctuccaaaagt

SEQ ID NO: 41216 - DNA, 31 bp, Artificial Sequence; identical to SEQ ID NO: 28982
  Synthetic

SEQ ID NO: 41217 - DNA, 22 bp, Artificial Sequence
  Synthetic
gagtcauagcatcccucaagca

SEQ ID NO: 41218 - DNA, 28 bp, Artificial Sequence
  Synthetic
tcaaatgtttcatguttttggaccacug

SEQ ID NO: 41219 - DNA, 24 bp, Artificial Sequence
  Synthetic
agaaaactuggaaggctugggaaa

SEQ ID NO: 41220 - DNA, 28 bp, Artificial Sequence
  Synthetic
cattttgccuagtgctcaguaagaaaag

SEQ ID NO: 41221 - DNA, 27 bp, Artificial Sequence
  Synthetic
gacgtaggacucaaagagatggtttut

SEQ ID NO: 41222 - DNA, 27 bp, Artificial Sequence
  Synthetic
agagttcagagagutctttccaugagt

SEQ ID NO: 41223 - DNA, 27 bp, Artificial Sequence
  Synthetic
tgattcaugacagaatgcttauggaca

SEQ ID NO: 41224 - DNA, 25 bp, Artificial Sequence
  Synthetic
gggccatcaaugtgagtctttcuat

SEQ ID NO: 41225 - DNA, 30 bp, Artificial Sequence; identical to SEQ ID NO: 28991
  Synthetic

SEQ ID NO: 41226 - DNA, 28 bp, Artificial Sequence
  Synthetic
actatcataaugaactggcatactuggg

SEQ ID NO: 41227 - DNA, 22 bp, Artificial Sequence
  Synthetic
gggacatgguatttaccccuga

SEQ ID NO: 41228 - DNA, 22 bp, Artificial Sequence
  Synthetic
cccatgtggaguaggactcugt

SEQ ID NO: 41229 - DNA, 29 bp, Artificial Sequence
  Synthetic
agtaaaaacaaugccatugaaccaagaag

SEQ ID NO: 41230 - DNA, 27 bp, Artificial Sequence
  Synthetic
atgctataaaugacagcatgtgagcua

SEQ ID NO: 41231 - DNA, 26 bp, Artificial Sequence
  Synthetic
ggtctaugaagacacautcacccuat

SEQ ID NO: 41232 - DNA, 22 bp, Artificial Sequence
  Synthetic
ccactggacutaagtgctgcut

SEQ ID NO: 41233 - DNA, 27 bp, Artificial Sequence
  Synthetic
aacatcagtagcauttctttaccccut

SEQ ID NO: 41234 - DNA, 26 bp, Artificial Sequence
  Synthetic
gattcuttgtagcagaugaggagagg

SEQ ID NO: 41235 - DNA, 27 bp, Artificial Sequence
  Synthetic
gctatttatggtuttgcttgtggguag

SEQ ID NO: 41236 - DNA, 24 bp, Artificial Sequence
  Synthetic
acaaaggacggacaucagtgatuc

SEQ ID NO: 41237 - DNA, 30 bp, Artificial Sequence; identical to SEQ ID NO: 29003
  Synthetic

SEQ ID NO: 41238 - DNA, 27 bp, Artificial Sequence
  Synthetic
ccataaagtaaaggucccaagatucct

SEQ ID NO: 41239 - DNA, 30 bp, Artificial Sequence; identical to SEQ ID NO: 29005
  Synthetic

SEQ ID NO: 41240 - DNA, 28 bp, Artificial Sequence
  Synthetic
aatgtacccaagutttaggatgcttcut

SEQ ID NO: 41241 - DNA, 25 bp, Artificial Sequence
  Synthetic
acattgtttgguttgtctgacucca

SEQ ID NO: 41242 - DNA, 24 bp, Artificial Sequence
  Synthetic
cagtagaaacugtccaagguccat

SEQ ID NO: 41243 - DNA, 29 bp, Artificial Sequence
  Synthetic
gccataggtgucttattcctacttuacag

SEQ ID NO: 41244 - DNA, 31 bp, Artificial Sequence; identical to SEQ ID NO: 29010
  Synthetic

SEQ ID NO: 41245 - DNA, 26 bp, Artificial Sequence
  Synthetic
gatgaagaactguctcctcctaguga

SEQ ID NO: 41246 - DNA, 27 bp, Artificial Sequence
  Synthetic
ctgaattcaagucttttaccaggucca

SEQ ID NO: 41247 - DNA, 29 bp, Artificial Sequence
  Synthetic
tgagtguacagtggatauagaaaggacaa

SEQ ID NO: 41248 - DNA, 31 bp, Artificial Sequence; identical to SEQ ID NO: 29014
  Synthetic

SEQ ID NO: 41249 - DNA, 24 bp, Artificial Sequence
  Synthetic
gtgtccaccaaaaugaacgactut

SEQ ID NO: 41250 - DNA, 21 bp, Artificial Sequence
  Synthetic
cagguggagagctctattugc

SEQ ID NO: 41251 - DNA, 25 bp, Artificial Sequence
  Synthetic
cccactgauaaaaaggaagcaaucc

SEQ ID NO: 41252 - DNA, 26 bp, Artificial Sequence
  Synthetic
agucctttaaactuagggacagagga

SEQ ID NO: 41253 - DNA, 27 bp, Artificial Sequence
  Synthetic
gaacatctcacagcauttccatcttut

SEQ ID NO: 41254 - DNA, 21 bp, Artificial Sequence
  Synthetic
caagcaatgtuccagggccua

SEQ ID NO: 41255 - DNA, 22 bp, Artificial Sequence
  Synthetic
gcaagttctccugtctccctut

SEQ ID NO: 41256 - DNA, 23 bp, Artificial Sequence
  Synthetic
cccatgucagaaaagcgcatcua

SEQ ID NO: 41257 - DNA, 25 bp, Artificial Sequence
  Synthetic
gctaatggctcuttttccctttgut

SEQ ID NO: 41258 - DNA, 22 bp, Artificial Sequence
  Synthetic
caggaaaugggcaagauggaac

SEQ ID NO: 41259 - DNA, 23 bp, Artificial Sequence
  Synthetic
gcuaagaacaaggctttcuggga

SEQ ID NO: 41260 - DNA, 25 bp, Artificial Sequence
  Synthetic
ccacatatccautttctcaguggga

SEQ ID NO: 41261 - DNA, 26 bp, Artificial Sequence
  Synthetic
ccttctcuaccccttttcttucacag

SEQ ID NO: 41262 - DNA, 21 bp, Artificial Sequence
  Synthetic
caagaaggcutggagggagug

SEQ ID NO: 41263 - DNA, 25 bp, Artificial Sequence
  Synthetic
cgtgatccctutcttcttgtcttug

SEQ ID NO: 41264 - DNA, 24 bp, Artificial Sequence
  Synthetic
acacaaatccutctcaagctcucg

SEQ ID NO: 41265 - DNA, 24 bp, Artificial Sequence
  Synthetic
ctggcacauagcttttctcaucat

SEQ ID NO: 41266 - DNA, 22 bp, Artificial Sequence
  Synthetic
ccctttgutgctctuggagcat

SEQ ID NO: 41267 - DNA, 25 bp, Artificial Sequence
  Synthetic
cccctaattcugtgttttgtgtuca

SEQ ID NO: 41268 - DNA, 24 bp, Artificial Sequence
  Synthetic
gggataagcuacttttgcuaccac

SEQ ID NO: 41269 - DNA, 29 bp, Artificial Sequence
  Synthetic
gtggagtttagagutgatgttttccatut

SEQ ID NO: 41270 - DNA, 27 bp, Artificial Sequence
  Synthetic
tgcccaaatgutttagacagatuacca

SEQ ID NO: 41271 - DNA, 24 bp, Artificial Sequence
  Synthetic
ctcccactaautgtcctccaucac

SEQ ID NO: 41272 - DNA, 28 bp, Artificial Sequence
  Synthetic
aataaaagtagagaaacaugagccccut

SEQ ID NO: 41273 - DNA, 26 bp, Artificial Sequence
  Synthetic
gaccttttagcuttgtgcatctugag

SEQ ID NO: 41274 - DNA, 20 bp, Artificial Sequence
  Synthetic
caagttgggauacgccucca

SEQ ID NO: 41275 - DNA, 28 bp, Artificial Sequence
  Synthetic
gattgttctttgutgtctgtcttuccag

SEQ ID NO: 41276 - DNA, 22 bp, Artificial Sequence
  Synthetic
ggaatuccagcacttugagagg

SEQ ID NO: 41277 - DNA, 24 bp, Artificial Sequence
  Synthetic
ggacaagaccutttgtttccctug

SEQ ID NO: 41278 - DNA, 21 bp, Artificial Sequence
  Synthetic
atcctuaccccagagcucgat

SEQ ID NO: 41279 - DNA, 28 bp, Artificial Sequence
  Synthetic
tttcctctgccutgcgttttaatttuag

SEQ ID NO: 41280 - DNA, 17 bp, Artificial Sequence
  Synthetic
ccuggcacaggacugca

SEQ ID NO: 41281 - DNA, 19 bp, Artificial Sequence
  Synthetic
cutggguggagccacaact

SEQ ID NO: 41282 - DNA, 26 bp, Artificial Sequence
  Synthetic
tctcaatgaaaugctttggcagttut

SEQ ID NO: 41283 - DNA, 26 bp, Artificial Sequence
  Synthetic
gatguaagagaagagaguaccttugt

SEQ ID NO: 41284 - DNA, 25 bp, Artificial Sequence
  Synthetic
gtgtggcaataucacattccttguc

SEQ ID NO: 41285 - DNA, 25 bp, Artificial Sequence
  Synthetic
cacgtuccccagttgtaatuaccat

SEQ ID NO: 41286 - DNA, 27 bp, Artificial Sequence
  Synthetic
ttctccttttgugttttgtctctcugt

SEQ ID NO: 41287 - DNA, 23 bp, Artificial Sequence
  Synthetic
ggtgagaaaugaaaagccuggag

SEQ ID NO: 41288 - DNA, 29 bp, Artificial Sequence
  Synthetic
gaaaaggacugaactctaaattcuggact

SEQ ID NO: 41289 - DNA, 27 bp, Artificial Sequence
  Synthetic
cgtagcagugatcatgguaaaagaaga

SEQ ID NO: 41290 - DNA, 23 bp, Artificial Sequence
  Synthetic
ccctgcttcuggatcgtttacut

SEQ ID NO: 41291 - DNA, 31 bp, Artificial Sequence; identical to SEQ ID NO: 29057
  Synthetic

SEQ ID NO: 41292 - DNA, 27 bp, Artificial Sequence
  Synthetic
ttcttgtgtctucactgtctccattut

SEQ ID NO: 41293 - DNA, 26 bp, Artificial Sequence
  Synthetic
agttcagaugaagaacttgucacagg

SEQ ID NO: 41294 - DNA, 28 bp, Artificial Sequence
  Synthetic
cagcctcatcuggagatattgttaugac

SEQ ID NO: 41295 - DNA, 27 bp, Artificial Sequence
  Synthetic
gagtaatgttacucgctatgactugga

SEQ ID NO: 41296 - DNA, 23 bp, Artificial Sequence
  Synthetic
tcagctgaaauatccctguagcg

SEQ ID NO: 41297 - DNA, 26 bp, Artificial Sequence
  Synthetic
agtactgttugaagggttaggcatut

SEQ ID NO: 41298 - DNA, 28 bp, Artificial Sequence
  Synthetic
acaaaagaaccatuatacgaaggcctua

SEQ ID NO: 41299 - DNA, 31 bp, Artificial Sequence; identical to SEQ ID NO: 29065
  Synthetic

SEQ ID NO: 41300 - DNA, 17 bp, Artificial Sequence
  Synthetic
aacucccacggccctuc

SEQ ID NO: 41301 - DNA, 17 bp, Artificial Sequence
  Synthetic
tcccgctucggagggua

SEQ ID NO: 41302 - DNA, 17 bp, Artificial Sequence
  Synthetic
ctgcugccgcctcctua

SEQ ID NO: 41303 - DNA, 25 bp, Artificial Sequence
  Synthetic
ggaagaucgtatccuccaggaagag

SEQ ID NO: 41304 - DNA, 20 bp, Artificial Sequence
  Synthetic
gcaguggaaccgatccucag

SEQ ID NO: 41305 - DNA, 20 bp, Artificial Sequence
  Synthetic
gggatgagcgutccaaccut

SEQ ID NO: 41306 - DNA, 22 bp, Artificial Sequence
  Synthetic
ccttgtagccugtccagtctut

SEQ ID NO: 41307 - DNA, 21 bp, Artificial Sequence
  Synthetic
gtcccucaagaggtcuagcca

SEQ ID NO: 41308 - DNA, 25 bp, Artificial Sequence
  Synthetic
cctacctcucggttatcttttcucc

SEQ ID NO: 41309 - DNA, 22 bp, Artificial Sequence
  Synthetic
ccagaaccaaagcutcaucacc

SEQ ID NO: 41310 - DNA, 23 bp, Artificial Sequence
  Synthetic
ggtaaaggaccugcctgttctuc

SEQ ID NO: 41311 - DNA, 28 bp, Artificial Sequence
  Synthetic
tctcatgggauaagaaagttagggacuc

SEQ ID NO: 41312 - DNA, 21 bp, Artificial Sequence
  Synthetic
ctaggcacuggatggaggtug

SEQ ID NO: 41313 - DNA, 28 bp, Artificial Sequence
  Synthetic
gggctaaauataggtactugaaaagcct

SEQ ID NO: 41314 - DNA, 23 bp, Artificial Sequence
  Synthetic
aatgaagtccaugccaccatuct

SEQ ID NO: 41315 - DNA, 28 bp, Artificial Sequence
  Synthetic
gcttaatucagcaagactgtugaaaaca

SEQ ID NO: 41316 - DNA, 20 bp, Artificial Sequence
  Synthetic
aatgacutggtgguggcaga

SEQ ID NO: 41317 - DNA, 23 bp, Artificial Sequence
  Synthetic
tgccaaagtcutgtgacctguag

SEQ ID NO: 41318 - DNA, 24 bp, Artificial Sequence
  Synthetic
tttcagtgtucaccacccacaaua

SEQ ID NO: 41319 - DNA, 23 bp, Artificial Sequence
  Synthetic
gactcugaagaggctagaucgga

SEQ ID NO: 41320 - DNA, 23 bp, Artificial Sequence
  Synthetic
gccgacgucatgcaagtauacat

SEQ ID NO: 41321 - DNA, 23 bp, Artificial Sequence
  Synthetic
acttcttgactutgggagtgguc

SEQ ID NO: 41322 - DNA, 21 bp, Artificial Sequence
  Synthetic
ctcaccaacucaggucccaat

SEQ ID NO: 41323 - DNA, 23 bp, Artificial Sequence
  Synthetic
catctctgcuacccaagatgucc

SEQ ID NO: 41324 - DNA, 27 bp, Artificial Sequence
  Synthetic
aattgcagtcutgctgtattucaaagg

SEQ ID NO: 41325 - DNA, 28 bp, Artificial Sequence
  Synthetic
tgttagcuaagagagaacattcucagga

SEQ ID NO: 41326 - DNA, 23 bp, Artificial Sequence
  Synthetic
ttgctagtatgugcttggtcugg

SEQ ID NO: 41327 - DNA, 28 bp, Artificial Sequence
  Synthetic
aggaagtatggcucccaaagattauaga

SEQ ID NO: 41328 - DNA, 24 bp, Artificial Sequence
  Synthetic
acataatgcutgtggttuccccaa

SEQ ID NO: 41329 - DNA, 23 bp, Artificial Sequence
  Synthetic
ctctatagcccuctccaagcuca

SEQ ID NO: 41330 - DNA, 21 bp, Artificial Sequence
  Synthetic
gatgatgcuactgcagcugga

SEQ ID NO: 41331 - DNA, 20 bp, Artificial Sequence
  Synthetic
tgtgggacuctgtcctucgt

SEQ ID NO: 41332 - DNA, 23 bp, Artificial Sequence
  Synthetic
ctcccatcuccctgcaataacut

SEQ ID NO: 41333 - DNA, 24 bp, Artificial Sequence
  Synthetic
gtaagaccaacautgttgcuccag

SEQ ID NO: 41334 - DNA, 21 bp, Artificial Sequence
  Synthetic
cagggaucttgaggcugcaaa

SEQ ID NO: 41335 - DNA, 21 bp, Artificial Sequence
  Synthetic
ctaagtccgcutctggtcucc

SEQ ID NO: 41336 - DNA, 21 bp, Artificial Sequence
  Synthetic
gggaaaggugactcuggaaga

SEQ ID NO: 41337 - DNA, 23 bp, Artificial Sequence
  Synthetic
acuacacaacacguaggatcuac

SEQ ID NO: 41338 - DNA, 20 bp, Artificial Sequence
  Synthetic
tgctggcgaaugacgtctut

SEQ ID NO: 41339 - DNA, 29 bp, Artificial Sequence
  Synthetic
gattttggcttcuctcagaaactcattut

SEQ ID NO: 41340 - DNA, 25 bp, Artificial Sequence
  Synthetic
tcagtgttcagcugtctttggaaut

SEQ ID NO: 41341 - DNA, 21 bp, Artificial Sequence
  Synthetic
ctgautgttcctguggaagcc

SEQ ID NO: 41342 - DNA, 23 bp, Artificial Sequence
  Synthetic
ctaaggcagagutguaaccacct

SEQ ID NO: 41343 - DNA, 22 bp, Artificial Sequence
  Synthetic
acactttgcauctccctgtgug

SEQ ID NO: 41344 - DNA, 23 bp, Artificial Sequence
  Synthetic
ctcaggcaugcatcacaagtuag

SEQ ID NO: 41345 - DNA, 29 bp, Artificial Sequence
  Synthetic
gaacttgttgttutctcttttagggugaa

SEQ ID NO: 41346 - DNA, 28 bp, Artificial Sequence
  Synthetic
ttgtgtatgttuctagtcttacctucca

SEQ ID NO: 41347 - DNA, 28 bp, Artificial Sequence
  Synthetic
tcctgugaaggagaatatctcucaagat

SEQ ID NO: 41348 - DNA, 28 bp, Artificial Sequence
  Synthetic
aaagctctgtuaggatgattaaacagug

SEQ ID NO: 41349 - DNA, 26 bp, Artificial Sequence
  Synthetic
cccacttccaaauccttgtaatgugt

SEQ ID NO: 41350 - DNA, 22 bp, Artificial Sequence
  Synthetic
tcccaatcauacagccagcaug

SEQ ID NO: 41351 - DNA, 24 bp, Artificial Sequence
  Synthetic
tttacgugggctatactugccaat

SEQ ID NO: 41352 - DNA, 31 bp, Artificial Sequence; identical to SEQ ID NO: 29118
  Synthetic

SEQ ID NO: 41353 - DNA, 28 bp, Artificial Sequence
  Synthetic
acttagagtctugctttcagaattugct

SEQ ID NO: 41354 - DNA, 23 bp, Artificial Sequence
  Synthetic
ggtgcagcacacaugataaugag

SEQ ID NO: 41355 - DNA, 25 bp, Artificial Sequence
  Synthetic
gcctgaagccugatatcatgatugt

SEQ ID NO: 41356 - DNA, 22 bp, Artificial Sequence
  Synthetic
ggaatttgaagcugggcccaua

SEQ ID NO: 41357 - DNA, 24 bp, Artificial Sequence
  Synthetic
tgtttggcatuaaaaccgaaccug

SEQ ID NO: 41358 - DNA, 28 bp, Artificial Sequence
  Synthetic
gctttcctctucctctttgtaatttucc

SEQ ID NO: 41359 - DNA, 22 bp, Artificial Sequence
  Synthetic
aaccacacuaggguacagagct

SEQ ID NO: 41360 - DNA, 18 bp, Artificial Sequence
  Synthetic
gcagggcagcuctctgug

SEQ ID NO: 41361 - DNA, 19 bp, Artificial Sequence
  Synthetic
cacuctgcagguggacgag

SEQ ID NO: 41362 - DNA, 20 bp, Artificial Sequence
  Synthetic
gggcgttcugtgtgtcauca

SEQ ID NO: 41363 - DNA, 21 bp, Artificial Sequence
  Synthetic
ctaccugcccaacttcuaccc

SEQ ID NO: 41364 - DNA, 17 bp, Artificial Sequence
  Synthetic
gctugggccccacguag

SEQ ID NO: 41365 - DNA, 19 bp, Artificial Sequence
  Synthetic
cctgggugtatgcccucat

SEQ ID NO: 41366 - DNA, 23 bp, Artificial Sequence
  Synthetic
taggaccagaugtctgagucgat

SEQ ID NO: 41367 - DNA, 21 bp, Artificial Sequence
  Synthetic
ggaguacctauccagccacca

SEQ ID NO: 41368 - DNA, 17 bp, Artificial Sequence
  Synthetic
tcgccgugcgaacagua

SEQ ID NO: 41369 - DNA, 22 bp, Artificial Sequence
  Synthetic
tctacaaaggucacctgtucgg

SEQ ID NO: 41370 - DNA, 22 bp, Artificial Sequence
  Synthetic
gggaaacaaccccugaggatua

SEQ ID NO: 41371 - DNA, 24 bp, Artificial Sequence
  Synthetic
cttgcctttucttcttggttugca

SEQ ID NO: 41372 - DNA, 21 bp, Artificial Sequence
  Synthetic
gccctcaucacaaggtucact

SEQ ID NO: 41373 - DNA, 21 bp, Artificial Sequence
  Synthetic
gcacagactuccctgagctug

SEQ ID NO: 41374 - DNA, 22 bp, Artificial Sequence
  Synthetic
cacattucaagggcccuacact

SEQ ID NO: 41375 - DNA, 18 bp, Artificial Sequence
  Synthetic
gcuggagagcgacctgug

SEQ ID NO: 41376 - DNA, 22 bp, Artificial Sequence
  Synthetic
gatggctgugtgcatgcttauc

SEQ ID NO: 41377 - DNA, 29 bp, Artificial Sequence
  Synthetic
ctctaacagacuttgtgtgtttctuacca

SEQ ID NO: 41378 - DNA, 25 bp, Artificial Sequence
  Synthetic
agtttcaaauagcaactggaccuct

SEQ ID NO: 41379 - DNA, 23 bp, Artificial Sequence
  Synthetic
ggaucatcauccggaagacagaa

SEQ ID NO: 41380 - DNA, 22 bp, Artificial Sequence
  Synthetic
auttggaggacauggagagcac

SEQ ID NO: 41381 - DNA, 29 bp, Artificial Sequence
  Synthetic
ggctccugaaaggaaaacttgtttaauac

SEQ ID NO: 41382 - DNA, 20 bp, Artificial Sequence
  Synthetic
gaaguccgggacacugagag

SEQ ID NO: 41383 - DNA, 18 bp, Artificial Sequence
  Synthetic
cctcgaaguggacccgut

SEQ ID NO: 41384 - DNA, 19 bp, Artificial Sequence
  Synthetic
cucacaccggacguggaaa

SEQ ID NO: 41385 - DNA, 20 bp, Artificial Sequence
  Synthetic
ttcucacaacccucggaacc

SEQ ID NO: 41386 - DNA, 21 bp, Artificial Sequence
  Synthetic
cctggttcugcagagtcacut

SEQ ID NO: 41387 - DNA, 20 bp, Artificial Sequence
  Synthetic
cacagcggguctgattccuc

SEQ ID NO: 41388 - DNA, 21 bp, Artificial Sequence
  Synthetic
gggaggcaccuaagtaucgaa

SEQ ID NO: 41389 - DNA, 23 bp, Artificial Sequence
  Synthetic
tgttcccgttucctcttgatcuc

SEQ ID NO: 41390 - DNA, 22 bp, Artificial Sequence
  Synthetic
ggagaatgcaaggutcccacut

SEQ ID NO: 41391 - DNA, 23 bp, Artificial Sequence
  Synthetic
cctcatcggaaucaagctcagug

SEQ ID NO: 41392 - DNA, 26 bp, Artificial Sequence
  Synthetic
ccacaaagccccutataatacacuca

SEQ ID NO: 41393 - DNA, 27 bp, Artificial Sequence
  Synthetic
aggcaattgaaaaaguaaggaccauct

SEQ ID NO: 41394 - DNA, 22 bp, Artificial Sequence
  Synthetic
gctgtugctgagttuggagaac

SEQ ID NO: 41395 - DNA, 26 bp, Artificial Sequence
  Synthetic
tcattaatcccagcgcuttctacauc

SEQ ID NO: 41396 - DNA, 17 bp, Artificial Sequence
  Synthetic
cuggaagcgcccucagt

SEQ ID NO: 41397 - DNA, 27 bp, Artificial Sequence
  Synthetic
ggctgcgagtuataatgtgttacaauc

SEQ ID NO: 41398 - DNA, 25 bp, Artificial Sequence
  Synthetic
agtaagtgcuggatattcggguagt

SEQ ID NO: 41399 - DNA, 21 bp, Artificial Sequence
  Synthetic
ccttgtgccucttctgtucca

SEQ ID NO: 41400 - DNA, 24 bp, Artificial Sequence
  Synthetic
agcaaaagaugagagtgtccacut

SEQ ID NO: 41401 - DNA, 18 bp, Artificial Sequence
  Synthetic
cuccgcacggaguacgac

SEQ ID NO: 41402 - DNA, 23 bp, Artificial Sequence
  Synthetic
acaggcugaaagagttctcucac

SEQ ID NO: 41403 - DNA, 25 bp, Artificial Sequence
  Synthetic
gcatgttggugacctctgaatttut

SEQ ID NO: 41404 - DNA, 25 bp, Artificial Sequence
  Synthetic
atctttacugggtcagacugaggaa

SEQ ID NO: 41405 - DNA, 24 bp, Artificial Sequence
  Synthetic
caccatcctcugtttttgctguag

SEQ ID NO: 41406 - DNA, 26 bp, Artificial Sequence
  Synthetic
gacuaaaacaaccaaaccaaacucca

SEQ ID NO: 41407 - DNA, 23 bp, Artificial Sequence
  Synthetic
gcatttcgcautctgttgugacc

SEQ ID NO: 41408 - DNA, 25 bp, Artificial Sequence
  Synthetic
gaaaggaagaagacuacagggcaua

SEQ ID NO: 41409 - DNA, 27 bp, Artificial Sequence
  Synthetic
gtgacctgccuactaattcccataaut

SEQ ID NO: 41410 - DNA, 20 bp, Artificial Sequence
  Synthetic
gcggtccaugtaaccaugac

SEQ ID NO: 41411 - DNA, 28 bp, Artificial Sequence
  Synthetic
tcttttcatggtcucgtctcctaattuc

SEQ ID NO: 41412 - DNA, 26 bp, Artificial Sequence
  Synthetic
tgttccugagaaattttugccaacaa

SEQ ID NO: 41413 - DNA, 29 bp, Artificial Sequence
  Synthetic
acagtgagaaattuttgtctctgctttuc

SEQ ID NO: 41414 - DNA, 20 bp, Artificial Sequence
  Synthetic
cgcutctgtggucaggacat

SEQ ID NO: 41415 - DNA, 28 bp, Artificial Sequence
  Synthetic
catgagtttgcagugattttgctatuct

SEQ ID NO: 41416 - DNA, 20 bp, Artificial Sequence
  Synthetic
ccacgttgguctcgaggtuc

SEQ ID NO: 41417 - DNA, 20 bp, Artificial Sequence
  Synthetic
actcctcccutctgctucgt

SEQ ID NO: 41418 - DNA, 17 bp, Artificial Sequence
  Synthetic
ggacgcugggctuggat

SEQ ID NO: 41419 - DNA, 24 bp, Artificial Sequence
  Synthetic
ccutttguaaagauggaggaggag

SEQ ID NO: 41420 - DNA, 25 bp, Artificial Sequence
  Synthetic
ggactcacaatuacaagcctgttuc

SEQ ID NO: 41421 - DNA, 18 bp, Artificial Sequence
  Synthetic
gggagcgccugttuaccc

SEQ ID NO: 41422 - DNA, 22 bp, Artificial Sequence
  Synthetic
ctgcagucactcagtcuagcag

SEQ ID NO: 41423 - DNA, 23 bp, Artificial Sequence
  Synthetic
aaactccaccugcctagtttgut

SEQ ID NO: 41424 - DNA, 22 bp, Artificial Sequence
  Synthetic
aaatgcacaccguctcugagaa

SEQ ID NO: 41425 - DNA, 31 bp, Artificial Sequence; identical to SEQ ID NO: 29191
  Synthetic

SEQ ID NO: 41426 - DNA, 22 bp, Artificial Sequence
  Synthetic
caccgucccaguagaaaaccaa

SEQ ID NO: 41427 - DNA, 26 bp, Artificial Sequence
  Synthetic
atcggcttcuggttcttcttttcuag

SEQ ID NO: 41428 - DNA, 29 bp, Artificial Sequence
  Synthetic
agaaaacacagtaaauaggaggagacuct

SEQ ID NO: 41429 - DNA, 28 bp, Artificial Sequence
  Synthetic
ccagtgacuagaagttttccttccuaaa

SEQ ID NO: 41430 - DNA, 28 bp, Artificial Sequence
  Synthetic
caattatgcacagutcctttaacttuca

SEQ ID NO: 41431 - DNA, 26 bp, Artificial Sequence
  Synthetic
tcaactgcugcttattgtctcuacag

SEQ ID NO: 41432 - DNA, 21 bp, Artificial Sequence
  Synthetic
ggctgagagagcuttctcgug

SEQ ID NO: 41433 - DNA, 27 bp, Artificial Sequence
  Synthetic
aagtataggaacuaaggcagcuacact

SEQ ID NO: 41434 - DNA, 30 bp, Artificial Sequence; identical to SEQ ID NO: 29200
  Synthetic

SEQ ID NO: 41435 - DNA, 27 bp, Artificial Sequence
  Synthetic
ccccaaatgatugtgttctgttttgut

SEQ ID NO: 41436 - DNA, 22 bp, Artificial Sequence
  Synthetic
gcuggacaaggacaacuacaca

SEQ ID NO: 41437 - DNA, 26 bp, Artificial Sequence
  Synthetic
accattccauacacacctgttctuag

SEQ ID NO: 41438 - DNA, 26 bp, Artificial Sequence
  Synthetic
aggacaaaacaucttcgttcagauca

SEQ ID NO: 41439 - DNA, 29 bp, Artificial Sequence
  Synthetic
catggagctcaguttttgtgaatatctut

SEQ ID NO: 41440 - DNA, 26 bp, Artificial Sequence
  Synthetic
agaattatgctuggtacttggcugaa

SEQ ID NO: 41441 - DNA, 31 bp, Artificial Sequence; identical to SEQ ID NO: 29207
  Synthetic

SEQ ID NO: 41442 - DNA, 23 bp, Artificial Sequence
  Synthetic
gcatgggugaaagctagcuagat

SEQ ID NO: 41443 - DNA, 31 bp, Artificial Sequence; identical to SEQ ID NO: 29209
  Synthetic

SEQ ID NO: 41444 - DNA, 30 bp, Artificial Sequence; identical to SEQ ID NO: 29210
  Synthetic

SEQ ID NO: 41445 - DNA, 26 bp, Artificial Sequence
  Synthetic
gtctgtttacacucccttctccttut

SEQ ID NO: 41446 - DNA, 26 bp, Artificial Sequence
  Synthetic
ctcttcatccauctcagaagaagcug

SEQ ID NO: 41447 - DNA, 27 bp, Artificial Sequence
  Synthetic
aggaacgtcucagtggtttttaagtut

SEQ ID NO: 41448 - DNA, 24 bp, Artificial Sequence
  Synthetic
gaaacacuagacctauggcaacac

SEQ ID NO: 41449 - DNA, 27 bp, Artificial Sequence
  Synthetic
cttagcacacccucaaaagagtaauga

SEQ ID NO: 41450 - DNA, 27 bp, Artificial Sequence
  Synthetic
caaataaagatuccccactgtuccagt

SEQ ID NO: 41451 - DNA, 21 bp, Artificial Sequence
  Synthetic
gctggcatuacctcgcctaug

SEQ ID NO: 41452 - DNA, 25 bp, Artificial Sequence
  Synthetic
agggactaaguagaagggaugaagg

SEQ ID NO: 41453 - DNA, 28 bp, Artificial Sequence
  Synthetic
cataactgaaagccaaugacagatctut

SEQ ID NO: 41454 - DNA, 28 bp, Artificial Sequence
  Synthetic
tctgtatcatcugtatccatgtguacca

SEQ ID NO: 41455 - DNA, 24 bp, Artificial Sequence
  Synthetic
tgtatgtgtguttgactccacucc

SEQ ID NO: 41456 - DNA, 25 bp, Artificial Sequence
  Synthetic
gttcattacuggcatctaaguggac

SEQ ID NO: 41457 - DNA, 28 bp, Artificial Sequence
  Synthetic
gcttattagttgucttgccaattgtuct

SEQ ID NO: 41458 - DNA, 25 bp, Artificial Sequence
  Synthetic
gaaattcaagcagccuaaagcugat

SEQ ID NO: 41459 - DNA, 29 bp, Artificial Sequence
  Synthetic
agatgctagtgtutgaatctctctttuca

SEQ ID NO: 41460 - DNA, 26 bp, Artificial Sequence
  Synthetic
agaagagaaaucaagggtcauaccca

SEQ ID NO: 41461 - DNA, 23 bp, Artificial Sequence
  Synthetic
gaccctggagutcagggatatuc

SEQ ID NO: 41462 - DNA, 20 bp, Artificial Sequence
  Synthetic
caaggtgtuccaagccagug

SEQ ID NO: 41463 - DNA, 19 bp, Artificial Sequence
  Synthetic
caccagcagcauggcauag

SEQ ID NO: 41464 - DNA, 22 bp, Artificial Sequence
  Synthetic
tcaatcccucagaggctucact

SEQ ID NO: 41465 - DNA, 19 bp, Artificial Sequence
  Synthetic
cagaguggcagtgctgaug

SEQ ID NO: 41466 - DNA, 20 bp, Artificial Sequence
  Synthetic
gccatgucccttccugcaaa

SEQ ID NO: 41467 - DNA, 22 bp, Artificial Sequence
  Synthetic
cagcttccucctccacttcuac

SEQ ID NO: 41468 - DNA, 19 bp, Artificial Sequence
  Synthetic
gtgacaggcaugccaggua

SEQ ID NO: 41469 - DNA, 21 bp, Artificial Sequence
  Synthetic
cgccagatugaccaagtcucc

SEQ ID NO: 41470 - DNA, 20 bp, Artificial Sequence
  Synthetic
caaccaggcuggtcctgaua

SEQ ID NO: 41471 - DNA, 20 bp, Artificial Sequence
  Synthetic
ctgatggugcccctctctuc

SEQ ID NO: 41472 - DNA, 20 bp, Artificial Sequence
  Synthetic
aagcucacacagaggtgcut

SEQ ID NO: 41473 - DNA, 24 bp, Artificial Sequence
  Synthetic
gaaaaacatucgtggctucaagct

SEQ ID NO: 41474 - DNA, 21 bp, Artificial Sequence
  Synthetic
cagaggtugggagtttgggut

SEQ ID NO: 41475 - DNA, 21 bp, Artificial Sequence
  Synthetic
tgtccgctucagtgttccauc

SEQ ID NO: 41476 - DNA, 22 bp, Artificial Sequence
  Synthetic
tgagcaguatcaugagcccaga

SEQ ID NO: 41477 - DNA, 20 bp, Artificial Sequence
  Synthetic
ctgagccuccacatgtcucc

SEQ ID NO: 41478 - DNA, 20 bp, Artificial Sequence
  Synthetic
ccttggagcutcctcugagc

SEQ ID NO: 41479 - DNA, 22 bp, Artificial Sequence
  Synthetic
ggcctcttuccggatgtttcuc

SEQ ID NO: 41480 - DNA, 24 bp, Artificial Sequence
  Synthetic
ggactgagugttgtttctttucca

SEQ ID NO: 41481 - DNA, 25 bp, Artificial Sequence
  Synthetic
gtcccgaggcuatgaaattgaugaa

SEQ ID NO: 41482 - DNA, 24 bp, Artificial Sequence
  Synthetic
taacacttagggugcaggatuagg

SEQ ID NO: 41483 - DNA, 24 bp, Artificial Sequence
  Synthetic
tccttacccacugggattgtttug

SEQ ID NO: 41484 - DNA, 20 bp, Artificial Sequence
  Synthetic
ccccaaacccgaugacaucc

SEQ ID NO: 41485 - DNA, 27 bp, Artificial Sequence
  Synthetic
tcagcaagatcaucgcagagaatatut

SEQ ID NO: 41486 - DNA, 17 bp, Artificial Sequence
  Synthetic
gcctacccucccggcua

SEQ ID NO: 41487 - DNA, 17 bp, Artificial Sequence
  Synthetic
cggguccgggcaugaag

SEQ ID NO: 41488 - DNA, 23 bp, Artificial Sequence
  Synthetic
aacatuggccagaaggaagacut

SEQ ID NO: 41489 - DNA, 19 bp, Artificial Sequence
  Synthetic
accacugccctccacauca

SEQ ID NO: 41490 - DNA, 18 bp, Artificial Sequence
  Synthetic
cauccaguccagcgcact

SEQ ID NO: 41491 - DNA, 17 bp, Artificial Sequence
  Synthetic
ccctccgccuccatcuc

SEQ ID NO: 41492 - DNA, 21 bp, Artificial Sequence
  Synthetic
ggctcugaccccttgtccuat

SEQ ID NO: 41493 - DNA, 18 bp, Artificial Sequence
  Synthetic
gggagacucggccauacc

SEQ ID NO: 41494 - DNA, 20 bp, Artificial Sequence
  Synthetic
cccagcugaccctgtcttuc

SEQ ID NO: 41495 - DNA, 20 bp, Artificial Sequence
  Synthetic
gagcugcuaccaccaaaggt

SEQ ID NO: 41496 - DNA, 19 bp, Artificial Sequence
  Synthetic
gccctctcutcccacccua

SEQ ID NO: 41497 - DNA, 18 bp, Artificial Sequence
  Synthetic
cagggcugcagacacuca

SEQ ID NO: 41498 - DNA, 21 bp, Artificial Sequence
  Synthetic
ccctgccuggaaaaatggcua

SEQ ID NO: 41499 - DNA, 20 bp, Artificial Sequence
  Synthetic
cccttgugaggcggtuagag

SEQ ID NO: 41500 - DNA, 21 bp, Artificial Sequence
  Synthetic
ctcaagggccaggugtacauc

SEQ ID NO: 41501 - DNA, 23 bp, Artificial Sequence
  Synthetic
tccagtcaaaagauaggctcugt

SEQ ID NO: 41502 - DNA, 26 bp, Artificial Sequence
  Synthetic
acccagtgtgugttgttattgtuaat

SEQ ID NO: 41503 - DNA, 21 bp, Artificial Sequence
  Synthetic
ccccagcucctcattguacac

SEQ ID NO: 41504 - DNA, 28 bp, Artificial Sequence
  Synthetic
caagttaacacugattgaccatcatucc

SEQ ID NO: 41505 - DNA, 24 bp, Artificial Sequence
  Synthetic
ccagtagcctutctgagagccuaa

SEQ ID NO: 41506 - DNA, 21 bp, Artificial Sequence
  Synthetic
agacgctuctcccatagucgt

SEQ ID NO: 41507 - DNA, 22 bp, Artificial Sequence
  Synthetic
atgguagggcacaaugaagagg

SEQ ID NO: 41508 - DNA, 24 bp, Artificial Sequence
  Synthetic
gcttagucccaaggtcatgaauca

SEQ ID NO: 41509 - DNA, 29 bp, Artificial Sequence
  Synthetic
ctatattctggcuggtctgtatcttucag

SEQ ID NO: 41510 - DNA, 23 bp, Artificial Sequence
  Synthetic
ccaggugagattccagtuccaaa

SEQ ID NO: 41511 - DNA, 31 bp, Artificial Sequence; identical to SEQ ID NO: 29277
  Synthetic

SEQ ID NO: 41512 - DNA, 25 bp, Artificial Sequence
  Synthetic
acctgtcugaaggaagaatgtuagc

SEQ ID NO: 41513 - DNA, 25 bp, Artificial Sequence
  Synthetic
tcaaacttcatguccacgtctctut

SEQ ID NO: 41514 - DNA, 20 bp, Artificial Sequence
  Synthetic
accatagtgucacgctgcuc

SEQ ID NO: 41515 - DNA, 27 bp, Artificial Sequence
  Synthetic
tgactatucagatgaaatgtucgcagt

SEQ ID NO: 41516 - DNA, 23 bp, Artificial Sequence
  Synthetic
gggctggatutggagctaaagua

SEQ ID NO: 41517 - DNA, 31 bp, Artificial Sequence; identical to SEQ ID NO: 29283
  Synthetic

SEQ ID NO: 41518 - DNA, 24 bp, Artificial Sequence
  Synthetic
caccatcttccuctgtgtttccut

SEQ ID NO: 41519 - DNA, 23 bp, Artificial Sequence
  Synthetic
gggaaugccagacttcttuggag

SEQ ID NO: 41520 - DNA, 21 bp, Artificial Sequence
  Synthetic
tgtaaaggcucagggtucacg

SEQ ID NO: 41521 - DNA, 24 bp, Artificial Sequence
  Synthetic
tggaataccgacugccatttctut

SEQ ID NO: 41522 - DNA, 25 bp, Artificial Sequence
  Synthetic
atcccagaattuccttgtttccaut

SEQ ID NO: 41523 - DNA, 28 bp, Artificial Sequence
  Synthetic
atgtgcaacattuttcgtcttgtgauat

SEQ ID NO: 41524 - DNA, 25 bp, Artificial Sequence
  Synthetic
tagatctaaaagagagcucctccug

SEQ ID NO: 41525 - DNA, 28 bp, Artificial Sequence
  Synthetic
tgccactgctgaugtactttattaacut

SEQ ID NO: 41526 - DNA, 28 bp, Artificial Sequence
  Synthetic
aatgtttuccagagacaaagtugcaaaa

SEQ ID NO: 41527 - DNA, 25 bp, Artificial Sequence
  Synthetic
ccacagaagccucatatgaagaugg

SEQ ID NO: 41528 - DNA, 27 bp, Artificial Sequence
  Synthetic
cccaaatataccucaacagggatuacc

SEQ ID NO: 41529 - DNA, 29 bp, Artificial Sequence
  Synthetic
gttccacaaacatucagccctttataaut

SEQ ID NO: 41530 - DNA, 25 bp, Artificial Sequence
  Synthetic
cccaacaggtauatgaggagatcug

SEQ ID NO: 41531 - DNA, 25 bp, Artificial Sequence
  Synthetic
agacgtttccugtttgacctttuct

SEQ ID NO: 41532 - DNA, 24 bp, Artificial Sequence
  Synthetic
gaataagcucaggacaagtugcac

SEQ ID NO: 41533 - DNA, 28 bp, Artificial Sequence
  Synthetic
gtatcatccatugcccttttcttgatut

SEQ ID NO: 41534 - DNA, 21 bp, Artificial Sequence
  Synthetic
ctccccgacauttgcttgtug

SEQ ID NO: 41535 - DNA, 24 bp, Artificial Sequence
  Synthetic
cattgcatugaacacgtgcatuag

SEQ ID NO: 41536 - DNA, 23 bp, Artificial Sequence
  Synthetic
ccttattcucaccatcccucact

SEQ ID NO: 41537 - DNA, 20 bp, Artificial Sequence
  Synthetic
cagutgttctcaugcagccg

SEQ ID NO: 41538 - DNA, 21 bp, Artificial Sequence
  Synthetic
ccccacagaccugacttcuct

SEQ ID NO: 41539 - DNA, 19 bp, Artificial Sequence
  Synthetic
ggttcucccgaaugcggaa

SEQ ID NO: 41540 - DNA, 18 bp, Artificial Sequence
  Synthetic
cccctguctgcttggugc

SEQ ID NO: 41541 - DNA, 19 bp, Artificial Sequence
  Synthetic
gagtcgucctcgtcguaca

SEQ ID NO: 41542 - DNA, 20 bp, Artificial Sequence
  Synthetic
tgggacgugcagcattcuaa

SEQ ID NO: 41543 - DNA, 19 bp, Artificial Sequence
  Synthetic
cttgtguaccgccucacca

SEQ ID NO: 41544 - DNA, 22 bp, Artificial Sequence
  Synthetic
gggaagaggugtgctacacaug

SEQ ID NO: 41545 - DNA, 22 bp, Artificial Sequence
  Synthetic
acacgutgaaguggagcaagag

SEQ ID NO: 41546 - DNA, 20 bp, Artificial Sequence
  Synthetic
ctggctaaggugttccccug

SEQ ID NO: 41547 - DNA, 23 bp, Artificial Sequence
  Synthetic
atgtagtgaagutcggcacacut

SEQ ID NO: 41548 - DNA, 19 bp, Artificial Sequence
  Synthetic
gctggtgcugttccctguc

SEQ ID NO: 41549 - DNA, 18 bp, Artificial Sequence
  Synthetic
ggcgttuccagggctuac

SEQ ID NO: 41550 - DNA, 19 bp, Artificial Sequence
  Synthetic
gctgagugggctacgtcug

SEQ ID NO: 41551 - DNA, 22 bp, Artificial Sequence
  Synthetic
ctcagaugtgctgtugagacct

SEQ ID NO: 41552 - DNA, 20 bp, Artificial Sequence
  Synthetic
caagccacccauctccucag

SEQ ID NO: 41553 - DNA, 18 bp, Artificial Sequence
  Synthetic
tggccuctgtcuccccag

SEQ ID NO: 41554 - DNA, 18 bp, Artificial Sequence
  Synthetic
caaggcgaugcaggucca

SEQ ID NO: 41555 - DNA, 17 bp, Artificial Sequence
  Synthetic
ccctgcagcuggcctua

SEQ ID NO: 41556 - DNA, 23 bp, Artificial Sequence
  Synthetic
ctcatcgtggaguacgccaaaua

SEQ ID NO: 41557 - DNA, 19 bp, Artificial Sequence
  Synthetic
gugcagagccataugcacg

SEQ ID NO: 41558 - DNA, 24 bp, Artificial Sequence
  Synthetic
ggttactgaaagcucagggauagg

SEQ ID NO: 41559 - DNA, 27 bp, Artificial Sequence
  Synthetic
tgtataagggugtttctgtaaccucca

SEQ ID NO: 41560 - DNA, 21 bp, Artificial Sequence
  Synthetic
ctggcccugcttggatcauat

SEQ ID NO: 41561 - DNA, 23 bp, Artificial Sequence
  Synthetic
ctttcagcutgtgggaatuggac

SEQ ID NO: 41562 - DNA, 24 bp, Artificial Sequence
  Synthetic
tccctuccacatggatugaaaaca

SEQ ID NO: 41563 - DNA, 32 bp, Artificial Sequence; identical to SEQ ID NO: 29329
  Synthetic

SEQ ID NO: 41564 - DNA, 29 bp, Artificial Sequence
  Synthetic
ggcaaaattaauggacacgtttgatagut

SEQ ID NO: 41565 - DNA, 23 bp, Artificial Sequence
  Synthetic
gtctgcuaggagggaaaaucacc

SEQ ID NO: 41566 - DNA, 19 bp, Artificial Sequence
  Synthetic
gaagcgcuccgggtagaut

SEQ ID NO: 41567 - DNA, 20 bp, Artificial Sequence
  Synthetic
cgacuggagaaagcaagcug

SEQ ID NO: 41568 - DNA, 17 bp, Artificial Sequence
  Synthetic
caccccutccggcucac

SEQ ID NO: 41569 - DNA, 17 bp, Artificial Sequence
  Synthetic
cggtgcugtcccuggat

SEQ ID NO: 41570 - DNA, 27 bp, Artificial Sequence
  Synthetic
cagaacaauacagatacuagggaccaa

SEQ ID NO: 41571 - DNA, 22 bp, Artificial Sequence
  Synthetic
ctcttccugaactgctccucag

SEQ ID NO: 41572 - DNA, 22 bp, Artificial Sequence
  Synthetic
gctgtcaggaugggactgttug

SEQ ID NO: 41573 - DNA, 23 bp, Artificial Sequence
  Synthetic
gutatgagcuaggagcaccaagg

SEQ ID NO: 41574 - DNA, 28 bp, Artificial Sequence
  Synthetic
ccattttgccugatcaagttacaauaaa

SEQ ID NO: 41575 - DNA, 22 bp, Artificial Sequence
  Synthetic
gguaggaggagaagaguccaua

SEQ ID NO: 41576 - DNA, 21 bp, Artificial Sequence
  Synthetic
ccaagcutacctgugaaggct

SEQ ID NO: 41577 - DNA, 26 bp, Artificial Sequence
  Synthetic
tcgttggaagccautttgactatcut

SEQ ID NO: 41578 - DNA, 18 bp, Artificial Sequence
  Synthetic
gacaggugctagggcugt

SEQ ID NO: 41579 - DNA, 17 bp, Artificial Sequence
  Synthetic
gccaccuggacggctua

SEQ ID NO: 41580 - DNA, 18 bp, Artificial Sequence
  Synthetic
cctcaggaggutgccuct

SEQ ID NO: 41581 - DNA, 24 bp, Artificial Sequence
  Synthetic
ctcaaaggagacutcggttaucct

SEQ ID NO: 41582 - DNA, 30 bp, Artificial Sequence; identical to SEQ ID NO: 29348
  Synthetic

SEQ ID NO: 41583 - DNA, 22 bp, Artificial Sequence
  Synthetic
tccctccaggaugcttcuagac

SEQ ID NO: 41584 - DNA, 22 bp, Artificial Sequence
  Synthetic
cctcugaccaccagatgcttug

SEQ ID NO: 41585 - DNA, 21 bp, Artificial Sequence
  Synthetic
tcaagugcagtgttgugaggt

SEQ ID NO: 41586 - DNA, 21 bp, Artificial Sequence
  Synthetic
gcatuccagaacaagcagcuc

SEQ ID NO: 41587 - DNA, 24 bp, Artificial Sequence
  Synthetic
agaagtctcuttgcagctgugaaa

SEQ ID NO: 41588 - DNA, 22 bp, Artificial Sequence
  Synthetic
gcctacugagagcaagccatug

SEQ ID NO: 41589 - DNA, 21 bp, Artificial Sequence
  Synthetic
cctaacacuccggctctgugt

SEQ ID NO: 41590 - DNA, 30 bp, Artificial Sequence; identical to SEQ ID NO: 29356
  Synthetic

SEQ ID NO: 41591 - DNA, 23 bp, Artificial Sequence
  Synthetic
ggcugaaaagcacagtugaacag

SEQ ID NO: 41592 - DNA, 27 bp, Artificial Sequence
  Synthetic
agtagaaaauggcccctttgataaugt

SEQ ID NO: 41593 - DNA, 23 bp, Artificial Sequence
  Synthetic
gtcagagaaaccguctucaccat

SEQ ID NO: 41594 - DNA, 24 bp, Artificial Sequence
  Synthetic
tcctcccttucaagtgtcacttug

SEQ ID NO: 41595 - DNA, 24 bp, Artificial Sequence
  Synthetic
gtagtagcgaaagucagtcuggag

SEQ ID NO: 41596 - DNA, 25 bp, Artificial Sequence
  Synthetic
ctggtccacuttcttcttcttcuga

SEQ ID NO: 41597 - DNA, 21 bp, Artificial Sequence
  Synthetic
aggagagtuccaccccugaat

SEQ ID NO: 41598 - DNA, 26 bp, Artificial Sequence
  Synthetic
tgattctacagugctttctgttgcut

SEQ ID NO: 41599 - DNA, 23 bp, Artificial Sequence
  Synthetic
gcagcugagcctacauacacaac

SEQ ID NO: 41600 - DNA, 23 bp, Artificial Sequence
  Synthetic
gctgaaatgtuctacagccgcua

SEQ ID NO: 41601 - DNA, 21 bp, Artificial Sequence
  Synthetic
gccgucgattgtuaccaccag

SEQ ID NO: 41602 - DNA, 27 bp, Artificial Sequence
  Synthetic
aaaatctgaagaugtacccatgcucat

SEQ ID NO: 41603 - DNA, 28 bp, Artificial Sequence
  Synthetic
tgttttgagaatcauggaattctaggug

SEQ ID NO: 41604 - DNA, 26 bp, Artificial Sequence
  Synthetic
tccccttgtttugttcagatgtgaut

SEQ ID NO: 41605 - DNA, 24 bp, Artificial Sequence
  Synthetic
acagtgtguaaaacagacccucag

SEQ ID NO: 41606 - DNA, 23 bp, Artificial Sequence
  Synthetic
gaaatgaagcugaaggaggugga

SEQ ID NO: 41607 - DNA, 29 bp, Artificial Sequence
  Synthetic
ctcctgacatttcucctttttctctttut

SEQ ID NO: 41608 - DNA, 23 bp, Artificial Sequence
  Synthetic
ggcagaaggagagaugtttggug

SEQ ID NO: 41609 - DNA, 24 bp, Artificial Sequence
  Synthetic
ttgccaactguttcaagaactgug

SEQ ID NO: 41610 - DNA, 27 bp, Artificial Sequence
  Synthetic
aatttgcctctucagttgtaagcaaug

SEQ ID NO: 41611 - DNA, 24 bp, Artificial Sequence
  Synthetic
caagccaagaguaagtctcugagg

SEQ ID NO: 41612 - DNA, 29 bp, Artificial Sequence
  Synthetic
aaatgtgaattttcutgcagacttcagut

SEQ ID NO: 41613 - DNA, 28 bp, Artificial Sequence
  Synthetic
gtgtcacaactugtttccttacattuca

SEQ ID NO: 41614 - DNA, 24 bp, Artificial Sequence
  Synthetic
acccaactacutctcagagtucct

SEQ ID NO: 41615 - DNA, 30 bp, Artificial Sequence; identical to SEQ ID NO: 29381
  Synthetic

SEQ ID NO: 41616 - DNA, 22 bp, Artificial Sequence
  Synthetic
aaggcccctuctgtgtatccua

SEQ ID NO: 41617 - DNA, 31 bp, Artificial Sequence; identical to SEQ ID NO: 29383
  Synthetic

SEQ ID NO: 41618 - DNA, 23 bp, Artificial Sequence
  Synthetic
gggtcaatugcatagacagucaa

SEQ ID NO: 41619 - DNA, 28 bp, Artificial Sequence
  Synthetic
ggactgtcatguttgtactttgttugat

SEQ ID NO: 41620 - DNA, 25 bp, Artificial Sequence
  Synthetic
ctgaaaacacugacctatggcuagt

SEQ ID NO: 41621 - DNA, 31 bp, Artificial Sequence; identical to SEQ ID NO: 29387
  Synthetic

SEQ ID NO: 41622 - DNA, 23 bp, Artificial Sequence
  Synthetic
tgcaaacuacaggcttacagcut

SEQ ID NO: 41623 - DNA, 22 bp, Artificial Sequence
  Synthetic
tgcatcgtutcttgtccuccag

SEQ ID NO: 41624 - DNA, 25 bp, Artificial Sequence
  Synthetic
gactcgaaguacatagcttgtccug

SEQ ID NO: 41625 - DNA, 27 bp, Artificial Sequence
  Synthetic
agtgtttttgaaaucacagtgccttut

SEQ ID NO: 41626 - DNA, 28 bp, Artificial Sequence
  Synthetic
acatttcgugtatttcaaaaucggacag

SEQ ID NO: 41627 - DNA, 26 bp, Artificial Sequence
  Synthetic
tgtgctgtuacgctgttcttactuat

SEQ ID NO: 41628 - DNA, 30 bp, Artificial Sequence; identical to SEQ ID NO: 29394
  Synthetic

SEQ ID NO: 41629 - DNA, 28 bp, Artificial Sequence
  Synthetic
tcattgcactgugttttaacttgguaac

SEQ ID NO: 41630 - DNA, 22 bp, Artificial Sequence
  Synthetic
gcaggcaaccagaagucatcuc

SEQ ID NO: 41631 - DNA, 31 bp, Artificial Sequence; identical to SEQ ID NO: 29397
  Synthetic

SEQ ID NO: 41632 - DNA, 31 bp, Artificial Sequence; identical to SEQ ID NO: 29398
  Synthetic

SEQ ID NO: 41633 - DNA, 26 bp, Artificial Sequence
  Synthetic
tcaccaattcaacauacactgtccut

SEQ ID NO: 41634 - DNA, 22 bp, Artificial Sequence
  Synthetic
ccauctgtugccacaacaacaa

SEQ ID NO: 41635 - DNA, 27 bp, Artificial Sequence
  Synthetic
catttacaguagcccgtcaaaactuac

SEQ ID NO: 41636 - DNA, 24 bp, Artificial Sequence
  Synthetic
ggcttcttctuccaccacagauaa

SEQ ID NO: 41637 - DNA, 31 bp, Artificial Sequence; identical to SEQ ID NO: 29403
  Synthetic

SEQ ID NO: 41638 - DNA, 22 bp, Artificial Sequence
  Synthetic
acaaacagcugaaagcctcuga

SEQ ID NO: 41639 - DNA, 23 bp, Artificial Sequence
  Synthetic
tgagtgggcgccauatcaatuac

SEQ ID NO: 41640 - DNA, 24 bp, Artificial Sequence
  Synthetic
gataaaagaatacutgccgcgcut

SEQ ID NO: 41641 - DNA, 29 bp, Artificial Sequence
  Synthetic
gctcagggagacutcatcatcaauaaaac

SEQ ID NO: 41642 - DNA, 29 bp, Artificial Sequence
  Synthetic
ttcttcatgagcauatcgtataaugcaca

SEQ ID NO: 41643 - DNA, 28 bp, Artificial Sequence
  Synthetic
cgtcaatatucaagtgatggaugcaaat

SEQ ID NO: 41644 - DNA, 30 bp, Artificial Sequence; identical to SEQ ID NO: 29410
  Synthetic

SEQ ID NO: 41645 - DNA, 23 bp, Artificial Sequence
  Synthetic
aaagacccagagcutcaccttut

SEQ ID NO: 41646 - DNA, 28 bp, Artificial Sequence
  Synthetic
ctcttctctagcutatgtagccatauct

SEQ ID NO: 41647 - DNA, 28 bp, Artificial Sequence
  Synthetic
agttatcaaggcuatatcctggaatcug

SEQ ID NO: 41648 - DNA, 26 bp, Artificial Sequence
  Synthetic
cataaaactgccuacagtagcgtcua

SEQ ID NO: 41649 - DNA, 23 bp, Artificial Sequence
  Synthetic
ccauatgcatccuaggacagcag

SEQ ID NO: 41650 - DNA, 29 bp, Artificial Sequence
  Synthetic
tccttggaatugagagaatttgttacugt

SEQ ID NO: 41651 - DNA, 28 bp, Artificial Sequence
  Synthetic
gcggctgaaugaaactctcttaatttut

SEQ ID NO: 41652 - DNA, 20 bp, Artificial Sequence
  Synthetic
cggcaaucacgagtgttugg

SEQ ID NO: 41653 - DNA, 26 bp, Artificial Sequence
  Synthetic
ctcctggctatugtgcctaatttcua

SEQ ID NO: 41654 - DNA, 29 bp, Artificial Sequence
  Synthetic
tcttatcttcatagutgagcctcttccut

SEQ ID NO: 41655 - DNA, 28 bp, Artificial Sequence
  Synthetic
gcatgucatctctaactuccaagaggat

SEQ ID NO: 41656 - DNA, 31 bp, Artificial Sequence; identical to SEQ ID NO: 29422
  Synthetic

SEQ ID NO: 41657 - DNA, 25 bp, Artificial Sequence
  Synthetic
accgatgaacauacactccattgug

SEQ ID NO: 41658 - DNA, 29 bp, Artificial Sequence
  Synthetic
tcactaacatctcuatccagaactctucc

SEQ ID NO: 41659 - DNA, 25 bp, Artificial Sequence
  Synthetic
caggtacaautctgguggacaacat

SEQ ID NO: 41660 - DNA, 21 bp, Artificial Sequence
  Synthetic
ctggctcgcuctaaaggucaa

SEQ ID NO: 41661 - DNA, 31 bp, Artificial Sequence; identical to SEQ ID NO: 29427
  Synthetic

SEQ ID NO: 41662 - DNA, 23 bp, Artificial Sequence
  Synthetic
cctcacccugtgtcaccttauag

SEQ ID NO: 41663 - DNA, 23 bp, Artificial Sequence
  Synthetic
ccttcacttgugggaagggatug

SEQ ID NO: 41664 - DNA, 18 bp, Artificial Sequence
  Synthetic
accucagcaccgccuaac

SEQ ID NO: 41665 - DNA, 20 bp, Artificial Sequence
  Synthetic
ctctggccucttccacccua

SEQ ID NO: 41666 - DNA, 21 bp, Artificial Sequence
  Synthetic
ggctcacccutgtacttgcut

SEQ ID NO: 41667 - DNA, 21 bp, Artificial Sequence
  Synthetic
cggatcacugtgacgauaccg

SEQ ID NO: 41668 - DNA, 22 bp, Artificial Sequence
  Synthetic
cactcaaccuaaggctgtgugt

SEQ ID NO: 41669 - DNA, 22 bp, Artificial Sequence
  Synthetic
ccctcugagaagggacttcuga

SEQ ID NO: 41670 - DNA, 22 bp, Artificial Sequence
  Synthetic
ctggtcacaccugaatgctuct

SEQ ID NO: 41671 - DNA, 20 bp, Artificial Sequence
  Synthetic
gaggttggcauccgaguagg

SEQ ID NO: 41672 - DNA, 23 bp, Artificial Sequence
  Synthetic
gagttcaacagcuccgaguacag

SEQ ID NO: 41673 - DNA, 30 bp, Artificial Sequence; identical to SEQ ID NO: 29439
  Synthetic

SEQ ID NO: 41674 - DNA, 23 bp, Artificial Sequence
  Synthetic
gcaaaggcauggagaggactuac

SEQ ID NO: 41675 - DNA, 23 bp, Artificial Sequence
  Synthetic
ggccggtugtcattttcatugat

SEQ ID NO: 41676 - DNA, 22 bp, Artificial Sequence
  Synthetic
acccagagggautttguccaag

SEQ ID NO: 41677 - DNA, 22 bp, Artificial Sequence
  Synthetic
ggcagaaaaccagugtccucag

SEQ ID NO: 41678 - DNA, 25 bp, Artificial Sequence
  Synthetic
cccaucaacaagcctgtttuaaacc

SEQ ID NO: 41679 - DNA, 20 bp, Artificial Sequence
  Synthetic
gcacgttgucgttgacaucc

SEQ ID NO: 41680 - DNA, 20 bp, Artificial Sequence
  Synthetic
gtgaacagggccaguctucc

SEQ ID NO: 41681 - DNA, 20 bp, Artificial Sequence
  Synthetic
gagttcugccccacaccuac

SEQ ID NO: 41682 - DNA, 20 bp, Artificial Sequence
  Synthetic
ctcctgcaaccugtctgugt

SEQ ID NO: 41683 - DNA, 21 bp, Artificial Sequence
  Synthetic
cccacaauttgtgugcagagc

SEQ ID NO: 41684 - DNA, 20 bp, Artificial Sequence
  Synthetic
acccactuctctctcuggca

SEQ ID NO: 41685 - DNA, 19 bp, Artificial Sequence
  Synthetic
ggguccagagguacaagca

SEQ ID NO: 41686 - DNA, 19 bp, Artificial Sequence
  Synthetic
ccuccccaggaccaacguc

SEQ ID NO: 41687 - DNA, 22 bp, Artificial Sequence
  Synthetic
ctgtagaacutgttggguggct

SEQ ID NO: 41688 - DNA, 22 bp, Artificial Sequence
  Synthetic
tctctugcacccatctuaccct

SEQ ID NO: 41689 - DNA, 28 bp, Artificial Sequence
  Synthetic
tggtaggaaugagatgatagagacucac

SEQ ID NO: 41690 - DNA, 21 bp, Artificial Sequence
  Synthetic
acutcctcaucaacagcagca

SEQ ID NO: 41691 - DNA, 19 bp, Artificial Sequence
  Synthetic
gacatgggcucccctcuac

SEQ ID NO: 41692 - DNA, 23 bp, Artificial Sequence
  Synthetic
gtgtacaaugtgtctgtguccga

SEQ ID NO: 41693 - DNA, 21 bp, Artificial Sequence
  Synthetic
acctagtcuggctgtccauct

SEQ ID NO: 41694 - DNA, 21 bp, Artificial Sequence
  Synthetic
ggagtgugcaaagucacagga

SEQ ID NO: 41695 - DNA, 24 bp, Artificial Sequence
  Synthetic
tcatagctgcuctgcagaaagaug

SEQ ID NO: 41696 - DNA, 28 bp, Artificial Sequence
  Synthetic
ggaaggaaaggaacuctaaaaacctcut

SEQ ID NO: 41697 - DNA, 21 bp, Artificial Sequence
  Synthetic
cttuggcagccuagagaagct

SEQ ID NO: 41698 - DNA, 17 bp, Artificial Sequence
  Synthetic
ggctucccagccuccac

SEQ ID NO: 41699 - DNA, 18 bp, Artificial Sequence
  Synthetic
aatgggauccccggctuc

SEQ ID NO: 41700 - DNA, 25 bp, Artificial Sequence
  Synthetic
gaautacctggacuacgagaccaag

SEQ ID NO: 41701 - DNA, 23 bp, Artificial Sequence
  Synthetic
gttgaggttgucgatggaguagg

SEQ ID NO: 41702 - DNA, 21 bp, Artificial Sequence
  Synthetic
cagggtuaacaagggugcgat

SEQ ID NO: 41703 - DNA, 23 bp, Artificial Sequence
  Synthetic
aggacatgggutaggaagtguca

SEQ ID NO: 41704 - DNA, 19 bp, Artificial Sequence
  Synthetic
cttgaccuggccacctcuc

SEQ ID NO: 41705 - DNA, 20 bp, Artificial Sequence
  Synthetic
ccagtgguctctcaguccaa

SEQ ID NO: 41706 - DNA, 21 bp, Artificial Sequence
  Synthetic
cagaatgacugctctccugct

SEQ ID NO: 41707 - DNA, 21 bp, Artificial Sequence
  Synthetic
caccagguggtagaagctcug

SEQ ID NO: 41708 - DNA, 22 bp, Artificial Sequence
  Synthetic
aaggacgugacccactctttuc

SEQ ID NO: 41709 - DNA, 20 bp, Artificial Sequence
  Synthetic
aggtgtugacgatgtugcct

SEQ ID NO: 41710 - DNA, 22 bp, Artificial Sequence
  Synthetic
ctaccaccccuagatccaucct

SEQ ID NO: 41711 - DNA, 21 bp, Artificial Sequence
  Synthetic
gctttctgggucccatcctuc

SEQ ID NO: 41712 - DNA, 19 bp, Artificial Sequence
  Synthetic
ctacctucccccgggacua

SEQ ID NO: 41713 - DNA, 22 bp, Artificial Sequence
  Synthetic
tcccttcttaucctccccugag

SEQ ID NO: 41714 - DNA, 23 bp, Artificial Sequence
  Synthetic
gagtttgtgauctctcctgugga

SEQ ID NO: 41715 - DNA, 22 bp, Artificial Sequence
  Synthetic
cctctctuggcacaaggguaac

SEQ ID NO: 41716 - DNA, 21 bp, Artificial Sequence
  Synthetic
gaaccugcccatgaacaucac

SEQ ID NO: 41717 - DNA, 24 bp, Artificial Sequence
  Synthetic
gtccuctttttcacuggaaaccct

SEQ ID NO: 41718 - DNA, 18 bp, Artificial Sequence
  Synthetic
gccuacaacgugccccat

SEQ ID NO: 41719 - DNA, 22 bp, Artificial Sequence
  Synthetic
ttaggcauaagggaggtccuca

SEQ ID NO: 41720 - DNA, 22 bp, Artificial Sequence
  Synthetic
gcacccctuttctgtgtgttuc

SEQ ID NO: 41721 - DNA, 19 bp, Artificial Sequence
  Synthetic
ctaaaggugggccggtugt

SEQ ID NO: 41722 - DNA, 23 bp, Artificial Sequence
  Synthetic
agauctttcuggaagaggccact

SEQ ID NO: 41723 - DNA, 21 bp, Artificial Sequence
  Synthetic
tgtaggacucctgctcctcuc

SEQ ID NO: 41724 - DNA, 20 bp, Artificial Sequence
  Synthetic
ctgagccaggcacugtcaut

SEQ ID NO: 41725 - DNA, 18 bp, Artificial Sequence
  Synthetic
gggugcaggcccttguac

SEQ ID NO: 41726 - DNA, 21 bp, Artificial Sequence
  Synthetic
gcttggcugaggcuaaggaag

SEQ ID NO: 41727 - DNA, 19 bp, Artificial Sequence
  Synthetic
cctccaggauccgcuccat

SEQ ID NO: 41728 - DNA, 19 bp, Artificial Sequence
  Synthetic
agtgggagccuctgtguct

SEQ ID NO: 41729 - DNA, 17 bp, Artificial Sequence
  Synthetic
cuggacccagcctgugg

SEQ ID NO: 41730 - DNA, 28 bp, Artificial Sequence
  Synthetic
cttttgaatgautgaaggaccuaaagcc

SEQ ID NO: 41731 - DNA, 21 bp, Artificial Sequence
  Synthetic
ctttgctugttgccuccacaa

SEQ ID NO: 41732 - DNA, 24 bp, Artificial Sequence
  Synthetic
ggaaggatgtcucaaccagagcua

SEQ ID NO: 41733 - DNA, 22 bp, Artificial Sequence
  Synthetic
tgtcattgacgucgatgaccuc

SEQ ID NO: 41734 - DNA, 23 bp, Artificial Sequence
  Synthetic
ctcaggaccuaggagctgagaut

SEQ ID NO: 41735 - DNA, 20 bp, Artificial Sequence
  Synthetic
gctgagcaguctggaugagg

SEQ ID NO: 41736 - DNA, 23 bp, Artificial Sequence
  Synthetic
gtcttttccuctgactgtgcuct

SEQ ID NO: 41737 - DNA, 27 bp, Artificial Sequence
  Synthetic
cagtgtatauaggagagtgtgtgctug

SEQ ID NO: 41738 - DNA, 20 bp, Artificial Sequence
  Synthetic
gggcuagagaugacccacat

SEQ ID NO: 41739 - DNA, 19 bp, Artificial Sequence
  Synthetic
aggtguccagctgcgatug

SEQ ID NO: 41740 - DNA, 21 bp, Artificial Sequence
  Synthetic
cacttacaccaccugcctcut

SEQ ID NO: 41741 - DNA, 20 bp, Artificial Sequence
  Synthetic
tggcuagaggccactcaugt

SEQ ID NO: 41742 - DNA, 22 bp, Artificial Sequence
  Synthetic
cauctacatccugagggacgac

SEQ ID NO: 41743 - DNA, 20 bp, Artificial Sequence
  Synthetic
ctttgcacaaugccctguct

SEQ ID NO: 41744 - DNA, 22 bp, Artificial Sequence
  Synthetic
gggtugttgaacttuggaggct

SEQ ID NO: 41745 - DNA, 21 bp, Artificial Sequence
  Synthetic
cacguccaggacgttgtagut

SEQ ID NO: 41746 - DNA, 18 bp, Artificial Sequence
  Synthetic
ggccugagacgtcagcut

SEQ ID NO: 41747 - DNA, 19 bp, Artificial Sequence
  Synthetic
gcccagugaagggccugag

SEQ ID NO: 41748 - DNA, 20 bp, Artificial Sequence
  Synthetic
ctggaagggcaccugtcuac

SEQ ID NO: 41749 - DNA, 19 bp, Artificial Sequence
  Synthetic
gcccctugtgatgccugac

SEQ ID NO: 41750 - DNA, 21 bp, Artificial Sequence
  Synthetic
tcagatgtccgugtaccccut

SEQ ID NO: 41751 - DNA, 20 bp, Artificial Sequence
  Synthetic
ctttttgcaccauccgcugt

SEQ ID NO: 41752 - DNA, 17 bp, Artificial Sequence
  Synthetic
ggcauggcccugagcat

SEQ ID NO: 41753 - DNA, 19 bp, Artificial Sequence
  Synthetic
ggcccttcuggtcttccuc

SEQ ID NO: 41754 - DNA, 21 bp, Artificial Sequence
  Synthetic
ccctggagaucacagagcugt

SEQ ID NO: 41755 - DNA, 24 bp, Artificial Sequence
  Synthetic
tgaaggtagaggucagatgcugaa

SEQ ID NO: 41756 - DNA, 22 bp, Artificial Sequence
  Synthetic
tggctacaaautggacugcaac

SEQ ID NO: 41757 - DNA, 25 bp, Artificial Sequence
  Synthetic
caaagattgatgugcccttcctuac

SEQ ID NO: 41758 - DNA, 24 bp, Artificial Sequence
  Synthetic
cgacagtgccuaagacagaaatuc

SEQ ID NO: 41759 - DNA, 28 bp, Artificial Sequence
  Synthetic
gctgatcaacaaaugaaaagacaccuac

SEQ ID NO: 41760 - DNA, 27 bp, Artificial Sequence
  Synthetic
tgcacttaaaugcagattatttuggag

SEQ ID NO: 41761 - DNA, 27 bp, Artificial Sequence
  Synthetic
caccaaggaguctagtgatctacauga

SEQ ID NO: 41762 - DNA, 24 bp, Artificial Sequence
  Synthetic
gactattctcuccttcccgcttut

SEQ ID NO: 41763 - DNA, 23 bp, Artificial Sequence
  Synthetic
caccugtaaatactugccacagc

SEQ ID NO: 41764 - DNA, 19 bp, Artificial Sequence
  Synthetic
ccctguggacggtgactug

SEQ ID NO: 41765 - DNA, 22 bp, Artificial Sequence
  Synthetic
caucctcagaaaugcagcaagg

SEQ ID NO: 41766 - DNA, 25 bp, Artificial Sequence
  Synthetic
gtcttucaggagtcguaagaaagca

SEQ ID NO: 41767 - DNA, 26 bp, Artificial Sequence
  Synthetic
acctugaacacgagaaatgaugaaca

SEQ ID NO: 41768 - DNA, 27 bp, Artificial Sequence
  Synthetic
tgaaaattgucacgaaacaatgagcut

SEQ ID NO: 41769 - DNA, 20 bp, Artificial Sequence
  Synthetic
cagtgcccugagcaauagca

SEQ ID NO: 41770 - DNA, 26 bp, Artificial Sequence
  Synthetic
ctgtacctgtucacattcagacucaa

SEQ ID NO: 41771 - DNA, 22 bp, Artificial Sequence
  Synthetic
ctcccttcuttgtctcaugggt

SEQ ID NO: 41772 - DNA, 25 bp, Artificial Sequence
  Synthetic
gctacctagaautgaacacgucaga

SEQ ID NO: 41773 - DNA, 29 bp, Artificial Sequence
  Synthetic
cagcggtugacatctaatattugacaaaa

SEQ ID NO: 41774 - DNA, 21 bp, Artificial Sequence
  Synthetic
gcagacgucgttacaatcgug

SEQ ID NO: 41775 - DNA, 24 bp, Artificial Sequence
  Synthetic
ccattattgtuccctgatcugcaa

SEQ ID NO: 41776 - DNA, 21 bp, Artificial Sequence
  Synthetic
attcagatgguccggcaagut

SEQ ID NO: 41777 - DNA, 28 bp, Artificial Sequence
  Synthetic
cctcactagccutgtcaaaaatgaaaut

SEQ ID NO: 41778 - DNA, 22 bp, Artificial Sequence
  Synthetic
aaatgugctacacuggacacca

SEQ ID NO: 41779 - DNA, 21 bp, Artificial Sequence
  Synthetic
ggcaaagaaccacucaccugt

SEQ ID NO: 41780 - DNA, 27 bp, Artificial Sequence
  Synthetic
tggtatatcttguccagcaaccattut

SEQ ID NO: 41781 - DNA, 25 bp, Artificial Sequence
  Synthetic
ggcatttacgaaucacttctucagg

SEQ ID NO: 41782 - DNA, 29 bp, Artificial Sequence
  Synthetic
caagatggttgaaucccaagatguaaaaa

SEQ ID NO: 41783 - DNA, 28 bp, Artificial Sequence
  Synthetic
agttcccagcutgtatcctaauaagagt

SEQ ID NO: 41784 - DNA, 20 bp, Artificial Sequence
  Synthetic
gccaagaagugccccttcuc

SEQ ID NO: 41785 - DNA, 17 bp, Artificial Sequence
  Synthetic
cggcgcgugctguagat

SEQ ID NO: 41786 - DNA, 21 bp, Artificial Sequence
  Synthetic
tctggagugtaggauggcact

SEQ ID NO: 41787 - DNA, 22 bp, Artificial Sequence
  Synthetic
ccttcctcugcctatctgucca

SEQ ID NO: 41788 - DNA, 20 bp, Artificial Sequence
  Synthetic
cagggtcugaagccacucaa

SEQ ID NO: 41789 - DNA, 18 bp, Artificial Sequence
  Synthetic
gaaaccugggcgugacct

SEQ ID NO: 41790 - DNA, 19 bp, Artificial Sequence
  Synthetic
cucagcccuacaccatcuc

SEQ ID NO: 41791 - DNA, 19 bp, Artificial Sequence
  Synthetic
gtcctagtgugggctgcuc

SEQ ID NO: 41792 - DNA, 17 bp, Artificial Sequence
  Synthetic
ccgtggcugaccacugt

SEQ ID NO: 41793 - DNA, 18 bp, Artificial Sequence
  Synthetic
tggguctgcucacaggga

SEQ ID NO: 41794 - DNA, 22 bp, Artificial Sequence
  Synthetic
gggagctguagcttccauaagg

SEQ ID NO: 41795 - DNA, 18 bp, Artificial Sequence
  Synthetic
tggcaggugggctacuca

SEQ ID NO: 41796 - DNA, 22 bp, Artificial Sequence
  Synthetic
agatgctcacagucccccauat

SEQ ID NO: 41797 - DNA, 22 bp, Artificial Sequence
  Synthetic
aagggagaaacucactggctug

SEQ ID NO: 41798 - DNA, 19 bp, Artificial Sequence
  Synthetic
caggguggccacucacaat

SEQ ID NO: 41799 - DNA, 21 bp, Artificial Sequence
  Synthetic
cuccactaugggcaggagaga

SEQ ID NO: 41800 - DNA, 21 bp, Artificial Sequence
  Synthetic
ccaggtgugaactggtgtcug

SEQ ID NO: 41801 - DNA, 22 bp, Artificial Sequence
  Synthetic
caatggcccautctgacaucat

SEQ ID NO: 41802 - DNA, 18 bp, Artificial Sequence
  Synthetic
tcccutctcuggccccaa

SEQ ID NO: 41803 - DNA, 18 bp, Artificial Sequence
  Synthetic
gcagggcugggtgatgug

SEQ ID NO: 41804 - DNA, 17 bp, Artificial Sequence
  Synthetic
cugaccgugcccaggag

SEQ ID NO: 41805 - DNA, 17 bp, Artificial Sequence
  Synthetic
tgcugagcccccaagug

SEQ ID NO: 41806 - DNA, 31 bp, Artificial Sequence; identical to SEQ ID NO: 29572
  Synthetic

SEQ ID NO: 41807 - DNA, 21 bp, Artificial Sequence
  Synthetic
agtccaagcuaggccctttug

SEQ ID NO: 41808 - DNA, 21 bp, Artificial Sequence
  Synthetic
cuaaaggcacugagcacttuc

SEQ ID NO: 41809 - DNA, 22 bp, Artificial Sequence
  Synthetic
ggcactgacuctctctgccuat

SEQ ID NO: 41810 - DNA, 21 bp, Artificial Sequence
  Synthetic
ccaccagacutagggcctcua

SEQ ID NO: 41811 - DNA, 23 bp, Artificial Sequence
  Synthetic
agttcgauaagccagagaagcug

SEQ ID NO: 41812 - DNA, 18 bp, Artificial Sequence
  Synthetic
tguccctcugcaccccat

SEQ ID NO: 41813 - DNA, 17 bp, Artificial Sequence
  Synthetic
gctgtugcccccactug

SEQ ID NO: 41814 - DNA, 23 bp, Artificial Sequence
  Synthetic
ccatcctuacagggtcctugagt

SEQ ID NO: 41815 - DNA, 19 bp, Artificial Sequence
  Synthetic
gggctttcugtgccactuc

SEQ ID NO: 41816 - DNA, 20 bp, Artificial Sequence
  Synthetic
tcatctgguggctgtgggua

SEQ ID NO: 41817 - DNA, 20 bp, Artificial Sequence
  Synthetic
cggtgccugcttctctctut

SEQ ID NO: 41818 - DNA, 22 bp, Artificial Sequence
  Synthetic
cacactccuccttggactctuc

SEQ ID NO: 41819 - DNA, 22 bp, Artificial Sequence
  Synthetic
tggtggcugaggacagaacuaa

SEQ ID NO: 41820 - DNA, 21 bp, Artificial Sequence
  Synthetic
cctaucagaggccaggguaga

SEQ ID NO: 41821 - DNA, 23 bp, Artificial Sequence
  Synthetic
gagctatguggaccaacactgut

SEQ ID NO: 41822 - DNA, 24 bp, Artificial Sequence
  Synthetic
gtacaccaaacugcacatugcaaa

SEQ ID NO: 41823 - DNA, 23 bp, Artificial Sequence
  Synthetic
cctatgtcacaccugtgttccuc

SEQ ID NO: 41824 - DNA, 20 bp, Artificial Sequence
  Synthetic
ggtccgaggugtctcuggaa

SEQ ID NO: 41825 - DNA, 25 bp, Artificial Sequence
  Synthetic
caaatgaguaactcttcctcuggct

SEQ ID NO: 41826 - DNA, 21 bp, Artificial Sequence
  Synthetic
cagtctctuggccacctucag

SEQ ID NO: 41827 - DNA, 23 bp, Artificial Sequence
  Synthetic
ccaaatcacuctctgcctgugaa

SEQ ID NO: 41828 - DNA, 21 bp, Artificial Sequence
  Synthetic
cugugagaagaucagcaacga

SEQ ID NO: 41829 - DNA, 21 bp, Artificial Sequence
  Synthetic
cugattcacccucagagggat

SEQ ID NO: 41830 - DNA, 23 bp, Artificial Sequence
  Synthetic
ttctagcagaaccuttgcaucca

SEQ ID NO: 41831 - DNA, 21 bp, Artificial Sequence
  Synthetic
cgtttgtugctgccttuccag

SEQ ID NO: 41832 - DNA, 20 bp, Artificial Sequence
  Synthetic
cccaagggaacutgcacuca

SEQ ID NO: 41833 - DNA, 23 bp, Artificial Sequence
  Synthetic
gtgttccucctctttggugacag

SEQ ID NO: 41834 - DNA, 20 bp, Artificial Sequence
  Synthetic
agacagtucctccccuccac

SEQ ID NO: 41835 - DNA, 23 bp, Artificial Sequence
  Synthetic
tcugagaacaagccccugagaat

SEQ ID NO: 41836 - DNA, 21 bp, Artificial Sequence
  Synthetic
cctaccccutccctttgtuga

SEQ ID NO: 41837 - DNA, 22 bp, Artificial Sequence
  Synthetic
tgttggtcugtcccatttgugt

SEQ ID NO: 41838 - DNA, 25 bp, Artificial Sequence
  Synthetic
ctctatgttatucagtgggacaugg

SEQ ID NO: 41839 - DNA, 19 bp, Artificial Sequence
  Synthetic
cggugggacacgcctaaug

SEQ ID NO: 41840 - DNA, 22 bp, Artificial Sequence
  Synthetic
gutttgggcctuagaggaccat

SEQ ID NO: 41841 - DNA, 18 bp, Artificial Sequence
  Synthetic
cctctccccucccctcug

SEQ ID NO: 41842 - DNA, 21 bp, Artificial Sequence
  Synthetic
ccuacccccaagagauggaga

SEQ ID NO: 41843 - DNA, 21 bp, Artificial Sequence
  Synthetic
gtcacgcucctcccacuaaac

SEQ ID NO: 41844 - DNA, 21 bp, Artificial Sequence
  Synthetic
gaagatgttcucccaggcgua

SEQ ID NO: 41845 - DNA, 20 bp, Artificial Sequence
  Synthetic
cagaagccuctcccctcuga

SEQ ID NO: 41846 - DNA, 22 bp, Artificial Sequence
  Synthetic
cttccccucagcccatctagua

SEQ ID NO: 41847 - DNA, 27 bp, Artificial Sequence
  Synthetic
gaatgtgaaacacuctgctctcattuc

SEQ ID NO: 41848 - DNA, 24 bp, Artificial Sequence
  Synthetic
caagtacctguattgctcctcuca

SEQ ID NO: 41849 - DNA, 23 bp, Artificial Sequence
  Synthetic
attttgcuggcaatgacagucac

SEQ ID NO: 41850 - DNA, 21 bp, Artificial Sequence
  Synthetic
gaagacgucgttctcctuccc

SEQ ID NO: 41851 - DNA, 21 bp, Artificial Sequence
  Synthetic
gaattagcccucaggcacuct

SEQ ID NO: 41852 - DNA, 20 bp, Artificial Sequence
  Synthetic
catccaccaguaggtgccut

SEQ ID NO: 41853 - DNA, 22 bp, Artificial Sequence
  Synthetic
ggtagggaguggtgagaagtug

SEQ ID NO: 41854 - DNA, 20 bp, Artificial Sequence
  Synthetic
gauggcgtgguccaagaact

SEQ ID NO: 41855 - DNA, 21 bp, Artificial Sequence
  Synthetic
cacatgaugcacacacgtcuc

SEQ ID NO: 41856 - DNA, 23 bp, Artificial Sequence
  Synthetic
cactttccugagtccucagacag

SEQ ID NO: 41857 - DNA, 20 bp, Artificial Sequence
  Synthetic
accctcutcctccuccaagt

SEQ ID NO: 41858 - DNA, 24 bp, Artificial Sequence
  Synthetic
ggtgatgaagaguaggaagacgug

SEQ ID NO: 41859 - DNA, 17 bp, Artificial Sequence
  Synthetic
atgccccuggccttcug

SEQ ID NO: 41860 - DNA, 20 bp, Artificial Sequence
  Synthetic
ccgaggcuttgtgtucacga

SEQ ID NO: 41861 - DNA, 20 bp, Artificial Sequence
  Synthetic
agagtggguactccccctug

SEQ ID NO: 41862 - DNA, 22 bp, Artificial Sequence
  Synthetic
ctggagaaagguggctgagaut

SEQ ID NO: 41863 - DNA, 21 bp, Artificial Sequence
  Synthetic
tgcaccauccaactgagtgug

SEQ ID NO: 41864 - DNA, 21 bp, Artificial Sequence
  Synthetic
cactccaaguggtcacctgut

SEQ ID NO: 41865 - DNA, 24 bp, Artificial Sequence
  Synthetic
tccctaaggccugttttcctcuaa

SEQ ID NO: 41866 - DNA, 21 bp, Artificial Sequence
  Synthetic
gcccagaaugcaccactauca

SEQ ID NO: 41867 - DNA, 22 bp, Artificial Sequence
  Synthetic
ttggatuccgaccattcauccc

SEQ ID NO: 41868 - DNA, 23 bp, Artificial Sequence
  Synthetic
tggtcugctcctcuagagacaac

SEQ ID NO: 41869 - DNA, 26 bp, Artificial Sequence
  Synthetic
tgggtccctgutaaactaactcctua

SEQ ID NO: 41870 - DNA, 20 bp, Artificial Sequence
  Synthetic
cagtccuccactggatugcc

SEQ ID NO: 41871 - DNA, 22 bp, Artificial Sequence
  Synthetic
cttcccttauctggccatguga

SEQ ID NO: 41872 - DNA, 27 bp, Artificial Sequence
  Synthetic
ggatagtagaacaugtccaaagggaug

SEQ ID NO: 41873 - DNA, 28 bp, Artificial Sequence
  Synthetic
ctctaagcagagugacaatuacagaact

SEQ ID NO: 41874 - DNA, 20 bp, Artificial Sequence
  Synthetic
attgtgucccagggttgcut

SEQ ID NO: 41875 - DNA, 30 bp, Artificial Sequence; identical to SEQ ID NO: 29641
  Synthetic

SEQ ID NO: 41876 - DNA, 19 bp, Artificial Sequence
  Synthetic
ctgaagcugggtgtcugca

SEQ ID NO: 41877 - DNA, 23 bp, Artificial Sequence
  Synthetic
ttcaccagctucctcctctttuc

SEQ ID NO: 41878 - DNA, 22 bp, Artificial Sequence
  Synthetic
gcacacugatgttcaugcacag

SEQ ID NO: 41879 - DNA, 29 bp, Artificial Sequence
  Synthetic
ccaacttttcuccaaatcaagaatucaca

SEQ ID NO: 41880 - DNA, 21 bp, Artificial Sequence
  Synthetic
ggagtgtguggcagagaucaa

SEQ ID NO: 41881 - DNA, 20 bp, Artificial Sequence
  Synthetic
ctggactgcugtggtctguc

SEQ ID NO: 41882 - DNA, 21 bp, Artificial Sequence
  Synthetic
gggaucacagtcugacccaat

SEQ ID NO: 41883 - DNA, 22 bp, Artificial Sequence
  Synthetic
ctgaaucccgagcacacattuc

SEQ ID NO: 41884 - DNA, 21 bp, Artificial Sequence
  Synthetic
gggugcatctcuagagcaagc

SEQ ID NO: 41885 - DNA, 23 bp, Artificial Sequence
  Synthetic
gttcctcaaacguctctcgcuaa

SEQ ID NO: 41886 - DNA, 19 bp, Artificial Sequence
  Synthetic
ctcccccggacuctgttug

SEQ ID NO: 41887 - DNA, 20 bp, Artificial Sequence
  Synthetic
catcaccgaccuctcctgug

SEQ ID NO: 41888 - DNA, 23 bp, Artificial Sequence
  Synthetic
gagcucctctgtcucagaacaac

SEQ ID NO: 41889 - DNA, 27 bp, Artificial Sequence
  Synthetic
gagctgtgattcugctattggatttuc

SEQ ID NO: 41890 - DNA, 21 bp, Artificial Sequence
  Synthetic
ggaattcucgggccactttuc

SEQ ID NO: 41891 - DNA, 19 bp, Artificial Sequence
  Synthetic
acgacucagcacctucgac

SEQ ID NO: 41892 - DNA, 28 bp, Artificial Sequence
  Synthetic
gctgcaaatauagggaagtaagtucaca

SEQ ID NO: 41893 - DNA, 27 bp, Artificial Sequence
  Synthetic
gcaatttcttttuccttgtggtcugat

SEQ ID NO: 41894 - DNA, 27 bp, Artificial Sequence
  Synthetic
ccagcuaacctggatauggacaaaaat

SEQ ID NO: 41895 - DNA, 26 bp, Artificial Sequence
  Synthetic
gtgtgtaggaaccuagttgtgtuagt

SEQ ID NO: 41896 - DNA, 18 bp, Artificial Sequence
  Synthetic
gtggccccaaggutguga

SEQ ID NO: 41897 - DNA, 19 bp, Artificial Sequence
  Synthetic
gccaggcuggtcucaaaca

SEQ ID NO: 41898 - DNA, 23 bp, Artificial Sequence
  Synthetic
gctgagucagaattgcttgaucc

SEQ ID NO: 41899 - DNA, 28 bp, Artificial Sequence
  Synthetic
accacatagtatguccctttaaagcaut

SEQ ID NO: 41900 - DNA, 24 bp, Artificial Sequence
  Synthetic
ctaggtuaacaaggccaaacucca

SEQ ID NO: 41901 - DNA, 28 bp, Artificial Sequence
  Synthetic
gaaggcccauttgtaagaatgtugaaaa

SEQ ID NO: 41902 - DNA, 31 bp, Artificial Sequence; identical to SEQ ID NO: 29668
  Synthetic

SEQ ID NO: 41903 - DNA, 23 bp, Artificial Sequence
  Synthetic
tgtaaagcgcaggauggagatut

SEQ ID NO: 41904 - DNA, 22 bp, Artificial Sequence
  Synthetic
tcagtuccaacccaaatgccut

SEQ ID NO: 41905 - DNA, 21 bp, Artificial Sequence
  Synthetic
caagtgctaguccactggcut

SEQ ID NO: 41906 - DNA, 20 bp, Artificial Sequence
  Synthetic
gccaccgcuatcacctucag

SEQ ID NO: 41907 - DNA, 25 bp, Artificial Sequence
  Synthetic
cutcaatggctauagagagaaccca

SEQ ID NO: 41908 - DNA, 20 bp, Artificial Sequence
  Synthetic
ggaaagagutgcugcaccag

SEQ ID NO: 41909 - DNA, 19 bp, Artificial Sequence
  Synthetic
cacatccaucggcgcttug

SEQ ID NO: 41910 - DNA, 27 bp, Artificial Sequence
  Synthetic
gatatcgugccttctgtauacaaaggt

SEQ ID NO: 41911 - DNA, 28 bp, Artificial Sequence
  Synthetic
gtctcaatacuggccaagattacaguaa

SEQ ID NO: 41912 - DNA, 25 bp, Artificial Sequence
  Synthetic
cttctagugaagagagatcgccuct

SEQ ID NO: 41913 - DNA, 21 bp, Artificial Sequence
  Synthetic
aggtttgccuctctccucaca

SEQ ID NO: 41914 - DNA, 26 bp, Artificial Sequence
  Synthetic
cggagcaaacagguttaaagacatug

SEQ ID NO: 41915 - DNA, 22 bp, Artificial Sequence
  Synthetic
gctaacctgucccacctgatut

SEQ ID NO: 41916 - DNA, 24 bp, Artificial Sequence
  Synthetic
gctctttguactgaagatguggca

SEQ ID NO: 41917 - DNA, 24 bp, Artificial Sequence
  Synthetic
ccaacggagaagautcagaugagg

SEQ ID NO: 41918 - DNA, 21 bp, Artificial Sequence
  Synthetic
tggatggcugcttgggtttua

SEQ ID NO: 41919 - DNA, 28 bp, Artificial Sequence
  Synthetic
gacactaccattuggtttgattttggut

SEQ ID NO: 41920 - DNA, 22 bp, Artificial Sequence
  Synthetic
actcccgcutatactgggcuat

SEQ ID NO: 41921 - DNA, 30 bp, Artificial Sequence; identical to SEQ ID NO: 29687
  Synthetic

SEQ ID NO: 41922 - DNA, 25 bp, Artificial Sequence
  Synthetic
cagtaagaaaugaagagagggcgut

SEQ ID NO: 41923 - DNA, 22 bp, Artificial Sequence
  Synthetic
cctctcctcuccctttccucag

SEQ ID NO: 41924 - DNA, 25 bp, Artificial Sequence
  Synthetic
ggcctgtgagucaactaaaaguagg

SEQ ID NO: 41925 - DNA, 17 bp, Artificial Sequence
  Synthetic
tccagcuggcgcttuga

SEQ ID NO: 41926 - DNA, 30 bp, Artificial Sequence; identical to SEQ ID NO: 29692
  Synthetic

SEQ ID NO: 41927 - DNA, 25 bp, Artificial Sequence
  Synthetic
aggctagaccutctctgtccattua

SEQ ID NO: 41928 - DNA, 22 bp, Artificial Sequence
  Synthetic
cttgaaccaugttugcccaaga

SEQ ID NO: 41929 - DNA, 24 bp, Artificial Sequence
  Synthetic
cttaaagccucccttcctctuact

SEQ ID NO: 41930 - DNA, 23 bp, Artificial Sequence
  Synthetic
agagagatucttcccauccacca

SEQ ID NO: 41931 - DNA, 25 bp, Artificial Sequence
  Synthetic
actccccaccucttcttcttttcua

SEQ ID NO: 41932 - DNA, 17 bp, Artificial Sequence
  Synthetic
caaguccgccggcucat

SEQ ID NO: 41933 - DNA, 22 bp, Artificial Sequence
  Synthetic
cagctgtctucggttctctcug

SEQ ID NO: 41934 - DNA, 18 bp, Artificial Sequence
  Synthetic
cgcuccccggcctactua

SEQ ID NO: 41935 - DNA, 18 bp, Artificial Sequence
  Synthetic
tgagcgccutcactgucc

SEQ ID NO: 41936 - DNA, 17 bp, Artificial Sequence
  Synthetic
ttcaggucccgcacguc

SEQ ID NO: 41937 - DNA, 17 bp, Artificial Sequence
  Synthetic
ggctuccacgtgtgucc

SEQ ID NO: 41938 - DNA, 22 bp, Artificial Sequence
  Synthetic
cccctacagccucccattuact

SEQ ID NO: 41939 - DNA, 23 bp, Artificial Sequence
  Synthetic
cagaugggcaatagctuccagaa

SEQ ID NO: 41940 - DNA, 21 bp, Artificial Sequence
  Synthetic
agagtcaacacuccctgctug

SEQ ID NO: 41941 - DNA, 24 bp, Artificial Sequence
  Synthetic
ccgaguagaaacacagatgtguct

SEQ ID NO: 41942 - DNA, 20 bp, Artificial Sequence
  Synthetic
agccccuggttggaagaaug

SEQ ID NO: 41943 - DNA, 18 bp, Artificial Sequence
  Synthetic
gagatgccuccccuccct

SEQ ID NO: 41944 - DNA, 18 bp, Artificial Sequence
  Synthetic
gtgagcugtgggtugggt

SEQ ID NO: 41945 - DNA, 22 bp, Artificial Sequence
  Synthetic
cattcaggcacutaccagguga

SEQ ID NO: 41946 - DNA, 23 bp, Artificial Sequence
  Synthetic
cctgagacaucagtccacuggat

SEQ ID NO: 41947 - DNA, 25 bp, Artificial Sequence
  Synthetic
cttagcuacccactctauacccaca

SEQ ID NO: 41948 - DNA, 20 bp, Artificial Sequence
  Synthetic
caggcccugccatattgugt

SEQ ID NO: 41949 - DNA, 26 bp, Artificial Sequence
  Synthetic
aatccuggagattcctaucagaggag

SEQ ID NO: 41950 - DNA, 21 bp, Artificial Sequence
  Synthetic
atgtgagugtctagcauggct

SEQ ID NO: 41951 - DNA, 24 bp, Artificial Sequence
  Synthetic
ctgattcaggagcugagtcaugaa

SEQ ID NO: 41952 - DNA, 21 bp, Artificial Sequence
  Synthetic
ccttcccucggatctgttugg

SEQ ID NO: 41953 - DNA, 21 bp, Artificial Sequence
  Synthetic
ggacgagcaacgutacucaag

SEQ ID NO: 41954 - DNA, 22 bp, Artificial Sequence
  Synthetic
ccttgactgugaggttgaccug

SEQ ID NO: 41955 - DNA, 22 bp, Artificial Sequence
  Synthetic
tctgacutggatcucaccccaa

SEQ ID NO: 41956 - DNA, 23 bp, Artificial Sequence
  Synthetic
ctggtuccacacacccatctuat

SEQ ID NO: 41957 - DNA, 26 bp, Artificial Sequence
  Synthetic
ctctgaactacautgtgtcttcugca

SEQ ID NO: 41958 - DNA, 18 bp, Artificial Sequence
  Synthetic
gacccacccuacccugga

SEQ ID NO: 41959 - DNA, 17 bp, Artificial Sequence
  Synthetic
gggtgtguggcccagug

SEQ ID NO: 41960 - DNA, 21 bp, Artificial Sequence
  Synthetic
gtccaagcccuaaagccucat

SEQ ID NO: 41961 - DNA, 25 bp, Artificial Sequence
  Synthetic
cttcaaauaccggtucaagaaggac

SEQ ID NO: 41962 - DNA, 19 bp, Artificial Sequence
  Synthetic
gcaagtgcugtggcctcut

SEQ ID NO: 41963 - DNA, 19 bp, Artificial Sequence
  Synthetic
agccaacccucatgcucac

SEQ ID NO: 41964 - DNA, 20 bp, Artificial Sequence
  Synthetic
gccacaccgagucagagaua

SEQ ID NO: 41965 - DNA, 20 bp, Artificial Sequence
  Synthetic
tggaacuggctgaccaugac

SEQ ID NO: 41966 - DNA, 19 bp, Artificial Sequence
  Synthetic
cctctccuctcccctcuga

SEQ ID NO: 41967 - DNA, 18 bp, Artificial Sequence
  Synthetic
ccuagacugcgggacaca

SEQ ID NO: 41968 - DNA, 20 bp, Artificial Sequence
  Synthetic
cagtgttgugctcaggguca

SEQ ID NO: 41969 - DNA, 23 bp, Artificial Sequence
  Synthetic
ctaatcccttuccagtcccucac

SEQ ID NO: 41970 - DNA, 19 bp, Artificial Sequence
  Synthetic
ccccagucgagacccugaa

SEQ ID NO: 41971 - DNA, 24 bp, Artificial Sequence
  Synthetic
ggcaagtcugtgaatacucagagg

SEQ ID NO: 41972 - DNA, 19 bp, Artificial Sequence
  Synthetic
tgccttcuagggctcucca

SEQ ID NO: 41973 - DNA, 17 bp, Artificial Sequence
  Synthetic
ctgtcgccccugcctut

SEQ ID NO: 41974 - DNA, 20 bp, Artificial Sequence
  Synthetic
ttttgagaccugcccuggac

SEQ ID NO: 41975 - DNA, 20 bp, Artificial Sequence
  Synthetic
cacgacucccatctgauccc

SEQ ID NO: 41976 - DNA, 19 bp, Artificial Sequence
  Synthetic
cttgttgcuggcgctgaug

SEQ ID NO: 41977 - DNA, 25 bp, Artificial Sequence
  Synthetic
tgctagcacaguatttacugagagg

SEQ ID NO: 41978 - DNA, 19 bp, Artificial Sequence
  Synthetic
aaggcctuggctatgguga

SEQ ID NO: 41979 - DNA, 18 bp, Artificial Sequence
  Synthetic
aguggacagggcccttug

SEQ ID NO: 41980 - DNA, 20 bp, Artificial Sequence
  Synthetic
cagtagagcuccgtctccuc

SEQ ID NO: 41981 - DNA, 21 bp, Artificial Sequence
  Synthetic
gagcctaccugcactgactut

SEQ ID NO: 41982 - DNA, 21 bp, Artificial Sequence
  Synthetic
gaaagagccggcuaaccuact

SEQ ID NO: 41983 - DNA, 20 bp, Artificial Sequence
  Synthetic
ctgattccaucccccaccug

SEQ ID NO: 41984 - DNA, 23 bp, Artificial Sequence
  Synthetic
ccaugggctgattuggaagaagg

SEQ ID NO: 41985 - DNA, 23 bp, Artificial Sequence
  Synthetic
tgucaacaactauggcaaaggct

SEQ ID NO: 41986 - DNA, 24 bp, Artificial Sequence
  Synthetic
ctaaaaggagggcugaatgaggua

SEQ ID NO: 41987 - DNA, 20 bp, Artificial Sequence
  Synthetic
cuggagagctucgagaaggc

SEQ ID NO: 41988 - DNA, 21 bp, Artificial Sequence
  Synthetic
ccaaggcaggucttgcaguag

SEQ ID NO: 41989 - DNA, 20 bp, Artificial Sequence
  Synthetic
gtccaaggcucagaguccag

SEQ ID NO: 41990 - DNA, 21 bp, Artificial Sequence
  Synthetic
cctttguccacacctgcaaug

SEQ ID NO: 41991 - DNA, 20 bp, Artificial Sequence
  Synthetic
tgattccugccccatgagug

SEQ ID NO: 41992 - DNA, 17 bp, Artificial Sequence
  Synthetic
ccatcucctcgcugcgt

SEQ ID NO: 41993 - DNA, 19 bp, Artificial Sequence
  Synthetic
gcagctccucgtgatccuc

SEQ ID NO: 41994 - DNA, 18 bp, Artificial Sequence
  Synthetic
cucatccgcuacgccaac

SEQ ID NO: 41995 - DNA, 20 bp, Artificial Sequence
  Synthetic
ggactttggcuccacccauc

SEQ ID NO: 41996 - DNA, 22 bp, Artificial Sequence
  Synthetic
cctaccacacaacaugttcugg

SEQ ID NO: 41997 - DNA, 23 bp, Artificial Sequence
  Synthetic
cccaaggcutctctttguaggaa

SEQ ID NO: 41998 - DNA, 23 bp, Artificial Sequence
  Synthetic
ctgatttcagggutcccaccuag

SEQ ID NO: 41999 - DNA, 23 bp, Artificial Sequence
  Synthetic
aagaagaacugcaggaacgugaa

SEQ ID NO: 42000 - DNA, 22 bp, Artificial Sequence
  Synthetic
tgtggaaauagcagcagcugag

SEQ ID NO: 42001 - DNA, 22 bp, Artificial Sequence
  Synthetic
gggaagguccatggtatggtut

SEQ ID NO: 42002 - DNA, 22 bp, Artificial Sequence
  Synthetic
cctgttggcugtggatgagaug

SEQ ID NO: 42003 - DNA, 26 bp, Artificial Sequence
  Synthetic
agtgctatuctaagttccuaggcaga

SEQ ID NO: 42004 - DNA, 21 bp, Artificial Sequence
  Synthetic
ctgcagucccatgaucaccat

SEQ ID NO: 42005 - DNA, 23 bp, Artificial Sequence
  Synthetic
gtagtagccuggcctctgauaca

SEQ ID NO: 42006 - DNA, 23 bp, Artificial Sequence
  Synthetic
gucacaggcauagacaccaaaga

SEQ ID NO: 42007 - DNA, 24 bp, Artificial Sequence
  Synthetic
tggttggtgautgttccaaaggut

SEQ ID NO: 42008 - DNA, 21 bp, Artificial Sequence
  Synthetic
cttcccttgcuctgagccuac

SEQ ID NO: 42009 - DNA, 21 bp, Artificial Sequence
  Synthetic
cagcautctggucagcacaac

SEQ ID NO: 42010 - DNA, 22 bp, Artificial Sequence
  Synthetic
tctcaacctutgccctccuact

SEQ ID NO: 42011 - DNA, 22 bp, Artificial Sequence
  Synthetic
gatcagtgucctgctggtguac

SEQ ID NO: 42012 - DNA, 20 bp, Artificial Sequence
  Synthetic
cagtgcuggacacucggaat

SEQ ID NO: 42013 - DNA, 22 bp, Artificial Sequence
  Synthetic
cctgctgccuggaatcttcuaa

SEQ ID NO: 42014 - DNA, 21 bp, Artificial Sequence
  Synthetic
cagcaggauggccatguagat

SEQ ID NO: 42015 - DNA, 19 bp, Artificial Sequence
  Synthetic
gcccaaggucatcgagugc

SEQ ID NO: 42016 - DNA, 23 bp, Artificial Sequence
  Synthetic
cgcttcugcaaggagaaagctua

SEQ ID NO: 42017 - DNA, 25 bp, Artificial Sequence
  Synthetic
ctggtaccugaagaccattgacauc

SEQ ID NO: 42018 - DNA, 25 bp, Artificial Sequence
  Synthetic
attaaggtcaugggaatacgctcug

SEQ ID NO: 42019 - DNA, 26 bp, Artificial Sequence
  Synthetic
tttgacttcaagcugttcttcaaugg

SEQ ID NO: 42020 - DNA, 23 bp, Artificial Sequence
  Synthetic
gggtgaaguttgcactttcuaca

SEQ ID NO: 42021 - DNA, 23 bp, Artificial Sequence
  Synthetic
ccaccatcaucttcgacaacugg

SEQ ID NO: 42022 - DNA, 22 bp, Artificial Sequence
  Synthetic
ccccugagagaaagggaugaga

SEQ ID NO: 42023 - DNA, 21 bp, Artificial Sequence
  Synthetic
caggctgcutgtgtgttucag

SEQ ID NO: 42024 - DNA, 23 bp, Artificial Sequence
  Synthetic
ctgtactggucacaagccaugat

SEQ ID NO: 42025 - DNA, 22 bp, Artificial Sequence
  Synthetic
tcucccauacagagcctctuag

SEQ ID NO: 42026 - DNA, 23 bp, Artificial Sequence
  Synthetic
ccagaagcaugacatggtctcuc

SEQ ID NO: 42027 - DNA, 21 bp, Artificial Sequence
  Synthetic
gtgtcccacggguaagcauat

SEQ ID NO: 42028 - DNA, 17 bp, Artificial Sequence
  Synthetic
ccugaagugcgcagcct

SEQ ID NO: 42029 - DNA, 17 bp, Artificial Sequence
  Synthetic
ggcggcacucacguaga

SEQ ID NO: 42030 - DNA, 20 bp, Artificial Sequence
  Synthetic
cagagcacauccgccaguat

SEQ ID NO: 42031 - DNA, 21 bp, Artificial Sequence
  Synthetic
tggagcuctaggtccuaagcc

SEQ ID NO: 42032 - DNA, 21 bp, Artificial Sequence
  Synthetic
gctttgccagugacacccuac

SEQ ID NO: 42033 - DNA, 21 bp, Artificial Sequence
  Synthetic
tgggtctautcctgcauccct

SEQ ID NO: 42034 - DNA, 20 bp, Artificial Sequence
  Synthetic
gggtacacugacgtcctcut

SEQ ID NO: 42035 - DNA, 22 bp, Artificial Sequence
  Synthetic
ctcaccctcauactgcaggtug

SEQ ID NO: 42036 - DNA, 22 bp, Artificial Sequence
  Synthetic
agtggcagccuagtcctctuag

SEQ ID NO: 42037 - DNA, 23 bp, Artificial Sequence
  Synthetic
cctucagagggauagaagtcaug

SEQ ID NO: 42038 - DNA, 19 bp, Artificial Sequence
  Synthetic
gtgccaguggctgaucact

SEQ ID NO: 42039 - DNA, 23 bp, Artificial Sequence
  Synthetic
ggaaggaaautcccaugagcaga

SEQ ID NO: 42040 - DNA, 25 bp, Artificial Sequence
  Synthetic
aatatgaccuggagagcattgacug

SEQ ID NO: 42041 - DNA, 28 bp, Artificial Sequence
  Synthetic
tcattagtccuattttgcagaugaggaa

SEQ ID NO: 42042 - DNA, 22 bp, Artificial Sequence
  Synthetic
acaagcucaacgccaacuacat

SEQ ID NO: 42043 - DNA, 24 bp, Artificial Sequence
  Synthetic
ggatatcttautcctgggcuggag

SEQ ID NO: 42044 - DNA, 17 bp, Artificial Sequence
  Synthetic
gcacagccccucccauc

SEQ ID NO: 42045 - DNA, 18 bp, Artificial Sequence
  Synthetic
ctccacgucacccuagcc

SEQ ID NO: 42046 - DNA, 24 bp, Artificial Sequence
  Synthetic
ggaatgauggagaccatccgaauc

SEQ ID NO: 42047 - DNA, 22 bp, Artificial Sequence
  Synthetic
cgcccauggtcctgauaagaaa

SEQ ID NO: 42048 - DNA, 21 bp, Artificial Sequence
  Synthetic
ggtggtccuagaggagaccut

SEQ ID NO: 42049 - DNA, 22 bp, Artificial Sequence
  Synthetic
acaccacacguacacctgtaug

SEQ ID NO: 42050 - DNA, 20 bp, Artificial Sequence
  Synthetic
ggtcaguctggaaugggaca

SEQ ID NO: 42051 - DNA, 19 bp, Artificial Sequence
  Synthetic
gcctugcgcaccagauagg

SEQ ID NO: 42052 - DNA, 22 bp, Artificial Sequence
  Synthetic
ggaatcccugcaacaacagcua

SEQ ID NO: 42053 - DNA, 21 bp, Artificial Sequence
  Synthetic
gccagcaaguggacaccuaag

SEQ ID NO: 42054 - DNA, 21 bp, Artificial Sequence
  Synthetic
ctccuggagcagauggaaagg

SEQ ID NO: 42055 - DNA, 20 bp, Artificial Sequence
  Synthetic
aggaucaacacaagcggugt

SEQ ID NO: 42056 - DNA, 29 bp, Artificial Sequence
  Synthetic
gacctctctgaguataaatttgccaagut

SEQ ID NO: 42057 - DNA, 20 bp, Artificial Sequence
  Synthetic
caccacccucatcacuacgg

SEQ ID NO: 42058 - DNA, 23 bp, Artificial Sequence
  Synthetic
ccatgagugatggcagugagaag

SEQ ID NO: 42059 - DNA, 26 bp, Artificial Sequence
  Synthetic
tataggaucctttttcugcagaggag

SEQ ID NO: 42060 - DNA, 22 bp, Artificial Sequence
  Synthetic
gggaacaccccuaacttuacct

SEQ ID NO: 42061 - DNA, 23 bp, Artificial Sequence
  Synthetic
acucagccaucaaaagacttuca

SEQ ID NO: 42062 - DNA, 18 bp, Artificial Sequence
  Synthetic
gggtgautcccccuccct

SEQ ID NO: 42063 - DNA, 20 bp, Artificial Sequence
  Synthetic
cctagcuccccttcccacuc

SEQ ID NO: 42064 - DNA, 19 bp, Artificial Sequence
  Synthetic
actuccaggccaccaaguc

SEQ ID NO: 42065 - DNA, 23 bp, Artificial Sequence
  Synthetic
accttgucaaacagggcaatgua

SEQ ID NO: 42066 - DNA, 23 bp, Artificial Sequence
  Synthetic
tccgttttcugtctgaacugacc

SEQ ID NO: 42067 - DNA, 23 bp, Artificial Sequence
  Synthetic
gtgaagaccucttugcggaagaa

SEQ ID NO: 42068 - DNA, 18 bp, Artificial Sequence
  Synthetic
ctgggccaaugcaugacc

SEQ ID NO: 42069 - DNA, 22 bp, Artificial Sequence
  Synthetic
ggactcctcucagcccttcuac

SEQ ID NO: 42070 - DNA, 20 bp, Artificial Sequence
  Synthetic
ctctcagugccttggtcucg

SEQ ID NO: 42071 - DNA, 22 bp, Artificial Sequence
  Synthetic
ctctgtcugtctgcatcuccat

SEQ ID NO: 42072 - DNA, 20 bp, Artificial Sequence
  Synthetic
ctgttcuccgtgttggucct

SEQ ID NO: 42073 - DNA, 19 bp, Artificial Sequence
  Synthetic
cagugccaggcagtccaua

SEQ ID NO: 42074 - DNA, 22 bp, Artificial Sequence
  Synthetic
ctcatcaucctggaccaugaca

SEQ ID NO: 42075 - DNA, 23 bp, Artificial Sequence
  Synthetic
cctattguacagctgugggaagt

SEQ ID NO: 42076 - DNA, 18 bp, Artificial Sequence
  Synthetic
ttgctgacgguccctgug

SEQ ID NO: 42077 - DNA, 18 bp, Artificial Sequence
  Synthetic
gcccaguggcacggauat

SEQ ID NO: 42078 - DNA, 19 bp, Artificial Sequence
  Synthetic
aggtccugtgacucccgat

SEQ ID NO: 42079 - DNA, 21 bp, Artificial Sequence
  Synthetic
gtaccucagggctttcuggag

SEQ ID NO: 42080 - DNA, 20 bp, Artificial Sequence
  Synthetic
gggttgtcugcctccaagug

SEQ ID NO: 42081 - DNA, 20 bp, Artificial Sequence
  Synthetic
gggcacugcagaccuagaag

SEQ ID NO: 42082 - DNA, 23 bp, Artificial Sequence
  Synthetic
ccaaggactuctgccagaacauc

SEQ ID NO: 42083 - DNA, 21 bp, Artificial Sequence
  Synthetic
cccagtucctctctctuccgt

SEQ ID NO: 42084 - DNA, 19 bp, Artificial Sequence
  Synthetic
ggacgugagcactcctcug

SEQ ID NO: 42085 - DNA, 21 bp, Artificial Sequence
  Synthetic
ggccaaaguacagcaacgcua

SEQ ID NO: 42086 - DNA, 20 bp, Artificial Sequence
  Synthetic
ggactcugagctctgagcug

SEQ ID NO: 42087 - DNA, 21 bp, Artificial Sequence
  Synthetic
ctctgagaagcccauggtgua

SEQ ID NO: 42088 - DNA, 19 bp, Artificial Sequence
  Synthetic
gccttctgugagggcaugt

SEQ ID NO: 42089 - DNA, 19 bp, Artificial Sequence
  Synthetic
cacuaggcccagcaggaug

SEQ ID NO: 42090 - DNA, 21 bp, Artificial Sequence
  Synthetic
cucacagccaugagcaaacag

SEQ ID NO: 42091 - DNA, 20 bp, Artificial Sequence
  Synthetic
catcccagagagaugccuca

SEQ ID NO: 42092 - DNA, 18 bp, Artificial Sequence
  Synthetic
cacgtguccccggtacuc

SEQ ID NO: 42093 - DNA, 21 bp, Artificial Sequence
  Synthetic
ccgttcugaccaauagacgac

SEQ ID NO: 42094 - DNA, 23 bp, Artificial Sequence
  Synthetic
ggaaatuccagtccctucaggat

SEQ ID NO: 42095 - DNA, 25 bp, Artificial Sequence
  Synthetic
cttccactccuttccagaaaacuca

SEQ ID NO: 42096 - DNA, 24 bp, Artificial Sequence
  Synthetic
actgcacuctctaagguaacaaca

SEQ ID NO: 42097 - DNA, 27 bp, Artificial Sequence
  Synthetic
gcaccacactcucctatctttactuac

SEQ ID NO: 42098 - DNA, 28 bp, Artificial Sequence
  Synthetic
gaggtgatcugaacttaaatctctuccc

SEQ ID NO: 42099 - DNA, 22 bp, Artificial Sequence
  Synthetic
acactaggcagucactgtucct

SEQ ID NO: 42100 - DNA, 22 bp, Artificial Sequence
  Synthetic
cgacacugtggtcctuagcaac

SEQ ID NO: 42101 - DNA, 24 bp, Artificial Sequence
  Synthetic
guaaggcagaaaggagaugcagat

SEQ ID NO: 42102 - DNA, 21 bp, Artificial Sequence
  Synthetic
aggcctgaugtcctaggaugt

SEQ ID NO: 42103 - DNA, 23 bp, Artificial Sequence
  Synthetic
agaaatcttcccugccaccttuc

SEQ ID NO: 42104 - DNA, 22 bp, Artificial Sequence
  Synthetic
ctgtgcaucccaggtttcuagg

SEQ ID NO: 42105 - DNA, 25 bp, Artificial Sequence
  Synthetic
tgggatttggugagaacaagagaut

SEQ ID NO: 42106 - DNA, 20 bp, Artificial Sequence
  Synthetic
ggcagcutaacgaugcccat

SEQ ID NO: 42107 - DNA, 23 bp, Artificial Sequence
  Synthetic
tcuaaagagaugaagcccccaca

SEQ ID NO: 42108 - DNA, 20 bp, Artificial Sequence
  Synthetic
ctucggcaggagggatugag

SEQ ID NO: 42109 - DNA, 18 bp, Artificial Sequence
  Synthetic
cagccccuccaccucaga

SEQ ID NO: 42110 - DNA, 23 bp, Artificial Sequence
  Synthetic
tcccaagccuatgggttcattuc

SEQ ID NO: 42111 - DNA, 23 bp, Artificial Sequence
  Synthetic
cctggctacauggaaaacgauct

SEQ ID NO: 42112 - DNA, 24 bp, Artificial Sequence
  Synthetic
ctggagatgcugtggatgtaacuc

SEQ ID NO: 42113 - DNA, 31 bp, Artificial Sequence; identical to SEQ ID NO: 29879
  Synthetic

SEQ ID NO: 42114 - DNA, 21 bp, Artificial Sequence
  Synthetic
gggagggugatggcagacuaa

SEQ ID NO: 42115 - DNA, 25 bp, Artificial Sequence
  Synthetic
caagautcttgcctuccaaaaccag

SEQ ID NO: 42116 - DNA, 24 bp, Artificial Sequence
  Synthetic
gttggtggtggutagtgggtatut

SEQ ID NO: 42117 - DNA, 21 bp, Artificial Sequence
  Synthetic
ggtgtctgcucctgcactauc

SEQ ID NO: 42118 - DNA, 22 bp, Artificial Sequence
  Synthetic
cacctctcaguccatctcucac

SEQ ID NO: 42119 - DNA, 27 bp, Artificial Sequence
  Synthetic
cagaaatgagacuatggagtcacucac

SEQ ID NO: 42120 - DNA, 23 bp, Artificial Sequence
  Synthetic
gcatttcaaagcutggctuggat

SEQ ID NO: 42121 - DNA, 22 bp, Artificial Sequence
  Synthetic
cagtctcguagggttucacagg

SEQ ID NO: 42122 - DNA, 26 bp, Artificial Sequence
  Synthetic
gggatgggaauagagacattcatcua

SEQ ID NO: 42123 - DNA, 22 bp, Artificial Sequence
  Synthetic
ccccacucaggtugaaaaggac

SEQ ID NO: 42124 - DNA, 22 bp, Artificial Sequence
  Synthetic
ccatccgttcugcatccctauc

SEQ ID NO: 42125 - DNA, 29 bp, Artificial Sequence
  Synthetic
cagggagaaaaagcucattcattcattuc

SEQ ID NO: 42126 - DNA, 21 bp, Artificial Sequence
  Synthetic
gtgccatgucggagaacauct

SEQ ID NO: 42127 - DNA, 23 bp, Artificial Sequence
  Synthetic
ggagagggaaucacauccaaagc

SEQ ID NO: 42128 - DNA, 33 bp, Artificial Sequence; identical to SEQ ID NO: 29894
  Synthetic

SEQ ID NO: 42129 - DNA, 22 bp, Artificial Sequence
  Synthetic
cctgtacacaugaagccaucgt

SEQ ID NO: 42130 - DNA, 31 bp, Artificial Sequence; identical to SEQ ID NO: 29896
  Synthetic

SEQ ID NO: 42131 - DNA, 28 bp, Artificial Sequence
  Synthetic
ccutctagaacaguagacacaaaacagg

SEQ ID NO: 42132 - DNA, 23 bp, Artificial Sequence
  Synthetic
tgcatggcautagcaaagacuca

SEQ ID NO: 42133 - DNA, 22 bp, Artificial Sequence
  Synthetic
gaguacagtgcaaugagggacc

SEQ ID NO: 42134 - DNA, 28 bp, Artificial Sequence
  Synthetic
gtacucatgaaaatggucagagaaacct

SEQ ID NO: 42135 - DNA, 22 bp, Artificial Sequence
  Synthetic
aacttgtgguagttggagcugg

SEQ ID NO: 42136 - DNA, 19 bp, Artificial Sequence
  Synthetic
ccggtauctactgguggca

SEQ ID NO: 42137 - DNA, 24 bp, Artificial Sequence
  Synthetic
gcctaccacucccttaaagacuga

SEQ ID NO: 42138 - DNA, 23 bp, Artificial Sequence
  Synthetic
cgatttctucccagggtcaaguc

SEQ ID NO: 42139 - DNA, 29 bp, Artificial Sequence
  Synthetic
cctgatctcagaaugtccttttctttuca

SEQ ID NO: 42140 - DNA, 21 bp, Artificial Sequence
  Synthetic
tgtttagaaggucgcgugcat

SEQ ID NO: 42141 - DNA, 29 bp, Artificial Sequence
  Synthetic
ttgggatcttgggautaagaaacaatcut

SEQ ID NO: 42142 - DNA, 24 bp, Artificial Sequence
  Synthetic
gatggctguctttttcacactugg

SEQ ID NO: 42143 - DNA, 28 bp, Artificial Sequence
  Synthetic
tcttcatcaaccuctggtaatcuacaga

SEQ ID NO: 42144 - DNA, 27 bp, Artificial Sequence
  Synthetic
tgccgatatauaccaagtactuagaca

SEQ ID NO: 42145 - DNA, 25 bp, Artificial Sequence
  Synthetic
ccggaauatccagacugacaacaac

SEQ ID NO: 42146 - DNA, 29 bp, Artificial Sequence
  Synthetic
cugaagcatcttaguaagacaaaacagga

SEQ ID NO: 42147 - DNA, 28 bp, Artificial Sequence
  Synthetic
gttggatacacagccuagacttacttut

SEQ ID NO: 42148 - DNA, 19 bp, Artificial Sequence
  Synthetic
cugggatuacaggcgcaga

SEQ ID NO: 42149 - DNA, 27 bp, Artificial Sequence
  Synthetic
cctatgcttccuctttcctttguacag

SEQ ID NO: 42150 - DNA, 20 bp, Artificial Sequence
  Synthetic
cagccgagguaccccattua

SEQ ID NO: 42151 - DNA, 26 bp, Artificial Sequence
  Synthetic
gtattacatugaatgccttgaugcca

SEQ ID NO: 42152 - DNA, 22 bp, Artificial Sequence
  Synthetic
ggcaaugactgaacugcagagt

SEQ ID NO: 42153 - DNA, 20 bp, Artificial Sequence
  Synthetic
cagaacagggcutccagguc

SEQ ID NO: 42154 - DNA, 21 bp, Artificial Sequence
  Synthetic
tgccgtcagguagttctccut

SEQ ID NO: 42155 - DNA, 21 bp, Artificial Sequence
  Synthetic
cctagugccaccgagataugc

SEQ ID NO: 42156 - DNA, 29 bp, Artificial Sequence
  Synthetic
atggtagtaatcugatcactagggtuaca

SEQ ID NO: 42157 - DNA, 25 bp, Artificial Sequence
  Synthetic
ttgcttgatugcaggaaatctucac

SEQ ID NO: 42158 - DNA, 18 bp, Artificial Sequence
  Synthetic
gggctccacucaccgtug

SEQ ID NO: 42159 - DNA, 19 bp, Artificial Sequence
  Synthetic
ccccagcugagtacggcua

SEQ ID NO: 42160 - DNA, 23 bp, Artificial Sequence
  Synthetic
cggattgtgtugtttctgggtuc

SEQ ID NO: 42161 - DNA, 22 bp, Artificial Sequence
  Synthetic
aactggguagcaaggcatcuac

SEQ ID NO: 42162 - DNA, 22 bp, Artificial Sequence
  Synthetic
gtccagauaggcaatgctgtuc

SEQ ID NO: 42163 - DNA, 23 bp, Artificial Sequence
  Synthetic
ccttgaaccaugaactctuggca

SEQ ID NO: 42164 - DNA, 23 bp, Artificial Sequence
  Synthetic
gttcttctugggaacgtttgcug

SEQ ID NO: 42165 - DNA, 24 bp, Artificial Sequence
  Synthetic
gtctctcaagcutttgtgtctgug

SEQ ID NO: 42166 - DNA, 22 bp, Artificial Sequence
  Synthetic
ttgttgagggacutgagtgugg

SEQ ID NO: 42167 - DNA, 23 bp, Artificial Sequence
  Synthetic
acaatcctggcugatctctcugt

SEQ ID NO: 42168 - DNA, 21 bp, Artificial Sequence
  Synthetic
cccctccaucttccaacucca

SEQ ID NO: 42169 - DNA, 20 bp, Artificial Sequence
  Synthetic
gggcugggacataaagcugt

SEQ ID NO: 42170 - DNA, 21 bp, Artificial Sequence
  Synthetic
ctcagugcaggacactuggat

SEQ ID NO: 42171 - DNA, 21 bp, Artificial Sequence
  Synthetic
cgcagtcuctggacuaaggag

SEQ ID NO: 42172 - DNA, 21 bp, Artificial Sequence
  Synthetic
gagacttgutccaaccugcca

SEQ ID NO: 42173 - DNA, 25 bp, Artificial Sequence
  Synthetic
gtgcattctugtttcactttgucca

SEQ ID NO: 42174 - DNA, 21 bp, Artificial Sequence
  Synthetic
gctgagggagguagaagccut

SEQ ID NO: 42175 - DNA, 23 bp, Artificial Sequence
  Synthetic
ccactgtcagutctcatctccug

SEQ ID NO: 42176 - DNA, 22 bp, Artificial Sequence
  Synthetic
ctcaugccaggagcatcactua

SEQ ID NO: 42177 - DNA, 22 bp, Artificial Sequence
  Synthetic
tttccauaccaggctcugagac

SEQ ID NO: 42178 - DNA, 23 bp, Artificial Sequence
  Synthetic
gcccttcctugagggaacaatuc

SEQ ID NO: 42179 - DNA, 24 bp, Artificial Sequence
  Synthetic
acctgcttccuccttcccattaua

SEQ ID NO: 42180 - DNA, 18 bp, Artificial Sequence
  Synthetic
catgagggccugcacuga

SEQ ID NO: 42181 - DNA, 21 bp, Artificial Sequence
  Synthetic
caccttctuaccccagctcut

SEQ ID NO: 42182 - DNA, 21 bp, Artificial Sequence
  Synthetic
ggatcctaaugcccagcaguc

SEQ ID NO: 42183 - DNA, 19 bp, Artificial Sequence
  Synthetic
actgggcuttcccuagcac

SEQ ID NO: 42184 - DNA, 24 bp, Artificial Sequence
  Synthetic
acttctgttcutcattcctccuga

SEQ ID NO: 42185 - DNA, 24 bp, Artificial Sequence
  Synthetic
ggttgatcacutcttggtgtcuct

SEQ ID NO: 42186 - DNA, 19 bp, Artificial Sequence
  Synthetic
cccuccaccgatagugcct

SEQ ID NO: 42187 - DNA, 23 bp, Artificial Sequence
  Synthetic
ggctcagcucaccttttctttuc

SEQ ID NO: 42188 - DNA, 17 bp, Artificial Sequence
  Synthetic
gaggccgutcccctguc

SEQ ID NO: 42189 - DNA, 19 bp, Artificial Sequence
  Synthetic
cccaaaccauccgccucat

SEQ ID NO: 42190 - DNA, 22 bp, Artificial Sequence
  Synthetic
cctcccuaacccaaactccauc

SEQ ID NO: 42191 - DNA, 22 bp, Artificial Sequence
  Synthetic
ccaccctcutctctctccugaa

SEQ ID NO: 42192 - DNA, 21 bp, Artificial Sequence
  Synthetic
cccuacaaggguacacaggga

SEQ ID NO: 42193 - DNA, 21 bp, Artificial Sequence
  Synthetic
ggttggtgggutagtgggaug

SEQ ID NO: 42194 - DNA, 21 bp, Artificial Sequence
  Synthetic
ccugtgcctcauagaacagca

SEQ ID NO: 42195 - DNA, 21 bp, Artificial Sequence
  Synthetic
cauccgagggcatctugaaca

SEQ ID NO: 42196 - DNA, 21 bp, Artificial Sequence
  Synthetic
ccugtgggcaugagaagaagg

SEQ ID NO: 42197 - DNA, 29 bp, Artificial Sequence
  Synthetic
ggttcattctutgctgcttattugacaat

SEQ ID NO: 42198 - DNA, 21 bp, Artificial Sequence
  Synthetic
gagcaaugagcaagggtuacg

SEQ ID NO: 42199 - DNA, 23 bp, Artificial Sequence
  Synthetic
gaactggcautcacctctctuct

SEQ ID NO: 42200 - DNA, 21 bp, Artificial Sequence
  Synthetic
gggttgtutcgagggucaaga

SEQ ID NO: 42201 - DNA, 22 bp, Artificial Sequence
  Synthetic
caactcatgcutaggctgucct

SEQ ID NO: 42202 - DNA, 21 bp, Artificial Sequence
  Synthetic
gctagtuccactgagcuccac

SEQ ID NO: 42203 - DNA, 28 bp, Artificial Sequence
  Synthetic
cccagaagtcugattgaacattttcuct

SEQ ID NO: 42204 - DNA, 25 bp, Artificial Sequence
  Synthetic
atctcagaagugacctcatugaact

SEQ ID NO: 42205 - DNA, 25 bp, Artificial Sequence
  Synthetic
tgggatatctcuctctctccctuca

SEQ ID NO: 42206 - DNA, 21 bp, Artificial Sequence
  Synthetic
gctgcggucctagtggtcuat

SEQ ID NO: 42207 - DNA, 29 bp, Artificial Sequence
  Synthetic
tgttttagcagttuatagggattgaccug

SEQ ID NO: 42208 - DNA, 27 bp, Artificial Sequence
  Synthetic
ctaagcaautatctguaaagcagaggt

SEQ ID NO: 42209 - DNA, 25 bp, Artificial Sequence
  Synthetic
ctcctaacgtugttgggtttcttug

SEQ ID NO: 42210 - DNA, 22 bp, Artificial Sequence
  Synthetic
tggctgcuctttaagaggugac

SEQ ID NO: 42211 - DNA, 27 bp, Artificial Sequence
  Synthetic
gtcatcttaccaugttcttcacctuca

SEQ ID NO: 42212 - DNA, 23 bp, Artificial Sequence
  Synthetic
gccccacaggauggtaagtuaga

SEQ ID NO: 42213 - DNA, 24 bp, Artificial Sequence
  Synthetic
cttagtgggcutactcggctuaat

SEQ ID NO: 42214 - DNA, 21 bp, Artificial Sequence
  Synthetic
agcatctaugggagcgtgtut

SEQ ID NO: 42215 - DNA, 23 bp, Artificial Sequence
  Synthetic
cctctgcgacgacauaatctgug

SEQ ID NO: 42216 - DNA, 17 bp, Artificial Sequence
  Synthetic
cuccagagcuggagcgg

SEQ ID NO: 42217 - DNA, 18 bp, Artificial Sequence
  Synthetic
ccgcggugagccatgaut

SEQ ID NO: 42218 - DNA, 18 bp, Artificial Sequence
  Synthetic
gggcuctccugggaacca

SEQ ID NO: 42219 - DNA, 19 bp, Artificial Sequence
  Synthetic
tccucccggaagagctuca

SEQ ID NO: 42220 - DNA, 22 bp, Artificial Sequence
  Synthetic
gctggagtaguagcttccacug

SEQ ID NO: 42221 - DNA, 21 bp, Artificial Sequence
  Synthetic
gcuccaacaccagcagaucaa

SEQ ID NO: 42222 - DNA, 27 bp, Artificial Sequence
  Synthetic
agtcactgatcucatgtatgtgtgtug

SEQ ID NO: 42223 - DNA, 21 bp, Artificial Sequence
  Synthetic
gagctcaugaacaccaagcug

SEQ ID NO: 42224 - DNA, 25 bp, Artificial Sequence
  Synthetic
gtttcttttagaacucaggccccut

SEQ ID NO: 42225 - DNA, 24 bp, Artificial Sequence
  Synthetic
cagaatcttucctctttccuggct

SEQ ID NO: 42226 - DNA, 28 bp, Artificial Sequence
  Synthetic
tgtcagttccautcaaatctttcacuca

SEQ ID NO: 42227 - DNA, 22 bp, Artificial Sequence
  Synthetic
agtgccaaucatccctgttucc

SEQ ID NO: 42228 - DNA, 23 bp, Artificial Sequence
  Synthetic
cccaaaggaaggcauggtaguag

SEQ ID NO: 42229 - DNA, 20 bp, Artificial Sequence
  Synthetic
gagccgttgutcgagcagua

SEQ ID NO: 42230 - DNA, 27 bp, Artificial Sequence
  Synthetic
gccaaaacatcutccttctttctcuct

SEQ ID NO: 42231 - DNA, 22 bp, Artificial Sequence
  Synthetic
ctccuggaggtauccaagaggt

SEQ ID NO: 42232 - DNA, 21 bp, Artificial Sequence
  Synthetic
gcaccaccuccaaagccauag

SEQ ID NO: 42233 - DNA, 17 bp, Artificial Sequence
  Synthetic
ggctucggcagggucag

SEQ ID NO: 42234 - DNA, 20 bp, Artificial Sequence
  Synthetic
cacacutgacuggcgagaca

SEQ ID NO: 42235 - DNA, 22 bp, Artificial Sequence
  Synthetic
tgcccagcccacutaatcatuc

SEQ ID NO: 42236 - DNA, 21 bp, Artificial Sequence
  Synthetic
gagttgcgccgutttccuaac

SEQ ID NO: 42237 - DNA, 23 bp, Artificial Sequence
  Synthetic
ggcctccacuatgtttcgaauga

SEQ ID NO: 42238 - DNA, 26 bp, Artificial Sequence
  Synthetic
attgacgtaaacaugtaaggtgcuct

SEQ ID NO: 42239 - DNA, 27 bp, Artificial Sequence
  Synthetic
gattcctgacuactttgctgtgaatug

SEQ ID NO: 42240 - DNA, 24 bp, Artificial Sequence
  Synthetic
acatcagtttgugagaggatggug

SEQ ID NO: 42241 - DNA, 28 bp, Artificial Sequence
  Synthetic
tggcacagauacacttaacatgcaauat

SEQ ID NO: 42242 - DNA, 29 bp, Artificial Sequence
  Synthetic
gctgaggtagauggttttcaaaugaagat

SEQ ID NO: 42243 - DNA, 27 bp, Artificial Sequence
  Synthetic
tggaaatgatuaaggtcatatggcuct

SEQ ID NO: 42244 - DNA, 26 bp, Artificial Sequence
  Synthetic
catatgcaugtatacacucacccaca

SEQ ID NO: 42245 - DNA, 22 bp, Artificial Sequence
  Synthetic
gctcagacagugaaggctgtuc

SEQ ID NO: 42246 - DNA, 28 bp, Artificial Sequence
  Synthetic
ggtctgttccauacagaaataagcuact

SEQ ID NO: 42247 - DNA, 26 bp, Artificial Sequence
  Synthetic
atuatgggagaagaagaaaucgctut

SEQ ID NO: 42248 - DNA, 30 bp, Artificial Sequence; identical to SEQ ID NO: 30014
  Synthetic

SEQ ID NO: 42249 - DNA, 27 bp, Artificial Sequence
  Synthetic
cagtcattactuacaatgcgcauaaca

SEQ ID NO: 42250 - DNA, 28 bp, Artificial Sequence
  Synthetic
gacaccagatugatctgtatcaactuca

SEQ ID NO: 42251 - DNA, 28 bp, Artificial Sequence
  Synthetic
catctctgcaaaugttagatacgguaca

SEQ ID NO: 42252 - DNA, 30 bp, Artificial Sequence; identical to SEQ ID NO: 30018
  Synthetic

SEQ ID NO: 42253 - DNA, 28 bp, Artificial Sequence
  Synthetic
gtaacaaaguacacttgtgcacuaaaca

SEQ ID NO: 42254 - DNA, 28 bp, Artificial Sequence
  Synthetic
actgttctcttttuctttccctgtgaut

SEQ ID NO: 42255 - DNA, 24 bp, Artificial Sequence
  Synthetic
gattgcagaggutgacttttccug

SEQ ID NO: 42256 - DNA, 25 bp, Artificial Sequence
  Synthetic
tttagcatgcugtgagttcaucaga

SEQ ID NO: 42257 - DNA, 26 bp, Artificial Sequence
  Synthetic
gcttcccgaaguttaagagacaugat

SEQ ID NO: 42258 - DNA, 26 bp, Artificial Sequence
  Synthetic
cctccactgutatctgcatttugaac

SEQ ID NO: 42259 - DNA, 25 bp, Artificial Sequence
  Synthetic
ttgaaggtgccuatagtgacaaucc

SEQ ID NO: 42260 - DNA, 27 bp, Artificial Sequence
  Synthetic
aaaagccatucaaaactctctcuacct

SEQ ID NO: 42261 - DNA, 28 bp, Artificial Sequence
  Synthetic
gtggaggaauaaacagtgtctcttacug

SEQ ID NO: 42262 - DNA, 30 bp, Artificial Sequence; identical to SEQ ID NO: 30028
  Synthetic

SEQ ID NO: 42263 - DNA, 22 bp, Artificial Sequence
  Synthetic
cccaggutcctggatuaaggat

SEQ ID NO: 42264 - DNA, 25 bp, Artificial Sequence
  Synthetic
atgtctggccugatatttgacuaca

SEQ ID NO: 42265 - DNA, 27 bp, Artificial Sequence
  Synthetic
ggctgtcccagaaguttatttaccuaa

SEQ ID NO: 42266 - DNA, 28 bp, Artificial Sequence
  Synthetic
ggaatgaaattauggaaatccctguacc

SEQ ID NO: 42267 - DNA, 21 bp, Artificial Sequence
  Synthetic
ctaucgagaggcaugcaccat

SEQ ID NO: 42268 - DNA, 22 bp, Artificial Sequence
  Synthetic
ggctguaaaagcttctgugcat

SEQ ID NO: 42269 - DNA, 29 bp, Artificial Sequence
  Synthetic
tcagtcttttcatgugtaatcctcttgut

SEQ ID NO: 42270 - DNA, 21 bp, Artificial Sequence
  Synthetic
acataccaaguagccccucca

SEQ ID NO: 42271 - DNA, 29 bp, Artificial Sequence
  Synthetic
gctgctttaatagcuctcagaatgtttuc

SEQ ID NO: 42272 - DNA, 25 bp, Artificial Sequence
  Synthetic
caacatugaaaatgtcacuggcaga

SEQ ID NO: 42273 - DNA, 27 bp, Artificial Sequence
  Synthetic
agtatgacaagcutctcattgctgaut

SEQ ID NO: 42274 - DNA, 23 bp, Artificial Sequence
  Synthetic
atgctcataugtgagatgugcca

SEQ ID NO: 42275 - DNA, 23 bp, Artificial Sequence
  Synthetic
ggaggatttgutggtttgcccua

SEQ ID NO: 42276 - DNA, 17 bp, Artificial Sequence
  Synthetic
ggcagugcagggucgag

SEQ ID NO: 42277 - DNA, 21 bp, Artificial Sequence
  Synthetic
gtgatgctgutcaagctccug

SEQ ID NO: 42278 - DNA, 28 bp, Artificial Sequence
  Synthetic
tgctcttgagtaugtactcatatccugt

SEQ ID NO: 42279 - DNA, 26 bp, Artificial Sequence
  Synthetic
gcagtgcccuccagaaaataaaguaa

SEQ ID NO: 42280 - DNA, 22 bp, Artificial Sequence
  Synthetic
ctauggcgatgguagggaaaga

SEQ ID NO: 42281 - DNA, 23 bp, Artificial Sequence
  Synthetic
cttcactcaagccugtggtttug

SEQ ID NO: 42282 - DNA, 28 bp, Artificial Sequence
  Synthetic
gaaagcacaauaatggttttctguaccc

SEQ ID NO: 42283 - DNA, 25 bp, Artificial Sequence
  Synthetic
gctctcagautgactttccatucca

SEQ ID NO: 42284 - DNA, 22 bp, Artificial Sequence
  Synthetic
cctgggcucaactcattugaga

SEQ ID NO: 42285 - DNA, 22 bp, Artificial Sequence
  Synthetic
gagtcuggcttggctuaaacct

SEQ ID NO: 42286 - DNA, 25 bp, Artificial Sequence
  Synthetic
tttcatacttgccuccacatactug

SEQ ID NO: 42287 - DNA, 30 bp, Artificial Sequence; identical to SEQ ID NO: 30053
  Synthetic

SEQ ID NO: 42288 - DNA, 24 bp, Artificial Sequence
  Synthetic
tcatgctgguattttccatccuca

SEQ ID NO: 42289 - DNA, 26 bp, Artificial Sequence
  Synthetic
gccttgaaaaaucaggtgtctcttut

SEQ ID NO: 42290 - DNA, 28 bp, Artificial Sequence
  Synthetic
tgctgttattttaugaagacagtgugga

SEQ ID NO: 42291 - DNA, 23 bp, Artificial Sequence
  Synthetic
atttggauaaacgtagccugcct

SEQ ID NO: 42292 - DNA, 27 bp, Artificial Sequence
  Synthetic
agaaaagaacauggaagtttgcuacga

SEQ ID NO: 42293 - DNA, 29 bp, Artificial Sequence
  Synthetic
ggaatgaattgcuaaactgtggaaaaugt

SEQ ID NO: 42294 - DNA, 19 bp, Artificial Sequence
  Synthetic
gtttuccaggaccgcagug

SEQ ID NO: 42295 - DNA, 18 bp, Artificial Sequence
  Synthetic
ccucctgcgucaggacaa

SEQ ID NO: 42296 - DNA, 23 bp, Artificial Sequence
  Synthetic
ccaagctcccacuttctgtgaut

SEQ ID NO: 42297 - DNA, 26 bp, Artificial Sequence
  Synthetic
caaaccattctguttgcttctctcuc

SEQ ID NO: 42298 - DNA, 20 bp, Artificial Sequence
  Synthetic
cccatctccgucctcctcuc

SEQ ID NO: 42299 - DNA, 23 bp, Artificial Sequence
  Synthetic
ggcaatguccctttctccttuca

SEQ ID NO: 42300 - DNA, 21 bp, Artificial Sequence
  Synthetic
ggatcccagauggtgacccua

SEQ ID NO: 42301 - DNA, 28 bp, Artificial Sequence
  Synthetic
acatagatcttgacugtcactttctguc

SEQ ID NO: 42302 - DNA, 23 bp, Artificial Sequence
  Synthetic
tgcgtgagagcutcacattcaut

SEQ ID NO: 42303 - DNA, 29 bp, Artificial Sequence
  Synthetic
cagaatcttaattugggtggctaaacaut

SEQ ID NO: 42304 - DNA, 19 bp, Artificial Sequence
  Synthetic
aggtgtucgagttgcccut

SEQ ID NO: 42305 - DNA, 18 bp, Artificial Sequence
  Synthetic
tcaggucccgucaagcag

SEQ ID NO: 42306 - DNA, 22 bp, Artificial Sequence
  Synthetic
tgcctctacucggtccaaguat

SEQ ID NO: 42307 - DNA, 24 bp, Artificial Sequence
  Synthetic
cuttttacaguacaagcccaccac

SEQ ID NO: 42308 - DNA, 20 bp, Artificial Sequence
  Synthetic
gtgcgagcagaaugcttugg

SEQ ID NO: 42309 - DNA, 24 bp, Artificial Sequence
  Synthetic
ccaaugatgctaaugacgacacag

SEQ ID NO: 42310 - DNA, 22 bp, Artificial Sequence
  Synthetic
ggagagccuctagctgctuact

SEQ ID NO: 42311 - DNA, 23 bp, Artificial Sequence
  Synthetic
acagaauagttucccagcagcac

SEQ ID NO: 42312 - DNA, 28 bp, Artificial Sequence
  Synthetic
tcagatactaggauaaagaagccacucc

SEQ ID NO: 42313 - DNA, 28 bp, Artificial Sequence
  Synthetic
gtgtacatgcucctttttctttcactut

SEQ ID NO: 42314 - DNA, 23 bp, Artificial Sequence
  Synthetic
gaagagucacacacacuggaaga

SEQ ID NO: 42315 - DNA, 31 bp, Artificial Sequence; identical to SEQ ID NO: 30081
  Synthetic

SEQ ID NO: 42316 - DNA, 23 bp, Artificial Sequence
  Synthetic
catattgcguggagtaagcuggt

SEQ ID NO: 42317 - DNA, 23 bp, Artificial Sequence
  Synthetic
cagggucaaatcatucagagcct

SEQ ID NO: 42318 - DNA, 26 bp, Artificial Sequence
  Synthetic
gcttggtgucagatacaaacaatugg

SEQ ID NO: 42319 - DNA, 26 bp, Artificial Sequence
  Synthetic
attgttgtttttguagccaaagccut

SEQ ID NO: 42320 - DNA, 24 bp, Artificial Sequence
  Synthetic
aagtccagauggattctucacagt

SEQ ID NO: 42321 - DNA, 27 bp, Artificial Sequence
  Synthetic
aauacttaguaacacggaguacaagag

SEQ ID NO: 42322 - DNA, 28 bp, Artificial Sequence
  Synthetic
ctgctgctatuttcaatgaaagaaucct

SEQ ID NO: 42323 - DNA, 23 bp, Artificial Sequence
  Synthetic
gtagctugtgctcauggcaaaaa

SEQ ID NO: 42324 - DNA, 28 bp, Artificial Sequence
  Synthetic
tgggcatgaaautagacatacttctucc

SEQ ID NO: 42325 - DNA, 28 bp, Artificial Sequence
  Synthetic
attgttttcuagctaaagatuccaggct

SEQ ID NO: 42326 - DNA, 21 bp, Artificial Sequence
  Synthetic
gcatggcaacagcutcagtug

SEQ ID NO: 42327 - DNA, 29 bp, Artificial Sequence
  Synthetic
cctgaagcctcutttaggaagtaacatut

SEQ ID NO: 42328 - DNA, 22 bp, Artificial Sequence
  Synthetic
ctaggccacuggatauggaacc

SEQ ID NO: 42329 - DNA, 25 bp, Artificial Sequence
  Synthetic
tgtgtgtgaaugggtgtattuagca

SEQ ID NO: 42330 - DNA, 21 bp, Artificial Sequence
  Synthetic
gcuggagaaccaugagcagag

SEQ ID NO: 42331 - DNA, 28 bp, Artificial Sequence
  Synthetic
tccttcatatcatutgttctgtcaggug

SEQ ID NO: 42332 - DNA, 23 bp, Artificial Sequence
  Synthetic
gtgaattctguctcccactuccc

SEQ ID NO: 42333 - DNA, 24 bp, Artificial Sequence
  Synthetic
tttgtaacaagcautcccttcugt

SEQ ID NO: 42334 - DNA, 22 bp, Artificial Sequence
  Synthetic
tcatcatttuccagggccacuc

SEQ ID NO: 42335 - DNA, 28 bp, Artificial Sequence
  Synthetic
acataaactguggctttaaaggacucat

SEQ ID NO: 42336 - DNA, 26 bp, Artificial Sequence
  Synthetic
caggatgtcatacugaccagagtcua

SEQ ID NO: 42337 - DNA, 27 bp, Artificial Sequence
  Synthetic
acttucaaccaaaaccattcttugcag

SEQ ID NO: 42338 - DNA, 29 bp, Artificial Sequence
  Synthetic
cacaacaaaguctgaacattugaacaaaa

SEQ ID NO: 42339 - DNA, 27 bp, Artificial Sequence
  Synthetic
ggtaccttgaugagctaaagaatucct

SEQ ID NO: 42340 - DNA, 29 bp, Artificial Sequence
  Synthetic
catggaautactttattcuacccccaagg

SEQ ID NO: 42341 - DNA, 28 bp, Artificial Sequence
  Synthetic
ccaagcatttuagatgaggaagatucag

SEQ ID NO: 42342 - DNA, 17 bp, Artificial Sequence
  Synthetic
cgggctugcggacatug

SEQ ID NO: 42343 - DNA, 18 bp, Artificial Sequence
  Synthetic
cgttccggcguctcctug

SEQ ID NO: 42344 - DNA, 17 bp, Artificial Sequence
  Synthetic
gccgtugccgttgcuac

SEQ ID NO: 42345 - DNA, 17 bp, Artificial Sequence
  Synthetic
ccgagtcucgccgctuc

SEQ ID NO: 42346 - DNA, 24 bp, Artificial Sequence
  Synthetic
gtcttagcugtgttgttguggaaa

SEQ ID NO: 42347 - DNA, 28 bp, Artificial Sequence
  Synthetic
aggatcctctcutttcattccaactuac

SEQ ID NO: 42348 - DNA, 26 bp, Artificial Sequence
  Synthetic
cacatcaagatucagaacactgguga

SEQ ID NO: 42349 - DNA, 29 bp, Artificial Sequence
  Synthetic
gcagactttguggtcactaaaatgtuact

SEQ ID NO: 42350 - DNA, 29 bp, Artificial Sequence
  Synthetic
ctctcugggaaagaaguagagaaattaut

SEQ ID NO: 42351 - DNA, 25 bp, Artificial Sequence
  Synthetic
catctugccagacccattttucaac

SEQ ID NO: 42352 - DNA, 31 bp, Artificial Sequence; identical to SEQ ID NO: 30118
  Synthetic

SEQ ID NO: 42353 - DNA, 25 bp, Artificial Sequence
  Synthetic
caagagcaacutctcctccacuaaa

SEQ ID NO: 42354 - DNA, 24 bp, Artificial Sequence
  Synthetic
aatgaacaaaacutggacuaggct

SEQ ID NO: 42355 - DNA, 28 bp, Artificial Sequence
  Synthetic
agaaaacactgugaaaagcaaagctuac

SEQ ID NO: 42356 - DNA, 22 bp, Artificial Sequence
  Synthetic
tgaatgactuttggcggauggt

SEQ ID NO: 42357 - DNA, 33 bp, Artificial Sequence; identical to SEQ ID NO: 30123
  Synthetic

SEQ ID NO: 42358 - DNA, 27 bp, Artificial Sequence
  Synthetic
ctcttcctcuccattggattuaggaaa

SEQ ID NO: 42359 - DNA, 23 bp, Artificial Sequence
  Synthetic
atgatgctcucctgcttatggug

SEQ ID NO: 42360 - DNA, 30 bp, Artificial Sequence; identical to SEQ ID NO: 30126
  Synthetic

SEQ ID NO: 42361 - DNA, 28 bp, Artificial Sequence
  Synthetic
cgtgagcacttuccttccataaacuaaa

SEQ ID NO: 42362 - DNA, 26 bp, Artificial Sequence
  Synthetic
ccccttaaaauaaccattgtcccuca

SEQ ID NO: 42363 - DNA, 31 bp, Artificial Sequence; identical to SEQ ID NO: 21019
  Synthetic

SEQ ID NO: 42364 - DNA, 30 bp, Artificial Sequence; identical to SEQ ID NO: 30130
  Synthetic

SEQ ID NO: 42365 - DNA, 20 bp, Artificial Sequence
  Synthetic
gccagaguggagcgacaaua

SEQ ID NO: 42366 - DNA, 17 bp, Artificial Sequence
  Synthetic
gccacggagguctggug

SEQ ID NO: 42367 - DNA, 18 bp, Artificial Sequence
  Synthetic
cugcaacacguggccaag

SEQ ID NO: 42368 - DNA, 25 bp, Artificial Sequence
  Synthetic
gaatcttcttcacugggtgatguct

SEQ ID NO: 42369 - DNA, 27 bp, Artificial Sequence
  Synthetic
ctcaggacttautcttcagtacttugg

SEQ ID NO: 42370 - DNA, 19 bp, Artificial Sequence
  Synthetic
gggcagugggtatgggtug

SEQ ID NO: 42371 - DNA, 24 bp, Artificial Sequence
  Synthetic
actgataggcgutatctcccauct

SEQ ID NO: 42372 - DNA, 22 bp, Artificial Sequence
  Synthetic
gccatucagaggagcaaagtuc

SEQ ID NO: 42373 - DNA, 29 bp, Artificial Sequence
  Synthetic
cggatgaaaauaatggatttggcucaaaa

SEQ ID NO: 42374 - DNA, 19 bp, Artificial Sequence
  Synthetic
ggaauccaggccacgguac

SEQ ID NO: 42375 - DNA, 20 bp, Artificial Sequence
  Synthetic
tgagccaggccuctaguaca

SEQ ID NO: 42376 - DNA, 23 bp, Artificial Sequence
  Synthetic
cttcttctctuccaagccaccut

SEQ ID NO: 42377 - DNA, 21 bp, Artificial Sequence
  Synthetic
cactacugccagggcttgtua

SEQ ID NO: 42378 - DNA, 22 bp, Artificial Sequence
  Synthetic
caactgggcaaugcgtuaaact

SEQ ID NO: 42379 - DNA, 22 bp, Artificial Sequence
  Synthetic
caacactguggactgctttgug

SEQ ID NO: 42380 - DNA, 23 bp, Artificial Sequence
  Synthetic
ggaagaagaugctgcttgtguag

SEQ ID NO: 42381 - DNA, 21 bp, Artificial Sequence
  Synthetic
catctcccacauccggctaug

SEQ ID NO: 42382 - DNA, 26 bp, Artificial Sequence
  Synthetic
cauaatgcgaaaaaugaagaggacgg

SEQ ID NO: 42383 - DNA, 25 bp, Artificial Sequence
  Synthetic
tgtcctagctagugattcctgtgut

SEQ ID NO: 42384 - DNA, 25 bp, Artificial Sequence
  Synthetic
ctcttgutttcagagauggaccaca

SEQ ID NO: 42385 - DNA, 24 bp, Artificial Sequence
  Synthetic
gcaatcacagguttcccaagcuaa

SEQ ID NO: 42386 - DNA, 21 bp, Artificial Sequence
  Synthetic
acttucagcagcagguagcac

SEQ ID NO: 42387 - DNA, 29 bp, Artificial Sequence
  Synthetic
ctttgaagcagccuttatgtatgtgttut

SEQ ID NO: 42388 - DNA, 21 bp, Artificial Sequence
  Synthetic
gaacttgcgaguggtttcgug

SEQ ID NO: 42389 - DNA, 23 bp, Artificial Sequence
  Synthetic
ttttccgagucatgatcctcgug

SEQ ID NO: 42390 - DNA, 27 bp, Artificial Sequence
  Synthetic
actaatataugcaaactgcucacagca

SEQ ID NO: 42391 - DNA, 28 bp, Artificial Sequence
  Synthetic
ctgagtgtuaggaaggaaaagaaguaca

SEQ ID NO: 42392 - DNA, 20 bp, Artificial Sequence
  Synthetic
cctggtugcaggtcccuaac

SEQ ID NO: 42393 - DNA, 28 bp, Artificial Sequence
  Synthetic
agcgtggacgacaguaattaaaaguaat

SEQ ID NO: 42394 - DNA, 29 bp, Artificial Sequence
  Synthetic
gatagatttatgcuctctggacaagaugt

SEQ ID NO: 42395 - DNA, 23 bp, Artificial Sequence
  Synthetic
cgaagucgaaagaaactgtccuc

SEQ ID NO: 42396 - DNA, 19 bp, Artificial Sequence
  Synthetic
ggagaagccacgugctcua

SEQ ID NO: 42397 - DNA, 18 bp, Artificial Sequence
  Synthetic
cgacgcaguggaaaugcc

SEQ ID NO: 42398 - DNA, 22 bp, Artificial Sequence
  Synthetic
cagcccttcaugttccagttuc

SEQ ID NO: 42399 - DNA, 29 bp, Artificial Sequence
  Synthetic
acaacatgggauaaatgagaagaacucac

SEQ ID NO: 42400 - DNA, 25 bp, Artificial Sequence
  Synthetic
tttcagcagugtcataagtauggct

SEQ ID NO: 42401 - DNA, 22 bp, Artificial Sequence
  Synthetic
gcatggagugccacactctuac

SEQ ID NO: 42402 - DNA, 23 bp, Artificial Sequence
  Synthetic
gaccatucccagaggtacttucc

SEQ ID NO: 42403 - DNA, 29 bp, Artificial Sequence
  Synthetic
ccctgaagttgaaaugtagatggtatcut

SEQ ID NO: 42404 - DNA, 22 bp, Artificial Sequence
  Synthetic
gggtatccauctgagagctugc

SEQ ID NO: 42405 - DNA, 23 bp, Artificial Sequence
  Synthetic
atgccacattugagagagctcut

SEQ ID NO: 42406 - DNA, 28 bp, Artificial Sequence
  Synthetic
caccaacatacutcagaagcauaaacag

SEQ ID NO: 42407 - DNA, 28 bp, Artificial Sequence
  Synthetic
ctgcagaguggactagtttgttuaaaga

SEQ ID NO: 42408 - DNA, 26 bp, Artificial Sequence
  Synthetic
ctttggtttuaggccactgagauaga

SEQ ID NO: 42409 - DNA, 25 bp, Artificial Sequence
  Synthetic
aggagaacaaaggacuaagactugc

SEQ ID NO: 42410 - DNA, 21 bp, Artificial Sequence
  Synthetic
ctgctgcaucagggugagaat

SEQ ID NO: 42411 - DNA, 28 bp, Artificial Sequence
  Synthetic
ttgaaggtagtguaagaaaagcgaauct

SEQ ID NO: 42412 - DNA, 23 bp, Artificial Sequence
  Synthetic
ccatctgtatuccccctgcttuc

SEQ ID NO: 42413 - DNA, 22 bp, Artificial Sequence
  Synthetic
agatgccucggcacatctttut

SEQ ID NO: 42414 - DNA, 22 bp, Artificial Sequence
  Synthetic
tcatuccagccaguaacaaccc

SEQ ID NO: 42415 - DNA, 27 bp, Artificial Sequence
  Synthetic
tgaagatgtaauaacctcgaacuccca

SEQ ID NO: 42416 - DNA, 25 bp, Artificial Sequence
  Synthetic
ggattggaaguttccctacauaccc

SEQ ID NO: 42417 - DNA, 25 bp, Artificial Sequence
  Synthetic
ccataggatuggcagagatctgcua

SEQ ID NO: 42418 - DNA, 21 bp, Artificial Sequence
  Synthetic
cattgaagcuggccagtaucg

SEQ ID NO: 42419 - DNA, 27 bp, Artificial Sequence
  Synthetic
cccacaatttagugcttcagagtttut

SEQ ID NO: 42420 - DNA, 26 bp, Artificial Sequence
  Synthetic
gagtggaagutctcagagacuaacag

SEQ ID NO: 42421 - DNA, 23 bp, Artificial Sequence
  Synthetic
gccucccaaagtgcuaggaaaaa

SEQ ID NO: 42422 - DNA, 28 bp, Artificial Sequence
  Synthetic
ctagagagtaccguaatgggttaatugg

SEQ ID NO: 42423 - DNA, 30 bp, Artificial Sequence; identical to SEQ ID NO: 30189
  Synthetic

SEQ ID NO: 42424 - DNA, 22 bp, Artificial Sequence
  Synthetic
gggctcacacugcaacagtaua

SEQ ID NO: 42425 - DNA, 26 bp, Artificial Sequence
  Synthetic
atcaguacaaaaccaaacucaaacut

SEQ ID NO: 42426 - DNA, 25 bp, Artificial Sequence
  Synthetic
cattcatttagcauccccaguacct

SEQ ID NO: 42427 - DNA, 30 bp, Artificial Sequence; identical to SEQ ID NO: 30193
  Synthetic

SEQ ID NO: 42428 - DNA, 22 bp, Artificial Sequence
  Synthetic
gcaggcagcutgactaaugagt

SEQ ID NO: 42429 - DNA, 17 bp, Artificial Sequence
  Synthetic
ggccgtucccgtagucc

SEQ ID NO: 42430 - DNA, 23 bp, Artificial Sequence
  Synthetic
cctccatacccuccccacttaua

SEQ ID NO: 42431 - DNA, 24 bp, Artificial Sequence
  Synthetic
gtatctaaccccacautccccauc

SEQ ID NO: 42432 - DNA, 21 bp, Artificial Sequence
  Synthetic
tuggtgtatgauggcccagac

SEQ ID NO: 42433 - DNA, 24 bp, Artificial Sequence
  Synthetic
cacagtatgguaacacggtugact

SEQ ID NO: 42434 - DNA, 25 bp, Artificial Sequence
  Synthetic
tauaactgcattguagcccaaaacg

SEQ ID NO: 42435 - DNA, 26 bp, Artificial Sequence
  Synthetic
ctagaacagcaauggacataggctua

SEQ ID NO: 42436 - DNA, 26 bp, Artificial Sequence
  Synthetic
gggcttgtacugaactatctagugat

SEQ ID NO: 42437 - DNA, 30 bp, Artificial Sequence; identical to SEQ ID NO: 30203
  Synthetic

SEQ ID NO: 42438 - DNA, 21 bp, Artificial Sequence
  Synthetic
cctacugccctgauccaggat

SEQ ID NO: 42439 - DNA, 23 bp, Artificial Sequence
  Synthetic
ggatttguccccacacacttcuc

SEQ ID NO: 42440 - DNA, 28 bp, Artificial Sequence
  Synthetic
attggttctcacaaauagtaggtgtgut

SEQ ID NO: 42441 - DNA, 24 bp, Artificial Sequence
  Synthetic
aaaatgauggaggagggaaaggug

SEQ ID NO: 42442 - DNA, 20 bp, Artificial Sequence
  Synthetic
agcttcugcagctgcttcut

SEQ ID NO: 42443 - DNA, 21 bp, Artificial Sequence
  Synthetic
ccatgttccutgccacctcuc

SEQ ID NO: 42444 - DNA, 23 bp, Artificial Sequence
  Synthetic
cttttctagaugtcctgggcuct

SEQ ID NO: 42445 - DNA, 21 bp, Artificial Sequence
  Synthetic
gaaggagaacaucgccaucgt

SEQ ID NO: 42446 - DNA, 17 bp, Artificial Sequence
  Synthetic
ggaggccaguccccuga

SEQ ID NO: 42447 - DNA, 18 bp, Artificial Sequence
  Synthetic
ggtggacucgcugcagac

SEQ ID NO: 42448 - DNA, 20 bp, Artificial Sequence
  Synthetic
gugagggagaagugggagac

SEQ ID NO: 42449 - DNA, 24 bp, Artificial Sequence
  Synthetic
gggaacauaggctttgagcttuct

SEQ ID NO: 42450 - DNA, 21 bp, Artificial Sequence
  Synthetic
cctccaaggaggutgccttug

SEQ ID NO: 42451 - DNA, 22 bp, Artificial Sequence
  Synthetic
gcaccggcuacagaatgagaua

SEQ ID NO: 42452 - DNA, 20 bp, Artificial Sequence
  Synthetic
gccccutcctctcugagagt

SEQ ID NO: 42453 - DNA, 18 bp, Artificial Sequence
  Synthetic
gcatgacugcgaccugct

SEQ ID NO: 42454 - DNA, 21 bp, Artificial Sequence
  Synthetic
gctccattuctggcacugaga

SEQ ID NO: 42455 - DNA, 20 bp, Artificial Sequence
  Synthetic
cacaagccccucattucacc

SEQ ID NO: 42456 - DNA, 25 bp, Artificial Sequence
  Synthetic
agaatgagaaugacaagggagaugg

SEQ ID NO: 42457 - DNA, 17 bp, Artificial Sequence
  Synthetic
aaccugcagcgggugaa

SEQ ID NO: 42458 - DNA, 19 bp, Artificial Sequence
  Synthetic
cucccgagacaggtcugag

SEQ ID NO: 42459 - DNA, 24 bp, Artificial Sequence
  Synthetic
ggaacctaagtucctggtagctut

SEQ ID NO: 42460 - DNA, 21 bp, Artificial Sequence
  Synthetic
caggccagacaccuccatuag

SEQ ID NO: 42461 - DNA, 27 bp, Artificial Sequence
  Synthetic
ctttgcttautttcttcccuccaacag

SEQ ID NO: 42462 - DNA, 23 bp, Artificial Sequence
  Synthetic
gggcctctugtagagctttctuc

SEQ ID NO: 42463 - DNA, 23 bp, Artificial Sequence
  Synthetic
ccagactagagugttgtccuggt

SEQ ID NO: 42464 - DNA, 21 bp, Artificial Sequence
  Synthetic
ttcttgagcuctgagcacucg

SEQ ID NO: 42465 - DNA, 25 bp, Artificial Sequence
  Synthetic
ccctagguctcctctcttuaaccat

SEQ ID NO: 42466 - DNA, 22 bp, Artificial Sequence
  Synthetic
ggacttcuccagcgtctcttug

SEQ ID NO: 42467 - DNA, 23 bp, Artificial Sequence
  Synthetic
tcucttttatagugccccaccct

SEQ ID NO: 42468 - DNA, 22 bp, Artificial Sequence
  Synthetic
tcctctcugctccacucaacat

SEQ ID NO: 42469 - DNA, 22 bp, Artificial Sequence
  Synthetic
catgggtgacuctggacactuc

SEQ ID NO: 42470 - DNA, 24 bp, Artificial Sequence
  Synthetic
gtcagcctuagggtaaagtggaug

SEQ ID NO: 42471 - DNA, 22 bp, Artificial Sequence
  Synthetic
cctaacuccccaccttcatcug

SEQ ID NO: 42472 - DNA, 22 bp, Artificial Sequence
  Synthetic
ctggcccuttgtgtctucagaa

SEQ ID NO: 42473 - DNA, 21 bp, Artificial Sequence
  Synthetic
cttctcccugatccacuacgc

SEQ ID NO: 42474 - DNA, 19 bp, Artificial Sequence
  Synthetic
gcauaggtggugaggccaa

SEQ ID NO: 42475 - DNA, 17 bp, Artificial Sequence
  Synthetic
ctcccaccccucaugcc

SEQ ID NO: 42476 - DNA, 24 bp, Artificial Sequence
  Synthetic
acatcttctcauacactgcctugg

SEQ ID NO: 42477 - DNA, 24 bp, Artificial Sequence
  Synthetic
agtgctcactuatcctttcccuct

SEQ ID NO: 42478 - DNA, 19 bp, Artificial Sequence
  Synthetic
cactcacaucgguggccat

SEQ ID NO: 42479 - DNA, 22 bp, Artificial Sequence
  Synthetic
ctcccttucccaactctaccug

SEQ ID NO: 42480 - DNA, 24 bp, Artificial Sequence
  Synthetic
aaaacaggagauggcaggaaugat

SEQ ID NO: 42481 - DNA, 23 bp, Artificial Sequence
  Synthetic
caggatttcacuctgtcctuccc

SEQ ID NO: 42482 - DNA, 18 bp, Artificial Sequence
  Synthetic
ggtaacucgggucagcct

SEQ ID NO: 42483 - DNA, 25 bp, Artificial Sequence
  Synthetic
cctgagttttgautggtctctgugg

SEQ ID NO: 42484 - DNA, 17 bp, Artificial Sequence
  Synthetic
tgggugggtgtcuggga

SEQ ID NO: 42485 - DNA, 19 bp, Artificial Sequence
  Synthetic
gccttguctcctgcuccag

SEQ ID NO: 42486 - DNA, 23 bp, Artificial Sequence
  Synthetic
cctctgcaucttcttucccagac

SEQ ID NO: 42487 - DNA, 21 bp, Artificial Sequence
  Synthetic
gcccttugacattcgcacuga

SEQ ID NO: 42488 - DNA, 22 bp, Artificial Sequence
  Synthetic
ctcagggcagugaagaagaguc

SEQ ID NO: 42489 - DNA, 27 bp, Artificial Sequence
  Synthetic
gactgattggacuttgtttccttucaa

SEQ ID NO: 42490 - DNA, 19 bp, Artificial Sequence
  Synthetic
gggacgagcuctcctaugc

SEQ ID NO: 42491 - DNA, 25 bp, Artificial Sequence
  Synthetic
ccttctatgacugtgccatctucac

SEQ ID NO: 42492 - DNA, 20 bp, Artificial Sequence
  Synthetic
cttctgcagcugcttctugc

SEQ ID NO: 42493 - DNA, 22 bp, Artificial Sequence
  Synthetic
tgugaggactugaccagaccat

SEQ ID NO: 42494 - DNA, 23 bp, Artificial Sequence
  Synthetic
gagcaggaaaagcautgagcauc

SEQ ID NO: 42495 - DNA, 18 bp, Artificial Sequence
  Synthetic
gagcuggaggagtugcgt

SEQ ID NO: 42496 - DNA, 19 bp, Artificial Sequence
  Synthetic
cagtccccuctgggugagt

SEQ ID NO: 42497 - DNA, 18 bp, Artificial Sequence
  Synthetic
ggactcgcugcagaccuc

SEQ ID NO: 42498 - DNA, 20 bp, Artificial Sequence
  Synthetic
gaccaaaagccuggagcuca

SEQ ID NO: 42499 - DNA, 22 bp, Artificial Sequence
  Synthetic
cctcaaccgagutaccgtgtuc

SEQ ID NO: 42500 - DNA, 20 bp, Artificial Sequence
  Synthetic
gctctggccuctcacugaac

SEQ ID NO: 42501 - DNA, 22 bp, Artificial Sequence
  Synthetic
gcaccggcuacagaatgagauc

SEQ ID NO: 42502 - DNA, 20 bp, Artificial Sequence
  Synthetic
tagctaagcaucgcctgugt

SEQ ID NO: 42503 - DNA, 20 bp, Artificial Sequence
  Synthetic
tccttuccaaggccaacucg

SEQ ID NO: 42504 - DNA, 23 bp, Artificial Sequence
  Synthetic
gctgggaagggaagugattugat

SEQ ID NO: 42505 - DNA, 24 bp, Artificial Sequence
  Synthetic
agtgctgatcuagaatggtgctuc

SEQ ID NO: 42506 - DNA, 21 bp, Artificial Sequence
  Synthetic
gggaagugggaaaaugaacca

SEQ ID NO: 42507 - DNA, 17 bp, Artificial Sequence
  Synthetic
agcugggcgagcagauc

SEQ ID NO: 42508 - DNA, 19 bp, Artificial Sequence
  Synthetic
cucccgagacaggtcugag

SEQ ID NO: 42509 - DNA, 22 bp, Artificial Sequence
  Synthetic
aactgacutgctgtuccagaga

SEQ ID NO: 42510 - DNA, 23 bp, Artificial Sequence
  Synthetic
gggtctgcutgtactgttauggg

SEQ ID NO: 42511 - DNA, 21 bp, Artificial Sequence
  Synthetic
cctggcuccttctctcuacca

SEQ ID NO: 42512 - DNA, 23 bp, Artificial Sequence
  Synthetic
gcctctugcagagctttcttcuc

SEQ ID NO: 42513 - DNA, 20 bp, Artificial Sequence
  Synthetic
agcagcauggacctugacat

SEQ ID NO: 42514 - DNA, 24 bp, Artificial Sequence
  Synthetic
ctcagcattcauctcctcctcauc

SEQ ID NO: 42515 - DNA, 26 bp, Artificial Sequence
  Synthetic
gagttacccucctatttgagtgaugt

SEQ ID NO: 42516 - DNA, 22 bp, Artificial Sequence
  Synthetic
gtgtgaacucctccttcaugga

SEQ ID NO: 42517 - DNA, 22 bp, Artificial Sequence
  Synthetic
caaggttucaggacctcaggua

SEQ ID NO: 42518 - DNA, 24 bp, Artificial Sequence
  Synthetic
caggaaaagcaucagaggagucaa

SEQ ID NO: 42519 - DNA, 22 bp, Artificial Sequence
  Synthetic
catgggtgacuctggacactuc

SEQ ID NO: 42520 - DNA, 22 bp, Artificial Sequence
  Synthetic
gtggtgguaggtagggagaugt

SEQ ID NO: 42521 - DNA, 26 bp, Artificial Sequence
  Synthetic
tttctcuattgcattttuggccacag

SEQ ID NO: 42522 - DNA, 22 bp, Artificial Sequence
  Synthetic
cagaatcccugctcctctguac

SEQ ID NO: 42523 - DNA, 23 bp, Artificial Sequence
  Synthetic
cccacttcuccctgatccacuat

SEQ ID NO: 42524 - DNA, 24 bp, Artificial Sequence
  Synthetic
gagaautcaggtgguaaggccaaa

SEQ ID NO: 42525 - DNA, 17 bp, Artificial Sequence
  Synthetic
gcucccacccctcaugc

SEQ ID NO: 42526 - DNA, 26 bp, Artificial Sequence
  Synthetic
gttgggaagagugaacttgaaaacuc

SEQ ID NO: 42527 - DNA, 23 bp, Artificial Sequence
  Synthetic
ttgctactugccttttcctucca

SEQ ID NO: 42528 - DNA, 21 bp, Artificial Sequence
  Synthetic
gatggcgccugtcagcttaua

SEQ ID NO: 42529 - DNA, 27 bp, Artificial Sequence
  Synthetic
cagggatuaaggagacaagttttcuct

SEQ ID NO: 42530 - DNA, 21 bp, Artificial Sequence
  Synthetic
ccaggtugccatggagauagt

SEQ ID NO: 42531 - DNA, 29 bp, Artificial Sequence
  Synthetic
ccctaacttttctutctctccttcttcuc

SEQ ID NO: 42532 - DNA, 23 bp, Artificial Sequence
  Synthetic
gggaaggcucatatcugagacca

SEQ ID NO: 42533 - DNA, 20 bp, Artificial Sequence
  Synthetic
gucctguaccgcagaaaggg

SEQ ID NO: 42534 - DNA, 21 bp, Artificial Sequence
  Synthetic
ggctgggaucagggagatuct

SEQ ID NO: 42535 - DNA, 17 bp, Artificial Sequence
  Synthetic
acugggauaggccggga

SEQ ID NO: 42536 - DNA, 25 bp, Artificial Sequence
  Synthetic
ccuagacacaaauagaagacacuct

SEQ ID NO: 42537 - DNA, 23 bp, Artificial Sequence
  Synthetic
gttcgacaaaaucgaggacaugg

SEQ ID NO: 42538 - DNA, 21 bp, Artificial Sequence
  Synthetic
ctctctguccacccaggtgua

SEQ ID NO: 42539 - DNA, 25 bp, Artificial Sequence
  Synthetic
tttgaccucaagaaggatgtctucg

SEQ ID NO: 42540 - DNA, 26 bp, Artificial Sequence
  Synthetic
tggagagaagaggagautaagctuga

SEQ ID NO: 42541 - DNA, 19 bp, Artificial Sequence
  Synthetic
ccagtcuggtggactuggg

SEQ ID NO: 42542 - DNA, 24 bp, Artificial Sequence
  Synthetic
gggagagaauagtttgagctccug

SEQ ID NO: 42543 - DNA, 28 bp, Artificial Sequence
  Synthetic
ccatatggtgtugtcctctatttctuag

SEQ ID NO: 42544 - DNA, 19 bp, Artificial Sequence
  Synthetic
ggacaccccucgacttcuc

SEQ ID NO: 42545 - DNA, 22 bp, Artificial Sequence
  Synthetic
tccgtgagcuctacaagaucct

SEQ ID NO: 42546 - DNA, 19 bp, Artificial Sequence
  Synthetic
cttgcucctgcguaaagcc

SEQ ID NO: 42547 - DNA, 18 bp, Artificial Sequence
  Synthetic
cccctacucctccgccut

SEQ ID NO: 42548 - DNA, 22 bp, Artificial Sequence
  Synthetic
gcagcuacagaagtuggaacga

SEQ ID NO: 42549 - DNA, 24 bp, Artificial Sequence
  Synthetic
tctcttcttucagcagcugagaac

SEQ ID NO: 42550 - DNA, 27 bp, Artificial Sequence
  Synthetic
agcctaggataugaacatactgctcut

SEQ ID NO: 42551 - DNA, 21 bp, Artificial Sequence
  Synthetic
acctacccaucaggaccucac

SEQ ID NO: 42552 - DNA, 24 bp, Artificial Sequence
  Synthetic
gtgagctaacacugaagtcctcut

SEQ ID NO: 42553 - DNA, 22 bp, Artificial Sequence
  Synthetic
gaatctugccaatgtggugagc

SEQ ID NO: 42554 - DNA, 24 bp, Artificial Sequence
  Synthetic
ccctgatctaautgtgccctctut

SEQ ID NO: 42555 - DNA, 22 bp, Artificial Sequence
  Synthetic
cacacaccugaagtactugcca

SEQ ID NO: 42556 - DNA, 26 bp, Artificial Sequence
  Synthetic
ggaccataaagauttccagactgcua

SEQ ID NO: 42557 - DNA, 22 bp, Artificial Sequence
  Synthetic
tggattgggccugataaagcug

SEQ ID NO: 42558 - DNA, 30 bp, Artificial Sequence; identical to SEQ ID NO: 30324
  Synthetic

SEQ ID NO: 42559 - DNA, 22 bp, Artificial Sequence
  Synthetic
agtgaauccagtcuggcaaagg

SEQ ID NO: 42560 - DNA, 24 bp, Artificial Sequence
  Synthetic
guggagcaagaugaggaagaagat

SEQ ID NO: 42561 - DNA, 31 bp, Artificial Sequence; identical to SEQ ID NO: 30327
  Synthetic

SEQ ID NO: 42562 - DNA, 25 bp, Artificial Sequence
  Synthetic
gtacttttuaagggttgugggacct

SEQ ID NO: 42563 - DNA, 29 bp, Artificial Sequence
  Synthetic
agcacaaagguagttaattcugaaagaca

SEQ ID NO: 42564 - DNA, 26 bp, Artificial Sequence
  Synthetic
ctacattactgtugcactcctgauct

SEQ ID NO: 42565 - DNA, 28 bp, Artificial Sequence
  Synthetic
gtgacaaacaaatuatcagtcttgggut

SEQ ID NO: 42566 - DNA, 23 bp, Artificial Sequence
  Synthetic
tgtgtggagaaaugatggctugt

SEQ ID NO: 42567 - DNA, 30 bp, Artificial Sequence; identical to SEQ ID NO: 30333
  Synthetic

SEQ ID NO: 42568 - DNA, 29 bp, Artificial Sequence
  Synthetic
gaattgtgaaaucatagcaaagagugacc

SEQ ID NO: 42569 - DNA, 28 bp, Artificial Sequence
  Synthetic
ttgacattaagagcuctgacacattcut

SEQ ID NO: 42570 - DNA, 29 bp, Artificial Sequence
  Synthetic
ccttttatggaccaautagcattccauca

SEQ ID NO: 42571 - DNA, 24 bp, Artificial Sequence
  Synthetic
tctauaggcacctcctuccaaagt

SEQ ID NO: 42572 - DNA, 22 bp, Artificial Sequence
  Synthetic
tgggtgggautcaccactttuc

SEQ ID NO: 42573 - DNA, 24 bp, Artificial Sequence
  Synthetic
ttacaacgtguctctgcttctcuc

SEQ ID NO: 42574 - DNA, 21 bp, Artificial Sequence
  Synthetic
ttcttggucaccctcaggtug

SEQ ID NO: 42575 - DNA, 28 bp, Artificial Sequence
  Synthetic
ctatgatgaagcguttaggcatgttuaa

SEQ ID NO: 42576 - DNA, 21 bp, Artificial Sequence
  Synthetic
caggctggutgagcaacctua

SEQ ID NO: 42577 - DNA, 27 bp, Artificial Sequence
  Synthetic
gctagtggauaagtttttggaggaugt

SEQ ID NO: 42578 - DNA, 22 bp, Artificial Sequence
  Synthetic
gaaattcaggcccuccaggaut

SEQ ID NO: 42579 - DNA, 23 bp, Artificial Sequence
  Synthetic
catcccaccaugatcaggaucac

SEQ ID NO: 42580 - DNA, 29 bp, Artificial Sequence
  Synthetic
gtgtgtctttccutcaagatgtaaatguc

SEQ ID NO: 42581 - DNA, 23 bp, Artificial Sequence
  Synthetic
caacatagugagacccccacaua

SEQ ID NO: 42582 - DNA, 24 bp, Artificial Sequence
  Synthetic
agctttttctuccaaagccactug

SEQ ID NO: 42583 - DNA, 24 bp, Artificial Sequence
  Synthetic
tgtgaagttgcucgaatgtctuct

SEQ ID NO: 42584 - DNA, 31 bp, Artificial Sequence; identical to SEQ ID NO: 30350
  Synthetic

SEQ ID NO: 42585 - DNA, 23 bp, Artificial Sequence
  Synthetic
cacaccttguaatcacccctuga

SEQ ID NO: 42586 - DNA, 24 bp, Artificial Sequence
  Synthetic
tgtggaggaaggauacauttccua

SEQ ID NO: 42587 - DNA, 27 bp, Artificial Sequence
  Synthetic
cacctcacatuctaaagtgttgctuac

SEQ ID NO: 42588 - DNA, 23 bp, Artificial Sequence
  Synthetic
ttgagatcagggaugctccuagt

SEQ ID NO: 42589 - DNA, 23 bp, Artificial Sequence
  Synthetic
aaaagctctaugctgccctucat

SEQ ID NO: 42590 - DNA, 28 bp, Artificial Sequence
  Synthetic
aaatgaactagtaugaactttgccucca

SEQ ID NO: 42591 - DNA, 24 bp, Artificial Sequence
  Synthetic
gacutcatgaggtuaacccaggag

SEQ ID NO: 42592 - DNA, 24 bp, Artificial Sequence
  Synthetic
agcagctgcaacuctttgtattuc

SEQ ID NO: 42593 - DNA, 22 bp, Artificial Sequence
  Synthetic
ccttacccutctgggtctucct

SEQ ID NO: 42594 - DNA, 21 bp, Artificial Sequence
  Synthetic
ctgtgaatgcgugcttcctut

SEQ ID NO: 42595 - DNA, 20 bp, Artificial Sequence
  Synthetic
gagccaaucaggacugcaca

SEQ ID NO: 42596 - DNA, 22 bp, Artificial Sequence
  Synthetic
aggactucttcctguacaacgc

SEQ ID NO: 42597 - DNA, 23 bp, Artificial Sequence
  Synthetic
ggccatgugagctttuagaaaca

SEQ ID NO: 42598 - DNA, 24 bp, Artificial Sequence
  Synthetic
aagcuaaagaccaggauacaggga

SEQ ID NO: 42599 - DNA, 28 bp, Artificial Sequence
  Synthetic
cacatacauatgcatgaguacacacact

SEQ ID NO: 42600 - DNA, 22 bp, Artificial Sequence
  Synthetic
tgacccctgugaaccagtttuc

SEQ ID NO: 42601 - DNA, 31 bp, Artificial Sequence; identical to SEQ ID NO: 30367
  Synthetic

SEQ ID NO: 42602 - DNA, 24 bp, Artificial Sequence
  Synthetic
aaacgugagttgcucaaaccaaat

SEQ ID NO: 42603 - DNA, 20 bp, Artificial Sequence
  Synthetic
caccctguatgttgcctugg

SEQ ID NO: 42604 - DNA, 25 bp, Artificial Sequence
  Synthetic
gggttgattuggagattcagtgugt

SEQ ID NO: 42605 - DNA, 21 bp, Artificial Sequence
  Synthetic
gtagcctagucccctcccaut

SEQ ID NO: 42606 - DNA, 24 bp, Artificial Sequence
  Synthetic
aagutacagtaguagaggcggagt

SEQ ID NO: 42607 - DNA, 26 bp, Artificial Sequence
  Synthetic
tccacctugagttttaatgtguaggg

SEQ ID NO: 42608 - DNA, 20 bp, Artificial Sequence
  Synthetic
gcagcucaccatgtaugcct

SEQ ID NO: 42609 - DNA, 25 bp, Artificial Sequence
  Synthetic
cattgcttuactaaagggucaggct

SEQ ID NO: 42610 - DNA, 18 bp, Artificial Sequence
  Synthetic
ccaccauggacgccauca

SEQ ID NO: 42611 - DNA, 17 bp, Artificial Sequence
  Synthetic
gtgccaggcucgagucc

SEQ ID NO: 42612 - DNA, 19 bp, Artificial Sequence
  Synthetic
ccagcucgaggaggacauc

SEQ ID NO: 42613 - DNA, 27 bp, Artificial Sequence
  Synthetic
gagaaagagaaagagutagccatucgt

SEQ ID NO: 42614 - DNA, 21 bp, Artificial Sequence
  Synthetic
gcaccgaagaugaacuggaca

SEQ ID NO: 42615 - DNA, 25 bp, Artificial Sequence
  Synthetic
ggtaaacttccutcattgctcucca

SEQ ID NO: 42616 - DNA, 17 bp, Artificial Sequence
  Synthetic
gggaguagctcgcugga

SEQ ID NO: 42617 - DNA, 17 bp, Artificial Sequence
  Synthetic
gggaggaugcgcctcug

SEQ ID NO: 42618 - DNA, 25 bp, Artificial Sequence
  Synthetic
cttgggttttcutgcttgtcttuct

SEQ ID NO: 42619 - DNA, 25 bp, Artificial Sequence
  Synthetic
gaatcaagacugtacattgcuccct

SEQ ID NO: 42620 - DNA, 23 bp, Artificial Sequence
  Synthetic
gggtgtcutatgtatgaaugcgt

SEQ ID NO: 42621 - DNA, 23 bp, Artificial Sequence
  Synthetic
ccuaaaaaccauacgagccauca

SEQ ID NO: 42622 - DNA, 23 bp, Artificial Sequence
  Synthetic
ccttaacauctgttggcugagct

SEQ ID NO: 42623 - DNA, 27 bp, Artificial Sequence
  Synthetic
tggcttcauccacaactctcatatuac

SEQ ID NO: 42624 - DNA, 22 bp, Artificial Sequence
  Synthetic
cctcacucaccctccatttcut

SEQ ID NO: 42625 - DNA, 25 bp, Artificial Sequence
  Synthetic
gaaggcatgguggtgagtttatuac

SEQ ID NO: 42626 - DNA, 28 bp, Artificial Sequence
  Synthetic
tgaggtctctutgtgttctctatuaact

SEQ ID NO: 42627 - DNA, 24 bp, Artificial Sequence
  Synthetic
gcctagaatucagcccaagtttut

SEQ ID NO: 42628 - DNA, 24 bp, Artificial Sequence
  Synthetic
tgtgattgatguttgcctgccuaa

SEQ ID NO: 42629 - DNA, 23 bp, Artificial Sequence
  Synthetic
gcagcuaaggaggttttcacaug

SEQ ID NO: 42630 - DNA, 18 bp, Artificial Sequence
  Synthetic
gcugccccgggagaaauc

SEQ ID NO: 42631 - DNA, 20 bp, Artificial Sequence
  Synthetic
gctgttgguctggtcuccat

SEQ ID NO: 42632 - DNA, 20 bp, Artificial Sequence
  Synthetic
ccugaggacugggaaaggga

SEQ ID NO: 42633 - DNA, 20 bp, Artificial Sequence
  Synthetic
acgcucctctugaagaagcc

SEQ ID NO: 42634 - DNA, 21 bp, Artificial Sequence
  Synthetic
ggctugggcaaaaatguccaa

SEQ ID NO: 42635 - DNA, 21 bp, Artificial Sequence
  Synthetic
ctgcccattucttgtcaccuc

SEQ ID NO: 42636 - DNA, 18 bp, Artificial Sequence
  Synthetic
cagguccaccuggacagc

SEQ ID NO: 42637 - DNA, 19 bp, Artificial Sequence
  Synthetic
tcagctgcuctcccacuca

SEQ ID NO: 42638 - DNA, 22 bp, Artificial Sequence
  Synthetic
gagttccccucctctccauact

SEQ ID NO: 42639 - DNA, 19 bp, Artificial Sequence
  Synthetic
ccctgtcuggttgacucga

SEQ ID NO: 42640 - DNA, 18 bp, Artificial Sequence
  Synthetic
cauggagacgcgtgucct

SEQ ID NO: 42641 - DNA, 22 bp, Artificial Sequence
  Synthetic
ctacacacauctgcacacaugg

SEQ ID NO: 42642 - DNA, 19 bp, Artificial Sequence
  Synthetic
cccaagugatgcugagcca

SEQ ID NO: 42643 - DNA, 17 bp, Artificial Sequence
  Synthetic
acugtgccugggacacc

SEQ ID NO: 42644 - DNA, 23 bp, Artificial Sequence
  Synthetic
gcaagaccauagggaatacucca

SEQ ID NO: 42645 - DNA, 27 bp, Artificial Sequence
  Synthetic
gggctattatgaauaaagctgctauga

SEQ ID NO: 42646 - DNA, 22 bp, Artificial Sequence
  Synthetic
cactaccautcaccuacagcca

SEQ ID NO: 42647 - DNA, 24 bp, Artificial Sequence
  Synthetic
gagagactgutgactggtgugaaa

SEQ ID NO: 42648 - DNA, 25 bp, Artificial Sequence
  Synthetic
caaacgttcauaggcaaatgucagg

SEQ ID NO: 42649 - DNA, 22 bp, Artificial Sequence
  Synthetic
agggtgccuagacaagagguag

SEQ ID NO: 42650 - DNA, 21 bp, Artificial Sequence
  Synthetic
cagccucctttggtuagcaag

SEQ ID NO: 42651 - DNA, 22 bp, Artificial Sequence
  Synthetic
tggcgagaggauattccaguga

SEQ ID NO: 42652 - DNA, 23 bp, Artificial Sequence
  Synthetic
tccaaaccaggaggaucagtcuc

SEQ ID NO: 42653 - DNA, 25 bp, Artificial Sequence
  Synthetic
cttactagacacucctctcctcucc

SEQ ID NO: 42654 - DNA, 22 bp, Artificial Sequence
  Synthetic
cccctcgggugctaacttcuat

SEQ ID NO: 42655 - DNA, 27 bp, Artificial Sequence
  Synthetic
cctatgagttcaugagcacattctuct

SEQ ID NO: 42656 - DNA, 23 bp, Artificial Sequence
  Synthetic
gaagcttcacuctgagcauaaca

SEQ ID NO: 42657 - DNA, 22 bp, Artificial Sequence
  Synthetic
aagtgtgaaccugaagggtguc

SEQ ID NO: 42658 - DNA, 22 bp, Artificial Sequence
  Synthetic
cgttgcuccatcacccuagaac

SEQ ID NO: 42659 - DNA, 27 bp, Artificial Sequence
  Synthetic
gcttccttugaaactgacatgtucaat

SEQ ID NO: 42660 - DNA, 24 bp, Artificial Sequence
  Synthetic
accttcccacaucatcctttcuct

SEQ ID NO: 42661 - DNA, 31 bp, Artificial Sequence; identical to SEQ ID NO: 30427
  Synthetic

SEQ ID NO: 42662 - DNA, 18 bp, Artificial Sequence
  Synthetic
cgggacaaguccgacuca

SEQ ID NO: 42663 - DNA, 20 bp, Artificial Sequence
  Synthetic
gaccagcgcuacgtccttua

SEQ ID NO: 42664 - DNA, 20 bp, Artificial Sequence
  Synthetic
ccaaagccuggagcttguca

SEQ ID NO: 42665 - DNA, 17 bp, Artificial Sequence
  Synthetic
ggcacaauccgcugcac

SEQ ID NO: 42666 - DNA, 22 bp, Artificial Sequence
  Synthetic
cuccacgggagcaaauacagag

SEQ ID NO: 42667 - DNA, 26 bp, Artificial Sequence
  Synthetic
cactctcctttugaccttagcatuaa

SEQ ID NO: 42668 - DNA, 27 bp, Artificial Sequence
  Synthetic
ggatgaaaagucaaaactgaccaguct

SEQ ID NO: 42669 - DNA, 26 bp, Artificial Sequence
  Synthetic
gctgtttgaagaguttgccatagaug

SEQ ID NO: 42670 - DNA, 21 bp, Artificial Sequence
  Synthetic
ccatgcuccaaagguagcaag

SEQ ID NO: 42671 - DNA, 23 bp, Artificial Sequence
  Synthetic
aaagacaaagtcugccctctgut

SEQ ID NO: 42672 - DNA, 26 bp, Artificial Sequence
  Synthetic
ggcaggagauagaacagatggtagua

SEQ ID NO: 42673 - DNA, 21 bp, Artificial Sequence
  Synthetic
tcaacuacggccgcatctaug

SEQ ID NO: 42674 - DNA, 23 bp, Artificial Sequence
  Synthetic
gcccaatgtucatcagaactguc

SEQ ID NO: 42675 - DNA, 22 bp, Artificial Sequence
  Synthetic
tgggtauctcactctucccaca

SEQ ID NO: 42676 - DNA, 22 bp, Artificial Sequence
  Synthetic
gggaaggaaaugggtctuagca

SEQ ID NO: 42677 - DNA, 23 bp, Artificial Sequence
  Synthetic
gatagattcugcttcccauggct

SEQ ID NO: 42678 - DNA, 22 bp, Artificial Sequence
  Synthetic
agtctcaggugtgtcactcuga

SEQ ID NO: 42679 - DNA, 22 bp, Artificial Sequence
  Synthetic
cagggccugatataggtgtgug

SEQ ID NO: 42680 - DNA, 20 bp, Artificial Sequence
  Synthetic
ctccccaaagcucaggtuca

SEQ ID NO: 42681 - DNA, 22 bp, Artificial Sequence
  Synthetic
cagagtgggcauctggtaauca

SEQ ID NO: 42682 - DNA, 21 bp, Artificial Sequence
  Synthetic
tgacgcuctgagtagugcaga

SEQ ID NO: 42683 - DNA, 25 bp, Artificial Sequence
  Synthetic
gacattgugagagagagaacctucc

SEQ ID NO: 42684 - DNA, 21 bp, Artificial Sequence
  Synthetic
cctucccagagauaaccccua

SEQ ID NO: 42685 - DNA, 20 bp, Artificial Sequence
  Synthetic
ccctaguggactggctcugt

SEQ ID NO: 42686 - DNA, 25 bp, Artificial Sequence
  Synthetic
atccatcaacgacutcttcatcucc

SEQ ID NO: 42687 - DNA, 22 bp, Artificial Sequence
  Synthetic
cttgcuaaaccagcucagggat

SEQ ID NO: 42688 - DNA, 17 bp, Artificial Sequence
  Synthetic
tgugccacagcccaugt

SEQ ID NO: 42689 - DNA, 19 bp, Artificial Sequence
  Synthetic
gtccctugctctggtuccc

SEQ ID NO: 42690 - DNA, 22 bp, Artificial Sequence
  Synthetic
caggaaaggaguacctccccua

SEQ ID NO: 42691 - DNA, 20 bp, Artificial Sequence
  Synthetic
cctggagguccctactggug

SEQ ID NO: 42692 - DNA, 19 bp, Artificial Sequence
  Synthetic
cagcccguaacaggaccuc

SEQ ID NO: 42693 - DNA, 17 bp, Artificial Sequence
  Synthetic
ccgtacccguggccauc

SEQ ID NO: 42694 - DNA, 19 bp, Artificial Sequence
  Synthetic
gtagggcaggcuctgctuc

SEQ ID NO: 42695 - DNA, 20 bp, Artificial Sequence
  Synthetic
ggcugcacgagcaaatctuc

SEQ ID NO: 42696 - DNA, 17 bp, Artificial Sequence
  Synthetic
ggccaccutccuccaga

SEQ ID NO: 42697 - DNA, 21 bp, Artificial Sequence
  Synthetic
caggcatggucaaacccatut

SEQ ID NO: 42698 - DNA, 20 bp, Artificial Sequence
  Synthetic
caccccucactctgcttcuc

SEQ ID NO: 42699 - DNA, 18 bp, Artificial Sequence
  Synthetic
gguccacccgaagctugt

SEQ ID NO: 42700 - DNA, 18 bp, Artificial Sequence
  Synthetic
agaggaucacgcgggtug

SEQ ID NO: 42701 - DNA, 21 bp, Artificial Sequence
  Synthetic
guatttggaggucagcacggt

SEQ ID NO: 42702 - DNA, 22 bp, Artificial Sequence
  Synthetic
gtgttgctcagaugtccccaut

SEQ ID NO: 42703 - DNA, 23 bp, Artificial Sequence
  Synthetic
aaagacacagguagctcacucac

SEQ ID NO: 42704 - DNA, 21 bp, Artificial Sequence
  Synthetic
agggttctuggagagcacauc

SEQ ID NO: 42705 - DNA, 18 bp, Artificial Sequence
  Synthetic
ctgacgucacccauccca

SEQ ID NO: 42706 - DNA, 23 bp, Artificial Sequence
  Synthetic
ggaggtgagugggagatguagat

SEQ ID NO: 42707 - DNA, 31 bp, Artificial Sequence; identical to SEQ ID NO: 30473
  Synthetic

SEQ ID NO: 42708 - DNA, 19 bp, Artificial Sequence
  Synthetic
cctgggtgucctctccugt

SEQ ID NO: 42709 - DNA, 24 bp, Artificial Sequence
  Synthetic
aacctuccagagcagttucagaaa

SEQ ID NO: 42710 - DNA, 18 bp, Artificial Sequence
  Synthetic
agggcccugctcacatuc

SEQ ID NO: 42711 - DNA, 17 bp, Artificial Sequence
  Synthetic
tgccagcucacugcaca

SEQ ID NO: 42712 - DNA, 23 bp, Artificial Sequence
  Synthetic
tgtcctatgagaucgtcctgucc

SEQ ID NO: 42713 - DNA, 22 bp, Artificial Sequence
  Synthetic
cccaagguaccatcttcugagt

SEQ ID NO: 42714 - DNA, 21 bp, Artificial Sequence
  Synthetic
cgtccaugacctgtugaccac

SEQ ID NO: 42715 - DNA, 21 bp, Artificial Sequence
  Synthetic
ctcagaaagcugcactucacc

SEQ ID NO: 42716 - DNA, 17 bp, Artificial Sequence
  Synthetic
gcagacgggcuggtgug

SEQ ID NO: 42717 - DNA, 21 bp, Artificial Sequence
  Synthetic
ccacggagaaauagcccugag

SEQ ID NO: 42718 - DNA, 23 bp, Artificial Sequence
  Synthetic
gtaagtccuggccttctctucaa

SEQ ID NO: 42719 - DNA, 21 bp, Artificial Sequence
  Synthetic
gacuccaacacaacgcagaug

SEQ ID NO: 42720 - DNA, 22 bp, Artificial Sequence
  Synthetic
ctctggcttucaccatcctcut

SEQ ID NO: 42721 - DNA, 23 bp, Artificial Sequence
  Synthetic
acatcccucagacaugcaaacag

SEQ ID NO: 42722 - DNA, 18 bp, Artificial Sequence
  Synthetic
gaaggcccugtccugacg

SEQ ID NO: 42723 - DNA, 20 bp, Artificial Sequence
  Synthetic
cagaggcucgcagtctttug

SEQ ID NO: 42724 - DNA, 20 bp, Artificial Sequence
  Synthetic
ctgaggtgucctgtctccug

SEQ ID NO: 42725 - DNA, 20 bp, Artificial Sequence
  Synthetic
gctgagatgugcgtgagcut

SEQ ID NO: 42726 - DNA, 21 bp, Artificial Sequence
  Synthetic
cctgaccacccuctccatuac

SEQ ID NO: 42727 - DNA, 18 bp, Artificial Sequence
  Synthetic
tttcugccgcaaggccua

SEQ ID NO: 42728 - DNA, 18 bp, Artificial Sequence
  Synthetic
ccatugccaccccucact

SEQ ID NO: 42729 - DNA, 19 bp, Artificial Sequence
  Synthetic
ccacagccccaugtcctuc

SEQ ID NO: 42730 - DNA, 21 bp, Artificial Sequence
  Synthetic
ctttggcccutggtgauaggt

SEQ ID NO: 42731 - DNA, 22 bp, Artificial Sequence
  Synthetic
atcatguccagacaggttuccg

SEQ ID NO: 42732 - DNA, 22 bp, Artificial Sequence
  Synthetic
gtttcacgcuccctgtcttcua

SEQ ID NO: 42733 - DNA, 21 bp, Artificial Sequence
  Synthetic
gaggaaaggaaggugcaguca

SEQ ID NO: 42734 - DNA, 20 bp, Artificial Sequence
  Synthetic
gaggctgguggttttgcauc

SEQ ID NO: 42735 - DNA, 21 bp, Artificial Sequence
  Synthetic
gucttctccugcacaggaacc

SEQ ID NO: 42736 - DNA, 19 bp, Artificial Sequence
  Synthetic
guactggccucaggccaaa

SEQ ID NO: 42737 - DNA, 22 bp, Artificial Sequence
  Synthetic
caccgacagugacttguacagg

SEQ ID NO: 42738 - DNA, 21 bp, Artificial Sequence
  Synthetic
tctctgcucgacctgtgtgua

SEQ ID NO: 42739 - DNA, 21 bp, Artificial Sequence
  Synthetic
cagcacctaugaggcagagug

SEQ ID NO: 42740 - DNA, 21 bp, Artificial Sequence
  Synthetic
ggttctctutgggatggucct

SEQ ID NO: 42741 - DNA, 20 bp, Artificial Sequence
  Synthetic
agaggagcuggacttgcuca

SEQ ID NO: 42742 - DNA, 19 bp, Artificial Sequence
  Synthetic
gaggtuaaggcccggucac

SEQ ID NO: 42743 - DNA, 23 bp, Artificial Sequence
  Synthetic
tttaaggcguccctctctacuct

SEQ ID NO: 42744 - DNA, 19 bp, Artificial Sequence
  Synthetic
gatggccaggcuctgtgut

SEQ ID NO: 42745 - DNA, 18 bp, Artificial Sequence
  Synthetic
acacagcuccagcggaug

SEQ ID NO: 42746 - DNA, 17 bp, Artificial Sequence
  Synthetic
gtgaugccacccugcct

SEQ ID NO: 42747 - DNA, 18 bp, Artificial Sequence
  Synthetic
ccucaccacacacgucca

SEQ ID NO: 42748 - DNA, 21 bp, Artificial Sequence
  Synthetic
ccagagccccuggagtaauca

SEQ ID NO: 42749 - DNA, 23 bp, Artificial Sequence
  Synthetic
accggagucattgtagacaaugg

SEQ ID NO: 42750 - DNA, 19 bp, Artificial Sequence
  Synthetic
caguagccgagaucagcct

SEQ ID NO: 42751 - DNA, 17 bp, Artificial Sequence
  Synthetic
ctctuggcgccacacug

SEQ ID NO: 42752 - DNA, 19 bp, Artificial Sequence
  Synthetic
ccugcacgcaaatgugagt

SEQ ID NO: 42753 - DNA, 21 bp, Artificial Sequence
  Synthetic
gagggagccccauattcccua

SEQ ID NO: 42754 - DNA, 19 bp, Artificial Sequence
  Synthetic
tcctcgguggaggactuca

SEQ ID NO: 42755 - DNA, 21 bp, Artificial Sequence
  Synthetic
gtgtaccacutctgugggcat

SEQ ID NO: 42756 - DNA, 23 bp, Artificial Sequence
  Synthetic
cttgtaaggugcggcuagaaact

SEQ ID NO: 42757 - DNA, 20 bp, Artificial Sequence
  Synthetic
cctacccugggtggtcgaua

SEQ ID NO: 42758 - DNA, 27 bp, Artificial Sequence
  Synthetic
tcaaggaguaaaaacacaggtttugat

SEQ ID NO: 42759 - DNA, 28 bp, Artificial Sequence
  Synthetic
tcttcctagaggcautcattgtgaaaug

SEQ ID NO: 42760 - DNA, 27 bp, Artificial Sequence
  Synthetic
tttaggctguttatctatgtugcccaa

SEQ ID NO: 42761 - DNA, 28 bp, Artificial Sequence
  Synthetic
cagccatucaccaaagatattucagaaa

SEQ ID NO: 42762 - DNA, 28 bp, Artificial Sequence
  Synthetic
tttttcagtgacauatcattagccccut

SEQ ID NO: 42763 - DNA, 26 bp, Artificial Sequence
  Synthetic
aggtgcacaaacacutctctactuac

SEQ ID NO: 42764 - DNA, 24 bp, Artificial Sequence
  Synthetic
gatctgtgaacugctgttctccua

SEQ ID NO: 42765 - DNA, 24 bp, Artificial Sequence
  Synthetic
gggccattcutgacaagagtttuc

SEQ ID NO: 42766 - DNA, 24 bp, Artificial Sequence
  Synthetic
ggtgcaaaacugtagaaagtugct

SEQ ID NO: 42767 - DNA, 27 bp, Artificial Sequence
  Synthetic
tcccaaccaugaagatttctttgcuaa

SEQ ID NO: 42768 - DNA, 21 bp, Artificial Sequence
  Synthetic
tgcttttcuctggccugagag

SEQ ID NO: 42769 - DNA, 20 bp, Artificial Sequence
  Synthetic
cagggucaagcagcucaaga

SEQ ID NO: 42770 - DNA, 24 bp, Artificial Sequence
  Synthetic
ggaagaggtuccctgacttcacua

SEQ ID NO: 42771 - DNA, 20 bp, Artificial Sequence
  Synthetic
ggagcaagcuccacgagaug

SEQ ID NO: 42772 - DNA, 17 bp, Artificial Sequence
  Synthetic
ggcccucacctgctgug

SEQ ID NO: 42773 - DNA, 19 bp, Artificial Sequence
  Synthetic
cccugaggcatgacuccaa

SEQ ID NO: 42774 - DNA, 21 bp, Artificial Sequence
  Synthetic
catctgaggcuctccuagcaa

SEQ ID NO: 42775 - DNA, 23 bp, Artificial Sequence
  Synthetic
cttgtcctcccugttgactcaug

SEQ ID NO: 42776 - DNA, 23 bp, Artificial Sequence
  Synthetic
cgaagttuccacaccaaccauga

SEQ ID NO: 42777 - DNA, 19 bp, Artificial Sequence
  Synthetic
caacaugcaggcgcucaag

SEQ ID NO: 42778 - DNA, 21 bp, Artificial Sequence
  Synthetic
cctcgcauggactggtgaaua

SEQ ID NO: 42779 - DNA, 23 bp, Artificial Sequence
  Synthetic
cctuggaagucaaagaggaacuc

SEQ ID NO: 42780 - DNA, 19 bp, Artificial Sequence
  Synthetic
gagccacgcgucatacuct

SEQ ID NO: 42781 - DNA, 22 bp, Artificial Sequence
  Synthetic
cggccgcutatgataaacugga

SEQ ID NO: 42782 - DNA, 23 bp, Artificial Sequence
  Synthetic
agagaagtugagaggacccauga

SEQ ID NO: 42783 - DNA, 22 bp, Artificial Sequence
  Synthetic
acctcttugcatccctttugca

SEQ ID NO: 42784 - DNA, 19 bp, Artificial Sequence
  Synthetic
ctccuccccacagaacugg

SEQ ID NO: 42785 - DNA, 26 bp, Artificial Sequence
  Synthetic
aggtggaacauaagaagaagaagcug

SEQ ID NO: 42786 - DNA, 25 bp, Artificial Sequence
  Synthetic
ctgctgatgucactcttatgtguca

SEQ ID NO: 42787 - DNA, 22 bp, Artificial Sequence
  Synthetic
actgccatucactgtgttccuc

SEQ ID NO: 42788 - DNA, 21 bp, Artificial Sequence
  Synthetic
ctcctggagguctgagatgug

SEQ ID NO: 42789 - DNA, 25 bp, Artificial Sequence
  Synthetic
cauaactgtctggucccagaaaagt

SEQ ID NO: 42790 - DNA, 28 bp, Artificial Sequence
  Synthetic
caacagagcaagaccucatctcuaaaaa

SEQ ID NO: 42791 - DNA, 23 bp, Artificial Sequence
  Synthetic
ggaacgaaaacucctugaggaga

SEQ ID NO: 42792 - DNA, 23 bp, Artificial Sequence
  Synthetic
ctgtggtgagggucaagtgatut

SEQ ID NO: 42793 - DNA, 22 bp, Artificial Sequence
  Synthetic
gtatgcagaggcugaggagaug

SEQ ID NO: 42794 - DNA, 21 bp, Artificial Sequence
  Synthetic
cccagccaugcatccauacag

SEQ ID NO: 42795 - DNA, 21 bp, Artificial Sequence
  Synthetic
aatgatgggcuaaccgtgugt

SEQ ID NO: 42796 - DNA, 25 bp, Artificial Sequence
  Synthetic
tgtgattcgcguttgaggtatuagg

SEQ ID NO: 42797 - DNA, 24 bp, Artificial Sequence
  Synthetic
ctcttccttuccttcctttugcag

SEQ ID NO: 42798 - DNA, 20 bp, Artificial Sequence
  Synthetic
gggtaccuccagcatccaut

SEQ ID NO: 42799 - DNA, 20 bp, Artificial Sequence
  Synthetic
gggatccacugccctcttug

SEQ ID NO: 42800 - DNA, 20 bp, Artificial Sequence
  Synthetic
cgtagcguggtcatcagcut

SEQ ID NO: 42801 - DNA, 22 bp, Artificial Sequence
  Synthetic
gctgagccuctggcctattuag

SEQ ID NO: 42802 - DNA, 21 bp, Artificial Sequence
  Synthetic
tgccactcucagactgtcuct

SEQ ID NO: 42803 - DNA, 20 bp, Artificial Sequence
  Synthetic
gaaugctggtuccccaaagc

SEQ ID NO: 42804 - DNA, 21 bp, Artificial Sequence
  Synthetic
acacacgtguacaaggtguga

SEQ ID NO: 42805 - DNA, 24 bp, Artificial Sequence
  Synthetic
gctctucaaccacaccatgtucat

SEQ ID NO: 42806 - DNA, 23 bp, Artificial Sequence
  Synthetic
gccatctacaugcctttcuccaa

SEQ ID NO: 42807 - DNA, 22 bp, Artificial Sequence
  Synthetic
gcaacataugagcgcctttucc

SEQ ID NO: 42808 - DNA, 24 bp, Artificial Sequence
  Synthetic
gggtgcatggauggataagtgaua

SEQ ID NO: 42809 - DNA, 26 bp, Artificial Sequence
  Synthetic
tcacgatgttucttttctccauccag

SEQ ID NO: 42810 - DNA, 25 bp, Artificial Sequence
  Synthetic
tcttaacaggutccactggtaucca

SEQ ID NO: 42811 - DNA, 24 bp, Artificial Sequence
  Synthetic
tgacctgtctucctctccttcuag

SEQ ID NO: 42812 - DNA, 23 bp, Artificial Sequence
  Synthetic
ctggaaagauagaggtggctcut

SEQ ID NO: 42813 - DNA, 23 bp, Artificial Sequence
  Synthetic
cctgaactgugttttcctgtugg

SEQ ID NO: 42814 - DNA, 22 bp, Artificial Sequence
  Synthetic
ggugcaagaggatcaugcagat

SEQ ID NO: 42815 - DNA, 25 bp, Artificial Sequence
  Synthetic
catatattcuccagcccctgatguc

SEQ ID NO: 42816 - DNA, 25 bp, Artificial Sequence
  Synthetic
ctgcactcauggatcttttcttuca

SEQ ID NO: 42817 - DNA, 28 bp, Artificial Sequence
  Synthetic
cccttagcucagagctcattttaatuca

SEQ ID NO: 42818 - DNA, 21 bp, Artificial Sequence
  Synthetic
gcccutgtacatgucgacgat

SEQ ID NO: 42819 - DNA, 30 bp, Artificial Sequence; identical to SEQ ID NO: 30585
  Synthetic

SEQ ID NO: 42820 - DNA, 24 bp, Artificial Sequence
  Synthetic
ttctggaugtcatcttucccaacc

SEQ ID NO: 42821 - DNA, 26 bp, Artificial Sequence
  Synthetic
tgagaagtucctctttguggacaaaa

SEQ ID NO: 42822 - DNA, 17 bp, Artificial Sequence
  Synthetic
ggacggucagagcugca

SEQ ID NO: 42823 - DNA, 21 bp, Artificial Sequence
  Synthetic
ggugaagaugccggaggaaag

SEQ ID NO: 42824 - DNA, 17 bp, Artificial Sequence
  Synthetic
cggccccucctcctcuc

SEQ ID NO: 42825 - DNA, 20 bp, Artificial Sequence
  Synthetic
agagtcugtgccucacgagt

SEQ ID NO: 42826 - DNA, 20 bp, Artificial Sequence
  Synthetic
agcaagttugccgcctttug

SEQ ID NO: 42827 - DNA, 20 bp, Artificial Sequence
  Synthetic
ggcugcagaagcgagtctut

SEQ ID NO: 42828 - DNA, 25 bp, Artificial Sequence
  Synthetic
aggtccttcutatccaggaugaaga

SEQ ID NO: 42829 - DNA, 22 bp, Artificial Sequence
  Synthetic
tgtcctccacacaugggaaaug

SEQ ID NO: 42830 - DNA, 22 bp, Artificial Sequence
  Synthetic
cctccagcucagttcctugaaa

SEQ ID NO: 42831 - DNA, 27 bp, Artificial Sequence
  Synthetic
ctctaaaaagtucctttcccttccuca

SEQ ID NO: 42832 - DNA, 19 bp, Artificial Sequence
  Synthetic
ccagggcgugaccatctua

SEQ ID NO: 42833 - DNA, 22 bp, Artificial Sequence
  Synthetic
cttcctugacctcccauaaccc

SEQ ID NO: 42834 - DNA, 26 bp, Artificial Sequence
  Synthetic
agctggaagacaauttcaaagagugt

SEQ ID NO: 42835 - DNA, 24 bp, Artificial Sequence
  Synthetic
tttgcacaacaugcatctaucaga

SEQ ID NO: 42836 - DNA, 23 bp, Artificial Sequence
  Synthetic
gtgttgtgtguttgtgagtguca

SEQ ID NO: 42837 - DNA, 20 bp, Artificial Sequence
  Synthetic
gggagcagcaugctaccuat

SEQ ID NO: 42838 - DNA, 23 bp, Artificial Sequence
  Synthetic
cagaaaccacauctcaugaacgc

SEQ ID NO: 42839 - DNA, 27 bp, Artificial Sequence
  Synthetic
ttcaccatcaucattccctttcttuca

SEQ ID NO: 42840 - DNA, 24 bp, Artificial Sequence
  Synthetic
caggaagtagaugaggtcgcauag

SEQ ID NO: 42841 - DNA, 22 bp, Artificial Sequence
  Synthetic
gatccaactggugaagagccut

SEQ ID NO: 42842 - DNA, 22 bp, Artificial Sequence
  Synthetic
gccatgagtugacagggaacut

SEQ ID NO: 42843 - DNA, 23 bp, Artificial Sequence
  Synthetic
caaauagcgccatcaucaacgac

SEQ ID NO: 42844 - DNA, 24 bp, Artificial Sequence
  Synthetic
ttgcgguagaaggttcuaaaagca

SEQ ID NO: 42845 - DNA, 23 bp, Artificial Sequence
  Synthetic
cttccacauctgtgtcttugcag

SEQ ID NO: 42846 - DNA, 21 bp, Artificial Sequence
  Synthetic
cucagacattctugcgcaacc

SEQ ID NO: 42847 - DNA, 26 bp, Artificial Sequence
  Synthetic
ttcactttattcuctgcagaagcugt

SEQ ID NO: 42848 - DNA, 23 bp, Artificial Sequence
  Synthetic
aaaacuccccctguaagcaaagt

SEQ ID NO: 42849 - DNA, 24 bp, Artificial Sequence
  Synthetic
ccctaacccaguccttttatccuc

SEQ ID NO: 42850 - DNA, 29 bp, Artificial Sequence
  Synthetic
actaatcttttagggucttctcagacucc

SEQ ID NO: 42851 - DNA, 24 bp, Artificial Sequence
  Synthetic
ccataaatggcucttcctgtgtuc

SEQ ID NO: 42852 - DNA, 22 bp, Artificial Sequence
  Synthetic
catgtgtccauctgagctcucc

SEQ ID NO: 42853 - DNA, 25 bp, Artificial Sequence
  Synthetic
cttaccttccccautcattcacuca

SEQ ID NO: 42854 - DNA, 22 bp, Artificial Sequence
  Synthetic
ccatccucctcctuacccaagt

SEQ ID NO: 42855 - DNA, 23 bp, Artificial Sequence
  Synthetic
cctcagttuacccatgaccctuc

SEQ ID NO: 42856 - DNA, 18 bp, Artificial Sequence
  Synthetic
ggcccagutgatcccuga

SEQ ID NO: 42857 - DNA, 19 bp, Artificial Sequence
  Synthetic
cgcacagagcutgctaugg

SEQ ID NO: 42858 - DNA, 21 bp, Artificial Sequence
  Synthetic
cacccugaggtgguaacagac

SEQ ID NO: 42859 - DNA, 25 bp, Artificial Sequence
  Synthetic
ctgccttuctgtattttcugaccct

SEQ ID NO: 42860 - DNA, 20 bp, Artificial Sequence
  Synthetic
ccctagcugggagggtagut

SEQ ID NO: 42861 - DNA, 30 bp, Artificial Sequence; identical to SEQ ID NO: 30627
  Synthetic

SEQ ID NO: 42862 - DNA, 24 bp, Artificial Sequence
  Synthetic
ccttttctgcugtagaaaguccct

SEQ ID NO: 42863 - DNA, 21 bp, Artificial Sequence
  Synthetic
guggaaccagagucagagaug

SEQ ID NO: 42864 - DNA, 19 bp, Artificial Sequence
  Synthetic
gttcggtgucgccgaagua

SEQ ID NO: 42865 - DNA, 17 bp, Artificial Sequence
  Synthetic
guggucacccgcagact

SEQ ID NO: 42866 - DNA, 30 bp, Artificial Sequence; identical to SEQ ID NO: 30632
  Synthetic

SEQ ID NO: 42867 - DNA, 25 bp, Artificial Sequence
  Synthetic
acccattaucaccactctgtttcug

SEQ ID NO: 42868 - DNA, 26 bp, Artificial Sequence
  Synthetic
acagaatgacuaaaagttcccugcaa

SEQ ID NO: 42869 - DNA, 25 bp, Artificial Sequence
  Synthetic
agcacttcctcucttaggtcctuac

SEQ ID NO: 42870 - DNA, 20 bp, Artificial Sequence
  Synthetic
guctctggcugcagagcaat

SEQ ID NO: 42871 - DNA, 24 bp, Artificial Sequence
  Synthetic
aggugatggacatauggcaaacag

SEQ ID NO: 42872 - DNA, 28 bp, Artificial Sequence
  Synthetic
cgcatctttcaguaatcattttggtuct

SEQ ID NO: 42873 - DNA, 23 bp, Artificial Sequence
  Synthetic
tcgtacagugactgtccttcugt

SEQ ID NO: 42874 - DNA, 25 bp, Artificial Sequence
  Synthetic
tcagacagtguatgtttggagtuca

SEQ ID NO: 42875 - DNA, 20 bp, Artificial Sequence
  Synthetic
cugcttgatcauggccaagg

SEQ ID NO: 42876 - DNA, 21 bp, Artificial Sequence
  Synthetic
ccaggacacucccacatucac

SEQ ID NO: 42877 - DNA, 24 bp, Artificial Sequence
  Synthetic
tggccucaaagctttcctuaacaa

SEQ ID NO: 42878 - DNA, 22 bp, Artificial Sequence
  Synthetic
aagagaggauggagguccagag

SEQ ID NO: 42879 - DNA, 20 bp, Artificial Sequence
  Synthetic
cttcacaggcggugacagua

SEQ ID NO: 42880 - DNA, 20 bp, Artificial Sequence
  Synthetic
tgccugccgtgtgtuaaact

SEQ ID NO: 42881 - DNA, 26 bp, Artificial Sequence
  Synthetic
ctcctttgtcuccagtctaatggtut

SEQ ID NO: 42882 - DNA, 20 bp, Artificial Sequence
  Synthetic
tcagaacgutgacagugcgt

SEQ ID NO: 42883 - DNA, 26 bp, Artificial Sequence
  Synthetic
gcctgtgggaaaauggtttctaauga

SEQ ID NO: 42884 - DNA, 26 bp, Artificial Sequence
  Synthetic
gtgccctucacagacatcttuaaaaa

SEQ ID NO: 42885 - DNA, 17 bp, Artificial Sequence
  Synthetic
cggccccacgcuctuac

SEQ ID NO: 42886 - DNA, 21 bp, Artificial Sequence
  Synthetic
aggaataaucgcccccgatug

SEQ ID NO: 42887 - DNA, 17 bp, Artificial Sequence
  Synthetic
cugcccccacuggacat

SEQ ID NO: 42888 - DNA, 18 bp, Artificial Sequence
  Synthetic
gcgaauacaccggcucgt

SEQ ID NO: 42889 - DNA, 22 bp, Artificial Sequence
  Synthetic
ctccaggucccttcgtattugg

SEQ ID NO: 42890 - DNA, 19 bp, Artificial Sequence
  Synthetic
ctgctucaaccctguccgt

SEQ ID NO: 42891 - DNA, 20 bp, Artificial Sequence
  Synthetic
gggagttgauggacgtccuc

SEQ ID NO: 42892 - DNA, 22 bp, Artificial Sequence
  Synthetic
cagtgacuccgagatccucaag

SEQ ID NO: 42893 - DNA, 21 bp, Artificial Sequence
  Synthetic
ctgatgguggagtggatgucg

SEQ ID NO: 42894 - DNA, 18 bp, Artificial Sequence
  Synthetic
ctcggacgggcucaagua

SEQ ID NO: 42895 - DNA, 20 bp, Artificial Sequence
  Synthetic
ccaccttcucgcggatctug

SEQ ID NO: 42896 - DNA, 19 bp, Artificial Sequence
  Synthetic
ccucaacccagaccccugt

SEQ ID NO: 42897 - DNA, 20 bp, Artificial Sequence
  Synthetic
cccacgaugccagtaucagg

SEQ ID NO: 42898 - DNA, 19 bp, Artificial Sequence
  Synthetic
gacatcgaggugctgucca

SEQ ID NO: 42899 - DNA, 18 bp, Artificial Sequence
  Synthetic
cucctcguccaccgacac

SEQ ID NO: 42900 - DNA, 18 bp, Artificial Sequence
  Synthetic
ggcctgcucgtggaugac

SEQ ID NO: 42901 - DNA, 23 bp, Artificial Sequence
  Synthetic
catccucagcaagggtttcauct

SEQ ID NO: 42902 - DNA, 19 bp, Artificial Sequence
  Synthetic
gcagagacugcgguccaag

SEQ ID NO: 42903 - DNA, 22 bp, Artificial Sequence
  Synthetic
ccattctccucgtcggactcua

SEQ ID NO: 42904 - DNA, 22 bp, Artificial Sequence
  Synthetic
gggtctgcuagcttggugaaaa

SEQ ID NO: 42905 - DNA, 28 bp, Artificial Sequence
  Synthetic
gcgacatctcaucagatgaaaaagtuaa

SEQ ID NO: 42906 - DNA, 19 bp, Artificial Sequence
  Synthetic
ggcttucaggccaacaugg

SEQ ID NO: 42907 - DNA, 17 bp, Artificial Sequence
  Synthetic
cagagcucggccuccag

SEQ ID NO: 42908 - DNA, 30 bp, Artificial Sequence; identical to SEQ ID NO: 30674
  Synthetic

SEQ ID NO: 42909 - DNA, 28 bp, Artificial Sequence
  Synthetic
gctactgacugaagaacatcagaugaat

SEQ ID NO: 42910 - DNA, 20 bp, Artificial Sequence
  Synthetic
gaggcagcauttccuggaac

SEQ ID NO: 42911 - DNA, 19 bp, Artificial Sequence
  Synthetic
ccacagccucactcucaca

SEQ ID NO: 42912 - DNA, 22 bp, Artificial Sequence
  Synthetic
ccagcaguggttctgattugga

SEQ ID NO: 42913 - DNA, 29 bp, Artificial Sequence
  Synthetic
gttcagagagcuctgatttacagaactua

SEQ ID NO: 42914 - DNA, 24 bp, Artificial Sequence
  Synthetic
acggaauccccaagtagttagugt

SEQ ID NO: 42915 - DNA, 21 bp, Artificial Sequence
  Synthetic
aatgaccuccacgaactcugg

SEQ ID NO: 42916 - DNA, 26 bp, Artificial Sequence
  Synthetic
gttgtccttggugtagaactttguct

SEQ ID NO: 42917 - DNA, 24 bp, Artificial Sequence
  Synthetic
gatctcatcgaugtagacgaugca

SEQ ID NO: 42918 - DNA, 22 bp, Artificial Sequence
  Synthetic
caaggtcttcgucctgtgaguc

SEQ ID NO: 42919 - DNA, 24 bp, Artificial Sequence
  Synthetic
cuatcttcagugcaaaaggcaacc

SEQ ID NO: 42920 - DNA, 21 bp, Artificial Sequence
  Synthetic
tctgttgtgucaggaccccua

SEQ ID NO: 42921 - DNA, 19 bp, Artificial Sequence
  Synthetic
gctgggaucctggctcuga

SEQ ID NO: 42922 - DNA, 23 bp, Artificial Sequence
  Synthetic
tcctctuaagccctgauagcaga

SEQ ID NO: 42923 - DNA, 21 bp, Artificial Sequence
  Synthetic
ggtucaagccctgcuaaggag

SEQ ID NO: 42924 - DNA, 21 bp, Artificial Sequence
  Synthetic
cctgggtcaucttgacctugt

SEQ ID NO: 42925 - DNA, 21 bp, Artificial Sequence
  Synthetic
ggaaaagcgcuctgaaaccuc

SEQ ID NO: 42926 - DNA, 22 bp, Artificial Sequence
  Synthetic
catcgccuactccatggugaag

SEQ ID NO: 42927 - DNA, 20 bp, Artificial Sequence
  Synthetic
acccutgtgtgguagaccca

SEQ ID NO: 42928 - DNA, 22 bp, Artificial Sequence
  Synthetic
caccuccccaggacauagagat

SEQ ID NO: 42929 - DNA, 22 bp, Artificial Sequence
  Synthetic
caagtcctguttctccctcugg

SEQ ID NO: 42930 - DNA, 18 bp, Artificial Sequence
  Synthetic
gccgactuggcccaagua

SEQ ID NO: 42931 - DNA, 21 bp, Artificial Sequence
  Synthetic
cucacaaacacaggacuccgt

SEQ ID NO: 42932 - DNA, 23 bp, Artificial Sequence
  Synthetic
caagagcuccatgttatgctugt

SEQ ID NO: 42933 - DNA, 20 bp, Artificial Sequence
  Synthetic
ctgaggaccugctcctcuct

SEQ ID NO: 42934 - DNA, 22 bp, Artificial Sequence
  Synthetic
ccggaacautcttuggcagaag

SEQ ID NO: 42935 - DNA, 23 bp, Artificial Sequence
  Synthetic
ctgtggacaugtacttgaagcug

SEQ ID NO: 42936 - DNA, 21 bp, Artificial Sequence
  Synthetic
cacagacaacccutcccauct

SEQ ID NO: 42937 - DNA, 20 bp, Artificial Sequence
  Synthetic
agccactucttggtgtugca

SEQ ID NO: 42938 - DNA, 21 bp, Artificial Sequence
  Synthetic
agaggacaccutggctgguaa

SEQ ID NO: 42939 - DNA, 29 bp, Artificial Sequence
  Synthetic
gaggaatgtgucagccttatttagaauga

SEQ ID NO: 42940 - DNA, 23 bp, Artificial Sequence
  Synthetic
cagggtgttuaggagatgaccut

SEQ ID NO: 42941 - DNA, 20 bp, Artificial Sequence
  Synthetic
atctgtgtgcuggtgctcuc

SEQ ID NO: 42942 - DNA, 23 bp, Artificial Sequence
  Synthetic
cccacaacuagtagagugaagga

SEQ ID NO: 42943 - DNA, 22 bp, Artificial Sequence
  Synthetic
cctgcctugaactctttugcag

SEQ ID NO: 42944 - DNA, 19 bp, Artificial Sequence
  Synthetic
cctgcccagguggtaguag

SEQ ID NO: 42945 - DNA, 22 bp, Artificial Sequence
  Synthetic
tgtgccagcauactgctcttut

SEQ ID NO: 42946 - DNA, 24 bp, Artificial Sequence
  Synthetic
cccuccagagaaccctaauacagt

SEQ ID NO: 42947 - DNA, 28 bp, Artificial Sequence
  Synthetic
agaattgatagcagugtttgctgttcua

SEQ ID NO: 42948 - DNA, 19 bp, Artificial Sequence
  Synthetic
gaacggucacctacgugct

SEQ ID NO: 42949 - DNA, 20 bp, Artificial Sequence
  Synthetic
gcaccutccttcugcagact

SEQ ID NO: 42950 - DNA, 20 bp, Artificial Sequence
  Synthetic
ggtccgaaagcugcguaaac

SEQ ID NO: 42951 - DNA, 29 bp, Artificial Sequence
  Synthetic
ttttcagattttguacagcagcaattuct

SEQ ID NO: 42952 - DNA, 23 bp, Artificial Sequence
  Synthetic
tggtatgtcugcatgtctgtcuc

SEQ ID NO: 42953 - DNA, 19 bp, Artificial Sequence
  Synthetic
gatgtgggucctccugcac

SEQ ID NO: 42954 - DNA, 23 bp, Artificial Sequence
  Synthetic
ggaatttuccagggcacugaaga

SEQ ID NO: 42955 - DNA, 26 bp, Artificial Sequence
  Synthetic
tgaatggctaguactgatggttucac

SEQ ID NO: 42956 - DNA, 25 bp, Artificial Sequence
  Synthetic
gtctaatgccuctgcctaauggaaa

SEQ ID NO: 42957 - DNA, 24 bp, Artificial Sequence
  Synthetic
ccctaacuagtttcttcctucgca

SEQ ID NO: 42958 - DNA, 22 bp, Artificial Sequence
  Synthetic
ggtguagcacaacagacacuca

SEQ ID NO: 42959 - DNA, 30 bp, Artificial Sequence; identical to SEQ ID NO: 15103
  Synthetic

SEQ ID NO: 42960 - DNA, 24 bp, Artificial Sequence
  Synthetic
tgagagacugacaaggaaagucct

SEQ ID NO: 42961 - DNA, 21 bp, Artificial Sequence
  Synthetic
ggtcaccguctgtgggaatug

SEQ ID NO: 42962 - DNA, 22 bp, Artificial Sequence
  Synthetic
ctgggaaggcugaaaaacucaa

SEQ ID NO: 42963 - DNA, 25 bp, Artificial Sequence
  Synthetic
gttctcattcugtgtcttcccugaa

SEQ ID NO: 42964 - DNA, 22 bp, Artificial Sequence
  Synthetic
accagaaaucatggatguggca

SEQ ID NO: 42965 - DNA, 22 bp, Artificial Sequence
  Synthetic
tcutctcuccacacaggacact

SEQ ID NO: 42966 - DNA, 22 bp, Artificial Sequence
  Synthetic
cccuacacacactctugaccag

SEQ ID NO: 42967 - DNA, 24 bp, Artificial Sequence
  Synthetic
tgaagggagcggaugcttttatut

SEQ ID NO: 42968 - DNA, 20 bp, Artificial Sequence
  Synthetic
ggcatcuccagtcagcgtua

SEQ ID NO: 42969 - DNA, 20 bp, Artificial Sequence
  Synthetic
ctctttcugctgcatuggca

SEQ ID NO: 42970 - DNA, 22 bp, Artificial Sequence
  Synthetic
tgctgaagcuctggaagtgtut

SEQ ID NO: 42971 - DNA, 25 bp, Artificial Sequence
  Synthetic
gtgtgctgacauctgttttctgtuc

SEQ ID NO: 42972 - DNA, 26 bp, Artificial Sequence
  Synthetic
aaacagcacguttcaauagagagaca

SEQ ID NO: 42973 - DNA, 29 bp, Artificial Sequence
  Synthetic
agaccatgatguccataaataacttuggt

SEQ ID NO: 42974 - DNA, 27 bp, Artificial Sequence
  Synthetic
actagacugcaaaaacagtaacacuga

SEQ ID NO: 42975 - DNA, 29 bp, Artificial Sequence
  Synthetic
aggaaaatgcautcataaaggacucagaa

SEQ ID NO: 42976 - DNA, 22 bp, Artificial Sequence
  Synthetic
ggcaggttucctcatcttugct

SEQ ID NO: 42977 - DNA, 30 bp, Artificial Sequence; identical to SEQ ID NO: 30743
  Synthetic

SEQ ID NO: 42978 - DNA, 21 bp, Artificial Sequence
  Synthetic
gcctcgggugttttctuagga

SEQ ID NO: 42979 - DNA, 21 bp, Artificial Sequence
  Synthetic
tcgaaccgacutctctccgua

SEQ ID NO: 42980 - DNA, 21 bp, Artificial Sequence
  Synthetic
ttccuggacaggactauggct

SEQ ID NO: 42981 - DNA, 19 bp, Artificial Sequence
  Synthetic
ggtuccggttctuggcgat

SEQ ID NO: 42982 - DNA, 19 bp, Artificial Sequence
  Synthetic
tgcagcagcuggacaaugt

SEQ ID NO: 42983 - DNA, 21 bp, Artificial Sequence
  Synthetic
guagtaggcgaugaagagcgt

SEQ ID NO: 42984 - DNA, 21 bp, Artificial Sequence
  Synthetic
accagggcuttggcctuaaag

SEQ ID NO: 42985 - DNA, 21 bp, Artificial Sequence
  Synthetic
gctguggaaggcgtagaugag

SEQ ID NO: 42986 - DNA, 20 bp, Artificial Sequence
  Synthetic
gacccugggcagttcctuac

SEQ ID NO: 42987 - DNA, 20 bp, Artificial Sequence
  Synthetic
cacaaccuccccatgtccuc

SEQ ID NO: 42988 - DNA, 20 bp, Artificial Sequence
  Synthetic
atctttgcugccagctcuca

SEQ ID NO: 42989 - DNA, 20 bp, Artificial Sequence
  Synthetic
tcagccccauaccacuaggg

SEQ ID NO: 42990 - DNA, 21 bp, Artificial Sequence
  Synthetic
gggaaacggucaggcauacag

SEQ ID NO: 42991 - DNA, 21 bp, Artificial Sequence
  Synthetic
caggagcccugttaacatugg

SEQ ID NO: 42992 - DNA, 24 bp, Artificial Sequence
  Synthetic
ctctcatagtgugaaggcagguag

SEQ ID NO: 42993 - DNA, 22 bp, Artificial Sequence
  Synthetic
gctcctugggaggaagtauggt

SEQ ID NO: 42994 - DNA, 21 bp, Artificial Sequence
  Synthetic
ccauccacagacaggaaucgc

SEQ ID NO: 42995 - DNA, 21 bp, Artificial Sequence
  Synthetic
ttggttccugacccctttguc

SEQ ID NO: 42996 - DNA, 22 bp, Artificial Sequence
  Synthetic
cccuaaaaacaggcagggagug

SEQ ID NO: 42997 - DNA, 21 bp, Artificial Sequence
  Synthetic
acagacucgcactgucaacaa

SEQ ID NO: 42998 - DNA, 22 bp, Artificial Sequence
  Synthetic
gcctggccutcttgagaaacut

SEQ ID NO: 42999 - DNA, 23 bp, Artificial Sequence
  Synthetic
acgaagaauggatcaaggucgag

SEQ ID NO: 43000 - DNA, 25 bp, Artificial Sequence
  Synthetic
cgatcttctctucccgaggttcaua

SEQ ID NO: 43001 - DNA, 28 bp, Artificial Sequence
  Synthetic
tttctcatcttggacutgatcttgtcut

SEQ ID NO: 43002 - DNA, 27 bp, Artificial Sequence
  Synthetic
guaaatattaccaaguccaccccaaga

SEQ ID NO: 43003 - DNA, 20 bp, Artificial Sequence
  Synthetic
ctaacgaaugccgtccucct

SEQ ID NO: 43004 - DNA, 23 bp, Artificial Sequence
  Synthetic
tggttggagaagagcucaccaua

SEQ ID NO: 43005 - DNA, 28 bp, Artificial Sequence
  Synthetic
acttttctugacccttttatccucacag

SEQ ID NO: 43006 - DNA, 24 bp, Artificial Sequence
  Synthetic
tcaatgtcgugggaatcatagucc

SEQ ID NO: 43007 - DNA, 25 bp, Artificial Sequence
  Synthetic
ggatggtttugggatttaagtggut

SEQ ID NO: 43008 - DNA, 26 bp, Artificial Sequence
  Synthetic
acttauaggagguaaagagcaggaua

SEQ ID NO: 43009 - DNA, 31 bp, Artificial Sequence; identical to SEQ ID NO: 30775
  Synthetic

SEQ ID NO: 43010 - DNA, 23 bp, Artificial Sequence
  Synthetic
gcaagaagcagcaacugtcttua

SEQ ID NO: 43011 - DNA, 24 bp, Artificial Sequence
  Synthetic
ggatatcaccucacctgcttcuct

SEQ ID NO: 43012 - DNA, 25 bp, Artificial Sequence
  Synthetic
ggatagccauggattttcctgacuc

SEQ ID NO: 43013 - DNA, 29 bp, Artificial Sequence
  Synthetic
gagatcacgtttugacttgaatctttcut

SEQ ID NO: 43014 - DNA, 23 bp, Artificial Sequence
  Synthetic
gaatcaaugaactcgctcuccca

SEQ ID NO: 43015 - DNA, 28 bp, Artificial Sequence
  Synthetic
aacgtatttcuaaaccctattgcucagg

SEQ ID NO: 43016 - DNA, 21 bp, Artificial Sequence
  Synthetic
ccgacttggcaucttggagut

SEQ ID NO: 43017 - DNA, 28 bp, Artificial Sequence
  Synthetic
cccctggctcauctgtaatttactttut

SEQ ID NO: 43018 - DNA, 22 bp, Artificial Sequence
  Synthetic
ccacucaagtcttuccacccaa

SEQ ID NO: 43019 - DNA, 22 bp, Artificial Sequence
  Synthetic
caguaaggacaaucccaaccug

SEQ ID NO: 43020 - DNA, 21 bp, Artificial Sequence
  Synthetic
cctctcugggcccttagctua

SEQ ID NO: 43021 - DNA, 22 bp, Artificial Sequence
  Synthetic
gcagtgtaccuggtctggtgua

SEQ ID NO: 43022 - DNA, 21 bp, Artificial Sequence
  Synthetic
ccggugcaatcccaauacaag

SEQ ID NO: 43023 - DNA, 29 bp, Artificial Sequence
  Synthetic
gagaacaaaagaggutaactcuggagaat

SEQ ID NO: 43024 - DNA, 22 bp, Artificial Sequence
  Synthetic
gcctgtugagcagagtcaaguc

SEQ ID NO: 43025 - DNA, 29 bp, Artificial Sequence
  Synthetic
tggttatggaagguaatgatagttccugt

SEQ ID NO: 43026 - DNA, 21 bp, Artificial Sequence
  Synthetic
gcttgucggcttcauaccaca

SEQ ID NO: 43027 - DNA, 23 bp, Artificial Sequence
  Synthetic
ggtagcagtugcctttggttcua

SEQ ID NO: 43028 - DNA, 23 bp, Artificial Sequence
  Synthetic
cctucccaguaggaacctatcua

SEQ ID NO: 43029 - DNA, 26 bp, Artificial Sequence
  Synthetic
aggctaatttcaugtccacctuacag

SEQ ID NO: 43030 - DNA, 21 bp, Artificial Sequence
  Synthetic
aggcggcccagautcttttua

SEQ ID NO: 43031 - DNA, 27 bp, Artificial Sequence
  Synthetic
gcttgattgtgcuttttggactttuag

SEQ ID NO: 43032 - DNA, 22 bp, Artificial Sequence
  Synthetic
cttgttctgcutgatccccuca

SEQ ID NO: 43033 - DNA, 25 bp, Artificial Sequence
  Synthetic
ggaatcttccutgtaatcccctugg

SEQ ID NO: 43034 - DNA, 30 bp, Artificial Sequence; identical to SEQ ID NO: 30800
  Synthetic

SEQ ID NO: 43035 - DNA, 23 bp, Artificial Sequence
  Synthetic
ctggtttaagcuccaggtcugat

SEQ ID NO: 43036 - DNA, 22 bp, Artificial Sequence
  Synthetic
cgatacugcacgtgactaucca

SEQ ID NO: 43037 - DNA, 22 bp, Artificial Sequence
  Synthetic
cggacagtugttttcctcuggt

SEQ ID NO: 43038 - DNA, 25 bp, Artificial Sequence
  Synthetic
gcttgaggtugaagttgtaguccag

SEQ ID NO: 43039 - DNA, 24 bp, Artificial Sequence
  Synthetic
tgactcttacuctccatgtuccca

SEQ ID NO: 43040 - DNA, 22 bp, Artificial Sequence
  Synthetic
aaaaggctacaugcccaccuag

SEQ ID NO: 43041 - DNA, 24 bp, Artificial Sequence
  Synthetic
tgaaggacacaccccuctauacag

SEQ ID NO: 43042 - DNA, 20 bp, Artificial Sequence
  Synthetic
ccctccaccugagcgttuag

SEQ ID NO: 43043 - DNA, 28 bp, Artificial Sequence
  Synthetic
ctttggctgacucttcctttcatttuag

SEQ ID NO: 43044 - DNA, 30 bp, Artificial Sequence; identical to SEQ ID NO: 30810
  Synthetic

SEQ ID NO: 43045 - DNA, 25 bp, Artificial Sequence
  Synthetic
gacttggtggaugacaactactuct

SEQ ID NO: 43046 - DNA, 24 bp, Artificial Sequence
  Synthetic
gtaagcagcuagacaaacccauac

SEQ ID NO: 43047 - DNA, 24 bp, Artificial Sequence
  Synthetic
ccttggactaugctgacaacaucc

SEQ ID NO: 43048 - DNA, 23 bp, Artificial Sequence
  Synthetic
ccacccaccauatttcagcctut

SEQ ID NO: 43049 - DNA, 25 bp, Artificial Sequence
  Synthetic
agccttctcuttttctaatgugcca

SEQ ID NO: 43050 - DNA, 22 bp, Artificial Sequence
  Synthetic
cggaacttccugttggtcaugt

SEQ ID NO: 43051 - DNA, 23 bp, Artificial Sequence
  Synthetic
ggcctttaaacugaggtgcctut

SEQ ID NO: 43052 - DNA, 28 bp, Artificial Sequence
  Synthetic
tctctttctcctuaggtggaatgaauct

SEQ ID NO: 43053 - DNA, 20 bp, Artificial Sequence
  Synthetic
cgutgtctcugggacagcac

SEQ ID NO: 43054 - DNA, 30 bp, Artificial Sequence; identical to SEQ ID NO: 30820
  Synthetic

SEQ ID NO: 43055 - DNA, 27 bp, Artificial Sequence
  Synthetic
acaaatgacaaaautgtgcgtaacugt

SEQ ID NO: 43056 - DNA, 30 bp, Artificial Sequence; identical to SEQ ID NO: 30822
  Synthetic

SEQ ID NO: 43057 - DNA, 25 bp, Artificial Sequence
  Synthetic
ccattctttugggtctcgtttcuga

SEQ ID NO: 43058 - DNA, 28 bp, Artificial Sequence
  Synthetic
gttggtgtuaaccaattttctgtucact

SEQ ID NO: 43059 - DNA, 27 bp, Artificial Sequence
  Synthetic
gttaaagcactaucctctacccctuac

SEQ ID NO: 43060 - DNA, 24 bp, Artificial Sequence
  Synthetic
tggtaccautctcttcaucccagt

SEQ ID NO: 43061 - DNA, 23 bp, Artificial Sequence
  Synthetic
ggtcatuggaacagctggctauc

SEQ ID NO: 43062 - DNA, 25 bp, Artificial Sequence
  Synthetic
tccataccuaacttcttgtguggga

SEQ ID NO: 43063 - DNA, 29 bp, Artificial Sequence
  Synthetic
cagtgaagaugcaaaagaaatgguaagat

SEQ ID NO: 43064 - DNA, 26 bp, Artificial Sequence
  Synthetic
ctcactatgtttgutgtccaggctua

SEQ ID NO: 43065 - DNA, 24 bp, Artificial Sequence
  Synthetic
caucagagtgcauccagaggaaaa

SEQ ID NO: 43066 - DNA, 22 bp, Artificial Sequence
  Synthetic
cctttatgagccauccatgcuc

SEQ ID NO: 43067 - DNA, 28 bp, Artificial Sequence
  Synthetic
ctctttacaaagutgacgtgtcattuct

SEQ ID NO: 43068 - DNA, 23 bp, Artificial Sequence
  Synthetic
gcttgagagtugaaggccagaug

SEQ ID NO: 43069 - DNA, 28 bp, Artificial Sequence
  Synthetic
ctacccatccgutaagattggttactua

SEQ ID NO: 43070 - DNA, 20 bp, Artificial Sequence
  Synthetic
cacgtgggaguctcctucag

SEQ ID NO: 43071 - DNA, 20 bp, Artificial Sequence
  Synthetic
gagagagccugcacauacgg

SEQ ID NO: 43072 - DNA, 21 bp, Artificial Sequence
  Synthetic
cctacatcaagguacggccut

SEQ ID NO: 43073 - DNA, 22 bp, Artificial Sequence
  Synthetic
tgaugatcagcgugaggacaac

SEQ ID NO: 43074 - DNA, 20 bp, Artificial Sequence
  Synthetic
cctctcuaagcccgcccuat

SEQ ID NO: 43075 - DNA, 27 bp, Artificial Sequence
  Synthetic
gatguaggagaaguagaagagaaacug

SEQ ID NO: 43076 - DNA, 17 bp, Artificial Sequence
  Synthetic
cgcccuccgtctgtcug

SEQ ID NO: 43077 - DNA, 17 bp, Artificial Sequence
  Synthetic
cuggaaggucccgggaa

SEQ ID NO: 43078 - DNA, 26 bp, Artificial Sequence
  Synthetic
ttcttcatccagcacutctgtttgua

SEQ ID NO: 43079 - DNA, 21 bp, Artificial Sequence
  Synthetic
aggctattgaauggcctcugg

SEQ ID NO: 43080 - DNA, 26 bp, Artificial Sequence
  Synthetic
atctcttttcuttaaggctucaggca

SEQ ID NO: 43081 - DNA, 21 bp, Artificial Sequence
  Synthetic
ggctgcutgatctcugggaat

SEQ ID NO: 43082 - DNA, 21 bp, Artificial Sequence
  Synthetic
gggaaatugaagtcggugcga

SEQ ID NO: 43083 - DNA, 22 bp, Artificial Sequence
  Synthetic
cagctgccuctttactgacugt

SEQ ID NO: 43084 - DNA, 18 bp, Artificial Sequence
  Synthetic
ggugggcctuaggagcct

SEQ ID NO: 43085 - DNA, 19 bp, Artificial Sequence
  Synthetic
gtcggugggcttattgcuc

SEQ ID NO: 43086 - DNA, 19 bp, Artificial Sequence
  Synthetic
gcagcuccaggagaaccug

SEQ ID NO: 43087 - DNA, 24 bp, Artificial Sequence
  Synthetic
cattgtcaugaattgcgtcaucgt

SEQ ID NO: 43088 - DNA, 18 bp, Artificial Sequence
  Synthetic
cccutcacacuggccaca

SEQ ID NO: 43089 - DNA, 19 bp, Artificial Sequence
  Synthetic
tcactggcuctcccuccag

SEQ ID NO: 43090 - DNA, 21 bp, Artificial Sequence
  Synthetic
acacagggcacgaugatgtua

SEQ ID NO: 43091 - DNA, 19 bp, Artificial Sequence
  Synthetic
ctcugacagccagcugacc

SEQ ID NO: 43092 - DNA, 20 bp, Artificial Sequence
  Synthetic
cctcggaguagctctuccca

SEQ ID NO: 43093 - DNA, 21 bp, Artificial Sequence
  Synthetic
tgtgcaaaaagcucggttucc

SEQ ID NO: 43094 - DNA, 22 bp, Artificial Sequence
  Synthetic
ctggacaagaccucacaccaut

SEQ ID NO: 43095 - DNA, 21 bp, Artificial Sequence
  Synthetic
agccaaaaaucccacttcugg

SEQ ID NO: 43096 - DNA, 24 bp, Artificial Sequence
  Synthetic
ctgtgtctaaguctccatctuggt

SEQ ID NO: 43097 - DNA, 24 bp, Artificial Sequence
  Synthetic
cagagcucagaataacccugagaa

SEQ ID NO: 43098 - DNA, 18 bp, Artificial Sequence
  Synthetic
ggcacugaacccccacuc

SEQ ID NO: 43099 - DNA, 18 bp, Artificial Sequence
  Synthetic
ggcugcggtgactuacct

SEQ ID NO: 43100 - DNA, 21 bp, Artificial Sequence
  Synthetic
cccaaccagagcccugaaaut

SEQ ID NO: 43101 - DNA, 25 bp, Artificial Sequence
  Synthetic
cagctctgatuatcccttccctuac

SEQ ID NO: 43102 - DNA, 23 bp, Artificial Sequence
  Synthetic
ggtgtttggagaugttaagcuca

SEQ ID NO: 43103 - DNA, 22 bp, Artificial Sequence
  Synthetic
gcatactgggaugtggcgauag

SEQ ID NO: 43104 - DNA, 24 bp, Artificial Sequence
  Synthetic
gggacttugaagctcaucagaact

SEQ ID NO: 43105 - DNA, 21 bp, Artificial Sequence
  Synthetic
ggagaaaugggaggcaggtug

SEQ ID NO: 43106 - DNA, 22 bp, Artificial Sequence
  Synthetic
tgacaaccugtugaacacacct

SEQ ID NO: 43107 - DNA, 21 bp, Artificial Sequence
  Synthetic
gcacccguactccaucaaaga

SEQ ID NO: 43108 - DNA, 21 bp, Artificial Sequence
  Synthetic
ccuagggagacugcagaacca

SEQ ID NO: 43109 - DNA, 21 bp, Artificial Sequence
  Synthetic
cugacccgacugggaagaaag

SEQ ID NO: 43110 - DNA, 20 bp, Artificial Sequence
  Synthetic
agtccagtutgggtgcucag

SEQ ID NO: 43111 - DNA, 21 bp, Artificial Sequence
  Synthetic
tctgcagaagaccgucctgua

SEQ ID NO: 43112 - DNA, 20 bp, Artificial Sequence
  Synthetic
gacagtgagucctgacugct

SEQ ID NO: 43113 - DNA, 25 bp, Artificial Sequence
  Synthetic
gaatgactggutagttgccauacac

SEQ ID NO: 43114 - DNA, 21 bp, Artificial Sequence
  Synthetic
cgcactguccccatctctuaa

SEQ ID NO: 43115 - DNA, 24 bp, Artificial Sequence
  Synthetic
cggaatggtguagagctcactuac

SEQ ID NO: 43116 - DNA, 20 bp, Artificial Sequence
  Synthetic
ccagccgguccagauttaut

SEQ ID NO: 43117 - DNA, 17 bp, Artificial Sequence
  Synthetic
gcagccccgagucucac

SEQ ID NO: 43118 - DNA, 20 bp, Artificial Sequence
  Synthetic
ccagcaacaggugcacatuc

SEQ ID NO: 43119 - DNA, 21 bp, Artificial Sequence
  Synthetic
gagaataagugcagcccuggt

SEQ ID NO: 43120 - DNA, 24 bp, Artificial Sequence
  Synthetic
ccctcatttcuctccaccctacut

SEQ ID NO: 43121 - DNA, 28 bp, Artificial Sequence
  Synthetic
cttactgggcuggatattcaaggaaaut

SEQ ID NO: 43122 - DNA, 21 bp, Artificial Sequence
  Synthetic
ggcctgauccctgatgagauc

SEQ ID NO: 43123 - DNA, 26 bp, Artificial Sequence
  Synthetic
gatgtcuaaggaaagggaggattugt

SEQ ID NO: 43124 - DNA, 22 bp, Artificial Sequence
  Synthetic
acuaaccaggacagctcucaca

SEQ ID NO: 43125 - DNA, 23 bp, Artificial Sequence
  Synthetic
agaagagtgaugaggatgcaugg

SEQ ID NO: 43126 - DNA, 24 bp, Artificial Sequence
  Synthetic
aatctgtcttugaatggccuggaa

SEQ ID NO: 43127 - DNA, 31 bp, Artificial Sequence; identical to SEQ ID NO: 30893
  Synthetic

SEQ ID NO: 43128 - DNA, 22 bp, Artificial Sequence
  Synthetic
cccaccaauacgcctcttcuac

SEQ ID NO: 43129 - DNA, 19 bp, Artificial Sequence
  Synthetic
gtggguaacgggcgtaguc

SEQ ID NO: 43130 - DNA, 23 bp, Artificial Sequence
  Synthetic
ccagagcucaggaagtttcctut

SEQ ID NO: 43131 - DNA, 21 bp, Artificial Sequence
  Synthetic
ggtctcaacccuccagtctuc

SEQ ID NO: 43132 - DNA, 17 bp, Artificial Sequence
  Synthetic
cccaucctccuccccac

SEQ ID NO: 43133 - DNA, 21 bp, Artificial Sequence
  Synthetic
gtucaagacagaagggccuga

SEQ ID NO: 43134 - DNA, 32 bp, Artificial Sequence; identical to SEQ ID NO: 30900
  Synthetic

SEQ ID NO: 43135 - DNA, 28 bp, Artificial Sequence
  Synthetic
guagctaactaactucagaacaccaact

SEQ ID NO: 43136 - DNA, 25 bp, Artificial Sequence
  Synthetic
aaagtgaatcugaggcataacugca

SEQ ID NO: 43137 - DNA, 26 bp, Artificial Sequence
  Synthetic
cttgcttctcutttcctatccugagt

SEQ ID NO: 43138 - DNA, 21 bp, Artificial Sequence
  Synthetic
accuggagggccacugacaac

SEQ ID NO: 43139 - DNA, 29 bp, Artificial Sequence
  Synthetic
gcctctgattccucactgattgctctuag

SEQ ID NO: 43140 - DNA, 22 bp, Artificial Sequence
  Synthetic
gcctcacaaccuccgtcatgug

SEQ ID NO: 43141 - DNA, 29 bp, Artificial Sequence
  Synthetic
tctgtctccttccucttcctacagtacuc

SEQ ID NO: 43142 - DNA, 21 bp, Artificial Sequence
  Synthetic
ctcauggaagccagccccuca

SEQ ID NO: 43143 - DNA, 21 bp, Artificial Sequence
  Synthetic
ctgcaccagcagcuccuacac

SEQ ID NO: 43144 - DNA, 23 bp, Artificial Sequence
  Synthetic
ccttgtcctuaccagaacgtugt

SEQ ID NO: 43145 - DNA, 26 bp, Artificial Sequence
  Synthetic
tttcagacctauggaaactgtgagug

SEQ ID NO: 43146 - DNA, 17 bp, Artificial Sequence
  Synthetic
ctcgtggguccggugaa

SEQ ID NO: 43147 - DNA, 17 bp, Artificial Sequence
  Synthetic
gccuccacccacagguc

SEQ ID NO: 43148 - DNA, 20 bp, Artificial Sequence
  Synthetic
ggtcacagguaggctcccut

SEQ ID NO: 43149 - DNA, 20 bp, Artificial Sequence
  Synthetic
gacaaggcguagtggaucgt

SEQ ID NO: 43150 - DNA, 21 bp, Artificial Sequence
  Synthetic
ctctgagccccuactctccut

SEQ ID NO: 43151 - DNA, 17 bp, Artificial Sequence
  Synthetic
gccgcguccgtgtcuag

SEQ ID NO: 43152 - DNA, 20 bp, Artificial Sequence
  Synthetic
ctggcaucgctcctcaguat

SEQ ID NO: 43153 - DNA, 23 bp, Artificial Sequence
  Synthetic
catttcuggcacaagctcactuc

SEQ ID NO: 43154 - DNA, 23 bp, Artificial Sequence
  Synthetic
gacctctugcattgacctcuacc

SEQ ID NO: 43155 - DNA, 24 bp, Artificial Sequence
  Synthetic
atgactacaugtcctccugagagt

SEQ ID NO: 43156 - DNA, 22 bp, Artificial Sequence
  Synthetic
tgggcagaaaaugcaagucaac

SEQ ID NO: 43157 - DNA, 23 bp, Artificial Sequence
  Synthetic
acttgaacauccagtccagctut

SEQ ID NO: 43158 - DNA, 21 bp, Artificial Sequence
  Synthetic
gctgccucttacccuacccat

SEQ ID NO: 43159 - DNA, 19 bp, Artificial Sequence
  Synthetic
gtggaucctcgtcugcaca

SEQ ID NO: 43160 - DNA, 24 bp, Artificial Sequence
  Synthetic
gtctttagctuggccatcatcaug

SEQ ID NO: 43161 - DNA, 22 bp, Artificial Sequence
  Synthetic
actgggcuttgcttuagaggaa

SEQ ID NO: 43162 - DNA, 21 bp, Artificial Sequence
  Synthetic
cccaggtcutcagcagcttua

SEQ ID NO: 43163 - DNA, 17 bp, Artificial Sequence
  Synthetic
cutcccacuggcaccca

SEQ ID NO: 43164 - DNA, 21 bp, Artificial Sequence
  Synthetic
agtgagcccautgaggttgug

SEQ ID NO: 43165 - DNA, 21 bp, Artificial Sequence
  Synthetic
ttgattgggcagguaggcuag

SEQ ID NO: 43166 - DNA, 22 bp, Artificial Sequence
  Synthetic
catgtcacuggacatccucagt

SEQ ID NO: 43167 - DNA, 23 bp, Artificial Sequence
  Synthetic
tgagtugcctcctcuacaggaaa

SEQ ID NO: 43168 - DNA, 18 bp, Artificial Sequence
  Synthetic
gccacagcutaccgcauc

SEQ ID NO: 43169 - DNA, 21 bp, Artificial Sequence
  Synthetic
cagaagggugagctgaggtut

SEQ ID NO: 43170 - DNA, 19 bp, Artificial Sequence
  Synthetic
ccccatuccccttcccuga

SEQ ID NO: 43171 - DNA, 18 bp, Artificial Sequence
  Synthetic
gcttgggugggacgtuct

SEQ ID NO: 43172 - DNA, 23 bp, Artificial Sequence
  Synthetic
ttcgagaaaggugtggttuccat

SEQ ID NO: 43173 - DNA, 21 bp, Artificial Sequence
  Synthetic
cctcauagctcggguaaggct

SEQ ID NO: 43174 - DNA, 18 bp, Artificial Sequence
  Synthetic
ggcttuccctggcuacgg

SEQ ID NO: 43175 - DNA, 22 bp, Artificial Sequence
  Synthetic
ggcactgcugtctttttcauca

SEQ ID NO: 43176 - DNA, 19 bp, Artificial Sequence
  Synthetic
cgacattgccucccctcug

SEQ ID NO: 43177 - DNA, 24 bp, Artificial Sequence
  Synthetic
actggtaggcaugaagattcugga

SEQ ID NO: 43178 - DNA, 25 bp, Artificial Sequence
  Synthetic
ggaaaccctccautaccaaaaccuc

SEQ ID NO: 43179 - DNA, 23 bp, Artificial Sequence
  Synthetic
gaaagttcuccaggtttggcauc

SEQ ID NO: 43180 - DNA, 20 bp, Artificial Sequence
  Synthetic
aacugcaagcccctucagaa

SEQ ID NO: 43181 - DNA, 18 bp, Artificial Sequence
  Synthetic
gagtagccgcuccctucg

SEQ ID NO: 43182 - DNA, 21 bp, Artificial Sequence
  Synthetic
agcutcctctacugcaaccag

SEQ ID NO: 43183 - DNA, 22 bp, Artificial Sequence
  Synthetic
cgaactuggagaagctgucgag

SEQ ID NO: 43184 - DNA, 19 bp, Artificial Sequence
  Synthetic
ccgacaaagcutgggcuga

SEQ ID NO: 43185 - DNA, 21 bp, Artificial Sequence
  Synthetic
ccacggaaggguctucaaaca

SEQ ID NO: 43186 - DNA, 21 bp, Artificial Sequence
  Synthetic
accccacuacagcagctttug

SEQ ID NO: 43187 - DNA, 21 bp, Artificial Sequence
  Synthetic
ctttgctgaugccatcugagg

SEQ ID NO: 43188 - DNA, 21 bp, Artificial Sequence
  Synthetic
gactucaagcaggaggaggug

SEQ ID NO: 43189 - DNA, 21 bp, Artificial Sequence
  Synthetic
aggagcucacauagggaggag

SEQ ID NO: 43190 - DNA, 18 bp, Artificial Sequence
  Synthetic
catcctgcugggcccuac

SEQ ID NO: 43191 - DNA, 19 bp, Artificial Sequence
  Synthetic
ggctccguaagctttugcc

SEQ ID NO: 43192 - DNA, 21 bp, Artificial Sequence
  Synthetic
cctcttgcuccctgaatccug

SEQ ID NO: 43193 - DNA, 18 bp, Artificial Sequence
  Synthetic
ccgctugcccgactugaa

SEQ ID NO: 43194 - DNA, 20 bp, Artificial Sequence
  Synthetic
tccucgacaacagccactug

SEQ ID NO: 43195 - DNA, 19 bp, Artificial Sequence
  Synthetic
caggttccgcutcttggug

SEQ ID NO: 43196 - DNA, 23 bp, Artificial Sequence
  Synthetic
ggaugtcttcucccaagaaagcc

SEQ ID NO: 43197 - DNA, 23 bp, Artificial Sequence
  Synthetic
cgctttacaugcgaacttctuga

SEQ ID NO: 43198 - DNA, 23 bp, Artificial Sequence
  Synthetic
gtggaagaaggccuggtaaaugt

SEQ ID NO: 43199 - DNA, 22 bp, Artificial Sequence
  Synthetic
ctttccggcucctcttctuagg

SEQ ID NO: 43200 - DNA, 21 bp, Artificial Sequence
  Synthetic
ccagugaggacaactctggug

SEQ ID NO: 43201 - DNA, 17 bp, Artificial Sequence
  Synthetic
ctgtcgucgtcgctugg

SEQ ID NO: 43202 - DNA, 18 bp, Artificial Sequence
  Synthetic
ttcgugcggguggagaag

SEQ ID NO: 43203 - DNA, 17 bp, Artificial Sequence
  Synthetic
gccuccagggagtgugg

SEQ ID NO: 43204 - DNA, 22 bp, Artificial Sequence
  Synthetic
gtacctctugccttgtttgcug

SEQ ID NO: 43205 - DNA, 19 bp, Artificial Sequence
  Synthetic
ctgcacacucgggacctut

SEQ ID NO: 43206 - DNA, 18 bp, Artificial Sequence
  Synthetic
gtgauggccgggaggaug

SEQ ID NO: 43207 - DNA, 17 bp, Artificial Sequence
  Synthetic
gctgggcuggcctctua

SEQ ID NO: 43208 - DNA, 20 bp, Artificial Sequence
  Synthetic
ccucctggcugcagacaaaa

SEQ ID NO: 43209 - DNA, 19 bp, Artificial Sequence
  Synthetic
ctcctcucccgctugacac

SEQ ID NO: 43210 - DNA, 19 bp, Artificial Sequence
  Synthetic
ttttgcagaggcugccgua

SEQ ID NO: 43211 - DNA, 18 bp, Artificial Sequence
  Synthetic
gcuccggaacgggtttuc

SEQ ID NO: 43212 - DNA, 22 bp, Artificial Sequence
  Synthetic
gggatctuccagtgggatcugt

SEQ ID NO: 43213 - DNA, 22 bp, Artificial Sequence
  Synthetic
cacctctgguaacgtcctctuc

SEQ ID NO: 43214 - DNA, 26 bp, Artificial Sequence
  Synthetic
ggcugtgaaaauagaaaaggacagga

SEQ ID NO: 43215 - DNA, 17 bp, Artificial Sequence
  Synthetic
ctccgcugcgagaugga

SEQ ID NO: 43216 - DNA, 21 bp, Artificial Sequence
  Synthetic
cacccttccuggcactatucc

SEQ ID NO: 43217 - DNA, 23 bp, Artificial Sequence
  Synthetic
ccttctggugtgaatggcatuct

SEQ ID NO: 43218 - DNA, 22 bp, Artificial Sequence
  Synthetic
ggtcacgcauctcgtucagaat

SEQ ID NO: 43219 - DNA, 23 bp, Artificial Sequence
  Synthetic
ggcagtautcaggccuaaggaac

SEQ ID NO: 43220 - DNA, 23 bp, Artificial Sequence
  Synthetic
ctcgtggtucttcttcagguagg

SEQ ID NO: 43221 - DNA, 24 bp, Artificial Sequence
  Synthetic
tgtgatcaggaugggtgtctcaua

SEQ ID NO: 43222 - DNA, 22 bp, Artificial Sequence
  Synthetic
gaaggagcuagctggaatggug

SEQ ID NO: 43223 - DNA, 21 bp, Artificial Sequence
  Synthetic
gtgagaaggugaccaugcaga

SEQ ID NO: 43224 - DNA, 18 bp, Artificial Sequence
  Synthetic
gcugaagccaccgccaua

SEQ ID NO: 43225 - DNA, 18 bp, Artificial Sequence
  Synthetic
gcaccaugaccaccugca

SEQ ID NO: 43226 - DNA, 23 bp, Artificial Sequence
  Synthetic
gcagattuccaagggagactuca

SEQ ID NO: 43227 - DNA, 19 bp, Artificial Sequence
  Synthetic
gaucccccacagccacuac

SEQ ID NO: 43228 - DNA, 22 bp, Artificial Sequence
  Synthetic
tgtgccaagaacugtgctacuc

SEQ ID NO: 43229 - DNA, 25 bp, Artificial Sequence
  Synthetic
acactttgaaugctctttcctucct

SEQ ID NO: 43230 - DNA, 21 bp, Artificial Sequence
  Synthetic
caatcugaggaacccccaucg

SEQ ID NO: 43231 - DNA, 25 bp, Artificial Sequence
  Synthetic
cctctctctucctctcttctuccag

SEQ ID NO: 43232 - DNA, 24 bp, Artificial Sequence
  Synthetic
ttgttaaggaaaguggtgcatuga

SEQ ID NO: 43233 - DNA, 33 bp, Artificial Sequence; identical to SEQ ID NO: 30999
  Synthetic

SEQ ID NO: 43234 - DNA, 22 bp, Artificial Sequence
  Synthetic
gcctcgccucatgtggtttuat

SEQ ID NO: 43235 - DNA, 29 bp, Artificial Sequence
  Synthetic
gtgctagagguaactcatgataauggaat

SEQ ID NO: 43236 - DNA, 22 bp, Artificial Sequence
  Synthetic
ctgggcagautctgcaacttuc

SEQ ID NO: 43237 - DNA, 30 bp, Artificial Sequence; identical to SEQ ID NO: 4777
  Synthetic

SEQ ID NO: 43238 - DNA, 22 bp, Artificial Sequence
  Synthetic
tgttgcucctccacaucaacaa

SEQ ID NO: 43239 - DNA, 22 bp, Artificial Sequence
  Synthetic
cacaattgguggcgatggttut

SEQ ID NO: 43240 - DNA, 29 bp, Artificial Sequence
  Synthetic
caaacacagctautaaaaagtcattccuc

SEQ ID NO: 43241 - DNA, 28 bp, Artificial Sequence
  Synthetic
ttcccttgatguctacaatttcacctut

SEQ ID NO: 43242 - DNA, 24 bp, Artificial Sequence
  Synthetic
caaagagaugatgucagcaaacct

SEQ ID NO: 43243 - DNA, 32 bp, Artificial Sequence; identical to SEQ ID NO: 31009
  Synthetic

SEQ ID NO: 43244 - DNA, 23 bp, Artificial Sequence
  Synthetic
ccaaucaagaaaggatccugggt

SEQ ID NO: 43245 - DNA, 19 bp, Artificial Sequence
  Synthetic
catagcaccgutgcuaccg

SEQ ID NO: 43246 - DNA, 22 bp, Artificial Sequence
  Synthetic
cttcgguaacccugagccaaat

SEQ ID NO: 43247 - DNA, 25 bp, Artificial Sequence
  Synthetic
cctatgggaaguagtcatgcatcuc

SEQ ID NO: 43248 - DNA, 25 bp, Artificial Sequence
  Synthetic
gttgcaaaaccccuaatcuaagcat

SEQ ID NO: 43249 - DNA, 27 bp, Artificial Sequence
  Synthetic
ggaaatgagaacautccaagtacagug

SEQ ID NO: 43250 - DNA, 28 bp, Artificial Sequence
  Synthetic
cgatatgggtttugtaaaagtccatgut

SEQ ID NO: 43251 - DNA, 29 bp, Artificial Sequence
  Synthetic
ggaaagaatgaguctaatatcaagccugt

SEQ ID NO: 43252 - DNA, 22 bp, Artificial Sequence
  Synthetic
gcaaatgacuggcgcttugaaa

SEQ ID NO: 43253 - DNA, 30 bp, Artificial Sequence; identical to SEQ ID NO: 31019
  Synthetic

SEQ ID NO: 43254 - DNA, 25 bp, Artificial Sequence
  Synthetic
tgcaaaacccuttctccactuaaca

SEQ ID NO: 43255 - DNA, 26 bp, Artificial Sequence
  Synthetic
agacaaguaaaagacaugacagcgat

SEQ ID NO: 43256 - DNA, 28 bp, Artificial Sequence
  Synthetic
tcactgcuagaacaactatcaattugca

SEQ ID NO: 43257 - DNA, 28 bp, Artificial Sequence
  Synthetic
ctcgaaaaagaauctgcttucaaaacga

SEQ ID NO: 43258 - DNA, 22 bp, Artificial Sequence
  Synthetic
accattctgcuccgtttggtua

SEQ ID NO: 43259 - DNA, 32 bp, Artificial Sequence; identical to SEQ ID NO: 9083
  Synthetic

SEQ ID NO: 43260 - DNA, 28 bp, Artificial Sequence
  Synthetic
tggccagtaaguctattttctcugaaga

SEQ ID NO: 43261 - DNA, 31 bp, Artificial Sequence; identical to SEQ ID NO: 6943
  Synthetic

SEQ ID NO: 43262 - DNA, 27 bp, Artificial Sequence
  Synthetic
ccgcctatcautacatgtttcctuact

SEQ ID NO: 43263 - DNA, 27 bp, Artificial Sequence
  Synthetic
gcatccagaaaaguatcagggtagtuc

SEQ ID NO: 43264 - DNA, 24 bp, Artificial Sequence
  Synthetic
ttgtaaaggucccaaatggtctuc

SEQ ID NO: 43265 - DNA, 29 bp, Artificial Sequence
  Synthetic
gtttcttatuaggactctgtctttuccct

SEQ ID NO: 43266 - DNA, 32 bp, Artificial Sequence; identical to SEQ ID NO: 31032
  Synthetic

SEQ ID NO: 43267 - DNA, 28 bp, Artificial Sequence
  Synthetic
tgcttgactgtuctttaccatactgtut

SEQ ID NO: 43268 - DNA, 23 bp, Artificial Sequence
  Synthetic
tctguagaagtctttuggcacgg

SEQ ID NO: 43269 - DNA, 28 bp, Artificial Sequence
  Synthetic
caacaaagagcauacatagggtttcuct

SEQ ID NO: 43270 - DNA, 28 bp, Artificial Sequence
  Synthetic
atttctacttttucctactgtggtugct

SEQ ID NO: 43271 - DNA, 30 bp, Artificial Sequence; identical to SEQ ID NO: 31037
  Synthetic

SEQ ID NO: 43272 - DNA, 27 bp, Artificial Sequence
  Synthetic
ggtcaattcugttcatttgcauaggag

SEQ ID NO: 43273 - DNA, 31 bp, Artificial Sequence; identical to SEQ ID NO: 31039
  Synthetic

SEQ ID NO: 43274 - DNA, 22 bp, Artificial Sequence
  Synthetic
tctgatccucctgtgtgtguga

SEQ ID NO: 43275 - DNA, 19 bp, Artificial Sequence
  Synthetic
tctccatutcggctugcgt

SEQ ID NO: 43276 - DNA, 22 bp, Artificial Sequence
  Synthetic
ccaucaacatcgucaccaccaa

SEQ ID NO: 43277 - DNA, 20 bp, Artificial Sequence
  Synthetic
gccccatccuctcagtccut

SEQ ID NO: 43278 - DNA, 21 bp, Artificial Sequence
  Synthetic
ccauaccaggccaaacagtug

SEQ ID NO: 43279 - DNA, 22 bp, Artificial Sequence
  Synthetic
gacctaugaagggcctggacua

SEQ ID NO: 43280 - DNA, 19 bp, Artificial Sequence
  Synthetic
cccccagaucgggagaaug

SEQ ID NO: 43281 - DNA, 21 bp, Artificial Sequence
  Synthetic
cccutcctttgugggaggaat

SEQ ID NO: 43282 - DNA, 21 bp, Artificial Sequence
  Synthetic
ctgaggcacuacttccgcuac

SEQ ID NO: 43283 - DNA, 22 bp, Artificial Sequence
  Synthetic
ctgtatccugagggacctcuga

SEQ ID NO: 43284 - DNA, 19 bp, Artificial Sequence
  Synthetic
gcgcacggugataaagucc

SEQ ID NO: 43285 - DNA, 27 bp, Artificial Sequence
  Synthetic
attttaatcaugcctaaagucccacct

SEQ ID NO: 43286 - DNA, 23 bp, Artificial Sequence
  Synthetic
cgtatgaatcucctggaccccut

SEQ ID NO: 43287 - DNA, 21 bp, Artificial Sequence
  Synthetic
cgctctccutcttcagaucgg

SEQ ID NO: 43288 - DNA, 19 bp, Artificial Sequence
  Synthetic
gucaacggcuccagcaaga

SEQ ID NO: 43289 - DNA, 19 bp, Artificial Sequence
  Synthetic
ggcaaaucagcccugacca

SEQ ID NO: 43290 - DNA, 21 bp, Artificial Sequence
  Synthetic
ccacccggautacaaguacca

SEQ ID NO: 43291 - DNA, 20 bp, Artificial Sequence
  Synthetic
cgggacggagauagcttguc

SEQ ID NO: 43292 - DNA, 21 bp, Artificial Sequence
  Synthetic
agcgacgucatctccaacauc

SEQ ID NO: 43293 - DNA, 19 bp, Artificial Sequence
  Synthetic
tgcutggacauccacacgt

SEQ ID NO: 43294 - DNA, 20 bp, Artificial Sequence
  Synthetic
caucaagacggagcagcuga

SEQ ID NO: 43295 - DNA, 23 bp, Artificial Sequence
  Synthetic
tgtaggugaaggtggaguagagg

SEQ ID NO: 43296 - DNA, 20 bp, Artificial Sequence
  Synthetic
acacagcucactcgacctug

SEQ ID NO: 43297 - DNA, 25 bp, Artificial Sequence
  Synthetic
ggataggtcaugtttgtgtctugga

SEQ ID NO: 43298 - DNA, 21 bp, Artificial Sequence
  Synthetic
gtgggaaagugcttgccttug

SEQ ID NO: 43299 - DNA, 26 bp, Artificial Sequence
  Synthetic
ccctagattcatutccaccagctaut

SEQ ID NO: 43300 - DNA, 20 bp, Artificial Sequence
  Synthetic
cctccggagugaccctcuag

SEQ ID NO: 43301 - DNA, 23 bp, Artificial Sequence
  Synthetic
catcggacauggagtuggagaag

SEQ ID NO: 43302 - DNA, 22 bp, Artificial Sequence
  Synthetic
gctcagctaucccctctctguc

SEQ ID NO: 43303 - DNA, 27 bp, Artificial Sequence
  Synthetic
attutaagttgtgggugaaagaggagt

SEQ ID NO: 43304 - DNA, 19 bp, Artificial Sequence
  Synthetic
ccuacacgacgccgtgaug

SEQ ID NO: 43305 - DNA, 20 bp, Artificial Sequence
  Synthetic
tcatcgtugcggctcaugat

SEQ ID NO: 43306 - DNA, 23 bp, Artificial Sequence
  Synthetic
tcatggagaugcttagccugaga

SEQ ID NO: 43307 - DNA, 23 bp, Artificial Sequence
  Synthetic
atttcuccaccgtgauccaagac

SEQ ID NO: 43308 - DNA, 17 bp, Artificial Sequence
  Synthetic
gggccutcaggcaucga

SEQ ID NO: 43309 - DNA, 19 bp, Artificial Sequence
  Synthetic
ctugaggccgucggagaag

SEQ ID NO: 43310 - DNA, 21 bp, Artificial Sequence
  Synthetic
cccaccauggtctctctcaut

SEQ ID NO: 43311 - DNA, 19 bp, Artificial Sequence
  Synthetic
ggugtacaaggugcaccca

SEQ ID NO: 43312 - DNA, 19 bp, Artificial Sequence
  Synthetic
ccgcuacgagggtcagtuc

SEQ ID NO: 43313 - DNA, 20 bp, Artificial Sequence
  Synthetic
ccaagtcuggctcucccaac

SEQ ID NO: 43314 - DNA, 21 bp, Artificial Sequence
  Synthetic
ccctcuccagagagaacccua

SEQ ID NO: 43315 - DNA, 22 bp, Artificial Sequence
  Synthetic
acctcgtaggucttagccucac

SEQ ID NO: 43316 - DNA, 17 bp, Artificial Sequence
  Synthetic
gggtgcccugctgacug

SEQ ID NO: 43317 - DNA, 17 bp, Artificial Sequence
  Synthetic
ccuccccaccgagcuct

SEQ ID NO: 43318 - DNA, 20 bp, Artificial Sequence
  Synthetic
ggtcccaccugaagaggtug

SEQ ID NO: 43319 - DNA, 22 bp, Artificial Sequence
  Synthetic
catgttgtuggtgacctuccag

SEQ ID NO: 43320 - DNA, 20 bp, Artificial Sequence
  Synthetic
cccctgaucctagcatggut

SEQ ID NO: 43321 - DNA, 21 bp, Artificial Sequence
  Synthetic
ggcctagtucctgggtcctua

SEQ ID NO: 43322 - DNA, 22 bp, Artificial Sequence
  Synthetic
gcctccactucagggctatcua

SEQ ID NO: 43323 - DNA, 23 bp, Artificial Sequence
  Synthetic
ctatgggauggagatggaguagg

SEQ ID NO: 43324 - DNA, 23 bp, Artificial Sequence
  Synthetic
tgaagctuacagagaagcaggug

SEQ ID NO: 43325 - DNA, 19 bp, Artificial Sequence
  Synthetic
gggtucggaggtggucaga

SEQ ID NO: 43326 - DNA, 22 bp, Artificial Sequence
  Synthetic
ctttatccggccugaggaugac

SEQ ID NO: 43327 - DNA, 22 bp, Artificial Sequence
  Synthetic
gccaggucgcaattccactuaa

SEQ ID NO: 43328 - DNA, 21 bp, Artificial Sequence
  Synthetic
tggtctcugcagtgtccauga

SEQ ID NO: 43329 - DNA, 21 bp, Artificial Sequence
  Synthetic
gggagucaacttctugcagct

SEQ ID NO: 43330 - DNA, 18 bp, Artificial Sequence
  Synthetic
ccccaaccugacccgtua

SEQ ID NO: 43331 - DNA, 19 bp, Artificial Sequence
  Synthetic
cacctgucgtgacccucag

SEQ ID NO: 43332 - DNA, 25 bp, Artificial Sequence
  Synthetic
gtaaagtacuggattcagggugact

SEQ ID NO: 43333 - DNA, 21 bp, Artificial Sequence
  Synthetic
ggacaaauggacagacauggc

SEQ ID NO: 43334 - DNA, 21 bp, Artificial Sequence
  Synthetic
tgaccctcugaagcactcuct

SEQ ID NO: 43335 - DNA, 17 bp, Artificial Sequence
  Synthetic
cccugcccaccacucac

SEQ ID NO: 43336 - DNA, 23 bp, Artificial Sequence
  Synthetic
atcatcccugacatccctaucgt

SEQ ID NO: 43337 - DNA, 22 bp, Artificial Sequence
  Synthetic
gacucactctguacccaagacc

SEQ ID NO: 43338 - DNA, 20 bp, Artificial Sequence
  Synthetic
gggugaccaggaatgugcag

SEQ ID NO: 43339 - DNA, 19 bp, Artificial Sequence
  Synthetic
ctcaggugggtgccauagg

SEQ ID NO: 43340 - DNA, 24 bp, Artificial Sequence
  Synthetic
cctgctcctcucactcttgtttug

SEQ ID NO: 43341 - DNA, 20 bp, Artificial Sequence
  Synthetic
ggatggccaccccugtacua

SEQ ID NO: 43342 - DNA, 22 bp, Artificial Sequence
  Synthetic
cccacatcuctcagagugagct

SEQ ID NO: 43343 - DNA, 21 bp, Artificial Sequence
  Synthetic
gttccugacacagctgaggua

SEQ ID NO: 43344 - DNA, 19 bp, Artificial Sequence
  Synthetic
tggtgguggaagaccucct

SEQ ID NO: 43345 - DNA, 22 bp, Artificial Sequence
  Synthetic
aguagaggaagagcaucagcct

SEQ ID NO: 43346 - DNA, 17 bp, Artificial Sequence
  Synthetic
cugagcccagacucgct

SEQ ID NO: 43347 - DNA, 20 bp, Artificial Sequence
  Synthetic
gagcagggaagaugcctuca

SEQ ID NO: 43348 - DNA, 20 bp, Artificial Sequence
  Synthetic
ccaccctcugactggccuat

SEQ ID NO: 43349 - DNA, 18 bp, Artificial Sequence
  Synthetic
gagagccgggauccccua

SEQ ID NO: 43350 - DNA, 21 bp, Artificial Sequence
  Synthetic
ctuagcacccacauggaccaa

SEQ ID NO: 43351 - DNA, 21 bp, Artificial Sequence
  Synthetic
aauaggttugggcccacagag

SEQ ID NO: 43352 - DNA, 21 bp, Artificial Sequence
  Synthetic
gcctcuactcccauagcccaa

SEQ ID NO: 43353 - DNA, 19 bp, Artificial Sequence
  Synthetic
gcccagacucctgcctuac

SEQ ID NO: 43354 - DNA, 18 bp, Artificial Sequence
  Synthetic
ctctgcgugcguggagat

SEQ ID NO: 43355 - DNA, 18 bp, Artificial Sequence
  Synthetic
ccuggcgacuccaagacc

SEQ ID NO: 43356 - DNA, 29 bp, Artificial Sequence
  Synthetic
aaaacctcacaaggucctttatacttugt

SEQ ID NO: 43357 - DNA, 22 bp, Artificial Sequence
  Synthetic
ccataggacacagccucctcut

SEQ ID NO: 43358 - DNA, 20 bp, Artificial Sequence
  Synthetic
ccuggagaggaggcauacga

SEQ ID NO: 43359 - DNA, 24 bp, Artificial Sequence
  Synthetic
aaaacagaagucagggctacucac

SEQ ID NO: 43360 - DNA, 21 bp, Artificial Sequence
  Synthetic
tcaatggtgucgctgtctcuc

SEQ ID NO: 43361 - DNA, 22 bp, Artificial Sequence
  Synthetic
aaaccugggaaggcttcctuac

SEQ ID NO: 43362 - DNA, 21 bp, Artificial Sequence
  Synthetic
acctccaagagcuggtgtgua

SEQ ID NO: 43363 - DNA, 20 bp, Artificial Sequence
  Synthetic
cggtcgugactcttcuccag

SEQ ID NO: 43364 - DNA, 25 bp, Artificial Sequence
  Synthetic
ccactcactcuctctctctttcucc

SEQ ID NO: 43365 - DNA, 29 bp, Artificial Sequence
  Synthetic
attaaacatgtgucgagtttgcagaauac

SEQ ID NO: 43366 - DNA, 20 bp, Artificial Sequence
  Synthetic
gaggctcuggtgttctuggg

SEQ ID NO: 43367 - DNA, 18 bp, Artificial Sequence
  Synthetic
cacatccucgctgccugt

SEQ ID NO: 43368 - DNA, 21 bp, Artificial Sequence
  Synthetic
acggcgagautgaggcctaua

SEQ ID NO: 43369 - DNA, 20 bp, Artificial Sequence
  Synthetic
ctgagggcaucctctgtguc

SEQ ID NO: 43370 - DNA, 19 bp, Artificial Sequence
  Synthetic
caccctguggctccttguc

SEQ ID NO: 43371 - DNA, 26 bp, Artificial Sequence
  Synthetic
tggttgaagtatutggtggtcttgut

SEQ ID NO: 43372 - DNA, 27 bp, Artificial Sequence
  Synthetic
gggcaatatucacaggtatttctttuc

SEQ ID NO: 43373 - DNA, 22 bp, Artificial Sequence
  Synthetic
gcttcctcucgatcaggaucgt

SEQ ID NO: 43374 - DNA, 27 bp, Artificial Sequence
  Synthetic
ccagccctaautttgctttttgaugaa

SEQ ID NO: 43375 - DNA, 22 bp, Artificial Sequence
  Synthetic
cctgtgtcaccutgaccatcuc

SEQ ID NO: 43376 - DNA, 24 bp, Artificial Sequence
  Synthetic
ggtctctcccugagtctctgttut

SEQ ID NO: 43377 - DNA, 21 bp, Artificial Sequence
  Synthetic
ttctctgucacccggttgtuc

SEQ ID NO: 43378 - DNA, 18 bp, Artificial Sequence
  Synthetic
cctcggugccgggauaga

SEQ ID NO: 43379 - DNA, 20 bp, Artificial Sequence
  Synthetic
gaccttcaugacccacgugt

SEQ ID NO: 43380 - DNA, 18 bp, Artificial Sequence
  Synthetic
cccctcugtcctgtcucc

SEQ ID NO: 43381 - DNA, 19 bp, Artificial Sequence
  Synthetic
cctttccgcugctcccuac

SEQ ID NO: 43382 - DNA, 25 bp, Artificial Sequence
  Synthetic
catttcctggaauctgagtttgugg

SEQ ID NO: 43383 - DNA, 20 bp, Artificial Sequence
  Synthetic
gatgagagccagucgctugt

SEQ ID NO: 43384 - DNA, 21 bp, Artificial Sequence
  Synthetic
cagatgaucgccaacaagcuc

SEQ ID NO: 43385 - DNA, 26 bp, Artificial Sequence
  Synthetic
ctggtttatuaaattgctgaguggct

SEQ ID NO: 43386 - DNA, 21 bp, Artificial Sequence
  Synthetic
gatggctuctcatcgtcugct

SEQ ID NO: 43387 - DNA, 26 bp, Artificial Sequence
  Synthetic
ccctagtaauaaaagctggtuggcaa

SEQ ID NO: 43388 - DNA, 22 bp, Artificial Sequence
  Synthetic
gggtgtatuactttgccaugcc

SEQ ID NO: 43389 - DNA, 24 bp, Artificial Sequence
  Synthetic
accctcgaagguctgtatacucac

SEQ ID NO: 43390 - DNA, 22 bp, Artificial Sequence
  Synthetic
tcgtcaccaaucccaaggaaug

SEQ ID NO: 43391 - DNA, 27 bp, Artificial Sequence
  Synthetic
caagttaaaguggaatgaaaagugcct

SEQ ID NO: 43392 - DNA, 17 bp, Artificial Sequence
  Synthetic
tgtccgcgauggaggug

SEQ ID NO: 43393 - DNA, 18 bp, Artificial Sequence
  Synthetic
ggaggcuacacgggacug

SEQ ID NO: 43394 - DNA, 26 bp, Artificial Sequence
  Synthetic
gggctcttttgauaaaccaagagaut

SEQ ID NO: 43395 - DNA, 22 bp, Artificial Sequence
  Synthetic
agcgatctcacucttccggaua

SEQ ID NO: 43396 - DNA, 28 bp, Artificial Sequence
  Synthetic
tgtttctcgaugaaatggagtttuacct

SEQ ID NO: 43397 - DNA, 21 bp, Artificial Sequence
  Synthetic
ccgtagatgcugactgcacuc

SEQ ID NO: 43398 - DNA, 25 bp, Artificial Sequence
  Synthetic
aaaacattcaaggcutcaccatgug

SEQ ID NO: 43399 - DNA, 24 bp, Artificial Sequence
  Synthetic
gaaatgaacagcgagguctttgug

SEQ ID NO: 43400 - DNA, 26 bp, Artificial Sequence
  Synthetic
tgatgaucgagaagatgtcuggaagt

SEQ ID NO: 43401 - DNA, 30 bp, Artificial Sequence; identical to SEQ ID NO: 31167
  Synthetic

SEQ ID NO: 43402 - DNA, 17 bp, Artificial Sequence
  Synthetic
ccugcacgggagcugaa

SEQ ID NO: 43403 - DNA, 25 bp, Artificial Sequence
  Synthetic
tggataagucaaagtccaggucagt

SEQ ID NO: 43404 - DNA, 19 bp, Artificial Sequence
  Synthetic
ccuctgauggcgaaagcga

SEQ ID NO: 43405 - DNA, 19 bp, Artificial Sequence
  Synthetic
cagctcaggcuccttgucc

SEQ ID NO: 43406 - DNA, 19 bp, Artificial Sequence
  Synthetic
ggugagtcccuggaccaga

SEQ ID NO: 43407 - DNA, 19 bp, Artificial Sequence
  Synthetic
ggcacgaucttgcggaugt

SEQ ID NO: 43408 - DNA, 17 bp, Artificial Sequence
  Synthetic
gcccugagcctccagug

SEQ ID NO: 43409 - DNA, 18 bp, Artificial Sequence
  Synthetic
ccugagcgggaagagcug

SEQ ID NO: 43410 - DNA, 21 bp, Artificial Sequence
  Synthetic
gctggacagcugttggtucat

SEQ ID NO: 43411 - DNA, 22 bp, Artificial Sequence
  Synthetic
tggagtcguagatccgaaccuc

SEQ ID NO: 43412 - DNA, 21 bp, Artificial Sequence
  Synthetic
agtcugattcggugcggaaaa

SEQ ID NO: 43413 - DNA, 21 bp, Artificial Sequence
  Synthetic
tgggctgucgctttcttcuag

SEQ ID NO: 43414 - DNA, 19 bp, Artificial Sequence
  Synthetic
gaaggagguctgtcgcuga

SEQ ID NO: 43415 - DNA, 18 bp, Artificial Sequence
  Synthetic
cucagaccccgcacucac

SEQ ID NO: 43416 - DNA, 21 bp, Artificial Sequence
  Synthetic
ggagcucaacgacctcatgug

SEQ ID NO: 43417 - DNA, 29 bp, Artificial Sequence
  Synthetic
ctgtcacttacaaaaguagacattccugt

SEQ ID NO: 43418 - DNA, 19 bp, Artificial Sequence
  Synthetic
gccugagaaccggaugagg

SEQ ID NO: 43419 - DNA, 19 bp, Artificial Sequence
  Synthetic
gaaggcgucctgcagttug

SEQ ID NO: 43420 - DNA, 27 bp, Artificial Sequence
  Synthetic
gctctttctcautttcagcatctcuct

SEQ ID NO: 43421 - DNA, 21 bp, Artificial Sequence
  Synthetic
accagaaacggucagtgaugg

SEQ ID NO: 43422 - DNA, 20 bp, Artificial Sequence
  Synthetic
gcctccagacaucgaguacc

SEQ ID NO: 43423 - DNA, 22 bp, Artificial Sequence
  Synthetic
ccagugactuggaaccaaggat

SEQ ID NO: 43424 - DNA, 19 bp, Artificial Sequence
  Synthetic
cacctagcuttgccccuga

SEQ ID NO: 43425 - DNA, 21 bp, Artificial Sequence
  Synthetic
cacactacgugcaaaccctug

SEQ ID NO: 43426 - DNA, 23 bp, Artificial Sequence
  Synthetic
gccctacguagcaaacuacagag

SEQ ID NO: 43427 - DNA, 22 bp, Artificial Sequence
  Synthetic
atgagtggacgagugatgagug

SEQ ID NO: 43428 - DNA, 21 bp, Artificial Sequence
  Synthetic
aggagatcagguggacacuct

SEQ ID NO: 43429 - DNA, 23 bp, Artificial Sequence
  Synthetic
gtaggagctugagaccttatugc

SEQ ID NO: 43430 - DNA, 25 bp, Artificial Sequence
  Synthetic
atgaaattgcugaccatgctttgut

SEQ ID NO: 43431 - DNA, 19 bp, Artificial Sequence
  Synthetic
ccugccgagggagcaauac

SEQ ID NO: 43432 - DNA, 22 bp, Artificial Sequence
  Synthetic
ctccgcattutctacctgtgug

SEQ ID NO: 43433 - DNA, 27 bp, Artificial Sequence
  Synthetic
cccaauaaagaagauaaaaggccagua

SEQ ID NO: 43434 - DNA, 21 bp, Artificial Sequence
  Synthetic
cattcgccucttccccttcut

SEQ ID NO: 43435 - DNA, 23 bp, Artificial Sequence
  Synthetic
cttagctgtcacutagcgtccuc

SEQ ID NO: 43436 - DNA, 21 bp, Artificial Sequence
  Synthetic
catcctgagutgtcacgugga

SEQ ID NO: 43437 - DNA, 22 bp, Artificial Sequence
  Synthetic
tgaatgaggccautggtctuca

SEQ ID NO: 43438 - DNA, 19 bp, Artificial Sequence
  Synthetic
cacagucaccccucagcac

SEQ ID NO: 43439 - DNA, 28 bp, Artificial Sequence
  Synthetic
tccttctcatttutagttctccacucac

SEQ ID NO: 43440 - DNA, 22 bp, Artificial Sequence
  Synthetic
catgtaccaugcccucaaggag

SEQ ID NO: 43441 - DNA, 20 bp, Artificial Sequence
  Synthetic
gggctgtgucctgtttccug

SEQ ID NO: 43442 - DNA, 17 bp, Artificial Sequence
  Synthetic
gcgcccccaaucccauc

SEQ ID NO: 43443 - DNA, 17 bp, Artificial Sequence
  Synthetic
gcagcugggcacguagt

SEQ ID NO: 43444 - DNA, 19 bp, Artificial Sequence
  Synthetic
agccatcccugctcgacua

SEQ ID NO: 43445 - DNA, 17 bp, Artificial Sequence
  Synthetic
gcuccagggccccttug

SEQ ID NO: 43446 - DNA, 28 bp, Artificial Sequence
  Synthetic
gaaattgatugaagtaatgttcgugcct

SEQ ID NO: 43447 - DNA, 21 bp, Artificial Sequence
  Synthetic
gacttcgugatccatcugcct

SEQ ID NO: 43448 - DNA, 23 bp, Artificial Sequence
  Synthetic
cctaggugacagaaugagaccct

SEQ ID NO: 43449 - DNA, 24 bp, Artificial Sequence
  Synthetic
accgactattugacgcagtaugac

SEQ ID NO: 43450 - DNA, 22 bp, Artificial Sequence
  Synthetic
ggcatcccuggcatcauacaaa

SEQ ID NO: 43451 - DNA, 31 bp, Artificial Sequence; identical to SEQ ID NO: 31217
  Synthetic

SEQ ID NO: 43452 - DNA, 21 bp, Artificial Sequence
  Synthetic
gggacgttuccttcttgagug

SEQ ID NO: 43453 - DNA, 28 bp, Artificial Sequence
  Synthetic
gatttaattgtuacgcttttcccccuaa

SEQ ID NO: 43454 - DNA, 27 bp, Artificial Sequence
  Synthetic
accttcactacautagcaaagtctuag

SEQ ID NO: 43455 - DNA, 28 bp, Artificial Sequence
  Synthetic
ctacattaaggtcuttcctgcagacaut

SEQ ID NO: 43456 - DNA, 23 bp, Artificial Sequence
  Synthetic
gggaataaaagcgutttggcugt

SEQ ID NO: 43457 - DNA, 25 bp, Artificial Sequence
  Synthetic
ctctaaccggugttatttcccctuc

SEQ ID NO: 43458 - DNA, 20 bp, Artificial Sequence
  Synthetic
cgtgtacucctcgcagtucc

SEQ ID NO: 43459 - DNA, 21 bp, Artificial Sequence
  Synthetic
ccccuaacccagagauacgca

SEQ ID NO: 43460 - DNA, 22 bp, Artificial Sequence
  Synthetic
gggtcttcugacccctcactua

SEQ ID NO: 43461 - DNA, 18 bp, Artificial Sequence
  Synthetic
caccgugcccuaaacgac

SEQ ID NO: 43462 - DNA, 22 bp, Artificial Sequence
  Synthetic
ctgacctcccuctacaacccua

SEQ ID NO: 43463 - DNA, 22 bp, Artificial Sequence
  Synthetic
agaccttcuaccccctgaaucc

SEQ ID NO: 43464 - DNA, 20 bp, Artificial Sequence
  Synthetic
cccctgcaaucgtctcugac

SEQ ID NO: 43465 - DNA, 24 bp, Artificial Sequence
  Synthetic
agggcaacatuaagggtctgttut

SEQ ID NO: 43466 - DNA, 26 bp, Artificial Sequence
  Synthetic
ccuatgagtaggatuagggaccagat

SEQ ID NO: 43467 - DNA, 22 bp, Artificial Sequence
  Synthetic
caagacctuttctgtccuccca

SEQ ID NO: 43468 - DNA, 19 bp, Artificial Sequence
  Synthetic
agaggaggcugacctgugt

SEQ ID NO: 43469 - DNA, 22 bp, Artificial Sequence
  Synthetic
cctgaguagctgggatuacacc

SEQ ID NO: 43470 - DNA, 19 bp, Artificial Sequence
  Synthetic
gtgacgtugcggcagtuag

SEQ ID NO: 43471 - DNA, 24 bp, Artificial Sequence
  Synthetic
ctcgaagtagaugatgaggtccug

SEQ ID NO: 43472 - DNA, 22 bp, Artificial Sequence
  Synthetic
tgggtcucctattgtgaugcct

SEQ ID NO: 43473 - DNA, 19 bp, Artificial Sequence
  Synthetic
tcaggacugggaccccuac

SEQ ID NO: 43474 - DNA, 20 bp, Artificial Sequence
  Synthetic
ggccgctucacctctcatuc

SEQ ID NO: 43475 - DNA, 21 bp, Artificial Sequence
  Synthetic
gaggccagcautcagagtuca

SEQ ID NO: 43476 - DNA, 19 bp, Artificial Sequence
  Synthetic
cuctctggctucccaccac

SEQ ID NO: 43477 - DNA, 18 bp, Artificial Sequence
  Synthetic
gggtguagccctcgguga

SEQ ID NO: 43478 - DNA, 22 bp, Artificial Sequence
  Synthetic
atctccacaggagccuccaaua

SEQ ID NO: 43479 - DNA, 21 bp, Artificial Sequence
  Synthetic
ttgaugcggaaggagauggac

SEQ ID NO: 43480 - DNA, 22 bp, Artificial Sequence
  Synthetic
ccattgaucccaggactgctuc

SEQ ID NO: 43481 - DNA, 25 bp, Artificial Sequence
  Synthetic
cgatactccutgatgggtucaagat

SEQ ID NO: 43482 - DNA, 22 bp, Artificial Sequence
  Synthetic
ggtcatgauggaggaggguaga

SEQ ID NO: 43483 - DNA, 19 bp, Artificial Sequence
  Synthetic
ccuggcaccgcaagtcuag

SEQ ID NO: 43484 - DNA, 18 bp, Artificial Sequence
  Synthetic
gtgaccugtcgccuccac

SEQ ID NO: 43485 - DNA, 20 bp, Artificial Sequence
  Synthetic
ccagccctuagcacagcauc

SEQ ID NO: 43486 - DNA, 19 bp, Artificial Sequence
  Synthetic
gacactgguggaccgtcug

SEQ ID NO: 43487 - DNA, 21 bp, Artificial Sequence
  Synthetic
ggctcgatgutgtagccguag

SEQ ID NO: 43488 - DNA, 22 bp, Artificial Sequence
  Synthetic
cccaaagccugtcttcuaccaa

SEQ ID NO: 43489 - DNA, 24 bp, Artificial Sequence
  Synthetic
tgactgctucaaactcgaaguacc

SEQ ID NO: 43490 - DNA, 26 bp, Artificial Sequence
  Synthetic
ctgtcttcatauatctctcccuccct

SEQ ID NO: 43491 - DNA, 26 bp, Artificial Sequence
  Synthetic
gggtgaagataauggtgttctctgug

SEQ ID NO: 43492 - DNA, 22 bp, Artificial Sequence
  Synthetic
ccaactctcccauccctaccuc

SEQ ID NO: 43493 - DNA, 21 bp, Artificial Sequence
  Synthetic
gttgauggcaaatggcucgaa

SEQ ID NO: 43494 - DNA, 21 bp, Artificial Sequence
  Synthetic
tgugaccaggtguaggaccaa

SEQ ID NO: 43495 - DNA, 20 bp, Artificial Sequence
  Synthetic
cggaagtgcuggtggaacug

SEQ ID NO: 43496 - DNA, 22 bp, Artificial Sequence
  Synthetic
cgaccctgacuacgaaaaccug

SEQ ID NO: 43497 - DNA, 18 bp, Artificial Sequence
  Synthetic
gcccccaauccccacuct

SEQ ID NO: 43498 - DNA, 21 bp, Artificial Sequence
  Synthetic
ctgaccacuagttccccucct

SEQ ID NO: 43499 - DNA, 17 bp, Artificial Sequence
  Synthetic
cctgcaccucccaccuc

SEQ ID NO: 43500 - DNA, 21 bp, Artificial Sequence
  Synthetic
gaccuacaaatuggccccaga

SEQ ID NO: 43501 - DNA, 21 bp, Artificial Sequence
  Synthetic
ccattagugcccccatcacug

SEQ ID NO: 43502 - DNA, 20 bp, Artificial Sequence
  Synthetic
ctgatgccagugtccuggag

SEQ ID NO: 43503 - DNA, 18 bp, Artificial Sequence
  Synthetic
ctgcccaccccugcauag

SEQ ID NO: 43504 - DNA, 19 bp, Artificial Sequence
  Synthetic
tctgugcagccacguagac

SEQ ID NO: 43505 - DNA, 23 bp, Artificial Sequence
  Synthetic
gtgaccatttuctgtgctcctuc

SEQ ID NO: 43506 - DNA, 17 bp, Artificial Sequence
  Synthetic
gcctcagcccugccauc

SEQ ID NO: 43507 - DNA, 25 bp, Artificial Sequence
  Synthetic
gcatgtatcuctggagtttugggaa

SEQ ID NO: 43508 - DNA, 24 bp, Artificial Sequence
  Synthetic
gugaagaggaagaugaggaggaga

SEQ ID NO: 43509 - DNA, 21 bp, Artificial Sequence
  Synthetic
cagcccaccugtaactucaca

SEQ ID NO: 43510 - DNA, 20 bp, Artificial Sequence
  Synthetic
agcgctatguggacaagcuc

SEQ ID NO: 43511 - DNA, 23 bp, Artificial Sequence
  Synthetic
tttagaggtugagggtccucagt

SEQ ID NO: 43512 - DNA, 28 bp, Artificial Sequence
  Synthetic
gcatgcacauatgcacaaataaaugagt

SEQ ID NO: 43513 - DNA, 26 bp, Artificial Sequence
  Synthetic
ggtttctctuccttcttctucaccag

SEQ ID NO: 43514 - DNA, 20 bp, Artificial Sequence
  Synthetic
gctccaagccutgcattguc

SEQ ID NO: 43515 - DNA, 20 bp, Artificial Sequence
  Synthetic
aggctcauggtgtctuccac

SEQ ID NO: 43516 - DNA, 18 bp, Artificial Sequence
  Synthetic
gctgucacagtgguggct

SEQ ID NO: 43517 - DNA, 17 bp, Artificial Sequence
  Synthetic
ccugagcuccccagcac

SEQ ID NO: 43518 - DNA, 22 bp, Artificial Sequence
  Synthetic
gagacaagcaggagugagaugt

SEQ ID NO: 43519 - DNA, 23 bp, Artificial Sequence
  Synthetic
tgagtttggaaucagcaggtguc

SEQ ID NO: 43520 - DNA, 21 bp, Artificial Sequence
  Synthetic
aggtctcugatggtggcucat

SEQ ID NO: 43521 - DNA, 19 bp, Artificial Sequence
  Synthetic
gatggccucttcgauggca

SEQ ID NO: 43522 - DNA, 18 bp, Artificial Sequence
  Synthetic
ccggcccccucctcaaua

SEQ ID NO: 43523 - DNA, 18 bp, Artificial Sequence
  Synthetic
cctggcucagggtcucac

SEQ ID NO: 43524 - DNA, 21 bp, Artificial Sequence
  Synthetic
ggauggaactuggcgaaggag

SEQ ID NO: 43525 - DNA, 22 bp, Artificial Sequence
  Synthetic
gcaagaagucctggttcucgat

SEQ ID NO: 43526 - DNA, 21 bp, Artificial Sequence
  Synthetic
cutggatccttuggccacagt

SEQ ID NO: 43527 - DNA, 21 bp, Artificial Sequence
  Synthetic
gcagcauagagtccaccauga

SEQ ID NO: 43528 - DNA, 24 bp, Artificial Sequence
  Synthetic
gggattctacaucttgtgcatugt

SEQ ID NO: 43529 - DNA, 20 bp, Artificial Sequence
  Synthetic
acaaaugagccccgcaguag

SEQ ID NO: 43530 - DNA, 19 bp, Artificial Sequence
  Synthetic
cctgctucacccggtttuc

SEQ ID NO: 43531 - DNA, 24 bp, Artificial Sequence
  Synthetic
tgaaatcttccuctctgtcuccca

SEQ ID NO: 43532 - DNA, 20 bp, Artificial Sequence
  Synthetic
cccccaggautctctgucct

SEQ ID NO: 43533 - DNA, 24 bp, Artificial Sequence
  Synthetic
ggtttcatttugaccctcaaugct

SEQ ID NO: 43534 - DNA, 21 bp, Artificial Sequence
  Synthetic
gagtcccugaaggccatgaut

SEQ ID NO: 43535 - DNA, 21 bp, Artificial Sequence
  Synthetic
gccaugccccttgttcuagac

SEQ ID NO: 43536 - DNA, 22 bp, Artificial Sequence
  Synthetic
ggctggcaucctctgaatcuag

SEQ ID NO: 43537 - DNA, 23 bp, Artificial Sequence
  Synthetic
caugaaggcaaucagcaaaacca

SEQ ID NO: 43538 - DNA, 23 bp, Artificial Sequence
  Synthetic
ggctgatccutctctccacauct

SEQ ID NO: 43539 - DNA, 22 bp, Artificial Sequence
  Synthetic
aacaggtgucctaggtgaguct

SEQ ID NO: 43540 - DNA, 21 bp, Artificial Sequence
  Synthetic
cacccctcautggacccttua

SEQ ID NO: 43541 - DNA, 24 bp, Artificial Sequence
  Synthetic
ggattacaaucctgtgaggucagg

SEQ ID NO: 43542 - DNA, 22 bp, Artificial Sequence
  Synthetic
actgtccuctgtcctctuagcc

SEQ ID NO: 43543 - DNA, 22 bp, Artificial Sequence
  Synthetic
gaacatcagcuctggaaucgga

SEQ ID NO: 43544 - DNA, 18 bp, Artificial Sequence
  Synthetic
cgugggccagaaccucac

SEQ ID NO: 43545 - DNA, 22 bp, Artificial Sequence
  Synthetic
atucaaacacucagggactcuc

SEQ ID NO: 43546 - DNA, 20 bp, Artificial Sequence
  Synthetic
gacacguggcagcuaaacac

SEQ ID NO: 43547 - DNA, 21 bp, Artificial Sequence
  Synthetic
ggagauttggacucccagcac

SEQ ID NO: 43548 - DNA, 21 bp, Artificial Sequence
  Synthetic
ctacacagagaugccgcaugt

SEQ ID NO: 43549 - DNA, 24 bp, Artificial Sequence
  Synthetic
gautctcaggatatuccccagcag

SEQ ID NO: 43550 - DNA, 22 bp, Artificial Sequence
  Synthetic
tgctaggtuggagatgctgtut

SEQ ID NO: 43551 - DNA, 22 bp, Artificial Sequence
  Synthetic
cccgatagtugggatgaagugg

SEQ ID NO: 43552 - DNA, 21 bp, Artificial Sequence
  Synthetic
ggacgagtuctctgtgctcug

SEQ ID NO: 43553 - DNA, 24 bp, Artificial Sequence
  Synthetic
gaagaagttuctagccagucagga

SEQ ID NO: 43554 - DNA, 19 bp, Artificial Sequence
  Synthetic
cctguccggtcugcaacac

SEQ ID NO: 43555 - DNA, 21 bp, Artificial Sequence
  Synthetic
ggccagguaggaagtccuaga

SEQ ID NO: 43556 - DNA, 21 bp, Artificial Sequence
  Synthetic
tgaagaagaugctgcccaucg

SEQ ID NO: 43557 - DNA, 22 bp, Artificial Sequence
  Synthetic
tggcattguggttgttcccuaa

SEQ ID NO: 43558 - DNA, 23 bp, Artificial Sequence
  Synthetic
acccautgagtccucccaaaaac

SEQ ID NO: 43559 - DNA, 21 bp, Artificial Sequence
  Synthetic
ggactcugcgcacgatttuct

SEQ ID NO: 43560 - DNA, 21 bp, Artificial Sequence
  Synthetic
gggatgtgacugtcctgcuat

SEQ ID NO: 43561 - DNA, 23 bp, Artificial Sequence
  Synthetic
cctccattcuccagactcuccag

SEQ ID NO: 43562 - DNA, 21 bp, Artificial Sequence
  Synthetic
gggactcuagaaaccctcucc

SEQ ID NO: 43563 - DNA, 20 bp, Artificial Sequence
  Synthetic
gcccuggcaagagtctucac

SEQ ID NO: 43564 - DNA, 22 bp, Artificial Sequence
  Synthetic
tgcagugcttguccacaaaaag

SEQ ID NO: 43565 - DNA, 24 bp, Artificial Sequence
  Synthetic
tgctgaatgaaugggagatgacug

SEQ ID NO: 43566 - DNA, 21 bp, Artificial Sequence
  Synthetic
ggaacacacugcctuccaact

SEQ ID NO: 43567 - DNA, 24 bp, Artificial Sequence
  Synthetic
cttgccttctuctgaagtccctut

SEQ ID NO: 43568 - DNA, 22 bp, Artificial Sequence
  Synthetic
aggcttcaucacatacccccua

SEQ ID NO: 43569 - DNA, 25 bp, Artificial Sequence
  Synthetic
ggaaucccaaaggaagatgtcucag

SEQ ID NO: 43570 - DNA, 19 bp, Artificial Sequence
  Synthetic
gtgtctuggcgcatcugac

SEQ ID NO: 43571 - DNA, 25 bp, Artificial Sequence
  Synthetic
ctaattcagucaacccttccguacc

SEQ ID NO: 43572 - DNA, 21 bp, Artificial Sequence
  Synthetic
gagacggtucaggtgtgacut

SEQ ID NO: 43573 - DNA, 23 bp, Artificial Sequence
  Synthetic
gacatggcuttggagaagtucct

SEQ ID NO: 43574 - DNA, 21 bp, Artificial Sequence
  Synthetic
catcgtgauccctgatcccut

SEQ ID NO: 43575 - DNA, 22 bp, Artificial Sequence
  Synthetic
cctgagcgagcutcatcaucat

SEQ ID NO: 43576 - DNA, 19 bp, Artificial Sequence
  Synthetic
gtttaggcccugctgggua

SEQ ID NO: 43577 - DNA, 23 bp, Artificial Sequence
  Synthetic
ctttactgtuccctcacccucac

SEQ ID NO: 43578 - DNA, 25 bp, Artificial Sequence
  Synthetic
catccaatguggagatgatccucaa

SEQ ID NO: 43579 - DNA, 21 bp, Artificial Sequence
  Synthetic
gcagagatguctcttgccuga

SEQ ID NO: 43580 - DNA, 18 bp, Artificial Sequence
  Synthetic
cgacaucggctucaacgt

SEQ ID NO: 43581 - DNA, 21 bp, Artificial Sequence
  Synthetic
ctcgaaguagatgcgcucgat

SEQ ID NO: 43582 - DNA, 23 bp, Artificial Sequence
  Synthetic
gacaccaucttcgagaugcagat

SEQ ID NO: 43583 - DNA, 17 bp, Artificial Sequence
  Synthetic
caggcugcggtagcuga

SEQ ID NO: 43584 - DNA, 17 bp, Artificial Sequence
  Synthetic
ggtggccgugaccgaug

SEQ ID NO: 43585 - DNA, 23 bp, Artificial Sequence
  Synthetic
tccaaucccccatcttuccaaaa

SEQ ID NO: 43586 - DNA, 21 bp, Artificial Sequence
  Synthetic
ctcctgaccuctctctgucct

SEQ ID NO: 43587 - DNA, 21 bp, Artificial Sequence
  Synthetic
gtgacctggcuggatcctuac

SEQ ID NO: 43588 - DNA, 23 bp, Artificial Sequence
  Synthetic
cacagaugaatctctguccccat

SEQ ID NO: 43589 - DNA, 23 bp, Artificial Sequence
  Synthetic
ctgtgctttccuccaggaaguag

SEQ ID NO: 43590 - DNA, 21 bp, Artificial Sequence
  Synthetic
cctttggccucctcccacuat

SEQ ID NO: 43591 - DNA, 19 bp, Artificial Sequence
  Synthetic
gccuggactggguggaaac

SEQ ID NO: 43592 - DNA, 22 bp, Artificial Sequence
  Synthetic
gtctacacagccugatgctcuc

SEQ ID NO: 43593 - DNA, 22 bp, Artificial Sequence
  Synthetic
cttgagtgucagactccaguca

SEQ ID NO: 43594 - DNA, 20 bp, Artificial Sequence
  Synthetic
gcacagcugactctcgagug

SEQ ID NO: 43595 - DNA, 20 bp, Artificial Sequence
  Synthetic
cauggcgatguccaggagat

SEQ ID NO: 43596 - DNA, 17 bp, Artificial Sequence
  Synthetic
gctgaccuggccccauc

SEQ ID NO: 43597 - DNA, 20 bp, Artificial Sequence
  Synthetic
ggaagggucccagagtgcua

SEQ ID NO: 43598 - DNA, 21 bp, Artificial Sequence
  Synthetic
ttcacatguacgtgggtgucc

SEQ ID NO: 43599 - DNA, 23 bp, Artificial Sequence
  Synthetic
ctgcattctuagccatggagcua

SEQ ID NO: 43600 - DNA, 22 bp, Artificial Sequence
  Synthetic
gcctccacuctgatgtctctug

SEQ ID NO: 43601 - DNA, 22 bp, Artificial Sequence
  Synthetic
aaagctaaguaccccactgcug

SEQ ID NO: 43602 - DNA, 28 bp, Artificial Sequence
  Synthetic
aacagagcaacacccugtctaaaaauat

SEQ ID NO: 43603 - DNA, 23 bp, Artificial Sequence
  Synthetic
ctaagctggucctcatactgcut

SEQ ID NO: 43604 - DNA, 20 bp, Artificial Sequence
  Synthetic
cagccccgaauctagccuac

SEQ ID NO: 43605 - DNA, 27 bp, Artificial Sequence
  Synthetic
gaagatagccuttacatccctaauccc

SEQ ID NO: 43606 - DNA, 24 bp, Artificial Sequence
  Synthetic
cgtcatctcuggaatccccatcua

SEQ ID NO: 43607 - DNA, 21 bp, Artificial Sequence
  Synthetic
gguggaggcacagauagacgt

SEQ ID NO: 43608 - DNA, 17 bp, Artificial Sequence
  Synthetic
ccggucccctcuacacc

SEQ ID NO: 43609 - DNA, 28 bp, Artificial Sequence
  Synthetic
tcctggaagaacacucagaaaaacuaaa

SEQ ID NO: 43610 - DNA, 25 bp, Artificial Sequence
  Synthetic
tcatgtgagugtgaatgagtgugag

SEQ ID NO: 43611 - DNA, 24 bp, Artificial Sequence
  Synthetic
attgtuccggcagaagaagaugat

SEQ ID NO: 43612 - DNA, 21 bp, Artificial Sequence
  Synthetic
ctgacctgccutctctgtguc

SEQ ID NO: 43613 - DNA, 20 bp, Artificial Sequence
  Synthetic
gaagatgcuacggtggcugt

SEQ ID NO: 43614 - DNA, 20 bp, Artificial Sequence
  Synthetic
tgacgacagutcagcguacc

SEQ ID NO: 43615 - DNA, 22 bp, Artificial Sequence
  Synthetic
tcggtgtuccacaaatcctucc

SEQ ID NO: 43616 - DNA, 24 bp, Artificial Sequence
  Synthetic
acccactggaucacttcgauaagt

SEQ ID NO: 43617 - DNA, 18 bp, Artificial Sequence
  Synthetic
gcaacugctgcagaugct

SEQ ID NO: 43618 - DNA, 22 bp, Artificial Sequence
  Synthetic
gggcacagcauagttgtgtuga

SEQ ID NO: 43619 - DNA, 23 bp, Artificial Sequence
  Synthetic
ctcuccagucaaagacctaagut

SEQ ID NO: 43620 - DNA, 21 bp, Artificial Sequence
  Synthetic
ggutggctccaugaccaagat

SEQ ID NO: 43621 - DNA, 23 bp, Artificial Sequence
  Synthetic
tcaaggcuactccatcaaugcag

SEQ ID NO: 43622 - DNA, 20 bp, Artificial Sequence
  Synthetic
tgutacaaagugccccagca

SEQ ID NO: 43623 - DNA, 19 bp, Artificial Sequence
  Synthetic
aaggcggagautgcaguga

SEQ ID NO: 43624 - DNA, 20 bp, Artificial Sequence
  Synthetic
cccggagucgaagacagtuc

SEQ ID NO: 43625 - DNA, 19 bp, Artificial Sequence
  Synthetic
gtgttgaccucgccctcuc

SEQ ID NO: 43626 - DNA, 22 bp, Artificial Sequence
  Synthetic
agggugagccctatatcuggac

SEQ ID NO: 43627 - DNA, 24 bp, Artificial Sequence
  Synthetic
ctatgcctcuttcttctcctucca

SEQ ID NO: 43628 - DNA, 18 bp, Artificial Sequence
  Synthetic
gggagguaaggacgguga

SEQ ID NO: 43629 - DNA, 18 bp, Artificial Sequence
  Synthetic
ccuggaggaggaggugct

SEQ ID NO: 43630 - DNA, 24 bp, Artificial Sequence
  Synthetic
cctcacctttuctctcccaatugt

SEQ ID NO: 43631 - DNA, 24 bp, Artificial Sequence
  Synthetic
ccagagaaucagcattctgtcucc

SEQ ID NO: 43632 - DNA, 23 bp, Artificial Sequence
  Synthetic
gtgatucaggacccuagaaggua

SEQ ID NO: 43633 - DNA, 23 bp, Artificial Sequence
  Synthetic
ctttacaccggauttcgaaggug

SEQ ID NO: 43634 - DNA, 19 bp, Artificial Sequence
  Synthetic
gcagagagaggugctccug

SEQ ID NO: 43635 - DNA, 21 bp, Artificial Sequence
  Synthetic
cgctgggugtattcgcctaug

SEQ ID NO: 43636 - DNA, 23 bp, Artificial Sequence
  Synthetic
ctctttucccctccaaauccagt

SEQ ID NO: 43637 - DNA, 25 bp, Artificial Sequence
  Synthetic
ggttcatttaucccacccttctcut

SEQ ID NO: 43638 - DNA, 21 bp, Artificial Sequence
  Synthetic
cacccccaaucctagagctuc

SEQ ID NO: 43639 - DNA, 17 bp, Artificial Sequence
  Synthetic
ggtgcccugcaggtguc

SEQ ID NO: 43640 - DNA, 25 bp, Artificial Sequence
  Synthetic
gttctaaggcucggtcattcaucaa

SEQ ID NO: 43641 - DNA, 22 bp, Artificial Sequence
  Synthetic
catcgtggugaggctuaaggag

SEQ ID NO: 43642 - DNA, 22 bp, Artificial Sequence
  Synthetic
tctcagctucaccctaggacug

SEQ ID NO: 43643 - DNA, 22 bp, Artificial Sequence
  Synthetic
tgtccttcugcagactccgtua

SEQ ID NO: 43644 - DNA, 21 bp, Artificial Sequence
  Synthetic
cgtcaccccauggtgaguaac

SEQ ID NO: 43645 - DNA, 23 bp, Artificial Sequence
  Synthetic
gugccaagagaaaugactguact

SEQ ID NO: 43646 - DNA, 22 bp, Artificial Sequence
  Synthetic
cactgttugccaagacccagua

SEQ ID NO: 43647 - DNA, 23 bp, Artificial Sequence
  Synthetic
cctcctcccaucactctttgtuc

SEQ ID NO: 43648 - DNA, 21 bp, Artificial Sequence
  Synthetic
caagacccuccacagatgugt

SEQ ID NO: 43649 - DNA, 20 bp, Artificial Sequence
  Synthetic
gggcgtaggucatggcauag

SEQ ID NO: 43650 - DNA, 22 bp, Artificial Sequence
  Synthetic
tccctaucaggccagagctaug

SEQ ID NO: 43651 - DNA, 22 bp, Artificial Sequence
  Synthetic
cgatggagagagauggagacug

SEQ ID NO: 43652 - DNA, 22 bp, Artificial Sequence
  Synthetic
caagttttuagggaacgcugct

SEQ ID NO: 43653 - DNA, 22 bp, Artificial Sequence
  Synthetic
catagctuggcgatggtctuga

SEQ ID NO: 43654 - DNA, 23 bp, Artificial Sequence
  Synthetic
gggtgauacaggcttcttttuga

SEQ ID NO: 43655 - DNA, 24 bp, Artificial Sequence
  Synthetic
cugagaaggagatauacccagcca

SEQ ID NO: 43656 - DNA, 21 bp, Artificial Sequence
  Synthetic
gacaacctccugtcccgttua

SEQ ID NO: 43657 - DNA, 20 bp, Artificial Sequence
  Synthetic
ccatcgtcuccagacccuga

SEQ ID NO: 43658 - DNA, 18 bp, Artificial Sequence
  Synthetic
ctgucggaggaggagcug

SEQ ID NO: 43659 - DNA, 21 bp, Artificial Sequence
  Synthetic
caaggucacagtgucagcaga

SEQ ID NO: 43660 - DNA, 23 bp, Artificial Sequence
  Synthetic
gttgctttgcugttacctctguc

SEQ ID NO: 43661 - DNA, 20 bp, Artificial Sequence
  Synthetic
cctcaccuttccctccucac

SEQ ID NO: 43662 - DNA, 17 bp, Artificial Sequence
  Synthetic
gggtccgguaggcaugg

SEQ ID NO: 43663 - DNA, 17 bp, Artificial Sequence
  Synthetic
ggcgctcugggagtcug

SEQ ID NO: 43664 - DNA, 18 bp, Artificial Sequence
  Synthetic
gatcgcagccuccctguc

SEQ ID NO: 43665 - DNA, 21 bp, Artificial Sequence
  Synthetic
ctcatccuggccttctucaca

SEQ ID NO: 43666 - DNA, 21 bp, Artificial Sequence
  Synthetic
agaguggccttatguccacct

SEQ ID NO: 43667 - DNA, 22 bp, Artificial Sequence
  Synthetic
aagacctgcuctagcccauact

SEQ ID NO: 43668 - DNA, 22 bp, Artificial Sequence
  Synthetic
cgcggtcugctatacgatguac

SEQ ID NO: 43669 - DNA, 24 bp, Artificial Sequence
  Synthetic
guagaagaggacgacauggacaaa

SEQ ID NO: 43670 - DNA, 22 bp, Artificial Sequence
  Synthetic
gttggccccaugtttctcaaug

SEQ ID NO: 43671 - DNA, 25 bp, Artificial Sequence
  Synthetic
gttaattggtttugtgcctgcctua

SEQ ID NO: 43672 - DNA, 20 bp, Artificial Sequence
  Synthetic
cgaacugccttgccaucgaa

SEQ ID NO: 43673 - DNA, 27 bp, Artificial Sequence
  Synthetic
caatcttacacgugtgtgggttttuaa

SEQ ID NO: 43674 - DNA, 23 bp, Artificial Sequence
  Synthetic
gatgtucgcacagttatccuggt

SEQ ID NO: 43675 - DNA, 24 bp, Artificial Sequence
  Synthetic
ctaagctgccagcutctgttttuc

SEQ ID NO: 43676 - DNA, 28 bp, Artificial Sequence
  Synthetic
gtggcttattugtgaaaagtcaaauggt

SEQ ID NO: 43677 - DNA, 26 bp, Artificial Sequence
  Synthetic
ccctaaactugaactccatttcucct

SEQ ID NO: 43678 - DNA, 23 bp, Artificial Sequence
  Synthetic
acacacacacacgauagtggaug

SEQ ID NO: 43679 - DNA, 29 bp, Artificial Sequence
  Synthetic
ttgggtattaggaaaauaagtggtggtut

SEQ ID NO: 43680 - DNA, 26 bp, Artificial Sequence
  Synthetic
gaaccagguccagagaaauatcauaa

SEQ ID NO: 43681 - DNA, 21 bp, Artificial Sequence
  Synthetic
ggtggcaccugctatgaugag

SEQ ID NO: 43682 - DNA, 21 bp, Artificial Sequence
  Synthetic
ggaagggucccagagauagca

SEQ ID NO: 43683 - DNA, 25 bp, Artificial Sequence
  Synthetic
ccgattgtcucccctttgattcuag

SEQ ID NO: 43684 - DNA, 22 bp, Artificial Sequence
  Synthetic
attcccggaugagggagtctua

SEQ ID NO: 43685 - DNA, 27 bp, Artificial Sequence
  Synthetic
tgatctgaucccaagcctatcttcuag

SEQ ID NO: 43686 - DNA, 21 bp, Artificial Sequence
  Synthetic
cttggccauctgaggtttugc

SEQ ID NO: 43687 - DNA, 24 bp, Artificial Sequence
  Synthetic
tctctctccccutctcctcttcua

SEQ ID NO: 43688 - DNA, 21 bp, Artificial Sequence
  Synthetic
gcaagtcggcuacccaagtut

SEQ ID NO: 43689 - DNA, 24 bp, Artificial Sequence
  Synthetic
atttctcatgcucatccccatcuc

SEQ ID NO: 43690 - DNA, 22 bp, Artificial Sequence
  Synthetic
tcacacuggacaagcctaggua

SEQ ID NO: 43691 - DNA, 21 bp, Artificial Sequence
  Synthetic
gactgccaucctggttttugc

SEQ ID NO: 43692 - DNA, 21 bp, Artificial Sequence
  Synthetic
accctggguctcatcccuaag

SEQ ID NO: 43693 - DNA, 27 bp, Artificial Sequence
  Synthetic
tctcttaacgtucaaaaggctaaccug

SEQ ID NO: 43694 - DNA, 25 bp, Artificial Sequence
  Synthetic
gggtgauaaatggacacuaaaagca

SEQ ID NO: 43695 - DNA, 21 bp, Artificial Sequence
  Synthetic
agtatcagauccgcgugacct

SEQ ID NO: 43696 - DNA, 28 bp, Artificial Sequence
  Synthetic
aaatgctaagtacuaaggagacagaucc

SEQ ID NO: 43697 - DNA, 28 bp, Artificial Sequence
  Synthetic
gaccctgtttcugaattgctaaattgut

SEQ ID NO: 43698 - DNA, 23 bp, Artificial Sequence
  Synthetic
acugatactcctugaggcacact

SEQ ID NO: 43699 - DNA, 28 bp, Artificial Sequence
  Synthetic
tctatacucgaagaaaacagctttcucc

SEQ ID NO: 43700 - DNA, 18 bp, Artificial Sequence
  Synthetic
ctccuaccttggcucgca

SEQ ID NO: 43701 - DNA, 17 bp, Artificial Sequence
  Synthetic
gcuccaaucggcggagt

SEQ ID NO: 43702 - DNA, 22 bp, Artificial Sequence
  Synthetic
ggaaaggaggguggatccugat

SEQ ID NO: 43703 - DNA, 20 bp, Artificial Sequence
  Synthetic
ggcctuggctgctagtugag

SEQ ID NO: 43704 - DNA, 21 bp, Artificial Sequence
  Synthetic
ccugagaccagcgucaagaag

SEQ ID NO: 43705 - DNA, 22 bp, Artificial Sequence
  Synthetic
aatuaagcaggaccccuaggga

SEQ ID NO: 43706 - DNA, 22 bp, Artificial Sequence
  Synthetic
ggcatcagagcucaccttugaa

SEQ ID NO: 43707 - DNA, 19 bp, Artificial Sequence
  Synthetic
gccccaccucggatttcuc

SEQ ID NO: 43708 - DNA, 19 bp, Artificial Sequence
  Synthetic
cactgaccaugagggcugt

SEQ ID NO: 43709 - DNA, 23 bp, Artificial Sequence
  Synthetic
cggtgtacuctctgtccaugagt

SEQ ID NO: 43710 - DNA, 20 bp, Artificial Sequence
  Synthetic
ctgttcaagggugcggguat

SEQ ID NO: 43711 - DNA, 20 bp, Artificial Sequence
  Synthetic
ccactactucgggcacucac

SEQ ID NO: 43712 - DNA, 21 bp, Artificial Sequence
  Synthetic
ggacuaccatcugaccgaggt

SEQ ID NO: 43713 - DNA, 21 bp, Artificial Sequence
  Synthetic
ctggugacagcactgatcuca

SEQ ID NO: 43714 - DNA, 22 bp, Artificial Sequence
  Synthetic
gcaagacaagccuctgagtugg

SEQ ID NO: 43715 - DNA, 25 bp, Artificial Sequence
  Synthetic
gtctgtcttaucggagatttgguca

SEQ ID NO: 43716 - DNA, 22 bp, Artificial Sequence
  Synthetic
cctaccccuctgaaggtgacuc

SEQ ID NO: 43717 - DNA, 24 bp, Artificial Sequence
  Synthetic
ggcctcaaagguctcttcaucaaa

SEQ ID NO: 43718 - DNA, 19 bp, Artificial Sequence
  Synthetic
agguagagaggccagcuga

SEQ ID NO: 43719 - DNA, 19 bp, Artificial Sequence
  Synthetic
caccctgaauccagcggua

SEQ ID NO: 43720 - DNA, 22 bp, Artificial Sequence
  Synthetic
aaccgctucaagaagaucagca

SEQ ID NO: 43721 - DNA, 18 bp, Artificial Sequence
  Synthetic
gaagcggucactgcaugg

SEQ ID NO: 43722 - DNA, 22 bp, Artificial Sequence
  Synthetic
cttcctgaccccuctgtgatuc

SEQ ID NO: 43723 - DNA, 22 bp, Artificial Sequence
  Synthetic
agtcccaucagcatcctctuca

SEQ ID NO: 43724 - DNA, 24 bp, Artificial Sequence
  Synthetic
ctcatacacggucttatcgtccug

SEQ ID NO: 43725 - DNA, 23 bp, Artificial Sequence
  Synthetic
catcuggaagctctuccgaaact

SEQ ID NO: 43726 - DNA, 19 bp, Artificial Sequence
  Synthetic
cgtguccgagggcttctuc

SEQ ID NO: 43727 - DNA, 18 bp, Artificial Sequence
  Synthetic
cgcagccucgaagugact

SEQ ID NO: 43728 - DNA, 19 bp, Artificial Sequence
  Synthetic
gucctguacagcgagagca

SEQ ID NO: 43729 - DNA, 19 bp, Artificial Sequence
  Synthetic
cuacagcccggactgugac

SEQ ID NO: 43730 - DNA, 22 bp, Artificial Sequence
  Synthetic
gttcatcctucttgggctgugt

SEQ ID NO: 43731 - DNA, 23 bp, Artificial Sequence
  Synthetic
gaattcatcugcactgtgtuggg

SEQ ID NO: 43732 - DNA, 24 bp, Artificial Sequence
  Synthetic
caacttttugcaaagcagcauagc

SEQ ID NO: 43733 - DNA, 24 bp, Artificial Sequence
  Synthetic
gaaaacaagatugcggtcagcuaa

SEQ ID NO: 43734 - DNA, 22 bp, Artificial Sequence
  Synthetic
gagccauccatctuggagacag

SEQ ID NO: 43735 - DNA, 23 bp, Artificial Sequence
  Synthetic
guacggauggaaaaagagtcuca

SEQ ID NO: 43736 - DNA, 24 bp, Artificial Sequence
  Synthetic
ggaatggaaggauggaagaacuca

SEQ ID NO: 43737 - DNA, 22 bp, Artificial Sequence
  Synthetic
aagaacttcucgtctgcuagcg

SEQ ID NO: 43738 - DNA, 23 bp, Artificial Sequence
  Synthetic
cacaaatgugccaggaactucaa

SEQ ID NO: 43739 - DNA, 31 bp, Artificial Sequence; identical to SEQ ID NO: 31505
  Synthetic

SEQ ID NO: 43740 - DNA, 23 bp, Artificial Sequence
  Synthetic
gatgcttucggcttgactatugg

SEQ ID NO: 43741 - DNA, 22 bp, Artificial Sequence
  Synthetic
cttagaugccccagggaaagug

SEQ ID NO: 43742 - DNA, 24 bp, Artificial Sequence
  Synthetic
acttcctcuacatcgatgcttucg

SEQ ID NO: 43743 - DNA, 22 bp, Artificial Sequence
  Synthetic
agttcactaaugccgtgaugct

SEQ ID NO: 43744 - DNA, 20 bp, Artificial Sequence
  Synthetic
ggtgtgggugcgataaugca

SEQ ID NO: 43745 - DNA, 23 bp, Artificial Sequence
  Synthetic
gggugggaccaaactataatucc

SEQ ID NO: 43746 - DNA, 21 bp, Artificial Sequence
  Synthetic
agcccuacagaggtggtuaca

SEQ ID NO: 43747 - DNA, 20 bp, Artificial Sequence
  Synthetic
tgctctguctgtggtcaucg

SEQ ID NO: 43748 - DNA, 23 bp, Artificial Sequence
  Synthetic
cttcccctuccctttcttggaug

SEQ ID NO: 43749 - DNA, 22 bp, Artificial Sequence
  Synthetic
tgcctugaaacaagccaagcua

SEQ ID NO: 43750 - DNA, 20 bp, Artificial Sequence
  Synthetic
atgtucacctggaugcggat

SEQ ID NO: 43751 - DNA, 24 bp, Artificial Sequence
  Synthetic
ccccaggacauaagctattuagcc

SEQ ID NO: 43752 - DNA, 20 bp, Artificial Sequence
  Synthetic
gccattcuccctgugacagt

SEQ ID NO: 43753 - DNA, 21 bp, Artificial Sequence
  Synthetic
cgtctgugagaaatgctgugc

SEQ ID NO: 43754 - DNA, 18 bp, Artificial Sequence
  Synthetic
cgtacguccgggaagcuc

SEQ ID NO: 43755 - DNA, 20 bp, Artificial Sequence
  Synthetic
gcaaataacugcggctcucc

SEQ ID NO: 43756 - DNA, 19 bp, Artificial Sequence
  Synthetic
gggttuccgttgcagucct

SEQ ID NO: 43757 - DNA, 19 bp, Artificial Sequence
  Synthetic
cccgctccuagcaaaggug

SEQ ID NO: 43758 - DNA, 23 bp, Artificial Sequence
  Synthetic
agcactttcuccatgggaagtut

SEQ ID NO: 43759 - DNA, 29 bp, Artificial Sequence
  Synthetic
tcgccattatuacaagagttaagcatcut

SEQ ID NO: 43760 - DNA, 22 bp, Artificial Sequence
  Synthetic
tgggtattgtugggaggaggua

SEQ ID NO: 43761 - DNA, 24 bp, Artificial Sequence
  Synthetic
caagggaatguttattgggcgauc

SEQ ID NO: 43762 - DNA, 25 bp, Artificial Sequence
  Synthetic
cgttttcctaaccutgttcgccuat

SEQ ID NO: 43763 - DNA, 29 bp, Artificial Sequence
  Synthetic
gtacaggatgacauagtagaagttcucag

SEQ ID NO: 43764 - DNA, 22 bp, Artificial Sequence
  Synthetic
ccaatgaccccuaccaccagua

SEQ ID NO: 43765 - DNA, 23 bp, Artificial Sequence
  Synthetic
catctcttcaugtctggacguca

SEQ ID NO: 43766 - DNA, 29 bp, Artificial Sequence
  Synthetic
catttcaatcucagtgatttatgctugct

SEQ ID NO: 43767 - DNA, 28 bp, Artificial Sequence
  Synthetic
gtcacacacaaaugatgtttcaugagaa

SEQ ID NO: 43768 - DNA, 23 bp, Artificial Sequence
  Synthetic
ggatgtguccagtttuagccagt

SEQ ID NO: 43769 - DNA, 20 bp, Artificial Sequence
  Synthetic
agcacucgaacgacccatuc

SEQ ID NO: 43770 - DNA, 20 bp, Artificial Sequence
  Synthetic
ccaccctgcugaactgtcuc

SEQ ID NO: 43771 - DNA, 21 bp, Artificial Sequence
  Synthetic
acgtgtgggutttggccaaua

SEQ ID NO: 43772 - DNA, 17 bp, Artificial Sequence
  Synthetic
gcuacgccggcttcuga

SEQ ID NO: 43773 - DNA, 20 bp, Artificial Sequence
  Synthetic
gggactauccctggcucaca

SEQ ID NO: 43774 - DNA, 21 bp, Artificial Sequence
  Synthetic
cttctggagggugctgtucaa

SEQ ID NO: 43775 - DNA, 21 bp, Artificial Sequence
  Synthetic
cctcaaacaccacuccggtuc

SEQ ID NO: 43776 - DNA, 19 bp, Artificial Sequence
  Synthetic
cgtccccaaggcuttggua

SEQ ID NO: 43777 - DNA, 19 bp, Artificial Sequence
  Synthetic
aagacuggagacccuggct

SEQ ID NO: 43778 - DNA, 20 bp, Artificial Sequence
  Synthetic
ctgcctgcutctggcauaga

SEQ ID NO: 43779 - DNA, 17 bp, Artificial Sequence
  Synthetic
cccgccacagcgucuac

SEQ ID NO: 43780 - DNA, 18 bp, Artificial Sequence
  Synthetic
cattgcugacgccccuct

SEQ ID NO: 43781 - DNA, 20 bp, Artificial Sequence
  Synthetic
tccctgagugcccagguaaa

SEQ ID NO: 43782 - DNA, 17 bp, Artificial Sequence
  Synthetic
cctgccguggtgggtua

SEQ ID NO: 43783 - DNA, 23 bp, Artificial Sequence
  Synthetic
caggtaccacutcctccagaauc

SEQ ID NO: 43784 - DNA, 18 bp, Artificial Sequence
  Synthetic
cgcugaggucgggagaga

SEQ ID NO: 43785 - DNA, 21 bp, Artificial Sequence
  Synthetic
cctgaaatuctgcccugacca

SEQ ID NO: 43786 - DNA, 19 bp, Artificial Sequence
  Synthetic
tctgcaugggcgtctctug

SEQ ID NO: 43787 - DNA, 19 bp, Artificial Sequence
  Synthetic
gcttcccutcagggucagt

SEQ ID NO: 43788 - DNA, 18 bp, Artificial Sequence
  Synthetic
agggucccagcagucact

SEQ ID NO: 43789 - DNA, 19 bp, Artificial Sequence
  Synthetic
ccggcaggugcttguagac

SEQ ID NO: 43790 - DNA, 17 bp, Artificial Sequence
  Synthetic
cgcugttgccucccaca

SEQ ID NO: 43791 - DNA, 17 bp, Artificial Sequence
  Synthetic
ccgaccacgcucacuca

SEQ ID NO: 43792 - DNA, 22 bp, Artificial Sequence
  Synthetic
gttgggcugacctcttctctut

SEQ ID NO: 43793 - DNA, 21 bp, Artificial Sequence
  Synthetic
ctgagttuccacggcucaaga

SEQ ID NO: 43794 - DNA, 20 bp, Artificial Sequence
  Synthetic
gggacaugcagctctgauga

SEQ ID NO: 43795 - DNA, 25 bp, Artificial Sequence
  Synthetic
ggtttaattuccaggcacatgaugg

SEQ ID NO: 43796 - DNA, 21 bp, Artificial Sequence
  Synthetic
gtgcctguaatcccagcuaca

SEQ ID NO: 43797 - DNA, 22 bp, Artificial Sequence
  Synthetic
gtggtggcaauggttacaugag

SEQ ID NO: 43798 - DNA, 20 bp, Artificial Sequence
  Synthetic
cttggacccggacucgtuat

SEQ ID NO: 43799 - DNA, 19 bp, Artificial Sequence
  Synthetic
ggaaguccaggugcaccac

SEQ ID NO: 43800 - DNA, 27 bp, Artificial Sequence
  Synthetic
ggaaccacttcuaactgaaattggtut

SEQ ID NO: 43801 - DNA, 27 bp, Artificial Sequence
  Synthetic
gatctgatgagucagcaaagaagacut

SEQ ID NO: 43802 - DNA, 21 bp, Artificial Sequence
  Synthetic
gagcctuggcagaattucacg

SEQ ID NO: 43803 - DNA, 23 bp, Artificial Sequence
  Synthetic
tttacagaggucgcagagggaua

SEQ ID NO: 43804 - DNA, 20 bp, Artificial Sequence
  Synthetic
ggtgggacgutcactguagt

SEQ ID NO: 43805 - DNA, 20 bp, Artificial Sequence
  Synthetic
gctctgtcgcuctgcttcug

SEQ ID NO: 43806 - DNA, 18 bp, Artificial Sequence
  Synthetic
gtcccccaacucccctut

SEQ ID NO: 43807 - DNA, 18 bp, Artificial Sequence
  Synthetic
tcaugcgggaagcgaugg

SEQ ID NO: 43808 - DNA, 23 bp, Artificial Sequence
  Synthetic
tgtccttccccautggtttgtua

SEQ ID NO: 43809 - DNA, 24 bp, Artificial Sequence
  Synthetic
cagtttcaucgagttcuagcccaa

SEQ ID NO: 43810 - DNA, 22 bp, Artificial Sequence
  Synthetic
cacctcacutccacucacagag

SEQ ID NO: 43811 - DNA, 28 bp, Artificial Sequence
  Synthetic
ccaaatuaacgcucaggaaaaatacaut

SEQ ID NO: 43812 - DNA, 30 bp, Artificial Sequence; identical to SEQ ID NO: 31578
  Synthetic

SEQ ID NO: 43813 - DNA, 26 bp, Artificial Sequence
  Synthetic
agcccauaaaggaatguaaaccaaca

SEQ ID NO: 43814 - DNA, 23 bp, Artificial Sequence
  Synthetic
ggcgcttacaguagctgttctua

SEQ ID NO: 43815 - DNA, 23 bp, Artificial Sequence
  Synthetic
ccatctgcaguacacacatgucc

SEQ ID NO: 43816 - DNA, 26 bp, Artificial Sequence
  Synthetic
cagtaggcagugaagtaaatttgugg

SEQ ID NO: 43817 - DNA, 28 bp, Artificial Sequence
  Synthetic
acagtgacaucatcagtuaaaacaaggt

SEQ ID NO: 43818 - DNA, 22 bp, Artificial Sequence
  Synthetic
aacagcacaugatcccactuca

SEQ ID NO: 43819 - DNA, 20 bp, Artificial Sequence
  Synthetic
cgaatcgcugtggcctugat

SEQ ID NO: 43820 - DNA, 23 bp, Artificial Sequence
  Synthetic
ccctcttctgugaagctgacauc

SEQ ID NO: 43821 - DNA, 26 bp, Artificial Sequence
  Synthetic
aggaaagagaacaucaccaggacuaa

SEQ ID NO: 43822 - DNA, 22 bp, Artificial Sequence
  Synthetic
tgatgcatgauaccctctugcc

SEQ ID NO: 43823 - DNA, 28 bp, Artificial Sequence
  Synthetic
tccugatcagcaaaauacaagaaagaga

SEQ ID NO: 43824 - DNA, 21 bp, Artificial Sequence
  Synthetic
cuggtttagccucaagcccaa

SEQ ID NO: 43825 - DNA, 21 bp, Artificial Sequence
  Synthetic
cagggtgggugcctactttua

SEQ ID NO: 43826 - DNA, 23 bp, Artificial Sequence
  Synthetic
gtggccttcuttgaagagctcua

SEQ ID NO: 43827 - DNA, 26 bp, Artificial Sequence
  Synthetic
gagagaaatctcuacagggtcguagt

SEQ ID NO: 43828 - DNA, 21 bp, Artificial Sequence
  Synthetic
cttgagcagcugaagctgtut

SEQ ID NO: 43829 - DNA, 17 bp, Artificial Sequence
  Synthetic
ctcctcucgccctugcc

SEQ ID NO: 43830 - DNA, 20 bp, Artificial Sequence
  Synthetic
gccaaggauctgggaucagg

SEQ ID NO: 43831 - DNA, 21 bp, Artificial Sequence
  Synthetic
ccttgauggcgaactgaguga

SEQ ID NO: 43832 - DNA, 17 bp, Artificial Sequence
  Synthetic
gctgcccugctggcaua

SEQ ID NO: 43833 - DNA, 22 bp, Artificial Sequence
  Synthetic
cccagtgcuaactccagtctut

SEQ ID NO: 43834 - DNA, 17 bp, Artificial Sequence
  Synthetic
gccuccacggacaggut

SEQ ID NO: 43835 - DNA, 17 bp, Artificial Sequence
  Synthetic
cccutgatgcucccgca

SEQ ID NO: 43836 - DNA, 18 bp, Artificial Sequence
  Synthetic
caccccaaggugccacut

SEQ ID NO: 43837 - DNA, 21 bp, Artificial Sequence
  Synthetic
cuctctcuagggaaggccaca

SEQ ID NO: 43838 - DNA, 20 bp, Artificial Sequence
  Synthetic
ggtccaggutgggagtggua

SEQ ID NO: 43839 - DNA, 20 bp, Artificial Sequence
  Synthetic
cccuccctctctugggacag

SEQ ID NO: 43840 - DNA, 28 bp, Artificial Sequence
  Synthetic
aagaattgttgaguctgaggaatauggg

SEQ ID NO: 43841 - DNA, 27 bp, Artificial Sequence
  Synthetic
ctgaatactgagcautttctgaagcug

SEQ ID NO: 43842 - DNA, 21 bp, Artificial Sequence
  Synthetic
ccacccacutgagacacctuc

SEQ ID NO: 43843 - DNA, 23 bp, Artificial Sequence
  Synthetic
tgactgccaugtgtctttctguc

SEQ ID NO: 43844 - DNA, 20 bp, Artificial Sequence
  Synthetic
cttctggucacgcaugcaac

SEQ ID NO: 43845 - DNA, 28 bp, Artificial Sequence
  Synthetic
ccatacatagtuccttctgttctucaca

SEQ ID NO: 43846 - DNA, 25 bp, Artificial Sequence
  Synthetic
ttcccugcaagacaacacattauga

SEQ ID NO: 43847 - DNA, 21 bp, Artificial Sequence
  Synthetic
gctgttgtgcutgtccccuag

SEQ ID NO: 43848 - DNA, 25 bp, Artificial Sequence
  Synthetic
gtgagaaccugcatttcuaacagac

SEQ ID NO: 43849 - DNA, 24 bp, Artificial Sequence
  Synthetic
ttttgttgacagcguctcggauat

SEQ ID NO: 43850 - DNA, 17 bp, Artificial Sequence
  Synthetic
gcaccagucgggtcuca

SEQ ID NO: 43851 - DNA, 17 bp, Artificial Sequence
  Synthetic
ctgggccutcugcagct

SEQ ID NO: 43852 - DNA, 25 bp, Artificial Sequence
  Synthetic
aaattatcuacccagcactgcagut

SEQ ID NO: 43853 - DNA, 17 bp, Artificial Sequence
  Synthetic
gtccgcautgccauccg

SEQ ID NO: 43854 - DNA, 23 bp, Artificial Sequence
  Synthetic
cgagctgaagutggtttgggaua

SEQ ID NO: 43855 - DNA, 26 bp, Artificial Sequence
  Synthetic
atcaaagtgattucagggatccucac

SEQ ID NO: 43856 - DNA, 21 bp, Artificial Sequence
  Synthetic
acgctgguagagaggcctaut

SEQ ID NO: 43857 - DNA, 24 bp, Artificial Sequence
  Synthetic
ccatatcacaagccuctgggttuc

SEQ ID NO: 43858 - DNA, 24 bp, Artificial Sequence
  Synthetic
autcagctgagugggaaaaaggaa

SEQ ID NO: 43859 - DNA, 22 bp, Artificial Sequence
  Synthetic
gcctttgaccgugacttttcug

SEQ ID NO: 43860 - DNA, 27 bp, Artificial Sequence
  Synthetic
tgcaatgaatgucaatggttgaauagc

SEQ ID NO: 43861 - DNA, 21 bp, Artificial Sequence
  Synthetic
gaggccagggcucaactuaat

SEQ ID NO: 43862 - DNA, 25 bp, Artificial Sequence
  Synthetic
gcgggaaucaggagttguaaaacat

SEQ ID NO: 43863 - DNA, 28 bp, Artificial Sequence
  Synthetic
ctatctgcaccutttgtaaagtctguct

SEQ ID NO: 43864 - DNA, 22 bp, Artificial Sequence
  Synthetic
cctgaucccagcaaatcugagt

SEQ ID NO: 43865 - DNA, 31 bp, Artificial Sequence; identical to SEQ ID NO: 31631
  Synthetic

SEQ ID NO: 43866 - DNA, 22 bp, Artificial Sequence
  Synthetic
cgaaguttgacugccaaccact

SEQ ID NO: 43867 - DNA, 27 bp, Artificial Sequence
  Synthetic
gggtcaaaatttaugagtcctgagugt

SEQ ID NO: 43868 - DNA, 27 bp, Artificial Sequence
  Synthetic
ctgtttattgtggucttccaggattug

SEQ ID NO: 43869 - DNA, 27 bp, Artificial Sequence
  Synthetic
tttttgatgccaauaggaatcugcaag

SEQ ID NO: 43870 - DNA, 23 bp, Artificial Sequence
  Synthetic
ctcccctcttucctcactctcua

SEQ ID NO: 43871 - DNA, 24 bp, Artificial Sequence
  Synthetic
ccuaacccccaaagcaaaauaagg

SEQ ID NO: 43872 - DNA, 31 bp, Artificial Sequence; identical to SEQ ID NO: 31638
  Synthetic

SEQ ID NO: 43873 - DNA, 27 bp, Artificial Sequence
  Synthetic
tgtataacataacugtgtggtgggtut

SEQ ID NO: 43874 - DNA, 24 bp, Artificial Sequence
  Synthetic
actactcacguttccatgttgucc

SEQ ID NO: 43875 - DNA, 24 bp, Artificial Sequence
  Synthetic
cagaagacuggagtggtcatuagt

SEQ ID NO: 43876 - DNA, 21 bp, Artificial Sequence
  Synthetic
cagcaacuggcacaggagaua

SEQ ID NO: 43877 - DNA, 23 bp, Artificial Sequence
  Synthetic
ctagacuggatgagacuggaacc

SEQ ID NO: 43878 - DNA, 28 bp, Artificial Sequence
  Synthetic
acugaagagctaataugagaaaacgaag

SEQ ID NO: 43879 - DNA, 28 bp, Artificial Sequence
  Synthetic
gcatgautctatccaaatuccaagacag

SEQ ID NO: 43880 - DNA, 26 bp, Artificial Sequence
  Synthetic
aatctgctgucaaataagaacaguct

SEQ ID NO: 43881 - DNA, 29 bp, Artificial Sequence
  Synthetic
ggtcagtaattgutttctgctttgatuct

SEQ ID NO: 43882 - DNA, 23 bp, Artificial Sequence
  Synthetic
acgttgaccaaautgttgtgcuc

SEQ ID NO: 43883 - DNA, 28 bp, Artificial Sequence
  Synthetic
ggacacugaaaggaaggttttautctut

SEQ ID NO: 43884 - DNA, 26 bp, Artificial Sequence
  Synthetic
gtcacctgucatttaactuggaggaa

SEQ ID NO: 43885 - DNA, 30 bp, Artificial Sequence; identical to SEQ ID NO: 31651
  Synthetic

SEQ ID NO: 43886 - DNA, 22 bp, Artificial Sequence
  Synthetic
gccaggcuaatgtcgcatttua

SEQ ID NO: 43887 - DNA, 27 bp, Artificial Sequence
  Synthetic
gaatttgacctccutgcctttctttut

SEQ ID NO: 43888 - DNA, 27 bp, Artificial Sequence
  Synthetic
aaaggacaacaaugtttacaatgugct

SEQ ID NO: 43889 - DNA, 27 bp, Artificial Sequence
  Synthetic
ccaatttgcutttgactatugcacaca

SEQ ID NO: 43890 - DNA, 21 bp, Artificial Sequence
  Synthetic
cctcttgaagutcccggaguc

SEQ ID NO: 43891 - DNA, 28 bp, Artificial Sequence
  Synthetic
gcctaaaacctugtcatattgccaatut

SEQ ID NO: 43892 - DNA, 24 bp, Artificial Sequence
  Synthetic
ctatgtgcutaacatgugcaaggc

SEQ ID NO: 43893 - DNA, 22 bp, Artificial Sequence
  Synthetic
acatggtacgcugctgttctut

SEQ ID NO: 43894 - DNA, 29 bp, Artificial Sequence
  Synthetic
aggaccttgguaagagttatgauaagagg

SEQ ID NO: 43895 - DNA, 27 bp, Artificial Sequence
  Synthetic
tgtaagcaaagutggcatttuaaagca

SEQ ID NO: 43896 - DNA, 23 bp, Artificial Sequence
  Synthetic
ccttggagtcutctaggagccut

SEQ ID NO: 43897 - DNA, 25 bp, Artificial Sequence
  Synthetic
catctgaacauttggtccttugcag

SEQ ID NO: 43898 - DNA, 26 bp, Artificial Sequence
  Synthetic
ctccaagaggcautgatattctcugt

SEQ ID NO: 43899 - DNA, 29 bp, Artificial Sequence
  Synthetic
gctgtttacgaaguattttaagacacucc

SEQ ID NO: 43900 - DNA, 26 bp, Artificial Sequence
  Synthetic
tccagccattgugttgaatccttuaa

SEQ ID NO: 43901 - DNA, 28 bp, Artificial Sequence
  Synthetic
atgtgagataacguttggaagttacaut

SEQ ID NO: 43902 - DNA, 23 bp, Artificial Sequence
  Synthetic
taagaactggugggaaatgguct

SEQ ID NO: 43903 - DNA, 20 bp, Artificial Sequence
  Synthetic
gcagattucaaccgggctug

SEQ ID NO: 43904 - DNA, 23 bp, Artificial Sequence
  Synthetic
gccaaagagaaugggatccagua

SEQ ID NO: 43905 - DNA, 30 bp, Artificial Sequence; identical to SEQ ID NO: 31671
  Synthetic

SEQ ID NO: 43906 - DNA, 29 bp, Artificial Sequence
  Synthetic
ccaaatgagaaaautcagtgatatugcca

SEQ ID NO: 43907 - DNA, 28 bp, Artificial Sequence
  Synthetic
tgaagacctugaagagcagttaaaucat

SEQ ID NO: 43908 - DNA, 25 bp, Artificial Sequence
  Synthetic
gcaacattuaacacatgugacggaa

SEQ ID NO: 43909 - DNA, 24 bp, Artificial Sequence
  Synthetic
acgttgttgcauttgtctgttuca

SEQ ID NO: 43910 - DNA, 28 bp, Artificial Sequence
  Synthetic
ttttcttttagtugctgctctttuccag

SEQ ID NO: 43911 - DNA, 28 bp, Artificial Sequence
  Synthetic
gtgtcccagttugcattaacaaatagut

SEQ ID NO: 43912 - DNA, 21 bp, Artificial Sequence
  Synthetic
cgcagautcaggctucccaat

SEQ ID NO: 43913 - DNA, 30 bp, Artificial Sequence; identical to SEQ ID NO: 31679
  Synthetic

SEQ ID NO: 43914 - DNA, 29 bp, Artificial Sequence
  Synthetic
ccatggaggguactgaaataaattcuaca

SEQ ID NO: 43915 - DNA, 27 bp, Artificial Sequence
  Synthetic
aggtcggatugacattattcauagcaa

SEQ ID NO: 43916 - DNA, 27 bp, Artificial Sequence
  Synthetic
agtcaattgttcuggcactatgaauga

SEQ ID NO: 43917 - DNA, 26 bp, Artificial Sequence
  Synthetic
ctcacaagcccuattagaaguggaac

SEQ ID NO: 43918 - DNA, 23 bp, Artificial Sequence
  Synthetic
gttgcaaacacauacgtgggtut

SEQ ID NO: 43919 - DNA, 20 bp, Artificial Sequence
  Synthetic
gaatgcagugcguaggcaag

SEQ ID NO: 43920 - DNA, 21 bp, Artificial Sequence
  Synthetic
cctttcatcuctgggcucagg

SEQ ID NO: 43921 - DNA, 26 bp, Artificial Sequence
  Synthetic
gcagccagaagugcactatacataua

SEQ ID NO: 43922 - DNA, 23 bp, Artificial Sequence
  Synthetic
cctccagtggutcaagcaattut

SEQ ID NO: 43923 - DNA, 28 bp, Artificial Sequence
  Synthetic
gattagttuagcaauaggaggttgaaua

SEQ ID NO: 43924 - DNA, 28 bp, Artificial Sequence
  Synthetic
aggacaaagatgautgaagtaactggug

SEQ ID NO: 43925 - DNA, 28 bp, Artificial Sequence
  Synthetic
tgccatggtaugtctctgtacaatuaag

SEQ ID NO: 43926 - DNA, 27 bp, Artificial Sequence
  Synthetic
gaggtgacagcuatccagttactatuc

SEQ ID NO: 43927 - DNA, 24 bp, Artificial Sequence
  Synthetic
aaggtcaaugctctcctttucaca

SEQ ID NO: 43928 - DNA, 28 bp, Artificial Sequence
  Synthetic
aggcaactucagaatccaaattacuagg

SEQ ID NO: 43929 - DNA, 28 bp, Artificial Sequence
  Synthetic
cutttcagguaacagaaagaaagcaaca

SEQ ID NO: 43930 - DNA, 20 bp, Artificial Sequence
  Synthetic
ccugcgtattugccaccaga

SEQ ID NO: 43931 - DNA, 25 bp, Artificial Sequence
  Synthetic
agtgccttttuacactgtcctuaca

SEQ ID NO: 43932 - DNA, 29 bp, Artificial Sequence
  Synthetic
aagttagaaacacugcaacattttgtuga

SEQ ID NO: 43933 - DNA, 24 bp, Artificial Sequence
  Synthetic
acttaauccaggagtcccucacat

SEQ ID NO: 43934 - DNA, 28 bp, Artificial Sequence
  Synthetic
tgatagcttttcugtaatcctgcugaac

SEQ ID NO: 43935 - DNA, 29 bp, Artificial Sequence
  Synthetic
cgtgatattgugattgattttcaugcaga

SEQ ID NO: 43936 - DNA, 26 bp, Artificial Sequence
  Synthetic
gctcattttatcugagaggcctguat

SEQ ID NO: 43937 - DNA, 22 bp, Artificial Sequence
  Synthetic
gautcgcatatuggcacagacc

SEQ ID NO: 43938 - DNA, 29 bp, Artificial Sequence
  Synthetic
ggatttgtctuctatttggtactugacct

SEQ ID NO: 43939 - DNA, 26 bp, Artificial Sequence
  Synthetic
ttctttcttaggaaguttgggcaugt

SEQ ID NO: 43940 - DNA, 22 bp, Artificial Sequence
  Synthetic
gtggagcutgagctaugacact

SEQ ID NO: 43941 - DNA, 29 bp, Artificial Sequence
  Synthetic
aactgggatgtugtgagaaagaaattaua

SEQ ID NO: 43942 - DNA, 31 bp, Artificial Sequence; identical to SEQ ID NO: 31708
  Synthetic

SEQ ID NO: 43943 - DNA, 28 bp, Artificial Sequence
  Synthetic
tgtttgtttgtttugtggaaggtctaug

SEQ ID NO: 43944 - DNA, 29 bp, Artificial Sequence
  Synthetic
tgagtgttaagttcuttgagttctgtcuc

SEQ ID NO: 43945 - DNA, 27 bp, Artificial Sequence
  Synthetic
gccatcagucccaattttacatttuct

SEQ ID NO: 43946 - DNA, 25 bp, Artificial Sequence
  Synthetic
ctgaaggucaaatgcttatguacct

SEQ ID NO: 43947 - DNA, 22 bp, Artificial Sequence
  Synthetic
aaatugagggacgcuggaagaa

SEQ ID NO: 43948 - DNA, 24 bp, Artificial Sequence
  Synthetic
gtgaatgcttgauaagcgtgctut

SEQ ID NO: 43949 - DNA, 22 bp, Artificial Sequence
  Synthetic
cgctaucaggagaccatgagug

SEQ ID NO: 43950 - DNA, 23 bp, Artificial Sequence
  Synthetic
agtaccutctggattuccccaca

SEQ ID NO: 43951 - DNA, 26 bp, Artificial Sequence
  Synthetic
aattcaaagcauagcccugaaagaga

SEQ ID NO: 43952 - DNA, 28 bp, Artificial Sequence
  Synthetic
cctattgatuatgctccaaauggaagga

SEQ ID NO: 43953 - DNA, 30 bp, Artificial Sequence; identical to SEQ ID NO: 31719
  Synthetic

SEQ ID NO: 43954 - DNA, 28 bp, Artificial Sequence
  Synthetic
acaagtgctugtctgatataatucagct

SEQ ID NO: 43955 - DNA, 27 bp, Artificial Sequence
  Synthetic
tgaattactcauctttgctctcaugct

SEQ ID NO: 43956 - DNA, 22 bp, Artificial Sequence
  Synthetic
gcugaagugaaaacaccaccaa

SEQ ID NO: 43957 - DNA, 23 bp, Artificial Sequence
  Synthetic
aagggaacagaucctgguaaagc

SEQ ID NO: 43958 - DNA, 27 bp, Artificial Sequence
  Synthetic
aatctggttgctucttttgtagggtua

SEQ ID NO: 43959 - DNA, 25 bp, Artificial Sequence
  Synthetic
gaauaagtcagugacccagaagacg

SEQ ID NO: 43960 - DNA, 30 bp, Artificial Sequence; identical to SEQ ID NO: 31726
  Synthetic

SEQ ID NO: 43961 - DNA, 28 bp, Artificial Sequence
  Synthetic
aattctttaatgtcutgcagtgccttut

SEQ ID NO: 43962 - DNA, 26 bp, Artificial Sequence
  Synthetic
ctgacctuaagttgttctuccaaagc

SEQ ID NO: 43963 - DNA, 28 bp, Artificial Sequence
  Synthetic
gagagcaaatcauttcaacacacatgua

SEQ ID NO: 43964 - DNA, 27 bp, Artificial Sequence
  Synthetic
acaaactgagaaucgtaactuaaccat

SEQ ID NO: 43965 - DNA, 29 bp, Artificial Sequence
  Synthetic
tgaagtacaagagcagaugaatctccuaa

SEQ ID NO: 43966 - DNA, 25 bp, Artificial Sequence
  Synthetic
tgaggaaaaaggaugacttgccaut

SEQ ID NO: 43967 - DNA, 29 bp, Artificial Sequence
  Synthetic
cagctttagaagaaguattatcgtggcut

SEQ ID NO: 43968 - DNA, 25 bp, Artificial Sequence
  Synthetic
cttggaagcagutctctggtttgua

SEQ ID NO: 43969 - DNA, 24 bp, Artificial Sequence
  Synthetic
tggtttttcccccucctctctauc

SEQ ID NO: 43970 - DNA, 28 bp, Artificial Sequence
  Synthetic
ctgttgagaatagugcatttgatgaugt

SEQ ID NO: 43971 - DNA, 30 bp, Artificial Sequence; identical to SEQ ID NO: 31737
  Synthetic

SEQ ID NO: 43972 - DNA, 24 bp, Artificial Sequence
  Synthetic
aaagtaggacaugatcuggaacca

SEQ ID NO: 43973 - DNA, 30 bp, Artificial Sequence; identical to SEQ ID NO: 31739
  Synthetic

SEQ ID NO: 43974 - DNA, 24 bp, Artificial Sequence
  Synthetic
ccucacaacaaaagucccaattua

SEQ ID NO: 43975 - DNA, 23 bp, Artificial Sequence
  Synthetic
cagccuccgcagaatttgaaaug

SEQ ID NO: 43976 - DNA, 29 bp, Artificial Sequence
  Synthetic
caatctacctaautagtgagcttgucaca

SEQ ID NO: 43977 - DNA, 28 bp, Artificial Sequence
  Synthetic
cctacuggagcaataaagttugaagaac

SEQ ID NO: 43978 - DNA, 27 bp, Artificial Sequence
  Synthetic
tcatggccagcutctaattgtattugt

SEQ ID NO: 43979 - DNA, 24 bp, Artificial Sequence
  Synthetic
gggagctgutggaattcaaauaga

SEQ ID NO: 43980 - DNA, 31 bp, Artificial Sequence; identical to SEQ ID NO: 31746
  Synthetic

SEQ ID NO: 43981 - DNA, 28 bp, Artificial Sequence
  Synthetic
gaaagaggcctuactgcagaatatagut

SEQ ID NO: 43982 - DNA, 21 bp, Artificial Sequence
  Synthetic
ggccgtgaccutctcactcua

SEQ ID NO: 43983 - DNA, 23 bp, Artificial Sequence
  Synthetic
ttctttgggaaggcugccttuaa

SEQ ID NO: 43984 - DNA, 28 bp, Artificial Sequence
  Synthetic
attttgactttucagttgagatgaugcc

SEQ ID NO: 43985 - DNA, 28 bp, Artificial Sequence
  Synthetic
ttcugaaatcagcttuggagagaagaaa

SEQ ID NO: 43986 - DNA, 24 bp, Artificial Sequence
  Synthetic
gatttggacacccuggcuaaagaa

SEQ ID NO: 43987 - DNA, 26 bp, Artificial Sequence
  Synthetic
actgtttcacutaaagcaagucagga

SEQ ID NO: 43988 - DNA, 25 bp, Artificial Sequence
  Synthetic
ggaaggagacgcgauatugaaaaga

SEQ ID NO: 43989 - DNA, 28 bp, Artificial Sequence
  Synthetic
tgggacaguaaaaggcaataatagctut

SEQ ID NO: 43990 - DNA, 27 bp, Artificial Sequence
  Synthetic
ctgaagaaaacaaauatgacugccaca

SEQ ID NO: 43991 - DNA, 26 bp, Artificial Sequence
  Synthetic
tcctccattccutgtttcttgctuac

SEQ ID NO: 43992 - DNA, 22 bp, Artificial Sequence
  Synthetic
cctcagcuccagaagccuaaat

SEQ ID NO: 43993 - DNA, 26 bp, Artificial Sequence
  Synthetic
caaagttaagcacguattacagugca

SEQ ID NO: 43994 - DNA, 22 bp, Artificial Sequence
  Synthetic
tctaggaagugcctgagcuagt

SEQ ID NO: 43995 - DNA, 21 bp, Artificial Sequence
  Synthetic
ggcggcuacacgactttcaut

SEQ ID NO: 43996 - DNA, 22 bp, Artificial Sequence
  Synthetic
cgguagcaggacaacagttuct

SEQ ID NO: 43997 - DNA, 24 bp, Artificial Sequence
  Synthetic
gctaatgtgcacutgcaatctcug

SEQ ID NO: 43998 - DNA, 30 bp, Artificial Sequence; identical to SEQ ID NO: 31764
  Synthetic

SEQ ID NO: 43999 - DNA, 26 bp, Artificial Sequence
  Synthetic
ttgagctctucggtagtaggtauagg

SEQ ID NO: 44000 - DNA, 28 bp, Artificial Sequence
  Synthetic
gctgttgutgcattttauacagagaaat

SEQ ID NO: 44001 - DNA, 24 bp, Artificial Sequence
  Synthetic
gaaaaaccctutgagcatccucag

SEQ ID NO: 44002 - DNA, 25 bp, Artificial Sequence
  Synthetic
caaagaagatgcuggagattctuca

SEQ ID NO: 44003 - DNA, 28 bp, Artificial Sequence
  Synthetic
ttggtcccatugaatatctcgttuacaa

SEQ ID NO: 44004 - DNA, 26 bp, Artificial Sequence
  Synthetic
gctttggcattcugaagtacttggua

SEQ ID NO: 44005 - DNA, 30 bp, Artificial Sequence; identical to SEQ ID NO: 31771
  Synthetic

SEQ ID NO: 44006 - DNA, 23 bp, Artificial Sequence
  Synthetic
ggttcttcugtcagaggatuggg

SEQ ID NO: 44007 - DNA, 21 bp, Artificial Sequence
  Synthetic
cagccagacuacagugaacga

SEQ ID NO: 44008 - DNA, 22 bp, Artificial Sequence
  Synthetic
caggcagtuggcagttgauaga

SEQ ID NO: 44009 - DNA, 26 bp, Artificial Sequence
  Synthetic
gacaacugggagaagggtgauaaaaa

SEQ ID NO: 44010 - DNA, 20 bp, Artificial Sequence
  Synthetic
gtgttgggcucatggatugg

SEQ ID NO: 44011 - DNA, 24 bp, Artificial Sequence
  Synthetic
tttccctcaucctctttctccuca

SEQ ID NO: 44012 - DNA, 22 bp, Artificial Sequence
  Synthetic
tcttttctgcccaugtacccut

SEQ ID NO: 44013 - DNA, 26 bp, Artificial Sequence
  Synthetic
aaaaaggagauccacctcuaccaaac

SEQ ID NO: 44014 - DNA, 22 bp, Artificial Sequence
  Synthetic
gatccaacccaccucttctuca

SEQ ID NO: 44015 - DNA, 25 bp, Artificial Sequence
  Synthetic
tgccttcatttuctccccaatcuag

SEQ ID NO: 44016 - DNA, 17 bp, Artificial Sequence
  Synthetic
cgatggtucccggcgua

SEQ ID NO: 44017 - DNA, 21 bp, Artificial Sequence
  Synthetic
cguagctcaagaucccgaagg

SEQ ID NO: 44018 - DNA, 22 bp, Artificial Sequence
  Synthetic
aaacaacuaaacgccgcttucc

SEQ ID NO: 44019 - DNA, 22 bp, Artificial Sequence
  Synthetic
tcttccagccutttcctucagc

SEQ ID NO: 44020 - DNA, 23 bp, Artificial Sequence
  Synthetic
ggataacttcuggctggtgacug

SEQ ID NO: 44021 - DNA, 22 bp, Artificial Sequence
  Synthetic
gagctgacacccaugtagctua

SEQ ID NO: 44022 - DNA, 23 bp, Artificial Sequence
  Synthetic
gcacccagccaguagaaggauat

SEQ ID NO: 44023 - DNA, 23 bp, Artificial Sequence
  Synthetic
cggattgccaccuctacatcaug

SEQ ID NO: 44024 - DNA, 21 bp, Artificial Sequence
  Synthetic
gccccagtugtggttctctuc

SEQ ID NO: 44025 - DNA, 25 bp, Artificial Sequence
  Synthetic
ccagtaccaaaautccaagcctuac

SEQ ID NO: 44026 - DNA, 22 bp, Artificial Sequence
  Synthetic
gatggtgugagcagtcacucat

SEQ ID NO: 44027 - DNA, 24 bp, Artificial Sequence
  Synthetic
gctatctcucaatgcttcctuggg

SEQ ID NO: 44028 - DNA, 23 bp, Artificial Sequence
  Synthetic
ggctctggccutttatatgccut

SEQ ID NO: 44029 - DNA, 28 bp, Artificial Sequence
  Synthetic
ctatccccatccuttcctcaaacataut

SEQ ID NO: 44030 - DNA, 23 bp, Artificial Sequence
  Synthetic
ccctacctuactcctccttcuct

SEQ ID NO: 44031 - DNA, 27 bp, Artificial Sequence
  Synthetic
cttgttctcttauctctgccctcuaac

SEQ ID NO: 44032 - DNA, 29 bp, Artificial Sequence
  Synthetic
tgatcactcttatuattgccttaggtgug

SEQ ID NO: 44033 - DNA, 25 bp, Artificial Sequence
  Synthetic
tgtgggagaaaacaucatgucgaat

SEQ ID NO: 44034 - DNA, 23 bp, Artificial Sequence
  Synthetic
caatctggucttctctcuccact

SEQ ID NO: 44035 - DNA, 22 bp, Artificial Sequence
  Synthetic
gccacgcucaggattgaactua

SEQ ID NO: 44036 - DNA, 23 bp, Artificial Sequence
  Synthetic
cagatgucgagaaggaggugaag

SEQ ID NO: 44037 - DNA, 22 bp, Artificial Sequence
  Synthetic
cacatccucagaacagcuccaa

SEQ ID NO: 44038 - DNA, 22 bp, Artificial Sequence
  Synthetic
agtcatgucccaatgtcctguc

SEQ ID NO: 44039 - DNA, 24 bp, Artificial Sequence
  Synthetic
aatatguacagggaggtgcuaggt

SEQ ID NO: 44040 - DNA, 21 bp, Artificial Sequence
  Synthetic
tctcacucccactgccctuat

SEQ ID NO: 44041 - DNA, 23 bp, Artificial Sequence
  Synthetic
ctatatggcaugaactccugcct

SEQ ID NO: 44042 - DNA, 23 bp, Artificial Sequence
  Synthetic
ccagaggcutgaatctgttugga

SEQ ID NO: 44043 - DNA, 24 bp, Artificial Sequence
  Synthetic
ccccttacctuccacctctctuac

SEQ ID NO: 44044 - DNA, 25 bp, Artificial Sequence
  Synthetic
ctaggcaagagucttagugagaacc

SEQ ID NO: 44045 - DNA, 21 bp, Artificial Sequence
  Synthetic
ggttgtaguacctcccgggua

SEQ ID NO: 44046 - DNA, 22 bp, Artificial Sequence
  Synthetic
ctccacacugagtcatggtguc

SEQ ID NO: 44047 - DNA, 27 bp, Artificial Sequence
  Synthetic
tccagtgtgtautgaaatttgagguct

SEQ ID NO: 44048 - DNA, 22 bp, Artificial Sequence
  Synthetic
ctgcctccguggattctactut

SEQ ID NO: 44049 - DNA, 23 bp, Artificial Sequence
  Synthetic
cuatacacacttcuggcaccact

SEQ ID NO: 44050 - DNA, 30 bp, Artificial Sequence; identical to SEQ ID NO: 31816
  Synthetic

SEQ ID NO: 44051 - DNA, 22 bp, Artificial Sequence
  Synthetic
tcattguccagcagtcgatgug

SEQ ID NO: 44052 - DNA, 24 bp, Artificial Sequence
  Synthetic
gtgattcaatgutgcaggagauca

SEQ ID NO: 44053 - DNA, 21 bp, Artificial Sequence
  Synthetic
acacatggagcugaacgugag

SEQ ID NO: 44054 - DNA, 22 bp, Artificial Sequence
  Synthetic
ccctgtgucctctgtctgtuct

SEQ ID NO: 44055 - DNA, 23 bp, Artificial Sequence
  Synthetic
caatcttgguccactcccuaagc

SEQ ID NO: 44056 - DNA, 25 bp, Artificial Sequence
  Synthetic
ctgataaacatautggctgctgugg

SEQ ID NO: 44057 - DNA, 21 bp, Artificial Sequence
  Synthetic
ttttgcacuccgcattuccag

SEQ ID NO: 44058 - DNA, 29 bp, Artificial Sequence
  Synthetic
atcttcacctctutcttctttggtttuct

SEQ ID NO: 44059 - DNA, 23 bp, Artificial Sequence
  Synthetic
gattccaguaaccgcaaacctug

SEQ ID NO: 44060 - DNA, 25 bp, Artificial Sequence
  Synthetic
ctacaaatgctugcagtcttctgut

SEQ ID NO: 44061 - DNA, 20 bp, Artificial Sequence
  Synthetic
tgugtgguagagcagcaacc

SEQ ID NO: 44062 - DNA, 21 bp, Artificial Sequence
  Synthetic
cctgctccuaccctgcuagag

SEQ ID NO: 44063 - DNA, 22 bp, Artificial Sequence
  Synthetic
cgtcatgaagugagaggctgug

SEQ ID NO: 44064 - DNA, 23 bp, Artificial Sequence
  Synthetic
tgaggagcuatggatgucaagga

SEQ ID NO: 44065 - DNA, 22 bp, Artificial Sequence
  Synthetic
tgccgguacacagaggtctuat

SEQ ID NO: 44066 - DNA, 22 bp, Artificial Sequence
  Synthetic
cacutgggatctucacaaggac

SEQ ID NO: 44067 - DNA, 23 bp, Artificial Sequence
  Synthetic
agtctcacaaucccaggctctua

SEQ ID NO: 44068 - DNA, 25 bp, Artificial Sequence
  Synthetic
cacccttcuaccaatcctactctug

SEQ ID NO: 44069 - DNA, 25 bp, Artificial Sequence
  Synthetic
caaatgctcccutatacctcugcat

SEQ ID NO: 44070 - DNA, 29 bp, Artificial Sequence
  Synthetic
catgataagtaccaugactccaatgagug

SEQ ID NO: 44071 - DNA, 23 bp, Artificial Sequence
  Synthetic
ccagatgaaaucccagtgcctua

SEQ ID NO: 44072 - DNA, 23 bp, Artificial Sequence
  Synthetic
ggatugggaaaggaggtugaaga

SEQ ID NO: 44073 - DNA, 23 bp, Artificial Sequence
  Synthetic
ccgcccccuaaatttattccaug

SEQ ID NO: 44074 - DNA, 26 bp, Artificial Sequence
  Synthetic
agtaccaacatauttggacgctacug

SEQ ID NO: 44075 - DNA, 21 bp, Artificial Sequence
  Synthetic
caacagcucaatgccucacat

SEQ ID NO: 44076 - DNA, 22 bp, Artificial Sequence
  Synthetic
ccaucatgucagacacggacag

SEQ ID NO: 44077 - DNA, 21 bp, Artificial Sequence
  Synthetic
gcacctccutcctctgctuag

SEQ ID NO: 44078 - DNA, 24 bp, Artificial Sequence
  Synthetic
tgggaattauctgagggagugagg

SEQ ID NO: 44079 - DNA, 26 bp, Artificial Sequence
  Synthetic
gttcaagccaauacaccaaagaauca

SEQ ID NO: 44080 - DNA, 22 bp, Artificial Sequence
  Synthetic
tggcatugagccatgtgtauag

SEQ ID NO: 44081 - DNA, 24 bp, Artificial Sequence
  Synthetic
agtcagaggaacuactgaagucca

SEQ ID NO: 44082 - DNA, 23 bp, Artificial Sequence
  Synthetic
gctgctgtttucccatctgacut

SEQ ID NO: 44083 - DNA, 23 bp, Artificial Sequence
  Synthetic
gattctacugagcactccaccuc

SEQ ID NO: 44084 - DNA, 24 bp, Artificial Sequence
  Synthetic
tttctctaagutcccctccugact

SEQ ID NO: 44085 - DNA, 31 bp, Artificial Sequence; identical to SEQ ID NO: 31851
  Synthetic

SEQ ID NO: 44086 - DNA, 28 bp, Artificial Sequence
  Synthetic
ctttaatguggaatttggaguggaaacc

SEQ ID NO: 44087 - DNA, 23 bp, Artificial Sequence
  Synthetic
gatatcaucctcccaaugcagct

SEQ ID NO: 44088 - DNA, 30 bp, Artificial Sequence; identical to SEQ ID NO: 31854
  Synthetic

SEQ ID NO: 44089 - DNA, 28 bp, Artificial Sequence
  Synthetic
gtccatataccagaucctcattgucaat

SEQ ID NO: 44090 - DNA, 24 bp, Artificial Sequence
  Synthetic
aggaaaggugaatctucagggaga

SEQ ID NO: 44091 - DNA, 28 bp, Artificial Sequence
  Synthetic
cuttctttgttcttcuaaacaccaagcc

SEQ ID NO: 44092 - DNA, 21 bp, Artificial Sequence
  Synthetic
ggagaaccccauggctttgut

SEQ ID NO: 44093 - DNA, 21 bp, Artificial Sequence
  Synthetic
tggaacugccggagtttgaug

SEQ ID NO: 44094 - DNA, 27 bp, Artificial Sequence
  Synthetic
tgtttttggtgugtttgtctcagatug

SEQ ID NO: 44095 - DNA, 23 bp, Artificial Sequence
  Synthetic
agatcaccauctttgcctgugag

SEQ ID NO: 44096 - DNA, 27 bp, Artificial Sequence
  Synthetic
ctaaataactgggucttctgtgtucct

SEQ ID NO: 44097 - DNA, 31 bp, Artificial Sequence; identical to SEQ ID NO: 31863
  Synthetic

SEQ ID NO: 44098 - DNA, 31 bp, Artificial Sequence; identical to SEQ ID NO: 31864
  Synthetic

SEQ ID NO: 44099 - DNA, 21 bp, Artificial Sequence
  Synthetic
acaacccaaucccctcccuat

SEQ ID NO: 44100 - DNA, 26 bp, Artificial Sequence
  Synthetic
ttgctgtcaataaauatcagggccut

SEQ ID NO: 44101 - DNA, 24 bp, Artificial Sequence
  Synthetic
tggtgtcuaagaggaaggtgtuca

SEQ ID NO: 44102 - DNA, 23 bp, Artificial Sequence
  Synthetic
caagtgtctgcuagaggtgacug

SEQ ID NO: 44103 - DNA, 28 bp, Artificial Sequence
  Synthetic
gcatctaagtcautctgctacctuaact

SEQ ID NO: 44104 - DNA, 25 bp, Artificial Sequence
  Synthetic
tttgtgtgtggcuatttgtctcgua

SEQ ID NO: 44105 - DNA, 23 bp, Artificial Sequence
  Synthetic
cctctttguaacgctcttgaugc

SEQ ID NO: 44106 - DNA, 28 bp, Artificial Sequence
  Synthetic
gtatgcctttutaaggttgattucccaa

SEQ ID NO: 44107 - DNA, 28 bp, Artificial Sequence
  Synthetic
catgttctcaaugttctttcccattuct

SEQ ID NO: 44108 - DNA, 25 bp, Artificial Sequence
  Synthetic
gtggcatgtugaactttgatagcuc

SEQ ID NO: 44109 - DNA, 23 bp, Artificial Sequence
  Synthetic
cagtggcagaagagutaaggcua

SEQ ID NO: 44110 - DNA, 23 bp, Artificial Sequence
  Synthetic
tttttcttccuctgctgcucaca

SEQ ID NO: 44111 - DNA, 29 bp, Artificial Sequence
  Synthetic
cgttagctgtaaucacaccacattauact

SEQ ID NO: 44112 - DNA, 25 bp, Artificial Sequence
  Synthetic
gactaacaaattcugccccctcuat

SEQ ID NO: 44113 - DNA, 24 bp, Artificial Sequence
  Synthetic
cacttcctgccuggtatctctuac

SEQ ID NO: 44114 - DNA, 25 bp, Artificial Sequence
  Synthetic
tttttggtcugaggaagcattcuga

SEQ ID NO: 44115 - DNA, 29 bp, Artificial Sequence
  Synthetic
gccttgacauccctactatagatauccaa

SEQ ID NO: 44116 - DNA, 26 bp, Artificial Sequence
  Synthetic
cagtcaaugcaaaggttguaaaggac

SEQ ID NO: 44117 - DNA, 27 bp, Artificial Sequence
  Synthetic
tgcaatcacggaacauttgattctuac

SEQ ID NO: 44118 - DNA, 24 bp, Artificial Sequence
  Synthetic
cccggcaaautgtccttaacttut

SEQ ID NO: 44119 - DNA, 25 bp, Artificial Sequence
  Synthetic
agtattuggcacagagacagctuac

SEQ ID NO: 44120 - DNA, 23 bp, Artificial Sequence
  Synthetic
gaccatacguaaggtgagugagt

SEQ ID NO: 44121 - DNA, 31 bp, Artificial Sequence; identical to SEQ ID NO: 31887
  Synthetic

SEQ ID NO: 44122 - DNA, 32 bp, Artificial Sequence; identical to SEQ ID NO: 31888
  Synthetic

SEQ ID NO: 44123 - DNA, 24 bp, Artificial Sequence
  Synthetic
ccaggcttuctaattctgctucct

SEQ ID NO: 44124 - DNA, 28 bp, Artificial Sequence
  Synthetic
tccctttcctagauagaagctaagtugt

SEQ ID NO: 44125 - DNA, 31 bp, Artificial Sequence; identical to SEQ ID NO: 31891
  Synthetic

SEQ ID NO: 44126 - DNA, 26 bp, Artificial Sequence
  Synthetic
agatgtgugagagttactagttuggg

SEQ ID NO: 44127 - DNA, 28 bp, Artificial Sequence
  Synthetic
gacatcatgctutcttcattttccaugt

SEQ ID NO: 44128 - DNA, 23 bp, Artificial Sequence
  Synthetic
gatccttuggtggcacugagaat

SEQ ID NO: 44129 - DNA, 20 bp, Artificial Sequence
  Synthetic
tggaccuggcttaguacgct

SEQ ID NO: 44130 - DNA, 26 bp, Artificial Sequence
  Synthetic
caataatttctuggcctttgcucaga

SEQ ID NO: 44131 - DNA, 28 bp, Artificial Sequence
  Synthetic
tctagatgtcauggatgaagaatccuga

SEQ ID NO: 44132 - DNA, 22 bp, Artificial Sequence
  Synthetic
tgtgcagcuatcagtcttuggt

SEQ ID NO: 44133 - DNA, 22 bp, Artificial Sequence
  Synthetic
gtgagacugctgaacacatugc

SEQ ID NO: 44134 - DNA, 22 bp, Artificial Sequence
  Synthetic
tctctgtggaggutgcaaagug

SEQ ID NO: 44135 - DNA, 22 bp, Artificial Sequence
  Synthetic
gcaacaagucctgaatccctug

SEQ ID NO: 44136 - DNA, 30 bp, Artificial Sequence; identical to SEQ ID NO: 31902
  Synthetic

SEQ ID NO: 44137 - DNA, 24 bp, Artificial Sequence
  Synthetic
tcatcactgaguacatggccaaug

SEQ ID NO: 44138 - DNA, 28 bp, Artificial Sequence
  Synthetic
cctctcttacugtaagtcatcttuaagc

SEQ ID NO: 44139 - DNA, 23 bp, Artificial Sequence
  Synthetic
acgtggccaucaagatgaucaaa

SEQ ID NO: 44140 - DNA, 22 bp, Artificial Sequence
  Synthetic
gcagaacagugtaccucaagga

SEQ ID NO: 44141 - DNA, 24 bp, Artificial Sequence
  Synthetic
gcatgaccuctctctctgttucag

SEQ ID NO: 44142 - DNA, 21 bp, Artificial Sequence
  Synthetic
ggcacagcaucaaggagcuat

SEQ ID NO: 44143 - DNA, 26 bp, Artificial Sequence
  Synthetic
agacagcttcuttttcgttgttucag

SEQ ID NO: 44144 - DNA, 23 bp, Artificial Sequence
  Synthetic
gagagagagagutcctccuggaa

SEQ ID NO: 44145 - DNA, 24 bp, Artificial Sequence
  Synthetic
gtgggcataugaatctgtctccug

SEQ ID NO: 44146 - DNA, 30 bp, Artificial Sequence; identical to SEQ ID NO: 31912
  Synthetic

SEQ ID NO: 44147 - DNA, 27 bp, Artificial Sequence
  Synthetic
aaaccctcctaccutttctcctaacua

SEQ ID NO: 44148 - DNA, 21 bp, Artificial Sequence
  Synthetic
acagacccutgggagagugat

SEQ ID NO: 44149 - DNA, 26 bp, Artificial Sequence
  Synthetic
tgatctctctcutctttcctgcuaca

SEQ ID NO: 44150 - DNA, 21 bp, Artificial Sequence
  Synthetic
cccaccaccccutctaatugt

SEQ ID NO: 44151 - DNA, 28 bp, Artificial Sequence
  Synthetic
agcaatgcaucaaccaataaccatttut

SEQ ID NO: 44152 - DNA, 22 bp, Artificial Sequence
  Synthetic
ccccucctccuaccaacgaaaa

SEQ ID NO: 44153 - DNA, 25 bp, Artificial Sequence
  Synthetic
ctaaactucaagaagcgcctgttuc

SEQ ID NO: 44154 - DNA, 27 bp, Artificial Sequence
  Synthetic
gccttgagcutttaaagtgaauggaga

SEQ ID NO: 44155 - DNA, 23 bp, Artificial Sequence
  Synthetic
tgtaatccugcctgcttcaucac

SEQ ID NO: 44156 - DNA, 26 bp, Artificial Sequence
  Synthetic
gauagtaacaucaagagcaagggaaa

SEQ ID NO: 44157 - DNA, 25 bp, Artificial Sequence
  Synthetic
caaagctcuccttcaggauaaggac

SEQ ID NO: 44158 - DNA, 23 bp, Artificial Sequence
  Synthetic
tcctcccaggaacuttacctgua

SEQ ID NO: 44159 - DNA, 26 bp, Artificial Sequence
  Synthetic
tcttggacuggacatctttuaaccag

SEQ ID NO: 44160 - DNA, 25 bp, Artificial Sequence
  Synthetic
tttgaaggagaccutggtttcctut

SEQ ID NO: 44161 - DNA, 23 bp, Artificial Sequence
  Synthetic
ccccagcuggaaattcatttcut

SEQ ID NO: 44162 - DNA, 22 bp, Artificial Sequence
  Synthetic
agcagatcuactccccagucag

SEQ ID NO: 44163 - DNA, 26 bp, Artificial Sequence
  Synthetic
tgtgcttctacaauggtgactcttut

SEQ ID NO: 44164 - DNA, 21 bp, Artificial Sequence
  Synthetic
gggagccauccaacagtcauc

SEQ ID NO: 44165 - DNA, 28 bp, Artificial Sequence
  Synthetic
gcctaataaaugggaggtacctaagugt

SEQ ID NO: 44166 - DNA, 20 bp, Artificial Sequence
  Synthetic
cgcagcccagaugtagtuct

SEQ ID NO: 44167 - DNA, 21 bp, Artificial Sequence
  Synthetic
gagggugattggtuagcggaa

SEQ ID NO: 44168 - DNA, 25 bp, Artificial Sequence
  Synthetic
cttggatttguactctggactcuga

SEQ ID NO: 44169 - DNA, 25 bp, Artificial Sequence
  Synthetic
aaacuaaagcagacatuccagagct

SEQ ID NO: 44170 - DNA, 24 bp, Artificial Sequence
  Synthetic
gtcctccauaaatgaagucagcgt

SEQ ID NO: 44171 - DNA, 26 bp, Artificial Sequence
  Synthetic
tctactaagctguctgtgtcctttug

SEQ ID NO: 44172 - DNA, 21 bp, Artificial Sequence
  Synthetic
tggaggaagaguccgucaaca

SEQ ID NO: 44173 - DNA, 22 bp, Artificial Sequence
  Synthetic
cccactctuttgagcaagucct

SEQ ID NO: 44174 - DNA, 22 bp, Artificial Sequence
  Synthetic
gggctttcauattggcagaugt

SEQ ID NO: 44175 - DNA, 31 bp, Artificial Sequence; identical to SEQ ID NO: 31941
  Synthetic

SEQ ID NO: 44176 - DNA, 24 bp, Artificial Sequence
  Synthetic
gtgtaaatguaacgcactcccuga

SEQ ID NO: 44177 - DNA, 23 bp, Artificial Sequence
  Synthetic
acugtagcttcuaccgaaccaga

SEQ ID NO: 44178 - DNA, 24 bp, Artificial Sequence
  Synthetic
gggttgggaguaagagauagagag

SEQ ID NO: 44179 - DNA, 23 bp, Artificial Sequence
  Synthetic
actgttagtcaugtgggcatgug

SEQ ID NO: 44180 - DNA, 25 bp, Artificial Sequence
  Synthetic
gaagcagtcuttgcatttcaguaca

SEQ ID NO: 44181 - DNA, 26 bp, Artificial Sequence
  Synthetic
ccccagcttauttcttatgaatgucg

SEQ ID NO: 44182 - DNA, 20 bp, Artificial Sequence
  Synthetic
gcugttccucaaacgacacg

SEQ ID NO: 44183 - DNA, 19 bp, Artificial Sequence
  Synthetic
cccttctcuccggcggaua

SEQ ID NO: 44184 - DNA, 30 bp, Artificial Sequence; identical to SEQ ID NO: 31950
  Synthetic

SEQ ID NO: 44185 - DNA, 28 bp, Artificial Sequence
  Synthetic
aaagctagtaccutgaacacatcugaag

SEQ ID NO: 44186 - DNA, 24 bp, Artificial Sequence
  Synthetic
gatctggaccutcttctgtuaacc

SEQ ID NO: 44187 - DNA, 26 bp, Artificial Sequence
  Synthetic
ggaacttcaaacagugttcctcauca

SEQ ID NO: 44188 - DNA, 26 bp, Artificial Sequence
  Synthetic
ccctgcauataaggaatgtugaaaga

SEQ ID NO: 44189 - DNA, 28 bp, Artificial Sequence
  Synthetic
caacaaggaaaucaggaacuttttagua

SEQ ID NO: 44190 - DNA, 29 bp, Artificial Sequence
  Synthetic
tcagtgaataaaaugtaagtcccatguga

SEQ ID NO: 44191 - DNA, 24 bp, Artificial Sequence
  Synthetic
tgccaggauatgtttgaugagacc

SEQ ID NO: 44192 - DNA, 25 bp, Artificial Sequence
  Synthetic
tgaacauacctttgtauggaagcga

SEQ ID NO: 44193 - DNA, 26 bp, Artificial Sequence
  Synthetic
ccaaaaggaaautccagaagtgtuct

SEQ ID NO: 44194 - DNA, 25 bp, Artificial Sequence
  Synthetic
attaaccutttgtaacuccccggaa

SEQ ID NO: 44195 - DNA, 29 bp, Artificial Sequence
  Synthetic
caagcaactgaacuttacatgaacaugaa

SEQ ID NO: 44196 - DNA, 27 bp, Artificial Sequence
  Synthetic
ctgugagatttgtattucacaacacca

SEQ ID NO: 44197 - DNA, 25 bp, Artificial Sequence
  Synthetic
ggctacaggugagttaaccactuac

SEQ ID NO: 44198 - DNA, 31 bp, Artificial Sequence; identical to SEQ ID NO: 31964
  Synthetic

SEQ ID NO: 44199 - DNA, 25 bp, Artificial Sequence
  Synthetic
gatcaagcctuaaccttctctguga

SEQ ID NO: 44200 - DNA, 26 bp, Artificial Sequence
  Synthetic
accgaautcttuggagaggaacaaat

SEQ ID NO: 44201 - DNA, 29 bp, Artificial Sequence
  Synthetic
gctgaattactgauctgttctgagtcuaa

SEQ ID NO: 44202 - DNA, 24 bp, Artificial Sequence
  Synthetic
gatgcatgttugtgtctgtctgut

SEQ ID NO: 44203 - DNA, 27 bp, Artificial Sequence
  Synthetic
cagagacaatgguaaagggaaaacuca

SEQ ID NO: 44204 - DNA, 24 bp, Artificial Sequence
  Synthetic
tcagcaaagacuctgtaaccaucc

SEQ ID NO: 44205 - DNA, 27 bp, Artificial Sequence
  Synthetic
aggtttatgtctugggacagttctuac

SEQ ID NO: 44206 - DNA, 22 bp, Artificial Sequence
  Synthetic
gcttcctgcugctcttctgauc

SEQ ID NO: 44207 - DNA, 23 bp, Artificial Sequence
  Synthetic
gcttctuaagctttggucgcaaa

SEQ ID NO: 44208 - DNA, 26 bp, Artificial Sequence
  Synthetic
cagcagctguaagttcctcttactut

SEQ ID NO: 44209 - DNA, 22 bp, Artificial Sequence
  Synthetic
cgtgttgcaugaagcactctua

SEQ ID NO: 44210 - DNA, 21 bp, Artificial Sequence
  Synthetic
gctugggagcgaagaagacua

SEQ ID NO: 44211 - DNA, 29 bp, Artificial Sequence
  Synthetic
ctttggctuggcaatataagtcuaaaagt

SEQ ID NO: 44212 - DNA, 24 bp, Artificial Sequence
  Synthetic
gutccctttaucgaggaagaccac

SEQ ID NO: 44213 - DNA, 24 bp, Artificial Sequence
  Synthetic
aggacaacgagauaagcaccttuc

SEQ ID NO: 44214 - DNA, 23 bp, Artificial Sequence
  Synthetic
cctcctcctcuctctcggttaut

SEQ ID NO: 44215 - DNA, 28 bp, Artificial Sequence
  Synthetic
tgacaaacctttuctttaccttcaccut

SEQ ID NO: 44216 - DNA, 21 bp, Artificial Sequence
  Synthetic
ccagcaaagggugtcgtttuc

SEQ ID NO: 44217 - DNA, 27 bp, Artificial Sequence
  Synthetic
gcctttctgucatgctgauaaggaaat

SEQ ID NO: 44218 - DNA, 28 bp, Artificial Sequence
  Synthetic
gctggataagguttcttcatgttcuaca

SEQ ID NO: 44219 - DNA, 25 bp, Artificial Sequence
  Synthetic
gggaagaaatugaagtgccttucag

SEQ ID NO: 44220 - DNA, 25 bp, Artificial Sequence
  Synthetic
acaagttctucaagggacagaaugt

SEQ ID NO: 44221 - DNA, 26 bp, Artificial Sequence
  Synthetic
aggctctgaaucttggaattgaagug

SEQ ID NO: 44222 - DNA, 22 bp, Artificial Sequence
  Synthetic
cctgggttcautagctggguat

SEQ ID NO: 44223 - DNA, 23 bp, Artificial Sequence
  Synthetic
gutcaagaacaacuacccaagcc

SEQ ID NO: 44224 - DNA, 26 bp, Artificial Sequence
  Synthetic
gcagcacauctaaaataauccccaga

SEQ ID NO: 44225 - DNA, 28 bp, Artificial Sequence
  Synthetic
ctgcttactgaaacaugaaaaccttgut

SEQ ID NO: 44226 - DNA, 19 bp, Artificial Sequence
  Synthetic
ctgucccgggaaguccaag

SEQ ID NO: 44227 - DNA, 22 bp, Artificial Sequence
  Synthetic
ggtagcugcgaggaaactttug

SEQ ID NO: 44228 - DNA, 25 bp, Artificial Sequence
  Synthetic
ctagtggctugtattcctagtugct

SEQ ID NO: 44229 - DNA, 26 bp, Artificial Sequence
  Synthetic
caaatcttatgucagcaggtcctuac

SEQ ID NO: 44230 - DNA, 27 bp, Artificial Sequence
  Synthetic
ggtaaaatcacuctgaaagcatauggt

SEQ ID NO: 44231 - DNA, 28 bp, Artificial Sequence
  Synthetic
ccataggaatttuctcctctacttgucg

SEQ ID NO: 44232 - DNA, 28 bp, Artificial Sequence
  Synthetic
aggtaagtgaaucttctcccttaatuga

SEQ ID NO: 44233 - DNA, 24 bp, Artificial Sequence
  Synthetic
gctgaggagagcacuggaattuac

SEQ ID NO: 44234 - DNA, 25 bp, Artificial Sequence
  Synthetic
tccagagaugaggtcaagcaauact

SEQ ID NO: 44235 - DNA, 28 bp, Artificial Sequence
  Synthetic
caagagaaacgutaattgcagtacucac

SEQ ID NO: 44236 - DNA, 26 bp, Artificial Sequence
  Synthetic
gtcggtatgagugggaaacgaaauaa

SEQ ID NO: 44237 - DNA, 27 bp, Artificial Sequence
  Synthetic
catatguaagctaagtguccagcacat

SEQ ID NO: 44238 - DNA, 27 bp, Artificial Sequence
  Synthetic
gccgaactttucttcttagacatucat

SEQ ID NO: 44239 - DNA, 33 bp, Artificial Sequence; identical to SEQ ID NO: 32005
  Synthetic

SEQ ID NO: 44240 - DNA, 19 bp, Artificial Sequence
  Synthetic
tgacatccutggccaugct

SEQ ID NO: 44241 - DNA, 32 bp, Artificial Sequence; identical to SEQ ID NO: 32007
  Synthetic

SEQ ID NO: 44242 - DNA, 25 bp, Artificial Sequence
  Synthetic
agtttcagucccagtttttcaugct

SEQ ID NO: 44243 - DNA, 28 bp, Artificial Sequence
  Synthetic
gactacatacattutggcaagcctaaug

SEQ ID NO: 44244 - DNA, 31 bp, Artificial Sequence; identical to SEQ ID NO: 32010
  Synthetic

SEQ ID NO: 44245 - DNA, 27 bp, Artificial Sequence
  Synthetic
acattatcuaaggcaagcagtugacat

SEQ ID NO: 44246 - DNA, 22 bp, Artificial Sequence
  Synthetic
cccatgugcaaactcacttcug

SEQ ID NO: 44247 - DNA, 22 bp, Artificial Sequence
  Synthetic
tcctttcttcugattgccgugt

SEQ ID NO: 44248 - DNA, 21 bp, Artificial Sequence
  Synthetic
ctcctgtccuggactccacua

SEQ ID NO: 44249 - DNA, 20 bp, Artificial Sequence
  Synthetic
cgacagccuggccgattaug

SEQ ID NO: 44250 - DNA, 17 bp, Artificial Sequence
  Synthetic
gugaaggccagggugga

SEQ ID NO: 44251 - DNA, 20 bp, Artificial Sequence
  Synthetic
cgctgtugagacagagugct

SEQ ID NO: 44252 - DNA, 18 bp, Artificial Sequence
  Synthetic
caugcttcccuggcaggt

SEQ ID NO: 44253 - DNA, 17 bp, Artificial Sequence
  Synthetic
accctcuctcccuggca

SEQ ID NO: 44254 - DNA, 20 bp, Artificial Sequence
  Synthetic
ctccctgtuggcaggtcaut

SEQ ID NO: 44255 - DNA, 18 bp, Artificial Sequence
  Synthetic
gccaaccccugtctgucc

SEQ ID NO: 44256 - DNA, 20 bp, Artificial Sequence
  Synthetic
cagaaccgaguggcagguag

SEQ ID NO: 44257 - DNA, 21 bp, Artificial Sequence
  Synthetic
agtgtcatccucagtggctug

SEQ ID NO: 44258 - DNA, 21 bp, Artificial Sequence
  Synthetic
cctcaccaucctgtcgcttua

SEQ ID NO: 44259 - DNA, 25 bp, Artificial Sequence
  Synthetic
ctctatccaagucactggtggttuc

SEQ ID NO: 44260 - DNA, 23 bp, Artificial Sequence
  Synthetic
gcctggacuttgatctcauaggg

SEQ ID NO: 44261 - DNA, 23 bp, Artificial Sequence
  Synthetic
gccaaagaaugctggtgttctug

SEQ ID NO: 44262 - DNA, 21 bp, Artificial Sequence
  Synthetic
ctctcuaagccctccctucac

SEQ ID NO: 44263 - DNA, 20 bp, Artificial Sequence
  Synthetic
ctgtcgcccuatgtccacua

SEQ ID NO: 44264 - DNA, 21 bp, Artificial Sequence
  Synthetic
gcactgagcucaagcctctua

SEQ ID NO: 44265 - DNA, 21 bp, Artificial Sequence
  Synthetic
gtaagucctaggguggaagcc

SEQ ID NO: 44266 - DNA, 20 bp, Artificial Sequence
  Synthetic
ccccttucaccgtcactguc

SEQ ID NO: 44267 - DNA, 22 bp, Artificial Sequence
  Synthetic
gaggacaacagagugactuccc

SEQ ID NO: 44268 - DNA, 20 bp, Artificial Sequence
  Synthetic
agtagcguccggtgtcatug

SEQ ID NO: 44269 - DNA, 20 bp, Artificial Sequence
  Synthetic
ctggtaguggtgagtgucgt

SEQ ID NO: 44270 - DNA, 21 bp, Artificial Sequence
  Synthetic
gcagggacagacugggagtua

SEQ ID NO: 44271 - DNA, 17 bp, Artificial Sequence
  Synthetic
ccaccugctgcaugcac

SEQ ID NO: 44272 - DNA, 21 bp, Artificial Sequence
  Synthetic
ccatgacagugggcaucacag

SEQ ID NO: 44273 - DNA, 23 bp, Artificial Sequence
  Synthetic
gucaccuaccagaaccacaacaa

SEQ ID NO: 44274 - DNA, 18 bp, Artificial Sequence
  Synthetic
aucaccccagcccccuat

SEQ ID NO: 44275 - DNA, 19 bp, Artificial Sequence
  Synthetic
cacccacuttctccuggca

SEQ ID NO: 44276 - DNA, 19 bp, Artificial Sequence
  Synthetic
gaagtcaugaccccgucca

SEQ ID NO: 44277 - DNA, 19 bp, Artificial Sequence
  Synthetic
gagtgucagcccgtctguc

SEQ ID NO: 44278 - DNA, 22 bp, Artificial Sequence
  Synthetic
acctcugagcaaagttgctgut

SEQ ID NO: 44279 - DNA, 19 bp, Artificial Sequence
  Synthetic
cttgcaccugtcccuccag

SEQ ID NO: 44280 - DNA, 22 bp, Artificial Sequence
  Synthetic
ctgactgugcttgtcgguaaga

SEQ ID NO: 44281 - DNA, 22 bp, Artificial Sequence
  Synthetic
cgtgaccgagagagutagcuga

SEQ ID NO: 44282 - DNA, 22 bp, Artificial Sequence
  Synthetic
ctgagtctuagctggctcctug

SEQ ID NO: 44283 - DNA, 20 bp, Artificial Sequence
  Synthetic
caccacucagaguccccaaa

SEQ ID NO: 44284 - DNA, 24 bp, Artificial Sequence
  Synthetic
cttacaggtcutcagtccttuccc

SEQ ID NO: 44285 - DNA, 22 bp, Artificial Sequence
  Synthetic
gaaagccgugaaggagtctuct

SEQ ID NO: 44286 - DNA, 21 bp, Artificial Sequence
  Synthetic
cgtttctugggaatggccuga

SEQ ID NO: 44287 - DNA, 21 bp, Artificial Sequence
  Synthetic
agagggugtgcaggugaaaag

SEQ ID NO: 44288 - DNA, 21 bp, Artificial Sequence
  Synthetic
ccctcucccagttaccgugaa

SEQ ID NO: 44289 - DNA, 22 bp, Artificial Sequence
  Synthetic
tgtcuttctgtttguccccaca

SEQ ID NO: 44290 - DNA, 18 bp, Artificial Sequence
  Synthetic
tccccggucacggaugat

SEQ ID NO: 44291 - DNA, 27 bp, Artificial Sequence
  Synthetic
aacccctcaaguttaaaaaggugaaga

SEQ ID NO: 44292 - DNA, 24 bp, Artificial Sequence
  Synthetic
gauggccaaaucaggacatauact

SEQ ID NO: 44293 - DNA, 22 bp, Artificial Sequence
  Synthetic
aaaaaggtcgugcagctcaaug

SEQ ID NO: 44294 - DNA, 19 bp, Artificial Sequence
  Synthetic
gcaaaucgcatugcgcaga

SEQ ID NO: 44295 - DNA, 17 bp, Artificial Sequence
  Synthetic
ccutccgcauccgccat

SEQ ID NO: 44296 - DNA, 25 bp, Artificial Sequence
  Synthetic
aaaatccatttccuacctgcccuaa

SEQ ID NO: 44297 - DNA, 30 bp, Artificial Sequence; identical to SEQ ID NO: 32063
  Synthetic

SEQ ID NO: 44298 - DNA, 22 bp, Artificial Sequence
  Synthetic
gtttgtgggccacauagtggua

SEQ ID NO: 44299 - DNA, 24 bp, Artificial Sequence
  Synthetic
agaaagtaaguttgcacagugcct

SEQ ID NO: 44300 - DNA, 24 bp, Artificial Sequence
  Synthetic
atcccaaggugactggttgttuaa

SEQ ID NO: 44301 - DNA, 31 bp, Artificial Sequence; identical to SEQ ID NO: 32067
  Synthetic

SEQ ID NO: 44302 - DNA, 22 bp, Artificial Sequence
  Synthetic
ggaccagugactgcacatguac

SEQ ID NO: 44303 - DNA, 21 bp, Artificial Sequence
  Synthetic
ccacucacaggcctaaugact

SEQ ID NO: 44304 - DNA, 28 bp, Artificial Sequence
  Synthetic
ctgatgggcugagatacaaataaacuga

SEQ ID NO: 44305 - DNA, 30 bp, Artificial Sequence; identical to SEQ ID NO: 32071
  Synthetic

SEQ ID NO: 44306 - DNA, 27 bp, Artificial Sequence
  Synthetic
gggctcatcaautatcaattcttucac

SEQ ID NO: 44307 - DNA, 21 bp, Artificial Sequence
  Synthetic
acgcaacccaguaccactuac

SEQ ID NO: 44308 - DNA, 23 bp, Artificial Sequence
  Synthetic
tttgatgguggctttagactugc

SEQ ID NO: 44309 - DNA, 23 bp, Artificial Sequence
  Synthetic
acautccaaacugaggacagcat

SEQ ID NO: 44310 - DNA, 23 bp, Artificial Sequence
  Synthetic
gcttgcttgacugtggaccttua

SEQ ID NO: 44311 - DNA, 22 bp, Artificial Sequence
  Synthetic
agcttcaaguggccttcacuac

SEQ ID NO: 44312 - DNA, 28 bp, Artificial Sequence
  Synthetic
aagagttaagutaaattggaugcaccct

SEQ ID NO: 44313 - DNA, 20 bp, Artificial Sequence
  Synthetic
aggcacaggaccuctacuga

SEQ ID NO: 44314 - DNA, 22 bp, Artificial Sequence
  Synthetic
gaagguagcgagtcaguaacgg

SEQ ID NO: 44315 - DNA, 28 bp, Artificial Sequence
  Synthetic
gactacuggaaacaactagaagugagaa

SEQ ID NO: 44316 - DNA, 29 bp, Artificial Sequence
  Synthetic
ctgctctgagucagttaaacagtaaauct

SEQ ID NO: 44317 - DNA, 27 bp, Artificial Sequence
  Synthetic
gcatgtccttgugataaccttctttut

SEQ ID NO: 44318 - DNA, 22 bp, Artificial Sequence
  Synthetic
catgttcagauggagaggcugt

SEQ ID NO: 44319 - DNA, 17 bp, Artificial Sequence
  Synthetic
ctgccccutgcccugat

SEQ ID NO: 44320 - DNA, 24 bp, Artificial Sequence
  Synthetic
gccacttctucccatcaagacuat

SEQ ID NO: 44321 - DNA, 30 bp, Artificial Sequence; identical to SEQ ID NO: 32087
  Synthetic

SEQ ID NO: 44322 - DNA, 26 bp, Artificial Sequence
  Synthetic
agaagcatggagauggattcattauc

SEQ ID NO: 44323 - DNA, 23 bp, Artificial Sequence
  Synthetic
tgtgtuccacccgtttcattuca

SEQ ID NO: 44324 - DNA, 25 bp, Artificial Sequence
  Synthetic
tctgctttgaucactgattgtgtuc

SEQ ID NO: 44325 - DNA, 28 bp, Artificial Sequence
  Synthetic
gcagcaatgaaaacauccattctatuca

SEQ ID NO: 44326 - DNA, 30 bp, Artificial Sequence; identical to SEQ ID NO: 32092
  Synthetic

SEQ ID NO: 44327 - DNA, 26 bp, Artificial Sequence
  Synthetic
accaaaagcuggtacttcacugaaaa

SEQ ID NO: 44328 - DNA, 27 bp, Artificial Sequence
  Synthetic
aagcttcttatugcacgtaggauaaat

SEQ ID NO: 44329 - DNA, 30 bp, Artificial Sequence; identical to SEQ ID NO: 32095
  Synthetic

SEQ ID NO: 44330 - DNA, 29 bp, Artificial Sequence
  Synthetic
ccaaaagtgggaauacattatagucagca

SEQ ID NO: 44331 - DNA, 24 bp, Artificial Sequence
  Synthetic
gctcctttacucagcccttauacc

SEQ ID NO: 44332 - DNA, 25 bp, Artificial Sequence
  Synthetic
gagcagagcaaaggaauaaccaaug

SEQ ID NO: 44333 - DNA, 30 bp, Artificial Sequence; identical to SEQ ID NO: 32099
  Synthetic

SEQ ID NO: 44334 - DNA, 24 bp, Artificial Sequence
  Synthetic
ttcgggcttautttgtccctcaut

SEQ ID NO: 44335 - DNA, 23 bp, Artificial Sequence
  Synthetic
agaguagcaacagaaagctcugc

SEQ ID NO: 44336 - DNA, 28 bp, Artificial Sequence
  Synthetic
agggaatagguccttctgataaatguga

SEQ ID NO: 44337 - DNA, 27 bp, Artificial Sequence
  Synthetic
cagucatttctuacaaggagccaaaaa

SEQ ID NO: 44338 - DNA, 28 bp, Artificial Sequence
  Synthetic
cctttgcaatggguaatggagatctaut

SEQ ID NO: 44339 - DNA, 26 bp, Artificial Sequence
  Synthetic
ggataattguggatgacaccucaacc

SEQ ID NO: 44340 - DNA, 30 bp, Artificial Sequence; identical to SEQ ID NO: 32106
  Synthetic

SEQ ID NO: 44341 - DNA, 28 bp, Artificial Sequence
  Synthetic
gactggcacuaagaatttcaugaagaac

SEQ ID NO: 44342 - DNA, 26 bp, Artificial Sequence
  Synthetic
gtaagaaatagguttctgctgctugg

SEQ ID NO: 44343 - DNA, 25 bp, Artificial Sequence
  Synthetic
agaaucagcaaggtggauacaaagg

SEQ ID NO: 44344 - DNA, 27 bp, Artificial Sequence
  Synthetic
gatttagccucaaagctgtagcattut

SEQ ID NO: 44345 - DNA, 31 bp, Artificial Sequence; identical to SEQ ID NO: 32111
  Synthetic

SEQ ID NO: 44346 - DNA, 27 bp, Artificial Sequence
  Synthetic
accactctctgutgacgatacatttut

SEQ ID NO: 44347 - DNA, 29 bp, Artificial Sequence
  Synthetic
cagcaggtactgauaatacaagttcctua

SEQ ID NO: 44348 - DNA, 29 bp, Artificial Sequence
  Synthetic
tctcatttaatctuaattggaggccugac

SEQ ID NO: 44349 - DNA, 27 bp, Artificial Sequence
  Synthetic
ctcctctagtgauttgttgatgctcut

SEQ ID NO: 44350 - DNA, 23 bp, Artificial Sequence
  Synthetic
gggtgucttgaattcugggagaa

SEQ ID NO: 44351 - DNA, 29 bp, Artificial Sequence
  Synthetic
gagtaaccagagucttattcttcctcauc

SEQ ID NO: 44352 - DNA, 24 bp, Artificial Sequence
  Synthetic
agacagtttcucctgagaauggga

SEQ ID NO: 44353 - DNA, 26 bp, Artificial Sequence
  Synthetic
atctctttuccccattgttttugcag

SEQ ID NO: 44354 - DNA, 28 bp, Artificial Sequence
  Synthetic
tcttttacugacctatatugcaaaccat

SEQ ID NO: 44355 - DNA, 24 bp, Artificial Sequence
  Synthetic
gatctagctucaggactcatuggc

SEQ ID NO: 44356 - DNA, 22 bp, Artificial Sequence
  Synthetic
agcuggagaaaggaccaacaua

SEQ ID NO: 44357 - DNA, 26 bp, Artificial Sequence
  Synthetic
cagaccatauaacatctacccucacg

SEQ ID NO: 44358 - DNA, 23 bp, Artificial Sequence
  Synthetic
tccatuggagacaaggctgaaut

SEQ ID NO: 44359 - DNA, 25 bp, Artificial Sequence
  Synthetic
ctcgtgaagcuattcagcatgaauc

SEQ ID NO: 44360 - DNA, 25 bp, Artificial Sequence
  Synthetic
ctaacctuaaacatggctucaggat

SEQ ID NO: 44361 - DNA, 25 bp, Artificial Sequence
  Synthetic
ctttatccaaautcgctcagtugcc

SEQ ID NO: 44362 - DNA, 26 bp, Artificial Sequence
  Synthetic
ccttcagcaacacacuatattccugt

SEQ ID NO: 44363 - DNA, 26 bp, Artificial Sequence
  Synthetic
ctttccttacugctcaaacactctug

SEQ ID NO: 44364 - DNA, 22 bp, Artificial Sequence
  Synthetic
ccgagcugtttgtgaacugaag

SEQ ID NO: 44365 - DNA, 27 bp, Artificial Sequence
  Synthetic
actctatcttugccttctctctcauca

SEQ ID NO: 44366 - DNA, 23 bp, Artificial Sequence
  Synthetic
tcaggugaaggaacacaaaugct

SEQ ID NO: 44367 - DNA, 29 bp, Artificial Sequence
  Synthetic
gtgccttacctacucatatctttctcaug

SEQ ID NO: 44368 - DNA, 22 bp, Artificial Sequence
  Synthetic
guaacgccaccatuacaaagca

SEQ ID NO: 44369 - DNA, 23 bp, Artificial Sequence
  Synthetic
tggcggacauctcattctuacag

SEQ ID NO: 44370 - DNA, 24 bp, Artificial Sequence
  Synthetic
aagcagactuacatccccacaauc

SEQ ID NO: 44371 - DNA, 29 bp, Artificial Sequence
  Synthetic
ccagttgaacauttgtagcaataagucat

SEQ ID NO: 44372 - DNA, 20 bp, Artificial Sequence
  Synthetic
cccagucccctacaucgaca

SEQ ID NO: 44373 - DNA, 19 bp, Artificial Sequence
  Synthetic
ctcccagccguatgcugag

SEQ ID NO: 44374 - DNA, 22 bp, Artificial Sequence
  Synthetic
tctcugtggagcugggaaaaac

SEQ ID NO: 44375 - DNA, 20 bp, Artificial Sequence
  Synthetic
cagccctguggaacctguac

SEQ ID NO: 44376 - DNA, 24 bp, Artificial Sequence
  Synthetic
cgtcttctaacccucctcctctuc

SEQ ID NO: 44377 - DNA, 22 bp, Artificial Sequence
  Synthetic
aaccagugaaagggtgcugaat

SEQ ID NO: 44378 - DNA, 22 bp, Artificial Sequence
  Synthetic
ggaacgtctgugcctgtgaaut

SEQ ID NO: 44379 - DNA, 21 bp, Artificial Sequence
  Synthetic
gacaagagugaagggcacaug

SEQ ID NO: 44380 - DNA, 22 bp, Artificial Sequence
  Synthetic
tcctcccctucttctccctcua

SEQ ID NO: 44381 - DNA, 19 bp, Artificial Sequence
  Synthetic
agtggtaggugaccgugga

SEQ ID NO: 44382 - DNA, 24 bp, Artificial Sequence
  Synthetic
aggatgaggaggaugatgatguga

SEQ ID NO: 44383 - DNA, 22 bp, Artificial Sequence
  Synthetic
gcacactagaugccatccucag

SEQ ID NO: 44384 - DNA, 17 bp, Artificial Sequence
  Synthetic
cccgucgcgaagttucc

SEQ ID NO: 44385 - DNA, 19 bp, Artificial Sequence
  Synthetic
cccatucaggtcgtuccca

SEQ ID NO: 44386 - DNA, 23 bp, Artificial Sequence
  Synthetic
ggccagcccuggaaaaatattuc

SEQ ID NO: 44387 - DNA, 19 bp, Artificial Sequence
  Synthetic
ggaagcccugacccaccua

SEQ ID NO: 44388 - DNA, 21 bp, Artificial Sequence
  Synthetic
ggagctccugaagaagtuccg

SEQ ID NO: 44389 - DNA, 21 bp, Artificial Sequence
  Synthetic
acacccagautgcacgucaaa

SEQ ID NO: 44390 - DNA, 21 bp, Artificial Sequence
  Synthetic
ccccacacugggtgagatgua

SEQ ID NO: 44391 - DNA, 23 bp, Artificial Sequence
  Synthetic
cttcctaucacccctcugaggat

SEQ ID NO: 44392 - DNA, 19 bp, Artificial Sequence
  Synthetic
cutctctgugaccccacgt

SEQ ID NO: 44393 - DNA, 21 bp, Artificial Sequence
  Synthetic
aatcacccauctcgccatcuc

SEQ ID NO: 44394 - DNA, 20 bp, Artificial Sequence
  Synthetic
cagugacaggaggtgcuaca

SEQ ID NO: 44395 - DNA, 20 bp, Artificial Sequence
  Synthetic
agtactguggcccacaacuc

SEQ ID NO: 44396 - DNA, 20 bp, Artificial Sequence
  Synthetic
tcctactgaggugctcccut

SEQ ID NO: 44397 - DNA, 22 bp, Artificial Sequence
  Synthetic
gcagaagccagaugaaggtguc

SEQ ID NO: 44398 - DNA, 18 bp, Artificial Sequence
  Synthetic
gaggaggcugcactgtug

SEQ ID NO: 44399 - DNA, 17 bp, Artificial Sequence
  Synthetic
tgtgcaggugggtggug

SEQ ID NO: 44400 - DNA, 20 bp, Artificial Sequence
  Synthetic
agccaatggugaggacccua

SEQ ID NO: 44401 - DNA, 21 bp, Artificial Sequence
  Synthetic
ggcaagcaguttcccttcugt

SEQ ID NO: 44402 - DNA, 23 bp, Artificial Sequence
  Synthetic
ggccatccuagaattctgccuaa

SEQ ID NO: 44403 - DNA, 18 bp, Artificial Sequence
  Synthetic
cccgcaucctggctaugc

SEQ ID NO: 44404 - DNA, 21 bp, Artificial Sequence
  Synthetic
ggccactgaugctttctguct

SEQ ID NO: 44405 - DNA, 20 bp, Artificial Sequence
  Synthetic
ggcctggccaautagggauc

SEQ ID NO: 44406 - DNA, 24 bp, Artificial Sequence
  Synthetic
ccccatautcttgattcuccccaa

SEQ ID NO: 44407 - DNA, 28 bp, Artificial Sequence
  Synthetic
agccatgtguctcttatttttctugact

SEQ ID NO: 44408 - DNA, 21 bp, Artificial Sequence
  Synthetic
tccagactugggactguggaa

SEQ ID NO: 44409 - DNA, 20 bp, Artificial Sequence
  Synthetic
gtgggtgccucaaggactua

SEQ ID NO: 44410 - DNA, 21 bp, Artificial Sequence
  Synthetic
caaugggaagagcaccgugat

SEQ ID NO: 44411 - DNA, 21 bp, Artificial Sequence
  Synthetic
cgtgucacaacggaggactug

SEQ ID NO: 44412 - DNA, 20 bp, Artificial Sequence
  Synthetic
ctcacaagucccaggtcugt

SEQ ID NO: 44413 - DNA, 19 bp, Artificial Sequence
  Synthetic
gcugggagctugggagaag

SEQ ID NO: 44414 - DNA, 21 bp, Artificial Sequence
  Synthetic
ccaccuacactcactcuggac

SEQ ID NO: 44415 - DNA, 28 bp, Artificial Sequence
  Synthetic
gaaaaggaggacauctgttctcatcaut

SEQ ID NO: 44416 - DNA, 22 bp, Artificial Sequence
  Synthetic
ctggcagugaaaaccagaguct

SEQ ID NO: 44417 - DNA, 25 bp, Artificial Sequence
  Synthetic
acctatctgcagucttggactctua

SEQ ID NO: 44418 - DNA, 22 bp, Artificial Sequence
  Synthetic
tgagaggaaggaugtgccauct

SEQ ID NO: 44419 - DNA, 21 bp, Artificial Sequence
  Synthetic
acctgttgcuccatgacucac

SEQ ID NO: 44420 - DNA, 21 bp, Artificial Sequence
  Synthetic
tgguagagccctgtcuccaag

SEQ ID NO: 44421 - DNA, 23 bp, Artificial Sequence
  Synthetic
acacagctugtcacagttuaggt

SEQ ID NO: 44422 - DNA, 21 bp, Artificial Sequence
  Synthetic
agactcaauacgtcccccuca

SEQ ID NO: 44423 - DNA, 20 bp, Artificial Sequence
  Synthetic
cttcccgagcagaacugguc

SEQ ID NO: 44424 - DNA, 21 bp, Artificial Sequence
  Synthetic
gggctctauggcctcctcuac

SEQ ID NO: 44425 - DNA, 22 bp, Artificial Sequence
  Synthetic
ctgacccugcctaaaggaaguc

SEQ ID NO: 44426 - DNA, 21 bp, Artificial Sequence
  Synthetic
tgtcaagcguccttaggaugg

SEQ ID NO: 44427 - DNA, 20 bp, Artificial Sequence
  Synthetic
ggagcccacauggcactuag

SEQ ID NO: 44428 - DNA, 17 bp, Artificial Sequence
  Synthetic
ctgctgcugcgctucac

SEQ ID NO: 44429 - DNA, 17 bp, Artificial Sequence
  Synthetic
gaacugccgcugcaacc

SEQ ID NO: 44430 - DNA, 24 bp, Artificial Sequence
  Synthetic
cacggtgcautcttttctcaucac

SEQ ID NO: 44431 - DNA, 22 bp, Artificial Sequence
  Synthetic
ctctttgucacctccaggtuct

SEQ ID NO: 44432 - DNA, 21 bp, Artificial Sequence
  Synthetic
tuacaggcagggctuacaagg

SEQ ID NO: 44433 - DNA, 24 bp, Artificial Sequence
  Synthetic
gaagttgcuctcaaagaaguccca

SEQ ID NO: 44434 - DNA, 21 bp, Artificial Sequence
  Synthetic
ctggtcgacuaccctgatgug

SEQ ID NO: 44435 - DNA, 23 bp, Artificial Sequence
  Synthetic
gttcuccaaaaccccctgaucaa

SEQ ID NO: 44436 - DNA, 24 bp, Artificial Sequence
  Synthetic
ggaggagaaauggtcactttgcut

SEQ ID NO: 44437 - DNA, 21 bp, Artificial Sequence
  Synthetic
catgacacacucgggacucac

SEQ ID NO: 44438 - DNA, 22 bp, Artificial Sequence
  Synthetic
ccatcgccuatgaaatctucgg

SEQ ID NO: 44439 - DNA, 23 bp, Artificial Sequence
  Synthetic
gagaacagagguttcuacccaca

SEQ ID NO: 44440 - DNA, 25 bp, Artificial Sequence
  Synthetic
gggtgaacauattctagcccugaag

SEQ ID NO: 44441 - DNA, 20 bp, Artificial Sequence
  Synthetic
ctccaugcagggacaucaca

SEQ ID NO: 44442 - DNA, 20 bp, Artificial Sequence
  Synthetic
acccacgucgattgcatcuc

SEQ ID NO: 44443 - DNA, 20 bp, Artificial Sequence
  Synthetic
cacctgtguccccaagcaua

SEQ ID NO: 44444 - DNA, 20 bp, Artificial Sequence
  Synthetic
aagcaggcugatuggagagg

SEQ ID NO: 44445 - DNA, 28 bp, Artificial Sequence
  Synthetic
ctggatactggauatacagaccugaact

SEQ ID NO: 44446 - DNA, 21 bp, Artificial Sequence
  Synthetic
ggacaccccgauctgtggaua

SEQ ID NO: 44447 - DNA, 20 bp, Artificial Sequence
  Synthetic
catgagcuggtaggcgaugt

SEQ ID NO: 44448 - DNA, 21 bp, Artificial Sequence
  Synthetic
cagaagtgauggctcctguct

SEQ ID NO: 44449 - DNA, 19 bp, Artificial Sequence
  Synthetic
ccaucacaggccacctcug

SEQ ID NO: 44450 - DNA, 19 bp, Artificial Sequence
  Synthetic
ggucacagcctcucagcat

SEQ ID NO: 44451 - DNA, 18 bp, Artificial Sequence
  Synthetic
ccagggccgugttuccag

SEQ ID NO: 44452 - DNA, 21 bp, Artificial Sequence
  Synthetic
cctccucggaagacactcuga

SEQ ID NO: 44453 - DNA, 21 bp, Artificial Sequence
  Synthetic
ccagguggguagacaggagac

SEQ ID NO: 44454 - DNA, 20 bp, Artificial Sequence
  Synthetic
ggctcucagcaggtgttucc

SEQ ID NO: 44455 - DNA, 18 bp, Artificial Sequence
  Synthetic
aggctgcauacgccauca

SEQ ID NO: 44456 - DNA, 19 bp, Artificial Sequence
  Synthetic
tttgccaaaugcgcctcuc

SEQ ID NO: 44457 - DNA, 22 bp, Artificial Sequence
  Synthetic
ggauggcgacggauaaaggaaa

SEQ ID NO: 44458 - DNA, 22 bp, Artificial Sequence
  Synthetic
catggagauggtgttcugggaa

SEQ ID NO: 44459 - DNA, 27 bp, Artificial Sequence
  Synthetic
gtgctgatcaauatcactccatuaggg

SEQ ID NO: 44460 - DNA, 29 bp, Artificial Sequence
  Synthetic
ctttgaagatcugtctgtaatgtgugagt

SEQ ID NO: 44461 - DNA, 28 bp, Artificial Sequence
  Synthetic
accacttcactugagataaatcagctut

SEQ ID NO: 44462 - DNA, 30 bp, Artificial Sequence; identical to SEQ ID NO: 32228
  Synthetic

SEQ ID NO: 44463 - DNA, 23 bp, Artificial Sequence
  Synthetic
agtcaaagtccutctgctcaucc

SEQ ID NO: 44464 - DNA, 21 bp, Artificial Sequence
  Synthetic
agctcatcutcgtcacaugcc

SEQ ID NO: 44465 - DNA, 23 bp, Artificial Sequence
  Synthetic
agcagguagaggaagaggaacuc

SEQ ID NO: 44466 - DNA, 19 bp, Artificial Sequence
  Synthetic
gccgtcugcatcgtacuca

SEQ ID NO: 44467 - DNA, 20 bp, Artificial Sequence
  Synthetic
ggtcaggutgggtgcugaag

SEQ ID NO: 44468 - DNA, 21 bp, Artificial Sequence
  Synthetic
gagtgaccccacuctgagtuc

SEQ ID NO: 44469 - DNA, 24 bp, Artificial Sequence
  Synthetic
ttgcaggcagcguagatagtuaat

SEQ ID NO: 44470 - DNA, 23 bp, Artificial Sequence
  Synthetic
gtaagagaggugagaagtgcucc

SEQ ID NO: 44471 - DNA, 24 bp, Artificial Sequence
  Synthetic
tgggtatcuccagaacctctaguc

SEQ ID NO: 44472 - DNA, 21 bp, Artificial Sequence
  Synthetic
catcttccuccccacaacugt

SEQ ID NO: 44473 - DNA, 22 bp, Artificial Sequence
  Synthetic
agggcttaccuttccctaccut

SEQ ID NO: 44474 - DNA, 27 bp, Artificial Sequence
  Synthetic
agctctattgugaactatacgggttuc

SEQ ID NO: 44475 - DNA, 30 bp, Artificial Sequence; identical to SEQ ID NO: 32241
  Synthetic

SEQ ID NO: 44476 - DNA, 22 bp, Artificial Sequence
  Synthetic
cggccagcagcccuatttuaat

SEQ ID NO: 44477 - DNA, 25 bp, Artificial Sequence
  Synthetic
gatggtaaugaccttaggtgtugct

SEQ ID NO: 44478 - DNA, 24 bp, Artificial Sequence
  Synthetic
cacaaggaacuactgctggaauca

SEQ ID NO: 44479 - DNA, 27 bp, Artificial Sequence
  Synthetic
gagtggatattugtcatctaccacugt

SEQ ID NO: 44480 - DNA, 28 bp, Artificial Sequence
  Synthetic
gataggugacaatcttgaatuggaggag

SEQ ID NO: 44481 - DNA, 26 bp, Artificial Sequence
  Synthetic
cacttgcuaaggatcctaaatugcag

SEQ ID NO: 44482 - DNA, 28 bp, Artificial Sequence
  Synthetic
aaacacaaggcaaagcautttaacagua

SEQ ID NO: 44483 - DNA, 27 bp, Artificial Sequence
  Synthetic
tttccatcattgugttttgttggcuag

SEQ ID NO: 44484 - DNA, 17 bp, Artificial Sequence
  Synthetic
ggcggguccagatgcug

SEQ ID NO: 44485 - DNA, 17 bp, Artificial Sequence
  Synthetic
tgcgcaggutgcgauct

SEQ ID NO: 44486 - DNA, 17 bp, Artificial Sequence
  Synthetic
agctaguggcgcucacg

SEQ ID NO: 44487 - DNA, 17 bp, Artificial Sequence
  Synthetic
ccgcuccagcacgtugt

SEQ ID NO: 44488 - DNA, 22 bp, Artificial Sequence
  Synthetic
ggagacugaggaccagaacuca

SEQ ID NO: 44489 - DNA, 24 bp, Artificial Sequence
  Synthetic
cucattaccgaugacacagaaggg

SEQ ID NO: 44490 - DNA, 20 bp, Artificial Sequence
  Synthetic
gtaggcuggctgtgatcucg

SEQ ID NO: 44491 - DNA, 20 bp, Artificial Sequence
  Synthetic
ctatgcgcguagaccacuga

SEQ ID NO: 44492 - DNA, 18 bp, Artificial Sequence
  Synthetic
ctutcccgtguggaagcc

SEQ ID NO: 44493 - DNA, 20 bp, Artificial Sequence
  Synthetic
ccuacaaagacccucacgca

SEQ ID NO: 44494 - DNA, 20 bp, Artificial Sequence
  Synthetic
gacaccctugcagcctctua

SEQ ID NO: 44495 - DNA, 21 bp, Artificial Sequence
  Synthetic
cttctucccgggcatcttgua

SEQ ID NO: 44496 - DNA, 21 bp, Artificial Sequence
  Synthetic
gcaggaccuggcaagatcuga

SEQ ID NO: 44497 - DNA, 17 bp, Artificial Sequence
  Synthetic
ggtgcuccgtcggguac

SEQ ID NO: 44498 - DNA, 21 bp, Artificial Sequence
  Synthetic
gctctggcuaacttggctcuc

SEQ ID NO: 44499 - DNA, 21 bp, Artificial Sequence
  Synthetic
gctccagcucttttgcaccut

SEQ ID NO: 44500 - DNA, 25 bp, Artificial Sequence
  Synthetic
cctattggacacuctactggtggut

SEQ ID NO: 44501 - DNA, 20 bp, Artificial Sequence
  Synthetic
gcctcaggccucagtctuac

SEQ ID NO: 44502 - DNA, 23 bp, Artificial Sequence
  Synthetic
ggaaatucaaggagacacugcga

SEQ ID NO: 44503 - DNA, 22 bp, Artificial Sequence
  Synthetic
ggttggccucagacttcatuca

SEQ ID NO: 44504 - DNA, 17 bp, Artificial Sequence
  Synthetic
ccacuccaccggcuagg

SEQ ID NO: 44505 - DNA, 18 bp, Artificial Sequence
  Synthetic
gucgaacagcggcactug

SEQ ID NO: 44506 - DNA, 19 bp, Artificial Sequence
  Synthetic
tcggucagcaccaacaugg

SEQ ID NO: 44507 - DNA, 19 bp, Artificial Sequence
  Synthetic
catcucacgctccugaggt

SEQ ID NO: 44508 - DNA, 22 bp, Artificial Sequence
  Synthetic
ctugagacttcatuccccagca

SEQ ID NO: 44509 - DNA, 23 bp, Artificial Sequence
  Synthetic
cagtugcaacgaagccaatcaua

SEQ ID NO: 44510 - DNA, 21 bp, Artificial Sequence
  Synthetic
ccucaagcccttctugcagag

SEQ ID NO: 44511 - DNA, 20 bp, Artificial Sequence
  Synthetic
tgaagtggcucctagcccua

SEQ ID NO: 44512 - DNA, 21 bp, Artificial Sequence
  Synthetic
acaggccuagcttgcaaugat

SEQ ID NO: 44513 - DNA, 24 bp, Artificial Sequence
  Synthetic
cgatacggucagctcttgtaggua

SEQ ID NO: 44514 - DNA, 22 bp, Artificial Sequence
  Synthetic
agaaggccuacttctccacucc

SEQ ID NO: 44515 - DNA, 23 bp, Artificial Sequence
  Synthetic
ccaccauaaatcaggguccacat

SEQ ID NO: 44516 - DNA, 23 bp, Artificial Sequence
  Synthetic
aggaattgcutgctcaacucagt

SEQ ID NO: 44517 - DNA, 24 bp, Artificial Sequence
  Synthetic
ggctgaaguggagattaacauccc

SEQ ID NO: 44518 - DNA, 26 bp, Artificial Sequence
  Synthetic
caaccttacucctttccuaacgaact

SEQ ID NO: 44519 - DNA, 30 bp, Artificial Sequence; identical to SEQ ID NO: 32285
  Synthetic

SEQ ID NO: 44520 - DNA, 28 bp, Artificial Sequence
  Synthetic
gagcacatgctuaggaaaactcttaauc

SEQ ID NO: 44521 - DNA, 27 bp, Artificial Sequence
  Synthetic
actgaggtttcugttatcttctcucct

SEQ ID NO: 44522 - DNA, 28 bp, Artificial Sequence
  Synthetic
gttttagatgtgautcagattgagugca

SEQ ID NO: 44523 - DNA, 26 bp, Artificial Sequence
  Synthetic
ctttcaaccucttccatcacaucaac

SEQ ID NO: 44524 - DNA, 29 bp, Artificial Sequence
  Synthetic
acacatcttctucagaatcacaaactuga

SEQ ID NO: 44525 - DNA, 24 bp, Artificial Sequence
  Synthetic
caagcccauttgtgtttcugaaca

SEQ ID NO: 44526 - DNA, 30 bp, Artificial Sequence; identical to SEQ ID NO: 32292
  Synthetic

SEQ ID NO: 44527 - DNA, 26 bp, Artificial Sequence
  Synthetic
ctcaacuggaggacattcacttuact

SEQ ID NO: 44528 - DNA, 26 bp, Artificial Sequence
  Synthetic
tcagtccaguaattttcaagccauga

SEQ ID NO: 44529 - DNA, 27 bp, Artificial Sequence
  Synthetic
tcttccctatguttcaatgtcctucag

SEQ ID NO: 44530 - DNA, 23 bp, Artificial Sequence
  Synthetic
cacugagagaugccaaggaauag

SEQ ID NO: 44531 - DNA, 28 bp, Artificial Sequence
  Synthetic
cttcttccttatucttccaccattucag

SEQ ID NO: 44532 - DNA, 21 bp, Artificial Sequence
  Synthetic
cagaagugcatgggacugaca

SEQ ID NO: 44533 - DNA, 21 bp, Artificial Sequence
  Synthetic
ctagcagctutggcctccaua

SEQ ID NO: 44534 - DNA, 25 bp, Artificial Sequence
  Synthetic
aagtcagttucggtttccttcugaa

SEQ ID NO: 44535 - DNA, 23 bp, Artificial Sequence
  Synthetic
gagtccatgugatctcctuccac

SEQ ID NO: 44536 - DNA, 22 bp, Artificial Sequence
  Synthetic
gggaatgttaugcctccctcut

SEQ ID NO: 44537 - DNA, 22 bp, Artificial Sequence
  Synthetic
ggagaggcacuacaacatgcuc

SEQ ID NO: 44538 - DNA, 22 bp, Artificial Sequence
  Synthetic
gcaggacucttccaagtgucaa

SEQ ID NO: 44539 - DNA, 21 bp, Artificial Sequence
  Synthetic
ggaatccuctcctgcucacct

SEQ ID NO: 44540 - DNA, 21 bp, Artificial Sequence
  Synthetic
aagagacccagcacutggtut

SEQ ID NO: 44541 - DNA, 26 bp, Artificial Sequence
  Synthetic
ctccaaatggcauttctttctctucc

SEQ ID NO: 44542 - DNA, 22 bp, Artificial Sequence
  Synthetic
gggtctgaugatcaccctucct

SEQ ID NO: 44543 - DNA, 24 bp, Artificial Sequence
  Synthetic
aggctagctcugtgttttctccua

SEQ ID NO: 44544 - DNA, 24 bp, Artificial Sequence
  Synthetic
ctaaccagcaccuccaaactcaua

SEQ ID NO: 44545 - DNA, 21 bp, Artificial Sequence
  Synthetic
ggtcccauggaaaggacagug

SEQ ID NO: 44546 - DNA, 20 bp, Artificial Sequence
  Synthetic
cggtaacccucccagcttug

SEQ ID NO: 44547 - DNA, 24 bp, Artificial Sequence
  Synthetic
cgtttccaacagucctacttcuct

SEQ ID NO: 44548 - DNA, 25 bp, Artificial Sequence
  Synthetic
ttatgcucacccggttattcucaaa

SEQ ID NO: 44549 - DNA, 26 bp, Artificial Sequence
  Synthetic
cactctgagutgtctcattucacaca

SEQ ID NO: 44550 - DNA, 21 bp, Artificial Sequence
  Synthetic
cctcttgguctggtcctucag

SEQ ID NO: 44551 - DNA, 22 bp, Artificial Sequence
  Synthetic
tgaacaaauccaagcaccucca

SEQ ID NO: 44552 - DNA, 24 bp, Artificial Sequence
  Synthetic
ggtatgtgaagugtgaggcactua

SEQ ID NO: 44553 - DNA, 21 bp, Artificial Sequence
  Synthetic
caaggagcagcucucagagat

SEQ ID NO: 44554 - DNA, 23 bp, Artificial Sequence
  Synthetic
gggtttgguagctggaagacaut

SEQ ID NO: 44555 - DNA, 28 bp, Artificial Sequence
  Synthetic
gaggcctcuaaagaaatacctgattucc

SEQ ID NO: 44556 - DNA, 28 bp, Artificial Sequence
  Synthetic
gcaagtcaaaaaucctactcaaatcucc

SEQ ID NO: 44557 - DNA, 23 bp, Artificial Sequence
  Synthetic
tggtctgaggauttcctgttucc

SEQ ID NO: 44558 - DNA, 27 bp, Artificial Sequence
  Synthetic
tuaatatcttcuacagggagccaggat

SEQ ID NO: 44559 - DNA, 27 bp, Artificial Sequence
  Synthetic
gaagacaacaagcaguttcacaaacua

SEQ ID NO: 44560 - DNA, 21 bp, Artificial Sequence
  Synthetic
ggatggugaagggttgaccug

SEQ ID NO: 44561 - DNA, 28 bp, Artificial Sequence
  Synthetic
agcaactttgaggcugattatggaauat

SEQ ID NO: 44562 - DNA, 20 bp, Artificial Sequence
  Synthetic
gcccttcuaagcagcatgug

SEQ ID NO: 44563 - DNA, 26 bp, Artificial Sequence
  Synthetic
tttattccacguctattcucccacag

SEQ ID NO: 44564 - DNA, 17 bp, Artificial Sequence
  Synthetic
gcccuctgggugagcag

SEQ ID NO: 44565 - DNA, 28 bp, Artificial Sequence
  Synthetic
cattagagauccagaccttataggcaut

SEQ ID NO: 44566 - DNA, 23 bp, Artificial Sequence
  Synthetic
actugacagaaaccagcuggaat

SEQ ID NO: 44567 - DNA, 28 bp, Artificial Sequence
  Synthetic
ggtcaagaacutatcttccttctuccaa

SEQ ID NO: 44568 - DNA, 22 bp, Artificial Sequence
  Synthetic
ctgcagaaguacccagtgtuct

SEQ ID NO: 44569 - DNA, 23 bp, Artificial Sequence
  Synthetic
tcagtcatcccauccatctgtug

SEQ ID NO: 44570 - DNA, 20 bp, Artificial Sequence
  Synthetic
tcatctugcgcaccaaggut

SEQ ID NO: 44571 - DNA, 23 bp, Artificial Sequence
  Synthetic
gtacacccuttaccaacaaugcc

SEQ ID NO: 44572 - DNA, 20 bp, Artificial Sequence
  Synthetic
ggagccauggatttgccauc

SEQ ID NO: 44573 - DNA, 21 bp, Artificial Sequence
  Synthetic
agccactgcutttctcgtugt

SEQ ID NO: 44574 - DNA, 22 bp, Artificial Sequence
  Synthetic
gaaagaguagacagccgcugat

SEQ ID NO: 44575 - DNA, 24 bp, Artificial Sequence
  Synthetic
gtctgaacaucaccttcuacgaga

SEQ ID NO: 44576 - DNA, 25 bp, Artificial Sequence
  Synthetic
agagagtcagtutcctaggcttcut

SEQ ID NO: 44577 - DNA, 21 bp, Artificial Sequence
  Synthetic
actggctuctgattggugcag

SEQ ID NO: 44578 - DNA, 23 bp, Artificial Sequence
  Synthetic
ccagtaggatutgctggtggaut

SEQ ID NO: 44579 - DNA, 22 bp, Artificial Sequence
  Synthetic
cttgatgcugctgtctauggct

SEQ ID NO: 44580 - DNA, 23 bp, Artificial Sequence
  Synthetic
ccctuccaaggaaacgtgttgua

SEQ ID NO: 44581 - DNA, 23 bp, Artificial Sequence
  Synthetic
gttcttgttggcuttctccacug

SEQ ID NO: 44582 - DNA, 22 bp, Artificial Sequence
  Synthetic
agctagatgucacgctctccut

SEQ ID NO: 44583 - DNA, 24 bp, Artificial Sequence
  Synthetic
caatgcagtgauttggtgtaccug

SEQ ID NO: 44584 - DNA, 19 bp, Artificial Sequence
  Synthetic
ggaggaggaucgcgaacut

SEQ ID NO: 44585 - DNA, 23 bp, Artificial Sequence
  Synthetic
ctttgtcccuctgtgtcttcuca

SEQ ID NO: 44586 - DNA, 20 bp, Artificial Sequence
  Synthetic
agagctgguccagggauaca

SEQ ID NO: 44587 - DNA, 24 bp, Artificial Sequence
  Synthetic
tcctcctcacacuctctcaactut

SEQ ID NO: 44588 - DNA, 21 bp, Artificial Sequence
  Synthetic
gagggtgcgaucagtgatgut

SEQ ID NO: 44589 - DNA, 27 bp, Artificial Sequence
  Synthetic
gcagtgacugtatttcttctucccaag

SEQ ID NO: 44590 - DNA, 24 bp, Artificial Sequence
  Synthetic
cccccttacuctgatcatgtucat

SEQ ID NO: 44591 - DNA, 25 bp, Artificial Sequence
  Synthetic
ctgttcgtgtcuctgtcttgatcuc

SEQ ID NO: 44592 - DNA, 22 bp, Artificial Sequence
  Synthetic
cuaaggccacucagcaagacaa

SEQ ID NO: 44593 - DNA, 25 bp, Artificial Sequence
  Synthetic
ctctcctucaactggtaugaagaca

SEQ ID NO: 44594 - DNA, 25 bp, Artificial Sequence
  Synthetic
caggctacucacctcttgaattcut

SEQ ID NO: 44595 - DNA, 27 bp, Artificial Sequence
  Synthetic
tgttttactgucaattacagctuccca

SEQ ID NO: 44596 - DNA, 21 bp, Artificial Sequence
  Synthetic
gccuggagctttugcaaggat

SEQ ID NO: 44597 - DNA, 26 bp, Artificial Sequence
  Synthetic
cctacagtggauagaagacactcugt

SEQ ID NO: 44598 - DNA, 20 bp, Artificial Sequence
  Synthetic
ctttctcaggcugggtgcut

SEQ ID NO: 44599 - DNA, 28 bp, Artificial Sequence
  Synthetic
ttcaacacccugttctttctcttatuca

SEQ ID NO: 44600 - DNA, 21 bp, Artificial Sequence
  Synthetic
ccggagggugtccatgaatug

SEQ ID NO: 44601 - DNA, 24 bp, Artificial Sequence
  Synthetic
ctgggugacagagcgagauaaaaa

SEQ ID NO: 44602 - DNA, 22 bp, Artificial Sequence
  Synthetic
cacucccacccuaagatcttuc

SEQ ID NO: 44603 - DNA, 26 bp, Artificial Sequence
  Synthetic
agcaccacugaactttctctctttut

SEQ ID NO: 44604 - DNA, 23 bp, Artificial Sequence
  Synthetic
guccagttctuccagagcaaaag

SEQ ID NO: 44605 - DNA, 29 bp, Artificial Sequence
  Synthetic
ccccaacuaagggcttatgtgtaatuaaa

SEQ ID NO: 44606 - DNA, 32 bp, Artificial Sequence; identical to SEQ ID NO: 32372
  Synthetic

SEQ ID NO: 44607 - DNA, 26 bp, Artificial Sequence
  Synthetic
ccaacaaggacagutgauacaaaaca

SEQ ID NO: 44608 - DNA, 27 bp, Artificial Sequence
  Synthetic
aaaagctctatctuccctagtgtggua

SEQ ID NO: 44609 - DNA, 22 bp, Artificial Sequence
  Synthetic
gagtacagugccaugagagacc

SEQ ID NO: 44610 - DNA, 27 bp, Artificial Sequence
  Synthetic
cagaatatggguaaagatgauccgaca

SEQ ID NO: 44611 - DNA, 24 bp, Artificial Sequence
  Synthetic
accctgautactggttuccaacag

SEQ ID NO: 44612 - DNA, 22 bp, Artificial Sequence
  Synthetic
ctgucaaagagggagutggaug

SEQ ID NO: 44613 - DNA, 22 bp, Artificial Sequence
  Synthetic
ccctuccccacacagttcaaug

SEQ ID NO: 44614 - DNA, 26 bp, Artificial Sequence
  Synthetic
ggagggauacagcttttctttcauct

SEQ ID NO: 44615 - DNA, 26 bp, Artificial Sequence
  Synthetic
tttgcttccaguccctaatcacuaac

SEQ ID NO: 44616 - DNA, 24 bp, Artificial Sequence
  Synthetic
tgtgtgtttguctgcctgtctuaa

SEQ ID NO: 44617 - DNA, 22 bp, Artificial Sequence
  Synthetic
gctttcctugccttctcaaugg

SEQ ID NO: 44618 - DNA, 25 bp, Artificial Sequence
  Synthetic
gcttgccutaatgttccauacagga

SEQ ID NO: 44619 - DNA, 22 bp, Artificial Sequence
  Synthetic
gutccctctucacagcacgaat

SEQ ID NO: 44620 - DNA, 27 bp, Artificial Sequence
  Synthetic
acacattctgutttctatgacuccaat

SEQ ID NO: 44621 - DNA, 23 bp, Artificial Sequence
  Synthetic
gtcccaccacucaattucaggaa

SEQ ID NO: 44622 - DNA, 26 bp, Artificial Sequence
  Synthetic
tctcttagaaucatctcuacccgcat

SEQ ID NO: 44623 - DNA, 25 bp, Artificial Sequence
  Synthetic
ctgctcuagagacttgatucaggaa

SEQ ID NO: 44624 - DNA, 28 bp, Artificial Sequence
  Synthetic
gcacagaaggaacuacaagaaaaaguca

SEQ ID NO: 44625 - DNA, 28 bp, Artificial Sequence
  Synthetic
aggattaaagacauaaacttgccacuct

SEQ ID NO: 44626 - DNA, 22 bp, Artificial Sequence
  Synthetic
agccctgccuctgatctucaat

SEQ ID NO: 44627 - DNA, 20 bp, Artificial Sequence
  Synthetic
ggcccaguatggacaccuac

SEQ ID NO: 44628 - DNA, 26 bp, Artificial Sequence
  Synthetic
ggttctttcuaccccatcatctucca

SEQ ID NO: 44629 - DNA, 22 bp, Artificial Sequence
  Synthetic
ccccctuaatcccctcuaaccc

SEQ ID NO: 44630 - DNA, 33 bp, Artificial Sequence; identical to SEQ ID NO: 32396
  Synthetic

SEQ ID NO: 44631 - DNA, 21 bp, Artificial Sequence
  Synthetic
agtgtucagccccatgcttut

SEQ ID NO: 44632 - DNA, 20 bp, Artificial Sequence
  Synthetic
acgtcgcugtaagcucacac

SEQ ID NO: 44633 - DNA, 24 bp, Artificial Sequence
  Synthetic
caatctcaccuggctactccatuc

SEQ ID NO: 44634 - DNA, 20 bp, Artificial Sequence
  Synthetic
tctucagcccactucccaga

SEQ ID NO: 44635 - DNA, 25 bp, Artificial Sequence
  Synthetic
tgggtgacttcutagatgagggtut

SEQ ID NO: 44636 - DNA, 25 bp, Artificial Sequence
  Synthetic
ggtgatgtcuacaatgatgggacug

SEQ ID NO: 44637 - DNA, 24 bp, Artificial Sequence
  Synthetic
atgtgaccctuacctacactcuct

SEQ ID NO: 44638 - DNA, 21 bp, Artificial Sequence
  Synthetic
cacactctgcucccagaacut

SEQ ID NO: 44639 - DNA, 22 bp, Artificial Sequence
  Synthetic
gtccaggaucagttgctctucc

SEQ ID NO: 44640 - DNA, 20 bp, Artificial Sequence
  Synthetic
cctaggucacgggcaaugaa

SEQ ID NO: 44641 - DNA, 18 bp, Artificial Sequence
  Synthetic
cacccagcuggtctgguc

SEQ ID NO: 44642 - DNA, 21 bp, Artificial Sequence
  Synthetic
tgagtgaccccutcccatuca

SEQ ID NO: 44643 - DNA, 20 bp, Artificial Sequence
  Synthetic
ggaggcuaatggcugaaccg

SEQ ID NO: 44644 - DNA, 29 bp, Artificial Sequence
  Synthetic
aaaaacgaaaagtutcaatggctctaugt

SEQ ID NO: 44645 - DNA, 25 bp, Artificial Sequence
  Synthetic
gatacccttatuccctgtggatguc

SEQ ID NO: 44646 - DNA, 20 bp, Artificial Sequence
  Synthetic
ccatacucagctccauccgt

SEQ ID NO: 44647 - DNA, 23 bp, Artificial Sequence
  Synthetic
cctagcagaugtgtccattcucc

SEQ ID NO: 44648 - DNA, 21 bp, Artificial Sequence
  Synthetic
tgctgatugggagctctcuct

SEQ ID NO: 44649 - DNA, 23 bp, Artificial Sequence
  Synthetic
gctcctagucatcacaugaccca

SEQ ID NO: 44650 - DNA, 22 bp, Artificial Sequence
  Synthetic
ccaccaagucctcatcactcuc

SEQ ID NO: 44651 - DNA, 24 bp, Artificial Sequence
  Synthetic
cactctttauccctggactccuca

SEQ ID NO: 44652 - DNA, 22 bp, Artificial Sequence
  Synthetic
ggtccagcaauttgagucaggt

SEQ ID NO: 44653 - DNA, 24 bp, Artificial Sequence
  Synthetic
gtagatgugagaagggatgctugg

SEQ ID NO: 44654 - DNA, 22 bp, Artificial Sequence
  Synthetic
tccaccccaucagttctctcut

SEQ ID NO: 44655 - DNA, 23 bp, Artificial Sequence
  Synthetic
aattagcaaggucaccaggacuc

SEQ ID NO: 44656 - DNA, 17 bp, Artificial Sequence
  Synthetic
cccctgacucccccugt

SEQ ID NO: 44657 - DNA, 17 bp, Artificial Sequence
  Synthetic
catgguccagcccugct

SEQ ID NO: 44658 - DNA, 22 bp, Artificial Sequence
  Synthetic
gatctgccuccctcctccttua

SEQ ID NO: 44659 - DNA, 24 bp, Artificial Sequence
  Synthetic
gatgtcccggaacuctttacucac

SEQ ID NO: 44660 - DNA, 21 bp, Artificial Sequence
  Synthetic
ggctcccugacaatctccauc

SEQ ID NO: 44661 - DNA, 20 bp, Artificial Sequence
  Synthetic
catccaggacuggcacucac

SEQ ID NO: 44662 - DNA, 23 bp, Artificial Sequence
  Synthetic
tctcctgtcuccatccttcacut

SEQ ID NO: 44663 - DNA, 24 bp, Artificial Sequence
  Synthetic
attgtagacaguggaagaggctuc

SEQ ID NO: 44664 - DNA, 25 bp, Artificial Sequence
  Synthetic
tgagaatggctuttcataccctgug

SEQ ID NO: 44665 - DNA, 23 bp, Artificial Sequence
  Synthetic
ctccugaaagcacuaaggcaaag

SEQ ID NO: 44666 - DNA, 23 bp, Artificial Sequence
  Synthetic
cgtuaagcagagaguaacaccuc

SEQ ID NO: 44667 - DNA, 21 bp, Artificial Sequence
  Synthetic
gtgctgcugtcatcctaguca

SEQ ID NO: 44668 - DNA, 24 bp, Artificial Sequence
  Synthetic
tcagagaggaaaacgugttgtgut

SEQ ID NO: 44669 - DNA, 27 bp, Artificial Sequence
  Synthetic
gatggatctucacgtctgtccuaaaaa

SEQ ID NO: 44670 - DNA, 24 bp, Artificial Sequence
  Synthetic
cacctagguctagcagtatugcat

SEQ ID NO: 44671 - DNA, 27 bp, Artificial Sequence
  Synthetic
caguttgaaaaataucaggagcagcac

SEQ ID NO: 44672 - DNA, 30 bp, Artificial Sequence; identical to SEQ ID NO: 32438
  Synthetic

SEQ ID NO: 44673 - DNA, 25 bp, Artificial Sequence
  Synthetic
tgctcacctcutacttgtcctauct

SEQ ID NO: 44674 - DNA, 29 bp, Artificial Sequence
  Synthetic
atcatgattgcuatcaacttcacuaagaa

SEQ ID NO: 44675 - DNA, 22 bp, Artificial Sequence
  Synthetic
aaggagutggcugaggaagaac

SEQ ID NO: 44676 - DNA, 20 bp, Artificial Sequence
  Synthetic
acattccccuctggcccaua

SEQ ID NO: 44677 - DNA, 25 bp, Artificial Sequence
  Synthetic
cacaccatguctcttgtctcugaag

SEQ ID NO: 44678 - DNA, 18 bp, Artificial Sequence
  Synthetic
gggtggcgaucacttguc

SEQ ID NO: 44679 - DNA, 25 bp, Artificial Sequence
  Synthetic
gggagtcucgcaaggataagaaaua

SEQ ID NO: 44680 - DNA, 20 bp, Artificial Sequence
  Synthetic
gggcttgacugttcccaucc

SEQ ID NO: 44681 - DNA, 25 bp, Artificial Sequence
  Synthetic
caaacgtacagcaguctctcttcut

SEQ ID NO: 44682 - DNA, 22 bp, Artificial Sequence
  Synthetic
cctctucccccaacctaucagt

SEQ ID NO: 44683 - DNA, 22 bp, Artificial Sequence
  Synthetic
ctacagtgacaauggcacgtuc

SEQ ID NO: 44684 - DNA, 22 bp, Artificial Sequence
  Synthetic
gttauccaaccccaggatuccc

SEQ ID NO: 44685 - DNA, 23 bp, Artificial Sequence
  Synthetic
atctgatuccccactttgtgcut

SEQ ID NO: 44686 - DNA, 28 bp, Artificial Sequence
  Synthetic
ttcagcaatgttgutactggaaatgtuc

SEQ ID NO: 44687 - DNA, 28 bp, Artificial Sequence
  Synthetic
cctgtctatuacaacaacatgctacuca

SEQ ID NO: 44688 - DNA, 29 bp, Artificial Sequence
  Synthetic
gcatttacaaaucagtcttttccaacuct

SEQ ID NO: 44689 - DNA, 28 bp, Artificial Sequence
  Synthetic
gacttcttcagcautatgacaagagcua

SEQ ID NO: 44690 - DNA, 31 bp, Artificial Sequence; identical to SEQ ID NO: 32456
  Synthetic

SEQ ID NO: 44691 - DNA, 23 bp, Artificial Sequence
  Synthetic
gtcagttatguggctagcagcut

SEQ ID NO: 44692 - DNA, 22 bp, Artificial Sequence
  Synthetic
ggtgcucaccagaatauccact

SEQ ID NO: 44693 - DNA, 28 bp, Artificial Sequence
  Synthetic
gtaaattgttcutgaggaaggtuccaaa

SEQ ID NO: 44694 - DNA, 30 bp, Artificial Sequence; identical to SEQ ID NO: 32460
  Synthetic

SEQ ID NO: 44695 - DNA, 22 bp, Artificial Sequence
  Synthetic
ccctcaaauatggtcccaucct

SEQ ID NO: 44696 - DNA, 28 bp, Artificial Sequence
  Synthetic
aggagtattucctcctctactugagaag

SEQ ID NO: 44697 - DNA, 26 bp, Artificial Sequence
  Synthetic
tccaaagttatugtcactggcatuca

SEQ ID NO: 44698 - DNA, 25 bp, Artificial Sequence
  Synthetic
ctcacugatataaagtugcgagcca

SEQ ID NO: 44699 - DNA, 24 bp, Artificial Sequence
  Synthetic
gccaaaauaaacttccauggccaa

SEQ ID NO: 44700 - DNA, 21 bp, Artificial Sequence
  Synthetic
tcgtugaaacccaugcagaca

SEQ ID NO: 44701 - DNA, 30 bp, Artificial Sequence; identical to SEQ ID NO: 32467
  Synthetic

SEQ ID NO: 44702 - DNA, 23 bp, Artificial Sequence
  Synthetic
ctctcugagacagacagggauca

SEQ ID NO: 44703 - DNA, 26 bp, Artificial Sequence
  Synthetic
gccagaaauaaaccaggaaaaaugcc

SEQ ID NO: 44704 - DNA, 24 bp, Artificial Sequence
  Synthetic
tgutcttgtucagacacagccaat

SEQ ID NO: 44705 - DNA, 23 bp, Artificial Sequence
  Synthetic
aaataccuccatgtuggcaggag

SEQ ID NO: 44706 - DNA, 25 bp, Artificial Sequence
  Synthetic
aggatggaatugatggttactccug

SEQ ID NO: 44707 - DNA, 26 bp, Artificial Sequence
  Synthetic
gctaactacaccauctgtgatucaga

SEQ ID NO: 44708 - DNA, 22 bp, Artificial Sequence
  Synthetic
tgttggucccagccttgttuaa

SEQ ID NO: 44709 - DNA, 20 bp, Artificial Sequence
  Synthetic
cuaagccaaucacccaacgc

SEQ ID NO: 44710 - DNA, 29 bp, Artificial Sequence
  Synthetic
ttactttccagauatagctgtaacugcac

SEQ ID NO: 44711 - DNA, 26 bp, Artificial Sequence
  Synthetic
attggtggaagguattttgtcacuca

SEQ ID NO: 44712 - DNA, 22 bp, Artificial Sequence
  Synthetic
gcaataguaacccctgccaguc

SEQ ID NO: 44713 - DNA, 28 bp, Artificial Sequence
  Synthetic
agaaagtcaagtcauatcccatctccut

SEQ ID NO: 44714 - DNA, 25 bp, Artificial Sequence
  Synthetic
aatgaatgttcutcaaaccctugcc

SEQ ID NO: 44715 - DNA, 26 bp, Artificial Sequence
  Synthetic
aagtgagggaugcatgttccattaut

SEQ ID NO: 44716 - DNA, 22 bp, Artificial Sequence
  Synthetic
ggtcaaaaguggctcagugaca

SEQ ID NO: 44717 - DNA, 23 bp, Artificial Sequence
  Synthetic
ctggtgtugtgggaaaugaacag

SEQ ID NO: 44718 - DNA, 20 bp, Artificial Sequence
  Synthetic
gcaucgcgaaagctccuact

SEQ ID NO: 44719 - DNA, 23 bp, Artificial Sequence
  Synthetic
atgaugagccagaugagatgtuc

SEQ ID NO: 44720 - DNA, 29 bp, Artificial Sequence
  Synthetic
ttttctcctccucctctattttgacatug

SEQ ID NO: 44721 - DNA, 27 bp, Artificial Sequence
  Synthetic
ccagacacggauatattgataagugct

SEQ ID NO: 44722 - DNA, 28 bp, Artificial Sequence
  Synthetic
ctgtatcagtcutcacaaaaccuaggat

SEQ ID NO: 44723 - DNA, 31 bp, Artificial Sequence; identical to SEQ ID NO: 32489
  Synthetic

SEQ ID NO: 44724 - DNA, 25 bp, Artificial Sequence
  Synthetic
aaacagatatguggtttcaccguca

SEQ ID NO: 44725 - DNA, 22 bp, Artificial Sequence
  Synthetic
tgaatccacaccacugaaccuc

SEQ ID NO: 44726 - DNA, 29 bp, Artificial Sequence
  Synthetic
tcaccttctctcautaggtattgcaaaug

SEQ ID NO: 44727 - DNA, 23 bp, Artificial Sequence
  Synthetic
gctgttgccacuttgcaatugaa

SEQ ID NO: 44728 - DNA, 24 bp, Artificial Sequence
  Synthetic
gcaaauggaaguggacaacgaaac

SEQ ID NO: 44729 - DNA, 30 bp, Artificial Sequence; identical to SEQ ID NO: 32495
  Synthetic

SEQ ID NO: 44730 - DNA, 21 bp, Artificial Sequence
  Synthetic
cccugtttgcauggaggaaac

SEQ ID NO: 44731 - DNA, 28 bp, Artificial Sequence
  Synthetic
ttgtctatauccacttcacagtucacac

SEQ ID NO: 44732 - DNA, 28 bp, Artificial Sequence
  Synthetic
cttgaatgagaugaacaagaugaacagc

SEQ ID NO: 44733 - DNA, 25 bp, Artificial Sequence
  Synthetic
tcttccagaaggcuctaatgugact

SEQ ID NO: 44734 - DNA, 23 bp, Artificial Sequence
  Synthetic
cttgctctggutggtcttcatuc

SEQ ID NO: 44735 - DNA, 21 bp, Artificial Sequence
  Synthetic
acaauggccagcaagaggauc

SEQ ID NO: 44736 - DNA, 21 bp, Artificial Sequence
  Synthetic
ccctgcaauggagagacugat

SEQ ID NO: 44737 - DNA, 19 bp, Artificial Sequence
  Synthetic
acaauggtgucgagcggaa

SEQ ID NO: 44738 - DNA, 21 bp, Artificial Sequence
  Synthetic
ggattccuccccaguggagaa

SEQ ID NO: 44739 - DNA, 22 bp, Artificial Sequence
  Synthetic
cctaaaguacagccuggaccac

SEQ ID NO: 44740 - DNA, 23 bp, Artificial Sequence
  Synthetic
cacttgcagguggcataguagag

SEQ ID NO: 44741 - DNA, 21 bp, Artificial Sequence
  Synthetic
cctcctgcugctgttccatut

SEQ ID NO: 44742 - DNA, 22 bp, Artificial Sequence
  Synthetic
cattgagcuaactccgcctuct

SEQ ID NO: 44743 - DNA, 23 bp, Artificial Sequence
  Synthetic
ccagatcuccctcttuccacaaa

SEQ ID NO: 44744 - DNA, 23 bp, Artificial Sequence
  Synthetic
tgtaccactcuccaccatgguaa

SEQ ID NO: 44745 - DNA, 19 bp, Artificial Sequence
  Synthetic
gctccccaacguggactug

SEQ ID NO: 44746 - DNA, 22 bp, Artificial Sequence
  Synthetic
gctgaugcactgaacaugggaa

SEQ ID NO: 44747 - DNA, 20 bp, Artificial Sequence
  Synthetic
atuagggcagucgaggaauc

SEQ ID NO: 44748 - DNA, 20 bp, Artificial Sequence
  Synthetic
tcctgtcugcctcctccuac

SEQ ID NO: 44749 - DNA, 22 bp, Artificial Sequence
  Synthetic
agatggctugcaccccaatauc

SEQ ID NO: 44750 - DNA, 20 bp, Artificial Sequence
  Synthetic
gtcccugagctgguccaaaa

SEQ ID NO: 44751 - DNA, 17 bp, Artificial Sequence
  Synthetic
ccacccccuctcccucc

SEQ ID NO: 44752 - DNA, 23 bp, Artificial Sequence
  Synthetic
gaagcttcugtcaagactcucca

SEQ ID NO: 44753 - DNA, 23 bp, Artificial Sequence
  Synthetic
agtgtaagcucctctcccttcuc

SEQ ID NO: 44754 - DNA, 19 bp, Artificial Sequence
  Synthetic
ctgcugagaactgcucgga

SEQ ID NO: 44755 - DNA, 21 bp, Artificial Sequence
  Synthetic
cacccttgcutccagaccuat

SEQ ID NO: 44756 - DNA, 18 bp, Artificial Sequence
  Synthetic
gcctgaugccttgucgca

SEQ ID NO: 44757 - DNA, 23 bp, Artificial Sequence
  Synthetic
tgtagaaagagccucaggucaga

SEQ ID NO: 44758 - DNA, 20 bp, Artificial Sequence
  Synthetic
cggaccacccucacttcgua

SEQ ID NO: 44759 - DNA, 18 bp, Artificial Sequence
  Synthetic
ggacaugccgtgugacga

SEQ ID NO: 44760 - DNA, 20 bp, Artificial Sequence
  Synthetic
gggcauaccccctctgtcua

SEQ ID NO: 44761 - DNA, 20 bp, Artificial Sequence
  Synthetic
ggagagcgcugtgacctaug

SEQ ID NO: 44762 - DNA, 21 bp, Artificial Sequence
  Synthetic
agccaagutttcatgcuccct

SEQ ID NO: 44763 - DNA, 20 bp, Artificial Sequence
  Synthetic
aagaactgugagcggtguca

SEQ ID NO: 44764 - DNA, 19 bp, Artificial Sequence
  Synthetic
cacucgacccagacccuac

SEQ ID NO: 44765 - DNA, 26 bp, Artificial Sequence
  Synthetic
gcccttcttugttgattactccugat

SEQ ID NO: 44766 - DNA, 19 bp, Artificial Sequence
  Synthetic
agcauggccgugacagaag

SEQ ID NO: 44767 - DNA, 28 bp, Artificial Sequence
  Synthetic
catatgaaggagacuctatgtgcctcua

SEQ ID NO: 44768 - DNA, 23 bp, Artificial Sequence
  Synthetic
gaacagtgggacaucagggatut

SEQ ID NO: 44769 - DNA, 20 bp, Artificial Sequence
  Synthetic
gatugagcgctccucagact

SEQ ID NO: 44770 - DNA, 22 bp, Artificial Sequence
  Synthetic
gagagacaaggacacugtgcuc

SEQ ID NO: 44771 - DNA, 23 bp, Artificial Sequence
  Synthetic
tggacagtcuctggatgacagut

SEQ ID NO: 44772 - DNA, 20 bp, Artificial Sequence
  Synthetic
ttccuccagtccugggaagt

SEQ ID NO: 44773 - DNA, 21 bp, Artificial Sequence
  Synthetic
tggactgcuccatcacacauc

SEQ ID NO: 44774 - DNA, 22 bp, Artificial Sequence
  Synthetic
gaccuttccuaggacacagcaa

SEQ ID NO: 44775 - DNA, 22 bp, Artificial Sequence
  Synthetic
tcacaugccactugagacaagg

SEQ ID NO: 44776 - DNA, 20 bp, Artificial Sequence
  Synthetic
gcucaaccccggatcugaac

SEQ ID NO: 44777 - DNA, 25 bp, Artificial Sequence
  Synthetic
gtatgttaccugtctttaccugcct

SEQ ID NO: 44778 - DNA, 31 bp, Artificial Sequence; identical to SEQ ID NO: 32544
  Synthetic

SEQ ID NO: 44779 - DNA, 23 bp, Artificial Sequence
  Synthetic
tgacuaaggaacgcaccacatuc

SEQ ID NO: 44780 - DNA, 21 bp, Artificial Sequence
  Synthetic
ggcagcatucggtgaaguaca

SEQ ID NO: 44781 - DNA, 24 bp, Artificial Sequence
  Synthetic
ccagcucatggacatucaagacaa

SEQ ID NO: 44782 - DNA, 24 bp, Artificial Sequence
  Synthetic
tccttgtuaccatggctaugacac

SEQ ID NO: 44783 - DNA, 22 bp, Artificial Sequence
  Synthetic
tggccatttutctgtcccugat

SEQ ID NO: 44784 - DNA, 29 bp, Artificial Sequence
  Synthetic
aacatatgtgtgtutcttgaggaagauga

SEQ ID NO: 44785 - DNA, 28 bp, Artificial Sequence
  Synthetic
ccctatttguaggtgttgaaugaacaag

SEQ ID NO: 44786 - DNA, 19 bp, Artificial Sequence
  Synthetic
ccctccgucggtuaacacg

SEQ ID NO: 44787 - DNA, 23 bp, Artificial Sequence
  Synthetic
cctgcactccutcaaagaggtua

SEQ ID NO: 44788 - DNA, 20 bp, Artificial Sequence
  Synthetic
gatccacucggaagccguac

SEQ ID NO: 44789 - DNA, 27 bp, Artificial Sequence
  Synthetic
gtcttgactcuacgtatccattcucat

SEQ ID NO: 44790 - DNA, 22 bp, Artificial Sequence
  Synthetic
gtgcaggccuctactccaauag

SEQ ID NO: 44791 - DNA, 25 bp, Artificial Sequence
  Synthetic
tttgtaggaggugggatcttggaua

SEQ ID NO: 44792 - DNA, 22 bp, Artificial Sequence
  Synthetic
actgatgtugaccactgctugg

SEQ ID NO: 44793 - DNA, 28 bp, Artificial Sequence
  Synthetic
cttgcttttgacagucttgttgattuct

SEQ ID NO: 44794 - DNA, 26 bp, Artificial Sequence
  Synthetic
agcttccgtuatagattaggacugga

SEQ ID NO: 44795 - DNA, 25 bp, Artificial Sequence
  Synthetic
aagtgacuggacattcauacagacc

SEQ ID NO: 44796 - DNA, 23 bp, Artificial Sequence
  Synthetic
ccaagggcucaggcaauagaaag

SEQ ID NO: 44797 - DNA, 30 bp, Artificial Sequence; identical to SEQ ID NO: 32563
  Synthetic

SEQ ID NO: 44798 - DNA, 22 bp, Artificial Sequence
  Synthetic
gactcaaaauaccccctuggct

SEQ ID NO: 44799 - DNA, 22 bp, Artificial Sequence
  Synthetic
ccuggaaaccuccaagaaaccc

SEQ ID NO: 44800 - DNA, 20 bp, Artificial Sequence
  Synthetic
cctccatucgtgcaggcuac

SEQ ID NO: 44801 - DNA, 23 bp, Artificial Sequence
  Synthetic
agaagtcagcccuccagatctut

SEQ ID NO: 44802 - DNA, 28 bp, Artificial Sequence
  Synthetic
aaagtcacaggaucaaagcuaaaaggat

SEQ ID NO: 44803 - DNA, 23 bp, Artificial Sequence
  Synthetic
aattcagcugggcatacctguag

SEQ ID NO: 44804 - DNA, 21 bp, Artificial Sequence
  Synthetic
ccccaagcutttcccucgaag

SEQ ID NO: 44805 - DNA, 22 bp, Artificial Sequence
  Synthetic
ctctctacacacugacccugga

SEQ ID NO: 44806 - DNA, 24 bp, Artificial Sequence
  Synthetic
ggcatgucagggctcatctattua

SEQ ID NO: 44807 - DNA, 25 bp, Artificial Sequence
  Synthetic
gcaggagaaautttaagccctugga

SEQ ID NO: 44808 - DNA, 28 bp, Artificial Sequence
  Synthetic
gcatgtctgtuacttttctaaaggguct

SEQ ID NO: 44809 - DNA, 22 bp, Artificial Sequence
  Synthetic
acacaaacuctggaagcuccac

SEQ ID NO: 44810 - DNA, 21 bp, Artificial Sequence
  Synthetic
gtgttggagcaguacgcatuc

SEQ ID NO: 44811 - DNA, 25 bp, Artificial Sequence
  Synthetic
tttcaaggaagutgtggagtuagca

SEQ ID NO: 44812 - DNA, 28 bp, Artificial Sequence
  Synthetic
tcaccattttgacaugcttgtatcctua

SEQ ID NO: 44813 - DNA, 31 bp, Artificial Sequence; identical to SEQ ID NO: 32579
  Synthetic

SEQ ID NO: 44814 - DNA, 27 bp, Artificial Sequence
  Synthetic
atttcttctggtgutgacataggtgut

SEQ ID NO: 44815 - DNA, 30 bp, Artificial Sequence; identical to SEQ ID NO: 32581
  Synthetic

SEQ ID NO: 44816 - DNA, 26 bp, Artificial Sequence
  Synthetic
ggaaaagcaaguttccattacgacuc

SEQ ID NO: 44817 - DNA, 25 bp, Artificial Sequence
  Synthetic
gggatggugtgacttttgauacact

SEQ ID NO: 44818 - DNA, 26 bp, Artificial Sequence
  Synthetic
gugacctcatataucaaacacacacc

SEQ ID NO: 44819 - DNA, 22 bp, Artificial Sequence
  Synthetic
agagtaccagaucaggcaggut

SEQ ID NO: 44820 - DNA, 22 bp, Artificial Sequence
  Synthetic
ctgaaccccutttcccagagut

SEQ ID NO: 44821 - DNA, 28 bp, Artificial Sequence
  Synthetic
tcaaatgcagtcauttttctgcttctut

SEQ ID NO: 44822 - DNA, 28 bp, Artificial Sequence
  Synthetic
ttcaagattgtctautttggtccacgua

SEQ ID NO: 44823 - DNA, 27 bp, Artificial Sequence
  Synthetic
tttttctcttuccagatgtgaaccuca

SEQ ID NO: 44824 - DNA, 27 bp, Artificial Sequence
  Synthetic
aacacatttctucaattgatgcctucc

SEQ ID NO: 44825 - DNA, 28 bp, Artificial Sequence
  Synthetic
cacaaaagccuaccctatgtatgtcuaa

SEQ ID NO: 44826 - DNA, 23 bp, Artificial Sequence
  Synthetic
tggcaccgggucattcttttuaa

SEQ ID NO: 44827 - DNA, 27 bp, Artificial Sequence
  Synthetic
actttatagcagccucagttttctucc

SEQ ID NO: 44828 - DNA, 23 bp, Artificial Sequence
  Synthetic
cacagcaaauctggtttccugag

SEQ ID NO: 44829 - DNA, 23 bp, Artificial Sequence
  Synthetic
aatcagttgggauctgcaagaug

SEQ ID NO: 44830 - DNA, 30 bp, Artificial Sequence; identical to SEQ ID NO: 32596
  Synthetic

SEQ ID NO: 44831 - DNA, 28 bp, Artificial Sequence
  Synthetic
gtatccatgcgcuaaaactcaaaagtua

SEQ ID NO: 44832 - DNA, 27 bp, Artificial Sequence
  Synthetic
cattaaatgagautgtcatggcugaga

SEQ ID NO: 44833 - DNA, 24 bp, Artificial Sequence
  Synthetic
cccaaautaccactguggaagaca

SEQ ID NO: 44834 - DNA, 22 bp, Artificial Sequence
  Synthetic
cacttgaagacauagccuggca

SEQ ID NO: 44835 - DNA, 25 bp, Artificial Sequence
  Synthetic
gtgtcatcuggacatctcctucaaa

SEQ ID NO: 44836 - DNA, 30 bp, Artificial Sequence; identical to SEQ ID NO: 32602
  Synthetic

SEQ ID NO: 44837 - DNA, 28 bp, Artificial Sequence
  Synthetic
aagccaaacacagaguattggatcttua

SEQ ID NO: 44838 - DNA, 31 bp, Artificial Sequence; identical to SEQ ID NO: 32604
  Synthetic

SEQ ID NO: 44839 - DNA, 22 bp, Artificial Sequence
  Synthetic
tgtgacaacgutagctggtcut

SEQ ID NO: 44840 - DNA, 27 bp, Artificial Sequence
  Synthetic
actttgaacuattcaacaugcccagaa

SEQ ID NO: 44841 - DNA, 27 bp, Artificial Sequence
  Synthetic
gatgttcctgcutgtcttttgcttuag

SEQ ID NO: 44842 - DNA, 25 bp, Artificial Sequence
  Synthetic
acttagtggaaucacagacaauggg

SEQ ID NO: 44843 - DNA, 21 bp, Artificial Sequence
  Synthetic
gcctgacccucacatcactut

SEQ ID NO: 44844 - DNA, 24 bp, Artificial Sequence
  Synthetic
tcaacacagagucaatccagggua

SEQ ID NO: 44845 - DNA, 27 bp, Artificial Sequence
  Synthetic
gctcttagcccauggacaaaataugaa

SEQ ID NO: 44846 - DNA, 25 bp, Artificial Sequence
  Synthetic
gggtugccaagatataaucacagat

SEQ ID NO: 44847 - DNA, 25 bp, Artificial Sequence
  Synthetic
ctggaaaugtcactaatugcacagt

SEQ ID NO: 44848 - DNA, 27 bp, Artificial Sequence
  Synthetic
cctatgtagaagacauttggctgtgua

SEQ ID NO: 44849 - DNA, 29 bp, Artificial Sequence
  Synthetic
tttcccatacaggutattttccaatccut

SEQ ID NO: 44850 - DNA, 28 bp, Artificial Sequence
  Synthetic
agatagccaacauttgcatagactuacc

SEQ ID NO: 44851 - DNA, 23 bp, Artificial Sequence
  Synthetic
gucatguacaguggagaagagac

SEQ ID NO: 44852 - DNA, 30 bp, Artificial Sequence; identical to SEQ ID NO: 32618
  Synthetic

SEQ ID NO: 44853 - DNA, 24 bp, Artificial Sequence
  Synthetic
actcacagguggaaaatcgaacuc

SEQ ID NO: 44854 - DNA, 21 bp, Artificial Sequence
  Synthetic
tgagucaccgccacttactuc

SEQ ID NO: 44855 - DNA, 23 bp, Artificial Sequence
  Synthetic
ctatcgtgctuacggatttgcuc

SEQ ID NO: 44856 - DNA, 25 bp, Artificial Sequence
  Synthetic
attaagcaccacauataagcugcca

SEQ ID NO: 44857 - DNA, 21 bp, Artificial Sequence
  Synthetic
cugacgaggacauacccgaag

SEQ ID NO: 44858 - DNA, 23 bp, Artificial Sequence
  Synthetic
gggagaagaaguggaaggaaugg

SEQ ID NO: 44859 - DNA, 29 bp, Artificial Sequence
  Synthetic
gtgggattcuggaacgctatgtattauat

SEQ ID NO: 44860 - DNA, 25 bp, Artificial Sequence
  Synthetic
ccagcatgugagagagacaacatut

SEQ ID NO: 44861 - DNA, 29 bp, Artificial Sequence
  Synthetic
gctgagtaaattcutgtttctccctaucc

SEQ ID NO: 44862 - DNA, 24 bp, Artificial Sequence
  Synthetic
gcctcccauccatgtauaaacagt

SEQ ID NO: 44863 - DNA, 27 bp, Artificial Sequence
  Synthetic
tccatgatttatuggtttgggtcugaa

SEQ ID NO: 44864 - DNA, 29 bp, Artificial Sequence
  Synthetic
tgcaaacaaaaaggaagutaataggguct

SEQ ID NO: 44865 - DNA, 28 bp, Artificial Sequence
  Synthetic
ctgttgtcagaggugtaattgagaagua

SEQ ID NO: 44866 - DNA, 24 bp, Artificial Sequence
  Synthetic
gtgtgtgugcacatatgcattuga

SEQ ID NO: 44867 - DNA, 28 bp, Artificial Sequence
  Synthetic
gccagccccucattaatctatatgagua

SEQ ID NO: 44868 - DNA, 23 bp, Artificial Sequence
  Synthetic
atccagautgactcugacagcac

SEQ ID NO: 44869 - DNA, 25 bp, Artificial Sequence
  Synthetic
ctgcagaggacaaaaaugattggua

SEQ ID NO: 44870 - DNA, 21 bp, Artificial Sequence
  Synthetic
actccgaugcatgcttcauca

SEQ ID NO: 44871 - DNA, 30 bp, Artificial Sequence; identical to SEQ ID NO: 32637
  Synthetic

SEQ ID NO: 44872 - DNA, 30 bp, Artificial Sequence; identical to SEQ ID NO: 32638
  Synthetic

SEQ ID NO: 44873 - DNA, 28 bp, Artificial Sequence
  Synthetic
tcctagagttucttagcaccctuacaat

SEQ ID NO: 44874 - DNA, 21 bp, Artificial Sequence
  Synthetic
cctcccagcugttauacacgt

SEQ ID NO: 44875 - DNA, 28 bp, Artificial Sequence
  Synthetic
gcctatttcuttgactttaauggcacat

SEQ ID NO: 44876 - DNA, 27 bp, Artificial Sequence
  Synthetic
acagaaaagtauggcaacaccaacaua

SEQ ID NO: 44877 - DNA, 30 bp, Artificial Sequence; identical to SEQ ID NO: 32643
  Synthetic

SEQ ID NO: 44878 - DNA, 23 bp, Artificial Sequence
  Synthetic
tttacctcaguaccaggcaccua

SEQ ID NO: 44879 - DNA, 25 bp, Artificial Sequence
  Synthetic
tttgctgaucacacttgtctuacca

SEQ ID NO: 44880 - DNA, 27 bp, Artificial Sequence
  Synthetic
cttcgtgtcucctaaataaagcaaugt

SEQ ID NO: 44881 - DNA, 29 bp, Artificial Sequence
  Synthetic
cctatatatcagcuggaaaggagagaguc

SEQ ID NO: 44882 - DNA, 29 bp, Artificial Sequence
  Synthetic
tcatatccatuaaaacttgcttaccugct

SEQ ID NO: 44883 - DNA, 23 bp, Artificial Sequence
  Synthetic
aagctgtugcacactgctaaauc

SEQ ID NO: 44884 - DNA, 22 bp, Artificial Sequence
  Synthetic
tgtccaaaugaagcccuaagcc

SEQ ID NO: 44885 - DNA, 23 bp, Artificial Sequence
  Synthetic
tcaauatctccugggagaagcca

SEQ ID NO: 44886 - DNA, 28 bp, Artificial Sequence
  Synthetic
aatttgaggaaacauttgcatucagagg

SEQ ID NO: 44887 - DNA, 28 bp, Artificial Sequence
  Synthetic
gtagaatcggccaaugaaaatgcatuaa

SEQ ID NO: 44888 - DNA, 22 bp, Artificial Sequence
  Synthetic
gggaatcucagccttggatuct

SEQ ID NO: 44889 - DNA, 23 bp, Artificial Sequence
  Synthetic
cagctaccauctggaatctggut

SEQ ID NO: 44890 - DNA, 28 bp, Artificial Sequence
  Synthetic
acagagtcugagccaataggaatgauat

SEQ ID NO: 44891 - DNA, 29 bp, Artificial Sequence
  Synthetic
ttcaccaacttgugaaatgtaactttgut

SEQ ID NO: 44892 - DNA, 27 bp, Artificial Sequence
  Synthetic
ccatccctgaguaaactgtaaguaagc

SEQ ID NO: 44893 - DNA, 28 bp, Artificial Sequence
  Synthetic
tgctggatatctuacttcagtttgctut

SEQ ID NO: 44894 - DNA, 21 bp, Artificial Sequence
  Synthetic
cacugggaacacaagcaucac

SEQ ID NO: 44895 - DNA, 30 bp, Artificial Sequence; identical to SEQ ID NO: 32661
  Synthetic

SEQ ID NO: 44896 - DNA, 22 bp, Artificial Sequence
  Synthetic
acacacugaccagtcaggcuat

SEQ ID NO: 44897 - DNA, 29 bp, Artificial Sequence
  Synthetic
cttggtagagtatuctgtttttctgtgua

SEQ ID NO: 44898 - DNA, 23 bp, Artificial Sequence
  Synthetic
ggtcaaatugtacctgugaggct

SEQ ID NO: 44899 - DNA, 22 bp, Artificial Sequence
  Synthetic
catcugcaagcccaatgtugaa

SEQ ID NO: 44900 - DNA, 25 bp, Artificial Sequence
  Synthetic
cactgaagtccuttggcttctttut

SEQ ID NO: 44901 - DNA, 27 bp, Artificial Sequence
  Synthetic
gaatgaaatcautttcccatccucacc

SEQ ID NO: 44902 - DNA, 22 bp, Artificial Sequence
  Synthetic
agccatcaggauccaactctug

SEQ ID NO: 44903 - DNA, 31 bp, Artificial Sequence; identical to SEQ ID NO: 32669
  Synthetic

SEQ ID NO: 44904 - DNA, 25 bp, Artificial Sequence
  Synthetic
tgcautgtagauagaagcacacagg

SEQ ID NO: 44905 - DNA, 28 bp, Artificial Sequence
  Synthetic
tcaattguaaaccttgtcaaugcaacag

SEQ ID NO: 44906 - DNA, 26 bp, Artificial Sequence
  Synthetic
aatgtaaagctugaaatctggctugc

SEQ ID NO: 44907 - DNA, 24 bp, Artificial Sequence
  Synthetic
gagttcguaaaagccacgcaaaua

SEQ ID NO: 44908 - DNA, 21 bp, Artificial Sequence
  Synthetic
gaagtcuccaccagccuagag

SEQ ID NO: 44909 - DNA, 24 bp, Artificial Sequence
  Synthetic
aggaattgtggugcttttggaaug

SEQ ID NO: 44910 - DNA, 24 bp, Artificial Sequence
  Synthetic
gacatgaagtutgtgggcattugt

SEQ ID NO: 44911 - DNA, 27 bp, Artificial Sequence
  Synthetic
gataatagagtgucacggttgaaucct

SEQ ID NO: 44912 - DNA, 27 bp, Artificial Sequence
  Synthetic
agtgaattcagcauttatccttucggt

SEQ ID NO: 44913 - DNA, 29 bp, Artificial Sequence
  Synthetic
ggtattgcttgguaaacagagacttctua

SEQ ID NO: 44914 - DNA, 26 bp, Artificial Sequence
  Synthetic
atttctucacaagaattcuccccagt

SEQ ID NO: 44915 - DNA, 24 bp, Artificial Sequence
  Synthetic
tctcttttccggutgcttccuaag

SEQ ID NO: 44916 - DNA, 22 bp, Artificial Sequence
  Synthetic
ctatgggcgutaggaugcagat

SEQ ID NO: 44917 - DNA, 22 bp, Artificial Sequence
  Synthetic
gaaaguttccatcgugccaacc

SEQ ID NO: 44918 - DNA, 24 bp, Artificial Sequence
  Synthetic
ccaatgaaagaacugggcaatuca

SEQ ID NO: 44919 - DNA, 25 bp, Artificial Sequence
  Synthetic
gataccagcagcuactcatgtctuc

SEQ ID NO: 44920 - DNA, 22 bp, Artificial Sequence
  Synthetic
ctcugacagugaggaagaagug

SEQ ID NO: 44921 - DNA, 23 bp, Artificial Sequence
  Synthetic
gcatcagggaaugaatgtcuggt

SEQ ID NO: 44922 - DNA, 22 bp, Artificial Sequence
  Synthetic
agagcugaccctcaaauacgga

SEQ ID NO: 44923 - DNA, 22 bp, Artificial Sequence
  Synthetic
cagguacagugaccaacacagg

SEQ ID NO: 44924 - DNA, 20 bp, Artificial Sequence
  Synthetic
tcctcaacuccgtgcugaac

SEQ ID NO: 44925 - DNA, 24 bp, Artificial Sequence
  Synthetic
gtgtttttcuaaaggcggctgtut

SEQ ID NO: 44926 - DNA, 21 bp, Artificial Sequence
  Synthetic
ggttgggacugaatggtggua

SEQ ID NO: 44927 - DNA, 23 bp, Artificial Sequence
  Synthetic
gcactgaucatgatgagguaggc

SEQ ID NO: 44928 - DNA, 24 bp, Artificial Sequence
  Synthetic
tgacaaggaugtctctgtctucct

SEQ ID NO: 44929 - DNA, 21 bp, Artificial Sequence
  Synthetic
cccagucaactcugaaagcca

SEQ ID NO: 44930 - DNA, 21 bp, Artificial Sequence
  Synthetic
agctttgtuccctgguaacac

SEQ ID NO: 44931 - DNA, 21 bp, Artificial Sequence
  Synthetic
cgtgtgaacaugggcacctua

SEQ ID NO: 44932 - DNA, 21 bp, Artificial Sequence
  Synthetic
gtccucgaacaagctcctgug

SEQ ID NO: 44933 - DNA, 21 bp, Artificial Sequence
  Synthetic
aaagaugagcccgaacgugat

SEQ ID NO: 44934 - DNA, 17 bp, Artificial Sequence
  Synthetic
gtggacggcucggtgut

SEQ ID NO: 44935 - DNA, 22 bp, Artificial Sequence
  Synthetic
gcctgaagaaucccacacucac

SEQ ID NO: 44936 - DNA, 21 bp, Artificial Sequence
  Synthetic
cccccaccuattctuccaagg

SEQ ID NO: 44937 - DNA, 24 bp, Artificial Sequence
  Synthetic
gcttgcugaacaaatctacugggt

SEQ ID NO: 44938 - DNA, 24 bp, Artificial Sequence
  Synthetic
ggatgctaccutttcagctgtcua

SEQ ID NO: 44939 - DNA, 22 bp, Artificial Sequence
  Synthetic
gcccagaggucttcattcucag

SEQ ID NO: 44940 - DNA, 24 bp, Artificial Sequence
  Synthetic
caaauttatgcagttugcaagcca

SEQ ID NO: 44941 - DNA, 25 bp, Artificial Sequence
  Synthetic
tcttcagauacggcagcaaaaucat

SEQ ID NO: 44942 - DNA, 27 bp, Artificial Sequence
  Synthetic
ccattactatuctgttggaccuccaaa

SEQ ID NO: 44943 - DNA, 25 bp, Artificial Sequence
  Synthetic
gttgctgctuggaaactttactuga

SEQ ID NO: 44944 - DNA, 25 bp, Artificial Sequence
  Synthetic
cautgggaaagauggagaaaagcaa

SEQ ID NO: 44945 - DNA, 23 bp, Artificial Sequence
  Synthetic
aaaugtaaccaggucaccagacc

SEQ ID NO: 44946 - DNA, 20 bp, Artificial Sequence
  Synthetic
gaccttuccgagccctctut

SEQ ID NO: 44947 - DNA, 20 bp, Artificial Sequence
  Synthetic
tctaggtgcuctccagggut

SEQ ID NO: 44948 - DNA, 17 bp, Artificial Sequence
  Synthetic
cccagccaugctgugct

SEQ ID NO: 44949 - DNA, 18 bp, Artificial Sequence
  Synthetic
gctucagacccgccagug

SEQ ID NO: 44950 - DNA, 22 bp, Artificial Sequence
  Synthetic
cgaaggugaaccagacacaguc

SEQ ID NO: 44951 - DNA, 25 bp, Artificial Sequence
  Synthetic
gtatactccacaaucctaccugcac

SEQ ID NO: 44952 - DNA, 20 bp, Artificial Sequence
  Synthetic
gguggagggaugccagaaac

SEQ ID NO: 44953 - DNA, 17 bp, Artificial Sequence
  Synthetic
ggccaacgugggcuacc

SEQ ID NO: 44954 - DNA, 23 bp, Artificial Sequence
  Synthetic
ctcattagggcccuctcctctua

SEQ ID NO: 44955 - DNA, 23 bp, Artificial Sequence
  Synthetic
gcacttcgcuttcttttgauccc

SEQ ID NO: 44956 - DNA, 22 bp, Artificial Sequence
  Synthetic
tggtgagatgguccctgagaut

SEQ ID NO: 44957 - DNA, 21 bp, Artificial Sequence
  Synthetic
gctgttucccttgtggauccg

SEQ ID NO: 44958 - DNA, 21 bp, Artificial Sequence
  Synthetic
agggaucagcaggcactgaua

SEQ ID NO: 44959 - DNA, 21 bp, Artificial Sequence
  Synthetic
cgtgtgcacugacacctaugt

SEQ ID NO: 44960 - DNA, 26 bp, Artificial Sequence
  Synthetic
tgcaccacacuttatttaacgcttug

SEQ ID NO: 44961 - DNA, 22 bp, Artificial Sequence
  Synthetic
gacagugaggaccccaaaugag

SEQ ID NO: 44962 - DNA, 24 bp, Artificial Sequence
  Synthetic
aaggaaaguaaaaccctgtgcuca

SEQ ID NO: 44963 - DNA, 18 bp, Artificial Sequence
  Synthetic
cctccugcagaccuccca

SEQ ID NO: 44964 - DNA, 20 bp, Artificial Sequence
  Synthetic
cagagtccccauggagctug

SEQ ID NO: 44965 - DNA, 20 bp, Artificial Sequence
  Synthetic
tgggatacuggcaggaugct

SEQ ID NO: 44966 - DNA, 22 bp, Artificial Sequence
  Synthetic
tgcagttccuttcctgtgtuca

SEQ ID NO: 44967 - DNA, 30 bp, Artificial Sequence; identical to SEQ ID NO: 32733
  Synthetic

SEQ ID NO: 44968 - DNA, 18 bp, Artificial Sequence
  Synthetic
ggtgggcucaggtuggaa

SEQ ID NO: 44969 - DNA, 17 bp, Artificial Sequence
  Synthetic
ggcuccagccggctuac

SEQ ID NO: 44970 - DNA, 23 bp, Artificial Sequence
  Synthetic
cctctggtcuactctctgctcuc

SEQ ID NO: 44971 - DNA, 20 bp, Artificial Sequence
  Synthetic
ctcaccgucaaagacugcac

SEQ ID NO: 44972 - DNA, 20 bp, Artificial Sequence
  Synthetic
gcactctuagcaccccaucc

SEQ ID NO: 44973 - DNA, 23 bp, Artificial Sequence
  Synthetic
gctttgggcaagutttcacucac

SEQ ID NO: 44974 - DNA, 20 bp, Artificial Sequence
  Synthetic
gctgugagaaccuggcacat

SEQ ID NO: 44975 - DNA, 21 bp, Artificial Sequence
  Synthetic
gatttggcucaggtgaugggt

SEQ ID NO: 44976 - DNA, 19 bp, Artificial Sequence
  Synthetic
gaccaccacccuctgtuca

SEQ ID NO: 44977 - DNA, 29 bp, Artificial Sequence
  Synthetic
ggaaaaatacgaucatgactugggaaaaa

SEQ ID NO: 44978 - DNA, 20 bp, Artificial Sequence
  Synthetic
ttgcugaaaccgtgaguacc

SEQ ID NO: 44979 - DNA, 22 bp, Artificial Sequence
  Synthetic
ccttggguagcttgatctugcc

SEQ ID NO: 44980 - DNA, 21 bp, Artificial Sequence
  Synthetic
ctccaggagguggtagaugga

SEQ ID NO: 44981 - DNA, 22 bp, Artificial Sequence
  Synthetic
ccaaatgtcuagaccccaccug

SEQ ID NO: 44982 - DNA, 19 bp, Artificial Sequence
  Synthetic
gggaacugccaagcaauga

SEQ ID NO: 44983 - DNA, 18 bp, Artificial Sequence
  Synthetic
gugaccacaggccucact

SEQ ID NO: 44984 - DNA, 22 bp, Artificial Sequence
  Synthetic
gggatctaacuctctgggcuag

SEQ ID NO: 44985 - DNA, 23 bp, Artificial Sequence
  Synthetic
acacaccctuatcaccccauaga

SEQ ID NO: 44986 - DNA, 22 bp, Artificial Sequence
  Synthetic
cacauggctcuggagaagacat

SEQ ID NO: 44987 - DNA, 21 bp, Artificial Sequence
  Synthetic
cgccaaagauctcgatcucgt

SEQ ID NO: 44988 - DNA, 23 bp, Artificial Sequence
  Synthetic
ctgggtaagggaugctgattcut

SEQ ID NO: 44989 - DNA, 24 bp, Artificial Sequence
  Synthetic
gatctggatauagaccagccucac

SEQ ID NO: 44990 - DNA, 18 bp, Artificial Sequence
  Synthetic
cgcctagugcgcctugat

SEQ ID NO: 44991 - DNA, 21 bp, Artificial Sequence
  Synthetic
ctggctucaccttccctcuac

SEQ ID NO: 44992 - DNA, 24 bp, Artificial Sequence
  Synthetic
cactctcctcautctgtgtgctua

SEQ ID NO: 44993 - DNA, 21 bp, Artificial Sequence
  Synthetic
ggtgcagaugtcaaagtuggg

SEQ ID NO: 44994 - DNA, 19 bp, Artificial Sequence
  Synthetic
ggatucaggccagtgcgut

SEQ ID NO: 44995 - DNA, 22 bp, Artificial Sequence
  Synthetic
ccatcatcuccccttccccuac

SEQ ID NO: 44996 - DNA, 21 bp, Artificial Sequence
  Synthetic
gtcagagagcgcuacctctug

SEQ ID NO: 44997 - DNA, 29 bp, Artificial Sequence
  Synthetic
ggagcccacaaauaagtaaacagtacaua

SEQ ID NO: 44998 - DNA, 25 bp, Artificial Sequence
  Synthetic
cttgtttccttucctttgctgtugt

SEQ ID NO: 44999 - DNA, 24 bp, Artificial Sequence
  Synthetic
gttagggacgucttcgaggattua

SEQ ID NO: 45000 - DNA, 20 bp, Artificial Sequence
  Synthetic
caggagtgcutggtccguat

SEQ ID NO: 45001 - DNA, 24 bp, Artificial Sequence
  Synthetic
ctactaugaactcccugaggcaga

SEQ ID NO: 45002 - DNA, 23 bp, Artificial Sequence
  Synthetic
ggtagtttcgagcucttgtccug

SEQ ID NO: 45003 - DNA, 22 bp, Artificial Sequence
  Synthetic
gtctcaccgaucttttcgucct

SEQ ID NO: 45004 - DNA, 24 bp, Artificial Sequence
  Synthetic
gagtgtcctugaagcatctcauct

SEQ ID NO: 45005 - DNA, 20 bp, Artificial Sequence
  Synthetic
cgagagcccaccauggttug

SEQ ID NO: 45006 - DNA, 20 bp, Artificial Sequence
  Synthetic
ctgttcugtgcccucagcat

SEQ ID NO: 45007 - DNA, 18 bp, Artificial Sequence
  Synthetic
cctgtggcugggcaaguc

SEQ ID NO: 45008 - DNA, 29 bp, Artificial Sequence
  Synthetic
actgtgttggaaaucttaatgagaacuat

SEQ ID NO: 45009 - DNA, 21 bp, Artificial Sequence
  Synthetic
gggaaucggaaggacacugac

SEQ ID NO: 45010 - DNA, 24 bp, Artificial Sequence
  Synthetic
ttggccaaaaacuacctctctgut

SEQ ID NO: 45011 - DNA, 22 bp, Artificial Sequence
  Synthetic
gggcuggaggaagtagactuac

SEQ ID NO: 45012 - DNA, 20 bp, Artificial Sequence
  Synthetic
cagttgaccuccgggatcuc

SEQ ID NO: 45013 - DNA, 21 bp, Artificial Sequence
  Synthetic
cucccccatuagacccagagt

SEQ ID NO: 45014 - DNA, 19 bp, Artificial Sequence
  Synthetic
ctggugaagccctucagct

SEQ ID NO: 45015 - DNA, 23 bp, Artificial Sequence
  Synthetic
gggagaaggaaaugatggaagug

SEQ ID NO: 45016 - DNA, 24 bp, Artificial Sequence
  Synthetic
acccaaaaguaaatgccucaggac

SEQ ID NO: 45017 - DNA, 25 bp, Artificial Sequence
  Synthetic
atcttgatttcugcctgctcttuct

SEQ ID NO: 45018 - DNA, 21 bp, Artificial Sequence
  Synthetic
cccttguaccaagcaccuagc

SEQ ID NO: 45019 - DNA, 23 bp, Artificial Sequence
  Synthetic
tgttgggcacagcauaatagugt

SEQ ID NO: 45020 - DNA, 20 bp, Artificial Sequence
  Synthetic
acctgacccuctaggcugac

SEQ ID NO: 45021 - DNA, 22 bp, Artificial Sequence
  Synthetic
cgtggaugtccttuccagcaat

SEQ ID NO: 45022 - DNA, 24 bp, Artificial Sequence
  Synthetic
gttggagcugagatgttuagagca

SEQ ID NO: 45023 - DNA, 28 bp, Artificial Sequence
  Synthetic
caccagctatttutcttccactttguag

SEQ ID NO: 45024 - DNA, 22 bp, Artificial Sequence
  Synthetic
gctccugacccgtguaaaaagg

SEQ ID NO: 45025 - DNA, 21 bp, Artificial Sequence
  Synthetic
cacttgucagagctgguggag

SEQ ID NO: 45026 - DNA, 22 bp, Artificial Sequence
  Synthetic
ccucaagaagaugcccagcaaa

SEQ ID NO: 45027 - DNA, 21 bp, Artificial Sequence
  Synthetic
gcugagatcgucaccaagacc

SEQ ID NO: 45028 - DNA, 27 bp, Artificial Sequence
  Synthetic
attaaagaatccautctgaggcuacgg

SEQ ID NO: 45029 - DNA, 22 bp, Artificial Sequence
  Synthetic
cgtgttgagguggcttttccut

SEQ ID NO: 45030 - DNA, 20 bp, Artificial Sequence
  Synthetic
cccttgctaugctcccctuc

SEQ ID NO: 45031 - DNA, 21 bp, Artificial Sequence
  Synthetic
actacuctgagcugagccagt

SEQ ID NO: 45032 - DNA, 22 bp, Artificial Sequence
  Synthetic
agacaaugacaggcttctuggg

SEQ ID NO: 45033 - DNA, 24 bp, Artificial Sequence
  Synthetic
gggtgtcacauagatcctgaguga

SEQ ID NO: 45034 - DNA, 20 bp, Artificial Sequence
  Synthetic
gagtgccacaaugcgaaugg

SEQ ID NO: 45035 - DNA, 22 bp, Artificial Sequence
  Synthetic
tgaggtcattutgaggctgtug

SEQ ID NO: 45036 - DNA, 24 bp, Artificial Sequence
  Synthetic
ggaaagtatgucccacttcucagg

SEQ ID NO: 45037 - DNA, 23 bp, Artificial Sequence
  Synthetic
tttggcatcucaggttttccuca

SEQ ID NO: 45038 - DNA, 24 bp, Artificial Sequence
  Synthetic
ccagaggagggauggaaacactua

SEQ ID NO: 45039 - DNA, 29 bp, Artificial Sequence
  Synthetic
cttatatcctucctgtttcttttcuggca

SEQ ID NO: 45040 - DNA, 23 bp, Artificial Sequence
  Synthetic
aatgtaatgaggugctcgtccug

SEQ ID NO: 45041 - DNA, 24 bp, Artificial Sequence
  Synthetic
cactcagtcuacgttgacucacat

SEQ ID NO: 45042 - DNA, 24 bp, Artificial Sequence
  Synthetic
ggccuaggaacaggaagacuacat

SEQ ID NO: 45043 - DNA, 22 bp, Artificial Sequence
  Synthetic
gctttgccuccttcctggauag

SEQ ID NO: 45044 - DNA, 22 bp, Artificial Sequence
  Synthetic
acagcacacagggautgaacug

SEQ ID NO: 45045 - DNA, 23 bp, Artificial Sequence
  Synthetic
gactgttcagugattggtcucct

SEQ ID NO: 45046 - DNA, 20 bp, Artificial Sequence
  Synthetic
gccccaucatgctgcauagg

SEQ ID NO: 45047 - DNA, 25 bp, Artificial Sequence
  Synthetic
gcactggatugagtctaccttcuct

SEQ ID NO: 45048 - DNA, 23 bp, Artificial Sequence
  Synthetic
gggatctcccutgaggtcaucat

SEQ ID NO: 45049 - DNA, 24 bp, Artificial Sequence
  Synthetic
caattcaugggagcctgtcattug

SEQ ID NO: 45050 - DNA, 23 bp, Artificial Sequence
  Synthetic
caggtaguactgtagcuccccat

SEQ ID NO: 45051 - DNA, 28 bp, Artificial Sequence
  Synthetic
gcagatcagagguctagttctgtaaugt

SEQ ID NO: 45052 - DNA, 23 bp, Artificial Sequence
  Synthetic
agcaaacauggcacaaactugac

SEQ ID NO: 45053 - DNA, 22 bp, Artificial Sequence
  Synthetic
cctcatccccggutctttgtuc

SEQ ID NO: 45054 - DNA, 29 bp, Artificial Sequence
  Synthetic
caatcttccccaautattggtgaaucaaa

SEQ ID NO: 45055 - DNA, 28 bp, Artificial Sequence
  Synthetic
gcctcatttgtcuaactgttgaactuct

SEQ ID NO: 45056 - DNA, 22 bp, Artificial Sequence
  Synthetic
gtcaacacguagaaagguggct

SEQ ID NO: 45057 - DNA, 26 bp, Artificial Sequence
  Synthetic
ggtaatttctgucctccaattccgua

SEQ ID NO: 45058 - DNA, 22 bp, Artificial Sequence
  Synthetic
ccaguatcctcugcaggaaagt

SEQ ID NO: 45059 - DNA, 22 bp, Artificial Sequence
  Synthetic
gtgaauaggcgttctcauccct

SEQ ID NO: 45060 - DNA, 27 bp, Artificial Sequence
  Synthetic
tgaaacaaggcuacattttggtcaaug

SEQ ID NO: 45061 - DNA, 24 bp, Artificial Sequence
  Synthetic
cactttauggccaataaacgcugt

SEQ ID NO: 45062 - DNA, 22 bp, Artificial Sequence
  Synthetic
gccgagcaagugagtttuccat

SEQ ID NO: 45063 - DNA, 30 bp, Artificial Sequence; identical to SEQ ID NO: 32829
  Synthetic

SEQ ID NO: 45064 - DNA, 24 bp, Artificial Sequence
  Synthetic
aaaagaaacaagcacutaggcugt

SEQ ID NO: 45065 - DNA, 24 bp, Artificial Sequence
  Synthetic
ttaatggtggugttacctgctcuc

SEQ ID NO: 45066 - DNA, 24 bp, Artificial Sequence
  Synthetic
aaaaugcatcaataucccgagggt

SEQ ID NO: 45067 - DNA, 25 bp, Artificial Sequence
  Synthetic
gtgggctauggattgtcaaguagaa

SEQ ID NO: 45068 - DNA, 27 bp, Artificial Sequence
  Synthetic
ctagagagcutgtttacacuagaaggg

SEQ ID NO: 45069 - DNA, 28 bp, Artificial Sequence
  Synthetic
gccctctttttcuaatccttcattgtut

SEQ ID NO: 45070 - DNA, 21 bp, Artificial Sequence
  Synthetic
ccaggtucactagcacauggt

SEQ ID NO: 45071 - DNA, 29 bp, Artificial Sequence
  Synthetic
cgttctcaatatuggttggttgtttctug

SEQ ID NO: 45072 - DNA, 21 bp, Artificial Sequence
  Synthetic
acctcatagguctcccgaguc

SEQ ID NO: 45073 - DNA, 27 bp, Artificial Sequence
  Synthetic
gttctgccautcaatatcacatugcat

SEQ ID NO: 45074 - DNA, 22 bp, Artificial Sequence
  Synthetic
cgttgagccutgtctcccauac

SEQ ID NO: 45075 - DNA, 22 bp, Artificial Sequence
  Synthetic
cctgctcaugtcaaagctucaa

SEQ ID NO: 45076 - DNA, 17 bp, Artificial Sequence
  Synthetic
gcttggcuccgccacuc

SEQ ID NO: 45077 - DNA, 18 bp, Artificial Sequence
  Synthetic
gggcgcacucacctcuac

SEQ ID NO: 45078 - DNA, 22 bp, Artificial Sequence
  Synthetic
agtgctctcucttcttggccua

SEQ ID NO: 45079 - DNA, 21 bp, Artificial Sequence
  Synthetic
ggataacagcggugtgtgguc

SEQ ID NO: 45080 - DNA, 21 bp, Artificial Sequence
  Synthetic
tgtcgaaucaaagccccuacc

SEQ ID NO: 45081 - DNA, 22 bp, Artificial Sequence
  Synthetic
gtaatugcatgatgugccccaa

SEQ ID NO: 45082 - DNA, 28 bp, Artificial Sequence
  Synthetic
ctatcacagcauatgacaaagaagtuga

SEQ ID NO: 45083 - DNA, 22 bp, Artificial Sequence
  Synthetic
ggactctgguctgtggactuac

SEQ ID NO: 45084 - DNA, 26 bp, Artificial Sequence
  Synthetic
cauagaattgtagugaacagcagcct

SEQ ID NO: 45085 - DNA, 20 bp, Artificial Sequence
  Synthetic
gagcctagccutgctgctua

SEQ ID NO: 45086 - DNA, 24 bp, Artificial Sequence
  Synthetic
cctgacatucccaccaccttacua

SEQ ID NO: 45087 - DNA, 25 bp, Artificial Sequence
  Synthetic
ttcattcaugcaggaaacaccaaug

SEQ ID NO: 45088 - DNA, 22 bp, Artificial Sequence
  Synthetic
tctgtgtgugctttgtggtuct

SEQ ID NO: 45089 - DNA, 26 bp, Artificial Sequence
  Synthetic
tcgtgctcttcuagggtttagactua

SEQ ID NO: 45090 - DNA, 24 bp, Artificial Sequence
  Synthetic
tcaaacccaugactggtctatugg

SEQ ID NO: 45091 - DNA, 26 bp, Artificial Sequence
  Synthetic
gcaaacattttuagctgggagactua

SEQ ID NO: 45092 - DNA, 28 bp, Artificial Sequence
  Synthetic
attatcaagugaaagaaaacacgcugac

SEQ ID NO: 45093 - DNA, 28 bp, Artificial Sequence
  Synthetic
aaactgctacctucttatcccacattut

SEQ ID NO: 45094 - DNA, 24 bp, Artificial Sequence
  Synthetic
ttcctgaccugggtttuagagaac

SEQ ID NO: 45095 - DNA, 23 bp, Artificial Sequence
  Synthetic
actcctgcauttctcggaaguac

SEQ ID NO: 45096 - DNA, 23 bp, Artificial Sequence
  Synthetic
ggcagaaacugcttgcaagttut

SEQ ID NO: 45097 - DNA, 21 bp, Artificial Sequence
  Synthetic
ccaaacccutccaggauagcc

SEQ ID NO: 45098 - DNA, 22 bp, Artificial Sequence
  Synthetic
gctttguggaaaggcttgcauc

SEQ ID NO: 45099 - DNA, 23 bp, Artificial Sequence
  Synthetic
caugcagagtauggaagggagac

SEQ ID NO: 45100 - DNA, 28 bp, Artificial Sequence
  Synthetic
caagcagacgutatttacgtcaauacac

SEQ ID NO: 45101 - DNA, 24 bp, Artificial Sequence
  Synthetic
agtcagatcutcccattccucact

SEQ ID NO: 45102 - DNA, 24 bp, Artificial Sequence
  Synthetic
cgatgaacutttgtttgcugacga

SEQ ID NO: 45103 - DNA, 28 bp, Artificial Sequence
  Synthetic
gacagcttactuaacaacattcatcugg

SEQ ID NO: 45104 - DNA, 23 bp, Artificial Sequence
  Synthetic
gctaagcucagctcattttcugc

SEQ ID NO: 45105 - DNA, 23 bp, Artificial Sequence
  Synthetic
aaaccacctuagggagactcugt

SEQ ID NO: 45106 - DNA, 21 bp, Artificial Sequence
  Synthetic
cctcgauggcactttucacct

SEQ ID NO: 45107 - DNA, 29 bp, Artificial Sequence
  Synthetic
ggacaataattcucatgcatggatttcut

SEQ ID NO: 45108 - DNA, 24 bp, Artificial Sequence
  Synthetic
tgtgttgaugacgatgacagugat

SEQ ID NO: 45109 - DNA, 25 bp, Artificial Sequence
  Synthetic
ccagatggguagttgtgggatttut

SEQ ID NO: 45110 - DNA, 25 bp, Artificial Sequence
  Synthetic
gatgacgtugacgatgaaguagagg

SEQ ID NO: 45111 - DNA, 25 bp, Artificial Sequence
  Synthetic
ttccaaaccucacttcctttcucag

SEQ ID NO: 45112 - DNA, 23 bp, Artificial Sequence
  Synthetic
gctgcagutctgttcaucaaagg

SEQ ID NO: 45113 - DNA, 27 bp, Artificial Sequence
  Synthetic
gccattttccucttttatcccaatugt

SEQ ID NO: 45114 - DNA, 29 bp, Artificial Sequence
  Synthetic
ccagatcttttcugaaggaatgtgaatut

SEQ ID NO: 45115 - DNA, 26 bp, Artificial Sequence
  Synthetic
gtcaatactgaautcccatgcacauc

SEQ ID NO: 45116 - DNA, 29 bp, Artificial Sequence
  Synthetic
ttggtatatatcccugttacccatatuga

SEQ ID NO: 45117 - DNA, 26 bp, Artificial Sequence
  Synthetic
ctctctcccccauaaaaatgatccut

SEQ ID NO: 45118 - DNA, 22 bp, Artificial Sequence
  Synthetic
cctccagcacuttagccucaaa

SEQ ID NO: 45119 - DNA, 23 bp, Artificial Sequence
  Synthetic
acaauagctctagugagccgact

SEQ ID NO: 45120 - DNA, 29 bp, Artificial Sequence
  Synthetic
agtcagatccaaautcattccctaaacuc

SEQ ID NO: 45121 - DNA, 22 bp, Artificial Sequence
  Synthetic
gtgagccuaccccagaaguaac

SEQ ID NO: 45122 - DNA, 27 bp, Artificial Sequence
  Synthetic
ctaaagacuacaccatgttactuggct

SEQ ID NO: 45123 - DNA, 27 bp, Artificial Sequence
  Synthetic
catgacugagatgaaattugcaagcat

SEQ ID NO: 45124 - DNA, 26 bp, Artificial Sequence
  Synthetic
aaggcttctuagagttttctgtgcut

SEQ ID NO: 45125 - DNA, 26 bp, Artificial Sequence
  Synthetic
cgacaguggaaagtacacaatuaagg

SEQ ID NO: 45126 - DNA, 28 bp, Artificial Sequence
  Synthetic
agaaatgttgaagutcttcagatgugga

SEQ ID NO: 45127 - DNA, 28 bp, Artificial Sequence
  Synthetic
cttcatcucacagcctagatcucaaaat

SEQ ID NO: 45128 - DNA, 23 bp, Artificial Sequence
  Synthetic
ccttcatctcugtgactggctug

SEQ ID NO: 45129 - DNA, 28 bp, Artificial Sequence
  Synthetic
tcagaactcatgcugagattaaagcaut

SEQ ID NO: 45130 - DNA, 23 bp, Artificial Sequence
  Synthetic
gaagcttccuctttgagggcuaa

SEQ ID NO: 45131 - DNA, 30 bp, Artificial Sequence; identical to SEQ ID NO: 32897
  Synthetic

SEQ ID NO: 45132 - DNA, 30 bp, Artificial Sequence; identical to SEQ ID NO: 32898
  Synthetic

SEQ ID NO: 45133 - DNA, 25 bp, Artificial Sequence
  Synthetic
aaccaaaagcucctgaaccaattuc

SEQ ID NO: 45134 - DNA, 29 bp, Artificial Sequence
  Synthetic
gccccataaatugtaagttggtttuagac

SEQ ID NO: 45135 - DNA, 24 bp, Artificial Sequence
  Synthetic
cctgtgtggutgaaagcagtguat

SEQ ID NO: 45136 - DNA, 24 bp, Artificial Sequence
  Synthetic
gggtgagaaggutctggagattuc

SEQ ID NO: 45137 - DNA, 23 bp, Artificial Sequence
  Synthetic
gagatctctucagtccaggctuc

SEQ ID NO: 45138 - DNA, 20 bp, Artificial Sequence
  Synthetic
cctcguagacggtcauggac

SEQ ID NO: 45139 - DNA, 24 bp, Artificial Sequence
  Synthetic
atctgagauggaagcttcgtctuc

SEQ ID NO: 45140 - DNA, 22 bp, Artificial Sequence
  Synthetic
cgttgcatagucagaagctucg

SEQ ID NO: 45141 - DNA, 22 bp, Artificial Sequence
  Synthetic
ccatguggccaaaatacacgut

SEQ ID NO: 45142 - DNA, 28 bp, Artificial Sequence
  Synthetic
ctttcatggacucataccuggaaaagat

SEQ ID NO: 45143 - DNA, 23 bp, Artificial Sequence
  Synthetic
cgctccctguctccaacttauat

SEQ ID NO: 45144 - DNA, 24 bp, Artificial Sequence
  Synthetic
ctttgacaugaagtcaagtucgct

SEQ ID NO: 45145 - DNA, 28 bp, Artificial Sequence
  Synthetic
ggaggaaauaagaaaagacutcagguat

SEQ ID NO: 45146 - DNA, 29 bp, Artificial Sequence
  Synthetic
ctctcttcctcugttcttttcattgcuaa

SEQ ID NO: 45147 - DNA, 24 bp, Artificial Sequence
  Synthetic
ggcgtatucctaaactgucccaag

SEQ ID NO: 45148 - DNA, 23 bp, Artificial Sequence
  Synthetic
gggtcgttuctgtacaactcugt

SEQ ID NO: 45149 - DNA, 30 bp, Artificial Sequence; identical to SEQ ID NO: 32915
  Synthetic

SEQ ID NO: 45150 - DNA, 26 bp, Artificial Sequence
  Synthetic
agaatttcagccautctgagggttut

SEQ ID NO: 45151 - DNA, 24 bp, Artificial Sequence
  Synthetic
ggcttggautattatgctcugcac

SEQ ID NO: 45152 - DNA, 23 bp, Artificial Sequence
  Synthetic
gccagtaaccutttgaacauggg

SEQ ID NO: 45153 - DNA, 24 bp, Artificial Sequence
  Synthetic
aggtcagaaaaucaaaccagguga

SEQ ID NO: 45154 - DNA, 23 bp, Artificial Sequence
  Synthetic
tcattgtgtcugttctgcgctua

SEQ ID NO: 45155 - DNA, 27 bp, Artificial Sequence
  Synthetic
gagaacagugagaaatacgaaaucacc

SEQ ID NO: 45156 - DNA, 26 bp, Artificial Sequence
  Synthetic
caatggaugccactttaacttuagca

SEQ ID NO: 45157 - DNA, 22 bp, Artificial Sequence
  Synthetic
gaaatctcgcaugacagcaucg

SEQ ID NO: 45158 - DNA, 21 bp, Artificial Sequence
  Synthetic
agccaggaaugggttgauacc

SEQ ID NO: 45159 - DNA, 30 bp, Artificial Sequence; identical to SEQ ID NO: 32925
  Synthetic

SEQ ID NO: 45160 - DNA, 30 bp, Artificial Sequence; identical to SEQ ID NO: 32926
  Synthetic

SEQ ID NO: 45161 - DNA, 27 bp, Artificial Sequence
  Synthetic
ctcaaagaagacauacatggccaaaut

SEQ ID NO: 45162 - DNA, 25 bp, Artificial Sequence
  Synthetic
gatgctttagucatggagactuccc

SEQ ID NO: 45163 - DNA, 22 bp, Artificial Sequence
  Synthetic
gaaagatggcuccgtguaggac

SEQ ID NO: 45164 - DNA, 21 bp, Artificial Sequence
  Synthetic
ggucaggaacaucagccacat

SEQ ID NO: 45165 - DNA, 23 bp, Artificial Sequence
  Synthetic
ccuggcagaaaggauaagatcuc

SEQ ID NO: 45166 - DNA, 25 bp, Artificial Sequence
  Synthetic
ctccacccccaagutaataacucat

SEQ ID NO: 45167 - DNA, 29 bp, Artificial Sequence
  Synthetic
ggcaaagaaatcautgcagatggatuaaa

SEQ ID NO: 45168 - DNA, 23 bp, Artificial Sequence
  Synthetic
ttcctcttuaaagtgtggugcct

SEQ ID NO: 45169 - DNA, 29 bp, Artificial Sequence
  Synthetic
cgtgagaagaaguagaauaaatggattuc

SEQ ID NO: 45170 - DNA, 28 bp, Artificial Sequence
  Synthetic
tgcaaagauggaactttaccauaggaag

SEQ ID NO: 45171 - DNA, 22 bp, Artificial Sequence
  Synthetic
ggtgtctucagccatctcagug

SEQ ID NO: 45172 - DNA, 27 bp, Artificial Sequence
  Synthetic
gggaaaatacaautgtggtggtttuca

SEQ ID NO: 45173 - DNA, 25 bp, Artificial Sequence
  Synthetic
cgtaagactcaugctgggaaauaca

SEQ ID NO: 45174 - DNA, 21 bp, Artificial Sequence
  Synthetic
ccauggaaccaagtcauggca

SEQ ID NO: 45175 - DNA, 26 bp, Artificial Sequence
  Synthetic
ccaatgaggutggagaaguagaaacc

SEQ ID NO: 45176 - DNA, 23 bp, Artificial Sequence
  Synthetic
ttccggcttugtatgagctctut

SEQ ID NO: 45177 - DNA, 31 bp, Artificial Sequence; identical to SEQ ID NO: 32943
  Synthetic

SEQ ID NO: 45178 - DNA, 27 bp, Artificial Sequence
  Synthetic
gtgaattgcttguccttaatacgtucc

SEQ ID NO: 45179 - DNA, 28 bp, Artificial Sequence
  Synthetic
ccagtaaagcugactcccttttcatuat

SEQ ID NO: 45180 - DNA, 23 bp, Artificial Sequence
  Synthetic
ttgtggtggugatctgagtctug

SEQ ID NO: 45181 - DNA, 28 bp, Artificial Sequence
  Synthetic
gggactgtattcuaatacatgtgtgcut

SEQ ID NO: 45182 - DNA, 26 bp, Artificial Sequence
  Synthetic
tgctgaaacacggaaauggtattcua

SEQ ID NO: 45183 - DNA, 23 bp, Artificial Sequence
  Synthetic
agaagggccacuggaatatgaug

SEQ ID NO: 45184 - DNA, 25 bp, Artificial Sequence
  Synthetic
cagtgtgtguttcagatgtugcaat

SEQ ID NO: 45185 - DNA, 22 bp, Artificial Sequence
  Synthetic
cttagtcccccuaccccaaaug

SEQ ID NO: 45186 - DNA, 23 bp, Artificial Sequence
  Synthetic
ctctcgaatcutggttggagugg

SEQ ID NO: 45187 - DNA, 29 bp, Artificial Sequence
  Synthetic
caactttgcagcaacuttaaccagtauat

SEQ ID NO: 45188 - DNA, 20 bp, Artificial Sequence
  Synthetic
ggagcgguaccgtgtcatug

SEQ ID NO: 45189 - DNA, 23 bp, Artificial Sequence
  Synthetic
tcgtgttaaccuctgtcttgcug

SEQ ID NO: 45190 - DNA, 22 bp, Artificial Sequence
  Synthetic
gatgagcgucacgttgttcuac

SEQ ID NO: 45191 - DNA, 30 bp, Artificial Sequence; identical to SEQ ID NO: 32957
  Synthetic

SEQ ID NO: 45192 - DNA, 26 bp, Artificial Sequence
  Synthetic
gtggtttcacggauggttaattuagc

SEQ ID NO: 45193 - DNA, 26 bp, Artificial Sequence
  Synthetic
aatgcctgattuctttcccatagugt

SEQ ID NO: 45194 - DNA, 25 bp, Artificial Sequence
  Synthetic
gtgctctaggacugtgggtttuaag

SEQ ID NO: 45195 - DNA, 23 bp, Artificial Sequence
  Synthetic
gcatuggagaaccttgugaaaca

SEQ ID NO: 45196 - DNA, 27 bp, Artificial Sequence
  Synthetic
tctcaacgaugtaattgttgacuggag

SEQ ID NO: 45197 - DNA, 27 bp, Artificial Sequence
  Synthetic
tgatcacctctcuagaaaggaactaug

SEQ ID NO: 45198 - DNA, 22 bp, Artificial Sequence
  Synthetic
tgagtagctcucagtggtguca

SEQ ID NO: 45199 - DNA, 26 bp, Artificial Sequence
  Synthetic
tttcttctcacaccugtccatgaaut

SEQ ID NO: 45200 - DNA, 23 bp, Artificial Sequence
  Synthetic
gcaattgatucgctgtatucgct

SEQ ID NO: 45201 - DNA, 28 bp, Artificial Sequence
  Synthetic
ggtactgacatugtaggatatgttcugg

SEQ ID NO: 45202 - DNA, 30 bp, Artificial Sequence; identical to SEQ ID NO: 32968
  Synthetic

SEQ ID NO: 45203 - DNA, 24 bp, Artificial Sequence
  Synthetic
atggagggtugtgattaccagtuc

SEQ ID NO: 45204 - DNA, 26 bp, Artificial Sequence
  Synthetic
tgatttcatugccaccatcagatuca

SEQ ID NO: 45205 - DNA, 23 bp, Artificial Sequence
  Synthetic
gaagggagaaggguagucttauc

SEQ ID NO: 45206 - DNA, 23 bp, Artificial Sequence
  Synthetic
gttcttgaugagcctgguaacga

SEQ ID NO: 45207 - DNA, 24 bp, Artificial Sequence
  Synthetic
ggcttgtcautacacctgttucag

SEQ ID NO: 45208 - DNA, 21 bp, Artificial Sequence
  Synthetic
cagttgcucgtttgccaguat

SEQ ID NO: 45209 - DNA, 29 bp, Artificial Sequence
  Synthetic
ttcattcatatcugttttgcctacugaca

SEQ ID NO: 45210 - DNA, 25 bp, Artificial Sequence
  Synthetic
gctaacacacggaacucataagugt

SEQ ID NO: 45211 - DNA, 28 bp, Artificial Sequence
  Synthetic
agatcaacagtaucactgatttggtcug

SEQ ID NO: 45212 - DNA, 28 bp, Artificial Sequence
  Synthetic
agttctgaactgauattccagtcctuct

SEQ ID NO: 45213 - DNA, 19 bp, Artificial Sequence
  Synthetic
gcgctccuaccagaccuga

SEQ ID NO: 45214 - DNA, 22 bp, Artificial Sequence
  Synthetic
ctggaatugacaagcugccaag

SEQ ID NO: 45215 - DNA, 25 bp, Artificial Sequence
  Synthetic
ccctggaaaauacagctggtgtuaa

SEQ ID NO: 45216 - DNA, 22 bp, Artificial Sequence
  Synthetic
caggacgaccacugattgguac

SEQ ID NO: 45217 - DNA, 26 bp, Artificial Sequence
  Synthetic
gtagagcgtcutgttgagaaaacuga

SEQ ID NO: 45218 - DNA, 23 bp, Artificial Sequence
  Synthetic
tggtcaggtutaagccaagcuaa

SEQ ID NO: 45219 - DNA, 24 bp, Artificial Sequence
  Synthetic
ggcaggttaucagtgaaaaaugca

SEQ ID NO: 45220 - DNA, 22 bp, Artificial Sequence
  Synthetic
gcctggagugtctagcacttuc

SEQ ID NO: 45221 - DNA, 24 bp, Artificial Sequence
  Synthetic
gcaaaccagacuctaacctuagcc

SEQ ID NO: 45222 - DNA, 26 bp, Artificial Sequence
  Synthetic
acaacatgaguctgtttgaagttugc

SEQ ID NO: 45223 - DNA, 22 bp, Artificial Sequence
  Synthetic
acutaggagacuggcacaaggt

SEQ ID NO: 45224 - DNA, 22 bp, Artificial Sequence
  Synthetic
ggttgacgggcuctctacatut

SEQ ID NO: 45225 - DNA, 29 bp, Artificial Sequence
  Synthetic
ggcagtgaaatucaacagtatatcctuga

SEQ ID NO: 45226 - DNA, 26 bp, Artificial Sequence
  Synthetic
acataguaccgcttaguaaaaacgca

SEQ ID NO: 45227 - DNA, 27 bp, Artificial Sequence
  Synthetic
cuacatcatugaaaaaugggaaaccag

SEQ ID NO: 45228 - DNA, 28 bp, Artificial Sequence
  Synthetic
ctagagttagtutctttttccttgucca

SEQ ID NO: 45229 - DNA, 25 bp, Artificial Sequence
  Synthetic
ttggauccaccagcctatttgtuag

SEQ ID NO: 45230 - DNA, 26 bp, Artificial Sequence
  Synthetic
tggtcttcctugtaccaaagcttuaa

SEQ ID NO: 45231 - DNA, 27 bp, Artificial Sequence
  Synthetic
ccttgtgatauggcactacugaaaaat

SEQ ID NO: 45232 - DNA, 23 bp, Artificial Sequence
  Synthetic
tgacgtcaguaaagttgcatcuc

SEQ ID NO: 45233 - DNA, 28 bp, Artificial Sequence
  Synthetic
gacctggttacaaaugtaatgatgcaut

SEQ ID NO: 45234 - DNA, 27 bp, Artificial Sequence
  Synthetic
tcagcatauacacggaattggtaaucc

SEQ ID NO: 45235 - DNA, 24 bp, Artificial Sequence
  Synthetic
cccccaggaaagucagutatauac

SEQ ID NO: 45236 - DNA, 22 bp, Artificial Sequence
  Synthetic
gtcgttcuggcaacactugaac

SEQ ID NO: 45237 - DNA, 27 bp, Artificial Sequence
  Synthetic
gataatgcagtgugtagaattgcaguc

SEQ ID NO: 45238 - DNA, 23 bp, Artificial Sequence
  Synthetic
ctgatggauggtttgggtttucc

SEQ ID NO: 45239 - DNA, 22 bp, Artificial Sequence
  Synthetic
agtcagucctggagtucagagt

SEQ ID NO: 45240 - DNA, 22 bp, Artificial Sequence
  Synthetic
gtccagcugaggatgacagaug

SEQ ID NO: 45241 - DNA, 23 bp, Artificial Sequence
  Synthetic
ccaagagaacauggtctgtcgug

SEQ ID NO: 45242 - DNA, 22 bp, Artificial Sequence
  Synthetic
agctggtgugtcaagcacttua

SEQ ID NO: 45243 - DNA, 28 bp, Artificial Sequence
  Synthetic
ctgtcacauggagaaaagaugagaagaa

SEQ ID NO: 45244 - DNA, 28 bp, Artificial Sequence
  Synthetic
aaaaagagtgatutcctggaagtaugct

SEQ ID NO: 45245 - DNA, 26 bp, Artificial Sequence
  Synthetic
caacctgaaaccuggagtcaatuact

SEQ ID NO: 45246 - DNA, 24 bp, Artificial Sequence
  Synthetic
ccatcauagacaggcttacuccag

SEQ ID NO: 45247 - DNA, 22 bp, Artificial Sequence
  Synthetic
gcagcatctucacctgtgtcut

SEQ ID NO: 45248 - DNA, 24 bp, Artificial Sequence
  Synthetic
tttttgtctggugtcacggauagt

SEQ ID NO: 45249 - DNA, 28 bp, Artificial Sequence
  Synthetic
ttgtaccttgtttucccttcctttcuaa

SEQ ID NO: 45250 - DNA, 27 bp, Artificial Sequence
  Synthetic
aattttggtggtugtaatgatgcacuc

SEQ ID NO: 45251 - DNA, 27 bp, Artificial Sequence
  Synthetic
acatcgtgttttgucctttcactgaua

SEQ ID NO: 45252 - DNA, 23 bp, Artificial Sequence
  Synthetic
agcccatggcautccttagttut

SEQ ID NO: 45253 - DNA, 23 bp, Artificial Sequence
  Synthetic
caggtacauctgtgaagcucaga

SEQ ID NO: 45254 - DNA, 25 bp, Artificial Sequence
  Synthetic
aaccaggaaaagguatgcggaaaua

SEQ ID NO: 45255 - DNA, 27 bp, Artificial Sequence
  Synthetic
agcttcaccaaugttactgaaacucaa

SEQ ID NO: 45256 - DNA, 23 bp, Artificial Sequence
  Synthetic
gagaagcagautagcggcactua

SEQ ID NO: 45257 - DNA, 30 bp, Artificial Sequence; identical to SEQ ID NO: 33023
  Synthetic

SEQ ID NO: 45258 - DNA, 26 bp, Artificial Sequence
  Synthetic
actgtttcugtctttcattuccaggt

SEQ ID NO: 45259 - DNA, 28 bp, Artificial Sequence
  Synthetic
ccaacttttcaaagauccaggttttcut

SEQ ID NO: 45260 - DNA, 23 bp, Artificial Sequence
  Synthetic
ttttctgcctugatgcggaatug

SEQ ID NO: 45261 - DNA, 30 bp, Artificial Sequence; identical to SEQ ID NO: 33027
  Synthetic

SEQ ID NO: 45262 - DNA, 27 bp, Artificial Sequence
  Synthetic
caggttctcagcaguaatttcggtaut

SEQ ID NO: 45263 - DNA, 31 bp, Artificial Sequence; identical to SEQ ID NO: 33029
  Synthetic

SEQ ID NO: 45264 - DNA, 22 bp, Artificial Sequence
  Synthetic
gccacugcacattuaacccagt

SEQ ID NO: 45265 - DNA, 28 bp, Artificial Sequence
  Synthetic
gaagagtgcacauttaaaagtgctguaa

SEQ ID NO: 45266 - DNA, 21 bp, Artificial Sequence
  Synthetic
ggagaggcggutacagttgut

SEQ ID NO: 45267 - DNA, 24 bp, Artificial Sequence
  Synthetic
aatgttttgagugctgcttcacug

SEQ ID NO: 45268 - DNA, 23 bp, Artificial Sequence
  Synthetic
ggcttacuccacaagacatuggg

SEQ ID NO: 45269 - DNA, 27 bp, Artificial Sequence
  Synthetic
acaacaggagcugaatatgtttucaga

SEQ ID NO: 45270 - DNA, 21 bp, Artificial Sequence
  Synthetic
cggctuaacccaggcaauagt

SEQ ID NO: 45271 - DNA, 28 bp, Artificial Sequence
  Synthetic
gacttcgggaaggaugtgaatatgaaua

SEQ ID NO: 45272 - DNA, 26 bp, Artificial Sequence
  Synthetic
ttgaccagcaaagugtcatagatuct

SEQ ID NO: 45273 - DNA, 27 bp, Artificial Sequence
  Synthetic
gcatggacaataugtgaaggagagtua

SEQ ID NO: 45274 - DNA, 23 bp, Artificial Sequence
  Synthetic
tggtggaccaggcutatcaagua

SEQ ID NO: 45275 - DNA, 22 bp, Artificial Sequence
  Synthetic
cgacctcugccagtaattucct

SEQ ID NO: 45276 - DNA, 22 bp, Artificial Sequence
  Synthetic
cagtggatucagatggcucact

SEQ ID NO: 45277 - DNA, 27 bp, Artificial Sequence
  Synthetic
agtgtcacutaaatggtcuaaaccaca

SEQ ID NO: 45278 - DNA, 28 bp, Artificial Sequence
  Synthetic
acacgatactcauacatcagtcctucat

SEQ ID NO: 45279 - DNA, 23 bp, Artificial Sequence
  Synthetic
cctggtacucctaaagttgugca

SEQ ID NO: 45280 - DNA, 23 bp, Artificial Sequence
  Synthetic
gatgttctugcaactgcttguga

SEQ ID NO: 45281 - DNA, 31 bp, Artificial Sequence; identical to SEQ ID NO: 33047
  Synthetic

SEQ ID NO: 45282 - DNA, 28 bp, Artificial Sequence
  Synthetic
tctagttgtcuctttaagagtcugacca

SEQ ID NO: 45283 - DNA, 23 bp, Artificial Sequence
  Synthetic
gtcttcaggguagctgcagtuaa

SEQ ID NO: 45284 - DNA, 26 bp, Artificial Sequence
  Synthetic
acttttcactcccuttagtctgcaut

SEQ ID NO: 45285 - DNA, 22 bp, Artificial Sequence
  Synthetic
ctacttccgagucttggctucc

SEQ ID NO: 45286 - DNA, 22 bp, Artificial Sequence
  Synthetic
aataaguggtggtucccaggac

SEQ ID NO: 45287 - DNA, 27 bp, Artificial Sequence
  Synthetic
cagctcattuacaatgttggtgatuga

SEQ ID NO: 45288 - DNA, 23 bp, Artificial Sequence
  Synthetic
cagaacgaccaccuttcugagat

SEQ ID NO: 45289 - DNA, 26 bp, Artificial Sequence
  Synthetic
caacaggatuacaaggaaagcagtuc

SEQ ID NO: 45290 - DNA, 24 bp, Artificial Sequence
  Synthetic
ggagacagaagauctggaagtguc

SEQ ID NO: 45291 - DNA, 24 bp, Artificial Sequence
  Synthetic
gauggaccaagugcaacaagaaaa

SEQ ID NO: 45292 - DNA, 22 bp, Artificial Sequence
  Synthetic
gaggaccuggtggcttauaagg

SEQ ID NO: 45293 - DNA, 21 bp, Artificial Sequence
  Synthetic
gactctctuggacccaggtut

SEQ ID NO: 45294 - DNA, 22 bp, Artificial Sequence
  Synthetic
cctggcctgucaagtaccttua

SEQ ID NO: 45295 - DNA, 29 bp, Artificial Sequence
  Synthetic
ctgatgttgtutggtcaaaagauggaaaa

SEQ ID NO: 45296 - DNA, 24 bp, Artificial Sequence
  Synthetic
ggcaccacuactatcagatggtuc

SEQ ID NO: 45297 - DNA, 23 bp, Artificial Sequence
  Synthetic
actgaaauggaagaaaccugcct

SEQ ID NO: 45298 - DNA, 26 bp, Artificial Sequence
  Synthetic
ccaaugccaacaatatttucagcaga

SEQ ID NO: 45299 - DNA, 24 bp, Artificial Sequence
  Synthetic
gtgaatgauggaggcaccaaaaut

SEQ ID NO: 45300 - DNA, 23 bp, Artificial Sequence
  Synthetic
gggcacttttuccatacctgtut

SEQ ID NO: 45301 - DNA, 26 bp, Artificial Sequence
  Synthetic
tgcagacttugtagtcatatctuggg

SEQ ID NO: 45302 - DNA, 30 bp, Artificial Sequence; identical to SEQ ID NO: 33068
  Synthetic

SEQ ID NO: 45303 - DNA, 28 bp, Artificial Sequence
  Synthetic
acacatataguatccaagcuggagaaga

SEQ ID NO: 45304 - DNA, 29 bp, Artificial Sequence
  Synthetic
attataagcctugacacggaactgataut

SEQ ID NO: 45305 - DNA, 22 bp, Artificial Sequence
  Synthetic
ctuccccaucaggaaaggtuac

SEQ ID NO: 45306 - DNA, 28 bp, Artificial Sequence
  Synthetic
aacttgttttgcugcatttactacucac

SEQ ID NO: 45307 - DNA, 24 bp, Artificial Sequence
  Synthetic
ggaaaacagcaguggatcaaaguc

SEQ ID NO: 45308 - DNA, 24 bp, Artificial Sequence
  Synthetic
gttggacgaccuttgaatggaaug

SEQ ID NO: 45309 - DNA, 30 bp, Artificial Sequence; identical to SEQ ID NO: 33075
  Synthetic

SEQ ID NO: 45310 - DNA, 21 bp, Artificial Sequence
  Synthetic
gttuaccccaggcaagtguga

SEQ ID NO: 45311 - DNA, 23 bp, Artificial Sequence
  Synthetic
gccgcatuacagatttgcgtcua

SEQ ID NO: 45312 - DNA, 28 bp, Artificial Sequence
  Synthetic
gcaatatttgtgacutccaagcttttug

SEQ ID NO: 45313 - DNA, 21 bp, Artificial Sequence
  Synthetic
gagaaaccagucgactugcct

SEQ ID NO: 45314 - DNA, 28 bp, Artificial Sequence
  Synthetic
tggaggtcctgguctatctaatacttut

SEQ ID NO: 45315 - DNA, 30 bp, Artificial Sequence; identical to SEQ ID NO: 33081
  Synthetic

SEQ ID NO: 45316 - DNA, 26 bp, Artificial Sequence
  Synthetic
ttggatccautgaaattctugggagt

SEQ ID NO: 45317 - DNA, 25 bp, Artificial Sequence
  Synthetic
gtagagaaacgugatttgcctgaug

SEQ ID NO: 45318 - DNA, 22 bp, Artificial Sequence
  Synthetic
tcacagggauctctggcuacat

SEQ ID NO: 45319 - DNA, 27 bp, Artificial Sequence
  Synthetic
gutaccaccuggagagaaaagaaagaa

SEQ ID NO: 45320 - DNA, 23 bp, Artificial Sequence
  Synthetic
ggcctggtuctttgtagggauat

SEQ ID NO: 45321 - DNA, 22 bp, Artificial Sequence
  Synthetic
caaccaccacaguatgggaugt

SEQ ID NO: 45322 - DNA, 29 bp, Artificial Sequence
  Synthetic
ccttttggaggaucaggtttatcuagagt

SEQ ID NO: 45323 - DNA, 20 bp, Artificial Sequence
  Synthetic
cuggacgtccuaagccaacc

SEQ ID NO: 45324 - DNA, 27 bp, Artificial Sequence
  Synthetic
aggatcacttcuccccttttcattuac

SEQ ID NO: 45325 - DNA, 23 bp, Artificial Sequence
  Synthetic
gtcaccagaaacagugtctcuct

SEQ ID NO: 45326 - DNA, 24 bp, Artificial Sequence
  Synthetic
ttggagcugatcgatttuccaaga

SEQ ID NO: 45327 - DNA, 26 bp, Artificial Sequence
  Synthetic
tttgttactgugagagttcuggacac

SEQ ID NO: 45328 - DNA, 23 bp, Artificial Sequence
  Synthetic
ctcggattucaccatccacctut

SEQ ID NO: 45329 - DNA, 30 bp, Artificial Sequence; identical to SEQ ID NO: 33095
  Synthetic

SEQ ID NO: 45330 - DNA, 27 bp, Artificial Sequence
  Synthetic
caccaacacucacatcacattttucaa

SEQ ID NO: 45331 - DNA, 24 bp, Artificial Sequence
  Synthetic
gttcagagttuctgctgagaaugc

SEQ ID NO: 45332 - DNA, 23 bp, Artificial Sequence
  Synthetic
cagatgctgguctttcccauaca

SEQ ID NO: 45333 - DNA, 23 bp, Artificial Sequence
  Synthetic
tctcagcugcaaggttacuaagc

SEQ ID NO: 45334 - DNA, 25 bp, Artificial Sequence
  Synthetic
tgtgcattttuctgctgtaacucct

SEQ ID NO: 45335 - DNA, 27 bp, Artificial Sequence
  Synthetic
cacagcucgattagaaauaaagagcac

SEQ ID NO: 45336 - DNA, 23 bp, Artificial Sequence
  Synthetic
tcgtggtggauctacctcatcuc

SEQ ID NO: 45337 - DNA, 27 bp, Artificial Sequence
  Synthetic
tggaagcaagaucactggttatatugt

SEQ ID NO: 45338 - DNA, 22 bp, Artificial Sequence
  Synthetic
ggtcacgagccacauaacatuc

SEQ ID NO: 45339 - DNA, 23 bp, Artificial Sequence
  Synthetic
gccaatcagugatggaggaagua

SEQ ID NO: 45340 - DNA, 25 bp, Artificial Sequence
  Synthetic
tcccatatcugttttcagcugcaat

SEQ ID NO: 45341 - DNA, 26 bp, Artificial Sequence
  Synthetic
ccagttaaaauggatgaagugacagc

SEQ ID NO: 45342 - DNA, 24 bp, Artificial Sequence
  Synthetic
aggcgtcctutattgtcagtagug

SEQ ID NO: 45343 - DNA, 20 bp, Artificial Sequence
  Synthetic
actgagtgugccagtgaucg

SEQ ID NO: 45344 - DNA, 24 bp, Artificial Sequence
  Synthetic
ttggtctgcauctccacaatguag

SEQ ID NO: 45345 - DNA, 28 bp, Artificial Sequence
  Synthetic
cttcaagaaggcugtagctactattuca

SEQ ID NO: 45346 - DNA, 22 bp, Artificial Sequence
  Synthetic
gtcccaugtgagtgugacagat

SEQ ID NO: 45347 - DNA, 24 bp, Artificial Sequence
  Synthetic
agcatcgaauccacaagctctuac

SEQ ID NO: 45348 - DNA, 23 bp, Artificial Sequence
  Synthetic
agutcaatttcuggaggcagcat

SEQ ID NO: 45349 - DNA, 26 bp, Artificial Sequence
  Synthetic
atcactgggtauatggttgagatugc

SEQ ID NO: 45350 - DNA, 24 bp, Artificial Sequence
  Synthetic
agccttgtaaaauggactgguagg

SEQ ID NO: 45351 - DNA, 25 bp, Artificial Sequence
  Synthetic
gattctgatgguggaagtgaaauca

SEQ ID NO: 45352 - DNA, 28 bp, Artificial Sequence
  Synthetic
ccactccatatutatttacagccaugac

SEQ ID NO: 45353 - DNA, 28 bp, Artificial Sequence
  Synthetic
actgaagtgacaucagaaaagtgtguac

SEQ ID NO: 45354 - DNA, 22 bp, Artificial Sequence
  Synthetic
agtcgcugtaagggtauaggca

SEQ ID NO: 45355 - DNA, 29 bp, Artificial Sequence
  Synthetic
cggttatatuaaaagcaggtgaagcatuc

SEQ ID NO: 45356 - DNA, 24 bp, Artificial Sequence
  Synthetic
cgatcacacggaautcataugcag

SEQ ID NO: 45357 - DNA, 26 bp, Artificial Sequence
  Synthetic
cacctggaaaaccaguacctcuaaat

SEQ ID NO: 45358 - DNA, 27 bp, Artificial Sequence
  Synthetic
cacttgatttgaaaaugttgcctggua

SEQ ID NO: 45359 - DNA, 22 bp, Artificial Sequence
  Synthetic
catcagcaugcatagtugccaa

SEQ ID NO: 45360 - DNA, 21 bp, Artificial Sequence
  Synthetic
cagtctgccgcauttccacua

SEQ ID NO: 45361 - DNA, 27 bp, Artificial Sequence
  Synthetic
cctatccatuaacagcaaggaacatug

SEQ ID NO: 45362 - DNA, 22 bp, Artificial Sequence
  Synthetic
cgaccgagcacuggaattucaa

SEQ ID NO: 45363 - DNA, 25 bp, Artificial Sequence
  Synthetic
cgtgaaagggutagaatgtgttgug

SEQ ID NO: 45364 - DNA, 22 bp, Artificial Sequence
  Synthetic
atgttaaggcugtctgguggag

SEQ ID NO: 45365 - DNA, 26 bp, Artificial Sequence
  Synthetic
aatcttatuccacagccaccacuaag

SEQ ID NO: 45366 - DNA, 20 bp, Artificial Sequence
  Synthetic
gcgtguccaagactcugacg

SEQ ID NO: 45367 - DNA, 28 bp, Artificial Sequence
  Synthetic
tggaccaaagauaacatcaaccugaaaa

SEQ ID NO: 45368 - DNA, 21 bp, Artificial Sequence
  Synthetic
gccatcucccgttctacgaut

SEQ ID NO: 45369 - DNA, 23 bp, Artificial Sequence
  Synthetic
ggtggactugaaatcactggcua

SEQ ID NO: 45370 - DNA, 30 bp, Artificial Sequence; identical to SEQ ID NO: 33136
  Synthetic

SEQ ID NO: 45371 - DNA, 22 bp, Artificial Sequence
  Synthetic
cgaattccgugtcagugcagaa

SEQ ID NO: 45372 - DNA, 24 bp, Artificial Sequence
  Synthetic
catcgcaggcutttcttttctcuc

SEQ ID NO: 45373 - DNA, 29 bp, Artificial Sequence
  Synthetic
agggaattgacauggaaacatttauagca

SEQ ID NO: 45374 - DNA, 24 bp, Artificial Sequence
  Synthetic
ccacatgccugcaagactgaauat

SEQ ID NO: 45375 - DNA, 23 bp, Artificial Sequence
  Synthetic
cgaaggtggaacaugtgaaggua

SEQ ID NO: 45376 - DNA, 30 bp, Artificial Sequence; identical to SEQ ID NO: 33142
  Synthetic

SEQ ID NO: 45377 - DNA, 28 bp, Artificial Sequence
  Synthetic
agcctccttccutttctgattaaaaugt

SEQ ID NO: 45378 - DNA, 25 bp, Artificial Sequence
  Synthetic
caaggucagttacaguaaaggcaca

SEQ ID NO: 45379 - DNA, 27 bp, Artificial Sequence
  Synthetic
ctggtatttgttugactggttttgcut

SEQ ID NO: 45380 - DNA, 21 bp, Artificial Sequence
  Synthetic
cttgcccacaccugctaaaut

SEQ ID NO: 45381 - DNA, 27 bp, Artificial Sequence
  Synthetic
cttgatacatcccugggtcttttguag

SEQ ID NO: 45382 - DNA, 30 bp, Artificial Sequence; identical to SEQ ID NO: 33148
  Synthetic

SEQ ID NO: 45383 - DNA, 28 bp, Artificial Sequence
  Synthetic
gaaaaccaccttuagagtaaccagacut

SEQ ID NO: 45384 - DNA, 23 bp, Artificial Sequence
  Synthetic
ggcttctgcugtgacttcaucaa

SEQ ID NO: 45385 - DNA, 26 bp, Artificial Sequence
  Synthetic
gaagatcctcuagcaactgacacuag

SEQ ID NO: 45386 - DNA, 24 bp, Artificial Sequence
  Synthetic
agataagcuagtgagugggacaca

SEQ ID NO: 45387 - DNA, 29 bp, Artificial Sequence
  Synthetic
caacgagttaugaaatccttaagccuaca

SEQ ID NO: 45388 - DNA, 27 bp, Artificial Sequence
  Synthetic
gcaaaggagaaaugataagtguaagcc

SEQ ID NO: 45389 - DNA, 28 bp, Artificial Sequence
  Synthetic
tccaaaacaagcutcagagtagctaaut

SEQ ID NO: 45390 - DNA, 28 bp, Artificial Sequence
  Synthetic
tgaaatagactuaccaagcacttucaca

SEQ ID NO: 45391 - DNA, 28 bp, Artificial Sequence
  Synthetic
ccacctccaaagautacttggtcuaaac

SEQ ID NO: 45392 - DNA, 23 bp, Artificial Sequence
  Synthetic
gccttatgtacuccccctgguaa

SEQ ID NO: 45393 - DNA, 20 bp, Artificial Sequence
  Synthetic
gctgacuccgataacugggt

SEQ ID NO: 45394 - DNA, 24 bp, Artificial Sequence
  Synthetic
ttcatgaaaacutccttccugggt

SEQ ID NO: 45395 - DNA, 28 bp, Artificial Sequence
  Synthetic
gaacatuaaaagcaacaggtctucaaga

SEQ ID NO: 45396 - DNA, 23 bp, Artificial Sequence
  Synthetic
cttccagcugactgtcatgugat

SEQ ID NO: 45397 - DNA, 27 bp, Artificial Sequence
  Synthetic
caaaaacccatauggtaggaacattuc

SEQ ID NO: 45398 - DNA, 21 bp, Artificial Sequence
  Synthetic
gcagagactugagcccagtug

SEQ ID NO: 45399 - DNA, 26 bp, Artificial Sequence
  Synthetic
aggtctccagaccuctactctauact

SEQ ID NO: 45400 - DNA, 27 bp, Artificial Sequence
  Synthetic
gcagtaatggtauagtctcctgagucc

SEQ ID NO: 45401 - DNA, 26 bp, Artificial Sequence
  Synthetic
tgcttggatgcuactgtttttgguaa

SEQ ID NO: 45402 - DNA, 27 bp, Artificial Sequence
  Synthetic
tgaccatcatgaaugctgttacatcut

SEQ ID NO: 45403 - DNA, 22 bp, Artificial Sequence
  Synthetic
ggtgataaaugggtacggugca

SEQ ID NO: 45404 - DNA, 27 bp, Artificial Sequence
  Synthetic
cttagacuccgagatttaaatgugcct

SEQ ID NO: 45405 - DNA, 24 bp, Artificial Sequence
  Synthetic
tgatactcttguccggtcaacuga

SEQ ID NO: 45406 - DNA, 28 bp, Artificial Sequence
  Synthetic
gaagacaaggaagaugtcagtttcuaca

SEQ ID NO: 45407 - DNA, 23 bp, Artificial Sequence
  Synthetic
cggctcuagcttcagucacaaaa

SEQ ID NO: 45408 - DNA, 29 bp, Artificial Sequence
  Synthetic
tttctgagcttcauatttagatggccaut

SEQ ID NO: 45409 - DNA, 22 bp, Artificial Sequence
  Synthetic
atgaagutgtcacauccagcca

SEQ ID NO: 45410 - DNA, 27 bp, Artificial Sequence
  Synthetic
aatttctagagcuagattccucaggga

SEQ ID NO: 45411 - DNA, 27 bp, Artificial Sequence
  Synthetic
tggccuaaaggaaggaaagaaauacaa

SEQ ID NO: 45412 - DNA, 23 bp, Artificial Sequence
  Synthetic
gccatcgautttagcaccuccat

SEQ ID NO: 45413 - DNA, 30 bp, Artificial Sequence; identical to SEQ ID NO: 33179
  Synthetic

SEQ ID NO: 45414 - DNA, 28 bp, Artificial Sequence
  Synthetic
catggaagctugttttcttaacttcugg

SEQ ID NO: 45415 - DNA, 28 bp, Artificial Sequence
  Synthetic
gatgctgaggagacaugtatatctgaut

SEQ ID NO: 45416 - DNA, 22 bp, Artificial Sequence
  Synthetic
ggccatagugtcaaccagauca

SEQ ID NO: 45417 - DNA, 31 bp, Artificial Sequence; identical to SEQ ID NO: 33183
  Synthetic

SEQ ID NO: 45418 - DNA, 23 bp, Artificial Sequence
  Synthetic
attacaccguttccagcctucat

SEQ ID NO: 45419 - DNA, 23 bp, Artificial Sequence
  Synthetic
tttacttucagagccacctgguc

SEQ ID NO: 45420 - DNA, 23 bp, Artificial Sequence
  Synthetic
tcautttctgcctugacacggaa

SEQ ID NO: 45421 - DNA, 26 bp, Artificial Sequence
  Synthetic
gtaagcaaagaagagaugactguggt

SEQ ID NO: 45422 - DNA, 23 bp, Artificial Sequence
  Synthetic
ggaggcccugtgcctattttaut

SEQ ID NO: 45423 - DNA, 25 bp, Artificial Sequence
  Synthetic
ttgttgatgtguccagtgataggug

SEQ ID NO: 45424 - DNA, 23 bp, Artificial Sequence
  Synthetic
ccatcactucgctttgcttuagt

SEQ ID NO: 45425 - DNA, 31 bp, Artificial Sequence; identical to SEQ ID NO: 33191
  Synthetic

SEQ ID NO: 45426 - DNA, 28 bp, Artificial Sequence
  Synthetic
ccatgtagtgaguttctttaatgctucc

SEQ ID NO: 45427 - DNA, 29 bp, Artificial Sequence
  Synthetic
aaacaaaaactcccautctggctatuaac

SEQ ID NO: 45428 - DNA, 23 bp, Artificial Sequence
  Synthetic
cctttctggtutggtttgcgaua

SEQ ID NO: 45429 - DNA, 27 bp, Artificial Sequence
  Synthetic
tgatcatggcaaguatatcatcucagc

SEQ ID NO: 45430 - DNA, 23 bp, Artificial Sequence
  Synthetic
gactcgagcuagaatgcggauag

SEQ ID NO: 45431 - DNA, 23 bp, Artificial Sequence
  Synthetic
attaggcaaugtgccttuagggt

SEQ ID NO: 45432 - DNA, 23 bp, Artificial Sequence
  Synthetic
agctgtttctcugctcttgtcut

SEQ ID NO: 45433 - DNA, 24 bp, Artificial Sequence
  Synthetic
ggtcaacaaaacaccuatcgcuga

SEQ ID NO: 45434 - DNA, 25 bp, Artificial Sequence
  Synthetic
ggagacggaggacuaaatttaugct

SEQ ID NO: 45435 - DNA, 31 bp, Artificial Sequence; identical to SEQ ID NO: 33201
  Synthetic

SEQ ID NO: 45436 - DNA, 25 bp, Artificial Sequence
  Synthetic
gcccaggaacaucaagaacaguaag

SEQ ID NO: 45437 - DNA, 25 bp, Artificial Sequence
  Synthetic
ctgctattauaagaggtgtgccugt

SEQ ID NO: 45438 - DNA, 27 bp, Artificial Sequence
  Synthetic
gaggcacugaaaagtaaacaugaaaaa

SEQ ID NO: 45439 - DNA, 25 bp, Artificial Sequence
  Synthetic
aaagctgaaaacautgtgggtctug

SEQ ID NO: 45440 - DNA, 30 bp, Artificial Sequence; identical to SEQ ID NO: 33206
  Synthetic

SEQ ID NO: 45441 - DNA, 24 bp, Artificial Sequence
  Synthetic
tcacttcgcuaagcatctgaauga

SEQ ID NO: 45442 - DNA, 25 bp, Artificial Sequence
  Synthetic
agacagttttugaaccagctggaut

SEQ ID NO: 45443 - DNA, 26 bp, Artificial Sequence
  Synthetic
aagacttagugccatcaucaaaggag

SEQ ID NO: 45444 - DNA, 31 bp, Artificial Sequence; identical to SEQ ID NO: 33210
  Synthetic

SEQ ID NO: 45445 - DNA, 25 bp, Artificial Sequence
  Synthetic
ccctgagtcaugtcctgaaacuaaa

SEQ ID NO: 45446 - DNA, 26 bp, Artificial Sequence
  Synthetic
ccaattggatcuttagcaaagacugg

SEQ ID NO: 45447 - DNA, 28 bp, Artificial Sequence
  Synthetic
cacaaacuacatccuggaaaagagagaa

SEQ ID NO: 45448 - DNA, 23 bp, Artificial Sequence
  Synthetic
aggaaccccugtaacaaatgtug

SEQ ID NO: 45449 - DNA, 28 bp, Artificial Sequence
  Synthetic
cggatacatgcugaaaatctgtauggaa

SEQ ID NO: 45450 - DNA, 27 bp, Artificial Sequence
  Synthetic
gtctttacccacutccttcttcucaat

SEQ ID NO: 45451 - DNA, 28 bp, Artificial Sequence
  Synthetic
ggcaataacatttugtgccatgatttut

SEQ ID NO: 45452 - DNA, 25 bp, Artificial Sequence
  Synthetic
gttcuccacaaccauacagtattug

SEQ ID NO: 45453 - DNA, 20 bp, Artificial Sequence
  Synthetic
cctcacuggccgttacucag

SEQ ID NO: 45454 - DNA, 30 bp, Artificial Sequence; identical to SEQ ID NO: 33220
  Synthetic

SEQ ID NO: 45455 - DNA, 28 bp, Artificial Sequence
  Synthetic
ggactgagaagutccacaaagtuacaaa

SEQ ID NO: 45456 - DNA, 28 bp, Artificial Sequence
  Synthetic
cttaggaggatuccaagtcaaagtuaca

SEQ ID NO: 45457 - DNA, 31 bp, Artificial Sequence; identical to SEQ ID NO: 33223
  Synthetic

SEQ ID NO: 45458 - DNA, 21 bp, Artificial Sequence
  Synthetic
gcggtcagautcacgctttuc

SEQ ID NO: 45459 - DNA, 30 bp, Artificial Sequence; identical to SEQ ID NO: 33225
  Synthetic

SEQ ID NO: 45460 - DNA, 21 bp, Artificial Sequence
  Synthetic
ggtggcutcttgagguaaggt

SEQ ID NO: 45461 - DNA, 31 bp, Artificial Sequence; identical to SEQ ID NO: 33227
  Synthetic

SEQ ID NO: 45462 - DNA, 26 bp, Artificial Sequence
  Synthetic
cagcaatgttgacugctctaactcua

SEQ ID NO: 45463 - DNA, 26 bp, Artificial Sequence
  Synthetic
tggtgatgctutaggaagccatuaaa

SEQ ID NO: 45464 - DNA, 22 bp, Artificial Sequence
  Synthetic
gcugcaaagagccagtauacgt

SEQ ID NO: 45465 - DNA, 27 bp, Artificial Sequence
  Synthetic
ggtcttattgaaggutccgactaucaa

SEQ ID NO: 45466 - DNA, 23 bp, Artificial Sequence
  Synthetic
agagccuccatcatattcuggct

SEQ ID NO: 45467 - DNA, 28 bp, Artificial Sequence
  Synthetic
agaaacctcutctgtaaguaggagaaca

SEQ ID NO: 45468 - DNA, 24 bp, Artificial Sequence
  Synthetic
cttaggttcacuggagacauggac

SEQ ID NO: 45469 - DNA, 28 bp, Artificial Sequence
  Synthetic
catctgagtgauaaagggttccttctut

SEQ ID NO: 45470 - DNA, 28 bp, Artificial Sequence
  Synthetic
aagtatcatcuaccaccagtttgtugac

SEQ ID NO: 45471 - DNA, 28 bp, Artificial Sequence
  Synthetic
tgctttttgctccuaatgacaactttut

SEQ ID NO: 45472 - DNA, 28 bp, Artificial Sequence
  Synthetic
actaggtctucaacagtaaattgcagut

SEQ ID NO: 45473 - DNA, 26 bp, Artificial Sequence
  Synthetic
tttttacagatccucctgatccucct

SEQ ID NO: 45474 - DNA, 26 bp, Artificial Sequence
  Synthetic
caggcttttccaucaatagtcctcut

SEQ ID NO: 45475 - DNA, 30 bp, Artificial Sequence; identical to SEQ ID NO: 33241
  Synthetic

SEQ ID NO: 45476 - DNA, 27 bp, Artificial Sequence
  Synthetic
ctccagctguacaaagaaaataguagt

SEQ ID NO: 45477 - DNA, 29 bp, Artificial Sequence
  Synthetic
gcaatgaagguaggaaaataaccattcuc

SEQ ID NO: 45478 - DNA, 26 bp, Artificial Sequence
  Synthetic
tactagtaccutgaatatcaguggca

SEQ ID NO: 45479 - DNA, 28 bp, Artificial Sequence
  Synthetic
agcccaaucaaaggatacattguagaaa

SEQ ID NO: 45480 - DNA, 21 bp, Artificial Sequence
  Synthetic
guccccagaaauggaagcaua

SEQ ID NO: 45481 - DNA, 23 bp, Artificial Sequence
  Synthetic
ggaagtcctuattggtcacgugt

SEQ ID NO: 45482 - DNA, 28 bp, Artificial Sequence
  Synthetic
ggcgataaggaucttgaatgactactut

SEQ ID NO: 45483 - DNA, 28 bp, Artificial Sequence
  Synthetic
agtcatcccucccaaaataagttgaaut

SEQ ID NO: 45484 - DNA, 23 bp, Artificial Sequence
  Synthetic
tcctacttgcaucacgtttguca

SEQ ID NO: 45485 - DNA, 31 bp, Artificial Sequence; identical to SEQ ID NO: 33251
  Synthetic

SEQ ID NO: 45486 - DNA, 21 bp, Artificial Sequence
  Synthetic
ggaccgctutgggaatgcuaa

SEQ ID NO: 45487 - DNA, 25 bp, Artificial Sequence
  Synthetic
acuatcaaagtuaaggcaggagagc

SEQ ID NO: 45488 - DNA, 27 bp, Artificial Sequence
  Synthetic
caacttatgggauaaaggcacactgua

SEQ ID NO: 45489 - DNA, 27 bp, Artificial Sequence
  Synthetic
ctttgaaagagtuaacaagcgactcug

SEQ ID NO: 45490 - DNA, 24 bp, Artificial Sequence
  Synthetic
attttgagacugttgggagttuga

SEQ ID NO: 45491 - DNA, 27 bp, Artificial Sequence
  Synthetic
gagggacaagaauataagttccgtgut

SEQ ID NO: 45492 - DNA, 28 bp, Artificial Sequence
  Synthetic
gataaagcctgutatttcacttccucca

SEQ ID NO: 45493 - DNA, 28 bp, Artificial Sequence
  Synthetic
cacaggatttucccaagtgatactauct

SEQ ID NO: 45494 - DNA, 30 bp, Artificial Sequence; identical to SEQ ID NO: 33260
  Synthetic

SEQ ID NO: 45495 - DNA, 27 bp, Artificial Sequence
  Synthetic
ctaatgcaugactgttctcttucaaca

SEQ ID NO: 45496 - DNA, 20 bp, Artificial Sequence
  Synthetic
atugacagcacucacccgaa

SEQ ID NO: 45497 - DNA, 24 bp, Artificial Sequence
  Synthetic
caagagtcacugacacaagctcua

SEQ ID NO: 45498 - DNA, 27 bp, Artificial Sequence
  Synthetic
gacataggugagtccttctaauaagcc

SEQ ID NO: 45499 - DNA, 21 bp, Artificial Sequence
  Synthetic
gaccacctgaugcaccagaua

SEQ ID NO: 45500 - DNA, 27 bp, Artificial Sequence
  Synthetic
tgcaatgtcuaagtgttgaagugacaa

SEQ ID NO: 45501 - DNA, 28 bp, Artificial Sequence
  Synthetic
ccttcccacacaaauttttgattacugt

SEQ ID NO: 45502 - DNA, 23 bp, Artificial Sequence
  Synthetic
gaggcaggacaaauggttctuct

SEQ ID NO: 45503 - DNA, 25 bp, Artificial Sequence
  Synthetic
aggtgatgaaauagcacttgaugca

SEQ ID NO: 45504 - DNA, 22 bp, Artificial Sequence
  Synthetic
gggaaaguggcaactccaugaa

SEQ ID NO: 45505 - DNA, 25 bp, Artificial Sequence
  Synthetic
gaagaaagguggaagagatgcaaug

SEQ ID NO: 45506 - DNA, 22 bp, Artificial Sequence
  Synthetic
gccatagugcatccatguccaa

SEQ ID NO: 45507 - DNA, 21 bp, Artificial Sequence
  Synthetic
cautatgtccuggagcgcaga

SEQ ID NO: 45508 - DNA, 26 bp, Artificial Sequence
  Synthetic
tcctctacatgugaagaatgtcuggt

SEQ ID NO: 45509 - DNA, 29 bp, Artificial Sequence
  Synthetic
ggcaaagaagtuaaagcaagtgatagaut

SEQ ID NO: 45510 - DNA, 27 bp, Artificial Sequence
  Synthetic
cagagtatgucaaaatgcaatgcauga

SEQ ID NO: 45511 - DNA, 28 bp, Artificial Sequence
  Synthetic
ttgttccugacaaagaatatgtccugag

SEQ ID NO: 45512 - DNA, 26 bp, Artificial Sequence
  Synthetic
actggacacauttcaacatggtaucc

SEQ ID NO: 45513 - DNA, 28 bp, Artificial Sequence
  Synthetic
gaagatccaacaaguaagtagtgcugat

SEQ ID NO: 45514 - DNA, 27 bp, Artificial Sequence
  Synthetic
aaaaacacagutaagaattugcagcca

SEQ ID NO: 45515 - DNA, 29 bp, Artificial Sequence
  Synthetic
cctttcctctggutttcctaatcattgut

SEQ ID NO: 45516 - DNA, 21 bp, Artificial Sequence
  Synthetic
ccactgttugccagcctttuc

SEQ ID NO: 45517 - DNA, 22 bp, Artificial Sequence
  Synthetic
gcctgcactutcagactgacua

SEQ ID NO: 45518 - DNA, 24 bp, Artificial Sequence
  Synthetic
agccttatucacagctctaacucg

SEQ ID NO: 45519 - DNA, 22 bp, Artificial Sequence
  Synthetic
ccagaacaugatggaggugcaa

SEQ ID NO: 45520 - DNA, 30 bp, Artificial Sequence; identical to SEQ ID NO: 33286
  Synthetic

SEQ ID NO: 45521 - DNA, 28 bp, Artificial Sequence
  Synthetic
atgatgatacacaugcactttgttccua

SEQ ID NO: 45522 - DNA, 22 bp, Artificial Sequence
  Synthetic
ccatcaucatctggcucacacc

SEQ ID NO: 45523 - DNA, 28 bp, Artificial Sequence
  Synthetic
aaggatgcttatgucaaacttgcattut

SEQ ID NO: 45524 - DNA, 25 bp, Artificial Sequence
  Synthetic
gggattaattuggtggcctugaagt

SEQ ID NO: 45525 - DNA, 25 bp, Artificial Sequence
  Synthetic
ttctgcatcugtaatgccauacaca

SEQ ID NO: 45526 - DNA, 30 bp, Artificial Sequence; identical to SEQ ID NO: 33292
  Synthetic

SEQ ID NO: 45527 - DNA, 27 bp, Artificial Sequence
  Synthetic
cctctgacctuaaatctgcttgaacut

SEQ ID NO: 45528 - DNA, 24 bp, Artificial Sequence
  Synthetic
ccaacaaagcccautttagugact

SEQ ID NO: 45529 - DNA, 26 bp, Artificial Sequence
  Synthetic
catgggauccacctaaaaatgauggt

SEQ ID NO: 45530 - DNA, 22 bp, Artificial Sequence
  Synthetic
gcctugccccataactucaact

SEQ ID NO: 45531 - DNA, 31 bp, Artificial Sequence; identical to SEQ ID NO: 33297
  Synthetic

SEQ ID NO: 45532 - DNA, 25 bp, Artificial Sequence
  Synthetic
ttcccctactcucatttttggcaut

SEQ ID NO: 45533 - DNA, 23 bp, Artificial Sequence
  Synthetic
cagtgactcgugagtgcatttut

SEQ ID NO: 45534 - DNA, 24 bp, Artificial Sequence
  Synthetic
gagaaatgacaagutcggcauagg

SEQ ID NO: 45535 - DNA, 30 bp, Artificial Sequence; identical to SEQ ID NO: 33301
  Synthetic

SEQ ID NO: 45536 - DNA, 27 bp, Artificial Sequence
  Synthetic
cacatacagtuatgtccatgauccaca

SEQ ID NO: 45537 - DNA, 27 bp, Artificial Sequence
  Synthetic
ctgaaagauggaggaagcccaatatua

SEQ ID NO: 45538 - DNA, 28 bp, Artificial Sequence
  Synthetic
ggcctaatatcuggatttcatgcaguaa

SEQ ID NO: 45539 - DNA, 23 bp, Artificial Sequence
  Synthetic
ggatacugccatgactgugagag

SEQ ID NO: 45540 - DNA, 28 bp, Artificial Sequence
  Synthetic
ccacagaagaagaaaauatgagttuggg

SEQ ID NO: 45541 - DNA, 25 bp, Artificial Sequence
  Synthetic
gttgagtacctautccgtgtgagug

SEQ ID NO: 45542 - DNA, 29 bp, Artificial Sequence
  Synthetic
tctttctcttaaugtcacgtcttucaaca

SEQ ID NO: 45543 - DNA, 28 bp, Artificial Sequence
  Synthetic
cacaattuaaaagcaagauagcacacua

SEQ ID NO: 45544 - DNA, 26 bp, Artificial Sequence
  Synthetic
cctttgtctccuttcttggcttcuaa

SEQ ID NO: 45545 - DNA, 28 bp, Artificial Sequence
  Synthetic
agcgttcacatgutatctttctcacuag

SEQ ID NO: 45546 - DNA, 27 bp, Artificial Sequence
  Synthetic
ccttcactcaucatctggtgtttauca

SEQ ID NO: 45547 - DNA, 29 bp, Artificial Sequence
  Synthetic
ttctttccagaaautcctgttgagaucat

SEQ ID NO: 45548 - DNA, 27 bp, Artificial Sequence
  Synthetic
aggagacattggautatcagttagcut

SEQ ID NO: 45549 - DNA, 24 bp, Artificial Sequence
  Synthetic
cacttggaagaucagacagucact

SEQ ID NO: 45550 - DNA, 22 bp, Artificial Sequence
  Synthetic
catcugggaagccacagtctut

SEQ ID NO: 45551 - DNA, 27 bp, Artificial Sequence
  Synthetic
tuttctccttuacaacagaggaagacc

SEQ ID NO: 45552 - DNA, 27 bp, Artificial Sequence
  Synthetic
ctgcactttuaacattttcacctcugt

SEQ ID NO: 45553 - DNA, 28 bp, Artificial Sequence
  Synthetic
caaagccaaauggttcagaaaugaagaa

SEQ ID NO: 45554 - DNA, 29 bp, Artificial Sequence
  Synthetic
catctttcacaacuaggaccctcttttua

SEQ ID NO: 45555 - DNA, 28 bp, Artificial Sequence
  Synthetic
caaagccucaaaaccttgaaatactuga

SEQ ID NO: 45556 - DNA, 26 bp, Artificial Sequence
  Synthetic
ttcctgtttcaaugatctcctcaucc

SEQ ID NO: 45557 - DNA, 28 bp, Artificial Sequence
  Synthetic
ccagcttaacucaatgtggtttttgtut

SEQ ID NO: 45558 - DNA, 30 bp, Artificial Sequence; identical to SEQ ID NO: 33324
  Synthetic

SEQ ID NO: 45559 - DNA, 24 bp, Artificial Sequence
  Synthetic
cttaaggacaccugtgugaaggaa

SEQ ID NO: 45560 - DNA, 28 bp, Artificial Sequence
  Synthetic
aagtgttgtgtugttttgttgttguagt

SEQ ID NO: 45561 - DNA, 27 bp, Artificial Sequence
  Synthetic
aagaagtatgaaautgttgctgauggc

SEQ ID NO: 45562 - DNA, 24 bp, Artificial Sequence
  Synthetic
attgttcaugagcctctgcctuat

SEQ ID NO: 45563 - DNA, 30 bp, Artificial Sequence; identical to SEQ ID NO: 33329
  Synthetic

SEQ ID NO: 45564 - DNA, 30 bp, Artificial Sequence; identical to SEQ ID NO: 33330
  Synthetic

SEQ ID NO: 45565 - DNA, 22 bp, Artificial Sequence
  Synthetic
atgctggcccutcacttttcua

SEQ ID NO: 45566 - DNA, 26 bp, Artificial Sequence
  Synthetic
gctttctttaggautagcatgcgtut

SEQ ID NO: 45567 - DNA, 29 bp, Artificial Sequence
  Synthetic
aaagcttttcacutatactttactugcag

SEQ ID NO: 45568 - DNA, 27 bp, Artificial Sequence
  Synthetic
gaatgtgatcgaaugagttttccctuc

SEQ ID NO: 45569 - DNA, 24 bp, Artificial Sequence
  Synthetic
ttcctcaccccuctcaaagatgua

SEQ ID NO: 45570 - DNA, 29 bp, Artificial Sequence
  Synthetic
tcctttataagcucaaatctgtcaucacc

SEQ ID NO: 45571 - DNA, 25 bp, Artificial Sequence
  Synthetic
cttcatccacugtccacttcttuca

SEQ ID NO: 45572 - DNA, 23 bp, Artificial Sequence
  Synthetic
accaagcaaccccuctcctauat

SEQ ID NO: 45573 - DNA, 30 bp, Artificial Sequence; identical to SEQ ID NO: 33339
  Synthetic

SEQ ID NO: 45574 - DNA, 24 bp, Artificial Sequence
  Synthetic
gcctttatcttuaaggtccgccut

SEQ ID NO: 45575 - DNA, 26 bp, Artificial Sequence
  Synthetic
gcuaaatgtctttuacagaggccgat

SEQ ID NO: 45576 - DNA, 30 bp, Artificial Sequence; identical to SEQ ID NO: 33342
  Synthetic

SEQ ID NO: 45577 - DNA, 27 bp, Artificial Sequence
  Synthetic
tctgaggcattauctatgcttgcatut

SEQ ID NO: 45578 - DNA, 31 bp, Artificial Sequence; identical to SEQ ID NO: 33344
  Synthetic

SEQ ID NO: 45579 - DNA, 27 bp, Artificial Sequence
  Synthetic
tcaactttattucacttccctgugcat

SEQ ID NO: 45580 - DNA, 23 bp, Artificial Sequence
  Synthetic
attgcatuaagggcctgguagag

SEQ ID NO: 45581 - DNA, 30 bp, Artificial Sequence; identical to SEQ ID NO: 33347
  Synthetic

SEQ ID NO: 45582 - DNA, 25 bp, Artificial Sequence
  Synthetic
tcagtttccatugtccaggaatguc

SEQ ID NO: 45583 - DNA, 24 bp, Artificial Sequence
  Synthetic
caaagcatcgutgggttgtcuaaa

SEQ ID NO: 45584 - DNA, 29 bp, Artificial Sequence
  Synthetic
agcaatatcttcuggcatagcattctuaa

SEQ ID NO: 45585 - DNA, 25 bp, Artificial Sequence
  Synthetic
gaagtcattagagautggctgguga

SEQ ID NO: 45586 - DNA, 22 bp, Artificial Sequence
  Synthetic
aatcttgccauccttccuccag

SEQ ID NO: 45587 - DNA, 27 bp, Artificial Sequence
  Synthetic
agtagcaactugcattgtagtttuaca

SEQ ID NO: 45588 - DNA, 23 bp, Artificial Sequence
  Synthetic
gtgtatucaccagcaucggaaag

SEQ ID NO: 45589 - DNA, 31 bp, Artificial Sequence; identical to SEQ ID NO: 33355
  Synthetic

SEQ ID NO: 45590 - DNA, 26 bp, Artificial Sequence
  Synthetic
ttcccctugaatatgaacttuggaaa

SEQ ID NO: 45591 - DNA, 28 bp, Artificial Sequence
  Synthetic
ctcaccctccauggtttactatuaaaca

SEQ ID NO: 45592 - DNA, 29 bp, Artificial Sequence
  Synthetic
tgtgtgtgaauacagaaagaatatgcugt

SEQ ID NO: 45593 - DNA, 28 bp, Artificial Sequence
  Synthetic
tccaagatacgugggcttaattttagut

SEQ ID NO: 45594 - DNA, 27 bp, Artificial Sequence
  Synthetic
tgtaccttttgtuggttcaggaatcut

SEQ ID NO: 45595 - DNA, 33 bp, Artificial Sequence; identical to SEQ ID NO: 33361
  Synthetic

SEQ ID NO: 45596 - DNA, 24 bp, Artificial Sequence
  Synthetic
acttaacgcugacagaatggtuga

SEQ ID NO: 45597 - DNA, 30 bp, Artificial Sequence; identical to SEQ ID NO: 33363
  Synthetic

SEQ ID NO: 45598 - DNA, 27 bp, Artificial Sequence
  Synthetic
ctggatagaaguttgaagcaggcuaat

SEQ ID NO: 45599 - DNA, 32 bp, Artificial Sequence; identical to SEQ ID NO: 33365
  Synthetic

SEQ ID NO: 45600 - DNA, 20 bp, Artificial Sequence
  Synthetic
tgtaccugctggagguggaa

SEQ ID NO: 45601 - DNA, 30 bp, Artificial Sequence; identical to SEQ ID NO: 33367
  Synthetic

SEQ ID NO: 45602 - DNA, 26 bp, Artificial Sequence
  Synthetic
aggtgacttautagacaagggugagt

SEQ ID NO: 45603 - DNA, 29 bp, Artificial Sequence
  Synthetic
gtgatgaatgttuactggtgattgttuct

SEQ ID NO: 45604 - DNA, 29 bp, Artificial Sequence
  Synthetic
tgaaaugtgaaaatcaugaagcagaacag

SEQ ID NO: 45605 - DNA, 28 bp, Artificial Sequence
  Synthetic
gcttttgtcttguttctcaatcttcgut

SEQ ID NO: 45606 - DNA, 19 bp, Artificial Sequence
  Synthetic
gggaggacuttccggttug

SEQ ID NO: 45607 - DNA, 20 bp, Artificial Sequence
  Synthetic
agugccacccacaaaaggua

SEQ ID NO: 45608 - DNA, 28 bp, Artificial Sequence
  Synthetic
gatcatcugaagcctaaaatcagugaca

SEQ ID NO: 45609 - DNA, 29 bp, Artificial Sequence
  Synthetic
ttgagtttaagcgucagaagatctatcuc

SEQ ID NO: 45610 - DNA, 22 bp, Artificial Sequence
  Synthetic
catagccaucttgtggcatuga

SEQ ID NO: 45611 - DNA, 29 bp, Artificial Sequence
  Synthetic
gtgccuaagaaaattgtgguagaagaaaa

SEQ ID NO: 45612 - DNA, 25 bp, Artificial Sequence
  Synthetic
gacatcaaguggaatgcaaactugt

SEQ ID NO: 45613 - DNA, 28 bp, Artificial Sequence
  Synthetic
agtgctccaaaauacttcaagagtucat

SEQ ID NO: 45614 - DNA, 25 bp, Artificial Sequence
  Synthetic
cttccactucttcagccucaaaaac

SEQ ID NO: 45615 - DNA, 26 bp, Artificial Sequence
  Synthetic
agaaatuccggaagaagaagagtucc

SEQ ID NO: 45616 - DNA, 28 bp, Artificial Sequence
  Synthetic
caucaaaaacaaucaagacacagagaca

SEQ ID NO: 45617 - DNA, 29 bp, Artificial Sequence
  Synthetic
ttgaacattcucagctaacuaaaacacct

SEQ ID NO: 45618 - DNA, 25 bp, Artificial Sequence
  Synthetic
tcctctatgcuaggtggttcttcug

SEQ ID NO: 45619 - DNA, 21 bp, Artificial Sequence
  Synthetic
acaagcgtutcgaaggcugag

SEQ ID NO: 45620 - DNA, 24 bp, Artificial Sequence
  Synthetic
actggagaugaacaaaaggauggg

SEQ ID NO: 45621 - DNA, 26 bp, Artificial Sequence
  Synthetic
aggaagttccucccgaagaagaauat

SEQ ID NO: 45622 - DNA, 26 bp, Artificial Sequence
  Synthetic
agaacttccucttcctcagguagaac

SEQ ID NO: 45623 - DNA, 28 bp, Artificial Sequence
  Synthetic
cctttcataagcutcttcattgttguga

SEQ ID NO: 45624 - DNA, 24 bp, Artificial Sequence
  Synthetic
tgcaacatugcaagttcatguacc

SEQ ID NO: 45625 - DNA, 21 bp, Artificial Sequence
  Synthetic
ggccttacautgccagcctua

SEQ ID NO: 45626 - DNA, 23 bp, Artificial Sequence
  Synthetic
gugacacauacacaaggtttuga

SEQ ID NO: 45627 - DNA, 29 bp, Artificial Sequence
  Synthetic
ttctttcctgcaaaauttccaacattcut

SEQ ID NO: 45628 - DNA, 26 bp, Artificial Sequence
  Synthetic
ttcccacaaaagaaguttucacacac

SEQ ID NO: 45629 - DNA, 25 bp, Artificial Sequence
  Synthetic
tgggtggccutttactgacaauaaa

SEQ ID NO: 45630 - DNA, 24 bp, Artificial Sequence
  Synthetic
acucagcaaaaauacagaccauca

SEQ ID NO: 45631 - DNA, 28 bp, Artificial Sequence
  Synthetic
ctagcctugagaaacctgtttcaattut

SEQ ID NO: 45632 - DNA, 25 bp, Artificial Sequence
  Synthetic
tgagtgtgcacauatttagtguggt

SEQ ID NO: 45633 - DNA, 28 bp, Artificial Sequence
  Synthetic
gcttatacccuagaagaagaagctgtut

SEQ ID NO: 45634 - DNA, 29 bp, Artificial Sequence
  Synthetic
agtataggagucagattgggaacuagaag

SEQ ID NO: 45635 - DNA, 28 bp, Artificial Sequence
  Synthetic
acacacatttucagaatcttgcaatuca

SEQ ID NO: 45636 - DNA, 23 bp, Artificial Sequence
  Synthetic
cagcccccauaaccagtgtatut

SEQ ID NO: 45637 - DNA, 30 bp, Artificial Sequence; identical to SEQ ID NO: 33403
  Synthetic

SEQ ID NO: 45638 - DNA, 27 bp, Artificial Sequence
  Synthetic
ggcacacttatuttctggttaatgtut

SEQ ID NO: 45639 - DNA, 29 bp, Artificial Sequence
  Synthetic
acctaatcttuctaaagttccugaagcac

SEQ ID NO: 45640 - DNA, 29 bp, Artificial Sequence
  Synthetic
ggtctguagacaatttgugaaagaaaaca

SEQ ID NO: 45641 - DNA, 28 bp, Artificial Sequence
  Synthetic
cagcaggctgaauttaaatgaaacctua

SEQ ID NO: 45642 - DNA, 28 bp, Artificial Sequence
  Synthetic
cagaccagauggaaaaagcaagaattua

SEQ ID NO: 45643 - DNA, 24 bp, Artificial Sequence
  Synthetic
actgggctucaatgagatcacaut

SEQ ID NO: 45644 - DNA, 26 bp, Artificial Sequence
  Synthetic
gacatgcaautaaagaggctugaagg

SEQ ID NO: 45645 - DNA, 24 bp, Artificial Sequence
  Synthetic
tccacccguctgctttctuaaaaa

SEQ ID NO: 45646 - DNA, 28 bp, Artificial Sequence
  Synthetic
agacaaaggcagcauagtacataugaag

SEQ ID NO: 45647 - DNA, 30 bp, Artificial Sequence; identical to SEQ ID NO: 33413
  Synthetic

SEQ ID NO: 45648 - DNA, 28 bp, Artificial Sequence
  Synthetic
tcgtttcagatutgtgagttactuagca

SEQ ID NO: 45649 - DNA, 29 bp, Artificial Sequence
  Synthetic
gtacctgaagttucaaagaagattgtucc

SEQ ID NO: 45650 - DNA, 22 bp, Artificial Sequence
  Synthetic
gtgcctatuggattgaacugct

SEQ ID NO: 45651 - DNA, 29 bp, Artificial Sequence
  Synthetic
agcatcccttcutattcctgtgttttuat

SEQ ID NO: 45652 - DNA, 22 bp, Artificial Sequence
  Synthetic
tccccttcgucatagccttcut

SEQ ID NO: 45653 - DNA, 26 bp, Artificial Sequence
  Synthetic
cacaaggagaagagagucttcatuga

SEQ ID NO: 45654 - DNA, 29 bp, Artificial Sequence
  Synthetic
agaatagtuagcagaagtgcaaatcucag

SEQ ID NO: 45655 - DNA, 28 bp, Artificial Sequence
  Synthetic
caaacaactaacaaugatgtggaggaut

SEQ ID NO: 45656 - DNA, 22 bp, Artificial Sequence
  Synthetic
tcutgaccacuagagggccaat

SEQ ID NO: 45657 - DNA, 21 bp, Artificial Sequence
  Synthetic
tcctgtggtugctcctccuat

SEQ ID NO: 45658 - DNA, 20 bp, Artificial Sequence
  Synthetic
tgcagtttggucgctgguat

SEQ ID NO: 45659 - DNA, 29 bp, Artificial Sequence
  Synthetic
ctctatgcttatuacatgtcccttuccag

SEQ ID NO: 45660 - DNA, 26 bp, Artificial Sequence
  Synthetic
agaatggtatagguaggctacgtgut

SEQ ID NO: 45661 - DNA, 30 bp, Artificial Sequence; identical to SEQ ID NO: 33427
  Synthetic

SEQ ID NO: 45662 - DNA, 21 bp, Artificial Sequence
  Synthetic
cggccatcautcctgaagtug

SEQ ID NO: 45663 - DNA, 30 bp, Artificial Sequence; identical to SEQ ID NO: 33429
  Synthetic

SEQ ID NO: 45664 - DNA, 22 bp, Artificial Sequence
  Synthetic
ctggtcttcugctcgaacauct

SEQ ID NO: 45665 - DNA, 26 bp, Artificial Sequence
  Synthetic
aaaatgcgtgutgtatcacaugaaca

SEQ ID NO: 45666 - DNA, 28 bp, Artificial Sequence
  Synthetic
cggtcaccaucaatgcttatttcaaaut

SEQ ID NO: 45667 - DNA, 31 bp, Artificial Sequence; identical to SEQ ID NO: 33433
  Synthetic

SEQ ID NO: 45668 - DNA, 28 bp, Artificial Sequence
  Synthetic
tgacgtcatauaactataggattcuggt

SEQ ID NO: 45669 - DNA, 23 bp, Artificial Sequence
  Synthetic
cactgactuccgaggtcttctuc

SEQ ID NO: 45670 - DNA, 21 bp, Artificial Sequence
  Synthetic
gtggaugcggaacccactuat

SEQ ID NO: 45671 - DNA, 27 bp, Artificial Sequence
  Synthetic
acaaaaactgautctgggttauaccga

SEQ ID NO: 45672 - DNA, 24 bp, Artificial Sequence
  Synthetic
agtgcacttacuttctacgacuct

SEQ ID NO: 45673 - DNA, 28 bp, Artificial Sequence
  Synthetic
caacctccuaaggcttatttuacaaagg

SEQ ID NO: 45674 - DNA, 22 bp, Artificial Sequence
  Synthetic
actagcaaagcugaagcugcat

SEQ ID NO: 45675 - DNA, 30 bp, Artificial Sequence; identical to SEQ ID NO: 33441
  Synthetic

SEQ ID NO: 45676 - DNA, 23 bp, Artificial Sequence
  Synthetic
gcatcatuggacactttgcaugt

SEQ ID NO: 45677 - DNA, 23 bp, Artificial Sequence
  Synthetic
ctttcaaactugagggacgtgug

SEQ ID NO: 45678 - DNA, 24 bp, Artificial Sequence
  Synthetic
tcauaaaaacgacacctucaggct

SEQ ID NO: 45679 - DNA, 22 bp, Artificial Sequence
  Synthetic
gaaguggcggaaaguaccagat

SEQ ID NO: 45680 - DNA, 24 bp, Artificial Sequence
  Synthetic
tctggaccaugtcagtttacugaa

SEQ ID NO: 45681 - DNA, 29 bp, Artificial Sequence
  Synthetic
catttttagacaauacagccacacucaat

SEQ ID NO: 45682 - DNA, 24 bp, Artificial Sequence
  Synthetic
aggccuccccagacattttaaauc

SEQ ID NO: 45683 - DNA, 24 bp, Artificial Sequence
  Synthetic
acccacuacgacttacaaaaugca

SEQ ID NO: 45684 - DNA, 23 bp, Artificial Sequence
  Synthetic
ggttcugcagccaagagagauaa

SEQ ID NO: 45685 - DNA, 25 bp, Artificial Sequence
  Synthetic
tgcaggacaauacaactgctacaut

SEQ ID NO: 45686 - DNA, 25 bp, Artificial Sequence
  Synthetic
ccatttttcutccagguaaccgaaa

SEQ ID NO: 45687 - DNA, 29 bp, Artificial Sequence
  Synthetic
tgtcagactgcucttctagatttauacga

SEQ ID NO: 45688 - DNA, 22 bp, Artificial Sequence
  Synthetic
ctccaaagacacgutgcatcug

SEQ ID NO: 45689 - DNA, 31 bp, Artificial Sequence; identical to SEQ ID NO: 33455
  Synthetic

SEQ ID NO: 45690 - DNA, 24 bp, Artificial Sequence
  Synthetic
auttccttcauggaaccaggagac

SEQ ID NO: 45691 - DNA, 28 bp, Artificial Sequence
  Synthetic
tccatcaaaaagacagutctctctucaa

SEQ ID NO: 45692 - DNA, 30 bp, Artificial Sequence; identical to SEQ ID NO: 33458
  Synthetic

SEQ ID NO: 45693 - DNA, 28 bp, Artificial Sequence
  Synthetic
cacactcaccaggauctgtattttctut

SEQ ID NO: 45694 - DNA, 30 bp, Artificial Sequence; identical to SEQ ID NO: 33460
  Synthetic

SEQ ID NO: 45695 - DNA, 24 bp, Artificial Sequence
  Synthetic
ccaggcttucctcctttttcauca

SEQ ID NO: 45696 - DNA, 25 bp, Artificial Sequence
  Synthetic
aggatguggatactggtuaggaagt

SEQ ID NO: 45697 - DNA, 29 bp, Artificial Sequence
  Synthetic
acttacagaatacauccgtattttcctut

SEQ ID NO: 45698 - DNA, 24 bp, Artificial Sequence
  Synthetic
accgagucaacgaatgacattcug

SEQ ID NO: 45699 - DNA, 26 bp, Artificial Sequence
  Synthetic
ctgtgtttttccucttggttccauag

SEQ ID NO: 45700 - DNA, 25 bp, Artificial Sequence
  Synthetic
gagaactgucagagtggcagtatut

SEQ ID NO: 45701 - DNA, 27 bp, Artificial Sequence
  Synthetic
caccatgttggucttcattctttucag

SEQ ID NO: 45702 - DNA, 31 bp, Artificial Sequence; identical to SEQ ID NO: 33468
  Synthetic

SEQ ID NO: 45703 - DNA, 26 bp, Artificial Sequence
  Synthetic
gtggatgcctuctcacctgtaaauaa

SEQ ID NO: 45704 - DNA, 27 bp, Artificial Sequence
  Synthetic
aggaagcaacgutatttttgaatugca

SEQ ID NO: 45705 - DNA, 26 bp, Artificial Sequence
  Synthetic
gctgactaccaucctttgtaccauag

SEQ ID NO: 45706 - DNA, 28 bp, Artificial Sequence
  Synthetic
gctctcaagaauttccagtatgguagat

SEQ ID NO: 45707 - DNA, 30 bp, Artificial Sequence; identical to SEQ ID NO: 33473
  Synthetic

SEQ ID NO: 45708 - DNA, 22 bp, Artificial Sequence
  Synthetic
tctaatggcugcaccucaaaca

SEQ ID NO: 45709 - DNA, 23 bp, Artificial Sequence
  Synthetic
cccttccgccutgcaatatcuag

SEQ ID NO: 45710 - DNA, 26 bp, Artificial Sequence
  Synthetic
ctccaacaagcucagattcaaaguac

SEQ ID NO: 45711 - DNA, 23 bp, Artificial Sequence
  Synthetic
gcaaaactacccutccccacaua

SEQ ID NO: 45712 - DNA, 28 bp, Artificial Sequence
  Synthetic
atgaatgtaatgugatgtttgctgtcug

SEQ ID NO: 45713 - DNA, 29 bp, Artificial Sequence
  Synthetic
cactcttgagttugaaaggttactttgut

SEQ ID NO: 45714 - DNA, 28 bp, Artificial Sequence
  Synthetic
gaaatcctggtautttcactctctcuga

SEQ ID NO: 45715 - DNA, 25 bp, Artificial Sequence
  Synthetic
gtgtggccaugattctcacatttut

SEQ ID NO: 45716 - DNA, 28 bp, Artificial Sequence
  Synthetic
tcattagtagcuttgcagtgatatuccc

SEQ ID NO: 45717 - DNA, 23 bp, Artificial Sequence
  Synthetic
gccttctccaguaggagctctua

SEQ ID NO: 45718 - DNA, 24 bp, Artificial Sequence
  Synthetic
cuaagagcccaaaucagaggagaa

SEQ ID NO: 45719 - DNA, 30 bp, Artificial Sequence; identical to SEQ ID NO: 33485
  Synthetic

SEQ ID NO: 45720 - DNA, 31 bp, Artificial Sequence; identical to SEQ ID NO: 33486
  Synthetic

SEQ ID NO: 45721 - DNA, 28 bp, Artificial Sequence
  Synthetic
ctggaggaaacuatacaatcacatgugt

SEQ ID NO: 45722 - DNA, 25 bp, Artificial Sequence
  Synthetic
ccacagttugcaaagaaaaagagug

SEQ ID NO: 45723 - DNA, 21 bp, Artificial Sequence
  Synthetic
cccatccaagugtgctgguat

SEQ ID NO: 45724 - DNA, 31 bp, Artificial Sequence; identical to SEQ ID NO: 33490
  Synthetic

SEQ ID NO: 45725 - DNA, 26 bp, Artificial Sequence
  Synthetic
aacatcaaugacagtggagaguacac

SEQ ID NO: 45726 - DNA, 26 bp, Artificial Sequence
  Synthetic
ggccgtaattuggtatctcctttgua

SEQ ID NO: 45727 - DNA, 31 bp, Artificial Sequence; identical to SEQ ID NO: 33493
  Synthetic

SEQ ID NO: 45728 - DNA, 23 bp, Artificial Sequence
  Synthetic
acatcccttccugcctcatttuc

SEQ ID NO: 45729 - DNA, 26 bp, Artificial Sequence
  Synthetic
acctacacuggaacacttccaattuc

SEQ ID NO: 45730 - DNA, 29 bp, Artificial Sequence
  Synthetic
cagtuaaacacaagaaaaauacaaggaug

SEQ ID NO: 45731 - DNA, 24 bp, Artificial Sequence
  Synthetic
ggagaccggugcaacatctattut

SEQ ID NO: 45732 - DNA, 25 bp, Artificial Sequence
  Synthetic
tgtcaacatagaugtgcaccugaag

SEQ ID NO: 45733 - DNA, 30 bp, Artificial Sequence; identical to SEQ ID NO: 33499
  Synthetic

SEQ ID NO: 45734 - DNA, 28 bp, Artificial Sequence
  Synthetic
ttgtaaaaggaauttgcauaagcaacca

SEQ ID NO: 45735 - DNA, 22 bp, Artificial Sequence
  Synthetic
caaggauggaaagctgtugacc

SEQ ID NO: 45736 - DNA, 22 bp, Artificial Sequence
  Synthetic
cagcattuggcaccagtttcua

SEQ ID NO: 45737 - DNA, 25 bp, Artificial Sequence
  Synthetic
guccagtggctuaaagagaaggaag

SEQ ID NO: 45738 - DNA, 21 bp, Artificial Sequence
  Synthetic
gtccagatcaugcgagaguga

SEQ ID NO: 45739 - DNA, 30 bp, Artificial Sequence; identical to SEQ ID NO: 33505
  Synthetic

SEQ ID NO: 45740 - DNA, 27 bp, Artificial Sequence
  Synthetic
gggagaagguggttttcatttaaugag

SEQ ID NO: 45741 - DNA, 28 bp, Artificial Sequence
  Synthetic
gccagtgataaguacagaatgacttuca

SEQ ID NO: 45742 - DNA, 30 bp, Artificial Sequence; identical to SEQ ID NO: 33508
  Synthetic

SEQ ID NO: 45743 - DNA, 28 bp, Artificial Sequence
  Synthetic
ggaacttgtcucaggtcctaaatgttuc

SEQ ID NO: 45744 - DNA, 30 bp, Artificial Sequence; identical to SEQ ID NO: 33510
  Synthetic

SEQ ID NO: 45745 - DNA, 22 bp, Artificial Sequence
  Synthetic
cagacttgugtgccaugagaga

SEQ ID NO: 45746 - DNA, 24 bp, Artificial Sequence
  Synthetic
caaugcaaacagcaaaacacaucc

SEQ ID NO: 45747 - DNA, 22 bp, Artificial Sequence
  Synthetic
gacagcggucagtacacttuca

SEQ ID NO: 45748 - DNA, 24 bp, Artificial Sequence
  Synthetic
gccatttcacuttgagttctggug

SEQ ID NO: 45749 - DNA, 27 bp, Artificial Sequence
  Synthetic
gtctauagcgacagtttcatuagcaga

SEQ ID NO: 45750 - DNA, 28 bp, Artificial Sequence
  Synthetic
tgtccattauccacacttctgattugaa

SEQ ID NO: 45751 - DNA, 30 bp, Artificial Sequence; identical to SEQ ID NO: 33517
  Synthetic

SEQ ID NO: 45752 - DNA, 24 bp, Artificial Sequence
  Synthetic
tgctgcttcgaauttccctgtuat

SEQ ID NO: 45753 - DNA, 30 bp, Artificial Sequence; identical to SEQ ID NO: 33519
  Synthetic

SEQ ID NO: 45754 - DNA, 24 bp, Artificial Sequence
  Synthetic
ccatcaaugaaggaaatgccaugt

SEQ ID NO: 45755 - DNA, 25 bp, Artificial Sequence
  Synthetic
gttttgcccagugacctgttttuaa

SEQ ID NO: 45756 - DNA, 23 bp, Artificial Sequence
  Synthetic
gaggtgtcauccttccaaacuga

SEQ ID NO: 45757 - DNA, 23 bp, Artificial Sequence
  Synthetic
tctttcaccucagaaccccctua

SEQ ID NO: 45758 - DNA, 29 bp, Artificial Sequence
  Synthetic
ggcagtattgucatgaaaagagaattugt

SEQ ID NO: 45759 - DNA, 25 bp, Artificial Sequence
  Synthetic
ctccttcatucaccaaaaagcugaa

SEQ ID NO: 45760 - DNA, 23 bp, Artificial Sequence
  Synthetic
gggtcagttcutggccatcttua

SEQ ID NO: 45761 - DNA, 25 bp, Artificial Sequence
  Synthetic
ggtaaugcacaacccacatctaucc

SEQ ID NO: 45762 - DNA, 24 bp, Artificial Sequence
  Synthetic
tcttcagtgauttcatcgctguct

SEQ ID NO: 45763 - DNA, 28 bp, Artificial Sequence
  Synthetic
ctggcttttcugaagagtcaattcttut

SEQ ID NO: 45764 - DNA, 24 bp, Artificial Sequence
  Synthetic
ggctaaccagaugatcctgaauga

SEQ ID NO: 45765 - DNA, 22 bp, Artificial Sequence
  Synthetic
cccctccucccttaaugcaaat

SEQ ID NO: 45766 - DNA, 27 bp, Artificial Sequence
  Synthetic
cagtagacuccacaaaagacattcugt

SEQ ID NO: 45767 - DNA, 31 bp, Artificial Sequence; identical to SEQ ID NO: 33533
  Synthetic

SEQ ID NO: 45768 - DNA, 27 bp, Artificial Sequence
  Synthetic
agcttctttgguaatatagcagctucc

SEQ ID NO: 45769 - DNA, 28 bp, Artificial Sequence
  Synthetic
tcccttagaucaaccctcttaactctut

SEQ ID NO: 45770 - DNA, 22 bp, Artificial Sequence
  Synthetic
gtgcctuccacaaatgctaucc

SEQ ID NO: 45771 - DNA, 21 bp, Artificial Sequence
  Synthetic
cucccttcttgugcaacacac

SEQ ID NO: 45772 - DNA, 28 bp, Artificial Sequence
  Synthetic
agctgggcaacautgtttttaaaactua

SEQ ID NO: 45773 - DNA, 25 bp, Artificial Sequence
  Synthetic
cctaacaagcauttagggtgcuaac

SEQ ID NO: 45774 - DNA, 24 bp, Artificial Sequence
  Synthetic
gcaacaccatuggaaaagctcaut

SEQ ID NO: 45775 - DNA, 30 bp, Artificial Sequence; identical to SEQ ID NO: 33541
  Synthetic

SEQ ID NO: 45776 - DNA, 22 bp, Artificial Sequence
  Synthetic
gccacactugccgacttcatua

SEQ ID NO: 45777 - DNA, 22 bp, Artificial Sequence
  Synthetic
cttcagugtgaagtcucaggca

SEQ ID NO: 45778 - DNA, 25 bp, Artificial Sequence
  Synthetic
ctacaaaagcaugaaagcattgugt

SEQ ID NO: 45779 - DNA, 28 bp, Artificial Sequence
  Synthetic
gtaaaagtugaagacagtgggagtuact

SEQ ID NO: 45780 - DNA, 26 bp, Artificial Sequence
  Synthetic
agtttttctacugaggattcctugca

SEQ ID NO: 45781 - DNA, 27 bp, Artificial Sequence
  Synthetic
ccccagggaaagautataagatctgut

SEQ ID NO: 45782 - DNA, 29 bp, Artificial Sequence
  Synthetic
ggctctaattcttuaatgaaatgtggcut

SEQ ID NO: 45783 - DNA, 26 bp, Artificial Sequence
  Synthetic
gggactcctgugatagaaaccattug

SEQ ID NO: 45784 - DNA, 25 bp, Artificial Sequence
  Synthetic
ccagttgguaatacaagcattuccc

SEQ ID NO: 45785 - DNA, 27 bp, Artificial Sequence
  Synthetic
tcgatctucaaagtatatcuccagcct

SEQ ID NO: 45786 - DNA, 23 bp, Artificial Sequence
  Synthetic
tctggaaguggcagataagugaa

SEQ ID NO: 45787 - DNA, 27 bp, Artificial Sequence
  Synthetic
tcgacaaagtaaauaccgaagaccauc

SEQ ID NO: 45788 - DNA, 26 bp, Artificial Sequence
  Synthetic
ttcctcagaaacagugtccacuaaag

SEQ ID NO: 45789 - DNA, 26 bp, Artificial Sequence
  Synthetic
ggttaaatatttggaugccacaccug

SEQ ID NO: 45790 - DNA, 22 bp, Artificial Sequence
  Synthetic
acttgtttuggctccttgcuga

SEQ ID NO: 45791 - DNA, 22 bp, Artificial Sequence
  Synthetic
ggtcgaggcugtaaacaucacc

SEQ ID NO: 45792 - DNA, 24 bp, Artificial Sequence
  Synthetic
ccttagaaagaagguccctuccct

SEQ ID NO: 45793 - DNA, 22 bp, Artificial Sequence
  Synthetic
acuggaaaaugcagggcaagat

SEQ ID NO: 45794 - DNA, 21 bp, Artificial Sequence
  Synthetic
gtcccucagctaagctcugac

SEQ ID NO: 45795 - DNA, 29 bp, Artificial Sequence
  Synthetic
aactttattagcugaacctgaagggaaut

SEQ ID NO: 45796 - DNA, 24 bp, Artificial Sequence
  Synthetic
ctttggagaaggutttcugggact

SEQ ID NO: 45797 - DNA, 28 bp, Artificial Sequence
  Synthetic
agaaaaccagcaacuatcttaugagcat

SEQ ID NO: 45798 - DNA, 22 bp, Artificial Sequence
  Synthetic
tggaaaatccucaggagccuct

SEQ ID NO: 45799 - DNA, 28 bp, Artificial Sequence
  Synthetic
ctttgcaccagugtttattacactauca

SEQ ID NO: 45800 - DNA, 21 bp, Artificial Sequence
  Synthetic
ccucccagctttuccagagat

SEQ ID NO: 45801 - DNA, 29 bp, Artificial Sequence
  Synthetic
ctattaacccctuctgctgactacaaaut

SEQ ID NO: 45802 - DNA, 24 bp, Artificial Sequence
  Synthetic
gtgccttccutttcggaaucaaat

SEQ ID NO: 45803 - DNA, 26 bp, Artificial Sequence
  Synthetic
gccatcaacuggtgtctaattcttug

SEQ ID NO: 45804 - DNA, 28 bp, Artificial Sequence
  Synthetic
attttaagtuaaggtgagtgcugcaaag

SEQ ID NO: 45805 - DNA, 30 bp, Artificial Sequence; identical to SEQ ID NO: 33571
  Synthetic

SEQ ID NO: 45806 - DNA, 24 bp, Artificial Sequence
  Synthetic
ccttccaccaccugaaatucaaaa

SEQ ID NO: 45807 - DNA, 22 bp, Artificial Sequence
  Synthetic
agtgcaacauacaggugcagag

SEQ ID NO: 45808 - DNA, 26 bp, Artificial Sequence
  Synthetic
gggatccctaugactgaacattugaa

SEQ ID NO: 45809 - DNA, 27 bp, Artificial Sequence
  Synthetic
gttcccgaattuactcctgaccauaaa

SEQ ID NO: 45810 - DNA, 26 bp, Artificial Sequence
  Synthetic
gacaatttctugaggagaaggtgtuc

SEQ ID NO: 45811 - DNA, 28 bp, Artificial Sequence
  Synthetic
agagtacatgtgucatgctgtaaacauc

SEQ ID NO: 45812 - DNA, 26 bp, Artificial Sequence
  Synthetic
auttcgataccattucacaccaggaa

SEQ ID NO: 45813 - DNA, 27 bp, Artificial Sequence
  Synthetic
caaatgagcatutctacacaccuacag

SEQ ID NO: 45814 - DNA, 24 bp, Artificial Sequence
  Synthetic
gggtgtggaauatcgctcuagagt

SEQ ID NO: 45815 - DNA, 27 bp, Artificial Sequence
  Synthetic
gttgctgaaagauattcaacacctucc

SEQ ID NO: 45816 - DNA, 28 bp, Artificial Sequence
  Synthetic
gggacttuggagattcaaaatatucaac

SEQ ID NO: 45817 - DNA, 29 bp, Artificial Sequence
  Synthetic
tggaagaagtaacuttcaacactgtguat

SEQ ID NO: 45818 - DNA, 24 bp, Artificial Sequence
  Synthetic
acgcttuccagcagcaagtaaaua

SEQ ID NO: 45819 - DNA, 31 bp, Artificial Sequence; identical to SEQ ID NO: 33585
  Synthetic

SEQ ID NO: 45820 - DNA, 25 bp, Artificial Sequence
  Synthetic
gtggcatctguatattcctgtgucc

SEQ ID NO: 45821 - DNA, 22 bp, Artificial Sequence
  Synthetic
gtgccctacutccaacctcauc

SEQ ID NO: 45822 - DNA, 29 bp, Artificial Sequence
  Synthetic
ctgtacatgucggacttctttttcuaaag

SEQ ID NO: 45823 - DNA, 27 bp, Artificial Sequence
  Synthetic
aaacuagggaacaguaggaaatacaut

SEQ ID NO: 45824 - DNA, 29 bp, Artificial Sequence
  Synthetic
ctggttgaccacuatctaattctuggaat

SEQ ID NO: 45825 - DNA, 26 bp, Artificial Sequence
  Synthetic
agctgctttccuctcaaactcauaaa

SEQ ID NO: 45826 - DNA, 30 bp, Artificial Sequence; identical to SEQ ID NO: 33592
  Synthetic

SEQ ID NO: 45827 - DNA, 27 bp, Artificial Sequence
  Synthetic
gccattgtataugaagaatccctuggt

SEQ ID NO: 45828 - DNA, 25 bp, Artificial Sequence
  Synthetic
cactttgggcacautcttgtacaut

SEQ ID NO: 45829 - DNA, 27 bp, Artificial Sequence
  Synthetic
ttcaagaaccauaaaaaucagcaagcc

SEQ ID NO: 45830 - DNA, 28 bp, Artificial Sequence
  Synthetic
gtctcaaggcttugaaaatagtccctua

SEQ ID NO: 45831 - DNA, 27 bp, Artificial Sequence
  Synthetic
ggcagttgaaagugtttcagatcuaac

SEQ ID NO: 45832 - DNA, 25 bp, Artificial Sequence
  Synthetic
tggttctgcuttaaaaggacuccat

SEQ ID NO: 45833 - DNA, 25 bp, Artificial Sequence
  Synthetic
gaacctaaagcaaugcctcaagauc

SEQ ID NO: 45834 - DNA, 28 bp, Artificial Sequence
  Synthetic
ggaactggugggttagttttuaacaaat

SEQ ID NO: 45835 - DNA, 29 bp, Artificial Sequence
  Synthetic
tggaacaguaaaaacaaccagtatgctua

SEQ ID NO: 45836 - DNA, 23 bp, Artificial Sequence
  Synthetic
gtgggatuggcatgtcattgtua

SEQ ID NO: 45837 - DNA, 28 bp, Artificial Sequence
  Synthetic
tctctgcttcuacacgaattgatgaaut

SEQ ID NO: 45838 - DNA, 28 bp, Artificial Sequence
  Synthetic
tgtggtgtaatagcutgagacacattut

SEQ ID NO: 45839 - DNA, 27 bp, Artificial Sequence
  Synthetic
tccagacugaaataagaaugagccaag

SEQ ID NO: 45840 - DNA, 31 bp, Artificial Sequence; identical to SEQ ID NO: 33606
  Synthetic

SEQ ID NO: 45841 - DNA, 22 bp, Artificial Sequence
  Synthetic
ccuggacaaggagaucaaagug

SEQ ID NO: 45842 - DNA, 28 bp, Artificial Sequence
  Synthetic
cattcccttttgutccacatcttgttut

SEQ ID NO: 45843 - DNA, 30 bp, Artificial Sequence; identical to SEQ ID NO: 33609
  Synthetic

SEQ ID NO: 45844 - DNA, 28 bp, Artificial Sequence
  Synthetic
gaatctctgtctuggacccttttaauct

SEQ ID NO: 45845 - DNA, 28 bp, Artificial Sequence
  Synthetic
agccttctttuacccagaaacttacaut

SEQ ID NO: 45846 - DNA, 22 bp, Artificial Sequence
  Synthetic
aagctgcauaaagcgaugagga

SEQ ID NO: 45847 - DNA, 24 bp, Artificial Sequence
  Synthetic
cacgaaggugcaaagauagaggaa

SEQ ID NO: 45848 - DNA, 23 bp, Artificial Sequence
  Synthetic
ccgtggacuctttagcacatucc

SEQ ID NO: 45849 - DNA, 23 bp, Artificial Sequence
  Synthetic
agtggcagautcctcttucacaa

SEQ ID NO: 45850 - DNA, 26 bp, Artificial Sequence
  Synthetic
cacaguatgcaauaaaacaaacagca

SEQ ID NO: 45851 - DNA, 27 bp, Artificial Sequence
  Synthetic
gcttatagtugatgcttacucagagca

SEQ ID NO: 45852 - DNA, 24 bp, Artificial Sequence
  Synthetic
ccattggauttctggctugggaat

SEQ ID NO: 45853 - DNA, 30 bp, Artificial Sequence; identical to SEQ ID NO: 33619
  Synthetic

SEQ ID NO: 45854 - DNA, 23 bp, Artificial Sequence
  Synthetic
cttggccuacagcattacuagca

SEQ ID NO: 45855 - DNA, 28 bp, Artificial Sequence
  Synthetic
tgaagtatctcutttcttttgtgucgca

SEQ ID NO: 45856 - DNA, 25 bp, Artificial Sequence
  Synthetic
ggaaaggacaaaagccugcttctua

SEQ ID NO: 45857 - DNA, 27 bp, Artificial Sequence
  Synthetic
ttcaagtgcaaauttcttcatgauggg

SEQ ID NO: 45858 - DNA, 27 bp, Artificial Sequence
  Synthetic
ggaggattauttctgatggauccacaa

SEQ ID NO: 45859 - DNA, 29 bp, Artificial Sequence
  Synthetic
acgacacaaauatgtaguggaaagaagaa

SEQ ID NO: 45860 - DNA, 27 bp, Artificial Sequence
  Synthetic
ggatggtggutagaaaatguaaaaggg

SEQ ID NO: 45861 - DNA, 24 bp, Artificial Sequence
  Synthetic
cgtgtcaacugcaaaactcttugt

SEQ ID NO: 45862 - DNA, 25 bp, Artificial Sequence
  Synthetic
gtttaccguatggtgatucagagga

SEQ ID NO: 45863 - DNA, 26 bp, Artificial Sequence
  Synthetic
tttctacatgcuattttccagcucgt

SEQ ID NO: 45864 - DNA, 30 bp, Artificial Sequence; identical to SEQ ID NO: 33630
  Synthetic

SEQ ID NO: 45865 - DNA, 26 bp, Artificial Sequence
  Synthetic
ttacgtaaagtcuccttgggtgttut

SEQ ID NO: 45866 - DNA, 23 bp, Artificial Sequence
  Synthetic
ttggtcatugccacagacaaaug

SEQ ID NO: 45867 - DNA, 24 bp, Artificial Sequence
  Synthetic
caaaactgccucttttgagtguga

SEQ ID NO: 45868 - DNA, 23 bp, Artificial Sequence
  Synthetic
gggttcatuaaggaaagggcugt

SEQ ID NO: 45869 - DNA, 25 bp, Artificial Sequence
  Synthetic
acaaacacagacuggtcucagaaag

SEQ ID NO: 45870 - DNA, 26 bp, Artificial Sequence
  Synthetic
ggagcaatucagtgatagggtuaact

SEQ ID NO: 45871 - DNA, 22 bp, Artificial Sequence
  Synthetic
ggagttgtgcuggaatccaaug

SEQ ID NO: 45872 - DNA, 28 bp, Artificial Sequence
  Synthetic
tttatggtauccaaaatggccataucgt

SEQ ID NO: 45873 - DNA, 25 bp, Artificial Sequence
  Synthetic
atggccauaaaaggagacutaucat

SEQ ID NO: 45874 - DNA, 29 bp, Artificial Sequence
  Synthetic
ggttaataaauataccaaccugccacagt

SEQ ID NO: 45875 - DNA, 28 bp, Artificial Sequence
  Synthetic
ggaattgatgucctgtggaatttuaagg

SEQ ID NO: 45876 - DNA, 28 bp, Artificial Sequence
  Synthetic
tctcttggtuattgttacacugggaaag

SEQ ID NO: 45877 - DNA, 25 bp, Artificial Sequence
  Synthetic
gtacaggccautgtgaaaggtacua

SEQ ID NO: 45878 - DNA, 27 bp, Artificial Sequence
  Synthetic
acacacacaagaugaatgaattttgut

SEQ ID NO: 45879 - DNA, 27 bp, Artificial Sequence
  Synthetic
gacatgacuaaggaagatgcuggaaat

SEQ ID NO: 45880 - DNA, 22 bp, Artificial Sequence
  Synthetic
cgtctttcauccagacgcctuc

SEQ ID NO: 45881 - DNA, 27 bp, Artificial Sequence
  Synthetic
ctgcagtgagcaucattatggtttaut

SEQ ID NO: 45882 - DNA, 23 bp, Artificial Sequence
  Synthetic
acgtccacgacgagaugtaatug

SEQ ID NO: 45883 - DNA, 29 bp, Artificial Sequence
  Synthetic
ctaagtctagaugcatacctcuccaaaaa

SEQ ID NO: 45884 - DNA, 25 bp, Artificial Sequence
  Synthetic
tcaauggtcagtauggagaggaagt

SEQ ID NO: 45885 - DNA, 26 bp, Artificial Sequence
  Synthetic
ctttttcccccaccuttttcttguag

SEQ ID NO: 45886 - DNA, 20 bp, Artificial Sequence
  Synthetic
tcttcgggccaguaccagua

SEQ ID NO: 45887 - DNA, 28 bp, Artificial Sequence
  Synthetic
aaggcaaaaucacgattccaactttuaa

SEQ ID NO: 45888 - DNA, 25 bp, Artificial Sequence
  Synthetic
ggtaatggctucataatagcccuct

SEQ ID NO: 45889 - DNA, 22 bp, Artificial Sequence
  Synthetic
aaggccugagtttcacguacat

SEQ ID NO: 45890 - DNA, 22 bp, Artificial Sequence
  Synthetic
tccacgatguccaggtaaugga

SEQ ID NO: 45891 - DNA, 24 bp, Artificial Sequence
  Synthetic
aggtgcacutacaggtguaacaac

SEQ ID NO: 45892 - DNA, 26 bp, Artificial Sequence
  Synthetic
ccatatttgtuagtggctcugcaagt

SEQ ID NO: 45893 - DNA, 24 bp, Artificial Sequence
  Synthetic
tccttaagacutaagcgcttuggg

SEQ ID NO: 45894 - DNA, 22 bp, Artificial Sequence
  Synthetic
tctatatgucccccgtgggaug

SEQ ID NO: 45895 - DNA, 27 bp, Artificial Sequence
  Synthetic
attgattattcccucccccaactttut

SEQ ID NO: 45896 - DNA, 24 bp, Artificial Sequence
  Synthetic
tcaaccatacaaugtcagggtugg

SEQ ID NO: 45897 - DNA, 26 bp, Artificial Sequence
  Synthetic
caggtatttcagccutactccctcua

SEQ ID NO: 45898 - DNA, 28 bp, Artificial Sequence
  Synthetic
ggcagggacaauaattagtgattgagua

SEQ ID NO: 45899 - DNA, 29 bp, Artificial Sequence
  Synthetic
tgcucatgaatcauaaaaacacaaaaaca

SEQ ID NO: 45900 - DNA, 28 bp, Artificial Sequence
  Synthetic
gaaacaggtttuaacacaaagactggut

SEQ ID NO: 45901 - DNA, 24 bp, Artificial Sequence
  Synthetic
gcctcacgaaaguattgtgtguct

SEQ ID NO: 45902 - DNA, 23 bp, Artificial Sequence
  Synthetic
ggaatgtaagucggagcuccaag

SEQ ID NO: 45903 - DNA, 22 bp, Artificial Sequence
  Synthetic
caagcgcaucaaacauggagaa

SEQ ID NO: 45904 - DNA, 27 bp, Artificial Sequence
  Synthetic
ccaatttguatctttactguggcaagg

SEQ ID NO: 45905 - DNA, 25 bp, Artificial Sequence
  Synthetic
atggagaagaaaagauggcagtuga

SEQ ID NO: 45906 - DNA, 21 bp, Artificial Sequence
  Synthetic
tcuaaccccgagctcaucact

SEQ ID NO: 45907 - DNA, 29 bp, Artificial Sequence
  Synthetic
cacctggatttguatactctgagtaugaa

SEQ ID NO: 45908 - DNA, 23 bp, Artificial Sequence
  Synthetic
gcacauagaaactggagtugcac

SEQ ID NO: 45909 - DNA, 28 bp, Artificial Sequence
  Synthetic
cccacagaagagutgttgataactgaut

SEQ ID NO: 45910 - DNA, 23 bp, Artificial Sequence
  Synthetic
ccagtttcuggaccactggttut

SEQ ID NO: 45911 - DNA, 23 bp, Artificial Sequence
  Synthetic
ccagtautggcaaatugcaaccc

SEQ ID NO: 45912 - DNA, 23 bp, Artificial Sequence
  Synthetic
aagtgatggcaugtgcatuagga

SEQ ID NO: 45913 - DNA, 22 bp, Artificial Sequence
  Synthetic
gacagugacatgguacagggaa

SEQ ID NO: 45914 - DNA, 25 bp, Artificial Sequence
  Synthetic
gagaaactgauctttgcaaacgugt

SEQ ID NO: 45915 - DNA, 29 bp, Artificial Sequence
  Synthetic
tgcatgagcuaagagtttatgagattucc

SEQ ID NO: 45916 - DNA, 22 bp, Artificial Sequence
  Synthetic
aacgccagcutcactcttguaa

SEQ ID NO: 45917 - DNA, 30 bp, Artificial Sequence; identical to SEQ ID NO: 33683
  Synthetic

SEQ ID NO: 45918 - DNA, 24 bp, Artificial Sequence
  Synthetic
tgaggctugctttaccaugaacaa

SEQ ID NO: 45919 - DNA, 27 bp, Artificial Sequence
  Synthetic
cactttggaguacggatauaaggaacg

SEQ ID NO: 45920 - DNA, 23 bp, Artificial Sequence
  Synthetic
gggauttcacactuggaacaaca

SEQ ID NO: 45921 - DNA, 31 bp, Artificial Sequence; identical to SEQ ID NO: 33687
  Synthetic

SEQ ID NO: 45922 - DNA, 22 bp, Artificial Sequence
  Synthetic
agtgacuttcacatuggcagga

SEQ ID NO: 45923 - DNA, 29 bp, Artificial Sequence
  Synthetic
gtcttcccatugcttttgtatctttugaa

SEQ ID NO: 45924 - DNA, 31 bp, Artificial Sequence; identical to SEQ ID NO: 33690
  Synthetic

SEQ ID NO: 45925 - DNA, 28 bp, Artificial Sequence
  Synthetic
accatattattucattgggcaucaggaa

SEQ ID NO: 45926 - DNA, 23 bp, Artificial Sequence
  Synthetic
ctcagtggauggtggttgagtua

SEQ ID NO: 45927 - DNA, 22 bp, Artificial Sequence
  Synthetic
gttgttgcugccgttgataugg

SEQ ID NO: 45928 - DNA, 31 bp, Artificial Sequence; identical to SEQ ID NO: 33694
  Synthetic

SEQ ID NO: 45929 - DNA, 23 bp, Artificial Sequence
  Synthetic
gaggcugagaugagagagacaac

SEQ ID NO: 45930 - DNA, 24 bp, Artificial Sequence
  Synthetic
ggacaagggaauctttctcgttuc

SEQ ID NO: 45931 - DNA, 22 bp, Artificial Sequence
  Synthetic
aagucaagauccccaacaccac

SEQ ID NO: 45932 - DNA, 26 bp, Artificial Sequence
  Synthetic
aagatuaaaacaaagcccacgtugag

SEQ ID NO: 45933 - DNA, 24 bp, Artificial Sequence
  Synthetic
acattcauctttccctucccacag

SEQ ID NO: 45934 - DNA, 24 bp, Artificial Sequence
  Synthetic
gtagaggucgccttcttgugaaat

SEQ ID NO: 45935 - DNA, 27 bp, Artificial Sequence
  Synthetic
tctcactcttgacuttgttctcttguc

SEQ ID NO: 45936 - DNA, 22 bp, Artificial Sequence
  Synthetic
agatccatuggtggcttucagg

SEQ ID NO: 45937 - DNA, 27 bp, Artificial Sequence
  Synthetic
tgcccattcaaacauaaaggtgaatug

SEQ ID NO: 45938 - DNA, 24 bp, Artificial Sequence
  Synthetic
gtgccatgtucctcaagagaauct

SEQ ID NO: 45939 - DNA, 29 bp, Artificial Sequence
  Synthetic
gaagcatggaagaaaugattccaaaguaa

SEQ ID NO: 45940 - DNA, 22 bp, Artificial Sequence
  Synthetic
accaactgccugctttgauagt

SEQ ID NO: 45941 - DNA, 30 bp, Artificial Sequence; identical to SEQ ID NO: 33707
  Synthetic

SEQ ID NO: 45942 - DNA, 24 bp, Artificial Sequence
  Synthetic
ccttcttaugaggcaggatucgat

SEQ ID NO: 45943 - DNA, 27 bp, Artificial Sequence
  Synthetic
gaagtatggcucttataatugcccgaa

SEQ ID NO: 45944 - DNA, 28 bp, Artificial Sequence
  Synthetic
acagtctaaagguaatgaaagtgatugg

SEQ ID NO: 45945 - DNA, 31 bp, Artificial Sequence; identical to SEQ ID NO: 33711
  Synthetic

SEQ ID NO: 45946 - DNA, 28 bp, Artificial Sequence
  Synthetic
aaatgatatttcacagucttctgcccua

SEQ ID NO: 45947 - DNA, 27 bp, Artificial Sequence
  Synthetic
aaaaatatcgauggatgtccccuaacc

SEQ ID NO: 45948 - DNA, 25 bp, Artificial Sequence
  Synthetic
agagggagaagggucagtttaauga

SEQ ID NO: 45949 - DNA, 29 bp, Artificial Sequence
  Synthetic
tgccttctttgcutgatttgtattttuct

SEQ ID NO: 45950 - DNA, 30 bp, Artificial Sequence; identical to SEQ ID NO: 33716
  Synthetic

SEQ ID NO: 45951 - DNA, 26 bp, Artificial Sequence
  Synthetic
gtcactttgtguatgtgtgtgtgtut

SEQ ID NO: 45952 - DNA, 22 bp, Artificial Sequence
  Synthetic
cctgcaagcutcaacagaggut

SEQ ID NO: 45953 - DNA, 27 bp, Artificial Sequence
  Synthetic
acagacttgugtgtcatttuaaaggga

SEQ ID NO: 45954 - DNA, 29 bp, Artificial Sequence
  Synthetic
ttttgttccttuttcaagcagaugaagag

SEQ ID NO: 45955 - DNA, 28 bp, Artificial Sequence
  Synthetic
tgttcctctctaugaaacacaatggtut

SEQ ID NO: 45956 - DNA, 19 bp, Artificial Sequence
  Synthetic
cagcaccacgucacaacug

SEQ ID NO: 45957 - DNA, 17 bp, Artificial Sequence
  Synthetic
gccaugcccuggaggag

SEQ ID NO: 45958 - DNA, 31 bp, Artificial Sequence; identical to SEQ ID NO: 33724
  Synthetic

SEQ ID NO: 45959 - DNA, 25 bp, Artificial Sequence
  Synthetic
agaagaggaagaccuggagcaauaa

SEQ ID NO: 45960 - DNA, 30 bp, Artificial Sequence; identical to SEQ ID NO: 33726
  Synthetic

SEQ ID NO: 45961 - DNA, 22 bp, Artificial Sequence
  Synthetic
tgacugtgaattgucccagcat

SEQ ID NO: 45962 - DNA, 26 bp, Artificial Sequence
  Synthetic
tttatctccctuccaggagaaatugc

SEQ ID NO: 45963 - DNA, 26 bp, Artificial Sequence
  Synthetic
actagaccauatgaagagctuggaca

SEQ ID NO: 45964 - DNA, 31 bp, Artificial Sequence; identical to SEQ ID NO: 33730
  Synthetic

SEQ ID NO: 45965 - DNA, 22 bp, Artificial Sequence
  Synthetic
cuccaagcactguacaccaaag

SEQ ID NO: 45966 - DNA, 32 bp, Artificial Sequence; identical to SEQ ID NO: 33732
  Synthetic

SEQ ID NO: 45967 - DNA, 21 bp, Artificial Sequence
  Synthetic
cgugcaagauggaggaagcaa

SEQ ID NO: 45968 - DNA, 29 bp, Artificial Sequence
  Synthetic
gggattgacauatgttttagaugagaaga

SEQ ID NO: 45969 - DNA, 27 bp, Artificial Sequence
  Synthetic
gcttttgagagaacucattacccugac

SEQ ID NO: 45970 - DNA, 22 bp, Artificial Sequence
  Synthetic
cacaggtuaaacccccucacat

SEQ ID NO: 45971 - DNA, 23 bp, Artificial Sequence
  Synthetic
agcutttatgcccucaggaaagg

SEQ ID NO: 45972 - DNA, 26 bp, Artificial Sequence
  Synthetic
gcacaatucacagttctagaauccca

SEQ ID NO: 45973 - DNA, 17 bp, Artificial Sequence
  Synthetic
gagggcaucggcuagct

SEQ ID NO: 45974 - DNA, 21 bp, Artificial Sequence
  Synthetic
gctgtgttuggccttcttcuc

SEQ ID NO: 45975 - DNA, 20 bp, Artificial Sequence
  Synthetic
acagcccugcttgtcucaac

SEQ ID NO: 45976 - DNA, 20 bp, Artificial Sequence
  Synthetic
atuggagagucccagatguc

SEQ ID NO: 45977 - DNA, 20 bp, Artificial Sequence
  Synthetic
gcgtcuccaagatcctgugc

SEQ ID NO: 45978 - DNA, 18 bp, Artificial Sequence
  Synthetic
cgctgaggcccuccctua

SEQ ID NO: 45979 - DNA, 18 bp, Artificial Sequence
  Synthetic
gtucccgagggtcauccg

SEQ ID NO: 45980 - DNA, 30 bp, Artificial Sequence; identical to SEQ ID NO: 33746
  Synthetic

SEQ ID NO: 45981 - DNA, 22 bp, Artificial Sequence
  Synthetic
cggtttcuggactcttcctuga

SEQ ID NO: 45982 - DNA, 27 bp, Artificial Sequence
  Synthetic
caaaaaggaaguaggaaaugctcttua

SEQ ID NO: 45983 - DNA, 22 bp, Artificial Sequence
  Synthetic
tgatgacagcugtgctaacguc

SEQ ID NO: 45984 - DNA, 23 bp, Artificial Sequence
  Synthetic
tgaaggctcccuttggtacatug

SEQ ID NO: 45985 - DNA, 22 bp, Artificial Sequence
  Synthetic
caccttgtguccaacctcucag

SEQ ID NO: 45986 - DNA, 24 bp, Artificial Sequence
  Synthetic
ttagagtcattugcttccccaucc

SEQ ID NO: 45987 - DNA, 29 bp, Artificial Sequence
  Synthetic
tctgtccuccaagaataaatcucaagaga

SEQ ID NO: 45988 - DNA, 23 bp, Artificial Sequence
  Synthetic
gctccacttcuccttcaaggaut

SEQ ID NO: 45989 - DNA, 27 bp, Artificial Sequence
  Synthetic
gatccaagaaugggctttttctuacag

SEQ ID NO: 45990 - DNA, 17 bp, Artificial Sequence
  Synthetic
ggguggagctuccagca

SEQ ID NO: 45991 - DNA, 28 bp, Artificial Sequence
  Synthetic
gcttgaagattgtuaacctatgaggcut

SEQ ID NO: 45992 - DNA, 24 bp, Artificial Sequence
  Synthetic
cctcagtguaagacagctcugaat

SEQ ID NO: 45993 - DNA, 22 bp, Artificial Sequence
  Synthetic
ttctccauggtgttucccaagg

SEQ ID NO: 45994 - DNA, 27 bp, Artificial Sequence
  Synthetic
agaataaaattcaacccuccacagcut

SEQ ID NO: 45995 - DNA, 29 bp, Artificial Sequence
  Synthetic
acaagattgggagaucaatgtttguaact

SEQ ID NO: 45996 - DNA, 21 bp, Artificial Sequence
  Synthetic
agcccccuctctagaagaucc

SEQ ID NO: 45997 - DNA, 25 bp, Artificial Sequence
  Synthetic
tgcttgctgutcctgagatcuaaaa

SEQ ID NO: 45998 - DNA, 27 bp, Artificial Sequence
  Synthetic
gacaataaaagucaagatgctgggaut

SEQ ID NO: 45999 - DNA, 22 bp, Artificial Sequence
  Synthetic
gagtcagugagcctggaacauc

SEQ ID NO: 46000 - DNA, 23 bp, Artificial Sequence
  Synthetic
gggatuaacgtgcatatuccaca

SEQ ID NO: 46001 - DNA, 28 bp, Artificial Sequence
  Synthetic
tggtgacatugttcagtcaaatuaacct

SEQ ID NO: 46002 - DNA, 17 bp, Artificial Sequence
  Synthetic
gctgggcugccauggaa

SEQ ID NO: 46003 - DNA, 23 bp, Artificial Sequence
  Synthetic
gcccagccuttgcttctatttut

SEQ ID NO: 46004 - DNA, 21 bp, Artificial Sequence
  Synthetic
gctcaucccaacctcatgguc

SEQ ID NO: 46005 - DNA, 21 bp, Artificial Sequence
  Synthetic
gctccttgutgtagccctuct

SEQ ID NO: 46006 - DNA, 24 bp, Artificial Sequence
  Synthetic
agagagagagagagugggtgaaug

SEQ ID NO: 46007 - DNA, 19 bp, Artificial Sequence
  Synthetic
ccctcggccutccaaagug

SEQ ID NO: 46008 - DNA, 21 bp, Artificial Sequence
  Synthetic
tcaccctgccucctttcctua

SEQ ID NO: 46009 - DNA, 19 bp, Artificial Sequence
  Synthetic
guggcagccaguacacgaa

SEQ ID NO: 46010 - DNA, 21 bp, Artificial Sequence
  Synthetic
gagtgtcacuctctgcccaut

SEQ ID NO: 46011 - DNA, 20 bp, Artificial Sequence
  Synthetic
tgugtgtgtcugagggacct

SEQ ID NO: 46012 - DNA, 19 bp, Artificial Sequence
  Synthetic
ccgcaagccccucttcuac

SEQ ID NO: 46013 - DNA, 19 bp, Artificial Sequence
  Synthetic
ggcucccaggaggaaguga

SEQ ID NO: 46014 - DNA, 20 bp, Artificial Sequence
  Synthetic
gctccaagcugagtgttugc

SEQ ID NO: 46015 - DNA, 24 bp, Artificial Sequence
  Synthetic
ccaggattacaguggtgagcttut

SEQ ID NO: 46016 - DNA, 20 bp, Artificial Sequence
  Synthetic
gccgaggaguacttccugct

SEQ ID NO: 46017 - DNA, 17 bp, Artificial Sequence
  Synthetic
gggccagagugggtgug

SEQ ID NO: 46018 - DNA, 18 bp, Artificial Sequence
  Synthetic
tctcugccccuacccaca

SEQ ID NO: 46019 - DNA, 18 bp, Artificial Sequence
  Synthetic
tcucctggcuccccaaca

SEQ ID NO: 46020 - DNA, 22 bp, Artificial Sequence
  Synthetic
ccuatttagcuggcagggacat

SEQ ID NO: 46021 - DNA, 21 bp, Artificial Sequence
  Synthetic
aggtcaatcuccttgcagugg

SEQ ID NO: 46022 - DNA, 19 bp, Artificial Sequence
  Synthetic
tcugacacaugcacgcaca

SEQ ID NO: 46023 - DNA, 23 bp, Artificial Sequence
  Synthetic
cagtactuggagacagugaaggt

SEQ ID NO: 46024 - DNA, 21 bp, Artificial Sequence
  Synthetic
gcatctccutctgccacauct

SEQ ID NO: 46025 - DNA, 20 bp, Artificial Sequence
  Synthetic
cccaccuggctttagaccuc

SEQ ID NO: 46026 - DNA, 19 bp, Artificial Sequence
  Synthetic
cgtuacaacggccuacggt

SEQ ID NO: 46027 - DNA, 17 bp, Artificial Sequence
  Synthetic
ccagttcuccgcccucc

SEQ ID NO: 46028 - DNA, 22 bp, Artificial Sequence
  Synthetic
gtcatcttcugcaatcgcaguc

SEQ ID NO: 46029 - DNA, 20 bp, Artificial Sequence
  Synthetic
gcttcagaccgugctaucgt

SEQ ID NO: 46030 - DNA, 22 bp, Artificial Sequence
  Synthetic
ccctagtcugccactgaggaut

SEQ ID NO: 46031 - DNA, 25 bp, Artificial Sequence
  Synthetic
acagaaatctucaatctcccauccg

SEQ ID NO: 46032 - DNA, 19 bp, Artificial Sequence
  Synthetic
accagcacugcaaauggct

SEQ ID NO: 46033 - DNA, 19 bp, Artificial Sequence
  Synthetic
cgaggcugcctgtcttcua

SEQ ID NO: 46034 - DNA, 26 bp, Artificial Sequence
  Synthetic
cccaccttauattgccatcttuacga

SEQ ID NO: 46035 - DNA, 25 bp, Artificial Sequence
  Synthetic
agctcagctgutttctttccctuag

SEQ ID NO: 46036 - DNA, 27 bp, Artificial Sequence
  Synthetic
acgctttaagtutgcacataaatcucc

SEQ ID NO: 46037 - DNA, 26 bp, Artificial Sequence
  Synthetic
aaaccagaguccttaacaagcatuga

SEQ ID NO: 46038 - DNA, 26 bp, Artificial Sequence
  Synthetic
gaatcgcttaauggactagaaggcut

SEQ ID NO: 46039 - DNA, 23 bp, Artificial Sequence
  Synthetic
atguccaggagaccaagttucag

SEQ ID NO: 46040 - DNA, 21 bp, Artificial Sequence
  Synthetic
cggcacaguccactaactcua

SEQ ID NO: 46041 - DNA, 24 bp, Artificial Sequence
  Synthetic
gcactgacugccaactaatttugc

SEQ ID NO: 46042 - DNA, 30 bp, Artificial Sequence; identical to SEQ ID NO: 33808
  Synthetic

SEQ ID NO: 46043 - DNA, 28 bp, Artificial Sequence
  Synthetic
tgtggcttctguttgtcttgtctatuaa

SEQ ID NO: 46044 - DNA, 27 bp, Artificial Sequence
  Synthetic
accccattaautgactgacatuaccac

SEQ ID NO: 46045 - DNA, 28 bp, Artificial Sequence
  Synthetic
ccaatcatggaautttctttctccucct

SEQ ID NO: 46046 - DNA, 27 bp, Artificial Sequence
  Synthetic
tcctcatcccuatcttccttggauaaa

SEQ ID NO: 46047 - DNA, 30 bp, Artificial Sequence; identical to SEQ ID NO: 33813
  Synthetic

SEQ ID NO: 46048 - DNA, 31 bp, Artificial Sequence; identical to SEQ ID NO: 33814
  Synthetic

SEQ ID NO: 46049 - DNA, 22 bp, Artificial Sequence
  Synthetic
gttggtccuaaaggtggtccut

SEQ ID NO: 46050 - DNA, 22 bp, Artificial Sequence
  Synthetic
gctgauagccaaactgcugaac

SEQ ID NO: 46051 - DNA, 32 bp, Artificial Sequence; identical to SEQ ID NO: 33817
  Synthetic

SEQ ID NO: 46052 - DNA, 18 bp, Artificial Sequence
  Synthetic
ccagcuggagcgtttucg

SEQ ID NO: 46053 - DNA, 18 bp, Artificial Sequence
  Synthetic
cccuccccaaguccaact

SEQ ID NO: 46054 - DNA, 21 bp, Artificial Sequence
  Synthetic
ctgaccaucacgaggcugaat

SEQ ID NO: 46055 - DNA, 25 bp, Artificial Sequence
  Synthetic
tgtatgagagaaacucaggtuccga

SEQ ID NO: 46056 - DNA, 24 bp, Artificial Sequence
  Synthetic
tgggatuacaggcaaaaaccucat

SEQ ID NO: 46057 - DNA, 20 bp, Artificial Sequence
  Synthetic
ggtagcggucaacaagggut

SEQ ID NO: 46058 - DNA, 23 bp, Artificial Sequence
  Synthetic
cctcagagacuacaaggugaagc

SEQ ID NO: 46059 - DNA, 25 bp, Artificial Sequence
  Synthetic
ggtgactttugggattttccatguc

SEQ ID NO: 46060 - DNA, 22 bp, Artificial Sequence
  Synthetic
gaaggatgcucaggaaguccac

SEQ ID NO: 46061 - DNA, 22 bp, Artificial Sequence
  Synthetic
tgtgugaagcccaucaaagacc

SEQ ID NO: 46062 - DNA, 29 bp, Artificial Sequence
  Synthetic
ggcaacttcaguacttcctatatcttucc

SEQ ID NO: 46063 - DNA, 22 bp, Artificial Sequence
  Synthetic
agtgcaaggcugtcaacaugat

SEQ ID NO: 46064 - DNA, 18 bp, Artificial Sequence
  Synthetic
acatcuggcccgcacauc

SEQ ID NO: 46065 - DNA, 17 bp, Artificial Sequence
  Synthetic
ggcgauacgcguccaca

SEQ ID NO: 46066 - DNA, 28 bp, Artificial Sequence
  Synthetic
tcaaaacagttucactttcctgtcauct

SEQ ID NO: 46067 - DNA, 29 bp, Artificial Sequence
  Synthetic
agtgagggagcaugactaaaaauagaaaa

SEQ ID NO: 46068 - DNA, 25 bp, Artificial Sequence
  Synthetic
cagtcaagttuccacaactgtguaa

SEQ ID NO: 46069 - DNA, 29 bp, Artificial Sequence
  Synthetic
acactgactgtgugtactatgagaauaca

SEQ ID NO: 46070 - DNA, 21 bp, Artificial Sequence
  Synthetic
caagctccccuaccatgacut

SEQ ID NO: 46071 - DNA, 27 bp, Artificial Sequence
  Synthetic
ccacaccctuaagagaagaaaacucac

SEQ ID NO: 46072 - DNA, 23 bp, Artificial Sequence
  Synthetic
ctgggagtugccatatctgucat

SEQ ID NO: 46073 - DNA, 21 bp, Artificial Sequence
  Synthetic
gutgatgttgtuggcacacgt

SEQ ID NO: 46074 - DNA, 24 bp, Artificial Sequence
  Synthetic
cagaacactucagagcagttugag

SEQ ID NO: 46075 - DNA, 22 bp, Artificial Sequence
  Synthetic
gtactcctguaggttgccctug

SEQ ID NO: 46076 - DNA, 24 bp, Artificial Sequence
  Synthetic
gacctcaagagcuccaatatccuc

SEQ ID NO: 46077 - DNA, 25 bp, Artificial Sequence
  Synthetic
ggagatatggaucaagagguagggt

SEQ ID NO: 46078 - DNA, 24 bp, Artificial Sequence
  Synthetic
catctcaccaugctcatttcctut

SEQ ID NO: 46079 - DNA, 27 bp, Artificial Sequence
  Synthetic
tgacctttguaaacactcactcctuac

SEQ ID NO: 46080 - DNA, 21 bp, Artificial Sequence
  Synthetic
gacggcuccctaaacacuacc

SEQ ID NO: 46081 - DNA, 26 bp, Artificial Sequence
  Synthetic
tgacaatgucaaaggcatagaaugct

SEQ ID NO: 46082 - DNA, 24 bp, Artificial Sequence
  Synthetic
catctagacgtutccttggctcut

SEQ ID NO: 46083 - DNA, 21 bp, Artificial Sequence
  Synthetic
cccgttaagucgtagccctua

SEQ ID NO: 46084 - DNA, 32 bp, Artificial Sequence; identical to SEQ ID NO: 33850
  Synthetic

SEQ ID NO: 46085 - DNA, 24 bp, Artificial Sequence
  Synthetic
cagacaaugtcaucacaggaggat

SEQ ID NO: 46086 - DNA, 32 bp, Artificial Sequence; identical to SEQ ID NO: 33852
  Synthetic

SEQ ID NO: 46087 - DNA, 21 bp, Artificial Sequence
  Synthetic
ctgtgggugtttcctgugagt

SEQ ID NO: 46088 - DNA, 22 bp, Artificial Sequence
  Synthetic
gctttttcuccccctcccacua

SEQ ID NO: 46089 - DNA, 19 bp, Artificial Sequence
  Synthetic
ggaugagaagcgcccugac

SEQ ID NO: 46090 - DNA, 23 bp, Artificial Sequence
  Synthetic
ccaccagauggttcgtacagaut

SEQ ID NO: 46091 - DNA, 23 bp, Artificial Sequence
  Synthetic
ctgattttuggcagccactucag

SEQ ID NO: 46092 - DNA, 26 bp, Artificial Sequence
  Synthetic
atgatctgcacutccttttcttcaut

SEQ ID NO: 46093 - DNA, 21 bp, Artificial Sequence
  Synthetic
gcagtugaggccctatgcauc

SEQ ID NO: 46094 - DNA, 28 bp, Artificial Sequence
  Synthetic
gttgtatctcaagcaugaattcagctut

SEQ ID NO: 46095 - DNA, 28 bp, Artificial Sequence
  Synthetic
gagctactatttucagaaacgatcagut

SEQ ID NO: 46096 - DNA, 29 bp, Artificial Sequence
  Synthetic
ctatgacagcatuatttcttgttccctug

SEQ ID NO: 46097 - DNA, 28 bp, Artificial Sequence
  Synthetic
aaatgcttagtauctgcttgatcacuga

SEQ ID NO: 46098 - DNA, 22 bp, Artificial Sequence
  Synthetic
gacaccagugtatgttgggaug

SEQ ID NO: 46099 - DNA, 26 bp, Artificial Sequence
  Synthetic
ctgcaggatatutccatcttctguga

SEQ ID NO: 46100 - DNA, 21 bp, Artificial Sequence
  Synthetic
caggtctauctgaggccucca

SEQ ID NO: 46101 - DNA, 19 bp, Artificial Sequence
  Synthetic
ccgtgaguccatcgtguga

SEQ ID NO: 46102 - DNA, 20 bp, Artificial Sequence
  Synthetic
acctggaggutatcgcuggt

SEQ ID NO: 46103 - DNA, 22 bp, Artificial Sequence
  Synthetic
tctttgaagcaugcctcctucc

SEQ ID NO: 46104 - DNA, 22 bp, Artificial Sequence
  Synthetic
gacccutttggugaaggcaaag

SEQ ID NO: 46105 - DNA, 29 bp, Artificial Sequence
  Synthetic
tcgatatgtuctatgagatcugggagaaa

SEQ ID NO: 46106 - DNA, 26 bp, Artificial Sequence
  Synthetic
gatgaggaaggagaugatgatguagg

SEQ ID NO: 46107 - DNA, 21 bp, Artificial Sequence
  Synthetic
tggcaucgacgacatgtucaa

SEQ ID NO: 46108 - DNA, 21 bp, Artificial Sequence
  Synthetic
tctccguccagctgacttgua

SEQ ID NO: 46109 - DNA, 25 bp, Artificial Sequence
  Synthetic
gtcctgagaaaaucaacatctuggc

SEQ ID NO: 46110 - DNA, 20 bp, Artificial Sequence
  Synthetic
gactgugaagcggctcugat

SEQ ID NO: 46111 - DNA, 21 bp, Artificial Sequence
  Synthetic
gttggugccttctcttugcac

SEQ ID NO: 46112 - DNA, 23 bp, Artificial Sequence
  Synthetic
ggctttcagaugcagacacugat

SEQ ID NO: 46113 - DNA, 29 bp, Artificial Sequence
  Synthetic
agcgaggtacagaautaaatgattgtcut

SEQ ID NO: 46114 - DNA, 24 bp, Artificial Sequence
  Synthetic
gctcttgttgtucacgatggtgua

SEQ ID NO: 46115 - DNA, 22 bp, Artificial Sequence
  Synthetic
gaactgagccacutctctgucc

SEQ ID NO: 46116 - DNA, 17 bp, Artificial Sequence
  Synthetic
cutcgggugcccacact

SEQ ID NO: 46117 - DNA, 19 bp, Artificial Sequence
  Synthetic
ttgtcuggccttgtcugca

SEQ ID NO: 46118 - DNA, 22 bp, Artificial Sequence
  Synthetic
tgaatgtcucgaaccagctgug

SEQ ID NO: 46119 - DNA, 27 bp, Artificial Sequence
  Synthetic
ctttctcucagtcatctctucaaccat

SEQ ID NO: 46120 - DNA, 22 bp, Artificial Sequence
  Synthetic
tcagggacaaaggcaugcatua

SEQ ID NO: 46121 - DNA, 21 bp, Artificial Sequence
  Synthetic
ggtgtgtggacucagctcaua

SEQ ID NO: 46122 - DNA, 25 bp, Artificial Sequence
  Synthetic
ctgttctccucatcttcttctuggt

SEQ ID NO: 46123 - DNA, 19 bp, Artificial Sequence
  Synthetic
gcatugccaccccctacuc

SEQ ID NO: 46124 - DNA, 24 bp, Artificial Sequence
  Synthetic
gaggttgttcauctctctgtccuc

SEQ ID NO: 46125 - DNA, 24 bp, Artificial Sequence
  Synthetic
cctcagttuccccatcauagaact

SEQ ID NO: 46126 - DNA, 20 bp, Artificial Sequence
  Synthetic
gcauaatgacugccccgaca

SEQ ID NO: 46127 - DNA, 23 bp, Artificial Sequence
  Synthetic
ccatcatcgugttcatcttugct

SEQ ID NO: 46128 - DNA, 24 bp, Artificial Sequence
  Synthetic
cagatcaaaguagggaugaccaag

SEQ ID NO: 46129 - DNA, 23 bp, Artificial Sequence
  Synthetic
tggaacatcutcgacagcaucat

SEQ ID NO: 46130 - DNA, 22 bp, Artificial Sequence
  Synthetic
gcaggaucccttcttcctuacc

SEQ ID NO: 46131 - DNA, 24 bp, Artificial Sequence
  Synthetic
ctcaccatcacuatgtgcatcgua

SEQ ID NO: 46132 - DNA, 24 bp, Artificial Sequence
  Synthetic
gctgggauaaagatgaggguacct

SEQ ID NO: 46133 - DNA, 22 bp, Artificial Sequence
  Synthetic
cgcaaatcucctgattgcacuc

SEQ ID NO: 46134 - DNA, 23 bp, Artificial Sequence
  Synthetic
ccagtaaugagaccaccccatug

SEQ ID NO: 46135 - DNA, 23 bp, Artificial Sequence
  Synthetic
cctgggttcugaagcagatttug

SEQ ID NO: 46136 - DNA, 22 bp, Artificial Sequence
  Synthetic
gctagaaccacagcugggatua

SEQ ID NO: 46137 - DNA, 22 bp, Artificial Sequence
  Synthetic
cgtccgttccuccactctttuc

SEQ ID NO: 46138 - DNA, 22 bp, Artificial Sequence
  Synthetic
caggtucaccagguagaaggac

SEQ ID NO: 46139 - DNA, 22 bp, Artificial Sequence
  Synthetic
gctattugaaccccuggcacaa

SEQ ID NO: 46140 - DNA, 29 bp, Artificial Sequence
  Synthetic
ggtcagggcauaaatagaaaatacaguca

SEQ ID NO: 46141 - DNA, 26 bp, Artificial Sequence
  Synthetic
tcaccagcaugatgtttctctuacag

SEQ ID NO: 46142 - DNA, 20 bp, Artificial Sequence
  Synthetic
cgttgagcgcugtgaagtug

SEQ ID NO: 46143 - DNA, 19 bp, Artificial Sequence
  Synthetic
gtgaccccgugcttgtuct

SEQ ID NO: 46144 - DNA, 22 bp, Artificial Sequence
  Synthetic
accaauaggagacacacaguca

SEQ ID NO: 46145 - DNA, 25 bp, Artificial Sequence
  Synthetic
ccaataactguggtttgattcugca

SEQ ID NO: 46146 - DNA, 20 bp, Artificial Sequence
  Synthetic
caggagccauggcauggaat

SEQ ID NO: 46147 - DNA, 20 bp, Artificial Sequence
  Synthetic
gctgcucagctttcctugac

SEQ ID NO: 46148 - DNA, 19 bp, Artificial Sequence
  Synthetic
tggaggugggtggtaguca

SEQ ID NO: 46149 - DNA, 18 bp, Artificial Sequence
  Synthetic
ccaucgagaagcgcaugg

SEQ ID NO: 46150 - DNA, 20 bp, Artificial Sequence
  Synthetic
ggcagcaggaugtcaaguga

SEQ ID NO: 46151 - DNA, 20 bp, Artificial Sequence
  Synthetic
cttccccaugttgcacucct

SEQ ID NO: 46152 - DNA, 23 bp, Artificial Sequence
  Synthetic
ctccattucaccaatgggucaca

SEQ ID NO: 46153 - DNA, 24 bp, Artificial Sequence
  Synthetic
cuccagcacattuccaagaacaag

SEQ ID NO: 46154 - DNA, 23 bp, Artificial Sequence
  Synthetic
tctccccgguactaacactaugg

SEQ ID NO: 46155 - DNA, 19 bp, Artificial Sequence
  Synthetic
ggagtguctgtggcucact

SEQ ID NO: 46156 - DNA, 22 bp, Artificial Sequence
  Synthetic
ccactctgggauccactcacut

SEQ ID NO: 46157 - DNA, 23 bp, Artificial Sequence
  Synthetic
ctctgtactuacagcccccaaug

SEQ ID NO: 46158 - DNA, 18 bp, Artificial Sequence
  Synthetic
guggcaggagccacaaug

SEQ ID NO: 46159 - DNA, 19 bp, Artificial Sequence
  Synthetic
aggtacugcccaggacuga

SEQ ID NO: 46160 - DNA, 18 bp, Artificial Sequence
  Synthetic
gauccaggcaggcucagt

SEQ ID NO: 46161 - DNA, 19 bp, Artificial Sequence
  Synthetic
gtaccaucgggctgugaca

SEQ ID NO: 46162 - DNA, 23 bp, Artificial Sequence
  Synthetic
gtgggaaucagagagggtugaaa

SEQ ID NO: 46163 - DNA, 27 bp, Artificial Sequence
  Synthetic
ggatgatgaguactctgaatacuccga

SEQ ID NO: 46164 - DNA, 20 bp, Artificial Sequence
  Synthetic
ccugcattcauggacaccca

SEQ ID NO: 46165 - DNA, 20 bp, Artificial Sequence
  Synthetic
gctgcccauggtgactucag

SEQ ID NO: 46166 - DNA, 22 bp, Artificial Sequence
  Synthetic
cttcttgacugcttgccctgua

SEQ ID NO: 46167 - DNA, 24 bp, Artificial Sequence
  Synthetic
ctttatggtcccugtggtcttcug

SEQ ID NO: 46168 - DNA, 22 bp, Artificial Sequence
  Synthetic
tcugaccucagggacaacagaa

SEQ ID NO: 46169 - DNA, 21 bp, Artificial Sequence
  Synthetic
ccaacctgccugactctgauc

SEQ ID NO: 46170 - DNA, 28 bp, Artificial Sequence
  Synthetic
ggagatauaggacagagtcagtaaucag

SEQ ID NO: 46171 - DNA, 23 bp, Artificial Sequence
  Synthetic
ctctcatgcutcttctgtuccca

SEQ ID NO: 46172 - DNA, 18 bp, Artificial Sequence
  Synthetic
cccccucattcugagcgt

SEQ ID NO: 46173 - DNA, 24 bp, Artificial Sequence
  Synthetic
gauggagagaagggagauaaggua

SEQ ID NO: 46174 - DNA, 25 bp, Artificial Sequence
  Synthetic
gggtcactauaaggtcaaaagcuac

SEQ ID NO: 46175 - DNA, 20 bp, Artificial Sequence
  Synthetic
gcauctgaguggccacacat

SEQ ID NO: 46176 - DNA, 21 bp, Artificial Sequence
  Synthetic
ccctcacagaugctguggaac

SEQ ID NO: 46177 - DNA, 23 bp, Artificial Sequence
  Synthetic
ccgugacttctuacccaaaccaa

SEQ ID NO: 46178 - DNA, 21 bp, Artificial Sequence
  Synthetic
caggcaggaaucagaggaguc

SEQ ID NO: 46179 - DNA, 29 bp, Artificial Sequence
  Synthetic
gggtgagtggaucttgtatgatatuagaa

SEQ ID NO: 46180 - DNA, 22 bp, Artificial Sequence
  Synthetic
ggactgaagucacagcactguc

SEQ ID NO: 46181 - DNA, 22 bp, Artificial Sequence
  Synthetic
gtcttacuccacagccgaacuc

SEQ ID NO: 46182 - DNA, 20 bp, Artificial Sequence
  Synthetic
ggtcaugggaggtcagugga

SEQ ID NO: 46183 - DNA, 21 bp, Artificial Sequence
  Synthetic
ctcgugaggacttaggauggg

SEQ ID NO: 46184 - DNA, 22 bp, Artificial Sequence
  Synthetic
ggattcaccaugcccctacaug

SEQ ID NO: 46185 - DNA, 22 bp, Artificial Sequence
  Synthetic
cattgaccatuccctcccttug

SEQ ID NO: 46186 - DNA, 23 bp, Artificial Sequence
  Synthetic
ggucacccttugaggaaaagagg

SEQ ID NO: 46187 - DNA, 24 bp, Artificial Sequence
  Synthetic
ctgaactctgugctcatgttccua

SEQ ID NO: 46188 - DNA, 22 bp, Artificial Sequence
  Synthetic
gagccttctcugctcagtaguc

SEQ ID NO: 46189 - DNA, 23 bp, Artificial Sequence
  Synthetic
gcauatttaagctcuggccccat

SEQ ID NO: 46190 - DNA, 22 bp, Artificial Sequence
  Synthetic
gagaggtcagugggattcctug

SEQ ID NO: 46191 - DNA, 22 bp, Artificial Sequence
  Synthetic
acccacaagccugttuccaaat

SEQ ID NO: 46192 - DNA, 20 bp, Artificial Sequence
  Synthetic
tgctgccccacucctcauat

SEQ ID NO: 46193 - DNA, 21 bp, Artificial Sequence
  Synthetic
ctgacagagcucttccctcuc

SEQ ID NO: 46194 - DNA, 23 bp, Artificial Sequence
  Synthetic
ggatgucagggtgacaauggaca

SEQ ID NO: 46195 - DNA, 24 bp, Artificial Sequence
  Synthetic
cacaggutagggtcauagggagat

SEQ ID NO: 46196 - DNA, 18 bp, Artificial Sequence
  Synthetic
gaggtuggcgcacacuac

SEQ ID NO: 46197 - DNA, 23 bp, Artificial Sequence
  Synthetic
gccttctcugtgttaatcccuga

SEQ ID NO: 46198 - DNA, 22 bp, Artificial Sequence
  Synthetic
accaaggaaacugaggcaguac

SEQ ID NO: 46199 - DNA, 25 bp, Artificial Sequence
  Synthetic
guatggaaatugacccccaaggaaa

SEQ ID NO: 46200 - DNA, 21 bp, Artificial Sequence
  Synthetic
gcataugcacaccacctcuag

SEQ ID NO: 46201 - DNA, 24 bp, Artificial Sequence
  Synthetic
gctaaggtcagugtgtggaaucag

SEQ ID NO: 46202 - DNA, 22 bp, Artificial Sequence
  Synthetic
gggttauggcacacacuaccat

SEQ ID NO: 46203 - DNA, 23 bp, Artificial Sequence
  Synthetic
ccaccccatuttcttgtttccug

SEQ ID NO: 46204 - DNA, 22 bp, Artificial Sequence
  Synthetic
ctgaaatgcaaauagcggguga

SEQ ID NO: 46205 - DNA, 21 bp, Artificial Sequence
  Synthetic
gagccuggaaagcctggtaut

SEQ ID NO: 46206 - DNA, 18 bp, Artificial Sequence
  Synthetic
cagccccuatgcctgugg

SEQ ID NO: 46207 - DNA, 20 bp, Artificial Sequence
  Synthetic
gggtgugaaggtgcttucct

SEQ ID NO: 46208 - DNA, 24 bp, Artificial Sequence
  Synthetic
gagagaugaagacaaactgcuagg

SEQ ID NO: 46209 - DNA, 20 bp, Artificial Sequence
  Synthetic
ccaaggtgagugcggatgut

SEQ ID NO: 46210 - DNA, 22 bp, Artificial Sequence
  Synthetic
ggagggutgcccatugaaacat

SEQ ID NO: 46211 - DNA, 23 bp, Artificial Sequence
  Synthetic
ccactctttuctgaggtcucagg

SEQ ID NO: 46212 - DNA, 24 bp, Artificial Sequence
  Synthetic
gcctgaatcucctttctctcccua

SEQ ID NO: 46213 - DNA, 22 bp, Artificial Sequence
  Synthetic
gccagacaccagugaatgttug

SEQ ID NO: 46214 - DNA, 22 bp, Artificial Sequence
  Synthetic
ctgtgggaacagaucactggut

SEQ ID NO: 46215 - DNA, 29 bp, Artificial Sequence
  Synthetic
cagaggcccuataaatctuaacaaagact

SEQ ID NO: 46216 - DNA, 22 bp, Artificial Sequence
  Synthetic
ggtctagggucctcatgugaag

SEQ ID NO: 46217 - DNA, 26 bp, Artificial Sequence
  Synthetic
gcctctuaccactctatttuccacag

SEQ ID NO: 46218 - DNA, 22 bp, Artificial Sequence
  Synthetic
ctggagggaauagggucagaua

SEQ ID NO: 46219 - DNA, 23 bp, Artificial Sequence
  Synthetic
ggaaagggugagtgtgattgguc

SEQ ID NO: 46220 - DNA, 21 bp, Artificial Sequence
  Synthetic
cttgcugaggaacagcctuga

SEQ ID NO: 46221 - DNA, 22 bp, Artificial Sequence
  Synthetic
ccccttgtugagccattctuct

SEQ ID NO: 46222 - DNA, 21 bp, Artificial Sequence
  Synthetic
ctccagaccccutgtgugaag

SEQ ID NO: 46223 - DNA, 23 bp, Artificial Sequence
  Synthetic
aaggcuaccaacattcccaugag

SEQ ID NO: 46224 - DNA, 23 bp, Artificial Sequence
  Synthetic
cctcagcctutcctatcacctuc

SEQ ID NO: 46225 - DNA, 24 bp, Artificial Sequence
  Synthetic
tccctgagugagttagatccugac

SEQ ID NO: 46226 - DNA, 21 bp, Artificial Sequence
  Synthetic
ggtuccaagaacccccaugat

SEQ ID NO: 46227 - DNA, 22 bp, Artificial Sequence
  Synthetic
cttgagaacugcttgctucgag

SEQ ID NO: 46228 - DNA, 21 bp, Artificial Sequence
  Synthetic
caggactuagtcaggguccca

SEQ ID NO: 46229 - DNA, 24 bp, Artificial Sequence
  Synthetic
ggtgaaggttgucttcctgactuc

SEQ ID NO: 46230 - DNA, 23 bp, Artificial Sequence
  Synthetic
ccaagtcccauagataggcccua

SEQ ID NO: 46231 - DNA, 26 bp, Artificial Sequence
  Synthetic
acctccatuccaatgaagacttugat

SEQ ID NO: 46232 - DNA, 22 bp, Artificial Sequence
  Synthetic
gagucaccuaggagcccaaaat

SEQ ID NO: 46233 - DNA, 22 bp, Artificial Sequence
  Synthetic
caggagugggacttttgtgugt

SEQ ID NO: 46234 - DNA, 22 bp, Artificial Sequence
  Synthetic
gucaagggcaagaagucagaac

SEQ ID NO: 46235 - DNA, 23 bp, Artificial Sequence
  Synthetic
ctggagagaagguaagugcaacc

SEQ ID NO: 46236 - DNA, 23 bp, Artificial Sequence
  Synthetic
ctggagggaacucttatctccut

SEQ ID NO: 46237 - DNA, 26 bp, Artificial Sequence
  Synthetic
caaatctcugaacccccaaattcauc

SEQ ID NO: 46238 - DNA, 21 bp, Artificial Sequence
  Synthetic
accccagaacugggacaucat

SEQ ID NO: 46239 - DNA, 18 bp, Artificial Sequence
  Synthetic
gggtgtggguctctccug

SEQ ID NO: 46240 - DNA, 22 bp, Artificial Sequence
  Synthetic
gaacagcaggucagggaaugaa

SEQ ID NO: 46241 - DNA, 24 bp, Artificial Sequence
  Synthetic
cctcatcacucctggtatcttugg

SEQ ID NO: 46242 - DNA, 24 bp, Artificial Sequence
  Synthetic
gagacaaaguataaggugcaaccc

SEQ ID NO: 46243 - DNA, 22 bp, Artificial Sequence
  Synthetic
cccactgcuctctgtcctuaca

SEQ ID NO: 46244 - DNA, 23 bp, Artificial Sequence
  Synthetic
gaagaacccugggaagacactua

SEQ ID NO: 46245 - DNA, 22 bp, Artificial Sequence
  Synthetic
ctaaaggugagcaagccttguc

SEQ ID NO: 46246 - DNA, 22 bp, Artificial Sequence
  Synthetic
tcccgatgautctaactcugct

SEQ ID NO: 46247 - DNA, 25 bp, Artificial Sequence
  Synthetic
cccacctaacugctatcttcttuca

SEQ ID NO: 46248 - DNA, 23 bp, Artificial Sequence
  Synthetic
ggaaagacaugtcagatgugggt

SEQ ID NO: 46249 - DNA, 25 bp, Artificial Sequence
  Synthetic
gggactggguggtagaatauaaggg

SEQ ID NO: 46250 - DNA, 24 bp, Artificial Sequence
  Synthetic
aagaaggtcuggacagagtccaua

SEQ ID NO: 46251 - DNA, 22 bp, Artificial Sequence
  Synthetic
ccaggcttcuggtaaggaguag

SEQ ID NO: 46252 - DNA, 20 bp, Artificial Sequence
  Synthetic
caccaagcucccagtggaua

SEQ ID NO: 46253 - DNA, 21 bp, Artificial Sequence
  Synthetic
caggctcugtgtttcctucca

SEQ ID NO: 46254 - DNA, 22 bp, Artificial Sequence
  Synthetic
ccttcccacuacgcccactaua

SEQ ID NO: 46255 - DNA, 27 bp, Artificial Sequence
  Synthetic
ctttttaatcaagutctgtctccugca

SEQ ID NO: 46256 - DNA, 19 bp, Artificial Sequence
  Synthetic
ccaaggugaggcaggctua

SEQ ID NO: 46257 - DNA, 23 bp, Artificial Sequence
  Synthetic
tgtcactaucccacatgctctug

SEQ ID NO: 46258 - DNA, 24 bp, Artificial Sequence
  Synthetic
actaccaatccuggtcctttcucc

SEQ ID NO: 46259 - DNA, 22 bp, Artificial Sequence
  Synthetic
acucccaggaaauacagacuct

SEQ ID NO: 46260 - DNA, 20 bp, Artificial Sequence
  Synthetic
gtgatccguagaacgucgct

SEQ ID NO: 46261 - DNA, 24 bp, Artificial Sequence
  Synthetic
acactaaccucacactgacttuca

SEQ ID NO: 46262 - DNA, 20 bp, Artificial Sequence
  Synthetic
ccaccuggacccccaauaaa

SEQ ID NO: 46263 - DNA, 20 bp, Artificial Sequence
  Synthetic
ttccagcagacuccccatug

SEQ ID NO: 46264 - DNA, 21 bp, Artificial Sequence
  Synthetic
gcacccauaccctcattgguc

SEQ ID NO: 46265 - DNA, 27 bp, Artificial Sequence
  Synthetic
acttctgacttcugtctgtaactccua

SEQ ID NO: 46266 - DNA, 21 bp, Artificial Sequence
  Synthetic
aggtacacucagaccccucag

SEQ ID NO: 46267 - DNA, 22 bp, Artificial Sequence
  Synthetic
tctatgcugtgctcuccaacag

SEQ ID NO: 46268 - DNA, 22 bp, Artificial Sequence
  Synthetic
caagccugcaagauaacagggt

SEQ ID NO: 46269 - DNA, 19 bp, Artificial Sequence
  Synthetic
gaggccacugacaucccat

SEQ ID NO: 46270 - DNA, 22 bp, Artificial Sequence
  Synthetic
gccttgcagacucaggactcua

SEQ ID NO: 46271 - DNA, 21 bp, Artificial Sequence
  Synthetic
tgaatcccuggtgggactcuc

SEQ ID NO: 46272 - DNA, 24 bp, Artificial Sequence
  Synthetic
cagggcaagaggucactttatcut

SEQ ID NO: 46273 - DNA, 25 bp, Artificial Sequence
  Synthetic
caatcctugagagtacaguggacag

SEQ ID NO: 46274 - DNA, 21 bp, Artificial Sequence
  Synthetic
gtctaggucaggguacaccgt

SEQ ID NO: 46275 - DNA, 21 bp, Artificial Sequence
  Synthetic
gtcctgaugggtcgtcactuc

SEQ ID NO: 46276 - DNA, 21 bp, Artificial Sequence
  Synthetic
ggttccccuggacacttcaut

SEQ ID NO: 46277 - DNA, 23 bp, Artificial Sequence
  Synthetic
ccatccgugagcttagcuacaag

SEQ ID NO: 46278 - DNA, 19 bp, Artificial Sequence
  Synthetic
gggttuccagggtctccuc

SEQ ID NO: 46279 - DNA, 24 bp, Artificial Sequence
  Synthetic
gttcttactggauggctcctcauc

SEQ ID NO: 46280 - DNA, 19 bp, Artificial Sequence
  Synthetic
ggaugaaggccgaguggag

SEQ ID NO: 46281 - DNA, 21 bp, Artificial Sequence
  Synthetic
gctgacggcutttactgccua

SEQ ID NO: 46282 - DNA, 22 bp, Artificial Sequence
  Synthetic
gcaaaacuccuggaagggacag

SEQ ID NO: 46283 - DNA, 23 bp, Artificial Sequence
  Synthetic
aagaatguggcgatgggttaugt

SEQ ID NO: 46284 - DNA, 22 bp, Artificial Sequence
  Synthetic
ccugggaagagauaagggttuc

SEQ ID NO: 46285 - DNA, 26 bp, Artificial Sequence
  Synthetic
gcttatgtcucatgtgtcattcucca

SEQ ID NO: 46286 - DNA, 25 bp, Artificial Sequence
  Synthetic
acaggtgtagugtgttcatcaaugt

SEQ ID NO: 46287 - DNA, 22 bp, Artificial Sequence
  Synthetic
tgccctcuggtgtttcauacag

SEQ ID NO: 46288 - DNA, 21 bp, Artificial Sequence
  Synthetic
aagcagucaaugaagccagga

SEQ ID NO: 46289 - DNA, 28 bp, Artificial Sequence
  Synthetic
cagatgctcttgugtttctgtctttuag

SEQ ID NO: 46290 - DNA, 20 bp, Artificial Sequence
  Synthetic
cccatttgcuggctcaugac

SEQ ID NO: 46291 - DNA, 23 bp, Artificial Sequence
  Synthetic
gcctgaggcuttcaatctctucc

SEQ ID NO: 46292 - DNA, 18 bp, Artificial Sequence
  Synthetic
gtgcaggugcgagucagt

SEQ ID NO: 46293 - DNA, 18 bp, Artificial Sequence
  Synthetic
ggcccuggtggcacuaag

SEQ ID NO: 46294 - DNA, 22 bp, Artificial Sequence
  Synthetic
cagagccagauagcagacctug

SEQ ID NO: 46295 - DNA, 22 bp, Artificial Sequence
  Synthetic
gagttcaugaagggtguggagt

SEQ ID NO: 46296 - DNA, 19 bp, Artificial Sequence
  Synthetic
gcauggaggcaggagauca

SEQ ID NO: 46297 - DNA, 18 bp, Artificial Sequence
  Synthetic
ccacagcccuacccugag

SEQ ID NO: 46298 - DNA, 22 bp, Artificial Sequence
  Synthetic
ggctcggauaggctaaatugct

SEQ ID NO: 46299 - DNA, 20 bp, Artificial Sequence
  Synthetic
gggcaaggugatgaggaugc

SEQ ID NO: 46300 - DNA, 20 bp, Artificial Sequence
  Synthetic
accaagccuctggtctcugg

SEQ ID NO: 46301 - DNA, 22 bp, Artificial Sequence
  Synthetic
tcagcagcagcuataccugagt

SEQ ID NO: 46302 - DNA, 21 bp, Artificial Sequence
  Synthetic
cctttucccggagctctucaa

SEQ ID NO: 46303 - DNA, 22 bp, Artificial Sequence
  Synthetic
tggtaaugagcaaagccgtcuc

SEQ ID NO: 46304 - DNA, 26 bp, Artificial Sequence
  Synthetic
atgcagaaagucaacttauggaagga

SEQ ID NO: 46305 - DNA, 28 bp, Artificial Sequence
  Synthetic
ccatcacttttccauggattatcactug

SEQ ID NO: 46306 - DNA, 24 bp, Artificial Sequence
  Synthetic
tggttctgtaauaggcctcaccut

SEQ ID NO: 46307 - DNA, 25 bp, Artificial Sequence
  Synthetic
catacaattucaggcaaggccauac

SEQ ID NO: 46308 - DNA, 24 bp, Artificial Sequence
  Synthetic
ccugaagaagaaggaggttuaugt

SEQ ID NO: 46309 - DNA, 28 bp, Artificial Sequence
  Synthetic
ctgaggatacutaaaggtacugaaaggt

SEQ ID NO: 46310 - DNA, 29 bp, Artificial Sequence
  Synthetic
cttccaacaauaggattcagcauagagaa

SEQ ID NO: 46311 - DNA, 24 bp, Artificial Sequence
  Synthetic
gggtaggaagaaugaccagguaga

SEQ ID NO: 46312 - DNA, 24 bp, Artificial Sequence
  Synthetic
cttaggtuaggaaatgcccaugga

SEQ ID NO: 46313 - DNA, 28 bp, Artificial Sequence
  Synthetic
agatacagacugaaagacacacacauac

SEQ ID NO: 46314 - DNA, 25 bp, Artificial Sequence
  Synthetic
tgtaaaagtgtcucagttgctgugt

SEQ ID NO: 46315 - DNA, 27 bp, Artificial Sequence
  Synthetic
gcttataugccaccatgtttgaucact

SEQ ID NO: 46316 - DNA, 22 bp, Artificial Sequence
  Synthetic
tgggccacauagcaagatccua

SEQ ID NO: 46317 - DNA, 29 bp, Artificial Sequence
  Synthetic
tgctgaggttuccaactattatctttuca

SEQ ID NO: 46318 - DNA, 28 bp, Artificial Sequence
  Synthetic
cttgcatttatggacuctgaccttttua

SEQ ID NO: 46319 - DNA, 28 bp, Artificial Sequence
  Synthetic
gggatgagatggcutataactgacttut

SEQ ID NO: 46320 - DNA, 25 bp, Artificial Sequence
  Synthetic
caaccaucaaucagaaaaaggaggg

SEQ ID NO: 46321 - DNA, 26 bp, Artificial Sequence
  Synthetic
agcaagacaagugaagtcaactgtua

SEQ ID NO: 46322 - DNA, 29 bp, Artificial Sequence
  Synthetic
ttcttctaacaacautctgacacctuacc

SEQ ID NO: 46323 - DNA, 21 bp, Artificial Sequence
  Synthetic
tgcuacaactguggcaaacca

SEQ ID NO: 46324 - DNA, 21 bp, Artificial Sequence
  Synthetic
gcatgtgcucacctcuccaag

SEQ ID NO: 46325 - DNA, 24 bp, Artificial Sequence
  Synthetic
ctggtctgacuagccgaattctut

SEQ ID NO: 46326 - DNA, 18 bp, Artificial Sequence
  Synthetic
cctcugccacggcttcuc

SEQ ID NO: 46327 - DNA, 28 bp, Artificial Sequence
  Synthetic
aaaagaactttcaguggtttaatgcugt

SEQ ID NO: 46328 - DNA, 22 bp, Artificial Sequence
  Synthetic
cttctacgugcccttcuccaat

SEQ ID NO: 46329 - DNA, 20 bp, Artificial Sequence
  Synthetic
cggctaggutgagcaggaug

SEQ ID NO: 46330 - DNA, 23 bp, Artificial Sequence
  Synthetic
cctagctacccuctccctgtcua

SEQ ID NO: 46331 - DNA, 21 bp, Artificial Sequence
  Synthetic
cccatgauggcatggttcucc

SEQ ID NO: 46332 - DNA, 21 bp, Artificial Sequence
  Synthetic
ctgtucccaagtcccucacag

SEQ ID NO: 46333 - DNA, 28 bp, Artificial Sequence
  Synthetic
tgcccauagcagaaaaagatgataauca

SEQ ID NO: 46334 - DNA, 19 bp, Artificial Sequence
  Synthetic
ctggaggagccauggtcug

SEQ ID NO: 46335 - DNA, 22 bp, Artificial Sequence
  Synthetic
gaagaugggaccgaagtuggag

SEQ ID NO: 46336 - DNA, 20 bp, Artificial Sequence
  Synthetic
gggcgaaccucactaacgug

SEQ ID NO: 46337 - DNA, 23 bp, Artificial Sequence
  Synthetic
acagagtccuaggcaggtctuag

SEQ ID NO: 46338 - DNA, 27 bp, Artificial Sequence
  Synthetic
aaatcttcctctuttaactagctgcug

SEQ ID NO: 46339 - DNA, 24 bp, Artificial Sequence
  Synthetic
cctggttguactgtagcttgtugt

SEQ ID NO: 46340 - DNA, 22 bp, Artificial Sequence
  Synthetic
cgggttucacatttctcctucc

SEQ ID NO: 46341 - DNA, 24 bp, Artificial Sequence
  Synthetic
tcaaaaacaaaugtccccggauct

SEQ ID NO: 46342 - DNA, 26 bp, Artificial Sequence
  Synthetic
tcctaactcugaacacagcttttuga

SEQ ID NO: 46343 - DNA, 27 bp, Artificial Sequence
  Synthetic
gttttgtttgaaagaucggtggaacut

SEQ ID NO: 46344 - DNA, 23 bp, Artificial Sequence
  Synthetic
tctgaacagcutcaagagggtuc

SEQ ID NO: 46345 - DNA, 21 bp, Artificial Sequence
  Synthetic
acctctuggccttctcucaca

SEQ ID NO: 46346 - DNA, 23 bp, Artificial Sequence
  Synthetic
gcacaggaggacauaaacugagg

SEQ ID NO: 46347 - DNA, 17 bp, Artificial Sequence
  Synthetic
cgcgccucgatctcuga

SEQ ID NO: 46348 - DNA, 17 bp, Artificial Sequence
  Synthetic
gtgcagauggtgugcgt

SEQ ID NO: 46349 - DNA, 17 bp, Artificial Sequence
  Synthetic
gccgcugtggucaaggg

SEQ ID NO: 46350 - DNA, 20 bp, Artificial Sequence
  Synthetic
gccacgagutgtugaggaag

SEQ ID NO: 46351 - DNA, 19 bp, Artificial Sequence
  Synthetic
cggccugcgaagacatgut

SEQ ID NO: 46352 - DNA, 20 bp, Artificial Sequence
  Synthetic
aacgggaacutcgcgaugat

SEQ ID NO: 46353 - DNA, 17 bp, Artificial Sequence
  Synthetic
cugcuggccccagagac

SEQ ID NO: 46354 - DNA, 18 bp, Artificial Sequence
  Synthetic
guccgctuacggccaagt

SEQ ID NO: 46355 - DNA, 18 bp, Artificial Sequence
  Synthetic
ccggagccccuctctgut

SEQ ID NO: 46356 - DNA, 24 bp, Artificial Sequence
  Synthetic
ggaaacttgtguggcttggtttua

SEQ ID NO: 46357 - DNA, 25 bp, Artificial Sequence
  Synthetic
ttttcttgccaautttaagcucgca

SEQ ID NO: 46358 - DNA, 30 bp, Artificial Sequence; identical to SEQ ID NO: 34124
  Synthetic

SEQ ID NO: 46359 - DNA, 27 bp, Artificial Sequence
  Synthetic
cgtccattttgcuaaaaaccatacuca

SEQ ID NO: 46360 - DNA, 18 bp, Artificial Sequence
  Synthetic
tguccgcccctcuaacga

SEQ ID NO: 46361 - DNA, 17 bp, Artificial Sequence
  Synthetic
gcugctccguccccaag

SEQ ID NO: 46362 - DNA, 21 bp, Artificial Sequence
  Synthetic
ccactgtcugggtcaaggaug

SEQ ID NO: 46363 - DNA, 21 bp, Artificial Sequence
  Synthetic
actcggcucctttctguagct

SEQ ID NO: 46364 - DNA, 17 bp, Artificial Sequence
  Synthetic
cctctgcucccacucgg

SEQ ID NO: 46365 - DNA, 17 bp, Artificial Sequence
  Synthetic
cgcccaccutgaugcct

SEQ ID NO: 46366 - DNA, 20 bp, Artificial Sequence
  Synthetic
gtggagccuggtcauggaaa

SEQ ID NO: 46367 - DNA, 18 bp, Artificial Sequence
  Synthetic
ggcagaugacgcucaggg

SEQ ID NO: 46368 - DNA, 21 bp, Artificial Sequence
  Synthetic
actgcaaggugtacagugacg

SEQ ID NO: 46369 - DNA, 22 bp, Artificial Sequence
  Synthetic
ctagacccaaauccucacgcaa

SEQ ID NO: 46370 - DNA, 18 bp, Artificial Sequence
  Synthetic
ctcgccuatcgctcugct

SEQ ID NO: 46371 - DNA, 17 bp, Artificial Sequence
  Synthetic
gcgucccccagacagug

SEQ ID NO: 46372 - DNA, 22 bp, Artificial Sequence
  Synthetic
gtatgcaggcaucctcagcuac

SEQ ID NO: 46373 - DNA, 26 bp, Artificial Sequence
  Synthetic
agctcagaaccuggtatctacttuct

SEQ ID NO: 46374 - DNA, 18 bp, Artificial Sequence
  Synthetic
gctgagagugggcgagut

SEQ ID NO: 46375 - DNA, 17 bp, Artificial Sequence
  Synthetic
ccagcccugctcugcac

SEQ ID NO: 46376 - DNA, 17 bp, Artificial Sequence
  Synthetic
cggtaggugcgguagcg

SEQ ID NO: 46377 - DNA, 20 bp, Artificial Sequence
  Synthetic
cttgaaggugagctgcucct

SEQ ID NO: 46378 - DNA, 20 bp, Artificial Sequence
  Synthetic
ggagagguggagaggctuca

SEQ ID NO: 46379 - DNA, 19 bp, Artificial Sequence
  Synthetic
cgtccuactggcaugaccc

SEQ ID NO: 46380 - DNA, 20 bp, Artificial Sequence
  Synthetic
ggtgtctgucctgggaguct

SEQ ID NO: 46381 - DNA, 18 bp, Artificial Sequence
  Synthetic
gccagggaugccacucac

SEQ ID NO: 46382 - DNA, 19 bp, Artificial Sequence
  Synthetic
ctgcccgcagguacaugat

SEQ ID NO: 46383 - DNA, 19 bp, Artificial Sequence
  Synthetic
cccacaccucagcactcug

SEQ ID NO: 46384 - DNA, 18 bp, Artificial Sequence
  Synthetic
gggacgacuccgtgttug

SEQ ID NO: 46385 - DNA, 23 bp, Artificial Sequence
  Synthetic
cacacagaccaaagcuctgtgua

SEQ ID NO: 46386 - DNA, 26 bp, Artificial Sequence
  Synthetic
atctgtcagcagauctcaagaaacug

SEQ ID NO: 46387 - DNA, 23 bp, Artificial Sequence
  Synthetic
gggagccatutcctatctcatug

SEQ ID NO: 46388 - DNA, 30 bp, Artificial Sequence; identical to SEQ ID NO: 34154
  Synthetic

SEQ ID NO: 46389 - DNA, 26 bp, Artificial Sequence
  Synthetic
caccctttaatcugttgttgctctut

SEQ ID NO: 46390 - DNA, 24 bp, Artificial Sequence
  Synthetic
cactcaugaacaagcaccaaacug

SEQ ID NO: 46391 - DNA, 28 bp, Artificial Sequence
  Synthetic
ccccgaaagttcucattcaaagtgtaut

SEQ ID NO: 46392 - DNA, 23 bp, Artificial Sequence
  Synthetic
aggcctttuaagagcaccttucc

SEQ ID NO: 46393 - DNA, 31 bp, Artificial Sequence; identical to SEQ ID NO: 34159
  Synthetic

SEQ ID NO: 46394 - DNA, 27 bp, Artificial Sequence
  Synthetic
gaggccauaactcttgtagaaucaact

SEQ ID NO: 46395 - DNA, 30 bp, Artificial Sequence; identical to SEQ ID NO: 34161
  Synthetic

SEQ ID NO: 46396 - DNA, 24 bp, Artificial Sequence
  Synthetic
agggagaaauggcataaagcacut

SEQ ID NO: 46397 - DNA, 22 bp, Artificial Sequence
  Synthetic
tcacgccucctaaagttccuct

SEQ ID NO: 46398 - DNA, 28 bp, Artificial Sequence
  Synthetic
ggaaatggtcaaugtagttgagaaaguc

SEQ ID NO: 46399 - DNA, 27 bp, Artificial Sequence
  Synthetic
aaataattaccugcagctcatctccuc

SEQ ID NO: 46400 - DNA, 24 bp, Artificial Sequence
  Synthetic
gaccguaagaattaacuggcaggt

SEQ ID NO: 46401 - DNA, 22 bp, Artificial Sequence
  Synthetic
tttctgttgcutccgtcgttug

SEQ ID NO: 46402 - DNA, 21 bp, Artificial Sequence
  Synthetic
caguccgggaacagatuccac

SEQ ID NO: 46403 - DNA, 28 bp, Artificial Sequence
  Synthetic
acaaagaagauaagagcaccauacaaua

SEQ ID NO: 46404 - DNA, 28 bp, Artificial Sequence
  Synthetic
gaagauaaagggaggaacaguttttaug

SEQ ID NO: 46405 - DNA, 22 bp, Artificial Sequence
  Synthetic
gcttgtuggagaccaccttcug

SEQ ID NO: 46406 - DNA, 21 bp, Artificial Sequence
  Synthetic
ctggucaatcaccuggacgag

SEQ ID NO: 46407 - DNA, 22 bp, Artificial Sequence
  Synthetic
cccctgggagucacacatcaua

SEQ ID NO: 46408 - DNA, 22 bp, Artificial Sequence
  Synthetic
tcttcctatggauggctggcua

SEQ ID NO: 46409 - DNA, 24 bp, Artificial Sequence
  Synthetic
ctgaactgccugagaagatucaga

SEQ ID NO: 46410 - DNA, 28 bp, Artificial Sequence
  Synthetic
cctttcttuaaaaacaagcagccacuaa

SEQ ID NO: 46411 - DNA, 27 bp, Artificial Sequence
  Synthetic
ctagctcttgucgaagatttgagtuct

SEQ ID NO: 46412 - DNA, 33 bp, Artificial Sequence; identical to SEQ ID NO: 34178
  Synthetic

SEQ ID NO: 46413 - DNA, 25 bp, Artificial Sequence
  Synthetic
cgagagaagcugtacttggatcuac

SEQ ID NO: 46414 - DNA, 22 bp, Artificial Sequence
  Synthetic
cttauggaagucgggaaggauc

SEQ ID NO: 46415 - DNA, 26 bp, Artificial Sequence
  Synthetic
aacaauaaactggaguacacaaggca

SEQ ID NO: 46416 - DNA, 32 bp, Artificial Sequence; identical to SEQ ID NO: 34182
  Synthetic

SEQ ID NO: 46417 - DNA, 30 bp, Artificial Sequence; identical to SEQ ID NO: 34183
  Synthetic

SEQ ID NO: 46418 - DNA, 26 bp, Artificial Sequence
  Synthetic
gaaagcctacaccauttttgcatgua

SEQ ID NO: 46419 - DNA, 29 bp, Artificial Sequence
  Synthetic
agaaccatctugcttcatacttttcugat

SEQ ID NO: 46420 - DNA, 30 bp, Artificial Sequence; identical to SEQ ID NO: 34186
  Synthetic

SEQ ID NO: 46421 - DNA, 24 bp, Artificial Sequence
  Synthetic
gggagcuagacatagcuagcaaag

SEQ ID NO: 46422 - DNA, 22 bp, Artificial Sequence
  Synthetic
tgcagcacuccacaacatcaut

SEQ ID NO: 46423 - DNA, 30 bp, Artificial Sequence; identical to SEQ ID NO: 34189
  Synthetic

SEQ ID NO: 46424 - DNA, 26 bp, Artificial Sequence
  Synthetic
gattttattttucagtgccagcucct

SEQ ID NO: 46425 - DNA, 31 bp, Artificial Sequence; identical to SEQ ID NO: 34191
  Synthetic

SEQ ID NO: 46426 - DNA, 28 bp, Artificial Sequence
  Synthetic
cagaattatugcaagtggactgugaaat

SEQ ID NO: 46427 - DNA, 32 bp, Artificial Sequence; identical to SEQ ID NO: 34193
  Synthetic

SEQ ID NO: 46428 - DNA, 27 bp, Artificial Sequence
  Synthetic
tgattaatttgcaggutattgcgagug

SEQ ID NO: 46429 - DNA, 29 bp, Artificial Sequence
  Synthetic
caggtaagaaautaggaaatctcauggct

SEQ ID NO: 46430 - DNA, 22 bp, Artificial Sequence
  Synthetic
gctgtagauggtgcactugcat

SEQ ID NO: 46431 - DNA, 32 bp, Artificial Sequence; identical to SEQ ID NO: 34197
  Synthetic

SEQ ID NO: 46432 - DNA, 26 bp, Artificial Sequence
  Synthetic
tctcagcaagaaauccuaaagaccag

SEQ ID NO: 46433 - DNA, 28 bp, Artificial Sequence
  Synthetic
cttctagggctutttgtttcctaacaug

SEQ ID NO: 46434 - DNA, 28 bp, Artificial Sequence
  Synthetic
ccaatcgacaugatgataataggucaga

SEQ ID NO: 46435 - DNA, 23 bp, Artificial Sequence
  Synthetic
ctgcaaaccucgcttugaagaag

SEQ ID NO: 46436 - DNA, 21 bp, Artificial Sequence
  Synthetic
gaagaagctcugctgcccaua

SEQ ID NO: 46437 - DNA, 31 bp, Artificial Sequence; identical to SEQ ID NO: 34203
  Synthetic

SEQ ID NO: 46438 - DNA, 22 bp, Artificial Sequence
  Synthetic
ctggaaggcaaagucctucaca

SEQ ID NO: 46439 - DNA, 24 bp, Artificial Sequence
  Synthetic
cgatttgttuctgaaccatuggct

SEQ ID NO: 46440 - DNA, 33 bp, Artificial Sequence; identical to SEQ ID NO: 34206
  Synthetic

SEQ ID NO: 46441 - DNA, 23 bp, Artificial Sequence
  Synthetic
gcctctuggcattagaugaaggt

SEQ ID NO: 46442 - DNA, 32 bp, Artificial Sequence; identical to SEQ ID NO: 34208
  Synthetic

SEQ ID NO: 46443 - DNA, 23 bp, Artificial Sequence
  Synthetic
gatttggttcuagggtgctguga

SEQ ID NO: 46444 - DNA, 22 bp, Artificial Sequence
  Synthetic
acuatgtucaggagaccccact

SEQ ID NO: 46445 - DNA, 23 bp, Artificial Sequence
  Synthetic
gcttggttugagctgttugagga

SEQ ID NO: 46446 - DNA, 25 bp, Artificial Sequence
  Synthetic
cacggaaagtacuccagatggatut

SEQ ID NO: 46447 - DNA, 32 bp, Artificial Sequence; identical to SEQ ID NO: 34213
  Synthetic

SEQ ID NO: 46448 - DNA, 21 bp, Artificial Sequence
  Synthetic
attaccuccacctguggcaag

SEQ ID NO: 46449 - DNA, 23 bp, Artificial Sequence
  Synthetic
tctaactcctuctccagcagcua

SEQ ID NO: 46450 - DNA, 29 bp, Artificial Sequence
  Synthetic
gatgacaauaaaguagaggaaggtgauat

SEQ ID NO: 46451 - DNA, 30 bp, Artificial Sequence; identical to SEQ ID NO: 34217
  Synthetic

SEQ ID NO: 46452 - DNA, 25 bp, Artificial Sequence
  Synthetic
caaggtctucaatgataagcuccca

SEQ ID NO: 46453 - DNA, 27 bp, Artificial Sequence
  Synthetic
cctctgatuccttattttctttugcct

SEQ ID NO: 46454 - DNA, 26 bp, Artificial Sequence
  Synthetic
agtcauccaaagacauaccagacaga

SEQ ID NO: 46455 - DNA, 24 bp, Artificial Sequence
  Synthetic
tgatttaggagcauagcctgaugc

SEQ ID NO: 46456 - DNA, 28 bp, Artificial Sequence
  Synthetic
ccttcaagacucaagggtgataaugaaa

SEQ ID NO: 46457 - DNA, 27 bp, Artificial Sequence
  Synthetic
ttactatggaatutgcaccttccugaa

SEQ ID NO: 46458 - DNA, 28 bp, Artificial Sequence
  Synthetic
acctgaucaagaagaaaaacccttuaca

SEQ ID NO: 46459 - DNA, 24 bp, Artificial Sequence
  Synthetic
cctcgagagautgaaggcatgtut

SEQ ID NO: 46460 - DNA, 22 bp, Artificial Sequence
  Synthetic
gccuccaaaagccctagugaag

SEQ ID NO: 46461 - DNA, 23 bp, Artificial Sequence
  Synthetic
gttucggucaggagactgtauag

SEQ ID NO: 46462 - DNA, 22 bp, Artificial Sequence
  Synthetic
cagguagacagaugagccaaca

SEQ ID NO: 46463 - DNA, 30 bp, Artificial Sequence; identical to SEQ ID NO: 34229
  Synthetic

SEQ ID NO: 46464 - DNA, 25 bp, Artificial Sequence
  Synthetic
gcacaaacuccagttttaagtccut

SEQ ID NO: 46465 - DNA, 24 bp, Artificial Sequence
  Synthetic
gtttccaggtucctgacctatuga

SEQ ID NO: 46466 - DNA, 28 bp, Artificial Sequence
  Synthetic
aaacatgugaactctattucaggaacca

SEQ ID NO: 46467 - DNA, 26 bp, Artificial Sequence
  Synthetic
ctcacccaaacaucctctgtttuaga

SEQ ID NO: 46468 - DNA, 30 bp, Artificial Sequence; identical to SEQ ID NO: 5832
  Synthetic

SEQ ID NO: 46469 - DNA, 23 bp, Artificial Sequence
  Synthetic
tttgcttgagcugctagaacuga

SEQ ID NO: 46470 - DNA, 19 bp, Artificial Sequence
  Synthetic
cagcucggccatcucagat

SEQ ID NO: 46471 - DNA, 33 bp, Artificial Sequence; identical to SEQ ID NO: 34237
  Synthetic

SEQ ID NO: 46472 - DNA, 27 bp, Artificial Sequence
  Synthetic
cctgtctauacaagtcatgagttuggg

SEQ ID NO: 46473 - DNA, 23 bp, Artificial Sequence
  Synthetic
agcttatuccaagctgagtugct

SEQ ID NO: 46474 - DNA, 27 bp, Artificial Sequence
  Synthetic
gccaataccaauagaattgttagguga

SEQ ID NO: 46475 - DNA, 27 bp, Artificial Sequence
  Synthetic
ttaaatcccauaggcaatagctuggaa

SEQ ID NO: 46476 - DNA, 23 bp, Artificial Sequence
  Synthetic
gcagagcccucagcaaatacuac

SEQ ID NO: 46477 - DNA, 27 bp, Artificial Sequence
  Synthetic
cagaaatgucccagaactuaaagcaat

SEQ ID NO: 46478 - DNA, 30 bp, Artificial Sequence; identical to SEQ ID NO: 34244
  Synthetic

SEQ ID NO: 46479 - DNA, 23 bp, Artificial Sequence
  Synthetic
tctgactccucttctggcttcut

SEQ ID NO: 46480 - DNA, 21 bp, Artificial Sequence
  Synthetic
agagcaagcugccctttctut

SEQ ID NO: 46481 - DNA, 21 bp, Artificial Sequence
  Synthetic
tgctctctgagucctcctcug

SEQ ID NO: 46482 - DNA, 21 bp, Artificial Sequence
  Synthetic
cttctgtacguggtgtccugt

SEQ ID NO: 46483 - DNA, 17 bp, Artificial Sequence
  Synthetic
gctgcuctgcgagucct

SEQ ID NO: 46484 - DNA, 22 bp, Artificial Sequence
  Synthetic
tcccctcaucctgtttcucact

SEQ ID NO: 46485 - DNA, 21 bp, Artificial Sequence
  Synthetic
gcttcttgagucctcctccug

SEQ ID NO: 46486 - DNA, 24 bp, Artificial Sequence
  Synthetic
ctcactcacautctccttcuggac

SEQ ID NO: 46487 - DNA, 23 bp, Artificial Sequence
  Synthetic
tctgatgacucctcactacugct

SEQ ID NO: 46488 - DNA, 23 bp, Artificial Sequence
  Synthetic
tcacacugggactctgtcuacaa

SEQ ID NO: 46489 - DNA, 20 bp, Artificial Sequence
  Synthetic
tgctctccgagutgtccaug

SEQ ID NO: 46490 - DNA, 23 bp, Artificial Sequence
  Synthetic
gaaccttcuccagcctttcttug

SEQ ID NO: 46491 - DNA, 23 bp, Artificial Sequence
  Synthetic
gaagaatcctcugctggtctcug

SEQ ID NO: 46492 - DNA, 22 bp, Artificial Sequence
  Synthetic
actccuggagacacctctctuc

SEQ ID NO: 46493 - DNA, 23 bp, Artificial Sequence
  Synthetic
tcctcactgcuctcagagtctuc

SEQ ID NO: 46494 - DNA, 25 bp, Artificial Sequence
  Synthetic
ccctccttaautcccttttcuccac

SEQ ID NO: 46495 - DNA, 22 bp, Artificial Sequence
  Synthetic
agtgactggucctcctctcuac

SEQ ID NO: 46496 - DNA, 23 bp, Artificial Sequence
  Synthetic
ccctacatgggaugtaacaccut

SEQ ID NO: 46497 - DNA, 21 bp, Artificial Sequence
  Synthetic
ctgtctucccaggaggtgtug

SEQ ID NO: 46498 - DNA, 24 bp, Artificial Sequence
  Synthetic
gttgaagcaguttccccaaatuct

SEQ ID NO: 46499 - DNA, 22 bp, Artificial Sequence
  Synthetic
gcagtggagcacaugaagguat

SEQ ID NO: 46500 - DNA, 21 bp, Artificial Sequence
  Synthetic
gtggacccuttgccttguaaa

SEQ ID NO: 46501 - DNA, 18 bp, Artificial Sequence
  Synthetic
gggcttgugcgggtguag

SEQ ID NO: 46502 - DNA, 20 bp, Artificial Sequence
  Synthetic
ccccatcucgctccattuca

SEQ ID NO: 46503 - DNA, 26 bp, Artificial Sequence
  Synthetic
cacatgtggguaagtatggaaguagg

SEQ ID NO: 46504 - DNA, 22 bp, Artificial Sequence
  Synthetic
gaccaggtcutacttgcccuaa

SEQ ID NO: 46505 - DNA, 21 bp, Artificial Sequence
  Synthetic
tgaagaactgucgctgctguc

SEQ ID NO: 46506 - DNA, 22 bp, Artificial Sequence
  Synthetic
gggcuaccaacaggatactgug

SEQ ID NO: 46507 - DNA, 21 bp, Artificial Sequence
  Synthetic
cctgagggaucggguagacag

SEQ ID NO: 46508 - DNA, 23 bp, Artificial Sequence
  Synthetic
tgaccccacautctctctccaua

SEQ ID NO: 46509 - DNA, 24 bp, Artificial Sequence
  Synthetic
cttctttcuttcctgtuccagcag

SEQ ID NO: 46510 - DNA, 24 bp, Artificial Sequence
  Synthetic
ctctgttuccccagaaaagaccuc

SEQ ID NO: 46511 - DNA, 23 bp, Artificial Sequence
  Synthetic
tgctttgauctccacctucaacc

SEQ ID NO: 46512 - DNA, 24 bp, Artificial Sequence
  Synthetic
ggaattcacuagtccucaggaggt

SEQ ID NO: 46513 - DNA, 24 bp, Artificial Sequence
  Synthetic
accctgaatgcucaggaatgatug

SEQ ID NO: 46514 - DNA, 27 bp, Artificial Sequence
  Synthetic
ttttctcttctcucagcggtttaaugt

SEQ ID NO: 46515 - DNA, 29 bp, Artificial Sequence
  Synthetic
aguattaaaatcaugaggagcaggacaaa

SEQ ID NO: 46516 - DNA, 26 bp, Artificial Sequence
  Synthetic
acagcctgaggugttttgaaatttug

SEQ ID NO: 46517 - DNA, 24 bp, Artificial Sequence
  Synthetic
aataatgccuccttctcucagcag

SEQ ID NO: 46518 - DNA, 28 bp, Artificial Sequence
  Synthetic
actaatggtgtttuctctctctctcuct

SEQ ID NO: 46519 - DNA, 31 bp, Artificial Sequence; identical to SEQ ID NO: 34285
  Synthetic

SEQ ID NO: 46520 - DNA, 27 bp, Artificial Sequence
  Synthetic
ggatctttatugacgatcttgggtgut

SEQ ID NO: 46521 - DNA, 23 bp, Artificial Sequence
  Synthetic
gtcaaccagtuatgggaagggut

SEQ ID NO: 46522 - DNA, 28 bp, Artificial Sequence
  Synthetic
gaattgaacatucacttgctgtttcuga

SEQ ID NO: 46523 - DNA, 24 bp, Artificial Sequence
  Synthetic
ctgccugagacaggaataatcucc

SEQ ID NO: 46524 - DNA, 27 bp, Artificial Sequence
  Synthetic
ctcagattaatugctgtgctttuggat

SEQ ID NO: 46525 - DNA, 23 bp, Artificial Sequence
  Synthetic
gcattttgggaugttccacugac

SEQ ID NO: 46526 - DNA, 21 bp, Artificial Sequence
  Synthetic
autcaagagcucagacgccaa

SEQ ID NO: 46527 - DNA, 27 bp, Artificial Sequence
  Synthetic
gttctggguccatttcagaatcuacat

SEQ ID NO: 46528 - DNA, 21 bp, Artificial Sequence
  Synthetic
gagtagacacggugcagucaa

SEQ ID NO: 46529 - DNA, 31 bp, Artificial Sequence; identical to SEQ ID NO: 34295
  Synthetic

SEQ ID NO: 46530 - DNA, 28 bp, Artificial Sequence
  Synthetic
ttgattcttattgaugccccatgtttug

SEQ ID NO: 46531 - DNA, 30 bp, Artificial Sequence; identical to SEQ ID NO: 34297
  Synthetic

SEQ ID NO: 46532 - DNA, 22 bp, Artificial Sequence
  Synthetic
gctggaaaagcaaucgtcaugt

SEQ ID NO: 46533 - DNA, 30 bp, Artificial Sequence; identical to SEQ ID NO: 34299
  Synthetic

SEQ ID NO: 46534 - DNA, 25 bp, Artificial Sequence
  Synthetic
gcagaacaguatgatgtucccaagg

SEQ ID NO: 46535 - DNA, 27 bp, Artificial Sequence
  Synthetic
agaatgttcagaaucaaaagccaguga

SEQ ID NO: 46536 - DNA, 23 bp, Artificial Sequence
  Synthetic
gattccagagaaccutggccuaa

SEQ ID NO: 46537 - DNA, 25 bp, Artificial Sequence
  Synthetic
gcaagcccaauaaagagtcaccaut

SEQ ID NO: 46538 - DNA, 28 bp, Artificial Sequence
  Synthetic
cgaagtgatuccattagtatctguacca

SEQ ID NO: 46539 - DNA, 27 bp, Artificial Sequence
  Synthetic
actaatgagaggcutctgttttgctut

SEQ ID NO: 46540 - DNA, 25 bp, Artificial Sequence
  Synthetic
tgctctctcuccaaaattcaaccug

SEQ ID NO: 46541 - DNA, 24 bp, Artificial Sequence
  Synthetic
ggagagccuttggtaucagaagag

SEQ ID NO: 46542 - DNA, 27 bp, Artificial Sequence
  Synthetic
ctcttacagatccutaggtgaggaugt

SEQ ID NO: 46543 - DNA, 21 bp, Artificial Sequence
  Synthetic
caggacuccgguaagagacca

SEQ ID NO: 46544 - DNA, 23 bp, Artificial Sequence
  Synthetic
attatctggcgagutgtctgcut

SEQ ID NO: 46545 - DNA, 21 bp, Artificial Sequence
  Synthetic
cagttttcutttgcgcucggt

SEQ ID NO: 46546 - DNA, 27 bp, Artificial Sequence
  Synthetic
gaagatggtgaccauttttctgatgug

SEQ ID NO: 46547 - DNA, 21 bp, Artificial Sequence
  Synthetic
tgttcatgcgcutacgaggut

SEQ ID NO: 46548 - DNA, 24 bp, Artificial Sequence
  Synthetic
caagcatactugaggaaccacuga

SEQ ID NO: 46549 - DNA, 29 bp, Artificial Sequence
  Synthetic
gacaatgtttaucagcactttctccaaut

SEQ ID NO: 46550 - DNA, 25 bp, Artificial Sequence
  Synthetic
attacaacaatuttggcctguggac

SEQ ID NO: 46551 - DNA, 21 bp, Artificial Sequence
  Synthetic
aaaacggagccucccttucaa

SEQ ID NO: 46552 - DNA, 28 bp, Artificial Sequence
  Synthetic
tgtgcccagtutctaaatcatctaaugt

SEQ ID NO: 46553 - DNA, 32 bp, Artificial Sequence; identical to SEQ ID NO: 34319
  Synthetic

SEQ ID NO: 46554 - DNA, 30 bp, Artificial Sequence; identical to SEQ ID NO: 34320
  Synthetic

SEQ ID NO: 46555 - DNA, 28 bp, Artificial Sequence
  Synthetic
gaaggtgaaaagaucaggaactgaguaa

SEQ ID NO: 46556 - DNA, 26 bp, Artificial Sequence
  Synthetic
ctttaacccacugacactggtttuac

SEQ ID NO: 46557 - DNA, 28 bp, Artificial Sequence
  Synthetic
gaggaagaccgutcgatatctacttuac

SEQ ID NO: 46558 - DNA, 21 bp, Artificial Sequence
  Synthetic
gccttcuacccttgtguggaa

SEQ ID NO: 46559 - DNA, 28 bp, Artificial Sequence
  Synthetic
gaggttttacaautagactgguccacat

SEQ ID NO: 46560 - DNA, 22 bp, Artificial Sequence
  Synthetic
gctgggucaaagatcctugcat

SEQ ID NO: 46561 - DNA, 31 bp, Artificial Sequence; identical to SEQ ID NO: 34327
  Synthetic

SEQ ID NO: 46562 - DNA, 26 bp, Artificial Sequence
  Synthetic
cagacagacatugctaatccttacut

SEQ ID NO: 46563 - DNA, 28 bp, Artificial Sequence
  Synthetic
ctcccacatcaugtctcatcttaucaat

SEQ ID NO: 46564 - DNA, 31 bp, Artificial Sequence; identical to SEQ ID NO: 34330
  Synthetic

SEQ ID NO: 46565 - DNA, 25 bp, Artificial Sequence
  Synthetic
gagccagctautccatttctctuct

SEQ ID NO: 46566 - DNA, 23 bp, Artificial Sequence
  Synthetic
ctgtgggauagactctgaaugca

SEQ ID NO: 46567 - DNA, 25 bp, Artificial Sequence
  Synthetic
aagcaacugcaaagaggagaaagua

SEQ ID NO: 46568 - DNA, 22 bp, Artificial Sequence
  Synthetic
gcagaggtcucaggaagtcuga

SEQ ID NO: 46569 - DNA, 25 bp, Artificial Sequence
  Synthetic
tcagctgcagaaucctgaaatgaut

SEQ ID NO: 46570 - DNA, 25 bp, Artificial Sequence
  Synthetic
gaatgaggcucagagagggtagtua

SEQ ID NO: 46571 - DNA, 26 bp, Artificial Sequence
  Synthetic
tccccacaacuaaaacactcatctuc

SEQ ID NO: 46572 - DNA, 22 bp, Artificial Sequence
  Synthetic
tcatccacaccutcggactgua

SEQ ID NO: 46573 - DNA, 25 bp, Artificial Sequence
  Synthetic
ggaaatgaaaagcaucccttcucga

SEQ ID NO: 46574 - DNA, 22 bp, Artificial Sequence
  Synthetic
agagcaaucaacaggaauggct

SEQ ID NO: 46575 - DNA, 23 bp, Artificial Sequence
  Synthetic
ggaaaccaaggautgggattugg

SEQ ID NO: 46576 - DNA, 22 bp, Artificial Sequence
  Synthetic
caaccacuggaaagacctcugg

SEQ ID NO: 46577 - DNA, 21 bp, Artificial Sequence
  Synthetic
tttctcaggaggugggaguct

SEQ ID NO: 46578 - DNA, 21 bp, Artificial Sequence
  Synthetic
gcttcaccucatcaggucaca

SEQ ID NO: 46579 - DNA, 22 bp, Artificial Sequence
  Synthetic
gcaggaggcugagaaagaaguc

SEQ ID NO: 46580 - DNA, 20 bp, Artificial Sequence
  Synthetic
ccagcaacuacctgcactug

SEQ ID NO: 46581 - DNA, 22 bp, Artificial Sequence
  Synthetic
cagtgtctguccagccactaug

SEQ ID NO: 46582 - DNA, 22 bp, Artificial Sequence
  Synthetic
cttccagucacaagtgugcaga

SEQ ID NO: 46583 - DNA, 20 bp, Artificial Sequence
  Synthetic
acaaccauaagcccccacug

SEQ ID NO: 46584 - DNA, 17 bp, Artificial Sequence
  Synthetic
cgaccucgcgagcctuc

SEQ ID NO: 46585 - DNA, 17 bp, Artificial Sequence
  Synthetic
gacucggcgcggaucat

SEQ ID NO: 46586 - DNA, 22 bp, Artificial Sequence
  Synthetic
agtggttttgucccgttttugc

SEQ ID NO: 46587 - DNA, 23 bp, Artificial Sequence
  Synthetic
cgaugggaauagggaaagctuac

SEQ ID NO: 46588 - DNA, 22 bp, Artificial Sequence
  Synthetic
ttgcccagaacgggutttcaua

SEQ ID NO: 46589 - DNA, 24 bp, Artificial Sequence
  Synthetic
tggtgacatguttggtgaacucat

SEQ ID NO: 46590 - DNA, 23 bp, Artificial Sequence
  Synthetic
gcgtaagugaaacaggugcaaag

SEQ ID NO: 46591 - DNA, 30 bp, Artificial Sequence; identical to SEQ ID NO: 34357
  Synthetic

SEQ ID NO: 46592 - DNA, 20 bp, Artificial Sequence
  Synthetic
ctgccttugaacctcctgug

SEQ ID NO: 46593 - DNA, 22 bp, Artificial Sequence
  Synthetic
aacaggcucaagacaagcauct

SEQ ID NO: 46594 - DNA, 28 bp, Artificial Sequence
  Synthetic
ctcaataagcugaaacaagaaagugacc

SEQ ID NO: 46595 - DNA, 25 bp, Artificial Sequence
  Synthetic
tggcacggcuttaagtcatauaaga

SEQ ID NO: 46596 - DNA, 23 bp, Artificial Sequence
  Synthetic
cgcagtggagutggattctucag

SEQ ID NO: 46597 - DNA, 31 bp, Artificial Sequence; identical to SEQ ID NO: 34363
  Synthetic

SEQ ID NO: 46598 - DNA, 28 bp, Artificial Sequence
  Synthetic
gtagctacattaaugcaggttgaaaauc

SEQ ID NO: 46599 - DNA, 25 bp, Artificial Sequence
  Synthetic
ggtttattgcutctgtagtcugggt

SEQ ID NO: 46600 - DNA, 29 bp, Artificial Sequence
  Synthetic
acacauacttatgaauaaagccaaaccct

SEQ ID NO: 46601 - DNA, 24 bp, Artificial Sequence
  Synthetic
gctttgggaacutggatgactuac

SEQ ID NO: 46602 - DNA, 22 bp, Artificial Sequence
  Synthetic
cccatctagugggtggcattut

SEQ ID NO: 46603 - DNA, 30 bp, Artificial Sequence; identical to SEQ ID NO: 34369
  Synthetic

SEQ ID NO: 46604 - DNA, 22 bp, Artificial Sequence
  Synthetic
aggcctagcaccutgataccua

SEQ ID NO: 46605 - DNA, 23 bp, Artificial Sequence
  Synthetic
cgaatcttcugcagctccaucag

SEQ ID NO: 46606 - DNA, 31 bp, Artificial Sequence; identical to SEQ ID NO: 34372
  Synthetic

SEQ ID NO: 46607 - DNA, 25 bp, Artificial Sequence
  Synthetic
cctctgaagtuggcaagcatatcut

SEQ ID NO: 46608 - DNA, 30 bp, Artificial Sequence; identical to SEQ ID NO: 34374
  Synthetic

SEQ ID NO: 46609 - DNA, 25 bp, Artificial Sequence
  Synthetic
ggccactgtuataagctttcaagut

SEQ ID NO: 46610 - DNA, 27 bp, Artificial Sequence
  Synthetic
actaugaagacagaacuacagaaagcc

SEQ ID NO: 46611 - DNA, 28 bp, Artificial Sequence
  Synthetic
caagtgacautatcttgugaacaaccaa

SEQ ID NO: 46612 - DNA, 23 bp, Artificial Sequence
  Synthetic
actatcaggcuttctgcaagugg

SEQ ID NO: 46613 - DNA, 28 bp, Artificial Sequence
  Synthetic
ccagaggaaaacaugaatuacacccaat

SEQ ID NO: 46614 - DNA, 27 bp, Artificial Sequence
  Synthetic
gaaatatcuggcaaacgagacaaauca

SEQ ID NO: 46615 - DNA, 29 bp, Artificial Sequence
  Synthetic
gctatcctcaggaagugtatacgcttuac

SEQ ID NO: 46616 - DNA, 24 bp, Artificial Sequence
  Synthetic
ctttccutccttttcuccaaggct

SEQ ID NO: 46617 - DNA, 27 bp, Artificial Sequence
  Synthetic
ccaggatgtguccaaatccatgttaua

SEQ ID NO: 46618 - DNA, 24 bp, Artificial Sequence
  Synthetic
gcagaaauaccaggcagagtgtuc

SEQ ID NO: 46619 - DNA, 31 bp, Artificial Sequence; identical to SEQ ID NO: 34385
  Synthetic

SEQ ID NO: 46620 - DNA, 25 bp, Artificial Sequence
  Synthetic
ggagaaggaguacgagatugaaagg

SEQ ID NO: 46621 - DNA, 30 bp, Artificial Sequence; identical to SEQ ID NO: 34387
  Synthetic

SEQ ID NO: 46622 - DNA, 26 bp, Artificial Sequence
  Synthetic
gcuctgagataaugcagaagaagcag

SEQ ID NO: 46623 - DNA, 23 bp, Artificial Sequence
  Synthetic
ctcctccugaaactcagcttuga

SEQ ID NO: 46624 - DNA, 24 bp, Artificial Sequence
  Synthetic
tttgagaccgagaucaacaucacc

SEQ ID NO: 46625 - DNA, 21 bp, Artificial Sequence
  Synthetic
agtggccutttgctgtuggat

SEQ ID NO: 46626 - DNA, 30 bp, Artificial Sequence; identical to SEQ ID NO: 34392
  Synthetic

SEQ ID NO: 46627 - DNA, 23 bp, Artificial Sequence
  Synthetic
cagttcttgcucctgaacctuca

SEQ ID NO: 46628 - DNA, 20 bp, Artificial Sequence
  Synthetic
gaggagcugaatcggcugaa

SEQ ID NO: 46629 - DNA, 23 bp, Artificial Sequence
  Synthetic
gaggtcatccucactcctctuct

SEQ ID NO: 46630 - DNA, 24 bp, Artificial Sequence
  Synthetic
tcacttgaggaaugagcattucca

SEQ ID NO: 46631 - DNA, 22 bp, Artificial Sequence
  Synthetic
ggctcctuagttccaagauggt

SEQ ID NO: 46632 - DNA, 27 bp, Artificial Sequence
  Synthetic
catttcttucttcttcaatuccaggca

SEQ ID NO: 46633 - DNA, 25 bp, Artificial Sequence
  Synthetic
gaatttgctguttctcacacuccag

SEQ ID NO: 46634 - DNA, 25 bp, Artificial Sequence
  Synthetic
gtctuaggagtgagaucgaaagact

SEQ ID NO: 46635 - DNA, 21 bp, Artificial Sequence
  Synthetic
cccaucaaacaccagctugga

SEQ ID NO: 46636 - DNA, 25 bp, Artificial Sequence
  Synthetic
gaagaagtcaguggaagaagtugct

SEQ ID NO: 46637 - DNA, 21 bp, Artificial Sequence
  Synthetic
tcagcttcucattccgauggg

SEQ ID NO: 46638 - DNA, 28 bp, Artificial Sequence
  Synthetic
agtatctgttucagaagccaucaagaaa

SEQ ID NO: 46639 - DNA, 24 bp, Artificial Sequence
  Synthetic
ttttggugactggauccacaaagt

SEQ ID NO: 46640 - DNA, 23 bp, Artificial Sequence
  Synthetic
tgaccgtcacugagctaguagat

SEQ ID NO: 46641 - DNA, 21 bp, Artificial Sequence
  Synthetic
actccagagcaguaccagguc

SEQ ID NO: 46642 - DNA, 25 bp, Artificial Sequence
  Synthetic
agctgtcacugggtataatgaucct

SEQ ID NO: 46643 - DNA, 30 bp, Artificial Sequence; identical to SEQ ID NO: 34409
  Synthetic

SEQ ID NO: 46644 - DNA, 22 bp, Artificial Sequence
  Synthetic
gatgaggaaauagggcuctguc

SEQ ID NO: 46645 - DNA, 28 bp, Artificial Sequence
  Synthetic
gatggttatttcutcccattcacatucc

SEQ ID NO: 46646 - DNA, 22 bp, Artificial Sequence
  Synthetic
ctcagccucactcaatttgcug

SEQ ID NO: 46647 - DNA, 24 bp, Artificial Sequence
  Synthetic
aggttttcugtgtcaaagauggct

SEQ ID NO: 46648 - DNA, 21 bp, Artificial Sequence
  Synthetic
gtcactucaggacgcagtcuc

SEQ ID NO: 46649 - DNA, 20 bp, Artificial Sequence
  Synthetic
acutccgggucaacaagacc

SEQ ID NO: 46650 - DNA, 22 bp, Artificial Sequence
  Synthetic
ccagcagcuatgccaaaaucct

SEQ ID NO: 46651 - DNA, 22 bp, Artificial Sequence
  Synthetic
cggagccgaagacaugttguaa

SEQ ID NO: 46652 - DNA, 20 bp, Artificial Sequence
  Synthetic
ccgctcacugacagacacuc

SEQ ID NO: 46653 - DNA, 22 bp, Artificial Sequence
  Synthetic
gccggtctaaugtaggcaagua

SEQ ID NO: 46654 - DNA, 23 bp, Artificial Sequence
  Synthetic
caggcaaucccattttctcugga

SEQ ID NO: 46655 - DNA, 22 bp, Artificial Sequence
  Synthetic
cgcttacccucaagaaccugaa

SEQ ID NO: 46656 - DNA, 23 bp, Artificial Sequence
  Synthetic
acccttaaucctgcctcauagaa

SEQ ID NO: 46657 - DNA, 26 bp, Artificial Sequence
  Synthetic
gtagagaggatugaagacagccauag

SEQ ID NO: 46658 - DNA, 21 bp, Artificial Sequence
  Synthetic
caccttcttuagctccccgut

SEQ ID NO: 46659 - DNA, 19 bp, Artificial Sequence
  Synthetic
ctcacacgutcgucaccac

SEQ ID NO: 46660 - DNA, 21 bp, Artificial Sequence
  Synthetic
gtaggtgatugcttgctgcug

SEQ ID NO: 46661 - DNA, 22 bp, Artificial Sequence
  Synthetic
cccutctacccucaacgacaaa

SEQ ID NO: 46662 - DNA, 18 bp, Artificial Sequence
  Synthetic
gtgccuggactcguacgg

SEQ ID NO: 46663 - DNA, 20 bp, Artificial Sequence
  Synthetic
cgucatgcaauacgccgact

SEQ ID NO: 46664 - DNA, 19 bp, Artificial Sequence
  Synthetic
cggugttcugcggagaact

SEQ ID NO: 46665 - DNA, 19 bp, Artificial Sequence
  Synthetic
gccaacaugggcagtcuga

SEQ ID NO: 46666 - DNA, 22 bp, Artificial Sequence
  Synthetic
gctggcauaggttccactguat

SEQ ID NO: 46667 - DNA, 28 bp, Artificial Sequence
  Synthetic
gcttggttuacaacagggaataggttua

SEQ ID NO: 46668 - DNA, 17 bp, Artificial Sequence
  Synthetic
ccacccgguggttgucg

SEQ ID NO: 46669 - DNA, 25 bp, Artificial Sequence
  Synthetic
ctaaaaucagagccauccagacagt

SEQ ID NO: 46670 - DNA, 25 bp, Artificial Sequence
  Synthetic
gcctatactucaccatggagactuc

SEQ ID NO: 46671 - DNA, 28 bp, Artificial Sequence
  Synthetic
aacaagtgattugatgatgtgttuacct

SEQ ID NO: 46672 - DNA, 25 bp, Artificial Sequence
  Synthetic
gtgaagtgaugcccgatgacattua

SEQ ID NO: 46673 - DNA, 29 bp, Artificial Sequence
  Synthetic
ggcattttcattcugacttggtatttugt

SEQ ID NO: 46674 - DNA, 27 bp, Artificial Sequence
  Synthetic
tgaatgagtgaaugtgtgaatggauga

SEQ ID NO: 46675 - DNA, 26 bp, Artificial Sequence
  Synthetic
agtcctcaactucttccgtttctaug

SEQ ID NO: 46676 - DNA, 27 bp, Artificial Sequence
  Synthetic
ttctgctguaggagagagagaacuaaa

SEQ ID NO: 46677 - DNA, 22 bp, Artificial Sequence
  Synthetic
cugcaaaagcaucaggaggaga

SEQ ID NO: 46678 - DNA, 22 bp, Artificial Sequence
  Synthetic
ctccccucctactacacauggt

SEQ ID NO: 46679 - DNA, 23 bp, Artificial Sequence
  Synthetic
cagccacatcuggcttgaaatuc

SEQ ID NO: 46680 - DNA, 23 bp, Artificial Sequence
  Synthetic
gcttccugagatcatttggucct

SEQ ID NO: 46681 - DNA, 21 bp, Artificial Sequence
  Synthetic
ggttctgcugctctccaaucc

SEQ ID NO: 46682 - DNA, 21 bp, Artificial Sequence
  Synthetic
gtcttccuggcaaggguaaac

SEQ ID NO: 46683 - DNA, 23 bp, Artificial Sequence
  Synthetic
gctgcttatccutcagccactuc

SEQ ID NO: 46684 - DNA, 23 bp, Artificial Sequence
  Synthetic
gcagtgagaugaggatctgcuct

SEQ ID NO: 46685 - DNA, 23 bp, Artificial Sequence
  Synthetic
agacttcccccutgttcctacuc

SEQ ID NO: 46686 - DNA, 22 bp, Artificial Sequence
  Synthetic
acgtcttagcugaacgtgagug

SEQ ID NO: 46687 - DNA, 18 bp, Artificial Sequence
  Synthetic
gaucaccggcaugcagga

SEQ ID NO: 46688 - DNA, 24 bp, Artificial Sequence
  Synthetic
gaauggacaggaucagacagagac

SEQ ID NO: 46689 - DNA, 23 bp, Artificial Sequence
  Synthetic
catcctgcucacactttctucct

SEQ ID NO: 46690 - DNA, 19 bp, Artificial Sequence
  Synthetic
ggguaggagacgtccuggt

SEQ ID NO: 46691 - DNA, 20 bp, Artificial Sequence
  Synthetic
gctgtccuggtgccguagat

SEQ ID NO: 46692 - DNA, 21 bp, Artificial Sequence
  Synthetic
ggagatgttugtgcacccuga

SEQ ID NO: 46693 - DNA, 22 bp, Artificial Sequence
  Synthetic
atgcaggaagaugaggccauac

SEQ ID NO: 46694 - DNA, 22 bp, Artificial Sequence
  Synthetic
gcaagagacaaggutggtguga

SEQ ID NO: 46695 - DNA, 27 bp, Artificial Sequence
  Synthetic
tccatgaccugatttattccttgucag

SEQ ID NO: 46696 - DNA, 22 bp, Artificial Sequence
  Synthetic
tgcttgtuaggctggtagtucc

SEQ ID NO: 46697 - DNA, 21 bp, Artificial Sequence
  Synthetic
aaccagccacuacccttccua

SEQ ID NO: 46698 - DNA, 19 bp, Artificial Sequence
  Synthetic
cacttgggucccacaggut

SEQ ID NO: 46699 - DNA, 24 bp, Artificial Sequence
  Synthetic
cccacctcucccttaagagaauga

SEQ ID NO: 46700 - DNA, 19 bp, Artificial Sequence
  Synthetic
gaggagcauccccacacug

SEQ ID NO: 46701 - DNA, 24 bp, Artificial Sequence
  Synthetic
aggacacatuccttgtgtgtgtut

SEQ ID NO: 46702 - DNA, 19 bp, Artificial Sequence
  Synthetic
cccatcccaccugccatug

SEQ ID NO: 46703 - DNA, 23 bp, Artificial Sequence
  Synthetic
ttggcuggaggataaacacucag

SEQ ID NO: 46704 - DNA, 20 bp, Artificial Sequence
  Synthetic
ccggcutcccaauacccaag

SEQ ID NO: 46705 - DNA, 24 bp, Artificial Sequence
  Synthetic
tgtgacccugactcttattcucca

SEQ ID NO: 46706 - DNA, 21 bp, Artificial Sequence
  Synthetic
tgcagaggagutccagcucaa

SEQ ID NO: 46707 - DNA, 28 bp, Artificial Sequence
  Synthetic
gaaggagaggagguttttgactctaauc

SEQ ID NO: 46708 - DNA, 21 bp, Artificial Sequence
  Synthetic
ttggccccugagacgatacua

SEQ ID NO: 46709 - DNA, 25 bp, Artificial Sequence
  Synthetic
ctcatctguggtgtatctgttuccc

SEQ ID NO: 46710 - DNA, 21 bp, Artificial Sequence
  Synthetic
ggcaaaacaucaccccaucct

SEQ ID NO: 46711 - DNA, 23 bp, Artificial Sequence
  Synthetic
cctgtgtccutgtctctgcttuc

SEQ ID NO: 46712 - DNA, 25 bp, Artificial Sequence
  Synthetic
gguaagagaagagagucagagacac

SEQ ID NO: 46713 - DNA, 28 bp, Artificial Sequence
  Synthetic
ttctctaatatctugtctgccttcucct

SEQ ID NO: 46714 - DNA, 23 bp, Artificial Sequence
  Synthetic
caccccacaggaaacutgtcaua

SEQ ID NO: 46715 - DNA, 23 bp, Artificial Sequence
  Synthetic
ggtctgaccauctgctttcucag

SEQ ID NO: 46716 - DNA, 21 bp, Artificial Sequence
  Synthetic
actcaggaugcttggtgctug

SEQ ID NO: 46717 - DNA, 24 bp, Artificial Sequence
  Synthetic
gtttaattugggagcatggctgug

SEQ ID NO: 46718 - DNA, 22 bp, Artificial Sequence
  Synthetic
ggcagacagacuaatgcuaggg

SEQ ID NO: 46719 - DNA, 22 bp, Artificial Sequence
  Synthetic
gatccttccucctgggaatcug

SEQ ID NO: 46720 - DNA, 22 bp, Artificial Sequence
  Synthetic
caggtgaacuctcagcuggaaa

SEQ ID NO: 46721 - DNA, 20 bp, Artificial Sequence
  Synthetic
gaagctgagutcccccacuc

SEQ ID NO: 46722 - DNA, 20 bp, Artificial Sequence
  Synthetic
aagagctgcuttccagcugt

SEQ ID NO: 46723 - DNA, 24 bp, Artificial Sequence
  Synthetic
tgacaactccucttccctctguag

SEQ ID NO: 46724 - DNA, 23 bp, Artificial Sequence
  Synthetic
agagagaacautacccaggguga

SEQ ID NO: 46725 - DNA, 29 bp, Artificial Sequence
  Synthetic
ctgaaccctaccuttcataacttcucaat

SEQ ID NO: 46726 - DNA, 21 bp, Artificial Sequence
  Synthetic
tcaactgacuggctgactuca

SEQ ID NO: 46727 - DNA, 21 bp, Artificial Sequence
  Synthetic
ctgtccutccctcucacacag

SEQ ID NO: 46728 - DNA, 23 bp, Artificial Sequence
  Synthetic
gaaggcagugaagagaggagaug

SEQ ID NO: 46729 - DNA, 23 bp, Artificial Sequence
  Synthetic
tcttaggagcutggtcctuccaa

SEQ ID NO: 46730 - DNA, 27 bp, Artificial Sequence
  Synthetic
agagccauatgaataaugagacaaggg

SEQ ID NO: 46731 - DNA, 23 bp, Artificial Sequence
  Synthetic
gggccacuggtcacattttcuat

SEQ ID NO: 46732 - DNA, 26 bp, Artificial Sequence
  Synthetic
acagacaaaaucccagcagacattua

SEQ ID NO: 46733 - DNA, 24 bp, Artificial Sequence
  Synthetic
ccttgttgcucatgctttgaaucc

SEQ ID NO: 46734 - DNA, 22 bp, Artificial Sequence
  Synthetic
ggtgggauctcctatccaucac

SEQ ID NO: 46735 - DNA, 20 bp, Artificial Sequence
  Synthetic
tggagguctgaccgucacac

SEQ ID NO: 46736 - DNA, 24 bp, Artificial Sequence
  Synthetic
agacggcaugaatggataaaacug

SEQ ID NO: 46737 - DNA, 25 bp, Artificial Sequence
  Synthetic
ggtaagtguagtggcaaatguaggg

SEQ ID NO: 46738 - DNA, 22 bp, Artificial Sequence
  Synthetic
ctcccttcccuacctatccuca

SEQ ID NO: 46739 - DNA, 19 bp, Artificial Sequence
  Synthetic
acagggucgtgtccucact

SEQ ID NO: 46740 - DNA, 22 bp, Artificial Sequence
  Synthetic
ccugggagaauaagggaagugt

SEQ ID NO: 46741 - DNA, 21 bp, Artificial Sequence
  Synthetic
ccctcccuatgcctccuaacc

SEQ ID NO: 46742 - DNA, 25 bp, Artificial Sequence
  Synthetic
caaaagaagccccuttccagaacua

SEQ ID NO: 46743 - DNA, 23 bp, Artificial Sequence
  Synthetic
gaagggtgaauttggagagugct

SEQ ID NO: 46744 - DNA, 23 bp, Artificial Sequence
  Synthetic
tcctccauatctttccugcccat

SEQ ID NO: 46745 - DNA, 24 bp, Artificial Sequence
  Synthetic
tcttttgcatuctcttcccacucc

SEQ ID NO: 46746 - DNA, 23 bp, Artificial Sequence
  Synthetic
gaaggctcagaugagcacauaga

SEQ ID NO: 46747 - DNA, 24 bp, Artificial Sequence
  Synthetic
ggcaguggaaauaggagaagcaag

SEQ ID NO: 46748 - DNA, 26 bp, Artificial Sequence
  Synthetic
gaucgaaaccaauaagaagcaatuct

SEQ ID NO: 46749 - DNA, 22 bp, Artificial Sequence
  Synthetic
gggcccuacgattacacctaug

SEQ ID NO: 46750 - DNA, 21 bp, Artificial Sequence
  Synthetic
atcaagacgucatgggcugag

SEQ ID NO: 46751 - DNA, 23 bp, Artificial Sequence
  Synthetic
actcttctccutctctcctuggg

SEQ ID NO: 46752 - DNA, 22 bp, Artificial Sequence
  Synthetic
ggacacagtuccaggaagacug

SEQ ID NO: 46753 - DNA, 22 bp, Artificial Sequence
  Synthetic
cccaggcauctctcctcctuag

SEQ ID NO: 46754 - DNA, 22 bp, Artificial Sequence
  Synthetic
ggttcctgautttgtggccugt

SEQ ID NO: 46755 - DNA, 24 bp, Artificial Sequence
  Synthetic
cgctccatcuctctcatgtcttug

SEQ ID NO: 46756 - DNA, 26 bp, Artificial Sequence
  Synthetic
gtctcaaggguttcacagttuagagt

SEQ ID NO: 46757 - DNA, 22 bp, Artificial Sequence
  Synthetic
cgcutcctgtaugaagaccaga

SEQ ID NO: 46758 - DNA, 19 bp, Artificial Sequence
  Synthetic
gccuaccccaccatgucac

SEQ ID NO: 46759 - DNA, 24 bp, Artificial Sequence
  Synthetic
tcctgataaucatggactcuccca

SEQ ID NO: 46760 - DNA, 18 bp, Artificial Sequence
  Synthetic
cucttaccugcccagcct

SEQ ID NO: 46761 - DNA, 17 bp, Artificial Sequence
  Synthetic
ccgcagccuctgaccuc

SEQ ID NO: 46762 - DNA, 25 bp, Artificial Sequence
  Synthetic
gacccacccauactatatgacaucc

SEQ ID NO: 46763 - DNA, 26 bp, Artificial Sequence
  Synthetic
cagtgagttgucttcccttgttcuat

SEQ ID NO: 46764 - DNA, 22 bp, Artificial Sequence
  Synthetic
gctgaagggauttgtgugggaa

SEQ ID NO: 46765 - DNA, 28 bp, Artificial Sequence
  Synthetic
gccttaacaguagttttctgcctuacag

SEQ ID NO: 46766 - DNA, 26 bp, Artificial Sequence
  Synthetic
gaccctaaactuaaattccaccguca

SEQ ID NO: 46767 - DNA, 20 bp, Artificial Sequence
  Synthetic
tgugaagaagcugggcaagg

SEQ ID NO: 46768 - DNA, 21 bp, Artificial Sequence
  Synthetic
ggaggctcuccttaccctcua

SEQ ID NO: 46769 - DNA, 23 bp, Artificial Sequence
  Synthetic
cacacuacagtuacgaccaccag

SEQ ID NO: 46770 - DNA, 23 bp, Artificial Sequence
  Synthetic
tgagcctcagugtccccaataua

SEQ ID NO: 46771 - DNA, 25 bp, Artificial Sequence
  Synthetic
caggtgtttcaugaagaagaccauc

SEQ ID NO: 46772 - DNA, 27 bp, Artificial Sequence
  Synthetic
ggaagaggaugatgtugaagagaacac

SEQ ID NO: 46773 - DNA, 29 bp, Artificial Sequence
  Synthetic
cgatgtgatgaauaattctgagagccaut

SEQ ID NO: 46774 - DNA, 24 bp, Artificial Sequence
  Synthetic
ggtcaaactugactttcaguagcg

SEQ ID NO: 46775 - DNA, 19 bp, Artificial Sequence
  Synthetic
ccugccaccactacugcat

SEQ ID NO: 46776 - DNA, 22 bp, Artificial Sequence
  Synthetic
gctcacgtcucttatgctggut

SEQ ID NO: 46777 - DNA, 19 bp, Artificial Sequence
  Synthetic
ccccttucaattgcugcga

SEQ ID NO: 46778 - DNA, 20 bp, Artificial Sequence
  Synthetic
gctcctcucctgtctccuca

SEQ ID NO: 46779 - DNA, 23 bp, Artificial Sequence
  Synthetic
actgtgctugggaaaagauaccc

SEQ ID NO: 46780 - DNA, 22 bp, Artificial Sequence
  Synthetic
cctcacctccugcctgtctuat

SEQ ID NO: 46781 - DNA, 24 bp, Artificial Sequence
  Synthetic
gctcccautctatagcaugaaggg

SEQ ID NO: 46782 - DNA, 30 bp, Artificial Sequence; identical to SEQ ID NO: 34548
  Synthetic

SEQ ID NO: 46783 - DNA, 26 bp, Artificial Sequence
  Synthetic
attcaguacacccggaaactatucag

SEQ ID NO: 46784 - DNA, 23 bp, Artificial Sequence
  Synthetic
catagcagcagcagcugatttug

SEQ ID NO: 46785 - DNA, 25 bp, Artificial Sequence
  Synthetic
agttgatgaauggagtguccagaag

SEQ ID NO: 46786 - DNA, 22 bp, Artificial Sequence
  Synthetic
tcatctccacccuccaagctua

SEQ ID NO: 46787 - DNA, 26 bp, Artificial Sequence
  Synthetic
tggtcccacutacaacugaacaaaaa

SEQ ID NO: 46788 - DNA, 29 bp, Artificial Sequence
  Synthetic
agtagcuattcccactauaagggagaaag

SEQ ID NO: 46789 - DNA, 28 bp, Artificial Sequence
  Synthetic
aggcagaaacucaagatggttatgtuag

SEQ ID NO: 46790 - DNA, 24 bp, Artificial Sequence
  Synthetic
tgctatgaatucctaatggcugca

SEQ ID NO: 46791 - DNA, 25 bp, Artificial Sequence
  Synthetic
ctccctcctccuattcccatttcua

SEQ ID NO: 46792 - DNA, 23 bp, Artificial Sequence
  Synthetic
ccatcugaaggctggacuaggat

SEQ ID NO: 46793 - DNA, 29 bp, Artificial Sequence
  Synthetic
tttcactgguaataatggattguggaaaa

SEQ ID NO: 46794 - DNA, 26 bp, Artificial Sequence
  Synthetic
tcagaacattctcuagtaccccaguc

SEQ ID NO: 46795 - DNA, 21 bp, Artificial Sequence
  Synthetic
gttggtcaacguaggcctcuc

SEQ ID NO: 46796 - DNA, 27 bp, Artificial Sequence
  Synthetic
tggttttggccaauctgtaagaagtua

SEQ ID NO: 46797 - DNA, 27 bp, Artificial Sequence
  Synthetic
tcagcttcctuattgctgaatgaauct

SEQ ID NO: 46798 - DNA, 26 bp, Artificial Sequence
  Synthetic
caaaacttgaggaguttgatccauga

SEQ ID NO: 46799 - DNA, 22 bp, Artificial Sequence
  Synthetic
ttcttgauagcgctgaugccat

SEQ ID NO: 46800 - DNA, 25 bp, Artificial Sequence
  Synthetic
tctttgatctguaccatcctcucca

SEQ ID NO: 46801 - DNA, 27 bp, Artificial Sequence
  Synthetic
gagcaggcttugaagatttcagaauag

SEQ ID NO: 46802 - DNA, 22 bp, Artificial Sequence
  Synthetic
cctcuaccacaggcattgcaut

SEQ ID NO: 46803 - DNA, 26 bp, Artificial Sequence
  Synthetic
gagttgcttuttgactgtctucacag

SEQ ID NO: 46804 - DNA, 22 bp, Artificial Sequence
  Synthetic
gtcctctcugctgttatugggt

SEQ ID NO: 46805 - DNA, 29 bp, Artificial Sequence
  Synthetic
cgatatttgtggcuggtggtttataugat

SEQ ID NO: 46806 - DNA, 21 bp, Artificial Sequence
  Synthetic
cugaggtgaauacaggccaca

SEQ ID NO: 46807 - DNA, 25 bp, Artificial Sequence
  Synthetic
ctgcuccacaaaattccgucaaaaa

SEQ ID NO: 46808 - DNA, 25 bp, Artificial Sequence
  Synthetic
catggcaccauagtcaaagttctug

SEQ ID NO: 46809 - DNA, 20 bp, Artificial Sequence
  Synthetic
catcaaccuccauggcaacg

SEQ ID NO: 46810 - DNA, 22 bp, Artificial Sequence
  Synthetic
ccagctgugccaaacacaauat

SEQ ID NO: 46811 - DNA, 29 bp, Artificial Sequence
  Synthetic
gaaagtacctgaugacatgcatttgttua

SEQ ID NO: 46812 - DNA, 23 bp, Artificial Sequence
  Synthetic
acaaacagtcuccccctacauga

SEQ ID NO: 46813 - DNA, 29 bp, Artificial Sequence
  Synthetic
ccagctagtgatutttgaaacaggtttut

SEQ ID NO: 46814 - DNA, 30 bp, Artificial Sequence; identical to SEQ ID NO: 34580
  Synthetic

SEQ ID NO: 46815 - DNA, 27 bp, Artificial Sequence
  Synthetic
tggctttcattccuctgaaggatttut

SEQ ID NO: 46816 - DNA, 21 bp, Artificial Sequence
  Synthetic
caacatgcucgcaatcctugt

SEQ ID NO: 46817 - DNA, 31 bp, Artificial Sequence; identical to SEQ ID NO: 34583
  Synthetic

SEQ ID NO: 46818 - DNA, 23 bp, Artificial Sequence
  Synthetic
cttcttcaacaccutgccatgut

SEQ ID NO: 46819 - DNA, 24 bp, Artificial Sequence
  Synthetic
ttcttugggaggtgaaaauaccac

SEQ ID NO: 46820 - DNA, 24 bp, Artificial Sequence
  Synthetic
tgtctggaatugaagggtgatugg

SEQ ID NO: 46821 - DNA, 24 bp, Artificial Sequence
  Synthetic
cgagtgggtcugtcttttccatut

SEQ ID NO: 46822 - DNA, 21 bp, Artificial Sequence
  Synthetic
aacgagauaacctgctccuct

SEQ ID NO: 46823 - DNA, 29 bp, Artificial Sequence
  Synthetic
aacaaccactgucaattatgtacgtgaua

SEQ ID NO: 46824 - DNA, 22 bp, Artificial Sequence
  Synthetic
cutctataagccucgacagcca

SEQ ID NO: 46825 - DNA, 23 bp, Artificial Sequence
  Synthetic
tggaaacccuttcagcttctugt

SEQ ID NO: 46826 - DNA, 27 bp, Artificial Sequence
  Synthetic
tgggccttattuatcatctgttctguc

SEQ ID NO: 46827 - DNA, 29 bp, Artificial Sequence
  Synthetic
atgtgtccagtuttcttattttgcttuca

SEQ ID NO: 46828 - DNA, 24 bp, Artificial Sequence
  Synthetic
tgctgugagaaaacaagugacagt

SEQ ID NO: 46829 - DNA, 30 bp, Artificial Sequence; identical to SEQ ID NO: 34595
  Synthetic

SEQ ID NO: 46830 - DNA, 25 bp, Artificial Sequence
  Synthetic
acacccctgautgagaaagaactut

SEQ ID NO: 46831 - DNA, 27 bp, Artificial Sequence
  Synthetic
gatcccctggauttgttgaaacatuag

SEQ ID NO: 46832 - DNA, 24 bp, Artificial Sequence
  Synthetic
tgtgtccuacacaagaaugcagaa

SEQ ID NO: 46833 - DNA, 28 bp, Artificial Sequence
  Synthetic
tcaacagaatcucaggagccatatcuaa

SEQ ID NO: 46834 - DNA, 22 bp, Artificial Sequence
  Synthetic
cagatgcttauggaaggctugc

SEQ ID NO: 46835 - DNA, 26 bp, Artificial Sequence
  Synthetic
ggagatttgtcuggaagcatgttcua

SEQ ID NO: 46836 - DNA, 26 bp, Artificial Sequence
  Synthetic
tgaaagaccccaauacaaatguccag

SEQ ID NO: 46837 - DNA, 22 bp, Artificial Sequence
  Synthetic
gttaaaggugccaaaccgaugg

SEQ ID NO: 46838 - DNA, 24 bp, Artificial Sequence
  Synthetic
ggcucagcaactatagucaaggac

SEQ ID NO: 46839 - DNA, 23 bp, Artificial Sequence
  Synthetic
cctactcaacucccttcttuccc

SEQ ID NO: 46840 - DNA, 26 bp, Artificial Sequence
  Synthetic
ctggaacttauccagaaagttuccct

SEQ ID NO: 46841 - DNA, 22 bp, Artificial Sequence
  Synthetic
gacaacgucacagtggagaaug

SEQ ID NO: 46842 - DNA, 24 bp, Artificial Sequence
  Synthetic
tatcgctgccauttggactaaaut

SEQ ID NO: 46843 - DNA, 20 bp, Artificial Sequence
  Synthetic
ggagtgugagacgcccaauc

SEQ ID NO: 46844 - DNA, 21 bp, Artificial Sequence
  Synthetic
ccagccuacactctctgaugg

SEQ ID NO: 46845 - DNA, 24 bp, Artificial Sequence
  Synthetic
catttgcgaggaaagutcccaaug

SEQ ID NO: 46846 - DNA, 28 bp, Artificial Sequence
  Synthetic
agtagtcaguacagcattaaucacaaaa

SEQ ID NO: 46847 - DNA, 25 bp, Artificial Sequence
  Synthetic
ggattttcuccagggaatgtcucag

SEQ ID NO: 46848 - DNA, 25 bp, Artificial Sequence
  Synthetic
gtgtgctgtcutatttgcttgacut

SEQ ID NO: 46849 - DNA, 25 bp, Artificial Sequence
  Synthetic
aggagcugcaaacattgacatttut

SEQ ID NO: 46850 - DNA, 27 bp, Artificial Sequence
  Synthetic
actcctatgtgauaccaaagtccauct

SEQ ID NO: 46851 - DNA, 30 bp, Artificial Sequence; identical to SEQ ID NO: 34617
  Synthetic

SEQ ID NO: 46852 - DNA, 24 bp, Artificial Sequence
  Synthetic
acacaacguggcttgcatuaaaaa

SEQ ID NO: 46853 - DNA, 21 bp, Artificial Sequence
  Synthetic
agtcctggucaatgggcuaac

SEQ ID NO: 46854 - DNA, 26 bp, Artificial Sequence
  Synthetic
ccuccttctagagtuaagaagcaacc

SEQ ID NO: 46855 - DNA, 20 bp, Artificial Sequence
  Synthetic
caacgugagcctgtcuggat

SEQ ID NO: 46856 - DNA, 21 bp, Artificial Sequence
  Synthetic
tttctcctugcatggcaguga

SEQ ID NO: 46857 - DNA, 25 bp, Artificial Sequence
  Synthetic
cctgtgacautgtgaactuaacgga

SEQ ID NO: 46858 - DNA, 23 bp, Artificial Sequence
  Synthetic
ctctctgaccucactggcaaaut

SEQ ID NO: 46859 - DNA, 31 bp, Artificial Sequence; identical to SEQ ID NO: 34625
  Synthetic

SEQ ID NO: 46860 - DNA, 21 bp, Artificial Sequence
  Synthetic
gacgtggacutccacauccaa

SEQ ID NO: 46861 - DNA, 28 bp, Artificial Sequence
  Synthetic
gtgacugtgaatttaauccaaaaagaca

SEQ ID NO: 46862 - DNA, 31 bp, Artificial Sequence; identical to SEQ ID NO: 34628
  Synthetic

SEQ ID NO: 46863 - DNA, 27 bp, Artificial Sequence
  Synthetic
gagttctcttcccutaagtcagtccua

SEQ ID NO: 46864 - DNA, 22 bp, Artificial Sequence
  Synthetic
ctgtgagacccuccccagatua

SEQ ID NO: 46865 - DNA, 30 bp, Artificial Sequence; identical to SEQ ID NO: 34631
  Synthetic

SEQ ID NO: 46866 - DNA, 24 bp, Artificial Sequence
  Synthetic
tggcctcuaacaaaatcacugcaa

SEQ ID NO: 46867 - DNA, 31 bp, Artificial Sequence; identical to SEQ ID NO: 34633
  Synthetic

SEQ ID NO: 46868 - DNA, 22 bp, Artificial Sequence
  Synthetic
gcagcaaauccatgccacuaga

SEQ ID NO: 46869 - DNA, 23 bp, Artificial Sequence
  Synthetic
ccgatgactucacatccagguac

SEQ ID NO: 46870 - DNA, 22 bp, Artificial Sequence
  Synthetic
tgttccctugggaatgtgagug

SEQ ID NO: 46871 - DNA, 22 bp, Artificial Sequence
  Synthetic
ctttguttctgacgugccacag

SEQ ID NO: 46872 - DNA, 23 bp, Artificial Sequence
  Synthetic
cagtaaccccuagcaggaaagut

SEQ ID NO: 46873 - DNA, 23 bp, Artificial Sequence
  Synthetic
ccagtgcuggttcatcagaucaa

SEQ ID NO: 46874 - DNA, 23 bp, Artificial Sequence
  Synthetic
ggtaactguccccaaaacaguga

SEQ ID NO: 46875 - DNA, 28 bp, Artificial Sequence
  Synthetic
aactgaaggactuatttggtgtccauag

SEQ ID NO: 46876 - DNA, 28 bp, Artificial Sequence
  Synthetic
gatgaaaaagacaaucagaaugaagcca

SEQ ID NO: 46877 - DNA, 28 bp, Artificial Sequence
  Synthetic
gggtggtcttuatgctcatgatauaaat

SEQ ID NO: 46878 - DNA, 21 bp, Artificial Sequence
  Synthetic
gctccaugggacuggaaagag

SEQ ID NO: 46879 - DNA, 22 bp, Artificial Sequence
  Synthetic
tggagccaugtactaccuggaa

SEQ ID NO: 46880 - DNA, 24 bp, Artificial Sequence
  Synthetic
guatgggacuggcaacagagaaaa

SEQ ID NO: 46881 - DNA, 31 bp, Artificial Sequence; identical to SEQ ID NO: 34647
  Synthetic

SEQ ID NO: 46882 - DNA, 21 bp, Artificial Sequence
  Synthetic
ctcgccagcccaucatgatua

SEQ ID NO: 46883 - DNA, 31 bp, Artificial Sequence; identical to SEQ ID NO: 34649
  Synthetic

SEQ ID NO: 46884 - DNA, 27 bp, Artificial Sequence
  Synthetic
gttaatggucatcaagaaauggccaaa

SEQ ID NO: 46885 - DNA, 30 bp, Artificial Sequence; identical to SEQ ID NO: 34651
  Synthetic

SEQ ID NO: 46886 - DNA, 25 bp, Artificial Sequence
  Synthetic
tcctcaugagaaccaatctugcaat

SEQ ID NO: 46887 - DNA, 31 bp, Artificial Sequence; identical to SEQ ID NO: 34653
  Synthetic

SEQ ID NO: 46888 - DNA, 28 bp, Artificial Sequence
  Synthetic
cacttacctatcaaugtactcagcauca

SEQ ID NO: 46889 - DNA, 31 bp, Artificial Sequence; identical to SEQ ID NO: 34655
  Synthetic

SEQ ID NO: 46890 - DNA, 21 bp, Artificial Sequence
  Synthetic
cagacacgcuggctcattuac

SEQ ID NO: 46891 - DNA, 27 bp, Artificial Sequence
  Synthetic
cataaggattuccactttctgtccuca

SEQ ID NO: 46892 - DNA, 28 bp, Artificial Sequence
  Synthetic
ccugtcctuagaaaaggaagaaaaucaa

SEQ ID NO: 46893 - DNA, 25 bp, Artificial Sequence
  Synthetic
ggtagtggttugaatctgacctuca

SEQ ID NO: 46894 - DNA, 26 bp, Artificial Sequence
  Synthetic
tcaatactcaucagagagaucagcca

SEQ ID NO: 46895 - DNA, 27 bp, Artificial Sequence
  Synthetic
ctcatctcctuaatttcccaggttuca

SEQ ID NO: 46896 - DNA, 24 bp, Artificial Sequence
  Synthetic
gcccctttcauccagaacatttut

SEQ ID NO: 46897 - DNA, 20 bp, Artificial Sequence
  Synthetic
caagggcucagacgacucag

SEQ ID NO: 46898 - DNA, 21 bp, Artificial Sequence
  Synthetic
caggaccacgagugtgatucc

SEQ ID NO: 46899 - DNA, 26 bp, Artificial Sequence
  Synthetic
gtcttcctccugaaaaacgtcaaauc

SEQ ID NO: 46900 - DNA, 27 bp, Artificial Sequence
  Synthetic
gcttcttcaaaugctcttgacatguat

SEQ ID NO: 46901 - DNA, 30 bp, Artificial Sequence; identical to SEQ ID NO: 34667
  Synthetic

SEQ ID NO: 46902 - DNA, 28 bp, Artificial Sequence
  Synthetic
agtgguggagaaagtagaataucgagat

SEQ ID NO: 46903 - DNA, 23 bp, Artificial Sequence
  Synthetic
ggattgggugggtatcaguaagc

SEQ ID NO: 46904 - DNA, 25 bp, Artificial Sequence
  Synthetic
gatgtagcugaagagagggacaaug

SEQ ID NO: 46905 - DNA, 30 bp, Artificial Sequence; identical to SEQ ID NO: 34671
  Synthetic

SEQ ID NO: 46906 - DNA, 21 bp, Artificial Sequence
  Synthetic
ggaacccacgucagtcctcua

SEQ ID NO: 46907 - DNA, 25 bp, Artificial Sequence
  Synthetic
agattgagaagugcaaagctccuac

SEQ ID NO: 46908 - DNA, 30 bp, Artificial Sequence; identical to SEQ ID NO: 34674
  Synthetic

SEQ ID NO: 46909 - DNA, 27 bp, Artificial Sequence
  Synthetic
aaatggctttguaagtggtcagauact

SEQ ID NO: 46910 - DNA, 23 bp, Artificial Sequence
  Synthetic
gaauaccccaguggaccagaaat

SEQ ID NO: 46911 - DNA, 28 bp, Artificial Sequence
  Synthetic
cagtgtcacauaaaaccaggctaattut

SEQ ID NO: 46912 - DNA, 17 bp, Artificial Sequence
  Synthetic
ggaggtgucctcgcuca

SEQ ID NO: 46913 - DNA, 20 bp, Artificial Sequence
  Synthetic
gcctcctccucgttctccuc

SEQ ID NO: 46914 - DNA, 22 bp, Artificial Sequence
  Synthetic
ggtucacggaggagaaauggag

SEQ ID NO: 46915 - DNA, 22 bp, Artificial Sequence
  Synthetic
tgtctccccugggtagtttugt

SEQ ID NO: 46916 - DNA, 28 bp, Artificial Sequence
  Synthetic
ccaagagaugcaaaccataaacttgtut

SEQ ID NO: 46917 - DNA, 28 bp, Artificial Sequence
  Synthetic
tcaaatgtcauggagataagugaaagct

SEQ ID NO: 46918 - DNA, 31 bp, Artificial Sequence; identical to SEQ ID NO: 34684
  Synthetic

SEQ ID NO: 46919 - DNA, 22 bp, Artificial Sequence
  Synthetic
ctggccuggctctctacttuaa

SEQ ID NO: 46920 - DNA, 29 bp, Artificial Sequence
  Synthetic
gttattgaatggucacatcaaauccaaga

SEQ ID NO: 46921 - DNA, 28 bp, Artificial Sequence
  Synthetic
cagctcaggacacuttgctaatttaaut

SEQ ID NO: 46922 - DNA, 24 bp, Artificial Sequence
  Synthetic
ccatgttgtttuacgtggctcuct

SEQ ID NO: 46923 - DNA, 30 bp, Artificial Sequence; identical to SEQ ID NO: 34689
  Synthetic

SEQ ID NO: 46924 - DNA, 27 bp, Artificial Sequence
  Synthetic
tgattcttugaaacagagacggtuaca

SEQ ID NO: 46925 - DNA, 28 bp, Artificial Sequence
  Synthetic
cttcccataaaguagcttgccaatttut

SEQ ID NO: 46926 - DNA, 25 bp, Artificial Sequence
  Synthetic
tgctcaatgtaguggaaaggtctut

SEQ ID NO: 46927 - DNA, 31 bp, Artificial Sequence; identical to SEQ ID NO: 34693
  Synthetic

SEQ ID NO: 46928 - DNA, 23 bp, Artificial Sequence
  Synthetic
gcgagugagagagagcuaaagua

SEQ ID NO: 46929 - DNA, 25 bp, Artificial Sequence
  Synthetic
aataattgucccaagccttctguca

SEQ ID NO: 46930 - DNA, 26 bp, Artificial Sequence
  Synthetic
actcatagtgcutaatgttgcctuca

SEQ ID NO: 46931 - DNA, 25 bp, Artificial Sequence
  Synthetic
gtgtccaaccutatccaccactuac

SEQ ID NO: 46932 - DNA, 32 bp, Artificial Sequence; identical to SEQ ID NO: 34698
  Synthetic

SEQ ID NO: 46933 - DNA, 28 bp, Artificial Sequence
  Synthetic
gaccatttauggcactgaattuaaccaa

SEQ ID NO: 46934 - DNA, 29 bp, Artificial Sequence
  Synthetic
gctaacatattuggcactttttgtttugg

SEQ ID NO: 46935 - DNA, 19 bp, Artificial Sequence
  Synthetic
gccatgucagccacgtugt

SEQ ID NO: 46936 - DNA, 21 bp, Artificial Sequence
  Synthetic
ggtgauccagcagaccaugag

SEQ ID NO: 46937 - DNA, 29 bp, Artificial Sequence
  Synthetic
agatttttgctctuctctgaactcaauga

SEQ ID NO: 46938 - DNA, 27 bp, Artificial Sequence
  Synthetic
tccctctctggauacctggaaaattua

SEQ ID NO: 46939 - DNA, 27 bp, Artificial Sequence
  Synthetic
cctctctgtcuagggaaggttuaaaca

SEQ ID NO: 46940 - DNA, 26 bp, Artificial Sequence
  Synthetic
actctcccttugaagaattacctugg

SEQ ID NO: 46941 - DNA, 25 bp, Artificial Sequence
  Synthetic
gtctccagggugtttctgaaatcua

SEQ ID NO: 46942 - DNA, 28 bp, Artificial Sequence
  Synthetic
gcaaggaaaacccutagcatttaatgua

SEQ ID NO: 46943 - DNA, 23 bp, Artificial Sequence
  Synthetic
aaaggcttcaugtccacctugaa

SEQ ID NO: 46944 - DNA, 32 bp, Artificial Sequence; identical to SEQ ID NO: 34710
  Synthetic

SEQ ID NO: 46945 - DNA, 24 bp, Artificial Sequence
  Synthetic
tgcaccaugatgtcaacuaaacca

SEQ ID NO: 46946 - DNA, 26 bp, Artificial Sequence
  Synthetic
tgaagtaattucgcatttgtgcctut

SEQ ID NO: 46947 - DNA, 28 bp, Artificial Sequence
  Synthetic
acaaaaacttgguaactagcttacguca

SEQ ID NO: 46948 - DNA, 27 bp, Artificial Sequence
  Synthetic
gttcagagagagautcagacactaugc

SEQ ID NO: 46949 - DNA, 27 bp, Artificial Sequence
  Synthetic
gcaaaacaaagacaaaaugtggcagua

SEQ ID NO: 46950 - DNA, 26 bp, Artificial Sequence
  Synthetic
gaagaagaaaugttgcagaugcaaga

SEQ ID NO: 46951 - DNA, 30 bp, Artificial Sequence; identical to SEQ ID NO: 34717
  Synthetic

SEQ ID NO: 46952 - DNA, 28 bp, Artificial Sequence
  Synthetic
ccaggagtugggaaatatatgucaaagg

SEQ ID NO: 46953 - DNA, 22 bp, Artificial Sequence
  Synthetic
gtaactctgugatggcccucag

SEQ ID NO: 46954 - DNA, 26 bp, Artificial Sequence
  Synthetic
aggcaaaaggaaccgutcatataugt

SEQ ID NO: 46955 - DNA, 28 bp, Artificial Sequence
  Synthetic
aaaattagccaaguagaaaugacccagt

SEQ ID NO: 46956 - DNA, 26 bp, Artificial Sequence
  Synthetic
cagagtagatauagtgcctcccucat

SEQ ID NO: 46957 - DNA, 31 bp, Artificial Sequence; identical to SEQ ID NO: 34723
  Synthetic

SEQ ID NO: 46958 - DNA, 21 bp, Artificial Sequence
  Synthetic
tctaatauccacggccccgua

SEQ ID NO: 46959 - DNA, 29 bp, Artificial Sequence
  Synthetic
ggttgcaccuccataacacagtatuaaat

SEQ ID NO: 46960 - DNA, 28 bp, Artificial Sequence
  Synthetic
cataacgttucatgacttcatauggcat

SEQ ID NO: 46961 - DNA, 22 bp, Artificial Sequence
  Synthetic
ctgtacatuccaactgcccugt

SEQ ID NO: 46962 - DNA, 22 bp, Artificial Sequence
  Synthetic
ccttagagccaguaggaggaug

SEQ ID NO: 46963 - DNA, 27 bp, Artificial Sequence
  Synthetic
aatcaaaaatccacagutccctaggut

SEQ ID NO: 46964 - DNA, 31 bp, Artificial Sequence; identical to SEQ ID NO: 34730
  Synthetic

SEQ ID NO: 46965 - DNA, 20 bp, Artificial Sequence
  Synthetic
agtttugccaccacgtcuct

SEQ ID NO: 46966 - DNA, 21 bp, Artificial Sequence
  Synthetic
ccagtgtccugcgtatgauga

SEQ ID NO: 46967 - DNA, 29 bp, Artificial Sequence
  Synthetic
ctatctggacggaaacuttgaattgtuac

SEQ ID NO: 46968 - DNA, 27 bp, Artificial Sequence
  Synthetic
gcgtaaaaaccccutctgttaaatuct

SEQ ID NO: 46969 - DNA, 20 bp, Artificial Sequence
  Synthetic
gatagccugcatgccacuca

SEQ ID NO: 46970 - DNA, 28 bp, Artificial Sequence
  Synthetic
tcagcaatttguacttatcaccttguca

SEQ ID NO: 46971 - DNA, 28 bp, Artificial Sequence
  Synthetic
caagaaaacguaacaaatgatcccucac

SEQ ID NO: 46972 - DNA, 26 bp, Artificial Sequence
  Synthetic
ggtgtttgtuagaccttgtatuggct

SEQ ID NO: 46973 - DNA, 23 bp, Artificial Sequence
  Synthetic
catctgtucaaagtgcagctucc

SEQ ID NO: 46974 - DNA, 23 bp, Artificial Sequence
  Synthetic
ggcutgggtguaaggaaagaaga

SEQ ID NO: 46975 - DNA, 27 bp, Artificial Sequence
  Synthetic
gacaacaaatgtuctttccatagcugt

SEQ ID NO: 46976 - DNA, 23 bp, Artificial Sequence
  Synthetic
gaaacagaagccgguttggaaug

SEQ ID NO: 46977 - DNA, 24 bp, Artificial Sequence
  Synthetic
gcttgtacugaaaaacggcttuct

SEQ ID NO: 46978 - DNA, 24 bp, Artificial Sequence
  Synthetic
acacagcctgugatacttctggua

SEQ ID NO: 46979 - DNA, 26 bp, Artificial Sequence
  Synthetic
cgctcctuaagtgatgtatcucaaac

SEQ ID NO: 46980 - DNA, 24 bp, Artificial Sequence
  Synthetic
tctgctttucaagcctagtgtuca

SEQ ID NO: 46981 - DNA, 25 bp, Artificial Sequence
  Synthetic
tuaaatggcguaaccgaagacaaac

SEQ ID NO: 46982 - DNA, 24 bp, Artificial Sequence
  Synthetic
cttgctgacucctgaaaatguacc

SEQ ID NO: 46983 - DNA, 22 bp, Artificial Sequence
  Synthetic
gttttaaccuccccaugaccct

SEQ ID NO: 46984 - DNA, 23 bp, Artificial Sequence
  Synthetic
gtgguggcagaaagagaugaaag

SEQ ID NO: 46985 - DNA, 30 bp, Artificial Sequence; identical to SEQ ID NO: 34751
  Synthetic

SEQ ID NO: 46986 - DNA, 30 bp, Artificial Sequence; identical to SEQ ID NO: 34752
  Synthetic

SEQ ID NO: 46987 - DNA, 28 bp, Artificial Sequence
  Synthetic
ccttgatgatttutgatcccttgttuct

SEQ ID NO: 46988 - DNA, 28 bp, Artificial Sequence
  Synthetic
ggtcataactatggucctggaggaaaua

SEQ ID NO: 46989 - DNA, 29 bp, Artificial Sequence
  Synthetic
gatttugggagagagtaaacuacagagac

SEQ ID NO: 46990 - DNA, 22 bp, Artificial Sequence
  Synthetic
cctggauacagggaggagugaa

SEQ ID NO: 46991 - DNA, 26 bp, Artificial Sequence
  Synthetic
tgctgttggaaauggaagcuaaagat

SEQ ID NO: 46992 - DNA, 28 bp, Artificial Sequence
  Synthetic
gcctctgaautaaaggtatttuccccat

SEQ ID NO: 46993 - DNA, 25 bp, Artificial Sequence
  Synthetic
tgacctctgacautcatacgctuac

SEQ ID NO: 46994 - DNA, 23 bp, Artificial Sequence
  Synthetic
ccctcattuattgccacttugct

SEQ ID NO: 46995 - DNA, 27 bp, Artificial Sequence
  Synthetic
gaaaagcatcgugactagttaacucac

SEQ ID NO: 46996 - DNA, 21 bp, Artificial Sequence
  Synthetic
caacgccgcaucagcatttua

SEQ ID NO: 46997 - DNA, 29 bp, Artificial Sequence
  Synthetic
ggaagatcttucaagaaatgtgttggtut

SEQ ID NO: 46998 - DNA, 29 bp, Artificial Sequence
  Synthetic
gcgatgaagatguggacaagataattuct

SEQ ID NO: 46999 - DNA, 28 bp, Artificial Sequence
  Synthetic
gcaatagcaggutttaactaacaugcaa

SEQ ID NO: 47000 - DNA, 29 bp, Artificial Sequence
  Synthetic
ttgagaggattucacatgaactgtaaugt

SEQ ID NO: 47001 - DNA, 28 bp, Artificial Sequence
  Synthetic
gcttcttctucaacaggttctuaaacag

SEQ ID NO: 47002 - DNA, 23 bp, Artificial Sequence
  Synthetic
atttgttgugaacaaggccagug

SEQ ID NO: 47003 - DNA, 26 bp, Artificial Sequence
  Synthetic
gctccgcacuctaaatgttggaatua

SEQ ID NO: 47004 - DNA, 22 bp, Artificial Sequence
  Synthetic
tccagactuccgctaatccugt

SEQ ID NO: 47005 - DNA, 22 bp, Artificial Sequence
  Synthetic
aggautttcatctugccaggct

SEQ ID NO: 47006 - DNA, 30 bp, Artificial Sequence; identical to SEQ ID NO: 34772
  Synthetic

SEQ ID NO: 47007 - DNA, 25 bp, Artificial Sequence
  Synthetic
ccctttguggagaacatctguaaac

SEQ ID NO: 47008 - DNA, 27 bp, Artificial Sequence
  Synthetic
ggtttgtccauttaccttacaguaaca

SEQ ID NO: 47009 - DNA, 23 bp, Artificial Sequence
  Synthetic
ttctugacaccggactttcucag

SEQ ID NO: 47010 - DNA, 21 bp, Artificial Sequence
  Synthetic
tggaaggacguaaacctugcc

SEQ ID NO: 47011 - DNA, 25 bp, Artificial Sequence
  Synthetic
aagaacatcuccacagagtgtctuc

SEQ ID NO: 47012 - DNA, 25 bp, Artificial Sequence
  Synthetic
acctagggtuactttctcatgacut

SEQ ID NO: 47013 - DNA, 21 bp, Artificial Sequence
  Synthetic
gttatuccaggcggcaatugt

SEQ ID NO: 47014 - DNA, 28 bp, Artificial Sequence
  Synthetic
ccactgaatttuaaggtttttgaaugcc

SEQ ID NO: 47015 - DNA, 25 bp, Artificial Sequence
  Synthetic
gctgctgcugaaaatcattuagcaa

SEQ ID NO: 47016 - DNA, 31 bp, Artificial Sequence; identical to SEQ ID NO: 34782
  Synthetic

SEQ ID NO: 47017 - DNA, 25 bp, Artificial Sequence
  Synthetic
actaagtgtuggtggtgacguaaac

SEQ ID NO: 47018 - DNA, 22 bp, Artificial Sequence
  Synthetic
agggaagcuttctggaugacac

SEQ ID NO: 47019 - DNA, 28 bp, Artificial Sequence
  Synthetic
gtcctcttagaggaautaccaagtcuga

SEQ ID NO: 47020 - DNA, 29 bp, Artificial Sequence
  Synthetic
ggtgatugaagccaaagaaaaugaaagaa

SEQ ID NO: 47021 - DNA, 28 bp, Artificial Sequence
  Synthetic
ccaatgtuccagaaacaaattgaacucc

SEQ ID NO: 47022 - DNA, 21 bp, Artificial Sequence
  Synthetic
catgcagggacgcauctcuat

SEQ ID NO: 47023 - DNA, 21 bp, Artificial Sequence
  Synthetic
agaggcatcugcctttggtuc

SEQ ID NO: 47024 - DNA, 28 bp, Artificial Sequence
  Synthetic
agatagacccucttgaattggattucct

SEQ ID NO: 47025 - DNA, 29 bp, Artificial Sequence
  Synthetic
tttacatttcaacacuggagagagcuaat

SEQ ID NO: 47026 - DNA, 31 bp, Artificial Sequence; identical to SEQ ID NO: 34792
  Synthetic

SEQ ID NO: 47027 - DNA, 27 bp, Artificial Sequence
  Synthetic
cagatcctccuaactcttcagacuaca

SEQ ID NO: 47028 - DNA, 22 bp, Artificial Sequence
  Synthetic
gugcgaagtatguggagaggac

SEQ ID NO: 47029 - DNA, 29 bp, Artificial Sequence
  Synthetic
aaaagaaactaagaucactgtgaacugaa

SEQ ID NO: 47030 - DNA, 25 bp, Artificial Sequence
  Synthetic
agtaataugcctcacctucacagga

SEQ ID NO: 47031 - DNA, 22 bp, Artificial Sequence
  Synthetic
tcatctggugtaggugcagact

SEQ ID NO: 47032 - DNA, 23 bp, Artificial Sequence
  Synthetic
gacccttgcucttggaaaccaua

SEQ ID NO: 47033 - DNA, 22 bp, Artificial Sequence
  Synthetic
aaaaggauagcttcggcuccag

SEQ ID NO: 47034 - DNA, 20 bp, Artificial Sequence
  Synthetic
cgtgctacuggttggcuact

SEQ ID NO: 47035 - DNA, 29 bp, Artificial Sequence
  Synthetic
ttcaugaattcttctaaauacacccgaca

SEQ ID NO: 47036 - DNA, 23 bp, Artificial Sequence
  Synthetic
cctccacccaaaugctgaaauag

SEQ ID NO: 47037 - DNA, 30 bp, Artificial Sequence; identical to SEQ ID NO: 34803
  Synthetic

SEQ ID NO: 47038 - DNA, 26 bp, Artificial Sequence
  Synthetic
gcttccaagaaugtgagaggaugaat

SEQ ID NO: 47039 - DNA, 22 bp, Artificial Sequence
  Synthetic
gataatgccaautccccctugc

SEQ ID NO: 47040 - DNA, 24 bp, Artificial Sequence
  Synthetic
aacagcaaguttttcttccuccct

SEQ ID NO: 47041 - DNA, 22 bp, Artificial Sequence
  Synthetic
gtaaacaaagcagggcutcugg

SEQ ID NO: 47042 - DNA, 28 bp, Artificial Sequence
  Synthetic
aaccagaatgtugaatgtttattgcauc

SEQ ID NO: 47043 - DNA, 24 bp, Artificial Sequence
  Synthetic
ctgtttggtutcttgtctguccac

SEQ ID NO: 47044 - DNA, 19 bp, Artificial Sequence
  Synthetic
gctggaguggctctgctuc

SEQ ID NO: 47045 - DNA, 18 bp, Artificial Sequence
  Synthetic
acagucgtgugccaccac

SEQ ID NO: 47046 - DNA, 17 bp, Artificial Sequence
  Synthetic
ggcgugaaccgagcuga

SEQ ID NO: 47047 - DNA, 17 bp, Artificial Sequence
  Synthetic
gtcguccgtcacuccca

SEQ ID NO: 47048 - DNA, 23 bp, Artificial Sequence
  Synthetic
gtattgccaagcuaggctaguga

SEQ ID NO: 47049 - DNA, 31 bp, Artificial Sequence; identical to SEQ ID NO: 34815
  Synthetic

SEQ ID NO: 47050 - DNA, 25 bp, Artificial Sequence
  Synthetic
gggctatuaggatacatuccacagt

SEQ ID NO: 47051 - DNA, 28 bp, Artificial Sequence
  Synthetic
aatcaacacacatuttcttcacaggtuc

SEQ ID NO: 47052 - DNA, 28 bp, Artificial Sequence
  Synthetic
actcaactaattutcctgaagtcaugct

SEQ ID NO: 47053 - DNA, 31 bp, Artificial Sequence; identical to SEQ ID NO: 34819
  Synthetic

SEQ ID NO: 47054 - DNA, 23 bp, Artificial Sequence
  Synthetic
ctccttatgaggutctctcccut

SEQ ID NO: 47055 - DNA, 28 bp, Artificial Sequence
  Synthetic
cctgacttuagcaaggatatcaaccaua

SEQ ID NO: 47056 - DNA, 22 bp, Artificial Sequence
  Synthetic
ctgaagttcutgaagcgtugcc

SEQ ID NO: 47057 - DNA, 29 bp, Artificial Sequence
  Synthetic
agugattucaaagacaauaacaaaaacca

SEQ ID NO: 47058 - DNA, 24 bp, Artificial Sequence
  Synthetic
catgcgtgttutgggacaatguag

SEQ ID NO: 47059 - DNA, 30 bp, Artificial Sequence; identical to SEQ ID NO: 34825
  Synthetic

SEQ ID NO: 47060 - DNA, 23 bp, Artificial Sequence
  Synthetic
gtggaagccaauggcctaatcua

SEQ ID NO: 47061 - DNA, 28 bp, Artificial Sequence
  Synthetic
gtcttttgacatcucctacagagctuat

SEQ ID NO: 47062 - DNA, 30 bp, Artificial Sequence; identical to SEQ ID NO: 34828
  Synthetic

SEQ ID NO: 47063 - DNA, 27 bp, Artificial Sequence
  Synthetic
caacccatttguctgtttcggtatuat

SEQ ID NO: 47064 - DNA, 26 bp, Artificial Sequence
  Synthetic
gcaaatgaagagacccutgaaacaug

SEQ ID NO: 47065 - DNA, 21 bp, Artificial Sequence
  Synthetic
tcttggttttguggccagcua

SEQ ID NO: 47066 - DNA, 25 bp, Artificial Sequence
  Synthetic
tttgcaaatuggttgtgacugagat

SEQ ID NO: 47067 - DNA, 27 bp, Artificial Sequence
  Synthetic
agaactctcaauctgccaacatctuac

SEQ ID NO: 47068 - DNA, 29 bp, Artificial Sequence
  Synthetic
tttttaaaccctaugcagacacatugaac

SEQ ID NO: 47069 - DNA, 23 bp, Artificial Sequence
  Synthetic
acagttccatugctgctggauac

SEQ ID NO: 47070 - DNA, 27 bp, Artificial Sequence
  Synthetic
agagaguaggtttctatcucaggcaaa

SEQ ID NO: 47071 - DNA, 23 bp, Artificial Sequence
  Synthetic
auctttagctgugagaccagcac

SEQ ID NO: 47072 - DNA, 30 bp, Artificial Sequence; identical to SEQ ID NO: 34838
  Synthetic

SEQ ID NO: 47073 - DNA, 22 bp, Artificial Sequence
  Synthetic
agacgacaauggtgagcaaucc

SEQ ID NO: 47074 - DNA, 30 bp, Artificial Sequence; identical to SEQ ID NO: 34840
  Synthetic

SEQ ID NO: 47075 - DNA, 25 bp, Artificial Sequence
  Synthetic
agtacuaagaggaacaccacacuca

SEQ ID NO: 47076 - DNA, 29 bp, Artificial Sequence
  Synthetic
cttaatgtactucctgaaatacucagcga

SEQ ID NO: 47077 - DNA, 28 bp, Artificial Sequence
  Synthetic
ctgagatggataucataaggctgttgut

SEQ ID NO: 47078 - DNA, 30 bp, Artificial Sequence; identical to SEQ ID NO: 34844
  Synthetic

SEQ ID NO: 47079 - DNA, 28 bp, Artificial Sequence
  Synthetic
ggcaggaagcauataagaaccaaatcut

SEQ ID NO: 47080 - DNA, 21 bp, Artificial Sequence
  Synthetic
acaccagaaugatgggctcut

SEQ ID NO: 47081 - DNA, 27 bp, Artificial Sequence
  Synthetic
cagcaaatgtcucacaaaggtactuac

SEQ ID NO: 47082 - DNA, 23 bp, Artificial Sequence
  Synthetic
gccttuccagataacagtugcca

SEQ ID NO: 47083 - DNA, 28 bp, Artificial Sequence
  Synthetic
ctgctctcaucagggaaaggaaataaut

SEQ ID NO: 47084 - DNA, 27 bp, Artificial Sequence
  Synthetic
gcttttgagccugatgaggatatugaa

SEQ ID NO: 47085 - DNA, 31 bp, Artificial Sequence; identical to SEQ ID NO: 34851
  Synthetic

SEQ ID NO: 47086 - DNA, 27 bp, Artificial Sequence
  Synthetic
tcctaggaacuaacaaaacattgtguc

SEQ ID NO: 47087 - DNA, 25 bp, Artificial Sequence
  Synthetic
aaccttgacccucttgagattucac

SEQ ID NO: 47088 - DNA, 28 bp, Artificial Sequence
  Synthetic
tgggttgaugctattctatttcuaccct

SEQ ID NO: 47089 - DNA, 28 bp, Artificial Sequence
  Synthetic
atgttccctgacagutcttaatcagaua

SEQ ID NO: 47090 - DNA, 22 bp, Artificial Sequence
  Synthetic
gctatgcguacacttgcaucct

SEQ ID NO: 47091 - DNA, 27 bp, Artificial Sequence
  Synthetic
cgtctgaataautctagccatttugcc

SEQ ID NO: 47092 - DNA, 22 bp, Artificial Sequence
  Synthetic
tggagaacccguagtgcaaauc

SEQ ID NO: 47093 - DNA, 21 bp, Artificial Sequence
  Synthetic
gtccacacacccacucttgut

SEQ ID NO: 47094 - DNA, 22 bp, Artificial Sequence
  Synthetic
atggaccuaggaggaagguagg

SEQ ID NO: 47095 - DNA, 23 bp, Artificial Sequence
  Synthetic
ccaggacaaaggauccatucaga

SEQ ID NO: 47096 - DNA, 20 bp, Artificial Sequence
  Synthetic
ctgaagggutgtgggcugat

SEQ ID NO: 47097 - DNA, 23 bp, Artificial Sequence
  Synthetic
cactaatcccutgcccactguag

SEQ ID NO: 47098 - DNA, 22 bp, Artificial Sequence
  Synthetic
gccuggcagagagagtactuga

SEQ ID NO: 47099 - DNA, 23 bp, Artificial Sequence
  Synthetic
gcatcccaucctcacattgtucc

SEQ ID NO: 47100 - DNA, 22 bp, Artificial Sequence
  Synthetic
aggtgaaccugggtcctcauaa

SEQ ID NO: 47101 - DNA, 23 bp, Artificial Sequence
  Synthetic
agaagaaccgagacuaccctcug

SEQ ID NO: 47102 - DNA, 22 bp, Artificial Sequence
  Synthetic
agtctggtugctgggauaacct

SEQ ID NO: 47103 - DNA, 21 bp, Artificial Sequence
  Synthetic
ccaaccugcaggcaaatgtuc

SEQ ID NO: 47104 - DNA, 24 bp, Artificial Sequence
  Synthetic
tctcagcaagaaagucgatgtcuc

SEQ ID NO: 47105 - DNA, 22 bp, Artificial Sequence
  Synthetic
cctggctttcutccagccttut

SEQ ID NO: 47106 - DNA, 21 bp, Artificial Sequence
  Synthetic
ccaccatggucagttcctgug

SEQ ID NO: 47107 - DNA, 25 bp, Artificial Sequence
  Synthetic
tgataaactcttuacgtgggctgug

SEQ ID NO: 47108 - DNA, 17 bp, Artificial Sequence
  Synthetic
tggaugcgcgcaccuag

SEQ ID NO: 47109 - DNA, 17 bp, Artificial Sequence
  Synthetic
cggcgucagcaguagca

SEQ ID NO: 47110 - DNA, 29 bp, Artificial Sequence
  Synthetic
ctgaagatagttcuaggaggaaacagcua

SEQ ID NO: 47111 - DNA, 28 bp, Artificial Sequence
  Synthetic
acaggtcguaaaaaccttccctaaaauc

SEQ ID NO: 47112 - DNA, 17 bp, Artificial Sequence
  Synthetic
agtgaguggccccucca

SEQ ID NO: 47113 - DNA, 18 bp, Artificial Sequence
  Synthetic
cccagucgacucccggat

SEQ ID NO: 47114 - DNA, 22 bp, Artificial Sequence
  Synthetic
gaatatggagcaaucccgguca

SEQ ID NO: 47115 - DNA, 23 bp, Artificial Sequence
  Synthetic
ccctctccccutagagcacttua

SEQ ID NO: 47116 - DNA, 27 bp, Artificial Sequence
  Synthetic
tctctctctctcuctctctgtctcuac

SEQ ID NO: 47117 - DNA, 18 bp, Artificial Sequence
  Synthetic
gagccaucagcaguccca

SEQ ID NO: 47118 - DNA, 21 bp, Artificial Sequence
  Synthetic
gctcagccaugttctgccuaa

SEQ ID NO: 47119 - DNA, 21 bp, Artificial Sequence
  Synthetic
gagtctgguggcaagttcuca

SEQ ID NO: 47120 - DNA, 22 bp, Artificial Sequence
  Synthetic
cacagugcctggaguaaggaat

SEQ ID NO: 47121 - DNA, 24 bp, Artificial Sequence
  Synthetic
agctcatttcacugtctcaaccut

SEQ ID NO: 47122 - DNA, 20 bp, Artificial Sequence
  Synthetic
cccccaaccacacutctgug

SEQ ID NO: 47123 - DNA, 24 bp, Artificial Sequence
  Synthetic
caccccatucccagcttttctaut

SEQ ID NO: 47124 - DNA, 26 bp, Artificial Sequence
  Synthetic
ctgcagtagtuatgtccaagagauga

SEQ ID NO: 47125 - DNA, 28 bp, Artificial Sequence
  Synthetic
actctuggagaaaucagaaagtaaaugg

SEQ ID NO: 47126 - DNA, 21 bp, Artificial Sequence
  Synthetic
ctggagaauccacccuttcug

SEQ ID NO: 47127 - DNA, 23 bp, Artificial Sequence
  Synthetic
gatggaggttuagggtgttgcua

SEQ ID NO: 47128 - DNA, 27 bp, Artificial Sequence
  Synthetic
tttgttcttaaugcccaaggagagaut

SEQ ID NO: 47129 - DNA, 23 bp, Artificial Sequence
  Synthetic
cagggaagugggaatgtttcuca

SEQ ID NO: 47130 - DNA, 22 bp, Artificial Sequence
  Synthetic
acagctgugatttgctucgaat

SEQ ID NO: 47131 - DNA, 27 bp, Artificial Sequence
  Synthetic
cagatctgaacuaattccgtctagugc

SEQ ID NO: 47132 - DNA, 21 bp, Artificial Sequence
  Synthetic
gcctctccugttccttcucag

SEQ ID NO: 47133 - DNA, 18 bp, Artificial Sequence
  Synthetic
gcgcctucccgtcguaag

SEQ ID NO: 47134 - DNA, 22 bp, Artificial Sequence
  Synthetic
gctcccaggcugagacttctua

SEQ ID NO: 47135 - DNA, 23 bp, Artificial Sequence
  Synthetic
aggucctagugaccagagagaac

SEQ ID NO: 47136 - DNA, 22 bp, Artificial Sequence
  Synthetic
cagggagggauggctattgtut

SEQ ID NO: 47137 - DNA, 23 bp, Artificial Sequence
  Synthetic
tgauagaacaauccaccccaggt

SEQ ID NO: 47138 - DNA, 22 bp, Artificial Sequence
  Synthetic
tgcacaaggugagtctttugct

SEQ ID NO: 47139 - DNA, 25 bp, Artificial Sequence
  Synthetic
ctcaaatgggacacaucgtgatuac

SEQ ID NO: 47140 - DNA, 20 bp, Artificial Sequence
  Synthetic
agctuccggaacacgactuc

SEQ ID NO: 47141 - DNA, 19 bp, Artificial Sequence
  Synthetic
ggactcuccaccagcucca

SEQ ID NO: 47142 - DNA, 21 bp, Artificial Sequence
  Synthetic
agaaggacaggugtgagctug

SEQ ID NO: 47143 - DNA, 24 bp, Artificial Sequence
  Synthetic
gggacatuacaggaggccaaauag

SEQ ID NO: 47144 - DNA, 19 bp, Artificial Sequence
  Synthetic
ggaggcutggguagcacac

SEQ ID NO: 47145 - DNA, 21 bp, Artificial Sequence
  Synthetic
ttgagccucactgtccatguc

SEQ ID NO: 47146 - DNA, 17 bp, Artificial Sequence
  Synthetic
ctcacgccccacuccuc

SEQ ID NO: 47147 - DNA, 18 bp, Artificial Sequence
  Synthetic
accccuggcctcuggaaa

SEQ ID NO: 47148 - DNA, 22 bp, Artificial Sequence
  Synthetic
gcgacaaacacucacctctgua

SEQ ID NO: 47149 - DNA, 28 bp, Artificial Sequence
  Synthetic
tctaactgttctutctctattgccaugc

SEQ ID NO: 47150 - DNA, 19 bp, Artificial Sequence
  Synthetic
gctggcccutggtgacaua

SEQ ID NO: 47151 - DNA, 19 bp, Artificial Sequence
  Synthetic
gcuggaagcaggtgtugct

SEQ ID NO: 47152 - DNA, 18 bp, Artificial Sequence
  Synthetic
ctgagccacugggtcugt

SEQ ID NO: 47153 - DNA, 17 bp, Artificial Sequence
  Synthetic
tgcugtggcugcaggag

SEQ ID NO: 47154 - DNA, 18 bp, Artificial Sequence
  Synthetic
ctggtccccuggctccua

SEQ ID NO: 47155 - DNA, 21 bp, Artificial Sequence
  Synthetic
ccaccatcutcctcccugaca

SEQ ID NO: 47156 - DNA, 19 bp, Artificial Sequence
  Synthetic
acgauacccaaccggugac

SEQ ID NO: 47157 - DNA, 22 bp, Artificial Sequence
  Synthetic
gtctacacucaccaccaaccuc

SEQ ID NO: 47158 - DNA, 17 bp, Artificial Sequence
  Synthetic
ccccagccccuctccua

SEQ ID NO: 47159 - DNA, 20 bp, Artificial Sequence
  Synthetic
gttctcuccgtggucagcag

SEQ ID NO: 47160 - DNA, 20 bp, Artificial Sequence
  Synthetic
aaaccacugagcaggtgcut

SEQ ID NO: 47161 - DNA, 18 bp, Artificial Sequence
  Synthetic
cucagcaagugcggaggt

SEQ ID NO: 47162 - DNA, 22 bp, Artificial Sequence
  Synthetic
gtggtccacucataaagccuac

SEQ ID NO: 47163 - DNA, 21 bp, Artificial Sequence
  Synthetic
ctttuccaggcacugcagaac

SEQ ID NO: 47164 - DNA, 21 bp, Artificial Sequence
  Synthetic
cattcaaacugctccgagugc

SEQ ID NO: 47165 - DNA, 22 bp, Artificial Sequence
  Synthetic
atccuacccacccacuaaaggt

SEQ ID NO: 47166 - DNA, 23 bp, Artificial Sequence
  Synthetic
cgtugccaagagtaugaacaagg

SEQ ID NO: 47167 - DNA, 24 bp, Artificial Sequence
  Synthetic
ggttgtttggcutaaactctggug

SEQ ID NO: 47168 - DNA, 24 bp, Artificial Sequence
  Synthetic
gctgcctuctcttttcaucacagt

SEQ ID NO: 47169 - DNA, 21 bp, Artificial Sequence
  Synthetic
cttgccacccuacctagtguc

SEQ ID NO: 47170 - DNA, 21 bp, Artificial Sequence
  Synthetic
ccacagggucactctugagat

SEQ ID NO: 47171 - DNA, 17 bp, Artificial Sequence
  Synthetic
gcttcccccuggctucc

SEQ ID NO: 47172 - DNA, 20 bp, Artificial Sequence
  Synthetic
gtctcacgaugccgttcuct

SEQ ID NO: 47173 - DNA, 22 bp, Artificial Sequence
  Synthetic
tgtaaggtgcutgggacatgug

SEQ ID NO: 47174 - DNA, 18 bp, Artificial Sequence
  Synthetic
cgtgtggguggcagucag

SEQ ID NO: 47175 - DNA, 19 bp, Artificial Sequence
  Synthetic
cttcctcucgcccaucaca

SEQ ID NO: 47176 - DNA, 20 bp, Artificial Sequence
  Synthetic
ccgacatcucctcgggctua

SEQ ID NO: 47177 - DNA, 21 bp, Artificial Sequence
  Synthetic
ctctaacacccugtggctcuc

SEQ ID NO: 47178 - DNA, 22 bp, Artificial Sequence
  Synthetic
ccactcctugcttctcagauga

SEQ ID NO: 47179 - DNA, 21 bp, Artificial Sequence
  Synthetic
cagtgcauacaccgagaccug

SEQ ID NO: 47180 - DNA, 23 bp, Artificial Sequence
  Synthetic
acgccaccacaagaugataaguc

SEQ ID NO: 47181 - DNA, 22 bp, Artificial Sequence
  Synthetic
ggctggaauactgcuacaaccc

SEQ ID NO: 47182 - DNA, 22 bp, Artificial Sequence
  Synthetic
ggactgauaccccagcucagat

SEQ ID NO: 47183 - DNA, 30 bp, Artificial Sequence; identical to SEQ ID NO: 34949
  Synthetic

SEQ ID NO: 47184 - DNA, 23 bp, Artificial Sequence
  Synthetic
agaauagcaagcaaggaaugcct

SEQ ID NO: 47185 - DNA, 20 bp, Artificial Sequence
  Synthetic
gctctagggugaccccacuc

SEQ ID NO: 47186 - DNA, 23 bp, Artificial Sequence
  Synthetic
ggctgtggaagucactcttctug

SEQ ID NO: 47187 - DNA, 21 bp, Artificial Sequence
  Synthetic
ctaacacccugttcgcacuga

SEQ ID NO: 47188 - DNA, 25 bp, Artificial Sequence
  Synthetic
tggcatttgtutttccaactctucg

SEQ ID NO: 47189 - DNA, 19 bp, Artificial Sequence
  Synthetic
tgggtggugctggtctgua

SEQ ID NO: 47190 - DNA, 23 bp, Artificial Sequence
  Synthetic
atccctacugagatggagtgugt

SEQ ID NO: 47191 - DNA, 21 bp, Artificial Sequence
  Synthetic
gcacaucgaggtgaaugggag

SEQ ID NO: 47192 - DNA, 22 bp, Artificial Sequence
  Synthetic
cctggctctucccactaaacuc

SEQ ID NO: 47193 - DNA, 24 bp, Artificial Sequence
  Synthetic
tctggacccucaatgtatccctut

SEQ ID NO: 47194 - DNA, 23 bp, Artificial Sequence
  Synthetic
cctcutaaacccaaugcccagac

SEQ ID NO: 47195 - DNA, 22 bp, Artificial Sequence
  Synthetic
aactgcacuagccttggugaaa

SEQ ID NO: 47196 - DNA, 21 bp, Artificial Sequence
  Synthetic
gttgatgctcugcacatcguc

SEQ ID NO: 47197 - DNA, 23 bp, Artificial Sequence
  Synthetic
agcgtaatuccctttgtctcucc

SEQ ID NO: 47198 - DNA, 19 bp, Artificial Sequence
  Synthetic
cctagcggugcagagtgug

SEQ ID NO: 47199 - DNA, 21 bp, Artificial Sequence
  Synthetic
ctttccccucccctaccuaga

SEQ ID NO: 47200 - DNA, 26 bp, Artificial Sequence
  Synthetic
gatacccctuctactggttttuccat

SEQ ID NO: 47201 - DNA, 24 bp, Artificial Sequence
  Synthetic
agttauccagcagagcaucaaagg

SEQ ID NO: 47202 - DNA, 22 bp, Artificial Sequence
  Synthetic
gcgagtccuacctatgtuccca

SEQ ID NO: 47203 - DNA, 21 bp, Artificial Sequence
  Synthetic
gacccucctgcucagaagaac

SEQ ID NO: 47204 - DNA, 23 bp, Artificial Sequence
  Synthetic
caagccuaggaggttgttgatut

SEQ ID NO: 47205 - DNA, 28 bp, Artificial Sequence
  Synthetic
atctaguaggaagcaaguattttuggat

SEQ ID NO: 47206 - DNA, 24 bp, Artificial Sequence
  Synthetic
tgctgcctcutcctttggatatut

SEQ ID NO: 47207 - DNA, 29 bp, Artificial Sequence
  Synthetic
gccaagtactttucaggaacaaaagaaua

SEQ ID NO: 47208 - DNA, 25 bp, Artificial Sequence
  Synthetic
ggcactaugacagttgagaugaaag

SEQ ID NO: 47209 - DNA, 26 bp, Artificial Sequence
  Synthetic
gagaatgaacaugctgcaagcttuaa

SEQ ID NO: 47210 - DNA, 23 bp, Artificial Sequence
  Synthetic
gctagtugggagaatgctacugt

SEQ ID NO: 47211 - DNA, 29 bp, Artificial Sequence
  Synthetic
ccctttcttcacuatatgaaaactgucca

SEQ ID NO: 47212 - DNA, 30 bp, Artificial Sequence; identical to SEQ ID NO: 34978
  Synthetic

SEQ ID NO: 47213 - DNA, 27 bp, Artificial Sequence
  Synthetic
tgataccagtuttgttgtccaauacca

SEQ ID NO: 47214 - DNA, 27 bp, Artificial Sequence
  Synthetic
caaaaatatttcugaggctccagctuc

SEQ ID NO: 47215 - DNA, 22 bp, Artificial Sequence
  Synthetic
gttgcaagcugtccatctugat

SEQ ID NO: 47216 - DNA, 28 bp, Artificial Sequence
  Synthetic
ggaagaccuccagaaaagtgatactgua

SEQ ID NO: 47217 - DNA, 30 bp, Artificial Sequence; identical to SEQ ID NO: 34983
  Synthetic

SEQ ID NO: 47218 - DNA, 31 bp, Artificial Sequence; identical to SEQ ID NO: 34984
  Synthetic

SEQ ID NO: 47219 - DNA, 27 bp, Artificial Sequence
  Synthetic
gctacaattuaccacactcgtttcaut

SEQ ID NO: 47220 - DNA, 28 bp, Artificial Sequence
  Synthetic
ccggttugacaggagataatutatguaa

SEQ ID NO: 47221 - DNA, 31 bp, Artificial Sequence; identical to SEQ ID NO: 34987
  Synthetic

SEQ ID NO: 47222 - DNA, 23 bp, Artificial Sequence
  Synthetic
ctcttaccagucctgatgctuca

SEQ ID NO: 47223 - DNA, 27 bp, Artificial Sequence
  Synthetic
agcatcaactugacagaagctatucat

SEQ ID NO: 47224 - DNA, 22 bp, Artificial Sequence
  Synthetic
caagccactutggactcaguga

SEQ ID NO: 47225 - DNA, 26 bp, Artificial Sequence
  Synthetic
gccttattuacagtgcacatcucaca

SEQ ID NO: 47226 - DNA, 28 bp, Artificial Sequence
  Synthetic
gatactgtgtttuctgataaggcttgug

SEQ ID NO: 47227 - DNA, 30 bp, Artificial Sequence; identical to SEQ ID NO: 34993
  Synthetic

SEQ ID NO: 47228 - DNA, 31 bp, Artificial Sequence; identical to SEQ ID NO: 34994
  Synthetic

SEQ ID NO: 47229 - DNA, 27 bp, Artificial Sequence
  Synthetic
tttctttcacttgaugtcatgctgtug

SEQ ID NO: 47230 - DNA, 28 bp, Artificial Sequence
  Synthetic
caacaccaccauctttagatttttgcua

SEQ ID NO: 47231 - DNA, 26 bp, Artificial Sequence
  Synthetic
actggatgtttuatatggctgcucac

SEQ ID NO: 47232 - DNA, 22 bp, Artificial Sequence
  Synthetic
cgcaaatcucaggtttgtccut

SEQ ID NO: 47233 - DNA, 29 bp, Artificial Sequence
  Synthetic
gcactaacatcacacutatcttgtcttuc

SEQ ID NO: 47234 - DNA, 26 bp, Artificial Sequence
  Synthetic
tcacagacauagaggaaggagtacug

SEQ ID NO: 47235 - DNA, 23 bp, Artificial Sequence
  Synthetic
cagttccucgagttcugaagagg

SEQ ID NO: 47236 - DNA, 25 bp, Artificial Sequence
  Synthetic
tgaaacctgugccaaggaaagaaua

SEQ ID NO: 47237 - DNA, 29 bp, Artificial Sequence
  Synthetic
ccacaaagagcauacagtttauccaaaga

SEQ ID NO: 47238 - DNA, 30 bp, Artificial Sequence; identical to SEQ ID NO: 35004
  Synthetic

SEQ ID NO: 47239 - DNA, 26 bp, Artificial Sequence
  Synthetic
attaccutcttcctcuaaccccaaga

SEQ ID NO: 47240 - DNA, 28 bp, Artificial Sequence
  Synthetic
gggtaatguggattcaaauacacaagac

SEQ ID NO: 47241 - DNA, 26 bp, Artificial Sequence
  Synthetic
tttaaggagguctcaactuggcaaat

SEQ ID NO: 47242 - DNA, 28 bp, Artificial Sequence
  Synthetic
tcutgaaagcaguagagaacaagaagat

SEQ ID NO: 47243 - DNA, 26 bp, Artificial Sequence
  Synthetic
tgaaagucaaactggttauccaaggg

SEQ ID NO: 47244 - DNA, 22 bp, Artificial Sequence
  Synthetic
caccucagtgaagugaagcaca

SEQ ID NO: 47245 - DNA, 26 bp, Artificial Sequence
  Synthetic
gcatttgcugacccataggattuact

SEQ ID NO: 47246 - DNA, 27 bp, Artificial Sequence
  Synthetic
aaacaaagcugacacattttgaucact

SEQ ID NO: 47247 - DNA, 20 bp, Artificial Sequence
  Synthetic
cacaaaggautgcccaugcc

SEQ ID NO: 47248 - DNA, 22 bp, Artificial Sequence
  Synthetic
gcagcagaugggcagctataug

SEQ ID NO: 47249 - DNA, 20 bp, Artificial Sequence
  Synthetic
cgagugacgcaaggaaggug

SEQ ID NO: 47250 - DNA, 21 bp, Artificial Sequence
  Synthetic
gtuaggccgcaaaccctuaac

SEQ ID NO: 47251 - DNA, 23 bp, Artificial Sequence
  Synthetic
ccttgaccacugtttgaugggaa

SEQ ID NO: 47252 - DNA, 23 bp, Artificial Sequence
  Synthetic
catgtcacccaugaaagcaauga

SEQ ID NO: 47253 - DNA, 24 bp, Artificial Sequence
  Synthetic
gcctataaauggacgagactgcug

SEQ ID NO: 47254 - DNA, 22 bp, Artificial Sequence
  Synthetic
cgacugataccuggccaacaac

SEQ ID NO: 47255 - DNA, 21 bp, Artificial Sequence
  Synthetic
gtaggctcugtgtcccctuac

SEQ ID NO: 47256 - DNA, 23 bp, Artificial Sequence
  Synthetic
ccggatatgacucaggttagugg

SEQ ID NO: 47257 - DNA, 23 bp, Artificial Sequence
  Synthetic
ttttcttctugggacccauccag

SEQ ID NO: 47258 - DNA, 22 bp, Artificial Sequence
  Synthetic
cgaaagccccuaagatucccaa

SEQ ID NO: 47259 - DNA, 22 bp, Artificial Sequence
  Synthetic
cacccctcauttcataggcugt

SEQ ID NO: 47260 - DNA, 26 bp, Artificial Sequence
  Synthetic
gctcggccacauttttctttttaauc

SEQ ID NO: 47261 - DNA, 28 bp, Artificial Sequence
  Synthetic
ccataaatcccacagauctggtacuaac

SEQ ID NO: 47262 - DNA, 27 bp, Artificial Sequence
  Synthetic
tttcagtcctautttgtgctcataugg

SEQ ID NO: 47263 - DNA, 30 bp, Artificial Sequence; identical to SEQ ID NO: 35029
  Synthetic

SEQ ID NO: 47264 - DNA, 29 bp, Artificial Sequence
  Synthetic
tgtatgtggtcaaaugaatccaattcuga

SEQ ID NO: 47265 - DNA, 26 bp, Artificial Sequence
  Synthetic
gctcccuggacattagtttcucaaac

SEQ ID NO: 47266 - DNA, 25 bp, Artificial Sequence
  Synthetic
gacagcagtgugtcatatccauact

SEQ ID NO: 47267 - DNA, 21 bp, Artificial Sequence
  Synthetic
aggttcggaautcccttuccc

SEQ ID NO: 47268 - DNA, 26 bp, Artificial Sequence
  Synthetic
tcagagttgutcttatagggucgagt

SEQ ID NO: 47269 - DNA, 24 bp, Artificial Sequence
  Synthetic
tgcaatcaccaauatggtcacuga

SEQ ID NO: 47270 - DNA, 27 bp, Artificial Sequence
  Synthetic
acttgcaagcaaaucatgacactagua

SEQ ID NO: 47271 - DNA, 29 bp, Artificial Sequence
  Synthetic
cttctgaatgttugttagctcaactucaa

SEQ ID NO: 47272 - DNA, 26 bp, Artificial Sequence
  Synthetic
cagtattcacgutatgctgtccaauc

SEQ ID NO: 47273 - DNA, 24 bp, Artificial Sequence
  Synthetic
gtagtctuccagtatguccaagca

SEQ ID NO: 47274 - DNA, 25 bp, Artificial Sequence
  Synthetic
aaaaggagcaaguatgttgtcgcua

SEQ ID NO: 47275 - DNA, 27 bp, Artificial Sequence
  Synthetic
guacacaggaggaaaauaaacctauca

SEQ ID NO: 47276 - DNA, 24 bp, Artificial Sequence
  Synthetic
ataccaucacattggaaugagggt

SEQ ID NO: 47277 - DNA, 28 bp, Artificial Sequence
  Synthetic
tgtcgaacattuccctttcataggaaut

SEQ ID NO: 47278 - DNA, 28 bp, Artificial Sequence
  Synthetic
actctctttgagaaaaaugcagcattug

SEQ ID NO: 47279 - DNA, 27 bp, Artificial Sequence
  Synthetic
cttcacagaatutagacccttcaucct

SEQ ID NO: 47280 - DNA, 28 bp, Artificial Sequence
  Synthetic
ataaacaaaagcugctttacattcugct

SEQ ID NO: 47281 - DNA, 25 bp, Artificial Sequence
  Synthetic
gtgttcgaaugggacttcttacuca

SEQ ID NO: 47282 - DNA, 23 bp, Artificial Sequence
  Synthetic
gctcuacagtgcagugaaggaag

SEQ ID NO: 47283 - DNA, 28 bp, Artificial Sequence
  Synthetic
ccagttgggaautctaactactgtuaca

SEQ ID NO: 47284 - DNA, 23 bp, Artificial Sequence
  Synthetic
gccaactcacugagcaagatgua

SEQ ID NO: 47285 - DNA, 22 bp, Artificial Sequence
  Synthetic
caaacagcauggtggagaccua

SEQ ID NO: 47286 - DNA, 24 bp, Artificial Sequence
  Synthetic
gattctaggttugtcagctccugt

SEQ ID NO: 47287 - DNA, 25 bp, Artificial Sequence
  Synthetic
aaaagggaatuaagctctccagguc

SEQ ID NO: 47288 - DNA, 21 bp, Artificial Sequence
  Synthetic
ggagagagggcaugtgagcua

SEQ ID NO: 47289 - DNA, 30 bp, Artificial Sequence; identical to SEQ ID NO: 35055
  Synthetic

SEQ ID NO: 47290 - DNA, 25 bp, Artificial Sequence
  Synthetic
aaagtagcacugggcagattatuac

SEQ ID NO: 47291 - DNA, 31 bp, Artificial Sequence; identical to SEQ ID NO: 35057
  Synthetic

SEQ ID NO: 47292 - DNA, 30 bp, Artificial Sequence; identical to SEQ ID NO: 35058
  Synthetic

SEQ ID NO: 47293 - DNA, 22 bp, Artificial Sequence
  Synthetic
cagacgtguagtcagggtugaa

SEQ ID NO: 47294 - DNA, 27 bp, Artificial Sequence
  Synthetic
tcttttcctgaaguatgatgcaagcua

SEQ ID NO: 47295 - DNA, 31 bp, Artificial Sequence; identical to SEQ ID NO: 35061
  Synthetic

SEQ ID NO: 47296 - DNA, 27 bp, Artificial Sequence
  Synthetic
aaagtgtacaatguagaatgccctuga

SEQ ID NO: 47297 - DNA, 21 bp, Artificial Sequence
  Synthetic
gcagagctuaagcctctcucc

SEQ ID NO: 47298 - DNA, 26 bp, Artificial Sequence
  Synthetic
cctcaatgacccugagttatcctuct

SEQ ID NO: 47299 - DNA, 22 bp, Artificial Sequence
  Synthetic
gttttcaggcucctccacttug

SEQ ID NO: 47300 - DNA, 24 bp, Artificial Sequence
  Synthetic
gcagacacugggtccaaatctaut

SEQ ID NO: 47301 - DNA, 24 bp, Artificial Sequence
  Synthetic
agtactcgugaaaaagagcaggug

SEQ ID NO: 47302 - DNA, 26 bp, Artificial Sequence
  Synthetic
gagatgaaacccgagauggattcuac

SEQ ID NO: 47303 - DNA, 27 bp, Artificial Sequence
  Synthetic
tcaagcuagaaagatttcctcuaccct

SEQ ID NO: 47304 - DNA, 23 bp, Artificial Sequence
  Synthetic
aagcagtgtugaaaggcaaaugg

SEQ ID NO: 47305 - DNA, 25 bp, Artificial Sequence
  Synthetic
cucccttttaagcugcagaaacaag

SEQ ID NO: 47306 - DNA, 21 bp, Artificial Sequence
  Synthetic
ccagctucgagagtcucaggt

SEQ ID NO: 47307 - DNA, 27 bp, Artificial Sequence
  Synthetic
agttccatttgagucttaaaggcauca

SEQ ID NO: 47308 - DNA, 29 bp, Artificial Sequence
  Synthetic
atccattctaggauagcgttttctugaaa

SEQ ID NO: 47309 - DNA, 25 bp, Artificial Sequence
  Synthetic
agcctagtcccaucttcaagatuga

SEQ ID NO: 47310 - DNA, 26 bp, Artificial Sequence
  Synthetic
atgatctgacagutctctttggcaut

SEQ ID NO: 47311 - DNA, 31 bp, Artificial Sequence; identical to SEQ ID NO: 35077
  Synthetic

SEQ ID NO: 47312 - DNA, 29 bp, Artificial Sequence
  Synthetic
gggaagactgugtttttaatcatttguca

SEQ ID NO: 47313 - DNA, 28 bp, Artificial Sequence
  Synthetic
ggccaacagaaaauaagaaagacuaagg

SEQ ID NO: 47314 - DNA, 21 bp, Artificial Sequence
  Synthetic
atgttugaccgccttcucact

SEQ ID NO: 47315 - DNA, 22 bp, Artificial Sequence
  Synthetic
tctggagatuctgaaggcucgt

SEQ ID NO: 47316 - DNA, 19 bp, Artificial Sequence
  Synthetic
ttgggcgggcugttgaaua

SEQ ID NO: 47317 - DNA, 21 bp, Artificial Sequence
  Synthetic
gatccatucgcagagucagca

SEQ ID NO: 47318 - DNA, 23 bp, Artificial Sequence
  Synthetic
acccatccaugtttctaccucca

SEQ ID NO: 47319 - DNA, 22 bp, Artificial Sequence
  Synthetic
ctgcagtctuatccaggctcuc

SEQ ID NO: 47320 - DNA, 32 bp, Artificial Sequence; identical to SEQ ID NO: 35086
  Synthetic

SEQ ID NO: 47321 - DNA, 22 bp, Artificial Sequence
  Synthetic
gtggcacagaaguacacaguct

SEQ ID NO: 47322 - DNA, 21 bp, Artificial Sequence
  Synthetic
cctatggtgugaggcatggug

SEQ ID NO: 47323 - DNA, 28 bp, Artificial Sequence
  Synthetic
ttggcttugaatacatgaauagggaact

SEQ ID NO: 47324 - DNA, 28 bp, Artificial Sequence
  Synthetic
caaaagtccaaucacaaaatucacacac

SEQ ID NO: 47325 - DNA, 28 bp, Artificial Sequence
  Synthetic
agataucagccauccagtaaaaaucaaa

SEQ ID NO: 47326 - DNA, 20 bp, Artificial Sequence
  Synthetic
cgagcuaacagcccaggtut

SEQ ID NO: 47327 - DNA, 27 bp, Artificial Sequence
  Synthetic
ttttccuagagacctucagagaagaca

SEQ ID NO: 47328 - DNA, 28 bp, Artificial Sequence
  Synthetic
gacaatcctuccattgaagaaguaggaa

SEQ ID NO: 47329 - DNA, 27 bp, Artificial Sequence
  Synthetic
attattcacctugctccaaggatauct

SEQ ID NO: 47330 - DNA, 23 bp, Artificial Sequence
  Synthetic
ttgtgacaagaagucccacguag

SEQ ID NO: 47331 - DNA, 22 bp, Artificial Sequence
  Synthetic
ggtgttgcaacutgttccctug

SEQ ID NO: 47332 - DNA, 28 bp, Artificial Sequence
  Synthetic
tttgttgtattgaagutttggcaacuga

SEQ ID NO: 47333 - DNA, 28 bp, Artificial Sequence
  Synthetic
ggaagattttcauttggaaacctgtuct

SEQ ID NO: 47334 - DNA, 25 bp, Artificial Sequence
  Synthetic
gggtgcguagataataaacaaucca

SEQ ID NO: 47335 - DNA, 24 bp, Artificial Sequence
  Synthetic
gttctttcucttgcttgugcacag

SEQ ID NO: 47336 - DNA, 29 bp, Artificial Sequence
  Synthetic
ctctttagtacautcgtaaaggcuacagt

SEQ ID NO: 47337 - DNA, 23 bp, Artificial Sequence
  Synthetic
ctttgaccgugccttcttgttut

SEQ ID NO: 47338 - DNA, 24 bp, Artificial Sequence
  Synthetic
ccattuagaccaaaggtucccaag

SEQ ID NO: 47339 - DNA, 29 bp, Artificial Sequence
  Synthetic
atctctttaaggaugaattctgagccaut

SEQ ID NO: 47340 - DNA, 30 bp, Artificial Sequence; identical to SEQ ID NO: 35106
  Synthetic

SEQ ID NO: 47341 - DNA, 27 bp, Artificial Sequence
  Synthetic
tggcaggaagaaguatctcgtatcaua

SEQ ID NO: 47342 - DNA, 22 bp, Artificial Sequence
  Synthetic
ggcattcuagtccatgcugcaa

SEQ ID NO: 47343 - DNA, 30 bp, Artificial Sequence; identical to SEQ ID NO: 35109
  Synthetic

SEQ ID NO: 47344 - DNA, 21 bp, Artificial Sequence
  Synthetic
ccccagaauatggcaggugac

SEQ ID NO: 47345 - DNA, 24 bp, Artificial Sequence
  Synthetic
cauaaagctucagacccacgacat

SEQ ID NO: 47346 - DNA, 24 bp, Artificial Sequence
  Synthetic
aaacagcagutatcuggcaagagt

SEQ ID NO: 47347 - DNA, 25 bp, Artificial Sequence
  Synthetic
accttattttucttccagctugcct

SEQ ID NO: 47348 - DNA, 25 bp, Artificial Sequence
  Synthetic
ttcttgcatgauggatgtgaaacug

SEQ ID NO: 47349 - DNA, 29 bp, Artificial Sequence
  Synthetic
acattaaagaggaggutctgatcacaaug

SEQ ID NO: 47350 - DNA, 21 bp, Artificial Sequence
  Synthetic
tgggtgggucataaggtguga

SEQ ID NO: 47351 - DNA, 30 bp, Artificial Sequence; identical to SEQ ID NO: 35117
  Synthetic

SEQ ID NO: 47352 - DNA, 30 bp, Artificial Sequence; identical to SEQ ID NO: 35118
  Synthetic

SEQ ID NO: 47353 - DNA, 25 bp, Artificial Sequence
  Synthetic
cacttttcctguttctagcctguga

SEQ ID NO: 47354 - DNA, 24 bp, Artificial Sequence
  Synthetic
gctacttcauaaactaggccugca

SEQ ID NO: 47355 - DNA, 28 bp, Artificial Sequence
  Synthetic
tgccttgaagugagtaggaattuaacaa

SEQ ID NO: 47356 - DNA, 28 bp, Artificial Sequence
  Synthetic
actatctctcucatttttgcttgauggg

SEQ ID NO: 47357 - DNA, 23 bp, Artificial Sequence
  Synthetic
gcaaatgtugccaacagcttuct

SEQ ID NO: 47358 - DNA, 25 bp, Artificial Sequence
  Synthetic
gaccaaugaccatactgaugaagga

SEQ ID NO: 47359 - DNA, 29 bp, Artificial Sequence
  Synthetic
ctttgtttcccautgtgaatatgacucag

SEQ ID NO: 47360 - DNA, 32 bp, Artificial Sequence; identical to SEQ ID NO: 35126
  Synthetic

SEQ ID NO: 47361 - DNA, 25 bp, Artificial Sequence
  Synthetic
cctggcatccugccttatctttuaa

SEQ ID NO: 47362 - DNA, 28 bp, Artificial Sequence
  Synthetic
tccttaacctuacagagtttcatggtuc

SEQ ID NO: 47363 - DNA, 28 bp, Artificial Sequence
  Synthetic
agtttattcctgcugtgttcaggtuaaa

SEQ ID NO: 47364 - DNA, 23 bp, Artificial Sequence
  Synthetic
gttctcggcuagaaaguccaaca

SEQ ID NO: 47365 - DNA, 25 bp, Artificial Sequence
  Synthetic
gtgtacacaugtgcttcctuaaaca

SEQ ID NO: 47366 - DNA, 22 bp, Artificial Sequence
  Synthetic
tgcaucgttugagaacggaaca

SEQ ID NO: 47367 - DNA, 29 bp, Artificial Sequence
  Synthetic
gcgtggcattutaattactagaaagugat

SEQ ID NO: 47368 - DNA, 25 bp, Artificial Sequence
  Synthetic
ctcagtgaagautctgttgcagcua

SEQ ID NO: 47369 - DNA, 22 bp, Artificial Sequence
  Synthetic
ggagttugagcgggtgactuac

SEQ ID NO: 47370 - DNA, 22 bp, Artificial Sequence
  Synthetic
gcggcagaauttgagagatugt

SEQ ID NO: 47371 - DNA, 29 bp, Artificial Sequence
  Synthetic
gggtgacttgauggagtcattaatcttua

SEQ ID NO: 47372 - DNA, 18 bp, Artificial Sequence
  Synthetic
cctccctgugctctgcut

SEQ ID NO: 47373 - DNA, 20 bp, Artificial Sequence
  Synthetic
ctcccagucctccttuccag

SEQ ID NO: 47374 - DNA, 18 bp, Artificial Sequence
  Synthetic
caacgaguccacgtcguc

SEQ ID NO: 47375 - DNA, 19 bp, Artificial Sequence
  Synthetic
gcagtccucctcguccaca

SEQ ID NO: 47376 - DNA, 19 bp, Artificial Sequence
  Synthetic
acgagagugagcgggacua

SEQ ID NO: 47377 - DNA, 19 bp, Artificial Sequence
  Synthetic
ggccagguggacagaagug

SEQ ID NO: 47378 - DNA, 23 bp, Artificial Sequence
  Synthetic
cctcatccuccattcccatucac

SEQ ID NO: 47379 - DNA, 25 bp, Artificial Sequence
  Synthetic
gaaaggacacuagctcctagaucct

SEQ ID NO: 47380 - DNA, 23 bp, Artificial Sequence
  Synthetic
catttguggagcacttgauccct

SEQ ID NO: 47381 - DNA, 22 bp, Artificial Sequence
  Synthetic
ggtagaugagctccucagcaga

SEQ ID NO: 47382 - DNA, 21 bp, Artificial Sequence
  Synthetic
tggaagcuaagggtccgtcut

SEQ ID NO: 47383 - DNA, 18 bp, Artificial Sequence
  Synthetic
ggagcugttcccgugcag

SEQ ID NO: 47384 - DNA, 21 bp, Artificial Sequence
  Synthetic
ggtgggacugtgctttcugac

SEQ ID NO: 47385 - DNA, 26 bp, Artificial Sequence
  Synthetic
cacagtgagaaugaaattagggcuct

SEQ ID NO: 47386 - DNA, 20 bp, Artificial Sequence
  Synthetic
cagtgcugtgacuggacact

SEQ ID NO: 47387 - DNA, 22 bp, Artificial Sequence
  Synthetic
tggatcuaagccacaugacgac

SEQ ID NO: 47388 - DNA, 23 bp, Artificial Sequence
  Synthetic
cugatatgtggugaagccagact

SEQ ID NO: 47389 - DNA, 17 bp, Artificial Sequence
  Synthetic
agugctgggugcagacg

SEQ ID NO: 47390 - DNA, 19 bp, Artificial Sequence
  Synthetic
ccacccgcuttctgtcuct

SEQ ID NO: 47391 - DNA, 17 bp, Artificial Sequence
  Synthetic
ccugccccauccagagg

SEQ ID NO: 47392 - DNA, 23 bp, Artificial Sequence
  Synthetic
catctgctcuccctagacagcua

SEQ ID NO: 47393 - DNA, 22 bp, Artificial Sequence
  Synthetic
ggtcctggcugttgtaagacuc

SEQ ID NO: 47394 - DNA, 19 bp, Artificial Sequence
  Synthetic
tgtggacccccutgacuga

SEQ ID NO: 47395 - DNA, 19 bp, Artificial Sequence
  Synthetic
gacagugagcggcacugat

SEQ ID NO: 47396 - DNA, 23 bp, Artificial Sequence
  Synthetic
ccttaacuaacacgggctctcut

SEQ ID NO: 47397 - DNA, 20 bp, Artificial Sequence
  Synthetic
cctcagcuagccctccucat

SEQ ID NO: 47398 - DNA, 21 bp, Artificial Sequence
  Synthetic
ctacatcgcaguctcctucgt

SEQ ID NO: 47399 - DNA, 19 bp, Artificial Sequence
  Synthetic
agccccagccauaaaggug

SEQ ID NO: 47400 - DNA, 24 bp, Artificial Sequence
  Synthetic
ctctcgaugcaactctatcgucac

SEQ ID NO: 47401 - DNA, 28 bp, Artificial Sequence
  Synthetic
ccgcaaatcccacuagctaaatatcuaa

SEQ ID NO: 47402 - DNA, 22 bp, Artificial Sequence
  Synthetic
cactgaauagggctttggccut

SEQ ID NO: 47403 - DNA, 21 bp, Artificial Sequence
  Synthetic
caattggtggugtggccaauc

SEQ ID NO: 47404 - DNA, 23 bp, Artificial Sequence
  Synthetic
gttcctccucagcctctttctut

SEQ ID NO: 47405 - DNA, 22 bp, Artificial Sequence
  Synthetic
gccttccaguttggacctccua

SEQ ID NO: 47406 - DNA, 20 bp, Artificial Sequence
  Synthetic
cctgcuccaccgaggtctua

SEQ ID NO: 47407 - DNA, 22 bp, Artificial Sequence
  Synthetic
cautccccaaacugccaaacag

SEQ ID NO: 47408 - DNA, 22 bp, Artificial Sequence
  Synthetic
tctttagccaguggcttggtut

SEQ ID NO: 47409 - DNA, 25 bp, Artificial Sequence
  Synthetic
cagataccagaaucagaggacucac

SEQ ID NO: 47410 - DNA, 22 bp, Artificial Sequence
  Synthetic
cctcttgcucctctgcttaguc

SEQ ID NO: 47411 - DNA, 23 bp, Artificial Sequence
  Synthetic
gaatgcctccucctcatttcuca

SEQ ID NO: 47412 - DNA, 24 bp, Artificial Sequence
  Synthetic
ggacatgcutctcttaactuccct

SEQ ID NO: 47413 - DNA, 27 bp, Artificial Sequence
  Synthetic
aggaaagtccugatttctttagctugg

SEQ ID NO: 47414 - DNA, 23 bp, Artificial Sequence
  Synthetic
ccagtgcttcuccctcaactaug

SEQ ID NO: 47415 - DNA, 23 bp, Artificial Sequence
  Synthetic
ccttgaggugaggaactttgcut

SEQ ID NO: 47416 - DNA, 20 bp, Artificial Sequence
  Synthetic
cccttcagauggccctggua

SEQ ID NO: 47417 - DNA, 21 bp, Artificial Sequence
  Synthetic
ccaggucagacgctcauagac

SEQ ID NO: 47418 - DNA, 20 bp, Artificial Sequence
  Synthetic
agtggcaucttgcuccacac

SEQ ID NO: 47419 - DNA, 20 bp, Artificial Sequence
  Synthetic
acccuggagccctaacctut

SEQ ID NO: 47420 - DNA, 18 bp, Artificial Sequence
  Synthetic
ccugcagcccagcagaua

SEQ ID NO: 47421 - DNA, 20 bp, Artificial Sequence
  Synthetic
ggtaugagccagctctucca

SEQ ID NO: 47422 - DNA, 18 bp, Artificial Sequence
  Synthetic
cttctuccgccagucggt

SEQ ID NO: 47423 - DNA, 18 bp, Artificial Sequence
  Synthetic
gtcctccgcucggctuag

SEQ ID NO: 47424 - DNA, 22 bp, Artificial Sequence
  Synthetic
atgaagccaccaugcctacaut

SEQ ID NO: 47425 - DNA, 22 bp, Artificial Sequence
  Synthetic
ggcccacuaagatgggcattut

SEQ ID NO: 47426 - DNA, 23 bp, Artificial Sequence
  Synthetic
tgatgctggccucatatgttugt

SEQ ID NO: 47427 - DNA, 27 bp, Artificial Sequence
  Synthetic
acutacttcttcauaacgaggaacagc

SEQ ID NO: 47428 - DNA, 21 bp, Artificial Sequence
  Synthetic
gtcgaugtgtgguagccagag

SEQ ID NO: 47429 - DNA, 20 bp, Artificial Sequence
  Synthetic
gatggugcagcaggttccua

SEQ ID NO: 47430 - DNA, 24 bp, Artificial Sequence
  Synthetic
gagttcagatuagcccatggauca

SEQ ID NO: 47431 - DNA, 22 bp, Artificial Sequence
  Synthetic
gccguagaagggatugacaagc

SEQ ID NO: 47432 - DNA, 23 bp, Artificial Sequence
  Synthetic
ctcacuaacaaagcaggcttugg

SEQ ID NO: 47433 - DNA, 26 bp, Artificial Sequence
  Synthetic
gccaaccaucttgtctaactucagat

SEQ ID NO: 47434 - DNA, 20 bp, Artificial Sequence
  Synthetic
ctcctccuctgctcauggag

SEQ ID NO: 47435 - DNA, 22 bp, Artificial Sequence
  Synthetic
aggactgcagacugaactcuca

SEQ ID NO: 47436 - DNA, 22 bp, Artificial Sequence
  Synthetic
acgtctggagauaggaggcuat

SEQ ID NO: 47437 - DNA, 22 bp, Artificial Sequence
  Synthetic
ctagctaggugtcctgtuccac

SEQ ID NO: 47438 - DNA, 21 bp, Artificial Sequence
  Synthetic
ccatctccugaccctcctcuc

SEQ ID NO: 47439 - DNA, 17 bp, Artificial Sequence
  Synthetic
actgcucccccgacuca

SEQ ID NO: 47440 - DNA, 20 bp, Artificial Sequence
  Synthetic
cctugagccagggctguaag

SEQ ID NO: 47441 - DNA, 17 bp, Artificial Sequence
  Synthetic
cuccugcccaccagagg

SEQ ID NO: 47442 - DNA, 19 bp, Artificial Sequence
  Synthetic
ggtcaguccttccgacuct

SEQ ID NO: 47443 - DNA, 18 bp, Artificial Sequence
  Synthetic
gctccgagccaugcaucc

SEQ ID NO: 47444 - DNA, 21 bp, Artificial Sequence
  Synthetic
gcagatcttccucccctccuc

SEQ ID NO: 47445 - DNA, 23 bp, Artificial Sequence
  Synthetic
accaaatgugaagacgugggaat

SEQ ID NO: 47446 - DNA, 18 bp, Artificial Sequence
  Synthetic
cccagcaugaccccugaa

SEQ ID NO: 47447 - DNA, 19 bp, Artificial Sequence
  Synthetic
tgggtccuggaggtcucac

SEQ ID NO: 47448 - DNA, 20 bp, Artificial Sequence
  Synthetic
gcguccacgagcagaacuac

SEQ ID NO: 47449 - DNA, 21 bp, Artificial Sequence
  Synthetic
tgtgggaagutggcatctguc

SEQ ID NO: 47450 - DNA, 22 bp, Artificial Sequence
  Synthetic
ccctcagcugtgagtgtatuga

SEQ ID NO: 47451 - DNA, 24 bp, Artificial Sequence
  Synthetic
accctgtatguccttgtgacuact

SEQ ID NO: 47452 - DNA, 24 bp, Artificial Sequence
  Synthetic
gagggagutgaagaugacaaggaa

SEQ ID NO: 47453 - DNA, 30 bp, Artificial Sequence; identical to SEQ ID NO: 35219
  Synthetic

SEQ ID NO: 47454 - DNA, 31 bp, Artificial Sequence; identical to SEQ ID NO: 35220
  Synthetic

SEQ ID NO: 47455 - DNA, 25 bp, Artificial Sequence
  Synthetic
auccttucacagaauacacaacaga

SEQ ID NO: 47456 - DNA, 20 bp, Artificial Sequence
  Synthetic
gtatacguggtggcugcaga

SEQ ID NO: 47457 - DNA, 19 bp, Artificial Sequence
  Synthetic
cgugcaggaugaccagcag

SEQ ID NO: 47458 - DNA, 24 bp, Artificial Sequence
  Synthetic
agcctcatctucaagctcatcaut

SEQ ID NO: 47459 - DNA, 21 bp, Artificial Sequence
  Synthetic
tgagguagcagagcucacaga

SEQ ID NO: 47460 - DNA, 23 bp, Artificial Sequence
  Synthetic
auccagacccaggcaauaacaag

SEQ ID NO: 47461 - DNA, 27 bp, Artificial Sequence
  Synthetic
gccaaaacgaaagutgcataactuagt

SEQ ID NO: 47462 - DNA, 25 bp, Artificial Sequence
  Synthetic
aggacauagacttugaaacaagcga

SEQ ID NO: 47463 - DNA, 22 bp, Artificial Sequence
  Synthetic
catcacttttugtgtggccucc

SEQ ID NO: 47464 - DNA, 22 bp, Artificial Sequence
  Synthetic
gtctggagggcugagaaugaac

SEQ ID NO: 47465 - DNA, 22 bp, Artificial Sequence
  Synthetic
gatgttctaucagcgcauccac

SEQ ID NO: 47466 - DNA, 24 bp, Artificial Sequence
  Synthetic
ccatatgguaacagaagauggcaa

SEQ ID NO: 47467 - DNA, 24 bp, Artificial Sequence
  Synthetic
cccacatcauaccattcctuggat

SEQ ID NO: 47468 - DNA, 21 bp, Artificial Sequence
  Synthetic
guaaaggaaagggcuccagca

SEQ ID NO: 47469 - DNA, 26 bp, Artificial Sequence
  Synthetic
gctgtgtgtcauatctgagcttctut

SEQ ID NO: 47470 - DNA, 23 bp, Artificial Sequence
  Synthetic
ccaggacaguttggguaaacagt

SEQ ID NO: 47471 - DNA, 28 bp, Artificial Sequence
  Synthetic
cctgtagcttgaucacctcattctttut

SEQ ID NO: 47472 - DNA, 25 bp, Artificial Sequence
  Synthetic
ggctgatgucttgtgcaaatauagt

SEQ ID NO: 47473 - DNA, 26 bp, Artificial Sequence
  Synthetic
tcggagcuaaaactcccttttatucc

SEQ ID NO: 47474 - DNA, 25 bp, Artificial Sequence
  Synthetic
agaatcccauagcattgtagcctug

SEQ ID NO: 47475 - DNA, 26 bp, Artificial Sequence
  Synthetic
agaagatgucagtggttgtttucagt

SEQ ID NO: 47476 - DNA, 21 bp, Artificial Sequence
  Synthetic
cctcuacacccgcatttugca

SEQ ID NO: 47477 - DNA, 22 bp, Artificial Sequence
  Synthetic
ggucatgugacacagcgaagat

SEQ ID NO: 47478 - DNA, 17 bp, Artificial Sequence
  Synthetic
gtccgagccaugcguct

SEQ ID NO: 47479 - DNA, 17 bp, Artificial Sequence
  Synthetic
ccctgutcgctcugcac

SEQ ID NO: 47480 - DNA, 23 bp, Artificial Sequence
  Synthetic
taatgttctccuctcttggcuct

SEQ ID NO: 47481 - DNA, 19 bp, Artificial Sequence
  Synthetic
ccggacucccagcactuac

SEQ ID NO: 47482 - DNA, 20 bp, Artificial Sequence
  Synthetic
gagtacatcguccgggtcug

SEQ ID NO: 47483 - DNA, 21 bp, Artificial Sequence
  Synthetic
tcagagtcgggautgggagua

SEQ ID NO: 47484 - DNA, 18 bp, Artificial Sequence
  Synthetic
gcagatccugcgcauggt

SEQ ID NO: 47485 - DNA, 19 bp, Artificial Sequence
  Synthetic
agacagccccuctgaccuc

SEQ ID NO: 47486 - DNA, 20 bp, Artificial Sequence
  Synthetic
gtgaccagucctgcctguaa

SEQ ID NO: 47487 - DNA, 20 bp, Artificial Sequence
  Synthetic
tccccaggcaaaugtgugac

SEQ ID NO: 47488 - DNA, 19 bp, Artificial Sequence
  Synthetic
gggacugagaggccucact

SEQ ID NO: 47489 - DNA, 22 bp, Artificial Sequence
  Synthetic
cacttgtccucaaagggcatug

SEQ ID NO: 47490 - DNA, 21 bp, Artificial Sequence
  Synthetic
tcttgttugagcacgugcaac

SEQ ID NO: 47491 - DNA, 25 bp, Artificial Sequence
  Synthetic
gtcugagagaggaugaagacagaga

SEQ ID NO: 47492 - DNA, 21 bp, Artificial Sequence
  Synthetic
gcatcuggcaccuccaacaat

SEQ ID NO: 47493 - DNA, 18 bp, Artificial Sequence
  Synthetic
gccctcgaucggacucag

SEQ ID NO: 47494 - DNA, 23 bp, Artificial Sequence
  Synthetic
gggauagcaaagagauggagagg

SEQ ID NO: 47495 - DNA, 22 bp, Artificial Sequence
  Synthetic
gcctgctgaguactgctcaaug

SEQ ID NO: 47496 - DNA, 23 bp, Artificial Sequence
  Synthetic
cctctgatggutcccttacccut

SEQ ID NO: 47497 - DNA, 21 bp, Artificial Sequence
  Synthetic
gcttcttgguatggccagcuc

SEQ ID NO: 47498 - DNA, 19 bp, Artificial Sequence
  Synthetic
gcttctautcgcgcugcct

SEQ ID NO: 47499 - DNA, 21 bp, Artificial Sequence
  Synthetic
gcctcugagaagtcccucagt

SEQ ID NO: 47500 - DNA, 24 bp, Artificial Sequence
  Synthetic
tgtcuccaaggaggaaaugaacua

SEQ ID NO: 47501 - DNA, 22 bp, Artificial Sequence
  Synthetic
gtgtcctcgaucttctgctuca

SEQ ID NO: 47502 - DNA, 21 bp, Artificial Sequence
  Synthetic
aggcctgaaggutaaggtgug

SEQ ID NO: 47503 - DNA, 20 bp, Artificial Sequence
  Synthetic
tcagtcagcautcggaggug

SEQ ID NO: 47504 - DNA, 22 bp, Artificial Sequence
  Synthetic
cataacucccctcatgcugaca

SEQ ID NO: 47505 - DNA, 27 bp, Artificial Sequence
  Synthetic
agcctctattuacattttccctcucac

SEQ ID NO: 47506 - DNA, 23 bp, Artificial Sequence
  Synthetic
acccagaaaaccucatgactgug

SEQ ID NO: 47507 - DNA, 20 bp, Artificial Sequence
  Synthetic
cccaauagggccaatcgtug

SEQ ID NO: 47508 - DNA, 17 bp, Artificial Sequence
  Synthetic
gcatccccuggccctug

SEQ ID NO: 47509 - DNA, 24 bp, Artificial Sequence
  Synthetic
aaactcattugaaggcagauggga

SEQ ID NO: 47510 - DNA, 24 bp, Artificial Sequence
  Synthetic
ttgaacaguccatgaaaggugaca

SEQ ID NO: 47511 - DNA, 31 bp, Artificial Sequence; identical to SEQ ID NO: 35277
  Synthetic

SEQ ID NO: 47512 - DNA, 28 bp, Artificial Sequence
  Synthetic
tgtgagaaagaaaaaucaaucaagcaat

SEQ ID NO: 47513 - DNA, 27 bp, Artificial Sequence
  Synthetic
ttcctaagcatgugctctatttcguag

SEQ ID NO: 47514 - DNA, 25 bp, Artificial Sequence
  Synthetic
ggaggacaatucctgagagagauga

SEQ ID NO: 47515 - DNA, 30 bp, Artificial Sequence; identical to SEQ ID NO: 35281
  Synthetic

SEQ ID NO: 47516 - DNA, 28 bp, Artificial Sequence
  Synthetic
caatcagaaacccautgtcttcauaggt

SEQ ID NO: 47517 - DNA, 30 bp, Artificial Sequence; identical to SEQ ID NO: 35283
  Synthetic

SEQ ID NO: 47518 - DNA, 27 bp, Artificial Sequence
  Synthetic
gtgatcaggatuggtatcaaagguagg

SEQ ID NO: 47519 - DNA, 27 bp, Artificial Sequence
  Synthetic
ctcttccaaagccutttaaaaccacut

SEQ ID NO: 47520 - DNA, 30 bp, Artificial Sequence; identical to SEQ ID NO: 35286
  Synthetic

SEQ ID NO: 47521 - DNA, 28 bp, Artificial Sequence
  Synthetic
catggcttgaaaautactggacugaaaa

SEQ ID NO: 47522 - DNA, 21 bp, Artificial Sequence
  Synthetic
ccaagcuaggccctacttuga

SEQ ID NO: 47523 - DNA, 24 bp, Artificial Sequence
  Synthetic
aatgttctgtcuccccttcaucac

SEQ ID NO: 47524 - DNA, 25 bp, Artificial Sequence
  Synthetic
caggtcattaaucaatgccttcuct

SEQ ID NO: 47525 - DNA, 28 bp, Artificial Sequence
  Synthetic
ccaaagccataacuccttttaagggaut

SEQ ID NO: 47526 - DNA, 24 bp, Artificial Sequence
  Synthetic
cagatcugcttgaaaugagagcaa

SEQ ID NO: 47527 - DNA, 23 bp, Artificial Sequence
  Synthetic
gcagcgaatucagaaagagguct

SEQ ID NO: 47528 - DNA, 21 bp, Artificial Sequence
  Synthetic
gggctctcugtaggaggcaua

SEQ ID NO: 47529 - DNA, 26 bp, Artificial Sequence
  Synthetic
cctaatctcgcucttctcttaccuct

SEQ ID NO: 47530 - DNA, 21 bp, Artificial Sequence
  Synthetic
ggaggaggagaccuggaacug

SEQ ID NO: 47531 - DNA, 23 bp, Artificial Sequence
  Synthetic
ctuaggcccaaccacuaacagag

SEQ ID NO: 47532 - DNA, 20 bp, Artificial Sequence
  Synthetic
ccagcccugggaatctctug

SEQ ID NO: 47533 - DNA, 21 bp, Artificial Sequence
  Synthetic
ctgtcagcucatccuccacag

SEQ ID NO: 47534 - DNA, 24 bp, Artificial Sequence
  Synthetic
gtggccauaacaaaacautttuca

SEQ ID NO: 47535 - DNA, 28 bp, Artificial Sequence
  Synthetic
tccactcctugaaggatactcagtaaut

SEQ ID NO: 47536 - DNA, 27 bp, Artificial Sequence
  Synthetic
gtgacttgcatuatggcattatgtucc

SEQ ID NO: 47537 - DNA, 23 bp, Artificial Sequence
  Synthetic
tctcagttcucagtccggttuct

SEQ ID NO: 47538 - DNA, 24 bp, Artificial Sequence
  Synthetic
tgggtataagguccagttcuggat

SEQ ID NO: 47539 - DNA, 26 bp, Artificial Sequence
  Synthetic
tgaagtggacucaattcctgttgaug

SEQ ID NO: 47540 - DNA, 22 bp, Artificial Sequence
  Synthetic
ggaggaagaaaguggcacucat

SEQ ID NO: 47541 - DNA, 29 bp, Artificial Sequence
  Synthetic
gcagtgctattaccutcatcttggaatua

SEQ ID NO: 47542 - DNA, 22 bp, Artificial Sequence
  Synthetic
cccaggutttctgucaggagat

SEQ ID NO: 47543 - DNA, 22 bp, Artificial Sequence
  Synthetic
tgctctccucttctcttuccga

SEQ ID NO: 47544 - DNA, 21 bp, Artificial Sequence
  Synthetic
gggctcacuccactgauaaac

SEQ ID NO: 47545 - DNA, 23 bp, Artificial Sequence
  Synthetic
tccttctgcucttccctctucat

SEQ ID NO: 47546 - DNA, 21 bp, Artificial Sequence
  Synthetic
gctgtgguggcttacactgua

SEQ ID NO: 47547 - DNA, 21 bp, Artificial Sequence
  Synthetic
ctcagaugtcctcuccaccct

SEQ ID NO: 47548 - DNA, 29 bp, Artificial Sequence
  Synthetic
ggtcaagtacctuaatgttgtcttcagut

SEQ ID NO: 47549 - DNA, 26 bp, Artificial Sequence
  Synthetic
gggtatguaaacagactggagattug

SEQ ID NO: 47550 - DNA, 22 bp, Artificial Sequence
  Synthetic
gtgtcttgugacttccugagca

SEQ ID NO: 47551 - DNA, 28 bp, Artificial Sequence
  Synthetic
tgctgtacttguggtattcattgcatua

SEQ ID NO: 47552 - DNA, 27 bp, Artificial Sequence
  Synthetic
ctgccagttugaaatgttagtttguga

SEQ ID NO: 47553 - DNA, 23 bp, Artificial Sequence
  Synthetic
tgtuccagaagcagaaauggaca

SEQ ID NO: 47554 - DNA, 20 bp, Artificial Sequence
  Synthetic
caacgccugccatctugaac

SEQ ID NO: 47555 - DNA, 25 bp, Artificial Sequence
  Synthetic
ccagtcacatguctcactctgtcua

SEQ ID NO: 47556 - DNA, 23 bp, Artificial Sequence
  Synthetic
cagcuaaacaccgaccgacaaua

SEQ ID NO: 47557 - DNA, 21 bp, Artificial Sequence
  Synthetic
ccaggacuccaatgtctgcuc

SEQ ID NO: 47558 - DNA, 21 bp, Artificial Sequence
  Synthetic
ccagccccutagacttucgag

SEQ ID NO: 47559 - DNA, 27 bp, Artificial Sequence
  Synthetic
caacaaaacagagcutgggttagatut

SEQ ID NO: 47560 - DNA, 28 bp, Artificial Sequence
  Synthetic
gcatatgctctgugcttgaagttctuat

SEQ ID NO: 47561 - DNA, 23 bp, Artificial Sequence
  Synthetic
acagagcuggcatcagtctttut

SEQ ID NO: 47562 - DNA, 24 bp, Artificial Sequence
  Synthetic
aaatcttcugcaaatggucccaga

SEQ ID NO: 47563 - DNA, 21 bp, Artificial Sequence
  Synthetic
ctttggcacaggcutgtacut

SEQ ID NO: 47564 - DNA, 21 bp, Artificial Sequence
  Synthetic
gagacugagcagcagctgtua

SEQ ID NO: 47565 - DNA, 24 bp, Artificial Sequence
  Synthetic
cttaactctcccguccttcttgug

SEQ ID NO: 47566 - DNA, 21 bp, Artificial Sequence
  Synthetic
tgggctcuagagaagtgugct

SEQ ID NO: 47567 - DNA, 19 bp, Artificial Sequence
  Synthetic
cactgacgccugtgttcug

SEQ ID NO: 47568 - DNA, 20 bp, Artificial Sequence
  Synthetic
caggaaugcggtgatcuggt

SEQ ID NO: 47569 - DNA, 27 bp, Artificial Sequence
  Synthetic
gggccatgtaautaggcattatgttua

SEQ ID NO: 47570 - DNA, 21 bp, Artificial Sequence
  Synthetic
cguttacauagagggccacct

SEQ ID NO: 47571 - DNA, 25 bp, Artificial Sequence
  Synthetic
gtaaggtaggauagggagactccut

SEQ ID NO: 47572 - DNA, 23 bp, Artificial Sequence
  Synthetic
ctgatcaagguaccaagcgagua

SEQ ID NO: 47573 - DNA, 22 bp, Artificial Sequence
  Synthetic
gctctttttcugtgccctcucc

SEQ ID NO: 47574 - DNA, 21 bp, Artificial Sequence
  Synthetic
cagaaagcacagcaugauggt

SEQ ID NO: 47575 - DNA, 22 bp, Artificial Sequence
  Synthetic
gcacatggagugtgcguagaaa

SEQ ID NO: 47576 - DNA, 22 bp, Artificial Sequence
  Synthetic
gauggagaagctguccaggaac

SEQ ID NO: 47577 - DNA, 27 bp, Artificial Sequence
  Synthetic
gcactctactatuctgcttctctccut

SEQ ID NO: 47578 - DNA, 27 bp, Artificial Sequence
  Synthetic
tgatttatgaguccagtctcaauccct

SEQ ID NO: 47579 - DNA, 21 bp, Artificial Sequence
  Synthetic
ccggaguggtattcccugaca

SEQ ID NO: 47580 - DNA, 25 bp, Artificial Sequence
  Synthetic
gggatgtagggautcttgtttctuc

SEQ ID NO: 47581 - DNA, 25 bp, Artificial Sequence
  Synthetic
caacttcgacuggagggacatatut

SEQ ID NO: 47582 - DNA, 23 bp, Artificial Sequence
  Synthetic
gggcctgcutgttgtatttugat

SEQ ID NO: 47583 - DNA, 25 bp, Artificial Sequence
  Synthetic
guacttcttugacaacagcacacag

SEQ ID NO: 47584 - DNA, 20 bp, Artificial Sequence
  Synthetic
gggagguccaggguacacaa

SEQ ID NO: 47585 - DNA, 26 bp, Artificial Sequence
  Synthetic
tctgtaaaatcugtcccttgtcucct

SEQ ID NO: 47586 - DNA, 27 bp, Artificial Sequence
  Synthetic
caatcccuagaaaggccutatagtuat

SEQ ID NO: 47587 - DNA, 22 bp, Artificial Sequence
  Synthetic
ctgaagacttugccttgcccua

SEQ ID NO: 47588 - DNA, 28 bp, Artificial Sequence
  Synthetic
cctcttgaatucttggtgacataucaga

SEQ ID NO: 47589 - DNA, 30 bp, Artificial Sequence; identical to SEQ ID NO: 35355
  Synthetic

SEQ ID NO: 47590 - DNA, 23 bp, Artificial Sequence
  Synthetic
agagcttgaagaaguccacgtug

SEQ ID NO: 47591 - DNA, 21 bp, Artificial Sequence
  Synthetic
ccacagggcaguttctagugt

SEQ ID NO: 47592 - DNA, 21 bp, Artificial Sequence
  Synthetic
ccttcctgccuccgctaguat

SEQ ID NO: 47593 - DNA, 22 bp, Artificial Sequence
  Synthetic
gacagagcuacacatcttgucc

SEQ ID NO: 47594 - DNA, 22 bp, Artificial Sequence
  Synthetic
tgcatgguagggatcucaacac

SEQ ID NO: 47595 - DNA, 27 bp, Artificial Sequence
  Synthetic
ccgtcttgtccucattttctgtttuaa

SEQ ID NO: 47596 - DNA, 22 bp, Artificial Sequence
  Synthetic
ccccacactuccaacctgttua

SEQ ID NO: 47597 - DNA, 22 bp, Artificial Sequence
  Synthetic
gggcttcgugagacagauacag

SEQ ID NO: 47598 - DNA, 29 bp, Artificial Sequence
  Synthetic
tgtaattaugccaagaaaucatatgcuca

SEQ ID NO: 47599 - DNA, 29 bp, Artificial Sequence
  Synthetic
tgcaagagagcutataatttggattgugt

SEQ ID NO: 47600 - DNA, 21 bp, Artificial Sequence
  Synthetic
cgtaactcutggccagtucgt

SEQ ID NO: 47601 - DNA, 29 bp, Artificial Sequence
  Synthetic
ctgtacccagccuaatcttgtttttctua

SEQ ID NO: 47602 - DNA, 22 bp, Artificial Sequence
  Synthetic
ccttcgccugtcctcatgtaut

SEQ ID NO: 47603 - DNA, 32 bp, Artificial Sequence; identical to SEQ ID NO: 35369
  Synthetic

SEQ ID NO: 47604 - DNA, 31 bp, Artificial Sequence; identical to SEQ ID NO: 35370
  Synthetic

SEQ ID NO: 47605 - DNA, 27 bp, Artificial Sequence
  Synthetic
cttcactgtctuctctatccatggtut

SEQ ID NO: 47606 - DNA, 26 bp, Artificial Sequence
  Synthetic
gactgtguactcttaccttuccaacc

SEQ ID NO: 47607 - DNA, 28 bp, Artificial Sequence
  Synthetic
gtcctgagcucattagacagtaaatugt

SEQ ID NO: 47608 - DNA, 25 bp, Artificial Sequence
  Synthetic
tgaaugggagaaguaagaaggagaa

SEQ ID NO: 47609 - DNA, 27 bp, Artificial Sequence
  Synthetic
tgtgccaaagautattctgtucagagt

SEQ ID NO: 47610 - DNA, 23 bp, Artificial Sequence
  Synthetic
ggctgccacuttcatgaatgaug

SEQ ID NO: 47611 - DNA, 28 bp, Artificial Sequence
  Synthetic
aggtatttatugcttctcaaactucaga

SEQ ID NO: 47612 - DNA, 23 bp, Artificial Sequence
  Synthetic
gcaugcctactcugaaagccaat

SEQ ID NO: 47613 - DNA, 23 bp, Artificial Sequence
  Synthetic
ctaagccagauacctttguccgt

SEQ ID NO: 47614 - DNA, 28 bp, Artificial Sequence
  Synthetic
cctaagaaggagcuaaaggaaggagaua

SEQ ID NO: 47615 - DNA, 30 bp, Artificial Sequence; identical to SEQ ID NO: 35381
  Synthetic

SEQ ID NO: 47616 - DNA, 29 bp, Artificial Sequence
  Synthetic
ctttggtatacuaatatctctgccugaca

SEQ ID NO: 47617 - DNA, 22 bp, Artificial Sequence
  Synthetic
ccactgagaaaugcaccttugg

SEQ ID NO: 47618 - DNA, 21 bp, Artificial Sequence
  Synthetic
ccagcuggagaagtgactuca

SEQ ID NO: 47619 - DNA, 21 bp, Artificial Sequence
  Synthetic
gaggttuccacccaaucccat

SEQ ID NO: 47620 - DNA, 22 bp, Artificial Sequence
  Synthetic
aggcagcugctgatgcuaaaat

SEQ ID NO: 47621 - DNA, 25 bp, Artificial Sequence
  Synthetic
tctccctcaaguttttcagacucac

SEQ ID NO: 47622 - DNA, 33 bp, Artificial Sequence; identical to SEQ ID NO: 35388
  Synthetic

SEQ ID NO: 47623 - DNA, 28 bp, Artificial Sequence
  Synthetic
caggagttggcuaaagttttacaatgut

SEQ ID NO: 47624 - DNA, 22 bp, Artificial Sequence
  Synthetic
ctacagagaacauggctcguga

SEQ ID NO: 47625 - DNA, 19 bp, Artificial Sequence
  Synthetic
aggcaagggcutgcaguag

SEQ ID NO: 47626 - DNA, 21 bp, Artificial Sequence
  Synthetic
ctgctgugccctctttaguca

SEQ ID NO: 47627 - DNA, 19 bp, Artificial Sequence
  Synthetic
tcagcttcucctcccugct

SEQ ID NO: 47628 - DNA, 21 bp, Artificial Sequence
  Synthetic
tccctcguggtgtagagugat

SEQ ID NO: 47629 - DNA, 20 bp, Artificial Sequence
  Synthetic
tgggtgcguaactttgucga

SEQ ID NO: 47630 - DNA, 27 bp, Artificial Sequence
  Synthetic
gcttctgtcaguctttggtgaaacuag

SEQ ID NO: 47631 - DNA, 21 bp, Artificial Sequence
  Synthetic
caccatgcuctttgccucaga

SEQ ID NO: 47632 - DNA, 27 bp, Artificial Sequence
  Synthetic
catagttggguagagaaatcgctcuaa

SEQ ID NO: 47633 - DNA, 20 bp, Artificial Sequence
  Synthetic
ccccugaacaucagcgagac

SEQ ID NO: 47634 - DNA, 24 bp, Artificial Sequence
  Synthetic
ggacacagaucagcatggcuaaat

SEQ ID NO: 47635 - DNA, 21 bp, Artificial Sequence
  Synthetic
catcacccacutggcucaaga

SEQ ID NO: 47636 - DNA, 22 bp, Artificial Sequence
  Synthetic
agtttcucaacccccagacauc

SEQ ID NO: 47637 - DNA, 26 bp, Artificial Sequence
  Synthetic
gaatcggatauaacatcatccgggua

SEQ ID NO: 47638 - DNA, 22 bp, Artificial Sequence
  Synthetic
guatcaguacccagcgggaaac

SEQ ID NO: 47639 - DNA, 23 bp, Artificial Sequence
  Synthetic
cttcagccgcuatgagaguacac

SEQ ID NO: 47640 - DNA, 24 bp, Artificial Sequence
  Synthetic
actggaaggcuaccaaaggacuat

SEQ ID NO: 47641 - DNA, 21 bp, Artificial Sequence
  Synthetic
tgcccaggagaguagtugagg

SEQ ID NO: 47642 - DNA, 20 bp, Artificial Sequence
  Synthetic
actgcucacccagaaagugc

SEQ ID NO: 47643 - DNA, 21 bp, Artificial Sequence
  Synthetic
ttcctgctgucggacactuac

SEQ ID NO: 47644 - DNA, 23 bp, Artificial Sequence
  Synthetic
gctggutatttcacaucagagca

SEQ ID NO: 47645 - DNA, 23 bp, Artificial Sequence
  Synthetic
gctctctacccacuctaccccua

SEQ ID NO: 47646 - DNA, 24 bp, Artificial Sequence
  Synthetic
cctctatgtcccuttcccttccut

SEQ ID NO: 47647 - DNA, 25 bp, Artificial Sequence
  Synthetic
atgaagugggaaacctgatacucac

SEQ ID NO: 47648 - DNA, 21 bp, Artificial Sequence
  Synthetic
ctcagtcccuaagcccatcug

SEQ ID NO: 47649 - DNA, 25 bp, Artificial Sequence
  Synthetic
ctccctattggutctcctccagtua

SEQ ID NO: 47650 - DNA, 22 bp, Artificial Sequence
  Synthetic
gaccacagacaaugttcccuct

SEQ ID NO: 47651 - DNA, 24 bp, Artificial Sequence
  Synthetic
gtatgtgtagacugtgctcagugt

SEQ ID NO: 47652 - DNA, 22 bp, Artificial Sequence
  Synthetic
agttgggaagggauctguggat

SEQ ID NO: 47653 - DNA, 21 bp, Artificial Sequence
  Synthetic
ccacuggaaggccatttgaug

SEQ ID NO: 47654 - DNA, 22 bp, Artificial Sequence
  Synthetic
cctacctucttccctacugcac

SEQ ID NO: 47655 - DNA, 21 bp, Artificial Sequence
  Synthetic
cctggugagtggtccuacact

SEQ ID NO: 47656 - DNA, 26 bp, Artificial Sequence
  Synthetic
ttggcctcttautattggagtcaugg

SEQ ID NO: 47657 - DNA, 21 bp, Artificial Sequence
  Synthetic
gctguccacccaguaggagat

SEQ ID NO: 47658 - DNA, 23 bp, Artificial Sequence
  Synthetic
cactttgtcacugtcactgucct

SEQ ID NO: 47659 - DNA, 21 bp, Artificial Sequence
  Synthetic
cctgcattccutgggagacug

SEQ ID NO: 47660 - DNA, 23 bp, Artificial Sequence
  Synthetic
acagaaauggcctgugaaacaga

SEQ ID NO: 47661 - DNA, 24 bp, Artificial Sequence
  Synthetic
ggtgaacagugtctgatcatguga

SEQ ID NO: 47662 - DNA, 24 bp, Artificial Sequence
  Synthetic
gccacaatttucaccttaggugga

SEQ ID NO: 47663 - DNA, 28 bp, Artificial Sequence
  Synthetic
tgggcttttctcuatttcatgttccaut

SEQ ID NO: 47664 - DNA, 24 bp, Artificial Sequence
  Synthetic
ctcacatautttgcacaugacgct

SEQ ID NO: 47665 - DNA, 28 bp, Artificial Sequence
  Synthetic
aatcacattgtuctgattacccauccat

SEQ ID NO: 47666 - DNA, 26 bp, Artificial Sequence
  Synthetic
acagactugggatgatacucaaagca

SEQ ID NO: 47667 - DNA, 22 bp, Artificial Sequence
  Synthetic
aaactccuaaatgacgcuggct

SEQ ID NO: 47668 - DNA, 23 bp, Artificial Sequence
  Synthetic
ctctgagagcutttggaacugct

SEQ ID NO: 47669 - DNA, 21 bp, Artificial Sequence
  Synthetic
gccaggugcagtgtagtccua

SEQ ID NO: 47670 - DNA, 20 bp, Artificial Sequence
  Synthetic
cagaaugggtccucacacgt

SEQ ID NO: 47671 - DNA, 21 bp, Artificial Sequence
  Synthetic
autggtuacccgaggcagaag

SEQ ID NO: 47672 - DNA, 23 bp, Artificial Sequence
  Synthetic
atctcgaugaccatcaccttugg

SEQ ID NO: 47673 - DNA, 19 bp, Artificial Sequence
  Synthetic
cagtcgcucggtgacugat

SEQ ID NO: 47674 - DNA, 20 bp, Artificial Sequence
  Synthetic
ggaguagtcuccgcccagat

SEQ ID NO: 47675 - DNA, 22 bp, Artificial Sequence
  Synthetic
acttctttucccacccctccua

SEQ ID NO: 47676 - DNA, 23 bp, Artificial Sequence
  Synthetic
ggaggguttttgacgucacaagt

SEQ ID NO: 47677 - DNA, 24 bp, Artificial Sequence
  Synthetic
catgcttccccucattcctcauag

SEQ ID NO: 47678 - DNA, 22 bp, Artificial Sequence
  Synthetic
gattgcugagagacaccugagt

SEQ ID NO: 47679 - DNA, 24 bp, Artificial Sequence
  Synthetic
gggatttuaagcaggtuccaggaa

SEQ ID NO: 47680 - DNA, 27 bp, Artificial Sequence
  Synthetic
aagggatgacugtaattactuggaacc

SEQ ID NO: 47681 - DNA, 25 bp, Artificial Sequence
  Synthetic
ctgggaaacacaucatctcttugga

SEQ ID NO: 47682 - DNA, 30 bp, Artificial Sequence; identical to SEQ ID NO: 35448
  Synthetic

SEQ ID NO: 47683 - DNA, 22 bp, Artificial Sequence
  Synthetic
agcaucaaagacagccgatuct

SEQ ID NO: 47684 - DNA, 26 bp, Artificial Sequence
  Synthetic
tgactcaaacugccatgtatttcuca

SEQ ID NO: 47685 - DNA, 20 bp, Artificial Sequence
  Synthetic
acgagagucacccgaguacc

SEQ ID NO: 47686 - DNA, 19 bp, Artificial Sequence
  Synthetic
catgctgcucgtcacucga

SEQ ID NO: 47687 - DNA, 23 bp, Artificial Sequence
  Synthetic
cuaaaagccaguaggcataucac

SEQ ID NO: 47688 - DNA, 21 bp, Artificial Sequence
  Synthetic
cagagaccucggccattttug

SEQ ID NO: 47689 - DNA, 23 bp, Artificial Sequence
  Synthetic
aagccaatcacugctatggtuga

SEQ ID NO: 47690 - DNA, 22 bp, Artificial Sequence
  Synthetic
gggaaaatuacaggctggucct

SEQ ID NO: 47691 - DNA, 29 bp, Artificial Sequence
  Synthetic
cagttccaagcautcataaattctcacut

SEQ ID NO: 47692 - DNA, 23 bp, Artificial Sequence
  Synthetic
ggctgttuctcacagaucccaaa

SEQ ID NO: 47693 - DNA, 22 bp, Artificial Sequence
  Synthetic
aagcaaggcutctgaagtcucc

SEQ ID NO: 47694 - DNA, 28 bp, Artificial Sequence
  Synthetic
aagcacaaacugcattttgaatcuaagt

SEQ ID NO: 47695 - DNA, 30 bp, Artificial Sequence; identical to SEQ ID NO: 35461
  Synthetic

SEQ ID NO: 47696 - DNA, 20 bp, Artificial Sequence
  Synthetic
gtugaggcagcacaaagguc

SEQ ID NO: 47697 - DNA, 27 bp, Artificial Sequence
  Synthetic
catgttgtcacaguctttgtccaaaut

SEQ ID NO: 47698 - DNA, 22 bp, Artificial Sequence
  Synthetic
ccattggutcctguggcaagaa

SEQ ID NO: 47699 - DNA, 24 bp, Artificial Sequence
  Synthetic
ccutgatatccugggacacagaag

SEQ ID NO: 47700 - DNA, 24 bp, Artificial Sequence
  Synthetic
tttgacaagugctctgguaaacaa

SEQ ID NO: 47701 - DNA, 22 bp, Artificial Sequence
  Synthetic
gcatccugacaagtugcaccat

SEQ ID NO: 47702 - DNA, 21 bp, Artificial Sequence
  Synthetic
gccatgggucttgggttgaua

SEQ ID NO: 47703 - DNA, 23 bp, Artificial Sequence
  Synthetic
ccaacaaagaggcaucaagguct

SEQ ID NO: 47704 - DNA, 23 bp, Artificial Sequence
  Synthetic
gccagtauagcagtcaaccucct

SEQ ID NO: 47705 - DNA, 21 bp, Artificial Sequence
  Synthetic
agctccacacautccccatug

SEQ ID NO: 47706 - DNA, 28 bp, Artificial Sequence
  Synthetic
tcatgcactuctgcaagattauacaagt

SEQ ID NO: 47707 - DNA, 26 bp, Artificial Sequence
  Synthetic
caagttctcacaaguaccaccattut

SEQ ID NO: 47708 - DNA, 23 bp, Artificial Sequence
  Synthetic
gctgtacccaucagcaatgtcua

SEQ ID NO: 47709 - DNA, 25 bp, Artificial Sequence
  Synthetic
ctatgttacaaacugagccctuggt

SEQ ID NO: 47710 - DNA, 26 bp, Artificial Sequence
  Synthetic
aggtcaataatcagucaaaggtgcut

SEQ ID NO: 47711 - DNA, 29 bp, Artificial Sequence
  Synthetic
gcacatattgatugatcactttcaagugg

SEQ ID NO: 47712 - DNA, 27 bp, Artificial Sequence
  Synthetic
aattgattggaaucacattacccugga

SEQ ID NO: 47713 - DNA, 24 bp, Artificial Sequence
  Synthetic
ccatagcacucagctttctcucac

SEQ ID NO: 47714 - DNA, 26 bp, Artificial Sequence
  Synthetic
caggcttacutctagcttuggaaaac

SEQ ID NO: 47715 - DNA, 28 bp, Artificial Sequence
  Synthetic
tcgattttccacguagaagcagaaauaa

SEQ ID NO: 47716 - DNA, 26 bp, Artificial Sequence
  Synthetic
aatggtggattcutcaaaggctguat

SEQ ID NO: 47717 - DNA, 30 bp, Artificial Sequence; identical to SEQ ID NO: 35483
  Synthetic

SEQ ID NO: 47718 - DNA, 21 bp, Artificial Sequence
  Synthetic
ctcacaagugggaaagccugt

SEQ ID NO: 47719 - DNA, 29 bp, Artificial Sequence
  Synthetic
aactggctttguctatactctttttcugt

SEQ ID NO: 47720 - DNA, 25 bp, Artificial Sequence
  Synthetic
gcaugcagaaaaagaguctgaatut

SEQ ID NO: 47721 - DNA, 23 bp, Artificial Sequence
  Synthetic
caautgtgctggucacaaaaggt

SEQ ID NO: 47722 - DNA, 23 bp, Artificial Sequence
  Synthetic
cctgcaagggugtctaaguacaa

SEQ ID NO: 47723 - DNA, 30 bp, Artificial Sequence; identical to SEQ ID NO: 35489
  Synthetic

SEQ ID NO: 47724 - DNA, 22 bp, Artificial Sequence
  Synthetic
acatgtgagccuggatacacug

SEQ ID NO: 47725 - DNA, 26 bp, Artificial Sequence
  Synthetic
accaagcttcauatggactttaugct

SEQ ID NO: 47726 - DNA, 28 bp, Artificial Sequence
  Synthetic
actttttcttcccauttcacaaccaaug

SEQ ID NO: 47727 - DNA, 25 bp, Artificial Sequence
  Synthetic
gagacauaaaaggagaggctgctua

SEQ ID NO: 47728 - DNA, 22 bp, Artificial Sequence
  Synthetic
cagtgactgucgccttgtuact

SEQ ID NO: 47729 - DNA, 22 bp, Artificial Sequence
  Synthetic
cgaagggacacaaugctccuaa

SEQ ID NO: 47730 - DNA, 23 bp, Artificial Sequence
  Synthetic
gcttgaauagaggaguccccaca

SEQ ID NO: 47731 - DNA, 20 bp, Artificial Sequence
  Synthetic
gcagtaucccccgccttuag

SEQ ID NO: 47732 - DNA, 27 bp, Artificial Sequence
  Synthetic
gctcaggguaatcttactagcuacaca

SEQ ID NO: 47733 - DNA, 20 bp, Artificial Sequence
  Synthetic
tccgugaccacatcaauggg

SEQ ID NO: 47734 - DNA, 22 bp, Artificial Sequence
  Synthetic
tgaatgcccaauagtccaugcc

SEQ ID NO: 47735 - DNA, 28 bp, Artificial Sequence
  Synthetic
tgacaatgacacugagactattcuacct

SEQ ID NO: 47736 - DNA, 21 bp, Artificial Sequence
  Synthetic
ggaggaagccauaatgccuca

SEQ ID NO: 47737 - DNA, 25 bp, Artificial Sequence
  Synthetic
acacattgatucactgttcacucat

SEQ ID NO: 47738 - DNA, 20 bp, Artificial Sequence
  Synthetic
gcaatgtccugcttggtcug

SEQ ID NO: 47739 - DNA, 21 bp, Artificial Sequence
  Synthetic
aggttagugggctccuacagt

SEQ ID NO: 47740 - DNA, 23 bp, Artificial Sequence
  Synthetic
ggcactggautgaatctgugagg

SEQ ID NO: 47741 - DNA, 22 bp, Artificial Sequence
  Synthetic
ccacatgtaagcugggttggut

SEQ ID NO: 47742 - DNA, 20 bp, Artificial Sequence
  Synthetic
gacauagcucaccagggcat

SEQ ID NO: 47743 - DNA, 23 bp, Artificial Sequence
  Synthetic
tcatggagatguctggctgttuc

SEQ ID NO: 47744 - DNA, 23 bp, Artificial Sequence
  Synthetic
cgagaagcaugaggaauggagat

SEQ ID NO: 47745 - DNA, 20 bp, Artificial Sequence
  Synthetic
gutgtccctuccgagagacc

SEQ ID NO: 47746 - DNA, 26 bp, Artificial Sequence
  Synthetic
agcactgtgaaaaugcctttaaacug

SEQ ID NO: 47747 - DNA, 28 bp, Artificial Sequence
  Synthetic
ctagaugcaaagagtaagatugagcaga

SEQ ID NO: 47748 - DNA, 21 bp, Artificial Sequence
  Synthetic
ggcatugcggagtcuaccaaa

SEQ ID NO: 47749 - DNA, 23 bp, Artificial Sequence
  Synthetic
cctagcctgugactgtgattucc

SEQ ID NO: 47750 - DNA, 18 bp, Artificial Sequence
  Synthetic
cgucccccaggcttugag

SEQ ID NO: 47751 - DNA, 23 bp, Artificial Sequence
  Synthetic
aatctaggacacagucccugaca

SEQ ID NO: 47752 - DNA, 19 bp, Artificial Sequence
  Synthetic
attugggacccaccacgut

SEQ ID NO: 47753 - DNA, 21 bp, Artificial Sequence
  Synthetic
gccaugtcatcugcagggaag

SEQ ID NO: 47754 - DNA, 21 bp, Artificial Sequence
  Synthetic
gtaggugagtccagugaagcc

SEQ ID NO: 47755 - DNA, 21 bp, Artificial Sequence
  Synthetic
gctcctggaauctgctcugaa

SEQ ID NO: 47756 - DNA, 20 bp, Artificial Sequence
  Synthetic
cggtuccggaaatagugcag

SEQ ID NO: 47757 - DNA, 22 bp, Artificial Sequence
  Synthetic
caaaggtgugggtcagatguca

SEQ ID NO: 47758 - DNA, 25 bp, Artificial Sequence
  Synthetic
cttagatttagugcccttcctgcut

SEQ ID NO: 47759 - DNA, 22 bp, Artificial Sequence
  Synthetic
ctactatgctgugtcccagcuc

SEQ ID NO: 47760 - DNA, 21 bp, Artificial Sequence
  Synthetic
ggcaaguagggcaaguaucaa

SEQ ID NO: 47761 - DNA, 24 bp, Artificial Sequence
  Synthetic
cttctctttcccutccctctguag

SEQ ID NO: 47762 - DNA, 19 bp, Artificial Sequence
  Synthetic
acucgccaggtctuaccga

SEQ ID NO: 47763 - DNA, 21 bp, Artificial Sequence
  Synthetic
tgtggtaugccaggaggttug

SEQ ID NO: 47764 - DNA, 21 bp, Artificial Sequence
  Synthetic
cctgtggaggcugtacagtut

SEQ ID NO: 47765 - DNA, 23 bp, Artificial Sequence
  Synthetic
tgagtgtctgcuatctccctcuc

SEQ ID NO: 47766 - DNA, 22 bp, Artificial Sequence
  Synthetic
actgaagggacuacaggugaca

SEQ ID NO: 47767 - DNA, 22 bp, Artificial Sequence
  Synthetic
gcactgttguacccagttugct

SEQ ID NO: 47768 - DNA, 24 bp, Artificial Sequence
  Synthetic
ttggaaaatgcuggagctcuagac

SEQ ID NO: 47769 - DNA, 23 bp, Artificial Sequence
  Synthetic
actaggtctuggccctttcuaca

SEQ ID NO: 47770 - DNA, 22 bp, Artificial Sequence
  Synthetic
accaggcagguaaagacaggua

SEQ ID NO: 47771 - DNA, 20 bp, Artificial Sequence
  Synthetic
cagtgacgacagaugggugt

SEQ ID NO: 47772 - DNA, 22 bp, Artificial Sequence
  Synthetic
tgcattccagggutacgtctuc

SEQ ID NO: 47773 - DNA, 30 bp, Artificial Sequence; identical to SEQ ID NO: 35539
  Synthetic

SEQ ID NO: 47774 - DNA, 26 bp, Artificial Sequence
  Synthetic
acagtgagttguccatcaagacttuc

SEQ ID NO: 47775 - DNA, 27 bp, Artificial Sequence
  Synthetic
gaaatacucacagcaacttccttcuca

SEQ ID NO: 47776 - DNA, 27 bp, Artificial Sequence
  Synthetic
ggctctttguggatttttctttguagt

SEQ ID NO: 47777 - DNA, 28 bp, Artificial Sequence
  Synthetic
ccagagaugacaaaaatgctttcugaaa

SEQ ID NO: 47778 - DNA, 25 bp, Artificial Sequence
  Synthetic
tctgctggucagctttcagattuag

SEQ ID NO: 47779 - DNA, 21 bp, Artificial Sequence
  Synthetic
gaacggccaacugaaggagua

SEQ ID NO: 47780 - DNA, 26 bp, Artificial Sequence
  Synthetic
gtttttaaaaguggcttctccgagut

SEQ ID NO: 47781 - DNA, 23 bp, Artificial Sequence
  Synthetic
ccacatacaagcugagagtggug

SEQ ID NO: 47782 - DNA, 22 bp, Artificial Sequence
  Synthetic
catccttcugcctgacccatua

SEQ ID NO: 47783 - DNA, 24 bp, Artificial Sequence
  Synthetic
gccttcaagccutcactaacuact

SEQ ID NO: 47784 - DNA, 29 bp, Artificial Sequence
  Synthetic
tgatttttaaaagucaaccagtccuggat

SEQ ID NO: 47785 - DNA, 25 bp, Artificial Sequence
  Synthetic
ccacgttccaugtgatctcttcuac

SEQ ID NO: 47786 - DNA, 27 bp, Artificial Sequence
  Synthetic
tctttaagtgccutttcaaattgugca

SEQ ID NO: 47787 - DNA, 27 bp, Artificial Sequence
  Synthetic
aatagcaacucagcctagaaaauccaa

SEQ ID NO: 47788 - DNA, 24 bp, Artificial Sequence
  Synthetic
gttgcaucaaaggtgcaatcucag

SEQ ID NO: 47789 - DNA, 28 bp, Artificial Sequence
  Synthetic
cctggtgtttuaaagattcttcccauga

SEQ ID NO: 47790 - DNA, 27 bp, Artificial Sequence
  Synthetic
caaatagttcacggaugaagaggguat

SEQ ID NO: 47791 - DNA, 22 bp, Artificial Sequence
  Synthetic
cuacacagtaacugccagcaac

SEQ ID NO: 47792 - DNA, 27 bp, Artificial Sequence
  Synthetic
agttcataacttcugatctggccatut

SEQ ID NO: 47793 - DNA, 28 bp, Artificial Sequence
  Synthetic
gccttactctcaguataacttctcccut

SEQ ID NO: 47794 - DNA, 26 bp, Artificial Sequence
  Synthetic
catacattcattugagtggcacugac

SEQ ID NO: 47795 - DNA, 25 bp, Artificial Sequence
  Synthetic
aggcttcaaaggaaugaaatgcuct

SEQ ID NO: 47796 - DNA, 24 bp, Artificial Sequence
  Synthetic
aatgtccucaccacatuccaagag

SEQ ID NO: 47797 - DNA, 23 bp, Artificial Sequence
  Synthetic
cgctatgaagugattcgcagaug

SEQ ID NO: 47798 - DNA, 21 bp, Artificial Sequence
  Synthetic
ggcutcatctguccacagagg

SEQ ID NO: 47799 - DNA, 28 bp, Artificial Sequence
  Synthetic
ctacacaaagaaautgtatgcugcaagt

SEQ ID NO: 47800 - DNA, 27 bp, Artificial Sequence
  Synthetic
gggaagattcuaaggtttgaaucagag

SEQ ID NO: 47801 - DNA, 28 bp, Artificial Sequence
  Synthetic
ggttcagagaaugactttccagcaauat

SEQ ID NO: 47802 - DNA, 24 bp, Artificial Sequence
  Synthetic
cccaaggagcuggaaaatctugag

SEQ ID NO: 47803 - DNA, 21 bp, Artificial Sequence
  Synthetic
gcctgctuggtttccttucag

SEQ ID NO: 47804 - DNA, 31 bp, Artificial Sequence; identical to SEQ ID NO: 35570
  Synthetic

SEQ ID NO: 47805 - DNA, 24 bp, Artificial Sequence
  Synthetic
ggtcatcatcaauccacccttcug

SEQ ID NO: 47806 - DNA, 29 bp, Artificial Sequence
  Synthetic
tccuttaaaatgttuacacacacacacac

SEQ ID NO: 47807 - DNA, 28 bp, Artificial Sequence
  Synthetic
gcagtgctagugatgattacattgtuca

SEQ ID NO: 47808 - DNA, 29 bp, Artificial Sequence
  Synthetic
aacaatttaacaacuttcagtgggacaug

SEQ ID NO: 47809 - DNA, 27 bp, Artificial Sequence
  Synthetic
caatggcctcguttctcaatatcaaut

SEQ ID NO: 47810 - DNA, 28 bp, Artificial Sequence
  Synthetic
gttatgaaggaguttacagatuccacct

SEQ ID NO: 47811 - DNA, 29 bp, Artificial Sequence
  Synthetic
tgcactttatttcutgcttgctttttcua

SEQ ID NO: 47812 - DNA, 22 bp, Artificial Sequence
  Synthetic
cagtgtggaugagaccttuccc

SEQ ID NO: 47813 - DNA, 26 bp, Artificial Sequence
  Synthetic
attgctgcttaautcctacgtctuca

SEQ ID NO: 47814 - DNA, 27 bp, Artificial Sequence
  Synthetic
ggttagatgcauagggcaattaaaugt

SEQ ID NO: 47815 - DNA, 22 bp, Artificial Sequence
  Synthetic
gatgtgccucaaggagtgaguc

SEQ ID NO: 47816 - DNA, 26 bp, Artificial Sequence
  Synthetic
agtttaaggagagutgatgucagagt

SEQ ID NO: 47817 - DNA, 26 bp, Artificial Sequence
  Synthetic
gataagaggguctcacaatuccacag

SEQ ID NO: 47818 - DNA, 22 bp, Artificial Sequence
  Synthetic
cgccuccgagagcttttctauc

SEQ ID NO: 47819 - DNA, 25 bp, Artificial Sequence
  Synthetic
tccagtggagaguctaaagcacaua

SEQ ID NO: 47820 - DNA, 26 bp, Artificial Sequence
  Synthetic
tctagggcaaauttctcactctcuct

SEQ ID NO: 47821 - DNA, 20 bp, Artificial Sequence
  Synthetic
tgtggcagaaugccgtacuc

SEQ ID NO: 47822 - DNA, 26 bp, Artificial Sequence
  Synthetic
cccatagtttutgagtacaccuggaa

SEQ ID NO: 47823 - DNA, 27 bp, Artificial Sequence
  Synthetic
ttcaaacttucaggtttgttguaacgg

SEQ ID NO: 47824 - DNA, 22 bp, Artificial Sequence
  Synthetic
gctcatcacuctgatccugcac

SEQ ID NO: 47825 - DNA, 28 bp, Artificial Sequence
  Synthetic
tgccacttttuacttaagactgauagca

SEQ ID NO: 47826 - DNA, 25 bp, Artificial Sequence
  Synthetic
gtgggtgtuggtatatcactuggag

SEQ ID NO: 47827 - DNA, 27 bp, Artificial Sequence
  Synthetic
ggaaggtgggautcagactattgtuag

SEQ ID NO: 47828 - DNA, 23 bp, Artificial Sequence
  Synthetic
actcagugacaacaccattuggg

SEQ ID NO: 47829 - DNA, 28 bp, Artificial Sequence
  Synthetic
gcatttagctuaacatgtgcttttucag

SEQ ID NO: 47830 - DNA, 24 bp, Artificial Sequence
  Synthetic
tguggactccatugaagacagaga

SEQ ID NO: 47831 - DNA, 26 bp, Artificial Sequence
  Synthetic
ccatgtccugcatttattgtugacag

SEQ ID NO: 47832 - DNA, 22 bp, Artificial Sequence
  Synthetic
tgagattggcucctctctcugg

SEQ ID NO: 47833 - DNA, 28 bp, Artificial Sequence
  Synthetic
ggaaggaaaucctgtattttgugaagaa

SEQ ID NO: 47834 - DNA, 26 bp, Artificial Sequence
  Synthetic
ggaataaaagccuccttcattuccct

SEQ ID NO: 47835 - DNA, 22 bp, Artificial Sequence
  Synthetic
cccaccguacctcagaatgtug

SEQ ID NO: 47836 - DNA, 21 bp, Artificial Sequence
  Synthetic
actgcggaagucacattggut

SEQ ID NO: 47837 - DNA, 21 bp, Artificial Sequence
  Synthetic
ggcctcgugaacttcaatugc

SEQ ID NO: 47838 - DNA, 23 bp, Artificial Sequence
  Synthetic
agagtgctcaucagtacccgaua

SEQ ID NO: 47839 - DNA, 25 bp, Artificial Sequence
  Synthetic
cagagctgutctctgatacuccaac

SEQ ID NO: 47840 - DNA, 24 bp, Artificial Sequence
  Synthetic
gcagtgtaugggtgtaaatgcauc

SEQ ID NO: 47841 - DNA, 25 bp, Artificial Sequence
  Synthetic
ccaagaggtcugactttctggatut

SEQ ID NO: 47842 - DNA, 27 bp, Artificial Sequence
  Synthetic
tgtataacccagcugatagaauggaca

SEQ ID NO: 47843 - DNA, 28 bp, Artificial Sequence
  Synthetic
ctgctctaatucatctgtgttttucgac

SEQ ID NO: 47844 - DNA, 28 bp, Artificial Sequence
  Synthetic
aggcattgcaatugttataggatcagut

SEQ ID NO: 47845 - DNA, 30 bp, Artificial Sequence; identical to SEQ ID NO: 35611
  Synthetic

SEQ ID NO: 47846 - DNA, 22 bp, Artificial Sequence
  Synthetic
gaguccatuagggcgaaaaggt

SEQ ID NO: 47847 - DNA, 29 bp, Artificial Sequence
  Synthetic
tttactucacaguaaaaagagattcttug

SEQ ID NO: 47848 - DNA, 27 bp, Artificial Sequence
  Synthetic
ggactcugaaggaatgtaaacuccaag

SEQ ID NO: 47849 - DNA, 28 bp, Artificial Sequence
  Synthetic
cttgctttctuaagaccttctttgcuat

SEQ ID NO: 47850 - DNA, 23 bp, Artificial Sequence
  Synthetic
ggtgaataugagtgggcttuggg

SEQ ID NO: 47851 - DNA, 28 bp, Artificial Sequence
  Synthetic
ttcctcaatgtucatgaaaactttuggg

SEQ ID NO: 47852 - DNA, 30 bp, Artificial Sequence; identical to SEQ ID NO: 35618
  Synthetic

SEQ ID NO: 47853 - DNA, 28 bp, Artificial Sequence
  Synthetic
aaaaagtgucacaaatccaagtucaaat

SEQ ID NO: 47854 - DNA, 23 bp, Artificial Sequence
  Synthetic
tgcagatauggaacccctggaua

SEQ ID NO: 47855 - DNA, 30 bp, Artificial Sequence; identical to SEQ ID NO: 35621
  Synthetic

SEQ ID NO: 47856 - DNA, 27 bp, Artificial Sequence
  Synthetic
ttcatgacugaaatgtggaagucaaga

SEQ ID NO: 47857 - DNA, 23 bp, Artificial Sequence
  Synthetic
gtaaacacgcaacccuctttugt

SEQ ID NO: 47858 - DNA, 27 bp, Artificial Sequence
  Synthetic
ctgtcctcactauaggctttcagaaug

SEQ ID NO: 47859 - DNA, 28 bp, Artificial Sequence
  Synthetic
agaactgccattutccctattttctcut

SEQ ID NO: 47860 - DNA, 25 bp, Artificial Sequence
  Synthetic
tttagaggaccuccacattaccugt

SEQ ID NO: 47861 - DNA, 23 bp, Artificial Sequence
  Synthetic
cgttaactuggcatctgtgucca

SEQ ID NO: 47862 - DNA, 27 bp, Artificial Sequence
  Synthetic
autgctatctctugaaacacagaacca

SEQ ID NO: 47863 - DNA, 27 bp, Artificial Sequence
  Synthetic
ctttcataucagcaagtgtgaauggac

SEQ ID NO: 47864 - DNA, 28 bp, Artificial Sequence
  Synthetic
taaagaaaccccaautaagtgtaaugcc

SEQ ID NO: 47865 - DNA, 28 bp, Artificial Sequence
  Synthetic
tggtggaatgaacuttgagatttcctut

SEQ ID NO: 47866 - DNA, 27 bp, Artificial Sequence
  Synthetic
gaggucaagttaaucaaacaggagaga

SEQ ID NO: 47867 - DNA, 25 bp, Artificial Sequence
  Synthetic
tggcagagtuctgaagaacaaauca

SEQ ID NO: 47868 - DNA, 31 bp, Artificial Sequence; identical to SEQ ID NO: 35634
  Synthetic

SEQ ID NO: 47869 - DNA, 28 bp, Artificial Sequence
  Synthetic
aaggtgtatttcucatctcctcttcuct

SEQ ID NO: 47870 - DNA, 25 bp, Artificial Sequence
  Synthetic
caaaagccugatgcctaauagcaat

SEQ ID NO: 47871 - DNA, 33 bp, Artificial Sequence; identical to SEQ ID NO: 35637
  Synthetic

SEQ ID NO: 47872 - DNA, 28 bp, Artificial Sequence
  Synthetic
tttttcctttcctucacttacctgacut

SEQ ID NO: 47873 - DNA, 26 bp, Artificial Sequence
  Synthetic
acagacttcacuggtaagtgtgttug

SEQ ID NO: 47874 - DNA, 23 bp, Artificial Sequence
  Synthetic
tggtcaucagagctgguagagat

SEQ ID NO: 47875 - DNA, 29 bp, Artificial Sequence
  Synthetic
tgtcuagagacagaaaucaaattctugaa

SEQ ID NO: 47876 - DNA, 31 bp, Artificial Sequence; identical to SEQ ID NO: 35642
  Synthetic

SEQ ID NO: 47877 - DNA, 24 bp, Artificial Sequence
  Synthetic
ccctctguctgaattcauggaact

SEQ ID NO: 47878 - DNA, 29 bp, Artificial Sequence
  Synthetic
catattgatgtcauaccccacaactttuc

SEQ ID NO: 47879 - DNA, 25 bp, Artificial Sequence
  Synthetic
gggacgacautcattgttttgaugt

SEQ ID NO: 47880 - DNA, 24 bp, Artificial Sequence
  Synthetic
tggttgtcatugtttgaggaggut

SEQ ID NO: 47881 - DNA, 29 bp, Artificial Sequence
  Synthetic
gtctgatgagtuacgtaggttcactatut

SEQ ID NO: 47882 - DNA, 28 bp, Artificial Sequence
  Synthetic
gtacagaaaaaucgtacttggcaaaugg

SEQ ID NO: 47883 - DNA, 22 bp, Artificial Sequence
  Synthetic
gtcccagagggaaacutgacut

SEQ ID NO: 47884 - DNA, 26 bp, Artificial Sequence
  Synthetic
gaaaccacaacagcauttatccucaa

SEQ ID NO: 47885 - DNA, 22 bp, Artificial Sequence
  Synthetic
ctgattctccaaaugcccacug

SEQ ID NO: 47886 - DNA, 24 bp, Artificial Sequence
  Synthetic
agcctttctgaugggttctaaaug

SEQ ID NO: 47887 - DNA, 27 bp, Artificial Sequence
  Synthetic
gtaaacaattugtcactggcucaaagt

SEQ ID NO: 47888 - DNA, 24 bp, Artificial Sequence
  Synthetic
gaagttatugctttgcaacugcca

SEQ ID NO: 47889 - DNA, 26 bp, Artificial Sequence
  Synthetic
aactggtgcagutaatcacatctgua

SEQ ID NO: 47890 - DNA, 26 bp, Artificial Sequence
  Synthetic
aggaatgtcatugtgcactgaaaaug

SEQ ID NO: 47891 - DNA, 23 bp, Artificial Sequence
  Synthetic
aggtcttcgcugtaatcagtgug

SEQ ID NO: 47892 - DNA, 25 bp, Artificial Sequence
  Synthetic
cctccaaacauttattgcactguct

SEQ ID NO: 47893 - DNA, 24 bp, Artificial Sequence
  Synthetic
caaattctgcaaucctcactcugg

SEQ ID NO: 47894 - DNA, 27 bp, Artificial Sequence
  Synthetic
tccagatggtaauagagatgtgacugt

SEQ ID NO: 47895 - DNA, 27 bp, Artificial Sequence
  Synthetic
cagtgccagaauggattctacaatcua

SEQ ID NO: 47896 - DNA, 26 bp, Artificial Sequence
  Synthetic
acatccaaauaagtttcuggcagaca

SEQ ID NO: 47897 - DNA, 23 bp, Artificial Sequence
  Synthetic
tgcataaccuttccctgaugcag

SEQ ID NO: 47898 - DNA, 24 bp, Artificial Sequence
  Synthetic
ttgtaatggcagcutttggaaugg

SEQ ID NO: 47899 - DNA, 30 bp, Artificial Sequence; identical to SEQ ID NO: 35665
  Synthetic

SEQ ID NO: 47900 - DNA, 25 bp, Artificial Sequence
  Synthetic
agtacugcccatgaaaaugaaacct

SEQ ID NO: 47901 - DNA, 29 bp, Artificial Sequence
  Synthetic
tctcaacatttugatttctgtttugccaa

SEQ ID NO: 47902 - DNA, 26 bp, Artificial Sequence
  Synthetic
gaaagctgaagacagutgacagaauc

SEQ ID NO: 47903 - DNA, 28 bp, Artificial Sequence
  Synthetic
atcatucagttctttaguccacaaccaa

SEQ ID NO: 47904 - DNA, 23 bp, Artificial Sequence
  Synthetic
acaaaagagagaggaugggctuc

SEQ ID NO: 47905 - DNA, 24 bp, Artificial Sequence
  Synthetic
gtccttacaguctccctctugact

SEQ ID NO: 47906 - DNA, 26 bp, Artificial Sequence
  Synthetic
atactgctgcagautttgtgaguaga

SEQ ID NO: 47907 - DNA, 29 bp, Artificial Sequence
  Synthetic
ggtttgcaaccuccaataaaagtaaugac

SEQ ID NO: 47908 - DNA, 28 bp, Artificial Sequence
  Synthetic
aatgatcttcacuactactggtttuggg

SEQ ID NO: 47909 - DNA, 23 bp, Artificial Sequence
  Synthetic
ctgcaucacaccagacaagaaug

SEQ ID NO: 47910 - DNA, 22 bp, Artificial Sequence
  Synthetic
ctgggaguccacatactgctug

SEQ ID NO: 47911 - DNA, 27 bp, Artificial Sequence
  Synthetic
tgctttaucaggaggagaatgutttut

SEQ ID NO: 47912 - DNA, 20 bp, Artificial Sequence
  Synthetic
tgtgtccaaguctccagguc

SEQ ID NO: 47913 - DNA, 21 bp, Artificial Sequence
  Synthetic
cattagggacguccgctcauc

SEQ ID NO: 47914 - DNA, 22 bp, Artificial Sequence
  Synthetic
ctggtuccaaaaatccgugcat

SEQ ID NO: 47915 - DNA, 22 bp, Artificial Sequence
  Synthetic
aaacagcatgaucacgtgctuc

SEQ ID NO: 47916 - DNA, 22 bp, Artificial Sequence
  Synthetic
ccctagcagguccagaaucact

SEQ ID NO: 47917 - DNA, 23 bp, Artificial Sequence
  Synthetic
cgatgacgcugatcatgaugagg

SEQ ID NO: 47918 - DNA, 22 bp, Artificial Sequence
  Synthetic
gaagagcatucaggcttgggua

SEQ ID NO: 47919 - DNA, 21 bp, Artificial Sequence
  Synthetic
ggaccctgcugcttatctguc

SEQ ID NO: 47920 - DNA, 20 bp, Artificial Sequence
  Synthetic
atggtgugcatccacuggaa

SEQ ID NO: 47921 - DNA, 19 bp, Artificial Sequence
  Synthetic
gatttggcccuggacaucg

SEQ ID NO: 47922 - DNA, 21 bp, Artificial Sequence
  Synthetic
ccgcctgagaugtgaacctut

SEQ ID NO: 47923 - DNA, 22 bp, Artificial Sequence
  Synthetic
gaacucatgcctcucagggaag

SEQ ID NO: 47924 - DNA, 17 bp, Artificial Sequence
  Synthetic
gagcagcugggcctuct

SEQ ID NO: 47925 - DNA, 18 bp, Artificial Sequence
  Synthetic
gcauccccagccacucac

SEQ ID NO: 47926 - DNA, 22 bp, Artificial Sequence
  Synthetic
ctgcutgctgtgtucaagaagg

SEQ ID NO: 47927 - DNA, 24 bp, Artificial Sequence
  Synthetic
ccaatgaaaatuccctgcagctug

SEQ ID NO: 47928 - DNA, 27 bp, Artificial Sequence
  Synthetic
atttgtcauagcaccaggtatauagga

SEQ ID NO: 47929 - DNA, 23 bp, Artificial Sequence
  Synthetic
ctacttcctguctgctgtgaugg

SEQ ID NO: 47930 - DNA, 22 bp, Artificial Sequence
  Synthetic
gcctccgugtagatgatctucc

SEQ ID NO: 47931 - DNA, 26 bp, Artificial Sequence
  Synthetic
catccaatacagcccugaaactgtua

SEQ ID NO: 47932 - DNA, 25 bp, Artificial Sequence
  Synthetic
cggaugttaggttuaagaagaggct

SEQ ID NO: 47933 - DNA, 27 bp, Artificial Sequence
  Synthetic
gaacctgttcccutacagttctctuac

SEQ ID NO: 47934 - DNA, 23 bp, Artificial Sequence
  Synthetic
ccaugtagtugccagagcagaat

SEQ ID NO: 47935 - DNA, 30 bp, Artificial Sequence; identical to SEQ ID NO: 35701
  Synthetic

SEQ ID NO: 47936 - DNA, 25 bp, Artificial Sequence
  Synthetic
aagaaaagguaggaaaacgguggaa

SEQ ID NO: 47937 - DNA, 29 bp, Artificial Sequence
  Synthetic
gcaggcaaacaugaaagatatcaaagauc

SEQ ID NO: 47938 - DNA, 17 bp, Artificial Sequence
  Synthetic
cccagccuagcccacug

SEQ ID NO: 47939 - DNA, 22 bp, Artificial Sequence
  Synthetic
agaggaugaagacccucagcat

SEQ ID NO: 47940 - DNA, 18 bp, Artificial Sequence
  Synthetic
cctcucccaggcatuggt

SEQ ID NO: 47941 - DNA, 19 bp, Artificial Sequence
  Synthetic
cggtcctucttcgcacugg

SEQ ID NO: 47942 - DNA, 23 bp, Artificial Sequence
  Synthetic
tctcagaagcugagcctaacuca

SEQ ID NO: 47943 - DNA, 21 bp, Artificial Sequence
  Synthetic
ccctaacutgtcccugcagac

SEQ ID NO: 47944 - DNA, 21 bp, Artificial Sequence
  Synthetic
cagggtgccutaggctagtut

SEQ ID NO: 47945 - DNA, 22 bp, Artificial Sequence
  Synthetic
caatgcctuggaccttaaccug

SEQ ID NO: 47946 - DNA, 23 bp, Artificial Sequence
  Synthetic
gtgcagtaggutggtttcctuca

SEQ ID NO: 47947 - DNA, 23 bp, Artificial Sequence
  Synthetic
agctagugagacagtuacaggga

SEQ ID NO: 47948 - DNA, 24 bp, Artificial Sequence
  Synthetic
caaggaaacuaccttcacgtccuc

SEQ ID NO: 47949 - DNA, 21 bp, Artificial Sequence
  Synthetic
cttccccugaagcuggacaaa

SEQ ID NO: 47950 - DNA, 23 bp, Artificial Sequence
  Synthetic
catcaagccugtggtcaaggtua

SEQ ID NO: 47951 - DNA, 28 bp, Artificial Sequence
  Synthetic
ccatacgtaaacacucttgaatgaatug

SEQ ID NO: 47952 - DNA, 24 bp, Artificial Sequence
  Synthetic
aagtgtuggcagttattgttuggg

SEQ ID NO: 47953 - DNA, 29 bp, Artificial Sequence
  Synthetic
agtgagaacugactgctttcauagaaaat

SEQ ID NO: 47954 - DNA, 23 bp, Artificial Sequence
  Synthetic
gggtcttcugattctgggaucac

SEQ ID NO: 47955 - DNA, 24 bp, Artificial Sequence
  Synthetic
gaagacccagggaaaugtacucac

SEQ ID NO: 47956 - DNA, 23 bp, Artificial Sequence
  Synthetic
gggacagucagggtttuagagga

SEQ ID NO: 47957 - DNA, 20 bp, Artificial Sequence
  Synthetic
gaaaguccccucccgagaga

SEQ ID NO: 47958 - DNA, 21 bp, Artificial Sequence
  Synthetic
catccugccagtaucccagac

SEQ ID NO: 47959 - DNA, 26 bp, Artificial Sequence
  Synthetic
ccctaaagacuccaagacucagaact

SEQ ID NO: 47960 - DNA, 22 bp, Artificial Sequence
  Synthetic
ccatccacagccugttcatgua

SEQ ID NO: 47961 - DNA, 23 bp, Artificial Sequence
  Synthetic
cucaggcaaaucaaaaaccccat

SEQ ID NO: 47962 - DNA, 20 bp, Artificial Sequence
  Synthetic
gctccttgugacctgaccuc

SEQ ID NO: 47963 - DNA, 20 bp, Artificial Sequence
  Synthetic
caugacaccucaaggccagt

SEQ ID NO: 47964 - DNA, 22 bp, Artificial Sequence
  Synthetic
gggaacaagutcgacaugacct

SEQ ID NO: 47965 - DNA, 22 bp, Artificial Sequence
  Synthetic
gagtagactcuggcagcttucc

SEQ ID NO: 47966 - DNA, 17 bp, Artificial Sequence
  Synthetic
accctcugccctguggt

SEQ ID NO: 47967 - DNA, 20 bp, Artificial Sequence
  Synthetic
cagtugagccaggagaggug

SEQ ID NO: 47968 - DNA, 21 bp, Artificial Sequence
  Synthetic
ggaccaguacctguaccagct

SEQ ID NO: 47969 - DNA, 21 bp, Artificial Sequence
  Synthetic
ttgtcccugccagttctgaug

SEQ ID NO: 47970 - DNA, 22 bp, Artificial Sequence
  Synthetic
gactgtggguttctgtcctuct

SEQ ID NO: 47971 - DNA, 20 bp, Artificial Sequence
  Synthetic
caaggcagcuccaggtagug

SEQ ID NO: 47972 - DNA, 22 bp, Artificial Sequence
  Synthetic
accccaagutttctgacgucac

SEQ ID NO: 47973 - DNA, 21 bp, Artificial Sequence
  Synthetic
caaaaggagggugcaguccat

SEQ ID NO: 47974 - DNA, 23 bp, Artificial Sequence
  Synthetic
ctgtctgtcucctctcattgcut

SEQ ID NO: 47975 - DNA, 20 bp, Artificial Sequence
  Synthetic
cautcagtcguccccaccag

SEQ ID NO: 47976 - DNA, 21 bp, Artificial Sequence
  Synthetic
tctgagtcugccccttctcut

SEQ ID NO: 47977 - DNA, 20 bp, Artificial Sequence
  Synthetic
gacaagugcagccccacaua

SEQ ID NO: 47978 - DNA, 22 bp, Artificial Sequence
  Synthetic
ctcactcuggcacctctgttut

SEQ ID NO: 47979 - DNA, 24 bp, Artificial Sequence
  Synthetic
gatgtctccautcccagatcucag

SEQ ID NO: 47980 - DNA, 20 bp, Artificial Sequence
  Synthetic
ggaccagacgcucatctuct

SEQ ID NO: 47981 - DNA, 20 bp, Artificial Sequence
  Synthetic
agaccccaccuttgcacaug

SEQ ID NO: 47982 - DNA, 22 bp, Artificial Sequence
  Synthetic
atggactguctgatcacugaca

SEQ ID NO: 47983 - DNA, 26 bp, Artificial Sequence
  Synthetic
gcaatcagttugaagaaggaaagguc

SEQ ID NO: 47984 - DNA, 27 bp, Artificial Sequence
  Synthetic
cacttggcattuctttctgtcctauct

SEQ ID NO: 47985 - DNA, 17 bp, Artificial Sequence
  Synthetic
ggacggcucaccucgat

SEQ ID NO: 47986 - DNA, 21 bp, Artificial Sequence
  Synthetic
gcagtccugtgtcaucaggaa

SEQ ID NO: 47987 - DNA, 19 bp, Artificial Sequence
  Synthetic
aucccgcagggaatuggag

SEQ ID NO: 47988 - DNA, 22 bp, Artificial Sequence
  Synthetic
gtcttgtctuggtcccttggut

SEQ ID NO: 47989 - DNA, 20 bp, Artificial Sequence
  Synthetic
ctggaggaugcccatccuac

SEQ ID NO: 47990 - DNA, 23 bp, Artificial Sequence
  Synthetic
gggtttccaacuctgaagaaugc

SEQ ID NO: 47991 - DNA, 23 bp, Artificial Sequence
  Synthetic
gtcagacugaagagaggcctuac

SEQ ID NO: 47992 - DNA, 26 bp, Artificial Sequence
  Synthetic
cacagccaaaccauatcaacaaugat

SEQ ID NO: 47993 - DNA, 22 bp, Artificial Sequence
  Synthetic
gccaaatgcucggacaatguag

SEQ ID NO: 47994 - DNA, 22 bp, Artificial Sequence
  Synthetic
ggcactcaugaagccucaaaga

SEQ ID NO: 47995 - DNA, 23 bp, Artificial Sequence
  Synthetic
agacccaagaugccccaattuac

SEQ ID NO: 47996 - DNA, 26 bp, Artificial Sequence
  Synthetic
tctctatgactaugacctcctcucca

SEQ ID NO: 47997 - DNA, 23 bp, Artificial Sequence
  Synthetic
ggugtgttgucagagaagacagg

SEQ ID NO: 47998 - DNA, 20 bp, Artificial Sequence
  Synthetic
ctgggcagccccautatcuc

SEQ ID NO: 47999 - DNA, 20 bp, Artificial Sequence
  Synthetic
cccaagggucaaggtccuac

SEQ ID NO: 48000 - DNA, 28 bp, Artificial Sequence
  Synthetic
tctaggtggatuagagtgataccttucc

SEQ ID NO: 48001 - DNA, 19 bp, Artificial Sequence
  Synthetic
ttcccutcccugagccaga

SEQ ID NO: 48002 - DNA, 22 bp, Artificial Sequence
  Synthetic
aagggaacacugcctctctcua

SEQ ID NO: 48003 - DNA, 24 bp, Artificial Sequence
  Synthetic
tgggattcuagcaatagcgctuac

SEQ ID NO: 48004 - DNA, 22 bp, Artificial Sequence
  Synthetic
ccctaaccaagugctctctguc

SEQ ID NO: 48005 - DNA, 21 bp, Artificial Sequence
  Synthetic
ctcctggacugtggcctauac

SEQ ID NO: 48006 - DNA, 20 bp, Artificial Sequence
  Synthetic
gatcaccaugggtccctguc

SEQ ID NO: 48007 - DNA, 21 bp, Artificial Sequence
  Synthetic
acaatcaggccuaggagguct

SEQ ID NO: 48008 - DNA, 24 bp, Artificial Sequence
  Synthetic
atttatgcutgacccaugacacct

SEQ ID NO: 48009 - DNA, 26 bp, Artificial Sequence
  Synthetic
ctgagacagacagugattcagatuga

SEQ ID NO: 48010 - DNA, 25 bp, Artificial Sequence
  Synthetic
gaaagaguaggcagaaaucaagaug

SEQ ID NO: 48011 - DNA, 27 bp, Artificial Sequence
  Synthetic
gctgaaattctuggttttggatcacug

SEQ ID NO: 48012 - DNA, 23 bp, Artificial Sequence
  Synthetic
acuattatgctgugcccaacagg

SEQ ID NO: 48013 - DNA, 26 bp, Artificial Sequence
  Synthetic
ctttcctgacguctgaatactcacug

SEQ ID NO: 48014 - DNA, 21 bp, Artificial Sequence
  Synthetic
ccatcugggccagttccauag

SEQ ID NO: 48015 - DNA, 23 bp, Artificial Sequence
  Synthetic
ccttaguaaggtagagtgugggt

SEQ ID NO: 48016 - DNA, 22 bp, Artificial Sequence
  Synthetic
ccgaguttgttgtucccaggat

SEQ ID NO: 48017 - DNA, 27 bp, Artificial Sequence
  Synthetic
gcttctctcacauttcctttttctguc

SEQ ID NO: 48018 - DNA, 21 bp, Artificial Sequence
  Synthetic
atctcgtccucgatgctgaug

SEQ ID NO: 48019 - DNA, 21 bp, Artificial Sequence
  Synthetic
acacgtgaucctttggtggut

SEQ ID NO: 48020 - DNA, 23 bp, Artificial Sequence
  Synthetic
acagcatccugcttgttcucaat

SEQ ID NO: 48021 - DNA, 30 bp, Artificial Sequence; identical to SEQ ID NO: 35787
  Synthetic

SEQ ID NO: 48022 - DNA, 26 bp, Artificial Sequence
  Synthetic
tcattttaggaaggagguctgtgcua

SEQ ID NO: 48023 - DNA, 22 bp, Artificial Sequence
  Synthetic
catgaggcagugagcctactuc

SEQ ID NO: 48024 - DNA, 20 bp, Artificial Sequence
  Synthetic
gggcuaaccccaccctcaua

SEQ ID NO: 48025 - DNA, 21 bp, Artificial Sequence
  Synthetic
catgctaucaccaagcacucg

SEQ ID NO: 48026 - DNA, 22 bp, Artificial Sequence
  Synthetic
gacctgggucactcaggatcua

SEQ ID NO: 48027 - DNA, 23 bp, Artificial Sequence
  Synthetic
gctacatcucctcccagatugag

SEQ ID NO: 48028 - DNA, 22 bp, Artificial Sequence
  Synthetic
ccgtccucagacccaaacatua

SEQ ID NO: 48029 - DNA, 25 bp, Artificial Sequence
  Synthetic
gcaaagggaacautatcaucagcac

SEQ ID NO: 48030 - DNA, 27 bp, Artificial Sequence
  Synthetic
gaaatgcttctugggaaattcacauga

SEQ ID NO: 48031 - DNA, 24 bp, Artificial Sequence
  Synthetic
ctgcttcttuctgttggttuccag

SEQ ID NO: 48032 - DNA, 22 bp, Artificial Sequence
  Synthetic
cgggacaaagugcaagacatuc

SEQ ID NO: 48033 - DNA, 26 bp, Artificial Sequence
  Synthetic
agtattttctccucaaggccaaguac

SEQ ID NO: 48034 - DNA, 21 bp, Artificial Sequence
  Synthetic
gactgagcaccuccaauccag

SEQ ID NO: 48035 - DNA, 26 bp, Artificial Sequence
  Synthetic
gcctcagtacuctcatttccttguag

SEQ ID NO: 48036 - DNA, 21 bp, Artificial Sequence
  Synthetic
ctgaggcuttcccaucagacc

SEQ ID NO: 48037 - DNA, 22 bp, Artificial Sequence
  Synthetic
acagtgggaaugctgcttctut

SEQ ID NO: 48038 - DNA, 25 bp, Artificial Sequence
  Synthetic
ggaaaccacacaugaacccaaatuc

SEQ ID NO: 48039 - DNA, 22 bp, Artificial Sequence
  Synthetic
cccttgaccutttcctcctugt

SEQ ID NO: 48040 - DNA, 22 bp, Artificial Sequence
  Synthetic
ccaacaacutttgcugagacct

SEQ ID NO: 48041 - DNA, 22 bp, Artificial Sequence
  Synthetic
ccaaccctcuatggcatctcuc

SEQ ID NO: 48042 - DNA, 22 bp, Artificial Sequence
  Synthetic
gcaugaagcacaacaagcaguc

SEQ ID NO: 48043 - DNA, 25 bp, Artificial Sequence
  Synthetic
ggtgaaggcauactcatcacatcuc

SEQ ID NO: 48044 - DNA, 22 bp, Artificial Sequence
  Synthetic
ctttccagcauccctgcattuc

SEQ ID NO: 48045 - DNA, 26 bp, Artificial Sequence
  Synthetic
cctcattacctugttttgcctctgua

SEQ ID NO: 48046 - DNA, 22 bp, Artificial Sequence
  Synthetic
gctgccagguaggaaugagaga

SEQ ID NO: 48047 - DNA, 23 bp, Artificial Sequence
  Synthetic
tctcgtgacugtagcaaactgug

SEQ ID NO: 48048 - DNA, 24 bp, Artificial Sequence
  Synthetic
cttcuaaaacccaacccaguagca

SEQ ID NO: 48049 - DNA, 24 bp, Artificial Sequence
  Synthetic
cacccuacccaactatgaagaugt

SEQ ID NO: 48050 - DNA, 26 bp, Artificial Sequence
  Synthetic
gactctatatuctacgactgcuccca

SEQ ID NO: 48051 - DNA, 24 bp, Artificial Sequence
  Synthetic
cctgatguagttttccucccacag

SEQ ID NO: 48052 - DNA, 24 bp, Artificial Sequence
  Synthetic
caacggaaacuccacaccatatuc

SEQ ID NO: 48053 - DNA, 31 bp, Artificial Sequence; identical to SEQ ID NO: 35819
  Synthetic

SEQ ID NO: 48054 - DNA, 22 bp, Artificial Sequence
  Synthetic
ggaaggatccaucaggaagcug

SEQ ID NO: 48055 - DNA, 24 bp, Artificial Sequence
  Synthetic
tgatggauggaaaactcactugct

SEQ ID NO: 48056 - DNA, 21 bp, Artificial Sequence
  Synthetic
cugcaatcttcuagccaccgt

SEQ ID NO: 48057 - DNA, 25 bp, Artificial Sequence
  Synthetic
cctttgttccutttgttgtggguag

SEQ ID NO: 48058 - DNA, 23 bp, Artificial Sequence
  Synthetic
ccaaagccauctgccacttcaua

SEQ ID NO: 48059 - DNA, 26 bp, Artificial Sequence
  Synthetic
gatgagtuccaagaagaaggattugc

SEQ ID NO: 48060 - DNA, 27 bp, Artificial Sequence
  Synthetic
ctcaataaatguaacaggaccuaggca

SEQ ID NO: 48061 - DNA, 22 bp, Artificial Sequence
  Synthetic
tccagatcauggttgagtuggg

SEQ ID NO: 48062 - DNA, 28 bp, Artificial Sequence
  Synthetic
gaatgatgcuagaagatgcatgttuagg

SEQ ID NO: 48063 - DNA, 25 bp, Artificial Sequence
  Synthetic
ctgggucaaacagatgauaccagat

SEQ ID NO: 48064 - DNA, 29 bp, Artificial Sequence
  Synthetic
aaaaagatactuagcacttcgaagatucc

SEQ ID NO: 48065 - DNA, 28 bp, Artificial Sequence
  Synthetic
gcatcatcuacaagcccaaaacuaaaga

SEQ ID NO: 48066 - DNA, 23 bp, Artificial Sequence
  Synthetic
actgatctuacaccaagcatucc

SEQ ID NO: 48067 - DNA, 20 bp, Artificial Sequence
  Synthetic
gagaggtgcugtcccttgut

SEQ ID NO: 48068 - DNA, 21 bp, Artificial Sequence
  Synthetic
actcctgagccuggaatccut

SEQ ID NO: 48069 - DNA, 22 bp, Artificial Sequence
  Synthetic
cgtttctttuccttccccagug

SEQ ID NO: 48070 - DNA, 19 bp, Artificial Sequence
  Synthetic
gttcgggacguccatcugt

SEQ ID NO: 48071 - DNA, 17 bp, Artificial Sequence
  Synthetic
gaggccccugcttccuc

SEQ ID NO: 48072 - DNA, 22 bp, Artificial Sequence
  Synthetic
ctatucccgggacctttuccag

SEQ ID NO: 48073 - DNA, 24 bp, Artificial Sequence
  Synthetic
caacugtgtgttugaaggcaagag

SEQ ID NO: 48074 - DNA, 23 bp, Artificial Sequence
  Synthetic
cttgguggaaagaugggaaggaa

SEQ ID NO: 48075 - DNA, 27 bp, Artificial Sequence
  Synthetic
ggctacagaaugatactctgtcucaat

SEQ ID NO: 48076 - DNA, 31 bp, Artificial Sequence; identical to SEQ ID NO: 35842
  Synthetic

SEQ ID NO: 48077 - DNA, 19 bp, Artificial Sequence
  Synthetic
gcccacagcucggactuac

SEQ ID NO: 48078 - DNA, 28 bp, Artificial Sequence
  Synthetic
ggtattaatgcauttgtttggtagcugt

SEQ ID NO: 48079 - DNA, 23 bp, Artificial Sequence
  Synthetic
tccctctucaccctggaacttua

SEQ ID NO: 48080 - DNA, 22 bp, Artificial Sequence
  Synthetic
tgcaagcccuggctaatuacag

SEQ ID NO: 48081 - DNA, 24 bp, Artificial Sequence
  Synthetic
gcaaagttucaactctcagucagg

SEQ ID NO: 48082 - DNA, 23 bp, Artificial Sequence
  Synthetic
gcccagaccucagtgttttcaut

SEQ ID NO: 48083 - DNA, 23 bp, Artificial Sequence
  Synthetic
cccttacugggtatagctcucac

SEQ ID NO: 48084 - DNA, 22 bp, Artificial Sequence
  Synthetic
gccccaguagccctgttttuat

SEQ ID NO: 48085 - DNA, 30 bp, Artificial Sequence; identical to SEQ ID NO: 35851
  Synthetic

SEQ ID NO: 48086 - DNA, 24 bp, Artificial Sequence
  Synthetic
ctcucataccacaugaaaccagca

SEQ ID NO: 48087 - DNA, 27 bp, Artificial Sequence
  Synthetic
cctagaagaaugggattcatcacugat

SEQ ID NO: 48088 - DNA, 24 bp, Artificial Sequence
  Synthetic
gggcttttcuggtcacaguaacaa

SEQ ID NO: 48089 - DNA, 24 bp, Artificial Sequence
  Synthetic
cacataagcccugagaagtgtuca

SEQ ID NO: 48090 - DNA, 20 bp, Artificial Sequence
  Synthetic
ctgacgcugctgaagacgua

SEQ ID NO: 48091 - DNA, 25 bp, Artificial Sequence
  Synthetic
cccctgaaucaaagctgtgtacaua

SEQ ID NO: 48092 - DNA, 23 bp, Artificial Sequence
  Synthetic
caaaggcauggatugcacaaaga

SEQ ID NO: 48093 - DNA, 20 bp, Artificial Sequence
  Synthetic
cucagagctcuccagcaact

SEQ ID NO: 48094 - DNA, 24 bp, Artificial Sequence
  Synthetic
catgaaggacgguacatccugaat

SEQ ID NO: 48095 - DNA, 22 bp, Artificial Sequence
  Synthetic
ggacttcugagccttcugagga

SEQ ID NO: 48096 - DNA, 26 bp, Artificial Sequence
  Synthetic
cagcagaacuaaagggagaagcaaua

SEQ ID NO: 48097 - DNA, 29 bp, Artificial Sequence
  Synthetic
gactcattgaatuaaatcagcaaggauga

SEQ ID NO: 48098 - DNA, 23 bp, Artificial Sequence
  Synthetic
ctgttgtaugccacctacttgut

SEQ ID NO: 48099 - DNA, 22 bp, Artificial Sequence
  Synthetic
cactcucccctgaucaaacacc

SEQ ID NO: 48100 - DNA, 29 bp, Artificial Sequence
  Synthetic
ctaaatagccccaaguattagcuagaaac

SEQ ID NO: 48101 - DNA, 23 bp, Artificial Sequence
  Synthetic
tgttcgtcatugcctccatcauc

SEQ ID NO: 48102 - DNA, 24 bp, Artificial Sequence
  Synthetic
tctgcctgtutgttagcacaugat

SEQ ID NO: 48103 - DNA, 21 bp, Artificial Sequence
  Synthetic
cacctaccacutcgtcaugca

SEQ ID NO: 48104 - DNA, 27 bp, Artificial Sequence
  Synthetic
tctaactggtacugagagcctatgaut

SEQ ID NO: 48105 - DNA, 23 bp, Artificial Sequence
  Synthetic
tgagatcatcgucacccacttuc

SEQ ID NO: 48106 - DNA, 20 bp, Artificial Sequence
  Synthetic
cagtggugagaagcatuccg

SEQ ID NO: 48107 - DNA, 23 bp, Artificial Sequence
  Synthetic
agatgactauggcggtgugaaaa

SEQ ID NO: 48108 - DNA, 21 bp, Artificial Sequence
  Synthetic
cgacgtgcucacactgttuca

SEQ ID NO: 48109 - DNA, 26 bp, Artificial Sequence
  Synthetic
cactaggtcttuctccttttctgugg

SEQ ID NO: 48110 - DNA, 18 bp, Artificial Sequence
  Synthetic
gcccccagugctcttguc

SEQ ID NO: 48111 - DNA, 22 bp, Artificial Sequence
  Synthetic
gttggtgtcauctgctgtcuca

SEQ ID NO: 48112 - DNA, 26 bp, Artificial Sequence
  Synthetic
acagttcagaaagautagtccgtgug

SEQ ID NO: 48113 - DNA, 27 bp, Artificial Sequence
  Synthetic
gaaacaagauggtggactttauaccct

SEQ ID NO: 48114 - DNA, 24 bp, Artificial Sequence
  Synthetic
auttttctuccaccacaggaccat

SEQ ID NO: 48115 - DNA, 30 bp, Artificial Sequence; identical to SEQ ID NO: 35881
  Synthetic

SEQ ID NO: 48116 - DNA, 20 bp, Artificial Sequence
  Synthetic
aggacaugcttugggcagac

SEQ ID NO: 48117 - DNA, 23 bp, Artificial Sequence
  Synthetic
actgtgtauctgctatgcuccac

SEQ ID NO: 48118 - DNA, 21 bp, Artificial Sequence
  Synthetic
acuggccacggaaattttugg

SEQ ID NO: 48119 - DNA, 28 bp, Artificial Sequence
  Synthetic
tccacatcugaagaacttcaacattuct

SEQ ID NO: 48120 - DNA, 30 bp, Artificial Sequence; identical to SEQ ID NO: 35886
  Synthetic

SEQ ID NO: 48121 - DNA, 23 bp, Artificial Sequence
  Synthetic
gcgaucagaccctaaccaucaag

SEQ ID NO: 48122 - DNA, 27 bp, Artificial Sequence
  Synthetic
ccttcgtttaugctcatctgaguagaa

SEQ ID NO: 48123 - DNA, 28 bp, Artificial Sequence
  Synthetic
gatgucagaggcaaaatcucaagaaaag

SEQ ID NO: 48124 - DNA, 25 bp, Artificial Sequence
  Synthetic
gtggguaaaaacaaaagccaaccua

SEQ ID NO: 48125 - DNA, 26 bp, Artificial Sequence
  Synthetic
caaatcauttgcattcuacaggccat

SEQ ID NO: 48126 - DNA, 27 bp, Artificial Sequence
  Synthetic
tgtatccugcaacccagtaacaatuac

SEQ ID NO: 48127 - DNA, 24 bp, Artificial Sequence
  Synthetic
tgagatttcuggtgaagguggaac

SEQ ID NO: 48128 - DNA, 22 bp, Artificial Sequence
  Synthetic
caggtgaccucttttgccctua

SEQ ID NO: 48129 - DNA, 25 bp, Artificial Sequence
  Synthetic
aagcagutaagtcuccaaaacgagt

SEQ ID NO: 48130 - DNA, 21 bp, Artificial Sequence
  Synthetic
ccacgctguaattgcccucat

SEQ ID NO: 48131 - DNA, 25 bp, Artificial Sequence
  Synthetic
tttggcagcaagaautcuaacaaag

SEQ ID NO: 48132 - DNA, 25 bp, Artificial Sequence
  Synthetic
catctgtgatutcacttcccugaca

SEQ ID NO: 48133 - DNA, 21 bp, Artificial Sequence
  Synthetic
ctgtgugcaccaacuacaagg

SEQ ID NO: 48134 - DNA, 31 bp, Artificial Sequence; identical to SEQ ID NO: 35900
  Synthetic

SEQ ID NO: 48135 - DNA, 27 bp, Artificial Sequence
  Synthetic
agatttgagagguctgcaagattugat

SEQ ID NO: 48136 - DNA, 23 bp, Artificial Sequence
  Synthetic
cagacacuggcctcattaacuca

SEQ ID NO: 48137 - DNA, 25 bp, Artificial Sequence
  Synthetic
cacccagcauctctcagaauacaaa

SEQ ID NO: 48138 - DNA, 24 bp, Artificial Sequence
  Synthetic
cttcgttgggaugtgataggtuga

SEQ ID NO: 48139 - DNA, 27 bp, Artificial Sequence
  Synthetic
gaattactccuccccattgatgacuac

SEQ ID NO: 48140 - DNA, 25 bp, Artificial Sequence
  Synthetic
gctggtcucactatctcaagaucat

SEQ ID NO: 48141 - DNA, 25 bp, Artificial Sequence
  Synthetic
cagtatgaaaugcctgggaaactug

SEQ ID NO: 48142 - DNA, 22 bp, Artificial Sequence
  Synthetic
atccggagutttctctccucct

SEQ ID NO: 48143 - DNA, 25 bp, Artificial Sequence
  Synthetic
gcgacacguacaaaaacaaatugac

SEQ ID NO: 48144 - DNA, 22 bp, Artificial Sequence
  Synthetic
cttcaggcaaagugtcccugat

SEQ ID NO: 48145 - DNA, 27 bp, Artificial Sequence
  Synthetic
ccacctccaacagauagtacctuaaga

SEQ ID NO: 48146 - DNA, 29 bp, Artificial Sequence
  Synthetic
ctgactcaaatgugtacttcttgtcatug

SEQ ID NO: 48147 - DNA, 25 bp, Artificial Sequence
  Synthetic
actgccguagaaccaugaagaaaat

SEQ ID NO: 48148 - DNA, 21 bp, Artificial Sequence
  Synthetic
gatggccacuccatcttcgua

SEQ ID NO: 48149 - DNA, 23 bp, Artificial Sequence
  Synthetic
cgatcucagaagggagtgagugt

SEQ ID NO: 48150 - DNA, 24 bp, Artificial Sequence
  Synthetic
ctatcttcugcttcaaccaugggt

SEQ ID NO: 48151 - DNA, 27 bp, Artificial Sequence
  Synthetic
ggaacactgguatatgtgctatugagt

SEQ ID NO: 48152 - DNA, 23 bp, Artificial Sequence
  Synthetic
ctgacgggcutgaccaaattcua

SEQ ID NO: 48153 - DNA, 26 bp, Artificial Sequence
  Synthetic
aggacttgacauatttgagcgcatua

SEQ ID NO: 48154 - DNA, 26 bp, Artificial Sequence
  Synthetic
cctgatcaguccctttgacttuaaca

SEQ ID NO: 48155 - DNA, 30 bp, Artificial Sequence; identical to SEQ ID NO: 35921
  Synthetic

SEQ ID NO: 48156 - DNA, 27 bp, Artificial Sequence
  Synthetic
aagttgatcacgguataacgtgttuct

SEQ ID NO: 48157 - DNA, 27 bp, Artificial Sequence
  Synthetic
gaattgaucagaagacagttgaacugg

SEQ ID NO: 48158 - DNA, 26 bp, Artificial Sequence
  Synthetic
acttggtaguggccattattgucaat

SEQ ID NO: 48159 - DNA, 29 bp, Artificial Sequence
  Synthetic
cacttaaacacauactgttagatgtugct

SEQ ID NO: 48160 - DNA, 31 bp, Artificial Sequence; identical to SEQ ID NO: 35926
  Synthetic

SEQ ID NO: 48161 - DNA, 25 bp, Artificial Sequence
  Synthetic
actcccaaatcugatgtcccaatuc

SEQ ID NO: 48162 - DNA, 28 bp, Artificial Sequence
  Synthetic
agtttctcgaauttcttctgttgucaca

SEQ ID NO: 48163 - DNA, 30 bp, Artificial Sequence; identical to SEQ ID NO: 35929
  Synthetic

SEQ ID NO: 48164 - DNA, 26 bp, Artificial Sequence
  Synthetic
gtgaggttcacaautctacaggtugt

SEQ ID NO: 48165 - DNA, 25 bp, Artificial Sequence
  Synthetic
ccacaautgtatttucccccaacag

SEQ ID NO: 48166 - DNA, 24 bp, Artificial Sequence
  Synthetic
caaaaacattgcugagctggacut

SEQ ID NO: 48167 - DNA, 26 bp, Artificial Sequence
  Synthetic
gttatgtacatuggtcgtccaguacc

SEQ ID NO: 48168 - DNA, 23 bp, Artificial Sequence
  Synthetic
gctugcaggagaagcttacuact

SEQ ID NO: 48169 - DNA, 29 bp, Artificial Sequence
  Synthetic
ttcctgacatuaaatggtacagattuggt

SEQ ID NO: 48170 - DNA, 28 bp, Artificial Sequence
  Synthetic
gggaattagccutaacttgtttagttug

SEQ ID NO: 48171 - DNA, 24 bp, Artificial Sequence
  Synthetic
cagtgccuggaagaagagcaauaa

SEQ ID NO: 48172 - DNA, 24 bp, Artificial Sequence
  Synthetic
gaccaaacauggcttgcttcttua

SEQ ID NO: 48173 - DNA, 22 bp, Artificial Sequence
  Synthetic
ctgacaagugggucagacacaa

SEQ ID NO: 48174 - DNA, 28 bp, Artificial Sequence
  Synthetic
cagtcccaaguattataagccaaugact

SEQ ID NO: 48175 - DNA, 25 bp, Artificial Sequence
  Synthetic
gtggtaaaaggccucaaagagaaug

SEQ ID NO: 48176 - DNA, 20 bp, Artificial Sequence
  Synthetic
cacagagcggacutggaugt

SEQ ID NO: 48177 - DNA, 25 bp, Artificial Sequence
  Synthetic
ccaggatattaguaagcgtgccaug

SEQ ID NO: 48178 - DNA, 28 bp, Artificial Sequence
  Synthetic
gggactaagaaauaagtctatggcaaut

SEQ ID NO: 48179 - DNA, 26 bp, Artificial Sequence
  Synthetic
tcaacatgaauggaccaagtguaaca

SEQ ID NO: 48180 - DNA, 31 bp, Artificial Sequence; identical to SEQ ID NO: 35946
  Synthetic

SEQ ID NO: 48181 - DNA, 26 bp, Artificial Sequence
  Synthetic
ggtccgtguaaataaagtacctguga

SEQ ID NO: 48182 - DNA, 20 bp, Artificial Sequence
  Synthetic
tggaagggccugtggactua

SEQ ID NO: 48183 - DNA, 22 bp, Artificial Sequence
  Synthetic
tgctccacugagtggttatgug

SEQ ID NO: 48184 - DNA, 28 bp, Artificial Sequence
  Synthetic
acttcaaatcaaaautgggtgacugaac

SEQ ID NO: 48185 - DNA, 28 bp, Artificial Sequence
  Synthetic
tgtcacagttgaaacucacactaaagua

SEQ ID NO: 48186 - DNA, 26 bp, Artificial Sequence
  Synthetic
gctatttggtacauacctctgagguc

SEQ ID NO: 48187 - DNA, 25 bp, Artificial Sequence
  Synthetic
cagagagauggatgaaggttgucac

SEQ ID NO: 48188 - DNA, 22 bp, Artificial Sequence
  Synthetic
ctgagaccaguactgcaucaga

SEQ ID NO: 48189 - DNA, 22 bp, Artificial Sequence
  Synthetic
attcccacgautgatgguggag

SEQ ID NO: 48190 - DNA, 27 bp, Artificial Sequence
  Synthetic
agaggtgatcaaucataggtcaagcua

SEQ ID NO: 48191 - DNA, 20 bp, Artificial Sequence
  Synthetic
ctugcaagccgggcaatuat

SEQ ID NO: 48192 - DNA, 30 bp, Artificial Sequence; identical to SEQ ID NO: 35958
  Synthetic

SEQ ID NO: 48193 - DNA, 21 bp, Artificial Sequence
  Synthetic
gccgtgaacgugaagggtaug

SEQ ID NO: 48194 - DNA, 25 bp, Artificial Sequence
  Synthetic
tgatcagtgtccutctcttgcatut

SEQ ID NO: 48195 - DNA, 31 bp, Artificial Sequence; identical to SEQ ID NO: 35961
  Synthetic

SEQ ID NO: 48196 - DNA, 22 bp, Artificial Sequence
  Synthetic
actgtuaccagctgcatucact

SEQ ID NO: 48197 - DNA, 27 bp, Artificial Sequence
  Synthetic
gcataucatcattcaguggacaaaacc

SEQ ID NO: 48198 - DNA, 23 bp, Artificial Sequence
  Synthetic
tgataagacugcccttctcccut

SEQ ID NO: 48199 - DNA, 23 bp, Artificial Sequence
  Synthetic
cgaatgcccaacccuatcctaug

SEQ ID NO: 48200 - DNA, 24 bp, Artificial Sequence
  Synthetic
tgcccacacuggaaaatgctauat

SEQ ID NO: 48201 - DNA, 26 bp, Artificial Sequence
  Synthetic
tctctgugaaaaagtctcttugcagt

SEQ ID NO: 48202 - DNA, 22 bp, Artificial Sequence
  Synthetic
gagcugtcaguaggcaaaacag

SEQ ID NO: 48203 - DNA, 22 bp, Artificial Sequence
  Synthetic
gtgacugctctcagugaaggag

SEQ ID NO: 48204 - DNA, 22 bp, Artificial Sequence
  Synthetic
caaccttgcugcctccatcaua

SEQ ID NO: 48205 - DNA, 28 bp, Artificial Sequence
  Synthetic
gttggtatguatcacaattuaagggcat

SEQ ID NO: 48206 - DNA, 30 bp, Artificial Sequence; identical to SEQ ID NO: 35972
  Synthetic

SEQ ID NO: 48207 - DNA, 21 bp, Artificial Sequence
  Synthetic
agcgtgaaucggguacaacag

SEQ ID NO: 48208 - DNA, 23 bp, Artificial Sequence
  Synthetic
ccacaactgugacgctaaatgut

SEQ ID NO: 48209 - DNA, 23 bp, Artificial Sequence
  Synthetic
caggaagcccauttaccatugac

SEQ ID NO: 48210 - DNA, 24 bp, Artificial Sequence
  Synthetic
ttggcctucacacggaattcauat

SEQ ID NO: 48211 - DNA, 23 bp, Artificial Sequence
  Synthetic
atactagcaaaucctccgcaguc

SEQ ID NO: 48212 - DNA, 25 bp, Artificial Sequence
  Synthetic
tcattgaccutgaagatcugacgag

SEQ ID NO: 48213 - DNA, 26 bp, Artificial Sequence
  Synthetic
ggtagtaagucaatcacatucaccgt

SEQ ID NO: 48214 - DNA, 24 bp, Artificial Sequence
  Synthetic
ctgutgtatggataucagcccgaa

SEQ ID NO: 48215 - DNA, 29 bp, Artificial Sequence
  Synthetic
ggttaacagcucctgagttagacauagat

SEQ ID NO: 48216 - DNA, 23 bp, Artificial Sequence
  Synthetic
ttttcacacaugcctctgcatuc

SEQ ID NO: 48217 - DNA, 24 bp, Artificial Sequence
  Synthetic
gcaagtggcauctcaagactcaut

SEQ ID NO: 48218 - DNA, 28 bp, Artificial Sequence
  Synthetic
ccatcttgtgcutttcttttctcttcut

SEQ ID NO: 48219 - DNA, 27 bp, Artificial Sequence
  Synthetic
caagcaaatgcauctaattgattuggg

SEQ ID NO: 48220 - DNA, 22 bp, Artificial Sequence
  Synthetic
caattagugcccaggcaaguct

SEQ ID NO: 48221 - DNA, 29 bp, Artificial Sequence
  Synthetic
agacatgccuagttgtattttaauggaca

SEQ ID NO: 48222 - DNA, 21 bp, Artificial Sequence
  Synthetic
cgatggucccgagtagcauct

SEQ ID NO: 48223 - DNA, 28 bp, Artificial Sequence
  Synthetic
attattaaguccggagagagcctuagaa

SEQ ID NO: 48224 - DNA, 28 bp, Artificial Sequence
  Synthetic
aaatgtgaatgcucttagtctcatugga

SEQ ID NO: 48225 - DNA, 20 bp, Artificial Sequence
  Synthetic
caaggaaaugaacgcugggt

SEQ ID NO: 48226 - DNA, 28 bp, Artificial Sequence
  Synthetic
augtaagaaggtgaugcagagaagaaaa

SEQ ID NO: 48227 - DNA, 22 bp, Artificial Sequence
  Synthetic
ccactggacuggtagaagguct

SEQ ID NO: 48228 - DNA, 24 bp, Artificial Sequence
  Synthetic
tgacatgccaucagaagtcacaut

SEQ ID NO: 48229 - DNA, 26 bp, Artificial Sequence
  Synthetic
ttcacaaactaacuggaagatggugt

SEQ ID NO: 48230 - DNA, 23 bp, Artificial Sequence
  Synthetic
ccaagggugatgactgtaauggg

SEQ ID NO: 48231 - DNA, 28 bp, Artificial Sequence
  Synthetic
cacaatgtgcaccutgaattaccttaua

SEQ ID NO: 48232 - DNA, 26 bp, Artificial Sequence
  Synthetic
tcagtccuttctcattttuggcaaac

SEQ ID NO: 48233 - DNA, 29 bp, Artificial Sequence
  Synthetic
tgatctcucaatgaaagacucaacaaaga

SEQ ID NO: 48234 - DNA, 25 bp, Artificial Sequence
  Synthetic
aggatgtgcuagaacatttgtguga

SEQ ID NO: 48235 - DNA, 26 bp, Artificial Sequence
  Synthetic
gaacctaagtcutcaactgtgagugt

SEQ ID NO: 48236 - DNA, 22 bp, Artificial Sequence
  Synthetic
gtatcuggcatcacugccaaga

SEQ ID NO: 48237 - DNA, 28 bp, Artificial Sequence
  Synthetic
agcatactuccaggaaatcactctttut

SEQ ID NO: 48238 - DNA, 23 bp, Artificial Sequence
  Synthetic
guttacagcagauacccggaagt

SEQ ID NO: 48239 - DNA, 23 bp, Artificial Sequence
  Synthetic
caaccaagtcauccatcacccut

SEQ ID NO: 48240 - DNA, 22 bp, Artificial Sequence
  Synthetic
caggtgaagaugctgcagguat

SEQ ID NO: 48241 - DNA, 31 bp, Artificial Sequence; identical to SEQ ID NO: 36007
  Synthetic

SEQ ID NO: 48242 - DNA, 23 bp, Artificial Sequence
  Synthetic
aagcataugcacaggttagcgua

SEQ ID NO: 48243 - DNA, 26 bp, Artificial Sequence
  Synthetic
ggtctatggugtctgaacattuggaa

SEQ ID NO: 48244 - DNA, 26 bp, Artificial Sequence
  Synthetic
ggacaaaacacgaugttagtactuct

SEQ ID NO: 48245 - DNA, 28 bp, Artificial Sequence
  Synthetic
atcgccttaataguggatgctatgaaut

SEQ ID NO: 48246 - DNA, 23 bp, Artificial Sequence
  Synthetic
cactcaataguaggcgcaggtut

SEQ ID NO: 48247 - DNA, 29 bp, Artificial Sequence
  Synthetic
ccttactttaaggutggtgcaactattut

SEQ ID NO: 48248 - DNA, 24 bp, Artificial Sequence
  Synthetic
ctgagucaagccagagatgaugaa

SEQ ID NO: 48249 - DNA, 28 bp, Artificial Sequence
  Synthetic
cgctaatcugcttctcttatuaccacag

SEQ ID NO: 48250 - DNA, 24 bp, Artificial Sequence
  Synthetic
gttttccaacuccagcagcattut

SEQ ID NO: 48251 - DNA, 21 bp, Artificial Sequence
  Synthetic
gcagtgcagucgtaggctauc

SEQ ID NO: 48252 - DNA, 25 bp, Artificial Sequence
  Synthetic
aggugttgcuacaaaagagagaaat

SEQ ID NO: 48253 - DNA, 27 bp, Artificial Sequence
  Synthetic
atgaaacugaccacaggagaagaauac

SEQ ID NO: 48254 - DNA, 26 bp, Artificial Sequence
  Synthetic
ccatttgagagucacactttctucag

SEQ ID NO: 48255 - DNA, 24 bp, Artificial Sequence
  Synthetic
cccctuaaggcaaccatgagatut

SEQ ID NO: 48256 - DNA, 29 bp, Artificial Sequence
  Synthetic
cacaaaattagacauacctagttgcucct

SEQ ID NO: 48257 - DNA, 28 bp, Artificial Sequence
  Synthetic
gutgaagcacuagaaaaaggacagaaaa

SEQ ID NO: 48258 - DNA, 30 bp, Artificial Sequence; identical to SEQ ID NO: 36024
  Synthetic

SEQ ID NO: 48259 - DNA, 22 bp, Artificial Sequence
  Synthetic
gcaagaaagcaugggtctcugt

SEQ ID NO: 48260 - DNA, 28 bp, Artificial Sequence
  Synthetic
gggtatcuaaaactttgacaacuaaggt

SEQ ID NO: 48261 - DNA, 21 bp, Artificial Sequence
  Synthetic
ccttuccgaggaagaccagua

SEQ ID NO: 48262 - DNA, 30 bp, Artificial Sequence; identical to SEQ ID NO: 36028
  Synthetic

SEQ ID NO: 48263 - DNA, 25 bp, Artificial Sequence
  Synthetic
tgtggacucaggcaagacaactaua

SEQ ID NO: 48264 - DNA, 24 bp, Artificial Sequence
  Synthetic
gcagcautttctgcauaaacacga

SEQ ID NO: 48265 - DNA, 28 bp, Artificial Sequence
  Synthetic
cgtctttggaaautacttctgugaccaa

SEQ ID NO: 48266 - DNA, 28 bp, Artificial Sequence
  Synthetic
acttggttacttuacaggatgtcatcug

SEQ ID NO: 48267 - DNA, 22 bp, Artificial Sequence
  Synthetic
tctguggccgttaatugcaaag

SEQ ID NO: 48268 - DNA, 31 bp, Artificial Sequence; identical to SEQ ID NO: 36034
  Synthetic

SEQ ID NO: 48269 - DNA, 22 bp, Artificial Sequence
  Synthetic
aaggaatgcugctgactcagut

SEQ ID NO: 48270 - DNA, 26 bp, Artificial Sequence
  Synthetic
ctgtgatcttagcuccaccatcauaa

SEQ ID NO: 48271 - DNA, 22 bp, Artificial Sequence
  Synthetic
caaatgaaaguctccggcctug

SEQ ID NO: 48272 - DNA, 23 bp, Artificial Sequence
  Synthetic
caagcatgguagattttguggca

SEQ ID NO: 48273 - DNA, 25 bp, Artificial Sequence
  Synthetic
cacctctacaacauggcacatagut

SEQ ID NO: 48274 - DNA, 22 bp, Artificial Sequence
  Synthetic
gtccuggtctgucaaggacaat

SEQ ID NO: 48275 - DNA, 26 bp, Artificial Sequence
  Synthetic
caagcuactgtgaacuggagaaaaga

SEQ ID NO: 48276 - DNA, 26 bp, Artificial Sequence
  Synthetic
ttgtcttggaucacttcttcccttut

SEQ ID NO: 48277 - DNA, 27 bp, Artificial Sequence
  Synthetic
cagcaaaattacuggttatgtggtuga

SEQ ID NO: 48278 - DNA, 25 bp, Artificial Sequence
  Synthetic
ctggcaaaccaaucccatattcaut

SEQ ID NO: 48279 - DNA, 25 bp, Artificial Sequence
  Synthetic
aagtgaagaaagacucagtgacgut

SEQ ID NO: 48280 - DNA, 27 bp, Artificial Sequence
  Synthetic
cgaccactgucaaatctggtaacatua

SEQ ID NO: 48281 - DNA, 25 bp, Artificial Sequence
  Synthetic
ccaccagaaauagaactcgatgcug

SEQ ID NO: 48282 - DNA, 26 bp, Artificial Sequence
  Synthetic
gtgttttcttuaagcttggtcacugt

SEQ ID NO: 48283 - DNA, 22 bp, Artificial Sequence
  Synthetic
cccaagcaauccaaaagugacg

SEQ ID NO: 48284 - DNA, 21 bp, Artificial Sequence
  Synthetic
tgagccgcagauccgttaaug

SEQ ID NO: 48285 - DNA, 20 bp, Artificial Sequence
  Synthetic
ggcctgtuacggcctguaat

SEQ ID NO: 48286 - DNA, 23 bp, Artificial Sequence
  Synthetic
gttaagggccugtacctcagtug

SEQ ID NO: 48287 - DNA, 27 bp, Artificial Sequence
  Synthetic
gtggtacaaaguctatacccatcacug

SEQ ID NO: 48288 - DNA, 27 bp, Artificial Sequence
  Synthetic
cattctagcagcugtttcttcaagtuc

SEQ ID NO: 48289 - DNA, 26 bp, Artificial Sequence
  Synthetic
caagaaatgcagcuggaaacttuagt

SEQ ID NO: 48290 - DNA, 26 bp, Artificial Sequence
  Synthetic
acctgttatttugctaccaccaucat

SEQ ID NO: 48291 - DNA, 25 bp, Artificial Sequence
  Synthetic
gggccttgaguatgagttcaaagut

SEQ ID NO: 48292 - DNA, 27 bp, Artificial Sequence
  Synthetic
ttctttctgutcaagatgguagccaat

SEQ ID NO: 48293 - DNA, 28 bp, Artificial Sequence
  Synthetic
cggagtaccaguttagaatttttgcuga

SEQ ID NO: 48294 - DNA, 22 bp, Artificial Sequence
  Synthetic
ccaccagtauaggctggaggut

SEQ ID NO: 48295 - DNA, 27 bp, Artificial Sequence
  Synthetic
gctacctcaacugttttgcacatuaaa

SEQ ID NO: 48296 - DNA, 31 bp, Artificial Sequence; identical to SEQ ID NO: 36062
  Synthetic

SEQ ID NO: 48297 - DNA, 26 bp, Artificial Sequence
  Synthetic
tgttactgguttgagttcuggacaag

SEQ ID NO: 48298 - DNA, 21 bp, Artificial Sequence
  Synthetic
gtcugggacacatcagugagt

SEQ ID NO: 48299 - DNA, 26 bp, Artificial Sequence
  Synthetic
agtcaaucagaaaagcguatgcuaat

SEQ ID NO: 48300 - DNA, 28 bp, Artificial Sequence
  Synthetic
gtcaagaacuttcacagtuacaaaagca

SEQ ID NO: 48301 - DNA, 22 bp, Artificial Sequence
  Synthetic
ctggtggauctgccagaatuca

SEQ ID NO: 48302 - DNA, 21 bp, Artificial Sequence
  Synthetic
gttgagggcacagacucguat

SEQ ID NO: 48303 - DNA, 30 bp, Artificial Sequence; identical to SEQ ID NO: 36069
  Synthetic

SEQ ID NO: 48304 - DNA, 28 bp, Artificial Sequence
  Synthetic
catgatcttctgutaatcctgtcacuct

SEQ ID NO: 48305 - DNA, 25 bp, Artificial Sequence
  Synthetic
aaaaatccattugtgcttccuggac

SEQ ID NO: 48306 - DNA, 24 bp, Artificial Sequence
  Synthetic
caacttcugaagcaacaacagucc

SEQ ID NO: 48307 - DNA, 28 bp, Artificial Sequence
  Synthetic
caggttctaagucattcccagtaaaugt

SEQ ID NO: 48308 - DNA, 30 bp, Artificial Sequence; identical to SEQ ID NO: 36074
  Synthetic

SEQ ID NO: 48309 - DNA, 25 bp, Artificial Sequence
  Synthetic
caataacugccaaggatgaggtuga

SEQ ID NO: 48310 - DNA, 21 bp, Artificial Sequence
  Synthetic
agcuagctttcauccaacgac

SEQ ID NO: 48311 - DNA, 25 bp, Artificial Sequence
  Synthetic
aaagcaagcaagaautctgaaugct

SEQ ID NO: 48312 - DNA, 27 bp, Artificial Sequence
  Synthetic
tgttgacctttguccacaaaatacugt

SEQ ID NO: 48313 - DNA, 27 bp, Artificial Sequence
  Synthetic
cttagagtctgauccaattgtagcuca

SEQ ID NO: 48314 - DNA, 27 bp, Artificial Sequence
  Synthetic
gtagttcuagcaacaguagcagaaaca

SEQ ID NO: 48315 - DNA, 26 bp, Artificial Sequence
  Synthetic
agaagacagcauccatcgaaattgua

SEQ ID NO: 48316 - DNA, 26 bp, Artificial Sequence
  Synthetic
gggagaccauctttagtccagguaat

SEQ ID NO: 48317 - DNA, 29 bp, Artificial Sequence
  Synthetic
gggaagaatatcuttttagagttgtugct

SEQ ID NO: 48318 - DNA, 26 bp, Artificial Sequence
  Synthetic
catcatgttcaggutttgtccaacuc

SEQ ID NO: 48319 - DNA, 28 bp, Artificial Sequence
  Synthetic
tgctgttguaactaactgccauaagaat

SEQ ID NO: 48320 - DNA, 25 bp, Artificial Sequence
  Synthetic
actttcaggtuaacaggtggactug

SEQ ID NO: 48321 - DNA, 25 bp, Artificial Sequence
  Synthetic
cgtccuacaccagaagttaaauggg

SEQ ID NO: 48322 - DNA, 25 bp, Artificial Sequence
  Synthetic
actataatagguccagggacgucag

SEQ ID NO: 48323 - DNA, 27 bp, Artificial Sequence
  Synthetic
gtggctgtgaaautcaaggatacatug

SEQ ID NO: 48324 - DNA, 22 bp, Artificial Sequence
  Synthetic
gcttggutcactaaguccagca

SEQ ID NO: 48325 - DNA, 25 bp, Artificial Sequence
  Synthetic
cagtgaccaaggacucaatgatugt

SEQ ID NO: 48326 - DNA, 29 bp, Artificial Sequence
  Synthetic
acggaaagtauattcattgcctucaagaa

SEQ ID NO: 48327 - DNA, 25 bp, Artificial Sequence
  Synthetic
cacctgaaggaccugttgttatcuc

SEQ ID NO: 48328 - DNA, 20 bp, Artificial Sequence
  Synthetic
tgagactgguggcaaagucg

SEQ ID NO: 48329 - DNA, 24 bp, Artificial Sequence
  Synthetic
aaagcacaggagcaauaacagcua

SEQ ID NO: 48330 - DNA, 25 bp, Artificial Sequence
  Synthetic
gccctcagguaattctttcttcuca

SEQ ID NO: 48331 - DNA, 24 bp, Artificial Sequence
  Synthetic
attggcaagccgaguaaagtauca

SEQ ID NO: 48332 - DNA, 26 bp, Artificial Sequence
  Synthetic
cttgcgttcuagatgatagccaauga

SEQ ID NO: 48333 - DNA, 30 bp, Artificial Sequence; identical to SEQ ID NO: 36099
  Synthetic

SEQ ID NO: 48334 - DNA, 26 bp, Artificial Sequence
  Synthetic
ggcccuaggaaagaguaatactauca

SEQ ID NO: 48335 - DNA, 31 bp, Artificial Sequence; identical to SEQ ID NO: 36101
  Synthetic

SEQ ID NO: 48336 - DNA, 24 bp, Artificial Sequence
  Synthetic
ctggtggaaugacaagatcttugg

SEQ ID NO: 48337 - DNA, 21 bp, Artificial Sequence
  Synthetic
atggaggcagccgaautcuag

SEQ ID NO: 48338 - DNA, 25 bp, Artificial Sequence
  Synthetic
ccauattcattttcugcgagaaccc

SEQ ID NO: 48339 - DNA, 29 bp, Artificial Sequence
  Synthetic
gatctgaagguaaaagaggtcacuaagac

SEQ ID NO: 48340 - DNA, 27 bp, Artificial Sequence
  Synthetic
gtttacauttccaacaauaagcagggt

SEQ ID NO: 48341 - DNA, 23 bp, Artificial Sequence
  Synthetic
gaacuccaaaggcugaagacaga

SEQ ID NO: 48342 - DNA, 24 bp, Artificial Sequence
  Synthetic
aatctgccatucatcttcctcugg

SEQ ID NO: 48343 - DNA, 22 bp, Artificial Sequence
  Synthetic
tgcuggaattagugcaccaagt

SEQ ID NO: 48344 - DNA, 25 bp, Artificial Sequence
  Synthetic
tcacgccgtuccacaatataatuga

SEQ ID NO: 48345 - DNA, 29 bp, Artificial Sequence
  Synthetic
tcttgaaaggcaaugaatacatatuccgt

SEQ ID NO: 48346 - DNA, 22 bp, Artificial Sequence
  Synthetic
tccaguggagggaaccatgaua

SEQ ID NO: 48347 - DNA, 28 bp, Artificial Sequence
  Synthetic
acaaagatucaacaagaagggatagugg

SEQ ID NO: 48348 - DNA, 23 bp, Artificial Sequence
  Synthetic
cctgaaacaucagcttccaguct

SEQ ID NO: 48349 - DNA, 24 bp, Artificial Sequence
  Synthetic
cagtcagtggccuaacagaagaug

SEQ ID NO: 48350 - DNA, 26 bp, Artificial Sequence
  Synthetic
ggcttagcccauttaagtgttacugt

SEQ ID NO: 48351 - DNA, 23 bp, Artificial Sequence
  Synthetic
gcagactgugagcaaagcttuag

SEQ ID NO: 48352 - DNA, 26 bp, Artificial Sequence
  Synthetic
gaggtccaggaaccutaaatggauag

SEQ ID NO: 48353 - DNA, 26 bp, Artificial Sequence
  Synthetic
tggtggtguaccaataagcaactaug

SEQ ID NO: 48354 - DNA, 24 bp, Artificial Sequence
  Synthetic
tgatgacaucaccaacctctccua

SEQ ID NO: 48355 - DNA, 24 bp, Artificial Sequence
  Synthetic
ccaaagcuggtgacaacaucaaag

SEQ ID NO: 48356 - DNA, 30 bp, Artificial Sequence; identical to SEQ ID NO: 36122
  Synthetic

SEQ ID NO: 48357 - DNA, 23 bp, Artificial Sequence
  Synthetic
cguaaaagcctcugaagcaccat

SEQ ID NO: 48358 - DNA, 28 bp, Artificial Sequence
  Synthetic
cggtaactttauatgtgcatttauggca

SEQ ID NO: 48359 - DNA, 24 bp, Artificial Sequence
  Synthetic
tgggaagaaaaguggctttgugaa

SEQ ID NO: 48360 - DNA, 23 bp, Artificial Sequence
  Synthetic
cgtattttcaaugttggcucggt

SEQ ID NO: 48361 - DNA, 21 bp, Artificial Sequence
  Synthetic
cagcggtgautccagatgtug

SEQ ID NO: 48362 - DNA, 24 bp, Artificial Sequence
  Synthetic
cctacuttttgatgcuccacgaca

SEQ ID NO: 48363 - DNA, 28 bp, Artificial Sequence
  Synthetic
cgttcattccagagugccaatatttuat

SEQ ID NO: 48364 - DNA, 22 bp, Artificial Sequence
  Synthetic
gtggaccaatucctgctctgut

SEQ ID NO: 48365 - DNA, 30 bp, Artificial Sequence; identical to SEQ ID NO: 36131
  Synthetic

SEQ ID NO: 48366 - DNA, 31 bp, Artificial Sequence; identical to SEQ ID NO: 36132
  Synthetic

SEQ ID NO: 48367 - DNA, 25 bp, Artificial Sequence
  Synthetic
cttttgtggacaguggtttcugaag

SEQ ID NO: 48368 - DNA, 22 bp, Artificial Sequence
  Synthetic
gaccagguacatcaaggacugt

SEQ ID NO: 48369 - DNA, 23 bp, Artificial Sequence
  Synthetic
ccaaaaucaagttgguccaaggc

SEQ ID NO: 48370 - DNA, 30 bp, Artificial Sequence; identical to SEQ ID NO: 36136
  Synthetic

SEQ ID NO: 48371 - DNA, 24 bp, Artificial Sequence
  Synthetic
gccaaccaugttaatgucccagaa

SEQ ID NO: 48372 - DNA, 27 bp, Artificial Sequence
  Synthetic
tccaggaggauctaaaacauaaaagca

SEQ ID NO: 48373 - DNA, 30 bp, Artificial Sequence; identical to SEQ ID NO: 36139
  Synthetic

SEQ ID NO: 48374 - DNA, 27 bp, Artificial Sequence
  Synthetic
actgttcucagggaaatatttgugagg

SEQ ID NO: 48375 - DNA, 24 bp, Artificial Sequence
  Synthetic
acggtttugaggaggcttcttaut

SEQ ID NO: 48376 - DNA, 26 bp, Artificial Sequence
  Synthetic
ctgaaggtatatuccatgccctcaug

SEQ ID NO: 48377 - DNA, 23 bp, Artificial Sequence
  Synthetic
catccccacuggaccaaucaaat

SEQ ID NO: 48378 - DNA, 22 bp, Artificial Sequence
  Synthetic
cgcagaugactcaacacugact

SEQ ID NO: 48379 - DNA, 30 bp, Artificial Sequence; identical to SEQ ID NO: 36145
  Synthetic

SEQ ID NO: 48380 - DNA, 27 bp, Artificial Sequence
  Synthetic
ccttcagtcaaaucttttgcagaguac

SEQ ID NO: 48381 - DNA, 28 bp, Artificial Sequence
  Synthetic
gcttacacttatcauttctcctttgcut

SEQ ID NO: 48382 - DNA, 25 bp, Artificial Sequence
  Synthetic
aagaagtaggautttccctccucca

SEQ ID NO: 48383 - DNA, 19 bp, Artificial Sequence
  Synthetic
agauactccugggccacct

SEQ ID NO: 48384 - DNA, 28 bp, Artificial Sequence
  Synthetic
gtccaatcctguctcttagattgacaut

SEQ ID NO: 48385 - DNA, 21 bp, Artificial Sequence
  Synthetic
aaggccaguccctggaaauac

SEQ ID NO: 48386 - DNA, 24 bp, Artificial Sequence
  Synthetic
agattctgtgguaagttgcaccuc

SEQ ID NO: 48387 - DNA, 27 bp, Artificial Sequence
  Synthetic
catuaaacacucaggaaggaagtttuc

SEQ ID NO: 48388 - DNA, 23 bp, Artificial Sequence
  Synthetic
cacggaacucatattcgguacct

SEQ ID NO: 48389 - DNA, 29 bp, Artificial Sequence
  Synthetic
atcctcctgutattagcaacauaaccaaa

SEQ ID NO: 48390 - DNA, 25 bp, Artificial Sequence
  Synthetic
aatgaaaaaccaucgggaaaugtuc

SEQ ID NO: 48391 - DNA, 24 bp, Artificial Sequence
  Synthetic
ttgutgacaaacgugaaacaagca

SEQ ID NO: 48392 - DNA, 29 bp, Artificial Sequence
  Synthetic
gtcttctcccacautattctgtaaaucct

SEQ ID NO: 48393 - DNA, 21 bp, Artificial Sequence
  Synthetic
gcuattcagcgugaaccggaa

SEQ ID NO: 48394 - DNA, 21 bp, Artificial Sequence
  Synthetic
caagaaacugttggcaucggt

SEQ ID NO: 48395 - DNA, 28 bp, Artificial Sequence
  Synthetic
agaagcagcataugaatttcccactaut

SEQ ID NO: 48396 - DNA, 22 bp, Artificial Sequence
  Synthetic
ggaatctggugaggtgcaguat

SEQ ID NO: 48397 - DNA, 31 bp, Artificial Sequence; identical to SEQ ID NO: 36163
  Synthetic

SEQ ID NO: 48398 - DNA, 23 bp, Artificial Sequence
  Synthetic
cuacaaggccaguacaaggauat

SEQ ID NO: 48399 - DNA, 26 bp, Artificial Sequence
  Synthetic
gacatcttccutgtcttcatcuccag

SEQ ID NO: 48400 - DNA, 21 bp, Artificial Sequence
  Synthetic
cuttccaacccugcaggaagt

SEQ ID NO: 48401 - DNA, 29 bp, Artificial Sequence
  Synthetic
tcttacatttcttucctcttggttcaugt

SEQ ID NO: 48402 - DNA, 22 bp, Artificial Sequence
  Synthetic
gagctgtcugctttatgcacug

SEQ ID NO: 48403 - DNA, 24 bp, Artificial Sequence
  Synthetic
ccaccagaagaaacutauccacct

SEQ ID NO: 48404 - DNA, 24 bp, Artificial Sequence
  Synthetic
gcatttcuggccgctactcuaaat

SEQ ID NO: 48405 - DNA, 20 bp, Artificial Sequence
  Synthetic
ctggttaccucccctacgug

SEQ ID NO: 48406 - DNA, 30 bp, Artificial Sequence; identical to SEQ ID NO: 36172
  Synthetic

SEQ ID NO: 48407 - DNA, 21 bp, Artificial Sequence
  Synthetic
aagacatggucgaccgtuacc

SEQ ID NO: 48408 - DNA, 22 bp, Artificial Sequence
  Synthetic
acatgtctccucagcatcccua

SEQ ID NO: 48409 - DNA, 28 bp, Artificial Sequence
  Synthetic
tugataatgtggucagaaaaggacaagt

SEQ ID NO: 48410 - DNA, 26 bp, Artificial Sequence
  Synthetic
gaatgaaucacatgcuaagggaagga

SEQ ID NO: 48411 - DNA, 24 bp, Artificial Sequence
  Synthetic
caaaaatagcagaugcgtctccug

SEQ ID NO: 48412 - DNA, 29 bp, Artificial Sequence
  Synthetic
cgaatacttcugtgcttgagatuaagagt

SEQ ID NO: 48413 - DNA, 25 bp, Artificial Sequence
  Synthetic
tctccucccagaccatgaataucag

SEQ ID NO: 48414 - DNA, 26 bp, Artificial Sequence
  Synthetic
caccatcatautcaggtggatuccaa

SEQ ID NO: 48415 - DNA, 29 bp, Artificial Sequence
  Synthetic
atgaatatatttucagagtccgugcagaa

SEQ ID NO: 48416 - DNA, 21 bp, Artificial Sequence
  Synthetic
ggtggaucccagcaaacagua

SEQ ID NO: 48417 - DNA, 28 bp, Artificial Sequence
  Synthetic
ccgtgctgatucatctaaattttctcut

SEQ ID NO: 48418 - DNA, 25 bp, Artificial Sequence
  Synthetic
ctttgacagtuaggaccccactuaa

SEQ ID NO: 48419 - DNA, 25 bp, Artificial Sequence
  Synthetic
cgatgacugggaaagagtgcauaaa

SEQ ID NO: 48420 - DNA, 22 bp, Artificial Sequence
  Synthetic
gctcaccuggtctgtcaauagg

SEQ ID NO: 48421 - DNA, 31 bp, Artificial Sequence; identical to SEQ ID NO: 36187
  Synthetic

SEQ ID NO: 48422 - DNA, 22 bp, Artificial Sequence
  Synthetic
ggcatgtccacugctgttctua

SEQ ID NO: 48423 - DNA, 25 bp, Artificial Sequence
  Synthetic
gttattaccgugagaguaggccaaa

SEQ ID NO: 48424 - DNA, 28 bp, Artificial Sequence
  Synthetic
gtactcattuccttcaattaguccaggt

SEQ ID NO: 48425 - DNA, 28 bp, Artificial Sequence
  Synthetic
cctggaccaccuattaatcctaaacuga

SEQ ID NO: 48426 - DNA, 23 bp, Artificial Sequence
  Synthetic
gtccagucactctgaactucagg

SEQ ID NO: 48427 - DNA, 23 bp, Artificial Sequence
  Synthetic
tgactccacaccuactgttgcua

SEQ ID NO: 48428 - DNA, 26 bp, Artificial Sequence
  Synthetic
ccacgtgtcttuccttgtatcttgut

SEQ ID NO: 48429 - DNA, 24 bp, Artificial Sequence
  Synthetic
ggtagcaaaacaguagccguacat

SEQ ID NO: 48430 - DNA, 22 bp, Artificial Sequence
  Synthetic
ggttgtccacuttgcaguagga

SEQ ID NO: 48431 - DNA, 30 bp, Artificial Sequence; identical to SEQ ID NO: 36197
  Synthetic

SEQ ID NO: 48432 - DNA, 23 bp, Artificial Sequence
  Synthetic
cctgggtgccutcttcttgauat

SEQ ID NO: 48433 - DNA, 29 bp, Artificial Sequence
  Synthetic
cgtaagttgcuttctctgaauacaaaact

SEQ ID NO: 48434 - DNA, 20 bp, Artificial Sequence
  Synthetic
ggaagagguactggtugcct

SEQ ID NO: 48435 - DNA, 25 bp, Artificial Sequence
  Synthetic
cuttttagataaaccugggccacct

SEQ ID NO: 48436 - DNA, 24 bp, Artificial Sequence
  Synthetic
tccaagttacutttgggaauggca

SEQ ID NO: 48437 - DNA, 29 bp, Artificial Sequence
  Synthetic
gtttgcaaggaaaauagatgtctgatugt

SEQ ID NO: 48438 - DNA, 23 bp, Artificial Sequence
  Synthetic
tcccgaagaccggugactttaua

SEQ ID NO: 48439 - DNA, 23 bp, Artificial Sequence
  Synthetic
ttagctaaaccaaguccaccugt

SEQ ID NO: 48440 - DNA, 30 bp, Artificial Sequence; identical to SEQ ID NO: 36206
  Synthetic

SEQ ID NO: 48441 - DNA, 22 bp, Artificial Sequence
  Synthetic
tgatgcaccugatcagccaaut

SEQ ID NO: 48442 - DNA, 26 bp, Artificial Sequence
  Synthetic
tgaatcagauaccagaggaucactua

SEQ ID NO: 48443 - DNA, 31 bp, Artificial Sequence; identical to SEQ ID NO: 36209
  Synthetic

SEQ ID NO: 48444 - DNA, 26 bp, Artificial Sequence
  Synthetic
tggcacaaaaugttattgccattuct

SEQ ID NO: 48445 - DNA, 24 bp, Artificial Sequence
  Synthetic
agatcaaggccaaacgutcagaut

SEQ ID NO: 48446 - DNA, 24 bp, Artificial Sequence
  Synthetic
tgaaccaggaaaccutaggcttug

SEQ ID NO: 48447 - DNA, 30 bp, Artificial Sequence; identical to SEQ ID NO: 36213
  Synthetic

SEQ ID NO: 48448 - DNA, 27 bp, Artificial Sequence
  Synthetic
cagtgtattttcugctaagcaagtugt

SEQ ID NO: 48449 - DNA, 31 bp, Artificial Sequence; identical to SEQ ID NO: 36215
  Synthetic

SEQ ID NO: 48450 - DNA, 22 bp, Artificial Sequence
  Synthetic
ggctctcugataacaagugcct

SEQ ID NO: 48451 - DNA, 27 bp, Artificial Sequence
  Synthetic
ggctctccaaucaccaattatgtcaut

SEQ ID NO: 48452 - DNA, 28 bp, Artificial Sequence
  Synthetic
gaatgttgguttaaaaagtugcacagac

SEQ ID NO: 48453 - DNA, 25 bp, Artificial Sequence
  Synthetic
cgtcaccuggaacatgaaugaaaga

SEQ ID NO: 48454 - DNA, 24 bp, Artificial Sequence
  Synthetic
tcaggtgaaacuggaagcaatuga

SEQ ID NO: 48455 - DNA, 30 bp, Artificial Sequence; identical to SEQ ID NO: 36221
  Synthetic

SEQ ID NO: 48456 - DNA, 26 bp, Artificial Sequence
  Synthetic
attcatagtgcauttccttagugcca

SEQ ID NO: 48457 - DNA, 25 bp, Artificial Sequence
  Synthetic
actaacgtauactggctcttugcag

SEQ ID NO: 48458 - DNA, 24 bp, Artificial Sequence
  Synthetic
agcautgattgcatauacccggaa

SEQ ID NO: 48459 - DNA, 23 bp, Artificial Sequence
  Synthetic
ctccatgacugtcaacugggaag

SEQ ID NO: 48460 - DNA, 27 bp, Artificial Sequence
  Synthetic
tggctttgtaugtgaaaatgttcucct

SEQ ID NO: 48461 - DNA, 26 bp, Artificial Sequence
  Synthetic
aaagagaagcuaacaggaagacaugg

SEQ ID NO: 48462 - DNA, 29 bp, Artificial Sequence
  Synthetic
caagtaatttuaaccaaaccatgcaguct

SEQ ID NO: 48463 - DNA, 25 bp, Artificial Sequence
  Synthetic
agaaccugttctctaugacacccat

SEQ ID NO: 48464 - DNA, 28 bp, Artificial Sequence
  Synthetic
gaactatuattgaacaccuaggaaggca

SEQ ID NO: 48465 - DNA, 23 bp, Artificial Sequence
  Synthetic
gtgcaauaagcgtgatguggaag

SEQ ID NO: 48466 - DNA, 23 bp, Artificial Sequence
  Synthetic
gcttacataucggatctcuggca

SEQ ID NO: 48467 - DNA, 28 bp, Artificial Sequence
  Synthetic
agacaggaucaaaggctatgttatugag

SEQ ID NO: 48468 - DNA, 30 bp, Artificial Sequence; identical to SEQ ID NO: 36234
  Synthetic

SEQ ID NO: 48469 - DNA, 21 bp, Artificial Sequence
  Synthetic
gtacagcuggagactgcugaa

SEQ ID NO: 48470 - DNA, 28 bp, Artificial Sequence
  Synthetic
tccatcctatuagaaaaggagacaguca

SEQ ID NO: 48471 - DNA, 22 bp, Artificial Sequence
  Synthetic
gattccugctgtcaucaaggga

SEQ ID NO: 48472 - DNA, 25 bp, Artificial Sequence
  Synthetic
cagtcagtaguaccttcttctugca

SEQ ID NO: 48473 - DNA, 25 bp, Artificial Sequence
  Synthetic
cagcacttcaucagcttcaaaauct

SEQ ID NO: 48474 - DNA, 22 bp, Artificial Sequence
  Synthetic
tttggttattggugctcggcua

SEQ ID NO: 48475 - DNA, 27 bp, Artificial Sequence
  Synthetic
ggaatcagtgaugagtgcaaaucagat

SEQ ID NO: 48476 - DNA, 31 bp, Artificial Sequence; identical to SEQ ID NO: 36242
  Synthetic

SEQ ID NO: 48477 - DNA, 27 bp, Artificial Sequence
  Synthetic
tggcagtgaaaucacccattatgtuat

SEQ ID NO: 48478 - DNA, 23 bp, Artificial Sequence
  Synthetic
cggtcuggaaaggaaucaacaga

SEQ ID NO: 48479 - DNA, 22 bp, Artificial Sequence
  Synthetic
ccgaagugaggcaaaaacugag

SEQ ID NO: 48480 - DNA, 22 bp, Artificial Sequence
  Synthetic
cattggaaggccugtcacauct

SEQ ID NO: 48481 - DNA, 30 bp, Artificial Sequence; identical to SEQ ID NO: 36247
  Synthetic

SEQ ID NO: 48482 - DNA, 28 bp, Artificial Sequence
  Synthetic
caagatttucaaccagaaaagatguggt

SEQ ID NO: 48483 - DNA, 24 bp, Artificial Sequence
  Synthetic
tcattttcactugcctctggcuaa

SEQ ID NO: 48484 - DNA, 23 bp, Artificial Sequence
  Synthetic
cagccaaacutgttctuggcaat

SEQ ID NO: 48485 - DNA, 27 bp, Artificial Sequence
  Synthetic
acttaactggtcugatccagaagauga

SEQ ID NO: 48486 - DNA, 28 bp, Artificial Sequence
  Synthetic
gatagtatcactugggaaaatcctguga

SEQ ID NO: 48487 - DNA, 25 bp, Artificial Sequence
  Synthetic
cgtgttgtaauagacaacgtuggaa

SEQ ID NO: 48488 - DNA, 25 bp, Artificial Sequence
  Synthetic
tctgtugaaagagaacagtcaugca

SEQ ID NO: 48489 - DNA, 23 bp, Artificial Sequence
  Synthetic
ccgagagggugctgatuacaaac

SEQ ID NO: 48490 - DNA, 26 bp, Artificial Sequence
  Synthetic
gggttcccatuctagttcaatagtug

SEQ ID NO: 48491 - DNA, 30 bp, Artificial Sequence; identical to SEQ ID NO: 36257
  Synthetic

SEQ ID NO: 48492 - DNA, 27 bp, Artificial Sequence
  Synthetic
ccaaaguacatgguaaaaaggcaaact

SEQ ID NO: 48493 - DNA, 24 bp, Artificial Sequence
  Synthetic
caaaacccgacucagaatggatug

SEQ ID NO: 48494 - DNA, 30 bp, Artificial Sequence; identical to SEQ ID NO: 36260
  Synthetic

SEQ ID NO: 48495 - DNA, 24 bp, Artificial Sequence
  Synthetic
gagaaggaagggugaagtucaaga

SEQ ID NO: 48496 - DNA, 26 bp, Artificial Sequence
  Synthetic
gttgggtaaggugatccagaaauact

SEQ ID NO: 48497 - DNA, 24 bp, Artificial Sequence
  Synthetic
gagttgccacuttcccatttugaa

SEQ ID NO: 48498 - DNA, 22 bp, Artificial Sequence
  Synthetic
gtcaggattgguaccaggtgut

SEQ ID NO: 48499 - DNA, 30 bp, Artificial Sequence; identical to SEQ ID NO: 36265
  Synthetic

SEQ ID NO: 48500 - DNA, 27 bp, Artificial Sequence
  Synthetic
tggtatatatgttcucctcccagctuc

SEQ ID NO: 48501 - DNA, 28 bp, Artificial Sequence
  Synthetic
ccccactuagagacaagtgcattatuaa

SEQ ID NO: 48502 - DNA, 28 bp, Artificial Sequence
  Synthetic
tgcagagatgtgaucattcttcattgut

SEQ ID NO: 48503 - DNA, 29 bp, Artificial Sequence
  Synthetic
tgcattgcatttugacatactctgtttut

SEQ ID NO: 48504 - DNA, 24 bp, Artificial Sequence
  Synthetic
ccaatagcautgactgctcucact

SEQ ID NO: 48505 - DNA, 29 bp, Artificial Sequence
  Synthetic
cagagaaaaatgguggaagtcctatcaua

SEQ ID NO: 48506 - DNA, 22 bp, Artificial Sequence
  Synthetic
gugagggaggaccugagaaaag

SEQ ID NO: 48507 - DNA, 24 bp, Artificial Sequence
  Synthetic
gaaggaacagagguccagttucag

SEQ ID NO: 48508 - DNA, 28 bp, Artificial Sequence
  Synthetic
tgtcacaaagatuaagtgcaagagcaua

SEQ ID NO: 48509 - DNA, 24 bp, Artificial Sequence
  Synthetic
attguggaaaagagagacgucagg

SEQ ID NO: 48510 - DNA, 23 bp, Artificial Sequence
  Synthetic
tctcauatcgtagcucacaggca

SEQ ID NO: 48511 - DNA, 27 bp, Artificial Sequence
  Synthetic
ctcatggaaggauaggaauactcatuc

SEQ ID NO: 48512 - DNA, 30 bp, Artificial Sequence; identical to SEQ ID NO: 36278
  Synthetic

SEQ ID NO: 48513 - DNA, 28 bp, Artificial Sequence
  Synthetic
tcatatgaactccuttttgacaaaccua

SEQ ID NO: 48514 - DNA, 25 bp, Artificial Sequence
  Synthetic
actgctgtcutaacatcttgauggg

SEQ ID NO: 48515 - DNA, 24 bp, Artificial Sequence
  Synthetic
ctaaagacgcagugactcucacat

SEQ ID NO: 48516 - DNA, 29 bp, Artificial Sequence
  Synthetic
aaatatgacaccaaaaugcaagttugaca

SEQ ID NO: 48517 - DNA, 23 bp, Artificial Sequence
  Synthetic
ctcatccaccgucaaggauacaa

SEQ ID NO: 48518 - DNA, 29 bp, Artificial Sequence
  Synthetic
tccccttttaaaaugagaaccttcctuac

SEQ ID NO: 48519 - DNA, 27 bp, Artificial Sequence
  Synthetic
cttggacaaaggcugatatgattcuga

SEQ ID NO: 48520 - DNA, 24 bp, Artificial Sequence
  Synthetic
agcagatttaaggucagaggccua

SEQ ID NO: 48521 - DNA, 29 bp, Artificial Sequence
  Synthetic
tcgacatcacaguaaaacatcctattcug

SEQ ID NO: 48522 - DNA, 29 bp, Artificial Sequence
  Synthetic
tcaactatataucctttgatgcgugaacc

SEQ ID NO: 48523 - DNA, 24 bp, Artificial Sequence
  Synthetic
tggcaatgugaagagaactgcaua

SEQ ID NO: 48524 - DNA, 28 bp, Artificial Sequence
  Synthetic
ccacatttgtuacgagcacaaacttuaa

SEQ ID NO: 48525 - DNA, 26 bp, Artificial Sequence
  Synthetic
ccctggtcauggtaaaaatctttugg

SEQ ID NO: 48526 - DNA, 22 bp, Artificial Sequence
  Synthetic
aaatgcacucacgagtcacugt

SEQ ID NO: 48527 - DNA, 24 bp, Artificial Sequence
  Synthetic
gggtgaaaaugaagaccttgtcug

SEQ ID NO: 48528 - DNA, 22 bp, Artificial Sequence
  Synthetic
cctgtugccccaaagtagcuat

SEQ ID NO: 48529 - DNA, 29 bp, Artificial Sequence
  Synthetic
tggatcatggacauaactgtatgtgttut

SEQ ID NO: 48530 - DNA, 26 bp, Artificial Sequence
  Synthetic
tcttcgcaucgctcaattatauagcc

SEQ ID NO: 48531 - DNA, 27 bp, Artificial Sequence
  Synthetic
actaacgtaaatgguatgctccaacuc

SEQ ID NO: 48532 - DNA, 22 bp, Artificial Sequence
  Synthetic
acagtugcagacaggtctucag

SEQ ID NO: 48533 - DNA, 30 bp, Artificial Sequence; identical to SEQ ID NO: 36299
  Synthetic

SEQ ID NO: 48534 - DNA, 22 bp, Artificial Sequence
  Synthetic
ccagtgccaacuctgtttctug

SEQ ID NO: 48535 - DNA, 26 bp, Artificial Sequence
  Synthetic
ggtggaagcaaaaucataggtuacgt

SEQ ID NO: 48536 - DNA, 25 bp, Artificial Sequence
  Synthetic
tgctgtctugcttttaaattgugct

SEQ ID NO: 48537 - DNA, 26 bp, Artificial Sequence
  Synthetic
cggctgaacaaacutctttcagaaut

SEQ ID NO: 48538 - DNA, 31 bp, Artificial Sequence; identical to SEQ ID NO: 36304
  Synthetic

SEQ ID NO: 48539 - DNA, 28 bp, Artificial Sequence
  Synthetic
tccaatggcuaagaaataacatggtugt

SEQ ID NO: 48540 - DNA, 32 bp, Artificial Sequence; identical to SEQ ID NO: 36306
  Synthetic

SEQ ID NO: 48541 - DNA, 27 bp, Artificial Sequence
  Synthetic
tgcaagctaacugataatccaatguct

SEQ ID NO: 48542 - DNA, 22 bp, Artificial Sequence
  Synthetic
agaagacagcgucatcgaacuc

SEQ ID NO: 48543 - DNA, 30 bp, Artificial Sequence; identical to SEQ ID NO: 36309
  Synthetic

SEQ ID NO: 48544 - DNA, 26 bp, Artificial Sequence
  Synthetic
aggtctucctctgttguaaaggagaa

SEQ ID NO: 48545 - DNA, 28 bp, Artificial Sequence
  Synthetic
gccaactataatgugtctttgaccaauc

SEQ ID NO: 48546 - DNA, 27 bp, Artificial Sequence
  Synthetic
acccuaaaagcaagaacaaactuacca

SEQ ID NO: 48547 - DNA, 31 bp, Artificial Sequence; identical to SEQ ID NO: 36313
  Synthetic

SEQ ID NO: 48548 - DNA, 31 bp, Artificial Sequence; identical to SEQ ID NO: 36314
  Synthetic

SEQ ID NO: 48549 - DNA, 25 bp, Artificial Sequence
  Synthetic
gcgcagaagugatttggtauaaagg

SEQ ID NO: 48550 - DNA, 27 bp, Artificial Sequence
  Synthetic
caaaaaccacautgagttaagcuggaa

SEQ ID NO: 48551 - DNA, 29 bp, Artificial Sequence
  Synthetic
ttcttgtcaucaacaaatgtctacuggat

SEQ ID NO: 48552 - DNA, 28 bp, Artificial Sequence
  Synthetic
tgacagtacaagaugacaggtauacagt

SEQ ID NO: 48553 - DNA, 30 bp, Artificial Sequence; identical to SEQ ID NO: 36319
  Synthetic

SEQ ID NO: 48554 - DNA, 29 bp, Artificial Sequence
  Synthetic
cagtcatgtauaacaagttttcugaccct

SEQ ID NO: 48555 - DNA, 28 bp, Artificial Sequence
  Synthetic
gagtaccttggcuaatgagtatgatuct

SEQ ID NO: 48556 - DNA, 23 bp, Artificial Sequence
  Synthetic
aagtgaagguggaagaacuccag

SEQ ID NO: 48557 - DNA, 23 bp, Artificial Sequence
  Synthetic
aaagctgttucttccctcucgaa

SEQ ID NO: 48558 - DNA, 22 bp, Artificial Sequence
  Synthetic
cuagaaaagugaagggccagca

SEQ ID NO: 48559 - DNA, 24 bp, Artificial Sequence
  Synthetic
gctgttatuaaggcagauggcaag

SEQ ID NO: 48560 - DNA, 29 bp, Artificial Sequence
  Synthetic
aaauttaaaaagcactuaccaagcacagt

SEQ ID NO: 48561 - DNA, 21 bp, Artificial Sequence
  Synthetic
ttcaagaaugaccagcgccua

SEQ ID NO: 48562 - DNA, 29 bp, Artificial Sequence
  Synthetic
actatttacctucaatgatcagttugcca

SEQ ID NO: 48563 - DNA, 25 bp, Artificial Sequence
  Synthetic
gcuaaaaggaacccaggaaaucaca

SEQ ID NO: 48564 - DNA, 22 bp, Artificial Sequence
  Synthetic
gggtgtaucaggaagtctugca

SEQ ID NO: 48565 - DNA, 24 bp, Artificial Sequence
  Synthetic
ccttcuaaccctcacuccaaacag

SEQ ID NO: 48566 - DNA, 29 bp, Artificial Sequence
  Synthetic
ttttattagucgagctgaaatgauacagt

SEQ ID NO: 48567 - DNA, 23 bp, Artificial Sequence
  Synthetic
tgcgccgcaucttaaaaaucaaa

SEQ ID NO: 48568 - DNA, 22 bp, Artificial Sequence
  Synthetic
ccccacucccatgatucagaaa

SEQ ID NO: 48569 - DNA, 23 bp, Artificial Sequence
  Synthetic
tcauctcttcugagggcaagact

SEQ ID NO: 48570 - DNA, 25 bp, Artificial Sequence
  Synthetic
tgggatgucacagatctcatuagct

SEQ ID NO: 48571 - DNA, 27 bp, Artificial Sequence
  Synthetic
agaggcaaaugttatatgguccaaagg

SEQ ID NO: 48572 - DNA, 29 bp, Artificial Sequence
  Synthetic
aaaatcagacatuaagaatgaggctttuc

SEQ ID NO: 48573 - DNA, 22 bp, Artificial Sequence
  Synthetic
gcacaaagucaaacuggaccaa

SEQ ID NO: 48574 - DNA, 29 bp, Artificial Sequence
  Synthetic
ctccattattatuaaagcaacccgaauct

SEQ ID NO: 48575 - DNA, 24 bp, Artificial Sequence
  Synthetic
tttgaugcagaaatcucagaggca

SEQ ID NO: 48576 - DNA, 25 bp, Artificial Sequence
  Synthetic
ccaacgatgcuttgcttttatgugt

SEQ ID NO: 48577 - DNA, 29 bp, Artificial Sequence
  Synthetic
gagagatggaaaucatctgtaccucaaaa

SEQ ID NO: 48578 - DNA, 27 bp, Artificial Sequence
  Synthetic
gaacgaaatcucccaggaaagtacuaa

SEQ ID NO: 48579 - DNA, 24 bp, Artificial Sequence
  Synthetic
gagttaaacaaagagcgugacgug

SEQ ID NO: 48580 - DNA, 26 bp, Artificial Sequence
  Synthetic
caatgcaagtugctactaaggttugt

SEQ ID NO: 48581 - DNA, 26 bp, Artificial Sequence
  Synthetic
gaaagctgcacaucattgatgtucaa

SEQ ID NO: 48582 - DNA, 23 bp, Artificial Sequence
  Synthetic
cugaagagucaacgaactcugat

SEQ ID NO: 48583 - DNA, 29 bp, Artificial Sequence
  Synthetic
tcctaaggagaugccaaatcaacttttua

SEQ ID NO: 48584 - DNA, 27 bp, Artificial Sequence
  Synthetic
gcagcauaaacagggcttgaatttuaa

SEQ ID NO: 48585 - DNA, 28 bp, Artificial Sequence
  Synthetic
cactaatgcaauggacttctctcuacag

SEQ ID NO: 48586 - DNA, 28 bp, Artificial Sequence
  Synthetic
ttaaggtcatgugttcaaatcttgaugt

SEQ ID NO: 48587 - DNA, 25 bp, Artificial Sequence
  Synthetic
caaaacctgutgaagaggtugaagt

SEQ ID NO: 48588 - DNA, 27 bp, Artificial Sequence
  Synthetic
acaaattgtcacugagattcctaccug

SEQ ID NO: 48589 - DNA, 29 bp, Artificial Sequence
  Synthetic
ttgcatttgtcaagcutattcaacatcut

SEQ ID NO: 48590 - DNA, 23 bp, Artificial Sequence
  Synthetic
cagaacautcgauggaggcagaa

SEQ ID NO: 48591 - DNA, 29 bp, Artificial Sequence
  Synthetic
ggagtagaaagutaatcacttgctucaga

SEQ ID NO: 48592 - DNA, 27 bp, Artificial Sequence
  Synthetic
caacacaacacacaauaagaagagugt

SEQ ID NO: 48593 - DNA, 31 bp, Artificial Sequence; identical to SEQ ID NO: 36359
  Synthetic

SEQ ID NO: 48594 - DNA, 31 bp, Artificial Sequence; identical to SEQ ID NO: 36360
  Synthetic

SEQ ID NO: 48595 - DNA, 28 bp, Artificial Sequence
  Synthetic
gcaaaatgtgaagucgatgtggtauaaa

SEQ ID NO: 48596 - DNA, 28 bp, Artificial Sequence
  Synthetic
caatcaccaguaaacattcatcacatut

SEQ ID NO: 48597 - DNA, 31 bp, Artificial Sequence; identical to SEQ ID NO: 36363
  Synthetic

SEQ ID NO: 48598 - DNA, 24 bp, Artificial Sequence
  Synthetic
aaaagcucagagcacccagaatua

SEQ ID NO: 48599 - DNA, 25 bp, Artificial Sequence
  Synthetic
tgagctcatguctttaaagtgtucg

SEQ ID NO: 48600 - DNA, 27 bp, Artificial Sequence
  Synthetic
caaacaataucaaacacagcaccauga

SEQ ID NO: 48601 - DNA, 26 bp, Artificial Sequence
  Synthetic
gatcaaacucttctgctcuggaaagt

SEQ ID NO: 48602 - DNA, 22 bp, Artificial Sequence
  Synthetic
gagaucggcggacacttctaug

SEQ ID NO: 48603 - DNA, 31 bp, Artificial Sequence; identical to SEQ ID NO: 36369
  Synthetic

SEQ ID NO: 48604 - DNA, 26 bp, Artificial Sequence
  Synthetic
gaaaagccagtuacctttagttggug

SEQ ID NO: 48605 - DNA, 24 bp, Artificial Sequence
  Synthetic
attgttgctgugttctgttctgug

SEQ ID NO: 48606 - DNA, 26 bp, Artificial Sequence
  Synthetic
gggtttctaaucttccaaacugaaca

SEQ ID NO: 48607 - DNA, 30 bp, Artificial Sequence; identical to SEQ ID NO: 36373
  Synthetic

SEQ ID NO: 48608 - DNA, 25 bp, Artificial Sequence
  Synthetic
tgcatgcaacaauacacgaaaaucc

SEQ ID NO: 48609 - DNA, 24 bp, Artificial Sequence
  Synthetic
ctatgaaagcutgctcucgacagt

SEQ ID NO: 48610 - DNA, 29 bp, Artificial Sequence
  Synthetic
cgatataagaaaagcauactggtgaauct

SEQ ID NO: 48611 - DNA, 24 bp, Artificial Sequence
  Synthetic
gagccugaagaagagcctattuca

SEQ ID NO: 48612 - DNA, 28 bp, Artificial Sequence
  Synthetic
cttttauaggagaaggaaggaaauggca

SEQ ID NO: 48613 - DNA, 25 bp, Artificial Sequence
  Synthetic
tgttaacacautggtctttcugggt

SEQ ID NO: 48614 - DNA, 26 bp, Artificial Sequence
  Synthetic
caggtacaaautcttcttccucaggt

SEQ ID NO: 48615 - DNA, 28 bp, Artificial Sequence
  Synthetic
aagaagaaautgttccugaagaggaagt

SEQ ID NO: 48616 - DNA, 24 bp, Artificial Sequence
  Synthetic
cuaaagagttgcaucccaaagagt

SEQ ID NO: 48617 - DNA, 21 bp, Artificial Sequence
  Synthetic
gaagugcccaagaaacctgug

SEQ ID NO: 48618 - DNA, 24 bp, Artificial Sequence
  Synthetic
gaaagatcugctatggcucaccaa

SEQ ID NO: 48619 - DNA, 30 bp, Artificial Sequence; identical to SEQ ID NO: 36385
  Synthetic

SEQ ID NO: 48620 - DNA, 22 bp, Artificial Sequence
  Synthetic
ccttugcaggaggcatcatcua

SEQ ID NO: 48621 - DNA, 31 bp, Artificial Sequence; identical to SEQ ID NO: 36387
  Synthetic

SEQ ID NO: 48622 - DNA, 27 bp, Artificial Sequence
  Synthetic
agaaaagaucacaaucgaggaaggaaa

SEQ ID NO: 48623 - DNA, 28 bp, Artificial Sequence
  Synthetic
gttcttgtccugattcttacattucagt

SEQ ID NO: 48624 - DNA, 26 bp, Artificial Sequence
  Synthetic
acagacauggaggaaacaaagatcuc

SEQ ID NO: 48625 - DNA, 32 bp, Artificial Sequence; identical to SEQ ID NO: 36391
  Synthetic

SEQ ID NO: 48626 - DNA, 27 bp, Artificial Sequence
  Synthetic
cctcatattcttcutcccgttgtacug

SEQ ID NO: 48627 - DNA, 31 bp, Artificial Sequence; identical to SEQ ID NO: 36393
  Synthetic

SEQ ID NO: 48628 - DNA, 26 bp, Artificial Sequence
  Synthetic
agtcagtataccuttagctggtggut

SEQ ID NO: 48629 - DNA, 26 bp, Artificial Sequence
  Synthetic
gctactactttauggctgccttttug

SEQ ID NO: 48630 - DNA, 26 bp, Artificial Sequence
  Synthetic
acccaccaacauataaacagtaugac

SEQ ID NO: 48631 - DNA, 30 bp, Artificial Sequence; identical to SEQ ID NO: 36397
  Synthetic

SEQ ID NO: 48632 - DNA, 28 bp, Artificial Sequence
  Synthetic
cataagacagutatgcaaatgugaaggt

SEQ ID NO: 48633 - DNA, 31 bp, Artificial Sequence; identical to SEQ ID NO: 36399
  Synthetic

SEQ ID NO: 48634 - DNA, 25 bp, Artificial Sequence
  Synthetic
cttugaggaaauacacacaaacuca

SEQ ID NO: 48635 - DNA, 28 bp, Artificial Sequence
  Synthetic
ctcttccccaaautctagaaagugagaa

SEQ ID NO: 48636 - DNA, 23 bp, Artificial Sequence
  Synthetic
agaaatacacccacagugcacuc

SEQ ID NO: 48637 - DNA, 27 bp, Artificial Sequence
  Synthetic
tgctcatttauttggccttttugacaa

SEQ ID NO: 48638 - DNA, 22 bp, Artificial Sequence
  Synthetic
gctttacgucgaaagccacugt

SEQ ID NO: 48639 - DNA, 28 bp, Artificial Sequence
  Synthetic
gcatgtgccuatgttctttcauaaaagt

SEQ ID NO: 48640 - DNA, 26 bp, Artificial Sequence
  Synthetic
acaacaagagggauaaaaatcugcct

SEQ ID NO: 48641 - DNA, 29 bp, Artificial Sequence
  Synthetic
ccatgtgtttgauctgatgtcttgtacua

SEQ ID NO: 48642 - DNA, 22 bp, Artificial Sequence
  Synthetic
cttgtgtacaugggtgcuagga

SEQ ID NO: 48643 - DNA, 31 bp, Artificial Sequence; identical to SEQ ID NO: 36409
  Synthetic

SEQ ID NO: 48644 - DNA, 28 bp, Artificial Sequence
  Synthetic
atttcacataaacugcaaatcaggtuca

SEQ ID NO: 48645 - DNA, 27 bp, Artificial Sequence
  Synthetic
aagaagggcaagaauactaugaaaggg

SEQ ID NO: 48646 - DNA, 27 bp, Artificial Sequence
  Synthetic
agttcgtcauaaggttctucgaaagat

SEQ ID NO: 48647 - DNA, 29 bp, Artificial Sequence
  Synthetic
tttagtgaagcagutggatggatagaaut

SEQ ID NO: 48648 - DNA, 22 bp, Artificial Sequence
  Synthetic
cttccttcacccuccactgtut

SEQ ID NO: 48649 - DNA, 30 bp, Artificial Sequence; identical to SEQ ID NO: 36415
  Synthetic

SEQ ID NO: 48650 - DNA, 24 bp, Artificial Sequence
  Synthetic
acgttttgguggtggtttctttuc

SEQ ID NO: 48651 - DNA, 29 bp, Artificial Sequence
  Synthetic
tgaagtactgaaagaaaugcatgagacut

SEQ ID NO: 48652 - DNA, 32 bp, Artificial Sequence; identical to SEQ ID NO: 36418
  Synthetic

SEQ ID NO: 48653 - DNA, 25 bp, Artificial Sequence
  Synthetic
acgtagccuacctataccattcuga

SEQ ID NO: 48654 - DNA, 25 bp, Artificial Sequence
  Synthetic
gatagaatgagagcaugagcgcaua

SEQ ID NO: 48655 - DNA, 25 bp, Artificial Sequence
  Synthetic
cagaacugacagagagccagaaaua

SEQ ID NO: 48656 - DNA, 24 bp, Artificial Sequence
  Synthetic
cactttggtgugtgtctacaggua

SEQ ID NO: 48657 - DNA, 27 bp, Artificial Sequence
  Synthetic
acacaaagtccauaaattgaccatugc

SEQ ID NO: 48658 - DNA, 23 bp, Artificial Sequence
  Synthetic
acgcagatgugctcaacaguaat

SEQ ID NO: 48659 - DNA, 26 bp, Artificial Sequence
  Synthetic
aactgaaaaacuggaacccagtgaua

SEQ ID NO: 48660 - DNA, 26 bp, Artificial Sequence
  Synthetic
ctttttacctcugtctgtgacaguct

SEQ ID NO: 48661 - DNA, 28 bp, Artificial Sequence
  Synthetic
gctgaatatagucatgcgtcctcuaaat

SEQ ID NO: 48662 - DNA, 24 bp, Artificial Sequence
  Synthetic
tttgcttgagcagutcaaatgcut

SEQ ID NO: 48663 - DNA, 29 bp, Artificial Sequence
  Synthetic
agtagaagacaggugttttatccttacut

SEQ ID NO: 48664 - DNA, 22 bp, Artificial Sequence
  Synthetic
caugttcgttaaaugccacgca

SEQ ID NO: 48665 - DNA, 28 bp, Artificial Sequence
  Synthetic
tttcattattccutagaaaccacugcga

SEQ ID NO: 48666 - DNA, 22 bp, Artificial Sequence
  Synthetic
tgctggctugagctgcataaua

SEQ ID NO: 48667 - DNA, 24 bp, Artificial Sequence
  Synthetic
cagggaaauaaagcctucagacag

SEQ ID NO: 48668 - DNA, 30 bp, Artificial Sequence; identical to SEQ ID NO: 36434
  Synthetic

SEQ ID NO: 48669 - DNA, 21 bp, Artificial Sequence
  Synthetic
catgaacgacgcuggtttgua

SEQ ID NO: 48670 - DNA, 27 bp, Artificial Sequence
  Synthetic
ttttgtaucaggcaacagutataggut

SEQ ID NO: 48671 - DNA, 30 bp, Artificial Sequence; identical to SEQ ID NO: 36437
  Synthetic

SEQ ID NO: 48672 - DNA, 23 bp, Artificial Sequence
  Synthetic
gggcgctgutttccagataacua

SEQ ID NO: 48673 - DNA, 29 bp, Artificial Sequence
  Synthetic
ctgaaaccttgtcuttctgctctactaut

SEQ ID NO: 48674 - DNA, 25 bp, Artificial Sequence
  Synthetic
caaggcuccggtcagtttuaaaaat

SEQ ID NO: 48675 - DNA, 26 bp, Artificial Sequence
  Synthetic
tctgttccuacagagcaaaaactucc

SEQ ID NO: 48676 - DNA, 29 bp, Artificial Sequence
  Synthetic
tgaaaaccagtguagcaacattattccua

SEQ ID NO: 48677 - DNA, 24 bp, Artificial Sequence
  Synthetic
gcatgtctccutcatgactgatug

SEQ ID NO: 48678 - DNA, 26 bp, Artificial Sequence
  Synthetic
caggaatctttuccagaggcatttuc

SEQ ID NO: 48679 - DNA, 22 bp, Artificial Sequence
  Synthetic
acattcacuggaactccuccca

SEQ ID NO: 48680 - DNA, 29 bp, Artificial Sequence
  Synthetic
tcgtataaatcuagaagagcagtcugaca

SEQ ID NO: 48681 - DNA, 23 bp, Artificial Sequence
  Synthetic
agcagtgaacuagtaccagguga

SEQ ID NO: 48682 - DNA, 29 bp, Artificial Sequence
  Synthetic
tttactgttttguaaactgacctcucaca

SEQ ID NO: 48683 - DNA, 23 bp, Artificial Sequence
  Synthetic
tctatgggucacctccaatcuct

SEQ ID NO: 48684 - DNA, 26 bp, Artificial Sequence
  Synthetic
tgaugaaggaaaaguccaagaaauca

SEQ ID NO: 48685 - DNA, 29 bp, Artificial Sequence
  Synthetic
ctgaactcaguactaagtggttuaaggat

SEQ ID NO: 48686 - DNA, 22 bp, Artificial Sequence
  Synthetic
tggtgagtgugtgccttgtauc

SEQ ID NO: 48687 - DNA, 26 bp, Artificial Sequence
  Synthetic
ggtguggttcaaagauaagggagaaa

SEQ ID NO: 48688 - DNA, 27 bp, Artificial Sequence
  Synthetic
gggcaacagaguattacaatuagaagg

SEQ ID NO: 48689 - DNA, 28 bp, Artificial Sequence
  Synthetic
ggcaagaaguacaagataatgtcugaga

SEQ ID NO: 48690 - DNA, 27 bp, Artificial Sequence
  Synthetic
gaggacaatuaaagaggaggctaaugt

SEQ ID NO: 48691 - DNA, 30 bp, Artificial Sequence; identical to SEQ ID NO: 36457
  Synthetic

SEQ ID NO: 48692 - DNA, 22 bp, Artificial Sequence
  Synthetic
agcacacccacccucctataut

SEQ ID NO: 48693 - DNA, 26 bp, Artificial Sequence
  Synthetic
ggcaactacaagaugactttgguaga

SEQ ID NO: 48694 - DNA, 24 bp, Artificial Sequence
  Synthetic
gcagtgaagcugctttacaaugaa

SEQ ID NO: 48695 - DNA, 23 bp, Artificial Sequence
  Synthetic
aagtgtctuggtacaaggauggg

SEQ ID NO: 48696 - DNA, 28 bp, Artificial Sequence
  Synthetic
gaaaatgaatctgutcacacacacuagg

SEQ ID NO: 48697 - DNA, 26 bp, Artificial Sequence
  Synthetic
gctacgatcagcucctgcatauaaaa

SEQ ID NO: 48698 - DNA, 22 bp, Artificial Sequence
  Synthetic
agcaagtcagucatgccatgua

SEQ ID NO: 48699 - DNA, 31 bp, Artificial Sequence; identical to SEQ ID NO: 36465
  Synthetic

SEQ ID NO: 48700 - DNA, 27 bp, Artificial Sequence
  Synthetic
ggttctauaaggagaaaacatgugggt

SEQ ID NO: 48701 - DNA, 26 bp, Artificial Sequence
  Synthetic
ggaagatttugtcacagaacuggagt

SEQ ID NO: 48702 - DNA, 24 bp, Artificial Sequence
  Synthetic
cacgtccacaugaaagaggtgtua

SEQ ID NO: 48703 - DNA, 22 bp, Artificial Sequence
  Synthetic
tccagctttucggaaaacguct

SEQ ID NO: 48704 - DNA, 21 bp, Artificial Sequence
  Synthetic
ccctccacccccuggaaauat

SEQ ID NO: 48705 - DNA, 28 bp, Artificial Sequence
  Synthetic
tggttcaaagauggaagagaattgtcug

SEQ ID NO: 48706 - DNA, 21 bp, Artificial Sequence
  Synthetic
tctctggcugtgctttgcuac

SEQ ID NO: 48707 - DNA, 25 bp, Artificial Sequence
  Synthetic
tggctgaaagauagaggtgaaguca

SEQ ID NO: 48708 - DNA, 25 bp, Artificial Sequence
  Synthetic
aaaaaugtgagaatcauggccacac

SEQ ID NO: 48709 - DNA, 25 bp, Artificial Sequence
  Synthetic
ccttaatctugaagcctccgatguc

SEQ ID NO: 48710 - DNA, 26 bp, Artificial Sequence
  Synthetic
acattggagaaucacatcagaaccut

SEQ ID NO: 48711 - DNA, 28 bp, Artificial Sequence
  Synthetic
tcatatgaucacaccagtcactctucaa

SEQ ID NO: 48712 - DNA, 26 bp, Artificial Sequence
  Synthetic
tgatcgtaagcaaugccacagaatua

SEQ ID NO: 48713 - DNA, 28 bp, Artificial Sequence
  Synthetic
ccttactgacugttttgtttggttuact

SEQ ID NO: 48714 - DNA, 27 bp, Artificial Sequence
  Synthetic
agaattctcaaaugaggagtgttuccc

SEQ ID NO: 48715 - DNA, 24 bp, Artificial Sequence
  Synthetic
cattgccttucttctcatccucca

SEQ ID NO: 48716 - DNA, 29 bp, Artificial Sequence
  Synthetic
tcatcgtctctuaaaagtactccatcuct

SEQ ID NO: 48717 - DNA, 28 bp, Artificial Sequence
  Synthetic
gaacttctcauttcatctccuaacacct

SEQ ID NO: 48718 - DNA, 29 bp, Artificial Sequence
  Synthetic
cagttcctatacuattttctgcttugcat

SEQ ID NO: 48719 - DNA, 24 bp, Artificial Sequence
  Synthetic
ctgggacaccagaaautacagugt

SEQ ID NO: 48720 - DNA, 22 bp, Artificial Sequence
  Synthetic
gaaaggcucacagtuagcaact

SEQ ID NO: 48721 - DNA, 21 bp, Artificial Sequence
  Synthetic
gggcagtatucctgcgagaut

SEQ ID NO: 48722 - DNA, 28 bp, Artificial Sequence
  Synthetic
gttaaaaccaucctttttccaagugaca

SEQ ID NO: 48723 - DNA, 28 bp, Artificial Sequence
  Synthetic
ccttgtgttttucttgtgtttaacugct

SEQ ID NO: 48724 - DNA, 22 bp, Artificial Sequence
  Synthetic
ccagttcugccacagtgtctuc

SEQ ID NO: 48725 - DNA, 31 bp, Artificial Sequence; identical to SEQ ID NO: 36491
  Synthetic

SEQ ID NO: 48726 - DNA, 24 bp, Artificial Sequence
  Synthetic
agaattcaacugcaatgugcagac

SEQ ID NO: 48727 - DNA, 25 bp, Artificial Sequence
  Synthetic
tgagtctcutacctttccucacaca

SEQ ID NO: 48728 - DNA, 25 bp, Artificial Sequence
  Synthetic
agctaaatttgugtttttggcugct

SEQ ID NO: 48729 - DNA, 28 bp, Artificial Sequence
  Synthetic
agactttgacagauggatatcacgttut

SEQ ID NO: 48730 - DNA, 31 bp, Artificial Sequence; identical to SEQ ID NO: 36496
  Synthetic

SEQ ID NO: 48731 - DNA, 28 bp, Artificial Sequence
  Synthetic
acaatttccatccaucttttcctgtuca

SEQ ID NO: 48732 - DNA, 28 bp, Artificial Sequence
  Synthetic
acattgagaatgugaatacttgtgugga

SEQ ID NO: 48733 - DNA, 28 bp, Artificial Sequence
  Synthetic
agtagcccaatucatgagaaattctugt

SEQ ID NO: 48734 - DNA, 21 bp, Artificial Sequence
  Synthetic
gtatgacggccacugagucaa

SEQ ID NO: 48735 - DNA, 29 bp, Artificial Sequence
  Synthetic
tgatactctcctcuttcctgactcttuag

SEQ ID NO: 48736 - DNA, 20 bp, Artificial Sequence
  Synthetic
gucgaccctuccaagccaat

SEQ ID NO: 48737 - DNA, 31 bp, Artificial Sequence; identical to SEQ ID NO: 36503
  Synthetic

SEQ ID NO: 48738 - DNA, 29 bp, Artificial Sequence
  Synthetic
tccagautattaactuccagagacacaga

SEQ ID NO: 48739 - DNA, 23 bp, Artificial Sequence
  Synthetic
gttttgcugtttgcatuggacag

SEQ ID NO: 48740 - DNA, 23 bp, Artificial Sequence
  Synthetic
gcttccgaagucatttuccacct

SEQ ID NO: 48741 - DNA, 23 bp, Artificial Sequence
  Synthetic
catgacctuggaatgtgttgugg

SEQ ID NO: 48742 - DNA, 27 bp, Artificial Sequence
  Synthetic
ctgctaatgaaacugtcgctauagact

SEQ ID NO: 48743 - DNA, 29 bp, Artificial Sequence
  Synthetic
tgtctatatttcatutgtggacagtgugg

SEQ ID NO: 48744 - DNA, 31 bp, Artificial Sequence; identical to SEQ ID NO: 36510
  Synthetic

SEQ ID NO: 48745 - DNA, 24 bp, Artificial Sequence
  Synthetic
cgtttgaagucacttggcugaaga

SEQ ID NO: 48746 - DNA, 23 bp, Artificial Sequence
  Synthetic
cucaagggaagaucccaaactua

SEQ ID NO: 48747 - DNA, 26 bp, Artificial Sequence
  Synthetic
gggaatgaaauaacagccatucagaa

SEQ ID NO: 48748 - DNA, 29 bp, Artificial Sequence
  Synthetic
caagaaaatcuagacaagcaagaaaguga

SEQ ID NO: 48749 - DNA, 25 bp, Artificial Sequence
  Synthetic
aacaaagagutacacucaggagcag

SEQ ID NO: 48750 - DNA, 31 bp, Artificial Sequence; identical to SEQ ID NO: 36516
  Synthetic

SEQ ID NO: 48751 - DNA, 22 bp, Artificial Sequence
  Synthetic
cccataagcauccagtggtuca

SEQ ID NO: 48752 - DNA, 24 bp, Artificial Sequence
  Synthetic
cccaaucctctctguagaagaaca

SEQ ID NO: 48753 - DNA, 27 bp, Artificial Sequence
  Synthetic
gactaaggagatuacagccaaatggut

SEQ ID NO: 48754 - DNA, 21 bp, Artificial Sequence
  Synthetic
ccaaggcaaacgutcugaacc

SEQ ID NO: 48755 - DNA, 24 bp, Artificial Sequence
  Synthetic
gccaattacggugacttggcuaaa

SEQ ID NO: 48756 - DNA, 22 bp, Artificial Sequence
  Synthetic
cttcagaaaagccagucccuca

SEQ ID NO: 48757 - DNA, 28 bp, Artificial Sequence
  Synthetic
ctgcgaagtgguagaaagtataagacut

SEQ ID NO: 48758 - DNA, 22 bp, Artificial Sequence
  Synthetic
ggccauaacttuggcaacacaa

SEQ ID NO: 48759 - DNA, 29 bp, Artificial Sequence
  Synthetic
tgauagagaaatuaaggagagcagcaaac

SEQ ID NO: 48760 - DNA, 26 bp, Artificial Sequence
  Synthetic
acaaggtuagcacaaagatgucaaga

SEQ ID NO: 48761 - DNA, 22 bp, Artificial Sequence
  Synthetic
caacaaagagcuggtttcuggt

SEQ ID NO: 48762 - DNA, 24 bp, Artificial Sequence
  Synthetic
gataaaaugcaaagtcuccagcca

SEQ ID NO: 48763 - DNA, 28 bp, Artificial Sequence
  Synthetic
aaagaaatagcugcttctgacagauaca

SEQ ID NO: 48764 - DNA, 26 bp, Artificial Sequence
  Synthetic
gttgggttucaaatgcatatguagca

SEQ ID NO: 48765 - DNA, 23 bp, Artificial Sequence
  Synthetic
gtacaaagaugggagaccctugg

SEQ ID NO: 48766 - DNA, 29 bp, Artificial Sequence
  Synthetic
gcaatttgagguttaaatgttccuacaca

SEQ ID NO: 48767 - DNA, 27 bp, Artificial Sequence
  Synthetic
ggtcaucagagaagacggaaaaaucaa

SEQ ID NO: 48768 - DNA, 28 bp, Artificial Sequence
  Synthetic
gataggauaagagaagaaaguaccagut

SEQ ID NO: 48769 - DNA, 27 bp, Artificial Sequence
  Synthetic
tgttggtgaataugaatgtgttgtugc

SEQ ID NO: 48770 - DNA, 26 bp, Artificial Sequence
  Synthetic
gaaccagcuaatttcaaatgguccag

SEQ ID NO: 48771 - DNA, 25 bp, Artificial Sequence
  Synthetic
ggtttgtttacugagtttccaucca

SEQ ID NO: 48772 - DNA, 22 bp, Artificial Sequence
  Synthetic
ggatcacaggugagccttucag

SEQ ID NO: 48773 - DNA, 24 bp, Artificial Sequence
  Synthetic
ttatgtgtgtugggtctctttgut

SEQ ID NO: 48774 - DNA, 30 bp, Artificial Sequence; identical to SEQ ID NO: 36540
  Synthetic

SEQ ID NO: 48775 - DNA, 25 bp, Artificial Sequence
  Synthetic
gccaagcagagutgatcatcatuga

SEQ ID NO: 48776 - DNA, 22 bp, Artificial Sequence
  Synthetic
agagtgcagcaccauctttcug

SEQ ID NO: 48777 - DNA, 29 bp, Artificial Sequence
  Synthetic
gacttaactcaucttttctctgtctugga

SEQ ID NO: 48778 - DNA, 22 bp, Artificial Sequence
  Synthetic
cacctgggutctcaggattuca

SEQ ID NO: 48779 - DNA, 26 bp, Artificial Sequence
  Synthetic
ttaatggactcuacttcccttugcag

SEQ ID NO: 48780 - DNA, 23 bp, Artificial Sequence
  Synthetic
ggcctcacagacauactctccut

SEQ ID NO: 48781 - DNA, 23 bp, Artificial Sequence
  Synthetic
ggatggccccaugatacauacac

SEQ ID NO: 48782 - DNA, 22 bp, Artificial Sequence
  Synthetic
gctgaagcaaccccuttaguga

SEQ ID NO: 48783 - DNA, 24 bp, Artificial Sequence
  Synthetic
cctaacagcugagggtccuagaat

SEQ ID NO: 48784 - DNA, 22 bp, Artificial Sequence
  Synthetic
acatgatgtguctgggctctug

SEQ ID NO: 48785 - DNA, 25 bp, Artificial Sequence
  Synthetic
ggcaataaagaaagugcaggaggua

SEQ ID NO: 48786 - DNA, 22 bp, Artificial Sequence
  Synthetic
cutcctcaattcugaccgcaga

SEQ ID NO: 48787 - DNA, 21 bp, Artificial Sequence
  Synthetic
cacaaagugcgctcatctuga

SEQ ID NO: 48788 - DNA, 26 bp, Artificial Sequence
  Synthetic
tggaggttcuattgaagactguggat

SEQ ID NO: 48789 - DNA, 24 bp, Artificial Sequence
  Synthetic
ccaacctacagcugcagattguac

SEQ ID NO: 48790 - DNA, 26 bp, Artificial Sequence
  Synthetic
ctgctcaatucattggcttuagcaat

SEQ ID NO: 48791 - DNA, 21 bp, Artificial Sequence
  Synthetic
cugcaaagcaaaguccacacc

SEQ ID NO: 48792 - DNA, 25 bp, Artificial Sequence
  Synthetic
gttccagagccautagggttaugaa

SEQ ID NO: 48793 - DNA, 23 bp, Artificial Sequence
  Synthetic
gaaacagaaucagcaguggcaaa

SEQ ID NO: 48794 - DNA, 25 bp, Artificial Sequence
  Synthetic
gctatgaucatcaccgucaaaaaca

SEQ ID NO: 48795 - DNA, 27 bp, Artificial Sequence
  Synthetic
gtctgaatcuccagtttacccaacuaa

SEQ ID NO: 48796 - DNA, 24 bp, Artificial Sequence
  Synthetic
gggtcuccaaggtaatgaatucaa

SEQ ID NO: 48797 - DNA, 25 bp, Artificial Sequence
  Synthetic
caaacaaaucaggaatggcugagag

SEQ ID NO: 48798 - DNA, 22 bp, Artificial Sequence
  Synthetic
gccacttucctcaacagugaac

SEQ ID NO: 48799 - DNA, 28 bp, Artificial Sequence
  Synthetic
tcttaaagagcaacuacacagacagtut

SEQ ID NO: 48800 - DNA, 26 bp, Artificial Sequence
  Synthetic
agatagcctcucctacacaatucaca

SEQ ID NO: 48801 - DNA, 31 bp, Artificial Sequence; identical to SEQ ID NO: 36567
  Synthetic

SEQ ID NO: 48802 - DNA, 30 bp, Artificial Sequence; identical to SEQ ID NO: 36568
  Synthetic

SEQ ID NO: 48803 - DNA, 25 bp, Artificial Sequence
  Synthetic
gattuggaacacaccacatcaucaa

SEQ ID NO: 48804 - DNA, 23 bp, Artificial Sequence
  Synthetic
gcaaagctctutgcttccccuat

SEQ ID NO: 48805 - DNA, 26 bp, Artificial Sequence
  Synthetic
cattgttgaagutgaaggtctuccag

SEQ ID NO: 48806 - DNA, 28 bp, Artificial Sequence
  Synthetic
catatttcataagcugaacccctctcut

SEQ ID NO: 48807 - DNA, 23 bp, Artificial Sequence
  Synthetic
actcuggagagatacuccacacc

SEQ ID NO: 48808 - DNA, 27 bp, Artificial Sequence
  Synthetic
ggagtatctttcucctacctcacctuc

SEQ ID NO: 48809 - DNA, 27 bp, Artificial Sequence
  Synthetic
gatcagttttauaccccaccatcauct

SEQ ID NO: 48810 - DNA, 31 bp, Artificial Sequence; identical to SEQ ID NO: 36576
  Synthetic

SEQ ID NO: 48811 - DNA, 25 bp, Artificial Sequence
  Synthetic
agaatcugagacctcccuaacacaa

SEQ ID NO: 48812 - DNA, 25 bp, Artificial Sequence
  Synthetic
acatttttcttcuccagaggcauga

SEQ ID NO: 48813 - DNA, 22 bp, Artificial Sequence
  Synthetic
gcattuccaaagcaggatggug

SEQ ID NO: 48814 - DNA, 28 bp, Artificial Sequence
  Synthetic
aggacaacttttcucagaaagatcagut

SEQ ID NO: 48815 - DNA, 28 bp, Artificial Sequence
  Synthetic
gagctttcaaauagaactatgguggaga

SEQ ID NO: 48816 - DNA, 27 bp, Artificial Sequence
  Synthetic
tgtaacgttucagggctaggaatttut

SEQ ID NO: 48817 - DNA, 28 bp, Artificial Sequence
  Synthetic
cacactcaaauaaaacacacagatguga

SEQ ID NO: 48818 - DNA, 24 bp, Artificial Sequence
  Synthetic
ttccctttctugtgcgtcaaatuc

SEQ ID NO: 48819 - DNA, 29 bp, Artificial Sequence
  Synthetic
ctcaaaagaagatugatgacaaagcctut

SEQ ID NO: 48820 - DNA, 24 bp, Artificial Sequence
  Synthetic
ctttttccccggguagtgtatcuc

SEQ ID NO: 48821 - DNA, 29 bp, Artificial Sequence
  Synthetic
ttggaaaacutggtagaucagaaaaggaa

SEQ ID NO: 48822 - DNA, 26 bp, Artificial Sequence
  Synthetic
gacattgtatgaautcagccctgaug

SEQ ID NO: 48823 - DNA, 31 bp, Artificial Sequence; identical to SEQ ID NO: 36589
  Synthetic

SEQ ID NO: 48824 - DNA, 25 bp, Artificial Sequence
  Synthetic
ttctctataagugacaggcuccact

SEQ ID NO: 48825 - DNA, 25 bp, Artificial Sequence
  Synthetic
cagccagtugtaacatggttucaaa

SEQ ID NO: 48826 - DNA, 30 bp, Artificial Sequence; identical to SEQ ID NO: 36592
  Synthetic

SEQ ID NO: 48827 - DNA, 24 bp, Artificial Sequence
  Synthetic
gtcaagagggucaaacaaauctuc

SEQ ID NO: 48828 - DNA, 29 bp, Artificial Sequence
  Synthetic
gacatcatgttttugttttgctttcacut

SEQ ID NO: 48829 - DNA, 28 bp, Artificial Sequence
  Synthetic
gatatcctcaaccuatagtgacgtggua

SEQ ID NO: 48830 - DNA, 27 bp, Artificial Sequence
  Synthetic
atgttttcttccutctgttcggtttug

SEQ ID NO: 48831 - DNA, 27 bp, Artificial Sequence
  Synthetic
agaaggaggaaguatatgagactccug

SEQ ID NO: 48832 - DNA, 25 bp, Artificial Sequence
  Synthetic
ggtagactttccuttaccagtgcut

SEQ ID NO: 48833 - DNA, 29 bp, Artificial Sequence
  Synthetic
ctctagagaggacaugaaaatcagatcua

SEQ ID NO: 48834 - DNA, 22 bp, Artificial Sequence
  Synthetic
cctccctuaaacgttgcaacut

SEQ ID NO: 48835 - DNA, 25 bp, Artificial Sequence
  Synthetic
ggtttactggcuctcccttuaacaa

SEQ ID NO: 48836 - DNA, 29 bp, Artificial Sequence
  Synthetic
tccgttctgcucttttcagaaattcuaaa

SEQ ID NO: 48837 - DNA, 27 bp, Artificial Sequence
  Synthetic
atttacaccatcacucttccagctuag

SEQ ID NO: 48838 - DNA, 28 bp, Artificial Sequence
  Synthetic
aaccggttcacccuctaaaacatattua

SEQ ID NO: 48839 - DNA, 25 bp, Artificial Sequence
  Synthetic
gggaauctgaacatucagaaaggga

SEQ ID NO: 48840 - DNA, 26 bp, Artificial Sequence
  Synthetic
ttttgtgattguttcagtctcucgga

SEQ ID NO: 48841 - DNA, 27 bp, Artificial Sequence
  Synthetic
aattgcagaaagcacugagctatcuaa

SEQ ID NO: 48842 - DNA, 27 bp, Artificial Sequence
  Synthetic
ccttttgagatautttgctctccucct

SEQ ID NO: 48843 - DNA, 29 bp, Artificial Sequence
  Synthetic
gggcaagugacaaaguttagatcttaaua

SEQ ID NO: 48844 - DNA, 24 bp, Artificial Sequence
  Synthetic
actattggcugctttgcaagagua

SEQ ID NO: 48845 - DNA, 22 bp, Artificial Sequence
  Synthetic
gatttcaugcgagggtttcugg

SEQ ID NO: 48846 - DNA, 29 bp, Artificial Sequence
  Synthetic
ggaacaacaatgauttacatgaactctug

SEQ ID NO: 48847 - DNA, 27 bp, Artificial Sequence
  Synthetic
agaagatgaaggaacutacacgttugt

SEQ ID NO: 48848 - DNA, 29 bp, Artificial Sequence
  Synthetic
tttgtaagtatuggcaatgacacctttug

SEQ ID NO: 48849 - DNA, 28 bp, Artificial Sequence
  Synthetic
tgtgaggtctcuatggtgacttaaucat

SEQ ID NO: 48850 - DNA, 28 bp, Artificial Sequence
  Synthetic
cttcaatuagcaaaagugtgtattctug

SEQ ID NO: 48851 - DNA, 27 bp, Artificial Sequence
  Synthetic
atgggctattugtcaacatttacucct

SEQ ID NO: 48852 - DNA, 25 bp, Artificial Sequence
  Synthetic
gtctcagagauaaacattcggugga

SEQ ID NO: 48853 - DNA, 28 bp, Artificial Sequence
  Synthetic
gagcttcaagttuttgttgttgttgtug

SEQ ID NO: 48854 - DNA, 22 bp, Artificial Sequence
  Synthetic
gatgcgaacauctctgcctuct

SEQ ID NO: 48855 - DNA, 28 bp, Artificial Sequence
  Synthetic
ggtaaactcgaauttccatttcauccat

SEQ ID NO: 48856 - DNA, 28 bp, Artificial Sequence
  Synthetic
tgaaaccataccutccacataaagtgug

SEQ ID NO: 48857 - DNA, 28 bp, Artificial Sequence
  Synthetic
cagtgaactaugaaggcatctctuacaa

SEQ ID NO: 48858 - DNA, 22 bp, Artificial Sequence
  Synthetic
agtggucagcaaagtguaggat

SEQ ID NO: 48859 - DNA, 22 bp, Artificial Sequence
  Synthetic
acagaggacucggcagaauaca

SEQ ID NO: 48860 - DNA, 21 bp, Artificial Sequence
  Synthetic
gggacautgaagugggacacc

SEQ ID NO: 48861 - DNA, 28 bp, Artificial Sequence
  Synthetic
tgaaccccatguatctatttgtttggut

SEQ ID NO: 48862 - DNA, 22 bp, Artificial Sequence
  Synthetic
cagcatcagcutgtggacttuc

SEQ ID NO: 48863 - DNA, 28 bp, Artificial Sequence
  Synthetic
tcactgaattgcuccaattttcctctua

SEQ ID NO: 48864 - DNA, 30 bp, Artificial Sequence; identical to SEQ ID NO: 36630
  Synthetic

SEQ ID NO: 48865 - DNA, 28 bp, Artificial Sequence
  Synthetic
ggacttcttttccutgatgatgtcauct

SEQ ID NO: 48866 - DNA, 23 bp, Artificial Sequence
  Synthetic
tgtcauctaatttgguggcagca

SEQ ID NO: 48867 - DNA, 29 bp, Artificial Sequence
  Synthetic
actcatactguacatctcttgtuccaaag

SEQ ID NO: 48868 - DNA, 26 bp, Artificial Sequence
  Synthetic
tttagaactgggcutgatttcctugt

SEQ ID NO: 48869 - DNA, 29 bp, Artificial Sequence
  Synthetic
tttcccagtguaacaataaccaagagaut

SEQ ID NO: 48870 - DNA, 24 bp, Artificial Sequence
  Synthetic
ttcggttaatgacuagtcgctgut

SEQ ID NO: 48871 - DNA, 29 bp, Artificial Sequence
  Synthetic
attcatcttgtgugtgtatgatttugcag

SEQ ID NO: 48872 - DNA, 22 bp, Artificial Sequence
  Synthetic
gggctggaauggtgaaagagua

SEQ ID NO: 48873 - DNA, 28 bp, Artificial Sequence
  Synthetic
tgaagttaaagtcuccttggaaagtgug

SEQ ID NO: 48874 - DNA, 21 bp, Artificial Sequence
  Synthetic
gcugacaggaaugggaggact

SEQ ID NO: 48875 - DNA, 29 bp, Artificial Sequence
  Synthetic
tgtggagcttaaauccaatggcaaataua

SEQ ID NO: 48876 - DNA, 27 bp, Artificial Sequence
  Synthetic
ctaattttaccacaugctaagggugac

SEQ ID NO: 48877 - DNA, 24 bp, Artificial Sequence
  Synthetic
ggatgcactcugacagaaaggtuc

SEQ ID NO: 48878 - DNA, 27 bp, Artificial Sequence
  Synthetic
aatacaaagacagguccaucaaaggaa

SEQ ID NO: 48879 - DNA, 21 bp, Artificial Sequence
  Synthetic
attgaacgguctgaccggauc

SEQ ID NO: 48880 - DNA, 28 bp, Artificial Sequence
  Synthetic
actaggactuagttcaatcttgucaggt

SEQ ID NO: 48881 - DNA, 24 bp, Artificial Sequence
  Synthetic
caguaaatucaagcgcagaacaga

SEQ ID NO: 48882 - DNA, 25 bp, Artificial Sequence
  Synthetic
cttcaaactgaagcuttcctggtuc

SEQ ID NO: 48883 - DNA, 25 bp, Artificial Sequence
  Synthetic
aggttcagagtucgctatgatggua

SEQ ID NO: 48884 - DNA, 26 bp, Artificial Sequence
  Synthetic
ctggcttttgcutttctttctgauct

SEQ ID NO: 48885 - DNA, 30 bp, Artificial Sequence; identical to SEQ ID NO: 36651
  Synthetic

SEQ ID NO: 48886 - DNA, 23 bp, Artificial Sequence
  Synthetic
gtgttagccugcattcaaagugg

SEQ ID NO: 48887 - DNA, 24 bp, Artificial Sequence
  Synthetic
gccugagccagagagaaagtuaat

SEQ ID NO: 48888 - DNA, 28 bp, Artificial Sequence
  Synthetic
atcaatatagtgguatagcttcccuggt

SEQ ID NO: 48889 - DNA, 26 bp, Artificial Sequence
  Synthetic
acttgaaaugaaagtcagagcuacgg

SEQ ID NO: 48890 - DNA, 28 bp, Artificial Sequence
  Synthetic
gctgaaataccugtttataacccaagug

SEQ ID NO: 48891 - DNA, 31 bp, Artificial Sequence; identical to SEQ ID NO: 36657
  Synthetic

SEQ ID NO: 48892 - DNA, 29 bp, Artificial Sequence
  Synthetic
gattcatgagcaaaaacutatcacgctua

SEQ ID NO: 48893 - DNA, 28 bp, Artificial Sequence
  Synthetic
acagatgagucacaacttgagagacuat

SEQ ID NO: 48894 - DNA, 27 bp, Artificial Sequence
  Synthetic
ttagcccucgattttcttctuacacaa

SEQ ID NO: 48895 - DNA, 23 bp, Artificial Sequence
  Synthetic
gaaattgtatguggagcctgcug

SEQ ID NO: 48896 - DNA, 29 bp, Artificial Sequence
  Synthetic
ccatcttgtagaaaguccatttggtauct

SEQ ID NO: 48897 - DNA, 26 bp, Artificial Sequence
  Synthetic
aacatttatcauagctcctugccaca

SEQ ID NO: 48898 - DNA, 29 bp, Artificial Sequence
  Synthetic
ctgattcaacagcutcagattcagaaaug

SEQ ID NO: 48899 - DNA, 27 bp, Artificial Sequence
  Synthetic
aacagtctagcucagatacatctccut

SEQ ID NO: 48900 - DNA, 28 bp, Artificial Sequence
  Synthetic
actacagtatctutggccattttctucc

SEQ ID NO: 48901 - DNA, 26 bp, Artificial Sequence
  Synthetic
tuactgatgaagucccagcaagaaat

SEQ ID NO: 48902 - DNA, 25 bp, Artificial Sequence
  Synthetic
gggtgaguaaattctactcuaggct

SEQ ID NO: 48903 - DNA, 22 bp, Artificial Sequence
  Synthetic
ctgccgcgccutactttatuac

SEQ ID NO: 48904 - DNA, 22 bp, Artificial Sequence
  Synthetic
ccctcatatuagcttccgggut

SEQ ID NO: 48905 - DNA, 27 bp, Artificial Sequence
  Synthetic
gggtcactaaacauctcatctcaauga

SEQ ID NO: 48906 - DNA, 27 bp, Artificial Sequence
  Synthetic
gtcaatggaactutcgatttggtaguc

SEQ ID NO: 48907 - DNA, 28 bp, Artificial Sequence
  Synthetic
gcagttgaaaugcataagttcaaacuct

SEQ ID NO: 48908 - DNA, 21 bp, Artificial Sequence
  Synthetic
gcaagacuccactggctacut

SEQ ID NO: 48909 - DNA, 21 bp, Artificial Sequence
  Synthetic
ccttcgcugacacaccagaua

SEQ ID NO: 48910 - DNA, 24 bp, Artificial Sequence
  Synthetic
cagagatgctcugtttcacaggut

SEQ ID NO: 48911 - DNA, 28 bp, Artificial Sequence
  Synthetic
ggtatcacugagtttcatttcaaugcag

SEQ ID NO: 48912 - DNA, 20 bp, Artificial Sequence
  Synthetic
ctaccttugcggcggaaaug

SEQ ID NO: 48913 - DNA, 31 bp, Artificial Sequence; identical to SEQ ID NO: 36679
  Synthetic

SEQ ID NO: 48914 - DNA, 25 bp, Artificial Sequence
  Synthetic
tcaccttcucctgagttattugcac

SEQ ID NO: 48915 - DNA, 28 bp, Artificial Sequence
  Synthetic
cctcctttctttutgacttacgtttcut

SEQ ID NO: 48916 - DNA, 27 bp, Artificial Sequence
  Synthetic
aagacttctccauttaagggtttugac

SEQ ID NO: 48917 - DNA, 30 bp, Artificial Sequence; identical to SEQ ID NO: 36683
  Synthetic

SEQ ID NO: 48918 - DNA, 27 bp, Artificial Sequence
  Synthetic
tgattatctgtgutgacccctguaaga

SEQ ID NO: 48919 - DNA, 29 bp, Artificial Sequence
  Synthetic
gtgttttctucctttctctaugaaaagca

SEQ ID NO: 48920 - DNA, 24 bp, Artificial Sequence
  Synthetic
ctgatcactggutctctcactcug

SEQ ID NO: 48921 - DNA, 24 bp, Artificial Sequence
  Synthetic
gtattttgcuctaggtggcucagt

SEQ ID NO: 48922 - DNA, 24 bp, Artificial Sequence
  Synthetic
ctgatctgaguagaggttgucagc

SEQ ID NO: 48923 - DNA, 24 bp, Artificial Sequence
  Synthetic
tcttgacctcugccttttggttut

SEQ ID NO: 48924 - DNA, 21 bp, Artificial Sequence
  Synthetic
gtgcttuggcagcaauagacg

SEQ ID NO: 48925 - DNA, 26 bp, Artificial Sequence
  Synthetic
ctcaacgtgggcuttgttttaatcut

SEQ ID NO: 48926 - DNA, 23 bp, Artificial Sequence
  Synthetic
ctuggccccattuagacacaaac

SEQ ID NO: 48927 - DNA, 22 bp, Artificial Sequence
  Synthetic
ccagagcucccttgattuccaa

SEQ ID NO: 48928 - DNA, 22 bp, Artificial Sequence
  Synthetic
gcatctaccuctgcccauagct

SEQ ID NO: 48929 - DNA, 26 bp, Artificial Sequence
  Synthetic
actaaagccaacaguggacgatatuc

SEQ ID NO: 48930 - DNA, 22 bp, Artificial Sequence
  Synthetic
tcaagtccugcagcaacgtuaa

SEQ ID NO: 48931 - DNA, 26 bp, Artificial Sequence
  Synthetic
ccttagcugggacaccctaatttaut

SEQ ID NO: 48932 - DNA, 24 bp, Artificial Sequence
  Synthetic
aggtttaaagcauggccacattuc

SEQ ID NO: 48933 - DNA, 25 bp, Artificial Sequence
  Synthetic
tttgtatttggcautggcattgugt

SEQ ID NO: 48934 - DNA, 26 bp, Artificial Sequence
  Synthetic
tgatgcaacutccattaagucaccat

SEQ ID NO: 48935 - DNA, 28 bp, Artificial Sequence
  Synthetic
gcgttagtagcuagagataaaccaagua

SEQ ID NO: 48936 - DNA, 25 bp, Artificial Sequence
  Synthetic
ccaacagttaautggatacccugga

SEQ ID NO: 48937 - DNA, 28 bp, Artificial Sequence
  Synthetic
gtgagggaaaauaaccaatcacttucat

SEQ ID NO: 48938 - DNA, 29 bp, Artificial Sequence
  Synthetic
cattgagttttuacctacctttctugcac

SEQ ID NO: 48939 - DNA, 26 bp, Artificial Sequence
  Synthetic
ggcactggcaaaacutaagtaaguct

SEQ ID NO: 48940 - DNA, 25 bp, Artificial Sequence
  Synthetic
gaacctgccutttcttaaagtcuga

SEQ ID NO: 48941 - DNA, 26 bp, Artificial Sequence
  Synthetic
gtgcatgttutaaaattgcttuggca

SEQ ID NO: 48942 - DNA, 26 bp, Artificial Sequence
  Synthetic
ttacacatcaguccaacacttuagca

SEQ ID NO: 48943 - DNA, 29 bp, Artificial Sequence
  Synthetic
aatttaggtaugttattcacagugggcat

SEQ ID NO: 48944 - DNA, 27 bp, Artificial Sequence
  Synthetic
ttacaagtagttucccaagtttgcaut

SEQ ID NO: 48945 - DNA, 28 bp, Artificial Sequence
  Synthetic
gctacccaggtutattatgagaaggtug

SEQ ID NO: 48946 - DNA, 28 bp, Artificial Sequence
  Synthetic
ggctgattaaaattucccatgaggagua

SEQ ID NO: 48947 - DNA, 30 bp, Artificial Sequence; identical to SEQ ID NO: 36713
  Synthetic

SEQ ID NO: 48948 - DNA, 20 bp, Artificial Sequence
  Synthetic
agcaaaagcucgtgggtgua

SEQ ID NO: 48949 - DNA, 20 bp, Artificial Sequence
  Synthetic
aucttcgagaucgggaggga

SEQ ID NO: 48950 - DNA, 17 bp, Artificial Sequence
  Synthetic
gcacucacccggtucct

SEQ ID NO: 48951 - DNA, 17 bp, Artificial Sequence
  Synthetic
gccagggugctggacug

SEQ ID NO: 48952 - DNA, 28 bp, Artificial Sequence
  Synthetic
ccattgcctuaaaatgttgcatttguct

SEQ ID NO: 48953 - DNA, 21 bp, Artificial Sequence
  Synthetic
gtttctggtcutcgcagccua

SEQ ID NO: 48954 - DNA, 26 bp, Artificial Sequence
  Synthetic
cacgtcucaacaattaauaaccgcaa

SEQ ID NO: 48955 - DNA, 27 bp, Artificial Sequence
  Synthetic
ggacaaaguaagccttggacttttuag

SEQ ID NO: 48956 - DNA, 23 bp, Artificial Sequence
  Synthetic
gtaggacugagatgtuggcagac

SEQ ID NO: 48957 - DNA, 25 bp, Artificial Sequence
  Synthetic
attttaacctcutcccaatcuggct

SEQ ID NO: 48958 - DNA, 22 bp, Artificial Sequence
  Synthetic
gctgtctgggutggaaggaauc

SEQ ID NO: 48959 - DNA, 22 bp, Artificial Sequence
  Synthetic
ggtggcugatgaactttugcac

SEQ ID NO: 48960 - DNA, 24 bp, Artificial Sequence
  Synthetic
ggttgaaagccaucagttgatugg

SEQ ID NO: 48961 - DNA, 28 bp, Artificial Sequence
  Synthetic
tttcagtaagaagccuctaatctgttut

SEQ ID NO: 48962 - DNA, 25 bp, Artificial Sequence
  Synthetic
gggccagtucctccctagtauaaat

SEQ ID NO: 48963 - DNA, 33 bp, Artificial Sequence; identical to SEQ ID NO: 36729
  Synthetic

SEQ ID NO: 48964 - DNA, 25 bp, Artificial Sequence
  Synthetic
cuctctcctttaaugcgaggaaact

SEQ ID NO: 48965 - DNA, 22 bp, Artificial Sequence
  Synthetic
tcttaaccacuttcagccccug

SEQ ID NO: 48966 - DNA, 20 bp, Artificial Sequence
  Synthetic
ctgccgucagatcaccaaug

SEQ ID NO: 48967 - DNA, 25 bp, Artificial Sequence
  Synthetic
agtaaatucgggaaaggugaagagg

SEQ ID NO: 48968 - DNA, 22 bp, Artificial Sequence
  Synthetic
gggagaggutaatgggccuagt

SEQ ID NO: 48969 - DNA, 21 bp, Artificial Sequence
  Synthetic
tgcccgccugttctctuaaag

SEQ ID NO: 48970 - DNA, 22 bp, Artificial Sequence
  Synthetic
gtatggagccaguctcctggua

SEQ ID NO: 48971 - DNA, 24 bp, Artificial Sequence
  Synthetic
gcttctcuttttcacctucccaca

SEQ ID NO: 48972 - DNA, 18 bp, Artificial Sequence
  Synthetic
caucatccugggcacagc

SEQ ID NO: 48973 - DNA, 18 bp, Artificial Sequence
  Synthetic
tttcccgggutccagcuc

SEQ ID NO: 48974 - DNA, 26 bp, Artificial Sequence
  Synthetic
ggatgcutcagtcttuacagaacagg

SEQ ID NO: 48975 - DNA, 26 bp, Artificial Sequence
  Synthetic
agtgatttgauggctgtaatcctuca

SEQ ID NO: 48976 - DNA, 21 bp, Artificial Sequence
  Synthetic
ccagaucagcccccaaattuc

SEQ ID NO: 48977 - DNA, 28 bp, Artificial Sequence
  Synthetic
ctgtttctaagcugcatttcacttucaa

SEQ ID NO: 48978 - DNA, 20 bp, Artificial Sequence
  Synthetic
gccctttccauctggaggug

SEQ ID NO: 48979 - DNA, 19 bp, Artificial Sequence
  Synthetic
ctagcggugcccacgtuat

SEQ ID NO: 48980 - DNA, 30 bp, Artificial Sequence; identical to SEQ ID NO: 36746
  Synthetic

SEQ ID NO: 48981 - DNA, 25 bp, Artificial Sequence
  Synthetic
tggguacagacattcacuaggaagt

SEQ ID NO: 48982 - DNA, 25 bp, Artificial Sequence
  Synthetic
cctgatcaatuacacacacggguat

SEQ ID NO: 48983 - DNA, 30 bp, Artificial Sequence; identical to SEQ ID NO: 36749
  Synthetic

SEQ ID NO: 48984 - DNA, 29 bp, Artificial Sequence
  Synthetic
ttcaaatagcagatuccatcattagccut

SEQ ID NO: 48985 - DNA, 26 bp, Artificial Sequence
  Synthetic
gggagcucactaaactatucacaagt

SEQ ID NO: 48986 - DNA, 22 bp, Artificial Sequence
  Synthetic
ggcagattccaucatcagccut

SEQ ID NO: 48987 - DNA, 29 bp, Artificial Sequence
  Synthetic
gctcacugaagacccuaatttaaactaut

SEQ ID NO: 48988 - DNA, 21 bp, Artificial Sequence
  Synthetic
gtggtcacauagtggtgcuct

SEQ ID NO: 48989 - DNA, 27 bp, Artificial Sequence
  Synthetic
ctggatctgagcuctgaaatgactuat

SEQ ID NO: 48990 - DNA, 21 bp, Artificial Sequence
  Synthetic
cccaccauagcctcttggtug

SEQ ID NO: 48991 - DNA, 29 bp, Artificial Sequence
  Synthetic
agtccctgcaauctgtaataatttcctut

SEQ ID NO: 48992 - DNA, 22 bp, Artificial Sequence
  Synthetic
tcaggatctcaucgctttgcug

SEQ ID NO: 48993 - DNA, 22 bp, Artificial Sequence
  Synthetic
agggtactgaugtgtgtcccut

SEQ ID NO: 48994 - DNA, 25 bp, Artificial Sequence
  Synthetic
gcttctgtaaaucgtcaccagatug

SEQ ID NO: 48995 - DNA, 28 bp, Artificial Sequence
  Synthetic
ccatttttauaggaatctcuggaagcct

SEQ ID NO: 48996 - DNA, 21 bp, Artificial Sequence
  Synthetic
cctcatuccacagccctguag

SEQ ID NO: 48997 - DNA, 21 bp, Artificial Sequence
  Synthetic
gggaguggagtgagugaggag

SEQ ID NO: 48998 - DNA, 21 bp, Artificial Sequence
  Synthetic
tgauccggcacctgttucaag

SEQ ID NO: 48999 - DNA, 22 bp, Artificial Sequence
  Synthetic
ctaucctggtacuggaaagcca

SEQ ID NO: 49000 - DNA, 20 bp, Artificial Sequence
  Synthetic
gcactggugacatgccttug

SEQ ID NO: 49001 - DNA, 20 bp, Artificial Sequence
  Synthetic
actcacgacuggcagagtug

SEQ ID NO: 49002 - DNA, 21 bp, Artificial Sequence
  Synthetic
cgtgcttguctaccacuacgg

SEQ ID NO: 49003 - DNA, 21 bp, Artificial Sequence
  Synthetic
gggtgctucagtcaccttcut

SEQ ID NO: 49004 - DNA, 21 bp, Artificial Sequence
  Synthetic
cctggccugaccctaagaugt

SEQ ID NO: 49005 - DNA, 21 bp, Artificial Sequence
  Synthetic
gggcaccaggaugttgaugat

SEQ ID NO: 49006 - DNA, 22 bp, Artificial Sequence
  Synthetic
cccaaggucacagctaagtcug

SEQ ID NO: 49007 - DNA, 20 bp, Artificial Sequence
  Synthetic
gggcaaacacucagctugga

SEQ ID NO: 49008 - DNA, 20 bp, Artificial Sequence
  Synthetic
cctttcttguggcccctuga

SEQ ID NO: 49009 - DNA, 21 bp, Artificial Sequence
  Synthetic
tctcgaacaugaggtcacugc

SEQ ID NO: 49010 - DNA, 22 bp, Artificial Sequence
  Synthetic
tggtcttggutttcagcccauc

SEQ ID NO: 49011 - DNA, 21 bp, Artificial Sequence
  Synthetic
ggcaatccugtggtccctuac

SEQ ID NO: 49012 - DNA, 21 bp, Artificial Sequence
  Synthetic
gcaggacaagcgcutcatcua

SEQ ID NO: 49013 - DNA, 21 bp, Artificial Sequence
  Synthetic
gatgtccacccucagaccauc

SEQ ID NO: 49014 - DNA, 22 bp, Artificial Sequence
  Synthetic
aggcccagaucgtcaaggauat

SEQ ID NO: 49015 - DNA, 22 bp, Artificial Sequence
  Synthetic
ggaaacugtgtcugcagcagat

SEQ ID NO: 49016 - DNA, 21 bp, Artificial Sequence
  Synthetic
cgtguggaaggtgagcuacac

SEQ ID NO: 49017 - DNA, 26 bp, Artificial Sequence
  Synthetic
tggatctcgaucaggtagctctuaat

SEQ ID NO: 49018 - DNA, 17 bp, Artificial Sequence
  Synthetic
aagguggtgcugcggaa

SEQ ID NO: 49019 - DNA, 20 bp, Artificial Sequence
  Synthetic
cgaagggccautgtgctuct

SEQ ID NO: 49020 - DNA, 17 bp, Artificial Sequence
  Synthetic
gtgguctggaucgcgga

SEQ ID NO: 49021 - DNA, 18 bp, Artificial Sequence
  Synthetic
cggccuccatctccucct

SEQ ID NO: 49022 - DNA, 22 bp, Artificial Sequence
  Synthetic
cggtguggctcttuaacaacct

SEQ ID NO: 49023 - DNA, 28 bp, Artificial Sequence
  Synthetic
cctgtactuaccacaacaaccttatcut

SEQ ID NO: 49024 - DNA, 19 bp, Artificial Sequence
  Synthetic
ggagcgcautgcacaucaa

SEQ ID NO: 49025 - DNA, 25 bp, Artificial Sequence
  Synthetic
gatgttugcccctaaacaucacaat

SEQ ID NO: 49026 - DNA, 23 bp, Artificial Sequence
  Synthetic
cctgaagacaggugcaaagucaa

SEQ ID NO: 49027 - DNA, 24 bp, Artificial Sequence
  Synthetic
cagggtacaucctgtgtcttugag

SEQ ID NO: 49028 - DNA, 20 bp, Artificial Sequence
  Synthetic
ccacgagtugggtccttucg

SEQ ID NO: 49029 - DNA, 28 bp, Artificial Sequence
  Synthetic
ggtgataaaugcacttttgtcatauggt

SEQ ID NO: 49030 - DNA, 22 bp, Artificial Sequence
  Synthetic
caccgagagccacutgtgauag

SEQ ID NO: 49031 - DNA, 31 bp, Artificial Sequence; identical to SEQ ID NO: 36797
  Synthetic

SEQ ID NO: 49032 - DNA, 24 bp, Artificial Sequence
  Synthetic
ggcaatgucaattagcuggaacat

SEQ ID NO: 49033 - DNA, 22 bp, Artificial Sequence
  Synthetic
gtagacctcccugagcacttuc

SEQ ID NO: 49034 - DNA, 21 bp, Artificial Sequence
  Synthetic
acaccaaagcccugcagtuag

SEQ ID NO: 49035 - DNA, 32 bp, Artificial Sequence; identical to SEQ ID NO: 36801
  Synthetic

SEQ ID NO: 49036 - DNA, 27 bp, Artificial Sequence
  Synthetic
cacacaaggauaagccaacagaagaua

SEQ ID NO: 49037 - DNA, 24 bp, Artificial Sequence
  Synthetic
cctcccucagagaaaauctttugt

SEQ ID NO: 49038 - DNA, 22 bp, Artificial Sequence
  Synthetic
ggagggaaugcgaagaaacuct

SEQ ID NO: 49039 - DNA, 25 bp, Artificial Sequence
  Synthetic
cctaaaaaccaguctttccctgcut

SEQ ID NO: 49040 - DNA, 23 bp, Artificial Sequence
  Synthetic
cccucaacaugccagaaagagaa

SEQ ID NO: 49041 - DNA, 33 bp, Artificial Sequence; identical to SEQ ID NO: 36807
  Synthetic

SEQ ID NO: 49042 - DNA, 32 bp, Artificial Sequence; identical to SEQ ID NO: 36808
  Synthetic

SEQ ID NO: 49043 - DNA, 24 bp, Artificial Sequence
  Synthetic
tccagctgcauctctcctacaaua

SEQ ID NO: 49044 - DNA, 20 bp, Artificial Sequence
  Synthetic
agaactgcgcuctcttcucg

SEQ ID NO: 49045 - DNA, 20 bp, Artificial Sequence
  Synthetic
cccctccguacctgctctua

SEQ ID NO: 49046 - DNA, 30 bp, Artificial Sequence; identical to SEQ ID NO: 36812
  Synthetic

SEQ ID NO: 49047 - DNA, 22 bp, Artificial Sequence
  Synthetic
tcauacacggcagccacauaat

SEQ ID NO: 49048 - DNA, 23 bp, Artificial Sequence
  Synthetic
cggttcttccugccatctgauaa

SEQ ID NO: 49049 - DNA, 24 bp, Artificial Sequence
  Synthetic
acugaggaaaaagguaggaaucac

SEQ ID NO: 49050 - DNA, 26 bp, Artificial Sequence
  Synthetic
acaaatgtcgugttcagcaataaugg

SEQ ID NO: 49051 - DNA, 21 bp, Artificial Sequence
  Synthetic
aggcagutggguacacaacat

SEQ ID NO: 49052 - DNA, 23 bp, Artificial Sequence
  Synthetic
ctctggaguccttttgguaccat

SEQ ID NO: 49053 - DNA, 21 bp, Artificial Sequence
  Synthetic
ggagcatucacgttccactug

SEQ ID NO: 49054 - DNA, 24 bp, Artificial Sequence
  Synthetic
accttauccaaagagctgtaugcc

SEQ ID NO: 49055 - DNA, 24 bp, Artificial Sequence
  Synthetic
gtcatcccugaggucagaaacaaa

SEQ ID NO: 49056 - DNA, 21 bp, Artificial Sequence
  Synthetic
gcgcttgtaugagagggacua

SEQ ID NO: 49057 - DNA, 28 bp, Artificial Sequence
  Synthetic
aatgtctcgaugattgaggttuaagagg

SEQ ID NO: 49058 - DNA, 17 bp, Artificial Sequence
  Synthetic
tcuggcccgcacatcug

SEQ ID NO: 49059 - DNA, 17 bp, Artificial Sequence
  Synthetic
tgaacgugcggugggat

SEQ ID NO: 49060 - DNA, 31 bp, Artificial Sequence; identical to SEQ ID NO: 36826
  Synthetic

SEQ ID NO: 49061 - DNA, 27 bp, Artificial Sequence
  Synthetic
caggtggaaaauctcacaucacaaaat

SEQ ID NO: 49062 - DNA, 24 bp, Artificial Sequence
  Synthetic
cctttctgtcuggaggccatatua

SEQ ID NO: 49063 - DNA, 24 bp, Artificial Sequence
  Synthetic
ggagaagcagcaucttccagaaua

SEQ ID NO: 49064 - DNA, 23 bp, Artificial Sequence
  Synthetic
catgaacccacutcctgacagua

SEQ ID NO: 49065 - DNA, 23 bp, Artificial Sequence
  Synthetic
cgcggtagcaguagaagatgaug

SEQ ID NO: 49066 - DNA, 21 bp, Artificial Sequence
  Synthetic
ggaagaugaccgctcugacat

SEQ ID NO: 49067 - DNA, 23 bp, Artificial Sequence
  Synthetic
ggaaagatctugactgccacugt

SEQ ID NO: 49068 - DNA, 23 bp, Artificial Sequence
  Synthetic
ggaaacaauactggctgaucacc

SEQ ID NO: 49069 - DNA, 22 bp, Artificial Sequence
  Synthetic
agcaggtuaggtcgttctucac

SEQ ID NO: 49070 - DNA, 28 bp, Artificial Sequence
  Synthetic
ttgtgaaaauaaaaaggcagctggaaut

SEQ ID NO: 49071 - DNA, 22 bp, Artificial Sequence
  Synthetic
aatgatgctgguccacaccuac

SEQ ID NO: 49072 - DNA, 22 bp, Artificial Sequence
  Synthetic
atggtgcccuttggatctctut

SEQ ID NO: 49073 - DNA, 21 bp, Artificial Sequence
  Synthetic
ccugcccuagaagagctatut

SEQ ID NO: 49074 - DNA, 17 bp, Artificial Sequence
  Synthetic
gggcuggatggcguaag

SEQ ID NO: 49075 - DNA, 19 bp, Artificial Sequence
  Synthetic
cggtucaccactgtcucgt

SEQ ID NO: 49076 - DNA, 32 bp, Artificial Sequence; identical to SEQ ID NO: 36842
  Synthetic

SEQ ID NO: 49077 - DNA, 24 bp, Artificial Sequence
  Synthetic
gcacaaacaucctgctacttugag

SEQ ID NO: 49078 - DNA, 26 bp, Artificial Sequence
  Synthetic
ccccttgggautagtatctatctcuc

SEQ ID NO: 49079 - DNA, 26 bp, Artificial Sequence
  Synthetic
agcttcaacaauttactctcccaugt

SEQ ID NO: 49080 - DNA, 21 bp, Artificial Sequence
  Synthetic
ctcaccccucaggacagttut

SEQ ID NO: 49081 - DNA, 25 bp, Artificial Sequence
  Synthetic
ggttgaggaguttggtgctacatua

SEQ ID NO: 49082 - DNA, 28 bp, Artificial Sequence
  Synthetic
ttaatacagacttugctaccaggactug

SEQ ID NO: 49083 - DNA, 20 bp, Artificial Sequence
  Synthetic
tttgcucagaggcugcagaa

SEQ ID NO: 49084 - DNA, 25 bp, Artificial Sequence
  Synthetic
gcaagatgaggagaugcttgaacuc

SEQ ID NO: 49085 - DNA, 24 bp, Artificial Sequence
  Synthetic
acagaataaaggagguaggctgua

SEQ ID NO: 49086 - DNA, 27 bp, Artificial Sequence
  Synthetic
gggttgguaggattctattactuacct

SEQ ID NO: 49087 - DNA, 26 bp, Artificial Sequence
  Synthetic
gcttgttcacacacucagctgattua

SEQ ID NO: 49088 - DNA, 25 bp, Artificial Sequence
  Synthetic
gttaaagcttgcuccttcatgtuct

SEQ ID NO: 49089 - DNA, 27 bp, Artificial Sequence
  Synthetic
acagaagtauaagaatggctgucacac

SEQ ID NO: 49090 - DNA, 26 bp, Artificial Sequence
  Synthetic
ggtattgaatttcuttggaccaggug

SEQ ID NO: 49091 - DNA, 27 bp, Artificial Sequence
  Synthetic
aaagattgtaugaggtcctgtccuagt

SEQ ID NO: 49092 - DNA, 25 bp, Artificial Sequence
  Synthetic
tcacacattcugcctcctaaacaut

SEQ ID NO: 49093 - DNA, 28 bp, Artificial Sequence
  Synthetic
cagaaggcaaguataagtcttaagugct

SEQ ID NO: 49094 - DNA, 24 bp, Artificial Sequence
  Synthetic
gaaaaaggcugcttttcagtgugt

SEQ ID NO: 49095 - DNA, 24 bp, Artificial Sequence
  Synthetic
caccctcctaugacagtgtcacua

SEQ ID NO: 49096 - DNA, 20 bp, Artificial Sequence
  Synthetic
gauaaccauggccgacacct

SEQ ID NO: 49097 - DNA, 22 bp, Artificial Sequence
  Synthetic
cgcatccatugcatggacatuc

SEQ ID NO: 49098 - DNA, 27 bp, Artificial Sequence
  Synthetic
gacaggaccgaauactcaataaacuga

SEQ ID NO: 49099 - DNA, 21 bp, Artificial Sequence
  Synthetic
gtgggcaucctcttctucacc

SEQ ID NO: 49100 - DNA, 20 bp, Artificial Sequence
  Synthetic
ctgtuggcgaaggtcuggaa

SEQ ID NO: 49101 - DNA, 20 bp, Artificial Sequence
  Synthetic
gcatccucagactgauccga

SEQ ID NO: 49102 - DNA, 23 bp, Artificial Sequence
  Synthetic
ccacaaagagcaggutgatctug

SEQ ID NO: 49103 - DNA, 25 bp, Artificial Sequence
  Synthetic
actttccattugcctctccttucag

SEQ ID NO: 49104 - DNA, 17 bp, Artificial Sequence
  Synthetic
ccctcaauccccuggca

SEQ ID NO: 49105 - DNA, 23 bp, Artificial Sequence
  Synthetic
tctccctgtgugatttctcccut

SEQ ID NO: 49106 - DNA, 21 bp, Artificial Sequence
  Synthetic
gaagucccttctcuccaggac

SEQ ID NO: 49107 - DNA, 22 bp, Artificial Sequence
  Synthetic
agagggagacutgccttugaac

SEQ ID NO: 49108 - DNA, 20 bp, Artificial Sequence
  Synthetic
gaaggcagccaccuctctua

SEQ ID NO: 49109 - DNA, 23 bp, Artificial Sequence
  Synthetic
atcctccccauttctacttugcc

SEQ ID NO: 49110 - DNA, 23 bp, Artificial Sequence
  Synthetic
ccagtttcugacctgacttucca

SEQ ID NO: 49111 - DNA, 21 bp, Artificial Sequence
  Synthetic
caagaccugctaccacaucgt

SEQ ID NO: 49112 - DNA, 20 bp, Artificial Sequence
  Synthetic
tctggguggaactgaggcua

SEQ ID NO: 49113 - DNA, 21 bp, Artificial Sequence
  Synthetic
ctacucagcccacacucacac

SEQ ID NO: 49114 - DNA, 21 bp, Artificial Sequence
  Synthetic
gggaagcugcttugagagagg

SEQ ID NO: 49115 - DNA, 20 bp, Artificial Sequence
  Synthetic
ggccgagucagacacagaug

SEQ ID NO: 49116 - DNA, 19 bp, Artificial Sequence
  Synthetic
gcaccttcuccgtctcugg

SEQ ID NO: 49117 - DNA, 19 bp, Artificial Sequence
  Synthetic
caaccucacagccccugat

SEQ ID NO: 49118 - DNA, 28 bp, Artificial Sequence
  Synthetic
ggtagatggatugatagaagggtaagua

SEQ ID NO: 49119 - DNA, 22 bp, Artificial Sequence
  Synthetic
tctguggagagtggaucgagac

SEQ ID NO: 49120 - DNA, 21 bp, Artificial Sequence
  Synthetic
gttctugccaaagagcugcat

SEQ ID NO: 49121 - DNA, 20 bp, Artificial Sequence
  Synthetic
ccagagcccutcacaagguc

SEQ ID NO: 49122 - DNA, 22 bp, Artificial Sequence
  Synthetic
gctccaugaggctaaggaugac

SEQ ID NO: 49123 - DNA, 20 bp, Artificial Sequence
  Synthetic
ggccagggaguctttccauc

SEQ ID NO: 49124 - DNA, 21 bp, Artificial Sequence
  Synthetic
cgccaugaagagtgtgtugag

SEQ ID NO: 49125 - DNA, 27 bp, Artificial Sequence
  Synthetic
acagaatcaaacuaactcattggcugt

SEQ ID NO: 49126 - DNA, 23 bp, Artificial Sequence
  Synthetic
cgtgtatutttggactuggcact

SEQ ID NO: 49127 - DNA, 24 bp, Artificial Sequence
  Synthetic
caaaaagaacagcacugtggacug

SEQ ID NO: 49128 - DNA, 23 bp, Artificial Sequence
  Synthetic
cgctgtgcugttttcatcatcug

SEQ ID NO: 49129 - DNA, 21 bp, Artificial Sequence
  Synthetic
aagagcacaugtcatggucgt

SEQ ID NO: 49130 - DNA, 22 bp, Artificial Sequence
  Synthetic
cctacagtcaggugagggctua

SEQ ID NO: 49131 - DNA, 26 bp, Artificial Sequence
  Synthetic
tcttcttcatgcutgtcatcttccug

SEQ ID NO: 49132 - DNA, 20 bp, Artificial Sequence
  Synthetic
acttgugtagccuggaccct

SEQ ID NO: 49133 - DNA, 22 bp, Artificial Sequence
  Synthetic
aacaaagtcuctgtgtguggct

SEQ ID NO: 49134 - DNA, 22 bp, Artificial Sequence
  Synthetic
ggtctgctgguctcacaaaguc

SEQ ID NO: 49135 - DNA, 22 bp, Artificial Sequence
  Synthetic
cagctcttcaugggcaaccuaa

SEQ ID NO: 49136 - DNA, 21 bp, Artificial Sequence
  Synthetic
ggcatatcccuctagcctugg

SEQ ID NO: 49137 - DNA, 26 bp, Artificial Sequence
  Synthetic
gttgtcattgtcucgtgtgtgaatut

SEQ ID NO: 49138 - DNA, 23 bp, Artificial Sequence
  Synthetic
aggcauagcacagcauagcaaat

SEQ ID NO: 49139 - DNA, 21 bp, Artificial Sequence
  Synthetic
gctcaggccucccuaagaaac

SEQ ID NO: 49140 - DNA, 24 bp, Artificial Sequence
  Synthetic
ggtacucagcaggtattaacugca

SEQ ID NO: 49141 - DNA, 22 bp, Artificial Sequence
  Synthetic
agggcctaaugctactgtcugt

SEQ ID NO: 49142 - DNA, 20 bp, Artificial Sequence
  Synthetic
gctctccugcaaggtggtug

SEQ ID NO: 49143 - DNA, 22 bp, Artificial Sequence
  Synthetic
tctctguccctgggcauagaat

SEQ ID NO: 49144 - DNA, 18 bp, Artificial Sequence
  Synthetic
agcacuccccucccagaa

SEQ ID NO: 49145 - DNA, 23 bp, Artificial Sequence
  Synthetic
ccatcuagagggattcagugggt

SEQ ID NO: 49146 - DNA, 21 bp, Artificial Sequence
  Synthetic
gtcctcataggugcctgtguc

SEQ ID NO: 49147 - DNA, 24 bp, Artificial Sequence
  Synthetic
ggatagcucctcattaucaggcat

SEQ ID NO: 49148 - DNA, 18 bp, Artificial Sequence
  Synthetic
gtcagccuaccccacucc

SEQ ID NO: 49149 - DNA, 20 bp, Artificial Sequence
  Synthetic
ggtguggccccacctttuaa

SEQ ID NO: 49150 - DNA, 22 bp, Artificial Sequence
  Synthetic
cttcttgggcuctggcttttug

SEQ ID NO: 49151 - DNA, 23 bp, Artificial Sequence
  Synthetic
aatagccccuaagcctagccaua

SEQ ID NO: 49152 - DNA, 22 bp, Artificial Sequence
  Synthetic
actgaaauaacggacgugcaca

SEQ ID NO: 49153 - DNA, 20 bp, Artificial Sequence
  Synthetic
agatggcugacgaccgttuc

SEQ ID NO: 49154 - DNA, 23 bp, Artificial Sequence
  Synthetic
accauagacaaaagggugacagg

SEQ ID NO: 49155 - DNA, 22 bp, Artificial Sequence
  Synthetic
ctgaccttucaaccctctcuga

SEQ ID NO: 49156 - DNA, 24 bp, Artificial Sequence
  Synthetic
catcactaucccaaggagctucag

SEQ ID NO: 49157 - DNA, 22 bp, Artificial Sequence
  Synthetic
tgtgcacacaguggaaaucagt

SEQ ID NO: 49158 - DNA, 20 bp, Artificial Sequence
  Synthetic
ccugagaggaccccagtuga

SEQ ID NO: 49159 - DNA, 23 bp, Artificial Sequence
  Synthetic
tgtctctccaucttcccatccut

SEQ ID NO: 49160 - DNA, 18 bp, Artificial Sequence
  Synthetic
tgctgggugagggaggua

SEQ ID NO: 49161 - DNA, 20 bp, Artificial Sequence
  Synthetic
cctgaggucagaggucacag

SEQ ID NO: 49162 - DNA, 22 bp, Artificial Sequence
  Synthetic
ggcaggcuggaagatggttaug

SEQ ID NO: 49163 - DNA, 29 bp, Artificial Sequence
  Synthetic
cctctgattacugactctgtcctatauct

SEQ ID NO: 49164 - DNA, 21 bp, Artificial Sequence
  Synthetic
ccactguccacagaccctgua

SEQ ID NO: 49165 - DNA, 23 bp, Artificial Sequence
  Synthetic
cacaaaggagagauggtgagugt

SEQ ID NO: 49166 - DNA, 22 bp, Artificial Sequence
  Synthetic
cccagugccctaatatcugacc

SEQ ID NO: 49167 - DNA, 24 bp, Artificial Sequence
  Synthetic
gattctcttuggtccctcacugac

SEQ ID NO: 49168 - DNA, 23 bp, Artificial Sequence
  Synthetic
cactuaagaggauccccaggaua

SEQ ID NO: 49169 - DNA, 22 bp, Artificial Sequence
  Synthetic
cctgatcuggtcctgacugaat

SEQ ID NO: 49170 - DNA, 23 bp, Artificial Sequence
  Synthetic
tctgggaguttgagctcucagat

SEQ ID NO: 49171 - DNA, 21 bp, Artificial Sequence
  Synthetic
tcccgacucctctgattccug

SEQ ID NO: 49172 - DNA, 19 bp, Artificial Sequence
  Synthetic
gccccgcaccugaattcua

SEQ ID NO: 49173 - DNA, 22 bp, Artificial Sequence
  Synthetic
ctttgtctgguccccactgtut

SEQ ID NO: 49174 - DNA, 22 bp, Artificial Sequence
  Synthetic
caccctggauggtgacatuagg

SEQ ID NO: 49175 - DNA, 21 bp, Artificial Sequence
  Synthetic
ccactgatucccctcacugat

SEQ ID NO: 49176 - DNA, 21 bp, Artificial Sequence
  Synthetic
ccccaucctaagtccucacga

SEQ ID NO: 49177 - DNA, 21 bp, Artificial Sequence
  Synthetic
gggttcccaagucactctcug

SEQ ID NO: 49178 - DNA, 22 bp, Artificial Sequence
  Synthetic
cctcccaggacuctcaucagaa

SEQ ID NO: 49179 - DNA, 23 bp, Artificial Sequence
  Synthetic
tccgatgccucttttccucaaag

SEQ ID NO: 49180 - DNA, 20 bp, Artificial Sequence
  Synthetic
cccaagaguggccccttaug

SEQ ID NO: 49181 - DNA, 22 bp, Artificial Sequence
  Synthetic
gccugactacugagcagagaag

SEQ ID NO: 49182 - DNA, 24 bp, Artificial Sequence
  Synthetic
gtcatgagggugggtaaactaugg

SEQ ID NO: 49183 - DNA, 21 bp, Artificial Sequence
  Synthetic
caaggaaucccactgaccuct

SEQ ID NO: 49184 - DNA, 22 bp, Artificial Sequence
  Synthetic
catggcattuggaaacaggcut

SEQ ID NO: 49185 - DNA, 22 bp, Artificial Sequence
  Synthetic
gggcctgaaauatgaggagugg

SEQ ID NO: 49186 - DNA, 21 bp, Artificial Sequence
  Synthetic
ccugagagggaagagctcugt

SEQ ID NO: 49187 - DNA, 23 bp, Artificial Sequence
  Synthetic
gttctctcatgucgtcctgtguc

SEQ ID NO: 49188 - DNA, 23 bp, Artificial Sequence
  Synthetic
cccuggaggaagagaaagtucag

SEQ ID NO: 49189 - DNA, 24 bp, Artificial Sequence
  Synthetic
gtcatctccugcaatgaggaugag

SEQ ID NO: 49190 - DNA, 20 bp, Artificial Sequence
  Synthetic
cagagaaggccuggctcauc

SEQ ID NO: 49191 - DNA, 22 bp, Artificial Sequence
  Synthetic
gtgaccaguactgcctcagtut

SEQ ID NO: 49192 - DNA, 25 bp, Artificial Sequence
  Synthetic
caatacatgugagagccaccttcut

SEQ ID NO: 49193 - DNA, 23 bp, Artificial Sequence
  Synthetic
cacactagagguggtgtgcauat

SEQ ID NO: 49194 - DNA, 23 bp, Artificial Sequence
  Synthetic
gggatgagaugtcaagtcagucc

SEQ ID NO: 49195 - DNA, 26 bp, Artificial Sequence
  Synthetic
cctataacccuctgtgatccugagat

SEQ ID NO: 49196 - DNA, 20 bp, Artificial Sequence
  Synthetic
catcuctgcccugcaggaaa

SEQ ID NO: 49197 - DNA, 18 bp, Artificial Sequence
  Synthetic
cuggccaggagagugagg

SEQ ID NO: 49198 - DNA, 22 bp, Artificial Sequence
  Synthetic
cugcaggaguggaagagagaat

SEQ ID NO: 49199 - DNA, 20 bp, Artificial Sequence
  Synthetic
gacctctugctgtcccucag

SEQ ID NO: 49200 - DNA, 22 bp, Artificial Sequence
  Synthetic
acagaacctauggagcctcaug

SEQ ID NO: 49201 - DNA, 26 bp, Artificial Sequence
  Synthetic
gttcctagcaguttgtcttcatcuct

SEQ ID NO: 49202 - DNA, 21 bp, Artificial Sequence
  Synthetic
cacggucacccugaaaacaag

SEQ ID NO: 49203 - DNA, 22 bp, Artificial Sequence
  Synthetic
gccatgaugtttcaaugggcaa

SEQ ID NO: 49204 - DNA, 23 bp, Artificial Sequence
  Synthetic
acccugagaccucagaaaagagt

SEQ ID NO: 49205 - DNA, 21 bp, Artificial Sequence
  Synthetic
gaaggtaaagucccccaccug

SEQ ID NO: 49206 - DNA, 21 bp, Artificial Sequence
  Synthetic
gtctacacgugtgcctcaugt

SEQ ID NO: 49207 - DNA, 23 bp, Artificial Sequence
  Synthetic
acatccaaccagugatctgtucc

SEQ ID NO: 49208 - DNA, 23 bp, Artificial Sequence
  Synthetic
actctctcggaugctgtgacuat

SEQ ID NO: 49209 - DNA, 23 bp, Artificial Sequence
  Synthetic
ccttaggcucacagggacuagag

SEQ ID NO: 49210 - DNA, 22 bp, Artificial Sequence
  Synthetic
ccggtcacccugtggaaaauag

SEQ ID NO: 49211 - DNA, 26 bp, Artificial Sequence
  Synthetic
ccatcttacccucacctcttatcuga

SEQ ID NO: 49212 - DNA, 21 bp, Artificial Sequence
  Synthetic
cgaaacccutcaatgcccuga

SEQ ID NO: 49213 - DNA, 22 bp, Artificial Sequence
  Synthetic
ctcagcaagcutatctcugcca

SEQ ID NO: 49214 - DNA, 21 bp, Artificial Sequence
  Synthetic
gggaagugggagttaguggaa

SEQ ID NO: 49215 - DNA, 20 bp, Artificial Sequence
  Synthetic
gggaccugagggctcctaut

SEQ ID NO: 49216 - DNA, 23 bp, Artificial Sequence
  Synthetic
gagggtttagcautacagggtug

SEQ ID NO: 49217 - DNA, 26 bp, Artificial Sequence
  Synthetic
caaaatatugggagggtctgtcucag

SEQ ID NO: 49218 - DNA, 21 bp, Artificial Sequence
  Synthetic
gcagggaguggatggaugaac

SEQ ID NO: 49219 - DNA, 20 bp, Artificial Sequence
  Synthetic
tcatggcggguaagggagua

SEQ ID NO: 49220 - DNA, 22 bp, Artificial Sequence
  Synthetic
ctcgaagcaagcagutcucaag

SEQ ID NO: 49221 - DNA, 22 bp, Artificial Sequence
  Synthetic
ccgggugaatcaatgugggaat

SEQ ID NO: 49222 - DNA, 23 bp, Artificial Sequence
  Synthetic
gccctguggatggaaggauaaga

SEQ ID NO: 49223 - DNA, 22 bp, Artificial Sequence
  Synthetic
agggcctauctatgggactugg

SEQ ID NO: 49224 - DNA, 22 bp, Artificial Sequence
  Synthetic
ctgtggaaucacagcccagaua

SEQ ID NO: 49225 - DNA, 22 bp, Artificial Sequence
  Synthetic
gattttgggcucctaggugact

SEQ ID NO: 49226 - DNA, 22 bp, Artificial Sequence
  Synthetic
ggccccugaatguagagaaagt

SEQ ID NO: 49227 - DNA, 23 bp, Artificial Sequence
  Synthetic
tctagcccugtctgtccataucc

SEQ ID NO: 49228 - DNA, 25 bp, Artificial Sequence
  Synthetic
aaaagaagaggucagagctgagtug

SEQ ID NO: 49229 - DNA, 21 bp, Artificial Sequence
  Synthetic
gagttugggaccccttgtcug

SEQ ID NO: 49230 - DNA, 23 bp, Artificial Sequence
  Synthetic
ggagcaguggttgatgatugagg

SEQ ID NO: 49231 - DNA, 24 bp, Artificial Sequence
  Synthetic
ctgacttgaugatgtcccagtuct

SEQ ID NO: 49232 - DNA, 25 bp, Artificial Sequence
  Synthetic
aataugagccaagaactaugaagcc

SEQ ID NO: 49233 - DNA, 22 bp, Artificial Sequence
  Synthetic
attcccctgutcattcccugac

SEQ ID NO: 49234 - DNA, 21 bp, Artificial Sequence
  Synthetic
ggucacaagggccagaguaac

SEQ ID NO: 49235 - DNA, 26 bp, Artificial Sequence
  Synthetic
caccttatacttugtctcctccauca

SEQ ID NO: 49236 - DNA, 18 bp, Artificial Sequence
  Synthetic
ctgcacaggguctggugt

SEQ ID NO: 49237 - DNA, 20 bp, Artificial Sequence
  Synthetic
cagtgcccacgutgacatuc

SEQ ID NO: 49238 - DNA, 20 bp, Artificial Sequence
  Synthetic
ggagagcccugcaaauggag

SEQ ID NO: 49239 - DNA, 21 bp, Artificial Sequence
  Synthetic
cccttcctgucctgacctcut

SEQ ID NO: 49240 - DNA, 22 bp, Artificial Sequence
  Synthetic
ggcccuaggaagggtaaucagt

SEQ ID NO: 49241 - DNA, 22 bp, Artificial Sequence
  Synthetic
ccctcaucgagaggugaacaga

SEQ ID NO: 49242 - DNA, 25 bp, Artificial Sequence
  Synthetic
gaacccucagaccccutatattcua

SEQ ID NO: 49243 - DNA, 25 bp, Artificial Sequence
  Synthetic
cttaatgtggugatgttgggaaugg

SEQ ID NO: 49244 - DNA, 22 bp, Artificial Sequence
  Synthetic
ttccccaucagcctactcctua

SEQ ID NO: 49245 - DNA, 24 bp, Artificial Sequence
  Synthetic
gttctgacaugtccttcctuccag

SEQ ID NO: 49246 - DNA, 22 bp, Artificial Sequence
  Synthetic
gccucagggagaggtagaauct

SEQ ID NO: 49247 - DNA, 25 bp, Artificial Sequence
  Synthetic
tcagtaacttgutccccttccuaca

SEQ ID NO: 49248 - DNA, 27 bp, Artificial Sequence
  Synthetic
acttgatuaaaaagctgtcuccacaga

SEQ ID NO: 49249 - DNA, 25 bp, Artificial Sequence
  Synthetic
cctcgatcttucattcctcctucag

SEQ ID NO: 49250 - DNA, 22 bp, Artificial Sequence
  Synthetic
cccaatgguccctaacttccuc

SEQ ID NO: 49251 - DNA, 23 bp, Artificial Sequence
  Synthetic
ccctgattccugagctttctcuc

SEQ ID NO: 49252 - DNA, 21 bp, Artificial Sequence
  Synthetic
actcgcacugagtagcugact

SEQ ID NO: 49253 - DNA, 21 bp, Artificial Sequence
  Synthetic
gtgaaggtauggctcccugac

SEQ ID NO: 49254 - DNA, 20 bp, Artificial Sequence
  Synthetic
gctaatgcggugtggcuagt

SEQ ID NO: 49255 - DNA, 21 bp, Artificial Sequence
  Synthetic
cagagttugctagcccuggag

SEQ ID NO: 49256 - DNA, 21 bp, Artificial Sequence
  Synthetic
gggtcugaaagagcaauggag

SEQ ID NO: 49257 - DNA, 21 bp, Artificial Sequence
  Synthetic
catgccagcauttccctcuga

SEQ ID NO: 49258 - DNA, 21 bp, Artificial Sequence
  Synthetic
cacaagccucctgcagtacuc

SEQ ID NO: 49259 - DNA, 24 bp, Artificial Sequence
  Synthetic
ccacctacccugacttctctctua

SEQ ID NO: 49260 - DNA, 18 bp, Artificial Sequence
  Synthetic
cgacaccucccccacuca

SEQ ID NO: 49261 - DNA, 23 bp, Artificial Sequence
  Synthetic
ggtctgacccugttatctugcag

SEQ ID NO: 49262 - DNA, 21 bp, Artificial Sequence
  Synthetic
tgaagaaagugcccagcctuc

SEQ ID NO: 49263 - DNA, 22 bp, Artificial Sequence
  Synthetic
ctgtagagucctgagtcugcaa

SEQ ID NO: 49264 - DNA, 20 bp, Artificial Sequence
  Synthetic
ggtcagaggcuggcagaaut

SEQ ID NO: 49265 - DNA, 24 bp, Artificial Sequence
  Synthetic
ctgggcaagauaaagtgacctcut

SEQ ID NO: 49266 - DNA, 21 bp, Artificial Sequence
  Synthetic
ggacctugtagccagucacag

SEQ ID NO: 49267 - DNA, 24 bp, Artificial Sequence
  Synthetic
tgattccatccuatgtgctccuga

SEQ ID NO: 49268 - DNA, 20 bp, Artificial Sequence
  Synthetic
tcactcctgcucggtcctua

SEQ ID NO: 49269 - DNA, 23 bp, Artificial Sequence
  Synthetic
gatgaccccaaaugaagtgucca

SEQ ID NO: 49270 - DNA, 22 bp, Artificial Sequence
  Synthetic
tggtcagccacauggagaatug

SEQ ID NO: 49271 - DNA, 22 bp, Artificial Sequence
  Synthetic
gatacccguaaccctcacccua

SEQ ID NO: 49272 - DNA, 19 bp, Artificial Sequence
  Synthetic
ggaccucgcggaaatugct

SEQ ID NO: 49273 - DNA, 20 bp, Artificial Sequence
  Synthetic
accatcccaagucccaguga

SEQ ID NO: 49274 - DNA, 23 bp, Artificial Sequence
  Synthetic
tcagtgggaucatggacugaaac

SEQ ID NO: 49275 - DNA, 19 bp, Artificial Sequence
  Synthetic
gggccacaccaccuatucc

SEQ ID NO: 49276 - DNA, 21 bp, Artificial Sequence
  Synthetic
tgtcccuggacgactgtacuc

SEQ ID NO: 49277 - DNA, 20 bp, Artificial Sequence
  Synthetic
ggtgctgaugcgtggctuat

SEQ ID NO: 49278 - DNA, 20 bp, Artificial Sequence
  Synthetic
cctgaccuccaggacccuat

SEQ ID NO: 49279 - DNA, 21 bp, Artificial Sequence
  Synthetic
gcctctgccugtatgggaaug

SEQ ID NO: 49280 - DNA, 21 bp, Artificial Sequence
  Synthetic
ccccacaccacutctugacac

SEQ ID NO: 49281 - DNA, 21 bp, Artificial Sequence
  Synthetic
ggatgcugggacctggauact

SEQ ID NO: 49282 - DNA, 27 bp, Artificial Sequence
  Synthetic
acaaggauactgctctaugaacaagga

SEQ ID NO: 49283 - DNA, 22 bp, Artificial Sequence
  Synthetic
aaaacgctccacuttggtccua

SEQ ID NO: 49284 - DNA, 23 bp, Artificial Sequence
  Synthetic
ggaccacuguaaacagggaggaa

SEQ ID NO: 49285 - DNA, 19 bp, Artificial Sequence
  Synthetic
gcaguaccgggacagucac

SEQ ID NO: 49286 - DNA, 19 bp, Artificial Sequence
  Synthetic
ccacccuccaagaucagca

SEQ ID NO: 49287 - DNA, 17 bp, Artificial Sequence
  Synthetic
cgccgtcugcactcgut

SEQ ID NO: 49288 - DNA, 20 bp, Artificial Sequence
  Synthetic
ccaggacucagctggagtug

SEQ ID NO: 49289 - DNA, 22 bp, Artificial Sequence
  Synthetic
ccgcatcgacuatgatgguaag

SEQ ID NO: 49290 - DNA, 22 bp, Artificial Sequence
  Synthetic
aatctgagacugccctcctgua

SEQ ID NO: 49291 - DNA, 20 bp, Artificial Sequence
  Synthetic
ctacccuggcctctguaacg

SEQ ID NO: 49292 - DNA, 22 bp, Artificial Sequence
  Synthetic
tccacctcaucgatcatcucct

SEQ ID NO: 49293 - DNA, 20 bp, Artificial Sequence
  Synthetic
ctgctgagcccugactacug

SEQ ID NO: 49294 - DNA, 19 bp, Artificial Sequence
  Synthetic
gctacuaaccccgcacuct

SEQ ID NO: 49295 - DNA, 20 bp, Artificial Sequence
  Synthetic
gcuggaggatacuacacgca

SEQ ID NO: 49296 - DNA, 21 bp, Artificial Sequence
  Synthetic
tgccggtttucccaacttcua

SEQ ID NO: 49297 - DNA, 20 bp, Artificial Sequence
  Synthetic
aaccggcgutgaggagauac

SEQ ID NO: 49298 - DNA, 27 bp, Artificial Sequence
  Synthetic
gctcttcuaaattgtgtgucccaaaat

SEQ ID NO: 49299 - DNA, 33 bp, Artificial Sequence; identical to SEQ ID NO: 37065
  Synthetic

SEQ ID NO: 49300 - DNA, 24 bp, Artificial Sequence
  Synthetic
ccataactuaaggtgccttugggt

SEQ ID NO: 49301 - DNA, 26 bp, Artificial Sequence
  Synthetic
cacuattatcuagcccaaggcacaaa

SEQ ID NO: 49302 - DNA, 29 bp, Artificial Sequence
  Synthetic
cttgaggaaaacucatctctggtaatugt

SEQ ID NO: 49303 - DNA, 28 bp, Artificial Sequence
  Synthetic
gggataaagtggautacctggatgatut

SEQ ID NO: 49304 - DNA, 28 bp, Artificial Sequence
  Synthetic
ggcacatgtugaatattgcataugaagg

SEQ ID NO: 49305 - DNA, 28 bp, Artificial Sequence
  Synthetic
aaccatctagutaagcaacatucacaga

SEQ ID NO: 49306 - DNA, 27 bp, Artificial Sequence
  Synthetic
caaaatgaccuaaaaagctggaagugt

SEQ ID NO: 49307 - DNA, 28 bp, Artificial Sequence
  Synthetic
gccagggtttauctttgatgttctcuaa

SEQ ID NO: 49308 - DNA, 28 bp, Artificial Sequence
  Synthetic
tcaatttcaatgcutaaccagtttugct

SEQ ID NO: 49309 - DNA, 28 bp, Artificial Sequence
  Synthetic
gctgaagacacacaguattttgtaaugt

SEQ ID NO: 49310 - DNA, 25 bp, Artificial Sequence
  Synthetic
tcagatcagauccagactgugaaga

SEQ ID NO: 49311 - DNA, 28 bp, Artificial Sequence
  Synthetic
ccaaattagcauacctgaagtcctaugt

SEQ ID NO: 49312 - DNA, 27 bp, Artificial Sequence
  Synthetic
cagttataagccauctcatcccaucat

SEQ ID NO: 49313 - DNA, 19 bp, Artificial Sequence
  Synthetic
caaagcgcacuagtuggca

SEQ ID NO: 49314 - DNA, 21 bp, Artificial Sequence
  Synthetic
aattgtgcautcccgugcaag

SEQ ID NO: 49315 - DNA, 24 bp, Artificial Sequence
  Synthetic
tctgaggcccautgtgaaaactut

SEQ ID NO: 49316 - DNA, 18 bp, Artificial Sequence
  Synthetic
gcatggucgcagucacga

SEQ ID NO: 49317 - DNA, 28 bp, Artificial Sequence
  Synthetic
aaaggttttatagucttggcctgttuct

SEQ ID NO: 49318 - DNA, 29 bp, Artificial Sequence
  Synthetic
gaccagtcttgauactaacaaatacugaa

SEQ ID NO: 49319 - DNA, 17 bp, Artificial Sequence
  Synthetic
ggccguggtcguggaat

SEQ ID NO: 49320 - DNA, 24 bp, Artificial Sequence
  Synthetic
gggaggtcacuttataagggtcug

SEQ ID NO: 49321 - DNA, 24 bp, Artificial Sequence
  Synthetic
caggtagtacugtgggtacucgaa

SEQ ID NO: 49322 - DNA, 18 bp, Artificial Sequence
  Synthetic
gcgcacgccuctcaacua

SEQ ID NO: 49323 - DNA, 19 bp, Artificial Sequence
  Synthetic
tctcccagaccccuccaug

SEQ ID NO: 49324 - DNA, 22 bp, Artificial Sequence
  Synthetic
tgtaagcccaugagcaactucc

SEQ ID NO: 49325 - DNA, 23 bp, Artificial Sequence
  Synthetic
gaaccagacacuactgggttuga

SEQ ID NO: 49326 - DNA, 21 bp, Artificial Sequence
  Synthetic
ttcgtgguccacttcaccauc

SEQ ID NO: 49327 - DNA, 19 bp, Artificial Sequence
  Synthetic
gtccagaccauggctccuc

SEQ ID NO: 49328 - DNA, 24 bp, Artificial Sequence
  Synthetic
gcautctacatctucacccaccag

SEQ ID NO: 49329 - DNA, 21 bp, Artificial Sequence
  Synthetic
ggaagtagcutgtcctuggca

SEQ ID NO: 49330 - DNA, 19 bp, Artificial Sequence
  Synthetic
cuaccgtguccaagacgga

SEQ ID NO: 49331 - DNA, 18 bp, Artificial Sequence
  Synthetic
tcucaggctgucccaggt

SEQ ID NO: 49332 - DNA, 28 bp, Artificial Sequence
  Synthetic
cacaacaaaagtgcuctagttctctcua

SEQ ID NO: 49333 - DNA, 27 bp, Artificial Sequence
  Synthetic
ttttgtttttcaaaccucctgcttcuc

SEQ ID NO: 49334 - DNA, 20 bp, Artificial Sequence
  Synthetic
cctccaggacutgcaucgaa

SEQ ID NO: 49335 - DNA, 26 bp, Artificial Sequence
  Synthetic
agatttgcgtuagagtttttgtuggg

SEQ ID NO: 49336 - DNA, 20 bp, Artificial Sequence
  Synthetic
cggtugcccggtgaatttut

SEQ ID NO: 49337 - DNA, 21 bp, Artificial Sequence
  Synthetic
cggcctguactcggttuacac

SEQ ID NO: 49338 - DNA, 19 bp, Artificial Sequence
  Synthetic
cgcgtcuagccatggacug

SEQ ID NO: 49339 - DNA, 23 bp, Artificial Sequence
  Synthetic
ctttctacugggctcgtctctut

SEQ ID NO: 49340 - DNA, 18 bp, Artificial Sequence
  Synthetic
ctgcaucctcgcauccgt

SEQ ID NO: 49341 - DNA, 18 bp, Artificial Sequence
  Synthetic
gcctgcagutcgcttgug

SEQ ID NO: 49342 - DNA, 17 bp, Artificial Sequence
  Synthetic
gtguacggcccguacga

SEQ ID NO: 49343 - DNA, 19 bp, Artificial Sequence
  Synthetic
ccccaaguacctgcaguct

SEQ ID NO: 49344 - DNA, 19 bp, Artificial Sequence
  Synthetic
gccggtagutgcccttcuc

SEQ ID NO: 49345 - DNA, 20 bp, Artificial Sequence
  Synthetic
ctgtccggcauctaccagua

SEQ ID NO: 49346 - DNA, 18 bp, Artificial Sequence
  Synthetic
ggctccutgactgugcga

SEQ ID NO: 49347 - DNA, 22 bp, Artificial Sequence
  Synthetic
ccgcagtcuccagaagttugag

SEQ ID NO: 49348 - DNA, 19 bp, Artificial Sequence
  Synthetic
ggagtggagcucagccuct

SEQ ID NO: 49349 - DNA, 18 bp, Artificial Sequence
  Synthetic
ggucgtgctucgggaaac

SEQ ID NO: 49350 - DNA, 31 bp, Artificial Sequence; identical to SEQ ID NO: 37116
  Synthetic

SEQ ID NO: 49351 - DNA, 28 bp, Artificial Sequence
  Synthetic
cccaaaaccuaccagtgtcataaactua

SEQ ID NO: 49352 - DNA, 28 bp, Artificial Sequence
  Synthetic
tggtagccttucagagatttatccguat

SEQ ID NO: 49353 - DNA, 31 bp, Artificial Sequence; identical to SEQ ID NO: 37119
  Synthetic

SEQ ID NO: 49354 - DNA, 21 bp, Artificial Sequence
  Synthetic
cctcatggutgcccatctucc

SEQ ID NO: 49355 - DNA, 19 bp, Artificial Sequence
  Synthetic
gtcctcgugggaggcatuc

SEQ ID NO: 49356 - DNA, 19 bp, Artificial Sequence
  Synthetic
cattggtugcggccatcuc

SEQ ID NO: 49357 - DNA, 19 bp, Artificial Sequence
  Synthetic
gggccutagtcccucagct

SEQ ID NO: 49358 - DNA, 21 bp, Artificial Sequence
  Synthetic
gcattggaggcaucaaggugg

SEQ ID NO: 49359 - DNA, 20 bp, Artificial Sequence
  Synthetic
aacutgttcuccacgacgca

SEQ ID NO: 49360 - DNA, 17 bp, Artificial Sequence
  Synthetic
gccccugagcgtcauct

SEQ ID NO: 49361 - DNA, 20 bp, Artificial Sequence
  Synthetic
attcaccuccacgtgctuga

SEQ ID NO: 49362 - DNA, 19 bp, Artificial Sequence
  Synthetic
ctgagccggguctcttguc

SEQ ID NO: 49363 - DNA, 21 bp, Artificial Sequence
  Synthetic
ggcaugggacagagtcgtuac

SEQ ID NO: 49364 - DNA, 22 bp, Artificial Sequence
  Synthetic
ggccucaacgcccatgtcttug

SEQ ID NO: 49365 - DNA, 21 bp, Artificial Sequence
  Synthetic
gcgggagaucttgugcacggt

SEQ ID NO: 49366 - DNA, 18 bp, Artificial Sequence
  Synthetic
tgtaccuccacgcccugt

SEQ ID NO: 49367 - DNA, 17 bp, Artificial Sequence
  Synthetic
gcccucagcaccacuga

SEQ ID NO: 49368 - DNA, 22 bp, Artificial Sequence
  Synthetic
ccgtgaagaugctgaaagguga

SEQ ID NO: 49369 - DNA, 17 bp, Artificial Sequence
  Synthetic
gccgcuaccgcaccuac

SEQ ID NO: 49370 - DNA, 21 bp, Artificial Sequence
  Synthetic
ctactcctucgacaccugcaa

SEQ ID NO: 49371 - DNA, 20 bp, Artificial Sequence
  Synthetic
gctgaagccuctccaccuct

SEQ ID NO: 49372 - DNA, 18 bp, Artificial Sequence
  Synthetic
tcaugccaguaggacgcc

SEQ ID NO: 49373 - DNA, 17 bp, Artificial Sequence
  Synthetic
tccuggctcugcccagt

SEQ ID NO: 49374 - DNA, 21 bp, Artificial Sequence
  Synthetic
ccttcaggcugttcccgaaua

SEQ ID NO: 49375 - DNA, 18 bp, Artificial Sequence
  Synthetic
gcacucacgtcgguggac

SEQ ID NO: 49376 - DNA, 18 bp, Artificial Sequence
  Synthetic
agagguggctgugcgaag

SEQ ID NO: 49377 - DNA, 17 bp, Artificial Sequence
  Synthetic
cccutcacguccgcgag

SEQ ID NO: 49378 - DNA, 26 bp, Artificial Sequence
  Synthetic
accatgtatucacttcagugaaaggg

SEQ ID NO: 49379 - DNA, 24 bp, Artificial Sequence
  Synthetic
caagactacgaaccugaagccuaa

SEQ ID NO: 49380 - DNA, 28 bp, Artificial Sequence
  Synthetic
gagagcaaatgatuctcactaagcacua

SEQ ID NO: 49381 - DNA, 30 bp, Artificial Sequence; identical to SEQ ID NO: 37147
  Synthetic

SEQ ID NO: 49382 - DNA, 23 bp, Artificial Sequence
  Synthetic
ggaaucttgaatacugggccaca

SEQ ID NO: 49383 - DNA, 25 bp, Artificial Sequence
  Synthetic
cagcaattuaaggctagctugagac

SEQ ID NO: 49384 - DNA, 26 bp, Artificial Sequence
  Synthetic
tatcgaactggcuaacatgttttuct

SEQ ID NO: 49385 - DNA, 29 bp, Artificial Sequence
  Synthetic
acttgagtgaaagaugaagtggtaacauc

SEQ ID NO: 49386 - DNA, 24 bp, Artificial Sequence
  Synthetic
ctgctgucagatggctuaaagaga

SEQ ID NO: 49387 - DNA, 23 bp, Artificial Sequence
  Synthetic
gctaactcctutttcctgctgug

SEQ ID NO: 49388 - DNA, 31 bp, Artificial Sequence; identical to SEQ ID NO: 37154
  Synthetic

SEQ ID NO: 49389 - DNA, 23 bp, Artificial Sequence
  Synthetic
ccccagaccuctgcaatugaaaa

SEQ ID NO: 49390 - DNA, 24 bp, Artificial Sequence
  Synthetic
gcatacaucaggccatctccuact

SEQ ID NO: 49391 - DNA, 30 bp, Artificial Sequence; identical to SEQ ID NO: 37157
  Synthetic

SEQ ID NO: 49392 - DNA, 31 bp, Artificial Sequence; identical to SEQ ID NO: 37158
  Synthetic

SEQ ID NO: 49393 - DNA, 28 bp, Artificial Sequence
  Synthetic
gaaagatacagaaugcaagcaagctuac

SEQ ID NO: 49394 - DNA, 27 bp, Artificial Sequence
  Synthetic
tgaaagattuccaggacctaatgctug

SEQ ID NO: 49395 - DNA, 26 bp, Artificial Sequence
  Synthetic
cccaaugagaaccttttgtuccagaa

SEQ ID NO: 49396 - DNA, 18 bp, Artificial Sequence
  Synthetic
cccggcgagcutaactug

SEQ ID NO: 49397 - DNA, 21 bp, Artificial Sequence
  Synthetic
ctcgguggaaagagctggtut

SEQ ID NO: 49398 - DNA, 19 bp, Artificial Sequence
  Synthetic
gcccugacagacgacaugg

SEQ ID NO: 49399 - DNA, 22 bp, Artificial Sequence
  Synthetic
tgagcagugcctttttcuggag

SEQ ID NO: 49400 - DNA, 27 bp, Artificial Sequence
  Synthetic
gtttagccaccuttcctaatttuccaa

SEQ ID NO: 49401 - DNA, 24 bp, Artificial Sequence
  Synthetic
acagaauacacacactgacauggg

SEQ ID NO: 49402 - DNA, 22 bp, Artificial Sequence
  Synthetic
caagtugaggcactgaagaugg

SEQ ID NO: 49403 - DNA, 31 bp, Artificial Sequence; identical to SEQ ID NO: 37169
  Synthetic

SEQ ID NO: 49404 - DNA, 32 bp, Artificial Sequence; identical to SEQ ID NO: 37170
  Synthetic

SEQ ID NO: 49405 - DNA, 23 bp, Artificial Sequence
  Synthetic
cactcuccagaacggcttgauac

SEQ ID NO: 49406 - DNA, 27 bp, Artificial Sequence
  Synthetic
tgatgtaagtatugctcttctgcaguc

SEQ ID NO: 49407 - DNA, 31 bp, Artificial Sequence; identical to SEQ ID NO: 37173
  Synthetic

SEQ ID NO: 49408 - DNA, 28 bp, Artificial Sequence
  Synthetic
gagcttttaaguggtagccatagtauga

SEQ ID NO: 49409 - DNA, 33 bp, Artificial Sequence; identical to SEQ ID NO: 37175
  Synthetic

SEQ ID NO: 49410 - DNA, 30 bp, Artificial Sequence; identical to SEQ ID NO: 37176
  Synthetic

SEQ ID NO: 49411 - DNA, 27 bp, Artificial Sequence
  Synthetic
gtgaccaggguttgtaatcttctgtua

SEQ ID NO: 49412 - DNA, 27 bp, Artificial Sequence
  Synthetic
ctcatgauaaggatgatatgucgcgaa

SEQ ID NO: 49413 - DNA, 22 bp, Artificial Sequence
  Synthetic
tcttgtcaucaggctgtgagug

SEQ ID NO: 49414 - DNA, 28 bp, Artificial Sequence
  Synthetic
agggttatattagugatccctgcataut

SEQ ID NO: 49415 - DNA, 31 bp, Artificial Sequence; identical to SEQ ID NO: 37181
  Synthetic

SEQ ID NO: 49416 - DNA, 26 bp, Artificial Sequence
  Synthetic
agttaccaactuggtaccagtttgut

SEQ ID NO: 49417 - DNA, 30 bp, Artificial Sequence; identical to SEQ ID NO: 37183
  Synthetic

SEQ ID NO: 49418 - DNA, 28 bp, Artificial Sequence
  Synthetic
agcttggctucaagttgtctttttaaug

SEQ ID NO: 49419 - DNA, 23 bp, Artificial Sequence
  Synthetic
agattgcacaacugccctcuaag

SEQ ID NO: 49420 - DNA, 33 bp, Artificial Sequence; identical to SEQ ID NO: 37186
  Synthetic

SEQ ID NO: 49421 - DNA, 25 bp, Artificial Sequence
  Synthetic
cgguaagtaagagugccaaccaaaa

SEQ ID NO: 49422 - DNA, 26 bp, Artificial Sequence
  Synthetic
tgttactgcauacacattgtgaccut

SEQ ID NO: 49423 - DNA, 22 bp, Artificial Sequence
  Synthetic
cccccatgucccataatgctuc

SEQ ID NO: 49424 - DNA, 21 bp, Artificial Sequence
  Synthetic
ggctcaagcutgccatctcut

SEQ ID NO: 49425 - DNA, 29 bp, Artificial Sequence
  Synthetic
ggacagtcatgtugccagtattaaaatug

SEQ ID NO: 49426 - DNA, 24 bp, Artificial Sequence
  Synthetic
auccagcaacagaaaauccaggaa

SEQ ID NO: 49427 - DNA, 32 bp, Artificial Sequence; identical to SEQ ID NO: 37193
  Synthetic

SEQ ID NO: 49428 - DNA, 26 bp, Artificial Sequence
  Synthetic
tcaaatgaaacccucgattgaaucct

SEQ ID NO: 49429 - DNA, 23 bp, Artificial Sequence
  Synthetic
tgggtctugcccatctttcatuc

SEQ ID NO: 49430 - DNA, 22 bp, Artificial Sequence
  Synthetic
gtttctccauacaggucacggg

SEQ ID NO: 49431 - DNA, 28 bp, Artificial Sequence
  Synthetic
tgatccacaugacgtttctcttcatuat

SEQ ID NO: 49432 - DNA, 23 bp, Artificial Sequence
  Synthetic
tcaagcagugagaatacguccac

SEQ ID NO: 49433 - DNA, 30 bp, Artificial Sequence; identical to SEQ ID NO: 37199
  Synthetic

SEQ ID NO: 49434 - DNA, 22 bp, Artificial Sequence
  Synthetic
aagatcctgugagcgaagtucc

SEQ ID NO: 49435 - DNA, 28 bp, Artificial Sequence
  Synthetic
gaactgacagaaguacatctgcuaaaca

SEQ ID NO: 49436 - DNA, 23 bp, Artificial Sequence
  Synthetic
cagaaguaaaacaccuccaccac

SEQ ID NO: 49437 - DNA, 21 bp, Artificial Sequence
  Synthetic
gcacucaggctggaugaacaa

SEQ ID NO: 49438 - DNA, 30 bp, Artificial Sequence; identical to SEQ ID NO: 37204
  Synthetic

SEQ ID NO: 49439 - DNA, 22 bp, Artificial Sequence
  Synthetic
tttguacacaggcagctgacut

SEQ ID NO: 49440 - DNA, 24 bp, Artificial Sequence
  Synthetic
caatcgaaucccctccaaaugagt

SEQ ID NO: 49441 - DNA, 28 bp, Artificial Sequence
  Synthetic
catagcagaautaatgcattcugcaaga

SEQ ID NO: 49442 - DNA, 28 bp, Artificial Sequence
  Synthetic
aagaaaccaactucaccagtaaaaccua

SEQ ID NO: 49443 - DNA, 32 bp, Artificial Sequence; identical to SEQ ID NO: 37209
  Synthetic

SEQ ID NO: 49444 - DNA, 26 bp, Artificial Sequence
  Synthetic
ttccagggaaaaggcugaatuaagaa

SEQ ID NO: 49445 - DNA, 21 bp, Artificial Sequence
  Synthetic
cttttcaucagttgcugcccc

SEQ ID NO: 49446 - DNA, 24 bp, Artificial Sequence
  Synthetic
cagggagaaccaaguaaaccucaa

SEQ ID NO: 49447 - DNA, 25 bp, Artificial Sequence
  Synthetic
ccacccatattuctgggactatgut

SEQ ID NO: 49448 - DNA, 31 bp, Artificial Sequence; identical to SEQ ID NO: 37214
  Synthetic

SEQ ID NO: 49449 - DNA, 29 bp, Artificial Sequence
  Synthetic
ggttttagaattcgugggcctttatuact

SEQ ID NO: 49450 - DNA, 22 bp, Artificial Sequence
  Synthetic
aaaugaaacagcccctucaagc

SEQ ID NO: 49451 - DNA, 21 bp, Artificial Sequence
  Synthetic
gagaagtgguggctgttugac

SEQ ID NO: 49452 - DNA, 23 bp, Artificial Sequence
  Synthetic
tgcccagcaaccautaaguagac

SEQ ID NO: 49453 - DNA, 28 bp, Artificial Sequence
  Synthetic
ggataaacctgtutgtttggtaaggtuc

SEQ ID NO: 49454 - DNA, 30 bp, Artificial Sequence; identical to SEQ ID NO: 37220
  Synthetic

SEQ ID NO: 49455 - DNA, 26 bp, Artificial Sequence
  Synthetic
tgtggauagagacataucaggaaggg

SEQ ID NO: 49456 - DNA, 28 bp, Artificial Sequence
  Synthetic
cattctgaaaguccttctagactuccaa

SEQ ID NO: 49457 - DNA, 28 bp, Artificial Sequence
  Synthetic
gcggatacttggutttctttactttgut

SEQ ID NO: 49458 - DNA, 27 bp, Artificial Sequence
  Synthetic
ctaatttatcaaauggcacctgctgut

SEQ ID NO: 49459 - DNA, 21 bp, Artificial Sequence
  Synthetic
gcatgggaacacugccatuac

SEQ ID NO: 49460 - DNA, 25 bp, Artificial Sequence
  Synthetic
agttctataguggaacguaccccat

SEQ ID NO: 49461 - DNA, 27 bp, Artificial Sequence
  Synthetic
ctttgtgttgtuattcactggagtugg

SEQ ID NO: 49462 - DNA, 26 bp, Artificial Sequence
  Synthetic
gggtcttacctugtgacatctgttua

SEQ ID NO: 49463 - DNA, 22 bp, Artificial Sequence
  Synthetic
ctaaccaucaagagtgccuccc

SEQ ID NO: 49464 - DNA, 23 bp, Artificial Sequence
  Synthetic
gttgttctgucacccagttggua

SEQ ID NO: 49465 - DNA, 27 bp, Artificial Sequence
  Synthetic
tcaatattccauagcctgtucccaaag

SEQ ID NO: 49466 - DNA, 22 bp, Artificial Sequence
  Synthetic
aagtggccugtgctcttagtuc

SEQ ID NO: 49467 - DNA, 23 bp, Artificial Sequence
  Synthetic
cctccucagtttcugagaccaac

SEQ ID NO: 49468 - DNA, 23 bp, Artificial Sequence
  Synthetic
ctttgatgagcagcuggtttgug

SEQ ID NO: 49469 - DNA, 22 bp, Artificial Sequence
  Synthetic
tcctagggaugggtggcaatua

SEQ ID NO: 49470 - DNA, 21 bp, Artificial Sequence
  Synthetic
atgugacaccccaggucaaag

SEQ ID NO: 49471 - DNA, 20 bp, Artificial Sequence
  Synthetic
cagaggugctcauggcagag

SEQ ID NO: 49472 - DNA, 19 bp, Artificial Sequence
  Synthetic
guagccucccagaccaagg

SEQ ID NO: 49473 - DNA, 22 bp, Artificial Sequence
  Synthetic
cagagugggagaacaagtccug

SEQ ID NO: 49474 - DNA, 17 bp, Artificial Sequence
  Synthetic
ggccugcagtugccaag

SEQ ID NO: 49475 - DNA, 20 bp, Artificial Sequence
  Synthetic
tguggagacaggagcuggat

SEQ ID NO: 49476 - DNA, 20 bp, Artificial Sequence
  Synthetic
cuaggaaaacagggccugca

SEQ ID NO: 49477 - DNA, 28 bp, Artificial Sequence
  Synthetic
tctaggtucagagaggaaaagucaaaac

SEQ ID NO: 49478 - DNA, 17 bp, Artificial Sequence
  Synthetic
ccugcaacccccucagc

SEQ ID NO: 49479 - DNA, 24 bp, Artificial Sequence
  Synthetic
agattgtagacagagucccagugt

SEQ ID NO: 49480 - DNA, 21 bp, Artificial Sequence
  Synthetic
gtccaggucaaggcugaaaag

SEQ ID NO: 49481 - DNA, 20 bp, Artificial Sequence
  Synthetic
aaaacccaugctctgccuga

SEQ ID NO: 49482 - DNA, 21 bp, Artificial Sequence
  Synthetic
gacttcuccagcaggctcauc

SEQ ID NO: 49483 - DNA, 21 bp, Artificial Sequence
  Synthetic
aggaguccaaaggaccacgua

SEQ ID NO: 49484 - DNA, 22 bp, Artificial Sequence
  Synthetic
ccaggugaaagcugaaaagcag

SEQ ID NO: 49485 - DNA, 21 bp, Artificial Sequence
  Synthetic
caacacuagcccccagucaag

SEQ ID NO: 49486 - DNA, 25 bp, Artificial Sequence
  Synthetic
ctccaatacuattatcccccugcaa

SEQ ID NO: 49487 - DNA, 19 bp, Artificial Sequence
  Synthetic
tccattcccucccccucac

SEQ ID NO: 49488 - DNA, 20 bp, Artificial Sequence
  Synthetic
accagaucagagctgcctug

SEQ ID NO: 49489 - DNA, 22 bp, Artificial Sequence
  Synthetic
ccgttcugaggagtgagtgtug

SEQ ID NO: 49490 - DNA, 25 bp, Artificial Sequence
  Synthetic
tctgttuaggaucaggagtcttcut

SEQ ID NO: 49491 - DNA, 21 bp, Artificial Sequence
  Synthetic
cagggtucacacagaagctug

SEQ ID NO: 49492 - DNA, 23 bp, Artificial Sequence
  Synthetic
tgtcgacccuaatcgtaguccag

SEQ ID NO: 49493 - DNA, 20 bp, Artificial Sequence
  Synthetic
ctcccaccacugcauaaggg

SEQ ID NO: 49494 - DNA, 21 bp, Artificial Sequence
  Synthetic
gcaucccaaggacttgugagt

SEQ ID NO: 49495 - DNA, 18 bp, Artificial Sequence
  Synthetic
gcacctuctacgcuccgt

SEQ ID NO: 49496 - DNA, 23 bp, Artificial Sequence
  Synthetic
ctgagagcucagatgacagugag

SEQ ID NO: 49497 - DNA, 24 bp, Artificial Sequence
  Synthetic
tgagtctgagauatggagcugagg

SEQ ID NO: 49498 - DNA, 21 bp, Artificial Sequence
  Synthetic
gcctcttucacaatgggctuc

SEQ ID NO: 49499 - DNA, 23 bp, Artificial Sequence
  Synthetic
ccctccugcagaccttaactuac

SEQ ID NO: 49500 - DNA, 21 bp, Artificial Sequence
  Synthetic
tcagtggugaaggtccugact

SEQ ID NO: 49501 - DNA, 20 bp, Artificial Sequence
  Synthetic
gctttccccutggaagucgt

SEQ ID NO: 49502 - DNA, 20 bp, Artificial Sequence
  Synthetic
cctgtgcaccucccaacaut

SEQ ID NO: 49503 - DNA, 22 bp, Artificial Sequence
  Synthetic
ggtctgttutctggccugagac

SEQ ID NO: 49504 - DNA, 24 bp, Artificial Sequence
  Synthetic
cattttguaagaatggcatugcct

SEQ ID NO: 49505 - DNA, 20 bp, Artificial Sequence
  Synthetic
gcttcgcucccgggaatuac

SEQ ID NO: 49506 - DNA, 22 bp, Artificial Sequence
  Synthetic
gcggaaacgaugcctgtattuc

SEQ ID NO: 49507 - DNA, 24 bp, Artificial Sequence
  Synthetic
tccacattccutcatcatctugcc

SEQ ID NO: 49508 - DNA, 22 bp, Artificial Sequence
  Synthetic
gctaaagccauttcagccccut

SEQ ID NO: 49509 - DNA, 27 bp, Artificial Sequence
  Synthetic
gcactgttaagutctcccttttctuac

SEQ ID NO: 49510 - DNA, 23 bp, Artificial Sequence
  Synthetic
taatggatucgctgcattuagct

SEQ ID NO: 49511 - DNA, 28 bp, Artificial Sequence
  Synthetic
tcaatgcaaaccaaagucagaagttuac

SEQ ID NO: 49512 - DNA, 26 bp, Artificial Sequence
  Synthetic
gaaggacagaagutcaaagagcuaca

SEQ ID NO: 49513 - DNA, 30 bp, Artificial Sequence; identical to SEQ ID NO: 37279
  Synthetic

SEQ ID NO: 49514 - DNA, 17 bp, Artificial Sequence
  Synthetic
ctgcgtcugcgccaaug

SEQ ID NO: 49515 - DNA, 21 bp, Artificial Sequence
  Synthetic
acgcacacacacguacacaua

SEQ ID NO: 49516 - DNA, 25 bp, Artificial Sequence
  Synthetic
tgggtgtacuatgcagttaucgact

SEQ ID NO: 49517 - DNA, 23 bp, Artificial Sequence
  Synthetic
aggacucaaggaagugcaaacaa

SEQ ID NO: 49518 - DNA, 26 bp, Artificial Sequence
  Synthetic
gaattttacttgugtggacgaugcag

SEQ ID NO: 49519 - DNA, 22 bp, Artificial Sequence
  Synthetic
agctaauggcaagaauggcgat

SEQ ID NO: 49520 - DNA, 28 bp, Artificial Sequence
  Synthetic
cccttttcacuaggagacacaaacatua

SEQ ID NO: 49521 - DNA, 23 bp, Artificial Sequence
  Synthetic
aagtttccctutaagtggccugt

SEQ ID NO: 49522 - DNA, 21 bp, Artificial Sequence
  Synthetic
cttcttuggcggcaatgaugt

SEQ ID NO: 49523 - DNA, 25 bp, Artificial Sequence
  Synthetic
tcttcgaattgaugtctgcctucaa

SEQ ID NO: 49524 - DNA, 26 bp, Artificial Sequence
  Synthetic
agcttctgattucatctccctttucc

SEQ ID NO: 49525 - DNA, 27 bp, Artificial Sequence
  Synthetic
caggaatacautttcggttcttugacc

SEQ ID NO: 49526 - DNA, 25 bp, Artificial Sequence
  Synthetic
cctgttgctuaatggctgttugaaa

SEQ ID NO: 49527 - DNA, 30 bp, Artificial Sequence; identical to SEQ ID NO: 37293
  Synthetic

SEQ ID NO: 49528 - DNA, 28 bp, Artificial Sequence
  Synthetic
cactgcaaagaaagaauttgagactuca

SEQ ID NO: 49529 - DNA, 24 bp, Artificial Sequence
  Synthetic
ggtcacugcttccatcaucagaag

SEQ ID NO: 49530 - DNA, 21 bp, Artificial Sequence
  Synthetic
gctgccacaaacacuagggua

SEQ ID NO: 49531 - DNA, 26 bp, Artificial Sequence
  Synthetic
gagttctcacuggatatgcttgauga

SEQ ID NO: 49532 - DNA, 23 bp, Artificial Sequence
  Synthetic
gaggagtgcaguttgaaatgcug

SEQ ID NO: 49533 - DNA, 23 bp, Artificial Sequence
  Synthetic
ggctttgaugttccagagucact

SEQ ID NO: 49534 - DNA, 22 bp, Artificial Sequence
  Synthetic
gcggttgaugactgcucaaaac

SEQ ID NO: 49535 - DNA, 21 bp, Artificial Sequence
  Synthetic
tgtcggacaguaagccaggua

SEQ ID NO: 49536 - DNA, 25 bp, Artificial Sequence
  Synthetic
cacagtgaaccguaaagcctuaaag

SEQ ID NO: 49537 - DNA, 28 bp, Artificial Sequence
  Synthetic
cagattgcttaaccutgctatcgaaaug

SEQ ID NO: 49538 - DNA, 22 bp, Artificial Sequence
  Synthetic
cgttuaaaccaaaggcgcacua

SEQ ID NO: 49539 - DNA, 23 bp, Artificial Sequence
  Synthetic
gcagtcagcaugattttgctcug

SEQ ID NO: 49540 - DNA, 26 bp, Artificial Sequence
  Synthetic
ggtctcauaaaaacagtgggtttucc

SEQ ID NO: 49541 - DNA, 25 bp, Artificial Sequence
  Synthetic
ggaccagugaaagtttgctgaaaut

SEQ ID NO: 49542 - DNA, 24 bp, Artificial Sequence
  Synthetic
attucaaccaaagaagagccucca

SEQ ID NO: 49543 - DNA, 23 bp, Artificial Sequence
  Synthetic
cugctcaaatacugagaccccaa

SEQ ID NO: 49544 - DNA, 23 bp, Artificial Sequence
  Synthetic
tcaatatccauggcagcugacaa

SEQ ID NO: 49545 - DNA, 28 bp, Artificial Sequence
  Synthetic
gcacttcaaacutactactgcatuacgt

SEQ ID NO: 49546 - DNA, 24 bp, Artificial Sequence
  Synthetic
gggtcaaauggaagagacaucaat

SEQ ID NO: 49547 - DNA, 25 bp, Artificial Sequence
  Synthetic
cacaagugggcaaacatttctcuac

SEQ ID NO: 49548 - DNA, 30 bp, Artificial Sequence; identical to SEQ ID NO: 37314
  Synthetic

SEQ ID NO: 49549 - DNA, 26 bp, Artificial Sequence
  Synthetic
ctggacacacucttcatgguaaaact

SEQ ID NO: 49550 - DNA, 31 bp, Artificial Sequence; identical to SEQ ID NO: 37316
  Synthetic

SEQ ID NO: 49551 - DNA, 27 bp, Artificial Sequence
  Synthetic
ggtaaagtgatuagggcagatgauact

SEQ ID NO: 49552 - DNA, 24 bp, Artificial Sequence
  Synthetic
cttgcagtcutgtgatctgaaugc

SEQ ID NO: 49553 - DNA, 27 bp, Artificial Sequence
  Synthetic
gagatgagtgcuattcttcaggctuac

SEQ ID NO: 49554 - DNA, 21 bp, Artificial Sequence
  Synthetic
cctcgagcugttcctuccaac

SEQ ID NO: 49555 - DNA, 25 bp, Artificial Sequence
  Synthetic
gtcugtgtttgccugagaaacaaaa

SEQ ID NO: 49556 - DNA, 25 bp, Artificial Sequence
  Synthetic
gtttgccttttucaggacgtgaaut

SEQ ID NO: 49557 - DNA, 20 bp, Artificial Sequence
  Synthetic
tcatagagcagcaugcggut

SEQ ID NO: 49558 - DNA, 26 bp, Artificial Sequence
  Synthetic
tgtatacattuggataccagtgucct

SEQ ID NO: 49559 - DNA, 27 bp, Artificial Sequence
  Synthetic
cagtgaaaacagcauttcccattacut

SEQ ID NO: 49560 - DNA, 24 bp, Artificial Sequence
  Synthetic
ctgttctctugggagttggtaucc

SEQ ID NO: 49561 - DNA, 22 bp, Artificial Sequence
  Synthetic
agcagaaguctagaaggguggt

SEQ ID NO: 49562 - DNA, 22 bp, Artificial Sequence
  Synthetic
gggugaaaucacaaaggagcga

SEQ ID NO: 49563 - DNA, 24 bp, Artificial Sequence
  Synthetic
gaacgaguagcggtacaaauggat

SEQ ID NO: 49564 - DNA, 22 bp, Artificial Sequence
  Synthetic
ccagcuccttttguaagcagca

SEQ ID NO: 49565 - DNA, 25 bp, Artificial Sequence
  Synthetic
tttatctgacatuttgggtgccuga

SEQ ID NO: 49566 - DNA, 25 bp, Artificial Sequence
  Synthetic
cccagccuttagataaggucagaga

SEQ ID NO: 49567 - DNA, 23 bp, Artificial Sequence
  Synthetic
ggatttauccagccttgggucag

SEQ ID NO: 49568 - DNA, 21 bp, Artificial Sequence
  Synthetic
gacaaaccccaugcctcttug

SEQ ID NO: 49569 - DNA, 22 bp, Artificial Sequence
  Synthetic
ggcatcttcucatcagcctgug

SEQ ID NO: 49570 - DNA, 24 bp, Artificial Sequence
  Synthetic
gcaagcugttaaatcacucaccca

SEQ ID NO: 49571 - DNA, 25 bp, Artificial Sequence
  Synthetic
gagacctaaaagautgcccactcut

SEQ ID NO: 49572 - DNA, 21 bp, Artificial Sequence
  Synthetic
cccugggaaaagcctcaucac

SEQ ID NO: 49573 - DNA, 30 bp, Artificial Sequence; identical to SEQ ID NO: 37339
  Synthetic

SEQ ID NO: 49574 - DNA, 19 bp, Artificial Sequence
  Synthetic
cccgcggaucaacactcug

SEQ ID NO: 49575 - DNA, 17 bp, Artificial Sequence
  Synthetic
ggacgguccctcccugt

SEQ ID NO: 49576 - DNA, 29 bp, Artificial Sequence
  Synthetic
aaggttttcttccuggtagtatgtgttut

SEQ ID NO: 49577 - DNA, 23 bp, Artificial Sequence
  Synthetic
cgatccatgcuctgtggacaaua

SEQ ID NO: 49578 - DNA, 22 bp, Artificial Sequence
  Synthetic
gaggctacacutgtcagagugg

SEQ ID NO: 49579 - DNA, 26 bp, Artificial Sequence
  Synthetic
tgaggtcuagaagactctttgucaca

SEQ ID NO: 49580 - DNA, 24 bp, Artificial Sequence
  Synthetic
ctgaggccaguatcugaagaaaag

SEQ ID NO: 49581 - DNA, 29 bp, Artificial Sequence
  Synthetic
tcgatgcactugagaaataaatcagctua

SEQ ID NO: 49582 - DNA, 25 bp, Artificial Sequence
  Synthetic
gggtgauggaagtttaatgaugact

SEQ ID NO: 49583 - DNA, 25 bp, Artificial Sequence
  Synthetic
gcctaccucaattttgtcugaagct

SEQ ID NO: 49584 - DNA, 24 bp, Artificial Sequence
  Synthetic
aaactgctuactagctttcaugca

SEQ ID NO: 49585 - DNA, 25 bp, Artificial Sequence
  Synthetic
gatgaacatcaaugcacttggugat

SEQ ID NO: 49586 - DNA, 30 bp, Artificial Sequence; identical to SEQ ID NO: 37352
  Synthetic

SEQ ID NO: 49587 - DNA, 22 bp, Artificial Sequence
  Synthetic
ggttctggguctgagacgauac

SEQ ID NO: 49588 - DNA, 23 bp, Artificial Sequence
  Synthetic
gattgtacagcugaagcctcgua

SEQ ID NO: 49589 - DNA, 31 bp, Artificial Sequence; identical to SEQ ID NO: 37355
  Synthetic

SEQ ID NO: 49590 - DNA, 22 bp, Artificial Sequence
  Synthetic
agcctggcuctagcatgtttuc

SEQ ID NO: 49591 - DNA, 22 bp, Artificial Sequence
  Synthetic
cctaagtggcccugaggacaua

SEQ ID NO: 49592 - DNA, 21 bp, Artificial Sequence
  Synthetic
agacgauagccgacctugagt

SEQ ID NO: 49593 - DNA, 27 bp, Artificial Sequence
  Synthetic
tgauacaaagagaaagatgucccaagc

SEQ ID NO: 49594 - DNA, 28 bp, Artificial Sequence
  Synthetic
agaaaaugacaaguaagaaacatggaug

SEQ ID NO: 49595 - DNA, 25 bp, Artificial Sequence
  Synthetic
ccaggcaaaauactagcagauacct

SEQ ID NO: 49596 - DNA, 22 bp, Artificial Sequence
  Synthetic
gctgaggttcucaaccagctua

SEQ ID NO: 49597 - DNA, 27 bp, Artificial Sequence
  Synthetic
aaaugaagauccagaaaaagaagctug

SEQ ID NO: 49598 - DNA, 22 bp, Artificial Sequence
  Synthetic
ccgcccaatutggtgacttgua

SEQ ID NO: 49599 - DNA, 23 bp, Artificial Sequence
  Synthetic
gaagtctgagaguggatctgcug

SEQ ID NO: 49600 - DNA, 30 bp, Artificial Sequence; identical to SEQ ID NO: 37366
  Synthetic

SEQ ID NO: 49601 - DNA, 21 bp, Artificial Sequence
  Synthetic
gcggcguttagcatcauagag

SEQ ID NO: 49602 - DNA, 29 bp, Artificial Sequence
  Synthetic
agggtacaaauaacagtggtaaaagagug

SEQ ID NO: 49603 - DNA, 26 bp, Artificial Sequence
  Synthetic
cttaattgaatuggcgcaaagtucag

SEQ ID NO: 49604 - DNA, 28 bp, Artificial Sequence
  Synthetic
tgatttaaaactguggaactgtagcugt

SEQ ID NO: 49605 - DNA, 27 bp, Artificial Sequence
  Synthetic
gggcaggtttuaagagatatgtgauga

SEQ ID NO: 49606 - DNA, 26 bp, Artificial Sequence
  Synthetic
gggaaaagtacugcttctttctugga

SEQ ID NO: 49607 - DNA, 21 bp, Artificial Sequence
  Synthetic
gcaagctucgctttgaacugg

SEQ ID NO: 49608 - DNA, 25 bp, Artificial Sequence
  Synthetic
cacccgacugacttatgagatugaa

SEQ ID NO: 49609 - DNA, 23 bp, Artificial Sequence
  Synthetic
tcttcctgcaguagaacccucaa

SEQ ID NO: 49610 - DNA, 28 bp, Artificial Sequence
  Synthetic
ggagatatccaugcaaaaagaggaugat

SEQ ID NO: 49611 - DNA, 25 bp, Artificial Sequence
  Synthetic
cctgcttcagutctatctccagaug

SEQ ID NO: 49612 - DNA, 28 bp, Artificial Sequence
  Synthetic
tcaggacaaaaauaaggagaucgagaga

SEQ ID NO: 49613 - DNA, 23 bp, Artificial Sequence
  Synthetic
gtatcctctuccttctgcauggt

SEQ ID NO: 49614 - DNA, 22 bp, Artificial Sequence
  Synthetic
tcucaggaggguggaagaagac

SEQ ID NO: 49615 - DNA, 30 bp, Artificial Sequence; identical to SEQ ID NO: 37381
  Synthetic

SEQ ID NO: 49616 - DNA, 24 bp, Artificial Sequence
  Synthetic
gugcgacggagacaauaaacaaac

SEQ ID NO: 49617 - DNA, 22 bp, Artificial Sequence
  Synthetic
cctctugcaggagtcttcugac

SEQ ID NO: 49618 - DNA, 22 bp, Artificial Sequence
  Synthetic
ctggagcaggcauccattgtua

SEQ ID NO: 49619 - DNA, 27 bp, Artificial Sequence
  Synthetic
cttctgcttttaucttctatcgcctuc

SEQ ID NO: 49620 - DNA, 24 bp, Artificial Sequence
  Synthetic
gaagcggacagugataaaaaugca

SEQ ID NO: 49621 - DNA, 28 bp, Artificial Sequence
  Synthetic
agtgaagctgugatcaagtatttgugaa

SEQ ID NO: 49622 - DNA, 26 bp, Artificial Sequence
  Synthetic
tgcaaaaucaactcuagaggcagaaa

SEQ ID NO: 49623 - DNA, 27 bp, Artificial Sequence
  Synthetic
tcttcaattctcutgatctctgctugg

SEQ ID NO: 49624 - DNA, 20 bp, Artificial Sequence
  Synthetic
tgtgaguggaccgtugacac

SEQ ID NO: 49625 - DNA, 23 bp, Artificial Sequence
  Synthetic
cgaaggaauggctggattucaga

SEQ ID NO: 49626 - DNA, 26 bp, Artificial Sequence
  Synthetic
ggcagctacagguggtataattgauc

SEQ ID NO: 49627 - DNA, 28 bp, Artificial Sequence
  Synthetic
gcattccggttuctctatcaatcaaaut

SEQ ID NO: 49628 - DNA, 26 bp, Artificial Sequence
  Synthetic
gaatgauccccgagatagucagaaaa

SEQ ID NO: 49629 - DNA, 24 bp, Artificial Sequence
  Synthetic
agtggacgguctcaatauaccaga

SEQ ID NO: 49630 - DNA, 23 bp, Artificial Sequence
  Synthetic
ggccatgaaaautggcttagucc

SEQ ID NO: 49631 - DNA, 28 bp, Artificial Sequence
  Synthetic
ggaacaaagagaugatgtttcctgttuc

SEQ ID NO: 49632 - DNA, 22 bp, Artificial Sequence
  Synthetic
atugauccaaaggagagccauc

SEQ ID NO: 49633 - DNA, 28 bp, Artificial Sequence
  Synthetic
tguttcttcttttcttucagaggcagaa

SEQ ID NO: 49634 - DNA, 23 bp, Artificial Sequence
  Synthetic
acctucaaagaactgtgugagca

SEQ ID NO: 49635 - DNA, 26 bp, Artificial Sequence
  Synthetic
gacaccattttucaaggagatcaugt

SEQ ID NO: 49636 - DNA, 21 bp, Artificial Sequence
  Synthetic
tggaagaaucgagccccatug

SEQ ID NO: 49637 - DNA, 23 bp, Artificial Sequence
  Synthetic
catgucttggtcaaucacaccct

SEQ ID NO: 49638 - DNA, 22 bp, Artificial Sequence
  Synthetic
tcctggagutccagtaccucac

SEQ ID NO: 49639 - DNA, 28 bp, Artificial Sequence
  Synthetic
gagcgatttauggcatccttataggaua

SEQ ID NO: 49640 - DNA, 28 bp, Artificial Sequence
  Synthetic
catttagcagtagutctattgggcacua

SEQ ID NO: 49641 - DNA, 29 bp, Artificial Sequence
  Synthetic
augagctaagaagauaaaaagccagaaca

SEQ ID NO: 49642 - DNA, 31 bp, Artificial Sequence; identical to SEQ ID NO: 37408
  Synthetic

SEQ ID NO: 49643 - DNA, 24 bp, Artificial Sequence
  Synthetic
cgcaaacuggagaagucagaagac

SEQ ID NO: 49644 - DNA, 22 bp, Artificial Sequence
  Synthetic
gcccttttuaacagagccgtuc

SEQ ID NO: 49645 - DNA, 25 bp, Artificial Sequence
  Synthetic
atttgttccctuccttcttcctcuc

SEQ ID NO: 49646 - DNA, 19 bp, Artificial Sequence
  Synthetic
gacggcgaacugtaucacg

SEQ ID NO: 49647 - DNA, 23 bp, Artificial Sequence
  Synthetic
tgaaaggcuccatcatccagtug

SEQ ID NO: 49648 - DNA, 21 bp, Artificial Sequence
  Synthetic
aagttcucgctctugggaagg

SEQ ID NO: 49649 - DNA, 20 bp, Artificial Sequence
  Synthetic
ccctgtcaucggctaccuga

SEQ ID NO: 49650 - DNA, 21 bp, Artificial Sequence
  Synthetic
cutccctaaaugcaggccact

SEQ ID NO: 49651 - DNA, 19 bp, Artificial Sequence
  Synthetic
cggcaagucggttccucac

SEQ ID NO: 49652 - DNA, 21 bp, Artificial Sequence
  Synthetic
gctgctcucagctttctuggt

SEQ ID NO: 49653 - DNA, 23 bp, Artificial Sequence
  Synthetic
agaaccaguacgtccacattucc

SEQ ID NO: 49654 - DNA, 17 bp, Artificial Sequence
  Synthetic
cttgtgucccggcguct

SEQ ID NO: 49655 - DNA, 20 bp, Artificial Sequence
  Synthetic
cagttcatugggtccuccca

SEQ ID NO: 49656 - DNA, 21 bp, Artificial Sequence
  Synthetic
ccctguggacaatgctttgug

SEQ ID NO: 49657 - DNA, 20 bp, Artificial Sequence
  Synthetic
gaatgccugccucccaagaa

SEQ ID NO: 49658 - DNA, 26 bp, Artificial Sequence
  Synthetic
agccactacacauattgttcttggut

SEQ ID NO: 49659 - DNA, 28 bp, Artificial Sequence
  Synthetic
acutctctgugaaaggaagaaagaauac

SEQ ID NO: 49660 - DNA, 26 bp, Artificial Sequence
  Synthetic
gaaagatucaaaggatcacucaccct

SEQ ID NO: 49661 - DNA, 32 bp, Artificial Sequence; identical to SEQ ID NO: 37427
  Synthetic

SEQ ID NO: 49662 - DNA, 25 bp, Artificial Sequence
  Synthetic
attttccaggucaggactttaucct

SEQ ID NO: 49663 - DNA, 23 bp, Artificial Sequence
  Synthetic
tttggatttccuctcctgcacuc

SEQ ID NO: 49664 - DNA, 23 bp, Artificial Sequence
  Synthetic
gguagagggagagaaacaauguc

SEQ ID NO: 49665 - DNA, 24 bp, Artificial Sequence
  Synthetic
aggaggaggagagaguagaguaua

SEQ ID NO: 49666 - DNA, 18 bp, Artificial Sequence
  Synthetic
ggagccauccccgttucc

SEQ ID NO: 49667 - DNA, 25 bp, Artificial Sequence
  Synthetic
caagugcaaagaaaaagcuagttuc

SEQ ID NO: 49668 - DNA, 22 bp, Artificial Sequence
  Synthetic
cgaactccaugggtttccagua

SEQ ID NO: 49669 - DNA, 24 bp, Artificial Sequence
  Synthetic
gaaaagctcugacaaccucaggaa

SEQ ID NO: 49670 - DNA, 22 bp, Artificial Sequence
  Synthetic
ccttgaatuctgcccugacaca

SEQ ID NO: 49671 - DNA, 24 bp, Artificial Sequence
  Synthetic
tccactcugccactagagtauagg

SEQ ID NO: 49672 - DNA, 22 bp, Artificial Sequence
  Synthetic
acuacccccagaacaucaccat

SEQ ID NO: 49673 - DNA, 23 bp, Artificial Sequence
  Synthetic
cctggctcucatcagtcacauac

SEQ ID NO: 49674 - DNA, 26 bp, Artificial Sequence
  Synthetic
ctaaattgagaugggtgaaugaggaa

SEQ ID NO: 49675 - DNA, 24 bp, Artificial Sequence
  Synthetic
ctagtuttgtctcctucccacagt

SEQ ID NO: 49676 - DNA, 18 bp, Artificial Sequence
  Synthetic
gagccccagaugccacuc

SEQ ID NO: 49677 - DNA, 21 bp, Artificial Sequence
  Synthetic
gcctgtcugcttcatgggaua

SEQ ID NO: 49678 - DNA, 21 bp, Artificial Sequence
  Synthetic
cctccagccugagtcugagat

SEQ ID NO: 49679 - DNA, 19 bp, Artificial Sequence
  Synthetic
gtgtgguccagctcaccut

SEQ ID NO: 49680 - DNA, 24 bp, Artificial Sequence
  Synthetic
gucaccaaaauccagaaaccacua

SEQ ID NO: 49681 - DNA, 19 bp, Artificial Sequence
  Synthetic
ccuctcccucacccaacag

SEQ ID NO: 49682 - DNA, 22 bp, Artificial Sequence
  Synthetic
tcgagugagccaaagatcucct

SEQ ID NO: 49683 - DNA, 23 bp, Artificial Sequence
  Synthetic
cctcacaccaaccutgtctctug

SEQ ID NO: 49684 - DNA, 22 bp, Artificial Sequence
  Synthetic
gggagtcuatttgtccuggaga

SEQ ID NO: 49685 - DNA, 20 bp, Artificial Sequence
  Synthetic
cctgtggacutgggacctug

SEQ ID NO: 49686 - DNA, 21 bp, Artificial Sequence
  Synthetic
tgagtcccaacuccaacucca

SEQ ID NO: 49687 - DNA, 21 bp, Artificial Sequence
  Synthetic
cattctctugactgccugcac

SEQ ID NO: 49688 - DNA, 18 bp, Artificial Sequence
  Synthetic
cuccccaacagccuccac

SEQ ID NO: 49689 - DNA, 18 bp, Artificial Sequence
  Synthetic
gggatgcucctccugacc

SEQ ID NO: 49690 - DNA, 20 bp, Artificial Sequence
  Synthetic
catcuggagacggaggcauc

SEQ ID NO: 49691 - DNA, 25 bp, Artificial Sequence
  Synthetic
tgtaugtgtgtgtcuaggacaggaa

SEQ ID NO: 49692 - DNA, 22 bp, Artificial Sequence
  Synthetic
gggtaaagaggaugaggctugg

SEQ ID NO: 49693 - DNA, 25 bp, Artificial Sequence
  Synthetic
ggtattgacagutttggaggtgaug

SEQ ID NO: 49694 - DNA, 23 bp, Artificial Sequence
  Synthetic
acccatatucccaggtctgucat

SEQ ID NO: 49695 - DNA, 21 bp, Artificial Sequence
  Synthetic
ttcaagattcccugggccauc

SEQ ID NO: 49696 - DNA, 25 bp, Artificial Sequence
  Synthetic
ccacatctcautctcttttgtcucc

SEQ ID NO: 49697 - DNA, 23 bp, Artificial Sequence
  Synthetic
cacctccaucctaagcaaugaca

SEQ ID NO: 49698 - DNA, 18 bp, Artificial Sequence
  Synthetic
gccagggagutggcagug

SEQ ID NO: 49699 - DNA, 24 bp, Artificial Sequence
  Synthetic
ctgggcccaugttttgtatactug

SEQ ID NO: 49700 - DNA, 17 bp, Artificial Sequence
  Synthetic
ccctgcucccacuccca

SEQ ID NO: 49701 - DNA, 25 bp, Artificial Sequence
  Synthetic
gtctctgacuctcttctctuaccca

SEQ ID NO: 49702 - DNA, 23 bp, Artificial Sequence
  Synthetic
gtcagccauctcatcuggaaaga

SEQ ID NO: 49703 - DNA, 21 bp, Artificial Sequence
  Synthetic
gccatgacuccttcctccugt

SEQ ID NO: 49704 - DNA, 21 bp, Artificial Sequence
  Synthetic
agccccuggtggtaucagaat

SEQ ID NO: 49705 - DNA, 26 bp, Artificial Sequence
  Synthetic
atcttccccaaaugtctggttcauag

SEQ ID NO: 49706 - DNA, 23 bp, Artificial Sequence
  Synthetic
ccctcaaatcuccaactaccugt

SEQ ID NO: 49707 - DNA, 25 bp, Artificial Sequence
  Synthetic
caggaactctcuctgcttttgtcua

SEQ ID NO: 49708 - DNA, 21 bp, Artificial Sequence
  Synthetic
cctgagaauggguagccagga

SEQ ID NO: 49709 - DNA, 21 bp, Artificial Sequence
  Synthetic
gtaagtugaccccgagctcug

SEQ ID NO: 49710 - DNA, 21 bp, Artificial Sequence
  Synthetic
gggaactcagcutccttccug

SEQ ID NO: 49711 - DNA, 23 bp, Artificial Sequence
  Synthetic
cttcccacuccttgactctgtut

SEQ ID NO: 49712 - DNA, 23 bp, Artificial Sequence
  Synthetic
ccuauagagggaagaggagtugt

SEQ ID NO: 49713 - DNA, 23 bp, Artificial Sequence
  Synthetic
ctcacccugggtaatgttctcuc

SEQ ID NO: 49714 - DNA, 23 bp, Artificial Sequence
  Synthetic
cctgcatcugtgctttcuggaat

SEQ ID NO: 49715 - DNA, 23 bp, Artificial Sequence
  Synthetic
cctcctctcacucctaactgcut

SEQ ID NO: 49716 - DNA, 23 bp, Artificial Sequence
  Synthetic
ggaguctggagacucaggagaat

SEQ ID NO: 49717 - DNA, 24 bp, Artificial Sequence
  Synthetic
gccctctcaccuctatctttcuca

SEQ ID NO: 49718 - DNA, 22 bp, Artificial Sequence
  Synthetic
gttggaaggaucaagcuccuaa

SEQ ID NO: 49719 - DNA, 23 bp, Artificial Sequence
  Synthetic
gaggccccuttataaatgccuct

SEQ ID NO: 49720 - DNA, 21 bp, Artificial Sequence
  Synthetic
cctttcagugcaagggucact

SEQ ID NO: 49721 - DNA, 22 bp, Artificial Sequence
  Synthetic
tgctgggautttgtctgtgucc

SEQ ID NO: 49722 - DNA, 27 bp, Artificial Sequence
  Synthetic
ctgaaacccttaauttcctgtatccut

SEQ ID NO: 49723 - DNA, 22 bp, Artificial Sequence
  Synthetic
gtgcctggucacctgtttcuag

SEQ ID NO: 49724 - DNA, 22 bp, Artificial Sequence
  Synthetic
gaaggcagcuagaaagguggag

SEQ ID NO: 49725 - DNA, 28 bp, Artificial Sequence
  Synthetic
actaaagggacacagutttatccatuca

SEQ ID NO: 49726 - DNA, 23 bp, Artificial Sequence
  Synthetic
ggtaaagctgcugtgccttcuag

SEQ ID NO: 49727 - DNA, 26 bp, Artificial Sequence
  Synthetic
cagtgaaagtaauggatgggcuaagt

SEQ ID NO: 49728 - DNA, 23 bp, Artificial Sequence
  Synthetic
ggaagccuggagaactaggucat

SEQ ID NO: 49729 - DNA, 24 bp, Artificial Sequence
  Synthetic
cttgttctgacacutcccttgtuc

SEQ ID NO: 49730 - DNA, 22 bp, Artificial Sequence
  Synthetic
gagacugagctggugaacagat

SEQ ID NO: 49731 - DNA, 23 bp, Artificial Sequence
  Synthetic
ggtguggatagttcuggaaaggg

SEQ ID NO: 49732 - DNA, 18 bp, Artificial Sequence
  Synthetic
cctgccgcacacucacuc

SEQ ID NO: 49733 - DNA, 22 bp, Artificial Sequence
  Synthetic
ggaccttcuctccttgaccuca

SEQ ID NO: 49734 - DNA, 24 bp, Artificial Sequence
  Synthetic
acaagccaccuaacaggaaatuac

SEQ ID NO: 49735 - DNA, 24 bp, Artificial Sequence
  Synthetic
tgacccctacucttttgttccuca

SEQ ID NO: 49736 - DNA, 24 bp, Artificial Sequence
  Synthetic
ggutaaaaaucagaggcgacagga

SEQ ID NO: 49737 - DNA, 22 bp, Artificial Sequence
  Synthetic
ggctacatgugtgtctcctuca

SEQ ID NO: 49738 - DNA, 24 bp, Artificial Sequence
  Synthetic
cctcacgauaatcatccccauagc

SEQ ID NO: 49739 - DNA, 22 bp, Artificial Sequence
  Synthetic
cagccctaacauccccatcuac

SEQ ID NO: 49740 - DNA, 24 bp, Artificial Sequence
  Synthetic
gaaggtgtccuaggagatgatugc

SEQ ID NO: 49741 - DNA, 22 bp, Artificial Sequence
  Synthetic
tcaccccacaccutccaatuac

SEQ ID NO: 49742 - DNA, 31 bp, Artificial Sequence; identical to SEQ ID NO: 37508
  Synthetic

SEQ ID NO: 49743 - DNA, 22 bp, Artificial Sequence
  Synthetic
cagcagcaaccaucaagactuc

SEQ ID NO: 49744 - DNA, 22 bp, Artificial Sequence
  Synthetic
cagaagtcaaucctgcctcuga

SEQ ID NO: 49745 - DNA, 25 bp, Artificial Sequence
  Synthetic
ttcacttgaaccucttccaccatut

SEQ ID NO: 49746 - DNA, 20 bp, Artificial Sequence
  Synthetic
cctcggaagacuggcugaga

SEQ ID NO: 49747 - DNA, 24 bp, Artificial Sequence
  Synthetic
actctgtgtguatctctctcggut

SEQ ID NO: 49748 - DNA, 22 bp, Artificial Sequence
  Synthetic
ccaggcaucaggactcctctua

SEQ ID NO: 49749 - DNA, 23 bp, Artificial Sequence
  Synthetic
tcatagtctgcuccctgtctuct

SEQ ID NO: 49750 - DNA, 21 bp, Artificial Sequence
  Synthetic
gcctgtacugccccattuaca

SEQ ID NO: 49751 - DNA, 26 bp, Artificial Sequence
  Synthetic
gctgatgtgaugtgctttctctuaca

SEQ ID NO: 49752 - DNA, 22 bp, Artificial Sequence
  Synthetic
ccagcugtgagaauccagacat

SEQ ID NO: 49753 - DNA, 29 bp, Artificial Sequence
  Synthetic
gtgttcacagtguggtttgatttacauag

SEQ ID NO: 49754 - DNA, 22 bp, Artificial Sequence
  Synthetic
gggaggaagauccatcccauct

SEQ ID NO: 49755 - DNA, 23 bp, Artificial Sequence
  Synthetic
ttgacaatcguctccttctugca

SEQ ID NO: 49756 - DNA, 18 bp, Artificial Sequence
  Synthetic
tcggctuccacctggtug

SEQ ID NO: 49757 - DNA, 20 bp, Artificial Sequence
  Synthetic
gcgattcucccagatugcct

SEQ ID NO: 49758 - DNA, 19 bp, Artificial Sequence
  Synthetic
acaggtugagctccuccgt

SEQ ID NO: 49759 - DNA, 22 bp, Artificial Sequence
  Synthetic
cccatcuccagctgtctgttuc

SEQ ID NO: 49760 - DNA, 22 bp, Artificial Sequence
  Synthetic
tgaactcgauctgcagcatguc

SEQ ID NO: 49761 - DNA, 21 bp, Artificial Sequence
  Synthetic
tgaagccguacctggctauct

SEQ ID NO: 49762 - DNA, 23 bp, Artificial Sequence
  Synthetic
cccuatcaatgagtugggcacaa

SEQ ID NO: 49763 - DNA, 21 bp, Artificial Sequence
  Synthetic
gactacactuggcaagcaugg

SEQ ID NO: 49764 - DNA, 20 bp, Artificial Sequence
  Synthetic
tggaaccuagcgtccagcua

SEQ ID NO: 49765 - DNA, 19 bp, Artificial Sequence
  Synthetic
catagcgguagtcgcgcut

SEQ ID NO: 49766 - DNA, 23 bp, Artificial Sequence
  Synthetic
gggtgatgugaatattgtuggca

SEQ ID NO: 49767 - DNA, 22 bp, Artificial Sequence
  Synthetic
ctctctttuaggccctccucct

SEQ ID NO: 49768 - DNA, 21 bp, Artificial Sequence
  Synthetic
gggtttugggctaaccaucat

SEQ ID NO: 49769 - DNA, 24 bp, Artificial Sequence
  Synthetic
tggcctccagguaatggactatua

SEQ ID NO: 49770 - DNA, 22 bp, Artificial Sequence
  Synthetic
tggcgagaagaacauggactug

SEQ ID NO: 49771 - DNA, 22 bp, Artificial Sequence
  Synthetic
gtgggccuttcagaatcuggaa

SEQ ID NO: 49772 - DNA, 22 bp, Artificial Sequence
  Synthetic
aacttcccugatcacagtugct

SEQ ID NO: 49773 - DNA, 23 bp, Artificial Sequence
  Synthetic
caagagcagutgctcagauacca

SEQ ID NO: 49774 - DNA, 22 bp, Artificial Sequence
  Synthetic
gacaatguggcggctaacttuc

SEQ ID NO: 49775 - DNA, 30 bp, Artificial Sequence; identical to SEQ ID NO: 37541
  Synthetic

SEQ ID NO: 49776 - DNA, 26 bp, Artificial Sequence
  Synthetic
acttctgctuttgcttctttuaagcc

SEQ ID NO: 49777 - DNA, 20 bp, Artificial Sequence
  Synthetic
aucttctttuccccgccaca

SEQ ID NO: 49778 - DNA, 24 bp, Artificial Sequence
  Synthetic
cagttugacccagagaucaagact

SEQ ID NO: 49779 - DNA, 25 bp, Artificial Sequence
  Synthetic
tcctttattguccaaatgtcugcct

SEQ ID NO: 49780 - DNA, 27 bp, Artificial Sequence
  Synthetic
cacactctaaaagauaggctgaaugct

SEQ ID NO: 49781 - DNA, 29 bp, Artificial Sequence
  Synthetic
ttgatatatatucggccctatgcacttuc

SEQ ID NO: 49782 - DNA, 29 bp, Artificial Sequence
  Synthetic
tcagtgtaaguagattgacattugcaaca

SEQ ID NO: 49783 - DNA, 23 bp, Artificial Sequence
  Synthetic
catcgagucatcactgcucaaca

SEQ ID NO: 49784 - DNA, 26 bp, Artificial Sequence
  Synthetic
gccctatgugagttcatttccaucat

SEQ ID NO: 49785 - DNA, 31 bp, Artificial Sequence; identical to SEQ ID NO: 37551
  Synthetic

SEQ ID NO: 49786 - DNA, 27 bp, Artificial Sequence
  Synthetic
catgaugttgaaatagtuggcaccaat

SEQ ID NO: 49787 - DNA, 22 bp, Artificial Sequence
  Synthetic
aggcaaaucaccaaagtcugct

SEQ ID NO: 49788 - DNA, 28 bp, Artificial Sequence
  Synthetic
aactggatauaacttctgaatugcccaa

SEQ ID NO: 49789 - DNA, 29 bp, Artificial Sequence
  Synthetic
tgatggcaagagugatggattacaaauaa

SEQ ID NO: 49790 - DNA, 29 bp, Artificial Sequence
  Synthetic
cctcattaatcttucaaagttcagctucc

SEQ ID NO: 49791 - DNA, 23 bp, Artificial Sequence
  Synthetic
tttggaugcaatguggaaagcat

SEQ ID NO: 49792 - DNA, 26 bp, Artificial Sequence
  Synthetic
gtttaggguttgaagaatugccaagt

SEQ ID NO: 49793 - DNA, 27 bp, Artificial Sequence
  Synthetic
caaatgcagagaacaguggaattaugc

SEQ ID NO: 49794 - DNA, 24 bp, Artificial Sequence
  Synthetic
tgcatggaugtatgaaauggcact

SEQ ID NO: 49795 - DNA, 25 bp, Artificial Sequence
  Synthetic
ccaagaggaggucgaattggtatuc

SEQ ID NO: 49796 - DNA, 25 bp, Artificial Sequence
  Synthetic
tgaattccuaagcacaatcugcact

SEQ ID NO: 49797 - DNA, 23 bp, Artificial Sequence
  Synthetic
agaatctctggcutcttggctut

SEQ ID NO: 49798 - DNA, 22 bp, Artificial Sequence
  Synthetic
agtctcuctgatccugccacaa

SEQ ID NO: 49799 - DNA, 28 bp, Artificial Sequence
  Synthetic
gccagtcauggagtacttttaaaugaca

SEQ ID NO: 49800 - DNA, 27 bp, Artificial Sequence
  Synthetic
gaaaattctcacagutgggatttcugg

SEQ ID NO: 49801 - DNA, 28 bp, Artificial Sequence
  Synthetic
ccgaaatatacaaautcagcctgacgua

SEQ ID NO: 49802 - DNA, 25 bp, Artificial Sequence
  Synthetic
ggtcttccuagctcattcactuacc

SEQ ID NO: 49803 - DNA, 25 bp, Artificial Sequence
  Synthetic
ccaatgccautgttatgctgtuaca

SEQ ID NO: 49804 - DNA, 28 bp, Artificial Sequence
  Synthetic
guatttctctaucagacacaagcacaca

SEQ ID NO: 49805 - DNA, 28 bp, Artificial Sequence
  Synthetic
atccctuagaaaaggaacaaaagctuct

SEQ ID NO: 49806 - DNA, 28 bp, Artificial Sequence
  Synthetic
ttccaaactcuttactgtgttguacaat

SEQ ID NO: 49807 - DNA, 26 bp, Artificial Sequence
  Synthetic
cctgaatcagcuttaaaatgguccct

SEQ ID NO: 49808 - DNA, 26 bp, Artificial Sequence
  Synthetic
acctgcctguttattaacagtaugac

SEQ ID NO: 49809 - DNA, 25 bp, Artificial Sequence
  Synthetic
atgcaagttguggcttttggtatut

SEQ ID NO: 49810 - DNA, 22 bp, Artificial Sequence
  Synthetic
ggttcugacctggtgauggaag

SEQ ID NO: 49811 - DNA, 29 bp, Artificial Sequence
  Synthetic
ggttccttactaaaugagcactattgugt

SEQ ID NO: 49812 - DNA, 21 bp, Artificial Sequence
  Synthetic
agccacgagggutagacaaug

SEQ ID NO: 49813 - DNA, 31 bp, Artificial Sequence; identical to SEQ ID NO: 37579
  Synthetic

SEQ ID NO: 49814 - DNA, 23 bp, Artificial Sequence
  Synthetic
cgaccaaagcutgaatugaccaa

SEQ ID NO: 49815 - DNA, 30 bp, Artificial Sequence; identical to SEQ ID NO: 37581
  Synthetic

SEQ ID NO: 49816 - DNA, 24 bp, Artificial Sequence
  Synthetic
ggcccagcacaugtaattttgtug

SEQ ID NO: 49817 - DNA, 29 bp, Artificial Sequence
  Synthetic
gacctttgctguaacatgctgtatttuat

SEQ ID NO: 49818 - DNA, 30 bp, Artificial Sequence; identical to SEQ ID NO: 37584
  Synthetic

SEQ ID NO: 49819 - DNA, 28 bp, Artificial Sequence
  Synthetic
tctttcttuccagcaaccttatcauaca

SEQ ID NO: 49820 - DNA, 27 bp, Artificial Sequence
  Synthetic
aaacttaagagaccuaacatttugcca

SEQ ID NO: 49821 - DNA, 27 bp, Artificial Sequence
  Synthetic
agcatctctugttttcctaagugacat

SEQ ID NO: 49822 - DNA, 27 bp, Artificial Sequence
  Synthetic
ccctcaaaucccacatatcatctauca

SEQ ID NO: 49823 - DNA, 22 bp, Artificial Sequence
  Synthetic
ggagtgcaguttcaagtctugg

SEQ ID NO: 49824 - DNA, 27 bp, Artificial Sequence
  Synthetic
gcucattagacttuccaacaaaacact

SEQ ID NO: 49825 - DNA, 29 bp, Artificial Sequence
  Synthetic
gatgtcctcagtuctatcatcctctttut

SEQ ID NO: 49826 - DNA, 25 bp, Artificial Sequence
  Synthetic
acagtttccacagugacaatctcut

SEQ ID NO: 49827 - DNA, 22 bp, Artificial Sequence
  Synthetic
acttttccucgggctgcttuag

SEQ ID NO: 49828 - DNA, 22 bp, Artificial Sequence
  Synthetic
cagccaggaacutgactccaua

SEQ ID NO: 49829 - DNA, 28 bp, Artificial Sequence
  Synthetic
gactgacaatttuccctttgtccatuag

SEQ ID NO: 49830 - DNA, 27 bp, Artificial Sequence
  Synthetic
cagtaagttgaggaugcttgtgtuagt

SEQ ID NO: 49831 - DNA, 22 bp, Artificial Sequence
  Synthetic
ccaacccagcuctctgtttucc

SEQ ID NO: 49832 - DNA, 26 bp, Artificial Sequence
  Synthetic
ctcagtaatcutgacggtaatuggct

SEQ ID NO: 49833 - DNA, 28 bp, Artificial Sequence
  Synthetic
catutcattaagattgaugacaccccat

SEQ ID NO: 49834 - DNA, 22 bp, Artificial Sequence
  Synthetic
ccaaugatcuggcacaaagagg

SEQ ID NO: 49835 - DNA, 26 bp, Artificial Sequence
  Synthetic
tggttctttccuaatggtgactgtut

SEQ ID NO: 49836 - DNA, 22 bp, Artificial Sequence
  Synthetic
ctgtagcatuagccaggacucg

SEQ ID NO: 49837 - DNA, 25 bp, Artificial Sequence
  Synthetic
agaatgggtagugaggaagcaaaug

SEQ ID NO: 49838 - DNA, 22 bp, Artificial Sequence
  Synthetic
ccacacagggugacattccuat

SEQ ID NO: 49839 - DNA, 22 bp, Artificial Sequence
  Synthetic
ctgttgcccuggaaauagaggt

SEQ ID NO: 49840 - DNA, 22 bp, Artificial Sequence
  Synthetic
ggcttccaccaugtaagcugaa

SEQ ID NO: 49841 - DNA, 27 bp, Artificial Sequence
  Synthetic
gatgatcaactuccttgcaatguaact

SEQ ID NO: 49842 - DNA, 20 bp, Artificial Sequence
  Synthetic
caattccccugacacucgct

SEQ ID NO: 49843 - DNA, 23 bp, Artificial Sequence
  Synthetic
gtgggaccauacttactgugagg

SEQ ID NO: 49844 - DNA, 22 bp, Artificial Sequence
  Synthetic
ccagactgugaagagggaugga

SEQ ID NO: 49845 - DNA, 25 bp, Artificial Sequence
  Synthetic
ggaaaggctucaccttcatgtauga

SEQ ID NO: 49846 - DNA, 21 bp, Artificial Sequence
  Synthetic
agggttucacaccagatgcuc

SEQ ID NO: 49847 - DNA, 24 bp, Artificial Sequence
  Synthetic
ccctaccutccacttaatugacct

SEQ ID NO: 49848 - DNA, 24 bp, Artificial Sequence
  Synthetic
cctagctgaaugctagaccaucaa

SEQ ID NO: 49849 - DNA, 23 bp, Artificial Sequence
  Synthetic
cgaggcugatgaactauacggat

SEQ ID NO: 49850 - DNA, 24 bp, Artificial Sequence
  Synthetic
tttcagaggacautgattgcccut

SEQ ID NO: 49851 - DNA, 25 bp, Artificial Sequence
  Synthetic
gactattcugcagttctucccagag

SEQ ID NO: 49852 - DNA, 27 bp, Artificial Sequence
  Synthetic
gttatattaacaguggtcacucaccca

SEQ ID NO: 49853 - DNA, 28 bp, Artificial Sequence
  Synthetic
ggtgatcccatutgaatatgctgtttut

SEQ ID NO: 49854 - DNA, 25 bp, Artificial Sequence
  Synthetic
gacagactacautggtctggttuga

SEQ ID NO: 49855 - DNA, 28 bp, Artificial Sequence
  Synthetic
aggaacatttgaugatagtgagagguct

SEQ ID NO: 49856 - DNA, 27 bp, Artificial Sequence
  Synthetic
catgttacaaaucagtgaggagugagt

SEQ ID NO: 49857 - DNA, 30 bp, Artificial Sequence; identical to SEQ ID NO: 37623
  Synthetic

SEQ ID NO: 49858 - DNA, 23 bp, Artificial Sequence
  Synthetic
acagtgaagucactggcatugag

SEQ ID NO: 49859 - DNA, 26 bp, Artificial Sequence
  Synthetic
tccttgaggaugaaactctguaaggt

SEQ ID NO: 49860 - DNA, 22 bp, Artificial Sequence
  Synthetic
ctcaaggucaacaagcautcut

SEQ ID NO: 49861 - DNA, 30 bp, Artificial Sequence; identical to SEQ ID NO: 37627
  Synthetic

SEQ ID NO: 49862 - DNA, 20 bp, Artificial Sequence
  Synthetic
cauagaacaggcccgtcucc

SEQ ID NO: 49863 - DNA, 22 bp, Artificial Sequence
  Synthetic
ggtugggaacaagggctcuaac

SEQ ID NO: 49864 - DNA, 25 bp, Artificial Sequence
  Synthetic
agagagcaauaccaataccuaccca

SEQ ID NO: 49865 - DNA, 29 bp, Artificial Sequence
  Synthetic
gcctttctatttuatctgaactgcaucca

SEQ ID NO: 49866 - DNA, 22 bp, Artificial Sequence
  Synthetic
cauaaagaccauccccagtuct

SEQ ID NO: 49867 - DNA, 29 bp, Artificial Sequence
  Synthetic
ccatcatttagtcutgtctgtcttgacut

SEQ ID NO: 49868 - DNA, 21 bp, Artificial Sequence
  Synthetic
gggctatcccaugatgctcug

SEQ ID NO: 49869 - DNA, 27 bp, Artificial Sequence
  Synthetic
cacttagtgtutgagaaagagaugcct

SEQ ID NO: 49870 - DNA, 25 bp, Artificial Sequence
  Synthetic
cctaggtuagcaaaggtgctttuga

SEQ ID NO: 49871 - DNA, 29 bp, Artificial Sequence
  Synthetic
cctgtaatgtttaugcgatctacatguct

SEQ ID NO: 49872 - DNA, 22 bp, Artificial Sequence
  Synthetic
catcccucatgccauacagaca

SEQ ID NO: 49873 - DNA, 30 bp, Artificial Sequence; identical to SEQ ID NO: 37639
  Synthetic

SEQ ID NO: 49874 - DNA, 29 bp, Artificial Sequence
  Synthetic
agaaagtaagcaagaugagagagauaggt

SEQ ID NO: 49875 - DNA, 22 bp, Artificial Sequence
  Synthetic
cccagaagacucgtgcagatuc

SEQ ID NO: 49876 - DNA, 27 bp, Artificial Sequence
  Synthetic
gagaaagagagagaaugtgtgtgtgut

SEQ ID NO: 49877 - DNA, 30 bp, Artificial Sequence; identical to SEQ ID NO: 37643
  Synthetic

SEQ ID NO: 49878 - DNA, 24 bp, Artificial Sequence
  Synthetic
tcccactcauaaaaaccacucacc

SEQ ID NO: 49879 - DNA, 29 bp, Artificial Sequence
  Synthetic
acatgctcactugtggtactattttcuaa

SEQ ID NO: 49880 - DNA, 24 bp, Artificial Sequence
  Synthetic
agcaaaaatcccucatcctgtcug

SEQ ID NO: 49881 - DNA, 27 bp, Artificial Sequence
  Synthetic
gcctgagatttcuttcccttgtgtuag

SEQ ID NO: 49882 - DNA, 30 bp, Artificial Sequence; identical to SEQ ID NO: 37648
  Synthetic

SEQ ID NO: 49883 - DNA, 27 bp, Artificial Sequence
  Synthetic
tgctccaaucaaaactgaaaatgctut

SEQ ID NO: 49884 - DNA, 22 bp, Artificial Sequence
  Synthetic
gcggugagtttttcugagagga

SEQ ID NO: 49885 - DNA, 26 bp, Artificial Sequence
  Synthetic
tcttggttttcuttttcttgctucgg

SEQ ID NO: 49886 - DNA, 20 bp, Artificial Sequence
  Synthetic
tcuagagccaagacgccuct

SEQ ID NO: 49887 - DNA, 22 bp, Artificial Sequence
  Synthetic
aggataaggugtcccagctuca

SEQ ID NO: 49888 - DNA, 24 bp, Artificial Sequence
  Synthetic
acaacgcuaaacagaaagagcuga

SEQ ID NO: 49889 - DNA, 27 bp, Artificial Sequence
  Synthetic
cctcttgcttugccaaacatttatcut

SEQ ID NO: 49890 - DNA, 27 bp, Artificial Sequence
  Synthetic
caagatgtgaagauggcacatttuagt

SEQ ID NO: 49891 - DNA, 22 bp, Artificial Sequence
  Synthetic
ccacagccautcgtcccaaaua

SEQ ID NO: 49892 - DNA, 22 bp, Artificial Sequence
  Synthetic
gcatattucttgcccucaagca

SEQ ID NO: 49893 - DNA, 27 bp, Artificial Sequence
  Synthetic
cctcatcttcaugagcttcactttcuc

SEQ ID NO: 49894 - DNA, 24 bp, Artificial Sequence
  Synthetic
caggaagaccaugggtgaagtuac

SEQ ID NO: 49895 - DNA, 28 bp, Artificial Sequence
  Synthetic
cttcctctucaccaaactgataaaaucc

SEQ ID NO: 49896 - DNA, 27 bp, Artificial Sequence
  Synthetic
ggtccccatuagactactaaatctugc

SEQ ID NO: 49897 - DNA, 28 bp, Artificial Sequence
  Synthetic
tgtttgtgtgtcugtgtgtgataauagt

SEQ ID NO: 49898 - DNA, 28 bp, Artificial Sequence
  Synthetic
acagaagggtcaguttttctgagaaaut

SEQ ID NO: 49899 - DNA, 27 bp, Artificial Sequence
  Synthetic
tccacactaggaucatccatttctgua

SEQ ID NO: 49900 - DNA, 28 bp, Artificial Sequence
  Synthetic
tgaggaagaugaagatgaggaagaugat

SEQ ID NO: 49901 - DNA, 29 bp, Artificial Sequence
  Synthetic
gcttgatttucaagattgagatttugcag

SEQ ID NO: 49902 - DNA, 19 bp, Artificial Sequence
  Synthetic
cgaccctucgcctaaccuc

SEQ ID NO: 49903 - DNA, 24 bp, Artificial Sequence
  Synthetic
ggttgtccucgctttccaaauact

SEQ ID NO: 49904 - DNA, 27 bp, Artificial Sequence
  Synthetic
gtttcttctgcuagcaatacagcuaca

SEQ ID NO: 49905 - DNA, 29 bp, Artificial Sequence
  Synthetic
gaaaagtcattuactccaatgcttucagt

SEQ ID NO: 49906 - DNA, 25 bp, Artificial Sequence
  Synthetic
tggacagtttugttgccaatttugt

SEQ ID NO: 49907 - DNA, 28 bp, Artificial Sequence
  Synthetic
agttcttctagacautttgccccuaaaa

SEQ ID NO: 49908 - DNA, 33 bp, Artificial Sequence; identical to SEQ ID NO: 37674
  Synthetic

SEQ ID NO: 49909 - DNA, 28 bp, Artificial Sequence
  Synthetic
acgctgcacugaatctctttctataaut

SEQ ID NO: 49910 - DNA, 24 bp, Artificial Sequence
  Synthetic
tttaacttagcutcaggcaccugt

SEQ ID NO: 49911 - DNA, 22 bp, Artificial Sequence
  Synthetic
ggguaaataucaaggccgagca

SEQ ID NO: 49912 - DNA, 22 bp, Artificial Sequence
  Synthetic
ggaatucccacagacacgcaua

SEQ ID NO: 49913 - DNA, 27 bp, Artificial Sequence
  Synthetic
cctaccucacagcaacaattcttatug

SEQ ID NO: 49914 - DNA, 29 bp, Artificial Sequence
  Synthetic
gtggctgttaacaucttaaagacttucaa

SEQ ID NO: 49915 - DNA, 22 bp, Artificial Sequence
  Synthetic
gcttttugcacccacctucaac

SEQ ID NO: 49916 - DNA, 28 bp, Artificial Sequence
  Synthetic
cgagatgagugaagaacttatggaacuc

SEQ ID NO: 49917 - DNA, 27 bp, Artificial Sequence
  Synthetic
gatggtccctatuatcactgtgaccua

SEQ ID NO: 49918 - DNA, 27 bp, Artificial Sequence
  Synthetic
ggcatttaaguccaaaactctggaaut

SEQ ID NO: 49919 - DNA, 27 bp, Artificial Sequence
  Synthetic
attcaccccttucatttaacagccuat

SEQ ID NO: 49920 - DNA, 23 bp, Artificial Sequence
  Synthetic
ttgcutacagggtuggaaaccat

SEQ ID NO: 49921 - DNA, 28 bp, Artificial Sequence
  Synthetic
ttgccatgaccuaagcttaactactuac

SEQ ID NO: 49922 - DNA, 29 bp, Artificial Sequence
  Synthetic
caatcctgaucacgctttagtttaucaaa

SEQ ID NO: 49923 - DNA, 26 bp, Artificial Sequence
  Synthetic
cctaccttugggtcaaaatugacaca

SEQ ID NO: 49924 - DNA, 21 bp, Artificial Sequence
  Synthetic
gctatugacgagcagcugaca

SEQ ID NO: 49925 - DNA, 20 bp, Artificial Sequence
  Synthetic
gtgctctcucctgggaggua

SEQ ID NO: 49926 - DNA, 30 bp, Artificial Sequence; identical to SEQ ID NO: 37692
  Synthetic

SEQ ID NO: 49927 - DNA, 27 bp, Artificial Sequence
  Synthetic
accacaatgucgtcaatgaattcuaca

SEQ ID NO: 49928 - DNA, 24 bp, Artificial Sequence
  Synthetic
tgatcttgtugcctcctgagatug

SEQ ID NO: 49929 - DNA, 28 bp, Artificial Sequence
  Synthetic
ccatacucagccacaatttgttttugaa

SEQ ID NO: 49930 - DNA, 26 bp, Artificial Sequence
  Synthetic
agtggtgaatgucatcaacaaaguct

SEQ ID NO: 49931 - DNA, 30 bp, Artificial Sequence; identical to SEQ ID NO: 37697
  Synthetic

SEQ ID NO: 49932 - DNA, 29 bp, Artificial Sequence
  Synthetic
ttgaggacttuagagtgtttgatagtugg

SEQ ID NO: 49933 - DNA, 28 bp, Artificial Sequence
  Synthetic
catgaaactggcaacautaatacgctua

SEQ ID NO: 49934 - DNA, 23 bp, Artificial Sequence
  Synthetic
acagatuccggactucagagaga

SEQ ID NO: 49935 - DNA, 31 bp, Artificial Sequence; identical to SEQ ID NO: 37701
  Synthetic

SEQ ID NO: 49936 - DNA, 31 bp, Artificial Sequence; identical to SEQ ID NO: 37702
  Synthetic

SEQ ID NO: 49937 - DNA, 26 bp, Artificial Sequence
  Synthetic
cgctgtgtauggattttctgcatuaa

SEQ ID NO: 49938 - DNA, 30 bp, Artificial Sequence; identical to SEQ ID NO: 37704
  Synthetic

SEQ ID NO: 49939 - DNA, 26 bp, Artificial Sequence
  Synthetic
gagccactucaaaaagacgaguagat

SEQ ID NO: 49940 - DNA, 30 bp, Artificial Sequence; identical to SEQ ID NO: 37706
  Synthetic

SEQ ID NO: 49941 - DNA, 28 bp, Artificial Sequence
  Synthetic
gtggtgcugagaaagataaattgttgua

SEQ ID NO: 49942 - DNA, 23 bp, Artificial Sequence
  Synthetic
cacagutaaggacaugacagcct

SEQ ID NO: 49943 - DNA, 25 bp, Artificial Sequence
  Synthetic
cacttcauctcagatgaugcaaacc

SEQ ID NO: 49944 - DNA, 22 bp, Artificial Sequence
  Synthetic
gaaatcagucagaccugggcaa

SEQ ID NO: 49945 - DNA, 29 bp, Artificial Sequence
  Synthetic
tgtaaacatacaucaaaacatcacauggt

SEQ ID NO: 49946 - DNA, 24 bp, Artificial Sequence
  Synthetic
gagcaagugttaagcuggcaaaat

SEQ ID NO: 49947 - DNA, 24 bp, Artificial Sequence
  Synthetic
gcatacagccugtcttugacaaac

SEQ ID NO: 49948 - DNA, 27 bp, Artificial Sequence
  Synthetic
ccgaagutttaatgacugaagggacaa

SEQ ID NO: 49949 - DNA, 31 bp, Artificial Sequence; identical to SEQ ID NO: 37715
  Synthetic

SEQ ID NO: 49950 - DNA, 25 bp, Artificial Sequence
  Synthetic
gaagacaaucaggatgtttcugcac

SEQ ID NO: 49951 - DNA, 27 bp, Artificial Sequence
  Synthetic
ttgcttgttgaacucaaccttcuaaga

SEQ ID NO: 49952 - DNA, 21 bp, Artificial Sequence
  Synthetic
ccauagtggccuacgaggaaa

SEQ ID NO: 49953 - DNA, 31 bp, Artificial Sequence; identical to SEQ ID NO: 37719
  Synthetic

SEQ ID NO: 49954 - DNA, 25 bp, Artificial Sequence
  Synthetic
ctggagauagacagaagaucaugac

SEQ ID NO: 49955 - DNA, 27 bp, Artificial Sequence
  Synthetic
aaacaacgacttucttggaactacuct

SEQ ID NO: 49956 - DNA, 28 bp, Artificial Sequence
  Synthetic
gactgtgatguttgtgttttctatugct

SEQ ID NO: 49957 - DNA, 30 bp, Artificial Sequence; identical to SEQ ID NO: 37723
  Synthetic

SEQ ID NO: 49958 - DNA, 23 bp, Artificial Sequence
  Synthetic
gcattttgcaguggtttgcatut

SEQ ID NO: 49959 - DNA, 25 bp, Artificial Sequence
  Synthetic
gctaagccacaaagcauaacactug

SEQ ID NO: 49960 - DNA, 31 bp, Artificial Sequence; identical to SEQ ID NO: 37726
  Synthetic

SEQ ID NO: 49961 - DNA, 28 bp, Artificial Sequence
  Synthetic
gccagctacucactcaacaaaatcauat

SEQ ID NO: 49962 - DNA, 22 bp, Artificial Sequence
  Synthetic
tgacgacaucccagtgtttcug

SEQ ID NO: 49963 - DNA, 29 bp, Artificial Sequence
  Synthetic
caattagccacaautatttccacugacaa

SEQ ID NO: 49964 - DNA, 31 bp, Artificial Sequence; identical to SEQ ID NO: 37730
  Synthetic

SEQ ID NO: 49965 - DNA, 26 bp, Artificial Sequence
  Synthetic
tgttgtcacagcuttagggttuaagt

SEQ ID NO: 49966 - DNA, 26 bp, Artificial Sequence
  Synthetic
aggtctcttcucatccattcuacgag

SEQ ID NO: 49967 - DNA, 29 bp, Artificial Sequence
  Synthetic
gaatcgaactctuaatacactcaggaugt

SEQ ID NO: 49968 - DNA, 22 bp, Artificial Sequence
  Synthetic
tcactccctucatgaggctuct

SEQ ID NO: 49969 - DNA, 25 bp, Artificial Sequence
  Synthetic
ctgtgcaacaacaugaatgtgctua

SEQ ID NO: 49970 - DNA, 28 bp, Artificial Sequence
  Synthetic
atgtactctcutaaggataaaguggagt

SEQ ID NO: 49971 - DNA, 27 bp, Artificial Sequence
  Synthetic
tcataaacttcutttgggctgucagaa

SEQ ID NO: 49972 - DNA, 28 bp, Artificial Sequence
  Synthetic
aggtttctaccccuatgatattgtuact

SEQ ID NO: 49973 - DNA, 21 bp, Artificial Sequence
  Synthetic
cctgcgacggaaauttcacug

SEQ ID NO: 49974 - DNA, 24 bp, Artificial Sequence
  Synthetic
acgcactcuctctctctttcugat

SEQ ID NO: 49975 - DNA, 24 bp, Artificial Sequence
  Synthetic
caaagactgttuttcccactccug

SEQ ID NO: 49976 - DNA, 24 bp, Artificial Sequence
  Synthetic
guggatgaaaucgacagaagaagt

SEQ ID NO: 49977 - DNA, 31 bp, Artificial Sequence; identical to SEQ ID NO: 37743
  Synthetic

SEQ ID NO: 49978 - DNA, 24 bp, Artificial Sequence
  Synthetic
taaggagguaatctgcgaugaaga

SEQ ID NO: 49979 - DNA, 26 bp, Artificial Sequence
  Synthetic
tttgagagcaguattcaacacccuac

SEQ ID NO: 49980 - DNA, 24 bp, Artificial Sequence
  Synthetic
gcacuaaacaccatctauggccaa

SEQ ID NO: 49981 - DNA, 25 bp, Artificial Sequence
  Synthetic
ggcataacauagagcagtcaaggua

SEQ ID NO: 49982 - DNA, 21 bp, Artificial Sequence
  Synthetic
gtgtgggtcugcaagctttuc

SEQ ID NO: 49983 - DNA, 25 bp, Artificial Sequence
  Synthetic
tgtaatgtggguccttccctctauc

SEQ ID NO: 49984 - DNA, 20 bp, Artificial Sequence
  Synthetic
gccataaugggcgcttccut

SEQ ID NO: 49985 - DNA, 21 bp, Artificial Sequence
  Synthetic
gaagggucagaagaacugcct

SEQ ID NO: 49986 - DNA, 28 bp, Artificial Sequence
  Synthetic
gctgaactttgucttgtaaaacattuca

SEQ ID NO: 49987 - DNA, 28 bp, Artificial Sequence
  Synthetic
ccagagcaugaacttcattatgaatucc

SEQ ID NO: 49988 - DNA, 20 bp, Artificial Sequence
  Synthetic
tcattcaucacccgcctgut

SEQ ID NO: 49989 - DNA, 18 bp, Artificial Sequence
  Synthetic
caggcugacacggcauac

SEQ ID NO: 49990 - DNA, 26 bp, Artificial Sequence
  Synthetic
ccaccccaaagagutttcuagaacaa

SEQ ID NO: 49991 - DNA, 30 bp, Artificial Sequence; identical to SEQ ID NO: 37757
  Synthetic

SEQ ID NO: 49992 - DNA, 27 bp, Artificial Sequence
  Synthetic
catctgagtcaaccuccatttttctut

SEQ ID NO: 49993 - DNA, 30 bp, Artificial Sequence; identical to SEQ ID NO: 37759
  Synthetic

SEQ ID NO: 49994 - DNA, 27 bp, Artificial Sequence
  Synthetic
ttttgtaatgtgagucctaaaagcuga

SEQ ID NO: 49995 - DNA, 27 bp, Artificial Sequence
  Synthetic
accacttttagacagutctctggaaug

SEQ ID NO: 49996 - DNA, 26 bp, Artificial Sequence
  Synthetic
tgtaaagcauccatcctatcugggat

SEQ ID NO: 49997 - DNA, 27 bp, Artificial Sequence
  Synthetic
ccttttcaatgucatagtttgcacuca

SEQ ID NO: 49998 - DNA, 24 bp, Artificial Sequence
  Synthetic
cggcutcattugaaaaagcaacag

SEQ ID NO: 49999 - DNA, 24 bp, Artificial Sequence
  Synthetic
aaaatccccacaagcugatcugaa

SEQ ID NO: 50000 - DNA, 28 bp, Artificial Sequence
  Synthetic
aatccattaagucctttgaagcucaaga

SEQ ID NO: 50001 - DNA, 25 bp, Artificial Sequence
  Synthetic
gctgacaagguaaggaactgaacut

SEQ ID NO: 50002 - DNA, 25 bp, Artificial Sequence
  Synthetic
gatatccatgutgacggatgaugct

SEQ ID NO: 50003 - DNA, 26 bp, Artificial Sequence
  Synthetic
agccagtctcutcaaacttcacauac

SEQ ID NO: 50004 - DNA, 26 bp, Artificial Sequence
  Synthetic
tggccaagguccattataagaauaca

SEQ ID NO: 50005 - DNA, 26 bp, Artificial Sequence
  Synthetic
tgaggattugccaattttgtgugaag

SEQ ID NO: 50006 - DNA, 26 bp, Artificial Sequence
  Synthetic
gtacttaaccaccauttcccacacut

SEQ ID NO: 50007 - DNA, 24 bp, Artificial Sequence
  Synthetic
gcctccaatcuctctaccagttug

SEQ ID NO: 50008 - DNA, 29 bp, Artificial Sequence
  Synthetic
ctcataatttttcauttcaggtacgucct

SEQ ID NO: 50009 - DNA, 21 bp, Artificial Sequence
  Synthetic
cttgctgccacuggtctguaa

SEQ ID NO: 50010 - DNA, 24 bp, Artificial Sequence
  Synthetic
aaccttaaactgutgccctgtgua

SEQ ID NO: 50011 - DNA, 22 bp, Artificial Sequence
  Synthetic
catgggtgaugctctccaucag

SEQ ID NO: 50012 - DNA, 22 bp, Artificial Sequence
  Synthetic
ttctgcctacucagtcatguct

SEQ ID NO: 50013 - DNA, 24 bp, Artificial Sequence
  Synthetic
gtgtgtucaactgtgaaucgaagc

SEQ ID NO: 50014 - DNA, 27 bp, Artificial Sequence
  Synthetic
actgtaaagtaucgttcacaccatucc

SEQ ID NO: 50015 - DNA, 31 bp, Artificial Sequence; identical to SEQ ID NO: 37781
  Synthetic

SEQ ID NO: 50016 - DNA, 22 bp, Artificial Sequence
  Synthetic
tacttctatcgugtgcctgugt

SEQ ID NO: 50017 - DNA, 29 bp, Artificial Sequence
  Synthetic
cttcgaatgcttuaactaagtccaatcug

SEQ ID NO: 50018 - DNA, 22 bp, Artificial Sequence
  Synthetic
acagaatuccaggctcctcuca

SEQ ID NO: 50019 - DNA, 28 bp, Artificial Sequence
  Synthetic
agtgtcttcccugaaacttaatacucac

SEQ ID NO: 50020 - DNA, 26 bp, Artificial Sequence
  Synthetic
agattacagggutttcatgagtgcug

SEQ ID NO: 50021 - DNA, 22 bp, Artificial Sequence
  Synthetic
gacttcatugtctgccuagcct

SEQ ID NO: 50022 - DNA, 25 bp, Artificial Sequence
  Synthetic
gagcaggagtutaaaagcatcctut

SEQ ID NO: 50023 - DNA, 23 bp, Artificial Sequence
  Synthetic
gcccaaagacugacagctttgua

SEQ ID NO: 50024 - DNA, 25 bp, Artificial Sequence
  Synthetic
ttgaggaagugaaaatggatgccua

SEQ ID NO: 50025 - DNA, 24 bp, Artificial Sequence
  Synthetic
tgttggatgucactgtcaggaaut

SEQ ID NO: 50026 - DNA, 28 bp, Artificial Sequence
  Synthetic
caccaugacgaaaactgaaauagaaagg

SEQ ID NO: 50027 - DNA, 31 bp, Artificial Sequence; identical to SEQ ID NO: 37793
  Synthetic

SEQ ID NO: 50028 - DNA, 25 bp, Artificial Sequence
  Synthetic
attggaagauattcactgtguggct

SEQ ID NO: 50029 - DNA, 26 bp, Artificial Sequence
  Synthetic
cautattcagaacacuaacccagcac

SEQ ID NO: 50030 - DNA, 22 bp, Artificial Sequence
  Synthetic
cgggaaccutacaugcaacact

SEQ ID NO: 50031 - DNA, 20 bp, Artificial Sequence
  Synthetic
ggttccccacutacccctug

SEQ ID NO: 50032 - DNA, 24 bp, Artificial Sequence
  Synthetic
ctatgccggucatcttugcaaaag

SEQ ID NO: 50033 - DNA, 23 bp, Artificial Sequence
  Synthetic
gccagtgtuaccttacgcttcua

SEQ ID NO: 50034 - DNA, 17 bp, Artificial Sequence
  Synthetic
cgcccggccutgtctut

SEQ ID NO: 50035 - DNA, 22 bp, Artificial Sequence
  Synthetic
tcttcttgcugctcttcuccac

SEQ ID NO: 50036 - DNA, 22 bp, Artificial Sequence
  Synthetic
accccatcuaataagggccuca

SEQ ID NO: 50037 - DNA, 28 bp, Artificial Sequence
  Synthetic
cccacgttcuattctttgttatauccca

SEQ ID NO: 50038 - DNA, 21 bp, Artificial Sequence
  Synthetic
ccgtggutcctcagucaaact

SEQ ID NO: 50039 - DNA, 31 bp, Artificial Sequence; identical to SEQ ID NO: 37805
  Synthetic

SEQ ID NO: 50040 - DNA, 26 bp, Artificial Sequence
  Synthetic
tggatguagcaaaccaauatcagaut

SEQ ID NO: 50041 - DNA, 29 bp, Artificial Sequence
  Synthetic
gttaaatgcggauacttaaaatcagccut

SEQ ID NO: 50042 - DNA, 28 bp, Artificial Sequence
  Synthetic
gaattgaaagcaacugcagatgacttua

SEQ ID NO: 50043 - DNA, 28 bp, Artificial Sequence
  Synthetic
gtgtccaaacaugagtttuaagaaacca

SEQ ID NO: 50044 - DNA, 22 bp, Artificial Sequence
  Synthetic
atgaacctaaucgccagccaut

SEQ ID NO: 50045 - DNA, 27 bp, Artificial Sequence
  Synthetic
gagaaactggcuacatgatcaggtuat

SEQ ID NO: 50046 - DNA, 30 bp, Artificial Sequence; identical to SEQ ID NO: 37812
  Synthetic

SEQ ID NO: 50047 - DNA, 24 bp, Artificial Sequence
  Synthetic
gctgagagccucccaaaatgtaua

SEQ ID NO: 50048 - DNA, 28 bp, Artificial Sequence
  Synthetic
aagatctacagucagttcttuccaaacc

SEQ ID NO: 50049 - DNA, 25 bp, Artificial Sequence
  Synthetic
guttcctaaactuccaccacaaaca

SEQ ID NO: 50050 - DNA, 28 bp, Artificial Sequence
  Synthetic
tcutttacttcctguaaacaagcacact

SEQ ID NO: 50051 - DNA, 28 bp, Artificial Sequence
  Synthetic
gaaagtggaacagugaattaacaucaca

SEQ ID NO: 50052 - DNA, 25 bp, Artificial Sequence
  Synthetic
ggtcgatuaggacacattcucgaat

SEQ ID NO: 50053 - DNA, 25 bp, Artificial Sequence
  Synthetic
tctctgatgaguctgaagtccacuc

SEQ ID NO: 50054 - DNA, 18 bp, Artificial Sequence
  Synthetic
ctcctcgcugtcctcugg

SEQ ID NO: 50055 - DNA, 19 bp, Artificial Sequence
  Synthetic
ctccgcutctctcuacgca

SEQ ID NO: 50056 - DNA, 27 bp, Artificial Sequence
  Synthetic
tgaatgtaatcacuttgcatgtgctut

SEQ ID NO: 50057 - DNA, 28 bp, Artificial Sequence
  Synthetic
caccaaccuaatagaggtataaugcact

SEQ ID NO: 50058 - DNA, 24 bp, Artificial Sequence
  Synthetic
aatggtgggauctgttgttcugag

SEQ ID NO: 50059 - DNA, 28 bp, Artificial Sequence
  Synthetic
ttcautacctgtataatuccaaccagca

SEQ ID NO: 50060 - DNA, 21 bp, Artificial Sequence
  Synthetic
ttggcagaucctttggtuggt

SEQ ID NO: 50061 - DNA, 22 bp, Artificial Sequence
  Synthetic
ggcccagacucagagaaugaat

SEQ ID NO: 50062 - DNA, 24 bp, Artificial Sequence
  Synthetic
accaatctugctgatttcacugct

SEQ ID NO: 50063 - DNA, 28 bp, Artificial Sequence
  Synthetic
ttgtttgucaaccaaataatgcugaact

SEQ ID NO: 50064 - DNA, 22 bp, Artificial Sequence
  Synthetic
tggtggucaaatctucacagca

SEQ ID NO: 50065 - DNA, 26 bp, Artificial Sequence
  Synthetic
ccuataaaaccagtucagcaaaaggg

SEQ ID NO: 50066 - DNA, 22 bp, Artificial Sequence
  Synthetic
gtctgugaacaggctgtcucat

SEQ ID NO: 50067 - DNA, 25 bp, Artificial Sequence
  Synthetic
ggtaugcagagaaguagggttauac

SEQ ID NO: 50068 - DNA, 28 bp, Artificial Sequence
  Synthetic
aggtagttatcacaugatggtaccugat

SEQ ID NO: 50069 - DNA, 27 bp, Artificial Sequence
  Synthetic
aggaaatctgggutttacgttacucac

SEQ ID NO: 50070 - DNA, 29 bp, Artificial Sequence
  Synthetic
tgaggctugaaattatttaaucccagaca

SEQ ID NO: 50071 - DNA, 28 bp, Artificial Sequence
  Synthetic
ggaccccaguaaatacttgtagaaugaa

SEQ ID NO: 50072 - DNA, 22 bp, Artificial Sequence
  Synthetic
taccaaggaacagugtguaggt

SEQ ID NO: 50073 - DNA, 26 bp, Artificial Sequence
  Synthetic
gttgggatatcaagutcctccagauc

SEQ ID NO: 50074 - DNA, 28 bp, Artificial Sequence
  Synthetic
tgaaagtaataaugtttctccugagcaa

SEQ ID NO: 50075 - DNA, 30 bp, Artificial Sequence; identical to SEQ ID NO: 37841
  Synthetic

SEQ ID NO: 50076 - DNA, 28 bp, Artificial Sequence
  Synthetic
gacggtccatgaugctatactctatcua

SEQ ID NO: 50077 - DNA, 30 bp, Artificial Sequence; identical to SEQ ID NO: 37843
  Synthetic

SEQ ID NO: 50078 - DNA, 28 bp, Artificial Sequence
  Synthetic
aatgcagactuaaggagaattcagtugt

SEQ ID NO: 50079 - DNA, 30 bp, Artificial Sequence; identical to SEQ ID NO: 37845
  Synthetic

SEQ ID NO: 50080 - DNA, 19 bp, Artificial Sequence
  Synthetic
cgggagcagucctgacuct

SEQ ID NO: 50081 - DNA, 22 bp, Artificial Sequence
  Synthetic
acagtuacgaaaagcggctgua

SEQ ID NO: 50082 - DNA, 22 bp, Artificial Sequence
  Synthetic
aacctcagcutgaccucagaac

SEQ ID NO: 50083 - DNA, 22 bp, Artificial Sequence
  Synthetic
ctgatctgcuccacctacctuc

SEQ ID NO: 50084 - DNA, 21 bp, Artificial Sequence
  Synthetic
cuatgagguagggcacgaact

SEQ ID NO: 50085 - DNA, 24 bp, Artificial Sequence
  Synthetic
ggtatcccguttttgccctuaaga

SEQ ID NO: 50086 - DNA, 20 bp, Artificial Sequence
  Synthetic
cccaauccccagcacatuct

SEQ ID NO: 50087 - DNA, 21 bp, Artificial Sequence
  Synthetic
gactcttcuctgccttgugca

SEQ ID NO: 50088 - DNA, 22 bp, Artificial Sequence
  Synthetic
ccaggagccauaccatcaccua

SEQ ID NO: 50089 - DNA, 22 bp, Artificial Sequence
  Synthetic
gctcttccgucctttcucacag

SEQ ID NO: 50090 - DNA, 22 bp, Artificial Sequence
  Synthetic
ctgcttcugggaatcctuggag

SEQ ID NO: 50091 - DNA, 25 bp, Artificial Sequence
  Synthetic
ccactttcatcutcaccctccuaaa

SEQ ID NO: 50092 - DNA, 20 bp, Artificial Sequence
  Synthetic
cagcgtgagggucctctcua

SEQ ID NO: 50093 - DNA, 20 bp, Artificial Sequence
  Synthetic
gcatggctuctctggcaucc

SEQ ID NO: 50094 - DNA, 20 bp, Artificial Sequence
  Synthetic
cagggagugtagcagugcag

SEQ ID NO: 50095 - DNA, 24 bp, Artificial Sequence
  Synthetic
gaccacactucccttctacaucag

SEQ ID NO: 50096 - DNA, 23 bp, Artificial Sequence
  Synthetic
aaagtctcuccatctctccaugc

SEQ ID NO: 50097 - DNA, 26 bp, Artificial Sequence
  Synthetic
tccccactaauaacactcacttcuct

SEQ ID NO: 50098 - DNA, 21 bp, Artificial Sequence
  Synthetic
cgtctucggagagacctugag

SEQ ID NO: 50099 - DNA, 22 bp, Artificial Sequence
  Synthetic
gacttggctuacccctcctuag

SEQ ID NO: 50100 - DNA, 17 bp, Artificial Sequence
  Synthetic
ctcgtgucccgggtgut

SEQ ID NO: 50101 - DNA, 17 bp, Artificial Sequence
  Synthetic
cctccucgggacucgac

SEQ ID NO: 50102 - DNA, 25 bp, Artificial Sequence
  Synthetic
tctataaauagctggaggugggcat

SEQ ID NO: 50103 - DNA, 26 bp, Artificial Sequence
  Synthetic
gttcaaagggcauatactggtacugg

SEQ ID NO: 50104 - DNA, 23 bp, Artificial Sequence
  Synthetic
tgtctgcuggcctctgtctatua

SEQ ID NO: 50105 - DNA, 27 bp, Artificial Sequence
  Synthetic
atttctttattccucagtccccaucac

SEQ ID NO: 50106 - DNA, 21 bp, Artificial Sequence
  Synthetic
acgggatctutctggtgctuc

SEQ ID NO: 50107 - DNA, 21 bp, Artificial Sequence
  Synthetic
acacccugcttaacatucgct

SEQ ID NO: 50108 - DNA, 25 bp, Artificial Sequence
  Synthetic
ggacattcatcucccttttcaccut

SEQ ID NO: 50109 - DNA, 21 bp, Artificial Sequence
  Synthetic
ccagctcuggcttcagtcaug

SEQ ID NO: 50110 - DNA, 23 bp, Artificial Sequence
  Synthetic
cctctctuccacctgtttctcug

SEQ ID NO: 50111 - DNA, 29 bp, Artificial Sequence
  Synthetic
gcacttgtggauactgattaaaactgtut

SEQ ID NO: 50112 - DNA, 22 bp, Artificial Sequence
  Synthetic
tgaaaacugcccacctctgtut

SEQ ID NO: 50113 - DNA, 23 bp, Artificial Sequence
  Synthetic
caatcuacagcctcacuccacac

SEQ ID NO: 50114 - DNA, 24 bp, Artificial Sequence
  Synthetic
gactacgguggacuaaaggaaact

SEQ ID NO: 50115 - DNA, 24 bp, Artificial Sequence
  Synthetic
gtgctgtttccuctttaccatgug

SEQ ID NO: 50116 - DNA, 23 bp, Artificial Sequence
  Synthetic
tgcagaaaggaggauagugggaa

SEQ ID NO: 50117 - DNA, 25 bp, Artificial Sequence
  Synthetic
ctagatugcaactctcagucagacc

SEQ ID NO: 50118 - DNA, 25 bp, Artificial Sequence
  Synthetic
tcatgtctctcautccgtgttatuc

SEQ ID NO: 50119 - DNA, 23 bp, Artificial Sequence
  Synthetic
gatgtgagcaauctgacccgtua

SEQ ID NO: 50120 - DNA, 22 bp, Artificial Sequence
  Synthetic
caccatgcttuctccctccaua

SEQ ID NO: 50121 - DNA, 24 bp, Artificial Sequence
  Synthetic
actagctcuggagtcgacttctuc

SEQ ID NO: 50122 - DNA, 18 bp, Artificial Sequence
  Synthetic
gauggcgcggaagttguc

SEQ ID NO: 50123 - DNA, 22 bp, Artificial Sequence
  Synthetic
cgcttttcccuttgctccugat

SEQ ID NO: 50124 - DNA, 23 bp, Artificial Sequence
  Synthetic
cagctcttuggaggcaaatgtua

SEQ ID NO: 50125 - DNA, 24 bp, Artificial Sequence
  Synthetic
gtatccccaaacacauctcctcuc

SEQ ID NO: 50126 - DNA, 24 bp, Artificial Sequence
  Synthetic
ggtgaaaggaggcuctgtgattut

SEQ ID NO: 50127 - DNA, 22 bp, Artificial Sequence
  Synthetic
ccugagcagucagcaaaagact

SEQ ID NO: 50128 - DNA, 27 bp, Artificial Sequence
  Synthetic
ttcctttcattguacctgttctttuct

SEQ ID NO: 50129 - DNA, 20 bp, Artificial Sequence
  Synthetic
ccccgguactctttcgagut

SEQ ID NO: 50130 - DNA, 20 bp, Artificial Sequence
  Synthetic
gcaagguagagggcgagtug

SEQ ID NO: 50131 - DNA, 21 bp, Artificial Sequence
  Synthetic
cccacacaagutcacccucag

SEQ ID NO: 50132 - DNA, 20 bp, Artificial Sequence
  Synthetic
cgaucccagacaccuagcat

SEQ ID NO: 50133 - DNA, 27 bp, Artificial Sequence
  Synthetic
ctggccagaguattccttttaaguagg

SEQ ID NO: 50134 - DNA, 17 bp, Artificial Sequence
  Synthetic
tgccugcggccttgaut

SEQ ID NO: 50135 - DNA, 19 bp, Artificial Sequence
  Synthetic
gcagctgcuacctggaugc

SEQ ID NO: 50136 - DNA, 20 bp, Artificial Sequence
  Synthetic
tgggacuggacgagcttcua

SEQ ID NO: 50137 - DNA, 20 bp, Artificial Sequence
  Synthetic
ctgagcgcuctttcctccuc

SEQ ID NO: 50138 - DNA, 21 bp, Artificial Sequence
  Synthetic
gcagacaggcaugggaguaga

SEQ ID NO: 50139 - DNA, 19 bp, Artificial Sequence
  Synthetic
catgacccccuacccugac

SEQ ID NO: 50140 - DNA, 18 bp, Artificial Sequence
  Synthetic
cagctcccuctccccugt

SEQ ID NO: 50141 - DNA, 19 bp, Artificial Sequence
  Synthetic
ccuccttccttucccacca

SEQ ID NO: 50142 - DNA, 19 bp, Artificial Sequence
  Synthetic
cuggaagagguggaagcca

SEQ ID NO: 50143 - DNA, 19 bp, Artificial Sequence
  Synthetic
cuctgcaggaugaccgcat

SEQ ID NO: 50144 - DNA, 22 bp, Artificial Sequence
  Synthetic
tgctaaaguccccggagactuc

SEQ ID NO: 50145 - DNA, 21 bp, Artificial Sequence
  Synthetic
gggtgguggatgggttuaaca

SEQ ID NO: 50146 - DNA, 21 bp, Artificial Sequence
  Synthetic
ggacaaucagacgggaagcug

SEQ ID NO: 50147 - DNA, 26 bp, Artificial Sequence
  Synthetic
ctgtgatuaccttgatttcuggacct

SEQ ID NO: 50148 - DNA, 21 bp, Artificial Sequence
  Synthetic
ccttagguctaggagcuggca

SEQ ID NO: 50149 - DNA, 17 bp, Artificial Sequence
  Synthetic
ccugacagccggcucag

SEQ ID NO: 50150 - DNA, 18 bp, Artificial Sequence
  Synthetic
cccucccagaggcgauct

SEQ ID NO: 50151 - DNA, 19 bp, Artificial Sequence
  Synthetic
gctctcccugcaaaacugg

SEQ ID NO: 50152 - DNA, 18 bp, Artificial Sequence
  Synthetic
cgatgtgucccgcaccuc

SEQ ID NO: 50153 - DNA, 22 bp, Artificial Sequence
  Synthetic
ccaagcugaagaagacauggct

SEQ ID NO: 50154 - DNA, 19 bp, Artificial Sequence
  Synthetic
ctccuggcactucccacaa

SEQ ID NO: 50155 - DNA, 19 bp, Artificial Sequence
  Synthetic
cagacacugtgcccuggac

SEQ ID NO: 50156 - DNA, 21 bp, Artificial Sequence
  Synthetic
catccctcuggtgcagugaag

SEQ ID NO: 50157 - DNA, 22 bp, Artificial Sequence
  Synthetic
cttgtcagutctgcccauccat

SEQ ID NO: 50158 - DNA, 21 bp, Artificial Sequence
  Synthetic
gccagtcacauggatgctcug

SEQ ID NO: 50159 - DNA, 20 bp, Artificial Sequence
  Synthetic
ccctgaugcctgagcauagt

SEQ ID NO: 50160 - DNA, 21 bp, Artificial Sequence
  Synthetic
cacaagugggagcatgtccut

SEQ ID NO: 50161 - DNA, 19 bp, Artificial Sequence
  Synthetic
ggagaguacgcccagctuc

SEQ ID NO: 50162 - DNA, 18 bp, Artificial Sequence
  Synthetic
tcucaccagcagguggag

SEQ ID NO: 50163 - DNA, 19 bp, Artificial Sequence
  Synthetic
tgccaauggcggacucaaa

SEQ ID NO: 50164 - DNA, 17 bp, Artificial Sequence
  Synthetic
ccctgcucagggaggug

SEQ ID NO: 50165 - DNA, 21 bp, Artificial Sequence
  Synthetic
cgtcccugaccttacagucct

SEQ ID NO: 50166 - DNA, 22 bp, Artificial Sequence
  Synthetic
agaaagaggacucctcagucca

SEQ ID NO: 50167 - DNA, 19 bp, Artificial Sequence
  Synthetic
tcccctgugctgcttucag

SEQ ID NO: 50168 - DNA, 26 bp, Artificial Sequence
  Synthetic
agtctgctatcutcatcacattgucc

SEQ ID NO: 50169 - DNA, 24 bp, Artificial Sequence
  Synthetic
gttctaugagacaagtcggcuagt

SEQ ID NO: 50170 - DNA, 19 bp, Artificial Sequence
  Synthetic
ctcctcugggttgtggcug

SEQ ID NO: 50171 - DNA, 23 bp, Artificial Sequence
  Synthetic
tuctttgaggugaagccaaacct

SEQ ID NO: 50172 - DNA, 21 bp, Artificial Sequence
  Synthetic
ctgttugcttggaaugggaca

SEQ ID NO: 50173 - DNA, 24 bp, Artificial Sequence
  Synthetic
ccaacttaugccactctctgttuc

SEQ ID NO: 50174 - DNA, 27 bp, Artificial Sequence
  Synthetic
ccaaagctauaaattagggacaaugga

SEQ ID NO: 50175 - DNA, 27 bp, Artificial Sequence
  Synthetic
catcgtctacaagaugaagagtgguac

SEQ ID NO: 50176 - DNA, 24 bp, Artificial Sequence
  Synthetic
gcaggacaucgagaggagaagtua

SEQ ID NO: 50177 - DNA, 26 bp, Artificial Sequence
  Synthetic
cattttgcttccgutgtctcttcuag

SEQ ID NO: 50178 - DNA, 24 bp, Artificial Sequence
  Synthetic
agtgacgttgcuctcaaagctuat

SEQ ID NO: 50179 - DNA, 22 bp, Artificial Sequence
  Synthetic
ccgaatgggaucattccucacg

SEQ ID NO: 50180 - DNA, 21 bp, Artificial Sequence
  Synthetic
caggttgtcugggccaatcut

SEQ ID NO: 50181 - DNA, 22 bp, Artificial Sequence
  Synthetic
cctctttagccauggcaagguc

SEQ ID NO: 50182 - DNA, 22 bp, Artificial Sequence
  Synthetic
cuaactttcgcaugcacacaca

SEQ ID NO: 50183 - DNA, 21 bp, Artificial Sequence
  Synthetic
cctgtctcucttggcttuccc

SEQ ID NO: 50184 - DNA, 18 bp, Artificial Sequence
  Synthetic
gcagggcutggcuaccaa

SEQ ID NO: 50185 - DNA, 17 bp, Artificial Sequence
  Synthetic
ctgcagcutcgctgucg

SEQ ID NO: 50186 - DNA, 23 bp, Artificial Sequence
  Synthetic
ccacatcaccugcaaccatauca

SEQ ID NO: 50187 - DNA, 23 bp, Artificial Sequence
  Synthetic
acctctaacugcagaacugggat

SEQ ID NO: 50188 - DNA, 24 bp, Artificial Sequence
  Synthetic
gaatatcctggaugtctgcagcua

SEQ ID NO: 50189 - DNA, 26 bp, Artificial Sequence
  Synthetic
gaccttcagaagacguaggatgaaug

SEQ ID NO: 50190 - DNA, 22 bp, Artificial Sequence
  Synthetic
gtcaacccucgctccttuaagt

SEQ ID NO: 50191 - DNA, 21 bp, Artificial Sequence
  Synthetic
ctttguccaggtcuacaggct

SEQ ID NO: 50192 - DNA, 22 bp, Artificial Sequence
  Synthetic
gcctagtggucttcaggaaugg

SEQ ID NO: 50193 - DNA, 28 bp, Artificial Sequence
  Synthetic
attcataucccacacgaatccaatuagt

SEQ ID NO: 50194 - DNA, 28 bp, Artificial Sequence
  Synthetic
ggagccattuaaaccaggaaattaugac

SEQ ID NO: 50195 - DNA, 21 bp, Artificial Sequence
  Synthetic
catggatttugccgtcctuga

SEQ ID NO: 50196 - DNA, 28 bp, Artificial Sequence
  Synthetic
ggtcccagattuattctgtttcttcuga

SEQ ID NO: 50197 - DNA, 30 bp, Artificial Sequence; identical to SEQ ID NO: 37963
  Synthetic

SEQ ID NO: 50198 - DNA, 26 bp, Artificial Sequence
  Synthetic
gaagaacagaaagucgatcatcuggt

SEQ ID NO: 50199 - DNA, 24 bp, Artificial Sequence
  Synthetic
gttccctggaugatatctgtgucc

SEQ ID NO: 50200 - DNA, 30 bp, Artificial Sequence; identical to SEQ ID NO: 37966
  Synthetic

SEQ ID NO: 50201 - DNA, 28 bp, Artificial Sequence
  Synthetic
cttgacttaagcagacugttttccttut

SEQ ID NO: 50202 - DNA, 26 bp, Artificial Sequence
  Synthetic
tgtggaggaagaugtagttgattgug

SEQ ID NO: 50203 - DNA, 23 bp, Artificial Sequence
  Synthetic
cagtgacaguagaggatgctuct

SEQ ID NO: 50204 - DNA, 24 bp, Artificial Sequence
  Synthetic
gacagcaagcaauaaatuccaggt

SEQ ID NO: 50205 - DNA, 29 bp, Artificial Sequence
  Synthetic
cgtggaatugagattactttuggaacaaa

SEQ ID NO: 50206 - DNA, 29 bp, Artificial Sequence
  Synthetic
guatttaacatcctugagcaaaaacccaa

SEQ ID NO: 50207 - DNA, 22 bp, Artificial Sequence
  Synthetic
agaatttgcccuggttguagca

SEQ ID NO: 50208 - DNA, 29 bp, Artificial Sequence
  Synthetic
agcctataaaaucagctccagtatguaga

SEQ ID NO: 50209 - DNA, 28 bp, Artificial Sequence
  Synthetic
accagtgtcatuggcaataaaagactua

SEQ ID NO: 50210 - DNA, 31 bp, Artificial Sequence; identical to SEQ ID NO: 37976
  Synthetic

SEQ ID NO: 50211 - DNA, 23 bp, Artificial Sequence
  Synthetic
caggaacugaagcttgcaatugg

SEQ ID NO: 50212 - DNA, 25 bp, Artificial Sequence
  Synthetic
cttggugctaaaccuaaagggaagt

SEQ ID NO: 50213 - DNA, 30 bp, Artificial Sequence; identical to SEQ ID NO: 37979
  Synthetic

SEQ ID NO: 50214 - DNA, 23 bp, Artificial Sequence
  Synthetic
ttttggaagugacttgctcucca

SEQ ID NO: 50215 - DNA, 27 bp, Artificial Sequence
  Synthetic
ccctcatagguatggttctcctttuga

SEQ ID NO: 50216 - DNA, 28 bp, Artificial Sequence
  Synthetic
ctgaagagtuagaaagaggtgaugacat

SEQ ID NO: 50217 - DNA, 31 bp, Artificial Sequence; identical to SEQ ID NO: 37983
  Synthetic

SEQ ID NO: 50218 - DNA, 25 bp, Artificial Sequence
  Synthetic
ggagagcaagccacugaagaatuaa

SEQ ID NO: 50219 - DNA, 31 bp, Artificial Sequence; identical to SEQ ID NO: 37985
  Synthetic

SEQ ID NO: 50220 - DNA, 21 bp, Artificial Sequence
  Synthetic
actatcggccugacagugaca

SEQ ID NO: 50221 - DNA, 29 bp, Artificial Sequence
  Synthetic
cctggaacacugaaattccacagaatuat

SEQ ID NO: 50222 - DNA, 25 bp, Artificial Sequence
  Synthetic
atctatgtugcaggaatuccaggag

SEQ ID NO: 50223 - DNA, 24 bp, Artificial Sequence
  Synthetic
cagaagccauttgcctttgucaat

SEQ ID NO: 50224 - DNA, 21 bp, Artificial Sequence
  Synthetic
gcccaacgauggatgaacuct

SEQ ID NO: 50225 - DNA, 26 bp, Artificial Sequence
  Synthetic
cccttctccuctgtatgatgattugc

SEQ ID NO: 50226 - DNA, 23 bp, Artificial Sequence
  Synthetic
atggtacacutcaggaagcugac

SEQ ID NO: 50227 - DNA, 27 bp, Artificial Sequence
  Synthetic
gctttattgtuctcttcccugaacaca

SEQ ID NO: 50228 - DNA, 29 bp, Artificial Sequence
  Synthetic
cacatttgacutgatggguaaaagaagaa

SEQ ID NO: 50229 - DNA, 24 bp, Artificial Sequence
  Synthetic
gatttcatttguctgaccgcugag

SEQ ID NO: 50230 - DNA, 24 bp, Artificial Sequence
  Synthetic
cttggtcaagcutgcctctuagat

SEQ ID NO: 50231 - DNA, 31 bp, Artificial Sequence; identical to SEQ ID NO: 37997
  Synthetic

SEQ ID NO: 50232 - DNA, 19 bp, Artificial Sequence
  Synthetic
caccccaaacuccctucca

SEQ ID NO: 50233 - DNA, 23 bp, Artificial Sequence
  Synthetic
ctcatcatucctggatcugccat

SEQ ID NO: 50234 - DNA, 24 bp, Artificial Sequence
  Synthetic
agaatgtggtuacccggaaaaucc

SEQ ID NO: 50235 - DNA, 30 bp, Artificial Sequence; identical to SEQ ID NO: 38001
  Synthetic

SEQ ID NO: 50236 - DNA, 21 bp, Artificial Sequence
  Synthetic
gtctacccuggcaugcagaat

SEQ ID NO: 50237 - DNA, 21 bp, Artificial Sequence
  Synthetic
tgcauggaaaaauccccacgt

SEQ ID NO: 50238 - DNA, 23 bp, Artificial Sequence
  Synthetic
tccttttatugccaccucaggac

SEQ ID NO: 50239 - DNA, 22 bp, Artificial Sequence
  Synthetic
actgtctggcuccgagaacuaa

SEQ ID NO: 50240 - DNA, 23 bp, Artificial Sequence
  Synthetic
caagauaccccaatgctguagga

SEQ ID NO: 50241 - DNA, 21 bp, Artificial Sequence
  Synthetic
gaggagtgccugctggatuac

SEQ ID NO: 50242 - DNA, 22 bp, Artificial Sequence
  Synthetic
gaataugggccccagaaacaug

SEQ ID NO: 50243 - DNA, 23 bp, Artificial Sequence
  Synthetic
aaaagauggctgtugaccaggat

SEQ ID NO: 50244 - DNA, 26 bp, Artificial Sequence
  Synthetic
agtttcagaaacaucagccacuaact

SEQ ID NO: 50245 - DNA, 22 bp, Artificial Sequence
  Synthetic
cttcacuagctgagcatucggt

SEQ ID NO: 50246 - DNA, 30 bp, Artificial Sequence; identical to SEQ ID NO: 38012
  Synthetic

SEQ ID NO: 50247 - DNA, 25 bp, Artificial Sequence
  Synthetic
tggcagttttugctttcttttccut

SEQ ID NO: 50248 - DNA, 28 bp, Artificial Sequence
  Synthetic
gagacaugcagaaacacattaaaaguga

SEQ ID NO: 50249 - DNA, 29 bp, Artificial Sequence
  Synthetic
aaggctcgggaaucacaataattgtatua

SEQ ID NO: 50250 - DNA, 26 bp, Artificial Sequence
  Synthetic
gggaatgattucttgctcttauagct

SEQ ID NO: 50251 - DNA, 26 bp, Artificial Sequence
  Synthetic
cctcacagattutaatggctccaaug

SEQ ID NO: 50252 - DNA, 26 bp, Artificial Sequence
  Synthetic
ttgctgugacccaaaatattatugct

SEQ ID NO: 50253 - DNA, 29 bp, Artificial Sequence
  Synthetic
cctgaatcaccacuttgtaatacaaauga

SEQ ID NO: 50254 - DNA, 26 bp, Artificial Sequence
  Synthetic
tgutcacttccttaugaagacagcac

SEQ ID NO: 50255 - DNA, 23 bp, Artificial Sequence
  Synthetic
gttucccaaagaucacaccacua

SEQ ID NO: 50256 - DNA, 22 bp, Artificial Sequence
  Synthetic
ccautgtccacaauccccaact

SEQ ID NO: 50257 - DNA, 29 bp, Artificial Sequence
  Synthetic
gcacagaguaagtacaaagaauacaacct

SEQ ID NO: 50258 - DNA, 23 bp, Artificial Sequence
  Synthetic
agtggctttccutgtgttaccuc

SEQ ID NO: 50259 - DNA, 29 bp, Artificial Sequence
  Synthetic
gccatttcatgggcuaatcttcaatttua

SEQ ID NO: 50260 - DNA, 26 bp, Artificial Sequence
  Synthetic
ctuggcccucaaagaagaaactatua

SEQ ID NO: 50261 - DNA, 21 bp, Artificial Sequence
  Synthetic
cutaagcaagtucgcgagcag

SEQ ID NO: 50262 - DNA, 24 bp, Artificial Sequence
  Synthetic
cagggugcttatctttucccagat

SEQ ID NO: 50263 - DNA, 25 bp, Artificial Sequence
  Synthetic
tagccccuttatcatagatuccact

SEQ ID NO: 50264 - DNA, 25 bp, Artificial Sequence
  Synthetic
tcgacagattcuccaaacctgatuc

SEQ ID NO: 50265 - DNA, 28 bp, Artificial Sequence
  Synthetic
ctttttaaaggcaucaggactttctugt

SEQ ID NO: 50266 - DNA, 29 bp, Artificial Sequence
  Synthetic
ctgtgaaaatcuacaggctgatuacaaga

SEQ ID NO: 50267 - DNA, 28 bp, Artificial Sequence
  Synthetic
aggtcgaaaaataaucaaaggctgagua

SEQ ID NO: 50268 - DNA, 23 bp, Artificial Sequence
  Synthetic
ctatggugcactcatggaugagg

SEQ ID NO: 50269 - DNA, 26 bp, Artificial Sequence
  Synthetic
tctgtcatgctuctatggaaaaccug

SEQ ID NO: 50270 - DNA, 22 bp, Artificial Sequence
  Synthetic
atgggagggugagtaagaaguc

SEQ ID NO: 50271 - DNA, 24 bp, Artificial Sequence
  Synthetic
agtctgagaacuccatcagcucat

SEQ ID NO: 50272 - DNA, 21 bp, Artificial Sequence
  Synthetic
gattucccaacgctgguacct

SEQ ID NO: 50273 - DNA, 23 bp, Artificial Sequence
  Synthetic
aggatggttcugcagatggttuc

SEQ ID NO: 50274 - DNA, 23 bp, Artificial Sequence
  Synthetic
atatttcccugcctcgtgcatua

SEQ ID NO: 50275 - DNA, 22 bp, Artificial Sequence
  Synthetic
tcttgtagcugtcctccuggaa

SEQ ID NO: 50276 - DNA, 22 bp, Artificial Sequence
  Synthetic
ttggcaggaugatggaugaaca

SEQ ID NO: 50277 - DNA, 24 bp, Artificial Sequence
  Synthetic
gaacaaatgugagctcgcacuaac

SEQ ID NO: 50278 - DNA, 22 bp, Artificial Sequence
  Synthetic
gtgtgttttcugtgcacggaug

SEQ ID NO: 50279 - DNA, 28 bp, Artificial Sequence
  Synthetic
cctgccaatagaugtgaaactgacauaa

SEQ ID NO: 50280 - DNA, 25 bp, Artificial Sequence
  Synthetic
ctgtttctugctttgcttucaagga

SEQ ID NO: 50281 - DNA, 21 bp, Artificial Sequence
  Synthetic
cacugctgtcaugaagcagga

SEQ ID NO: 50282 - DNA, 22 bp, Artificial Sequence
  Synthetic
gccaacttuactggccuaacac

SEQ ID NO: 50283 - DNA, 24 bp, Artificial Sequence
  Synthetic
gagtggaaaccutgaagaaacuca

SEQ ID NO: 50284 - DNA, 23 bp, Artificial Sequence
  Synthetic
gaaccaattuagagccttugcca

SEQ ID NO: 50285 - DNA, 28 bp, Artificial Sequence
  Synthetic
gaattcaagggcautctacattguacac

SEQ ID NO: 50286 - DNA, 22 bp, Artificial Sequence
  Synthetic
cattgagcugctacggaagauc

SEQ ID NO: 50287 - DNA, 27 bp, Artificial Sequence
  Synthetic
tttgagcaaaguttttatgtgcaucca

SEQ ID NO: 50288 - DNA, 23 bp, Artificial Sequence
  Synthetic
gaugagagggtacuggaacaagc

SEQ ID NO: 50289 - DNA, 23 bp, Artificial Sequence
  Synthetic
tcctctucggaacctttctcuga

SEQ ID NO: 50290 - DNA, 25 bp, Artificial Sequence
  Synthetic
cttcagtttcccugatactgtggut

SEQ ID NO: 50291 - DNA, 23 bp, Artificial Sequence
  Synthetic
gctactgaaggauctccgtccuc

SEQ ID NO: 50292 - DNA, 29 bp, Artificial Sequence
  Synthetic
cattttatgctcutttgcatcttgaugga

SEQ ID NO: 50293 - DNA, 22 bp, Artificial Sequence
  Synthetic
acatcuggcgcctatttacugg

SEQ ID NO: 50294 - DNA, 22 bp, Artificial Sequence
  Synthetic
ccagcccauatagcagtacugt

SEQ ID NO: 50295 - DNA, 29 bp, Artificial Sequence
  Synthetic
caactttttctugtccattttcugagacc

SEQ ID NO: 50296 - DNA, 24 bp, Artificial Sequence
  Synthetic
gcctaatgtcucaacaccagtguc

SEQ ID NO: 50297 - DNA, 20 bp, Artificial Sequence
  Synthetic
aggcaagcuccccaactuac

SEQ ID NO: 50298 - DNA, 21 bp, Artificial Sequence
  Synthetic
cagacacacggauccctgtua

SEQ ID NO: 50299 - DNA, 27 bp, Artificial Sequence
  Synthetic
attccttccaacuctaaactcugcaat

SEQ ID NO: 50300 - DNA, 29 bp, Artificial Sequence
  Synthetic
gaaacgacatagaugtcgaaaccctaaua

SEQ ID NO: 50301 - DNA, 27 bp, Artificial Sequence
  Synthetic
gcagacaggautcttttcccctauaga

SEQ ID NO: 50302 - DNA, 22 bp, Artificial Sequence
  Synthetic
atttccauttggaauggcaggt

SEQ ID NO: 50303 - DNA, 23 bp, Artificial Sequence
  Synthetic
acttttgggccutcttcctctuc

SEQ ID NO: 50304 - DNA, 21 bp, Artificial Sequence
  Synthetic
ctgtttgcuggaatggaccug

SEQ ID NO: 50305 - DNA, 20 bp, Artificial Sequence
  Synthetic
aguagcagcugacagagggt

SEQ ID NO: 50306 - DNA, 22 bp, Artificial Sequence
  Synthetic
aaaagcacagaugctgttucgg

SEQ ID NO: 50307 - DNA, 22 bp, Artificial Sequence
  Synthetic
gcattctgaagucctgccaaug

SEQ ID NO: 50308 - DNA, 24 bp, Artificial Sequence
  Synthetic
gaagagcuagactcacttgauggg

SEQ ID NO: 50309 - DNA, 25 bp, Artificial Sequence
  Synthetic
accaagataccutttgacacaccug

SEQ ID NO: 50310 - DNA, 27 bp, Artificial Sequence
  Synthetic
gcatttacttcugacatctcgatucct

SEQ ID NO: 50311 - DNA, 20 bp, Artificial Sequence
  Synthetic
gcgctctaugtggagagugg

SEQ ID NO: 50312 - DNA, 24 bp, Artificial Sequence
  Synthetic
cagaaatucagcaaaaccaugcca

SEQ ID NO: 50313 - DNA, 23 bp, Artificial Sequence
  Synthetic
gcatcattugggaaagucaagca

SEQ ID NO: 50314 - DNA, 28 bp, Artificial Sequence
  Synthetic
ccaattguacaaacaguataccagatut

SEQ ID NO: 50315 - DNA, 27 bp, Artificial Sequence
  Synthetic
cagtttactcagugctttcatggatut

SEQ ID NO: 50316 - DNA, 25 bp, Artificial Sequence
  Synthetic
ttactcagaacguctgatgttuccc

SEQ ID NO: 50317 - DNA, 26 bp, Artificial Sequence
  Synthetic
ttgatgagtucagaacagtgctguaa

SEQ ID NO: 50318 - DNA, 22 bp, Artificial Sequence
  Synthetic
gaacgaccuattgggctucact

SEQ ID NO: 50319 - DNA, 29 bp, Artificial Sequence
  Synthetic
gtgcaaagcagutaattgatctaaacugt

SEQ ID NO: 50320 - DNA, 25 bp, Artificial Sequence
  Synthetic
atctcatauccgacataggcatuct

SEQ ID NO: 50321 - DNA, 29 bp, Artificial Sequence
  Synthetic
cgcttaccctatuttccaattgtaaacut

SEQ ID NO: 50322 - DNA, 24 bp, Artificial Sequence
  Synthetic
aatctgttaccugggccaaauacc

SEQ ID NO: 50323 - DNA, 29 bp, Artificial Sequence
  Synthetic
aatgtttatcuccagggtttttcttccut

SEQ ID NO: 50324 - DNA, 28 bp, Artificial Sequence
  Synthetic
atgtaagtattgacugtacaccctcuct

SEQ ID NO: 50325 - DNA, 29 bp, Artificial Sequence
  Synthetic
gacactgtagccuttacgaatgtacuaaa

SEQ ID NO: 50326 - DNA, 26 bp, Artificial Sequence
  Synthetic
catggaagaaaggutaagtgagtuca

SEQ ID NO: 50327 - DNA, 24 bp, Artificial Sequence
  Synthetic
ccucttctcagaaauccagaccac

SEQ ID NO: 50328 - DNA, 23 bp, Artificial Sequence
  Synthetic
cagatgagacugcctgcagtaut

SEQ ID NO: 50329 - DNA, 29 bp, Artificial Sequence
  Synthetic
ggttttgttttcuagattcaagatuggca

SEQ ID NO: 50330 - DNA, 24 bp, Artificial Sequence
  Synthetic
acactcttgcuccacgttgtaaut

SEQ ID NO: 50331 - DNA, 27 bp, Artificial Sequence
  Synthetic
cagtgtaagagcuttatgtttccccut

SEQ ID NO: 50332 - DNA, 24 bp, Artificial Sequence
  Synthetic
tcactcccttutgcacacatgaua

SEQ ID NO: 50333 - DNA, 31 bp, Artificial Sequence; identical to SEQ ID NO: 38099
  Synthetic

SEQ ID NO: 50334 - DNA, 20 bp, Artificial Sequence
  Synthetic
ggcggguaggcacttcaaua

SEQ ID NO: 50335 - DNA, 28 bp, Artificial Sequence
  Synthetic
ccccctatauagacaaattaggcaucct

SEQ ID NO: 50336 - DNA, 26 bp, Artificial Sequence
  Synthetic
cctaaaaggauaaaatcctgggcuga

SEQ ID NO: 50337 - DNA, 28 bp, Artificial Sequence
  Synthetic
cctaggaacatcutcttaccgtttctut

SEQ ID NO: 50338 - DNA, 22 bp, Artificial Sequence
  Synthetic
aagaaagguccccaacgatcug

SEQ ID NO: 50339 - DNA, 31 bp, Artificial Sequence; identical to SEQ ID NO: 38105
  Synthetic

SEQ ID NO: 50340 - DNA, 23 bp, Artificial Sequence
  Synthetic
cacacatuccaaacacaccagua

SEQ ID NO: 50341 - DNA, 31 bp, Artificial Sequence; identical to SEQ ID NO: 38107
  Synthetic

SEQ ID NO: 50342 - DNA, 25 bp, Artificial Sequence
  Synthetic
gagtaatauaaacggccacccctut

SEQ ID NO: 50343 - DNA, 27 bp, Artificial Sequence
  Synthetic
tcaaguttcttatttgucaaggcaagc

SEQ ID NO: 50344 - DNA, 28 bp, Artificial Sequence
  Synthetic
attatttacaacautacaacctgugggt

SEQ ID NO: 50345 - DNA, 23 bp, Artificial Sequence
  Synthetic
ctttgagccutccatcctucaca

SEQ ID NO: 50346 - DNA, 25 bp, Artificial Sequence
  Synthetic
tacuctttugggaaagaaggaagga

SEQ ID NO: 50347 - DNA, 22 bp, Artificial Sequence
  Synthetic
ccagagagugcctaucaacgaa

SEQ ID NO: 50348 - DNA, 25 bp, Artificial Sequence
  Synthetic
ttcttggatuactgctgtucacagt

SEQ ID NO: 50349 - DNA, 27 bp, Artificial Sequence
  Synthetic
ttggcttttgucctcttctcttctuag

SEQ ID NO: 50350 - DNA, 23 bp, Artificial Sequence
  Synthetic
tgtgtcctttuccctctccacua

SEQ ID NO: 50351 - DNA, 26 bp, Artificial Sequence
  Synthetic
tttttctcaggguccagaattauggg

SEQ ID NO: 50352 - DNA, 27 bp, Artificial Sequence
  Synthetic
ccatatttctgtugatcagctctguct

SEQ ID NO: 50353 - DNA, 21 bp, Artificial Sequence
  Synthetic
agtguccaggcacagaguagt

SEQ ID NO: 50354 - DNA, 26 bp, Artificial Sequence
  Synthetic
acttttaauagcttggacugcacaca

SEQ ID NO: 50355 - DNA, 21 bp, Artificial Sequence
  Synthetic
catgctgggaccugttcacut

SEQ ID NO: 50356 - DNA, 22 bp, Artificial Sequence
  Synthetic
gagtuagaagcccccaaaguga

SEQ ID NO: 50357 - DNA, 25 bp, Artificial Sequence
  Synthetic
tgtgatcaccuaatagccagcgaua

SEQ ID NO: 50358 - DNA, 23 bp, Artificial Sequence
  Synthetic
cctgagggugctgttauagaagg

SEQ ID NO: 50359 - DNA, 25 bp, Artificial Sequence
  Synthetic
atgataguggcaaaggagagagtug

SEQ ID NO: 50360 - DNA, 23 bp, Artificial Sequence
  Synthetic
gggactccuctattcttggcuca

SEQ ID NO: 50361 - DNA, 21 bp, Artificial Sequence
  Synthetic
ggctggaaucccgcttacuaa

SEQ ID NO: 50362 - DNA, 25 bp, Artificial Sequence
  Synthetic
aaaaatgtggucctgagtctuagca

SEQ ID NO: 50363 - DNA, 25 bp, Artificial Sequence
  Synthetic
ggacagtuaagagaaggctgcttut

SEQ ID NO: 50364 - DNA, 28 bp, Artificial Sequence
  Synthetic
cagagcagaagaaaggugaatgaagaua

SEQ ID NO: 50365 - DNA, 22 bp, Artificial Sequence
  Synthetic
agtgagaagugtcttgggtugg

SEQ ID NO: 50366 - DNA, 24 bp, Artificial Sequence
  Synthetic
cttggcgguagtgatttttgcaut

SEQ ID NO: 50367 - DNA, 27 bp, Artificial Sequence
  Synthetic
caactttatcgcuttttcctgccatua

SEQ ID NO: 50368 - DNA, 23 bp, Artificial Sequence
  Synthetic
tccccctucccaaactcttcaua

SEQ ID NO: 50369 - DNA, 28 bp, Artificial Sequence
  Synthetic
aggtgaaatctgautaaaacaagcacug

SEQ ID NO: 50370 - DNA, 25 bp, Artificial Sequence
  Synthetic
aatgtctcauggagaagcagugaaa

SEQ ID NO: 50371 - DNA, 23 bp, Artificial Sequence
  Synthetic
tcagtcaggaugcaaactctugg

SEQ ID NO: 50372 - DNA, 28 bp, Artificial Sequence
  Synthetic
tttcaatacuccagaatgaagugaaggt

SEQ ID NO: 50373 - DNA, 28 bp, Artificial Sequence
  Synthetic
ccatgccatcguctgtattaagtctuat

SEQ ID NO: 50374 - DNA, 20 bp, Artificial Sequence
  Synthetic
ggttctccucgcctactgug

SEQ ID NO: 50375 - DNA, 22 bp, Artificial Sequence
  Synthetic
caacccaucccagctgagtaut

SEQ ID NO: 50376 - DNA, 25 bp, Artificial Sequence
  Synthetic
caccagaatutaaacaacgcugaca

SEQ ID NO: 50377 - DNA, 22 bp, Artificial Sequence
  Synthetic
gauacaagagctuccggagacc

SEQ ID NO: 50378 - DNA, 23 bp, Artificial Sequence
  Synthetic
ctgcctguggctttgtagttcua

SEQ ID NO: 50379 - DNA, 23 bp, Artificial Sequence
  Synthetic
gatttgcaucccagugaaagcac

SEQ ID NO: 50380 - DNA, 28 bp, Artificial Sequence
  Synthetic
tgttttaaggagacuatgaggtgtguct

SEQ ID NO: 50381 - DNA, 24 bp, Artificial Sequence
  Synthetic
gttactttctucctgcctttgucc

SEQ ID NO: 50382 - DNA, 28 bp, Artificial Sequence
  Synthetic
gtaatcacaguaaaacacaatgcugagg

SEQ ID NO: 50383 - DNA, 27 bp, Artificial Sequence
  Synthetic
cccgcaaacuaactaggataaatcuct

SEQ ID NO: 50384 - DNA, 33 bp, Artificial Sequence
  Synthetic
acaataataatccucaaaaacaaagaaacaugg

SEQ ID NO: 50385 - DNA, 23 bp, Artificial Sequence
  Synthetic
tgtgactgguggtgtgtattcug

SEQ ID NO: 50386 - DNA, 23 bp, Artificial Sequence
  Synthetic
ggccagaggaaautattgcucca

SEQ ID NO: 50387 - DNA, 24 bp, Artificial Sequence
  Synthetic
gggtttgagcagutctgagaaugt

SEQ ID NO: 50388 - DNA, 23 bp, Artificial Sequence
  Synthetic
ccaactcaauggccctcctttua

SEQ ID NO: 50389 - DNA, 23 bp, Artificial Sequence
  Synthetic
tgcagugcaaaaatgcaguaagg

SEQ ID NO: 50390 - DNA, 20 bp, Artificial Sequence
  Synthetic
gcatcccaggauaacgcugt

SEQ ID NO: 50391 - DNA, 26 bp, Artificial Sequence
  Synthetic
cttatctgctaugtggcatactugga

SEQ ID NO: 50392 - DNA, 26 bp, Artificial Sequence
  Synthetic
gcttactaggaccugtaagagtcugt

SEQ ID NO: 50393 - DNA, 28 bp, Artificial Sequence
  Synthetic
tgatgatgugcaagaaaggtagguaaaa

SEQ ID NO: 50394 - DNA, 26 bp, Artificial Sequence
  Synthetic
cccagggaaggaauaagtacattuga

SEQ ID NO: 50395 - DNA, 22 bp, Artificial Sequence
  Synthetic
caggcatutgaccttcuagcca

SEQ ID NO: 50396 - DNA, 27 bp, Artificial Sequence
  Synthetic
aaatttgcaccuggtgttattttuggt

SEQ ID NO: 50397 - DNA, 27 bp, Artificial Sequence
  Synthetic
gcccccattauaacattggagagaaua

SEQ ID NO: 50398 - DNA, 22 bp, Artificial Sequence
  Synthetic
caccagttugagcacagagaut

SEQ ID NO: 50399 - DNA, 22 bp, Artificial Sequence
  Synthetic
gugagaagagccucaaggacag

SEQ ID NO: 50400 - DNA, 20 bp, Artificial Sequence
  Synthetic
ggccagaggacuctgcagua

SEQ ID NO: 50401 - DNA, 24 bp, Artificial Sequence
  Synthetic
tgttcttcuccatcccattucacc

SEQ ID NO: 50402 - DNA, 28 bp, Artificial Sequence
  Synthetic
gataggacccutgttttcaaaaagtugt

SEQ ID NO: 50403 - DNA, 21 bp, Artificial Sequence
  Synthetic
attagcugcaggcagcaguaa

SEQ ID NO: 50404 - DNA, 20 bp, Artificial Sequence
  Synthetic
ggaccugcgaaaucccaaaa

SEQ ID NO: 50405 - DNA, 21 bp, Artificial Sequence
  Synthetic
accccgucgtatcuagcagag

SEQ ID NO: 50406 - DNA, 22 bp, Artificial Sequence
  Synthetic
acctttggaugttgttcuggct

SEQ ID NO: 50407 - DNA, 26 bp, Artificial Sequence
  Synthetic
tccgtagtaaaugagagcaagttugt

SEQ ID NO: 50408 - DNA, 24 bp, Artificial Sequence
  Synthetic
tcagtttttctautggcccacgut

SEQ ID NO: 50409 - DNA, 28 bp, Artificial Sequence
  Synthetic
cttccatagatcucatagccatccttut

SEQ ID NO: 50410 - DNA, 22 bp, Artificial Sequence
  Synthetic
ggagggaguagaguggaagaca

SEQ ID NO: 50411 - DNA, 24 bp, Artificial Sequence
  Synthetic
ccttccatuaaacccagcaccuac

SEQ ID NO: 50412 - DNA, 20 bp, Artificial Sequence
  Synthetic
ctgcaauggaggauccagca

SEQ ID NO: 50413 - DNA, 23 bp, Artificial Sequence
  Synthetic
gctgatgtgtutggtgagctgua

SEQ ID NO: 50414 - DNA, 21 bp, Artificial Sequence
  Synthetic
gcacaggcggcutagaagaut

SEQ ID NO: 50415 - DNA, 26 bp, Artificial Sequence
  Synthetic
ggctaactagtugcgtttacaactut

SEQ ID NO: 50416 - DNA, 20 bp, Artificial Sequence
  Synthetic
tctctaccagcugtgcucgt

SEQ ID NO: 50417 - DNA, 23 bp, Artificial Sequence
  Synthetic
ccttctgtcucaccttcttucgt

SEQ ID NO: 50418 - DNA, 32 bp, Artificial Sequence
  Synthetic
ggcaacttatatguatttttgtatttcatgug

SEQ ID NO: 50419 - DNA, 34 bp, Artificial Sequence
  Synthetic
tgccttaatttatttaccuatcctgtagattaut

SEQ ID NO: 50420 - DNA, 27 bp, Artificial Sequence
  Synthetic
cataaatatgugagtcaatuccccaag

SEQ ID NO: 50421 - DNA, 31 bp, Artificial Sequence
  Synthetic
agacagactaauaggaggtagatagacugga

SEQ ID NO: 50422 - DNA, 30 bp, Artificial Sequence
  Synthetic
tgatagaacacutgtcatagttuagaacga

SEQ ID NO: 50423 - DNA, 30 bp, Artificial Sequence
  Synthetic
tgcaccaaatatuggtaattaaatgttuac

SEQ ID NO: 50424 - DNA, 29 bp, Artificial Sequence
  Synthetic
gtctcagtttucctacctgtaaaaugaag

SEQ ID NO: 50425 - DNA, 23 bp, Artificial Sequence
  Synthetic
gacagcatutcctgtgucagacc

SEQ ID NO: 50426 - DNA, 23 bp, Artificial Sequence
  Synthetic
tttgggggcauctcttatacuca

SEQ ID NO: 50427 - DNA, 21 bp, Artificial Sequence
  Synthetic
ccactgcaguccaatcugggt

SEQ ID NO: 50428 - DNA, 18 bp, Artificial Sequence
  Synthetic
cacagggcutccgagugc

SEQ ID NO: 50429 - DNA, 23 bp, Artificial Sequence
  Synthetic
aattcaaaggguatctgggcuct

SEQ ID NO: 50430 - DNA, 24 bp, Artificial Sequence
  Synthetic
actctgacccauctaacgcctauc

SEQ ID NO: 50431 - DNA, 24 bp, Artificial Sequence
  Synthetic
agttggtcaaauctcctcctucaa

SEQ ID NO: 50432 - DNA, 23 bp, Artificial Sequence
  Synthetic
cagatcccaagcucttcctctuc

SEQ ID NO: 50433 - DNA, 28 bp, Artificial Sequence
  Synthetic
tgtgtgcatctguaagcatgtatctauc

SEQ ID NO: 50434 - DNA, 22 bp, Artificial Sequence
  Synthetic
gagccaguggattuggaaacag

SEQ ID NO: 50435 - DNA, 23 bp, Artificial Sequence
  Synthetic
aggtggcccauaatcatgagtua

SEQ ID NO: 50436 - DNA, 24 bp, Artificial Sequence
  Synthetic
gcctgggcaacagaauaagatuct

SEQ ID NO: 50437 - DNA, 28 bp, Artificial Sequence
  Synthetic
ccattacccgaauaaaaatcttctcuct

SEQ ID NO: 50438 - DNA, 23 bp, Artificial Sequence
  Synthetic
agatgtgaaagcccuagtggaug

SEQ ID NO: 50439 - DNA, 31 bp, Artificial Sequence
  Synthetic
gataggacagaugataaatacataggaugga

SEQ ID NO: 50440 - DNA, 22 bp, Artificial Sequence
  Synthetic
acuggcacagaacaggcactua

SEQ ID NO: 50441 - DNA, 23 bp, Artificial Sequence
  Synthetic
tggtcttacucctgttccctucc

SEQ ID NO: 50442 - DNA, 21 bp, Artificial Sequence
  Synthetic
ttcatgccacugcactucact

SEQ ID NO: 50443 - DNA, 24 bp, Artificial Sequence
  Synthetic
ttctctggtgugtggagatgtcut

SEQ ID NO: 50444 - DNA, 23 bp, Artificial Sequence
  Synthetic
caagggtgautttcctcttuggt

SEQ ID NO: 50445 - DNA, 24 bp, Artificial Sequence
  Synthetic
aagtgatuccaatcauagccacag

SEQ ID NO: 50446 - DNA, 32 bp, Artificial Sequence
  Synthetic
taaccaaaataaaautaggcatattuacaagc

SEQ ID NO: 50447 - DNA, 26 bp, Artificial Sequence
  Synthetic
gctgctgagugatttgtctgtaatug

SEQ ID NO: 50448 - DNA, 28 bp, Artificial Sequence
  Synthetic
caactucagctatgagguaatttttcuc

SEQ ID NO: 50449 - DNA, 24 bp, Artificial Sequence
  Synthetic
aucagagctuaaactgggaagcug

SEQ ID NO: 50450 - DNA, 28 bp, Artificial Sequence
  Synthetic
caactucagctatgagguaatttttcuc

SEQ ID NO: 50451 - DNA, 24 bp, Artificial Sequence
  Synthetic
aucagagctuaaactgggaagcug

SEQ ID NO: 50452 - DNA, 23 bp, Artificial Sequence
  Synthetic
ttttgccagugcctuaacaacag

SEQ ID NO: 50453 - DNA, 28 bp, Artificial Sequence
  Synthetic
ttgatacaagtccuactgtactcacuga

SEQ ID NO: 50454 - DNA, 29 bp, Artificial Sequence
  Synthetic
gaacaagauagagccaaagtacauacact

SEQ ID NO: 50455 - DNA, 21 bp, Artificial Sequence
  Synthetic
gcacgctcugtcactgctuaa

SEQ ID NO: 50456 - DNA, 22 bp, Artificial Sequence
  Synthetic
cctgcaagcutcaacagaggut

SEQ ID NO: 50457 - DNA, 27 bp, Artificial Sequence
  Synthetic
acagacttgugtgtcatttuaaaggga

SEQ ID NO: 50458 - DNA, 21 bp, Artificial Sequence
  Synthetic
cctggaccuccagtgagtcut

SEQ ID NO: 50459 - DNA, 25 bp, Artificial Sequence
  Synthetic
cctttcauaccagggaatccaggua

SEQ ID NO: 50460 - DNA, 19 bp, Artificial Sequence
  Synthetic
caggagccgccugatctuc

SEQ ID NO: 50461 - DNA, 25 bp, Artificial Sequence
  Synthetic
actccctaugaaccaagttcuacca

SEQ ID NO: 50462 - DNA, 25 bp, Artificial Sequence
  Synthetic
gttcgtgtcaagauacccgtgtaut

SEQ ID NO: 50463 - DNA, 28 bp, Artificial Sequence
  Synthetic
ccauatctctatttcuagggaccccaag

SEQ ID NO: 50464 - DNA, 28 bp, Artificial Sequence
  Synthetic
acaaatatgtcaauatgaccagcaucca

SEQ ID NO: 50465 - DNA, 26 bp, Artificial Sequence
  Synthetic
cutcaactgcataucagcaacaaact

SEQ ID NO: 50466 - DNA, 31 bp, Artificial Sequence
  Synthetic
attatatctcaaauctgtcaggauccaaaat

SEQ ID NO: 50467 - DNA, 27 bp, Artificial Sequence
  Synthetic
ccagaaacctuatgttgcacttatuca

SEQ ID NO: 50468 - DNA, 21 bp, Artificial Sequence
  Synthetic
gaguggauggcaaacacacaa

SEQ ID NO: 50469 - DNA, 20 bp, Artificial Sequence
  Synthetic
agcuggagcctcuaggacaa

SEQ ID NO: 50470 - DNA, 20 bp, Artificial Sequence
  Synthetic
gaggctcuggctgggaauag

SEQ ID NO: 50471 - DNA, 23 bp, Artificial Sequence
  Synthetic
cagaaatgttcutagccgcgaug

SEQ ID NO: 50472 - DNA, 23 bp, Artificial Sequence
  Synthetic
ggagaugatggaauaccgacacc

SEQ ID NO: 50473 - DNA, 23 bp, Artificial Sequence
  Synthetic
gcatccaacuggaatccactugt

SEQ ID NO: 50474 - DNA, 23 bp, Artificial Sequence
  Synthetic
gggccagtucctccctagtauaa

SEQ ID NO: 50475 - DNA, 26 bp, Artificial Sequence
  Synthetic
tgttttgttcutctgtgctttuagcc

SEQ ID NO: 50476 - DNA, 28 bp, Artificial Sequence
  Synthetic
tcacaaaccucagaaataactcatugga

SEQ ID NO: 50477 - DNA, 21 bp, Artificial Sequence
  Synthetic
caagatccugtgcagguacca

SEQ ID NO: 50478 - DNA, 20 bp, Artificial Sequence
  Synthetic
tgauccggcacctgttucaa

SEQ ID NO: 50479 - DNA, 24 bp, Artificial Sequence
  Synthetic
ctatcctgguactggaaagccauc

SEQ ID NO: 50480 - DNA, 24 bp, Artificial Sequence
  Synthetic
agagattgtgcuggagaacaagut

SEQ ID NO: 50481 - DNA, 21 bp, Artificial Sequence
  Synthetic
cacgaagccguagtgguagac

SEQ ID NO: 50482 - DNA, 26 bp, Artificial Sequence
  Synthetic
cattaagagcuacctgatcgagaucc

SEQ ID NO: 50483 - DNA, 20 bp, Artificial Sequence
  Synthetic
gcagccccugtgaagaaguc

SEQ ID NO: 50484 - DNA, 25 bp, Artificial Sequence
  Synthetic
gtcctcugcctctttcctuaaaaag

SEQ ID NO: 50485 - DNA, 28 bp, Artificial Sequence
  Synthetic
ttctactcaugcccctcaaacttattut

SEQ ID NO: 50486 - DNA, 27 bp, Artificial Sequence
  Synthetic
aacgaggttttucttactgaacccuaa

SEQ ID NO: 50487 - DNA, 23 bp, Artificial Sequence
  Synthetic
gtgtggcttcugtttgtcttguc

SEQ ID NO: 50488 - DNA, 20 bp, Artificial Sequence
  Synthetic
ctcttcuaccgacccctgug

SEQ ID NO: 50489 - DNA, 23 bp, Artificial Sequence
  Synthetic
agggagugcagagtccaaaatug

SEQ ID NO: 50490 - DNA, 27 bp, Artificial Sequence
  Synthetic
cttcaaaagcccuagauaacaccaagt

SEQ ID NO: 50491 - DNA, 23 bp, Artificial Sequence
  Synthetic
caatgtgtuccacagtccactuc

SEQ ID NO: 50492 - DNA, 20 bp, Artificial Sequence
  Synthetic
ctaccugggcacgaggttua

SEQ ID NO: 50493 - DNA, 21 bp, Artificial Sequence
  Synthetic
gactccaauggctgcaucaac

SEQ ID NO: 50494 - DNA, 20 bp, Artificial Sequence
  Synthetic
atctgatccgugctgcacut

SEQ ID NO: 50495 - DNA, 28 bp, Artificial Sequence
  Synthetic
acctgaataaugacagtccagttttuca

SEQ ID NO: 50496 - DNA, 25 bp, Artificial Sequence
  Synthetic
gactaaaacacagcauccagaguga

SEQ ID NO: 50497 - DNA, 24 bp, Artificial Sequence
  Synthetic
caggtaatgaauttgggcatccug

SEQ ID NO: 50498 - DNA, 27 bp, Artificial Sequence
  Synthetic
ttcttccaaccaccaucttatgttuga

SEQ ID NO: 50499 - DNA, 32 bp, Artificial Sequence
  Synthetic
ttcttgaacattaugattcttgagauagagcc

SEQ ID NO: 50500 - DNA, 28 bp, Artificial Sequence
  Synthetic
caagaccautttcatgttaauccccaag

SEQ ID NO: 50501 - DNA, 21 bp, Artificial Sequence
  Synthetic
catgaatgtucaccccacgut

SEQ ID NO: 50502 - DNA, 21 bp, Artificial Sequence
  Synthetic
gagcagtucttgctttuggct

SEQ ID NO: 50503 - DNA, 22 bp, Artificial Sequence
  Synthetic
ggaatccgugcttgtgaugagt

SEQ ID NO: 50504 - DNA, 19 bp, Artificial Sequence
  Synthetic
ccuggaggagccatgguct

SEQ ID NO: 50505 - DNA, 21 bp, Artificial Sequence
  Synthetic
gaagaugggaccgaagtugga

SEQ ID NO: 50506 - DNA, 24 bp, Artificial Sequence
  Synthetic
gcatacaattutactgcaccugct

SEQ ID NO: 50507 - DNA, 28 bp, Artificial Sequence
  Synthetic
agaaggcacauagtaaaaacagtgauga

SEQ ID NO: 50508 - DNA, 18 bp, Artificial Sequence
  Synthetic
gcaccuggtgcatgugga

SEQ ID NO: 50509 - DNA, 21 bp, Artificial Sequence
  Synthetic
ggtctcugaagctcucacagt

SEQ ID NO: 50510 - DNA, 23 bp, Artificial Sequence
  Synthetic
cctctgaguccttggatguccat

SEQ ID NO: 50511 - DNA, 23 bp, Artificial Sequence
  Synthetic
aagtccttccacucaaacaccug

SEQ ID NO: 50512 - DNA, 17 bp, Artificial Sequence
  Synthetic
aggucaucgcgcagcat

SEQ ID NO: 50513 - DNA, 17 bp, Artificial Sequence
  Synthetic
cgggcgggugttgtuga

SEQ ID NO: 50514 - DNA, 18 bp, Artificial Sequence
  Synthetic
tccuggacucagccccat

SEQ ID NO: 50515 - DNA, 19 bp, Artificial Sequence
  Synthetic
cagccccugcttccuacac

SEQ ID NO: 50516 - DNA, 20 bp, Artificial Sequence
  Synthetic
gtcggctcutggtggagtut

SEQ ID NO: 50517 - DNA, 19 bp, Artificial Sequence
  Synthetic
ggagatgccucggacgaug

SEQ ID NO: 50518 - DNA, 28 bp, Artificial Sequence
  Synthetic
gagccaagtagcugtcataattcatuct

SEQ ID NO: 50519 - DNA, 25 bp, Artificial Sequence
  Synthetic
gcatttggttugtgacattctugga

SEQ ID NO: 50520 - DNA, 24 bp, Artificial Sequence
  Synthetic
aacaaugcaatactuggcaacaca

SEQ ID NO: 50521 - DNA, 27 bp, Artificial Sequence
  Synthetic
cgtactgagtugcaaaatgagtgacua

SEQ ID NO: 50522 - DNA, 24 bp, Artificial Sequence
  Synthetic
tcatagagtugccaaatgctuggt

SEQ ID NO: 50523 - DNA, 27 bp, Artificial Sequence
  Synthetic
ctaacagcaggutctcatagaagauga

SEQ ID NO: 50524 - DNA, 23 bp, Artificial Sequence
  Synthetic
gggcgauatcaacttugcagaga

SEQ ID NO: 50525 - DNA, 29 bp, Artificial Sequence
  Synthetic
ggacauaaagtgugagagaaaagagaaga

SEQ ID NO: 50526 - DNA, 22 bp, Artificial Sequence
  Synthetic
gacaagcacuttgtccctcugt

SEQ ID NO: 50527 - DNA, 23 bp, Artificial Sequence
  Synthetic
gcggtgtttucagctcatgacua

SEQ ID NO: 50528 - DNA, 21 bp, Artificial Sequence
  Synthetic
ccatacctugcccaactgguc

SEQ ID NO: 50529 - DNA, 24 bp, Artificial Sequence
  Synthetic
accaccctutaatctgttgtugct

SEQ ID NO: 50530 - DNA, 33 bp, Artificial Sequence
  Synthetic
tggataactggttauaatctgcttctaatctuc

SEQ ID NO: 50531 - DNA, 22 bp, Artificial Sequence
  Synthetic
agtgccacagcuagaggaguaa

SEQ ID NO: 50532 - DNA, 28 bp, Artificial Sequence
  Synthetic
gaagcaaagugtgtttattcaauccagt

SEQ ID NO: 50533 - DNA, 28 bp, Artificial Sequence
  Synthetic
ccatctctttutacctcttgaucaggat

SEQ ID NO: 50534 - DNA, 23 bp, Artificial Sequence
  Synthetic
atttagcugaagaccgtcaugct

SEQ ID NO: 50535 - DNA, 22 bp, Artificial Sequence
  Synthetic
catcatcaccagucggactcug

SEQ ID NO: 50536 - DNA, 24 bp, Artificial Sequence
  Synthetic
gctctcagauctagacacctcugt

SEQ ID NO: 50537 - DNA, 21 bp, Artificial Sequence
  Synthetic
cttgtggccccutcttcugat

SEQ ID NO: 50538 - DNA, 24 bp, Artificial Sequence
  Synthetic
acagcacaguattgctaugcagaa

SEQ ID NO: 50539 - DNA, 27 bp, Artificial Sequence
  Synthetic
gccttgagucatatcattagguacaca

SEQ ID NO: 50540 - DNA, 24 bp, Artificial Sequence
  Synthetic
agggagaaauggcataaagcacut

SEQ ID NO: 50541 - DNA, 27 bp, Artificial Sequence
  Synthetic
gcctgatgtaugcattcatatctctug

SEQ ID NO: 50542 - DNA, 27 bp, Artificial Sequence
  Synthetic
gcatcatguacaagctcagtttctaug

SEQ ID NO: 50543 - DNA, 29 bp, Artificial Sequence
  Synthetic
acaaaactaccuaatttccgtttacugct

SEQ ID NO: 50544 - DNA, 25 bp, Artificial Sequence
  Synthetic
gctttcgaatuccctatcacaguca

SEQ ID NO: 50545 - DNA, 25 bp, Artificial Sequence
  Synthetic
cttggcaggugaaaaagaaagaugg

SEQ ID NO: 50546 - DNA, 22 bp, Artificial Sequence
  Synthetic
ctctccccauggacctgaguat

SEQ ID NO: 50547 - DNA, 26 bp, Artificial Sequence
  Synthetic
gtatgtggaaaugtagctggtcttug

SEQ ID NO: 50548 - DNA, 25 bp, Artificial Sequence
  Synthetic
ctttcaaagagccagugaactuacc

SEQ ID NO: 50549 - DNA, 28 bp, Artificial Sequence
  Synthetic
atctaagtgtgcuttgttaccttgtuct

SEQ ID NO: 50550 - DNA, 22 bp, Artificial Sequence
  Synthetic
ggcgtgcugctcatttcttcua

SEQ ID NO: 50551 - DNA, 28 bp, Artificial Sequence
  Synthetic
gggaacatacguaactgagaatcttuaa

SEQ ID NO: 50552 - DNA, 22 bp, Artificial Sequence
  Synthetic
cttcaucaggcaggaagagugg

SEQ ID NO: 50553 - DNA, 26 bp, Artificial Sequence
  Synthetic
ctctttgaaagcucaggatcagacut

SEQ ID NO: 50554 - DNA, 27 bp, Artificial Sequence
  Synthetic
ggcaaugttacucaggagacaaagaaa

SEQ ID NO: 50555 - DNA, 27 bp, Artificial Sequence
  Synthetic
ggtttaagggaacutcttgatttgucc

SEQ ID NO: 50556 - DNA, 28 bp, Artificial Sequence
  Synthetic
gggaagaugaaatccaacaatuacaaaa

SEQ ID NO: 50557 - DNA, 27 bp, Artificial Sequence
  Synthetic
catgctaccucccaattttctuaaacc

SEQ ID NO: 50558 - DNA, 24 bp, Artificial Sequence
  Synthetic
agcccctaatutagatgatggcua

SEQ ID NO: 50559 - DNA, 23 bp, Artificial Sequence
  Synthetic
gctgaaaccuccccttcttctuc

SEQ ID NO: 50560 - DNA, 28 bp, Artificial Sequence
  Synthetic
gattaatttgcaggutattgcgagtgut

SEQ ID NO: 50561 - DNA, 28 bp, Artificial Sequence
  Synthetic
aggtaccuttttaacttcuaaagcacat

SEQ ID NO: 50562 - DNA, 28 bp, Artificial Sequence
  Synthetic
gtcatcagcugaagatgaaataggaugt

SEQ ID NO: 50563 - DNA, 27 bp, Artificial Sequence
  Synthetic
tgaagataaacuagaaccctgcaguct

SEQ ID NO: 50564 - DNA, 20 bp, Artificial Sequence
  Synthetic
ccagcccagacugctucaaa

SEQ ID NO: 50565 - DNA, 29 bp, Artificial Sequence
  Synthetic
gggattcgatugttagatcactuagagat

SEQ ID NO: 50566 - DNA, 26 bp, Artificial Sequence
  Synthetic
aagaaaatuggaggaatctgctucat

SEQ ID NO: 50567 - DNA, 28 bp, Artificial Sequence
  Synthetic
ctttgctggtcutccatcattatacuct

SEQ ID NO: 50568 - DNA, 18 bp, Artificial Sequence
  Synthetic
agacagggccugcagtug

SEQ ID NO: 50569 - DNA, 20 bp, Artificial Sequence
  Synthetic
tguggagacaggagcuggat

SEQ ID NO: 50570 - DNA, 21 bp, Artificial Sequence
  Synthetic
gtccaggucaaggcugaaaag

SEQ ID NO: 50571 - DNA, 20 bp, Artificial Sequence
  Synthetic
aaaacccaugctctgccuga

SEQ ID NO: 50572 - DNA, 22 bp, Artificial Sequence
  Synthetic
guagagaggaggaccagucact

SEQ ID NO: 50573 - DNA, 20 bp, Artificial Sequence
  Synthetic
ccacagauggcacagaugct

SEQ ID NO: 50574 - DNA, 22 bp, Artificial Sequence
  Synthetic
gccagucacagaggaugagagt

SEQ ID NO: 50575 - DNA, 28 bp, Artificial Sequence
  Synthetic
ccgtccacttcauttctttgcttattut

SEQ ID NO: 50576 - DNA, 22 bp, Artificial Sequence
  Synthetic
cgttuaaaccaaaggcgcacua

SEQ ID NO: 50577 - DNA, 21 bp, Artificial Sequence
  Synthetic
cgtggcccagcugaatcuaag

SEQ ID NO: 50578 - DNA, 22 bp, Artificial Sequence
  Synthetic
ccgagtgatuggctgaacauct

SEQ ID NO: 50579 - DNA, 20 bp, Artificial Sequence
  Synthetic
tcccgggaucgtgttcuaca

SEQ ID NO: 50580 - DNA, 27 bp, Artificial Sequence
  Synthetic
tgtatacatttggauaccagtgtccut

SEQ ID NO: 50581 - DNA, 27 bp, Artificial Sequence
  Synthetic
gtaacagugaaaacagcatttcccaut

SEQ ID NO: 50582 - DNA, 26 bp, Artificial Sequence
  Synthetic
catcaaggagaaggaguacgagatug

SEQ ID NO: 50583 - DNA, 27 bp, Artificial Sequence
  Synthetic
ttttggaatcaucctctttttgcaugg

SEQ ID NO: 50584 - DNA, 21 bp, Artificial Sequence
  Synthetic
cttcgaugaccgucagcagat

SEQ ID NO: 50585 - DNA, 23 bp, Artificial Sequence
  Synthetic
aaggcgacauctttuggcaaaaa

SEQ ID NO: 50586 - DNA, 25 bp, Artificial Sequence
  Synthetic
tgaccccaacacugaagaaaatcut

SEQ ID NO: 50587 - DNA, 24 bp, Artificial Sequence
  Synthetic
ggcctccugaacagacatttctut

SEQ ID NO: 50588 - DNA, 17 bp, Artificial Sequence
  Synthetic
cccguccctgtcctugt

SEQ ID NO: 50589 - DNA, 21 bp, Artificial Sequence
  Synthetic
ctctctcuccctccttcucca

SEQ ID NO: 50590 - DNA, 24 bp, Artificial Sequence
  Synthetic
cacattttcuagggctgtctucca

SEQ ID NO: 50591 - DNA, 20 bp, Artificial Sequence
  Synthetic
tcaccgugcaguacaaggac

SEQ ID NO: 50592 - DNA, 20 bp, Artificial Sequence
  Synthetic
tggtuaccccgagacuccaa

SEQ ID NO: 50593 - DNA, 19 bp, Artificial Sequence
  Synthetic
gctucgactcctucaccgt

SEQ ID NO: 50594 - DNA, 22 bp, Artificial Sequence
  Synthetic
ggtcaagaggucaagcauggat

SEQ ID NO: 50595 - DNA, 25 bp, Artificial Sequence
  Synthetic
accgtctcttucttgttcctcatut

SEQ ID NO: 50596 - DNA, 27 bp, Artificial Sequence
  Synthetic
tctgatatuccccacatctcattcuct

SEQ ID NO: 50597 - DNA, 26 bp, Artificial Sequence
  Synthetic
gcaatgacaccuatttctgttccuct

SEQ ID NO: 50598 - DNA, 21 bp, Artificial Sequence
  Synthetic
ggcaaaacaucaccccaucct

SEQ ID NO: 50599 - DNA, 23 bp, Artificial Sequence
  Synthetic
cctgtgtccutgtctctgcttuc

SEQ ID NO: 50600 - DNA, 23 bp, Artificial Sequence
  Synthetic
gtcagccauctcatcuggaaaga

SEQ ID NO: 50601 - DNA, 21 bp, Artificial Sequence
  Synthetic
gccatgacuccttcctccugt

SEQ ID NO: 50602 - DNA, 22 bp, Artificial Sequence
  Synthetic
ccugtgacctagugaagccaac

SEQ ID NO: 50603 - DNA, 21 bp, Artificial Sequence
  Synthetic
tgacccugagcctctttguct

SEQ ID NO: 50604 - DNA, 25 bp, Artificial Sequence
  Synthetic
tggcaccaauagattcatucagcaa

SEQ ID NO: 50605 - DNA, 23 bp, Artificial Sequence
  Synthetic
cttacccaucaggcaaaucacca

SEQ ID NO: 50606 - DNA, 26 bp, Artificial Sequence
  Synthetic
cccagtccucaatcaatttcttcuca

SEQ ID NO: 50607 - DNA, 28 bp, Artificial Sequence
  Synthetic
gccttcaatgtcugactaaagtactuct

SEQ ID NO: 50608 - DNA, 23 bp, Artificial Sequence
  Synthetic
aatggccacacagutgaugagat

SEQ ID NO: 50609 - DNA, 29 bp, Artificial Sequence
  Synthetic
atgtgtccagtuttcttattttgcttuca

SEQ ID NO: 50610 - DNA, 28 bp, Artificial Sequence
  Synthetic
attcagatattgugcattagaccagcut

SEQ ID NO: 50611 - DNA, 26 bp, Artificial Sequence
  Synthetic
cagccaatuaccgtcaagattacuga

SEQ ID NO: 50612 - DNA, 24 bp, Artificial Sequence
  Synthetic
gaatgacagaguggagtaccagut

SEQ ID NO: 50613 - DNA, 24 bp, Artificial Sequence
  Synthetic
cctgcaguttaatgaaatguggca

SEQ ID NO: 50614 - DNA, 24 bp, Artificial Sequence
  Synthetic
gacugaagacatugagaccaacca

SEQ ID NO: 50615 - DNA, 29 bp, Artificial Sequence
  Synthetic
gaagcagagaatugagtggtatcatgtua

SEQ ID NO: 50616 - DNA, 24 bp, Artificial Sequence
  Synthetic
tttcaaatgatugcgacaccauct

SEQ ID NO: 50617 - DNA, 25 bp, Artificial Sequence
  Synthetic
gcaagaacaatuccacctgtacuga

SEQ ID NO: 50618 - DNA, 26 bp, Artificial Sequence
  Synthetic
cagcttcatgutgacactcatttuct

SEQ ID NO: 50619 - DNA, 27 bp, Artificial Sequence
  Synthetic
ttcgttgctauagatttgtgcaaaugg

SEQ ID NO: 50620 - DNA, 23 bp, Artificial Sequence
  Synthetic
tcaattcaggcugtgtactugct

SEQ ID NO: 50621 - DNA, 26 bp, Artificial Sequence
  Synthetic
gctgaaagttuaaagatgcggaagut

SEQ ID NO: 50622 - DNA, 28 bp, Artificial Sequence
  Synthetic
cataaccttuaaagaaggcagugaggat

SEQ ID NO: 50623 - DNA, 26 bp, Artificial Sequence
  Synthetic
ttaatttttagggugcctctggugaa

SEQ ID NO: 50624 - DNA, 23 bp, Artificial Sequence
  Synthetic
agtgagggugtgaaggactauga

SEQ ID NO: 50625 - DNA, 28 bp, Artificial Sequence
  Synthetic
actcctgtttcagucatttttcttcuct

SEQ ID NO: 50626 - DNA, 28 bp, Artificial Sequence
  Synthetic
cacagtaccaaaugcttttcttttcuct

SEQ ID NO: 50627 - DNA, 24 bp, Artificial Sequence
  Synthetic
cctccugagggaaagaacaatguc

SEQ ID NO: 50628 - DNA, 25 bp, Artificial Sequence
  Synthetic
caagatgccaggutttgtttctuct

SEQ ID NO: 50629 - DNA, 25 bp, Artificial Sequence
  Synthetic
acaacgcagguaactctccaaauaa

SEQ ID NO: 50630 - DNA, 29 bp, Artificial Sequence
  Synthetic
ggtcctgtttuacttcacaagatauggaa

SEQ ID NO: 50631 - DNA, 21 bp, Artificial Sequence
  Synthetic
ctggccuggctctctacttua

SEQ ID NO: 50632 - DNA, 28 bp, Artificial Sequence
  Synthetic
cccttggttaaautcagtgccataaaug

SEQ ID NO: 50633 - DNA, 25 bp, Artificial Sequence
  Synthetic
acagttacagucctcacaactcuga

SEQ ID NO: 50634 - DNA, 23 bp, Artificial Sequence
  Synthetic
accaccaagaucctttcaagcuc

SEQ ID NO: 50635 - DNA, 24 bp, Artificial Sequence
  Synthetic
gatctgcaaugctgtcgaaaagut

SEQ ID NO: 50636 - DNA, 21 bp, Artificial Sequence
  Synthetic
ggttgtcaguccccaagctut

SEQ ID NO: 50637 - DNA, 24 bp, Artificial Sequence
  Synthetic
ggttgtutttcctatcuggacgga

SEQ ID NO: 50638 - DNA, 21 bp, Artificial Sequence
  Synthetic
ggtggaagccaauggccuaat

SEQ ID NO: 50639 - DNA, 27 bp, Artificial Sequence
  Synthetic
gtcttttgacatcucctacagagctua

SEQ ID NO: 50640 - DNA, 23 bp, Artificial Sequence
  Synthetic
tgaggcaugtaagttgcauggat

SEQ ID NO: 50641 - DNA, 26 bp, Artificial Sequence
  Synthetic
ccatgctgtttauacctgttccctut

SEQ ID NO: 50642 - DNA, 24 bp, Artificial Sequence
  Synthetic
gcagagcaaugcaacctttatuca

SEQ ID NO: 50643 - DNA, 31 bp, Artificial Sequence
  Synthetic
gactatctatttugaagaactgacaggtugt

SEQ ID NO: 50644 - DNA, 23 bp, Artificial Sequence
  Synthetic
aggctgcagugttctgtcttuag

SEQ ID NO: 50645 - DNA, 23 bp, Artificial Sequence
  Synthetic
cttattccaaacugggcucggat

SEQ ID NO: 50646 - DNA, 20 bp, Artificial Sequence
  Synthetic
catgcugcctccuaggaagt

SEQ ID NO: 50647 - DNA, 21 bp, Artificial Sequence
  Synthetic
caccatacugctccacacugt

SEQ ID NO: 50648 - DNA, 22 bp, Artificial Sequence
  Synthetic
gaugactggtcugggaagaact

SEQ ID NO: 50649 - DNA, 19 bp, Artificial Sequence
  Synthetic
gggaucttgggugcccaac

SEQ ID NO: 50650 - DNA, 28 bp, Artificial Sequence
  Synthetic
ttgcctctuatatttcaggtugaacagt

SEQ ID NO: 50651 - DNA, 23 bp, Artificial Sequence
  Synthetic
gcccaaataaaaugccacaccut

SEQ ID NO: 50652 - DNA, 26 bp, Artificial Sequence
  Synthetic
gauttgattgatuacagcacgggaaa

SEQ ID NO: 50653 - DNA, 28 bp, Artificial Sequence
  Synthetic
gcatatttctcuagtctggtaagcauca

SEQ ID NO: 50654 - DNA, 22 bp, Artificial Sequence
  Synthetic
gcctcuagcacaataugcacca

SEQ ID NO: 50655 - DNA, 24 bp, Artificial Sequence
  Synthetic
acatattucagtgcguccaacaca

SEQ ID NO: 50656 - DNA, 27 bp, Artificial Sequence
  Synthetic
gcctggccccaautcattcttataaut

SEQ ID NO: 50657 - DNA, 20 bp, Artificial Sequence
  Synthetic
tggaaccccucucagcagat

SEQ ID NO: 50658 - DNA, 28 bp, Artificial Sequence
  Synthetic
aaactatggaaucaaaccacaacaaugg

SEQ ID NO: 50659 - DNA, 27 bp, Artificial Sequence
  Synthetic
acataagaggcautacaagcttucagt

SEQ ID NO: 50660 - DNA, 24 bp, Artificial Sequence
  Synthetic
gacutctttctacugcagcagaca

SEQ ID NO: 50661 - DNA, 28 bp, Artificial Sequence
  Synthetic
tcaatcaagtgcutaaaaacagtgctuc

SEQ ID NO: 50662 - DNA, 28 bp, Artificial Sequence
  Synthetic
gaatgtatatagucctcaaacuggccat

SEQ ID NO: 50663 - DNA, 22 bp, Artificial Sequence
  Synthetic
ggcugaccaaaggcagtatugt

SEQ ID NO: 50664 - DNA, 25 bp, Artificial Sequence
  Synthetic
aguatttttgtgctauaggcaggct

SEQ ID NO: 50665 - DNA, 24 bp, Artificial Sequence
  Synthetic
gccaagtaccucactatgaaucca

SEQ ID NO: 50666 - DNA, 20 bp, Artificial Sequence
  Synthetic
ctttgcaaguggcactccuc

SEQ ID NO: 50667 - DNA, 27 bp, Artificial Sequence
  Synthetic
gcatagagcagucctggttttacuaaa

SEQ ID NO: 50668 - DNA, 26 bp, Artificial Sequence
  Synthetic
ggccatgtgcutttcaaactaatugt

SEQ ID NO: 50669 - DNA, 26 bp, Artificial Sequence
  Synthetic
gacaggaguaccaagaagugagaaat

SEQ ID NO: 50670 - DNA, 22 bp, Artificial Sequence
  Synthetic
cgatctgugagccgagtcttua

SEQ ID NO: 50671 - DNA, 28 bp, Artificial Sequence
  Synthetic
tcatctttctucacgtgtgaattcucaa

SEQ ID NO: 50672 - DNA, 19 bp, Artificial Sequence
  Synthetic
gtgaaguagagcgccguca

SEQ ID NO: 50673 - DNA, 22 bp, Artificial Sequence
  Synthetic
gttcttgctcaugtgcacctut

SEQ ID NO: 50674 - DNA, 21 bp, Artificial Sequence
  Synthetic
tgcccctuggtgctgaattua

SEQ ID NO: 50675 - DNA, 23 bp, Artificial Sequence
  Synthetic
cgaatatcagcuctgcctgtugt

SEQ ID NO: 50676 - DNA, 21 bp, Artificial Sequence
  Synthetic
ttgctatugtgcccucaccat

SEQ ID NO: 50677 - DNA, 20 bp, Artificial Sequence
  Synthetic
accgacacacuatgcuccct

SEQ ID NO: 50678 - DNA, 19 bp, Artificial Sequence
  Synthetic
gtccagcgutaaccgctuc

SEQ ID NO: 50679 - DNA, 25 bp, Artificial Sequence
  Synthetic
gcggutauggacaccaagaagaaaa

SEQ ID NO: 50680 - DNA, 22 bp, Artificial Sequence
  Synthetic
ggtugaccagaaauccccaagt

SEQ ID NO: 50681 - DNA, 28 bp, Artificial Sequence
  Synthetic
tgtagttgaaaaugctttgtcctctcuc

SEQ ID NO: 50682 - DNA, 18 bp, Artificial Sequence
  Synthetic
caggguccagcagcucac

SEQ ID NO: 50683 - DNA, 20 bp, Artificial Sequence
  Synthetic
gaaagtccaugccccaucct

SEQ ID NO: 50684 - DNA, 18 bp, Artificial Sequence
  Synthetic
gctcccuctcccctgugt

SEQ ID NO: 50685 - DNA, 19 bp, Artificial Sequence
  Synthetic
tggccuccttccttuccca

SEQ ID NO: 50686 - DNA, 32 bp, Artificial Sequence
  Synthetic
ggtcaatgtgttuctgaatttaaaattacugt

SEQ ID NO: 50687 - DNA, 25 bp, Artificial Sequence
  Synthetic
ccttcaattccuacacctgccttut

SEQ ID NO: 50688 - DNA, 21 bp, Artificial Sequence
  Synthetic
gacatctccucgggctuacag

SEQ ID NO: 50689 - DNA, 20 bp, Artificial Sequence
  Synthetic
gaggcggagaagcucuaaca

SEQ ID NO: 50690 - DNA, 21 bp, Artificial Sequence
  Synthetic
gagaggccutgggactgauac

SEQ ID NO: 50691 - DNA, 26 bp, Artificial Sequence
  Synthetic
ccaagtaaatgaguctcaacgtgtuc

SEQ ID NO: 50692 - DNA, 26 bp, Artificial Sequence
  Synthetic
tttgtacccagugacttaaaaggugt

SEQ ID NO: 50693 - DNA, 26 bp, Artificial Sequence
  Synthetic
cctcacagattutaatggctccaaug

SEQ ID NO: 50694 - DNA, 21 bp, Artificial Sequence
  Synthetic
gttgcucagcagccttaaugg

SEQ ID NO: 50695 - DNA, 21 bp, Artificial Sequence
  Synthetic
ccctgctutgccttaaaucgt

SEQ ID NO: 50696 - DNA, 22 bp, Artificial Sequence
  Synthetic
gcctccttgutcacactgaugt

SEQ ID NO: 50697 - DNA, 28 bp, Artificial Sequence
  Synthetic
gaggaaaacaaaccuatcagaaucaggt

SEQ ID NO: 50698 - DNA, 24 bp, Artificial Sequence
  Synthetic
attctaggtttgucagctcctgug

SEQ ID NO: 50699 - DNA, 21 bp, Artificial Sequence
  Synthetic
ctctccagguccaccctcuaa

SEQ ID NO: 50700 - DNA, 29 bp, Artificial Sequence
  Synthetic
ttcctcttagcautgttgaattcuacaca

SEQ ID NO: 50701 - DNA, 23 bp, Artificial Sequence
  Synthetic
acuccatccguagccaagaagat

SEQ ID NO: 50702 - DNA, 20 bp, Artificial Sequence
  Synthetic
acaacgtccuccccgttaug

SEQ ID NO: 50703 - DNA, 28 bp, Artificial Sequence
  Synthetic
ccaactttgatgtutctattcccctcut

SEQ ID NO: 50704 - DNA, 20 bp, Artificial Sequence
  Synthetic
cctcgauggccgctagaaug

SEQ ID NO: 50705 - DNA, 24 bp, Artificial Sequence
  Synthetic
ccutgggatcaatuggaaaacgag

SEQ ID NO: 50706 - DNA, 24 bp, Artificial Sequence
  Synthetic
gtaagaagatgtucctagggccut

SEQ ID NO: 50707 - DNA, 27 bp, Artificial Sequence
  Synthetic
ggaatccaatcugcaagtatgtcagut

SEQ ID NO: 50708 - DNA, 22 bp, Artificial Sequence
  Synthetic
caattgcctugatggctcagut

SEQ ID NO: 50709 - DNA, 26 bp, Artificial Sequence
  Synthetic
caatagaagcugaatttggtgtgcug

SEQ ID NO: 50710 - DNA, 29 bp, Artificial Sequence
  Synthetic
tgttcacctatautactccatcactucca

SEQ ID NO: 50711 - DNA, 28 bp, Artificial Sequence
  Synthetic
tggttctttgtugcatttgtgttuaact

SEQ ID NO: 50712 - DNA, 21 bp, Artificial Sequence
  Synthetic
tgggagagcaggcutagacut

SEQ ID NO: 50713 - DNA, 22 bp, Artificial Sequence
  Synthetic
cacagcutgagcuggaagaaga

SEQ ID NO: 50714 - DNA, 21 bp, Artificial Sequence
  Synthetic
atgaccctcucaaccctcugt

SEQ ID NO: 50715 - DNA, 22 bp, Artificial Sequence
  Synthetic
gggauaugacccagaaggaggt

SEQ ID NO: 50716 - DNA, 23 bp, Artificial Sequence
  Synthetic
cctaatccccuagagtggtguct

SEQ ID NO: 50717 - DNA, 28 bp, Artificial Sequence
  Synthetic
cacaatgtcacauttcggaagtcttuaa

SEQ ID NO: 50718 - DNA, 25 bp, Artificial Sequence
  Synthetic
aaatggtcacugtggtaagaucagg

SEQ ID NO: 50719 - DNA, 24 bp, Artificial Sequence
  Synthetic
ccctggtgcuttacgcagaauaaa

SEQ ID NO: 50720 - DNA, 22 bp, Artificial Sequence
  Synthetic
agatggctgugtgcatgctuat

SEQ ID NO: 50721 - DNA, 27 bp, Artificial Sequence
  Synthetic
agctctaacagacuttgtgtgtttcut

SEQ ID NO: 50722 - DNA, 24 bp, Artificial Sequence
  Synthetic
tgggtcacucattagtgcctauca

SEQ ID NO: 50723 - DNA, 25 bp, Artificial Sequence
  Synthetic
cctctccaaacutctccaaaucgac

SEQ ID NO: 50724 - DNA, 28 bp, Artificial Sequence
  Synthetic
ttggtaaagaagaauggaacttgctgua

SEQ ID NO: 50725 - DNA, 27 bp, Artificial Sequence
  Synthetic
gcaagtttaagcugagtttcagcaaug

SEQ ID NO: 50726 - DNA, 27 bp, Artificial Sequence
  Synthetic
atcaaatctuactgacagctuacacat

SEQ ID NO: 50727 - DNA, 28 bp, Artificial Sequence
  Synthetic
gtcacttccagaaauttggactctuact

SEQ ID NO: 50728 - DNA, 27 bp, Artificial Sequence
  Synthetic
ccucatttcacattuaaagcagcacat

SEQ ID NO: 50729 - DNA, 26 bp, Artificial Sequence
  Synthetic
gatgaccauagaccacaagttaccug

SEQ ID NO: 50730 - DNA, 23 bp, Artificial Sequence
  Synthetic
ctgtctaacuggagcaggaacuc

SEQ ID NO: 50731 - DNA, 24 bp, Artificial Sequence
  Synthetic
agacaggtccaugtctttcttucc

SEQ ID NO: 50732 - DNA, 21 bp, Artificial Sequence
  Synthetic
agacgctuctcccatagucgt

SEQ ID NO: 50733 - DNA, 21 bp, Artificial Sequence
  Synthetic
gggtgcucagattccatggua

SEQ ID NO: 50734 - DNA, 26 bp, Artificial Sequence
  Synthetic
ctgcttcugctttttcttctucaagt

SEQ ID NO: 50735 - DNA, 27 bp, Artificial Sequence
  Synthetic
ttcctatattcuggctggtctgtauct

SEQ ID NO: 50736 - DNA, 21 bp, Artificial Sequence
  Synthetic
gcaccucctucaaggacagaa

SEQ ID NO: 50737 - DNA, 28 bp, Artificial Sequence
  Synthetic
aggaagtgatcuaactttgctgcaaaua

SEQ ID NO: 50738 - DNA, 21 bp, Artificial Sequence
  Synthetic
gcucaggacaagtugcacagt

SEQ ID NO: 50739 - DNA, 27 bp, Artificial Sequence
  Synthetic
aagtatcatccautgcccttttctuga

SEQ ID NO: 50740 - DNA, 23 bp, Artificial Sequence
  Synthetic
cttccctttcuggctctttcucc

SEQ ID NO: 50741 - DNA, 26 bp, Artificial Sequence
  Synthetic
tgggagcaccaagauatacatugaga

SEQ ID NO: 50742 - DNA, 21 bp, Artificial Sequence
  Synthetic
cttccctcucaagggcaacuc

SEQ ID NO: 50743 - DNA, 21 bp, Artificial Sequence
  Synthetic
tgacccacccutgggatctua

SEQ ID NO: 50744 - DNA, 21 bp, Artificial Sequence
  Synthetic
gctccaggaaagcucatcuct

SEQ ID NO: 50745 - DNA, 23 bp, Artificial Sequence
  Synthetic
caaagccaugaaaaggttgguca

SEQ ID NO: 50746 - DNA, 24 bp, Artificial Sequence
  Synthetic
ctatttttccuctcctguccacct

SEQ ID NO: 50747 - DNA, 25 bp, Artificial Sequence
  Synthetic
ggacaatgggagcutggaagtuaat

SEQ ID NO: 50748 - DNA, 28 bp, Artificial Sequence
  Synthetic
aaaaattggucacagttttgtcatuggt

SEQ ID NO: 50749 - DNA, 26 bp, Artificial Sequence
  Synthetic
ggagtccaugattgacaguaagaaca

SEQ ID NO: 50750 - DNA, 23 bp, Artificial Sequence
  Synthetic
atgtgctgucatctgtuaagcca

SEQ ID NO: 50751 - DNA, 27 bp, Artificial Sequence
  Synthetic
tgccaguatttttgaaguggaagaaga

SEQ ID NO: 50752 - DNA, 28 bp, Artificial Sequence
  Synthetic
atgcacatgtaaauaacagctttgagug

SEQ ID NO: 50753 - DNA, 28 bp, Artificial Sequence
  Synthetic
cgtcaatatucaagtgatggaugcaaat

SEQ ID NO: 50754 - DNA, 19 bp, Artificial Sequence
  Synthetic
cacgtcuctgctugaccga

SEQ ID NO: 50755 - DNA, 23 bp, Artificial Sequence
  Synthetic
gctcattcucacaaagccucaca

SEQ ID NO: 50756 - DNA, 20 bp, Artificial Sequence
  Synthetic
ccaugaccgagacucaggac

SEQ ID NO: 50757 - DNA, 22 bp, Artificial Sequence
  Synthetic
tcacacaauggugaggccaaat

SEQ ID NO: 50758 - DNA, 18 bp, Artificial Sequence
  Synthetic
aaagccacccucccccua

SEQ ID NO: 50759 - DNA, 20 bp, Artificial Sequence
  Synthetic
caaccccaguccctgtcauc

SEQ ID NO: 50760 - DNA, 21 bp, Artificial Sequence
  Synthetic
cacttacaccaccugcctcut

SEQ ID NO: 50761 - DNA, 20 bp, Artificial Sequence
  Synthetic
tggcuagaggccactcaugt

SEQ ID NO: 50762 - DNA, 17 bp, Artificial Sequence
  Synthetic
ccacugcccgggctuac

SEQ ID NO: 50763 - DNA, 18 bp, Artificial Sequence
  Synthetic
ggccaagcugacgtcuca

SEQ ID NO: 50764 - DNA, 24 bp, Artificial Sequence
  Synthetic
tgtgttaccgugtttgctagtugt

SEQ ID NO: 50765 - DNA, 26 bp, Artificial Sequence
  Synthetic
gctccaacauggacaatcctuaaaaa

SEQ ID NO: 50766 - DNA, 24 bp, Artificial Sequence
  Synthetic
aaaccaaggcauagaggaagctut

SEQ ID NO: 50767 - DNA, 27 bp, Artificial Sequence
  Synthetic
gggattttgcutatttctccacuaaga

SEQ ID NO: 50768 - DNA, 23 bp, Artificial Sequence
  Synthetic
caggaagagagaugcacagaugt

SEQ ID NO: 50769 - DNA, 18 bp, Artificial Sequence
  Synthetic
ctgaccagugccctcucc

SEQ ID NO: 50770 - DNA, 21 bp, Artificial Sequence
  Synthetic
ccutgaagcagaucagccact

SEQ ID NO: 50771 - DNA, 22 bp, Artificial Sequence
  Synthetic
cacatcggtuccgagtctgaut

SEQ ID NO: 50772 - DNA, 23 bp, Artificial Sequence
  Synthetic
ctggaagauctacauccggaagg

SEQ ID NO: 50773 - DNA, 21 bp, Artificial Sequence
  Synthetic
caagccaaaugcatggugaga

SEQ ID NO: 50774 - DNA, 20 bp, Artificial Sequence
  Synthetic
cccacagacgacagugcauc

SEQ ID NO: 50775 - DNA, 23 bp, Artificial Sequence
  Synthetic
gcccagaguaacugacacagaaa

SEQ ID NO: 50776 - DNA, 19 bp, Artificial Sequence
  Synthetic
cgtcgacccugagctctuc

SEQ ID NO: 50777 - DNA, 22 bp, Artificial Sequence
  Synthetic
gctcttctcuctgggcctttua

SEQ ID NO: 50778 - DNA, 18 bp, Artificial Sequence
  Synthetic
cctgctcuggcctcacuc

SEQ ID NO: 50779 - DNA, 18 bp, Artificial Sequence
  Synthetic
ggtgcuccctgcctcuct

SEQ ID NO: 50780 - DNA, 27 bp, Artificial Sequence
  Synthetic
acactgaaaagaugcccagagaaauaa

SEQ ID NO: 50781 - DNA, 28 bp, Artificial Sequence
  Synthetic
gaaauagaacatccttuacccaagagca

SEQ ID NO: 50782 - DNA, 20 bp, Artificial Sequence
  Synthetic
gtctgcccgutcaacaucct

SEQ ID NO: 50783 - DNA, 28 bp, Artificial Sequence
  Synthetic
gacactaccattuggtttgattttggut

SEQ ID NO: 50784 - DNA, 17 bp, Artificial Sequence
  Synthetic
cgtcgcgaguccctgug

SEQ ID NO: 50785 - DNA, 26 bp, Artificial Sequence
  Synthetic
ttttcttgcuaacagagccccataut

SEQ ID NO: 50786 - DNA, 26 bp, Artificial Sequence
  Synthetic
agagaatcaugaaatcaacccuagcc

SEQ ID NO: 50787 - DNA, 28 bp, Artificial Sequence
  Synthetic
tgagatcccctuttccagtatcatttuc

SEQ ID NO: 50788 - DNA, 23 bp, Artificial Sequence
  Synthetic
gtcctgaaacaccacuggttgua

SEQ ID NO: 50789 - DNA, 26 bp, Artificial Sequence
  Synthetic
ccagagggaaacucaatugcaaaaac

SEQ ID NO: 50790 - DNA, 21 bp, Artificial Sequence
  Synthetic
cttgtgcctuctagggctcuc

SEQ ID NO: 50791 - DNA, 21 bp, Artificial Sequence
  Synthetic
gcctgtggucaagtggtucaa

SEQ ID NO: 50792 - DNA, 21 bp, Artificial Sequence
  Synthetic
ggagcaucctgattucagggt

SEQ ID NO: 50793 - DNA, 23 bp, Artificial Sequence
  Synthetic
tucagccagccaacauagaagaa

SEQ ID NO: 50794 - DNA, 22 bp, Artificial Sequence
  Synthetic
ggataugccagagauccccgaa

SEQ ID NO: 50795 - DNA, 21 bp, Artificial Sequence
  Synthetic
gcagtgauggaacccuaggaa

SEQ ID NO: 50796 - DNA, 23 bp, Artificial Sequence
  Synthetic
caggauccatgucccagacaaat

SEQ ID NO: 50797 - DNA, 20 bp, Artificial Sequence
  Synthetic
gacatcugggccaagacucc

SEQ ID NO: 50798 - DNA, 20 bp, Artificial Sequence
  Synthetic
gggtacacugacgtcctcut

SEQ ID NO: 50799 - DNA, 21 bp, Artificial Sequence
  Synthetic
gatctcccagutctcggtguc

SEQ ID NO: 50800 - DNA, 19 bp, Artificial Sequence
  Synthetic
ccagcgcaucatccagtuc

SEQ ID NO: 50801 - DNA, 20 bp, Artificial Sequence
  Synthetic
agggtgaugcatggacacuc

SEQ ID NO: 50802 - DNA, 28 bp, Artificial Sequence
  Synthetic
tgtttaacaugagggtgttttguacaga

SEQ ID NO: 50803 - DNA, 23 bp, Artificial Sequence
  Synthetic
gctgaaatuggcagctttaucca

SEQ ID NO: 50804 - DNA, 27 bp, Artificial Sequence
  Synthetic
cagctgaugtagtaatcuaagcaaggt

SEQ ID NO: 50805 - DNA, 24 bp, Artificial Sequence
  Synthetic
ggcttgtgtugaggctgatacaut

SEQ ID NO: 50806 - DNA, 26 bp, Artificial Sequence
  Synthetic
agcaagcagcugaaacaaataatgut

SEQ ID NO: 50807 - DNA, 28 bp, Artificial Sequence
  Synthetic
aaacaggaagaacaggauagaaagacug

SEQ ID NO: 50808 - DNA, 22 bp, Artificial Sequence
  Synthetic
aaaccctttugaaggccuggat

SEQ ID NO: 50809 - DNA, 28 bp, Artificial Sequence
  Synthetic
gtgcagtaucacagcactctttagauaa

SEQ ID NO: 50810 - DNA, 30 bp, Artificial Sequence
  Synthetic
ctttgacttatcucacagcaaagaaguaga

SEQ ID NO: 50811 - DNA, 28 bp, Artificial Sequence
  Synthetic
caagtttucagaaaagaagccaugacat

SEQ ID NO: 50812 - DNA, 21 bp, Artificial Sequence
  Synthetic
ttggatgaautagcccugcgt

SEQ ID NO: 50813 - DNA, 24 bp, Artificial Sequence
  Synthetic
acagggtagaauattgggcugagt

SEQ ID NO: 50814 - DNA, 27 bp, Artificial Sequence
  Synthetic
gttgaggcactutgtgatgcttataut

SEQ ID NO: 50815 - DNA, 22 bp, Artificial Sequence
  Synthetic
gggaatgcugaagccaucagat

SEQ ID NO: 50816 - DNA, 22 bp, Artificial Sequence
  Synthetic
agcagcagcuagaagaggauct

SEQ ID NO: 50817 - DNA, 21 bp, Artificial Sequence
  Synthetic
cggtcaaagutctgtgcugac

SEQ ID NO: 50818 - DNA, 20 bp, Artificial Sequence
  Synthetic
caccagatugggctgctcua

SEQ ID NO: 50819 - DNA, 25 bp, Artificial Sequence
  Synthetic
gaaaaucaccagccaguagaagaca

SEQ ID NO: 50820 - DNA, 21 bp, Artificial Sequence
  Synthetic
ccctcctuggcatctguagga

SEQ ID NO: 50821 - DNA, 26 bp, Artificial Sequence
  Synthetic
agcugatgaaguagaagacagcaaag

SEQ ID NO: 50822 - DNA, 22 bp, Artificial Sequence
  Synthetic
gtggagcugggaaaaactccua

SEQ ID NO: 50823 - DNA, 24 bp, Artificial Sequence
  Synthetic
ctgtggaaccugtacctttctuct

SEQ ID NO: 50824 - DNA, 19 bp, Artificial Sequence
  Synthetic
gctccacggucaccuacca

SEQ ID NO: 50825 - DNA, 19 bp, Artificial Sequence
  Synthetic
tcgttgauctgcccauccc

SEQ ID NO: 50826 - DNA, 21 bp, Artificial Sequence
  Synthetic
gcagacagagacagguccaut

SEQ ID NO: 50827 - DNA, 19 bp, Artificial Sequence
  Synthetic
ctgccggaacutctucagg

SEQ ID NO: 50828 - DNA, 21 bp, Artificial Sequence
  Synthetic
ggaatgagggcugaactuggg

SEQ ID NO: 50829 - DNA, 23 bp, Artificial Sequence
  Synthetic
cttcctaucacccctcugaggat

SEQ ID NO: 50830 - DNA, 18 bp, Artificial Sequence
  Synthetic
gcagcgaccucctacuga

SEQ ID NO: 50831 - DNA, 21 bp, Artificial Sequence
  Synthetic
ggcagaagccagaugaaggug

SEQ ID NO: 50832 - DNA, 17 bp, Artificial Sequence
  Synthetic
ctgctgcugcgctucac

SEQ ID NO: 50833 - DNA, 17 bp, Artificial Sequence
  Synthetic
gaacugccgcugcaacc

SEQ ID NO: 50834 - DNA, 28 bp, Artificial Sequence
  Synthetic
catgtaccccaagaauaaaactgatgug

SEQ ID NO: 50835 - DNA, 23 bp, Artificial Sequence
  Synthetic
cccuttcuacagaggacaacaga

SEQ ID NO: 50836 - DNA, 21 bp, Artificial Sequence
  Synthetic
gcagatcttccucccctccuc

SEQ ID NO: 50837 - DNA, 22 bp, Artificial Sequence
  Synthetic
gggtgtauccaccaaatgugaa

SEQ ID NO: 50838 - DNA, 22 bp, Artificial Sequence
  Synthetic
ccctcagcugtgagtgtatuga

SEQ ID NO: 50839 - DNA, 25 bp, Artificial Sequence
  Synthetic
caaaccctgtaugtccttgtgacua

SEQ ID NO: 50840 - DNA, 19 bp, Artificial Sequence
  Synthetic
cgccgtcugcatcgtacuc

SEQ ID NO: 50841 - DNA, 18 bp, Artificial Sequence
  Synthetic
aggtugggtgcugaagcc

SEQ ID NO: 50842 - DNA, 20 bp, Artificial Sequence
  Synthetic
ggcutgggcaugaaggaaac

SEQ ID NO: 50843 - DNA, 20 bp, Artificial Sequence
  Synthetic
ggccuttccttcugcaggac

SEQ ID NO: 50844 - DNA, 20 bp, Artificial Sequence
  Synthetic
gcggtcucagttcctgtguc

SEQ ID NO: 50845 - DNA, 24 bp, Artificial Sequence
  Synthetic
atgttgcuaaaggccatctctuct

SEQ ID NO: 50846 - DNA, 21 bp, Artificial Sequence
  Synthetic
tctttccacccutgccaugag

SEQ ID NO: 50847 - DNA, 26 bp, Artificial Sequence
  Synthetic
ggtagagtaacacuggcttctgatug

SEQ ID NO: 50848 - DNA, 23 bp, Artificial Sequence
  Synthetic
aagagctugaagaagtccacgut

SEQ ID NO: 50849 - DNA, 25 bp, Artificial Sequence
  Synthetic
cagtttctagugttgcctcttcucc

SEQ ID NO: 50850 - DNA, 24 bp, Artificial Sequence
  Synthetic
gaccaaucaggccaatuaaaccag

SEQ ID NO: 50851 - DNA, 26 bp, Artificial Sequence
  Synthetic
tccagttaggugatgagaaggagaut

SEQ ID NO: 50852 - DNA, 24 bp, Artificial Sequence
  Synthetic
tgtaccttugcaccttctttucct

SEQ ID NO: 50853 - DNA, 28 bp, Artificial Sequence
  Synthetic
tgtttttgagtutgtgttatcttugcca

SEQ ID NO: 50854 - DNA, 19 bp, Artificial Sequence
  Synthetic
cgcacacaucagucaccga

SEQ ID NO: 50855 - DNA, 24 bp, Artificial Sequence
  Synthetic
caaacguacagcagtctctctuct

SEQ ID NO: 50856 - DNA, 28 bp, Artificial Sequence
  Synthetic
tgtacacatgccutgttagtttctucat

SEQ ID NO: 50857 - DNA, 22 bp, Artificial Sequence
  Synthetic
ctgcutcaactgtugcagcaaa

SEQ ID NO: 50858 - DNA, 21 bp, Artificial Sequence
  Synthetic
gctgttgcuggcagttacugt

SEQ ID NO: 50859 - DNA, 26 bp, Artificial Sequence
  Synthetic
ccaaatggccagaucagaagttauga

SEQ ID NO: 50860 - DNA, 27 bp, Artificial Sequence
  Synthetic
tctgatcaattucccttctctctttuc

SEQ ID NO: 50861 - DNA, 23 bp, Artificial Sequence
  Synthetic
gaatgtgccugggtcgtttatuc

SEQ ID NO: 50862 - DNA, 21 bp, Artificial Sequence
  Synthetic
gtgcatgcutggactcugaag

SEQ ID NO: 50863 - DNA, 27 bp, Artificial Sequence
  Synthetic
tcacatcaagagugcttgctttctuaa

SEQ ID NO: 50864 - DNA, 27 bp, Artificial Sequence
  Synthetic
ctgtcctcactauaggctttcagaaug

SEQ ID NO: 50865 - DNA, 28 bp, Artificial Sequence
  Synthetic
agaactgccattutccctattttctcut

SEQ ID NO: 50866 - DNA, 22 bp, Artificial Sequence
  Synthetic
cactctgctcutttccctggua

SEQ ID NO: 50867 - DNA, 27 bp, Artificial Sequence
  Synthetic
ccctttatgcgauactaatccctuact

SEQ ID NO: 50868 - DNA, 25 bp, Artificial Sequence
  Synthetic
ccagctgttauacacgttgattugt

SEQ ID NO: 50869 - DNA, 28 bp, Artificial Sequence
  Synthetic
gcctatttcuttgactttaauggcacat

SEQ ID NO: 50870 - DNA, 21 bp, Artificial Sequence
  Synthetic
gcttcaggautcaaccgugac

SEQ ID NO: 50871 - DNA, 24 bp, Artificial Sequence
  Synthetic
gtccttacaguctccctctugact

SEQ ID NO: 50872 - DNA, 26 bp, Artificial Sequence
  Synthetic
gggacctaugaaagcttataccuaca

SEQ ID NO: 50873 - DNA, 22 bp, Artificial Sequence
  Synthetic
gcugcaucacaccagacaagaa

SEQ ID NO: 50874 - DNA, 24 bp, Artificial Sequence
  Synthetic
tttgatugacaggcatctctugga

SEQ ID NO: 50875 - DNA, 20 bp, Artificial Sequence
  Synthetic
cattagggacguccgcucat

SEQ ID NO: 50876 - DNA, 28 bp, Artificial Sequence
  Synthetic
gtgcattggttugtcactacttatucaa

SEQ ID NO: 50877 - DNA, 26 bp, Artificial Sequence
  Synthetic
gttgtccattaautcggaacgagaug

SEQ ID NO: 50878 - DNA, 27 bp, Artificial Sequence
  Synthetic
acacacaautttaccttcuaagaggct

SEQ ID NO: 50879 - DNA, 25 bp, Artificial Sequence
  Synthetic
actgggctatuagcaatgggacuat

SEQ ID NO: 50880 - DNA, 28 bp, Artificial Sequence
  Synthetic
cttttattcttcautgctgtcctucaca

SEQ ID NO: 50881 - DNA, 22 bp, Artificial Sequence
  Synthetic
gtctcauaggaacccucccaac

SEQ ID NO: 50882 - DNA, 26 bp, Artificial Sequence
  Synthetic
cttcatcagugcctttggttaaacut

SEQ ID NO: 50883 - DNA, 28 bp, Artificial Sequence
  Synthetic
caatttccagcuaagacttttcaaggua

SEQ ID NO: 50884 - DNA, 28 bp, Artificial Sequence
  Synthetic
tggcatttgacutaactacaagtucaca

SEQ ID NO: 50885 - DNA, 23 bp, Artificial Sequence
  Synthetic
ccaguaccacagatgttugcagt

SEQ ID NO: 50886 - DNA, 27 bp, Artificial Sequence
  Synthetic
ggaagtgggatautcctggacataaut

SEQ ID NO: 50887 - DNA, 28 bp, Artificial Sequence
  Synthetic
caacaaauccctagaaauagaaccacga

SEQ ID NO: 50888 - DNA, 21 bp, Artificial Sequence
  Synthetic
gtgccatgucggagaacauct

SEQ ID NO: 50889 - DNA, 22 bp, Artificial Sequence
  Synthetic
gggagagggaaucacauccaaa

SEQ ID NO: 50890 - DNA, 33 bp, Artificial Sequence
  Synthetic
atcatttgcatgtautgatacaaatacaaaugg

SEQ ID NO: 50891 - DNA, 26 bp, Artificial Sequence
  Synthetic
ttctcaatcgcutttcagctgauact

SEQ ID NO: 50892 - DNA, 26 bp, Artificial Sequence
  Synthetic
tggcttautattcctcauggagacac

SEQ ID NO: 50893 - DNA, 28 bp, Artificial Sequence
  Synthetic
gctccttgcaugatagtacaatgttuac

SEQ ID NO: 50894 - DNA, 28 bp, Artificial Sequence
  Synthetic
gtaataaaggccautacccaauacagga

SEQ ID NO: 50895 - DNA, 26 bp, Artificial Sequence
  Synthetic
tactcctucaactcaaaacuccagaa

SEQ ID NO: 50896 - DNA, 26 bp, Artificial Sequence
  Synthetic
gacataagaactucctgcaagagcua

SEQ ID NO: 50897 - DNA, 25 bp, Artificial Sequence
  Synthetic
tgtgcatguctgtgaaauagcagaa

SEQ ID NO: 50898 - DNA, 26 bp, Artificial Sequence
  Synthetic
ctgaagaagtugatagtcaggcugaa

SEQ ID NO: 50899 - DNA, 22 bp, Artificial Sequence
  Synthetic
ttaagaguccgggttugagcag

SEQ ID NO: 50900 - DNA, 26 bp, Artificial Sequence
  Synthetic
gcaactgacugaatttgtugagaaca

SEQ ID NO: 50901 - DNA, 28 bp, Artificial Sequence
  Synthetic
atttaaatgcuacttacaaggaaucgct

SEQ ID NO: 50902 - DNA, 23 bp, Artificial Sequence
  Synthetic
cttgtaaguggaggtggcaugaa

SEQ ID NO: 50903 - DNA, 28 bp, Artificial Sequence
  Synthetic
cctggaaaactucctttgatgaagaaug

SEQ ID NO: 50904 - DNA, 27 bp, Artificial Sequence
  Synthetic
cacctgaatgutttggagttaaugcag

SEQ ID NO: 50905 - DNA, 28 bp, Artificial Sequence
  Synthetic
aaatgcttcagtuttcaagtgtcttaug

SEQ ID NO: 50906 - DNA, 21 bp, Artificial Sequence
  Synthetic
gcccccautactgagugagga

SEQ ID NO: 50907 - DNA, 22 bp, Artificial Sequence
  Synthetic
ggccttttgccucttccttcua

SEQ ID NO: 50908 - DNA, 22 bp, Artificial Sequence
  Synthetic
gggaaggcggcutttacugaat

SEQ ID NO: 50909 - DNA, 23 bp, Artificial Sequence
  Synthetic
attcttcuctgagccugagacct

SEQ ID NO: 50910 - DNA, 20 bp, Artificial Sequence
  Synthetic
ggaacggacucagaggagug

SEQ ID NO: 50911 - DNA, 21 bp, Artificial Sequence
  Synthetic
caaacctccugagggctugag

SEQ ID NO: 50912 - DNA, 27 bp, Artificial Sequence
  Synthetic
acagactggatuaacatagcattgcut

SEQ ID NO: 50913 - DNA, 29 bp, Artificial Sequence
  Synthetic
tgtttgatctaaugagtgtttgagugaca

SEQ ID NO: 50914 - DNA, 28 bp, Artificial Sequence
  Synthetic
tcagtaaatgcugaggtagatggtttuc

SEQ ID NO: 50915 - DNA, 28 bp, Artificial Sequence
  Synthetic
tggctcttagaaaguttgatgcactuat

SEQ ID NO: 50916 - DNA, 27 bp, Artificial Sequence
  Synthetic
agcatgtcgaautattggattgucact

SEQ ID NO: 50917 - DNA, 27 bp, Artificial Sequence
  Synthetic
gaaaacagaggaaaaaugcccagtuaa

SEQ ID NO: 50918 - DNA, 28 bp, Artificial Sequence
  Synthetic
ggtgacttcagutaataccaaaccaaug

SEQ ID NO: 50919 - DNA, 28 bp, Artificial Sequence
  Synthetic
aaaagaactgaccauaagtcctgcauat

SEQ ID NO: 50920 - DNA, 28 bp, Artificial Sequence
  Synthetic
ctcttgagaggaaaucaaaatgctuacc

SEQ ID NO: 50921 - DNA, 22 bp, Artificial Sequence
  Synthetic
agcaaaccgucttggtuacagt

SEQ ID NO: 50922 - DNA, 25 bp, Artificial Sequence
  Synthetic
agtgaacaaguacattgcuccaagt

SEQ ID NO: 50923 - DNA, 22 bp, Artificial Sequence
  Synthetic
gtactcaggacgutgccttcuc

SEQ ID NO: 50924 - DNA, 21 bp, Artificial Sequence
  Synthetic
ccctgaugctgaactgaucgt

SEQ ID NO: 50925 - DNA, 21 bp, Artificial Sequence
  Synthetic
acaacagcgcauttccccuat

SEQ ID NO: 50926 - DNA, 24 bp, Artificial Sequence
  Synthetic
gctgaagugaaagctacucaccaa

SEQ ID NO: 50927 - DNA, 27 bp, Artificial Sequence
  Synthetic
tccacttcucacacttcagattucaac

SEQ ID NO: 50928 - DNA, 29 bp, Artificial Sequence
  Synthetic
atcctgactaaacaugatctaagcaaugt

SEQ ID NO: 50929 - DNA, 29 bp, Artificial Sequence
  Synthetic
ggaatctatgcaaauatgaggatggtuca

SEQ ID NO: 50930 - DNA, 20 bp, Artificial Sequence
  Synthetic
cctggaggaggugcaccaua

SEQ ID NO: 50931 - DNA, 22 bp, Artificial Sequence
  Synthetic
agugggtagguaaaagcaagcc

SEQ ID NO: 50932 - DNA, 22 bp, Artificial Sequence
  Synthetic
cgaccttgagugcagatgugaa

SEQ ID NO: 50933 - DNA, 24 bp, Artificial Sequence
  Synthetic
ccaaggactcuatcccctcaucag

SEQ ID NO: 50934 - DNA, 22 bp, Artificial Sequence
  Synthetic
cacactcaccuttcctctuggt

SEQ ID NO: 50935 - DNA, 21 bp, Artificial Sequence
  Synthetic
tcgagctcuctccacctcauc

SEQ ID NO: 50936 - DNA, 31 bp, Artificial Sequence
  Synthetic
gtcataatgtttttcutttcaggacatguga

SEQ ID NO: 50937 - DNA, 27 bp, Artificial Sequence
  Synthetic
agcctgctauaatcgatcaaacuaacc

SEQ ID NO: 50938 - DNA, 24 bp, Artificial Sequence
  Synthetic
ttgagggaaugtagagacaagugg

SEQ ID NO: 50939 - DNA, 25 bp, Artificial Sequence
  Synthetic
tctgaaggtugatcacttgcugaat

SEQ ID NO: 50940 - DNA, 22 bp, Artificial Sequence
  Synthetic
gagaagggucatggagggaaug

SEQ ID NO: 50941 - DNA, 26 bp, Artificial Sequence
  Synthetic
cggcattgtaaucgcaatgattgtut

SEQ ID NO: 50942 - DNA, 23 bp, Artificial Sequence
  Synthetic
aaagccgguaagtatgugggaaa

SEQ ID NO: 50943 - DNA, 28 bp, Artificial Sequence
  Synthetic
agggtaaaaacaccuagctatgatccua

SEQ ID NO: 50944 - DNA, 28 bp, Artificial Sequence
  Synthetic
acttgtctactcugctttcatcacuaga

SEQ ID NO: 50945 - DNA, 28 bp, Artificial Sequence
  Synthetic
ctgtttgatccaacacuctctttctcut

SEQ ID NO: 50946 - DNA, 18 bp, Artificial Sequence
  Synthetic
ggactggucgagggugac

SEQ ID NO: 50947 - DNA, 18 bp, Artificial Sequence
  Synthetic
tcgggccccutgtaguga

SEQ ID NO: 50948 - DNA, 23 bp, Artificial Sequence
  Synthetic
aaaacaggagauggcaggaauga

SEQ ID NO: 50949 - DNA, 22 bp, Artificial Sequence
  Synthetic
agttccctcacuctgtcccaut

SEQ ID NO: 50950 - DNA, 21 bp, Artificial Sequence
  Synthetic
cggagagacacuggtcuggat

SEQ ID NO: 50951 - DNA, 22 bp, Artificial Sequence
  Synthetic
gctcaatgcutttcctgctcug

SEQ ID NO: 50952 - DNA, 23 bp, Artificial Sequence
  Synthetic
agaggaagggaagugggaaaaug

SEQ ID NO: 50953 - DNA, 17 bp, Artificial Sequence
  Synthetic
aaccugcagcgggugaa

SEQ ID NO: 50954 - DNA, 20 bp, Artificial Sequence
  Synthetic
cgggaaaccucctctugaga

SEQ ID NO: 50955 - DNA, 21 bp, Artificial Sequence
  Synthetic
cuccctagtcauggccaacac

SEQ ID NO: 50956 - DNA, 21 bp, Artificial Sequence
  Synthetic
catcaccuggtcctcctucac

SEQ ID NO: 50957 - DNA, 21 bp, Artificial Sequence
  Synthetic
gagcactautgccctgucact

SEQ ID NO: 50958 - DNA, 24 bp, Artificial Sequence
  Synthetic
ggtgatcuccattaacacugacct

SEQ ID NO: 50959 - DNA, 24 bp, Artificial Sequence
  Synthetic
tggaaagcaaagauctgtgtcuca

SEQ ID NO: 50960 - DNA, 26 bp, Artificial Sequence
  Synthetic
gtttcagtctgauttctcctccacut

SEQ ID NO: 50961 - DNA, 29 bp, Artificial Sequence
  Synthetic
aaccaattatggauagaagtcaggtccua

SEQ ID NO: 50962 - DNA, 23 bp, Artificial Sequence
  Synthetic
gggacagcugagacuaaaaacat

SEQ ID NO: 50963 - DNA, 25 bp, Artificial Sequence
  Synthetic
gccaccaacagautattctucacag

SEQ ID NO: 50964 - DNA, 28 bp, Artificial Sequence
  Synthetic
gactgtucgagcgacatauaaaacaaaa

SEQ ID NO: 50965 - DNA, 21 bp, Artificial Sequence
  Synthetic
cuttcacttcucccaccacca

SEQ ID NO: 50966 - DNA, 27 bp, Artificial Sequence
  Synthetic
tctgatacacacuaactgttgcttugg

SEQ ID NO: 50967 - DNA, 22 bp, Artificial Sequence
  Synthetic
gtggcatcaaugtcctctucct

SEQ ID NO: 50968 - DNA, 27 bp, Artificial Sequence
  Synthetic
agatgtaggcuttcttcatucaccaaa

SEQ ID NO: 50969 - DNA, 28 bp, Artificial Sequence
  Synthetic
gccatctggtugctaattttagctgaua

SEQ ID NO: 50970 - DNA, 21 bp, Artificial Sequence
  Synthetic
aagtgacagcguttgcccuaa

SEQ ID NO: 50971 - DNA, 28 bp, Artificial Sequence
  Synthetic
cagatctccaacuttgtgaaatgguaga

SEQ ID NO: 50972 - DNA, 21 bp, Artificial Sequence
  Synthetic
gaggacgaugaccctgaugac

SEQ ID NO: 50973 - DNA, 22 bp, Artificial Sequence
  Synthetic
gtcctcccugggaaagtatgut

SEQ ID NO: 50974 - DNA, 21 bp, Artificial Sequence
  Synthetic
ttcctguacaacgccuccaag

SEQ ID NO: 50975 - DNA, 22 bp, Artificial Sequence
  Synthetic
tgggccaugtgagctttuagaa

SEQ ID NO: 50976 - DNA, 23 bp, Artificial Sequence
  Synthetic
cctcagctgugcaattcaaccua

SEQ ID NO: 50977 - DNA, 22 bp, Artificial Sequence
  Synthetic
ctgtgagauctgcccttuccag

SEQ ID NO: 50978 - DNA, 23 bp, Artificial Sequence
  Synthetic
ttagtccaaautgccacatguga

SEQ ID NO: 50979 - DNA, 26 bp, Artificial Sequence
  Synthetic
ctgaatgaagauacacgagtgtguga

SEQ ID NO: 50980 - DNA, 20 bp, Artificial Sequence
  Synthetic
gcggagaugagcttgagguc

SEQ ID NO: 50981 - DNA, 21 bp, Artificial Sequence
  Synthetic
ggcttccccugtaggcttuac

SEQ ID NO: 50982 - DNA, 18 bp, Artificial Sequence
  Synthetic
aggaagugcuccgggagt

SEQ ID NO: 50983 - DNA, 18 bp, Artificial Sequence
  Synthetic
cggcucccacaccaucag

SEQ ID NO: 50984 - DNA, 19 bp, Artificial Sequence
  Synthetic
gtggtgggugagggctaug

SEQ ID NO: 50985 - DNA, 17 bp, Artificial Sequence
  Synthetic
cctcaacuccggcguct

SEQ ID NO: 50986 - DNA, 19 bp, Artificial Sequence
  Synthetic
guggatugggacacgggaa

SEQ ID NO: 50987 - DNA, 24 bp, Artificial Sequence
  Synthetic
gagcaguacatgtccttucacaag

SEQ ID NO: 50988 - DNA, 17 bp, Artificial Sequence
  Synthetic
cggctcugcccaggtua

SEQ ID NO: 50989 - DNA, 18 bp, Artificial Sequence
  Synthetic
cgtgatccuctgcccuga

SEQ ID NO: 50990 - DNA, 21 bp, Artificial Sequence
  Synthetic
cttgtctgccucagggaucag

SEQ ID NO: 50991 - DNA, 20 bp, Artificial Sequence
  Synthetic
gcagtcctucagctcgauga

SEQ ID NO: 50992 - DNA, 20 bp, Artificial Sequence
  Synthetic
cacctggucgaagctaguga

SEQ ID NO: 50993 - DNA, 17 bp, Artificial Sequence
  Synthetic
ctgttcgccgugcacut

SEQ ID NO: 50994 - DNA, 21 bp, Artificial Sequence
  Synthetic
cgctaaaggcugctctcucaa

SEQ ID NO: 50995 - DNA, 20 bp, Artificial Sequence
  Synthetic
gctggagcgugtgactgaug

SEQ ID NO: 50996 - DNA, 27 bp, Artificial Sequence
  Synthetic
tttaggctguttatctatgtugcccaa

SEQ ID NO: 50997 - DNA, 28 bp, Artificial Sequence
  Synthetic
cagccatucaccaaagatattucagaaa

SEQ ID NO: 50998 - DNA, 27 bp, Artificial Sequence
  Synthetic
tccgatgauagttcgctaugaaaaagg

SEQ ID NO: 50999 - DNA, 25 bp, Artificial Sequence
  Synthetic
caacaaaatgcucaaagccgaaaug

SEQ ID NO: 51000 - DNA, 21 bp, Artificial Sequence
  Synthetic
ctcctgcugaagcctgttcut

SEQ ID NO: 51001 - DNA, 20 bp, Artificial Sequence
  Synthetic
cctcucaccctacccuggac

SEQ ID NO: 51002 - DNA, 21 bp, Artificial Sequence
  Synthetic
ctccagcauccattccuccac

SEQ ID NO: 51003 - DNA, 20 bp, Artificial Sequence
  Synthetic
agggatccacugccctctut

SEQ ID NO: 51004 - DNA, 22 bp, Artificial Sequence
  Synthetic
cccacauacagucagacccaag

SEQ ID NO: 51005 - DNA, 22 bp, Artificial Sequence
  Synthetic
cgtggcaggautttccctttut

SEQ ID NO: 51006 - DNA, 23 bp, Artificial Sequence
  Synthetic
ctgcccattucctgattctcuct

SEQ ID NO: 51007 - DNA, 24 bp, Artificial Sequence
  Synthetic
accatccattuctaccagaagcug

SEQ ID NO: 51008 - DNA, 21 bp, Artificial Sequence
  Synthetic
aggcggcccagautcttttua

SEQ ID NO: 51009 - DNA, 23 bp, Artificial Sequence
  Synthetic
ctggcttgautgtgcttttugga

SEQ ID NO: 51010 - DNA, 23 bp, Artificial Sequence
  Synthetic
gggcucagaacttguaacagaaa

SEQ ID NO: 51011 - DNA, 28 bp, Artificial Sequence
  Synthetic
gcaacctttugtatatgttctucagcaa

SEQ ID NO: 51012 - DNA, 21 bp, Artificial Sequence
  Synthetic
ggacgaggutaguacgaagcc

SEQ ID NO: 51013 - DNA, 21 bp, Artificial Sequence
  Synthetic
gaggaggaacggugatgucat

SEQ ID NO: 51014 - DNA, 22 bp, Artificial Sequence
  Synthetic
gtgaugaggccaagtcugacaa

SEQ ID NO: 51015 - DNA, 21 bp, Artificial Sequence
  Synthetic
agactggtuttgggagcugag

SEQ ID NO: 51016 - DNA, 20 bp, Artificial Sequence
  Synthetic
ggucaacgtcatugccccat

SEQ ID NO: 51017 - DNA, 23 bp, Artificial Sequence
  Synthetic
gctgaagcccaauctatgaugct

SEQ ID NO: 51018 - DNA, 23 bp, Artificial Sequence
  Synthetic
acuttcatcatctucaccagcgt

SEQ ID NO: 51019 - DNA, 27 bp, Artificial Sequence
  Synthetic
agtatcaccaaacuctcacttcaacug

SEQ ID NO: 51020 - DNA, 24 bp, Artificial Sequence
  Synthetic
tgagtcugccagcttattugaagt

SEQ ID NO: 51021 - DNA, 22 bp, Artificial Sequence
  Synthetic
ctgacctccutgtccaggttuc

SEQ ID NO: 51022 - DNA, 20 bp, Artificial Sequence
  Synthetic
tctcaggcacccagugtcua

SEQ ID NO: 51023 - DNA, 19 bp, Artificial Sequence
  Synthetic
gccccaaccauggaggaug

SEQ ID NO: 51024 - DNA, 20 bp, Artificial Sequence
  Synthetic
cccaggutggtuggaacagt

SEQ ID NO: 51025 - DNA, 23 bp, Artificial Sequence
  Synthetic
caggcaagaaacuccaggtguaa

SEQ ID NO: 51026 - DNA, 21 bp, Artificial Sequence
  Synthetic
cctggaagcugaggaggagua

SEQ ID NO: 51027 - DNA, 19 bp, Artificial Sequence
  Synthetic
gactcggugcccactguag

SEQ ID NO: 51028 - DNA, 25 bp, Artificial Sequence
  Synthetic
ccattcacaccaugcacatatgaut

SEQ ID NO: 51029 - DNA, 24 bp, Artificial Sequence
  Synthetic
gtttgcgcacuttcatctucaact

SEQ ID NO: 51030 - DNA, 20 bp, Artificial Sequence
  Synthetic
gggcgaccugtuccaaaagt

SEQ ID NO: 51031 - DNA, 22 bp, Artificial Sequence
  Synthetic
cagaagaccuggcugaaaggag

SEQ ID NO: 51032 - DNA, 27 bp, Artificial Sequence
  Synthetic
cagtcgcatgaugaagcatgtatauct

SEQ ID NO: 51033 - DNA, 21 bp, Artificial Sequence
  Synthetic
ccccugcucaacaagaacaac

SEQ ID NO: 51034 - DNA, 22 bp, Artificial Sequence
  Synthetic
tggtggcaguaactttucccaa

SEQ ID NO: 51035 - DNA, 27 bp, Artificial Sequence
  Synthetic
cttcagctucctctaagatucaagaga

SEQ ID NO: 51036 - DNA, 19 bp, Artificial Sequence
  Synthetic
gggatuaccggcauccaag

SEQ ID NO: 51037 - DNA, 22 bp, Artificial Sequence
  Synthetic
tggcagccuttctcaaaccaut

SEQ ID NO: 51038 - DNA, 20 bp, Artificial Sequence
  Synthetic
gggaaaccuctctcgcccua

SEQ ID NO: 51039 - DNA, 23 bp, Artificial Sequence
  Synthetic
ggttttgcucactgtctgtucct

SEQ ID NO: 51040 - DNA, 22 bp, Artificial Sequence
  Synthetic
acccugcacagagagaacacua

SEQ ID NO: 51041 - DNA, 22 bp, Artificial Sequence
  Synthetic
cctaacccugagttccccttug

SEQ ID NO: 51042 - DNA, 20 bp, Artificial Sequence
  Synthetic
ccuaaggaugggaggcacga

SEQ ID NO: 51043 - DNA, 23 bp, Artificial Sequence
  Synthetic
ccaagtcccacucatacctcuct

SEQ ID NO: 51044 - DNA, 18 bp, Artificial Sequence
  Synthetic
ccaggcaaugagggugga

SEQ ID NO: 51045 - DNA, 18 bp, Artificial Sequence
  Synthetic
cugaggcuggcacaggat

SEQ ID NO: 51046 - DNA, 17 bp, Artificial Sequence
  Synthetic
cgggagaugcggcugaa

SEQ ID NO: 51047 - DNA, 17 bp, Artificial Sequence
  Synthetic
ggccccuacaggcacug

SEQ ID NO: 51048 - DNA, 20 bp, Artificial Sequence
  Synthetic
ctgguggcaatgggugagat

SEQ ID NO: 51049 - DNA, 20 bp, Artificial Sequence
  Synthetic
gtgcgtccugtgttgttcug

SEQ ID NO: 51050 - DNA, 20 bp, Artificial Sequence
  Synthetic
cagcaguacctggacgtugt

SEQ ID NO: 51051 - DNA, 21 bp, Artificial Sequence
  Synthetic
ggtcatgttcuccaccaccug

SEQ ID NO: 51052 - DNA, 25 bp, Artificial Sequence
  Synthetic
atggcatagcuaattacaacgguga

SEQ ID NO: 51053 - DNA, 28 bp, Artificial Sequence
  Synthetic
ctttguatcgtgaaagtuagggagaagt

SEQ ID NO: 51054 - DNA, 23 bp, Artificial Sequence
  Synthetic
aagctgagcautaccagtucaca

SEQ ID NO: 51055 - DNA, 25 bp, Artificial Sequence
  Synthetic
ccttactctaacugttgcctacucc

SEQ ID NO: 51056 - DNA, 25 bp, Artificial Sequence
  Synthetic
gcttcucaacggacatagugaaact

SEQ ID NO: 51057 - DNA, 21 bp, Artificial Sequence
  Synthetic
ttgcaacaacuccagaugggt

SEQ ID NO: 51058 - DNA, 29 bp, Artificial Sequence
  Synthetic
caaagatacuggagaactgaatgtuacca

SEQ ID NO: 51059 - DNA, 28 bp, Artificial Sequence
  Synthetic
cgtaacctgtuagctgaaatcaugacat

SEQ ID NO: 51060 - DNA, 18 bp, Artificial Sequence
  Synthetic
gggtgcagucaggugaag

SEQ ID NO: 51061 - DNA, 18 bp, Artificial Sequence
  Synthetic
ttgaccacgugcaggugt

SEQ ID NO: 51062 - DNA, 17 bp, Artificial Sequence
  Synthetic
gactggcugggcctcut

SEQ ID NO: 51063 - DNA, 18 bp, Artificial Sequence
  Synthetic
cgcagaugcggaaggcua

SEQ ID NO: 51064 - DNA, 18 bp, Artificial Sequence
  Synthetic
ccccuttaccgucaccca

SEQ ID NO: 51065 - DNA, 19 bp, Artificial Sequence
  Synthetic
gggacaggcaugcttugac

SEQ ID NO: 51066 - DNA, 23 bp, Artificial Sequence
  Synthetic
gggatctgugcttattctgtucc

SEQ ID NO: 51067 - DNA, 24 bp, Artificial Sequence
  Synthetic
ggcagctcagauactagggttgua

SEQ ID NO: 51068 - DNA, 19 bp, Artificial Sequence
  Synthetic
agaggaggcugacctgugt

SEQ ID NO: 51069 - DNA, 21 bp, Artificial Sequence
  Synthetic
cacccaccutcttctugagca

SEQ ID NO: 51070 - DNA, 21 bp, Artificial Sequence
  Synthetic
caccacgcaguacagcaaaug

SEQ ID NO: 51071 - DNA, 23 bp, Artificial Sequence
  Synthetic
tccagagaugcagtccaucaaag

SEQ ID NO: 51072 - DNA, 20 bp, Artificial Sequence
  Synthetic
gactgaugcaggaggcucat

SEQ ID NO: 51073 - DNA, 18 bp, Artificial Sequence
  Synthetic
gtgcagcagcugagctug

SEQ ID NO: 51074 - DNA, 24 bp, Artificial Sequence
  Synthetic
ctcataaaagccutcagcaugacc

SEQ ID NO: 51075 - DNA, 22 bp, Artificial Sequence
  Synthetic
gagggucctcagtgaucagagt

SEQ ID NO: 51076 - DNA, 21 bp, Artificial Sequence
  Synthetic
ctucacccggtttucccagaa

SEQ ID NO: 51077 - DNA, 24 bp, Artificial Sequence
  Synthetic
tgaaatcttccuctctgtcuccca

SEQ ID NO: 51078 - DNA, 21 bp, Artificial Sequence
  Synthetic
tggcuggagagtcuggagaat

SEQ ID NO: 51079 - DNA, 21 bp, Artificial Sequence
  Synthetic
catgcggucctcaaaactgug

SEQ ID NO: 51080 - DNA, 21 bp, Artificial Sequence
  Synthetic
gggaggugtatgcugagacca

SEQ ID NO: 51081 - DNA, 25 bp, Artificial Sequence
  Synthetic
ggcttctcugaacctctttactgut

SEQ ID NO: 51082 - DNA, 20 bp, Artificial Sequence
  Synthetic
agggccggauctccttcuac

SEQ ID NO: 51083 - DNA, 28 bp, Artificial Sequence
  Synthetic
tcctggaagaacacucagaaaaacuaaa

SEQ ID NO: 51084 - DNA, 20 bp, Artificial Sequence
  Synthetic
cacacttgagugccccauca

SEQ ID NO: 51085 - DNA, 21 bp, Artificial Sequence
  Synthetic
gggagggaaggagaugauccc

SEQ ID NO: 51086 - DNA, 24 bp, Artificial Sequence
  Synthetic
gccttatcaccugatgttgcauct

SEQ ID NO: 51087 - DNA, 23 bp, Artificial Sequence
  Synthetic
gggtggtccugtttatcccagua

SEQ ID NO: 51088 - DNA, 19 bp, Artificial Sequence
  Synthetic
gccugcaaagtcugcaaga

SEQ ID NO: 51089 - DNA, 22 bp, Artificial Sequence
  Synthetic
cccaaagutgcaaaacauggct

SEQ ID NO: 51090 - DNA, 23 bp, Artificial Sequence
  Synthetic
gggtgauacaggcttcttttuga

SEQ ID NO: 51091 - DNA, 24 bp, Artificial Sequence
  Synthetic
agaaggagauauacccagccacaa

SEQ ID NO: 51092 - DNA, 21 bp, Artificial Sequence
  Synthetic
gaagagacgugagaggctgut

SEQ ID NO: 51093 - DNA, 22 bp, Artificial Sequence
  Synthetic
gctcctaacgccutctcttcug

SEQ ID NO: 51094 - DNA, 20 bp, Artificial Sequence
  Synthetic
cgaacugccttgccaucgaa

SEQ ID NO: 51095 - DNA, 27 bp, Artificial Sequence
  Synthetic
caatcttacacgugtgtgggttttuaa

SEQ ID NO: 51096 - DNA, 22 bp, Artificial Sequence
  Synthetic
cacacgauagtggatgagugct

SEQ ID NO: 51097 - DNA, 25 bp, Artificial Sequence
  Synthetic
ttttacttagggcuaagaccgctut

SEQ ID NO: 51098 - DNA, 20 bp, Artificial Sequence
  Synthetic
actggtccautcccggauga

SEQ ID NO: 51099 - DNA, 24 bp, Artificial Sequence
  Synthetic
tgtgatctgaucccaagcctauct

SEQ ID NO: 51100 - DNA, 25 bp, Artificial Sequence
  Synthetic
gggtgauaaatggacacuaaaagca

SEQ ID NO: 51101 - DNA, 24 bp, Artificial Sequence
  Synthetic
gcgtgaccugtgatgactacuact

SEQ ID NO: 51102 - DNA, 19 bp, Artificial Sequence
  Synthetic
ggcctccutcccgaguagt

SEQ ID NO: 51103 - DNA, 25 bp, Artificial Sequence
  Synthetic
cacatactucaaagtgtgccucaag

SEQ ID NO: 51104 - DNA, 21 bp, Artificial Sequence
  Synthetic
catgtcauggacacccctcut

SEQ ID NO: 51105 - DNA, 22 bp, Artificial Sequence
  Synthetic
cctgactcutctctccauccac

SEQ ID NO: 51106 - DNA, 22 bp, Artificial Sequence
  Synthetic
agagagagagggauagguccca

SEQ ID NO: 51107 - DNA, 19 bp, Artificial Sequence
  Synthetic
ggccaaggaugaggcuagt

SEQ ID NO: 51108 - DNA, 25 bp, Artificial Sequence
  Synthetic
cctcttcgagacauatgccatctuc

SEQ ID NO: 51109 - DNA, 21 bp, Artificial Sequence
  Synthetic
ggtgactgcugatgtctcucc

SEQ ID NO: 51110 - DNA, 24 bp, Artificial Sequence
  Synthetic
gcaagttcttugcttgacgttcug

SEQ ID NO: 51111 - DNA, 28 bp, Artificial Sequence
  Synthetic
ctagtgggaggucaaatattctucagat

SEQ ID NO: 51112 - DNA, 24 bp, Artificial Sequence
  Synthetic
tgcaaacttcauccctacttuggt

SEQ ID NO: 51113 - DNA, 21 bp, Artificial Sequence
  Synthetic
atgatuggagccagctctucc

SEQ ID NO: 51114 - DNA, 28 bp, Artificial Sequence
  Synthetic
ggtaaatcagcugttttctttgtucaga

SEQ ID NO: 51115 - DNA, 21 bp, Artificial Sequence
  Synthetic
caaguatgggucaccagcaca

SEQ ID NO: 51116 - DNA, 19 bp, Artificial Sequence
  Synthetic
gatctgucacccgctguct

SEQ ID NO: 51117 - DNA, 18 bp, Artificial Sequence
  Synthetic
guggccatguggacagga

SEQ ID NO: 51118 - DNA, 20 bp, Artificial Sequence
  Synthetic
gggtuaccctgggugaagaa

SEQ ID NO: 51119 - DNA, 20 bp, Artificial Sequence
  Synthetic
ccaggtatgugcagtgctug

SEQ ID NO: 51120 - DNA, 22 bp, Artificial Sequence
  Synthetic
gcagtgtugggaaggugagaac

SEQ ID NO: 51121 - DNA, 24 bp, Artificial Sequence
  Synthetic
ggacacagacacagucagtcttut

SEQ ID NO: 51122 - DNA, 20 bp, Artificial Sequence
  Synthetic
cggaugaagcgggagaugat

SEQ ID NO: 51123 - DNA, 23 bp, Artificial Sequence
  Synthetic
cacccgcaaacugctttaacuac

SEQ ID NO: 51124 - DNA, 23 bp, Artificial Sequence
  Synthetic
gccauccacacaaagacaacugt

SEQ ID NO: 51125 - DNA, 28 bp, Artificial Sequence
  Synthetic
ggctttttgtuattacttctcttuggct

SEQ ID NO: 51126 - DNA, 22 bp, Artificial Sequence
  Synthetic
tgcaggttuaaatggcggauga

SEQ ID NO: 51127 - DNA, 24 bp, Artificial Sequence
  Synthetic
ccauttttgataggugcaggacca

SEQ ID NO: 51128 - DNA, 21 bp, Artificial Sequence
  Synthetic
cgcagautcaggctucccaat

SEQ ID NO: 51129 - DNA, 28 bp, Artificial Sequence
  Synthetic
gcttcatttttgtuttgcctttttggua

SEQ ID NO: 51130 - DNA, 22 bp, Artificial Sequence
  Synthetic
ccucaccaccattcuccaacaa

SEQ ID NO: 51131 - DNA, 27 bp, Artificial Sequence
  Synthetic
ccggtgtugggataatttaguccaaaa

SEQ ID NO: 51132 - DNA, 22 bp, Artificial Sequence
  Synthetic
ggatggctucaatgctcactug

SEQ ID NO: 51133 - DNA, 26 bp, Artificial Sequence
  Synthetic
aggacattcauggacaattcactgut

SEQ ID NO: 51134 - DNA, 22 bp, Artificial Sequence
  Synthetic
gtaagagctguatcctgcguca

SEQ ID NO: 51135 - DNA, 28 bp, Artificial Sequence
  Synthetic
gtggcacaaaugatcctuaaagaaaaca

SEQ ID NO: 51136 - DNA, 28 bp, Artificial Sequence
  Synthetic
caatgaatcaccauagtacatgggtcut

SEQ ID NO: 51137 - DNA, 26 bp, Artificial Sequence
  Synthetic
tcagatctgcugatagccatagcaua

SEQ ID NO: 51138 - DNA, 23 bp, Artificial Sequence
  Synthetic
accauccaacacacacacagaut

SEQ ID NO: 51139 - DNA, 24 bp, Artificial Sequence
  Synthetic
ggtatcgugaactcgtgatgucag

SEQ ID NO: 51140 - DNA, 21 bp, Artificial Sequence
  Synthetic
gaauctcacugacgaggcaga

SEQ ID NO: 51141 - DNA, 26 bp, Artificial Sequence
  Synthetic
tcttttacttccugcccctaatugac

SEQ ID NO: 51142 - DNA, 24 bp, Artificial Sequence
  Synthetic
aggtttttccugagggcatttgua

SEQ ID NO: 51143 - DNA, 20 bp, Artificial Sequence
  Synthetic
gtcacugccccacuagcaaa

SEQ ID NO: 51144 - DNA, 23 bp, Artificial Sequence
  Synthetic
tgctttcctucacccttagcuac

SEQ ID NO: 51145 - DNA, 25 bp, Artificial Sequence
  Synthetic
gggatgggucctaacatgtttcuat

SEQ ID NO: 51146 - DNA, 22 bp, Artificial Sequence
  Synthetic
cggaggagacacutgggatcut

SEQ ID NO: 51147 - DNA, 23 bp, Artificial Sequence
  Synthetic
tcatcccccuagtctcacaaucc

SEQ ID NO: 51148 - DNA, 24 bp, Artificial Sequence
  Synthetic
gaatgcgacacucctttgtttcuc

SEQ ID NO: 51149 - DNA, 20 bp, Artificial Sequence
  Synthetic
tcagctcacggugcttctuc

SEQ ID NO: 51150 - DNA, 21 bp, Artificial Sequence
  Synthetic
cccactgcccugagaatctut

SEQ ID NO: 51151 - DNA, 26 bp, Artificial Sequence
  Synthetic
gtgttggttugtttggaatctucaca

SEQ ID NO: 51152 - DNA, 24 bp, Artificial Sequence
  Synthetic
gagtgaaaguggaagtgactcuga

SEQ ID NO: 51153 - DNA, 23 bp, Artificial Sequence
  Synthetic
caacatcauagctgggcacugat

SEQ ID NO: 51154 - DNA, 27 bp, Artificial Sequence
  Synthetic
ctttagagaatagguctgccattguga

SEQ ID NO: 51155 - DNA, 22 bp, Artificial Sequence
  Synthetic
gatgagcuggagggagagttug

SEQ ID NO: 51156 - DNA, 27 bp, Artificial Sequence
  Synthetic
tgaatgaccutgcattaucagaacagt

SEQ ID NO: 51157 - DNA, 25 bp, Artificial Sequence
  Synthetic
gcaagccttcaauattggtgactut

SEQ ID NO: 51158 - DNA, 27 bp, Artificial Sequence
  Synthetic
ttgctcagttaugtttcacgtacucat

SEQ ID NO: 51159 - DNA, 24 bp, Artificial Sequence
  Synthetic
ttgcttcacttuagcaaccttgug

SEQ ID NO: 51160 - DNA, 26 bp, Artificial Sequence
  Synthetic
ggttgcaaagugtgaattttcccaut

SEQ ID NO: 51161 - DNA, 25 bp, Artificial Sequence
  Synthetic
ctaatgcaacaagucctgaauccct

SEQ ID NO: 51162 - DNA, 27 bp, Artificial Sequence
  Synthetic
ctaaggccaaguccttgatatctugaa

SEQ ID NO: 51163 - DNA, 24 bp, Artificial Sequence
  Synthetic
acacaggugaacuccagaaagaag

SEQ ID NO: 51164 - DNA, 23 bp, Artificial Sequence
  Synthetic
tcaaggtatucccggatgcaaug

SEQ ID NO: 51165 - DNA, 28 bp, Artificial Sequence
  Synthetic
aagacctgaagacacuatatcccttcut

SEQ ID NO: 51166 - DNA, 23 bp, Artificial Sequence
  Synthetic
ggaaatgctgucccttagtgcua

SEQ ID NO: 51167 - DNA, 25 bp, Artificial Sequence
  Synthetic
ctgaggcauaatttaccuggaggac

SEQ ID NO: 51168 - DNA, 22 bp, Artificial Sequence
  Synthetic
gggctttcauattggcagaugt

SEQ ID NO: 51169 - DNA, 29 bp, Artificial Sequence
  Synthetic
ccagtgtcagtgugtattagtttggtuag

SEQ ID NO: 51170 - DNA, 24 bp, Artificial Sequence
  Synthetic
gcgtactgugaaattcatcugcca

SEQ ID NO: 51171 - DNA, 25 bp, Artificial Sequence
  Synthetic
agtggtggguagagcttgttttuaa

SEQ ID NO: 51172 - DNA, 23 bp, Artificial Sequence
  Synthetic
accaccgtcauactgactctcut

SEQ ID NO: 51173 - DNA, 20 bp, Artificial Sequence
  Synthetic
ctgatccagucccccugaac

SEQ ID NO: 51174 - DNA, 28 bp, Artificial Sequence
  Synthetic
gtctttattcugagacccctttgatuct

SEQ ID NO: 51175 - DNA, 26 bp, Artificial Sequence
  Synthetic
ccaaagttguagggaaggtctacuct

SEQ ID NO: 51176 - DNA, 24 bp, Artificial Sequence
  Synthetic
ctatgtggacutgtcctttccuct

SEQ ID NO: 51177 - DNA, 28 bp, Artificial Sequence
  Synthetic
acaagctgtaagutttctggtaaucaca

SEQ ID NO: 51178 - DNA, 23 bp, Artificial Sequence
  Synthetic
agccaacccacacaguataccua

SEQ ID NO: 51179 - DNA, 24 bp, Artificial Sequence
  Synthetic
ctgaagcattutcgattccgugac

SEQ ID NO: 51180 - DNA, 20 bp, Artificial Sequence
  Synthetic
cctgtuggcaggtcatucct

SEQ ID NO: 51181 - DNA, 21 bp, Artificial Sequence
  Synthetic
caactgtccutcaacctucgg

SEQ ID NO: 51182 - DNA, 21 bp, Artificial Sequence
  Synthetic
cccacaaucccacacgaacuc

SEQ ID NO: 51183 - DNA, 21 bp, Artificial Sequence
  Synthetic
cagaggtuccagggcatcuac

SEQ ID NO: 51184 - DNA, 21 bp, Artificial Sequence
  Synthetic
cagggagaaggugaggaggua

SEQ ID NO: 51185 - DNA, 18 bp, Artificial Sequence
  Synthetic
ccgccgggaaagaugguc

SEQ ID NO: 51186 - DNA, 21 bp, Artificial Sequence
  Synthetic
ccctcucccagttaccgugaa

SEQ ID NO: 51187 - DNA, 25 bp, Artificial Sequence
  Synthetic
gttccttgtguctttctgtttgucc

SEQ ID NO: 51188 - DNA, 17 bp, Artificial Sequence
  Synthetic
ggagcgccugacctcuc

SEQ ID NO: 51189 - DNA, 19 bp, Artificial Sequence
  Synthetic
gtcccgaaucctcgcctut

SEQ ID NO: 51190 - DNA, 25 bp, Artificial Sequence
  Synthetic
gagggutttgcttcuaggagaacaa

SEQ ID NO: 51191 - DNA, 23 bp, Artificial Sequence
  Synthetic
gaacaccttucccctcattcuct

SEQ ID NO: 51192 - DNA, 28 bp, Artificial Sequence
  Synthetic
cgaatttcugccataaatgctttuacca

SEQ ID NO: 51193 - DNA, 29 bp, Artificial Sequence
  Synthetic
tcagagaactuagagcatttcacaucaaa

SEQ ID NO: 51194 - DNA, 26 bp, Artificial Sequence
  Synthetic
ttuaaggagcaaagaatcugcagagt

SEQ ID NO: 51195 - DNA, 29 bp, Artificial Sequence
  Synthetic
ggatgccttattuccagctctattctuat

SEQ ID NO: 51196 - DNA, 21 bp, Artificial Sequence
  Synthetic
aaccggutgtugaaaggcaaa

SEQ ID NO: 51197 - DNA, 32 bp, Artificial Sequence
  Synthetic
cacagtttaggutttgagataaataugacaga

SEQ ID NO: 51198 - DNA, 21 bp, Artificial Sequence
  Synthetic
tgttctgcccgutgtgtctua

SEQ ID NO: 51199 - DNA, 21 bp, Artificial Sequence
  Synthetic
ctcacagccugaagaauccca

SEQ ID NO: 51200 - DNA, 27 bp, Artificial Sequence
  Synthetic
gtaggaaaacgguggaatcaaguaaag

SEQ ID NO: 51201 - DNA, 22 bp, Artificial Sequence
  Synthetic
gttcaacugcaggcaaacauga

SEQ ID NO: 51202 - DNA, 23 bp, Artificial Sequence
  Synthetic
gggatctaacuctctgggcuagt

SEQ ID NO: 51203 - DNA, 23 bp, Artificial Sequence
  Synthetic
acacccttaucaccccauagagg

SEQ ID NO: 51204 - DNA, 21 bp, Artificial Sequence
  Synthetic
gtcttgtcutggtccctuggt

SEQ ID NO: 51205 - DNA, 20 bp, Artificial Sequence
  Synthetic
tgtcgaugagcacgtctucc

SEQ ID NO: 51206 - DNA, 26 bp, Artificial Sequence
  Synthetic
tcattttaggaaggagguctgtgcua

SEQ ID NO: 51207 - DNA, 19 bp, Artificial Sequence
  Synthetic
gccuactucacccggagac

SEQ ID NO: 51208 - DNA, 22 bp, Artificial Sequence
  Synthetic
acagcacacagggautgaacug

SEQ ID NO: 51209 - DNA, 24 bp, Artificial Sequence
  Synthetic
cttggactgtucagtgattgguct

SEQ ID NO: 51210 - DNA, 22 bp, Artificial Sequence
  Synthetic
cacacagtgaugctagcgguaa

SEQ ID NO: 51211 - DNA, 26 bp, Artificial Sequence
  Synthetic
aggtgtuaaaaatcatgacugagcca

SEQ ID NO: 51212 - DNA, 28 bp, Artificial Sequence
  Synthetic
gaggaggattcugaattagtggtgaaut

SEQ ID NO: 51213 - DNA, 28 bp, Artificial Sequence
  Synthetic
cgacatcttuggcttttgttagaaauct

SEQ ID NO: 51214 - DNA, 30 bp, Artificial Sequence
  Synthetic
tggttttagttcuttaagtgcatttgucaa

SEQ ID NO: 51215 - DNA, 25 bp, Artificial Sequence
  Synthetic
ggattgtcagutctgcgatcatuca

SEQ ID NO: 51216 - DNA, 20 bp, Artificial Sequence
  Synthetic
cggtcaccagggutcatcut

SEQ ID NO: 51217 - DNA, 24 bp, Artificial Sequence
  Synthetic
tgaagucagaccaggagtcuaaca

SEQ ID NO: 51218 - DNA, 26 bp, Artificial Sequence
  Synthetic
gatgatgacgutgacgatgaaguaga

SEQ ID NO: 51219 - DNA, 21 bp, Artificial Sequence
  Synthetic
acctgccugggattuccaaac

SEQ ID NO: 51220 - DNA, 22 bp, Artificial Sequence
  Synthetic
gccaccaucctgggtgattuaa

SEQ ID NO: 51221 - DNA, 24 bp, Artificial Sequence
  Synthetic
cgcccagaccutgttctctauaac

SEQ ID NO: 51222 - DNA, 25 bp, Artificial Sequence
  Synthetic
ggaacaacttgauggtgctacttug

SEQ ID NO: 51223 - DNA, 24 bp, Artificial Sequence
  Synthetic
ccccuctttgugaggagaagaaag

SEQ ID NO: 51224 - DNA, 22 bp, Artificial Sequence
  Synthetic
ccttatttucagggcccuccag

SEQ ID NO: 51225 - DNA, 28 bp, Artificial Sequence
  Synthetic
ttttcttcugggattctgacauaaagca

SEQ ID NO: 51226 - DNA, 25 bp, Artificial Sequence
  Synthetic
aactgacutctttactucagggcat

SEQ ID NO: 51227 - DNA, 22 bp, Artificial Sequence
  Synthetic
cacacucaaggauaggccaaca

SEQ ID NO: 51228 - DNA, 25 bp, Artificial Sequence
  Synthetic
ccctacaagaccacuggaactttut

SEQ ID NO: 51229 - DNA, 23 bp, Artificial Sequence
  Synthetic
gtaacttactggutccccaggut

SEQ ID NO: 51230 - DNA, 28 bp, Artificial Sequence
  Synthetic
cctcttcatagagutcctggtttucaaa

SEQ ID NO: 51231 - DNA, 28 bp, Artificial Sequence
  Synthetic
tctcaaatgcagcutttatacaggtuga

SEQ ID NO: 51232 - DNA, 23 bp, Artificial Sequence
  Synthetic
ggatctcctgguggcaaggtaua

SEQ ID NO: 51233 - DNA, 23 bp, Artificial Sequence
  Synthetic
tgggaacucacactttctccuct

SEQ ID NO: 51234 - DNA, 24 bp, Artificial Sequence
  Synthetic
gtgacaaaggugaaacaggugaac

SEQ ID NO: 51235 - DNA, 28 bp, Artificial Sequence
  Synthetic
agccttcaaatccauttctcatctctuc

SEQ ID NO: 51236 - DNA, 24 bp, Artificial Sequence
  Synthetic
gcacacaagcaaauggaatgtuct

SEQ ID NO: 51237 - DNA, 28 bp, Artificial Sequence
  Synthetic
acaaaggagagugattgattttctucct

SEQ ID NO: 51238 - DNA, 21 bp, Artificial Sequence
  Synthetic
cctgtggugctataggugggt

SEQ ID NO: 51239 - DNA, 23 bp, Artificial Sequence
  Synthetic
cctcttcccaauctggctgttut

SEQ ID NO: 51240 - DNA, 22 bp, Artificial Sequence
  Synthetic
tgtagagaaggcauctgccgua

SEQ ID NO: 51241 - DNA, 20 bp, Artificial Sequence
  Synthetic
augggcagagaccacguaag

SEQ ID NO: 51242 - DNA, 17 bp, Artificial Sequence
  Synthetic
gctccagcgccugagut

SEQ ID NO: 51243 - DNA, 24 bp, Artificial Sequence
  Synthetic
ctgcctcaaaguagaggttgtgut

SEQ ID NO: 51244 - DNA, 26 bp, Artificial Sequence
  Synthetic
tggattcacuatcttaagaccucgct

SEQ ID NO: 51245 - DNA, 23 bp, Artificial Sequence
  Synthetic
cagagacccacucccagatttug

SEQ ID NO: 51246 - DNA, 25 bp, Artificial Sequence
  Synthetic
ccatgttgaugaggcttatctggut

SEQ ID NO: 51247 - DNA, 25 bp, Artificial Sequence
  Synthetic
tcaacatgtacautgccatcaucct

SEQ ID NO: 51248 - DNA, 24 bp, Artificial Sequence
  Synthetic
ttggccaagaugttgattttcuca

SEQ ID NO: 51249 - DNA, 22 bp, Artificial Sequence
  Synthetic
gagcacttuccatttgcctcuc

SEQ ID NO: 51250 - DNA, 27 bp, Artificial Sequence
  Synthetic
gggtaggtgaaauaaatgagtgaguag

SEQ ID NO: 51251 - DNA, 23 bp, Artificial Sequence
  Synthetic
cttgcttgutatggtcatuggca

SEQ ID NO: 51252 - DNA, 21 bp, Artificial Sequence
  Synthetic
ccaggcauatccctcuagcct

SEQ ID NO: 51253 - DNA, 23 bp, Artificial Sequence
  Synthetic
tctcgtgtgugaatttccctugt

SEQ ID NO: 51254 - DNA, 23 bp, Artificial Sequence
  Synthetic
gcatgaaggcutccttgaacuct

SEQ ID NO: 51255 - DNA, 21 bp, Artificial Sequence
  Synthetic
tttuaagccgggcatcugagt

SEQ ID NO: 51256 - DNA, 23 bp, Artificial Sequence
  Synthetic
gaagctggaauggcatgagtuag

SEQ ID NO: 51257 - DNA, 21 bp, Artificial Sequence
  Synthetic
gtcagcaagaugccctttgug

SEQ ID NO: 51258 - DNA, 21 bp, Artificial Sequence
  Synthetic
caggtggcutctccaagacug

SEQ ID NO: 51259 - DNA, 27 bp, Artificial Sequence
  Synthetic
tttgaataacagtucctgcaacttgug

SEQ ID NO: 51260 - DNA, 20 bp, Artificial Sequence
  Synthetic
aggaaacggccagugcaaua

SEQ ID NO: 51261 - DNA, 21 bp, Artificial Sequence
  Synthetic
gcaucaagtacaugcggcaga

SEQ ID NO: 51262 - DNA, 20 bp, Artificial Sequence
  Synthetic
gtacagaggccccutctucc

SEQ ID NO: 51263 - DNA, 23 bp, Artificial Sequence
  Synthetic
agcagaagcugcaagatgtucat

SEQ ID NO: 51264 - DNA, 26 bp, Artificial Sequence
  Synthetic
gtttgcttttgutcttcctcatguct

SEQ ID NO: 51265 - DNA, 28 bp, Artificial Sequence
  Synthetic
gccaagaucaacaaagcugaaaaagaaa

SEQ ID NO: 51266 - DNA, 28 bp, Artificial Sequence
  Synthetic
ttggctaagtuacatgaagcttctugat

SEQ ID NO: 51267 - DNA, 29 bp, Artificial Sequence
  Synthetic
ctgtaacaggautttcacatucaacaagt

SEQ ID NO: 51268 - DNA, 23 bp, Artificial Sequence
  Synthetic
cgcatgttuccaagtggaactuc

SEQ ID NO: 51269 - DNA, 19 bp, Artificial Sequence
  Synthetic
gggagcacugcgtcuacac

SEQ ID NO: 51270 - DNA, 19 bp, Artificial Sequence
  Synthetic
cttttgcuggtgcacgugt

SEQ ID NO: 51271 - DNA, 18 bp, Artificial Sequence
  Synthetic
actuggagcccacgtgut

SEQ ID NO: 51272 - DNA, 23 bp, Artificial Sequence
  Synthetic
ccttcaggcugttcccgaauaag

SEQ ID NO: 51273 - DNA, 19 bp, Artificial Sequence
  Synthetic
cggtggacgucacgguaag

SEQ ID NO: 51274 - DNA, 18 bp, Artificial Sequence
  Synthetic
acacgcuggccattguct

SEQ ID NO: 51275 - DNA, 19 bp, Artificial Sequence
  Synthetic
cccatctucctgcacggut

SEQ ID NO: 51276 - DNA, 26 bp, Artificial Sequence
  Synthetic
ccctagaaaauggctatccugaaact

SEQ ID NO: 51277 - DNA, 29 bp, Artificial Sequence
  Synthetic
tgctgtcatcatuttaatgcttctacuca

SEQ ID NO: 51278 - DNA, 28 bp, Artificial Sequence
  Synthetic
ccagagagataguattcccagtctucat

SEQ ID NO: 51279 - DNA, 31 bp, Artificial Sequence
  Synthetic
ttctagttauaagttggaaaucaaccagaaa

SEQ ID NO: 51280 - DNA, 28 bp, Artificial Sequence
  Synthetic
agatatgcacuagttcaaagagaaugcc

SEQ ID NO: 51281 - DNA, 24 bp, Artificial Sequence
  Synthetic
ggcaccaagtuctacctcatgtut

SEQ ID NO: 51282 - DNA, 27 bp, Artificial Sequence
  Synthetic
ttgatgtcttcuctctcttacagcuct

SEQ ID NO: 51283 - DNA, 28 bp, Artificial Sequence
  Synthetic
aactgagcauacgctaggaaaataauga

SEQ ID NO: 51284 - DNA, 28 bp, Artificial Sequence
  Synthetic
tgcaaaaggagaauacacuaaaccaagt

SEQ ID NO: 51285 - DNA, 25 bp, Artificial Sequence
  Synthetic
tttcagaaccucaggaagcatgaut

SEQ ID NO: 51286 - DNA, 22 bp, Artificial Sequence
  Synthetic
gaagggttutactccccugcat

SEQ ID NO: 51287 - DNA, 25 bp, Artificial Sequence
  Synthetic
gctcucacattccttucagagaagt

SEQ ID NO: 51288 - DNA, 21 bp, Artificial Sequence
  Synthetic
gctaugcgaggaugcagacac

SEQ ID NO: 51289 - DNA, 28 bp, Artificial Sequence
  Synthetic
gatgactaagugggaggtttaucagaaa

SEQ ID NO: 51290 - DNA, 23 bp, Artificial Sequence
  Synthetic
agactcaacugggctagugaact

SEQ ID NO: 51291 - DNA, 24 bp, Artificial Sequence
  Synthetic
tgtgctgtttcugtgtactctgug

SEQ ID NO: 51292 - DNA, 26 bp, Artificial Sequence
  Synthetic
caaaaccucagggagtcatuagaagt

SEQ ID NO: 51293 - DNA, 21 bp, Artificial Sequence
  Synthetic
tutccagagagucacggcaag

SEQ ID NO: 51294 - DNA, 22 bp, Artificial Sequence
  Synthetic
cggatgcucaacttaacuccca

SEQ ID NO: 51295 - DNA, 24 bp, Artificial Sequence
  Synthetic
gacctggugagtgtggaaaaauct

SEQ ID NO: 51296 - DNA, 24 bp, Artificial Sequence
  Synthetic
gatgaaagtaguagtgcccuggaa

SEQ ID NO: 51297 - DNA, 21 bp, Artificial Sequence
  Synthetic
acatgcguagcacagggaauc

SEQ ID NO: 51298 - DNA, 20 bp, Artificial Sequence
  Synthetic
tgggcccauctcaggatgua

SEQ ID NO: 51299 - DNA, 23 bp, Artificial Sequence
  Synthetic
gtgcagtgcauaactcctctuga

SEQ ID NO: 51300 - DNA, 28 bp, Artificial Sequence
  Synthetic
tctttaaagtagaaaugcttgccucaga

SEQ ID NO: 51301 - DNA, 26 bp, Artificial Sequence
  Synthetic
tgctttttcaaaaccuccaaatggug

SEQ ID NO: 51302 - DNA, 19 bp, Artificial Sequence
  Synthetic
cgtacttugcgccguacct

SEQ ID NO: 51303 - DNA, 25 bp, Artificial Sequence
  Synthetic
tctccagtaguaaagacaccaccuc

SEQ ID NO: 51304 - DNA, 20 bp, Artificial Sequence
  Synthetic
gccuacggagctaacaucct

SEQ ID NO: 51305 - DNA, 22 bp, Artificial Sequence
  Synthetic
ggtgccatauctgcagtagguc

SEQ ID NO: 51306 - DNA, 21 bp, Artificial Sequence
  Synthetic
gcttcguccctgugcaaaaga

SEQ ID NO: 51307 - DNA, 22 bp, Artificial Sequence
  Synthetic
gcaccaucatcaugagcgaaaa

SEQ ID NO: 51308 - DNA, 24 bp, Artificial Sequence
  Synthetic
gctagaaaaucacacagaggccua

SEQ ID NO: 51309 - DNA, 22 bp, Artificial Sequence
  Synthetic
agatccuggtgtccugacagaa

SEQ ID NO: 51310 - DNA, 28 bp, Artificial Sequence
  Synthetic
ggtaggaagcautttaatcttggtcauc

SEQ ID NO: 51311 - DNA, 27 bp, Artificial Sequence
  Synthetic
gcaaaccctaugctataatgctttuca

SEQ ID NO: 51312 - DNA, 22 bp, Artificial Sequence
  Synthetic
cctctgccutctgattggguaa

SEQ ID NO: 51313 - DNA, 26 bp, Artificial Sequence
  Synthetic
tcataatattucagggcattguggca

SEQ ID NO: 51314 - DNA, 21 bp, Artificial Sequence
  Synthetic
ctgtgcccuccatcaucaagt

SEQ ID NO: 51315 - DNA, 28 bp, Artificial Sequence
  Synthetic
gagaacagcaguttccatgtaacattut

SEQ ID NO: 51316 - DNA, 28 bp, Artificial Sequence
  Synthetic
cttttgaatuccaacactttacctguca

SEQ ID NO: 51317 - DNA, 22 bp, Artificial Sequence
  Synthetic
ggagtuccttcactuccagcag

SEQ ID NO: 51318 - DNA, 27 bp, Artificial Sequence
  Synthetic
gcagaagaaaaugaaatuaggcaagga

SEQ ID NO: 51319 - DNA, 26 bp, Artificial Sequence
  Synthetic
acaccagaaatcauatcctcttgcug

SEQ ID NO: 51320 - DNA, 22 bp, Artificial Sequence
  Synthetic
acaaccccagacutctgtggua

SEQ ID NO: 51321 - DNA, 28 bp, Artificial Sequence
  Synthetic
gcccagatgaugaagtggtaataaugag

SEQ ID NO: 51322 - DNA, 29 bp, Artificial Sequence
  Synthetic
ctaaatgttctacccauaagcagagagua

SEQ ID NO: 51323 - DNA, 27 bp, Artificial Sequence
  Synthetic
ctggtcttatuattgagtgagcuaggt

SEQ ID NO: 51324 - DNA, 25 bp, Artificial Sequence
  Synthetic
gcttagtgtgcuaattttggctuct

SEQ ID NO: 51325 - DNA, 27 bp, Artificial Sequence
  Synthetic
tgttcgcatagcugtttcataagagut

SEQ ID NO: 51326 - DNA, 24 bp, Artificial Sequence
  Synthetic
aaaataagaccccagcucatggut

SEQ ID NO: 51327 - DNA, 28 bp, Artificial Sequence
  Synthetic
cgcatgugaactctaaattuaaagcact

SEQ ID NO: 51328 - DNA, 25 bp, Artificial Sequence
  Synthetic
cagtgctttcuggatttaagcugaa

SEQ ID NO: 51329 - DNA, 18 bp, Artificial Sequence
  Synthetic
gggtcugtgcccauagca

SEQ ID NO: 51330 - DNA, 25 bp, Artificial Sequence
  Synthetic
aaaacagacgugactatgctctugt

SEQ ID NO: 51331 - DNA, 29 bp, Artificial Sequence
  Synthetic
cctgcacttugacagatggattaagaaua

SEQ ID NO: 51332 - DNA, 23 bp, Artificial Sequence
  Synthetic
tggctgcagcutcatatgaucag

SEQ ID NO: 51333 - DNA, 28 bp, Artificial Sequence
  Synthetic
cctcaagttuacaagagggaatacugaa

SEQ ID NO: 51334 - DNA, 28 bp, Artificial Sequence
  Synthetic
ctgtttcttacuaggaatcaacccucaa

SEQ ID NO: 51335 - DNA, 22 bp, Artificial Sequence
  Synthetic
ccgguaagtaagagugccaacc

SEQ ID NO: 51336 - DNA, 21 bp, Artificial Sequence
  Synthetic
cagauagcccuggacaaacca

SEQ ID NO: 51337 - DNA, 26 bp, Artificial Sequence
  Synthetic
ctttccguggcaaaatgtaauaaagt

SEQ ID NO: 51338 - DNA, 28 bp, Artificial Sequence
  Synthetic
ctcaagaaacagtuctctcagttctcut

SEQ ID NO: 51339 - DNA, 25 bp, Artificial Sequence
  Synthetic
ccacccatattuctgggactatgut

SEQ ID NO: 51340 - DNA, 21 bp, Artificial Sequence
  Synthetic
gtggaacguaccccatucagt

SEQ ID NO: 51341 - DNA, 23 bp, Artificial Sequence
  Synthetic
actttgggtuccactggattcug

SEQ ID NO: 51342 - DNA, 23 bp, Artificial Sequence
  Synthetic
caaggtgatuaaaccccctcuga

SEQ ID NO: 51343 - DNA, 20 bp, Artificial Sequence
  Synthetic
ctcccaccacugcauaaggg

SEQ ID NO: 51344 - DNA, 26 bp, Artificial Sequence
  Synthetic
agcttctgattucatctccctttucc

SEQ ID NO: 51345 - DNA, 23 bp, Artificial Sequence
  Synthetic
ctttgaccccutgggaacaucat

SEQ ID NO: 51346 - DNA, 26 bp, Artificial Sequence
  Synthetic
ggatatatctgauacgcaggcctcua

SEQ ID NO: 51347 - DNA, 26 bp, Artificial Sequence
  Synthetic
ggguttattcttctcucgagaacact

SEQ ID NO: 51348 - DNA, 25 bp, Artificial Sequence
  Synthetic
cttcatccaaatugcgagatgctut

SEQ ID NO: 51349 - DNA, 24 bp, Artificial Sequence
  Synthetic
cagtacagcaucaagagucacact

SEQ ID NO: 51350 - DNA, 23 bp, Artificial Sequence
  Synthetic
cctgctgctuttcatcgtgaaug

SEQ ID NO: 51351 - DNA, 28 bp, Artificial Sequence
  Synthetic
agaggatgguaaaagagatgagtgcuat

SEQ ID NO: 51352 - DNA, 24 bp, Artificial Sequence
  Synthetic
tccacccagagautttgaagugac

SEQ ID NO: 51353 - DNA, 27 bp, Artificial Sequence
  Synthetic
agagccagctautccatttctcttcua

SEQ ID NO: 51354 - DNA, 20 bp, Artificial Sequence
  Synthetic
cacagtctugctggtcugct

SEQ ID NO: 51355 - DNA, 25 bp, Artificial Sequence
  Synthetic
gcagcttgttugttcatgtgacaut

SEQ ID NO: 51356 - DNA, 21 bp, Artificial Sequence
  Synthetic
ggcgccuctctttgtcttugt

SEQ ID NO: 51357 - DNA, 28 bp, Artificial Sequence
  Synthetic
cgatcctucggtagatatttugaagact

SEQ ID NO: 51358 - DNA, 21 bp, Artificial Sequence
  Synthetic
gctttcaugcaggctcaccua

SEQ ID NO: 51359 - DNA, 25 bp, Artificial Sequence
  Synthetic
atcaatgcacutggtgatcugaaga

SEQ ID NO: 51360 - DNA, 20 bp, Artificial Sequence
  Synthetic
aggcgtaagcuggaggatuc

SEQ ID NO: 51361 - DNA, 22 bp, Artificial Sequence
  Synthetic
tcatagagcugcattgctguca

SEQ ID NO: 51362 - DNA, 23 bp, Artificial Sequence
  Synthetic
cccttttuaacagagccgttcut

SEQ ID NO: 51363 - DNA, 25 bp, Artificial Sequence
  Synthetic
atttgttccctuccttcttcctcuc

SEQ ID NO: 51364 - DNA, 23 bp, Artificial Sequence
  Synthetic
ctguaccaggaaggagucaaagg

SEQ ID NO: 51365 - DNA, 21 bp, Artificial Sequence
  Synthetic
ggccgcuaagaaatgcucact

SEQ ID NO: 51366 - DNA, 18 bp, Artificial Sequence
  Synthetic
ccugcucaggaggagcca

SEQ ID NO: 51367 - DNA, 17 bp, Artificial Sequence
  Synthetic
gtgggccccauctcugt

SEQ ID NO: 51368 - DNA, 21 bp, Artificial Sequence
  Synthetic
atccctguccttgtacugcac

SEQ ID NO: 51369 - DNA, 25 bp, Artificial Sequence
  Synthetic
agccctttaugcctctatctctuct

SEQ ID NO: 51370 - DNA, 22 bp, Artificial Sequence
  Synthetic
actgtcaauaccccatccccut

SEQ ID NO: 51371 - DNA, 26 bp, Artificial Sequence
  Synthetic
tgaccctgacucttattctccatcug

SEQ ID NO: 51372 - DNA, 25 bp, Artificial Sequence
  Synthetic
gggattgtgcuaacagaaaagauga

SEQ ID NO: 51373 - DNA, 22 bp, Artificial Sequence
  Synthetic
cgaatgaucgaatggtgagugg

SEQ ID NO: 51374 - DNA, 25 bp, Artificial Sequence
  Synthetic
tctataagccucgacagccagaaua

SEQ ID NO: 51375 - DNA, 27 bp, Artificial Sequence
  Synthetic
ggaaaaacagaagucacattcttgcut

SEQ ID NO: 51376 - DNA, 22 bp, Artificial Sequence
  Synthetic
ccaaactgugaagctcuggaac

SEQ ID NO: 51377 - DNA, 28 bp, Artificial Sequence
  Synthetic
agattccatctaccutcattctcccuaa

SEQ ID NO: 51378 - DNA, 26 bp, Artificial Sequence
  Synthetic
atcttcttccaugtcaactuagccaa

SEQ ID NO: 51379 - DNA, 22 bp, Artificial Sequence
  Synthetic
cctagacacagugctggcttua

SEQ ID NO: 51380 - DNA, 25 bp, Artificial Sequence
  Synthetic
tcctcaugagaaccaatctugcaat

SEQ ID NO: 51381 - DNA, 29 bp, Artificial Sequence
  Synthetic
tggtcattcttaccucagtttgtctttuc

SEQ ID NO: 51382 - DNA, 26 bp, Artificial Sequence
  Synthetic
gtctgtatttgugtccagagaacuca

SEQ ID NO: 51383 - DNA, 23 bp, Artificial Sequence
  Synthetic
agttccgtucaacttcgcuacaa

SEQ ID NO: 51384 - DNA, 24 bp, Artificial Sequence
  Synthetic
aaacaaacagccugccaatctuac

SEQ ID NO: 51385 - DNA, 25 bp, Artificial Sequence
  Synthetic
tcccagagttcuctttctctcctuc

SEQ ID NO: 51386 - DNA, 25 bp, Artificial Sequence
  Synthetic
tggccttccutccacaagaaauaaa

SEQ ID NO: 51387 - DNA, 28 bp, Artificial Sequence
  Synthetic
ccaacccccuaaatcattagtcttugat

SEQ ID NO: 51388 - DNA, 25 bp, Artificial Sequence
  Synthetic
ctgatatugcacactaggcugaagt

SEQ ID NO: 51389 - DNA, 21 bp, Artificial Sequence
  Synthetic
acaggctcagugcctgattut

SEQ ID NO: 51390 - DNA, 28 bp, Artificial Sequence
  Synthetic
gttgcacatgttuggcttaattctctua

SEQ ID NO: 51391 - DNA, 19 bp, Artificial Sequence
  Synthetic
gattgcucagccccucgat

SEQ ID NO: 51392 - DNA, 23 bp, Artificial Sequence
  Synthetic
cacctguttgtcagauccacaca

SEQ ID NO: 51393 - DNA, 28 bp, Artificial Sequence
  Synthetic
aaacttgccaugctacaattagtugaag

SEQ ID NO: 51394 - DNA, 20 bp, Artificial Sequence
  Synthetic
cccctgtuggccctgttauc

SEQ ID NO: 51395 - DNA, 28 bp, Artificial Sequence
  Synthetic
agcatgagttattutggatgttgcatut

SEQ ID NO: 51396 - DNA, 24 bp, Artificial Sequence
  Synthetic
aggacaccaagutcatgtaaugct

SEQ ID NO: 51397 - DNA, 29 bp, Artificial Sequence
  Synthetic
gtttgctagaauaacatttggtgtgctut

SEQ ID NO: 51398 - DNA, 28 bp, Artificial Sequence
  Synthetic
accataccagaugtcatcaacttattuc

SEQ ID NO: 51399 - DNA, 18 bp, Artificial Sequence
  Synthetic
ggagaaccuggtgugcct

SEQ ID NO: 51400 - DNA, 28 bp, Artificial Sequence
  Synthetic
acctagttggaaucctgaagtctacaut

SEQ ID NO: 51401 - DNA, 29 bp, Artificial Sequence
  Synthetic
ttcccattctauagggtttgatctgauct

SEQ ID NO: 51402 - DNA, 26 bp, Artificial Sequence
  Synthetic
gggttccagagautcagaatauaccc

SEQ ID NO: 51403 - DNA, 28 bp, Artificial Sequence
  Synthetic
gcttaactaaucacagaaatggcttugt

SEQ ID NO: 51404 - DNA, 26 bp, Artificial Sequence
  Synthetic
ctctcgaccacutaaaactucagact

SEQ ID NO: 51405 - DNA, 25 bp, Artificial Sequence
  Synthetic
agaggttguagcagaactucagaga

SEQ ID NO: 51406 - DNA, 27 bp, Artificial Sequence
  Synthetic
tgatgccagaugaagaaactccatuag

SEQ ID NO: 51407 - DNA, 28 bp, Artificial Sequence
  Synthetic
caatcacttaccuttcaagagacucaga

SEQ ID NO: 51408 - DNA, 27 bp, Artificial Sequence
  Synthetic
acaaaactuagagctgaattcaucgct

SEQ ID NO: 51409 - DNA, 26 bp, Artificial Sequence
  Synthetic
acattagcagcaaaguctttcactug

SEQ ID NO: 51410 - DNA, 24 bp, Artificial Sequence
  Synthetic
agacatgaaguctcacctcuccat

SEQ ID NO: 51411 - DNA, 21 bp, Artificial Sequence
  Synthetic
tgcctgcttugcctgatcaut

SEQ ID NO: 51412 - DNA, 21 bp, Artificial Sequence
  Synthetic
ccauagtggccuacgaggaaa

SEQ ID NO: 51413 - DNA, 28 bp, Artificial Sequence
  Synthetic
agcaagcttacaucttgaagttccttua

SEQ ID NO: 51414 - DNA, 27 bp, Artificial Sequence
  Synthetic
gttgaagtgaagggucttattagcugt

SEQ ID NO: 51415 - DNA, 28 bp, Artificial Sequence
  Synthetic
ccttcagcaacuaacaagattucacaga

SEQ ID NO: 51416 - DNA, 21 bp, Artificial Sequence
  Synthetic
caacgccgcaucagcatttua

SEQ ID NO: 51417 - DNA, 28 bp, Artificial Sequence
  Synthetic
ggaagatcttucaagaaatgtgttggut

SEQ ID NO: 51418 - DNA, 27 bp, Artificial Sequence
  Synthetic
gtcaatccattaagucctttgaagcuc

SEQ ID NO: 51419 - DNA, 26 bp, Artificial Sequence
  Synthetic
aatgtgatctutctacctgcugacaa

SEQ ID NO: 51420 - DNA, 26 bp, Artificial Sequence
  Synthetic
cctgtgtauagaaccaaacugagagg

SEQ ID NO: 51421 - DNA, 27 bp, Artificial Sequence
  Synthetic
agttagaauaatgtgcaugggaacagt

SEQ ID NO: 51422 - DNA, 25 bp, Artificial Sequence
  Synthetic
gggctatuaggatacatuccacagt

SEQ ID NO: 51423 - DNA, 28 bp, Artificial Sequence
  Synthetic
aacacacattttcutcacaggttcaauc

SEQ ID NO: 51424 - DNA, 20 bp, Artificial Sequence
  Synthetic
gtctgcagguacgatggcua

SEQ ID NO: 51425 - DNA, 20 bp, Artificial Sequence
  Synthetic
gcatggagagggcuctgtuc

SEQ ID NO: 51426 - DNA, 20 bp, Artificial Sequence
  Synthetic
agcacaagacaguccgacuc

SEQ ID NO: 51427 - DNA, 28 bp, Artificial Sequence
  Synthetic
gaguagcaaaucaaaagccacagaaaat

SEQ ID NO: 51428 - DNA, 27 bp, Artificial Sequence
  Synthetic
tgcagatugataagggtauggagagaa

SEQ ID NO: 51429 - DNA, 28 bp, Artificial Sequence
  Synthetic
tctctttgtctuctgcatttactucaca

SEQ ID NO: 51430 - DNA, 28 bp, Artificial Sequence
  Synthetic
gtgtcaatgaguatagcatttgcucaac

SEQ ID NO: 51431 - DNA, 28 bp, Artificial Sequence
  Synthetic
agtctgaaaaccaauttgatcctgugat

SEQ ID NO: 51432 - DNA, 29 bp, Artificial Sequence
  Synthetic
ccatgatttccaguttagtttgatgtugt

SEQ ID NO: 51433 - DNA, 22 bp, Artificial Sequence
  Synthetic
cagcaaaaccacuccucacaag

SEQ ID NO: 51434 - DNA, 23 bp, Artificial Sequence
  Synthetic
ggactgcautaccaactctuggg

SEQ ID NO: 51435 - DNA, 23 bp, Artificial Sequence
  Synthetic
ttcatactgcugagctccactug

SEQ ID NO: 51436 - DNA, 23 bp, Artificial Sequence
  Synthetic
aaggacagcgacuacaaggaauc

SEQ ID NO: 51437 - DNA, 28 bp, Artificial Sequence
  Synthetic
gctgcagtgcuttccttaaaaatatcua

SEQ ID NO: 51438 - DNA, 27 bp, Artificial Sequence
  Synthetic
ctagagagcagggugaatgttttctua

SEQ ID NO: 51439 - DNA, 25 bp, Artificial Sequence
  Synthetic
agcagcagguatttcttctgguaaa

SEQ ID NO: 51440 - DNA, 28 bp, Artificial Sequence
  Synthetic
ggcaattgtgaaauttgacatttgtuct

SEQ ID NO: 51441 - DNA, 28 bp, Artificial Sequence
  Synthetic
tgctattttgacutcaccttgatucagt

SEQ ID NO: 51442 - DNA, 24 bp, Artificial Sequence
  Synthetic
gggacagacaucttcagaaugaca

SEQ ID NO: 51443 - DNA, 20 bp, Artificial Sequence
  Synthetic
agcaccaccgauguccaaag

SEQ ID NO: 51444 - DNA, 26 bp, Artificial Sequence
  Synthetic
ttcgtgtgcuttttgttctttuggat

SEQ ID NO: 51445 - DNA, 21 bp, Artificial Sequence
  Synthetic
gagaacaagcucacaggugga

SEQ ID NO: 51446 - DNA, 28 bp, Artificial Sequence
  Synthetic
ggtgacttgttuactggaaacttttgut

SEQ ID NO: 51447 - DNA, 21 bp, Artificial Sequence
  Synthetic
ctttgugagccagcatuggac

SEQ ID NO: 51448 - DNA, 27 bp, Artificial Sequence
  Synthetic
ggtcccacuttttattctttugcagag

SEQ ID NO: 51449 - DNA, 27 bp, Artificial Sequence
  Synthetic
cacctattcaccagauttcgtagtcut

SEQ ID NO: 51450 - DNA, 22 bp, Artificial Sequence
  Synthetic
tcaaagaauggcaccagtguga

SEQ ID NO: 51451 - DNA, 29 bp, Artificial Sequence
  Synthetic
tgtccataguccttttaagcttguaacaa

SEQ ID NO: 51452 - DNA, 23 bp, Artificial Sequence
  Synthetic
atccagatcgauggtgtgtctug

SEQ ID NO: 51453 - DNA, 28 bp, Artificial Sequence
  Synthetic
cctatgagaaaacugcacuggagaaaaa

SEQ ID NO: 51454 - DNA, 22 bp, Artificial Sequence
  Synthetic
agcucaaaacacaccacaggut

SEQ ID NO: 51455 - DNA, 22 bp, Artificial Sequence
  Synthetic
caatgatgacaugtgccctcuc

SEQ ID NO: 51456 - DNA, 19 bp, Artificial Sequence
  Synthetic
gtccagugagtgcugcaga

SEQ ID NO: 51457 - DNA, 23 bp, Artificial Sequence
  Synthetic
cccagctcauttcactgtcucaa

SEQ ID NO: 51458 - DNA, 24 bp, Artificial Sequence
  Synthetic
acggtggacuaaaggaaactucag

SEQ ID NO: 51459 - DNA, 24 bp, Artificial Sequence
  Synthetic
gtgctgtttccuctttaccatgug

SEQ ID NO: 51460 - DNA, 22 bp, Artificial Sequence
  Synthetic
gcccaaggagagautggttcug

SEQ ID NO: 51461 - DNA, 26 bp, Artificial Sequence
  Synthetic
ttgattacagggaagugggaatgtut

SEQ ID NO: 51462 - DNA, 20 bp, Artificial Sequence
  Synthetic
gggcuaacccaccatgctut

SEQ ID NO: 51463 - DNA, 22 bp, Artificial Sequence
  Synthetic
gctctggagucgacttctucct

SEQ ID NO: 51464 - DNA, 21 bp, Artificial Sequence
  Synthetic
ggctcttcugaggttgcctua

SEQ ID NO: 51465 - DNA, 18 bp, Artificial Sequence
  Synthetic
caagcaccugctcagugg

SEQ ID NO: 51466 - DNA, 28 bp, Artificial Sequence
  Synthetic
tgaagtcaaataaugaagtcccaaguga

SEQ ID NO: 51467 - DNA, 26 bp, Artificial Sequence
  Synthetic
ggctttttguacttgtttgtccucaa

SEQ ID NO: 51468 - DNA, 29 bp, Artificial Sequence
  Synthetic
gggatgaaauagaaagtcaaugaggagaa

SEQ ID NO: 51469 - DNA, 21 bp, Artificial Sequence
  Synthetic
acctgagtcucctgctctugt

SEQ ID NO: 51470 - DNA, 21 bp, Artificial Sequence
  Synthetic
ggcaacctuccaccttcctut

SEQ ID NO: 51471 - DNA, 26 bp, Artificial Sequence
  Synthetic
accatgttuaaggatctcaatugcca

SEQ ID NO: 51472 - DNA, 21 bp, Artificial Sequence
  Synthetic
caggcagggagcaaugtuagt

SEQ ID NO: 51473 - DNA, 21 bp, Artificial Sequence
  Synthetic
cuatgcttgcguaaccagcag

SEQ ID NO: 51474 - DNA, 21 bp, Artificial Sequence
  Synthetic
ccatugtccacaauccccaac

SEQ ID NO: 51475 - DNA, 21 bp, Artificial Sequence
  Synthetic
gaccutcccaagucaccaaga

SEQ ID NO: 51476 - DNA, 26 bp, Artificial Sequence
  Synthetic
aacaaaagctgcuttacattctgcut

SEQ ID NO: 51477 - DNA, 27 bp, Artificial Sequence
  Synthetic
agataggtgtucgaatgggacttctua

SEQ ID NO: 51478 - DNA, 26 bp, Artificial Sequence
  Synthetic
ccagatgauggtaggtacattuagca

SEQ ID NO: 51479 - DNA, 20 bp, Artificial Sequence
  Synthetic
cggatctuccgtagcagcuc

SEQ ID NO: 51480 - DNA, 27 bp, Artificial Sequence
  Synthetic
aaaacaaatgagacaagaugcaccauc

SEQ ID NO: 51481 - DNA, 27 bp, Artificial Sequence
  Synthetic
agttcaagcacugtcacattaggtuac

SEQ ID NO: 51482 - DNA, 26 bp, Artificial Sequence
  Synthetic
gtaagagacaugtccagattccucac

SEQ ID NO: 51483 - DNA, 24 bp, Artificial Sequence
  Synthetic
gattgcttgtutggcttgtgtuct

SEQ ID NO: 51484 - DNA, 27 bp, Artificial Sequence
  Synthetic
tccctttugcacacatgataatuacca

SEQ ID NO: 51485 - DNA, 29 bp, Artificial Sequence
  Synthetic
tgttcattccaggacuattagacagugat

SEQ ID NO: 51486 - DNA, 26 bp, Artificial Sequence
  Synthetic
catccacaguagcaataaggguaagt

SEQ ID NO: 51487 - DNA, 24 bp, Artificial Sequence
  Synthetic
gctcagcgtgucacagtactatuc

SEQ ID NO: 51488 - DNA, 25 bp, Artificial Sequence
  Synthetic
gagtaatauaaacggccacccctut

SEQ ID NO: 51489 - DNA, 25 bp, Artificial Sequence
  Synthetic
gcaagcagataugctactgtcagug

SEQ ID NO: 51490 - DNA, 28 bp, Artificial Sequence
  Synthetic
gagtagctcatutctgtgtatcguaagg

SEQ ID NO: 51491 - DNA, 26 bp, Artificial Sequence
  Synthetic
gctgtgattauctgtgctaacuggat

SEQ ID NO: 51492 - DNA, 22 bp, Artificial Sequence
  Synthetic
tggtcaaaggcugccatgtuaa

SEQ ID NO: 51493 - DNA, 23 bp, Artificial Sequence
  Synthetic
gtccccuggttaaaacgugaact

SEQ ID NO: 51494 - DNA, 27 bp, Artificial Sequence
  Synthetic
acaaacccaaautcctaatccugaagt

SEQ ID NO: 51495 - DNA, 23 bp, Artificial Sequence
  Synthetic
aagaacatcucaggaagcacugg

SEQ ID NO: 51496 - DNA, 21 bp, Artificial Sequence
  Synthetic
gcaugaaagcagcgtcatuca

SEQ ID NO: 51497 - DNA, 19 bp, Artificial Sequence
  Synthetic
cgtcacuggtcgcgauaca

SEQ ID NO: 51498 - DNA, 24 bp, Artificial Sequence
  Synthetic
gtggccauttacaaccucaagaag

SEQ ID NO: 51499 - DNA, 21 bp, Artificial Sequence
  Synthetic
tgacctgauggtaccugccat

SEQ ID NO: 51500 - DNA, 19 bp, Artificial Sequence
  Synthetic
accacacuccggctccuat

SEQ ID NO: 51501 - DNA, 22 bp, Artificial Sequence
  Synthetic
cctagccccaggaucctactug

SEQ ID NO: 51502 - DNA, 20 bp, Artificial Sequence
  Synthetic
ggccatcugcattgggauct

SEQ ID NO: 51503 - DNA, 21 bp, Artificial Sequence
  Synthetic
ccagugagcaatgugagcaac

SEQ ID NO: 51504 - DNA, 28 bp, Artificial Sequence
  Synthetic
aaacacagtaaauaggaggagactcuct

SEQ ID NO: 51505 - DNA, 28 bp, Artificial Sequence
  Synthetic
ccagtgacuagaagttttccttccuaaa

SEQ ID NO: 51506 - DNA, 30 bp, Artificial Sequence
  Synthetic
attcacagaauctatctgtttaaugaaggt

SEQ ID NO: 51507 - DNA, 27 bp, Artificial Sequence
  Synthetic
gaatgcaugagaaagctgagaaucaat

SEQ ID NO: 51508 - DNA, 20 bp, Artificial Sequence
  Synthetic
gaccaccccaugaucgacat

SEQ ID NO: 51509 - DNA, 21 bp, Artificial Sequence
  Synthetic
cugaccaacagagacggugac

SEQ ID NO: 51510 - DNA, 21 bp, Artificial Sequence
  Synthetic
ggttcagggugcatagaugct

SEQ ID NO: 51511 - DNA, 21 bp, Artificial Sequence
  Synthetic
catcgtcaugcctgtgtcuca

SEQ ID NO: 51512 - DNA, 24 bp, Artificial Sequence
  Synthetic
cgggcaaauacaagcatagacuct

SEQ ID NO: 51513 - DNA, 20 bp, Artificial Sequence
  Synthetic
ccctacctuccaggcatugg

SEQ ID NO: 51514 - DNA, 20 bp, Artificial Sequence
  Synthetic
aggccggagaaguaacccut

SEQ ID NO: 51515 - DNA, 25 bp, Artificial Sequence
  Synthetic
gguttaaagugacaaccgcaaagac

SEQ ID NO: 51516 - DNA, 22 bp, Artificial Sequence
  Synthetic
ggucccaggguagagaacaaca

SEQ ID NO: 51517 - DNA, 21 bp, Artificial Sequence
  Synthetic
ctcttccugaactgctccuca

SEQ ID NO: 51518 - DNA, 21 bp, Artificial Sequence
  Synthetic
ggactcgcuggacatgatuga

SEQ ID NO: 51519 - DNA, 20 bp, Artificial Sequence
  Synthetic
cgcttgccuactcactcuct

SEQ ID NO: 51520 - DNA, 23 bp, Artificial Sequence
  Synthetic
accatgtgccautcatcctucat

SEQ ID NO: 51521 - DNA, 20 bp, Artificial Sequence
  Synthetic
gcagccucactggtttccug

SEQ ID NO: 51522 - DNA, 26 bp, Artificial Sequence
  Synthetic
ctcttcagggauatcttgagctucag

SEQ ID NO: 51523 - DNA, 27 bp, Artificial Sequence
  Synthetic
aauccacagagucagaaggagaaaaag

SEQ ID NO: 51524 - DNA, 23 bp, Artificial Sequence
  Synthetic
gctccaagttucaggcttttgut

SEQ ID NO: 51525 - DNA, 29 bp, Artificial Sequence
  Synthetic
ggtgtatctgaagaugcaagaatgttuac

SEQ ID NO: 51526 - DNA, 23 bp, Artificial Sequence
  Synthetic
aaaaaggtgaagcuctgggtcut

SEQ ID NO: 51527 - DNA, 28 bp, Artificial Sequence
  Synthetic
ccacgatataggucaccatctttugaat

SEQ ID NO: 51528 - DNA, 28 bp, Artificial Sequence
  Synthetic
attagcttggautatgacaaaguagcga

SEQ ID NO: 51529 - DNA, 28 bp, Artificial Sequence
  Synthetic
catgtcatctcuaacttccaagaggaut

SEQ ID NO: 51530 - DNA, 22 bp, Artificial Sequence
  Synthetic
aaatcctggcucgctcuaaagg

SEQ ID NO: 51531 - DNA, 26 bp, Artificial Sequence
  Synthetic
tcagatcagcuttgagtgaacttuga

SEQ ID NO: 51532 - DNA, 18 bp, Artificial Sequence
  Synthetic
gagcaggugccagacugt

SEQ ID NO: 51533 - DNA, 18 bp, Artificial Sequence
  Synthetic
caugcggaaggccatguc

SEQ ID NO: 51534 - DNA, 25 bp, Artificial Sequence
  Synthetic
caggtctttcucctcatacttugga

SEQ ID NO: 51535 - DNA, 24 bp, Artificial Sequence
  Synthetic
gttgttgucattgatguccacgat

SEQ ID NO: 51536 - DNA, 21 bp, Artificial Sequence
  Synthetic
gtatguggccttcctuggaca

SEQ ID NO: 51537 - DNA, 20 bp, Artificial Sequence
  Synthetic
ccaccacggucagacugaac

SEQ ID NO: 51538 - DNA, 21 bp, Artificial Sequence
  Synthetic
ggctgtccutctgggtguaac

SEQ ID NO: 51539 - DNA, 20 bp, Artificial Sequence
  Synthetic
ccctcctgcuctgcctctua

SEQ ID NO: 51540 - DNA, 19 bp, Artificial Sequence
  Synthetic
ggaggccuaacgtgctguc

SEQ ID NO: 51541 - DNA, 19 bp, Artificial Sequence
  Synthetic
agccctucacgcacatgua

SEQ ID NO: 51542 - DNA, 18 bp, Artificial Sequence
  Synthetic
agcagauggccacugcaa

SEQ ID NO: 51543 - DNA, 24 bp, Artificial Sequence
  Synthetic
tgttttgtgttucttgctctgcuc

SEQ ID NO: 51544 - DNA, 22 bp, Artificial Sequence
  Synthetic
ggagtgtguggcagagaucaaa

SEQ ID NO: 51545 - DNA, 20 bp, Artificial Sequence
  Synthetic
ctggactgcugtggtctguc

SEQ ID NO: 51546 - DNA, 23 bp, Artificial Sequence
  Synthetic
attcttcccauccaccaaaugct

SEQ ID NO: 51547 - DNA, 22 bp, Artificial Sequence
  Synthetic
agatccatgcaugctccatucc

SEQ ID NO: 51548 - DNA, 17 bp, Artificial Sequence
  Synthetic
gcacgucggagcccaut

SEQ ID NO: 51549 - DNA, 17 bp, Artificial Sequence
  Synthetic
cggctuccacgtgtguc

SEQ ID NO: 51550 - DNA, 21 bp, Artificial Sequence
  Synthetic
ggctcaccauggtcttctugt

SEQ ID NO: 51551 - DNA, 20 bp, Artificial Sequence
  Synthetic
tgacccaacugggtctguct

SEQ ID NO: 51552 - DNA, 19 bp, Artificial Sequence
  Synthetic
ccccagucgagacccugaa

SEQ ID NO: 51553 - DNA, 21 bp, Artificial Sequence
  Synthetic
ccccatctcuccacccttuga

SEQ ID NO: 51554 - DNA, 22 bp, Artificial Sequence
  Synthetic
ggtttccgauctcggtcaugat

SEQ ID NO: 51555 - DNA, 20 bp, Artificial Sequence
  Synthetic
tctgctucgctgacauccac

SEQ ID NO: 51556 - DNA, 21 bp, Artificial Sequence
  Synthetic
gtccacccacaugacuccaaa

SEQ ID NO: 51557 - DNA, 23 bp, Artificial Sequence
  Synthetic
tcttgttggtauactggcggaug

SEQ ID NO: 51558 - DNA, 27 bp, Artificial Sequence
  Synthetic
ttttacagacagugatgtgtgttcuga

SEQ ID NO: 51559 - DNA, 27 bp, Artificial Sequence
  Synthetic
ggcgcttaaatutctcaacttcttuct

SEQ ID NO: 51560 - DNA, 33 bp, Artificial Sequence
  Synthetic
tatttttagagtactauggaaatgatggtgaut

SEQ ID NO: 51561 - DNA, 25 bp, Artificial Sequence
  Synthetic
ggagacagcucacagttagguaaac

SEQ ID NO: 51562 - DNA, 27 bp, Artificial Sequence
  Synthetic
tgagcaaauacaagctgaaaacttugg

SEQ ID NO: 51563 - DNA, 27 bp, Artificial Sequence
  Synthetic
tgtaagtcagacauaatgcatgcugaa

SEQ ID NO: 51564 - DNA, 25 bp, Artificial Sequence
  Synthetic
gcttaattattcugaagggccguga

SEQ ID NO: 51565 - DNA, 28 bp, Artificial Sequence
  Synthetic
cccaaccaaauggcatcttttatatgut

SEQ ID NO: 51566 - DNA, 19 bp, Artificial Sequence
  Synthetic
ccuccagcgacagggtuac

SEQ ID NO: 51567 - DNA, 21 bp, Artificial Sequence
  Synthetic
gcggtgcugattggaguagac

SEQ ID NO: 51568 - DNA, 21 bp, Artificial Sequence
  Synthetic
ggaaaggaacagugacugcct

SEQ ID NO: 51569 - DNA, 25 bp, Artificial Sequence
  Synthetic
tccaaaaggauccgtcactcttcua

SEQ ID NO: 51570 - DNA, 23 bp, Artificial Sequence
  Synthetic
accaagcagcaguaagactucag

SEQ ID NO: 51571 - DNA, 24 bp, Artificial Sequence
  Synthetic
agaagaggaucaggttggugaaga

SEQ ID NO: 51572 - DNA, 22 bp, Artificial Sequence
  Synthetic
gcacctuacaggtccttgugaa

SEQ ID NO: 51573 - DNA, 20 bp, Artificial Sequence
  Synthetic
cgtgttagcuacaggcugct

SEQ ID NO: 51574 - DNA, 21 bp, Artificial Sequence
  Synthetic
gtgaacaccugcctctgucaa

SEQ ID NO: 51575 - DNA, 20 bp, Artificial Sequence
  Synthetic
tgguccaagagggtguccat

SEQ ID NO: 51576 - DNA, 23 bp, Artificial Sequence
  Synthetic
gttcctccucagcctctttctut

SEQ ID NO: 51577 - DNA, 22 bp, Artificial Sequence
  Synthetic
gaaatggaaaccuggtgcctuc

SEQ ID NO: 51578 - DNA, 22 bp, Artificial Sequence
  Synthetic
gcagagaggcucttgctcttua

SEQ ID NO: 51579 - DNA, 23 bp, Artificial Sequence
  Synthetic
cgccagauaccagaaucagagga

SEQ ID NO: 51580 - DNA, 22 bp, Artificial Sequence
  Synthetic
gatgtgccauctgctaggauct

SEQ ID NO: 51581 - DNA, 21 bp, Artificial Sequence
  Synthetic
caagaggaccugttgcuccat

SEQ ID NO: 51582 - DNA, 20 bp, Artificial Sequence
  Synthetic
gtatacguggtggcugcaga

SEQ ID NO: 51583 - DNA, 17 bp, Artificial Sequence
  Synthetic
gccacgugcaggaugac

SEQ ID NO: 51584 - DNA, 21 bp, Artificial Sequence
  Synthetic
ctgatcaccgccuggtacauc

SEQ ID NO: 51585 - DNA, 21 bp, Artificial Sequence
  Synthetic
gctcaacccugagucaggagt

SEQ ID NO: 51586 - DNA, 21 bp, Artificial Sequence
  Synthetic
gctctggcuaacttggctcuc

SEQ ID NO: 51587 - DNA, 24 bp, Artificial Sequence
  Synthetic
ggtcattgaagcuccagctcttut

SEQ ID NO: 51588 - DNA, 22 bp, Artificial Sequence
  Synthetic
gggaaatggagucgaagcugac

SEQ ID NO: 51589 - DNA, 27 bp, Artificial Sequence
  Synthetic
gccaatcatauatttcgcccuagaaca

SEQ ID NO: 51590 - DNA, 24 bp, Artificial Sequence
  Synthetic
gaaagaaugaccaagaggtcuggt

SEQ ID NO: 51591 - DNA, 21 bp, Artificial Sequence
  Synthetic
caaggagcagcucucagagat

SEQ ID NO: 51592 - DNA, 21 bp, Artificial Sequence
  Synthetic
ccagccccutagacttucgag

SEQ ID NO: 51593 - DNA, 27 bp, Artificial Sequence
  Synthetic
caacaaaacagagcutgggttagatut

SEQ ID NO: 51594 - DNA, 26 bp, Artificial Sequence
  Synthetic
gggaaaggaaccaaaguatucaagat

SEQ ID NO: 51595 - DNA, 22 bp, Artificial Sequence
  Synthetic
gagcaucgtctuggagaaggag

SEQ ID NO: 51596 - DNA, 25 bp, Artificial Sequence
  Synthetic
gggatgtagggautcttgtttctuc

SEQ ID NO: 51597 - DNA, 25 bp, Artificial Sequence
  Synthetic
caacttcgacuggagggacatatut

SEQ ID NO: 51598 - DNA, 25 bp, Artificial Sequence
  Synthetic
actgcagagguaatgtagtatuggt

SEQ ID NO: 51599 - DNA, 19 bp, Artificial Sequence
  Synthetic
aautggugagccgggacaa

SEQ ID NO: 51600 - DNA, 23 bp, Artificial Sequence
  Synthetic
tgcagagagaauacggtggtgua

SEQ ID NO: 51601 - DNA, 21 bp, Artificial Sequence
  Synthetic
acuagggcucaccaggagaac

SEQ ID NO: 51602 - DNA, 22 bp, Artificial Sequence
  Synthetic
ggcguccacacactctatgaut

SEQ ID NO: 51603 - DNA, 26 bp, Artificial Sequence
  Synthetic
ggautaccaggatauccaggaagaca

SEQ ID NO: 51604 - DNA, 22 bp, Artificial Sequence
  Synthetic
gcggacattguggtgagtacug

SEQ ID NO: 51605 - DNA, 22 bp, Artificial Sequence
  Synthetic
ggccggaucattcatgacctut

SEQ ID NO: 51606 - DNA, 22 bp, Artificial Sequence
  Synthetic
ggccucccaggaactaattcug

SEQ ID NO: 51607 - DNA, 26 bp, Artificial Sequence
  Synthetic
agaataagtcttcuccagctcctuct

SEQ ID NO: 51608 - DNA, 19 bp, Artificial Sequence
  Synthetic
gcctgaguggtcaguccca

SEQ ID NO: 51609 - DNA, 21 bp, Artificial Sequence
  Synthetic
gugacacuggaggcagaagag

SEQ ID NO: 51610 - DNA, 20 bp, Artificial Sequence
  Synthetic
atccccuccccatccctuaa

SEQ ID NO: 51611 - DNA, 23 bp, Artificial Sequence
  Synthetic
acacacaccaugtctcttgtcuc

SEQ ID NO: 51612 - DNA, 19 bp, Artificial Sequence
  Synthetic
cccttgccutggtcctgug

SEQ ID NO: 51613 - DNA, 19 bp, Artificial Sequence
  Synthetic
caccccagugttccaugct

SEQ ID NO: 51614 - DNA, 25 bp, Artificial Sequence
  Synthetic
ccaaaacacacacagcuacttcuac

SEQ ID NO: 51615 - DNA, 24 bp, Artificial Sequence
  Synthetic
ccctttgtaccugcactgacttut

SEQ ID NO: 51616 - DNA, 27 bp, Artificial Sequence
  Synthetic
ggctctttguggatttttctttguagt

SEQ ID NO: 51617 - DNA, 25 bp, Artificial Sequence
  Synthetic
gccagagaugacaaaaatgcttuct

SEQ ID NO: 51618 - DNA, 20 bp, Artificial Sequence
  Synthetic
acugacggcccaaagatcug

SEQ ID NO: 51619 - DNA, 28 bp, Artificial Sequence
  Synthetic
cctataggctucaaaggaatgaaaugct

SEQ ID NO: 51620 - DNA, 21 bp, Artificial Sequence
  Synthetic
ccccaagcutttcccucgaag

SEQ ID NO: 51621 - DNA, 21 bp, Artificial Sequence
  Synthetic
cctcagccuctguggacagat

SEQ ID NO: 51622 - DNA, 24 bp, Artificial Sequence
  Synthetic
aaggttugaatcagaguccaaggg

SEQ ID NO: 51623 - DNA, 28 bp, Artificial Sequence
  Synthetic
tcagagaatgacuttccagcaatatugt

SEQ ID NO: 51624 - DNA, 22 bp, Artificial Sequence
  Synthetic
gcatttucagcagcttcucact

SEQ ID NO: 51625 - DNA, 23 bp, Artificial Sequence
  Synthetic
gcactgtgauaagagggtcucac

SEQ ID NO: 51626 - DNA, 24 bp, Artificial Sequence
  Synthetic
ctccattacagcauttctggcuct

SEQ ID NO: 51627 - DNA, 28 bp, Artificial Sequence
  Synthetic
agcctcagtttucttccctttttctaut

SEQ ID NO: 51628 - DNA, 26 bp, Artificial Sequence
  Synthetic
ccttgtagcattuagctcttctccua

SEQ ID NO: 51629 - DNA, 21 bp, Artificial Sequence
  Synthetic
cgcaacccucttttgtcccut

SEQ ID NO: 51630 - DNA, 28 bp, Artificial Sequence
  Synthetic
aggctattacagaugtgattaacugcac

SEQ ID NO: 51631 - DNA, 27 bp, Artificial Sequence
  Synthetic
tgggaattagugccttggtagagtaut

SEQ ID NO: 51632 - DNA, 20 bp, Artificial Sequence
  Synthetic
ccagacatacugcggtgcut

SEQ ID NO: 51633 - DNA, 23 bp, Artificial Sequence
  Synthetic
tccagatcauacccagggtcaut

SEQ ID NO: 51634 - DNA, 27 bp, Artificial Sequence
  Synthetic
ttagcccatgtucattttctctcauca

SEQ ID NO: 51635 - DNA, 28 bp, Artificial Sequence
  Synthetic
gatttcatgucaacaagtggcttcaaua

SEQ ID NO: 51636 - DNA, 24 bp, Artificial Sequence
  Synthetic
ctccagagacucttgcaatcauca

SEQ ID NO: 51637 - DNA, 23 bp, Artificial Sequence
  Synthetic
ctctgaatcaccutctccaccuc

SEQ ID NO: 51638 - DNA, 25 bp, Artificial Sequence
  Synthetic
gttcagttggucaagtagagtugct

SEQ ID NO: 51639 - DNA, 25 bp, Artificial Sequence
  Synthetic
ccttggttugagcttgtcatcttut

SEQ ID NO: 51640 - DNA, 23 bp, Artificial Sequence
  Synthetic
gggtgtauggttgacaugaacga

SEQ ID NO: 51641 - DNA, 26 bp, Artificial Sequence
  Synthetic
gcttccttgugctgcaaactuaaaaa

SEQ ID NO: 51642 - DNA, 22 bp, Artificial Sequence
  Synthetic
gcccagguttaaggcaacucaa

SEQ ID NO: 51643 - DNA, 22 bp, Artificial Sequence
  Synthetic
acatcttcggugagtctugcag

SEQ ID NO: 51644 - DNA, 23 bp, Artificial Sequence
  Synthetic
ggaagtcatacugcccatgctut

SEQ ID NO: 51645 - DNA, 24 bp, Artificial Sequence
  Synthetic
gggtacaatgucttcttccagtuc

SEQ ID NO: 51646 - DNA, 27 bp, Artificial Sequence
  Synthetic
agtgagagauaaacagggacataucct

SEQ ID NO: 51647 - DNA, 24 bp, Artificial Sequence
  Synthetic
gagaatcatcuccacgttgtugga

SEQ ID NO: 51648 - DNA, 27 bp, Artificial Sequence
  Synthetic
agctgagtgtguatttcaaagttcugt

SEQ ID NO: 51649 - DNA, 28 bp, Artificial Sequence
  Synthetic
gcatccgugaatttggaatttugaaaaa

SEQ ID NO: 51650 - DNA, 26 bp, Artificial Sequence
  Synthetic
ctcaataattcgacucaccacagcua

SEQ ID NO: 51651 - DNA, 27 bp, Artificial Sequence
  Synthetic
tcaccctgaaugtgtcttctctauagt

SEQ ID NO: 51652 - DNA, 24 bp, Artificial Sequence
  Synthetic
ggaguaaaagaacaggaacugcct

SEQ ID NO: 51653 - DNA, 26 bp, Artificial Sequence
  Synthetic
tcacctuacacccaatagaaatugct

SEQ ID NO: 51654 - DNA, 21 bp, Artificial Sequence
  Synthetic
gccacctcucagtccatcuct

SEQ ID NO: 51655 - DNA, 25 bp, Artificial Sequence
  Synthetic
agccagaaaugagactatggaguca

SEQ ID NO: 51656 - DNA, 20 bp, Artificial Sequence
  Synthetic
gcgguacacaccagcctaug

SEQ ID NO: 51657 - DNA, 23 bp, Artificial Sequence
  Synthetic
ccattcucaggacccttcaguct

SEQ ID NO: 51658 - DNA, 21 bp, Artificial Sequence
  Synthetic
ccggagaaugacagactuggt

SEQ ID NO: 51659 - DNA, 29 bp, Artificial Sequence
  Synthetic
ttttccttctgcugattctcttctttuct

SEQ ID NO: 51660 - DNA, 26 bp, Artificial Sequence
  Synthetic
atgacatagcaauggaagccaacuaa

SEQ ID NO: 51661 - DNA, 27 bp, Artificial Sequence
  Synthetic
caccaagaauccatctcattctguagt

SEQ ID NO: 51662 - DNA, 24 bp, Artificial Sequence
  Synthetic
gggtttcatucacacgctgaacua

SEQ ID NO: 51663 - DNA, 26 bp, Artificial Sequence
  Synthetic
ggactccatcuatatggcttgcaaug

SEQ ID NO: 51664 - DNA, 22 bp, Artificial Sequence
  Synthetic
gaagtgaaagugtgttgcgcut

SEQ ID NO: 51665 - DNA, 24 bp, Artificial Sequence
  Synthetic
ggtttggaatcuggctgaatcugt

SEQ ID NO: 51666 - DNA, 20 bp, Artificial Sequence
  Synthetic
ctgccgucaggtagttcucc

SEQ ID NO: 51667 - DNA, 22 bp, Artificial Sequence
  Synthetic
gatatgctcgutccgagaucgt

SEQ ID NO: 51668 - DNA, 27 bp, Artificial Sequence
  Synthetic
atgagtggcaaugtcaggtgttauaat

SEQ ID NO: 51669 - DNA, 30 bp, Artificial Sequence
  Synthetic
ctaagaaactcaccuaatgtaagcctaugg

SEQ ID NO: 51670 - DNA, 22 bp, Artificial Sequence
  Synthetic
ccctggatguggccaacaauag

SEQ ID NO: 51671 - DNA, 29 bp, Artificial Sequence
  Synthetic
tcaaactggcaugaataaccacuaaaaga

SEQ ID NO: 51672 - DNA, 27 bp, Artificial Sequence
  Synthetic
gtgacacactatuggtagctgttctua

SEQ ID NO: 51673 - DNA, 29 bp, Artificial Sequence
  Synthetic
cttctggaauacaggaaaatttgttcuga

SEQ ID NO: 51674 - DNA, 26 bp, Artificial Sequence
  Synthetic
cggtctttagauatgagcagcaauga

SEQ ID NO: 51675 - DNA, 29 bp, Artificial Sequence
  Synthetic
ggcaataatcgtcutacctctttcagtut

SEQ ID NO: 51676 - DNA, 28 bp, Artificial Sequence
  Synthetic
ctggaggtagaauagtagagggttugaa

SEQ ID NO: 51677 - DNA, 33 bp, Artificial Sequence
  Synthetic
catctgtttaaggaautaagcatacaacuacaa

SEQ ID NO: 51678 - DNA, 26 bp, Artificial Sequence
  Synthetic
gtcugacgagacgcattttatuacct

SEQ ID NO: 51679 - DNA, 28 bp, Artificial Sequence
  Synthetic
gatttaccucagaagtgtatcctucagt

SEQ ID NO: 51680 - DNA, 28 bp, Artificial Sequence
  Synthetic
aatccacaaatucaacggaaagaaaugt

SEQ ID NO: 51681 - DNA, 30 bp, Artificial Sequence
  Synthetic
aaaataacttacagtuggcttgttcttguc

SEQ ID NO: 51682 - DNA, 23 bp, Artificial Sequence
  Synthetic
gtacacagggagucagtgggaua

SEQ ID NO: 51683 - DNA, 21 bp, Artificial Sequence
  Synthetic
ggttggtgggutagtgggaug

SEQ ID NO: 51684 - DNA, 23 bp, Artificial Sequence
  Synthetic
tgactccagagaugtcaguggaa

SEQ ID NO: 51685 - DNA, 21 bp, Artificial Sequence
  Synthetic
gacuttgcuaccccaggagag

SEQ ID NO: 51686 - DNA, 23 bp, Artificial Sequence
  Synthetic
gcccgacaggcauttaaauaggt

SEQ ID NO: 51687 - DNA, 28 bp, Artificial Sequence
  Synthetic
acagtaatgtagcutcacatacagctug

SEQ ID NO: 51688 - DNA, 25 bp, Artificial Sequence
  Synthetic
tggcaaaaagcccaaguaactauct

SEQ ID NO: 51689 - DNA, 24 bp, Artificial Sequence
  Synthetic
aaaagaaaagcccccauctcugat

SEQ ID NO: 51690 - DNA, 21 bp, Artificial Sequence
  Synthetic
gctgctacutcccacagauga

SEQ ID NO: 51691 - DNA, 26 bp, Artificial Sequence
  Synthetic
gatgtgaaatgcugctcaaggttuag

SEQ ID NO: 51692 - DNA, 21 bp, Artificial Sequence
  Synthetic
tgcgtgagagcutcacatuca

SEQ ID NO: 51693 - DNA, 28 bp, Artificial Sequence
  Synthetic
acagaatcttaauttgggtggcuaaaca

SEQ ID NO: 51694 - DNA, 28 bp, Artificial Sequence
  Synthetic
tgggcatgaaautagacatacttctucc

SEQ ID NO: 51695 - DNA, 27 bp, Artificial Sequence
  Synthetic
aactctccugcagggaauaaagaaaat

SEQ ID NO: 51696 - DNA, 27 bp, Artificial Sequence
  Synthetic
tgtgaaagaacaacaugaacccauagt

SEQ ID NO: 51697 - DNA, 21 bp, Artificial Sequence
  Synthetic
gctctccccuttgtcaucacc

SEQ ID NO: 51698 - DNA, 26 bp, Artificial Sequence
  Synthetic
tgaatgaacaaaacutggacuaggct

SEQ ID NO: 51699 - DNA, 26 bp, Artificial Sequence
  Synthetic
ggucagaaaacactgugaaaagcaaa

SEQ ID NO: 51700 - DNA, 22 bp, Artificial Sequence
  Synthetic
acaggccautttccatgtuggt

SEQ ID NO: 51701 - DNA, 24 bp, Artificial Sequence
  Synthetic
gagcatactcaucaggccagtaut

SEQ ID NO: 51702 - DNA, 30 bp, Artificial Sequence
  Synthetic
ctgaaagaauaagaagagtgagctauagca

SEQ ID NO: 51703 - DNA, 27 bp, Artificial Sequence
  Synthetic
agctccctagagutctgaatcctatut

SEQ ID NO: 51704 - DNA, 22 bp, Artificial Sequence
  Synthetic
ggtcagauccgactccatctuc

SEQ ID NO: 51705 - DNA, 28 bp, Artificial Sequence
  Synthetic
aaacgatcaataguctaaaagtgggcut

SEQ ID NO: 51706 - DNA, 19 bp, Artificial Sequence
  Synthetic
cccaggugagggagaagug

SEQ ID NO: 51707 - DNA, 20 bp, Artificial Sequence
  Synthetic
ttgagctttcuggccctcug

SEQ ID NO: 51708 - DNA, 22 bp, Artificial Sequence
  Synthetic
gctccagctugaccttagacut

SEQ ID NO: 51709 - DNA, 22 bp, Artificial Sequence
  Synthetic
ccatagatguctccaggcuggt

SEQ ID NO: 51710 - DNA, 20 bp, Artificial Sequence
  Synthetic
gcgtccguctcatactuggt

SEQ ID NO: 51711 - DNA, 21 bp, Artificial Sequence
  Synthetic
ggagaaagcugaacccaccuc

SEQ ID NO: 51712 - DNA, 25 bp, Artificial Sequence
  Synthetic
actcagggaaccuttgatagucagt

SEQ ID NO: 51713 - DNA, 28 bp, Artificial Sequence
  Synthetic
agaactcgtaugctaattgagucaaaca

SEQ ID NO: 51714 - DNA, 21 bp, Artificial Sequence
  Synthetic
ggagaauaccgagagcuggga

SEQ ID NO: 51715 - DNA, 22 bp, Artificial Sequence
  Synthetic
gcttgtatcugggcaggtcaua

SEQ ID NO: 51716 - DNA, 28 bp, Artificial Sequence
  Synthetic
aagatatttgugaaagtccaccatucct

SEQ ID NO: 51717 - DNA, 21 bp, Artificial Sequence
  Synthetic
tcagcuccaagactctcugct

SEQ ID NO: 51718 - DNA, 27 bp, Artificial Sequence
  Synthetic
agtgcacaaagutctgtttttcttucc

SEQ ID NO: 51719 - DNA, 23 bp, Artificial Sequence
  Synthetic
gcaaaggcaguttcagagacuga

SEQ ID NO: 51720 - DNA, 23 bp, Artificial Sequence
  Synthetic
ggtgatctugttgaaggtugggt

SEQ ID NO: 51721 - DNA, 22 bp, Artificial Sequence
  Synthetic
atccctgaucactgggagucat

SEQ ID NO: 51722 - DNA, 23 bp, Artificial Sequence
  Synthetic
cagaagcauacagggauagcact

SEQ ID NO: 51723 - DNA, 24 bp, Artificial Sequence
  Synthetic
cgagcatgguatcatcaccaacug

SEQ ID NO: 51724 - DNA, 21 bp, Artificial Sequence
  Synthetic
gggagucccgttgtcucaaag

SEQ ID NO: 51725 - DNA, 20 bp, Artificial Sequence
  Synthetic
actgggcacccugtatgtug

SEQ ID NO: 51726 - DNA, 27 bp, Artificial Sequence
  Synthetic
agacaaaggaaacacaautacctucca

SEQ ID NO: 51727 - DNA, 28 bp, Artificial Sequence
  Synthetic
ggcagaguaacaactaaagattccugaa

SEQ ID NO: 51728 - DNA, 25 bp, Artificial Sequence
  Synthetic
agtagcgaugaaaacaaaacucaga

SEQ ID NO: 51729 - DNA, 20 bp, Artificial Sequence
  Synthetic
gcaacccuggctaccatuca

SEQ ID NO: 51730 - DNA, 26 bp, Artificial Sequence
  Synthetic
ctccctgtgaagutatatgacagcut

SEQ ID NO: 51731 - DNA, 28 bp, Artificial Sequence
  Synthetic
tcagaactgcaaaguctggatattgtua

SEQ ID NO: 51732 - DNA, 27 bp, Artificial Sequence
  Synthetic
aattctttugcaggaaaagctgacaut

SEQ ID NO: 51733 - DNA, 25 bp, Artificial Sequence
  Synthetic
cgaatcaaguccttgcattaaugga

SEQ ID NO: 51734 - DNA, 23 bp, Artificial Sequence
  Synthetic
gggtgtcutatgtatgaaugcgt

SEQ ID NO: 51735 - DNA, 25 bp, Artificial Sequence
  Synthetic
atgtctgggtugcagttaaaccuaa

SEQ ID NO: 51736 - DNA, 24 bp, Artificial Sequence
  Synthetic
cagaaagcaagcacaauccacaut

SEQ ID NO: 51737 - DNA, 24 bp, Artificial Sequence
  Synthetic
gcagacctcguccttcttcataut

SEQ ID NO: 51738 - DNA, 21 bp, Artificial Sequence
  Synthetic
ccucagcaatucacagcggaa

SEQ ID NO: 51739 - DNA, 21 bp, Artificial Sequence
  Synthetic
gggaauacagggcccaatcug

SEQ ID NO: 51740 - DNA, 21 bp, Artificial Sequence
  Synthetic
gggctaggugagagtucaagt

SEQ ID NO: 51741 - DNA, 23 bp, Artificial Sequence
  Synthetic
cctttgcugagcgcttactaaug

SEQ ID NO: 51742 - DNA, 21 bp, Artificial Sequence
  Synthetic
gctctugggagtccacaucag

SEQ ID NO: 51743 - DNA, 22 bp, Artificial Sequence
  Synthetic
tgtggaattucagcagtgcugt

SEQ ID NO: 51744 - DNA, 21 bp, Artificial Sequence
  Synthetic
ggagagguttcatgccuggat

SEQ ID NO: 51745 - DNA, 19 bp, Artificial Sequence
  Synthetic
cccatcaagcucgcctguc

SEQ ID NO: 51746 - DNA, 23 bp, Artificial Sequence
  Synthetic
gacgatagccugaaaaaccucca

SEQ ID NO: 51747 - DNA, 21 bp, Artificial Sequence
  Synthetic
cuagaagacagggagcgugaa

SEQ ID NO: 51748 - DNA, 18 bp, Artificial Sequence
  Synthetic
caccctgugcgtgggaut

SEQ ID NO: 51749 - DNA, 19 bp, Artificial Sequence
  Synthetic
gggcctucctgaacacugg

SEQ ID NO: 51750 - DNA, 17 bp, Artificial Sequence
  Synthetic
cccagcucctgcacgua

SEQ ID NO: 51751 - DNA, 18 bp, Artificial Sequence
  Synthetic
gcgucuacgccaaggaca

SEQ ID NO: 51752 - DNA, 21 bp, Artificial Sequence
  Synthetic
ctgagaggugcacagtgtcut

SEQ ID NO: 51753 - DNA, 17 bp, Artificial Sequence
  Synthetic
gcagcaggugcuggaca

SEQ ID NO: 51754 - DNA, 19 bp, Artificial Sequence
  Synthetic
gggtgguaaatggcucgga

SEQ ID NO: 51755 - DNA, 17 bp, Artificial Sequence
  Synthetic
gccgacugcaccaugga

SEQ ID NO: 51756 - DNA, 19 bp, Artificial Sequence
  Synthetic
agcacggucaggagguact

SEQ ID NO: 51757 - DNA, 18 bp, Artificial Sequence
  Synthetic
cagcccucagtgctgcua

SEQ ID NO: 51758 - DNA, 20 bp, Artificial Sequence
  Synthetic
ccaggucccctggatgaugt

SEQ ID NO: 51759 - DNA, 25 bp, Artificial Sequence
  Synthetic
cccttcuagaggctttgacuaacca

SEQ ID NO: 51760 - DNA, 20 bp, Artificial Sequence
  Synthetic
aggccacacacguguacaag

SEQ ID NO: 51761 - DNA, 23 bp, Artificial Sequence
  Synthetic
tcaacuacaccaacgagaagcug

SEQ ID NO: 51762 - DNA, 22 bp, Artificial Sequence
  Synthetic
caccgagcugtaccucaaagat

SEQ ID NO: 51763 - DNA, 23 bp, Artificial Sequence
  Synthetic
gcccattgagaauaaccgggtuc

SEQ ID NO: 51764 - DNA, 21 bp, Artificial Sequence
  Synthetic
ggcaccaaaaggugtaccuga

SEQ ID NO: 51765 - DNA, 22 bp, Artificial Sequence
  Synthetic
cacttggccgguatgtatguct

SEQ ID NO: 51766 - DNA, 19 bp, Artificial Sequence
  Synthetic
ccaccaccacaccuaccuc

SEQ ID NO: 51767 - DNA, 25 bp, Artificial Sequence
  Synthetic
gctgatggucacagtttctgtttuc

SEQ ID NO: 51768 - DNA, 18 bp, Artificial Sequence
  Synthetic
cagctugggccccattuc

SEQ ID NO: 51769 - DNA, 22 bp, Artificial Sequence
  Synthetic
gtcctgtuagcgactcgaauct

SEQ ID NO: 51770 - DNA, 21 bp, Artificial Sequence
  Synthetic
agaaaaugaucgcaccgcaga

SEQ ID NO: 51771 - DNA, 23 bp, Artificial Sequence
  Synthetic
caaaccucagcugaaaagcaact

SEQ ID NO: 51772 - DNA, 21 bp, Artificial Sequence
  Synthetic
cgacgttgutcttggctguca

SEQ ID NO: 51773 - DNA, 23 bp, Artificial Sequence
  Synthetic
gatttcuaacctgcuggagacct

SEQ ID NO: 51774 - DNA, 27 bp, Artificial Sequence
  Synthetic
tggtaaaatcccauggtcaattgaugt

SEQ ID NO: 51775 - DNA, 26 bp, Artificial Sequence
  Synthetic
cgctgatgccutttcaactaaactua

SEQ ID NO: 51776 - DNA, 21 bp, Artificial Sequence
  Synthetic
gacccagugcctcatgtcaut

SEQ ID NO: 51777 - DNA, 24 bp, Artificial Sequence
  Synthetic
ctgaaatcugaacagacugagcca

SEQ ID NO: 51778 - DNA, 18 bp, Artificial Sequence
  Synthetic
agacagtggugggccuct

SEQ ID NO: 51779 - DNA, 18 bp, Artificial Sequence
  Synthetic
cccaccccggugtttucc

SEQ ID NO: 51780 - DNA, 20 bp, Artificial Sequence
  Synthetic
ccctugacacagcggaaguc

SEQ ID NO: 51781 - DNA, 22 bp, Artificial Sequence
  Synthetic
gagaggcaaauttcagggcuct

SEQ ID NO: 51782 - DNA, 20 bp, Artificial Sequence
  Synthetic
cccaccaauacgcctctuct

SEQ ID NO: 51783 - DNA, 18 bp, Artificial Sequence
  Synthetic
gtggguaacgggcguagt

SEQ ID NO: 51784 - DNA, 24 bp, Artificial Sequence
  Synthetic
cgcaaatttccutccactcggaua

SEQ ID NO: 51785 - DNA, 22 bp, Artificial Sequence
  Synthetic
ggccatcuacaagcagucacag

SEQ ID NO: 51786 - DNA, 18 bp, Artificial Sequence
  Synthetic
ctggaggugggaccugag

SEQ ID NO: 51787 - DNA, 19 bp, Artificial Sequence
  Synthetic
ccacccucaccuccgagaa

SEQ ID NO: 51788 - DNA, 24 bp, Artificial Sequence
  Synthetic
catcacagtgugacttgcattucc

SEQ ID NO: 51789 - DNA, 25 bp, Artificial Sequence
  Synthetic
acatttgtgaaaacacutgctgguc

SEQ ID NO: 51790 - DNA, 28 bp, Artificial Sequence
  Synthetic
tgtggaagagauccaaaacatcaugaaa

SEQ ID NO: 51791 - DNA, 21 bp, Artificial Sequence
  Synthetic
cgtagtatgugcgcctgagug

SEQ ID NO: 51792 - DNA, 22 bp, Artificial Sequence
  Synthetic
gcacatggugttctgtctcuct

SEQ ID NO: 51793 - DNA, 24 bp, Artificial Sequence
  Synthetic
catgtcatcagucacaatctuggg

SEQ ID NO: 51794 - DNA, 21 bp, Artificial Sequence
  Synthetic
gautcctcugaaccccaccat

SEQ ID NO: 51795 - DNA, 26 bp, Artificial Sequence
  Synthetic
ctaagtggaguagctttgtggttcut

SEQ ID NO: 51796 - DNA, 21 bp, Artificial Sequence
  Synthetic
gggcatagugtgagagauggg

SEQ ID NO: 51797 - DNA, 23 bp, Artificial Sequence
  Synthetic
cttcagatgcugagtgaggauga

SEQ ID NO: 51798 - DNA, 25 bp, Artificial Sequence
  Synthetic
cgctacaacuatacaacucccaagt

SEQ ID NO: 51799 - DNA, 22 bp, Artificial Sequence
  Synthetic
gatcccuccagttcacuggaaa

SEQ ID NO: 51800 - DNA, 24 bp, Artificial Sequence
  Synthetic
tgtgtctuccaataagcgttucca

SEQ ID NO: 51801 - DNA, 28 bp, Artificial Sequence
  Synthetic
ccctgactcaggauatctatctgatuct

SEQ ID NO: 51802 - DNA, 20 bp, Artificial Sequence
  Synthetic
gcagcggguccagaatctuc

SEQ ID NO: 51803 - DNA, 22 bp, Artificial Sequence
  Synthetic
tgctgatactuggcgaggttut

SEQ ID NO: 51804 - DNA, 19 bp, Artificial Sequence
  Synthetic
agtgcugcccaaagaccuc

SEQ ID NO: 51805 - DNA, 19 bp, Artificial Sequence
  Synthetic
acucagggccgugagagaa

SEQ ID NO: 51806 - DNA, 20 bp, Artificial Sequence
  Synthetic
catgauccttcggucacgca

SEQ ID NO: 51807 - DNA, 21 bp, Artificial Sequence
  Synthetic
gctgcuggagaccttgaaugt

SEQ ID NO: 51808 - DNA, 19 bp, Artificial Sequence
  Synthetic
tcccccacccuctucaaga

SEQ ID NO: 51809 - DNA, 20 bp, Artificial Sequence
  Synthetic
ctgggcgaggugatcttcug

SEQ ID NO: 51810 - DNA, 30 bp, Artificial Sequence
  Synthetic
tggagcaaaaguaatacgtaaauggaaagt

SEQ ID NO: 51811 - DNA, 27 bp, Artificial Sequence
  Synthetic
ggttgtaactuaccttttccaggcuat

SEQ ID NO: 51812 - DNA, 27 bp, Artificial Sequence
  Synthetic
gggtaggatgugatattccttctagug

SEQ ID NO: 51813 - DNA, 27 bp, Artificial Sequence
  Synthetic
agaaaaaguacagaagaagcugaccat

SEQ ID NO: 51814 - DNA, 24 bp, Artificial Sequence
  Synthetic
ggtttgttgttuttcctggcttug

SEQ ID NO: 51815 - DNA, 26 bp, Artificial Sequence
  Synthetic
ttcccaggacaguctaugaaaacaag

SEQ ID NO: 51816 - DNA, 21 bp, Artificial Sequence
  Synthetic
gggauggaggaggactcacut

SEQ ID NO: 51817 - DNA, 22 bp, Artificial Sequence
  Synthetic
cataccacucaggtctgaugcc

SEQ ID NO: 51818 - DNA, 18 bp, Artificial Sequence
  Synthetic
ctcaccagugccctcgut

SEQ ID NO: 51819 - DNA, 20 bp, Artificial Sequence
  Synthetic
cctcaccccuttccaccuct

SEQ ID NO: 51820 - DNA, 25 bp, Artificial Sequence
  Synthetic
cctgtggattucctctccaaagtut

SEQ ID NO: 51821 - DNA, 21 bp, Artificial Sequence
  Synthetic
ctgcacgtugggtgtgattuc

SEQ ID NO: 51822 - DNA, 19 bp, Artificial Sequence
  Synthetic
cagaggcaucaagccugga

SEQ ID NO: 51823 - DNA, 18 bp, Artificial Sequence
  Synthetic
ccatucaccgccctgcut

SEQ ID NO: 51824 - DNA, 19 bp, Artificial Sequence
  Synthetic
aggagugggacugaagcct

SEQ ID NO: 51825 - DNA, 22 bp, Artificial Sequence
  Synthetic
ccccttugccactttcuaacct

SEQ ID NO: 51826 - DNA, 21 bp, Artificial Sequence
  Synthetic
catcugaccaggagctccaut

SEQ ID NO: 51827 - DNA, 26 bp, Artificial Sequence
  Synthetic
aggttcttaccutctacctcttucct

SEQ ID NO: 51828 - DNA, 21 bp, Artificial Sequence
  Synthetic
cccaaatguggtggaguggaa

SEQ ID NO: 51829 - DNA, 25 bp, Artificial Sequence
  Synthetic
gtcttcctuacctcttccctucaat

SEQ ID NO: 51830 - DNA, 19 bp, Artificial Sequence
  Synthetic
acggcgagagucggagaua

SEQ ID NO: 51831 - DNA, 25 bp, Artificial Sequence
  Synthetic
ggagacatggutagtgctttaugct

SEQ ID NO: 51832 - DNA, 18 bp, Artificial Sequence
  Synthetic
cacccgcucacaguacga

SEQ ID NO: 51833 - DNA, 20 bp, Artificial Sequence
  Synthetic
caaggtcgagugagctgugt

SEQ ID NO: 51834 - DNA, 20 bp, Artificial Sequence
  Synthetic
ctgcuggagaagagucacga

SEQ ID NO: 51835 - DNA, 21 bp, Artificial Sequence
  Synthetic
tctagatgccuggccatggua

SEQ ID NO: 51836 - DNA, 24 bp, Artificial Sequence
  Synthetic
gctccttgtcuccaggaacaaaug

SEQ ID NO: 51837 - DNA, 26 bp, Artificial Sequence
  Synthetic
ctcaggatgagcuggttgaagtatut

SEQ ID NO: 51838 - DNA, 22 bp, Artificial Sequence
  Synthetic
ccacctcuacacactgtuccac

SEQ ID NO: 51839 - DNA, 21 bp, Artificial Sequence
  Synthetic
aggcccaaaugttgtcucact

SEQ ID NO: 51840 - DNA, 22 bp, Artificial Sequence
  Synthetic
gcccagaauccucaaagcaaca

SEQ ID NO: 51841 - DNA, 19 bp, Artificial Sequence
  Synthetic
tguccacacccccaccaua

SEQ ID NO: 51842 - DNA, 24 bp, Artificial Sequence
  Synthetic
ctccacattcuctgccttttcauc

SEQ ID NO: 51843 - DNA, 18 bp, Artificial Sequence
  Synthetic
cgatcccugtgccacuct

SEQ ID NO: 51844 - DNA, 20 bp, Artificial Sequence
  Synthetic
gctgagagcutcggctucaa

SEQ ID NO: 51845 - DNA, 18 bp, Artificial Sequence
  Synthetic
gctgcuctgccucacagg

SEQ ID NO: 51846 - DNA, 21 bp, Artificial Sequence
  Synthetic
tctctgagaggugcctuccaa

SEQ ID NO: 51847 - DNA, 24 bp, Artificial Sequence
  Synthetic
tctcgtgguctagttcatcaucct

SEQ ID NO: 51848 - DNA, 20 bp, Artificial Sequence
  Synthetic
gcacccguccagtgguaaac

SEQ ID NO: 51849 - DNA, 24 bp, Artificial Sequence
  Synthetic
gctccctttcucctgcagaaauaa

SEQ ID NO: 51850 - DNA, 28 bp, Artificial Sequence
  Synthetic
ttcccttttagacaaugaagcctcauag

SEQ ID NO: 51851 - DNA, 24 bp, Artificial Sequence
  Synthetic
tgccgcacuaaatgaggatgttua

SEQ ID NO: 51852 - DNA, 25 bp, Artificial Sequence
  Synthetic
gagttggactautcagtgctgcuat

SEQ ID NO: 51853 - DNA, 27 bp, Artificial Sequence
  Synthetic
ctaatcgacttgugaaaagctgcttua

SEQ ID NO: 51854 - DNA, 26 bp, Artificial Sequence
  Synthetic
acaatcagggutttagttgtccugaa

SEQ ID NO: 51855 - DNA, 25 bp, Artificial Sequence
  Synthetic
agcacaacagaguggctttuaaaga

SEQ ID NO: 51856 - DNA, 28 bp, Artificial Sequence
  Synthetic
cagttaccagatucccactgaaaatuct

SEQ ID NO: 51857 - DNA, 27 bp, Artificial Sequence
  Synthetic
cactgctaattaaacuctgggtcagut

SEQ ID NO: 51858 - DNA, 22 bp, Artificial Sequence
  Synthetic
ccatgccauttgtttccuccat

SEQ ID NO: 51859 - DNA, 26 bp, Artificial Sequence
  Synthetic
caaaacaacccucgaaggtctgtaua

SEQ ID NO: 51860 - DNA, 21 bp, Artificial Sequence
  Synthetic
gctuagccagagcaggactut

SEQ ID NO: 51861 - DNA, 28 bp, Artificial Sequence
  Synthetic
atagtctctugggttatcgagguagaat

SEQ ID NO: 51862 - DNA, 22 bp, Artificial Sequence
  Synthetic
gtaaacccuggcttgactugga

SEQ ID NO: 51863 - DNA, 21 bp, Artificial Sequence
  Synthetic
acctucaccagctcaaauggg

SEQ ID NO: 51864 - DNA, 20 bp, Artificial Sequence
  Synthetic
gaggccgugtatgggaugac

SEQ ID NO: 51865 - DNA, 21 bp, Artificial Sequence
  Synthetic
aaataagcccccucccugaga

SEQ ID NO: 51866 - DNA, 21 bp, Artificial Sequence
  Synthetic
aggagttgucaggagcaggua

SEQ ID NO: 51867 - DNA, 20 bp, Artificial Sequence
  Synthetic
gagcttgagcugctcctuga

SEQ ID NO: 51868 - DNA, 22 bp, Artificial Sequence
  Synthetic
caacagtuccccaaagccctua

SEQ ID NO: 51869 - DNA, 24 bp, Artificial Sequence
  Synthetic
gactgctucaaactcgaaguacca

SEQ ID NO: 51870 - DNA, 20 bp, Artificial Sequence
  Synthetic
gtctgacucaggcuccgaaa

SEQ ID NO: 51871 - DNA, 17 bp, Artificial Sequence
  Synthetic
caggaagccugguggga

SEQ ID NO: 51872 - DNA, 21 bp, Artificial Sequence
  Synthetic
gcctgaggucttcacugagga

SEQ ID NO: 51873 - DNA, 21 bp, Artificial Sequence
  Synthetic
gcagcccaccugtaactucac

SEQ ID NO: 51874 - DNA, 22 bp, Artificial Sequence
  Synthetic
cctccccuccatctctagaucc

SEQ ID NO: 51875 - DNA, 24 bp, Artificial Sequence
  Synthetic
ggtttcatttugaccctcaaugct

SEQ ID NO: 51876 - DNA, 19 bp, Artificial Sequence
  Synthetic
gcutgtcttgugagcgcat

SEQ ID NO: 51877 - DNA, 22 bp, Artificial Sequence
  Synthetic
tttcacccaccccaucttctuc

SEQ ID NO: 51878 - DNA, 21 bp, Artificial Sequence
  Synthetic
ctgagguccagcagguaacag

SEQ ID NO: 51879 - DNA, 25 bp, Artificial Sequence
  Synthetic
cttaacaagaagagguccacucgaa

SEQ ID NO: 51880 - DNA, 23 bp, Artificial Sequence
  Synthetic
ctgguggagggaagtguaaaact

SEQ ID NO: 51881 - DNA, 18 bp, Artificial Sequence
  Synthetic
ccccaaggccacucacuc

SEQ ID NO: 51882 - DNA, 28 bp, Artificial Sequence
  Synthetic
cggcggagttuatagataagttggaaut

SEQ ID NO: 51883 - DNA, 21 bp, Artificial Sequence
  Synthetic
gtggaggcacagauagacgug

SEQ ID NO: 51884 - DNA, 18 bp, Artificial Sequence
  Synthetic
gggagagcgguaccacut

SEQ ID NO: 51885 - DNA, 19 bp, Artificial Sequence
  Synthetic
tccuggacccucagacagg

SEQ ID NO: 51886 - DNA, 21 bp, Artificial Sequence
  Synthetic
gatgaccugagggtcctgtut

SEQ ID NO: 51887 - DNA, 22 bp, Artificial Sequence
  Synthetic
ggcagautgatctucagagcca

SEQ ID NO: 51888 - DNA, 20 bp, Artificial Sequence
  Synthetic
gggattaggcuggagcuaca

SEQ ID NO: 51889 - DNA, 18 bp, Artificial Sequence
  Synthetic
gtgctuggaggcgtucag

SEQ ID NO: 51890 - DNA, 20 bp, Artificial Sequence
  Synthetic
ggcatccggcugaagaagua

SEQ ID NO: 51891 - DNA, 21 bp, Artificial Sequence
  Synthetic
cccccttaugcttctccgtut

SEQ ID NO: 51892 - DNA, 26 bp, Artificial Sequence
  Synthetic
ttaaagttucggaagagctuccagat

SEQ ID NO: 51893 - DNA, 19 bp, Artificial Sequence
  Synthetic
ggagaaggaugggctgcug

SEQ ID NO: 51894 - DNA, 27 bp, Artificial Sequence
  Synthetic
tctagagatttcacugtgtctgcatug

SEQ ID NO: 51895 - DNA, 21 bp, Artificial Sequence
  Synthetic
ggccaccuccgttgtgaauaa

SEQ ID NO: 51896 - DNA, 21 bp, Artificial Sequence
  Synthetic
gatcctcauccagcaggtgut

SEQ ID NO: 51897 - DNA, 21 bp, Artificial Sequence
  Synthetic
acagggagacutcagtgcuca

SEQ ID NO: 51898 - DNA, 17 bp, Artificial Sequence
  Synthetic
ccccacugccctgugag

SEQ ID NO: 51899 - DNA, 18 bp, Artificial Sequence
  Synthetic
ctgcccugaccacctgut

SEQ ID NO: 51900 - DNA, 18 bp, Artificial Sequence
  Synthetic
cgggtucgggttcagcua

SEQ ID NO: 51901 - DNA, 17 bp, Artificial Sequence
  Synthetic
gccgaccacgcucacuc

SEQ ID NO: 51902 - DNA, 21 bp, Artificial Sequence
  Synthetic
gtaggtcgutcccttuccaca

SEQ ID NO: 51903 - DNA, 22 bp, Artificial Sequence
  Synthetic
cgggcaagcuttgtgactuaga

SEQ ID NO: 51904 - DNA, 26 bp, Artificial Sequence
  Synthetic
tttaacattcacugctgatccucact

SEQ ID NO: 51905 - DNA, 22 bp, Artificial Sequence
  Synthetic
tgttttggcagauttcggccua

SEQ ID NO: 51906 - DNA, 24 bp, Artificial Sequence
  Synthetic
agggtaaaucctgaagccuacagt

SEQ ID NO: 51907 - DNA, 24 bp, Artificial Sequence
  Synthetic
aaatgcactaucccatgguggaat

SEQ ID NO: 51908 - DNA, 23 bp, Artificial Sequence
  Synthetic
acaggtattguaggccaggcuaa

SEQ ID NO: 51909 - DNA, 24 bp, Artificial Sequence
  Synthetic
tgaatttgaccuccttgccttuct

SEQ ID NO: 51910 - DNA, 29 bp, Artificial Sequence
  Synthetic
ccatggaggguactgaaataaattcuaca

SEQ ID NO: 51911 - DNA, 20 bp, Artificial Sequence
  Synthetic
cgcctguggaaagggugaag

SEQ ID NO: 51912 - DNA, 24 bp, Artificial Sequence
  Synthetic
cutcaaagtcctuagcacagaggt

SEQ ID NO: 51913 - DNA, 25 bp, Artificial Sequence
  Synthetic
aggaggtttcacugttaggaagcua

SEQ ID NO: 51914 - DNA, 29 bp, Artificial Sequence
  Synthetic
ccttgagagcautatgttttgtctguaac

SEQ ID NO: 51915 - DNA, 28 bp, Artificial Sequence
  Synthetic
tcagaatgaagacaaugagggtactgua

SEQ ID NO: 51916 - DNA, 26 bp, Artificial Sequence
  Synthetic
actctcttgggutgttttcttuggat

SEQ ID NO: 51917 - DNA, 28 bp, Artificial Sequence
  Synthetic
ggcatgagtuattgtcatactuggagaa

SEQ ID NO: 51918 - DNA, 25 bp, Artificial Sequence
  Synthetic
agttttcuccaaacctccctucaag

SEQ ID NO: 51919 - DNA, 27 bp, Artificial Sequence
  Synthetic
aaattgagtgtauctgatccccaugag

SEQ ID NO: 51920 - DNA, 24 bp, Artificial Sequence
  Synthetic
gcagtagtugtcatctgcuccaat

SEQ ID NO: 51921 - DNA, 26 bp, Artificial Sequence
  Synthetic
tcatttctttcaguctgtgggtucag

SEQ ID NO: 51922 - DNA, 25 bp, Artificial Sequence
  Synthetic
aaaatccaaccaguctccctugaaa

SEQ ID NO: 51923 - DNA, 29 bp, Artificial Sequence
  Synthetic
gaagtacaagagcagaugaatctccuaaa

SEQ ID NO: 51924 - DNA, 21 bp, Artificial Sequence
  Synthetic
caggagcugatugggaagacc

SEQ ID NO: 51925 - DNA, 25 bp, Artificial Sequence
  Synthetic
acgguaagaccagctttttgtucat

SEQ ID NO: 51926 - DNA, 18 bp, Artificial Sequence
  Synthetic
cccuccacagagccacut

SEQ ID NO: 51927 - DNA, 19 bp, Artificial Sequence
  Synthetic
cagtgguccagaacgucca

SEQ ID NO: 51928 - DNA, 22 bp, Artificial Sequence
  Synthetic
tgctttccccaauctggtctuc

SEQ ID NO: 51929 - DNA, 20 bp, Artificial Sequence
  Synthetic
gattcugccacgcucaggat

SEQ ID NO: 51930 - DNA, 21 bp, Artificial Sequence
  Synthetic
gctacaacccacucacccuct

SEQ ID NO: 51931 - DNA, 21 bp, Artificial Sequence
  Synthetic
ggtcccuccagcattccuagt

SEQ ID NO: 51932 - DNA, 22 bp, Artificial Sequence
  Synthetic
gggcutggtgttuagaagaaca

SEQ ID NO: 51933 - DNA, 27 bp, Artificial Sequence
  Synthetic
gutctcctctaucacagaaaagacact

SEQ ID NO: 51934 - DNA, 27 bp, Artificial Sequence
  Synthetic
ttttggtgtguttgtctcagatugaac

SEQ ID NO: 51935 - DNA, 29 bp, Artificial Sequence
  Synthetic
gtccattttccucactatattcugcaaga

SEQ ID NO: 51936 - DNA, 23 bp, Artificial Sequence
  Synthetic
ggagcacaucgggaaagaugaaa

SEQ ID NO: 51937 - DNA, 24 bp, Artificial Sequence
  Synthetic
tggccgauctttactttuccagaa

SEQ ID NO: 51938 - DNA, 25 bp, Artificial Sequence
  Synthetic
gaaugttttctgaaguagcccagga

SEQ ID NO: 51939 - DNA, 22 bp, Artificial Sequence
  Synthetic
ggtactugggctgcttttugac

SEQ ID NO: 51940 - DNA, 23 bp, Artificial Sequence
  Synthetic
cagagtgacutgccctcaguaat

SEQ ID NO: 51941 - DNA, 27 bp, Artificial Sequence
  Synthetic
ctgacactccaaaguacttactgtcut

SEQ ID NO: 51942 - DNA, 24 bp, Artificial Sequence
  Synthetic
gaaguatcucccgaacagaaacga

SEQ ID NO: 51943 - DNA, 25 bp, Artificial Sequence
  Synthetic
ttggtgguacaggttttagttcugg

SEQ ID NO: 51944 - DNA, 27 bp, Artificial Sequence
  Synthetic
gatcttctggaugtagtggcaagtaut

SEQ ID NO: 51945 - DNA, 27 bp, Artificial Sequence
  Synthetic
acaggcttccaauatgttaggtctcua

SEQ ID NO: 51946 - DNA, 27 bp, Artificial Sequence
  Synthetic
ccataataacutaagctgaugcccagt

SEQ ID NO: 51947 - DNA, 28 bp, Artificial Sequence
  Synthetic
gctgctgtattcucgaggattactaaut

SEQ ID NO: 51948 - DNA, 21 bp, Artificial Sequence
  Synthetic
gggctccuaagcttgggatut

SEQ ID NO: 51949 - DNA, 28 bp, Artificial Sequence
  Synthetic
ggattctagccacuctaacactttacut

SEQ ID NO: 51950 - DNA, 28 bp, Artificial Sequence
  Synthetic
ctgtctguggagattatgaagtaucacc

SEQ ID NO: 51951 - DNA, 28 bp, Artificial Sequence
  Synthetic
tccatagcaagautttcattgactucct

SEQ ID NO: 51952 - DNA, 23 bp, Artificial Sequence
  Synthetic
tccaagccaggaauaaagctugt

SEQ ID NO: 51953 - DNA, 27 bp, Artificial Sequence
  Synthetic
cttctcugccaccttatgttauaccaa

SEQ ID NO: 51954 - DNA, 21 bp, Artificial Sequence
  Synthetic
catugcacagactcugaggga

SEQ ID NO: 51955 - DNA, 28 bp, Artificial Sequence
  Synthetic
agcagcaccatuaagtatctagacttug

SEQ ID NO: 51956 - DNA, 24 bp, Artificial Sequence
  Synthetic
tctccaagggagaugagcuagaag

SEQ ID NO: 51957 - DNA, 23 bp, Artificial Sequence
  Synthetic
ctaaccacagugagcaguagaca

SEQ ID NO: 51958 - DNA, 22 bp, Artificial Sequence
  Synthetic
cagtaccacautctggugagca

SEQ ID NO: 51959 - DNA, 21 bp, Artificial Sequence
  Synthetic
gcctgautcagcctuggacat

SEQ ID NO: 51960 - DNA, 21 bp, Artificial Sequence
  Synthetic
gagtttcuggcacccactuga

SEQ ID NO: 51961 - DNA, 19 bp, Artificial Sequence
  Synthetic
tctccuagctcccugcgaa

SEQ ID NO: 51962 - DNA, 20 bp, Artificial Sequence
  Synthetic
ggaggaccgggcautcuaag

SEQ ID NO: 51963 - DNA, 28 bp, Artificial Sequence
  Synthetic
cagagggaaactutgaaccatgagtaut

SEQ ID NO: 51964 - DNA, 25 bp, Artificial Sequence
  Synthetic
ggagggaacgaaugatggaugaaag

SEQ ID NO: 51965 - DNA, 20 bp, Artificial Sequence
  Synthetic
ctggttcugagctccgtcug

SEQ ID NO: 51966 - DNA, 23 bp, Artificial Sequence
  Synthetic
caacagatccugcagctctuagt

SEQ ID NO: 51967 - DNA, 27 bp, Artificial Sequence
  Synthetic
tgaactcttcccugaagaaactttguc

SEQ ID NO: 51968 - DNA, 21 bp, Artificial Sequence
  Synthetic
cgcaaggttuccagttgccua

SEQ ID NO: 51969 - DNA, 21 bp, Artificial Sequence
  Synthetic
ggtagactutgtgggcuccat

SEQ ID NO: 51970 - DNA, 21 bp, Artificial Sequence
  Synthetic
ccttctccutcttgccacugt

SEQ ID NO: 51971 - DNA, 18 bp, Artificial Sequence
  Synthetic
tgctctcacucgcaccug

SEQ ID NO: 51972 - DNA, 24 bp, Artificial Sequence
  Synthetic
gctcaagccucttactctcaaugg

SEQ ID NO: 51973 - DNA, 22 bp, Artificial Sequence
  Synthetic
tcttggtggugggtaagtccua

SEQ ID NO: 51974 - DNA, 22 bp, Artificial Sequence
  Synthetic
gttctugaggaagcctggagut

SEQ ID NO: 51975 - DNA, 23 bp, Artificial Sequence
  Synthetic
acctctacttugccaatgtgcuc

SEQ ID NO: 51976 - DNA, 24 bp, Artificial Sequence
  Synthetic
gagctgaatugaactggaggaugt

SEQ ID NO: 51977 - DNA, 21 bp, Artificial Sequence
  Synthetic
cccagatgccauctctctguc

SEQ ID NO: 51978 - DNA, 20 bp, Artificial Sequence
  Synthetic
cggagaacaagucggctgug

SEQ ID NO: 51979 - DNA, 21 bp, Artificial Sequence
  Synthetic
aatgaagtccgucagggctut

SEQ ID NO: 51980 - DNA, 21 bp, Artificial Sequence
  Synthetic
tgggccacauagtggtacuga

SEQ ID NO: 51981 - DNA, 24 bp, Artificial Sequence
  Synthetic
agaaagtaaguttgcacagugcct

SEQ ID NO: 51982 - DNA, 23 bp, Artificial Sequence
  Synthetic
tccagcgucagtattttgauggt

SEQ ID NO: 51983 - DNA, 22 bp, Artificial Sequence
  Synthetic
acautccaaacugaggacagca

SEQ ID NO: 51984 - DNA, 26 bp, Artificial Sequence
  Synthetic
tcacgctuccccaaatttcttauagg

SEQ ID NO: 51985 - DNA, 29 bp, Artificial Sequence
  Synthetic
actatgaaaacaaacugacaaacctcuct

SEQ ID NO: 51986 - DNA, 25 bp, Artificial Sequence
  Synthetic
gttattgttugggagggaagagcua

SEQ ID NO: 51987 - DNA, 28 bp, Artificial Sequence
  Synthetic
aagtgagaacugactgctttcauagaaa

SEQ ID NO: 51988 - DNA, 21 bp, Artificial Sequence
  Synthetic
gcaggctcuctagcatcucaa

SEQ ID NO: 51989 - DNA, 26 bp, Artificial Sequence
  Synthetic
acacttcaccuctgagcataucaaac

SEQ ID NO: 51990 - DNA, 20 bp, Artificial Sequence
  Synthetic
gggcuaaccccaccctcaua

SEQ ID NO: 51991 - DNA, 22 bp, Artificial Sequence
  Synthetic
accatgctaucaccaagcacuc

SEQ ID NO: 51992 - DNA, 20 bp, Artificial Sequence
  Synthetic
acctccaauccagcaccuct

SEQ ID NO: 51993 - DNA, 23 bp, Artificial Sequence
  Synthetic
gcagcctcaguactctcattucc

SEQ ID NO: 51994 - DNA, 26 bp, Artificial Sequence
  Synthetic
gtatcctcugcaggaaagttctacuc

SEQ ID NO: 51995 - DNA, 22 bp, Artificial Sequence
  Synthetic
gtgaauaggcgttctcauccct

SEQ ID NO: 51996 - DNA, 20 bp, Artificial Sequence
  Synthetic
ctgacgcugctgaagacgua

SEQ ID NO: 51997 - DNA, 21 bp, Artificial Sequence
  Synthetic
acccctgaaucaaagctgugt

SEQ ID NO: 51998 - DNA, 27 bp, Artificial Sequence
  Synthetic
tcaactcactugagtcagaatttuggt

SEQ ID NO: 51999 - DNA, 27 bp, Artificial Sequence
  Synthetic
ccacaatccauaacttctcatuaccct

SEQ ID NO: 52000 - DNA, 28 bp, Artificial Sequence
  Synthetic
ggaggatucacttaatctcuacaaagca

SEQ ID NO: 52001 - DNA, 23 bp, Artificial Sequence
  Synthetic
gatgagauaaggctgaggagugg

SEQ ID NO: 52002 - DNA, 24 bp, Artificial Sequence
  Synthetic
catgcataagugccaatccttuga

SEQ ID NO: 52003 - DNA, 29 bp, Artificial Sequence
  Synthetic
acctagtaacuttgctttgtgaugaacat

SEQ ID NO: 52004 - DNA, 19 bp, Artificial Sequence
  Synthetic
ggctcuccaggttcaccut

SEQ ID NO: 52005 - DNA, 28 bp, Artificial Sequence
  Synthetic
ggctgttttgaaagauctcatcagagua

SEQ ID NO: 52006 - DNA, 29 bp, Artificial Sequence
  Synthetic
gttctagtttuccttactgttcucagact

SEQ ID NO: 52007 - DNA, 27 bp, Artificial Sequence
  Synthetic
tctttctggtaacugtccttctgttut

SEQ ID NO: 52008 - DNA, 25 bp, Artificial Sequence
  Synthetic
aattccattcugagtgctcctgtut

SEQ ID NO: 52009 - DNA, 21 bp, Artificial Sequence
  Synthetic
autggttcacguggaccagag

SEQ ID NO: 52010 - DNA, 21 bp, Artificial Sequence
  Synthetic
ggcaaguacccaguacggaac

SEQ ID NO: 52011 - DNA, 23 bp, Artificial Sequence
  Synthetic
ggtactattcugccggttaucca

SEQ ID NO: 52012 - DNA, 21 bp, Artificial Sequence
  Synthetic
ggaatgggucagggagaggut

SEQ ID NO: 52013 - DNA, 25 bp, Artificial Sequence
  Synthetic
ggcatagagugagttctggaacaut

SEQ ID NO: 52014 - DNA, 20 bp, Artificial Sequence
  Synthetic
ggcaagugagtgacgcucaa

SEQ ID NO: 52015 - DNA, 20 bp, Artificial Sequence
  Synthetic
cgggccaaguactcacctuc

SEQ ID NO: 52016 - DNA, 30 bp, Artificial Sequence
  Synthetic
gaagctagaagauccttactagtcugaaga

SEQ ID NO: 52017 - DNA, 23 bp, Artificial Sequence
  Synthetic
agcttgcaugactgccttaugaa

SEQ ID NO: 52018 - DNA, 22 bp, Artificial Sequence
  Synthetic
ccugggaaagcacuggagaaat

SEQ ID NO: 52019 - DNA, 27 bp, Artificial Sequence
  Synthetic
gtaccgaaatgcutagtatctgctuga

SEQ ID NO: 52020 - DNA, 22 bp, Artificial Sequence
  Synthetic
cctaagtcugctacccgtcugt

SEQ ID NO: 52021 - DNA, 22 bp, Artificial Sequence
  Synthetic
ggaatcccuggacctttaccuc

SEQ ID NO: 52022 - DNA, 22 bp, Artificial Sequence
  Synthetic
cactcaggcacuggttttcuca

SEQ ID NO: 52023 - DNA, 21 bp, Artificial Sequence
  Synthetic
atcugtccaggugaaggcaag

SEQ ID NO: 52024 - DNA, 22 bp, Artificial Sequence
  Synthetic
cagacacttgauggcttggcua

SEQ ID NO: 52025 - DNA, 27 bp, Artificial Sequence
  Synthetic
tggtactttcutcaattgcacugacat

SEQ ID NO: 52026 - DNA, 28 bp, Artificial Sequence
  Synthetic
ggatcccagtguatccaatcataatuca

SEQ ID NO: 52027 - DNA, 26 bp, Artificial Sequence
  Synthetic
gtagcagtgcucctaaaccattaugt

SEQ ID NO: 52028 - DNA, 18 bp, Artificial Sequence
  Synthetic
gcgggcugcctgtcuaag

SEQ ID NO: 52029 - DNA, 17 bp, Artificial Sequence
  Synthetic
cgggccucggctactug

SEQ ID NO: 52030 - DNA, 24 bp, Artificial Sequence
  Synthetic
cttaggtuaggaaatgcccaugga

SEQ ID NO: 52031 - DNA, 27 bp, Artificial Sequence
  Synthetic
gaacagauacagacugaaagacacaca

SEQ ID NO: 52032 - DNA, 22 bp, Artificial Sequence
  Synthetic
gtggaggcagutcatgatgcua

SEQ ID NO: 52033 - DNA, 24 bp, Artificial Sequence
  Synthetic
cttttctctccuccccctttcaut

SEQ ID NO: 52034 - DNA, 22 bp, Artificial Sequence
  Synthetic
gttcuccaccagcagtgtguag

SEQ ID NO: 52035 - DNA, 22 bp, Artificial Sequence
  Synthetic
cagctgcauccttcaggaagua

SEQ ID NO: 52036 - DNA, 17 bp, Artificial Sequence
  Synthetic
gtcuccacgcgcctcut

SEQ ID NO: 52037 - DNA, 20 bp, Artificial Sequence
  Synthetic
agcccctttucctcctgcua

SEQ ID NO: 52038 - DNA, 20 bp, Artificial Sequence
  Synthetic
gctcccgcccuttggttaut

SEQ ID NO: 52039 - DNA, 27 bp, Artificial Sequence
  Synthetic
cagacctgacucatcaactcttttuct

SEQ ID NO: 52040 - DNA, 27 bp, Artificial Sequence
  Synthetic
ccactagataaaaugtgttgggtcgut

SEQ ID NO: 52041 - DNA, 22 bp, Artificial Sequence
  Synthetic
cttcactaguaggcagccctuc

SEQ ID NO: 52042 - DNA, 21 bp, Artificial Sequence
  Synthetic
tttcccugcagatgctguacc

SEQ ID NO: 52043 - DNA, 27 bp, Artificial Sequence
  Synthetic
gctgagcaaccuctatcatttuaagca

SEQ ID NO: 52044 - DNA, 18 bp, Artificial Sequence
  Synthetic
tgctcccacucgggucat

SEQ ID NO: 52045 - DNA, 17 bp, Artificial Sequence
  Synthetic
cctccaaugcggtgcuc

SEQ ID NO: 52046 - DNA, 23 bp, Artificial Sequence
  Synthetic
gugaggctaaaugaaagccaact

SEQ ID NO: 52047 - DNA, 28 bp, Artificial Sequence
  Synthetic
gctttgagtcuggaaagatggtatugat

SEQ ID NO: 52048 - DNA, 26 bp, Artificial Sequence
  Synthetic
ccaaaaatauaaagcatcgcgguaca

SEQ ID NO: 52049 - DNA, 25 bp, Artificial Sequence
  Synthetic
tgctctttcttcuctctgcctttuc

SEQ ID NO: 52050 - DNA, 24 bp, Artificial Sequence
  Synthetic
gcaacttataguggagctggcuat

SEQ ID NO: 52051 - DNA, 22 bp, Artificial Sequence
  Synthetic
ggagggatgcaugtcctcagua

SEQ ID NO: 52052 - DNA, 22 bp, Artificial Sequence
  Synthetic
cattattgccugcaatgugcca

SEQ ID NO: 52053 - DNA, 27 bp, Artificial Sequence
  Synthetic
aggaatgcttugtgactagcuaaaaca

SEQ ID NO: 52054 - DNA, 26 bp, Artificial Sequence
  Synthetic
tactaguaagaagaaagagtgcugga

SEQ ID NO: 52055 - DNA, 26 bp, Artificial Sequence
  Synthetic
acaatcaacguagatgggttttccut

SEQ ID NO: 52056 - DNA, 26 bp, Artificial Sequence
  Synthetic
tgattctuggagtgaaatucgggaag

SEQ ID NO: 52057 - DNA, 25 bp, Artificial Sequence
  Synthetic
ccacttcgggucatttcaaacaaut

SEQ ID NO: 52058 - DNA, 22 bp, Artificial Sequence
  Synthetic
gcaggaggugaaatgcaaaugt

SEQ ID NO: 52059 - DNA, 23 bp, Artificial Sequence
  Synthetic
cgggtucttgtatgaugggagag

SEQ ID NO: 52060 - DNA, 25 bp, Artificial Sequence
  Synthetic
cccaggtgcutcttcagaaagtaut

SEQ ID NO: 52061 - DNA, 29 bp, Artificial Sequence
  Synthetic
ccattcgatugcaaactatttagacttut

SEQ ID NO: 52062 - DNA, 21 bp, Artificial Sequence
  Synthetic
acagutgactgcuggaggaag

SEQ ID NO: 52063 - DNA, 28 bp, Artificial Sequence
  Synthetic
cacacaatggauctgtgaacttguagat

SEQ ID NO: 52064 - DNA, 25 bp, Artificial Sequence
  Synthetic
aggaatcuggtggacaguaacaaac

SEQ ID NO: 52065 - DNA, 20 bp, Artificial Sequence
  Synthetic
acacttguggcagcctctuc

SEQ ID NO: 52066 - DNA, 20 bp, Artificial Sequence
  Synthetic
ggacttgtugttgggcgtuc

SEQ ID NO: 52067 - DNA, 28 bp, Artificial Sequence
  Synthetic
tgagatctcttuaaggctctatgttcut

SEQ ID NO: 52068 - DNA, 25 bp, Artificial Sequence
  Synthetic
tctataaggugcgacatgttgcaut

SEQ ID NO: 52069 - DNA, 23 bp, Artificial Sequence
  Synthetic
catggacauggtgttcttugcag

SEQ ID NO: 52070 - DNA, 23 bp, Artificial Sequence
  Synthetic
cttcaccaaacucctcctcuacc

SEQ ID NO: 52071 - DNA, 28 bp, Artificial Sequence
  Synthetic
acggcataacaggaautactaacacaut

SEQ ID NO: 52072 - DNA, 26 bp, Artificial Sequence
  Synthetic
catattccacaauagggccctctauc

SEQ ID NO: 52073 - DNA, 25 bp, Artificial Sequence
  Synthetic
tttgttcagaauggtccaatggcua

SEQ ID NO: 52074 - DNA, 28 bp, Artificial Sequence
  Synthetic
cactaggcatcucaatttttctgacuct

SEQ ID NO: 52075 - DNA, 28 bp, Artificial Sequence
  Synthetic
tgtgatttttggaaaugttggttgtuca

SEQ ID NO: 52076 - DNA, 27 bp, Artificial Sequence
  Synthetic
tgaagctcatcaucaaatatggcauga

SEQ ID NO: 52077 - DNA, 28 bp, Artificial Sequence
  Synthetic
cactttauttacaacagcuccaagacag

SEQ ID NO: 52078 - DNA, 28 bp, Artificial Sequence
  Synthetic
ttcatgaacactutaatgtgttttccuc

SEQ ID NO: 52079 - DNA, 28 bp, Artificial Sequence
  Synthetic
acctagaccaaugatagcttttgttugt

SEQ ID NO: 52080 - DNA, 26 bp, Artificial Sequence
  Synthetic
attgcttctugctgatctugacaaag

SEQ ID NO: 52081 - DNA, 29 bp, Artificial Sequence
  Synthetic
tgtactgccaagutacttacatttucagt

SEQ ID NO: 52082 - DNA, 26 bp, Artificial Sequence
  Synthetic
agtcagtaatgcaugtggaacttugt

SEQ ID NO: 52083 - DNA, 23 bp, Artificial Sequence
  Synthetic
caagctugagccaggagacauaa

SEQ ID NO: 52084 - DNA, 28 bp, Artificial Sequence
  Synthetic
gcctaccaattauagtgaacgttacuct

SEQ ID NO: 52085 - DNA, 27 bp, Artificial Sequence
  Synthetic
gctttgtccagaugaactcttugagaa

SEQ ID NO: 52086 - DNA, 27 bp, Artificial Sequence
  Synthetic
ttgatgatgaugatgttgaccttucca

SEQ ID NO: 52087 - DNA, 26 bp, Artificial Sequence
  Synthetic
gggaaaagtggautgtttctgaagua

SEQ ID NO: 52088 - DNA, 24 bp, Artificial Sequence
  Synthetic
cactcacattcuccttctggacuc

SEQ ID NO: 52089 - DNA, 24 bp, Artificial Sequence
  Synthetic
gatgactccucactactgctcuct

SEQ ID NO: 52090 - DNA, 19 bp, Artificial Sequence
  Synthetic
ccagccagacagcaucuga

SEQ ID NO: 52091 - DNA, 19 bp, Artificial Sequence
  Synthetic
acttgaaggcugggtccug

SEQ ID NO: 52092 - DNA, 26 bp, Artificial Sequence
  Synthetic
ctttttgtagucaaagcgaugagact

SEQ ID NO: 52093 - DNA, 28 bp, Artificial Sequence
  Synthetic
tctttcagctccuactaccacttcatua

SEQ ID NO: 52094 - DNA, 17 bp, Artificial Sequence
  Synthetic
aggguccttggcugggt

SEQ ID NO: 52095 - DNA, 17 bp, Artificial Sequence
  Synthetic
ccctccucctgcaugct

SEQ ID NO: 52096 - DNA, 24 bp, Artificial Sequence
  Synthetic
aacaattttggccugtggactcua

SEQ ID NO: 52097 - DNA, 21 bp, Artificial Sequence
  Synthetic
aagutctgacugagccaaggg

SEQ ID NO: 52098 - DNA, 22 bp, Artificial Sequence
  Synthetic
gctgggucaaagatcctugcat

SEQ ID NO: 52099 - DNA, 28 bp, Artificial Sequence
  Synthetic
agaaatgattucttaccttcugagcaca

SEQ ID NO: 52100 - DNA, 21 bp, Artificial Sequence
  Synthetic
gggttgcutgcctuacagaaa

SEQ ID NO: 52101 - DNA, 21 bp, Artificial Sequence
  Synthetic
cgtggctutgggaactuggat

SEQ ID NO: 52102 - DNA, 28 bp, Artificial Sequence
  Synthetic
tcaggacaaaaauaaggagaucgagaga

SEQ ID NO: 52103 - DNA, 20 bp, Artificial Sequence
  Synthetic
ccgguagccactggtaucct

SEQ ID NO: 52104 - DNA, 21 bp, Artificial Sequence
  Synthetic
gtccctguccttgtacugcac

SEQ ID NO: 52105 - DNA, 21 bp, Artificial Sequence
  Synthetic
tcaccttctcugtcccctcut

SEQ ID NO: 52106 - DNA, 21 bp, Artificial Sequence
  Synthetic
cccctgtgcauccttgtacug

SEQ ID NO: 52107 - DNA, 20 bp, Artificial Sequence
  Synthetic
acctggcuggatctcctugt

SEQ ID NO: 52108 - DNA, 21 bp, Artificial Sequence
  Synthetic
gtccatcccugtccctguact

SEQ ID NO: 52109 - DNA, 23 bp, Artificial Sequence
  Synthetic
ttcctatgugggatttggctucc

SEQ ID NO: 52110 - DNA, 24 bp, Artificial Sequence
  Synthetic
gcagatuccctctctaguccagat

SEQ ID NO: 52111 - DNA, 22 bp, Artificial Sequence
  Synthetic
agcctaugaccagagaggacug

SEQ ID NO: 52112 - DNA, 20 bp, Artificial Sequence
  Synthetic
agccctcugagtccacguaa

SEQ ID NO: 52113 - DNA, 20 bp, Artificial Sequence
  Synthetic
ctgtcctggugccgtagaug

SEQ ID NO: 52114 - DNA, 20 bp, Artificial Sequence
  Synthetic
aggacacgguaaagctgcug

SEQ ID NO: 52115 - DNA, 23 bp, Artificial Sequence
  Synthetic
ccctcttatgagutcccccatut

SEQ ID NO: 52116 - DNA, 27 bp, Artificial Sequence
  Synthetic
tctttcctggucattttgtcatcauca

SEQ ID NO: 52117 - DNA, 26 bp, Artificial Sequence
  Synthetic
ctgtgttcacagugtggtttgattua

SEQ ID NO: 52118 - DNA, 22 bp, Artificial Sequence
  Synthetic
gggaggaagauccatcccauct

SEQ ID NO: 52119 - DNA, 23 bp, Artificial Sequence
  Synthetic
gctcttgacaaucgtctcctuct

SEQ ID NO: 52120 - DNA, 24 bp, Artificial Sequence
  Synthetic
acttatagcaugacaccaggccua

SEQ ID NO: 52121 - DNA, 27 bp, Artificial Sequence
  Synthetic
ttcaggtgcutgatgatatugagaagt

SEQ ID NO: 52122 - DNA, 23 bp, Artificial Sequence
  Synthetic
tctatttccugcttgugccacat

SEQ ID NO: 52123 - DNA, 29 bp, Artificial Sequence
  Synthetic
tctgggctcacutaatagagaaaatgtut

SEQ ID NO: 52124 - DNA, 27 bp, Artificial Sequence
  Synthetic
aggtttaatttacucaccttggugcaa

SEQ ID NO: 52125 - DNA, 23 bp, Artificial Sequence
  Synthetic
tggauaccataugcaggaagcag

SEQ ID NO: 52126 - DNA, 28 bp, Artificial Sequence
  Synthetic
ggatggttcuggaggaaaaatgtatgua

SEQ ID NO: 52127 - DNA, 27 bp, Artificial Sequence
  Synthetic
gagcagttatuccagttcttgcaaaut

SEQ ID NO: 52128 - DNA, 20 bp, Artificial Sequence
  Synthetic
catccacagugggtctcucc

SEQ ID NO: 52129 - DNA, 26 bp, Artificial Sequence
  Synthetic
tggtcccacutacaacugaacaaaaa

SEQ ID NO: 52130 - DNA, 24 bp, Artificial Sequence
  Synthetic
caaaaucucaagcagaagcaacct

SEQ ID NO: 52131 - DNA, 24 bp, Artificial Sequence
  Synthetic
cttacctggcuttcattcctcuga

SEQ ID NO: 52132 - DNA, 24 bp, Artificial Sequence
  Synthetic
ctatugaagaaccagucacagcct

SEQ ID NO: 52133 - DNA, 28 bp, Artificial Sequence
  Synthetic
gggttccttacuaaatgagcactatugt

SEQ ID NO: 52134 - DNA, 28 bp, Artificial Sequence
  Synthetic
catgtcttuaacctctaactuccaaggg

SEQ ID NO: 52135 - DNA, 26 bp, Artificial Sequence
  Synthetic
tctccacagaauttccgtctctauca

SEQ ID NO: 52136 - DNA, 24 bp, Artificial Sequence
  Synthetic
agtcutgcttgacauacagcagaa

SEQ ID NO: 52137 - DNA, 27 bp, Artificial Sequence
  Synthetic
tccacagattucagttgtgttcgtuat

SEQ ID NO: 52138 - DNA, 23 bp, Artificial Sequence
  Synthetic
gtagaccgtucttgttcgtcuga

SEQ ID NO: 52139 - DNA, 24 bp, Artificial Sequence
  Synthetic
ccagccaaaauggtgaaactgaug

SEQ ID NO: 52140 - DNA, 22 bp, Artificial Sequence
  Synthetic
ggttgtggaugccattctucca

SEQ ID NO: 52141 - DNA, 28 bp, Artificial Sequence
  Synthetic
tgtaaaatacagcuacccgaaaaugact

SEQ ID NO: 52142 - DNA, 27 bp, Artificial Sequence
  Synthetic
ttgtcaaagagaucagcataaucagca

SEQ ID NO: 52143 - DNA, 28 bp, Artificial Sequence
  Synthetic
tttggtgacguggatgatactttcuaat

SEQ ID NO: 52144 - DNA, 24 bp, Artificial Sequence
  Synthetic
caggagagaaaaaggugcaaagut

SEQ ID NO: 52145 - DNA, 23 bp, Artificial Sequence
  Synthetic
cgctcatagacugctctctctut

SEQ ID NO: 52146 - DNA, 21 bp, Artificial Sequence
  Synthetic
tcaattgggccucttggctut

SEQ ID NO: 52147 - DNA, 25 bp, Artificial Sequence
  Synthetic
gaaggagcaagutggcataaagaut

SEQ ID NO: 52148 - DNA, 17 bp, Artificial Sequence
  Synthetic
ccgcgacugucgaggat

SEQ ID NO: 52149 - DNA, 22 bp, Artificial Sequence
  Synthetic
aggtuccagagagucaggaagt

SEQ ID NO: 52150 - DNA, 24 bp, Artificial Sequence
  Synthetic
aacgcuaaacagaaagagcugaga

SEQ ID NO: 52151 - DNA, 27 bp, Artificial Sequence
  Synthetic
cctcttgcttugccaaacatttatcut

SEQ ID NO: 52152 - DNA, 27 bp, Artificial Sequence
  Synthetic
cttgagagaaatgucaaagaagtggug

SEQ ID NO: 52153 - DNA, 28 bp, Artificial Sequence
  Synthetic
aaaccaacuccagcttgttcaaaauaaa

SEQ ID NO: 52154 - DNA, 27 bp, Artificial Sequence
  Synthetic
gggaaatauggacagaagaaaaucaga

SEQ ID NO: 52155 - DNA, 28 bp, Artificial Sequence
  Synthetic
caaccgtcaaacaacuttacacatguat

SEQ ID NO: 52156 - DNA, 28 bp, Artificial Sequence
  Synthetic
actctcccttugaagaattaccttggua

SEQ ID NO: 52157 - DNA, 26 bp, Artificial Sequence
  Synthetic
actttgttgaugacattcaccacuct

SEQ ID NO: 52158 - DNA, 25 bp, Artificial Sequence
  Synthetic
agcttttcugtgttcctttucaggt

SEQ ID NO: 52159 - DNA, 28 bp, Artificial Sequence
  Synthetic
atcagaactagaacgutaaatggcguaa

SEQ ID NO: 52160 - DNA, 28 bp, Artificial Sequence
  Synthetic
acaaaatttgtgcutgatgggtataugg

SEQ ID NO: 52161 - DNA, 21 bp, Artificial Sequence
  Synthetic
cctgcgacggaaauttcacug

SEQ ID NO: 52162 - DNA, 25 bp, Artificial Sequence
  Synthetic
acaagaacttucgccttatcctuca

SEQ ID NO: 52163 - DNA, 27 bp, Artificial Sequence
  Synthetic
gtgttggtggugacgtaaacattttua

SEQ ID NO: 52164 - DNA, 23 bp, Artificial Sequence
  Synthetic
ctgttugagaaggacaagcucac

SEQ ID NO: 52165 - DNA, 21 bp, Artificial Sequence
  Synthetic
aaautcccctcaugccaccaa

SEQ ID NO: 52166 - DNA, 27 bp, Artificial Sequence
  Synthetic
gtatcgttcacaccautcctacttgut

SEQ ID NO: 52167 - DNA, 28 bp, Artificial Sequence
  Synthetic
gtaatttttcttuttctggacacucgga

SEQ ID NO: 52168 - DNA, 25 bp, Artificial Sequence
  Synthetic
cgaagtatguggagaggaccagaut

SEQ ID NO: 52169 - DNA, 26 bp, Artificial Sequence
  Synthetic
agaucactgtgaacugaaaagaaggg

SEQ ID NO: 52170 - DNA, 26 bp, Artificial Sequence
  Synthetic
cctgaagtcaugcttcatcttgaaug

SEQ ID NO: 52171 - DNA, 25 bp, Artificial Sequence
  Synthetic
ttgagaagatgugttactcgctuga

SEQ ID NO: 52172 - DNA, 26 bp, Artificial Sequence
  Synthetic
ccttaggtttaugatgctgcagucag

SEQ ID NO: 52173 - DNA, 28 bp, Artificial Sequence
  Synthetic
ctggctacaugatcaggttataaauggt

SEQ ID NO: 52174 - DNA, 25 bp, Artificial Sequence
  Synthetic
acttgttutacatgtgaucccacga

SEQ ID NO: 52175 - DNA, 28 bp, Artificial Sequence
  Synthetic
ggccactguatttaaacacauagaggat

SEQ ID NO: 52176 - DNA, 20 bp, Artificial Sequence
  Synthetic
aaccagutgtauggcagcga

SEQ ID NO: 52177 - DNA, 27 bp, Artificial Sequence
  Synthetic
tgtttcctgttutgcttttctgatugt

SEQ ID NO: 52178 - DNA, 20 bp, Artificial Sequence
  Synthetic
tcucccacagggaacgugat

SEQ ID NO: 52179 - DNA, 17 bp, Artificial Sequence
  Synthetic
cgctuccgcaccuccag

SEQ ID NO: 52180 - DNA, 21 bp, Artificial Sequence
  Synthetic
actccctgucctccagctuag

SEQ ID NO: 52181 - DNA, 22 bp, Artificial Sequence
  Synthetic
gaagctgggcugaaggacuaaa

SEQ ID NO: 52182 - DNA, 19 bp, Artificial Sequence
  Synthetic
tgggcaggacaccucctua

SEQ ID NO: 52183 - DNA, 20 bp, Artificial Sequence
  Synthetic
ctccgccuaactccctcauc

SEQ ID NO: 52184 - DNA, 28 bp, Artificial Sequence
  Synthetic
gcttgccttcucaaagtaaaagatgaut

SEQ ID NO: 52185 - DNA, 28 bp, Artificial Sequence
  Synthetic
ccatgagttcugttgtatcctttucaac

SEQ ID NO: 52186 - DNA, 29 bp, Artificial Sequence
  Synthetic
tgagtgaucaagaatgtgugaagagaaat

SEQ ID NO: 52187 - DNA, 26 bp, Artificial Sequence
  Synthetic
ttcttcatuagcggtttctactugct

SEQ ID NO: 52188 - DNA, 28 bp, Artificial Sequence
  Synthetic
attacaaagaugcaacugcaaagagaag

SEQ ID NO: 52189 - DNA, 25 bp, Artificial Sequence
  Synthetic
tctggctgaguttcaagtgugaaaa

SEQ ID NO: 52190 - DNA, 27 bp, Artificial Sequence
  Synthetic
gaagaaagcaugggatauaagggagaa

SEQ ID NO: 52191 - DNA, 29 bp, Artificial Sequence
  Synthetic
ctggccagtuaatttctgtagttguaaaa

SEQ ID NO: 52192 - DNA, 25 bp, Artificial Sequence
  Synthetic
caagtacttcutgtggctcatugac

SEQ ID NO: 52193 - DNA, 28 bp, Artificial Sequence
  Synthetic
gcagaaatgauaagcatgcactaatuct

SEQ ID NO: 52194 - DNA, 25 bp, Artificial Sequence
  Synthetic
tctcugcaaaacccatatuccaact

SEQ ID NO: 52195 - DNA, 21 bp, Artificial Sequence
  Synthetic
gcccaatuggaggcctuacat

SEQ ID NO: 52196 - DNA, 25 bp, Artificial Sequence
  Synthetic
cctacttgcacauagaaaggtcuga

SEQ ID NO: 52197 - DNA, 28 bp, Artificial Sequence
  Synthetic
aagttagcaauacgtaagacacctuacc

SEQ ID NO: 52198 - DNA, 28 bp, Artificial Sequence
  Synthetic
cagatatgctguttcattatttgcuggt

SEQ ID NO: 52199 - DNA, 24 bp, Artificial Sequence
  Synthetic
tccccatacuccacctttgtttuc

SEQ ID NO: 52200 - DNA, 28 bp, Artificial Sequence
  Synthetic
catctgcaauaaagacagaguccaaaac

SEQ ID NO: 52201 - DNA, 24 bp, Artificial Sequence
  Synthetic
tccagcaaatguctcacaaaggua

SEQ ID NO: 52202 - DNA, 23 bp, Artificial Sequence
  Synthetic
caattttggaugaccttcugcct

SEQ ID NO: 52203 - DNA, 28 bp, Artificial Sequence
  Synthetic
acaggactucaaccctcaatcaaauaaa

SEQ ID NO: 52204 - DNA, 22 bp, Artificial Sequence
  Synthetic
tcttgctgugcagcatcugaat

SEQ ID NO: 52205 - DNA, 27 bp, Artificial Sequence
  Synthetic
gggtcctgcacaguattttgtctttua

SEQ ID NO: 52206 - DNA, 19 bp, Artificial Sequence
  Synthetic
gggtcccucgccaauacag

SEQ ID NO: 52207 - DNA, 23 bp, Artificial Sequence
  Synthetic
cgaccucacgggctattuaaagg

SEQ ID NO: 52208 - DNA, 24 bp, Artificial Sequence
  Synthetic
gcaggagugctatttagcaucgag

SEQ ID NO: 52209 - DNA, 24 bp, Artificial Sequence
  Synthetic
caccccatucccagcttttctaut

SEQ ID NO: 52210 - DNA, 19 bp, Artificial Sequence
  Synthetic
tggaaccugccugaggaca

SEQ ID NO: 52211 - DNA, 19 bp, Artificial Sequence
  Synthetic
tcttccagcccuggacuct

SEQ ID NO: 52212 - DNA, 17 bp, Artificial Sequence
  Synthetic
gtccgagccgugtcugt

SEQ ID NO: 52213 - DNA, 18 bp, Artificial Sequence
  Synthetic
ccatggccucttcgccug

SEQ ID NO: 52214 - DNA, 20 bp, Artificial Sequence
  Synthetic
gccgtcgutgcagtagauga

SEQ ID NO: 52215 - DNA, 22 bp, Artificial Sequence
  Synthetic
gctgtgtgaguggagaatgugg

SEQ ID NO: 52216 - DNA, 28 bp, Artificial Sequence
  Synthetic
cgctaaaaacuacttacaaaaagcugga

SEQ ID NO: 52217 - DNA, 26 bp, Artificial Sequence
  Synthetic
ttttctcgaaagccucctaacaacut

SEQ ID NO: 52218 - DNA, 18 bp, Artificial Sequence
  Synthetic
cutgaccugcgagggaga

SEQ ID NO: 52219 - DNA, 17 bp, Artificial Sequence
  Synthetic
ccgcccuggagguagga

SEQ ID NO: 52220 - DNA, 26 bp, Artificial Sequence
  Synthetic
caccttttactuggacatgaagcaut

SEQ ID NO: 52221 - DNA, 22 bp, Artificial Sequence
  Synthetic
ctgagagaugggcaucagaagg

SEQ ID NO: 52222 - DNA, 21 bp, Artificial Sequence
  Synthetic
gctaaaguccccggagactuc

SEQ ID NO: 52223 - DNA, 28 bp, Artificial Sequence
  Synthetic
ggttuaacagaaggaaucaacacagaaa

SEQ ID NO: 52224 - DNA, 17 bp, Artificial Sequence
  Synthetic
agccgcguggacatuca

SEQ ID NO: 52225 - DNA, 20 bp, Artificial Sequence
  Synthetic
gctgcugttcatccuaccca

SEQ ID NO: 52226 - DNA, 22 bp, Artificial Sequence
  Synthetic
cacagggucactcttgagaugg

SEQ ID NO: 52227 - DNA, 21 bp, Artificial Sequence
  Synthetic
ccaaggacaugctcccactug

SEQ ID NO: 52228 - DNA, 28 bp, Artificial Sequence
  Synthetic
agttccaggttugtgcatttatgtauga

SEQ ID NO: 52229 - DNA, 29 bp, Artificial Sequence
  Synthetic
ccatgacagcaacautatctcttcttuct

SEQ ID NO: 52230 - DNA, 21 bp, Artificial Sequence
  Synthetic
tgaagattugcgccctuacga

SEQ ID NO: 52231 - DNA, 29 bp, Artificial Sequence
  Synthetic
tctttggacacaautcttcattagctuga

SEQ ID NO: 52232 - DNA, 25 bp, Artificial Sequence
  Synthetic
aaatccttttautgccaccucagga

SEQ ID NO: 52233 - DNA, 22 bp, Artificial Sequence
  Synthetic
gtctggcuccgagaacuaaagt

SEQ ID NO: 52234 - DNA, 22 bp, Artificial Sequence
  Synthetic
gcctggauaaagctgtgcuaca

SEQ ID NO: 52235 - DNA, 28 bp, Artificial Sequence
  Synthetic
aggtcgaaaaataaucaaaggctgagua

SEQ ID NO: 52236 - DNA, 25 bp, Artificial Sequence
  Synthetic
gctgtucccaaacaactagacatug

SEQ ID NO: 52237 - DNA, 23 bp, Artificial Sequence
  Synthetic
tccgggagaaggaaugtttctug

SEQ ID NO: 52238 - DNA, 24 bp, Artificial Sequence
  Synthetic
ccaaaaugaacaagcacgagcaut

SEQ ID NO: 52239 - DNA, 28 bp, Artificial Sequence
  Synthetic
tcaggaagtagtucatcatgtgctttua

SEQ ID NO: 52240 - DNA, 27 bp, Artificial Sequence
  Synthetic
attccaaacacaccaguatttcctcut

SEQ ID NO: 52241 - DNA, 28 bp, Artificial Sequence
  Synthetic
ctgcctagtcuggatttttctctuaagt

SEQ ID NO: 52242 - DNA, 23 bp, Artificial Sequence
  Synthetic
aagaccacagugttgcataaugt

SEQ ID NO: 52243 - DNA, 25 bp, Artificial Sequence
  Synthetic
ggcagatcaautttcggcttttuga

SEQ ID NO: 52244 - DNA, 22 bp, Artificial Sequence
  Synthetic
tcttttcacagggcucgcttua

SEQ ID NO: 52245 - DNA, 28 bp, Artificial Sequence
  Synthetic
caggattttgatuctccttgcctuaaaa

SEQ ID NO: 52246 - DNA, 26 bp, Artificial Sequence
  Synthetic
cttctccacaucatctaccaaucaca

SEQ ID NO: 52247 - DNA, 27 bp, Artificial Sequence
  Synthetic
gaaagagaucaggcaacagtgattcua

SEQ ID NO: 52248 - DNA, 23 bp, Artificial Sequence
  Synthetic
agctgtcugggtaaagatugcac

SEQ ID NO: 52249 - DNA, 23 bp, Artificial Sequence
  Synthetic
ggcagagcugtaggaacuaacac

SEQ ID NO: 52250 - DNA, 19 bp, Artificial Sequence
  Synthetic
ctgggctauggcactguga

SEQ ID NO: 52251 - DNA, 23 bp, Artificial Sequence
  Synthetic
gtagggacucagtgaagucagga

SEQ ID NO: 52252 - DNA, 19 bp, Artificial Sequence
  Synthetic
ggagcagcaugtggacuct

SEQ ID NO: 52253 - DNA, 17 bp, Artificial Sequence
  Synthetic
cccggcgcggauactua

SEQ ID NO: 52254 - DNA, 27 bp, Artificial Sequence
  Synthetic
cacaggcaagaauaattaactcagcuc

SEQ ID NO: 52255 - DNA, 23 bp, Artificial Sequence
  Synthetic
gaaacagagguaguccagcacat

SEQ ID NO: 52256 - DNA, 23 bp, Artificial Sequence
  Synthetic
taggaccagaugtctgagucgat

SEQ ID NO: 52257 - DNA, 21 bp, Artificial Sequence
  Synthetic
gaguacctauccagccaccac

SEQ ID NO: 52258 - DNA, 25 bp, Artificial Sequence
  Synthetic
acacaggacaaaauaacgugagcat

SEQ ID NO: 52259 - DNA, 21 bp, Artificial Sequence
  Synthetic
gaaaaagccautggccaccuc

SEQ ID NO: 52260 - DNA, 24 bp, Artificial Sequence
  Synthetic
acaaggacugggagtgaagauact

SEQ ID NO: 52261 - DNA, 20 bp, Artificial Sequence
  Synthetic
ccaggutcucagcggaagac

SEQ ID NO: 52262 - DNA, 19 bp, Artificial Sequence
  Synthetic
cgtccauacccgcuggaaa

SEQ ID NO: 52263 - DNA, 19 bp, Artificial Sequence
  Synthetic
gugcatuccacaggccaag

SEQ ID NO: 52264 - DNA, 20 bp, Artificial Sequence
  Synthetic
ctgggatttcugcccgagut

SEQ ID NO: 52265 - DNA, 20 bp, Artificial Sequence
  Synthetic
ggtcucaaaggccgagaugg

SEQ ID NO: 52266 - DNA, 23 bp, Artificial Sequence
  Synthetic
gacacgaaugaacctccttucct

SEQ ID NO: 52267 - DNA, 21 bp, Artificial Sequence
  Synthetic
ctttcugaggccaacctguct

SEQ ID NO: 52268 - DNA, 22 bp, Artificial Sequence
  Synthetic
gccacgttugacctgagatcut

SEQ ID NO: 52269 - DNA, 24 bp, Artificial Sequence
  Synthetic
ccugtcctttaaatucaccaccct

SEQ ID NO: 52270 - DNA, 24 bp, Artificial Sequence
  Synthetic
tccatggucaatgacctucgaaaa

SEQ ID NO: 52271 - DNA, 21 bp, Artificial Sequence
  Synthetic
gugagaaccccacagtuacct

SEQ ID NO: 52272 - DNA, 20 bp, Artificial Sequence
  Synthetic
ccgtacuagcggctcatgut

SEQ ID NO: 52273 - DNA, 21 bp, Artificial Sequence
  Synthetic
caaacaaccgcaaaucugcca

SEQ ID NO: 52274 - DNA, 21 bp, Artificial Sequence
  Synthetic
ggtctcagucaggttgcugat

SEQ ID NO: 52275 - DNA, 23 bp, Artificial Sequence
  Synthetic
tgggagutcaucacaaagaacca

SEQ ID NO: 52276 - DNA, 21 bp, Artificial Sequence
  Synthetic
cggcauggaagagatctucgg

SEQ ID NO: 52277 - DNA, 21 bp, Artificial Sequence
  Synthetic
ctgaacugtcctugccacact

SEQ ID NO: 52278 - DNA, 23 bp, Artificial Sequence
  Synthetic
agggacagtgutgttttgctcut

SEQ ID NO: 52279 - DNA, 26 bp, Artificial Sequence
  Synthetic
tcaaggtgaaacaucatgctgtuaga

SEQ ID NO: 52280 - DNA, 28 bp, Artificial Sequence
  Synthetic
gcatacacttcuatcccctttgatuaga

SEQ ID NO: 52281 - DNA, 27 bp, Artificial Sequence
  Synthetic
cgggagaggagaguttaaaaagctuaa

SEQ ID NO: 52282 - DNA, 28 bp, Artificial Sequence
  Synthetic
agctaggttagacutcatttcagcttut

SEQ ID NO: 52283 - DNA, 24 bp, Artificial Sequence
  Synthetic
cttgactggtuccacactaggtuc

SEQ ID NO: 52284 - DNA, 21 bp, Artificial Sequence
  Synthetic
gccttggcutggtcccuaaac

SEQ ID NO: 52285 - DNA, 20 bp, Artificial Sequence
  Synthetic
tcacugagacggcggaaaut

SEQ ID NO: 52286 - DNA, 28 bp, Artificial Sequence
  Synthetic
gtgaattttctugcagacttcagttugt

SEQ ID NO: 52287 - DNA, 28 bp, Artificial Sequence
  Synthetic
ctgtgtcacaacutgtttccttacatut

SEQ ID NO: 52288 - DNA, 28 bp, Artificial Sequence
  Synthetic
tcttgaagaatauccagcacagtcatut

SEQ ID NO: 52289 - DNA, 21 bp, Artificial Sequence
  Synthetic
guggaagaagaagccaaugcc

SEQ ID NO: 52290 - DNA, 29 bp, Artificial Sequence
  Synthetic
cacaccaaggaacauacctgtagattuaa

SEQ ID NO: 52291 - DNA, 28 bp, Artificial Sequence
  Synthetic
cgtaaccatctucttttcctctcttuct

SEQ ID NO: 52292 - DNA, 28 bp, Artificial Sequence
  Synthetic
catactcccugaaaatagttucggacat

SEQ ID NO: 52293 - DNA, 23 bp, Artificial Sequence
  Synthetic
tgattgccguccactcacttauc

SEQ ID NO: 52294 - DNA, 23 bp, Artificial Sequence
  Synthetic
caaactcaaguccctcctctcut

SEQ ID NO: 52295 - DNA, 21 bp, Artificial Sequence
  Synthetic
tcagagccugagatgccuact

SEQ ID NO: 52296 - DNA, 21 bp, Artificial Sequence
  Synthetic
ctcctgcaaccugtctgtgut

SEQ ID NO: 52297 - DNA, 22 bp, Artificial Sequence
  Synthetic
tggaccucccacaatttgtgug

SEQ ID NO: 52298 - DNA, 25 bp, Artificial Sequence
  Synthetic
ggaattcatuccctacttggtcugg

SEQ ID NO: 52299 - DNA, 19 bp, Artificial Sequence
  Synthetic
tcgttguccgtgcagtuca

SEQ ID NO: 52300 - DNA, 19 bp, Artificial Sequence
  Synthetic
gcctacaacgugccccaut

SEQ ID NO: 52301 - DNA, 21 bp, Artificial Sequence
  Synthetic
aggcauaagggaggtccucag

SEQ ID NO: 52302 - DNA, 23 bp, Artificial Sequence
  Synthetic
guaatgccaccaucgacagagag

SEQ ID NO: 52303 - DNA, 19 bp, Artificial Sequence
  Synthetic
cgtggtcaauggccgugat

SEQ ID NO: 52304 - DNA, 22 bp, Artificial Sequence
  Synthetic
gggtcaguttcccuaccagagt

SEQ ID NO: 52305 - DNA, 23 bp, Artificial Sequence
  Synthetic
acuataccttttugccagcacca

SEQ ID NO: 52306 - DNA, 17 bp, Artificial Sequence
  Synthetic
agcgccuctcccgtcua

SEQ ID NO: 52307 - DNA, 20 bp, Artificial Sequence
  Synthetic
cctcagcauctccctccuct

SEQ ID NO: 52308 - DNA, 25 bp, Artificial Sequence
  Synthetic
tgacagaugatagcttcucccagaa

SEQ ID NO: 52309 - DNA, 20 bp, Artificial Sequence
  Synthetic
gctggaccauaccggaugac

SEQ ID NO: 52310 - DNA, 24 bp, Artificial Sequence
  Synthetic
cacatagguaacgagtcagagcut

SEQ ID NO: 52311 - DNA, 22 bp, Artificial Sequence
  Synthetic
cagaugtggaucagcaaacagg

SEQ ID NO: 52312 - DNA, 23 bp, Artificial Sequence
  Synthetic
ccctcccauaagaccaggagaut

SEQ ID NO: 52313 - DNA, 21 bp, Artificial Sequence
  Synthetic
ctcctcauactcctgcaugct

SEQ ID NO: 52314 - DNA, 23 bp, Artificial Sequence
  Synthetic
aatgtgtctuccagcactgaugt

SEQ ID NO: 52315 - DNA, 25 bp, Artificial Sequence
  Synthetic
ttccaagatgucttcttccatgucc

SEQ ID NO: 52316 - DNA, 20 bp, Artificial Sequence
  Synthetic
tggcaaggugagcatgtuct

SEQ ID NO: 52317 - DNA, 21 bp, Artificial Sequence
  Synthetic
cagaccccuctctgacctcuc

SEQ ID NO: 52318 - DNA, 20 bp, Artificial Sequence
  Synthetic
ctctgcccguccttctugaa

SEQ ID NO: 52319 - DNA, 25 bp, Artificial Sequence
  Synthetic
gtttgagugtgaagtaucggaggag

SEQ ID NO: 52320 - DNA, 20 bp, Artificial Sequence
  Synthetic
ctgatggucagggtacgcut

SEQ ID NO: 52321 - DNA, 23 bp, Artificial Sequence
  Synthetic
agcaagtaagutcccctcuggat

SEQ ID NO: 52322 - DNA, 21 bp, Artificial Sequence
  Synthetic
gctgttctuctcgcctaugga

SEQ ID NO: 52323 - DNA, 22 bp, Artificial Sequence
  Synthetic
actttgttctcaucccccacug

SEQ ID NO: 52324 - DNA, 20 bp, Artificial Sequence
  Synthetic
ctcauggcccggtactucag

SEQ ID NO: 52325 - DNA, 25 bp, Artificial Sequence
  Synthetic
ccctacctgcugttagagaaaccua

SEQ ID NO: 52326 - DNA, 20 bp, Artificial Sequence
  Synthetic
gttgaacccauccuggaggt

SEQ ID NO: 52327 - DNA, 21 bp, Artificial Sequence
  Synthetic
agtaacagguccugggcagaa

SEQ ID NO: 52328 - DNA, 21 bp, Artificial Sequence
  Synthetic
ctgcagucccatgaucaccat

SEQ ID NO: 52329 - DNA, 20 bp, Artificial Sequence
  Synthetic
agactugaaggcguccacag

SEQ ID NO: 52330 - DNA, 19 bp, Artificial Sequence
  Synthetic
ccaucggcggatgtguagg

SEQ ID NO: 52331 - DNA, 21 bp, Artificial Sequence
  Synthetic
cctggtgggcuactacatcut

SEQ ID NO: 52332 - DNA, 20 bp, Artificial Sequence
  Synthetic
actcucagcctcuggacaca

SEQ ID NO: 52333 - DNA, 18 bp, Artificial Sequence
  Synthetic
cctgctugagcggtuccc

SEQ ID NO: 52334 - DNA, 17 bp, Artificial Sequence
  Synthetic
tgccccugctgccttut

SEQ ID NO: 52335 - DNA, 20 bp, Artificial Sequence
  Synthetic
cagaccuagaagccggugac

SEQ ID NO: 52336 - DNA, 22 bp, Artificial Sequence
  Synthetic
tgcagaccutgtgaggacuaga

SEQ ID NO: 52337 - DNA, 22 bp, Artificial Sequence
  Synthetic
caaguggtgcatuggacagaag

SEQ ID NO: 52338 - DNA, 29 bp, Artificial Sequence
  Synthetic
ttctcagacugacggattaaatuccaaat

SEQ ID NO: 52339 - DNA, 24 bp, Artificial Sequence
  Synthetic
agtgttggacutggttgtctctut

SEQ ID NO: 52340 - DNA, 28 bp, Artificial Sequence
  Synthetic
aggatttcguaatattgccgucaaagaa

SEQ ID NO: 52341 - DNA, 29 bp, Artificial Sequence
  Synthetic
ttctgatagttugaaaggaatagtugcat

SEQ ID NO: 52342 - DNA, 26 bp, Artificial Sequence
  Synthetic
gcttttggtctuctaagtgaagctut

SEQ ID NO: 52343 - DNA, 28 bp, Artificial Sequence
  Synthetic
gcagctacuacccagctaaaattaucat

SEQ ID NO: 52344 - DNA, 23 bp, Artificial Sequence
  Synthetic
ctggcttttucctgcgattgtua

SEQ ID NO: 52345 - DNA, 28 bp, Artificial Sequence
  Synthetic
cctggccttaauttccacatttguaaaa

SEQ ID NO: 52346 - DNA, 24 bp, Artificial Sequence
  Synthetic
tgctttuaaaggagcttccuggag

SEQ ID NO: 52347 - DNA, 27 bp, Artificial Sequence
  Synthetic
tttacaaacatctuggtcacgacgaua

SEQ ID NO: 52348 - DNA, 26 bp, Artificial Sequence
  Synthetic
gcttcagcaaacagcutttgaaaaug

SEQ ID NO: 52349 - DNA, 28 bp, Artificial Sequence
  Synthetic
cagttgtttuagagcagctttatacugt

SEQ ID NO: 52350 - DNA, 28 bp, Artificial Sequence
  Synthetic
acgtttagaagacuttatggcatcucat

SEQ ID NO: 52351 - DNA, 21 bp, Artificial Sequence
  Synthetic
gtatgtgugttgctggugagg

SEQ ID NO: 52352 - DNA, 21 bp, Artificial Sequence
  Synthetic
tgctcagugttgguggacaag

SEQ ID NO: 52353 - DNA, 28 bp, Artificial Sequence
  Synthetic
ccctacttaaaguatgttggcaggtuaa

SEQ ID NO: 52354 - DNA, 19 bp, Artificial Sequence
  Synthetic
gaccacggcutccucgaat

SEQ ID NO: 52355 - DNA, 20 bp, Artificial Sequence
  Synthetic
ggtccagccutaccttggug

SEQ ID NO: 52356 - DNA, 23 bp, Artificial Sequence
  Synthetic
gttccctccuacactgttcccua

SEQ ID NO: 52357 - DNA, 20 bp, Artificial Sequence
  Synthetic
ccucacagcuccaggaagga

SEQ ID NO: 52358 - DNA, 20 bp, Artificial Sequence
  Synthetic
gctccuggcatctccugaag

SEQ ID NO: 52359 - DNA, 21 bp, Artificial Sequence
  Synthetic
ccttccccaggaaugctgaug

SEQ ID NO: 52360 - DNA, 22 bp, Artificial Sequence
  Synthetic
ctccttcucctcctctcucagg

SEQ ID NO: 52361 - DNA, 22 bp, Artificial Sequence
  Synthetic
cagtacuggcccttgaatguca

SEQ ID NO: 52362 - DNA, 18 bp, Artificial Sequence
  Synthetic
gtucggcaaccacgucag

SEQ ID NO: 52363 - DNA, 17 bp, Artificial Sequence
  Synthetic
cccagggcggugttgut

SEQ ID NO: 52364 - DNA, 18 bp, Artificial Sequence
  Synthetic
cccaccgcgguagtacuc

SEQ ID NO: 52365 - DNA, 20 bp, Artificial Sequence
  Synthetic
tcgtgccgucatcagttcuc

SEQ ID NO: 52366 - DNA, 20 bp, Artificial Sequence
  Synthetic
caggctcucagcaggtgtut

SEQ ID NO: 52367 - DNA, 18 bp, Artificial Sequence
  Synthetic
ggctgcauacgccaucac

SEQ ID NO: 52368 - DNA, 17 bp, Artificial Sequence
  Synthetic
gtccgagccaugcguct

SEQ ID NO: 52369 - DNA, 17 bp, Artificial Sequence
  Synthetic
ccctgutcgctcugcac

SEQ ID NO: 52370 - DNA, 22 bp, Artificial Sequence
  Synthetic
gagagggtgcugggaaagaauc

SEQ ID NO: 52371 - DNA, 23 bp, Artificial Sequence
  Synthetic
gagtactgcucaatgacgtccut

SEQ ID NO: 52372 - DNA, 25 bp, Artificial Sequence
  Synthetic
gtttgtgagagacucaggagauacc

SEQ ID NO: 52373 - DNA, 21 bp, Artificial Sequence
  Synthetic
aaacaucacccagctgtucca

SEQ ID NO: 52374 - DNA, 22 bp, Artificial Sequence
  Synthetic
ccagtgtuctctttgcucccat

SEQ ID NO: 52375 - DNA, 23 bp, Artificial Sequence
  Synthetic
tgtcagtcaucccatccatcugt

SEQ ID NO: 52376 - DNA, 21 bp, Artificial Sequence
  Synthetic
cacaggaggucagacaggaug

SEQ ID NO: 52377 - DNA, 28 bp, Artificial Sequence
  Synthetic
agctgccttaaaauaacctgaagactut

SEQ ID NO: 52378 - DNA, 22 bp, Artificial Sequence
  Synthetic
ctggcacagcuagggttuacat

SEQ ID NO: 52379 - DNA, 28 bp, Artificial Sequence
  Synthetic
acagagttattgauggtgctacaatguc

SEQ ID NO: 52380 - DNA, 24 bp, Artificial Sequence
  Synthetic
cagttttcauccacagaagcgtua

SEQ ID NO: 52381 - DNA, 27 bp, Artificial Sequence
  Synthetic
ttctctctctcccuccttttataccuc

SEQ ID NO: 52382 - DNA, 28 bp, Artificial Sequence
  Synthetic
accaccagaugtgaaattacaguaaact

SEQ ID NO: 52383 - DNA, 31 bp, Artificial Sequence
  Synthetic
catctaatgcatucaacaatgatgtcaauga

SEQ ID NO: 52384 - DNA, 30 bp, Artificial Sequence
  Synthetic
gcttctaataaacaautggaatcactugct

SEQ ID NO: 52385 - DNA, 24 bp, Artificial Sequence
  Synthetic
ggtccucaaggtatcucagggaaa

SEQ ID NO: 52386 - DNA, 21 bp, Artificial Sequence
  Synthetic
cacttacaguctccccacgut

SEQ ID NO: 52387 - DNA, 31 bp, Artificial Sequence
  Synthetic
caacagaagagcaaaguaaaatagctaaugg

SEQ ID NO: 52388 - DNA, 26 bp, Artificial Sequence
  Synthetic
ttacttttucaccaggaggaccaaut

SEQ ID NO: 52389 - DNA, 24 bp, Artificial Sequence
  Synthetic
agcagcttgugtaaaactccucat

SEQ ID NO: 52390 - DNA, 24 bp, Artificial Sequence
  Synthetic
cataccatgtucccttttggucct

SEQ ID NO: 52391 - DNA, 28 bp, Artificial Sequence
  Synthetic
gtataggtcttguctcttcttcgttucc

SEQ ID NO: 52392 - DNA, 26 bp, Artificial Sequence
  Synthetic
aaagtaagtugcttacagctucacct

SEQ ID NO: 52393 - DNA, 28 bp, Artificial Sequence
  Synthetic
ggtgatgatggaaugagggtatgtuaat

SEQ ID NO: 52394 - DNA, 28 bp, Artificial Sequence
  Synthetic
aaagaacttacacugataccacatgugt

SEQ ID NO: 52395 - DNA, 18 bp, Artificial Sequence
  Synthetic
gggtcugccaggugacaa

SEQ ID NO: 52396 - DNA, 22 bp, Artificial Sequence
  Synthetic
caccagcucctctgaacaaaug

SEQ ID NO: 52397 - DNA, 27 bp, Artificial Sequence
  Synthetic
gggttatatttcccuggtagagatgut

SEQ ID NO: 52398 - DNA, 20 bp, Artificial Sequence
  Synthetic
gactccgagcaguctctguc

SEQ ID NO: 52399 - DNA, 20 bp, Artificial Sequence
  Synthetic
guagaccgccaagcgaucat

SEQ ID NO: 52400 - DNA, 25 bp, Artificial Sequence
  Synthetic
aactgagaauggcttttcauaccct

SEQ ID NO: 52401 - DNA, 21 bp, Artificial Sequence
  Synthetic
gagggctccugaaagcacuaa

SEQ ID NO: 52402 - DNA, 21 bp, Artificial Sequence
  Synthetic
cctcaggucccaatggttcug

SEQ ID NO: 52403 - DNA, 25 bp, Artificial Sequence
  Synthetic
agcaactatcugagtcccttcauct

SEQ ID NO: 52404 - DNA, 22 bp, Artificial Sequence
  Synthetic
cagagaccucggccattttuga

SEQ ID NO: 52405 - DNA, 23 bp, Artificial Sequence
  Synthetic
tggacaaagccaaucactgcuat

SEQ ID NO: 52406 - DNA, 25 bp, Artificial Sequence
  Synthetic
gtgttaaugaccacagactcuccac

SEQ ID NO: 52407 - DNA, 22 bp, Artificial Sequence
  Synthetic
gttttgaagugtgcagctguca

SEQ ID NO: 52408 - DNA, 20 bp, Artificial Sequence
  Synthetic
tcacttcucggctcggtgua

SEQ ID NO: 52409 - DNA, 28 bp, Artificial Sequence
  Synthetic
tggaaggaaaucctgtattttgugaaga

SEQ ID NO: 52410 - DNA, 26 bp, Artificial Sequence
  Synthetic
caactgccaaautcctaatugcacaa

SEQ ID NO: 52411 - DNA, 21 bp, Artificial Sequence
  Synthetic
acacagcutgcccatuacagt

SEQ ID NO: 52412 - DNA, 23 bp, Artificial Sequence
  Synthetic
ggaccccuggttttgtcttguaa

SEQ ID NO: 52413 - DNA, 29 bp, Artificial Sequence
  Synthetic
gataggaaagcagutagcaatgattctuc

SEQ ID NO: 52414 - DNA, 21 bp, Artificial Sequence
  Synthetic
caccagcacugaaccagagut

SEQ ID NO: 52415 - DNA, 22 bp, Artificial Sequence
  Synthetic
gtcacaggccagugtttctgua

SEQ ID NO: 52416 - DNA, 23 bp, Artificial Sequence
  Synthetic
tgcttgtuacacatttgctuccc

SEQ ID NO: 52417 - DNA, 28 bp, Artificial Sequence
  Synthetic
tttcaaaaatccaauctgactcctguct

SEQ ID NO: 52418 - DNA, 26 bp, Artificial Sequence
  Synthetic
ccaaaucagcaacgttaagttugcat

SEQ ID NO: 52419 - DNA, 23 bp, Artificial Sequence
  Synthetic
ggccctctaautgaagtggagut

SEQ ID NO: 52420 - DNA, 27 bp, Artificial Sequence
  Synthetic
gagaattcaaattucttcctccaccug

SEQ ID NO: 52421 - DNA, 22 bp, Artificial Sequence
  Synthetic
agtgatugccattcgaguggat

SEQ ID NO: 52422 - DNA, 25 bp, Artificial Sequence
  Synthetic
ctcagtgagaauctttccuggacaa

SEQ ID NO: 52423 - DNA, 28 bp, Artificial Sequence
  Synthetic
ggaaaaggaatagcuaggttcaccaaua

SEQ ID NO: 52424 - DNA, 20 bp, Artificial Sequence
  Synthetic
tucacucacacccgaaacca

SEQ ID NO: 52425 - DNA, 26 bp, Artificial Sequence
  Synthetic
gtaacccagatguggctattactgut

SEQ ID NO: 52426 - DNA, 24 bp, Artificial Sequence
  Synthetic
accttctagaugcttcttccugct

SEQ ID NO: 52427 - DNA, 23 bp, Artificial Sequence
  Synthetic
aatttccgugccacttcctttuc

SEQ ID NO: 52428 - DNA, 27 bp, Artificial Sequence
  Synthetic
tgctactttccuccttttgctaaagut

SEQ ID NO: 52429 - DNA, 25 bp, Artificial Sequence
  Synthetic
cttggttctttugttttggcaacug

SEQ ID NO: 52430 - DNA, 33 bp, Artificial Sequence
  Synthetic
tttaatctactacugaaaagacaaaugagacat

SEQ ID NO: 52431 - DNA, 25 bp, Artificial Sequence
  Synthetic
accugtttacagacuagaccacaca

SEQ ID NO: 52432 - DNA, 26 bp, Artificial Sequence
  Synthetic
cactcctattaacucacactcctugt

SEQ ID NO: 52433 - DNA, 21 bp, Artificial Sequence
  Synthetic
ggatgggaagcugctgtugag

SEQ ID NO: 52434 - DNA, 23 bp, Artificial Sequence
  Synthetic
cactagaaaacccugtgcaccut

SEQ ID NO: 52435 - DNA, 26 bp, Artificial Sequence
  Synthetic
aaaaaugggacagaaaagagacuggt

SEQ ID NO: 52436 - DNA, 26 bp, Artificial Sequence
  Synthetic
tgcttttgattuctgcaggatuaggt

SEQ ID NO: 52437 - DNA, 26 bp, Artificial Sequence
  Synthetic
tcttctctttgagugacagctgttut

SEQ ID NO: 52438 - DNA, 22 bp, Artificial Sequence
  Synthetic
ttttctgagccuctgccaacut

SEQ ID NO: 52439 - DNA, 29 bp, Artificial Sequence
  Synthetic
ccattcatcttcucttttccatgtgttut

SEQ ID NO: 52440 - DNA, 26 bp, Artificial Sequence
  Synthetic
gttgttaccacaaaaugaaaggcuca

SEQ ID NO: 52441 - DNA, 26 bp, Artificial Sequence
  Synthetic
ctttggcacagaguttcttattucct

SEQ ID NO: 52442 - DNA, 28 bp, Artificial Sequence
  Synthetic
gtctactgttcuagaaggcaaaucacat

SEQ ID NO: 52443 - DNA, 28 bp, Artificial Sequence
  Synthetic
ggaaaatttggugtagtggaaacuagga

SEQ ID NO: 52444 - DNA, 21 bp, Artificial Sequence
  Synthetic
agattccucagcagcgagaug

SEQ ID NO: 52445 - DNA, 28 bp, Artificial Sequence
  Synthetic
tcttcatcaaccuctggtaatcuacaga

SEQ ID NO: 52446 - DNA, 22 bp, Artificial Sequence
  Synthetic
tgttttggcuggaagcctgtua

SEQ ID NO: 52447 - DNA, 28 bp, Artificial Sequence
  Synthetic
cataaggagautatttagugcccagcat

SEQ ID NO: 52448 - DNA, 28 bp, Artificial Sequence
  Synthetic
ctagaaaaatuccagattgcttugccaa

SEQ ID NO: 52449 - DNA, 28 bp, Artificial Sequence
  Synthetic
cagtaggagguttacacuagaagcaaaa

SEQ ID NO: 52450 - DNA, 28 bp, Artificial Sequence
  Synthetic
tgtgaattcagtuccaaggtatttgugt

SEQ ID NO: 52451 - DNA, 26 bp, Artificial Sequence
  Synthetic
agtatttttccggutgtagcccaaua

SEQ ID NO: 52452 - DNA, 21 bp, Artificial Sequence
  Synthetic
gcaatgctgutcttgcagugg

SEQ ID NO: 52453 - DNA, 24 bp, Artificial Sequence
  Synthetic
aggtcctugaaccatgaactctug

SEQ ID NO: 52454 - DNA, 22 bp, Artificial Sequence
  Synthetic
cttgaaatcctugaggccccua

SEQ ID NO: 52455 - DNA, 28 bp, Artificial Sequence
  Synthetic
tgtgtagtaaaccccucattttctgtuc

SEQ ID NO: 52456 - DNA, 26 bp, Artificial Sequence
  Synthetic
catatgcaugtatacacucacccaca

SEQ ID NO: 52457 - DNA, 24 bp, Artificial Sequence
  Synthetic
tccccataccutcccaattugaac

SEQ ID NO: 52458 - DNA, 22 bp, Artificial Sequence
  Synthetic
ccattccacutaccaggtuggg

SEQ ID NO: 52459 - DNA, 28 bp, Artificial Sequence
  Synthetic
agtcattactuacaatgcgcauaacaga

SEQ ID NO: 52460 - DNA, 26 bp, Artificial Sequence
  Synthetic
ggagtaggaaaguttcaaagaccuga

SEQ ID NO: 52461 - DNA, 25 bp, Artificial Sequence
  Synthetic
caagtactaggutggttctgtggut

SEQ ID NO: 52462 - DNA, 25 bp, Artificial Sequence
  Synthetic
agaacauggaagtttgcuacgacat

SEQ ID NO: 52463 - DNA, 28 bp, Artificial Sequence
  Synthetic
caggaatgaautgctaaactguggaaaa

SEQ ID NO: 52464 - DNA, 22 bp, Artificial Sequence
  Synthetic
agaaaggaaagcaggugtuggt

SEQ ID NO: 52465 - DNA, 21 bp, Artificial Sequence
  Synthetic
catguaagccctgtgtuccgt

SEQ ID NO: 52466 - DNA, 21 bp, Artificial Sequence
  Synthetic
ccccgaacuggattctguact

SEQ ID NO: 52467 - DNA, 29 bp, Artificial Sequence
  Synthetic
ggtaccttgaugagctaaagaattccuaa

SEQ ID NO: 52468 - DNA, 22 bp, Artificial Sequence
  Synthetic
tgaaactctuaggctgcagcut

SEQ ID NO: 52469 - DNA, 25 bp, Artificial Sequence
  Synthetic
ctttcctgagacugcgtttauagca

SEQ ID NO: 52470 - DNA, 29 bp, Artificial Sequence
  Synthetic
tcttggacttguaacatctaatggactuc

SEQ ID NO: 52471 - DNA, 24 bp, Artificial Sequence
  Synthetic
tggctagautcttctugggcaaaa

SEQ ID NO: 52472 - DNA, 22 bp, Artificial Sequence
  Synthetic
gattctguccgtctcagcugaa

SEQ ID NO: 52473 - DNA, 25 bp, Artificial Sequence
  Synthetic
cctgtcagacugctttctttauggt

SEQ ID NO: 52474 - DNA, 21 bp, Artificial Sequence
  Synthetic
ctgggtcucctttgtcaccut

SEQ ID NO: 52475 - DNA, 23 bp, Artificial Sequence
  Synthetic
tgtggaucacaaggctttgtuct

SEQ ID NO: 52476 - DNA, 21 bp, Artificial Sequence
  Synthetic
agcucaggagagtcucggaaa

SEQ ID NO: 52477 - DNA, 21 bp, Artificial Sequence
  Synthetic
gucggagagaaaggugaaccc

SEQ ID NO: 52478 - DNA, 24 bp, Artificial Sequence
  Synthetic
gatctgagttugtgggttactugt

SEQ ID NO: 52479 - DNA, 20 bp, Artificial Sequence
  Synthetic
caccaggcutaccagggaug

SEQ ID NO: 52480 - DNA, 25 bp, Artificial Sequence
  Synthetic
gtgtataaactcuccaggttgccut

SEQ ID NO: 52481 - DNA, 24 bp, Artificial Sequence
  Synthetic
gcccatctaucctgacctguagac

SEQ ID NO: 52482 - DNA, 18 bp, Artificial Sequence
  Synthetic
ccgccgcaucttcuggaa

SEQ ID NO: 52483 - DNA, 20 bp, Artificial Sequence
  Synthetic
cuttgtgtcugacccaggca

SEQ ID NO: 52484 - DNA, 20 bp, Artificial Sequence
  Synthetic
agcauacccaaggcaacugt

SEQ ID NO: 52485 - DNA, 24 bp, Artificial Sequence
  Synthetic
actgcagcuggaagaaaagctuaa

SEQ ID NO: 52486 - DNA, 20 bp, Artificial Sequence
  Synthetic
ccagtcccuggttgugagat

SEQ ID NO: 52487 - DNA, 22 bp, Artificial Sequence
  Synthetic
ccaccaugaaggaagagtucgg

SEQ ID NO: 52488 - DNA, 21 bp, Artificial Sequence
  Synthetic
acgactacguagccctagcut

SEQ ID NO: 52489 - DNA, 25 bp, Artificial Sequence
  Synthetic
cctgttgatuatttctcctcucgct

SEQ ID NO: 52490 - DNA, 21 bp, Artificial Sequence
  Synthetic
tgttcacuccagctggctcua

SEQ ID NO: 52491 - DNA, 22 bp, Artificial Sequence
  Synthetic
ggtgcutttcaaccucaaggag

SEQ ID NO: 52492 - DNA, 20 bp, Artificial Sequence
  Synthetic
cctccaaggaggauggcuct

SEQ ID NO: 52493 - DNA, 20 bp, Artificial Sequence
  Synthetic
tccucgcuggagaagaccaa

SEQ ID NO: 52494 - DNA, 25 bp, Artificial Sequence
  Synthetic
atcagttccugtaatgctgugaaca

SEQ ID NO: 52495 - DNA, 22 bp, Artificial Sequence
  Synthetic
cttacctcaccauccctcctuc

SEQ ID NO: 52496 - DNA, 22 bp, Artificial Sequence
  Synthetic
ggagcgagugagtgattgtuct

SEQ ID NO: 52497 - DNA, 23 bp, Artificial Sequence
  Synthetic
caatatggguctctccuccacct

SEQ ID NO: 52498 - DNA, 21 bp, Artificial Sequence
  Synthetic
agctgcaagguctggaacaut

SEQ ID NO: 52499 - DNA, 23 bp, Artificial Sequence
  Synthetic
actttatgctgguactcacgcut

SEQ ID NO: 52500 - DNA, 25 bp, Artificial Sequence
  Synthetic
ggauatgttattgucggcaccaaag

SEQ ID NO: 52501 - DNA, 28 bp, Artificial Sequence
  Synthetic
actatcaccutcaatgacatucacagaa

SEQ ID NO: 52502 - DNA, 20 bp, Artificial Sequence
  Synthetic
ccutcucggaggaggcagat

SEQ ID NO: 52503 - DNA, 23 bp, Artificial Sequence
  Synthetic
tcacacagucagaacucagagga

SEQ ID NO: 52504 - DNA, 24 bp, Artificial Sequence
  Synthetic
gaactaggguagtcacctguacct

SEQ ID NO: 52505 - DNA, 28 bp, Artificial Sequence
  Synthetic
gtgaactgggugataatctgaagaugaa

SEQ ID NO: 52506 - DNA, 28 bp, Artificial Sequence
  Synthetic
attcgatcaaguatctgttgtgatucgt

SEQ ID NO: 52507 - DNA, 28 bp, Artificial Sequence
  Synthetic
gagagctaaguggcatatgtacattgua

SEQ ID NO: 52508 - DNA, 26 bp, Artificial Sequence
  Synthetic
ctctgcuaggacaggtaatttugagt

SEQ ID NO: 52509 - DNA, 21 bp, Artificial Sequence
  Synthetic
aacagttcaguggaggaugcc

SEQ ID NO: 52510 - DNA, 27 bp, Artificial Sequence
  Synthetic
agacttgtaaucaaccaattgtuccca

SEQ ID NO: 52511 - DNA, 25 bp, Artificial Sequence
  Synthetic
tgttttggacacautcctggttuct

SEQ ID NO: 52512 - DNA, 26 bp, Artificial Sequence
  Synthetic
aggtacagacaaaacutccaggagua

SEQ ID NO: 52513 - DNA, 26 bp, Artificial Sequence
  Synthetic
gcaaagtagauacaggcaaagttugg

SEQ ID NO: 52514 - DNA, 21 bp, Artificial Sequence
  Synthetic
ccaguccagggaagcatucac

SEQ ID NO: 52515 - DNA, 26 bp, Artificial Sequence
  Synthetic
cctatcttccccautttcaagggtua

SEQ ID NO: 52516 - DNA, 25 bp, Artificial Sequence
  Synthetic
ccctggtugttaatacacucaccac

SEQ ID NO: 52517 - DNA, 28 bp, Artificial Sequence
  Synthetic
aatggctaaugacatattgtaguggaaa

SEQ ID NO: 52518 - DNA, 21 bp, Artificial Sequence
  Synthetic
cccgtgtgutgtgtgtgtcua

SEQ ID NO: 52519 - DNA, 18 bp, Artificial Sequence
  Synthetic
gctgtccuccgccttgug

SEQ ID NO: 52520 - DNA, 21 bp, Artificial Sequence
  Synthetic
ccactttgauagcggtgucca

SEQ ID NO: 52521 - DNA, 19 bp, Artificial Sequence
  Synthetic
gtcacggacaccugcauga

SEQ ID NO: 52522 - DNA, 23 bp, Artificial Sequence
  Synthetic
ggacacagggcaccutauaaact

SEQ ID NO: 52523 - DNA, 23 bp, Artificial Sequence
  Synthetic
tguaaaacccctuccaacccaac

SEQ ID NO: 52524 - DNA, 19 bp, Artificial Sequence
  Synthetic
ccagguagcgaacctcguc

SEQ ID NO: 52525 - DNA, 24 bp, Artificial Sequence
  Synthetic
gcttctacccuggagttaatuggt

SEQ ID NO: 52526 - DNA, 19 bp, Artificial Sequence
  Synthetic
gtagggcaggcuctgctuc

SEQ ID NO: 52527 - DNA, 20 bp, Artificial Sequence
  Synthetic
ggcugcacgagcaaatctuc

SEQ ID NO: 52528 - DNA, 19 bp, Artificial Sequence
  Synthetic
atguccgaacgaggtggug

SEQ ID NO: 52529 - DNA, 22 bp, Artificial Sequence
  Synthetic
cccaagguaccatcttcugagt

SEQ ID NO: 52530 - DNA, 17 bp, Artificial Sequence
  Synthetic
agcuggcuggaggaggt

SEQ ID NO: 52531 - DNA, 17 bp, Artificial Sequence
  Synthetic
gcagccggacugacuga

SEQ ID NO: 52532 - DNA, 19 bp, Artificial Sequence
  Synthetic
gtgacaggugccaggacuc

SEQ ID NO: 52533 - DNA, 20 bp, Artificial Sequence
  Synthetic
ggccatccuggtaggugact

SEQ ID NO: 52534 - DNA, 18 bp, Artificial Sequence
  Synthetic
cuctguccgccacaccat

SEQ ID NO: 52535 - DNA, 18 bp, Artificial Sequence
  Synthetic
accggguatgggctcuga

SEQ ID NO: 52536 - DNA, 28 bp, Artificial Sequence
  Synthetic
accaaagaaauggatgacttccuacaaa

SEQ ID NO: 52537 - DNA, 27 bp, Artificial Sequence
  Synthetic
gcctatgatacutggcaacaataucct

SEQ ID NO: 52538 - DNA, 21 bp, Artificial Sequence
  Synthetic
gctacccuccagacucaaggt

SEQ ID NO: 52539 - DNA, 24 bp, Artificial Sequence
  Synthetic
cttattgacccugacctgtctucc

SEQ ID NO: 52540 - DNA, 21 bp, Artificial Sequence
  Synthetic
agcagtuccacttacgugcat

SEQ ID NO: 52541 - DNA, 24 bp, Artificial Sequence
  Synthetic
agcatggagaagcuttagaauggg

SEQ ID NO: 52542 - DNA, 18 bp, Artificial Sequence
  Synthetic
gggacacaccugcuggaa

SEQ ID NO: 52543 - DNA, 18 bp, Artificial Sequence
  Synthetic
cuccaccgagctcuccac

SEQ ID NO: 52544 - DNA, 22 bp, Artificial Sequence
  Synthetic
ggccttcuccctgacacataut

SEQ ID NO: 52545 - DNA, 21 bp, Artificial Sequence
  Synthetic
acaggaaagauggguggcaag

SEQ ID NO: 52546 - DNA, 26 bp, Artificial Sequence
  Synthetic
cagccgttctugagatttccttatuc

SEQ ID NO: 52547 - DNA, 21 bp, Artificial Sequence
  Synthetic
ctggctgcugatggatuacct

SEQ ID NO: 52548 - DNA, 22 bp, Artificial Sequence
  Synthetic
ggcacauaagaacctgguagcc

SEQ ID NO: 52549 - DNA, 25 bp, Artificial Sequence
  Synthetic
gtggutccagcttaugaagaagaga

SEQ ID NO: 52550 - DNA, 26 bp, Artificial Sequence
  Synthetic
acgatttttaguctgcattgcttugg

SEQ ID NO: 52551 - DNA, 26 bp, Artificial Sequence
  Synthetic
tgctcagctgcutctttaaacagaua

SEQ ID NO: 52552 - DNA, 22 bp, Artificial Sequence
  Synthetic
gttgttgcccutgtctgtgtuc

SEQ ID NO: 52553 - DNA, 24 bp, Artificial Sequence
  Synthetic
tggcgagaagaccautatcaucac

SEQ ID NO: 52554 - DNA, 21 bp, Artificial Sequence
  Synthetic
ctacaugcccacctagtugga

SEQ ID NO: 52555 - DNA, 24 bp, Artificial Sequence
  Synthetic
tgaaggacacaccccuctauacag

SEQ ID NO: 52556 - DNA, 21 bp, Artificial Sequence
  Synthetic
cactccgaacuggccaucaat

SEQ ID NO: 52557 - DNA, 22 bp, Artificial Sequence
  Synthetic
ggtatagaaacccugcgagucc

SEQ ID NO: 52558 - DNA, 23 bp, Artificial Sequence
  Synthetic
agtggtggcugtagcctctaaua

SEQ ID NO: 52559 - DNA, 23 bp, Artificial Sequence
  Synthetic
ctccaucaaagaacacctcugct

SEQ ID NO: 52560 - DNA, 20 bp, Artificial Sequence
  Synthetic
ccagacggaaaccguagcug

SEQ ID NO: 52561 - DNA, 24 bp, Artificial Sequence
  Synthetic
cccggacgauattgaacaatggut

SEQ ID NO: 52562 - DNA, 20 bp, Artificial Sequence
  Synthetic
cctaaacuggccccacauga

SEQ ID NO: 52563 - DNA, 24 bp, Artificial Sequence
  Synthetic
ctcccatatcucagaggcccauat

SEQ ID NO: 52564 - DNA, 22 bp, Artificial Sequence
  Synthetic
cccacctacuctaccactcuct

SEQ ID NO: 52565 - DNA, 22 bp, Artificial Sequence
  Synthetic
cagtaaggcugtcagtggtuga

SEQ ID NO: 52566 - DNA, 21 bp, Artificial Sequence
  Synthetic
cagcacaaggutgtgtgtuga

SEQ ID NO: 52567 - DNA, 24 bp, Artificial Sequence
  Synthetic
ccaccacguatttgcttccuaact

SEQ ID NO: 52568 - DNA, 17 bp, Artificial Sequence
  Synthetic
gcggcguctacctggug

SEQ ID NO: 52569 - DNA, 20 bp, Artificial Sequence
  Synthetic
cccgagacugcagacacaut

SEQ ID NO: 52570 - DNA, 24 bp, Artificial Sequence
  Synthetic
tggacagtcuacgaaaagctctug

SEQ ID NO: 52571 - DNA, 27 bp, Artificial Sequence
  Synthetic
ggactgaacaaguaggaaaaugacaga

SEQ ID NO: 52572 - DNA, 23 bp, Artificial Sequence
  Synthetic
gcagatacaccugtcagcaaaut

SEQ ID NO: 52573 - DNA, 24 bp, Artificial Sequence
  Synthetic
gagaacacttuacctgtcctuggg

SEQ ID NO: 52574 - DNA, 23 bp, Artificial Sequence
  Synthetic
ggtgtgugtgtggctucaaaaac

SEQ ID NO: 52575 - DNA, 27 bp, Artificial Sequence
  Synthetic
agacattttacaucatcatctgcugct

SEQ ID NO: 52576 - DNA, 23 bp, Artificial Sequence
  Synthetic
gttttctgccccaugcaataguc

SEQ ID NO: 52577 - DNA, 21 bp, Artificial Sequence
  Synthetic
tgaguggcagcagacauacac

SEQ ID NO: 52578 - DNA, 21 bp, Artificial Sequence
  Synthetic
cccagutcctccugagaacaa

SEQ ID NO: 52579 - DNA, 19 bp, Artificial Sequence
  Synthetic
ggcucaaagcacggcuaag

SEQ ID NO: 52580 - DNA, 26 bp, Artificial Sequence
  Synthetic
guatgttaaguccacagaaccacaga

SEQ ID NO: 52581 - DNA, 20 bp, Artificial Sequence
  Synthetic
cagcauccaacccacccuac

SEQ ID NO: 52582 - DNA, 21 bp, Artificial Sequence
  Synthetic
gccttctugaggttgccaguc

SEQ ID NO: 52583 - DNA, 21 bp, Artificial Sequence
  Synthetic
aggactagaggutcccgcaua

SEQ ID NO: 52584 - DNA, 21 bp, Artificial Sequence
  Synthetic
tgtcaggcggaagutccatug

SEQ ID NO: 52585 - DNA, 22 bp, Artificial Sequence
  Synthetic
gccaagagcucatgctttccut

SEQ ID NO: 52586 - DNA, 20 bp, Artificial Sequence
  Synthetic
gctuaggcaaggccacaaug

SEQ ID NO: 52587 - DNA, 25 bp, Artificial Sequence
  Synthetic
cctatctctggccugactctttcut

SEQ ID NO: 52588 - DNA, 21 bp, Artificial Sequence
  Synthetic
tctggacuctgaggucccaaa

SEQ ID NO: 52589 - DNA, 25 bp, Artificial Sequence
  Synthetic
cctcactcugacttctcttgttugt

SEQ ID NO: 52590 - DNA, 20 bp, Artificial Sequence
  Synthetic
agagtgcaacgcutacccut

SEQ ID NO: 52591 - DNA, 20 bp, Artificial Sequence
  Synthetic
gctcuaacgcgcgtctctuc

SEQ ID NO: 52592 - DNA, 21 bp, Artificial Sequence
  Synthetic
actcucagcccaccttctcuc

SEQ ID NO: 52593 - DNA, 23 bp, Artificial Sequence
  Synthetic
ggacagtccacguttgcttctua

SEQ ID NO: 52594 - DNA, 21 bp, Artificial Sequence
  Synthetic
ccauaccaggccaaacagtug

SEQ ID NO: 52595 - DNA, 22 bp, Artificial Sequence
  Synthetic
gacctaugaagggcctggacua

SEQ ID NO: 52596 - DNA, 21 bp, Artificial Sequence
  Synthetic
cggaggaagucggugaagaac

SEQ ID NO: 52597 - DNA, 20 bp, Artificial Sequence
  Synthetic
cgggacggagauagcttguc

SEQ ID NO: 52598 - DNA, 22 bp, Artificial Sequence
  Synthetic
gggccagutaaucagacacaca

SEQ ID NO: 52599 - DNA, 22 bp, Artificial Sequence
  Synthetic
cggaagaggcuacgttcttcuc

SEQ ID NO: 52600 - DNA, 26 bp, Artificial Sequence
  Synthetic
atgctgagaaggguataaatgcagut

SEQ ID NO: 52601 - DNA, 21 bp, Artificial Sequence
  Synthetic
ttcaattgcagcutccgctug

SEQ ID NO: 52602 - DNA, 22 bp, Artificial Sequence
  Synthetic
gggtggcgucaacttgtaucaa

SEQ ID NO: 52603 - DNA, 20 bp, Artificial Sequence
  Synthetic
ggccaaguactgagccucaa

SEQ ID NO: 52604 - DNA, 21 bp, Artificial Sequence
  Synthetic
gauggtcaaggugacacagga

SEQ ID NO: 52605 - DNA, 20 bp, Artificial Sequence
  Synthetic
gctttuaaggctgcgugcaa

SEQ ID NO: 52606 - DNA, 20 bp, Artificial Sequence
  Synthetic
tcttccctguccgccaagua

SEQ ID NO: 52607 - DNA, 27 bp, Artificial Sequence
  Synthetic
gctgctcacatutctttgtgtttctuc

SEQ ID NO: 52608 - DNA, 20 bp, Artificial Sequence
  Synthetic
tccaagcaguccctagugct

SEQ ID NO: 52609 - DNA, 25 bp, Artificial Sequence
  Synthetic
gacaaacacaatuccggatctctuc

SEQ ID NO: 52610 - DNA, 19 bp, Artificial Sequence
  Synthetic
cgacgguactgccucaagt

SEQ ID NO: 52611 - DNA, 20 bp, Artificial Sequence
  Synthetic
cagtcctugaaggccagcut

SEQ ID NO: 52612 - DNA, 21 bp, Artificial Sequence
  Synthetic
guagcacucaaagccagcaac

SEQ ID NO: 52613 - DNA, 26 bp, Artificial Sequence
  Synthetic
tgactagcaaguatgactccaugaca

SEQ ID NO: 52614 - DNA, 23 bp, Artificial Sequence
  Synthetic
gatatacugccctgtgcucagaa

SEQ ID NO: 52615 - DNA, 25 bp, Artificial Sequence
  Synthetic
gacttauagccagtaatgucaccga

SEQ ID NO: 52616 - DNA, 22 bp, Artificial Sequence
  Synthetic
catgcagguactgactgaugga

SEQ ID NO: 52617 - DNA, 21 bp, Artificial Sequence
  Synthetic
acctccuggcaccctcttaut

SEQ ID NO: 52618 - DNA, 26 bp, Artificial Sequence
  Synthetic
gagaaaaaccacagauaagcgcauac

SEQ ID NO: 52619 - DNA, 26 bp, Artificial Sequence
  Synthetic
ggtataaccttugtttccctctgucc

SEQ ID NO: 52620 - DNA, 21 bp, Artificial Sequence
  Synthetic
ccacaaacucccugagcagaa

SEQ ID NO: 52621 - DNA, 25 bp, Artificial Sequence
  Synthetic
aaaaggcattauccgcttgatgtug

SEQ ID NO: 52622 - DNA, 21 bp, Artificial Sequence
  Synthetic
gctgtgctcauggctgatcut

SEQ ID NO: 52623 - DNA, 28 bp, Artificial Sequence
  Synthetic
tcccaacaugacacttaacatattucca

SEQ ID NO: 52624 - DNA, 28 bp, Artificial Sequence
  Synthetic
gaaugaattagcagtucaaaaccagcat

SEQ ID NO: 52625 - DNA, 22 bp, Artificial Sequence
  Synthetic
gcgtgaucaccacaacatcauc

SEQ ID NO: 52626 - DNA, 17 bp, Artificial Sequence
  Synthetic
cagagggcuccgtucca

SEQ ID NO: 52627 - DNA, 18 bp, Artificial Sequence
  Synthetic
gaugagaggcaggcgcut

SEQ ID NO: 52628 - DNA, 28 bp, Artificial Sequence
  Synthetic
cttgaaagagctguagatgttagaggut

SEQ ID NO: 52629 - DNA, 28 bp, Artificial Sequence
  Synthetic
ctttacagtguatgtgccatttugaaca

SEQ ID NO: 52630 - DNA, 22 bp, Artificial Sequence
  Synthetic
tgattgcttucaggtgcagcua

SEQ ID NO: 52631 - DNA, 21 bp, Artificial Sequence
  Synthetic
acacacgucactgctccuaga

SEQ ID NO: 52632 - DNA, 20 bp, Artificial Sequence
  Synthetic
ggcacugacctggacttuga

SEQ ID NO: 52633 - DNA, 17 bp, Artificial Sequence
  Synthetic
ggcagccutcggctuct

SEQ ID NO: 52634 - DNA, 23 bp, Artificial Sequence
  Synthetic
cctccagacaucgaguaccagat

SEQ ID NO: 52635 - DNA, 22 bp, Artificial Sequence
  Synthetic
tgactuggaaccaaggatgcug

SEQ ID NO: 52636 - DNA, 24 bp, Artificial Sequence
  Synthetic
cctgattuacccacaacccuaact

SEQ ID NO: 52637 - DNA, 26 bp, Artificial Sequence
  Synthetic
gggtttccaggutagctcgattttua

SEQ ID NO: 52638 - DNA, 27 bp, Artificial Sequence
  Synthetic
aaagacugaggaaatcaugaaggaagg

SEQ ID NO: 52639 - DNA, 28 bp, Artificial Sequence
  Synthetic
caagtaggccautttacaaacaagctua

SEQ ID NO: 52640 - DNA, 23 bp, Artificial Sequence
  Synthetic
ggtcatgauggaggaggguagag

SEQ ID NO: 52641 - DNA, 18 bp, Artificial Sequence
  Synthetic
ccuggcaccgcaagtcua

SEQ ID NO: 52642 - DNA, 19 bp, Artificial Sequence
  Synthetic
gctggcugccaucgaagag

SEQ ID NO: 52643 - DNA, 20 bp, Artificial Sequence
  Synthetic
ggtgcacccggutttctuca

SEQ ID NO: 52644 - DNA, 20 bp, Artificial Sequence
  Synthetic
gagcagagcagucacugagt

SEQ ID NO: 52645 - DNA, 21 bp, Artificial Sequence
  Synthetic
cactcctucgccaagtuccat

SEQ ID NO: 52646 - DNA, 21 bp, Artificial Sequence
  Synthetic
cacugcaggaaccactucagt

SEQ ID NO: 52647 - DNA, 21 bp, Artificial Sequence
  Synthetic
cttgtaaccgcguagccatuc

SEQ ID NO: 52648 - DNA, 22 bp, Artificial Sequence
  Synthetic
cagcauccttcccaucagaaca

SEQ ID NO: 52649 - DNA, 23 bp, Artificial Sequence
  Synthetic
gggagauaaagggtccaaugagg

SEQ ID NO: 52650 - DNA, 22 bp, Artificial Sequence
  Synthetic
actgtccuctgtcctctuagcc

SEQ ID NO: 52651 - DNA, 21 bp, Artificial Sequence
  Synthetic
tcagcuctggaaucggagagt

SEQ ID NO: 52652 - DNA, 20 bp, Artificial Sequence
  Synthetic
ccagttggucctgcactuca

SEQ ID NO: 52653 - DNA, 28 bp, Artificial Sequence
  Synthetic
gcctgaccagcaaagugatattuaaaga

SEQ ID NO: 52654 - DNA, 19 bp, Artificial Sequence
  Synthetic
gtgtctuggcgcatcugac

SEQ ID NO: 52655 - DNA, 23 bp, Artificial Sequence
  Synthetic
gggcggaaacuaattcagucaac

SEQ ID NO: 52656 - DNA, 21 bp, Artificial Sequence
  Synthetic
ccaggaatccaucagcgacut

SEQ ID NO: 52657 - DNA, 22 bp, Artificial Sequence
  Synthetic
gaagggaucagggatcacgaug

SEQ ID NO: 52658 - DNA, 22 bp, Artificial Sequence
  Synthetic
agagaatugaggctcuccaggt

SEQ ID NO: 52659 - DNA, 25 bp, Artificial Sequence
  Synthetic
cgcagttgaucatttcgttctcauc

SEQ ID NO: 52660 - DNA, 18 bp, Artificial Sequence
  Synthetic
ccgcaucgagcgcatcua

SEQ ID NO: 52661 - DNA, 24 bp, Artificial Sequence
  Synthetic
gctggacgaaaugtguacaaaagg

SEQ ID NO: 52662 - DNA, 21 bp, Artificial Sequence
  Synthetic
tggcagacccacagaugaauc

SEQ ID NO: 52663 - DNA, 22 bp, Artificial Sequence
  Synthetic
gtgctttccuccaggaaguagt

SEQ ID NO: 52664 - DNA, 17 bp, Artificial Sequence
  Synthetic
ctgaccuggccccaucc

SEQ ID NO: 52665 - DNA, 19 bp, Artificial Sequence
  Synthetic
gggcucaccgtcatcaugt

SEQ ID NO: 52666 - DNA, 21 bp, Artificial Sequence
  Synthetic
cctggagguaggtagcuggag

SEQ ID NO: 52667 - DNA, 21 bp, Artificial Sequence
  Synthetic
tgacccccugaatcccguaat

SEQ ID NO: 52668 - DNA, 22 bp, Artificial Sequence
  Synthetic
gcacagcauagttgtgtugagg

SEQ ID NO: 52669 - DNA, 23 bp, Artificial Sequence
  Synthetic
actcuccagccaaagaccuaagt

SEQ ID NO: 52670 - DNA, 18 bp, Artificial Sequence
  Synthetic
guccccaagacccuccac

SEQ ID NO: 52671 - DNA, 19 bp, Artificial Sequence
  Synthetic
gggcgtaggucatggcaua

SEQ ID NO: 52672 - DNA, 20 bp, Artificial Sequence
  Synthetic
gtttcagcutcgccaucagg

SEQ ID NO: 52673 - DNA, 21 bp, Artificial Sequence
  Synthetic
cgacaacgcugaacucacagt

SEQ ID NO: 52674 - DNA, 24 bp, Artificial Sequence
  Synthetic
gggtctctugtcacttacaucgaa

SEQ ID NO: 52675 - DNA, 17 bp, Artificial Sequence
  Synthetic
gggagguggcucaggga

SEQ ID NO: 52676 - DNA, 19 bp, Artificial Sequence
  Synthetic
tgagaugcggcactcgaut

SEQ ID NO: 52677 - DNA, 25 bp, Artificial Sequence
  Synthetic
cagagctuaaaccgaatggaguaca

SEQ ID NO: 52678 - DNA, 28 bp, Artificial Sequence
  Synthetic
tacagaaaaatuagacaaagggctcuca

SEQ ID NO: 52679 - DNA, 26 bp, Artificial Sequence
  Synthetic
gtctcttagtgacuccaggatcttut

SEQ ID NO: 52680 - DNA, 24 bp, Artificial Sequence
  Synthetic
aagaggcutatuaccagagggaca

SEQ ID NO: 52681 - DNA, 23 bp, Artificial Sequence
  Synthetic
cctacgaugcagagctctcttut

SEQ ID NO: 52682 - DNA, 17 bp, Artificial Sequence
  Synthetic
acguccuccgccagact

SEQ ID NO: 52683 - DNA, 18 bp, Artificial Sequence
  Synthetic
ggcucggaggcgaagaug

SEQ ID NO: 52684 - DNA, 20 bp, Artificial Sequence
  Synthetic
ccaggatauctgggctucgg

SEQ ID NO: 52685 - DNA, 22 bp, Artificial Sequence
  Synthetic
cttagaugccccagggaaagug

SEQ ID NO: 52686 - DNA, 26 bp, Artificial Sequence
  Synthetic
cacaagcauaagaagcctttuggaaa

SEQ ID NO: 52687 - DNA, 21 bp, Artificial Sequence
  Synthetic
agagtctguggaagagguggt

SEQ ID NO: 52688 - DNA, 19 bp, Artificial Sequence
  Synthetic
gctcaccuaagcagcggua

SEQ ID NO: 52689 - DNA, 25 bp, Artificial Sequence
  Synthetic
cccctgccucaagtaacaattgaut

SEQ ID NO: 52690 - DNA, 24 bp, Artificial Sequence
  Synthetic
ccacccuctagtcatgauggagat

SEQ ID NO: 52691 - DNA, 22 bp, Artificial Sequence
  Synthetic
catagcgcuccaggttgtaguc

SEQ ID NO: 52692 - DNA, 19 bp, Artificial Sequence
  Synthetic
gggtgggacgutcactgua

SEQ ID NO: 52693 - DNA, 20 bp, Artificial Sequence
  Synthetic
tgtggatgugtcgctctguc

SEQ ID NO: 52694 - DNA, 28 bp, Artificial Sequence
  Synthetic
tgagggaatttggutcatgcttatctut

SEQ ID NO: 52695 - DNA, 23 bp, Artificial Sequence
  Synthetic
agaggcgagagaguttcugaaga

SEQ ID NO: 52696 - DNA, 26 bp, Artificial Sequence
  Synthetic
tgaacctaccagaugtatttgggtug

SEQ ID NO: 52697 - DNA, 27 bp, Artificial Sequence
  Synthetic
agagccctttcutgtgaatatgtcaut

SEQ ID NO: 52698 - DNA, 21 bp, Artificial Sequence
  Synthetic
gggcaaagacuggagtuagca

SEQ ID NO: 52699 - DNA, 18 bp, Artificial Sequence
  Synthetic
gccaaccugtccguggag

SEQ ID NO: 52700 - DNA, 22 bp, Artificial Sequence
  Synthetic
ggctcaugtattcccugcaaga

SEQ ID NO: 52701 - DNA, 20 bp, Artificial Sequence
  Synthetic
gttgtgcutgtccccuagca

SEQ ID NO: 52702 - DNA, 18 bp, Artificial Sequence
  Synthetic
cccugctuacccaaagcc

SEQ ID NO: 52703 - DNA, 28 bp, Artificial Sequence
  Synthetic
tgcttgttgaguattgagatatgtguga

SEQ ID NO: 52704 - DNA, 28 bp, Artificial Sequence
  Synthetic
gcaaagccaaaaucacaaattcgaauag

SEQ ID NO: 52705 - DNA, 28 bp, Artificial Sequence
  Synthetic
tgcattgctugacagtttgtgaauaaag

SEQ ID NO: 52706 - DNA, 28 bp, Artificial Sequence
  Synthetic
ttctctgttatcaugtggacttttcugg

SEQ ID NO: 52707 - DNA, 25 bp, Artificial Sequence
  Synthetic
ctgaggatucagaagctgttuacga

SEQ ID NO: 52708 - DNA, 22 bp, Artificial Sequence
  Synthetic
tgtcctaagaccugctcagcut

SEQ ID NO: 52709 - DNA, 28 bp, Artificial Sequence
  Synthetic
gtctcctccagacuagcatttactacua

SEQ ID NO: 52710 - DNA, 21 bp, Artificial Sequence
  Synthetic
tcgguaagttctguccaagcc

SEQ ID NO: 52711 - DNA, 27 bp, Artificial Sequence
  Synthetic
tgaaattggctcuttagcttgtgttuc

SEQ ID NO: 52712 - DNA, 25 bp, Artificial Sequence
  Synthetic
gcaaaaagttcccuaccttaacguc

SEQ ID NO: 52713 - DNA, 25 bp, Artificial Sequence
  Synthetic
gcttgaagaccutgaagagcagtua

SEQ ID NO: 52714 - DNA, 27 bp, Artificial Sequence
  Synthetic
gttgugagaaaaacacttuagcaagga

SEQ ID NO: 52715 - DNA, 27 bp, Artificial Sequence
  Synthetic
ctagtatcccacutgaaccuggaaaag

SEQ ID NO: 52716 - DNA, 28 bp, Artificial Sequence
  Synthetic
acatgtgccaatutttgttctcaatcut

SEQ ID NO: 52717 - DNA, 24 bp, Artificial Sequence
  Synthetic
ctgcatuggaaacaaagagtgugg

SEQ ID NO: 52718 - DNA, 27 bp, Artificial Sequence
  Synthetic
tcttctttttcugaaagccatgcacua

SEQ ID NO: 52719 - DNA, 28 bp, Artificial Sequence
  Synthetic
atgtgtgagaaacuagctguaaaagaca

SEQ ID NO: 52720 - DNA, 25 bp, Artificial Sequence
  Synthetic
agaaatctcuccttgtgctugcaat

SEQ ID NO: 52721 - DNA, 28 bp, Artificial Sequence
  Synthetic
gcaaagacautaattgtguaacacccaa

SEQ ID NO: 52722 - DNA, 27 bp, Artificial Sequence
  Synthetic
ctgacauttggctttuaggaaacaagt

SEQ ID NO: 52723 - DNA, 27 bp, Artificial Sequence
  Synthetic
caatcacttcatucctactttgtgcuc

SEQ ID NO: 52724 - DNA, 28 bp, Artificial Sequence
  Synthetic
agaccctaacauataaaagcagttcuga

SEQ ID NO: 52725 - DNA, 23 bp, Artificial Sequence
  Synthetic
ggatcaaagucagccaucagcaa

SEQ ID NO: 52726 - DNA, 21 bp, Artificial Sequence
  Synthetic
acacccctcucagatccctug

SEQ ID NO: 52727 - DNA, 27 bp, Artificial Sequence
  Synthetic
ctggtcctcaaugaagtcgtagauaag

SEQ ID NO: 52728 - DNA, 21 bp, Artificial Sequence
  Synthetic
agatcggugctggagtcugat

SEQ ID NO: 52729 - DNA, 25 bp, Artificial Sequence
  Synthetic
ggagatctguttaaggagccucaaa

SEQ ID NO: 52730 - DNA, 22 bp, Artificial Sequence
  Synthetic
agcccaucccccatattccuaa

SEQ ID NO: 52731 - DNA, 22 bp, Artificial Sequence
  Synthetic
gtccagcagucgatgtggauag

SEQ ID NO: 52732 - DNA, 23 bp, Artificial Sequence
  Synthetic
actgtgtacatuggcttgtccut

SEQ ID NO: 52733 - DNA, 22 bp, Artificial Sequence
  Synthetic
agaacgagccugttctgtugac

SEQ ID NO: 52734 - DNA, 28 bp, Artificial Sequence
  Synthetic
gatacctcaaggaautctcctaaacugg

SEQ ID NO: 52735 - DNA, 23 bp, Artificial Sequence
  Synthetic
acaagttaaacuggcagcacuct

SEQ ID NO: 52736 - DNA, 20 bp, Artificial Sequence
  Synthetic
cctgguccagcaacaucaac

SEQ ID NO: 52737 - DNA, 28 bp, Artificial Sequence
  Synthetic
cctcctttaaacugttttcatcucacaa

SEQ ID NO: 52738 - DNA, 21 bp, Artificial Sequence
  Synthetic
gtgcaagctucctgagaggua

SEQ ID NO: 52739 - DNA, 21 bp, Artificial Sequence
  Synthetic
tccuggagaacacccauagca

SEQ ID NO: 52740 - DNA, 22 bp, Artificial Sequence
  Synthetic
gccctgauggcttctttcttug

SEQ ID NO: 52741 - DNA, 24 bp, Artificial Sequence
  Synthetic
acttctaaccuactctgcctgcua

SEQ ID NO: 52742 - DNA, 22 bp, Artificial Sequence
  Synthetic
ttgaaagcaccaauagcccugt

SEQ ID NO: 52743 - DNA, 28 bp, Artificial Sequence
  Synthetic
ccagagcucaagataucaagaaaaggaa

SEQ ID NO: 52744 - DNA, 24 bp, Artificial Sequence
  Synthetic
gtactcaugcccaagttagcuagg

SEQ ID NO: 52745 - DNA, 28 bp, Artificial Sequence
  Synthetic
cttgggcttccutataattgttgtctut

SEQ ID NO: 52746 - DNA, 28 bp, Artificial Sequence
  Synthetic
caatcaggtugcagattctaaaatugct

SEQ ID NO: 52747 - DNA, 25 bp, Artificial Sequence
  Synthetic
tgttctcaautgtcctttcuccaca

SEQ ID NO: 52748 - DNA, 20 bp, Artificial Sequence
  Synthetic
gctuccgaaggagaccctug

SEQ ID NO: 52749 - DNA, 22 bp, Artificial Sequence
  Synthetic
ctctgtgggaaucaggtggtua

SEQ ID NO: 52750 - DNA, 28 bp, Artificial Sequence
  Synthetic
ttttagaggacacutttctgttggtuct

SEQ ID NO: 52751 - DNA, 27 bp, Artificial Sequence
  Synthetic
caggugaaggacgagaatatctucaat

SEQ ID NO: 52752 - DNA, 22 bp, Artificial Sequence
  Synthetic
ggcuggaggaggtauacaggat

SEQ ID NO: 52753 - DNA, 20 bp, Artificial Sequence
  Synthetic
ccatctcgguggtgtgctuc

SEQ ID NO: 52754 - DNA, 21 bp, Artificial Sequence
  Synthetic
catcaggaaaccuggccuacc

SEQ ID NO: 52755 - DNA, 28 bp, Artificial Sequence
  Synthetic
gccctacaauaacatactccatucagaa

SEQ ID NO: 52756 - DNA, 21 bp, Artificial Sequence
  Synthetic
ctgtgcaaauccctcccucaa

SEQ ID NO: 52757 - DNA, 27 bp, Artificial Sequence
  Synthetic
caagccatacagutgttggaaaagaug

SEQ ID NO: 52758 - DNA, 23 bp, Artificial Sequence
  Synthetic
acacttacccugctcttttggug

SEQ ID NO: 52759 - DNA, 28 bp, Artificial Sequence
  Synthetic
ccattcttatggacuaaaaggtgctcut

SEQ ID NO: 52760 - DNA, 22 bp, Artificial Sequence
  Synthetic
caatgcugagaggtguggacat

SEQ ID NO: 52761 - DNA, 19 bp, Artificial Sequence
  Synthetic
ccaacacguccacctucgt

SEQ ID NO: 52762 - DNA, 21 bp, Artificial Sequence
  Synthetic
agaggtcuggacttccagcut

SEQ ID NO: 52763 - DNA, 23 bp, Artificial Sequence
  Synthetic
agatgcaacucagatcacucagg

SEQ ID NO: 52764 - DNA, 21 bp, Artificial Sequence
  Synthetic
ccatgacagugggcaucacag

SEQ ID NO: 52765 - DNA, 21 bp, Artificial Sequence
  Synthetic
cgaggaggaugatggcgagua

SEQ ID NO: 52766 - DNA, 26 bp, Artificial Sequence
  Synthetic
ctgctaggatutagcacaaagguaga

SEQ ID NO: 52767 - DNA, 23 bp, Artificial Sequence
  Synthetic
actctcuagacccaccgttacug

SEQ ID NO: 52768 - DNA, 26 bp, Artificial Sequence
  Synthetic
ccacattgctacucactattgctgua

SEQ ID NO: 52769 - DNA, 28 bp, Artificial Sequence
  Synthetic
gcataaaccaatguatctcatgctcaut

SEQ ID NO: 52770 - DNA, 29 bp, Artificial Sequence
  Synthetic
ttctctacaattugcttggtttgattucc

SEQ ID NO: 52771 - DNA, 27 bp, Artificial Sequence
  Synthetic
tgactggcacuaagaatttcaugaaga

SEQ ID NO: 52772 - DNA, 25 bp, Artificial Sequence
  Synthetic
ggtccatgagcucttttcccttuaa

SEQ ID NO: 52773 - DNA, 24 bp, Artificial Sequence
  Synthetic
tggcaaaaagucatctcccctuac

SEQ ID NO: 52774 - DNA, 26 bp, Artificial Sequence
  Synthetic
accttaaacauggcttcaggattugt

SEQ ID NO: 52775 - DNA, 26 bp, Artificial Sequence
  Synthetic
ctctccttccuttatccaaatucgct

SEQ ID NO: 52776 - DNA, 24 bp, Artificial Sequence
  Synthetic
ccaccatuacaaagcacacacauc

SEQ ID NO: 52777 - DNA, 22 bp, Artificial Sequence
  Synthetic
cctttggcggacauctcatuct

SEQ ID NO: 52778 - DNA, 20 bp, Artificial Sequence
  Synthetic
gctgccccaggcuttgauaa

SEQ ID NO: 52779 - DNA, 27 bp, Artificial Sequence
  Synthetic
gtgccccataautaaatctttctgugt

SEQ ID NO: 52780 - DNA, 26 bp, Artificial Sequence
  Synthetic
tgaaattggauattgcagcagucaga

SEQ ID NO: 52781 - DNA, 31 bp, Artificial Sequence
  Synthetic
gctcctttataagcutcttcagtatatguca

SEQ ID NO: 52782 - DNA, 24 bp, Artificial Sequence
  Synthetic
gggaggacutttctctuggcaaat

SEQ ID NO: 52783 - DNA, 20 bp, Artificial Sequence
  Synthetic
gcauaucaccagcccggaaa

SEQ ID NO: 52784 - DNA, 21 bp, Artificial Sequence
  Synthetic
ggtgcaguaggttggttucct

SEQ ID NO: 52785 - DNA, 22 bp, Artificial Sequence
  Synthetic
agacagtuacagggagggtcug

SEQ ID NO: 52786 - DNA, 22 bp, Artificial Sequence
  Synthetic
tttatguggcgaagcuggaact

SEQ ID NO: 52787 - DNA, 21 bp, Artificial Sequence
  Synthetic
aagacctucaggcagaagugg

SEQ ID NO: 52788 - DNA, 22 bp, Artificial Sequence
  Synthetic
tggttccucagaacaucaagcc

SEQ ID NO: 52789 - DNA, 20 bp, Artificial Sequence
  Synthetic
gagatgtuggccagctggua

SEQ ID NO: 52790 - DNA, 27 bp, Artificial Sequence
  Synthetic
tccttgaagcauctcatctatgtctug

SEQ ID NO: 52791 - DNA, 20 bp, Artificial Sequence
  Synthetic
cgagagcccaccauggttug

SEQ ID NO: 52792 - DNA, 27 bp, Artificial Sequence
  Synthetic
catgtatgtcuagttggatgatuggct

SEQ ID NO: 52793 - DNA, 25 bp, Artificial Sequence
  Synthetic
tggtcaggucaggctaacttuagaa

SEQ ID NO: 52794 - DNA, 20 bp, Artificial Sequence
  Synthetic
cacacaggccgaguttgtug

SEQ ID NO: 52795 - DNA, 28 bp, Artificial Sequence
  Synthetic
tggttttagcttcuctcacatttcctut

SEQ ID NO: 52796 - DNA, 29 bp, Artificial Sequence
  Synthetic
tguacctaatatauaccaggacaccacaa

SEQ ID NO: 52797 - DNA, 26 bp, Artificial Sequence
  Synthetic
gaacacataccugaaggaagcgatua

SEQ ID NO: 52798 - DNA, 21 bp, Artificial Sequence
  Synthetic
gcttctuggaccccagcttut

SEQ ID NO: 52799 - DNA, 30 bp, Artificial Sequence
  Synthetic
tgtagacaatgautctggttttaacuacat

SEQ ID NO: 52800 - DNA, 20 bp, Artificial Sequence
  Synthetic
gtgcaatuggcactgucact

SEQ ID NO: 52801 - DNA, 28 bp, Artificial Sequence
  Synthetic
ggagauaagacaagcagaagatcugaat

SEQ ID NO: 52802 - DNA, 27 bp, Artificial Sequence
  Synthetic
ggagagcaatuccagatcaagaattug

SEQ ID NO: 52803 - DNA, 27 bp, Artificial Sequence
  Synthetic
atgcctgactgauttgtatctggtuag

SEQ ID NO: 52804 - DNA, 20 bp, Artificial Sequence
  Synthetic
agcaaaagcucgtgggtgua

SEQ ID NO: 52805 - DNA, 20 bp, Artificial Sequence
  Synthetic
aucttcgagaucgggaggga

SEQ ID NO: 52806 - DNA, 24 bp, Artificial Sequence
  Synthetic
cctccuggtattccugggagaaat

SEQ ID NO: 52807 - DNA, 26 bp, Artificial Sequence
  Synthetic
accgtaautgttataccugaggacca

SEQ ID NO: 52808 - DNA, 28 bp, Artificial Sequence
  Synthetic
tgttactggugatgatttgttagucgaa

SEQ ID NO: 52809 - DNA, 27 bp, Artificial Sequence
  Synthetic
tcaagaaauaaccagatctgtugcagt

SEQ ID NO: 52810 - DNA, 21 bp, Artificial Sequence
  Synthetic
ggacttagagguggagcuggt

SEQ ID NO: 52811 - DNA, 22 bp, Artificial Sequence
  Synthetic
cctcctcttuctccaggcatuc

SEQ ID NO: 52812 - DNA, 27 bp, Artificial Sequence
  Synthetic
agagaaaagcauagcattcaagccaua

SEQ ID NO: 52813 - DNA, 23 bp, Artificial Sequence
  Synthetic
aagggutaccttatcuccaggct

SEQ ID NO: 52814 - DNA, 25 bp, Artificial Sequence
  Synthetic
aagtgaaatggcucttacacgtuct

SEQ ID NO: 52815 - DNA, 27 bp, Artificial Sequence
  Synthetic
cacaggtguaaaacatgctgtcattut

SEQ ID NO: 52816 - DNA, 28 bp, Artificial Sequence
  Synthetic
aagcctgcucaagaaatcatttcattut

SEQ ID NO: 52817 - DNA, 28 bp, Artificial Sequence
  Synthetic
ttggtatggucacttaatgttggtucat

SEQ ID NO: 52818 - DNA, 28 bp, Artificial Sequence
  Synthetic
cccatacattctuattcactttcccuga

SEQ ID NO: 52819 - DNA, 28 bp, Artificial Sequence
  Synthetic
catagactcaccucacaaatatctgugt

SEQ ID NO: 52820 - DNA, 24 bp, Artificial Sequence
  Synthetic
ttctcttgagutgctgaatgcuga

SEQ ID NO: 52821 - DNA, 24 bp, Artificial Sequence
  Synthetic
ggagccattcuctgtgacaagaua

SEQ ID NO: 52822 - DNA, 28 bp, Artificial Sequence
  Synthetic
gctgtggataaauctgccgaatcataut

SEQ ID NO: 52823 - DNA, 29 bp, Artificial Sequence
  Synthetic
gatatgtatgtttugatgttggcttguga

SEQ ID NO: 52824 - DNA, 21 bp, Artificial Sequence
  Synthetic
tcgtttccacugccagcttua

SEQ ID NO: 52825 - DNA, 21 bp, Artificial Sequence
  Synthetic
caagcgagaaggacaugguca

SEQ ID NO: 52826 - DNA, 20 bp, Artificial Sequence
  Synthetic
cutccuggaagcaccaaagg

SEQ ID NO: 52827 - DNA, 25 bp, Artificial Sequence
  Synthetic
tggatataattuccgagcgaagcug

SEQ ID NO: 52828 - DNA, 19 bp, Artificial Sequence
  Synthetic
ctgcggcacaguccacuaa

SEQ ID NO: 52829 - DNA, 24 bp, Artificial Sequence
  Synthetic
tgattgcacugactgccaacuaat

SEQ ID NO: 52830 - DNA, 22 bp, Artificial Sequence
  Synthetic
caacaagcacagucatgcugag

SEQ ID NO: 52831 - DNA, 20 bp, Artificial Sequence
  Synthetic
cgtaaggcgccaaugatgug

SEQ ID NO: 52832 - DNA, 21 bp, Artificial Sequence
  Synthetic
aactcatggugcccttuggat

SEQ ID NO: 52833 - DNA, 21 bp, Artificial Sequence
  Synthetic
tgttuagggagccgtctucag

SEQ ID NO: 52834 - DNA, 20 bp, Artificial Sequence
  Synthetic
ctcccgcccaagugagttua

SEQ ID NO: 52835 - DNA, 25 bp, Artificial Sequence
  Synthetic
tcttcaaagacccacaucttgacug

SEQ ID NO: 52836 - DNA, 23 bp, Artificial Sequence
  Synthetic
aatgccucaaccgtggacaauat

SEQ ID NO: 52837 - DNA, 30 bp, Artificial Sequence
  Synthetic
tcttgaaaggtuccaaaataatgtgaugga

SEQ ID NO: 52838 - DNA, 22 bp, Artificial Sequence
  Synthetic
gctccacugctgagtaggauca

SEQ ID NO: 52839 - DNA, 23 bp, Artificial Sequence
  Synthetic
gccattagaugtgggcatucaca

SEQ ID NO: 52840 - DNA, 23 bp, Artificial Sequence
  Synthetic
cauggcatggaauggaaaggaag

SEQ ID NO: 52841 - DNA, 20 bp, Artificial Sequence
  Synthetic
tgctgcucagctttcctuga

SEQ ID NO: 52842 - DNA, 21 bp, Artificial Sequence
  Synthetic
gtcctcataggugcctgtguc

SEQ ID NO: 52843 - DNA, 25 bp, Artificial Sequence
  Synthetic
ggtgtagacugttgtagaactgugt

SEQ ID NO: 52844 - DNA, 23 bp, Artificial Sequence
  Synthetic
aggagucttctgguaacagcact

SEQ ID NO: 52845 - DNA, 21 bp, Artificial Sequence
  Synthetic
ggccgatgcuatgggaagaug

SEQ ID NO: 52846 - DNA, 26 bp, Artificial Sequence
  Synthetic
ctccaguaagaaaaactccttcugct

SEQ ID NO: 52847 - DNA, 28 bp, Artificial Sequence
  Synthetic
acattggagaaaaugaaggtggtatuga

SEQ ID NO: 52848 - DNA, 29 bp, Artificial Sequence
  Synthetic
aatcctatcatcuccttagtgacagatut

SEQ ID NO: 52849 - DNA, 28 bp, Artificial Sequence
  Synthetic
gggataaagtggautacctggatgatut

SEQ ID NO: 52850 - DNA, 25 bp, Artificial Sequence
  Synthetic
caatgctuaaccagttttgcucaga

SEQ ID NO: 52851 - DNA, 25 bp, Artificial Sequence
  Synthetic
aggcugaagacacacagtatttugt

SEQ ID NO: 52852 - DNA, 28 bp, Artificial Sequence
  Synthetic
gaaagtggctugaacaacacaaatauga

SEQ ID NO: 52853 - DNA, 25 bp, Artificial Sequence
  Synthetic
cctgctcaaaaauctcctgatcuct

SEQ ID NO: 52854 - DNA, 24 bp, Artificial Sequence
  Synthetic
gcacatttgtutcaagccacugat

SEQ ID NO: 52855 - DNA, 20 bp, Artificial Sequence
  Synthetic
gacucagccaacaagacgug

SEQ ID NO: 52856 - DNA, 19 bp, Artificial Sequence
  Synthetic
gccagugtcttugcagagg

SEQ ID NO: 52857 - DNA, 20 bp, Artificial Sequence
  Synthetic
agctctgcccuttgccaaut

SEQ ID NO: 52858 - DNA, 22 bp, Artificial Sequence
  Synthetic
ttttggcaaucggtgacccuaa

SEQ ID NO: 52859 - DNA, 20 bp, Artificial Sequence
  Synthetic
gggagccaagaugttgugag

SEQ ID NO: 52860 - DNA, 26 bp, Artificial Sequence
  Synthetic
tcatcttgttgugcatacttcuggag

SEQ ID NO: 52861 - DNA, 28 bp, Artificial Sequence
  Synthetic
tgtaatctccccutttctctctctctut

SEQ ID NO: 52862 - DNA, 18 bp, Artificial Sequence
  Synthetic
ggutccggtuggcacaca

SEQ ID NO: 52863 - DNA, 17 bp, Artificial Sequence
  Synthetic
gctgacugccgguggag

SEQ ID NO: 52864 - DNA, 19 bp, Artificial Sequence
  Synthetic
gcctcauggttgcccauct

SEQ ID NO: 52865 - DNA, 19 bp, Artificial Sequence
  Synthetic
gggaggcautcagcaccug

SEQ ID NO: 52866 - DNA, 17 bp, Artificial Sequence
  Synthetic
gccccugagcgtcauct

SEQ ID NO: 52867 - DNA, 20 bp, Artificial Sequence
  Synthetic
tgcttgagccacuggatgug

SEQ ID NO: 52868 - DNA, 21 bp, Artificial Sequence
  Synthetic
caugagcuccaacacaccact

SEQ ID NO: 52869 - DNA, 20 bp, Artificial Sequence
  Synthetic
cctctgacuggtggctgtut

SEQ ID NO: 52870 - DNA, 26 bp, Artificial Sequence
  Synthetic
ggtgtctgagauggagatgaugaaga

SEQ ID NO: 52871 - DNA, 21 bp, Artificial Sequence
  Synthetic
gcagaaacucccgcaggtuac

SEQ ID NO: 52872 - DNA, 20 bp, Artificial Sequence
  Synthetic
ggagagguggagaggctuca

SEQ ID NO: 52873 - DNA, 19 bp, Artificial Sequence
  Synthetic
gcgtccuactggcaugacc

SEQ ID NO: 52874 - DNA, 27 bp, Artificial Sequence
  Synthetic
gatctagattucccacttaatguggca

SEQ ID NO: 52875 - DNA, 21 bp, Artificial Sequence
  Synthetic
gaaaccacccacagcuttgut

SEQ ID NO: 52876 - DNA, 20 bp, Artificial Sequence
  Synthetic
tcccacucccacaugacaga

SEQ ID NO: 52877 - DNA, 26 bp, Artificial Sequence
  Synthetic
catgtatacuaacactgtgctugcct

SEQ ID NO: 52878 - DNA, 22 bp, Artificial Sequence
  Synthetic
acaatcugatgctgtugcaggt

SEQ ID NO: 52879 - DNA, 23 bp, Artificial Sequence
  Synthetic
gacttggcaugtgtgttcugaag

SEQ ID NO: 52880 - DNA, 28 bp, Artificial Sequence
  Synthetic
gtgatgguaaaaacagaaaugaaacgga

SEQ ID NO: 52881 - DNA, 22 bp, Artificial Sequence
  Synthetic
aattcctcaccugcgttgacut

SEQ ID NO: 52882 - DNA, 22 bp, Artificial Sequence
  Synthetic
gccauattugaagcccaccaaa

SEQ ID NO: 52883 - DNA, 25 bp, Artificial Sequence
  Synthetic
actatagggcugaaggtagcttugt

SEQ ID NO: 52884 - DNA, 25 bp, Artificial Sequence
  Synthetic
agagtatgtugactgtatgctugcc

SEQ ID NO: 52885 - DNA, 22 bp, Artificial Sequence
  Synthetic
agccgauaacaagtgacacugt

SEQ ID NO: 52886 - DNA, 28 bp, Artificial Sequence
  Synthetic
cagaatcuacagaaacatctgtccugaa

SEQ ID NO: 52887 - DNA, 25 bp, Artificial Sequence
  Synthetic
ccttcaccagcuccttcacttuaat

SEQ ID NO: 52888 - DNA, 25 bp, Artificial Sequence
  Synthetic
caaagaaaagugaggagcaaacugg

SEQ ID NO: 52889 - DNA, 24 bp, Artificial Sequence
  Synthetic
cctagaguggcctctttcugaaaa

SEQ ID NO: 52890 - DNA, 29 bp, Artificial Sequence
  Synthetic
ctcaagactcauccattactacucaaaca

SEQ ID NO: 52891 - DNA, 28 bp, Artificial Sequence
  Synthetic
ggatgtgatgguaacagaatacactuca

SEQ ID NO: 52892 - DNA, 29 bp, Artificial Sequence
  Synthetic
gtgacccaaatugctatgacttaaagaug

SEQ ID NO: 52893 - DNA, 25 bp, Artificial Sequence
  Synthetic
ctacgaattuaaccaagcggactut

SEQ ID NO: 52894 - DNA, 23 bp, Artificial Sequence
  Synthetic
gcctaacuccttgagtgttucca

SEQ ID NO: 52895 - DNA, 28 bp, Artificial Sequence
  Synthetic
cgggaaagaagaugactgtttttatuga

SEQ ID NO: 52896 - DNA, 24 bp, Artificial Sequence
  Synthetic
ggctcgaaaaugatcttgcagtut

SEQ ID NO: 52897 - DNA, 25 bp, Artificial Sequence
  Synthetic
acttatgtgtacaugcactgcauga

SEQ ID NO: 52898 - DNA, 24 bp, Artificial Sequence
  Synthetic
tgtatctgccugtgtatccctcut

SEQ ID NO: 52899 - DNA, 20 bp, Artificial Sequence
  Synthetic
ggaagaccaccugcauccac

SEQ ID NO: 52900 - DNA, 23 bp, Artificial Sequence
  Synthetic
cgttgcccugtgaagcatatuac

SEQ ID NO: 52901 - DNA, 28 bp, Artificial Sequence
  Synthetic
ggcatttccaguttatctgcatatugat

SEQ ID NO: 52902 - DNA, 21 bp, Artificial Sequence
  Synthetic
ggtaaatugggccccgagaut

SEQ ID NO: 52903 - DNA, 27 bp, Artificial Sequence
  Synthetic
ccatttgcugaatgtgttugacaacat

SEQ ID NO: 52904 - DNA, 23 bp, Artificial Sequence
  Synthetic
attccagagcuagccaagaaugg

SEQ ID NO: 52905 - DNA, 19 bp, Artificial Sequence
  Synthetic
agagtgcauggcccagaug

SEQ ID NO: 52906 - DNA, 21 bp, Artificial Sequence
  Synthetic
gaccttggccaucctgttgua

SEQ ID NO: 52907 - DNA, 26 bp, Artificial Sequence
  Synthetic
gggctgacautgatatgattucaaag

SEQ ID NO: 52908 - DNA, 21 bp, Artificial Sequence
  Synthetic
gatatgccccaugtccccaut

SEQ ID NO: 52909 - DNA, 26 bp, Artificial Sequence
  Synthetic
gggcagtttcagutgctatttctgua

SEQ ID NO: 52910 - DNA, 25 bp, Artificial Sequence
  Synthetic
ttcatattgtuggccataccagugt

SEQ ID NO: 52911 - DNA, 21 bp, Artificial Sequence
  Synthetic
gggtcatcacugccaaggtua

SEQ ID NO: 52912 - DNA, 28 bp, Artificial Sequence
  Synthetic
tcactgaattucctagaccctauggaat

SEQ ID NO: 52913 - DNA, 24 bp, Artificial Sequence
  Synthetic
tcctatgauccccagagcttctuc

SEQ ID NO: 52914 - DNA, 26 bp, Artificial Sequence
  Synthetic
tcaggaactgcucttaggaaaacauc

SEQ ID NO: 52915 - DNA, 28 bp, Artificial Sequence
  Synthetic
actctcagaagucaacaatgagtttuct

SEQ ID NO: 52916 - DNA, 20 bp, Artificial Sequence
  Synthetic
ccatgcgacaguctggaugt

SEQ ID NO: 52917 - DNA, 23 bp, Artificial Sequence
  Synthetic
cttgtcaucaggctgtgagugaa

SEQ ID NO: 52918 - DNA, 28 bp, Artificial Sequence
  Synthetic
aggaagcttagauagttctcgttcugaa

SEQ ID NO: 52919 - DNA, 23 bp, Artificial Sequence
  Synthetic
cccagaactuctgtcttccugag

SEQ ID NO: 52920 - DNA, 23 bp, Artificial Sequence
  Synthetic
ctgcccagcaaccautaaguaga

SEQ ID NO: 52921 - DNA, 23 bp, Artificial Sequence
  Synthetic
cctgaggacutagtugaagcagt

SEQ ID NO: 52922 - DNA, 21 bp, Artificial Sequence
  Synthetic
tccttuggactccuggagaca

SEQ ID NO: 52923 - DNA, 23 bp, Artificial Sequence
  Synthetic
tcctcactgcuctcagagtctuc

SEQ ID NO: 52924 - DNA, 26 bp, Artificial Sequence
  Synthetic
cctgtcataaacutgaccaggttgua

SEQ ID NO: 52925 - DNA, 23 bp, Artificial Sequence
  Synthetic
gcttctgcautgatttccacucc

SEQ ID NO: 52926 - DNA, 21 bp, Artificial Sequence
  Synthetic
agatgcugcgaaaaucaggct

SEQ ID NO: 52927 - DNA, 23 bp, Artificial Sequence
  Synthetic
tgccaacaaugtccactauggat

SEQ ID NO: 52928 - DNA, 25 bp, Artificial Sequence
  Synthetic
agcaaaacagaagccuctcatuagt

SEQ ID NO: 52929 - DNA, 24 bp, Artificial Sequence
  Synthetic
gccccacccuttattaacgagtuc

SEQ ID NO: 52930 - DNA, 24 bp, Artificial Sequence
  Synthetic
ccttttguaagcagcaucgagaag

SEQ ID NO: 52931 - DNA, 22 bp, Artificial Sequence
  Synthetic
tctgacatttugggtgccugag

SEQ ID NO: 52932 - DNA, 20 bp, Artificial Sequence
  Synthetic
gcataugccgagagctgtug

SEQ ID NO: 52933 - DNA, 21 bp, Artificial Sequence
  Synthetic
cctgcagaagcucttccugag

SEQ ID NO: 52934 - DNA, 22 bp, Artificial Sequence
  Synthetic
agcctgtgaugagtgttgctut

SEQ ID NO: 52935 - DNA, 26 bp, Artificial Sequence
  Synthetic
ggtaatgtaacucaaggtcggctauc

SEQ ID NO: 52936 - DNA, 21 bp, Artificial Sequence
  Synthetic
ggtcttgtugacccggaagug

SEQ ID NO: 52937 - DNA, 27 bp, Artificial Sequence
  Synthetic
atggagcgattuatggcatccttauag

SEQ ID NO: 52938 - DNA, 26 bp, Artificial Sequence
  Synthetic
tgctttgtguaaacctattccctgut

SEQ ID NO: 52939 - DNA, 18 bp, Artificial Sequence
  Synthetic
agcaacgaaugccugcct

SEQ ID NO: 52940 - DNA, 21 bp, Artificial Sequence
  Synthetic
gccgaccauccttatcctugt

SEQ ID NO: 52941 - DNA, 21 bp, Artificial Sequence
  Synthetic
cactctccaugcacctcacug

SEQ ID NO: 52942 - DNA, 23 bp, Artificial Sequence
  Synthetic
acucaccagtuaaaccaacagca

SEQ ID NO: 52943 - DNA, 21 bp, Artificial Sequence
  Synthetic
gagggccaguttgaccattuc

SEQ ID NO: 52944 - DNA, 27 bp, Artificial Sequence
  Synthetic
gtactggactaugaaggagtcaaacug

SEQ ID NO: 52945 - DNA, 24 bp, Artificial Sequence
  Synthetic
tctttacuaacagcccccuaccat

SEQ ID NO: 52946 - DNA, 26 bp, Artificial Sequence
  Synthetic
aggatattgauctgagcagaguccaa

SEQ ID NO: 52947 - DNA, 20 bp, Artificial Sequence
  Synthetic
gcctacutccaacugcgcat

SEQ ID NO: 52948 - DNA, 20 bp, Artificial Sequence
  Synthetic
tcaggatgcutggtgctugt

SEQ ID NO: 52949 - DNA, 24 bp, Artificial Sequence
  Synthetic
tctgtttaatutgggagcauggct

SEQ ID NO: 52950 - DNA, 24 bp, Artificial Sequence
  Synthetic
ctgtctccucacgataatcauccc

SEQ ID NO: 52951 - DNA, 20 bp, Artificial Sequence
  Synthetic
aagcctccuctcagcccuaa

SEQ ID NO: 52952 - DNA, 21 bp, Artificial Sequence
  Synthetic
cgcactcaugccaggaaugat

SEQ ID NO: 52953 - DNA, 21 bp, Artificial Sequence
  Synthetic
gcactaatguggcaagcctuc

SEQ ID NO: 52954 - DNA, 20 bp, Artificial Sequence
  Synthetic
tgcttcccugtgagctcuct

SEQ ID NO: 52955 - DNA, 26 bp, Artificial Sequence
  Synthetic
gctcaaacccccautatgaagagtut

SEQ ID NO: 52956 - DNA, 18 bp, Artificial Sequence
  Synthetic
gcccagcgugatctgugt

SEQ ID NO: 52957 - DNA, 20 bp, Artificial Sequence
  Synthetic
ccaagcggguctcttcctug

SEQ ID NO: 52958 - DNA, 27 bp, Artificial Sequence
  Synthetic
ttgctttctuccacagtacuaaaacca

SEQ ID NO: 52959 - DNA, 25 bp, Artificial Sequence
  Synthetic
gcuaaaaagcagcugaaaggcaaaa

SEQ ID NO: 52960 - DNA, 22 bp, Artificial Sequence
  Synthetic
gaggccacugatttggttcuga

SEQ ID NO: 52961 - DNA, 25 bp, Artificial Sequence
  Synthetic
ctgcuccacaaaattccgucaaaaa

SEQ ID NO: 52962 - DNA, 28 bp, Artificial Sequence
  Synthetic
acttaagagaccuaacattttgccauca

SEQ ID NO: 52963 - DNA, 29 bp, Artificial Sequence
  Synthetic
agcatctcttgtuttcctaagtgacauaa

SEQ ID NO: 52964 - DNA, 21 bp, Artificial Sequence
  Synthetic
cagccaggaacutgacuccat

SEQ ID NO: 52965 - DNA, 22 bp, Artificial Sequence
  Synthetic
tcccagggacugacaatttucc

SEQ ID NO: 52966 - DNA, 21 bp, Artificial Sequence
  Synthetic
ccttgcauggcagtgacuact

SEQ ID NO: 52967 - DNA, 22 bp, Artificial Sequence
  Synthetic
caatcggtccugtgacattgug

SEQ ID NO: 52968 - DNA, 29 bp, Artificial Sequence
  Synthetic
gtactcagcaucaaaatcaaaagttucca

SEQ ID NO: 52969 - DNA, 26 bp, Artificial Sequence
  Synthetic
atgacctgcttugccatattgaguat

SEQ ID NO: 52970 - DNA, 26 bp, Artificial Sequence
  Synthetic
tctaccatatucaaagcccccuagat

SEQ ID NO: 52971 - DNA, 26 bp, Artificial Sequence
  Synthetic
tctgtgcctaugagctataacaaugg

SEQ ID NO: 52972 - DNA, 21 bp, Artificial Sequence
  Synthetic
gtctagaaugcagccccugaa

SEQ ID NO: 52973 - DNA, 28 bp, Artificial Sequence
  Synthetic
tctuttccacataatcugacaacaacct

SEQ ID NO: 52974 - DNA, 23 bp, Artificial Sequence
  Synthetic
gggtttuccgagtacatgatuga

SEQ ID NO: 52975 - DNA, 28 bp, Artificial Sequence
  Synthetic
tgcttctggcuttgttttattgugaaat

SEQ ID NO: 52976 - DNA, 27 bp, Artificial Sequence
  Synthetic
cttccatguagacaaggattugaaagg

SEQ ID NO: 52977 - DNA, 24 bp, Artificial Sequence
  Synthetic
tggtttcatgtuttgccttgtcug

SEQ ID NO: 52978 - DNA, 24 bp, Artificial Sequence
  Synthetic
gcagtcaucaatgtcctgtucaca

SEQ ID NO: 52979 - DNA, 31 bp, Artificial Sequence
  Synthetic
cctgtactaaggutaaaggaatgtuaagagt

SEQ ID NO: 52980 - DNA, 28 bp, Artificial Sequence
  Synthetic
ccccttaaatgugtactagttgtuccat

SEQ ID NO: 52981 - DNA, 26 bp, Artificial Sequence
  Synthetic
tgactattgctuagggaaccacagua

SEQ ID NO: 52982 - DNA, 27 bp, Artificial Sequence
  Synthetic
ccagaaagaaauaggcatcaauaaccc

SEQ ID NO: 52983 - DNA, 28 bp, Artificial Sequence
  Synthetic
aacttattttguggcagatgttgucaaa

SEQ ID NO: 52984 - DNA, 28 bp, Artificial Sequence
  Synthetic
tcagtaatattuggtgaagatgtugcct

SEQ ID NO: 52985 - DNA, 25 bp, Artificial Sequence
  Synthetic
gtggcgtuggaaatgaaaaggaaut

SEQ ID NO: 52986 - DNA, 21 bp, Artificial Sequence
  Synthetic
catgccccguctttctttcug

SEQ ID NO: 52987 - DNA, 24 bp, Artificial Sequence
  Synthetic
acataccttgautcctgggcaaug

SEQ ID NO: 52988 - DNA, 27 bp, Artificial Sequence
  Synthetic
cacagagttacacutcatcctgaucaa

SEQ ID NO: 52989 - DNA, 26 bp, Artificial Sequence
  Synthetic
cttcagagautggtgucaaaagagga

SEQ ID NO: 52990 - DNA, 17 bp, Artificial Sequence
  Synthetic
tcucgggugaggagcca

SEQ ID NO: 52991 - DNA, 17 bp, Artificial Sequence
  Synthetic
gcguctugggcgaaact

SEQ ID NO: 52992 - DNA, 28 bp, Artificial Sequence
  Synthetic
tcttcaaaccccautagcatgaatuact

SEQ ID NO: 52993 - DNA, 28 bp, Artificial Sequence
  Synthetic
agtgaacttcguaagaaaacttcauggt

SEQ ID NO: 52994 - DNA, 28 bp, Artificial Sequence
  Synthetic
ctgaagcacctutaaatcctcctatuga

SEQ ID NO: 52995 - DNA, 20 bp, Artificial Sequence
  Synthetic
cgacacaguttgcgauccca

SEQ ID NO: 52996 - DNA, 27 bp, Artificial Sequence
  Synthetic
gctctatagtttaugtcttggctggut

SEQ ID NO: 52997 - DNA, 25 bp, Artificial Sequence
  Synthetic
tctctgatgaguctgaagtccacuc

SEQ ID NO: 52998 - DNA, 28 bp, Artificial Sequence
  Synthetic
acutcaaaatacuggagcaaagacaagt

SEQ ID NO: 52999 - DNA, 28 bp, Artificial Sequence
  Synthetic
tggcagcttaaauagaaaccagactuaa

SEQ ID NO: 53000 - DNA, 20 bp, Artificial Sequence
  Synthetic
gacactaugagtgccgugct

SEQ ID NO: 53001 - DNA, 21 bp, Artificial Sequence
  Synthetic
gcagcagtutctgtccttucc

SEQ ID NO: 53002 - DNA, 29 bp, Artificial Sequence
  Synthetic
actctacataguggagaaataaccaguca

SEQ ID NO: 53003 - DNA, 25 bp, Artificial Sequence
  Synthetic
aaaucatgatcaaatugcgcacagt

SEQ ID NO: 53004 - DNA, 28 bp, Artificial Sequence
  Synthetic
ccctaggaauaaaagacatacacgugaa

SEQ ID NO: 53005 - DNA, 27 bp, Artificial Sequence
  Synthetic
aatttgtaggctutcctgttctcauca

SEQ ID NO: 53006 - DNA, 26 bp, Artificial Sequence
  Synthetic
acaaacucttggtactucaaacacga

SEQ ID NO: 53007 - DNA, 28 bp, Artificial Sequence
  Synthetic
ttcccaatctccuttttcatgttctcut

SEQ ID NO: 53008 - DNA, 30 bp, Artificial Sequence
  Synthetic
tgctttatgggauaaggaatagaattgcut

SEQ ID NO: 53009 - DNA, 28 bp, Artificial Sequence
  Synthetic
ctgtctcatatcutccaactgttctuca

SEQ ID NO: 53010 - DNA, 28 bp, Artificial Sequence
  Synthetic
ccaagaagaaagagaautactguccaga

SEQ ID NO: 53011 - DNA, 28 bp, Artificial Sequence
  Synthetic
ccacctuaagcctttgaagaauacaaat

SEQ ID NO: 53012 - DNA, 22 bp, Artificial Sequence
  Synthetic
gaccgaaaacacuttggagcug

SEQ ID NO: 53013 - DNA, 28 bp, Artificial Sequence
  Synthetic
acagcctcaacuttggttttagatcaua

SEQ ID NO: 53014 - DNA, 23 bp, Artificial Sequence
  Synthetic
tgcatgttugagccacttccuat

SEQ ID NO: 53015 - DNA, 29 bp, Artificial Sequence
  Synthetic
gcatgtagttctugcatcttctcaattut

SEQ ID NO: 53016 - DNA, 28 bp, Artificial Sequence
  Synthetic
ggtactacagaugcagttggtttacuaa

SEQ ID NO: 53017 - DNA, 32 bp, Artificial Sequence
  Synthetic
catagtggctccuattaaaatcttaacctuca

SEQ ID NO: 53018 - DNA, 24 bp, Artificial Sequence
  Synthetic
ggagagttguctctttctcauccc

SEQ ID NO: 53019 - DNA, 25 bp, Artificial Sequence
  Synthetic
aagcugagaacatgcuaaagaacca

SEQ ID NO: 53020 - DNA, 22 bp, Artificial Sequence
  Synthetic
gcttugagcaaacagtggcuaa

SEQ ID NO: 53021 - DNA, 22 bp, Artificial Sequence
  Synthetic
gcttaggccuggtcgacuagat

SEQ ID NO: 53022 - DNA, 23 bp, Artificial Sequence
  Synthetic
cacutgttgacucacacggagat

SEQ ID NO: 53023 - DNA, 25 bp, Artificial Sequence
  Synthetic
caacctgcauaaacctagagaccug

SEQ ID NO: 53024 - DNA, 23 bp, Artificial Sequence
  Synthetic
ctcctgtgaguaaaagagcucca

SEQ ID NO: 53025 - DNA, 24 bp, Artificial Sequence
  Synthetic
ctgggaaggcaaaautcagcatut

SEQ ID NO: 53026 - DNA, 27 bp, Artificial Sequence
  Synthetic
cctctgatatuaccaaaggaagcaugg

SEQ ID NO: 53027 - DNA, 28 bp, Artificial Sequence
  Synthetic
tttggtcaggcutacactttatuaggaa

SEQ ID NO: 53028 - DNA, 27 bp, Artificial Sequence
  Synthetic
gatgatgagucaactggaatctcugac

SEQ ID NO: 53029 - DNA, 22 bp, Artificial Sequence
  Synthetic
ggcuggaaacugacaccaaact

SEQ ID NO: 53030 - DNA, 23 bp, Artificial Sequence
  Synthetic
cccccattugagagtccaagtut

SEQ ID NO: 53031 - DNA, 25 bp, Artificial Sequence
  Synthetic
caagctatagaaguggtctggaguc

SEQ ID NO: 53032 - DNA, 23 bp, Artificial Sequence
  Synthetic
caggutggaaacugaacaaagca

SEQ ID NO: 53033 - DNA, 27 bp, Artificial Sequence
  Synthetic
ggatgaaacugaacaaaaauggaagca

SEQ ID NO: 53034 - DNA, 24 bp, Artificial Sequence
  Synthetic
aactattctguttcatccguggca

SEQ ID NO: 53035 - DNA, 26 bp, Artificial Sequence
  Synthetic
ctgaggguaagaaagttgtggtgaut

SEQ ID NO: 53036 - DNA, 21 bp, Artificial Sequence
  Synthetic
gactcaagggugaacctggug

SEQ ID NO: 53037 - DNA, 21 bp, Artificial Sequence
  Synthetic
ccagaccaccugccaagaaut

SEQ ID NO: 53038 - DNA, 21 bp, Artificial Sequence
  Synthetic
agggttcgtuactgagcacug

SEQ ID NO: 53039 - DNA, 28 bp, Artificial Sequence
  Synthetic
catcaatctgggutgcattttaaucact

SEQ ID NO: 53040 - DNA, 28 bp, Artificial Sequence
  Synthetic
aagctgtttttauacatgagttcuccca

SEQ ID NO: 53041 - DNA, 28 bp, Artificial Sequence
  Synthetic
gtcttgtcctugactttaactacctuct

SEQ ID NO: 53042 - DNA, 23 bp, Artificial Sequence
  Synthetic
gttaaagggcagagutccctcut

SEQ ID NO: 53043 - DNA, 28 bp, Artificial Sequence
  Synthetic
aagccaaacugaaggctatactgaaaua

SEQ ID NO: 53044 - DNA, 26 bp, Artificial Sequence
  Synthetic
ggagaaactaacutgatgggatgugg

SEQ ID NO: 53045 - DNA, 27 bp, Artificial Sequence
  Synthetic
agttgcagttgcutctaaaaatcatut

SEQ ID NO: 53046 - DNA, 21 bp, Artificial Sequence
  Synthetic
cggctcagcutctttcgugaa

SEQ ID NO: 53047 - DNA, 26 bp, Artificial Sequence
  Synthetic
ctcagaacaacagaucccaccatuaa

SEQ ID NO: 53048 - DNA, 22 bp, Artificial Sequence
  Synthetic
gaagugtgtctgugaacaggct

SEQ ID NO: 53049 - DNA, 27 bp, Artificial Sequence
  Synthetic
gaaattaugcaatcggtaugcagagaa

SEQ ID NO: 53050 - DNA, 29 bp, Artificial Sequence
  Synthetic
gaattaauagaaacagagcugacggaaga

SEQ ID NO: 53051 - DNA, 24 bp, Artificial Sequence
  Synthetic
ttccctgctaugaagccatcttut

SEQ ID NO: 53052 - DNA, 23 bp, Artificial Sequence
  Synthetic
attacagtguccgaagttcgcut

SEQ ID NO: 53053 - DNA, 28 bp, Artificial Sequence
  Synthetic
ccctgtaaccaagutcaaatatcaucac

SEQ ID NO: 53054 - DNA, 27 bp, Artificial Sequence
  Synthetic
ctaatcaaaggaaucatccuccggaaa

SEQ ID NO: 53055 - DNA, 28 bp, Artificial Sequence
  Synthetic
tcgcacattttugcaaagttcatuagaa

SEQ ID NO: 53056 - DNA, 27 bp, Artificial Sequence
  Synthetic
gagggtaaaautaagcacaguggaaga

SEQ ID NO: 53057 - DNA, 28 bp, Artificial Sequence
  Synthetic
ggtagtgtgaagggutcatatgcauaat

SEQ ID NO: 53058 - DNA, 26 bp, Artificial Sequence
  Synthetic
tcagtaaguaactttggcugccaaat

SEQ ID NO: 53059 - DNA, 24 bp, Artificial Sequence
  Synthetic
cggctacucccacgtaaatguaaa

SEQ ID NO: 53060 - DNA, 25 bp, Artificial Sequence
  Synthetic
aacatcttcctugaggctgaatugt

SEQ ID NO: 53061 - DNA, 24 bp, Artificial Sequence
  Synthetic
cccatcagcucttgtttttgcaut

SEQ ID NO: 53062 - DNA, 25 bp, Artificial Sequence
  Synthetic
tutttagtctuccacaaggcagaca

SEQ ID NO: 53063 - DNA, 28 bp, Artificial Sequence
  Synthetic
ctgtacctgtttcuactccagatttcut

SEQ ID NO: 53064 - DNA, 23 bp, Artificial Sequence
  Synthetic
gaggctcugtgattttcgugact

SEQ ID NO: 53065 - DNA, 22 bp, Artificial Sequence
  Synthetic
acaggtcagugcatgttcctug

SEQ ID NO: 53066 - DNA, 20 bp, Artificial Sequence
  Synthetic
acctccucgttggcatugac

SEQ ID NO: 53067 - DNA, 19 bp, Artificial Sequence
  Synthetic
cgtgtgggacuggctcauc

SEQ ID NO: 53068 - DNA, 18 bp, Artificial Sequence
  Synthetic
tgccacguggttguccat

SEQ ID NO: 53069 - DNA, 17 bp, Artificial Sequence
  Synthetic
acgaccacgugcctcuc

SEQ ID NO: 53070 - DNA, 19 bp, Artificial Sequence
  Synthetic
gctcctacuccagccccua

SEQ ID NO: 53071 - DNA, 18 bp, Artificial Sequence
  Synthetic
cccucgacagggcucaag

SEQ ID NO: 53072 - DNA, 20 bp, Artificial Sequence
  Synthetic
aatcagacgggaagcugguc

SEQ ID NO: 53073 - DNA, 23 bp, Artificial Sequence
  Synthetic
tgatttctggaccugcagcttut

SEQ ID NO: 53074 - DNA, 22 bp, Artificial Sequence
  Synthetic
aggtccagguactcctgtgaug

SEQ ID NO: 53075 - DNA, 21 bp, Artificial Sequence
  Synthetic
cttcaagcagcugguggaaga

SEQ ID NO: 53076 - DNA, 21 bp, Artificial Sequence
  Synthetic
gccccguctctccaataucag

SEQ ID NO: 53077 - DNA, 25 bp, Artificial Sequence
  Synthetic
ggatcaguactccagugagaagaca

SEQ ID NO: 53078 - DNA, 26 bp, Artificial Sequence
  Synthetic
agtttcagaaacaucagccacuaact

SEQ ID NO: 53079 - DNA, 22 bp, Artificial Sequence
  Synthetic
gctgagcatucggtccacuaac

SEQ ID NO: 53080 - DNA, 29 bp, Artificial Sequence
  Synthetic
gaagttgagcuaacaaacatucagaagaa

SEQ ID NO: 53081 - DNA, 25 bp, Artificial Sequence
  Synthetic
ttctggtgctucaatcgtcactuaa

SEQ ID NO: 53082 - DNA, 24 bp, Artificial Sequence
  Synthetic
tgtttttaacucttgcacccugga

SEQ ID NO: 53083 - DNA, 21 bp, Artificial Sequence
  Synthetic
tgctcagugagttggcgttua

SEQ ID NO: 53084 - DNA, 23 bp, Artificial Sequence
  Synthetic
gctcactgcaacuctgttctgut

SEQ ID NO: 53085 - DNA, 28 bp, Artificial Sequence
  Synthetic
ctctcttgaggccuttgataaatcuaca

SEQ ID NO: 53086 - DNA, 28 bp, Artificial Sequence
  Synthetic
ctgctgugaactattaaauccagaggaa

SEQ ID NO: 53087 - DNA, 24 bp, Artificial Sequence
  Synthetic
ccacattatuccacaagcctggua

SEQ ID NO: 53088 - DNA, 22 bp, Artificial Sequence
  Synthetic
gggcagcaauaatctgctgaug

SEQ ID NO: 53089 - DNA, 23 bp, Artificial Sequence
  Synthetic
tcacattcacgaaguccccttut

SEQ ID NO: 53090 - DNA, 23 bp, Artificial Sequence
  Synthetic
cagaguttcatggtucccagaga

SEQ ID NO: 53091 - DNA, 28 bp, Artificial Sequence
  Synthetic
gtttattcctgcugtgttcaggtuaaaa

SEQ ID NO: 53092 - DNA, 21 bp, Artificial Sequence
  Synthetic
gcaatttccugccgaatgcug

SEQ ID NO: 53093 - DNA, 27 bp, Artificial Sequence
  Synthetic
aagggauacgaacttttctuccaaact

SEQ ID NO: 53094 - DNA, 22 bp, Artificial Sequence
  Synthetic
ccctttgutgctctuggagcat

SEQ ID NO: 53095 - DNA, 23 bp, Artificial Sequence
  Synthetic
gcccctaatuctgtgttttgugt

SEQ ID NO: 53096 - DNA, 24 bp, Artificial Sequence
  Synthetic
caaggagucaggaaggagagttut

SEQ ID NO: 53097 - DNA, 23 bp, Artificial Sequence
  Synthetic
cttuacggaactcguggagagag

SEQ ID NO: 53098 - DNA, 23 bp, Artificial Sequence
  Synthetic
cggtggagutgttgttcttcugt

SEQ ID NO: 53099 - DNA, 24 bp, Artificial Sequence
  Synthetic
acaaagctgaaugcccactatgua

SEQ ID NO: 53100 - DNA, 21 bp, Artificial Sequence
  Synthetic
ggccuaagcuggagaacagat

SEQ ID NO: 53101 - DNA, 27 bp, Artificial Sequence
  Synthetic
gaatagucagatcactuacaagagcca

SEQ ID NO: 53102 - DNA, 22 bp, Artificial Sequence
  Synthetic
cccaccatucctccctcatgua

SEQ ID NO: 53103 - DNA, 22 bp, Artificial Sequence
  Synthetic
autcaagcgaugggacagagac

SEQ ID NO: 53104 - DNA, 21 bp, Artificial Sequence
  Synthetic
ccgacacccccauacacatut

SEQ ID NO: 53105 - DNA, 19 bp, Artificial Sequence
  Synthetic
ccgccaggaguacaccauc

SEQ ID NO: 53106 - DNA, 27 bp, Artificial Sequence
  Synthetic
agaaatctggutactggcatcuagaac

SEQ ID NO: 53107 - DNA, 29 bp, Artificial Sequence
  Synthetic
tccctaggtctaaucctcttctttcttut

SEQ ID NO: 53108 - DNA, 21 bp, Artificial Sequence
  Synthetic
acacagacucctgauccagca

SEQ ID NO: 53109 - DNA, 28 bp, Artificial Sequence
  Synthetic
gactgggttaatutgcttgtgtttacut

SEQ ID NO: 53110 - DNA, 18 bp, Artificial Sequence
  Synthetic
cccgaugctgtggtuggt

SEQ ID NO: 53111 - DNA, 20 bp, Artificial Sequence
  Synthetic
ccagugaagcctcugaggga

SEQ ID NO: 53112 - DNA, 20 bp, Artificial Sequence
  Synthetic
ggttagcacgugactgucca

SEQ ID NO: 53113 - DNA, 21 bp, Artificial Sequence
  Synthetic
agacaagctuggccattggut

SEQ ID NO: 53114 - DNA, 22 bp, Artificial Sequence
  Synthetic
gtgagcucaggauacaggaagg

SEQ ID NO: 53115 - DNA, 22 bp, Artificial Sequence
  Synthetic
ctgccacuggacacaggauaag

SEQ ID NO: 53116 - DNA, 24 bp, Artificial Sequence
  Synthetic
gtagaattcctcucggtcatgcug

SEQ ID NO: 53117 - DNA, 27 bp, Artificial Sequence
  Synthetic
cctgtgtuggaagacagctaaaaugat

SEQ ID NO: 53118 - DNA, 27 bp, Artificial Sequence
  Synthetic
tggatatcccagaauttccttgttucc

SEQ ID NO: 53119 - DNA, 26 bp, Artificial Sequence
  Synthetic
atgtgcaacauttttcgtcttgugat

SEQ ID NO: 53120 - DNA, 27 bp, Artificial Sequence
  Synthetic
caaccacauactaaatcugacccaaag

SEQ ID NO: 53121 - DNA, 22 bp, Artificial Sequence
  Synthetic
cccctgugttcttctctuccat

SEQ ID NO: 53122 - DNA, 27 bp, Artificial Sequence
  Synthetic
cccaaatataccucaacagggatuacc

SEQ ID NO: 53123 - DNA, 29 bp, Artificial Sequence
  Synthetic
gttccacaaacatucagccctttataaut

SEQ ID NO: 53124 - DNA, 22 bp, Artificial Sequence
  Synthetic
cagggcccaacagguataugag

SEQ ID NO: 53125 - DNA, 24 bp, Artificial Sequence
  Synthetic
acagacgttucctgtttgacctut

SEQ ID NO: 53126 - DNA, 21 bp, Artificial Sequence
  Synthetic
cccuacuacgaagaccccgaa

SEQ ID NO: 53127 - DNA, 22 bp, Artificial Sequence
  Synthetic
caacccuctacccugacacaac

SEQ ID NO: 53128 - DNA, 21 bp, Artificial Sequence
  Synthetic
ggcctgauggatctgggauct

SEQ ID NO: 53129 - DNA, 23 bp, Artificial Sequence
  Synthetic
cggatcgttucctcagtgaacuc

SEQ ID NO: 53130 - DNA, 20 bp, Artificial Sequence
  Synthetic
catagcgggugggatgacut

SEQ ID NO: 53131 - DNA, 26 bp, Artificial Sequence
  Synthetic
ggatcaagagcutgttgagttugaga

SEQ ID NO: 53132 - DNA, 20 bp, Artificial Sequence
  Synthetic
ctuaaccaccggccatcugt

SEQ ID NO: 53133 - DNA, 19 bp, Artificial Sequence
  Synthetic
gaggucacgaggttgcuct

SEQ ID NO: 53134 - DNA, 25 bp, Artificial Sequence
  Synthetic
ccccagagaaaggagucaataaugt

SEQ ID NO: 53135 - DNA, 29 bp, Artificial Sequence
  Synthetic
tctgatctctguaactggattatgctgua

SEQ ID NO: 53136 - DNA, 20 bp, Artificial Sequence
  Synthetic
cagcgcagccgucataaauc

SEQ ID NO: 53137 - DNA, 23 bp, Artificial Sequence
  Synthetic
gcagtguagaccccaaagactut

SEQ ID NO: 53138 - DNA, 27 bp, Artificial Sequence
  Synthetic
gagagagattucaactgttctgtucct

SEQ ID NO: 53139 - DNA, 27 bp, Artificial Sequence
  Synthetic
ggaaagttccaaauagaccagagauca

SEQ ID NO: 53140 - DNA, 22 bp, Artificial Sequence
  Synthetic
aaggcccctuctgtgtatccua

SEQ ID NO: 53141 - DNA, 29 bp, Artificial Sequence
  Synthetic
gctctttctctgcuagcatcattaattut

SEQ ID NO: 53142 - DNA, 22 bp, Artificial Sequence
  Synthetic
tctguttactggcuccaggaga

SEQ ID NO: 53143 - DNA, 27 bp, Artificial Sequence
  Synthetic
agctgaugaagggaaauagaaaaagca

SEQ ID NO: 53144 - DNA, 21 bp, Artificial Sequence
  Synthetic
ctgaccucattcactguggca

SEQ ID NO: 53145 - DNA, 20 bp, Artificial Sequence
  Synthetic
acatugcagccaccgaugaa

SEQ ID NO: 53146 - DNA, 22 bp, Artificial Sequence
  Synthetic
gcacccctuttctgtgtgttuc

SEQ ID NO: 53147 - DNA, 19 bp, Artificial Sequence
  Synthetic
ctaaaggugggccggtugt

SEQ ID NO: 53148 - DNA, 22 bp, Artificial Sequence
  Synthetic
ccugggaagggcagatttuagg

SEQ ID NO: 53149 - DNA, 23 bp, Artificial Sequence
  Synthetic
caatgagagaugtcugcagggaa

SEQ ID NO: 53150 - DNA, 27 bp, Artificial Sequence
  Synthetic
aagaaagagaugacattctacgtuccc

SEQ ID NO: 53151 - DNA, 28 bp, Artificial Sequence
  Synthetic
ggaagagcaucataagtgcattuaacct

SEQ ID NO: 53152 - DNA, 22 bp, Artificial Sequence
  Synthetic
gtgatcugggaaaaccccuagt

SEQ ID NO: 53153 - DNA, 22 bp, Artificial Sequence
  Synthetic
tcacagacugcatgaggttcug

SEQ ID NO: 53154 - DNA, 21 bp, Artificial Sequence
  Synthetic
cacctttagcccugccttcuc

SEQ ID NO: 53155 - DNA, 22 bp, Artificial Sequence
  Synthetic
ggtacatcugagccatcuccct

SEQ ID NO: 53156 - DNA, 21 bp, Artificial Sequence
  Synthetic
ctggcagaugtgtgctttgug

SEQ ID NO: 53157 - DNA, 23 bp, Artificial Sequence
  Synthetic
gagacatgggucagaggaaaugg

SEQ ID NO: 53158 - DNA, 23 bp, Artificial Sequence
  Synthetic
gccagauaaacagtguggacagg

SEQ ID NO: 53159 - DNA, 21 bp, Artificial Sequence
  Synthetic
ctttgctgggugacctcugat

SEQ ID NO: 53160 - DNA, 23 bp, Artificial Sequence
  Synthetic
cttcacctuagggttgcccauaa

SEQ ID NO: 53161 - DNA, 25 bp, Artificial Sequence
  Synthetic
ctctgcctautggtctatttuccca

SEQ ID NO: 53162 - DNA, 21 bp, Artificial Sequence
  Synthetic
cctctgagcucctctgtcuca

SEQ ID NO: 53163 - DNA, 26 bp, Artificial Sequence
  Synthetic
ggagctgtgatuctgctattggatut

SEQ ID NO: 53164 - DNA, 22 bp, Artificial Sequence
  Synthetic
atccugtgacatcugcaacact

SEQ ID NO: 53165 - DNA, 25 bp, Artificial Sequence
  Synthetic
gcaaggagctuggtactaagatgua

SEQ ID NO: 53166 - DNA, 25 bp, Artificial Sequence
  Synthetic
gtgttttcccuccatggatgatgua

SEQ ID NO: 53167 - DNA, 27 bp, Artificial Sequence
  Synthetic
tgatggacaagutttcttcttuggaca

SEQ ID NO: 53168 - DNA, 17 bp, Artificial Sequence
  Synthetic
gugctuggccgaggaca

SEQ ID NO: 53169 - DNA, 20 bp, Artificial Sequence
  Synthetic
gcaagcagggagugtugact

SEQ ID NO: 53170 - DNA, 23 bp, Artificial Sequence
  Synthetic
cctgagacaucagtccacuggat

SEQ ID NO: 53171 - DNA, 26 bp, Artificial Sequence
  Synthetic
cctcacttagcuacccactctauacc

SEQ ID NO: 53172 - DNA, 24 bp, Artificial Sequence
  Synthetic
ggaaagugagcagaaccaagacuc

SEQ ID NO: 53173 - DNA, 21 bp, Artificial Sequence
  Synthetic
gtcagccaagcuccactucat

SEQ ID NO: 53174 - DNA, 24 bp, Artificial Sequence
  Synthetic
agagtccuaagcaacaacagugac

SEQ ID NO: 53175 - DNA, 23 bp, Artificial Sequence
  Synthetic
aaggacccagaaugggaagacua

SEQ ID NO: 53176 - DNA, 18 bp, Artificial Sequence
  Synthetic
gcucgcagcagaaagcug

SEQ ID NO: 53177 - DNA, 18 bp, Artificial Sequence
  Synthetic
ccacggcaggutctcgua

SEQ ID NO: 53178 - DNA, 22 bp, Artificial Sequence
  Synthetic
ctgggaugatctttctguggga

SEQ ID NO: 53179 - DNA, 20 bp, Artificial Sequence
  Synthetic
ctggccacaccugatgtuga

SEQ ID NO: 53180 - DNA, 21 bp, Artificial Sequence
  Synthetic
tcataccagguctccgtucca

SEQ ID NO: 53181 - DNA, 21 bp, Artificial Sequence
  Synthetic
ggtcattugagctgcagguga

SEQ ID NO: 53182 - DNA, 22 bp, Artificial Sequence
  Synthetic
gtttccatggcuagggaggaut

SEQ ID NO: 53183 - DNA, 20 bp, Artificial Sequence
  Synthetic
gctagucaggcagctcauca

SEQ ID NO: 53184 - DNA, 26 bp, Artificial Sequence
  Synthetic
acaagttcaucaagcagatctuccag

SEQ ID NO: 53185 - DNA, 24 bp, Artificial Sequence
  Synthetic
acagcaaagcuccatacccatuat

SEQ ID NO: 53186 - DNA, 20 bp, Artificial Sequence
  Synthetic
ccttauccggcaggtcucac

SEQ ID NO: 53187 - DNA, 21 bp, Artificial Sequence
  Synthetic
tggcauggaggacugaaggat

SEQ ID NO: 53188 - DNA, 22 bp, Artificial Sequence
  Synthetic
ggctucattcctguccccaaat

SEQ ID NO: 53189 - DNA, 22 bp, Artificial Sequence
  Synthetic
guctgtggtucaggcagagaag

SEQ ID NO: 53190 - DNA, 24 bp, Artificial Sequence
  Synthetic
ttcacaggcutaaccaatacgugt

SEQ ID NO: 53191 - DNA, 27 bp, Artificial Sequence
  Synthetic
aacaggtagaaauagcccatgtcatut

SEQ ID NO: 53192 - DNA, 24 bp, Artificial Sequence
  Synthetic
ctagaagtugccaaggtagcucag

SEQ ID NO: 53193 - DNA, 28 bp, Artificial Sequence
  Synthetic
acccttattgagacaaugccaacatuaa

SEQ ID NO: 53194 - DNA, 22 bp, Artificial Sequence
  Synthetic
ggccaggtuctgaagttcctut

SEQ ID NO: 53195 - DNA, 22 bp, Artificial Sequence
  Synthetic
tgttcugacaaacctccuccac

SEQ ID NO: 53196 - DNA, 21 bp, Artificial Sequence
  Synthetic
gcatctcuggacttacgcgut

SEQ ID NO: 53197 - DNA, 27 bp, Artificial Sequence
  Synthetic
gctggatttgcauattctgaaccucat

SEQ ID NO: 53198 - DNA, 20 bp, Artificial Sequence
  Synthetic
aaaggccagagucagcaguc

SEQ ID NO: 53199 - DNA, 22 bp, Artificial Sequence
  Synthetic
tgttccttcccugtccatcugt

SEQ ID NO: 53200 - DNA, 23 bp, Artificial Sequence
  Synthetic
tttggtucaaggaaggtctugct

SEQ ID NO: 53201 - DNA, 24 bp, Artificial Sequence
  Synthetic
cagtgaagagcaugttgaggaugt

SEQ ID NO: 53202 - DNA, 20 bp, Artificial Sequence
  Synthetic
gggtcaugcgtctggugaag

SEQ ID NO: 53203 - DNA, 22 bp, Artificial Sequence
  Synthetic
tccttgtgucagctgtgttcug

SEQ ID NO: 53204 - DNA, 20 bp, Artificial Sequence
  Synthetic
gagaccguggctctctgaug

SEQ ID NO: 53205 - DNA, 20 bp, Artificial Sequence
  Synthetic
cctcccaugaaccccgtuat

SEQ ID NO: 53206 - DNA, 24 bp, Artificial Sequence
  Synthetic
gggaaccuagaacaagccaaugag

SEQ ID NO: 53207 - DNA, 20 bp, Artificial Sequence
  Synthetic
cgcatuctaagggugccaca

SEQ ID NO: 53208 - DNA, 20 bp, Artificial Sequence
  Synthetic
gactggacacugctggacuc

SEQ ID NO: 53209 - DNA, 20 bp, Artificial Sequence
  Synthetic
gcccuggatcuaagccacat

SEQ ID NO: 53210 - DNA, 21 bp, Artificial Sequence
  Synthetic
aaggccacugatgctttcugt

SEQ ID NO: 53211 - DNA, 23 bp, Artificial Sequence
  Synthetic
gaagaaagguccaagagggucag

SEQ ID NO: 53212 - DNA, 21 bp, Artificial Sequence
  Synthetic
cacgtggugacccatttucaa

SEQ ID NO: 53213 - DNA, 23 bp, Artificial Sequence
  Synthetic
ccuccuagccaggaagaaagaaa

SEQ ID NO: 53214 - DNA, 23 bp, Artificial Sequence
  Synthetic
ccagtgcttcuccctcaactaug

SEQ ID NO: 53215 - DNA, 22 bp, Artificial Sequence
  Synthetic
gcccttgaggugaggaacttug

SEQ ID NO: 53216 - DNA, 22 bp, Artificial Sequence
  Synthetic
atgaagccaccaugcctacaut

SEQ ID NO: 53217 - DNA, 23 bp, Artificial Sequence
  Synthetic
cccactaagaugggcatttugag

SEQ ID NO: 53218 - DNA, 21 bp, Artificial Sequence
  Synthetic
catctggtucaacagggcauc

SEQ ID NO: 53219 - DNA, 24 bp, Artificial Sequence
  Synthetic
tgtgugcggagctaaauaaagaca

SEQ ID NO: 53220 - DNA, 25 bp, Artificial Sequence
  Synthetic
tgtctgtaatgugtgagtcttgucc

SEQ ID NO: 53221 - DNA, 28 bp, Artificial Sequence
  Synthetic
attccaccactucacttgagataaauca

SEQ ID NO: 53222 - DNA, 22 bp, Artificial Sequence
  Synthetic
cctgggagaaucccatagcaut

SEQ ID NO: 53223 - DNA, 24 bp, Artificial Sequence
  Synthetic
cctctcacttcuctctggcttcut

SEQ ID NO: 53224 - DNA, 28 bp, Artificial Sequence
  Synthetic
ctgaaaataatgutctcctctctuggct

SEQ ID NO: 53225 - DNA, 18 bp, Artificial Sequence
  Synthetic
ccggacucccagcactua

SEQ ID NO: 53226 - DNA, 20 bp, Artificial Sequence
  Synthetic
ggtaggcuggctgtgatcuc

SEQ ID NO: 53227 - DNA, 20 bp, Artificial Sequence
  Synthetic
accttgcuatgcgcguagac

SEQ ID NO: 53228 - DNA, 25 bp, Artificial Sequence
  Synthetic
gttttctggagaagugtaggcttuc

SEQ ID NO: 53229 - DNA, 27 bp, Artificial Sequence
  Synthetic
gccaaccaagaacugttuaaaaagcaa

SEQ ID NO: 53230 - DNA, 24 bp, Artificial Sequence
  Synthetic
cccccttacuctgatcatgtucat

SEQ ID NO: 53231 - DNA, 24 bp, Artificial Sequence
  Synthetic
tctctgtctugatctctgtcuggt

SEQ ID NO: 53232 - DNA, 21 bp, Artificial Sequence
  Synthetic
ccctgcauggtagggatcuca

SEQ ID NO: 53233 - DNA, 25 bp, Artificial Sequence
  Synthetic
cccgtcttgucctcattttctgtut

SEQ ID NO: 53234 - DNA, 22 bp, Artificial Sequence
  Synthetic
tcagggaacaaaugccaaguga

SEQ ID NO: 53235 - DNA, 26 bp, Artificial Sequence
  Synthetic
ctctatattugacatcgccacugaac

SEQ ID NO: 53236 - DNA, 29 bp, Artificial Sequence
  Synthetic
tttgcaactacuagatgacatgtgaauca

SEQ ID NO: 53237 - DNA, 20 bp, Artificial Sequence
  Synthetic
cuacacugcagggaccacaa

SEQ ID NO: 53238 - DNA, 32 bp, Artificial Sequence
  Synthetic
aatgagtaaagactuaggtagtacaaacatut

SEQ ID NO: 53239 - DNA, 25 bp, Artificial Sequence
  Synthetic
tcaaaggugacatgggtcuaaaagg

SEQ ID NO: 53240 - DNA, 27 bp, Artificial Sequence
  Synthetic
ttaccttttcaccuttagatccctuga

SEQ ID NO: 53241 - DNA, 24 bp, Artificial Sequence
  Synthetic
gtccacaaggucctattggauacc

SEQ ID NO: 53242 - DNA, 26 bp, Artificial Sequence
  Synthetic
tgtctggtaacuttccattgtuccat

SEQ ID NO: 53243 - DNA, 30 bp, Artificial Sequence
  Synthetic
ttaacccaacuagataaatactcactuggc

SEQ ID NO: 53244 - DNA, 28 bp, Artificial Sequence
  Synthetic
ctgacataccttguttggaatctagcut

SEQ ID NO: 53245 - DNA, 27 bp, Artificial Sequence
  Synthetic
ggaaatctcttguttgaacatgtgugt

SEQ ID NO: 53246 - DNA, 21 bp, Artificial Sequence
  Synthetic
cucactcaucccagacacagg

SEQ ID NO: 53247 - DNA, 21 bp, Artificial Sequence
  Synthetic
tctctcccugatgcagctgua

SEQ ID NO: 53248 - DNA, 20 bp, Artificial Sequence
  Synthetic
ctccctggugacagtctgug

SEQ ID NO: 53249 - DNA, 24 bp, Artificial Sequence
  Synthetic
ctctctattgcuatccccacacut

SEQ ID NO: 53250 - DNA, 24 bp, Artificial Sequence
  Synthetic
ctgtaatggttugttccggacauc

SEQ ID NO: 53251 - DNA, 28 bp, Artificial Sequence
  Synthetic
atagatgcagucacaataatgtgctaut

SEQ ID NO: 53252 - DNA, 25 bp, Artificial Sequence
  Synthetic
gtgcaagctutcagctgataugaat

SEQ ID NO: 53253 - DNA, 27 bp, Artificial Sequence
  Synthetic
gcatttctuccgaacactaagattugt

SEQ ID NO: 53254 - DNA, 24 bp, Artificial Sequence
  Synthetic
tguggactccatugaagacagaga

SEQ ID NO: 53255 - DNA, 27 bp, Artificial Sequence
  Synthetic
cattcaccatgucctgcatttattgut

SEQ ID NO: 53256 - DNA, 28 bp, Artificial Sequence
  Synthetic
ccgatattcatattutgtccatgggcua

SEQ ID NO: 53257 - DNA, 21 bp, Artificial Sequence
  Synthetic
cccaaguccagagctgttcuc

SEQ ID NO: 53258 - DNA, 23 bp, Artificial Sequence
  Synthetic
gggagaagaaguggaaggaaugg

SEQ ID NO: 53259 - DNA, 27 bp, Artificial Sequence
  Synthetic
gtgggattcuggaacgctatgtatuat

SEQ ID NO: 53260 - DNA, 25 bp, Artificial Sequence
  Synthetic
accccaautaagtgtaaugccaaca

SEQ ID NO: 53261 - DNA, 28 bp, Artificial Sequence
  Synthetic
tggtggaatgaacuttgagatttcctut

SEQ ID NO: 53262 - DNA, 22 bp, Artificial Sequence
  Synthetic
gatccttcuccacgccatugat

SEQ ID NO: 53263 - DNA, 28 bp, Artificial Sequence
  Synthetic
ccagcugaacaaaguaaagaagaaagaa

SEQ ID NO: 53264 - DNA, 21 bp, Artificial Sequence
  Synthetic
ccucaaauacggagcgaagca

SEQ ID NO: 53265 - DNA, 20 bp, Artificial Sequence
  Synthetic
gctgcagguacagugaccaa

SEQ ID NO: 53266 - DNA, 26 bp, Artificial Sequence
  Synthetic
gttgtgacuggagaatgagaattugg

SEQ ID NO: 53267 - DNA, 22 bp, Artificial Sequence
  Synthetic
ctcatttctcucctgggcagut

SEQ ID NO: 53268 - DNA, 27 bp, Artificial Sequence
  Synthetic
tgactgttcattguccgacatatgtut

SEQ ID NO: 53269 - DNA, 23 bp, Artificial Sequence
  Synthetic
ggaatggctguccccatcttaug

SEQ ID NO: 53270 - DNA, 26 bp, Artificial Sequence
  Synthetic
gggaggaucagctgaaagtaattuct

SEQ ID NO: 53271 - DNA, 24 bp, Artificial Sequence
  Synthetic
gtcaggtgacautgtctgtcugaa

SEQ ID NO: 53272 - DNA, 26 bp, Artificial Sequence
  Synthetic
cactttcuaccacacagttgaatucc

SEQ ID NO: 53273 - DNA, 28 bp, Artificial Sequence
  Synthetic
gaaggcaggtuggaaaatagaaaaagut

SEQ ID NO: 53274 - DNA, 20 bp, Artificial Sequence
  Synthetic
ctgtcacacgucctguggag

SEQ ID NO: 53275 - DNA, 21 bp, Artificial Sequence
  Synthetic
ccaagcgucccaatcagaaug

SEQ ID NO: 53276 - DNA, 21 bp, Artificial Sequence
  Synthetic
gtacattguccccaugacgga

SEQ ID NO: 53277 - DNA, 25 bp, Artificial Sequence
  Synthetic
tctgtcagcauctgtatggtttugg

SEQ ID NO: 53278 - DNA, 28 bp, Artificial Sequence
  Synthetic
cctccttcttccuctttcttgttttuca

SEQ ID NO: 53279 - DNA, 28 bp, Artificial Sequence
  Synthetic
cgcatatacacutaatttcgtcucagga

SEQ ID NO: 53280 - DNA, 26 bp, Artificial Sequence
  Synthetic
ttccggctcauatatcagctgtttut

SEQ ID NO: 53281 - DNA, 23 bp, Artificial Sequence
  Synthetic
ccaagtgauggccatgcttguat

SEQ ID NO: 53282 - DNA, 29 bp, Artificial Sequence
  Synthetic
tcagcaaaagauacuaagaagggaagaga

SEQ ID NO: 53283 - DNA, 28 bp, Artificial Sequence
  Synthetic
gcttcattttcutcctttcctgaucaga

SEQ ID NO: 53284 - DNA, 21 bp, Artificial Sequence
  Synthetic
gggtggcuggtaatgttugat

SEQ ID NO: 53285 - DNA, 27 bp, Artificial Sequence
  Synthetic
ggctcttgtuattactggctugaaaac

SEQ ID NO: 53286 - DNA, 21 bp, Artificial Sequence
  Synthetic
cccaacgauacccgactucag

SEQ ID NO: 53287 - DNA, 21 bp, Artificial Sequence
  Synthetic
ccttcgtugaccacgucaaat

SEQ ID NO: 53288 - DNA, 23 bp, Artificial Sequence
  Synthetic
tcacgttuaccatgttcugagca

SEQ ID NO: 53289 - DNA, 26 bp, Artificial Sequence
  Synthetic
aagaagcugagtcatgaauggagaag

SEQ ID NO: 53290 - DNA, 28 bp, Artificial Sequence
  Synthetic
ggtgtcctugaagaactagaatgttuca

SEQ ID NO: 53291 - DNA, 25 bp, Artificial Sequence
  Synthetic
cctgggaacacautttcugcaaaag

SEQ ID NO: 53292 - DNA, 26 bp, Artificial Sequence
  Synthetic
acaaaactgaagcuaccgctattcut

SEQ ID NO: 53293 - DNA, 28 bp, Artificial Sequence
  Synthetic
ggcttccuactatgtaaccauagagact

SEQ ID NO: 53294 - DNA, 23 bp, Artificial Sequence
  Synthetic
tgttcauccaccagtatgtugct

SEQ ID NO: 53295 - DNA, 29 bp, Artificial Sequence
  Synthetic
ggtcaccugaaatgaaaatguagaaaagg

SEQ ID NO: 53296 - DNA, 26 bp, Artificial Sequence
  Synthetic
ctcttgaatuaccttgtcatcuggct

SEQ ID NO: 53297 - DNA, 28 bp, Artificial Sequence
  Synthetic
gttggatacacagccuagacttacttut

SEQ ID NO: 53298 - DNA, 24 bp, Artificial Sequence
  Synthetic
gggtcuacaaaccattcacaguct

SEQ ID NO: 53299 - DNA, 25 bp, Artificial Sequence
  Synthetic
aagtttcuggacttcatcatuggct

SEQ ID NO: 53300 - DNA, 20 bp, Artificial Sequence
  Synthetic
catctccucccttgctgcua

SEQ ID NO: 53301 - DNA, 17 bp, Artificial Sequence
  Synthetic
agcaugacgccgaggug

SEQ ID NO: 53302 - DNA, 22 bp, Artificial Sequence
  Synthetic
ctggtcuggacatgatggtuct

SEQ ID NO: 53303 - DNA, 21 bp, Artificial Sequence
  Synthetic
cccttctcucacagggugaac

SEQ ID NO: 53304 - DNA, 22 bp, Artificial Sequence
  Synthetic
cgccttuggcaggagauaagaa

SEQ ID NO: 53305 - DNA, 21 bp, Artificial Sequence
  Synthetic
ccctcaccuctacctgctcuc

SEQ ID NO: 53306 - DNA, 20 bp, Artificial Sequence
  Synthetic
ggcuaccacgaagaccccua

SEQ ID NO: 53307 - DNA, 24 bp, Artificial Sequence
  Synthetic
ggttgatcacutcttggtgtcuct

SEQ ID NO: 53308 - DNA, 27 bp, Artificial Sequence
  Synthetic
gcacatttcaaguagccttagttcuga

SEQ ID NO: 53309 - DNA, 27 bp, Artificial Sequence
  Synthetic
caaaaatacugggaggcaacuaaaaga

SEQ ID NO: 53310 - DNA, 28 bp, Artificial Sequence
  Synthetic
ctttggagtgacugtaaaaatcatcugg

SEQ ID NO: 53311 - DNA, 27 bp, Artificial Sequence
  Synthetic
ccaaacagctcucattcactctcttut

SEQ ID NO: 53312 - DNA, 22 bp, Artificial Sequence
  Synthetic
gcacatgcuttcatactugcct

SEQ ID NO: 53313 - DNA, 28 bp, Artificial Sequence
  Synthetic
catgcttgctaugagtacaatcacatut

SEQ ID NO: 53314 - DNA, 22 bp, Artificial Sequence
  Synthetic
gaaaggtcccugctgggaauat

SEQ ID NO: 53315 - DNA, 28 bp, Artificial Sequence
  Synthetic
cctctcactctuttaatcgatgctttut

SEQ ID NO: 53316 - DNA, 27 bp, Artificial Sequence
  Synthetic
agatgtcatttgtutggactagctgut

SEQ ID NO: 53317 - DNA, 29 bp, Artificial Sequence
  Synthetic
gcatguaaacaagagaaagacgauaagga

SEQ ID NO: 53318 - DNA, 28 bp, Artificial Sequence
  Synthetic
agttatacaacaaaccugctgctcuaaa

SEQ ID NO: 53319 - DNA, 23 bp, Artificial Sequence
  Synthetic
ctcacagccaaugaggaactuga

SEQ ID NO: 53320 - DNA, 18 bp, Artificial Sequence
  Synthetic
gggctucagcgacauggt

SEQ ID NO: 53321 - DNA, 17 bp, Artificial Sequence
  Synthetic
ggcggcuccttggtcuc

SEQ ID NO: 53322 - DNA, 24 bp, Artificial Sequence
  Synthetic
gtgttgttguggaaagtagtgcug

SEQ ID NO: 53323 - DNA, 26 bp, Artificial Sequence
  Synthetic
ctcaggatccuctcttttcatuccaa

SEQ ID NO: 53324 - DNA, 22 bp, Artificial Sequence
  Synthetic
acacacttucagcagcagguag

SEQ ID NO: 53325 - DNA, 28 bp, Artificial Sequence
  Synthetic
ctttgaagcagccuttatgtatgtgtut

SEQ ID NO: 53326 - DNA, 29 bp, Artificial Sequence
  Synthetic
tcacagtagtgtuatgtgcaaactatuga

SEQ ID NO: 53327 - DNA, 28 bp, Artificial Sequence
  Synthetic
tctctctctgacaugatctggtatctut

SEQ ID NO: 53328 - DNA, 28 bp, Artificial Sequence
  Synthetic
gaaaagagtgguagaaaagaggtttcug

SEQ ID NO: 53329 - DNA, 26 bp, Artificial Sequence
  Synthetic
acaaagtgtattuagccggagauagg

SEQ ID NO: 53330 - DNA, 28 bp, Artificial Sequence
  Synthetic
tttgatttcttagautccccaaguccaa

SEQ ID NO: 53331 - DNA, 28 bp, Artificial Sequence
  Synthetic
catgcccauggacaaatgtaaagtuaat

SEQ ID NO: 53332 - DNA, 22 bp, Artificial Sequence
  Synthetic
gaatttcccaaguggcaucgag

SEQ ID NO: 53333 - DNA, 26 bp, Artificial Sequence
  Synthetic
cagcatucagagcaagaaaatgtuca

SEQ ID NO: 53334 - DNA, 23 bp, Artificial Sequence
  Synthetic
ctcaucccccatgctucagaaaa

SEQ ID NO: 53335 - DNA, 24 bp, Artificial Sequence
  Synthetic
gctcctguacagcttactcucaat

SEQ ID NO: 53336 - DNA, 22 bp, Artificial Sequence
  Synthetic
acttcatgcugcatcacgagut

SEQ ID NO: 53337 - DNA, 24 bp, Artificial Sequence
  Synthetic
cttcttctcacaucagggttcugt

SEQ ID NO: 53338 - DNA, 19 bp, Artificial Sequence
  Synthetic
gcucucacagacccaggga

SEQ ID NO: 53339 - DNA, 28 bp, Artificial Sequence
  Synthetic
gtttaatctgctutctgcaagacaauct

SEQ ID NO: 53340 - DNA, 25 bp, Artificial Sequence
  Synthetic
gggctcguattttatggacugaaca

SEQ ID NO: 53341 - DNA, 24 bp, Artificial Sequence
  Synthetic
ccaggacaagcucaagtucaagaa

SEQ ID NO: 53342 - DNA, 21 bp, Artificial Sequence
  Synthetic
atcagcaaaggcuctgggtut

SEQ ID NO: 53343 - DNA, 22 bp, Artificial Sequence
  Synthetic
agccaugaaagtgagctuccag

SEQ ID NO: 53344 - DNA, 28 bp, Artificial Sequence
  Synthetic
tccttttaactcgaautggagagggaua

SEQ ID NO: 53345 - DNA, 25 bp, Artificial Sequence
  Synthetic
cctctccaugaaaaaccagtcaaug

SEQ ID NO: 53346 - DNA, 21 bp, Artificial Sequence
  Synthetic
aggagaaaggacggcutccua

SEQ ID NO: 53347 - DNA, 19 bp, Artificial Sequence
  Synthetic
ggagugguacgcgcacaat

SEQ ID NO: 53348 - DNA, 26 bp, Artificial Sequence
  Synthetic
tgtgaaatcauagcaaagagugacca

SEQ ID NO: 53349 - DNA, 28 bp, Artificial Sequence
  Synthetic
agttttgacautaagagctcugacacat

SEQ ID NO: 53350 - DNA, 20 bp, Artificial Sequence
  Synthetic
ctcaccgcagucctugaact

SEQ ID NO: 53351 - DNA, 21 bp, Artificial Sequence
  Synthetic
cccgacagguttgtcttguga

SEQ ID NO: 53352 - DNA, 21 bp, Artificial Sequence
  Synthetic
gcaaaaacauggacguggcat

SEQ ID NO: 53353 - DNA, 22 bp, Artificial Sequence
  Synthetic
gcggtaattucctgtgcttcut

SEQ ID NO: 53354 - DNA, 17 bp, Artificial Sequence
  Synthetic
gaggaagccugcgctug

SEQ ID NO: 53355 - DNA, 23 bp, Artificial Sequence
  Synthetic
cctatugtacggacucccaaggt

SEQ ID NO: 53356 - DNA, 25 bp, Artificial Sequence
  Synthetic
gacaattucacgttcagcuacagaa

SEQ ID NO: 53357 - DNA, 22 bp, Artificial Sequence
  Synthetic
catgaagaucctcacugagcgt

SEQ ID NO: 53358 - DNA, 25 bp, Artificial Sequence
  Synthetic
ctagtaugaactttgccuccaagca

SEQ ID NO: 53359 - DNA, 24 bp, Artificial Sequence
  Synthetic
gacutcatgaggtuaacccaggag

SEQ ID NO: 53360 - DNA, 21 bp, Artificial Sequence
  Synthetic
cacgtccaccuctaacauggt

SEQ ID NO: 53361 - DNA, 25 bp, Artificial Sequence
  Synthetic
agattatcaggugagatgcctgtug

SEQ ID NO: 53362 - DNA, 21 bp, Artificial Sequence
  Synthetic
tgcauggcccagagagaaaug

SEQ ID NO: 53363 - DNA, 27 bp, Artificial Sequence
  Synthetic
gaaagcaacugaagggtgtcataaaut

SEQ ID NO: 53364 - DNA, 28 bp, Artificial Sequence
  Synthetic
tggagaaactaaaacucacctgtactug

SEQ ID NO: 53365 - DNA, 24 bp, Artificial Sequence
  Synthetic
atcaccaacccuccaatcctttut

SEQ ID NO: 53366 - DNA, 25 bp, Artificial Sequence
  Synthetic
aatggaatgttuggtgctgtttuca

SEQ ID NO: 53367 - DNA, 22 bp, Artificial Sequence
  Synthetic
actccacuactcactgtucggt

SEQ ID NO: 53368 - DNA, 25 bp, Artificial Sequence
  Synthetic
actcaggaguatttctcaugggaca

SEQ ID NO: 53369 - DNA, 26 bp, Artificial Sequence
  Synthetic
ggctctattuaacctcccttgatucc

SEQ ID NO: 53370 - DNA, 28 bp, Artificial Sequence
  Synthetic
tcatggaaaatuaggcttcctttugaga

SEQ ID NO: 53371 - DNA, 24 bp, Artificial Sequence
  Synthetic
gtgtaatgcgggcuttcatgtuac

SEQ ID NO: 53372 - DNA, 21 bp, Artificial Sequence
  Synthetic
cccgtttgucagagctgtgua

SEQ ID NO: 53373 - DNA, 22 bp, Artificial Sequence
  Synthetic
cccagtgugaagtatggagcug

SEQ ID NO: 53374 - DNA, 22 bp, Artificial Sequence
  Synthetic
cattctaaggcuccccaugcaa

SEQ ID NO: 53375 - DNA, 23 bp, Artificial Sequence
  Synthetic
tggccatcucttcctcttctuct

SEQ ID NO: 53376 - DNA, 20 bp, Artificial Sequence
  Synthetic
ggtaaaucccagggcgauct

SEQ ID NO: 53377 - DNA, 17 bp, Artificial Sequence
  Synthetic
cgccugaagugggagca

SEQ ID NO: 53378 - DNA, 21 bp, Artificial Sequence
  Synthetic
catgtcgtccaucctgcctut

SEQ ID NO: 53379 - DNA, 23 bp, Artificial Sequence
  Synthetic
gagtttctugaccaggctctuga

SEQ ID NO: 53380 - DNA, 25 bp, Artificial Sequence
  Synthetic
gggttccacuatgtagaaatcctuc

SEQ ID NO: 53381 - DNA, 27 bp, Artificial Sequence
  Synthetic
tgtccttacugccatttgacctttuat

SEQ ID NO: 53382 - DNA, 22 bp, Artificial Sequence
  Synthetic
cuaatgcagcucgaggaggaag

SEQ ID NO: 53383 - DNA, 20 bp, Artificial Sequence
  Synthetic
cttttcggtuccgggtctug

SEQ ID NO: 53384 - DNA, 20 bp, Artificial Sequence
  Synthetic
gcacccacgaucatgcugag

SEQ ID NO: 53385 - DNA, 22 bp, Artificial Sequence
  Synthetic
cagggcctuttcttgctaguga

SEQ ID NO: 53386 - DNA, 19 bp, Artificial Sequence
  Synthetic
aaguagccccagccaugac

SEQ ID NO: 53387 - DNA, 21 bp, Artificial Sequence
  Synthetic
aactgcccutaccatcgugac

SEQ ID NO: 53388 - DNA, 20 bp, Artificial Sequence
  Synthetic
gggucccaagcactatgcuc

SEQ ID NO: 53389 - DNA, 17 bp, Artificial Sequence
  Synthetic
ggttcccgcaugcgtut

SEQ ID NO: 53390 - DNA, 23 bp, Artificial Sequence
  Synthetic
ctagtcuggaaaatgcaguggga

SEQ ID NO: 53391 - DNA, 27 bp, Artificial Sequence
  Synthetic
cctctctctaguagctcaactggauaa

SEQ ID NO: 53392 - DNA, 21 bp, Artificial Sequence
  Synthetic
gggaggtgagugggagatgua

SEQ ID NO: 53393 - DNA, 29 bp, Artificial Sequence
  Synthetic
ggaccattaucagaacaggatctcaatuc

SEQ ID NO: 53394 - DNA, 20 bp, Artificial Sequence
  Synthetic
ccctgaccacccuctccaut

SEQ ID NO: 53395 - DNA, 18 bp, Artificial Sequence
  Synthetic
tttcugccgcaaggccua

SEQ ID NO: 53396 - DNA, 20 bp, Artificial Sequence
  Synthetic
ggaacctacgugcagccaut

SEQ ID NO: 53397 - DNA, 17 bp, Artificial Sequence
  Synthetic
tgtggaccuggccacug

SEQ ID NO: 53398 - DNA, 24 bp, Artificial Sequence
  Synthetic
cctgctggaucaggtcttcatcua

SEQ ID NO: 53399 - DNA, 22 bp, Artificial Sequence
  Synthetic
cgtccattgugggtagcaauct

SEQ ID NO: 53400 - DNA, 18 bp, Artificial Sequence
  Synthetic
gcggaaggugacagcuga

SEQ ID NO: 53401 - DNA, 18 bp, Artificial Sequence
  Synthetic
cggatgcuggcacctuct

SEQ ID NO: 53402 - DNA, 20 bp, Artificial Sequence
  Synthetic
taggagacgutggtgccauc

SEQ ID NO: 53403 - DNA, 24 bp, Artificial Sequence
  Synthetic
gggtcctaccauctcttacaccut

SEQ ID NO: 53404 - DNA, 18 bp, Artificial Sequence
  Synthetic
gcggcutgcatugacgac

SEQ ID NO: 53405 - DNA, 22 bp, Artificial Sequence
  Synthetic
gctuacaacagcacaggugact

SEQ ID NO: 53406 - DNA, 22 bp, Artificial Sequence
  Synthetic
acgcagaugctggtgaaguaat

SEQ ID NO: 53407 - DNA, 19 bp, Artificial Sequence
  Synthetic
ggcccacuacctctucgac

SEQ ID NO: 53408 - DNA, 20 bp, Artificial Sequence
  Synthetic
cactguggagaccugcagac

SEQ ID NO: 53409 - DNA, 20 bp, Artificial Sequence
  Synthetic
tgccttcugctctgctucat

SEQ ID NO: 53410 - DNA, 21 bp, Artificial Sequence
  Synthetic
tgcttttcuctggccugagag

SEQ ID NO: 53411 - DNA, 20 bp, Artificial Sequence
  Synthetic
cagggucaagcagcucaaga

SEQ ID NO: 53412 - DNA, 27 bp, Artificial Sequence
  Synthetic
tggtttacctuccagttctgaaaucat

SEQ ID NO: 53413 - DNA, 24 bp, Artificial Sequence
  Synthetic
tuctcttuccccaaaaaggaacga

SEQ ID NO: 53414 - DNA, 23 bp, Artificial Sequence
  Synthetic
cccaggcutaauccaaaagcaac

SEQ ID NO: 53415 - DNA, 24 bp, Artificial Sequence
  Synthetic
gcgtctttgcuttctctgtgauga

SEQ ID NO: 53416 - DNA, 22 bp, Artificial Sequence
  Synthetic
gggagtcucacctgtacacgua

SEQ ID NO: 53417 - DNA, 21 bp, Artificial Sequence
  Synthetic
tgaatgcucaccgtcctgtuc

SEQ ID NO: 53418 - DNA, 21 bp, Artificial Sequence
  Synthetic
cucccacccacacauacagac

SEQ ID NO: 53419 - DNA, 26 bp, Artificial Sequence
  Synthetic
gctgactgccuttctgtattttcuga

SEQ ID NO: 53420 - DNA, 21 bp, Artificial Sequence
  Synthetic
acccactguctgaaccugagt

SEQ ID NO: 53421 - DNA, 21 bp, Artificial Sequence
  Synthetic
ccagaaccgaauccugaggag

SEQ ID NO: 53422 - DNA, 21 bp, Artificial Sequence
  Synthetic
gcggcucctagtucagaagga

SEQ ID NO: 53423 - DNA, 22 bp, Artificial Sequence
  Synthetic
caaaatgtcagcucggttcgug

SEQ ID NO: 53424 - DNA, 21 bp, Artificial Sequence
  Synthetic
cccaguccagcacctttuact

SEQ ID NO: 53425 - DNA, 21 bp, Artificial Sequence
  Synthetic
gccccacauacacatcagcuc

SEQ ID NO: 53426 - DNA, 22 bp, Artificial Sequence
  Synthetic
ttagcauggccuacacaacaca

SEQ ID NO: 53427 - DNA, 27 bp, Artificial Sequence
  Synthetic
ctgagcctuatttgtcttcucagaact

SEQ ID NO: 53428 - DNA, 21 bp, Artificial Sequence
  Synthetic
tcccttagggccugagcaaua

SEQ ID NO: 53429 - DNA, 26 bp, Artificial Sequence
  Synthetic
acacgtatcaagautggactcaacuc

SEQ ID NO: 53430 - DNA, 24 bp, Artificial Sequence
  Synthetic
gtcaaggutaacatguccgaggaa

SEQ ID NO: 53431 - DNA, 20 bp, Artificial Sequence
  Synthetic
ctaagugccgcaccagcuat

SEQ ID NO: 53432 - DNA, 22 bp, Artificial Sequence
  Synthetic
guggaaagcatucccaaaacga

SEQ ID NO: 53433 - DNA, 24 bp, Artificial Sequence
  Synthetic
ctacaactucaacctcaagccugt

SEQ ID NO: 53434 - DNA, 22 bp, Artificial Sequence
  Synthetic
caaccuaaacagcagccttcuc

SEQ ID NO: 53435 - DNA, 27 bp, Artificial Sequence
  Synthetic
agtctgcttautcttgatgttguaccc

SEQ ID NO: 53436 - DNA, 24 bp, Artificial Sequence
  Synthetic
agctagacaaacccauaccaccua

SEQ ID NO: 53437 - DNA, 24 bp, Artificial Sequence
  Synthetic
ccttggactaugctgacaacaucc

SEQ ID NO: 53438 - DNA, 28 bp, Artificial Sequence
  Synthetic
aattaactggaaauaacaagggagcuga

SEQ ID NO: 53439 - DNA, 20 bp, Artificial Sequence
  Synthetic
cttaucgagggccggguaac

SEQ ID NO: 53440 - DNA, 23 bp, Artificial Sequence
  Synthetic
gggctaaaagutctggaggctut

SEQ ID NO: 53441 - DNA, 26 bp, Artificial Sequence
  Synthetic
agccattugaacgaagataatcugct

SEQ ID NO: 53442 - DNA, 20 bp, Artificial Sequence
  Synthetic
ctcaggagcugccaaccuaa

SEQ ID NO: 53443 - DNA, 18 bp, Artificial Sequence
  Synthetic
tggguacactggguccct

SEQ ID NO: 53444 - DNA, 20 bp, Artificial Sequence
  Synthetic
cgttgauggagaccgugcat

SEQ ID NO: 53445 - DNA, 23 bp, Artificial Sequence
  Synthetic
gaagccgcucttctacgtcatua

SEQ ID NO: 53446 - DNA, 21 bp, Artificial Sequence
  Synthetic
gggccugatccctgaugagat

SEQ ID NO: 53447 - DNA, 22 bp, Artificial Sequence
  Synthetic
agagctcctucagcttccaaug

SEQ ID NO: 53448 - DNA, 22 bp, Artificial Sequence
  Synthetic
gagtctagccaucccagagcua

SEQ ID NO: 53449 - DNA, 21 bp, Artificial Sequence
  Synthetic
ggcaggaagutcgagatucgg

SEQ ID NO: 53450 - DNA, 23 bp, Artificial Sequence
  Synthetic
cgcgagaacagcugatgagaaua

SEQ ID NO: 53451 - DNA, 22 bp, Artificial Sequence
  Synthetic
atctgaaccaugctctgctcug

SEQ ID NO: 53452 - DNA, 23 bp, Artificial Sequence
  Synthetic
gcaccatugcttctcctugaaat

SEQ ID NO: 53453 - DNA, 24 bp, Artificial Sequence
  Synthetic
cctcaggcaugttcatgtcaucaa

SEQ ID NO: 53454 - DNA, 25 bp, Artificial Sequence
  Synthetic
tttctaggactcuggctacaagcua

SEQ ID NO: 53455 - DNA, 24 bp, Artificial Sequence
  Synthetic
tgagagaugagagcttggctttut

SEQ ID NO: 53456 - DNA, 22 bp, Artificial Sequence
  Synthetic
ccagggauggaatcgctcauac

SEQ ID NO: 53457 - DNA, 26 bp, Artificial Sequence
  Synthetic
ccctctgatucacccctcaaaatuaa

SEQ ID NO: 53458 - DNA, 21 bp, Artificial Sequence
  Synthetic
caaaaccgaggccutcacauc

SEQ ID NO: 53459 - DNA, 21 bp, Artificial Sequence
  Synthetic
tccaccagagutgtccucact

SEQ ID NO: 53460 - DNA, 28 bp, Artificial Sequence
  Synthetic
gtcatggaagaaaugttggauaaagcat

SEQ ID NO: 53461 - DNA, 26 bp, Artificial Sequence
  Synthetic
gagtctgtgucagacaaatctaugga

SEQ ID NO: 53462 - DNA, 29 bp, Artificial Sequence
  Synthetic
catactcaguagacaacataaagccucat

SEQ ID NO: 53463 - DNA, 26 bp, Artificial Sequence
  Synthetic
gaagtcccagcutggtagaaaauact

SEQ ID NO: 53464 - DNA, 28 bp, Artificial Sequence
  Synthetic
ggagttatatutcctttcctugcagagt

SEQ ID NO: 53465 - DNA, 28 bp, Artificial Sequence
  Synthetic
cacaatttcugtgtttgtuaaccagagt

SEQ ID NO: 53466 - DNA, 28 bp, Artificial Sequence
  Synthetic
agtgtctgaaucaaatgttctctuggat

SEQ ID NO: 53467 - DNA, 28 bp, Artificial Sequence
  Synthetic
ggcctccuaaaagtagactggaauaaaa

SEQ ID NO: 53468 - DNA, 21 bp, Artificial Sequence
  Synthetic
ccacaccagggcaucuagact

SEQ ID NO: 53469 - DNA, 23 bp, Artificial Sequence
  Synthetic
cccctccatguttctctctccut

SEQ ID NO: 53470 - DNA, 22 bp, Artificial Sequence
  Synthetic
gggtgaaacuggttgatccugt

SEQ ID NO: 53471 - DNA, 20 bp, Artificial Sequence
  Synthetic
agcctagguccctcctuacc

SEQ ID NO: 53472 - DNA, 23 bp, Artificial Sequence
  Synthetic
gguccaccagaauccagagaaag

SEQ ID NO: 53473 - DNA, 22 bp, Artificial Sequence
  Synthetic
tcccaagutcctcacauagggt

SEQ ID NO: 53474 - DNA, 23 bp, Artificial Sequence
  Synthetic
aggatccagacucttcagucact

SEQ ID NO: 53475 - DNA, 23 bp, Artificial Sequence
  Synthetic
agccatccuaaaggaagtgctut

SEQ ID NO: 53476 - DNA, 25 bp, Artificial Sequence
  Synthetic
agctctccagutagcagtatucact

SEQ ID NO: 53477 - DNA, 28 bp, Artificial Sequence
  Synthetic
gagtaggatttacutcacatcgtgtuca

SEQ ID NO: 53478 - DNA, 27 bp, Artificial Sequence
  Synthetic
gttttcatttuagaaagcggcctctua

SEQ ID NO: 53479 - DNA, 27 bp, Artificial Sequence
  Synthetic
cagctagtgucttgaatttaaguccca

SEQ ID NO: 53480 - DNA, 17 bp, Artificial Sequence
  Synthetic
tgtccgcgauggaggug

SEQ ID NO: 53481 - DNA, 19 bp, Artificial Sequence
  Synthetic
aggcuacacgggacugaga

SEQ ID NO: 53482 - DNA, 20 bp, Artificial Sequence
  Synthetic
gctgaaagcccugaaccugt

SEQ ID NO: 53483 - DNA, 18 bp, Artificial Sequence
  Synthetic
ccacacguccgtgctuct

SEQ ID NO: 53484 - DNA, 20 bp, Artificial Sequence
  Synthetic
cgtgugaccgaaacgtguct

SEQ ID NO: 53485 - DNA, 24 bp, Artificial Sequence
  Synthetic
gaaatgaacagcgagguctttgug

SEQ ID NO: 53486 - DNA, 20 bp, Artificial Sequence
  Synthetic
gctacatuggcgtggugaac

SEQ ID NO: 53487 - DNA, 20 bp, Artificial Sequence
  Synthetic
gcacacuacgugcaaaccct

SEQ ID NO: 53488 - DNA, 21 bp, Artificial Sequence
  Synthetic
ccccacacaugacacaaccut

SEQ ID NO: 53489 - DNA, 20 bp, Artificial Sequence
  Synthetic
ttcagctugacgacctgcut

SEQ ID NO: 53490 - DNA, 20 bp, Artificial Sequence
  Synthetic
ccacagcaccaauggccuat

SEQ ID NO: 53491 - DNA, 24 bp, Artificial Sequence
  Synthetic
gagguagagaugaaagaggccaag

SEQ ID NO: 53492 - DNA, 21 bp, Artificial Sequence
  Synthetic
agaggagagcaaugggacuga

SEQ ID NO: 53493 - DNA, 25 bp, Artificial Sequence
  Synthetic
ggtgtagacatutaggcggtctaug

SEQ ID NO: 53494 - DNA, 22 bp, Artificial Sequence
  Synthetic
agaaugagaaggaugccaccac

SEQ ID NO: 53495 - DNA, 27 bp, Artificial Sequence
  Synthetic
gggttcatuggagacatgatagaauct

SEQ ID NO: 53496 - DNA, 23 bp, Artificial Sequence
  Synthetic
acccautgagtccucccaaaaac

SEQ ID NO: 53497 - DNA, 20 bp, Artificial Sequence
  Synthetic
gtaguagagcacggcugaca

SEQ ID NO: 53498 - DNA, 25 bp, Artificial Sequence
  Synthetic
tgtctcaaggguttgaagatgugac

SEQ ID NO: 53499 - DNA, 24 bp, Artificial Sequence
  Synthetic
gcttgctgugagaataaggcacut

SEQ ID NO: 53500 - DNA, 21 bp, Artificial Sequence
  Synthetic
agagaccagcugcatcucaac

SEQ ID NO: 53501 - DNA, 21 bp, Artificial Sequence
  Synthetic
ggccccuttttcctgauacca

SEQ ID NO: 53502 - DNA, 24 bp, Artificial Sequence
  Synthetic
gacacatgcacutaaaagcauccc

SEQ ID NO: 53503 - DNA, 22 bp, Artificial Sequence
  Synthetic
gaaaggaaagaccugccacuca

SEQ ID NO: 53504 - DNA, 19 bp, Artificial Sequence
  Synthetic
gtgcccuccgttacctgut

SEQ ID NO: 53505 - DNA, 18 bp, Artificial Sequence
  Synthetic
gaggcgcuactgcuccag

SEQ ID NO: 53506 - DNA, 22 bp, Artificial Sequence
  Synthetic
catggagtucatcagggtcugg

SEQ ID NO: 53507 - DNA, 21 bp, Artificial Sequence
  Synthetic
aggcacugcatgtcaactuca

SEQ ID NO: 53508 - DNA, 22 bp, Artificial Sequence
  Synthetic
agcctcuccattccttcucaca

SEQ ID NO: 53509 - DNA, 20 bp, Artificial Sequence
  Synthetic
ctgggagguctctccauggt

SEQ ID NO: 53510 - DNA, 22 bp, Artificial Sequence
  Synthetic
tcatcacggcutgtgccaauaa

SEQ ID NO: 53511 - DNA, 19 bp, Artificial Sequence
  Synthetic
ccaagcaacauggcugcac

SEQ ID NO: 53512 - DNA, 21 bp, Artificial Sequence
  Synthetic
gtctgtgcugtgaccugaagt

SEQ ID NO: 53513 - DNA, 23 bp, Artificial Sequence
  Synthetic
cagcattuccaggagaaagugga

SEQ ID NO: 53514 - DNA, 27 bp, Artificial Sequence
  Synthetic
gtucaagaaacacaaaaccaugcaaag

SEQ ID NO: 53515 - DNA, 28 bp, Artificial Sequence
  Synthetic
ccatcattcccaugtttctctttttgut

SEQ ID NO: 53516 - DNA, 22 bp, Artificial Sequence
  Synthetic
cccaccuttgactuagagggaa

SEQ ID NO: 53517 - DNA, 23 bp, Artificial Sequence
  Synthetic
ctctctcaucagagctgcatguc

SEQ ID NO: 53518 - DNA, 21 bp, Artificial Sequence
  Synthetic
gagatgatggcugctgagtug

SEQ ID NO: 53519 - DNA, 24 bp, Artificial Sequence
  Synthetic
cagggaccuggtaatacugaagga

SEQ ID NO: 53520 - DNA, 25 bp, Artificial Sequence
  Synthetic
tccacagatucagagcattctucac

SEQ ID NO: 53521 - DNA, 27 bp, Artificial Sequence
  Synthetic
ggaacagaatucaactgaggtgtucaa

SEQ ID NO: 53522 - DNA, 26 bp, Artificial Sequence
  Synthetic
aacagaaaacautgctgguaggaaga

SEQ ID NO: 53523 - DNA, 25 bp, Artificial Sequence
  Synthetic
gtatuagggcagggatcattuggaa

SEQ ID NO: 53524 - DNA, 21 bp, Artificial Sequence
  Synthetic
gcctgaucccagcaaatcuga

SEQ ID NO: 53525 - DNA, 28 bp, Artificial Sequence
  Synthetic
ggtgttaaaaatguaatcatggccctut

SEQ ID NO: 53526 - DNA, 28 bp, Artificial Sequence
  Synthetic
ttcaatcaatatutgcctggcauacaac

SEQ ID NO: 53527 - DNA, 28 bp, Artificial Sequence
  Synthetic
tgtataacataacugtgtggtgggttut

SEQ ID NO: 53528 - DNA, 25 bp, Artificial Sequence
  Synthetic
caatgatuggacactcttugcagat

SEQ ID NO: 53529 - DNA, 23 bp, Artificial Sequence
  Synthetic
catcctttugccctccttctcuc

SEQ ID NO: 53530 - DNA, 27 bp, Artificial Sequence
  Synthetic
tctgctgtcaaauaagaacagtctguc

SEQ ID NO: 53531 - DNA, 28 bp, Artificial Sequence
  Synthetic
gggtcagtaatugttttctgctttgaut

SEQ ID NO: 53532 - DNA, 27 bp, Artificial Sequence
  Synthetic
cttgtccaaauaccgaaatacaucagg

SEQ ID NO: 53533 - DNA, 21 bp, Artificial Sequence
  Synthetic
acaggaugctacccguaagga

SEQ ID NO: 53534 - DNA, 27 bp, Artificial Sequence
  Synthetic
caacacacaauacaaggaaatgcauca

SEQ ID NO: 53535 - DNA, 28 bp, Artificial Sequence
  Synthetic
cctgaaatgcutggatgacatugaaaaa

SEQ ID NO: 53536 - DNA, 23 bp, Artificial Sequence
  Synthetic
caagcatttcuccaactgtugct

SEQ ID NO: 53537 - DNA, 28 bp, Artificial Sequence
  Synthetic
tctgcccuagacagtttttattcacuct

SEQ ID NO: 53538 - DNA, 26 bp, Artificial Sequence
  Synthetic
cacctttttguaagacagattucgca

SEQ ID NO: 53539 - DNA, 25 bp, Artificial Sequence
  Synthetic
gaacautcgaccugagaaagacaga

SEQ ID NO: 53540 - DNA, 26 bp, Artificial Sequence
  Synthetic
gtggagctugagctatgacactatut

SEQ ID NO: 53541 - DNA, 28 bp, Artificial Sequence
  Synthetic
cattctaacugggatgttgugagaaaga

SEQ ID NO: 53542 - DNA, 31 bp, Artificial Sequence
  Synthetic
cttaccttagaaaatugtgcatttacccaut

SEQ ID NO: 53543 - DNA, 28 bp, Artificial Sequence
  Synthetic
ccagcatcacucatgtttaattccatut

SEQ ID NO: 53544 - DNA, 25 bp, Artificial Sequence
  Synthetic
gaacatcguggaaagactgaatugg

SEQ ID NO: 53545 - DNA, 29 bp, Artificial Sequence
  Synthetic
agtgttggcatacuttgaactttctctua

SEQ ID NO: 53546 - DNA, 28 bp, Artificial Sequence
  Synthetic
ggaattccattttuctcagccattaaut

SEQ ID NO: 53547 - DNA, 27 bp, Artificial Sequence
  Synthetic
gaaactucagaacccaaagtcatugag

SEQ ID NO: 53548 - DNA, 22 bp, Artificial Sequence
  Synthetic
aaacaacuaaacgccgcttucc

SEQ ID NO: 53549 - DNA, 27 bp, Artificial Sequence
  Synthetic
cttagattctuccagccttttcctuca

SEQ ID NO: 53550 - DNA, 21 bp, Artificial Sequence
  Synthetic
ccacucacgcaacuagccaaa

SEQ ID NO: 53551 - DNA, 26 bp, Artificial Sequence
  Synthetic
acctcttccutcttactgaaaauggg

SEQ ID NO: 53552 - DNA, 24 bp, Artificial Sequence
  Synthetic
catcaccaaguacttaugggagca

SEQ ID NO: 53553 - DNA, 25 bp, Artificial Sequence
  Synthetic
agtacaagutcaagcucaacccaat

SEQ ID NO: 53554 - DNA, 21 bp, Artificial Sequence
  Synthetic
gcaaggaagcutaaggcggut

SEQ ID NO: 53555 - DNA, 27 bp, Artificial Sequence
  Synthetic
ctcctcagacaaaaguagacaatcuct

SEQ ID NO: 53556 - DNA, 23 bp, Artificial Sequence
  Synthetic
gtggtatgataugctgggtgucc

SEQ ID NO: 53557 - DNA, 27 bp, Artificial Sequence
  Synthetic
ggacctgaguacattgattcctttcut

SEQ ID NO: 53558 - DNA, 21 bp, Artificial Sequence
  Synthetic
tagtgagccccaauctgacut

SEQ ID NO: 53559 - DNA, 24 bp, Artificial Sequence
  Synthetic
tgcaagatcaccauctccatctuc

SEQ ID NO: 53560 - DNA, 24 bp, Artificial Sequence
  Synthetic
gacggtctttucttgtgagtcugt

SEQ ID NO: 53561 - DNA, 28 bp, Artificial Sequence
  Synthetic
gguacacacaauaaaaaggacagcaaat

SEQ ID NO: 53562 - DNA, 24 bp, Artificial Sequence
  Synthetic
gtcattgcaautgaatgcaugaca

SEQ ID NO: 53563 - DNA, 25 bp, Artificial Sequence
  Synthetic
ctatgtccttugtgaggtctgugaa

SEQ ID NO: 53564 - DNA, 25 bp, Artificial Sequence
  Synthetic
gatatggtucccaaggactagugac

SEQ ID NO: 53565 - DNA, 28 bp, Artificial Sequence
  Synthetic
tgagtgctacaaaaugcacatttacuct

SEQ ID NO: 53566 - DNA, 22 bp, Artificial Sequence
  Synthetic
cacttgaguagcttgcttugcc

SEQ ID NO: 53567 - DNA, 25 bp, Artificial Sequence
  Synthetic
gcaattgcuacaaatggcctaucac

SEQ ID NO: 53568 - DNA, 22 bp, Artificial Sequence
  Synthetic
accttcuggagttccuggacaa

SEQ ID NO: 53569 - DNA, 28 bp, Artificial Sequence
  Synthetic
ctcaagtatgugcctaaaactataugcc

SEQ ID NO: 53570 - DNA, 24 bp, Artificial Sequence
  Synthetic
gtgaautcagtgtcucgagaacct

SEQ ID NO: 53571 - DNA, 24 bp, Artificial Sequence
  Synthetic
ccaccaacagcaugttttactugt

SEQ ID NO: 53572 - DNA, 22 bp, Artificial Sequence
  Synthetic
cattacucagtgccugcaaggt

SEQ ID NO: 53573 - DNA, 25 bp, Artificial Sequence
  Synthetic
ccctttttgttuttgcctctctuca

SEQ ID NO: 53574 - DNA, 27 bp, Artificial Sequence
  Synthetic
agacatgaagtutccatgctagtuagg

SEQ ID NO: 53575 - DNA, 28 bp, Artificial Sequence
  Synthetic
tttaccaaggcagcauctacttatucaa

SEQ ID NO: 53576 - DNA, 24 bp, Artificial Sequence
  Synthetic
tggcagaaucaattcauggaagca

SEQ ID NO: 53577 - DNA, 28 bp, Artificial Sequence
  Synthetic
cctggtattcacaugaaggtcattucaa

SEQ ID NO: 53578 - DNA, 21 bp, Artificial Sequence
  Synthetic
gcctgctuctcagaagugaca

SEQ ID NO: 53579 - DNA, 28 bp, Artificial Sequence
  Synthetic
ccaaaatggttucagcttcagtagaaut

SEQ ID NO: 53580 - DNA, 21 bp, Artificial Sequence
  Synthetic
gccgtcctuccaggaacauag

SEQ ID NO: 53581 - DNA, 28 bp, Artificial Sequence
  Synthetic
cctctggtttutacaacaggaaaugaaa

SEQ ID NO: 53582 - DNA, 26 bp, Artificial Sequence
  Synthetic
gatggcttcugcatcaacttcuaaat

SEQ ID NO: 53583 - DNA, 27 bp, Artificial Sequence
  Synthetic
ccagcccaaaaugacctaatatucaaa

SEQ ID NO: 53584 - DNA, 26 bp, Artificial Sequence
  Synthetic
catatgtccttucaatggccccatua

SEQ ID NO: 53585 - DNA, 28 bp, Artificial Sequence
  Synthetic
acagtcaaucttgcaaaguagaagagaa

SEQ ID NO: 53586 - DNA, 20 bp, Artificial Sequence
  Synthetic
gcggatcaugtcgtcguaca

SEQ ID NO: 53587 - DNA, 19 bp, Artificial Sequence
  Synthetic
cctgagcgucctctagcuc

SEQ ID NO: 53588 - DNA, 21 bp, Artificial Sequence
  Synthetic
aggtgatcuacccggacucag

SEQ ID NO: 53589 - DNA, 28 bp, Artificial Sequence
  Synthetic
cactttagactcuggatgttgagguaat

SEQ ID NO: 53590 - DNA, 20 bp, Artificial Sequence
  Synthetic
gcgtguaggagctctggtug

SEQ ID NO: 53591 - DNA, 23 bp, Artificial Sequence
  Synthetic
cttgttcaaagccutgggaggua

SEQ ID NO: 53592 - DNA, 19 bp, Artificial Sequence
  Synthetic
cagaaccgaguggcaggua

SEQ ID NO: 53593 - DNA, 21 bp, Artificial Sequence
  Synthetic
agtgtcatccucagtggctug

SEQ ID NO: 53594 - DNA, 24 bp, Artificial Sequence
  Synthetic
ccuggaaattuggaagcagaggaa

SEQ ID NO: 53595 - DNA, 20 bp, Artificial Sequence
  Synthetic
tcaagctgucgccctatguc

SEQ ID NO: 53596 - DNA, 21 bp, Artificial Sequence
  Synthetic
gggcttcugggcttagaagut

SEQ ID NO: 53597 - DNA, 21 bp, Artificial Sequence
  Synthetic
caccctgucttcagtgaugga

SEQ ID NO: 53598 - DNA, 24 bp, Artificial Sequence
  Synthetic
gacaacuacgcagatcttucggat

SEQ ID NO: 53599 - DNA, 23 bp, Artificial Sequence
  Synthetic
cgtaaagccuacgagttgaucct

SEQ ID NO: 53600 - DNA, 26 bp, Artificial Sequence
  Synthetic
agcttaccttuactttgccattcuga

SEQ ID NO: 53601 - DNA, 24 bp, Artificial Sequence
  Synthetic
ggctactaguccaactctatugcc

SEQ ID NO: 53602 - DNA, 25 bp, Artificial Sequence
  Synthetic
cuccttgaauacaaaggacggacat

SEQ ID NO: 53603 - DNA, 28 bp, Artificial Sequence
  Synthetic
acagttttcttgtugatcctagtcgtut

SEQ ID NO: 53604 - DNA, 27 bp, Artificial Sequence
  Synthetic
tgtaaacagaaaccuggtggtcaatut

SEQ ID NO: 53605 - DNA, 28 bp, Artificial Sequence
  Synthetic
acaattaaaugttgttgguaagcacagg

SEQ ID NO: 53606 - DNA, 27 bp, Artificial Sequence
  Synthetic
tgagctgatttagutgagacttacgug

SEQ ID NO: 53607 - DNA, 24 bp, Artificial Sequence
  Synthetic
aacttctuggcaagtcggtuaaga

SEQ ID NO: 53608 - DNA, 28 bp, Artificial Sequence
  Synthetic
ccuttttaatacttuccccaagaagcca

SEQ ID NO: 53609 - DNA, 22 bp, Artificial Sequence
  Synthetic
tgaccacaggcutgatgtucac

SEQ ID NO: 53610 - DNA, 22 bp, Artificial Sequence
  Synthetic
gctgggaguatagcaucaccat

SEQ ID NO: 53611 - DNA, 20 bp, Artificial Sequence
  Synthetic
aggtctgcauctgtgccuac

SEQ ID NO: 53612 - DNA, 20 bp, Artificial Sequence
  Synthetic
gggaccagacgcucatctuc

SEQ ID NO: 53613 - DNA, 22 bp, Artificial Sequence
  Synthetic
ggagtuaggagagcacccauct

SEQ ID NO: 53614 - DNA, 25 bp, Artificial Sequence
  Synthetic
catttcagcugcaaagattccagua

SEQ ID NO: 53615 - DNA, 21 bp, Artificial Sequence
  Synthetic
cugataugggagccagggaag

SEQ ID NO: 53616 - DNA, 22 bp, Artificial Sequence
  Synthetic
aaccacagccaggaucaagtut

SEQ ID NO: 53617 - DNA, 22 bp, Artificial Sequence
  Synthetic
tcagatttgcucatgcctguca

SEQ ID NO: 53618 - DNA, 25 bp, Artificial Sequence
  Synthetic
gacacacaugcaattatctggcuaa

SEQ ID NO: 53619 - DNA, 22 bp, Artificial Sequence
  Synthetic
cctgcagcugatacagctcauc

SEQ ID NO: 53620 - DNA, 24 bp, Artificial Sequence
  Synthetic
ccttcttaugaggcaggatucgat

SEQ ID NO: 53621 - DNA, 27 bp, Artificial Sequence
  Synthetic
gaagtatggcucttataatugcccgaa

SEQ ID NO: 53622 - DNA, 25 bp, Artificial Sequence
  Synthetic
agagggagaagggucagtttaauga

SEQ ID NO: 53623 - DNA, 29 bp, Artificial Sequence
  Synthetic
agttttgccttcuttgcttgatttgtaut

SEQ ID NO: 53624 - DNA, 26 bp, Artificial Sequence
  Synthetic
gcccttugaggattagtaaauaccga

SEQ ID NO: 53625 - DNA, 26 bp, Artificial Sequence
  Synthetic
agagaagucagaaggttggagaugaa

SEQ ID NO: 53626 - DNA, 20 bp, Artificial Sequence
  Synthetic
agtggcgacugaatgugcat

SEQ ID NO: 53627 - DNA, 28 bp, Artificial Sequence
  Synthetic
ggtgttgatttugaaatccattggtuca

SEQ ID NO: 53628 - DNA, 27 bp, Artificial Sequence
  Synthetic
attacctgagacccuctgttcatauca

SEQ ID NO: 53629 - DNA, 24 bp, Artificial Sequence
  Synthetic
cugcaacauggaaacaggagaaac

SEQ ID NO: 53630 - DNA, 26 bp, Artificial Sequence
  Synthetic
agacaccutttaaaacugaagccagt

SEQ ID NO: 53631 - DNA, 28 bp, Artificial Sequence
  Synthetic
cctaaactcaaagcucttgttccatuaa

SEQ ID NO: 53632 - DNA, 22 bp, Artificial Sequence
  Synthetic
agccctctcucctgctgaatua

SEQ ID NO: 53633 - DNA, 28 bp, Artificial Sequence
  Synthetic
ggttcttaugcctttgaggatugaaaaa

SEQ ID NO: 53634 - DNA, 23 bp, Artificial Sequence
  Synthetic
gaaactacttacugccggtccug

SEQ ID NO: 53635 - DNA, 28 bp, Artificial Sequence
  Synthetic
atggtcatcaatugacaacatccattug

SEQ ID NO: 53636 - DNA, 21 bp, Artificial Sequence
  Synthetic
ggctatgucaccaccaaugga

SEQ ID NO: 53637 - DNA, 28 bp, Artificial Sequence
  Synthetic
cttacacattggugaaatcacattucct

SEQ ID NO: 53638 - DNA, 28 bp, Artificial Sequence
  Synthetic
aactataatatucaccaactgccagtut

SEQ ID NO: 53639 - DNA, 28 bp, Artificial Sequence
  Synthetic
ctttagttggccaugttagaggaagaut

SEQ ID NO: 53640 - DNA, 22 bp, Artificial Sequence
  Synthetic
tgtgtagcaautcctgctcugt

SEQ ID NO: 53641 - DNA, 28 bp, Artificial Sequence
  Synthetic
ttgtgtgatcuacggcaaaaaggttaua

SEQ ID NO: 53642 - DNA, 21 bp, Artificial Sequence
  Synthetic
gggctagugacaaggaugaga

SEQ ID NO: 53643 - DNA, 19 bp, Artificial Sequence
  Synthetic
tgggcaaucgggctctcua

SEQ ID NO: 53644 - DNA, 20 bp, Artificial Sequence
  Synthetic
gagctgcuggacttcucact

SEQ ID NO: 53645 - DNA, 19 bp, Artificial Sequence
  Synthetic
gaagcgcaccutctcgaug

SEQ ID NO: 53646 - DNA, 26 bp, Artificial Sequence
  Synthetic
ggagggttctuaactcttaggaggut

SEQ ID NO: 53647 - DNA, 23 bp, Artificial Sequence
  Synthetic
cctttttctuccccagacuccag

SEQ ID NO: 53648 - DNA, 23 bp, Artificial Sequence
  Synthetic
ccagagaaaucgcctggaagtua

SEQ ID NO: 53649 - DNA, 18 bp, Artificial Sequence
  Synthetic
caaccgccgugcaagaug

SEQ ID NO: 53650 - DNA, 19 bp, Artificial Sequence
  Synthetic
aggttguccggagccuagt

SEQ ID NO: 53651 - DNA, 28 bp, Artificial Sequence
  Synthetic
caaaagctgagaugaaacagtgtaagut

SEQ ID NO: 53652 - DNA, 22 bp, Artificial Sequence
  Synthetic
gccaucttuacgaaccaaccca

SEQ ID NO: 53653 - DNA, 25 bp, Artificial Sequence
  Synthetic
ccccattagcucagctgttttctut

SEQ ID NO: 53654 - DNA, 21 bp, Artificial Sequence
  Synthetic
ggtgctgaccaugtggacaut

SEQ ID NO: 53655 - DNA, 27 bp, Artificial Sequence
  Synthetic
tgccaatcauggaattttctttcucct

SEQ ID NO: 53656 - DNA, 25 bp, Artificial Sequence
  Synthetic
tctagaauccagacctgtcagucaa

SEQ ID NO: 53657 - DNA, 26 bp, Artificial Sequence
  Synthetic
caccaaagtaccuactatgtgtgugg

SEQ ID NO: 53658 - DNA, 21 bp, Artificial Sequence
  Synthetic
ctgaccaucacgaggcugaat

SEQ ID NO: 53659 - DNA, 22 bp, Artificial Sequence
  Synthetic
gagaaacucaggtuccgaggag

SEQ ID NO: 53660 - DNA, 19 bp, Artificial Sequence
  Synthetic
cuccacgtgugccaacaac

SEQ ID NO: 53661 - DNA, 24 bp, Artificial Sequence
  Synthetic
aaagatcttgacugccactgtcuc

SEQ ID NO: 53662 - DNA, 24 bp, Artificial Sequence
  Synthetic
ccccaccagutcattcacagaauc

SEQ ID NO: 53663 - DNA, 28 bp, Artificial Sequence
  Synthetic
gcagatgaaagugtgaggaaatgaaaut

SEQ ID NO: 53664 - DNA, 22 bp, Artificial Sequence
  Synthetic
cacctcgatuggaaacgggaua

SEQ ID NO: 53665 - DNA, 23 bp, Artificial Sequence
  Synthetic
gagaaggccgutctccattacut

SEQ ID NO: 53666 - DNA, 22 bp, Artificial Sequence
  Synthetic
gcctgggacucatggaaaugat

SEQ ID NO: 53667 - DNA, 22 bp, Artificial Sequence
  Synthetic
caggaguctcaagugaggaagg

SEQ ID NO: 53668 - DNA, 24 bp, Artificial Sequence
  Synthetic
cagcaaagaugaacacgatgaugg

SEQ ID NO: 53669 - DNA, 22 bp, Artificial Sequence
  Synthetic
ttucaggcaggagcuagagaga

SEQ ID NO: 53670 - DNA, 23 bp, Artificial Sequence
  Synthetic
ccacccucaaaagatccttcugt

SEQ ID NO: 53671 - DNA, 24 bp, Artificial Sequence
  Synthetic
caccatcacuatgtgcatcguact

SEQ ID NO: 53672 - DNA, 22 bp, Artificial Sequence
  Synthetic
caggtucaccagguagaaggac

SEQ ID NO: 53673 - DNA, 22 bp, Artificial Sequence
  Synthetic
tctaccctccuccctaggcuat

SEQ ID NO: 53674 - DNA, 19 bp, Artificial Sequence
  Synthetic
gactgucccggtacugcac

SEQ ID NO: 53675 - DNA, 22 bp, Artificial Sequence
  Synthetic
gccttgtgucgtccacttagut

SEQ ID NO: 53676 - DNA, 24 bp, Artificial Sequence
  Synthetic
ttcatgaacuccaggaactctgug

SEQ ID NO: 53677 - DNA, 22 bp, Artificial Sequence
  Synthetic
catcgaccuggatgagcugaag

SEQ ID NO: 53678 - DNA, 28 bp, Artificial Sequence
  Synthetic
tttagcttatcaaaugctgagtagccut

SEQ ID NO: 53679 - DNA, 26 bp, Artificial Sequence
  Synthetic
ctcggctaauaacacatcaaatcgut

SEQ ID NO: 53680 - DNA, 25 bp, Artificial Sequence
  Synthetic
tcagagtgautgctttgatguggat

SEQ ID NO: 53681 - DNA, 23 bp, Artificial Sequence
  Synthetic
ccagatagcugactccacatugt

SEQ ID NO: 53682 - DNA, 21 bp, Artificial Sequence
  Synthetic
cutccagggatucaggcaaga

SEQ ID NO: 53683 - DNA, 24 bp, Artificial Sequence
  Synthetic
cctgtttcautccagatgcuccag

SEQ ID NO: 53684 - DNA, 19 bp, Artificial Sequence
  Synthetic
catucagggtcucggcact

SEQ ID NO: 53685 - DNA, 20 bp, Artificial Sequence
  Synthetic
cccccagcaggucgatttuc

SEQ ID NO: 53686 - DNA, 20 bp, Artificial Sequence
  Synthetic
ccgtccacuggtcgauacct

SEQ ID NO: 53687 - DNA, 22 bp, Artificial Sequence
  Synthetic
accaagtuaccccattgccauc

SEQ ID NO: 53688 - DNA, 20 bp, Artificial Sequence
  Synthetic
ccatggcagutctccaugct

SEQ ID NO: 53689 - DNA, 24 bp, Artificial Sequence
  Synthetic
gaagacgaaguatccaugcagaga

SEQ ID NO: 53690 - DNA, 23 bp, Artificial Sequence
  Synthetic
aggagatcuagagctcugacgac

SEQ ID NO: 53691 - DNA, 28 bp, Artificial Sequence
  Synthetic
atactttcaacagguaatacagcaccut

SEQ ID NO: 53692 - DNA, 28 bp, Artificial Sequence
  Synthetic
actgtttcattucacgaagtttgatguc

SEQ ID NO: 53693 - DNA, 27 bp, Artificial Sequence
  Synthetic
acatttttgaagucccaaatcctccut

SEQ ID NO: 53694 - DNA, 28 bp, Artificial Sequence
  Synthetic
gtttacgaucagccacagaaattcttut

SEQ ID NO: 53695 - DNA, 27 bp, Artificial Sequence
  Synthetic
cctaggaautagcaaggauaaagcagg

SEQ ID NO: 53696 - DNA, 27 bp, Artificial Sequence
  Synthetic
actatgagaugttccatgacuacacga

SEQ ID NO: 53697 - DNA, 26 bp, Artificial Sequence
  Synthetic
ttacagttgucaaagctgaaggauga

SEQ ID NO: 53698 - DNA, 29 bp, Artificial Sequence
  Synthetic
cttagatgtttgcuctgagtaactttugg

SEQ ID NO: 53699 - DNA, 22 bp, Artificial Sequence
  Synthetic
cgggcguaaacaccttcaatut

SEQ ID NO: 53700 - DNA, 22 bp, Artificial Sequence
  Synthetic
gactacauctcccuccacagga

SEQ ID NO: 53701 - DNA, 17 bp, Artificial Sequence
  Synthetic
gggtguccgcgaactug

SEQ ID NO: 53702 - DNA, 20 bp, Artificial Sequence
  Synthetic
caacgcccaugtcttugcag

SEQ ID NO: 53703 - DNA, 24 bp, Artificial Sequence
  Synthetic
actttctgtuacctgtcgctugag

SEQ ID NO: 53704 - DNA, 20 bp, Artificial Sequence
  Synthetic
cgccttucgagcagtacucc

SEQ ID NO: 53705 - DNA, 21 bp, Artificial Sequence
  Synthetic
gctagggaccccucacatugt

SEQ ID NO: 53706 - DNA, 21 bp, Artificial Sequence
  Synthetic
ctccctgcucttccattuggt

SEQ ID NO: 53707 - DNA, 23 bp, Artificial Sequence
  Synthetic
tgaagtaguagacgcagcgttug

SEQ ID NO: 53708 - DNA, 19 bp, Artificial Sequence
  Synthetic
ccgaaggaugagcgauccc

SEQ ID NO: 53709 - DNA, 23 bp, Artificial Sequence
  Synthetic
gacagguggaaggacttgagtut

SEQ ID NO: 53710 - DNA, 26 bp, Artificial Sequence
  Synthetic
tcccttttgccautcatgagattuct

SEQ ID NO: 53711 - DNA, 26 bp, Artificial Sequence
  Synthetic
tcaaaacttucccattagugcaagga

SEQ ID NO: 53712 - DNA, 25 bp, Artificial Sequence
  Synthetic
ggcagguacagatacttcaaucact

SEQ ID NO: 53713 - DNA, 27 bp, Artificial Sequence
  Synthetic
agtgtgtgcugtctttttgattttuct

SEQ ID NO: 53714 - DNA, 24 bp, Artificial Sequence
  Synthetic
gggtucctagagatuccaagaaga

SEQ ID NO: 53715 - DNA, 25 bp, Artificial Sequence
  Synthetic
catatgttguagaagcagcuggaca

SEQ ID NO: 53716 - DNA, 20 bp, Artificial Sequence
  Synthetic
ctgttgagtguggcctccua

SEQ ID NO: 53717 - DNA, 28 bp, Artificial Sequence
  Synthetic
gaacatgacaggugtcatagaagatuga

SEQ ID NO: 53718 - DNA, 20 bp, Artificial Sequence
  Synthetic
ccctucagaagcgaguggaa

SEQ ID NO: 53719 - DNA, 25 bp, Artificial Sequence
  Synthetic
tutcagttttugcggaagaggaaag

SEQ ID NO: 53720 - DNA, 23 bp, Artificial Sequence
  Synthetic
tgtgcagaggaggaugatucaga

SEQ ID NO: 53721 - DNA, 25 bp, Artificial Sequence
  Synthetic
cctgtatgutttggttcauccacat

SEQ ID NO: 53722 - DNA, 27 bp, Artificial Sequence
  Synthetic
agacactccaaaugagttcttcacaut

SEQ ID NO: 53723 - DNA, 28 bp, Artificial Sequence
  Synthetic
gctgtgcuatattaatgcuacgaaggat

SEQ ID NO: 53724 - DNA, 27 bp, Artificial Sequence
  Synthetic
agtaaaatggtcuggttcttcccttut

SEQ ID NO: 53725 - DNA, 26 bp, Artificial Sequence
  Synthetic
gctctaacacacuttcctgaaugaga

SEQ ID NO: 53726 - DNA, 27 bp, Artificial Sequence
  Synthetic
agtgcacagauatagaattcagctugg

SEQ ID NO: 53727 - DNA, 22 bp, Artificial Sequence
  Synthetic
cacatgcaaccutgctcttugt

SEQ ID NO: 53728 - DNA, 25 bp, Artificial Sequence
  Synthetic
gacattaaagcaaugcagaauggga

SEQ ID NO: 53729 - DNA, 28 bp, Artificial Sequence
  Synthetic
gttggatggcuttagactctacatuacc

SEQ ID NO: 53730 - DNA, 22 bp, Artificial Sequence
  Synthetic
gcctucaagcatcccugaaaga

SEQ ID NO: 53731 - DNA, 19 bp, Artificial Sequence
  Synthetic
tgagucggguccgacagaa

SEQ ID NO: 53732 - DNA, 27 bp, Artificial Sequence
  Synthetic
gcttcatgtcuccccttaaaataugct

SEQ ID NO: 53733 - DNA, 23 bp, Artificial Sequence
  Synthetic
agatggaaaugtcctctgcucac

SEQ ID NO: 53734 - DNA, 28 bp, Artificial Sequence
  Synthetic
acgtctatcaaugtattgagtagcucca

SEQ ID NO: 53735 - DNA, 28 bp, Artificial Sequence
  Synthetic
tcacagctgtugatcacattgtattuct

SEQ ID NO: 53736 - DNA, 21 bp, Artificial Sequence
  Synthetic
actggccaugtatuccagcag

SEQ ID NO: 53737 - DNA, 22 bp, Artificial Sequence
  Synthetic
cgtcttgguccagtgatgtcua

SEQ ID NO: 53738 - DNA, 26 bp, Artificial Sequence
  Synthetic
gacaaacattugctgagcacauacaa

SEQ ID NO: 53739 - DNA, 28 bp, Artificial Sequence
  Synthetic
cttagcacaautatcaacuccaccaaaa

SEQ ID NO: 53740 - DNA, 29 bp, Artificial Sequence
  Synthetic
agttcattttcucccatttcaacaucaga

SEQ ID NO: 53741 - DNA, 22 bp, Artificial Sequence
  Synthetic
ggagcagugaactgttguccaa

SEQ ID NO: 53742 - DNA, 22 bp, Artificial Sequence
  Synthetic
gtacugtgcttgtugaccacct

SEQ ID NO: 53743 - DNA, 20 bp, Artificial Sequence
  Synthetic
agacguttgctgucggacat

SEQ ID NO: 53744 - DNA, 25 bp, Artificial Sequence
  Synthetic
actttcucagaattccaugcacagt

SEQ ID NO: 53745 - DNA, 27 bp, Artificial Sequence
  Synthetic
accagcauattcaccauacaagacaat

SEQ ID NO: 53746 - DNA, 24 bp, Artificial Sequence
  Synthetic
cuagggtucgaagaccagaaacat

SEQ ID NO: 53747 - DNA, 25 bp, Artificial Sequence
  Synthetic
aggtcutgatttttgtuccccagaa

SEQ ID NO: 53748 - DNA, 27 bp, Artificial Sequence
  Synthetic
atttgccttugaacagatgtggtagua

SEQ ID NO: 53749 - DNA, 28 bp, Artificial Sequence
  Synthetic
catctgtgaaucagagtacatcctcaut

SEQ ID NO: 53750 - DNA, 25 bp, Artificial Sequence
  Synthetic
aaatgtcaaugtttgctuggcagat

SEQ ID NO: 53751 - DNA, 26 bp, Artificial Sequence
  Synthetic
gctctttacccutgctagaatacugg

SEQ ID NO: 53752 - DNA, 26 bp, Artificial Sequence
  Synthetic
aacatgttucaggctaaagcauaaca

SEQ ID NO: 53753 - DNA, 27 bp, Artificial Sequence
  Synthetic
ggttatcaggagucaaaagaacacuca

SEQ ID NO: 53754 - DNA, 23 bp, Artificial Sequence
  Synthetic
ggcgucaagggatuaaaagcaat

SEQ ID NO: 53755 - DNA, 26 bp, Artificial Sequence
  Synthetic
gcaatttgtggucgatctttgtacut

SEQ ID NO: 53756 - DNA, 27 bp, Artificial Sequence
  Synthetic
cutacaaacagataugaccagaaggca

SEQ ID NO: 53757 - DNA, 28 bp, Artificial Sequence
  Synthetic
gctcttcgcugttttatcactuagaaac

SEQ ID NO: 53758 - DNA, 22 bp, Artificial Sequence
  Synthetic
cggcagaaugaaggucaaggag

SEQ ID NO: 53759 - DNA, 27 bp, Artificial Sequence
  Synthetic
acattggtacugaatgcttcuggaaat

SEQ ID NO: 53760 - DNA, 28 bp, Artificial Sequence
  Synthetic
ccgcaaaaggaacauggagaaaaauaaa

SEQ ID NO: 53761 - DNA, 26 bp, Artificial Sequence
  Synthetic
gtattacctgugggagatctuccaga

SEQ ID NO: 53762 - DNA, 22 bp, Artificial Sequence
  Synthetic
ctccccatcugtgccattguaa

SEQ ID NO: 53763 - DNA, 20 bp, Artificial Sequence
  Synthetic
gggacttcugaggtgtggug

SEQ ID NO: 53764 - DNA, 18 bp, Artificial Sequence
  Synthetic
cgccguaacccggauagg

SEQ ID NO: 53765 - DNA, 18 bp, Artificial Sequence
  Synthetic
cggcgcuacaagugcaag

SEQ ID NO: 53766 - DNA, 24 bp, Artificial Sequence
  Synthetic
ttaggtgaggaugtcagtgacuct

SEQ ID NO: 53767 - DNA, 23 bp, Artificial Sequence
  Synthetic
caggtttugagcagtcaucaacc

SEQ ID NO: 53768 - DNA, 25 bp, Artificial Sequence
  Synthetic
gaatgaggcucagagagggtagtua

SEQ ID NO: 53769 - DNA, 26 bp, Artificial Sequence
  Synthetic
tccccacaacuaaaacactcatctuc

SEQ ID NO: 53770 - DNA, 27 bp, Artificial Sequence
  Synthetic
cttcacagacuaattatgtcacuggca

SEQ ID NO: 53771 - DNA, 24 bp, Artificial Sequence
  Synthetic
tgggccacugttataagcttucaa

SEQ ID NO: 53772 - DNA, 22 bp, Artificial Sequence
  Synthetic
caggttaugggaccuggagaaa

SEQ ID NO: 53773 - DNA, 28 bp, Artificial Sequence
  Synthetic
acccaattaatcucaaaacagctaugga

SEQ ID NO: 53774 - DNA, 25 bp, Artificial Sequence
  Synthetic
aactgtggaacugtagctgttagug

SEQ ID NO: 53775 - DNA, 27 bp, Artificial Sequence
  Synthetic
gggcaggtttuaagagatatgtgauga

SEQ ID NO: 53776 - DNA, 22 bp, Artificial Sequence
  Synthetic
tccctaaaugcaggccacttut

SEQ ID NO: 53777 - DNA, 20 bp, Artificial Sequence
  Synthetic
gttccucacccgtacgaguc

SEQ ID NO: 53778 - DNA, 22 bp, Artificial Sequence
  Synthetic
ctccccucctactacacauggt

SEQ ID NO: 53779 - DNA, 25 bp, Artificial Sequence
  Synthetic
gccacatcuggcttgaaattcuact

SEQ ID NO: 53780 - DNA, 22 bp, Artificial Sequence
  Synthetic
acatcaccaugaagtggcugaa

SEQ ID NO: 53781 - DNA, 21 bp, Artificial Sequence
  Synthetic
gctcctggcuctcatcaguca

SEQ ID NO: 53782 - DNA, 19 bp, Artificial Sequence
  Synthetic
gttcagugcacgcaacugt

SEQ ID NO: 53783 - DNA, 19 bp, Artificial Sequence
  Synthetic
ccagaaacuccagguggga

SEQ ID NO: 53784 - DNA, 22 bp, Artificial Sequence
  Synthetic
ccatggcucctgtucacagaat

SEQ ID NO: 53785 - DNA, 21 bp, Artificial Sequence
  Synthetic
gtgtgtgtguagagggctucc

SEQ ID NO: 53786 - DNA, 21 bp, Artificial Sequence
  Synthetic
ggagatgttugtgcacccuga

SEQ ID NO: 53787 - DNA, 22 bp, Artificial Sequence
  Synthetic
atgcaggaagaugaggccauac

SEQ ID NO: 53788 - DNA, 24 bp, Artificial Sequence
  Synthetic
cacatttagagcauggagcugagt

SEQ ID NO: 53789 - DNA, 21 bp, Artificial Sequence
  Synthetic
ctgcucacacccatcttgugt

SEQ ID NO: 53790 - DNA, 21 bp, Artificial Sequence
  Synthetic
gggaatcugggaagcgtugat

SEQ ID NO: 53791 - DNA, 26 bp, Artificial Sequence
  Synthetic
cgcctctgatutttaacctttgacuc

SEQ ID NO: 53792 - DNA, 22 bp, Artificial Sequence
  Synthetic
gggtctcaaggguttcacagut

SEQ ID NO: 53793 - DNA, 23 bp, Artificial Sequence
  Synthetic
gcutcctgtaugaagaccagact

SEQ ID NO: 53794 - DNA, 20 bp, Artificial Sequence
  Synthetic
accctcuaggctcccaaguc

SEQ ID NO: 53795 - DNA, 22 bp, Artificial Sequence
  Synthetic
aggagtucacagccttgttucc

SEQ ID NO: 53796 - DNA, 23 bp, Artificial Sequence
  Synthetic
ccacgtttctuggagtgcacuat

SEQ ID NO: 53797 - DNA, 21 bp, Artificial Sequence
  Synthetic
ccgaggaaucugagagcgaga

SEQ ID NO: 53798 - DNA, 23 bp, Artificial Sequence
  Synthetic
ggccaaaaucccaaggaagagut

SEQ ID NO: 53799 - DNA, 20 bp, Artificial Sequence
  Synthetic
acaagaugcggagtcgtugg

SEQ ID NO: 53800 - DNA, 20 bp, Artificial Sequence
  Synthetic
gctacagcuttggccatucc

SEQ ID NO: 53801 - DNA, 33 bp, Artificial Sequence
  Synthetic
acacacaaattctaautaatgactttgatgtut

SEQ ID NO: 53802 - DNA, 26 bp, Artificial Sequence
  Synthetic
gtttaggguttgaagaatugccaagt

SEQ ID NO: 53803 - DNA, 25 bp, Artificial Sequence
  Synthetic
ggaattaugcacccaauaacagcag

SEQ ID NO: 53804 - DNA, 23 bp, Artificial Sequence
  Synthetic
acaaacagtcuccccctacauga

SEQ ID NO: 53805 - DNA, 25 bp, Artificial Sequence
  Synthetic
ggtccccagcuagtgattttugaaa

SEQ ID NO: 53806 - DNA, 19 bp, Artificial Sequence
  Synthetic
gcacttaggguggcccaut

SEQ ID NO: 53807 - DNA, 28 bp, Artificial Sequence
  Synthetic
gttccatgacagaauttaccagaaaugt

SEQ ID NO: 53808 - DNA, 26 bp, Artificial Sequence
  Synthetic
gggaatgtgagugagaatatgugagt

SEQ ID NO: 53809 - DNA, 28 bp, Artificial Sequence
  Synthetic
aacccagacgutaatactttgtttcuga

SEQ ID NO: 53810 - DNA, 29 bp, Artificial Sequence
  Synthetic
gagtaagccagucaaatagaugagaaaga

SEQ ID NO: 53811 - DNA, 27 bp, Artificial Sequence
  Synthetic
tttaattcgcttuaggcattccatgug

SEQ ID NO: 53812 - DNA, 26 bp, Artificial Sequence
  Synthetic
acagctgtttcutgtttgtgctagua

SEQ ID NO: 53813 - DNA, 23 bp, Artificial Sequence
  Synthetic
tgtcattccaaugtgactgucca

SEQ ID NO: 53814 - DNA, 20 bp, Artificial Sequence
  Synthetic
cagccccuggaatgcttcua

SEQ ID NO: 53815 - DNA, 23 bp, Artificial Sequence
  Synthetic
agcagccacacuaggtttcttut

SEQ ID NO: 53816 - DNA, 28 bp, Artificial Sequence
  Synthetic
tgctttuaccacacaacttttucaaact

SEQ ID NO: 53817 - DNA, 28 bp, Artificial Sequence
  Synthetic
ggagaattacctguttaactcccatcut

SEQ ID NO: 53818 - DNA, 28 bp, Artificial Sequence
  Synthetic
cataaatccaggugtgcataaacatguc

SEQ ID NO: 53819 - DNA, 28 bp, Artificial Sequence
  Synthetic
gctttgtaatttugttgaacaggauggt

SEQ ID NO: 53820 - DNA, 26 bp, Artificial Sequence
  Synthetic
aagttagauagtccccuacccacaat

SEQ ID NO: 53821 - DNA, 26 bp, Artificial Sequence
  Synthetic
cagaaacaacucaacatgcttagcut

SEQ ID NO: 53822 - DNA, 26 bp, Artificial Sequence
  Synthetic
aaagtcactctugtttacccttgugt

SEQ ID NO: 53823 - DNA, 27 bp, Artificial Sequence
  Synthetic
atggtttcatgcauaaactgcctttut

SEQ ID NO: 53824 - DNA, 22 bp, Artificial Sequence
  Synthetic
gcactactugcctgatcaucca

SEQ ID NO: 53825 - DNA, 28 bp, Artificial Sequence
  Synthetic
tctgtctgtctutctttctctttgtucc

SEQ ID NO: 53826 - DNA, 27 bp, Artificial Sequence
  Synthetic
ctggaatgaaatucatctgccatgtut

SEQ ID NO: 53827 - DNA, 19 bp, Artificial Sequence
  Synthetic
cttggccgugtaggaccug

SEQ ID NO: 53828 - DNA, 27 bp, Artificial Sequence
  Synthetic
gcacctactuggagatggtaagatuct

SEQ ID NO: 53829 - DNA, 29 bp, Artificial Sequence
  Synthetic
aagaagtcagaaaagucaaagaaaaaugc

SEQ ID NO: 53830 - DNA, 24 bp, Artificial Sequence
  Synthetic
gacaacattuaagtgtggccaugt

SEQ ID NO: 53831 - DNA, 24 bp, Artificial Sequence
  Synthetic
cgattaataugcgtgtctguggga

SEQ ID NO: 53832 - DNA, 25 bp, Artificial Sequence
  Synthetic
cttgaacttccguagaatgctgcua

SEQ ID NO: 53833 - DNA, 27 bp, Artificial Sequence
  Synthetic
tctgtcaaatuccagagttttggacut

SEQ ID NO: 53834 - DNA, 24 bp, Artificial Sequence
  Synthetic
gggttttcttugctcagtacatug

SEQ ID NO: 53835 - DNA, 22 bp, Artificial Sequence
  Synthetic
gctgtcagcugctcgtcaauag

SEQ ID NO: 53836 - DNA, 26 bp, Artificial Sequence
  Synthetic
actgtgttataucttgggagcuaggt

SEQ ID NO: 53837 - DNA, 24 bp, Artificial Sequence
  Synthetic
gaccaaggauactgaccccaauag

SEQ ID NO: 53838 - DNA, 27 bp, Artificial Sequence
  Synthetic
cttggcatgauggtctatgtatucaac

SEQ ID NO: 53839 - DNA, 27 bp, Artificial Sequence
  Synthetic
aagtgaggcacucagaattuaacagaa

SEQ ID NO: 53840 - DNA, 21 bp, Artificial Sequence
  Synthetic
ctcccagacagutctcgtuca

SEQ ID NO: 53841 - DNA, 26 bp, Artificial Sequence
  Synthetic
gtgtcaccuacaaagactgttttucc

SEQ ID NO: 53842 - DNA, 28 bp, Artificial Sequence
  Synthetic
taaacaccatctauggccaaatcttuag

SEQ ID NO: 53843 - DNA, 26 bp, Artificial Sequence
  Synthetic
caagaggcauaacatagagcagucaa

SEQ ID NO: 53844 - DNA, 28 bp, Artificial Sequence
  Synthetic
agtctgtttaacaaautcctcacctgut

SEQ ID NO: 53845 - DNA, 25 bp, Artificial Sequence
  Synthetic
ttctggaacacutcagtctgaaugg

SEQ ID NO: 53846 - DNA, 23 bp, Artificial Sequence
  Synthetic
gggaagagguttgtccattuacc

SEQ ID NO: 53847 - DNA, 26 bp, Artificial Sequence
  Synthetic
gactttctcagcugttgcttttucaa

SEQ ID NO: 53848 - DNA, 28 bp, Artificial Sequence
  Synthetic
gtaatcatuttagaaaagcucgagcaca

SEQ ID NO: 53849 - DNA, 25 bp, Artificial Sequence
  Synthetic
gggcctcgtugatttttctttcaut

SEQ ID NO: 53850 - DNA, 23 bp, Artificial Sequence
  Synthetic
gaagccacagagautacagggut

SEQ ID NO: 53851 - DNA, 26 bp, Artificial Sequence
  Synthetic
gtgagatgacuctgacttcattguct

SEQ ID NO: 53852 - DNA, 25 bp, Artificial Sequence
  Synthetic
tttgctuccaagaatgugagaggat

SEQ ID NO: 53853 - DNA, 25 bp, Artificial Sequence
  Synthetic
tgtcataactcaaugcaaactgcug

SEQ ID NO: 53854 - DNA, 28 bp, Artificial Sequence
  Synthetic
ccagtttaagtgutagttcttggtgugt

SEQ ID NO: 53855 - DNA, 28 bp, Artificial Sequence
  Synthetic
gcttgtctucaaactgttgttaauccaa

SEQ ID NO: 53856 - DNA, 25 bp, Artificial Sequence
  Synthetic
tgttggcauggttataaaccucagt

SEQ ID NO: 53857 - DNA, 28 bp, Artificial Sequence
  Synthetic
ggtcgaagtaaugccaatgtcttttcua

SEQ ID NO: 53858 - DNA, 25 bp, Artificial Sequence
  Synthetic
ttgtctgcccagutagaatgatcug

SEQ ID NO: 53859 - DNA, 19 bp, Artificial Sequence
  Synthetic
ccaaaggugccggtcguag

SEQ ID NO: 53860 - DNA, 21 bp, Artificial Sequence
  Synthetic
gcagggcugaugaggaaaact

SEQ ID NO: 53861 - DNA, 21 bp, Artificial Sequence
  Synthetic
tccucaaggtugggacaacac

SEQ ID NO: 53862 - DNA, 18 bp, Artificial Sequence
  Synthetic
ggctctcuaggccgugga

SEQ ID NO: 53863 - DNA, 17 bp, Artificial Sequence
  Synthetic
ccucccaccccgtgcua

SEQ ID NO: 53864 - DNA, 25 bp, Artificial Sequence
  Synthetic
ccagcucactgctaattuacaacaa

SEQ ID NO: 53865 - DNA, 33 bp, Artificial Sequence
  Synthetic
gcattagtaatactuacttgctgaaattgaauc

SEQ ID NO: 53866 - DNA, 21 bp, Artificial Sequence
  Synthetic
gggacagucgaagaactucag

SEQ ID NO: 53867 - DNA, 24 bp, Artificial Sequence
  Synthetic
catttctcccutatgccgtgttut

SEQ ID NO: 53868 - DNA, 28 bp, Artificial Sequence
  Synthetic
cagtcatgtgauactcaagtaagctcut

SEQ ID NO: 53869 - DNA, 28 bp, Artificial Sequence
  Synthetic
agatggtaagtgauccaaaatcaacugt

SEQ ID NO: 53870 - DNA, 25 bp, Artificial Sequence
  Synthetic
cagagaacaatguaccctggaagut

SEQ ID NO: 53871 - DNA, 32 bp, Artificial Sequence
  Synthetic
aaggcattatccucatatttattatgctuact

SEQ ID NO: 53872 - DNA, 27 bp, Artificial Sequence
  Synthetic
tctttgttuagcttgaacaugcgaaag

SEQ ID NO: 53873 - DNA, 27 bp, Artificial Sequence
  Synthetic
tctacccttagtugtcaatggcaaaut

SEQ ID NO: 53874 - DNA, 28 bp, Artificial Sequence
  Synthetic
gggtcagatataucagcattaacctuga

SEQ ID NO: 53875 - DNA, 29 bp, Artificial Sequence
  Synthetic
tctgtagttcuagcagcttcttttcttut

SEQ ID NO: 53876 - DNA, 28 bp, Artificial Sequence
  Synthetic
ctgtcattcagacaacuactgagctaut

SEQ ID NO: 53877 - DNA, 28 bp, Artificial Sequence
  Synthetic
ctcttcttgaaguttttcagcctttuct

SEQ ID NO: 53878 - DNA, 25 bp, Artificial Sequence
  Synthetic
gggtcagggaauttatctuacacac

SEQ ID NO: 53879 - DNA, 28 bp, Artificial Sequence
  Synthetic
tctctcttcagaaaugatcccaccauat

SEQ ID NO: 53880 - DNA, 25 bp, Artificial Sequence
  Synthetic
gtcgaaactuagagcttcagguact

SEQ ID NO: 53881 - DNA, 24 bp, Artificial Sequence
  Synthetic
cgactgtgttuttcctctagcugt

SEQ ID NO: 53882 - DNA, 27 bp, Artificial Sequence
  Synthetic
ggcattgttcaautcttcaagtccaut

SEQ ID NO: 53883 - DNA, 24 bp, Artificial Sequence
  Synthetic
gcccagcttuactgtgacataugg

SEQ ID NO: 53884 - DNA, 20 bp, Artificial Sequence
  Synthetic
gcaggagguttcggcuaagt

SEQ ID NO: 53885 - DNA, 21 bp, Artificial Sequence
  Synthetic
tcucccccaaacaagcugaag

SEQ ID NO: 53886 - DNA, 27 bp, Artificial Sequence
  Synthetic
ctccccttttguaaaaaccaagatucc

SEQ ID NO: 53887 - DNA, 28 bp, Artificial Sequence
  Synthetic
gcctatgatguttgtgctatcuaccaat

SEQ ID NO: 53888 - DNA, 21 bp, Artificial Sequence
  Synthetic
gggttgggugaagtgtttugg

SEQ ID NO: 53889 - DNA, 28 bp, Artificial Sequence
  Synthetic
cccctttcuaggaagtaagtgauagaca

SEQ ID NO: 53890 - DNA, 23 bp, Artificial Sequence
  Synthetic
gccatggatguctctcactguaa

SEQ ID NO: 53891 - DNA, 28 bp, Artificial Sequence
  Synthetic
cttcagagtagcaucaacttcatagucc

SEQ ID NO: 53892 - DNA, 26 bp, Artificial Sequence
  Synthetic
tgactucctggtcatuagagcaaaag

SEQ ID NO: 53893 - DNA, 27 bp, Artificial Sequence
  Synthetic
caagcatugagaaaaacggtgaattut

SEQ ID NO: 53894 - DNA, 18 bp, Artificial Sequence
  Synthetic
gctgcagcuacatggugt

SEQ ID NO: 53895 - DNA, 19 bp, Artificial Sequence
  Synthetic
cccgcuccgcttctctcua

SEQ ID NO: 53896 - DNA, 23 bp, Artificial Sequence
  Synthetic
tcttgctgauttcactgcuggat

SEQ ID NO: 53897 - DNA, 28 bp, Artificial Sequence
  Synthetic
ttgtttgucaaccaaataatgcugaact

SEQ ID NO: 53898 - DNA, 24 bp, Artificial Sequence
  Synthetic
acgtttgcccaaaautgttctgut

SEQ ID NO: 53899 - DNA, 26 bp, Artificial Sequence
  Synthetic
aaaggaactgucagctaatgtgauga

SEQ ID NO: 53900 - DNA, 22 bp, Artificial Sequence
  Synthetic
ttgctgcuaacagcagagcuaa

SEQ ID NO: 53901 - DNA, 28 bp, Artificial Sequence
  Synthetic
ctcagacuaacaccaggtggtttauaat

SEQ ID NO: 53902 - DNA, 24 bp, Artificial Sequence
  Synthetic
gggaatuggaagcaaatgacauca

SEQ ID NO: 53903 - DNA, 20 bp, Artificial Sequence
  Synthetic
tctttccgaagcucggtugg

SEQ ID NO: 53904 - DNA, 27 bp, Artificial Sequence
  Synthetic
aaaataaaaccacaauggtggcaugaa

SEQ ID NO: 53905 - DNA, 28 bp, Artificial Sequence
  Synthetic
ctgccagaaaaautacuaagcaccaaat

SEQ ID NO: 53906 - DNA, 28 bp, Artificial Sequence
  Synthetic
gaagaactcuaaaacaagcatttgcuga

SEQ ID NO: 53907 - DNA, 26 bp, Artificial Sequence
  Synthetic
gttgcaattugcaggaactaucacat

SEQ ID NO: 53908 - DNA, 21 bp, Artificial Sequence
  Synthetic
gctcagccaugttctgccuaa

SEQ ID NO: 53909 - DNA, 22 bp, Artificial Sequence
  Synthetic
ggagagaugagguggcagaaga

SEQ ID NO: 53910 - DNA, 23 bp, Artificial Sequence
  Synthetic
aactttggcautgagccagttut

SEQ ID NO: 53911 - DNA, 20 bp, Artificial Sequence
  Synthetic
gggcgcuaaggtgaggaaug

SEQ ID NO: 53912 - DNA, 28 bp, Artificial Sequence
  Synthetic
acgatacgtccuatgtaattgagaguga

SEQ ID NO: 53913 - DNA, 33 bp, Artificial Sequence
  Synthetic
tgttacataattaguagcaatttcattgtggua

SEQ ID NO: 53914 - DNA, 27 bp, Artificial Sequence
  Synthetic
ccagggactuaagttaacgaacaaaut

SEQ ID NO: 53915 - DNA, 29 bp, Artificial Sequence
  Synthetic
ccagctctaccaauctcctgataatauga

SEQ ID NO: 53916 - DNA, 23 bp, Artificial Sequence
  Synthetic
ttcgaaaacugtatctucgggca

SEQ ID NO: 53917 - DNA, 23 bp, Artificial Sequence
  Synthetic
ctggccgaautttatgctttgut

SEQ ID NO: 53918 - DNA, 26 bp, Artificial Sequence
  Synthetic
caataaaatggatgutcccccagcua

SEQ ID NO: 53919 - DNA, 28 bp, Artificial Sequence
  Synthetic
gacagtggaagcuatggtcatattauca

SEQ ID NO: 53920 - DNA, 25 bp, Artificial Sequence
  Synthetic
acagtctauggccatcacatacuct

SEQ ID NO: 53921 - DNA, 26 bp, Artificial Sequence
  Synthetic
gaggaaatugatcccaagucagaact

SEQ ID NO: 53922 - DNA, 20 bp, Artificial Sequence
  Synthetic
gcgaggccaaaguctgcuat

SEQ ID NO: 53923 - DNA, 26 bp, Artificial Sequence
  Synthetic
agttctatgagacaagucggctagut

SEQ ID NO: 53924 - DNA, 24 bp, Artificial Sequence
  Synthetic
gccagaaaauaaggcccaaagcua

SEQ ID NO: 53925 - DNA, 27 bp, Artificial Sequence
  Synthetic
gtctacaagaugaagagtgguaccaag

SEQ ID NO: 53926 - DNA, 24 bp, Artificial Sequence
  Synthetic
cctcccctgutcccattactcuaa

SEQ ID NO: 53927 - DNA, 22 bp, Artificial Sequence
  Synthetic
ggacauccccagaaaagaugga

SEQ ID NO: 53928 - DNA, 21 bp, Artificial Sequence
  Synthetic
cccatgucacccaugaaagca

SEQ ID NO: 53929 - DNA, 21 bp, Artificial Sequence
  Synthetic
gtgccgaggacaugcctauaa

SEQ ID NO: 53930 - DNA, 23 bp, Artificial Sequence
  Synthetic
cccuaagatucccaaagagccaa

SEQ ID NO: 53931 - DNA, 22 bp, Artificial Sequence
  Synthetic
cctcccaccccucatttcauag

SEQ ID NO: 53932 - DNA, 28 bp, Artificial Sequence
  Synthetic
atttatttaaatcuggtccagcctguga

SEQ ID NO: 53933 - DNA, 28 bp, Artificial Sequence
  Synthetic
agaccacaccacuatgctatttucaaat

SEQ ID NO: 53934 - DNA, 21 bp, Artificial Sequence
  Synthetic
cccttucctcctguccacaat

SEQ ID NO: 53935 - DNA, 22 bp, Artificial Sequence
  Synthetic
cagtcttauccaggctctccuc

SEQ ID NO: 53936 - DNA, 29 bp, Artificial Sequence
  Synthetic
gacataacttcucattgaatgctcucaga

SEQ ID NO: 53937 - DNA, 27 bp, Artificial Sequence
  Synthetic
ggtttccttcuaaagtgttttggcuat

SEQ ID NO: 53938 - DNA, 28 bp, Artificial Sequence
  Synthetic
gcccaaattccuaaagatgaatgcatug

SEQ ID NO: 53939 - DNA, 24 bp, Artificial Sequence
  Synthetic
ccacuggcagcaaagttcttatut

SEQ ID NO: 53940 - DNA, 21 bp, Artificial Sequence
  Synthetic
gggcttcuctgtcaactuccc

SEQ ID NO: 53941 - DNA, 28 bp, Artificial Sequence
  Synthetic
gcttcattaggcuctactctccttttua

SEQ ID NO: 53942 - DNA, 20 bp, Artificial Sequence
  Synthetic
cctgcacaccugcacauact

SEQ ID NO: 53943 - DNA, 24 bp, Artificial Sequence
  Synthetic
cccaatcaucccgtcatttcacua

SEQ ID NO: 53944 - DNA, 20 bp, Artificial Sequence
  Synthetic
tcaggtcgugggtctgagut

SEQ ID NO: 53945 - DNA, 22 bp, Artificial Sequence
  Synthetic
catcaacauggaggacagguct

SEQ ID NO: 53946 - DNA, 24 bp, Artificial Sequence
  Synthetic
cgatctctatutctgctccgugat

SEQ ID NO: 53947 - DNA, 29 bp, Artificial Sequence
  Synthetic
tcauagaaagcatcaugggaagaaaagaa

SEQ ID NO: 53948 - DNA, 23 bp, Artificial Sequence
  Synthetic
atgaagtccaugccaccattcut

SEQ ID NO: 53949 - DNA, 28 bp, Artificial Sequence
  Synthetic
gcttaatucagcaagactgtugaaaaca

SEQ ID NO: 53950 - DNA, 20 bp, Artificial Sequence
  Synthetic
agcaugggcaaccaactgua

SEQ ID NO: 53951 - DNA, 28 bp, Artificial Sequence
  Synthetic
gctatacttgccaaugaaaatggttuct

SEQ ID NO: 53952 - DNA, 26 bp, Artificial Sequence
  Synthetic
tctgacaaaaacagccautagacuga

SEQ ID NO: 53953 - DNA, 24 bp, Artificial Sequence
  Synthetic
catgccauaacaaaactggcucat

SEQ ID NO: 53954 - DNA, 27 bp, Artificial Sequence
  Synthetic
gaagcatttgguaatcatgtttugggt

SEQ ID NO: 53955 - DNA, 22 bp, Artificial Sequence
  Synthetic
gcttgtcugcaaggtctucaaa

SEQ ID NO: 53956 - DNA, 23 bp, Artificial Sequence
  Synthetic
ccttctttgaggcugtgcttcut

SEQ ID NO: 53957 - DNA, 23 bp, Artificial Sequence
  Synthetic
tggagatctgugaagttgtgugg

SEQ ID NO: 53958 - DNA, 20 bp, Artificial Sequence
  Synthetic
gcutgttugcagagagccat

SEQ ID NO: 53959 - DNA, 20 bp, Artificial Sequence
  Synthetic
agcccaauctgctggauacc

SEQ ID NO: 53960 - DNA, 22 bp, Artificial Sequence
  Synthetic
ccgaactcuggagtttccugat

SEQ ID NO: 53961 - DNA, 24 bp, Artificial Sequence
  Synthetic
cagagaautcccuaaaaccagcca

SEQ ID NO: 53962 - DNA, 17 bp, Artificial Sequence
  Synthetic
cgcuccgagccgactut

SEQ ID NO: 53963 - DNA, 18 bp, Artificial Sequence
  Synthetic
gcgctcucgctacctgug

SEQ ID NO: 53964 - DNA, 23 bp, Artificial Sequence
  Synthetic
cagttgcuatgctgtucagcaaa

SEQ ID NO: 53965 - DNA, 20 bp, Artificial Sequence
  Synthetic
cttuaaaccgcaccgugcat

SEQ ID NO: 53966 - DNA, 28 bp, Artificial Sequence
  Synthetic
acttctaatccacuaggtgcaaaatcug

SEQ ID NO: 53967 - DNA, 28 bp, Artificial Sequence
  Synthetic
aaggcaagaacaucgggagaatattuat

SEQ ID NO: 53968 - DNA, 28 bp, Artificial Sequence
  Synthetic
gccgttgatatuactgtggatacuagga

SEQ ID NO: 53969 - DNA, 28 bp, Artificial Sequence
  Synthetic
gttttggattucacaggcaatgtaauca

SEQ ID NO: 53970 - DNA, 28 bp, Artificial Sequence
  Synthetic
ccauatttgttacttcugaagggcacat

SEQ ID NO: 53971 - DNA, 24 bp, Artificial Sequence
  Synthetic
cctgccgagaaaautaagtccuct

SEQ ID NO: 53972 - DNA, 19 bp, Artificial Sequence
  Synthetic
cgggtaaugcggccugaat

SEQ ID NO: 53973 - DNA, 28 bp, Artificial Sequence
  Synthetic
accccattatuaaaaggtggcttatuga

SEQ ID NO: 53974 - DNA, 22 bp, Artificial Sequence
  Synthetic
ggtgctgtucaggaaaagcaut

SEQ ID NO: 53975 - DNA, 24 bp, Artificial Sequence
  Synthetic
cgcggttuaagagcatgatcttug

SEQ ID NO: 53976 - DNA, 20 bp, Artificial Sequence
  Synthetic
tctgctctcucccttggcua

SEQ ID NO: 53977 - DNA, 21 bp, Artificial Sequence
  Synthetic
ctguccccaggagagaatugg

SEQ ID NO: 53978 - DNA, 20 bp, Artificial Sequence
  Synthetic
cagcctguacgagaacguca

SEQ ID NO: 53979 - DNA, 22 bp, Artificial Sequence
  Synthetic
cccctucctgaagaguccaaaa

SEQ ID NO: 53980 - DNA, 21 bp, Artificial Sequence
  Synthetic
cacccatctuaccctgtccut

SEQ ID NO: 53981 - DNA, 25 bp, Artificial Sequence
  Synthetic
ggctgguaggaatgagatgauagag

SEQ ID NO: 53982 - DNA, 21 bp, Artificial Sequence
  Synthetic
tgcacaacauctgtcgctcut

SEQ ID NO: 53983 - DNA, 19 bp, Artificial Sequence
  Synthetic
gggctgtuctcgctgaugg

SEQ ID NO: 53984 - DNA, 23 bp, Artificial Sequence
  Synthetic
ggccaagaagcugggttcttuaa

SEQ ID NO: 53985 - DNA, 20 bp, Artificial Sequence
  Synthetic
ggccccucacgaatgatcug

SEQ ID NO: 53986 - DNA, 20 bp, Artificial Sequence
  Synthetic
ccacaucgcaccacagaaug

SEQ ID NO: 53987 - DNA, 23 bp, Artificial Sequence
  Synthetic
gcgagaagaucttgccgauaagg

SEQ ID NO: 53988 - DNA, 22 bp, Artificial Sequence
  Synthetic
cccagcugaaagtgaggatguc

SEQ ID NO: 53989 - DNA, 26 bp, Artificial Sequence
  Synthetic
cctgctcaatuctctgcatatcugaa

SEQ ID NO: 53990 - DNA, 27 bp, Artificial Sequence
  Synthetic
ttcgctacaugactaatggcuacaaat

SEQ ID NO: 53991 - DNA, 27 bp, Artificial Sequence
  Synthetic
caattaagcaaagautgatgtgcccut

SEQ ID NO: 53992 - DNA, 28 bp, Artificial Sequence
  Synthetic
acaattgcaaagaacaaaauggtcauct

SEQ ID NO: 53993 - DNA, 27 bp, Artificial Sequence
  Synthetic
ccaaggagtcuagtgatctacaugact

SEQ ID NO: 53994 - DNA, 21 bp, Artificial Sequence
  Synthetic
ctcucccccttatcucccaca

SEQ ID NO: 53995 - DNA, 23 bp, Artificial Sequence
  Synthetic
tgacttaucacgcccaattguct

SEQ ID NO: 53996 - DNA, 24 bp, Artificial Sequence
  Synthetic
caagagugtggcuacagaagagag

SEQ ID NO: 53997 - DNA, 28 bp, Artificial Sequence
  Synthetic
tggtcaaatactcutcgatcatcaggua

SEQ ID NO: 53998 - DNA, 21 bp, Artificial Sequence
  Synthetic
gaggccaugaagagcagugaa

SEQ ID NO: 53999 - DNA, 27 bp, Artificial Sequence
  Synthetic
gcttcuggttatagaguggaagacaag

SEQ ID NO: 54000 - DNA, 25 bp, Artificial Sequence
  Synthetic
ggtacccaagugttgatauccacat

SEQ ID NO: 54001 - DNA, 28 bp, Artificial Sequence
  Synthetic
ttcacaaacagucaaacaucaacagaag

SEQ ID NO: 54002 - DNA, 19 bp, Artificial Sequence
  Synthetic
ctccaccugtcccauccac

SEQ ID NO: 54003 - DNA, 20 bp, Artificial Sequence
  Synthetic
ggaccaggcggugtucaaat

SEQ ID NO: 54004 - DNA, 21 bp, Artificial Sequence
  Synthetic
cctatgcccuctcctctccug

SEQ ID NO: 54005 - DNA, 19 bp, Artificial Sequence
  Synthetic
aggcacccccauctgagua

SEQ ID NO: 54006 - DNA, 21 bp, Artificial Sequence
  Synthetic
cttcuccagcacctttgucca

SEQ ID NO: 54007 - DNA, 22 bp, Artificial Sequence
  Synthetic
gctgcttttgutcccacgttuc

SEQ ID NO: 54008 - DNA, 22 bp, Artificial Sequence
  Synthetic
caaaggagtgcugaggttccua

SEQ ID NO: 54009 - DNA, 19 bp, Artificial Sequence
  Synthetic
cccggautcgaccuccaag

SEQ ID NO: 54010 - DNA, 23 bp, Artificial Sequence
  Synthetic
gggtgaaguttgcactttcuaca

SEQ ID NO: 54011 - DNA, 20 bp, Artificial Sequence
  Synthetic
ggttcucgcccaccatcauc

SEQ ID NO: 54012 - DNA, 20 bp, Artificial Sequence
  Synthetic
ggtggtcutggcaagtugga

SEQ ID NO: 54013 - DNA, 20 bp, Artificial Sequence
  Synthetic
gtcagctgcutgctgatcug

SEQ ID NO: 54014 - DNA, 21 bp, Artificial Sequence
  Synthetic
cactttgggutttggcacgua

SEQ ID NO: 54015 - DNA, 20 bp, Artificial Sequence
  Synthetic
gtacacacccguccagtuga

SEQ ID NO: 54016 - DNA, 29 bp, Artificial Sequence
  Synthetic
ccaagaucaaagtacactguaaaaagcaa

SEQ ID NO: 54017 - DNA, 27 bp, Artificial Sequence
  Synthetic
cugcatcatatttcucaaggaaccaat

SEQ ID NO: 54018 - DNA, 29 bp, Artificial Sequence
  Synthetic
ttttcagtggaggutaacattcaucaaga

SEQ ID NO: 54019 - DNA, 27 bp, Artificial Sequence
  Synthetic
gtccagtctttguggctaaaatgttut

SEQ ID NO: 54020 - DNA, 24 bp, Artificial Sequence
  Synthetic
gaagcacaaguattcugggcaaaa

SEQ ID NO: 54021 - DNA, 33 bp, Artificial Sequence
  Synthetic
ttaaataacagtaaaacacuaatccagccaaua

SEQ ID NO: 54022 - DNA, 24 bp, Artificial Sequence
  Synthetic
tgaagtctucatggatgttugcca

SEQ ID NO: 54023 - DNA, 24 bp, Artificial Sequence
  Synthetic
aagtagctacacugcgcgtauaag

SEQ ID NO: 54024 - DNA, 24 bp, Artificial Sequence
  Synthetic
gggacaagautcttgatacugcac

SEQ ID NO: 54025 - DNA, 24 bp, Artificial Sequence
  Synthetic
gggcaccacacuctcctatcttua

SEQ ID NO: 54026 - DNA, 21 bp, Artificial Sequence
  Synthetic
aggcctgaugtcctaggaugt

SEQ ID NO: 54027 - DNA, 23 bp, Artificial Sequence
  Synthetic
agaaatcttcccugccaccttuc

SEQ ID NO: 54028 - DNA, 24 bp, Artificial Sequence
  Synthetic
tcctaggaacgaguggaatatcuc

SEQ ID NO: 54029 - DNA, 26 bp, Artificial Sequence
  Synthetic
cgcaacacuggtaagauaaagggaaa

SEQ ID NO: 54030 - DNA, 21 bp, Artificial Sequence
  Synthetic
ctgccuctttgctguaaccca

SEQ ID NO: 54031 - DNA, 24 bp, Artificial Sequence
  Synthetic
gcgttguggagaggacauagaaac

SEQ ID NO: 54032 - DNA, 20 bp, Artificial Sequence
  Synthetic
ttgactgcutcgtcgtgugt

SEQ ID NO: 54033 - DNA, 21 bp, Artificial Sequence
  Synthetic
ccttgcccuctggaagaacut

SEQ ID NO: 54034 - DNA, 28 bp, Artificial Sequence
  Synthetic
ttgttttgtccttucttgttggttctuc

SEQ ID NO: 54035 - DNA, 20 bp, Artificial Sequence
  Synthetic
gtuagggacagacgccaugt

SEQ ID NO: 54036 - DNA, 20 bp, Artificial Sequence
  Synthetic
acgccatgugcgtcttcuaa

SEQ ID NO: 54037 - DNA, 22 bp, Artificial Sequence
  Synthetic
accagtgaaagggugctgaaug

SEQ ID NO: 54038 - DNA, 22 bp, Artificial Sequence
  Synthetic
gcctaaacatucacctcgguca

SEQ ID NO: 54039 - DNA, 18 bp, Artificial Sequence
  Synthetic
tccccgcaucctggcuat

SEQ ID NO: 54040 - DNA, 20 bp, Artificial Sequence
  Synthetic
cctgcuccaccgaggtctua

SEQ ID NO: 54041 - DNA, 22 bp, Artificial Sequence
  Synthetic
cautccccaaacugccaaacag

SEQ ID NO: 54042 - DNA, 24 bp, Artificial Sequence
  Synthetic
tctgatgcuggcctcatatgttug

SEQ ID NO: 54043 - DNA, 23 bp, Artificial Sequence
  Synthetic
tucttcauaacgaggaacagcgt

SEQ ID NO: 54044 - DNA, 24 bp, Artificial Sequence
  Synthetic
ggagccaucgcctatgaaatctuc

SEQ ID NO: 54045 - DNA, 23 bp, Artificial Sequence
  Synthetic
gagaacagagguttcuacccaca

SEQ ID NO: 54046 - DNA, 21 bp, Artificial Sequence
  Synthetic
cccgauctgtggauaaagcca

SEQ ID NO: 54047 - DNA, 22 bp, Artificial Sequence
  Synthetic
ctcacgtcaaugtccctgaugt

SEQ ID NO: 54048 - DNA, 20 bp, Artificial Sequence
  Synthetic
ggacugagaggcctcacuga

SEQ ID NO: 54049 - DNA, 22 bp, Artificial Sequence
  Synthetic
cacttgtccucaaagggcatug

SEQ ID NO: 54050 - DNA, 22 bp, Artificial Sequence
  Synthetic
aatggcaacaucatgccaacug

SEQ ID NO: 54051 - DNA, 22 bp, Artificial Sequence
  Synthetic
cccaatccugaccccttttcut

SEQ ID NO: 54052 - DNA, 22 bp, Artificial Sequence
  Synthetic
gccauagacagcagcaucaagg

SEQ ID NO: 54053 - DNA, 24 bp, Artificial Sequence
  Synthetic
cattggauaaaaggcactgctcut

SEQ ID NO: 54054 - DNA, 28 bp, Artificial Sequence
  Synthetic
gctatttcatcaugggatagttggcuaa

SEQ ID NO: 54055 - DNA, 23 bp, Artificial Sequence
  Synthetic
tgttgttgaaacucctgcagugt

SEQ ID NO: 54056 - DNA, 23 bp, Artificial Sequence
  Synthetic
agaaatcatuggcagctuccaga

SEQ ID NO: 54057 - DNA, 27 bp, Artificial Sequence
  Synthetic
ggctctactguaagtacttttccctut

SEQ ID NO: 54058 - DNA, 27 bp, Artificial Sequence
  Synthetic
ttcagagttctuacatcagctccatug

SEQ ID NO: 54059 - DNA, 28 bp, Artificial Sequence
  Synthetic
atgaaggatgacutataaccctgatgug

SEQ ID NO: 54060 - DNA, 28 bp, Artificial Sequence
  Synthetic
gcatgaaaacauaccctattgucaccaa

SEQ ID NO: 54061 - DNA, 28 bp, Artificial Sequence
  Synthetic
gtgctctuccaggagaatattacugaat

SEQ ID NO: 54062 - DNA, 28 bp, Artificial Sequence
  Synthetic
tgtttctgtaataucagtttctgcuggt

SEQ ID NO: 54063 - DNA, 21 bp, Artificial Sequence
  Synthetic
gacggcagggautctgatcut

SEQ ID NO: 54064 - DNA, 23 bp, Artificial Sequence
  Synthetic
cauaaggaaccacaggaugacga

SEQ ID NO: 54065 - DNA, 28 bp, Artificial Sequence
  Synthetic
gccactaacacaautgcctgatatttut

SEQ ID NO: 54066 - DNA, 26 bp, Artificial Sequence
  Synthetic
ttgaaaagtctuctgggaaagtucca

SEQ ID NO: 54067 - DNA, 25 bp, Artificial Sequence
  Synthetic
agaaaccttaauggaggaccccuat

SEQ ID NO: 54068 - DNA, 22 bp, Artificial Sequence
  Synthetic
caccttgugctgtctgtauggt

SEQ ID NO: 54069 - DNA, 22 bp, Artificial Sequence
  Synthetic
ctggaggacuggattgaggaug

SEQ ID NO: 54070 - DNA, 28 bp, Artificial Sequence
  Synthetic
tcagaagtaataacauccctgctaguca

SEQ ID NO: 54071 - DNA, 22 bp, Artificial Sequence
  Synthetic
ggagctgguggagtttgugaag

SEQ ID NO: 54072 - DNA, 27 bp, Artificial Sequence
  Synthetic
acctactaaaaguctaccaccagctua

SEQ ID NO: 54073 - DNA, 22 bp, Artificial Sequence
  Synthetic
caggaatgucccaagccttuga

SEQ ID NO: 54074 - DNA, 22 bp, Artificial Sequence
  Synthetic
cgtccctccutccccatactua

SEQ ID NO: 54075 - DNA, 21 bp, Artificial Sequence
  Synthetic
cagaagctccuggtactcguc

SEQ ID NO: 54076 - DNA, 21 bp, Artificial Sequence
  Synthetic
ctcagtcccuaagcccatcug

SEQ ID NO: 54077 - DNA, 25 bp, Artificial Sequence
  Synthetic
ctccctattggutctcctccagtua

SEQ ID NO: 54078 - DNA, 22 bp, Artificial Sequence
  Synthetic
ggaagtugggaagggatctgug

SEQ ID NO: 54079 - DNA, 21 bp, Artificial Sequence
  Synthetic
ccacuggaaggccatttgaug

SEQ ID NO: 54080 - DNA, 25 bp, Artificial Sequence
  Synthetic
cagactugggatgatacucaaagca

SEQ ID NO: 54081 - DNA, 23 bp, Artificial Sequence
  Synthetic
actcctaaaugacgctggcttut

SEQ ID NO: 54082 - DNA, 23 bp, Artificial Sequence
  Synthetic
ctcatcactcugatcctgcacua

SEQ ID NO: 54083 - DNA, 28 bp, Artificial Sequence
  Synthetic
tgccacttttuacttaagactgauagca

SEQ ID NO: 54084 - DNA, 25 bp, Artificial Sequence
  Synthetic
aataagggaggcucatttcttugct

SEQ ID NO: 54085 - DNA, 26 bp, Artificial Sequence
  Synthetic
gcatcgttaagcuatgaagtgaguga

SEQ ID NO: 54086 - DNA, 21 bp, Artificial Sequence
  Synthetic
agctgtgcugtgtacaguagg

SEQ ID NO: 54087 - DNA, 28 bp, Artificial Sequence
  Synthetic
tgagataggacuatagtggaggagugaa

SEQ ID NO: 54088 - DNA, 25 bp, Artificial Sequence
  Synthetic
ggaaatggguctacagagatgtugt

SEQ ID NO: 54089 - DNA, 28 bp, Artificial Sequence
  Synthetic
cttctggugaaaggcctaacataucaat

SEQ ID NO: 54090 - DNA, 22 bp, Artificial Sequence
  Synthetic
tgaaatcuggcttgctcugaca

SEQ ID NO: 54091 - DNA, 22 bp, Artificial Sequence
  Synthetic
ccccatcucttcaagagtucgt

SEQ ID NO: 54092 - DNA, 22 bp, Artificial Sequence
  Synthetic
actgacugcaaacacgtgtgua

SEQ ID NO: 54093 - DNA, 25 bp, Artificial Sequence
  Synthetic
tctgatgggaugagtgatuacagaa

SEQ ID NO: 54094 - DNA, 21 bp, Artificial Sequence
  Synthetic
agatgatgcugctgactgcuc

SEQ ID NO: 54095 - DNA, 28 bp, Artificial Sequence
  Synthetic
tgacacctgugaaagaaattgttccuat

SEQ ID NO: 54096 - DNA, 20 bp, Artificial Sequence
  Synthetic
cgaaggcutccacagucgat

SEQ ID NO: 54097 - DNA, 28 bp, Artificial Sequence
  Synthetic
caaccaagaagcugttttuacaagagaa

SEQ ID NO: 54098 - DNA, 22 bp, Artificial Sequence
  Synthetic
tctctttcaccuccccauccaa

SEQ ID NO: 54099 - DNA, 21 bp, Artificial Sequence
  Synthetic
ctcatgtcuccagcagugacc

SEQ ID NO: 54100 - DNA, 26 bp, Artificial Sequence
  Synthetic
cacaucaatcgataugcaagaaagga

SEQ ID NO: 54101 - DNA, 25 bp, Artificial Sequence
  Synthetic
actcaaacuggaaaacatugggact

SEQ ID NO: 54102 - DNA, 23 bp, Artificial Sequence
  Synthetic
ggaaaatgcaaaugtcgtgguga

SEQ ID NO: 54103 - DNA, 27 bp, Artificial Sequence
  Synthetic
atcactcgugagggtgtgtatatuaga

SEQ ID NO: 54104 - DNA, 21 bp, Artificial Sequence
  Synthetic
gugctgccucagaagaagaac

SEQ ID NO: 54105 - DNA, 24 bp, Artificial Sequence
  Synthetic
gccatacgugtcttggtuagcaaa

SEQ ID NO: 54106 - DNA, 28 bp, Artificial Sequence
  Synthetic
aagtgaaggcaguctatttuagagcaaa

SEQ ID NO: 54107 - DNA, 22 bp, Artificial Sequence
  Synthetic
agaaatacgacgaguccggtug

SEQ ID NO: 54108 - DNA, 26 bp, Artificial Sequence
  Synthetic
cagagttgtcaugatgaggaagauga

SEQ ID NO: 54109 - DNA, 26 bp, Artificial Sequence
  Synthetic
ttcagcaaatgtuaggactcaggtut

SEQ ID NO: 54110 - DNA, 26 bp, Artificial Sequence
  Synthetic
ccgtgcgatauaggtaacagaatuga

SEQ ID NO: 54111 - DNA, 26 bp, Artificial Sequence
  Synthetic
gttttggtttutagaggtgatugggt

SEQ ID NO: 54112 - DNA, 30 bp, Artificial Sequence
  Synthetic
acatttctgaaaaggaucttagctcaauct

SEQ ID NO: 54113 - DNA, 27 bp, Artificial Sequence
  Synthetic
cccaattttgtucggacatttctuaca

SEQ ID NO: 54114 - DNA, 28 bp, Artificial Sequence
  Synthetic
actgttttaccttautggtccaaggaut

SEQ ID NO: 54115 - DNA, 23 bp, Artificial Sequence
  Synthetic
tgtgctttttgugttggttgcut

SEQ ID NO: 54116 - DNA, 26 bp, Artificial Sequence
  Synthetic
tacucatgaaaatggucagagaaacc

SEQ ID NO: 54117 - DNA, 26 bp, Artificial Sequence
  Synthetic
gccttgacgauacagctaatucagaa

SEQ ID NO: 54118 - DNA, 23 bp, Artificial Sequence
  Synthetic
cgaaatgacautggacccucagt

SEQ ID NO: 54119 - DNA, 29 bp, Artificial Sequence
  Synthetic
catcagcatattuaggcaacccttttaut

SEQ ID NO: 54120 - DNA, 28 bp, Artificial Sequence
  Synthetic
gaactaagatccuttcccaatgaaaugg

SEQ ID NO: 54121 - DNA, 26 bp, Artificial Sequence
  Synthetic
tgtccatcaaagucacagagaguaga

SEQ ID NO: 54122 - DNA, 24 bp, Artificial Sequence
  Synthetic
gaatgtatuggcgacaaggcatut

SEQ ID NO: 54123 - DNA, 26 bp, Artificial Sequence
  Synthetic
tcatactgucgcaaagctttaaggua

SEQ ID NO: 54124 - DNA, 28 bp, Artificial Sequence
  Synthetic
tgctgataguagaatattgtgctuagcc

SEQ ID NO: 54125 - DNA, 28 bp, Artificial Sequence
  Synthetic
gtctctttttcccaucttcggtatugat

SEQ ID NO: 54126 - DNA, 22 bp, Artificial Sequence
  Synthetic
gggagcuacttcucagaaggga

SEQ ID NO: 54127 - DNA, 23 bp, Artificial Sequence
  Synthetic
ctctcttctcauccgcctacuct

SEQ ID NO: 54128 - DNA, 25 bp, Artificial Sequence
  Synthetic
tttcttatgucatccaacuggccaa

SEQ ID NO: 54129 - DNA, 26 bp, Artificial Sequence
  Synthetic
ggatgttgaguccactacggtttuaa

SEQ ID NO: 54130 - DNA, 33 bp, Artificial Sequence
  Synthetic
tatgatttttaggatuacttgaatcaacaguca

SEQ ID NO: 54131 - DNA, 26 bp, Artificial Sequence
  Synthetic
aggaaauagcagacagacagtaugga

SEQ ID NO: 54132 - DNA, 21 bp, Artificial Sequence
  Synthetic
gctgaacgugagaaggaugga

SEQ ID NO: 54133 - DNA, 23 bp, Artificial Sequence
  Synthetic
cctctcaautctttcctgucgct

SEQ ID NO: 54134 - DNA, 25 bp, Artificial Sequence
  Synthetic
gttactcaatucatgcagcaugcaa

SEQ ID NO: 54135 - DNA, 26 bp, Artificial Sequence
  Synthetic
tctcatgccuagctctctagcaauat

SEQ ID NO: 54136 - DNA, 33 bp, Artificial Sequence
  Synthetic
attataaacucacataggagtuaaacaaagaca

SEQ ID NO: 54137 - DNA, 20 bp, Artificial Sequence
  Synthetic
cccctctgcucatggttcuc

SEQ ID NO: 54138 - DNA, 20 bp, Artificial Sequence
  Synthetic
ctgctguaggaaggcaugct

SEQ ID NO: 54139 - DNA, 25 bp, Artificial Sequence
  Synthetic
catccctauaagaagccctacaugg

SEQ ID NO: 54140 - DNA, 28 bp, Artificial Sequence
  Synthetic
gttcccagggaggutatatucaaaagaa

SEQ ID NO: 54141 - DNA, 26 bp, Artificial Sequence
  Synthetic
tccagaatucgtttccttttauggca

SEQ ID NO: 54142 - DNA, 28 bp, Artificial Sequence
  Synthetic
catgtatggcauatgcaaagugaagaat

SEQ ID NO: 54143 - DNA, 33 bp, Artificial Sequence
  Synthetic
agatcaaatgaatuacctatgttatgttaugga

SEQ ID NO: 54144 - DNA, 26 bp, Artificial Sequence
  Synthetic
tctataacucggtcttcaugcagaga

SEQ ID NO: 54145 - DNA, 25 bp, Artificial Sequence
  Synthetic
ggaatgugaggtattggugacaagg

SEQ ID NO: 54146 - DNA, 26 bp, Artificial Sequence
  Synthetic
gctaaatggcaauggattcaacgtut

SEQ ID NO: 54147 - DNA, 24 bp, Artificial Sequence
  Synthetic
tgcaacttugcatcacgaaaugac

SEQ ID NO: 54148 - DNA, 23 bp, Artificial Sequence
  Synthetic
cccctttgaugatgtcguaagga

SEQ ID NO: 54149 - DNA, 24 bp, Artificial Sequence
  Synthetic
tgtgcagatuggacatgttttgug

SEQ ID NO: 54150 - DNA, 28 bp, Artificial Sequence
  Synthetic
tcaaaacagtaauaaggctttcaccuga

SEQ ID NO: 54151 - DNA, 27 bp, Artificial Sequence
  Synthetic
ccctcgcttugaaagtgttcttctaut

SEQ ID NO: 54152 - DNA, 21 bp, Artificial Sequence
  Synthetic
cttgatgtugcgtggcttcug

SEQ ID NO: 54153 - DNA, 23 bp, Artificial Sequence
  Synthetic
cagattccutttcctgucagggt

SEQ ID NO: 54154 - DNA, 26 bp, Artificial Sequence
  Synthetic
ttgaacatcttcucatacactgccut

SEQ ID NO: 54155 - DNA, 24 bp, Artificial Sequence
  Synthetic
tgctcacttaucctttccctcuca

SEQ ID NO: 54156 - DNA, 20 bp, Artificial Sequence
  Synthetic
gaccaaaagccuggagcuca

SEQ ID NO: 54157 - DNA, 22 bp, Artificial Sequence
  Synthetic
cctcaaccgagutaccgtgtuc

SEQ ID NO: 54158 - DNA, 24 bp, Artificial Sequence
  Synthetic
tctccaggaucttgtagagcucac

SEQ ID NO: 54159 - DNA, 18 bp, Artificial Sequence
  Synthetic
tcgatgcugccgtcgtut

SEQ ID NO: 54160 - DNA, 24 bp, Artificial Sequence
  Synthetic
tgutgaacagtctuaaggcagcat

SEQ ID NO: 54161 - DNA, 19 bp, Artificial Sequence
  Synthetic
cctttgagcutccggguct

SEQ ID NO: 54162 - DNA, 21 bp, Artificial Sequence
  Synthetic
gttaccuggagcccacauaca

SEQ ID NO: 54163 - DNA, 21 bp, Artificial Sequence
  Synthetic
ccaagtcucccctcttcaugg

SEQ ID NO: 54164 - DNA, 25 bp, Artificial Sequence
  Synthetic
gcaccttttcutcttcaaacagugg

SEQ ID NO: 54165 - DNA, 28 bp, Artificial Sequence
  Synthetic
tcagatgccauaactcatttctcttugt

SEQ ID NO: 54166 - DNA, 21 bp, Artificial Sequence
  Synthetic
gcccugcagaagcaaccttua

SEQ ID NO: 54167 - DNA, 28 bp, Artificial Sequence
  Synthetic
tttccccauagatgatcttaguagccat

SEQ ID NO: 54168 - DNA, 20 bp, Artificial Sequence
  Synthetic
gggccgaaaucagtgtccua

SEQ ID NO: 54169 - DNA, 24 bp, Artificial Sequence
  Synthetic
aagcctcaccauaacttatgctut

SEQ ID NO: 54170 - DNA, 26 bp, Artificial Sequence
  Synthetic
tcctttcctugaaggtagctgtauct

SEQ ID NO: 54171 - DNA, 22 bp, Artificial Sequence
  Synthetic
ggaaaatugcggctgatgaugg

SEQ ID NO: 54172 - DNA, 27 bp, Artificial Sequence
  Synthetic
agcattcttuccaggtctttctaaguc

SEQ ID NO: 54173 - DNA, 27 bp, Artificial Sequence
  Synthetic
ttgctgggautatgacatcttuggaat

SEQ ID NO: 54174 - DNA, 22 bp, Artificial Sequence
  Synthetic
agcgtttttgugcagacaaucc

SEQ ID NO: 54175 - DNA, 22 bp, Artificial Sequence
  Synthetic
acagggacagugatgcatgaut

SEQ ID NO: 54176 - DNA, 21 bp, Artificial Sequence
  Synthetic
ctgaagcuaccaccctcacut

SEQ ID NO: 54177 - DNA, 23 bp, Artificial Sequence
  Synthetic
caaaagatggcugatgaggcaut

SEQ ID NO: 54178 - DNA, 21 bp, Artificial Sequence
  Synthetic
ggcaaaaauguccaagcccat

SEQ ID NO: 54179 - DNA, 19 bp, Artificial Sequence
  Synthetic
cgctgcccauttcttguca

SEQ ID NO: 54180 - DNA, 20 bp, Artificial Sequence
  Synthetic
ggtactccuccagcaccuca

SEQ ID NO: 54181 - DNA, 21 bp, Artificial Sequence
  Synthetic
tgcctcaucctgagtccugat

SEQ ID NO: 54182 - DNA, 20 bp, Artificial Sequence
  Synthetic
tgtcccuctggucaggagaa

SEQ ID NO: 54183 - DNA, 20 bp, Artificial Sequence
  Synthetic
ctcacccugctgtaggcauc

SEQ ID NO: 54184 - DNA, 20 bp, Artificial Sequence
  Synthetic
tctgtggaccuctcctucca

SEQ ID NO: 54185 - DNA, 18 bp, Artificial Sequence
  Synthetic
agcacttuccccguccag

SEQ ID NO: 54186 - DNA, 23 bp, Artificial Sequence
  Synthetic
ctcaggttccucagacagguagt

SEQ ID NO: 54187 - DNA, 21 bp, Artificial Sequence
  Synthetic
gaggctccuatggccttucag

SEQ ID NO: 54188 - DNA, 17 bp, Artificial Sequence
  Synthetic
cccugggccacgatcuc

SEQ ID NO: 54189 - DNA, 17 bp, Artificial Sequence
  Synthetic
tgcacugaccucacgca

SEQ ID NO: 54190 - DNA, 20 bp, Artificial Sequence
  Synthetic
gggtgauggccaaagaccua

SEQ ID NO: 54191 - DNA, 17 bp, Artificial Sequence
  Synthetic
caagggcagccucucca

SEQ ID NO: 54192 - DNA, 21 bp, Artificial Sequence
  Synthetic
tcgaagguccacgtgatgtug

SEQ ID NO: 54193 - DNA, 19 bp, Artificial Sequence
  Synthetic
gcugccaaccacacctaug

SEQ ID NO: 54194 - DNA, 21 bp, Artificial Sequence
  Synthetic
ggcagggcagacautcucaaa

SEQ ID NO: 54195 - DNA, 19 bp, Artificial Sequence
  Synthetic
cgtguccaggcacaaccuc

SEQ ID NO: 54196 - DNA, 24 bp, Artificial Sequence
  Synthetic
actttccttaugaggccaggagua

SEQ ID NO: 54197 - DNA, 22 bp, Artificial Sequence
  Synthetic
tggagaauggcaagaaggucac

SEQ ID NO: 54198 - DNA, 26 bp, Artificial Sequence
  Synthetic
gggttactcagugtcatcttgaucag

SEQ ID NO: 54199 - DNA, 28 bp, Artificial Sequence
  Synthetic
caagattgaggcgcucagaaatttatut

SEQ ID NO: 54200 - DNA, 22 bp, Artificial Sequence
  Synthetic
cctcttagucccacacctucct

SEQ ID NO: 54201 - DNA, 21 bp, Artificial Sequence
  Synthetic
gttgaaggacagugctuccga

SEQ ID NO: 54202 - DNA, 24 bp, Artificial Sequence
  Synthetic
cctggccttcutgagaaacttcua

SEQ ID NO: 54203 - DNA, 22 bp, Artificial Sequence
  Synthetic
gtgcagcucaaggatctgauct

SEQ ID NO: 54204 - DNA, 22 bp, Artificial Sequence
  Synthetic
caagagaagcaggugaggugat

SEQ ID NO: 54205 - DNA, 25 bp, Artificial Sequence
  Synthetic
acactcttuaagggcacttactucc

SEQ ID NO: 54206 - DNA, 25 bp, Artificial Sequence
  Synthetic
gggaaaatctgcuccctctacauac

SEQ ID NO: 54207 - DNA, 28 bp, Artificial Sequence
  Synthetic
tcatatgagaucacgttttgactugaat

SEQ ID NO: 54208 - DNA, 22 bp, Artificial Sequence
  Synthetic
gguagaaccaaaggcaacugct

SEQ ID NO: 54209 - DNA, 23 bp, Artificial Sequence
  Synthetic
cattcaccctucccattgcttut

SEQ ID NO: 54210 - DNA, 28 bp, Artificial Sequence
  Synthetic
agcccaagaaauagaatactaggucaga

SEQ ID NO: 54211 - DNA, 21 bp, Artificial Sequence
  Synthetic
atgcgtggcautaccccttua

SEQ ID NO: 54212 - DNA, 21 bp, Artificial Sequence
  Synthetic
gcttcguggcctacagtguat

SEQ ID NO: 54213 - DNA, 21 bp, Artificial Sequence
  Synthetic
gctgaagaagacgucgtugct

SEQ ID NO: 54214 - DNA, 21 bp, Artificial Sequence
  Synthetic
gucgttgtcuacggcaaaagt

SEQ ID NO: 54215 - DNA, 22 bp, Artificial Sequence
  Synthetic
gagguacagaugggaacagagg

SEQ ID NO: 54216 - DNA, 20 bp, Artificial Sequence
  Synthetic
gacagtgagucctgacugct

SEQ ID NO: 54217 - DNA, 26 bp, Artificial Sequence
  Synthetic
agaatgactggutagttgccauacac

SEQ ID NO: 54218 - DNA, 20 bp, Artificial Sequence
  Synthetic
agcaagagcucuaccgcaac

SEQ ID NO: 54219 - DNA, 22 bp, Artificial Sequence
  Synthetic
gctugagggaaggcacauaact

SEQ ID NO: 54220 - DNA, 24 bp, Artificial Sequence
  Synthetic
gggcaatgatucagttcagagtug

SEQ ID NO: 54221 - DNA, 25 bp, Artificial Sequence
  Synthetic
cttctgtccugaaactcttgctuga

SEQ ID NO: 54222 - DNA, 21 bp, Artificial Sequence
  Synthetic
ggagaggacugaggtgctcua

SEQ ID NO: 54223 - DNA, 23 bp, Artificial Sequence
  Synthetic
agccugtcttucaggaacacaat

SEQ ID NO: 54224 - DNA, 23 bp, Artificial Sequence
  Synthetic
ttgtccaguctttgaccaaugct

SEQ ID NO: 54225 - DNA, 27 bp, Artificial Sequence
  Synthetic
catcaactctaaautagccacaagcug

SEQ ID NO: 54226 - DNA, 27 bp, Artificial Sequence
  Synthetic
atgtatgtgtauccatgggtcuagaca

SEQ ID NO: 54227 - DNA, 23 bp, Artificial Sequence
  Synthetic
cctagaccttuctgcagatgcuc

SEQ ID NO: 54228 - DNA, 25 bp, Artificial Sequence
  Synthetic
gtttccauggcaaacaacagaacua

SEQ ID NO: 54229 - DNA, 20 bp, Artificial Sequence
  Synthetic
ctgcctcgguggtacttguc

SEQ ID NO: 54230 - DNA, 18 bp, Artificial Sequence
  Synthetic
gaucccgcagagccugaa

SEQ ID NO: 54231 - DNA, 17 bp, Artificial Sequence
  Synthetic
gctugggcgcatcucca

SEQ ID NO: 54232 - DNA, 22 bp, Artificial Sequence
  Synthetic
cctactacccugaacacugcct

SEQ ID NO: 54233 - DNA, 19 bp, Artificial Sequence
  Synthetic
tgcacacucgggaccttug

SEQ ID NO: 54234 - DNA, 28 bp, Artificial Sequence
  Synthetic
caaccaaaggacacaaugagattagaug

SEQ ID NO: 54235 - DNA, 26 bp, Artificial Sequence
  Synthetic
agcugagagaaaauaaaaccccagag

SEQ ID NO: 54236 - DNA, 25 bp, Artificial Sequence
  Synthetic
tgttgccctugggtttttacauagt

SEQ ID NO: 54237 - DNA, 23 bp, Artificial Sequence
  Synthetic
tgctttacguttggtgcttucag

SEQ ID NO: 54238 - DNA, 28 bp, Artificial Sequence
  Synthetic
gctggttcttcaucagttagatagcaut

SEQ ID NO: 54239 - DNA, 30 bp, Artificial Sequence
  Synthetic
caaaaccataaaaccuttggaagtguaagt

SEQ ID NO: 54240 - DNA, 21 bp, Artificial Sequence
  Synthetic
aacagguggcttgggaucaat

SEQ ID NO: 54241 - DNA, 26 bp, Artificial Sequence
  Synthetic
acatgggacucaaagtttuagcacaa

SEQ ID NO: 54242 - DNA, 28 bp, Artificial Sequence
  Synthetic
ctgttatcattgugccaagatccaaaut

SEQ ID NO: 54243 - DNA, 29 bp, Artificial Sequence
  Synthetic
catcaaccatccutctccagatacattua

SEQ ID NO: 54244 - DNA, 17 bp, Artificial Sequence
  Synthetic
cagagccuctccucgca

SEQ ID NO: 54245 - DNA, 21 bp, Artificial Sequence
  Synthetic
cccatguggcagauggacaaa

SEQ ID NO: 54246 - DNA, 20 bp, Artificial Sequence
  Synthetic
agggtguaactgtccucggt

SEQ ID NO: 54247 - DNA, 21 bp, Artificial Sequence
  Synthetic
gccuaccccattccucacaag

SEQ ID NO: 54248 - DNA, 25 bp, Artificial Sequence
  Synthetic
agtgccatagguttgttagagcuac

SEQ ID NO: 54249 - DNA, 21 bp, Artificial Sequence
  Synthetic
tcttgccgugaaagggaacut

SEQ ID NO: 54250 - DNA, 22 bp, Artificial Sequence
  Synthetic
cagtttgggutgcttgtctgut

SEQ ID NO: 54251 - DNA, 28 bp, Artificial Sequence
  Synthetic
cagugattgaauacaaaaccaccaagac

SEQ ID NO: 54252 - DNA, 23 bp, Artificial Sequence
  Synthetic
gaccaacauaacctgctcccaut

SEQ ID NO: 54253 - DNA, 22 bp, Artificial Sequence
  Synthetic
gccagtgcucagtggactuaac

SEQ ID NO: 54254 - DNA, 19 bp, Artificial Sequence
  Synthetic
tgctctcugggtgctcuca

SEQ ID NO: 54255 - DNA, 19 bp, Artificial Sequence
  Synthetic
tgatccuggtccagcuggt

SEQ ID NO: 54256 - DNA, 20 bp, Artificial Sequence
  Synthetic
actctgggcagagucaccua

SEQ ID NO: 54257 - DNA, 23 bp, Artificial Sequence
  Synthetic
tcagagaugagggtgctaaguct

SEQ ID NO: 54258 - DNA, 19 bp, Artificial Sequence
  Synthetic
tgaggaccagccugacuct

SEQ ID NO: 54259 - DNA, 20 bp, Artificial Sequence
  Synthetic
ccacccuaccagacugagca

SEQ ID NO: 54260 - DNA, 24 bp, Artificial Sequence
  Synthetic
gtcctaagatguccacagcaaguc

SEQ ID NO: 54261 - DNA, 20 bp, Artificial Sequence
  Synthetic
tggcugttggaguggacaac

SEQ ID NO: 54262 - DNA, 23 bp, Artificial Sequence
  Synthetic
cgaagggtauggctggtaaaugt

SEQ ID NO: 54263 - DNA, 25 bp, Artificial Sequence
  Synthetic
tcattttcttcucgctggtctucat

SEQ ID NO: 54264 - DNA, 18 bp, Artificial Sequence
  Synthetic
cctgcgcuggacacagua

SEQ ID NO: 54265 - DNA, 17 bp, Artificial Sequence
  Synthetic
ctgctccuccgctccuc

SEQ ID NO: 54266 - DNA, 20 bp, Artificial Sequence
  Synthetic
cuggccacacccacuaaact

SEQ ID NO: 54267 - DNA, 29 bp, Artificial Sequence
  Synthetic
agcaaggagtcaugcaacgtaatttauat

SEQ ID NO: 54268 - DNA, 21 bp, Artificial Sequence
  Synthetic
cccctucacctccgtcuagaa

SEQ ID NO: 54269 - DNA, 22 bp, Artificial Sequence
  Synthetic
gagttgugacgggagttguagt

SEQ ID NO: 54270 - DNA, 22 bp, Artificial Sequence
  Synthetic
gctcguggcagagatgattuac

SEQ ID NO: 54271 - DNA, 21 bp, Artificial Sequence
  Synthetic
ttcctctcuggcaagtgugac

SEQ ID NO: 54272 - DNA, 26 bp, Artificial Sequence
  Synthetic
ccuatgagtaggatuagggaccagat

SEQ ID NO: 54273 - DNA, 22 bp, Artificial Sequence
  Synthetic
caagacctuttctgtccuccca

SEQ ID NO: 54274 - DNA, 21 bp, Artificial Sequence
  Synthetic
tgugaccaggtguaggaccaa

SEQ ID NO: 54275 - DNA, 19 bp, Artificial Sequence
  Synthetic
agtgcuggtggaacuggac

SEQ ID NO: 54276 - DNA, 24 bp, Artificial Sequence
  Synthetic
gggattctacaucttgtgcatugt

SEQ ID NO: 54277 - DNA, 20 bp, Artificial Sequence
  Synthetic
gatgcuaaagagcgctugcc

SEQ ID NO: 54278 - DNA, 18 bp, Artificial Sequence
  Synthetic
gaggtgtcgucggcagut

SEQ ID NO: 54279 - DNA, 20 bp, Artificial Sequence
  Synthetic
tucttcagtguggccacgat

SEQ ID NO: 54280 - DNA, 17 bp, Artificial Sequence
  Synthetic
gccugacgcccacctut

SEQ ID NO: 54281 - DNA, 18 bp, Artificial Sequence
  Synthetic
aaacccagguccccucct

SEQ ID NO: 54282 - DNA, 21 bp, Artificial Sequence
  Synthetic
caggtgauggaggccttugag

SEQ ID NO: 54283 - DNA, 23 bp, Artificial Sequence
  Synthetic
ctgagcagguctcacttaucgaa

SEQ ID NO: 54284 - DNA, 21 bp, Artificial Sequence
  Synthetic
cttctugagaagcctggcuca

SEQ ID NO: 54285 - DNA, 24 bp, Artificial Sequence
  Synthetic
tgacgaaguatgggcttuggaaat

SEQ ID NO: 54286 - DNA, 19 bp, Artificial Sequence
  Synthetic
ccaaggccaggaucuccaa

SEQ ID NO: 54287 - DNA, 18 bp, Artificial Sequence
  Synthetic
gggagguacctggagugg

SEQ ID NO: 54288 - DNA, 22 bp, Artificial Sequence
  Synthetic
aaacttggccauctgaggttut

SEQ ID NO: 54289 - DNA, 28 bp, Artificial Sequence
  Synthetic
tctcctcttcuaggatttggttaauggt

SEQ ID NO: 54290 - DNA, 18 bp, Artificial Sequence
  Synthetic
ggtctcuggcccaaguca

SEQ ID NO: 54291 - DNA, 22 bp, Artificial Sequence
  Synthetic
gctgctttugaaagtccacucc

SEQ ID NO: 54292 - DNA, 23 bp, Artificial Sequence
  Synthetic
ccctcttuggccttcatctcuac

SEQ ID NO: 54293 - DNA, 22 bp, Artificial Sequence
  Synthetic
tgggtttaatcugccaagggut

SEQ ID NO: 54294 - DNA, 22 bp, Artificial Sequence
  Synthetic
cgtgaggtccutgggattaguc

SEQ ID NO: 54295 - DNA, 23 bp, Artificial Sequence
  Synthetic
cactctctguacctgaccccaua

SEQ ID NO: 54296 - DNA, 20 bp, Artificial Sequence
  Synthetic
cctaccaguctgugcagcaa

SEQ ID NO: 54297 - DNA, 22 bp, Artificial Sequence
  Synthetic
ccttatguggaacccccaccua

SEQ ID NO: 54298 - DNA, 25 bp, Artificial Sequence
  Synthetic
gatgccccaaaautttccatgtuct

SEQ ID NO: 54299 - DNA, 23 bp, Artificial Sequence
  Synthetic
tgcuattggtucagcaagagagg

SEQ ID NO: 54300 - DNA, 22 bp, Artificial Sequence
  Synthetic
tcacttugcaggcacauaccaa

SEQ ID NO: 54301 - DNA, 22 bp, Artificial Sequence
  Synthetic
ggaugcaaatccuggaagacca

SEQ ID NO: 54302 - DNA, 27 bp, Artificial Sequence
  Synthetic
acgtagacatgugagataccagtuact

SEQ ID NO: 54303 - DNA, 27 bp, Artificial Sequence
  Synthetic
gtcctgtuacaaagacgtttggauaac

SEQ ID NO: 54304 - DNA, 26 bp, Artificial Sequence
  Synthetic
ctccagtggtucaagcaatttttgua

SEQ ID NO: 54305 - DNA, 28 bp, Artificial Sequence
  Synthetic
tgattagttuagcaacaggaggtugaat

SEQ ID NO: 54306 - DNA, 29 bp, Artificial Sequence
  Synthetic
ggacaaagatgatugaagtaactggtgua

SEQ ID NO: 54307 - DNA, 24 bp, Artificial Sequence
  Synthetic
ggatcattcaggcugacacactut

SEQ ID NO: 54308 - DNA, 25 bp, Artificial Sequence
  Synthetic
agtataggccacuttgttgctctug

SEQ ID NO: 54309 - DNA, 33 bp, Artificial Sequence
  Synthetic
agatcatctacttugtttacatgtttgaaucat

SEQ ID NO: 54310 - DNA, 23 bp, Artificial Sequence
  Synthetic
gtaccutctggattuccccacaa

SEQ ID NO: 54311 - DNA, 26 bp, Artificial Sequence
  Synthetic
aattcaaagcauagcccugaaagaga

SEQ ID NO: 54312 - DNA, 21 bp, Artificial Sequence
  Synthetic
gcagttgcgugatctccacua

SEQ ID NO: 54313 - DNA, 29 bp, Artificial Sequence
  Synthetic
gagcaaatcattucaacacacatguaaga

SEQ ID NO: 54314 - DNA, 28 bp, Artificial Sequence
  Synthetic
catagcttgttaugaggatcatgugaca

SEQ ID NO: 54315 - DNA, 20 bp, Artificial Sequence
  Synthetic
accuagaggaacgggccaut

SEQ ID NO: 54316 - DNA, 21 bp, Artificial Sequence
  Synthetic
ctctcctcaucttgccagugt

SEQ ID NO: 54317 - DNA, 28 bp, Artificial Sequence
  Synthetic
acagagatccuatcagatgacctuacag

SEQ ID NO: 54318 - DNA, 28 bp, Artificial Sequence
  Synthetic
gagaaagacgcuttcatgcatauaagag

SEQ ID NO: 54319 - DNA, 26 bp, Artificial Sequence
  Synthetic
ttcaactguagaaagcctuggagaaa

SEQ ID NO: 54320 - DNA, 27 bp, Artificial Sequence
  Synthetic
tgacttttcagutgagatgaugccaat

SEQ ID NO: 54321 - DNA, 28 bp, Artificial Sequence
  Synthetic
ttcugaaatcagcttuggagagaagaaa

SEQ ID NO: 54322 - DNA, 22 bp, Artificial Sequence
  Synthetic
cgcctggauttcatctcctuca

SEQ ID NO: 54323 - DNA, 28 bp, Artificial Sequence
  Synthetic
ctgggtaattgcauctgaggatgattua

SEQ ID NO: 54324 - DNA, 20 bp, Artificial Sequence
  Synthetic
cctaagcccuctgtgcugat

SEQ ID NO: 54325 - DNA, 23 bp, Artificial Sequence
  Synthetic
gtgactgcugggattgtttugag

SEQ ID NO: 54326 - DNA, 21 bp, Artificial Sequence
  Synthetic
ctccctucccatcatgauccc

SEQ ID NO: 54327 - DNA, 24 bp, Artificial Sequence
  Synthetic
aggagauccacctcuaccaaacat

SEQ ID NO: 54328 - DNA, 22 bp, Artificial Sequence
  Synthetic
gtgtgagcagucactcatcuca

SEQ ID NO: 54329 - DNA, 25 bp, Artificial Sequence
  Synthetic
cttctcaggcuatctctcaatgcut

SEQ ID NO: 54330 - DNA, 20 bp, Artificial Sequence
  Synthetic
ctgccuccgtggattcuact

SEQ ID NO: 54331 - DNA, 23 bp, Artificial Sequence
  Synthetic
cctauacacacttcuggcaccac

SEQ ID NO: 54332 - DNA, 27 bp, Artificial Sequence
  Synthetic
caaatgcttgcagucttctgttttcua

SEQ ID NO: 54333 - DNA, 20 bp, Artificial Sequence
  Synthetic
tgugtgguagagcagcaacc

SEQ ID NO: 54334 - DNA, 27 bp, Artificial Sequence
  Synthetic
gtgacacgaggaaugaatgaaauaacc

SEQ ID NO: 54335 - DNA, 21 bp, Artificial Sequence
  Synthetic
gtaggauggctgtugaacgga

SEQ ID NO: 54336 - DNA, 26 bp, Artificial Sequence
  Synthetic
tttactgccauacatctcctttccug

SEQ ID NO: 54337 - DNA, 22 bp, Artificial Sequence
  Synthetic
tctgagcugactggttccucat

SEQ ID NO: 54338 - DNA, 21 bp, Artificial Sequence
  Synthetic
ctgcaaauggagggctgacua

SEQ ID NO: 54339 - DNA, 27 bp, Artificial Sequence
  Synthetic
gatgttgttcaucaaaaagggcaaaut

SEQ ID NO: 54340 - DNA, 28 bp, Artificial Sequence
  Synthetic
gcagaagtaagguataatcctgctgtua

SEQ ID NO: 54341 - DNA, 27 bp, Artificial Sequence
  Synthetic
cttacaacaagtuccaaaacaccauct

SEQ ID NO: 54342 - DNA, 26 bp, Artificial Sequence
  Synthetic
ctcagcagtauaaagtcctcatuggt

SEQ ID NO: 54343 - DNA, 27 bp, Artificial Sequence
  Synthetic
ccctcatagtucagaggtctcucaaaa

SEQ ID NO: 54344 - DNA, 26 bp, Artificial Sequence
  Synthetic
tggaatgaaacautaccatcugccaa

SEQ ID NO: 54345 - DNA, 24 bp, Artificial Sequence
  Synthetic
ggtgactcttutcctccctcucat

SEQ ID NO: 54346 - DNA, 22 bp, Artificial Sequence
  Synthetic
gccttacguccaaccctcaaua

SEQ ID NO: 54347 - DNA, 21 bp, Artificial Sequence
  Synthetic
gtcuggcagcaaaccttgaut

SEQ ID NO: 54348 - DNA, 23 bp, Artificial Sequence
  Synthetic
gguagccagcagacaagtaucat

SEQ ID NO: 54349 - DNA, 23 bp, Artificial Sequence
  Synthetic
gtccgcttuggtttcttttgucc

SEQ ID NO: 54350 - DNA, 29 bp, Artificial Sequence
  Synthetic
agtgttatcctgcutatttgatgcttcut

SEQ ID NO: 54351 - DNA, 25 bp, Artificial Sequence
  Synthetic
gatcaagcctuaaccttctctguga

SEQ ID NO: 54352 - DNA, 20 bp, Artificial Sequence
  Synthetic
ggctctuccgaaagccugaa

SEQ ID NO: 54353 - DNA, 27 bp, Artificial Sequence
  Synthetic
gcattgggattugaaggtctttgauat

SEQ ID NO: 54354 - DNA, 27 bp, Artificial Sequence
  Synthetic
ctgtccccaautttagtgttctcuact

SEQ ID NO: 54355 - DNA, 28 bp, Artificial Sequence
  Synthetic
tgctaagttccucaaaggtaatgugaaa

SEQ ID NO: 54356 - DNA, 25 bp, Artificial Sequence
  Synthetic
gtcagcacuaatcagttaccugcaa

SEQ ID NO: 54357 - DNA, 24 bp, Artificial Sequence
  Synthetic
ctgatgcatucctggttgtttuct

SEQ ID NO: 54358 - DNA, 22 bp, Artificial Sequence
  Synthetic
aagagaacccagacucuggaca

SEQ ID NO: 54359 - DNA, 20 bp, Artificial Sequence
  Synthetic
cccgccugtacgactucaac

SEQ ID NO: 54360 - DNA, 25 bp, Artificial Sequence
  Synthetic
tttgagactugttgttggcuaggaa

SEQ ID NO: 54361 - DNA, 26 bp, Artificial Sequence
  Synthetic
aaaagttcggcgutatgatatgcauc

SEQ ID NO: 54362 - DNA, 19 bp, Artificial Sequence
  Synthetic
ggccauaggguacgggaag

SEQ ID NO: 54363 - DNA, 23 bp, Artificial Sequence
  Synthetic
ccttacctcugcgggatguagaa

SEQ ID NO: 54364 - DNA, 21 bp, Artificial Sequence
  Synthetic
gaagtagcguccggtgtcaut

SEQ ID NO: 54365 - DNA, 21 bp, Artificial Sequence
  Synthetic
tgagtgtcucgtcctgguagt

SEQ ID NO: 54366 - DNA, 20 bp, Artificial Sequence
  Synthetic
gtctccugcacagaucggat

SEQ ID NO: 54367 - DNA, 22 bp, Artificial Sequence
  Synthetic
acccaggucatggtgaucaaac

SEQ ID NO: 54368 - DNA, 21 bp, Artificial Sequence
  Synthetic
gggcaaacagutctgtcucct

SEQ ID NO: 54369 - DNA, 19 bp, Artificial Sequence
  Synthetic
gacgaagucgggugaaggt

SEQ ID NO: 54370 - DNA, 27 bp, Artificial Sequence
  Synthetic
ttcatagaaucctttgagctugcaaga

SEQ ID NO: 54371 - DNA, 28 bp, Artificial Sequence
  Synthetic
ggactaacccagcugaatttaatctcug

SEQ ID NO: 54372 - DNA, 26 bp, Artificial Sequence
  Synthetic
cttgcctcugatcttcctcauaagaa

SEQ ID NO: 54373 - DNA, 27 bp, Artificial Sequence
  Synthetic
gggatgtaaacccuaaggacctuaaga

SEQ ID NO: 54374 - DNA, 27 bp, Artificial Sequence
  Synthetic
tttattgctgctautgcatgattgcut

SEQ ID NO: 54375 - DNA, 25 bp, Artificial Sequence
  Synthetic
ctggaaaagutccctttcugagagt

SEQ ID NO: 54376 - DNA, 29 bp, Artificial Sequence
  Synthetic
agtagtataaatttgugcaaggtctgugt

SEQ ID NO: 54377 - DNA, 26 bp, Artificial Sequence
  Synthetic
gatgaagaactguctcctcctaguga

SEQ ID NO: 54378 - DNA, 20 bp, Artificial Sequence
  Synthetic
ccgaucagacccuacaggac

SEQ ID NO: 54379 - DNA, 26 bp, Artificial Sequence
  Synthetic
gcttctccagutgaacatttguagca

SEQ ID NO: 54380 - DNA, 22 bp, Artificial Sequence
  Synthetic
cagagtcaggcuctgcaaauct

SEQ ID NO: 54381 - DNA, 23 bp, Artificial Sequence
  Synthetic
tgccaagucagcugaagagaaaa

SEQ ID NO: 54382 - DNA, 28 bp, Artificial Sequence
  Synthetic
tgcacagtttggauattactttcgtgua

SEQ ID NO: 54383 - DNA, 20 bp, Artificial Sequence
  Synthetic
cgactugcaaacctgtuggt

SEQ ID NO: 54384 - DNA, 24 bp, Artificial Sequence
  Synthetic
acaggctaugtagaaccaaugcag

SEQ ID NO: 54385 - DNA, 23 bp, Artificial Sequence
  Synthetic
tttctccaaaauggctggtcgua

SEQ ID NO: 54386 - DNA, 28 bp, Artificial Sequence
  Synthetic
gcctttatatgcuatgtcagtguaaacc

SEQ ID NO: 54387 - DNA, 22 bp, Artificial Sequence
  Synthetic
gacucacauggcacaaaacacc

SEQ ID NO: 54388 - DNA, 21 bp, Artificial Sequence
  Synthetic
ccccauggagcttgaucaact

SEQ ID NO: 54389 - DNA, 21 bp, Artificial Sequence
  Synthetic
ccgagcugaagtctgggauac

SEQ ID NO: 54390 - DNA, 22 bp, Artificial Sequence
  Synthetic
acagugaacagaagguggagga

SEQ ID NO: 54391 - DNA, 19 bp, Artificial Sequence
  Synthetic
ctcggccaugacaccucaa

SEQ ID NO: 54392 - DNA, 21 bp, Artificial Sequence
  Synthetic
ggactgtggguttctgtccut

SEQ ID NO: 54393 - DNA, 20 bp, Artificial Sequence
  Synthetic
caaggcagcuccaggtagug

SEQ ID NO: 54394 - DNA, 21 bp, Artificial Sequence
  Synthetic
cagaggcaaggcacucaugaa

SEQ ID NO: 54395 - DNA, 21 bp, Artificial Sequence
  Synthetic
gggttatccugtctggcucct

SEQ ID NO: 54396 - DNA, 21 bp, Artificial Sequence
  Synthetic
ccttggaccagcuggatgaug

SEQ ID NO: 54397 - DNA, 28 bp, Artificial Sequence
  Synthetic
ggaggaacaguaagcatgtattttcuga

SEQ ID NO: 54398 - DNA, 21 bp, Artificial Sequence
  Synthetic
gaagagcugagtgccacaaug

SEQ ID NO: 54399 - DNA, 24 bp, Artificial Sequence
  Synthetic
gaaccaaacacaugagagctccua

SEQ ID NO: 54400 - DNA, 25 bp, Artificial Sequence
  Synthetic
gaaacaagcacutaggctgugaaaa

SEQ ID NO: 54401 - DNA, 24 bp, Artificial Sequence
  Synthetic
ttaatggtggugttacctgctcuc

SEQ ID NO: 54402 - DNA, 25 bp, Artificial Sequence
  Synthetic
gaagaagcacuaacacccagaagua

SEQ ID NO: 54403 - DNA, 22 bp, Artificial Sequence
  Synthetic
tccagatcauggttgagtuggg

SEQ ID NO: 54404 - DNA, 27 bp, Artificial Sequence
  Synthetic
tggatttccttauctccaccataguct

SEQ ID NO: 54405 - DNA, 26 bp, Artificial Sequence
  Synthetic
tcaatattggtuggttgtttctugcc

SEQ ID NO: 54406 - DNA, 22 bp, Artificial Sequence
  Synthetic
cggtcaaugagagaacggucag

SEQ ID NO: 54407 - DNA, 24 bp, Artificial Sequence
  Synthetic
cgcttcugcacagcgttatacuat

SEQ ID NO: 54408 - DNA, 27 bp, Artificial Sequence
  Synthetic
cagtgttttcatutcctctcttccuct

SEQ ID NO: 54409 - DNA, 26 bp, Artificial Sequence
  Synthetic
catcctatcagcccutactgggtaua

SEQ ID NO: 54410 - DNA, 27 bp, Artificial Sequence
  Synthetic
tcaactgaactuccaggatgaacttut

SEQ ID NO: 54411 - DNA, 26 bp, Artificial Sequence
  Synthetic
tggaatgtccaacuttgcctatgtua

SEQ ID NO: 54412 - DNA, 26 bp, Artificial Sequence
  Synthetic
acagaatccacugctgcatacauaat

SEQ ID NO: 54413 - DNA, 29 bp, Artificial Sequence
  Synthetic
tggacatgttgaauacagcaaaactuact

SEQ ID NO: 54414 - DNA, 27 bp, Artificial Sequence
  Synthetic
acctctgguaagtattaggcgtuaaga

SEQ ID NO: 54415 - DNA, 24 bp, Artificial Sequence
  Synthetic
gggtggugaattcctttcuagaga

SEQ ID NO: 54416 - DNA, 25 bp, Artificial Sequence
  Synthetic
aacagctguagtccaattagugcaa

SEQ ID NO: 54417 - DNA, 28 bp, Artificial Sequence
  Synthetic
tcagaggcuttatgtcatuacaaacact

SEQ ID NO: 54418 - DNA, 25 bp, Artificial Sequence
  Synthetic
agaagtttatuggctactcugcaca

SEQ ID NO: 54419 - DNA, 28 bp, Artificial Sequence
  Synthetic
ctgggctaugggacatgtatgtauaaat

SEQ ID NO: 54420 - DNA, 27 bp, Artificial Sequence
  Synthetic
tggcttacttuacacaaaacaaacugg

SEQ ID NO: 54421 - DNA, 27 bp, Artificial Sequence
  Synthetic
aggttgctguctaacatactuggaaaa

SEQ ID NO: 54422 - DNA, 27 bp, Artificial Sequence
  Synthetic
gaatgugcccagcataatattuaagca

SEQ ID NO: 54423 - DNA, 20 bp, Artificial Sequence
  Synthetic
tgugggagaucgaggaccag

SEQ ID NO: 54424 - DNA, 27 bp, Artificial Sequence
  Synthetic
ttgtctcacuaagttgactuacagcag

SEQ ID NO: 54425 - DNA, 24 bp, Artificial Sequence
  Synthetic
ctaaaggctucagtcttcctguga

SEQ ID NO: 54426 - DNA, 26 bp, Artificial Sequence
  Synthetic
caagagtgaugtggtaaguagagaca

SEQ ID NO: 54427 - DNA, 27 bp, Artificial Sequence
  Synthetic
gctggacatcugtatactagcacatut

SEQ ID NO: 54428 - DNA, 18 bp, Artificial Sequence
  Synthetic
gacucagcacucgaccca

SEQ ID NO: 54429 - DNA, 17 bp, Artificial Sequence
  Synthetic
gctccgguggccttguc

SEQ ID NO: 54430 - DNA, 22 bp, Artificial Sequence
  Synthetic
ggtcttggtuttcagcccauct

SEQ ID NO: 54431 - DNA, 22 bp, Artificial Sequence
  Synthetic
tgtacatggcaaucctgtgguc

SEQ ID NO: 54432 - DNA, 21 bp, Artificial Sequence
  Synthetic
ctcggatcucctcctguggat

SEQ ID NO: 54433 - DNA, 21 bp, Artificial Sequence
  Synthetic
tctcgcaaaccugacactcuc

SEQ ID NO: 54434 - DNA, 17 bp, Artificial Sequence
  Synthetic
ctgcgcucggtgaacuc

SEQ ID NO: 54435 - DNA, 18 bp, Artificial Sequence
  Synthetic
gggctucagaccgtgcua

SEQ ID NO: 54436 - DNA, 21 bp, Artificial Sequence
  Synthetic
cctggtccccugggtttcuaa

SEQ ID NO: 54437 - DNA, 23 bp, Artificial Sequence
  Synthetic
ccctgacccucctattuggagag

SEQ ID NO: 54438 - DNA, 21 bp, Artificial Sequence
  Synthetic
gctgccuggcagttggauaat

SEQ ID NO: 54439 - DNA, 23 bp, Artificial Sequence
  Synthetic
ctcatgcaggauttctggttguc

SEQ ID NO: 54440 - DNA, 28 bp, Artificial Sequence
  Synthetic
aggagaaagaaugacgagaacauaacac

SEQ ID NO: 54441 - DNA, 25 bp, Artificial Sequence
  Synthetic
gucccacaccctuaagagaagaaaa

SEQ ID NO: 54442 - DNA, 21 bp, Artificial Sequence
  Synthetic
agggaccucaagagcuccaat

SEQ ID NO: 54443 - DNA, 26 bp, Artificial Sequence
  Synthetic
agatatggaucaagaggtagggugag

SEQ ID NO: 54444 - DNA, 26 bp, Artificial Sequence
  Synthetic
tgtctttccugaggtgatttcaugac

SEQ ID NO: 54445 - DNA, 22 bp, Artificial Sequence
  Synthetic
tggttgaggaguttggtgcuac

SEQ ID NO: 54446 - DNA, 21 bp, Artificial Sequence
  Synthetic
acagcuctguagaaccagcac

SEQ ID NO: 54447 - DNA, 26 bp, Artificial Sequence
  Synthetic
tcttccaccatutccacatcagaauc

SEQ ID NO: 54448 - DNA, 23 bp, Artificial Sequence
  Synthetic
caggctgttcucctcatcttcut

SEQ ID NO: 54449 - DNA, 19 bp, Artificial Sequence
  Synthetic
gcatugccaccccctacuc

SEQ ID NO: 54450 - DNA, 22 bp, Artificial Sequence
  Synthetic
acaacacccaaaacuacccugt

SEQ ID NO: 54451 - DNA, 22 bp, Artificial Sequence
  Synthetic
ctccccaaguctgacucagaag

SEQ ID NO: 54452 - DNA, 23 bp, Artificial Sequence
  Synthetic
guttctaaugggcaaaggcacag

SEQ ID NO: 54453 - DNA, 24 bp, Artificial Sequence
  Synthetic
tctgcctgtaugggaatgacatug

SEQ ID NO: 54454 - DNA, 28 bp, Artificial Sequence
  Synthetic
tgtgtttaacucacacttacccaugaaa

SEQ ID NO: 54455 - DNA, 22 bp, Artificial Sequence
  Synthetic
gggataagucgctggcatttug

SEQ ID NO: 54456 - DNA, 27 bp, Artificial Sequence
  Synthetic
tgaagcaacacaguatucacagaaaca

SEQ ID NO: 54457 - DNA, 28 bp, Artificial Sequence
  Synthetic
gtttgatcattaugaaccgacgttctut

SEQ ID NO: 54458 - DNA, 28 bp, Artificial Sequence
  Synthetic
atttcgaaugagtaaaaacgaugcacat

SEQ ID NO: 54459 - DNA, 27 bp, Artificial Sequence
  Synthetic
agcgaactgaagaaaucaaggttcaua

SEQ ID NO: 54460 - DNA, 27 bp, Artificial Sequence
  Synthetic
cctcctccuttagcatatctuccaaat

SEQ ID NO: 54461 - DNA, 28 bp, Artificial Sequence
  Synthetic
tatgaaatgctttutaggcacgtttuct

SEQ ID NO: 54462 - DNA, 27 bp, Artificial Sequence
  Synthetic
cctcaucagaactcatcttuagcaact

SEQ ID NO: 54463 - DNA, 25 bp, Artificial Sequence
  Synthetic
ggtttggcauaggaaaagctacugt

SEQ ID NO: 54464 - DNA, 18 bp, Artificial Sequence
  Synthetic
gggccuggagaucgagat

SEQ ID NO: 54465 - DNA, 17 bp, Artificial Sequence
  Synthetic
gggcgccacuctacguc

SEQ ID NO: 54466 - DNA, 25 bp, Artificial Sequence
  Synthetic
agggctuaacactttccattugagt

SEQ ID NO: 54467 - DNA, 28 bp, Artificial Sequence
  Synthetic
cacctccacatutgatgttctgtataug

SEQ ID NO: 54468 - DNA, 26 bp, Artificial Sequence
  Synthetic
ctgtctgttctcugggttatatgcut

SEQ ID NO: 54469 - DNA, 29 bp, Artificial Sequence
  Synthetic
acataaatgttaccutagtggcagaaucc

SEQ ID NO: 54470 - DNA, 24 bp, Artificial Sequence
  Synthetic
ccgutacatattgcugccaagaag

SEQ ID NO: 54471 - DNA, 28 bp, Artificial Sequence
  Synthetic
ccaaaacacucttgattgaugcaagaaa

SEQ ID NO: 54472 - DNA, 21 bp, Artificial Sequence
  Synthetic
caguatcgccugggagaacag

SEQ ID NO: 54473 - DNA, 20 bp, Artificial Sequence
  Synthetic
ccutcatcagcucccgaaca

SEQ ID NO: 54474 - DNA, 23 bp, Artificial Sequence
  Synthetic
aagtgttctugcttcagcaguct

SEQ ID NO: 54475 - DNA, 24 bp, Artificial Sequence
  Synthetic
acagaauacacacactgacauggg

SEQ ID NO: 54476 - DNA, 25 bp, Artificial Sequence
  Synthetic
gtctctguccaaggcatcattauct

SEQ ID NO: 54477 - DNA, 28 bp, Artificial Sequence
  Synthetic
aggtcctttgugagttatagatcccaua

SEQ ID NO: 54478 - DNA, 28 bp, Artificial Sequence
  Synthetic
acaaactcagacautggtcactaaugat

SEQ ID NO: 54479 - DNA, 22 bp, Artificial Sequence
  Synthetic
ttgcccttcugtgtgatgucaa

SEQ ID NO: 54480 - DNA, 26 bp, Artificial Sequence
  Synthetic
aaagagcactuttggctttgatucaa

SEQ ID NO: 54481 - DNA, 22 bp, Artificial Sequence
  Synthetic
accgctccautcatctttugct

SEQ ID NO: 54482 - DNA, 26 bp, Artificial Sequence
  Synthetic
tctgtaaaaagtuccctgcagtcauc

SEQ ID NO: 54483 - DNA, 23 bp, Artificial Sequence
  Synthetic
gttgggtgaucgttcctttcauc

SEQ ID NO: 54484 - DNA, 28 bp, Artificial Sequence
  Synthetic
gtgaactgagaautcaaaaggaatgugg

SEQ ID NO: 54485 - DNA, 28 bp, Artificial Sequence
  Synthetic
acacattttaacatugcttgcttggaut

SEQ ID NO: 54486 - DNA, 26 bp, Artificial Sequence
  Synthetic
aacaagcccaguctagaatttcucaa

SEQ ID NO: 54487 - DNA, 25 bp, Artificial Sequence
  Synthetic
caggaagttuttcacgctcuacaaa

SEQ ID NO: 54488 - DNA, 24 bp, Artificial Sequence
  Synthetic
gaggaataccuccacagcacuaat

SEQ ID NO: 54489 - DNA, 28 bp, Artificial Sequence
  Synthetic
catctgacuggccaaaattaagttttuc

SEQ ID NO: 54490 - DNA, 24 bp, Artificial Sequence
  Synthetic
acaagaccctutcattaccccauc

SEQ ID NO: 54491 - DNA, 27 bp, Artificial Sequence
  Synthetic
aggcagtcaaugagcttgtaaataugt

SEQ ID NO: 54492 - DNA, 26 bp, Artificial Sequence
  Synthetic
gattggaatcuggcagagtgtuaaga

SEQ ID NO: 54493 - DNA, 25 bp, Artificial Sequence
  Synthetic
gtatgtttcucaaaccaccugcaac

SEQ ID NO: 54494 - DNA, 21 bp, Artificial Sequence
  Synthetic
aucaaggccugaaaccccaaa

SEQ ID NO: 54495 - DNA, 22 bp, Artificial Sequence
  Synthetic
tccctcctautgtcatgccugt

SEQ ID NO: 54496 - DNA, 26 bp, Artificial Sequence
  Synthetic
tgaagtccgaagaggautcctcauat

SEQ ID NO: 54497 - DNA, 27 bp, Artificial Sequence
  Synthetic
gaaguaatcatuagacaagcagagcca

SEQ ID NO: 54498 - DNA, 28 bp, Artificial Sequence
  Synthetic
cctcgattgaaucctattctgaagauga

SEQ ID NO: 54499 - DNA, 23 bp, Artificial Sequence
  Synthetic
ggtcttgcccauctttcattcug

SEQ ID NO: 54500 - DNA, 22 bp, Artificial Sequence
  Synthetic
gctttgaugagcagctggttug

SEQ ID NO: 54501 - DNA, 21 bp, Artificial Sequence
  Synthetic
agagggcaacucctagggaug

SEQ ID NO: 54502 - DNA, 22 bp, Artificial Sequence
  Synthetic
agctgaacauctgtttgccuct

SEQ ID NO: 54503 - DNA, 22 bp, Artificial Sequence
  Synthetic
ggaatgatugggaagcguacct

SEQ ID NO: 54504 - DNA, 22 bp, Artificial Sequence
  Synthetic
gcggaaacgaugcctgtattuc

SEQ ID NO: 54505 - DNA, 28 bp, Artificial Sequence
  Synthetic
ggaagaaagcuaaacaaacctagauggt

SEQ ID NO: 54506 - DNA, 27 bp, Artificial Sequence
  Synthetic
caatgattuagaccctggatttaugcc

SEQ ID NO: 54507 - DNA, 25 bp, Artificial Sequence
  Synthetic
actgcugacacacacactaattuct

SEQ ID NO: 54508 - DNA, 21 bp, Artificial Sequence
  Synthetic
ggucccaaccacuggaaagac

SEQ ID NO: 54509 - DNA, 23 bp, Artificial Sequence
  Synthetic
gtttgtcaguaggcctgtcugaa

SEQ ID NO: 54510 - DNA, 20 bp, Artificial Sequence
  Synthetic
cugtacgacuggagcgacaa

SEQ ID NO: 54511 - DNA, 21 bp, Artificial Sequence
  Synthetic
gaccaaucatuccccgagacc

SEQ ID NO: 54512 - DNA, 23 bp, Artificial Sequence
  Synthetic
gacaagcaagaaacauggaugct

SEQ ID NO: 54513 - DNA, 27 bp, Artificial Sequence
  Synthetic
ggtaaccaggcaaaauactagcagaua

SEQ ID NO: 54514 - DNA, 23 bp, Artificial Sequence
  Synthetic
cucacagtgtauccagggacaat

SEQ ID NO: 54515 - DNA, 22 bp, Artificial Sequence
  Synthetic
ccagaaggcuctctctttccug

SEQ ID NO: 54516 - DNA, 21 bp, Artificial Sequence
  Synthetic
gcggagaacuggaaatgugga

SEQ ID NO: 54517 - DNA, 19 bp, Artificial Sequence
  Synthetic
gccaacaugggcagtcuga

SEQ ID NO: 54518 - DNA, 21 bp, Artificial Sequence
  Synthetic
ggcaggaccaccutgaatuct

SEQ ID NO: 54519 - DNA, 25 bp, Artificial Sequence
  Synthetic
cagaagtgtgtutccaccataccut

SEQ ID NO: 54520 - DNA, 17 bp, Artificial Sequence
  Synthetic
cgagcgccugggaucag

SEQ ID NO: 54521 - DNA, 19 bp, Artificial Sequence
  Synthetic
tgctcaucgcctcgcatut

SEQ ID NO: 54522 - DNA, 21 bp, Artificial Sequence
  Synthetic
cctgtacuggaccaggaagug

SEQ ID NO: 54523 - DNA, 19 bp, Artificial Sequence
  Synthetic
cgtgtcugtccagcuccaa

SEQ ID NO: 54524 - DNA, 19 bp, Artificial Sequence
  Synthetic
acucacctgucaccccgat

SEQ ID NO: 54525 - DNA, 20 bp, Artificial Sequence
  Synthetic
ggtucccgagggacagttug

SEQ ID NO: 54526 - DNA, 17 bp, Artificial Sequence
  Synthetic
gcagcuccgcguaccac

SEQ ID NO: 54527 - DNA, 19 bp, Artificial Sequence
  Synthetic
ggtgacgacugtggcauga

SEQ ID NO: 54528 - DNA, 25 bp, Artificial Sequence
  Synthetic
tgggaattcugagaacataggugga

SEQ ID NO: 54529 - DNA, 26 bp, Artificial Sequence
  Synthetic
ccatcccctgaucagtctacttcuat

SEQ ID NO: 54530 - DNA, 22 bp, Artificial Sequence
  Synthetic
aagggaagugucagaacaagca

SEQ ID NO: 54531 - DNA, 24 bp, Artificial Sequence
  Synthetic
catatctgtucaccagctcaguct

SEQ ID NO: 54532 - DNA, 24 bp, Artificial Sequence
  Synthetic
aagccccaaauctccttgtuagac

SEQ ID NO: 54533 - DNA, 17 bp, Artificial Sequence
  Synthetic
ccggcguttcggctuct

SEQ ID NO: 54534 - DNA, 21 bp, Artificial Sequence
  Synthetic
cacagtgucagtgcctaugga

SEQ ID NO: 54535 - DNA, 22 bp, Artificial Sequence
  Synthetic
ggcctcagucaagaactuccag

SEQ ID NO: 54536 - DNA, 20 bp, Artificial Sequence
  Synthetic
cgtctgguggtcgtaacugt

SEQ ID NO: 54537 - DNA, 22 bp, Artificial Sequence
  Synthetic
cccatcuccagctgtctgttuc

SEQ ID NO: 54538 - DNA, 28 bp, Artificial Sequence
  Synthetic
ccttcttaagtttutcaatctgcctgut

SEQ ID NO: 54539 - DNA, 28 bp, Artificial Sequence
  Synthetic
ctttgggaaatuaccaggttctgaagua

SEQ ID NO: 54540 - DNA, 28 bp, Artificial Sequence
  Synthetic
ccatttctacatgugctctttcttcuca

SEQ ID NO: 54541 - DNA, 24 bp, Artificial Sequence
  Synthetic
tctgggtcaaacuggcactttaut

SEQ ID NO: 54542 - DNA, 22 bp, Artificial Sequence
  Synthetic
gtctcuctgatccugccacaac

SEQ ID NO: 54543 - DNA, 27 bp, Artificial Sequence
  Synthetic
tgccagtcauggagtacttttaaauga

SEQ ID NO: 54544 - DNA, 26 bp, Artificial Sequence
  Synthetic
tgctcagagucacaataactggatut

SEQ ID NO: 54545 - DNA, 28 bp, Artificial Sequence
  Synthetic
ttctcttccctuaagtcagtcctactut

SEQ ID NO: 54546 - DNA, 21 bp, Artificial Sequence
  Synthetic
tgagacccuccccagatuacc

SEQ ID NO: 54547 - DNA, 27 bp, Artificial Sequence
  Synthetic
cagtgaacaaaacgagutgcaaagtua

SEQ ID NO: 54548 - DNA, 21 bp, Artificial Sequence
  Synthetic
ggccagtggugtccattcaua

SEQ ID NO: 54549 - DNA, 22 bp, Artificial Sequence
  Synthetic
aagggctaucggctagaucagt

SEQ ID NO: 54550 - DNA, 21 bp, Artificial Sequence
  Synthetic
gctatcccaugatgctcugct

SEQ ID NO: 54551 - DNA, 24 bp, Artificial Sequence
  Synthetic
gatgcctggaagcugcatagtaut

SEQ ID NO: 54552 - DNA, 24 bp, Artificial Sequence
  Synthetic
gtaaccugggcagaattgucaaaa

SEQ ID NO: 54553 - DNA, 28 bp, Artificial Sequence
  Synthetic
actgttgcuggacttagaaagtuaaagt

SEQ ID NO: 54554 - DNA, 25 bp, Artificial Sequence
  Synthetic
aagggctaactuatgttgccatgua

SEQ ID NO: 54555 - DNA, 26 bp, Artificial Sequence
  Synthetic
aaaactgugagaaagcaatugaccac

SEQ ID NO: 54556 - DNA, 24 bp, Artificial Sequence
  Synthetic
cuagaaaattcuccacagggccaa

SEQ ID NO: 54557 - DNA, 24 bp, Artificial Sequence
  Synthetic
ttcagtgtugcagtgacaguaact

SEQ ID NO: 54558 - DNA, 21 bp, Artificial Sequence
  Synthetic
gtgaucaaaacagggcgacug

SEQ ID NO: 54559 - DNA, 22 bp, Artificial Sequence
  Synthetic
ttggcaugtggaatugcacaag

SEQ ID NO: 54560 - DNA, 17 bp, Artificial Sequence
  Synthetic
tgccgguctggctctuc

SEQ ID NO: 54561 - DNA, 18 bp, Artificial Sequence
  Synthetic
tccgtccucctgctcuct

SEQ ID NO: 54562 - DNA, 29 bp, Artificial Sequence
  Synthetic
gttctgcaactuagtatttgaatgtucct

SEQ ID NO: 54563 - DNA, 27 bp, Artificial Sequence
  Synthetic
caccacaatgucgtcaatgaattcuac

SEQ ID NO: 54564 - DNA, 22 bp, Artificial Sequence
  Synthetic
ggagacagautccggactucag

SEQ ID NO: 54565 - DNA, 26 bp, Artificial Sequence
  Synthetic
gagggtgatcguttcttttagaggut

SEQ ID NO: 54566 - DNA, 25 bp, Artificial Sequence
  Synthetic
cagctgaguttgctcttcuaaaacc

SEQ ID NO: 54567 - DNA, 27 bp, Artificial Sequence
  Synthetic
ttcttgcatcugcaacatttcttctuc

SEQ ID NO: 54568 - DNA, 28 bp, Artificial Sequence
  Synthetic
tcagaaattctugagaaaccccuagaga

SEQ ID NO: 54569 - DNA, 27 bp, Artificial Sequence
  Synthetic
tgggagagaguaaactacagagactug

SEQ ID NO: 54570 - DNA, 25 bp, Artificial Sequence
  Synthetic
aatggctgugaatccagaauacact

SEQ ID NO: 54571 - DNA, 21 bp, Artificial Sequence
  Synthetic
ccctctaucagcaaaguggca

SEQ ID NO: 54572 - DNA, 26 bp, Artificial Sequence
  Synthetic
tcugtgtaatctaguggaagggaact

SEQ ID NO: 54573 - DNA, 22 bp, Artificial Sequence
  Synthetic
agaugacaucaccaaaggccaa

SEQ ID NO: 54574 - DNA, 18 bp, Artificial Sequence
  Synthetic
cgccaggaggauggacut

SEQ ID NO: 54575 - DNA, 18 bp, Artificial Sequence
  Synthetic
gcagcucaagcaccugga

SEQ ID NO: 54576 - DNA, 20 bp, Artificial Sequence
  Synthetic
gatcgacccugagcaucaca

SEQ ID NO: 54577 - DNA, 24 bp, Artificial Sequence
  Synthetic
ggatatcttucttgggtgucagca

SEQ ID NO: 54578 - DNA, 22 bp, Artificial Sequence
  Synthetic
cagtggugatgtcugcacagat

SEQ ID NO: 54579 - DNA, 21 bp, Artificial Sequence
  Synthetic
tggaagtgacgugaggcttuc

SEQ ID NO: 54580 - DNA, 21 bp, Artificial Sequence
  Synthetic
agauggcccaacacacagaug

SEQ ID NO: 54581 - DNA, 24 bp, Artificial Sequence
  Synthetic
gggtcctttagutctggcaaguaa

SEQ ID NO: 54582 - DNA, 28 bp, Artificial Sequence
  Synthetic
gaaaagaaaacccutgaagacatgtuga

SEQ ID NO: 54583 - DNA, 29 bp, Artificial Sequence
  Synthetic
gtgttcctttgcutttcaatctcttcaut

SEQ ID NO: 54584 - DNA, 28 bp, Artificial Sequence
  Synthetic
agaatgattuaaggctacagauggaagc

SEQ ID NO: 54585 - DNA, 26 bp, Artificial Sequence
  Synthetic
tccttgatcutttcctctugagcaaa

SEQ ID NO: 54586 - DNA, 23 bp, Artificial Sequence
  Synthetic
tcataaguagaaccagggccugt

SEQ ID NO: 54587 - DNA, 24 bp, Artificial Sequence
  Synthetic
acagcttctcucttccagcuaaag

SEQ ID NO: 54588 - DNA, 26 bp, Artificial Sequence
  Synthetic
tgttccuaggatgacauggagaaact

SEQ ID NO: 54589 - DNA, 28 bp, Artificial Sequence
  Synthetic
ttggtcaatttcuacctctttttccugt

SEQ ID NO: 54590 - DNA, 24 bp, Artificial Sequence
  Synthetic
acgtggcuatagatcatcugagca

SEQ ID NO: 54591 - DNA, 26 bp, Artificial Sequence
  Synthetic
gggtaagttcuaagtcctttgcacua

SEQ ID NO: 54592 - DNA, 28 bp, Artificial Sequence
  Synthetic
gctgtactuccaaaacagaatctgtuac

SEQ ID NO: 54593 - DNA, 28 bp, Artificial Sequence
  Synthetic
tttactuaaggaggacgaatccaugaac

SEQ ID NO: 54594 - DNA, 25 bp, Artificial Sequence
  Synthetic
actgatatcugccctcagttgauct

SEQ ID NO: 54595 - DNA, 28 bp, Artificial Sequence
  Synthetic
cctcttcctuccatctttcattacuaca

SEQ ID NO: 54596 - DNA, 21 bp, Artificial Sequence
  Synthetic
gtccagcaaugaggucaaggt

SEQ ID NO: 54597 - DNA, 28 bp, Artificial Sequence
  Synthetic
tcaatatcgagcutttctagtgcttuca

SEQ ID NO: 54598 - DNA, 25 bp, Artificial Sequence
  Synthetic
tgccaggttuatttcactcttucca

SEQ ID NO: 54599 - DNA, 26 bp, Artificial Sequence
  Synthetic
ggcttuaaggagaaagcactacuact

SEQ ID NO: 54600 - DNA, 24 bp, Artificial Sequence
  Synthetic
tctaagagaugcgggaatgaucca

SEQ ID NO: 54601 - DNA, 23 bp, Artificial Sequence
  Synthetic
gcggcgagaguccattgtaaaua

SEQ ID NO: 54602 - DNA, 19 bp, Artificial Sequence
  Synthetic
caagguccagtuggccgaa

SEQ ID NO: 54603 - DNA, 28 bp, Artificial Sequence
  Synthetic
actcatcaacaaauagatgccactugaa

SEQ ID NO: 54604 - DNA, 28 bp, Artificial Sequence
  Synthetic
acgaattaagcaguatttgtggugaagt

SEQ ID NO: 54605 - DNA, 26 bp, Artificial Sequence
  Synthetic
tttatgtgcgagauggctacagttua

SEQ ID NO: 54606 - DNA, 24 bp, Artificial Sequence
  Synthetic
cattcttauagccacgggtucaga

SEQ ID NO: 54607 - DNA, 29 bp, Artificial Sequence
  Synthetic
tcccaaagctgaaugaccatcaaaataua

SEQ ID NO: 54608 - DNA, 27 bp, Artificial Sequence
  Synthetic
catgctatcagaautcacaagguacca

SEQ ID NO: 54609 - DNA, 29 bp, Artificial Sequence
  Synthetic
tcctagttttgtuagccatcagttuacag

SEQ ID NO: 54610 - DNA, 21 bp, Artificial Sequence
  Synthetic
gagactugtttgctgugccaa

SEQ ID NO: 54611 - DNA, 20 bp, Artificial Sequence
  Synthetic
cgcuaccacacacagaugct

SEQ ID NO: 54612 - DNA, 22 bp, Artificial Sequence
  Synthetic
ccagcacccaccugaaacaaua

SEQ ID NO: 54613 - DNA, 21 bp, Artificial Sequence
  Synthetic
caaaaccgtgutcccgttcuc

SEQ ID NO: 54614 - DNA, 20 bp, Artificial Sequence
  Synthetic
tggaucttccgtuccaccac

SEQ ID NO: 54615 - DNA, 21 bp, Artificial Sequence
  Synthetic
gggccaugagcgaauacacat

SEQ ID NO: 54616 - DNA, 25 bp, Artificial Sequence
  Synthetic
tgaagatgaccuccccttctuagaa

SEQ ID NO: 54617 - DNA, 28 bp, Artificial Sequence
  Synthetic
cacacctcaccugtaaaactcagtauat

SEQ ID NO: 54618 - DNA, 27 bp, Artificial Sequence
  Synthetic
gatcattgctatuccatggatgacuca

SEQ ID NO: 54619 - DNA, 28 bp, Artificial Sequence
  Synthetic
actgcaaaccuctgaagaaaagtguaat

SEQ ID NO: 54620 - DNA, 21 bp, Artificial Sequence
  Synthetic
acagtggtcuccttcccagua

SEQ ID NO: 54621 - DNA, 22 bp, Artificial Sequence
  Synthetic
gtagcaacguggagttcatgug

SEQ ID NO: 54622 - DNA, 24 bp, Artificial Sequence
  Synthetic
caaccagaacaccgutcaaagaug

SEQ ID NO: 54623 - DNA, 26 bp, Artificial Sequence
  Synthetic
caaautcctugaaagcaaagcaagaa

SEQ ID NO: 54624 - DNA, 22 bp, Artificial Sequence
  Synthetic
aatgcttccaugagcactgcua

SEQ ID NO: 54625 - DNA, 23 bp, Artificial Sequence
  Synthetic
tutggucagcaaaacaacagcaa

SEQ ID NO: 54626 - DNA, 22 bp, Artificial Sequence
  Synthetic
gcgcctccaaugaaggatcuac

SEQ ID NO: 54627 - DNA, 29 bp, Artificial Sequence
  Synthetic
ggccaacagaaaauaagaaagacuaagga

SEQ ID NO: 54628 - DNA, 19 bp, Artificial Sequence
  Synthetic
gaauggaccugacgagcct

SEQ ID NO: 54629 - DNA, 22 bp, Artificial Sequence
  Synthetic
gtttccaguagcagcugacaga

SEQ ID NO: 54630 - DNA, 21 bp, Artificial Sequence
  Synthetic
ggccagguccagatcgaaauc

SEQ ID NO: 54631 - DNA, 17 bp, Artificial Sequence
  Synthetic
gcagcucaacgcgcuac

SEQ ID NO: 54632 - DNA, 21 bp, Artificial Sequence
  Synthetic
tgtgggcacagacaugactut

SEQ ID NO: 54633 - DNA, 29 bp, Artificial Sequence
  Synthetic
ttgtgttttgctuggattattgtgcatua

SEQ ID NO: 54634 - DNA, 28 bp, Artificial Sequence
  Synthetic
cutaaaatgtttuacaagcacacacaca

SEQ ID NO: 54635 - DNA, 21 bp, Artificial Sequence
  Synthetic
aggugcaaacatcucaagcca

SEQ ID NO: 54636 - DNA, 27 bp, Artificial Sequence
  Synthetic
gttattacactctugctccacgttgua

SEQ ID NO: 54637 - DNA, 27 bp, Artificial Sequence
  Synthetic
actccagtguaagagctttatgttucc

SEQ ID NO: 54638 - DNA, 21 bp, Artificial Sequence
  Synthetic
accugtgggtuaaaggccaaa

SEQ ID NO: 54639 - DNA, 22 bp, Artificial Sequence
  Synthetic
ttgagccutccatcctucacac

SEQ ID NO: 54640 - DNA, 21 bp, Artificial Sequence
  Synthetic
ggcacctggutggctagaaua

SEQ ID NO: 54641 - DNA, 27 bp, Artificial Sequence
  Synthetic
gatggaccugtgatcatatcugaaact

SEQ ID NO: 54642 - DNA, 28 bp, Artificial Sequence
  Synthetic
ggtttttgaaccugttgagttttucagt

SEQ ID NO: 54643 - DNA, 20 bp, Artificial Sequence
  Synthetic
ccaatgcauccctgcuggat

SEQ ID NO: 54644 - DNA, 24 bp, Artificial Sequence
  Synthetic
accagaactguaagattgctccug

SEQ ID NO: 54645 - DNA, 26 bp, Artificial Sequence
  Synthetic
cacgtctcagauacaaggaguacaaa

SEQ ID NO: 54646 - DNA, 23 bp, Artificial Sequence
  Synthetic
cautctagctccugaaccaacct

SEQ ID NO: 54647 - DNA, 21 bp, Artificial Sequence
  Synthetic
gcatctcccugtgtggguaga

SEQ ID NO: 54648 - DNA, 25 bp, Artificial Sequence
  Synthetic
aaaaccaaagcuttcctcttccuct

SEQ ID NO: 54649 - DNA, 22 bp, Artificial Sequence
  Synthetic
tgcttcgggauggaaacctaug

SEQ ID NO: 54650 - DNA, 24 bp, Artificial Sequence
  Synthetic
gctttgtcctucagcgttttgaug

SEQ ID NO: 54651 - DNA, 20 bp, Artificial Sequence
  Synthetic
gctgcggugacagtgatgut

SEQ ID NO: 54652 - DNA, 23 bp, Artificial Sequence
  Synthetic
acatautgctgcaaucaggacca

SEQ ID NO: 54653 - DNA, 28 bp, Artificial Sequence
  Synthetic
ggcaggatctuggttactcttataaguc

SEQ ID NO: 54654 - DNA, 27 bp, Artificial Sequence
  Synthetic
agatgtggaugagatagagaaagcugt

SEQ ID NO: 54655 - DNA, 26 bp, Artificial Sequence
  Synthetic
ctcatttctucaactgatgggucaga

SEQ ID NO: 54656 - DNA, 25 bp, Artificial Sequence
  Synthetic
gttaaatctguggtgtggcaaugac

SEQ ID NO: 54657 - DNA, 28 bp, Artificial Sequence
  Synthetic
cctttctcattcuggtgttcttcactua

SEQ ID NO: 54658 - DNA, 23 bp, Artificial Sequence
  Synthetic
ccatcucagaagaagctgcaguc

SEQ ID NO: 54659 - DNA, 27 bp, Artificial Sequence
  Synthetic
ggaacgtctcaguggtttttaagttut

SEQ ID NO: 54660 - DNA, 27 bp, Artificial Sequence
  Synthetic
gatgaaggaaaucccatacctgtcuac

SEQ ID NO: 54661 - DNA, 27 bp, Artificial Sequence
  Synthetic
atccataacugaaagccaaugacagat

SEQ ID NO: 54662 - DNA, 24 bp, Artificial Sequence
  Synthetic
ggctattagugcacaaggaaaugg

SEQ ID NO: 54663 - DNA, 29 bp, Artificial Sequence
  Synthetic
aggtacttaggaauggcaaatttgtuaca

SEQ ID NO: 54664 - DNA, 22 bp, Artificial Sequence
  Synthetic
gatccagaggutgggagttugg

SEQ ID NO: 54665 - DNA, 20 bp, Artificial Sequence
  Synthetic
tgtccgcutcagtgtuccat

SEQ ID NO: 54666 - DNA, 22 bp, Artificial Sequence
  Synthetic
ctggagaugcaggaagacacug

SEQ ID NO: 54667 - DNA, 23 bp, Artificial Sequence
  Synthetic
aaatctgacuggactgtgtgugt

SEQ ID NO: 54668 - DNA, 21 bp, Artificial Sequence
  Synthetic
tgtctggguctgaaacgctut

SEQ ID NO: 54669 - DNA, 28 bp, Artificial Sequence
  Synthetic
tcggatttttcacuttgctcatgtttut

SEQ ID NO: 54670 - DNA, 20 bp, Artificial Sequence
  Synthetic
cctggtugcactctgactug

SEQ ID NO: 54671 - DNA, 22 bp, Artificial Sequence
  Synthetic
ccacctccgacugataagggua

SEQ ID NO: 54672 - DNA, 22 bp, Artificial Sequence
  Synthetic
caggttccucctatcctgcuct

SEQ ID NO: 54673 - DNA, 22 bp, Artificial Sequence
  Synthetic
caaacaugcccacaagcugaaa

SEQ ID NO: 54674 - DNA, 28 bp, Artificial Sequence
  Synthetic
tgtttttggtcuttgacattttcugcaa

SEQ ID NO: 54675 - DNA, 28 bp, Artificial Sequence
  Synthetic
tggcgaacaaaacuatttgaggtaguat

SEQ ID NO: 54676 - DNA, 21 bp, Artificial Sequence
  Synthetic
ccagaacaagcagcuccugac

SEQ ID NO: 54677 - DNA, 23 bp, Artificial Sequence
  Synthetic
aagaagtctcuttgcagctguga

SEQ ID NO: 54678 - DNA, 25 bp, Artificial Sequence
  Synthetic
gacgtugaaacggaaaguggaaaaa

SEQ ID NO: 54679 - DNA, 24 bp, Artificial Sequence
  Synthetic
aattttgcccauccaccaaacauc

SEQ ID NO: 54680 - DNA, 24 bp, Artificial Sequence
  Synthetic
tutccactagaguaggaggcacat

SEQ ID NO: 54681 - DNA, 29 bp, Artificial Sequence
  Synthetic
gaatttgaaaaucagaaaccactgtguct

SEQ ID NO: 54682 - DNA, 21 bp, Artificial Sequence
  Synthetic
ccgggucaggatcaatgtgut

SEQ ID NO: 54683 - DNA, 25 bp, Artificial Sequence
  Synthetic
gctaagataaauggcaggagugcag

SEQ ID NO: 54684 - DNA, 21 bp, Artificial Sequence
  Synthetic
ccacacccuacaataccccut

SEQ ID NO: 54685 - DNA, 22 bp, Artificial Sequence
  Synthetic
gtctgtgtcucctttggtgugt

SEQ ID NO: 54686 - DNA, 21 bp, Artificial Sequence
  Synthetic
gagauccaucaaggccaggat

SEQ ID NO: 54687 - DNA, 27 bp, Artificial Sequence
  Synthetic
caagctttccugaatggtttucaaagt

SEQ ID NO: 54688 - DNA, 25 bp, Artificial Sequence
  Synthetic
ggctttggtuactaaaccagcugaa

SEQ ID NO: 54689 - DNA, 22 bp, Artificial Sequence
  Synthetic
attaacagcagcucaggtucgt

SEQ ID NO: 54690 - DNA, 23 bp, Artificial Sequence
  Synthetic
tcattcagtgugccaaggacauc

SEQ ID NO: 54691 - DNA, 27 bp, Artificial Sequence
  Synthetic
acctagtttttcuctcctgcttttcuc

SEQ ID NO: 54692 - DNA, 20 bp, Artificial Sequence
  Synthetic
guaacagcccacgtttugcc

SEQ ID NO: 54693 - DNA, 27 bp, Artificial Sequence
  Synthetic
agcagagttauacattgtcaagcauca

SEQ ID NO: 54694 - DNA, 24 bp, Artificial Sequence
  Synthetic
gagaacacagggautatgcaucct

SEQ ID NO: 54695 - DNA, 26 bp, Artificial Sequence
  Synthetic
gatgctgacucataatgtgtugaacc

SEQ ID NO: 54696 - DNA, 20 bp, Artificial Sequence
  Synthetic
gcugtggcgaucacgaaaag

SEQ ID NO: 54697 - DNA, 21 bp, Artificial Sequence
  Synthetic
ttgcatcugagcaagguggat

SEQ ID NO: 54698 - DNA, 17 bp, Artificial Sequence
  Synthetic
gctccagucccauccgt

SEQ ID NO: 54699 - DNA, 18 bp, Artificial Sequence
  Synthetic
accccagcuguccaagga

SEQ ID NO: 54700 - DNA, 24 bp, Artificial Sequence
  Synthetic
cctgcccagaautttacucacaca

SEQ ID NO: 54701 - DNA, 29 bp, Artificial Sequence
  Synthetic
agctctctacaguaagttctcataccaut

SEQ ID NO: 54702 - DNA, 21 bp, Artificial Sequence
  Synthetic
gggagaaggacuccactuggt

SEQ ID NO: 54703 - DNA, 21 bp, Artificial Sequence
  Synthetic
cgctgacacugtgcttctcuc

SEQ ID NO: 54704 - DNA, 18 bp, Artificial Sequence
  Synthetic
gcuccccggcctactuac

SEQ ID NO: 54705 - DNA, 18 bp, Artificial Sequence
  Synthetic
tgagcgccutcactgucc

SEQ ID NO: 54706 - DNA, 24 bp, Artificial Sequence
  Synthetic
acaccugaagaagcucaaaaggaa

SEQ ID NO: 54707 - DNA, 21 bp, Artificial Sequence
  Synthetic
ggcagagaugtcgaaggtugg

SEQ ID NO: 54708 - DNA, 25 bp, Artificial Sequence
  Synthetic
gcaatgaggaggucagttuggaaaa

SEQ ID NO: 54709 - DNA, 20 bp, Artificial Sequence
  Synthetic
gtcaugcacacggactucac

SEQ ID NO: 54710 - DNA, 22 bp, Artificial Sequence
  Synthetic
tgagtcaggautgcacuggaga

SEQ ID NO: 54711 - DNA, 28 bp, Artificial Sequence
  Synthetic
gtgtgctacaucatacattctuccagaa

SEQ ID NO: 54712 - DNA, 20 bp, Artificial Sequence
  Synthetic
ctgaagctcuaccacgccut

SEQ ID NO: 54713 - DNA, 25 bp, Artificial Sequence
  Synthetic
aaatgaccuggagagaatucaagca

SEQ ID NO: 54714 - DNA, 20 bp, Artificial Sequence
  Synthetic
ggctgttcgugtggattgug

SEQ ID NO: 54715 - DNA, 25 bp, Artificial Sequence
  Synthetic
gcaagggagagacgugatatttcut

SEQ ID NO: 54716 - DNA, 22 bp, Artificial Sequence
  Synthetic
ggaagcuccugaagaagagaca

SEQ ID NO: 54717 - DNA, 22 bp, Artificial Sequence
  Synthetic
gtagacgaugcctgcaaaaugg

SEQ ID NO: 54718 - DNA, 21 bp, Artificial Sequence
  Synthetic
gcagguggtccuagaggagac

SEQ ID NO: 54719 - DNA, 23 bp, Artificial Sequence
  Synthetic
aaacaccacacguacacctguat

SEQ ID NO: 54720 - DNA, 21 bp, Artificial Sequence
  Synthetic
gccaugagcctgtcaaucact

SEQ ID NO: 54721 - DNA, 20 bp, Artificial Sequence
  Synthetic
aggaucaacacaagcggugt

SEQ ID NO: 54722 - DNA, 23 bp, Artificial Sequence
  Synthetic
gttcgggttcuccctctacatug

SEQ ID NO: 54723 - DNA, 21 bp, Artificial Sequence
  Synthetic
ggagucaggcagagccaatua

SEQ ID NO: 54724 - DNA, 28 bp, Artificial Sequence
  Synthetic
gagctgattguagcaacatactacucaa

SEQ ID NO: 54725 - DNA, 26 bp, Artificial Sequence
  Synthetic
agacagauacagacagagtgcttuct

SEQ ID NO: 54726 - DNA, 25 bp, Artificial Sequence
  Synthetic
ttgtggtggagutattgatgacgut

SEQ ID NO: 54727 - DNA, 28 bp, Artificial Sequence
  Synthetic
agacattgaaggugtcaaccaauaaact

SEQ ID NO: 54728 - DNA, 30 bp, Artificial Sequence; identical to SEQ ID NO: 6366
  Synthetic

SEQ ID NO: 54729 - DNA, 28 bp, Artificial Sequence
  Synthetic
gggttttacacacacauaactcctucat

SEQ ID NO: 54730 - DNA, 22 bp, Artificial Sequence
  Synthetic
caacacgguccattttgccaut

SEQ ID NO: 54731 - DNA, 22 bp, Artificial Sequence
  Synthetic
acatttccautgtgcugaggga

SEQ ID NO: 54732 - DNA, 23 bp, Artificial Sequence
  Synthetic
cttgttcucaccaaaucccacct

SEQ ID NO: 54733 - DNA, 23 bp, Artificial Sequence
  Synthetic
acaaaccagutaatgggcaucgt

SEQ ID NO: 54734 - DNA, 21 bp, Artificial Sequence
  Synthetic
caaugcgaccatcuccacagt

SEQ ID NO: 54735 - DNA, 17 bp, Artificial Sequence
  Synthetic
ggucccaggagcaugcc

SEQ ID NO: 54736 - DNA, 21 bp, Artificial Sequence
  Synthetic
cctgcttgugctgtttgucat

SEQ ID NO: 54737 - DNA, 22 bp, Artificial Sequence
  Synthetic
ctctgctggucatgttggtgua

SEQ ID NO: 54738 - DNA, 23 bp, Artificial Sequence
  Synthetic
actaaatctuggcgttcagacuc

SEQ ID NO: 54739 - DNA, 27 bp, Artificial Sequence
  Synthetic
gcagagaauguggacaggaaaagaaat

SEQ ID NO: 54740 - DNA, 21 bp, Artificial Sequence
  Synthetic
gctcatugccctctccttugg

SEQ ID NO: 54741 - DNA, 21 bp, Artificial Sequence
  Synthetic
ctgacccugccuaaaggaagt

SEQ ID NO: 54742 - DNA, 20 bp, Artificial Sequence
  Synthetic
acccacgucgattgcatcuc

SEQ ID NO: 54743 - DNA, 22 bp, Artificial Sequence
  Synthetic
acctttttaugcctccaccugt

SEQ ID NO: 54744 - DNA, 22 bp, Artificial Sequence
  Synthetic
cccagcautcagtgttttucgg

SEQ ID NO: 54745 - DNA, 27 bp, Artificial Sequence
  Synthetic
tctctgcgcuttattttcaugaggaat

SEQ ID NO: 54746 - DNA, 22 bp, Artificial Sequence
  Synthetic
ctctagccaagcuccaccttuc

SEQ ID NO: 54747 - DNA, 19 bp, Artificial Sequence
  Synthetic
ggtccagcutgtgcucgat

SEQ ID NO: 54748 - DNA, 21 bp, Artificial Sequence
  Synthetic
cgaagccgggcauaaagguaa

SEQ ID NO: 54749 - DNA, 27 bp, Artificial Sequence
  Synthetic
tccactcctugaaggatactcaguaat

SEQ ID NO: 54750 - DNA, 29 bp, Artificial Sequence
  Synthetic
tctcattcatgguagttaagcaagucaaa

SEQ ID NO: 54751 - DNA, 23 bp, Artificial Sequence
  Synthetic
tggtctgaggauttcctgttucc

SEQ ID NO: 54752 - DNA, 21 bp, Artificial Sequence
  Synthetic
acccacagaggagaaugguga

SEQ ID NO: 54753 - DNA, 28 bp, Artificial Sequence
  Synthetic
ccacagtcatgtutattccacgtctaut

SEQ ID NO: 54754 - DNA, 23 bp, Artificial Sequence
  Synthetic
caggaggctutagctggaactua

SEQ ID NO: 54755 - DNA, 23 bp, Artificial Sequence
  Synthetic
caatctgggauctgctccugaag

SEQ ID NO: 54756 - DNA, 22 bp, Artificial Sequence
  Synthetic
ccccacaaaggcaucggtatut

SEQ ID NO: 54757 - DNA, 28 bp, Artificial Sequence
  Synthetic
aatgactttggugatcagaaucagaagt

SEQ ID NO: 54758 - DNA, 21 bp, Artificial Sequence
  Synthetic
catcauaccaggctgcugact

SEQ ID NO: 54759 - DNA, 28 bp, Artificial Sequence
  Synthetic
gtctgcagugatttaattctttguagca

SEQ ID NO: 54760 - DNA, 32 bp, Artificial Sequence
  Synthetic
acctatcagtuaggattactttcctcuaagac

SEQ ID NO: 54761 - DNA, 18 bp, Artificial Sequence
  Synthetic
gcugcaggccaagaugga

SEQ ID NO: 54762 - DNA, 23 bp, Artificial Sequence
  Synthetic
gttgaccaggauctccatctuca

SEQ ID NO: 54763 - DNA, 28 bp, Artificial Sequence
  Synthetic
gagagtgagagguaccacaatcttttua

SEQ ID NO: 54764 - DNA, 24 bp, Artificial Sequence
  Synthetic
cagaaaaccuggtgagaaguaggt

SEQ ID NO: 54765 - DNA, 23 bp, Artificial Sequence
  Synthetic
tcttctcuagggaggtgatggug

SEQ ID NO: 54766 - DNA, 27 bp, Artificial Sequence
  Synthetic
ttgaattctttcucatagcatcugcct

SEQ ID NO: 54767 - DNA, 28 bp, Artificial Sequence
  Synthetic
gcattagtttgggutcatcttttgtuct

SEQ ID NO: 54768 - DNA, 27 bp, Artificial Sequence
  Synthetic
acttcttcauccaaaatccttgtucca

SEQ ID NO: 54769 - DNA, 28 bp, Artificial Sequence
  Synthetic
accactgttuctttgaagctuacaaaag

SEQ ID NO: 54770 - DNA, 24 bp, Artificial Sequence
  Synthetic
ccaagaaaccauatgctcacctug

SEQ ID NO: 54771 - DNA, 23 bp, Artificial Sequence
  Synthetic
tttggattgtguccgttgagcua

SEQ ID NO: 54772 - DNA, 18 bp, Artificial Sequence
  Synthetic
gcccucaccggttuagca

SEQ ID NO: 54773 - DNA, 25 bp, Artificial Sequence
  Synthetic
gggtgacttcutagatgagggttuc

SEQ ID NO: 54774 - DNA, 22 bp, Artificial Sequence
  Synthetic
caagcagaugcaaaccaaccua

SEQ ID NO: 54775 - DNA, 19 bp, Artificial Sequence
  Synthetic
ccgagccugagcagctauc

SEQ ID NO: 54776 - DNA, 24 bp, Artificial Sequence
  Synthetic
agtgtcctuttctcctcuccagat

SEQ ID NO: 54777 - DNA, 20 bp, Artificial Sequence
  Synthetic
gctccgaugttggccaucag

SEQ ID NO: 54778 - DNA, 25 bp, Artificial Sequence
  Synthetic
tgatcttcatucaggtggtcaaugg

SEQ ID NO: 54779 - DNA, 23 bp, Artificial Sequence
  Synthetic
aatctggccaguttactctgcut

SEQ ID NO: 54780 - DNA, 20 bp, Artificial Sequence
  Synthetic
ccgtgtccacugcaccauac

SEQ ID NO: 54781 - DNA, 22 bp, Artificial Sequence
  Synthetic
atggctgtgugcttctatcucc

SEQ ID NO: 54782 - DNA, 25 bp, Artificial Sequence
  Synthetic
gtaaaccggutgttactaccucact

SEQ ID NO: 54783 - DNA, 27 bp, Artificial Sequence
  Synthetic
tcatggacatucaagacaagaaaguct

SEQ ID NO: 54784 - DNA, 26 bp, Artificial Sequence
  Synthetic
tcaatttttgtugagagggaggtgut

SEQ ID NO: 54785 - DNA, 27 bp, Artificial Sequence
  Synthetic
ccgtttgttcugaattctactggagut

SEQ ID NO: 54786 - DNA, 28 bp, Artificial Sequence
  Synthetic
aaagaaccagaaauacaattgagccuct

SEQ ID NO: 54787 - DNA, 28 bp, Artificial Sequence
  Synthetic
aaggcagcttgauaactgatcctauaac

SEQ ID NO: 54788 - DNA, 22 bp, Artificial Sequence
  Synthetic
cttttgtucgaaagctggccut

SEQ ID NO: 54789 - DNA, 26 bp, Artificial Sequence
  Synthetic
gaccatgcgaguatattgctgtguat

SEQ ID NO: 54790 - DNA, 23 bp, Artificial Sequence
  Synthetic
cctgtgaaaacgccaugggaaua

SEQ ID NO: 54791 - DNA, 26 bp, Artificial Sequence
  Synthetic
gggacgacatucattgttttgatgut

SEQ ID NO: 54792 - DNA, 21 bp, Artificial Sequence
  Synthetic
ggtaacacuctgaccagcugt

SEQ ID NO: 54793 - DNA, 21 bp, Artificial Sequence
  Synthetic
ccagucaagggaggcucaaag

SEQ ID NO: 54794 - DNA, 21 bp, Artificial Sequence
  Synthetic
cagatgcuggctgcttcttuc

SEQ ID NO: 54795 - DNA, 23 bp, Artificial Sequence
  Synthetic
ggctagtgcugatgtgctcatut

SEQ ID NO: 54796 - DNA, 21 bp, Artificial Sequence
  Synthetic
cgacagagccgucctgttuac

SEQ ID NO: 54797 - DNA, 21 bp, Artificial Sequence
  Synthetic
atggacagaacugcaggucac

SEQ ID NO: 54798 - DNA, 26 bp, Artificial Sequence
  Synthetic
gtctctgatttguagttaccagcuga

SEQ ID NO: 54799 - DNA, 28 bp, Artificial Sequence
  Synthetic
agtaagtcucagaccaaatgctaatucc

SEQ ID NO: 54800 - DNA, 25 bp, Artificial Sequence
  Synthetic
tguatagttgattcaugccgggaag

SEQ ID NO: 54801 - DNA, 24 bp, Artificial Sequence
  Synthetic
ttgggaugttgaguacggaaaaca

SEQ ID NO: 54802 - DNA, 30 bp, Artificial Sequence
  Synthetic
cctgtaaattctgugaaaatcaagctctut

SEQ ID NO: 54803 - DNA, 25 bp, Artificial Sequence
  Synthetic
accttgtccautgaccatttgucat

SEQ ID NO: 54804 - DNA, 25 bp, Artificial Sequence
  Synthetic
gaaguacgagatataauccgcagca

SEQ ID NO: 54805 - DNA, 27 bp, Artificial Sequence
  Synthetic
aaaggcttugcaagtaggataaugact

SEQ ID NO: 54806 - DNA, 26 bp, Artificial Sequence
  Synthetic
cttaggtgaaacuggaccaatgguag

SEQ ID NO: 54807 - DNA, 26 bp, Artificial Sequence
  Synthetic
tgctctctctucagtactgtgguaaa

SEQ ID NO: 54808 - DNA, 25 bp, Artificial Sequence
  Synthetic
ggttatggttugacacatggucaca

SEQ ID NO: 54809 - DNA, 28 bp, Artificial Sequence
  Synthetic
agaugtaatgacaaacugaaacgaagga

SEQ ID NO: 54810 - DNA, 28 bp, Artificial Sequence
  Synthetic
tgatgutacttaatggtugaagccaaca

SEQ ID NO: 54811 - DNA, 26 bp, Artificial Sequence
  Synthetic
cuaagtctgtaggauagagccgaagt

SEQ ID NO: 54812 - DNA, 22 bp, Artificial Sequence
  Synthetic
gggaggtuggagatgtaguggt

SEQ ID NO: 54813 - DNA, 18 bp, Artificial Sequence
  Synthetic
gacagucccccagccaut

SEQ ID NO: 54814 - DNA, 27 bp, Artificial Sequence
  Synthetic
attgatagtcaccgugttggtacttut

SEQ ID NO: 54815 - DNA, 29 bp, Artificial Sequence
  Synthetic
cccatgtaatucaattctgtgttaaugcc

SEQ ID NO: 54816 - DNA, 21 bp, Artificial Sequence
  Synthetic
gctggagaugctgtggatgua

SEQ ID NO: 54817 - DNA, 28 bp, Artificial Sequence
  Synthetic
ggaagggtauagaattctgtcccauaga

SEQ ID NO: 54818 - DNA, 21 bp, Artificial Sequence
  Synthetic
ctggcaaggcaaaauagcugt

SEQ ID NO: 54819 - DNA, 26 bp, Artificial Sequence
  Synthetic
caccagcacuaagtgatatccaucat

SEQ ID NO: 54820 - DNA, 28 bp, Artificial Sequence
  Synthetic
agacatctgcttuctgccaaaattaaug

SEQ ID NO: 54821 - DNA, 28 bp, Artificial Sequence
  Synthetic
ccaatgcaacagacuttaaagaagtugt

SEQ ID NO: 54822 - DNA, 21 bp, Artificial Sequence
  Synthetic
gcgatttctucccagggucaa

SEQ ID NO: 54823 - DNA, 26 bp, Artificial Sequence
  Synthetic
tccctgatcucagaatgtcctttuct

SEQ ID NO: 54824 - DNA, 19 bp, Artificial Sequence
  Synthetic
gcgggauaggaggagguga

SEQ ID NO: 54825 - DNA, 18 bp, Artificial Sequence
  Synthetic
cuccgaggccaagcugaa

SEQ ID NO: 54826 - DNA, 28 bp, Artificial Sequence
  Synthetic
ttctagaaaguaacagtctgttcaacuc

SEQ ID NO: 54827 - DNA, 26 bp, Artificial Sequence
  Synthetic
gctgctaggaccaguttgtgaatauc

SEQ ID NO: 54828 - DNA, 30 bp, Artificial Sequence
  Synthetic
actgtttattcatttugcctgtaattgcut

SEQ ID NO: 54829 - DNA, 22 bp, Artificial Sequence
  Synthetic
aatgaugcaccagcagctuaga

SEQ ID NO: 54830 - DNA, 27 bp, Artificial Sequence
  Synthetic
gtttctaaacctcugttgcaagtgtut

SEQ ID NO: 54831 - DNA, 26 bp, Artificial Sequence
  Synthetic
caaagacaaaagugaggccttgaaua

SEQ ID NO: 54832 - DNA, 28 bp, Artificial Sequence
  Synthetic
ccagaatagttcuctaaacatggtcugt

SEQ ID NO: 54833 - DNA, 25 bp, Artificial Sequence
  Synthetic
tgaggtcauagacagcaagguacaa

SEQ ID NO: 54834 - DNA, 28 bp, Artificial Sequence
  Synthetic
ctacaggaguccttcttcatttucaaga

SEQ ID NO: 54835 - DNA, 24 bp, Artificial Sequence
  Synthetic
ccccgugccacaaaaauaaaagac

SEQ ID NO: 54836 - DNA, 25 bp, Artificial Sequence
  Synthetic
cttuaagggacaaagugagcacaga

SEQ ID NO: 54837 - DNA, 23 bp, Artificial Sequence
  Synthetic
gggauacagtgugaaaagcagca

SEQ ID NO: 54838 - DNA, 22 bp, Artificial Sequence
  Synthetic
atgcataatgguggtggtguca

SEQ ID NO: 54839 - DNA, 22 bp, Artificial Sequence
  Synthetic
gttcttcugaaggcagagggut

SEQ ID NO: 54840 - DNA, 21 bp, Artificial Sequence
  Synthetic
ggtauggcaaaggacugcaca

SEQ ID NO: 54841 - DNA, 24 bp, Artificial Sequence
  Synthetic
gctcagcucaccttttctttucca

SEQ ID NO: 54842 - DNA, 19 bp, Artificial Sequence
  Synthetic
gggctacuggcgtttcauc

SEQ ID NO: 54843 - DNA, 24 bp, Artificial Sequence
  Synthetic
gaggaagcugggatatctctcuct

SEQ ID NO: 54844 - DNA, 22 bp, Artificial Sequence
  Synthetic
gcagugtttcuccaagagccat

SEQ ID NO: 54845 - DNA, 26 bp, Artificial Sequence
  Synthetic
tgctgtcatcutaccatgttctucac

SEQ ID NO: 54846 - DNA, 28 bp, Artificial Sequence
  Synthetic
gaatatttgagtaaagugagttgccgut

SEQ ID NO: 54847 - DNA, 21 bp, Artificial Sequence
  Synthetic
ggctctcacutccccacaauc

SEQ ID NO: 54848 - DNA, 22 bp, Artificial Sequence
  Synthetic
agcaaggcugactuggacaaat

SEQ ID NO: 54849 - DNA, 27 bp, Artificial Sequence
  Synthetic
ttcccgaagttuaagagacatgatgut

SEQ ID NO: 54850 - DNA, 26 bp, Artificial Sequence
  Synthetic
cagttuaacacatcctuaccagagca

SEQ ID NO: 54851 - DNA, 19 bp, Artificial Sequence
  Synthetic
gacauggcctgugccaaac

SEQ ID NO: 54852 - DNA, 28 bp, Artificial Sequence
  Synthetic
agtactgucaaaaacaacaacugagaca

SEQ ID NO: 54853 - DNA, 21 bp, Artificial Sequence
  Synthetic
ccagccaacaucacccugaag

SEQ ID NO: 54854 - DNA, 26 bp, Artificial Sequence
  Synthetic
tcttcatgatgtutccttcgtaggug

SEQ ID NO: 54855 - DNA, 23 bp, Artificial Sequence
  Synthetic
aggccuagcaagagaaugagaat

SEQ ID NO: 54856 - DNA, 24 bp, Artificial Sequence
  Synthetic
tcttcttctcaugtctccgguagg

SEQ ID NO: 54857 - DNA, 27 bp, Artificial Sequence
  Synthetic
catttttcgcatuatgatcctcgtugt

SEQ ID NO: 54858 - DNA, 22 bp, Artificial Sequence
  Synthetic
ccgggaaaaaguggtcauagca

SEQ ID NO: 54859 - DNA, 23 bp, Artificial Sequence
  Synthetic
gaaggtgtggaucacagtcauct

SEQ ID NO: 54860 - DNA, 27 bp, Artificial Sequence
  Synthetic
tggatatactcuaccctgcgatttuct

SEQ ID NO: 54861 - DNA, 22 bp, Artificial Sequence
  Synthetic
tggttcttugagcaacauggga

SEQ ID NO: 54862 - DNA, 28 bp, Artificial Sequence
  Synthetic
aacttgaggutgctaactaugaaacact

SEQ ID NO: 54863 - DNA, 23 bp, Artificial Sequence
  Synthetic
ccttcagcacutctttugagcac

SEQ ID NO: 54864 - DNA, 22 bp, Artificial Sequence
  Synthetic
gagcaaagaguacccgtgguaa

SEQ ID NO: 54865 - DNA, 28 bp, Artificial Sequence
  Synthetic
ggagcgtgttugtaattagggaaacuaa

SEQ ID NO: 54866 - DNA, 24 bp, Artificial Sequence
  Synthetic
gccagagaagaaacutccacauct

SEQ ID NO: 54867 - DNA, 18 bp, Artificial Sequence
  Synthetic
cgagcagaucgcccucaa

SEQ ID NO: 54868 - DNA, 20 bp, Artificial Sequence
  Synthetic
gagagugggtgugagcagaa

SEQ ID NO: 54869 - DNA, 20 bp, Artificial Sequence
  Synthetic
gcaagucaagagccuccaga

SEQ ID NO: 54870 - DNA, 20 bp, Artificial Sequence
  Synthetic
gggttcucagactccuggct

SEQ ID NO: 54871 - DNA, 25 bp, Artificial Sequence
  Synthetic
ccttctatgacugtgccatctucac

SEQ ID NO: 54872 - DNA, 21 bp, Artificial Sequence
  Synthetic
cgctgctucagcttgaactuc

SEQ ID NO: 54873 - DNA, 28 bp, Artificial Sequence
  Synthetic
ggatctcactuacccatcatacttctut

SEQ ID NO: 54874 - DNA, 24 bp, Artificial Sequence
  Synthetic
gagaggucaagaccagatggtcua

SEQ ID NO: 54875 - DNA, 24 bp, Artificial Sequence
  Synthetic
ctcatcaccacuctcttccatcuc

SEQ ID NO: 54876 - DNA, 21 bp, Artificial Sequence
  Synthetic
ggctgggaucagggagatuct

SEQ ID NO: 54877 - DNA, 22 bp, Artificial Sequence
  Synthetic
tcctgaagggaacugggauagg

SEQ ID NO: 54878 - DNA, 26 bp, Artificial Sequence
  Synthetic
atgctgtaacucagacttcctgttut

SEQ ID NO: 54879 - DNA, 22 bp, Artificial Sequence
  Synthetic
guggaccatatcugggaaggac

SEQ ID NO: 54880 - DNA, 26 bp, Artificial Sequence
  Synthetic
tggttgagcaaccutaccttuaaaga

SEQ ID NO: 54881 - DNA, 27 bp, Artificial Sequence
  Synthetic
gctagtggauaagtttttggaggaugt

SEQ ID NO: 54882 - DNA, 24 bp, Artificial Sequence
  Synthetic
catacgatcagcaauaccagggua

SEQ ID NO: 54883 - DNA, 23 bp, Artificial Sequence
  Synthetic
ccttgaccugaatgcactgugat

SEQ ID NO: 54884 - DNA, 21 bp, Artificial Sequence
  Synthetic
acaaaaugggtcucgccaaga

SEQ ID NO: 54885 - DNA, 28 bp, Artificial Sequence
  Synthetic
gggaaaacaugactgtacugaaaaacaa

SEQ ID NO: 54886 - DNA, 22 bp, Artificial Sequence
  Synthetic
ccuaatctcaucaagcccagca

SEQ ID NO: 54887 - DNA, 24 bp, Artificial Sequence
  Synthetic
cgaggaagaguaacgtgtgttuct

SEQ ID NO: 54888 - DNA, 33 bp, Artificial Sequence
  Synthetic
aaaaatgttaactugaacaatgcaagaaaaaua

SEQ ID NO: 54889 - DNA, 24 bp, Artificial Sequence
  Synthetic
gctttcctccuggacctcaaatuc

SEQ ID NO: 54890 - DNA, 21 bp, Artificial Sequence
  Synthetic
ctggaagaugagctggtguca

SEQ ID NO: 54891 - DNA, 28 bp, Artificial Sequence
  Synthetic
gaaaaggtaaactuccttcattgctcuc

SEQ ID NO: 54892 - DNA, 21 bp, Artificial Sequence
  Synthetic
ccacagcccugtttctgtgut

SEQ ID NO: 54893 - DNA, 21 bp, Artificial Sequence
  Synthetic
ctgatguaggcagcacccaua

SEQ ID NO: 54894 - DNA, 21 bp, Artificial Sequence
  Synthetic
aagcaggcgcuaagaucacaa

SEQ ID NO: 54895 - DNA, 22 bp, Artificial Sequence
  Synthetic
ggtagguacctgaucccggaag

SEQ ID NO: 54896 - DNA, 24 bp, Artificial Sequence
  Synthetic
ctcagaagcuggtcgtaaaacuga

SEQ ID NO: 54897 - DNA, 23 bp, Artificial Sequence
  Synthetic
tccacccccacuagttttugaac

SEQ ID NO: 54898 - DNA, 22 bp, Artificial Sequence
  Synthetic
gatctctccaucctgacccugt

SEQ ID NO: 54899 - DNA, 22 bp, Artificial Sequence
  Synthetic
gctgcagagcuctccttgaaut

SEQ ID NO: 54900 - DNA, 19 bp, Artificial Sequence
  Synthetic
ccugcacgcaaatgugagt

SEQ ID NO: 54901 - DNA, 20 bp, Artificial Sequence
  Synthetic
gcugagggagccccatatuc

SEQ ID NO: 54902 - DNA, 19 bp, Artificial Sequence
  Synthetic
cucccagccgaggaaugag

SEQ ID NO: 54903 - DNA, 21 bp, Artificial Sequence
  Synthetic
cctctcacagguctgtctcug

SEQ ID NO: 54904 - DNA, 24 bp, Artificial Sequence
  Synthetic
tgacttcactaugactcctgcugt

SEQ ID NO: 54905 - DNA, 20 bp, Artificial Sequence
  Synthetic
ggagcaagcuccacgagaug

SEQ ID NO: 54906 - DNA, 21 bp, Artificial Sequence
  Synthetic
gggauacauggacacacagca

SEQ ID NO: 54907 - DNA, 22 bp, Artificial Sequence
  Synthetic
ttttgcagugcggcuaaagaag

SEQ ID NO: 54908 - DNA, 24 bp, Artificial Sequence
  Synthetic
caautctccagcucaaagcagaac

SEQ ID NO: 54909 - DNA, 27 bp, Artificial Sequence
  Synthetic
gccttggtttcuaagtttctagttucc

SEQ ID NO: 54910 - DNA, 26 bp, Artificial Sequence
  Synthetic
aagcccaagagaagcauaaaagguaa

SEQ ID NO: 54911 - DNA, 26 bp, Artificial Sequence
  Synthetic
gtggaagatacugatgctgatagcug

SEQ ID NO: 54912 - DNA, 20 bp, Artificial Sequence
  Synthetic
ggcagcauttccuggaacga

SEQ ID NO: 54913 - DNA, 20 bp, Artificial Sequence
  Synthetic
cucatucacaggagcccaca

SEQ ID NO: 54914 - DNA, 26 bp, Artificial Sequence
  Synthetic
ctgtcgcaucagcttgtatttgtauc

SEQ ID NO: 54915 - DNA, 25 bp, Artificial Sequence
  Synthetic
tgccttccagguaaggttaggtaut

SEQ ID NO: 54916 - DNA, 22 bp, Artificial Sequence
  Synthetic
gtcagatcacutgcctgcauct

SEQ ID NO: 54917 - DNA, 28 bp, Artificial Sequence
  Synthetic
tcgtcttcccaucaagagtuaaaaacat

SEQ ID NO: 54918 - DNA, 21 bp, Artificial Sequence
  Synthetic
tcactccaaucagaccgggua

SEQ ID NO: 54919 - DNA, 21 bp, Artificial Sequence
  Synthetic
gatccagccaaucacctggut

SEQ ID NO: 54920 - DNA, 27 bp, Artificial Sequence
  Synthetic
tgtttggagaugttaagcucaaaagga

SEQ ID NO: 54921 - DNA, 22 bp, Artificial Sequence
  Synthetic
catactgggaugtggcgauagg

SEQ ID NO: 54922 - DNA, 23 bp, Artificial Sequence
  Synthetic
gggacttugaagctcaucagaac

SEQ ID NO: 54923 - DNA, 25 bp, Artificial Sequence
  Synthetic
aaagcttgctuccattgagggtaua

SEQ ID NO: 54924 - DNA, 26 bp, Artificial Sequence
  Synthetic
gcatctgtaucaggcaaagtcauaga

SEQ ID NO: 54925 - DNA, 29 bp, Artificial Sequence
  Synthetic
gtagctaactaacutcagaacaccaacut

SEQ ID NO: 54926 - DNA, 26 bp, Artificial Sequence
  Synthetic
tgtcatttggugagtaactgcatuca

SEQ ID NO: 54927 - DNA, 22 bp, Artificial Sequence
  Synthetic
cgctcacagutgatgagaaugg

SEQ ID NO: 54928 - DNA, 20 bp, Artificial Sequence
  Synthetic
aacugcaagcccctucagaa

SEQ ID NO: 54929 - DNA, 21 bp, Artificial Sequence
  Synthetic
ctggctttuatgctgctcugg

SEQ ID NO: 54930 - DNA, 21 bp, Artificial Sequence
  Synthetic
ctctccugacgacatguccac

SEQ ID NO: 54931 - DNA, 20 bp, Artificial Sequence
  Synthetic
gctucagcccaagctttguc

SEQ ID NO: 54932 - DNA, 21 bp, Artificial Sequence
  Synthetic
gaccccacuacagcagcttut

SEQ ID NO: 54933 - DNA, 20 bp, Artificial Sequence
  Synthetic
cctcatgggugtccccttug

SEQ ID NO: 54934 - DNA, 27 bp, Artificial Sequence
  Synthetic
gtataggtatctguggttgatgcagut

SEQ ID NO: 54935 - DNA, 26 bp, Artificial Sequence
  Synthetic
cagtactgactutggtatgtgtgtuc

SEQ ID NO: 54936 - DNA, 24 bp, Artificial Sequence
  Synthetic
gaaaaaccuacagaccuggagaca

SEQ ID NO: 54937 - DNA, 22 bp, Artificial Sequence
  Synthetic
ggcgtttcagcuaaacccaaut

SEQ ID NO: 54938 - DNA, 23 bp, Artificial Sequence
  Synthetic
gtgtgtatgtgugtgctgaggua

SEQ ID NO: 54939 - DNA, 24 bp, Artificial Sequence
  Synthetic
cacttcaaagcuaacatgtugcca

SEQ ID NO: 54940 - DNA, 23 bp, Artificial Sequence
  Synthetic
ctgccattguctcaccgtaugaa

SEQ ID NO: 54941 - DNA, 28 bp, Artificial Sequence
  Synthetic
taaaacaaaagcacauaacugaaaacca

SEQ ID NO: 54942 - DNA, 28 bp, Artificial Sequence
  Synthetic
tgggtgtatcuggtgttgaaaattcuaa

SEQ ID NO: 54943 - DNA, 24 bp, Artificial Sequence
  Synthetic
tcactauccccatgacugggaaat

SEQ ID NO: 54944 - DNA, 33 bp, Artificial Sequence
  Synthetic
tattttctgtctttacutgttcctttattcuct

SEQ ID NO: 54945 - DNA, 24 bp, Artificial Sequence
  Synthetic
gcagctgacutgactttgctaaug

SEQ ID NO: 54946 - DNA, 25 bp, Artificial Sequence
  Synthetic
tgagagatatuccaacgtgcaagug

SEQ ID NO: 54947 - DNA, 28 bp, Artificial Sequence
  Synthetic
tccacagaactuataaaaacctttgugt

SEQ ID NO: 54948 - DNA, 22 bp, Artificial Sequence
  Synthetic
gccaccgtuttccttttagcut

SEQ ID NO: 54949 - DNA, 28 bp, Artificial Sequence
  Synthetic
ttgcctccautagttggaaaatugaaac

SEQ ID NO: 54950 - DNA, 27 bp, Artificial Sequence
  Synthetic
tattagagcttuctttgagtccucagt

SEQ ID NO: 54951 - DNA, 26 bp, Artificial Sequence
  Synthetic
gttgtgatcccugattccatttctug

SEQ ID NO: 54952 - DNA, 21 bp, Artificial Sequence
  Synthetic
ccacacucagctgatucacca

SEQ ID NO: 54953 - DNA, 24 bp, Artificial Sequence
  Synthetic
ctccccutggacatatucgagaag

SEQ ID NO: 54954 - DNA, 18 bp, Artificial Sequence
  Synthetic
cgccaccacugcgtauct

SEQ ID NO: 54955 - DNA, 17 bp, Artificial Sequence
  Synthetic
cccgaaggutggcgugt

SEQ ID NO: 54956 - DNA, 20 bp, Artificial Sequence
  Synthetic
gtccgtacuccacccaaguc

SEQ ID NO: 54957 - DNA, 18 bp, Artificial Sequence
  Synthetic
gcccuaccctuccaggca

SEQ ID NO: 54958 - DNA, 24 bp, Artificial Sequence
  Synthetic
caatccagtacuctcctgtgguag

SEQ ID NO: 54959 - DNA, 20 bp, Artificial Sequence
  Synthetic
ctgccgugacctcaagaugt

SEQ ID NO: 54960 - DNA, 28 bp, Artificial Sequence
  Synthetic
gtccatgaaatagaugaagacagtccut

SEQ ID NO: 54961 - DNA, 27 bp, Artificial Sequence
  Synthetic
cctggaataguccactttgtagtagug

SEQ ID NO: 54962 - DNA, 18 bp, Artificial Sequence
  Synthetic
gggcagcuacggcaucag

SEQ ID NO: 54963 - DNA, 17 bp, Artificial Sequence
  Synthetic
ctcagcguggucagcgt

SEQ ID NO: 54964 - DNA, 20 bp, Artificial Sequence
  Synthetic
cgtctuccacctgagctuca

SEQ ID NO: 54965 - DNA, 22 bp, Artificial Sequence
  Synthetic
ggaacucgaagacgaagtccuc

SEQ ID NO: 54966 - DNA, 22 bp, Artificial Sequence
  Synthetic
tcattggtguttcccacauggt

SEQ ID NO: 54967 - DNA, 20 bp, Artificial Sequence
  Synthetic
cggagatugttgcggtugat

SEQ ID NO: 54968 - DNA, 25 bp, Artificial Sequence
  Synthetic
catttttgatgguctctgcctcuct

SEQ ID NO: 54969 - DNA, 28 bp, Artificial Sequence
  Synthetic
cagtggcataagguacttaccattcuat

SEQ ID NO: 54970 - DNA, 26 bp, Artificial Sequence
  Synthetic
tgatatcaaugacaacgaaccagugt

SEQ ID NO: 54971 - DNA, 29 bp, Artificial Sequence
  Synthetic
actgctttcttaucatttgttctguaggt

SEQ ID NO: 54972 - DNA, 25 bp, Artificial Sequence
  Synthetic
tttttctaacuggcctcaguggaaa

SEQ ID NO: 54973 - DNA, 22 bp, Artificial Sequence
  Synthetic
ttccttggccauacctccuact

SEQ ID NO: 54974 - DNA, 22 bp, Artificial Sequence
  Synthetic
gtctagaggguggtggactuca

SEQ ID NO: 54975 - DNA, 20 bp, Artificial Sequence
  Synthetic
gttacccccucagggtcuct

SEQ ID NO: 54976 - DNA, 19 bp, Artificial Sequence
  Synthetic
gccccgaggutcggatcua

SEQ ID NO: 54977 - DNA, 21 bp, Artificial Sequence
  Synthetic
gcaagctugaagagcccucat

SEQ ID NO: 54978 - DNA, 20 bp, Artificial Sequence
  Synthetic
gaggtctgucgctgactcut

SEQ ID NO: 54979 - DNA, 18 bp, Artificial Sequence
  Synthetic
cucagaccccgcacucac

SEQ ID NO: 54980 - DNA, 17 bp, Artificial Sequence
  Synthetic
gggccaggucgtugagg

SEQ ID NO: 54981 - DNA, 18 bp, Artificial Sequence
  Synthetic
tggccgauggagcugaag

SEQ ID NO: 54982 - DNA, 21 bp, Artificial Sequence
  Synthetic
tgggcccccucatatctcaut

SEQ ID NO: 54983 - DNA, 19 bp, Artificial Sequence
  Synthetic
aggccaguacctggtccut

SEQ ID NO: 54984 - DNA, 23 bp, Artificial Sequence
  Synthetic
acctgggcuttgttgtcttuagt

SEQ ID NO: 54985 - DNA, 28 bp, Artificial Sequence
  Synthetic
gatttaattgtuacgcttttcccccuaa

SEQ ID NO: 54986 - DNA, 18 bp, Artificial Sequence
  Synthetic
tcccauggagcccuacca

SEQ ID NO: 54987 - DNA, 18 bp, Artificial Sequence
  Synthetic
tcctgcacugcgctguag

SEQ ID NO: 54988 - DNA, 21 bp, Artificial Sequence
  Synthetic
ccugactaccaucagcacgac

SEQ ID NO: 54989 - DNA, 21 bp, Artificial Sequence
  Synthetic
tcccgcuccagaaagttccua

SEQ ID NO: 54990 - DNA, 17 bp, Artificial Sequence
  Synthetic
gcctcagcccugccauc

SEQ ID NO: 54991 - DNA, 23 bp, Artificial Sequence
  Synthetic
ggagtttugggaatgugggagaa

SEQ ID NO: 54992 - DNA, 23 bp, Artificial Sequence
  Synthetic
tcatgagccugttggagaaagug

SEQ ID NO: 54993 - DNA, 22 bp, Artificial Sequence
  Synthetic
ccctctcacucctgcctatcua

SEQ ID NO: 54994 - DNA, 22 bp, Artificial Sequence
  Synthetic
cgagacaagcaggagugagaug

SEQ ID NO: 54995 - DNA, 20 bp, Artificial Sequence
  Synthetic
ggcccgauttcctccctuag

SEQ ID NO: 54996 - DNA, 20 bp, Artificial Sequence
  Synthetic
acagtcgcucaagacaggug

SEQ ID NO: 54997 - DNA, 22 bp, Artificial Sequence
  Synthetic
cggtacacgguatgcagcauag

SEQ ID NO: 54998 - DNA, 19 bp, Artificial Sequence
  Synthetic
gugcccgcuacacagagat

SEQ ID NO: 54999 - DNA, 28 bp, Artificial Sequence
  Synthetic
gttgttgacgaugattctcaggatatuc

SEQ ID NO: 55000 - DNA, 21 bp, Artificial Sequence
  Synthetic
ggaggtgacuggagtcugaca

SEQ ID NO: 55001 - DNA, 20 bp, Artificial Sequence
  Synthetic
gacgtugggaaccctccuaa

SEQ ID NO: 55002 - DNA, 20 bp, Artificial Sequence
  Synthetic
gcggugaggatgatctugcc

SEQ ID NO: 55003 - DNA, 21 bp, Artificial Sequence
  Synthetic
gctgcacaguctccacttcuc

SEQ ID NO: 55004 - DNA, 21 bp, Artificial Sequence
  Synthetic
tctccaggucctcaggactuc

SEQ ID NO: 55005 - DNA, 22 bp, Artificial Sequence
  Synthetic
gcgtcauaacccctggaaugat

SEQ ID NO: 55006 - DNA, 21 bp, Artificial Sequence
  Synthetic
gacaacctccugtcccgttua

SEQ ID NO: 55007 - DNA, 21 bp, Artificial Sequence
  Synthetic
ccttgaccgugcggatguaat

SEQ ID NO: 55008 - DNA, 20 bp, Artificial Sequence
  Synthetic
cuggauggacagcggaagaa

SEQ ID NO: 55009 - DNA, 20 bp, Artificial Sequence
  Synthetic
gggagtcugacctcuccgaa

SEQ ID NO: 55010 - DNA, 22 bp, Artificial Sequence
  Synthetic
ggactagaaaccucgcatccut

SEQ ID NO: 55011 - DNA, 22 bp, Artificial Sequence
  Synthetic
gcctgguctttatccugaagcc

SEQ ID NO: 55012 - DNA, 22 bp, Artificial Sequence
  Synthetic
gttggccccaugtttctcaaug

SEQ ID NO: 55013 - DNA, 25 bp, Artificial Sequence
  Synthetic
tcttaactgtggcutggatctgtug

SEQ ID NO: 55014 - DNA, 19 bp, Artificial Sequence
  Synthetic
ggaccagcaagucggcuac

SEQ ID NO: 55015 - DNA, 24 bp, Artificial Sequence
  Synthetic
atttctcatgcucatccccatcuc

SEQ ID NO: 55016 - DNA, 20 bp, Artificial Sequence
  Synthetic
gucctguacagcgagagcat

SEQ ID NO: 55017 - DNA, 19 bp, Artificial Sequence
  Synthetic
cuacagcccggactgugac

SEQ ID NO: 55018 - DNA, 23 bp, Artificial Sequence
  Synthetic
actagattuggccgcattgaugt

SEQ ID NO: 55019 - DNA, 26 bp, Artificial Sequence
  Synthetic
acaaatuaagaacacgacctcauggt

SEQ ID NO: 55020 - DNA, 23 bp, Artificial Sequence
  Synthetic
catgtgcauccgaatatgtugct

SEQ ID NO: 55021 - DNA, 22 bp, Artificial Sequence
  Synthetic
ctgtcagagcuccctcaagaug

SEQ ID NO: 55022 - DNA, 23 bp, Artificial Sequence
  Synthetic
agccaaagutgatgcugagaact

SEQ ID NO: 55023 - DNA, 26 bp, Artificial Sequence
  Synthetic
gtggccttcgautcttctagatucaa

SEQ ID NO: 55024 - DNA, 21 bp, Artificial Sequence
  Synthetic
ttggcagaauttcacgugcag

SEQ ID NO: 55025 - DNA, 23 bp, Artificial Sequence
  Synthetic
tttacagaggucgcagagggaua

SEQ ID NO: 55026 - DNA, 20 bp, Artificial Sequence
  Synthetic
ccacgguccctcgatttcug

SEQ ID NO: 55027 - DNA, 21 bp, Artificial Sequence
  Synthetic
caggaaugaaccccttgccut

SEQ ID NO: 55028 - DNA, 25 bp, Artificial Sequence
  Synthetic
gcccagcaacutactcatcttuact

SEQ ID NO: 55029 - DNA, 28 bp, Artificial Sequence
  Synthetic
gtaaauacagagcttguagggaaaggaa

SEQ ID NO: 55030 - DNA, 23 bp, Artificial Sequence
  Synthetic
aaagggtcutaccaagatuggca

SEQ ID NO: 55031 - DNA, 22 bp, Artificial Sequence
  Synthetic
agggcatauccagctcctcuac

SEQ ID NO: 55032 - DNA, 21 bp, Artificial Sequence
  Synthetic
ggtcacagcugcgtctaacug

SEQ ID NO: 55033 - DNA, 21 bp, Artificial Sequence
  Synthetic
agugataccacugcagaccct

SEQ ID NO: 55034 - DNA, 18 bp, Artificial Sequence
  Synthetic
gggccuctcgtccucact

SEQ ID NO: 55035 - DNA, 17 bp, Artificial Sequence
  Synthetic
cctcgguccgcatccug

SEQ ID NO: 55036 - DNA, 28 bp, Artificial Sequence
  Synthetic
gttcagccaaguagaatttgacatctuc

SEQ ID NO: 55037 - DNA, 32 bp, Artificial Sequence
  Synthetic
agtgattggttgacugattagataatttugct

SEQ ID NO: 55038 - DNA, 23 bp, Artificial Sequence
  Synthetic
gggatttugagggatgaggucaa

SEQ ID NO: 55039 - DNA, 27 bp, Artificial Sequence
  Synthetic
ttaacaugggcaccaaaaagaattugt

SEQ ID NO: 55040 - DNA, 28 bp, Artificial Sequence
  Synthetic
tctcccctcuctaagtaaaaatguaccc

SEQ ID NO: 55041 - DNA, 27 bp, Artificial Sequence
  Synthetic
tgggttgtcugttatttctgauggaat

SEQ ID NO: 55042 - DNA, 27 bp, Artificial Sequence
  Synthetic
aaaggacaacaaugtttacaatgugct

SEQ ID NO: 55043 - DNA, 23 bp, Artificial Sequence
  Synthetic
ggagaaatugcgcctcugaaaga

SEQ ID NO: 55044 - DNA, 24 bp, Artificial Sequence
  Synthetic
ggaggtgacagcuatccagtuact

SEQ ID NO: 55045 - DNA, 27 bp, Artificial Sequence
  Synthetic
attacttgaaggucaatgctctcctut

SEQ ID NO: 55046 - DNA, 24 bp, Artificial Sequence
  Synthetic
cccttttctucctacctaccucca

SEQ ID NO: 55047 - DNA, 21 bp, Artificial Sequence
  Synthetic
tgacaagcagutggcagctua

SEQ ID NO: 55048 - DNA, 21 bp, Artificial Sequence
  Synthetic
tctgcactguttcagctgcut

SEQ ID NO: 55049 - DNA, 25 bp, Artificial Sequence
  Synthetic
ccagtaatgccutataacgggtcuc

SEQ ID NO: 55050 - DNA, 20 bp, Artificial Sequence
  Synthetic
gccaaagcccucacucaaac

SEQ ID NO: 55051 - DNA, 23 bp, Artificial Sequence
  Synthetic
tgctggtcagugaacactcttut

SEQ ID NO: 55052 - DNA, 24 bp, Artificial Sequence
  Synthetic
gcggctcautgttattctugacaa

SEQ ID NO: 55053 - DNA, 26 bp, Artificial Sequence
  Synthetic
ctctaacagaugctaagaaugcacca

SEQ ID NO: 55054 - DNA, 23 bp, Artificial Sequence
  Synthetic
aacacgtaaugagtgcccgtuat

SEQ ID NO: 55055 - DNA, 25 bp, Artificial Sequence
  Synthetic
gccagtccagucaaaacgactttua

SEQ ID NO: 55056 - DNA, 26 bp, Artificial Sequence
  Synthetic
agtcaaaaagtggucttatccccauc

SEQ ID NO: 55057 - DNA, 27 bp, Artificial Sequence
  Synthetic
accacacaaagaacutatcctccatuc

SEQ ID NO: 55058 - DNA, 21 bp, Artificial Sequence
  Synthetic
acgagaaccagcgacucttug

SEQ ID NO: 55059 - DNA, 23 bp, Artificial Sequence
  Synthetic
ggagaugauggagagggaaagga

SEQ ID NO: 55060 - DNA, 20 bp, Artificial Sequence
  Synthetic
acaggcagutgaagtucgct

SEQ ID NO: 55061 - DNA, 26 bp, Artificial Sequence
  Synthetic
ccaaagtatgaaguacccgtccaaug

SEQ ID NO: 55062 - DNA, 23 bp, Artificial Sequence
  Synthetic
ctttcctctcuccactcccauct

SEQ ID NO: 55063 - DNA, 21 bp, Artificial Sequence
  Synthetic
caccctcauctccccaactuc

SEQ ID NO: 55064 - DNA, 20 bp, Artificial Sequence
  Synthetic
cccgcauaccatctgcugac

SEQ ID NO: 55065 - DNA, 20 bp, Artificial Sequence
  Synthetic
tcgcuaccccttacctucca

SEQ ID NO: 55066 - DNA, 25 bp, Artificial Sequence
  Synthetic
gctcagcugaagatagtgacttuga

SEQ ID NO: 55067 - DNA, 23 bp, Artificial Sequence
  Synthetic
tgcagttacguaggctcctttut

SEQ ID NO: 55068 - DNA, 23 bp, Artificial Sequence
  Synthetic
gagtccaagutaaagcugaggca

SEQ ID NO: 55069 - DNA, 24 bp, Artificial Sequence
  Synthetic
ggcttaggaccuccatcttuacca

SEQ ID NO: 55070 - DNA, 22 bp, Artificial Sequence
  Synthetic
cagtgccuggaggtatggatug

SEQ ID NO: 55071 - DNA, 29 bp, Artificial Sequence
  Synthetic
cacttagatgaatuctttccttcctccut

SEQ ID NO: 55072 - DNA, 25 bp, Artificial Sequence
  Synthetic
cctggccatuaacatgaagtttgut

SEQ ID NO: 55073 - DNA, 22 bp, Artificial Sequence
  Synthetic
ccataccaagaggguggcaaug

SEQ ID NO: 55074 - DNA, 28 bp, Artificial Sequence
  Synthetic
aacaaacaatttcugcacaactgatuct

SEQ ID NO: 55075 - DNA, 23 bp, Artificial Sequence
  Synthetic
tgttguaaccaccatgactugct

SEQ ID NO: 55076 - DNA, 22 bp, Artificial Sequence
  Synthetic
gactccagguattccatggcut

SEQ ID NO: 55077 - DNA, 25 bp, Artificial Sequence
  Synthetic
ggagaagactagutccttgccttuc

SEQ ID NO: 55078 - DNA, 22 bp, Artificial Sequence
  Synthetic
caccgtttutgagctggugaat

SEQ ID NO: 55079 - DNA, 25 bp, Artificial Sequence
  Synthetic
ctgaatcctaacugctgaagtcugt

SEQ ID NO: 55080 - DNA, 26 bp, Artificial Sequence
  Synthetic
ttcaggagaacaaggcutttcttcut

SEQ ID NO: 55081 - DNA, 25 bp, Artificial Sequence
  Synthetic
gaacaaggccauaaatgcaatcuca

SEQ ID NO: 55082 - DNA, 26 bp, Artificial Sequence
  Synthetic
ggaaattggaaaacugggtguaacct

SEQ ID NO: 55083 - DNA, 26 bp, Artificial Sequence
  Synthetic
tcacugtgggtaauaaaaaggcaagt

SEQ ID NO: 55084 - DNA, 28 bp, Artificial Sequence
  Synthetic
ccttataagcaagcutgtaactcgguat

SEQ ID NO: 55085 - DNA, 23 bp, Artificial Sequence
  Synthetic
gttgcctutaggtcctuccagag

SEQ ID NO: 55086 - DNA, 27 bp, Artificial Sequence
  Synthetic
cccatggaaaucctaaaggauagaagg

SEQ ID NO: 55087 - DNA, 28 bp, Artificial Sequence
  Synthetic
cacaggaccaucatatacaatcagtgut

SEQ ID NO: 55088 - DNA, 24 bp, Artificial Sequence
  Synthetic
gttgcacaattuggtcaaggcuat

SEQ ID NO: 55089 - DNA, 28 bp, Artificial Sequence
  Synthetic
tttcagtgtcuggagcatttcagauaaa

SEQ ID NO: 55090 - DNA, 27 bp, Artificial Sequence
  Synthetic
accuttgtauggaagcgaaaagaaaga

SEQ ID NO: 55091 - DNA, 25 bp, Artificial Sequence
  Synthetic
gccaaaaggaaautccagaagtgut

SEQ ID NO: 55092 - DNA, 26 bp, Artificial Sequence
  Synthetic
agtgtcgauacattcgtgatatugct

SEQ ID NO: 55093 - DNA, 23 bp, Artificial Sequence
  Synthetic
tgacaaugcaaaaggtggtgtug

SEQ ID NO: 55094 - DNA, 21 bp, Artificial Sequence
  Synthetic
ctggccaugggtgaccttaut

SEQ ID NO: 55095 - DNA, 27 bp, Artificial Sequence
  Synthetic
tctcagtcauaaagcagacctgttuac

SEQ ID NO: 55096 - DNA, 22 bp, Artificial Sequence
  Synthetic
ccagaauttctcacugggaggt

SEQ ID NO: 55097 - DNA, 26 bp, Artificial Sequence
  Synthetic
aattattcagaaugctgcggtttucc

SEQ ID NO: 55098 - DNA, 23 bp, Artificial Sequence
  Synthetic
agtactgugggaacaucacagat

SEQ ID NO: 55099 - DNA, 23 bp, Artificial Sequence
  Synthetic
acctcttuggccgattcagaaut

SEQ ID NO: 55100 - DNA, 26 bp, Artificial Sequence
  Synthetic
caccagggaauttcaaaatgctuacc

SEQ ID NO: 55101 - DNA, 28 bp, Artificial Sequence
  Synthetic
cattatctctgtaugccttggcaattua

SEQ ID NO: 55102 - DNA, 26 bp, Artificial Sequence
  Synthetic
gcacattgcugaattgtattgucaca

SEQ ID NO: 55103 - DNA, 27 bp, Artificial Sequence
  Synthetic
tgagttgaatguattttcatcccucat

SEQ ID NO: 55104 - DNA, 28 bp, Artificial Sequence
  Synthetic
atcaatcgagutttatatccagtugcca

SEQ ID NO: 55105 - DNA, 28 bp, Artificial Sequence
  Synthetic
gcagttgacautgctatctttuaacagt

SEQ ID NO: 55106 - DNA, 18 bp, Artificial Sequence
  Synthetic
ggccaaagcuggcaugaa

SEQ ID NO: 55107 - DNA, 18 bp, Artificial Sequence
  Synthetic
tcctugcggacgaugcag

SEQ ID NO: 55108 - DNA, 29 bp, Artificial Sequence
  Synthetic
cttgccctcttuctcttctttcttatcut

SEQ ID NO: 55109 - DNA, 26 bp, Artificial Sequence
  Synthetic
ctggcatgtuctctgtgatactuaca

SEQ ID NO: 55110 - DNA, 20 bp, Artificial Sequence
  Synthetic
acaaggtcaaacugccgcut

SEQ ID NO: 55111 - DNA, 23 bp, Artificial Sequence
  Synthetic
caaagggtgucctccctacaaut

SEQ ID NO: 55112 - DNA, 28 bp, Artificial Sequence
  Synthetic
tgtcatcatcuggtaaagtcaaatguca

SEQ ID NO: 55113 - DNA, 26 bp, Artificial Sequence
  Synthetic
actattttatugctgcaguggagagg

SEQ ID NO: 55114 - DNA, 22 bp, Artificial Sequence
  Synthetic
tgtggccugaagtgtgtcatut

SEQ ID NO: 55115 - DNA, 26 bp, Artificial Sequence
  Synthetic
catagagaagacugacccttggttug

SEQ ID NO: 55116 - DNA, 23 bp, Artificial Sequence
  Synthetic
gctgctttacucactgtgcauga

SEQ ID NO: 55117 - DNA, 27 bp, Artificial Sequence
  Synthetic
aacatcagtagcauttctttaccccut

SEQ ID NO: 55118 - DNA, 21 bp, Artificial Sequence
  Synthetic
cctggaccaguacctguacca

SEQ ID NO: 55119 - DNA, 21 bp, Artificial Sequence
  Synthetic
cttgtcccugccagttcugat

SEQ ID NO: 55120 - DNA, 21 bp, Artificial Sequence
  Synthetic
gagggaggguttccaactcug

SEQ ID NO: 55121 - DNA, 22 bp, Artificial Sequence
  Synthetic
accgacugtcagacugaagaga

SEQ ID NO: 55122 - DNA, 19 bp, Artificial Sequence
  Synthetic
ccagtgggaucaccauggg

SEQ ID NO: 55123 - DNA, 19 bp, Artificial Sequence
  Synthetic
acccuggcaggacaaucag

SEQ ID NO: 55124 - DNA, 24 bp, Artificial Sequence
  Synthetic
actgaggaaaugaccctgcaaaut

SEQ ID NO: 55125 - DNA, 21 bp, Artificial Sequence
  Synthetic
gcagcgggaagacuatttgug

SEQ ID NO: 55126 - DNA, 26 bp, Artificial Sequence
  Synthetic
gtcuggatgggatugaagaaaggaaa

SEQ ID NO: 55127 - DNA, 24 bp, Artificial Sequence
  Synthetic
gagcagtgcutatatccttccugt

SEQ ID NO: 55128 - DNA, 22 bp, Artificial Sequence
  Synthetic
ctgccagguaggaaugagagaa

SEQ ID NO: 55129 - DNA, 22 bp, Artificial Sequence
  Synthetic
tcgtgactguagcaaactgugg

SEQ ID NO: 55130 - DNA, 20 bp, Artificial Sequence
  Synthetic
atcaggaagcugacagcgut

SEQ ID NO: 55131 - DNA, 25 bp, Artificial Sequence
  Synthetic
ccttgatggauggaaaactcactug

SEQ ID NO: 55132 - DNA, 26 bp, Artificial Sequence
  Synthetic
acatcaacaautaggaaauccagcca

SEQ ID NO: 55133 - DNA, 28 bp, Artificial Sequence
  Synthetic
tgaagcttaagutgtgcatgatugaaac

SEQ ID NO: 55134 - DNA, 22 bp, Artificial Sequence
  Synthetic
acagguttaaagcauggccaca

SEQ ID NO: 55135 - DNA, 27 bp, Artificial Sequence
  Synthetic
gcattggcattgugtaccatacttaut

SEQ ID NO: 55136 - DNA, 23 bp, Artificial Sequence
  Synthetic
cgagtgucattgcttugaagcat

SEQ ID NO: 55137 - DNA, 28 bp, Artificial Sequence
  Synthetic
gctggaatggcugaattatagcagaaua

SEQ ID NO: 55138 - DNA, 33 bp, Artificial Sequence
  Synthetic
ctaggctctataaacutttccataatattcugt

SEQ ID NO: 55139 - DNA, 21 bp, Artificial Sequence
  Synthetic
gggtccaggagcuccatttuc

SEQ ID NO: 55140 - DNA, 21 bp, Artificial Sequence
  Synthetic
caagaagctugctcccccaua

SEQ ID NO: 55141 - DNA, 21 bp, Artificial Sequence
  Synthetic
gagaccgtuagctcctggtut

SEQ ID NO: 55142 - DNA, 23 bp, Artificial Sequence
  Synthetic
aactcaccatuggtccaggttut

SEQ ID NO: 55143 - DNA, 28 bp, Artificial Sequence
  Synthetic
ctgagtgagggutattgtcagttaacut

SEQ ID NO: 55144 - DNA, 21 bp, Artificial Sequence
  Synthetic
accagccaaaagcagucaugt

SEQ ID NO: 55145 - DNA, 25 bp, Artificial Sequence
  Synthetic
tttgcaacgttuctcctcatttgut

SEQ ID NO: 55146 - DNA, 19 bp, Artificial Sequence
  Synthetic
gcttaccucgctcgcucag

SEQ ID NO: 55147 - DNA, 21 bp, Artificial Sequence
  Synthetic
cctgcttguctcaaccatgug

SEQ ID NO: 55148 - DNA, 20 bp, Artificial Sequence
  Synthetic
gcctggccugacccuaagat

SEQ ID NO: 55149 - DNA, 23 bp, Artificial Sequence
  Synthetic
ttgaccaugaaggagaugagcac

SEQ ID NO: 55150 - DNA, 21 bp, Artificial Sequence
  Synthetic
gaugggcagaaggactuagcc

SEQ ID NO: 55151 - DNA, 25 bp, Artificial Sequence
  Synthetic
tcttcatggagutgctccttagtuc

SEQ ID NO: 55152 - DNA, 23 bp, Artificial Sequence
  Synthetic
ctctggaguccttttgguaccat

SEQ ID NO: 55153 - DNA, 21 bp, Artificial Sequence
  Synthetic
agcattcacgutccactuggt

SEQ ID NO: 55154 - DNA, 28 bp, Artificial Sequence
  Synthetic
ttcactactaguaaactgcagtccttug

SEQ ID NO: 55155 - DNA, 26 bp, Artificial Sequence
  Synthetic
acagacaatgtcaucacaggaggaua

SEQ ID NO: 55156 - DNA, 27 bp, Artificial Sequence
  Synthetic
catgtttcagggautacttctcccaut

SEQ ID NO: 55157 - DNA, 28 bp, Artificial Sequence
  Synthetic
ggagagctacuattttcagaaacgauca

SEQ ID NO: 55158 - DNA, 21 bp, Artificial Sequence
  Synthetic
ccagccucccacttgacauaa

SEQ ID NO: 55159 - DNA, 20 bp, Artificial Sequence
  Synthetic
gacgctctuccgagtcaucc

SEQ ID NO: 55160 - DNA, 24 bp, Artificial Sequence
  Synthetic
gagctggtgcuctacgtatcttut

SEQ ID NO: 55161 - DNA, 22 bp, Artificial Sequence
  Synthetic
tctccctgugtgatttcuccct

SEQ ID NO: 55162 - DNA, 23 bp, Artificial Sequence
  Synthetic
actcacacuggctcttgttgtuc

SEQ ID NO: 55163 - DNA, 22 bp, Artificial Sequence
  Synthetic
gaactgagccacutctctgucc

SEQ ID NO: 55164 - DNA, 23 bp, Artificial Sequence
  Synthetic
gcaatgggttuctccttcctgut

SEQ ID NO: 55165 - DNA, 23 bp, Artificial Sequence
  Synthetic
agtaugccgacaagatgtucaca

SEQ ID NO: 55166 - DNA, 19 bp, Artificial Sequence
  Synthetic
ccctcugcagactggtcut

SEQ ID NO: 55167 - DNA, 18 bp, Artificial Sequence
  Synthetic
gugcatcucaggccgact

SEQ ID NO: 55168 - DNA, 23 bp, Artificial Sequence
  Synthetic
agagatcuggcagcttttuggag

SEQ ID NO: 55169 - DNA, 23 bp, Artificial Sequence
  Synthetic
aagcaggaugagaagauggcaaa

SEQ ID NO: 55170 - DNA, 20 bp, Artificial Sequence
  Synthetic
ccagcgtuggacaccacaua

SEQ ID NO: 55171 - DNA, 21 bp, Artificial Sequence
  Synthetic
gaagccaaaacgcuccactut

SEQ ID NO: 55172 - DNA, 28 bp, Artificial Sequence
  Synthetic
tgttaacccuaaaaggttacacgatgut

SEQ ID NO: 55173 - DNA, 24 bp, Artificial Sequence
  Synthetic
gcttactaugccagctttggtuac

SEQ ID NO: 55174 - DNA, 21 bp, Artificial Sequence
  Synthetic
gcacaaaaucctggcccucaa

SEQ ID NO: 55175 - DNA, 20 bp, Artificial Sequence
  Synthetic
agtgggcaagcugtgatcug

SEQ ID NO: 55176 - DNA, 21 bp, Artificial Sequence
  Synthetic
cggtacguggtggtgtguaag

SEQ ID NO: 55177 - DNA, 21 bp, Artificial Sequence
  Synthetic
tggaaccagacacuacugggt

SEQ ID NO: 55178 - DNA, 27 bp, Artificial Sequence
  Synthetic
ctgcttcaagguttcaaaatccagtut

SEQ ID NO: 55179 - DNA, 27 bp, Artificial Sequence
  Synthetic
tgctgtttaagaaagcucaggagtuac

SEQ ID NO: 55180 - DNA, 21 bp, Artificial Sequence
  Synthetic
gcctatcgcuctgctctcuct

SEQ ID NO: 55181 - DNA, 22 bp, Artificial Sequence
  Synthetic
acgcagagugaugagaaaaccc

SEQ ID NO: 55182 - DNA, 24 bp, Artificial Sequence
  Synthetic
caacaacgutttcccctucaagat

SEQ ID NO: 55183 - DNA, 21 bp, Artificial Sequence
  Synthetic
cccagccacaccutctcttug

SEQ ID NO: 55184 - DNA, 20 bp, Artificial Sequence
  Synthetic
gtttcucagggagccgucag

SEQ ID NO: 55185 - DNA, 22 bp, Artificial Sequence
  Synthetic
cctatgccucatcagggagaut

SEQ ID NO: 55186 - DNA, 24 bp, Artificial Sequence
  Synthetic
ccagtagaaugcattttgccaugt

SEQ ID NO: 55187 - DNA, 27 bp, Artificial Sequence
  Synthetic
agcauttattccaatugggcaaaaact

SEQ ID NO: 55188 - DNA, 28 bp, Artificial Sequence
  Synthetic
gcatttctgtgacuacactgaagaugaa

SEQ ID NO: 55189 - DNA, 28 bp, Artificial Sequence
  Synthetic
cacccctaggucataagaaagaaaugaa

SEQ ID NO: 55190 - DNA, 23 bp, Artificial Sequence
  Synthetic
cagcuggaggaaaggagaaagut

SEQ ID NO: 55191 - DNA, 27 bp, Artificial Sequence
  Synthetic
gcggaattgtuggtatttgtcattguc

SEQ ID NO: 55192 - DNA, 27 bp, Artificial Sequence
  Synthetic
cgaactggcuaacatgtttttcttuct

SEQ ID NO: 55193 - DNA, 28 bp, Artificial Sequence
  Synthetic
gagtacttgagugaaagatgaagtggua

SEQ ID NO: 55194 - DNA, 20 bp, Artificial Sequence
  Synthetic
agtcggaguttgctgtugct

SEQ ID NO: 55195 - DNA, 28 bp, Artificial Sequence
  Synthetic
cctttgautcaggtatttuagccaacat

SEQ ID NO: 55196 - DNA, 26 bp, Artificial Sequence
  Synthetic
ggaggacaagcuttaaggtctaauga

SEQ ID NO: 55197 - DNA, 33 bp, Artificial Sequence
  Synthetic
tgtttctcactatgauttatatttctgtgctua

SEQ ID NO: 55198 - DNA, 28 bp, Artificial Sequence
  Synthetic
cagcatggcuaagttgauaagagagaat

SEQ ID NO: 55199 - DNA, 26 bp, Artificial Sequence
  Synthetic
cttgtaucgcttctgtauccagaact

SEQ ID NO: 55200 - DNA, 28 bp, Artificial Sequence
  Synthetic
gactttttgtgcucctttttacatguca

SEQ ID NO: 55201 - DNA, 28 bp, Artificial Sequence
  Synthetic
atctggctcatuttagcagctacauaat

SEQ ID NO: 55202 - DNA, 22 bp, Artificial Sequence
  Synthetic
ggtcugtgtcagucacaaacct

SEQ ID NO: 55203 - DNA, 23 bp, Artificial Sequence
  Synthetic
gctgcacugacaggcttgtaaua

SEQ ID NO: 55204 - DNA, 21 bp, Artificial Sequence
  Synthetic
gatggcttuggaagggucagt

SEQ ID NO: 55205 - DNA, 27 bp, Artificial Sequence
  Synthetic
ggactgcaaaaagcauttgtgaaacua

SEQ ID NO: 55206 - DNA, 29 bp, Artificial Sequence
  Synthetic
cgatacugaagaagaagaaaggttaugga

SEQ ID NO: 55207 - DNA, 26 bp, Artificial Sequence
  Synthetic
aatgtacacagcutttggcatgtuag

SEQ ID NO: 55208 - DNA, 29 bp, Artificial Sequence
  Synthetic
agcagcttacctuagatactgaaaacaut

SEQ ID NO: 55209 - DNA, 25 bp, Artificial Sequence
  Synthetic
gttccttaaacucctcttgctggut

SEQ ID NO: 55210 - DNA, 23 bp, Artificial Sequence
  Synthetic
gccaaattaugcatcgagcugaa

SEQ ID NO: 55211 - DNA, 27 bp, Artificial Sequence
  Synthetic
gcaagcatcatcauagtccacagtauc

SEQ ID NO: 55212 - DNA, 23 bp, Artificial Sequence
  Synthetic
cagatgaaagcaguggctgguat

SEQ ID NO: 55213 - DNA, 27 bp, Artificial Sequence
  Synthetic
ctgtgtcaucaaagaggttgaguaaag

SEQ ID NO: 55214 - DNA, 28 bp, Artificial Sequence
  Synthetic
ccagaaaatucagctcctttaaucgaat

SEQ ID NO: 55215 - DNA, 27 bp, Artificial Sequence
  Synthetic
tctctcactgcutatgtaacctuacct

SEQ ID NO: 55216 - DNA, 26 bp, Artificial Sequence
  Synthetic
gattgtcttttucctcttgcccttut

SEQ ID NO: 55217 - DNA, 28 bp, Artificial Sequence
  Synthetic
ccattccagcauatcgtcttagtguaat

SEQ ID NO: 55218 - DNA, 28 bp, Artificial Sequence
  Synthetic
ctttacaagtaauaaaggcccacgaaut

SEQ ID NO: 55219 - DNA, 22 bp, Artificial Sequence
  Synthetic
tcattgucctgccucgagagat

SEQ ID NO: 55220 - DNA, 20 bp, Artificial Sequence
  Synthetic
cgggagcuacttccccugat

SEQ ID NO: 55221 - DNA, 21 bp, Artificial Sequence
  Synthetic
gccgctgauctccacatctug

SEQ ID NO: 55222 - DNA, 21 bp, Artificial Sequence
  Synthetic
agagcaagcugccctttctut

SEQ ID NO: 55223 - DNA, 20 bp, Artificial Sequence
  Synthetic
gcgtctccucctcactguca

SEQ ID NO: 55224 - DNA, 20 bp, Artificial Sequence
  Synthetic
ggcagagagacgcutgguaa

SEQ ID NO: 55225 - DNA, 25 bp, Artificial Sequence
  Synthetic
gcctgacttuctacaaatgcugagt

SEQ ID NO: 55226 - DNA, 23 bp, Artificial Sequence
  Synthetic
agaagaaattguctgctgcccut

SEQ ID NO: 55227 - DNA, 27 bp, Artificial Sequence
  Synthetic
cagtggaatguaacaagatggagaauc

SEQ ID NO: 55228 - DNA, 27 bp, Artificial Sequence
  Synthetic
gattcttattgaugccccatgtttugt

SEQ ID NO: 55229 - DNA, 28 bp, Artificial Sequence
  Synthetic
gcaactgccuttaacatgtataaucact

SEQ ID NO: 55230 - DNA, 22 bp, Artificial Sequence
  Synthetic
ttacagtgggutcagacgaugt

SEQ ID NO: 55231 - DNA, 24 bp, Artificial Sequence
  Synthetic
tgguaaaacttuccacacaagggt

SEQ ID NO: 55232 - DNA, 24 bp, Artificial Sequence
  Synthetic
ttgatgcaacugcagtgatacuca

SEQ ID NO: 55233 - DNA, 23 bp, Artificial Sequence
  Synthetic
tgcttctguagtctgggtuacga

SEQ ID NO: 55234 - DNA, 27 bp, Artificial Sequence
  Synthetic
aagtactgcttcuttcttggaatguga

SEQ ID NO: 55235 - DNA, 21 bp, Artificial Sequence
  Synthetic
gcaagctucgctttgaacugg

SEQ ID NO: 55236 - DNA, 25 bp, Artificial Sequence
  Synthetic
cttaugacgaggttggugagagaat

SEQ ID NO: 55237 - DNA, 20 bp, Artificial Sequence
  Synthetic
tgtaggctucctccacuggt

SEQ ID NO: 55238 - DNA, 20 bp, Artificial Sequence
  Synthetic
cagtggtgucagcgatgaug

SEQ ID NO: 55239 - DNA, 24 bp, Artificial Sequence
  Synthetic
cccgctctauaccttctgtaaugg

SEQ ID NO: 55240 - DNA, 24 bp, Artificial Sequence
  Synthetic
gctgcagaggautgaggcttaaut

SEQ ID NO: 55241 - DNA, 18 bp, Artificial Sequence
  Synthetic
gcucuacgggagcacagt

SEQ ID NO: 55242 - DNA, 21 bp, Artificial Sequence
  Synthetic
cagtggucaaccucacaggaa

SEQ ID NO: 55243 - DNA, 18 bp, Artificial Sequence
  Synthetic
gcatgggcccugtgtcug

SEQ ID NO: 55244 - DNA, 21 bp, Artificial Sequence
  Synthetic
cctgagaauggguagccagga

SEQ ID NO: 55245 - DNA, 22 bp, Artificial Sequence
  Synthetic
tgctttccagcugagagtucac

SEQ ID NO: 55246 - DNA, 22 bp, Artificial Sequence
  Synthetic
cuccctgtuaaccccaaaccaa

SEQ ID NO: 55247 - DNA, 22 bp, Artificial Sequence
  Synthetic
acctggaccutctctcctugac

SEQ ID NO: 55248 - DNA, 23 bp, Artificial Sequence
  Synthetic
gatgggaauagggagaugagggt

SEQ ID NO: 55249 - DNA, 22 bp, Artificial Sequence
  Synthetic
cagcagcaaccaucaagactuc

SEQ ID NO: 55250 - DNA, 21 bp, Artificial Sequence
  Synthetic
tgagcugcagggagaaaucag

SEQ ID NO: 55251 - DNA, 19 bp, Artificial Sequence
  Synthetic
cgaaccccgggaguttgug

SEQ ID NO: 55252 - DNA, 18 bp, Artificial Sequence
  Synthetic
cccucaagcccctcccut

SEQ ID NO: 55253 - DNA, 21 bp, Artificial Sequence
  Synthetic
tccttccucgacctcctctug

SEQ ID NO: 55254 - DNA, 23 bp, Artificial Sequence
  Synthetic
cgctatgaucgggttctcttcug

SEQ ID NO: 55255 - DNA, 19 bp, Artificial Sequence
  Synthetic
ccccttucaattgcugcga

SEQ ID NO: 55256 - DNA, 20 bp, Artificial Sequence
  Synthetic
ggccguccaagggagtuaag

SEQ ID NO: 55257 - DNA, 26 bp, Artificial Sequence
  Synthetic
actttctgacugtttagactccucgt

SEQ ID NO: 55258 - DNA, 23 bp, Artificial Sequence
  Synthetic
gctgtgaaguggaaggaaaaugt

SEQ ID NO: 55259 - DNA, 25 bp, Artificial Sequence
  Synthetic
gcagccacaautggtattttuggat

SEQ ID NO: 55260 - DNA, 25 bp, Artificial Sequence
  Synthetic
ggatgaaatcatuccagtgctccut

SEQ ID NO: 55261 - DNA, 25 bp, Artificial Sequence
  Synthetic
cctactgtgacutgcactagtcaut

SEQ ID NO: 55262 - DNA, 23 bp, Artificial Sequence
  Synthetic
gcaactttacuggtgcacucact

SEQ ID NO: 55263 - DNA, 23 bp, Artificial Sequence
  Synthetic
tgtggacagaagcaaugttcuga

SEQ ID NO: 55264 - DNA, 21 bp, Artificial Sequence
  Synthetic
tcatagcucccaccagaguga

SEQ ID NO: 55265 - DNA, 29 bp, Artificial Sequence
  Synthetic
ctttaggttcuctggactttatttugcat

SEQ ID NO: 55266 - DNA, 21 bp, Artificial Sequence
  Synthetic
gcccaaugatcuggcacaaag

SEQ ID NO: 55267 - DNA, 26 bp, Artificial Sequence
  Synthetic
tggttctttccuaatggtgactgtut

SEQ ID NO: 55268 - DNA, 23 bp, Artificial Sequence
  Synthetic
tccagaagugaaaggagcuacca

SEQ ID NO: 55269 - DNA, 19 bp, Artificial Sequence
  Synthetic
acaccgutcttcagugcgt

SEQ ID NO: 55270 - DNA, 21 bp, Artificial Sequence
  Synthetic
ggcaggtcugctggtcaauat

SEQ ID NO: 55271 - DNA, 23 bp, Artificial Sequence
  Synthetic
gaccccacuacctgtcagtttut

SEQ ID NO: 55272 - DNA, 22 bp, Artificial Sequence
  Synthetic
ggcttguggaggagagagaaut

SEQ ID NO: 55273 - DNA, 23 bp, Artificial Sequence
  Synthetic
tttttcagcuggcagttcgatug

SEQ ID NO: 55274 - DNA, 21 bp, Artificial Sequence
  Synthetic
cggacagcaccucgtucaaat

SEQ ID NO: 55275 - DNA, 26 bp, Artificial Sequence
  Synthetic
catctggugggagacttctucaaaaa

SEQ ID NO: 55276 - DNA, 25 bp, Artificial Sequence
  Synthetic
ctcatcctgtcuggtcttcctatuc

SEQ ID NO: 55277 - DNA, 25 bp, Artificial Sequence
  Synthetic
tctatgcagccugagatttcttucc

SEQ ID NO: 55278 - DNA, 26 bp, Artificial Sequence
  Synthetic
cattctactgaccugccaaaaguagt

SEQ ID NO: 55279 - DNA, 27 bp, Artificial Sequence
  Synthetic
tgctccaaucaaaactgaaaatgctut

SEQ ID NO: 55280 - DNA, 22 bp, Artificial Sequence
  Synthetic
gtttgccagcugaaactucagg

SEQ ID NO: 55281 - DNA, 25 bp, Artificial Sequence
  Synthetic
tcagcaaaacguaaccctcacttua

SEQ ID NO: 55282 - DNA, 27 bp, Artificial Sequence
  Synthetic
gagtgaaguagaacgtaggaatgugaa

SEQ ID NO: 55283 - DNA, 28 bp, Artificial Sequence
  Synthetic
tccaaggcagugaaaaactatcacatua

SEQ ID NO: 55284 - DNA, 28 bp, Artificial Sequence
  Synthetic
ggtcccatagtuatgccatattgtctua

SEQ ID NO: 55285 - DNA, 28 bp, Artificial Sequence
  Synthetic
cttggaagaauccattaccctaucaagt

SEQ ID NO: 55286 - DNA, 24 bp, Artificial Sequence
  Synthetic
accaugaccagagcaaaattcuga

SEQ ID NO: 55287 - DNA, 23 bp, Artificial Sequence
  Synthetic
gugcaaaauaccacaacggaaga

SEQ ID NO: 55288 - DNA, 22 bp, Artificial Sequence
  Synthetic
aaagugagaaaagcaccccuca

SEQ ID NO: 55289 - DNA, 21 bp, Artificial Sequence
  Synthetic
cgaagugccacctatgcuagt

SEQ ID NO: 55290 - DNA, 23 bp, Artificial Sequence
  Synthetic
agctttgcuacagtgagcttcut

SEQ ID NO: 55291 - DNA, 27 bp, Artificial Sequence
  Synthetic
aggttttaacagtugggatcaatgcua

SEQ ID NO: 55292 - DNA, 26 bp, Artificial Sequence
  Synthetic
agacaatatggcugagttcttucgac

SEQ ID NO: 55293 - DNA, 28 bp, Artificial Sequence
  Synthetic
tgctagtgaagaagutgttggttuaaca

SEQ ID NO: 55294 - DNA, 21 bp, Artificial Sequence
  Synthetic
gcggtcctuacctaggtcucc

SEQ ID NO: 55295 - DNA, 23 bp, Artificial Sequence
  Synthetic
gccaggtacaucgacttcctcua

SEQ ID NO: 55296 - DNA, 28 bp, Artificial Sequence
  Synthetic
ggtggctgtuaacatcttaaagacttuc

SEQ ID NO: 55297 - DNA, 21 bp, Artificial Sequence
  Synthetic
gcttttugcacccacctucaa

SEQ ID NO: 55298 - DNA, 21 bp, Artificial Sequence
  Synthetic
cacggccccguattgtactut

SEQ ID NO: 55299 - DNA, 29 bp, Artificial Sequence
  Synthetic
ggttgcaccuccataacacagtatuaaat

SEQ ID NO: 55300 - DNA, 27 bp, Artificial Sequence
  Synthetic
agatgaagcttutcaagatggtaaugg

SEQ ID NO: 55301 - DNA, 27 bp, Artificial Sequence
  Synthetic
acatatgttcggutcagtgttcucaaa

SEQ ID NO: 55302 - DNA, 23 bp, Artificial Sequence
  Synthetic
gctgtccacuctctagggcttua

SEQ ID NO: 55303 - DNA, 23 bp, Artificial Sequence
  Synthetic
gtgcagtuaactatggcugggaa

SEQ ID NO: 55304 - DNA, 27 bp, Artificial Sequence
  Synthetic
agtcaaacaguaggataaatgcagcut

SEQ ID NO: 55305 - DNA, 28 bp, Artificial Sequence
  Synthetic
agtgttcatucaccacttttagacagut

SEQ ID NO: 55306 - DNA, 25 bp, Artificial Sequence
  Synthetic
cctacctagautatgcaggcuacca

SEQ ID NO: 55307 - DNA, 24 bp, Artificial Sequence
  Synthetic
aaggaaggaaagacccuctaccut

SEQ ID NO: 55308 - DNA, 25 bp, Artificial Sequence
  Synthetic
cttcaaaagaaautctgcgcuggaa

SEQ ID NO: 55309 - DNA, 26 bp, Artificial Sequence
  Synthetic
gtatctttcttucctggaccaugagg

SEQ ID NO: 55310 - DNA, 25 bp, Artificial Sequence
  Synthetic
tgaagtaccaugtttacugcaccat

SEQ ID NO: 55311 - DNA, 26 bp, Artificial Sequence
  Synthetic
cctaaccaaaccutaaccttctcuga

SEQ ID NO: 55312 - DNA, 26 bp, Artificial Sequence
  Synthetic
gccatcagcautattcttgttuccat

SEQ ID NO: 55313 - DNA, 24 bp, Artificial Sequence
  Synthetic
ctgggtgtguggaagtttcatgua

SEQ ID NO: 55314 - DNA, 28 bp, Artificial Sequence
  Synthetic
gaagaccttgtugaagaattgagcttut

SEQ ID NO: 55315 - DNA, 27 bp, Artificial Sequence
  Synthetic
tgcagaaacaauctcagctttcaaauc

SEQ ID NO: 55316 - DNA, 28 bp, Artificial Sequence
  Synthetic
ccaaggagaagutgaagaacaaacatut

SEQ ID NO: 55317 - DNA, 30 bp, Artificial Sequence
  Synthetic
aggacaaaguctattacatugaaacaacca

SEQ ID NO: 55318 - DNA, 21 bp, Artificial Sequence
  Synthetic
ctctgtgagaugtgcgucagt

SEQ ID NO: 55319 - DNA, 28 bp, Artificial Sequence
  Synthetic
gtgagtatacaaaaugacccaggttcut

SEQ ID NO: 55320 - DNA, 21 bp, Artificial Sequence
  Synthetic
cctcugcagcttggguagaac

SEQ ID NO: 55321 - DNA, 22 bp, Artificial Sequence
  Synthetic
ggagaaaucaccactggtccuc

SEQ ID NO: 55322 - DNA, 23 bp, Artificial Sequence
  Synthetic
ggaccgaaccauctttgtgcaua

SEQ ID NO: 55323 - DNA, 32 bp, Artificial Sequence
  Synthetic
tgtgcaatttatgautactccaatagacugat

SEQ ID NO: 55324 - DNA, 23 bp, Artificial Sequence
  Synthetic
tcctaacugagacctuacaccgt

SEQ ID NO: 55325 - DNA, 26 bp, Artificial Sequence
  Synthetic
agaatcctctucgatgccattcatut

SEQ ID NO: 55326 - DNA, 28 bp, Artificial Sequence
  Synthetic
ctgtcaaggtugtaaatagactttugct

SEQ ID NO: 55327 - DNA, 23 bp, Artificial Sequence
  Synthetic
caagctucccaggaaactgtuct

SEQ ID NO: 55328 - DNA, 20 bp, Artificial Sequence
  Synthetic
gtctgtttguggcggaucct

SEQ ID NO: 55329 - DNA, 19 bp, Artificial Sequence
  Synthetic
gaggugcgagccttcugaa

SEQ ID NO: 55330 - DNA, 19 bp, Artificial Sequence
  Synthetic
aaggaccgggugtcaccua

SEQ ID NO: 55331 - DNA, 17 bp, Artificial Sequence
  Synthetic
ggugcaggugaggcagt

SEQ ID NO: 55332 - DNA, 27 bp, Artificial Sequence
  Synthetic
tgcttaccccuccatgtttcaatttua

SEQ ID NO: 55333 - DNA, 24 bp, Artificial Sequence
  Synthetic
ccgccucattttctaatugcgaat

SEQ ID NO: 55334 - DNA, 24 bp, Artificial Sequence
  Synthetic
gttgaatuccaaaccggcatcuat

SEQ ID NO: 55335 - DNA, 28 bp, Artificial Sequence
  Synthetic
gttttgtttcucctctttttctucaggt

SEQ ID NO: 55336 - DNA, 21 bp, Artificial Sequence
  Synthetic
gaggagaugcgtcccaucaag

SEQ ID NO: 55337 - DNA, 20 bp, Artificial Sequence
  Synthetic
tcttccuagcgcagagggua

SEQ ID NO: 55338 - DNA, 22 bp, Artificial Sequence
  Synthetic
agacaggcaugggaguagagac

SEQ ID NO: 55339 - DNA, 20 bp, Artificial Sequence
  Synthetic
agtctgccacutccggagua

SEQ ID NO: 55340 - DNA, 21 bp, Artificial Sequence
  Synthetic
tcccatctcuccatccctcug

SEQ ID NO: 55341 - DNA, 23 bp, Artificial Sequence
  Synthetic
agtcagcugaagcgtaacactut

SEQ ID NO: 55342 - DNA, 28 bp, Artificial Sequence
  Synthetic
gttaaaaagctucacagtttgtcctugt

SEQ ID NO: 55343 - DNA, 28 bp, Artificial Sequence
  Synthetic
ccccagtagtugaatcttcaaaggauaa

SEQ ID NO: 55344 - DNA, 25 bp, Artificial Sequence
  Synthetic
tgtaatgugtacatggugccagaat

SEQ ID NO: 55345 - DNA, 28 bp, Artificial Sequence
  Synthetic
acataaattacucacaacttccucagca

SEQ ID NO: 55346 - DNA, 22 bp, Artificial Sequence
  Synthetic
agccgaacagaaugaugagcaa

SEQ ID NO: 55347 - DNA, 20 bp, Artificial Sequence
  Synthetic
cacaaaggautgcccaugcc

SEQ ID NO: 55348 - DNA, 25 bp, Artificial Sequence
  Synthetic
cctctgttttcaugcctgattccua

SEQ ID NO: 55349 - DNA, 25 bp, Artificial Sequence
  Synthetic
ccaagaaaugaagcaagcugaagag

SEQ ID NO: 55350 - DNA, 23 bp, Artificial Sequence
  Synthetic
gttgtctttcagugaagccgaug

SEQ ID NO: 55351 - DNA, 24 bp, Artificial Sequence
  Synthetic
agaccaagccauacagttgagaug

SEQ ID NO: 55352 - DNA, 23 bp, Artificial Sequence
  Synthetic
cctccagtcauctcatctgcuca

SEQ ID NO: 55353 - DNA, 21 bp, Artificial Sequence
  Synthetic
gccgaccucaacaccttucag

SEQ ID NO: 55354 - DNA, 22 bp, Artificial Sequence
  Synthetic
cctugccaaaagcugccaaaat

SEQ ID NO: 55355 - DNA, 21 bp, Artificial Sequence
  Synthetic
caacgacaccauccaccaaug

SEQ ID NO: 55356 - DNA, 26 bp, Artificial Sequence
  Synthetic
taattatcccugcaccaatcauacac

SEQ ID NO: 55357 - DNA, 24 bp, Artificial Sequence
  Synthetic
aaucaaagugacccagaagaagca

SEQ ID NO: 55358 - DNA, 21 bp, Artificial Sequence
  Synthetic
gggagaggcaucaaatcaguc

SEQ ID NO: 55359 - DNA, 27 bp, Artificial Sequence
  Synthetic
gaacatctcacagcauttccatcttut

SEQ ID NO: 55360 - DNA, 22 bp, Artificial Sequence
  Synthetic
caaucacctttucccccacagt

SEQ ID NO: 55361 - DNA, 26 bp, Artificial Sequence
  Synthetic
tctgtttccttcucttgtatcccuct

SEQ ID NO: 55362 - DNA, 22 bp, Artificial Sequence
  Synthetic
gggctttcugtatgcttgucca

SEQ ID NO: 55363 - DNA, 24 bp, Artificial Sequence
  Synthetic
tctccgaaacuggaagagguacaa

SEQ ID NO: 55364 - DNA, 21 bp, Artificial Sequence
  Synthetic
gctgagctccuctgctgagua

SEQ ID NO: 55365 - DNA, 22 bp, Artificial Sequence
  Synthetic
caggtcuaagcggccttcuaag

SEQ ID NO: 55366 - DNA, 23 bp, Artificial Sequence
  Synthetic
ctcggttatcutttctcccguca

SEQ ID NO: 55367 - DNA, 22 bp, Artificial Sequence
  Synthetic
cccagaaccaaagcutcaucac

SEQ ID NO: 55368 - DNA, 22 bp, Artificial Sequence
  Synthetic
ggctgggccauatgatatcuga

SEQ ID NO: 55369 - DNA, 24 bp, Artificial Sequence
  Synthetic
gtgactgcttutccttctcacuct

SEQ ID NO: 55370 - DNA, 23 bp, Artificial Sequence
  Synthetic
gttctcaauagccagcccucaaa

SEQ ID NO: 55371 - DNA, 25 bp, Artificial Sequence
  Synthetic
tcacaatttcccutcctttctugct

SEQ ID NO: 55372 - DNA, 22 bp, Artificial Sequence
  Synthetic
gccatcaguccctgggtaacua

SEQ ID NO: 55373 - DNA, 28 bp, Artificial Sequence
  Synthetic
gcatcagctattugtgaactagatcugt

SEQ ID NO: 55374 - DNA, 22 bp, Artificial Sequence
  Synthetic
cctactgtgaccucagccacua

SEQ ID NO: 55375 - DNA, 24 bp, Artificial Sequence
  Synthetic
ccacatactgcuctctctttcucc

SEQ ID NO: 55376 - DNA, 21 bp, Artificial Sequence
  Synthetic
gggagaugcccagctacgaua

SEQ ID NO: 55377 - DNA, 24 bp, Artificial Sequence
  Synthetic
gcagggagggaaugagaaaatguc

SEQ ID NO: 55378 - DNA, 21 bp, Artificial Sequence
  Synthetic
cccttcctgugttctcgaguc

SEQ ID NO: 55379 - DNA, 26 bp, Artificial Sequence
  Synthetic
aatttccttgaaaacaugcagcagut

SEQ ID NO: 55380 - DNA, 22 bp, Artificial Sequence
  Synthetic
ctctcagaauggtgguggagaa

SEQ ID NO: 55381 - DNA, 21 bp, Artificial Sequence
  Synthetic
ccaagaaaguggctgaacguc

SEQ ID NO: 55382 - DNA, 20 bp, Artificial Sequence
  Synthetic
tggaaaugcuccccggaaat

SEQ ID NO: 55383 - DNA, 21 bp, Artificial Sequence
  Synthetic
ctugggagctaguaggcaagg

SEQ ID NO: 55384 - DNA, 28 bp, Artificial Sequence
  Synthetic
cgattcctctttuatcagctaatccuct

SEQ ID NO: 55385 - DNA, 23 bp, Artificial Sequence
  Synthetic
ccaagcugacacttcaatugcat

SEQ ID NO: 55386 - DNA, 30 bp, Artificial Sequence
  Synthetic
tcaagtattatacuagtgagatcgacauga

SEQ ID NO: 55387 - DNA, 26 bp, Artificial Sequence
  Synthetic
ctggccaggaauatggacaagatuat

SEQ ID NO: 55388 - DNA, 25 bp, Artificial Sequence
  Synthetic
ctttttgaaggaacucggagatugg

SEQ ID NO: 55389 - DNA, 28 bp, Artificial Sequence
  Synthetic
cttatagcguaaagacaatgaccaggua

SEQ ID NO: 55390 - DNA, 21 bp, Artificial Sequence
  Synthetic
cctgtccagugctttcccuaa

SEQ ID NO: 55391 - DNA, 28 bp, Artificial Sequence
  Synthetic
tttgacagccutaaaagctgtttucaat

SEQ ID NO: 55392 - DNA, 28 bp, Artificial Sequence
  Synthetic
acttacatctuctatgtccttguccaga

SEQ ID NO: 55393 - DNA, 28 bp, Artificial Sequence
  Synthetic
cggtctacacautgaaatactggaugaa

SEQ ID NO: 55394 - DNA, 24 bp, Artificial Sequence
  Synthetic
cccttgtacutgctttgctcucat

SEQ ID NO: 55395 - DNA, 20 bp, Artificial Sequence
  Synthetic
cgttgaccgugagctgguag

SEQ ID NO: 55396 - DNA, 19 bp, Artificial Sequence
  Synthetic
cccaggaccaacgucugag

SEQ ID NO: 55397 - DNA, 24 bp, Artificial Sequence
  Synthetic
ctgttgaggcugtagaacttgtug

SEQ ID NO: 55398 - DNA, 23 bp, Artificial Sequence
  Synthetic
tgcttaaaacacugcacucccaa

SEQ ID NO: 55399 - DNA, 22 bp, Artificial Sequence
  Synthetic
aacactucgccaatggagucat

SEQ ID NO: 55400 - DNA, 21 bp, Artificial Sequence
  Synthetic
tgagaaugauaacgcgcccat

SEQ ID NO: 55401 - DNA, 22 bp, Artificial Sequence
  Synthetic
ccttgtctugatcctgccauca

SEQ ID NO: 55402 - DNA, 21 bp, Artificial Sequence
  Synthetic
cgggacugggagttcttcauc

SEQ ID NO: 55403 - DNA, 21 bp, Artificial Sequence
  Synthetic
agttccccuagggacttucca

SEQ ID NO: 55404 - DNA, 20 bp, Artificial Sequence
  Synthetic
cctcugcaccaaaggcaauc

SEQ ID NO: 55405 - DNA, 22 bp, Artificial Sequence
  Synthetic
cctggccauatagtgccttuca

SEQ ID NO: 55406 - DNA, 21 bp, Artificial Sequence
  Synthetic
ctgcggcucaaaaagctctut

SEQ ID NO: 55407 - DNA, 21 bp, Artificial Sequence
  Synthetic
ccacccautgctgtcttuggt

SEQ ID NO: 55408 - DNA, 20 bp, Artificial Sequence
  Synthetic
aaauccacaccccugcacaa

SEQ ID NO: 55409 - DNA, 19 bp, Artificial Sequence
  Synthetic
agccaaggutguccccaag

SEQ ID NO: 55410 - DNA, 33 bp, Artificial Sequence
  Synthetic
tatattgtgaaggcauattatgtgagtaaucct

SEQ ID NO: 55411 - DNA, 25 bp, Artificial Sequence
  Synthetic
cagtggttugaacagtctctttucc

SEQ ID NO: 55412 - DNA, 21 bp, Artificial Sequence
  Synthetic
gcaggccaucagacagatcut

SEQ ID NO: 55413 - DNA, 23 bp, Artificial Sequence
  Synthetic
cccactacugctctguaaggaca

SEQ ID NO: 55414 - DNA, 21 bp, Artificial Sequence
  Synthetic
cagtgccugcatctaccuaca

SEQ ID NO: 55415 - DNA, 21 bp, Artificial Sequence
  Synthetic
gggtgcagggutatagtuggg

SEQ ID NO: 55416 - DNA, 26 bp, Artificial Sequence
  Synthetic
ggtcttcacuctgcttttcattucag

SEQ ID NO: 55417 - DNA, 22 bp, Artificial Sequence
  Synthetic
cctccugcctcttcucagaaag

SEQ ID NO: 55418 - DNA, 18 bp, Artificial Sequence
  Synthetic
gggccuggccaagaagug

SEQ ID NO: 55419 - DNA, 19 bp, Artificial Sequence
  Synthetic
cgcgugctgtagauggaga

SEQ ID NO: 55420 - DNA, 21 bp, Artificial Sequence
  Synthetic
cactccaaguggtcacctgut

SEQ ID NO: 55421 - DNA, 23 bp, Artificial Sequence
  Synthetic
tccctaaggccugttttcctcua

SEQ ID NO: 55422 - DNA, 21 bp, Artificial Sequence
  Synthetic
ccatggaccugaccagguact

SEQ ID NO: 55423 - DNA, 25 bp, Artificial Sequence
  Synthetic
gccaagaccuattggtaacauccaa

SEQ ID NO: 55424 - DNA, 23 bp, Artificial Sequence
  Synthetic
cacagugggtcattcugaagaca

SEQ ID NO: 55425 - DNA, 23 bp, Artificial Sequence
  Synthetic
tcaaatgtgcccuttgtcctcuc

SEQ ID NO: 55426 - DNA, 23 bp, Artificial Sequence
  Synthetic
gatggagtuagccttccaaguga

SEQ ID NO: 55427 - DNA, 28 bp, Artificial Sequence
  Synthetic
agctgaactgtguctcatcattttgtua

SEQ ID NO: 55428 - DNA, 23 bp, Artificial Sequence
  Synthetic
gggaugagagaaccagguaaact

SEQ ID NO: 55429 - DNA, 24 bp, Artificial Sequence
  Synthetic
aaacatgccaauctgcatttgugt

SEQ ID NO: 55430 - DNA, 21 bp, Artificial Sequence
  Synthetic
gcaaggttucctcggaagugg

SEQ ID NO: 55431 - DNA, 25 bp, Artificial Sequence
  Synthetic
tccgtgattcugcttctatctcuct

SEQ ID NO: 55432 - DNA, 20 bp, Artificial Sequence
  Synthetic
gcagagcgcugtaggtgtut

SEQ ID NO: 55433 - DNA, 24 bp, Artificial Sequence
  Synthetic
tgtcuaccaaccaatuccacaacc

SEQ ID NO: 55434 - DNA, 20 bp, Artificial Sequence
  Synthetic
cuggacaagcatcuccggaa

SEQ ID NO: 55435 - DNA, 25 bp, Artificial Sequence
  Synthetic
gatcgccatacuggtttcatctuca

SEQ ID NO: 55436 - DNA, 21 bp, Artificial Sequence
  Synthetic
ctgttggugacaggactuggt

SEQ ID NO: 55437 - DNA, 22 bp, Artificial Sequence
  Synthetic
gccagagcucatcatuggcaat

SEQ ID NO: 55438 - DNA, 20 bp, Artificial Sequence
  Synthetic
tcggcaccacguagguagaa

SEQ ID NO: 55439 - DNA, 20 bp, Artificial Sequence
  Synthetic
gtcagctccuctgctcccua

SEQ ID NO: 55440 - DNA, 23 bp, Artificial Sequence
  Synthetic
acataatgtcugcagagccctut

SEQ ID NO: 55441 - DNA, 22 bp, Artificial Sequence
  Synthetic
gggattcuggacttcagcucac

SEQ ID NO: 55442 - DNA, 22 bp, Artificial Sequence
  Synthetic
cagcaaaggcutttgagaccug

SEQ ID NO: 55443 - DNA, 20 bp, Artificial Sequence
  Synthetic
caccacgacucccatcugat

SEQ ID NO: 55444 - DNA, 22 bp, Artificial Sequence
  Synthetic
tgagactctcuctcgcccauag

SEQ ID NO: 55445 - DNA, 22 bp, Artificial Sequence
  Synthetic
cctttcgaucatctcccugcat

SEQ ID NO: 55446 - DNA, 21 bp, Artificial Sequence
  Synthetic
ctttgccagugacacccuact

SEQ ID NO: 55447 - DNA, 21 bp, Artificial Sequence
  Synthetic
tgggtctautcctgcauccct

SEQ ID NO: 55448 - DNA, 22 bp, Artificial Sequence
  Synthetic
ctttcugagcctttgtcugggt

SEQ ID NO: 55449 - DNA, 20 bp, Artificial Sequence
  Synthetic
cggatucggatggtcuccat

SEQ ID NO: 55450 - DNA, 22 bp, Artificial Sequence
  Synthetic
gccaggtcautttgacagctut

SEQ ID NO: 55451 - DNA, 22 bp, Artificial Sequence
  Synthetic
cagggatctuctcactgccauc

SEQ ID NO: 55452 - DNA, 22 bp, Artificial Sequence
  Synthetic
agctggugcatttgactcugaa

SEQ ID NO: 55453 - DNA, 22 bp, Artificial Sequence
  Synthetic
aacccactcaugttgtcctguc

SEQ ID NO: 55454 - DNA, 19 bp, Artificial Sequence
  Synthetic
ctacgccccguactgugag

SEQ ID NO: 55455 - DNA, 24 bp, Artificial Sequence
  Synthetic
ccacagaaucucaaagcagggaat

SEQ ID NO: 55456 - DNA, 21 bp, Artificial Sequence
  Synthetic
gaatcagugagaagccugggt

SEQ ID NO: 55457 - DNA, 24 bp, Artificial Sequence
  Synthetic
caggatcatcucagagccataguc

SEQ ID NO: 55458 - DNA, 20 bp, Artificial Sequence
  Synthetic
ctgttcuccgtgttggucct

SEQ ID NO: 55459 - DNA, 26 bp, Artificial Sequence
  Synthetic
gggccacaacauacttagatctctuc

SEQ ID NO: 55460 - DNA, 23 bp, Artificial Sequence
  Synthetic
gcaucaaugagaggaccaagcag

SEQ ID NO: 55461 - DNA, 24 bp, Artificial Sequence
  Synthetic
tgtgtgucccataagaucccaaga

SEQ ID NO: 55462 - DNA, 23 bp, Artificial Sequence
  Synthetic
gaggcatatgugcagatccugaa

SEQ ID NO: 55463 - DNA, 21 bp, Artificial Sequence
  Synthetic
tgtgugaggaaggactgcauc

SEQ ID NO: 55464 - DNA, 21 bp, Artificial Sequence
  Synthetic
gccttaggugggaaggucaga

SEQ ID NO: 55465 - DNA, 20 bp, Artificial Sequence
  Synthetic
gccucagatgaucccaggac

SEQ ID NO: 55466 - DNA, 29 bp, Artificial Sequence
  Synthetic
ctgcaaattuatatccatcauccgaaagg

SEQ ID NO: 55467 - DNA, 28 bp, Artificial Sequence
  Synthetic
accagagaaauccagaggaaagtcauat

SEQ ID NO: 55468 - DNA, 25 bp, Artificial Sequence
  Synthetic
actatatatggcugttgtgccctuc

SEQ ID NO: 55469 - DNA, 25 bp, Artificial Sequence
  Synthetic
ggtcugagcagtagtuacacacaaa

SEQ ID NO: 55470 - DNA, 22 bp, Artificial Sequence
  Synthetic
ccagctgtcutcgacacttcuc

SEQ ID NO: 55471 - DNA, 27 bp, Artificial Sequence
  Synthetic
atcctgtaaagugcttttagtgggaut

SEQ ID NO: 55472 - DNA, 28 bp, Artificial Sequence
  Synthetic
ttaaattggtugtgttttctugaaggca

SEQ ID NO: 55473 - DNA, 26 bp, Artificial Sequence
  Synthetic
cctacttccuctttggctctttucag

SEQ ID NO: 55474 - DNA, 20 bp, Artificial Sequence
  Synthetic
acgctcuacccactgcagua

SEQ ID NO: 55475 - DNA, 28 bp, Artificial Sequence
  Synthetic
gctacctctgguttagtcagaaatucat

SEQ ID NO: 55476 - DNA, 27 bp, Artificial Sequence
  Synthetic
ggacttggugatagacatguacagaat

SEQ ID NO: 55477 - DNA, 28 bp, Artificial Sequence
  Synthetic
gcaaacaacatuccatgatgaccaaaua

SEQ ID NO: 55478 - DNA, 24 bp, Artificial Sequence
  Synthetic
ctcaaggaaacaugaagtgugcat

SEQ ID NO: 55479 - DNA, 27 bp, Artificial Sequence
  Synthetic
cctctgctguaaatacaaagcttucaa

SEQ ID NO: 55480 - DNA, 22 bp, Artificial Sequence
  Synthetic
ggttttggguttgctgttgguc

SEQ ID NO: 55481 - DNA, 21 bp, Artificial Sequence
  Synthetic
gcagcagcaaaggauacagut

SEQ ID NO: 55482 - DNA, 21 bp, Artificial Sequence
  Synthetic
gtcgcuaacacacatgcucct

SEQ ID NO: 55483 - DNA, 22 bp, Artificial Sequence
  Synthetic
agaaagcgacagaggaugcaut

SEQ ID NO: 55484 - DNA, 23 bp, Artificial Sequence
  Synthetic
gtacaagaacugtgagcuggaca

SEQ ID NO: 55485 - DNA, 26 bp, Artificial Sequence
  Synthetic
ttgaggaauagagagacgatcucagt

SEQ ID NO: 55486 - DNA, 23 bp, Artificial Sequence
  Synthetic
aagacaccguggatguaaaacca

SEQ ID NO: 55487 - DNA, 17 bp, Artificial Sequence
  Synthetic
aggagcugcaggcugac

SEQ ID NO: 55488 - DNA, 22 bp, Artificial Sequence
  Synthetic
ccctcatccuccattcccatuc

SEQ ID NO: 55489 - DNA, 23 bp, Artificial Sequence
  Synthetic
gacactagcucctagatccucct

SEQ ID NO: 55490 - DNA, 21 bp, Artificial Sequence
  Synthetic
actatguccacacuggagcct

SEQ ID NO: 55491 - DNA, 22 bp, Artificial Sequence
  Synthetic
gcacctcguagtcagcaaugat

SEQ ID NO: 55492 - DNA, 21 bp, Artificial Sequence
  Synthetic
ggaggugagcaggagaggaut

SEQ ID NO: 55493 - DNA, 22 bp, Artificial Sequence
  Synthetic
cagtaaucagaagggccagcuc

SEQ ID NO: 55494 - DNA, 23 bp, Artificial Sequence
  Synthetic
gctgacugaagttgaacttuccc

SEQ ID NO: 55495 - DNA, 28 bp, Artificial Sequence
  Synthetic
gccaaaagacaugactgttcctatacua

SEQ ID NO: 55496 - DNA, 27 bp, Artificial Sequence
  Synthetic
cgactagtgauggtaacagaagcttua

SEQ ID NO: 55497 - DNA, 30 bp, Artificial Sequence
  Synthetic
tgactgtttccauaaaagtgtctcattuct

SEQ ID NO: 55498 - DNA, 26 bp, Artificial Sequence
  Synthetic
ccatctatgutccagagtcucaggat

SEQ ID NO: 55499 - DNA, 17 bp, Artificial Sequence
  Synthetic
gggaagcugguccacct

SEQ ID NO: 55500 - DNA, 25 bp, Artificial Sequence
  Synthetic
aaactaatgaucatggcagaugcct

SEQ ID NO: 55501 - DNA, 28 bp, Artificial Sequence
  Synthetic
gtttctgaaaccauctctcttgatgcua

SEQ ID NO: 55502 - DNA, 27 bp, Artificial Sequence
  Synthetic
cataccgguaacatcaacataguacca

SEQ ID NO: 55503 - DNA, 20 bp, Artificial Sequence
  Synthetic
gguggaaagggcaaaugcaa

SEQ ID NO: 55504 - DNA, 28 bp, Artificial Sequence
  Synthetic
ccctctggagaautgtgaaaatctagug

SEQ ID NO: 55505 - DNA, 26 bp, Artificial Sequence
  Synthetic
agggaagcauggcaagtgataaauag

SEQ ID NO: 55506 - DNA, 23 bp, Artificial Sequence
  Synthetic
ctgcctatutcacctccucagat

SEQ ID NO: 55507 - DNA, 26 bp, Artificial Sequence
  Synthetic
ggttactcaacuctcttgaatccugt

SEQ ID NO: 55508 - DNA, 22 bp, Artificial Sequence
  Synthetic
gaccacagacaaugttcccuct

SEQ ID NO: 55509 - DNA, 24 bp, Artificial Sequence
  Synthetic
gtatgtgtagacugtgctcagugt

SEQ ID NO: 55510 - DNA, 24 bp, Artificial Sequence
  Synthetic
gtgaaggagaugtcatcugagacc

SEQ ID NO: 55511 - DNA, 22 bp, Artificial Sequence
  Synthetic
tgcatctgautccccacttugt

SEQ ID NO: 55512 - DNA, 21 bp, Artificial Sequence
  Synthetic
ctcgucactcgattuggaacc

SEQ ID NO: 55513 - DNA, 24 bp, Artificial Sequence
  Synthetic
tgaacuaaaagccagcaggcauat

SEQ ID NO: 55514 - DNA, 21 bp, Artificial Sequence
  Synthetic
gaaggaaaccugtgggcugaa

SEQ ID NO: 55515 - DNA, 24 bp, Artificial Sequence
  Synthetic
gctctttgtccutcccactttuct

SEQ ID NO: 55516 - DNA, 22 bp, Artificial Sequence
  Synthetic
ctccgtcggutaacacgtacuc

SEQ ID NO: 55517 - DNA, 23 bp, Artificial Sequence
  Synthetic
cctgcactccutcaaagaggtua

SEQ ID NO: 55518 - DNA, 24 bp, Artificial Sequence
  Synthetic
caactttcagugggacatgcatut

SEQ ID NO: 55519 - DNA, 26 bp, Artificial Sequence
  Synthetic
caatggccucgtttctcaataucaat

SEQ ID NO: 55520 - DNA, 23 bp, Artificial Sequence
  Synthetic
gggtgaguggtaacatagguagg

SEQ ID NO: 55521 - DNA, 25 bp, Artificial Sequence
  Synthetic
ctgacccucacatcacttuaaccaa

SEQ ID NO: 55522 - DNA, 19 bp, Artificial Sequence
  Synthetic
ccgucgggcagtagctuat

SEQ ID NO: 55523 - DNA, 25 bp, Artificial Sequence
  Synthetic
tggactctuaacacactcagtccut

SEQ ID NO: 55524 - DNA, 22 bp, Artificial Sequence
  Synthetic
tgccguaggtagaagttuccct

SEQ ID NO: 55525 - DNA, 20 bp, Artificial Sequence
  Synthetic
gggcagugtgagugcaaaaa

SEQ ID NO: 55526 - DNA, 21 bp, Artificial Sequence
  Synthetic
cagccaucaggatccaacuct

SEQ ID NO: 55527 - DNA, 28 bp, Artificial Sequence
  Synthetic
ccctgtcttguacctaatgagcaaatua

SEQ ID NO: 55528 - DNA, 24 bp, Artificial Sequence
  Synthetic
cttggaaagcugaagacagtugac

SEQ ID NO: 55529 - DNA, 28 bp, Artificial Sequence
  Synthetic
atcatucagttctttaguccacaaccaa

SEQ ID NO: 55530 - DNA, 26 bp, Artificial Sequence
  Synthetic
gcatgaaguagcctaaugaagagcat

SEQ ID NO: 55531 - DNA, 21 bp, Artificial Sequence
  Synthetic
ggaccctgcugcttatctguc

SEQ ID NO: 55532 - DNA, 21 bp, Artificial Sequence
  Synthetic
gttatccgacuggtccucgaa

SEQ ID NO: 55533 - DNA, 24 bp, Artificial Sequence
  Synthetic
aggttgtccguggagaaguaaaag

SEQ ID NO: 55534 - DNA, 28 bp, Artificial Sequence
  Synthetic
acggtgacucagtatgctatauacaaca

SEQ ID NO: 55535 - DNA, 28 bp, Artificial Sequence
  Synthetic
atcagccaattatutttgacttgtgcut

SEQ ID NO: 55536 - DNA, 22 bp, Artificial Sequence
  Synthetic
tcttctttugcagcggctcuaa

SEQ ID NO: 55537 - DNA, 28 bp, Artificial Sequence
  Synthetic
acgaagcaaagaaaaauaggagtgauct

SEQ ID NO: 55538 - DNA, 20 bp, Artificial Sequence
  Synthetic
tgtggaccgcauttgggaut

SEQ ID NO: 55539 - DNA, 26 bp, Artificial Sequence
  Synthetic
ctgagaaccaaaagacutctgaguga

SEQ ID NO: 55540 - DNA, 24 bp, Artificial Sequence
  Synthetic
gtgtcattcuacctcagguggaac

SEQ ID NO: 55541 - DNA, 24 bp, Artificial Sequence
  Synthetic
aagtaattccgaccutggcagaut

SEQ ID NO: 55542 - DNA, 25 bp, Artificial Sequence
  Synthetic
agagccugaagaagcagaugaaaaa

SEQ ID NO: 55543 - DNA, 21 bp, Artificial Sequence
  Synthetic
gtctggcaugttggcuaacag

SEQ ID NO: 55544 - DNA, 25 bp, Artificial Sequence
  Synthetic
ccttctcgacautgctatgggatuc

SEQ ID NO: 55545 - DNA, 22 bp, Artificial Sequence
  Synthetic
guttagaacaggugcagaccct

SEQ ID NO: 55546 - DNA, 20 bp, Artificial Sequence
  Synthetic
cctgtgcttuccgatggcut

SEQ ID NO: 55547 - DNA, 21 bp, Artificial Sequence
  Synthetic
aaacccuctcaccugggagat

SEQ ID NO: 55548 - DNA, 20 bp, Artificial Sequence
  Synthetic
gcttcactgugctgctctuc

SEQ ID NO: 55549 - DNA, 21 bp, Artificial Sequence
  Synthetic
tgcaugcagccctctugaaat

SEQ ID NO: 55550 - DNA, 19 bp, Artificial Sequence
  Synthetic
gguggcaatuccccaaacc

SEQ ID NO: 55551 - DNA, 17 bp, Artificial Sequence
  Synthetic
tccucctcugggagcgt

SEQ ID NO: 55552 - DNA, 20 bp, Artificial Sequence
  Synthetic
ggtcctctugggcatggtug

SEQ ID NO: 55553 - DNA, 23 bp, Artificial Sequence
  Synthetic
agtgggacuggaaagtgacaaug

SEQ ID NO: 55554 - DNA, 27 bp, Artificial Sequence
  Synthetic
tcttactgggacaacauacaactccua

SEQ ID NO: 55555 - DNA, 23 bp, Artificial Sequence
  Synthetic
tctcccaaagguacaaagctguc

SEQ ID NO: 55556 - DNA, 26 bp, Artificial Sequence
  Synthetic
caaacacacacuctctctcattcuct

SEQ ID NO: 55557 - DNA, 23 bp, Artificial Sequence
  Synthetic
cggagaattgugtgtgcattcut

SEQ ID NO: 55558 - DNA, 20 bp, Artificial Sequence
  Synthetic
cggccagccautcctactuc

SEQ ID NO: 55559 - DNA, 22 bp, Artificial Sequence
  Synthetic
gccacatagutcagccaaguct

SEQ ID NO: 55560 - DNA, 21 bp, Artificial Sequence
  Synthetic
ggttggucacttctgugcaaa

SEQ ID NO: 55561 - DNA, 28 bp, Artificial Sequence
  Synthetic
agggaaggttgucatgtgtacaaauaaa

SEQ ID NO: 55562 - DNA, 27 bp, Artificial Sequence
  Synthetic
acaaaagggtcaucaaaacttcaaucc

SEQ ID NO: 55563 - DNA, 27 bp, Artificial Sequence
  Synthetic
gctccaaaugaacacttatacagcaut

SEQ ID NO: 55564 - DNA, 23 bp, Artificial Sequence
  Synthetic
agagucacacacacuggaagaga

SEQ ID NO: 55565 - DNA, 27 bp, Artificial Sequence
  Synthetic
gctctatttgcagugttaatgtgctut

SEQ ID NO: 55566 - DNA, 21 bp, Artificial Sequence
  Synthetic
cccctcacgutcactggaaut

SEQ ID NO: 55567 - DNA, 29 bp, Artificial Sequence
  Synthetic
gactcattttgcutttcttttcctcaugt

SEQ ID NO: 55568 - DNA, 21 bp, Artificial Sequence
  Synthetic
tcctaugaaccctctguccgt

SEQ ID NO: 55569 - DNA, 24 bp, Artificial Sequence
  Synthetic
agcagcatttauacgagtcgtgut

SEQ ID NO: 55570 - DNA, 25 bp, Artificial Sequence
  Synthetic
actttttgggagaaggutccactut

SEQ ID NO: 55571 - DNA, 28 bp, Artificial Sequence
  Synthetic
ccaaaacgaaguacattcttctcaugga

SEQ ID NO: 55572 - DNA, 26 bp, Artificial Sequence
  Synthetic
tctctcuacacaacaaaccatcucac

SEQ ID NO: 55573 - DNA, 20 bp, Artificial Sequence
  Synthetic
gggaaggaaugcccacuact

SEQ ID NO: 55574 - DNA, 20 bp, Artificial Sequence
  Synthetic
cctgagcgccaucagttuga

SEQ ID NO: 55575 - DNA, 21 bp, Artificial Sequence
  Synthetic
ccagaggugtacacagtgucc

SEQ ID NO: 55576 - DNA, 21 bp, Artificial Sequence
  Synthetic
tcuatgguggcgagccaaaag

SEQ ID NO: 55577 - DNA, 25 bp, Artificial Sequence
  Synthetic
ggatcgatctcuttcctggtgttug

SEQ ID NO: 55578 - DNA, 23 bp, Artificial Sequence
  Synthetic
ctggccagaaaagacuccttuaa

SEQ ID NO: 55579 - DNA, 25 bp, Artificial Sequence
  Synthetic
caaatgtgtggcuttcttctctucc

SEQ ID NO: 55580 - DNA, 21 bp, Artificial Sequence
  Synthetic
ctgaagacacugccccttgut

SEQ ID NO: 55581 - DNA, 23 bp, Artificial Sequence
  Synthetic
aacgtggcautttaccctcauct

SEQ ID NO: 55582 - DNA, 24 bp, Artificial Sequence
  Synthetic
ccaggaatuccctgcaaugaagaa

SEQ ID NO: 55583 - DNA, 24 bp, Artificial Sequence
  Synthetic
gctcttcacugacacgctttuact

SEQ ID NO: 55584 - DNA, 20 bp, Artificial Sequence
  Synthetic
gccttuggcctctcacugaa

SEQ ID NO: 55585 - DNA, 22 bp, Artificial Sequence
  Synthetic
gcaccggcuacagaatgagaua

SEQ ID NO: 55586 - DNA, 22 bp, Artificial Sequence
  Synthetic
cctctgtcucctcctcgtacug

SEQ ID NO: 55587 - DNA, 21 bp, Artificial Sequence
  Synthetic
tcaaacagugaggugccacat

SEQ ID NO: 55588 - DNA, 20 bp, Artificial Sequence
  Synthetic
gucaaaggcactcugggaca

SEQ ID NO: 55589 - DNA, 22 bp, Artificial Sequence
  Synthetic
tggtcaccaacaaucccuacga

SEQ ID NO: 55590 - DNA, 21 bp, Artificial Sequence
  Synthetic
gctcugggcacagauagacat

SEQ ID NO: 55591 - DNA, 22 bp, Artificial Sequence
  Synthetic
gatcatugccaagcugaccaag

SEQ ID NO: 55592 - DNA, 22 bp, Artificial Sequence
  Synthetic
ggagatgtccuaggaggtccug

SEQ ID NO: 55593 - DNA, 23 bp, Artificial Sequence
  Synthetic
ttcctgcatcuctttctggcaut

SEQ ID NO: 55594 - DNA, 21 bp, Artificial Sequence
  Synthetic
ccacagcaacauccucagagt

SEQ ID NO: 55595 - DNA, 24 bp, Artificial Sequence
  Synthetic
ggctgcagaagutctcatttgcua

SEQ ID NO: 55596 - DNA, 21 bp, Artificial Sequence
  Synthetic
ctgcaugagaagggtguccaa

SEQ ID NO: 55597 - DNA, 23 bp, Artificial Sequence
  Synthetic
gtcttacagcgucaatgucacct

SEQ ID NO: 55598 - DNA, 26 bp, Artificial Sequence
  Synthetic
tttctagggcaaugtgtcagtatucc

SEQ ID NO: 55599 - DNA, 31 bp, Artificial Sequence
  Synthetic
tggtttctttgatucttaatccttgatucca

SEQ ID NO: 55600 - DNA, 21 bp, Artificial Sequence
  Synthetic
cttcttggucaccctcaggut

SEQ ID NO: 55601 - DNA, 23 bp, Artificial Sequence
  Synthetic
aggcaugtttaacauccagcact

SEQ ID NO: 55602 - DNA, 21 bp, Artificial Sequence
  Synthetic
ggaggtgugcgtttacuggaa

SEQ ID NO: 55603 - DNA, 26 bp, Artificial Sequence
  Synthetic
gtgggactacuttcattttccuccat

SEQ ID NO: 55604 - DNA, 21 bp, Artificial Sequence
  Synthetic
ttcgagtgguaatggcctgug

SEQ ID NO: 55605 - DNA, 26 bp, Artificial Sequence
  Synthetic
acctctgtcatucaacgtttctgaut

SEQ ID NO: 55606 - DNA, 24 bp, Artificial Sequence
  Synthetic
gttctuacaggcaaaggaaugcag

SEQ ID NO: 55607 - DNA, 24 bp, Artificial Sequence
  Synthetic
cacagtcacgcugtatttcttuga

SEQ ID NO: 55608 - DNA, 28 bp, Artificial Sequence
  Synthetic
gtgtaatctaugcagtccttgauaagca

SEQ ID NO: 55609 - DNA, 26 bp, Artificial Sequence
  Synthetic
tgtgctgagccuttttctaaaucact

SEQ ID NO: 55610 - DNA, 23 bp, Artificial Sequence
  Synthetic
ccccaacugcaaagcataagaut

SEQ ID NO: 55611 - DNA, 20 bp, Artificial Sequence
  Synthetic
tggatgaaugccaggccauc

SEQ ID NO: 55612 - DNA, 25 bp, Artificial Sequence
  Synthetic
ctacagtguacttacgttguccaca

SEQ ID NO: 55613 - DNA, 28 bp, Artificial Sequence
  Synthetic
gagctgttgcaauctatgcatttaagut

SEQ ID NO: 55614 - DNA, 28 bp, Artificial Sequence
  Synthetic
gtgcttcatttucatcctctagtttucc

SEQ ID NO: 55615 - DNA, 25 bp, Artificial Sequence
  Synthetic
ttgttttgccaggutggtatucaac

SEQ ID NO: 55616 - DNA, 21 bp, Artificial Sequence
  Synthetic
ctgtcctgcutgaggtctcut

SEQ ID NO: 55617 - DNA, 24 bp, Artificial Sequence
  Synthetic
gcctagaatucagcccaagtttut

SEQ ID NO: 55618 - DNA, 25 bp, Artificial Sequence
  Synthetic
attccauccccgaaaacactaacut

SEQ ID NO: 55619 - DNA, 20 bp, Artificial Sequence
  Synthetic
caacagggaugcggttcuga

SEQ ID NO: 55620 - DNA, 21 bp, Artificial Sequence
  Synthetic
ggacacccaaugacccaguag

SEQ ID NO: 55621 - DNA, 23 bp, Artificial Sequence
  Synthetic
attccugttgacatuggagagca

SEQ ID NO: 55622 - DNA, 22 bp, Artificial Sequence
  Synthetic
ccaacctucccacatcatccut

SEQ ID NO: 55623 - DNA, 27 bp, Artificial Sequence
  Synthetic
cagatacccugaccataaatgaugacc

SEQ ID NO: 55624 - DNA, 23 bp, Artificial Sequence
  Synthetic
ccccttaagaccuagggaacuct

SEQ ID NO: 55625 - DNA, 24 bp, Artificial Sequence
  Synthetic
ttcactacttuggtccttggacug

SEQ ID NO: 55626 - DNA, 25 bp, Artificial Sequence
  Synthetic
ggttccttctucaccttcttagcut

SEQ ID NO: 55627 - DNA, 21 bp, Artificial Sequence
  Synthetic
gctgctcucaggagagaggua

SEQ ID NO: 55628 - DNA, 23 bp, Artificial Sequence
  Synthetic
gctcggucaaaggaaacattgug

SEQ ID NO: 55629 - DNA, 26 bp, Artificial Sequence
  Synthetic
agtttaatgtcuccatggtgaaccug

SEQ ID NO: 55630 - DNA, 19 bp, Artificial Sequence
  Synthetic
ccccugacacgcattgugt

SEQ ID NO: 55631 - DNA, 22 bp, Artificial Sequence
  Synthetic
aggactctcuaagccagtgugt

SEQ ID NO: 55632 - DNA, 19 bp, Artificial Sequence
  Synthetic
guactggccucaggccaaa

SEQ ID NO: 55633 - DNA, 18 bp, Artificial Sequence
  Synthetic
gtcccggugctcctugaa

SEQ ID NO: 55634 - DNA, 19 bp, Artificial Sequence
  Synthetic
aaagcaguagugccccaca

SEQ ID NO: 55635 - DNA, 19 bp, Artificial Sequence
  Synthetic
ggcgaucacagcgcaacua

SEQ ID NO: 55636 - DNA, 22 bp, Artificial Sequence
  Synthetic
ctttcctcuctgcactcuggat

SEQ ID NO: 55637 - DNA, 17 bp, Artificial Sequence
  Synthetic
cugacgcctcuggcaca

SEQ ID NO: 55638 - DNA, 18 bp, Artificial Sequence
  Synthetic
ggagcaggutgugggaga

SEQ ID NO: 55639 - DNA, 26 bp, Artificial Sequence
  Synthetic
ttcatttgggucttccaucagaaagt

SEQ ID NO: 55640 - DNA, 22 bp, Artificial Sequence
  Synthetic
ggagcctucatctgtactucgt

SEQ ID NO: 55641 - DNA, 20 bp, Artificial Sequence
  Synthetic
aatgccctaugctggctugt

SEQ ID NO: 55642 - DNA, 27 bp, Artificial Sequence
  Synthetic
atgtcactcutatgtgtcaucaccaaa

SEQ ID NO: 55643 - DNA, 22 bp, Artificial Sequence
  Synthetic
actgccatucactgtgttccuc

SEQ ID NO: 55644 - DNA, 22 bp, Artificial Sequence
  Synthetic
tgtgaaggcuccagagugaaga

SEQ ID NO: 55645 - DNA, 19 bp, Artificial Sequence
  Synthetic
agggtguggcttcaugacc

SEQ ID NO: 55646 - DNA, 22 bp, Artificial Sequence
  Synthetic
ggcttctcucatggaccucaac

SEQ ID NO: 55647 - DNA, 26 bp, Artificial Sequence
  Synthetic
ggacagagaaagugaaggagaaacuc

SEQ ID NO: 55648 - DNA, 20 bp, Artificial Sequence
  Synthetic
tcctccgugatgctgugaac

SEQ ID NO: 55649 - DNA, 26 bp, Artificial Sequence
  Synthetic
gtagguactttccaauaaccacacca

SEQ ID NO: 55650 - DNA, 20 bp, Artificial Sequence
  Synthetic
ccagctccutgcactttgut

SEQ ID NO: 55651 - DNA, 20 bp, Artificial Sequence
  Synthetic
cccutcugggagaggaggac

SEQ ID NO: 55652 - DNA, 22 bp, Artificial Sequence
  Synthetic
ggaaagaggccaaacugcugaa

SEQ ID NO: 55653 - DNA, 23 bp, Artificial Sequence
  Synthetic
aaatatgagcuacagcuggcgaa

SEQ ID NO: 55654 - DNA, 20 bp, Artificial Sequence
  Synthetic
tggcctagcugagtccacut

SEQ ID NO: 55655 - DNA, 19 bp, Artificial Sequence
  Synthetic
tgagcgaugctgacacucc

SEQ ID NO: 55656 - DNA, 21 bp, Artificial Sequence
  Synthetic
gtacagtacccuctccccuca

SEQ ID NO: 55657 - DNA, 21 bp, Artificial Sequence
  Synthetic
tccagatcutccgagcucact

SEQ ID NO: 55658 - DNA, 23 bp, Artificial Sequence
  Synthetic
actgggagaugtagacaggtuca

SEQ ID NO: 55659 - DNA, 28 bp, Artificial Sequence
  Synthetic
tcgtcatttctgauagccttctctttut

SEQ ID NO: 55660 - DNA, 24 bp, Artificial Sequence
  Synthetic
gaatttacgucaggtggacctcut

SEQ ID NO: 55661 - DNA, 25 bp, Artificial Sequence
  Synthetic
cctcccgtuaagtctgctttuaaca

SEQ ID NO: 55662 - DNA, 26 bp, Artificial Sequence
  Synthetic
ccataccuaacttcttgtgugggaaa

SEQ ID NO: 55663 - DNA, 29 bp, Artificial Sequence
  Synthetic
cagtgaagaugcaaaagaaatgguaagat

SEQ ID NO: 55664 - DNA, 22 bp, Artificial Sequence
  Synthetic
aagatttggcgacuggttctut

SEQ ID NO: 55665 - DNA, 28 bp, Artificial Sequence
  Synthetic
ggtgttgtgaaggucaaaaataatguca

SEQ ID NO: 55666 - DNA, 22 bp, Artificial Sequence
  Synthetic
tgcutcacgtttugccaaacat

SEQ ID NO: 55667 - DNA, 24 bp, Artificial Sequence
  Synthetic
gatatcagctcucagaacccctug

SEQ ID NO: 55668 - DNA, 20 bp, Artificial Sequence
  Synthetic
gtcagcgutggtctcaucct

SEQ ID NO: 55669 - DNA, 21 bp, Artificial Sequence
  Synthetic
gccagagcutgtccattgguc

SEQ ID NO: 55670 - DNA, 27 bp, Artificial Sequence
  Synthetic
tccagcaaaugcatgaagaattucaag

SEQ ID NO: 55671 - DNA, 28 bp, Artificial Sequence
  Synthetic
atgcaagtaaauacctagacccuacaga

SEQ ID NO: 55672 - DNA, 24 bp, Artificial Sequence
  Synthetic
gtggacaaagcugcaaaagagaug

SEQ ID NO: 55673 - DNA, 23 bp, Artificial Sequence
  Synthetic
caccuccuccaagaagaaagcaa

SEQ ID NO: 55674 - DNA, 23 bp, Artificial Sequence
  Synthetic
cattcaugttccccuaaccacct

SEQ ID NO: 55675 - DNA, 21 bp, Artificial Sequence
  Synthetic
tccaggaagccauccacttug

SEQ ID NO: 55676 - DNA, 22 bp, Artificial Sequence
  Synthetic
cuggtagttacaugggccgaaa

SEQ ID NO: 55677 - DNA, 26 bp, Artificial Sequence
  Synthetic
ctaatataatuacagctcgggcugct

SEQ ID NO: 55678 - DNA, 26 bp, Artificial Sequence
  Synthetic
cctagacauaggaggaatccatcuga

SEQ ID NO: 55679 - DNA, 21 bp, Artificial Sequence
  Synthetic
aggattagccagcutggtgug

SEQ ID NO: 55680 - DNA, 21 bp, Artificial Sequence
  Synthetic
tccccuggaggagggatacua

SEQ ID NO: 55681 - DNA, 23 bp, Artificial Sequence
  Synthetic
ggaagagctuttctgaggttugg

SEQ ID NO: 55682 - DNA, 23 bp, Artificial Sequence
  Synthetic
ggtggccaaguatgaugagaact

SEQ ID NO: 55683 - DNA, 21 bp, Artificial Sequence
  Synthetic
gcaatgtcgutctgcagctuc

SEQ ID NO: 55684 - DNA, 20 bp, Artificial Sequence
  Synthetic
gggccuatggactgugaagt

SEQ ID NO: 55685 - DNA, 20 bp, Artificial Sequence
  Synthetic
gatcaaggaucggctcugga

SEQ ID NO: 55686 - DNA, 26 bp, Artificial Sequence
  Synthetic
tggctcagaatucaccttctacatut

SEQ ID NO: 55687 - DNA, 26 bp, Artificial Sequence
  Synthetic
aaccttttugaaaaccaagagugcat

SEQ ID NO: 55688 - DNA, 27 bp, Artificial Sequence
  Synthetic
agataatcatacugaaggcagctcuga

SEQ ID NO: 55689 - DNA, 22 bp, Artificial Sequence
  Synthetic
tgtgcaguaaagaauggccagt

SEQ ID NO: 55690 - DNA, 21 bp, Artificial Sequence
  Synthetic
accaucagagagcctugagga

SEQ ID NO: 55691 - DNA, 28 bp, Artificial Sequence
  Synthetic
catcagcagcuagatccttctttgauaa

SEQ ID NO: 55692 - DNA, 25 bp, Artificial Sequence
  Synthetic
cttcggaaautgaagaaatcugcct

SEQ ID NO: 55693 - DNA, 22 bp, Artificial Sequence
  Synthetic
agggacatcutttggccgaauc

SEQ ID NO: 55694 - DNA, 22 bp, Artificial Sequence
  Synthetic
gtcttttcuccaggcctgatuc

SEQ ID NO: 55695 - DNA, 28 bp, Artificial Sequence
  Synthetic
aucatcattatgctugcaaaaacgaact

SEQ ID NO: 55696 - DNA, 24 bp, Artificial Sequence
  Synthetic
ctgccuggaattgaugaagaaacc

SEQ ID NO: 55697 - DNA, 28 bp, Artificial Sequence
  Synthetic
tggtgtcttatautgttgctcaaaguca

SEQ ID NO: 55698 - DNA, 19 bp, Artificial Sequence
  Synthetic
ccaggaaggcugucagagg

SEQ ID NO: 55699 - DNA, 21 bp, Artificial Sequence
  Synthetic
ccctgatcacugcccctttut

SEQ ID NO: 55700 - DNA, 21 bp, Artificial Sequence
  Synthetic
gtccaggucgctggtattcug

SEQ ID NO: 55701 - DNA, 21 bp, Artificial Sequence
  Synthetic
cctcagctcugtggaagggua

SEQ ID NO: 55702 - DNA, 25 bp, Artificial Sequence
  Synthetic
ccagacccaacuaaacaaacaugga

SEQ ID NO: 55703 - DNA, 23 bp, Artificial Sequence
  Synthetic
tgtaaactugaccagcugcagag

SEQ ID NO: 55704 - DNA, 19 bp, Artificial Sequence
  Synthetic
cggagcugcagagatcuga

SEQ ID NO: 55705 - DNA, 20 bp, Artificial Sequence
  Synthetic
tctgacagccccucctaucc

SEQ ID NO: 55706 - DNA, 22 bp, Artificial Sequence
  Synthetic
ctgctgaggaggcuatgtgtua

SEQ ID NO: 55707 - DNA, 27 bp, Artificial Sequence
  Synthetic
actggaaatcucaagcttatccatguc

SEQ ID NO: 55708 - DNA, 20 bp, Artificial Sequence
  Synthetic
ccttcucccaccctcacuga

SEQ ID NO: 55709 - DNA, 24 bp, Artificial Sequence
  Synthetic
cctgttctcugtgaagctgaaugg

SEQ ID NO: 55710 - DNA, 22 bp, Artificial Sequence
  Synthetic
gttgatagcuctgctccauggg

SEQ ID NO: 55711 - DNA, 20 bp, Artificial Sequence
  Synthetic
ctgcgccaaugaugaaagca

SEQ ID NO: 55712 - DNA, 28 bp, Artificial Sequence
  Synthetic
tggcttcctaauttatttctctgugcat

SEQ ID NO: 55713 - DNA, 29 bp, Artificial Sequence
  Synthetic
cttttcttcctccutcatgatggattuct

SEQ ID NO: 55714 - DNA, 25 bp, Artificial Sequence
  Synthetic
gttctgcaccaggaugtaattucca

SEQ ID NO: 55715 - DNA, 22 bp, Artificial Sequence
  Synthetic
ggttcagctugtcctgcatcut

SEQ ID NO: 55716 - DNA, 21 bp, Artificial Sequence
  Synthetic
cgggtcucaccctttcuacct

SEQ ID NO: 55717 - DNA, 22 bp, Artificial Sequence
  Synthetic
gcatcagcccauaggactcaut

SEQ ID NO: 55718 - DNA, 24 bp, Artificial Sequence
  Synthetic
tgagccaggaacaacaugacaaut

SEQ ID NO: 55719 - DNA, 26 bp, Artificial Sequence
  Synthetic
caatatcacugaccagttctgcaaug

SEQ ID NO: 55720 - DNA, 23 bp, Artificial Sequence
  Synthetic
gtgcctguccattgtccttatug

SEQ ID NO: 55721 - DNA, 25 bp, Artificial Sequence
  Synthetic
tcttgtctcctutttcctttgggut

SEQ ID NO: 55722 - DNA, 21 bp, Artificial Sequence
  Synthetic
ggacatagucttgggcaugct

SEQ ID NO: 55723 - DNA, 27 bp, Artificial Sequence
  Synthetic
tgaaacagaccaaucatgtgcatttut

SEQ ID NO: 55724 - DNA, 26 bp, Artificial Sequence
  Synthetic
gactuacaaaagagcaatgctaugcc

SEQ ID NO: 55725 - DNA, 24 bp, Artificial Sequence
  Synthetic
actgtgugactgcatuaccgaaaa

SEQ ID NO: 55726 - DNA, 27 bp, Artificial Sequence
  Synthetic
cctttctgattucatatcttcccuggt

SEQ ID NO: 55727 - DNA, 28 bp, Artificial Sequence
  Synthetic
ggaggatggutcagtctauacaacaaat

SEQ ID NO: 55728 - DNA, 25 bp, Artificial Sequence
  Synthetic
gagatggcaauggagaagtuacaga

SEQ ID NO: 55729 - DNA, 27 bp, Artificial Sequence
  Synthetic
agctgcaaaacaugaacacatgattut

SEQ ID NO: 55730 - DNA, 21 bp, Artificial Sequence
  Synthetic
cttccugacccaatggctuct

SEQ ID NO: 55731 - DNA, 27 bp, Artificial Sequence
  Synthetic
cattagcauaaggctgatcuaccaagg

SEQ ID NO: 55732 - DNA, 21 bp, Artificial Sequence
  Synthetic
ggccccatucccagtcaatua

SEQ ID NO: 55733 - DNA, 23 bp, Artificial Sequence
  Synthetic
cacaauggaagtgucaagagcag

SEQ ID NO: 55734 - DNA, 20 bp, Artificial Sequence
  Synthetic
aggucgcccaaatugcaaga

SEQ ID NO: 55735 - DNA, 21 bp, Artificial Sequence
  Synthetic
cacatccacutcctgcugaac

SEQ ID NO: 55736 - DNA, 21 bp, Artificial Sequence
  Synthetic
catcctgagutgtcacgugga

SEQ ID NO: 55737 - DNA, 22 bp, Artificial Sequence
  Synthetic
tgtgaaugaggccattggtcut

SEQ ID NO: 55738 - DNA, 27 bp, Artificial Sequence
  Synthetic
gtaaagtuaaaaccaaatgaccugcca

SEQ ID NO: 55739 - DNA, 20 bp, Artificial Sequence
  Synthetic
cgctgcccaugtcatugaga

SEQ ID NO: 55740 - DNA, 21 bp, Artificial Sequence
  Synthetic
ccttgtcagugtctccuccga

SEQ ID NO: 55741 - DNA, 22 bp, Artificial Sequence
  Synthetic
ggaaaugatcaagucgggcaat

SEQ ID NO: 55742 - DNA, 20 bp, Artificial Sequence
  Synthetic
ggccgctucacctctcatuc

SEQ ID NO: 55743 - DNA, 21 bp, Artificial Sequence
  Synthetic
gaggccagcautcagagtuca

SEQ ID NO: 55744 - DNA, 20 bp, Artificial Sequence
  Synthetic
gtccatcuccttccgcauca

SEQ ID NO: 55745 - DNA, 22 bp, Artificial Sequence
  Synthetic
aagctgtcucaggtcagtccua

SEQ ID NO: 55746 - DNA, 17 bp, Artificial Sequence
  Synthetic
gugaccccgcacacuct

SEQ ID NO: 55747 - DNA, 17 bp, Artificial Sequence
  Synthetic
ccugagcuccccagcac

SEQ ID NO: 55748 - DNA, 20 bp, Artificial Sequence
  Synthetic
acctcccaucttcccctugt

SEQ ID NO: 55749 - DNA, 21 bp, Artificial Sequence
  Synthetic
ggctagautcagaggaugcca

SEQ ID NO: 55750 - DNA, 19 bp, Artificial Sequence
  Synthetic
agtgtucgcacagcccaut

SEQ ID NO: 55751 - DNA, 20 bp, Artificial Sequence
  Synthetic
ggatacagggcguagagguc

SEQ ID NO: 55752 - DNA, 18 bp, Artificial Sequence
  Synthetic
tccaagggcuccuccaca

SEQ ID NO: 55753 - DNA, 20 bp, Artificial Sequence
  Synthetic
gtcagcagggcuggaacuaa

SEQ ID NO: 55754 - DNA, 22 bp, Artificial Sequence
  Synthetic
gctcctugaagcagtagacugt

SEQ ID NO: 55755 - DNA, 20 bp, Artificial Sequence
  Synthetic
gctcuaccggctacucgaga

SEQ ID NO: 55756 - DNA, 20 bp, Artificial Sequence
  Synthetic
caggcaugctcatcccugat

SEQ ID NO: 55757 - DNA, 27 bp, Artificial Sequence
  Synthetic
cgatccggtucacagaaaaataaacug

SEQ ID NO: 55758 - DNA, 21 bp, Artificial Sequence
  Synthetic
ggcttccccutccctttctug

SEQ ID NO: 55759 - DNA, 20 bp, Artificial Sequence
  Synthetic
ctggcacccutcactcugaa

SEQ ID NO: 55760 - DNA, 28 bp, Artificial Sequence
  Synthetic
caggatgaaccagagutaataggtcaut

SEQ ID NO: 55761 - DNA, 28 bp, Artificial Sequence
  Synthetic
tgagtaaaactaautggttgtccugcat

SEQ ID NO: 55762 - DNA, 21 bp, Artificial Sequence
  Synthetic
gcatgtuggagactugggcaa

SEQ ID NO: 55763 - DNA, 28 bp, Artificial Sequence
  Synthetic
cgcgactaacaaucaaagtgaaaagaua

SEQ ID NO: 55764 - DNA, 21 bp, Artificial Sequence
  Synthetic
gcccagctuttgcctcagaua

SEQ ID NO: 55765 - DNA, 22 bp, Artificial Sequence
  Synthetic
gaggtcgaagaaucgctctuca

SEQ ID NO: 55766 - DNA, 23 bp, Artificial Sequence
  Synthetic
gggtagagcugtggattcattut

SEQ ID NO: 55767 - DNA, 24 bp, Artificial Sequence
  Synthetic
gacggacatttutcctccctctut

SEQ ID NO: 55768 - DNA, 27 bp, Artificial Sequence
  Synthetic
gaggactgtguggagtgattattucaa

SEQ ID NO: 55769 - DNA, 20 bp, Artificial Sequence
  Synthetic
cagcttauacaccccgcuca

SEQ ID NO: 55770 - DNA, 28 bp, Artificial Sequence
  Synthetic
ttgacctaccauaataaaccatgtgguc

SEQ ID NO: 55771 - DNA, 25 bp, Artificial Sequence
  Synthetic
ttctctttaccugctgccatttuct

SEQ ID NO: 55772 - DNA, 25 bp, Artificial Sequence
  Synthetic
tgatatgccutgagctttucgaagt

SEQ ID NO: 55773 - DNA, 24 bp, Artificial Sequence
  Synthetic
gaccaacugccacaataccaacua

SEQ ID NO: 55774 - DNA, 24 bp, Artificial Sequence
  Synthetic
cccagcctaugatgagttcttugt

SEQ ID NO: 55775 - DNA, 27 bp, Artificial Sequence
  Synthetic
tgaaattcutcttcgttauggacagca

SEQ ID NO: 55776 - DNA, 28 bp, Artificial Sequence
  Synthetic
ttgctcacutgaagtcaguagaaaaaga

SEQ ID NO: 55777 - DNA, 24 bp, Artificial Sequence
  Synthetic
gctatgcagacagutggtguacat

SEQ ID NO: 55778 - DNA, 25 bp, Artificial Sequence
  Synthetic
gagagagaatcugcaaatggagcua

SEQ ID NO: 55779 - DNA, 28 bp, Artificial Sequence
  Synthetic
cagatcttgatutccttagagagugagg

SEQ ID NO: 55780 - DNA, 23 bp, Artificial Sequence
  Synthetic
ctcttgaagtucccggagtctut

SEQ ID NO: 55781 - DNA, 24 bp, Artificial Sequence
  Synthetic
gcctaaaaccutgtcatatugcca

SEQ ID NO: 55782 - DNA, 27 bp, Artificial Sequence
  Synthetic
tgtaaaguaggacatgatcuggaacca

SEQ ID NO: 55783 - DNA, 28 bp, Artificial Sequence
  Synthetic
acaatcaactcguaattatccacaggut

SEQ ID NO: 55784 - DNA, 25 bp, Artificial Sequence
  Synthetic
ccacaugaaagatguacagggacat

SEQ ID NO: 55785 - DNA, 21 bp, Artificial Sequence
  Synthetic
gggcaaagcugtcaugagaca

SEQ ID NO: 55786 - DNA, 22 bp, Artificial Sequence
  Synthetic
tguggagaggagaugggaaagt

SEQ ID NO: 55787 - DNA, 22 bp, Artificial Sequence
  Synthetic
caacttccttucctcccctgug

SEQ ID NO: 55788 - DNA, 23 bp, Artificial Sequence
  Synthetic
gctgttccaagugcaattcaugt

SEQ ID NO: 55789 - DNA, 26 bp, Artificial Sequence
  Synthetic
cttctgaccaucatttctcttuccct

SEQ ID NO: 55790 - DNA, 24 bp, Artificial Sequence
  Synthetic
cattgaggagugaagaagcaggua

SEQ ID NO: 55791 - DNA, 25 bp, Artificial Sequence
  Synthetic
cagaggtaacuagagagtgguaggg

SEQ ID NO: 55792 - DNA, 28 bp, Artificial Sequence
  Synthetic
ttcacctctttcutctttggttttcuct

SEQ ID NO: 55793 - DNA, 23 bp, Artificial Sequence
  Synthetic
gattccaguaaccgcaaacctug

SEQ ID NO: 55794 - DNA, 26 bp, Artificial Sequence
  Synthetic
ggtugaagaaggagaaaagtucgact

SEQ ID NO: 55795 - DNA, 26 bp, Artificial Sequence
  Synthetic
tgaagctatcguttcagctacttugg

SEQ ID NO: 55796 - DNA, 26 bp, Artificial Sequence
  Synthetic
tgacccuaaactacagacuccaaaga

SEQ ID NO: 55797 - DNA, 20 bp, Artificial Sequence
  Synthetic
agtcagugacgccguaacag

SEQ ID NO: 55798 - DNA, 25 bp, Artificial Sequence
  Synthetic
gctggtacttcuacattcaggctua

SEQ ID NO: 55799 - DNA, 28 bp, Artificial Sequence
  Synthetic
gctctctcauacattgcaacuagaagaa

SEQ ID NO: 55800 - DNA, 25 bp, Artificial Sequence
  Synthetic
gtggaacttguacaacgtggagaua

SEQ ID NO: 55801 - DNA, 28 bp, Artificial Sequence
  Synthetic
gcttctacaaaaagugcttcatcttuca

SEQ ID NO: 55802 - DNA, 20 bp, Artificial Sequence
  Synthetic
ttcgctugctaatgggugga

SEQ ID NO: 55803 - DNA, 28 bp, Artificial Sequence
  Synthetic
attggtagccgautacattttctcaaut

SEQ ID NO: 55804 - DNA, 23 bp, Artificial Sequence
  Synthetic
ctgaagttgauggcacacaagut

SEQ ID NO: 55805 - DNA, 25 bp, Artificial Sequence
  Synthetic
tgcagaaaaaucatgctcttgugac

SEQ ID NO: 55806 - DNA, 21 bp, Artificial Sequence
  Synthetic
cagaacaggcccucagtucaa

SEQ ID NO: 55807 - DNA, 23 bp, Artificial Sequence
  Synthetic
cttaugaccaggagccacucaag

SEQ ID NO: 55808 - DNA, 25 bp, Artificial Sequence
  Synthetic
tcacccattttuatctcgtgctcuc

SEQ ID NO: 55809 - DNA, 27 bp, Artificial Sequence
  Synthetic
aaaccctcctaccutttctcctaacua

SEQ ID NO: 55810 - DNA, 27 bp, Artificial Sequence
  Synthetic
acugatagtaacaucaagagcaaggga

SEQ ID NO: 55811 - DNA, 20 bp, Artificial Sequence
  Synthetic
ccgacacaucagcccucaag

SEQ ID NO: 55812 - DNA, 22 bp, Artificial Sequence
  Synthetic
caactgtucccgttgagacuct

SEQ ID NO: 55813 - DNA, 21 bp, Artificial Sequence
  Synthetic
gggctagagcacuggacaaug

SEQ ID NO: 55814 - DNA, 28 bp, Artificial Sequence
  Synthetic
aaatgcttcttccutgggtgtataagut

SEQ ID NO: 55815 - DNA, 28 bp, Artificial Sequence
  Synthetic
actacttactcugattccttttggucct

SEQ ID NO: 55816 - DNA, 28 bp, Artificial Sequence
  Synthetic
agatcatttttcuggttttgctggttut

SEQ ID NO: 55817 - DNA, 28 bp, Artificial Sequence
  Synthetic
ttgagggattgtugtaatcttctggtut

SEQ ID NO: 55818 - DNA, 25 bp, Artificial Sequence
  Synthetic
attcttatgcccucaatcacctucc

SEQ ID NO: 55819 - DNA, 28 bp, Artificial Sequence
  Synthetic
gctatcttgucccagaggagtttaauat

SEQ ID NO: 55820 - DNA, 24 bp, Artificial Sequence
  Synthetic
ggcctgttccutcactagattuga

SEQ ID NO: 55821 - DNA, 22 bp, Artificial Sequence
  Synthetic
cgaugaagggagcugaacgaaa

SEQ ID NO: 55822 - DNA, 29 bp, Artificial Sequence
  Synthetic
tgttaccctggauatgttggatgtuagat

SEQ ID NO: 55823 - DNA, 28 bp, Artificial Sequence
  Synthetic
tctccuacaaggcaaatatgtttucaca

SEQ ID NO: 55824 - DNA, 27 bp, Artificial Sequence
  Synthetic
ttgttttcacaggutgttttgaauggt

SEQ ID NO: 55825 - DNA, 28 bp, Artificial Sequence
  Synthetic
gctagtggtgcugcagattattattcut

SEQ ID NO: 55826 - DNA, 27 bp, Artificial Sequence
  Synthetic
agggagatcagcuttagttcttcagua

SEQ ID NO: 55827 - DNA, 29 bp, Artificial Sequence
  Synthetic
accccagcuaataattccagtuaagaaac

SEQ ID NO: 55828 - DNA, 28 bp, Artificial Sequence
  Synthetic
acatgactttctutgaagactgaacugt

SEQ ID NO: 55829 - DNA, 21 bp, Artificial Sequence
  Synthetic
agaggaggcacugagaaccut

SEQ ID NO: 55830 - DNA, 19 bp, Artificial Sequence
  Synthetic
cctctguggcccacctcua

SEQ ID NO: 55831 - DNA, 18 bp, Artificial Sequence
  Synthetic
ctcctcugccaccagcuc

SEQ ID NO: 55832 - DNA, 20 bp, Artificial Sequence
  Synthetic
ccatgcgccugtcatctugt

SEQ ID NO: 55833 - DNA, 23 bp, Artificial Sequence
  Synthetic
tgctcatccuctgcttcaucaag

SEQ ID NO: 55834 - DNA, 22 bp, Artificial Sequence
  Synthetic
gctgctttucctggtctttgug

SEQ ID NO: 55835 - DNA, 22 bp, Artificial Sequence
  Synthetic
ccaggactuccccaaagaccua

SEQ ID NO: 55836 - DNA, 26 bp, Artificial Sequence
  Synthetic
ctaaaatccattucctacctgcccua

SEQ ID NO: 55837 - DNA, 27 bp, Artificial Sequence
  Synthetic
aaacacattactacucacggctacauc

SEQ ID NO: 55838 - DNA, 24 bp, Artificial Sequence
  Synthetic
aggactgaagaggcugaagacaua

SEQ ID NO: 55839 - DNA, 22 bp, Artificial Sequence
  Synthetic
aagcacaucatgcattgucacc

SEQ ID NO: 55840 - DNA, 26 bp, Artificial Sequence
  Synthetic
ggattccacucccacagatatacuct

SEQ ID NO: 55841 - DNA, 26 bp, Artificial Sequence
  Synthetic
accaaaagcuggtacttcacugaaaa

SEQ ID NO: 55842 - DNA, 26 bp, Artificial Sequence
  Synthetic
aaactagauccctgtaccucaaggaa

SEQ ID NO: 55843 - DNA, 24 bp, Artificial Sequence
  Synthetic
ggtctaugaagacacacucaccct

SEQ ID NO: 55844 - DNA, 24 bp, Artificial Sequence
  Synthetic
aaacacactaaugtgcaggguact

SEQ ID NO: 55845 - DNA, 28 bp, Artificial Sequence
  Synthetic
cgaaggttucaaagaagctgttcaauat

SEQ ID NO: 55846 - DNA, 28 bp, Artificial Sequence
  Synthetic
aaaacaccagaaautattgttggcagut

SEQ ID NO: 55847 - DNA, 28 bp, Artificial Sequence
  Synthetic
ctgtccacaaaggugctacaattagaua

SEQ ID NO: 55848 - DNA, 19 bp, Artificial Sequence
  Synthetic
tacaaccgccuccgtguag

SEQ ID NO: 55849 - DNA, 26 bp, Artificial Sequence
  Synthetic
catccaatacagcccugaaactgtua

SEQ ID NO: 55850 - DNA, 26 bp, Artificial Sequence
  Synthetic
gcctttuctctttttctuccagggat

SEQ ID NO: 55851 - DNA, 23 bp, Artificial Sequence
  Synthetic
cacaatccuacctgcacctucaa

SEQ ID NO: 55852 - DNA, 20 bp, Artificial Sequence
  Synthetic
ggcactctuagcaccccauc

SEQ ID NO: 55853 - DNA, 21 bp, Artificial Sequence
  Synthetic
tgcagcttugggcaagtttuc

SEQ ID NO: 55854 - DNA, 20 bp, Artificial Sequence
  Synthetic
gagcagcagagacucugacc

SEQ ID NO: 55855 - DNA, 21 bp, Artificial Sequence
  Synthetic
gtgccuccagagaccaaaugt

SEQ ID NO: 55856 - DNA, 20 bp, Artificial Sequence
  Synthetic
caggctatutgggccaugga

SEQ ID NO: 55857 - DNA, 28 bp, Artificial Sequence
  Synthetic
gguattccagataauacaacgcaggaaa

SEQ ID NO: 55858 - DNA, 21 bp, Artificial Sequence
  Synthetic
ctcugacaagtgguccgacaa

SEQ ID NO: 55859 - DNA, 21 bp, Artificial Sequence
  Synthetic
gagaacaagcaggaugctgug

SEQ ID NO: 55860 - DNA, 25 bp, Artificial Sequence
  Synthetic
ccacctcaagutatgggaaaagcua

SEQ ID NO: 55861 - DNA, 23 bp, Artificial Sequence
  Synthetic
atgcuggacaagaacaatcuggt

SEQ ID NO: 55862 - DNA, 20 bp, Artificial Sequence
  Synthetic
cttggcagggucaacacgua

SEQ ID NO: 55863 - DNA, 28 bp, Artificial Sequence
  Synthetic
gctagaggtaattuctgtcctccaatuc

SEQ ID NO: 55864 - DNA, 28 bp, Artificial Sequence
  Synthetic
tgtccagatgugtgtgttaatgaatuct

SEQ ID NO: 55865 - DNA, 21 bp, Artificial Sequence
  Synthetic
ggaatagcggguaaggctugg

SEQ ID NO: 55866 - DNA, 21 bp, Artificial Sequence
  Synthetic
ccgcaggacutcctcacttua

SEQ ID NO: 55867 - DNA, 28 bp, Artificial Sequence
  Synthetic
agagaataaatcaauaagcccacagcuc

SEQ ID NO: 55868 - DNA, 24 bp, Artificial Sequence
  Synthetic
tcctgaccugggtttuagagaaca

SEQ ID NO: 55869 - DNA, 20 bp, Artificial Sequence
  Synthetic
ccactccugcatttcucgga

SEQ ID NO: 55870 - DNA, 21 bp, Artificial Sequence
  Synthetic
cgccccaccutttcagtatug

SEQ ID NO: 55871 - DNA, 24 bp, Artificial Sequence
  Synthetic
ggagugcaggaggcaattauagag

SEQ ID NO: 55872 - DNA, 24 bp, Artificial Sequence
  Synthetic
ggacacttuggaaggattugcaga

SEQ ID NO: 55873 - DNA, 26 bp, Artificial Sequence
  Synthetic
tggatccucctcttctcauagcaaaa

SEQ ID NO: 55874 - DNA, 27 bp, Artificial Sequence
  Synthetic
ttcgttctcttucctgttctttctugt

SEQ ID NO: 55875 - DNA, 23 bp, Artificial Sequence
  Synthetic
tggtcatggucattggaaaccug

SEQ ID NO: 55876 - DNA, 25 bp, Artificial Sequence
  Synthetic
tcttctgatgcugtcctctgatuct

SEQ ID NO: 55877 - DNA, 24 bp, Artificial Sequence
  Synthetic
ggcctcucagagagttcttcugaa

SEQ ID NO: 55878 - DNA, 27 bp, Artificial Sequence
  Synthetic
gaacutagttcctaaauagccccaagt

SEQ ID NO: 55879 - DNA, 23 bp, Artificial Sequence
  Synthetic
tgttcgtcatugcctccatcauc

SEQ ID NO: 55880 - DNA, 25 bp, Artificial Sequence
  Synthetic
ggctgagtgaguagttgtttgctua

SEQ ID NO: 55881 - DNA, 27 bp, Artificial Sequence
  Synthetic
catttaacagcuctgatgatgugcaag

SEQ ID NO: 55882 - DNA, 27 bp, Artificial Sequence
  Synthetic
cataggagccuaaaagggaaugaaagt

SEQ ID NO: 55883 - DNA, 21 bp, Artificial Sequence
  Synthetic
gccttgagguccttgaccaut

SEQ ID NO: 55884 - DNA, 29 bp, Artificial Sequence
  Synthetic
tgaaatccttuggactgaaatacttguct

SEQ ID NO: 55885 - DNA, 25 bp, Artificial Sequence
  Synthetic
catttgtggugctagcattuaggaa

SEQ ID NO: 55886 - DNA, 27 bp, Artificial Sequence
  Synthetic
acaautatttgtaggguaacccaggac

SEQ ID NO: 55887 - DNA, 21 bp, Artificial Sequence
  Synthetic
gcgatccctuctctcctggut

SEQ ID NO: 55888 - DNA, 26 bp, Artificial Sequence
  Synthetic
gattacagcuttgaaguagagcaggt

SEQ ID NO: 55889 - DNA, 22 bp, Artificial Sequence
  Synthetic
acagcctugcgtgttcgataut

SEQ ID NO: 55890 - DNA, 25 bp, Artificial Sequence
  Synthetic
tccttaacgaagugcacatgtauga

SEQ ID NO: 55891 - DNA, 23 bp, Artificial Sequence
  Synthetic
cttgttagggugatcguggagac

SEQ ID NO: 55892 - DNA, 26 bp, Artificial Sequence
  Synthetic
tgctcaauctcacacuaaagaacacc

SEQ ID NO: 55893 - DNA, 28 bp, Artificial Sequence
  Synthetic
ttggacagtaaccauctaaaatctgcut

SEQ ID NO: 55894 - DNA, 25 bp, Artificial Sequence
  Synthetic
aaaacatgaccugtacgtgacauca

SEQ ID NO: 55895 - DNA, 28 bp, Artificial Sequence
  Synthetic
agtgggttctaautttaactggcttgut

SEQ ID NO: 55896 - DNA, 24 bp, Artificial Sequence
  Synthetic
gcatatgcucacaaatcccattuc

SEQ ID NO: 55897 - DNA, 27 bp, Artificial Sequence
  Synthetic
gaaaauaacccagaauaaggacaccca

SEQ ID NO: 55898 - DNA, 21 bp, Artificial Sequence
  Synthetic
gggaaagagcacucaggugaa

SEQ ID NO: 55899 - DNA, 28 bp, Artificial Sequence
  Synthetic
gaatagaagugggaacaagatccugaaa

SEQ ID NO: 55900 - DNA, 22 bp, Artificial Sequence
  Synthetic
ggctaccugcacttcttacugg

SEQ ID NO: 55901 - DNA, 20 bp, Artificial Sequence
  Synthetic
agggatgaaggucgggauca

SEQ ID NO: 55902 - DNA, 21 bp, Artificial Sequence
  Synthetic
cgctgauagccaaactgcuga

SEQ ID NO: 55903 - DNA, 28 bp, Artificial Sequence
  Synthetic
gtgttcttgggutgaatacttttgtuct

SEQ ID NO: 55904 - DNA, 28 bp, Artificial Sequence
  Synthetic
gggcaacttcaguacttcctatatctut

SEQ ID NO: 55905 - DNA, 21 bp, Artificial Sequence
  Synthetic
gcaaggcugtcaacatgaugg

SEQ ID NO: 55906 - DNA, 20 bp, Artificial Sequence
  Synthetic
gctgaaggcacutccgtuga

SEQ ID NO: 55907 - DNA, 21 bp, Artificial Sequence
  Synthetic
cccgttaagucgtagccctua

SEQ ID NO: 55908 - DNA, 27 bp, Artificial Sequence
  Synthetic
ctagcttcttucttagtactgcuccat

SEQ ID NO: 55909 - DNA, 25 bp, Artificial Sequence
  Synthetic
cagaaguagaagacgaggucagact

SEQ ID NO: 55910 - DNA, 21 bp, Artificial Sequence
  Synthetic
tggtggcuctagtgacacugt

SEQ ID NO: 55911 - DNA, 21 bp, Artificial Sequence
  Synthetic
ctgcaacgcucttugaagcat

SEQ ID NO: 55912 - DNA, 21 bp, Artificial Sequence
  Synthetic
ttttggactuggcactgguga

SEQ ID NO: 55913 - DNA, 21 bp, Artificial Sequence
  Synthetic
gcccuccauggcaaaaagaac

SEQ ID NO: 55914 - DNA, 22 bp, Artificial Sequence
  Synthetic
ccacttctugacacaccuccac

SEQ ID NO: 55915 - DNA, 21 bp, Artificial Sequence
  Synthetic
ggatgcugggacctggauact

SEQ ID NO: 55916 - DNA, 17 bp, Artificial Sequence
  Synthetic
ggctcaccgucctcguc

SEQ ID NO: 55917 - DNA, 20 bp, Artificial Sequence
  Synthetic
tgctgagcccugactacugt

SEQ ID NO: 55918 - DNA, 17 bp, Artificial Sequence
  Synthetic
caggccuctgcccaguc

SEQ ID NO: 55919 - DNA, 22 bp, Artificial Sequence
  Synthetic
acccagcaaacgauagcatcuc

SEQ ID NO: 55920 - DNA, 27 bp, Artificial Sequence
  Synthetic
gtagcaaaugttacauaagcccaaaca

SEQ ID NO: 55921 - DNA, 22 bp, Artificial Sequence
  Synthetic
ccagactcugaaaactgccuca

SEQ ID NO: 55922 - DNA, 20 bp, Artificial Sequence
  Synthetic
ccagccgugaacaatgucca

SEQ ID NO: 55923 - DNA, 28 bp, Artificial Sequence
  Synthetic
aagacaccaugaagctgaatatctgtut

SEQ ID NO: 55924 - DNA, 28 bp, Artificial Sequence
  Synthetic
tgaatgtttcugtcatcaagaucaacct

SEQ ID NO: 55925 - DNA, 22 bp, Artificial Sequence
  Synthetic
tccauccaagcaagagcuacac

SEQ ID NO: 55926 - DNA, 29 bp, Artificial Sequence
  Synthetic
aatcacagttattacutaccaaggcctut

SEQ ID NO: 55927 - DNA, 26 bp, Artificial Sequence
  Synthetic
aaagaagccacggaguctaagaatut

SEQ ID NO: 55928 - DNA, 22 bp, Artificial Sequence
  Synthetic
agtggcacaggutcgtttuaca

SEQ ID NO: 55929 - DNA, 20 bp, Artificial Sequence
  Synthetic
ttcatttugcccccucggaa

SEQ ID NO: 55930 - DNA, 17 bp, Artificial Sequence
  Synthetic
gctcugggccgaagugt

SEQ ID NO: 55931 - DNA, 18 bp, Artificial Sequence
  Synthetic
cuggaaccccggctuacc

SEQ ID NO: 55932 - DNA, 20 bp, Artificial Sequence
  Synthetic
ccccgtguctgacagugaaa

SEQ ID NO: 55933 - DNA, 20 bp, Artificial Sequence
  Synthetic
ccaccaccugtccaccuact

SEQ ID NO: 55934 - DNA, 18 bp, Artificial Sequence
  Synthetic
guggagggccaggucaag

SEQ ID NO: 55935 - DNA, 18 bp, Artificial Sequence
  Synthetic
cggtaacccgugtcgcua

SEQ ID NO: 55936 - DNA, 18 bp, Artificial Sequence
  Synthetic
accccuguacccccacaa

SEQ ID NO: 55937 - DNA, 19 bp, Artificial Sequence
  Synthetic
tctaggccccucctgugac

SEQ ID NO: 55938 - DNA, 18 bp, Artificial Sequence
  Synthetic
gtaccaggugcccaccuc

SEQ ID NO: 55939 - DNA, 17 bp, Artificial Sequence
  Synthetic
gtcuggccgcctgaguc

SEQ ID NO: 55940 - DNA, 22 bp, Artificial Sequence
  Synthetic
agaactccaucagtgcctccua

SEQ ID NO: 55941 - DNA, 23 bp, Artificial Sequence
  Synthetic
agtacctttugcaacatgguggt

SEQ ID NO: 55942 - DNA, 25 bp, Artificial Sequence
  Synthetic
ggaactcccuctttatggtugcaat

SEQ ID NO: 55943 - DNA, 27 bp, Artificial Sequence
  Synthetic
agatttctuaggaccccatcttacuca

SEQ ID NO: 55944 - DNA, 24 bp, Artificial Sequence
  Synthetic
attgtggccugtcactauggaaat

SEQ ID NO: 55945 - DNA, 28 bp, Artificial Sequence
  Synthetic
gctgaacctttutgcttataggaatuga

SEQ ID NO: 55946 - DNA, 28 bp, Artificial Sequence
  Synthetic
tccaagaagcauttgttgactacttuga

SEQ ID NO: 55947 - DNA, 24 bp, Artificial Sequence
  Synthetic
tgcaaaaguaacggattccuggat

SEQ ID NO: 55948 - DNA, 26 bp, Artificial Sequence
  Synthetic
attcgaattgaaaaucccaactcuct

SEQ ID NO: 55949 - DNA, 27 bp, Artificial Sequence
  Synthetic
aagacatgtccaacuttagcccaauat

SEQ ID NO: 55950 - DNA, 28 bp, Artificial Sequence
  Synthetic
aagaagaatacautgatgagcauggaca

SEQ ID NO: 55951 - DNA, 24 bp, Artificial Sequence
  Synthetic
ctcttctttcuctgtgcctucaga

SEQ ID NO: 55952 - DNA, 23 bp, Artificial Sequence
  Synthetic
tgtcctctucccttctctcuacc

SEQ ID NO: 55953 - DNA, 22 bp, Artificial Sequence
  Synthetic
ttgaaggcgaagutgagagcut

SEQ ID NO: 55954 - DNA, 22 bp, Artificial Sequence
  Synthetic
gttggatgccuaggatggtguc

SEQ ID NO: 55955 - DNA, 27 bp, Artificial Sequence
  Synthetic
tgcatacccucatagaagcattttugt

SEQ ID NO: 55956 - DNA, 22 bp, Artificial Sequence
  Synthetic
gcttgcatcugctactgctcua

SEQ ID NO: 55957 - DNA, 27 bp, Artificial Sequence
  Synthetic
gcatctcgtuaccctttgttaatugat

SEQ ID NO: 55958 - DNA, 28 bp, Artificial Sequence
  Synthetic
aaaataaaagtgautcctttgcctugct

SEQ ID NO: 55959 - DNA, 28 bp, Artificial Sequence
  Synthetic
ttacaaggttcuttccctctcaugaaaa

SEQ ID NO: 55960 - DNA, 28 bp, Artificial Sequence
  Synthetic
ttgctattacggutctcaaatcuaaggg

SEQ ID NO: 55961 - DNA, 28 bp, Artificial Sequence
  Synthetic
tgaagcaagugattaatgaaugggacaa

SEQ ID NO: 55962 - DNA, 27 bp, Artificial Sequence
  Synthetic
aaaatgttttccauctcactccgguat

SEQ ID NO: 55963 - DNA, 29 bp, Artificial Sequence
  Synthetic
gtttgacttttcguactgattcgagttut

SEQ ID NO: 55964 - DNA, 21 bp, Artificial Sequence
  Synthetic
acauaccccagcaactaugcc

SEQ ID NO: 55965 - DNA, 27 bp, Artificial Sequence
  Synthetic
ggatgctcutctgaaagtuacaaggaa

SEQ ID NO: 55966 - DNA, 25 bp, Artificial Sequence
  Synthetic
gcgtcggugaaaagtttcgaattut

SEQ ID NO: 55967 - DNA, 28 bp, Artificial Sequence
  Synthetic
aggcttacaatuccatcctaatttugct

SEQ ID NO: 55968 - DNA, 28 bp, Artificial Sequence
  Synthetic
gactctacatcaugcacttaccttuaca

SEQ ID NO: 55969 - DNA, 33 bp, Artificial Sequence
  Synthetic
aactttattttaatgcagauggaatggttaguc

SEQ ID NO: 55970 - DNA, 21 bp, Artificial Sequence
  Synthetic
cctccaaagugatgugaggga

SEQ ID NO: 55971 - DNA, 24 bp, Artificial Sequence
  Synthetic
caatugaaaagcccggatgugaag

SEQ ID NO: 55972 - DNA, 28 bp, Artificial Sequence
  Synthetic
gcatatgaaccaaaacuaacaccugaag

SEQ ID NO: 55973 - DNA, 29 bp, Artificial Sequence
  Synthetic
tattgaggctgugaatctcttaaaagtug

SEQ ID NO: 55974 - DNA, 25 bp, Artificial Sequence
  Synthetic
agatttttccccuctcccauaggat

SEQ ID NO: 55975 - DNA, 24 bp, Artificial Sequence
  Synthetic
acttacagtcuctatctgccugct

SEQ ID NO: 55976 - DNA, 22 bp, Artificial Sequence
  Synthetic
gatgctgtucccaggtactgut

SEQ ID NO: 55977 - DNA, 23 bp, Artificial Sequence
  Synthetic
gagaacugagggtgguacagaag

SEQ ID NO: 55978 - DNA, 32 bp, Artificial Sequence
  Synthetic
attttagactgctuaaagcaattgttgtauaa

SEQ ID NO: 55979 - DNA, 23 bp, Artificial Sequence
  Synthetic
cutccauaagaacggagggacat

SEQ ID NO: 55980 - DNA, 23 bp, Artificial Sequence
  Synthetic
gucttcttcugcacccaacaaaa

SEQ ID NO: 55981 - DNA, 29 bp, Artificial Sequence
  Synthetic
ggagcttatcatugaagaccttggaatua

SEQ ID NO: 55982 - DNA, 22 bp, Artificial Sequence
  Synthetic
gagaaaagcucatctggcucct

SEQ ID NO: 55983 - DNA, 27 bp, Artificial Sequence
  Synthetic
ttaaatcccauaggcaatagctuggaa

SEQ ID NO: 55984 - DNA, 19 bp, Artificial Sequence
  Synthetic
gaugacucagggagcagca

SEQ ID NO: 55985 - DNA, 20 bp, Artificial Sequence
  Synthetic
gccctauacccccgttcuga

SEQ ID NO: 55986 - DNA, 22 bp, Artificial Sequence
  Synthetic
gctaccaacaggauactgugct

SEQ ID NO: 55987 - DNA, 20 bp, Artificial Sequence
  Synthetic
cctgagggaucggguagaca

SEQ ID NO: 55988 - DNA, 23 bp, Artificial Sequence
  Synthetic
gccuctgttuccccagaaaagac

SEQ ID NO: 55989 - DNA, 21 bp, Artificial Sequence
  Synthetic
atccccttcugaagctccuct

SEQ ID NO: 55990 - DNA, 17 bp, Artificial Sequence
  Synthetic
agccgcuctcccgatug

SEQ ID NO: 55991 - DNA, 19 bp, Artificial Sequence
  Synthetic
tccgagtuctggtcgguga

SEQ ID NO: 55992 - DNA, 27 bp, Artificial Sequence
  Synthetic
cttcctggtaguatgtgttttcctuca

SEQ ID NO: 55993 - DNA, 20 bp, Artificial Sequence
  Synthetic
ccgatccaugctctguggac

SEQ ID NO: 55994 - DNA, 28 bp, Artificial Sequence
  Synthetic
aggagagcguaagatataagcaatcuct

SEQ ID NO: 55995 - DNA, 27 bp, Artificial Sequence
  Synthetic
gctcctgaaccutcagtttgtttatug

SEQ ID NO: 55996 - DNA, 22 bp, Artificial Sequence
  Synthetic
ctggagcaggcauccattgtua

SEQ ID NO: 55997 - DNA, 24 bp, Artificial Sequence
  Synthetic
cttctatcgccutctggaaaugct

SEQ ID NO: 55998 - DNA, 22 bp, Artificial Sequence
  Synthetic
cgacacaccugctgtaactcua

SEQ ID NO: 55999 - DNA, 27 bp, Artificial Sequence
  Synthetic
ccttctctaatucctcaggaggtuaag

SEQ ID NO: 56000 - DNA, 20 bp, Artificial Sequence
  Synthetic
ttggccaacuggatgaugga

SEQ ID NO: 56001 - DNA, 18 bp, Artificial Sequence
  Synthetic
cccccaguttgcugcagt

SEQ ID NO: 56002 - DNA, 25 bp, Artificial Sequence
  Synthetic
gcccguagagcagaaacttgtatut

SEQ ID NO: 56003 - DNA, 20 bp, Artificial Sequence
  Synthetic
gaggagaccuccagctcuct

SEQ ID NO: 56004 - DNA, 20 bp, Artificial Sequence
  Synthetic
cccatccccautcctguact

SEQ ID NO: 56005 - DNA, 20 bp, Artificial Sequence
  Synthetic
agaacccagggaccucacuc

SEQ ID NO: 56006 - DNA, 19 bp, Artificial Sequence
  Synthetic
gctctgcagugcacacuca

SEQ ID NO: 56007 - DNA, 19 bp, Artificial Sequence
  Synthetic
ccgctucgactcctucacc

SEQ ID NO: 56008 - DNA, 22 bp, Artificial Sequence
  Synthetic
ggacuggacagagacauggaaa

SEQ ID NO: 56009 - DNA, 21 bp, Artificial Sequence
  Synthetic
ggaauccgaccacagauacct

SEQ ID NO: 56010 - DNA, 19 bp, Artificial Sequence
  Synthetic
cagggaccugcagggaaug

SEQ ID NO: 56011 - DNA, 23 bp, Artificial Sequence
  Synthetic
agttcgacucttttgtgguccag

SEQ ID NO: 56012 - DNA, 21 bp, Artificial Sequence
  Synthetic
ccgtcccugtccttgtacuga

SEQ ID NO: 56013 - DNA, 26 bp, Artificial Sequence
  Synthetic
caaccatgutctttgtctucccaaat

SEQ ID NO: 56014 - DNA, 19 bp, Artificial Sequence
  Synthetic
cggatgcugcagtccucac

SEQ ID NO: 56015 - DNA, 17 bp, Artificial Sequence
  Synthetic
gcggccagugccuagat

SEQ ID NO: 56016 - DNA, 21 bp, Artificial Sequence
  Synthetic
ggatctcuagacggacccuca

SEQ ID NO: 56017 - DNA, 21 bp, Artificial Sequence
  Synthetic
gaagccccucttctcagctut

SEQ ID NO: 56018 - DNA, 20 bp, Artificial Sequence
  Synthetic
cctggutccgaauggacagg

SEQ ID NO: 56019 - DNA, 23 bp, Artificial Sequence
  Synthetic
ctccatccugctcacactttcut

SEQ ID NO: 56020 - DNA, 20 bp, Artificial Sequence
  Synthetic
cacttgggucccacaggtut

SEQ ID NO: 56021 - DNA, 26 bp, Artificial Sequence
  Synthetic
cccttaagagaaugacttcccatcuc

SEQ ID NO: 56022 - DNA, 20 bp, Artificial Sequence
  Synthetic
ggaacgccugtccccauaag

SEQ ID NO: 56023 - DNA, 21 bp, Artificial Sequence
  Synthetic
ctcatgugctcttcctuccca

SEQ ID NO: 56024 - DNA, 23 bp, Artificial Sequence
  Synthetic
gaaacagagucaaggagugggaa

SEQ ID NO: 56025 - DNA, 24 bp, Artificial Sequence
  Synthetic
gcatttgggtutctctgacaacuc

SEQ ID NO: 56026 - DNA, 23 bp, Artificial Sequence
  Synthetic
gtgctttcuggaatcagggauca

SEQ ID NO: 56027 - DNA, 23 bp, Artificial Sequence
  Synthetic
ctcactccuaactgcttcctguc

SEQ ID NO: 56028 - DNA, 24 bp, Artificial Sequence
  Synthetic
ccacaaggaagaggaugatgtuga

SEQ ID NO: 56029 - DNA, 20 bp, Artificial Sequence
  Synthetic
ccgaaagaggagcgauguga

SEQ ID NO: 56030 - DNA, 23 bp, Artificial Sequence
  Synthetic
ggaggcuttcttctctugggaaa

SEQ ID NO: 56031 - DNA, 22 bp, Artificial Sequence
  Synthetic
agagacugggaacuggaaggag

SEQ ID NO: 56032 - DNA, 21 bp, Artificial Sequence
  Synthetic
tgttgtatccuccccagccut

SEQ ID NO: 56033 - DNA, 26 bp, Artificial Sequence
  Synthetic
gaggtgaaaauaccactagcatccua

SEQ ID NO: 56034 - DNA, 21 bp, Artificial Sequence
  Synthetic
taaccuggcagagaatggugt

SEQ ID NO: 56035 - DNA, 27 bp, Artificial Sequence
  Synthetic
gcagatgggauttgctaatatgtcugt

SEQ ID NO: 56036 - DNA, 21 bp, Artificial Sequence
  Synthetic
acaauacctucccacccaacc

SEQ ID NO: 56037 - DNA, 22 bp, Artificial Sequence
  Synthetic
tgtggguacaacacaugcagaa

SEQ ID NO: 56038 - DNA, 25 bp, Artificial Sequence
  Synthetic
acattgcagagugcattactagugg

SEQ ID NO: 56039 - DNA, 26 bp, Artificial Sequence
  Synthetic
tctgtcttaauggagggatctgtgut

SEQ ID NO: 56040 - DNA, 28 bp, Artificial Sequence
  Synthetic
ccaaagaatuacacagaggaaagaugag

SEQ ID NO: 56041 - DNA, 27 bp, Artificial Sequence
  Synthetic
tgaatatccaugttcatgtgaugcaga

SEQ ID NO: 56042 - DNA, 23 bp, Artificial Sequence
  Synthetic
tggaaacagacaugtggtugaca

SEQ ID NO: 56043 - DNA, 30 bp, Artificial Sequence
  Synthetic
tgcatcatcgtauaacatggtttcauaact

SEQ ID NO: 56044 - DNA, 28 bp, Artificial Sequence
  Synthetic
atcttccccagaacutatcagatuaggt

SEQ ID NO: 56045 - DNA, 26 bp, Artificial Sequence
  Synthetic
agctcatacaggutcaatcatgugat

SEQ ID NO: 56046 - DNA, 23 bp, Artificial Sequence
  Synthetic
cagcagctuctccccaatatuct

SEQ ID NO: 56047 - DNA, 23 bp, Artificial Sequence
  Synthetic
agcaggtgaugatgtttctgguc

SEQ ID NO: 56048 - DNA, 21 bp, Artificial Sequence
  Synthetic
gccccacaggcuauaccaaaa

SEQ ID NO: 56049 - DNA, 22 bp, Artificial Sequence
  Synthetic
ggguagcttatgaugggagcat

SEQ ID NO: 56050 - DNA, 22 bp, Artificial Sequence
  Synthetic
gagattcagugcagcgtttgut

SEQ ID NO: 56051 - DNA, 29 bp, Artificial Sequence
  Synthetic
cagctcaggacacuttgctaatttaatut

SEQ ID NO: 56052 - DNA, 23 bp, Artificial Sequence
  Synthetic
cagggtuggaaaccattcugact

SEQ ID NO: 56053 - DNA, 28 bp, Artificial Sequence
  Synthetic
aataacttgccaugacctaagctuaact

SEQ ID NO: 56054 - DNA, 26 bp, Artificial Sequence
  Synthetic
gcaaaugaagaaatucccgaacaacc

SEQ ID NO: 56055 - DNA, 22 bp, Artificial Sequence
  Synthetic
aaaggcttcaugtccacctuga

SEQ ID NO: 56056 - DNA, 26 bp, Artificial Sequence
  Synthetic
acctccctatugatagaatgccauct

SEQ ID NO: 56057 - DNA, 26 bp, Artificial Sequence
  Synthetic
tcgtcagtcacuattttgggcataut

SEQ ID NO: 56058 - DNA, 26 bp, Artificial Sequence
  Synthetic
aggtctcttcucatccattcuacgag

SEQ ID NO: 56059 - DNA, 28 bp, Artificial Sequence
  Synthetic
acatcgacaagugaatcgaactctuaat

SEQ ID NO: 56060 - DNA, 22 bp, Artificial Sequence
  Synthetic
gtgtttucagccagugcacaaa

SEQ ID NO: 56061 - DNA, 20 bp, Artificial Sequence
  Synthetic
cttttggaugccgtucacca

SEQ ID NO: 56062 - DNA, 23 bp, Artificial Sequence
  Synthetic
gcccaagaaccuaaaacacccua

SEQ ID NO: 56063 - DNA, 27 bp, Artificial Sequence
  Synthetic
gggtgtccataaucttcctttgtttut

SEQ ID NO: 56064 - DNA, 28 bp, Artificial Sequence
  Synthetic
tgactgtatcttugcattgtcctttuca

SEQ ID NO: 56065 - DNA, 27 bp, Artificial Sequence
  Synthetic
ctgagagccucccaaaatgtatacuac

SEQ ID NO: 56066 - DNA, 21 bp, Artificial Sequence
  Synthetic
gccugaugccccagaagaaaa

SEQ ID NO: 56067 - DNA, 22 bp, Artificial Sequence
  Synthetic
tttgttguaggtgcugggaagt

SEQ ID NO: 56068 - DNA, 21 bp, Artificial Sequence
  Synthetic
ggaggcaucgcaggtaacauc

SEQ ID NO: 56069 - DNA, 21 bp, Artificial Sequence
  Synthetic
gctagggtcuccgaggtcuat

SEQ ID NO: 56070 - DNA, 25 bp, Artificial Sequence
  Synthetic
gagattactctcucaccccttcuct

SEQ ID NO: 56071 - DNA, 23 bp, Artificial Sequence
  Synthetic
ccccagaaugtgacagctuaagt

SEQ ID NO: 56072 - DNA, 22 bp, Artificial Sequence
  Synthetic
gggagggaauctaaccaguaca

SEQ ID NO: 56073 - DNA, 22 bp, Artificial Sequence
  Synthetic
gtctacagugcctggucagaag

SEQ ID NO: 56074 - DNA, 22 bp, Artificial Sequence
  Synthetic
cccctaccccugaagatctugt

SEQ ID NO: 56075 - DNA, 21 bp, Artificial Sequence
  Synthetic
gctgaggacuacguagcagag

SEQ ID NO: 56076 - DNA, 27 bp, Artificial Sequence
  Synthetic
tgagtcaaaagauagaaaccaugcagt

SEQ ID NO: 56077 - DNA, 28 bp, Artificial Sequence
  Synthetic
acccttttcttuttcttcttgtcugagt

SEQ ID NO: 56078 - DNA, 28 bp, Artificial Sequence
  Synthetic
ttctgtacacagugattgtgctattuca

SEQ ID NO: 56079 - DNA, 28 bp, Artificial Sequence
  Synthetic
gcctcatagttutgttcagtttcttuca

SEQ ID NO: 56080 - DNA, 29 bp, Artificial Sequence
  Synthetic
cagtagguttatagagcuggaacaagaaa

SEQ ID NO: 56081 - DNA, 28 bp, Artificial Sequence
  Synthetic
agtatacuagcaaagaacattccacuga

SEQ ID NO: 56082 - DNA, 26 bp, Artificial Sequence
  Synthetic
gcctcaacttaucagtagaagctgut

SEQ ID NO: 56083 - DNA, 24 bp, Artificial Sequence
  Synthetic
cccactggagcuctcttgatttut

SEQ ID NO: 56084 - DNA, 33 bp, Artificial Sequence
  Synthetic
tctcaatcctgatcautacataattatagcaut

SEQ ID NO: 56085 - DNA, 23 bp, Artificial Sequence
  Synthetic
aacaatguttcgaccuggacaga

SEQ ID NO: 56086 - DNA, 23 bp, Artificial Sequence
  Synthetic
ccctgtaagccutctactccauc

SEQ ID NO: 56087 - DNA, 27 bp, Artificial Sequence
  Synthetic
tgccaactaugaagcctgattcaaaua

SEQ ID NO: 56088 - DNA, 25 bp, Artificial Sequence
  Synthetic
cacttcacaaugcaaggtgtuacaa

SEQ ID NO: 56089 - DNA, 26 bp, Artificial Sequence
  Synthetic
tttttctgttgagucccaatttgcug

SEQ ID NO: 56090 - DNA, 25 bp, Artificial Sequence
  Synthetic
acttgagctuctctttacctugacc

SEQ ID NO: 56091 - DNA, 26 bp, Artificial Sequence
  Synthetic
gctggagaaacuggaaugagaaaaac

SEQ ID NO: 56092 - DNA, 26 bp, Artificial Sequence
  Synthetic
ggttactacuggattgacccuaacca

SEQ ID NO: 56093 - DNA, 23 bp, Artificial Sequence
  Synthetic
gaaggagaggugtttgtgggaut

SEQ ID NO: 56094 - DNA, 21 bp, Artificial Sequence
  Synthetic
cccccaacgugatcaggatuc

SEQ ID NO: 56095 - DNA, 25 bp, Artificial Sequence
  Synthetic
gggaacauacaactgatgagaaugt

SEQ ID NO: 56096 - DNA, 28 bp, Artificial Sequence
  Synthetic
cactccuccaaaatcaatguagaaccat

SEQ ID NO: 56097 - DNA, 22 bp, Artificial Sequence
  Synthetic
ggaccaaaagcuctguggaagg

SEQ ID NO: 56098 - DNA, 27 bp, Artificial Sequence
  Synthetic
ccggccauacccttttaacttttuaag

SEQ ID NO: 56099 - DNA, 28 bp, Artificial Sequence
  Synthetic
cctgtcttttctcutttcagaggatgut

SEQ ID NO: 56100 - DNA, 20 bp, Artificial Sequence
  Synthetic
ctcagcuggatctgctcuct

SEQ ID NO: 56101 - DNA, 28 bp, Artificial Sequence
  Synthetic
gggcaacauggtatttaaguacaaaaat

SEQ ID NO: 56102 - DNA, 23 bp, Artificial Sequence
  Synthetic
ccaaggaacagugtgtaggtcut

SEQ ID NO: 56103 - DNA, 29 bp, Artificial Sequence
  Synthetic
gaatctctatttccutggttgggatauca

SEQ ID NO: 56104 - DNA, 28 bp, Artificial Sequence
  Synthetic
tcctaggaacuaacaaaacattgtguct

SEQ ID NO: 56105 - DNA, 26 bp, Artificial Sequence
  Synthetic
agtatagcaucatggaccgucaaaaa

SEQ ID NO: 56106 - DNA, 25 bp, Artificial Sequence
  Synthetic
gtgaaaacauagcccgaatagctug

SEQ ID NO: 56107 - DNA, 26 bp, Artificial Sequence
  Synthetic
caatcuctgtgctguacaaaacacat

SEQ ID NO: 56108 - DNA, 21 bp, Artificial Sequence
  Synthetic
ggtgcagaugtgacagcagut

SEQ ID NO: 56109 - DNA, 29 bp, Artificial Sequence
  Synthetic
ttttgctuaaagagacagggatgauacat

SEQ ID NO: 56110 - DNA, 27 bp, Artificial Sequence
  Synthetic
ttgtcatcttcutcattgctgtuacct

SEQ ID NO: 56111 - DNA, 29 bp, Artificial Sequence
  Synthetic
acaatggaaatucaaagaaatcacttgut

SEQ ID NO: 56112 - DNA, 22 bp, Artificial Sequence
  Synthetic
gctcccaggcugagacttctua

SEQ ID NO: 56113 - DNA, 23 bp, Artificial Sequence
  Synthetic
caggucctagugaccagagagaa

SEQ ID NO: 56114 - DNA, 21 bp, Artificial Sequence
  Synthetic
cccuctccctcuaccagacaa

SEQ ID NO: 56115 - DNA, 20 bp, Artificial Sequence
  Synthetic
gtaccaggagcucccucgat

SEQ ID NO: 56116 - DNA, 19 bp, Artificial Sequence
  Synthetic
tgcaagtgucgctgctcut

SEQ ID NO: 56117 - DNA, 17 bp, Artificial Sequence
  Synthetic
ggagagcccguccagug

SEQ ID NO: 56118 - DNA, 22 bp, Artificial Sequence
  Synthetic
gggacttttguaggctgctcua

SEQ ID NO: 56119 - DNA, 21 bp, Artificial Sequence
  Synthetic
gtgctggacaugtacccugag

SEQ ID NO: 56120 - DNA, 19 bp, Artificial Sequence
  Synthetic
gcacccaggacguagugaa

SEQ ID NO: 56121 - DNA, 17 bp, Artificial Sequence
  Synthetic
cgcucccgagaaagcug

SEQ ID NO: 56122 - DNA, 26 bp, Artificial Sequence
  Synthetic
ggtggagaaaugatggtttaaaugct

SEQ ID NO: 56123 - DNA, 27 bp, Artificial Sequence
  Synthetic
tgttaattttcacgugtcctgctttuc

SEQ ID NO: 56124 - DNA, 29 bp, Artificial Sequence
  Synthetic
gacagtactaccuctcagttttcttucag

SEQ ID NO: 56125 - DNA, 28 bp, Artificial Sequence
  Synthetic
cacatcttttatuctgcacattcaucca

SEQ ID NO: 56126 - DNA, 24 bp, Artificial Sequence
  Synthetic
gaaggctatcugtgggttgtatut

SEQ ID NO: 56127 - DNA, 24 bp, Artificial Sequence
  Synthetic
aattgcuacagcggatagactugt

SEQ ID NO: 56128 - DNA, 27 bp, Artificial Sequence
  Synthetic
gagattttggaugatactgugcaaagg

SEQ ID NO: 56129 - DNA, 24 bp, Artificial Sequence
  Synthetic
caggacugctcagacatucaagaa

SEQ ID NO: 56130 - DNA, 24 bp, Artificial Sequence
  Synthetic
tttacaggtaucacgctcatugct

SEQ ID NO: 56131 - DNA, 25 bp, Artificial Sequence
  Synthetic
tgtaatttcgggacaucagactugg

SEQ ID NO: 56132 - DNA, 21 bp, Artificial Sequence
  Synthetic
ccttcaggauctgcagccaut

SEQ ID NO: 56133 - DNA, 29 bp, Artificial Sequence
  Synthetic
ccaaaactagguggaatttgaaatatgut

SEQ ID NO: 56134 - DNA, 23 bp, Artificial Sequence
  Synthetic
gattaccugtgtggttugccaaa

SEQ ID NO: 56135 - DNA, 28 bp, Artificial Sequence
  Synthetic
gatgccagtucttcaataaacagugaac

SEQ ID NO: 56136 - DNA, 27 bp, Artificial Sequence
  Synthetic
acgtattttggcuttgaaatggaacug

SEQ ID NO: 56137 - DNA, 27 bp, Artificial Sequence
  Synthetic
cgagagtugagagaaacacattttugg

SEQ ID NO: 56138 - DNA, 20 bp, Artificial Sequence
  Synthetic
ctgcctaucagcgcagcuat

SEQ ID NO: 56139 - DNA, 24 bp, Artificial Sequence
  Synthetic
agctgaguggaaacctugaagaaa

SEQ ID NO: 56140 - DNA, 25 bp, Artificial Sequence
  Synthetic
gatgatcugacagttctcttuggca

SEQ ID NO: 56141 - DNA, 26 bp, Artificial Sequence
  Synthetic
tctgtttcgguttctgaaaugaggaa

SEQ ID NO: 56142 - DNA, 27 bp, Artificial Sequence
  Synthetic
accaatcaccuattttcagacaugcaa

SEQ ID NO: 56143 - DNA, 27 bp, Artificial Sequence
  Synthetic
gacactctcuttcatgtaaccugaagt

SEQ ID NO: 56144 - DNA, 27 bp, Artificial Sequence
  Synthetic
tcatttgtgatggugggaagatcuaag

SEQ ID NO: 56145 - DNA, 27 bp, Artificial Sequence
  Synthetic
accttgcuccaaggatatcttttctut

SEQ ID NO: 56146 - DNA, 27 bp, Artificial Sequence
  Synthetic
gaaaagatcucatatccgacauaggca

SEQ ID NO: 56147 - DNA, 27 bp, Artificial Sequence
  Synthetic
agcgcttacccuattttccaattguaa

SEQ ID NO: 56148 - DNA, 22 bp, Artificial Sequence
  Synthetic
ggtaaggaagugaagggtccug

SEQ ID NO: 56149 - DNA, 26 bp, Artificial Sequence
  Synthetic
caatcacaggcauggttgagaatuag

SEQ ID NO: 56150 - DNA, 26 bp, Artificial Sequence
  Synthetic
gtacattcguaaaggctacagtguca

SEQ ID NO: 56151 - DNA, 22 bp, Artificial Sequence
  Synthetic
tctttgaccgugccttcttgut

SEQ ID NO: 56152 - DNA, 21 bp, Artificial Sequence
  Synthetic
cagatgagacugcctgcagua

SEQ ID NO: 56153 - DNA, 28 bp, Artificial Sequence
  Synthetic
gttttcuagattcaagatuggcaaagca

SEQ ID NO: 56154 - DNA, 25 bp, Artificial Sequence
  Synthetic
tuccatcttcatugagaagcacagt

SEQ ID NO: 56155 - DNA, 28 bp, Artificial Sequence
  Synthetic
ctggcatccugccttatctttuaaaaat

SEQ ID NO: 56156 - DNA, 23 bp, Artificial Sequence
  Synthetic
atgttcccucatctgctuccaag

SEQ ID NO: 56157 - DNA, 25 bp, Artificial Sequence
  Synthetic
ctaaccgtgauccctttcttctugt

SEQ ID NO: 56158 - DNA, 21 bp, Artificial Sequence
  Synthetic
ccacacatucccagtccugag

SEQ ID NO: 56159 - DNA, 24 bp, Artificial Sequence
  Synthetic
ctttcctcugccttgcgtttuaat

SEQ ID NO: 56160 - DNA, 28 bp, Artificial Sequence
  Synthetic
cttttgtgttttguctctctgtctgaug

SEQ ID NO: 56161 - DNA, 20 bp, Artificial Sequence
  Synthetic
ggacugaccgggugagaaat

SEQ ID NO: 56162 - DNA, 21 bp, Artificial Sequence
  Synthetic
cgtcccatugttccgaatcuc

SEQ ID NO: 56163 - DNA, 17 bp, Artificial Sequence
  Synthetic
gguacgcctucgcggat

SEQ ID NO: 56164 - DNA, 26 bp, Artificial Sequence
  Synthetic
cttacctacucccaaaattcugcagt

SEQ ID NO: 56165 - DNA, 27 bp, Artificial Sequence
  Synthetic
ccagtaagacggaacutgttgtttuct

SEQ ID NO: 56166 - DNA, 25 bp, Artificial Sequence
  Synthetic
cagtggctcutgaagatcgauagat

SEQ ID NO: 56167 - DNA, 27 bp, Artificial Sequence
  Synthetic
ccacttaacatguatggcagaagcaua

SEQ ID NO: 56168 - DNA, 29 bp, Artificial Sequence
  Synthetic
actgttgcaaugaagaataagaaaaugct

SEQ ID NO: 56169 - DNA, 22 bp, Artificial Sequence
  Synthetic
gccccgaucatgtttggcatua

SEQ ID NO: 56170 - DNA, 22 bp, Artificial Sequence
  Synthetic
ggattcgcagucgtgaaccaua

SEQ ID NO: 56171 - DNA, 22 bp, Artificial Sequence
  Synthetic
ctcttttgugaccgctctccut

SEQ ID NO: 56172 - DNA, 26 bp, Artificial Sequence
  Synthetic
ggcattatatugcagtgtgtgacuca

SEQ ID NO: 56173 - DNA, 29 bp, Artificial Sequence
  Synthetic
gcaagttttatcautccttccacaguaac

SEQ ID NO: 56174 - DNA, 25 bp, Artificial Sequence
  Synthetic
actgtctcagaguattctgcccuaa

SEQ ID NO: 56175 - DNA, 22 bp, Artificial Sequence
  Synthetic
tctgacaugtggcaacuggaag

SEQ ID NO: 56176 - DNA, 23 bp, Artificial Sequence
  Synthetic
atgcttgguacttggctgaauga

SEQ ID NO: 56177 - DNA, 28 bp, Artificial Sequence
  Synthetic
agtggcttgttgugataattaaggctua

SEQ ID NO: 56178 - DNA, 25 bp, Artificial Sequence
  Synthetic
cacacuttgtctggaucaaggacat

SEQ ID NO: 56179 - DNA, 22 bp, Artificial Sequence
  Synthetic
gcacacagugatcacacaguga

SEQ ID NO: 56180 - DNA, 22 bp, Artificial Sequence
  Synthetic
agcaguatcaugagcccagaga

SEQ ID NO: 56181 - DNA, 22 bp, Artificial Sequence
  Synthetic
caagacccagauccttgagugg

SEQ ID NO: 56182 - DNA, 21 bp, Artificial Sequence
  Synthetic
ctcaccaccugctgttctcut

SEQ ID NO: 56183 - DNA, 21 bp, Artificial Sequence
  Synthetic
cagcctccauggacatctcug

SEQ ID NO: 56184 - DNA, 17 bp, Artificial Sequence
  Synthetic
agaagugcggccagcut

SEQ ID NO: 56185 - DNA, 17 bp, Artificial Sequence
  Synthetic
ccagcccagcccutcut

SEQ ID NO: 56186 - DNA, 18 bp, Artificial Sequence
  Synthetic
ggctcaggccuccctuct

SEQ ID NO: 56187 - DNA, 21 bp, Artificial Sequence
  Synthetic
cataggcagacugtgcuggaa

SEQ ID NO: 56188 - DNA, 23 bp, Artificial Sequence
  Synthetic
augccttctactuacaggagggt

SEQ ID NO: 56189 - DNA, 28 bp, Artificial Sequence
  Synthetic
cctaacctggtutcaactgaagtacuaa

SEQ ID NO: 56190 - DNA, 24 bp, Artificial Sequence
  Synthetic
atctttaaaguaggctugccacat

SEQ ID NO: 56191 - DNA, 21 bp, Artificial Sequence
  Synthetic
agctgggacuaccatcctuca

SEQ ID NO: 56192 - DNA, 23 bp, Artificial Sequence
  Synthetic
gagttcaacagcuccgaguacag

SEQ ID NO: 56193 - DNA, 22 bp, Artificial Sequence
  Synthetic
ggtgccgcaaugtttgtttcua

SEQ ID NO: 56194 - DNA, 21 bp, Artificial Sequence
  Synthetic
aaggaagucacccctugcaaa

SEQ ID NO: 56195 - DNA, 23 bp, Artificial Sequence
  Synthetic
cggttgucattcacauccaggac

SEQ ID NO: 56196 - DNA, 22 bp, Artificial Sequence
  Synthetic
cagcttccuctccactgugaat

SEQ ID NO: 56197 - DNA, 19 bp, Artificial Sequence
  Synthetic
tcaggagcccautgcugac

SEQ ID NO: 56198 - DNA, 20 bp, Artificial Sequence
  Synthetic
gcagccccacucagttcuat

SEQ ID NO: 56199 - DNA, 23 bp, Artificial Sequence
  Synthetic
tcgtaguccaggtaatucacggt

SEQ ID NO: 56200 - DNA, 22 bp, Artificial Sequence
  Synthetic
ctccaucgacaaccucaaccaa

SEQ ID NO: 56201 - DNA, 28 bp, Artificial Sequence
  Synthetic
gccatcucaaggacattttaugacaaag

SEQ ID NO: 56202 - DNA, 21 bp, Artificial Sequence
  Synthetic
gggctagagaugacccacaua

SEQ ID NO: 56203 - DNA, 19 bp, Artificial Sequence
  Synthetic
aggtguccagctgcgatug

SEQ ID NO: 56204 - DNA, 26 bp, Artificial Sequence
  Synthetic
gtaggaagaguttgagcugaagaaga

SEQ ID NO: 56205 - DNA, 24 bp, Artificial Sequence
  Synthetic
tgaagcauccaacagagattuggt

SEQ ID NO: 56206 - DNA, 23 bp, Artificial Sequence
  Synthetic
ccagaacaagaucaagtcugcca

SEQ ID NO: 56207 - DNA, 25 bp, Artificial Sequence
  Synthetic
tgtccttatctucctgcacagttut

SEQ ID NO: 56208 - DNA, 20 bp, Artificial Sequence
  Synthetic
ccatguaaccgccacctgut

SEQ ID NO: 56209 - DNA, 22 bp, Artificial Sequence
  Synthetic
cctgggaauacatgctgauggg

SEQ ID NO: 56210 - DNA, 21 bp, Artificial Sequence
  Synthetic
catagtggugccccctgauag

SEQ ID NO: 56211 - DNA, 25 bp, Artificial Sequence
  Synthetic
ctgggtttuactctccactuaagga

SEQ ID NO: 56212 - DNA, 18 bp, Artificial Sequence
  Synthetic
cacccacucgcccaugat

SEQ ID NO: 56213 - DNA, 17 bp, Artificial Sequence
  Synthetic
gcgggucgttccacgua

SEQ ID NO: 56214 - DNA, 19 bp, Artificial Sequence
  Synthetic
agacccaccagccugtgua

SEQ ID NO: 56215 - DNA, 21 bp, Artificial Sequence
  Synthetic
ccataaccaguctgcugacga

SEQ ID NO: 56216 - DNA, 20 bp, Artificial Sequence
  Synthetic
gtctgccucatctucagcgt

SEQ ID NO: 56217 - DNA, 21 bp, Artificial Sequence
  Synthetic
cugtaucagggcaggaccaat

SEQ ID NO: 56218 - DNA, 21 bp, Artificial Sequence
  Synthetic
gcttcccacugtggttcttug

SEQ ID NO: 56219 - DNA, 22 bp, Artificial Sequence
  Synthetic
cttcccttauctggccatguga

SEQ ID NO: 56220 - DNA, 20 bp, Artificial Sequence
  Synthetic
caccttcccucggatctgut

SEQ ID NO: 56221 - DNA, 19 bp, Artificial Sequence
  Synthetic
ggctgatgugggtccaucc

SEQ ID NO: 56222 - DNA, 20 bp, Artificial Sequence
  Synthetic
ctcgucaacccccucaagaa

SEQ ID NO: 56223 - DNA, 24 bp, Artificial Sequence
  Synthetic
ggtccccauatatagugggaagga

SEQ ID NO: 56224 - DNA, 23 bp, Artificial Sequence
  Synthetic
gtcttgcaguaggagatggtcut

SEQ ID NO: 56225 - DNA, 20 bp, Artificial Sequence
  Synthetic
gctgtgguccagaucgacac

SEQ ID NO: 56226 - DNA, 21 bp, Artificial Sequence
  Synthetic
ggugatcctgguaccccagaa

SEQ ID NO: 56227 - DNA, 22 bp, Artificial Sequence
  Synthetic
gagtaacccuaagcugccagag

SEQ ID NO: 56228 - DNA, 21 bp, Artificial Sequence
  Synthetic
agggccuctgatcccuacaaa

SEQ ID NO: 56229 - DNA, 25 bp, Artificial Sequence
  Synthetic
gaugatgtaguagcagagcaggaag

SEQ ID NO: 56230 - DNA, 20 bp, Artificial Sequence
  Synthetic
cctcaccugcagcgtguaaa

SEQ ID NO: 56231 - DNA, 20 bp, Artificial Sequence
  Synthetic
gtgattuccccgagguccat

SEQ ID NO: 56232 - DNA, 25 bp, Artificial Sequence
  Synthetic
attcctttggguccatacaatucca

SEQ ID NO: 56233 - DNA, 28 bp, Artificial Sequence
  Synthetic
gggataatguaagcaaggttctcttuct

SEQ ID NO: 56234 - DNA, 24 bp, Artificial Sequence
  Synthetic
agggaccuatggccaaaugaaaaa

SEQ ID NO: 56235 - DNA, 24 bp, Artificial Sequence
  Synthetic
cctgtcagcutctggatttctugt

SEQ ID NO: 56236 - DNA, 28 bp, Artificial Sequence
  Synthetic
ttcaacatctttccaugtctccagatut

SEQ ID NO: 56237 - DNA, 27 bp, Artificial Sequence
  Synthetic
tggcttcuggataaacttctugaagag

SEQ ID NO: 56238 - DNA, 23 bp, Artificial Sequence
  Synthetic
agctatccaggauatgccaccut

SEQ ID NO: 56239 - DNA, 22 bp, Artificial Sequence
  Synthetic
guaacaguagcagccaaggaca

SEQ ID NO: 56240 - DNA, 25 bp, Artificial Sequence
  Synthetic
caggcaucuaacaaaggagaggaaa

SEQ ID NO: 56241 - DNA, 27 bp, Artificial Sequence
  Synthetic
gaatggcccautttgaataaggaucag

SEQ ID NO: 56242 - DNA, 27 bp, Artificial Sequence
  Synthetic
acagactgcttuccaaagattcttgua

SEQ ID NO: 56243 - DNA, 28 bp, Artificial Sequence
  Synthetic
gccatacctgtuttcccaataagtttuc

SEQ ID NO: 56244 - DNA, 27 bp, Artificial Sequence
  Synthetic
ctcttgcttacaugaactctatgucgt

SEQ ID NO: 56245 - DNA, 26 bp, Artificial Sequence
  Synthetic
tgtgagttguccatttcctttuccat

SEQ ID NO: 56246 - DNA, 22 bp, Artificial Sequence
  Synthetic
cacccggccuaaagttgtagut

SEQ ID NO: 56247 - DNA, 28 bp, Artificial Sequence
  Synthetic
gctaagcgaaautctgctttaaaugact

SEQ ID NO: 56248 - DNA, 23 bp, Artificial Sequence
  Synthetic
cagtucacacacacacaaaccut

SEQ ID NO: 56249 - DNA, 20 bp, Artificial Sequence
  Synthetic
gatcucaggcccgatgucat

SEQ ID NO: 56250 - DNA, 17 bp, Artificial Sequence
  Synthetic
ccctgagccuccctgug

SEQ ID NO: 56251 - DNA, 20 bp, Artificial Sequence
  Synthetic
agaacaggguccccatucct

SEQ ID NO: 56252 - DNA, 20 bp, Artificial Sequence
  Synthetic
gatgggtguctccacaguga

SEQ ID NO: 56253 - DNA, 19 bp, Artificial Sequence
  Synthetic
agacctgaacugggctugg

SEQ ID NO: 56254 - DNA, 21 bp, Artificial Sequence
  Synthetic
cggccagcagcccuatttuaa

SEQ ID NO: 56255 - DNA, 25 bp, Artificial Sequence
  Synthetic
gatggtaaugaccttaggtgtugct

SEQ ID NO: 56256 - DNA, 21 bp, Artificial Sequence
  Synthetic
cugccacccagaaaaccucat

SEQ ID NO: 56257 - DNA, 23 bp, Artificial Sequence
  Synthetic
gagggagaacuaggcttctcuga

SEQ ID NO: 56258 - DNA, 24 bp, Artificial Sequence
  Synthetic
gttatgccuccctcttauggcaat

SEQ ID NO: 56259 - DNA, 22 bp, Artificial Sequence
  Synthetic
ggagaggcacuacaacatgcuc

SEQ ID NO: 56260 - DNA, 23 bp, Artificial Sequence
  Synthetic
ggaggaagaaaguggcactcauc

SEQ ID NO: 56261 - DNA, 29 bp, Artificial Sequence
  Synthetic
gcagtgctattaccutcatcttggaatua

SEQ ID NO: 56262 - DNA, 21 bp, Artificial Sequence
  Synthetic
gctccttgugatcccctgtuc

SEQ ID NO: 56263 - DNA, 20 bp, Artificial Sequence
  Synthetic
tgagctauccaagcccgtuc

SEQ ID NO: 56264 - DNA, 20 bp, Artificial Sequence
  Synthetic
gaagggcccggcuagaaaua

SEQ ID NO: 56265 - DNA, 29 bp, Artificial Sequence
  Synthetic
ccttcattcaaguatagtcatccacauca

SEQ ID NO: 56266 - DNA, 21 bp, Artificial Sequence
  Synthetic
ggaggaccagguggaccuaag

SEQ ID NO: 56267 - DNA, 28 bp, Artificial Sequence
  Synthetic
caccatggaaaaaugtttaagccatuca

SEQ ID NO: 56268 - DNA, 28 bp, Artificial Sequence
  Synthetic
gggagcacatuagtgatgagaaaauact

SEQ ID NO: 56269 - DNA, 18 bp, Artificial Sequence
  Synthetic
agggtccucctggagcug

SEQ ID NO: 56270 - DNA, 22 bp, Artificial Sequence
  Synthetic
cttttctccagacuggcctuct

SEQ ID NO: 56271 - DNA, 28 bp, Artificial Sequence
  Synthetic
gatgcaaaagugttcaatgttttugaaa

SEQ ID NO: 56272 - DNA, 27 bp, Artificial Sequence
  Synthetic
aaaagctctatctuccctagtgtggua

SEQ ID NO: 56273 - DNA, 22 bp, Artificial Sequence
  Synthetic
aguacagtgccaugagagacca

SEQ ID NO: 56274 - DNA, 20 bp, Artificial Sequence
  Synthetic
agacagcaugccctttggut

SEQ ID NO: 56275 - DNA, 22 bp, Artificial Sequence
  Synthetic
gaaggaccgaguggtaagtcut

SEQ ID NO: 56276 - DNA, 29 bp, Artificial Sequence
  Synthetic
ttctgtcagtctutggtgaaactaguaag

SEQ ID NO: 56277 - DNA, 21 bp, Artificial Sequence
  Synthetic
caccatgcuctttgccucaga

SEQ ID NO: 56278 - DNA, 27 bp, Artificial Sequence
  Synthetic
cgaaaagtttcaauggctctatgucat

SEQ ID NO: 56279 - DNA, 25 bp, Artificial Sequence
  Synthetic
tgatacccttautccctgtggaugt

SEQ ID NO: 56280 - DNA, 22 bp, Artificial Sequence
  Synthetic
ggtccagcaauttgagucaggt

SEQ ID NO: 56281 - DNA, 25 bp, Artificial Sequence
  Synthetic
gaaagtcgugggtagatgugagaag

SEQ ID NO: 56282 - DNA, 23 bp, Artificial Sequence
  Synthetic
ctccttccucttcccacttucag

SEQ ID NO: 56283 - DNA, 23 bp, Artificial Sequence
  Synthetic
ccaaaagtctuccagagccttug

SEQ ID NO: 56284 - DNA, 24 bp, Artificial Sequence
  Synthetic
gcataagauccagcaccatcucaa

SEQ ID NO: 56285 - DNA, 28 bp, Artificial Sequence
  Synthetic
cattgttcacutaattctttuccaccca

SEQ ID NO: 56286 - DNA, 22 bp, Artificial Sequence
  Synthetic
gactcccagcuaaaactgccut

SEQ ID NO: 56287 - DNA, 22 bp, Artificial Sequence
  Synthetic
gacgucaaaaacccuccagaca

SEQ ID NO: 56288 - DNA, 22 bp, Artificial Sequence
  Synthetic
attactuggaaccagcccugac

SEQ ID NO: 56289 - DNA, 25 bp, Artificial Sequence
  Synthetic
gaagtcugggaaacacatcatcuct

SEQ ID NO: 56290 - DNA, 28 bp, Artificial Sequence
  Synthetic
cactgatataaagutgcgagccatttuc

SEQ ID NO: 56291 - DNA, 24 bp, Artificial Sequence
  Synthetic
gccaaaauaaacttccauggccaa

SEQ ID NO: 56292 - DNA, 23 bp, Artificial Sequence
  Synthetic
ccggccaauattgtctctugact

SEQ ID NO: 56293 - DNA, 20 bp, Artificial Sequence
  Synthetic
ggtgggctutgcctcttcuc

SEQ ID NO: 56294 - DNA, 21 bp, Artificial Sequence
  Synthetic
tgatgtugaccactgctuggg

SEQ ID NO: 56295 - DNA, 28 bp, Artificial Sequence
  Synthetic
cttgcttttgacagucttgttgattuct

SEQ ID NO: 56296 - DNA, 23 bp, Artificial Sequence
  Synthetic
gggtctgtaugaatgtccaguca

SEQ ID NO: 56297 - DNA, 25 bp, Artificial Sequence
  Synthetic
ggcctggtgutttaaagattctucc

SEQ ID NO: 56298 - DNA, 25 bp, Artificial Sequence
  Synthetic
acattgtacuccacaggaattucgg

SEQ ID NO: 56299 - DNA, 25 bp, Artificial Sequence
  Synthetic
acaaacatttgtugcccattctgut

SEQ ID NO: 56300 - DNA, 22 bp, Artificial Sequence
  Synthetic
tggataagugggaccugaccat

SEQ ID NO: 56301 - DNA, 22 bp, Artificial Sequence
  Synthetic
gcaggtugggaaaggtctcauc

SEQ ID NO: 56302 - DNA, 24 bp, Artificial Sequence
  Synthetic
cagaaaaguauggcaacaccaaca

SEQ ID NO: 56303 - DNA, 28 bp, Artificial Sequence
  Synthetic
gcaaacaatauagtgatggaaaauggca

SEQ ID NO: 56304 - DNA, 27 bp, Artificial Sequence
  Synthetic
aaactgttgagguaagaagcaaucaga

SEQ ID NO: 56305 - DNA, 22 bp, Artificial Sequence
  Synthetic
tcagttggtugtgtgaccagug

SEQ ID NO: 56306 - DNA, 17 bp, Artificial Sequence
  Synthetic
cccggcgugcaguacaa

SEQ ID NO: 56307 - DNA, 18 bp, Artificial Sequence
  Synthetic
tccacaaagcgcccucuc

SEQ ID NO: 56308 - DNA, 21 bp, Artificial Sequence
  Synthetic
tccctuagagggcactucact

SEQ ID NO: 56309 - DNA, 28 bp, Artificial Sequence
  Synthetic
agcttgtcgaugttgttcttatagtuga

SEQ ID NO: 56310 - DNA, 29 bp, Artificial Sequence
  Synthetic
acattctttccuactaacgttccttugag

SEQ ID NO: 56311 - DNA, 26 bp, Artificial Sequence
  Synthetic
tgaccacagggagaugaaatcaaaug

SEQ ID NO: 56312 - DNA, 22 bp, Artificial Sequence
  Synthetic
gaaggccugctccaaaugaaac

SEQ ID NO: 56313 - DNA, 28 bp, Artificial Sequence
  Synthetic
ggaaugcaaagaaauaaacacacacaca

SEQ ID NO: 56314 - DNA, 25 bp, Artificial Sequence
  Synthetic
gggtacaggauatggacttgaaaug

SEQ ID NO: 56315 - DNA, 19 bp, Artificial Sequence
  Synthetic
cccccaaugccgtcauact

SEQ ID NO: 56316 - DNA, 23 bp, Artificial Sequence
  Synthetic
agatgttgcuctgagcttuaccc

SEQ ID NO: 56317 - DNA, 27 bp, Artificial Sequence
  Synthetic
aatagcatcucaggaatcaaagacgut

SEQ ID NO: 56318 - DNA, 28 bp, Artificial Sequence
  Synthetic
catctaatgagtttucagccaagggaua

SEQ ID NO: 56319 - DNA, 22 bp, Artificial Sequence
  Synthetic
ctctcctucaactgggtuccac

SEQ ID NO: 56320 - DNA, 24 bp, Artificial Sequence
  Synthetic
ccaaacacaaauggccttctacuc

SEQ ID NO: 56321 - DNA, 28 bp, Artificial Sequence
  Synthetic
acagcccttagaaaguctatacacagua

SEQ ID NO: 56322 - DNA, 26 bp, Artificial Sequence
  Synthetic
gaacautagctttgtuccaacagaca

SEQ ID NO: 56323 - DNA, 28 bp, Artificial Sequence
  Synthetic
agcgtcaagcaugatgtatcuaagaaat

SEQ ID NO: 56324 - DNA, 28 bp, Artificial Sequence
  Synthetic
ccttacaattctcugggattcacatuct

SEQ ID NO: 56325 - DNA, 23 bp, Artificial Sequence
  Synthetic
gttttcagccaucatttcugcca

SEQ ID NO: 56326 - DNA, 28 bp, Artificial Sequence
  Synthetic
tcacttggaagaccutaaaacauaagca

SEQ ID NO: 56327 - DNA, 24 bp, Artificial Sequence
  Synthetic
cttcatatcucaaagcacugcaca

SEQ ID NO: 56328 - DNA, 27 bp, Artificial Sequence
  Synthetic
ctttaaggagtagcugagaaaccacut

SEQ ID NO: 56329 - DNA, 28 bp, Artificial Sequence
  Synthetic
ctacaaacaguaggcgtgatctaucaat

SEQ ID NO: 56330 - DNA, 28 bp, Artificial Sequence
  Synthetic
tgggaaagaugttattgaugaacaagga

SEQ ID NO: 56331 - DNA, 27 bp, Artificial Sequence
  Synthetic
gctacagauagcagccatgtttaaaug

SEQ ID NO: 56332 - DNA, 22 bp, Artificial Sequence
  Synthetic
aagcctgutgattcagugacct

SEQ ID NO: 56333 - DNA, 28 bp, Artificial Sequence
  Synthetic
gcagtagtagauacgttcatcgugaaat

SEQ ID NO: 56334 - DNA, 27 bp, Artificial Sequence
  Synthetic
cgtttacttuctgaagcagtuaacaca

SEQ ID NO: 56335 - DNA, 23 bp, Artificial Sequence
  Synthetic
gaaacgtgcugcaacaguagaac

SEQ ID NO: 56336 - DNA, 19 bp, Artificial Sequence
  Synthetic
cccaauggcgccctctuac

SEQ ID NO: 56337 - DNA, 28 bp, Artificial Sequence
  Synthetic
cgaacccautaggaacatugaaacaaat

SEQ ID NO: 56338 - DNA, 21 bp, Artificial Sequence
  Synthetic
ccacacaccgaacugtugaga

SEQ ID NO: 56339 - DNA, 21 bp, Artificial Sequence
  Synthetic
ggcgccuagcttatuccacag

SEQ ID NO: 56340 - DNA, 25 bp, Artificial Sequence
  Synthetic
cccattgtgccutcatagttctcug

SEQ ID NO: 56341 - DNA, 28 bp, Artificial Sequence
  Synthetic
ccggtgatuaaccacaacttcttactut

SEQ ID NO: 56342 - DNA, 28 bp, Artificial Sequence
  Synthetic
gttgatgatgttatugcctagtcagcua

SEQ ID NO: 56343 - DNA, 27 bp, Artificial Sequence
  Synthetic
atgaagtttattttugcccctctcuct

SEQ ID NO: 56344 - DNA, 26 bp, Artificial Sequence
  Synthetic
tcttctaaacucttacccagucagca

SEQ ID NO: 56345 - DNA, 27 bp, Artificial Sequence
  Synthetic
cgtccatcttucctccattttacugat

SEQ ID NO: 56346 - DNA, 22 bp, Artificial Sequence
  Synthetic
ctgtccattcugctgagacugt

SEQ ID NO: 56347 - DNA, 28 bp, Artificial Sequence
  Synthetic
gttggtggtggutttattgttaactcut

SEQ ID NO: 56348 - DNA, 23 bp, Artificial Sequence
  Synthetic
cgaccttcauaagtggcagtugt

SEQ ID NO: 56349 - DNA, 21 bp, Artificial Sequence
  Synthetic
gggcaaactuctcgtcatcug

SEQ ID NO: 56350 - DNA, 28 bp, Artificial Sequence
  Synthetic
cctgggatucagaaatgtggatuaaaag

SEQ ID NO: 56351 - DNA, 21 bp, Artificial Sequence
  Synthetic
cagtcaccagcuaatgcccua

SEQ ID NO: 56352 - DNA, 28 bp, Artificial Sequence
  Synthetic
agattttacaaagggaauggactgugaa

SEQ ID NO: 56353 - DNA, 28 bp, Artificial Sequence
  Synthetic
gcatctcgguaaaattctcctacacuaa

SEQ ID NO: 56354 - DNA, 21 bp, Artificial Sequence
  Synthetic
acgcaaagccugcatgaguaa

SEQ ID NO: 56355 - DNA, 28 bp, Artificial Sequence
  Synthetic
tgacatttcuaggcagttgagaaucaat

SEQ ID NO: 56356 - DNA, 25 bp, Artificial Sequence
  Synthetic
aggattggtuagaaagggagggaut

SEQ ID NO: 56357 - DNA, 23 bp, Artificial Sequence
  Synthetic
aggtcagccaaaaucaagucagg

SEQ ID NO: 56358 - DNA, 28 bp, Artificial Sequence
  Synthetic
ggagaagaaguggctgtgaagattttua

SEQ ID NO: 56359 - DNA, 27 bp, Artificial Sequence
  Synthetic
cacaaaacuttctacuccacaacgaaa

SEQ ID NO: 56360 - DNA, 28 bp, Artificial Sequence
  Synthetic
catcaatctuccacatgaagugcaaaat

SEQ ID NO: 56361 - DNA, 28 bp, Artificial Sequence
  Synthetic
acattccttcauacacacgagctattuc

SEQ ID NO: 56362 - DNA, 21 bp, Artificial Sequence
  Synthetic
gctgagggagguagaagccut

SEQ ID NO: 56363 - DNA, 22 bp, Artificial Sequence
  Synthetic
ggccactgucagttctcatcuc

SEQ ID NO: 56364 - DNA, 20 bp, Artificial Sequence
  Synthetic
agggagguagguagcaccac

SEQ ID NO: 56365 - DNA, 27 bp, Artificial Sequence
  Synthetic
agtgtctatgttcugagaatggtgtuc

SEQ ID NO: 56366 - DNA, 28 bp, Artificial Sequence
  Synthetic
acattttgcttuttgctcacaaucagat

SEQ ID NO: 56367 - DNA, 24 bp, Artificial Sequence
  Synthetic
gacactgaccutgtgcatcattut

SEQ ID NO: 56368 - DNA, 20 bp, Artificial Sequence
  Synthetic
ccggctuccacacatcctua

SEQ ID NO: 56369 - DNA, 23 bp, Artificial Sequence
  Synthetic
tctgtcaagtugactgcaaccuc

SEQ ID NO: 56370 - DNA, 17 bp, Artificial Sequence
  Synthetic
ggcagugcagggucgag

SEQ ID NO: 56371 - DNA, 21 bp, Artificial Sequence
  Synthetic
ctgtucaagctccugcagaga

SEQ ID NO: 56372 - DNA, 22 bp, Artificial Sequence
  Synthetic
ctauggcgatgguagggaaaga

SEQ ID NO: 56373 - DNA, 21 bp, Artificial Sequence
  Synthetic
actcaagccugtggtttuggt

SEQ ID NO: 56374 - DNA, 25 bp, Artificial Sequence
  Synthetic
gtctgtcactgugaaaagagggaut

SEQ ID NO: 56375 - DNA, 20 bp, Artificial Sequence
  Synthetic
gcagttcccuctgctcctug

SEQ ID NO: 56376 - DNA, 22 bp, Artificial Sequence
  Synthetic
gagaugcagctggaauaggcat

SEQ ID NO: 56377 - DNA, 28 bp, Artificial Sequence
  Synthetic
cctgaagcctcutttaggaagtaacaut

SEQ ID NO: 56378 - DNA, 25 bp, Artificial Sequence
  Synthetic
aggtcagaauctttgtgtugggaaa

SEQ ID NO: 56379 - DNA, 23 bp, Artificial Sequence
  Synthetic
gtgttcatgautgcagtgtcugg

SEQ ID NO: 56380 - DNA, 28 bp, Artificial Sequence
  Synthetic
cctttagcaaacutctgaaugacaacat

SEQ ID NO: 56381 - DNA, 25 bp, Artificial Sequence
  Synthetic
ccttaaccucacactatccctcucc

SEQ ID NO: 56382 - DNA, 22 bp, Artificial Sequence
  Synthetic
tgccactgucaattgtgccuaa

SEQ ID NO: 56383 - DNA, 27 bp, Artificial Sequence
  Synthetic
tcuggagaggaagatuaagaggacaag

SEQ ID NO: 56384 - DNA, 21 bp, Artificial Sequence
  Synthetic
gctcuggcagctctgauacag

SEQ ID NO: 56385 - DNA, 24 bp, Artificial Sequence
  Synthetic
ccccctcacaccucttattcttut

SEQ ID NO: 56386 - DNA, 21 bp, Artificial Sequence
  Synthetic
actcctctcugctccacucaa

SEQ ID NO: 56387 - DNA, 21 bp, Artificial Sequence
  Synthetic
ggtgactcuggacactuccct

SEQ ID NO: 56388 - DNA, 21 bp, Artificial Sequence
  Synthetic
ttcttgccacggucacctaug

SEQ ID NO: 56389 - DNA, 23 bp, Artificial Sequence
  Synthetic
atgaaccatgucaggcaaaucct

SEQ ID NO: 56390 - DNA, 22 bp, Artificial Sequence
  Synthetic
cgggacaaaaucttggcttuga

SEQ ID NO: 56391 - DNA, 24 bp, Artificial Sequence
  Synthetic
gtaacatagcccucctgtctcuga

SEQ ID NO: 56392 - DNA, 21 bp, Artificial Sequence
  Synthetic
gcctcggutcccttcacuaaa

SEQ ID NO: 56393 - DNA, 20 bp, Artificial Sequence
  Synthetic
caagagccuccagagctugt

SEQ ID NO: 56394 - DNA, 21 bp, Artificial Sequence
  Synthetic
gcttctuggcagtgagcucag

SEQ ID NO: 56395 - DNA, 25 bp, Artificial Sequence
  Synthetic
tctacctgcaagaaugaggacctua

SEQ ID NO: 56396 - DNA, 24 bp, Artificial Sequence
  Synthetic
gccaatgaugttgtaguccacgat

SEQ ID NO: 56397 - DNA, 22 bp, Artificial Sequence
  Synthetic
cagtgatgcuctctcctgctuc

SEQ ID NO: 56398 - DNA, 27 bp, Artificial Sequence
  Synthetic
gcaccttaaagucctcatatcaaucct

SEQ ID NO: 56399 - DNA, 29 bp, Artificial Sequence
  Synthetic
caccaaatgauccaacagaaataatucca

SEQ ID NO: 56400 - DNA, 24 bp, Artificial Sequence
  Synthetic
tttattctgtggcauggaggacug

SEQ ID NO: 56401 - DNA, 25 bp, Artificial Sequence
  Synthetic
ccacgaaugctctagaaaugagagt

SEQ ID NO: 56402 - DNA, 29 bp, Artificial Sequence
  Synthetic
gcaggctccugattattaacgtattcuaa

SEQ ID NO: 56403 - DNA, 24 bp, Artificial Sequence
  Synthetic
catcttctucacccctcggaauag

SEQ ID NO: 56404 - DNA, 22 bp, Artificial Sequence
  Synthetic
tccattcacuggaaagguccac

SEQ ID NO: 56405 - DNA, 27 bp, Artificial Sequence
  Synthetic
ggcattcctgugacaaacaaattauca

SEQ ID NO: 56406 - DNA, 23 bp, Artificial Sequence
  Synthetic
tggtccugagaagaactccagut

SEQ ID NO: 56407 - DNA, 29 bp, Artificial Sequence
  Synthetic
gagtgaauggcaattgtttgtuagaaaag

SEQ ID NO: 56408 - DNA, 28 bp, Artificial Sequence
  Synthetic
ccacagaaauaaaaagagaaacggcaut

SEQ ID NO: 56409 - DNA, 23 bp, Artificial Sequence
  Synthetic
gtgaccagggaaguaatgaguct

SEQ ID NO: 56410 - DNA, 28 bp, Artificial Sequence
  Synthetic
cttacctggtcauttcctttttgttuca

SEQ ID NO: 56411 - DNA, 21 bp, Artificial Sequence
  Synthetic
aggatctgaccugaggcacut

SEQ ID NO: 56412 - DNA, 24 bp, Artificial Sequence
  Synthetic
gaacatcacagcauccaagaggua

SEQ ID NO: 56413 - DNA, 21 bp, Artificial Sequence
  Synthetic
tctgtggtgutcccaccttuc

SEQ ID NO: 56414 - DNA, 25 bp, Artificial Sequence
  Synthetic
ttcagactgtaaucctcccttccut

SEQ ID NO: 56415 - DNA, 19 bp, Artificial Sequence
  Synthetic
cgcauaggaagcccctgua

SEQ ID NO: 56416 - DNA, 21 bp, Artificial Sequence
  Synthetic
ccctgggcucagatctgcuat

SEQ ID NO: 56417 - DNA, 22 bp, Artificial Sequence
  Synthetic
tcuaagggcattugccagaaca

SEQ ID NO: 56418 - DNA, 23 bp, Artificial Sequence
  Synthetic
gcatactuacccaagcacauggt

SEQ ID NO: 56419 - DNA, 27 bp, Artificial Sequence
  Synthetic
tcgtaatgaaugtcaagaaauccccaa

SEQ ID NO: 56420 - DNA, 28 bp, Artificial Sequence
  Synthetic
tcaagtagctcaucagttagctctttuc

SEQ ID NO: 56421 - DNA, 23 bp, Artificial Sequence
  Synthetic
gtgctgtccugtcactcaugaat

SEQ ID NO: 56422 - DNA, 23 bp, Artificial Sequence
  Synthetic
gccacaagaaagcuctcttugga

SEQ ID NO: 56423 - DNA, 25 bp, Artificial Sequence
  Synthetic
catggcauctgaagacaugaagact

SEQ ID NO: 56424 - DNA, 24 bp, Artificial Sequence
  Synthetic
gccatcaaagcutcatggaaucct

SEQ ID NO: 56425 - DNA, 22 bp, Artificial Sequence
  Synthetic
gagactcattugctgccactug

SEQ ID NO: 56426 - DNA, 20 bp, Artificial Sequence
  Synthetic
ggagucaggccagactagug

SEQ ID NO: 56427 - DNA, 26 bp, Artificial Sequence
  Synthetic
ctgttcugcaaacaagggaatcatut

SEQ ID NO: 56428 - DNA, 21 bp, Artificial Sequence
  Synthetic
gaaggagtcuccaggcagaug

SEQ ID NO: 56429 - DNA, 23 bp, Artificial Sequence
  Synthetic
cccaccgtguttctaggattcug

SEQ ID NO: 56430 - DNA, 22 bp, Artificial Sequence
  Synthetic
ggcgtggagugaactctttcuc

SEQ ID NO: 56431 - DNA, 20 bp, Artificial Sequence
  Synthetic
gccttcaugcaggcaaacuc

SEQ ID NO: 56432 - DNA, 21 bp, Artificial Sequence
  Synthetic
cctgagcaaugtgagcccaua

SEQ ID NO: 56433 - DNA, 28 bp, Artificial Sequence
  Synthetic
cctatgagttcaugagcacattcttcut

SEQ ID NO: 56434 - DNA, 24 bp, Artificial Sequence
  Synthetic
tggttaggaugagagaccctgtuc

SEQ ID NO: 56435 - DNA, 23 bp, Artificial Sequence
  Synthetic
gggttcacagugtgcacttuaac

SEQ ID NO: 56436 - DNA, 28 bp, Artificial Sequence
  Synthetic
ctcctaaucacagttaaaccugaaggaa

SEQ ID NO: 56437 - DNA, 22 bp, Artificial Sequence
  Synthetic
gacatccucaggttcttugcca

SEQ ID NO: 56438 - DNA, 21 bp, Artificial Sequence
  Synthetic
gccttucccccaagaggttug

SEQ ID NO: 56439 - DNA, 20 bp, Artificial Sequence
  Synthetic
tccatccccguggacuacat

SEQ ID NO: 56440 - DNA, 22 bp, Artificial Sequence
  Synthetic
cgcaaggcaggaaagutaacuc

SEQ ID NO: 56441 - DNA, 27 bp, Artificial Sequence
  Synthetic
gtcaacaaattcuccctaaggatgtuc

SEQ ID NO: 56442 - DNA, 22 bp, Artificial Sequence
  Synthetic
cctctgtgggaauccagggtua

SEQ ID NO: 56443 - DNA, 24 bp, Artificial Sequence
  Synthetic
ccgtgcuctggaaaucaacaaaat

SEQ ID NO: 56444 - DNA, 20 bp, Artificial Sequence
  Synthetic
ccagcgccaccugatuacag

SEQ ID NO: 56445 - DNA, 22 bp, Artificial Sequence
  Synthetic
ctgagagcuggtggtggtaaug

SEQ ID NO: 56446 - DNA, 18 bp, Artificial Sequence
  Synthetic
agctctgugccctgtgug

SEQ ID NO: 56447 - DNA, 23 bp, Artificial Sequence
  Synthetic
cacctcauagaactgcctgtuga

SEQ ID NO: 56448 - DNA, 22 bp, Artificial Sequence
  Synthetic
cagaaccaugagcctgtgtgua

SEQ ID NO: 56449 - DNA, 18 bp, Artificial Sequence
  Synthetic
ctgguggacgcuagccat

SEQ ID NO: 56450 - DNA, 20 bp, Artificial Sequence
  Synthetic
ggcctcagcugcttctctug

SEQ ID NO: 56451 - DNA, 18 bp, Artificial Sequence
  Synthetic
caacgugggacggauggt

SEQ ID NO: 56452 - DNA, 19 bp, Artificial Sequence
  Synthetic
gatggccaggcuctgtgut

SEQ ID NO: 56453 - DNA, 18 bp, Artificial Sequence
  Synthetic
acacagcuccagcggaug

SEQ ID NO: 56454 - DNA, 20 bp, Artificial Sequence
  Synthetic
ggcaacgacuttgtguccat

SEQ ID NO: 56455 - DNA, 19 bp, Artificial Sequence
  Synthetic
ctcctcgugaccgaagcuc

SEQ ID NO: 56456 - DNA, 21 bp, Artificial Sequence
  Synthetic
aaaggcugcagagcatugaac

SEQ ID NO: 56457 - DNA, 20 bp, Artificial Sequence
  Synthetic
tttgcacucttccuggccaa

SEQ ID NO: 56458 - DNA, 20 bp, Artificial Sequence
  Synthetic
gguccgcacaaacctttgut

SEQ ID NO: 56459 - DNA, 19 bp, Artificial Sequence
  Synthetic
cttgccucccagguaccac

SEQ ID NO: 56460 - DNA, 19 bp, Artificial Sequence
  Synthetic
cacctgcugtgtggcttug

SEQ ID NO: 56461 - DNA, 20 bp, Artificial Sequence
  Synthetic
gcaataccccugaggcauga

SEQ ID NO: 56462 - DNA, 20 bp, Artificial Sequence
  Synthetic
catgccccaagcucctagug

SEQ ID NO: 56463 - DNA, 22 bp, Artificial Sequence
  Synthetic
ggcagcacacauctctatucct

SEQ ID NO: 56464 - DNA, 17 bp, Artificial Sequence
  Synthetic
gcugcccctgugacacc

SEQ ID NO: 56465 - DNA, 23 bp, Artificial Sequence
  Synthetic
gagaagaaccugcuacaggaaca

SEQ ID NO: 56466 - DNA, 20 bp, Artificial Sequence
  Synthetic
ctcugcacgcaaacactcug

SEQ ID NO: 56467 - DNA, 28 bp, Artificial Sequence
  Synthetic
aggttgctttcuccaataactagatgug

SEQ ID NO: 56468 - DNA, 20 bp, Artificial Sequence
  Synthetic
gccttcttucccagccctug

SEQ ID NO: 56469 - DNA, 24 bp, Artificial Sequence
  Synthetic
cagagggacutgtcacttcttugt

SEQ ID NO: 56470 - DNA, 29 bp, Artificial Sequence
  Synthetic
aatgtaaacaaaatucatggcatggauca

SEQ ID NO: 56471 - DNA, 28 bp, Artificial Sequence
  Synthetic
gcttattctgttuactggagggttuagt

SEQ ID NO: 56472 - DNA, 22 bp, Artificial Sequence
  Synthetic
catcgccuactccatggugaag

SEQ ID NO: 56473 - DNA, 20 bp, Artificial Sequence
  Synthetic
acccutgtgtgguagaccca

SEQ ID NO: 56474 - DNA, 21 bp, Artificial Sequence
  Synthetic
tcccgaggutcataccgtgua

SEQ ID NO: 56475 - DNA, 27 bp, Artificial Sequence
  Synthetic
tgtttctcatctuggacttgatctugt

SEQ ID NO: 56476 - DNA, 24 bp, Artificial Sequence
  Synthetic
agggtagauactcatgttgucggt

SEQ ID NO: 56477 - DNA, 26 bp, Artificial Sequence
  Synthetic
tttgggatttaaguggttctggtuct

SEQ ID NO: 56478 - DNA, 22 bp, Artificial Sequence
  Synthetic
gccccaacagcagutaagucaa

SEQ ID NO: 56479 - DNA, 24 bp, Artificial Sequence
  Synthetic
cctcagaugccaaatgactttcuc

SEQ ID NO: 56480 - DNA, 21 bp, Artificial Sequence
  Synthetic
cctacaucaagctcgcaguca

SEQ ID NO: 56481 - DNA, 22 bp, Artificial Sequence
  Synthetic
gctttccgucctgtttccucac

SEQ ID NO: 56482 - DNA, 24 bp, Artificial Sequence
  Synthetic
ccagaagugggatttttggctuaa

SEQ ID NO: 56483 - DNA, 23 bp, Artificial Sequence
  Synthetic
gccaatgacccutccttctugac

SEQ ID NO: 56484 - DNA, 24 bp, Artificial Sequence
  Synthetic
ctccctttccuctccttgagacua

SEQ ID NO: 56485 - DNA, 28 bp, Artificial Sequence
  Synthetic
caggaagcaggagaugaaaataaatcug

SEQ ID NO: 56486 - DNA, 21 bp, Artificial Sequence
  Synthetic
gggatgugatgagagguggat

SEQ ID NO: 56487 - DNA, 22 bp, Artificial Sequence
  Synthetic
tgtgtaacagutcctgcauggg

SEQ ID NO: 56488 - DNA, 23 bp, Artificial Sequence
  Synthetic
tcagtcccauggaattttcgcut

SEQ ID NO: 56489 - DNA, 23 bp, Artificial Sequence
  Synthetic
ctggatccccacutttcctctug

SEQ ID NO: 56490 - DNA, 26 bp, Artificial Sequence
  Synthetic
ctcagtttaaagugcaaatcgacucc

SEQ ID NO: 56491 - DNA, 25 bp, Artificial Sequence
  Synthetic
gctggaagaaagugaaaacaacugt

SEQ ID NO: 56492 - DNA, 22 bp, Artificial Sequence
  Synthetic
tggagggcagautguagggaat

SEQ ID NO: 56493 - DNA, 24 bp, Artificial Sequence
  Synthetic
cttcacagtaauggccacctttut

SEQ ID NO: 56494 - DNA, 25 bp, Artificial Sequence
  Synthetic
ggatggagaauggcttcaacatgua

SEQ ID NO: 56495 - DNA, 20 bp, Artificial Sequence
  Synthetic
cacaaggcucccaccaacut

SEQ ID NO: 56496 - DNA, 20 bp, Artificial Sequence
  Synthetic
ccgtcuggactgaccucaat

SEQ ID NO: 56497 - DNA, 22 bp, Artificial Sequence
  Synthetic
aggcuagcagagactttcucct

SEQ ID NO: 56498 - DNA, 22 bp, Artificial Sequence
  Synthetic
gcaaatgguggctgactgagut

SEQ ID NO: 56499 - DNA, 21 bp, Artificial Sequence
  Synthetic
gcagatcctugagggcaacug

SEQ ID NO: 56500 - DNA, 28 bp, Artificial Sequence
  Synthetic
ggatcttataaggcuctatctgcaugaa

SEQ ID NO: 56501 - DNA, 26 bp, Artificial Sequence
  Synthetic
ggcctttcuccattaaacagcuagat

SEQ ID NO: 56502 - DNA, 21 bp, Artificial Sequence
  Synthetic
ctgctcccacucaagccttua

SEQ ID NO: 56503 - DNA, 21 bp, Artificial Sequence
  Synthetic
gcgcagugtgatcuggaagac

SEQ ID NO: 56504 - DNA, 21 bp, Artificial Sequence
  Synthetic
gctgcctauctgtgctccaut

SEQ ID NO: 56505 - DNA, 23 bp, Artificial Sequence
  Synthetic
ccatgaatcauctcgggtctcug

SEQ ID NO: 56506 - DNA, 23 bp, Artificial Sequence
  Synthetic
gctaacagagcuaagcagaugcc

SEQ ID NO: 56507 - DNA, 26 bp, Artificial Sequence
  Synthetic
gtgatcttaauggagttcuccaggat

SEQ ID NO: 56508 - DNA, 22 bp, Artificial Sequence
  Synthetic
ggucaaggcacttcuggaagaa

SEQ ID NO: 56509 - DNA, 21 bp, Artificial Sequence
  Synthetic
ccctccaugcctuacaagacc

SEQ ID NO: 56510 - DNA, 21 bp, Artificial Sequence
  Synthetic
ccctgcaaugtgacaugacga

SEQ ID NO: 56511 - DNA, 22 bp, Artificial Sequence
  Synthetic
agaaagcugccctttggtucat

SEQ ID NO: 56512 - DNA, 24 bp, Artificial Sequence
  Synthetic
tctgctttctgutttcccttccuc

SEQ ID NO: 56513 - DNA, 23 bp, Artificial Sequence
  Synthetic
gtggcatcucaactcggatuact

SEQ ID NO: 56514 - DNA, 26 bp, Artificial Sequence
  Synthetic
aatccaaguaagccattcucaagagg

SEQ ID NO: 56515 - DNA, 25 bp, Artificial Sequence
  Synthetic
aaccaatgctcucaccttaaagugt

SEQ ID NO: 56516 - DNA, 26 bp, Artificial Sequence
  Synthetic
gtgcataaccucttgcccaactauaa

SEQ ID NO: 56517 - DNA, 25 bp, Artificial Sequence
  Synthetic
caaaatcagaugccatgtgcttuga

SEQ ID NO: 56518 - DNA, 24 bp, Artificial Sequence
  Synthetic
gcacagaatutgacacactugcag

SEQ ID NO: 56519 - DNA, 26 bp, Artificial Sequence
  Synthetic
cttttcttccccgcutactctaauca

SEQ ID NO: 56520 - DNA, 28 bp, Artificial Sequence
  Synthetic
aacttcatttgtgutttctcctagguca

SEQ ID NO: 56521 - DNA, 25 bp, Artificial Sequence
  Synthetic
gtgttgtuggcagggatacauaaac

SEQ ID NO: 56522 - DNA, 29 bp, Artificial Sequence
  Synthetic
tgtcatgattcaucttactagccucaaac

SEQ ID NO: 56523 - DNA, 26 bp, Artificial Sequence
  Synthetic
gagtaatcuaggaaccucaaggcaaa

SEQ ID NO: 56524 - DNA, 22 bp, Artificial Sequence
  Synthetic
caggccaucaagtgtgactuct

SEQ ID NO: 56525 - DNA, 21 bp, Artificial Sequence
  Synthetic
ccctttcuggctctggaagug

SEQ ID NO: 56526 - DNA, 18 bp, Artificial Sequence
  Synthetic
agcgcaaggcgcgauaua

SEQ ID NO: 56527 - DNA, 26 bp, Artificial Sequence
  Synthetic
ccacaaagaguctacatgtcuagggt

SEQ ID NO: 56528 - DNA, 23 bp, Artificial Sequence
  Synthetic
agtgagcaugaaggacaatguca

SEQ ID NO: 56529 - DNA, 21 bp, Artificial Sequence
  Synthetic
ggaagccuggaactuggagag

SEQ ID NO: 56530 - DNA, 19 bp, Artificial Sequence
  Synthetic
gcgagcccgaucugaagaa

SEQ ID NO: 56531 - DNA, 18 bp, Artificial Sequence
  Synthetic
gttcaugggccgctugac

SEQ ID NO: 56532 - DNA, 19 bp, Artificial Sequence
  Synthetic
ccaggccgagcugaacauc

SEQ ID NO: 56533 - DNA, 21 bp, Artificial Sequence
  Synthetic
ggcuttcagguggacaaggac

SEQ ID NO: 56534 - DNA, 23 bp, Artificial Sequence
  Synthetic
ggcaatcugaaaggacctccaut

SEQ ID NO: 56535 - DNA, 20 bp, Artificial Sequence
  Synthetic
cagacaccugcctggctaug

SEQ ID NO: 56536 - DNA, 21 bp, Artificial Sequence
  Synthetic
caugcccgctaaucccagaat

SEQ ID NO: 56537 - DNA, 22 bp, Artificial Sequence
  Synthetic
ggaagtucttcggguagaaggg

SEQ ID NO: 56538 - DNA, 21 bp, Artificial Sequence
  Synthetic
caatccugaccccagtgctut

SEQ ID NO: 56539 - DNA, 22 bp, Artificial Sequence
  Synthetic
ctgaacacugcctgctatccuc

SEQ ID NO: 56540 - DNA, 21 bp, Artificial Sequence
  Synthetic
catggcagagagaguggaguc

SEQ ID NO: 56541 - DNA, 22 bp, Artificial Sequence
  Synthetic
gcagugaacaggcgagauacaa

SEQ ID NO: 56542 - DNA, 28 bp, Artificial Sequence
  Synthetic
tcatcaattcagaugacacatcttucca

SEQ ID NO: 56543 - DNA, 21 bp, Artificial Sequence
  Synthetic
ggaagttgaugagccctugct

SEQ ID NO: 56544 - DNA, 19 bp, Artificial Sequence
  Synthetic
ccaacagccgcutcgatug

SEQ ID NO: 56545 - DNA, 22 bp, Artificial Sequence
  Synthetic
cgtguagcccattucagaggag

SEQ ID NO: 56546 - DNA, 21 bp, Artificial Sequence
  Synthetic
caccctcaccutgacaggtut

SEQ ID NO: 56547 - DNA, 22 bp, Artificial Sequence
  Synthetic
ctggaggccuctgctttcuaac

SEQ ID NO: 56548 - DNA, 23 bp, Artificial Sequence
  Synthetic
aaacaagcttutgcccatguacc

SEQ ID NO: 56549 - DNA, 28 bp, Artificial Sequence
  Synthetic
aactgcaccattutgagtgtgttaaaut

SEQ ID NO: 56550 - DNA, 21 bp, Artificial Sequence
  Synthetic
gctcttttugccctggaugac

SEQ ID NO: 56551 - DNA, 22 bp, Artificial Sequence
  Synthetic
gatgaggucacagcaccatgua

SEQ ID NO: 56552 - DNA, 26 bp, Artificial Sequence
  Synthetic
gtatatggtatagutttgggccgugt

SEQ ID NO: 56553 - DNA, 25 bp, Artificial Sequence
  Synthetic
catgccttgcucttgaaatttcuca

SEQ ID NO: 56554 - DNA, 23 bp, Artificial Sequence
  Synthetic
ccatcacuggcacagtccttauc

SEQ ID NO: 56555 - DNA, 23 bp, Artificial Sequence
  Synthetic
gguggtttgtcaaugacggagaa

SEQ ID NO: 56556 - DNA, 28 bp, Artificial Sequence
  Synthetic
ttttattgcagguaattccaguggagaa

SEQ ID NO: 56557 - DNA, 23 bp, Artificial Sequence
  Synthetic
tcgtgcctcuacaggatcauact

SEQ ID NO: 56558 - DNA, 18 bp, Artificial Sequence
  Synthetic
ggcugugccgacaggaag

SEQ ID NO: 56559 - DNA, 21 bp, Artificial Sequence
  Synthetic
cctcctcgauctccttgtuga

SEQ ID NO: 56560 - DNA, 20 bp, Artificial Sequence
  Synthetic
guggagaccatucgcaacct

SEQ ID NO: 56561 - DNA, 25 bp, Artificial Sequence
  Synthetic
cccagctaccuccttctcattttua

SEQ ID NO: 56562 - DNA, 21 bp, Artificial Sequence
  Synthetic
tgtagcucacaccctctccut

SEQ ID NO: 56563 - DNA, 21 bp, Artificial Sequence
  Synthetic
gctgggaagaggucactgtug

SEQ ID NO: 56564 - DNA, 22 bp, Artificial Sequence
  Synthetic
acccagaagcaugaaacacugt

SEQ ID NO: 56565 - DNA, 28 bp, Artificial Sequence
  Synthetic
aggcacgaacautacttcaatcaattuc

SEQ ID NO: 56566 - DNA, 25 bp, Artificial Sequence
  Synthetic
gcgattttccautcaggttcttcug

SEQ ID NO: 56567 - DNA, 28 bp, Artificial Sequence
  Synthetic
cgtcattcctgauccttcatgagtauat

SEQ ID NO: 56568 - DNA, 25 bp, Artificial Sequence
  Synthetic
ctaccttagguactggtctgacugt

SEQ ID NO: 56569 - DNA, 24 bp, Artificial Sequence
  Synthetic
gaggcaaagtutgcaagtcttcuc

SEQ ID NO: 56570 - DNA, 23 bp, Artificial Sequence
  Synthetic
gcccagaugaggacctacaaaut

SEQ ID NO: 56571 - DNA, 20 bp, Artificial Sequence
  Synthetic
cccattagugcccccaucac

SEQ ID NO: 56572 - DNA, 21 bp, Artificial Sequence
  Synthetic
gaggagctgutcaggatggug

SEQ ID NO: 56573 - DNA, 22 bp, Artificial Sequence
  Synthetic
cagcagucaggaaggacatgut

SEQ ID NO: 56574 - DNA, 21 bp, Artificial Sequence
  Synthetic
agaacggugaagcugaagagg

SEQ ID NO: 56575 - DNA, 23 bp, Artificial Sequence
  Synthetic
tgttagttuggcgggtgtatcug

SEQ ID NO: 56576 - DNA, 21 bp, Artificial Sequence
  Synthetic
cgaggacaccauctucgagat

SEQ ID NO: 56577 - DNA, 17 bp, Artificial Sequence
  Synthetic
gtagcugaggccucgca

SEQ ID NO: 56578 - DNA, 20 bp, Artificial Sequence
  Synthetic
cagagctauggcgccuacag

SEQ ID NO: 56579 - DNA, 22 bp, Artificial Sequence
  Synthetic
cgggauctaaacugcagggaag

SEQ ID NO: 56580 - DNA, 19 bp, Artificial Sequence
  Synthetic
ctgtcgggcutctcgtcua

SEQ ID NO: 56581 - DNA, 19 bp, Artificial Sequence
  Synthetic
agctccugagtgcuaccgt

SEQ ID NO: 56582 - DNA, 21 bp, Artificial Sequence
  Synthetic
gcatcctctutcctggcctua

SEQ ID NO: 56583 - DNA, 26 bp, Artificial Sequence
  Synthetic
cagattgcagauctgacucagaagat

SEQ ID NO: 56584 - DNA, 20 bp, Artificial Sequence
  Synthetic
gacucgcaaacccactucct

SEQ ID NO: 56585 - DNA, 20 bp, Artificial Sequence
  Synthetic
ccctcacugacccuccaaac

SEQ ID NO: 56586 - DNA, 20 bp, Artificial Sequence
  Synthetic
caccagugaggtagcuggac

SEQ ID NO: 56587 - DNA, 21 bp, Artificial Sequence
  Synthetic
ggctgucccaacttcctguat

SEQ ID NO: 56588 - DNA, 22 bp, Artificial Sequence
  Synthetic
gacacaagauctgcucgaggac

SEQ ID NO: 56589 - DNA, 25 bp, Artificial Sequence
  Synthetic
tguggtgtaccuaaagacagagaca

SEQ ID NO: 56590 - DNA, 28 bp, Artificial Sequence
  Synthetic
gcaatttttcttaugttccaggaacuca

SEQ ID NO: 56591 - DNA, 23 bp, Artificial Sequence
  Synthetic
gggcagaguccttagcttttuct

SEQ ID NO: 56592 - DNA, 24 bp, Artificial Sequence
  Synthetic
gatgggtagugaagcaatggttut

SEQ ID NO: 56593 - DNA, 28 bp, Artificial Sequence
  Synthetic
ttctccatgtucacccttaaaagatuga

SEQ ID NO: 56594 - DNA, 21 bp, Artificial Sequence
  Synthetic
ctccacgguggttttcgttuc

SEQ ID NO: 56595 - DNA, 27 bp, Artificial Sequence
  Synthetic
tgttacucaccaaagagatggtttugt

SEQ ID NO: 56596 - DNA, 21 bp, Artificial Sequence
  Synthetic
ccaccagacauccgagtcauc

SEQ ID NO: 56597 - DNA, 26 bp, Artificial Sequence
  Synthetic
ccactcactgtuttctccttacacut

SEQ ID NO: 56598 - DNA, 21 bp, Artificial Sequence
  Synthetic
catgaugcccagggugaagaa

SEQ ID NO: 56599 - DNA, 22 bp, Artificial Sequence
  Synthetic
guggaaccttaaugcccaggat

SEQ ID NO: 56600 - DNA, 19 bp, Artificial Sequence
  Synthetic
cgtccccaaggcuttggua

SEQ ID NO: 56601 - DNA, 19 bp, Artificial Sequence
  Synthetic
aagacuggagacccuggct

SEQ ID NO: 56602 - DNA, 17 bp, Artificial Sequence
  Synthetic
gguccggctccuggaga

SEQ ID NO: 56603 - DNA, 26 bp, Artificial Sequence
  Synthetic
ccaagctcaucatttccaactugaaa

SEQ ID NO: 56604 - DNA, 20 bp, Artificial Sequence
  Synthetic
ctcctgccaucgtcaacuca

SEQ ID NO: 56605 - DNA, 21 bp, Artificial Sequence
  Synthetic
agtgggccaacuggaucaaag

SEQ ID NO: 56606 - DNA, 20 bp, Artificial Sequence
  Synthetic
cggccatucctgtgagguag

SEQ ID NO: 56607 - DNA, 22 bp, Artificial Sequence
  Synthetic
cuctctcuagggaaggccacat

SEQ ID NO: 56608 - DNA, 26 bp, Artificial Sequence
  Synthetic
agcaaaacattgaugaacaaatgcut

SEQ ID NO: 56609 - DNA, 23 bp, Artificial Sequence
  Synthetic
aagacaaggcuatgatgctgcut

SEQ ID NO: 56610 - DNA, 21 bp, Artificial Sequence
  Synthetic
gagaagtugccttcctuccga

SEQ ID NO: 56611 - DNA, 22 bp, Artificial Sequence
  Synthetic
gtcaggcaggaguctcagatug

SEQ ID NO: 56612 - DNA, 21 bp, Artificial Sequence
  Synthetic
ccccaaaaucuaacgcagcac

SEQ ID NO: 56613 - DNA, 24 bp, Artificial Sequence
  Synthetic
ggcaugatggagugacaggaaaaa

SEQ ID NO: 56614 - DNA, 21 bp, Artificial Sequence
  Synthetic
agcaatgcucccttcggttua

SEQ ID NO: 56615 - DNA, 24 bp, Artificial Sequence
  Synthetic
cgagcataagautaagcagctguc

SEQ ID NO: 56616 - DNA, 21 bp, Artificial Sequence
  Synthetic
gggcuttagugacagggaagt

SEQ ID NO: 56617 - DNA, 21 bp, Artificial Sequence
  Synthetic
agtgaauggagccacccaauc

SEQ ID NO: 56618 - DNA, 20 bp, Artificial Sequence
  Synthetic
agcccttcutatcgctggug

SEQ ID NO: 56619 - DNA, 23 bp, Artificial Sequence
  Synthetic
agtaacccctuaggtgcatccut

SEQ ID NO: 56620 - DNA, 21 bp, Artificial Sequence
  Synthetic
gaggcggcccautttcttuag

SEQ ID NO: 56621 - DNA, 21 bp, Artificial Sequence
  Synthetic
gcacctccutcctctgctuag

SEQ ID NO: 56622 - DNA, 25 bp, Artificial Sequence
  Synthetic
tgtaggtuccttttcaguggacaca

SEQ ID NO: 56623 - DNA, 26 bp, Artificial Sequence
  Synthetic
gaaaaatggaguaccaaggtttguca

SEQ ID NO: 56624 - DNA, 23 bp, Artificial Sequence
  Synthetic
gactaacaaatuctgcccccuct

SEQ ID NO: 56625 - DNA, 23 bp, Artificial Sequence
  Synthetic
catagcactucctgcctggtauc

SEQ ID NO: 56626 - DNA, 25 bp, Artificial Sequence
  Synthetic
gtttaguagaggaaacagacgugct

SEQ ID NO: 56627 - DNA, 22 bp, Artificial Sequence
  Synthetic
tgcattgacuggagtguggaaa

SEQ ID NO: 56628 - DNA, 26 bp, Artificial Sequence
  Synthetic
tctatggtgaucacacctuagggaaa

SEQ ID NO: 56629 - DNA, 24 bp, Artificial Sequence
  Synthetic
cucacagtattuggcacagagaca

SEQ ID NO: 56630 - DNA, 27 bp, Artificial Sequence
  Synthetic
tgaggaaagatuatttgcatggcugaa

SEQ ID NO: 56631 - DNA, 28 bp, Artificial Sequence
  Synthetic
catacccucaacagaaatgguaacagaa

SEQ ID NO: 56632 - DNA, 29 bp, Artificial Sequence
  Synthetic
tggtactacugagagatgcttttcuagac

SEQ ID NO: 56633 - DNA, 28 bp, Artificial Sequence
  Synthetic
agcaggagcugttataatgattuaccat

SEQ ID NO: 56634 - DNA, 28 bp, Artificial Sequence
  Synthetic
acttccacatgutgaatagttttgucct

SEQ ID NO: 56635 - DNA, 27 bp, Artificial Sequence
  Synthetic
cactgcccacuttgattaaaacttcut

SEQ ID NO: 56636 - DNA, 31 bp, Artificial Sequence
  Synthetic
gtggttaaaatuaaacaactccgatcttuct

SEQ ID NO: 56637 - DNA, 22 bp, Artificial Sequence
  Synthetic
gcagctgcaugttcaagaagug

SEQ ID NO: 56638 - DNA, 21 bp, Artificial Sequence
  Synthetic
ctgcugcagaacagtguacct

SEQ ID NO: 56639 - DNA, 23 bp, Artificial Sequence
  Synthetic
caacagcaugacctctctctcug

SEQ ID NO: 56640 - DNA, 25 bp, Artificial Sequence
  Synthetic
tgtgttaggauctcttggttuccct

SEQ ID NO: 56641 - DNA, 27 bp, Artificial Sequence
  Synthetic
aggaagagucaaggaaucaaacaaagt

SEQ ID NO: 56642 - DNA, 25 bp, Artificial Sequence
  Synthetic
cccagttgtatucagtaccaaccua

SEQ ID NO: 56643 - DNA, 21 bp, Artificial Sequence
  Synthetic
ggatttccugccacacctugt

SEQ ID NO: 56644 - DNA, 27 bp, Artificial Sequence
  Synthetic
ttattacctaugaaaggctggcaagut

SEQ ID NO: 56645 - DNA, 22 bp, Artificial Sequence
  Synthetic
tgcagaacaugaaaggcauggt

SEQ ID NO: 56646 - DNA, 27 bp, Artificial Sequence
  Synthetic
agttcctctuactttcatctuccacct

SEQ ID NO: 56647 - DNA, 18 bp, Artificial Sequence
  Synthetic
aacaaacgccccgugtug

SEQ ID NO: 56648 - DNA, 28 bp, Artificial Sequence
  Synthetic
atgagaaattgugtgaggttgtugaaac

SEQ ID NO: 56649 - DNA, 25 bp, Artificial Sequence
  Synthetic
ctcaatgccaugctctaccaattut

SEQ ID NO: 56650 - DNA, 25 bp, Artificial Sequence
  Synthetic
aaaaagatcaccuctccacgagtuc

SEQ ID NO: 56651 - DNA, 27 bp, Artificial Sequence
  Synthetic
gcctcttaugcacagatgttttgttut

SEQ ID NO: 56652 - DNA, 20 bp, Artificial Sequence
  Synthetic
ggctguccccatcatcacug

SEQ ID NO: 56653 - DNA, 22 bp, Artificial Sequence
  Synthetic
cgagcucaacctcugaaagcat

SEQ ID NO: 56654 - DNA, 22 bp, Artificial Sequence
  Synthetic
cctcacatugggtcaccatugt

SEQ ID NO: 56655 - DNA, 19 bp, Artificial Sequence
  Synthetic
ctcaacgcagcucaaugcc

SEQ ID NO: 56656 - DNA, 21 bp, Artificial Sequence
  Synthetic
ctgagtctuagctggctccut

SEQ ID NO: 56657 - DNA, 21 bp, Artificial Sequence
  Synthetic
catcaccaccacucagagucc

SEQ ID NO: 56658 - DNA, 21 bp, Artificial Sequence
  Synthetic
ggaaguttggacugagggaca

SEQ ID NO: 56659 - DNA, 20 bp, Artificial Sequence
  Synthetic
cgutcccugaggcaaaagag

SEQ ID NO: 56660 - DNA, 23 bp, Artificial Sequence
  Synthetic
ctccataugcacatccugagcaa

SEQ ID NO: 56661 - DNA, 27 bp, Artificial Sequence
  Synthetic
cttgatcttggcuactataccatgguc

SEQ ID NO: 56662 - DNA, 22 bp, Artificial Sequence
  Synthetic
cuacccatggtugagggaagaa

SEQ ID NO: 56663 - DNA, 28 bp, Artificial Sequence
  Synthetic
tttccatgtattugtgctaatctcucca

SEQ ID NO: 56664 - DNA, 28 bp, Artificial Sequence
  Synthetic
ccaaggttagaauggctaaagaaaggut

SEQ ID NO: 56665 - DNA, 22 bp, Artificial Sequence
  Synthetic
gagtcauagcatcccucaagca

SEQ ID NO: 56666 - DNA, 26 bp, Artificial Sequence
  Synthetic
gagagttcttuccatgagtccttugt

SEQ ID NO: 56667 - DNA, 26 bp, Artificial Sequence
  Synthetic
cacctttgattcaugacagaatgcut

SEQ ID NO: 56668 - DNA, 22 bp, Artificial Sequence
  Synthetic
ctguccaaggtccaucaagagt

SEQ ID NO: 56669 - DNA, 28 bp, Artificial Sequence
  Synthetic
acttcatagccauaggtgtcttatucct

SEQ ID NO: 56670 - DNA, 27 bp, Artificial Sequence
  Synthetic
tttccctcccaaccaucaatattctuc

SEQ ID NO: 56671 - DNA, 29 bp, Artificial Sequence
  Synthetic
agctctaggtttuctgtcatctatguact

SEQ ID NO: 56672 - DNA, 17 bp, Artificial Sequence
  Synthetic
gtgtgcgccguccttut

SEQ ID NO: 56673 - DNA, 17 bp, Artificial Sequence
  Synthetic
cagcagcugcccuacga

SEQ ID NO: 56674 - DNA, 26 bp, Artificial Sequence
  Synthetic
gggtatguggattccauacagaggaa

SEQ ID NO: 56675 - DNA, 24 bp, Artificial Sequence
  Synthetic
ggcctggaauctcctctatcacua

SEQ ID NO: 56676 - DNA, 28 bp, Artificial Sequence
  Synthetic
catagatgaatugggaagaggaactuct

SEQ ID NO: 56677 - DNA, 24 bp, Artificial Sequence
  Synthetic
gtatctgatuggccaaggcaguaa

SEQ ID NO: 56678 - DNA, 20 bp, Artificial Sequence
  Synthetic
cgaaggcgacagcuctctug

SEQ ID NO: 56679 - DNA, 20 bp, Artificial Sequence
  Synthetic
acctcggaaagucaggctug

SEQ ID NO: 56680 - DNA, 23 bp, Artificial Sequence
  Synthetic
ccatccacagccugttcatguaa

SEQ ID NO: 56681 - DNA, 21 bp, Artificial Sequence
  Synthetic
ccccucuagccaaaacccaag

SEQ ID NO: 56682 - DNA, 20 bp, Artificial Sequence
  Synthetic
gctccucttagtgguggcat

SEQ ID NO: 56683 - DNA, 21 bp, Artificial Sequence
  Synthetic
ctggctucaccttccctcuac

SEQ ID NO: 56684 - DNA, 22 bp, Artificial Sequence
  Synthetic
tgtaccaagcaccuagccaaug

SEQ ID NO: 56685 - DNA, 23 bp, Artificial Sequence
  Synthetic
tgttgggcacagcauaatagugt

SEQ ID NO: 56686 - DNA, 21 bp, Artificial Sequence
  Synthetic
cctacctuggcattcuggaca

SEQ ID NO: 56687 - DNA, 22 bp, Artificial Sequence
  Synthetic
gcattcttggutcgctgtcuct

SEQ ID NO: 56688 - DNA, 25 bp, Artificial Sequence
  Synthetic
tttggcauagacttccucaaaagag

SEQ ID NO: 56689 - DNA, 22 bp, Artificial Sequence
  Synthetic
ccaccaccuctccaccttcaua

SEQ ID NO: 56690 - DNA, 29 bp, Artificial Sequence
  Synthetic
aagaattcagcauatacttcctugagcat

SEQ ID NO: 56691 - DNA, 26 bp, Artificial Sequence
  Synthetic
cttttcacuggagaatgtgtgcuaaa

SEQ ID NO: 56692 - DNA, 30 bp, Artificial Sequence
  Synthetic
acaactcataatttcuacatacccattgut

SEQ ID NO: 56693 - DNA, 24 bp, Artificial Sequence
  Synthetic
ttcggacacugagagcttuaagac

SEQ ID NO: 56694 - DNA, 21 bp, Artificial Sequence
  Synthetic
ctgtgcautttcccgtucacc

SEQ ID NO: 56695 - DNA, 26 bp, Artificial Sequence
  Synthetic
gaagcagcagaacaagucttttuagt

SEQ ID NO: 56696 - DNA, 28 bp, Artificial Sequence
  Synthetic
cttttccttcuctttcagccttuagact

SEQ ID NO: 56697 - DNA, 28 bp, Artificial Sequence
  Synthetic
ccaggcctgaauttgtagataaatguct

SEQ ID NO: 56698 - DNA, 28 bp, Artificial Sequence
  Synthetic
attccccatcutcataaatgcaguaact

SEQ ID NO: 56699 - DNA, 28 bp, Artificial Sequence
  Synthetic
tgtcgtctctttugttccttgattcuaa

SEQ ID NO: 56700 - DNA, 22 bp, Artificial Sequence
  Synthetic
gccaacagaaacugaccacuga

SEQ ID NO: 56701 - DNA, 27 bp, Artificial Sequence
  Synthetic
cattgcugaaagaaaaucaaaggaacc

SEQ ID NO: 56702 - DNA, 20 bp, Artificial Sequence
  Synthetic
cacgagutgtugaggaagcc

SEQ ID NO: 56703 - DNA, 23 bp, Artificial Sequence
  Synthetic
acatgtucgagaagggcaacuac

SEQ ID NO: 56704 - DNA, 18 bp, Artificial Sequence
  Synthetic
gcccagagggugugaggt

SEQ ID NO: 56705 - DNA, 17 bp, Artificial Sequence
  Synthetic
gcctgcagutcgctugt

SEQ ID NO: 56706 - DNA, 18 bp, Artificial Sequence
  Synthetic
ggacagcgugagcctcut

SEQ ID NO: 56707 - DNA, 17 bp, Artificial Sequence
  Synthetic
cugcuggccccagagac

SEQ ID NO: 56708 - DNA, 20 bp, Artificial Sequence
  Synthetic
ctuaaaggcgctgucaccct

SEQ ID NO: 56709 - DNA, 23 bp, Artificial Sequence
  Synthetic
tcgatgauggcattgcagaugat

SEQ ID NO: 56710 - DNA, 17 bp, Artificial Sequence
  Synthetic
gccttgucggaccugct

SEQ ID NO: 56711 - DNA, 19 bp, Artificial Sequence
  Synthetic
gcgcagugcgtagaagaug

SEQ ID NO: 56712 - DNA, 21 bp, Artificial Sequence
  Synthetic
aatgcccutacctgttuggct

SEQ ID NO: 56713 - DNA, 28 bp, Artificial Sequence
  Synthetic
tttctttctttucagcctatcacaugga

SEQ ID NO: 56714 - DNA, 26 bp, Artificial Sequence
  Synthetic
atccatgagcuccaaaaagaactgua

SEQ ID NO: 56715 - DNA, 21 bp, Artificial Sequence
  Synthetic
gccaacuacggcagaugaaag

SEQ ID NO: 56716 - DNA, 28 bp, Artificial Sequence
  Synthetic
tgagacaaacautgtaaaggauccacaa

SEQ ID NO: 56717 - DNA, 19 bp, Artificial Sequence
  Synthetic
gutgatctuggcgggacga

SEQ ID NO: 56718 - DNA, 21 bp, Artificial Sequence
  Synthetic
acacagttccaugcgtacgut

SEQ ID NO: 56719 - DNA, 22 bp, Artificial Sequence
  Synthetic
ctataacggcucaggcauggat

SEQ ID NO: 56720 - DNA, 24 bp, Artificial Sequence
  Synthetic
aggacaacuacacacttcggttut

SEQ ID NO: 56721 - DNA, 25 bp, Artificial Sequence
  Synthetic
gatgaccattccauacacacctgut

SEQ ID NO: 56722 - DNA, 28 bp, Artificial Sequence
  Synthetic
aagtcataacatgcuttcctaacaccut

SEQ ID NO: 56723 - DNA, 27 bp, Artificial Sequence
  Synthetic
gtctgtttacacucccttctcctttut

SEQ ID NO: 56724 - DNA, 22 bp, Artificial Sequence
  Synthetic
gattccccacugttccagucaa

SEQ ID NO: 56725 - DNA, 21 bp, Artificial Sequence
  Synthetic
gctggcatuacctcgcctaug

SEQ ID NO: 56726 - DNA, 21 bp, Artificial Sequence
  Synthetic
cugggcaaacaacacucacag

SEQ ID NO: 56727 - DNA, 23 bp, Artificial Sequence
  Synthetic
ctgattcuagaggcaggcttuca

SEQ ID NO: 56728 - DNA, 24 bp, Artificial Sequence
  Synthetic
cggctgctgugctttataagcuat

SEQ ID NO: 56729 - DNA, 25 bp, Artificial Sequence
  Synthetic
gcttttacugcacaaccagttacuc

SEQ ID NO: 56730 - DNA, 24 bp, Artificial Sequence
  Synthetic
agaaaagccaaaugccuagaaggt

SEQ ID NO: 56731 - DNA, 28 bp, Artificial Sequence
  Synthetic
agcacctctttugccttctttacuaaaa

SEQ ID NO: 56732 - DNA, 20 bp, Artificial Sequence
  Synthetic
gggaaggugcggatgactug

SEQ ID NO: 56733 - DNA, 21 bp, Artificial Sequence
  Synthetic
gcaccctcucaccccttcaua

SEQ ID NO: 56734 - DNA, 21 bp, Artificial Sequence
  Synthetic
ggcctcauctgtcagctucag

SEQ ID NO: 56735 - DNA, 21 bp, Artificial Sequence
  Synthetic
ggaattcggcuccggacuaag

SEQ ID NO: 56736 - DNA, 21 bp, Artificial Sequence
  Synthetic
ctcaaaugccccttcctguct

SEQ ID NO: 56737 - DNA, 23 bp, Artificial Sequence
  Synthetic
gggatcuaaaatgcctcucgaca

SEQ ID NO: 56738 - DNA, 21 bp, Artificial Sequence
  Synthetic
gctugcccagagcatggauag

SEQ ID NO: 56739 - DNA, 21 bp, Artificial Sequence
  Synthetic
accucuccccacaaacgaaag

SEQ ID NO: 56740 - DNA, 24 bp, Artificial Sequence
  Synthetic
ggatttgaccutctgtgcacugat

SEQ ID NO: 56741 - DNA, 28 bp, Artificial Sequence
  Synthetic
gttttatgcaaacacutgacatctguct

SEQ ID NO: 56742 - DNA, 21 bp, Artificial Sequence
  Synthetic
ggctcccaautagcccagaug

SEQ ID NO: 56743 - DNA, 24 bp, Artificial Sequence
  Synthetic
cccactagcutctcaaggguaaga

SEQ ID NO: 56744 - DNA, 19 bp, Artificial Sequence
  Synthetic
ctcccatgaucgcccacuc

SEQ ID NO: 56745 - DNA, 21 bp, Artificial Sequence
  Synthetic
gacgctutccagacugacaca

SEQ ID NO: 56746 - DNA, 31 bp, Artificial Sequence
  Synthetic
cattactaatctggutctggaagttacugaa

SEQ ID NO: 56747 - DNA, 27 bp, Artificial Sequence
  Synthetic
tggaccaaauggacagatagagtaugt

SEQ ID NO: 56748 - DNA, 21 bp, Artificial Sequence
  Synthetic
cuggacuacgagaccacacag

SEQ ID NO: 56749 - DNA, 28 bp, Artificial Sequence
  Synthetic
ctcatttctatcaugactgtcaccacua

SEQ ID NO: 56750 - DNA, 18 bp, Artificial Sequence
  Synthetic
gctcacggcccutgtcug

SEQ ID NO: 56751 - DNA, 19 bp, Artificial Sequence
  Synthetic
ccacaagggaggugugagt

SEQ ID NO: 56752 - DNA, 18 bp, Artificial Sequence
  Synthetic
ccuccccaccctcaugct

SEQ ID NO: 56753 - DNA, 18 bp, Artificial Sequence
  Synthetic
tgcaucacuggccaccac

SEQ ID NO: 56754 - DNA, 20 bp, Artificial Sequence
  Synthetic
cuacaucaccgagggcaaca

SEQ ID NO: 56755 - DNA, 20 bp, Artificial Sequence
  Synthetic
tcttgtucccctcacucgga

SEQ ID NO: 56756 - DNA, 21 bp, Artificial Sequence
  Synthetic
ctctcauccatcgucagccat

SEQ ID NO: 56757 - DNA, 23 bp, Artificial Sequence
  Synthetic
gttgatgucaaagaggccacuct

SEQ ID NO: 56758 - DNA, 25 bp, Artificial Sequence
  Synthetic
cctcaugaactggtacuacaggact

SEQ ID NO: 56759 - DNA, 22 bp, Artificial Sequence
  Synthetic
ttctcacctgugtccccacuat

SEQ ID NO: 56760 - DNA, 22 bp, Artificial Sequence
  Synthetic
gctcagtgugggtggtcttaug

SEQ ID NO: 56761 - DNA, 23 bp, Artificial Sequence
  Synthetic
ttcatcctttucctctggtggug

SEQ ID NO: 56762 - DNA, 21 bp, Artificial Sequence
  Synthetic
cccctgacauggaagacgaut

SEQ ID NO: 56763 - DNA, 20 bp, Artificial Sequence
  Synthetic
atggccggaugcatauggag

SEQ ID NO: 56764 - DNA, 19 bp, Artificial Sequence
  Synthetic
ggacugcaaaggccaaugt

SEQ ID NO: 56765 - DNA, 27 bp, Artificial Sequence
  Synthetic
tgaggtgtuaagacactatgctacaua

SEQ ID NO: 56766 - DNA, 20 bp, Artificial Sequence
  Synthetic
tctgcggucacugcaacaat

SEQ ID NO: 56767 - DNA, 20 bp, Artificial Sequence
  Synthetic
gaaggacccgaggcuttcuc

SEQ ID NO: 56768 - DNA, 22 bp, Artificial Sequence
  Synthetic
cgccttgaaaaugtggcactut

SEQ ID NO: 56769 - DNA, 20 bp, Artificial Sequence
  Synthetic
gggcaagugatcaccaucgg

SEQ ID NO: 56770 - DNA, 20 bp, Artificial Sequence
  Synthetic
gggtggccacucacaatcuc

SEQ ID NO: 56771 - DNA, 21 bp, Artificial Sequence
  Synthetic
ccacuaugggcaggagagaac

SEQ ID NO: 56772 - DNA, 22 bp, Artificial Sequence
  Synthetic
cattccutcaggcugggagaag

SEQ ID NO: 56773 - DNA, 21 bp, Artificial Sequence
  Synthetic
tgcaccauccaactgagtgug

SEQ ID NO: 56774 - DNA, 22 bp, Artificial Sequence
  Synthetic
cactccacccutgtatgccaut

SEQ ID NO: 56775 - DNA, 24 bp, Artificial Sequence
  Synthetic
gaaaugcuggagaaggaaaagcag

SEQ ID NO: 56776 - DNA, 20 bp, Artificial Sequence
  Synthetic
guggagaugacaagggccaa

SEQ ID NO: 56777 - DNA, 28 bp, Artificial Sequence
  Synthetic
cgcaaacacacuaatctttctccattuc

SEQ ID NO: 56778 - DNA, 18 bp, Artificial Sequence
  Synthetic
cctcccccggacuctgut

SEQ ID NO: 56779 - DNA, 19 bp, Artificial Sequence
  Synthetic
tcaccgaccuctcctgugt

SEQ ID NO: 56780 - DNA, 27 bp, Artificial Sequence
  Synthetic
agagagacgaaauagaagcuacgaaga

SEQ ID NO: 56781 - DNA, 19 bp, Artificial Sequence
  Synthetic
ggacggacgucucgagagt

SEQ ID NO: 56782 - DNA, 25 bp, Artificial Sequence
  Synthetic
ccatacaccugaatctgaaaggcut

SEQ ID NO: 56783 - DNA, 25 bp, Artificial Sequence
  Synthetic
attactgcaaugagcatguggagat

SEQ ID NO: 56784 - DNA, 22 bp, Artificial Sequence
  Synthetic
ggcagggcuttctaatcuccag

SEQ ID NO: 56785 - DNA, 22 bp, Artificial Sequence
  Synthetic
atggcttcccuccctctcttua

SEQ ID NO: 56786 - DNA, 19 bp, Artificial Sequence
  Synthetic
gtcaauggcgggtcttgug

SEQ ID NO: 56787 - DNA, 23 bp, Artificial Sequence
  Synthetic
catcgatacuggtgaaggaccug

SEQ ID NO: 56788 - DNA, 19 bp, Artificial Sequence
  Synthetic
cccugaccagtctcuccca

SEQ ID NO: 56789 - DNA, 21 bp, Artificial Sequence
  Synthetic
cgtctggacguccctatcuct

SEQ ID NO: 56790 - DNA, 19 bp, Artificial Sequence
  Synthetic
tggaggtutccagctugcc

SEQ ID NO: 56791 - DNA, 24 bp, Artificial Sequence
  Synthetic
tccaagucagagcagagaguaaca

SEQ ID NO: 56792 - DNA, 21 bp, Artificial Sequence
  Synthetic
gtcttcacgutcctgcagtuc

SEQ ID NO: 56793 - DNA, 23 bp, Artificial Sequence
  Synthetic
tgagaccutcctttccugacact

SEQ ID NO: 56794 - DNA, 21 bp, Artificial Sequence
  Synthetic
cctcctutatgggcuccacct

SEQ ID NO: 56795 - DNA, 28 bp, Artificial Sequence
  Synthetic
gcaacctgtaugcattaactagtgcuat

SEQ ID NO: 56796 - DNA, 21 bp, Artificial Sequence
  Synthetic
acaaggccuggaagctuaagg

SEQ ID NO: 56797 - DNA, 27 bp, Artificial Sequence
  Synthetic
cacagtcttuaagcttttgtcttuggt

SEQ ID NO: 56798 - DNA, 21 bp, Artificial Sequence
  Synthetic
gcttcuccacaagccattugt

SEQ ID NO: 56799 - DNA, 24 bp, Artificial Sequence
  Synthetic
cagtagaacacguggtagttccut

SEQ ID NO: 56800 - DNA, 22 bp, Artificial Sequence
  Synthetic
caaguaccacacagccaugagt

SEQ ID NO: 56801 - DNA, 21 bp, Artificial Sequence
  Synthetic
tutttcugcagaggagcccaa

SEQ ID NO: 56802 - DNA, 22 bp, Artificial Sequence
  Synthetic
ttctgtcugaactgaccgtugg

SEQ ID NO: 56803 - DNA, 20 bp, Artificial Sequence
  Synthetic
agggcgugaagacctcttug

SEQ ID NO: 56804 - DNA, 19 bp, Artificial Sequence
  Synthetic
tgagccgugtcatggtguc

SEQ ID NO: 56805 - DNA, 19 bp, Artificial Sequence
  Synthetic
aaggcagugugcagacgaa

SEQ ID NO: 56806 - DNA, 21 bp, Artificial Sequence
  Synthetic
gggctcaguataggaggcaua

SEQ ID NO: 56807 - DNA, 24 bp, Artificial Sequence
  Synthetic
ctgcaatttugacaaagaggcuga

SEQ ID NO: 56808 - DNA, 19 bp, Artificial Sequence
  Synthetic
ggcatgtgugggcaaguga

SEQ ID NO: 56809 - DNA, 19 bp, Artificial Sequence
  Synthetic
cacuaggcccagcaggaug

SEQ ID NO: 56810 - DNA, 22 bp, Artificial Sequence
  Synthetic
ttctaacgcugatgcagctuga

SEQ ID NO: 56811 - DNA, 28 bp, Artificial Sequence
  Synthetic
acggcaatautacgaaatccugaagaat

SEQ ID NO: 56812 - DNA, 27 bp, Artificial Sequence
  Synthetic
gtgcaggagaaaguatcactctgttua

SEQ ID NO: 56813 - DNA, 28 bp, Artificial Sequence
  Synthetic
aagaaaatcttaccutggtacagtugct

SEQ ID NO: 56814 - DNA, 29 bp, Artificial Sequence
  Synthetic
cttttcttagacaugctcaagttcttgug

SEQ ID NO: 56815 - DNA, 28 bp, Artificial Sequence
  Synthetic
agcaacatcagauaaaatccaagagcut

SEQ ID NO: 56816 - DNA, 28 bp, Artificial Sequence
  Synthetic
cggccttaaggutaattcttgaaguaca

SEQ ID NO: 56817 - DNA, 24 bp, Artificial Sequence
  Synthetic
tctauaggacccacttcucccaag

SEQ ID NO: 56818 - DNA, 27 bp, Artificial Sequence
  Synthetic
tgaaggagtuatgtgtgtguaaaaccc

SEQ ID NO: 56819 - DNA, 28 bp, Artificial Sequence
  Synthetic
actacactagtgauggctttaccaaauc

SEQ ID NO: 56820 - DNA, 23 bp, Artificial Sequence
  Synthetic
cctccaaggagcuttgtcttcua

SEQ ID NO: 56821 - DNA, 22 bp, Artificial Sequence
  Synthetic
tgugcaccatucaagaacacca

SEQ ID NO: 56822 - DNA, 21 bp, Artificial Sequence
  Synthetic
accgcautgtcaaugacacga

SEQ ID NO: 56823 - DNA, 27 bp, Artificial Sequence
  Synthetic
autgaacaatgatgucagcaacagaag

SEQ ID NO: 56824 - DNA, 21 bp, Artificial Sequence
  Synthetic
cctgccatcaucaccagctut

SEQ ID NO: 56825 - DNA, 22 bp, Artificial Sequence
  Synthetic
cttctgagtguctctcccagug

SEQ ID NO: 56826 - DNA, 23 bp, Artificial Sequence
  Synthetic
ctcttguaccccaugcaaaaaca

SEQ ID NO: 56827 - DNA, 26 bp, Artificial Sequence
  Synthetic
aattgctcagcugaagaatatgguca

SEQ ID NO: 56828 - DNA, 24 bp, Artificial Sequence
  Synthetic
gcttttgaaaaugagtgggaugct

SEQ ID NO: 56829 - DNA, 23 bp, Artificial Sequence
  Synthetic
cctgtctgccautgggatgatut

SEQ ID NO: 56830 - DNA, 27 bp, Artificial Sequence
  Synthetic
agttctttcautcttgtttccuccaca

SEQ ID NO: 56831 - DNA, 28 bp, Artificial Sequence
  Synthetic
gatgcagctgguattatttttcttccut

SEQ ID NO: 56832 - DNA, 20 bp, Artificial Sequence
  Synthetic
gcuccacggaggttaaugcc

SEQ ID NO: 56833 - DNA, 28 bp, Artificial Sequence
  Synthetic
tgcaaactguacacctggtctauaaaaa

SEQ ID NO: 56834 - DNA, 20 bp, Artificial Sequence
  Synthetic
ggtcgcccaaaagcuctgua

SEQ ID NO: 56835 - DNA, 29 bp, Artificial Sequence
  Synthetic
gctgaaaggcacacautaacatcaattut

SEQ ID NO: 56836 - DNA, 28 bp, Artificial Sequence
  Synthetic
tccagggaggauacagaatttcatcaua

SEQ ID NO: 56837 - DNA, 25 bp, Artificial Sequence
  Synthetic
cacatgactucctcctatcauagca

SEQ ID NO: 56838 - DNA, 23 bp, Artificial Sequence
  Synthetic
gttagcacugaattugccaacca

SEQ ID NO: 56839 - DNA, 24 bp, Artificial Sequence
  Synthetic
tccggtcaautacgggaaatucaa

SEQ ID NO: 56840 - DNA, 24 bp, Artificial Sequence
  Synthetic
gacaaggtgtugagctctgtttug

SEQ ID NO: 56841 - DNA, 27 bp, Artificial Sequence
  Synthetic
tctgctttctucatcaagtcaucaagt

SEQ ID NO: 56842 - DNA, 26 bp, Artificial Sequence
  Synthetic
ggctcaccatuccaatatctcagaut

SEQ ID NO: 56843 - DNA, 30 bp, Artificial Sequence
  Synthetic
acaaaaagaattaccuaggagaaactcugg

SEQ ID NO: 56844 - DNA, 28 bp, Artificial Sequence
  Synthetic
gatccagtcauacagagaaatccatgut

SEQ ID NO: 56845 - DNA, 22 bp, Artificial Sequence
  Synthetic
ccttggaggcuaactccaucac

SEQ ID NO: 56846 - DNA, 20 bp, Artificial Sequence
  Synthetic
gctcaagugggctctgtgug

SEQ ID NO: 56847 - DNA, 23 bp, Artificial Sequence
  Synthetic
ctgactcaaucggtgtctgtcut

SEQ ID NO: 56848 - DNA, 24 bp, Artificial Sequence
  Synthetic
ggauggacagagatacucacagga

SEQ ID NO: 56849 - DNA, 20 bp, Artificial Sequence
  Synthetic
ctgcctgcgutcaggacuaa

SEQ ID NO: 56850 - DNA, 21 bp, Artificial Sequence
  Synthetic
gugtatcagcucagcccacat

SEQ ID NO: 56851 - DNA, 28 bp, Artificial Sequence
  Synthetic
gcgtgtcattgacutttctttttctcut

SEQ ID NO: 56852 - DNA, 22 bp, Artificial Sequence
  Synthetic
cggtttcgauactctctuggca

SEQ ID NO: 56853 - DNA, 27 bp, Artificial Sequence
  Synthetic
tgtaactaataacccuggctctctgut

SEQ ID NO: 56854 - DNA, 29 bp, Artificial Sequence
  Synthetic
agaataagacaauacaacaccugcaaact

SEQ ID NO: 56855 - DNA, 22 bp, Artificial Sequence
  Synthetic
tttcacaaagugcgccattcug

SEQ ID NO: 56856 - DNA, 19 bp, Artificial Sequence
  Synthetic
caccugaagggtgcgucat

SEQ ID NO: 56857 - DNA, 25 bp, Artificial Sequence
  Synthetic
ctgtatgcguaaaagagctctcugt

SEQ ID NO: 56858 - DNA, 24 bp, Artificial Sequence
  Synthetic
gattttgutctttctgugcgcact

SEQ ID NO: 56859 - DNA, 24 bp, Artificial Sequence
  Synthetic
catctugccagacccattttucaa

SEQ ID NO: 56860 - DNA, 20 bp, Artificial Sequence
  Synthetic
ctgtactcgaucagccccut

SEQ ID NO: 56861 - DNA, 27 bp, Artificial Sequence
  Synthetic
aagagcaactuctcctccacuaaaaat

SEQ ID NO: 56862 - DNA, 25 bp, Artificial Sequence
  Synthetic
gaatcttcttcacugggtgatguct

SEQ ID NO: 56863 - DNA, 21 bp, Artificial Sequence
  Synthetic
tccactttuagctgcctggug

SEQ ID NO: 56864 - DNA, 23 bp, Artificial Sequence
  Synthetic
actggtatugggaccccaaatug

SEQ ID NO: 56865 - DNA, 21 bp, Artificial Sequence
  Synthetic
cagggcacugataggcgtuat

SEQ ID NO: 56866 - DNA, 21 bp, Artificial Sequence
  Synthetic
tgatcgucggcaggtacaaug

SEQ ID NO: 56867 - DNA, 26 bp, Artificial Sequence
  Synthetic
aggctgcctuaaaatactggcatuaa

SEQ ID NO: 56868 - DNA, 24 bp, Artificial Sequence
  Synthetic
ggaccaacugatcaccttgaauct

SEQ ID NO: 56869 - DNA, 28 bp, Artificial Sequence
  Synthetic
gcacttatgcutaaaatctattugcagt

SEQ ID NO: 56870 - DNA, 24 bp, Artificial Sequence
  Synthetic
ttttgtttttgcuctagcccccua

SEQ ID NO: 56871 - DNA, 28 bp, Artificial Sequence
  Synthetic
cccctctcattcuttactacttcccuaa

SEQ ID NO: 56872 - DNA, 22 bp, Artificial Sequence
  Synthetic
tuaagcagcgagaugcagagaa

SEQ ID NO: 56873 - DNA, 19 bp, Artificial Sequence
  Synthetic
cgctgtggaucggctacuc

SEQ ID NO: 56874 - DNA, 22 bp, Artificial Sequence
  Synthetic
cctggttcugctccttctaucc

SEQ ID NO: 56875 - DNA, 28 bp, Artificial Sequence
  Synthetic
agcttactgccauacaggatcataaaut

SEQ ID NO: 56876 - DNA, 22 bp, Artificial Sequence
  Synthetic
acgagctcuaggcctcuaagat

SEQ ID NO: 56877 - DNA, 20 bp, Artificial Sequence
  Synthetic
gagaacauggagcgaucgga

SEQ ID NO: 56878 - DNA, 21 bp, Artificial Sequence
  Synthetic
ccacgcuctcctttcaaucct

SEQ ID NO: 56879 - DNA, 29 bp, Artificial Sequence
  Synthetic
agtgtgagccagutaactctagtactuat

SEQ ID NO: 56880 - DNA, 26 bp, Artificial Sequence
  Synthetic
tcgattcuacagtggtttuaacagca

SEQ ID NO: 56881 - DNA, 21 bp, Artificial Sequence
  Synthetic
gcctgcaacuaccttccucaa

SEQ ID NO: 56882 - DNA, 20 bp, Artificial Sequence
  Synthetic
ccugagacacgaaggcguag

SEQ ID NO: 56883 - DNA, 21 bp, Artificial Sequence
  Synthetic
ctccttgguccttgctgacut

SEQ ID NO: 56884 - DNA, 23 bp, Artificial Sequence
  Synthetic
gcctctugcagagctttcttcuc

SEQ ID NO: 56885 - DNA, 20 bp, Artificial Sequence
  Synthetic
actgacctugacccaggcua

SEQ ID NO: 56886 - DNA, 24 bp, Artificial Sequence
  Synthetic
caggaaaagcaucagaggagucaa

SEQ ID NO: 56887 - DNA, 21 bp, Artificial Sequence
  Synthetic
ggtgactcuggacactuccct

SEQ ID NO: 56888 - DNA, 25 bp, Artificial Sequence
  Synthetic
cttggcacttugagatgattagcug

SEQ ID NO: 56889 - DNA, 24 bp, Artificial Sequence
  Synthetic
cctccgagagaaggauccgattua

SEQ ID NO: 56890 - DNA, 27 bp, Artificial Sequence
  Synthetic
ttcttgttaaaagucagagcaaccuct

SEQ ID NO: 56891 - DNA, 28 bp, Artificial Sequence
  Synthetic
cagtaaaggaaacacucagacaatctuc

SEQ ID NO: 56892 - DNA, 28 bp, Artificial Sequence
  Synthetic
gggatctttuggataaacattcugaact

SEQ ID NO: 56893 - DNA, 25 bp, Artificial Sequence
  Synthetic
gatttactgtuggttgctgatgugt

SEQ ID NO: 56894 - DNA, 28 bp, Artificial Sequence
  Synthetic
caaagcaaaagauaagaagagccaauga

SEQ ID NO: 56895 - DNA, 19 bp, Artificial Sequence
  Synthetic
gggaagagcacaucguggt

SEQ ID NO: 56896 - DNA, 23 bp, Artificial Sequence
  Synthetic
cgtcatccugactggaagguaga

SEQ ID NO: 56897 - DNA, 28 bp, Artificial Sequence
  Synthetic
cttcagagttcacuggaagtttttgtut

SEQ ID NO: 56898 - DNA, 26 bp, Artificial Sequence
  Synthetic
tctcaggatgucctatgaggattuca

SEQ ID NO: 56899 - DNA, 23 bp, Artificial Sequence
  Synthetic
cctggaacuttttcggctuagac

SEQ ID NO: 56900 - DNA, 25 bp, Artificial Sequence
  Synthetic
gggutaaataguacaacagggcagt

SEQ ID NO: 56901 - DNA, 23 bp, Artificial Sequence
  Synthetic
actcccacgcutcattttctcut

SEQ ID NO: 56902 - DNA, 21 bp, Artificial Sequence
  Synthetic
cacaggugaagctuccaggag

SEQ ID NO: 56903 - DNA, 24 bp, Artificial Sequence
  Synthetic
tttggcctttuccgagttatccut

SEQ ID NO: 56904 - DNA, 22 bp, Artificial Sequence
  Synthetic
tgacttccuttgctgaugcaca

SEQ ID NO: 56905 - DNA, 25 bp, Artificial Sequence
  Synthetic
ccactgtaaccgugtaaccacttut

SEQ ID NO: 56906 - DNA, 27 bp, Artificial Sequence
  Synthetic
aatactaggcutcccctttttaugcaa

SEQ ID NO: 56907 - DNA, 21 bp, Artificial Sequence
  Synthetic
actgtcatugatgggcgaugt

SEQ ID NO: 56908 - DNA, 21 bp, Artificial Sequence
  Synthetic
ggaguctuccacagggagagt

SEQ ID NO: 56909 - DNA, 22 bp, Artificial Sequence
  Synthetic
tgctttuagcgtccuacacgag

SEQ ID NO: 56910 - DNA, 22 bp, Artificial Sequence
  Synthetic
ccaagaaccugcctgtgttcuc

SEQ ID NO: 56911 - DNA, 21 bp, Artificial Sequence
  Synthetic
gccatcgcugaatcagaggua

SEQ ID NO: 56912 - DNA, 21 bp, Artificial Sequence
  Synthetic
ccucggtatcuccccaaacca

SEQ ID NO: 56913 - DNA, 21 bp, Artificial Sequence
  Synthetic
ggacuacatcauccgggaagg

SEQ ID NO: 56914 - DNA, 20 bp, Artificial Sequence
  Synthetic
cagggtuggaggacgtugag

SEQ ID NO: 56915 - DNA, 22 bp, Artificial Sequence
  Synthetic
tggaagaacaucucccccaagt

SEQ ID NO: 56916 - DNA, 18 bp, Artificial Sequence
  Synthetic
ggcguacagctgagcuga

SEQ ID NO: 56917 - DNA, 20 bp, Artificial Sequence
  Synthetic
gggcugcaagcagacagaut

SEQ ID NO: 56918 - DNA, 21 bp, Artificial Sequence
  Synthetic
ttttctugccgtggugcaaaa

SEQ ID NO: 56919 - DNA, 27 bp, Artificial Sequence
  Synthetic
tcccaaccaugaagatttctttgcuaa

SEQ ID NO: 56920 - DNA, 21 bp, Artificial Sequence
  Synthetic
ttcagagcccucttccuccat

SEQ ID NO: 56921 - DNA, 22 bp, Artificial Sequence
  Synthetic
actttcaaggguggctgagtug

SEQ ID NO: 56922 - DNA, 21 bp, Artificial Sequence
  Synthetic
ctcctgucggctcttctctuc

SEQ ID NO: 56923 - DNA, 24 bp, Artificial Sequence
  Synthetic
gtgttcatcucctccggguaaaat

SEQ ID NO: 56924 - DNA, 22 bp, Artificial Sequence
  Synthetic
gatagcctuccccacauggaaa

SEQ ID NO: 56925 - DNA, 19 bp, Artificial Sequence
  Synthetic
ctgaugaccacgcuacgca

SEQ ID NO: 56926 - DNA, 21 bp, Artificial Sequence
  Synthetic
tccctuaaccccggattcuga

SEQ ID NO: 56927 - DNA, 23 bp, Artificial Sequence
  Synthetic
ccagaatcccuaactcccuccaa

SEQ ID NO: 56928 - DNA, 24 bp, Artificial Sequence
  Synthetic
ttctggaugtcatcttucccaacc

SEQ ID NO: 56929 - DNA, 26 bp, Artificial Sequence
  Synthetic
tgagaagtucctctttguggacaaaa

SEQ ID NO: 56930 - DNA, 21 bp, Artificial Sequence
  Synthetic
cctccagcucagttcctugaa

SEQ ID NO: 56931 - DNA, 23 bp, Artificial Sequence
  Synthetic
aaagttcctutcccttccucacc

SEQ ID NO: 56932 - DNA, 18 bp, Artificial Sequence
  Synthetic
gccccgauacctguccga

SEQ ID NO: 56933 - DNA, 23 bp, Artificial Sequence
  Synthetic
gtgatgacccaugttcccttuct

SEQ ID NO: 56934 - DNA, 22 bp, Artificial Sequence
  Synthetic
ggcatcttcuccacagcttugt

SEQ ID NO: 56935 - DNA, 24 bp, Artificial Sequence
  Synthetic
cataaatggcucttcctgtgtucc

SEQ ID NO: 56936 - DNA, 24 bp, Artificial Sequence
  Synthetic
gcagatctgacuaagggtgtugac

SEQ ID NO: 56937 - DNA, 23 bp, Artificial Sequence
  Synthetic
agatatccugctctttgccucct

SEQ ID NO: 56938 - DNA, 20 bp, Artificial Sequence
  Synthetic
gaaaagccccucccagguag

SEQ ID NO: 56939 - DNA, 22 bp, Artificial Sequence
  Synthetic
caauaggcacccagaagctuga

SEQ ID NO: 56940 - DNA, 26 bp, Artificial Sequence
  Synthetic
acttggtgaaaugacttcttgucaca

SEQ ID NO: 56941 - DNA, 24 bp, Artificial Sequence
  Synthetic
cgccattctcuagccaatgctuaa

SEQ ID NO: 56942 - DNA, 22 bp, Artificial Sequence
  Synthetic
tgtggacgaugagtcagggtua

SEQ ID NO: 56943 - DNA, 19 bp, Artificial Sequence
  Synthetic
ccaccguccctcttgucac

SEQ ID NO: 56944 - DNA, 21 bp, Artificial Sequence
  Synthetic
gctcagcucccaaaaccaguc

SEQ ID NO: 56945 - DNA, 25 bp, Artificial Sequence
  Synthetic
acaaattataugcccgtgcugagat

SEQ ID NO: 56946 - DNA, 24 bp, Artificial Sequence
  Synthetic
gcaattgaggaauttctcgcugat

SEQ ID NO: 56947 - DNA, 19 bp, Artificial Sequence
  Synthetic
gggcagaacugacacucac

SEQ ID NO: 56948 - DNA, 22 bp, Artificial Sequence
  Synthetic
ctccttgcgggauttcaacauc

SEQ ID NO: 56949 - DNA, 27 bp, Artificial Sequence
  Synthetic
agagauagagaaatccugggaggaaaa

SEQ ID NO: 56950 - DNA, 21 bp, Artificial Sequence
  Synthetic
caatcccaagutccggcucat

SEQ ID NO: 56951 - DNA, 22 bp, Artificial Sequence
  Synthetic
ggagtacacugcaggctcuagt

SEQ ID NO: 56952 - DNA, 21 bp, Artificial Sequence
  Synthetic
cccaggaaacccuccatuacc

SEQ ID NO: 56953 - DNA, 23 bp, Artificial Sequence
  Synthetic
gaaagttcuccaggtttggcauc

SEQ ID NO: 56954 - DNA, 20 bp, Artificial Sequence
  Synthetic
aggaagccaucggugagaag

SEQ ID NO: 56955 - DNA, 20 bp, Artificial Sequence
  Synthetic
gggctgaaguccttggcaut

SEQ ID NO: 56956 - DNA, 20 bp, Artificial Sequence
  Synthetic
ggcuccccaggatgtguact

SEQ ID NO: 56957 - DNA, 18 bp, Artificial Sequence
  Synthetic
gccttgggugagggctuc

SEQ ID NO: 56958 - DNA, 20 bp, Artificial Sequence
  Synthetic
cugccgctugagagaacact

SEQ ID NO: 56959 - DNA, 21 bp, Artificial Sequence
  Synthetic
actcatgttugcgaccctugt

SEQ ID NO: 56960 - DNA, 27 bp, Artificial Sequence
  Synthetic
cctgtgtcaaacugtgtaaagcaagua

SEQ ID NO: 56961 - DNA, 28 bp, Artificial Sequence
  Synthetic
caagtccuatgaacttaucaacgaagag

SEQ ID NO: 56962 - DNA, 27 bp, Artificial Sequence
  Synthetic
cagtcatcauttgccttaattuagcaa

SEQ ID NO: 56963 - DNA, 25 bp, Artificial Sequence
  Synthetic
ccgagaaucaaacagaguaaccaga

SEQ ID NO: 56964 - DNA, 24 bp, Artificial Sequence
  Synthetic
catgactccauggctgtcaaauct

SEQ ID NO: 56965 - DNA, 22 bp, Artificial Sequence
  Synthetic
agcaaacucaataccugcccaa

SEQ ID NO: 56966 - DNA, 22 bp, Artificial Sequence
  Synthetic
tttggctggcuagagttgguag

SEQ ID NO: 56967 - DNA, 22 bp, Artificial Sequence
  Synthetic
cactcacaucgctcctctucag

SEQ ID NO: 56968 - DNA, 23 bp, Artificial Sequence
  Synthetic
ccaaatctgggacucctaaccut

SEQ ID NO: 56969 - DNA, 21 bp, Artificial Sequence
  Synthetic
ctcctcucacacaggatggug

SEQ ID NO: 56970 - DNA, 20 bp, Artificial Sequence
  Synthetic
ctgccacgugaaggacucat

SEQ ID NO: 56971 - DNA, 24 bp, Artificial Sequence
  Synthetic
gctcuagaaacacaagccagugaa

SEQ ID NO: 56972 - DNA, 19 bp, Artificial Sequence
  Synthetic
gggccacaucgatgauggg

SEQ ID NO: 56973 - DNA, 20 bp, Artificial Sequence
  Synthetic
tccatcacucccacgtggua

SEQ ID NO: 56974 - DNA, 20 bp, Artificial Sequence
  Synthetic
caatcgugggctgcatcauc

SEQ ID NO: 56975 - DNA, 21 bp, Artificial Sequence
  Synthetic
tgtgcucgaacatgagctucc

SEQ ID NO: 56976 - DNA, 19 bp, Artificial Sequence
  Synthetic
gucaacggcuccagcaaga

SEQ ID NO: 56977 - DNA, 19 bp, Artificial Sequence
  Synthetic
ggcaaaucagcccugacca

SEQ ID NO: 56978 - DNA, 23 bp, Artificial Sequence
  Synthetic
gcaggaggguaaccagaaaggua

SEQ ID NO: 56979 - DNA, 21 bp, Artificial Sequence
  Synthetic
guagccacaaccuggaccaaa

SEQ ID NO: 56980 - DNA, 24 bp, Artificial Sequence
  Synthetic
agtcutacccaaaaauggcaggaa

SEQ ID NO: 56981 - DNA, 22 bp, Artificial Sequence
  Synthetic
guagaagagaugcagggccaag

SEQ ID NO: 56982 - DNA, 21 bp, Artificial Sequence
  Synthetic
accaaaaccgucctggaacug

SEQ ID NO: 56983 - DNA, 21 bp, Artificial Sequence
  Synthetic
tgtgtgaguggcatgtuccat

SEQ ID NO: 56984 - DNA, 21 bp, Artificial Sequence
  Synthetic
gcccucgcagtataucacagg

SEQ ID NO: 56985 - DNA, 22 bp, Artificial Sequence
  Synthetic
agaaagggugagacccguagag

SEQ ID NO: 56986 - DNA, 21 bp, Artificial Sequence
  Synthetic
gctacacgcuggagtucaagg

SEQ ID NO: 56987 - DNA, 19 bp, Artificial Sequence
  Synthetic
cagagacguagcggtggut

SEQ ID NO: 56988 - DNA, 21 bp, Artificial Sequence
  Synthetic
gggtcaacguctcagccaauc

SEQ ID NO: 56989 - DNA, 22 bp, Artificial Sequence
  Synthetic
atgauggaggaggaagggaugt

SEQ ID NO: 56990 - DNA, 29 bp, Artificial Sequence
  Synthetic
acttgaaaagaaugcctcaggatagaaut

SEQ ID NO: 56991 - DNA, 23 bp, Artificial Sequence
  Synthetic
gggagccacucacggattaauat

SEQ ID NO: 56992 - DNA, 20 bp, Artificial Sequence
  Synthetic
tgccgttaaugcccatggut

SEQ ID NO: 56993 - DNA, 25 bp, Artificial Sequence
  Synthetic
ctctctugacacccaggattcttuc

SEQ ID NO: 56994 - DNA, 22 bp, Artificial Sequence
  Synthetic
acccacccugttggatcagtua

SEQ ID NO: 56995 - DNA, 28 bp, Artificial Sequence
  Synthetic
gcaatggauataaagcataugacccaga

SEQ ID NO: 56996 - DNA, 28 bp, Artificial Sequence
  Synthetic
tgtttatgttaccuctctgtctagcuga

SEQ ID NO: 56997 - DNA, 20 bp, Artificial Sequence
  Synthetic
atgcacacacgccugaagua

SEQ ID NO: 56998 - DNA, 28 bp, Artificial Sequence
  Synthetic
atcttgacttcagugttattgtcgcuaa

SEQ ID NO: 56999 - DNA, 24 bp, Artificial Sequence
  Synthetic
cctttgcttgauctatccatgcuc

SEQ ID NO: 57000 - DNA, 25 bp, Artificial Sequence
  Synthetic
gtaatucacccaaaacaagctuggt

SEQ ID NO: 57001 - DNA, 24 bp, Artificial Sequence
  Synthetic
ggcacatcagcaguaaaagtggua

SEQ ID NO: 57002 - DNA, 24 bp, Artificial Sequence
  Synthetic
gggcagtcuagtaggaagaaaugg

SEQ ID NO: 57003 - DNA, 22 bp, Artificial Sequence
  Synthetic
ctcuaccagaaagcaggctuct

SEQ ID NO: 57004 - DNA, 23 bp, Artificial Sequence
  Synthetic
tgtctgctggutacatgtggaut

SEQ ID NO: 57005 - DNA, 23 bp, Artificial Sequence
  Synthetic
ccgtgcccuggaagtatacauat

SEQ ID NO: 57006 - DNA, 27 bp, Artificial Sequence
  Synthetic
gggatcactaaagutcattccttcugt

SEQ ID NO: 57007 - DNA, 23 bp, Artificial Sequence
  Synthetic
tctttctttcuccaggguccaga

SEQ ID NO: 57008 - DNA, 20 bp, Artificial Sequence
  Synthetic
ggcatcccuggcatcauaca

SEQ ID NO: 57009 - DNA, 25 bp, Artificial Sequence
  Synthetic
cttacatgtcuttgaaggacuggga

SEQ ID NO: 57010 - DNA, 21 bp, Artificial Sequence
  Synthetic
cagaaaaugggcacaacgugt

SEQ ID NO: 57011 - DNA, 19 bp, Artificial Sequence
  Synthetic
ggtcaggaggcucgatgut

SEQ ID NO: 57012 - DNA, 17 bp, Artificial Sequence
  Synthetic
ggcttccugcccgtcug

SEQ ID NO: 57013 - DNA, 17 bp, Artificial Sequence
  Synthetic
actgggcgcugcatgut

SEQ ID NO: 57014 - DNA, 21 bp, Artificial Sequence
  Synthetic
aggguccagagctacucacat

SEQ ID NO: 57015 - DNA, 23 bp, Artificial Sequence
  Synthetic
ctttgccatuggctgtaaagguc

SEQ ID NO: 57016 - DNA, 20 bp, Artificial Sequence
  Synthetic
ctgtgggaggaaucggauca

SEQ ID NO: 57017 - DNA, 28 bp, Artificial Sequence
  Synthetic
tcttcaagatctguttcacatcctcauc

SEQ ID NO: 57018 - DNA, 21 bp, Artificial Sequence
  Synthetic
gauggaactuggcgaaggagt

SEQ ID NO: 57019 - DNA, 22 bp, Artificial Sequence
  Synthetic
gcagcaagaagucctggttcuc

SEQ ID NO: 57020 - DNA, 25 bp, Artificial Sequence
  Synthetic
tctcagaccuatgatccucgagaag

SEQ ID NO: 57021 - DNA, 17 bp, Artificial Sequence
  Synthetic
cttccguccccacgugt

SEQ ID NO: 57022 - DNA, 21 bp, Artificial Sequence
  Synthetic
tggacccuttatcucccccaa

SEQ ID NO: 57023 - DNA, 24 bp, Artificial Sequence
  Synthetic
cctccaugggcaaaggatuacaat

SEQ ID NO: 57024 - DNA, 21 bp, Artificial Sequence
  Synthetic
ggacgagtuctctgtgctcug

SEQ ID NO: 57025 - DNA, 23 bp, Artificial Sequence
  Synthetic
ccaggaggaagagucagaaggut

SEQ ID NO: 57026 - DNA, 21 bp, Artificial Sequence
  Synthetic
ccccgaatcuagcctacguga

SEQ ID NO: 57027 - DNA, 28 bp, Artificial Sequence
  Synthetic
ctgaagatagccuttacatccctaaucc

SEQ ID NO: 57028 - DNA, 21 bp, Artificial Sequence
  Synthetic
tctcctctcuggtcccaacug

SEQ ID NO: 57029 - DNA, 21 bp, Artificial Sequence
  Synthetic
ccttuggcccaaacacaggua

SEQ ID NO: 57030 - DNA, 21 bp, Artificial Sequence
  Synthetic
catcagccugtccctggttua

SEQ ID NO: 57031 - DNA, 21 bp, Artificial Sequence
  Synthetic
ttttcgatcuccacggucagg

SEQ ID NO: 57032 - DNA, 23 bp, Artificial Sequence
  Synthetic
agatctgggugtgagctccttua

SEQ ID NO: 57033 - DNA, 20 bp, Artificial Sequence
  Synthetic
gtggcccccaguttactgut

SEQ ID NO: 57034 - DNA, 22 bp, Artificial Sequence
  Synthetic
gaggagaaaugtcgactgcugt

SEQ ID NO: 57035 - DNA, 27 bp, Artificial Sequence
  Synthetic
cccctctcctcuaaactcttgctaaut

SEQ ID NO: 57036 - DNA, 23 bp, Artificial Sequence
  Synthetic
gaacutatugcagccaaagccat

SEQ ID NO: 57037 - DNA, 23 bp, Artificial Sequence
  Synthetic
agccaaaauggucagggaagaag

SEQ ID NO: 57038 - DNA, 20 bp, Artificial Sequence
  Synthetic
gagggcutctuccgcaagat

SEQ ID NO: 57039 - DNA, 23 bp, Artificial Sequence
  Synthetic
aggugaaagaaagctctcuggac

SEQ ID NO: 57040 - DNA, 20 bp, Artificial Sequence
  Synthetic
tccgggaagcugtcctttug

SEQ ID NO: 57041 - DNA, 18 bp, Artificial Sequence
  Synthetic
gggccaccaaugccaaug

SEQ ID NO: 57042 - DNA, 19 bp, Artificial Sequence
  Synthetic
cggtgtgggugcgataaug

SEQ ID NO: 57043 - DNA, 23 bp, Artificial Sequence
  Synthetic
actataatuccccaagggcuggt

SEQ ID NO: 57044 - DNA, 19 bp, Artificial Sequence
  Synthetic
acaugacgtucgggagcac

SEQ ID NO: 57045 - DNA, 20 bp, Artificial Sequence
  Synthetic
gccgacacuctgaagaccut

SEQ ID NO: 57046 - DNA, 22 bp, Artificial Sequence
  Synthetic
ggctgcutcctgtuccaaagat

SEQ ID NO: 57047 - DNA, 27 bp, Artificial Sequence
  Synthetic
tgttggaatgacuatgcagtcttuagg

SEQ ID NO: 57048 - DNA, 24 bp, Artificial Sequence
  Synthetic
gcctcaaaauacccctaaaaugcc

SEQ ID NO: 57049 - DNA, 22 bp, Artificial Sequence
  Synthetic
acgggaaguggttttccttuct

SEQ ID NO: 57050 - DNA, 21 bp, Artificial Sequence
  Synthetic
cgcugtggtgtuagacaggat

SEQ ID NO: 57051 - DNA, 22 bp, Artificial Sequence
  Synthetic
tgggtttuggccaatacguact

SEQ ID NO: 57052 - DNA, 17 bp, Artificial Sequence
  Synthetic
gcacucacccccacuga

SEQ ID NO: 57053 - DNA, 18 bp, Artificial Sequence
  Synthetic
tctgaccccugaccccut

SEQ ID NO: 57054 - DNA, 20 bp, Artificial Sequence
  Synthetic
tggatcgguggcaagaaguc

SEQ ID NO: 57055 - DNA, 22 bp, Artificial Sequence
  Synthetic
tccgatcuggagggcaatagua

SEQ ID NO: 57056 - DNA, 21 bp, Artificial Sequence
  Synthetic
tggcctgcucaggtctuagaa

SEQ ID NO: 57057 - DNA, 23 bp, Artificial Sequence
  Synthetic
gccaggagacucttttugaaggg

SEQ ID NO: 57058 - DNA, 21 bp, Artificial Sequence
  Synthetic
tcgtgtucaaaccacggagut

SEQ ID NO: 57059 - DNA, 23 bp, Artificial Sequence
  Synthetic
cccccacttuactggaagcauat

SEQ ID NO: 57060 - DNA, 28 bp, Artificial Sequence
  Synthetic
tctcttcatcacutagttcttcuagggt

SEQ ID NO: 57061 - DNA, 28 bp, Artificial Sequence
  Synthetic
gggatccttguagttcaatgtaattgua

SEQ ID NO: 57062 - DNA, 20 bp, Artificial Sequence
  Synthetic
caugccggagaaguggaagt

SEQ ID NO: 57063 - DNA, 24 bp, Artificial Sequence
  Synthetic
accagcaaccaugactatgctauc

SEQ ID NO: 57064 - DNA, 22 bp, Artificial Sequence
  Synthetic
cagtutcctccacugagaccac

SEQ ID NO: 57065 - DNA, 21 bp, Artificial Sequence
  Synthetic
gcaccccaaggagutgacauc

SEQ ID NO: 57066 - DNA, 27 bp, Artificial Sequence
  Synthetic
aggaaggtcaguaggataattcagcua

SEQ ID NO: 57067 - DNA, 29 bp, Artificial Sequence
  Synthetic
gtcctgttcacuataactaaaaccgtuga

SEQ ID NO: 57068 - DNA, 23 bp, Artificial Sequence
  Synthetic
cgtcaaacutaccggagugcaat

SEQ ID NO: 57069 - DNA, 27 bp, Artificial Sequence
  Synthetic
gtgttcttugggaatttgatucgaaga

SEQ ID NO: 57070 - DNA, 20 bp, Artificial Sequence
  Synthetic
ctccgucaccactgatccut

SEQ ID NO: 57071 - DNA, 29 bp, Artificial Sequence
  Synthetic
gccaaataagcacutcttttcatctcaut

SEQ ID NO: 57072 - DNA, 23 bp, Artificial Sequence
  Synthetic
ccttggagtcutctaggagccut

SEQ ID NO: 57073 - DNA, 27 bp, Artificial Sequence
  Synthetic
ttcactaggugcaccattctgatatut

SEQ ID NO: 57074 - DNA, 20 bp, Artificial Sequence
  Synthetic
gggaggaguggcgtttauct

SEQ ID NO: 57075 - DNA, 28 bp, Artificial Sequence
  Synthetic
gccattucacacagaattaagacuggaa

SEQ ID NO: 57076 - DNA, 21 bp, Artificial Sequence
  Synthetic
tgctcaaugggcaaacuacca

SEQ ID NO: 57077 - DNA, 25 bp, Artificial Sequence
  Synthetic
ctcaacttagugtcaccgactauga

SEQ ID NO: 57078 - DNA, 24 bp, Artificial Sequence
  Synthetic
acagaauaggccacaattguaccc

SEQ ID NO: 57079 - DNA, 28 bp, Artificial Sequence
  Synthetic
tgtggcaaaagaaautgaattcgaugaa

SEQ ID NO: 57080 - DNA, 27 bp, Artificial Sequence
  Synthetic
gggaaauactgtgaccuaaaacagacc

SEQ ID NO: 57081 - DNA, 27 bp, Artificial Sequence
  Synthetic
tgtctcctggauctcttgtggatatua

SEQ ID NO: 57082 - DNA, 24 bp, Artificial Sequence
  Synthetic
gcagcugaagtattagauccagca

SEQ ID NO: 57083 - DNA, 28 bp, Artificial Sequence
  Synthetic
ctgctatacacugacctgtctcauaaaa

SEQ ID NO: 57084 - DNA, 21 bp, Artificial Sequence
  Synthetic
cgacaguggacauccagaacc

SEQ ID NO: 57085 - DNA, 22 bp, Artificial Sequence
  Synthetic
tcagctguccacttgttcaugt

SEQ ID NO: 57086 - DNA, 19 bp, Artificial Sequence
  Synthetic
cgacgccgagaccucuaaa

SEQ ID NO: 57087 - DNA, 21 bp, Artificial Sequence
  Synthetic
gagctgcutgggcuagagaag

SEQ ID NO: 57088 - DNA, 20 bp, Artificial Sequence
  Synthetic
ggcaccagauctctguacgg

SEQ ID NO: 57089 - DNA, 23 bp, Artificial Sequence
  Synthetic
agacuacacccagggaaugaaga

SEQ ID NO: 57090 - DNA, 20 bp, Artificial Sequence
  Synthetic
cgcctcaugcagctcattug

SEQ ID NO: 57091 - DNA, 26 bp, Artificial Sequence
  Synthetic
ggttcctattgtutctccccagatug

SEQ ID NO: 57092 - DNA, 23 bp, Artificial Sequence
  Synthetic
gagcuatggatgucaaggacact

SEQ ID NO: 57093 - DNA, 22 bp, Artificial Sequence
  Synthetic
tgccgguacacagaggtctuat

SEQ ID NO: 57094 - DNA, 28 bp, Artificial Sequence
  Synthetic
catgataaguaccatgactccaaugagt

SEQ ID NO: 57095 - DNA, 21 bp, Artificial Sequence
  Synthetic
caggucccagatgaaauccca

SEQ ID NO: 57096 - DNA, 22 bp, Artificial Sequence
  Synthetic
gatttgggtgcutgggcctaua

SEQ ID NO: 57097 - DNA, 25 bp, Artificial Sequence
  Synthetic
tgagtcagaggaacuactgaagucc

SEQ ID NO: 57098 - DNA, 21 bp, Artificial Sequence
  Synthetic
ggagaaccccauggctttgut

SEQ ID NO: 57099 - DNA, 21 bp, Artificial Sequence
  Synthetic
ctttttcagaggugggcgaug

SEQ ID NO: 57100 - DNA, 28 bp, Artificial Sequence
  Synthetic
ctttttguagaaccatagttttguggca

SEQ ID NO: 57101 - DNA, 22 bp, Artificial Sequence
  Synthetic
tcacggaagcugtgtcatcauc

SEQ ID NO: 57102 - DNA, 28 bp, Artificial Sequence
  Synthetic
gtcagcaagucacttagatcauaaacga

SEQ ID NO: 57103 - DNA, 32 bp, Artificial Sequence
  Synthetic
agaaaaatcatggucataaatagctaaugggt

SEQ ID NO: 57104 - DNA, 24 bp, Artificial Sequence
  Synthetic
agtggcucactaaaucagagcaag

SEQ ID NO: 57105 - DNA, 28 bp, Artificial Sequence
  Synthetic
ttccagagcagaugtctttaauagcaaa

SEQ ID NO: 57106 - DNA, 20 bp, Artificial Sequence
  Synthetic
gctgcctucgtcgcttuagt

SEQ ID NO: 57107 - DNA, 28 bp, Artificial Sequence
  Synthetic
gggattggtaaaagucacagctaaauca

SEQ ID NO: 57108 - DNA, 25 bp, Artificial Sequence
  Synthetic
caaagcaaccgaagaauguaaccat

SEQ ID NO: 57109 - DNA, 20 bp, Artificial Sequence
  Synthetic
ctgaccugacgcgatctcug

SEQ ID NO: 57110 - DNA, 26 bp, Artificial Sequence
  Synthetic
aaauctgttacucaccacagcaaaga

SEQ ID NO: 57111 - DNA, 27 bp, Artificial Sequence
  Synthetic
ctgtacctttuccctttcttcttcucc

SEQ ID NO: 57112 - DNA, 25 bp, Artificial Sequence
  Synthetic
ttgtaggaaaaugagacgctgucaa

SEQ ID NO: 57113 - DNA, 22 bp, Artificial Sequence
  Synthetic
ccugtttgtttcucacccccaa

SEQ ID NO: 57114 - DNA, 22 bp, Artificial Sequence
  Synthetic
cggaccaguctttcaggttgua

SEQ ID NO: 57115 - DNA, 22 bp, Artificial Sequence
  Synthetic
gtgttgcagcugttgttguacc

SEQ ID NO: 57116 - DNA, 23 bp, Artificial Sequence
  Synthetic
ttttagguggctgcaaaatucgg

SEQ ID NO: 57117 - DNA, 27 bp, Artificial Sequence
  Synthetic
ccacucccgttgaaauagaagaaagaa

SEQ ID NO: 57118 - DNA, 26 bp, Artificial Sequence
  Synthetic
ggagguagccagagataattauggga

SEQ ID NO: 57119 - DNA, 28 bp, Artificial Sequence
  Synthetic
ggtgagccctauttagtcatacactuaa

SEQ ID NO: 57120 - DNA, 25 bp, Artificial Sequence
  Synthetic
catcctgaacucgggagaagauaag

SEQ ID NO: 57121 - DNA, 28 bp, Artificial Sequence
  Synthetic
tgtaaaagagguttatgtctugggacag

SEQ ID NO: 57122 - DNA, 26 bp, Artificial Sequence
  Synthetic
attcccagugaacagaaaguaaacga

SEQ ID NO: 57123 - DNA, 24 bp, Artificial Sequence
  Synthetic
cactgtctuacaagccaactctug

SEQ ID NO: 57124 - DNA, 26 bp, Artificial Sequence
  Synthetic
attccacataccuggttaatgtgcut

SEQ ID NO: 57125 - DNA, 28 bp, Artificial Sequence
  Synthetic
tgacaaacctttuctttaccttcaccut

SEQ ID NO: 57126 - DNA, 27 bp, Artificial Sequence
  Synthetic
agtttcactctaguggtttttgaccut

SEQ ID NO: 57127 - DNA, 24 bp, Artificial Sequence
  Synthetic
gattggcaagutatgtgcccatuc

SEQ ID NO: 57128 - DNA, 20 bp, Artificial Sequence
  Synthetic
ctccucggaggcactcatug

SEQ ID NO: 57129 - DNA, 25 bp, Artificial Sequence
  Synthetic
ccatgtucaagaacaacuacccaag

SEQ ID NO: 57130 - DNA, 28 bp, Artificial Sequence
  Synthetic
tgtatgtgtcaaugaggcagtagtuaag

SEQ ID NO: 57131 - DNA, 26 bp, Artificial Sequence
  Synthetic
ctttatgtattcgucgcgtaaggcua

SEQ ID NO: 57132 - DNA, 20 bp, Artificial Sequence
  Synthetic
cctgagtattugccgcccut

SEQ ID NO: 57133 - DNA, 22 bp, Artificial Sequence
  Synthetic
gggccccaacuttaagagcaua

SEQ ID NO: 57134 - DNA, 21 bp, Artificial Sequence
  Synthetic
cggtgacauagtacgcaugcc

SEQ ID NO: 57135 - DNA, 23 bp, Artificial Sequence
  Synthetic
tcctttctcccutctgctctcut

SEQ ID NO: 57136 - DNA, 23 bp, Artificial Sequence
  Synthetic
gccctguagagataggagtugct

SEQ ID NO: 57137 - DNA, 22 bp, Artificial Sequence
  Synthetic
cagagacaucagaagggucagg

SEQ ID NO: 57138 - DNA, 20 bp, Artificial Sequence
  Synthetic
gtctggccutctgtccacug

SEQ ID NO: 57139 - DNA, 24 bp, Artificial Sequence
  Synthetic
aagtccctguctatgttccacuct

SEQ ID NO: 57140 - DNA, 25 bp, Artificial Sequence
  Synthetic
agctactcaucccataaucccagag

SEQ ID NO: 57141 - DNA, 23 bp, Artificial Sequence
  Synthetic
tgaaacgccaucaacgggaaaua

SEQ ID NO: 57142 - DNA, 28 bp, Artificial Sequence
  Synthetic
ttttaaaagaucatgtccatuggagaca

SEQ ID NO: 57143 - DNA, 26 bp, Artificial Sequence
  Synthetic
gaatcaggaaucttgggaccttuact

SEQ ID NO: 57144 - DNA, 17 bp, Artificial Sequence
  Synthetic
aagggucgcccactguc

SEQ ID NO: 57145 - DNA, 22 bp, Artificial Sequence
  Synthetic
ggtccacauacccatcctctuc

SEQ ID NO: 57146 - DNA, 23 bp, Artificial Sequence
  Synthetic
gaggatgatgaugtgagccaugt

SEQ ID NO: 57147 - DNA, 22 bp, Artificial Sequence
  Synthetic
gcacactagaugccatccucag

SEQ ID NO: 57148 - DNA, 23 bp, Artificial Sequence
  Synthetic
tggaaggauaggaaaugggaagt

SEQ ID NO: 57149 - DNA, 21 bp, Artificial Sequence
  Synthetic
ccagctcugtggtgacaucaa

SEQ ID NO: 57150 - DNA, 23 bp, Artificial Sequence
  Synthetic
ttctagcuacagcttccctucct

SEQ ID NO: 57151 - DNA, 27 bp, Artificial Sequence
  Synthetic
agcatctucatttttgttuccacacaa

SEQ ID NO: 57152 - DNA, 19 bp, Artificial Sequence
  Synthetic
gccatcucctgacccucct

SEQ ID NO: 57153 - DNA, 18 bp, Artificial Sequence
  Synthetic
cgacucaccagcgtccut

SEQ ID NO: 57154 - DNA, 20 bp, Artificial Sequence
  Synthetic
tccagttcuggatgcccuga

SEQ ID NO: 57155 - DNA, 24 bp, Artificial Sequence
  Synthetic
gctgaagtggacucaattcctgut

SEQ ID NO: 57156 - DNA, 25 bp, Artificial Sequence
  Synthetic
ttatgcucacccggttattcucaaa

SEQ ID NO: 57157 - DNA, 26 bp, Artificial Sequence
  Synthetic
ccatcactcugagttgtctcattuca

SEQ ID NO: 57158 - DNA, 22 bp, Artificial Sequence
  Synthetic
gaaagaguagacagccgcugat

SEQ ID NO: 57159 - DNA, 24 bp, Artificial Sequence
  Synthetic
gtctgaacaucaccttcuacgaga

SEQ ID NO: 57160 - DNA, 28 bp, Artificial Sequence
  Synthetic
cuttttaaccttaggucaaaggcaaagt

SEQ ID NO: 57161 - DNA, 21 bp, Artificial Sequence
  Synthetic
gcagcctguagtggtgtcauc

SEQ ID NO: 57162 - DNA, 21 bp, Artificial Sequence
  Synthetic
caaggtcuccttcagucgcaa

SEQ ID NO: 57163 - DNA, 23 bp, Artificial Sequence
  Synthetic
tccatcugggctttgttcucaac

SEQ ID NO: 57164 - DNA, 25 bp, Artificial Sequence
  Synthetic
tuccttaatgagtugggaagggaaa

SEQ ID NO: 57165 - DNA, 28 bp, Artificial Sequence
  Synthetic
gatcttctctatauagggtgaaccugga

SEQ ID NO: 57166 - DNA, 27 bp, Artificial Sequence
  Synthetic
caaactaaugccagacaaauccaaaga

SEQ ID NO: 57167 - DNA, 29 bp, Artificial Sequence
  Synthetic
gcaccaggctcauaatttactgtgataua

SEQ ID NO: 57168 - DNA, 23 bp, Artificial Sequence
  Synthetic
ccttgagaccuctgacaccauct

SEQ ID NO: 57169 - DNA, 31 bp, Artificial Sequence
  Synthetic
acgtataagtgguaattcatctattucaggg

SEQ ID NO: 57170 - DNA, 28 bp, Artificial Sequence
  Synthetic
ggaatagatguatcttaccctgugacct

SEQ ID NO: 57171 - DNA, 23 bp, Artificial Sequence
  Synthetic
cacatcctgugtcagttcacuct

SEQ ID NO: 57172 - DNA, 28 bp, Artificial Sequence
  Synthetic
tggatcacatcuctaccagagttaauca

SEQ ID NO: 57173 - DNA, 21 bp, Artificial Sequence
  Synthetic
ctggccaagagutacgggaut

SEQ ID NO: 57174 - DNA, 21 bp, Artificial Sequence
  Synthetic
tccctcguggtgtagagugat

SEQ ID NO: 57175 - DNA, 23 bp, Artificial Sequence
  Synthetic
ccaattgggugcgtaactttguc

SEQ ID NO: 57176 - DNA, 26 bp, Artificial Sequence
  Synthetic
gtcctcatcacuctctctgtctuact

SEQ ID NO: 57177 - DNA, 23 bp, Artificial Sequence
  Synthetic
ccacactcttuatccctggacuc

SEQ ID NO: 57178 - DNA, 24 bp, Artificial Sequence
  Synthetic
gaautctggtgtttucaggcaaca

SEQ ID NO: 57179 - DNA, 26 bp, Artificial Sequence
  Synthetic
cccaagagaaguttttccaggaacua

SEQ ID NO: 57180 - DNA, 28 bp, Artificial Sequence
  Synthetic
acaaatcagtcutttccaactctuccaa

SEQ ID NO: 57181 - DNA, 28 bp, Artificial Sequence
  Synthetic
gacttcttcagcautatgacaagagcua

SEQ ID NO: 57182 - DNA, 21 bp, Artificial Sequence
  Synthetic
cagggaccugcagcagtatua

SEQ ID NO: 57183 - DNA, 22 bp, Artificial Sequence
  Synthetic
ttactggaccuccccattcuca

SEQ ID NO: 57184 - DNA, 21 bp, Artificial Sequence
  Synthetic
acuttggaagugccaccaagt

SEQ ID NO: 57185 - DNA, 26 bp, Artificial Sequence
  Synthetic
gaccttgattgauttctcgtgttuca

SEQ ID NO: 57186 - DNA, 28 bp, Artificial Sequence
  Synthetic
gtgtgtttctugaggaagatgaauaggt

SEQ ID NO: 57187 - DNA, 28 bp, Artificial Sequence
  Synthetic
ccctatttguaggtgttgaaugaacaag

SEQ ID NO: 57188 - DNA, 24 bp, Artificial Sequence
  Synthetic
acaatggtuccatccctccuaagt

SEQ ID NO: 57189 - DNA, 27 bp, Artificial Sequence
  Synthetic
gccttactcucagtataacttcuccct

SEQ ID NO: 57190 - DNA, 21 bp, Artificial Sequence
  Synthetic
cctgtcaguggtgtcagtgug

SEQ ID NO: 57191 - DNA, 28 bp, Artificial Sequence
  Synthetic
agtgcactatuacaataaattgctgcut

SEQ ID NO: 57192 - DNA, 24 bp, Artificial Sequence
  Synthetic
cagaaccaccaaaaacugtuagca

SEQ ID NO: 57193 - DNA, 25 bp, Artificial Sequence
  Synthetic
ggctctttcauatcagcaagtguga

SEQ ID NO: 57194 - DNA, 27 bp, Artificial Sequence
  Synthetic
gagaccuaaaggaaattttuggcacat

SEQ ID NO: 57195 - DNA, 21 bp, Artificial Sequence
  Synthetic
cccgcgaagutataccaucct

SEQ ID NO: 57196 - DNA, 26 bp, Artificial Sequence
  Synthetic
ccaaauaagtttcuggcagacagagt

SEQ ID NO: 57197 - DNA, 28 bp, Artificial Sequence
  Synthetic
gaagtcataatgcauaacctttcccuga

SEQ ID NO: 57198 - DNA, 25 bp, Artificial Sequence
  Synthetic
atgaaaccttatutgcgtggcttut

SEQ ID NO: 57199 - DNA, 28 bp, Artificial Sequence
  Synthetic
tctcaacatttugatttctgtttugcca

SEQ ID NO: 57200 - DNA, 21 bp, Artificial Sequence
  Synthetic
acagcgaggaagaagugtgug

SEQ ID NO: 57201 - DNA, 22 bp, Artificial Sequence
  Synthetic
ccgcaucagggaatgaatguct

SEQ ID NO: 57202 - DNA, 29 bp, Artificial Sequence
  Synthetic
atgctttagaatuggaagtagattguggt

SEQ ID NO: 57203 - DNA, 24 bp, Artificial Sequence
  Synthetic
gagagcaagcaugcactttuagat

SEQ ID NO: 57204 - DNA, 21 bp, Artificial Sequence
  Synthetic
acactgacaguccagaccuga

SEQ ID NO: 57205 - DNA, 25 bp, Artificial Sequence
  Synthetic
aaagagtgcaaguctcaatgcaaug

SEQ ID NO: 57206 - DNA, 23 bp, Artificial Sequence
  Synthetic
tgtutagatctgagugccccaag

SEQ ID NO: 57207 - DNA, 28 bp, Artificial Sequence
  Synthetic
tggagguatgagaaaugagaaaggaaag

SEQ ID NO: 57208 - DNA, 26 bp, Artificial Sequence
  Synthetic
ggacgguggtattttgaattugagac

SEQ ID NO: 57209 - DNA, 24 bp, Artificial Sequence
  Synthetic
guactgtgaagcuaccaagaggaa

SEQ ID NO: 57210 - DNA, 24 bp, Artificial Sequence
  Synthetic
gcagtcaauggagttttgcucaga

SEQ ID NO: 57211 - DNA, 22 bp, Artificial Sequence
  Synthetic
cccgcacauaccatauagcagt

SEQ ID NO: 57212 - DNA, 21 bp, Artificial Sequence
  Synthetic
gcggttttugcacaagcuaca

SEQ ID NO: 57213 - DNA, 26 bp, Artificial Sequence
  Synthetic
acccttgtgaccugaaagagatttuc

SEQ ID NO: 57214 - DNA, 27 bp, Artificial Sequence
  Synthetic
cgcttctctcautgactcattactuca

SEQ ID NO: 57215 - DNA, 28 bp, Artificial Sequence
  Synthetic
aagaagccggaauagaatttgttaucca

SEQ ID NO: 57216 - DNA, 23 bp, Artificial Sequence
  Synthetic
tgggatugggcaatttcactuca

SEQ ID NO: 57217 - DNA, 27 bp, Artificial Sequence
  Synthetic
aggcagtaatatutccagcatcttuca

SEQ ID NO: 57218 - DNA, 22 bp, Artificial Sequence
  Synthetic
gccctgaugatcatgcugacaa

SEQ ID NO: 57219 - DNA, 23 bp, Artificial Sequence
  Synthetic
caggttgugggttaaagtuccct

SEQ ID NO: 57220 - DNA, 27 bp, Artificial Sequence
  Synthetic
tggtctgtagaaauctgttgtgctuac

SEQ ID NO: 57221 - DNA, 24 bp, Artificial Sequence
  Synthetic
agcaacgaggaaaucugaagaaca

SEQ ID NO: 57222 - DNA, 21 bp, Artificial Sequence
  Synthetic
ccaagatcgugaagcccaaug

SEQ ID NO: 57223 - DNA, 23 bp, Artificial Sequence
  Synthetic
cuccagaagagccuaagaagcaa

SEQ ID NO: 57224 - DNA, 25 bp, Artificial Sequence
  Synthetic
agccttcucgaactttgaactuacc

SEQ ID NO: 57225 - DNA, 27 bp, Artificial Sequence
  Synthetic
gggtacacacauttctgaaactacuaa

SEQ ID NO: 57226 - DNA, 25 bp, Artificial Sequence
  Synthetic
ggctcgaatgaucggaatcaaauac

SEQ ID NO: 57227 - DNA, 22 bp, Artificial Sequence
  Synthetic
ggtgutcgtccaucaaacccaa

SEQ ID NO: 57228 - DNA, 26 bp, Artificial Sequence
  Synthetic
tcccatcggautcaagtttucaaaga

SEQ ID NO: 57229 - DNA, 33 bp, Artificial Sequence
  Synthetic
taagtttctaaactacutaataaaaggcaggut

SEQ ID NO: 57230 - DNA, 28 bp, Artificial Sequence
  Synthetic
gctaggaauacttacttcucaaaccaca

SEQ ID NO: 57231 - DNA, 26 bp, Artificial Sequence
  Synthetic
ctgtacagccaucagaattagtugga

SEQ ID NO: 57232 - DNA, 25 bp, Artificial Sequence
  Synthetic
tcaagtaaagugagttgucgagcaa

SEQ ID NO: 57233 - DNA, 28 bp, Artificial Sequence
  Synthetic
caagagacaauggaccaggtcataauat

SEQ ID NO: 57234 - DNA, 28 bp, Artificial Sequence
  Synthetic
tgtaaagataucaatgctgccauccaat

SEQ ID NO: 57235 - DNA, 24 bp, Artificial Sequence
  Synthetic
guaaatcaaatcaugggcagccaa

SEQ ID NO: 57236 - DNA, 23 bp, Artificial Sequence
  Synthetic
aaaggcaagaaggcaguagtuca

SEQ ID NO: 57237 - DNA, 26 bp, Artificial Sequence
  Synthetic
ttcctatttuccaaggaacgtgtuca

SEQ ID NO: 57238 - DNA, 23 bp, Artificial Sequence
  Synthetic
ctcaccuaccccaagttttcuga

SEQ ID NO: 57239 - DNA, 21 bp, Artificial Sequence
  Synthetic
caaaaggagggugcaguccat

SEQ ID NO: 57240 - DNA, 22 bp, Artificial Sequence
  Synthetic
ccccacuccaagctgcaaatua

SEQ ID NO: 57241 - DNA, 24 bp, Artificial Sequence
  Synthetic
tguagtacatcttcucagcaggga

SEQ ID NO: 57242 - DNA, 21 bp, Artificial Sequence
  Synthetic
gccagccuagcatcccttcua

SEQ ID NO: 57243 - DNA, 25 bp, Artificial Sequence
  Synthetic
ttugaagaaggaaaggucagagcaa

SEQ ID NO: 57244 - DNA, 18 bp, Artificial Sequence
  Synthetic
gaagcaacgcgutccgut

SEQ ID NO: 57245 - DNA, 23 bp, Artificial Sequence
  Synthetic
ctctttgcugcctgtgtcattug

SEQ ID NO: 57246 - DNA, 23 bp, Artificial Sequence
  Synthetic
ctcaccaauggtggtgtagtuga

SEQ ID NO: 57247 - DNA, 21 bp, Artificial Sequence
  Synthetic
acagtctttgcugggcatcut

SEQ ID NO: 57248 - DNA, 27 bp, Artificial Sequence
  Synthetic
attaaagaatccautctgaggcuacgg

SEQ ID NO: 57249 - DNA, 22 bp, Artificial Sequence
  Synthetic
tgttgagguggcttttcctuct

SEQ ID NO: 57250 - DNA, 24 bp, Artificial Sequence
  Synthetic
atctagggatuctggtgtccauca

SEQ ID NO: 57251 - DNA, 23 bp, Artificial Sequence
  Synthetic
gtgaaccugggcaaaaagaucac

SEQ ID NO: 57252 - DNA, 25 bp, Artificial Sequence
  Synthetic
agcttttgttguagaagagcccaut

SEQ ID NO: 57253 - DNA, 27 bp, Artificial Sequence
  Synthetic
gccgacagaaggauttctttgctauat

SEQ ID NO: 57254 - DNA, 25 bp, Artificial Sequence
  Synthetic
aggctactaucaggtggatgttcut

SEQ ID NO: 57255 - DNA, 24 bp, Artificial Sequence
  Synthetic
gcaactttuaagggatggacgaut

SEQ ID NO: 57256 - DNA, 26 bp, Artificial Sequence
  Synthetic
catgaggacaaugaagcttucaaacc

SEQ ID NO: 57257 - DNA, 25 bp, Artificial Sequence
  Synthetic
gagtaucacagaaagcagttugcat

SEQ ID NO: 57258 - DNA, 22 bp, Artificial Sequence
  Synthetic
agagagacugactgaugcagga

SEQ ID NO: 57259 - DNA, 20 bp, Artificial Sequence
  Synthetic
agtagguccccaccaaugct

SEQ ID NO: 57260 - DNA, 27 bp, Artificial Sequence
  Synthetic
ccctgttacccauattgatttcctcug

SEQ ID NO: 57261 - DNA, 28 bp, Artificial Sequence
  Synthetic
cctctctcccccauaaaaatgatcctua

SEQ ID NO: 57262 - DNA, 24 bp, Artificial Sequence
  Synthetic
gccacagaacuattctccccagua

SEQ ID NO: 57263 - DNA, 28 bp, Artificial Sequence
  Synthetic
agcaaccautcaagatttuacaaaccag

SEQ ID NO: 57264 - DNA, 26 bp, Artificial Sequence
  Synthetic
acctcattgtuacctaaaactggcut

SEQ ID NO: 57265 - DNA, 28 bp, Artificial Sequence
  Synthetic
gttgtaattgtgugatgttagcagcuat

SEQ ID NO: 57266 - DNA, 22 bp, Artificial Sequence
  Synthetic
caggtccucccttttctucaca

SEQ ID NO: 57267 - DNA, 26 bp, Artificial Sequence
  Synthetic
gacagtcagataugccgtgacattua

SEQ ID NO: 57268 - DNA, 23 bp, Artificial Sequence
  Synthetic
tgcatggaugaaatggcattugg

SEQ ID NO: 57269 - DNA, 27 bp, Artificial Sequence
  Synthetic
acgatcacccugtgaacaaattcauag

SEQ ID NO: 57270 - DNA, 28 bp, Artificial Sequence
  Synthetic
ctcatttcctatcugaagtgtctgtuga

SEQ ID NO: 57271 - DNA, 21 bp, Artificial Sequence
  Synthetic
cctcgaugtcctttgaugcca

SEQ ID NO: 57272 - DNA, 23 bp, Artificial Sequence
  Synthetic
aacaggcacuaatcctggttcuc

SEQ ID NO: 57273 - DNA, 28 bp, Artificial Sequence
  Synthetic
gtttacatggcauattctagggugacat

SEQ ID NO: 57274 - DNA, 22 bp, Artificial Sequence
  Synthetic
gctcaaagcugtgctuaaggag

SEQ ID NO: 57275 - DNA, 25 bp, Artificial Sequence
  Synthetic
ctctcccatcucatccttgtcacua

SEQ ID NO: 57276 - DNA, 20 bp, Artificial Sequence
  Synthetic
autgaccuggagcgcagaat

SEQ ID NO: 57277 - DNA, 22 bp, Artificial Sequence
  Synthetic
gatctcctguagggcatgacug

SEQ ID NO: 57278 - DNA, 21 bp, Artificial Sequence
  Synthetic
tgaggctccautctctggcua

SEQ ID NO: 57279 - DNA, 21 bp, Artificial Sequence
  Synthetic
tggtgucctgggauggaagaa

SEQ ID NO: 57280 - DNA, 22 bp, Artificial Sequence
  Synthetic
ggctgaaguggaatgcugaaga

SEQ ID NO: 57281 - DNA, 24 bp, Artificial Sequence
  Synthetic
ggacaagaaccauagtgagctcug

SEQ ID NO: 57282 - DNA, 22 bp, Artificial Sequence
  Synthetic
gcttctgugagttgaggctucc

SEQ ID NO: 57283 - DNA, 22 bp, Artificial Sequence
  Synthetic
acagacgguagcaccagtacut

SEQ ID NO: 57284 - DNA, 18 bp, Artificial Sequence
  Synthetic
gggcucggtctaugacga

SEQ ID NO: 57285 - DNA, 17 bp, Artificial Sequence
  Synthetic
cgggcccgacugucaag

SEQ ID NO: 57286 - DNA, 24 bp, Artificial Sequence
  Synthetic
gtgtcatcuggcctcaaatctuct

SEQ ID NO: 57287 - DNA, 22 bp, Artificial Sequence
  Synthetic
tcgtgcaggaagugaactucat

SEQ ID NO: 57288 - DNA, 21 bp, Artificial Sequence
  Synthetic
tgggcuttcagaugcagacac

SEQ ID NO: 57289 - DNA, 28 bp, Artificial Sequence
  Synthetic
gctcaagcgagguacagaattaaaugat

SEQ ID NO: 57290 - DNA, 19 bp, Artificial Sequence
  Synthetic
cacagtcuccacggccaua

SEQ ID NO: 57291 - DNA, 21 bp, Artificial Sequence
  Synthetic
cctcugagagctctgucacga

SEQ ID NO: 57292 - DNA, 22 bp, Artificial Sequence
  Synthetic
gcatcuccagcacgaagacaua

SEQ ID NO: 57293 - DNA, 22 bp, Artificial Sequence
  Synthetic
gcttcatguccaccttgtcugg

SEQ ID NO: 57294 - DNA, 23 bp, Artificial Sequence
  Synthetic
gacaaaggcaugcattaccucac

SEQ ID NO: 57295 - DNA, 21 bp, Artificial Sequence
  Synthetic
ggtgtgtggacucagctcaua

SEQ ID NO: 57296 - DNA, 23 bp, Artificial Sequence
  Synthetic
ggcgaugacaaagaagagtcugt

SEQ ID NO: 57297 - DNA, 20 bp, Artificial Sequence
  Synthetic
acauacgggcaugccaagat

SEQ ID NO: 57298 - DNA, 21 bp, Artificial Sequence
  Synthetic
gctgttccaacucggtaguca

SEQ ID NO: 57299 - DNA, 28 bp, Artificial Sequence
  Synthetic
aatgtaacatgugtgctaattctugcag

SEQ ID NO: 57300 - DNA, 18 bp, Artificial Sequence
  Synthetic
ggcccucagugggaacaa

SEQ ID NO: 57301 - DNA, 17 bp, Artificial Sequence
  Synthetic
ggcacguacaccugcga

SEQ ID NO: 57302 - DNA, 21 bp, Artificial Sequence
  Synthetic
caggaaaggugcttcuaccca

SEQ ID NO: 57303 - DNA, 19 bp, Artificial Sequence
  Synthetic
cctgagccutcctgtgcut

SEQ ID NO: 57304 - DNA, 21 bp, Artificial Sequence
  Synthetic
catcugcagaaggugaagcac

SEQ ID NO: 57305 - DNA, 24 bp, Artificial Sequence
  Synthetic
gaaggcagcautgaggtttaugaa

SEQ ID NO: 57306 - DNA, 26 bp, Artificial Sequence
  Synthetic
tttactgcaccugcttaaaaccttug

SEQ ID NO: 57307 - DNA, 28 bp, Artificial Sequence
  Synthetic
tcaagaaggcacauagtaaaaacaguga

SEQ ID NO: 57308 - DNA, 20 bp, Artificial Sequence
  Synthetic
gccucacatgtcugggagat

SEQ ID NO: 57309 - DNA, 22 bp, Artificial Sequence
  Synthetic
ggttctucaggtgcuagaccag

SEQ ID NO: 57310 - DNA, 20 bp, Artificial Sequence
  Synthetic
accacugccagcagaggaua

SEQ ID NO: 57311 - DNA, 18 bp, Artificial Sequence
  Synthetic
ctgggaggccgugctuag

SEQ ID NO: 57312 - DNA, 22 bp, Artificial Sequence
  Synthetic
cagcagctuccctaagaauggt

SEQ ID NO: 57313 - DNA, 28 bp, Artificial Sequence
  Synthetic
agatgttgtgtuaaggcttaaagauccc

SEQ ID NO: 57314 - DNA, 25 bp, Artificial Sequence
  Synthetic
acatatatcaggucatggcctccut

SEQ ID NO: 57315 - DNA, 29 bp, Artificial Sequence
  Synthetic
ccacagaaauttacctacatuggaagagt

SEQ ID NO: 57316 - DNA, 26 bp, Artificial Sequence
  Synthetic
gtaatagctaucacccttctuggcaa

SEQ ID NO: 57317 - DNA, 18 bp, Artificial Sequence
  Synthetic
cagctuccacccguggat

SEQ ID NO: 57318 - DNA, 22 bp, Artificial Sequence
  Synthetic
agggugagagaagaccttgugt

SEQ ID NO: 57319 - DNA, 22 bp, Artificial Sequence
  Synthetic
cattggagcucatcatgccgua

SEQ ID NO: 57320 - DNA, 25 bp, Artificial Sequence
  Synthetic
gctgtaaatcuccagcctuaccaaa

SEQ ID NO: 57321 - DNA, 19 bp, Artificial Sequence
  Synthetic
tgggaagcugcatcaucgg

SEQ ID NO: 57322 - DNA, 23 bp, Artificial Sequence
  Synthetic
ccttccatuttaccaggauggct

SEQ ID NO: 57323 - DNA, 21 bp, Artificial Sequence
  Synthetic
cggcagattuggtgtcgtcut

SEQ ID NO: 57324 - DNA, 29 bp, Artificial Sequence
  Synthetic
aaaatgtagcaaautactctgacctucct

SEQ ID NO: 57325 - DNA, 27 bp, Artificial Sequence
  Synthetic
gtagccagcttucaaacaaactcaaut

SEQ ID NO: 57326 - DNA, 24 bp, Artificial Sequence
  Synthetic
gatgtgtctgauaaggcaggtuct

SEQ ID NO: 57327 - DNA, 29 bp, Artificial Sequence
  Synthetic
acaataacccatucctcttcaactaaucc

SEQ ID NO: 57328 - DNA, 25 bp, Artificial Sequence
  Synthetic
cagagaggatugaggaaaccatguc

SEQ ID NO: 57329 - DNA, 25 bp, Artificial Sequence
  Synthetic
ggttagtaucggccccttttcttut

SEQ ID NO: 57330 - DNA, 25 bp, Artificial Sequence
  Synthetic
aacccauttctgttucaggaaggaa

SEQ ID NO: 57331 - DNA, 21 bp, Artificial Sequence
  Synthetic
ccaguagccccttcttucaca

SEQ ID NO: 57332 - DNA, 26 bp, Artificial Sequence
  Synthetic
gcagtcttacauaatgcaaggcaaut

SEQ ID NO: 57333 - DNA, 22 bp, Artificial Sequence
  Synthetic
gautgacauccagaggaaccga

SEQ ID NO: 57334 - DNA, 28 bp, Artificial Sequence
  Synthetic
cccactcatugattattggcatatucac

SEQ ID NO: 57335 - DNA, 28 bp, Artificial Sequence
  Synthetic
gggatatttucacagatgtttcagtuga

SEQ ID NO: 57336 - DNA, 27 bp, Artificial Sequence
  Synthetic
accttttcguggaacttgacagattua

SEQ ID NO: 57337 - DNA, 26 bp, Artificial Sequence
  Synthetic
ccagctttgtguggttataaaggtut

SEQ ID NO: 57338 - DNA, 22 bp, Artificial Sequence
  Synthetic
gcccauggaaggcaatgctaua

SEQ ID NO: 57339 - DNA, 25 bp, Artificial Sequence
  Synthetic
gaaauaagggaggagcaaatcucca

SEQ ID NO: 57340 - DNA, 26 bp, Artificial Sequence
  Synthetic
ttcagataaaacutccacauccagca

SEQ ID NO: 57341 - DNA, 27 bp, Artificial Sequence
  Synthetic
tgtgctcucaaaagctagauaaaccat

SEQ ID NO: 57342 - DNA, 24 bp, Artificial Sequence
  Synthetic
caacagaugttaggaacucagcct

SEQ ID NO: 57343 - DNA, 21 bp, Artificial Sequence
  Synthetic
attgtcccucactuggccaaa

SEQ ID NO: 57344 - DNA, 26 bp, Artificial Sequence
  Synthetic
tttctcaaugccagagagtugaaaga

SEQ ID NO: 57345 - DNA, 27 bp, Artificial Sequence
  Synthetic
agcttgtuaaagaagacacctggatut

SEQ ID NO: 57346 - DNA, 28 bp, Artificial Sequence
  Synthetic
ctggtatcagtgucaggaaaagaguaat

SEQ ID NO: 57347 - DNA, 32 bp, Artificial Sequence
  Synthetic
aaatttaaaacagucaacactaccttaaugcc

SEQ ID NO: 57348 - DNA, 22 bp, Artificial Sequence
  Synthetic
actggttugagcaactgctuca

SEQ ID NO: 57349 - DNA, 29 bp, Artificial Sequence
  Synthetic
ccacaaccaggcaacugaattaattauag

SEQ ID NO: 57350 - DNA, 27 bp, Artificial Sequence
  Synthetic
cttttaggtagugcaacattgtgugag

SEQ ID NO: 57351 - DNA, 28 bp, Artificial Sequence
  Synthetic
cctgcaggaccuagcagaataatttuaa

SEQ ID NO: 57352 - DNA, 27 bp, Artificial Sequence
  Synthetic
tttaatgtgttttccuccccttaggut

SEQ ID NO: 57353 - DNA, 27 bp, Artificial Sequence
  Synthetic
atgctctatcccuctcaaatagcuaca

SEQ ID NO: 57354 - DNA, 27 bp, Artificial Sequence
  Synthetic
tggatttcuccaaatacgttgttucca

SEQ ID NO: 57355 - DNA, 28 bp, Artificial Sequence
  Synthetic
actatactcctttucacctcttctguga

SEQ ID NO: 57356 - DNA, 22 bp, Artificial Sequence
  Synthetic
tgtcatcgcuatttgctgucca

SEQ ID NO: 57357 - DNA, 28 bp, Artificial Sequence
  Synthetic
gcttattagcacucgttagagcaattut

SEQ ID NO: 57358 - DNA, 27 bp, Artificial Sequence
  Synthetic
gggattaattguggctttctcttuacc

SEQ ID NO: 57359 - DNA, 24 bp, Artificial Sequence
  Synthetic
agcttattccaagcugagttgcut

SEQ ID NO: 57360 - DNA, 26 bp, Artificial Sequence
  Synthetic
cataccagatgugtctgtcactctug

SEQ ID NO: 57361 - DNA, 23 bp, Artificial Sequence
  Synthetic
cgtagtatttgcugagggctcug

SEQ ID NO: 57362 - DNA, 17 bp, Artificial Sequence
  Synthetic
gccugcaacccccucag

SEQ ID NO: 57363 - DNA, 23 bp, Artificial Sequence
  Synthetic
ttgtagacagagucccagtguga

SEQ ID NO: 57364 - DNA, 18 bp, Artificial Sequence
  Synthetic
gggtcucttggcucccaa

SEQ ID NO: 57365 - DNA, 18 bp, Artificial Sequence
  Synthetic
cugggagaagcggucact

SEQ ID NO: 57366 - DNA, 20 bp, Artificial Sequence
  Synthetic
gtaggccuctggctugaagg

SEQ ID NO: 57367 - DNA, 17 bp, Artificial Sequence
  Synthetic
ccuggcgctgugagact

SEQ ID NO: 57368 - DNA, 22 bp, Artificial Sequence
  Synthetic
tgtctagttcagugggcatgut

SEQ ID NO: 57369 - DNA, 22 bp, Artificial Sequence
  Synthetic
aaggatcuccaaaagccuccac

SEQ ID NO: 57370 - DNA, 26 bp, Artificial Sequence
  Synthetic
gaatgccguaagatggactttaaugt

SEQ ID NO: 57371 - DNA, 28 bp, Artificial Sequence
  Synthetic
cccacatcatguctcatcttatcaaugt

SEQ ID NO: 57372 - DNA, 20 bp, Artificial Sequence
  Synthetic
cagacgcaguggagtuggat

SEQ ID NO: 57373 - DNA, 28 bp, Artificial Sequence
  Synthetic
tctgcactcaaaaucaatgaagaggaut

SEQ ID NO: 57374 - DNA, 26 bp, Artificial Sequence
  Synthetic
tctaagaagautgtacagcugaagcc

SEQ ID NO: 57375 - DNA, 28 bp, Artificial Sequence
  Synthetic
acattgactguggtgattattgaacuct

SEQ ID NO: 57376 - DNA, 20 bp, Artificial Sequence
  Synthetic
cgcccaauttggtgactugt

SEQ ID NO: 57377 - DNA, 23 bp, Artificial Sequence
  Synthetic
gaagtctgagaguggatctgcug

SEQ ID NO: 57378 - DNA, 25 bp, Artificial Sequence
  Synthetic
ggucatagtugacccagaaaccaat

SEQ ID NO: 57379 - DNA, 28 bp, Artificial Sequence
  Synthetic
cttgaatatcatacugactgcctgtcut

SEQ ID NO: 57380 - DNA, 23 bp, Artificial Sequence
  Synthetic
gaccugccccaaaaccaaatuaa

SEQ ID NO: 57381 - DNA, 22 bp, Artificial Sequence
  Synthetic
agccgaagacaugttguaaggg

SEQ ID NO: 57382 - DNA, 20 bp, Artificial Sequence
  Synthetic
gaccggccutcaaugcaaat

SEQ ID NO: 57383 - DNA, 23 bp, Artificial Sequence
  Synthetic
ctctgagaauggcgaacugaagt

SEQ ID NO: 57384 - DNA, 24 bp, Artificial Sequence
  Synthetic
gtccccautcttaaacuggaccaa

SEQ ID NO: 57385 - DNA, 25 bp, Artificial Sequence
  Synthetic
tcctugcagcaagagaaaagatuct

SEQ ID NO: 57386 - DNA, 21 bp, Artificial Sequence
  Synthetic
ggutttgggcugaagggaagt

SEQ ID NO: 57387 - DNA, 24 bp, Artificial Sequence
  Synthetic
gacccugaccacaagtacagatuc

SEQ ID NO: 57388 - DNA, 19 bp, Artificial Sequence
  Synthetic
ccttccacugtgtgcucgt

SEQ ID NO: 57389 - DNA, 22 bp, Artificial Sequence
  Synthetic
tgaatgaugccagcccagtaug

SEQ ID NO: 57390 - DNA, 22 bp, Artificial Sequence
  Synthetic
tccatccttuccaccttccuca

SEQ ID NO: 57391 - DNA, 21 bp, Artificial Sequence
  Synthetic
cggagacuagcccctatguca

SEQ ID NO: 57392 - DNA, 22 bp, Artificial Sequence
  Synthetic
gtgagccaaagauctccuccag

SEQ ID NO: 57393 - DNA, 22 bp, Artificial Sequence
  Synthetic
cctcacaccaaccutgtctcut

SEQ ID NO: 57394 - DNA, 21 bp, Artificial Sequence
  Synthetic
ccgggaguaagggcttctcut

SEQ ID NO: 57395 - DNA, 26 bp, Artificial Sequence
  Synthetic
ttcctcatctguggtgtatctgttuc

SEQ ID NO: 57396 - DNA, 24 bp, Artificial Sequence
  Synthetic
ccctcaaatcuccaactacctgut

SEQ ID NO: 57397 - DNA, 22 bp, Artificial Sequence
  Synthetic
cctgagagcaggaacuctcuct

SEQ ID NO: 57398 - DNA, 21 bp, Artificial Sequence
  Synthetic
gcctcgauccatgccctttut

SEQ ID NO: 57399 - DNA, 19 bp, Artificial Sequence
  Synthetic
tgtcucagcacugggacct

SEQ ID NO: 57400 - DNA, 26 bp, Artificial Sequence
  Synthetic
gggctatttgacuacagttgtttuct

SEQ ID NO: 57401 - DNA, 19 bp, Artificial Sequence
  Synthetic
gacggtcuacgccaggtuc

SEQ ID NO: 57402 - DNA, 25 bp, Artificial Sequence
  Synthetic
cagatgtcugacagtgtgctctuag

SEQ ID NO: 57403 - DNA, 31 bp, Artificial Sequence
  Synthetic
acgttactatttuaggttgtctttcttcugg

SEQ ID NO: 57404 - DNA, 22 bp, Artificial Sequence
  Synthetic
ggttccaguccacagcatctuc

SEQ ID NO: 57405 - DNA, 28 bp, Artificial Sequence
  Synthetic
tgggattcttuggctaaataacaucaca

SEQ ID NO: 57406 - DNA, 21 bp, Artificial Sequence
  Synthetic
caagtcucccagaggtcagug

SEQ ID NO: 57407 - DNA, 24 bp, Artificial Sequence
  Synthetic
ccatcttgggugggatgtttguag

SEQ ID NO: 57408 - DNA, 21 bp, Artificial Sequence
  Synthetic
gcauaaagaccacccccagut

SEQ ID NO: 57409 - DNA, 26 bp, Artificial Sequence
  Synthetic
gcaccatcattuagtcttgtctguct

SEQ ID NO: 57410 - DNA, 26 bp, Artificial Sequence
  Synthetic
tgaaatacugagggcacaattagugt

SEQ ID NO: 57411 - DNA, 28 bp, Artificial Sequence
  Synthetic
ccaaaaacacataucataatggcctcut

SEQ ID NO: 57412 - DNA, 28 bp, Artificial Sequence
  Synthetic
aatagtattgguggagtggattgucaaa

SEQ ID NO: 57413 - DNA, 26 bp, Artificial Sequence
  Synthetic
cagactgugaagatcacatcaaugga

SEQ ID NO: 57414 - DNA, 24 bp, Artificial Sequence
  Synthetic
gcttcaacuaattgtagcauggca

SEQ ID NO: 57415 - DNA, 26 bp, Artificial Sequence
  Synthetic
ccaggattatggugactgtgaagaua

SEQ ID NO: 57416 - DNA, 28 bp, Artificial Sequence
  Synthetic
tgttactcaccgauagcttttguaaagg

SEQ ID NO: 57417 - DNA, 28 bp, Artificial Sequence
  Synthetic
cagagatatcaaaauggccaggaguaat

SEQ ID NO: 57418 - DNA, 28 bp, Artificial Sequence
  Synthetic
acagaagggtcaguttttctgagaaaut

SEQ ID NO: 57419 - DNA, 20 bp, Artificial Sequence
  Synthetic
cctgctccucctccacacua

SEQ ID NO: 57420 - DNA, 27 bp, Artificial Sequence
  Synthetic
tcatcataacccugtgctaatgttuga

SEQ ID NO: 57421 - DNA, 28 bp, Artificial Sequence
  Synthetic
ccgaccatgtugttcaagaaaaacuaaa

SEQ ID NO: 57422 - DNA, 28 bp, Artificial Sequence
  Synthetic
tggagtaaatgacutttctcaagtggut

SEQ ID NO: 57423 - DNA, 24 bp, Artificial Sequence
  Synthetic
ccttccccucctagctcttcttut

SEQ ID NO: 57424 - DNA, 30 bp, Artificial Sequence
  Synthetic
ttgccatgaacaaaucagaagtataucagt

SEQ ID NO: 57425 - DNA, 22 bp, Artificial Sequence
  Synthetic
gagccccacucatggttagaug

SEQ ID NO: 57426 - DNA, 27 bp, Artificial Sequence
  Synthetic
gcgtaaaaaccccutctgttaaatuct

SEQ ID NO: 57427 - DNA, 21 bp, Artificial Sequence
  Synthetic
caagagauagcctgcaugcca

SEQ ID NO: 57428 - DNA, 26 bp, Artificial Sequence
  Synthetic
gttaactuagacacccaaggtgguaa

SEQ ID NO: 57429 - DNA, 25 bp, Artificial Sequence
  Synthetic
gaaggtacautttcaggagucagca

SEQ ID NO: 57430 - DNA, 22 bp, Artificial Sequence
  Synthetic
gctgagagutagagcucggaag

SEQ ID NO: 57431 - DNA, 25 bp, Artificial Sequence
  Synthetic
cctactgaggautttcagagtgugt

SEQ ID NO: 57432 - DNA, 25 bp, Artificial Sequence
  Synthetic
agcaaaattactutcccctgacucc

SEQ ID NO: 57433 - DNA, 22 bp, Artificial Sequence
  Synthetic
gtttgtccuagcctcagucact

SEQ ID NO: 57434 - DNA, 20 bp, Artificial Sequence
  Synthetic
ggctccugatgacccucaag

SEQ ID NO: 57435 - DNA, 25 bp, Artificial Sequence
  Synthetic
agaacacucaauaccccaacaaagg

SEQ ID NO: 57436 - DNA, 23 bp, Artificial Sequence
  Synthetic
ggguaagagagtatcugcccaag

SEQ ID NO: 57437 - DNA, 17 bp, Artificial Sequence
  Synthetic
cctcccccuggctgcua

SEQ ID NO: 57438 - DNA, 28 bp, Artificial Sequence
  Synthetic
gtcttggttaaugatcagctcttcucaa

SEQ ID NO: 57439 - DNA, 25 bp, Artificial Sequence
  Synthetic
ctcattgactcaugaaactcaccug

SEQ ID NO: 57440 - DNA, 22 bp, Artificial Sequence
  Synthetic
acauggcacagauggaggaaat

SEQ ID NO: 57441 - DNA, 28 bp, Artificial Sequence
  Synthetic
gtctctguagagcacacttttcttcuaa

SEQ ID NO: 57442 - DNA, 26 bp, Artificial Sequence
  Synthetic
cacataagucccttagtacaguggaa

SEQ ID NO: 57443 - DNA, 22 bp, Artificial Sequence
  Synthetic
agctgtgttcucagcctctcua

SEQ ID NO: 57444 - DNA, 28 bp, Artificial Sequence
  Synthetic
gcagtgtactutttagtggacauaagca

SEQ ID NO: 57445 - DNA, 25 bp, Artificial Sequence
  Synthetic
ggcagatgacuggcttttacuagat

SEQ ID NO: 57446 - DNA, 29 bp, Artificial Sequence
  Synthetic
agagtgttaccauactcatacctcguaaa

SEQ ID NO: 57447 - DNA, 25 bp, Artificial Sequence
  Synthetic
tgccacaaugacaggaactattuct

SEQ ID NO: 57448 - DNA, 28 bp, Artificial Sequence
  Synthetic
tggttttcttuaccagtatctcccaauc

SEQ ID NO: 57449 - DNA, 23 bp, Artificial Sequence
  Synthetic
acacccccauccaaaacauacac

SEQ ID NO: 57450 - DNA, 22 bp, Artificial Sequence
  Synthetic
acctcctguaagtagccacugt

SEQ ID NO: 57451 - DNA, 24 bp, Artificial Sequence
  Synthetic
agcacatttuagctacgcagguat

SEQ ID NO: 57452 - DNA, 25 bp, Artificial Sequence
  Synthetic
aacaagcaggautcaacatugcaaa

SEQ ID NO: 57453 - DNA, 28 bp, Artificial Sequence
  Synthetic
tgtggttcttagaugaatgctatgugaa

SEQ ID NO: 57454 - DNA, 28 bp, Artificial Sequence
  Synthetic
gtttautctcacaatctucaagccaacc

SEQ ID NO: 57455 - DNA, 28 bp, Artificial Sequence
  Synthetic
gttaatggagucagaatactgucaagca

SEQ ID NO: 57456 - DNA, 25 bp, Artificial Sequence
  Synthetic
ttcaattttcucaatccggagucca

SEQ ID NO: 57457 - DNA, 28 bp, Artificial Sequence
  Synthetic
cctctatttcagagaugaactgtctuct

SEQ ID NO: 57458 - DNA, 21 bp, Artificial Sequence
  Synthetic
agcaccutctcucagacccaa

SEQ ID NO: 57459 - DNA, 21 bp, Artificial Sequence
  Synthetic
gggtcaguctggtcuggacat

SEQ ID NO: 57460 - DNA, 23 bp, Artificial Sequence
  Synthetic
gtggtctguccaaaaacttgcut

SEQ ID NO: 57461 - DNA, 28 bp, Artificial Sequence
  Synthetic
tgagggttctttuatttctgccatagut

SEQ ID NO: 57462 - DNA, 28 bp, Artificial Sequence
  Synthetic
tccaaatctgtauggagaccaaaucaag

SEQ ID NO: 57463 - DNA, 28 bp, Artificial Sequence
  Synthetic
tcagatagatugtcagcagaaucaacag

SEQ ID NO: 57464 - DNA, 33 bp, Artificial Sequence
  Synthetic
tgtagcacaatgagaguataaagtagatguaat

SEQ ID NO: 57465 - DNA, 23 bp, Artificial Sequence
  Synthetic
cctcccagaaggcugttacatuc

SEQ ID NO: 57466 - DNA, 28 bp, Artificial Sequence
  Synthetic
tgactacatggaacacauaccttcgaua

SEQ ID NO: 57467 - DNA, 33 bp, Artificial Sequence
  Synthetic
tgtatacatccccaaacuatcttaatttaacut

SEQ ID NO: 57468 - DNA, 28 bp, Artificial Sequence
  Synthetic
aatggccaactcucgaaagttatgatua

SEQ ID NO: 57469 - DNA, 27 bp, Artificial Sequence
  Synthetic
gtcuaacaaagcaagcagtgtucaaat

SEQ ID NO: 57470 - DNA, 21 bp, Artificial Sequence
  Synthetic
ggttgggcucagatctgugat

SEQ ID NO: 57471 - DNA, 28 bp, Artificial Sequence
  Synthetic
ttcccactgugctattaaguaacagaac

SEQ ID NO: 57472 - DNA, 26 bp, Artificial Sequence
  Synthetic
caaaaggacacagcagutaaatguga

SEQ ID NO: 57473 - DNA, 22 bp, Artificial Sequence
  Synthetic
tcgttcagcaguttctggaugg

SEQ ID NO: 57474 - DNA, 25 bp, Artificial Sequence
  Synthetic
cttaggcctcucattctgccttaut

SEQ ID NO: 57475 - DNA, 19 bp, Artificial Sequence
  Synthetic
caggcaagccgautgaugg

SEQ ID NO: 57476 - DNA, 21 bp, Artificial Sequence
  Synthetic
gagaacccacccuttctgcut

SEQ ID NO: 57477 - DNA, 21 bp, Artificial Sequence
  Synthetic
agggtgtugctagtgucagga

SEQ ID NO: 57478 - DNA, 20 bp, Artificial Sequence
  Synthetic
tccaagcucctccaagguga

SEQ ID NO: 57479 - DNA, 23 bp, Artificial Sequence
  Synthetic
gctaccgcaccautagcaagaut

SEQ ID NO: 57480 - DNA, 20 bp, Artificial Sequence
  Synthetic
ctgagccugcccuaaagcaa

SEQ ID NO: 57481 - DNA, 19 bp, Artificial Sequence
  Synthetic
gggctatgucctcccacuc

SEQ ID NO: 57482 - DNA, 27 bp, Artificial Sequence
  Synthetic
ctggcattgcuggttttaaattacugt

SEQ ID NO: 57483 - DNA, 28 bp, Artificial Sequence
  Synthetic
ttttagcaguagaagactcagaaagugg

SEQ ID NO: 57484 - DNA, 23 bp, Artificial Sequence
  Synthetic
cagcaggtgugtgtctttcaaug

SEQ ID NO: 57485 - DNA, 26 bp, Artificial Sequence
  Synthetic
ctgagggctccugatgtactcataua

SEQ ID NO: 57486 - DNA, 24 bp, Artificial Sequence
  Synthetic
gataatgctguccaggatgtuggt

SEQ ID NO: 57487 - DNA, 18 bp, Artificial Sequence
  Synthetic
ggcttcuaccgcggucaa

SEQ ID NO: 57488 - DNA, 21 bp, Artificial Sequence
  Synthetic
ggtgctccuaaggacauggaa

SEQ ID NO: 57489 - DNA, 26 bp, Artificial Sequence
  Synthetic
ggatacuggaaatagccucaaacact

SEQ ID NO: 57490 - DNA, 27 bp, Artificial Sequence
  Synthetic
cacactgagcauttactacctgaaugt

SEQ ID NO: 57491 - DNA, 23 bp, Artificial Sequence
  Synthetic
gccaautgtcaugagaggcagaa

SEQ ID NO: 57492 - DNA, 21 bp, Artificial Sequence
  Synthetic
ccagugccggatatgacucag

SEQ ID NO: 57493 - DNA, 28 bp, Artificial Sequence
  Synthetic
ccagtgagttccuatttagttcttggut

SEQ ID NO: 57494 - DNA, 25 bp, Artificial Sequence
  Synthetic
tctgtttctugctttgcttucaagg

SEQ ID NO: 57495 - DNA, 22 bp, Artificial Sequence
  Synthetic
ccctaccacgugaacaaugact

SEQ ID NO: 57496 - DNA, 23 bp, Artificial Sequence
  Synthetic
ccacccccaaauaactaccaugt

SEQ ID NO: 57497 - DNA, 22 bp, Artificial Sequence
  Synthetic
gcctggcaaaggcuctaaatug

SEQ ID NO: 57498 - DNA, 27 bp, Artificial Sequence
  Synthetic
gttttatcautgagctgtuaggaggga

SEQ ID NO: 57499 - DNA, 20 bp, Artificial Sequence
  Synthetic
cagugagaaggcggucaaac

SEQ ID NO: 57500 - DNA, 27 bp, Artificial Sequence
  Synthetic
gagttgtgtaugacttaccgattcugt

SEQ ID NO: 57501 - DNA, 29 bp, Artificial Sequence
  Synthetic
tcattaccatguatgccatttguagacaa

SEQ ID NO: 57502 - DNA, 27 bp, Artificial Sequence
  Synthetic
cgtctaaauccagttttgcaaatuggt

SEQ ID NO: 57503 - DNA, 28 bp, Artificial Sequence
  Synthetic
gctgtatgggutaggaattgtattucca

SEQ ID NO: 57504 - DNA, 26 bp, Artificial Sequence
  Synthetic
cctgtcccaucattgtctccttauac

SEQ ID NO: 57505 - DNA, 22 bp, Artificial Sequence
  Synthetic
tgataauggccccctgugaaac

SEQ ID NO: 57506 - DNA, 28 bp, Artificial Sequence
  Synthetic
gttgtacattuccttaactgacucaaca

SEQ ID NO: 57507 - DNA, 22 bp, Artificial Sequence
  Synthetic
gtccgagaaagcutggugagaa

SEQ ID NO: 57508 - DNA, 25 bp, Artificial Sequence
  Synthetic
gtgtggcaataucacattccttguc

SEQ ID NO: 57509 - DNA, 23 bp, Artificial Sequence
  Synthetic
tggagataaugcttcacgtuccc

SEQ ID NO: 57510 - DNA, 23 bp, Artificial Sequence
  Synthetic
atgtctgcugatactcugaggga

SEQ ID NO: 57511 - DNA, 26 bp, Artificial Sequence
  Synthetic
tcactccaaggagaugggtatagaug

SEQ ID NO: 57512 - DNA, 24 bp, Artificial Sequence
  Synthetic
tcagtgtucagctgtcttuggaat

SEQ ID NO: 57513 - DNA, 21 bp, Artificial Sequence
  Synthetic
ctgautgttcctguggaagcc

SEQ ID NO: 57514 - DNA, 19 bp, Artificial Sequence
  Synthetic
gggcutctauccccgaacc

SEQ ID NO: 57515 - DNA, 17 bp, Artificial Sequence
  Synthetic
gcagcccugctcucaga

SEQ ID NO: 57516 - DNA, 20 bp, Artificial Sequence
  Synthetic
ctgaagccgcaugaggauga

SEQ ID NO: 57517 - DNA, 20 bp, Artificial Sequence
  Synthetic
caccatgaucggcacgtcua

SEQ ID NO: 57518 - DNA, 28 bp, Artificial Sequence
  Synthetic
ccaactgccutattatgatcttguacct

SEQ ID NO: 57519 - DNA, 28 bp, Artificial Sequence
  Synthetic
gcagaagcaguttagaaaattgccuaat

SEQ ID NO: 57520 - DNA, 25 bp, Artificial Sequence
  Synthetic
cctgtcugaaggaagaatgtuagca

SEQ ID NO: 57521 - DNA, 25 bp, Artificial Sequence
  Synthetic
tcaaacttcatguccacgtctctut

SEQ ID NO: 57522 - DNA, 22 bp, Artificial Sequence
  Synthetic
agtgtaaaggcucagggtucac

SEQ ID NO: 57523 - DNA, 24 bp, Artificial Sequence
  Synthetic
ataccgacugccatttcttttgut

SEQ ID NO: 57524 - DNA, 22 bp, Artificial Sequence
  Synthetic
tctcaaagugaggctugcaagt

SEQ ID NO: 57525 - DNA, 27 bp, Artificial Sequence
  Synthetic
cagtgttcatataugttctgccctugt

SEQ ID NO: 57526 - DNA, 20 bp, Artificial Sequence
  Synthetic
ctccgtggcuaactctgcuc

SEQ ID NO: 57527 - DNA, 19 bp, Artificial Sequence
  Synthetic
agaagggugcggcactuac

SEQ ID NO: 57528 - DNA, 22 bp, Artificial Sequence
  Synthetic
ctcugaccacacttcucagcaa

SEQ ID NO: 57529 - DNA, 22 bp, Artificial Sequence
  Synthetic
ggagagtauggagggaugaggt

SEQ ID NO: 57530 - DNA, 21 bp, Artificial Sequence
  Synthetic
gcaataccgugctggccatua

SEQ ID NO: 57531 - DNA, 25 bp, Artificial Sequence
  Synthetic
cagaagttaucggcagaacatccut

SEQ ID NO: 57532 - DNA, 22 bp, Artificial Sequence
  Synthetic
acauctctttaugggcccagca

SEQ ID NO: 57533 - DNA, 23 bp, Artificial Sequence
  Synthetic
ccttggttaggaucgacccagua

SEQ ID NO: 57534 - DNA, 22 bp, Artificial Sequence
  Synthetic
ttctgctucccaagcugaagaa

SEQ ID NO: 57535 - DNA, 23 bp, Artificial Sequence
  Synthetic
tccacgtggucatgggaataauc

SEQ ID NO: 57536 - DNA, 21 bp, Artificial Sequence
  Synthetic
gccccatuttgcctgaucaag

SEQ ID NO: 57537 - DNA, 19 bp, Artificial Sequence
  Synthetic
ccagcgtgucctgggtaug

SEQ ID NO: 57538 - DNA, 25 bp, Artificial Sequence
  Synthetic
ccatccttttcugcatctctagcut

SEQ ID NO: 57539 - DNA, 22 bp, Artificial Sequence
  Synthetic
ggtttgggaggugaaaccuagt

SEQ ID NO: 57540 - DNA, 26 bp, Artificial Sequence
  Synthetic
ctagtatcguagctacttcccttucc

SEQ ID NO: 57541 - DNA, 28 bp, Artificial Sequence
  Synthetic
gcctacagacucataataccaccaatua

SEQ ID NO: 57542 - DNA, 19 bp, Artificial Sequence
  Synthetic
cccugcccccaccttttuc

SEQ ID NO: 57543 - DNA, 19 bp, Artificial Sequence
  Synthetic
ggtguggaggaccagggua

SEQ ID NO: 57544 - DNA, 21 bp, Artificial Sequence
  Synthetic
tgaaccugcccatgaacauca

SEQ ID NO: 57545 - DNA, 23 bp, Artificial Sequence
  Synthetic
ggtccuctttttcacuggaaacc

SEQ ID NO: 57546 - DNA, 21 bp, Artificial Sequence
  Synthetic
cccatccugctccttacctut

SEQ ID NO: 57547 - DNA, 22 bp, Artificial Sequence
  Synthetic
ctccatugggaccttcatccug

SEQ ID NO: 57548 - DNA, 27 bp, Artificial Sequence
  Synthetic
tcttgtaggtuggaaaagagactgtuc

SEQ ID NO: 57549 - DNA, 31 bp, Artificial Sequence
  Synthetic
aaatcagctacuttttcttccuaacaagagt

SEQ ID NO: 57550 - DNA, 25 bp, Artificial Sequence
  Synthetic
atcgtctggcuaatgttatgauggg

SEQ ID NO: 57551 - DNA, 26 bp, Artificial Sequence
  Synthetic
ccctcguctttcaataauaggaagca

SEQ ID NO: 57552 - DNA, 24 bp, Artificial Sequence
  Synthetic
aacttcctcaccuggtctcattuc

SEQ ID NO: 57553 - DNA, 19 bp, Artificial Sequence
  Synthetic
ctgaucccacggcctcauc

SEQ ID NO: 57554 - DNA, 19 bp, Artificial Sequence
  Synthetic
ggcccggcutcatcgtaut

SEQ ID NO: 57555 - DNA, 27 bp, Artificial Sequence
  Synthetic
actaacgacugcactaatgatgacaut

SEQ ID NO: 57556 - DNA, 21 bp, Artificial Sequence
  Synthetic
cgatguccaggaaccgcuaat

SEQ ID NO: 57557 - DNA, 19 bp, Artificial Sequence
  Synthetic
gggucgcacgtgatauggg

SEQ ID NO: 57558 - DNA, 20 bp, Artificial Sequence
  Synthetic
ccagcactuggccctgatut

SEQ ID NO: 57559 - DNA, 20 bp, Artificial Sequence
  Synthetic
cutcacgtucacacgcagac

SEQ ID NO: 57560 - DNA, 25 bp, Artificial Sequence
  Synthetic
gtaagaaaugaagagagggcgtuga

SEQ ID NO: 57561 - DNA, 21 bp, Artificial Sequence
  Synthetic
ctcccttucctcaggucacag

SEQ ID NO: 57562 - DNA, 24 bp, Artificial Sequence
  Synthetic
ggagagtcagacutgaaagcagut

SEQ ID NO: 57563 - DNA, 23 bp, Artificial Sequence
  Synthetic
agtgtctcugactggcaattgug

SEQ ID NO: 57564 - DNA, 26 bp, Artificial Sequence
  Synthetic
cagguataagttactguggaaaggca

SEQ ID NO: 57565 - DNA, 28 bp, Artificial Sequence
  Synthetic
ccattgctttugaagaaacagttgtgua

SEQ ID NO: 57566 - DNA, 19 bp, Artificial Sequence
  Synthetic
caggcaggcucaccgauag

SEQ ID NO: 57567 - DNA, 21 bp, Artificial Sequence
  Synthetic
cauccuggagcgcaagaagaa

SEQ ID NO: 57568 - DNA, 22 bp, Artificial Sequence
  Synthetic
gggcagaaaaaccugtcctgut

SEQ ID NO: 57569 - DNA, 22 bp, Artificial Sequence
  Synthetic
gaaggaagaugagggcgtcuac

SEQ ID NO: 57570 - DNA, 23 bp, Artificial Sequence
  Synthetic
cutgacctcugcaagagaaggaa

SEQ ID NO: 57571 - DNA, 20 bp, Artificial Sequence
  Synthetic
tgcaggguccacaaacugac

SEQ ID NO: 57572 - DNA, 21 bp, Artificial Sequence
  Synthetic
aggagggcugaatgagguagt

SEQ ID NO: 57573 - DNA, 20 bp, Artificial Sequence
  Synthetic
ccuggagagctucgagaagg

SEQ ID NO: 57574 - DNA, 19 bp, Artificial Sequence
  Synthetic
tggcagaacacgcuctuga

SEQ ID NO: 57575 - DNA, 21 bp, Artificial Sequence
  Synthetic
ccacctgcugccctacttcua

SEQ ID NO: 57576 - DNA, 21 bp, Artificial Sequence
  Synthetic
cagtgggauccagttgucgaa

SEQ ID NO: 57577 - DNA, 24 bp, Artificial Sequence
  Synthetic
cgccttcatutctgaatcctucat

SEQ ID NO: 57578 - DNA, 20 bp, Artificial Sequence
  Synthetic
cccagggacgagauctacug

SEQ ID NO: 57579 - DNA, 20 bp, Artificial Sequence
  Synthetic
ctttggagccccuggctaut

SEQ ID NO: 57580 - DNA, 21 bp, Artificial Sequence
  Synthetic
gacaccugugacagggacaag

SEQ ID NO: 57581 - DNA, 22 bp, Artificial Sequence
  Synthetic
cttggtggucccatccaugaat

SEQ ID NO: 57582 - DNA, 22 bp, Artificial Sequence
  Synthetic
agtccagaaggcutcaggguat

SEQ ID NO: 57583 - DNA, 24 bp, Artificial Sequence
  Synthetic
ggcatcaccugaagtagtcauagg

SEQ ID NO: 57584 - DNA, 22 bp, Artificial Sequence
  Synthetic
gtctttgccccuccaatagcut

SEQ ID NO: 57585 - DNA, 29 bp, Artificial Sequence
  Synthetic
tgctattttctaagucaccctctaacuga

SEQ ID NO: 57586 - DNA, 23 bp, Artificial Sequence
  Synthetic
atcagcagcugttacctgttuga

SEQ ID NO: 57587 - DNA, 25 bp, Artificial Sequence
  Synthetic
ccacagcaaacagaacugtttuaga

SEQ ID NO: 57588 - DNA, 23 bp, Artificial Sequence
  Synthetic
gcacagtcatuttggagatccug

SEQ ID NO: 57589 - DNA, 24 bp, Artificial Sequence
  Synthetic
tctttttcccucaggctttctgut

SEQ ID NO: 57590 - DNA, 23 bp, Artificial Sequence
  Synthetic
ggccutagcaaaugcaaacagag

SEQ ID NO: 57591 - DNA, 28 bp, Artificial Sequence
  Synthetic
ccttgaaccgatuttagatggcatctua

SEQ ID NO: 57592 - DNA, 22 bp, Artificial Sequence
  Synthetic
ccatccaaggcaucttcctuct

SEQ ID NO: 57593 - DNA, 20 bp, Artificial Sequence
  Synthetic
gctgtgcccaguatcccauc

SEQ ID NO: 57594 - DNA, 20 bp, Artificial Sequence
  Synthetic
ccctaggcuccaccacugaa

SEQ ID NO: 57595 - DNA, 22 bp, Artificial Sequence
  Synthetic
caagccccutactugcaagact

SEQ ID NO: 57596 - DNA, 26 bp, Artificial Sequence
  Synthetic
acttcatcatccucttcatctgugga

SEQ ID NO: 57597 - DNA, 21 bp, Artificial Sequence
  Synthetic
tgaaccucacccaugccaaag

SEQ ID NO: 57598 - DNA, 20 bp, Artificial Sequence
  Synthetic
cgtgucagccaagaccuaga

SEQ ID NO: 57599 - DNA, 20 bp, Artificial Sequence
  Synthetic
ctcccagggacuctggagut

SEQ ID NO: 57600 - DNA, 22 bp, Artificial Sequence
  Synthetic
aggaugacgaaaaucggcaact

SEQ ID NO: 57601 - DNA, 20 bp, Artificial Sequence
  Synthetic
tgcuttggaaaugccccact

SEQ ID NO: 57602 - DNA, 23 bp, Artificial Sequence
  Synthetic
gagggucagttgaataugggcat

SEQ ID NO: 57603 - DNA, 24 bp, Artificial Sequence
  Synthetic
gggatucggaaagaggtatcugaa

SEQ ID NO: 57604 - DNA, 25 bp, Artificial Sequence
  Synthetic
gggatgggaauagagacattcauct

SEQ ID NO: 57605 - DNA, 21 bp, Artificial Sequence
  Synthetic
gutgaaaaggacucccaagcc

SEQ ID NO: 57606 - DNA, 24 bp, Artificial Sequence
  Synthetic
accaaagagguataccaacuccgt

SEQ ID NO: 57607 - DNA, 28 bp, Artificial Sequence
  Synthetic
tcacaagggatucagtggaatattgaut

SEQ ID NO: 57608 - DNA, 26 bp, Artificial Sequence
  Synthetic
ccccacacacuctgatactattuacc

SEQ ID NO: 57609 - DNA, 20 bp, Artificial Sequence
  Synthetic
gggaaucaaggcaccuccac

SEQ ID NO: 57610 - DNA, 24 bp, Artificial Sequence
  Synthetic
cacttacgaguctgaaacaaugcc

SEQ ID NO: 57611 - DNA, 28 bp, Artificial Sequence
  Synthetic
agccttcggttuatgtctttttgtttut

SEQ ID NO: 57612 - DNA, 31 bp, Artificial Sequence
  Synthetic
gtcagctuattatattcaattuaaacccacc

SEQ ID NO: 57613 - DNA, 22 bp, Artificial Sequence
  Synthetic
gcaaugagggaccagtacauga

SEQ ID NO: 57614 - DNA, 25 bp, Artificial Sequence
  Synthetic
ctctagcauaacaatgagcccauca

SEQ ID NO: 57615 - DNA, 23 bp, Artificial Sequence
  Synthetic
caacaaatuggaggtggcugaac

SEQ ID NO: 57616 - DNA, 25 bp, Artificial Sequence
  Synthetic
agagatatugatgcccuaagccaga

SEQ ID NO: 57617 - DNA, 28 bp, Artificial Sequence
  Synthetic
ccagtgacacaaaaguagaatgttctut

SEQ ID NO: 57618 - DNA, 23 bp, Artificial Sequence
  Synthetic
caacaaggtugggtgttttguga

SEQ ID NO: 57619 - DNA, 28 bp, Artificial Sequence
  Synthetic
attagatactuacctctcccugaaagca

SEQ ID NO: 57620 - DNA, 28 bp, Artificial Sequence
  Synthetic
acaaaatgtcttautctgggagagugaa

SEQ ID NO: 57621 - DNA, 29 bp, Artificial Sequence
  Synthetic
aaattacacgtauaagtcgacgagtugaa

SEQ ID NO: 57622 - DNA, 21 bp, Artificial Sequence
  Synthetic
tttgggttugcaacggatugt

SEQ ID NO: 57623 - DNA, 23 bp, Artificial Sequence
  Synthetic
ctgaacagagccucctcctttut

SEQ ID NO: 57624 - DNA, 20 bp, Artificial Sequence
  Synthetic
ctcuttgtgaggugcagggt

SEQ ID NO: 57625 - DNA, 24 bp, Artificial Sequence
  Synthetic
ccaagaaagcugcatctucgaaaa

SEQ ID NO: 57626 - DNA, 22 bp, Artificial Sequence
  Synthetic
catctggcuttccaguggaaca

SEQ ID NO: 57627 - DNA, 22 bp, Artificial Sequence
  Synthetic
gcatctugccaaacagctuagg

SEQ ID NO: 57628 - DNA, 20 bp, Artificial Sequence
  Synthetic
guagggacagaggcgguact

SEQ ID NO: 57629 - DNA, 20 bp, Artificial Sequence
  Synthetic
cgtcctuagcacgtgtugct

SEQ ID NO: 57630 - DNA, 23 bp, Artificial Sequence
  Synthetic
gggaggcuaagtgaacaucaaat

SEQ ID NO: 57631 - DNA, 25 bp, Artificial Sequence
  Synthetic
gttgtttttguagccaaagcctuct

SEQ ID NO: 57632 - DNA, 24 bp, Artificial Sequence
  Synthetic
tctttggtcugaaccagaatucgg

SEQ ID NO: 57633 - DNA, 28 bp, Artificial Sequence
  Synthetic
tgtttcattggcutggtacctttuagaa

SEQ ID NO: 57634 - DNA, 33 bp, Artificial Sequence
  Synthetic
atcataaatuaagctgatgaaaaucaaagacaa

SEQ ID NO: 57635 - DNA, 24 bp, Artificial Sequence
  Synthetic
gggatcccaaugatatgttucgat

SEQ ID NO: 57636 - DNA, 21 bp, Artificial Sequence
  Synthetic
ccttggcauttggtctguggt

SEQ ID NO: 57637 - DNA, 28 bp, Artificial Sequence
  Synthetic
cagatagcctcucctttatttgaaugga

SEQ ID NO: 57638 - DNA, 27 bp, Artificial Sequence
  Synthetic
gctccaaagaguagacattgtttcugt

SEQ ID NO: 57639 - DNA, 20 bp, Artificial Sequence
  Synthetic
gcttctugcccaccagauga

SEQ ID NO: 57640 - DNA, 26 bp, Artificial Sequence
  Synthetic
ccccttaaaauaaccattgtcccuca

SEQ ID NO: 57641 - DNA, 28 bp, Artificial Sequence
  Synthetic
accatgaccagguaaaaagaatttccut

SEQ ID NO: 57642 - DNA, 28 bp, Artificial Sequence
  Synthetic
tgagttugaagaaacagaagaaccugat

SEQ ID NO: 57643 - DNA, 28 bp, Artificial Sequence
  Synthetic
gaaaatcctuaccaatactccauccaca

SEQ ID NO: 57644 - DNA, 20 bp, Artificial Sequence
  Synthetic
agcttcugcagctgcttcut

SEQ ID NO: 57645 - DNA, 21 bp, Artificial Sequence
  Synthetic
ccatgttccutgccacctcuc

SEQ ID NO: 57646 - DNA, 23 bp, Artificial Sequence
  Synthetic
acttctccagcguctctttgaug

SEQ ID NO: 57647 - DNA, 23 bp, Artificial Sequence
  Synthetic
tcucttttatagugccccaccct

SEQ ID NO: 57648 - DNA, 22 bp, Artificial Sequence
  Synthetic
ctcccccugttctatgagcuct

SEQ ID NO: 57649 - DNA, 22 bp, Artificial Sequence
  Synthetic
gctggcauccactttacccuaa

SEQ ID NO: 57650 - DNA, 25 bp, Artificial Sequence
  Synthetic
cccaaagccagauacagtacaauca

SEQ ID NO: 57651 - DNA, 21 bp, Artificial Sequence
  Synthetic
cccatgcagutctgctcctut

SEQ ID NO: 57652 - DNA, 24 bp, Artificial Sequence
  Synthetic
gggaagggaagugatttgaugcaa

SEQ ID NO: 57653 - DNA, 24 bp, Artificial Sequence
  Synthetic
agtgctgatcuagaatggtgctuc

SEQ ID NO: 57654 - DNA, 18 bp, Artificial Sequence
  Synthetic
ccgccgcaucttcuggaa

SEQ ID NO: 57655 - DNA, 18 bp, Artificial Sequence
  Synthetic
gucugaccaggcacgcat

SEQ ID NO: 57656 - DNA, 21 bp, Artificial Sequence
  Synthetic
aggguggaagagccaacagua

SEQ ID NO: 57657 - DNA, 20 bp, Artificial Sequence
  Synthetic
gaggagtucacacgccucaa

SEQ ID NO: 57658 - DNA, 21 bp, Artificial Sequence
  Synthetic
ccagcgtcutagctctgctut

SEQ ID NO: 57659 - DNA, 22 bp, Artificial Sequence
  Synthetic
gtgtcccacccuaaccatgtut

SEQ ID NO: 57660 - DNA, 21 bp, Artificial Sequence
  Synthetic
ctctctguccacccaggtgua

SEQ ID NO: 57661 - DNA, 21 bp, Artificial Sequence
  Synthetic
ctaccugcgcaagucagagaa

SEQ ID NO: 57662 - DNA, 27 bp, Artificial Sequence
  Synthetic
tgcacacatugaggagttgaaaauact

SEQ ID NO: 57663 - DNA, 21 bp, Artificial Sequence
  Synthetic
acagatgtcugtgggttgcug

SEQ ID NO: 57664 - DNA, 21 bp, Artificial Sequence
  Synthetic
ccactuaggaccccaagucca

SEQ ID NO: 57665 - DNA, 22 bp, Artificial Sequence
  Synthetic
ggaautctcaccuccccaaagt

SEQ ID NO: 57666 - DNA, 28 bp, Artificial Sequence
  Synthetic
agccaccagcaauaaatttttaatgugt

SEQ ID NO: 57667 - DNA, 24 bp, Artificial Sequence
  Synthetic
ggattgcagaacagcauggataug

SEQ ID NO: 57668 - DNA, 21 bp, Artificial Sequence
  Synthetic
gccccacagccucttguaaaa

SEQ ID NO: 57669 - DNA, 23 bp, Artificial Sequence
  Synthetic
caaacgaaacugatgccuccaat

SEQ ID NO: 57670 - DNA, 24 bp, Artificial Sequence
  Synthetic
acagaguttctugaaagccacagt

SEQ ID NO: 57671 - DNA, 27 bp, Artificial Sequence
  Synthetic
gctcttaaaattucctgacatccccut

SEQ ID NO: 57672 - DNA, 23 bp, Artificial Sequence
  Synthetic
ccaatgaggutcttgcatuccat

SEQ ID NO: 57673 - DNA, 27 bp, Artificial Sequence
  Synthetic
cagaaggaaauacagccagtagugaaa

SEQ ID NO: 57674 - DNA, 24 bp, Artificial Sequence
  Synthetic
tcatccuaccaggaccattuacca

SEQ ID NO: 57675 - DNA, 28 bp, Artificial Sequence
  Synthetic
cttaaagcacacacaacutgaattucct

SEQ ID NO: 57676 - DNA, 23 bp, Artificial Sequence
  Synthetic
cacagagcuctagtgccaaauga

SEQ ID NO: 57677 - DNA, 24 bp, Artificial Sequence
  Synthetic
cagacugcaagaataccaugggat

SEQ ID NO: 57678 - DNA, 21 bp, Artificial Sequence
  Synthetic
acaaacacaccuguacagcca

SEQ ID NO: 57679 - DNA, 26 bp, Artificial Sequence
  Synthetic
tcaatgagtgugacctgaauccaaat

SEQ ID NO: 57680 - DNA, 27 bp, Artificial Sequence
  Synthetic
aatcttgggtttucttgcttgtcttuc

SEQ ID NO: 57681 - DNA, 21 bp, Artificial Sequence
  Synthetic
tgtacattgcuccctggctuc

SEQ ID NO: 57682 - DNA, 21 bp, Artificial Sequence
  Synthetic
tccgacucacctgtgagguaa

SEQ ID NO: 57683 - DNA, 21 bp, Artificial Sequence
  Synthetic
aacutccaaaccuccgaccag

SEQ ID NO: 57684 - DNA, 21 bp, Artificial Sequence
  Synthetic
cuctugccccaaacaaagaca

SEQ ID NO: 57685 - DNA, 17 bp, Artificial Sequence
  Synthetic
cgcagacucuccgcaga

SEQ ID NO: 57686 - DNA, 22 bp, Artificial Sequence
  Synthetic
cggttccugaggaatuggaagt

SEQ ID NO: 57687 - DNA, 20 bp, Artificial Sequence
  Synthetic
ctttcggaccuggtggtcut

SEQ ID NO: 57688 - DNA, 19 bp, Artificial Sequence
  Synthetic
ggagcucaggctugcagag

SEQ ID NO: 57689 - DNA, 19 bp, Artificial Sequence
  Synthetic
acaggacggcgaucttgug

SEQ ID NO: 57690 - DNA, 19 bp, Artificial Sequence
  Synthetic
cggacuttguggcggaact

SEQ ID NO: 57691 - DNA, 19 bp, Artificial Sequence
  Synthetic
ccttgcguggagagctgua

SEQ ID NO: 57692 - DNA, 18 bp, Artificial Sequence
  Synthetic
gctggcuctgggucagga

SEQ ID NO: 57693 - DNA, 23 bp, Artificial Sequence
  Synthetic
gcauctaatgcctucgagaacct

SEQ ID NO: 57694 - DNA, 27 bp, Artificial Sequence
  Synthetic
tcattacctgttcutttgtctgagcut

SEQ ID NO: 57695 - DNA, 25 bp, Artificial Sequence
  Synthetic
gcactcacgaugtttcttttcucca

SEQ ID NO: 57696 - DNA, 20 bp, Artificial Sequence
  Synthetic
agcaagttugccgcctttug

SEQ ID NO: 57697 - DNA, 23 bp, Artificial Sequence
  Synthetic
cgtctgtgaugtcaatggaugct

SEQ ID NO: 57698 - DNA, 20 bp, Artificial Sequence
  Synthetic
gaggtgacgucagggucaat

SEQ ID NO: 57699 - DNA, 21 bp, Artificial Sequence
  Synthetic
gctcagcttugggtgatgtuc

SEQ ID NO: 57700 - DNA, 24 bp, Artificial Sequence
  Synthetic
tcctctuaagccctgauagcagaa

SEQ ID NO: 57701 - DNA, 21 bp, Artificial Sequence
  Synthetic
ggtucaagccctgcuaaggag

SEQ ID NO: 57702 - DNA, 22 bp, Artificial Sequence
  Synthetic
cagtggcuatgtccuggaaact

SEQ ID NO: 57703 - DNA, 21 bp, Artificial Sequence
  Synthetic
gggcatggcucacattctuaa

SEQ ID NO: 57704 - DNA, 24 bp, Artificial Sequence
  Synthetic
gaggaaugagaaccgcttttgtut

SEQ ID NO: 57705 - DNA, 22 bp, Artificial Sequence
  Synthetic
caccgttgutgtaggacuggag

SEQ ID NO: 57706 - DNA, 19 bp, Artificial Sequence
  Synthetic
acacagggcacgaugaugt

SEQ ID NO: 57707 - DNA, 18 bp, Artificial Sequence
  Synthetic
ctctucagcccgctguca

SEQ ID NO: 57708 - DNA, 22 bp, Artificial Sequence
  Synthetic
gcctctgtucccatctguacct

SEQ ID NO: 57709 - DNA, 23 bp, Artificial Sequence
  Synthetic
cgattggcagaacugttcgctua

SEQ ID NO: 57710 - DNA, 22 bp, Artificial Sequence
  Synthetic
gggaatgcugaccatcuccaat

SEQ ID NO: 57711 - DNA, 20 bp, Artificial Sequence
  Synthetic
agcgguaggacttgcatgug

SEQ ID NO: 57712 - DNA, 28 bp, Artificial Sequence
  Synthetic
gaagaaatggaaaauaaggtgtcagugg

SEQ ID NO: 57713 - DNA, 28 bp, Artificial Sequence
  Synthetic
tgactggttucacaggtgattagaaaug

SEQ ID NO: 57714 - DNA, 27 bp, Artificial Sequence
  Synthetic
gcaggtttaagaagaucattcccaucc

SEQ ID NO: 57715 - DNA, 24 bp, Artificial Sequence
  Synthetic
gctacagactucagtgtggttgut

SEQ ID NO: 57716 - DNA, 21 bp, Artificial Sequence
  Synthetic
acagtcccuccagucacaact

SEQ ID NO: 57717 - DNA, 22 bp, Artificial Sequence
  Synthetic
atctgccauggctttctctcug

SEQ ID NO: 57718 - DNA, 21 bp, Artificial Sequence
  Synthetic
gaaggcugctaaggucaccat

SEQ ID NO: 57719 - DNA, 28 bp, Artificial Sequence
  Synthetic
cacatcacagaacaccucataaaatcuc

SEQ ID NO: 57720 - DNA, 26 bp, Artificial Sequence
  Synthetic
ttctggcagagautttgtugaagaga

SEQ ID NO: 57721 - DNA, 22 bp, Artificial Sequence
  Synthetic
ccccaagaaugaaagtgcaugg

SEQ ID NO: 57722 - DNA, 20 bp, Artificial Sequence
  Synthetic
gaaggccucagatggcauca

SEQ ID NO: 57723 - DNA, 19 bp, Artificial Sequence
  Synthetic
cacctgccucctcctucac

SEQ ID NO: 57724 - DNA, 22 bp, Artificial Sequence
  Synthetic
tgcagcugaacttcggaatuct

SEQ ID NO: 57725 - DNA, 28 bp, Artificial Sequence
  Synthetic
tcatattacttcaguagtcccatgugga

SEQ ID NO: 57726 - DNA, 27 bp, Artificial Sequence
  Synthetic
agttgcaaatataugtcttccacccut

SEQ ID NO: 57727 - DNA, 20 bp, Artificial Sequence
  Synthetic
gcttcagugtcagggtucca

SEQ ID NO: 57728 - DNA, 22 bp, Artificial Sequence
  Synthetic
gctgcugaaagcctucacaaga

SEQ ID NO: 57729 - DNA, 20 bp, Artificial Sequence
  Synthetic
ccatgggugggctataggut

SEQ ID NO: 57730 - DNA, 28 bp, Artificial Sequence
  Synthetic
tcctgctctguatccaatgctattuaac

SEQ ID NO: 57731 - DNA, 30 bp, Artificial Sequence
  Synthetic
aggcttattucaaacaagtcactctatuca

SEQ ID NO: 57732 - DNA, 25 bp, Artificial Sequence
  Synthetic
tgaaccttttgaaugactgcaguga

SEQ ID NO: 57733 - DNA, 26 bp, Artificial Sequence
  Synthetic
ctcttacatgccagutctctaggtut

SEQ ID NO: 57734 - DNA, 28 bp, Artificial Sequence
  Synthetic
ctcctggatccuttattacgaattguga

SEQ ID NO: 57735 - DNA, 21 bp, Artificial Sequence
  Synthetic
ggagaaggugccttgctucat

SEQ ID NO: 57736 - DNA, 26 bp, Artificial Sequence
  Synthetic
tgctgtttacaaaucagctgacagua

SEQ ID NO: 57737 - DNA, 22 bp, Artificial Sequence
  Synthetic
gacccagguatgcaagaagugt

SEQ ID NO: 57738 - DNA, 26 bp, Artificial Sequence
  Synthetic
tgagccttuaaagaaagctactgugt

SEQ ID NO: 57739 - DNA, 28 bp, Artificial Sequence
  Synthetic
ccaaccaaugcaaagttaaagtuagagt

SEQ ID NO: 57740 - DNA, 24 bp, Artificial Sequence
  Synthetic
tcagacacaaaggcuccuaaaagg

SEQ ID NO: 57741 - DNA, 29 bp, Artificial Sequence
  Synthetic
catgtactcucccaccttattttcaauga

SEQ ID NO: 57742 - DNA, 25 bp, Artificial Sequence
  Synthetic
cagucttctacttcucacccaaaca

SEQ ID NO: 57743 - DNA, 28 bp, Artificial Sequence
  Synthetic
gcacgaaggugaattaaaaucaaaagga

SEQ ID NO: 57744 - DNA, 20 bp, Artificial Sequence
  Synthetic
ggccccuctaaggtggauct

SEQ ID NO: 57745 - DNA, 22 bp, Artificial Sequence
  Synthetic
aaagctcccucacttctgucac

SEQ ID NO: 57746 - DNA, 22 bp, Artificial Sequence
  Synthetic
ggctagcccauctccuaacact

SEQ ID NO: 57747 - DNA, 22 bp, Artificial Sequence
  Synthetic
caacctggaugccatcaaaguc

SEQ ID NO: 57748 - DNA, 20 bp, Artificial Sequence
  Synthetic
gctctggugcatcatugggt

SEQ ID NO: 57749 - DNA, 25 bp, Artificial Sequence
  Synthetic
ccctctgacugttcctatgttcuct

SEQ ID NO: 57750 - DNA, 19 bp, Artificial Sequence
  Synthetic
cgcggcuccgctauaaaac

SEQ ID NO: 57751 - DNA, 17 bp, Artificial Sequence
  Synthetic
gggagcucaccugcact

SEQ ID NO: 57752 - DNA, 21 bp, Artificial Sequence
  Synthetic
caaagcagaagcacuggaguc

SEQ ID NO: 57753 - DNA, 25 bp, Artificial Sequence
  Synthetic
ttctcacccacautgatgaacugaa

SEQ ID NO: 57754 - DNA, 21 bp, Artificial Sequence
  Synthetic
ccgaggguttgggagtauacc

SEQ ID NO: 57755 - DNA, 28 bp, Artificial Sequence
  Synthetic
gttaacgtagutctcatctttcuccact

SEQ ID NO: 57756 - DNA, 23 bp, Artificial Sequence
  Synthetic
ccccttccacuccttcttcauct

SEQ ID NO: 57757 - DNA, 21 bp, Artificial Sequence
  Synthetic
cttccctccuctctccagugt

SEQ ID NO: 57758 - DNA, 19 bp, Artificial Sequence
  Synthetic
atgttgacagcgucgccua

SEQ ID NO: 57759 - DNA, 18 bp, Artificial Sequence
  Synthetic
ccaccuggagcggugaac

SEQ ID NO: 57760 - DNA, 22 bp, Artificial Sequence
  Synthetic
gcatccugaggaagucacaacc

SEQ ID NO: 57761 - DNA, 24 bp, Artificial Sequence
  Synthetic
tgaggaggacugaaatacggguaa

SEQ ID NO: 57762 - DNA, 21 bp, Artificial Sequence
  Synthetic
gcctcugagagggagaccauc

SEQ ID NO: 57763 - DNA, 22 bp, Artificial Sequence
  Synthetic
ggcctccuacatggtctucaac

SEQ ID NO: 57764 - DNA, 17 bp, Artificial Sequence
  Synthetic
gcgugucaccggaggat

SEQ ID NO: 57765 - DNA, 18 bp, Artificial Sequence
  Synthetic
gguctctcugcgggcaac

SEQ ID NO: 57766 - DNA, 21 bp, Artificial Sequence
  Synthetic
gctacaagcuggagaaccuga

SEQ ID NO: 57767 - DNA, 17 bp, Artificial Sequence
  Synthetic
ggtgcgugggtgucgat

SEQ ID NO: 57768 - DNA, 22 bp, Artificial Sequence
  Synthetic
ccatcccatucatcacccguat

SEQ ID NO: 57769 - DNA, 20 bp, Artificial Sequence
  Synthetic
tctgcaggucgtaccatgug

SEQ ID NO: 57770 - DNA, 21 bp, Artificial Sequence
  Synthetic
ggccugcaccagaaugaagat

SEQ ID NO: 57771 - DNA, 28 bp, Artificial Sequence
  Synthetic
cctgtaactaatuggtgattgtgtcugt

SEQ ID NO: 57772 - DNA, 19 bp, Artificial Sequence
  Synthetic
gccugacgaacacgcagua

SEQ ID NO: 57773 - DNA, 23 bp, Artificial Sequence
  Synthetic
cttggctctuaacctccacctuc

SEQ ID NO: 57774 - DNA, 31 bp, Artificial Sequence
  Synthetic
aaaatagatttguaggccactuaggaaaact

SEQ ID NO: 57775 - DNA, 17 bp, Artificial Sequence
  Synthetic
ggcuggccaccaucaca

SEQ ID NO: 57776 - DNA, 27 bp, Artificial Sequence
  Synthetic
cgcattataagcgaautcatccttugt

SEQ ID NO: 57777 - DNA, 24 bp, Artificial Sequence
  Synthetic
cugggacgtcuaaacaaccaaaag

SEQ ID NO: 57778 - DNA, 30 bp, Artificial Sequence
  Synthetic
cattgtataugaagaacagagcattugcat

SEQ ID NO: 57779 - DNA, 29 bp, Artificial Sequence
  Synthetic
ttttaaaautgtaacagaugccaaaacca

SEQ ID NO: 57780 - DNA, 22 bp, Artificial Sequence
  Synthetic
ggcagtggaagutctggaguat

SEQ ID NO: 57781 - DNA, 29 bp, Artificial Sequence
  Synthetic
cagtctccaagtuaaagccaaaatgaaut

SEQ ID NO: 57782 - DNA, 17 bp, Artificial Sequence
  Synthetic
cgtacgcccugctgcut

SEQ ID NO: 57783 - DNA, 17 bp, Artificial Sequence
  Synthetic
gccccaggucggatcuc

SEQ ID NO: 57784 - DNA, 21 bp, Artificial Sequence
  Synthetic
ccaaacaguggcccttucagt

SEQ ID NO: 57785 - DNA, 28 bp, Artificial Sequence
  Synthetic
ttcaggacctcauttcataaactcctut

SEQ ID NO: 57786 - DNA, 18 bp, Artificial Sequence
  Synthetic
gcagccuctgacctcuga

SEQ ID NO: 57787 - DNA, 24 bp, Artificial Sequence
  Synthetic
aguaatgauaaggaccccacccat

SEQ ID NO: 57788 - DNA, 21 bp, Artificial Sequence
  Synthetic
gggtgauacacaagccugacc

SEQ ID NO: 57789 - DNA, 21 bp, Artificial Sequence
  Synthetic
ggtgctgaugtcaccgaugat

SEQ ID NO: 57790 - DNA, 27 bp, Artificial Sequence
  Synthetic
ctaaacttagtcuggcaggagtuaaca

SEQ ID NO: 57791 - DNA, 28 bp, Artificial Sequence
  Synthetic
tggaaagaaatugagagcagctaatcut

SEQ ID NO: 57792 - DNA, 17 bp, Artificial Sequence
  Synthetic
cgctgccugaggacgua

SEQ ID NO: 57793 - DNA, 18 bp, Artificial Sequence
  Synthetic
gggtgugcagtcgaggug

SEQ ID NO: 57794 - DNA, 20 bp, Artificial Sequence
  Synthetic
ggttgggucggtctgaugat

SEQ ID NO: 57795 - DNA, 18 bp, Artificial Sequence
  Synthetic
ccagcccauccgcctuac

SEQ ID NO: 57796 - DNA, 19 bp, Artificial Sequence
  Synthetic
ggtuccgcaggacgaugag

SEQ ID NO: 57797 - DNA, 22 bp, Artificial Sequence
  Synthetic
ctcccagaacccucttcttugg

SEQ ID NO: 57798 - DNA, 22 bp, Artificial Sequence
  Synthetic
ccagatgaagutgccagaguct

SEQ ID NO: 57799 - DNA, 23 bp, Artificial Sequence
  Synthetic
gctcacugccatatgcattucca

SEQ ID NO: 57800 - DNA, 21 bp, Artificial Sequence
  Synthetic
gctccaagccutgcattguct

SEQ ID NO: 57801 - DNA, 20 bp, Artificial Sequence
  Synthetic
aggctcauggtgtctuccac

SEQ ID NO: 57802 - DNA, 21 bp, Artificial Sequence
  Synthetic
gggttugggaggctctgtuac

SEQ ID NO: 57803 - DNA, 21 bp, Artificial Sequence
  Synthetic
aatcatggccutcagggacuc

SEQ ID NO: 57804 - DNA, 20 bp, Artificial Sequence
  Synthetic
gaaaatcgugcgcagagucc

SEQ ID NO: 57805 - DNA, 23 bp, Artificial Sequence
  Synthetic
gatccattcuaagcctcgcctua

SEQ ID NO: 57806 - DNA, 21 bp, Artificial Sequence
  Synthetic
tcgtgatcccugatccctuct

SEQ ID NO: 57807 - DNA, 21 bp, Artificial Sequence
  Synthetic
gcgagctucatcatcatgugg

SEQ ID NO: 57808 - DNA, 23 bp, Artificial Sequence
  Synthetic
cgatgaggaugagaacatggugt

SEQ ID NO: 57809 - DNA, 26 bp, Artificial Sequence
  Synthetic
ccaccttgagacaautatagccaaug

SEQ ID NO: 57810 - DNA, 18 bp, Artificial Sequence
  Synthetic
agcagccccuctgtucct

SEQ ID NO: 57811 - DNA, 18 bp, Artificial Sequence
  Synthetic
gctcucccagaggcucac

SEQ ID NO: 57812 - DNA, 18 bp, Artificial Sequence
  Synthetic
gccugagggagggagaug

SEQ ID NO: 57813 - DNA, 22 bp, Artificial Sequence
  Synthetic
actattgaaccugccccaggua

SEQ ID NO: 57814 - DNA, 18 bp, Artificial Sequence
  Synthetic
ccgacugagcctccucca

SEQ ID NO: 57815 - DNA, 19 bp, Artificial Sequence
  Synthetic
cccagcagugctccucaac

SEQ ID NO: 57816 - DNA, 20 bp, Artificial Sequence
  Synthetic
cagcctcagaguccccttug

SEQ ID NO: 57817 - DNA, 20 bp, Artificial Sequence
  Synthetic
ggcaccaugggagaaaggua

SEQ ID NO: 57818 - DNA, 17 bp, Artificial Sequence
  Synthetic
ggaggccugcgacaugg

SEQ ID NO: 57819 - DNA, 24 bp, Artificial Sequence
  Synthetic
cccccattcuacagaaaaggaugt

SEQ ID NO: 57820 - DNA, 19 bp, Artificial Sequence
  Synthetic
agcaggccaaccguaugag

SEQ ID NO: 57821 - DNA, 21 bp, Artificial Sequence
  Synthetic
gggcugaatggauggaaacga

SEQ ID NO: 57822 - DNA, 17 bp, Artificial Sequence
  Synthetic
tccagcguggcctucac

SEQ ID NO: 57823 - DNA, 17 bp, Artificial Sequence
  Synthetic
gctgggcuctcgtcuct

SEQ ID NO: 57824 - DNA, 21 bp, Artificial Sequence
  Synthetic
caguagaaggccgucaccaag

SEQ ID NO: 57825 - DNA, 25 bp, Artificial Sequence
  Synthetic
ttttgttccugcgatgatgctttut

SEQ ID NO: 57826 - DNA, 25 bp, Artificial Sequence
  Synthetic
acaggaaugtaagcuagggagaagt

SEQ ID NO: 57827 - DNA, 20 bp, Artificial Sequence
  Synthetic
cgagtgtcggucttccaguc

SEQ ID NO: 57828 - DNA, 25 bp, Artificial Sequence
  Synthetic
gtgaaaagucaaatggtgacugcaa

SEQ ID NO: 57829 - DNA, 27 bp, Artificial Sequence
  Synthetic
cagtccctaaacutgaactccattuct

SEQ ID NO: 57830 - DNA, 22 bp, Artificial Sequence
  Synthetic
gagtattgaccugggctuggat

SEQ ID NO: 57831 - DNA, 21 bp, Artificial Sequence
  Synthetic
cctggttuctcctggttuggt

SEQ ID NO: 57832 - DNA, 20 bp, Artificial Sequence
  Synthetic
cgcccaccuttgatgcugat

SEQ ID NO: 57833 - DNA, 18 bp, Artificial Sequence
  Synthetic
ggacgugctgaccgugag

SEQ ID NO: 57834 - DNA, 22 bp, Artificial Sequence
  Synthetic
agagagcgagcaagcutatugg

SEQ ID NO: 57835 - DNA, 23 bp, Artificial Sequence
  Synthetic
ccaacaacguggtgtauaagcag

SEQ ID NO: 57836 - DNA, 21 bp, Artificial Sequence
  Synthetic
gagaagutctucccacaccgt

SEQ ID NO: 57837 - DNA, 26 bp, Artificial Sequence
  Synthetic
ggttggatgauaaaggtctggcttut

SEQ ID NO: 57838 - DNA, 20 bp, Artificial Sequence
  Synthetic
ctggcgcugcaggtuaaaag

SEQ ID NO: 57839 - DNA, 26 bp, Artificial Sequence
  Synthetic
ctatctgccaugatgatgtcaucgaa

SEQ ID NO: 57840 - DNA, 26 bp, Artificial Sequence
  Synthetic
tgcctttggcuaaatagcttatgucc

SEQ ID NO: 57841 - DNA, 21 bp, Artificial Sequence
  Synthetic
acttcuccggagctgtacuga

SEQ ID NO: 57842 - DNA, 25 bp, Artificial Sequence
  Synthetic
gcaguaagtacaatugagagaggct

SEQ ID NO: 57843 - DNA, 27 bp, Artificial Sequence
  Synthetic
ttgatttgtctugtttgctttctgugt

SEQ ID NO: 57844 - DNA, 27 bp, Artificial Sequence
  Synthetic
gguatggtgaatcatuaggaaccaaga

SEQ ID NO: 57845 - DNA, 21 bp, Artificial Sequence
  Synthetic
cagggaccaaaaccugcatug

SEQ ID NO: 57846 - DNA, 20 bp, Artificial Sequence
  Synthetic
gtcccagcagucactgacuc

SEQ ID NO: 57847 - DNA, 20 bp, Artificial Sequence
  Synthetic
ttccccagguggacctctua

SEQ ID NO: 57848 - DNA, 25 bp, Artificial Sequence
  Synthetic
gaattgttatucaaaggacggcgut

SEQ ID NO: 57849 - DNA, 27 bp, Artificial Sequence
  Synthetic
gagagctggtaauttggtcattgttut

SEQ ID NO: 57850 - DNA, 19 bp, Artificial Sequence
  Synthetic
ccugggaccccgaagtcua

SEQ ID NO: 57851 - DNA, 21 bp, Artificial Sequence
  Synthetic
tcccaggaaggagauccagug

SEQ ID NO: 57852 - DNA, 21 bp, Artificial Sequence
  Synthetic
ggaaagcgcagaugauccact

SEQ ID NO: 57853 - DNA, 23 bp, Artificial Sequence
  Synthetic
agcgccugaactggatttacuac

SEQ ID NO: 57854 - DNA, 28 bp, Artificial Sequence
  Synthetic
tgtaccacaaucaacctuaaaggaaagt

SEQ ID NO: 57855 - DNA, 29 bp, Artificial Sequence
  Synthetic
tggtgatctgaugcttaaggatgtaatut

SEQ ID NO: 57856 - DNA, 23 bp, Artificial Sequence
  Synthetic
gctgcttacutacagaggtucca

SEQ ID NO: 57857 - DNA, 22 bp, Artificial Sequence
  Synthetic
agacagtugggtgaagtugcat

SEQ ID NO: 57858 - DNA, 24 bp, Artificial Sequence
  Synthetic
gagauaaccacagcagcagaugat

SEQ ID NO: 57859 - DNA, 29 bp, Artificial Sequence
  Synthetic
ttggcttatgccutgagaattattuacct

SEQ ID NO: 57860 - DNA, 26 bp, Artificial Sequence
  Synthetic
gggtttctttutctctgattcaucca

SEQ ID NO: 57861 - DNA, 28 bp, Artificial Sequence
  Synthetic
ctaaccaataaugccatggtatgtcuct

SEQ ID NO: 57862 - DNA, 22 bp, Artificial Sequence
  Synthetic
cctgaggcautcccatctugaa

SEQ ID NO: 57863 - DNA, 28 bp, Artificial Sequence
  Synthetic
accacaccgatutacctagagttcuaat

SEQ ID NO: 57864 - DNA, 30 bp, Artificial Sequence
  Synthetic
ttgtgtagaaaugacaagtctcagaugaaa

SEQ ID NO: 57865 - DNA, 28 bp, Artificial Sequence
  Synthetic
cgccagataucaattaggcauagagaaa

SEQ ID NO: 57866 - DNA, 28 bp, Artificial Sequence
  Synthetic
gatatcagtagttuctccaaggcttuct

SEQ ID NO: 57867 - DNA, 25 bp, Artificial Sequence
  Synthetic
cagttgccttucacttttctgtuga

SEQ ID NO: 57868 - DNA, 22 bp, Artificial Sequence
  Synthetic
caggcagtuggcagttgauaga

SEQ ID NO: 57869 - DNA, 23 bp, Artificial Sequence
  Synthetic
gctttaaccuatgtgctccugct

SEQ ID NO: 57870 - DNA, 27 bp, Artificial Sequence
  Synthetic
aatagaggtgtugttgatagactgugg

SEQ ID NO: 57871 - DNA, 25 bp, Artificial Sequence
  Synthetic
cagcctcaacuacactcagttcaut

SEQ ID NO: 57872 - DNA, 28 bp, Artificial Sequence
  Synthetic
gatgaacattugactcaactugagaagg

SEQ ID NO: 57873 - DNA, 26 bp, Artificial Sequence
  Synthetic
cggatttgttaacaugctcccaatut

SEQ ID NO: 57874 - DNA, 28 bp, Artificial Sequence
  Synthetic
cagattcttccaggautgtctgttauga

SEQ ID NO: 57875 - DNA, 27 bp, Artificial Sequence
  Synthetic
cttgcctgccaaautttgcttatttut

SEQ ID NO: 57876 - DNA, 28 bp, Artificial Sequence
  Synthetic
tcctctataaggaaaaucccctttugga

SEQ ID NO: 57877 - DNA, 22 bp, Artificial Sequence
  Synthetic
ccagaggcuaactcggagacut

SEQ ID NO: 57878 - DNA, 22 bp, Artificial Sequence
  Synthetic
ccagagcagacauaaacgtugg

SEQ ID NO: 57879 - DNA, 26 bp, Artificial Sequence
  Synthetic
catggcttaaucggtaataggcuaca

SEQ ID NO: 57880 - DNA, 24 bp, Artificial Sequence
  Synthetic
acgaatcaacaugcagaactcucc

SEQ ID NO: 57881 - DNA, 21 bp, Artificial Sequence
  Synthetic
gcaaggaugggtctcttuggt

SEQ ID NO: 57882 - DNA, 24 bp, Artificial Sequence
  Synthetic
ggagacctuggtttcctttgtugt

SEQ ID NO: 57883 - DNA, 23 bp, Artificial Sequence
  Synthetic
ccccagcuggaaattcatttcut

SEQ ID NO: 57884 - DNA, 24 bp, Artificial Sequence
  Synthetic
agggctgttuctaaacaagctuct

SEQ ID NO: 57885 - DNA, 24 bp, Artificial Sequence
  Synthetic
gcaggttatgaguacctctgcaut

SEQ ID NO: 57886 - DNA, 19 bp, Artificial Sequence
  Synthetic
gggttugcctggtgaucct

SEQ ID NO: 57887 - DNA, 28 bp, Artificial Sequence
  Synthetic
catttauaactcaagccugggagaagaa

SEQ ID NO: 57888 - DNA, 26 bp, Artificial Sequence
  Synthetic
gttagaatugcagttctgtgtuggaa

SEQ ID NO: 57889 - DNA, 25 bp, Artificial Sequence
  Synthetic
ggtttaccagaaagucctggaaguc

SEQ ID NO: 57890 - DNA, 21 bp, Artificial Sequence
  Synthetic
ccaccuccacccttttcagug

SEQ ID NO: 57891 - DNA, 23 bp, Artificial Sequence
  Synthetic
ctgcccagautgggtatttggua

SEQ ID NO: 57892 - DNA, 27 bp, Artificial Sequence
  Synthetic
cctgttguaaaaaccagaggaaguaga

SEQ ID NO: 57893 - DNA, 28 bp, Artificial Sequence
  Synthetic
agtcctacgtuaggtatatgttgcuagt

SEQ ID NO: 57894 - DNA, 26 bp, Artificial Sequence
  Synthetic
caacaggaggaggauatgaaagugat

SEQ ID NO: 57895 - DNA, 29 bp, Artificial Sequence
  Synthetic
tgccttgatatgutctaaccaatgaguag

SEQ ID NO: 57896 - DNA, 18 bp, Artificial Sequence
  Synthetic
ggccttcucgcccaagut

SEQ ID NO: 57897 - DNA, 17 bp, Artificial Sequence
  Synthetic
cacacgcutcccuccgt

SEQ ID NO: 57898 - DNA, 20 bp, Artificial Sequence
  Synthetic
agcgcugtcactucaagagg

SEQ ID NO: 57899 - DNA, 20 bp, Artificial Sequence
  Synthetic
tgagugagggagcgggaaua

SEQ ID NO: 57900 - DNA, 23 bp, Artificial Sequence
  Synthetic
ctccagguggtaggagctauagg

SEQ ID NO: 57901 - DNA, 20 bp, Artificial Sequence
  Synthetic
cgaggtcucctgttcgctug

SEQ ID NO: 57902 - DNA, 17 bp, Artificial Sequence
  Synthetic
gggctcagguggaggug

SEQ ID NO: 57903 - DNA, 19 bp, Artificial Sequence
  Synthetic
tccacccucggugagaaga

SEQ ID NO: 57904 - DNA, 21 bp, Artificial Sequence
  Synthetic
cgtttctugggaatggccuga

SEQ ID NO: 57905 - DNA, 21 bp, Artificial Sequence
  Synthetic
agagggugtgcaggugaaaag

SEQ ID NO: 57906 - DNA, 20 bp, Artificial Sequence
  Synthetic
gcacctucacccgactucgt

SEQ ID NO: 57907 - DNA, 28 bp, Artificial Sequence
  Synthetic
tggtgaagtagcuctcttcatagtaguc

SEQ ID NO: 57908 - DNA, 21 bp, Artificial Sequence
  Synthetic
ggcugctttucaggaccacat

SEQ ID NO: 57909 - DNA, 26 bp, Artificial Sequence
  Synthetic
ctcatcttuggagtacgttcttucca

SEQ ID NO: 57910 - DNA, 29 bp, Artificial Sequence
  Synthetic
ttggaattaaguttgtggaagcuaagagt

SEQ ID NO: 57911 - DNA, 27 bp, Artificial Sequence
  Synthetic
ccagcctctacauctctcagtttauca

SEQ ID NO: 57912 - DNA, 23 bp, Artificial Sequence
  Synthetic
gagccctgcaguttctttccaua

SEQ ID NO: 57913 - DNA, 24 bp, Artificial Sequence
  Synthetic
ataggattgaugtcttcccuccct

SEQ ID NO: 57914 - DNA, 24 bp, Artificial Sequence
  Synthetic
gggacauacactgagaaugaaacc

SEQ ID NO: 57915 - DNA, 28 bp, Artificial Sequence
  Synthetic
gacccgctatuactctagtttcgtuaat

SEQ ID NO: 57916 - DNA, 23 bp, Artificial Sequence
  Synthetic
ccuctttcaggugaaggaacaca

SEQ ID NO: 57917 - DNA, 26 bp, Artificial Sequence
  Synthetic
cactgtgcctuacctactcatatcut

SEQ ID NO: 57918 - DNA, 23 bp, Artificial Sequence
  Synthetic
ggaggagaaauggtcacttugct

SEQ ID NO: 57919 - DNA, 19 bp, Artificial Sequence
  Synthetic
gatggcgcaugacacacuc

SEQ ID NO: 57920 - DNA, 23 bp, Artificial Sequence
  Synthetic
aaaagtgugaggcctgaaggtua

SEQ ID NO: 57921 - DNA, 21 bp, Artificial Sequence
  Synthetic
gctcugcaagaagggctugag

SEQ ID NO: 57922 - DNA, 20 bp, Artificial Sequence
  Synthetic
tgagcucagcuaaacaccga

SEQ ID NO: 57923 - DNA, 20 bp, Artificial Sequence
  Synthetic
accccaggacuccaatguct

SEQ ID NO: 57924 - DNA, 20 bp, Artificial Sequence
  Synthetic
ctttctcaggcugggtgcut

SEQ ID NO: 57925 - DNA, 28 bp, Artificial Sequence
  Synthetic
ttcaacacccugttctttctcttatuca

SEQ ID NO: 57926 - DNA, 23 bp, Artificial Sequence
  Synthetic
ccacagggaaucctcattuagca

SEQ ID NO: 57927 - DNA, 28 bp, Artificial Sequence
  Synthetic
cacctactcacuaacttttctgttccut

SEQ ID NO: 57928 - DNA, 27 bp, Artificial Sequence
  Synthetic
tctacatacauctgggaagcuaaggat

SEQ ID NO: 57929 - DNA, 28 bp, Artificial Sequence
  Synthetic
gttattatttagggaccucctggctuac

SEQ ID NO: 57930 - DNA, 22 bp, Artificial Sequence
  Synthetic
tgcctgcagcutacacacatua

SEQ ID NO: 57931 - DNA, 27 bp, Artificial Sequence
  Synthetic
ggttggttuccatccagatttugaaaa

SEQ ID NO: 57932 - DNA, 28 bp, Artificial Sequence
  Synthetic
tggattttccugcatttgcaattactut

SEQ ID NO: 57933 - DNA, 22 bp, Artificial Sequence
  Synthetic
gtcattcuagggtcctgtuggt

SEQ ID NO: 57934 - DNA, 21 bp, Artificial Sequence
  Synthetic
acgtaatccugctggtccauc

SEQ ID NO: 57935 - DNA, 28 bp, Artificial Sequence
  Synthetic
ggcattccacccaauattctcatcatua

SEQ ID NO: 57936 - DNA, 21 bp, Artificial Sequence
  Synthetic
ggctctctacugagggcttut

SEQ ID NO: 57937 - DNA, 27 bp, Artificial Sequence
  Synthetic
ggatttcttcatugaaagaggcatgut

SEQ ID NO: 57938 - DNA, 27 bp, Artificial Sequence
  Synthetic
cttgatacagagucagtcatcttgugg

SEQ ID NO: 57939 - DNA, 27 bp, Artificial Sequence
  Synthetic
agcacgtaautcaacatgttugacaaa

SEQ ID NO: 57940 - DNA, 28 bp, Artificial Sequence
  Synthetic
ccatatcactgaaauacgaagacctuct

SEQ ID NO: 57941 - DNA, 27 bp, Artificial Sequence
  Synthetic
gctaactgaatcugtgtctgtttgtut

SEQ ID NO: 57942 - DNA, 22 bp, Artificial Sequence
  Synthetic
gttacttacutcccgucagcga

SEQ ID NO: 57943 - DNA, 27 bp, Artificial Sequence
  Synthetic
catggtatucagcaaattggtgtugag

SEQ ID NO: 57944 - DNA, 21 bp, Artificial Sequence
  Synthetic
tctcaggcaccuttggtgtuc

SEQ ID NO: 57945 - DNA, 27 bp, Artificial Sequence
  Synthetic
tggacaacacacugctattctagacua

SEQ ID NO: 57946 - DNA, 21 bp, Artificial Sequence
  Synthetic
acactctgcucccagaactug

SEQ ID NO: 57947 - DNA, 21 bp, Artificial Sequence
  Synthetic
caagguccaggatcagtugct

SEQ ID NO: 57948 - DNA, 23 bp, Artificial Sequence
  Synthetic
gcaauaccaagaaggagggugac

SEQ ID NO: 57949 - DNA, 27 bp, Artificial Sequence
  Synthetic
aggtagaagagugagtgtacatgtgut

SEQ ID NO: 57950 - DNA, 18 bp, Artificial Sequence
  Synthetic
cggacccauctcctcugg

SEQ ID NO: 57951 - DNA, 19 bp, Artificial Sequence
  Synthetic
cctcgucctaccccucgat

SEQ ID NO: 57952 - DNA, 23 bp, Artificial Sequence
  Synthetic
cctgaaaugaggactgccaugag

SEQ ID NO: 57953 - DNA, 24 bp, Artificial Sequence
  Synthetic
catccatcaggaaauggtcctuca

SEQ ID NO: 57954 - DNA, 20 bp, Artificial Sequence
  Synthetic
gactcuccgcccccattuaa

SEQ ID NO: 57955 - DNA, 20 bp, Artificial Sequence
  Synthetic
cctacggcaagucggaggua

SEQ ID NO: 57956 - DNA, 20 bp, Artificial Sequence
  Synthetic
ggaguagtcuccgcccagat

SEQ ID NO: 57957 - DNA, 22 bp, Artificial Sequence
  Synthetic
ttctttucccacccctccuagt

SEQ ID NO: 57958 - DNA, 20 bp, Artificial Sequence
  Synthetic
accaagggcucaggcaauag

SEQ ID NO: 57959 - DNA, 25 bp, Artificial Sequence
  Synthetic
cctccagugagaacaaatggtgaua

SEQ ID NO: 57960 - DNA, 28 bp, Artificial Sequence
  Synthetic
gtggttagatgcauagggcaattaaaug

SEQ ID NO: 57961 - DNA, 22 bp, Artificial Sequence
  Synthetic
aagcugugagagccagaacaaa

SEQ ID NO: 57962 - DNA, 27 bp, Artificial Sequence
  Synthetic
caaatttctcacuctctctgcttcuca

SEQ ID NO: 57963 - DNA, 21 bp, Artificial Sequence
  Synthetic
gaatgccguactccaccucag

SEQ ID NO: 57964 - DNA, 20 bp, Artificial Sequence
  Synthetic
tguatucggccaccacaaca

SEQ ID NO: 57965 - DNA, 28 bp, Artificial Sequence
  Synthetic
gtctcagatcutctatgcctuacaagaa

SEQ ID NO: 57966 - DNA, 28 bp, Artificial Sequence
  Synthetic
gcatatgatccuggaaaagttctguact

SEQ ID NO: 57967 - DNA, 27 bp, Artificial Sequence
  Synthetic
agtgtcacaaauccaagttcaaatgug

SEQ ID NO: 57968 - DNA, 27 bp, Artificial Sequence
  Synthetic
acaattcgctgauaactctagagguct

SEQ ID NO: 57969 - DNA, 21 bp, Artificial Sequence
  Synthetic
caagaggtucagccaccagua

SEQ ID NO: 57970 - DNA, 22 bp, Artificial Sequence
  Synthetic
cctaggtagaugcaggctucca

SEQ ID NO: 57971 - DNA, 26 bp, Artificial Sequence
  Synthetic
gccagtgcugaatttgtcaauacaag

SEQ ID NO: 57972 - DNA, 25 bp, Artificial Sequence
  Synthetic
agatactgcugcagattttgugagt

SEQ ID NO: 57973 - DNA, 28 bp, Artificial Sequence
  Synthetic
cagtaaatggttugcaacctccaauaaa

SEQ ID NO: 57974 - DNA, 21 bp, Artificial Sequence
  Synthetic
cccctagcagguccagaauca

SEQ ID NO: 57975 - DNA, 22 bp, Artificial Sequence
  Synthetic
gcaccaccaagaagauggucat

SEQ ID NO: 57976 - DNA, 19 bp, Artificial Sequence
  Synthetic
ccatcacgutcgggcucat

SEQ ID NO: 57977 - DNA, 24 bp, Artificial Sequence
  Synthetic
ccaatgaaaatuccctgcagctug

SEQ ID NO: 57978 - DNA, 27 bp, Artificial Sequence
  Synthetic
ccatagacagutccccatgttuaaagg

SEQ ID NO: 57979 - DNA, 25 bp, Artificial Sequence
  Synthetic
agctgtctucatcagaaccucaaag

SEQ ID NO: 57980 - DNA, 26 bp, Artificial Sequence
  Synthetic
aggtcccautggttattttuaagcga

SEQ ID NO: 57981 - DNA, 28 bp, Artificial Sequence
  Synthetic
caggaacuccaaccaaatattttcaugt

SEQ ID NO: 57982 - DNA, 28 bp, Artificial Sequence
  Synthetic
tcctacatttctaauacctggtcctugt

SEQ ID NO: 57983 - DNA, 28 bp, Artificial Sequence
  Synthetic
agcaggagacauttttgtttatgugaga

SEQ ID NO: 57984 - DNA, 25 bp, Artificial Sequence
  Synthetic
gaaccaaataauagctgccccuaca

SEQ ID NO: 57985 - DNA, 22 bp, Artificial Sequence
  Synthetic
ggaagautcugaaacgggcaca

SEQ ID NO: 57986 - DNA, 26 bp, Artificial Sequence
  Synthetic
gaagatttacutcgtcgatucccaga

SEQ ID NO: 57987 - DNA, 27 bp, Artificial Sequence
  Synthetic
ggacagcacatugccaagtatatatug

SEQ ID NO: 57988 - DNA, 21 bp, Artificial Sequence
  Synthetic
gtgccugagagatgagcuacc

SEQ ID NO: 57989 - DNA, 20 bp, Artificial Sequence
  Synthetic
gaggaugtcauccgcaggaa

SEQ ID NO: 57990 - DNA, 23 bp, Artificial Sequence
  Synthetic
gcctctctttutggctggaagut

SEQ ID NO: 57991 - DNA, 22 bp, Artificial Sequence
  Synthetic
cagcccugggaaaccaagauat

SEQ ID NO: 57992 - DNA, 20 bp, Artificial Sequence
  Synthetic
agagggaggccaacaucuac

SEQ ID NO: 57993 - DNA, 23 bp, Artificial Sequence
  Synthetic
agaatgaggagaguggcucagaa

SEQ ID NO: 57994 - DNA, 21 bp, Artificial Sequence
  Synthetic
cgtacutggcctugaggagaa

SEQ ID NO: 57995 - DNA, 24 bp, Artificial Sequence
  Synthetic
cattcctttuacccttgctccugt

SEQ ID NO: 57996 - DNA, 29 bp, Artificial Sequence
  Synthetic
ctaagcgtctuctaagatcttgguaacaa

SEQ ID NO: 57997 - DNA, 25 bp, Artificial Sequence
  Synthetic
tcaatgcagaaaucgtgcuaggaaa

SEQ ID NO: 57998 - DNA, 23 bp, Artificial Sequence
  Synthetic
tcacugccccaagagcaatatuc

SEQ ID NO: 57999 - DNA, 27 bp, Artificial Sequence
  Synthetic
ccaactatgaagaugtagccaccttuc

SEQ ID NO: 58000 - DNA, 25 bp, Artificial Sequence
  Synthetic
acaaggctacautttggtcaauggt

SEQ ID NO: 58001 - DNA, 22 bp, Artificial Sequence
  Synthetic
gggagccacuttatggccaaua

SEQ ID NO: 58002 - DNA, 22 bp, Artificial Sequence
  Synthetic
cccttctcugctctggtaggut

SEQ ID NO: 58003 - DNA, 28 bp, Artificial Sequence
  Synthetic
ggagactctguctaacattttcctcuct

SEQ ID NO: 58004 - DNA, 27 bp, Artificial Sequence
  Synthetic
gcagtcaacautatgaatgccttuaca

SEQ ID NO: 58005 - DNA, 21 bp, Artificial Sequence
  Synthetic
accagugtttccguggaacat

SEQ ID NO: 58006 - DNA, 29 bp, Artificial Sequence
  Synthetic
ggcttuacagaaacagttgttatucagaa

SEQ ID NO: 58007 - DNA, 18 bp, Artificial Sequence
  Synthetic
cgggauggtgctgtugga

SEQ ID NO: 58008 - DNA, 26 bp, Artificial Sequence
  Synthetic
aatgtcattctucactttgggacuca

SEQ ID NO: 58009 - DNA, 29 bp, Artificial Sequence
  Synthetic
tgtctaatacaaaaugacgccaaactcua

SEQ ID NO: 58010 - DNA, 21 bp, Artificial Sequence
  Synthetic
cacgctctucctgaggctuaa

SEQ ID NO: 58011 - DNA, 23 bp, Artificial Sequence
  Synthetic
cutttcactcucaggagaaccca

SEQ ID NO: 58012 - DNA, 22 bp, Artificial Sequence
  Synthetic
gcatccctaguaaagggccaut

SEQ ID NO: 58013 - DNA, 28 bp, Artificial Sequence
  Synthetic
cttttgagagaacucattacccugacat

SEQ ID NO: 58014 - DNA, 21 bp, Artificial Sequence
  Synthetic
gctcaucccaacctcatgguc

SEQ ID NO: 58015 - DNA, 22 bp, Artificial Sequence
  Synthetic
gctccttgtugtagcccttcuc

SEQ ID NO: 58016 - DNA, 21 bp, Artificial Sequence
  Synthetic
gacccctacucctacaacgug

SEQ ID NO: 58017 - DNA, 21 bp, Artificial Sequence
  Synthetic
ccttggacucttccccaguct

SEQ ID NO: 58018 - DNA, 21 bp, Artificial Sequence
  Synthetic
ctauaagcccaggagcacuca

SEQ ID NO: 58019 - DNA, 27 bp, Artificial Sequence
  Synthetic
ggctctttuggaactgtttauaagggt

SEQ ID NO: 58020 - DNA, 20 bp, Artificial Sequence
  Synthetic
ccttgtugaccgctaccgua

SEQ ID NO: 58021 - DNA, 20 bp, Artificial Sequence
  Synthetic
atccaggcagutggguacac

SEQ ID NO: 58022 - DNA, 23 bp, Artificial Sequence
  Synthetic
agcagaacacutcagagcagtut

SEQ ID NO: 58023 - DNA, 22 bp, Artificial Sequence
  Synthetic
gtactcctguaggttgccctug

SEQ ID NO: 58024 - DNA, 28 bp, Artificial Sequence
  Synthetic
cacaaagutagtttaugggaaggaacct

SEQ ID NO: 58025 - DNA, 28 bp, Artificial Sequence
  Synthetic
accattcatttugaaggctagggtttua

SEQ ID NO: 58026 - DNA, 23 bp, Artificial Sequence
  Synthetic
atugcagaaagagacaucgggaa

SEQ ID NO: 58027 - DNA, 20 bp, Artificial Sequence
  Synthetic
cttggcagutgaggcccuat

SEQ ID NO: 58028 - DNA, 20 bp, Artificial Sequence
  Synthetic
ccugcugacggaagaggaag

SEQ ID NO: 58029 - DNA, 25 bp, Artificial Sequence
  Synthetic
tgaagatccagauggaggagaagut

SEQ ID NO: 58030 - DNA, 20 bp, Artificial Sequence
  Synthetic
gtctgaggaugcggcctaut

SEQ ID NO: 58031 - DNA, 21 bp, Artificial Sequence
  Synthetic
ctccttggcuccttgccauat

SEQ ID NO: 58032 - DNA, 20 bp, Artificial Sequence
  Synthetic
catguggcacgaaagctucc

SEQ ID NO: 58033 - DNA, 23 bp, Artificial Sequence
  Synthetic
gaatgaggtuggtgccttctcut

SEQ ID NO: 58034 - DNA, 23 bp, Artificial Sequence
  Synthetic
ggaggaggugggcagatatcuaa

SEQ ID NO: 58035 - DNA, 21 bp, Artificial Sequence
  Synthetic
caggaugucaaggacccagag

SEQ ID NO: 58036 - DNA, 22 bp, Artificial Sequence
  Synthetic
ccactctgggauccactcacut

SEQ ID NO: 58037 - DNA, 25 bp, Artificial Sequence
  Synthetic
ctccacatcccuctctgtactuaca

SEQ ID NO: 58038 - DNA, 24 bp, Artificial Sequence
  Synthetic
ggcacacaaauatcacacctucca

SEQ ID NO: 58039 - DNA, 23 bp, Artificial Sequence
  Synthetic
cccagatgcucttgtgtttcugt

SEQ ID NO: 58040 - DNA, 24 bp, Artificial Sequence
  Synthetic
gtgagtttugcacactgttgguaa

SEQ ID NO: 58041 - DNA, 27 bp, Artificial Sequence
  Synthetic
tcagagaagcaggcutattcattucaa

SEQ ID NO: 58042 - DNA, 28 bp, Artificial Sequence
  Synthetic
acttgaagggtautttctagagcguaga

SEQ ID NO: 58043 - DNA, 26 bp, Artificial Sequence
  Synthetic
gccattaggcauttcttcccatagua

SEQ ID NO: 58044 - DNA, 21 bp, Artificial Sequence
  Synthetic
ggguagtacugccaaccagaa

SEQ ID NO: 58045 - DNA, 28 bp, Artificial Sequence
  Synthetic
tttgctctgtatcutctctatccgttug

SEQ ID NO: 58046 - DNA, 18 bp, Artificial Sequence
  Synthetic
ccctguccgcccctcuaa

SEQ ID NO: 58047 - DNA, 18 bp, Artificial Sequence
  Synthetic
cguccccaaggacuccga

SEQ ID NO: 58048 - DNA, 20 bp, Artificial Sequence
  Synthetic
gacgugcacaacctcgacua

SEQ ID NO: 58049 - DNA, 18 bp, Artificial Sequence
  Synthetic
gccugagctcugcaggac

SEQ ID NO: 58050 - DNA, 27 bp, Artificial Sequence
  Synthetic
aagaaagacaccuagatttggugaagg

SEQ ID NO: 58051 - DNA, 27 bp, Artificial Sequence
  Synthetic
tgcaacagctttuctaggtcctaatut

SEQ ID NO: 58052 - DNA, 21 bp, Artificial Sequence
  Synthetic
ccagcucucagggaacaagaa

SEQ ID NO: 58053 - DNA, 25 bp, Artificial Sequence
  Synthetic
ccctcaccauctttgtgcttattug

SEQ ID NO: 58054 - DNA, 25 bp, Artificial Sequence
  Synthetic
tgtgagacacucttcatcagccuaa

SEQ ID NO: 58055 - DNA, 29 bp, Artificial Sequence
  Synthetic
gtatttcttttgtaugtgtcgttgctgua

SEQ ID NO: 58056 - DNA, 29 bp, Artificial Sequence
  Synthetic
aaaaggauaaacaaaaaggcatgtgucat

SEQ ID NO: 58057 - DNA, 23 bp, Artificial Sequence
  Synthetic
gctgtgccaagucagattucact

SEQ ID NO: 58058 - DNA, 25 bp, Artificial Sequence
  Synthetic
tgaagttgaaaaaugcctgcacaut

SEQ ID NO: 58059 - DNA, 28 bp, Artificial Sequence
  Synthetic
acatcagggaaaauctgaatggaauacc

SEQ ID NO: 58060 - DNA, 29 bp, Artificial Sequence
  Synthetic
agtctgctgtauattctgatgtcaaaugg

SEQ ID NO: 58061 - DNA, 21 bp, Artificial Sequence
  Synthetic
tgctguaacaggtgctucaca

SEQ ID NO: 58062 - DNA, 21 bp, Artificial Sequence
  Synthetic
ccgccuggguaagacagaaat

SEQ ID NO: 58063 - DNA, 27 bp, Artificial Sequence
  Synthetic
ggtccatgttcucatgatgtcattcuc

SEQ ID NO: 58064 - DNA, 20 bp, Artificial Sequence
  Synthetic
cttcagggcagcuaacccua

SEQ ID NO: 58065 - DNA, 26 bp, Artificial Sequence
  Synthetic
caccctatgccugtaaatcctttuct

SEQ ID NO: 58066 - DNA, 24 bp, Artificial Sequence
  Synthetic
ttctggcugatagattgucgacag

SEQ ID NO: 58067 - DNA, 28 bp, Artificial Sequence
  Synthetic
ttgttgttcaagggucttatccacttua

SEQ ID NO: 58068 - DNA, 23 bp, Artificial Sequence
  Synthetic
cccagatgcugactgttcaguag

SEQ ID NO: 58069 - DNA, 23 bp, Artificial Sequence
  Synthetic
atgcutgatggaaguggagaagg

SEQ ID NO: 58070 - DNA, 22 bp, Artificial Sequence
  Synthetic
tgcctttagggutctcgguact

SEQ ID NO: 58071 - DNA, 25 bp, Artificial Sequence
  Synthetic
gccatccugaaaagtggaauaacca

SEQ ID NO: 58072 - DNA, 21 bp, Artificial Sequence
  Synthetic
caatccaaugcatcucgcaga

SEQ ID NO: 58073 - DNA, 27 bp, Artificial Sequence
  Synthetic
gttaacatgugctttgaatgtcuccat

SEQ ID NO: 58074 - DNA, 28 bp, Artificial Sequence
  Synthetic
aaatcactcaaguggatagagcttucat

SEQ ID NO: 58075 - DNA, 25 bp, Artificial Sequence
  Synthetic
cugaagaaaaacuggaagcagcaaa

SEQ ID NO: 58076 - DNA, 26 bp, Artificial Sequence
  Synthetic
agcagtaaagaauacccatgcugaaa

SEQ ID NO: 58077 - DNA, 25 bp, Artificial Sequence
  Synthetic
acactactucagaggtcaucaagga

SEQ ID NO: 58078 - DNA, 27 bp, Artificial Sequence
  Synthetic
ggtcttgggugaagatttucaaaaagg

SEQ ID NO: 58079 - DNA, 21 bp, Artificial Sequence
  Synthetic
cagcatcguggacatccagut

SEQ ID NO: 58080 - DNA, 27 bp, Artificial Sequence
  Synthetic
tcaaatttcaauacactgaccugagca

SEQ ID NO: 58081 - DNA, 23 bp, Artificial Sequence
  Synthetic
gagggugagacgattgaatugga

SEQ ID NO: 58082 - DNA, 23 bp, Artificial Sequence
  Synthetic
ggtaatcgcuctgagagcttuct

SEQ ID NO: 58083 - DNA, 23 bp, Artificial Sequence
  Synthetic
aaatgggugcagtaccttuccaa

SEQ ID NO: 58084 - DNA, 22 bp, Artificial Sequence
  Synthetic
gccagacccucttgacauacct

SEQ ID NO: 58085 - DNA, 28 bp, Artificial Sequence
  Synthetic
cctgaaagtacautcttgtgtgaguagt

SEQ ID NO: 58086 - DNA, 29 bp, Artificial Sequence
  Synthetic
aacatattagcaccautacacaattcuca

SEQ ID NO: 58087 - DNA, 22 bp, Artificial Sequence
  Synthetic
acaatugaagggcuggaagaca

SEQ ID NO: 58088 - DNA, 22 bp, Artificial Sequence
  Synthetic
cgacctucagcagtttcgacut

SEQ ID NO: 58089 - DNA, 21 bp, Artificial Sequence
  Synthetic
tgcaatggcucgtgttttucc

SEQ ID NO: 58090 - DNA, 22 bp, Artificial Sequence
  Synthetic
ggctcugagagcaggaaugaag

SEQ ID NO: 58091 - DNA, 28 bp, Artificial Sequence
  Synthetic
cttagtagttgtgutgcatttgaggaug

SEQ ID NO: 58092 - DNA, 27 bp, Artificial Sequence
  Synthetic
gaagttttgtagggutgattgaggtut

SEQ ID NO: 58093 - DNA, 25 bp, Artificial Sequence
  Synthetic
gagaaggcuctttgtagttguagca

SEQ ID NO: 58094 - DNA, 33 bp, Artificial Sequence
  Synthetic
cactttagggtuaagagtattatagttgtgtut

SEQ ID NO: 58095 - DNA, 22 bp, Artificial Sequence
  Synthetic
ggcatgguggactcaatttcug

SEQ ID NO: 58096 - DNA, 24 bp, Artificial Sequence
  Synthetic
cagcggatgcutgtcttacaacua

SEQ ID NO: 58097 - DNA, 28 bp, Artificial Sequence
  Synthetic
tccatgaggauctaatctguaaacagga

SEQ ID NO: 58098 - DNA, 24 bp, Artificial Sequence
  Synthetic
gcccccaaauacgtaaagctguat

SEQ ID NO: 58099 - DNA, 28 bp, Artificial Sequence
  Synthetic
gcttacagtcaugccatatttgatgaug

SEQ ID NO: 58100 - DNA, 24 bp, Artificial Sequence
  Synthetic
gaacatcuggaccctgaugaagaa

SEQ ID NO: 58101 - DNA, 23 bp, Artificial Sequence
  Synthetic
gcgaaatacgutgactcctccuc

SEQ ID NO: 58102 - DNA, 23 bp, Artificial Sequence
  Synthetic
ctggaguaaaactgcggucaaaa

SEQ ID NO: 58103 - DNA, 26 bp, Artificial Sequence
  Synthetic
aactggaguacacaaggcaatgttua

SEQ ID NO: 58104 - DNA, 29 bp, Artificial Sequence
  Synthetic
cgctcaactucagaatctcacuaaaagaa

SEQ ID NO: 58105 - DNA, 25 bp, Artificial Sequence
  Synthetic
ttcaggccuaaagttggguaaaaca

SEQ ID NO: 58106 - DNA, 23 bp, Artificial Sequence
  Synthetic
tgcgaaguacaaggatgccaaua

SEQ ID NO: 58107 - DNA, 27 bp, Artificial Sequence
  Synthetic
catcatgucgattggtgucaaaaacat

SEQ ID NO: 58108 - DNA, 21 bp, Artificial Sequence
  Synthetic
ggtggaaaagaggcugctuca

SEQ ID NO: 58109 - DNA, 24 bp, Artificial Sequence
  Synthetic
ccttcttuctttcctgtuccagca

SEQ ID NO: 58110 - DNA, 26 bp, Artificial Sequence
  Synthetic
gcaaaagaaaacugaatcagctucca

SEQ ID NO: 58111 - DNA, 27 bp, Artificial Sequence
  Synthetic
aggatcagattgcutaaccttgctauc

SEQ ID NO: 58112 - DNA, 25 bp, Artificial Sequence
  Synthetic
tgattctugaggaaaacagcgugat

SEQ ID NO: 58113 - DNA, 28 bp, Artificial Sequence
  Synthetic
actttcttgttucagcttattgagcuct

SEQ ID NO: 58114 - DNA, 21 bp, Artificial Sequence
  Synthetic
caaacaguagugcgacggaga

SEQ ID NO: 58115 - DNA, 22 bp, Artificial Sequence
  Synthetic
tcctctugcaggagtcttcuga

SEQ ID NO: 58116 - DNA, 24 bp, Artificial Sequence
  Synthetic
tgtagtagacccugtgaacagugt

SEQ ID NO: 58117 - DNA, 23 bp, Artificial Sequence
  Synthetic
gcttctcutctgtacugaaagca

SEQ ID NO: 58118 - DNA, 19 bp, Artificial Sequence
  Synthetic
ccgagaacucgaagcccut

SEQ ID NO: 58119 - DNA, 26 bp, Artificial Sequence
  Synthetic
ggagttgauttattggcuggaaagga

SEQ ID NO: 58120 - DNA, 26 bp, Artificial Sequence
  Synthetic
ggttttccuggacccaataaaucagt

SEQ ID NO: 58121 - DNA, 21 bp, Artificial Sequence
  Synthetic
cgcaaguacaagttcctgcuc

SEQ ID NO: 58122 - DNA, 20 bp, Artificial Sequence
  Synthetic
gtggtcucggcttcatccut

SEQ ID NO: 58123 - DNA, 17 bp, Artificial Sequence
  Synthetic
gggcagcaucgtccugt

SEQ ID NO: 58124 - DNA, 18 bp, Artificial Sequence
  Synthetic
cacccgucaccccaauga

SEQ ID NO: 58125 - DNA, 17 bp, Artificial Sequence
  Synthetic
gcctgtccuggacggut

SEQ ID NO: 58126 - DNA, 20 bp, Artificial Sequence
  Synthetic
cccgtcccugtccttguact

SEQ ID NO: 58127 - DNA, 24 bp, Artificial Sequence
  Synthetic
ctcactctcucttcctccttcuca

SEQ ID NO: 58128 - DNA, 18 bp, Artificial Sequence
  Synthetic
ggaggcacaggugtucca

SEQ ID NO: 58129 - DNA, 24 bp, Artificial Sequence
  Synthetic
gtttgactcctutgtggtccagua

SEQ ID NO: 58130 - DNA, 28 bp, Artificial Sequence
  Synthetic
ggaaaagaagaaagagcuaagaagugga

SEQ ID NO: 58131 - DNA, 23 bp, Artificial Sequence
  Synthetic
tccgagttutctgcaactucaca

SEQ ID NO: 58132 - DNA, 21 bp, Artificial Sequence
  Synthetic
gaaggcagcuagaaaggugga

SEQ ID NO: 58133 - DNA, 27 bp, Artificial Sequence
  Synthetic
atgagcacuaaagggacacagtttuat

SEQ ID NO: 58134 - DNA, 21 bp, Artificial Sequence
  Synthetic
gacaccgaaccuctgcactua

SEQ ID NO: 58135 - DNA, 23 bp, Artificial Sequence
  Synthetic
cctcactcuggctatccttccuc

SEQ ID NO: 58136 - DNA, 22 bp, Artificial Sequence
  Synthetic
gagacugagctggugaacagat

SEQ ID NO: 58137 - DNA, 22 bp, Artificial Sequence
  Synthetic
cttacggccaucctctcttcuc

SEQ ID NO: 58138 - DNA, 22 bp, Artificial Sequence
  Synthetic
ggttcctgautttgtggccugt

SEQ ID NO: 58139 - DNA, 22 bp, Artificial Sequence
  Synthetic
cgctccatcuctctcatgtcut

SEQ ID NO: 58140 - DNA, 22 bp, Artificial Sequence
  Synthetic
cccagatcuccagacaugcaac

SEQ ID NO: 58141 - DNA, 21 bp, Artificial Sequence
  Synthetic
gacaggctgauccctttgcua

SEQ ID NO: 58142 - DNA, 26 bp, Artificial Sequence
  Synthetic
ccttggtgcaaautcatcaattguca

SEQ ID NO: 58143 - DNA, 23 bp, Artificial Sequence
  Synthetic
guggataccataugcaggaagca

SEQ ID NO: 58144 - DNA, 26 bp, Artificial Sequence
  Synthetic
tgttacctgugaaaagttacctgcuc

SEQ ID NO: 58145 - DNA, 28 bp, Artificial Sequence
  Synthetic
ttgctaccauagggatatgtgtaaucct

SEQ ID NO: 58146 - DNA, 25 bp, Artificial Sequence
  Synthetic
ggagtttgatccaugaagcagacut

SEQ ID NO: 58147 - DNA, 22 bp, Artificial Sequence
  Synthetic
ttcttgauagcgctgaugccat

SEQ ID NO: 58148 - DNA, 24 bp, Artificial Sequence
  Synthetic
acgagataaccugctcctcttuca

SEQ ID NO: 58149 - DNA, 27 bp, Artificial Sequence
  Synthetic
acaaccactgucaattatgtacgugat

SEQ ID NO: 58150 - DNA, 22 bp, Artificial Sequence
  Synthetic
catagcctcugacgtggtacuc

SEQ ID NO: 58151 - DNA, 26 bp, Artificial Sequence
  Synthetic
gttauaacaaggccttuaccccagaa

SEQ ID NO: 58152 - DNA, 28 bp, Artificial Sequence
  Synthetic
gtggacagcaaaaugatttgaaattcug

SEQ ID NO: 58153 - DNA, 23 bp, Artificial Sequence
  Synthetic
cactggguggaaaggatcatuct

SEQ ID NO: 58154 - DNA, 28 bp, Artificial Sequence
  Synthetic
gatcaacgttugagaaagaaacaugaca

SEQ ID NO: 58155 - DNA, 28 bp, Artificial Sequence
  Synthetic
ttctttccatcuttcaatgggaatucct

SEQ ID NO: 58156 - DNA, 27 bp, Artificial Sequence
  Synthetic
gccaccgcauttaaaatgtacttugat

SEQ ID NO: 58157 - DNA, 28 bp, Artificial Sequence
  Synthetic
accatgtaaaaataauggcagttgcaut

SEQ ID NO: 58158 - DNA, 24 bp, Artificial Sequence
  Synthetic
agtcugcagccaaaaagtaacuga

SEQ ID NO: 58159 - DNA, 23 bp, Artificial Sequence
  Synthetic
gctggttuttgggtguaaacact

SEQ ID NO: 58160 - DNA, 21 bp, Artificial Sequence
  Synthetic
tuggttccacaugggcaagat

SEQ ID NO: 58161 - DNA, 27 bp, Artificial Sequence
  Synthetic
cttttagaacautttgctgagauggct

SEQ ID NO: 58162 - DNA, 23 bp, Artificial Sequence
  Synthetic
aaagtgcacugtggtacucacaa

SEQ ID NO: 58163 - DNA, 28 bp, Artificial Sequence
  Synthetic
tgtcatuggaaaccaaagctaauacaga

SEQ ID NO: 58164 - DNA, 28 bp, Artificial Sequence
  Synthetic
aaaatacaacagatugtgtttggccaut

SEQ ID NO: 58165 - DNA, 24 bp, Artificial Sequence
  Synthetic
ggguacaggaaacaagatgcaugt

SEQ ID NO: 58166 - DNA, 20 bp, Artificial Sequence
  Synthetic
tcuagagccaagacgccuct

SEQ ID NO: 58167 - DNA, 22 bp, Artificial Sequence
  Synthetic
aggataaggugtcccagctuca

SEQ ID NO: 58168 - DNA, 22 bp, Artificial Sequence
  Synthetic
gccaggugacgaagaaacagut

SEQ ID NO: 58169 - DNA, 20 bp, Artificial Sequence
  Synthetic
cccttucaagcacgttguca

SEQ ID NO: 58170 - DNA, 23 bp, Artificial Sequence
  Synthetic
acguaaccccacaactcaaauca

SEQ ID NO: 58171 - DNA, 28 bp, Artificial Sequence
  Synthetic
tgtgaccattcaauaaccacagatucaa

SEQ ID NO: 58172 - DNA, 28 bp, Artificial Sequence
  Synthetic
gaaggaaguaagctacctgtuaaacagt

SEQ ID NO: 58173 - DNA, 23 bp, Artificial Sequence
  Synthetic
ccaggtatucagcgagagcttut

SEQ ID NO: 58174 - DNA, 20 bp, Artificial Sequence
  Synthetic
cgccgtguttggtcgauaga

SEQ ID NO: 58175 - DNA, 22 bp, Artificial Sequence
  Synthetic
gcaugttattcaugacgcccat

SEQ ID NO: 58176 - DNA, 25 bp, Artificial Sequence
  Synthetic
atggatgctttcutccccgatttua

SEQ ID NO: 58177 - DNA, 29 bp, Artificial Sequence
  Synthetic
atttcttaaggugcgttttcttcaatgut

SEQ ID NO: 58178 - DNA, 28 bp, Artificial Sequence
  Synthetic
gctactgagcuacacttcttattaccuc

SEQ ID NO: 58179 - DNA, 28 bp, Artificial Sequence
  Synthetic
gaaaacagatagugacccatggtaugaa

SEQ ID NO: 58180 - DNA, 26 bp, Artificial Sequence
  Synthetic
gaggaaaagugaagcaatctgcaaua

SEQ ID NO: 58181 - DNA, 31 bp, Artificial Sequence
  Synthetic
tggataaattttctcuatttgctcaggagut

SEQ ID NO: 58182 - DNA, 21 bp, Artificial Sequence
  Synthetic
cctggtgacugggaaccttut

SEQ ID NO: 58183 - DNA, 21 bp, Artificial Sequence
  Synthetic
cagatggagguggcagtucag

SEQ ID NO: 58184 - DNA, 21 bp, Artificial Sequence
  Synthetic
ggctgagcugctgctaguaac

SEQ ID NO: 58185 - DNA, 27 bp, Artificial Sequence
  Synthetic
ctttcttcctauagagtccctgttucc

SEQ ID NO: 58186 - DNA, 23 bp, Artificial Sequence
  Synthetic
cuaccaacccaccaaccugaaat

SEQ ID NO: 58187 - DNA, 20 bp, Artificial Sequence
  Synthetic
cttcugagcaggagauggca

SEQ ID NO: 58188 - DNA, 22 bp, Artificial Sequence
  Synthetic
ctagucagccaaggtagcaugt

SEQ ID NO: 58189 - DNA, 27 bp, Artificial Sequence
  Synthetic
aggatctgttguttggcttgtaguaag

SEQ ID NO: 58190 - DNA, 27 bp, Artificial Sequence
  Synthetic
gactgtuggagaagaaaguaagcaaga

SEQ ID NO: 58191 - DNA, 27 bp, Artificial Sequence
  Synthetic
tgaaggtgaaaccutagtgtgaaaugt

SEQ ID NO: 58192 - DNA, 24 bp, Artificial Sequence
  Synthetic
tcauatcctcttugcagcaacagt

SEQ ID NO: 58193 - DNA, 26 bp, Artificial Sequence
  Synthetic
tctcttuccagcaactttgctuaagt

SEQ ID NO: 58194 - DNA, 29 bp, Artificial Sequence
  Synthetic
aaaccacattccuttattcttatgacuca

SEQ ID NO: 58195 - DNA, 30 bp, Artificial Sequence
  Synthetic
ccagttcttctcuaaactgttctaatugct

SEQ ID NO: 58196 - DNA, 21 bp, Artificial Sequence
  Synthetic
ctgaaaagcuggcctuggaac

SEQ ID NO: 58197 - DNA, 25 bp, Artificial Sequence
  Synthetic
ttccacacttucacgttctctctut

SEQ ID NO: 58198 - DNA, 28 bp, Artificial Sequence
  Synthetic
cttaatgacacautagcaagugaacaga

SEQ ID NO: 58199 - DNA, 28 bp, Artificial Sequence
  Synthetic
ttgacattttagauggaggaaagcctua

SEQ ID NO: 58200 - DNA, 24 bp, Artificial Sequence
  Synthetic
gcgtaatgucaattgagatuggct

SEQ ID NO: 58201 - DNA, 23 bp, Artificial Sequence
  Synthetic
cagaggcaaugatggcttcaaug

SEQ ID NO: 58202 - DNA, 24 bp, Artificial Sequence
  Synthetic
cagaaagtttucgaaaggctcuca

SEQ ID NO: 58203 - DNA, 20 bp, Artificial Sequence
  Synthetic
cccttugggcgattggugat

SEQ ID NO: 58204 - DNA, 22 bp, Artificial Sequence
  Synthetic
gggctggtuaggagagaaauca

SEQ ID NO: 58205 - DNA, 28 bp, Artificial Sequence
  Synthetic
cgagatcctuccagatgaatcaaaatuc

SEQ ID NO: 58206 - DNA, 27 bp, Artificial Sequence
  Synthetic
acttgtatugtagtcttcugcagcaaa

SEQ ID NO: 58207 - DNA, 28 bp, Artificial Sequence
  Synthetic
catctctgttucagtactaactcugcat

SEQ ID NO: 58208 - DNA, 28 bp, Artificial Sequence
  Synthetic
gctttggagaaaguagcttaactagcut

SEQ ID NO: 58209 - DNA, 28 bp, Artificial Sequence
  Synthetic
cagtcaaaggttgutcctctagacaaua

SEQ ID NO: 58210 - DNA, 20 bp, Artificial Sequence
  Synthetic
gctcaagaaugcaggcuggt

SEQ ID NO: 58211 - DNA, 28 bp, Artificial Sequence
  Synthetic
agcattgggtgutggaaatgattauaga

SEQ ID NO: 58212 - DNA, 26 bp, Artificial Sequence
  Synthetic
caatcgtgcucatgttgatattuggt

SEQ ID NO: 58213 - DNA, 26 bp, Artificial Sequence
  Synthetic
acttgttttacucaccctttctccug

SEQ ID NO: 58214 - DNA, 27 bp, Artificial Sequence
  Synthetic
gaatggtaaggaaucgagacattgcua

SEQ ID NO: 58215 - DNA, 26 bp, Artificial Sequence
  Synthetic
caaacaaaautctacucacacgagca

SEQ ID NO: 58216 - DNA, 24 bp, Artificial Sequence
  Synthetic
cctcctacuccttggtctatucct

SEQ ID NO: 58217 - DNA, 27 bp, Artificial Sequence
  Synthetic
ttggctagaguaaatgaagacacgtut

SEQ ID NO: 58218 - DNA, 28 bp, Artificial Sequence
  Synthetic
ctcttagtatctgaguccttctccacut

SEQ ID NO: 58219 - DNA, 23 bp, Artificial Sequence
  Synthetic
gttcttgcaguggtaggtgaugt

SEQ ID NO: 58220 - DNA, 27 bp, Artificial Sequence
  Synthetic
ggaaagacuagagaagactttgtccut

SEQ ID NO: 58221 - DNA, 22 bp, Artificial Sequence
  Synthetic
ctgctctcugattcctgugcat

SEQ ID NO: 58222 - DNA, 27 bp, Artificial Sequence
  Synthetic
agttaaaccactucattagggcaagut

SEQ ID NO: 58223 - DNA, 20 bp, Artificial Sequence
  Synthetic
ggagagucacagccaucgac

SEQ ID NO: 58224 - DNA, 21 bp, Artificial Sequence
  Synthetic
ggacctttuccagtggugagt

SEQ ID NO: 58225 - DNA, 26 bp, Artificial Sequence
  Synthetic
tgtataatuccaaccagcagagucag

SEQ ID NO: 58226 - DNA, 24 bp, Artificial Sequence
  Synthetic
ccagcaccagutcgtattatgugt

SEQ ID NO: 58227 - DNA, 29 bp, Artificial Sequence
  Synthetic
gatcagcagttucatttcttagaccuagt

SEQ ID NO: 58228 - DNA, 20 bp, Artificial Sequence
  Synthetic
gcctctccugttccttcuca

SEQ ID NO: 58229 - DNA, 18 bp, Artificial Sequence
  Synthetic
gtcguaaggcagcuccga

SEQ ID NO: 58230 - DNA, 22 bp, Artificial Sequence
  Synthetic
gtgugaagacagccgtguagat

SEQ ID NO: 58231 - DNA, 20 bp, Artificial Sequence
  Synthetic
gcagagaugtcatcgcucct

SEQ ID NO: 58232 - DNA, 20 bp, Artificial Sequence
  Synthetic
actgaagcucatgcgucgag

SEQ ID NO: 58233 - DNA, 23 bp, Artificial Sequence
  Synthetic
tgactgcauccattcgtctgtut

SEQ ID NO: 58234 - DNA, 19 bp, Artificial Sequence
  Synthetic
ggaggcutggguagcacac

SEQ ID NO: 58235 - DNA, 21 bp, Artificial Sequence
  Synthetic
ttgagccucactgtccatguc

SEQ ID NO: 58236 - DNA, 21 bp, Artificial Sequence
  Synthetic
gcctgctguttgcttggaaug

SEQ ID NO: 58237 - DNA, 24 bp, Artificial Sequence
  Synthetic
cccaacttaugccactctctgtut

SEQ ID NO: 58238 - DNA, 22 bp, Artificial Sequence
  Synthetic
cggcactgcaugcaatttctut

SEQ ID NO: 58239 - DNA, 20 bp, Artificial Sequence
  Synthetic
acggtgccugttctgcuaag

SEQ ID NO: 58240 - DNA, 20 bp, Artificial Sequence
  Synthetic
catgcagcaguctcguccat

SEQ ID NO: 58241 - DNA, 22 bp, Artificial Sequence
  Synthetic
gctgaaaagauggctgtugacc

SEQ ID NO: 58242 - DNA, 22 bp, Artificial Sequence
  Synthetic
acttgctgagguactggtggua

SEQ ID NO: 58243 - DNA, 26 bp, Artificial Sequence
  Synthetic
gctaactttgggcutttcttgcauat

SEQ ID NO: 58244 - DNA, 23 bp, Artificial Sequence
  Synthetic
cggttctugaagctggtaagugg

SEQ ID NO: 58245 - DNA, 28 bp, Artificial Sequence
  Synthetic
agauaagcagcagtatttugacagacaa

SEQ ID NO: 58246 - DNA, 25 bp, Artificial Sequence
  Synthetic
aagaaacuttcgagtaucggcaaga

SEQ ID NO: 58247 - DNA, 28 bp, Artificial Sequence
  Synthetic
gcaccatagaguccattcaggattttua

SEQ ID NO: 58248 - DNA, 28 bp, Artificial Sequence
  Synthetic
cactatctctcucatttttgcttgaugg

SEQ ID NO: 58249 - DNA, 23 bp, Artificial Sequence
  Synthetic
agcatgtcuacgtgcaaatgtug

SEQ ID NO: 58250 - DNA, 25 bp, Artificial Sequence
  Synthetic
taatcatgaggcuaagagcguacac

SEQ ID NO: 58251 - DNA, 21 bp, Artificial Sequence
  Synthetic
gtattgctcugacccctccuc

SEQ ID NO: 58252 - DNA, 24 bp, Artificial Sequence
  Synthetic
cattcatattugccccgtcuaggt

SEQ ID NO: 58253 - DNA, 26 bp, Artificial Sequence
  Synthetic
catgtccttctcuaccccttttctut

SEQ ID NO: 58254 - DNA, 25 bp, Artificial Sequence
  Synthetic
ggtataccuaccccactctgaugag

SEQ ID NO: 58255 - DNA, 26 bp, Artificial Sequence
  Synthetic
cacgattgttcuttgttgtctgtcut

SEQ ID NO: 58256 - DNA, 19 bp, Artificial Sequence
  Synthetic
ggcctcucacctguagcac

SEQ ID NO: 58257 - DNA, 24 bp, Artificial Sequence
  Synthetic
gcagtcagttuggacaagacctut

SEQ ID NO: 58258 - DNA, 29 bp, Artificial Sequence
  Synthetic
agaatggaaaatagaaucaaagggctgut

SEQ ID NO: 58259 - DNA, 22 bp, Artificial Sequence
  Synthetic
gacagtaccagcugatgcauct

SEQ ID NO: 58260 - DNA, 25 bp, Artificial Sequence
  Synthetic
gctgctactutattgccaatgugaa

SEQ ID NO: 58261 - DNA, 18 bp, Artificial Sequence
  Synthetic
ctgggccacuggagucaa

SEQ ID NO: 58262 - DNA, 21 bp, Artificial Sequence
  Synthetic
gctccagtgugctagccatua

SEQ ID NO: 58263 - DNA, 22 bp, Artificial Sequence
  Synthetic
ttgcagauggcctcatactugt

SEQ ID NO: 58264 - DNA, 25 bp, Artificial Sequence
  Synthetic
gatgagcaagauaggaaggcagtua

SEQ ID NO: 58265 - DNA, 21 bp, Artificial Sequence
  Synthetic
autgttgcacuacagcaccct

SEQ ID NO: 58266 - DNA, 23 bp, Artificial Sequence
  Synthetic
gcatgacuccctctgcagauaac

SEQ ID NO: 58267 - DNA, 28 bp, Artificial Sequence
  Synthetic
ggaauatgagaagaatucagagccacat

SEQ ID NO: 58268 - DNA, 27 bp, Artificial Sequence
  Synthetic
tgagcatggauccctttttgattacut

SEQ ID NO: 58269 - DNA, 24 bp, Artificial Sequence
  Synthetic
ccagccuccaccttctatttucat

SEQ ID NO: 58270 - DNA, 28 bp, Artificial Sequence
  Synthetic
aaaaccaatctatutgcttccacttucc

SEQ ID NO: 58271 - DNA, 24 bp, Artificial Sequence
  Synthetic
ttcatcggctuctggttcttctut

SEQ ID NO: 58272 - DNA, 21 bp, Artificial Sequence
  Synthetic
ccctcaatcccucagaggcut

SEQ ID NO: 58273 - DNA, 21 bp, Artificial Sequence
  Synthetic
acctttggugccttcctcauc

SEQ ID NO: 58274 - DNA, 21 bp, Artificial Sequence
  Synthetic
caggctggucctgatacctut

SEQ ID NO: 58275 - DNA, 20 bp, Artificial Sequence
  Synthetic
ctgatggugcccctctctuc

SEQ ID NO: 58276 - DNA, 22 bp, Artificial Sequence
  Synthetic
tcccagagugacccttgtctua

SEQ ID NO: 58277 - DNA, 21 bp, Artificial Sequence
  Synthetic
ctctgagccugactcacucac

SEQ ID NO: 58278 - DNA, 22 bp, Artificial Sequence
  Synthetic
agaaatgacaccugcgtucaga

SEQ ID NO: 58279 - DNA, 24 bp, Artificial Sequence
  Synthetic
agcaaggaagccautactuacagg

SEQ ID NO: 58280 - DNA, 21 bp, Artificial Sequence
  Synthetic
acauaggtcuccagggaccat

SEQ ID NO: 58281 - DNA, 21 bp, Artificial Sequence
  Synthetic
ctttctgggcutcaagggcua

SEQ ID NO: 58282 - DNA, 21 bp, Artificial Sequence
  Synthetic
tguggagaaacagcccttucc

SEQ ID NO: 58283 - DNA, 28 bp, Artificial Sequence
  Synthetic
ttcttgcaagutcaaaaatccttucgat

SEQ ID NO: 58284 - DNA, 22 bp, Artificial Sequence
  Synthetic
cctcugaccaccagatgcttug

SEQ ID NO: 58285 - DNA, 21 bp, Artificial Sequence
  Synthetic
tcaagugcagtgttgugaggt

SEQ ID NO: 58286 - DNA, 27 bp, Artificial Sequence
  Synthetic
gaagatgtacccaugctcataactgua

SEQ ID NO: 58287 - DNA, 27 bp, Artificial Sequence
  Synthetic
tgacctgaaacgugataagaattcgut

SEQ ID NO: 58288 - DNA, 21 bp, Artificial Sequence
  Synthetic
cttgccacugctgcagatcua

SEQ ID NO: 58289 - DNA, 28 bp, Artificial Sequence
  Synthetic
cacagagaacagautttgtagacccaut

SEQ ID NO: 58290 - DNA, 28 bp, Artificial Sequence
  Synthetic
cctaggtattucaggttctttgctuaca

SEQ ID NO: 58291 - DNA, 22 bp, Artificial Sequence
  Synthetic
cuatgcaatugacccccaaacc

SEQ ID NO: 58292 - DNA, 29 bp, Artificial Sequence
  Synthetic
gattgactcgugttattactctuccagaa

SEQ ID NO: 58293 - DNA, 28 bp, Artificial Sequence
  Synthetic
tcattgcactgugttttaacttgguaac

SEQ ID NO: 58294 - DNA, 23 bp, Artificial Sequence
  Synthetic
tccatggattugggttgaaacut

SEQ ID NO: 58295 - DNA, 27 bp, Artificial Sequence
  Synthetic
ccctgcagtcaautattacttttggut

SEQ ID NO: 58296 - DNA, 20 bp, Artificial Sequence
  Synthetic
ctgcagaccuaccaccccua

SEQ ID NO: 58297 - DNA, 20 bp, Artificial Sequence
  Synthetic
catcctucgccaaccuccaa

SEQ ID NO: 58298 - DNA, 23 bp, Artificial Sequence
  Synthetic
ctcatcaccaucctggaugacaa

SEQ ID NO: 58299 - DNA, 20 bp, Artificial Sequence
  Synthetic
gcaaacuccgtguccaacct

SEQ ID NO: 58300 - DNA, 21 bp, Artificial Sequence
  Synthetic
cccctgaccagcucctttcua

SEQ ID NO: 58301 - DNA, 22 bp, Artificial Sequence
  Synthetic
gtcccttccaugagtgatguga

SEQ ID NO: 58302 - DNA, 23 bp, Artificial Sequence
  Synthetic
gctccctugacctgttgtcttut

SEQ ID NO: 58303 - DNA, 19 bp, Artificial Sequence
  Synthetic
gucggcaggactugaagca

SEQ ID NO: 58304 - DNA, 27 bp, Artificial Sequence
  Synthetic
ttugaaggcaagaagacugacaaaaag

SEQ ID NO: 58305 - DNA, 27 bp, Artificial Sequence
  Synthetic
caatggctttcugttcaagttttucca

SEQ ID NO: 58306 - DNA, 21 bp, Artificial Sequence
  Synthetic
tgagggugcatctcuagagca

SEQ ID NO: 58307 - DNA, 25 bp, Artificial Sequence
  Synthetic
ctaaccacccucccatctatttucc

SEQ ID NO: 58308 - DNA, 21 bp, Artificial Sequence
  Synthetic
agaggcaaagcgauccaucaa

SEQ ID NO: 58309 - DNA, 23 bp, Artificial Sequence
  Synthetic
ggatcgagucaacatctgcctuc

SEQ ID NO: 58310 - DNA, 23 bp, Artificial Sequence
  Synthetic
gagggagcugatggatcttuacc

SEQ ID NO: 58311 - DNA, 21 bp, Artificial Sequence
  Synthetic
caatggagccauccctcucaa

SEQ ID NO: 58312 - DNA, 20 bp, Artificial Sequence
  Synthetic
gggaguggaatccccuggat

SEQ ID NO: 58313 - DNA, 26 bp, Artificial Sequence
  Synthetic
cagacatuaagcacagcaagataugg

SEQ ID NO: 58314 - DNA, 23 bp, Artificial Sequence
  Synthetic
ccgaacautctcatcugagacct

SEQ ID NO: 58315 - DNA, 19 bp, Artificial Sequence
  Synthetic
cacccucccgagctcaaug

SEQ ID NO: 58316 - DNA, 25 bp, Artificial Sequence
  Synthetic
cttctggaacucaccatttgactug

SEQ ID NO: 58317 - DNA, 21 bp, Artificial Sequence
  Synthetic
cacggagcuctttgugaaagg

SEQ ID NO: 58318 - DNA, 22 bp, Artificial Sequence
  Synthetic
cccagauccaggacacagaauc

SEQ ID NO: 58319 - DNA, 20 bp, Artificial Sequence
  Synthetic
ccugctgcctucacacacaa

SEQ ID NO: 58320 - DNA, 22 bp, Artificial Sequence
  Synthetic
ccuacctgcatuagagcaaccc

SEQ ID NO: 58321 - DNA, 27 bp, Artificial Sequence
  Synthetic
aaguaggttucaaacaggagaaggaaa

SEQ ID NO: 58322 - DNA, 21 bp, Artificial Sequence
  Synthetic
agccuacccttccuccacaat

SEQ ID NO: 58323 - DNA, 21 bp, Artificial Sequence
  Synthetic
ttctccagcagcautctgguc

SEQ ID NO: 58324 - DNA, 18 bp, Artificial Sequence
  Synthetic
ggagagcacgcugacgut

SEQ ID NO: 58325 - DNA, 21 bp, Artificial Sequence
  Synthetic
gtagatgagguggtcccggua

SEQ ID NO: 58326 - DNA, 21 bp, Artificial Sequence
  Synthetic
tccagggcauacctcttguct

SEQ ID NO: 58327 - DNA, 22 bp, Artificial Sequence
  Synthetic
gccgcgaacutggcaaattuat

SEQ ID NO: 58328 - DNA, 17 bp, Artificial Sequence
  Synthetic
cgaaggcaccguccuct

SEQ ID NO: 58329 - DNA, 28 bp, Artificial Sequence
  Synthetic
gtaacactagatucagcaattcctcuga

SEQ ID NO: 58330 - DNA, 28 bp, Artificial Sequence
  Synthetic
tgaagataccagauccttggagattuct

SEQ ID NO: 58331 - DNA, 28 bp, Artificial Sequence
  Synthetic
aggtgatcttttatuacttcccagccua

SEQ ID NO: 58332 - DNA, 28 bp, Artificial Sequence
  Synthetic
gaggtttctgaaaugtgtatagcttguc

SEQ ID NO: 58333 - DNA, 25 bp, Artificial Sequence
  Synthetic
cgcagauagggctacaggauaaaac

SEQ ID NO: 58334 - DNA, 28 bp, Artificial Sequence
  Synthetic
tcattttggaagutcactggtctaugaa

SEQ ID NO: 58335 - DNA, 28 bp, Artificial Sequence
  Synthetic
tcatcatgtatacutacagggctttugg

SEQ ID NO: 58336 - DNA, 27 bp, Artificial Sequence
  Synthetic
cactgctatttugtattcactgtugct

SEQ ID NO: 58337 - DNA, 24 bp, Artificial Sequence
  Synthetic
gggatagagcgaauacacagacuc

SEQ ID NO: 58338 - DNA, 27 bp, Artificial Sequence
  Synthetic
gtgaagttttgtuaaccacttgtgcua

SEQ ID NO: 58339 - DNA, 22 bp, Artificial Sequence
  Synthetic
tcatgaaaucctaggccuccca

SEQ ID NO: 58340 - DNA, 28 bp, Artificial Sequence
  Synthetic
acaggagaatauggaaatctggtgacua

SEQ ID NO: 58341 - DNA, 25 bp, Artificial Sequence
  Synthetic
cactaaaacuctaagggcuaagcca

SEQ ID NO: 58342 - DNA, 21 bp, Artificial Sequence
  Synthetic
accgccugcaatagctugaaa

SEQ ID NO: 58343 - DNA, 22 bp, Artificial Sequence
  Synthetic
gcattggcautcatgtuggcat

SEQ ID NO: 58344 - DNA, 23 bp, Artificial Sequence
  Synthetic
ctgacutctttctcugcccacat

SEQ ID NO: 58345 - DNA, 19 bp, Artificial Sequence
  Synthetic
gcauggcgaaggcaaagut

SEQ ID NO: 58346 - DNA, 21 bp, Artificial Sequence
  Synthetic
ggccttgguccagagcuaaag

SEQ ID NO: 58347 - DNA, 21 bp, Artificial Sequence
  Synthetic
cccttgautctgacacuggca

SEQ ID NO: 58348 - DNA, 20 bp, Artificial Sequence
  Synthetic
gggtcgaguccagugagaaa

SEQ ID NO: 58349 - DNA, 18 bp, Artificial Sequence
  Synthetic
ctgcccauctgcgaguca

SEQ ID NO: 58350 - DNA, 27 bp, Artificial Sequence
  Synthetic
gtcctatggcauttgggatauaagcat

SEQ ID NO: 58351 - DNA, 26 bp, Artificial Sequence
  Synthetic
ctaagctttugaagcattcggtcaut

SEQ ID NO: 58352 - DNA, 23 bp, Artificial Sequence
  Synthetic
gttcatucccaaacacacgaguc

SEQ ID NO: 58353 - DNA, 27 bp, Artificial Sequence
  Synthetic
gtacctttgcauaatcctggtgtttut

SEQ ID NO: 58354 - DNA, 20 bp, Artificial Sequence
  Synthetic
tgccagacacutcagugcat

SEQ ID NO: 58355 - DNA, 27 bp, Artificial Sequence
  Synthetic
ccagctttctcuaaagaactccttuct

SEQ ID NO: 58356 - DNA, 23 bp, Artificial Sequence
  Synthetic
gggtcacacugagatttcugaaa

SEQ ID NO: 58357 - DNA, 23 bp, Artificial Sequence
  Synthetic
gatggctguggagatcaatguca

SEQ ID NO: 58358 - DNA, 29 bp, Artificial Sequence
  Synthetic
catttaagguaaaagctaacagtcugcat

SEQ ID NO: 58359 - DNA, 30 bp, Artificial Sequence; identical to SEQ ID NO: 26763
  Synthetic

SEQ ID NO: 58360 - DNA, 27 bp, Artificial Sequence
  Synthetic
caaaggcagaauatatcctgactucct

SEQ ID NO: 58361 - DNA, 25 bp, Artificial Sequence
  Synthetic
ggagacuacccaaaagcaaatggut

SEQ ID NO: 58362 - DNA, 23 bp, Artificial Sequence
  Synthetic
cagctcauagggaagtgatgcuc

SEQ ID NO: 58363 - DNA, 22 bp, Artificial Sequence
  Synthetic
tgaaaacauggcccactgctua

SEQ ID NO: 58364 - DNA, 21 bp, Artificial Sequence
  Synthetic
gtagggcautagctggugact

SEQ ID NO: 58365 - DNA, 24 bp, Artificial Sequence
  Synthetic
aaccagaattttugccagcagaug

SEQ ID NO: 58366 - DNA, 30 bp, Artificial Sequence
  Synthetic
ttgtttcattccaaautggagatguagaga

SEQ ID NO: 58367 - DNA, 27 bp, Artificial Sequence
  Synthetic
tccactatucagtaagagtuccaccaa

SEQ ID NO: 58368 - DNA, 28 bp, Artificial Sequence
  Synthetic
cttgcctcctuctatgacaatccuaaaa

SEQ ID NO: 58369 - DNA, 28 bp, Artificial Sequence
  Synthetic
catgtttctaaaggutctgttccagcua

SEQ ID NO: 58370 - DNA, 29 bp, Artificial Sequence
  Synthetic
ctttgcaatguctggaccttttauaaaca

SEQ ID NO: 58371 - DNA, 26 bp, Artificial Sequence
  Synthetic
aggcctttctugaggattttcttuca

SEQ ID NO: 58372 - DNA, 28 bp, Artificial Sequence
  Synthetic
gtaaaggaagccutaaaaatgtcaugct

SEQ ID NO: 58373 - DNA, 24 bp, Artificial Sequence
  Synthetic
catcattcacaucattgccctgut

SEQ ID NO: 58374 - DNA, 21 bp, Artificial Sequence
  Synthetic
cccugtgggcaugagaagaag

SEQ ID NO: 58375 - DNA, 28 bp, Artificial Sequence
  Synthetic
ggttcattctutgctgcttattugacaa

SEQ ID NO: 58376 - DNA, 23 bp, Artificial Sequence
  Synthetic
ccagtcttgcucctcaagauacc

SEQ ID NO: 58377 - DNA, 25 bp, Artificial Sequence
  Synthetic
ggtgtcttcccacuataaccatcuc

SEQ ID NO: 58378 - DNA, 21 bp, Artificial Sequence
  Synthetic
gcgccgttutcctaacagtut

SEQ ID NO: 58379 - DNA, 23 bp, Artificial Sequence
  Synthetic
gcctccacuatgtttcgaaugac

SEQ ID NO: 58380 - DNA, 27 bp, Artificial Sequence
  Synthetic
aaaagaaggauaaagagatggcagguc

SEQ ID NO: 58381 - DNA, 27 bp, Artificial Sequence
  Synthetic
agtatgacaagcutctcattgctgaut

SEQ ID NO: 58382 - DNA, 26 bp, Artificial Sequence
  Synthetic
tcagttttaccucattgctttcugct

SEQ ID NO: 58383 - DNA, 27 bp, Artificial Sequence
  Synthetic
atttaagctggaggauttgttggttug

SEQ ID NO: 58384 - DNA, 24 bp, Artificial Sequence
  Synthetic
atcagctuccaacgaatucagact

SEQ ID NO: 58385 - DNA, 23 bp, Artificial Sequence
  Synthetic
ccuaaaaagccagagaccucact

SEQ ID NO: 58386 - DNA, 20 bp, Artificial Sequence
  Synthetic
tcagagauggccctgctgua

SEQ ID NO: 58387 - DNA, 21 bp, Artificial Sequence
  Synthetic
cuttcagucgggaggcaagat

SEQ ID NO: 58388 - DNA, 22 bp, Artificial Sequence
  Synthetic
ctcagctgcguctttcttcuct

SEQ ID NO: 58389 - DNA, 27 bp, Artificial Sequence
  Synthetic
accaagtgcuaaggattctttcatuga

SEQ ID NO: 58390 - DNA, 24 bp, Artificial Sequence
  Synthetic
gctttgctttucacagtgtttuct

SEQ ID NO: 58391 - DNA, 28 bp, Artificial Sequence
  Synthetic
gcaatgtaacuctttttgggcttugaat

SEQ ID NO: 58392 - DNA, 21 bp, Artificial Sequence
  Synthetic
catcuccccacacctccttug

SEQ ID NO: 58393 - DNA, 22 bp, Artificial Sequence
  Synthetic
agaagtcuccctgttctgucct

SEQ ID NO: 58394 - DNA, 26 bp, Artificial Sequence
  Synthetic
cacgaggatcaugactcggaaaauaa

SEQ ID NO: 58395 - DNA, 25 bp, Artificial Sequence
  Synthetic
ttccacuaataaaccttugcccact

SEQ ID NO: 58396 - DNA, 31 bp, Artificial Sequence
  Synthetic
tataatatgtgcutcttaccagucaaaaagt

SEQ ID NO: 58397 - DNA, 27 bp, Artificial Sequence
  Synthetic
ctctgcaugaagaccgagttauagaat

SEQ ID NO: 58398 - DNA, 28 bp, Artificial Sequence
  Synthetic
gctatttccttutgtgaattctguccca

SEQ ID NO: 58399 - DNA, 21 bp, Artificial Sequence
  Synthetic
ccuggauccaaaggagagcaa

SEQ ID NO: 58400 - DNA, 23 bp, Artificial Sequence
  Synthetic
ctccctgtgugttatggctcaut

SEQ ID NO: 58401 - DNA, 21 bp, Artificial Sequence
  Synthetic
gttcaccuggcttaccuggag

SEQ ID NO: 58402 - DNA, 24 bp, Artificial Sequence
  Synthetic
agcttctguggtgttttgatguct

SEQ ID NO: 58403 - DNA, 22 bp, Artificial Sequence
  Synthetic
acgctgacugttggtctttcuc

SEQ ID NO: 58404 - DNA, 23 bp, Artificial Sequence
  Synthetic
cgcctttcuattacactcuggct

SEQ ID NO: 58405 - DNA, 21 bp, Artificial Sequence
  Synthetic
gtgaccgaggauttcctggua

SEQ ID NO: 58406 - DNA, 23 bp, Artificial Sequence
  Synthetic
gtcctcgauctcattctguagcc

SEQ ID NO: 58407 - DNA, 26 bp, Artificial Sequence
  Synthetic
gctacacttcugaggtttcaaggaut

SEQ ID NO: 58408 - DNA, 24 bp, Artificial Sequence
  Synthetic
gggaaggcucatatcugagaccat

SEQ ID NO: 58409 - DNA, 20 bp, Artificial Sequence
  Synthetic
gucctguaccgcagaaaggg

SEQ ID NO: 58410 - DNA, 21 bp, Artificial Sequence
  Synthetic
cccagutccctucaggaagac

SEQ ID NO: 58411 - DNA, 24 bp, Artificial Sequence
  Synthetic
gcaagtcacugctccttttctauc

SEQ ID NO: 58412 - DNA, 21 bp, Artificial Sequence
  Synthetic
acttttacgcacugctgguga

SEQ ID NO: 58413 - DNA, 28 bp, Artificial Sequence
  Synthetic
ctggcttatttcucctcctattctccua

SEQ ID NO: 58414 - DNA, 33 bp, Artificial Sequence
  Synthetic
gaaaaatgtuccatttattactcuaacaagacc

SEQ ID NO: 58415 - DNA, 28 bp, Artificial Sequence
  Synthetic
gctcgcatugcagttttagttaattuga

SEQ ID NO: 58416 - DNA, 26 bp, Artificial Sequence
  Synthetic
tcagacaguttaacagaucgggaaac

SEQ ID NO: 58417 - DNA, 23 bp, Artificial Sequence
  Synthetic
gcctttgacacuggagaacugaa

SEQ ID NO: 58418 - DNA, 28 bp, Artificial Sequence
  Synthetic
ccattccactcugtgtagaattatcuca

SEQ ID NO: 58419 - DNA, 26 bp, Artificial Sequence
  Synthetic
aggcaaccagaggutaaagaaaugaa

SEQ ID NO: 58420 - DNA, 21 bp, Artificial Sequence
  Synthetic
cgtgtcucaagttcuccagca

SEQ ID NO: 58421 - DNA, 25 bp, Artificial Sequence
  Synthetic
tgattctgttucctaccctgtcuct

SEQ ID NO: 58422 - DNA, 23 bp, Artificial Sequence
  Synthetic
gattctctgccugcacatcttug

SEQ ID NO: 58423 - DNA, 20 bp, Artificial Sequence
  Synthetic
gggaatgugctgtgcctaug

SEQ ID NO: 58424 - DNA, 24 bp, Artificial Sequence
  Synthetic
cagagccacautcattgatgtcut

SEQ ID NO: 58425 - DNA, 22 bp, Artificial Sequence
  Synthetic
acatgccgcutcttatttugcc

SEQ ID NO: 58426 - DNA, 22 bp, Artificial Sequence
  Synthetic
gcactgcccaugactgcataua

SEQ ID NO: 58427 - DNA, 29 bp, Artificial Sequence
  Synthetic
gactatgcctgguaaatgagagtaagtut

SEQ ID NO: 58428 - DNA, 25 bp, Artificial Sequence
  Synthetic
caacacaaaauagcctaucgggagt

SEQ ID NO: 58429 - DNA, 28 bp, Artificial Sequence
  Synthetic
gcttatgtttgggugtttgttcttctua

SEQ ID NO: 58430 - DNA, 23 bp, Artificial Sequence
  Synthetic
cttcacagtucttcccatcucgt

SEQ ID NO: 58431 - DNA, 25 bp, Artificial Sequence
  Synthetic
ccaagatcaugagtttgcaaaugga

SEQ ID NO: 58432 - DNA, 21 bp, Artificial Sequence
  Synthetic
tgacttgtguaacccccugga

SEQ ID NO: 58433 - DNA, 21 bp, Artificial Sequence
  Synthetic
gccctccccuaccatactuga

SEQ ID NO: 58434 - DNA, 17 bp, Artificial Sequence
  Synthetic
gactggcgugtcgucct

SEQ ID NO: 58435 - DNA, 24 bp, Artificial Sequence
  Synthetic
tgttataaggcuggccatgaagug

SEQ ID NO: 58436 - DNA, 18 bp, Artificial Sequence
  Synthetic
ctatggtgguggcggcua

SEQ ID NO: 58437 - DNA, 17 bp, Artificial Sequence
  Synthetic
cgucccagguggacaca

SEQ ID NO: 58438 - DNA, 22 bp, Artificial Sequence
  Synthetic
ggcgttccuccagaaagaaauc

SEQ ID NO: 58439 - DNA, 21 bp, Artificial Sequence
  Synthetic
tgcaggtacucacgttggtuc

SEQ ID NO: 58440 - DNA, 18 bp, Artificial Sequence
  Synthetic
gagauggcgccttccuct

SEQ ID NO: 58441 - DNA, 17 bp, Artificial Sequence
  Synthetic
tcagcacggugcucaca

SEQ ID NO: 58442 - DNA, 21 bp, Artificial Sequence
  Synthetic
cagggutctuggagagcacat

SEQ ID NO: 58443 - DNA, 18 bp, Artificial Sequence
  Synthetic
ctgacgucacccauccca

SEQ ID NO: 58444 - DNA, 21 bp, Artificial Sequence
  Synthetic
ctgctcacautccgtctcuct

SEQ ID NO: 58445 - DNA, 21 bp, Artificial Sequence
  Synthetic
cagcucacugcacacagaaac

SEQ ID NO: 58446 - DNA, 20 bp, Artificial Sequence
  Synthetic
gagctgtcuaacgcccucat

SEQ ID NO: 58447 - DNA, 18 bp, Artificial Sequence
  Synthetic
ggagccacautgccguca

SEQ ID NO: 58448 - DNA, 19 bp, Artificial Sequence
  Synthetic
gaggtuaaggcccggucac

SEQ ID NO: 58449 - DNA, 23 bp, Artificial Sequence
  Synthetic
tttaaggcguccctctctacuct

SEQ ID NO: 58450 - DNA, 17 bp, Artificial Sequence
  Synthetic
ggaaaguggcggcccua

SEQ ID NO: 58451 - DNA, 21 bp, Artificial Sequence
  Synthetic
gtgtccagcguggttgtcuat

SEQ ID NO: 58452 - DNA, 21 bp, Artificial Sequence
  Synthetic
gtccaccccauacagcaugat

SEQ ID NO: 58453 - DNA, 18 bp, Artificial Sequence
  Synthetic
gcuccttgagugcgcaca

SEQ ID NO: 58454 - DNA, 18 bp, Artificial Sequence
  Synthetic
aacggagtuggcggagut

SEQ ID NO: 58455 - DNA, 21 bp, Artificial Sequence
  Synthetic
tcgauggcatuccagacacag

SEQ ID NO: 58456 - DNA, 17 bp, Artificial Sequence
  Synthetic
gcgtauctgggcucggt

SEQ ID NO: 58457 - DNA, 19 bp, Artificial Sequence
  Synthetic
ccgcaucacacagcgtcua

SEQ ID NO: 58458 - DNA, 18 bp, Artificial Sequence
  Synthetic
aggcatugagccggaugg

SEQ ID NO: 58459 - DNA, 19 bp, Artificial Sequence
  Synthetic
ctgtgaguggccucagcat

SEQ ID NO: 58460 - DNA, 23 bp, Artificial Sequence
  Synthetic
cgaagttuccacaccaaccauga

SEQ ID NO: 58461 - DNA, 19 bp, Artificial Sequence
  Synthetic
caacaugcaggcgcucaag

SEQ ID NO: 58462 - DNA, 19 bp, Artificial Sequence
  Synthetic
ctccuccccacagaacugg

SEQ ID NO: 58463 - DNA, 24 bp, Artificial Sequence
  Synthetic
caagcaggagguggaacauaagaa

SEQ ID NO: 58464 - DNA, 21 bp, Artificial Sequence
  Synthetic
actctagggccuaccccatut

SEQ ID NO: 58465 - DNA, 29 bp, Artificial Sequence
  Synthetic
cgctgacatttgutttatactgtgttgut

SEQ ID NO: 58466 - DNA, 23 bp, Artificial Sequence
  Synthetic
gctctacctcucaccatggacuc

SEQ ID NO: 58467 - DNA, 22 bp, Artificial Sequence
  Synthetic
gggctaaggacuctgtctccua

SEQ ID NO: 58468 - DNA, 20 bp, Artificial Sequence
  Synthetic
tcagcccagcaccutaggua

SEQ ID NO: 58469 - DNA, 21 bp, Artificial Sequence
  Synthetic
gaucgctgagaucgagaagca

SEQ ID NO: 58470 - DNA, 21 bp, Artificial Sequence
  Synthetic
ggtuggagaagagcucaccat

SEQ ID NO: 58471 - DNA, 28 bp, Artificial Sequence
  Synthetic
tctcgtcttaacutttcttgacccttut

SEQ ID NO: 58472 - DNA, 21 bp, Artificial Sequence
  Synthetic
gtccttgugggtgaactccuc

SEQ ID NO: 58473 - DNA, 22 bp, Artificial Sequence
  Synthetic
gctgtgaccaugtgttctcugt

SEQ ID NO: 58474 - DNA, 24 bp, Artificial Sequence
  Synthetic
ccacgcaucaagagaguaaaccaa

SEQ ID NO: 58475 - DNA, 22 bp, Artificial Sequence
  Synthetic
cttaccuggaccagtacctgug

SEQ ID NO: 58476 - DNA, 25 bp, Artificial Sequence
  Synthetic
gcccaacaugggcaaatatatacug

SEQ ID NO: 58477 - DNA, 24 bp, Artificial Sequence
  Synthetic
tttgactaagcuggtggtggauag

SEQ ID NO: 58478 - DNA, 22 bp, Artificial Sequence
  Synthetic
gggaaacagacugcaaaagugg

SEQ ID NO: 58479 - DNA, 21 bp, Artificial Sequence
  Synthetic
tccgccaugacaaaagggtut

SEQ ID NO: 58480 - DNA, 26 bp, Artificial Sequence
  Synthetic
ggtccaaaagacagugaagattccua

SEQ ID NO: 58481 - DNA, 27 bp, Artificial Sequence
  Synthetic
actgttttctgautgtctcacauccat

SEQ ID NO: 58482 - DNA, 24 bp, Artificial Sequence
  Synthetic
tcctaagccuaactgctugagagt

SEQ ID NO: 58483 - DNA, 25 bp, Artificial Sequence
  Synthetic
cctacccauccgttaagattggtua

SEQ ID NO: 58484 - DNA, 20 bp, Artificial Sequence
  Synthetic
gcagccacacgagutcugaa

SEQ ID NO: 58485 - DNA, 25 bp, Artificial Sequence
  Synthetic
tctggatuggaatcgtgagucaaat

SEQ ID NO: 58486 - DNA, 22 bp, Artificial Sequence
  Synthetic
agccggcccagauttatttuca

SEQ ID NO: 58487 - DNA, 22 bp, Artificial Sequence
  Synthetic
cgagtcucacctcgauacacca

SEQ ID NO: 58488 - DNA, 20 bp, Artificial Sequence
  Synthetic
gctctcugagcgaagucact

SEQ ID NO: 58489 - DNA, 21 bp, Artificial Sequence
  Synthetic
gagaataagugcagcccuggt

SEQ ID NO: 58490 - DNA, 22 bp, Artificial Sequence
  Synthetic
gtgtgatgauggtgaggauggg

SEQ ID NO: 58491 - DNA, 21 bp, Artificial Sequence
  Synthetic
cctcatctugggcctgtgtua

SEQ ID NO: 58492 - DNA, 21 bp, Artificial Sequence
  Synthetic
cctcacaaccuccgtcatgug

SEQ ID NO: 58493 - DNA, 26 bp, Artificial Sequence
  Synthetic
actttcaactctguctccttcctcut

SEQ ID NO: 58494 - DNA, 24 bp, Artificial Sequence
  Synthetic
agaacctggugatgtccaagtaug

SEQ ID NO: 58495 - DNA, 28 bp, Artificial Sequence
  Synthetic
ccctggatcagagaauagagagattcua

SEQ ID NO: 58496 - DNA, 28 bp, Artificial Sequence
  Synthetic
ccagggaacaagaaacucatctattuca

SEQ ID NO: 58497 - DNA, 22 bp, Artificial Sequence
  Synthetic
ccgtucaggcagaauagagact

SEQ ID NO: 58498 - DNA, 22 bp, Artificial Sequence
  Synthetic
gcttcucaagagaagggcaugt

SEQ ID NO: 58499 - DNA, 23 bp, Artificial Sequence
  Synthetic
ctccccaauaccattugcaaagt

SEQ ID NO: 58500 - DNA, 20 bp, Artificial Sequence
  Synthetic
catgtccguggagaaugcca

SEQ ID NO: 58501 - DNA, 22 bp, Artificial Sequence
  Synthetic
agtgggaacutctgtgcucaac

SEQ ID NO: 58502 - DNA, 21 bp, Artificial Sequence
  Synthetic
ctgggctcugggtctgatcua

SEQ ID NO: 58503 - DNA, 20 bp, Artificial Sequence
  Synthetic
tccccgcugactagtctugt

SEQ ID NO: 58504 - DNA, 23 bp, Artificial Sequence
  Synthetic
cgtctgagacutccaactgtcug

SEQ ID NO: 58505 - DNA, 20 bp, Artificial Sequence
  Synthetic
aaacuccgcugagcagaact

SEQ ID NO: 58506 - DNA, 21 bp, Artificial Sequence
  Synthetic
gcauaccccaagcuccaaagg

SEQ ID NO: 58507 - DNA, 24 bp, Artificial Sequence
  Synthetic
tgctgtgcaacucttataggagug

SEQ ID NO: 58508 - DNA, 21 bp, Artificial Sequence
  Synthetic
gctccaacuggagacucacct

SEQ ID NO: 58509 - DNA, 20 bp, Artificial Sequence
  Synthetic
gctccaaugccctcctgtuc

SEQ ID NO: 58510 - DNA, 24 bp, Artificial Sequence
  Synthetic
agggccagutactagagacaucag

SEQ ID NO: 58511 - DNA, 29 bp, Artificial Sequence
  Synthetic
ttgctaaauccagaaatacactctuccaa

SEQ ID NO: 58512 - DNA, 18 bp, Artificial Sequence
  Synthetic
gtcccuccccugaggaca

SEQ ID NO: 58513 - DNA, 19 bp, Artificial Sequence
  Synthetic
cgtcccagcugctcaaguc

SEQ ID NO: 58514 - DNA, 17 bp, Artificial Sequence
  Synthetic
gctccccucctgccuga

SEQ ID NO: 58515 - DNA, 17 bp, Artificial Sequence
  Synthetic
atcgacgucgcggtcut

SEQ ID NO: 58516 - DNA, 22 bp, Artificial Sequence
  Synthetic
gagtccgcuggagtcatctcua

SEQ ID NO: 58517 - DNA, 21 bp, Artificial Sequence
  Synthetic
gcctcaagguattgcuggaca

SEQ ID NO: 58518 - DNA, 25 bp, Artificial Sequence
  Synthetic
gttgatggcugtctgattagcuagg

SEQ ID NO: 58519 - DNA, 26 bp, Artificial Sequence
  Synthetic
agattctaaacctuccctcccttcut

SEQ ID NO: 58520 - DNA, 20 bp, Artificial Sequence
  Synthetic
gggacucccccagaagacua

SEQ ID NO: 58521 - DNA, 23 bp, Artificial Sequence
  Synthetic
actctcagcucatcctcttcucc

SEQ ID NO: 58522 - DNA, 22 bp, Artificial Sequence
  Synthetic
cacagagaaaggagugucagca

SEQ ID NO: 58523 - DNA, 22 bp, Artificial Sequence
  Synthetic
ccagggtggcutctgatatguc

SEQ ID NO: 58524 - DNA, 19 bp, Artificial Sequence
  Synthetic
ggaagccccgutaagucca

SEQ ID NO: 58525 - DNA, 26 bp, Artificial Sequence
  Synthetic
ctcatctgactuctcttggtttggut

SEQ ID NO: 58526 - DNA, 19 bp, Artificial Sequence
  Synthetic
gccacgugtggatguccaa

SEQ ID NO: 58527 - DNA, 20 bp, Artificial Sequence
  Synthetic
ctccgtctugatgtgcgtuc

SEQ ID NO: 58528 - DNA, 21 bp, Artificial Sequence
  Synthetic
catcuacgcccuccagagaaa

SEQ ID NO: 58529 - DNA, 20 bp, Artificial Sequence
  Synthetic
acatauggaggcucgggact

SEQ ID NO: 58530 - DNA, 22 bp, Artificial Sequence
  Synthetic
ctggaagaagacautgcccugt

SEQ ID NO: 58531 - DNA, 20 bp, Artificial Sequence
  Synthetic
tcacuggagggucgaacact

SEQ ID NO: 58532 - DNA, 21 bp, Artificial Sequence
  Synthetic
gcacgaucctgaucgagagga

SEQ ID NO: 58533 - DNA, 22 bp, Artificial Sequence
  Synthetic
ccttccaggagutcatgtcuga

SEQ ID NO: 58534 - DNA, 20 bp, Artificial Sequence
  Synthetic
tgccgcaagugtctagctuc

SEQ ID NO: 58535 - DNA, 28 bp, Artificial Sequence
  Synthetic
gcttgtaatcugctttttgatgucacat

SEQ ID NO: 58536 - DNA, 19 bp, Artificial Sequence
  Synthetic
ggcctcucagtcccgtgua

SEQ ID NO: 58537 - DNA, 17 bp, Artificial Sequence
  Synthetic
cccggcucagcacacuc

SEQ ID NO: 58538 - DNA, 17 bp, Artificial Sequence
  Synthetic
ccugcguccagcgagag

SEQ ID NO: 58539 - DNA, 22 bp, Artificial Sequence
  Synthetic
tcagcauggagacaaccaagug

SEQ ID NO: 58540 - DNA, 18 bp, Artificial Sequence
  Synthetic
gaccccagagcgugttug

SEQ ID NO: 58541 - DNA, 17 bp, Artificial Sequence
  Synthetic
cagcagcugggcacgua

SEQ ID NO: 58542 - DNA, 22 bp, Artificial Sequence
  Synthetic
tgctctccauggtcctgaatug

SEQ ID NO: 58543 - DNA, 25 bp, Artificial Sequence
  Synthetic
aagaggtgucagatccaauaggact

SEQ ID NO: 58544 - DNA, 21 bp, Artificial Sequence
  Synthetic
ctggtgccuacacacccttua

SEQ ID NO: 58545 - DNA, 23 bp, Artificial Sequence
  Synthetic
gggttgagaggutctgagttcug

SEQ ID NO: 58546 - DNA, 19 bp, Artificial Sequence
  Synthetic
gacugaggguggcagaact

SEQ ID NO: 58547 - DNA, 17 bp, Artificial Sequence
  Synthetic
cccugggccctcactug

SEQ ID NO: 58548 - DNA, 19 bp, Artificial Sequence
  Synthetic
gcucttugcgggcacagaa

SEQ ID NO: 58549 - DNA, 19 bp, Artificial Sequence
  Synthetic
caccugcagagcgacauga

SEQ ID NO: 58550 - DNA, 21 bp, Artificial Sequence
  Synthetic
cactgttcauctccccuagca

SEQ ID NO: 58551 - DNA, 20 bp, Artificial Sequence
  Synthetic
tcacaccugaaccgtcucac

SEQ ID NO: 58552 - DNA, 17 bp, Artificial Sequence
  Synthetic
ctgcgaggccucagcua

SEQ ID NO: 58553 - DNA, 17 bp, Artificial Sequence
  Synthetic
gagctcggucaccguca

SEQ ID NO: 58554 - DNA, 18 bp, Artificial Sequence
  Synthetic
gggcgccugagattguga

SEQ ID NO: 58555 - DNA, 18 bp, Artificial Sequence
  Synthetic
cucacgcaggucagcaac

SEQ ID NO: 58556 - DNA, 20 bp, Artificial Sequence
  Synthetic
ggagtcctuggtccccaaug

SEQ ID NO: 58557 - DNA, 21 bp, Artificial Sequence
  Synthetic
ctcctcuccatcgtcuccaga

SEQ ID NO: 58558 - DNA, 20 bp, Artificial Sequence
  Synthetic
gggaaagaggccugagaguc

SEQ ID NO: 58559 - DNA, 21 bp, Artificial Sequence
  Synthetic
gctgtcccagcauctgtctuc

SEQ ID NO: 58560 - DNA, 22 bp, Artificial Sequence
  Synthetic
ggacaaaaggagcaagucugga

SEQ ID NO: 58561 - DNA, 26 bp, Artificial Sequence
  Synthetic
tgatatttgcagcuggacatcgatua

SEQ ID NO: 58562 - DNA, 23 bp, Artificial Sequence
  Synthetic
ccaggtggacagauacagcgaua

SEQ ID NO: 58563 - DNA, 22 bp, Artificial Sequence
  Synthetic
acagtcatgcuaaaccgcugaa

SEQ ID NO: 58564 - DNA, 22 bp, Artificial Sequence
  Synthetic
gagguagagaagcaguggaaca

SEQ ID NO: 58565 - DNA, 21 bp, Artificial Sequence
  Synthetic
gccatccugtctgtgaauggg

SEQ ID NO: 58566 - DNA, 24 bp, Artificial Sequence
  Synthetic
ggacctguagataccatacuccca

SEQ ID NO: 58567 - DNA, 23 bp, Artificial Sequence
  Synthetic
ctgattctctccucctccctcut

SEQ ID NO: 58568 - DNA, 18 bp, Artificial Sequence
  Synthetic
acugcuaggccaggaggt

SEQ ID NO: 58569 - DNA, 19 bp, Artificial Sequence
  Synthetic
ctcaggcccauccctacuc

SEQ ID NO: 58570 - DNA, 21 bp, Artificial Sequence
  Synthetic
gccauccatctuggagacagt

SEQ ID NO: 58571 - DNA, 23 bp, Artificial Sequence
  Synthetic
cggacggaaaaagagucucagaa

SEQ ID NO: 58572 - DNA, 27 bp, Artificial Sequence
  Synthetic
tcctcaaacagauaactcacttccuca

SEQ ID NO: 58573 - DNA, 24 bp, Artificial Sequence
  Synthetic
gttgacctggagutgtcatcctut

SEQ ID NO: 58574 - DNA, 21 bp, Artificial Sequence
  Synthetic
ggcaagcucaggttucccaat

SEQ ID NO: 58575 - DNA, 24 bp, Artificial Sequence
  Synthetic
gagaatgaacaugcccattuccag

SEQ ID NO: 58576 - DNA, 26 bp, Artificial Sequence
  Synthetic
ccaagaaccaggaaaaucaatctgut

SEQ ID NO: 58577 - DNA, 21 bp, Artificial Sequence
  Synthetic
gatctcccgcuggtacttuga

SEQ ID NO: 58578 - DNA, 28 bp, Artificial Sequence
  Synthetic
tcaatggttgaauagcacatacctucat

SEQ ID NO: 58579 - DNA, 22 bp, Artificial Sequence
  Synthetic
gccagctcuccagttcaguaag

SEQ ID NO: 58580 - DNA, 24 bp, Artificial Sequence
  Synthetic
acatccacucacctgaacaatuga

SEQ ID NO: 58581 - DNA, 28 bp, Artificial Sequence
  Synthetic
gtgtcaacaguttttcccttaattucct

SEQ ID NO: 58582 - DNA, 25 bp, Artificial Sequence
  Synthetic
cctagccuagcaggaaaaatucact

SEQ ID NO: 58583 - DNA, 24 bp, Artificial Sequence
  Synthetic
gctctgatgcuaggcagctttaug

SEQ ID NO: 58584 - DNA, 20 bp, Artificial Sequence
  Synthetic
ccaagcgagcgaaugtgtug

SEQ ID NO: 58585 - DNA, 24 bp, Artificial Sequence
  Synthetic
gtgtctcctucaccacctcattut

SEQ ID NO: 58586 - DNA, 28 bp, Artificial Sequence
  Synthetic
caggatgatttaugcttctactgcauct

SEQ ID NO: 58587 - DNA, 18 bp, Artificial Sequence
  Synthetic
ccgucgaggaccgaguca

SEQ ID NO: 58588 - DNA, 27 bp, Artificial Sequence
  Synthetic
aacaaattttctcuctcacccagucat

SEQ ID NO: 58589 - DNA, 27 bp, Artificial Sequence
  Synthetic
ggaagttagaagauctgagctcugagt

SEQ ID NO: 58590 - DNA, 28 bp, Artificial Sequence
  Synthetic
caaaaacauaggaacaaagcctuaacca

SEQ ID NO: 58591 - DNA, 24 bp, Artificial Sequence
  Synthetic
aaagaaugaagcagagccagagut

SEQ ID NO: 58592 - DNA, 28 bp, Artificial Sequence
  Synthetic
aatcaactcgugtaattaccatucacca

SEQ ID NO: 58593 - DNA, 23 bp, Artificial Sequence
  Synthetic
ggctugaaagggcaaguagaagt

SEQ ID NO: 58594 - DNA, 24 bp, Artificial Sequence
  Synthetic
ggaguatttctgaucccaaaggca

SEQ ID NO: 58595 - DNA, 28 bp, Artificial Sequence
  Synthetic
gatgaaagtgtucctacaggttaucaca

SEQ ID NO: 58596 - DNA, 20 bp, Artificial Sequence
  Synthetic
gaacctgauggcccgtttut

SEQ ID NO: 58597 - DNA, 21 bp, Artificial Sequence
  Synthetic
ggcaggauggagaggaguaca

SEQ ID NO: 58598 - DNA, 22 bp, Artificial Sequence
  Synthetic
ccttcacucacctctgcttugt

SEQ ID NO: 58599 - DNA, 28 bp, Artificial Sequence
  Synthetic
cccataatauccaaatccauggcaaagt

SEQ ID NO: 58600 - DNA, 21 bp, Artificial Sequence
  Synthetic
gccgtgaccutctcactcuaa

SEQ ID NO: 58601 - DNA, 23 bp, Artificial Sequence
  Synthetic
ttctttgggaaggcugccttuaa

SEQ ID NO: 58602 - DNA, 18 bp, Artificial Sequence
  Synthetic
accacccccuccagcuac

SEQ ID NO: 58603 - DNA, 20 bp, Artificial Sequence
  Synthetic
gctgaattcccugccggaut

SEQ ID NO: 58604 - DNA, 20 bp, Artificial Sequence
  Synthetic
cctccacacugagtcauggt

SEQ ID NO: 58605 - DNA, 27 bp, Artificial Sequence
  Synthetic
tccagtgtgtautgaaatttgagguct

SEQ ID NO: 58606 - DNA, 28 bp, Artificial Sequence
  Synthetic
actttctgataaacauattggctgcugt

SEQ ID NO: 58607 - DNA, 23 bp, Artificial Sequence
  Synthetic
gccctacccucttccttcttcuc

SEQ ID NO: 58608 - DNA, 20 bp, Artificial Sequence
  Synthetic
gctggttuggaacaguccga

SEQ ID NO: 58609 - DNA, 20 bp, Artificial Sequence
  Synthetic
gcccccgguttgtcagttut

SEQ ID NO: 58610 - DNA, 26 bp, Artificial Sequence
  Synthetic
ctcacaggcaaagauggtgatctuat

SEQ ID NO: 58611 - DNA, 25 bp, Artificial Sequence
  Synthetic
gcagtttgtcucactacagctaugt

SEQ ID NO: 58612 - DNA, 23 bp, Artificial Sequence
  Synthetic
gggtgtggugaaggattctccua

SEQ ID NO: 58613 - DNA, 24 bp, Artificial Sequence
  Synthetic
actacattccaagucctccacuca

SEQ ID NO: 58614 - DNA, 21 bp, Artificial Sequence
  Synthetic
cccttgtutgcagacauaccc

SEQ ID NO: 58615 - DNA, 24 bp, Artificial Sequence
  Synthetic
gacctttgcaaucacggaacatut

SEQ ID NO: 58616 - DNA, 23 bp, Artificial Sequence
  Synthetic
tgtaacccaacaaagguggugaa

SEQ ID NO: 58617 - DNA, 27 bp, Artificial Sequence
  Synthetic
cacagucacttgatuacaaaaaggcat

SEQ ID NO: 58618 - DNA, 23 bp, Artificial Sequence
  Synthetic
ggaatggucaggtagaggauggt

SEQ ID NO: 58619 - DNA, 20 bp, Artificial Sequence
  Synthetic
tcctcgtccuctgacaggug

SEQ ID NO: 58620 - DNA, 28 bp, Artificial Sequence
  Synthetic
aagtggtaacucatgtttaatgguggaa

SEQ ID NO: 58621 - DNA, 28 bp, Artificial Sequence
  Synthetic
cctctgtgttttgugagactagactcua

SEQ ID NO: 58622 - DNA, 26 bp, Artificial Sequence
  Synthetic
agttcttttatttugtgctgccccua

SEQ ID NO: 58623 - DNA, 28 bp, Artificial Sequence
  Synthetic
cctgagaagcaauagatctagctgttut

SEQ ID NO: 58624 - DNA, 20 bp, Artificial Sequence
  Synthetic
cacutaggacuaccgccagt

SEQ ID NO: 58625 - DNA, 25 bp, Artificial Sequence
  Synthetic
aaggctccatguctgaagatgaaut

SEQ ID NO: 58626 - DNA, 24 bp, Artificial Sequence
  Synthetic
ctcaacttcuattcactgggucct

SEQ ID NO: 58627 - DNA, 27 bp, Artificial Sequence
  Synthetic
agcaatgcaucaaccaataaccattut

SEQ ID NO: 58628 - DNA, 20 bp, Artificial Sequence
  Synthetic
ggtaggcguccttgccaauc

SEQ ID NO: 58629 - DNA, 23 bp, Artificial Sequence
  Synthetic
ggaaatttaugctgtccggucac

SEQ ID NO: 58630 - DNA, 22 bp, Artificial Sequence
  Synthetic
gcccaguaggugaaaaaggcat

SEQ ID NO: 58631 - DNA, 28 bp, Artificial Sequence
  Synthetic
ggaagccatgaguagccaaaacataaua

SEQ ID NO: 58632 - DNA, 23 bp, Artificial Sequence
  Synthetic
tccttctctgcuggtgtgaguat

SEQ ID NO: 58633 - DNA, 27 bp, Artificial Sequence
  Synthetic
gccgaaacutcacatttucaaacacaa

SEQ ID NO: 58634 - DNA, 22 bp, Artificial Sequence
  Synthetic
gccctgaggutttgcttaggut

SEQ ID NO: 58635 - DNA, 28 bp, Artificial Sequence
  Synthetic
gtcugcttctagaataucagagaacagt

SEQ ID NO: 58636 - DNA, 23 bp, Artificial Sequence
  Synthetic
actcctgcuctgcaaacataucc

SEQ ID NO: 58637 - DNA, 22 bp, Artificial Sequence
  Synthetic
ctagcgguaggagcaacaucaa

SEQ ID NO: 58638 - DNA, 21 bp, Artificial Sequence
  Synthetic
cccagcacuttgcctgauaac

SEQ ID NO: 58639 - DNA, 23 bp, Artificial Sequence
  Synthetic
tggtccaatucctgtggacttuc

SEQ ID NO: 58640 - DNA, 17 bp, Artificial Sequence
  Synthetic
ccucgcggcctauggag

SEQ ID NO: 58641 - DNA, 19 bp, Artificial Sequence
  Synthetic
ccggttcaugccagcttug

SEQ ID NO: 58642 - DNA, 21 bp, Artificial Sequence
  Synthetic
accttcctgucggtgtatgug

SEQ ID NO: 58643 - DNA, 21 bp, Artificial Sequence
  Synthetic
ctgggagaaguagaggcggua

SEQ ID NO: 58644 - DNA, 23 bp, Artificial Sequence
  Synthetic
gcctggacuttgatctcauaggg

SEQ ID NO: 58645 - DNA, 21 bp, Artificial Sequence
  Synthetic
cttggccaaccaacucctcut

SEQ ID NO: 58646 - DNA, 25 bp, Artificial Sequence
  Synthetic
cagttaaucgggaagctttgucaga

SEQ ID NO: 58647 - DNA, 22 bp, Artificial Sequence
  Synthetic
tgtttcaucctccaugccaagg

SEQ ID NO: 58648 - DNA, 22 bp, Artificial Sequence
  Synthetic
gcggaagucatugccagaagaa

SEQ ID NO: 58649 - DNA, 28 bp, Artificial Sequence
  Synthetic
ccattcctuggaaaccttuaaaaacact

SEQ ID NO: 58650 - DNA, 23 bp, Artificial Sequence
  Synthetic
accagtgacugcacatgtacaut

SEQ ID NO: 58651 - DNA, 21 bp, Artificial Sequence
  Synthetic
acccacucacaggcctaauga

SEQ ID NO: 58652 - DNA, 22 bp, Artificial Sequence
  Synthetic
ctttgcagagcuttctgtugct

SEQ ID NO: 58653 - DNA, 22 bp, Artificial Sequence
  Synthetic
accagactugcccaaaacauct

SEQ ID NO: 58654 - DNA, 25 bp, Artificial Sequence
  Synthetic
gttttaggatgcutcttggcaacug

SEQ ID NO: 58655 - DNA, 26 bp, Artificial Sequence
  Synthetic
actctgacatugtttggtttgtcuga

SEQ ID NO: 58656 - DNA, 21 bp, Artificial Sequence
  Synthetic
gctatgacgugctgttugcat

SEQ ID NO: 58657 - DNA, 20 bp, Artificial Sequence
  Synthetic
gcagtagauggacccctcug

SEQ ID NO: 58658 - DNA, 20 bp, Artificial Sequence
  Synthetic
gctacaguccctggguggaa

SEQ ID NO: 58659 - DNA, 20 bp, Artificial Sequence
  Synthetic
gagaguactguggcccacaa

SEQ ID NO: 58660 - DNA, 18 bp, Artificial Sequence
  Synthetic
cccacccgcuttctguct

SEQ ID NO: 58661 - DNA, 17 bp, Artificial Sequence
  Synthetic
tccagagggcguccugt

SEQ ID NO: 58662 - DNA, 24 bp, Artificial Sequence
  Synthetic
cccagcctcutatgacctattcut

SEQ ID NO: 58663 - DNA, 21 bp, Artificial Sequence
  Synthetic
cgtugagcacctcctuagcag

SEQ ID NO: 58664 - DNA, 21 bp, Artificial Sequence
  Synthetic
gtcgactacccugatgtgcug

SEQ ID NO: 58665 - DNA, 22 bp, Artificial Sequence
  Synthetic
ctttcttcuccggaagggugat

SEQ ID NO: 58666 - DNA, 22 bp, Artificial Sequence
  Synthetic
gctatcctuaccccgccaagua

SEQ ID NO: 58667 - DNA, 22 bp, Artificial Sequence
  Synthetic
ctagctaggugtcctgtuccac

SEQ ID NO: 58668 - DNA, 17 bp, Artificial Sequence
  Synthetic
ggagctaguggcgcuca

SEQ ID NO: 58669 - DNA, 17 bp, Artificial Sequence
  Synthetic
ccgcuccagcacgtugt

SEQ ID NO: 58670 - DNA, 18 bp, Artificial Sequence
  Synthetic
gaagcugctgggcucagt

SEQ ID NO: 58671 - DNA, 18 bp, Artificial Sequence
  Synthetic
cccacccgcutagaccuc

SEQ ID NO: 58672 - DNA, 23 bp, Artificial Sequence
  Synthetic
tgacctgtguccatttctgctuc

SEQ ID NO: 58673 - DNA, 28 bp, Artificial Sequence
  Synthetic
agcaactttgaggcugattatggaauat

SEQ ID NO: 58674 - DNA, 26 bp, Artificial Sequence
  Synthetic
aaatgtcctacucaagccttgttuga

SEQ ID NO: 58675 - DNA, 28 bp, Artificial Sequence
  Synthetic
ccctgaagataccucattttggttatug

SEQ ID NO: 58676 - DNA, 28 bp, Artificial Sequence
  Synthetic
catattcgccuaaatctccatcuaccag

SEQ ID NO: 58677 - DNA, 28 bp, Artificial Sequence
  Synthetic
cttcatgttccucaattccttgcaatut

SEQ ID NO: 58678 - DNA, 20 bp, Artificial Sequence
  Synthetic
caguaggaccgacggcaauc

SEQ ID NO: 58679 - DNA, 23 bp, Artificial Sequence
  Synthetic
gggttgagutcacagttgugagt

SEQ ID NO: 58680 - DNA, 22 bp, Artificial Sequence
  Synthetic
caggttcuccagcttgtcctut

SEQ ID NO: 58681 - DNA, 22 bp, Artificial Sequence
  Synthetic
ctctgtgggccuctttgttuct

SEQ ID NO: 58682 - DNA, 22 bp, Artificial Sequence
  Synthetic
cctgctugaagttcttcucgga

SEQ ID NO: 58683 - DNA, 25 bp, Artificial Sequence
  Synthetic
cagcauattugggaacgagaaacaa

SEQ ID NO: 58684 - DNA, 22 bp, Artificial Sequence
  Synthetic
gaggaccagguggagcagtaua

SEQ ID NO: 58685 - DNA, 20 bp, Artificial Sequence
  Synthetic
catagcccagcguggguaag

SEQ ID NO: 58686 - DNA, 18 bp, Artificial Sequence
  Synthetic
gcugcuggcggaaaagga

SEQ ID NO: 58687 - DNA, 19 bp, Artificial Sequence
  Synthetic
ggguctagucaaggccagt

SEQ ID NO: 58688 - DNA, 22 bp, Artificial Sequence
  Synthetic
agauggaaggagaggccucaat

SEQ ID NO: 58689 - DNA, 20 bp, Artificial Sequence
  Synthetic
ggugggaaccggtaagucag

SEQ ID NO: 58690 - DNA, 18 bp, Artificial Sequence
  Synthetic
gggacaagcguggcugag

SEQ ID NO: 58691 - DNA, 18 bp, Artificial Sequence
  Synthetic
cagcugggcctucaggaa

SEQ ID NO: 58692 - DNA, 21 bp, Artificial Sequence
  Synthetic
cctgagaggucttgcccacua

SEQ ID NO: 58693 - DNA, 22 bp, Artificial Sequence
  Synthetic
tctcacatgcutcccctcatuc

SEQ ID NO: 58694 - DNA, 23 bp, Artificial Sequence
  Synthetic
ggctgttuctcacagaucccaaa

SEQ ID NO: 58695 - DNA, 20 bp, Artificial Sequence
  Synthetic
ctgaagtcucccgaccacuc

SEQ ID NO: 58696 - DNA, 22 bp, Artificial Sequence
  Synthetic
ccutcctcctcucagccagaat

SEQ ID NO: 58697 - DNA, 25 bp, Artificial Sequence
  Synthetic
gcaggaagaagagcauaagaaccug

SEQ ID NO: 58698 - DNA, 23 bp, Artificial Sequence
  Synthetic
agcaccacauataagctgccaut

SEQ ID NO: 58699 - DNA, 25 bp, Artificial Sequence
  Synthetic
ctcctttaatguctcctggacugag

SEQ ID NO: 58700 - DNA, 24 bp, Artificial Sequence
  Synthetic
gtgtgtgugcacatatgcattuga

SEQ ID NO: 58701 - DNA, 26 bp, Artificial Sequence
  Synthetic
tgccagccccucattaatctatauga

SEQ ID NO: 58702 - DNA, 21 bp, Artificial Sequence
  Synthetic
gcctcugagaatgctgguaga

SEQ ID NO: 58703 - DNA, 22 bp, Artificial Sequence
  Synthetic
gatcgcccagucaactcugaaa

SEQ ID NO: 58704 - DNA, 23 bp, Artificial Sequence
  Synthetic
gctgctgtcutgggttattcugg

SEQ ID NO: 58705 - DNA, 28 bp, Artificial Sequence
  Synthetic
tccatcaagagtuatttggttgcacuaa

SEQ ID NO: 58706 - DNA, 22 bp, Artificial Sequence
  Synthetic
gtaacttugcagccugggaaga

SEQ ID NO: 58707 - DNA, 24 bp, Artificial Sequence
  Synthetic
ggtcauccagaagagtguagggaa

SEQ ID NO: 58708 - DNA, 27 bp, Artificial Sequence
  Synthetic
tctaatcttacuaccactctccuccct

SEQ ID NO: 58709 - DNA, 22 bp, Artificial Sequence
  Synthetic
agcaaaccaggcaugtactugt

SEQ ID NO: 58710 - DNA, 22 bp, Artificial Sequence
  Synthetic
catgtttgugttgctccaucgg

SEQ ID NO: 58711 - DNA, 23 bp, Artificial Sequence
  Synthetic
ttctttgcccautctcacacuca

SEQ ID NO: 58712 - DNA, 25 bp, Artificial Sequence
  Synthetic
agtgaaaccucagctctugaaaact

SEQ ID NO: 58713 - DNA, 21 bp, Artificial Sequence
  Synthetic
ggccagtguggtgaactcauc

SEQ ID NO: 58714 - DNA, 27 bp, Artificial Sequence
  Synthetic
cccctgttatugtacagtttgtttugg

SEQ ID NO: 58715 - DNA, 28 bp, Artificial Sequence
  Synthetic
ccaguttgtcattuaagagagaggaagg

SEQ ID NO: 58716 - DNA, 27 bp, Artificial Sequence
  Synthetic
gttactggagatautccccaacacaua

SEQ ID NO: 58717 - DNA, 27 bp, Artificial Sequence
  Synthetic
caagatattaaaguggcaatgtgugct

SEQ ID NO: 58718 - DNA, 20 bp, Artificial Sequence
  Synthetic
cgggaaacagcutagugggt

SEQ ID NO: 58719 - DNA, 20 bp, Artificial Sequence
  Synthetic
ccgtgcgccguatagaaguc

SEQ ID NO: 58720 - DNA, 23 bp, Artificial Sequence
  Synthetic
gtcacttugttctgttugcaggt

SEQ ID NO: 58721 - DNA, 27 bp, Artificial Sequence
  Synthetic
aattattccaaccuccaatgacccaut

SEQ ID NO: 58722 - DNA, 27 bp, Artificial Sequence
  Synthetic
ccattactatuctgttggaccuccaaa

SEQ ID NO: 58723 - DNA, 26 bp, Artificial Sequence
  Synthetic
ggtaaaagatugttgctgctuggaaa

SEQ ID NO: 58724 - DNA, 22 bp, Artificial Sequence
  Synthetic
cctgcagtucctttcctgtgut

SEQ ID NO: 58725 - DNA, 28 bp, Artificial Sequence
  Synthetic
ctctcaaaacuagaagtgtaagcuggat

SEQ ID NO: 58726 - DNA, 21 bp, Artificial Sequence
  Synthetic
ctcaucaggcgcattccauct

SEQ ID NO: 58727 - DNA, 23 bp, Artificial Sequence
  Synthetic
ctcagtgattuggctcaggugat

SEQ ID NO: 58728 - DNA, 22 bp, Artificial Sequence
  Synthetic
ccctagtaaaggaugcccagut

SEQ ID NO: 58729 - DNA, 19 bp, Artificial Sequence
  Synthetic
ccaccacagugtcgucagg

SEQ ID NO: 58730 - DNA, 21 bp, Artificial Sequence
  Synthetic
ctgaggcuttcccaucagacc

SEQ ID NO: 58731 - DNA, 22 bp, Artificial Sequence
  Synthetic
acagtgggaaugctgcttctut

SEQ ID NO: 58732 - DNA, 24 bp, Artificial Sequence
  Synthetic
ttggtagctguagcctgtcatcua

SEQ ID NO: 58733 - DNA, 21 bp, Artificial Sequence
  Synthetic
cttcccucttcacccuggaac

SEQ ID NO: 58734 - DNA, 28 bp, Artificial Sequence
  Synthetic
ctttgtggttctucattcttctctccut

SEQ ID NO: 58735 - DNA, 27 bp, Artificial Sequence
  Synthetic
actaatcgtgcucttctagggttuaga

SEQ ID NO: 58736 - DNA, 28 bp, Artificial Sequence
  Synthetic
agtactttctucagtggcaacacuaaaa

SEQ ID NO: 58737 - DNA, 28 bp, Artificial Sequence
  Synthetic
ggattgctagcaccuattcttaacagua

SEQ ID NO: 58738 - DNA, 28 bp, Artificial Sequence
  Synthetic
gcaagtacatttutgaattcctcaguca

SEQ ID NO: 58739 - DNA, 23 bp, Artificial Sequence
  Synthetic
ccttgguggtacagattugcaca

SEQ ID NO: 58740 - DNA, 28 bp, Artificial Sequence
  Synthetic
tgagtttttaccuacctttctugcacat

SEQ ID NO: 58741 - DNA, 24 bp, Artificial Sequence
  Synthetic
ccccuaaccaacggagagatttug

SEQ ID NO: 58742 - DNA, 28 bp, Artificial Sequence
  Synthetic
ccatatgtcacaguggtcttcactuaaa

SEQ ID NO: 58743 - DNA, 28 bp, Artificial Sequence
  Synthetic
agacatattcuctgtgaaacugaaacgg

SEQ ID NO: 58744 - DNA, 25 bp, Artificial Sequence
  Synthetic
ccaaatatgugtctgtgacucagga

SEQ ID NO: 58745 - DNA, 28 bp, Artificial Sequence
  Synthetic
ctttcattcccutttaggctcctaugat

SEQ ID NO: 58746 - DNA, 21 bp, Artificial Sequence
  Synthetic
aggagcuaaaggcgaagaugg

SEQ ID NO: 58747 - DNA, 28 bp, Artificial Sequence
  Synthetic
tgacagtgaugctgcttttctttuagat

SEQ ID NO: 58748 - DNA, 29 bp, Artificial Sequence
  Synthetic
aaacactgtcacauaaagatgagcuaagt

SEQ ID NO: 58749 - DNA, 26 bp, Artificial Sequence
  Synthetic
ggaaggaagagugtagtggaaaauga

SEQ ID NO: 58750 - DNA, 22 bp, Artificial Sequence
  Synthetic
gaagatgagccaacuccagcut

SEQ ID NO: 58751 - DNA, 26 bp, Artificial Sequence
  Synthetic
gcacaatgcaggauccaaatatttug

SEQ ID NO: 58752 - DNA, 29 bp, Artificial Sequence
  Synthetic
gagataaaatatugaccgatgcagcuact

SEQ ID NO: 58753 - DNA, 28 bp, Artificial Sequence
  Synthetic
gtacagttttacccuggatagtttcuga

SEQ ID NO: 58754 - DNA, 26 bp, Artificial Sequence
  Synthetic
caccatuaggaccctgaauagaaaca

SEQ ID NO: 58755 - DNA, 20 bp, Artificial Sequence
  Synthetic
tgacggacagccuggaguaa

SEQ ID NO: 58756 - DNA, 18 bp, Artificial Sequence
  Synthetic
agctccagutggcccaut

SEQ ID NO: 58757 - DNA, 29 bp, Artificial Sequence
  Synthetic
gaccttgggaatuttgttctatgaccuat

SEQ ID NO: 58758 - DNA, 29 bp, Artificial Sequence
  Synthetic
tggaagatgaaauggaaaaccgaatuagt

SEQ ID NO: 58759 - DNA, 22 bp, Artificial Sequence
  Synthetic
tggutcacguagagaggaagca

SEQ ID NO: 58760 - DNA, 28 bp, Artificial Sequence
  Synthetic
tcaatttgucaaaaacatacctccucca

SEQ ID NO: 58761 - DNA, 25 bp, Artificial Sequence
  Synthetic
atgaaacttacauggctcctgucaa

SEQ ID NO: 58762 - DNA, 24 bp, Artificial Sequence
  Synthetic
catgttattacucttggcccucgt

SEQ ID NO: 58763 - DNA, 25 bp, Artificial Sequence
  Synthetic
acttaccacaucactcttgctgtut

SEQ ID NO: 58764 - DNA, 28 bp, Artificial Sequence
  Synthetic
gtttattttguccatgtgttccucaagt

SEQ ID NO: 58765 - DNA, 27 bp, Artificial Sequence
  Synthetic
tgtctgaattttgaucatacagcggua

SEQ ID NO: 58766 - DNA, 21 bp, Artificial Sequence
  Synthetic
caggcctttuccctcatgcua

SEQ ID NO: 58767 - DNA, 20 bp, Artificial Sequence
  Synthetic
gaggacugagctgtccacug

SEQ ID NO: 58768 - DNA, 21 bp, Artificial Sequence
  Synthetic
cctgtgguaccatccauggga

SEQ ID NO: 58769 - DNA, 21 bp, Artificial Sequence
  Synthetic
cgcaggtguaggactggauct

SEQ ID NO: 58770 - DNA, 25 bp, Artificial Sequence
  Synthetic
catgtgtggcutaatcttgcctcua

SEQ ID NO: 58771 - DNA, 23 bp, Artificial Sequence
  Synthetic
ccaacatcucagtcctactgucc

SEQ ID NO: 58772 - DNA, 19 bp, Artificial Sequence
  Synthetic
cgagtugggtccttucgca

SEQ ID NO: 58773 - DNA, 28 bp, Artificial Sequence
  Synthetic
ggtgataaaugcacttttgtcatauggt

SEQ ID NO: 58774 - DNA, 21 bp, Artificial Sequence
  Synthetic
agcagguaagaagccgaacuc

SEQ ID NO: 58775 - DNA, 18 bp, Artificial Sequence
  Synthetic
cccuccccaaguccaact

SEQ ID NO: 58776 - DNA, 25 bp, Artificial Sequence
  Synthetic
ttgtgatgtgagautttccaccugt

SEQ ID NO: 58777 - DNA, 28 bp, Artificial Sequence
  Synthetic
caggugtttacattuaggagacagagat

SEQ ID NO: 58778 - DNA, 26 bp, Artificial Sequence
  Synthetic
acatttatggttuctcacctgccaut

SEQ ID NO: 58779 - DNA, 26 bp, Artificial Sequence
  Synthetic
actcaacaatguattcagcaagucct

SEQ ID NO: 58780 - DNA, 28 bp, Artificial Sequence
  Synthetic
tacagtttuaacgcctaaagtaucacat

SEQ ID NO: 58781 - DNA, 28 bp, Artificial Sequence
  Synthetic
caaaacattccttutcttcgtcccaaut

SEQ ID NO: 58782 - DNA, 21 bp, Artificial Sequence
  Synthetic
tggctccatuccaaactccug

SEQ ID NO: 58783 - DNA, 27 bp, Artificial Sequence
  Synthetic
agaacacaucccacagtgcataaauaa

SEQ ID NO: 58784 - DNA, 18 bp, Artificial Sequence
  Synthetic
tggccacgcugaagtuct

SEQ ID NO: 58785 - DNA, 18 bp, Artificial Sequence
  Synthetic
cctacugcgaccccacuc

SEQ ID NO: 58786 - DNA, 23 bp, Artificial Sequence
  Synthetic
ccagtaaugagaccaccccatug

SEQ ID NO: 58787 - DNA, 23 bp, Artificial Sequence
  Synthetic
cctgggttcugaagcagatttug

SEQ ID NO: 58788 - DNA, 23 bp, Artificial Sequence
  Synthetic
gattaccautgctcugggaccat

SEQ ID NO: 58789 - DNA, 20 bp, Artificial Sequence
  Synthetic
aaacgtccgutcctccacuc

SEQ ID NO: 58790 - DNA, 20 bp, Artificial Sequence
  Synthetic
ccacactugctgtccctugt

SEQ ID NO: 58791 - DNA, 24 bp, Artificial Sequence
  Synthetic
gcatggaacaaaguctctgtgugt

SEQ ID NO: 58792 - DNA, 25 bp, Artificial Sequence
  Synthetic
ggtacucagcaggtattaacugcaa

SEQ ID NO: 58793 - DNA, 22 bp, Artificial Sequence
  Synthetic
gggcctaaugctactgtctguc

SEQ ID NO: 58794 - DNA, 28 bp, Artificial Sequence
  Synthetic
cttcacttgaggguatagtagtttgugg

SEQ ID NO: 58795 - DNA, 20 bp, Artificial Sequence
  Synthetic
ctgatgcguggcttatgcut

SEQ ID NO: 58796 - DNA, 22 bp, Artificial Sequence
  Synthetic
ccctgagaagcugtgttugact

SEQ ID NO: 58797 - DNA, 23 bp, Artificial Sequence
  Synthetic
ggcctgaggcuttcaatctctuc

SEQ ID NO: 58798 - DNA, 26 bp, Artificial Sequence
  Synthetic
gggaagaaatucccacatgagatuca

SEQ ID NO: 58799 - DNA, 21 bp, Artificial Sequence
  Synthetic
tgagtgtagcuggtgccttut

SEQ ID NO: 58800 - DNA, 21 bp, Artificial Sequence
  Synthetic
cctccgggauttcatctcugg

SEQ ID NO: 58801 - DNA, 23 bp, Artificial Sequence
  Synthetic
ctgaggugggattttgacugaga

SEQ ID NO: 58802 - DNA, 22 bp, Artificial Sequence
  Synthetic
ggtcttggaaguccccttctug

SEQ ID NO: 58803 - DNA, 23 bp, Artificial Sequence
  Synthetic
acaaagacccuaucggaagacga

SEQ ID NO: 58804 - DNA, 28 bp, Artificial Sequence
  Synthetic
ccactcuggaggaatattcaauagcaat

SEQ ID NO: 58805 - DNA, 30 bp, Artificial Sequence
  Synthetic
gaaaatactgagauccgtattatcctucaa

SEQ ID NO: 58806 - DNA, 20 bp, Artificial Sequence
  Synthetic
ccgtgacautctccgtucca

SEQ ID NO: 58807 - DNA, 30 bp, Artificial Sequence
  Synthetic
gcctagtccaaagucataagaaagtatuca

SEQ ID NO: 58808 - DNA, 28 bp, Artificial Sequence
  Synthetic
tcttaccttgcugtttcttcatgaaugt

SEQ ID NO: 58809 - DNA, 28 bp, Artificial Sequence
  Synthetic
gggtgtgatguaggttagaactuaaagt

SEQ ID NO: 58810 - DNA, 19 bp, Artificial Sequence
  Synthetic
gcagauccggcagctctuc

SEQ ID NO: 58811 - DNA, 18 bp, Artificial Sequence
  Synthetic
ccgucucgggaggaaggt

SEQ ID NO: 58812 - DNA, 18 bp, Artificial Sequence
  Synthetic
gcugatcuacgcgagcga

SEQ ID NO: 58813 - DNA, 17 bp, Artificial Sequence
  Synthetic
gcugcagagcccgtugt

SEQ ID NO: 58814 - DNA, 20 bp, Artificial Sequence
  Synthetic
agagcaaucctcgtcgucag

SEQ ID NO: 58815 - DNA, 20 bp, Artificial Sequence
  Synthetic
acgagaggcugctggaguaa

SEQ ID NO: 58816 - DNA, 17 bp, Artificial Sequence
  Synthetic
cgggtguccctcuggct

SEQ ID NO: 58817 - DNA, 23 bp, Artificial Sequence
  Synthetic
gtttaccutgagtccuccacaga

SEQ ID NO: 58818 - DNA, 17 bp, Artificial Sequence
  Synthetic
gccagugaccgcgaugg

SEQ ID NO: 58819 - DNA, 19 bp, Artificial Sequence
  Synthetic
atgcgcugcatctcgauct

SEQ ID NO: 58820 - DNA, 23 bp, Artificial Sequence
  Synthetic
ggaaucttgaatacugggccaca

SEQ ID NO: 58821 - DNA, 27 bp, Artificial Sequence
  Synthetic
ggctagctugagacttatgtctugaat

SEQ ID NO: 58822 - DNA, 28 bp, Artificial Sequence
  Synthetic
tttctctctgtttucactcaggtgtuag

SEQ ID NO: 58823 - DNA, 28 bp, Artificial Sequence
  Synthetic
actaaaggaagucaaattctgcctugat

SEQ ID NO: 58824 - DNA, 26 bp, Artificial Sequence
  Synthetic
ctgaggtcautaagcaagagtuggaa

SEQ ID NO: 58825 - DNA, 22 bp, Artificial Sequence
  Synthetic
ggctacccccucattcttuagg

SEQ ID NO: 58826 - DNA, 23 bp, Artificial Sequence
  Synthetic
ctgctcctguctcttcaggtcua

SEQ ID NO: 58827 - DNA, 25 bp, Artificial Sequence
  Synthetic
caaacaaugaggcaaagaggaugaa

SEQ ID NO: 58828 - DNA, 23 bp, Artificial Sequence
  Synthetic
gaaccagctguacaagtccagut

SEQ ID NO: 58829 - DNA, 23 bp, Artificial Sequence
  Synthetic
ctcatactcugcagatggaggug

SEQ ID NO: 58830 - DNA, 22 bp, Artificial Sequence
  Synthetic
gaggagaagcugtaccuccaga

SEQ ID NO: 58831 - DNA, 22 bp, Artificial Sequence
  Synthetic
ggcgagaaaguggagaggaaug

SEQ ID NO: 58832 - DNA, 23 bp, Artificial Sequence
  Synthetic
tctaacactugcagactgctgut

SEQ ID NO: 58833 - DNA, 25 bp, Artificial Sequence
  Synthetic
acagctgtggugttgaattttucag

SEQ ID NO: 58834 - DNA, 28 bp, Artificial Sequence
  Synthetic
ggtgataaaacccgaaugactgagtuat

SEQ ID NO: 58835 - DNA, 22 bp, Artificial Sequence
  Synthetic
tcacacucaccaacggttucaa

SEQ ID NO: 58836 - DNA, 24 bp, Artificial Sequence
  Synthetic
gcaacagaaaguttggatguggaa

SEQ ID NO: 58837 - DNA, 23 bp, Artificial Sequence
  Synthetic
caagaagtcugctgctagtccug

SEQ ID NO: 58838 - DNA, 21 bp, Artificial Sequence
  Synthetic
aggaugaagaaccccatgcug

SEQ ID NO: 58839 - DNA, 21 bp, Artificial Sequence
  Synthetic
caacacggutgtctccuaggt

SEQ ID NO: 58840 - DNA, 28 bp, Artificial Sequence
  Synthetic
tgaagtaaaaacacauagccagaaccut

SEQ ID NO: 58841 - DNA, 27 bp, Artificial Sequence
  Synthetic
tcctttgtcttcutctggaatgtcauc

SEQ ID NO: 58842 - DNA, 22 bp, Artificial Sequence
  Synthetic
caaactctuggctttgctcugt

SEQ ID NO: 58843 - DNA, 28 bp, Artificial Sequence
  Synthetic
agccagtggcuatgtttatttcaguaaa

SEQ ID NO: 58844 - DNA, 23 bp, Artificial Sequence
  Synthetic
catcaccugtctgtaaguggagt

SEQ ID NO: 58845 - DNA, 28 bp, Artificial Sequence
  Synthetic
tgagtgattcucatcagagctcuaacat

SEQ ID NO: 58846 - DNA, 23 bp, Artificial Sequence
  Synthetic
gtttgcgaauggcctctagtgua

SEQ ID NO: 58847 - DNA, 28 bp, Artificial Sequence
  Synthetic
agagaagaaggaaautttgacacctuga

SEQ ID NO: 58848 - DNA, 20 bp, Artificial Sequence
  Synthetic
ggccacacccuacacacuaa

SEQ ID NO: 58849 - DNA, 27 bp, Artificial Sequence
  Synthetic
gtctccgacaccucatgttttactauc

SEQ ID NO: 58850 - DNA, 26 bp, Artificial Sequence
  Synthetic
atgtgtttcucgcaaattcatcagug

SEQ ID NO: 58851 - DNA, 20 bp, Artificial Sequence
  Synthetic
ccatuccggaagagcugact

SEQ ID NO: 58852 - DNA, 21 bp, Artificial Sequence
  Synthetic
aaugaagggcgaccugaaaca

SEQ ID NO: 58853 - DNA, 23 bp, Artificial Sequence
  Synthetic
tctctgcttuaaggcttcagcuc

SEQ ID NO: 58854 - DNA, 22 bp, Artificial Sequence
  Synthetic
gggacucaagggaaagaccauc

SEQ ID NO: 58855 - DNA, 27 bp, Artificial Sequence
  Synthetic
gtcagggtgugctttattagtgtcuac

SEQ ID NO: 58856 - DNA, 30 bp, Artificial Sequence
  Synthetic
tgctttcttagtgutttccagtaagctuat

SEQ ID NO: 58857 - DNA, 26 bp, Artificial Sequence
  Synthetic
gcagugactaacttaauggcacacaa

SEQ ID NO: 58858 - DNA, 25 bp, Artificial Sequence
  Synthetic
acttcacutgcaagatuaccaacca

SEQ ID NO: 58859 - DNA, 28 bp, Artificial Sequence
  Synthetic
gctgttctgatguaactgcctagtttut

SEQ ID NO: 58860 - DNA, 28 bp, Artificial Sequence
  Synthetic
atgactttaugggacaataucacaggaa

SEQ ID NO: 58861 - DNA, 24 bp, Artificial Sequence
  Synthetic
gatgccactcutaaagccatcuct

SEQ ID NO: 58862 - DNA, 27 bp, Artificial Sequence
  Synthetic
tgctaatttcaucaagctcaagtcugt

SEQ ID NO: 58863 - DNA, 22 bp, Artificial Sequence
  Synthetic
ctcgaugcataattuggccagt

SEQ ID NO: 58864 - DNA, 23 bp, Artificial Sequence
  Synthetic
ttccaaggacaucatccccuagt

SEQ ID NO: 58865 - DNA, 28 bp, Artificial Sequence
  Synthetic
ttctaccttttuattggctccatuacca

SEQ ID NO: 58866 - DNA, 23 bp, Artificial Sequence
  Synthetic
ggaaccttcuccagcctttctut

SEQ ID NO: 58867 - DNA, 21 bp, Artificial Sequence
  Synthetic
gaatcctcugctggtctcugg

SEQ ID NO: 58868 - DNA, 22 bp, Artificial Sequence
  Synthetic
ccaggugaaagcugaaaagcag

SEQ ID NO: 58869 - DNA, 21 bp, Artificial Sequence
  Synthetic
caacacuagcccccagucaag

SEQ ID NO: 58870 - DNA, 20 bp, Artificial Sequence
  Synthetic
cagcacaggccgguaaatug

SEQ ID NO: 58871 - DNA, 22 bp, Artificial Sequence
  Synthetic
cctcctgttucttgccatcuga

SEQ ID NO: 58872 - DNA, 22 bp, Artificial Sequence
  Synthetic
gaccaggtcutacttgcccuaa

SEQ ID NO: 58873 - DNA, 21 bp, Artificial Sequence
  Synthetic
tgaagaactgucgctgctguc

SEQ ID NO: 58874 - DNA, 26 bp, Artificial Sequence
  Synthetic
acagcctgaggugttttgaaatttug

SEQ ID NO: 58875 - DNA, 25 bp, Artificial Sequence
  Synthetic
gagcaacaataaugcctccttcuct

SEQ ID NO: 58876 - DNA, 25 bp, Artificial Sequence
  Synthetic
gcaugataguaagacgaaggagcag

SEQ ID NO: 58877 - DNA, 20 bp, Artificial Sequence
  Synthetic
cccacuagggctaggatugg

SEQ ID NO: 58878 - DNA, 23 bp, Artificial Sequence
  Synthetic
gttgtaggtutttgtgcaguggt

SEQ ID NO: 58879 - DNA, 21 bp, Artificial Sequence
  Synthetic
ggacaccaggcucttcatgut

SEQ ID NO: 58880 - DNA, 27 bp, Artificial Sequence
  Synthetic
tcaaagaatcagugtactcaggtggua

SEQ ID NO: 58881 - DNA, 23 bp, Artificial Sequence
  Synthetic
gcgggaauattgagtctuccact

SEQ ID NO: 58882 - DNA, 27 bp, Artificial Sequence
  Synthetic
ttgacacagaaaaccuggagaaaauct

SEQ ID NO: 58883 - DNA, 22 bp, Artificial Sequence
  Synthetic
gcctaugaaggctttcugagca

SEQ ID NO: 58884 - DNA, 18 bp, Artificial Sequence
  Synthetic
agggucctggtguccaca

SEQ ID NO: 58885 - DNA, 17 bp, Artificial Sequence
  Synthetic
gcagggcaggguctgut

SEQ ID NO: 58886 - DNA, 20 bp, Artificial Sequence
  Synthetic
ccagccacaagcagutcugt

SEQ ID NO: 58887 - DNA, 18 bp, Artificial Sequence
  Synthetic
ggccctgugtctgccaut

SEQ ID NO: 58888 - DNA, 20 bp, Artificial Sequence
  Synthetic
ctggcagcacutcctcaugt

SEQ ID NO: 58889 - DNA, 20 bp, Artificial Sequence
  Synthetic
ggactaccgaugagccucct

SEQ ID NO: 58890 - DNA, 21 bp, Artificial Sequence
  Synthetic
agtgaccuggtactcctgucc

SEQ ID NO: 58891 - DNA, 23 bp, Artificial Sequence
  Synthetic
ggtcaagtuccacacaguaccat

SEQ ID NO: 58892 - DNA, 20 bp, Artificial Sequence
  Synthetic
caggcacagaacccucaucc

SEQ ID NO: 58893 - DNA, 21 bp, Artificial Sequence
  Synthetic
gcctcacugttgcccattuct

SEQ ID NO: 58894 - DNA, 19 bp, Artificial Sequence
  Synthetic
actggcugagagggaggut

SEQ ID NO: 58895 - DNA, 24 bp, Artificial Sequence
  Synthetic
tttgcctctcacuctgtgtgtauc

SEQ ID NO: 58896 - DNA, 21 bp, Artificial Sequence
  Synthetic
ccagccuccactgaatcctut

SEQ ID NO: 58897 - DNA, 22 bp, Artificial Sequence
  Synthetic
actatatcgugctgcagtucgg

SEQ ID NO: 58898 - DNA, 26 bp, Artificial Sequence
  Synthetic
acaagaagcugaaagggtttccauag

SEQ ID NO: 58899 - DNA, 28 bp, Artificial Sequence
  Synthetic
aatttagttgctauttgtgccattgugt

SEQ ID NO: 58900 - DNA, 27 bp, Artificial Sequence
  Synthetic
cctacacaagaaugcagaaatucaaca

SEQ ID NO: 58901 - DNA, 26 bp, Artificial Sequence
  Synthetic
gtcaacagaatcucaggagccatauc

SEQ ID NO: 58902 - DNA, 22 bp, Artificial Sequence
  Synthetic
gcatcacugcaaattgcuggag

SEQ ID NO: 58903 - DNA, 20 bp, Artificial Sequence
  Synthetic
caacgugagcctgtcuggat

SEQ ID NO: 58904 - DNA, 22 bp, Artificial Sequence
  Synthetic
agaauttcuccagggcagcaaa

SEQ ID NO: 58905 - DNA, 27 bp, Artificial Sequence
  Synthetic
cactgtgaaggaggauctatacactug

SEQ ID NO: 58906 - DNA, 25 bp, Artificial Sequence
  Synthetic
caaagactgcuactcacgtgtguat

SEQ ID NO: 58907 - DNA, 27 bp, Artificial Sequence
  Synthetic
gcctgcctttcuattttatctgaacug

SEQ ID NO: 58908 - DNA, 26 bp, Artificial Sequence
  Synthetic
aaagagagagaaugtgtgtgtgtugt

SEQ ID NO: 58909 - DNA, 28 bp, Artificial Sequence
  Synthetic
gggagtatugcacaattatctcttguct

SEQ ID NO: 58910 - DNA, 24 bp, Artificial Sequence
  Synthetic
tcccactcauaaaaaccacucacc

SEQ ID NO: 58911 - DNA, 27 bp, Artificial Sequence
  Synthetic
acatgctcactugtggtactatttuct

SEQ ID NO: 58912 - DNA, 26 bp, Artificial Sequence
  Synthetic
ctagaaugatagttctgucgccaagg

SEQ ID NO: 58913 - DNA, 25 bp, Artificial Sequence
  Synthetic
acutatccaactuggccagaaacag

SEQ ID NO: 58914 - DNA, 26 bp, Artificial Sequence
  Synthetic
caatattgtuagggatagccttugct

SEQ ID NO: 58915 - DNA, 28 bp, Artificial Sequence
  Synthetic
atgcugaaaaactgttugaggacaaaat

SEQ ID NO: 58916 - DNA, 24 bp, Artificial Sequence
  Synthetic
cagaaatatgutgctgcacauggg

SEQ ID NO: 58917 - DNA, 27 bp, Artificial Sequence
  Synthetic
atggctattccucatttctccacttut

SEQ ID NO: 58918 - DNA, 23 bp, Artificial Sequence
  Synthetic
gttaccugcaaatcccaatugcc

SEQ ID NO: 58919 - DNA, 20 bp, Artificial Sequence
  Synthetic
gcatuccagggugcacaaaa

SEQ ID NO: 58920 - DNA, 23 bp, Artificial Sequence
  Synthetic
gcautgtgtttcguagaaggcaa

SEQ ID NO: 58921 - DNA, 23 bp, Artificial Sequence
  Synthetic
gcctaugcctttagcugaaggaa

SEQ ID NO: 58922 - DNA, 26 bp, Artificial Sequence
  Synthetic
agaaaactcatcugcaggctataugg

SEQ ID NO: 58923 - DNA, 28 bp, Artificial Sequence
  Synthetic
tacttttgcctgaugagctttctaguat

SEQ ID NO: 58924 - DNA, 25 bp, Artificial Sequence
  Synthetic
tactagcaatuaatgccagauggct

SEQ ID NO: 58925 - DNA, 28 bp, Artificial Sequence
  Synthetic
gtggtttgccuaaggatgttatgauagt

SEQ ID NO: 58926 - DNA, 21 bp, Artificial Sequence
  Synthetic
aggtggcaagaugggaaagug

SEQ ID NO: 58927 - DNA, 27 bp, Artificial Sequence
  Synthetic
aaccttacctgacugtctactacctut

SEQ ID NO: 58928 - DNA, 27 bp, Artificial Sequence
  Synthetic
tcattctcagagucctgaagcatttut

SEQ ID NO: 58929 - DNA, 22 bp, Artificial Sequence
  Synthetic
agaactgcuaacctcccctuct

SEQ ID NO: 58930 - DNA, 19 bp, Artificial Sequence
  Synthetic
cgaccctucgcctaaccuc

SEQ ID NO: 58931 - DNA, 24 bp, Artificial Sequence
  Synthetic
ggttgtccucgctttccaaauact

SEQ ID NO: 58932 - DNA, 27 bp, Artificial Sequence
  Synthetic
aaatattttgcugctcaatgtagugga

SEQ ID NO: 58933 - DNA, 28 bp, Artificial Sequence
  Synthetic
cttgtccattuaaaattgctccttuggt

SEQ ID NO: 58934 - DNA, 28 bp, Artificial Sequence
  Synthetic
gaggactttagagugtttgatagtuggt

SEQ ID NO: 58935 - DNA, 28 bp, Artificial Sequence
  Synthetic
catgaaactggcaacautaatacgctua

SEQ ID NO: 58936 - DNA, 20 bp, Artificial Sequence
  Synthetic
ggccccugacattgagcuaa

SEQ ID NO: 58937 - DNA, 28 bp, Artificial Sequence
  Synthetic
acaagaaaacguaacaaatgatcccuca

SEQ ID NO: 58938 - DNA, 28 bp, Artificial Sequence
  Synthetic
ggtactcaugagagcattaagggattuc

SEQ ID NO: 58939 - DNA, 22 bp, Artificial Sequence
  Synthetic
gccaugaaaagcaaatgcucct

SEQ ID NO: 58940 - DNA, 23 bp, Artificial Sequence
  Synthetic
ggtgguggcagaaagagaugaaa

SEQ ID NO: 58941 - DNA, 28 bp, Artificial Sequence
  Synthetic
ctaatacaautgctatgtuccacacacc

SEQ ID NO: 58942 - DNA, 26 bp, Artificial Sequence
  Synthetic
cagtagaacagaugtcaagtggagut

SEQ ID NO: 58943 - DNA, 25 bp, Artificial Sequence
  Synthetic
ctcagatgagugtgttcaactguga

SEQ ID NO: 58944 - DNA, 23 bp, Artificial Sequence
  Synthetic
ctggaugcagcaaaccaatauca

SEQ ID NO: 58945 - DNA, 28 bp, Artificial Sequence
  Synthetic
gacaatgtcuttaaggttaaaugcggat

SEQ ID NO: 58946 - DNA, 28 bp, Artificial Sequence
  Synthetic
tgagaagagaaugttgaacaagucacat

SEQ ID NO: 58947 - DNA, 26 bp, Artificial Sequence
  Synthetic
cagttacuggaggattctaccucaga

SEQ ID NO: 58948 - DNA, 26 bp, Artificial Sequence
  Synthetic
cccucattcatcugcaggaaaagaaa

SEQ ID NO: 58949 - DNA, 21 bp, Artificial Sequence
  Synthetic
aacctccucctgggcttauca

SEQ ID NO: 58950 - DNA, 22 bp, Artificial Sequence
  Synthetic
ggaccauggagagggaagatut

SEQ ID NO: 58951 - DNA, 23 bp, Artificial Sequence
  Synthetic
gtcagtctguggttcggtttcut

SEQ ID NO: 58952 - DNA, 23 bp, Artificial Sequence
  Synthetic
agagacucccaaagctgctttut

SEQ ID NO: 58953 - DNA, 27 bp, Artificial Sequence
  Synthetic
caatattcaaaucatggtgtgcugaca

SEQ ID NO: 58954 - DNA, 33 bp, Artificial Sequence
  Synthetic
agtggtattttatgugacttttctatcataugt

SEQ ID NO: 58955 - DNA, 24 bp, Artificial Sequence
  Synthetic
cagtcatctgcugtggttgaaaut

SEQ ID NO: 58956 - DNA, 26 bp, Artificial Sequence
  Synthetic
gttgattuggaagcaccaatttcugt

SEQ ID NO: 58957 - DNA, 24 bp, Artificial Sequence
  Synthetic
gagctgggtuataatgccatcuct

SEQ ID NO: 58958 - DNA, 28 bp, Artificial Sequence
  Synthetic
ggacctcaaacaacaaugtattcagcua

SEQ ID NO: 58959 - DNA, 27 bp, Artificial Sequence
  Synthetic
tcaucttttacttugagaaggcaagca

SEQ ID NO: 58960 - DNA, 29 bp, Artificial Sequence
  Synthetic
tggatcaggutcgtgaatatauggaaaat

SEQ ID NO: 58961 - DNA, 25 bp, Artificial Sequence
  Synthetic
agaatggtgggcuctatccaauact

SEQ ID NO: 58962 - DNA, 27 bp, Artificial Sequence
  Synthetic
cttcttgtgagugcagatactttucaa

SEQ ID NO: 58963 - DNA, 28 bp, Artificial Sequence
  Synthetic
acagaaauggttacaatgucaacagaga

SEQ ID NO: 58964 - DNA, 32 bp, Artificial Sequence
  Synthetic
agtcttttgagcagutacctattttguagaaa

SEQ ID NO: 58965 - DNA, 27 bp, Artificial Sequence
  Synthetic
gcccaccagaagaaugataaaaugagt

SEQ ID NO: 58966 - DNA, 23 bp, Artificial Sequence
  Synthetic
ctggttttgatuggtcctggtug

SEQ ID NO: 58967 - DNA, 27 bp, Artificial Sequence
  Synthetic
ttatgtgcttccutgctttcaatgtut

SEQ ID NO: 58968 - DNA, 28 bp, Artificial Sequence
  Synthetic
gtcactctgtgcutagaggtatacuaga

SEQ ID NO: 58969 - DNA, 23 bp, Artificial Sequence
  Synthetic
cuaatgccttugaagccaggaag

SEQ ID NO: 58970 - DNA, 28 bp, Artificial Sequence
  Synthetic
tgtgtgtcuggcataatugaaaaacaat

SEQ ID NO: 58971 - DNA, 25 bp, Artificial Sequence
  Synthetic
actgtttgaccuggagttccattut

SEQ ID NO: 58972 - DNA, 21 bp, Artificial Sequence
  Synthetic
ctggugagagaggacgtgtug

SEQ ID NO: 58973 - DNA, 23 bp, Artificial Sequence
  Synthetic
aactccttucaaactccccagug

SEQ ID NO: 58974 - DNA, 22 bp, Artificial Sequence
  Synthetic
ctgccctuccttgatatugcac

SEQ ID NO: 58975 - DNA, 27 bp, Artificial Sequence
  Synthetic
agaagaaauggaaggattcagcttuca

SEQ ID NO: 58976 - DNA, 26 bp, Artificial Sequence
  Synthetic
acacattatttccauaccaccagcuc

SEQ ID NO: 58977 - DNA, 25 bp, Artificial Sequence
  Synthetic
agtgagaatgugaccagacugagat

SEQ ID NO: 58978 - DNA, 27 bp, Artificial Sequence
  Synthetic
ctgctgtttccuataagaataccugct

SEQ ID NO: 58979 - DNA, 28 bp, Artificial Sequence
  Synthetic
cccctctguagaactgttgatttgttua

SEQ ID NO: 58980 - DNA, 26 bp, Artificial Sequence
  Synthetic
acacctaagaugagtagcaguaagca

SEQ ID NO: 58981 - DNA, 21 bp, Artificial Sequence
  Synthetic
ctcauagagaccucccgaacc

SEQ ID NO: 58982 - DNA, 27 bp, Artificial Sequence
  Synthetic
accatggtguagcattactaaguaagg

SEQ ID NO: 58983 - DNA, 28 bp, Artificial Sequence
  Synthetic
cagtgacttgatutttgccagttatcut

SEQ ID NO: 58984 - DNA, 28 bp, Artificial Sequence
  Synthetic
gatacaatagtgucatctacaggtgcut

SEQ ID NO: 58985 - DNA, 26 bp, Artificial Sequence
  Synthetic
aggagguaauaagaggcagaaagaca

SEQ ID NO: 58986 - DNA, 21 bp, Artificial Sequence
  Synthetic
ccctcatccucactgctcuca

SEQ ID NO: 58987 - DNA, 22 bp, Artificial Sequence
  Synthetic
tctctgaggcccautctctgut

SEQ ID NO: 58988 - DNA, 20 bp, Artificial Sequence
  Synthetic
gaccagaaguggucggagaa

SEQ ID NO: 58989 - DNA, 19 bp, Artificial Sequence
  Synthetic
agctcccugtcctcuccat

SEQ ID NO: 58990 - DNA, 17 bp, Artificial Sequence
  Synthetic
gcgcauggcctcgaugt

SEQ ID NO: 58991 - DNA, 18 bp, Artificial Sequence
  Synthetic
auggacaaccacguggca

SEQ ID NO: 58992 - DNA, 17 bp, Artificial Sequence
  Synthetic
gcgtccucgccagtcua

SEQ ID NO: 58993 - DNA, 17 bp, Artificial Sequence
  Synthetic
ggtguaagcggcuccgt

SEQ ID NO: 58994 - DNA, 22 bp, Artificial Sequence
  Synthetic
ccaggtugagttttccauggag

SEQ ID NO: 58995 - DNA, 22 bp, Artificial Sequence
  Synthetic
tggtccctgguactctcatgut

SEQ ID NO: 58996 - DNA, 28 bp, Artificial Sequence
  Synthetic
ctcactttagcaugagtctatcagaugg

SEQ ID NO: 58997 - DNA, 27 bp, Artificial Sequence
  Synthetic
aguaacatttgctcucagaaacacaca

SEQ ID NO: 58998 - DNA, 26 bp, Artificial Sequence
  Synthetic
cctcttagguaaacagctccugaaag

SEQ ID NO: 58999 - DNA, 28 bp, Artificial Sequence
  Synthetic
aaatattttggtagaguttctgccacua

SEQ ID NO: 59000 - DNA, 33 bp, Artificial Sequence
  Synthetic
aaggtatcttgattutaagttgtaattcctuga

SEQ ID NO: 59001 - DNA, 28 bp, Artificial Sequence
  Synthetic
acctgaacagtautctggagttacguat

SEQ ID NO: 59002 - DNA, 28 bp, Artificial Sequence
  Synthetic
tgggcatcuatagaagatcuggaaaaag

SEQ ID NO: 59003 - DNA, 24 bp, Artificial Sequence
  Synthetic
caauatgcaagtugacagcaccaa

SEQ ID NO: 59004 - DNA, 24 bp, Artificial Sequence
  Synthetic
ttgcaaugggtttugaaagcaagt

SEQ ID NO: 59005 - DNA, 21 bp, Artificial Sequence
  Synthetic
cttcagtttuggcagcagcut

SEQ ID NO: 59006 - DNA, 23 bp, Artificial Sequence
  Synthetic
gcagctaucgacagattcuccaa

SEQ ID NO: 59007 - DNA, 28 bp, Artificial Sequence
  Synthetic
tttttaaaggcaucaggactttcttgug

SEQ ID NO: 59008 - DNA, 27 bp, Artificial Sequence
  Synthetic
cagcctttgautatttttcgaccucaa

SEQ ID NO: 59009 - DNA, 28 bp, Artificial Sequence
  Synthetic
ccccttttcguagaagatcctctattuc

SEQ ID NO: 59010 - DNA, 21 bp, Artificial Sequence
  Synthetic
cattcttucccacggacgcua

SEQ ID NO: 59011 - DNA, 21 bp, Artificial Sequence
  Synthetic
acccuguagcacaaacagcat

SEQ ID NO: 59012 - DNA, 22 bp, Artificial Sequence
  Synthetic
ctctcgaacuctgtaccgcaut

SEQ ID NO: 59013 - DNA, 25 bp, Artificial Sequence
  Synthetic
aggataacucagggtcatugaggat

SEQ ID NO: 59014 - DNA, 25 bp, Artificial Sequence
  Synthetic
acauttaccgtaaguacagcagcaa

SEQ ID NO: 59015 - DNA, 28 bp, Artificial Sequence
  Synthetic
cccaaagttttuacagcttatgacguat

SEQ ID NO: 59016 - DNA, 22 bp, Artificial Sequence
  Synthetic
cacaatctggcuctgctgauga

SEQ ID NO: 59017 - DNA, 22 bp, Artificial Sequence
  Synthetic
aatacgttugccagctggttug

SEQ ID NO: 59018 - DNA, 24 bp, Artificial Sequence
  Synthetic
cuctttagctaucccaggagaggt

SEQ ID NO: 59019 - DNA, 28 bp, Artificial Sequence
  Synthetic
ttcatttgctgttuactcctcttctcut

SEQ ID NO: 59020 - DNA, 21 bp, Artificial Sequence
  Synthetic
ggaaatgugcacgctggaauc

SEQ ID NO: 59021 - DNA, 23 bp, Artificial Sequence
  Synthetic
gttttattucggaggctugcagt

SEQ ID NO: 59022 - DNA, 22 bp, Artificial Sequence
  Synthetic
cccagctcugatctacccagua

SEQ ID NO: 59023 - DNA, 24 bp, Artificial Sequence
  Synthetic
gggaaccttuggtctaaatggcut

SEQ ID NO: 59024 - DNA, 27 bp, Artificial Sequence
  Synthetic
tccatatttctgtugatcagctctguc

SEQ ID NO: 59025 - DNA, 21 bp, Artificial Sequence
  Synthetic
agtguccaggcacagaguagt

SEQ ID NO: 59026 - DNA, 27 bp, Artificial Sequence
  Synthetic
ctgaaaatttgacutactgtgccaucc

SEQ ID NO: 59027 - DNA, 28 bp, Artificial Sequence
  Synthetic
tgaggagcagguttctatatgagagtut

SEQ ID NO: 59028 - DNA, 26 bp, Artificial Sequence
  Synthetic
cctgcttcuggatcgtttactttuca

SEQ ID NO: 59029 - DNA, 28 bp, Artificial Sequence
  Synthetic
gatctacaucattgtcatcucccagaaa

SEQ ID NO: 59030 - DNA, 22 bp, Artificial Sequence
  Synthetic
tcctgagcagcauccctttcua

SEQ ID NO: 59031 - DNA, 28 bp, Artificial Sequence
  Synthetic
ggttctccacauggtgaatgaacttuat

SEQ ID NO: 59032 - DNA, 20 bp, Artificial Sequence
  Synthetic
ctgggaugcgatgtgggtua

SEQ ID NO: 59033 - DNA, 22 bp, Artificial Sequence
  Synthetic
ggacaugaagaccttggtgugg

SEQ ID NO: 59034 - DNA, 23 bp, Artificial Sequence
  Synthetic
cgctggacuctttagcagagtut

SEQ ID NO: 59035 - DNA, 25 bp, Artificial Sequence
  Synthetic
ctctgcuggagggaaattcttcaut

SEQ ID NO: 59036 - DNA, 21 bp, Artificial Sequence
  Synthetic
gggaaacaaccccugaggaut

SEQ ID NO: 59037 - DNA, 23 bp, Artificial Sequence
  Synthetic
catcgctugccttttcttctugg

SEQ ID NO: 59038 - DNA, 24 bp, Artificial Sequence
  Synthetic
agccaggaaccugacctatttcua

SEQ ID NO: 59039 - DNA, 25 bp, Artificial Sequence
  Synthetic
cttgttgtcttcutcctgttcccut

SEQ ID NO: 59040 - DNA, 21 bp, Artificial Sequence
  Synthetic
cutccugcaaaccacagacct

SEQ ID NO: 59041 - DNA, 23 bp, Artificial Sequence
  Synthetic
ttcagcttccucctccacttcua

SEQ ID NO: 59042 - DNA, 22 bp, Artificial Sequence
  Synthetic
cccctagaaaugccacctctua

SEQ ID NO: 59043 - DNA, 22 bp, Artificial Sequence
  Synthetic
tgccatcctugaagtccatguc

SEQ ID NO: 59044 - DNA, 25 bp, Artificial Sequence
  Synthetic
gttctgtgccaacaauatgcaagut

SEQ ID NO: 59045 - DNA, 25 bp, Artificial Sequence
  Synthetic
cagtagccttuctgagagccuaaag

SEQ ID NO: 59046 - DNA, 21 bp, Artificial Sequence
  Synthetic
tggccagaugcctcttcatug

SEQ ID NO: 59047 - DNA, 25 bp, Artificial Sequence
  Synthetic
cagtgtgagugagtgtcagtguaat

SEQ ID NO: 59048 - DNA, 21 bp, Artificial Sequence
  Synthetic
cctgcagcugtcctcugaaag

SEQ ID NO: 59049 - DNA, 26 bp, Artificial Sequence
  Synthetic
cttgataccucccaaaaacggattut

SEQ ID NO: 59050 - DNA, 21 bp, Artificial Sequence
  Synthetic
cctgacuccagctgtctcugt

SEQ ID NO: 59051 - DNA, 21 bp, Artificial Sequence
  Synthetic
ctcgccauaggtgaggtcauc

SEQ ID NO: 59052 - DNA, 22 bp, Artificial Sequence
  Synthetic
gcaccagaauggatttgggtut

SEQ ID NO: 59053 - DNA, 23 bp, Artificial Sequence
  Synthetic
gaatacacugacaccuccaccag

SEQ ID NO: 59054 - DNA, 19 bp, Artificial Sequence
  Synthetic
gggctttgutgctgtgugt

SEQ ID NO: 59055 - DNA, 18 bp, Artificial Sequence
  Synthetic
cggagggccutgtcguag

SEQ ID NO: 59056 - DNA, 25 bp, Artificial Sequence
  Synthetic
ggtaacatuaacttccaagcuccca

SEQ ID NO: 59057 - DNA, 26 bp, Artificial Sequence
  Synthetic
ggcaggauaaacacagcttatgucaa

SEQ ID NO: 59058 - DNA, 22 bp, Artificial Sequence
  Synthetic
aggcagaaggagagaugttugg

SEQ ID NO: 59059 - DNA, 28 bp, Artificial Sequence
  Synthetic
actgtggaacucaaatcagaacctaaug

SEQ ID NO: 59060 - DNA, 23 bp, Artificial Sequence
  Synthetic
caggcaaccagaagucatctcua

SEQ ID NO: 59061 - DNA, 26 bp, Artificial Sequence
  Synthetic
gautatgaggcattuccagaccaaga

SEQ ID NO: 59062 - DNA, 24 bp, Artificial Sequence
  Synthetic
tgcttttucccacacacctctaut

SEQ ID NO: 59063 - DNA, 26 bp, Artificial Sequence
  Synthetic
actactatgaacutgttgttguggca

SEQ ID NO: 59064 - DNA, 25 bp, Artificial Sequence
  Synthetic
acagcugaaagcctctgatuagaag

SEQ ID NO: 59065 - DNA, 21 bp, Artificial Sequence
  Synthetic
tgagugggcgccatatcaaut

SEQ ID NO: 59066 - DNA, 21 bp, Artificial Sequence
  Synthetic
gggtttccugtggaccugaag

SEQ ID NO: 59067 - DNA, 26 bp, Artificial Sequence
  Synthetic
ctgaaaagtucccagatctcaugagt

SEQ ID NO: 59068 - DNA, 20 bp, Artificial Sequence
  Synthetic
aatggcacccuggtguacag

SEQ ID NO: 59069 - DNA, 23 bp, Artificial Sequence
  Synthetic
gggtccauacagtcaguaacaga

SEQ ID NO: 59070 - DNA, 18 bp, Artificial Sequence
  Synthetic
gccaccgugttcgucact

SEQ ID NO: 59071 - DNA, 19 bp, Artificial Sequence
  Synthetic
ctctggugccacugagcat

SEQ ID NO: 59072 - DNA, 24 bp, Artificial Sequence
  Synthetic
gccatcttcuccttcatcgucaag

SEQ ID NO: 59073 - DNA, 22 bp, Artificial Sequence
  Synthetic
cagtgtacucagccttggugaa

SEQ ID NO: 59074 - DNA, 28 bp, Artificial Sequence
  Synthetic
tcttctctgtcutacgttctatcauggt

SEQ ID NO: 59075 - DNA, 28 bp, Artificial Sequence
  Synthetic
tcgutgtattgaucagaaaagcagaact

SEQ ID NO: 59076 - DNA, 18 bp, Artificial Sequence
  Synthetic
cctgagugccctcucact

SEQ ID NO: 59077 - DNA, 19 bp, Artificial Sequence
  Synthetic
cacacaugccctccuccaa

SEQ ID NO: 59078 - DNA, 24 bp, Artificial Sequence
  Synthetic
caattacagucccactcccuacac

SEQ ID NO: 59079 - DNA, 23 bp, Artificial Sequence
  Synthetic
gagaagcuatcatctgucaccca

SEQ ID NO: 59080 - DNA, 23 bp, Artificial Sequence
  Synthetic
ccctctcucctttctgtccugag

SEQ ID NO: 59081 - DNA, 21 bp, Artificial Sequence
  Synthetic
cccacatgccaucgaagtgut

SEQ ID NO: 59082 - DNA, 21 bp, Artificial Sequence
  Synthetic
tgaaatctgcucatgcccugt

SEQ ID NO: 59083 - DNA, 21 bp, Artificial Sequence
  Synthetic
agcctcccgaaucctttgtug

SEQ ID NO: 59084 - DNA, 22 bp, Artificial Sequence
  Synthetic
ccagcctgugtttctccactut

SEQ ID NO: 59085 - DNA, 20 bp, Artificial Sequence
  Synthetic
cagttcggaaucgctgcauc

SEQ ID NO: 59086 - DNA, 17 bp, Artificial Sequence
  Synthetic
cgccggugagccuagac

SEQ ID NO: 59087 - DNA, 19 bp, Artificial Sequence
  Synthetic
caccagcucucaggaagca

SEQ ID NO: 59088 - DNA, 22 bp, Artificial Sequence
  Synthetic
ctgttcucagggtgtcctucag

SEQ ID NO: 59089 - DNA, 20 bp, Artificial Sequence
  Synthetic
acguactccgucccgaagaa

SEQ ID NO: 59090 - DNA, 20 bp, Artificial Sequence
  Synthetic
tgcacccauggagaggauga

SEQ ID NO: 59091 - DNA, 19 bp, Artificial Sequence
  Synthetic
acaccacugaccuggacga

SEQ ID NO: 59092 - DNA, 19 bp, Artificial Sequence
  Synthetic
cuctatuggcccccacaca

SEQ ID NO: 59093 - DNA, 23 bp, Artificial Sequence
  Synthetic
ttcaccagctucctcctctttuc

SEQ ID NO: 59094 - DNA, 21 bp, Artificial Sequence
  Synthetic
cctttcuccagggcctcaaut

SEQ ID NO: 59095 - DNA, 28 bp, Artificial Sequence
  Synthetic
aggctccaagtuaatccaaatttctcut

SEQ ID NO: 59096 - DNA, 24 bp, Artificial Sequence
  Synthetic
gcugacaaagaagaagguggagat

SEQ ID NO: 59097 - DNA, 25 bp, Artificial Sequence
  Synthetic
tttcacagtccugtacatcttgugg

SEQ ID NO: 59098 - DNA, 22 bp, Artificial Sequence
  Synthetic
ccgtcuggaagcctcucaaaat

SEQ ID NO: 59099 - DNA, 22 bp, Artificial Sequence
  Synthetic
gtggagugcatctauggaaggg

SEQ ID NO: 59100 - DNA, 21 bp, Artificial Sequence
  Synthetic
gaagacgcggaaguaguagcc

SEQ ID NO: 59101 - DNA, 25 bp, Artificial Sequence
  Synthetic
tgctgatctgaauccctccatagua

SEQ ID NO: 59102 - DNA, 25 bp, Artificial Sequence
  Synthetic
gcaggagcaaaaggaugggaaatua

SEQ ID NO: 59103 - DNA, 21 bp, Artificial Sequence
  Synthetic
cgctgaggucaaatggcucaa

SEQ ID NO: 59104 - DNA, 19 bp, Artificial Sequence
  Synthetic
cagugacgccgtacuggaa

SEQ ID NO: 59105 - DNA, 20 bp, Artificial Sequence
  Synthetic
gtggctacagcuccttgguc

SEQ ID NO: 59106 - DNA, 20 bp, Artificial Sequence
  Synthetic
tcagggaaggcugaucagga

SEQ ID NO: 59107 - DNA, 18 bp, Artificial Sequence
  Synthetic
gcggaggcagugacauca

SEQ ID NO: 59108 - DNA, 22 bp, Artificial Sequence
  Synthetic
aggaggagggaautcgcuaaga

SEQ ID NO: 59109 - DNA, 18 bp, Artificial Sequence
  Synthetic
gucccccaucccacaagg

SEQ ID NO: 59110 - DNA, 20 bp, Artificial Sequence
  Synthetic
cccgactcaucctgcaagua

SEQ ID NO: 59111 - DNA, 20 bp, Artificial Sequence
  Synthetic
ctctgcagacacugcccaut

SEQ ID NO: 59112 - DNA, 20 bp, Artificial Sequence
  Synthetic
tccauctacucgccagagca

SEQ ID NO: 59113 - DNA, 24 bp, Artificial Sequence
  Synthetic
acagttggagcuctaggtccuaag

SEQ ID NO: 59114 - DNA, 21 bp, Artificial Sequence
  Synthetic
gggccugaacaacaccctuac

SEQ ID NO: 59115 - DNA, 22 bp, Artificial Sequence
  Synthetic
gggagatgaugttcatgggcut

SEQ ID NO: 59116 - DNA, 22 bp, Artificial Sequence
  Synthetic
atgagacccaguttggcaucaa

SEQ ID NO: 59117 - DNA, 24 bp, Artificial Sequence
  Synthetic
ggatatcttautcctgggcuggag

SEQ ID NO: 59118 - DNA, 20 bp, Artificial Sequence
  Synthetic
agctgcgguactcaggaaug

SEQ ID NO: 59119 - DNA, 26 bp, Artificial Sequence
  Synthetic
tcctgataagaaaautgggaccctug

SEQ ID NO: 59120 - DNA, 21 bp, Artificial Sequence
  Synthetic
gcctcccagcaguactttgua

SEQ ID NO: 59121 - DNA, 23 bp, Artificial Sequence
  Synthetic
catcccttcuctaggactccuct

SEQ ID NO: 59122 - DNA, 18 bp, Artificial Sequence
  Synthetic
ggacgugagcactccuct

SEQ ID NO: 59123 - DNA, 20 bp, Artificial Sequence
  Synthetic
gctgugcacgaaggcaacua

SEQ ID NO: 59124 - DNA, 24 bp, Artificial Sequence
  Synthetic
ggcagaggtucctgtcagaatauc

SEQ ID NO: 59125 - DNA, 21 bp, Artificial Sequence
  Synthetic
tgguccccaaaagccaaacut

SEQ ID NO: 59126 - DNA, 28 bp, Artificial Sequence
  Synthetic
ctgttcctcaguttgtcactaaaatcuc

SEQ ID NO: 59127 - DNA, 31 bp, Artificial Sequence
  Synthetic
gcaaattaccutaatttccataguagggaca

SEQ ID NO: 59128 - DNA, 18 bp, Artificial Sequence
  Synthetic
gcagtggugccgtcctuc

SEQ ID NO: 59129 - DNA, 23 bp, Artificial Sequence
  Synthetic
gagatcuccacacggtagttgua

SEQ ID NO: 59130 - DNA, 21 bp, Artificial Sequence
  Synthetic
catgggaguctcctgcactuc

SEQ ID NO: 59131 - DNA, 23 bp, Artificial Sequence
  Synthetic
gagagggacagucaggaaugaaa

SEQ ID NO: 59132 - DNA, 17 bp, Artificial Sequence
  Synthetic
cgcctgugtgcctucct

SEQ ID NO: 59133 - DNA, 17 bp, Artificial Sequence
  Synthetic
gggccaggccucaaucc

SEQ ID NO: 59134 - DNA, 24 bp, Artificial Sequence
  Synthetic
gcatccctaucccaggactattug

SEQ ID NO: 59135 - DNA, 28 bp, Artificial Sequence
  Synthetic
cagggagaaaaagcucattcattcatut

SEQ ID NO: 59136 - DNA, 25 bp, Artificial Sequence
  Synthetic
tccataccuaccgtaagtgcauaca

SEQ ID NO: 59137 - DNA, 28 bp, Artificial Sequence
  Synthetic
tggtttaagaactugggagtaaccttut

SEQ ID NO: 59138 - DNA, 21 bp, Artificial Sequence
  Synthetic
gcauaagcugagaccgaagcc

SEQ ID NO: 59139 - DNA, 24 bp, Artificial Sequence
  Synthetic
gcaacuacacacaagaagcaucct

SEQ ID NO: 59140 - DNA, 26 bp, Artificial Sequence
  Synthetic
cacatccctagutttccatggtaucc

SEQ ID NO: 59141 - DNA, 24 bp, Artificial Sequence
  Synthetic
aaaatgattttgtuggaggccgut

SEQ ID NO: 59142 - DNA, 20 bp, Artificial Sequence
  Synthetic
gcaggctcutgactgtcugg

SEQ ID NO: 59143 - DNA, 19 bp, Artificial Sequence
  Synthetic
ccagcugagtacggcuaca

SEQ ID NO: 59144 - DNA, 24 bp, Artificial Sequence
  Synthetic
acctttttgacutttctccccgut

SEQ ID NO: 59145 - DNA, 28 bp, Artificial Sequence
  Synthetic
agggagaaugagttgaagugaaaacaat

SEQ ID NO: 59146 - DNA, 27 bp, Artificial Sequence
  Synthetic
ccagaagcauagcaatacguaagaact

SEQ ID NO: 59147 - DNA, 29 bp, Artificial Sequence
  Synthetic
ccattcatcaaattuagacagcacatcut

SEQ ID NO: 59148 - DNA, 21 bp, Artificial Sequence
  Synthetic
cttcuaggccacatggtugct

SEQ ID NO: 59149 - DNA, 22 bp, Artificial Sequence
  Synthetic
gccctuagggtgtttuggacaa

SEQ ID NO: 59150 - DNA, 22 bp, Artificial Sequence
  Synthetic
cgagaccugaaaccccacaaug

SEQ ID NO: 59151 - DNA, 28 bp, Artificial Sequence
  Synthetic
tcagtggttauccatcctgaagauagaa

SEQ ID NO: 59152 - DNA, 21 bp, Artificial Sequence
  Synthetic
caaggctgtuctgaggagcua

SEQ ID NO: 59153 - DNA, 28 bp, Artificial Sequence
  Synthetic
cccagaagtcugattgaacattttcuct

SEQ ID NO: 59154 - DNA, 28 bp, Artificial Sequence
  Synthetic
tgaaattauggaaatccctguaccacac

SEQ ID NO: 59155 - DNA, 22 bp, Artificial Sequence
  Synthetic
gattccatccuggctgaaccut

SEQ ID NO: 59156 - DNA, 21 bp, Artificial Sequence
  Synthetic
acataccaaguagccccucca

SEQ ID NO: 59157 - DNA, 25 bp, Artificial Sequence
  Synthetic
tgccagacaccauagttgagtatuc

SEQ ID NO: 59158 - DNA, 27 bp, Artificial Sequence
  Synthetic
gtgtatgccaugagtatttcttugcat

SEQ ID NO: 59159 - DNA, 23 bp, Artificial Sequence
  Synthetic
cccactcaccagauactgatgut

SEQ ID NO: 59160 - DNA, 23 bp, Artificial Sequence
  Synthetic
gataaagaagccacuccaugcag

SEQ ID NO: 59161 - DNA, 24 bp, Artificial Sequence
  Synthetic
tcggttgtguacatgctcctttut

SEQ ID NO: 59162 - DNA, 25 bp, Artificial Sequence
  Synthetic
catgcgttuaggcataguagagaca

SEQ ID NO: 59163 - DNA, 20 bp, Artificial Sequence
  Synthetic
ccaccttcucgctaccaguc

SEQ ID NO: 59164 - DNA, 24 bp, Artificial Sequence
  Synthetic
gccuctctgatuacacaaaccagt

SEQ ID NO: 59165 - DNA, 24 bp, Artificial Sequence
  Synthetic
agggcuccaaatgtgaaguacaag

SEQ ID NO: 59166 - DNA, 19 bp, Artificial Sequence
  Synthetic
ctccgugcacagagtggua

SEQ ID NO: 59167 - DNA, 18 bp, Artificial Sequence
  Synthetic
aaccauggcuccccacag

SEQ ID NO: 59168 - DNA, 30 bp, Artificial Sequence
  Synthetic
actgcattctautatgcatttaacuaaggt

SEQ ID NO: 59169 - DNA, 28 bp, Artificial Sequence
  Synthetic
aagaaactttuagcaccaatgcagaaut

SEQ ID NO: 59170 - DNA, 32 bp, Artificial Sequence
  Synthetic
agtagaatgttaccaagautatttttgaccua

SEQ ID NO: 59171 - DNA, 20 bp, Artificial Sequence
  Synthetic
gctatccgugcactcctgut

SEQ ID NO: 59172 - DNA, 25 bp, Artificial Sequence
  Synthetic
ctgtgtgcugagagatgtaaugaca

SEQ ID NO: 59173 - DNA, 30 bp, Artificial Sequence
  Synthetic
aagcaaatcaaucaaatataccatgugcaa

SEQ ID NO: 59174 - DNA, 28 bp, Artificial Sequence
  Synthetic
tcctcgacatugatttctgttttuacct

SEQ ID NO: 59175 - DNA, 28 bp, Artificial Sequence
  Synthetic
cgaactggaaagaugctgcttttaauat

SEQ ID NO: 59176 - DNA, 25 bp, Artificial Sequence
  Synthetic
tcttattcccacagugtatcggcua

SEQ ID NO: 59177 - DNA, 28 bp, Artificial Sequence
  Synthetic
cagutaacaagtaaguagggaggagaga

SEQ ID NO: 59178 - DNA, 22 bp, Artificial Sequence
  Synthetic
gauggtatguaacagcgaccgt

SEQ ID NO: 59179 - DNA, 27 bp, Artificial Sequence
  Synthetic
gctactggaaaacautcaaaactggut

SEQ ID NO: 59180 - DNA, 26 bp, Artificial Sequence
  Synthetic
cggttttcatatuggacagtgaggua

SEQ ID NO: 59181 - DNA, 22 bp, Artificial Sequence
  Synthetic
caatggtcugtctctgtgucgt

SEQ ID NO: 59182 - DNA, 23 bp, Artificial Sequence
  Synthetic
cttactctgggucctggtttucc

SEQ ID NO: 59183 - DNA, 29 bp, Artificial Sequence
  Synthetic
gtcagtactcaguttctgcctatcattut

SEQ ID NO: 59184 - DNA, 22 bp, Artificial Sequence
  Synthetic
ccaactcatcuctggcctctug

SEQ ID NO: 59185 - DNA, 22 bp, Artificial Sequence
  Synthetic
agtatgaggagucgcagtcuga

SEQ ID NO: 59186 - DNA, 24 bp, Artificial Sequence
  Synthetic
agcaggaaaagcautgagcatcua

SEQ ID NO: 59187 - DNA, 21 bp, Artificial Sequence
  Synthetic
ggagcaggagcugatugagac

SEQ ID NO: 59188 - DNA, 20 bp, Artificial Sequence
  Synthetic
cccctcugggtgagtaccut

SEQ ID NO: 59189 - DNA, 18 bp, Artificial Sequence
  Synthetic
ggactcgcugcagaccuc

SEQ ID NO: 59190 - DNA, 22 bp, Artificial Sequence
  Synthetic
gggctgcuattttgtctauggt

SEQ ID NO: 59191 - DNA, 23 bp, Artificial Sequence
  Synthetic
gcaucaactucaccaacgagaag

SEQ ID NO: 59192 - DNA, 28 bp, Artificial Sequence
  Synthetic
gtagggaatgaugaagtaagtgctuagg

SEQ ID NO: 59193 - DNA, 28 bp, Artificial Sequence
  Synthetic
ccccaaagttcugctatacatgttucaa

SEQ ID NO: 59194 - DNA, 29 bp, Artificial Sequence
  Synthetic
tgctgtgttatatuctgctttcgtaaugt

SEQ ID NO: 59195 - DNA, 28 bp, Artificial Sequence
  Synthetic
gcatcatccttaauctcatcccatgtug

SEQ ID NO: 59196 - DNA, 24 bp, Artificial Sequence
  Synthetic
ggugggagaagugaaaggaaaagt

SEQ ID NO: 59197 - DNA, 23 bp, Artificial Sequence
  Synthetic
gctttaccgagutttccuccgat

SEQ ID NO: 59198 - DNA, 27 bp, Artificial Sequence
  Synthetic
aaggcttctgaguggtacaacttttua

SEQ ID NO: 59199 - DNA, 21 bp, Artificial Sequence
  Synthetic
caaggcugacactcacgauga

SEQ ID NO: 59200 - DNA, 20 bp, Artificial Sequence
  Synthetic
gcacaccaagcacagucuga

SEQ ID NO: 59201 - DNA, 21 bp, Artificial Sequence
  Synthetic
ccaagctucgccttccttuct

SEQ ID NO: 59202 - DNA, 23 bp, Artificial Sequence
  Synthetic
ccacctttucatgcaccugagaa

SEQ ID NO: 59203 - DNA, 20 bp, Artificial Sequence
  Synthetic
ctcctctucacgcctgugac

SEQ ID NO: 59204 - DNA, 22 bp, Artificial Sequence
  Synthetic
acagucagagaaucaggcgaag

SEQ ID NO: 59205 - DNA, 23 bp, Artificial Sequence
  Synthetic
ttgccacuaaggccctactttut

SEQ ID NO: 59206 - DNA, 22 bp, Artificial Sequence
  Synthetic
tccatggtucctacgaagcuct

SEQ ID NO: 59207 - DNA, 24 bp, Artificial Sequence
  Synthetic
gtaaaaggctucctgacactugga

SEQ ID NO: 59208 - DNA, 25 bp, Artificial Sequence
  Synthetic
agactttgatgautgtcctgtgcut

SEQ ID NO: 59209 - DNA, 26 bp, Artificial Sequence
  Synthetic
actccagatataacugggacttccug

SEQ ID NO: 59210 - DNA, 28 bp, Artificial Sequence
  Synthetic
ccatcttggtaccuatattcatggcuat

SEQ ID NO: 59211 - DNA, 28 bp, Artificial Sequence
  Synthetic
cttgcttaagauatggacgaaugcaaag

SEQ ID NO: 59212 - DNA, 29 bp, Artificial Sequence
  Synthetic
aaattctgtctuctttgcttaccuacaca

SEQ ID NO: 59213 - DNA, 26 bp, Artificial Sequence
  Synthetic
aacaguggaaccaataucaacaacct

SEQ ID NO: 59214 - DNA, 23 bp, Artificial Sequence
  Synthetic
tctttaagagggcagucaacugt

SEQ ID NO: 59215 - DNA, 25 bp, Artificial Sequence
  Synthetic
ggtttttacaccuctccagatggua

SEQ ID NO: 59216 - DNA, 22 bp, Artificial Sequence
  Synthetic
cccttttctugctgctgtgtug

SEQ ID NO: 59217 - DNA, 21 bp, Artificial Sequence
  Synthetic
gtguaagcaggcagaguggat

SEQ ID NO: 59218 - DNA, 20 bp, Artificial Sequence
  Synthetic
tccuacagccacggatgcua

SEQ ID NO: 59219 - DNA, 24 bp, Artificial Sequence
  Synthetic
gaataagagcaugaccctgcauga

SEQ ID NO: 59220 - DNA, 24 bp, Artificial Sequence
  Synthetic
ctgcaggaaacuatctctcggtuc

SEQ ID NO: 59221 - DNA, 23 bp, Artificial Sequence
  Synthetic
aggatagaggccuacacacauct

SEQ ID NO: 59222 - DNA, 22 bp, Artificial Sequence
  Synthetic
gcuccgaccatuaaagcccaat

SEQ ID NO: 59223 - DNA, 25 bp, Artificial Sequence
  Synthetic
acacttactagacacucctctccuc

SEQ ID NO: 59224 - DNA, 22 bp, Artificial Sequence
  Synthetic
tgggaagacagagcugactuct

SEQ ID NO: 59225 - DNA, 22 bp, Artificial Sequence
  Synthetic
gtgactcgtguccttacgtgua

SEQ ID NO: 59226 - DNA, 20 bp, Artificial Sequence
  Synthetic
gtctgtccgutgctccauca

SEQ ID NO: 59227 - DNA, 25 bp, Artificial Sequence
  Synthetic
gcttccttugaaactgacatgtuca

SEQ ID NO: 59228 - DNA, 18 bp, Artificial Sequence
  Synthetic
ggcacucgggaaggtuct

SEQ ID NO: 59229 - DNA, 21 bp, Artificial Sequence
  Synthetic
gggagttguccctaggtcugg

SEQ ID NO: 59230 - DNA, 21 bp, Artificial Sequence
  Synthetic
ggtgctcguagtagtcgugga

SEQ ID NO: 59231 - DNA, 24 bp, Artificial Sequence
  Synthetic
tagaccucagatcucaaggaacca

SEQ ID NO: 59232 - DNA, 21 bp, Artificial Sequence
  Synthetic
ggtcctacaugctggaacuca

SEQ ID NO: 59233 - DNA, 22 bp, Artificial Sequence
  Synthetic
gttcctgguacccatgcuacag

SEQ ID NO: 59234 - DNA, 20 bp, Artificial Sequence
  Synthetic
ctgcccaugctccaaaggua

SEQ ID NO: 59235 - DNA, 21 bp, Artificial Sequence
  Synthetic
gtctgcccuctgtttctgguc

SEQ ID NO: 59236 - DNA, 28 bp, Artificial Sequence
  Synthetic
gtgttattgacgucatagagtgacuaga

SEQ ID NO: 59237 - DNA, 21 bp, Artificial Sequence
  Synthetic
gcacugacctctatguccaca

SEQ ID NO: 59238 - DNA, 21 bp, Artificial Sequence
  Synthetic
tgctgtctuaggactgcgtut

SEQ ID NO: 59239 - DNA, 17 bp, Artificial Sequence
  Synthetic
ggaacuggcugcgcaac

SEQ ID NO: 59240 - DNA, 19 bp, Artificial Sequence
  Synthetic
guttccctgcugccaggat

SEQ ID NO: 59241 - DNA, 19 bp, Artificial Sequence
  Synthetic
cuggccuaccgagagacac

SEQ ID NO: 59242 - DNA, 22 bp, Artificial Sequence
  Synthetic
gacatgatggcucgatacguct

SEQ ID NO: 59243 - DNA, 20 bp, Artificial Sequence
  Synthetic
cgcttgucgtcacagugaca

SEQ ID NO: 59244 - DNA, 20 bp, Artificial Sequence
  Synthetic
ctcccagacutacugcccaa

SEQ ID NO: 59245 - DNA, 21 bp, Artificial Sequence
  Synthetic
gccucacacaaactcggugaa

SEQ ID NO: 59246 - DNA, 19 bp, Artificial Sequence
  Synthetic
cutgttctuggcccgaagg

SEQ ID NO: 59247 - DNA, 21 bp, Artificial Sequence
  Synthetic
ccagttugaccgacucaacca

SEQ ID NO: 59248 - DNA, 19 bp, Artificial Sequence
  Synthetic
tcacccgugcatucgaagt

SEQ ID NO: 59249 - DNA, 20 bp, Artificial Sequence
  Synthetic
gggatacaccutcacgcuca

SEQ ID NO: 59250 - DNA, 24 bp, Artificial Sequence
  Synthetic
gttctcagccgugacgatgataut

SEQ ID NO: 59251 - DNA, 19 bp, Artificial Sequence
  Synthetic
ctcgucgtcaaugcaagcc

SEQ ID NO: 59252 - DNA, 21 bp, Artificial Sequence
  Synthetic
cctcggccauactcaccacua

SEQ ID NO: 59253 - DNA, 22 bp, Artificial Sequence
  Synthetic
ccaacgauaccctgttcucagt

SEQ ID NO: 59254 - DNA, 28 bp, Artificial Sequence
  Synthetic
aaacacaggtttugattctttgcatuct

SEQ ID NO: 59255 - DNA, 28 bp, Artificial Sequence
  Synthetic
atcttccuagaggcattcattgugaaat

SEQ ID NO: 59256 - DNA, 24 bp, Artificial Sequence
  Synthetic
gataatccuacctttguggccagt

SEQ ID NO: 59257 - DNA, 26 bp, Artificial Sequence
  Synthetic
tccaagttuggaacacaggcaataua

SEQ ID NO: 59258 - DNA, 23 bp, Artificial Sequence
  Synthetic
ggtggactugaacttggactuga

SEQ ID NO: 59259 - DNA, 20 bp, Artificial Sequence
  Synthetic
ggtctcagugcgctctctug

SEQ ID NO: 59260 - DNA, 22 bp, Artificial Sequence
  Synthetic
caaggttcugccactcucagac

SEQ ID NO: 59261 - DNA, 24 bp, Artificial Sequence
  Synthetic
aggacaagacugagttctccauca

SEQ ID NO: 59262 - DNA, 22 bp, Artificial Sequence
  Synthetic
caaacuccacattccuggcaag

SEQ ID NO: 59263 - DNA, 21 bp, Artificial Sequence
  Synthetic
ctgcccauctacucggagaag

SEQ ID NO: 59264 - DNA, 21 bp, Artificial Sequence
  Synthetic
agatccucaccgagtgctcut

SEQ ID NO: 59265 - DNA, 19 bp, Artificial Sequence
  Synthetic
cucgcaagacgucaaggga

SEQ ID NO: 59266 - DNA, 21 bp, Artificial Sequence
  Synthetic
ggcacctcucacaccaatgut

SEQ ID NO: 59267 - DNA, 22 bp, Artificial Sequence
  Synthetic
agacctgguacgagtacaccug

SEQ ID NO: 59268 - DNA, 20 bp, Artificial Sequence
  Synthetic
cagacacgaagaugccagug

SEQ ID NO: 59269 - DNA, 22 bp, Artificial Sequence
  Synthetic
caccctggagucatccgtttua

SEQ ID NO: 59270 - DNA, 22 bp, Artificial Sequence
  Synthetic
caggaaguagatgaggucgcat

SEQ ID NO: 59271 - DNA, 24 bp, Artificial Sequence
  Synthetic
ctacctgauccaactggugaagag

SEQ ID NO: 59272 - DNA, 22 bp, Artificial Sequence
  Synthetic
cccctguaagcaaaguggacaa

SEQ ID NO: 59273 - DNA, 24 bp, Artificial Sequence
  Synthetic
accctaacccaguccttttaucct

SEQ ID NO: 59274 - DNA, 29 bp, Artificial Sequence
  Synthetic
tttgctttggttauttaggagtacacugt

SEQ ID NO: 59275 - DNA, 24 bp, Artificial Sequence
  Synthetic
gcagctacugactgaagaacauca

SEQ ID NO: 59276 - DNA, 21 bp, Artificial Sequence
  Synthetic
cacagaccaugtcatcgucct

SEQ ID NO: 59277 - DNA, 21 bp, Artificial Sequence
  Synthetic
aggctucacaccaagaagugt

SEQ ID NO: 59278 - DNA, 21 bp, Artificial Sequence
  Synthetic
cgtgttcccaguctgccatut

SEQ ID NO: 59279 - DNA, 19 bp, Artificial Sequence
  Synthetic
gacactgtgugacgccgua

SEQ ID NO: 59280 - DNA, 21 bp, Artificial Sequence
  Synthetic
ccccaccauacttccucccaa

SEQ ID NO: 59281 - DNA, 26 bp, Artificial Sequence
  Synthetic
gattcagctcugtactcctcttuacc

SEQ ID NO: 59282 - DNA, 20 bp, Artificial Sequence
  Synthetic
ttgccaagccaucgctcuaa

SEQ ID NO: 59283 - DNA, 27 bp, Artificial Sequence
  Synthetic
tctgcccagguttctattgttgttuaa

SEQ ID NO: 59284 - DNA, 19 bp, Artificial Sequence
  Synthetic
cggagugaaccccgugaac

SEQ ID NO: 59285 - DNA, 24 bp, Artificial Sequence
  Synthetic
gaatgaacacacacccutccttuc

SEQ ID NO: 59286 - DNA, 21 bp, Artificial Sequence
  Synthetic
cccagccccugtggaaaauac

SEQ ID NO: 59287 - DNA, 22 bp, Artificial Sequence
  Synthetic
gcccccautactguggaagaat

SEQ ID NO: 59288 - DNA, 20 bp, Artificial Sequence
  Synthetic
cactggcugtctttgcgtut

SEQ ID NO: 59289 - DNA, 19 bp, Artificial Sequence
  Synthetic
ccttgtuccacccccgtug

SEQ ID NO: 59290 - DNA, 21 bp, Artificial Sequence
  Synthetic
caaatgccccaautgcaggua

SEQ ID NO: 59291 - DNA, 27 bp, Artificial Sequence
  Synthetic
acttttatcacctutccttgcctctut

SEQ ID NO: 59292 - DNA, 23 bp, Artificial Sequence
  Synthetic
ggtctcagacacuttgagctuct

SEQ ID NO: 59293 - DNA, 22 bp, Artificial Sequence
  Synthetic
ccctggacugcttctttctguc

SEQ ID NO: 59294 - DNA, 25 bp, Artificial Sequence
  Synthetic
gctgcctgagaaauggaacaacaua

SEQ ID NO: 59295 - DNA, 24 bp, Artificial Sequence
  Synthetic
acugcagtgtucacagaaagagag

SEQ ID NO: 59296 - DNA, 23 bp, Artificial Sequence
  Synthetic
tattcctgucctcacaucagcat

SEQ ID NO: 59297 - DNA, 21 bp, Artificial Sequence
  Synthetic
gcatctuggccatgttgucaa

SEQ ID NO: 59298 - DNA, 21 bp, Artificial Sequence
  Synthetic
gcccccaagaaugatgaccua

SEQ ID NO: 59299 - DNA, 22 bp, Artificial Sequence
  Synthetic
ccttgtaauccatctgcuccga

SEQ ID NO: 59300 - DNA, 25 bp, Artificial Sequence
  Synthetic
aggactattauaacccgcagcctua

SEQ ID NO: 59301 - DNA, 20 bp, Artificial Sequence
  Synthetic
ctgaaggcuctccucaccag

SEQ ID NO: 59302 - DNA, 20 bp, Artificial Sequence
  Synthetic
tccucgacaacagccactug

SEQ ID NO: 59303 - DNA, 19 bp, Artificial Sequence
  Synthetic
ccaggtuccgcttctuggt

SEQ ID NO: 59304 - DNA, 20 bp, Artificial Sequence
  Synthetic
tgaagcuggaagccatcgug

SEQ ID NO: 59305 - DNA, 22 bp, Artificial Sequence
  Synthetic
cauaacggaucagccccagaag

SEQ ID NO: 59306 - DNA, 19 bp, Artificial Sequence
  Synthetic
cucctgacuccccgagaca

SEQ ID NO: 59307 - DNA, 17 bp, Artificial Sequence
  Synthetic
ccgagugaggcgctucc

SEQ ID NO: 59308 - DNA, 22 bp, Artificial Sequence
  Synthetic
gttactgcagcucacaaaugct

SEQ ID NO: 59309 - DNA, 29 bp, Artificial Sequence
  Synthetic
tcaccattaccautccaaatattctucca

SEQ ID NO: 59310 - DNA, 28 bp, Artificial Sequence
  Synthetic
gatttgttgcaggutttggttttaaugg

SEQ ID NO: 59311 - DNA, 28 bp, Artificial Sequence
  Synthetic
tgtgtgttctuaaagcaggcatacuaat

SEQ ID NO: 59312 - DNA, 19 bp, Artificial Sequence
  Synthetic
tgauggccaggaactuggg

SEQ ID NO: 59313 - DNA, 21 bp, Artificial Sequence
  Synthetic
tctgggaccucagcgtacuaa

SEQ ID NO: 59314 - DNA, 21 bp, Artificial Sequence
  Synthetic
gagtggauacccgagtcguag

SEQ ID NO: 59315 - DNA, 23 bp, Artificial Sequence
  Synthetic
catggugatgatgugggaagaca

SEQ ID NO: 59316 - DNA, 20 bp, Artificial Sequence
  Synthetic
cauccccaggcctcuaagga

SEQ ID NO: 59317 - DNA, 21 bp, Artificial Sequence
  Synthetic
tgacccatautcccctgcuct

SEQ ID NO: 59318 - DNA, 21 bp, Artificial Sequence
  Synthetic
gaagaugcttgggugggaaac

SEQ ID NO: 59319 - DNA, 26 bp, Artificial Sequence
  Synthetic
catctctccaauctgactcctttuct

SEQ ID NO: 59320 - DNA, 21 bp, Artificial Sequence
  Synthetic
gcagcaaugggaaggagguag

SEQ ID NO: 59321 - DNA, 27 bp, Artificial Sequence
  Synthetic
tcccttaaaaagucccactcagaguaa

SEQ ID NO: 59322 - DNA, 20 bp, Artificial Sequence
  Synthetic
cctgauccagaacgccucat

SEQ ID NO: 59323 - DNA, 23 bp, Artificial Sequence
  Synthetic
cctaactgtucctgtgactuccc

SEQ ID NO: 59324 - DNA, 19 bp, Artificial Sequence
  Synthetic
tggacacacaaggccucuc

SEQ ID NO: 59325 - DNA, 20 bp, Artificial Sequence
  Synthetic
aaggguaagcgttgcacuct

SEQ ID NO: 59326 - DNA, 22 bp, Artificial Sequence
  Synthetic
agagccaagguttgctaaugct

SEQ ID NO: 59327 - DNA, 22 bp, Artificial Sequence
  Synthetic
atgacgugatctgugacgagac

SEQ ID NO: 59328 - DNA, 21 bp, Artificial Sequence
  Synthetic
gaaggtcguctggactgtgut

SEQ ID NO: 59329 - DNA, 22 bp, Artificial Sequence
  Synthetic
ggcttttctugcctgtctucag

SEQ ID NO: 59330 - DNA, 22 bp, Artificial Sequence
  Synthetic
gcuctctacccuccagaggaat

SEQ ID NO: 59331 - DNA, 25 bp, Artificial Sequence
  Synthetic
tctatttgtcugactagcctgcuct

SEQ ID NO: 59332 - DNA, 20 bp, Artificial Sequence
  Synthetic
cccutcaugcggaaccacaa

SEQ ID NO: 59333 - DNA, 20 bp, Artificial Sequence
  Synthetic
gggagagcugcacttcucag

SEQ ID NO: 59334 - DNA, 23 bp, Artificial Sequence
  Synthetic
ggatgatgacaucacgtgtccut

SEQ ID NO: 59335 - DNA, 23 bp, Artificial Sequence
  Synthetic
ccaggaagaugacctgtgtguag

SEQ ID NO: 59336 - DNA, 23 bp, Artificial Sequence
  Synthetic
ctgctccattugtgctctctcut

SEQ ID NO: 59337 - DNA, 20 bp, Artificial Sequence
  Synthetic
ctccaggugacacaugcaac

SEQ ID NO: 59338 - DNA, 28 bp, Artificial Sequence
  Synthetic
gatttgguaaaggagaaggtaccugaag

SEQ ID NO: 59339 - DNA, 20 bp, Artificial Sequence
  Synthetic
ccctguggagcaggtcagua

SEQ ID NO: 59340 - DNA, 26 bp, Artificial Sequence
  Synthetic
acagaggatctugtgatcagcattut

SEQ ID NO: 59341 - DNA, 24 bp, Artificial Sequence
  Synthetic
ccctgguaacactgaagtttgugt

SEQ ID NO: 59342 - DNA, 21 bp, Artificial Sequence
  Synthetic
actgaggtcucagagccauct

SEQ ID NO: 59343 - DNA, 18 bp, Artificial Sequence
  Synthetic
agctctuggctgctggug

SEQ ID NO: 59344 - DNA, 20 bp, Artificial Sequence
  Synthetic
gatcccgcuggucaacaaac

SEQ ID NO: 59345 - DNA, 18 bp, Artificial Sequence
  Synthetic
ccggcccacgaagutcuc

SEQ ID NO: 59346 - DNA, 20 bp, Artificial Sequence
  Synthetic
ggaggcugacctccctcuac

SEQ ID NO: 59347 - DNA, 22 bp, Artificial Sequence
  Synthetic
attcatguccccagggtaguct

SEQ ID NO: 59348 - DNA, 25 bp, Artificial Sequence
  Synthetic
agacugtaatgtccaugggagaact

SEQ ID NO: 59349 - DNA, 21 bp, Artificial Sequence
  Synthetic
agaaggagguagccttggugt

SEQ ID NO: 59350 - DNA, 20 bp, Artificial Sequence
  Synthetic
gagacggucatggaggucat

SEQ ID NO: 59351 - DNA, 20 bp, Artificial Sequence
  Synthetic
tcaaacauggagcgctggut

SEQ ID NO: 59352 - DNA, 24 bp, Artificial Sequence
  Synthetic
ggagctacugaaattccugcagat

SEQ ID NO: 59353 - DNA, 22 bp, Artificial Sequence
  Synthetic
ctggttccauctttgctccuca

SEQ ID NO: 59354 - DNA, 21 bp, Artificial Sequence
  Synthetic
cacctcugaccacctcaacuc

SEQ ID NO: 59355 - DNA, 23 bp, Artificial Sequence
  Synthetic
ctacactcugactccucccaact

SEQ ID NO: 59356 - DNA, 22 bp, Artificial Sequence
  Synthetic
aggcttcaucacatacccccua

SEQ ID NO: 59357 - DNA, 24 bp, Artificial Sequence
  Synthetic
ggaaucccaaaggaagatgtcuca

SEQ ID NO: 59358 - DNA, 20 bp, Artificial Sequence
  Synthetic
ggcctcgugcatgttcctua

SEQ ID NO: 59359 - DNA, 27 bp, Artificial Sequence
  Synthetic
cgttgtauacggcaaacacatcatuac

SEQ ID NO: 59360 - DNA, 22 bp, Artificial Sequence
  Synthetic
ggctgtcaguttctgggtgtua

SEQ ID NO: 59361 - DNA, 22 bp, Artificial Sequence
  Synthetic
gtttctctgacgucccccauag

SEQ ID NO: 59362 - DNA, 21 bp, Artificial Sequence
  Synthetic
ccacctguggtgggtagtuag

SEQ ID NO: 59363 - DNA, 28 bp, Artificial Sequence
  Synthetic
accaggattacgaaugaggcaatttaut

SEQ ID NO: 59364 - DNA, 20 bp, Artificial Sequence
  Synthetic
ccacacgcucgtcttctgua

SEQ ID NO: 59365 - DNA, 22 bp, Artificial Sequence
  Synthetic
tgtcaacccccuccttttctug

SEQ ID NO: 59366 - DNA, 21 bp, Artificial Sequence
  Synthetic
caccctggguctcatcccuaa

SEQ ID NO: 59367 - DNA, 22 bp, Artificial Sequence
  Synthetic
aaaaggctaaccuggaggtgug

SEQ ID NO: 59368 - DNA, 21 bp, Artificial Sequence
  Synthetic
ctgaacaggugagtguccaca

SEQ ID NO: 59369 - DNA, 24 bp, Artificial Sequence
  Synthetic
ctgtcctgutaggtgguaaaggat

SEQ ID NO: 59370 - DNA, 23 bp, Artificial Sequence
  Synthetic
ccctgctttcugcctctctauac

SEQ ID NO: 59371 - DNA, 26 bp, Artificial Sequence
  Synthetic
ccatacttggcuctattctgcttcuc

SEQ ID NO: 59372 - DNA, 22 bp, Artificial Sequence
  Synthetic
caggaugagaaaggcaagccua

SEQ ID NO: 59373 - DNA, 26 bp, Artificial Sequence
  Synthetic
ctcttgggaguttctcactacttucc

SEQ ID NO: 59374 - DNA, 28 bp, Artificial Sequence
  Synthetic
ctttgacttucagcacttagttcactut

SEQ ID NO: 59375 - DNA, 23 bp, Artificial Sequence
  Synthetic
cactacagagcaugggttcugag

SEQ ID NO: 59376 - DNA, 26 bp, Artificial Sequence
  Synthetic
aactcttttugggtctgattctucca

SEQ ID NO: 59377 - DNA, 25 bp, Artificial Sequence
  Synthetic
gcttttcaaacugaagggaagtugt

SEQ ID NO: 59378 - DNA, 28 bp, Artificial Sequence
  Synthetic
ctaaaggtcaccugtcatttaactugga

SEQ ID NO: 59379 - DNA, 28 bp, Artificial Sequence
  Synthetic
cgaatggtucaaaagcaaaaatcatgut

SEQ ID NO: 59380 - DNA, 26 bp, Artificial Sequence
  Synthetic
cgaagttcacuccacttgaagtucat

SEQ ID NO: 59381 - DNA, 28 bp, Artificial Sequence
  Synthetic
cgcttgtttcttutgtttggtaattcug

SEQ ID NO: 59382 - DNA, 24 bp, Artificial Sequence
  Synthetic
ctggcatuggattgtctcugaaac

SEQ ID NO: 59383 - DNA, 28 bp, Artificial Sequence
  Synthetic
agctaatcaaugaggaacttgagacaut

SEQ ID NO: 59384 - DNA, 27 bp, Artificial Sequence
  Synthetic
ctaacctgugctgtactctttucaagt

SEQ ID NO: 59385 - DNA, 29 bp, Artificial Sequence
  Synthetic
caggcttattctgugatctttcttgttut

SEQ ID NO: 59386 - DNA, 28 bp, Artificial Sequence
  Synthetic
agctgtgtgattutctccacaagaaaua

SEQ ID NO: 59387 - DNA, 26 bp, Artificial Sequence
  Synthetic
gtaacagtgtcugcttccataaucct

SEQ ID NO: 59388 - DNA, 27 bp, Artificial Sequence
  Synthetic
acctgtaatgtuggtaggttttcaugt

SEQ ID NO: 59389 - DNA, 26 bp, Artificial Sequence
  Synthetic
ccagggtguccaaatctgattgttua

SEQ ID NO: 59390 - DNA, 21 bp, Artificial Sequence
  Synthetic
ccctgggtugggaagactuat

SEQ ID NO: 59391 - DNA, 28 bp, Artificial Sequence
  Synthetic
gtgtcaggaaggguattacaacgtaaut

SEQ ID NO: 59392 - DNA, 21 bp, Artificial Sequence
  Synthetic
actccccagucatgucccaat

SEQ ID NO: 59393 - DNA, 24 bp, Artificial Sequence
  Synthetic
aatatguacagggaggtgcuaggt

SEQ ID NO: 59394 - DNA, 24 bp, Artificial Sequence
  Synthetic
ccttcatcccucactttctcctut

SEQ ID NO: 59395 - DNA, 21 bp, Artificial Sequence
  Synthetic
tgtgagcugcagggttctcua

SEQ ID NO: 59396 - DNA, 25 bp, Artificial Sequence
  Synthetic
ggaagaggcaaauattcctccgtua

SEQ ID NO: 59397 - DNA, 21 bp, Artificial Sequence
  Synthetic
agctgugtcaccaucaggaag

SEQ ID NO: 59398 - DNA, 22 bp, Artificial Sequence
  Synthetic
gttttgcagccacucttgauga

SEQ ID NO: 59399 - DNA, 22 bp, Artificial Sequence
  Synthetic
ggagaagaaacacuggcctcug

SEQ ID NO: 59400 - DNA, 21 bp, Artificial Sequence
  Synthetic
gautgatgtggugcgcacaat

SEQ ID NO: 59401 - DNA, 24 bp, Artificial Sequence
  Synthetic
ggattttcugcagcacuaaaacga

SEQ ID NO: 59402 - DNA, 22 bp, Artificial Sequence
  Synthetic
agctatgggcuttccagcatut

SEQ ID NO: 59403 - DNA, 26 bp, Artificial Sequence
  Synthetic
ggtatatgatggacucctttgctgug

SEQ ID NO: 59404 - DNA, 23 bp, Artificial Sequence
  Synthetic
aaagaucggcagaaaacgcuaga

SEQ ID NO: 59405 - DNA, 22 bp, Artificial Sequence
  Synthetic
tctcactgguctctgttugcac

SEQ ID NO: 59406 - DNA, 27 bp, Artificial Sequence
  Synthetic
tttccctcttuctcttccttauaggct

SEQ ID NO: 59407 - DNA, 28 bp, Artificial Sequence
  Synthetic
acttaagtactgagauagaagctctgut

SEQ ID NO: 59408 - DNA, 23 bp, Artificial Sequence
  Synthetic
gctcctagcuagctctagtgcut

SEQ ID NO: 59409 - DNA, 28 bp, Artificial Sequence
  Synthetic
catgggatactgugtaccaataccaaut

SEQ ID NO: 59410 - DNA, 19 bp, Artificial Sequence
  Synthetic
aggtcaaccuggttugcca

SEQ ID NO: 59411 - DNA, 28 bp, Artificial Sequence
  Synthetic
tagcutcaggtatuagaaacaagagcat

SEQ ID NO: 59412 - DNA, 27 bp, Artificial Sequence
  Synthetic
cactcttagguctgttatcuacagggt

SEQ ID NO: 59413 - DNA, 21 bp, Artificial Sequence
  Synthetic
gatccctggacugcctcttuc

SEQ ID NO: 59414 - DNA, 20 bp, Artificial Sequence
  Synthetic
gttttcagggugagccuggt

SEQ ID NO: 59415 - DNA, 28 bp, Artificial Sequence
  Synthetic
tuggagtagauaaggaaggaaagaagga

SEQ ID NO: 59416 - DNA, 21 bp, Artificial Sequence
  Synthetic
cctggutcctgctuggaagag

SEQ ID NO: 59417 - DNA, 27 bp, Artificial Sequence
  Synthetic
tgaaggaagctutggacctgaatuaaa

SEQ ID NO: 59418 - DNA, 27 bp, Artificial Sequence
  Synthetic
ccttaatgtgcugttgagttagaaugg

SEQ ID NO: 59419 - DNA, 24 bp, Artificial Sequence
  Synthetic
tcccttcctuttctcttgcttugg

SEQ ID NO: 59420 - DNA, 25 bp, Artificial Sequence
  Synthetic
ggaaaaaccaaagucaggcaacuaa

SEQ ID NO: 59421 - DNA, 27 bp, Artificial Sequence
  Synthetic
tggcagaagaaaaagutatgctggaua

SEQ ID NO: 59422 - DNA, 28 bp, Artificial Sequence
  Synthetic
gacttcaatgaaagcuacctggtauact

SEQ ID NO: 59423 - DNA, 24 bp, Artificial Sequence
  Synthetic
tccaacactacugggatgttctug

SEQ ID NO: 59424 - DNA, 22 bp, Artificial Sequence
  Synthetic
cttcctgcugctcttctgaucc

SEQ ID NO: 59425 - DNA, 28 bp, Artificial Sequence
  Synthetic
gtttgatcaagtacucatccagcttcut

SEQ ID NO: 59426 - DNA, 23 bp, Artificial Sequence
  Synthetic
cttccccaccutccaattttgut

SEQ ID NO: 59427 - DNA, 28 bp, Artificial Sequence
  Synthetic
tgtgaatggcaugtacagaatctaugac

SEQ ID NO: 59428 - DNA, 28 bp, Artificial Sequence
  Synthetic
gactgtttttccugatgtggactatgua

SEQ ID NO: 59429 - DNA, 28 bp, Artificial Sequence
  Synthetic
ctccagtttugacacaccatcagtauaa

SEQ ID NO: 59430 - DNA, 24 bp, Artificial Sequence
  Synthetic
agtggtcccaaguagtcactuaga

SEQ ID NO: 59431 - DNA, 22 bp, Artificial Sequence
  Synthetic
cactaagggutcgtccagtucc

SEQ ID NO: 59432 - DNA, 25 bp, Artificial Sequence
  Synthetic
gctctgtcaugtgtgatctgtauca

SEQ ID NO: 59433 - DNA, 18 bp, Artificial Sequence
  Synthetic
gtcgcgccucccatttut

SEQ ID NO: 59434 - DNA, 19 bp, Artificial Sequence
  Synthetic
tccaggagcucugccagat

SEQ ID NO: 59435 - DNA, 17 bp, Artificial Sequence
  Synthetic
tgcatgggugggtgcug

SEQ ID NO: 59436 - DNA, 24 bp, Artificial Sequence
  Synthetic
gaacctttctuctcgattgtgcug

SEQ ID NO: 59437 - DNA, 27 bp, Artificial Sequence
  Synthetic
ccaaaacaatgtuaccatcatggcuaa

SEQ ID NO: 59438 - DNA, 20 bp, Artificial Sequence
  Synthetic
ggacacgacacucaccacua

SEQ ID NO: 59439 - DNA, 20 bp, Artificial Sequence
  Synthetic
cctgtctccugaggctgtuc

SEQ ID NO: 59440 - DNA, 21 bp, Artificial Sequence
  Synthetic
cccttccucaccctcctctuc

SEQ ID NO: 59441 - DNA, 18 bp, Artificial Sequence
  Synthetic
cccguactggcugcacaa

SEQ ID NO: 59442 - DNA, 19 bp, Artificial Sequence
  Synthetic
cgcccccgagaauggtuac

SEQ ID NO: 59443 - DNA, 23 bp, Artificial Sequence
  Synthetic
tgttcactutccctggugagaga

SEQ ID NO: 59444 - DNA, 21 bp, Artificial Sequence
  Synthetic
cacagcggucatctctaccug

SEQ ID NO: 59445 - DNA, 21 bp, Artificial Sequence
  Synthetic
cacgcaacccaguaccactua

SEQ ID NO: 59446 - DNA, 28 bp, Artificial Sequence
  Synthetic
ggattcattauctgagattcuccaccag

SEQ ID NO: 59447 - DNA, 23 bp, Artificial Sequence
  Synthetic
ttactgtgtuccacccgttucat

SEQ ID NO: 59448 - DNA, 28 bp, Artificial Sequence
  Synthetic
cctttgcaatggguaatggagatctaut

SEQ ID NO: 59449 - DNA, 26 bp, Artificial Sequence
  Synthetic
ctcccacuagaagaaacagaactuga

SEQ ID NO: 59450 - DNA, 20 bp, Artificial Sequence
  Synthetic
ggtgggacugtgctttcuga

SEQ ID NO: 59451 - DNA, 25 bp, Artificial Sequence
  Synthetic
agtgagaatgaaautagggctcugg

SEQ ID NO: 59452 - DNA, 21 bp, Artificial Sequence
  Synthetic
agagtcuggcccttggttgua

SEQ ID NO: 59453 - DNA, 22 bp, Artificial Sequence
  Synthetic
tccacctauctgcagtctugga

SEQ ID NO: 59454 - DNA, 18 bp, Artificial Sequence
  Synthetic
cttctuccgccagucggt

SEQ ID NO: 59455 - DNA, 17 bp, Artificial Sequence
  Synthetic
ctccgcucggctuagga

SEQ ID NO: 59456 - DNA, 20 bp, Artificial Sequence
  Synthetic
cgcctaccagcucatgcaua

SEQ ID NO: 59457 - DNA, 21 bp, Artificial Sequence
  Synthetic
caaccgcaaaucccctaaugg

SEQ ID NO: 59458 - DNA, 21 bp, Artificial Sequence
  Synthetic
gtccacgagcagaacuacguc

SEQ ID NO: 59459 - DNA, 21 bp, Artificial Sequence
  Synthetic
gtgggaagutggcatctguca

SEQ ID NO: 59460 - DNA, 25 bp, Artificial Sequence
  Synthetic
gtcctgcatugtccatttccttuag

SEQ ID NO: 59461 - DNA, 30 bp, Artificial Sequence
  Synthetic
ctcaattttaatacucaggacaaacugcat

SEQ ID NO: 59462 - DNA, 19 bp, Artificial Sequence
  Synthetic
cccuccggaatcgucaagt

SEQ ID NO: 59463 - DNA, 22 bp, Artificial Sequence
  Synthetic
gaugtacuccaagccgaaaacc

SEQ ID NO: 59464 - DNA, 20 bp, Artificial Sequence
  Synthetic
gattggcccuattgggctug

SEQ ID NO: 59465 - DNA, 27 bp, Artificial Sequence
  Synthetic
ccaaagccaatuaagtcctagcaagua

SEQ ID NO: 59466 - DNA, 21 bp, Artificial Sequence
  Synthetic
ggaggaggagaccuggaacug

SEQ ID NO: 59467 - DNA, 23 bp, Artificial Sequence
  Synthetic
ctuaggcccaaccacuaacagag

SEQ ID NO: 59468 - DNA, 21 bp, Artificial Sequence
  Synthetic
ccaatttcuggaggcggtuca

SEQ ID NO: 59469 - DNA, 29 bp, Artificial Sequence
  Synthetic
tgatcctttcttugctgttagcttatuca

SEQ ID NO: 59470 - DNA, 26 bp, Artificial Sequence
  Synthetic
cctgtgaauaccggaggttttgauac

SEQ ID NO: 59471 - DNA, 28 bp, Artificial Sequence
  Synthetic
gctcaggaaaagauggcagaatactuaa

SEQ ID NO: 59472 - DNA, 22 bp, Artificial Sequence
  Synthetic
ctggaagaccacugtcacctut

SEQ ID NO: 59473 - DNA, 28 bp, Artificial Sequence
  Synthetic
acagagacacaaaugctccagattttua

SEQ ID NO: 59474 - DNA, 21 bp, Artificial Sequence
  Synthetic
gctgtcctcuaggacctggut

SEQ ID NO: 59475 - DNA, 28 bp, Artificial Sequence
  Synthetic
gggcattcagtcuactttttacttggut

SEQ ID NO: 59476 - DNA, 24 bp, Artificial Sequence
  Synthetic
ccattattucaaaggagcugcagt

SEQ ID NO: 59477 - DNA, 28 bp, Artificial Sequence
  Synthetic
gggtagagguattttccaatugagaaga

SEQ ID NO: 59478 - DNA, 27 bp, Artificial Sequence
  Synthetic
catgtaaggtgaucccaaatgtaugga

SEQ ID NO: 59479 - DNA, 23 bp, Artificial Sequence
  Synthetic
caucagcaaaagccaaacuaggg

SEQ ID NO: 59480 - DNA, 18 bp, Artificial Sequence
  Synthetic
aggaccugcaggagcuca

SEQ ID NO: 59481 - DNA, 17 bp, Artificial Sequence
  Synthetic
cgcgcuccttggcuact

SEQ ID NO: 59482 - DNA, 22 bp, Artificial Sequence
  Synthetic
tccctttcccutccttccucaa

SEQ ID NO: 59483 - DNA, 22 bp, Artificial Sequence
  Synthetic
ttgggatgaagugggaaaccug

SEQ ID NO: 59484 - DNA, 21 bp, Artificial Sequence
  Synthetic
acagacugggccaucagagaa

SEQ ID NO: 59485 - DNA, 23 bp, Artificial Sequence
  Synthetic
tctcctctggacuctttggagug

SEQ ID NO: 59486 - DNA, 21 bp, Artificial Sequence
  Synthetic
gaggaaacgacugacccacuc

SEQ ID NO: 59487 - DNA, 21 bp, Artificial Sequence
  Synthetic
tgctcccagacuaacctguct

SEQ ID NO: 59488 - DNA, 21 bp, Artificial Sequence
  Synthetic
gttctcagutcagctgucggt

SEQ ID NO: 59489 - DNA, 24 bp, Artificial Sequence
  Synthetic
tccatttguaggaggtgggatcut

SEQ ID NO: 59490 - DNA, 25 bp, Artificial Sequence
  Synthetic
tcagttcagtaucttatccccguga

SEQ ID NO: 59491 - DNA, 21 bp, Artificial Sequence
  Synthetic
agagacccgacgauccuacat

SEQ ID NO: 59492 - DNA, 20 bp, Artificial Sequence
  Synthetic
gagccutcauaccccgaagt

SEQ ID NO: 59493 - DNA, 22 bp, Artificial Sequence
  Synthetic
agaugcctctgaugggaaaagg

SEQ ID NO: 59494 - DNA, 25 bp, Artificial Sequence
  Synthetic
ctggtgtctucagcagtattttugt

SEQ ID NO: 59495 - DNA, 22 bp, Artificial Sequence
  Synthetic
ttgatctccagcuggcattuct

SEQ ID NO: 59496 - DNA, 27 bp, Artificial Sequence
  Synthetic
aacagacgaacaaaaccuctactuaca

SEQ ID NO: 59497 - DNA, 21 bp, Artificial Sequence
  Synthetic
cctgcagggutctctcugaac

SEQ ID NO: 59498 - DNA, 21 bp, Artificial Sequence
  Synthetic
catuaggtggaguggaagcca

SEQ ID NO: 59499 - DNA, 27 bp, Artificial Sequence
  Synthetic
atcaaaggaaauatgaccggguaacat

SEQ ID NO: 59500 - DNA, 28 bp, Artificial Sequence
  Synthetic
catgttgtacugaatgcacctatguaga

SEQ ID NO: 59501 - DNA, 29 bp, Artificial Sequence
  Synthetic
ccttgtgatttcutccatgtttgtcuaaa

SEQ ID NO: 59502 - DNA, 21 bp, Artificial Sequence
  Synthetic
cctagggugacagctcucaca

SEQ ID NO: 59503 - DNA, 23 bp, Artificial Sequence
  Synthetic
aggtgcugacatccttuccaaag

SEQ ID NO: 59504 - DNA, 22 bp, Artificial Sequence
  Synthetic
ccagatuacagcacaagccaut

SEQ ID NO: 59505 - DNA, 26 bp, Artificial Sequence
  Synthetic
agaaauaaacgacaaaagcugcaacc

SEQ ID NO: 59506 - DNA, 21 bp, Artificial Sequence
  Synthetic
tcccacuggacatccucaagt

SEQ ID NO: 59507 - DNA, 25 bp, Artificial Sequence
  Synthetic
ctcaatcaacugcaagatgtgctuc

SEQ ID NO: 59508 - DNA, 23 bp, Artificial Sequence
  Synthetic
ctagtaguccctttccucggaga

SEQ ID NO: 59509 - DNA, 21 bp, Artificial Sequence
  Synthetic
ctgcucctgaacucccagaaa

SEQ ID NO: 59510 - DNA, 28 bp, Artificial Sequence
  Synthetic
tgctttctaaccuttgcattatggauga

SEQ ID NO: 59511 - DNA, 29 bp, Artificial Sequence
  Synthetic
gcaacgatctaaugagtagggtatguaaa

SEQ ID NO: 59512 - DNA, 27 bp, Artificial Sequence
  Synthetic
ctcagggcaauttatacagcatttugt

SEQ ID NO: 59513 - DNA, 28 bp, Artificial Sequence
  Synthetic
cagacactggguccttcttaatattcut

SEQ ID NO: 59514 - DNA, 25 bp, Artificial Sequence
  Synthetic
gcttaagctttcucaggacaatgua

SEQ ID NO: 59515 - DNA, 29 bp, Artificial Sequence
  Synthetic
gttcccaaagcauataagctagucagaat

SEQ ID NO: 59516 - DNA, 26 bp, Artificial Sequence
  Synthetic
tctctgtaaaaacutgcaggttcugt

SEQ ID NO: 59517 - DNA, 28 bp, Artificial Sequence
  Synthetic
cctttgacatcuttgacttggtaucagt

SEQ ID NO: 59518 - DNA, 23 bp, Artificial Sequence
  Synthetic
tctttgttccauaggcagctgut

SEQ ID NO: 59519 - DNA, 23 bp, Artificial Sequence
  Synthetic
cattaccgcugggaugaaaagga

SEQ ID NO: 59520 - DNA, 28 bp, Artificial Sequence
  Synthetic
tttagattcccaucttcccattguaacc

SEQ ID NO: 59521 - DNA, 28 bp, Artificial Sequence
  Synthetic
ggctaaggcaaauatgattgaatugaca

SEQ ID NO: 59522 - DNA, 20 bp, Artificial Sequence
  Synthetic
tccggauggcccccttauat

SEQ ID NO: 59523 - DNA, 28 bp, Artificial Sequence
  Synthetic
tcttggactatugtacccctatuaaggt

SEQ ID NO: 59524 - DNA, 25 bp, Artificial Sequence
  Synthetic
gatggtggataugcttgtggaauct

SEQ ID NO: 59525 - DNA, 26 bp, Artificial Sequence
  Synthetic
gcacaagacaaaagaaautccgttuc

SEQ ID NO: 59526 - DNA, 28 bp, Artificial Sequence
  Synthetic
gatcaaacaagtautttctgctggcaua

SEQ ID NO: 59527 - DNA, 28 bp, Artificial Sequence
  Synthetic
aagaagctcaugaattgagtgaagauca

SEQ ID NO: 59528 - DNA, 29 bp, Artificial Sequence
  Synthetic
aaacacatguagaaacctacctcaaaugt

SEQ ID NO: 59529 - DNA, 27 bp, Artificial Sequence
  Synthetic
gctgtggtgagucgaattattgagaut

SEQ ID NO: 59530 - DNA, 21 bp, Artificial Sequence
  Synthetic
cagaagcagccuggguaaaac

SEQ ID NO: 59531 - DNA, 28 bp, Artificial Sequence
  Synthetic
ggcagcactttauttgcaggtataguaa

SEQ ID NO: 59532 - DNA, 25 bp, Artificial Sequence
  Synthetic
ttcatggcguagtaaggtttucact

SEQ ID NO: 59533 - DNA, 25 bp, Artificial Sequence
  Synthetic
ccactggtuaacaagtctttgucct

SEQ ID NO: 59534 - DNA, 23 bp, Artificial Sequence
  Synthetic
cacctattctuccaaggccauca

SEQ ID NO: 59535 - DNA, 27 bp, Artificial Sequence
  Synthetic
gaacaaatctacugggtggaagaucat

SEQ ID NO: 59536 - DNA, 22 bp, Artificial Sequence
  Synthetic
gggaucaccagaggatgttguc

SEQ ID NO: 59537 - DNA, 23 bp, Artificial Sequence
  Synthetic
tttttgtttguggtttggugcct

SEQ ID NO: 59538 - DNA, 20 bp, Artificial Sequence
  Synthetic
gagacaagcgugtggcauac

SEQ ID NO: 59539 - DNA, 24 bp, Artificial Sequence
  Synthetic
agaagagaugggagaaaggcctua

SEQ ID NO: 59540 - DNA, 21 bp, Artificial Sequence
  Synthetic
ctgcctcuggagaaggaccua

SEQ ID NO: 59541 - DNA, 23 bp, Artificial Sequence
  Synthetic
gguggtgtgttgucagagaagac

SEQ ID NO: 59542 - DNA, 20 bp, Artificial Sequence
  Synthetic
gtttcctugagcgtgctguc

SEQ ID NO: 59543 - DNA, 25 bp, Artificial Sequence
  Synthetic
aaagtgtcugccaggaattgaacua

SEQ ID NO: 59544 - DNA, 19 bp, Artificial Sequence
  Synthetic
tccauccguccggagagaa

SEQ ID NO: 59545 - DNA, 19 bp, Artificial Sequence
  Synthetic
caaacutguccagcagcca

SEQ ID NO: 59546 - DNA, 24 bp, Artificial Sequence
  Synthetic
gtgagttgcuctcataccacauga

SEQ ID NO: 59547 - DNA, 26 bp, Artificial Sequence
  Synthetic
accctagaagaaugggattcaucact

SEQ ID NO: 59548 - DNA, 21 bp, Artificial Sequence
  Synthetic
ggcagaaacugcttgcaagut

SEQ ID NO: 59549 - DNA, 21 bp, Artificial Sequence
  Synthetic
ccaaacccutccaggauagcc

SEQ ID NO: 59550 - DNA, 26 bp, Artificial Sequence
  Synthetic
tcctcacagauatatttccacuggct

SEQ ID NO: 59551 - DNA, 18 bp, Artificial Sequence
  Synthetic
gcctggugttggcuggat

SEQ ID NO: 59552 - DNA, 29 bp, Artificial Sequence
  Synthetic
tcttcactctcuagggtattcattaugct

SEQ ID NO: 59553 - DNA, 23 bp, Artificial Sequence
  Synthetic
gactgtgttcugtctgagtgugt

SEQ ID NO: 59554 - DNA, 26 bp, Artificial Sequence
  Synthetic
cutagaggacugaaaggagaaagcat

SEQ ID NO: 59555 - DNA, 29 bp, Artificial Sequence
  Synthetic
gccatgtagaaagguaaactgctgataut

SEQ ID NO: 59556 - DNA, 21 bp, Artificial Sequence
  Synthetic
gggtcgatcugcctgtttgut

SEQ ID NO: 59557 - DNA, 21 bp, Artificial Sequence
  Synthetic
acctaccacutcgtcaugcag

SEQ ID NO: 59558 - DNA, 26 bp, Artificial Sequence
  Synthetic
tcatcctcctccucctctggattaua

SEQ ID NO: 59559 - DNA, 27 bp, Artificial Sequence
  Synthetic
gcgttaguagctagagauaaaccaagt

SEQ ID NO: 59560 - DNA, 28 bp, Artificial Sequence
  Synthetic
agaaaatgtctcuctcttttggaugcaa

SEQ ID NO: 59561 - DNA, 21 bp, Artificial Sequence
  Synthetic
agggaacugagggcaaaacug

SEQ ID NO: 59562 - DNA, 25 bp, Artificial Sequence
  Synthetic
cccagaacaucacatatcacugcaa

SEQ ID NO: 59563 - DNA, 29 bp, Artificial Sequence
  Synthetic
gctgactgcuttatgacctatatugagaa

SEQ ID NO: 59564 - DNA, 26 bp, Artificial Sequence
  Synthetic
ccttatcuaccattcattgcugcaaa

SEQ ID NO: 59565 - DNA, 19 bp, Artificial Sequence
  Synthetic
acaggcauacgtggtcguc

SEQ ID NO: 59566 - DNA, 22 bp, Artificial Sequence
  Synthetic
cagctuggcccagttatucagt

SEQ ID NO: 59567 - DNA, 22 bp, Artificial Sequence
  Synthetic
gctccttccauagctccatguc

SEQ ID NO: 59568 - DNA, 20 bp, Artificial Sequence
  Synthetic
atcttguggcggatgtggut

SEQ ID NO: 59569 - DNA, 20 bp, Artificial Sequence
  Synthetic
gcgtcggugctgtaacauga

SEQ ID NO: 59570 - DNA, 26 bp, Artificial Sequence
  Synthetic
caagaaactucagaaatttgccucca

SEQ ID NO: 59571 - DNA, 24 bp, Artificial Sequence
  Synthetic
gcacaacutgcagaaugaaccaat

SEQ ID NO: 59572 - DNA, 22 bp, Artificial Sequence
  Synthetic
aagttgugtagccaugggacat

SEQ ID NO: 59573 - DNA, 24 bp, Artificial Sequence
  Synthetic
tgtcaauacccatcttcucacgga

SEQ ID NO: 59574 - DNA, 22 bp, Artificial Sequence
  Synthetic
tcuaaccttucaacaggcagca

SEQ ID NO: 59575 - DNA, 26 bp, Artificial Sequence
  Synthetic
gctaacattugccttgcttgaugaac

SEQ ID NO: 59576 - DNA, 22 bp, Artificial Sequence
  Synthetic
cctttcccuttggtgaggugac

SEQ ID NO: 59577 - DNA, 26 bp, Artificial Sequence
  Synthetic
ggattacuctgagaccuaggcaaaaa

SEQ ID NO: 59578 - DNA, 19 bp, Artificial Sequence
  Synthetic
aggcaccutctccgtcuct

SEQ ID NO: 59579 - DNA, 19 bp, Artificial Sequence
  Synthetic
acagccccugaugaggaca

SEQ ID NO: 59580 - DNA, 21 bp, Artificial Sequence
  Synthetic
tuggccaactuaccacaaggt

SEQ ID NO: 59581 - DNA, 22 bp, Artificial Sequence
  Synthetic
gctggcacaugatggacttcut

SEQ ID NO: 59582 - DNA, 21 bp, Artificial Sequence
  Synthetic
ccagtcuccccggtacuaaca

SEQ ID NO: 59583 - DNA, 21 bp, Artificial Sequence
  Synthetic
cctctccuggcagagtucaag

SEQ ID NO: 59584 - DNA, 21 bp, Artificial Sequence
  Synthetic
ctggtcucccacatgtgugat

SEQ ID NO: 59585 - DNA, 22 bp, Artificial Sequence
  Synthetic
tggaatgggutggtttccucag

SEQ ID NO: 59586 - DNA, 27 bp, Artificial Sequence
  Synthetic
ttgagattcgccuaaaacatgatguct

SEQ ID NO: 59587 - DNA, 21 bp, Artificial Sequence
  Synthetic
gcgcuaagaacacctccacug

SEQ ID NO: 59588 - DNA, 28 bp, Artificial Sequence
  Synthetic
cttccaacaauaggattcagcauagaga

SEQ ID NO: 59589 - DNA, 28 bp, Artificial Sequence
  Synthetic
aataaaccagccauagtggtuagaaaca

SEQ ID NO: 59590 - DNA, 26 bp, Artificial Sequence
  Synthetic
ctgcaaaaugacctaaaaagcuggaa

SEQ ID NO: 59591 - DNA, 28 bp, Artificial Sequence
  Synthetic
gccagggtttauctttgatgttctcuaa

SEQ ID NO: 59592 - DNA, 23 bp, Artificial Sequence
  Synthetic
ggaguagggaagcaaagacugaa

SEQ ID NO: 59593 - DNA, 20 bp, Artificial Sequence
  Synthetic
cctgctgucctgctcttguc

SEQ ID NO: 59594 - DNA, 20 bp, Artificial Sequence
  Synthetic
gtacuccactcccuccgaga

SEQ ID NO: 59595 - DNA, 23 bp, Artificial Sequence
  Synthetic
ggctttccugccaatttctccua

SEQ ID NO: 59596 - DNA, 21 bp, Artificial Sequence
  Synthetic
ggaagcugaggcactgaauct

SEQ ID NO: 59597 - DNA, 21 bp, Artificial Sequence
  Synthetic
ggcauctgagacucacaccaa

SEQ ID NO: 59598 - DNA, 21 bp, Artificial Sequence
  Synthetic
cggcatguggctagttcctuc

SEQ ID NO: 59599 - DNA, 25 bp, Artificial Sequence
  Synthetic
gtgggtgatgutgtgcttctttauc

SEQ ID NO: 59600 - DNA, 19 bp, Artificial Sequence
  Synthetic
acaggcuggatcaggguca

SEQ ID NO: 59601 - DNA, 26 bp, Artificial Sequence
  Synthetic
ctctgccaattuccttacagggauag

SEQ ID NO: 59602 - DNA, 19 bp, Artificial Sequence
  Synthetic
agaggcuaagccgctcauc

SEQ ID NO: 59603 - DNA, 19 bp, Artificial Sequence
  Synthetic
gccuccccagugaagaagt

SEQ ID NO: 59604 - DNA, 20 bp, Artificial Sequence
  Synthetic
auctcctggcugaagaacgg

SEQ ID NO: 59605 - DNA, 19 bp, Artificial Sequence
  Synthetic
cacgacgcaggugtagtug

SEQ ID NO: 59606 - DNA, 20 bp, Artificial Sequence
  Synthetic
gcacaagauctcccgctucc

SEQ ID NO: 59607 - DNA, 24 bp, Artificial Sequence
  Synthetic
aaagtacccuaggctctacauggt

SEQ ID NO: 59608 - DNA, 20 bp, Artificial Sequence
  Synthetic
gggaucgccccattttguat

SEQ ID NO: 59609 - DNA, 21 bp, Artificial Sequence
  Synthetic
cccttgauacgctccgactug

SEQ ID NO: 59610 - DNA, 22 bp, Artificial Sequence
  Synthetic
agatcagctucctgttcgacug

SEQ ID NO: 59611 - DNA, 24 bp, Artificial Sequence
  Synthetic
cctggaaaggutctggttcctuag

SEQ ID NO: 59612 - DNA, 25 bp, Artificial Sequence
  Synthetic
ttgtccacguaatgagcatguagag

SEQ ID NO: 59613 - DNA, 21 bp, Artificial Sequence
  Synthetic
ccccacaggaaggaautcugg

SEQ ID NO: 59614 - DNA, 21 bp, Artificial Sequence
  Synthetic
gcacgguttgauggcagagat

SEQ ID NO: 59615 - DNA, 27 bp, Artificial Sequence
  Synthetic
ccatagccttgcugatattacacacuc

SEQ ID NO: 59616 - DNA, 22 bp, Artificial Sequence
  Synthetic
gggttctguggaagacaauacc

SEQ ID NO: 59617 - DNA, 27 bp, Artificial Sequence
  Synthetic
gcagccaucaatttgttttaagucact

SEQ ID NO: 59618 - DNA, 29 bp, Artificial Sequence
  Synthetic
ctaggaaaatcatuaggcggtatgtaucc

SEQ ID NO: 59619 - DNA, 27 bp, Artificial Sequence
  Synthetic
gagctctatttugttcctctccaucaa

SEQ ID NO: 59620 - DNA, 25 bp, Artificial Sequence
  Synthetic
aagtaatggugattcttggcaucca

SEQ ID NO: 59621 - DNA, 27 bp, Artificial Sequence
  Synthetic
gcacaatcaaguctccatcagattuag

SEQ ID NO: 59622 - DNA, 17 bp, Artificial Sequence
  Synthetic
gggcugagagcgucgag

SEQ ID NO: 59623 - DNA, 18 bp, Artificial Sequence
  Synthetic
tcaccugcagcagcagut

SEQ ID NO: 59624 - DNA, 21 bp, Artificial Sequence
  Synthetic
gatgaacugcacagtggcaut

SEQ ID NO: 59625 - DNA, 26 bp, Artificial Sequence
  Synthetic
tgatacattttucacccaacugacca

SEQ ID NO: 59626 - DNA, 22 bp, Artificial Sequence
  Synthetic
ctgtcauggctctcaucaaggt

SEQ ID NO: 59627 - DNA, 25 bp, Artificial Sequence
  Synthetic
gccatcattgutgtgtttcaatgug

SEQ ID NO: 59628 - DNA, 23 bp, Artificial Sequence
  Synthetic
agctgccgaaggugaatgtttua

SEQ ID NO: 59629 - DNA, 26 bp, Artificial Sequence
  Synthetic
gcaataacaugagagcttgccattut

SEQ ID NO: 59630 - DNA, 25 bp, Artificial Sequence
  Synthetic
tggttttaaagcutgaggcccauaa

SEQ ID NO: 59631 - DNA, 29 bp, Artificial Sequence
  Synthetic
agtcccagattcuctatttccaaaaccua

SEQ ID NO: 59632 - DNA, 28 bp, Artificial Sequence
  Synthetic
agaatcactgucttcattactcugcaaa

SEQ ID NO: 59633 - DNA, 20 bp, Artificial Sequence
  Synthetic
ctgaacaaagccguggagug

SEQ ID NO: 59634 - DNA, 28 bp, Artificial Sequence
  Synthetic
tgaaatcatatcaaugtcagccccauag

SEQ ID NO: 59635 - DNA, 33 bp, Artificial Sequence
  Synthetic
tccatgtaaatatcucattcttttccatuagca

SEQ ID NO: 59636 - DNA, 27 bp, Artificial Sequence
  Synthetic
accattaccugtttcagtttaaucgca

SEQ ID NO: 59637 - DNA, 28 bp, Artificial Sequence
  Synthetic
tccagtttacaauccatggctgtttuat

SEQ ID NO: 59638 - DNA, 27 bp, Artificial Sequence
  Synthetic
agaaaaccatccugagacaccuaaaaa

SEQ ID NO: 59639 - DNA, 24 bp, Artificial Sequence
  Synthetic
gctctcgtuttgtttgcatucagt

SEQ ID NO: 59640 - DNA, 23 bp, Artificial Sequence
  Synthetic
gttcgaacaaaagccaugaagug

SEQ ID NO: 59641 - DNA, 27 bp, Artificial Sequence
  Synthetic
tcgaattatccaucaatcgtccaugaa

SEQ ID NO: 59642 - DNA, 25 bp, Artificial Sequence
  Synthetic
ccagtgtgugccatatttaatugct

SEQ ID NO: 59643 - DNA, 25 bp, Artificial Sequence
  Synthetic
tgugggcagagcatttaucaaagaa

SEQ ID NO: 59644 - DNA, 25 bp, Artificial Sequence
  Synthetic
caacacagacgagccuttcttatut

SEQ ID NO: 59645 - DNA, 27 bp, Artificial Sequence
  Synthetic
ccttcacttcugactgtgtactttgua

SEQ ID NO: 59646 - DNA, 25 bp, Artificial Sequence
  Synthetic
tgggcttacuaatgaccacuacagt

SEQ ID NO: 59647 - DNA, 28 bp, Artificial Sequence
  Synthetic
gaagcacaggtutttatcagtcattgut

SEQ ID NO: 59648 - DNA, 25 bp, Artificial Sequence
  Synthetic
ggaagtgugaaagcattgauggaat

SEQ ID NO: 59649 - DNA, 32 bp, Artificial Sequence
  Synthetic
actgaataauacacaggtaagaaatuaggaaa

SEQ ID NO: 59650 - DNA, 28 bp, Artificial Sequence
  Synthetic
tccttcaucacagaaacagtcatttuca

SEQ ID NO: 59651 - DNA, 24 bp, Artificial Sequence
  Synthetic
ttttgaggcugaccacttctacuc

SEQ ID NO: 59652 - DNA, 22 bp, Artificial Sequence
  Synthetic
agcacccuagaaccaaauccag

SEQ ID NO: 59653 - DNA, 26 bp, Artificial Sequence
  Synthetic
aatcgaacgacuctcaaaactaucaa

SEQ ID NO: 59654 - DNA, 20 bp, Artificial Sequence
  Synthetic
gctctccccucatcctgtut

SEQ ID NO: 59655 - DNA, 17 bp, Artificial Sequence
  Synthetic
ggctgccagugcctcuc

SEQ ID NO: 59656 - DNA, 26 bp, Artificial Sequence
  Synthetic
cuctgttttctgttuaggaccaggag

SEQ ID NO: 59657 - DNA, 25 bp, Artificial Sequence
  Synthetic
cctctggaguacaggaagauaaggt

SEQ ID NO: 59658 - DNA, 25 bp, Artificial Sequence
  Synthetic
gaaaattgcucttctcugcagacaa

SEQ ID NO: 59659 - DNA, 28 bp, Artificial Sequence
  Synthetic
cttctcctcuaaaatgtacacaguagca

SEQ ID NO: 59660 - DNA, 22 bp, Artificial Sequence
  Synthetic
cctgagggugctttgatcucaa

SEQ ID NO: 59661 - DNA, 23 bp, Artificial Sequence
  Synthetic
gactctgagcugtgttctauggg

SEQ ID NO: 59662 - DNA, 24 bp, Artificial Sequence
  Synthetic
gacagagcaaaaucatgctgacug

SEQ ID NO: 59663 - DNA, 28 bp, Artificial Sequence
  Synthetic
tcagaaggacaaugtttatcagcactut

SEQ ID NO: 59664 - DNA, 26 bp, Artificial Sequence
  Synthetic
catgttaatgtuagctggtgcttugt

SEQ ID NO: 59665 - DNA, 31 bp, Artificial Sequence; identical to SEQ ID NO: 34327
  Synthetic

SEQ ID NO: 59666 - DNA, 25 bp, Artificial Sequence
  Synthetic
ctgacttgtttuatgcggtgtacut

SEQ ID NO: 59667 - DNA, 20 bp, Artificial Sequence
  Synthetic
ggguggcactcauagagcag

SEQ ID NO: 59668 - DNA, 22 bp, Artificial Sequence
  Synthetic
agagcaaucaacaggaauggct

SEQ ID NO: 59669 - DNA, 23 bp, Artificial Sequence
  Synthetic
ggaaaccaaggautgggattugg

SEQ ID NO: 59670 - DNA, 21 bp, Artificial Sequence
  Synthetic
cagcucaccaugcagaaggaa

SEQ ID NO: 59671 - DNA, 21 bp, Artificial Sequence
  Synthetic
agtggccutttgctgtuggat

SEQ ID NO: 59672 - DNA, 20 bp, Artificial Sequence
  Synthetic
cccgaacuccatgggttucc

SEQ ID NO: 59673 - DNA, 26 bp, Artificial Sequence
  Synthetic
aaagatgaaaagcuctgacaaccuca

SEQ ID NO: 59674 - DNA, 18 bp, Artificial Sequence
  Synthetic
gggaucagccccuggagt

SEQ ID NO: 59675 - DNA, 19 bp, Artificial Sequence
  Synthetic
ggcggacagcutcaaaguc

SEQ ID NO: 59676 - DNA, 18 bp, Artificial Sequence
  Synthetic
gcuaccguccaggacagg

SEQ ID NO: 59677 - DNA, 20 bp, Artificial Sequence
  Synthetic
ctuaggcaaaggcagcaugt

SEQ ID NO: 59678 - DNA, 22 bp, Artificial Sequence
  Synthetic
ccacacaguctccatgaaucca

SEQ ID NO: 59679 - DNA, 18 bp, Artificial Sequence
  Synthetic
ctguacggccuccacgag

SEQ ID NO: 59680 - DNA, 20 bp, Artificial Sequence
  Synthetic
acagagggcagggugtuact

SEQ ID NO: 59681 - DNA, 22 bp, Artificial Sequence
  Synthetic
gcgagttugactccttcgugat

SEQ ID NO: 59682 - DNA, 23 bp, Artificial Sequence
  Synthetic
gaccatucaccttagcuccagac

SEQ ID NO: 59683 - DNA, 26 bp, Artificial Sequence
  Synthetic
gggtaatgttcuctctgcttcatucc

SEQ ID NO: 59684 - DNA, 22 bp, Artificial Sequence
  Synthetic
acaaugacaacuccccaaacca

SEQ ID NO: 59685 - DNA, 23 bp, Artificial Sequence
  Synthetic
tgctgatgugatgtgctttcuct

SEQ ID NO: 59686 - DNA, 21 bp, Artificial Sequence
  Synthetic
cctgtcucctcagguccagat

SEQ ID NO: 59687 - DNA, 26 bp, Artificial Sequence
  Synthetic
ttctactgtgcutgggaaaagauacc

SEQ ID NO: 59688 - DNA, 28 bp, Artificial Sequence
  Synthetic
ggtacaccttgtucttctccagttacua

SEQ ID NO: 59689 - DNA, 21 bp, Artificial Sequence
  Synthetic
tttgatcuggcgacacaucgt

SEQ ID NO: 59690 - DNA, 28 bp, Artificial Sequence
  Synthetic
agagaagcucacaaaaatttgtcttugg

SEQ ID NO: 59691 - DNA, 23 bp, Artificial Sequence
  Synthetic
aggaaggagaagucgaccaucat

SEQ ID NO: 59692 - DNA, 24 bp, Artificial Sequence
  Synthetic
gcacacaauacacacacatgcaut

SEQ ID NO: 59693 - DNA, 28 bp, Artificial Sequence
  Synthetic
aggaacaaaagcutctgattctcctuag

SEQ ID NO: 59694 - DNA, 27 bp, Artificial Sequence
  Synthetic
attaccagaacaagcauacccattuct

SEQ ID NO: 59695 - DNA, 21 bp, Artificial Sequence
  Synthetic
gccutguccacaaacaccagt

SEQ ID NO: 59696 - DNA, 20 bp, Artificial Sequence
  Synthetic
atgctcgccuccgttaagut

SEQ ID NO: 59697 - DNA, 28 bp, Artificial Sequence
  Synthetic
cacaggtgcuatgaattcttagtucaga

SEQ ID NO: 59698 - DNA, 21 bp, Artificial Sequence
  Synthetic
gtgagugaatgcugaccccat

SEQ ID NO: 59699 - DNA, 26 bp, Artificial Sequence
  Synthetic
gtcagaggcuattggattcttcucaa

SEQ ID NO: 59700 - DNA, 27 bp, Artificial Sequence
  Synthetic
gttatattaacaguggtcacucaccca

SEQ ID NO: 59701 - DNA, 27 bp, Artificial Sequence
  Synthetic
ggtgatcccatutgaatatgctgttut

SEQ ID NO: 59702 - DNA, 27 bp, Artificial Sequence
  Synthetic
agactacatuggtctggttugagaaaa

SEQ ID NO: 59703 - DNA, 28 bp, Artificial Sequence
  Synthetic
aggaacatttgaugatagtgagagguct

SEQ ID NO: 59704 - DNA, 26 bp, Artificial Sequence
  Synthetic
acacgtgtctaauatcacatggaaug

SEQ ID NO: 59705 - DNA, 19 bp, Artificial Sequence
  Synthetic
acatcucccgactgccuct

SEQ ID NO: 59706 - DNA, 27 bp, Artificial Sequence
  Synthetic
ctcatagtcttuaggattgtgggucaa

SEQ ID NO: 59707 - DNA, 25 bp, Artificial Sequence
  Synthetic
ggtagtggttugaatctgacctuca

SEQ ID NO: 59708 - DNA, 26 bp, Artificial Sequence
  Synthetic
gccatttacugtacattcaccuccat

SEQ ID NO: 59709 - DNA, 28 bp, Artificial Sequence
  Synthetic
ggcaatagaaaaugaacctgtaggttut

SEQ ID NO: 59710 - DNA, 23 bp, Artificial Sequence
  Synthetic
actcuctatgcatgucccaccat

SEQ ID NO: 59711 - DNA, 26 bp, Artificial Sequence
  Synthetic
acacgaagtguttttgcatttctuca

SEQ ID NO: 59712 - DNA, 23 bp, Artificial Sequence
  Synthetic
gtggaagugacgaaggaaugact

SEQ ID NO: 59713 - DNA, 23 bp, Artificial Sequence
  Synthetic
gcattccccaugtgtcttcucat

SEQ ID NO: 59714 - DNA, 29 bp, Artificial Sequence
  Synthetic
gtgaagggacaauggataaacaagtctua

SEQ ID NO: 59715 - DNA, 25 bp, Artificial Sequence
  Synthetic
tgcactaaugggagctcaaactauc

SEQ ID NO: 59716 - DNA, 27 bp, Artificial Sequence
  Synthetic
caaagtatgcuttctgtagcuaggaaa

SEQ ID NO: 59717 - DNA, 21 bp, Artificial Sequence
  Synthetic
ctggaautcctggugcaaagg

SEQ ID NO: 59718 - DNA, 26 bp, Artificial Sequence
  Synthetic
cacacauaaacaatacugcacacaca

SEQ ID NO: 59719 - DNA, 29 bp, Artificial Sequence
  Synthetic
gcttcctttaacauacatgactgatcuca

SEQ ID NO: 59720 - DNA, 25 bp, Artificial Sequence
  Synthetic
gctgctttatcuacctggaacugag

SEQ ID NO: 59721 - DNA, 28 bp, Artificial Sequence
  Synthetic
caatgtaccctautgaaaatgcatgcut

SEQ ID NO: 59722 - DNA, 28 bp, Artificial Sequence
  Synthetic
gcattcaacuagtttttgaggcuagaac

SEQ ID NO: 59723 - DNA, 28 bp, Artificial Sequence
  Synthetic
tttcagggaaaugacattctaucaccat

SEQ ID NO: 59724 - DNA, 24 bp, Artificial Sequence
  Synthetic
gctgatctguatcatcgtgaugct

SEQ ID NO: 59725 - DNA, 27 bp, Artificial Sequence
  Synthetic
tcatgtttacaagauccaacagaugaa

SEQ ID NO: 59726 - DNA, 26 bp, Artificial Sequence
  Synthetic
cgtaatccautctattccagucagca

SEQ ID NO: 59727 - DNA, 28 bp, Artificial Sequence
  Synthetic
ctgctcaacgagauttctgatttcttut

SEQ ID NO: 59728 - DNA, 30 bp, Artificial Sequence
  Synthetic
tgtaatgatttttcaguctttccagtguca

SEQ ID NO: 59729 - DNA, 26 bp, Artificial Sequence
  Synthetic
cccaagctutcttcttaccugaacaa

SEQ ID NO: 59730 - DNA, 29 bp, Artificial Sequence
  Synthetic
aactggaaaccagauataactttgagugt

SEQ ID NO: 59731 - DNA, 28 bp, Artificial Sequence
  Synthetic
aggaucttaaccatttugaggacaacag

SEQ ID NO: 59732 - DNA, 25 bp, Artificial Sequence
  Synthetic
acgcacataatutggtcttgacugt

SEQ ID NO: 59733 - DNA, 28 bp, Artificial Sequence
  Synthetic
caagcaaagtggucatttcaacatacut

SEQ ID NO: 59734 - DNA, 22 bp, Artificial Sequence
  Synthetic
ggucaggcaggagatcaugaac

SEQ ID NO: 59735 - DNA, 28 bp, Artificial Sequence
  Synthetic
gaatttcttcatutgcatgagcauccat

SEQ ID NO: 59736 - DNA, 25 bp, Artificial Sequence
  Synthetic
ttttaggtaacaugtcacctugcca

SEQ ID NO: 59737 - DNA, 28 bp, Artificial Sequence
  Synthetic
cccctagcauagaaaacctcataaucaa

SEQ ID NO: 59738 - DNA, 20 bp, Artificial Sequence
  Synthetic
gctcgtcutcaacgtgtugt

SEQ ID NO: 59739 - DNA, 27 bp, Artificial Sequence
  Synthetic
aattatcttguccacatcttcaucgct

SEQ ID NO: 59740 - DNA, 26 bp, Artificial Sequence
  Synthetic
gtacttaaccaccauttcccacacut

SEQ ID NO: 59741 - DNA, 24 bp, Artificial Sequence
  Synthetic
gcctccaatcuctctaccagttug

SEQ ID NO: 59742 - DNA, 21 bp, Artificial Sequence
  Synthetic
gacccutgctctuggaaacca

SEQ ID NO: 59743 - DNA, 27 bp, Artificial Sequence
  Synthetic
aaatggtgagguctccaggatuaaaag

SEQ ID NO: 59744 - DNA, 28 bp, Artificial Sequence
  Synthetic
cttcctguaaacaagcacacuaaaaact

SEQ ID NO: 59745 - DNA, 28 bp, Artificial Sequence
  Synthetic
aggaaagtggaacagugaattaacauca

SEQ ID NO: 59746 - DNA, 22 bp, Artificial Sequence
  Synthetic
catgtcaguggattggctcuct

SEQ ID NO: 59747 - DNA, 24 bp, Artificial Sequence
  Synthetic
agtaatgggaauggagaggcuagg

SEQ ID NO: 59748 - DNA, 21 bp, Artificial Sequence
  Synthetic
ttctactuggctccctuccct

SEQ ID NO: 59749 - DNA, 21 bp, Artificial Sequence
  Synthetic
catgtccccaggugtgacuaa

SEQ ID NO: 59750 - DNA, 25 bp, Artificial Sequence
  Synthetic
agaaacattggaaaugggtgaggut

SEQ ID NO: 59751 - DNA, 28 bp, Artificial Sequence
  Synthetic
tcaccatgttuctgtttcaattgtucag

SEQ ID NO: 59752 - DNA, 28 bp, Artificial Sequence
  Synthetic
tgugaagtaaaugcagaagacaaagaga

SEQ ID NO: 59753 - DNA, 28 bp, Artificial Sequence
  Synthetic
acaacttggcugggtgattaaatcauaa

SEQ ID NO: 59754 - DNA, 28 bp, Artificial Sequence
  Synthetic
catggatgcttcuagacaactaatgtug

SEQ ID NO: 59755 - DNA, 27 bp, Artificial Sequence
  Synthetic
acccttaccugggctaattgtctatua

SEQ ID NO: 59756 - DNA, 28 bp, Artificial Sequence
  Synthetic
tctcagccttucatgaacgtaaaattug

SEQ ID NO: 59757 - DNA, 28 bp, Artificial Sequence
  Synthetic
tctagagctutcacttgttttugaaggt

SEQ ID NO: 59758 - DNA, 28 bp, Artificial Sequence
  Synthetic
gagtgaatgtucctcagaagaagtuact

SEQ ID NO: 59759 - DNA, 23 bp, Artificial Sequence
  Synthetic
cagacactguatcactgcctuca

SEQ ID NO: 59760 - DNA, 25 bp, Artificial Sequence
  Synthetic
gaagtacacaugctcctaggcttut

SEQ ID NO: 59761 - DNA, 23 bp, Artificial Sequence
  Synthetic
aaaacutgtugaagggcaagcag

SEQ ID NO: 59762 - DNA, 33 bp, Artificial Sequence
  Synthetic
aaaagaaaattttaguatgtgtgttccatucat

SEQ ID NO: 59763 - DNA, 26 bp, Artificial Sequence
  Synthetic
ggcattccauagctgcttgatatuca

SEQ ID NO: 59764 - DNA, 23 bp, Artificial Sequence
  Synthetic
agcagtctcaaaugctggagaug

SEQ ID NO: 59765 - DNA, 22 bp, Artificial Sequence
  Synthetic
ttgtgcaagcucactctucagt

SEQ ID NO: 59766 - DNA, 30 bp, Artificial Sequence
  Synthetic
ttttatgctaaagutactttctguccaggt

SEQ ID NO: 59767 - DNA, 28 bp, Artificial Sequence
  Synthetic
tgtttgccaacaauccattatctttugt

SEQ ID NO: 59768 - DNA, 20 bp, Artificial Sequence
  Synthetic
ccacucgagagcagcatucc

SEQ ID NO: 59769 - DNA, 24 bp, Artificial Sequence
  Synthetic
gactctctaccuctggcagaugat

SEQ ID NO: 59770 - DNA, 21 bp, Artificial Sequence
  Synthetic
cccaccaaucttgucccaacc

SEQ ID NO: 59771 - DNA, 28 bp, Artificial Sequence
  Synthetic
tccagctaagaugatggcatatttugaa

SEQ ID NO: 59772 - DNA, 31 bp, Artificial Sequence
  Synthetic
ctaaagcaactagaaaucttacaaaacgugt

SEQ ID NO: 59773 - DNA, 28 bp, Artificial Sequence
  Synthetic
ccagatgaccugaggaagagactaaaua

SEQ ID NO: 59774 - DNA, 27 bp, Artificial Sequence
  Synthetic
aagtactgaaagcutgtaatgcctcut

SEQ ID NO: 59775 - DNA, 27 bp, Artificial Sequence
  Synthetic
ggagacccaucatttcactaaggtuat

SEQ ID NO: 59776 - DNA, 25 bp, Artificial Sequence
  Synthetic
caaattggttgugactgagatugga

SEQ ID NO: 59777 - DNA, 24 bp, Artificial Sequence
  Synthetic
ccagaacuctcaatcugccaacat

SEQ ID NO: 59778 - DNA, 26 bp, Artificial Sequence
  Synthetic
caatcatcacauggaaaaccatuccc

SEQ ID NO: 59779 - DNA, 27 bp, Artificial Sequence
  Synthetic
ggcaggaagcauataagaaccaaauct

SEQ ID NO: 59780 - DNA, 24 bp, Artificial Sequence
  Synthetic
aagcttccccucaacaattgcuat

SEQ ID NO: 59781 - DNA, 28 bp, Artificial Sequence
  Synthetic
gtcagaagaaaauttaggcaaccaucaa

SEQ ID NO: 59782 - DNA, 23 bp, Artificial Sequence
  Synthetic
agaugacacuccagagacaggat

SEQ ID NO: 59783 - DNA, 20 bp, Artificial Sequence
  Synthetic
tcactgtcuccttgggcuca

SEQ ID NO: 59784 - DNA, 23 bp, Artificial Sequence
  Synthetic
agaaucgcccatcagugaaaagt

SEQ ID NO: 59785 - DNA, 21 bp, Artificial Sequence
  Synthetic
catcgactgugcccatgtgua

SEQ ID NO: 59786 - DNA, 27 bp, Artificial Sequence
  Synthetic
ggtatagcacccaaaguaaagtaguga

SEQ ID NO: 59787 - DNA, 23 bp, Artificial Sequence
  Synthetic
agaaagatcccgucttccccuaa

SEQ ID NO: 59788 - DNA, 19 bp, Artificial Sequence
  Synthetic
cagccccagugactgcaua

SEQ ID NO: 59789 - DNA, 23 bp, Artificial Sequence
  Synthetic
gaagtucaagaccacacaugcac

SEQ ID NO: 59790 - DNA, 20 bp, Artificial Sequence
  Synthetic
cgatggcguaccagaugcag

SEQ ID NO: 59791 - DNA, 20 bp, Artificial Sequence
  Synthetic
ccutgccccaucaacggaat

SEQ ID NO: 59792 - DNA, 23 bp, Artificial Sequence
  Synthetic
gaaaaucaccaucagcacaccat

SEQ ID NO: 59793 - DNA, 29 bp, Artificial Sequence
  Synthetic
tccaggaatgcuaacaattacagattuca

SEQ ID NO: 59794 - DNA, 21 bp, Artificial Sequence
  Synthetic
tgcaggaaggutgtggagtug

SEQ ID NO: 59795 - DNA, 26 bp, Artificial Sequence
  Synthetic
tggcattutgctcctauaaacacgat

SEQ ID NO: 59796 - DNA, 22 bp, Artificial Sequence
  Synthetic
gttgaccttccuctccccatuc

SEQ ID NO: 59797 - DNA, 20 bp, Artificial Sequence
  Synthetic
gagaacggcaucgugagaca

SEQ ID NO: 59798 - DNA, 29 bp, Artificial Sequence
  Synthetic
agttcagtggaaagugattcattcaguat

SEQ ID NO: 59799 - DNA, 26 bp, Artificial Sequence
  Synthetic
catctgttcttugttcactctctuct

SEQ ID NO: 59800 - DNA, 21 bp, Artificial Sequence
  Synthetic
ccaaacggguctgaagcaugt

SEQ ID NO: 59801 - DNA, 28 bp, Artificial Sequence
  Synthetic
cacctgtaactugttgtgtcattttuct

SEQ ID NO: 59802 - DNA, 28 bp, Artificial Sequence
  Synthetic
gtcttgggtagaaucatcttgtctcaut

SEQ ID NO: 59803 - DNA, 31 bp, Artificial Sequence
  Synthetic
ggaagagaaagaaagacutttagaatgucca

SEQ ID NO: 59804 - DNA, 23 bp, Artificial Sequence
  Synthetic
acagaatcucagagcctcaucct

SEQ ID NO: 59805 - DNA, 28 bp, Artificial Sequence
  Synthetic
acttgtgagaggccuataaactggtaua

SEQ ID NO: 59806 - DNA, 21 bp, Artificial Sequence
  Synthetic
cacctcccuggcaattgcuat

SEQ ID NO: 59807 - DNA, 24 bp, Artificial Sequence
  Synthetic
tttcatcugagaagcaaggagugg

SEQ ID NO: 59808 - DNA, 22 bp, Artificial Sequence
  Synthetic
cggagaaguaggtggtgucact

SEQ ID NO: 59809 - DNA, 18 bp, Artificial Sequence
  Synthetic
gtgaccugctgcagctuc

SEQ ID NO: 59810 - DNA, 22 bp, Artificial Sequence
  Synthetic
ctgtuggcaaacagtccugaag

SEQ ID NO: 59811 - DNA, 25 bp, Artificial Sequence
  Synthetic
acccagattauctcactgaggtuga

SEQ ID NO: 59812 - DNA, 28 bp, Artificial Sequence
  Synthetic
tcttttacttttugtcctccagtugact

SEQ ID NO: 59813 - DNA, 24 bp, Artificial Sequence
  Synthetic
gaaatcaaacauctggcgcctaut

SEQ ID NO: 59814 - DNA, 27 bp, Artificial Sequence
  Synthetic
tugaagaagatauagagaccccaccaa

SEQ ID NO: 59815 - DNA, 28 bp, Artificial Sequence
  Synthetic
ggtacataactuggcatatcaacagugt

SEQ ID NO: 59816 - DNA, 19 bp, Artificial Sequence
  Synthetic
gggcgggcugttgaauaac

SEQ ID NO: 59817 - DNA, 25 bp, Artificial Sequence
  Synthetic
gcatctgtgcutttctcagagtcut

SEQ ID NO: 59818 - DNA, 28 bp, Artificial Sequence
  Synthetic
aaaatgcttggugttgatgtgaaaauct

SEQ ID NO: 59819 - DNA, 26 bp, Artificial Sequence
  Synthetic
tgtagtuaaaacagagccaaugagca

SEQ ID NO: 59820 - DNA, 22 bp, Artificial Sequence
  Synthetic
aacgcgttuaccattgcaaaug

SEQ ID NO: 59821 - DNA, 24 bp, Artificial Sequence
  Synthetic
acaaagacaagcugagggactaug

SEQ ID NO: 59822 - DNA, 27 bp, Artificial Sequence
  Synthetic
tttctcacauaggataccaactcucca

SEQ ID NO: 59823 - DNA, 21 bp, Artificial Sequence
  Synthetic
tgccctcugttggguaaaacc

SEQ ID NO: 59824 - DNA, 20 bp, Artificial Sequence
  Synthetic
cgaaaucagcagcagcacuc

SEQ ID NO: 59825 - DNA, 24 bp, Artificial Sequence
  Synthetic
ggccctatcauctctgtgtttcuc

SEQ ID NO: 59826 - DNA, 21 bp, Artificial Sequence
  Synthetic
tcgtttcccuccaggctttuc

SEQ ID NO: 59827 - DNA, 22 bp, Artificial Sequence
  Synthetic
aggactctguccagagctcaut

SEQ ID NO: 59828 - DNA, 28 bp, Artificial Sequence
  Synthetic
gaacactgttuaccttgtgattcuagga

SEQ ID NO: 59829 - DNA, 31 bp, Artificial Sequence
  Synthetic
ctctttgtcatttugattaagccatagtugt

SEQ ID NO: 59830 - DNA, 23 bp, Artificial Sequence
  Synthetic
cggttttcuaccaccttcucaca

SEQ ID NO: 59831 - DNA, 21 bp, Artificial Sequence
  Synthetic
gcacagugaagagcugcaaag

SEQ ID NO: 59832 - DNA, 23 bp, Artificial Sequence
  Synthetic
aggaaucccacactcugacagat

SEQ ID NO: 59833 - DNA, 23 bp, Artificial Sequence
  Synthetic
ctgcugaacatgtacucagggaa

SEQ ID NO: 59834 - DNA, 21 bp, Artificial Sequence
  Synthetic
gcagcacagutgccatcatug

SEQ ID NO: 59835 - DNA, 26 bp, Artificial Sequence
  Synthetic
cattatttcctugtgtttgtggugga

SEQ ID NO: 59836 - DNA, 25 bp, Artificial Sequence
  Synthetic
ggttacaggcacucgaatguagaag

SEQ ID NO: 59837 - DNA, 20 bp, Artificial Sequence
  Synthetic
aatctggtugaggccacgut

SEQ ID NO: 59838 - DNA, 28 bp, Artificial Sequence
  Synthetic
aggcagatatacacuagctcattttgug

SEQ ID NO: 59839 - DNA, 21 bp, Artificial Sequence
  Synthetic
cccagtccagucataacgcut

SEQ ID NO: 59840 - DNA, 27 bp, Artificial Sequence
  Synthetic
agagcaacaaacagugcatagaaatug

SEQ ID NO: 59841 - DNA, 28 bp, Artificial Sequence
  Synthetic
cccatctgucacacaagtaaaattguct

SEQ ID NO: 59842 - DNA, 26 bp, Artificial Sequence
  Synthetic
gaaatgtcugaaaggaggttcaucca

SEQ ID NO: 59843 - DNA, 26 bp, Artificial Sequence
  Synthetic
cccagaatacuaagcccattgcauag

SEQ ID NO: 59844 - DNA, 26 bp, Artificial Sequence
  Synthetic
aggacaaaacaucttcgttcagauca

SEQ ID NO: 59845 - DNA, 28 bp, Artificial Sequence
  Synthetic
ccatggagcucagtttttgtgaatauct

SEQ ID NO: 59846 - DNA, 21 bp, Artificial Sequence
  Synthetic
gcatgctggcugattctgtuc

SEQ ID NO: 59847 - DNA, 28 bp, Artificial Sequence
  Synthetic
accatcccctuagtattaggtgaaauct

SEQ ID NO: 59848 - DNA, 27 bp, Artificial Sequence
  Synthetic
ttccctctatagcuatggaaagtccuc

SEQ ID NO: 59849 - DNA, 28 bp, Artificial Sequence
  Synthetic
ttcgatattguaacactctgagttugct

SEQ ID NO: 59850 - DNA, 21 bp, Artificial Sequence
  Synthetic
ccaggatuacgtggttuccct

SEQ ID NO: 59851 - DNA, 22 bp, Artificial Sequence
  Synthetic
gaggaugggacaaaggcttuga

SEQ ID NO: 59852 - DNA, 23 bp, Artificial Sequence
  Synthetic
acagaaaagguccaaacggtugt

SEQ ID NO: 59853 - DNA, 21 bp, Artificial Sequence
  Synthetic
acgtuggaagagaacgugcat

SEQ ID NO: 59854 - DNA, 22 bp, Artificial Sequence
  Synthetic
tctgauggaagcacgtcatcug

SEQ ID NO: 59855 - DNA, 26 bp, Artificial Sequence
  Synthetic
ttaaggaaaagagugaaacccaccut

SEQ ID NO: 59856 - DNA, 23 bp, Artificial Sequence
  Synthetic
ttccuccaaagacaaggcaauga

SEQ ID NO: 59857 - DNA, 23 bp, Artificial Sequence
  Synthetic
ggaatatggugaggtggttggug

SEQ ID NO: 59858 - DNA, 25 bp, Artificial Sequence
  Synthetic
gcatacctucactctgaguacagaa

SEQ ID NO: 59859 - DNA, 27 bp, Artificial Sequence
  Synthetic
tcccccatgaauaaccaccaauaaaaa

SEQ ID NO: 59860 - DNA, 21 bp, Artificial Sequence
  Synthetic
agggaaggtuggcgtgttauc

SEQ ID NO: 59861 - DNA, 28 bp, Artificial Sequence
  Synthetic
tgcacccttucaaattgtaagatuacct

SEQ ID NO: 59862 - DNA, 29 bp, Artificial Sequence
  Synthetic
aaccacagcaautaacaaaagaacaauca

SEQ ID NO: 59863 - DNA, 28 bp, Artificial Sequence
  Synthetic
cttcatatgtgcggutgtgatcattuac

SEQ ID NO: 59864 - DNA, 28 bp, Artificial Sequence
  Synthetic
actgggcattguaaaatatggacttuga

SEQ ID NO: 59865 - DNA, 26 bp, Artificial Sequence
  Synthetic
agtgaaacuccaaaaagauagcacga

SEQ ID NO: 59866 - DNA, 23 bp, Artificial Sequence
  Synthetic
gaagcttcucaccctcttctcut

SEQ ID NO: 59867 - DNA, 19 bp, Artificial Sequence
  Synthetic
gaggcugcccatgggauag

SEQ ID NO: 59868 - DNA, 22 bp, Artificial Sequence
  Synthetic
gttggtggagcuggcagaatua

SEQ ID NO: 59869 - DNA, 21 bp, Artificial Sequence
  Synthetic
ggtcatcuccaccaggtugat

SEQ ID NO: 59870 - DNA, 19 bp, Artificial Sequence
  Synthetic
gtctgtguccgaggacgug

SEQ ID NO: 59871 - DNA, 22 bp, Artificial Sequence
  Synthetic
aacagtagagcccugacctcut

SEQ ID NO: 59872 - DNA, 20 bp, Artificial Sequence
  Synthetic
agccugagggtcaggucaat

SEQ ID NO: 59873 - DNA, 24 bp, Artificial Sequence
  Synthetic
ccatguagtaggtgaucccaaagg

SEQ ID NO: 59874 - DNA, 26 bp, Artificial Sequence
  Synthetic
gtucgaggaaccttguaaaacacaaa

SEQ ID NO: 59875 - DNA, 22 bp, Artificial Sequence
  Synthetic
aagattccguagctgctcctug

SEQ ID NO: 59876 - DNA, 21 bp, Artificial Sequence
  Synthetic
acaccccaagucagugaaagg

SEQ ID NO: 59877 - DNA, 22 bp, Artificial Sequence
  Synthetic
ttctccgguaggtcatccucat

SEQ ID NO: 59878 - DNA, 24 bp, Artificial Sequence
  Synthetic
gagtatgacaacautgccaagcug

SEQ ID NO: 59879 - DNA, 20 bp, Artificial Sequence
  Synthetic
aggtctcuaccaccctgugt

SEQ ID NO: 59880 - DNA, 20 bp, Artificial Sequence
  Synthetic
tgguggacgaagccatugat

SEQ ID NO: 59881 - DNA, 21 bp, Artificial Sequence
  Synthetic
tttcacagccucacggaacut

SEQ ID NO: 59882 - DNA, 25 bp, Artificial Sequence
  Synthetic
agaggaaacaaaugguaaggaaggg

SEQ ID NO: 59883 - DNA, 25 bp, Artificial Sequence
  Synthetic
tggctagttttucccgaatttcugt

SEQ ID NO: 59884 - DNA, 19 bp, Artificial Sequence
  Synthetic
cagaaggcguggucaggat

SEQ ID NO: 59885 - DNA, 20 bp, Artificial Sequence
  Synthetic
gggtaacgutctgctcgugt

SEQ ID NO: 59886 - DNA, 21 bp, Artificial Sequence
  Synthetic
acccaggagugacctugagag

SEQ ID NO: 59887 - DNA, 23 bp, Artificial Sequence
  Synthetic
ctcaaagctucccactgtcttut

SEQ ID NO: 59888 - DNA, 19 bp, Artificial Sequence
  Synthetic
catucaccgaagggcuggt

SEQ ID NO: 59889 - DNA, 27 bp, Artificial Sequence
  Synthetic
cgtgaaggcauctttaatgaucagact

SEQ ID NO: 59890 - DNA, 20 bp, Artificial Sequence
  Synthetic
agugaacuggccggaaaagt

SEQ ID NO: 59891 - DNA, 18 bp, Artificial Sequence
  Synthetic
cggctuacgggtcgtugg

SEQ ID NO: 59892 - DNA, 23 bp, Artificial Sequence
  Synthetic
caggacucacctcttttucagca

SEQ ID NO: 59893 - DNA, 22 bp, Artificial Sequence
  Synthetic
tcctgctccuaatcccttucca

SEQ ID NO: 59894 - DNA, 19 bp, Artificial Sequence
  Synthetic
aaggcctuggctatgguga

SEQ ID NO: 59895 - DNA, 18 bp, Artificial Sequence
  Synthetic
aguggacagggcccttug

SEQ ID NO: 59896 - DNA, 22 bp, Artificial Sequence
  Synthetic
ggtttgccaaccugtcaaugaa

SEQ ID NO: 59897 - DNA, 26 bp, Artificial Sequence
  Synthetic
gattgctgtuggaaaagattcugcaa

SEQ ID NO: 59898 - DNA, 18 bp, Artificial Sequence
  Synthetic
gcctcuggacactgcuca

SEQ ID NO: 59899 - DNA, 20 bp, Artificial Sequence
  Synthetic
gggtucaaaggcctgttugg

SEQ ID NO: 59900 - DNA, 21 bp, Artificial Sequence
  Synthetic
caggtctgcugtcctagucct

SEQ ID NO: 59901 - DNA, 21 bp, Artificial Sequence
  Synthetic
ccctgcgugcttgttgaagua

SEQ ID NO: 59902 - DNA, 21 bp, Artificial Sequence
  Synthetic
gcttatcugctgccgucaact

SEQ ID NO: 59903 - DNA, 25 bp, Artificial Sequence
  Synthetic
ggaatctgaaugccgatctagaugt

SEQ ID NO: 59904 - DNA, 28 bp, Artificial Sequence
  Synthetic
ttctttcagcauaccacttcataacugt

SEQ ID NO: 59905 - DNA, 25 bp, Artificial Sequence
  Synthetic
aattcgaaagtugacagccaaaguc

SEQ ID NO: 59906 - DNA, 24 bp, Artificial Sequence
  Synthetic
aattcagaaacucttgtccggugt

SEQ ID NO: 59907 - DNA, 27 bp, Artificial Sequence
  Synthetic
cctaccttggcuttctggaataatuct

SEQ ID NO: 59908 - DNA, 26 bp, Artificial Sequence
  Synthetic
tttaccacagcaaugtgtgttcttug

SEQ ID NO: 59909 - DNA, 28 bp, Artificial Sequence
  Synthetic
cattcguatccacagauagcaaaagaaa

SEQ ID NO: 59910 - DNA, 22 bp, Artificial Sequence
  Synthetic
accacagtucttttcccguagg

SEQ ID NO: 59911 - DNA, 24 bp, Artificial Sequence
  Synthetic
ccatctgcagcautccaaatacut

SEQ ID NO: 59912 - DNA, 30 bp, Artificial Sequence; identical to SEQ ID NO: 6362
  Synthetic

SEQ ID NO: 59913 - DNA, 27 bp, Artificial Sequence
  Synthetic
ccctgaacatgugtagaaagcagatut

SEQ ID NO: 59914 - DNA, 20 bp, Artificial Sequence
  Synthetic
atgtcuggcagauacgcaca

SEQ ID NO: 59915 - DNA, 24 bp, Artificial Sequence
  Synthetic
gaatctctcugtgtagcctuggaa

SEQ ID NO: 59916 - DNA, 25 bp, Artificial Sequence
  Synthetic
tgtttcactugtactttctguggca

SEQ ID NO: 59917 - DNA, 24 bp, Artificial Sequence
  Synthetic
aaaaagcagagacutgaggauggt

SEQ ID NO: 59918 - DNA, 24 bp, Artificial Sequence
  Synthetic
tgttgcaaacuactgctcttcugt

SEQ ID NO: 59919 - DNA, 22 bp, Artificial Sequence
  Synthetic
tccacccaugcuccagaaaaag

SEQ ID NO: 59920 - DNA, 19 bp, Artificial Sequence
  Synthetic
gcgccgcagucaagtcuaa

SEQ ID NO: 59921 - DNA, 22 bp, Artificial Sequence
  Synthetic
cugagtuaccaggaggaaacca

SEQ ID NO: 59922 - DNA, 22 bp, Artificial Sequence
  Synthetic
ccactcacacuggtgttcctut

SEQ ID NO: 59923 - DNA, 19 bp, Artificial Sequence
  Synthetic
tctcuggcaccccttgcua

SEQ ID NO: 59924 - DNA, 21 bp, Artificial Sequence
  Synthetic
tgggctauggagatgcucact

SEQ ID NO: 59925 - DNA, 21 bp, Artificial Sequence
  Synthetic
ctgtcccucctttctggucaa

SEQ ID NO: 59926 - DNA, 22 bp, Artificial Sequence
  Synthetic
cctgggtgauggcctaggauag

SEQ ID NO: 59927 - DNA, 22 bp, Artificial Sequence
  Synthetic
ctcacccacaccuttcagtgua

SEQ ID NO: 59928 - DNA, 24 bp, Artificial Sequence
  Synthetic
ccacttuacagaggtcaagcugat

SEQ ID NO: 59929 - DNA, 28 bp, Artificial Sequence
  Synthetic
gctcaggaaaauggagtatttgcttcut

SEQ ID NO: 59930 - DNA, 24 bp, Artificial Sequence
  Synthetic
actcttctgaautgggctcugaac

SEQ ID NO: 59931 - DNA, 25 bp, Artificial Sequence
  Synthetic
cacatttctgggaauatccgcttuc

SEQ ID NO: 59932 - DNA, 20 bp, Artificial Sequence
  Synthetic
ccugaacaggcauagcccat

SEQ ID NO: 59933 - DNA, 27 bp, Artificial Sequence
  Synthetic
aaatccttaggcuctctacgtcuaact

SEQ ID NO: 59934 - DNA, 28 bp, Artificial Sequence
  Synthetic
tgttggatcatautcgtccacaaaauga

SEQ ID NO: 59935 - DNA, 27 bp, Artificial Sequence
  Synthetic
aggtactgguggagtatttgatagugt

SEQ ID NO: 59936 - DNA, 19 bp, Artificial Sequence
  Synthetic
gcugacgggcagaacugaa

SEQ ID NO: 59937 - DNA, 23 bp, Artificial Sequence
  Synthetic
gtagccaaagaaacuctcccuga

SEQ ID NO: 59938 - DNA, 26 bp, Artificial Sequence
  Synthetic
cacatgagctucactacagggaatua

SEQ ID NO: 59939 - DNA, 27 bp, Artificial Sequence
  Synthetic
gatctaaggtctucagtccaatcacug

SEQ ID NO: 59940 - DNA, 26 bp, Artificial Sequence
  Synthetic
caaagcatuaacgtggcauagaaaga

SEQ ID NO: 59941 - DNA, 29 bp, Artificial Sequence
  Synthetic
ccatcttcatcuccaatcttctcatguaa

SEQ ID NO: 59942 - DNA, 21 bp, Artificial Sequence
  Synthetic
cautttaugacgcagcgagca

SEQ ID NO: 59943 - DNA, 27 bp, Artificial Sequence
  Synthetic
actgaagcaatugtttgcccaaaauaa

SEQ ID NO: 59944 - DNA, 30 bp, Artificial Sequence
  Synthetic
attcaattcagaauggttagggaagaauat

SEQ ID NO: 59945 - DNA, 26 bp, Artificial Sequence
  Synthetic
accaccactgutatgatgttggaauc

SEQ ID NO: 59946 - DNA, 24 bp, Artificial Sequence
  Synthetic
agacaggaacagaagguccttcua

SEQ ID NO: 59947 - DNA, 26 bp, Artificial Sequence
  Synthetic
cagctctaagugcattcttgttucac

SEQ ID NO: 59948 - DNA, 24 bp, Artificial Sequence
  Synthetic
agagacaccaagaagugaucaacc

SEQ ID NO: 59949 - DNA, 26 bp, Artificial Sequence
  Synthetic
gccttcactcucacacatctttctut

SEQ ID NO: 59950 - DNA, 21 bp, Artificial Sequence
  Synthetic
ggaccacaaggacuccactuc

SEQ ID NO: 59951 - DNA, 26 bp, Artificial Sequence
  Synthetic
tgaaggctcacuctgtttctctttut

SEQ ID NO: 59952 - DNA, 22 bp, Artificial Sequence
  Synthetic
tctttccuccccctttccagua

SEQ ID NO: 59953 - DNA, 24 bp, Artificial Sequence
  Synthetic
cctctcatggucacttccttctug

SEQ ID NO: 59954 - DNA, 33 bp, Artificial Sequence; identical to SEQ ID NO: 26878
  Synthetic

SEQ ID NO: 59955 - DNA, 27 bp, Artificial Sequence
  Synthetic
agggcttaucgagacaaattgaagtut

SEQ ID NO: 59956 - DNA, 27 bp, Artificial Sequence
  Synthetic
acatatctgagggaauctgcaaatgua

SEQ ID NO: 59957 - DNA, 27 bp, Artificial Sequence
  Synthetic
cttgtgcacuaaacataatgctgagut

SEQ ID NO: 59958 - DNA, 26 bp, Artificial Sequence
  Synthetic
gggatcatagaacugtacctggttuc

SEQ ID NO: 59959 - DNA, 21 bp, Artificial Sequence
  Synthetic
cgagctcuctgtgctttcugt

SEQ ID NO: 59960 - DNA, 24 bp, Artificial Sequence
  Synthetic
cccccgaagaaacauagacacaua

SEQ ID NO: 59961 - DNA, 23 bp, Artificial Sequence
  Synthetic
gtccctgagugtgtgtttccuac

SEQ ID NO: 59962 - DNA, 28 bp, Artificial Sequence
  Synthetic
gttacttacuacgtcatttuccaaagcc

SEQ ID NO: 59963 - DNA, 27 bp, Artificial Sequence
  Synthetic
tgtgagtgtaacugattgccagatuat

SEQ ID NO: 59964 - DNA, 24 bp, Artificial Sequence
  Synthetic
gtgacatucagcaggatgcaaaut

SEQ ID NO: 59965 - DNA, 21 bp, Artificial Sequence
  Synthetic
guggaccuacacaagcagcat

SEQ ID NO: 59966 - DNA, 22 bp, Artificial Sequence
  Synthetic
caaacaccccaautctgugcat

SEQ ID NO: 59967 - DNA, 22 bp, Artificial Sequence
  Synthetic
gcaagacagugctttccctcug

SEQ ID NO: 59968 - DNA, 21 bp, Artificial Sequence
  Synthetic
gcagaagccaugctugcaaat

SEQ ID NO: 59969 - DNA, 25 bp, Artificial Sequence
  Synthetic
atgaatgctgugttgctgtctttut

SEQ ID NO: 59970 - DNA, 21 bp, Artificial Sequence
  Synthetic
cttgguggcgaagtctcctut

SEQ ID NO: 59971 - DNA, 28 bp, Artificial Sequence
  Synthetic
tctctctgcaatutttcatgtctgcaua

SEQ ID NO: 59972 - DNA, 22 bp, Artificial Sequence
  Synthetic
gccaugtccaaatuaagagcga

SEQ ID NO: 59973 - DNA, 27 bp, Artificial Sequence
  Synthetic
tcgcatctgaacucatttctttcucat

SEQ ID NO: 59974 - DNA, 29 bp, Artificial Sequence
  Synthetic
aaggaaatggaaugaaaagagagaaguca

SEQ ID NO: 59975 - DNA, 23 bp, Artificial Sequence
  Synthetic
acacagtgcguatgaatgaugct

SEQ ID NO: 59976 - DNA, 22 bp, Artificial Sequence
  Synthetic
cccacgcauggaatcatcgaut

SEQ ID NO: 59977 - DNA, 28 bp, Artificial Sequence
  Synthetic
ggtgatcaatgacaauggcatttctaut

SEQ ID NO: 59978 - DNA, 17 bp, Artificial Sequence
  Synthetic
cggcgcagcucuccaat

SEQ ID NO: 59979 - DNA, 19 bp, Artificial Sequence
  Synthetic
tcctcaggcuccagtucct

SEQ ID NO: 59980 - DNA, 20 bp, Artificial Sequence
  Synthetic
gggcaugctaatguggaagt

SEQ ID NO: 59981 - DNA, 22 bp, Artificial Sequence
  Synthetic
atctccagcucattcacccauc

SEQ ID NO: 59982 - DNA, 21 bp, Artificial Sequence
  Synthetic
ggctctgcacucagtaggtut

SEQ ID NO: 59983 - DNA, 18 bp, Artificial Sequence
  Synthetic
gugccaacgacgaccuga

SEQ ID NO: 59984 - DNA, 20 bp, Artificial Sequence
  Synthetic
cccccaugtacctucagcaa

SEQ ID NO: 59985 - DNA, 17 bp, Artificial Sequence
  Synthetic
cagcggguggtggacuc

SEQ ID NO: 59986 - DNA, 20 bp, Artificial Sequence
  Synthetic
gtgccugcctatggagucat

SEQ ID NO: 59987 - DNA, 22 bp, Artificial Sequence
  Synthetic
cctcucaacgagactgttgugg

SEQ ID NO: 59988 - DNA, 23 bp, Artificial Sequence
  Synthetic
catatatcauccaggccgcguag

SEQ ID NO: 59989 - DNA, 22 bp, Artificial Sequence
  Synthetic
tggtcactcaucctcctgctua

SEQ ID NO: 59990 - DNA, 23 bp, Artificial Sequence
  Synthetic
gggtctgcutgtactgttauggg

SEQ ID NO: 59991 - DNA, 23 bp, Artificial Sequence
  Synthetic
ctccttctcuctaccagcuggaa

SEQ ID NO: 59992 - DNA, 17 bp, Artificial Sequence
  Synthetic
gcutcucacgcggcgat

SEQ ID NO: 59993 - DNA, 19 bp, Artificial Sequence
  Synthetic
gtggcugaaggcgcatuac

SEQ ID NO: 59994 - DNA, 20 bp, Artificial Sequence
  Synthetic
ccacttgcucctgcguaaag

SEQ ID NO: 59995 - DNA, 21 bp, Artificial Sequence
  Synthetic
gcaaagccuaaggaggaggut

SEQ ID NO: 59996 - DNA, 24 bp, Artificial Sequence
  Synthetic
tgtgaatgtgugtctttcccauct

SEQ ID NO: 59997 - DNA, 27 bp, Artificial Sequence
  Synthetic
agaagaaacauccatgggattcuaacc

SEQ ID NO: 59998 - DNA, 21 bp, Artificial Sequence
  Synthetic
ttgagctgugtgggaauccaa

SEQ ID NO: 59999 - DNA, 23 bp, Artificial Sequence
  Synthetic
aagagctaugaactgcctgaugg

SEQ ID NO: 60000 - DNA, 22 bp, Artificial Sequence
  Synthetic
cagtggugacaaaggaguagcc

SEQ ID NO: 60001 - DNA, 27 bp, Artificial Sequence
  Synthetic
gtcctcaggaauttaccttgttctugt

SEQ ID NO: 60002 - DNA, 21 bp, Artificial Sequence
  Synthetic
ctgcagagcaugagagctcut

SEQ ID NO: 60003 - DNA, 27 bp, Artificial Sequence
  Synthetic
atcttcaatactcucatggctcagtuc

SEQ ID NO: 60004 - DNA, 23 bp, Artificial Sequence
  Synthetic
gctcctcaucctcattcacauct

SEQ ID NO: 60005 - DNA, 21 bp, Artificial Sequence
  Synthetic
aggccctcucctatcacaguc

SEQ ID NO: 60006 - DNA, 22 bp, Artificial Sequence
  Synthetic
gggttctcuagaggctggtuct

SEQ ID NO: 60007 - DNA, 26 bp, Artificial Sequence
  Synthetic
ggactttucgcacagaagatcuaaac

SEQ ID NO: 60008 - DNA, 23 bp, Artificial Sequence
  Synthetic
ccccttgctuttcttgtcttcug

SEQ ID NO: 60009 - DNA, 21 bp, Artificial Sequence
  Synthetic
ctccctuccgaacatctgugt

SEQ ID NO: 60010 - DNA, 28 bp, Artificial Sequence
  Synthetic
gtattaatgcaauttcctcccugacaga

SEQ ID NO: 60011 - DNA, 33 bp, Artificial Sequence
  Synthetic
tcacattttattcugcaatgaatttcataugag

SEQ ID NO: 60012 - DNA, 20 bp, Artificial Sequence
  Synthetic
ccugaggacugggaaaggga

SEQ ID NO: 60013 - DNA, 22 bp, Artificial Sequence
  Synthetic
ccgtacgcucctctugaagaag

SEQ ID NO: 60014 - DNA, 21 bp, Artificial Sequence
  Synthetic
ctggcuccactaccatucacc

SEQ ID NO: 60015 - DNA, 26 bp, Artificial Sequence
  Synthetic
ggcttatctugccatttcttcatguc

SEQ ID NO: 60016 - DNA, 25 bp, Artificial Sequence
  Synthetic
gaaagaaggguactaguccagaggt

SEQ ID NO: 60017 - DNA, 24 bp, Artificial Sequence
  Synthetic
accagactgtugttgcttgtttuc

SEQ ID NO: 60018 - DNA, 27 bp, Artificial Sequence
  Synthetic
ggatgatctcatuctcctggtagtuga

SEQ ID NO: 60019 - DNA, 21 bp, Artificial Sequence
  Synthetic
aggtctgcaccugatctccut

SEQ ID NO: 60020 - DNA, 20 bp, Artificial Sequence
  Synthetic
ccccttcccugggtggaaua

SEQ ID NO: 60021 - DNA, 21 bp, Artificial Sequence
  Synthetic
gctgctgcugctactgttcuc

SEQ ID NO: 60022 - DNA, 21 bp, Artificial Sequence
  Synthetic
catgtgcaugctcatggtguc

SEQ ID NO: 60023 - DNA, 26 bp, Artificial Sequence
  Synthetic
agcatgaggatuctgtatttggtgut

SEQ ID NO: 60024 - DNA, 19 bp, Artificial Sequence
  Synthetic
ccaggcatcucccctccut

SEQ ID NO: 60025 - DNA, 17 bp, Artificial Sequence
  Synthetic
tgggtcuccagcuccgt

SEQ ID NO: 60026 - DNA, 25 bp, Artificial Sequence
  Synthetic
ttgaataactcuccacccgugaaag

SEQ ID NO: 60027 - DNA, 21 bp, Artificial Sequence
  Synthetic
cagacgaugaggtcaugcaag

SEQ ID NO: 60028 - DNA, 22 bp, Artificial Sequence
  Synthetic
gtctggcuggacuaaaggcaaa

SEQ ID NO: 60029 - DNA, 24 bp, Artificial Sequence
  Synthetic
gtacatgcttuttctgctggugac

SEQ ID NO: 60030 - DNA, 19 bp, Artificial Sequence
  Synthetic
ccacaggcuccacgaaguc

SEQ ID NO: 60031 - DNA, 20 bp, Artificial Sequence
  Synthetic
atggcaccaacguctccuac

SEQ ID NO: 60032 - DNA, 20 bp, Artificial Sequence
  Synthetic
agcgtaggugtgcaugacat

SEQ ID NO: 60033 - DNA, 18 bp, Artificial Sequence
  Synthetic
ccggtucactcacugcgt

SEQ ID NO: 60034 - DNA, 23 bp, Artificial Sequence
  Synthetic
cctctgcauacagctctgtcuct

SEQ ID NO: 60035 - DNA, 24 bp, Artificial Sequence
  Synthetic
agaatgagcutaaggagcuggaac

SEQ ID NO: 60036 - DNA, 19 bp, Artificial Sequence
  Synthetic
cccugaaccccgtccuagt

SEQ ID NO: 60037 - DNA, 21 bp, Artificial Sequence
  Synthetic
cttgctauggcccatgaccut

SEQ ID NO: 60038 - DNA, 21 bp, Artificial Sequence
  Synthetic
caggtucaaagcagggucagt

SEQ ID NO: 60039 - DNA, 21 bp, Artificial Sequence
  Synthetic
cccatgtcugtctgtctgucc

SEQ ID NO: 60040 - DNA, 23 bp, Artificial Sequence
  Synthetic
cacctcguggtagaactcttugg

SEQ ID NO: 60041 - DNA, 22 bp, Artificial Sequence
  Synthetic
agtagggauaaggugaggccat

SEQ ID NO: 60042 - DNA, 22 bp, Artificial Sequence
  Synthetic
ctctcauggatcttcugccaca

SEQ ID NO: 60043 - DNA, 27 bp, Artificial Sequence
  Synthetic
cgagtctctugatctctaatgucacat

SEQ ID NO: 60044 - DNA, 21 bp, Artificial Sequence
  Synthetic
cctccaguggctcaacatcua

SEQ ID NO: 60045 - DNA, 24 bp, Artificial Sequence
  Synthetic
gaaatggttgugtgatgtctugcc

SEQ ID NO: 60046 - DNA, 21 bp, Artificial Sequence
  Synthetic
agcagcgccautagcatcaua

SEQ ID NO: 60047 - DNA, 20 bp, Artificial Sequence
  Synthetic
gagagagccugcacauacgg

SEQ ID NO: 60048 - DNA, 20 bp, Artificial Sequence
  Synthetic
cugacgctcugaccaggaaa

SEQ ID NO: 60049 - DNA, 23 bp, Artificial Sequence
  Synthetic
cacccagcuctgattatccctuc

SEQ ID NO: 60050 - DNA, 21 bp, Artificial Sequence
  Synthetic
gggcaucaaggctucaaacac

SEQ ID NO: 60051 - DNA, 23 bp, Artificial Sequence
  Synthetic
tctgttugggttaccuagggact

SEQ ID NO: 60052 - DNA, 24 bp, Artificial Sequence
  Synthetic
ccctcatttcuctccaccctacut

SEQ ID NO: 60053 - DNA, 28 bp, Artificial Sequence
  Synthetic
ggatatucaaggaaattgucaaggcaga

SEQ ID NO: 60054 - DNA, 22 bp, Artificial Sequence
  Synthetic
ccagggttautttcacgccuca

SEQ ID NO: 60055 - DNA, 24 bp, Artificial Sequence
  Synthetic
ctggacttgguagctccattugat

SEQ ID NO: 60056 - DNA, 23 bp, Artificial Sequence
  Synthetic
tctccuccagggatttctaucgg

SEQ ID NO: 60057 - DNA, 26 bp, Artificial Sequence
  Synthetic
catgtttttgucagacttcagauggt

SEQ ID NO: 60058 - DNA, 20 bp, Artificial Sequence
  Synthetic
ctctucccgctaugaagcgt

SEQ ID NO: 60059 - DNA, 28 bp, Artificial Sequence
  Synthetic
aaggtaggaaaugaaagccgttauaagt

SEQ ID NO: 60060 - DNA, 21 bp, Artificial Sequence
  Synthetic
cagggtcutcatgagugcaga

SEQ ID NO: 60061 - DNA, 22 bp, Artificial Sequence
  Synthetic
agtttgcaucagctgactguga

SEQ ID NO: 60062 - DNA, 24 bp, Artificial Sequence
  Synthetic
caccatatgcacugttgtcaacuc

SEQ ID NO: 60063 - DNA, 20 bp, Artificial Sequence
  Synthetic
ggtacucagggcctuggaaa

SEQ ID NO: 60064 - DNA, 26 bp, Artificial Sequence
  Synthetic
gctatttgactuggtggatggtttug

SEQ ID NO: 60065 - DNA, 29 bp, Artificial Sequence
  Synthetic
caccttgaguaaaataaactgctucacat

SEQ ID NO: 60066 - DNA, 26 bp, Artificial Sequence
  Synthetic
tgtttttgtugctgtatgtagucggt

SEQ ID NO: 60067 - DNA, 26 bp, Artificial Sequence
  Synthetic
tgaaggtcaaauaggctgaagugaag

SEQ ID NO: 60068 - DNA, 22 bp, Artificial Sequence
  Synthetic
tggccucaaagguagcaaaagg

SEQ ID NO: 60069 - DNA, 27 bp, Artificial Sequence
  Synthetic
tgaatcgttuacaaaacacagacugga

SEQ ID NO: 60070 - DNA, 28 bp, Artificial Sequence
  Synthetic
agaagaagtaacuggctgttctctttut

SEQ ID NO: 60071 - DNA, 27 bp, Artificial Sequence
  Synthetic
gtgaagagcccaugttaagttgattut

SEQ ID NO: 60072 - DNA, 21 bp, Artificial Sequence
  Synthetic
gcttctaccugcagagctcut

SEQ ID NO: 60073 - DNA, 23 bp, Artificial Sequence
  Synthetic
agaacccagcagaagucattucc

SEQ ID NO: 60074 - DNA, 21 bp, Artificial Sequence
  Synthetic
ctttggcctugggtcattguc

SEQ ID NO: 60075 - DNA, 21 bp, Artificial Sequence
  Synthetic
ctgtacccugcactgcucaat

SEQ ID NO: 60076 - DNA, 21 bp, Artificial Sequence
  Synthetic
cctcccacaguacctcagguc

SEQ ID NO: 60077 - DNA, 19 bp, Artificial Sequence
  Synthetic
gctgauggcacccctaucc

SEQ ID NO: 60078 - DNA, 21 bp, Artificial Sequence
  Synthetic
gctggtcttuctctggcacut

SEQ ID NO: 60079 - DNA, 22 bp, Artificial Sequence
  Synthetic
cgagtctaccaugtcgatgcug

SEQ ID NO: 60080 - DNA, 22 bp, Artificial Sequence
  Synthetic
actctctgucccttgggactuc

SEQ ID NO: 60081 - DNA, 24 bp, Artificial Sequence
  Synthetic
gcccttcctugtcttcttcatcuc

SEQ ID NO: 60082 - DNA, 21 bp, Artificial Sequence
  Synthetic
gaacctcacauccagcctuct

SEQ ID NO: 60083 - DNA, 22 bp, Artificial Sequence
  Synthetic
cccagatguatgaatcgcugct

SEQ ID NO: 60084 - DNA, 20 bp, Artificial Sequence
  Synthetic
gcagacgccauaaagcugac

SEQ ID NO: 60085 - DNA, 22 bp, Artificial Sequence
  Synthetic
ggagactugggatgcttuggaa

SEQ ID NO: 60086 - DNA, 21 bp, Artificial Sequence
  Synthetic
ctactccuccaccgctaucac

SEQ ID NO: 60087 - DNA, 22 bp, Artificial Sequence
  Synthetic
agccatccutgttgaacgugaa

SEQ ID NO: 60088 - DNA, 20 bp, Artificial Sequence
  Synthetic
cgacggagggutctgguaca

SEQ ID NO: 60089 - DNA, 20 bp, Artificial Sequence
  Synthetic
cggccucagtacucccaaag

SEQ ID NO: 60090 - DNA, 23 bp, Artificial Sequence
  Synthetic
cgttgcagutcaagtccuaggat

SEQ ID NO: 60091 - DNA, 29 bp, Artificial Sequence
  Synthetic
cagacgaaaacaaaugtgaaagagtuaca

SEQ ID NO: 60092 - DNA, 23 bp, Artificial Sequence
  Synthetic
gatctacacgaugtgtgcaguca

SEQ ID NO: 60093 - DNA, 28 bp, Artificial Sequence
  Synthetic
cctccatttggcucatatgtagtaccua

SEQ ID NO: 60094 - DNA, 25 bp, Artificial Sequence
  Synthetic
caggccagagaugtgcatatuaaac

SEQ ID NO: 60095 - DNA, 28 bp, Artificial Sequence
  Synthetic
ggtctacagacaacutcaacttgtauca

SEQ ID NO: 60096 - DNA, 28 bp, Artificial Sequence
  Synthetic
ggtaagagauggaaactatagacuccca

SEQ ID NO: 60097 - DNA, 23 bp, Artificial Sequence
  Synthetic
aagagaagaugggctccaatucc

SEQ ID NO: 60098 - DNA, 28 bp, Artificial Sequence
  Synthetic
atgccagatacucttgtgatgaaaauca

SEQ ID NO: 60099 - DNA, 28 bp, Artificial Sequence
  Synthetic
ggatagagaguttaaagaugggcaacat

SEQ ID NO: 60100 - DNA, 28 bp, Artificial Sequence
  Synthetic
ctcaagttcagautcgtattttggaugt

SEQ ID NO: 60101 - DNA, 28 bp, Artificial Sequence
  Synthetic
gcgtaacttcuacgttgacttgatttuc

SEQ ID NO: 60102 - DNA, 27 bp, Artificial Sequence
  Synthetic
tctgtggattcugtcacatctgaaaut

SEQ ID NO: 60103 - DNA, 24 bp, Artificial Sequence
  Synthetic
cccggccgagautaggtttttaua

SEQ ID NO: 60104 - DNA, 20 bp, Artificial Sequence
  Synthetic
agcggtttgutccccttcuc

SEQ ID NO: 60105 - DNA, 23 bp, Artificial Sequence
  Synthetic
gcttccggaaaggaaugatgguc

SEQ ID NO: 60106 - DNA, 21 bp, Artificial Sequence
  Synthetic
ccctgttguttctcccucaga

SEQ ID NO: 60107 - DNA, 27 bp, Artificial Sequence
  Synthetic
gccttcaagggcaagutttaatgaaug

SEQ ID NO: 60108 - DNA, 20 bp, Artificial Sequence
  Synthetic
cuccugcaggcacagagaag

SEQ ID NO: 60109 - DNA, 20 bp, Artificial Sequence
  Synthetic
ccaggugcaugaaccaacag

SEQ ID NO: 60110 - DNA, 25 bp, Artificial Sequence
  Synthetic
ctcatttucagcatctctctuccct

SEQ ID NO: 60111 - DNA, 21 bp, Artificial Sequence
  Synthetic
cgaccagaaacggucagugat

SEQ ID NO: 60112 - DNA, 20 bp, Artificial Sequence
  Synthetic
gagcgaggutccctgcuaag

SEQ ID NO: 60113 - DNA, 23 bp, Artificial Sequence
  Synthetic
tcatccttguaccaggacaguga

SEQ ID NO: 60114 - DNA, 19 bp, Artificial Sequence
  Synthetic
ccagaaucggauccgggaa

SEQ ID NO: 60115 - DNA, 18 bp, Artificial Sequence
  Synthetic
ccggcaugaagcctuggt

SEQ ID NO: 60116 - DNA, 21 bp, Artificial Sequence
  Synthetic
acccccacagutcuacgaagt

SEQ ID NO: 60117 - DNA, 28 bp, Artificial Sequence
  Synthetic
gaaugtgaatacuaacaaaagcaccgat

SEQ ID NO: 60118 - DNA, 17 bp, Artificial Sequence
  Synthetic
ggaggcugctggcctua

SEQ ID NO: 60119 - DNA, 23 bp, Artificial Sequence
  Synthetic
cacaacttcugaagctgactugg

SEQ ID NO: 60120 - DNA, 17 bp, Artificial Sequence
  Synthetic
tcucuccagcccacgga

SEQ ID NO: 60121 - DNA, 20 bp, Artificial Sequence
  Synthetic
tgcagcugctcaatccucat

SEQ ID NO: 60122 - DNA, 21 bp, Artificial Sequence
  Synthetic
tcaggactguggctcaccuat

SEQ ID NO: 60123 - DNA, 19 bp, Artificial Sequence
  Synthetic
cctcaguaccctccugcac

SEQ ID NO: 60124 - DNA, 21 bp, Artificial Sequence
  Synthetic
ccaagagguctcccuggaagt

SEQ ID NO: 60125 - DNA, 19 bp, Artificial Sequence
  Synthetic
ccaccugcaggaagtggut

SEQ ID NO: 60126 - DNA, 22 bp, Artificial Sequence
  Synthetic
actctccgautccagagcugat

SEQ ID NO: 60127 - DNA, 20 bp, Artificial Sequence
  Synthetic
gcagugccacagtggtguag

SEQ ID NO: 60128 - DNA, 20 bp, Artificial Sequence
  Synthetic
ctgaccacucccctgctuac

SEQ ID NO: 60129 - DNA, 25 bp, Artificial Sequence
  Synthetic
agutaagggaugaacaaagcagacc

SEQ ID NO: 60130 - DNA, 19 bp, Artificial Sequence
  Synthetic
gccccagaagggagugtuc

SEQ ID NO: 60131 - DNA, 26 bp, Artificial Sequence
  Synthetic
gaagaactugaggatcatcuccacat

SEQ ID NO: 60132 - DNA, 20 bp, Artificial Sequence
  Synthetic
gcacctccugacctctcuct

SEQ ID NO: 60133 - DNA, 22 bp, Artificial Sequence
  Synthetic
gggagaagaaggutcaggugac

SEQ ID NO: 60134 - DNA, 22 bp, Artificial Sequence
  Synthetic
gcctccacuctgatgtctctug

SEQ ID NO: 60135 - DNA, 22 bp, Artificial Sequence
  Synthetic
aaagctaaguaccccactgcug

SEQ ID NO: 60136 - DNA, 21 bp, Artificial Sequence
  Synthetic
gagcacuacccactggaucac

SEQ ID NO: 60137 - DNA, 26 bp, Artificial Sequence
  Synthetic
gctgagtatttuagagggagcugact

SEQ ID NO: 60138 - DNA, 17 bp, Artificial Sequence
  Synthetic
cgctcggccucatggua

SEQ ID NO: 60139 - DNA, 17 bp, Artificial Sequence
  Synthetic
gctugagccgcttccug

SEQ ID NO: 60140 - DNA, 21 bp, Artificial Sequence
  Synthetic
gtttccautgcaaguccccaa

SEQ ID NO: 60141 - DNA, 20 bp, Artificial Sequence
  Synthetic
ggtggtcgugtctgctctuc

SEQ ID NO: 60142 - DNA, 19 bp, Artificial Sequence
  Synthetic
ggtgcgaugatccagucgt

SEQ ID NO: 60143 - DNA, 21 bp, Artificial Sequence
  Synthetic
ccaagaaacgggaccugtuct

SEQ ID NO: 60144 - DNA, 20 bp, Artificial Sequence
  Synthetic
gccaugccgaggtatacgug

SEQ ID NO: 60145 - DNA, 25 bp, Artificial Sequence
  Synthetic
agttgcctgauctttttgcttcuct

SEQ ID NO: 60146 - DNA, 26 bp, Artificial Sequence
  Synthetic
tttgctgtcuaaagaaagactcggut

SEQ ID NO: 60147 - DNA, 20 bp, Artificial Sequence
  Synthetic
acuggagagagaccctucgt

SEQ ID NO: 60148 - DNA, 18 bp, Artificial Sequence
  Synthetic
cctcgaggaucccgcgua

SEQ ID NO: 60149 - DNA, 18 bp, Artificial Sequence
  Synthetic
ccgatgcucgcaccaugt

SEQ ID NO: 60150 - DNA, 20 bp, Artificial Sequence
  Synthetic
ggtggttcuctctgtggcut

SEQ ID NO: 60151 - DNA, 28 bp, Artificial Sequence
  Synthetic
tccttcccugaaatgtgtttaatugact

SEQ ID NO: 60152 - DNA, 23 bp, Artificial Sequence
  Synthetic
gtgtcattaauccaccccucacc

SEQ ID NO: 60153 - DNA, 23 bp, Artificial Sequence
  Synthetic
gtcgtgcuatgtcgtugaaaacc

SEQ ID NO: 60154 - DNA, 23 bp, Artificial Sequence
  Synthetic
tgtctgtuggagaccagauggat

SEQ ID NO: 60155 - DNA, 21 bp, Artificial Sequence
  Synthetic
tccucattcttcuggcacagg

SEQ ID NO: 60156 - DNA, 17 bp, Artificial Sequence
  Synthetic
gagguggcactccugct

SEQ ID NO: 60157 - DNA, 17 bp, Artificial Sequence
  Synthetic
gcaccggcaugcaugga

SEQ ID NO: 60158 - DNA, 19 bp, Artificial Sequence
  Synthetic
cagcagggcutcccatgua

SEQ ID NO: 60159 - DNA, 24 bp, Artificial Sequence
  Synthetic
tggcctgttaautctggcatacuc

SEQ ID NO: 60160 - DNA, 21 bp, Artificial Sequence
  Synthetic
gagaggacuggctggagttug

SEQ ID NO: 60161 - DNA, 22 bp, Artificial Sequence
  Synthetic
tcttgtgccutgaaacucacct

SEQ ID NO: 60162 - DNA, 19 bp, Artificial Sequence
  Synthetic
ctaccccucagctccggua

SEQ ID NO: 60163 - DNA, 17 bp, Artificial Sequence
  Synthetic
aggugcgagcgcaaaug

SEQ ID NO: 60164 - DNA, 20 bp, Artificial Sequence
  Synthetic
gccaaggauctgggaucagg

SEQ ID NO: 60165 - DNA, 21 bp, Artificial Sequence
  Synthetic
ccttgauggcgaactgaguga

SEQ ID NO: 60166 - DNA, 24 bp, Artificial Sequence
  Synthetic
gccatgatgugatacagcaggaug

SEQ ID NO: 60167 - DNA, 25 bp, Artificial Sequence
  Synthetic
cctctgtgtacautttcctgaccut

SEQ ID NO: 60168 - DNA, 26 bp, Artificial Sequence
  Synthetic
agtgataatgtutggatgctguccat

SEQ ID NO: 60169 - DNA, 28 bp, Artificial Sequence
  Synthetic
gaggtaatacccaagguctgtagctaua

SEQ ID NO: 60170 - DNA, 21 bp, Artificial Sequence
  Synthetic
aaaaccaugcgggaaucagga

SEQ ID NO: 60171 - DNA, 27 bp, Artificial Sequence
  Synthetic
tctgcacctttugtaaagtctgtctut

SEQ ID NO: 60172 - DNA, 20 bp, Artificial Sequence
  Synthetic
tcattgacguggctcacgut

SEQ ID NO: 60173 - DNA, 22 bp, Artificial Sequence
  Synthetic
ggcacugcacccuaaagagaat

SEQ ID NO: 60174 - DNA, 26 bp, Artificial Sequence
  Synthetic
gtaatttccaucaccctucagaacct

SEQ ID NO: 60175 - DNA, 28 bp, Artificial Sequence
  Synthetic
ggcggcgutttcattatgatauaaagat

SEQ ID NO: 60176 - DNA, 26 bp, Artificial Sequence
  Synthetic
agttgtctccuctttgcaacaatuct

SEQ ID NO: 60177 - DNA, 26 bp, Artificial Sequence
  Synthetic
tguaaaagaaaggctaugagcacagt

SEQ ID NO: 60178 - DNA, 21 bp, Artificial Sequence
  Synthetic
gcgtccaccutgtctgcaaua

SEQ ID NO: 60179 - DNA, 28 bp, Artificial Sequence
  Synthetic
gcaggatuacagaaaagctaucaagagt

SEQ ID NO: 60180 - DNA, 25 bp, Artificial Sequence
  Synthetic
agcaaatcgccaucctttguaaaag

SEQ ID NO: 60181 - DNA, 21 bp, Artificial Sequence
  Synthetic
cagctggutgagcattgucaa

SEQ ID NO: 60182 - DNA, 21 bp, Artificial Sequence
  Synthetic
ggaacatggguccttgtccut

SEQ ID NO: 60183 - DNA, 28 bp, Artificial Sequence
  Synthetic
agggtattaagcuaaacttgccttacug

SEQ ID NO: 60184 - DNA, 22 bp, Artificial Sequence
  Synthetic
ccccgtgucttttacagcuagt

SEQ ID NO: 60185 - DNA, 24 bp, Artificial Sequence
  Synthetic
gatgctgtgcutgattgtctctuc

SEQ ID NO: 60186 - DNA, 28 bp, Artificial Sequence
  Synthetic
aaactatgttgucagtttctggtcugaa

SEQ ID NO: 60187 - DNA, 28 bp, Artificial Sequence
  Synthetic
ggaagtgtgctutgttaaattgagtgua

SEQ ID NO: 60188 - DNA, 28 bp, Artificial Sequence
  Synthetic
acattacaatacacutggtgactgugaa

SEQ ID NO: 60189 - DNA, 26 bp, Artificial Sequence
  Synthetic
ccagaaccacaugagtcagaatcauc

SEQ ID NO: 60190 - DNA, 28 bp, Artificial Sequence
  Synthetic
ggaggttatcuacattgtatccctcugt

SEQ ID NO: 60191 - DNA, 27 bp, Artificial Sequence
  Synthetic
tttattucagacacacatcaugagcct

SEQ ID NO: 60192 - DNA, 28 bp, Artificial Sequence
  Synthetic
gaaatgtgaugcccttaccaattuaact

SEQ ID NO: 60193 - DNA, 27 bp, Artificial Sequence
  Synthetic
ggccttatgtauacttttggagauggt

SEQ ID NO: 60194 - DNA, 22 bp, Artificial Sequence
  Synthetic
ggaaactcuaacttgcccucct

SEQ ID NO: 60195 - DNA, 21 bp, Artificial Sequence
  Synthetic
cacagggcagcaaguaacuca

SEQ ID NO: 60196 - DNA, 22 bp, Artificial Sequence
  Synthetic
ttgaagtattgcucccccagug

SEQ ID NO: 60197 - DNA, 24 bp, Artificial Sequence
  Synthetic
tcatagacacccacuttcccucat

SEQ ID NO: 60198 - DNA, 21 bp, Artificial Sequence
  Synthetic
ggtccuggagcugaacaacaa

SEQ ID NO: 60199 - DNA, 24 bp, Artificial Sequence
  Synthetic
gttcctcttccutccaaccttuct

SEQ ID NO: 60200 - DNA, 23 bp, Artificial Sequence
  Synthetic
gggtaaccauggtgaatgagtug

SEQ ID NO: 60201 - DNA, 22 bp, Artificial Sequence
  Synthetic
ctgagaguaccaggctaguggt

SEQ ID NO: 60202 - DNA, 21 bp, Artificial Sequence
  Synthetic
gagaggaggcautccatucca

SEQ ID NO: 60203 - DNA, 25 bp, Artificial Sequence
  Synthetic
ggautgggaatuaagaggaaagggt

SEQ ID NO: 60204 - DNA, 22 bp, Artificial Sequence
  Synthetic
tggtgtgggagucgtaggttua

SEQ ID NO: 60205 - DNA, 20 bp, Artificial Sequence
  Synthetic
agtaggtggcuagcctccuc

SEQ ID NO: 60206 - DNA, 21 bp, Artificial Sequence
  Synthetic
gagugcucggagaaagaggaa

SEQ ID NO: 60207 - DNA, 28 bp, Artificial Sequence
  Synthetic
ctcataggcctuaatctcaggtctcuat

SEQ ID NO: 60208 - DNA, 23 bp, Artificial Sequence
  Synthetic
ggcaggttttuatttaccgccut

SEQ ID NO: 60209 - DNA, 27 bp, Artificial Sequence
  Synthetic
aggcagacaaauaactagucacaacag

SEQ ID NO: 60210 - DNA, 21 bp, Artificial Sequence
  Synthetic
ccaggctguggtattagcugt

SEQ ID NO: 60211 - DNA, 28 bp, Artificial Sequence
  Synthetic
tgccccauaattggtacuacaaagaaaa

SEQ ID NO: 60212 - DNA, 26 bp, Artificial Sequence
  Synthetic
actgtactgaauggcgaagacaauaa

SEQ ID NO: 60213 - DNA, 30 bp, Artificial Sequence
  Synthetic
cttgcctcugagagatttttaatactauga

SEQ ID NO: 60214 - DNA, 22 bp, Artificial Sequence
  Synthetic
agcttcugtggagttugcagat

SEQ ID NO: 60215 - DNA, 27 bp, Artificial Sequence
  Synthetic
cataagcaaaacguacactgaactuga

SEQ ID NO: 60216 - DNA, 25 bp, Artificial Sequence
  Synthetic
aatctggcatguttcaaaatggcut

SEQ ID NO: 60217 - DNA, 28 bp, Artificial Sequence
  Synthetic
ctgcttcttttgutaattcctgtgtuca

SEQ ID NO: 60218 - DNA, 26 bp, Artificial Sequence
  Synthetic
gggtaaacuggagagaagaaaatgut

SEQ ID NO: 60219 - DNA, 23 bp, Artificial Sequence
  Synthetic
ggaacccaacuctcctttgucac

SEQ ID NO: 60220 - DNA, 25 bp, Artificial Sequence
  Synthetic
gttgtgaugatgagatguggaggaa

SEQ ID NO: 60221 - DNA, 21 bp, Artificial Sequence
  Synthetic
cagcccacuctttugagcaag

SEQ ID NO: 60222 - DNA, 24 bp, Artificial Sequence
  Synthetic
gggttgggaguaagagauagagag

SEQ ID NO: 60223 - DNA, 23 bp, Artificial Sequence
  Synthetic
actgttagtcaugtgggcatgug

SEQ ID NO: 60224 - DNA, 21 bp, Artificial Sequence
  Synthetic
gcaacatgaaugcccccaaug

SEQ ID NO: 60225 - DNA, 28 bp, Artificial Sequence
  Synthetic
caaaccaccttgutatcagcactattut

SEQ ID NO: 60226 - DNA, 22 bp, Artificial Sequence
  Synthetic
agaaaggacuggctgacgttut

SEQ ID NO: 60227 - DNA, 26 bp, Artificial Sequence
  Synthetic
cttcatggctucatttcttgcactua

SEQ ID NO: 60228 - DNA, 19 bp, Artificial Sequence
  Synthetic
ggcacctguggtcgagtug

SEQ ID NO: 60229 - DNA, 19 bp, Artificial Sequence
  Synthetic
cutcatgggtucccgacga

SEQ ID NO: 60230 - DNA, 25 bp, Artificial Sequence
  Synthetic
ctagtggctugtattcctagtugct

SEQ ID NO: 60231 - DNA, 27 bp, Artificial Sequence
  Synthetic
gttatgcaaatctuatgtcagcagguc

SEQ ID NO: 60232 - DNA, 25 bp, Artificial Sequence
  Synthetic
agtttcagucccagtttttcaugct

SEQ ID NO: 60233 - DNA, 28 bp, Artificial Sequence
  Synthetic
gactacatacattutggcaagcctaaug

SEQ ID NO: 60234 - DNA, 21 bp, Artificial Sequence
  Synthetic
tacggtggugtgctcuacaag

SEQ ID NO: 60235 - DNA, 21 bp, Artificial Sequence
  Synthetic
tcctgaggugctgactctuca

SEQ ID NO: 60236 - DNA, 21 bp, Artificial Sequence
  Synthetic
cgtgtaggagcuctggttgua

SEQ ID NO: 60237 - DNA, 25 bp, Artificial Sequence
  Synthetic
tgcaacttcaggutccatatctugt

SEQ ID NO: 60238 - DNA, 24 bp, Artificial Sequence
  Synthetic
ggcagtaacccuaaaggtgtagug

SEQ ID NO: 60239 - DNA, 25 bp, Artificial Sequence
  Synthetic
tcactccattgucggttcatttcut

SEQ ID NO: 60240 - DNA, 21 bp, Artificial Sequence
  Synthetic
cagcutattgcuggcaaagca

SEQ ID NO: 60241 - DNA, 23 bp, Artificial Sequence
  Synthetic
guccactucaaacccaaggaaga

SEQ ID NO: 60242 - DNA, 19 bp, Artificial Sequence
  Synthetic
ggtcgaggucgcagaccua

SEQ ID NO: 60243 - DNA, 20 bp, Artificial Sequence
  Synthetic
cacucactgguccagaagca

SEQ ID NO: 60244 - DNA, 22 bp, Artificial Sequence
  Synthetic
gctgtcccucattcccugagat

SEQ ID NO: 60245 - DNA, 20 bp, Artificial Sequence
  Synthetic
caggaggagggcaaaucugg

SEQ ID NO: 60246 - DNA, 24 bp, Artificial Sequence
  Synthetic
cttuaccaaaagcccgtgtuaagg

SEQ ID NO: 60247 - DNA, 23 bp, Artificial Sequence
  Synthetic
accuacctgtcugcgaagagaat

SEQ ID NO: 60248 - DNA, 21 bp, Artificial Sequence
  Synthetic
ccaactgggucccttctcuct

SEQ ID NO: 60249 - DNA, 20 bp, Artificial Sequence
  Synthetic
cctggagcccuaaccttugg

SEQ ID NO: 60250 - DNA, 24 bp, Artificial Sequence
  Synthetic
ggaaacaaguaaaggccucagact

SEQ ID NO: 60251 - DNA, 17 bp, Artificial Sequence
  Synthetic
gctccgagccaugcauc

SEQ ID NO: 60252 - DNA, 24 bp, Artificial Sequence
  Synthetic
gtccagaaaaggaugggatucaga

SEQ ID NO: 60253 - DNA, 28 bp, Artificial Sequence
  Synthetic
acagaattgcacauttcactgaaaacut

SEQ ID NO: 60254 - DNA, 21 bp, Artificial Sequence
  Synthetic
agctcatcutcgtcacaugcc

SEQ ID NO: 60255 - DNA, 23 bp, Artificial Sequence
  Synthetic
agcagguagaggaagaggaacuc

SEQ ID NO: 60256 - DNA, 25 bp, Artificial Sequence
  Synthetic
gctatgaaatcagucagcaacccut

SEQ ID NO: 60257 - DNA, 28 bp, Artificial Sequence
  Synthetic
ctcatgagttuccatcattgtgtttugt

SEQ ID NO: 60258 - DNA, 21 bp, Artificial Sequence
  Synthetic
gcatcuggcaccuccaacaat

SEQ ID NO: 60259 - DNA, 18 bp, Artificial Sequence
  Synthetic
gccctcgaucggacucag

SEQ ID NO: 60260 - DNA, 23 bp, Artificial Sequence
  Synthetic
caagagacccagcacutggttua

SEQ ID NO: 60261 - DNA, 28 bp, Artificial Sequence
  Synthetic
cttctccaaauggcatttctttctctuc

SEQ ID NO: 60262 - DNA, 21 bp, Artificial Sequence
  Synthetic
cctcttgguctggtcctucag

SEQ ID NO: 60263 - DNA, 22 bp, Artificial Sequence
  Synthetic
tgaacaaauccaagcaccucca

SEQ ID NO: 60264 - DNA, 26 bp, Artificial Sequence
  Synthetic
aattactaccaucaggctacucacct

SEQ ID NO: 60265 - DNA, 28 bp, Artificial Sequence
  Synthetic
agactgtgcctaugtgtgtatataccua

SEQ ID NO: 60266 - DNA, 24 bp, Artificial Sequence
  Synthetic
gauttccacaaatuggagaagcgt

SEQ ID NO: 60267 - DNA, 26 bp, Artificial Sequence
  Synthetic
ttgagctcugaacaagtgaaggttua

SEQ ID NO: 60268 - DNA, 28 bp, Artificial Sequence
  Synthetic
gaaaagatcutactcaccauaggaccag

SEQ ID NO: 60269 - DNA, 25 bp, Artificial Sequence
  Synthetic
tgtagatgtccuccatatgguggaa

SEQ ID NO: 60270 - DNA, 27 bp, Artificial Sequence
  Synthetic
gtttcatttgaugtacgaaagcugcat

SEQ ID NO: 60271 - DNA, 24 bp, Artificial Sequence
  Synthetic
tccutagggattucaaggcaagac

SEQ ID NO: 60272 - DNA, 32 bp, Artificial Sequence
  Synthetic
actggtgtacatttuctctatacttactcugt

SEQ ID NO: 60273 - DNA, 27 bp, Artificial Sequence
  Synthetic
cacaactaccaugcacatttcucaaaa

SEQ ID NO: 60274 - DNA, 25 bp, Artificial Sequence
  Synthetic
tcgtggcucataagcaatttuacca

SEQ ID NO: 60275 - DNA, 27 bp, Artificial Sequence
  Synthetic
tggtcttacagacauttaggctgttut

SEQ ID NO: 60276 - DNA, 24 bp, Artificial Sequence
  Synthetic
tttggugaccacaaggtattuggt

SEQ ID NO: 60277 - DNA, 19 bp, Artificial Sequence
  Synthetic
acaacucagugccccaaca

SEQ ID NO: 60278 - DNA, 21 bp, Artificial Sequence
  Synthetic
ccttcgccugtcctcatguat

SEQ ID NO: 60279 - DNA, 28 bp, Artificial Sequence
  Synthetic
gcattgcattcccugtggtttttaauaa

SEQ ID NO: 60280 - DNA, 21 bp, Artificial Sequence
  Synthetic
ccactgccutgactcacucac

SEQ ID NO: 60281 - DNA, 22 bp, Artificial Sequence
  Synthetic
gggcttgcutttcagtcatucc

SEQ ID NO: 60282 - DNA, 26 bp, Artificial Sequence
  Synthetic
tgactcaaacugccatgtatttcuca

SEQ ID NO: 60283 - DNA, 20 bp, Artificial Sequence
  Synthetic
acgagagucacccgaguacc

SEQ ID NO: 60284 - DNA, 20 bp, Artificial Sequence
  Synthetic
gctgacgggugcaaacaauc

SEQ ID NO: 60285 - DNA, 28 bp, Artificial Sequence
  Synthetic
tgcagccaaauggaaaagttttgtatua

SEQ ID NO: 60286 - DNA, 27 bp, Artificial Sequence
  Synthetic
tcugttcatatttauccaggagaccga

SEQ ID NO: 60287 - DNA, 27 bp, Artificial Sequence
  Synthetic
caacaccagaagaaauctatccuccat

SEQ ID NO: 60288 - DNA, 26 bp, Artificial Sequence
  Synthetic
gaaaagcaagtutccattacgacuca

SEQ ID NO: 60289 - DNA, 27 bp, Artificial Sequence
  Synthetic
gatggtgtgacutttgatacactgtut

SEQ ID NO: 60290 - DNA, 28 bp, Artificial Sequence
  Synthetic
agcctgatgccuaatagcaattattuca

SEQ ID NO: 60291 - DNA, 27 bp, Artificial Sequence
  Synthetic
atgtatgcatgcutgtatcaggaucat

SEQ ID NO: 60292 - DNA, 26 bp, Artificial Sequence
  Synthetic
aaaaggaatgucattgtgcacugaaa

SEQ ID NO: 60293 - DNA, 21 bp, Artificial Sequence
  Synthetic
gtgtgagccucacagguacaa

SEQ ID NO: 60294 - DNA, 27 bp, Artificial Sequence
  Synthetic
agtgaattcagcauttatccttucggt

SEQ ID NO: 60295 - DNA, 27 bp, Artificial Sequence
  Synthetic
aggtattgcttgguaaacagagactuc

SEQ ID NO: 60296 - DNA, 28 bp, Artificial Sequence
  Synthetic
acgcagguaataattcagtttucagaca

SEQ ID NO: 60297 - DNA, 25 bp, Artificial Sequence
  Synthetic
ccgtctctcuagtcatgaagucgat

SEQ ID NO: 60298 - DNA, 25 bp, Artificial Sequence
  Synthetic
ctttccttacaugtgattcccguct

SEQ ID NO: 60299 - DNA, 22 bp, Artificial Sequence
  Synthetic
gttgcutcagctgucacaaagg

SEQ ID NO: 60300 - DNA, 26 bp, Artificial Sequence
  Synthetic
tgtgattgagaccucaacgtaugaac

SEQ ID NO: 60301 - DNA, 26 bp, Artificial Sequence
  Synthetic
atttactuaccaagaccaacacugct

SEQ ID NO: 60302 - DNA, 24 bp, Artificial Sequence
  Synthetic
gtctaagggcuatccagacatugg

SEQ ID NO: 60303 - DNA, 26 bp, Artificial Sequence
  Synthetic
cttccttcaugaaagtgctgagauga

SEQ ID NO: 60304 - DNA, 27 bp, Artificial Sequence
  Synthetic
agaaagccattucattgaaaactgugt

SEQ ID NO: 60305 - DNA, 23 bp, Artificial Sequence
  Synthetic
atcccauagaccctgucaaggaa

SEQ ID NO: 60306 - DNA, 28 bp, Artificial Sequence
  Synthetic
tcattaacaaataugcagaacacuccca

SEQ ID NO: 60307 - DNA, 28 bp, Artificial Sequence
  Synthetic
ctgtcatggucagaaatattugaacagt

SEQ ID NO: 60308 - DNA, 26 bp, Artificial Sequence
  Synthetic
ttctagaauggaaagcctgtttuggt

SEQ ID NO: 60309 - DNA, 23 bp, Artificial Sequence
  Synthetic
cacugaguagaacccccaagaag

SEQ ID NO: 60310 - DNA, 27 bp, Artificial Sequence
  Synthetic
tttgccttuggagttcttagaaugact

SEQ ID NO: 60311 - DNA, 28 bp, Artificial Sequence
  Synthetic
cgtattgtttcaacauaccaacccttut

SEQ ID NO: 60312 - DNA, 28 bp, Artificial Sequence
  Synthetic
tcgtttttagccuttgctattagtccut

SEQ ID NO: 60313 - DNA, 23 bp, Artificial Sequence
  Synthetic
ggcttgtcacuttggcatttuca

SEQ ID NO: 60314 - DNA, 24 bp, Artificial Sequence
  Synthetic
ccaagtcttgucccattgaatgug

SEQ ID NO: 60315 - DNA, 28 bp, Artificial Sequence
  Synthetic
aactcccacagucttatctaaucagagt

SEQ ID NO: 60316 - DNA, 20 bp, Artificial Sequence
  Synthetic
tgtgggutgccuaggaggaa

SEQ ID NO: 60317 - DNA, 31 bp, Artificial Sequence
  Synthetic
tgtttgaaaaccccaacutaattcttauagt

SEQ ID NO: 60318 - DNA, 23 bp, Artificial Sequence
  Synthetic
tgaaggccucacttctaggaugt

SEQ ID NO: 60319 - DNA, 26 bp, Artificial Sequence
  Synthetic
tttcttgtttccuttcacaggcaaug

SEQ ID NO: 60320 - DNA, 25 bp, Artificial Sequence
  Synthetic
gcttttatgcagacutttcggguat

SEQ ID NO: 60321 - DNA, 26 bp, Artificial Sequence
  Synthetic
gcctcacugaattaatgtgtttuccc

SEQ ID NO: 60322 - DNA, 24 bp, Artificial Sequence
  Synthetic
aacaccaaggaaaaugagggacut

SEQ ID NO: 60323 - DNA, 27 bp, Artificial Sequence
  Synthetic
aactgtccaaagutggaatcatcugat

SEQ ID NO: 60324 - DNA, 27 bp, Artificial Sequence
  Synthetic
tccattatgtttguggcatatcctucc

SEQ ID NO: 60325 - DNA, 23 bp, Artificial Sequence
  Synthetic
gctaacccaaauccatcguaggt

SEQ ID NO: 60326 - DNA, 27 bp, Artificial Sequence
  Synthetic
ttggctaatguatttgaagtaauccga

SEQ ID NO: 60327 - DNA, 27 bp, Artificial Sequence
  Synthetic
tgaaucccaaaactttgaucacagaca

SEQ ID NO: 60328 - DNA, 24 bp, Artificial Sequence
  Synthetic
ggacatucacatgtgttucagcaa

SEQ ID NO: 60329 - DNA, 28 bp, Artificial Sequence
  Synthetic
accttcattccautactgggattttuca

SEQ ID NO: 60330 - DNA, 21 bp, Artificial Sequence
  Synthetic
ccaagcatgcugagggtctuc

SEQ ID NO: 60331 - DNA, 22 bp, Artificial Sequence
  Synthetic
tgtctctcagcuctaggtgcuc

SEQ ID NO: 60332 - DNA, 21 bp, Artificial Sequence
  Synthetic
ccaagcugaagcacaggtcuc

SEQ ID NO: 60333 - DNA, 21 bp, Artificial Sequence
  Synthetic
acutgtcccugcagacacaac

SEQ ID NO: 60334 - DNA, 24 bp, Artificial Sequence
  Synthetic
acagucagggtttuagaggagaga

SEQ ID NO: 60335 - DNA, 20 bp, Artificial Sequence
  Synthetic
gaaaguccccucccgagaga

SEQ ID NO: 60336 - DNA, 25 bp, Artificial Sequence
  Synthetic
gtggctgggaagutagaatgtttuc

SEQ ID NO: 60337 - DNA, 26 bp, Artificial Sequence
  Synthetic
gtctgtctttugcttgtgttctucaa

SEQ ID NO: 60338 - DNA, 22 bp, Artificial Sequence
  Synthetic
caaggttaucagacctggguca

SEQ ID NO: 60339 - DNA, 19 bp, Artificial Sequence
  Synthetic
ccagatugagcggcccaut

SEQ ID NO: 60340 - DNA, 28 bp, Artificial Sequence
  Synthetic
gcattcttaccacuttgctgtatucact

SEQ ID NO: 60341 - DNA, 25 bp, Artificial Sequence
  Synthetic
catttattcacaaucccagccucac

SEQ ID NO: 60342 - DNA, 23 bp, Artificial Sequence
  Synthetic
cactgcaatcuggaggttgttug

SEQ ID NO: 60343 - DNA, 24 bp, Artificial Sequence
  Synthetic
tctccctattuctctacccccuct

SEQ ID NO: 60344 - DNA, 18 bp, Artificial Sequence
  Synthetic
caccgugggagcguacag

SEQ ID NO: 60345 - DNA, 24 bp, Artificial Sequence
  Synthetic
tttgcttttagcuccgagtctuca

SEQ ID NO: 60346 - DNA, 23 bp, Artificial Sequence
  Synthetic
cactcactatccuctcccgagut

SEQ ID NO: 60347 - DNA, 26 bp, Artificial Sequence
  Synthetic
ggagatgcugagaaattgtcgaaauc

SEQ ID NO: 60348 - DNA, 21 bp, Artificial Sequence
  Synthetic
cctccagcacuttagccucaa

SEQ ID NO: 60349 - DNA, 19 bp, Artificial Sequence
  Synthetic
agtgagccgacucgcttuc

SEQ ID NO: 60350 - DNA, 28 bp, Artificial Sequence
  Synthetic
cttattagggaagucaaggagaaagugg

SEQ ID NO: 60351 - DNA, 25 bp, Artificial Sequence
  Synthetic
atgcttugaagaggagactgagtut

SEQ ID NO: 60352 - DNA, 26 bp, Artificial Sequence
  Synthetic
aacctagtggccugattcaaaaugat

SEQ ID NO: 60353 - DNA, 23 bp, Artificial Sequence
  Synthetic
ctaggtgaauggaatgctgugga

SEQ ID NO: 60354 - DNA, 26 bp, Artificial Sequence
  Synthetic
tccctacaaaucctgagagttacucc

SEQ ID NO: 60355 - DNA, 28 bp, Artificial Sequence
  Synthetic
gcaggactgucccatatgacatauagat

SEQ ID NO: 60356 - DNA, 28 bp, Artificial Sequence
  Synthetic
agaaagatattcuggcattgtgatguca

SEQ ID NO: 60357 - DNA, 28 bp, Artificial Sequence
  Synthetic
gctgtgtttcugaaaattggaagatugt

SEQ ID NO: 60358 - DNA, 21 bp, Artificial Sequence
  Synthetic
ggccaggcacutaagaccaua

SEQ ID NO: 60359 - DNA, 22 bp, Artificial Sequence
  Synthetic
ggaatucggcgttgaaatuggg

SEQ ID NO: 60360 - DNA, 22 bp, Artificial Sequence
  Synthetic
aggtcttugaagaccccuccat

SEQ ID NO: 60361 - DNA, 27 bp, Artificial Sequence
  Synthetic
ctttggcaggautaagctagggtauaa

SEQ ID NO: 60362 - DNA, 24 bp, Artificial Sequence
  Synthetic
ctattgcaguttctggcauagcaa

SEQ ID NO: 60363 - DNA, 28 bp, Artificial Sequence
  Synthetic
gaagcaagtucctgtggagtauaaagat

SEQ ID NO: 60364 - DNA, 24 bp, Artificial Sequence
  Synthetic
ccattuccaaagctcugagcagaa

SEQ ID NO: 60365 - DNA, 26 bp, Artificial Sequence
  Synthetic
agtactccctucccccagtattuaat

SEQ ID NO: 60366 - DNA, 22 bp, Artificial Sequence
  Synthetic
gcgctctauacggatgcttuca

SEQ ID NO: 60367 - DNA, 23 bp, Artificial Sequence
  Synthetic
acatatggaauccaggagcccut

SEQ ID NO: 60368 - DNA, 21 bp, Artificial Sequence
  Synthetic
catttggctcugtgcccttug

SEQ ID NO: 60369 - DNA, 22 bp, Artificial Sequence
  Synthetic
ggttggguggattgtgtgttug

SEQ ID NO: 60370 - DNA, 19 bp, Artificial Sequence
  Synthetic
cagaccgcguccttgagua

SEQ ID NO: 60371 - DNA, 20 bp, Artificial Sequence
  Synthetic
ggaccgucccagaggatuca

SEQ ID NO: 60372 - DNA, 20 bp, Artificial Sequence
  Synthetic
caccggugtggctcttuaac

SEQ ID NO: 60373 - DNA, 28 bp, Artificial Sequence
  Synthetic
cctgtactuaccacaacaaccttatcut

SEQ ID NO: 60374 - DNA, 22 bp, Artificial Sequence
  Synthetic
ggagaaugaaggaaggctggug

SEQ ID NO: 60375 - DNA, 24 bp, Artificial Sequence
  Synthetic
tucaaatccucagccagacaacat

SEQ ID NO: 60376 - DNA, 22 bp, Artificial Sequence
  Synthetic
catgaacccacutccugacagt

SEQ ID NO: 60377 - DNA, 25 bp, Artificial Sequence
  Synthetic
gcggtagcaguagaagatgatgaug

SEQ ID NO: 60378 - DNA, 20 bp, Artificial Sequence
  Synthetic
ctgcugagcccaccttcaua

SEQ ID NO: 60379 - DNA, 23 bp, Artificial Sequence
  Synthetic
ccatcuagagggattcagugggt

SEQ ID NO: 60380 - DNA, 22 bp, Artificial Sequence
  Synthetic
cctccaagaucagcaccctcua

SEQ ID NO: 60381 - DNA, 21 bp, Artificial Sequence
  Synthetic
cagaggccuggactacatcuc

SEQ ID NO: 60382 - DNA, 28 bp, Artificial Sequence
  Synthetic
gtttgtatacatutcggcatccaucaac

SEQ ID NO: 60383 - DNA, 27 bp, Artificial Sequence
  Synthetic
cacacctcttcuacgatgtttccuaac

SEQ ID NO: 60384 - DNA, 24 bp, Artificial Sequence
  Synthetic
agctgcaaagaagcutgtgattug

SEQ ID NO: 60385 - DNA, 28 bp, Artificial Sequence
  Synthetic
acgaccaaagcutctagattgtttguaa

SEQ ID NO: 60386 - DNA, 27 bp, Artificial Sequence
  Synthetic
actcaagactucctcctaaattuccct

SEQ ID NO: 60387 - DNA, 28 bp, Artificial Sequence
  Synthetic
gctgtataucccaccaaagcagaauaaa

SEQ ID NO: 60388 - DNA, 26 bp, Artificial Sequence
  Synthetic
agtataaaccaccaucagcacatcug

SEQ ID NO: 60389 - DNA, 29 bp, Artificial Sequence
  Synthetic
tcttcaaagguataagcagttuagccaaa

SEQ ID NO: 60390 - DNA, 22 bp, Artificial Sequence
  Synthetic
ggattctccugttagcagccut

SEQ ID NO: 60391 - DNA, 23 bp, Artificial Sequence
  Synthetic
cagaagactuccagctccaucac

SEQ ID NO: 60392 - DNA, 26 bp, Artificial Sequence
  Synthetic
cacccaaaauaaaacaacatccucca

SEQ ID NO: 60393 - DNA, 28 bp, Artificial Sequence
  Synthetic
agggaaattttggugtatacagcatuct

SEQ ID NO: 60394 - DNA, 22 bp, Artificial Sequence
  Synthetic
ggctccutctttgaugcagagg

SEQ ID NO: 60395 - DNA, 21 bp, Artificial Sequence
  Synthetic
cugatgccugaagggaagaca

SEQ ID NO: 60396 - DNA, 25 bp, Artificial Sequence
  Synthetic
gctactactagcacuagatggccua

SEQ ID NO: 60397 - DNA, 27 bp, Artificial Sequence
  Synthetic
ccttttgccaauaatgagagggtcuat

SEQ ID NO: 60398 - DNA, 25 bp, Artificial Sequence
  Synthetic
gcugaacatuacaaggaccaaacaa

SEQ ID NO: 60399 - DNA, 28 bp, Artificial Sequence
  Synthetic
aaggtgatgttugcaaaaccactuaaat

SEQ ID NO: 60400 - DNA, 20 bp, Artificial Sequence
  Synthetic
ctgtacgtgcuggtggagua

SEQ ID NO: 60401 - DNA, 20 bp, Artificial Sequence
  Synthetic
acaggacaccaggucctuga

SEQ ID NO: 60402 - DNA, 28 bp, Artificial Sequence
  Synthetic
ttttcttcttcaacugtatcccttuggt

SEQ ID NO: 60403 - DNA, 27 bp, Artificial Sequence
  Synthetic
acctgtcacaauactgagagtgattug

SEQ ID NO: 60404 - DNA, 24 bp, Artificial Sequence
  Synthetic
agctggtuaagaagatccuaggca

SEQ ID NO: 60405 - DNA, 25 bp, Artificial Sequence
  Synthetic
tcagaactctcuacgaacacaguca

SEQ ID NO: 60406 - DNA, 24 bp, Artificial Sequence
  Synthetic
aggacucagagacctctacugaga

SEQ ID NO: 60407 - DNA, 21 bp, Artificial Sequence
  Synthetic
tgtgggcugaacuaccaaagg

SEQ ID NO: 60408 - DNA, 25 bp, Artificial Sequence
  Synthetic
tgcatatctcutttgtctgtuggct

SEQ ID NO: 60409 - DNA, 28 bp, Artificial Sequence
  Synthetic
atgagatgaacaauatccattcggtuga

SEQ ID NO: 60410 - DNA, 20 bp, Artificial Sequence
  Synthetic
aattucccacagggtugcca

SEQ ID NO: 60411 - DNA, 20 bp, Artificial Sequence
  Synthetic
aaggaccgucugccagaaag

SEQ ID NO: 60412 - DNA, 25 bp, Artificial Sequence
  Synthetic
ccttttaagagcaccuttccgaugt

SEQ ID NO: 60413 - DNA, 28 bp, Artificial Sequence
  Synthetic
tttgctctttaucagaaagtccttcugt

SEQ ID NO: 60414 - DNA, 21 bp, Artificial Sequence
  Synthetic
ggccaacgugatccgttacut

SEQ ID NO: 60415 - DNA, 22 bp, Artificial Sequence
  Synthetic
ccaacctggucctagcaaaguc

SEQ ID NO: 60416 - DNA, 26 bp, Artificial Sequence
  Synthetic
ctgctaguaccaaaaagagacaguca

SEQ ID NO: 60417 - DNA, 21 bp, Artificial Sequence
  Synthetic
ggttttcaauggccgaccuca

SEQ ID NO: 60418 - DNA, 21 bp, Artificial Sequence
  Synthetic
gactttttaccugggcgaugg

SEQ ID NO: 60419 - DNA, 21 bp, Artificial Sequence
  Synthetic
agattgtugggtggcaugaca

SEQ ID NO: 60420 - DNA, 22 bp, Artificial Sequence
  Synthetic
agatcttgccutgagtctgugg

SEQ ID NO: 60421 - DNA, 22 bp, Artificial Sequence
  Synthetic
aatgacuggcggaaggaaauga

SEQ ID NO: 60422 - DNA, 21 bp, Artificial Sequence
  Synthetic
gccauagctttcguccaggaa

SEQ ID NO: 60423 - DNA, 28 bp, Artificial Sequence
  Synthetic
tgactttauggaaagaagtgttucgact

SEQ ID NO: 60424 - DNA, 19 bp, Artificial Sequence
  Synthetic
cutacctgtuggccagggt

SEQ ID NO: 60425 - DNA, 28 bp, Artificial Sequence
  Synthetic
cttcctatgatautgactgcagttugga

SEQ ID NO: 60426 - DNA, 24 bp, Artificial Sequence
  Synthetic
ccttgacuaagtgaaccauggcat

SEQ ID NO: 60427 - DNA, 28 bp, Artificial Sequence
  Synthetic
gcaggtattugcagaaacttaactgaut

SEQ ID NO: 60428 - DNA, 17 bp, Artificial Sequence
  Synthetic
ccccaugggttccguct

SEQ ID NO: 60429 - DNA, 17 bp, Artificial Sequence
  Synthetic
ggcggcugttcgtgtuc

SEQ ID NO: 60430 - DNA, 24 bp, Artificial Sequence
  Synthetic
agtgatgctcuccagcactttauc

SEQ ID NO: 60431 - DNA, 28 bp, Artificial Sequence
  Synthetic
gtgtactacgggacaugaatctttcuaa

SEQ ID NO: 60432 - DNA, 21 bp, Artificial Sequence
  Synthetic
caguggagagactuccagacc

SEQ ID NO: 60433 - DNA, 28 bp, Artificial Sequence
  Synthetic
tgagctagatacuctgcatgaatugaac

SEQ ID NO: 60434 - DNA, 25 bp, Artificial Sequence
  Synthetic
agagaucagaggactttgugacagt

SEQ ID NO: 60435 - DNA, 25 bp, Artificial Sequence
  Synthetic
ggctattttgcugtggcataaauct

SEQ ID NO: 60436 - DNA, 28 bp, Artificial Sequence
  Synthetic
ctagattgaccaggaugttgtcatuact

SEQ ID NO: 60437 - DNA, 28 bp, Artificial Sequence
  Synthetic
tcagattauggcaggaaattggatucat

SEQ ID NO: 60438 - DNA, 25 bp, Artificial Sequence
  Synthetic
aggcctatacuggacctattuaggg

SEQ ID NO: 60439 - DNA, 26 bp, Artificial Sequence
  Synthetic
accaatcttccagaautcacacctut

SEQ ID NO: 60440 - DNA, 25 bp, Artificial Sequence
  Synthetic
ttcaagctgtugaatggagcauact

SEQ ID NO: 60441 - DNA, 23 bp, Artificial Sequence
  Synthetic
cgaggccuggaaacttcttctuc

SEQ ID NO: 60442 - DNA, 28 bp, Artificial Sequence
  Synthetic
ggacacctataaacutttccacagcuac

SEQ ID NO: 60443 - DNA, 27 bp, Artificial Sequence
  Synthetic
tcctctgcttuattgtcatccaatuca

SEQ ID NO: 60444 - DNA, 27 bp, Artificial Sequence
  Synthetic
ccaacttcaccaguaaaacctauacca

SEQ ID NO: 60445 - DNA, 27 bp, Artificial Sequence
  Synthetic
atgaggtgaaucaaaagcaaaactucc

SEQ ID NO: 60446 - DNA, 20 bp, Artificial Sequence
  Synthetic
tcgaggucagccuaaaccca

SEQ ID NO: 60447 - DNA, 28 bp, Artificial Sequence
  Synthetic
gctcagtctctutgataggttcatttuc

SEQ ID NO: 60448 - DNA, 22 bp, Artificial Sequence
  Synthetic
gccctgccutctggaagtaauc

SEQ ID NO: 60449 - DNA, 19 bp, Artificial Sequence
  Synthetic
gcttcgcucccgggaatua

SEQ ID NO: 60450 - DNA, 19 bp, Artificial Sequence
  Synthetic
cccaccagcuccagaguct

SEQ ID NO: 60451 - DNA, 18 bp, Artificial Sequence
  Synthetic
gcaggcgcagguctauga

SEQ ID NO: 60452 - DNA, 17 bp, Artificial Sequence
  Synthetic
agccaccgacacgucuc

SEQ ID NO: 60453 - DNA, 20 bp, Artificial Sequence
  Synthetic
agtucaccccagagcaucac

SEQ ID NO: 60454 - DNA, 22 bp, Artificial Sequence
  Synthetic
ccatggcagcugacaatucaga

SEQ ID NO: 60455 - DNA, 28 bp, Artificial Sequence
  Synthetic
caaagcacttcaaacutactactgcaut

SEQ ID NO: 60456 - DNA, 28 bp, Artificial Sequence
  Synthetic
tcagctaaaucaaaagagctttcctuca

SEQ ID NO: 60457 - DNA, 28 bp, Artificial Sequence
  Synthetic
gccatctguaacaccattgatatttucc

SEQ ID NO: 60458 - DNA, 28 bp, Artificial Sequence
  Synthetic
aaaaatgctcauctcctaagctguaact

SEQ ID NO: 60459 - DNA, 27 bp, Artificial Sequence
  Synthetic
tctgatttgtcucgtttgccagataut

SEQ ID NO: 60460 - DNA, 25 bp, Artificial Sequence
  Synthetic
tgtcaaacaagcucactugaggaat

SEQ ID NO: 60461 - DNA, 21 bp, Artificial Sequence
  Synthetic
ttatcactguccgcttcgcut

SEQ ID NO: 60462 - DNA, 21 bp, Artificial Sequence
  Synthetic
cgagaacccutaatccugcct

SEQ ID NO: 60463 - DNA, 23 bp, Artificial Sequence
  Synthetic
cagagugcagagauaagcaacga

SEQ ID NO: 60464 - DNA, 22 bp, Artificial Sequence
  Synthetic
gggagaggugtttuggaccaac

SEQ ID NO: 60465 - DNA, 26 bp, Artificial Sequence
  Synthetic
gattgagaaagucccttcccagaaut

SEQ ID NO: 60466 - DNA, 22 bp, Artificial Sequence
  Synthetic
cccaggaagauctgtcagucct

SEQ ID NO: 60467 - DNA, 21 bp, Artificial Sequence
  Synthetic
gatgaaccugtacggctucca

SEQ ID NO: 60468 - DNA, 22 bp, Artificial Sequence
  Synthetic
gccatcutcctcacucacaaac

SEQ ID NO: 60469 - DNA, 20 bp, Artificial Sequence
  Synthetic
gccactucgactcctucacc

SEQ ID NO: 60470 - DNA, 20 bp, Artificial Sequence
  Synthetic
cctcacagugaccttgcuct

SEQ ID NO: 60471 - DNA, 20 bp, Artificial Sequence
  Synthetic
cctgactcgcugagccttuc

SEQ ID NO: 60472 - DNA, 20 bp, Artificial Sequence
  Synthetic
cccgtcccugtccttguact

SEQ ID NO: 60473 - DNA, 21 bp, Artificial Sequence
  Synthetic
gccatcctcuctgtgtcccut

SEQ ID NO: 60474 - DNA, 20 bp, Artificial Sequence
  Synthetic
ggcccguctttgtcctugaa

SEQ ID NO: 60475 - DNA, 25 bp, Artificial Sequence
  Synthetic
cagtcaaggagucgtttuggaaaaa

SEQ ID NO: 60476 - DNA, 17 bp, Artificial Sequence
  Synthetic
gcccgcgaccucuacag

SEQ ID NO: 60477 - DNA, 19 bp, Artificial Sequence
  Synthetic
gaggacggcgaaugcatut

SEQ ID NO: 60478 - DNA, 17 bp, Artificial Sequence
  Synthetic
gcccccuctgacugcaa

SEQ ID NO: 60479 - DNA, 17 bp, Artificial Sequence
  Synthetic
cutcucaggccccgact

SEQ ID NO: 60480 - DNA, 18 bp, Artificial Sequence
  Synthetic
cccaucccacctgccaut

SEQ ID NO: 60481 - DNA, 20 bp, Artificial Sequence
  Synthetic
gccaccccaautcctctcuc

SEQ ID NO: 60482 - DNA, 19 bp, Artificial Sequence
  Synthetic
agaagcgaggugggucaga

SEQ ID NO: 60483 - DNA, 20 bp, Artificial Sequence
  Synthetic
cgaaaguccccttccccuga

SEQ ID NO: 60484 - DNA, 24 bp, Artificial Sequence
  Synthetic
caucgatggaaaugaggaagaacc

SEQ ID NO: 60485 - DNA, 24 bp, Artificial Sequence
  Synthetic
tgctactcttcuccttctctccut

SEQ ID NO: 60486 - DNA, 20 bp, Artificial Sequence
  Synthetic
cggtcaucagcguggacaat

SEQ ID NO: 60487 - DNA, 22 bp, Artificial Sequence
  Synthetic
ctgtcctcuccctgtctacucc

SEQ ID NO: 60488 - DNA, 24 bp, Artificial Sequence
  Synthetic
tgtgccatautaggtcttcugggt

SEQ ID NO: 60489 - DNA, 28 bp, Artificial Sequence
  Synthetic
tcttatttctatugggtgtttccaugct

SEQ ID NO: 60490 - DNA, 25 bp, Artificial Sequence
  Synthetic
tgaattccuaagcacaatcugcact

SEQ ID NO: 60491 - DNA, 24 bp, Artificial Sequence
  Synthetic
agaatctctggcutcttggcttuc

SEQ ID NO: 60492 - DNA, 24 bp, Artificial Sequence
  Synthetic
gaatagagauaaggccacguagca

SEQ ID NO: 60493 - DNA, 23 bp, Artificial Sequence
  Synthetic
gatctaugaacggcucaaacacc

SEQ ID NO: 60494 - DNA, 21 bp, Artificial Sequence
  Synthetic
caatgaccaugcaugccacac

SEQ ID NO: 60495 - DNA, 27 bp, Artificial Sequence
  Synthetic
gagaaccccagaauaaacacgtaatuc

SEQ ID NO: 60496 - DNA, 25 bp, Artificial Sequence
  Synthetic
tgtttgctttuccttatccctuggt

SEQ ID NO: 60497 - DNA, 29 bp, Artificial Sequence
  Synthetic
ttgatacatgccugtcttgttaacactua

SEQ ID NO: 60498 - DNA, 29 bp, Artificial Sequence
  Synthetic
ctgacatggtacuaatgaaaactcacuga

SEQ ID NO: 60499 - DNA, 28 bp, Artificial Sequence
  Synthetic
gctcatttcttctutccttccttcctut

SEQ ID NO: 60500 - DNA, 27 bp, Artificial Sequence
  Synthetic
gaacttactgaauagcaccgttctuct

SEQ ID NO: 60501 - DNA, 23 bp, Artificial Sequence
  Synthetic
gucagcgagcattuaacaaaggg

SEQ ID NO: 60502 - DNA, 20 bp, Artificial Sequence
  Synthetic
cccccttuctcctgctucac

SEQ ID NO: 60503 - DNA, 26 bp, Artificial Sequence
  Synthetic
gctattttcugattgggacuaaccac

SEQ ID NO: 60504 - DNA, 27 bp, Artificial Sequence
  Synthetic
gtgatttaguaatggaaaugccacact

SEQ ID NO: 60505 - DNA, 28 bp, Artificial Sequence
  Synthetic
gggaaaaagaaugtgactgtgtguaaga

SEQ ID NO: 60506 - DNA, 26 bp, Artificial Sequence
  Synthetic
cttgaagttaagcaucctgactcugt

SEQ ID NO: 60507 - DNA, 27 bp, Artificial Sequence
  Synthetic
agctttctcaagaugcatacctaccua

SEQ ID NO: 60508 - DNA, 27 bp, Artificial Sequence
  Synthetic
tgcttcttcaaaugctcttgacatgua

SEQ ID NO: 60509 - DNA, 28 bp, Artificial Sequence
  Synthetic
caactcattctcautttgtagtgcauca

SEQ ID NO: 60510 - DNA, 29 bp, Artificial Sequence
  Synthetic
tccttctagatutctcagctgaauacact

SEQ ID NO: 60511 - DNA, 28 bp, Artificial Sequence
  Synthetic
gcaauaaacaccacttucaggaaacaat

SEQ ID NO: 60512 - DNA, 25 bp, Artificial Sequence
  Synthetic
gggaaagtacutgttgcttcuggat

SEQ ID NO: 60513 - DNA, 20 bp, Artificial Sequence
  Synthetic
cggatuccagcccagatcut

SEQ ID NO: 60514 - DNA, 23 bp, Artificial Sequence
  Synthetic
tgctucaacagcccctcattuat

SEQ ID NO: 60515 - DNA, 26 bp, Artificial Sequence
  Synthetic
tgtggaaaagcaucgtgactagtuaa

SEQ ID NO: 60516 - DNA, 28 bp, Artificial Sequence
  Synthetic
gtgcttttccuctttaattaggugacag

SEQ ID NO: 60517 - DNA, 26 bp, Artificial Sequence
  Synthetic
ctttgaggaaacucagggaccaauaa

SEQ ID NO: 60518 - DNA, 20 bp, Artificial Sequence
  Synthetic
gagcagacucacggctucat

SEQ ID NO: 60519 - DNA, 29 bp, Artificial Sequence
  Synthetic
cccacaagctgauctgaacattttagtua

SEQ ID NO: 60520 - DNA, 22 bp, Artificial Sequence
  Synthetic
gcaguggaggaagtggguagaa

SEQ ID NO: 60521 - DNA, 28 bp, Artificial Sequence
  Synthetic
cagatcctccuaactcttcagacuacat

SEQ ID NO: 60522 - DNA, 23 bp, Artificial Sequence
  Synthetic
caggatggttuctggatgctgua

SEQ ID NO: 60523 - DNA, 21 bp, Artificial Sequence
  Synthetic
gcatctugaaccgtccctcug

SEQ ID NO: 60524 - DNA, 22 bp, Artificial Sequence
  Synthetic
cctgaccacuccccaactttuc

SEQ ID NO: 60525 - DNA, 24 bp, Artificial Sequence
  Synthetic
tutttctattgugaccaccccagt

SEQ ID NO: 60526 - DNA, 20 bp, Artificial Sequence
  Synthetic
cctttcugaccagcggaguc

SEQ ID NO: 60527 - DNA, 26 bp, Artificial Sequence
  Synthetic
acacacacucactgattucagaacaa

SEQ ID NO: 60528 - DNA, 27 bp, Artificial Sequence
  Synthetic
cttttgtgattugggatgttccaugat

SEQ ID NO: 60529 - DNA, 28 bp, Artificial Sequence
  Synthetic
tggaatacatctcuctcatgttctcugt

SEQ ID NO: 60530 - DNA, 24 bp, Artificial Sequence
  Synthetic
ggaatctgaugccatgtctacuca

SEQ ID NO: 60531 - DNA, 28 bp, Artificial Sequence
  Synthetic
gagcaacattauaaccattttgccctut

SEQ ID NO: 60532 - DNA, 22 bp, Artificial Sequence
  Synthetic
gtggcuaccaaagcagaactug

SEQ ID NO: 60533 - DNA, 33 bp, Artificial Sequence
  Synthetic
catcaaatccacaaaauactttttatctagcut

SEQ ID NO: 60534 - DNA, 23 bp, Artificial Sequence
  Synthetic
gacctacugaaagagcugcagaa

SEQ ID NO: 60535 - DNA, 22 bp, Artificial Sequence
  Synthetic
ctgcagugttttcctgugaacc

SEQ ID NO: 60536 - DNA, 28 bp, Artificial Sequence
  Synthetic
cagtttgaaacagcagaugatgaagaut

SEQ ID NO: 60537 - DNA, 28 bp, Artificial Sequence
  Synthetic
gctgcaagttucaaattatccagttuct

SEQ ID NO: 60538 - DNA, 26 bp, Artificial Sequence
  Synthetic
atgtctaacatgcuagtttggccaua

SEQ ID NO: 60539 - DNA, 25 bp, Artificial Sequence
  Synthetic
cttgcaactguaggtccttcuagat

SEQ ID NO: 60540 - DNA, 23 bp, Artificial Sequence
  Synthetic
ggtgagcccguaagtagctcuat

SEQ ID NO: 60541 - DNA, 21 bp, Artificial Sequence
  Synthetic
gcagatccagcutccccatua

SEQ ID NO: 60542 - DNA, 29 bp, Artificial Sequence
  Synthetic
aaaagtgattaaaaugcaacccagatuga

SEQ ID NO: 60543 - DNA, 24 bp, Artificial Sequence
  Synthetic
cactgagggacuggtatucacaaa

SEQ ID NO: 60544 - DNA, 18 bp, Artificial Sequence
  Synthetic
ccattttgcuccgccugt

SEQ ID NO: 60545 - DNA, 18 bp, Artificial Sequence
  Synthetic
cgccgggacuagaaguga

SEQ ID NO: 60546 - DNA, 23 bp, Artificial Sequence
  Synthetic
gtcgtctguatggcagtuaagga

SEQ ID NO: 60547 - DNA, 25 bp, Artificial Sequence
  Synthetic
ttttccaggtuggctccataugaaa

SEQ ID NO: 60548 - DNA, 27 bp, Artificial Sequence
  Synthetic
tgaggauattgaagatcuggaggaact

SEQ ID NO: 60549 - DNA, 29 bp, Artificial Sequence
  Synthetic
gccaaagcuccaaatgtataatucagaaa

SEQ ID NO: 60550 - DNA, 27 bp, Artificial Sequence
  Synthetic
ttgatggtaaguacatgggtgtttcut

SEQ ID NO: 60551 - DNA, 29 bp, Artificial Sequence
  Synthetic
tctgcaacttuccatatttcttgaucact

SEQ ID NO: 60552 - DNA, 22 bp, Artificial Sequence
  Synthetic
cagctcttuggaggcaaatgut

SEQ ID NO: 60553 - DNA, 23 bp, Artificial Sequence
  Synthetic
ccctgtauccccaaacacatcuc

SEQ ID NO: 60554 - DNA, 20 bp, Artificial Sequence
  Synthetic
gcaagguagagggcgagtug

SEQ ID NO: 60555 - DNA, 21 bp, Artificial Sequence
  Synthetic
gcctcuccacggtctttauga

SEQ ID NO: 60556 - DNA, 20 bp, Artificial Sequence
  Synthetic
tggtggaagcggaugaacuc

SEQ ID NO: 60557 - DNA, 21 bp, Artificial Sequence
  Synthetic
gctgagacugagacacugacc

SEQ ID NO: 60558 - DNA, 24 bp, Artificial Sequence
  Synthetic
caaacacacaaaccugactcaucc

SEQ ID NO: 60559 - DNA, 26 bp, Artificial Sequence
  Synthetic
ggtctagaacguttgcgtttatctuc

SEQ ID NO: 60560 - DNA, 22 bp, Artificial Sequence
  Synthetic
aggcccugtttggaaugaagaa

SEQ ID NO: 60561 - DNA, 28 bp, Artificial Sequence
  Synthetic
caaacagcaaaugtgttactaacugcat

SEQ ID NO: 60562 - DNA, 20 bp, Artificial Sequence
  Synthetic
agcagcggaaaugtccugaa

SEQ ID NO: 60563 - DNA, 25 bp, Artificial Sequence
  Synthetic
agtaacaacugactcttugcacagt

SEQ ID NO: 60564 - DNA, 24 bp, Artificial Sequence
  Synthetic
ctgttgtccuaccagtctcttugt

SEQ ID NO: 60565 - DNA, 25 bp, Artificial Sequence
  Synthetic
ggattgaagaacutgcaguagcagt

SEQ ID NO: 60566 - DNA, 21 bp, Artificial Sequence
  Synthetic
gttacagcugacggtggaguc

SEQ ID NO: 60567 - DNA, 20 bp, Artificial Sequence
  Synthetic
accagtacucccccagctut

SEQ ID NO: 60568 - DNA, 21 bp, Artificial Sequence
  Synthetic
ccttaccuggttggaggucaa

SEQ ID NO: 60569 - DNA, 24 bp, Artificial Sequence
  Synthetic
gggctagacuagagagtatccauc

SEQ ID NO: 60570 - DNA, 20 bp, Artificial Sequence
  Synthetic
gcgggtcacugtacacctua

SEQ ID NO: 60571 - DNA, 22 bp, Artificial Sequence
  Synthetic
cctctttagccauggcaagguc

SEQ ID NO: 60572 - DNA, 23 bp, Artificial Sequence
  Synthetic
cacuccagaacactguggaagaa

SEQ ID NO: 60573 - DNA, 26 bp, Artificial Sequence
  Synthetic
tgccatttcaugggctaatctucaat

SEQ ID NO: 60574 - DNA, 26 bp, Artificial Sequence
  Synthetic
gtgguctcagaaaauggacaagaaaa

SEQ ID NO: 60575 - DNA, 23 bp, Artificial Sequence
  Synthetic
cattaaggagaugccttgugggt

SEQ ID NO: 60576 - DNA, 21 bp, Artificial Sequence
  Synthetic
ggcacggcuaaaagaagcaut

SEQ ID NO: 60577 - DNA, 22 bp, Artificial Sequence
  Synthetic
cccactgccuacttctactucc

SEQ ID NO: 60578 - DNA, 25 bp, Artificial Sequence
  Synthetic
cgttagcuaggaggtaaggtctugt

SEQ ID NO: 60579 - DNA, 22 bp, Artificial Sequence
  Synthetic
aagcagtugctggaagauggaa

SEQ ID NO: 60580 - DNA, 21 bp, Artificial Sequence
  Synthetic
gcacttgagcaugcactctut

SEQ ID NO: 60581 - DNA, 29 bp, Artificial Sequence
  Synthetic
atcttcgagcccuataactgtaatccaua

SEQ ID NO: 60582 - DNA, 23 bp, Artificial Sequence
  Synthetic
tgtgtcctttuccctctccacua

SEQ ID NO: 60583 - DNA, 27 bp, Artificial Sequence
  Synthetic
cagaattaugggaaagcaaactggaug

SEQ ID NO: 60584 - DNA, 21 bp, Artificial Sequence
  Synthetic
agtttactguggtgccugcat

SEQ ID NO: 60585 - DNA, 23 bp, Artificial Sequence
  Synthetic
cttgggcugaaacaactttccug

SEQ ID NO: 60586 - DNA, 20 bp, Artificial Sequence
  Synthetic
caggcatccucattccgcut

SEQ ID NO: 60587 - DNA, 28 bp, Artificial Sequence
  Synthetic
cccagaacctucccattagattaaacug

SEQ ID NO: 60588 - DNA, 28 bp, Artificial Sequence
  Synthetic
tcactgtcattauttaggtcgtcatugg

SEQ ID NO: 60589 - DNA, 26 bp, Artificial Sequence
  Synthetic
gagctggatatuaatgtagccacugt

SEQ ID NO: 60590 - DNA, 21 bp, Artificial Sequence
  Synthetic
ggctcugcagaatcactgugt

SEQ ID NO: 60591 - DNA, 24 bp, Artificial Sequence
  Synthetic
gggatttgacutttcttcctugcc

SEQ ID NO: 60592 - DNA, 21 bp, Artificial Sequence
  Synthetic
ggatggaggutgctcccagua

SEQ ID NO: 60593 - DNA, 21 bp, Artificial Sequence
  Synthetic
aggagcccagaaauggtgtug

SEQ ID NO: 60594 - DNA, 23 bp, Artificial Sequence
  Synthetic
acttgattccacucaggagcuct

SEQ ID NO: 60595 - DNA, 25 bp, Artificial Sequence
  Synthetic
ggccagtcacuatatccacattguc

SEQ ID NO: 60596 - DNA, 19 bp, Artificial Sequence
  Synthetic
gccagguccttgugaacca

SEQ ID NO: 60597 - DNA, 20 bp, Artificial Sequence
  Synthetic
agccccugagcatgatctuc

SEQ ID NO: 60598 - DNA, 21 bp, Artificial Sequence
  Synthetic
ggcattuggaggacauggaga

SEQ ID NO: 60599 - DNA, 28 bp, Artificial Sequence
  Synthetic
aggctccugaaaggaaaacttgttuaat

SEQ ID NO: 60600 - DNA, 27 bp, Artificial Sequence
  Synthetic
gcggtcttagaautgaggaagaatugt

SEQ ID NO: 60601 - DNA, 28 bp, Artificial Sequence
  Synthetic
tctaggtcccaautctactgcaaauagt

SEQ ID NO: 60602 - DNA, 22 bp, Artificial Sequence
  Synthetic
gcttaggaaugtgggcccuaga

SEQ ID NO: 60603 - DNA, 24 bp, Artificial Sequence
  Synthetic
tcatgguagctgagaagucacaga

SEQ ID NO: 60604 - DNA, 21 bp, Artificial Sequence
  Synthetic
gucattcagcucagcagcaga

SEQ ID NO: 60605 - DNA, 26 bp, Artificial Sequence
  Synthetic
tccacaaattactucctgacctccua

SEQ ID NO: 60606 - DNA, 25 bp, Artificial Sequence
  Synthetic
gtgggagtgugaagaatgattctug

SEQ ID NO: 60607 - DNA, 26 bp, Artificial Sequence
  Synthetic
aggagcugtuaaagaaagcaaaagga

SEQ ID NO: 60608 - DNA, 27 bp, Artificial Sequence
  Synthetic
tccagagacaaagutgcaaaacagaua

SEQ ID NO: 60609 - DNA, 27 bp, Artificial Sequence
  Synthetic
cagaagcctcauatgaagatggctaut

SEQ ID NO: 60610 - DNA, 24 bp, Artificial Sequence
  Synthetic
ctgagctgagutgagtgggattut

SEQ ID NO: 60611 - DNA, 19 bp, Artificial Sequence
  Synthetic
acagcgauggacctcccua

SEQ ID NO: 60612 - DNA, 28 bp, Artificial Sequence
  Synthetic
ctcgggtttcucttttcctattacauga

SEQ ID NO: 60613 - DNA, 32 bp, Artificial Sequence
  Synthetic
ccttagttttcttaguctgtcattaactcugt

SEQ ID NO: 60614 - DNA, 27 bp, Artificial Sequence
  Synthetic
ggttgatggugagaacacaaacuaaaa

SEQ ID NO: 60615 - DNA, 26 bp, Artificial Sequence
  Synthetic
catcatctuctctaaaccugcagacc

SEQ ID NO: 60616 - DNA, 22 bp, Artificial Sequence
  Synthetic
cctgcaccacaauggagtguat

SEQ ID NO: 60617 - DNA, 27 bp, Artificial Sequence
  Synthetic
gaaaaatgtacugaatgaacgagugct

SEQ ID NO: 60618 - DNA, 21 bp, Artificial Sequence
  Synthetic
ctggtcacaccugaatgctuc

SEQ ID NO: 60619 - DNA, 20 bp, Artificial Sequence
  Synthetic
tggaggtuggcatccgagua

SEQ ID NO: 60620 - DNA, 22 bp, Artificial Sequence
  Synthetic
ccttcctgacuggcttcttcug

SEQ ID NO: 60621 - DNA, 22 bp, Artificial Sequence
  Synthetic
ccactccaaaaugccagugagt

SEQ ID NO: 60622 - DNA, 22 bp, Artificial Sequence
  Synthetic
gttaacaagggugcgatgtugt

SEQ ID NO: 60623 - DNA, 23 bp, Artificial Sequence
  Synthetic
ggacatgggutaggaagtgucat

SEQ ID NO: 60624 - DNA, 21 bp, Artificial Sequence
  Synthetic
ccuttgagatcgucaccacca

SEQ ID NO: 60625 - DNA, 22 bp, Artificial Sequence
  Synthetic
acttagccaguggtctcucagt

SEQ ID NO: 60626 - DNA, 24 bp, Artificial Sequence
  Synthetic
gtcttttcctcugactgtgctcut

SEQ ID NO: 60627 - DNA, 20 bp, Artificial Sequence
  Synthetic
aggagagugtgtgctugcag

SEQ ID NO: 60628 - DNA, 24 bp, Artificial Sequence
  Synthetic
aggtatttgaugagagggcagcua

SEQ ID NO: 60629 - DNA, 27 bp, Artificial Sequence
  Synthetic
gaacactguatgaggaaugagcaaaac

SEQ ID NO: 60630 - DNA, 24 bp, Artificial Sequence
  Synthetic
ggagaaauggattgtacugaccct

SEQ ID NO: 60631 - DNA, 23 bp, Artificial Sequence
  Synthetic
ggattttgagcugggtgcttaug

SEQ ID NO: 60632 - DNA, 21 bp, Artificial Sequence
  Synthetic
gagatgcuggttcacaaugcc

SEQ ID NO: 60633 - DNA, 28 bp, Artificial Sequence
  Synthetic
tgggactcagaucattttccttctttut

SEQ ID NO: 60634 - DNA, 20 bp, Artificial Sequence
  Synthetic
caaccccautggcctguact

SEQ ID NO: 60635 - DNA, 22 bp, Artificial Sequence
  Synthetic
cacctguggagagctgtatguc

SEQ ID NO: 60636 - DNA, 28 bp, Artificial Sequence
  Synthetic
gctacaaacaauttctgtgacttucagt

SEQ ID NO: 60637 - DNA, 24 bp, Artificial Sequence
  Synthetic
gggaaacagguttagaauccacct

SEQ ID NO: 60638 - DNA, 18 bp, Artificial Sequence
  Synthetic
cucagccccacaccauct

SEQ ID NO: 60639 - DNA, 18 bp, Artificial Sequence
  Synthetic
cgtcctguccccaaccug

SEQ ID NO: 60640 - DNA, 28 bp, Artificial Sequence
  Synthetic
aggaaccuttaatagaaatuggacagca

SEQ ID NO: 60641 - DNA, 27 bp, Artificial Sequence
  Synthetic
gcccttttgcuaatcatgttcauacct

SEQ ID NO: 60642 - DNA, 20 bp, Artificial Sequence
  Synthetic
ccaaccagagccaucaggug

SEQ ID NO: 60643 - DNA, 18 bp, Artificial Sequence
  Synthetic
aaggaacgggucgugcaa

SEQ ID NO: 60644 - DNA, 25 bp, Artificial Sequence
  Synthetic
gtatttcaaatuacccggtgtggug

SEQ ID NO: 60645 - DNA, 22 bp, Artificial Sequence
  Synthetic
ctcgacguagacacagtgcuaa

SEQ ID NO: 60646 - DNA, 22 bp, Artificial Sequence
  Synthetic
tctctgtucccccagguacaaa

SEQ ID NO: 60647 - DNA, 22 bp, Artificial Sequence
  Synthetic
tttgcutgggaaauccgagaca

SEQ ID NO: 60648 - DNA, 22 bp, Artificial Sequence
  Synthetic
tgaaccaugttugcccaagact

SEQ ID NO: 60649 - DNA, 23 bp, Artificial Sequence
  Synthetic
gcctccctucctcttactctcug

SEQ ID NO: 60650 - DNA, 17 bp, Artificial Sequence
  Synthetic
gcugctguaggcaccca

SEQ ID NO: 60651 - DNA, 17 bp, Artificial Sequence
  Synthetic
gtccgcucccccactuc

SEQ ID NO: 60652 - DNA, 21 bp, Artificial Sequence
  Synthetic
gatctttugggccagccttut

SEQ ID NO: 60653 - DNA, 29 bp, Artificial Sequence
  Synthetic
cacatgtgaaggaauctaaatacgaugat

SEQ ID NO: 60654 - DNA, 20 bp, Artificial Sequence
  Synthetic
gccagcacucatgtcuggat

SEQ ID NO: 60655 - DNA, 25 bp, Artificial Sequence
  Synthetic
caaggacaaauttgactgcuccaac

SEQ ID NO: 60656 - DNA, 22 bp, Artificial Sequence
  Synthetic
gggatggaaucaggctgtauca

SEQ ID NO: 60657 - DNA, 19 bp, Artificial Sequence
  Synthetic
ggtgguggcagaggaguag

SEQ ID NO: 60658 - DNA, 21 bp, Artificial Sequence
  Synthetic
gtgttgccugtaccaggugaa

SEQ ID NO: 60659 - DNA, 21 bp, Artificial Sequence
  Synthetic
caucaagagcccaactuccca

SEQ ID NO: 60660 - DNA, 18 bp, Artificial Sequence
  Synthetic
ccctcccgcutcctacug

SEQ ID NO: 60661 - DNA, 18 bp, Artificial Sequence
  Synthetic
cagctccagugaccgcut

SEQ ID NO: 60662 - DNA, 21 bp, Artificial Sequence
  Synthetic
tgggaaucccugcaacaacag

SEQ ID NO: 60663 - DNA, 21 bp, Artificial Sequence
  Synthetic
gccagcaaguggacaccuaag

SEQ ID NO: 60664 - DNA, 22 bp, Artificial Sequence
  Synthetic
gggaacaccccuaacttuacct

SEQ ID NO: 60665 - DNA, 21 bp, Artificial Sequence
  Synthetic
ggatgccautgccgatgauga

SEQ ID NO: 60666 - DNA, 20 bp, Artificial Sequence
  Synthetic
ccaagaacgacgucatcgug

SEQ ID NO: 60667 - DNA, 23 bp, Artificial Sequence
  Synthetic
cacttcaugcctcttcactucct

SEQ ID NO: 60668 - DNA, 26 bp, Artificial Sequence
  Synthetic
cacactggguatccagaatguaaaga

SEQ ID NO: 60669 - DNA, 20 bp, Artificial Sequence
  Synthetic
aggcatccgcuatcccagua

SEQ ID NO: 60670 - DNA, 31 bp, Artificial Sequence
  Synthetic
agtgcagttttaaaaucctttttctgtaugg

SEQ ID NO: 60671 - DNA, 23 bp, Artificial Sequence
  Synthetic
acagcaucctttgguaacagcat

SEQ ID NO: 60672 - DNA, 28 bp, Artificial Sequence
  Synthetic
ggctacagatugcaacccaattaatauc

SEQ ID NO: 60673 - DNA, 27 bp, Artificial Sequence
  Synthetic
gacttttgtgagcuttctaggttugac

SEQ ID NO: 60674 - DNA, 24 bp, Artificial Sequence
  Synthetic
aaggcaaagcautaggtactuggt

SEQ ID NO: 60675 - DNA, 24 bp, Artificial Sequence
  Synthetic
gacagagaagccaauactggacug

SEQ ID NO: 60676 - DNA, 27 bp, Artificial Sequence
  Synthetic
cccagccugattaggtaaatttugact

SEQ ID NO: 60677 - DNA, 29 bp, Artificial Sequence
  Synthetic
cctccacctccautagatttccattagua

SEQ ID NO: 60678 - DNA, 29 bp, Artificial Sequence
  Synthetic
ctgctaccaagguctatgatatgctuaaa

SEQ ID NO: 60679 - DNA, 28 bp, Artificial Sequence
  Synthetic
gggttggctaugctagataatgatuacc

SEQ ID NO: 60680 - DNA, 25 bp, Artificial Sequence
  Synthetic
caagaaggaagaaggugtguaagca

SEQ ID NO: 60681 - DNA, 29 bp, Artificial Sequence
  Synthetic
atcctaaacguaagaagcaacactcatua

SEQ ID NO: 60682 - DNA, 19 bp, Artificial Sequence
  Synthetic
tgtattugcccgtgucgct

SEQ ID NO: 60683 - DNA, 21 bp, Artificial Sequence
  Synthetic
cctugaggaccccgattctut

SEQ ID NO: 60684 - DNA, 21 bp, Artificial Sequence
  Synthetic
cgacacugtggtcctuagcaa

SEQ ID NO: 60685 - DNA, 23 bp, Artificial Sequence
  Synthetic
ggcagaaaggagaugcagaugag

SEQ ID NO: 60686 - DNA, 27 bp, Artificial Sequence
  Synthetic
tgagctaagucactgactaaaaugcaa

SEQ ID NO: 60687 - DNA, 23 bp, Artificial Sequence
  Synthetic
ccaatctcccaaucccaggtuag

SEQ ID NO: 60688 - DNA, 21 bp, Artificial Sequence
  Synthetic
gcctgtucaaaatcgccauga

SEQ ID NO: 60689 - DNA, 25 bp, Artificial Sequence
  Synthetic
ctgggaaucaaaggtctttcucaga

SEQ ID NO: 60690 - DNA, 21 bp, Artificial Sequence
  Synthetic
agcagacuccctcagaggtut

SEQ ID NO: 60691 - DNA, 23 bp, Artificial Sequence
  Synthetic
ctgtctattuccccatcccaucc

SEQ ID NO: 60692 - DNA, 28 bp, Artificial Sequence
  Synthetic
cccagttacucacctgatcaatgataut

SEQ ID NO: 60693 - DNA, 28 bp, Artificial Sequence
  Synthetic
aatgcccaggtuccaaatagtttaguat

SEQ ID NO: 60694 - DNA, 28 bp, Artificial Sequence
  Synthetic
gaggacagctcucatttcttgactuaaa

SEQ ID NO: 60695 - DNA, 28 bp, Artificial Sequence
  Synthetic
gctgtgattcuaaagcaaaacacattug

SEQ ID NO: 60696 - DNA, 26 bp, Artificial Sequence
  Synthetic
gcccaacagaaaacuggaggaaaaua

SEQ ID NO: 60697 - DNA, 22 bp, Artificial Sequence
  Synthetic
ttcccaagaagaacugguggag

SEQ ID NO: 60698 - DNA, 20 bp, Artificial Sequence
  Synthetic
agggactugagtgtggcauc

SEQ ID NO: 60699 - DNA, 23 bp, Artificial Sequence
  Synthetic
acaatcctggcugatctctcugt

SEQ ID NO: 60700 - DNA, 23 bp, Artificial Sequence
  Synthetic
tggataacuagcccctctgctut

SEQ ID NO: 60701 - DNA, 23 bp, Artificial Sequence
  Synthetic
cctctgcgacgacauaatctgug

SEQ ID NO: 60702 - DNA, 28 bp, Artificial Sequence
  Synthetic
ttttctattcctuagcctatgtgctucc

SEQ ID NO: 60703 - DNA, 26 bp, Artificial Sequence
  Synthetic
accctccaggaugaaatttuaaccat

SEQ ID NO: 60704 - DNA, 26 bp, Artificial Sequence
  Synthetic
gccacagtacutttcaagaaguggaa

SEQ ID NO: 60705 - DNA, 26 bp, Artificial Sequence
  Synthetic
ttgagacaccuattttgtgcctguat

SEQ ID NO: 60706 - DNA, 22 bp, Artificial Sequence
  Synthetic
cttgtagtggcutcctctccuc

SEQ ID NO: 60707 - DNA, 22 bp, Artificial Sequence
  Synthetic
gcctcaccuatgacugccaaaa

SEQ ID NO: 60708 - DNA, 22 bp, Artificial Sequence
  Synthetic
gggtccccaaguccttagcuat

SEQ ID NO: 60709 - DNA, 23 bp, Artificial Sequence
  Synthetic
acgcaatatgutgcctacagucc

SEQ ID NO: 60710 - DNA, 28 bp, Artificial Sequence
  Synthetic
tctgatctctuccagagtaaatgtguca

SEQ ID NO: 60711 - DNA, 28 bp, Artificial Sequence
  Synthetic
gttcccaaaguctctagaauacgacaat

SEQ ID NO: 60712 - DNA, 24 bp, Artificial Sequence
  Synthetic
cttgtggttcuggtaggaagucac

SEQ ID NO: 60713 - DNA, 26 bp, Artificial Sequence
  Synthetic
ggttttatcuggagacaaagggagut

SEQ ID NO: 60714 - DNA, 26 bp, Artificial Sequence
  Synthetic
aggtggtacccautgtaaaggaagua

SEQ ID NO: 60715 - DNA, 28 bp, Artificial Sequence
  Synthetic
ggagagaagaggaaugattucaaagaca

SEQ ID NO: 60716 - DNA, 27 bp, Artificial Sequence
  Synthetic
tcttgattcuggaacagatttgtctut

SEQ ID NO: 60717 - DNA, 26 bp, Artificial Sequence
  Synthetic
gggattccaugattcgatgtucacat

SEQ ID NO: 60718 - DNA, 25 bp, Artificial Sequence
  Synthetic
agtctgacaggutgacatcuacaga

SEQ ID NO: 60719 - DNA, 26 bp, Artificial Sequence
  Synthetic
cgggtcattgcuattttcttctcuga

SEQ ID NO: 60720 - DNA, 20 bp, Artificial Sequence
  Synthetic
gcagctuctccacctuagcc

SEQ ID NO: 60721 - DNA, 26 bp, Artificial Sequence
  Synthetic
gaacctaagtucctggtagctttuca

SEQ ID NO: 60722 - DNA, 24 bp, Artificial Sequence
  Synthetic
gacaacactcuagtctgggaguct

SEQ ID NO: 60723 - DNA, 23 bp, Artificial Sequence
  Synthetic
gatgaatgagaggcuggaggaug

SEQ ID NO: 60724 - DNA, 21 bp, Artificial Sequence
  Synthetic
aagccucagagtctcugggat

SEQ ID NO: 60725 - DNA, 23 bp, Artificial Sequence
  Synthetic
gggcutcactucagaggagaaag

SEQ ID NO: 60726 - DNA, 21 bp, Artificial Sequence
  Synthetic
ccctaggcaucagcgtgtaug

SEQ ID NO: 60727 - DNA, 22 bp, Artificial Sequence
  Synthetic
tctccgacaacgccuatcagua

SEQ ID NO: 60728 - DNA, 26 bp, Artificial Sequence
  Synthetic
tgattgggtuggagactacaaugaac

SEQ ID NO: 60729 - DNA, 28 bp, Artificial Sequence
  Synthetic
tcaaaagtgcaacutcaaggatccuaaa

SEQ ID NO: 60730 - DNA, 30 bp, Artificial Sequence
  Synthetic
ttgaatggaattgcutgaacatgaatctut

SEQ ID NO: 60731 - DNA, 27 bp, Artificial Sequence
  Synthetic
cgtgtcttaaaacaugcctcctcatua

SEQ ID NO: 60732 - DNA, 22 bp, Artificial Sequence
  Synthetic
ccaccagtucacctgccattua

SEQ ID NO: 60733 - DNA, 23 bp, Artificial Sequence
  Synthetic
ccagcatacgaaguggaccttuc

SEQ ID NO: 60734 - DNA, 22 bp, Artificial Sequence
  Synthetic
acagcccaugctttgtggttua

SEQ ID NO: 60735 - DNA, 22 bp, Artificial Sequence
  Synthetic
ccgccaucatcattctcugcaa

SEQ ID NO: 60736 - DNA, 26 bp, Artificial Sequence
  Synthetic
cagcaaatatucctgtatggtuccct

SEQ ID NO: 60737 - DNA, 24 bp, Artificial Sequence
  Synthetic
cgtctacgcgcugatcatattuga

SEQ ID NO: 60738 - DNA, 20 bp, Artificial Sequence
  Synthetic
ctgaccccugtgaaccagut

SEQ ID NO: 60739 - DNA, 24 bp, Artificial Sequence
  Synthetic
agcagutaauccaggagagaagga

SEQ ID NO: 60740 - DNA, 25 bp, Artificial Sequence
  Synthetic
ccaccacaaauaaacatgcagcaut

SEQ ID NO: 60741 - DNA, 29 bp, Artificial Sequence
  Synthetic
tgttttgactttguttgactcatgtgaut

SEQ ID NO: 60742 - DNA, 23 bp, Artificial Sequence
  Synthetic
agaaagttcugacaatgccguca

SEQ ID NO: 60743 - DNA, 22 bp, Artificial Sequence
  Synthetic
cctatcctcccaucccacctut

SEQ ID NO: 60744 - DNA, 26 bp, Artificial Sequence
  Synthetic
ggaagagtcucctaacaagacaguga

SEQ ID NO: 60745 - DNA, 21 bp, Artificial Sequence
  Synthetic
caacaccgutggcaacuacac

SEQ ID NO: 60746 - DNA, 24 bp, Artificial Sequence
  Synthetic
agagtttuaaaggacgtccccuct

SEQ ID NO: 60747 - DNA, 27 bp, Artificial Sequence
  Synthetic
gctcataaacttautttgccccacaut

SEQ ID NO: 60748 - DNA, 23 bp, Artificial Sequence
  Synthetic
ggagtgtgugtctgtaccugaag

SEQ ID NO: 60749 - DNA, 22 bp, Artificial Sequence
  Synthetic
atgtgaagtgutcccaggagug

SEQ ID NO: 60750 - DNA, 26 bp, Artificial Sequence
  Synthetic
aagtataaagugtccattugcccagt

SEQ ID NO: 60751 - DNA, 26 bp, Artificial Sequence
  Synthetic
ctgatattugcccaaatggaatcugt

SEQ ID NO: 60752 - DNA, 23 bp, Artificial Sequence
  Synthetic
cattcaggaaguagccaugcaga

SEQ ID NO: 60753 - DNA, 23 bp, Artificial Sequence
  Synthetic
gcgtctcagcuctctccttatut

SEQ ID NO: 60754 - DNA, 25 bp, Artificial Sequence
  Synthetic
tuccaagtatttugggcagaacaga

SEQ ID NO: 60755 - DNA, 22 bp, Artificial Sequence
  Synthetic
gtcagatagcuccttcctgugg

SEQ ID NO: 60756 - DNA, 17 bp, Artificial Sequence
  Synthetic
gcugcgactuccggact

SEQ ID NO: 60757 - DNA, 18 bp, Artificial Sequence
  Synthetic
tgcaggcuccggatctuc

SEQ ID NO: 60758 - DNA, 24 bp, Artificial Sequence
  Synthetic
ccatccctcucctttttctcucct

SEQ ID NO: 60759 - DNA, 24 bp, Artificial Sequence
  Synthetic
ggcctctttugagcagctctuaaa

SEQ ID NO: 60760 - DNA, 22 bp, Artificial Sequence
  Synthetic
ggaggagaaauggugcgagaag

SEQ ID NO: 60761 - DNA, 21 bp, Artificial Sequence
  Synthetic
tctccctcutcccatcuccag

SEQ ID NO: 60762 - DNA, 19 bp, Artificial Sequence
  Synthetic
cctccaatucggagcgcut

SEQ ID NO: 60763 - DNA, 21 bp, Artificial Sequence
  Synthetic
gctaaggauggacgcaaggut

SEQ ID NO: 60764 - DNA, 25 bp, Artificial Sequence
  Synthetic
acagtcucagagaggaguaaacact

SEQ ID NO: 60765 - DNA, 27 bp, Artificial Sequence
  Synthetic
gggacatctccucattgaaagatttut

SEQ ID NO: 60766 - DNA, 17 bp, Artificial Sequence
  Synthetic
cgcuccacggctttcug

SEQ ID NO: 60767 - DNA, 17 bp, Artificial Sequence
  Synthetic
ctcgguggacaccgcua

SEQ ID NO: 60768 - DNA, 22 bp, Artificial Sequence
  Synthetic
caaagcagagccucagatgcua

SEQ ID NO: 60769 - DNA, 22 bp, Artificial Sequence
  Synthetic
ctttauagcgcagggacucagg

SEQ ID NO: 60770 - DNA, 21 bp, Artificial Sequence
  Synthetic
cggcacucctggagaacuact

SEQ ID NO: 60771 - DNA, 21 bp, Artificial Sequence
  Synthetic
ctgggagagucctcacaaugg

SEQ ID NO: 60772 - DNA, 18 bp, Artificial Sequence
  Synthetic
acctugcgggcttctucc

SEQ ID NO: 60773 - DNA, 19 bp, Artificial Sequence
  Synthetic
aggcuacaggcctccauca

SEQ ID NO: 60774 - DNA, 20 bp, Artificial Sequence
  Synthetic
agacagaccugugagaggca

SEQ ID NO: 60775 - DNA, 24 bp, Artificial Sequence
  Synthetic
ggatgaatucacagcctaccaugt

SEQ ID NO: 60776 - DNA, 18 bp, Artificial Sequence
  Synthetic
gtcaacgugggccuccaa

SEQ ID NO: 60777 - DNA, 17 bp, Artificial Sequence
  Synthetic
agggccgagcacuccua

SEQ ID NO: 60778 - DNA, 19 bp, Artificial Sequence
  Synthetic
ggcugagtcatuggcagca

SEQ ID NO: 60779 - DNA, 17 bp, Artificial Sequence
  Synthetic
cctggcuggtggcaugt

SEQ ID NO: 60780 - DNA, 22 bp, Artificial Sequence
  Synthetic
aaggtccagucgaagagguagt

SEQ ID NO: 60781 - DNA, 19 bp, Artificial Sequence
  Synthetic
aggcaacaguggagcaugt

SEQ ID NO: 60782 - DNA, 19 bp, Artificial Sequence
  Synthetic
cacgucaaagcugcaggag

SEQ ID NO: 60783 - DNA, 17 bp, Artificial Sequence
  Synthetic
cgccaacgccucgucat

SEQ ID NO: 60784 - DNA, 23 bp, Artificial Sequence
  Synthetic
agagaagtugagaggacccauga

SEQ ID NO: 60785 - DNA, 22 bp, Artificial Sequence
  Synthetic
tctttgcauccctttugcagga

SEQ ID NO: 60786 - DNA, 22 bp, Artificial Sequence
  Synthetic
ggatagcaggauggtgggatug

SEQ ID NO: 60787 - DNA, 21 bp, Artificial Sequence
  Synthetic
ctgaagaagauccgggagcug

SEQ ID NO: 60788 - DNA, 27 bp, Artificial Sequence
  Synthetic
cgttaagtcacuaatcctctccucaag

SEQ ID NO: 60789 - DNA, 31 bp, Artificial Sequence
  Synthetic
aactctagttguattttgttataatgugggt

SEQ ID NO: 60790 - DNA, 21 bp, Artificial Sequence
  Synthetic
ggccaaccaucctcctcctua

SEQ ID NO: 60791 - DNA, 23 bp, Artificial Sequence
  Synthetic
ctcagttuacccatgaccctucc

SEQ ID NO: 60792 - DNA, 24 bp, Artificial Sequence
  Synthetic
cggaatccccaaguagttagtgut

SEQ ID NO: 60793 - DNA, 20 bp, Artificial Sequence
  Synthetic
ccaaccacagcaccuaccuc

SEQ ID NO: 60794 - DNA, 20 bp, Artificial Sequence
  Synthetic
ctgttugagcggatgugcat

SEQ ID NO: 60795 - DNA, 28 bp, Artificial Sequence
  Synthetic
aaattcaaagctacguctacaccagaut

SEQ ID NO: 60796 - DNA, 21 bp, Artificial Sequence
  Synthetic
ttttctugccgtagucagcca

SEQ ID NO: 60797 - DNA, 24 bp, Artificial Sequence
  Synthetic
acctaccccacucttccaaatcut

SEQ ID NO: 60798 - DNA, 23 bp, Artificial Sequence
  Synthetic
ccttcucacctccauacaaccat

SEQ ID NO: 60799 - DNA, 22 bp, Artificial Sequence
  Synthetic
cttguaccgctacauacagcca

SEQ ID NO: 60800 - DNA, 24 bp, Artificial Sequence
  Synthetic
cagcaggaaccuatctacccuact

SEQ ID NO: 60801 - DNA, 23 bp, Artificial Sequence
  Synthetic
ggaggcuaatttcatguccacct

SEQ ID NO: 60802 - DNA, 20 bp, Artificial Sequence
  Synthetic
ccttggtggugagcgtttuc

SEQ ID NO: 60803 - DNA, 24 bp, Artificial Sequence
  Synthetic
tgactcttacuctccatgtuccca

SEQ ID NO: 60804 - DNA, 21 bp, Artificial Sequence
  Synthetic
ctccgacaugtagtccgguag

SEQ ID NO: 60805 - DNA, 22 bp, Artificial Sequence
  Synthetic
cgggcctguggttagtgaatut

SEQ ID NO: 60806 - DNA, 26 bp, Artificial Sequence
  Synthetic
agugcaaatgugaaacaagaaaggag

SEQ ID NO: 60807 - DNA, 24 bp, Artificial Sequence
  Synthetic
ctgatgcatucaaagcccugaaaa

SEQ ID NO: 60808 - DNA, 22 bp, Artificial Sequence
  Synthetic
aggtgggucatgataacugggt

SEQ ID NO: 60809 - DNA, 27 bp, Artificial Sequence
  Synthetic
ggcacuccaaaatctaatgtucagaga

SEQ ID NO: 60810 - DNA, 21 bp, Artificial Sequence
  Synthetic
actggaaaccacugcatccug

SEQ ID NO: 60811 - DNA, 24 bp, Artificial Sequence
  Synthetic
caccgtguaagatgtaagcuggaa

SEQ ID NO: 60812 - DNA, 20 bp, Artificial Sequence
  Synthetic
cctugacaccgccatctcut

SEQ ID NO: 60813 - DNA, 22 bp, Artificial Sequence
  Synthetic
tgcttgatcuctgggaaugcag

SEQ ID NO: 60814 - DNA, 17 bp, Artificial Sequence
  Synthetic
cccaggcucuggcagaa

SEQ ID NO: 60815 - DNA, 18 bp, Artificial Sequence
  Synthetic
gtgggcutattgcuccgc

SEQ ID NO: 60816 - DNA, 22 bp, Artificial Sequence
  Synthetic
ccaattaugctgtgccugggaa

SEQ ID NO: 60817 - DNA, 22 bp, Artificial Sequence
  Synthetic
cctgccagagcucagaauaacc

SEQ ID NO: 60818 - DNA, 24 bp, Artificial Sequence
  Synthetic
tttgcacaccccacutcttttcua

SEQ ID NO: 60819 - DNA, 20 bp, Artificial Sequence
  Synthetic
tcatgcaugcccacgatcuc

SEQ ID NO: 60820 - DNA, 21 bp, Artificial Sequence
  Synthetic
cugacgcacacctatugcaag

SEQ ID NO: 60821 - DNA, 22 bp, Artificial Sequence
  Synthetic
tcatctctccuccctgcttcug

SEQ ID NO: 60822 - DNA, 21 bp, Artificial Sequence
  Synthetic
atctggaccugggtctucagt

SEQ ID NO: 60823 - DNA, 24 bp, Artificial Sequence
  Synthetic
gacttccugaaaacaacgttcugg

SEQ ID NO: 60824 - DNA, 28 bp, Artificial Sequence
  Synthetic
ggaaatcaauacatctgccttucgagaa

SEQ ID NO: 60825 - DNA, 25 bp, Artificial Sequence
  Synthetic
cgttcttuaacagccataaggtguc

SEQ ID NO: 60826 - DNA, 20 bp, Artificial Sequence
  Synthetic
acagttugcccggcataucc

SEQ ID NO: 60827 - DNA, 22 bp, Artificial Sequence
  Synthetic
ggtccauagtgaagcucacacc

SEQ ID NO: 60828 - DNA, 21 bp, Artificial Sequence
  Synthetic
ccttggcaggcutattgugct

SEQ ID NO: 60829 - DNA, 27 bp, Artificial Sequence
  Synthetic
gtgtagtagttgaauggcacgttttuc

SEQ ID NO: 60830 - DNA, 20 bp, Artificial Sequence
  Synthetic
ggttcuccccacccttcuga

SEQ ID NO: 60831 - DNA, 27 bp, Artificial Sequence
  Synthetic
aggacttttaggagugtctcctttuct

SEQ ID NO: 60832 - DNA, 21 bp, Artificial Sequence
  Synthetic
gtgtcaagaaccucgtgucca

SEQ ID NO: 60833 - DNA, 20 bp, Artificial Sequence
  Synthetic
gcctggutgcaguagaggaa

SEQ ID NO: 60834 - DNA, 18 bp, Artificial Sequence
  Synthetic
ggagtccgucatccugct

SEQ ID NO: 60835 - DNA, 19 bp, Artificial Sequence
  Synthetic
gcaggctugttgggctuct

SEQ ID NO: 60836 - DNA, 18 bp, Artificial Sequence
  Synthetic
gagccugcacuccacaga

SEQ ID NO: 60837 - DNA, 17 bp, Artificial Sequence
  Synthetic
gucgaagcggcugacca

SEQ ID NO: 60838 - DNA, 22 bp, Artificial Sequence
  Synthetic
acuctaucccccaacacaccaa

SEQ ID NO: 60839 - DNA, 23 bp, Artificial Sequence
  Synthetic
aaccaacacugcatacctuccaa

SEQ ID NO: 60840 - DNA, 27 bp, Artificial Sequence
  Synthetic
gcattccaatauaatccatcccugcaa

SEQ ID NO: 60841 - DNA, 19 bp, Artificial Sequence
  Synthetic
agugagggcggaacaggua

SEQ ID NO: 60842 - DNA, 21 bp, Artificial Sequence
  Synthetic
cacccctugccattgtcauct

SEQ ID NO: 60843 - DNA, 22 bp, Artificial Sequence
  Synthetic
gttcagccuctacugggaaacc

SEQ ID NO: 60844 - DNA, 23 bp, Artificial Sequence
  Synthetic
cacaaccaacuactgtgguccaa

SEQ ID NO: 60845 - DNA, 23 bp, Artificial Sequence
  Synthetic
cctggctttucctttcctctcug

SEQ ID NO: 60846 - DNA, 19 bp, Artificial Sequence
  Synthetic
cccccuggagttcacgtut

SEQ ID NO: 60847 - DNA, 19 bp, Artificial Sequence
  Synthetic
cagcaggcugctttucaga

SEQ ID NO: 60848 - DNA, 21 bp, Artificial Sequence
  Synthetic
tggcgtgucactcatccttut

SEQ ID NO: 60849 - DNA, 26 bp, Artificial Sequence
  Synthetic
cutcctaataatucaagccacagcac

SEQ ID NO: 60850 - DNA, 23 bp, Artificial Sequence
  Synthetic
gctgggatugaagggaagaggua

SEQ ID NO: 60851 - DNA, 28 bp, Artificial Sequence
  Synthetic
acttgtcttcuaacccatctttttccut

SEQ ID NO: 60852 - DNA, 21 bp, Artificial Sequence
  Synthetic
gggtaguccaggcccttcaua

SEQ ID NO: 60853 - DNA, 27 bp, Artificial Sequence
  Synthetic
tctctgaatccuaagaagaagctcuca

SEQ ID NO: 60854 - DNA, 17 bp, Artificial Sequence
  Synthetic
ccccgcgccutccuaag

SEQ ID NO: 60855 - DNA, 20 bp, Artificial Sequence
  Synthetic
ctgctcgucggtcatctuca

SEQ ID NO: 60856 - DNA, 22 bp, Artificial Sequence
  Synthetic
cccttgtugattttctcgugct

SEQ ID NO: 60857 - DNA, 23 bp, Artificial Sequence
  Synthetic
gaaggtctcgaugttggagauga

SEQ ID NO: 60858 - DNA, 22 bp, Artificial Sequence
  Synthetic
gtggcaatuaagccctgtugac

SEQ ID NO: 60859 - DNA, 19 bp, Artificial Sequence
  Synthetic
cctgtgcagguggctcauc

SEQ ID NO: 60860 - DNA, 22 bp, Artificial Sequence
  Synthetic
acaugaccuccaacaagaccac

SEQ ID NO: 60861 - DNA, 19 bp, Artificial Sequence
  Synthetic
ggacggcutgccctcauat

SEQ ID NO: 60862 - DNA, 21 bp, Artificial Sequence
  Synthetic
ggagagacaaaaccuggcuca

SEQ ID NO: 60863 - DNA, 26 bp, Artificial Sequence
  Synthetic
ctgcaccgguttttattcaucaacat

SEQ ID NO: 60864 - DNA, 21 bp, Artificial Sequence
  Synthetic
ctcaactcuccgcctgtgaut

SEQ ID NO: 60865 - DNA, 20 bp, Artificial Sequence
  Synthetic
cacaacguccaggtacugct

SEQ ID NO: 60866 - DNA, 20 bp, Artificial Sequence
  Synthetic
cgtccacuaagagugaggct

SEQ ID NO: 60867 - DNA, 20 bp, Artificial Sequence
  Synthetic
acaatccacaugccgucgaa

SEQ ID NO: 60868 - DNA, 20 bp, Artificial Sequence
  Synthetic
gcuacctgucggcagaagag

SEQ ID NO: 60869 - DNA, 17 bp, Artificial Sequence
  Synthetic
caggugcacgguccaca

SEQ ID NO: 60870 - DNA, 23 bp, Artificial Sequence
  Synthetic
ggagcuagggacaaacugagact

SEQ ID NO: 60871 - DNA, 23 bp, Artificial Sequence
  Synthetic
acactatctucaacctcggtgug

SEQ ID NO: 60872 - DNA, 23 bp, Artificial Sequence
  Synthetic
gccacagacaauagagcagtcut

SEQ ID NO: 60873 - DNA, 28 bp, Artificial Sequence
  Synthetic
cagttgttttatguatttcagtgggcut

SEQ ID NO: 60874 - DNA, 22 bp, Artificial Sequence
  Synthetic
gccactggcuttcagagactua

SEQ ID NO: 60875 - DNA, 27 bp, Artificial Sequence
  Synthetic
gcccaagactaugtcctgacatauaac

SEQ ID NO: 60876 - DNA, 27 bp, Artificial Sequence
  Synthetic
gcautcttgaucgagaagaaacaccat

SEQ ID NO: 60877 - DNA, 26 bp, Artificial Sequence
  Synthetic
tctacattgttucctcttgcauccaa

SEQ ID NO: 60878 - DNA, 26 bp, Artificial Sequence
  Synthetic
gctagatgaccgcutcttagatgaut

SEQ ID NO: 60879 - DNA, 24 bp, Artificial Sequence
  Synthetic
actgccagaggaguaggtattcuc

SEQ ID NO: 60880 - DNA, 20 bp, Artificial Sequence
  Synthetic
gggaauggcggtcaatgugt

SEQ ID NO: 60881 - DNA, 28 bp, Artificial Sequence
  Synthetic
atcacattccacaugacagactguaaat

SEQ ID NO: 60882 - DNA, 19 bp, Artificial Sequence
  Synthetic
gcatctuccacgagcggut

SEQ ID NO: 60883 - DNA, 25 bp, Artificial Sequence
  Synthetic
gaggtaggagcutgagaccttatug

SEQ ID NO: 60884 - DNA, 21 bp, Artificial Sequence
  Synthetic
gcatucgaggccattgugaaa

SEQ ID NO: 60885 - DNA, 22 bp, Artificial Sequence
  Synthetic
gtttccacaaggucaggaguca

SEQ ID NO: 60886 - DNA, 19 bp, Artificial Sequence
  Synthetic
gtgacgtugcggcagtuag

SEQ ID NO: 60887 - DNA, 20 bp, Artificial Sequence
  Synthetic
cttctccucgtgcugcaagt

SEQ ID NO: 60888 - DNA, 21 bp, Artificial Sequence
  Synthetic
acagactgucccccauaacct

SEQ ID NO: 60889 - DNA, 19 bp, Artificial Sequence
  Synthetic
cccctcccgucgatacucc

SEQ ID NO: 60890 - DNA, 21 bp, Artificial Sequence
  Synthetic
atgggtcuggtctctgacuga

SEQ ID NO: 60891 - DNA, 23 bp, Artificial Sequence
  Synthetic
gtgaccagugactccatactucc

SEQ ID NO: 60892 - DNA, 20 bp, Artificial Sequence
  Synthetic
ccccucctcaauagggcaac

SEQ ID NO: 60893 - DNA, 22 bp, Artificial Sequence
  Synthetic
tcagggtcucacatgcatcuct

SEQ ID NO: 60894 - DNA, 20 bp, Artificial Sequence
  Synthetic
cctguggagaccctcaagug

SEQ ID NO: 60895 - DNA, 24 bp, Artificial Sequence
  Synthetic
ttgaggguttcttggauaggagga

SEQ ID NO: 60896 - DNA, 22 bp, Artificial Sequence
  Synthetic
tgcatggaucctgacugaagac

SEQ ID NO: 60897 - DNA, 25 bp, Artificial Sequence
  Synthetic
gcatttctauaccccttgatgugga

SEQ ID NO: 60898 - DNA, 21 bp, Artificial Sequence
  Synthetic
aaagccuggacttgcctucat

SEQ ID NO: 60899 - DNA, 23 bp, Artificial Sequence
  Synthetic
ggaggagugaggttaggaugagt

SEQ ID NO: 60900 - DNA, 21 bp, Artificial Sequence
  Synthetic
ctctgatcccuctggcccuaa

SEQ ID NO: 60901 - DNA, 18 bp, Artificial Sequence
  Synthetic
gcctgtgauggcctggug

SEQ ID NO: 60902 - DNA, 23 bp, Artificial Sequence
  Synthetic
caagttttuagggaacgctgcug

SEQ ID NO: 60903 - DNA, 21 bp, Artificial Sequence
  Synthetic
cttggcgauggtcttgacuga

SEQ ID NO: 60904 - DNA, 22 bp, Artificial Sequence
  Synthetic
acctctguctgtctgtcucaca

SEQ ID NO: 60905 - DNA, 18 bp, Artificial Sequence
  Synthetic
tccctgcugagggtcucc

SEQ ID NO: 60906 - DNA, 21 bp, Artificial Sequence
  Synthetic
gactugggtgaatucgcgaaa

SEQ ID NO: 60907 - DNA, 22 bp, Artificial Sequence
  Synthetic
gctgcagacacucatcgatgua

SEQ ID NO: 60908 - DNA, 21 bp, Artificial Sequence
  Synthetic
ggaagggucccagagauagca

SEQ ID NO: 60909 - DNA, 21 bp, Artificial Sequence
  Synthetic
gccgattguctccccttugat

SEQ ID NO: 60910 - DNA, 22 bp, Artificial Sequence
  Synthetic
gacaggccuggtcctagtcaua

SEQ ID NO: 60911 - DNA, 23 bp, Artificial Sequence
  Synthetic
ggtccaccacucactgttttgut

SEQ ID NO: 60912 - DNA, 29 bp, Artificial Sequence
  Synthetic
ggtgatcagccutttattggtacttacug

SEQ ID NO: 60913 - DNA, 28 bp, Artificial Sequence
  Synthetic
cccaggagtgguaggtctcataatuaaa

SEQ ID NO: 60914 - DNA, 28 bp, Artificial Sequence
  Synthetic
gggaaaatguagccaacatauacaaaga

SEQ ID NO: 60915 - DNA, 28 bp, Artificial Sequence
  Synthetic
cagtcagatgtcauactcaccaagaaua

SEQ ID NO: 60916 - DNA, 25 bp, Artificial Sequence
  Synthetic
cactgtttaaugcaggacgaaugaa

SEQ ID NO: 60917 - DNA, 31 bp, Artificial Sequence
  Synthetic
ctagtcatttctgugttatggacattaguct

SEQ ID NO: 60918 - DNA, 22 bp, Artificial Sequence
  Synthetic
tgtgcactgugtctcctgacua

SEQ ID NO: 60919 - DNA, 22 bp, Artificial Sequence
  Synthetic
cttgaagagacgcuggtcauct

SEQ ID NO: 60920 - DNA, 22 bp, Artificial Sequence
  Synthetic
ccugcaatccatugggaggaaa

SEQ ID NO: 60921 - DNA, 22 bp, Artificial Sequence
  Synthetic
cccaacatcgugctgatcttug

SEQ ID NO: 60922 - DNA, 21 bp, Artificial Sequence
  Synthetic
gcatgcaacauggcaagtugt

SEQ ID NO: 60923 - DNA, 26 bp, Artificial Sequence
  Synthetic
aacaccatacauagttccttctgtuc

SEQ ID NO: 60924 - DNA, 18 bp, Artificial Sequence
  Synthetic
ggcagcagaaggucccua

SEQ ID NO: 60925 - DNA, 18 bp, Artificial Sequence
  Synthetic
ccgagccuggctctacug

SEQ ID NO: 60926 - DNA, 24 bp, Artificial Sequence
  Synthetic
gcugagugggaaaaaggaagagaa

SEQ ID NO: 60927 - DNA, 22 bp, Artificial Sequence
  Synthetic
gcctttgaccgugacttttcug

SEQ ID NO: 60928 - DNA, 28 bp, Artificial Sequence
  Synthetic
agtaggacaccaagacuccatataucac

SEQ ID NO: 60929 - DNA, 29 bp, Artificial Sequence
  Synthetic
ggtaaccatgttcugttgaaattttccut

SEQ ID NO: 60930 - DNA, 28 bp, Artificial Sequence
  Synthetic
ggcggatgaattuctcttctatacagut

SEQ ID NO: 60931 - DNA, 33 bp, Artificial Sequence
  Synthetic
taaaattatcagtgaauccatttttgataggug

SEQ ID NO: 60932 - DNA, 25 bp, Artificial Sequence
  Synthetic
aaaagcacacacucatgactuacct

SEQ ID NO: 60933 - DNA, 27 bp, Artificial Sequence
  Synthetic
cctgtttgctccucttacgtttatcuc

SEQ ID NO: 60934 - DNA, 27 bp, Artificial Sequence
  Synthetic
tgtaactgtgacuccagctgtttatug

SEQ ID NO: 60935 - DNA, 25 bp, Artificial Sequence
  Synthetic
agaauatgaccgtcuaaagcagcag

SEQ ID NO: 60936 - DNA, 29 bp, Artificial Sequence
  Synthetic
ttttattgaaactugtcatgcatctugct

SEQ ID NO: 60937 - DNA, 25 bp, Artificial Sequence
  Synthetic
caacgcugaagaaccctgatacuaa

SEQ ID NO: 60938 - DNA, 28 bp, Artificial Sequence
  Synthetic
ttaccattggttutatcatggtccugaa

SEQ ID NO: 60939 - DNA, 28 bp, Artificial Sequence
  Synthetic
agttgaaggaaugcctagtaattuggat

SEQ ID NO: 60940 - DNA, 27 bp, Artificial Sequence
  Synthetic
tctacttcattuagccacttgttugct

SEQ ID NO: 60941 - DNA, 26 bp, Artificial Sequence
  Synthetic
gctgcatttugaattacctgcuacaa

SEQ ID NO: 60942 - DNA, 25 bp, Artificial Sequence
  Synthetic
actatttgcaatguccatccagguc

SEQ ID NO: 60943 - DNA, 25 bp, Artificial Sequence
  Synthetic
gcagtacaccuggtgttaggagtua

SEQ ID NO: 60944 - DNA, 26 bp, Artificial Sequence
  Synthetic
ccagttgtggutctcttcatctttuc

SEQ ID NO: 60945 - DNA, 23 bp, Artificial Sequence
  Synthetic
ccccaccaguaccaaaatuccaa

SEQ ID NO: 60946 - DNA, 24 bp, Artificial Sequence
  Synthetic
ccacttttccuccttaggctucac

SEQ ID NO: 60947 - DNA, 28 bp, Artificial Sequence
  Synthetic
gacttccctcucagacatattattgcuc

SEQ ID NO: 60948 - DNA, 24 bp, Artificial Sequence
  Synthetic
gacattgacccuagttccagtgut

SEQ ID NO: 60949 - DNA, 20 bp, Artificial Sequence
  Synthetic
cttccccucacagggcauag

SEQ ID NO: 60950 - DNA, 22 bp, Artificial Sequence
  Synthetic
tctgtcccauagggcaggatut

SEQ ID NO: 60951 - DNA, 24 bp, Artificial Sequence
  Synthetic
ggaagttcttcugttcctcctguc

SEQ ID NO: 60952 - DNA, 21 bp, Artificial Sequence
  Synthetic
accctgtgucctctgtctgut

SEQ ID NO: 60953 - DNA, 20 bp, Artificial Sequence
  Synthetic
cttgguccactcccuaagcc

SEQ ID NO: 60954 - DNA, 21 bp, Artificial Sequence
  Synthetic
cctgagactucccatcccugt

SEQ ID NO: 60955 - DNA, 22 bp, Artificial Sequence
  Synthetic
gatggaaucgaagccagcaauc

SEQ ID NO: 60956 - DNA, 21 bp, Artificial Sequence
  Synthetic
gcctgggautgtgagacuagg

SEQ ID NO: 60957 - DNA, 27 bp, Artificial Sequence
  Synthetic
cgggtaggatcuacaagagtaggatug

SEQ ID NO: 60958 - DNA, 28 bp, Artificial Sequence
  Synthetic
agatggagagcaauaagcttggtattuc

SEQ ID NO: 60959 - DNA, 28 bp, Artificial Sequence
  Synthetic
ggccaaccacaaaaauatccactaatuc

SEQ ID NO: 60960 - DNA, 29 bp, Artificial Sequence
  Synthetic
ctcagtggctautttgttccttttatugt

SEQ ID NO: 60961 - DNA, 27 bp, Artificial Sequence
  Synthetic
cactccaaaccuttaaagatcctggua

SEQ ID NO: 60962 - DNA, 23 bp, Artificial Sequence
  Synthetic
tctggaaaggugatguggaggat

SEQ ID NO: 60963 - DNA, 24 bp, Artificial Sequence
  Synthetic
tcactgttacuttcagcagtuccc

SEQ ID NO: 60964 - DNA, 22 bp, Artificial Sequence
  Synthetic
actcgtccutctcgaaaugcaa

SEQ ID NO: 60965 - DNA, 30 bp, Artificial Sequence
  Synthetic
aaatattttctttguacagctgctgtatuc

SEQ ID NO: 60966 - DNA, 25 bp, Artificial Sequence
  Synthetic
gaatgtgtgcagcuatcagtcttug

SEQ ID NO: 60967 - DNA, 27 bp, Artificial Sequence
  Synthetic
cctcatctggcutcagagaaggtauat

SEQ ID NO: 60968 - DNA, 25 bp, Artificial Sequence
  Synthetic
ggagaaaaagguggacaggaaguag

SEQ ID NO: 60969 - DNA, 21 bp, Artificial Sequence
  Synthetic
tgggtaaaggaguggcctgua

SEQ ID NO: 60970 - DNA, 33 bp, Artificial Sequence
  Synthetic
gaacaatgaguagtaataaatagugagacacaa

SEQ ID NO: 60971 - DNA, 21 bp, Artificial Sequence
  Synthetic
gacctggtguccctggaaauc

SEQ ID NO: 60972 - DNA, 26 bp, Artificial Sequence
  Synthetic
ctattttgaugggcttttucacacct

SEQ ID NO: 60973 - DNA, 28 bp, Artificial Sequence
  Synthetic
acaguaagaaaaggaauccacaccaaat

SEQ ID NO: 60974 - DNA, 21 bp, Artificial Sequence
  Synthetic
agtgccttucctttggtggut

SEQ ID NO: 60975 - DNA, 28 bp, Artificial Sequence
  Synthetic
aggtgggaaagauaagaaaaugagaagg

SEQ ID NO: 60976 - DNA, 20 bp, Artificial Sequence
  Synthetic
gccagtggccuactcaacua

SEQ ID NO: 60977 - DNA, 23 bp, Artificial Sequence
  Synthetic
atttggauccattgguccaggag

SEQ ID NO: 60978 - DNA, 22 bp, Artificial Sequence
  Synthetic
gggtaaaggtugtagccctgut

SEQ ID NO: 60979 - DNA, 27 bp, Artificial Sequence
  Synthetic
tctggcugaaagacagaatgaaaacut

SEQ ID NO: 60980 - DNA, 27 bp, Artificial Sequence
  Synthetic
tccataagagtggaucagagcttacut

SEQ ID NO: 60981 - DNA, 24 bp, Artificial Sequence
  Synthetic
gctgtggcgugtaataagaaaucc

SEQ ID NO: 60982 - DNA, 25 bp, Artificial Sequence
  Synthetic
aggctgaacccutagatcaaaggua

SEQ ID NO: 60983 - DNA, 26 bp, Artificial Sequence
  Synthetic
gccaacttucccatttttgatgtuga

SEQ ID NO: 60984 - DNA, 25 bp, Artificial Sequence
  Synthetic
cttgtgaggccagaauatatgcuca

SEQ ID NO: 60985 - DNA, 21 bp, Artificial Sequence
  Synthetic
gcggaucccacattgcuacat

SEQ ID NO: 60986 - DNA, 21 bp, Artificial Sequence
  Synthetic
cagucagugcaccaggaagaa

SEQ ID NO: 60987 - DNA, 28 bp, Artificial Sequence
  Synthetic
ggtagacttgcauttcaaatccttcuct

SEQ ID NO: 60988 - DNA, 21 bp, Artificial Sequence
  Synthetic
cacttgucccaagaggccaut

SEQ ID NO: 60989 - DNA, 28 bp, Artificial Sequence
  Synthetic
tgagtagatatccuaaaaggcagauggt

SEQ ID NO: 60990 - DNA, 23 bp, Artificial Sequence
  Synthetic
tgutactgaaguggaagggacca

SEQ ID NO: 60991 - DNA, 27 bp, Artificial Sequence
  Synthetic
gaggcccugttaattttcaatuccaat

SEQ ID NO: 60992 - DNA, 22 bp, Artificial Sequence
  Synthetic
gtagactgtuccttcacgcuga

SEQ ID NO: 60993 - DNA, 28 bp, Artificial Sequence
  Synthetic
gttcatcacauaccagacaatagcauct

SEQ ID NO: 60994 - DNA, 21 bp, Artificial Sequence
  Synthetic
tcaggttgtgugtccgaagut

SEQ ID NO: 60995 - DNA, 20 bp, Artificial Sequence
  Synthetic
ggctacgugctctccuacca

SEQ ID NO: 60996 - DNA, 20 bp, Artificial Sequence
  Synthetic
ggagggucggtgctugaaag

SEQ ID NO: 60997 - DNA, 23 bp, Artificial Sequence
  Synthetic
cgcaggtacutcatagaggaugg

SEQ ID NO: 60998 - DNA, 20 bp, Artificial Sequence
  Synthetic
tctgaguggttgucggaggt

SEQ ID NO: 60999 - DNA, 24 bp, Artificial Sequence
  Synthetic
tctccggauctactggaugaacag

SEQ ID NO: 61000 - DNA, 21 bp, Artificial Sequence
  Synthetic
gactgutccgtgaugacaggt

SEQ ID NO: 61001 - DNA, 24 bp, Artificial Sequence
  Synthetic
tctcccucttttcatgucccacaa

SEQ ID NO: 61002 - DNA, 21 bp, Artificial Sequence
  Synthetic
tggcacagtutggcacagtua

SEQ ID NO: 61003 - DNA, 21 bp, Artificial Sequence
  Synthetic
ctguagaccagcuccaacagg

SEQ ID NO: 61004 - DNA, 21 bp, Artificial Sequence
  Synthetic
ggcaugccagaatagcttugt

SEQ ID NO: 61005 - DNA, 21 bp, Artificial Sequence
  Synthetic
gcuaccacctcaugggaagag

SEQ ID NO: 61006 - DNA, 22 bp, Artificial Sequence
  Synthetic
ggtgaautcgaagguagcgagt

SEQ ID NO: 61007 - DNA, 28 bp, Artificial Sequence
  Synthetic
cctgtcagacaaccaauaaatgctauct

SEQ ID NO: 61008 - DNA, 24 bp, Artificial Sequence
  Synthetic
aagagcacaaacaagcucauacct

SEQ ID NO: 61009 - DNA, 22 bp, Artificial Sequence
  Synthetic
gcaugggcagcaaugaaaacat

SEQ ID NO: 61010 - DNA, 27 bp, Artificial Sequence
  Synthetic
ttgtaattccacugtccttaacucacc

SEQ ID NO: 61011 - DNA, 24 bp, Artificial Sequence
  Synthetic
tgtccctcagutcaagaaagtugt

SEQ ID NO: 61012 - DNA, 24 bp, Artificial Sequence
  Synthetic
gcctagugctcaguaagaaaaggt

SEQ ID NO: 61013 - DNA, 24 bp, Artificial Sequence
  Synthetic
gacgtaggacucaaagagatggut

SEQ ID NO: 61014 - DNA, 27 bp, Artificial Sequence
  Synthetic
gatttagccucaaagctgtagcattut

SEQ ID NO: 61015 - DNA, 22 bp, Artificial Sequence
  Synthetic
actcacatugatggcccaucat

SEQ ID NO: 61016 - DNA, 22 bp, Artificial Sequence
  Synthetic
ggaacttuaacccccucaacga

SEQ ID NO: 61017 - DNA, 20 bp, Artificial Sequence
  Synthetic
gttctgcugggagtgcauca

SEQ ID NO: 61018 - DNA, 20 bp, Artificial Sequence
  Synthetic
aggtgcagcagugagaugac

SEQ ID NO: 61019 - DNA, 21 bp, Artificial Sequence
  Synthetic
ttctaacgugctctgugccaa

SEQ ID NO: 61020 - DNA, 22 bp, Artificial Sequence
  Synthetic
gcaaccaggagagcautccuaa

SEQ ID NO: 61021 - DNA, 20 bp, Artificial Sequence
  Synthetic
gtgggcagcuctaggaaguc

SEQ ID NO: 61022 - DNA, 23 bp, Artificial Sequence
  Synthetic
ggccugaagggaattttgaugga

SEQ ID NO: 61023 - DNA, 21 bp, Artificial Sequence
  Synthetic
gcctccgcauctgatcttugg

SEQ ID NO: 61024 - DNA, 22 bp, Artificial Sequence
  Synthetic
ggagauggtgttcugggaaaga

SEQ ID NO: 61025 - DNA, 27 bp, Artificial Sequence
  Synthetic
gtgctgatcaauatcactccatuaggg

SEQ ID NO: 61026 - DNA, 22 bp, Artificial Sequence
  Synthetic
ggauccagacccaggcaauaac

SEQ ID NO: 61027 - DNA, 21 bp, Artificial Sequence
  Synthetic
gcccagtucccagtgucaaaa

SEQ ID NO: 61028 - DNA, 21 bp, Artificial Sequence
  Synthetic
gctgtgguggcttacactgua

SEQ ID NO: 61029 - DNA, 22 bp, Artificial Sequence
  Synthetic
gttagtgcagcguctcagaugt

SEQ ID NO: 61030 - DNA, 22 bp, Artificial Sequence
  Synthetic
tcugcaaatggucccagaacaa

SEQ ID NO: 61031 - DNA, 21 bp, Artificial Sequence
  Synthetic
ctgaagaacugcttuggcaca

SEQ ID NO: 61032 - DNA, 21 bp, Artificial Sequence
  Synthetic
gagggtgcgaucagtgatgut

SEQ ID NO: 61033 - DNA, 27 bp, Artificial Sequence
  Synthetic
gcagagcagugactgtatttcttctuc

SEQ ID NO: 61034 - DNA, 22 bp, Artificial Sequence
  Synthetic
actcccaccccaagaucttuct

SEQ ID NO: 61035 - DNA, 26 bp, Artificial Sequence
  Synthetic
gcaccactgaacuttctctcttttug

SEQ ID NO: 61036 - DNA, 23 bp, Artificial Sequence
  Synthetic
aacaggaccaacutcaaauccga

SEQ ID NO: 61037 - DNA, 23 bp, Artificial Sequence
  Synthetic
cuccacucagaagcccaagaaaa

SEQ ID NO: 61038 - DNA, 20 bp, Artificial Sequence
  Synthetic
aaccaatugggccagctgua

SEQ ID NO: 61039 - DNA, 25 bp, Artificial Sequence
  Synthetic
gtggattcaacugtttctcttuggg

SEQ ID NO: 61040 - DNA, 31 bp, Artificial Sequence
  Synthetic
tgtaaagaaattttaaugaccaggtagcugt

SEQ ID NO: 61041 - DNA, 27 bp, Artificial Sequence
  Synthetic
gccagtgacucaggataagaattucat

SEQ ID NO: 61042 - DNA, 22 bp, Artificial Sequence
  Synthetic
gggtgcccaauatcttgcagut

SEQ ID NO: 61043 - DNA, 27 bp, Artificial Sequence
  Synthetic
ccagctggaagugtaacttttgtuact

SEQ ID NO: 61044 - DNA, 21 bp, Artificial Sequence
  Synthetic
cugaggacauccacagggaat

SEQ ID NO: 61045 - DNA, 22 bp, Artificial Sequence
  Synthetic
gctatgagaguacacgcagugg

SEQ ID NO: 61046 - DNA, 23 bp, Artificial Sequence
  Synthetic
ctcctgctugttctttcttuggt

SEQ ID NO: 61047 - DNA, 22 bp, Artificial Sequence
  Synthetic
tttcucaaccccacagatgcuc

SEQ ID NO: 61048 - DNA, 27 bp, Artificial Sequence
  Synthetic
tcccatcaatttugttcttcagccaua

SEQ ID NO: 61049 - DNA, 25 bp, Artificial Sequence
  Synthetic
gagctcatcgutaaatacaggcuct

SEQ ID NO: 61050 - DNA, 26 bp, Artificial Sequence
  Synthetic
ggcttttcagcauttatgatgtguga

SEQ ID NO: 61051 - DNA, 24 bp, Artificial Sequence
  Synthetic
catcaaggatutcagctcagugac

SEQ ID NO: 61052 - DNA, 21 bp, Artificial Sequence
  Synthetic
cccacagugagttgtccauca

SEQ ID NO: 61053 - DNA, 26 bp, Artificial Sequence
  Synthetic
tgtgaaatacucacagcaacttccut

SEQ ID NO: 61054 - DNA, 29 bp, Artificial Sequence
  Synthetic
aagtcacaggaucaaagctaaaaggauag

SEQ ID NO: 61055 - DNA, 23 bp, Artificial Sequence
  Synthetic
aattcagcugggcatacctguag

SEQ ID NO: 61056 - DNA, 21 bp, Artificial Sequence
  Synthetic
gtaggagccagcugagaguct

SEQ ID NO: 61057 - DNA, 26 bp, Artificial Sequence
  Synthetic
aagttatcccttutgcttctgtccut

SEQ ID NO: 61058 - DNA, 29 bp, Artificial Sequence
  Synthetic
ttggagcaguacgcattcttaaataacua

SEQ ID NO: 61059 - DNA, 25 bp, Artificial Sequence
  Synthetic
tttcaaggaagutgtggagtuagca

SEQ ID NO: 61060 - DNA, 23 bp, Artificial Sequence
  Synthetic
attgatgcctuccctgtggaaut

SEQ ID NO: 61061 - DNA, 28 bp, Artificial Sequence
  Synthetic
tcacaaaagccuaccctatgtatgtcua

SEQ ID NO: 61062 - DNA, 24 bp, Artificial Sequence
  Synthetic
attaaatgccautggatguccagt

SEQ ID NO: 61063 - DNA, 25 bp, Artificial Sequence
  Synthetic
tgatauaccaacacccacaatucgt

SEQ ID NO: 61064 - DNA, 26 bp, Artificial Sequence
  Synthetic
tggcccttcuaaagttttcaaugaca

SEQ ID NO: 61065 - DNA, 21 bp, Artificial Sequence
  Synthetic
ctuaaccacacagccaucgac

SEQ ID NO: 61066 - DNA, 22 bp, Artificial Sequence
  Synthetic
acttaacacugcggaagucaca

SEQ ID NO: 61067 - DNA, 28 bp, Artificial Sequence
  Synthetic
cctgtatcgucacactgattctaagtut

SEQ ID NO: 61068 - DNA, 27 bp, Artificial Sequence
  Synthetic
tgggtctacauagaatatcccagugaa

SEQ ID NO: 61069 - DNA, 28 bp, Artificial Sequence
  Synthetic
gctcaaagcgaagcaugtacttatttua

SEQ ID NO: 61070 - DNA, 20 bp, Artificial Sequence
  Synthetic
agttugtcctgcucccgaag

SEQ ID NO: 61071 - DNA, 28 bp, Artificial Sequence
  Synthetic
actgccaaggutatattttcacacugat

SEQ ID NO: 61072 - DNA, 25 bp, Artificial Sequence
  Synthetic
cactttgagccagugacaaattgut

SEQ ID NO: 61073 - DNA, 27 bp, Artificial Sequence
  Synthetic
ccgtcttactcuacaatgctattggua

SEQ ID NO: 61074 - DNA, 20 bp, Artificial Sequence
  Synthetic
gggcgtuaggatgcagauca

SEQ ID NO: 61075 - DNA, 22 bp, Artificial Sequence
  Synthetic
gaaaguttccatcgugccaacc

SEQ ID NO: 61076 - DNA, 22 bp, Artificial Sequence
  Synthetic
ctaggctgtaaugcctccacug

SEQ ID NO: 61077 - DNA, 23 bp, Artificial Sequence
  Synthetic
ttgatgaacacuagggccaugag

SEQ ID NO: 61078 - DNA, 20 bp, Artificial Sequence
  Synthetic
ggaaggtguccggccuaaag

SEQ ID NO: 61079 - DNA, 28 bp, Artificial Sequence
  Synthetic
cctgtaacucagcaaacacaatttucat

SEQ ID NO: 61080 - DNA, 23 bp, Artificial Sequence
  Synthetic
gtctcttagaugtgcctacugct

SEQ ID NO: 61081 - DNA, 27 bp, Artificial Sequence
  Synthetic
gttgtatcggaaacgutgattgtctug

SEQ ID NO: 61082 - DNA, 20 bp, Artificial Sequence
  Synthetic
ggagacagcauggcccttua

SEQ ID NO: 61083 - DNA, 29 bp, Artificial Sequence
  Synthetic
tctcccttctaaautttgtgactctucag

SEQ ID NO: 61084 - DNA, 23 bp, Artificial Sequence
  Synthetic
gcctagccutctgctuaaacact

SEQ ID NO: 61085 - DNA, 28 bp, Artificial Sequence
  Synthetic
cggagattcaugctacaaacaaaaagut

SEQ ID NO: 61086 - DNA, 25 bp, Artificial Sequence
  Synthetic
gggcuaggaaaatatacaucccagt

SEQ ID NO: 61087 - DNA, 22 bp, Artificial Sequence
  Synthetic
ccaucaccaccatugacacaag

SEQ ID NO: 61088 - DNA, 28 bp, Artificial Sequence
  Synthetic
ctggttcgtcaguatagagttgaagtut

SEQ ID NO: 61089 - DNA, 28 bp, Artificial Sequence
  Synthetic
ttgctattaaagugtctcaaaccatuct

SEQ ID NO: 61090 - DNA, 19 bp, Artificial Sequence
  Synthetic
tgtcccccacguctcauct

SEQ ID NO: 61091 - DNA, 17 bp, Artificial Sequence
  Synthetic
caggccaacgugggcua

SEQ ID NO: 61092 - DNA, 23 bp, Artificial Sequence
  Synthetic
cgggaucaaaagaaagcgaagug

SEQ ID NO: 61093 - DNA, 22 bp, Artificial Sequence
  Synthetic
aacuacagatucccccacagga

SEQ ID NO: 61094 - DNA, 23 bp, Artificial Sequence
  Synthetic
gaactgtgcccaauccacattut

SEQ ID NO: 61095 - DNA, 23 bp, Artificial Sequence
  Synthetic
ggagaacacuttgactgcugaga

SEQ ID NO: 61096 - DNA, 23 bp, Artificial Sequence
  Synthetic
agatgttuagagcaccacugacc

SEQ ID NO: 61097 - DNA, 27 bp, Artificial Sequence
  Synthetic
tcatcaccagcuatttttcttccacut

SEQ ID NO: 61098 - DNA, 26 bp, Artificial Sequence
  Synthetic
caaaggcutcugacaaaggaaaaagt

SEQ ID NO: 61099 - DNA, 28 bp, Artificial Sequence
  Synthetic
tgcctttgagaguctttaccaagauaaa

SEQ ID NO: 61100 - DNA, 21 bp, Artificial Sequence
  Synthetic
acaggaaacguagccatuccc

SEQ ID NO: 61101 - DNA, 24 bp, Artificial Sequence
  Synthetic
aattcctucccatcttuccaccaa

SEQ ID NO: 61102 - DNA, 23 bp, Artificial Sequence
  Synthetic
caaaggcauggatugcacaaaga

SEQ ID NO: 61103 - DNA, 25 bp, Artificial Sequence
  Synthetic
ctaagaguttttctagcugcagcct

SEQ ID NO: 61104 - DNA, 21 bp, Artificial Sequence
  Synthetic
gctgcagucacagcugaaaag

SEQ ID NO: 61105 - DNA, 28 bp, Artificial Sequence
  Synthetic
cagaagaattggcutgatttttggaaug

SEQ ID NO: 61106 - DNA, 24 bp, Artificial Sequence
  Synthetic
ggacaucaucaaagcaaagagcag

SEQ ID NO: 61107 - DNA, 28 bp, Artificial Sequence
  Synthetic
ctgtttagagucatcatttcagguagca

SEQ ID NO: 61108 - DNA, 26 bp, Artificial Sequence
  Synthetic
aaggcttgatutgtcactaggucaaa

SEQ ID NO: 61109 - DNA, 22 bp, Artificial Sequence
  Synthetic
ccacaaaagccaautccucgac

SEQ ID NO: 61110 - DNA, 24 bp, Artificial Sequence
  Synthetic
cctctgttguaaccgtttgcatut

SEQ ID NO: 61111 - DNA, 29 bp, Artificial Sequence
  Synthetic
gtgattttccugggctccttttatcuaat

SEQ ID NO: 61112 - DNA, 24 bp, Artificial Sequence
  Synthetic
cctgttgguaaaggtttucccagt

SEQ ID NO: 61113 - DNA, 28 bp, Artificial Sequence
  Synthetic
cctgaagacacuctcacctataatgtuc

SEQ ID NO: 61114 - DNA, 29 bp, Artificial Sequence
  Synthetic
aatctgataaugattgtgaaucaccagga

SEQ ID NO: 61115 - DNA, 21 bp, Artificial Sequence
  Synthetic
tgaggaccaguagggcaugat

SEQ ID NO: 61116 - DNA, 19 bp, Artificial Sequence
  Synthetic
ggaccagccggugctaaug

SEQ ID NO: 61117 - DNA, 23 bp, Artificial Sequence
  Synthetic
cacagggaggautcgacuaacaa

SEQ ID NO: 61118 - DNA, 31 bp, Artificial Sequence
  Synthetic
gtataggatgagaaacutacacattgcuact

SEQ ID NO: 61119 - DNA, 20 bp, Artificial Sequence
  Synthetic
cccauccttgccuggagaac

SEQ ID NO: 61120 - DNA, 28 bp, Artificial Sequence
  Synthetic
ctgaaataccagcaugcattatuggaat

SEQ ID NO: 61121 - DNA, 23 bp, Artificial Sequence
  Synthetic
tgctacaggauttcctggttcug

SEQ ID NO: 61122 - DNA, 24 bp, Artificial Sequence
  Synthetic
gttctcctcttuccccaggattuc

SEQ ID NO: 61123 - DNA, 26 bp, Artificial Sequence
  Synthetic
aatttttccgcaguagaagccattuc

SEQ ID NO: 61124 - DNA, 21 bp, Artificial Sequence
  Synthetic
gaaauccggcaccucaaggat

SEQ ID NO: 61125 - DNA, 25 bp, Artificial Sequence
  Synthetic
tgaggtaaucagtaatcucgagcct

SEQ ID NO: 61126 - DNA, 22 bp, Artificial Sequence
  Synthetic
ccaaggucacagctaagtcugg

SEQ ID NO: 61127 - DNA, 20 bp, Artificial Sequence
  Synthetic
aacctgugggcaaacacuca

SEQ ID NO: 61128 - DNA, 22 bp, Artificial Sequence
  Synthetic
ggagtactucctgctcaagucc

SEQ ID NO: 61129 - DNA, 22 bp, Artificial Sequence
  Synthetic
acagaugggcugaaaaccaaga

SEQ ID NO: 61130 - DNA, 25 bp, Artificial Sequence
  Synthetic
atcgcttaauggactagaaggctut

SEQ ID NO: 61131 - DNA, 25 bp, Artificial Sequence
  Synthetic
ggagaccaaguttcagatgtuccag

SEQ ID NO: 61132 - DNA, 22 bp, Artificial Sequence
  Synthetic
ggctgaaggugaggcttaauag

SEQ ID NO: 61133 - DNA, 24 bp, Artificial Sequence
  Synthetic
agttgaccagcuttccttttcugt

SEQ ID NO: 61134 - DNA, 18 bp, Artificial Sequence
  Synthetic
ctggaguccacgcggaut

SEQ ID NO: 61135 - DNA, 21 bp, Artificial Sequence
  Synthetic
ggcgaaauggaccuagaggac

SEQ ID NO: 61136 - DNA, 22 bp, Artificial Sequence
  Synthetic
cctgcaggaggugtttcauaga

SEQ ID NO: 61137 - DNA, 21 bp, Artificial Sequence
  Synthetic
gctggaagggcugagatgaug

SEQ ID NO: 61138 - DNA, 28 bp, Artificial Sequence
  Synthetic
tttaagaccautgaagagtuggagaagg

SEQ ID NO: 61139 - DNA, 27 bp, Artificial Sequence
  Synthetic
agtcctgagaauaggaatgauggacat

SEQ ID NO: 61140 - DNA, 23 bp, Artificial Sequence
  Synthetic
gggagauggttaaauccacaaca

SEQ ID NO: 61141 - DNA, 25 bp, Artificial Sequence
  Synthetic
ccctgccacuagaaatatctgtcut

SEQ ID NO: 61142 - DNA, 21 bp, Artificial Sequence
  Synthetic
caagtucgcacctggaucact

SEQ ID NO: 61143 - DNA, 22 bp, Artificial Sequence
  Synthetic
tctgtgaagaagcuggctgaug

SEQ ID NO: 61144 - DNA, 22 bp, Artificial Sequence
  Synthetic
cccctccucctgtgtgtgtaua

SEQ ID NO: 61145 - DNA, 25 bp, Artificial Sequence
  Synthetic
ccagtgaacugtcaatgaaactucc

SEQ ID NO: 61146 - DNA, 21 bp, Artificial Sequence
  Synthetic
gggctguccaggguagaagaa

SEQ ID NO: 61147 - DNA, 24 bp, Artificial Sequence
  Synthetic
acaaaaggcuttgatucggaagga

SEQ ID NO: 61148 - DNA, 20 bp, Artificial Sequence
  Synthetic
ctccctaccccucaacggua

SEQ ID NO: 61149 - DNA, 20 bp, Artificial Sequence
  Synthetic
gggagtugacaggcagtuca

SEQ ID NO: 61150 - DNA, 28 bp, Artificial Sequence
  Synthetic
tttccttttctugggaagtctaaccaut

SEQ ID NO: 61151 - DNA, 28 bp, Artificial Sequence
  Synthetic
ggacacaggtcuagtaaatgatagccua

SEQ ID NO: 61152 - DNA, 27 bp, Artificial Sequence
  Synthetic
tgttatcagaucagatccagactguga

SEQ ID NO: 61153 - DNA, 29 bp, Artificial Sequence
  Synthetic
cagagtccataaaugcaagcagaaaatua

SEQ ID NO: 61154 - DNA, 19 bp, Artificial Sequence
  Synthetic
acuggagcagcagcttcut

SEQ ID NO: 61155 - DNA, 18 bp, Artificial Sequence
  Synthetic
gggcaaugccaagccuga

SEQ ID NO: 61156 - DNA, 24 bp, Artificial Sequence
  Synthetic
atgcagacgtutatgatcccctut

SEQ ID NO: 61157 - DNA, 28 bp, Artificial Sequence
  Synthetic
gaacatgtagaugacaaaagactcgtug

SEQ ID NO: 61158 - DNA, 27 bp, Artificial Sequence
  Synthetic
atcttatttgugacgcaagcattgtut

SEQ ID NO: 61159 - DNA, 25 bp, Artificial Sequence
  Synthetic
gttaagcgtacucgagaaatgctuc

SEQ ID NO: 61160 - DNA, 25 bp, Artificial Sequence
  Synthetic
agtcaatgcucatttggtgauggaa

SEQ ID NO: 61161 - DNA, 19 bp, Artificial Sequence
  Synthetic
gcaagggagcgugagacug

SEQ ID NO: 61162 - DNA, 17 bp, Artificial Sequence
  Synthetic
gcgcgcutccaggucaa

SEQ ID NO: 61163 - DNA, 17 bp, Artificial Sequence
  Synthetic
cgcggcuggaggaagug

SEQ ID NO: 61164 - DNA, 20 bp, Artificial Sequence
  Synthetic
cgagttugcacactcauggt

SEQ ID NO: 61165 - DNA, 23 bp, Artificial Sequence
  Synthetic
ctcctcaccuttcagcatctuca

SEQ ID NO: 61166 - DNA, 20 bp, Artificial Sequence
  Synthetic
gccaccuccagaaactguga

SEQ ID NO: 61167 - DNA, 19 bp, Artificial Sequence
  Synthetic
acaaagaguccgggcaugg

SEQ ID NO: 61168 - DNA, 18 bp, Artificial Sequence
  Synthetic
cccgcagugcataggtuc

SEQ ID NO: 61169 - DNA, 19 bp, Artificial Sequence
  Synthetic
ggaggucagacagctucca

SEQ ID NO: 61170 - DNA, 25 bp, Artificial Sequence
  Synthetic
actgcttataaguttgcactgcuct

SEQ ID NO: 61171 - DNA, 25 bp, Artificial Sequence
  Synthetic
tgtggaaaaacugatctgugaacct

SEQ ID NO: 61172 - DNA, 25 bp, Artificial Sequence
  Synthetic
tggctgtattcaugtgttgttgtug

SEQ ID NO: 61173 - DNA, 29 bp, Artificial Sequence
  Synthetic
cgaatttccaatauctcttccaccacaua

SEQ ID NO: 61174 - DNA, 27 bp, Artificial Sequence
  Synthetic
acctgtttggcuttgctattatgtuct

SEQ ID NO: 61175 - DNA, 28 bp, Artificial Sequence
  Synthetic
tgagaagcagugacaactctgatuaaat

SEQ ID NO: 61176 - DNA, 23 bp, Artificial Sequence
  Synthetic
atgtctctgugttgagggugaac

SEQ ID NO: 61177 - DNA, 27 bp, Artificial Sequence
  Synthetic
gtaccaaatcaaauccggttctccuaa

SEQ ID NO: 61178 - DNA, 24 bp, Artificial Sequence
  Synthetic
gtgaagcgcuatactgactgucat

SEQ ID NO: 61179 - DNA, 28 bp, Artificial Sequence
  Synthetic
tttaagaaagccautggtgttcctttut

SEQ ID NO: 61180 - DNA, 28 bp, Artificial Sequence
  Synthetic
aaataatcctgcutcttcctctgatugt

SEQ ID NO: 61181 - DNA, 27 bp, Artificial Sequence
  Synthetic
gcacatacttcuggctgacatcaatua

SEQ ID NO: 61182 - DNA, 24 bp, Artificial Sequence
  Synthetic
gttttgctggcacutctgttcaut

SEQ ID NO: 61183 - DNA, 23 bp, Artificial Sequence
  Synthetic
ccaatcagatugctgtcctgtut

SEQ ID NO: 61184 - DNA, 23 bp, Artificial Sequence
  Synthetic
gccaagtccuctgaaagaauccc

SEQ ID NO: 61185 - DNA, 21 bp, Artificial Sequence
  Synthetic
gagctctccaugagcgatguc

SEQ ID NO: 61186 - DNA, 21 bp, Artificial Sequence
  Synthetic
ggccgaggaacutgagtuaga

SEQ ID NO: 61187 - DNA, 25 bp, Artificial Sequence
  Synthetic
gtgtcagccuatccactaattugga

SEQ ID NO: 61188 - DNA, 27 bp, Artificial Sequence
  Synthetic
ttggagaagugacttcctttcttugaa

SEQ ID NO: 61189 - DNA, 24 bp, Artificial Sequence
  Synthetic
tgttgaaaaccugggtcacatuct

SEQ ID NO: 61190 - DNA, 21 bp, Artificial Sequence
  Synthetic
cttcatagccgutcggctuct

SEQ ID NO: 61191 - DNA, 28 bp, Artificial Sequence
  Synthetic
ccaaacaaguttagatgaguagagcaca

SEQ ID NO: 61192 - DNA, 21 bp, Artificial Sequence
  Synthetic
cccgacucacatactcgucca

SEQ ID NO: 61193 - DNA, 20 bp, Artificial Sequence
  Synthetic
ggagugcguccgaaaagaac

SEQ ID NO: 61194 - DNA, 21 bp, Artificial Sequence
  Synthetic
gggacacuccccacatgtuac

SEQ ID NO: 61195 - DNA, 28 bp, Artificial Sequence
  Synthetic
gctctaaagtggaaauttcaccaagtuc

SEQ ID NO: 61196 - DNA, 24 bp, Artificial Sequence
  Synthetic
gagaagcagagcacaauaugaagg

SEQ ID NO: 61197 - DNA, 25 bp, Artificial Sequence
  Synthetic
ctgaatttgcaugcctgtacttcut

SEQ ID NO: 61198 - DNA, 22 bp, Artificial Sequence
  Synthetic
tggcctcugagcaccttttauc

SEQ ID NO: 61199 - DNA, 29 bp, Artificial Sequence
  Synthetic
tgttccatatuacagatctctcgtgucat

SEQ ID NO: 61200 - DNA, 21 bp, Artificial Sequence
  Synthetic
agaaagcugctccucacacag

SEQ ID NO: 61201 - DNA, 26 bp, Artificial Sequence
  Synthetic
tgcatcattcauccttgggctttaut

SEQ ID NO: 61202 - DNA, 26 bp, Artificial Sequence
  Synthetic
ctctcttgcagaaaugatggactcut

SEQ ID NO: 61203 - DNA, 28 bp, Artificial Sequence
  Synthetic
gtaggacacaucactagagtaacugagt

SEQ ID NO: 61204 - DNA, 24 bp, Artificial Sequence
  Synthetic
cattgagccagaacacuagctgua

SEQ ID NO: 61205 - DNA, 25 bp, Artificial Sequence
  Synthetic
ctactcatcccugaggaaacaucac

SEQ ID NO: 61206 - DNA, 28 bp, Artificial Sequence
  Synthetic
ggtaatatatauaaggtgcgtgcttuga

SEQ ID NO: 61207 - DNA, 29 bp, Artificial Sequence
  Synthetic
cgctctaauaaatcaatctguccagaaga

SEQ ID NO: 61208 - DNA, 27 bp, Artificial Sequence
  Synthetic
agaatgatttgacauaaccctgagcut

SEQ ID NO: 61209 - DNA, 27 bp, Artificial Sequence
  Synthetic
aagaaaggcaauttactaacctcugct

SEQ ID NO: 61210 - DNA, 25 bp, Artificial Sequence
  Synthetic
ctgtagatggugcacttgcatttut

SEQ ID NO: 61211 - DNA, 24 bp, Artificial Sequence
  Synthetic
cctgtggtccucatttgtagcuat

SEQ ID NO: 61212 - DNA, 25 bp, Artificial Sequence
  Synthetic
gaagaagtgucagccattcauacct

SEQ ID NO: 61213 - DNA, 29 bp, Artificial Sequence
  Synthetic
gaacatgtcctatutgaattttccgacut

SEQ ID NO: 61214 - DNA, 22 bp, Artificial Sequence
  Synthetic
ctcuggaaggcaaagtcctuca

SEQ ID NO: 61215 - DNA, 25 bp, Artificial Sequence
  Synthetic
gaaacacatucctgctguccaaaat

SEQ ID NO: 61216 - DNA, 22 bp, Artificial Sequence
  Synthetic
ccaggttcutccagatgcugat

SEQ ID NO: 61217 - DNA, 28 bp, Artificial Sequence
  Synthetic
gcctctttctcutggttttcatttgaut

SEQ ID NO: 61218 - DNA, 22 bp, Artificial Sequence
  Synthetic
ccttcaagcaaacaugcctuca

SEQ ID NO: 61219 - DNA, 23 bp, Artificial Sequence
  Synthetic
ctgtttgaccutcactagggcut

SEQ ID NO: 61220 - DNA, 19 bp, Artificial Sequence
  Synthetic
gcagcagcgaggagucauc

SEQ ID NO: 61221 - DNA, 23 bp, Artificial Sequence
  Synthetic
agtgggagaacaaguccugagaa

SEQ ID NO: 61222 - DNA, 21 bp, Artificial Sequence
  Synthetic
cuagtgauggaggccccaaaa

SEQ ID NO: 61223 - DNA, 28 bp, Artificial Sequence
  Synthetic
tttgttgatacacugtaggatccaacuc

SEQ ID NO: 61224 - DNA, 19 bp, Artificial Sequence
  Synthetic
ctgttgaggugggaucggt

SEQ ID NO: 61225 - DNA, 23 bp, Artificial Sequence
  Synthetic
gccaacaacaacutcgtgaacut

SEQ ID NO: 61226 - DNA, 22 bp, Artificial Sequence
  Synthetic
agugttggactugcagaacagt

SEQ ID NO: 61227 - DNA, 21 bp, Artificial Sequence
  Synthetic
tcgagattuagcgcaaggcut

SEQ ID NO: 61228 - DNA, 22 bp, Artificial Sequence
  Synthetic
gcagaggtcucaggaagtcuga

SEQ ID NO: 61229 - DNA, 25 bp, Artificial Sequence
  Synthetic
tcagctgcagaaucctgaaatgaut

SEQ ID NO: 61230 - DNA, 22 bp, Artificial Sequence
  Synthetic
gggugaaaucacaaaggagcga

SEQ ID NO: 61231 - DNA, 27 bp, Artificial Sequence
  Synthetic
cctgagtatgauggagagaacgaguag

SEQ ID NO: 61232 - DNA, 27 bp, Artificial Sequence
  Synthetic
tctttctttctauggagggatcugagg

SEQ ID NO: 61233 - DNA, 28 bp, Artificial Sequence
  Synthetic
cagaaagtcgaugcacttgagaaauaaa

SEQ ID NO: 61234 - DNA, 25 bp, Artificial Sequence
  Synthetic
acgaagaccaccaucaaggagauat

SEQ ID NO: 61235 - DNA, 24 bp, Artificial Sequence
  Synthetic
tuctgcattatcucagagccacag

SEQ ID NO: 61236 - DNA, 19 bp, Artificial Sequence
  Synthetic
ggtggugacgaacgtguga

SEQ ID NO: 61237 - DNA, 21 bp, Artificial Sequence
  Synthetic
cttcuacgcagggacucaacc

SEQ ID NO: 61238 - DNA, 19 bp, Artificial Sequence
  Synthetic
gggatcucgcgcttctugg

SEQ ID NO: 61239 - DNA, 20 bp, Artificial Sequence
  Synthetic
aagagccuggatccccuaca

SEQ ID NO: 61240 - DNA, 23 bp, Artificial Sequence
  Synthetic
cagtgagaugaggatctgctcut

SEQ ID NO: 61241 - DNA, 21 bp, Artificial Sequence
  Synthetic
agagactucccccttgtucct

SEQ ID NO: 61242 - DNA, 17 bp, Artificial Sequence
  Synthetic
accugucaccccgacga

SEQ ID NO: 61243 - DNA, 21 bp, Artificial Sequence
  Synthetic
gggacaguttgaccactucct

SEQ ID NO: 61244 - DNA, 23 bp, Artificial Sequence
  Synthetic
gggtaaccagagaugaggacuga

SEQ ID NO: 61245 - DNA, 21 bp, Artificial Sequence
  Synthetic
agcgagaggucacagtcuaca

SEQ ID NO: 61246 - DNA, 25 bp, Artificial Sequence
  Synthetic
cagtgacatgcuctttctaggtcut

SEQ ID NO: 61247 - DNA, 24 bp, Artificial Sequence
  Synthetic
gcacaagtacaagaugcacctgua

SEQ ID NO: 61248 - DNA, 21 bp, Artificial Sequence
  Synthetic
gtggaggcuttggcaaaauga

SEQ ID NO: 61249 - DNA, 21 bp, Artificial Sequence
  Synthetic
tggaucccgaccggaagtaua

SEQ ID NO: 61250 - DNA, 22 bp, Artificial Sequence
  Synthetic
acacccatatucccaggtcugt

SEQ ID NO: 61251 - DNA, 20 bp, Artificial Sequence
  Synthetic
caagattcccugggccauct

SEQ ID NO: 61252 - DNA, 22 bp, Artificial Sequence
  Synthetic
ctcacatagaucacagcugcca

SEQ ID NO: 61253 - DNA, 25 bp, Artificial Sequence
  Synthetic
acccttguaggaagctctcuaaact

SEQ ID NO: 61254 - DNA, 21 bp, Artificial Sequence
  Synthetic
cctcacctccugcctgtctua

SEQ ID NO: 61255 - DNA, 24 bp, Artificial Sequence
  Synthetic
gctcccautctatagcaugaaggg

SEQ ID NO: 61256 - DNA, 27 bp, Artificial Sequence
  Synthetic
ttctgaaaacaaagutgcaaaguggaa

SEQ ID NO: 61257 - DNA, 21 bp, Artificial Sequence
  Synthetic
aagctttggguttgccaacug

SEQ ID NO: 61258 - DNA, 24 bp, Artificial Sequence
  Synthetic
gcctacgtugaccaactcttcuat

SEQ ID NO: 61259 - DNA, 28 bp, Artificial Sequence
  Synthetic
tcactgtgauggtttcagtctuagaaaa

SEQ ID NO: 61260 - DNA, 28 bp, Artificial Sequence
  Synthetic
cagcacatguaattttgttgtgatugac

SEQ ID NO: 61261 - DNA, 26 bp, Artificial Sequence
  Synthetic
agacctttgcugtaacatgctgtaut

SEQ ID NO: 61262 - DNA, 27 bp, Artificial Sequence
  Synthetic
gacagccaaaacauagatgaattuccc

SEQ ID NO: 61263 - DNA, 28 bp, Artificial Sequence
  Synthetic
tctttcttuccagcaaccttatcauaca

SEQ ID NO: 61264 - DNA, 23 bp, Artificial Sequence
  Synthetic
ccagaaagttuccctcctccauc

SEQ ID NO: 61265 - DNA, 22 bp, Artificial Sequence
  Synthetic
actcacagcuggtttccugaaa

SEQ ID NO: 61266 - DNA, 28 bp, Artificial Sequence
  Synthetic
atggtgccattuattacaacagaatgug

SEQ ID NO: 61267 - DNA, 28 bp, Artificial Sequence
  Synthetic
aaauttcagtaccacuaaaacagaaggt

SEQ ID NO: 61268 - DNA, 24 bp, Artificial Sequence
  Synthetic
tcctcttcaccuctttctgtcugt

SEQ ID NO: 61269 - DNA, 27 bp, Artificial Sequence
  Synthetic
gaaaatctgtuttgtgagtguccaagg

SEQ ID NO: 61270 - DNA, 28 bp, Artificial Sequence
  Synthetic
tcactactgctautttacctgcaatugt

SEQ ID NO: 61271 - DNA, 28 bp, Artificial Sequence
  Synthetic
ccctgaccagtutgaagcaagaataaua

SEQ ID NO: 61272 - DNA, 23 bp, Artificial Sequence
  Synthetic
ggtcctugctctcctaucaggaa

SEQ ID NO: 61273 - DNA, 24 bp, Artificial Sequence
  Synthetic
gcttucagcaaaacacagtctuct

SEQ ID NO: 61274 - DNA, 23 bp, Artificial Sequence
  Synthetic
tcaaaagtatguccaggcccauc

SEQ ID NO: 61275 - DNA, 25 bp, Artificial Sequence
  Synthetic
agtcagcacauggatttactugcat

SEQ ID NO: 61276 - DNA, 20 bp, Artificial Sequence
  Synthetic
gcagaggccaugcactgaua

SEQ ID NO: 61277 - DNA, 27 bp, Artificial Sequence
  Synthetic
tgcaccccacaacuatcttcatuaaat

SEQ ID NO: 61278 - DNA, 24 bp, Artificial Sequence
  Synthetic
agttgatgcugagcagttuacagt

SEQ ID NO: 61279 - DNA, 28 bp, Artificial Sequence
  Synthetic
gctttttggcuaagatcacaggtatgua

SEQ ID NO: 61280 - DNA, 21 bp, Artificial Sequence
  Synthetic
gggauggagtcuccaaaggga

SEQ ID NO: 61281 - DNA, 25 bp, Artificial Sequence
  Synthetic
ctggtttgauagtgtgcaattgugt

SEQ ID NO: 61282 - DNA, 21 bp, Artificial Sequence
  Synthetic
gagacccuggtcctctcugaa

SEQ ID NO: 61283 - DNA, 25 bp, Artificial Sequence
  Synthetic
tgctccacuaacctatgtctgcuat

SEQ ID NO: 61284 - DNA, 21 bp, Artificial Sequence
  Synthetic
tctcacctugaggctcaccua

SEQ ID NO: 61285 - DNA, 27 bp, Artificial Sequence
  Synthetic
actgtuggcaaacaaagaaaaucaact

SEQ ID NO: 61286 - DNA, 32 bp, Artificial Sequence
  Synthetic
cagcaatttgcauaatatctttctttguacct

SEQ ID NO: 61287 - DNA, 24 bp, Artificial Sequence
  Synthetic
aggcactugttacagacuggaaaa

SEQ ID NO: 61288 - DNA, 19 bp, Artificial Sequence
  Synthetic
tgcagctugccatctugga

SEQ ID NO: 61289 - DNA, 19 bp, Artificial Sequence
  Synthetic
cgcugcggaagatcauccc

SEQ ID NO: 61290 - DNA, 24 bp, Artificial Sequence
  Synthetic
accctctgatugaagatgagcuga

SEQ ID NO: 61291 - DNA, 20 bp, Artificial Sequence
  Synthetic
gtgctctcucctgggaggua

SEQ ID NO: 61292 - DNA, 28 bp, Artificial Sequence
  Synthetic
tccctctctggauacctggaaaattuat

SEQ ID NO: 61293 - DNA, 25 bp, Artificial Sequence
  Synthetic
gcctctctguctagggaaggttuaa

SEQ ID NO: 61294 - DNA, 24 bp, Artificial Sequence
  Synthetic
ccgacagagagcuactgaugaact

SEQ ID NO: 61295 - DNA, 27 bp, Artificial Sequence
  Synthetic
gattatttcaccuctgcacttaccuct

SEQ ID NO: 61296 - DNA, 27 bp, Artificial Sequence
  Synthetic
ttgtttgacguaagctagtuaccaagt

SEQ ID NO: 61297 - DNA, 26 bp, Artificial Sequence
  Synthetic
cgctgtgtauggattttctgcatuaa

SEQ ID NO: 61298 - DNA, 24 bp, Artificial Sequence
  Synthetic
gcaaatgaagagcutgaggcctua

SEQ ID NO: 61299 - DNA, 28 bp, Artificial Sequence
  Synthetic
ctccacaaacugcatatguaaaagaact

SEQ ID NO: 61300 - DNA, 22 bp, Artificial Sequence
  Synthetic
catuggcaccagctgaugaaag

SEQ ID NO: 61301 - DNA, 25 bp, Artificial Sequence
  Synthetic
gcataacacagcaaguagaggcuat

SEQ ID NO: 61302 - DNA, 28 bp, Artificial Sequence
  Synthetic
tttgcctttatuttaggttcagtugcag

SEQ ID NO: 61303 - DNA, 21 bp, Artificial Sequence
  Synthetic
ccaagtucgctggactuccat

SEQ ID NO: 61304 - DNA, 26 bp, Artificial Sequence
  Synthetic
actaugacaaagagcacatuccagag

SEQ ID NO: 61305 - DNA, 26 bp, Artificial Sequence
  Synthetic
ccctttguggagaacatctguaaaca

SEQ ID NO: 61306 - DNA, 25 bp, Artificial Sequence
  Synthetic
accauaggtgatugaagccaaagaa

SEQ ID NO: 61307 - DNA, 28 bp, Artificial Sequence
  Synthetic
caatgtuccagaaacaaattgaacucct

SEQ ID NO: 61308 - DNA, 23 bp, Artificial Sequence
  Synthetic
tcctctcacccuccttcauagac

SEQ ID NO: 61309 - DNA, 26 bp, Artificial Sequence
  Synthetic
cccagtgtctuccctgaaacttaaua

SEQ ID NO: 61310 - DNA, 21 bp, Artificial Sequence
  Synthetic
ggaggccacaucacagaugac

SEQ ID NO: 61311 - DNA, 26 bp, Artificial Sequence
  Synthetic
aaggccaagcaucctcaataacatua

SEQ ID NO: 61312 - DNA, 29 bp, Artificial Sequence
  Synthetic
aactgtgttatctutgcattgcatttcut

SEQ ID NO: 61313 - DNA, 22 bp, Artificial Sequence
  Synthetic
ccacguacagaaaaccctugga

SEQ ID NO: 61314 - DNA, 25 bp, Artificial Sequence
  Synthetic
acaggtaaatggutgcagttttgug

SEQ ID NO: 61315 - DNA, 28 bp, Artificial Sequence
  Synthetic
cagaaagaagtacaugcaggaaaaagut

SEQ ID NO: 61316 - DNA, 28 bp, Artificial Sequence
  Synthetic
agcagtctctugtaaattcaaagucaga

SEQ ID NO: 61317 - DNA, 28 bp, Artificial Sequence
  Synthetic
ctgcttcaagtugtgcaaatttttctug

SEQ ID NO: 61318 - DNA, 28 bp, Artificial Sequence
  Synthetic
gaagagaacagggaauaactuagaaggg

SEQ ID NO: 61319 - DNA, 28 bp, Artificial Sequence
  Synthetic
tggaaggtttucttctccaaatucaagt

SEQ ID NO: 61320 - DNA, 25 bp, Artificial Sequence
  Synthetic
ggttggaaugatggaaagtttugct

SEQ ID NO: 61321 - DNA, 29 bp, Artificial Sequence
  Synthetic
tcctgcucaagacgatctattataucagt

SEQ ID NO: 61322 - DNA, 23 bp, Artificial Sequence
  Synthetic
ttgctacaacutgagagcacugt

SEQ ID NO: 61323 - DNA, 24 bp, Artificial Sequence
  Synthetic
tttgcatattccugaactgccuca

SEQ ID NO: 61324 - DNA, 23 bp, Artificial Sequence
  Synthetic
tcaattccugagctagcacatuc

SEQ ID NO: 61325 - DNA, 28 bp, Artificial Sequence
  Synthetic
accccagtctgauccagaatctaaaaua

SEQ ID NO: 61326 - DNA, 22 bp, Artificial Sequence
  Synthetic
gcactccagcugatttcaaucc

SEQ ID NO: 61327 - DNA, 23 bp, Artificial Sequence
  Synthetic
tgctgccaagaugtggtuaaact

SEQ ID NO: 61328 - DNA, 23 bp, Artificial Sequence
  Synthetic
agagaatccacgucctctagcut

SEQ ID NO: 61329 - DNA, 19 bp, Artificial Sequence
  Synthetic
gggccagagutacucagca

SEQ ID NO: 61330 - DNA, 27 bp, Artificial Sequence
  Synthetic
agtgtattaccugattaggaggcugaa

SEQ ID NO: 61331 - DNA, 29 bp, Artificial Sequence
  Synthetic
cttttcctaagcutttgcactatatugct

SEQ ID NO: 61332 - DNA, 22 bp, Artificial Sequence
  Synthetic
gcgtgtcuttggctgaauaagg

SEQ ID NO: 61333 - DNA, 23 bp, Artificial Sequence
  Synthetic
agccattttucctgtttgggtug

SEQ ID NO: 61334 - DNA, 18 bp, Artificial Sequence
  Synthetic
ctggtccaccuggtccuc

SEQ ID NO: 61335 - DNA, 27 bp, Artificial Sequence
  Synthetic
gagaatggguaaagcagaatctugagt

SEQ ID NO: 61336 - DNA, 21 bp, Artificial Sequence
  Synthetic
ctggtggugggtgtgtcatua

SEQ ID NO: 61337 - DNA, 28 bp, Artificial Sequence
  Synthetic
gtgtgatttgcucagaatcagttugaaa

SEQ ID NO: 61338 - DNA, 24 bp, Artificial Sequence
  Synthetic
catcagttguatgttcccctugga

SEQ ID NO: 61339 - DNA, 27 bp, Artificial Sequence
  Synthetic
cgatggttcuacattgatttuggagga

SEQ ID NO: 61340 - DNA, 20 bp, Artificial Sequence
  Synthetic
tgattgcugccctcctccua

SEQ ID NO: 61341 - DNA, 28 bp, Artificial Sequence
  Synthetic
tggctatttcttcutgaatctttcccut

SEQ ID NO: 61342 - DNA, 25 bp, Artificial Sequence
  Synthetic
atttacagagaucagagagcuggga

SEQ ID NO: 61343 - DNA, 27 bp, Artificial Sequence
  Synthetic
tgaggtggaaguctaccatgauaaaca

SEQ ID NO: 61344 - DNA, 26 bp, Artificial Sequence
  Synthetic
aggaagatgugcctttcaaatucaga

SEQ ID NO: 61345 - DNA, 28 bp, Artificial Sequence
  Synthetic
gcaaatgcttgcuagaccaataatuagt

SEQ ID NO: 61346 - DNA, 28 bp, Artificial Sequence
  Synthetic
tcttaaagctgugtctgtaaactgaugg

SEQ ID NO: 61347 - DNA, 27 bp, Artificial Sequence
  Synthetic
aatcacatcccaugagttttgagcuaa

SEQ ID NO: 61348 - DNA, 24 bp, Artificial Sequence
  Synthetic
gacacactutgtccacttugcaat

SEQ ID NO: 61349 - DNA, 26 bp, Artificial Sequence
  Synthetic
gttgcaacaaagaugtagggttguaa

SEQ ID NO: 61350 - DNA, 22 bp, Artificial Sequence
  Synthetic
agcagaggcutaaggagcuaca

SEQ ID NO: 61351 - DNA, 20 bp, Artificial Sequence
  Synthetic
ttctcagagggcaguccgua

SEQ ID NO: 61352 - DNA, 23 bp, Artificial Sequence
  Synthetic
gcttccagaggcaucattcacua

SEQ ID NO: 61353 - DNA, 26 bp, Artificial Sequence
  Synthetic
agtgcaataagcuggaaatacuggag

SEQ ID NO: 61354 - DNA, 18 bp, Artificial Sequence
  Synthetic
gtgggacuggacgagcut

SEQ ID NO: 61355 - DNA, 18 bp, Artificial Sequence
  Synthetic
tgccugagcgctcttucc

SEQ ID NO: 61356 - DNA, 17 bp, Artificial Sequence
  Synthetic
aggcaagggcgugtugt

SEQ ID NO: 61357 - DNA, 19 bp, Artificial Sequence
  Synthetic
gcgtggcutccacctctuc

SEQ ID NO: 61358 - DNA, 21 bp, Artificial Sequence
  Synthetic
ccaacgaaugaccacaggcut

SEQ ID NO: 61359 - DNA, 21 bp, Artificial Sequence
  Synthetic
gttgccaccauggactctuca

SEQ ID NO: 61360 - DNA, 20 bp, Artificial Sequence
  Synthetic
cactggttguggtccacuca

SEQ ID NO: 61361 - DNA, 21 bp, Artificial Sequence
  Synthetic
ctttuccaggcacugcagaac

SEQ ID NO: 61362 - DNA, 24 bp, Artificial Sequence
  Synthetic
gctgcctuctcttttcaucacagt

SEQ ID NO: 61363 - DNA, 21 bp, Artificial Sequence
  Synthetic
tgccacccuacctagtgtcug

SEQ ID NO: 61364 - DNA, 28 bp, Artificial Sequence
  Synthetic
aggtctttttgutggaattcattuaagg

SEQ ID NO: 61365 - DNA, 26 bp, Artificial Sequence
  Synthetic
cttcctcagagautgaagtcaacugt

SEQ ID NO: 61366 - DNA, 28 bp, Artificial Sequence
  Synthetic
actgaggcccagcaauaatttaaactua

SEQ ID NO: 61367 - DNA, 28 bp, Artificial Sequence
  Synthetic
gttgtcttctacuccatcttcaaaucca

SEQ ID NO: 61368 - DNA, 30 bp, Artificial Sequence
  Synthetic
tccaaagaatcaauagacaagtctgtgtut

SEQ ID NO: 61369 - DNA, 24 bp, Artificial Sequence
  Synthetic
ccaaataaactgugcctgcgauat

SEQ ID NO: 61370 - DNA, 26 bp, Artificial Sequence
  Synthetic
aaacattgacacguaccttauccaca

SEQ ID NO: 61371 - DNA, 28 bp, Artificial Sequence
  Synthetic
ggatatgcaaautgaacaaacugacact

SEQ ID NO: 61372 - DNA, 25 bp, Artificial Sequence
  Synthetic
aggautataggcttugagggcaaac

SEQ ID NO: 61373 - DNA, 23 bp, Artificial Sequence
  Synthetic
ggcatttgcugacccataggaut

SEQ ID NO: 61374 - DNA, 21 bp, Artificial Sequence
  Synthetic
gtgugttttctgugcacggat

SEQ ID NO: 61375 - DNA, 28 bp, Artificial Sequence
  Synthetic
cctgccaatagaugtgaaactgacauaa

SEQ ID NO: 61376 - DNA, 18 bp, Artificial Sequence
  Synthetic
cugcagcaacggagagug

SEQ ID NO: 61377 - DNA, 18 bp, Artificial Sequence
  Synthetic
ccaggcuggagagtggut

SEQ ID NO: 61378 - DNA, 28 bp, Artificial Sequence
  Synthetic
attaaaaactgaugcctcttggtacuca

SEQ ID NO: 61379 - DNA, 25 bp, Artificial Sequence
  Synthetic
ggcaaagacacautgatttggtuct

SEQ ID NO: 61380 - DNA, 27 bp, Artificial Sequence
  Synthetic
tgtatgacaucttcaggguaaacaagg

SEQ ID NO: 61381 - DNA, 28 bp, Artificial Sequence
  Synthetic
tcatcctcactgugtgctatgttttaut

SEQ ID NO: 61382 - DNA, 24 bp, Artificial Sequence
  Synthetic
cctgtccugggatgatcctuagaa

SEQ ID NO: 61383 - DNA, 23 bp, Artificial Sequence
  Synthetic
gagatccaaagugcagagtcucc

SEQ ID NO: 61384 - DNA, 23 bp, Artificial Sequence
  Synthetic
tgagtggacuggtacatgcttug

SEQ ID NO: 61385 - DNA, 32 bp, Artificial Sequence
  Synthetic
aaaacaacctttautgtcactctttaugcaat

SEQ ID NO: 61386 - DNA, 27 bp, Artificial Sequence
  Synthetic
ctatctcaacagcucaaatctguacct

SEQ ID NO: 61387 - DNA, 21 bp, Artificial Sequence
  Synthetic
cggtacaaucccaggatccuc

SEQ ID NO: 61388 - DNA, 27 bp, Artificial Sequence
  Synthetic
tgctgttcacaguataaggaatauggg

SEQ ID NO: 61389 - DNA, 26 bp, Artificial Sequence
  Synthetic
agtgattttggcutttgtcctctuct

SEQ ID NO: 61390 - DNA, 20 bp, Artificial Sequence
  Synthetic
ccagaaagcuaggtcggugt

SEQ ID NO: 61391 - DNA, 21 bp, Artificial Sequence
  Synthetic
ccattggtgaugagcccttug

SEQ ID NO: 61392 - DNA, 22 bp, Artificial Sequence
  Synthetic
tgggagggcagaaucaggaaua

SEQ ID NO: 61393 - DNA, 29 bp, Artificial Sequence
  Synthetic
cagagaccaagaucactgataagaaaugt

SEQ ID NO: 61394 - DNA, 20 bp, Artificial Sequence
  Synthetic
caacgacggcugtcccuaaa

SEQ ID NO: 61395 - DNA, 22 bp, Artificial Sequence
  Synthetic
catcagaaggaaggugtgcgua

SEQ ID NO: 61396 - DNA, 21 bp, Artificial Sequence
  Synthetic
ccugcagatttuccagcggat

SEQ ID NO: 61397 - DNA, 20 bp, Artificial Sequence
  Synthetic
gggatgagcgutccaaccut

SEQ ID NO: 61398 - DNA, 20 bp, Artificial Sequence
  Synthetic
tcccttguagcctguccagt

SEQ ID NO: 61399 - DNA, 23 bp, Artificial Sequence
  Synthetic
gcagaagtcccucaagaggtcua

SEQ ID NO: 61400 - DNA, 23 bp, Artificial Sequence
  Synthetic
acatttctgttuccacagggugt

SEQ ID NO: 61401 - DNA, 22 bp, Artificial Sequence
  Synthetic
gcucagacucagccaagaaacc

SEQ ID NO: 61402 - DNA, 25 bp, Artificial Sequence
  Synthetic
agttcaaagaacucaggttcggtut

SEQ ID NO: 61403 - DNA, 24 bp, Artificial Sequence
  Synthetic
gaaccucucaaaacgaaacaagca

SEQ ID NO: 61404 - DNA, 17 bp, Artificial Sequence
  Synthetic
gctugggccccacguag

SEQ ID NO: 61405 - DNA, 19 bp, Artificial Sequence
  Synthetic
cctgggugtatgcccucat

SEQ ID NO: 61406 - DNA, 21 bp, Artificial Sequence
  Synthetic
gcccagccaacutcuagcaaa

SEQ ID NO: 61407 - DNA, 28 bp, Artificial Sequence
  Synthetic
aagaaggttguattccaaatcauggagt

SEQ ID NO: 61408 - DNA, 20 bp, Artificial Sequence
  Synthetic
gggttgccaccuacagtgut

SEQ ID NO: 61409 - DNA, 23 bp, Artificial Sequence
  Synthetic
gcgatctaaugaagggtcctcut

SEQ ID NO: 61410 - DNA, 26 bp, Artificial Sequence
  Synthetic
tgtgtuacaagaaagcatuggcaaag

SEQ ID NO: 61411 - DNA, 28 bp, Artificial Sequence
  Synthetic
caggatgtttucatgacgtaacatuaca

SEQ ID NO: 61412 - DNA, 25 bp, Artificial Sequence
  Synthetic
ccagctgguctttggtaaagtuaag

SEQ ID NO: 61413 - DNA, 28 bp, Artificial Sequence
  Synthetic
tgattgtcatattucctcctcagtccua

SEQ ID NO: 61414 - DNA, 26 bp, Artificial Sequence
  Synthetic
gtcatcaagacuccaaaagacatugg

SEQ ID NO: 61415 - DNA, 25 bp, Artificial Sequence
  Synthetic
agctccgaguaatctagctagctut

SEQ ID NO: 61416 - DNA, 28 bp, Artificial Sequence
  Synthetic
aagcctgtaagacauctggaataatgut

SEQ ID NO: 61417 - DNA, 28 bp, Artificial Sequence
  Synthetic
ttgttttgattgaagutgcagtcagtut

SEQ ID NO: 61418 - DNA, 21 bp, Artificial Sequence
  Synthetic
caagggtcauacccacaugct

SEQ ID NO: 61419 - DNA, 23 bp, Artificial Sequence
  Synthetic
gtacttgtcucgtgggaaucact

SEQ ID NO: 61420 - DNA, 20 bp, Artificial Sequence
  Synthetic
acagaggugctucaccaaca

SEQ ID NO: 61421 - DNA, 20 bp, Artificial Sequence
  Synthetic
agcattguggcatcctucgt

SEQ ID NO: 61422 - DNA, 20 bp, Artificial Sequence
  Synthetic
aaagcgacugtgctcucaca

SEQ ID NO: 61423 - DNA, 18 bp, Artificial Sequence
  Synthetic
gggcugccactuggaagg

SEQ ID NO: 61424 - DNA, 22 bp, Artificial Sequence
  Synthetic
caaaatttcccugtctgccgut

SEQ ID NO: 61425 - DNA, 27 bp, Artificial Sequence
  Synthetic
agaaaaccuggagactttugaagaagt

SEQ ID NO: 61426 - DNA, 21 bp, Artificial Sequence
  Synthetic
gguctccatcuacaacgagca

SEQ ID NO: 61427 - DNA, 22 bp, Artificial Sequence
  Synthetic
ccacatctggucagtggtauga

SEQ ID NO: 61428 - DNA, 20 bp, Artificial Sequence
  Synthetic
cctttgcaguctgtgcucgt

SEQ ID NO: 61429 - DNA, 24 bp, Artificial Sequence
  Synthetic
caagtcacaggauaaagccggaua

SEQ ID NO: 61430 - DNA, 21 bp, Artificial Sequence
  Synthetic
cacatgtutgtggctuggaca

SEQ ID NO: 61431 - DNA, 23 bp, Artificial Sequence
  Synthetic
gcugtcacuaaaccacacacact

SEQ ID NO: 61432 - DNA, 23 bp, Artificial Sequence
  Synthetic
gaaaggugatgaaggucccagag

SEQ ID NO: 61433 - DNA, 23 bp, Artificial Sequence
  Synthetic
ctacagcactuccagttggaaug

SEQ ID NO: 61434 - DNA, 25 bp, Artificial Sequence
  Synthetic
ggaaagccagugcctcatattaugg

SEQ ID NO: 61435 - DNA, 23 bp, Artificial Sequence
  Synthetic
tgcaagtuaagcttcctguggaa

SEQ ID NO: 61436 - DNA, 19 bp, Artificial Sequence
  Synthetic
gcagtgcaugcgacactug

SEQ ID NO: 61437 - DNA, 23 bp, Artificial Sequence
  Synthetic
cccctcttcuatgggttcctugt

SEQ ID NO: 61438 - DNA, 26 bp, Artificial Sequence
  Synthetic
actatgaaatuccaaagcctcctuga

SEQ ID NO: 61439 - DNA, 23 bp, Artificial Sequence
  Synthetic
acacatgaggagaaugtaccuct

SEQ ID NO: 61440 - DNA, 26 bp, Artificial Sequence
  Synthetic
tgatcaatttccuccctttcaagugt

SEQ ID NO: 61441 - DNA, 19 bp, Artificial Sequence
  Synthetic
ggcuatcagguaccagcgt

SEQ ID NO: 61442 - DNA, 27 bp, Artificial Sequence
  Synthetic
tccacutacttttactugacccacaaa

SEQ ID NO: 61443 - DNA, 26 bp, Artificial Sequence
  Synthetic
gctcctctcacauttaatgcttgugt

SEQ ID NO: 61444 - DNA, 22 bp, Artificial Sequence
  Synthetic
ccctugcagatctcaugaggat

SEQ ID NO: 61445 - DNA, 19 bp, Artificial Sequence
  Synthetic
cctuccggaccctuagcac

SEQ ID NO: 61446 - DNA, 20 bp, Artificial Sequence
  Synthetic
ccagacccgggautgttuca

SEQ ID NO: 61447 - DNA, 27 bp, Artificial Sequence
  Synthetic
ccccuataaaataaaguacaggcagga

SEQ ID NO: 61448 - DNA, 29 bp, Artificial Sequence
  Synthetic
attgttgtgcaugagtgttactactttug

SEQ ID NO: 61449 - DNA, 22 bp, Artificial Sequence
  Synthetic
agtggccacagcuaacatcaut

SEQ ID NO: 61450 - DNA, 21 bp, Artificial Sequence
  Synthetic
catccaugcgcaguacaacac

SEQ ID NO: 61451 - DNA, 21 bp, Artificial Sequence
  Synthetic
gguccaacgugagggaagaaa

SEQ ID NO: 61452 - DNA, 25 bp, Artificial Sequence
  Synthetic
gtgtccatuctaactcaacuccagt

SEQ ID NO: 61453 - DNA, 25 bp, Artificial Sequence
  Synthetic
actaactcagcuctttggattgcut

SEQ ID NO: 61454 - DNA, 27 bp, Artificial Sequence
  Synthetic
ggataaacaugaacacagaggaaccua

SEQ ID NO: 61455 - DNA, 25 bp, Artificial Sequence
  Synthetic
tctatagaatccugtgaagcagcuc

SEQ ID NO: 61456 - DNA, 19 bp, Artificial Sequence
  Synthetic
ccgguaaccacgtccugag

SEQ ID NO: 61457 - DNA, 28 bp, Artificial Sequence
  Synthetic
acaataacagugaccaaaatgacaguga

SEQ ID NO: 61458 - DNA, 23 bp, Artificial Sequence
  Synthetic
acccaagagucttctctgtcucc

SEQ ID NO: 61459 - DNA, 25 bp, Artificial Sequence
  Synthetic
gcttacauttgcttcugacacaact

SEQ ID NO: 61460 - DNA, 22 bp, Artificial Sequence
  Synthetic
gcagtggacuggaaaatgugag

SEQ ID NO: 61461 - DNA, 21 bp, Artificial Sequence
  Synthetic
cgtgcatucaggcactuacca

SEQ ID NO: 61462 - DNA, 20 bp, Artificial Sequence
  Synthetic
tgctcagguccacccattug

SEQ ID NO: 61463 - DNA, 18 bp, Artificial Sequence
  Synthetic
gtgaccgugggtgagugt

SEQ ID NO: 61464 - DNA, 26 bp, Artificial Sequence
  Synthetic
aagctgctatauggcgagttctuaat

SEQ ID NO: 61465 - DNA, 25 bp, Artificial Sequence
  Synthetic
gtcttgtagugaactggtacacugg

SEQ ID NO: 61466 - DNA, 17 bp, Artificial Sequence
  Synthetic
gtgacccgcugguggaa

SEQ ID NO: 61467 - DNA, 18 bp, Artificial Sequence
  Synthetic
caggaugagcacgtugcc

SEQ ID NO: 61468 - DNA, 25 bp, Artificial Sequence
  Synthetic
attaaggtcaugggaatacgctcug

SEQ ID NO: 61469 - DNA, 26 bp, Artificial Sequence
  Synthetic
tttgacttcaagcugttcttcaaugg

SEQ ID NO: 61470 - DNA, 21 bp, Artificial Sequence
  Synthetic
gcggcttucctcgttauaggt

SEQ ID NO: 61471 - DNA, 25 bp, Artificial Sequence
  Synthetic
ccccttcatcguctactacttcauc

SEQ ID NO: 61472 - DNA, 22 bp, Artificial Sequence
  Synthetic
ccagaagcaugacatggtcuct

SEQ ID NO: 61473 - DNA, 22 bp, Artificial Sequence
  Synthetic
ccacggguaagcatatggauga

SEQ ID NO: 61474 - DNA, 20 bp, Artificial Sequence
  Synthetic
ctcttctugttgcgguggga

SEQ ID NO: 61475 - DNA, 28 bp, Artificial Sequence
  Synthetic
ccctactcugacatcgtatatcuagcat

SEQ ID NO: 61476 - DNA, 32 bp, Artificial Sequence
  Synthetic
aatgctgatgguattaaaacagttttuaagaa

SEQ ID NO: 61477 - DNA, 26 bp, Artificial Sequence
  Synthetic
gcaatggactucacctcatcaaaaug

SEQ ID NO: 61478 - DNA, 28 bp, Artificial Sequence
  Synthetic
tgatttattctgttutgtttgccaccut

SEQ ID NO: 61479 - DNA, 24 bp, Artificial Sequence
  Synthetic
ggcttccutcttcaaaugcaagac

SEQ ID NO: 61480 - DNA, 24 bp, Artificial Sequence
  Synthetic
gctgtcaaaccucctaactucact

SEQ ID NO: 61481 - DNA, 25 bp, Artificial Sequence
  Synthetic
ccagcccaugtaattttgacaucaa

SEQ ID NO: 61482 - DNA, 23 bp, Artificial Sequence
  Synthetic
ccttctcaugcccagauggaaat

SEQ ID NO: 61483 - DNA, 26 bp, Artificial Sequence
  Synthetic
attagctuccactccttuccagaaaa

SEQ ID NO: 61484 - DNA, 19 bp, Artificial Sequence
  Synthetic
gatgtugcacggcagctua

SEQ ID NO: 61485 - DNA, 24 bp, Artificial Sequence
  Synthetic
gtaatcacuccccagatagcagug

SEQ ID NO: 61486 - DNA, 22 bp, Artificial Sequence
  Synthetic
actcttuaagggcctcacucgt

SEQ ID NO: 61487 - DNA, 21 bp, Artificial Sequence
  Synthetic
ctgtgcucaacgtcactcuga

SEQ ID NO: 61488 - DNA, 21 bp, Artificial Sequence
  Synthetic
tgaaacacccugtgguagcag

SEQ ID NO: 61489 - DNA, 21 bp, Artificial Sequence
  Synthetic
tgaccatgagcugcagagaug

SEQ ID NO: 61490 - DNA, 21 bp, Artificial Sequence
  Synthetic
aattccccugctcccctctua

SEQ ID NO: 61491 - DNA, 23 bp, Artificial Sequence
  Synthetic
ctctttgcgcutcttgaactucc

SEQ ID NO: 61492 - DNA, 21 bp, Artificial Sequence
  Synthetic
tcaccatccuccccttggaut

SEQ ID NO: 61493 - DNA, 22 bp, Artificial Sequence
  Synthetic
ccaacctctugctccaaacuga

SEQ ID NO: 61494 - DNA, 21 bp, Artificial Sequence
  Synthetic
cuccaacgccaacaucaacaa

SEQ ID NO: 61495 - DNA, 20 bp, Artificial Sequence
  Synthetic
ctgtctccugagggtugcag

SEQ ID NO: 61496 - DNA, 22 bp, Artificial Sequence
  Synthetic
ctcccaagccuatgggttcaut

SEQ ID NO: 61497 - DNA, 21 bp, Artificial Sequence
  Synthetic
tctccccucccactagacuct

SEQ ID NO: 61498 - DNA, 29 bp, Artificial Sequence
  Synthetic
cgatttcacaagtuaaaccatctttccut

SEQ ID NO: 61499 - DNA, 22 bp, Artificial Sequence
  Synthetic
tctctagggcaucaaccugagt

SEQ ID NO: 61500 - DNA, 20 bp, Artificial Sequence
  Synthetic
tggcucgcaagcacaauagt

SEQ ID NO: 61501 - DNA, 26 bp, Artificial Sequence
  Synthetic
ggtcacaaauggatacttttcauggg

SEQ ID NO: 61502 - DNA, 23 bp, Artificial Sequence
  Synthetic
tccagctgguaggagaggttaug

SEQ ID NO: 61503 - DNA, 24 bp, Artificial Sequence
  Synthetic
gctaaagccugtgtcctgtgauat

SEQ ID NO: 61504 - DNA, 23 bp, Artificial Sequence
  Synthetic
gtgctgcautgtttacatuccct

SEQ ID NO: 61505 - DNA, 28 bp, Artificial Sequence
  Synthetic
ggttgagcauccacaagtttctaaauaa

SEQ ID NO: 61506 - DNA, 28 bp, Artificial Sequence
  Synthetic
acttccatggaugagaattcagctaaug

SEQ ID NO: 61507 - DNA, 28 bp, Artificial Sequence
  Synthetic
aaatgcctctguaagaatccccttttua

SEQ ID NO: 61508 - DNA, 27 bp, Artificial Sequence
  Synthetic
gcaatcctcaaautgtcagcatcttut

SEQ ID NO: 61509 - DNA, 27 bp, Artificial Sequence
  Synthetic
acacttgcaacagagguttagaaacua

SEQ ID NO: 61510 - DNA, 27 bp, Artificial Sequence
  Synthetic
gtgaaggcucatttcttgugaaaaaga

SEQ ID NO: 61511 - DNA, 25 bp, Artificial Sequence
  Synthetic
catcagggaaauccctaccaatugt

SEQ ID NO: 61512 - DNA, 26 bp, Artificial Sequence
  Synthetic
atgagtcctctutgatgctgttctut

SEQ ID NO: 61513 - DNA, 29 bp, Artificial Sequence
  Synthetic
gggatgaaatguggttcttactaaggtut

SEQ ID NO: 61514 - DNA, 28 bp, Artificial Sequence
  Synthetic
ggtctagaguagagaaactgcatcttuc

SEQ ID NO: 61515 - DNA, 32 bp, Artificial Sequence
  Synthetic
tggaaatctggattuatagttgacaggaatut

SEQ ID NO: 61516 - DNA, 20 bp, Artificial Sequence
  Synthetic
gtgagcucagaagccacuca

SEQ ID NO: 61517 - DNA, 23 bp, Artificial Sequence
  Synthetic
ctggtcctuctggaaaagauggt

SEQ ID NO: 61518 - DNA, 20 bp, Artificial Sequence
  Synthetic
ggaucctaaugcccagcagt

SEQ ID NO: 61519 - DNA, 24 bp, Artificial Sequence
  Synthetic
tgagaccacagcaaautcctctug

SEQ ID NO: 61520 - DNA, 26 bp, Artificial Sequence
  Synthetic
aaaagccagaccuttgtgattacuct

SEQ ID NO: 61521 - DNA, 23 bp, Artificial Sequence
  Synthetic
gccctagttucagctctgatgug

SEQ ID NO: 61522 - DNA, 25 bp, Artificial Sequence
  Synthetic
aactagtttgaaugcaaggctggua

SEQ ID NO: 61523 - DNA, 23 bp, Artificial Sequence
  Synthetic
ctcgctgauaagttctgugacca

SEQ ID NO: 61524 - DNA, 22 bp, Artificial Sequence
  Synthetic
gccauccttaauccaggaacct

SEQ ID NO: 61525 - DNA, 24 bp, Artificial Sequence
  Synthetic
ggcaaactuaaagcacttgugagt

SEQ ID NO: 61526 - DNA, 24 bp, Artificial Sequence
  Synthetic
gatggcgcucagatcccataauaa

SEQ ID NO: 61527 - DNA, 28 bp, Artificial Sequence
  Synthetic
atccttgagatucagtcttttcatgugt

SEQ ID NO: 61528 - DNA, 20 bp, Artificial Sequence
  Synthetic
tgggacaggcagguauaggt

SEQ ID NO: 61529 - DNA, 17 bp, Artificial Sequence
  Synthetic
cgccggagcugcaauga

SEQ ID NO: 61530 - DNA, 20 bp, Artificial Sequence
  Synthetic
cagagctaguggctcaccut

SEQ ID NO: 61531 - DNA, 28 bp, Artificial Sequence
  Synthetic
gggaatactgaucctgatttaacaguga

SEQ ID NO: 61532 - DNA, 28 bp, Artificial Sequence
  Synthetic
tgctgttattttaugaagacagtgugga

SEQ ID NO: 61533 - DNA, 26 bp, Artificial Sequence
  Synthetic
cctgctcugacaaacatcaucaagat

SEQ ID NO: 61534 - DNA, 28 bp, Artificial Sequence
  Synthetic
agctaggtgaugtttcattgggttuaat

SEQ ID NO: 61535 - DNA, 29 bp, Artificial Sequence
  Synthetic
tgttcagtgtttucttgttttgctttuct

SEQ ID NO: 61536 - DNA, 18 bp, Artificial Sequence
  Synthetic
ccgtugccgttgcuacca

SEQ ID NO: 61537 - DNA, 17 bp, Artificial Sequence
  Synthetic
ccgagtcucgccgctuc

SEQ ID NO: 61538 - DNA, 25 bp, Artificial Sequence
  Synthetic
ggatgattatagucgttgggtucgt

SEQ ID NO: 61539 - DNA, 19 bp, Artificial Sequence
  Synthetic
cctgcccugcgatucgaaa

SEQ ID NO: 61540 - DNA, 29 bp, Artificial Sequence
  Synthetic
tccttccaaaggauatagtagtgattuga

SEQ ID NO: 61541 - DNA, 28 bp, Artificial Sequence
  Synthetic
acttcttcaacagucttgacatagcaut

SEQ ID NO: 61542 - DNA, 21 bp, Artificial Sequence
  Synthetic
ggtggacagccaguacgagua

SEQ ID NO: 61543 - DNA, 28 bp, Artificial Sequence
  Synthetic
gaaacatctcacautgtcttcttcctug

SEQ ID NO: 61544 - DNA, 22 bp, Artificial Sequence
  Synthetic
ggcaagaaagcuacctttuggg

SEQ ID NO: 61545 - DNA, 26 bp, Artificial Sequence
  Synthetic
tgatcacctttuccttctcgatucag

SEQ ID NO: 61546 - DNA, 28 bp, Artificial Sequence
  Synthetic
ttcccttgaguacagagtcctttatuct

SEQ ID NO: 61547 - DNA, 22 bp, Artificial Sequence
  Synthetic
ggttactgcutctctctucggt

SEQ ID NO: 61548 - DNA, 17 bp, Artificial Sequence
  Synthetic
gcuggccgggaacucac

SEQ ID NO: 61549 - DNA, 18 bp, Artificial Sequence
  Synthetic
tgcgtagcgcuggaaguc

SEQ ID NO: 61550 - DNA, 20 bp, Artificial Sequence
  Synthetic
cauaggtggugaggccaagg

SEQ ID NO: 61551 - DNA, 20 bp, Artificial Sequence
  Synthetic
cccctgcagutcaacagcut

SEQ ID NO: 61552 - DNA, 20 bp, Artificial Sequence
  Synthetic
ctacccugcccacccatuat

SEQ ID NO: 61553 - DNA, 24 bp, Artificial Sequence
  Synthetic
caactttgcuacttgcctttucct

SEQ ID NO: 61554 - DNA, 25 bp, Artificial Sequence
  Synthetic
gttaatcccagguctaaccgtuacc

SEQ ID NO: 61555 - DNA, 25 bp, Artificial Sequence
  Synthetic
gccatatttcaaugtcagctccuca

SEQ ID NO: 61556 - DNA, 26 bp, Artificial Sequence
  Synthetic
gcctuccttttacagugaagaagaac

SEQ ID NO: 61557 - DNA, 31 bp, Artificial Sequence
  Synthetic
aatgtactcctgaautaacataacaccatua

SEQ ID NO: 61558 - DNA, 21 bp, Artificial Sequence
  Synthetic
cccagcuggacagcttctuac

SEQ ID NO: 61559 - DNA, 24 bp, Artificial Sequence
  Synthetic
tgctacactcutccaaacctucac

SEQ ID NO: 61560 - DNA, 28 bp, Artificial Sequence
  Synthetic
cacaataatcgaaaaaucccgtttcuga

SEQ ID NO: 61561 - DNA, 24 bp, Artificial Sequence
  Synthetic
actattccaggaagugacggtcut

SEQ ID NO: 61562 - DNA, 22 bp, Artificial Sequence
  Synthetic
gccagatctuctccatgtcguc

SEQ ID NO: 61563 - DNA, 25 bp, Artificial Sequence
  Synthetic
tgacatggugagagcatgatttuct

SEQ ID NO: 61564 - DNA, 22 bp, Artificial Sequence
  Synthetic
cuttttctucccaggaggagca

SEQ ID NO: 61565 - DNA, 26 bp, Artificial Sequence
  Synthetic
ggccctctuaactacactctcatuac

SEQ ID NO: 61566 - DNA, 20 bp, Artificial Sequence
  Synthetic
caguacgagggcatcuccat

SEQ ID NO: 61567 - DNA, 25 bp, Artificial Sequence
  Synthetic
acagtgtgaugacagatgcttctuc

SEQ ID NO: 61568 - DNA, 28 bp, Artificial Sequence
  Synthetic
accagtagagucaaggaacagaatuaca

SEQ ID NO: 61569 - DNA, 23 bp, Artificial Sequence
  Synthetic
gttggtccgcuatctctgucaaa

SEQ ID NO: 61570 - DNA, 23 bp, Artificial Sequence
  Synthetic
cagatatuccactggtggucgag

SEQ ID NO: 61571 - DNA, 24 bp, Artificial Sequence
  Synthetic
cagctcagcugttgtgttttgtut

SEQ ID NO: 61572 - DNA, 20 bp, Artificial Sequence
  Synthetic
agctgtgugagttcgcctuc

SEQ ID NO: 61573 - DNA, 19 bp, Artificial Sequence
  Synthetic
gaggtggcucagtgucgat

SEQ ID NO: 61574 - DNA, 22 bp, Artificial Sequence
  Synthetic
cccgtatcucctttccauccca

SEQ ID NO: 61575 - DNA, 25 bp, Artificial Sequence
  Synthetic
gactgtgagaguagattgggtcuct

SEQ ID NO: 61576 - DNA, 21 bp, Artificial Sequence
  Synthetic
gctgucctgagaauggagcaa

SEQ ID NO: 61577 - DNA, 21 bp, Artificial Sequence
  Synthetic
cctgctccugattgtctuccc

SEQ ID NO: 61578 - DNA, 23 bp, Artificial Sequence
  Synthetic
gtaccuacagagccagtccacua

SEQ ID NO: 61579 - DNA, 21 bp, Artificial Sequence
  Synthetic
ccagcgggagaugaagaaguc

SEQ ID NO: 61580 - DNA, 20 bp, Artificial Sequence
  Synthetic
ggcacaguactgcaucaggt

SEQ ID NO: 61581 - DNA, 21 bp, Artificial Sequence
  Synthetic
ggcaccaugaaggacatucgt

SEQ ID NO: 61582 - DNA, 19 bp, Artificial Sequence
  Synthetic
cccccaugcctgcttaugt

SEQ ID NO: 61583 - DNA, 17 bp, Artificial Sequence
  Synthetic
ccgtacccguggccauc

SEQ ID NO: 61584 - DNA, 20 bp, Artificial Sequence
  Synthetic
gagtggaagucagcctgugt

SEQ ID NO: 61585 - DNA, 17 bp, Artificial Sequence
  Synthetic
gggtcucacaggccuct

SEQ ID NO: 61586 - DNA, 22 bp, Artificial Sequence
  Synthetic
gctggtggtuttgcatcaggua

SEQ ID NO: 61587 - DNA, 21 bp, Artificial Sequence
  Synthetic
gctgaggccutctcaggttuc

SEQ ID NO: 61588 - DNA, 20 bp, Artificial Sequence
  Synthetic
caggttggaugtcgcaguct

SEQ ID NO: 61589 - DNA, 19 bp, Artificial Sequence
  Synthetic
gcucggcuagcaggaggat

SEQ ID NO: 61590 - DNA, 18 bp, Artificial Sequence
  Synthetic
cccagcucccacctccut

SEQ ID NO: 61591 - DNA, 17 bp, Artificial Sequence
  Synthetic
gcgcaggagcaguguca

SEQ ID NO: 61592 - DNA, 21 bp, Artificial Sequence
  Synthetic
cttggagcugaccaggtctuc

SEQ ID NO: 61593 - DNA, 21 bp, Artificial Sequence
  Synthetic
agtcacctcugggtcttgugt

SEQ ID NO: 61594 - DNA, 21 bp, Artificial Sequence
  Synthetic
gggtggautctcttcugccat

SEQ ID NO: 61595 - DNA, 24 bp, Artificial Sequence
  Synthetic
cccattgggaagugaagctaucag

SEQ ID NO: 61596 - DNA, 20 bp, Artificial Sequence
  Synthetic
ccctagcugggagggtagut

SEQ ID NO: 61597 - DNA, 28 bp, Artificial Sequence
  Synthetic
ccctagatcugaaggatgagagattcut

SEQ ID NO: 61598 - DNA, 23 bp, Artificial Sequence
  Synthetic
agaaacagccugaaggtcucaag

SEQ ID NO: 61599 - DNA, 27 bp, Artificial Sequence
  Synthetic
ttgatctgggaggguagagactaaaut

SEQ ID NO: 61600 - DNA, 20 bp, Artificial Sequence
  Synthetic
ggaaccgacutggcatctug

SEQ ID NO: 61601 - DNA, 28 bp, Artificial Sequence
  Synthetic
cccctggctcauctgtaatttactttut

SEQ ID NO: 61602 - DNA, 20 bp, Artificial Sequence
  Synthetic
ggagccagauagcccccuaa

SEQ ID NO: 61603 - DNA, 25 bp, Artificial Sequence
  Synthetic
agctgtgaugcatgatattcuggac

SEQ ID NO: 61604 - DNA, 22 bp, Artificial Sequence
  Synthetic
gcaatgccautggctgtatugt

SEQ ID NO: 61605 - DNA, 24 bp, Artificial Sequence
  Synthetic
ggagctaaacccutagagggatuc

SEQ ID NO: 61606 - DNA, 27 bp, Artificial Sequence
  Synthetic
acctggtguaaacagactaattuggaa

SEQ ID NO: 61607 - DNA, 23 bp, Artificial Sequence
  Synthetic
ccttctttacguccaaggcacuc

SEQ ID NO: 61608 - DNA, 23 bp, Artificial Sequence
  Synthetic
acttctgggaagugtcctgauga

SEQ ID NO: 61609 - DNA, 23 bp, Artificial Sequence
  Synthetic
tcctttgttgcuacgacccauac

SEQ ID NO: 61610 - DNA, 21 bp, Artificial Sequence
  Synthetic
tctcuggcagctctagugact

SEQ ID NO: 61611 - DNA, 25 bp, Artificial Sequence
  Synthetic
aatgatagagcccauggatguagga

SEQ ID NO: 61612 - DNA, 21 bp, Artificial Sequence
  Synthetic
aatggccuggaaacatgguca

SEQ ID NO: 61613 - DNA, 28 bp, Artificial Sequence
  Synthetic
gaccatggtaaacaugaggtacttgaua

SEQ ID NO: 61614 - DNA, 18 bp, Artificial Sequence
  Synthetic
cctcuggagcaccuagcc

SEQ ID NO: 61615 - DNA, 20 bp, Artificial Sequence
  Synthetic
tgcctatcacuccgcctcut

SEQ ID NO: 61616 - DNA, 21 bp, Artificial Sequence
  Synthetic
actgcaguttgttccucggat

SEQ ID NO: 61617 - DNA, 22 bp, Artificial Sequence
  Synthetic
cacaaacucggagcugcaaaag

SEQ ID NO: 61618 - DNA, 28 bp, Artificial Sequence
  Synthetic
cagttctttcaugctattaaacgaggut

SEQ ID NO: 61619 - DNA, 28 bp, Artificial Sequence
  Synthetic
caataauaacccacatccauaagccagt

SEQ ID NO: 61620 - DNA, 21 bp, Artificial Sequence
  Synthetic
ggcucatgucacccacacaat

SEQ ID NO: 61621 - DNA, 26 bp, Artificial Sequence
  Synthetic
ggccacttgcutcttataatagucct

SEQ ID NO: 61622 - DNA, 24 bp, Artificial Sequence
  Synthetic
ccaacacaaugcaaatgacagcut

SEQ ID NO: 61623 - DNA, 24 bp, Artificial Sequence
  Synthetic
actccacaaacuttttccagcuct

SEQ ID NO: 61624 - DNA, 21 bp, Artificial Sequence
  Synthetic
cgcagagautggcttccugac

SEQ ID NO: 61625 - DNA, 25 bp, Artificial Sequence
  Synthetic
gagaaaggtgugcatctatgaucct

SEQ ID NO: 61626 - DNA, 21 bp, Artificial Sequence
  Synthetic
gccaggtgutttcagggacut

SEQ ID NO: 61627 - DNA, 24 bp, Artificial Sequence
  Synthetic
caagcctcuagctccttgattcug

SEQ ID NO: 61628 - DNA, 24 bp, Artificial Sequence
  Synthetic
ccutgcagaauccaagaaaacagg

SEQ ID NO: 61629 - DNA, 24 bp, Artificial Sequence
  Synthetic
cattttccccutacctccatugct

SEQ ID NO: 61630 - DNA, 27 bp, Artificial Sequence
  Synthetic
gggaagugaaagaacttgaaagatuca

SEQ ID NO: 61631 - DNA, 28 bp, Artificial Sequence
  Synthetic
gaaataactgtgauttggcttccaucaa

SEQ ID NO: 61632 - DNA, 28 bp, Artificial Sequence
  Synthetic
gtctgacagagtuctcattacccaaaut

SEQ ID NO: 61633 - DNA, 27 bp, Artificial Sequence
  Synthetic
tcattttggctuctatacctccaugat

SEQ ID NO: 61634 - DNA, 26 bp, Artificial Sequence
  Synthetic
gctattgtugcaagaacagucagaat

SEQ ID NO: 61635 - DNA, 17 bp, Artificial Sequence
  Synthetic
tcugctcugccacgcaa

SEQ ID NO: 61636 - DNA, 22 bp, Artificial Sequence
  Synthetic
cactuggaaggagcaaacgaug

SEQ ID NO: 61637 - DNA, 23 bp, Artificial Sequence
  Synthetic
cttagtgtuggcctgagaaggut

SEQ ID NO: 61638 - DNA, 21 bp, Artificial Sequence
  Synthetic
cccutcuccagagaggcaaag

SEQ ID NO: 61639 - DNA, 22 bp, Artificial Sequence
  Synthetic
ctcaggcuacatttgacgcuca

SEQ ID NO: 61640 - DNA, 23 bp, Artificial Sequence
  Synthetic
gagccugtgctcttugaagagaa

SEQ ID NO: 61641 - DNA, 23 bp, Artificial Sequence
  Synthetic
gtccgtacuagtgctttcuggaa

SEQ ID NO: 61642 - DNA, 20 bp, Artificial Sequence
  Synthetic
ctgtggccutctgcagacut

SEQ ID NO: 61643 - DNA, 19 bp, Artificial Sequence
  Synthetic
gccauagcccggtcagtut

SEQ ID NO: 61644 - DNA, 20 bp, Artificial Sequence
  Synthetic
ctaagtccaggugtggcgut

SEQ ID NO: 61645 - DNA, 18 bp, Artificial Sequence
  Synthetic
guagacggagcggtuggt

SEQ ID NO: 61646 - DNA, 22 bp, Artificial Sequence
  Synthetic
atctucagcacctcugacacag

SEQ ID NO: 61647 - DNA, 20 bp, Artificial Sequence
  Synthetic
cgggatuggcagtcttcaut

SEQ ID NO: 61648 - DNA, 21 bp, Artificial Sequence
  Synthetic
cggaauggctgttcuggaagt

SEQ ID NO: 61649 - DNA, 24 bp, Artificial Sequence
  Synthetic
gacgtgtttcugggtttgcttaut

SEQ ID NO: 61650 - DNA, 28 bp, Artificial Sequence
  Synthetic
gtaaaacttctctuctccgaggacaaua

SEQ ID NO: 61651 - DNA, 21 bp, Artificial Sequence
  Synthetic
ctctccccacgugcatacaut

SEQ ID NO: 61652 - DNA, 27 bp, Artificial Sequence
  Synthetic
cacaagaaaugaaaataagctgctucc

SEQ ID NO: 61653 - DNA, 28 bp, Artificial Sequence
  Synthetic
tcacaccacatuttagtcatatgcaugt

SEQ ID NO: 61654 - DNA, 22 bp, Artificial Sequence
  Synthetic
agggtgtatgcuccagcttcua

SEQ ID NO: 61655 - DNA, 23 bp, Artificial Sequence
  Synthetic
ctttcccucaccatgacguaagg

SEQ ID NO: 61656 - DNA, 22 bp, Artificial Sequence
  Synthetic
ggtggtcagucatgtgtgucat

SEQ ID NO: 61657 - DNA, 20 bp, Artificial Sequence
  Synthetic
gtcctucaggtccacuggag

SEQ ID NO: 61658 - DNA, 21 bp, Artificial Sequence
  Synthetic
cgagagccaggaguctgatuc

SEQ ID NO: 61659 - DNA, 21 bp, Artificial Sequence
  Synthetic
aagagtguacagcggcatugt

SEQ ID NO: 61660 - DNA, 19 bp, Artificial Sequence
  Synthetic
atggcagggucaagctugt

SEQ ID NO: 61661 - DNA, 18 bp, Artificial Sequence
  Synthetic
ggaaagccagcccugcut

SEQ ID NO: 61662 - DNA, 28 bp, Artificial Sequence
  Synthetic
ggaaatgtaacautaggctcaattuggt

SEQ ID NO: 61663 - DNA, 24 bp, Artificial Sequence
  Synthetic
ccattatcaccuctaaccggtgut

SEQ ID NO: 61664 - DNA, 21 bp, Artificial Sequence
  Synthetic
gggacagaaucagggucaggt

SEQ ID NO: 61665 - DNA, 28 bp, Artificial Sequence
  Synthetic
ttgtaggtgacautggtgatgaagauag

SEQ ID NO: 61666 - DNA, 22 bp, Artificial Sequence
  Synthetic
gcgatgaccuctattccuacgg

SEQ ID NO: 61667 - DNA, 28 bp, Artificial Sequence
  Synthetic
caaggtgtauggtcagagactuagaaat

SEQ ID NO: 61668 - DNA, 22 bp, Artificial Sequence
  Synthetic
cctggtggagaugcttttccug

SEQ ID NO: 61669 - DNA, 21 bp, Artificial Sequence
  Synthetic
cagtccctuctttgccgtuct

SEQ ID NO: 61670 - DNA, 21 bp, Artificial Sequence
  Synthetic
ctcatttgtgugtcccccuct

SEQ ID NO: 61671 - DNA, 22 bp, Artificial Sequence
  Synthetic
accctccacauaggccatttug

SEQ ID NO: 61672 - DNA, 20 bp, Artificial Sequence
  Synthetic
gacacguggcagcuaaacac

SEQ ID NO: 61673 - DNA, 21 bp, Artificial Sequence
  Synthetic
ggagauttggacucccagcac

SEQ ID NO: 61674 - DNA, 19 bp, Artificial Sequence
  Synthetic
ctguccggtcugcaacact

SEQ ID NO: 61675 - DNA, 22 bp, Artificial Sequence
  Synthetic
gtaggaagucctagagggugct

SEQ ID NO: 61676 - DNA, 19 bp, Artificial Sequence
  Synthetic
cggtgaccccutgtagcug

SEQ ID NO: 61677 - DNA, 21 bp, Artificial Sequence
  Synthetic
tcgttcaccacgucgaagaug

SEQ ID NO: 61678 - DNA, 20 bp, Artificial Sequence
  Synthetic
ggaatgcccugatccuccat

SEQ ID NO: 61679 - DNA, 26 bp, Artificial Sequence
  Synthetic
gcaaagaagaagutgttgtagtgucc

SEQ ID NO: 61680 - DNA, 18 bp, Artificial Sequence
  Synthetic
tgtgcucccctcccucag

SEQ ID NO: 61681 - DNA, 22 bp, Artificial Sequence
  Synthetic
tgatgucgaagaccaccctgua

SEQ ID NO: 61682 - DNA, 22 bp, Artificial Sequence
  Synthetic
gacccaguacccagacgtcuat

SEQ ID NO: 61683 - DNA, 21 bp, Artificial Sequence
  Synthetic
ggccucctgagaucacaggaa

SEQ ID NO: 61684 - DNA, 19 bp, Artificial Sequence
  Synthetic
gcgtguccccatcccauag

SEQ ID NO: 61685 - DNA, 23 bp, Artificial Sequence
  Synthetic
ggcctcttcuctctggtcctuag

SEQ ID NO: 61686 - DNA, 25 bp, Artificial Sequence
  Synthetic
cttaaactugcctcgaaggucaaag

SEQ ID NO: 61687 - DNA, 24 bp, Artificial Sequence
  Synthetic
cggtacuggaagacgagauaagga

SEQ ID NO: 61688 - DNA, 21 bp, Artificial Sequence
  Synthetic
gagcagtacuccccgcuaaag

SEQ ID NO: 61689 - DNA, 22 bp, Artificial Sequence
  Synthetic
ccatgatccutccttgcuccat

SEQ ID NO: 61690 - DNA, 18 bp, Artificial Sequence
  Synthetic
ccgcgguctgctauacga

SEQ ID NO: 61691 - DNA, 27 bp, Artificial Sequence
  Synthetic
cacaautctgaaguagaagaggacgac

SEQ ID NO: 61692 - DNA, 20 bp, Artificial Sequence
  Synthetic
gtgacgcgggacugatacuc

SEQ ID NO: 61693 - DNA, 21 bp, Artificial Sequence
  Synthetic
gggtcagutcgagtuggagat

SEQ ID NO: 61694 - DNA, 19 bp, Artificial Sequence
  Synthetic
ccccggcutctctgcatua

SEQ ID NO: 61695 - DNA, 18 bp, Artificial Sequence
  Synthetic
gaucccacucgcacagca

SEQ ID NO: 61696 - DNA, 21 bp, Artificial Sequence
  Synthetic
gtgatgcaggucagcacttuc

SEQ ID NO: 61697 - DNA, 29 bp, Artificial Sequence
  Synthetic
gctatcgccautattacaagagtuaagca

SEQ ID NO: 61698 - DNA, 22 bp, Artificial Sequence
  Synthetic
tgggtattgtugggaggaggua

SEQ ID NO: 61699 - DNA, 21 bp, Artificial Sequence
  Synthetic
gccucagactacauccaaggg

SEQ ID NO: 61700 - DNA, 25 bp, Artificial Sequence
  Synthetic
gcaggaaaaguacaagagccaaauc

SEQ ID NO: 61701 - DNA, 27 bp, Artificial Sequence
  Synthetic
gcaaggaacucactttcttcuaagcaa

SEQ ID NO: 61702 - DNA, 21 bp, Artificial Sequence
  Synthetic
ttctggagggugctgtucaag

SEQ ID NO: 61703 - DNA, 20 bp, Artificial Sequence
  Synthetic
caaacaccacuccggtucca

SEQ ID NO: 61704 - DNA, 22 bp, Artificial Sequence
  Synthetic
ctcatgagcagucagagagcug

SEQ ID NO: 61705 - DNA, 22 bp, Artificial Sequence
  Synthetic
ctcacttctucacccaggguaa

SEQ ID NO: 61706 - DNA, 24 bp, Artificial Sequence
  Synthetic
ggattctctcuagctcccctctut

SEQ ID NO: 61707 - DNA, 21 bp, Artificial Sequence
  Synthetic
acactccugagtcccuaaccc

SEQ ID NO: 61708 - DNA, 22 bp, Artificial Sequence
  Synthetic
caggaagagcautagguccaca

SEQ ID NO: 61709 - DNA, 23 bp, Artificial Sequence
  Synthetic
ctatttaugaccgccuggagcaa

SEQ ID NO: 61710 - DNA, 28 bp, Artificial Sequence
  Synthetic
gtctactgttcauttcagctttaacgug

SEQ ID NO: 61711 - DNA, 25 bp, Artificial Sequence
  Synthetic
agggtcccuatacagtagaugcaat

SEQ ID NO: 61712 - DNA, 21 bp, Artificial Sequence
  Synthetic
ctgggagagagcutcctguag

SEQ ID NO: 61713 - DNA, 24 bp, Artificial Sequence
  Synthetic
acaccatttgcuacctttgggaut

SEQ ID NO: 61714 - DNA, 24 bp, Artificial Sequence
  Synthetic
gctgtgactguactacttcctgut

SEQ ID NO: 61715 - DNA, 25 bp, Artificial Sequence
  Synthetic
aggaccagutattgttugaaaggca

SEQ ID NO: 61716 - DNA, 26 bp, Artificial Sequence
  Synthetic
accucttctctuagaaccaggaaaga

SEQ ID NO: 61717 - DNA, 23 bp, Artificial Sequence
  Synthetic
tcagagaugcacgaatggaugac

SEQ ID NO: 61718 - DNA, 25 bp, Artificial Sequence
  Synthetic
agctggtggugaagttgattacaut

SEQ ID NO: 61719 - DNA, 28 bp, Artificial Sequence
  Synthetic
cttgctcaaggaaugcattttcttauga

SEQ ID NO: 61720 - DNA, 24 bp, Artificial Sequence
  Synthetic
gaaaggcatauggaacaggaguca

SEQ ID NO: 61721 - DNA, 24 bp, Artificial Sequence
  Synthetic
ctttcctaugaaggtgtguagcca

SEQ ID NO: 61722 - DNA, 25 bp, Artificial Sequence
  Synthetic
gatcccaaaccuttgacacatgtug

SEQ ID NO: 61723 - DNA, 27 bp, Artificial Sequence
  Synthetic
ctttttattgctutgtggtgaccucat

SEQ ID NO: 61724 - DNA, 20 bp, Artificial Sequence
  Synthetic
ggtcctcugccctcagucat

SEQ ID NO: 61725 - DNA, 17 bp, Artificial Sequence
  Synthetic
gcaggcugcccgtacug

SEQ ID NO: 61726 - DNA, 22 bp, Artificial Sequence
  Synthetic
aactgtaacccugcaaagcuga

SEQ ID NO: 61727 - DNA, 28 bp, Artificial Sequence
  Synthetic
aaccaactcautctgttacugaagaaca

SEQ ID NO: 61728 - DNA, 20 bp, Artificial Sequence
  Synthetic
ccctgaccagacuccacuga

SEQ ID NO: 61729 - DNA, 21 bp, Artificial Sequence
  Synthetic
gttgagaacuggctugcaagt

SEQ ID NO: 61730 - DNA, 22 bp, Artificial Sequence
  Synthetic
aggaaucagaggcaaaguggag

SEQ ID NO: 61731 - DNA, 26 bp, Artificial Sequence
  Synthetic
ccttattaccccuacttgcacuagag

SEQ ID NO: 61732 - DNA, 21 bp, Artificial Sequence
  Synthetic
tgctcacacugttcagucgaa

SEQ ID NO: 61733 - DNA, 28 bp, Artificial Sequence
  Synthetic
ccgttagctgtaaucacaccacattaua

SEQ ID NO: 61734 - DNA, 23 bp, Artificial Sequence
  Synthetic
caacuggtctcatucaggaaggt

SEQ ID NO: 61735 - DNA, 27 bp, Artificial Sequence
  Synthetic
gggtgctguagtgagttauaaaggaat

SEQ ID NO: 61736 - DNA, 26 bp, Artificial Sequence
  Synthetic
aaaatggatccaaguatgggtgugaa

SEQ ID NO: 61737 - DNA, 28 bp, Artificial Sequence
  Synthetic
gcatttgactucagtttccaaagaguaa

SEQ ID NO: 61738 - DNA, 23 bp, Artificial Sequence
  Synthetic
aagggaugacaccagtucaagac

SEQ ID NO: 61739 - DNA, 29 bp, Artificial Sequence
  Synthetic
agctcccaaacuagcacataaaauaacaa

SEQ ID NO: 61740 - DNA, 28 bp, Artificial Sequence
  Synthetic
aaagaatcaatccugtgttacaggugaa

SEQ ID NO: 61741 - DNA, 26 bp, Artificial Sequence
  Synthetic
ggccagtttuagcttttcaggacuat

SEQ ID NO: 61742 - DNA, 23 bp, Artificial Sequence
  Synthetic
gagagagagagutcctccuggaa

SEQ ID NO: 61743 - DNA, 23 bp, Artificial Sequence
  Synthetic
gatgaacugccacattgttucct

SEQ ID NO: 61744 - DNA, 24 bp, Artificial Sequence
  Synthetic
ccttatccugaaggagagcttugg

SEQ ID NO: 61745 - DNA, 28 bp, Artificial Sequence
  Synthetic
tttctccataugggtcatctagguaact

SEQ ID NO: 61746 - DNA, 21 bp, Artificial Sequence
  Synthetic
gggucagaaaggtgaugaagg

SEQ ID NO: 61747 - DNA, 25 bp, Artificial Sequence
  Synthetic
tgaggccaaccuttagctagagtua

SEQ ID NO: 61748 - DNA, 20 bp, Artificial Sequence
  Synthetic
ctttcacgguttccctggug

SEQ ID NO: 61749 - DNA, 23 bp, Artificial Sequence
  Synthetic
ctccaaugcaccggaaaaatuct

SEQ ID NO: 61750 - DNA, 29 bp, Artificial Sequence
  Synthetic
cagtacgactttuccttcttccaatcaua

SEQ ID NO: 61751 - DNA, 28 bp, Artificial Sequence
  Synthetic
cattctttgcuaatttcctttcctugct

SEQ ID NO: 61752 - DNA, 25 bp, Artificial Sequence
  Synthetic
gggtagctgugagatttgtattuca

SEQ ID NO: 61753 - DNA, 24 bp, Artificial Sequence
  Synthetic
caaaggcuacaggtgagtuaacca

SEQ ID NO: 61754 - DNA, 23 bp, Artificial Sequence
  Synthetic
gggttgtuagggaaggagaagua

SEQ ID NO: 61755 - DNA, 27 bp, Artificial Sequence
  Synthetic
agctgattaacauttgttcctcuccaa

SEQ ID NO: 61756 - DNA, 29 bp, Artificial Sequence
  Synthetic
catctaaaataauccccagaactcaccut

SEQ ID NO: 61757 - DNA, 27 bp, Artificial Sequence
  Synthetic
ctgcttacugaaacatgaaaacctugt

SEQ ID NO: 61758 - DNA, 22 bp, Artificial Sequence
  Synthetic
ggagguacggatcctctuccaa

SEQ ID NO: 61759 - DNA, 21 bp, Artificial Sequence
  Synthetic
cattctgcuctgtcgctucct

SEQ ID NO: 61760 - DNA, 19 bp, Artificial Sequence
  Synthetic
cgtgcacccuccaguagga

SEQ ID NO: 61761 - DNA, 22 bp, Artificial Sequence
  Synthetic
gctaccaagcugtttgcuagga

SEQ ID NO: 61762 - DNA, 22 bp, Artificial Sequence
  Synthetic
gacaggagccautcaaguagca

SEQ ID NO: 61763 - DNA, 28 bp, Artificial Sequence
  Synthetic
ttctttttguaccagtattucgaaccct

SEQ ID NO: 61764 - DNA, 20 bp, Artificial Sequence
  Synthetic
gcacgggccugtagtaggua

SEQ ID NO: 61765 - DNA, 22 bp, Artificial Sequence
  Synthetic
tctggguctcgtacucgaagat

SEQ ID NO: 61766 - DNA, 25 bp, Artificial Sequence
  Synthetic
acctttctugtccattatugcccaa

SEQ ID NO: 61767 - DNA, 22 bp, Artificial Sequence
  Synthetic
aaggaaccugaacgtgttucca

SEQ ID NO: 61768 - DNA, 21 bp, Artificial Sequence
  Synthetic
ctcagagguccaccagacuca

SEQ ID NO: 61769 - DNA, 28 bp, Artificial Sequence
  Synthetic
gcaacagagtugaagaaacttgattuca

SEQ ID NO: 61770 - DNA, 26 bp, Artificial Sequence
  Synthetic
ttgtgaactgaaguacagaactcugg

SEQ ID NO: 61771 - DNA, 25 bp, Artificial Sequence
  Synthetic
agctgactctauctttgccttcuct

SEQ ID NO: 61772 - DNA, 19 bp, Artificial Sequence
  Synthetic
ggaagggcuccatcctguc

SEQ ID NO: 61773 - DNA, 19 bp, Artificial Sequence
  Synthetic
gggugacggtgactugact

SEQ ID NO: 61774 - DNA, 24 bp, Artificial Sequence
  Synthetic
ggcctttgtgucctccttaacuaa

SEQ ID NO: 61775 - DNA, 20 bp, Artificial Sequence
  Synthetic
ccucgtaauccaccccgact

SEQ ID NO: 61776 - DNA, 27 bp, Artificial Sequence
  Synthetic
tcttatctcaccgucctttgttcuagt

SEQ ID NO: 61777 - DNA, 28 bp, Artificial Sequence
  Synthetic
ctcagccatgugtctcttatttttctug

SEQ ID NO: 61778 - DNA, 20 bp, Artificial Sequence
  Synthetic
caggctgguatctgcgtugt

SEQ ID NO: 61779 - DNA, 22 bp, Artificial Sequence
  Synthetic
gcagaacuttgucccagagcat

SEQ ID NO: 61780 - DNA, 24 bp, Artificial Sequence
  Synthetic
tctcgaaggucagagccaattcua

SEQ ID NO: 61781 - DNA, 24 bp, Artificial Sequence
  Synthetic
ctgtaagtgacugctccatacucc

SEQ ID NO: 61782 - DNA, 19 bp, Artificial Sequence
  Synthetic
tggtcacugcggaccatuc

SEQ ID NO: 61783 - DNA, 22 bp, Artificial Sequence
  Synthetic
gutgtcattgaguccccaccat

SEQ ID NO: 61784 - DNA, 24 bp, Artificial Sequence
  Synthetic
ggacagttugggtaaacagucact

SEQ ID NO: 61785 - DNA, 27 bp, Artificial Sequence
  Synthetic
cctgtagcttgaucacctcattcttut

SEQ ID NO: 61786 - DNA, 25 bp, Artificial Sequence
  Synthetic
gaaacaggautttgcaagaauggct

SEQ ID NO: 61787 - DNA, 24 bp, Artificial Sequence
  Synthetic
cagtcggagcuaaaactcccttut

SEQ ID NO: 61788 - DNA, 17 bp, Artificial Sequence
  Synthetic
tgcgaccguacgacgug

SEQ ID NO: 61789 - DNA, 23 bp, Artificial Sequence
  Synthetic
cagggaccucctcagtcuagaaa

SEQ ID NO: 61790 - DNA, 17 bp, Artificial Sequence
  Synthetic
gtccccaggugcagucc

SEQ ID NO: 61791 - DNA, 19 bp, Artificial Sequence
  Synthetic
ggagatgcugagcgtcugt

SEQ ID NO: 61792 - DNA, 22 bp, Artificial Sequence
  Synthetic
cctcccagagcugcagauagaa

SEQ ID NO: 61793 - DNA, 26 bp, Artificial Sequence
  Synthetic
cctttaccagtcuatctcagcctcua

SEQ ID NO: 61794 - DNA, 21 bp, Artificial Sequence
  Synthetic
gcagctgtuacctgagcgaua

SEQ ID NO: 61795 - DNA, 24 bp, Artificial Sequence
  Synthetic
cttaactctcccguccttcttgug

SEQ ID NO: 61796 - DNA, 24 bp, Artificial Sequence
  Synthetic
agtccagtcucaatccctttcuct

SEQ ID NO: 61797 - DNA, 26 bp, Artificial Sequence
  Synthetic
cacgtgaaguataagatccgaaugga

SEQ ID NO: 61798 - DNA, 21 bp, Artificial Sequence
  Synthetic
tgccaaugcaccucagaaact

SEQ ID NO: 61799 - DNA, 27 bp, Artificial Sequence
  Synthetic
tcggatggaauggaagaaatattuggt

SEQ ID NO: 61800 - DNA, 22 bp, Artificial Sequence
  Synthetic
tcuccaacaccaccaacugaac

SEQ ID NO: 61801 - DNA, 27 bp, Artificial Sequence
  Synthetic
ttgctttccaacacauttgacaatuct

SEQ ID NO: 61802 - DNA, 26 bp, Artificial Sequence
  Synthetic
agtgactgccaugcatataacacaua

SEQ ID NO: 61803 - DNA, 32 bp, Artificial Sequence
  Synthetic
ttttctattatattutcttagggtcugccagg

SEQ ID NO: 61804 - DNA, 27 bp, Artificial Sequence
  Synthetic
gttaactaaaatgutgtgcagcacuga

SEQ ID NO: 61805 - DNA, 21 bp, Artificial Sequence
  Synthetic
gggtccuccaggtcuacaagg

SEQ ID NO: 61806 - DNA, 28 bp, Artificial Sequence
  Synthetic
tcttcagugtttatcttuccagaaagca

SEQ ID NO: 61807 - DNA, 24 bp, Artificial Sequence
  Synthetic
ccactcatucattttgtcccucac

SEQ ID NO: 61808 - DNA, 24 bp, Artificial Sequence
  Synthetic
tctccatcctucacttctccctua

SEQ ID NO: 61809 - DNA, 23 bp, Artificial Sequence
  Synthetic
caucctgcactaucagcaagagg

SEQ ID NO: 61810 - DNA, 27 bp, Artificial Sequence
  Synthetic
tttttaggacagacgugaagatccauc

SEQ ID NO: 61811 - DNA, 28 bp, Artificial Sequence
  Synthetic
tgggcttttctcuatttcatgttccaut

SEQ ID NO: 61812 - DNA, 22 bp, Artificial Sequence
  Synthetic
ggcttatgguagcagccactua

SEQ ID NO: 61813 - DNA, 22 bp, Artificial Sequence
  Synthetic
ccctgtacucccagccaaauag

SEQ ID NO: 61814 - DNA, 27 bp, Artificial Sequence
  Synthetic
ctttgaacuattcaacaugcccagaac

SEQ ID NO: 61815 - DNA, 24 bp, Artificial Sequence
  Synthetic
tcctgatgtucctgcttgtcttut

SEQ ID NO: 61816 - DNA, 28 bp, Artificial Sequence
  Synthetic
ttgccaagatauaatcacagatgtugga

SEQ ID NO: 61817 - DNA, 26 bp, Artificial Sequence
  Synthetic
ccgtctatacutgagaactccuggaa

SEQ ID NO: 61818 - DNA, 28 bp, Artificial Sequence
  Synthetic
gcaatccatttaautggtcagttcugaa

SEQ ID NO: 61819 - DNA, 24 bp, Artificial Sequence
  Synthetic
gtgagauttactcaguggcagact

SEQ ID NO: 61820 - DNA, 25 bp, Artificial Sequence
  Synthetic
cattttggagcutcgtgtctccuaa

SEQ ID NO: 61821 - DNA, 24 bp, Artificial Sequence
  Synthetic
gagagtcatcuctaccagctcuga

SEQ ID NO: 61822 - DNA, 26 bp, Artificial Sequence
  Synthetic
catcttagguggacttagtcttuggg

SEQ ID NO: 61823 - DNA, 25 bp, Artificial Sequence
  Synthetic
aatatattttgtccugtgcccctut

SEQ ID NO: 61824 - DNA, 23 bp, Artificial Sequence
  Synthetic
cacactgaagucctttggctuct

SEQ ID NO: 61825 - DNA, 26 bp, Artificial Sequence
  Synthetic
tgaaatcatttucccatcctcaccut

SEQ ID NO: 61826 - DNA, 28 bp, Artificial Sequence
  Synthetic
ccttcttcctutgaatccttattuccgt

SEQ ID NO: 61827 - DNA, 27 bp, Artificial Sequence
  Synthetic
gggctatgaaguttctggatgtcuaat

SEQ ID NO: 61828 - DNA, 23 bp, Artificial Sequence
  Synthetic
cgtctgugaggaagggatcugaa

SEQ ID NO: 61829 - DNA, 28 bp, Artificial Sequence
  Synthetic
gataacacaugaaagcataggaugggat

SEQ ID NO: 61830 - DNA, 25 bp, Artificial Sequence
  Synthetic
cagaaattgtugatggcaacgugaa

SEQ ID NO: 61831 - DNA, 28 bp, Artificial Sequence
  Synthetic
ctgttggacttuaaaacatcttgcucaa

SEQ ID NO: 61832 - DNA, 21 bp, Artificial Sequence
  Synthetic
ctcagcagguaacagccugaa

SEQ ID NO: 61833 - DNA, 19 bp, Artificial Sequence
  Synthetic
gacgccgacucgtaaucct

SEQ ID NO: 61834 - DNA, 21 bp, Artificial Sequence
  Synthetic
tccatcauggccauccagaac

SEQ ID NO: 61835 - DNA, 23 bp, Artificial Sequence
  Synthetic
ccttcgacgucagctucaagaat

SEQ ID NO: 61836 - DNA, 24 bp, Artificial Sequence
  Synthetic
tgaagcagtaugagcacaacauca

SEQ ID NO: 61837 - DNA, 22 bp, Artificial Sequence
  Synthetic
augaagaaagcacccugaggag

SEQ ID NO: 61838 - DNA, 28 bp, Artificial Sequence
  Synthetic
cctaactctagttuggaaaagagacgut

SEQ ID NO: 61839 - DNA, 28 bp, Artificial Sequence
  Synthetic
aatgaagtaucaaacaactacgccuaca

SEQ ID NO: 61840 - DNA, 25 bp, Artificial Sequence
  Synthetic
agcagaatgacagutttggatguct

SEQ ID NO: 61841 - DNA, 24 bp, Artificial Sequence
  Synthetic
gttgctaugaacccaatcatgcut

SEQ ID NO: 61842 - DNA, 28 bp, Artificial Sequence
  Synthetic
cagtgaatgttattuatgagggctggua

SEQ ID NO: 61843 - DNA, 28 bp, Artificial Sequence
  Synthetic
tgttaaatcacugtttccauccagagac

SEQ ID NO: 61844 - DNA, 20 bp, Artificial Sequence
  Synthetic
gcatgccacgucttgcuaaa

SEQ ID NO: 61845 - DNA, 26 bp, Artificial Sequence
  Synthetic
catgagtttcuccaaagacggtaugt

SEQ ID NO: 61846 - DNA, 26 bp, Artificial Sequence
  Synthetic
gtcaaggaguccaaaagacagtucat

SEQ ID NO: 61847 - DNA, 22 bp, Artificial Sequence
  Synthetic
tccttattcgcugacctcucgt

SEQ ID NO: 61848 - DNA, 27 bp, Artificial Sequence
  Synthetic
ggtgcuaaaaagatcaaagtugcagaa

SEQ ID NO: 61849 - DNA, 22 bp, Artificial Sequence
  Synthetic
ggtcactttccuctgtcagcuc

SEQ ID NO: 61850 - DNA, 28 bp, Artificial Sequence
  Synthetic
ctaattttattgucacccctctcctugt

SEQ ID NO: 61851 - DNA, 29 bp, Artificial Sequence
  Synthetic
cttgagtgcagaacugaaaagattuagaa

SEQ ID NO: 61852 - DNA, 26 bp, Artificial Sequence
  Synthetic
tgaggttugcaaaaggatctgtaugt

SEQ ID NO: 61853 - DNA, 28 bp, Artificial Sequence
  Synthetic
cttctactuggcaaaacatttuggaact

SEQ ID NO: 61854 - DNA, 26 bp, Artificial Sequence
  Synthetic
acaattctctuggctttgatgucact

SEQ ID NO: 61855 - DNA, 28 bp, Artificial Sequence
  Synthetic
tgcttaatgtucagagtggtauggaaaa

SEQ ID NO: 61856 - DNA, 32 bp, Artificial Sequence
  Synthetic
tcttgcacattguataaacatttaatguaggt

SEQ ID NO: 61857 - DNA, 27 bp, Artificial Sequence
  Synthetic
ctgtgatcagaautcctcctcttugaa

SEQ ID NO: 61858 - DNA, 23 bp, Artificial Sequence
  Synthetic
aggctctgagaaugaagaccuct

SEQ ID NO: 61859 - DNA, 25 bp, Artificial Sequence
  Synthetic
tggtatctgaaccugttccctuaca

SEQ ID NO: 61860 - DNA, 21 bp, Artificial Sequence
  Synthetic
gcaggaugtggatgaugccat

SEQ ID NO: 61861 - DNA, 22 bp, Artificial Sequence
  Synthetic
cccctgcuctatgatcctguga

SEQ ID NO: 61862 - DNA, 22 bp, Artificial Sequence
  Synthetic
cttccttcttutcagggccuct

SEQ ID NO: 61863 - DNA, 21 bp, Artificial Sequence
  Synthetic
tgtaccugagcctgctacuct

SEQ ID NO: 61864 - DNA, 18 bp, Artificial Sequence
  Synthetic
gggaagcugcagatgugg

SEQ ID NO: 61865 - DNA, 21 bp, Artificial Sequence
  Synthetic
catggcccaaauagccugaag

SEQ ID NO: 61866 - DNA, 24 bp, Artificial Sequence
  Synthetic
aagagcaggcagaaaucaagauga

SEQ ID NO: 61867 - DNA, 27 bp, Artificial Sequence
  Synthetic
atgctgaaattcutggttttggaucac

SEQ ID NO: 61868 - DNA, 24 bp, Artificial Sequence
  Synthetic
ggaaagtatgucccacttcucagg

SEQ ID NO: 61869 - DNA, 22 bp, Artificial Sequence
  Synthetic
cctggtauggcctagtgttgut

SEQ ID NO: 61870 - DNA, 19 bp, Artificial Sequence
  Synthetic
cgccccaucatgctgcaua

SEQ ID NO: 61871 - DNA, 24 bp, Artificial Sequence
  Synthetic
gcactggatugagtctaccttcuc

SEQ ID NO: 61872 - DNA, 22 bp, Artificial Sequence
  Synthetic
ggagcaaacauggcacaaacut

SEQ ID NO: 61873 - DNA, 22 bp, Artificial Sequence
  Synthetic
cctcatccccggutctttgtuc

SEQ ID NO: 61874 - DNA, 21 bp, Artificial Sequence
  Synthetic
ctacgacugctcccaacucac

SEQ ID NO: 61875 - DNA, 24 bp, Artificial Sequence
  Synthetic
gcattcctgccugatgtagtttuc

SEQ ID NO: 61876 - DNA, 22 bp, Artificial Sequence
  Synthetic
cttcuagccaccgttagcucag

SEQ ID NO: 61877 - DNA, 26 bp, Artificial Sequence
  Synthetic
tcacttcctttgutccttttgttgug

SEQ ID NO: 61878 - DNA, 26 bp, Artificial Sequence
  Synthetic
acaactattgucatcttggccauacc

SEQ ID NO: 61879 - DNA, 25 bp, Artificial Sequence
  Synthetic
ggtgagctaaaugcctggttactut

SEQ ID NO: 61880 - DNA, 28 bp, Artificial Sequence
  Synthetic
gaaatctatugccaagttctaguccagt

SEQ ID NO: 61881 - DNA, 22 bp, Artificial Sequence
  Synthetic
ttcatgctcucaggctgctuag

SEQ ID NO: 61882 - DNA, 22 bp, Artificial Sequence
  Synthetic
tttgcctuaagcggtaacguct

SEQ ID NO: 61883 - DNA, 26 bp, Artificial Sequence
  Synthetic
cgttcacagauggaagaaaggtucat

SEQ ID NO: 61884 - DNA, 21 bp, Artificial Sequence
  Synthetic
cgtgacccauctgtggtgtua

SEQ ID NO: 61885 - DNA, 27 bp, Artificial Sequence
  Synthetic
atggcatttcttucatgttgcctatut

SEQ ID NO: 61886 - DNA, 28 bp, Artificial Sequence
  Synthetic
aaagagctccacuaaacttaaagucaca

SEQ ID NO: 61887 - DNA, 25 bp, Artificial Sequence
  Synthetic
tctttactggaauctttgcagcuga

SEQ ID NO: 61888 - DNA, 21 bp, Artificial Sequence
  Synthetic
acactgtgcugcctgagatut

SEQ ID NO: 61889 - DNA, 28 bp, Artificial Sequence
  Synthetic
acatctagtaucccaatggaatcttgug

SEQ ID NO: 61890 - DNA, 23 bp, Artificial Sequence
  Synthetic
tcatgctgcagutctgttcauca

SEQ ID NO: 61891 - DNA, 27 bp, Artificial Sequence
  Synthetic
ggagccatuttcctcttttaucccaat

SEQ ID NO: 61892 - DNA, 26 bp, Artificial Sequence
  Synthetic
tgccataaugctgacatucaagaact

SEQ ID NO: 61893 - DNA, 28 bp, Artificial Sequence
  Synthetic
gcgcgttatcugttttatgtctttgtut

SEQ ID NO: 61894 - DNA, 25 bp, Artificial Sequence
  Synthetic
tccatgaagagaaugtgccaauaca

SEQ ID NO: 61895 - DNA, 33 bp, Artificial Sequence
  Synthetic
tttttcatctgaacautgaagaatgacatcuac

SEQ ID NO: 61896 - DNA, 22 bp, Artificial Sequence
  Synthetic
tctaacgttugcatgccaguga

SEQ ID NO: 61897 - DNA, 29 bp, Artificial Sequence
  Synthetic
acttgtctgtgauagattgagggaagaua

SEQ ID NO: 61898 - DNA, 22 bp, Artificial Sequence
  Synthetic
gctggcugcagtaggttaugaa

SEQ ID NO: 61899 - DNA, 28 bp, Artificial Sequence
  Synthetic
gctacccaggtutattatgagaaggtug

SEQ ID NO: 61900 - DNA, 28 bp, Artificial Sequence
  Synthetic
tccttccaggaauacatacactgtguaa

SEQ ID NO: 61901 - DNA, 23 bp, Artificial Sequence
  Synthetic
aggaccagauggacctauagcac

SEQ ID NO: 61902 - DNA, 20 bp, Artificial Sequence
  Synthetic
gaccuggagagcgaggatug

SEQ ID NO: 61903 - DNA, 21 bp, Artificial Sequence
  Synthetic
aggtatcccagcuggacctut

SEQ ID NO: 61904 - DNA, 28 bp, Artificial Sequence
  Synthetic
gagaagagaagauagaacacttgcctua

SEQ ID NO: 61905 - DNA, 22 bp, Artificial Sequence
  Synthetic
ggtttcccaucacttcctgguc

SEQ ID NO: 61906 - DNA, 18 bp, Artificial Sequence
  Synthetic
ggaggcccucctggagut

SEQ ID NO: 61907 - DNA, 27 bp, Artificial Sequence
  Synthetic
acctccaugtttttccatuagaacact

SEQ ID NO: 61908 - DNA, 28 bp, Artificial Sequence
  Synthetic
aggttcagggaaacucatatgatacugt

SEQ ID NO: 61909 - DNA, 21 bp, Artificial Sequence
  Synthetic
gtgtttucccagggtggcaua

SEQ ID NO: 61910 - DNA, 25 bp, Artificial Sequence
  Synthetic
cccccacguaagtatcaacatugac

SEQ ID NO: 61911 - DNA, 28 bp, Artificial Sequence
  Synthetic
ggcttgatgauggctcctaaaacttuat

SEQ ID NO: 61912 - DNA, 27 bp, Artificial Sequence
  Synthetic
ctgtttgtcuccatttacttagugcct

SEQ ID NO: 61913 - DNA, 25 bp, Artificial Sequence
  Synthetic
ttgccttcccaauctcctacattut

SEQ ID NO: 61914 - DNA, 28 bp, Artificial Sequence
  Synthetic
attataatgguggacccaaatgtaacug

SEQ ID NO: 61915 - DNA, 28 bp, Artificial Sequence
  Synthetic
agccaactgtcuaaacaattacactgua

SEQ ID NO: 61916 - DNA, 22 bp, Artificial Sequence
  Synthetic
cagagccaggcautagtccuac

SEQ ID NO: 61917 - DNA, 24 bp, Artificial Sequence
  Synthetic
tccaggcttuaaagtcaagcacut

SEQ ID NO: 61918 - DNA, 18 bp, Artificial Sequence
  Synthetic
aguggccgagctcuacga

SEQ ID NO: 61919 - DNA, 19 bp, Artificial Sequence
  Synthetic
ggagaaggcaggugcugac

SEQ ID NO: 61920 - DNA, 23 bp, Artificial Sequence
  Synthetic
attcctagtguccctctggtcut

SEQ ID NO: 61921 - DNA, 18 bp, Artificial Sequence
  Synthetic
cacagcaucgacggcauc

SEQ ID NO: 61922 - DNA, 17 bp, Artificial Sequence
  Synthetic
gcccuccccacaauggt

SEQ ID NO: 61923 - DNA, 17 bp, Artificial Sequence
  Synthetic
ggcugtucccagcacct

SEQ ID NO: 61924 - DNA, 19 bp, Artificial Sequence
  Synthetic
gagcgcgutccatcctcua

SEQ ID NO: 61925 - DNA, 17 bp, Artificial Sequence
  Synthetic
ccccgccgucttctuca

SEQ ID NO: 61926 - DNA, 27 bp, Artificial Sequence
  Synthetic
aagggauagaaaagaaggcaacaugaa

SEQ ID NO: 61927 - DNA, 23 bp, Artificial Sequence
  Synthetic
gatatcaatgcutgcacgcugac

SEQ ID NO: 61928 - DNA, 22 bp, Artificial Sequence
  Synthetic
ggagaaguctgaacacugcaca

SEQ ID NO: 61929 - DNA, 21 bp, Artificial Sequence
  Synthetic
cgtgggccaucacaagcaaua

SEQ ID NO: 61930 - DNA, 21 bp, Artificial Sequence
  Synthetic
ccccttuggctgtgagauagg

SEQ ID NO: 61931 - DNA, 22 bp, Artificial Sequence
  Synthetic
tgtagacaaagcugcacucagg

SEQ ID NO: 61932 - DNA, 20 bp, Artificial Sequence
  Synthetic
ccagctacuccgttccucac

SEQ ID NO: 61933 - DNA, 22 bp, Artificial Sequence
  Synthetic
ggtgtctgtguccaggaaaguc

SEQ ID NO: 61934 - DNA, 22 bp, Artificial Sequence
  Synthetic
ctcaggaaguccactgtgauga

SEQ ID NO: 61935 - DNA, 22 bp, Artificial Sequence
  Synthetic
ctgtgugaagcccaucaaagac

SEQ ID NO: 61936 - DNA, 25 bp, Artificial Sequence
  Synthetic
ctggaattaaaugatgggccucact

SEQ ID NO: 61937 - DNA, 21 bp, Artificial Sequence
  Synthetic
acacaatgaugctgguccaca

SEQ ID NO: 61938 - DNA, 25 bp, Artificial Sequence
  Synthetic
tggagtttgutatcattgctuggct

SEQ ID NO: 61939 - DNA, 25 bp, Artificial Sequence
  Synthetic
acaaacatccugctactttgaggut

SEQ ID NO: 61940 - DNA, 25 bp, Artificial Sequence
  Synthetic
gacagaucaaagtagggaugaccaa

SEQ ID NO: 61941 - DNA, 23 bp, Artificial Sequence
  Synthetic
acatctucgacagcatcatcguc

SEQ ID NO: 61942 - DNA, 23 bp, Artificial Sequence
  Synthetic
ctccacaggugtagtgtgtucat

SEQ ID NO: 61943 - DNA, 21 bp, Artificial Sequence
  Synthetic
gtacagggagcutcccatcug

SEQ ID NO: 61944 - DNA, 21 bp, Artificial Sequence
  Synthetic
ccccucaauaccaaagccaac

SEQ ID NO: 61945 - DNA, 24 bp, Artificial Sequence
  Synthetic
tccccacgaaugcccatttaauat

SEQ ID NO: 61946 - DNA, 21 bp, Artificial Sequence
  Synthetic
gacaaactcugtgccgacauc

SEQ ID NO: 61947 - DNA, 23 bp, Artificial Sequence
  Synthetic
gggaugaggaugaagaggacact

SEQ ID NO: 61948 - DNA, 21 bp, Artificial Sequence
  Synthetic
ctgcctgutactgaccucacc

SEQ ID NO: 61949 - DNA, 27 bp, Artificial Sequence
  Synthetic
gctggcattugagttaagttcugaaga

SEQ ID NO: 61950 - DNA, 23 bp, Artificial Sequence
  Synthetic
gggtcagaagguaagactucact

SEQ ID NO: 61951 - DNA, 26 bp, Artificial Sequence
  Synthetic
tgtgcagagtuaagacttgcttgtua

SEQ ID NO: 61952 - DNA, 26 bp, Artificial Sequence
  Synthetic
ccataacttaaggugcctttggguaa

SEQ ID NO: 61953 - DNA, 25 bp, Artificial Sequence
  Synthetic
gtcgtttugccactattatcuagcc

SEQ ID NO: 61954 - DNA, 22 bp, Artificial Sequence
  Synthetic
agcugcaggacacaaacaauct

SEQ ID NO: 61955 - DNA, 28 bp, Artificial Sequence
  Synthetic
ggcctcttgauctttattgatcttugga

SEQ ID NO: 61956 - DNA, 23 bp, Artificial Sequence
  Synthetic
gggtgtgtttuctcttgtcagut

SEQ ID NO: 61957 - DNA, 21 bp, Artificial Sequence
  Synthetic
gccttgtgautcatgctgucc

SEQ ID NO: 61958 - DNA, 21 bp, Artificial Sequence
  Synthetic
ctucaccagcaccctcuacac

SEQ ID NO: 61959 - DNA, 24 bp, Artificial Sequence
  Synthetic
gggcttuggataacatugacagga

SEQ ID NO: 61960 - DNA, 28 bp, Artificial Sequence
  Synthetic
acagctttttctutcattgtctcaguct

SEQ ID NO: 61961 - DNA, 23 bp, Artificial Sequence
  Synthetic
gggctaaaauagtggagggtuca

SEQ ID NO: 61962 - DNA, 21 bp, Artificial Sequence
  Synthetic
gggagcacacagcucttctua

SEQ ID NO: 61963 - DNA, 24 bp, Artificial Sequence
  Synthetic
aaaacccaaaaccuaccagtguca

SEQ ID NO: 61964 - DNA, 23 bp, Artificial Sequence
  Synthetic
tucactgacttugaggacaagca

SEQ ID NO: 61965 - DNA, 21 bp, Artificial Sequence
  Synthetic
ctatcccttgucacccccauc

SEQ ID NO: 61966 - DNA, 21 bp, Artificial Sequence
  Synthetic
cctgcgcuttgtcatcaucca

SEQ ID NO: 61967 - DNA, 22 bp, Artificial Sequence
  Synthetic
gcttcgggaaagcacuttccut

SEQ ID NO: 61968 - DNA, 20 bp, Artificial Sequence
  Synthetic
ggtggatcacuccgacgtug

SEQ ID NO: 61969 - DNA, 22 bp, Artificial Sequence
  Synthetic
aagcuagugagagggacacaga

SEQ ID NO: 61970 - DNA, 19 bp, Artificial Sequence
  Synthetic
tgacgcucccccttctcut

SEQ ID NO: 61971 - DNA, 18 bp, Artificial Sequence
  Synthetic
gcccctgugactgcctug

SEQ ID NO: 61972 - DNA, 28 bp, Artificial Sequence
  Synthetic
cgcaaaaatuagagccggaaguaaaaat

SEQ ID NO: 61973 - DNA, 28 bp, Artificial Sequence
  Synthetic
ggtccacatgacautctcaaattgttut

SEQ ID NO: 61974 - DNA, 25 bp, Artificial Sequence
  Synthetic
aatctguaacattcaagugcccact

SEQ ID NO: 61975 - DNA, 22 bp, Artificial Sequence
  Synthetic
cctgataacugtggctgtguct

SEQ ID NO: 61976 - DNA, 20 bp, Artificial Sequence
  Synthetic
tggtgguggagatggacgua

SEQ ID NO: 61977 - DNA, 17 bp, Artificial Sequence
  Synthetic
gggagguggcgaugcag

SEQ ID NO: 61978 - DNA, 29 bp, Artificial Sequence
  Synthetic
ctcgacctatauctcatttggattuccat

SEQ ID NO: 61979 - DNA, 28 bp, Artificial Sequence
  Synthetic
ggaauaggcaacatgtucagagaaagaa

SEQ ID NO: 61980 - DNA, 27 bp, Artificial Sequence
  Synthetic
aaatcacaccacaagutttcactctuc

SEQ ID NO: 61981 - DNA, 27 bp, Artificial Sequence
  Synthetic
gtactttcctgtugggattccatttut

SEQ ID NO: 61982 - DNA, 26 bp, Artificial Sequence
  Synthetic
tgttttacagaugttgatggcaugga

SEQ ID NO: 61983 - DNA, 28 bp, Artificial Sequence
  Synthetic
gcattcatttggauactacctgtucaag

SEQ ID NO: 61984 - DNA, 31 bp, Artificial Sequence; identical to SEQ ID NO: 37154
  Synthetic

SEQ ID NO: 61985 - DNA, 24 bp, Artificial Sequence
  Synthetic
gtgccctctcucagtaagcattut

SEQ ID NO: 61986 - DNA, 23 bp, Artificial Sequence
  Synthetic
tccaatagttgaugagggcccua

SEQ ID NO: 61987 - DNA, 26 bp, Artificial Sequence
  Synthetic
tcaaaattacccugtgggctuaagac

SEQ ID NO: 61988 - DNA, 23 bp, Artificial Sequence
  Synthetic
acccaaaacucaagtggcuacag

SEQ ID NO: 61989 - DNA, 29 bp, Artificial Sequence
  Synthetic
tgctaaggtttggutcagtgaaaataugt

SEQ ID NO: 61990 - DNA, 27 bp, Artificial Sequence
  Synthetic
tcctgtgacauttgtctttcatuacca

SEQ ID NO: 61991 - DNA, 28 bp, Artificial Sequence
  Synthetic
ggatgaaggaacuagaagataactugct

SEQ ID NO: 61992 - DNA, 25 bp, Artificial Sequence
  Synthetic
tccagcaccuccatcttgtattcua

SEQ ID NO: 61993 - DNA, 28 bp, Artificial Sequence
  Synthetic
caaatgaccattutcctagtgtgcuaat

SEQ ID NO: 61994 - DNA, 21 bp, Artificial Sequence
  Synthetic
gatcuccacagccagtaugct

SEQ ID NO: 61995 - DNA, 21 bp, Artificial Sequence
  Synthetic
ccatgauccagacctgctugt

SEQ ID NO: 61996 - DNA, 24 bp, Artificial Sequence
  Synthetic
cttgggaataugaagagcgugaca

SEQ ID NO: 61997 - DNA, 29 bp, Artificial Sequence
  Synthetic
ggtttatgtaagaaauccgttgacacuga

SEQ ID NO: 61998 - DNA, 28 bp, Artificial Sequence
  Synthetic
ctttaagagggugacaatgctattucct

SEQ ID NO: 61999 - DNA, 22 bp, Artificial Sequence
  Synthetic
agtggaaagcuttgacccaucc

SEQ ID NO: 62000 - DNA, 26 bp, Artificial Sequence
  Synthetic
tgactttttgtugcaggatgaacuct

SEQ ID NO: 62001 - DNA, 28 bp, Artificial Sequence
  Synthetic
cacaagcauccagaatcagaaaaaucaa

SEQ ID NO: 62002 - DNA, 19 bp, Artificial Sequence
  Synthetic
cccctaugtacgccuccct

SEQ ID NO: 62003 - DNA, 19 bp, Artificial Sequence
  Synthetic
ccgggaggagacgucaaug

SEQ ID NO: 62004 - DNA, 28 bp, Artificial Sequence
  Synthetic
ccttcaagacucaagggtgataaugaaa

SEQ ID NO: 62005 - DNA, 26 bp, Artificial Sequence
  Synthetic
agcagcagctugatgtaaactactua

SEQ ID NO: 62006 - DNA, 24 bp, Artificial Sequence
  Synthetic
cccacctaatcucagtcccacuat

SEQ ID NO: 62007 - DNA, 28 bp, Artificial Sequence
  Synthetic
gcagaaagaatugaagatgaactuccag

SEQ ID NO: 62008 - DNA, 26 bp, Artificial Sequence
  Synthetic
aggactgtcccautaacaatccuaga

SEQ ID NO: 62009 - DNA, 22 bp, Artificial Sequence
  Synthetic
gggcauccacctgaauaaagga

SEQ ID NO: 62010 - DNA, 20 bp, Artificial Sequence
  Synthetic
ccccagaacaguaccgtcut

SEQ ID NO: 62011 - DNA, 22 bp, Artificial Sequence
  Synthetic
tggatguggcaaaggtgtuaca

SEQ ID NO: 62012 - DNA, 26 bp, Artificial Sequence
  Synthetic
gaacaucccaaaatgcttauggacaa

SEQ ID NO: 62013 - DNA, 24 bp, Artificial Sequence
  Synthetic
gttcctgtttcauagcaagtgcug

SEQ ID NO: 62014 - DNA, 22 bp, Artificial Sequence
  Synthetic
gcucctcagacugaaacacaga

SEQ ID NO: 62015 - DNA, 29 bp, Artificial Sequence
  Synthetic
ccaggtaattcuagcatgtttcctaaugt

SEQ ID NO: 62016 - DNA, 24 bp, Artificial Sequence
  Synthetic
cctgtcaucaagcatatccaguga

SEQ ID NO: 62017 - DNA, 24 bp, Artificial Sequence
  Synthetic
ccactttuagaaatgcuggccaaa

SEQ ID NO: 62018 - DNA, 25 bp, Artificial Sequence
  Synthetic
gggaagatgtuaaaaggtgcctuct

SEQ ID NO: 62019 - DNA, 28 bp, Artificial Sequence
  Synthetic
gaggttttacaautagactgguccacat

SEQ ID NO: 62020 - DNA, 22 bp, Artificial Sequence
  Synthetic
ttgcccagaacgggutttcaua

SEQ ID NO: 62021 - DNA, 23 bp, Artificial Sequence
  Synthetic
ccccaaacautcactggugacat

SEQ ID NO: 62022 - DNA, 24 bp, Artificial Sequence
  Synthetic
gcagaaauaccaggcagagtgtuc

SEQ ID NO: 62023 - DNA, 29 bp, Artificial Sequence
  Synthetic
tgtcttccacagautttcttcttctctut

SEQ ID NO: 62024 - DNA, 17 bp, Artificial Sequence
  Synthetic
cucggguggaccaccac

SEQ ID NO: 62025 - DNA, 17 bp, Artificial Sequence
  Synthetic
gacuccggcagccacut

SEQ ID NO: 62026 - DNA, 20 bp, Artificial Sequence
  Synthetic
gcaugtctggauggcacagt

SEQ ID NO: 62027 - DNA, 18 bp, Artificial Sequence
  Synthetic
tgugcaaggagtgugcct

SEQ ID NO: 62028 - DNA, 21 bp, Artificial Sequence
  Synthetic
guactggtggugacaggacaa

SEQ ID NO: 62029 - DNA, 20 bp, Artificial Sequence
  Synthetic
cccagtugaaccagccacua

SEQ ID NO: 62030 - DNA, 27 bp, Artificial Sequence
  Synthetic
gttcuctatccacaaauaccacacaca

SEQ ID NO: 62031 - DNA, 25 bp, Artificial Sequence
  Synthetic
ttggtgtctcugactctcttctcut

SEQ ID NO: 62032 - DNA, 22 bp, Artificial Sequence
  Synthetic
tggaaggaccaagcuccuaaga

SEQ ID NO: 62033 - DNA, 25 bp, Artificial Sequence
  Synthetic
acactcugaggcccctttataaaug

SEQ ID NO: 62034 - DNA, 21 bp, Artificial Sequence
  Synthetic
cagagcccuctaaagcugaca

SEQ ID NO: 62035 - DNA, 27 bp, Artificial Sequence
  Synthetic
accttaccaaugagggtatccagtauc

SEQ ID NO: 62036 - DNA, 21 bp, Artificial Sequence
  Synthetic
ccaggaccaccucaagatguc

SEQ ID NO: 62037 - DNA, 21 bp, Artificial Sequence
  Synthetic
tgacgcuttcacauccacaca

SEQ ID NO: 62038 - DNA, 27 bp, Artificial Sequence
  Synthetic
gcacaaaatggcuctcagaattatuca

SEQ ID NO: 62039 - DNA, 20 bp, Artificial Sequence
  Synthetic
gcaacccggacuacactugg

SEQ ID NO: 62040 - DNA, 22 bp, Artificial Sequence
  Synthetic
tccaaattccuggcgataugct

SEQ ID NO: 62041 - DNA, 28 bp, Artificial Sequence
  Synthetic
gttaatggaaccaccauttcatgttuca

SEQ ID NO: 62042 - DNA, 23 bp, Artificial Sequence
  Synthetic
tggtatcugagcaactgctctug

SEQ ID NO: 62043 - DNA, 25 bp, Artificial Sequence
  Synthetic
cagttgaugaatggagtguccagaa

SEQ ID NO: 62044 - DNA, 24 bp, Artificial Sequence
  Synthetic
acctggaggagaagugacaguaaa

SEQ ID NO: 62045 - DNA, 27 bp, Artificial Sequence
  Synthetic
agaagacaugaagacattgtucgagat

SEQ ID NO: 62046 - DNA, 27 bp, Artificial Sequence
  Synthetic
ttgtgagaucacataatgacucagcat

SEQ ID NO: 62047 - DNA, 22 bp, Artificial Sequence
  Synthetic
gcagaatggacugcatcctuct

SEQ ID NO: 62048 - DNA, 23 bp, Artificial Sequence
  Synthetic
agctttaggacugataccugcct

SEQ ID NO: 62049 - DNA, 25 bp, Artificial Sequence
  Synthetic
gtatcacatgcaagutgtggcttut

SEQ ID NO: 62050 - DNA, 23 bp, Artificial Sequence
  Synthetic
acaggtggccucagattcuaact

SEQ ID NO: 62051 - DNA, 24 bp, Artificial Sequence
  Synthetic
ctaatgctacagugtctgcctuca

SEQ ID NO: 62052 - DNA, 22 bp, Artificial Sequence
  Synthetic
agaagcggccagugaaatguag

SEQ ID NO: 62053 - DNA, 25 bp, Artificial Sequence
  Synthetic
ctttgttgaugcttctgatgugaca

SEQ ID NO: 62054 - DNA, 23 bp, Artificial Sequence
  Synthetic
gcaacattgguggtgacttcuga

SEQ ID NO: 62055 - DNA, 28 bp, Artificial Sequence
  Synthetic
tcaagagagcutattggacauggaaaaa

SEQ ID NO: 62056 - DNA, 24 bp, Artificial Sequence
  Synthetic
acctuagcaggaaaaaugggagac

SEQ ID NO: 62057 - DNA, 23 bp, Artificial Sequence
  Synthetic
tcctgcttauagctgcctccaua

SEQ ID NO: 62058 - DNA, 25 bp, Artificial Sequence
  Synthetic
gatcttacatugtgtgctaguccca

SEQ ID NO: 62059 - DNA, 25 bp, Artificial Sequence
  Synthetic
aacccaggaauaaactctgcttugt

SEQ ID NO: 62060 - DNA, 23 bp, Artificial Sequence
  Synthetic
acaatgctgauttgcgtcuacca

SEQ ID NO: 62061 - DNA, 27 bp, Artificial Sequence
  Synthetic
atgaatggagguctttgtcatgaauct

SEQ ID NO: 62062 - DNA, 27 bp, Artificial Sequence
  Synthetic
ggctagccauactctttattttctgut

SEQ ID NO: 62063 - DNA, 26 bp, Artificial Sequence
  Synthetic
gcaattccgautccaaauccaacaat

SEQ ID NO: 62064 - DNA, 28 bp, Artificial Sequence
  Synthetic
cagatcttgaaaaauctcagccaaagut

SEQ ID NO: 62065 - DNA, 25 bp, Artificial Sequence
  Synthetic
catctccaaguaggtgctgaauact

SEQ ID NO: 62066 - DNA, 26 bp, Artificial Sequence
  Synthetic
ctttgctaggauctgttgacaaugga

SEQ ID NO: 62067 - DNA, 28 bp, Artificial Sequence
  Synthetic
tgaatcccacugtagtttttctugaagg

SEQ ID NO: 62068 - DNA, 21 bp, Artificial Sequence
  Synthetic
agugtcuccaggagacggaat

SEQ ID NO: 62069 - DNA, 27 bp, Artificial Sequence
  Synthetic
aaacctaccucacagcaacaattctua

SEQ ID NO: 62070 - DNA, 28 bp, Artificial Sequence
  Synthetic
ggagtttgaaagugattatgtggcatut

SEQ ID NO: 62071 - DNA, 29 bp, Artificial Sequence
  Synthetic
aattcaccccttucatttaacagcctaua

SEQ ID NO: 62072 - DNA, 27 bp, Artificial Sequence
  Synthetic
agattcagcuttagccatctucaagaa

SEQ ID NO: 62073 - DNA, 28 bp, Artificial Sequence
  Synthetic
tcaagattuccaatgtacugagcaaaga

SEQ ID NO: 62074 - DNA, 23 bp, Artificial Sequence
  Synthetic
ctctttccuccttccccucagat

SEQ ID NO: 62075 - DNA, 26 bp, Artificial Sequence
  Synthetic
actgaaaaacggcuttctggauagaa

SEQ ID NO: 62076 - DNA, 25 bp, Artificial Sequence
  Synthetic
aatgctagtaggaaaugcaggagug

SEQ ID NO: 62077 - DNA, 28 bp, Artificial Sequence
  Synthetic
ccttgatgatttutgatcccttgttuct

SEQ ID NO: 62078 - DNA, 27 bp, Artificial Sequence
  Synthetic
gattttgctctttugtcatctccagut

SEQ ID NO: 62079 - DNA, 28 bp, Artificial Sequence
  Synthetic
gacctacagtttutgagagcagtatuca

SEQ ID NO: 62080 - DNA, 28 bp, Artificial Sequence
  Synthetic
agaagcaaaaugaggtauccgagaaaaa

SEQ ID NO: 62081 - DNA, 25 bp, Artificial Sequence
  Synthetic
cagtagcagugtattcttggtguca

SEQ ID NO: 62082 - DNA, 26 bp, Artificial Sequence
  Synthetic
gtttttgaatgccautgaaactgcut

SEQ ID NO: 62083 - DNA, 24 bp, Artificial Sequence
  Synthetic
gagatgctgcugctgaaaatcaut

SEQ ID NO: 62084 - DNA, 21 bp, Artificial Sequence
  Synthetic
gcaugcgtgtttugggacaat

SEQ ID NO: 62085 - DNA, 27 bp, Artificial Sequence
  Synthetic
gccccaaaccaaaauacttaagaaguc

SEQ ID NO: 62086 - DNA, 24 bp, Artificial Sequence
  Synthetic
gtcaaagggcutctgggaatguat

SEQ ID NO: 62087 - DNA, 21 bp, Artificial Sequence
  Synthetic
cgttgcaaacgcuatggucac

SEQ ID NO: 62088 - DNA, 20 bp, Artificial Sequence
  Synthetic
ggccaaaugacgtagggcut

SEQ ID NO: 62089 - DNA, 26 bp, Artificial Sequence
  Synthetic
ctaaatggcugcaaagtcacaatgut

SEQ ID NO: 62090 - DNA, 22 bp, Artificial Sequence
  Synthetic
gagaagtucaacgcgtccatug

SEQ ID NO: 62091 - DNA, 22 bp, Artificial Sequence
  Synthetic
gcactgttugctcagggattug

SEQ ID NO: 62092 - DNA, 21 bp, Artificial Sequence
  Synthetic
cuccucagggaagcaacacat

SEQ ID NO: 62093 - DNA, 22 bp, Artificial Sequence
  Synthetic
gcttccaucacacctctgtcug

SEQ ID NO: 62094 - DNA, 18 bp, Artificial Sequence
  Synthetic
gttcucgggcgacgugat

SEQ ID NO: 62095 - DNA, 21 bp, Artificial Sequence
  Synthetic
cctcucgcgcccactttatua

SEQ ID NO: 62096 - DNA, 19 bp, Artificial Sequence
  Synthetic
gccuggcagaaguaccgat

SEQ ID NO: 62097 - DNA, 22 bp, Artificial Sequence
  Synthetic
ctcaggtcugaggatgcatgug

SEQ ID NO: 62098 - DNA, 21 bp, Artificial Sequence
  Synthetic
ccagagcguaggagtctucat

SEQ ID NO: 62099 - DNA, 21 bp, Artificial Sequence
  Synthetic
cutgtggcatgucccaaagag

SEQ ID NO: 62100 - DNA, 28 bp, Artificial Sequence
  Synthetic
atgtagttttcuggtgaatttggaguga

SEQ ID NO: 62101 - DNA, 28 bp, Artificial Sequence
  Synthetic
aaggcucaaagggaatauaaaccaagat

SEQ ID NO: 62102 - DNA, 21 bp, Artificial Sequence
  Synthetic
tggaagcacuaaagcagcugt

SEQ ID NO: 62103 - DNA, 25 bp, Artificial Sequence
  Synthetic
ctgaattggtgauccattgctccua

SEQ ID NO: 62104 - DNA, 21 bp, Artificial Sequence
  Synthetic
ggaacagagcugucacaacga

SEQ ID NO: 62105 - DNA, 28 bp, Artificial Sequence
  Synthetic
cagtcgagagagugggatagtatatugt

SEQ ID NO: 62106 - DNA, 28 bp, Artificial Sequence
  Synthetic
caggttgttgaaaugcatactagttuga

SEQ ID NO: 62107 - DNA, 30 bp, Artificial Sequence
  Synthetic
acaaaactaacctugagaacttcaacauct

SEQ ID NO: 62108 - DNA, 26 bp, Artificial Sequence
  Synthetic
tcaggaggaggacaguatacacatut

SEQ ID NO: 62109 - DNA, 28 bp, Artificial Sequence
  Synthetic
tggagtagaaggcutacagggtaauaat

SEQ ID NO: 62110 - DNA, 32 bp, Artificial Sequence
  Synthetic
aattattgctattgauccatgaagtgatacua

SEQ ID NO: 62111 - DNA, 28 bp, Artificial Sequence
  Synthetic
actgtagccaagggaaucaaagtattut

SEQ ID NO: 62112 - DNA, 23 bp, Artificial Sequence
  Synthetic
gggaagcccugtaaguaagaacc

SEQ ID NO: 62113 - DNA, 27 bp, Artificial Sequence
  Synthetic
tctactccccaacutaggatgtttuca

SEQ ID NO: 62114 - DNA, 21 bp, Artificial Sequence
  Synthetic
cgacagacagagcacugacuc

SEQ ID NO: 62115 - DNA, 28 bp, Artificial Sequence
  Synthetic
accttaccatttcuttgctttgatccua

SEQ ID NO: 62116 - DNA, 27 bp, Artificial Sequence
  Synthetic
tcaagtatcgagugacaaagtcatugg

SEQ ID NO: 62117 - DNA, 27 bp, Artificial Sequence
  Synthetic
tttgaactgtugggagataatggucat

SEQ ID NO: 62118 - DNA, 24 bp, Artificial Sequence
  Synthetic
cactaggttuttgcctccugaact

SEQ ID NO: 62119 - DNA, 24 bp, Artificial Sequence
  Synthetic
cctgttuccagccctauaaaacca

SEQ ID NO: 62120 - DNA, 22 bp, Artificial Sequence
  Synthetic
ctcctcugagcaactgtgacut

SEQ ID NO: 62121 - DNA, 27 bp, Artificial Sequence
  Synthetic
accatcgacautgccatagaaaauagg

SEQ ID NO: 62122 - DNA, 27 bp, Artificial Sequence
  Synthetic
gacgacaacatuagaaaggacacatuc

SEQ ID NO: 62123 - DNA, 28 bp, Artificial Sequence
  Synthetic
agactagacttgugtaatgtttgccaut

SEQ ID NO: 62124 - DNA, 28 bp, Artificial Sequence
  Synthetic
agtgcagaaacuatgtagaaaatgcuga

SEQ ID NO: 62125 - DNA, 25 bp, Artificial Sequence
  Synthetic
tccaggaccagaaccuataactgut

SEQ ID NO: 62126 - DNA, 22 bp, Artificial Sequence
  Synthetic
gccattggugatgtagttgcug

SEQ ID NO: 62127 - DNA, 24 bp, Artificial Sequence
  Synthetic
cattggctuaaaaccacccatgut

SEQ ID NO: 62128 - DNA, 23 bp, Artificial Sequence
  Synthetic
actttaaagcugtcaagccgugt

SEQ ID NO: 62129 - DNA, 28 bp, Artificial Sequence
  Synthetic
aactccgccttuccagttgtataattua

SEQ ID NO: 62130 - DNA, 24 bp, Artificial Sequence
  Synthetic
gtgatgacagccucttcttcagua

SEQ ID NO: 62131 - DNA, 26 bp, Artificial Sequence
  Synthetic
gtgaagaacaaaagaacuacctugcc

SEQ ID NO: 62132 - DNA, 24 bp, Artificial Sequence
  Synthetic
gcaggaguccaattttcactcauc

SEQ ID NO: 62133 - DNA, 27 bp, Artificial Sequence
  Synthetic
acaagaaccagutggcagtatguaaat

SEQ ID NO: 62134 - DNA, 23 bp, Artificial Sequence
  Synthetic
gaaatcccuaccagcaucagaca

SEQ ID NO: 62135 - DNA, 22 bp, Artificial Sequence
  Synthetic
gcaccacacagacacutttcuc

SEQ ID NO: 62136 - DNA, 24 bp, Artificial Sequence
  Synthetic
cccactagucctcatcctctucag

SEQ ID NO: 62137 - DNA, 25 bp, Artificial Sequence
  Synthetic
tccagaataugggaatgggaatugg

SEQ ID NO: 62138 - DNA, 21 bp, Artificial Sequence
  Synthetic
ccctgcacaaggugagtctut

SEQ ID NO: 62139 - DNA, 21 bp, Artificial Sequence
  Synthetic
gctgctcaaaugggacacauc

SEQ ID NO: 62140 - DNA, 19 bp, Artificial Sequence
  Synthetic
gaacaagcgggucacggua

SEQ ID NO: 62141 - DNA, 21 bp, Artificial Sequence
  Synthetic
gctgcuacagaggcagaugac

SEQ ID NO: 62142 - DNA, 23 bp, Artificial Sequence
  Synthetic
atgtgagagcugggcauaaacaa

SEQ ID NO: 62143 - DNA, 22 bp, Artificial Sequence
  Synthetic
tgccgttcaucttgtgguagag

SEQ ID NO: 62144 - DNA, 19 bp, Artificial Sequence
  Synthetic
cccucaggagcgtcuccat

SEQ ID NO: 62145 - DNA, 22 bp, Artificial Sequence
  Synthetic
gtgattatguccccgtgacugt

SEQ ID NO: 62146 - DNA, 18 bp, Artificial Sequence
  Synthetic
cacagucggucccccaaa

SEQ ID NO: 62147 - DNA, 18 bp, Artificial Sequence
  Synthetic
ccautgccccuggacacc

SEQ ID NO: 62148 - DNA, 21 bp, Artificial Sequence
  Synthetic
ccaagacccccaccuttagug

SEQ ID NO: 62149 - DNA, 22 bp, Artificial Sequence
  Synthetic
tcatactctuggcaacgtcugg

SEQ ID NO: 62150 - DNA, 28 bp, Artificial Sequence
  Synthetic
caggtgattaatutgacagcttgatuag

SEQ ID NO: 62151 - DNA, 28 bp, Artificial Sequence
  Synthetic
ctcccagaagaaaucttatcacatggut

SEQ ID NO: 62152 - DNA, 26 bp, Artificial Sequence
  Synthetic
tggagtgatacugtttcagtggttuc

SEQ ID NO: 62153 - DNA, 26 bp, Artificial Sequence
  Synthetic
gcttattctcuaagagctccugcaaa

SEQ ID NO: 62154 - DNA, 21 bp, Artificial Sequence
  Synthetic
ctggctguggaagtcactcut

SEQ ID NO: 62155 - DNA, 21 bp, Artificial Sequence
  Synthetic
ctaacacccugttcgcacuga

SEQ ID NO: 62156 - DNA, 21 bp, Artificial Sequence
  Synthetic
gtctacccuggcaugcagaat

SEQ ID NO: 62157 - DNA, 20 bp, Artificial Sequence
  Synthetic
ccccacgugccatatagcug

SEQ ID NO: 62158 - DNA, 23 bp, Artificial Sequence
  Synthetic
gggcuaagaaggctgaatuggat

SEQ ID NO: 62159 - DNA, 24 bp, Artificial Sequence
  Synthetic
tctgagaacuccatcagctcauct

SEQ ID NO: 62160 - DNA, 23 bp, Artificial Sequence
  Synthetic
cagaagaaugcagatgtgctgut

SEQ ID NO: 62161 - DNA, 25 bp, Artificial Sequence
  Synthetic
gcatagtgaucaattcccttuccca

SEQ ID NO: 62162 - DNA, 22 bp, Artificial Sequence
  Synthetic
ggcttcacucctgatgaaucca

SEQ ID NO: 62163 - DNA, 25 bp, Artificial Sequence
  Synthetic
ggcttatgatgugcaaagcagtuaa

SEQ ID NO: 62164 - DNA, 25 bp, Artificial Sequence
  Synthetic
gggtgcguagataataaacaaucca

SEQ ID NO: 62165 - DNA, 25 bp, Artificial Sequence
  Synthetic
gcactacctgutctttctcttgcut

SEQ ID NO: 62166 - DNA, 18 bp, Artificial Sequence
  Synthetic
gcagcagagcucagggua

SEQ ID NO: 62167 - DNA, 17 bp, Artificial Sequence
  Synthetic
ctccuggagcgcctuct

SEQ ID NO: 62168 - DNA, 21 bp, Artificial Sequence
  Synthetic
gccagagagcuactgcugaat

SEQ ID NO: 62169 - DNA, 25 bp, Artificial Sequence
  Synthetic
aatagtggtugccagaactucaact

SEQ ID NO: 62170 - DNA, 22 bp, Artificial Sequence
  Synthetic
ccacagcccuaactcaacacut

SEQ ID NO: 62171 - DNA, 23 bp, Artificial Sequence
  Synthetic
agtgtgacccuctctgggaaaua

SEQ ID NO: 62172 - DNA, 22 bp, Artificial Sequence
  Synthetic
ggtactgaagguagctccccut

SEQ ID NO: 62173 - DNA, 26 bp, Artificial Sequence
  Synthetic
caaatccttgtaaugtgtcactggut

SEQ ID NO: 62174 - DNA, 20 bp, Artificial Sequence
  Synthetic
cgggugcagcacacatgaua

SEQ ID NO: 62175 - DNA, 21 bp, Artificial Sequence
  Synthetic
gtgaagcugccagatgtccut

SEQ ID NO: 62176 - DNA, 22 bp, Artificial Sequence
  Synthetic
gggtagctgaautctgctggua

SEQ ID NO: 62177 - DNA, 27 bp, Artificial Sequence
  Synthetic
ctgtcaatggagcugggaatataacut

SEQ ID NO: 62178 - DNA, 22 bp, Artificial Sequence
  Synthetic
ggagucatggugggaagaaagg

SEQ ID NO: 62179 - DNA, 20 bp, Artificial Sequence
  Synthetic
ccccagaaaaaggugcacug

SEQ ID NO: 62180 - DNA, 28 bp, Artificial Sequence
  Synthetic
tctagtggctcuaaagtcaatctctuct

SEQ ID NO: 62181 - DNA, 20 bp, Artificial Sequence
  Synthetic
gaacctguagcacacgucct

SEQ ID NO: 62182 - DNA, 24 bp, Artificial Sequence
  Synthetic
ctctgtgagcugctttttcaugag

SEQ ID NO: 62183 - DNA, 22 bp, Artificial Sequence
  Synthetic
ccaagaucccagccagagtuaa

SEQ ID NO: 62184 - DNA, 25 bp, Artificial Sequence
  Synthetic
gagcttgggaaucttactgucagaa

SEQ ID NO: 62185 - DNA, 22 bp, Artificial Sequence
  Synthetic
gcccaaaucactgaggaguagg

SEQ ID NO: 62186 - DNA, 21 bp, Artificial Sequence
  Synthetic
ggaaacgggagcauggttuag

SEQ ID NO: 62187 - DNA, 21 bp, Artificial Sequence
  Synthetic
tgtagcctugcaacttgggut

SEQ ID NO: 62188 - DNA, 23 bp, Artificial Sequence
  Synthetic
ggcctctuacacaaagtcuggaa

SEQ ID NO: 62189 - DNA, 21 bp, Artificial Sequence
  Synthetic
gtgacccauggaatcugggaa

SEQ ID NO: 62190 - DNA, 21 bp, Artificial Sequence
  Synthetic
gcaggcaggauttggcaaaug

SEQ ID NO: 62191 - DNA, 17 bp, Artificial Sequence
  Synthetic
cacccgcucggccauat

SEQ ID NO: 62192 - DNA, 21 bp, Artificial Sequence
  Synthetic
cctagagcuccggacctcaut

SEQ ID NO: 62193 - DNA, 21 bp, Artificial Sequence
  Synthetic
agagacgcuctgcatgagtug

SEQ ID NO: 62194 - DNA, 25 bp, Artificial Sequence
  Synthetic
agatccagauggaactgcuagagaa

SEQ ID NO: 62195 - DNA, 21 bp, Artificial Sequence
  Synthetic
ctagagauccctgcaguggag

SEQ ID NO: 62196 - DNA, 21 bp, Artificial Sequence
  Synthetic
tgaaaacugggctggcaucaa

SEQ ID NO: 62197 - DNA, 24 bp, Artificial Sequence
  Synthetic
agacttgaaguggctaatguacgg

SEQ ID NO: 62198 - DNA, 27 bp, Artificial Sequence
  Synthetic
cagttctttgtcutggatgttgtcaut

SEQ ID NO: 62199 - DNA, 22 bp, Artificial Sequence
  Synthetic
catgagaugggcatggagaugt

SEQ ID NO: 62200 - DNA, 19 bp, Artificial Sequence
  Synthetic
cgcacctuccagaacgcua

SEQ ID NO: 62201 - DNA, 19 bp, Artificial Sequence
  Synthetic
gagggccaccuggaugaag

SEQ ID NO: 62202 - DNA, 26 bp, Artificial Sequence
  Synthetic
ccttcttctugcaagcacaatgttut

SEQ ID NO: 62203 - DNA, 24 bp, Artificial Sequence
  Synthetic
aagcacugtagaaucagaggagga

SEQ ID NO: 62204 - DNA, 24 bp, Artificial Sequence
  Synthetic
tgtcgttgtugatagctgtgucat

SEQ ID NO: 62205 - DNA, 24 bp, Artificial Sequence
  Synthetic
ttttccacttuccgtttcaacguc

SEQ ID NO: 62206 - DNA, 28 bp, Artificial Sequence
  Synthetic
aatagtatuggaagaaaagggcaucaca

SEQ ID NO: 62207 - DNA, 28 bp, Artificial Sequence
  Synthetic
tgttgtttggccuttgatgttttuaagt

SEQ ID NO: 62208 - DNA, 23 bp, Artificial Sequence
  Synthetic
gaatactugccgcgcttctuaaa

SEQ ID NO: 62209 - DNA, 29 bp, Artificial Sequence
  Synthetic
gggagacutcatcatcaauaaaacaacag

SEQ ID NO: 62210 - DNA, 25 bp, Artificial Sequence
  Synthetic
tcaguccaacaaatugaggaagcaa

SEQ ID NO: 62211 - DNA, 26 bp, Artificial Sequence
  Synthetic
catcagauaggccaggaatcctcuat

SEQ ID NO: 62212 - DNA, 22 bp, Artificial Sequence
  Synthetic
ctcaactcagguatggcagcut

SEQ ID NO: 62213 - DNA, 28 bp, Artificial Sequence
  Synthetic
ctcctggctatugtgcctaatttctaua

SEQ ID NO: 62214 - DNA, 18 bp, Artificial Sequence
  Synthetic
accucagcaccgccuaac

SEQ ID NO: 62215 - DNA, 22 bp, Artificial Sequence
  Synthetic
tgugatcaccuggcaagagaaa

SEQ ID NO: 62216 - DNA, 21 bp, Artificial Sequence
  Synthetic
ggcaacaacutccggauccat

SEQ ID NO: 62217 - DNA, 21 bp, Artificial Sequence
  Synthetic
tctgttctagcugtgggctug

SEQ ID NO: 62218 - DNA, 22 bp, Artificial Sequence
  Synthetic
cgagagcacagggcutatcauc

SEQ ID NO: 62219 - DNA, 21 bp, Artificial Sequence
  Synthetic
tgaggcautggagaacugcac

SEQ ID NO: 62220 - DNA, 20 bp, Artificial Sequence
  Synthetic
caggcacugtcatugccaat

SEQ ID NO: 62221 - DNA, 20 bp, Artificial Sequence
  Synthetic
caggccctugtacctgtgut

SEQ ID NO: 62222 - DNA, 23 bp, Artificial Sequence
  Synthetic
ctgagatcccugtctaccuggaa

SEQ ID NO: 62223 - DNA, 22 bp, Artificial Sequence
  Synthetic
actcactgaugcaggcaucaag

SEQ ID NO: 62224 - DNA, 20 bp, Artificial Sequence
  Synthetic
ccacugcagtccuacgagaa

SEQ ID NO: 62225 - DNA, 24 bp, Artificial Sequence
  Synthetic
agctggaagaaggaaauactggug

SEQ ID NO: 62226 - DNA, 21 bp, Artificial Sequence
  Synthetic
gcactgagtcuctgagccgua

SEQ ID NO: 62227 - DNA, 26 bp, Artificial Sequence
  Synthetic
gggatctcgutaatgacgatctugac

SEQ ID NO: 62228 - DNA, 20 bp, Artificial Sequence
  Synthetic
gcccaaggutcagccacaua

SEQ ID NO: 62229 - DNA, 19 bp, Artificial Sequence
  Synthetic
accacauggatcccaucgg

SEQ ID NO: 62230 - DNA, 22 bp, Artificial Sequence
  Synthetic
cccgtggaucctacttctcugt

SEQ ID NO: 62231 - DNA, 22 bp, Artificial Sequence
  Synthetic
cctccucgtgcattaucaccag

SEQ ID NO: 62232 - DNA, 24 bp, Artificial Sequence
  Synthetic
tttgagggugtacaaugacagcat

SEQ ID NO: 62233 - DNA, 22 bp, Artificial Sequence
  Synthetic
cacccctccugaaaatcacugt

SEQ ID NO: 62234 - DNA, 23 bp, Artificial Sequence
  Synthetic
tgtttatgtgugacaggauggct

SEQ ID NO: 62235 - DNA, 22 bp, Artificial Sequence
  Synthetic
cggtcatccacugtgggatuat

SEQ ID NO: 62236 - DNA, 20 bp, Artificial Sequence
  Synthetic
gcatccggccutctgtcuac

SEQ ID NO: 62237 - DNA, 21 bp, Artificial Sequence
  Synthetic
agaccagaugcaggctccaua

SEQ ID NO: 62238 - DNA, 23 bp, Artificial Sequence
  Synthetic
tggtcugctcctcuagagacaac

SEQ ID NO: 62239 - DNA, 24 bp, Artificial Sequence
  Synthetic
tcacctggguccctgttaaacuaa

SEQ ID NO: 62240 - DNA, 22 bp, Artificial Sequence
  Synthetic
ccaccaaacucatctggtcuga

SEQ ID NO: 62241 - DNA, 21 bp, Artificial Sequence
  Synthetic
gcaggagcutctcaugcagaa

SEQ ID NO: 62242 - DNA, 23 bp, Artificial Sequence
  Synthetic
gaagaucgccaactgcaguaaga

SEQ ID NO: 62243 - DNA, 23 bp, Artificial Sequence
  Synthetic
cccatgactutgaggcatcugag

SEQ ID NO: 62244 - DNA, 23 bp, Artificial Sequence
  Synthetic
tcagctttggugtctgcttugat

SEQ ID NO: 62245 - DNA, 26 bp, Artificial Sequence
  Synthetic
agagctgugggcaatagtaatttuca

SEQ ID NO: 62246 - DNA, 26 bp, Artificial Sequence
  Synthetic
acatgaaaagauagcccatccugaag

SEQ ID NO: 62247 - DNA, 24 bp, Artificial Sequence
  Synthetic
ctgaagccagauatggtcatucca

SEQ ID NO: 62248 - DNA, 22 bp, Artificial Sequence
  Synthetic
ggtagctcuccaggaggaaguc

SEQ ID NO: 62249 - DNA, 24 bp, Artificial Sequence
  Synthetic
gctctgggtcugaaaagaagctut

SEQ ID NO: 62250 - DNA, 22 bp, Artificial Sequence
  Synthetic
catgctggcutctgactctgut

SEQ ID NO: 62251 - DNA, 20 bp, Artificial Sequence
  Synthetic
gctgcugcactucaaagacc

SEQ ID NO: 62252 - DNA, 21 bp, Artificial Sequence
  Synthetic
gaacaggtccutctggtggut

SEQ ID NO: 62253 - DNA, 17 bp, Artificial Sequence
  Synthetic
gcaccgcutgaccccut

SEQ ID NO: 62254 - DNA, 21 bp, Artificial Sequence
  Synthetic
caatccccaggugtcttgguc

SEQ ID NO: 62255 - DNA, 28 bp, Artificial Sequence
  Synthetic
gtgatgacaacucctacatgtacatuct

SEQ ID NO: 62256 - DNA, 23 bp, Artificial Sequence
  Synthetic
ccatgaaggugctcatgtucact

SEQ ID NO: 62257 - DNA, 23 bp, Artificial Sequence
  Synthetic
acagaaacugagctgccaauacc

SEQ ID NO: 62258 - DNA, 21 bp, Artificial Sequence
  Synthetic
cctggtggucaccttccuaga

SEQ ID NO: 62259 - DNA, 22 bp, Artificial Sequence
  Synthetic
acagtctgcauaacacccugac

SEQ ID NO: 62260 - DNA, 19 bp, Artificial Sequence
  Synthetic
aggtccugtgacucccgat

SEQ ID NO: 62261 - DNA, 20 bp, Artificial Sequence
  Synthetic
cgctgtaccucagggcttuc

SEQ ID NO: 62262 - DNA, 27 bp, Artificial Sequence
  Synthetic
acagaaugtctgagaauagcaaaacca

SEQ ID NO: 62263 - DNA, 28 bp, Artificial Sequence
  Synthetic
gcgacagtaatcugttaagccatttaut

SEQ ID NO: 62264 - DNA, 25 bp, Artificial Sequence
  Synthetic
agatgcugaacaaaaggacttcuga

SEQ ID NO: 62265 - DNA, 27 bp, Artificial Sequence
  Synthetic
catgaagatggutttctagagcaucct

SEQ ID NO: 62266 - DNA, 24 bp, Artificial Sequence
  Synthetic
tgtauggcaaaagcagaugaggaa

SEQ ID NO: 62267 - DNA, 21 bp, Artificial Sequence
  Synthetic
agtugccacaaacccucagac

SEQ ID NO: 62268 - DNA, 26 bp, Artificial Sequence
  Synthetic
cggaattugaaaacaagcaagctcuc

SEQ ID NO: 62269 - DNA, 28 bp, Artificial Sequence
  Synthetic
gaccaagucactctttctaugcaaaaac

SEQ ID NO: 62270 - DNA, 25 bp, Artificial Sequence
  Synthetic
gctatttggttugagaagcgatugg

SEQ ID NO: 62271 - DNA, 27 bp, Artificial Sequence
  Synthetic
cctgcaacucagaatgtagaaaaagug

SEQ ID NO: 62272 - DNA, 24 bp, Artificial Sequence
  Synthetic
ctctttgacuggaccatgaaucct

SEQ ID NO: 62273 - DNA, 28 bp, Artificial Sequence
  Synthetic
tgaaaaacugacaacaggaccttctuaa

SEQ ID NO: 62274 - DNA, 21 bp, Artificial Sequence
  Synthetic
gggcucaagcatcagttucat

SEQ ID NO: 62275 - DNA, 23 bp, Artificial Sequence
  Synthetic
cctactctugctcctctccucac

SEQ ID NO: 62276 - DNA, 22 bp, Artificial Sequence
  Synthetic
cccacagtugccttttcaguga

SEQ ID NO: 62277 - DNA, 23 bp, Artificial Sequence
  Synthetic
aagaaatgccacagucctcctut

SEQ ID NO: 62278 - DNA, 24 bp, Artificial Sequence
  Synthetic
gcaaaagaaaacccaguccugaca

SEQ ID NO: 62279 - DNA, 21 bp, Artificial Sequence
  Synthetic
tguacacaagaacgggctuca

SEQ ID NO: 62280 - DNA, 21 bp, Artificial Sequence
  Synthetic
gttgctgagugtgcctcacua

SEQ ID NO: 62281 - DNA, 28 bp, Artificial Sequence
  Synthetic
gaauacagccaggaauagcagaaagaat

SEQ ID NO: 62282 - DNA, 22 bp, Artificial Sequence
  Synthetic
cagtgggcagutgtgagaauga

SEQ ID NO: 62283 - DNA, 21 bp, Artificial Sequence
  Synthetic
ttccuccaaagagctgcaucc

SEQ ID NO: 62284 - DNA, 21 bp, Artificial Sequence
  Synthetic
agcggccaaugatttcucaga

SEQ ID NO: 62285 - DNA, 22 bp, Artificial Sequence
  Synthetic
accacacttugtactggtgcug

SEQ ID NO: 62286 - DNA, 22 bp, Artificial Sequence
  Synthetic
gttggtgguggttagtggguat

SEQ ID NO: 62287 - DNA, 22 bp, Artificial Sequence
  Synthetic
gtgtctgcucctgcactatcug

SEQ ID NO: 62288 - DNA, 24 bp, Artificial Sequence
  Synthetic
ggattaagaagcaaugccctcuca

SEQ ID NO: 62289 - DNA, 28 bp, Artificial Sequence
  Synthetic
ggacttagcaagaagutatggaatucct

SEQ ID NO: 62290 - DNA, 21 bp, Artificial Sequence
  Synthetic
ggaacagaaugtgcuggcaat

SEQ ID NO: 62291 - DNA, 21 bp, Artificial Sequence
  Synthetic
gcaucagagctcctuccacag

SEQ ID NO: 62292 - DNA, 26 bp, Artificial Sequence
  Synthetic
gtactgtcugtggtatgtgucaaagt

SEQ ID NO: 62293 - DNA, 22 bp, Artificial Sequence
  Synthetic
ctggagauttctccugacagca

SEQ ID NO: 62294 - DNA, 24 bp, Artificial Sequence
  Synthetic
ttttgatgccaugcactcattucc

SEQ ID NO: 62295 - DNA, 28 bp, Artificial Sequence
  Synthetic
cttgacagacaacucccacttcttaaua

SEQ ID NO: 62296 - DNA, 21 bp, Artificial Sequence
  Synthetic
tggttctgcccucctgtacut

SEQ ID NO: 62297 - DNA, 27 bp, Artificial Sequence
  Synthetic
tggtaatgatguctcatgacgttucat

SEQ ID NO: 62298 - DNA, 28 bp, Artificial Sequence
  Synthetic
ttcaaatacuaggtttctucaacagcga

SEQ ID NO: 62299 - DNA, 28 bp, Artificial Sequence
  Synthetic
cactttgcatuccaagatctgatttcut

SEQ ID NO: 62300 - DNA, 22 bp, Artificial Sequence
  Synthetic
acagtctgguactctcctgguc

SEQ ID NO: 62301 - DNA, 28 bp, Artificial Sequence
  Synthetic
aacaattatgcacacaautcagtcgtut

SEQ ID NO: 62302 - DNA, 22 bp, Artificial Sequence
  Synthetic
ctaccatcuaccccctgucaca

SEQ ID NO: 62303 - DNA, 22 bp, Artificial Sequence
  Synthetic
ccaccctcutctctctccugaa

SEQ ID NO: 62304 - DNA, 21 bp, Artificial Sequence
  Synthetic
gaggagagccacucuaagcaa

SEQ ID NO: 62305 - DNA, 23 bp, Artificial Sequence
  Synthetic
acctcctaacgutgttgggttuc

SEQ ID NO: 62306 - DNA, 21 bp, Artificial Sequence
  Synthetic
caggtcccugaaggugaagaa

SEQ ID NO: 62307 - DNA, 25 bp, Artificial Sequence
  Synthetic
ctctcctctaacutaccatcctgug

SEQ ID NO: 62308 - DNA, 20 bp, Artificial Sequence
  Synthetic
gggagaaggaugcugaggga

SEQ ID NO: 62309 - DNA, 17 bp, Artificial Sequence
  Synthetic
ccgtgcucctgccgtut

SEQ ID NO: 62310 - DNA, 21 bp, Artificial Sequence
  Synthetic
ctgggctcuccttgttgagut

SEQ ID NO: 62311 - DNA, 28 bp, Artificial Sequence
  Synthetic
caaacgaugaagagttcaaaaugcagat

SEQ ID NO: 62312 - DNA, 21 bp, Artificial Sequence
  Synthetic
ggatcccagauggtgacccua

SEQ ID NO: 62313 - DNA, 27 bp, Artificial Sequence
  Synthetic
catctcacauagatcttgactgucact

SEQ ID NO: 62314 - DNA, 22 bp, Artificial Sequence
  Synthetic
gagttgtagcucagccctctut

SEQ ID NO: 62315 - DNA, 24 bp, Artificial Sequence
  Synthetic
gaaatcacagaguttctgcuggga

SEQ ID NO: 62316 - DNA, 24 bp, Artificial Sequence
  Synthetic
tcgttcctugggtttcttucaaca

SEQ ID NO: 62317 - DNA, 28 bp, Artificial Sequence
  Synthetic
ggtcatagtaaucaccagtgttcugaat

SEQ ID NO: 62318 - DNA, 23 bp, Artificial Sequence
  Synthetic
ttctgugcccagctttatucact

SEQ ID NO: 62319 - DNA, 24 bp, Artificial Sequence
  Synthetic
gggtgtctgaugtgacttttcuct

SEQ ID NO: 62320 - DNA, 23 bp, Artificial Sequence
  Synthetic
aataaggugaggcccatgtctuc

SEQ ID NO: 62321 - DNA, 26 bp, Artificial Sequence
  Synthetic
tggaauaaaaggagagaagggttucc

SEQ ID NO: 62322 - DNA, 21 bp, Artificial Sequence
  Synthetic
cctccatacccuccccactua

SEQ ID NO: 62323 - DNA, 21 bp, Artificial Sequence
  Synthetic
ctaaccccacautccccaucc

SEQ ID NO: 62324 - DNA, 23 bp, Artificial Sequence
  Synthetic
acuatggugcaacagcagaagag

SEQ ID NO: 62325 - DNA, 28 bp, Artificial Sequence
  Synthetic
tgttaacaccaaauaacttactgcucaa

SEQ ID NO: 62326 - DNA, 22 bp, Artificial Sequence
  Synthetic
ctacgtccaccaucaagtccuc

SEQ ID NO: 62327 - DNA, 21 bp, Artificial Sequence
  Synthetic
gttgcccaguagagucacaca

SEQ ID NO: 62328 - DNA, 22 bp, Artificial Sequence
  Synthetic
gctccattuctggcacugagat

SEQ ID NO: 62329 - DNA, 20 bp, Artificial Sequence
  Synthetic
cacaagccccucattucacc

SEQ ID NO: 62330 - DNA, 21 bp, Artificial Sequence
  Synthetic
gccaccacaguctcctactuc

SEQ ID NO: 62331 - DNA, 29 bp, Artificial Sequence
  Synthetic
ggatttcatgtttuccacactttgctuat

SEQ ID NO: 62332 - DNA, 21 bp, Artificial Sequence
  Synthetic
tccucagggcagugaagaaga

SEQ ID NO: 62333 - DNA, 26 bp, Artificial Sequence
  Synthetic
aggactgatuggactttgtttcctut

SEQ ID NO: 62334 - DNA, 21 bp, Artificial Sequence
  Synthetic
gctggttgucactgtggcuat

SEQ ID NO: 62335 - DNA, 19 bp, Artificial Sequence
  Synthetic
cgagcagaucgcccucaag

SEQ ID NO: 62336 - DNA, 21 bp, Artificial Sequence
  Synthetic
ggaacacgguaactcggtuga

SEQ ID NO: 62337 - DNA, 24 bp, Artificial Sequence
  Synthetic
ctatgaggaguccctggaacauct

SEQ ID NO: 62338 - DNA, 19 bp, Artificial Sequence
  Synthetic
atggucccgaaugcaccaa

SEQ ID NO: 62339 - DNA, 25 bp, Artificial Sequence
  Synthetic
tgcttcttttgutgactctcctucc

SEQ ID NO: 62340 - DNA, 25 bp, Artificial Sequence
  Synthetic
cttctttctttaguagcagcccugt

SEQ ID NO: 62341 - DNA, 27 bp, Artificial Sequence
  Synthetic
gatgtgttttcugacgttctgtagtuc

SEQ ID NO: 62342 - DNA, 27 bp, Artificial Sequence
  Synthetic
ctgcaactuaaggaagaatctgugaag

SEQ ID NO: 62343 - DNA, 23 bp, Artificial Sequence
  Synthetic
ccagucacaccagcaatcacaua

SEQ ID NO: 62344 - DNA, 25 bp, Artificial Sequence
  Synthetic
gtacttttuaagggttgugggacct

SEQ ID NO: 62345 - DNA, 28 bp, Artificial Sequence
  Synthetic
gcuttaaatgatagcuacacagcacaaa

SEQ ID NO: 62346 - DNA, 22 bp, Artificial Sequence
  Synthetic
cctcgggcutcttcttcaucat

SEQ ID NO: 62347 - DNA, 26 bp, Artificial Sequence
  Synthetic
gcctgatggtugtaagagtggaatua

SEQ ID NO: 62348 - DNA, 22 bp, Artificial Sequence
  Synthetic
gacgtcacaauagcgacucact

SEQ ID NO: 62349 - DNA, 21 bp, Artificial Sequence
  Synthetic
gacagcugccctttacctcuc

SEQ ID NO: 62350 - DNA, 22 bp, Artificial Sequence
  Synthetic
tgggtgggautcaccactttuc

SEQ ID NO: 62351 - DNA, 24 bp, Artificial Sequence
  Synthetic
ttacaacgtguctctgcttctcuc

SEQ ID NO: 62352 - DNA, 22 bp, Artificial Sequence
  Synthetic
tcatcctcugctgcctuaggaa

SEQ ID NO: 62353 - DNA, 21 bp, Artificial Sequence
  Synthetic
acactgcagcugctattgucc

SEQ ID NO: 62354 - DNA, 24 bp, Artificial Sequence
  Synthetic
ggaaacccaaguggcatctatuca

SEQ ID NO: 62355 - DNA, 20 bp, Artificial Sequence
  Synthetic
accggagguctctuccagac

SEQ ID NO: 62356 - DNA, 28 bp, Artificial Sequence
  Synthetic
ggtgaattaaugaagcaaaacctggaut

SEQ ID NO: 62357 - DNA, 21 bp, Artificial Sequence
  Synthetic
aagggaucagctaccuccact

SEQ ID NO: 62358 - DNA, 25 bp, Artificial Sequence
  Synthetic
tgagccaaccaggaauattttcuga

SEQ ID NO: 62359 - DNA, 21 bp, Artificial Sequence
  Synthetic
gtgagatgugtcctgctguga

SEQ ID NO: 62360 - DNA, 24 bp, Artificial Sequence
  Synthetic
aataaaagagccugggctgttcut

SEQ ID NO: 62361 - DNA, 22 bp, Artificial Sequence
  Synthetic
cccagcttuactgtgtgggaut

SEQ ID NO: 62362 - DNA, 21 bp, Artificial Sequence
  Synthetic
gccccctugggaaagtacaua

SEQ ID NO: 62363 - DNA, 24 bp, Artificial Sequence
  Synthetic
gcttcagcauctgcatcttctuct

SEQ ID NO: 62364 - DNA, 18 bp, Artificial Sequence
  Synthetic
gaagttgcugcgggtguc

SEQ ID NO: 62365 - DNA, 20 bp, Artificial Sequence
  Synthetic
gugggugcacagaaccagaa

SEQ ID NO: 62366 - DNA, 28 bp, Artificial Sequence
  Synthetic
atcatctcatccugtgtttgtgatugat

SEQ ID NO: 62367 - DNA, 23 bp, Artificial Sequence
  Synthetic
gaaagaatguggtcgcagcuaag

SEQ ID NO: 62368 - DNA, 22 bp, Artificial Sequence
  Synthetic
gcgtguctccacaaugaggaag

SEQ ID NO: 62369 - DNA, 23 bp, Artificial Sequence
  Synthetic
tcttcaaugtggtgucagacaca

SEQ ID NO: 62370 - DNA, 17 bp, Artificial Sequence
  Synthetic
gccgtucgtgcuggact

SEQ ID NO: 62371 - DNA, 17 bp, Artificial Sequence
  Synthetic
ggccaaggcguggauca

SEQ ID NO: 62372 - DNA, 21 bp, Artificial Sequence
  Synthetic
tgtgagccgguggttaaacug

SEQ ID NO: 62373 - DNA, 22 bp, Artificial Sequence
  Synthetic
tgcttttcucactcctgctugt

SEQ ID NO: 62374 - DNA, 21 bp, Artificial Sequence
  Synthetic
gcccucagagcccagtttcua

SEQ ID NO: 62375 - DNA, 22 bp, Artificial Sequence
  Synthetic
tgctaagacccauttcctuccc

SEQ ID NO: 62376 - DNA, 19 bp, Artificial Sequence
  Synthetic
ttgctaagccucggctgut

SEQ ID NO: 62377 - DNA, 24 bp, Artificial Sequence
  Synthetic
ttgatgatgaugtcaggcatcucc

SEQ ID NO: 62378 - DNA, 22 bp, Artificial Sequence
  Synthetic
gctcctacagguacacggagut

SEQ ID NO: 62379 - DNA, 20 bp, Artificial Sequence
  Synthetic
ggtagcaggacuggauggga

SEQ ID NO: 62380 - DNA, 19 bp, Artificial Sequence
  Synthetic
caggcaguagccgagauca

SEQ ID NO: 62381 - DNA, 17 bp, Artificial Sequence
  Synthetic
gcuctuggcgccacact

SEQ ID NO: 62382 - DNA, 17 bp, Artificial Sequence
  Synthetic
gcguaccgaggugagca

SEQ ID NO: 62383 - DNA, 18 bp, Artificial Sequence
  Synthetic
gccacccgcucctacuga

SEQ ID NO: 62384 - DNA, 20 bp, Artificial Sequence
  Synthetic
ggattuggcaggcgaguagg

SEQ ID NO: 62385 - DNA, 21 bp, Artificial Sequence
  Synthetic
tgtgtgacacaucccctggua

SEQ ID NO: 62386 - DNA, 20 bp, Artificial Sequence
  Synthetic
tcgtgccaacgugtcttgua

SEQ ID NO: 62387 - DNA, 21 bp, Artificial Sequence
  Synthetic
cctacccugggtggtcgauag

SEQ ID NO: 62388 - DNA, 18 bp, Artificial Sequence
  Synthetic
cgttgaugcgcugggact

SEQ ID NO: 62389 - DNA, 19 bp, Artificial Sequence
  Synthetic
gcaagauggccgagcagua

SEQ ID NO: 62390 - DNA, 24 bp, Artificial Sequence
  Synthetic
gagguattaggaugcaggaaagca

SEQ ID NO: 62391 - DNA, 23 bp, Artificial Sequence
  Synthetic
ggagctctucctttccttcctut

SEQ ID NO: 62392 - DNA, 24 bp, Artificial Sequence
  Synthetic
gatgaacauggtgtggtugaagag

SEQ ID NO: 62393 - DNA, 24 bp, Artificial Sequence
  Synthetic
ggctccttgucttctgacttcaua

SEQ ID NO: 62394 - DNA, 26 bp, Artificial Sequence
  Synthetic
tgaagtcacaaucagctaaactugct

SEQ ID NO: 62395 - DNA, 23 bp, Artificial Sequence
  Synthetic
agtttggtgcuttggaaagtgug

SEQ ID NO: 62396 - DNA, 26 bp, Artificial Sequence
  Synthetic
cgcagccuaaacactttuaaaaaggt

SEQ ID NO: 62397 - DNA, 26 bp, Artificial Sequence
  Synthetic
gcttttctgaaaugttggtcttcugt

SEQ ID NO: 62398 - DNA, 22 bp, Artificial Sequence
  Synthetic
tttctcatggucccctctccut

SEQ ID NO: 62399 - DNA, 28 bp, Artificial Sequence
  Synthetic
caagttaggtutagttcaagcaucaaca

SEQ ID NO: 62400 - DNA, 20 bp, Artificial Sequence
  Synthetic
catguccggcttcuccaaca

SEQ ID NO: 62401 - DNA, 24 bp, Artificial Sequence
  Synthetic
aacctgttcugaaagacaucggaa

SEQ ID NO: 62402 - DNA, 27 bp, Artificial Sequence
  Synthetic
cgagctatagcagautatcttcgtuca

SEQ ID NO: 62403 - DNA, 28 bp, Artificial Sequence
  Synthetic
acaaatgacaaaatugtgcgtaactgut

SEQ ID NO: 62404 - DNA, 24 bp, Artificial Sequence
  Synthetic
ggtatagaagutggtccucagcct

SEQ ID NO: 62405 - DNA, 27 bp, Artificial Sequence
  Synthetic
atctgacccaggutccaattgttatut

SEQ ID NO: 62406 - DNA, 19 bp, Artificial Sequence
  Synthetic
ccacccagcguccgaauaa

SEQ ID NO: 62407 - DNA, 21 bp, Artificial Sequence
  Synthetic
gtctccaucaacgtcctgcuc

SEQ ID NO: 62408 - DNA, 21 bp, Artificial Sequence
  Synthetic
cagggtggugtatggcaacua

SEQ ID NO: 62409 - DNA, 22 bp, Artificial Sequence
  Synthetic
cccgtacugccttaagagaugg

SEQ ID NO: 62410 - DNA, 18 bp, Artificial Sequence
  Synthetic
tccccgucgcuagggaaa

SEQ ID NO: 62411 - DNA, 17 bp, Artificial Sequence
  Synthetic
gctccgccucagcacuc

SEQ ID NO: 62412 - DNA, 25 bp, Artificial Sequence
  Synthetic
gggttggctuacagaaaattacgut

SEQ ID NO: 62413 - DNA, 20 bp, Artificial Sequence
  Synthetic
ggagtauccaggaccgagug

SEQ ID NO: 62414 - DNA, 21 bp, Artificial Sequence
  Synthetic
cagccgaauctcgaactucct

SEQ ID NO: 62415 - DNA, 20 bp, Artificial Sequence
  Synthetic
ccggucctccacauagaggt

SEQ ID NO: 62416 - DNA, 20 bp, Artificial Sequence
  Synthetic
tcatcaguccgctggagtug

SEQ ID NO: 62417 - DNA, 21 bp, Artificial Sequence
  Synthetic
caagtcugccgggttgatgua

SEQ ID NO: 62418 - DNA, 22 bp, Artificial Sequence
  Synthetic
gccctgucctctatcuacagca

SEQ ID NO: 62419 - DNA, 19 bp, Artificial Sequence
  Synthetic
gtgtcucggagccgaugaa

SEQ ID NO: 62420 - DNA, 23 bp, Artificial Sequence
  Synthetic
cagctttcaucagctccauggat

SEQ ID NO: 62421 - DNA, 21 bp, Artificial Sequence
  Synthetic
tgatggaacugtggctggtug

SEQ ID NO: 62422 - DNA, 28 bp, Artificial Sequence
  Synthetic
ggaaaactatcacautcttcgcagguaa

SEQ ID NO: 62423 - DNA, 24 bp, Artificial Sequence
  Synthetic
ggtacacagagaaggutatgcugt

SEQ ID NO: 62424 - DNA, 21 bp, Artificial Sequence
  Synthetic
gcctgtguggaggtctttcut

SEQ ID NO: 62425 - DNA, 24 bp, Artificial Sequence
  Synthetic
tcttctgucccagtcatctgugat

SEQ ID NO: 62426 - DNA, 21 bp, Artificial Sequence
  Synthetic
ggatguaggcgaaaccguagg

SEQ ID NO: 62427 - DNA, 25 bp, Artificial Sequence
  Synthetic
agcagatttccutccagagguagaa

SEQ ID NO: 62428 - DNA, 24 bp, Artificial Sequence
  Synthetic
gcutccaauaaaaacaggacagca

SEQ ID NO: 62429 - DNA, 26 bp, Artificial Sequence
  Synthetic
aagcaaatuccccaaaacacaguaac

SEQ ID NO: 62430 - DNA, 28 bp, Artificial Sequence
  Synthetic
gcagttagcagutataaatagccuggaa

SEQ ID NO: 62431 - DNA, 30 bp, Artificial Sequence
  Synthetic
tcctgaaaatgaaugtgaaactatcacuca

SEQ ID NO: 62432 - DNA, 24 bp, Artificial Sequence
  Synthetic
cguataagcccucacaacaaccaa

SEQ ID NO: 62433 - DNA, 31 bp, Artificial Sequence
  Synthetic
gtcttgaaacgaacaucaatacataatagug

SEQ ID NO: 62434 - DNA, 22 bp, Artificial Sequence
  Synthetic
ggtgtgtgtutgcatggtctua

SEQ ID NO: 62435 - DNA, 24 bp, Artificial Sequence
  Synthetic
catcaatctuaggccaccaaucca

SEQ ID NO: 62436 - DNA, 22 bp, Artificial Sequence
  Synthetic
ctactcctttugggtggagcut

SEQ ID NO: 62437 - DNA, 22 bp, Artificial Sequence
  Synthetic
aagaggcutccaaatugagggt

SEQ ID NO: 62438 - DNA, 33 bp, Artificial Sequence
  Synthetic
tttagaatgccttcucttttgtctatatcugat

SEQ ID NO: 62439 - DNA, 28 bp, Artificial Sequence
  Synthetic
ctctccttgccaucattacttcaacuaa

SEQ ID NO: 62440 - DNA, 33 bp, Artificial Sequence
  Synthetic
agcagaaattatatcaaugagaaaattcatgut

SEQ ID NO: 62441 - DNA, 24 bp, Artificial Sequence
  Synthetic
gccgcataugttcttcttttguga

SEQ ID NO: 62442 - DNA, 28 bp, Artificial Sequence
  Synthetic
aggcaucaggtacaugaaaaagaagaat

SEQ ID NO: 62443 - DNA, 27 bp, Artificial Sequence
  Synthetic
tcaattcctgutaagtcaacugggaaa

SEQ ID NO: 62444 - DNA, 26 bp, Artificial Sequence
  Synthetic
tgtgctaaaactutgagtcccatgut

SEQ ID NO: 62445 - DNA, 25 bp, Artificial Sequence
  Synthetic
cacaucaagggaattgtugaaggac

SEQ ID NO: 62446 - DNA, 21 bp, Artificial Sequence
  Synthetic
gggacaccgugtacaccatug

SEQ ID NO: 62447 - DNA, 21 bp, Artificial Sequence
  Synthetic
cagaccaacccutccctctug

SEQ ID NO: 62448 - DNA, 25 bp, Artificial Sequence
  Synthetic
tccaacagaaggaggutcuagagag

SEQ ID NO: 62449 - DNA, 21 bp, Artificial Sequence
  Synthetic
cccatgtacuccagcgatgug

SEQ ID NO: 62450 - DNA, 19 bp, Artificial Sequence
  Synthetic
gctcctucccctcgccuaa

SEQ ID NO: 62451 - DNA, 18 bp, Artificial Sequence
  Synthetic
atccaugccatccugcgt

SEQ ID NO: 62452 - DNA, 28 bp, Artificial Sequence
  Synthetic
ctgatcagaagggauattaaggguacct

SEQ ID NO: 62453 - DNA, 24 bp, Artificial Sequence
  Synthetic
ggcuaaggcaaggcctattttuca

SEQ ID NO: 62454 - DNA, 22 bp, Artificial Sequence
  Synthetic
cctcaccacucttccagucaga

SEQ ID NO: 62455 - DNA, 21 bp, Artificial Sequence
  Synthetic
caagagaaggcucacgauggt

SEQ ID NO: 62456 - DNA, 25 bp, Artificial Sequence
  Synthetic
gagagaaggagagaugcugagagat

SEQ ID NO: 62457 - DNA, 23 bp, Artificial Sequence
  Synthetic
cactccagucttcttggttguca

SEQ ID NO: 62458 - DNA, 22 bp, Artificial Sequence
  Synthetic
gcttcttcutctctggcuacga

SEQ ID NO: 62459 - DNA, 21 bp, Artificial Sequence
  Synthetic
tgggatttucagccaccucac

SEQ ID NO: 62460 - DNA, 21 bp, Artificial Sequence
  Synthetic
cacugggaacaacccgtcuac

SEQ ID NO: 62461 - DNA, 23 bp, Artificial Sequence
  Synthetic
aaagggaattcuggttggtccuc

SEQ ID NO: 62462 - DNA, 21 bp, Artificial Sequence
  Synthetic
acggcgagautgaggcctaua

SEQ ID NO: 62463 - DNA, 20 bp, Artificial Sequence
  Synthetic
ctgagggcaucctctgtguc

SEQ ID NO: 62464 - DNA, 17 bp, Artificial Sequence
  Synthetic
ctgcugagcccgcttuc

SEQ ID NO: 62465 - DNA, 19 bp, Artificial Sequence
  Synthetic
gaggagccacucagctcuc

SEQ ID NO: 62466 - DNA, 20 bp, Artificial Sequence
  Synthetic
ggaggaagcucccuggaaac

SEQ ID NO: 62467 - DNA, 19 bp, Artificial Sequence
  Synthetic
gccccaaccutguaggaca

SEQ ID NO: 62468 - DNA, 21 bp, Artificial Sequence
  Synthetic
gcaggcacutgctugaaacac

SEQ ID NO: 62469 - DNA, 29 bp, Artificial Sequence
  Synthetic
agcagtctctgucttatgattcatttgut

SEQ ID NO: 62470 - DNA, 21 bp, Artificial Sequence
  Synthetic
gccatggauaggctcaucagg

SEQ ID NO: 62471 - DNA, 26 bp, Artificial Sequence
  Synthetic
cagtgcauacttttgtggugaaaact

SEQ ID NO: 62472 - DNA, 22 bp, Artificial Sequence
  Synthetic
tcagaaucagcaggttugcagt

SEQ ID NO: 62473 - DNA, 28 bp, Artificial Sequence
  Synthetic
cttaaatguaggaatgggatgucacaga

SEQ ID NO: 62474 - DNA, 26 bp, Artificial Sequence
  Synthetic
ctatgatgcuaactacgaugggaagg

SEQ ID NO: 62475 - DNA, 22 bp, Artificial Sequence
  Synthetic
aactcccgcaauctcattguga

SEQ ID NO: 62476 - DNA, 25 bp, Artificial Sequence
  Synthetic
tggagtttuaccttggaugcaaaca

SEQ ID NO: 62477 - DNA, 23 bp, Artificial Sequence
  Synthetic
gaaactguccgtagatgcugact

SEQ ID NO: 62478 - DNA, 18 bp, Artificial Sequence
  Synthetic
ccgccuctgauggcgaaa

SEQ ID NO: 62479 - DNA, 19 bp, Artificial Sequence
  Synthetic
cagctcaggcuccttgucc

SEQ ID NO: 62480 - DNA, 21 bp, Artificial Sequence
  Synthetic
atgccaaguatgaccgcuacc

SEQ ID NO: 62481 - DNA, 20 bp, Artificial Sequence
  Synthetic
gtaatgcucccgcgtctuct

SEQ ID NO: 62482 - DNA, 20 bp, Artificial Sequence
  Synthetic
tgtctgccacuccctgguat

SEQ ID NO: 62483 - DNA, 25 bp, Artificial Sequence
  Synthetic
gaaagttcttguactcctccaccuc

SEQ ID NO: 62484 - DNA, 21 bp, Artificial Sequence
  Synthetic
gcaaggccaggaaaugctcut

SEQ ID NO: 62485 - DNA, 23 bp, Artificial Sequence
  Synthetic
cgaccagccaguctctaaaagua

SEQ ID NO: 62486 - DNA, 20 bp, Artificial Sequence
  Synthetic
ccctgcaaucgtctcugact

SEQ ID NO: 62487 - DNA, 23 bp, Artificial Sequence
  Synthetic
agggcaacatuaagggtctgtut

SEQ ID NO: 62488 - DNA, 23 bp, Artificial Sequence
  Synthetic
cgggcagagaaaucctauacagt

SEQ ID NO: 62489 - DNA, 22 bp, Artificial Sequence
  Synthetic
agaguagacaagctgugggaga

SEQ ID NO: 62490 - DNA, 21 bp, Artificial Sequence
  Synthetic
ggcttgaaagcuggctcucat

SEQ ID NO: 62491 - DNA, 24 bp, Artificial Sequence
  Synthetic
ccccaaaatugagggttactgguc

SEQ ID NO: 62492 - DNA, 19 bp, Artificial Sequence
  Synthetic
tctgugcagccacguagac

SEQ ID NO: 62493 - DNA, 23 bp, Artificial Sequence
  Synthetic
gtgaccatttuctgtgctcctuc

SEQ ID NO: 62494 - DNA, 22 bp, Artificial Sequence
  Synthetic
ctcagagutcctgcttugggat

SEQ ID NO: 62495 - DNA, 24 bp, Artificial Sequence
  Synthetic
agaggtcucgagagaaagtuagca

SEQ ID NO: 62496 - DNA, 21 bp, Artificial Sequence
  Synthetic
gtactctgugcagacgucact

SEQ ID NO: 62497 - DNA, 22 bp, Artificial Sequence
  Synthetic
ctcagtggcautgtggttgtuc

SEQ ID NO: 62498 - DNA, 23 bp, Artificial Sequence
  Synthetic
agaaatccagutcctgcttucgt

SEQ ID NO: 62499 - DNA, 19 bp, Artificial Sequence
  Synthetic
gcacatgcuccgacaggut

SEQ ID NO: 62500 - DNA, 19 bp, Artificial Sequence
  Synthetic
gcccacucggctaaccaut

SEQ ID NO: 62501 - DNA, 20 bp, Artificial Sequence
  Synthetic
caagguacagggcatgcauc

SEQ ID NO: 62502 - DNA, 20 bp, Artificial Sequence
  Synthetic
gctcgguggatgaggucaat

SEQ ID NO: 62503 - DNA, 22 bp, Artificial Sequence
  Synthetic
cacaaatcctucccaagctcug

SEQ ID NO: 62504 - DNA, 17 bp, Artificial Sequence
  Synthetic
gcuccgcaggcaaggua

SEQ ID NO: 62505 - DNA, 20 bp, Artificial Sequence
  Synthetic
ccgaguggagagctggauct

SEQ ID NO: 62506 - DNA, 24 bp, Artificial Sequence
  Synthetic
gaagacuatggtttugggacacga

SEQ ID NO: 62507 - DNA, 21 bp, Artificial Sequence
  Synthetic
cccttcgagaagcugcagaug

SEQ ID NO: 62508 - DNA, 24 bp, Artificial Sequence
  Synthetic
agaacaactguaacccaagcauca

SEQ ID NO: 62509 - DNA, 23 bp, Artificial Sequence
  Synthetic
tcatagcgacagugatcgtcauc

SEQ ID NO: 62510 - DNA, 17 bp, Artificial Sequence
  Synthetic
ggaccagccggcaucuc

SEQ ID NO: 62511 - DNA, 18 bp, Artificial Sequence
  Synthetic
gcuccccagggaagguca

SEQ ID NO: 62512 - DNA, 19 bp, Artificial Sequence
  Synthetic
cttggacccggacucgtua

SEQ ID NO: 62513 - DNA, 17 bp, Artificial Sequence
  Synthetic
cgcucgcaggtcuccag

SEQ ID NO: 62514 - DNA, 21 bp, Artificial Sequence
  Synthetic
aagaactucaggcgccaagua

SEQ ID NO: 62515 - DNA, 22 bp, Artificial Sequence
  Synthetic
cctacgtgucttcttggacugg

SEQ ID NO: 62516 - DNA, 19 bp, Artificial Sequence
  Synthetic
catguagcgggcctcuagt

SEQ ID NO: 62517 - DNA, 18 bp, Artificial Sequence
  Synthetic
aaagucccccagccctug

SEQ ID NO: 62518 - DNA, 21 bp, Artificial Sequence
  Synthetic
atgtggtgcaucctgtctgut

SEQ ID NO: 62519 - DNA, 28 bp, Artificial Sequence
  Synthetic
agaagcaaaacaaaagguttaagctugt

SEQ ID NO: 62520 - DNA, 21 bp, Artificial Sequence
  Synthetic
agtggcuccctgauaccaaga

SEQ ID NO: 62521 - DNA, 21 bp, Artificial Sequence
  Synthetic
caaagugaauggcacaacggt

SEQ ID NO: 62522 - DNA, 26 bp, Artificial Sequence
  Synthetic
ctcaagctttucttttagttgcugct

SEQ ID NO: 62523 - DNA, 28 bp, Artificial Sequence
  Synthetic
gtgtcccagttugcattaacaaatagut

SEQ ID NO: 62524 - DNA, 28 bp, Artificial Sequence
  Synthetic
tggcaaaatuaagcactagtgtuacaga

SEQ ID NO: 62525 - DNA, 24 bp, Artificial Sequence
  Synthetic
ttgctcaguttcgaagacucaact

SEQ ID NO: 62526 - DNA, 22 bp, Artificial Sequence
  Synthetic
gctcagguaggctggctaatut

SEQ ID NO: 62527 - DNA, 26 bp, Artificial Sequence
  Synthetic
gcagccagaagugcactatacataua

SEQ ID NO: 62528 - DNA, 27 bp, Artificial Sequence
  Synthetic
tgcccgtugctttacaatttauaagga

SEQ ID NO: 62529 - DNA, 28 bp, Artificial Sequence
  Synthetic
agtctgaaguggaaatggtgauaaagac

SEQ ID NO: 62530 - DNA, 22 bp, Artificial Sequence
  Synthetic
tgacautacagguacccgagga

SEQ ID NO: 62531 - DNA, 27 bp, Artificial Sequence
  Synthetic
aaaagaagaggcagautactgtggaut

SEQ ID NO: 62532 - DNA, 25 bp, Artificial Sequence
  Synthetic
gaagcagtuctctggtttguacaac

SEQ ID NO: 62533 - DNA, 22 bp, Artificial Sequence
  Synthetic
tttcccccucctctctauccac

SEQ ID NO: 62534 - DNA, 24 bp, Artificial Sequence
  Synthetic
tgcgacaucacctgaaattctuca

SEQ ID NO: 62535 - DNA, 28 bp, Artificial Sequence
  Synthetic
cttgatgatgcagauagcagttcatuag

SEQ ID NO: 62536 - DNA, 21 bp, Artificial Sequence
  Synthetic
catggugggaccacatctuga

SEQ ID NO: 62537 - DNA, 28 bp, Artificial Sequence
  Synthetic
tgggacaguaaaaggcaataatagctut

SEQ ID NO: 62538 - DNA, 22 bp, Artificial Sequence
  Synthetic
accacacuttgtcccucaacaa

SEQ ID NO: 62539 - DNA, 24 bp, Artificial Sequence
  Synthetic
tgtgggagaaaacaucatgucgaa

SEQ ID NO: 62540 - DNA, 23 bp, Artificial Sequence
  Synthetic
tcccccugggaactagaaauagg

SEQ ID NO: 62541 - DNA, 26 bp, Artificial Sequence
  Synthetic
cctaaucagaaggaagcaaugcacat

SEQ ID NO: 62542 - DNA, 27 bp, Artificial Sequence
  Synthetic
ctgttttaacugacaccttgtttcuga

SEQ ID NO: 62543 - DNA, 27 bp, Artificial Sequence
  Synthetic
actttttctccagugtcccagtatcua

SEQ ID NO: 62544 - DNA, 28 bp, Artificial Sequence
  Synthetic
agtatcacaagugaagttgagaguacct

SEQ ID NO: 62545 - DNA, 26 bp, Artificial Sequence
  Synthetic
cgtatggatttuacacctggctttut

SEQ ID NO: 62546 - DNA, 27 bp, Artificial Sequence
  Synthetic
ccattgcattugcctactctttgatua

SEQ ID NO: 62547 - DNA, 29 bp, Artificial Sequence
  Synthetic
aggtcatttauccacccaacatttuaaca

SEQ ID NO: 62548 - DNA, 24 bp, Artificial Sequence
  Synthetic
gaaagcaacttucacctaggcaut

SEQ ID NO: 62549 - DNA, 22 bp, Artificial Sequence
  Synthetic
agataagcagugacccgttcug

SEQ ID NO: 62550 - DNA, 25 bp, Artificial Sequence
  Synthetic
ggtgtttgcugaagttctacctuct

SEQ ID NO: 62551 - DNA, 24 bp, Artificial Sequence
  Synthetic
catactccucaaaggucaagccat

SEQ ID NO: 62552 - DNA, 19 bp, Artificial Sequence
  Synthetic
tggtttugcagcccuggat

SEQ ID NO: 62553 - DNA, 28 bp, Artificial Sequence
  Synthetic
ccggccgcuaataataattctcatuaag

SEQ ID NO: 62554 - DNA, 24 bp, Artificial Sequence
  Synthetic
cacaactgtaauaactgcccccut

SEQ ID NO: 62555 - DNA, 28 bp, Artificial Sequence
  Synthetic
gaaaatgagatcuaacagctgtgtcuga

SEQ ID NO: 62556 - DNA, 23 bp, Artificial Sequence
  Synthetic
accttgtccugcattgcttaucc

SEQ ID NO: 62557 - DNA, 24 bp, Artificial Sequence
  Synthetic
cccaagttacugactaagcaucca

SEQ ID NO: 62558 - DNA, 26 bp, Artificial Sequence
  Synthetic
agcaagaauaccaattaacacugcca

SEQ ID NO: 62559 - DNA, 25 bp, Artificial Sequence
  Synthetic
gcattccataucatcactggctuct

SEQ ID NO: 62560 - DNA, 25 bp, Artificial Sequence
  Synthetic
cuatccattcccaugaaaccagaca

SEQ ID NO: 62561 - DNA, 27 bp, Artificial Sequence
  Synthetic
attgaaccaccuttcattaaugggact

SEQ ID NO: 62562 - DNA, 23 bp, Artificial Sequence
  Synthetic
cagauccagggaactagaugcag

SEQ ID NO: 62563 - DNA, 28 bp, Artificial Sequence
  Synthetic
aaagctagtaccutgaacacatcugaag

SEQ ID NO: 62564 - DNA, 28 bp, Artificial Sequence
  Synthetic
gaaatgaccutcatgtgaauaccaggat

SEQ ID NO: 62565 - DNA, 28 bp, Artificial Sequence
  Synthetic
cctattggttuatggctagaacuaagga

SEQ ID NO: 62566 - DNA, 22 bp, Artificial Sequence
  Synthetic
gctcctgugcttggttctcuac

SEQ ID NO: 62567 - DNA, 28 bp, Artificial Sequence
  Synthetic
tctttctcaagagautctccccaattuc

SEQ ID NO: 62568 - DNA, 24 bp, Artificial Sequence
  Synthetic
aaccctacauacctagcugcaaac

SEQ ID NO: 62569 - DNA, 28 bp, Artificial Sequence
  Synthetic
gttaggaatgcaaautgtgctatcauct

SEQ ID NO: 62570 - DNA, 26 bp, Artificial Sequence
  Synthetic
tutcttgatcaugaaaacgccaacaa

SEQ ID NO: 62571 - DNA, 27 bp, Artificial Sequence
  Synthetic
tgcatcugaagggtattatguggaaat

SEQ ID NO: 62572 - DNA, 24 bp, Artificial Sequence
  Synthetic
tgataaccgucagtgctttacugt

SEQ ID NO: 62573 - DNA, 24 bp, Artificial Sequence
  Synthetic
caacgcacaaugaccgtcttatut

SEQ ID NO: 62574 - DNA, 22 bp, Artificial Sequence
  Synthetic
agcggcucatttttgacttucc

SEQ ID NO: 62575 - DNA, 22 bp, Artificial Sequence
  Synthetic
guacctccttguacgacgacat

SEQ ID NO: 62576 - DNA, 20 bp, Artificial Sequence
  Synthetic
accaggcgcacautgtcuat

SEQ ID NO: 62577 - DNA, 20 bp, Artificial Sequence
  Synthetic
gagacctucggcgaguacag

SEQ ID NO: 62578 - DNA, 25 bp, Artificial Sequence
  Synthetic
tcttctgaagaggagugcaaggaua

SEQ ID NO: 62579 - DNA, 22 bp, Artificial Sequence
  Synthetic
gagguggaggaggaaguaggat

SEQ ID NO: 62580 - DNA, 21 bp, Artificial Sequence
  Synthetic
tccttuccctcagguggagat

SEQ ID NO: 62581 - DNA, 26 bp, Artificial Sequence
  Synthetic
gaacaaatctguctaaaagccacgut

SEQ ID NO: 62582 - DNA, 21 bp, Artificial Sequence
  Synthetic
ctgtgtggtugtctgcccaua

SEQ ID NO: 62583 - DNA, 23 bp, Artificial Sequence
  Synthetic
cttcaaaagcucgacttcaccuc

SEQ ID NO: 62584 - DNA, 28 bp, Artificial Sequence
  Synthetic
ttgtattttaggcauaggtgttctgugt

SEQ ID NO: 62585 - DNA, 28 bp, Artificial Sequence
  Synthetic
agttgtgacaagaacacuggtgattaut

SEQ ID NO: 62586 - DNA, 25 bp, Artificial Sequence
  Synthetic
gacagtttcucctgagaaugggaat

SEQ ID NO: 62587 - DNA, 28 bp, Artificial Sequence
  Synthetic
tgtgtctaaatcucttttccccattgut

SEQ ID NO: 62588 - DNA, 24 bp, Artificial Sequence
  Synthetic
aaagacagaaaaugcagtcagugt

SEQ ID NO: 62589 - DNA, 27 bp, Artificial Sequence
  Synthetic
tgtttgtagaatucacggatcacctut

SEQ ID NO: 62590 - DNA, 19 bp, Artificial Sequence
  Synthetic
ccagcggcggutgatuagt

SEQ ID NO: 62591 - DNA, 19 bp, Artificial Sequence
  Synthetic
ctcccagccguatgcugag

SEQ ID NO: 62592 - DNA, 22 bp, Artificial Sequence
  Synthetic
gcggcagaauttgagagatugt

SEQ ID NO: 62593 - DNA, 25 bp, Artificial Sequence
  Synthetic
gggtgacttgauggagtcattaauc

SEQ ID NO: 62594 - DNA, 23 bp, Artificial Sequence
  Synthetic
actcagtcuctccaggatugaca

SEQ ID NO: 62595 - DNA, 21 bp, Artificial Sequence
  Synthetic
aaagtgcuccatctccuccac

SEQ ID NO: 62596 - DNA, 20 bp, Artificial Sequence
  Synthetic
cccctcaccccuctcatgut

SEQ ID NO: 62597 - DNA, 20 bp, Artificial Sequence
  Synthetic
cttcccgagcagaacugguc

SEQ ID NO: 62598 - DNA, 20 bp, Artificial Sequence
  Synthetic
gtgaccagucctgcctguaa

SEQ ID NO: 62599 - DNA, 20 bp, Artificial Sequence
  Synthetic
cccaggcaaaugtgugacag

SEQ ID NO: 62600 - DNA, 20 bp, Artificial Sequence
  Synthetic
ccactguccaccctgtccua

SEQ ID NO: 62601 - DNA, 17 bp, Artificial Sequence
  Synthetic
gccguaggcccccatug

SEQ ID NO: 62602 - DNA, 24 bp, Artificial Sequence
  Synthetic
gcaagtcagtutcggtttcctuct

SEQ ID NO: 62603 - DNA, 22 bp, Artificial Sequence
  Synthetic
gcgagtccaugtgatctcctuc

SEQ ID NO: 62604 - DNA, 22 bp, Artificial Sequence
  Synthetic
gggtctgaugatcaccctucct

SEQ ID NO: 62605 - DNA, 22 bp, Artificial Sequence
  Synthetic
ccaggcuagctctgtgtttuct

SEQ ID NO: 62606 - DNA, 21 bp, Artificial Sequence
  Synthetic
ggacgtgucttgtgactucct

SEQ ID NO: 62607 - DNA, 29 bp, Artificial Sequence
  Synthetic
gctgtacttgtgguattcattgcattaut

SEQ ID NO: 62608 - DNA, 23 bp, Artificial Sequence
  Synthetic
actugacagaaaccagcuggaat

SEQ ID NO: 62609 - DNA, 28 bp, Artificial Sequence
  Synthetic
ggtcaagaacutatcttccttctuccaa

SEQ ID NO: 62610 - DNA, 22 bp, Artificial Sequence
  Synthetic
gacucatcaggaaucacaccgt

SEQ ID NO: 62611 - DNA, 28 bp, Artificial Sequence
  Synthetic
actccttcgacuttctctgtttattugt

SEQ ID NO: 62612 - DNA, 20 bp, Artificial Sequence
  Synthetic
gggagguccaggguacacaa

SEQ ID NO: 62613 - DNA, 26 bp, Artificial Sequence
  Synthetic
tctgtaaaatcugtcccttgtcucct

SEQ ID NO: 62614 - DNA, 25 bp, Artificial Sequence
  Synthetic
tcttggtgtguatgttcatcaugag

SEQ ID NO: 62615 - DNA, 27 bp, Artificial Sequence
  Synthetic
ccacatcttaguggccttacttuacat

SEQ ID NO: 62616 - DNA, 27 bp, Artificial Sequence
  Synthetic
caccactatatcaucaacacaagguaa

SEQ ID NO: 62617 - DNA, 29 bp, Artificial Sequence
  Synthetic
cattggagaagggautagagaagtaacug

SEQ ID NO: 62618 - DNA, 25 bp, Artificial Sequence
  Synthetic
cttaccagcagutgtttucaggaag

SEQ ID NO: 62619 - DNA, 28 bp, Artificial Sequence
  Synthetic
cttagagataagccgguatggttgttua

SEQ ID NO: 62620 - DNA, 32 bp, Artificial Sequence
  Synthetic
aagacactctaaautctttctttgatcauact

SEQ ID NO: 62621 - DNA, 22 bp, Artificial Sequence
  Synthetic
aaggaucuccaggagcaaaagg

SEQ ID NO: 62622 - DNA, 24 bp, Artificial Sequence
  Synthetic
acattttctcccutgtcaccctug

SEQ ID NO: 62623 - DNA, 23 bp, Artificial Sequence
  Synthetic
agugggaacccaagatttuccat

SEQ ID NO: 62624 - DNA, 26 bp, Artificial Sequence
  Synthetic
gaaagagaaagagaagcucugacact

SEQ ID NO: 62625 - DNA, 27 bp, Artificial Sequence
  Synthetic
gtcactgtgaugaagaagctgtaugat

SEQ ID NO: 62626 - DNA, 25 bp, Artificial Sequence
  Synthetic
atcaagcugttttaccttuggacct

SEQ ID NO: 62627 - DNA, 28 bp, Artificial Sequence
  Synthetic
tctgcaaatctuccttttgagtguacaa

SEQ ID NO: 62628 - DNA, 24 bp, Artificial Sequence
  Synthetic
cctcttgguccaatttctccauct

SEQ ID NO: 62629 - DNA, 24 bp, Artificial Sequence
  Synthetic
tgatttaacagggugaacgagguc

SEQ ID NO: 62630 - DNA, 28 bp, Artificial Sequence
  Synthetic
atcttgaaucacccaaatatcgtaauca

SEQ ID NO: 62631 - DNA, 19 bp, Artificial Sequence
  Synthetic
gggccaaaggugagagugg

SEQ ID NO: 62632 - DNA, 24 bp, Artificial Sequence
  Synthetic
ggacacagaucagcatggcuaaat

SEQ ID NO: 62633 - DNA, 22 bp, Artificial Sequence
  Synthetic
acttggcucaagaccaauggag

SEQ ID NO: 62634 - DNA, 22 bp, Artificial Sequence
  Synthetic
agaaaagtugcaggtggucact

SEQ ID NO: 62635 - DNA, 23 bp, Artificial Sequence
  Synthetic
tcatctccaucctcatcctcguc

SEQ ID NO: 62636 - DNA, 21 bp, Artificial Sequence
  Synthetic
ggaagggaccugaccaucaaa

SEQ ID NO: 62637 - DNA, 24 bp, Artificial Sequence
  Synthetic
ctctcauagacactacagtuggct

SEQ ID NO: 62638 - DNA, 25 bp, Artificial Sequence
  Synthetic
ctttgtcactgucactgtcctctut

SEQ ID NO: 62639 - DNA, 20 bp, Artificial Sequence
  Synthetic
ccacatcacuggcagagguc

SEQ ID NO: 62640 - DNA, 25 bp, Artificial Sequence
  Synthetic
tcctcctcuacttgagaagucaacc

SEQ ID NO: 62641 - DNA, 24 bp, Artificial Sequence
  Synthetic
tcgcaatccaugagcctctttaut

SEQ ID NO: 62642 - DNA, 22 bp, Artificial Sequence
  Synthetic
gtgaagggagacagguctcuca

SEQ ID NO: 62643 - DNA, 28 bp, Artificial Sequence
  Synthetic
agctggagtttautcagtttcttcctut

SEQ ID NO: 62644 - DNA, 26 bp, Artificial Sequence
  Synthetic
acatatactcugtgtacggtuggaga

SEQ ID NO: 62645 - DNA, 28 bp, Artificial Sequence
  Synthetic
ttaaaagagauctcatttgauggcagaa

SEQ ID NO: 62646 - DNA, 21 bp, Artificial Sequence
  Synthetic
cctccuggaggcattgcaaut

SEQ ID NO: 62647 - DNA, 24 bp, Artificial Sequence
  Synthetic
aaagucatguacagcggagaagag

SEQ ID NO: 62648 - DNA, 28 bp, Artificial Sequence
  Synthetic
aatttgaggaaacauttgcatucagagg

SEQ ID NO: 62649 - DNA, 28 bp, Artificial Sequence
  Synthetic
agaatcggccaaugaaaatgcatuaaaa

SEQ ID NO: 62650 - DNA, 26 bp, Artificial Sequence
  Synthetic
gaaaccacaacagcauttatccucaa

SEQ ID NO: 62651 - DNA, 27 bp, Artificial Sequence
  Synthetic
cagggatggutttgaaatcuacacaac

SEQ ID NO: 62652 - DNA, 33 bp, Artificial Sequence
  Synthetic
tattttcatttgtuaggccaagattaagtucat

SEQ ID NO: 62653 - DNA, 21 bp, Artificial Sequence
  Synthetic
tcccaggagagcutcacugaa

SEQ ID NO: 62654 - DNA, 26 bp, Artificial Sequence
  Synthetic
gagcatcggguaatcttttguagaca

SEQ ID NO: 62655 - DNA, 22 bp, Artificial Sequence
  Synthetic
tcttggcaaacuccaggugaag

SEQ ID NO: 62656 - DNA, 20 bp, Artificial Sequence
  Synthetic
ggcgaagacgagauccagut

SEQ ID NO: 62657 - DNA, 20 bp, Artificial Sequence
  Synthetic
accugcacacacttggugat

SEQ ID NO: 62658 - DNA, 28 bp, Artificial Sequence
  Synthetic
aatgtcgtgaaauagatggctuagaact

SEQ ID NO: 62659 - DNA, 28 bp, Artificial Sequence
  Synthetic
atggatattctcugccagtttttctcut

SEQ ID NO: 62660 - DNA, 22 bp, Artificial Sequence
  Synthetic
ggctauggcagaaatgauggct

SEQ ID NO: 62661 - DNA, 26 bp, Artificial Sequence
  Synthetic
catacactcauggaattgagcucaga

SEQ ID NO: 62662 - DNA, 28 bp, Artificial Sequence
  Synthetic
gatggcctaaaauatttgttcactuggg

SEQ ID NO: 62663 - DNA, 23 bp, Artificial Sequence
  Synthetic
tctggttcuccgtatctgtgugt

SEQ ID NO: 62664 - DNA, 28 bp, Artificial Sequence
  Synthetic
ggatatgttucacgtagtacacatugct

SEQ ID NO: 62665 - DNA, 28 bp, Artificial Sequence
  Synthetic
gccaggtgacautcagaacattatuagt

SEQ ID NO: 62666 - DNA, 21 bp, Artificial Sequence
  Synthetic
caggcaugcttgtgtugaagt

SEQ ID NO: 62667 - DNA, 27 bp, Artificial Sequence
  Synthetic
tccctttcuaatgttaagaacugggaa

SEQ ID NO: 62668 - DNA, 22 bp, Artificial Sequence
  Synthetic
cacauggctcuggagaagacat

SEQ ID NO: 62669 - DNA, 22 bp, Artificial Sequence
  Synthetic
cgccaaagauctcgatctcgua

SEQ ID NO: 62670 - DNA, 19 bp, Artificial Sequence
  Synthetic
ttcaggccagugcgttcut

SEQ ID NO: 62671 - DNA, 20 bp, Artificial Sequence
  Synthetic
ctgcccaucatctcccctuc

SEQ ID NO: 62672 - DNA, 19 bp, Artificial Sequence
  Synthetic
ctggucagagagcgcuacc

SEQ ID NO: 62673 - DNA, 26 bp, Artificial Sequence
  Synthetic
aaggagcccacaaauaaguaaacagt

SEQ ID NO: 62674 - DNA, 22 bp, Artificial Sequence
  Synthetic
ccatggauagaagctggugaca

SEQ ID NO: 62675 - DNA, 23 bp, Artificial Sequence
  Synthetic
cacaaaccautctggguggaaag

SEQ ID NO: 62676 - DNA, 25 bp, Artificial Sequence
  Synthetic
ggaagagacuttggatcugaaggaa

SEQ ID NO: 62677 - DNA, 24 bp, Artificial Sequence
  Synthetic
agaactcgaaucttgtgcuccaag

SEQ ID NO: 62678 - DNA, 29 bp, Artificial Sequence
  Synthetic
ggctttccagaaaugtcagagataucaat

SEQ ID NO: 62679 - DNA, 22 bp, Artificial Sequence
  Synthetic
tttatgctugcctccuggacaa

SEQ ID NO: 62680 - DNA, 18 bp, Artificial Sequence
  Synthetic
augccccggagcagaauc

SEQ ID NO: 62681 - DNA, 21 bp, Artificial Sequence
  Synthetic
ccctccaccuccttcuccaaa

SEQ ID NO: 62682 - DNA, 28 bp, Artificial Sequence
  Synthetic
ggttttatacatutcctagggctucgat

SEQ ID NO: 62683 - DNA, 30 bp, Artificial Sequence
  Synthetic
cagaaaacaagtuaaggctcacaataugaa

SEQ ID NO: 62684 - DNA, 24 bp, Artificial Sequence
  Synthetic
gtttaaacaggacugaagggugaa

SEQ ID NO: 62685 - DNA, 29 bp, Artificial Sequence
  Synthetic
aactatgcttacuccctctcaactaugat

SEQ ID NO: 62686 - DNA, 21 bp, Artificial Sequence
  Synthetic
ccccttugagaaccacagcut

SEQ ID NO: 62687 - DNA, 26 bp, Artificial Sequence
  Synthetic
cccttcagucttgtgtaugacaaaga

SEQ ID NO: 62688 - DNA, 21 bp, Artificial Sequence
  Synthetic
gttttgcucaaatgggcugct

SEQ ID NO: 62689 - DNA, 24 bp, Artificial Sequence
  Synthetic
ccagatccacutcctgagttuact

SEQ ID NO: 62690 - DNA, 18 bp, Artificial Sequence
  Synthetic
cgttucccagcucgacca

SEQ ID NO: 62691 - DNA, 26 bp, Artificial Sequence
  Synthetic
ctacacatggacauttgcctgattuc

SEQ ID NO: 62692 - DNA, 20 bp, Artificial Sequence
  Synthetic
ggctcaacuctcctgtgcut

SEQ ID NO: 62693 - DNA, 17 bp, Artificial Sequence
  Synthetic
gugaagcuggccccact

SEQ ID NO: 62694 - DNA, 25 bp, Artificial Sequence
  Synthetic
tgtaccttcccaugcactatttugt

SEQ ID NO: 62695 - DNA, 28 bp, Artificial Sequence
  Synthetic
ggattcagacuaaaaggaagagatgugt

SEQ ID NO: 62696 - DNA, 24 bp, Artificial Sequence
  Synthetic
gggaagcacugaaaccucaagaat

SEQ ID NO: 62697 - DNA, 25 bp, Artificial Sequence
  Synthetic
aaagttcctcaaugcactgactcut

SEQ ID NO: 62698 - DNA, 18 bp, Artificial Sequence
  Synthetic
ctcugagcgcgacucgaa

SEQ ID NO: 62699 - DNA, 21 bp, Artificial Sequence
  Synthetic
gctgcttuagcttcggagugt

SEQ ID NO: 62700 - DNA, 18 bp, Artificial Sequence
  Synthetic
ctgagtucgcccgtgtuc

SEQ ID NO: 62701 - DNA, 22 bp, Artificial Sequence
  Synthetic
gtggtcagaaacucctggtuca

SEQ ID NO: 62702 - DNA, 21 bp, Artificial Sequence
  Synthetic
ggaggcacaaagcugtctgua

SEQ ID NO: 62703 - DNA, 29 bp, Artificial Sequence
  Synthetic
gcctaaaagaaaacaugatggtugacaat

SEQ ID NO: 62704 - DNA, 23 bp, Artificial Sequence
  Synthetic
ggagggaaugcgaagaaactcut

SEQ ID NO: 62705 - DNA, 20 bp, Artificial Sequence
  Synthetic
cgtcgtaugcgagagtcugt

SEQ ID NO: 62706 - DNA, 26 bp, Artificial Sequence
  Synthetic
caagagttguctgatgttacuccagt

SEQ ID NO: 62707 - DNA, 28 bp, Artificial Sequence
  Synthetic
tcagcataattuacacctgtgttctugt

SEQ ID NO: 62708 - DNA, 23 bp, Artificial Sequence
  Synthetic
cggttcttccugccatctgauaa

SEQ ID NO: 62709 - DNA, 21 bp, Artificial Sequence
  Synthetic
ggcaggaaucacctctgtguc

SEQ ID NO: 62710 - DNA, 21 bp, Artificial Sequence
  Synthetic
gctgcucggaggagaagatuc

SEQ ID NO: 62711 - DNA, 24 bp, Artificial Sequence
  Synthetic
ggtttuccaggaagcatcagtuca

SEQ ID NO: 62712 - DNA, 22 bp, Artificial Sequence
  Synthetic
ggctctgacauctagtgtgugt

SEQ ID NO: 62713 - DNA, 25 bp, Artificial Sequence
  Synthetic
aaaaccaucccccauaaaccaagaa

SEQ ID NO: 62714 - DNA, 20 bp, Artificial Sequence
  Synthetic
gcgccaugaagagtgtgtug

SEQ ID NO: 62715 - DNA, 27 bp, Artificial Sequence
  Synthetic
acagaatcaaacuaactcattggcugt

SEQ ID NO: 62716 - DNA, 25 bp, Artificial Sequence
  Synthetic
cagagagagagucacttgtagcuga

SEQ ID NO: 62717 - DNA, 28 bp, Artificial Sequence
  Synthetic
gctttgtaatucccaataactgtggtut

SEQ ID NO: 62718 - DNA, 21 bp, Artificial Sequence
  Synthetic
gugccccgaggtaauaggaag

SEQ ID NO: 62719 - DNA, 22 bp, Artificial Sequence
  Synthetic
tctgtcccugggcatagaauca

SEQ ID NO: 62720 - DNA, 21 bp, Artificial Sequence
  Synthetic
gcctgtagccugcagcatuat

SEQ ID NO: 62721 - DNA, 22 bp, Artificial Sequence
  Synthetic
gcagtctcagautccaggccua

SEQ ID NO: 62722 - DNA, 23 bp, Artificial Sequence
  Synthetic
cattacatcuggccaagcguagt

SEQ ID NO: 62723 - DNA, 21 bp, Artificial Sequence
  Synthetic
ctggaccacagcacugactut

SEQ ID NO: 62724 - DNA, 28 bp, Artificial Sequence
  Synthetic
acattaagtaccagugagagaguacaca

SEQ ID NO: 62725 - DNA, 28 bp, Artificial Sequence
  Synthetic
atggattgaauatgtttgaugggacaga

SEQ ID NO: 62726 - DNA, 21 bp, Artificial Sequence
  Synthetic
ggacuctaccauccagccaca

SEQ ID NO: 62727 - DNA, 24 bp, Artificial Sequence
  Synthetic
atgacctggucttcttctctguct

SEQ ID NO: 62728 - DNA, 21 bp, Artificial Sequence
  Synthetic
ggtccaaaggcugtacggaut

SEQ ID NO: 62729 - DNA, 21 bp, Artificial Sequence
  Synthetic
gctcactttcuccctgtccuc

SEQ ID NO: 62730 - DNA, 24 bp, Artificial Sequence
  Synthetic
gcautctacatctucacccaccag

SEQ ID NO: 62731 - DNA, 21 bp, Artificial Sequence
  Synthetic
cctgggaaguagcttgtccut

SEQ ID NO: 62732 - DNA, 17 bp, Artificial Sequence
  Synthetic
gagccgccccuttgtug

SEQ ID NO: 62733 - DNA, 22 bp, Artificial Sequence
  Synthetic
ctcccatcugtgcctctguaag

SEQ ID NO: 62734 - DNA, 19 bp, Artificial Sequence
  Synthetic
gcaaguggcagtccccuaa

SEQ ID NO: 62735 - DNA, 18 bp, Artificial Sequence
  Synthetic
cagggaccugccuaggac

SEQ ID NO: 62736 - DNA, 20 bp, Artificial Sequence
  Synthetic
ccactguctgggucaaggat

SEQ ID NO: 62737 - DNA, 21 bp, Artificial Sequence
  Synthetic
gcactcggcucctttctguag

SEQ ID NO: 62738 - DNA, 22 bp, Artificial Sequence
  Synthetic
gttccacugcaaggtguacagt

SEQ ID NO: 62739 - DNA, 21 bp, Artificial Sequence
  Synthetic
cuccaaccccuagacccaaat

SEQ ID NO: 62740 - DNA, 20 bp, Artificial Sequence
  Synthetic
gccuggcgggcaattctaut

SEQ ID NO: 62741 - DNA, 21 bp, Artificial Sequence
  Synthetic
cggccguaagtcacaggatuc

SEQ ID NO: 62742 - DNA, 18 bp, Artificial Sequence
  Synthetic
ggaggaccuggaccgugt

SEQ ID NO: 62743 - DNA, 17 bp, Artificial Sequence
  Synthetic
ccaccgagccccuctuc

SEQ ID NO: 62744 - DNA, 19 bp, Artificial Sequence
  Synthetic
gcctccuctgacctuggga

SEQ ID NO: 62745 - DNA, 18 bp, Artificial Sequence
  Synthetic
accctcacugcccgguat

SEQ ID NO: 62746 - DNA, 23 bp, Artificial Sequence
  Synthetic
catgcactuccagactttgctut

SEQ ID NO: 62747 - DNA, 31 bp, Artificial Sequence
  Synthetic
atcttagagataacauggtgtttttggtgua

SEQ ID NO: 62748 - DNA, 31 bp, Artificial Sequence
  Synthetic
tcaattttggatucatatgccttctguaaga

SEQ ID NO: 62749 - DNA, 28 bp, Artificial Sequence
  Synthetic
ggcttctggcuagaggtcattaattaut

SEQ ID NO: 62750 - DNA, 22 bp, Artificial Sequence
  Synthetic
actgaagcugacaaccgaagut

SEQ ID NO: 62751 - DNA, 22 bp, Artificial Sequence
  Synthetic
cgaguggcaatgagucacagac

SEQ ID NO: 62752 - DNA, 28 bp, Artificial Sequence
  Synthetic
agctgtcagtgguagctataggaatuaa

SEQ ID NO: 62753 - DNA, 25 bp, Artificial Sequence
  Synthetic
gttgaactguatctgccaataugcc

SEQ ID NO: 62754 - DNA, 26 bp, Artificial Sequence
  Synthetic
tcatcttctgucctcttcacucaagt

SEQ ID NO: 62755 - DNA, 23 bp, Artificial Sequence
  Synthetic
gggttattcugacccaagccaua

SEQ ID NO: 62756 - DNA, 25 bp, Artificial Sequence
  Synthetic
ctaattttccuctccctcugccaat

SEQ ID NO: 62757 - DNA, 24 bp, Artificial Sequence
  Synthetic
gaaaaagaagaaagcguggugagg

SEQ ID NO: 62758 - DNA, 24 bp, Artificial Sequence
  Synthetic
ggaaagacauacccccagaugaga

SEQ ID NO: 62759 - DNA, 28 bp, Artificial Sequence
  Synthetic
ttcacctaatgacucttctgaacuacct

SEQ ID NO: 62760 - DNA, 27 bp, Artificial Sequence
  Synthetic
tccccuaaaacagaaagacactcuact

SEQ ID NO: 62761 - DNA, 25 bp, Artificial Sequence
  Synthetic
cctttcagtttutgtcgagggugat

SEQ ID NO: 62762 - DNA, 19 bp, Artificial Sequence
  Synthetic
acaacugcgagcactucgt

SEQ ID NO: 62763 - DNA, 22 bp, Artificial Sequence
  Synthetic
agagaaaaggucagggauggga

SEQ ID NO: 62764 - DNA, 24 bp, Artificial Sequence
  Synthetic
acctgtaataugaacagcauggca

SEQ ID NO: 62765 - DNA, 22 bp, Artificial Sequence
  Synthetic
gtctcctguctatgggcucaga

SEQ ID NO: 62766 - DNA, 21 bp, Artificial Sequence
  Synthetic
ggctgggutaggcaattuggt

SEQ ID NO: 62767 - DNA, 24 bp, Artificial Sequence
  Synthetic
gacgcctcaugaccatttctttut

SEQ ID NO: 62768 - DNA, 29 bp, Artificial Sequence
  Synthetic
ttctactaatuctgtatagccuccaagga

SEQ ID NO: 62769 - DNA, 27 bp, Artificial Sequence
  Synthetic
cacaaatgacuggactgatgggataut

SEQ ID NO: 62770 - DNA, 25 bp, Artificial Sequence
  Synthetic
gaggaaguaacatttgguccacaca

SEQ ID NO: 62771 - DNA, 22 bp, Artificial Sequence
  Synthetic
accagauggattuccgaggact

SEQ ID NO: 62772 - DNA, 22 bp, Artificial Sequence
  Synthetic
gttcaattgcugggcatgcuaa

SEQ ID NO: 62773 - DNA, 29 bp, Artificial Sequence
  Synthetic
ctacacagtatccucagcttcttgaaaua

SEQ ID NO: 62774 - DNA, 25 bp, Artificial Sequence
  Synthetic
cctgaaacaugataagcctgucact

SEQ ID NO: 62775 - DNA, 23 bp, Artificial Sequence
  Synthetic
atgaatcacttugtgaggcccut

SEQ ID NO: 62776 - DNA, 24 bp, Artificial Sequence
  Synthetic
agatatttgtgcguctgcgtguat

SEQ ID NO: 62777 - DNA, 22 bp, Artificial Sequence
  Synthetic
tgtgaccctutgtacagcagug

SEQ ID NO: 62778 - DNA, 23 bp, Artificial Sequence
  Synthetic
cagcatcgguatcaagtcccaut

SEQ ID NO: 62779 - DNA, 21 bp, Artificial Sequence
  Synthetic
cactactuagcctgugcacca

SEQ ID NO: 62780 - DNA, 24 bp, Artificial Sequence
  Synthetic
cgtgtaaggucttcagacauggac

SEQ ID NO: 62781 - DNA, 25 bp, Artificial Sequence
  Synthetic
gcagcatttagugggcggtttauat

SEQ ID NO: 62782 - DNA, 28 bp, Artificial Sequence
  Synthetic
cctttcaaagtautgtgtcattcaugct

SEQ ID NO: 62783 - DNA, 18 bp, Artificial Sequence
  Synthetic
cccagccucctgtgggua

SEQ ID NO: 62784 - DNA, 28 bp, Artificial Sequence
  Synthetic
acagacacttcauttggagtacctuaac

SEQ ID NO: 62785 - DNA, 25 bp, Artificial Sequence
  Synthetic
gcattagugaccagggtttgtaauc

SEQ ID NO: 62786 - DNA, 20 bp, Artificial Sequence
  Synthetic
tgcagcacuccacaacauca

SEQ ID NO: 62787 - DNA, 28 bp, Artificial Sequence
  Synthetic
acatgcacuacgatgtacactauagaga

SEQ ID NO: 62788 - DNA, 22 bp, Artificial Sequence
  Synthetic
cgagautccaaaacugacagca

SEQ ID NO: 62789 - DNA, 28 bp, Artificial Sequence
  Synthetic
tccagaacaaaaacccucuaacaagaat

SEQ ID NO: 62790 - DNA, 21 bp, Artificial Sequence
  Synthetic
cucaguaaaaccagcccaggt

SEQ ID NO: 62791 - DNA, 21 bp, Artificial Sequence
  Synthetic
ggcctccucctcacttucaga

SEQ ID NO: 62792 - DNA, 22 bp, Artificial Sequence
  Synthetic
ctgatagggcagggugatccua

SEQ ID NO: 62793 - DNA, 21 bp, Artificial Sequence
  Synthetic
ctggagtcuagcttgggagug

SEQ ID NO: 62794 - DNA, 21 bp, Artificial Sequence
  Synthetic
ttgaaagggaggcuccgttut

SEQ ID NO: 62795 - DNA, 26 bp, Artificial Sequence
  Synthetic
tcctgcttccuctaatcatatcugct

SEQ ID NO: 62796 - DNA, 22 bp, Artificial Sequence
  Synthetic
ccaaggagacugtugaggaagg

SEQ ID NO: 62797 - DNA, 25 bp, Artificial Sequence
  Synthetic
atgaaaacacaagugggcaaacaut

SEQ ID NO: 62798 - DNA, 24 bp, Artificial Sequence
  Synthetic
ctcautactagcagucccaaaccc

SEQ ID NO: 62799 - DNA, 22 bp, Artificial Sequence
  Synthetic
ttctggcgaggagutaggtcua

SEQ ID NO: 62800 - DNA, 26 bp, Artificial Sequence
  Synthetic
aggccuttttataugagccaacaact

SEQ ID NO: 62801 - DNA, 26 bp, Artificial Sequence
  Synthetic
ggttaccaacutcttttcttcagugg

SEQ ID NO: 62802 - DNA, 24 bp, Artificial Sequence
  Synthetic
gcaccagcaggaugtactattcuc

SEQ ID NO: 62803 - DNA, 20 bp, Artificial Sequence
  Synthetic
gggaagutcttucgggacct

SEQ ID NO: 62804 - DNA, 23 bp, Artificial Sequence
  Synthetic
cggcaggaagautacaugaagac

SEQ ID NO: 62805 - DNA, 28 bp, Artificial Sequence
  Synthetic
ggttgauacaaagagaaagatgucccaa

SEQ ID NO: 62806 - DNA, 22 bp, Artificial Sequence
  Synthetic
tggcccttugttttgctguact

SEQ ID NO: 62807 - DNA, 28 bp, Artificial Sequence
  Synthetic
gtaagtagttcaaugtaccgagcaugaa

SEQ ID NO: 62808 - DNA, 23 bp, Artificial Sequence
  Synthetic
tguttgatgggcugaggaagaag

SEQ ID NO: 62809 - DNA, 25 bp, Artificial Sequence
  Synthetic
ttctttctcutggcctcuaccaaag

SEQ ID NO: 62810 - DNA, 24 bp, Artificial Sequence
  Synthetic
ggatcctgtuagcaacttgaggut

SEQ ID NO: 62811 - DNA, 21 bp, Artificial Sequence
  Synthetic
cggttgcgauctgtgcttcua

SEQ ID NO: 62812 - DNA, 17 bp, Artificial Sequence
  Synthetic
cttgtgucccggcguct

SEQ ID NO: 62813 - DNA, 21 bp, Artificial Sequence
  Synthetic
cgcacaccutccagttcatug

SEQ ID NO: 62814 - DNA, 20 bp, Artificial Sequence
  Synthetic
cacccaugccgttttctuga

SEQ ID NO: 62815 - DNA, 20 bp, Artificial Sequence
  Synthetic
catcgccucgcatttccuct

SEQ ID NO: 62816 - DNA, 25 bp, Artificial Sequence
  Synthetic
cattcttgtacuggaccaggaagug

SEQ ID NO: 62817 - DNA, 24 bp, Artificial Sequence
  Synthetic
catgcccacccautctattttcug

SEQ ID NO: 62818 - DNA, 20 bp, Artificial Sequence
  Synthetic
gggtcccugtggagagaugg

SEQ ID NO: 62819 - DNA, 18 bp, Artificial Sequence
  Synthetic
cctguggcccccucaaat

SEQ ID NO: 62820 - DNA, 19 bp, Artificial Sequence
  Synthetic
cacagaccccuccccagua

SEQ ID NO: 62821 - DNA, 23 bp, Artificial Sequence
  Synthetic
gtggtctgaggutctctggtaug

SEQ ID NO: 62822 - DNA, 22 bp, Artificial Sequence
  Synthetic
aaagaggcucagggtcacuaga

SEQ ID NO: 62823 - DNA, 24 bp, Artificial Sequence
  Synthetic
ccctgtgactuctctttccctgua

SEQ ID NO: 62824 - DNA, 23 bp, Artificial Sequence
  Synthetic
tcctccauatctttccugcccat

SEQ ID NO: 62825 - DNA, 24 bp, Artificial Sequence
  Synthetic
tcaccccatcutttgcattctcut

SEQ ID NO: 62826 - DNA, 24 bp, Artificial Sequence
  Synthetic
ggutaaaaaucagaggcgacagga

SEQ ID NO: 62827 - DNA, 23 bp, Artificial Sequence
  Synthetic
tgagauggagaaaggcctagugt

SEQ ID NO: 62828 - DNA, 24 bp, Artificial Sequence
  Synthetic
gcttcutcacactcuccagaaagg

SEQ ID NO: 62829 - DNA, 23 bp, Artificial Sequence
  Synthetic
cctgtggtutcctaatgguccag

SEQ ID NO: 62830 - DNA, 23 bp, Artificial Sequence
  Synthetic
tgagcctcagugtccccaataua

SEQ ID NO: 62831 - DNA, 23 bp, Artificial Sequence
  Synthetic
tgaagaagaccaucgacatgcug

SEQ ID NO: 62832 - DNA, 23 bp, Artificial Sequence
  Synthetic
gtgagaagggagutggaauccag

SEQ ID NO: 62833 - DNA, 28 bp, Artificial Sequence
  Synthetic
ctcttcacucaccactatttcttctuca

SEQ ID NO: 62834 - DNA, 25 bp, Artificial Sequence
  Synthetic
acagattgcugcttctttuccaaac

SEQ ID NO: 62835 - DNA, 28 bp, Artificial Sequence
  Synthetic
ccgtgaaaatggaaauagtggctctuat

SEQ ID NO: 62836 - DNA, 25 bp, Artificial Sequence
  Synthetic
ccccaacaguttttagtaccuggaa

SEQ ID NO: 62837 - DNA, 25 bp, Artificial Sequence
  Synthetic
cctcgtcttcutgtagcaaaaaugg

SEQ ID NO: 62838 - DNA, 28 bp, Artificial Sequence
  Synthetic
gcgtcttcttttuccaactggtactuat

SEQ ID NO: 62839 - DNA, 22 bp, Artificial Sequence
  Synthetic
tctcacacccccutctcagaut

SEQ ID NO: 62840 - DNA, 28 bp, Artificial Sequence
  Synthetic
tcttttatctttagcaucctggtccuct

SEQ ID NO: 62841 - DNA, 28 bp, Artificial Sequence
  Synthetic
cgatatttgtggcuggtggtttatauga

SEQ ID NO: 62842 - DNA, 22 bp, Artificial Sequence
  Synthetic
ccagctgugccaaacacaauat

SEQ ID NO: 62843 - DNA, 26 bp, Artificial Sequence
  Synthetic
gaaagtacctgaugacatgcattugt

SEQ ID NO: 62844 - DNA, 24 bp, Artificial Sequence
  Synthetic
aactacagaaaaguatgggcaucc

SEQ ID NO: 62845 - DNA, 28 bp, Artificial Sequence
  Synthetic
gcaggagtatuaccatacaaggaaauct

SEQ ID NO: 62846 - DNA, 19 bp, Artificial Sequence
  Synthetic
gccccagcguttccgtauc

SEQ ID NO: 62847 - DNA, 26 bp, Artificial Sequence
  Synthetic
agattgaugacaccccatttaaccuc

SEQ ID NO: 62848 - DNA, 23 bp, Artificial Sequence
  Synthetic
gcaacaagacagguagctttucc

SEQ ID NO: 62849 - DNA, 22 bp, Artificial Sequence
  Synthetic
gaatcaguctctgtggugggat

SEQ ID NO: 62850 - DNA, 22 bp, Artificial Sequence
  Synthetic
guatgggacuggcaacagagaa

SEQ ID NO: 62851 - DNA, 29 bp, Artificial Sequence
  Synthetic
gttactcttgctugactctatgttcuact

SEQ ID NO: 62852 - DNA, 21 bp, Artificial Sequence
  Synthetic
ccaacautgagugaggcacaa

SEQ ID NO: 62853 - DNA, 22 bp, Artificial Sequence
  Synthetic
cttucaggcagccgacuaaaaa

SEQ ID NO: 62854 - DNA, 27 bp, Artificial Sequence
  Synthetic
tccccguaagcaatgtaucaaagaaat

SEQ ID NO: 62855 - DNA, 32 bp, Artificial Sequence
  Synthetic
agaaggatacaaugtttatgatggagaugaac

SEQ ID NO: 62856 - DNA, 29 bp, Artificial Sequence
  Synthetic
tgaaggtctgaaautctagggagatgtua

SEQ ID NO: 62857 - DNA, 22 bp, Artificial Sequence
  Synthetic
ggcaggaaagagacguaugagt

SEQ ID NO: 62858 - DNA, 25 bp, Artificial Sequence
  Synthetic
tgtgtggaaaugggatctgttctut

SEQ ID NO: 62859 - DNA, 28 bp, Artificial Sequence
  Synthetic
atgtctatggaaaugcaaatggatcuca

SEQ ID NO: 62860 - DNA, 33 bp, Artificial Sequence
  Synthetic
tttctaaaaaucagacaattacaagcuaaagag

SEQ ID NO: 62861 - DNA, 28 bp, Artificial Sequence
  Synthetic
caacctatgugaacgatcctgaagauaa

SEQ ID NO: 62862 - DNA, 28 bp, Artificial Sequence
  Synthetic
ttgatgcatcugcttagaacttaucaat

SEQ ID NO: 62863 - DNA, 25 bp, Artificial Sequence
  Synthetic
gaaautggugaaccaggaagacaag

SEQ ID NO: 62864 - DNA, 26 bp, Artificial Sequence
  Synthetic
tcttccaaatguaatggagtcagcut

SEQ ID NO: 62865 - DNA, 28 bp, Artificial Sequence
  Synthetic
tcacgaaattccacutcagctacaauat

SEQ ID NO: 62866 - DNA, 25 bp, Artificial Sequence
  Synthetic
aagaaatttttcacugggcgatugg

SEQ ID NO: 62867 - DNA, 24 bp, Artificial Sequence
  Synthetic
tgccttcaaaaucagggtttucct

SEQ ID NO: 62868 - DNA, 28 bp, Artificial Sequence
  Synthetic
gattctgactacauagaacaggaagugg

SEQ ID NO: 62869 - DNA, 24 bp, Artificial Sequence
  Synthetic
ttcacuccctatcaucccagaaca

SEQ ID NO: 62870 - DNA, 23 bp, Artificial Sequence
  Synthetic
gcatttcttagugagggcaguca

SEQ ID NO: 62871 - DNA, 27 bp, Artificial Sequence
  Synthetic
gtgtagtgctuaaacagaaaatgcugt

SEQ ID NO: 62872 - DNA, 28 bp, Artificial Sequence
  Synthetic
catgtgtttaccuagggttactttcuca

SEQ ID NO: 62873 - DNA, 20 bp, Artificial Sequence
  Synthetic
cactgggcaguccttcgtua

SEQ ID NO: 62874 - DNA, 23 bp, Artificial Sequence
  Synthetic
cgtaggcauccttcacatgcaut

SEQ ID NO: 62875 - DNA, 23 bp, Artificial Sequence
  Synthetic
ctgccatgutgaactcttcugga

SEQ ID NO: 62876 - DNA, 22 bp, Artificial Sequence
  Synthetic
attatcucctgctguggaagcc

SEQ ID NO: 62877 - DNA, 23 bp, Artificial Sequence
  Synthetic
aaagctccguctgcatagttcut

SEQ ID NO: 62878 - DNA, 23 bp, Artificial Sequence
  Synthetic
cgcttgacugctgatgtuaccaa

SEQ ID NO: 62879 - DNA, 26 bp, Artificial Sequence
  Synthetic
ctgagtaagaaaaggutccccactua

SEQ ID NO: 62880 - DNA, 26 bp, Artificial Sequence
  Synthetic
gattagaaaacgutgtgtgacgugat

SEQ ID NO: 62881 - DNA, 28 bp, Artificial Sequence
  Synthetic
tgtggccttaagutcttaactgcttuaa

SEQ ID NO: 62882 - DNA, 27 bp, Artificial Sequence
  Synthetic
agcaactgcagaugactttattcauca

SEQ ID NO: 62883 - DNA, 24 bp, Artificial Sequence
  Synthetic
ctctttcccutgtcatgtguccaa

SEQ ID NO: 62884 - DNA, 27 bp, Artificial Sequence
  Synthetic
cactagtgcutgaatacctttuacagt

SEQ ID NO: 62885 - DNA, 23 bp, Artificial Sequence
  Synthetic
gcaggatttcutggtcaaagugg

SEQ ID NO: 62886 - DNA, 20 bp, Artificial Sequence
  Synthetic
gcacugacccgagactcuga

SEQ ID NO: 62887 - DNA, 20 bp, Artificial Sequence
  Synthetic
cgtcacctuagcgagagcug

SEQ ID NO: 62888 - DNA, 21 bp, Artificial Sequence
  Synthetic
tgcatucaggaccaactguca

SEQ ID NO: 62889 - DNA, 21 bp, Artificial Sequence
  Synthetic
gcaccugggacaactggaauc

SEQ ID NO: 62890 - DNA, 27 bp, Artificial Sequence
  Synthetic
ctgtgtgucagcaagaacaacattaut

SEQ ID NO: 62891 - DNA, 27 bp, Artificial Sequence
  Synthetic
tutcttctgaaatagucagcacacagt

SEQ ID NO: 62892 - DNA, 24 bp, Artificial Sequence
  Synthetic
attcagtaatgtugggctggagut

SEQ ID NO: 62893 - DNA, 25 bp, Artificial Sequence
  Synthetic
aatggtcctcuccatcactauaggg

SEQ ID NO: 62894 - DNA, 29 bp, Artificial Sequence
  Synthetic
tgttcccttaagauagactgtgataugct

SEQ ID NO: 62895 - DNA, 28 bp, Artificial Sequence
  Synthetic
gttcctcctccautcatttcaatcaaut

SEQ ID NO: 62896 - DNA, 24 bp, Artificial Sequence
  Synthetic
cactgaaagugatgaatggugcaa

SEQ ID NO: 62897 - DNA, 21 bp, Artificial Sequence
  Synthetic
acugggccaaaccagcaauat

SEQ ID NO: 62898 - DNA, 25 bp, Artificial Sequence
  Synthetic
agttgatattuggtggctugcagat

SEQ ID NO: 62899 - DNA, 22 bp, Artificial Sequence
  Synthetic
gaatgaacagugacccauccct

SEQ ID NO: 62900 - DNA, 29 bp, Artificial Sequence
  Synthetic
ttcctttaggctutattgaacaactcuca

SEQ ID NO: 62901 - DNA, 28 bp, Artificial Sequence
  Synthetic
ccaagtcaagcaguctggtaatatcaut

SEQ ID NO: 62902 - DNA, 22 bp, Artificial Sequence
  Synthetic
cacttgagaaautgctggccut

SEQ ID NO: 62903 - DNA, 27 bp, Artificial Sequence
  Synthetic
ccagctcttcuagtcccaaattctuag

SEQ ID NO: 62904 - DNA, 26 bp, Artificial Sequence
  Synthetic
aagtcttgugttgaaattcucagggt

SEQ ID NO: 62905 - DNA, 24 bp, Artificial Sequence
  Synthetic
gataaatcgcgauagagcgtucct

SEQ ID NO: 62906 - DNA, 24 bp, Artificial Sequence
  Synthetic
ccattgugcaaaagactccctuac

SEQ ID NO: 62907 - DNA, 24 bp, Artificial Sequence
  Synthetic
tgaccttggtuaactgagtgtguc

SEQ ID NO: 62908 - DNA, 24 bp, Artificial Sequence
  Synthetic
tgtgauatgtgcccuaggagaagt

SEQ ID NO: 62909 - DNA, 26 bp, Artificial Sequence
  Synthetic
cttaccaagcuatccacatctaugct

SEQ ID NO: 62910 - DNA, 22 bp, Artificial Sequence
  Synthetic
tgaaaacugcccacctctgtut

SEQ ID NO: 62911 - DNA, 23 bp, Artificial Sequence
  Synthetic
caatcuacagcctcacuccacac

SEQ ID NO: 62912 - DNA, 28 bp, Artificial Sequence
  Synthetic
ttgacaagucattatgagtatuggcact

SEQ ID NO: 62913 - DNA, 23 bp, Artificial Sequence
  Synthetic
gatgtgagcaauctgacccgtua

SEQ ID NO: 62914 - DNA, 18 bp, Artificial Sequence
  Synthetic
cagcctgcuctccacguc

SEQ ID NO: 62915 - DNA, 17 bp, Artificial Sequence
  Synthetic
agcgguggtgcgtcuac

SEQ ID NO: 62916 - DNA, 19 bp, Artificial Sequence
  Synthetic
ccattgacucgcactugcc

SEQ ID NO: 62917 - DNA, 21 bp, Artificial Sequence
  Synthetic
gaacaccutccuggacaccat

SEQ ID NO: 62918 - DNA, 20 bp, Artificial Sequence
  Synthetic
gcccagacutacggcttugg

SEQ ID NO: 62919 - DNA, 21 bp, Artificial Sequence
  Synthetic
cgagccugaacggtuagagaa

SEQ ID NO: 62920 - DNA, 23 bp, Artificial Sequence
  Synthetic
ctcttctggcuggcatttttcut

SEQ ID NO: 62921 - DNA, 21 bp, Artificial Sequence
  Synthetic
ggtggctucagggtguaacag

SEQ ID NO: 62922 - DNA, 24 bp, Artificial Sequence
  Synthetic
tccccagggautaaaaatgtugct

SEQ ID NO: 62923 - DNA, 28 bp, Artificial Sequence
  Synthetic
catctgtcaacuccacaaaattctucaa

SEQ ID NO: 62924 - DNA, 22 bp, Artificial Sequence
  Synthetic
gacactgtcaguggttttgcut

SEQ ID NO: 62925 - DNA, 28 bp, Artificial Sequence
  Synthetic
aggtgagtcauttcaaacatactucagt

SEQ ID NO: 62926 - DNA, 25 bp, Artificial Sequence
  Synthetic
acagttccucacagcctgttattuc

SEQ ID NO: 62927 - DNA, 28 bp, Artificial Sequence
  Synthetic
tgctggcaaaauacagaatttuaagcat

SEQ ID NO: 62928 - DNA, 20 bp, Artificial Sequence
  Synthetic
ctgttcccacccuggcatua

SEQ ID NO: 62929 - DNA, 21 bp, Artificial Sequence
  Synthetic
catcguggagtatgccuccaa

SEQ ID NO: 62930 - DNA, 22 bp, Artificial Sequence
  Synthetic
gaccacaucacctgcaaccaua

SEQ ID NO: 62931 - DNA, 20 bp, Artificial Sequence
  Synthetic
tguggagccttgucaccaac

SEQ ID NO: 62932 - DNA, 20 bp, Artificial Sequence
  Synthetic
tgtuaggccgcaaaccctua

SEQ ID NO: 62933 - DNA, 22 bp, Artificial Sequence
  Synthetic
atgggaaucctacagcatuggg

SEQ ID NO: 62934 - DNA, 28 bp, Artificial Sequence
  Synthetic
cacattaaaagugaacactaagcgaucc

SEQ ID NO: 62935 - DNA, 23 bp, Artificial Sequence
  Synthetic
aaataaccaaggcucgggaauca

SEQ ID NO: 62936 - DNA, 24 bp, Artificial Sequence
  Synthetic
catagtggugtggtcttugggaaa

SEQ ID NO: 62937 - DNA, 27 bp, Artificial Sequence
  Synthetic
catgttguaccaattgaaaaguagcca

SEQ ID NO: 62938 - DNA, 26 bp, Artificial Sequence
  Synthetic
tcagagttgutcttatagggucgagt

SEQ ID NO: 62939 - DNA, 20 bp, Artificial Sequence
  Synthetic
gacuacacagcgccauggaa

SEQ ID NO: 62940 - DNA, 23 bp, Artificial Sequence
  Synthetic
aggccagcuctgtgaaaaaugaa

SEQ ID NO: 62941 - DNA, 21 bp, Artificial Sequence
  Synthetic
aaagcaacgcaucucacaacc

SEQ ID NO: 62942 - DNA, 26 bp, Artificial Sequence
  Synthetic
cctttaaagauggagagaccctugaa

SEQ ID NO: 62943 - DNA, 26 bp, Artificial Sequence
  Synthetic
gtgagtguaaacagtaggacuaccac

SEQ ID NO: 62944 - DNA, 24 bp, Artificial Sequence
  Synthetic
ggcuaatgatatagaugggcaggt

SEQ ID NO: 62945 - DNA, 28 bp, Artificial Sequence
  Synthetic
gaaccagtaatttuccatgctgtcttut

SEQ ID NO: 62946 - DNA, 27 bp, Artificial Sequence
  Synthetic
acagggtuaaggaaaatagcaatgugt

SEQ ID NO: 62947 - DNA, 28 bp, Artificial Sequence
  Synthetic
accagctttugaaaatggacagauagat

SEQ ID NO: 62948 - DNA, 27 bp, Artificial Sequence
  Synthetic
gcaacugagcgatcaaaaauagaaagt

SEQ ID NO: 62949 - DNA, 27 bp, Artificial Sequence
  Synthetic
tgtggtattgugcaatgtgattuaacc

SEQ ID NO: 62950 - DNA, 18 bp, Artificial Sequence
  Synthetic
ccggaagggccuctucat

SEQ ID NO: 62951 - DNA, 21 bp, Artificial Sequence
  Synthetic
aaauagcauccgccacaacct

SEQ ID NO: 62952 - DNA, 28 bp, Artificial Sequence
  Synthetic
gcatcttcaagaacutcaacctcttuct

SEQ ID NO: 62953 - DNA, 24 bp, Artificial Sequence
  Synthetic
cagaccacacaauatcaccaccuc

SEQ ID NO: 62954 - DNA, 21 bp, Artificial Sequence
  Synthetic
ccttctggcuccttgactgug

SEQ ID NO: 62955 - DNA, 21 bp, Artificial Sequence
  Synthetic
catccgcaguctccagaagut

SEQ ID NO: 62956 - DNA, 19 bp, Artificial Sequence
  Synthetic
ccgtggaccgcuacatcuc

SEQ ID NO: 62957 - DNA, 19 bp, Artificial Sequence
  Synthetic
gcatguggacguacagcac

SEQ ID NO: 62958 - DNA, 20 bp, Artificial Sequence
  Synthetic
cctggcagcaccaugaacua

SEQ ID NO: 62959 - DNA, 21 bp, Artificial Sequence
  Synthetic
cgtcagagauggacaccucca

SEQ ID NO: 62960 - DNA, 17 bp, Artificial Sequence
  Synthetic
gccucccaggccatugt

SEQ ID NO: 62961 - DNA, 20 bp, Artificial Sequence
  Synthetic
cctatgccucctgccagaug

SEQ ID NO: 62962 - DNA, 23 bp, Artificial Sequence
  Synthetic
ctgacttccuctacatcgaugct

SEQ ID NO: 62963 - DNA, 22 bp, Artificial Sequence
  Synthetic
gttcactaaugccgtgatgcug

SEQ ID NO: 62964 - DNA, 19 bp, Artificial Sequence
  Synthetic
agcugcagaaacctgcuga

SEQ ID NO: 62965 - DNA, 18 bp, Artificial Sequence
  Synthetic
gccuggugccaacagcat

SEQ ID NO: 62966 - DNA, 24 bp, Artificial Sequence
  Synthetic
tttcutcttcagcaucaccaaggt

SEQ ID NO: 62967 - DNA, 25 bp, Artificial Sequence
  Synthetic
atccaaatgucccctgcattuaaga

SEQ ID NO: 62968 - DNA, 19 bp, Artificial Sequence
  Synthetic
tctgcaugggcgtctctug

SEQ ID NO: 62969 - DNA, 20 bp, Artificial Sequence
  Synthetic
cttccctucagggtcagugg

SEQ ID NO: 62970 - DNA, 25 bp, Artificial Sequence
  Synthetic
aaccaatcatugagcactgactcut

SEQ ID NO: 62971 - DNA, 20 bp, Artificial Sequence
  Synthetic
tcctcagccuccgauaagca

SEQ ID NO: 62972 - DNA, 25 bp, Artificial Sequence
  Synthetic
acaatgaccaaautaccagctcucc

SEQ ID NO: 62973 - DNA, 25 bp, Artificial Sequence
  Synthetic
acatgaaatucaacagccctcugat

SEQ ID NO: 62974 - DNA, 21 bp, Artificial Sequence
  Synthetic
aggagcuaggaaaugcaagcc

SEQ ID NO: 62975 - DNA, 26 bp, Artificial Sequence
  Synthetic
tcacagagttucaccccaaaagtuaa

SEQ ID NO: 62976 - DNA, 22 bp, Artificial Sequence
  Synthetic
gcatacccautgtctgcaguga

SEQ ID NO: 62977 - DNA, 22 bp, Artificial Sequence
  Synthetic
agtgctaacuccagtcttugcc

SEQ ID NO: 62978 - DNA, 25 bp, Artificial Sequence
  Synthetic
catcaaacaagagugtgttctgcut

SEQ ID NO: 62979 - DNA, 28 bp, Artificial Sequence
  Synthetic
gtcctaaatctgauctcaccatgatcuc

SEQ ID NO: 62980 - DNA, 22 bp, Artificial Sequence
  Synthetic
cacttuggagacgguacgaact

SEQ ID NO: 62981 - DNA, 23 bp, Artificial Sequence
  Synthetic
ccaagcaucaggccaaatguaac

SEQ ID NO: 62982 - DNA, 22 bp, Artificial Sequence
  Synthetic
tcaaugttacugcccccaaagg

SEQ ID NO: 62983 - DNA, 28 bp, Artificial Sequence
  Synthetic
tgtgttttgacugttgcaattttctuct

SEQ ID NO: 62984 - DNA, 24 bp, Artificial Sequence
  Synthetic
acatttttaggcutgacaggugga

SEQ ID NO: 62985 - DNA, 25 bp, Artificial Sequence
  Synthetic
tctgggttttcucaggattgctaug

SEQ ID NO: 62986 - DNA, 26 bp, Artificial Sequence
  Synthetic
ccatgtgaaagucaaaatgccaucat

SEQ ID NO: 62987 - DNA, 24 bp, Artificial Sequence
  Synthetic
tggaacaactuctcaatgctccug

SEQ ID NO: 62988 - DNA, 26 bp, Artificial Sequence
  Synthetic
gctttttctguacaatctgacgucca

SEQ ID NO: 62989 - DNA, 28 bp, Artificial Sequence
  Synthetic
ccgctgcaaaaugctactctatuaaaat

SEQ ID NO: 62990 - DNA, 23 bp, Artificial Sequence
  Synthetic
gacuggagtataaugcccaacga

SEQ ID NO: 62991 - DNA, 29 bp, Artificial Sequence
  Synthetic
ttgttctttguagagcatgctgactaaua

SEQ ID NO: 62992 - DNA, 28 bp, Artificial Sequence
  Synthetic
ggagtttattcattugctcctctagcut

SEQ ID NO: 62993 - DNA, 25 bp, Artificial Sequence
  Synthetic
aggcttuacaaagttctcugcaaga

SEQ ID NO: 62994 - DNA, 24 bp, Artificial Sequence
  Synthetic
agcacttcagcugattatgagugt

SEQ ID NO: 62995 - DNA, 25 bp, Artificial Sequence
  Synthetic
acatggtgguggtagttgatgaauc

SEQ ID NO: 62996 - DNA, 28 bp, Artificial Sequence
  Synthetic
aaatttaccaaccutcaggatcgaguag

SEQ ID NO: 62997 - DNA, 27 bp, Artificial Sequence
  Synthetic
aagcatggaaguaaatctcauggaaca

SEQ ID NO: 62998 - DNA, 28 bp, Artificial Sequence
  Synthetic
aattttacaaagccacgutactggaaug

SEQ ID NO: 62999 - DNA, 27 bp, Artificial Sequence
  Synthetic
cctggactacugttcattttcatugct

SEQ ID NO: 63000 - DNA, 23 bp, Artificial Sequence
  Synthetic
gatgcagtatuggctcgagtgua

SEQ ID NO: 63001 - DNA, 27 bp, Artificial Sequence
  Synthetic
gcaagtcaggaautatttgatttugct

SEQ ID NO: 63002 - DNA, 18 bp, Artificial Sequence
  Synthetic
cctctcccccutcccgut

SEQ ID NO: 63003 - DNA, 20 bp, Artificial Sequence
  Synthetic
ccuccagagccccgatttuc

SEQ ID NO: 63004 - DNA, 24 bp, Artificial Sequence
  Synthetic
cacctgagtucatgatcgacacuc

SEQ ID NO: 63005 - DNA, 21 bp, Artificial Sequence
  Synthetic
gcccttccucactcaguacac

SEQ ID NO: 63006 - DNA, 22 bp, Artificial Sequence
  Synthetic
agccttaggacauctgggauca

SEQ ID NO: 63007 - DNA, 22 bp, Artificial Sequence
  Synthetic
tcaaacccacugccatctucag

SEQ ID NO: 63008 - DNA, 22 bp, Artificial Sequence
  Synthetic
gcctggtgccugacacatttua

SEQ ID NO: 63009 - DNA, 26 bp, Artificial Sequence
  Synthetic
ccactgccttuctctcattctaacug

SEQ ID NO: 63010 - DNA, 28 bp, Artificial Sequence
  Synthetic
acaaacacgattgutttggcttaatcuc

SEQ ID NO: 63011 - DNA, 25 bp, Artificial Sequence
  Synthetic
tgctgtcttaugcttcagtgcttua

SEQ ID NO: 63012 - DNA, 24 bp, Artificial Sequence
  Synthetic
cacagtgatugctggttccatuaa

SEQ ID NO: 63013 - DNA, 27 bp, Artificial Sequence
  Synthetic
gtttgtgtttcucctagggagtuaagt

SEQ ID NO: 63014 - DNA, 25 bp, Artificial Sequence
  Synthetic
gcccagauactgttttcaaugcaaa

SEQ ID NO: 63015 - DNA, 28 bp, Artificial Sequence
  Synthetic
gggaaaaagaaaaccautgtgatgauaa

SEQ ID NO: 63016 - DNA, 21 bp, Artificial Sequence
  Synthetic
tgactccggacuacctcacut

SEQ ID NO: 63017 - DNA, 26 bp, Artificial Sequence
  Synthetic
agtaatagtcacaugacacgttuccc

SEQ ID NO: 63018 - DNA, 25 bp, Artificial Sequence
  Synthetic
acagtatcccaugaaccattgugaa

SEQ ID NO: 63019 - DNA, 29 bp, Artificial Sequence
  Synthetic
ggaagaaagaauaaaaucacacacacaca

SEQ ID NO: 63020 - DNA, 22 bp, Artificial Sequence
  Synthetic
gaggcaggutgatgttgucaga

SEQ ID NO: 63021 - DNA, 23 bp, Artificial Sequence
  Synthetic
acugtagcttcuaccgaaccaga

SEQ ID NO: 63022 - DNA, 27 bp, Artificial Sequence
  Synthetic
acattaaaacuggcatctgtttccuca

SEQ ID NO: 63023 - DNA, 25 bp, Artificial Sequence
  Synthetic
attagaguaggaaagagggctugga

SEQ ID NO: 63024 - DNA, 24 bp, Artificial Sequence
  Synthetic
gggtcttccucttctagaccuaca

SEQ ID NO: 63025 - DNA, 22 bp, Artificial Sequence
  Synthetic
cccagatgguccccaatuagag

SEQ ID NO: 63026 - DNA, 23 bp, Artificial Sequence
  Synthetic
cugaagggctugaaaggaaagag

SEQ ID NO: 63027 - DNA, 28 bp, Artificial Sequence
  Synthetic
tcattcttgaggcauttattaggcucat

SEQ ID NO: 63028 - DNA, 21 bp, Artificial Sequence
  Synthetic
cagaagcacutgcccccaaua

SEQ ID NO: 63029 - DNA, 28 bp, Artificial Sequence
  Synthetic
gtgtacctauaactgttgtgauggacat

SEQ ID NO: 63030 - DNA, 24 bp, Artificial Sequence
  Synthetic
aacattgctcuctaatgggctgut

SEQ ID NO: 63031 - DNA, 24 bp, Artificial Sequence
  Synthetic
gagugaaattccuggagaaagcac

SEQ ID NO: 63032 - DNA, 21 bp, Artificial Sequence
  Synthetic
cacacccacagcuagaggtuc

SEQ ID NO: 63033 - DNA, 20 bp, Artificial Sequence
  Synthetic
agggagggutcagtgucagt

SEQ ID NO: 63034 - DNA, 23 bp, Artificial Sequence
  Synthetic
ctgggtgtgauctcgagaatuga

SEQ ID NO: 63035 - DNA, 24 bp, Artificial Sequence
  Synthetic
aacgtgcctugttctttgcauaag

SEQ ID NO: 63036 - DNA, 20 bp, Artificial Sequence
  Synthetic
gcagcgtuacatggagcuct

SEQ ID NO: 63037 - DNA, 27 bp, Artificial Sequence
  Synthetic
ccaaatgaaagucagctatcgccttua

SEQ ID NO: 63038 - DNA, 20 bp, Artificial Sequence
  Synthetic
gactgguacacggucacacc

SEQ ID NO: 63039 - DNA, 22 bp, Artificial Sequence
  Synthetic
agaagccccaaaccutgcuaat

SEQ ID NO: 63040 - DNA, 21 bp, Artificial Sequence
  Synthetic
cccaggacutttcuccaggac

SEQ ID NO: 63041 - DNA, 25 bp, Artificial Sequence
  Synthetic
atccctggacccuaatgatttugac

SEQ ID NO: 63042 - DNA, 18 bp, Artificial Sequence
  Synthetic
ccccggucacggatgaug

SEQ ID NO: 63043 - DNA, 27 bp, Artificial Sequence
  Synthetic
aacccctcaaguttaaaaaggugaaga

SEQ ID NO: 63044 - DNA, 28 bp, Artificial Sequence
  Synthetic
tgaggtgtcauccacaattatcctttut

SEQ ID NO: 63045 - DNA, 24 bp, Artificial Sequence
  Synthetic
gaggaagaaaacutggaaggctug

SEQ ID NO: 63046 - DNA, 27 bp, Artificial Sequence
  Synthetic
tcttggctgagguctaatacaguaact

SEQ ID NO: 63047 - DNA, 27 bp, Artificial Sequence
  Synthetic
gccaataactutccttactgcucaaac

SEQ ID NO: 63048 - DNA, 24 bp, Artificial Sequence
  Synthetic
gtctttuaccaggtccacaugaga

SEQ ID NO: 63049 - DNA, 29 bp, Artificial Sequence
  Synthetic
tgagtguacagtggatauagaaaggacaa

SEQ ID NO: 63050 - DNA, 21 bp, Artificial Sequence
  Synthetic
gccttggcutagcgatgtuga

SEQ ID NO: 63051 - DNA, 28 bp, Artificial Sequence
  Synthetic
accaaaatgaacgacuttttcctttcut

SEQ ID NO: 63052 - DNA, 20 bp, Artificial Sequence
  Synthetic
ccatcaacaucgcccugaac

SEQ ID NO: 63053 - DNA, 22 bp, Artificial Sequence
  Synthetic
ctcctccugctagactgugaac

SEQ ID NO: 63054 - DNA, 23 bp, Artificial Sequence
  Synthetic
cgatgcaacuctatcgucacagt

SEQ ID NO: 63055 - DNA, 28 bp, Artificial Sequence
  Synthetic
ccgcaaatcccacuagctaaatatcuaa

SEQ ID NO: 63056 - DNA, 22 bp, Artificial Sequence
  Synthetic
cctgtcaccuttagccctggua

SEQ ID NO: 63057 - DNA, 20 bp, Artificial Sequence
  Synthetic
aaggguaagacctcggugga

SEQ ID NO: 63058 - DNA, 22 bp, Artificial Sequence
  Synthetic
ccaacaggcucacagagaagug

SEQ ID NO: 63059 - DNA, 23 bp, Artificial Sequence
  Synthetic
agtaatucaccagctccaugcag

SEQ ID NO: 63060 - DNA, 24 bp, Artificial Sequence
  Synthetic
agcctcatctucaagctcatcaut

SEQ ID NO: 63061 - DNA, 21 bp, Artificial Sequence
  Synthetic
gtagcagagcucacagauggt

SEQ ID NO: 63062 - DNA, 20 bp, Artificial Sequence
  Synthetic
gggccggaagcuaaactugt

SEQ ID NO: 63063 - DNA, 23 bp, Artificial Sequence
  Synthetic
ggcatctucatcgggttucagaa

SEQ ID NO: 63064 - DNA, 33 bp, Artificial Sequence
  Synthetic
taaagtgaatataccuggaaataactgtttugt

SEQ ID NO: 63065 - DNA, 26 bp, Artificial Sequence
  Synthetic
agctgctccagutgatgtacuaaaag

SEQ ID NO: 63066 - DNA, 28 bp, Artificial Sequence
  Synthetic
gggaggauggttaatgttgcuaaaagaa

SEQ ID NO: 63067 - DNA, 28 bp, Artificial Sequence
  Synthetic
catcttgaaaatguctctcccttcauct

SEQ ID NO: 63068 - DNA, 25 bp, Artificial Sequence
  Synthetic
gtgatgtctacaaugatgggacugt

SEQ ID NO: 63069 - DNA, 22 bp, Artificial Sequence
  Synthetic
cctctcccacaugtgaccctua

SEQ ID NO: 63070 - DNA, 19 bp, Artificial Sequence
  Synthetic
cccgcaagacccutgacuc

SEQ ID NO: 63071 - DNA, 25 bp, Artificial Sequence
  Synthetic
gggaggagacuatggcaaagttauc

SEQ ID NO: 63072 - DNA, 28 bp, Artificial Sequence
  Synthetic
caatgttgttacuggaaatgttctcugg

SEQ ID NO: 63073 - DNA, 28 bp, Artificial Sequence
  Synthetic
cacttcccaaccuattttcctgtctaut

SEQ ID NO: 63074 - DNA, 21 bp, Artificial Sequence
  Synthetic
acacctcatucctcagggcua

SEQ ID NO: 63075 - DNA, 25 bp, Artificial Sequence
  Synthetic
tccaatccttucccctaatttgcut

SEQ ID NO: 63076 - DNA, 29 bp, Artificial Sequence
  Synthetic
ggctgagttgcuatttgtcttctgtauaa

SEQ ID NO: 63077 - DNA, 20 bp, Artificial Sequence
  Synthetic
cacccugggatgtgcaucaa

SEQ ID NO: 63078 - DNA, 23 bp, Artificial Sequence
  Synthetic
cttacttggtutagcccaccuca

SEQ ID NO: 63079 - DNA, 22 bp, Artificial Sequence
  Synthetic
tcgtacacaacagugtgggtut

SEQ ID NO: 63080 - DNA, 24 bp, Artificial Sequence
  Synthetic
agcctcctucatttccctactuct

SEQ ID NO: 63081 - DNA, 22 bp, Artificial Sequence
  Synthetic
tggagggugcacagagagttua

SEQ ID NO: 63082 - DNA, 22 bp, Artificial Sequence
  Synthetic
agcaaagaacugggaagggaut

SEQ ID NO: 63083 - DNA, 27 bp, Artificial Sequence
  Synthetic
acactgttccuaaagcaattacugaca

SEQ ID NO: 63084 - DNA, 23 bp, Artificial Sequence
  Synthetic
caaagagggaggcutguacacat

SEQ ID NO: 63085 - DNA, 26 bp, Artificial Sequence
  Synthetic
ctttctgaacaaucacctcaacaguc

SEQ ID NO: 63086 - DNA, 25 bp, Artificial Sequence
  Synthetic
aggcattcuggaagttttacacugt

SEQ ID NO: 63087 - DNA, 30 bp, Artificial Sequence
  Synthetic
agttcatttacctugtgatttcttccaugt

SEQ ID NO: 63088 - DNA, 22 bp, Artificial Sequence
  Synthetic
gtctggtactucaccactggut

SEQ ID NO: 63089 - DNA, 20 bp, Artificial Sequence
  Synthetic
ggcaggcutgtatccactug

SEQ ID NO: 63090 - DNA, 28 bp, Artificial Sequence
  Synthetic
ttctagucattactttgugaaccccaag

SEQ ID NO: 63091 - DNA, 24 bp, Artificial Sequence
  Synthetic
ttcaaaaactggutgggcattcug

SEQ ID NO: 63092 - DNA, 28 bp, Artificial Sequence
  Synthetic
tcaaattactaugctgtgttcttgucct

SEQ ID NO: 63093 - DNA, 28 bp, Artificial Sequence
  Synthetic
gaaaagagtgtguacttagggtatgugt

SEQ ID NO: 63094 - DNA, 21 bp, Artificial Sequence
  Synthetic
gcuccccacgagaagtucaag

SEQ ID NO: 63095 - DNA, 24 bp, Artificial Sequence
  Synthetic
acaggtacctuggtgccttacuat

SEQ ID NO: 63096 - DNA, 26 bp, Artificial Sequence
  Synthetic
tctttgucttcttttguccacacact

SEQ ID NO: 63097 - DNA, 28 bp, Artificial Sequence
  Synthetic
cagaccttuctgttggtauaagaggaaa

SEQ ID NO: 63098 - DNA, 28 bp, Artificial Sequence
  Synthetic
attcaaagaggaggaautctgaucacag

SEQ ID NO: 63099 - DNA, 25 bp, Artificial Sequence
  Synthetic
tccatttcuggcaatacagcacuat

SEQ ID NO: 63100 - DNA, 20 bp, Artificial Sequence
  Synthetic
cccgtuccccttuaagagca

SEQ ID NO: 63101 - DNA, 21 bp, Artificial Sequence
  Synthetic
gacgttcucggcauagaggat

SEQ ID NO: 63102 - DNA, 18 bp, Artificial Sequence
  Synthetic
aaccuccccagugcgaag

SEQ ID NO: 63103 - DNA, 18 bp, Artificial Sequence
  Synthetic
ctucagacccgccaguga

SEQ ID NO: 63104 - DNA, 20 bp, Artificial Sequence
  Synthetic
cagggtgccutaggctagut

SEQ ID NO: 63105 - DNA, 22 bp, Artificial Sequence
  Synthetic
gcaatgccutggacctuaacct

SEQ ID NO: 63106 - DNA, 21 bp, Artificial Sequence
  Synthetic
caguccagccaggagctatug

SEQ ID NO: 63107 - DNA, 21 bp, Artificial Sequence
  Synthetic
ccgatgcugacctcaaacugg

SEQ ID NO: 63108 - DNA, 22 bp, Artificial Sequence
  Synthetic
agggaacacugcctctctcuaa

SEQ ID NO: 63109 - DNA, 23 bp, Artificial Sequence
  Synthetic
cccatgtgcagaaugggattcua

SEQ ID NO: 63110 - DNA, 20 bp, Artificial Sequence
  Synthetic
gctcaccutgtctgugcaac

SEQ ID NO: 63111 - DNA, 25 bp, Artificial Sequence
  Synthetic
tccgcccacutttatactcctttuc

SEQ ID NO: 63112 - DNA, 20 bp, Artificial Sequence
  Synthetic
ttcgcaggauggcaaacuct

SEQ ID NO: 63113 - DNA, 22 bp, Artificial Sequence
  Synthetic
cactccagaacugcctgactuc

SEQ ID NO: 63114 - DNA, 27 bp, Artificial Sequence
  Synthetic
tctttgtctggcuttgttacactauca

SEQ ID NO: 63115 - DNA, 24 bp, Artificial Sequence
  Synthetic
gctactgtcautcagcgtgctuat

SEQ ID NO: 63116 - DNA, 22 bp, Artificial Sequence
  Synthetic
caatgagcuggactttgtuggg

SEQ ID NO: 63117 - DNA, 26 bp, Artificial Sequence
  Synthetic
tggtgaacatguacattgcagtcaua

SEQ ID NO: 63118 - DNA, 24 bp, Artificial Sequence
  Synthetic
tgagagccuatgattguccaagga

SEQ ID NO: 63119 - DNA, 21 bp, Artificial Sequence
  Synthetic
catcgucacccactttcccut

SEQ ID NO: 63120 - DNA, 28 bp, Artificial Sequence
  Synthetic
cagagtaacaaaaaucaccttucagcaa

SEQ ID NO: 63121 - DNA, 26 bp, Artificial Sequence
  Synthetic
cauattatgtcaucgcagagaacgga

SEQ ID NO: 63122 - DNA, 21 bp, Artificial Sequence
  Synthetic
ctggtacucctggtcugcaag

SEQ ID NO: 63123 - DNA, 26 bp, Artificial Sequence
  Synthetic
cgattacttuccaggagtgttgctut

SEQ ID NO: 63124 - DNA, 22 bp, Artificial Sequence
  Synthetic
ggcugcacagacatttctugga

SEQ ID NO: 63125 - DNA, 23 bp, Artificial Sequence
  Synthetic
acagtcuttgtttctugcagggt

SEQ ID NO: 63126 - DNA, 22 bp, Artificial Sequence
  Synthetic
agagcctgcuattcaggacuca

SEQ ID NO: 63127 - DNA, 28 bp, Artificial Sequence
  Synthetic
gctaagcatgaagauttctgtgcattut

SEQ ID NO: 63128 - DNA, 23 bp, Artificial Sequence
  Synthetic
ccagcaaugtatagtgtugccat

SEQ ID NO: 63129 - DNA, 26 bp, Artificial Sequence
  Synthetic
cactgguagcctgttaaactuacaca

SEQ ID NO: 63130 - DNA, 25 bp, Artificial Sequence
  Synthetic
gcagauatactuacaggagcaccct

SEQ ID NO: 63131 - DNA, 28 bp, Artificial Sequence
  Synthetic
tggtggccaatuatcttgaatctcaaut

SEQ ID NO: 63132 - DNA, 26 bp, Artificial Sequence
  Synthetic
actaatctgttcuggtttgcttgugt

SEQ ID NO: 63133 - DNA, 28 bp, Artificial Sequence
  Synthetic
tugtttttaatgucacagggacaaaagg

SEQ ID NO: 63134 - DNA, 20 bp, Artificial Sequence
  Synthetic
tccagcacaucctggcatuc

SEQ ID NO: 63135 - DNA, 28 bp, Artificial Sequence
  Synthetic
acaagatggcucaccttttattttcuca

SEQ ID NO: 63136 - DNA, 26 bp, Artificial Sequence
  Synthetic
tctaaaactaacuggcctgttgtgut

SEQ ID NO: 63137 - DNA, 28 bp, Artificial Sequence
  Synthetic
gtcttcaaagaccutgcaagaagtacua

SEQ ID NO: 63138 - DNA, 28 bp, Artificial Sequence
  Synthetic
tcttttgaaggagauttcaaggcuaaca

SEQ ID NO: 63139 - DNA, 24 bp, Artificial Sequence
  Synthetic
gtgattcaccugaagagacagcut

SEQ ID NO: 63140 - DNA, 24 bp, Artificial Sequence
  Synthetic
cctttcatugttgcatcucacaca

SEQ ID NO: 63141 - DNA, 25 bp, Artificial Sequence
  Synthetic
cgagtggcuacagaaaagtgtctut

SEQ ID NO: 63142 - DNA, 21 bp, Artificial Sequence
  Synthetic
tcctagaaaucgcccucacct

SEQ ID NO: 63143 - DNA, 21 bp, Artificial Sequence
  Synthetic
cautctgtccuaccgcagagt

SEQ ID NO: 63144 - DNA, 21 bp, Artificial Sequence
  Synthetic
cacaggtuaaacccccucaca

SEQ ID NO: 63145 - DNA, 28 bp, Artificial Sequence
  Synthetic
gagggtactugaatcttcagaagtugaa

SEQ ID NO: 63146 - DNA, 25 bp, Artificial Sequence
  Synthetic
acctcccaauagctgagatcgauaa

SEQ ID NO: 63147 - DNA, 22 bp, Artificial Sequence
  Synthetic
agcugggaaauccgagacaaat

SEQ ID NO: 63148 - DNA, 20 bp, Artificial Sequence
  Synthetic
tttcttguggcccctugaca

SEQ ID NO: 63149 - DNA, 22 bp, Artificial Sequence
  Synthetic
gcttcucgaacatgaggucact

SEQ ID NO: 63150 - DNA, 21 bp, Artificial Sequence
  Synthetic
gctacaccaccutcactguct

SEQ ID NO: 63151 - DNA, 22 bp, Artificial Sequence
  Synthetic
gagtagaugtggctgaugcact

SEQ ID NO: 63152 - DNA, 22 bp, Artificial Sequence
  Synthetic
gctctgcacauagtaggcauct

SEQ ID NO: 63153 - DNA, 23 bp, Artificial Sequence
  Synthetic
actctcccagugatctcaucaca

SEQ ID NO: 63154 - DNA, 24 bp, Artificial Sequence
  Synthetic
ggctgaagcucatttctgacauca

SEQ ID NO: 63155 - DNA, 28 bp, Artificial Sequence
  Synthetic
ggacagggaagaguctatuacagaaaat

SEQ ID NO: 63156 - DNA, 23 bp, Artificial Sequence
  Synthetic
gaugttaatgugcaccccacaaa

SEQ ID NO: 63157 - DNA, 21 bp, Artificial Sequence
  Synthetic
gccccagagaaguagcuggat

SEQ ID NO: 63158 - DNA, 23 bp, Artificial Sequence
  Synthetic
gccatuaccttcagugaagcagt

SEQ ID NO: 63159 - DNA, 21 bp, Artificial Sequence
  Synthetic
ccctaagcucctgcagacuct

SEQ ID NO: 63160 - DNA, 21 bp, Artificial Sequence
  Synthetic
cutccugagagcaaaggcagt

SEQ ID NO: 63161 - DNA, 22 bp, Artificial Sequence
  Synthetic
tgccactcacuctcctcttcut

SEQ ID NO: 63162 - DNA, 22 bp, Artificial Sequence
  Synthetic
acagaguggtttcucccaggat

SEQ ID NO: 63163 - DNA, 24 bp, Artificial Sequence
  Synthetic
cuccagcacattuccaagaacaag

SEQ ID NO: 63164 - DNA, 21 bp, Artificial Sequence
  Synthetic
gagacaaggguttcccagcut

SEQ ID NO: 63165 - DNA, 26 bp, Artificial Sequence
  Synthetic
tgtggcttatguctcatgtgtcatuc

SEQ ID NO: 63166 - DNA, 22 bp, Artificial Sequence
  Synthetic
ggccattcautcaccaguccaa

SEQ ID NO: 63167 - DNA, 21 bp, Artificial Sequence
  Synthetic
ggatggugcctgtgtgttuca

SEQ ID NO: 63168 - DNA, 21 bp, Artificial Sequence
  Synthetic
ccagcccuttctttcucacca

SEQ ID NO: 63169 - DNA, 23 bp, Artificial Sequence
  Synthetic
gagtccaacccucgtgtctatut

SEQ ID NO: 63170 - DNA, 21 bp, Artificial Sequence
  Synthetic
gggtgtcucctgggaucacat

SEQ ID NO: 63171 - DNA, 26 bp, Artificial Sequence
  Synthetic
cctaggaucaggagctttgugaaaaa

SEQ ID NO: 63172 - DNA, 21 bp, Artificial Sequence
  Synthetic
actttccccugtcctccucat

SEQ ID NO: 63173 - DNA, 27 bp, Artificial Sequence
  Synthetic
ggctcttacccuttcttctttttctug

SEQ ID NO: 63174 - DNA, 21 bp, Artificial Sequence
  Synthetic
tgtccccgaacucctacauga

SEQ ID NO: 63175 - DNA, 28 bp, Artificial Sequence
  Synthetic
catttacgutcacgtcuaacacacaaaa

SEQ ID NO: 63176 - DNA, 21 bp, Artificial Sequence
  Synthetic
cttgagucagacgccctucat

SEQ ID NO: 63177 - DNA, 21 bp, Artificial Sequence
  Synthetic
gtctggctcautccacgtcuc

SEQ ID NO: 63178 - DNA, 19 bp, Artificial Sequence
  Synthetic
gggacucctucaccaaggg

SEQ ID NO: 63179 - DNA, 17 bp, Artificial Sequence
  Synthetic
cccaccgugtggtugct

SEQ ID NO: 63180 - DNA, 26 bp, Artificial Sequence
  Synthetic
ccaagttccugaagatagcugaagag

SEQ ID NO: 63181 - DNA, 18 bp, Artificial Sequence
  Synthetic
ccaggguccctgtagcug

SEQ ID NO: 63182 - DNA, 19 bp, Artificial Sequence
  Synthetic
aggaggacucacccgcuaa

SEQ ID NO: 63183 - DNA, 23 bp, Artificial Sequence
  Synthetic
ggtttaggaacugtggagtccug

SEQ ID NO: 63184 - DNA, 21 bp, Artificial Sequence
  Synthetic
gctgaugctggtcuacaagga

SEQ ID NO: 63185 - DNA, 21 bp, Artificial Sequence
  Synthetic
gctgucaaagcccagcaugat

SEQ ID NO: 63186 - DNA, 21 bp, Artificial Sequence
  Synthetic
ctccuccaccgagtcttcuct

SEQ ID NO: 63187 - DNA, 20 bp, Artificial Sequence
  Synthetic
gctctccugctggaggctua

SEQ ID NO: 63188 - DNA, 23 bp, Artificial Sequence
  Synthetic
gtgcatttcuccaccacattugt

SEQ ID NO: 63189 - DNA, 28 bp, Artificial Sequence
  Synthetic
tgtgctacaataugtgctgtttctttug

SEQ ID NO: 63190 - DNA, 27 bp, Artificial Sequence
  Synthetic
ggttattgttgaauggaaacgtgauga

SEQ ID NO: 63191 - DNA, 26 bp, Artificial Sequence
  Synthetic
agtgtggaagcuatctgcatttgaut

SEQ ID NO: 63192 - DNA, 22 bp, Artificial Sequence
  Synthetic
cgaggtgctugtcttgctgtua

SEQ ID NO: 63193 - DNA, 28 bp, Artificial Sequence
  Synthetic
catccatgccgutaagaatttcatucaa

SEQ ID NO: 63194 - DNA, 22 bp, Artificial Sequence
  Synthetic
ctgaggaugacagtctugagca

SEQ ID NO: 63195 - DNA, 23 bp, Artificial Sequence
  Synthetic
tgaacctctttutctccccgtut

SEQ ID NO: 63196 - DNA, 24 bp, Artificial Sequence
  Synthetic
gaaccagugattcgaguacaacct

SEQ ID NO: 63197 - DNA, 22 bp, Artificial Sequence
  Synthetic
tgtctucagcctcaguggaaac

SEQ ID NO: 63198 - DNA, 23 bp, Artificial Sequence
  Synthetic
tgtaaggacuatgcccactucca

SEQ ID NO: 63199 - DNA, 21 bp, Artificial Sequence
  Synthetic
cctgaggagccacugtctuct

SEQ ID NO: 63200 - DNA, 28 bp, Artificial Sequence
  Synthetic
acaaagcaaaaugtagagacugaaacct

SEQ ID NO: 63201 - DNA, 22 bp, Artificial Sequence
  Synthetic
cagtgcaugactctggtctuga

SEQ ID NO: 63202 - DNA, 22 bp, Artificial Sequence
  Synthetic
acctccctutgctttgtcuacc

SEQ ID NO: 63203 - DNA, 22 bp, Artificial Sequence
  Synthetic
actccgaaguaggcagctcuat

SEQ ID NO: 63204 - DNA, 22 bp, Artificial Sequence
  Synthetic
ggagatguccagtgggatgtug

SEQ ID NO: 63205 - DNA, 22 bp, Artificial Sequence
  Synthetic
tggctccutcgtctttugcaat

SEQ ID NO: 63206 - DNA, 22 bp, Artificial Sequence
  Synthetic
aggaaacucctgtagacucgca

SEQ ID NO: 63207 - DNA, 27 bp, Artificial Sequence
  Synthetic
gatttcatggaugagctgatggacaua

SEQ ID NO: 63208 - DNA, 21 bp, Artificial Sequence
  Synthetic
tggagagagaagccguguaga

SEQ ID NO: 63209 - DNA, 23 bp, Artificial Sequence
  Synthetic
ctcttcactcugtgtgtgtccug

SEQ ID NO: 63210 - DNA, 17 bp, Artificial Sequence
  Synthetic
cgtccguccagcuccag

SEQ ID NO: 63211 - DNA, 22 bp, Artificial Sequence
  Synthetic
ccttgttctuggagggcaacua

SEQ ID NO: 63212 - DNA, 22 bp, Artificial Sequence
  Synthetic
cttgugacccaaatugccaaga

SEQ ID NO: 63213 - DNA, 24 bp, Artificial Sequence
  Synthetic
tctgtttuagaacgagtugcggaa

SEQ ID NO: 63214 - DNA, 22 bp, Artificial Sequence
  Synthetic
gactaccuacacatggugcaca

SEQ ID NO: 63215 - DNA, 20 bp, Artificial Sequence
  Synthetic
aggctacuggtcacactuga

SEQ ID NO: 63216 - DNA, 27 bp, Artificial Sequence
  Synthetic
agaaaacaagautctuacccacaggag

SEQ ID NO: 63217 - DNA, 27 bp, Artificial Sequence
  Synthetic
aatcctgagutatagaagccugagagt

SEQ ID NO: 63218 - DNA, 28 bp, Artificial Sequence
  Synthetic
caggttctgtagcuagaaaattgtgtuc

SEQ ID NO: 63219 - DNA, 28 bp, Artificial Sequence
  Synthetic
gataagctgcuaacaatgtcacaaacut

SEQ ID NO: 63220 - DNA, 22 bp, Artificial Sequence
  Synthetic
agctttgtgutgggcctaauga

SEQ ID NO: 63221 - DNA, 21 bp, Artificial Sequence
  Synthetic
aacagugaccacacccttgut

SEQ ID NO: 63222 - DNA, 29 bp, Artificial Sequence
  Synthetic
ttgccactatugaggaagatctaaugaag

SEQ ID NO: 63223 - DNA, 23 bp, Artificial Sequence
  Synthetic
acagctcacacaaugttgcacua

SEQ ID NO: 63224 - DNA, 26 bp, Artificial Sequence
  Synthetic
acacaagcaaaguctctatggtgaut

SEQ ID NO: 63225 - DNA, 27 bp, Artificial Sequence
  Synthetic
gcgttctctcuccaaacttctatctut

SEQ ID NO: 63226 - DNA, 26 bp, Artificial Sequence
  Synthetic
tgaaacagaaucagagcagccuaaag

SEQ ID NO: 63227 - DNA, 21 bp, Artificial Sequence
  Synthetic
cttgccacagguggagguaat

SEQ ID NO: 63228 - DNA, 24 bp, Artificial Sequence
  Synthetic
ctcgaguaagcactuggagaagaa

SEQ ID NO: 63229 - DNA, 26 bp, Artificial Sequence
  Synthetic
cggtctgagaaguactatttguggga

SEQ ID NO: 63230 - DNA, 24 bp, Artificial Sequence
  Synthetic
tctgtcacccagutggtauagaca

SEQ ID NO: 63231 - DNA, 27 bp, Artificial Sequence
  Synthetic
tcaatattccauagcctgtucccaaag

SEQ ID NO: 63232 - DNA, 25 bp, Artificial Sequence
  Synthetic
accttctcccuccttaattccctut

SEQ ID NO: 63233 - DNA, 20 bp, Artificial Sequence
  Synthetic
ctctcuaccccaacccucca

SEQ ID NO: 63234 - DNA, 21 bp, Artificial Sequence
  Synthetic
gggttgugtaatggatucgct

SEQ ID NO: 63235 - DNA, 28 bp, Artificial Sequence
  Synthetic
ccattaatcaaugcaaaccaaagucaga

SEQ ID NO: 63236 - DNA, 19 bp, Artificial Sequence
  Synthetic
ggtaccgcugctgctugaa

SEQ ID NO: 63237 - DNA, 20 bp, Artificial Sequence
  Synthetic
cgtaggucaagccgctctua

SEQ ID NO: 63238 - DNA, 21 bp, Artificial Sequence
  Synthetic
gatggaagcagugaccuggat

SEQ ID NO: 63239 - DNA, 26 bp, Artificial Sequence
  Synthetic
cccattaagtgguctgtatgtgagut

SEQ ID NO: 63240 - DNA, 25 bp, Artificial Sequence
  Synthetic
tcttttgcttguccctgatttucct

SEQ ID NO: 63241 - DNA, 29 bp, Artificial Sequence
  Synthetic
gggtaaagtgatuagggcagatgatacua

SEQ ID NO: 63242 - DNA, 21 bp, Artificial Sequence
  Synthetic
aatgctgccuttgaaccucct

SEQ ID NO: 63243 - DNA, 23 bp, Artificial Sequence
  Synthetic
gtttctgagcgaugttggtgtuc

SEQ ID NO: 63244 - DNA, 22 bp, Artificial Sequence
  Synthetic
gcttgccaacutcagaggtuct

SEQ ID NO: 63245 - DNA, 26 bp, Artificial Sequence
  Synthetic
cagagaaactguaaggcaagcatcua

SEQ ID NO: 63246 - DNA, 28 bp, Artificial Sequence
  Synthetic
cactttttgtauagaacttgcacaguga

SEQ ID NO: 63247 - DNA, 28 bp, Artificial Sequence
  Synthetic
caacaaatcagcaagucatgcagtuaat

SEQ ID NO: 63248 - DNA, 28 bp, Artificial Sequence
  Synthetic
gcatctgcttcucctaaggaaaaauact

SEQ ID NO: 63249 - DNA, 26 bp, Artificial Sequence
  Synthetic
cagtgatagctutttctgctgcauat

SEQ ID NO: 63250 - DNA, 20 bp, Artificial Sequence
  Synthetic
gggccacgguattcgctuat

SEQ ID NO: 63251 - DNA, 28 bp, Artificial Sequence
  Synthetic
tgcatctttctuttagttgcagauaggt

SEQ ID NO: 63252 - DNA, 23 bp, Artificial Sequence
  Synthetic
ttgaaauccaatagugcccaggt

SEQ ID NO: 63253 - DNA, 24 bp, Artificial Sequence
  Synthetic
ctagtuttgtctcctucccacagt

SEQ ID NO: 63254 - DNA, 18 bp, Artificial Sequence
  Synthetic
ccccacucacccgtgaug

SEQ ID NO: 63255 - DNA, 20 bp, Artificial Sequence
  Synthetic
gactcctucaccgtgcagua

SEQ ID NO: 63256 - DNA, 22 bp, Artificial Sequence
  Synthetic
ggaccaggaaguggtcaaacug

SEQ ID NO: 63257 - DNA, 19 bp, Artificial Sequence
  Synthetic
cccacacgugtctguccaa

SEQ ID NO: 63258 - DNA, 21 bp, Artificial Sequence
  Synthetic
cccuagggagagaggaatugg

SEQ ID NO: 63259 - DNA, 22 bp, Artificial Sequence
  Synthetic
cacctctgaccutgcttcacut

SEQ ID NO: 63260 - DNA, 21 bp, Artificial Sequence
  Synthetic
cacgggcuaccagaaaggtut

SEQ ID NO: 63261 - DNA, 19 bp, Artificial Sequence
  Synthetic
cctgtcugaaccccgcauc

SEQ ID NO: 63262 - DNA, 22 bp, Artificial Sequence
  Synthetic
tggcgagaagaacauggactug

SEQ ID NO: 63263 - DNA, 28 bp, Artificial Sequence
  Synthetic
guggagttaagaagauaggacagaacag

SEQ ID NO: 63264 - DNA, 28 bp, Artificial Sequence
  Synthetic
gctatcattacucaagattcccaucaca

SEQ ID NO: 63265 - DNA, 26 bp, Artificial Sequence
  Synthetic
ccctagtucctgaactcaucaaagaa

SEQ ID NO: 63266 - DNA, 27 bp, Artificial Sequence
  Synthetic
actctgaaaagcuaaactggtcaacut

SEQ ID NO: 63267 - DNA, 28 bp, Artificial Sequence
  Synthetic
tcatgtaaattguccctttccttgacut

SEQ ID NO: 63268 - DNA, 22 bp, Artificial Sequence
  Synthetic
ctggcaatucgagcactttuca

SEQ ID NO: 63269 - DNA, 29 bp, Artificial Sequence
  Synthetic
agttgctgtttaaucatgttgctgttuat

SEQ ID NO: 63270 - DNA, 25 bp, Artificial Sequence
  Synthetic
acatggcaccauagtcaaagttcut

SEQ ID NO: 63271 - DNA, 21 bp, Artificial Sequence
  Synthetic
gacaucaacctccauggcaac

SEQ ID NO: 63272 - DNA, 25 bp, Artificial Sequence
  Synthetic
caaaccaaagccutaccaataugcc

SEQ ID NO: 63273 - DNA, 27 bp, Artificial Sequence
  Synthetic
tgcactgttaguatatccaatgccaut

SEQ ID NO: 63274 - DNA, 23 bp, Artificial Sequence
  Synthetic
ctaaucagcacagtggucagaga

SEQ ID NO: 63275 - DNA, 24 bp, Artificial Sequence
  Synthetic
gtgugattttgagttugggagacc

SEQ ID NO: 63276 - DNA, 21 bp, Artificial Sequence
  Synthetic
cttttgaugtgggcucccact

SEQ ID NO: 63277 - DNA, 25 bp, Artificial Sequence
  Synthetic
gccctgtaaugtttatgcgatcuac

SEQ ID NO: 63278 - DNA, 23 bp, Artificial Sequence
  Synthetic
cgaaagaacuaccgtggaguaca

SEQ ID NO: 63279 - DNA, 28 bp, Artificial Sequence
  Synthetic
ggaataattguggaaagcagtttctuca

SEQ ID NO: 63280 - DNA, 23 bp, Artificial Sequence
  Synthetic
cctggttggcauttgcaaacaua

SEQ ID NO: 63281 - DNA, 28 bp, Artificial Sequence
  Synthetic
ccaagatgaaaagugatagtgctcaugt

SEQ ID NO: 63282 - DNA, 22 bp, Artificial Sequence
  Synthetic
cctgagtcuggacgctuaagac

SEQ ID NO: 63283 - DNA, 26 bp, Artificial Sequence
  Synthetic
aaagcccacagagaaautauccaact

SEQ ID NO: 63284 - DNA, 22 bp, Artificial Sequence
  Synthetic
agaccgcggcaaaguaactuaa

SEQ ID NO: 63285 - DNA, 20 bp, Artificial Sequence
  Synthetic
caagggcucagacgacucag

SEQ ID NO: 63286 - DNA, 26 bp, Artificial Sequence
  Synthetic
cctgattttgtuaagttgctgctgut

SEQ ID NO: 63287 - DNA, 23 bp, Artificial Sequence
  Synthetic
ttgaggauaaccgtgttguccag

SEQ ID NO: 63288 - DNA, 22 bp, Artificial Sequence
  Synthetic
tgggcttgcutttctgcagtua

SEQ ID NO: 63289 - DNA, 28 bp, Artificial Sequence
  Synthetic
tttaaggatgtgcugtcacacagaauat

SEQ ID NO: 63290 - DNA, 26 bp, Artificial Sequence
  Synthetic
agtttgcagugaaacacctagtcaut

SEQ ID NO: 63291 - DNA, 28 bp, Artificial Sequence
  Synthetic
cctctcagcagagaaugtaactttaugt

SEQ ID NO: 63292 - DNA, 21 bp, Artificial Sequence
  Synthetic
ggtgauccagcagaccaugag

SEQ ID NO: 63293 - DNA, 28 bp, Artificial Sequence
  Synthetic
ttgctcttcuctgaactcaaugaaaaga

SEQ ID NO: 63294 - DNA, 22 bp, Artificial Sequence
  Synthetic
tgcagagacutgcttucaccaa

SEQ ID NO: 63295 - DNA, 27 bp, Artificial Sequence
  Synthetic
gtggtgcugagaaagataaattgtugt

SEQ ID NO: 63296 - DNA, 27 bp, Artificial Sequence
  Synthetic
caaaaggaaccgutcatatatguggaa

SEQ ID NO: 63297 - DNA, 28 bp, Artificial Sequence
  Synthetic
ccaaaatuagccaagtagaaaugaccca

SEQ ID NO: 63298 - DNA, 28 bp, Artificial Sequence
  Synthetic
ttcattcatguaggctttctctttguga

SEQ ID NO: 63299 - DNA, 28 bp, Artificial Sequence
  Synthetic
cctcagcuaacacagtataauacgagac

SEQ ID NO: 63300 - DNA, 26 bp, Artificial Sequence
  Synthetic
gtattttccccautcttgccttguag

SEQ ID NO: 63301 - DNA, 28 bp, Artificial Sequence
  Synthetic
ggagtaagtagugacctctgacatucat

SEQ ID NO: 63302 - DNA, 20 bp, Artificial Sequence
  Synthetic
gcttcuggccaaggtccaut

SEQ ID NO: 63303 - DNA, 29 bp, Artificial Sequence
  Synthetic
gcttatagtgaggauttgccaattttgug

SEQ ID NO: 63304 - DNA, 27 bp, Artificial Sequence
  Synthetic
tgtcttggaugacatttuggagaaact

SEQ ID NO: 63305 - DNA, 28 bp, Artificial Sequence
  Synthetic
tgctgaagtctacuatagcctcacttua

SEQ ID NO: 63306 - DNA, 28 bp, Artificial Sequence
  Synthetic
agagcagtaugtaagctgtttugaagaa

SEQ ID NO: 63307 - DNA, 27 bp, Artificial Sequence
  Synthetic
cgattaggutcatcgtattucaaccac

SEQ ID NO: 63308 - DNA, 25 bp, Artificial Sequence
  Synthetic
ggaagtaaacacaaucctccctcug

SEQ ID NO: 63309 - DNA, 26 bp, Artificial Sequence
  Synthetic
caagtaacacaautcctggtctugag

SEQ ID NO: 63310 - DNA, 21 bp, Artificial Sequence
  Synthetic
ccctgatgugggaggtcucaa

SEQ ID NO: 63311 - DNA, 22 bp, Artificial Sequence
  Synthetic
cccacagtcuagaagggtcuca

SEQ ID NO: 63312 - DNA, 21 bp, Artificial Sequence
  Synthetic
gaguagttggtgucccaggag

SEQ ID NO: 63313 - DNA, 25 bp, Artificial Sequence
  Synthetic
tatgggcagauggttatggtgtuag

SEQ ID NO: 63314 - DNA, 19 bp, Artificial Sequence
  Synthetic
cattggcccuggtggagut

SEQ ID NO: 63315 - DNA, 22 bp, Artificial Sequence
  Synthetic
ccctaaccagcuctgagaucgt

SEQ ID NO: 63316 - DNA, 20 bp, Artificial Sequence
  Synthetic
gcattccugagccgtcaugt

SEQ ID NO: 63317 - DNA, 24 bp, Artificial Sequence
  Synthetic
ggaatgucccagacaagatctuca

SEQ ID NO: 63318 - DNA, 21 bp, Artificial Sequence
  Synthetic
gggagcutccagtugaaacat

SEQ ID NO: 63319 - DNA, 28 bp, Artificial Sequence
  Synthetic
aaataagaacatucttcagacacugcct

SEQ ID NO: 63320 - DNA, 24 bp, Artificial Sequence
  Synthetic
ctgagguttacttcuagcaggcaa

SEQ ID NO: 63321 - DNA, 25 bp, Artificial Sequence
  Synthetic
tttccatcucacagaccttgctuag

SEQ ID NO: 63322 - DNA, 26 bp, Artificial Sequence
  Synthetic
cagtatcaatttugtgcacagaggut

SEQ ID NO: 63323 - DNA, 29 bp, Artificial Sequence
  Synthetic
acatcttcaggttutctgtctaattccut

SEQ ID NO: 63324 - DNA, 26 bp, Artificial Sequence
  Synthetic
catgtctccuctgatttctccuacct

SEQ ID NO: 63325 - DNA, 22 bp, Artificial Sequence
  Synthetic
cgcatcaacuctgtctgtguca

SEQ ID NO: 63326 - DNA, 21 bp, Artificial Sequence
  Synthetic
tcagacuggcgaggtgaacua

SEQ ID NO: 63327 - DNA, 28 bp, Artificial Sequence
  Synthetic
tgttcttguattctctgtuccaaacagt

SEQ ID NO: 63328 - DNA, 26 bp, Artificial Sequence
  Synthetic
catactgttcacagguatgacaggut

SEQ ID NO: 63329 - DNA, 22 bp, Artificial Sequence
  Synthetic
tggcuacagcagtctacuacca

SEQ ID NO: 63330 - DNA, 23 bp, Artificial Sequence
  Synthetic
gcctttaggcacugtgtttctut

SEQ ID NO: 63331 - DNA, 23 bp, Artificial Sequence
  Synthetic
cctgtgtgcuacaagtagtcugg

SEQ ID NO: 63332 - DNA, 28 bp, Artificial Sequence
  Synthetic
ggaggttgagauttgcatactcugaaaa

SEQ ID NO: 63333 - DNA, 28 bp, Artificial Sequence
  Synthetic
tgggaatcacugaatctaaugaaaacga

SEQ ID NO: 63334 - DNA, 23 bp, Artificial Sequence
  Synthetic
gggaaaaggugcctttgtuagac

SEQ ID NO: 63335 - DNA, 28 bp, Artificial Sequence
  Synthetic
agggtgcaataagugtccttgaaaauat

SEQ ID NO: 63336 - DNA, 21 bp, Artificial Sequence
  Synthetic
ggtgaccaugatgtcucggaa

SEQ ID NO: 63337 - DNA, 28 bp, Artificial Sequence
  Synthetic
gggcttgttagaucaagatgtaaacuct

SEQ ID NO: 63338 - DNA, 25 bp, Artificial Sequence
  Synthetic
tttcagacgauaattgctacugcca

SEQ ID NO: 63339 - DNA, 27 bp, Artificial Sequence
  Synthetic
aaggagtatcagugaaatgaagctugt

SEQ ID NO: 63340 - DNA, 21 bp, Artificial Sequence
  Synthetic
gcagtctgucctgaaccugat

SEQ ID NO: 63341 - DNA, 23 bp, Artificial Sequence
  Synthetic
gtgaaauacccccaagcgatgua

SEQ ID NO: 63342 - DNA, 21 bp, Artificial Sequence
  Synthetic
gatgtgggcaugggaggaaua

SEQ ID NO: 63343 - DNA, 29 bp, Artificial Sequence
  Synthetic
aaacacaatcuacacaataggacauggaa

SEQ ID NO: 63344 - DNA, 26 bp, Artificial Sequence
  Synthetic
ccaagagaugaggatttcatgtcugt

SEQ ID NO: 63345 - DNA, 28 bp, Artificial Sequence
  Synthetic
ggaactctuggagaaaccagaaaguaaa

SEQ ID NO: 63346 - DNA, 19 bp, Artificial Sequence
  Synthetic
gaggccuggguaaagcaga

SEQ ID NO: 63347 - DNA, 22 bp, Artificial Sequence
  Synthetic
gggcccugatactgatttuggt

SEQ ID NO: 63348 - DNA, 21 bp, Artificial Sequence
  Synthetic
cactaccucccaccacatucc

SEQ ID NO: 63349 - DNA, 20 bp, Artificial Sequence
  Synthetic
tcaactuccgcaccaccuac

SEQ ID NO: 63350 - DNA, 21 bp, Artificial Sequence
  Synthetic
gaagacgaggcauagaugcga

SEQ ID NO: 63351 - DNA, 22 bp, Artificial Sequence
  Synthetic
ctgaccgtccutggtgtttcut

SEQ ID NO: 63352 - DNA, 22 bp, Artificial Sequence
  Synthetic
gagggcaaacaugagaguacca

SEQ ID NO: 63353 - DNA, 19 bp, Artificial Sequence
  Synthetic
gccaauggccgttctguct

SEQ ID NO: 63354 - DNA, 28 bp, Artificial Sequence
  Synthetic
cagtggaaacttcuacgtgactttgaua

SEQ ID NO: 63355 - DNA, 33 bp, Artificial Sequence
  Synthetic
aaatctaacattcagauagaaagtacattcugt

SEQ ID NO: 63356 - DNA, 29 bp, Artificial Sequence
  Synthetic
tgtttttacagagguaaataccggatugt

SEQ ID NO: 63357 - DNA, 26 bp, Artificial Sequence
  Synthetic
ccagtgtccauccataggtttaacut

SEQ ID NO: 63358 - DNA, 26 bp, Artificial Sequence
  Synthetic
gtccaacaatcauctactgtcctuct

SEQ ID NO: 63359 - DNA, 24 bp, Artificial Sequence
  Synthetic
cggagagcaaugatgattgaucct

SEQ ID NO: 63360 - DNA, 25 bp, Artificial Sequence
  Synthetic
gatgtttttaaucgacaggcaccut

SEQ ID NO: 63361 - DNA, 28 bp, Artificial Sequence
  Synthetic
gccaaattgttgucttaaaagagcauca

SEQ ID NO: 63362 - DNA, 30 bp, Artificial Sequence
  Synthetic
cattctaaggaaaaaugtggtatcugaagc

SEQ ID NO: 63363 - DNA, 25 bp, Artificial Sequence
  Synthetic
accagtaucttgtttgtugccagaa

SEQ ID NO: 63364 - DNA, 24 bp, Artificial Sequence
  Synthetic
cacatcccagutctgcagtuagag

SEQ ID NO: 63365 - DNA, 25 bp, Artificial Sequence
  Synthetic
ccctaccuagaccctcctaacttut

SEQ ID NO: 63366 - DNA, 25 bp, Artificial Sequence
  Synthetic
cagcagtgtgucatatccatacuca

SEQ ID NO: 63367 - DNA, 21 bp, Artificial Sequence
  Synthetic
ggttcggaautcccttuccca

SEQ ID NO: 63368 - DNA, 25 bp, Artificial Sequence
  Synthetic
tgtgaaacagcaauttgacuggaac

SEQ ID NO: 63369 - DNA, 27 bp, Artificial Sequence
  Synthetic
aagggcattcuacattgtacacttuct

SEQ ID NO: 63370 - DNA, 21 bp, Artificial Sequence
  Synthetic
acacctgtgutgctcatguca

SEQ ID NO: 63371 - DNA, 28 bp, Artificial Sequence
  Synthetic
gaagtctgaagatuatctcagcagcaut

SEQ ID NO: 63372 - DNA, 25 bp, Artificial Sequence
  Synthetic
tcagtcaggaauggtttgatcaugg

SEQ ID NO: 63373 - DNA, 28 bp, Artificial Sequence
  Synthetic
cataagctuagcaagtgtucaaagaaga

SEQ ID NO: 63374 - DNA, 25 bp, Artificial Sequence
  Synthetic
ctacttcauaaactaggccugcagt

SEQ ID NO: 63375 - DNA, 28 bp, Artificial Sequence
  Synthetic
tgccttgaagugagtaggaattuaacaa

SEQ ID NO: 63376 - DNA, 24 bp, Artificial Sequence
  Synthetic
actcagatauggacctgccagtua

SEQ ID NO: 63377 - DNA, 25 bp, Artificial Sequence
  Synthetic
tcagcaaacctuagaaactgtgcut

SEQ ID NO: 63378 - DNA, 23 bp, Artificial Sequence
  Synthetic
cacagtcaucctgttccugaact

SEQ ID NO: 63379 - DNA, 28 bp, Artificial Sequence
  Synthetic
gctcttttcugagacatctgtctguaac

SEQ ID NO: 63380 - DNA, 26 bp, Artificial Sequence
  Synthetic
ttctggactugaagactgtcuagaat

SEQ ID NO: 63381 - DNA, 27 bp, Artificial Sequence
  Synthetic
tcgtagcagugatcatgguaaaagaag

SEQ ID NO: 63382 - DNA, 20 bp, Artificial Sequence
  Synthetic
gcctugctcatcuagcccaa

SEQ ID NO: 63383 - DNA, 20 bp, Artificial Sequence
  Synthetic
cctcacugggcctgaaugac

SEQ ID NO: 63384 - DNA, 25 bp, Artificial Sequence
  Synthetic
gcccacatatutgacttagccauca

SEQ ID NO: 63385 - DNA, 21 bp, Artificial Sequence
  Synthetic
ctttacgtctugcagcagcuc

SEQ ID NO: 63386 - DNA, 21 bp, Artificial Sequence
  Synthetic
cguatgcttcaaugcacccat

SEQ ID NO: 63387 - DNA, 26 bp, Artificial Sequence
  Synthetic
taaagcacccucagtgatttctaucc

SEQ ID NO: 63388 - DNA, 29 bp, Artificial Sequence
  Synthetic
gttatttccattcutctccatgattugct

SEQ ID NO: 63389 - DNA, 24 bp, Artificial Sequence
  Synthetic
tcacacauaagtggaggugcaaaa

SEQ ID NO: 63390 - DNA, 24 bp, Artificial Sequence
  Synthetic
tttgttttgucttccaguggacct

SEQ ID NO: 63391 - DNA, 28 bp, Artificial Sequence
  Synthetic
ttggcctgauagcttttaatgtcctuaa

SEQ ID NO: 63392 - DNA, 23 bp, Artificial Sequence
  Synthetic
gtattgtaggucatgtgggcuga

SEQ ID NO: 63393 - DNA, 21 bp, Artificial Sequence
  Synthetic
ctgccagucctaagtcugcaa

SEQ ID NO: 63394 - DNA, 20 bp, Artificial Sequence
  Synthetic
gtcagucgtccagugccaat

SEQ ID NO: 63395 - DNA, 26 bp, Artificial Sequence
  Synthetic
ctctaacggccutcttttcatttucc

SEQ ID NO: 63396 - DNA, 22 bp, Artificial Sequence
  Synthetic
gaggaaccagaugtccatguca

SEQ ID NO: 63397 - DNA, 21 bp, Artificial Sequence
  Synthetic
ctcccaaggacacutguagcc

SEQ ID NO: 63398 - DNA, 25 bp, Artificial Sequence
  Synthetic
tagatctaaaagagagcucctccug

SEQ ID NO: 63399 - DNA, 28 bp, Artificial Sequence
  Synthetic
ttgccactgcugatgtactttatuaact

SEQ ID NO: 63400 - DNA, 21 bp, Artificial Sequence
  Synthetic
cccatgcagcaugactcatuc

SEQ ID NO: 63401 - DNA, 21 bp, Artificial Sequence
  Synthetic
ggcuggagaaccaacttgcua

SEQ ID NO: 63402 - DNA, 19 bp, Artificial Sequence
  Synthetic
agcaacucaugcagagcgt

SEQ ID NO: 63403 - DNA, 21 bp, Artificial Sequence
  Synthetic
gaagtcaucccacccgctaug

SEQ ID NO: 63404 - DNA, 22 bp, Artificial Sequence
  Synthetic
cctaccacugctaccagucagt

SEQ ID NO: 63405 - DNA, 20 bp, Artificial Sequence
  Synthetic
acagguaaacccgtgcugag

SEQ ID NO: 63406 - DNA, 21 bp, Artificial Sequence
  Synthetic
tgcccccutctagagccuaaa

SEQ ID NO: 63407 - DNA, 20 bp, Artificial Sequence
  Synthetic
cgacuggagaaagcaagcug

SEQ ID NO: 63408 - DNA, 28 bp, Artificial Sequence
  Synthetic
ccacacagaatucagtaaaacccaacua

SEQ ID NO: 63409 - DNA, 23 bp, Artificial Sequence
  Synthetic
ctgagtguacaaagacugcacga

SEQ ID NO: 63410 - DNA, 26 bp, Artificial Sequence
  Synthetic
ccctgccttgucatatattagctgut

SEQ ID NO: 63411 - DNA, 22 bp, Artificial Sequence
  Synthetic
gattcccuggaagtggtcctug

SEQ ID NO: 63412 - DNA, 28 bp, Artificial Sequence
  Synthetic
aaatatgctctguacctgtggaugaaat

SEQ ID NO: 63413 - DNA, 26 bp, Artificial Sequence
  Synthetic
cacaacagttuatgctgaagaugcag

SEQ ID NO: 63414 - DNA, 29 bp, Artificial Sequence
  Synthetic
gttatcagauacaaaccaacaaggaugga

SEQ ID NO: 63415 - DNA, 27 bp, Artificial Sequence
  Synthetic
gcggctgaaugaaactctcttaattut

SEQ ID NO: 63416 - DNA, 22 bp, Artificial Sequence
  Synthetic
gagtgcccugatgaagaaguga

SEQ ID NO: 63417 - DNA, 28 bp, Artificial Sequence
  Synthetic
ggaagaggcucaactatgaagauaagac

SEQ ID NO: 63418 - DNA, 19 bp, Artificial Sequence
  Synthetic
tctgcucaacgagcuggac

SEQ ID NO: 63419 - DNA, 20 bp, Artificial Sequence
  Synthetic
gcgtugaagcggtacgugat

SEQ ID NO: 63420 - DNA, 20 bp, Artificial Sequence
  Synthetic
tgcgcagcuactccctttuc

SEQ ID NO: 63421 - DNA, 21 bp, Artificial Sequence
  Synthetic
ttagcctguaggactccugct

SEQ ID NO: 63422 - DNA, 20 bp, Artificial Sequence
  Synthetic
tcaccatgauggccacugac

SEQ ID NO: 63423 - DNA, 24 bp, Artificial Sequence
  Synthetic
agtagctctggutgagacatccut

SEQ ID NO: 63424 - DNA, 19 bp, Artificial Sequence
  Synthetic
caccccuacccctggcuat

SEQ ID NO: 63425 - DNA, 18 bp, Artificial Sequence
  Synthetic
ctgggagacugcagcuct

SEQ ID NO: 63426 - DNA, 19 bp, Artificial Sequence
  Synthetic
caccaguggagcucaaggg

SEQ ID NO: 63427 - DNA, 20 bp, Artificial Sequence
  Synthetic
ccaugatcacgucgcgaagt

SEQ ID NO: 63428 - DNA, 22 bp, Artificial Sequence
  Synthetic
ttccucaggaccaccttcctua

SEQ ID NO: 63429 - DNA, 22 bp, Artificial Sequence
  Synthetic
cagggtgaggcucaagttguag

SEQ ID NO: 63430 - DNA, 23 bp, Artificial Sequence
  Synthetic
tgcccatauctcaggttcucaga

SEQ ID NO: 63431 - DNA, 23 bp, Artificial Sequence
  Synthetic
gttcuggctcttaaucacagcct

SEQ ID NO: 63432 - DNA, 17 bp, Artificial Sequence
  Synthetic
gcugcccacacugccat

SEQ ID NO: 63433 - DNA, 20 bp, Artificial Sequence
  Synthetic
ccctucacactcugcaccaa

SEQ ID NO: 63434 - DNA, 24 bp, Artificial Sequence
  Synthetic
tcaaatctgggccaucaagaagut

SEQ ID NO: 63435 - DNA, 23 bp, Artificial Sequence
  Synthetic
gtagggagugggactgtaatugg

SEQ ID NO: 63436 - DNA, 21 bp, Artificial Sequence
  Synthetic
gtgctgcauagcctccttcua

SEQ ID NO: 63437 - DNA, 25 bp, Artificial Sequence
  Synthetic
acatcattgtguttctcctctgucc

SEQ ID NO: 63438 - DNA, 19 bp, Artificial Sequence
  Synthetic
gggaggagaagugaugcgt

SEQ ID NO: 63439 - DNA, 17 bp, Artificial Sequence
  Synthetic
ccggcaccgcugaucat

SEQ ID NO: 63440 - DNA, 25 bp, Artificial Sequence
  Synthetic
gaaagaaaacaucaagcgtcccaua

SEQ ID NO: 63441 - DNA, 22 bp, Artificial Sequence
  Synthetic
gatctgtccacucctgatgcug

SEQ ID NO: 63442 - DNA, 22 bp, Artificial Sequence
  Synthetic
tgaaagagggccauguggaaag

SEQ ID NO: 63443 - DNA, 22 bp, Artificial Sequence
  Synthetic
cctgaaucccgagcacacatut

SEQ ID NO: 63444 - DNA, 19 bp, Artificial Sequence
  Synthetic
cccagggugatctcuccac

SEQ ID NO: 63445 - DNA, 18 bp, Artificial Sequence
  Synthetic
aggcatucccggcatcuc

SEQ ID NO: 63446 - DNA, 21 bp, Artificial Sequence
  Synthetic
cagggccaaagaguccaucag

SEQ ID NO: 63447 - DNA, 24 bp, Artificial Sequence
  Synthetic
tgagccttttucccttctttgugt

SEQ ID NO: 63448 - DNA, 20 bp, Artificial Sequence
  Synthetic
tcttttgccggguctgcaut

SEQ ID NO: 63449 - DNA, 29 bp, Artificial Sequence
  Synthetic
ccttgtgactugagatgtggtgattauat

SEQ ID NO: 63450 - DNA, 23 bp, Artificial Sequence
  Synthetic
cctggcccaugttcctgaaatua

SEQ ID NO: 63451 - DNA, 27 bp, Artificial Sequence
  Synthetic
ataaacttctggagguatttggaggug

SEQ ID NO: 63452 - DNA, 24 bp, Artificial Sequence
  Synthetic
cctgcaacacaggutatctuacga

SEQ ID NO: 63453 - DNA, 22 bp, Artificial Sequence
  Synthetic
atgggcaauagctuccagaagg

SEQ ID NO: 63454 - DNA, 21 bp, Artificial Sequence
  Synthetic
ccttcugccagatcacagugg

SEQ ID NO: 63455 - DNA, 23 bp, Artificial Sequence
  Synthetic
ctctcccguttctctgaacuaca

SEQ ID NO: 63456 - DNA, 21 bp, Artificial Sequence
  Synthetic
tgtggaaauagcagcagcuga

SEQ ID NO: 63457 - DNA, 23 bp, Artificial Sequence
  Synthetic
ggaaggtccauggtatggttuct

SEQ ID NO: 63458 - DNA, 21 bp, Artificial Sequence
  Synthetic
ctggctaauacacgaggccut

SEQ ID NO: 63459 - DNA, 21 bp, Artificial Sequence
  Synthetic
actgtgtcuggctgccttauc

SEQ ID NO: 63460 - DNA, 21 bp, Artificial Sequence
  Synthetic
gacaggtugatgaggguccag

SEQ ID NO: 63461 - DNA, 22 bp, Artificial Sequence
  Synthetic
ctcgctaaguaaggtggctuca

SEQ ID NO: 63462 - DNA, 22 bp, Artificial Sequence
  Synthetic
ggtgagaggugactgctgttug

SEQ ID NO: 63463 - DNA, 19 bp, Artificial Sequence
  Synthetic
cttaccauggcgacaucgg

SEQ ID NO: 63464 - DNA, 19 bp, Artificial Sequence
  Synthetic
cccccuggaggctcttcut

SEQ ID NO: 63465 - DNA, 19 bp, Artificial Sequence
  Synthetic
cacucagcccaaacgugga

SEQ ID NO: 63466 - DNA, 21 bp, Artificial Sequence
  Synthetic
cctacacgcuggaggagttut

SEQ ID NO: 63467 - DNA, 22 bp, Artificial Sequence
  Synthetic
tcauccuggcagacagaaacag

SEQ ID NO: 63468 - DNA, 28 bp, Artificial Sequence
  Synthetic
tttaatgaacaggauttgctaguccact

SEQ ID NO: 63469 - DNA, 28 bp, Artificial Sequence
  Synthetic
ccctctatttaaauccaatgagcacgut

SEQ ID NO: 63470 - DNA, 29 bp, Artificial Sequence
  Synthetic
atgggaauagagcaaaatatgtgugaagt

SEQ ID NO: 63471 - DNA, 26 bp, Artificial Sequence
  Synthetic
catctggcaucaaataaguggagaga

SEQ ID NO: 63472 - DNA, 20 bp, Artificial Sequence
  Synthetic
ccagacagccgugactuact

SEQ ID NO: 63473 - DNA, 33 bp, Artificial Sequence
  Synthetic
aacataaaacacucaaatccttctaacaauact

SEQ ID NO: 63474 - DNA, 28 bp, Artificial Sequence
  Synthetic
cccagccuaaaacttacauacacagaat

SEQ ID NO: 63475 - DNA, 28 bp, Artificial Sequence
  Synthetic
ctaagtaactatcutaagggttgcucca

SEQ ID NO: 63476 - DNA, 20 bp, Artificial Sequence
  Synthetic
caacauggccggttaugcac

SEQ ID NO: 63477 - DNA, 27 bp, Artificial Sequence
  Synthetic
ttctgctgacugctcatttaucaagat

SEQ ID NO: 63478 - DNA, 19 bp, Artificial Sequence
  Synthetic
gccctgcucggatctcauc

SEQ ID NO: 63479 - DNA, 22 bp, Artificial Sequence
  Synthetic
gggacatgaucttggtcuccac

SEQ ID NO: 63480 - DNA, 26 bp, Artificial Sequence
  Synthetic
ggagtgcuggagttatttagaauggt

SEQ ID NO: 63481 - DNA, 22 bp, Artificial Sequence
  Synthetic
gcuggtacuagagagagcagga

SEQ ID NO: 63482 - DNA, 23 bp, Artificial Sequence
  Synthetic
ggaaggtuggcagtttctgaugt

SEQ ID NO: 63483 - DNA, 22 bp, Artificial Sequence
  Synthetic
atttgtucccacacttggguca

SEQ ID NO: 63484 - DNA, 21 bp, Artificial Sequence
  Synthetic
tttggttcutcatggcuccca

SEQ ID NO: 63485 - DNA, 20 bp, Artificial Sequence
  Synthetic
gtcccugcagtucacaaagg

SEQ ID NO: 63486 - DNA, 18 bp, Artificial Sequence
  Synthetic
cctucggcaggagggaut

SEQ ID NO: 63487 - DNA, 19 bp, Artificial Sequence
  Synthetic
cuccaccucagaccaccac

SEQ ID NO: 63488 - DNA, 24 bp, Artificial Sequence
  Synthetic
ccaggaacacaggaguagcauaag

SEQ ID NO: 63489 - DNA, 28 bp, Artificial Sequence
  Synthetic
cagccaatattucactgggctaatcaua

SEQ ID NO: 63490 - DNA, 25 bp, Artificial Sequence
  Synthetic
agaagctcccuattcatttgcucaa

SEQ ID NO: 63491 - DNA, 27 bp, Artificial Sequence
  Synthetic
tcttcaccacaaccutctcaauaagat

SEQ ID NO: 63492 - DNA, 23 bp, Artificial Sequence
  Synthetic
cagagtcatcucccccatggaua

SEQ ID NO: 63493 - DNA, 28 bp, Artificial Sequence
  Synthetic
gtagtggctgauttaagaagatgaucct

SEQ ID NO: 63494 - DNA, 21 bp, Artificial Sequence
  Synthetic
gccaacaggaccautctcugt

SEQ ID NO: 63495 - DNA, 27 bp, Artificial Sequence
  Synthetic
tcaaccatttgugaatttgctgucaaa

SEQ ID NO: 63496 - DNA, 24 bp, Artificial Sequence
  Synthetic
attagctaccuaccctgacucgaa

SEQ ID NO: 63497 - DNA, 25 bp, Artificial Sequence
  Synthetic
gtctttttctttucagccctgtucc

SEQ ID NO: 63498 - DNA, 21 bp, Artificial Sequence
  Synthetic
catcacggcuggcauaaagag

SEQ ID NO: 63499 - DNA, 25 bp, Artificial Sequence
  Synthetic
tccgcagaacgaugtctttcaauat

SEQ ID NO: 63500 - DNA, 30 bp, Artificial Sequence
  Synthetic
cacactttgtctutgacttctttttctuct

SEQ ID NO: 63501 - DNA, 26 bp, Artificial Sequence
  Synthetic
cctgtacacaugaagccatcgtauat

SEQ ID NO: 63502 - DNA, 23 bp, Artificial Sequence
  Synthetic
gccggtttaucacctactcctua

SEQ ID NO: 63503 - DNA, 24 bp, Artificial Sequence
  Synthetic
gugacccaagtgugaaaaagacag

SEQ ID NO: 63504 - DNA, 33 bp, Artificial Sequence
  Synthetic
acttgatttatatttugtcagtctataacuggt

SEQ ID NO: 63505 - DNA, 28 bp, Artificial Sequence
  Synthetic
gggataacauctctaatgcaucaggaaa

SEQ ID NO: 63506 - DNA, 21 bp, Artificial Sequence
  Synthetic
cggagcguaaaaatgugccaa

SEQ ID NO: 63507 - DNA, 28 bp, Artificial Sequence
  Synthetic
gcugagctttgaaaauaaggaacgaaaa

SEQ ID NO: 63508 - DNA, 30 bp, Artificial Sequence
  Synthetic
agtcaactaaaaauacatgagccaaacuga

SEQ ID NO: 63509 - DNA, 28 bp, Artificial Sequence
  Synthetic
ctcttactcaacagaugttcgtctcaut

SEQ ID NO: 63510 - DNA, 21 bp, Artificial Sequence
  Synthetic
ccuaaaagaggcccugagcaa

SEQ ID NO: 63511 - DNA, 23 bp, Artificial Sequence
  Synthetic
ctctttccucacgacctctcuct

SEQ ID NO: 63512 - DNA, 21 bp, Artificial Sequence
  Synthetic
gcccutcctugagggaacaat

SEQ ID NO: 63513 - DNA, 21 bp, Artificial Sequence
  Synthetic
aagagcuccagggtttuagcc

SEQ ID NO: 63514 - DNA, 22 bp, Artificial Sequence
  Synthetic
cucagccacagagaucaacact

SEQ ID NO: 63515 - DNA, 19 bp, Artificial Sequence
  Synthetic
cccaaaccauccgccucat

SEQ ID NO: 63516 - DNA, 21 bp, Artificial Sequence
  Synthetic
gctgcggucctagtggtcuat

SEQ ID NO: 63517 - DNA, 28 bp, Artificial Sequence
  Synthetic
ggattgacctgguatcctcattttacut

SEQ ID NO: 63518 - DNA, 30 bp, Artificial Sequence
  Synthetic
tgcaaaatttccugtctaatagatguacct

SEQ ID NO: 63519 - DNA, 28 bp, Artificial Sequence
  Synthetic
aaaaacacaacggaaccuacuaagaaga

SEQ ID NO: 63520 - DNA, 26 bp, Artificial Sequence
  Synthetic
agcacaataauggttttctguaccca

SEQ ID NO: 63521 - DNA, 25 bp, Artificial Sequence
  Synthetic
gtgtgctcucagattgacttuccat

SEQ ID NO: 63522 - DNA, 21 bp, Artificial Sequence
  Synthetic
gguggaagagagtugggacct

SEQ ID NO: 63523 - DNA, 28 bp, Artificial Sequence
  Synthetic
tgtccucaaagggttaaaatguacaaga

SEQ ID NO: 63524 - DNA, 28 bp, Artificial Sequence
  Synthetic
tgctatcatacguagacactacaccaua

SEQ ID NO: 63525 - DNA, 30 bp, Artificial Sequence
  Synthetic
gatgttggutataactgaaugaaagggaac

SEQ ID NO: 63526 - DNA, 27 bp, Artificial Sequence
  Synthetic
acctccatttutcacttgtactucaca

SEQ ID NO: 63527 - DNA, 26 bp, Artificial Sequence
  Synthetic
gtagagccucctgaagaattucaaga

SEQ ID NO: 63528 - DNA, 28 bp, Artificial Sequence
  Synthetic
actaaattagcautgtctctgaguccac

SEQ ID NO: 63529 - DNA, 23 bp, Artificial Sequence
  Synthetic
gggaacgucaatatcgcagucaa

SEQ ID NO: 63530 - DNA, 24 bp, Artificial Sequence
  Synthetic
agaagtctcctuatgacgcagcua

SEQ ID NO: 63531 - DNA, 21 bp, Artificial Sequence
  Synthetic
gcttaacguggcagagttgug

SEQ ID NO: 63532 - DNA, 21 bp, Artificial Sequence
  Synthetic
cagaacaggagugcacggaua

SEQ ID NO: 63533 - DNA, 28 bp, Artificial Sequence
  Synthetic
tgctactgcaaaagagutagcactaaut

SEQ ID NO: 63534 - DNA, 28 bp, Artificial Sequence
  Synthetic
agcataaagtaagucatcgaaagcauca

SEQ ID NO: 63535 - DNA, 29 bp, Artificial Sequence
  Synthetic
cgaaaagacttctugcagtgtaaacaaut

SEQ ID NO: 63536 - DNA, 21 bp, Artificial Sequence
  Synthetic
acatgggugaggaggaacuct

SEQ ID NO: 63537 - DNA, 22 bp, Artificial Sequence
  Synthetic
ccttccctautcccacagguct

SEQ ID NO: 63538 - DNA, 23 bp, Artificial Sequence
  Synthetic
gaagagagaagcaguaaccguca

SEQ ID NO: 63539 - DNA, 26 bp, Artificial Sequence
  Synthetic
ccgcgcgcaguctattatttatuaaa

SEQ ID NO: 63540 - DNA, 22 bp, Artificial Sequence
  Synthetic
cctggcaucccctuaaaggaat

SEQ ID NO: 63541 - DNA, 24 bp, Artificial Sequence
  Synthetic
gtgctgatcugtctctcgaatuct

SEQ ID NO: 63542 - DNA, 24 bp, Artificial Sequence
  Synthetic
acccuggaacagaatagaaaugcc

SEQ ID NO: 63543 - DNA, 24 bp, Artificial Sequence
  Synthetic
ttttgcctgacugatgttcctcut

SEQ ID NO: 63544 - DNA, 21 bp, Artificial Sequence
  Synthetic
cctccttcugtgaggacucca

SEQ ID NO: 63545 - DNA, 22 bp, Artificial Sequence
  Synthetic
accagggacagauctuggacat

SEQ ID NO: 63546 - DNA, 20 bp, Artificial Sequence
  Synthetic
gctcccgucagcttguagac

SEQ ID NO: 63547 - DNA, 20 bp, Artificial Sequence
  Synthetic
gcctccautgatgacuccga

SEQ ID NO: 63548 - DNA, 21 bp, Artificial Sequence
  Synthetic
cttgaggucaaaaggccuggt

SEQ ID NO: 63549 - DNA, 22 bp, Artificial Sequence
  Synthetic
cctcttgacucttgagcauggt

SEQ ID NO: 63550 - DNA, 24 bp, Artificial Sequence
  Synthetic
catttcttgcacaugatgctcuga

SEQ ID NO: 63551 - DNA, 29 bp, Artificial Sequence
  Synthetic
gttgcatgaaggauactggttttgttuaa

SEQ ID NO: 63552 - DNA, 23 bp, Artificial Sequence
  Synthetic
gtacaagcuttacagugcagcag

SEQ ID NO: 63553 - DNA, 28 bp, Artificial Sequence
  Synthetic
acaattggtcaugcacctgtatttctua

SEQ ID NO: 63554 - DNA, 28 bp, Artificial Sequence
  Synthetic
gcactactgtuaactctttctctuagca

SEQ ID NO: 63555 - DNA, 22 bp, Artificial Sequence
  Synthetic
ccttcaatguccctgccatgua

SEQ ID NO: 63556 - DNA, 22 bp, Artificial Sequence
  Synthetic
ccagaagtuccccatccagtuc

SEQ ID NO: 63557 - DNA, 24 bp, Artificial Sequence
  Synthetic
ctccctgcutcacactuaaagaca

SEQ ID NO: 63558 - DNA, 25 bp, Artificial Sequence
  Synthetic
aatttgagtaugtgactctgugcgt

SEQ ID NO: 63559 - DNA, 24 bp, Artificial Sequence
  Synthetic
ccccaccucacattctaaagtgut

SEQ ID NO: 63560 - DNA, 21 bp, Artificial Sequence
  Synthetic
tcacagcagcugcaactctut

SEQ ID NO: 63561 - DNA, 22 bp, Artificial Sequence
  Synthetic
cttacccttcugggtcttccug

SEQ ID NO: 63562 - DNA, 29 bp, Artificial Sequence
  Synthetic
agagaagaagcagautgagaatacugaga

SEQ ID NO: 63563 - DNA, 28 bp, Artificial Sequence
  Synthetic
tgtggagaagcutgtaatgaattgcuat

SEQ ID NO: 63564 - DNA, 23 bp, Artificial Sequence
  Synthetic
gagaauggctcuccagagcaaat

SEQ ID NO: 63565 - DNA, 20 bp, Artificial Sequence
  Synthetic
agatgugccagggacaacuc

SEQ ID NO: 63566 - DNA, 21 bp, Artificial Sequence
  Synthetic
cctcucaaccacctucccaat

SEQ ID NO: 63567 - DNA, 23 bp, Artificial Sequence
  Synthetic
cgtatatcctauggccctgacug

SEQ ID NO: 63568 - DNA, 22 bp, Artificial Sequence
  Synthetic
ttugcaaaaagcacagcugaaa

SEQ ID NO: 63569 - DNA, 23 bp, Artificial Sequence
  Synthetic
gtggcaucctaaccaattugcac

SEQ ID NO: 63570 - DNA, 24 bp, Artificial Sequence
  Synthetic
gggatgaaaagucaaaacugacca

SEQ ID NO: 63571 - DNA, 21 bp, Artificial Sequence
  Synthetic
cgcttcugcatcagcauccat

SEQ ID NO: 63572 - DNA, 22 bp, Artificial Sequence
  Synthetic
cccatagaggccutcctcauca

SEQ ID NO: 63573 - DNA, 20 bp, Artificial Sequence
  Synthetic
tgagccucacgttgtctguc

SEQ ID NO: 63574 - DNA, 19 bp, Artificial Sequence
  Synthetic
agauccggcgctgaauagg

SEQ ID NO: 63575 - DNA, 24 bp, Artificial Sequence
  Synthetic
aacactcctgutgggttttgauga

SEQ ID NO: 63576 - DNA, 19 bp, Artificial Sequence
  Synthetic
ggcatgaggcauccccaua

SEQ ID NO: 63577 - DNA, 20 bp, Artificial Sequence
  Synthetic
ctggccagguagagtctugg

SEQ ID NO: 63578 - DNA, 28 bp, Artificial Sequence
  Synthetic
tttttcagtgacauatcattagccccut

SEQ ID NO: 63579 - DNA, 24 bp, Artificial Sequence
  Synthetic
aacaatgaaggugcacaaacacut

SEQ ID NO: 63580 - DNA, 20 bp, Artificial Sequence
  Synthetic
caagucctgtuccccagcaa

SEQ ID NO: 63581 - DNA, 20 bp, Artificial Sequence
  Synthetic
tgatgggcuaaccgtgtgug

SEQ ID NO: 63582 - DNA, 21 bp, Artificial Sequence
  Synthetic
gcccutgtacatgucgacgat

SEQ ID NO: 63583 - DNA, 22 bp, Artificial Sequence
  Synthetic
gaggaggtcuggaagtaagcug

SEQ ID NO: 63584 - DNA, 21 bp, Artificial Sequence
  Synthetic
ccatctuacccagcatgccut

SEQ ID NO: 63585 - DNA, 22 bp, Artificial Sequence
  Synthetic
ggcttcctugacctcccauaac

SEQ ID NO: 63586 - DNA, 21 bp, Artificial Sequence
  Synthetic
ggagtctcugtgctgcgaaut

SEQ ID NO: 63587 - DNA, 20 bp, Artificial Sequence
  Synthetic
gttcatgcgcugtgttccut

SEQ ID NO: 63588 - DNA, 17 bp, Artificial Sequence
  Synthetic
ggcgcugcatugagggt

SEQ ID NO: 63589 - DNA, 19 bp, Artificial Sequence
  Synthetic
tgcttuccccgctgctuag

SEQ ID NO: 63590 - DNA, 21 bp, Artificial Sequence
  Synthetic
gcaagaagcagcaacugtcut

SEQ ID NO: 63591 - DNA, 24 bp, Artificial Sequence
  Synthetic
gatatcaccucacctgcttctcut

SEQ ID NO: 63592 - DNA, 21 bp, Artificial Sequence
  Synthetic
gggugtgaaaugagcagagga

SEQ ID NO: 63593 - DNA, 25 bp, Artificial Sequence
  Synthetic
cggacatgtuaaccttgactttgug

SEQ ID NO: 63594 - DNA, 24 bp, Artificial Sequence
  Synthetic
ctcctcagcaaautctgagucagt

SEQ ID NO: 63595 - DNA, 22 bp, Artificial Sequence
  Synthetic
gaccacaacauagccgacuaca

SEQ ID NO: 63596 - DNA, 21 bp, Artificial Sequence
  Synthetic
tgtacguggcatcggatugaa

SEQ ID NO: 63597 - DNA, 21 bp, Artificial Sequence
  Synthetic
ggcttcugaaggagacuccca

SEQ ID NO: 63598 - DNA, 21 bp, Artificial Sequence
  Synthetic
cggaagguctgtgtgugacaa

SEQ ID NO: 63599 - DNA, 19 bp, Artificial Sequence
  Synthetic
caaggcugcggtgactuac

SEQ ID NO: 63600 - DNA, 21 bp, Artificial Sequence
  Synthetic
cacatcucagcacgggcauat

SEQ ID NO: 63601 - DNA, 21 bp, Artificial Sequence
  Synthetic
ctacccccacccaautctcug

SEQ ID NO: 63602 - DNA, 22 bp, Artificial Sequence
  Synthetic
ttcctgggcutccttuggaaat

SEQ ID NO: 63603 - DNA, 19 bp, Artificial Sequence
  Synthetic
ctcccgggcuttggaagut

SEQ ID NO: 63604 - DNA, 28 bp, Artificial Sequence
  Synthetic
ctgagacctcacuatcagtacccatuat

SEQ ID NO: 63605 - DNA, 21 bp, Artificial Sequence
  Synthetic
gggtuggaggaggagatctut

SEQ ID NO: 63606 - DNA, 22 bp, Artificial Sequence
  Synthetic
gaaggctaugagagtgccauga

SEQ ID NO: 63607 - DNA, 22 bp, Artificial Sequence
  Synthetic
ctgtacacaaaagugggcaucc

SEQ ID NO: 63608 - DNA, 22 bp, Artificial Sequence
  Synthetic
ctctgtgcucacagggatctug

SEQ ID NO: 63609 - DNA, 26 bp, Artificial Sequence
  Synthetic
ccatgggcttuttattgctgcttuaa

SEQ ID NO: 63610 - DNA, 19 bp, Artificial Sequence
  Synthetic
cctugaccccgaggcauac

SEQ ID NO: 63611 - DNA, 20 bp, Artificial Sequence
  Synthetic
gaacucaagucaggcaggca

SEQ ID NO: 63612 - DNA, 27 bp, Artificial Sequence
  Synthetic
aaagaatgggtuggagttctcttucaa

SEQ ID NO: 63613 - DNA, 22 bp, Artificial Sequence
  Synthetic
tgacaccaagugcaaggaauct

SEQ ID NO: 63614 - DNA, 21 bp, Artificial Sequence
  Synthetic
agccagccccguauaagagaa

SEQ ID NO: 63615 - DNA, 23 bp, Artificial Sequence
  Synthetic
gtgaggtcuccagtgtuaaaggg

SEQ ID NO: 63616 - DNA, 21 bp, Artificial Sequence
  Synthetic
ctggttuccagacctccucaa

SEQ ID NO: 63617 - DNA, 28 bp, Artificial Sequence
  Synthetic
ggactcctaaacucttctctgttctuct

SEQ ID NO: 63618 - DNA, 19 bp, Artificial Sequence
  Synthetic
gcccgtcugaatcgcucat

SEQ ID NO: 63619 - DNA, 21 bp, Artificial Sequence
  Synthetic
tgatgtttccugcgaggtcug

SEQ ID NO: 63620 - DNA, 26 bp, Artificial Sequence
  Synthetic
ggtctttguttttctctaguccgcat

SEQ ID NO: 63621 - DNA, 27 bp, Artificial Sequence
  Synthetic
aggaggtgagautcaaaattcgtgaut

SEQ ID NO: 63622 - DNA, 28 bp, Artificial Sequence
  Synthetic
gctctagacuaagttgctttcaagugat

SEQ ID NO: 63623 - DNA, 28 bp, Artificial Sequence
  Synthetic
gagcgactctugaaagattatcaaagug

SEQ ID NO: 63624 - DNA, 22 bp, Artificial Sequence
  Synthetic
ccuccagcagagaagcaatuct

SEQ ID NO: 63625 - DNA, 28 bp, Artificial Sequence
  Synthetic
cagatccttaacautggtccgtattuga

SEQ ID NO: 63626 - DNA, 25 bp, Artificial Sequence
  Synthetic
aagacgaccutttgataagauggca

SEQ ID NO: 63627 - DNA, 21 bp, Artificial Sequence
  Synthetic
tggtggcaaacuctccttcuc

SEQ ID NO: 63628 - DNA, 33 bp, Artificial Sequence
  Synthetic
aaatagttgatcauactttgtaacagaaucaca

SEQ ID NO: 63629 - DNA, 28 bp, Artificial Sequence
  Synthetic
ggtacaagtuaaggcacacagaagatua

SEQ ID NO: 63630 - DNA, 20 bp, Artificial Sequence
  Synthetic
gcacgcuacatgctgaugct

SEQ ID NO: 63631 - DNA, 27 bp, Artificial Sequence
  Synthetic
gaactgguaaacacaaattccttucct

SEQ ID NO: 63632 - DNA, 28 bp, Artificial Sequence
  Synthetic
tgcacatttaacagguactatgctctut

SEQ ID NO: 63633 - DNA, 28 bp, Artificial Sequence
  Synthetic
cttcgaacttctucagacactgtaagua

SEQ ID NO: 63634 - DNA, 26 bp, Artificial Sequence
  Synthetic
gttaggtgaagugattatccaggugt

SEQ ID NO: 63635 - DNA, 28 bp, Artificial Sequence
  Synthetic
ggatcttcggaucagtaagtacttctuc

SEQ ID NO: 63636 - DNA, 22 bp, Artificial Sequence
  Synthetic
tccacaatcucctccatccuca

SEQ ID NO: 63637 - DNA, 24 bp, Artificial Sequence
  Synthetic
gccaatuccaagaacctgugaagt

SEQ ID NO: 63638 - DNA, 20 bp, Artificial Sequence
  Synthetic
gagcaaggaggagguggaug

SEQ ID NO: 63639 - DNA, 20 bp, Artificial Sequence
  Synthetic
tctgaggcugggatctcugt

SEQ ID NO: 63640 - DNA, 26 bp, Artificial Sequence
  Synthetic
ctgcttctcatugagttacaccctua

SEQ ID NO: 63641 - DNA, 20 bp, Artificial Sequence
  Synthetic
ccaacccucacctuccacag

SEQ ID NO: 63642 - DNA, 23 bp, Artificial Sequence
  Synthetic
catctcagcaaugtctccuccac

SEQ ID NO: 63643 - DNA, 21 bp, Artificial Sequence
  Synthetic
gggccgggucattattcttut

SEQ ID NO: 63644 - DNA, 23 bp, Artificial Sequence
  Synthetic
cacccuggagagagaugaagaag

SEQ ID NO: 63645 - DNA, 21 bp, Artificial Sequence
  Synthetic
ggcagaggcaugatggtctut

SEQ ID NO: 63646 - DNA, 24 bp, Artificial Sequence
  Synthetic
ggcatactccugcttggatttuca

SEQ ID NO: 63647 - DNA, 22 bp, Artificial Sequence
  Synthetic
gaagagtgugttcctccucgac

SEQ ID NO: 63648 - DNA, 21 bp, Artificial Sequence
  Synthetic
ccctggguacagacctcuaca

SEQ ID NO: 63649 - DNA, 19 bp, Artificial Sequence
  Synthetic
ctccgccutacccttcucc

SEQ ID NO: 63650 - DNA, 22 bp, Artificial Sequence
  Synthetic
ggguggcagagaaguaacaagt

SEQ ID NO: 63651 - DNA, 23 bp, Artificial Sequence
  Synthetic
cggaataacugcccauagggaat

SEQ ID NO: 63652 - DNA, 18 bp, Artificial Sequence
  Synthetic
gcagacggucccgtgtug

SEQ ID NO: 63653 - DNA, 21 bp, Artificial Sequence
  Synthetic
ctucccaaagacccacagugt

SEQ ID NO: 63654 - DNA, 20 bp, Artificial Sequence
  Synthetic
agcacccaagugcttcctut

SEQ ID NO: 63655 - DNA, 23 bp, Artificial Sequence
  Synthetic
ctaggucactcacuccaggaaga

SEQ ID NO: 63656 - DNA, 21 bp, Artificial Sequence
  Synthetic
ggcucagcagacuacaggact

SEQ ID NO: 63657 - DNA, 28 bp, Artificial Sequence
  Synthetic
gcaagaaauggcgttgttatugagaaat

SEQ ID NO: 63658 - DNA, 24 bp, Artificial Sequence
  Synthetic
gcaaaactctguccgacgtaguat

SEQ ID NO: 63659 - DNA, 27 bp, Artificial Sequence
  Synthetic
ccctattatgugtgagatcaugcagaa

SEQ ID NO: 63660 - DNA, 27 bp, Artificial Sequence
  Synthetic
gtgttcaattttgugtctgtacagugg

SEQ ID NO: 63661 - DNA, 22 bp, Artificial Sequence
  Synthetic
acacttcccuaggccccttuaa

SEQ ID NO: 63662 - DNA, 22 bp, Artificial Sequence
  Synthetic
ggauggaaggugggaagaacac

SEQ ID NO: 63663 - DNA, 26 bp, Artificial Sequence
  Synthetic
cccaccaccaauacataaaactcauc

SEQ ID NO: 63664 - DNA, 28 bp, Artificial Sequence
  Synthetic
agagattttaaagugttgttcccctugt

SEQ ID NO: 63665 - DNA, 22 bp, Artificial Sequence
  Synthetic
agcgatctcacucttccggaua

SEQ ID NO: 63666 - DNA, 21 bp, Artificial Sequence
  Synthetic
ggagagaacgutccccagaug

SEQ ID NO: 63667 - DNA, 20 bp, Artificial Sequence
  Synthetic
cagtggtgacuctcctcgug

SEQ ID NO: 63668 - DNA, 19 bp, Artificial Sequence
  Synthetic
ccucaaggaggcgcucaac

SEQ ID NO: 63669 - DNA, 19 bp, Artificial Sequence
  Synthetic
ggccgaaugcttgagggua

SEQ ID NO: 63670 - DNA, 19 bp, Artificial Sequence
  Synthetic
agtaccuagcgcucaccga

SEQ ID NO: 63671 - DNA, 22 bp, Artificial Sequence
  Synthetic
cctcctcugcctgtgtgttuag

SEQ ID NO: 63672 - DNA, 18 bp, Artificial Sequence
  Synthetic
ctcctgggcuacggcuac

SEQ ID NO: 63673 - DNA, 22 bp, Artificial Sequence
  Synthetic
ggctgagucaggtcagagauca

SEQ ID NO: 63674 - DNA, 21 bp, Artificial Sequence
  Synthetic
ctccccacaccaugtcttcuc

SEQ ID NO: 63675 - DNA, 22 bp, Artificial Sequence
  Synthetic
caccgtccccaauctcaatcuc

SEQ ID NO: 63676 - DNA, 23 bp, Artificial Sequence
  Synthetic
ccaacaguccagggaaaccaaut

SEQ ID NO: 63677 - DNA, 21 bp, Artificial Sequence
  Synthetic
cttgctgaggucgaagcucat

SEQ ID NO: 63678 - DNA, 22 bp, Artificial Sequence
  Synthetic
cctgatgguctcacctccauct

SEQ ID NO: 63679 - DNA, 20 bp, Artificial Sequence
  Synthetic
gggtacgucttgcagtcuct

SEQ ID NO: 63680 - DNA, 20 bp, Artificial Sequence
  Synthetic
cgtgacgucatcgaggacug

SEQ ID NO: 63681 - DNA, 22 bp, Artificial Sequence
  Synthetic
cgggacaaugcacaagatguag

SEQ ID NO: 63682 - DNA, 21 bp, Artificial Sequence
  Synthetic
ccagcctuccctaagacccut

SEQ ID NO: 63683 - DNA, 25 bp, Artificial Sequence
  Synthetic
ttctctccauaggaccagttgtuct

SEQ ID NO: 63684 - DNA, 20 bp, Artificial Sequence
  Synthetic
gggatgtgacugtcctgcua

SEQ ID NO: 63685 - DNA, 23 bp, Artificial Sequence
  Synthetic
cctccattcuccagactcuccag

SEQ ID NO: 63686 - DNA, 23 bp, Artificial Sequence
  Synthetic
ctcuagaaaccctcuccccaagt

SEQ ID NO: 63687 - DNA, 22 bp, Artificial Sequence
  Synthetic
tcttcaccucttttccgucagg

SEQ ID NO: 63688 - DNA, 22 bp, Artificial Sequence
  Synthetic
tccagaacuaccuacggacaca

SEQ ID NO: 63689 - DNA, 22 bp, Artificial Sequence
  Synthetic
cttgcccgaguagtaccaguag

SEQ ID NO: 63690 - DNA, 20 bp, Artificial Sequence
  Synthetic
gctcguggaatcctcaucca

SEQ ID NO: 63691 - DNA, 17 bp, Artificial Sequence
  Synthetic
gcccacacgauguccca

SEQ ID NO: 63692 - DNA, 25 bp, Artificial Sequence
  Synthetic
ctggtatatggugatgtccctctug

SEQ ID NO: 63693 - DNA, 22 bp, Artificial Sequence
  Synthetic
cttatccctucaccacccacug

SEQ ID NO: 63694 - DNA, 27 bp, Artificial Sequence
  Synthetic
aaataaggtaaggguggttctgactug

SEQ ID NO: 63695 - DNA, 26 bp, Artificial Sequence
  Synthetic
ctactgacuggccttatgtuaaaggg

SEQ ID NO: 63696 - DNA, 23 bp, Artificial Sequence
  Synthetic
agtgtgaaugagtgtgagugcat

SEQ ID NO: 63697 - DNA, 22 bp, Artificial Sequence
  Synthetic
ccautgtuccggcagaagaaga

SEQ ID NO: 63698 - DNA, 27 bp, Artificial Sequence
  Synthetic
gggttttcatuacacttctgcuaggat

SEQ ID NO: 63699 - DNA, 22 bp, Artificial Sequence
  Synthetic
cgtcugagaagagtaggtuggg

SEQ ID NO: 63700 - DNA, 21 bp, Artificial Sequence
  Synthetic
gcctgtgutcacatgctugac

SEQ ID NO: 63701 - DNA, 20 bp, Artificial Sequence
  Synthetic
ccuccacccgtttugaacct

SEQ ID NO: 63702 - DNA, 21 bp, Artificial Sequence
  Synthetic
cttcttccgcugctcgaaaug

SEQ ID NO: 63703 - DNA, 22 bp, Artificial Sequence
  Synthetic
aaacggtucagttcaccaucct

SEQ ID NO: 63704 - DNA, 20 bp, Artificial Sequence
  Synthetic
ccacucccagggtctuggat

SEQ ID NO: 63705 - DNA, 18 bp, Artificial Sequence
  Synthetic
gggtgcgguacgguaagg

SEQ ID NO: 63706 - DNA, 20 bp, Artificial Sequence
  Synthetic
ctttgtctucaccggcugga

SEQ ID NO: 63707 - DNA, 24 bp, Artificial Sequence
  Synthetic
ctgtgttcuggaatcagggaugag

SEQ ID NO: 63708 - DNA, 21 bp, Artificial Sequence
  Synthetic
ccacucaaaucccagggagag

SEQ ID NO: 63709 - DNA, 26 bp, Artificial Sequence
  Synthetic
ctgaaaggtccutcgtgaactcauag

SEQ ID NO: 63710 - DNA, 24 bp, Artificial Sequence
  Synthetic
ggattgtcaaagcugcagaagaug

SEQ ID NO: 63711 - DNA, 25 bp, Artificial Sequence
  Synthetic
agcagtgttutgcacaaactugaaa

SEQ ID NO: 63712 - DNA, 21 bp, Artificial Sequence
  Synthetic
gcacactucccttcagucaca

SEQ ID NO: 63713 - DNA, 25 bp, Artificial Sequence
  Synthetic
ccttttcatgcuaaatgtggtuccc

SEQ ID NO: 63714 - DNA, 27 bp, Artificial Sequence
  Synthetic
agatttttgcauaacagcagactcuga

SEQ ID NO: 63715 - DNA, 20 bp, Artificial Sequence
  Synthetic
autctgctgaugcggaggag

SEQ ID NO: 63716 - DNA, 23 bp, Artificial Sequence
  Synthetic
gttgggutgttctauggccagat

SEQ ID NO: 63717 - DNA, 23 bp, Artificial Sequence
  Synthetic
ctcatggtacugggattctucgg

SEQ ID NO: 63718 - DNA, 18 bp, Artificial Sequence
  Synthetic
cattgcugacgccccuct

SEQ ID NO: 63719 - DNA, 19 bp, Artificial Sequence
  Synthetic
gggcctcucctgtggtcua

SEQ ID NO: 63720 - DNA, 23 bp, Artificial Sequence
  Synthetic
cggtgagccacutcttttctcug

SEQ ID NO: 63721 - DNA, 22 bp, Artificial Sequence
  Synthetic
ctccccaguaggactcugacaa

SEQ ID NO: 63722 - DNA, 22 bp, Artificial Sequence
  Synthetic
ggtgcuggagcgaatcaagtua

SEQ ID NO: 63723 - DNA, 28 bp, Artificial Sequence
  Synthetic
agaaagtttcaagaucttctgtcugagg

SEQ ID NO: 63724 - DNA, 17 bp, Artificial Sequence
  Synthetic
cgggugcggcttcugaa

SEQ ID NO: 63725 - DNA, 18 bp, Artificial Sequence
  Synthetic
ccugcagcccacagauga

SEQ ID NO: 63726 - DNA, 26 bp, Artificial Sequence
  Synthetic
tttcttggcagutctaatacccgaut

SEQ ID NO: 63727 - DNA, 26 bp, Artificial Sequence
  Synthetic
caaagagggtugctcattattcugga

SEQ ID NO: 63728 - DNA, 28 bp, Artificial Sequence
  Synthetic
gaactaaagggaaacauccagatcacut

SEQ ID NO: 63729 - DNA, 24 bp, Artificial Sequence
  Synthetic
gggttgggauagaatggaatggug

SEQ ID NO: 63730 - DNA, 18 bp, Artificial Sequence
  Synthetic
cccauagccgaggtcguc

SEQ ID NO: 63731 - DNA, 19 bp, Artificial Sequence
  Synthetic
gggtcugcggtaucggaaa

SEQ ID NO: 63732 - DNA, 23 bp, Artificial Sequence
  Synthetic
ggtgtcugcaacactgcaaaaua

SEQ ID NO: 63733 - DNA, 19 bp, Artificial Sequence
  Synthetic
gaugcaggctctucccgat

SEQ ID NO: 63734 - DNA, 28 bp, Artificial Sequence
  Synthetic
tggtaaagttaaugtgaaaggaucgaca

SEQ ID NO: 63735 - DNA, 23 bp, Artificial Sequence
  Synthetic
gttttggtaacutcctgctugct

SEQ ID NO: 63736 - DNA, 21 bp, Artificial Sequence
  Synthetic
gggcccugaagcaaagaagua

SEQ ID NO: 63737 - DNA, 27 bp, Artificial Sequence
  Synthetic
ggcagagaaaaauagatgagaccctug

SEQ ID NO: 63738 - DNA, 21 bp, Artificial Sequence
  Synthetic
gtccacgucaatggcaaaugt

SEQ ID NO: 63739 - DNA, 28 bp, Artificial Sequence
  Synthetic
ctgtgaagttaauctgcactataugggt

SEQ ID NO: 63740 - DNA, 27 bp, Artificial Sequence
  Synthetic
cactatgccucacatatgaccatguat

SEQ ID NO: 63741 - DNA, 27 bp, Artificial Sequence
  Synthetic
gaaagtgaaacuccttactgagtcugt

SEQ ID NO: 63742 - DNA, 24 bp, Artificial Sequence
  Synthetic
tcacagauaacaaagcacggagut

SEQ ID NO: 63743 - DNA, 25 bp, Artificial Sequence
  Synthetic
tgcagagtccugaatttgcaatcut

SEQ ID NO: 63744 - DNA, 30 bp, Artificial Sequence; identical to SEQ ID NO: 31726
  Synthetic

SEQ ID NO: 63745 - DNA, 28 bp, Artificial Sequence
  Synthetic
aattctttaatgtcutgcagtgccttut

SEQ ID NO: 63746 - DNA, 23 bp, Artificial Sequence
  Synthetic
catttgtutcacacgucaagggt

SEQ ID NO: 63747 - DNA, 27 bp, Artificial Sequence
  Synthetic
ctaggcattuggtctcttacctucaaa

SEQ ID NO: 63748 - DNA, 27 bp, Artificial Sequence
  Synthetic
catttccctgugtgttagtaacugact

SEQ ID NO: 63749 - DNA, 22 bp, Artificial Sequence
  Synthetic
gaaguaucaggagacaggcgaa

SEQ ID NO: 63750 - DNA, 25 bp, Artificial Sequence
  Synthetic
cacauttatccugagagcagacaga

SEQ ID NO: 63751 - DNA, 22 bp, Artificial Sequence
  Synthetic
ggcctttcugcttgttttcucc

SEQ ID NO: 63752 - DNA, 21 bp, Artificial Sequence
  Synthetic
tcccugcccagcuaacaaaag

SEQ ID NO: 63753 - DNA, 22 bp, Artificial Sequence
  Synthetic
actttcccauctcctcuccaca

SEQ ID NO: 63754 - DNA, 25 bp, Artificial Sequence
  Synthetic
ctcattcattaautctggccccuca

SEQ ID NO: 63755 - DNA, 25 bp, Artificial Sequence
  Synthetic
tggaagtutagtggaguccaagaga

SEQ ID NO: 63756 - DNA, 26 bp, Artificial Sequence
  Synthetic
cagccaguagaaggatattcuaagca

SEQ ID NO: 63757 - DNA, 27 bp, Artificial Sequence
  Synthetic
cggtagtatucagccatcttctguaac

SEQ ID NO: 63758 - DNA, 25 bp, Artificial Sequence
  Synthetic
attcaatgtugcaggagaucaggaa

SEQ ID NO: 63759 - DNA, 21 bp, Artificial Sequence
  Synthetic
acacatggagcugaacgugag

SEQ ID NO: 63760 - DNA, 24 bp, Artificial Sequence
  Synthetic
tcatgggttuagaaccctcctcut

SEQ ID NO: 63761 - DNA, 22 bp, Artificial Sequence
  Synthetic
ccctgagugtccttgugaagat

SEQ ID NO: 63762 - DNA, 21 bp, Artificial Sequence
  Synthetic
ctgtuaagggccccatgtcut

SEQ ID NO: 63763 - DNA, 28 bp, Artificial Sequence
  Synthetic
catgttctcaaugttctttcccattuct

SEQ ID NO: 63764 - DNA, 26 bp, Artificial Sequence
  Synthetic
tgcagtctatugagggtgtcatauca

SEQ ID NO: 63765 - DNA, 28 bp, Artificial Sequence
  Synthetic
aagcagcaaaauggaaguaaaagaacat

SEQ ID NO: 63766 - DNA, 18 bp, Artificial Sequence
  Synthetic
cttguggccctgauggct

SEQ ID NO: 63767 - DNA, 28 bp, Artificial Sequence
  Synthetic
ccatctccttcaucagcattttctauca

SEQ ID NO: 63768 - DNA, 24 bp, Artificial Sequence
  Synthetic
gutctgatgacuggagacaacagt

SEQ ID NO: 63769 - DNA, 28 bp, Artificial Sequence
  Synthetic
ggaaccagauaggactactcagtgauaa

SEQ ID NO: 63770 - DNA, 20 bp, Artificial Sequence
  Synthetic
gcagaggcacgccuaactua

SEQ ID NO: 63771 - DNA, 23 bp, Artificial Sequence
  Synthetic
agagatgugcaaggatgtctgug

SEQ ID NO: 63772 - DNA, 22 bp, Artificial Sequence
  Synthetic
ccctugggagagtgauggaaac

SEQ ID NO: 63773 - DNA, 27 bp, Artificial Sequence
  Synthetic
tcagatgtgauctctctcttcttucct

SEQ ID NO: 63774 - DNA, 27 bp, Artificial Sequence
  Synthetic
accattgattuactcttgcttucaggt

SEQ ID NO: 63775 - DNA, 28 bp, Artificial Sequence
  Synthetic
ccatcggtgtugaagttactttgaaaua

SEQ ID NO: 63776 - DNA, 26 bp, Artificial Sequence
  Synthetic
gagaaaaagguaguaaaggagagcct

SEQ ID NO: 63777 - DNA, 25 bp, Artificial Sequence
  Synthetic
gatgcatttaagugcctttgtuggt

SEQ ID NO: 63778 - DNA, 21 bp, Artificial Sequence
  Synthetic
ggucaaccaggcttuggaaac

SEQ ID NO: 63779 - DNA, 28 bp, Artificial Sequence
  Synthetic
taacgttaacacuaggtttgagtttuct

SEQ ID NO: 63780 - DNA, 24 bp, Artificial Sequence
  Synthetic
gtcctccauaaatgaagucagcgt

SEQ ID NO: 63781 - DNA, 26 bp, Artificial Sequence
  Synthetic
tctactaagctguctgtgtcctttug

SEQ ID NO: 63782 - DNA, 24 bp, Artificial Sequence
  Synthetic
tggcttcugtgatatcagugagga

SEQ ID NO: 63783 - DNA, 24 bp, Artificial Sequence
  Synthetic
cccaactgguctgtcaacguaaaa

SEQ ID NO: 63784 - DNA, 29 bp, Artificial Sequence
  Synthetic
tgctaatcgctacutctgttcatacatut

SEQ ID NO: 63785 - DNA, 28 bp, Artificial Sequence
  Synthetic
caatctcatcucccatctaggaaagtuc

SEQ ID NO: 63786 - DNA, 22 bp, Artificial Sequence
  Synthetic
aagaggaacugctttgggacug

SEQ ID NO: 63787 - DNA, 25 bp, Artificial Sequence
  Synthetic
tccttcttucaccaatgtgtccaut

SEQ ID NO: 63788 - DNA, 27 bp, Artificial Sequence
  Synthetic
gaagaatctcatuggttgtccagttug

SEQ ID NO: 63789 - DNA, 33 bp, Artificial Sequence
  Synthetic
aggtaagcaaattauaaagcaacataaaacugt

SEQ ID NO: 63790 - DNA, 24 bp, Artificial Sequence
  Synthetic
gacagacugggagttaggagguaa

SEQ ID NO: 63791 - DNA, 20 bp, Artificial Sequence
  Synthetic
tgatccugagcaacgugcag

SEQ ID NO: 63792 - DNA, 21 bp, Artificial Sequence
  Synthetic
caggugagagaagcacauggt

SEQ ID NO: 63793 - DNA, 25 bp, Artificial Sequence
  Synthetic
agtatttctctccautccctcccut

SEQ ID NO: 63794 - DNA, 21 bp, Artificial Sequence
  Synthetic
gctcccuggacctgtcctaut

SEQ ID NO: 63795 - DNA, 27 bp, Artificial Sequence
  Synthetic
gaaguggtaaaugaagaagaggacgat

SEQ ID NO: 63796 - DNA, 18 bp, Artificial Sequence
  Synthetic
cgtcgucatgggctuggt

SEQ ID NO: 63797 - DNA, 18 bp, Artificial Sequence
  Synthetic
ctcguacagcaccuccct

SEQ ID NO: 63798 - DNA, 18 bp, Artificial Sequence
  Synthetic
ggtgggugggtccuagca

SEQ ID NO: 63799 - DNA, 18 bp, Artificial Sequence
  Synthetic
cgagucgcccggagtuag

SEQ ID NO: 63800 - DNA, 17 bp, Artificial Sequence
  Synthetic
accutgctgcugcacca

SEQ ID NO: 63801 - DNA, 21 bp, Artificial Sequence
  Synthetic
ggcactucacaaggacctgua

SEQ ID NO: 63802 - DNA, 21 bp, Artificial Sequence
  Synthetic
ggutcctgcctugacacagat

SEQ ID NO: 63803 - DNA, 20 bp, Artificial Sequence
  Synthetic
cctccagcggcuacatgtug

SEQ ID NO: 63804 - DNA, 27 bp, Artificial Sequence
  Synthetic
gggtagtcctaauactgcctatcauca

SEQ ID NO: 63805 - DNA, 20 bp, Artificial Sequence
  Synthetic
ggagcccacauggcactuag

SEQ ID NO: 63806 - DNA, 23 bp, Artificial Sequence
  Synthetic
ggctgcucactgacattuacaga

SEQ ID NO: 63807 - DNA, 20 bp, Artificial Sequence
  Synthetic
ggagcugacccttgaggaug

SEQ ID NO: 63808 - DNA, 23 bp, Artificial Sequence
  Synthetic
ggagtacctagugctctgaggug

SEQ ID NO: 63809 - DNA, 25 bp, Artificial Sequence
  Synthetic
tctgagcttctutcctttgcttcut

SEQ ID NO: 63810 - DNA, 27 bp, Artificial Sequence
  Synthetic
ttccauaaagcttctuacacaggaaca

SEQ ID NO: 63811 - DNA, 24 bp, Artificial Sequence
  Synthetic
gatcctaaatugcagcaaggcuac

SEQ ID NO: 63812 - DNA, 23 bp, Artificial Sequence
  Synthetic
ccacaggaautcgtgatgaucgt

SEQ ID NO: 63813 - DNA, 22 bp, Artificial Sequence
  Synthetic
gagtcgggautgggaguaaagg

SEQ ID NO: 63814 - DNA, 25 bp, Artificial Sequence
  Synthetic
ctattggacacuctactggtggtut

SEQ ID NO: 63815 - DNA, 17 bp, Artificial Sequence
  Synthetic
ctcgccucaggccucag

SEQ ID NO: 63816 - DNA, 22 bp, Artificial Sequence
  Synthetic
gggctctcuctaaagacaugga

SEQ ID NO: 63817 - DNA, 21 bp, Artificial Sequence
  Synthetic
gcctatcugcaggacatggut

SEQ ID NO: 63818 - DNA, 21 bp, Artificial Sequence
  Synthetic
gccuggagctttugcaaggat

SEQ ID NO: 63819 - DNA, 25 bp, Artificial Sequence
  Synthetic
gtggauagaagacactctgtaugcc

SEQ ID NO: 63820 - DNA, 26 bp, Artificial Sequence
  Synthetic
tcaauattgcaaaacauggcaggaac

SEQ ID NO: 63821 - DNA, 23 bp, Artificial Sequence
  Synthetic
ggttgcucaggagattcctucaa

SEQ ID NO: 63822 - DNA, 29 bp, Artificial Sequence
  Synthetic
gctatgttttucaaaggctgattactuct

SEQ ID NO: 63823 - DNA, 23 bp, Artificial Sequence
  Synthetic
gtgacaagggugaagauggagat

SEQ ID NO: 63824 - DNA, 28 bp, Artificial Sequence
  Synthetic
tcacagcaugagagtaaugaaagaagag

SEQ ID NO: 63825 - DNA, 32 bp, Artificial Sequence
  Synthetic
tcagatatctccucctattggtattcaatuca

SEQ ID NO: 63826 - DNA, 28 bp, Artificial Sequence
  Synthetic
agcaatatctuggagtacaauaaacgca

SEQ ID NO: 63827 - DNA, 21 bp, Artificial Sequence
  Synthetic
ctcctggugagcaaggtctuc

SEQ ID NO: 63828 - DNA, 23 bp, Artificial Sequence
  Synthetic
tttccagagugaacugacacagg

SEQ ID NO: 63829 - DNA, 23 bp, Artificial Sequence
  Synthetic
cgcttaatcaugctgttggcaut

SEQ ID NO: 63830 - DNA, 23 bp, Artificial Sequence
  Synthetic
ccctgaattuccaaatgctgcut

SEQ ID NO: 63831 - DNA, 21 bp, Artificial Sequence
  Synthetic
ctgatggtcuacctggtccuc

SEQ ID NO: 63832 - DNA, 24 bp, Artificial Sequence
  Synthetic
cttggctgagguttcaatgaaugg

SEQ ID NO: 63833 - DNA, 28 bp, Artificial Sequence
  Synthetic
acccagcctaaucttgtttttcttaugt

SEQ ID NO: 63834 - DNA, 22 bp, Artificial Sequence
  Synthetic
ggaatggugctctaggaaucca

SEQ ID NO: 63835 - DNA, 18 bp, Artificial Sequence
  Synthetic
aggtccuacccucgccaa

SEQ ID NO: 63836 - DNA, 22 bp, Artificial Sequence
  Synthetic
tctgataaggcccugacctuca

SEQ ID NO: 63837 - DNA, 21 bp, Artificial Sequence
  Synthetic
gggatgucccggaactcttua

SEQ ID NO: 63838 - DNA, 25 bp, Artificial Sequence
  Synthetic
agactgucatttacctugccaaagt

SEQ ID NO: 63839 - DNA, 21 bp, Artificial Sequence
  Synthetic
ctccttctgguccagtgagug

SEQ ID NO: 63840 - DNA, 26 bp, Artificial Sequence
  Synthetic
actgtatcugccaaaaccatttgcua

SEQ ID NO: 63841 - DNA, 26 bp, Artificial Sequence
  Synthetic
ctcttttgguaggttgggauacacat

SEQ ID NO: 63842 - DNA, 21 bp, Artificial Sequence
  Synthetic
cgaggagcagauctttgguga

SEQ ID NO: 63843 - DNA, 21 bp, Artificial Sequence
  Synthetic
ctcaggcugctgtcctatuct

SEQ ID NO: 63844 - DNA, 21 bp, Artificial Sequence
  Synthetic
ccccaucccacctatgctcua

SEQ ID NO: 63845 - DNA, 24 bp, Artificial Sequence
  Synthetic
ctgatgctgacuattcctctcucc

SEQ ID NO: 63846 - DNA, 27 bp, Artificial Sequence
  Synthetic
ccaagacattttaauggtgagcatcug

SEQ ID NO: 63847 - DNA, 20 bp, Artificial Sequence
  Synthetic
tccugaacggccaacugaag

SEQ ID NO: 63848 - DNA, 26 bp, Artificial Sequence
  Synthetic
ctcccacaccggaaautttataaugg

SEQ ID NO: 63849 - DNA, 28 bp, Artificial Sequence
  Synthetic
aagccaaacacagaguattggatcttua

SEQ ID NO: 63850 - DNA, 26 bp, Artificial Sequence
  Synthetic
tccuaagtcugcaaaggagagagaat

SEQ ID NO: 63851 - DNA, 27 bp, Artificial Sequence
  Synthetic
gaggtttatugacaagacttctgcuct

SEQ ID NO: 63852 - DNA, 27 bp, Artificial Sequence
  Synthetic
agttcactuaccattcggatatucagg

SEQ ID NO: 63853 - DNA, 26 bp, Artificial Sequence
  Synthetic
actttugggaccaagagtgaaaugag

SEQ ID NO: 63854 - DNA, 28 bp, Artificial Sequence
  Synthetic
agagatgtgacugtaaacttttgcgtua

SEQ ID NO: 63855 - DNA, 27 bp, Artificial Sequence
  Synthetic
gtgccagaauggattctacaatcuaca

SEQ ID NO: 63856 - DNA, 23 bp, Artificial Sequence
  Synthetic
caggccuacctcatcatgaucag

SEQ ID NO: 63857 - DNA, 21 bp, Artificial Sequence
  Synthetic
cctcugcagaaagggaugcaa

SEQ ID NO: 63858 - DNA, 23 bp, Artificial Sequence
  Synthetic
gcatcaagaggucactgtctcua

SEQ ID NO: 63859 - DNA, 22 bp, Artificial Sequence
  Synthetic
gctattaggucagtguggcaga

SEQ ID NO: 63860 - DNA, 21 bp, Artificial Sequence
  Synthetic
gctggccuctaacccttgtug

SEQ ID NO: 63861 - DNA, 22 bp, Artificial Sequence
  Synthetic
ttaucgcaaggcttgugaacag

SEQ ID NO: 63862 - DNA, 25 bp, Artificial Sequence
  Synthetic
tcagagggcugaattttucaaggaa

SEQ ID NO: 63863 - DNA, 21 bp, Artificial Sequence
  Synthetic
agccauaggcctgtgtcuaca

SEQ ID NO: 63864 - DNA, 21 bp, Artificial Sequence
  Synthetic
ggagcaggaggaccuttcuga

SEQ ID NO: 63865 - DNA, 23 bp, Artificial Sequence
  Synthetic
aggctuacggactctauaggcaa

SEQ ID NO: 63866 - DNA, 27 bp, Artificial Sequence
  Synthetic
gggaaaatguggcttctgataaaauac

SEQ ID NO: 63867 - DNA, 25 bp, Artificial Sequence
  Synthetic
acagcttcauaacaaggagcauacc

SEQ ID NO: 63868 - DNA, 26 bp, Artificial Sequence
  Synthetic
ctcctacugttgtgttgauagaaggg

SEQ ID NO: 63869 - DNA, 23 bp, Artificial Sequence
  Synthetic
tcagtgtgaacaucatggtgugt

SEQ ID NO: 63870 - DNA, 25 bp, Artificial Sequence
  Synthetic
gtagtgttagucctttgtgccuaca

SEQ ID NO: 63871 - DNA, 22 bp, Artificial Sequence
  Synthetic
ccacccagacautagcaggtuc

SEQ ID NO: 63872 - DNA, 22 bp, Artificial Sequence
  Synthetic
aaautcagcaucaaacgcagca

SEQ ID NO: 63873 - DNA, 28 bp, Artificial Sequence
  Synthetic
ctccctagaagacugatatcatcacuga

SEQ ID NO: 63874 - DNA, 23 bp, Artificial Sequence
  Synthetic
ggcatcttucacaacgaggacut

SEQ ID NO: 63875 - DNA, 22 bp, Artificial Sequence
  Synthetic
tgcaattuaactggctcuggca

SEQ ID NO: 63876 - DNA, 33 bp, Artificial Sequence
  Synthetic
aataaagtaacuaagtggttaatcttuggacaa

SEQ ID NO: 63877 - DNA, 23 bp, Artificial Sequence
  Synthetic
gctgcatcauagaaggtcucagt

SEQ ID NO: 63878 - DNA, 28 bp, Artificial Sequence
  Synthetic
tggaaaaacagucatcaatggattcuga

SEQ ID NO: 63879 - DNA, 28 bp, Artificial Sequence
  Synthetic
gggcatgtatuagagaaagttcacttua

SEQ ID NO: 63880 - DNA, 27 bp, Artificial Sequence
  Synthetic
caactaatguggaagatgtttguccaa

SEQ ID NO: 63881 - DNA, 22 bp, Artificial Sequence
  Synthetic
ccaccaacgagacaugtagcug

SEQ ID NO: 63882 - DNA, 23 bp, Artificial Sequence
  Synthetic
aacaaaagtugaggcagctucac

SEQ ID NO: 63883 - DNA, 28 bp, Artificial Sequence
  Synthetic
tgagcctaaautattacggtatugcact

SEQ ID NO: 63884 - DNA, 27 bp, Artificial Sequence
  Synthetic
gcagagtaactuggataaagacgguat

SEQ ID NO: 63885 - DNA, 30 bp, Artificial Sequence
  Synthetic
ttacagcattcuttaaaacgacaaugacaa

SEQ ID NO: 63886 - DNA, 26 bp, Artificial Sequence
  Synthetic
ttgctgaataagugtaaaaccccuca

SEQ ID NO: 63887 - DNA, 28 bp, Artificial Sequence
  Synthetic
gtataatcatgtggguaactgcaggtua

SEQ ID NO: 63888 - DNA, 26 bp, Artificial Sequence
  Synthetic
ggtgatagtacucatggcccaaatug

SEQ ID NO: 63889 - DNA, 26 bp, Artificial Sequence
  Synthetic
ccttcucacaggacagagacauacat

SEQ ID NO: 63890 - DNA, 26 bp, Artificial Sequence
  Synthetic
catgttugcaacccattttcaugaac

SEQ ID NO: 63891 - DNA, 28 bp, Artificial Sequence
  Synthetic
ggtagtaagttucccattaccaagtuct

SEQ ID NO: 63892 - DNA, 20 bp, Artificial Sequence
  Synthetic
ccccagcucctgcaacttut

SEQ ID NO: 63893 - DNA, 19 bp, Artificial Sequence
  Synthetic
cugggacccaagggucaag

SEQ ID NO: 63894 - DNA, 23 bp, Artificial Sequence
  Synthetic
agaaaggtccaggugaggtaguc

SEQ ID NO: 63895 - DNA, 29 bp, Artificial Sequence
  Synthetic
attctttattacuccttctccctcuccaa

SEQ ID NO: 63896 - DNA, 22 bp, Artificial Sequence
  Synthetic
agacaaugacaggcttctuggg

SEQ ID NO: 63897 - DNA, 21 bp, Artificial Sequence
  Synthetic
catccagguaggacccacuct
